United States Patent 7,250,289 (METHODS OF GENETIC ANALYSIS OF MOUSE) - sequence listing, part 2

SEQ ID NO: 39450 - DNA, 25 bp, Mus musculus
aactgagtccaatacttgttccagg

SEQ ID NO: 39451 - DNA, 25 bp, Mus musculus
aactgagtccacatcctaactggga

SEQ ID NO: 39452 - DNA, 25 bp, Mus musculus
aactgagtccacttcctaactggga

SEQ ID NO: 39453 - DNA, 25 bp, Mus musculus
aactgagtctccagcattctggaaa

SEQ ID NO: 39454 - DNA, 25 bp, Mus musculus
aactgagtctcctgcattctggaaa

SEQ ID NO: 39455 - DNA, 25 bp, Mus musculus
aactgagtctgtcaaaacatgcccc

SEQ ID NO: 39456 - DNA, 25 bp, Mus musculus
aactgagtctgtgaaaacatgcccc

SEQ ID NO: 39457 - DNA, 25 bp, Mus musculus
aactgagtgatgcaccctcacttca

SEQ ID NO: 39458 - DNA, 25 bp, Mus musculus
aactgagtgatggaccctcacttca

SEQ ID NO: 39459 - DNA, 25 bp, Mus musculus
aactgagtgccacagggaagaagca

SEQ ID NO: 39460 - DNA, 25 bp, Mus musculus
aactgagtgccagagggaagaagca

SEQ ID NO: 39461 - DNA, 25 bp, Mus musculus
aactgagtgctcaccttacaggtgt

SEQ ID NO: 39462 - DNA, 25 bp, Mus musculus
aactgagtgctcatgggtgattctt

SEQ ID NO: 39463 - DNA, 25 bp, Mus musculus
aactgagtgctctccttacaggtgt

SEQ ID NO: 39464 - DNA, 25 bp, Mus musculus
aactgagtgctcttgggtgattctt

SEQ ID NO: 39465 - DNA, 25 bp, Mus musculus
aactgagtggatccagtttcctcac

SEQ ID NO: 39466 - DNA, 25 bp, Mus musculus
aactgagtggatgcagtttcctcac

SEQ ID NO: 39467 - DNA, 25 bp, Mus musculus
aactgagtgggcacaggtcctgtcc

SEQ ID NO: 39468 - DNA, 25 bp, Mus musculus
aactgagtgggctcaggtcctgtcc

SEQ ID NO: 39469 - DNA, 25 bp, Mus musculus
aactgagtgtaaaccacctgtccaa

SEQ ID NO: 39470 - DNA, 25 bp, Mus musculus
aactgagtgtaatccacctgtccaa

SEQ ID NO: 39471 - DNA, 25 bp, Mus musculus
aactgagttactcttgcagtagtaa

SEQ ID NO: 39472 - DNA, 25 bp, Mus musculus
aactgagttactgttgcagtagtaa

SEQ ID NO: 39473 - DNA, 25 bp, Mus musculus
aactgagttccgcagatgctggtct

SEQ ID NO: 39474 - DNA, 25 bp, Mus musculus
aactgagttccggagatgctggtct

SEQ ID NO: 39475 - DNA, 25 bp, Mus musculus
aactgagttcgtaaggcttggcaac

SEQ ID NO: 39476 - DNA, 25 bp, Mus musculus
aactgagttcgttaggcttggcaac

SEQ ID NO: 39477 - DNA, 25 bp, Mus musculus
aactgagttgccagagtatttgtaa

SEQ ID NO: 39478 - DNA, 25 bp, Mus musculus
aactgagttgcctgagtatttgtaa

SEQ ID NO: 39479 - DNA, 25 bp, Mus musculus
aactgagttggcatccctataccca

SEQ ID NO: 39480 - DNA, 25 bp, Mus musculus
aactgagttggcttccctataccca

SEQ ID NO: 39481 - DNA, 25 bp, Mus musculus
aactgagttgtgacctgctaagtcc

SEQ ID NO: 39482 - DNA, 25 bp, Mus musculus
aactgagttgtgtcctgctaagtcc

SEQ ID NO: 39483 - DNA, 25 bp, Mus musculus
aactgagtttccagaccctattgct

SEQ ID NO: 39484 - DNA, 25 bp, Mus musculus
aactgagtttcctgaccctattgct

SEQ ID NO: 39485 - DNA, 25 bp, Mus musculus
aactgagtttgtaccaatatgggaa

SEQ ID NO: 39486 - DNA, 25 bp, Mus musculus
aactgagtttgttccaatatgggaa

SEQ ID NO: 39487 - DNA, 25 bp, Mus musculus
aactgataaagcagtggaaaatgga

SEQ ID NO: 39488 - DNA, 25 bp, Mus musculus
aactgataaagctgtggaaaatgga

SEQ ID NO: 39489 - DNA, 25 bp, Mus musculus
aactgatacatcatctggacactta

SEQ ID NO: 39490 - DNA, 25 bp, Mus musculus
aactgatacatcttctggacactta

SEQ ID NO: 39491 - DNA, 25 bp, Mus musculus
aactgatacctaaagactgtgacta

SEQ ID NO: 39492 - DNA, 25 bp, Mus musculus
aactgatacctatagactgtgacta

SEQ ID NO: 39493 - DNA, 25 bp, Mus musculus
aactgatacgctaagtccactttgt

SEQ ID NO: 39494 - DNA, 25 bp, Mus musculus
aactgatacgcttagtccactttgt

SEQ ID NO: 39495 - DNA, 25 bp, Mus musculus
aactgataggcccacatttctggat

SEQ ID NO: 39496 - DNA, 25 bp, Mus musculus
aactgataggccgacatttctggat

SEQ ID NO: 39497 - DNA, 25 bp, Mus musculus
aactgatcaaatacctgaccttccc

SEQ ID NO: 39498 - DNA, 25 bp, Mus musculus
aactgatcaaattcctgaccttccc

SEQ ID NO: 39499 - DNA, 25 bp, Mus musculus
aactgatcacaccacagggctatga

SEQ ID NO: 39500 - DNA, 25 bp, Mus musculus
aactgatcacacgacagggctatga

SEQ ID NO: 39501 - DNA, 25 bp, Mus musculus
aactgatcaggaacatggtggcacg

SEQ ID NO: 39502 - DNA, 25 bp, Mus musculus
aactgatcaggatcatggtggcacg

SEQ ID NO: 39503 - DNA, 25 bp, Mus musculus
aactgatcagttattgtgtgtagaa

SEQ ID NO: 39504 - DNA, 25 bp, Mus musculus
aactgatcagtttttgtgtgtagaa

SEQ ID NO: 39505 - DNA, 25 bp, Mus musculus
aactgatcatctacttcggcacagc

SEQ ID NO: 39506 - DNA, 25 bp, Mus musculus
aactgatcatcttcttcggcacagc

SEQ ID NO: 39507 - DNA, 25 bp, Mus musculus
aactgatccctgaattgcctatgac

SEQ ID NO: 39508 - DNA, 25 bp, Mus musculus
aactgatccctgtattgcctatgac

SEQ ID NO: 39509 - DNA, 25 bp, Mus musculus
aactgatcggagagctaagattaga

SEQ ID NO: 39510 - DNA, 25 bp, Mus musculus
aactgatcggagtgctaagattaga

SEQ ID NO: 39511 - DNA, 25 bp, Mus musculus
aactgatctcatctgaattcggtga

SEQ ID NO: 39512 - DNA, 25 bp, Mus musculus
aactgatctcatgtgaattcggtga

SEQ ID NO: 39513 - DNA, 25 bp, Mus musculus
aactgatctggcctagggtgttgtc

SEQ ID NO: 39514 - DNA, 25 bp, Mus musculus
aactgatctggcgtagggtgttgtc

SEQ ID NO: 39515 - DNA, 25 bp, Mus musculus
aactgatctgttaccacatggagaa

SEQ ID NO: 39516 - DNA, 25 bp, Mus musculus
aactgatctgtttccacatggagaa

SEQ ID NO: 39517 - DNA, 25 bp, Mus musculus
aactgatgacttctgatgtcttttt

SEQ ID NO: 39518 - DNA, 25 bp, Mus musculus
aactgatgacttgtgatgtcttttt

SEQ ID NO: 39519 - DNA, 25 bp, Mus musculus
aactgatgatccatctcagaactgt

SEQ ID NO: 39520 - DNA, 25 bp, Mus musculus
aactgatgatccttctcagaactgt

SEQ ID NO: 39521 - DNA, 25 bp, Mus musculus
aactgatgcaacacccaactgacag

SEQ ID NO: 39522 - DNA, 25 bp, Mus musculus
aactgatgcaactcccaactgacag

SEQ ID NO: 39523 - DNA, 25 bp, Mus musculus
aactgatgcagaattgccccaccaa

SEQ ID NO: 39524 - DNA, 25 bp, Mus musculus
aactgatgcagatttgccccaccaa

SEQ ID NO: 39525 - DNA, 25 bp, Mus musculus
aactgatgcattacctaccagcagg

SEQ ID NO: 39526 - DNA, 25 bp, Mus musculus
aactgatgcatttcctaccagcagg

SEQ ID NO: 39527 - DNA, 25 bp, Mus musculus
aactgatgccctattagagtctgcc

SEQ ID NO: 39528 - DNA, 25 bp, Mus musculus
aactgatgcccttttagagtctgcc

SEQ ID NO: 39529 - DNA, 25 bp, Mus musculus
aactgatgctggatggaggcctcaa

SEQ ID NO: 39530 - DNA, 25 bp, Mus musculus
aactgatgctggttggaggcctcaa

SEQ ID NO: 39531 - DNA, 25 bp, Mus musculus
aactgatgctttaaggttggattga

SEQ ID NO: 39532 - DNA, 25 bp, Mus musculus
aactgatgcttttaggttggattga

SEQ ID NO: 39533 - DNA, 25 bp, Mus musculus
aactgatggagaccttcccatccta

SEQ ID NO: 39534 - DNA, 25 bp, Mus musculus
aactgatggagagcttcccatccta

SEQ ID NO: 39535 - DNA, 25 bp, Mus musculus
aactgatggccgctgtgaattcttg

SEQ ID NO: 39536 - DNA, 25 bp, Mus musculus
aactgatggccggtgtgaattcttg

SEQ ID NO: 39537 - DNA, 25 bp, Mus musculus
aactgatgggaaatgccgctgcctc

SEQ ID NO: 39538 - DNA, 25 bp, Mus musculus
aactgatgggaattgccgctgcctc

SEQ ID NO: 39539 - DNA, 25 bp, Mus musculus
aactgatgggtactgcttgtccctc

SEQ ID NO: 39540 - DNA, 25 bp, Mus musculus
aactgatgggtagtgcttgtccctc

SEQ ID NO: 39541 - DNA, 25 bp, Mus musculus
aactgatgggtgagccccacgtgat

SEQ ID NO: 39542 - DNA, 25 bp, Mus musculus
aactgatgggtgtgccccacgtgat

SEQ ID NO: 39543 - DNA, 25 bp, Mus musculus
aactgatgtaagaactactcttaag

SEQ ID NO: 39544 - DNA, 25 bp, Mus musculus
aactgatgtaagtactactcttaag

SEQ ID NO: 39545 - DNA, 25 bp, Mus musculus
aactgatgtcatacactggtttgtt

SEQ ID NO: 39546 - DNA, 25 bp, Mus musculus
aactgatgtcattcactggtttgtt

SEQ ID NO: 39547 - DNA, 25 bp, Mus musculus
aactgatgtcctaacatttcatttg

SEQ ID NO: 39548 - DNA, 25 bp, Mus musculus
aactgatgtccttacatttcatttg

SEQ ID NO: 39549 - DNA, 25 bp, Mus musculus
aactgatgtgcaccctgggaactac

SEQ ID NO: 39550 - DNA, 25 bp, Mus musculus
aactgatgtgcagcctgggaactac

SEQ ID NO: 39551 - DNA, 25 bp, Mus musculus
aactgatgtgcccttaacaccaggt

SEQ ID NO: 39552 - DNA, 25 bp, Mus musculus
aactgatgtgccgttaacaccaggt

SEQ ID NO: 39553 - DNA, 25 bp, Mus musculus
aactgatgtgtgacacccgtgggaa

SEQ ID NO: 39554 - DNA, 25 bp, Mus musculus
aactgatgtgtgtcacccgtgggaa

SEQ ID NO: 39555 - DNA, 25 bp, Mus musculus
aactgatgttgtcgtgtctgttccc

SEQ ID NO: 39556 - DNA, 25 bp, Mus musculus
aactgatgttgtggtgtctgttccc

SEQ ID NO: 39557 - DNA, 25 bp, Mus musculus
aactgatgtttgacttctctaagca

SEQ ID NO: 39558 - DNA, 25 bp, Mus musculus
aactgatgtttgtcttctctaagca

SEQ ID NO: 39559 - DNA, 25 bp, Mus musculus
aactgattactcatgttacggacaa

SEQ ID NO: 39560 - DNA, 25 bp, Mus musculus
aactgattactcttgttacggacaa

SEQ ID NO: 39561 - DNA, 25 bp, Mus musculus
aactgattccacacaaagatgtgct

SEQ ID NO: 39562 - DNA, 25 bp, Mus musculus
aactgattccactcaaagatgtgct

SEQ ID NO: 39563 - DNA, 25 bp, Mus musculus
aactgattcccgagtctattgcaga

SEQ ID NO: 39564 - DNA, 25 bp, Mus musculus
aactgattcccgtgtctattgcaga

SEQ ID NO: 39565 - DNA, 25 bp, Mus musculus
aactgattctttagacctggagcat

SEQ ID NO: 39566 - DNA, 25 bp, Mus musculus
aactgattcttttgacctggagcat

SEQ ID NO: 39567 - DNA, 25 bp, Mus musculus
aactgattgcagagagggcccggct

SEQ ID NO: 39568 - DNA, 25 bp, Mus musculus
aactgattgcagtgagggcccggct

SEQ ID NO: 39569 - DNA, 25 bp, Mus musculus
aactgattgcccaggactctaataa

SEQ ID NO: 39570 - DNA, 25 bp, Mus musculus
aactgattgccctggactctaataa

SEQ ID NO: 39571 - DNA, 25 bp, Mus musculus
aactgattgttactacaaaattgtg

SEQ ID NO: 39572 - DNA, 25 bp, Mus musculus
aactgattgttagtacaaaattgtg

SEQ ID NO: 39573 - DNA, 25 bp, Mus musculus
aactgatttctaaggctttcaaagc

SEQ ID NO: 39574 - DNA, 25 bp, Mus musculus
aactgatttctatggctttcaaagc

SEQ ID NO: 39575 - DNA, 25 bp, Mus musculus
aactgatttctcacaagctcaatat

SEQ ID NO: 39576 - DNA, 25 bp, Mus musculus
aactgatttctcatgccttccataa

SEQ ID NO: 39577 - DNA, 25 bp, Mus musculus
aactgatttctctcaagctcaatat

SEQ ID NO: 39578 - DNA, 25 bp, Mus musculus
aactgatttctcttgccttccataa

SEQ ID NO: 39579 - DNA, 25 bp, Mus musculus
aactgatttcttagtcctaactcat

SEQ ID NO: 39580 - DNA, 25 bp, Mus musculus
aactgatttcttcaatggtctcact

SEQ ID NO: 39581 - DNA, 25 bp, Mus musculus
aactgatttcttgaatggtctcact

SEQ ID NO: 39582 - DNA, 25 bp, Mus musculus
aactgatttctttgtcctaactcat

SEQ ID NO: 39583 - DNA, 25 bp, Mus musculus
aactgatttgagaggaaaacattgg

SEQ ID NO: 39584 - DNA, 25 bp, Mus musculus
aactgatttgagtggaaaacattgg

SEQ ID NO: 39585 - DNA, 25 bp, Mus musculus
aactgatttggcaatagctaagcaa

SEQ ID NO: 39586 - DNA, 25 bp, Mus musculus
aactgatttggctatagctaagcaa

SEQ ID NO: 39587 - DNA, 25 bp, Mus musculus
aactgcaaacagaaaccaggtgttt

SEQ ID NO: 39588 - DNA, 25 bp, Mus musculus
aactgcaaacagtaaccaggtgttt

SEQ ID NO: 39589 - DNA, 25 bp, Mus musculus
aactgcaaacctcagtctttcaggc

SEQ ID NO: 39590 - DNA, 25 bp, Mus musculus
aactgcaaacctgagtctttcaggc

SEQ ID NO: 39591 - DNA, 25 bp, Mus musculus
aactgcaaaggcagggtcttggaaa

SEQ ID NO: 39592 - DNA, 25 bp, Mus musculus
aactgcaaaggctgggtcttggaaa

SEQ ID NO: 39593 - DNA, 25 bp, Mus musculus
aactgcaaatctctgtttacttaaa

SEQ ID NO: 39594 - DNA, 25 bp, Mus musculus
aactgcaaatctgtgtttacttaaa

SEQ ID NO: 39595 - DNA, 25 bp, Mus musculus
aactgcaacatcaccttttgaaggc

SEQ ID NO: 39596 - DNA, 25 bp, Mus musculus
aactgcaacatcagggatgccatga

SEQ ID NO: 39597 - DNA, 25 bp, Mus musculus
aactgcaacatctccttttgaaggc

SEQ ID NO: 39598 - DNA, 25 bp, Mus musculus
aactgcaacatctgggatgccatga

SEQ ID NO: 39599 - DNA, 25 bp, Mus musculus
aactgcaacattattctttgtacat

SEQ ID NO: 39600 - DNA, 25 bp, Mus musculus
aactgcaacatttttctttgtacat

SEQ ID NO: 39601 - DNA, 25 bp, Mus musculus
aactgcaagaaacggcacgatgtga

SEQ ID NO: 39602 - DNA, 25 bp, Mus musculus
aactgcaagaaagggcacgatgtga

SEQ ID NO: 39603 - DNA, 25 bp, Mus musculus
aactgcaagtatctccgggtgaacc

SEQ ID NO: 39604 - DNA, 25 bp, Mus musculus
aactgcaagtatgtccgggtgaacc

SEQ ID NO: 39605 - DNA, 25 bp, Mus musculus
aactgcaagtgccaactgcctatcc

SEQ ID NO: 39606 - DNA, 25 bp, Mus musculus
aactgcaagtgcgaactgcctatcc

SEQ ID NO: 39607 - DNA, 25 bp, Mus musculus
aactgcaagtttcctgaccactgaa

SEQ ID NO: 39608 - DNA, 25 bp, Mus musculus
aactgcaagtttgctgaccactgaa

SEQ ID NO: 39609 - DNA, 25 bp, Mus musculus
aactgcaatcgactgcttcagggaa

SEQ ID NO: 39610 - DNA, 25 bp, Mus musculus
aactgcaatcgagtgcttcagggaa

SEQ ID NO: 39611 - DNA, 25 bp, Mus musculus
aactgcaatgagctgggtaaatact

SEQ ID NO: 39612 - DNA, 25 bp, Mus musculus
aactgcaatgaggtgggtaaatact

SEQ ID NO: 39613 - DNA, 25 bp, Mus musculus
aactgcaattccaaagcttctaacc

SEQ ID NO: 39614 - DNA, 25 bp, Mus musculus
aactgcaattcctaagcttctaacc

SEQ ID NO: 39615 - DNA, 25 bp, Mus musculus
aactgcacaatgactgttgccattt

SEQ ID NO: 39616 - DNA, 25 bp, Mus musculus
aactgcacaatgtctgttgccattt

SEQ ID NO: 39617 - DNA, 25 bp, Mus musculus
aactgcacatttatgatacttcact

SEQ ID NO: 39618 - DNA, 25 bp, Mus musculus
aactgcacatttttgatacttcact

SEQ ID NO: 39619 - DNA, 25 bp, Mus musculus
aactgcaccctgataatctcttatc

SEQ ID NO: 39620 - DNA, 25 bp, Mus musculus
aactgcaccctgttaatctcttatc

SEQ ID NO: 39621 - DNA, 25 bp, Mus musculus
aactgcacctagcttttgtgtacat

SEQ ID NO: 39622 - DNA, 25 bp, Mus musculus
aactgcacctaggttttgtgtacat

SEQ ID NO: 39623 - DNA, 25 bp, Mus musculus
aactgcaccttgcaagcatcgctgg

SEQ ID NO: 39624 - DNA, 25 bp, Mus musculus
aactgcaccttggaagcatcgctgg

SEQ ID NO: 39625 - DNA, 25 bp, Mus musculus
aactgcacgattctctctcctgatg

SEQ ID NO: 39626 - DNA, 25 bp, Mus musculus
aactgcacgattgtctctcctgatg

SEQ ID NO: 39627 - DNA, 25 bp, Mus musculus
aactgcacgcaactgaccgctactt

SEQ ID NO: 39628 - DNA, 25 bp, Mus musculus
aactgcacgcaagtgaccgctactt

SEQ ID NO: 39629 - DNA, 25 bp, Mus musculus
aactgcacgtggagttcatgtgaca

SEQ ID NO: 39630 - DNA, 25 bp, Mus musculus
aactgcacgtggtgttcatgtgaca

SEQ ID NO: 39631 - DNA, 25 bp, Mus musculus
aactgcactttcaatgacattttga

SEQ ID NO: 39632 - DNA, 25 bp, Mus musculus
aactgcactttctatgacattttga

SEQ ID NO: 39633 - DNA, 25 bp, Mus musculus
aactgcacttttaacacctgccaaa

SEQ ID NO: 39634 - DNA, 25 bp, Mus musculus
aactgcactttttacacctgccaaa

SEQ ID NO: 39635 - DNA, 25 bp, Mus musculus
aactgcagacctacaggtagctgga

SEQ ID NO: 39636 - DNA, 25 bp, Mus musculus
aactgcagaccttcaggtagctgga

SEQ ID NO: 39637 - DNA, 25 bp, Mus musculus
aactgcagacttctggatctcaaaa

SEQ ID NO: 39638 - DNA, 25 bp, Mus musculus
aactgcagacttgtggatctcaaaa

SEQ ID NO: 39639 - DNA, 25 bp, Mus musculus
aactgcagaggtccaactccagagt

SEQ ID NO: 39640 - DNA, 25 bp, Mus musculus
aactgcagaggtgcaactccagagt

SEQ ID NO: 39641 - DNA, 25 bp, Mus musculus
aactgcagatggctaacagctatca

SEQ ID NO: 39642 - DNA, 25 bp, Mus musculus
aactgcagatgggtaacagctatca

SEQ ID NO: 39643 - DNA, 25 bp, Mus musculus
aactgcagcaagacccttgctgtgc

SEQ ID NO: 39644 - DNA, 25 bp, Mus musculus
aactgcagcaagaccgtgagtccag

SEQ ID NO: 39645 - DNA, 25 bp, Mus musculus
aactgcagcaagtcccttgctgtgc

SEQ ID NO: 39646 - DNA, 25 bp, Mus musculus
aactgcagcaagtccgtgagtccag

SEQ ID NO: 39647 - DNA, 25 bp, Mus musculus
aactgcagcagaagatatctctgtg

SEQ ID NO: 39648 - DNA, 25 bp, Mus musculus
aactgcagcagatgatatctctgtg

SEQ ID NO: 39649 - DNA, 25 bp, Mus musculus
aactgcagccacctggctagaacca

SEQ ID NO: 39650 - DNA, 25 bp, Mus musculus
aactgcagccacgtggctagaacca

SEQ ID NO: 39651 - DNA, 25 bp, Mus musculus
aactgcagccgacaggccctggaaa

SEQ ID NO: 39652 - DNA, 25 bp, Mus musculus
aactgcagccgagaggccctggaaa

SEQ ID NO: 39653 - DNA, 25 bp, Mus musculus
aactgcagcctgagctagggccctg

SEQ ID NO: 39654 - DNA, 25 bp, Mus musculus
aactgcagcctgtgctagggccctg

SEQ ID NO: 39655 - DNA, 25 bp, Mus musculus
aactgcagcgctaacacatcagtct

SEQ ID NO: 39656 - DNA, 25 bp, Mus musculus
aactgcagcgcttacacatcagtct

SEQ ID NO: 39657 - DNA, 25 bp, Mus musculus
aactgcagctatcattcccattttt

SEQ ID NO: 39658 - DNA, 25 bp, Mus musculus
aactgcagctatgattcccattttt

SEQ ID NO: 39659 - DNA, 25 bp, Mus musculus
aactgcagctttcccgggttaagac

SEQ ID NO: 39660 - DNA, 25 bp, Mus musculus
aactgcagctttgccgggttaagac

SEQ ID NO: 39661 - DNA, 25 bp, Mus musculus
aactgcaggaaaatctaaaccacca

SEQ ID NO: 39662 - DNA, 25 bp, Mus musculus
aactgcaggaaattctaaaccacca

SEQ ID NO: 39663 - DNA, 25 bp, Mus musculus
aactgcaggaacagagcgagactct

SEQ ID NO: 39664 - DNA, 25 bp, Mus musculus
aactgcaggaactgagcgagactct

SEQ ID NO: 39665 - DNA, 25 bp, Mus musculus
aactgcaggagaagtttgcgcccac

SEQ ID NO: 39666 - DNA, 25 bp, Mus musculus
aactgcaggagacgtttgccctcac

SEQ ID NO: 39667 - DNA, 25 bp, Mus musculus
aactgcaggagaggtttgccctcac

SEQ ID NO: 39668 - DNA, 25 bp, Mus musculus
aactgcaggagatgtttgcgcccac

SEQ ID NO: 39669 - DNA, 25 bp, Mus musculus
aactgcaggcacaagtgcgcattgg

SEQ ID NO: 39670 - DNA, 25 bp, Mus musculus
aactgcaggcactagtgcgcattgg

SEQ ID NO: 39671 - DNA, 25 bp, Mus musculus
aactgcaggcatcagtacgtggtcc

SEQ ID NO: 39672 - DNA, 25 bp, Mus musculus
aactgcaggcatgagtacgtggtcc

SEQ ID NO: 39673 - DNA, 25 bp, Mus musculus
aactgcaggtgtctccatggccaag

SEQ ID NO: 39674 - DNA, 25 bp, Mus musculus
aactgcaggtgtgtccatggccaag

SEQ ID NO: 39675 - DNA, 25 bp, Mus musculus
aactgcagtatcaacacagcacttg

SEQ ID NO: 39676 - DNA, 25 bp, Mus musculus
aactgcagtatctacacagcacttg

SEQ ID NO: 39677 - DNA, 25 bp, Mus musculus
aactgcagtccccacctctgtagag

SEQ ID NO: 39678 - DNA, 25 bp, Mus musculus
aactgcagtcccgacctctgtagag

SEQ ID NO: 39679 - DNA, 25 bp, Mus musculus
aactgcagtgccagtagccggcaga

SEQ ID NO: 39680 - DNA, 25 bp, Mus musculus
aactgcagtgcctgtagccggcaga

SEQ ID NO: 39681 - DNA, 25 bp, Mus musculus
aactgcagtgcgactctgtgtttta

SEQ ID NO: 39682 - DNA, 25 bp, Mus musculus
aactgcagtgcgtctctgtgtttta

SEQ ID NO: 39683 - DNA, 25 bp, Mus musculus
aactgcagttggagctggccccact

SEQ ID NO: 39684 - DNA, 25 bp, Mus musculus
aactgcagttggtgctggccccact

SEQ ID NO: 39685 - DNA, 25 bp, Mus musculus
aactgcataagactggatccctcat

SEQ ID NO: 39686 - DNA, 25 bp, Mus musculus
aactgcataagagtggatccctcat

SEQ ID NO: 39687 - DNA, 25 bp, Mus musculus
aactgcatacacacagcaagtaatg

SEQ ID NO: 39688 - DNA, 25 bp, Mus musculus
aactgcatacactcagcaagtaatg

SEQ ID NO: 39689 - DNA, 25 bp, Mus musculus
aactgcatagctcaggatacccttg

SEQ ID NO: 39690 - DNA, 25 bp, Mus musculus
aactgcatagctgaggatacccttg

SEQ ID NO: 39691 - DNA, 25 bp, Mus musculus
aactgcatcatgactgagcttcgga

SEQ ID NO: 39692 - DNA, 25 bp, Mus musculus
aactgcatcatgtctgagcttcgga

SEQ ID NO: 39693 - DNA, 25 bp, Mus musculus
aactgcatccacattgttgagcctg

SEQ ID NO: 39694 - DNA, 25 bp, Mus musculus
aactgcatccactttgttgagcctg

SEQ ID NO: 39695 - DNA, 25 bp, Mus musculus
aactgcatccgtagccctagagaat

SEQ ID NO: 39696 - DNA, 25 bp, Mus musculus
aactgcatccgttgccctagagaat

SEQ ID NO: 39697 - DNA, 25 bp, Mus musculus
aactgcatccttagggctacatgta

SEQ ID NO: 39698 - DNA, 25 bp, Mus musculus
aactgcatcctttgggctacatgta

SEQ ID NO: 39699 - DNA, 25 bp, Mus musculus
aactgcatcgacaccacagcgtctg

SEQ ID NO: 39700 - DNA, 25 bp, Mus musculus
aactgcatcgactccacagcgtctg

SEQ ID NO: 39701 - DNA, 25 bp, Mus musculus
aactgcatctttcttgtacatctgt

SEQ ID NO: 39702 - DNA, 25 bp, Mus musculus
aactgcatctttgttgtacatctgt

SEQ ID NO: 39703 - DNA, 25 bp, Mus musculus
aactgcatgataagaagaggctgag

SEQ ID NO: 39704 - DNA, 25 bp, Mus musculus
aactgcatgatatgaagaggctgag

SEQ ID NO: 39705 - DNA, 25 bp, Mus musculus
aactgcatgcgcaccatgggctaca

SEQ ID NO: 39706 - DNA, 25 bp, Mus musculus
aactgcatgcgctccatgggctaca

SEQ ID NO: 39707 - DNA, 25 bp, Mus musculus
aactgcatggatcttcttgtgtctc

SEQ ID NO: 39708 - DNA, 25 bp, Mus musculus
aactgcatggatgttcttgtgtctc

SEQ ID NO: 39709 - DNA, 25 bp, Mus musculus
aactgcatggctacagggagggctt

SEQ ID NO: 39710 - DNA, 25 bp, Mus musculus
aactgcatggcttcagggagggctt

SEQ ID NO: 39711 - DNA, 25 bp, Mus musculus
aactgcatggttaatccttcattac

SEQ ID NO: 39712 - DNA, 25 bp, Mus musculus
aactgcatggtttatccttcattac

SEQ ID NO: 39713 - DNA, 25 bp, Mus musculus
aactgcatgtagagcccgtggagtc

SEQ ID NO: 39714 - DNA, 25 bp, Mus musculus
aactgcatgtagtgcccgtggagtc

SEQ ID NO: 39715 - DNA, 25 bp, Mus musculus
aactgcatgttcaatctggctgctc

SEQ ID NO: 39716 - DNA, 25 bp, Mus musculus
aactgcatgttctatctggctgctc

SEQ ID NO: 39717 - DNA, 25 bp, Mus musculus
aactgcattaaaacacgccaaacat

SEQ ID NO: 39718 - DNA, 25 bp, Mus musculus
aactgcattaaatcacgccaaacat

SEQ ID NO: 39719 - DNA, 25 bp, Mus musculus
aactgcattagtccgttgtaaaata

SEQ ID NO: 39720 - DNA, 25 bp, Mus musculus
aactgcattagtgcgttgtaaaata

SEQ ID NO: 39721 - DNA, 25 bp, Mus musculus
aactgcattataatcctaacccttc

SEQ ID NO: 39722 - DNA, 25 bp, Mus musculus
aactgcattatattcctaacccttc

SEQ ID NO: 39723 - DNA, 25 bp, Mus musculus
aactgcattattcatcgctgtcttt

SEQ ID NO: 39724 - DNA, 25 bp, Mus musculus
aactgcattattgatcgctgtcttt

SEQ ID NO: 39725 - DNA, 25 bp, Mus musculus
aactgcattccccagaaaacattgg

SEQ ID NO: 39726 - DNA, 25 bp, Mus musculus
aactgcattcccgagaaaacattgg

SEQ ID NO: 39727 - DNA, 25 bp, Mus musculus
aactgcattgacaccactgcgtcag

SEQ ID NO: 39728 - DNA, 25 bp, Mus musculus
aactgcattgactccactgcgtcag

SEQ ID NO: 39729 - DNA, 25 bp, Mus musculus
aactgcattgcactaggttcagtga

SEQ ID NO: 39730 - DNA, 25 bp, Mus musculus
aactgcattgcagtaggttcagtga

SEQ ID NO: 39731 - DNA, 25 bp, Mus musculus
aactgcatttttcccatccctattt

SEQ ID NO: 39732 - DNA, 25 bp, Mus musculus
aactgcatttttgccatccctattt

SEQ ID NO: 39733 - DNA, 25 bp, Mus musculus
aactgccaaggtcccaagctgctaa

SEQ ID NO: 39734 - DNA, 25 bp, Mus musculus
aactgccaaggtgccaagctgctaa

SEQ ID NO: 39735 - DNA, 25 bp, Mus musculus
aactgccacatgattctggtaacca

SEQ ID NO: 39736 - DNA, 25 bp, Mus musculus
aactgccacatgtttctggtaacca

SEQ ID NO: 39737 - DNA, 25 bp, Mus musculus
aactgccacattagcgctttatttg

SEQ ID NO: 39738 - DNA, 25 bp, Mus musculus
aactgccacatttgcgctttatttg

SEQ ID NO: 39739 - DNA, 25 bp, Mus musculus
aactgccaccccacagaaaggatga

SEQ ID NO: 39740 - DNA, 25 bp, Mus musculus
aactgccacccctcagaaaggatga

SEQ ID NO: 39741 - DNA, 25 bp, Mus musculus
aactgccagagtcacttatgttgta

SEQ ID NO: 39742 - DNA, 25 bp, Mus musculus
aactgccagagtgacttatgttgta

SEQ ID NO: 39743 - DNA, 25 bp, Mus musculus
aactgccagcaacattagctccata

SEQ ID NO: 39744 - DNA, 25 bp, Mus musculus
aactgccagcaagattagctccata

SEQ ID NO: 39745 - DNA, 25 bp, Mus musculus
aactgccaggccatccttctaatgt

SEQ ID NO: 39746 - DNA, 25 bp, Mus musculus
aactgccaggcccagagtacgagac

SEQ ID NO: 39747 - DNA, 25 bp, Mus musculus
aactgccaggccgagagtacgagac

SEQ ID NO: 39748 - DNA, 25 bp, Mus musculus
aactgccaggccttccttctaatgt

SEQ ID NO: 39749 - DNA, 25 bp, Mus musculus
aactgccagtgactccatgtgcaat

SEQ ID NO: 39750 - DNA, 25 bp, Mus musculus
aactgccagtgagtccatgtgcaat

SEQ ID NO: 39751 - DNA, 25 bp, Mus musculus
aactgccatcgtaaaaactgtcgtg

SEQ ID NO: 39752 - DNA, 25 bp, Mus musculus
aactgccatcgttaaaactgtcgtg

SEQ ID NO: 39753 - DNA, 25 bp, Mus musculus
aactgccatgttagtgctaggaatc

SEQ ID NO: 39754 - DNA, 25 bp, Mus musculus
aactgccatgtttgtgctaggaatc

SEQ ID NO: 39755 - DNA, 25 bp, Mus musculus
aactgccattgaaaagccaaccctg

SEQ ID NO: 39756 - DNA, 25 bp, Mus musculus
aactgccattgataagccaaccctg

SEQ ID NO: 39757 - DNA, 25 bp, Mus musculus
aactgccatttcctattattctcta

SEQ ID NO: 39758 - DNA, 25 bp, Mus musculus
aactgccatttcgtattattctcta

SEQ ID NO: 39759 - DNA, 25 bp, Mus musculus
aactgcccagcaccccggaagataa

SEQ ID NO: 39760 - DNA, 25 bp, Mus musculus
aactgcccagcagcccggaagataa

SEQ ID NO: 39761 - DNA, 25 bp, Mus musculus
aactgcccagccagaggaactgctc

SEQ ID NO: 39762 - DNA, 25 bp, Mus musculus
aactgcccagcctgaggaactgctc

SEQ ID NO: 39763 - DNA, 25 bp, Mus musculus
aactgcccagtcacatttcaagcat

SEQ ID NO: 39764 - DNA, 25 bp, Mus musculus
aactgcccagtctcatttcaagcat

SEQ ID NO: 39765 - DNA, 25 bp, Mus musculus
aactgccccaccatggaaatctgaa

SEQ ID NO: 39766 - DNA, 25 bp, Mus musculus
aactgccccaccttggaaatctgaa

SEQ ID NO: 39767 - DNA, 25 bp, Mus musculus
aactgccccagaaatgcattacacc

SEQ ID NO: 39768 - DNA, 25 bp, Mus musculus
aactgccccagatatgcattacacc

SEQ ID NO: 39769 - DNA, 25 bp, Mus musculus
aactgccccgtgagtgactacgcgg

SEQ ID NO: 39770 - DNA, 25 bp, Mus musculus
aactgccccgtgtgtgactacgcgg

SEQ ID NO: 39771 - DNA, 25 bp, Mus musculus
aactgcccctgtcttaatgaaaagg

SEQ ID NO: 39772 - DNA, 25 bp, Mus musculus
aactgcccctgtgttaatgaaaagg

SEQ ID NO: 39773 - DNA, 25 bp, Mus musculus
aactgcccgtcaaccttgaagataa

SEQ ID NO: 39774 - DNA, 25 bp, Mus musculus
aactgcccgtcatccttgaagataa

SEQ ID NO: 39775 - DNA, 25 bp, Mus musculus
aactgccctaacatgagattctttc

SEQ ID NO: 39776 - DNA, 25 bp, Mus musculus
aactgccctaacttgagattctttc

SEQ ID NO: 39777 - DNA, 25 bp, Mus musculus
aactgccctcacatattacaggcaa

SEQ ID NO: 39778 - DNA, 25 bp, Mus musculus
aactgccctcacttattacaggcaa

SEQ ID NO: 39779 - DNA, 25 bp, Mus musculus
aactgcccttcaattcgaatatcat

SEQ ID NO: 39780 - DNA, 25 bp, Mus musculus
aactgcccttcatttcgaatatcat

SEQ ID NO: 39781 - DNA, 25 bp, Mus musculus
aactgccgagttaagggtgtacctg

SEQ ID NO: 39782 - DNA, 25 bp, Mus musculus
aactgccgagtttagggtgtacctg

SEQ ID NO: 39783 - DNA, 25 bp, Mus musculus
aactgccgccttaaacagagaggaa

SEQ ID NO: 39784 - DNA, 25 bp, Mus musculus
aactgccgcctttaacagagaggaa

SEQ ID NO: 39785 - DNA, 25 bp, Mus musculus
aactgccgggtgctgtttgctgata

SEQ ID NO: 39786 - DNA, 25 bp, Mus musculus
aactgccgggtggtgtttgctgata

SEQ ID NO: 39787 - DNA, 25 bp, Mus musculus
aactgccgtcctctaagctgtgtat

SEQ ID NO: 39788 - DNA, 25 bp, Mus musculus
aactgccgtcctgtaagctgtgtat

SEQ ID NO: 39789 - DNA, 25 bp, Mus musculus
aactgccgtgcaagaattgtgttca

SEQ ID NO: 39790 - DNA, 25 bp, Mus musculus
aactgccgtgcatgaattgtgttca

SEQ ID NO: 39791 - DNA, 25 bp, Mus musculus
aactgcctatctcactctaaaacaa

SEQ ID NO: 39792 - DNA, 25 bp, Mus musculus
aactgcctatctgactctaaaacaa

SEQ ID NO: 39793 - DNA, 25 bp, Mus musculus
aactgcctcattagctcaaggacgt

SEQ ID NO: 39794 - DNA, 25 bp, Mus musculus
aactgcctcattcctaactcagatg

SEQ ID NO: 39795 - DNA, 25 bp, Mus musculus
aactgcctcattgctaactcagatg

SEQ ID NO: 39796 - DNA, 25 bp, Mus musculus
aactgcctcatttgctcaaggacgt

SEQ ID NO: 39797 - DNA, 25 bp, Mus musculus
aactgcctccatagacatggctacg

SEQ ID NO: 39798 - DNA, 25 bp, Mus musculus
aactgcctccatctcagggtagaaa

SEQ ID NO: 39799 - DNA, 25 bp, Mus musculus
aactgcctccatgtcagggtagaaa

SEQ ID NO: 39800 - DNA, 25 bp, Mus musculus
aactgcctccattgacatggctacg

SEQ ID NO: 39801 - DNA, 25 bp, Mus musculus
aactgcctcctgatcggacacaaga

SEQ ID NO: 39802 - DNA, 25 bp, Mus musculus
aactgcctcctgttcggacacaaga

SEQ ID NO: 39803 - DNA, 25 bp, Mus musculus
aactgcctgaagaacttactctggt

SEQ ID NO: 39804 - DNA, 25 bp, Mus musculus
aactgcctgaagtacttactctggt

SEQ ID NO: 39805 - DNA, 25 bp, Mus musculus
aactgcctgacaaagatttttccac

SEQ ID NO: 39806 - DNA, 25 bp, Mus musculus
aactgcctgacatagatttttccac

SEQ ID NO: 39807 - DNA, 25 bp, Mus musculus
aactgcctgcacagtgcagacgcca

SEQ ID NO: 39808 - DNA, 25 bp, Mus musculus
aactgcctgcactgtgcagacgcca

SEQ ID NO: 39809 - DNA, 25 bp, Mus musculus
aactgcctgcagaccgtagcaagct

SEQ ID NO: 39810 - DNA, 25 bp, Mus musculus
aactgcctgcagtccgtagcaagct

SEQ ID NO: 39811 - DNA, 25 bp, Mus musculus
aactgcctgctaacttcagacctga

SEQ ID NO: 39812 - DNA, 25 bp, Mus musculus
aactgcctgctatcttcagacctga

SEQ ID NO: 39813 - DNA, 25 bp, Mus musculus
aactgcctgctgctacatgggaaag

SEQ ID NO: 39814 - DNA, 25 bp, Mus musculus
aactgcctgctggtacatgggaaag

SEQ ID NO: 39815 - DNA, 25 bp, Mus musculus
aactgcctgcttcagggaaagagtt

SEQ ID NO: 39816 - DNA, 25 bp, Mus musculus
aactgcctgcttgagggaaagagtt

SEQ ID NO: 39817 - DNA, 25 bp, Mus musculus
aactgcctggaaatcagaacaaaga

SEQ ID NO: 39818 - DNA, 25 bp, Mus musculus
aactgcctggaattcagaacaaaga

SEQ ID NO: 39819 - DNA, 25 bp, Mus musculus
aactgcctggatccacttttgctga

SEQ ID NO: 39820 - DNA, 25 bp, Mus musculus
aactgcctggatgcacttttgctga

SEQ ID NO: 39821 - DNA, 25 bp, Mus musculus
aactgcctggcacagctgttgacat

SEQ ID NO: 39822 - DNA, 25 bp, Mus musculus
aactgcctggcagagctgttgacat

SEQ ID NO: 39823 - DNA, 25 bp, Mus musculus
aactgcctgggaagtaccacaacca

SEQ ID NO: 39824 - DNA, 25 bp, Mus musculus
aactgcctgggatgtaccacaacca

SEQ ID NO: 39825 - DNA, 25 bp, Mus musculus
aactgcctgtaactccatccttttt

SEQ ID NO: 39826 - DNA, 25 bp, Mus musculus
aactgcctgtaactctagttgtgag

SEQ ID NO: 39827 - DNA, 25 bp, Mus musculus
aactgcctgtaagtccatccttttt

SEQ ID NO: 39828 - DNA, 25 bp, Mus musculus
aactgcctgtaagtctagttgtgag

SEQ ID NO: 39829 - DNA, 25 bp, Mus musculus
aactgcctgtcaaatgagcgctagc

SEQ ID NO: 39830 - DNA, 25 bp, Mus musculus
aactgcctgtcatatgagcgctagc

SEQ ID NO: 39831 - DNA, 25 bp, Mus musculus
aactgccttcctatgattgcctttt

SEQ ID NO: 39832 - DNA, 25 bp, Mus musculus
aactgccttcctttgattgcctttt

SEQ ID NO: 39833 - DNA, 25 bp, Mus musculus
aactgccttgatcctgtgagtaagt

SEQ ID NO: 39834 - DNA, 25 bp, Mus musculus
aactgccttgatgctgtgagtaagt

SEQ ID NO: 39835 - DNA, 25 bp, Mus musculus
aactgccttgcacttagctagctgc

SEQ ID NO: 39836 - DNA, 25 bp, Mus musculus
aactgccttgcagttagctagctgc

SEQ ID NO: 39837 - DNA, 25 bp, Mus musculus
aactgcctttagaatgaactggaat

SEQ ID NO: 39838 - DNA, 25 bp, Mus musculus
aactgcctttagtatgaactggaat

SEQ ID NO: 39839 - DNA, 25 bp, Mus musculus
aactgcctttataacacacctggtt

SEQ ID NO: 39840 - DNA, 25 bp, Mus musculus
aactgcctttatagcttgtgggaaa

SEQ ID NO: 39841 - DNA, 25 bp, Mus musculus
aactgcctttattacacacctggtt

SEQ ID NO: 39842 - DNA, 25 bp, Mus musculus
aactgcctttattgcttgtgggaaa

SEQ ID NO: 39843 - DNA, 25 bp, Mus musculus
aactgcctttgcattgtctctgaga

SEQ ID NO: 39844 - DNA, 25 bp, Mus musculus
aactgcctttgctttgtctctgaga

SEQ ID NO: 39845 - DNA, 25 bp, Mus musculus
aactgcgaaggcaaactgcgaagct

SEQ ID NO: 39846 - DNA, 25 bp, Mus musculus
aactgcgaaggctaactgcgaagct

SEQ ID NO: 39847 - DNA, 25 bp, Mus musculus
aactgcgaagttatacacccatgaa

SEQ ID NO: 39848 - DNA, 25 bp, Mus musculus
aactgcgaagttttacacccatgaa

SEQ ID NO: 39849 - DNA, 25 bp, Mus musculus
aactgcgacgtcatgacgctatgta

SEQ ID NO: 39850 - DNA, 25 bp, Mus musculus
aactgcgacgtcttgacgctatgta

SEQ ID NO: 39851 - DNA, 25 bp, Mus musculus
aactgcgactacctgctgtgtgaat

SEQ ID NO: 39852 - DNA, 25 bp, Mus musculus
aactgcgactacgtgctgtgtgaat

SEQ ID NO: 39853 - DNA, 25 bp, Mus musculus
aactgcgagagcatcacgggataca

SEQ ID NO: 39854 - DNA, 25 bp, Mus musculus
aactgcgagagcttcacgggataca

SEQ ID NO: 39855 - DNA, 25 bp, Mus musculus
aactgcgagcggaaagtgctggcta

SEQ ID NO: 39856 - DNA, 25 bp, Mus musculus
aactgcgagcggtaagtgctggcta

SEQ ID NO: 39857 - DNA, 25 bp, Mus musculus
aactgcgagtagcaagaggtcttat

SEQ ID NO: 39858 - DNA, 25 bp, Mus musculus
aactgcgagtaggaagaggtcttat

SEQ ID NO: 39859 - DNA, 25 bp, Mus musculus
aactgcgatatgctgaagtgtctga

SEQ ID NO: 39860 - DNA, 25 bp, Mus musculus
aactgcgatatggtgaagtgtctga

SEQ ID NO: 39861 - DNA, 25 bp, Mus musculus
aactgcgcaggcaaaacatcgaaac

SEQ ID NO: 39862 - DNA, 25 bp, Mus musculus
aactgcgcaggctaaacatcgaaac

SEQ ID NO: 39863 - DNA, 25 bp, Mus musculus
aactgcgctaccaccttgaagagag

SEQ ID NO: 39864 - DNA, 25 bp, Mus musculus
aactgcgctacctccttgaagagag

SEQ ID NO: 39865 - DNA, 25 bp, Mus musculus
aactgcgctgggaatggacgacaca

SEQ ID NO: 39866 - DNA, 25 bp, Mus musculus
aactgcgctgggtatggacgacaca

SEQ ID NO: 39867 - DNA, 25 bp, Mus musculus
aactgcgctgttcagacttttctat

SEQ ID NO: 39868 - DNA, 25 bp, Mus musculus
aactgcgctgttgagacttttctat

SEQ ID NO: 39869 - DNA, 25 bp, Mus musculus
aactgcggaccgagggactctaatc

SEQ ID NO: 39870 - DNA, 25 bp, Mus musculus
aactgcggaccgtgggactctaatc

SEQ ID NO: 39871 - DNA, 25 bp, Mus musculus
aactgcggcaatatggtctcaaccc

SEQ ID NO: 39872 - DNA, 25 bp, Mus musculus
aactgcggcaatttggtctcaaccc

SEQ ID NO: 39873 - DNA, 25 bp, Mus musculus
aactgcggctttcaagagtatggct

SEQ ID NO: 39874 - DNA, 25 bp, Mus musculus
aactgcggctttgaagagtatggct

SEQ ID NO: 39875 - DNA, 25 bp, Mus musculus
aactgcgggctgcatcagtagttca

SEQ ID NO: 39876 - DNA, 25 bp, Mus musculus
aactgcgggctggatcagtagttca

SEQ ID NO: 39877 - DNA, 25 bp, Mus musculus
aactgcggtacacacgcaccaggtt

SEQ ID NO: 39878 - DNA, 25 bp, Mus musculus
aactgcggtacagacgcaccaggtt

SEQ ID NO: 39879 - DNA, 25 bp, Mus musculus
aactgcgtacaacacgagacggcca

SEQ ID NO: 39880 - DNA, 25 bp, Mus musculus
aactgcgtacaagacgagacggcca

SEQ ID NO: 39881 - DNA, 25 bp, Mus musculus
aactgcgtgatgaaatgtccctttt

SEQ ID NO: 39882 - DNA, 25 bp, Mus musculus
aactgcgtgatgtaatgtccctttt

SEQ ID NO: 39883 - DNA, 25 bp, Mus musculus
aactgcgtgcagaacttttacttgt

SEQ ID NO: 39884 - DNA, 25 bp, Mus musculus
aactgcgtgcagtacttttacttgt

SEQ ID NO: 39885 - DNA, 25 bp, Mus musculus
aactgcgttagtagtatactgcggc

SEQ ID NO: 39886 - DNA, 25 bp, Mus musculus
aactgcgttagttgtatactgcggc

SEQ ID NO: 39887 - DNA, 25 bp, Mus musculus
aactgctaatttatgacccactatg

SEQ ID NO: 39888 - DNA, 25 bp, Mus musculus
aactgctaatttttgacccactatg

SEQ ID NO: 39889 - DNA, 25 bp, Mus musculus
aactgctaccttatgtttgcttggg

SEQ ID NO: 39890 - DNA, 25 bp, Mus musculus
aactgctaccttctagaattctgat

SEQ ID NO: 39891 - DNA, 25 bp, Mus musculus
aactgctaccttctgggactgcaca

SEQ ID NO: 39892 - DNA, 25 bp, Mus musculus
aactgctaccttgtagaattctgat

SEQ ID NO: 39893 - DNA, 25 bp, Mus musculus
aactgctaccttgtgggactgcaca

SEQ ID NO: 39894 - DNA, 25 bp, Mus musculus
aactgctaccttttgtttgcttggg

SEQ ID NO: 39895 - DNA, 25 bp, Mus musculus
aactgctacgtaacacagttccacc

SEQ ID NO: 39896 - DNA, 25 bp, Mus musculus
aactgctacgtatcacagttccacc

SEQ ID NO: 39897 - DNA, 25 bp, Mus musculus
aactgctactgcaaacctgtatggg

SEQ ID NO: 39898 - DNA, 25 bp, Mus musculus
aactgctactgctaacctgtatggg

SEQ ID NO: 39899 - DNA, 25 bp, Mus musculus
aactgctaggaaacctgaaggcggt

SEQ ID NO: 39900 - DNA, 25 bp, Mus musculus
aactgctaggaatcctgaaggcggt

SEQ ID NO: 39901 - DNA, 25 bp, Mus musculus
aactgctagtacattaaccacatgg

SEQ ID NO: 39902 - DNA, 25 bp, Mus musculus
aactgctagtactttaaccacatgg

SEQ ID NO: 39903 - DNA, 25 bp, Mus musculus
aactgctagtccatcattttcatgc

SEQ ID NO: 39904 - DNA, 25 bp, Mus musculus
aactgctagtccttcattttcatgc

SEQ ID NO: 39905 - DNA, 25 bp, Mus musculus
aactgctagttcacttttaaagcta

SEQ ID NO: 39906 - DNA, 25 bp, Mus musculus
aactgctagttctcttttaaagcta

SEQ ID NO: 39907 - DNA, 25 bp, Mus musculus
aactgctattgcaacttgattgaaa

SEQ ID NO: 39908 - DNA, 25 bp, Mus musculus
aactgctattgctacttgattgaaa

SEQ ID NO: 39909 - DNA, 25 bp, Mus musculus
aactgctattttcttgtccccatct

SEQ ID NO: 39910 - DNA, 25 bp, Mus musculus
aactgctattttctttggttagtca

SEQ ID NO: 39911 - DNA, 25 bp, Mus musculus
aactgctattttgttgtccccatct

SEQ ID NO: 39912 - DNA, 25 bp, Mus musculus
aactgctattttgtttggttagtca

SEQ ID NO: 39913 - DNA, 25 bp, Mus musculus
aactgctcaaatatgcaactgtgac

SEQ ID NO: 39914 - DNA, 25 bp, Mus musculus
aactgctcaaatttgcaactgtgac

SEQ ID NO: 39915 - DNA, 25 bp, Mus musculus
aactgctcactaaatcctgcattga

SEQ ID NO: 39916 - DNA, 25 bp, Mus musculus
aactgctcactatatcctgcattga

SEQ ID NO: 39917 - DNA, 25 bp, Mus musculus
aactgctcactgaggactttattct

SEQ ID NO: 39918 - DNA, 25 bp, Mus musculus
aactgctcactgcatggtgggaaga

SEQ ID NO: 39919 - DNA, 25 bp, Mus musculus
aactgctcactggatggtgggaaga

SEQ ID NO: 39920 - DNA, 25 bp, Mus musculus
aactgctcactgtggactttattct

SEQ ID NO: 39921 - DNA, 25 bp, Mus musculus
aactgctcagatctcaggttggtta

SEQ ID NO: 39922 - DNA, 25 bp, Mus musculus
aactgctcagatgtcaggttggtta

SEQ ID NO: 39923 - DNA, 25 bp, Mus musculus
aactgctcagttagccaataggaaa

SEQ ID NO: 39924 - DNA, 25 bp, Mus musculus
aactgctcagtttgccaataggaaa

SEQ ID NO: 39925 - DNA, 25 bp, Mus musculus
aactgctcatttcaatcactgtcac

SEQ ID NO: 39926 - DNA, 25 bp, Mus musculus
aactgctcatttgaatcactgtcac

SEQ ID NO: 39927 - DNA, 25 bp, Mus musculus
aactgctccgagatgcgcttgaaca

SEQ ID NO: 39928 - DNA, 25 bp, Mus musculus
aactgctccgagttgcgcttgaaca

SEQ ID NO: 39929 - DNA, 25 bp, Mus musculus
aactgctcctccagatggaccaagg

SEQ ID NO: 39930 - DNA, 25 bp, Mus musculus
aactgctcctcctgatggaccaagg

SEQ ID NO: 39931 - DNA, 25 bp, Mus musculus
aactgctcctggaataggcacctat

SEQ ID NO: 39932 - DNA, 25 bp, Mus musculus
aactgctcctggtataggcacctat

SEQ ID NO: 39933 - DNA, 25 bp, Mus musculus
aactgctcctgtccctccgatggat

SEQ ID NO: 39934 - DNA, 25 bp, Mus musculus
aactgctcctgtgcctccgatggat

SEQ ID NO: 39935 - DNA, 25 bp, Mus musculus
aactgctcgctacatggcttgagta

SEQ ID NO: 39936 - DNA, 25 bp, Mus musculus
aactgctcgctagatggcttgagta

SEQ ID NO: 39937 - DNA, 25 bp, Mus musculus
aactgctcggaactggtcaccaggg

SEQ ID NO: 39938 - DNA, 25 bp, Mus musculus
aactgctcggaagtggtcaccaggg

SEQ ID NO: 39939 - DNA, 25 bp, Mus musculus
aactgctctgtactaggccatggct

SEQ ID NO: 39940 - DNA, 25 bp, Mus musculus
aactgctctgtagtaggccatggct

SEQ ID NO: 39941 - DNA, 25 bp, Mus musculus
aactgctctgtgatcgccgacgtga

SEQ ID NO: 39942 - DNA, 25 bp, Mus musculus
aactgctctgtgttcgccgacgtga

SEQ ID NO: 39943 - DNA, 25 bp, Mus musculus
aactgctctgttattattaatgtaa

SEQ ID NO: 39944 - DNA, 25 bp, Mus musculus
aactgctctgtttttattaatgtaa

SEQ ID NO: 39945 - DNA, 25 bp, Mus musculus
aactgctcttacctcagccgagaat

SEQ ID NO: 39946 - DNA, 25 bp, Mus musculus
aactgctcttacgtcagccgagaat

SEQ ID NO: 39947 - DNA, 25 bp, Mus musculus
aactgctcttccaaaaaagccacgg

SEQ ID NO: 39948 - DNA, 25 bp, Mus musculus
aactgctcttcctaaaaagccacgg

SEQ ID NO: 39949 - DNA, 25 bp, Mus musculus
aactgctcttcgaggaggtctgtca

SEQ ID NO: 39950 - DNA, 25 bp, Mus musculus
aactgctcttcgtggaggtctgtca

SEQ ID NO: 39951 - DNA, 25 bp, Mus musculus
aactgctcttctcctaagatgctga

SEQ ID NO: 39952 - DNA, 25 bp, Mus musculus
aactgctcttctgctaagatgctga

SEQ ID NO: 39953 - DNA, 25 bp, Mus musculus
aactgctcttggaagtgggacctgt

SEQ ID NO: 39954 - DNA, 25 bp, Mus musculus
aactgctcttggtagtgggacctgt

SEQ ID NO: 39955 - DNA, 25 bp, Mus musculus
aactgctgaacaaacttaaggccaa

SEQ ID NO: 39956 - DNA, 25 bp, Mus musculus
aactgctgaacatacttaaggccaa

SEQ ID NO: 39957 - DNA, 25 bp, Mus musculus
aactgctgaagacacggacactcct

SEQ ID NO: 39958 - DNA, 25 bp, Mus musculus
aactgctgaagagacggacactcct

SEQ ID NO: 39959 - DNA, 25 bp, Mus musculus
aactgctgacaacgttctcactatg

SEQ ID NO: 39960 - DNA, 25 bp, Mus musculus
aactgctgacaaggttctcactatg

SEQ ID NO: 39961 - DNA, 25 bp, Mus musculus
aactgctgacacctttgctagtatg

SEQ ID NO: 39962 - DNA, 25 bp, Mus musculus
aactgctgacacgtttgctagtatg

SEQ ID NO: 39963 - DNA, 25 bp, Mus musculus
aactgctgacatctaccttgtcttg

SEQ ID NO: 39964 - DNA, 25 bp, Mus musculus
aactgctgacatgtaccttgtcttg

SEQ ID NO: 39965 - DNA, 25 bp, Mus musculus
aactgctgacgcagcttcttcgctg

SEQ ID NO: 39966 - DNA, 25 bp, Mus musculus
aactgctgacgctgcttcttcgctg

SEQ ID NO: 39967 - DNA, 25 bp, Mus musculus
aactgctgagagagagctgctgtga

SEQ ID NO: 39968 - DNA, 25 bp, Mus musculus
aactgctgagagcacacgttgtaga

SEQ ID NO: 39969 - DNA, 25 bp, Mus musculus
aactgctgagaggacacgttgtaga

SEQ ID NO: 39970 - DNA, 25 bp, Mus musculus
aactgctgagagtgagctgctgtga

SEQ ID NO: 39971 - DNA, 25 bp, Mus musculus
aactgctgagtgatactgccatgga

SEQ ID NO: 39972 - DNA, 25 bp, Mus musculus
aactgctgagtgttactgccatgga

SEQ ID NO: 39973 - DNA, 25 bp, Mus musculus
aactgctgagttctacatctataga

SEQ ID NO: 39974 - DNA, 25 bp, Mus musculus
aactgctgagttgtacatctataga

SEQ ID NO: 39975 - DNA, 25 bp, Mus musculus
aactgctgataacaactactttgta

SEQ ID NO: 39976 - DNA, 25 bp, Mus musculus
aactgctgataagaactactttgta

SEQ ID NO: 39977 - DNA, 25 bp, Mus musculus
aactgctgatacacgtgcgtgtgat

SEQ ID NO: 39978 - DNA, 25 bp, Mus musculus
aactgctgatactcgtgcgtgtgat

SEQ ID NO: 39979 - DNA, 25 bp, Mus musculus
aactgctgatggcactcgtcaacag

SEQ ID NO: 39980 - DNA, 25 bp, Mus musculus
aactgctgatgggactcgtcaacag

SEQ ID NO: 39981 - DNA, 25 bp, Mus musculus
aactgctgcacccattttgtaactt

SEQ ID NO: 39982 - DNA, 25 bp, Mus musculus
aactgctgcaccgattttgtaactt

SEQ ID NO: 39983 - DNA, 25 bp, Mus musculus
aactgctgcagaaacattagagaac

SEQ ID NO: 39984 - DNA, 25 bp, Mus musculus
aactgctgcagatacattagagaac

SEQ ID NO: 39985 - DNA, 25 bp, Mus musculus
aactgctgcaggcttcctattgact

SEQ ID NO: 39986 - DNA, 25 bp, Mus musculus
aactgctgcagggttcctattgact

SEQ ID NO: 39987 - DNA, 25 bp, Mus musculus
aactgctgcatgaccctgtgggtga

SEQ ID NO: 39988 - DNA, 25 bp, Mus musculus
aactgctgcatgagtggctgcccta

SEQ ID NO: 39989 - DNA, 25 bp, Mus musculus
aactgctgcatgtccctgtgggtga

SEQ ID NO: 39990 - DNA, 25 bp, Mus musculus
aactgctgcatgtgtggctgcccta

SEQ ID NO: 39991 - DNA, 25 bp, Mus musculus
aactgctgctttacctaggcaacag

SEQ ID NO: 39992 - DNA, 25 bp, Mus musculus
aactgctgcttttcctaggcaacag

SEQ ID NO: 39993 - DNA, 25 bp, Mus musculus
aactgctggcctatctgtcaggata

SEQ ID NO: 39994 - DNA, 25 bp, Mus musculus
aactgctggcctttctgtcaggata

SEQ ID NO: 39995 - DNA, 25 bp, Mus musculus
aactgctgggcaatggctgtatcac

SEQ ID NO: 39996 - DNA, 25 bp, Mus musculus
aactgctgggcacactgtaatccca

SEQ ID NO: 39997 - DNA, 25 bp, Mus musculus
aactgctgggcagactgtaatccca

SEQ ID NO: 39998 - DNA, 25 bp, Mus musculus
aactgctgggcattggctgtatcac

SEQ ID NO: 39999 - DNA, 25 bp, Mus musculus
aactgctggtatagctcagctcagg

SEQ ID NO: 40000 - DNA, 25 bp, Mus musculus
aactgctggtattgctcagctcagg

SEQ ID NO: 40001 - DNA, 25 bp, Mus musculus
aactgctgtagcattaatccatact

SEQ ID NO: 40002 - DNA, 25 bp, Mus musculus
aactgctgtagctttaatccatact

SEQ ID NO: 40003 - DNA, 25 bp, Mus musculus
aactgctgtatgacctggcagatca

SEQ ID NO: 40004 - DNA, 25 bp, Mus musculus
aactgctgtatgtcctggcagatca

SEQ ID NO: 40005 - DNA, 25 bp, Mus musculus
aactgctgtcaaacaaagcaaacct

SEQ ID NO: 40006 - DNA, 25 bp, Mus musculus
aactgctgtcaatcaaagcaaacct

SEQ ID NO: 40007 - DNA, 25 bp, Mus musculus
aactgctgtgataatcggcttttga

SEQ ID NO: 40008 - DNA, 25 bp, Mus musculus
aactgctgtgatacatgccttgcca

SEQ ID NO: 40009 - DNA, 25 bp, Mus musculus
aactgctgtgattatcggcttttga

SEQ ID NO: 40010 - DNA, 25 bp, Mus musculus
aactgctgtgattcatgccttgcca

SEQ ID NO: 40011 - DNA, 25 bp, Mus musculus
aactgctgtgtacggttttctgaga

SEQ ID NO: 40012 - DNA, 25 bp, Mus musculus
aactgctgtgtagggttttctgaga

SEQ ID NO: 40013 - DNA, 25 bp, Mus musculus
aactgctgttacatatgtgattata

SEQ ID NO: 40014 - DNA, 25 bp, Mus musculus
aactgctgttacttatgtgattata

SEQ ID NO: 40015 - DNA, 25 bp, Mus musculus
aactgctgttgcataagctactttt

SEQ ID NO: 40016 - DNA, 25 bp, Mus musculus
aactgctgttgcttaagctactttt

SEQ ID NO: 40017 - DNA, 25 bp, Mus musculus
aactgctgttggagacttggagact

SEQ ID NO: 40018 - DNA, 25 bp, Mus musculus
aactgctgttggtgacttggagact

SEQ ID NO: 40019 - DNA, 25 bp, Mus musculus
aactgcttacgaccgtgtatatatt

SEQ ID NO: 40020 - DNA, 25 bp, Mus musculus
aactgcttacgagcgtgtatatatt

SEQ ID NO: 40021 - DNA, 25 bp, Mus musculus
aactgcttagttaatttgaggaaca

SEQ ID NO: 40022 - DNA, 25 bp, Mus musculus
aactgcttagtttatttgaggaaca

SEQ ID NO: 40023 - DNA, 25 bp, Mus musculus
aactgcttatcccagggtctatttt

SEQ ID NO: 40024 - DNA, 25 bp, Mus musculus
aactgcttatccgagggtctatttt

SEQ ID NO: 40025 - DNA, 25 bp, Mus musculus
aactgcttcaccattgtatttaaca

SEQ ID NO: 40026 - DNA, 25 bp, Mus musculus
aactgcttcacccatgttccagcaa

SEQ ID NO: 40027 - DNA, 25 bp, Mus musculus
aactgcttcaccgatgttccagcaa

SEQ ID NO: 40028 - DNA, 25 bp, Mus musculus
aactgcttcacctttgtatttaaca

SEQ ID NO: 40029 - DNA, 25 bp, Mus musculus
aactgcttccccaccggtgaaggtg

SEQ ID NO: 40030 - DNA, 25 bp, Mus musculus
aactgcttcccctccggtgaaggtg

SEQ ID NO: 40031 - DNA, 25 bp, Mus musculus
aactgcttcctaacagggttttgag

SEQ ID NO: 40032 - DNA, 25 bp, Mus musculus
aactgcttcctatcagggttttgag

SEQ ID NO: 40033 - DNA, 25 bp, Mus musculus
aactgcttcctgcttagatcactgg

SEQ ID NO: 40034 - DNA, 25 bp, Mus musculus
aactgcttcctggttagatcactgg

SEQ ID NO: 40035 - DNA, 25 bp, Mus musculus
aactgcttccttagacttaatactt

SEQ ID NO: 40036 - DNA, 25 bp, Mus musculus
aactgcttcctttgacttaatactt

SEQ ID NO: 40037 - DNA, 25 bp, Mus musculus
aactgcttctgtaacagtcacaaga

SEQ ID NO: 40038 - DNA, 25 bp, Mus musculus
aactgcttctgtacagactccagga

SEQ ID NO: 40039 - DNA, 25 bp, Mus musculus
aactgcttctgtagtaccattttga

SEQ ID NO: 40040 - DNA, 25 bp, Mus musculus
aactgcttctgttacagtcacaaga

SEQ ID NO: 40041 - DNA, 25 bp, Mus musculus
aactgcttctgttcagactccagga

SEQ ID NO: 40042 - DNA, 25 bp, Mus musculus
aactgcttctgttgtaccattttga

SEQ ID NO: 40043 - DNA, 25 bp, Mus musculus
aactgcttgcctccatgtggacttg

SEQ ID NO: 40044 - DNA, 25 bp, Mus musculus
aactgcttgcctcgttcacatgaag

SEQ ID NO: 40045 - DNA, 25 bp, Mus musculus
aactgcttgcctgcatgtggacttg

SEQ ID NO: 40046 - DNA, 25 bp, Mus musculus
aactgcttgcctggttcacatgaag

SEQ ID NO: 40047 - DNA, 25 bp, Mus musculus
aactgcttgcttacaactctttggt

SEQ ID NO: 40048 - DNA, 25 bp, Mus musculus
aactgcttgctttcaactctttggt

SEQ ID NO: 40049 - DNA, 25 bp, Mus musculus
aactgcttggagacctgaaactcag

SEQ ID NO: 40050 - DNA, 25 bp, Mus musculus
aactgcttggagtcctgaaactcag

SEQ ID NO: 40051 - DNA, 25 bp, Mus musculus
aactgcttgtttcaacaggatccta

SEQ ID NO: 40052 - DNA, 25 bp, Mus musculus
aactgcttgtttgaacaggatccta

SEQ ID NO: 40053 - DNA, 25 bp, Mus musculus
aactgctttacacgctgatctgcta

SEQ ID NO: 40054 - DNA, 25 bp, Mus musculus
aactgctttacaggctgatctgcta

SEQ ID NO: 40055 - DNA, 25 bp, Mus musculus
aactgctttctgcactgtacgacac

SEQ ID NO: 40056 - DNA, 25 bp, Mus musculus
aactgctttctggactgtacgacac

SEQ ID NO: 40057 - DNA, 25 bp, Mus musculus
aactgctttgccattgcctgacaaa

SEQ ID NO: 40058 - DNA, 25 bp, Mus musculus
aactgctttgcctttgcctgacaaa

SEQ ID NO: 40059 - DNA, 25 bp, Mus musculus
aactgctttgttactgagaccttcc

SEQ ID NO: 40060 - DNA, 25 bp, Mus musculus
aactgctttgtttctgagaccttcc

SEQ ID NO: 40061 - DNA, 25 bp, Mus musculus
aactgcttttcactgtgttgctcag

SEQ ID NO: 40062 - DNA, 25 bp, Mus musculus
aactgcttttcagtgtgttgctcag

SEQ ID NO: 40063 - DNA, 25 bp, Mus musculus
aactgcttttgacgatggtaagcta

SEQ ID NO: 40064 - DNA, 25 bp, Mus musculus
aactgcttttgaggatggtaagcta

SEQ ID NO: 40065 - DNA, 25 bp, Mus musculus
aactgctttttgcattcatttccat

SEQ ID NO: 40066 - DNA, 25 bp, Mus musculus
aactgctttttggattcatttccat

SEQ ID NO: 40067 - DNA, 25 bp, Mus musculus
aactggaaactcactgcacagtcca

SEQ ID NO: 40068 - DNA, 25 bp, Mus musculus
aactggaaactctctgcacagtcca

SEQ ID NO: 40069 - DNA, 25 bp, Mus musculus
aactggaaactgaaagagcttgcaa

SEQ ID NO: 40070 - DNA, 25 bp, Mus musculus
aactggaaactgtaagagcttgcaa

SEQ ID NO: 40071 - DNA, 25 bp, Mus musculus
aactggaaaggtctaggcctgctcc

SEQ ID NO: 40072 - DNA, 25 bp, Mus musculus
aactggaaaggtgtaggcctgctcc

SEQ ID NO: 40073 - DNA, 25 bp, Mus musculus
aactggaacacaccatttgccacta

SEQ ID NO: 40074 - DNA, 25 bp, Mus musculus
aactggaacacagcatttgccacta

SEQ ID NO: 40075 - DNA, 25 bp, Mus musculus
aactggaacagcacaacgccatggg

SEQ ID NO: 40076 - DNA, 25 bp, Mus musculus
aactggaacagcaccgtgagtcacg

SEQ ID NO: 40077 - DNA, 25 bp, Mus musculus
aactggaacagctcaacgccatggg

SEQ ID NO: 40078 - DNA, 25 bp, Mus musculus
aactggaacagctccgtgagtcacg

SEQ ID NO: 40079 - DNA, 25 bp, Mus musculus
aactggaaccagctggcccgcacag

SEQ ID NO: 40080 - DNA, 25 bp, Mus musculus
aactggaaccaggtggcccgcacag

SEQ ID NO: 40081 - DNA, 25 bp, Mus musculus
aactggaaccctactctcataaatg

SEQ ID NO: 40082 - DNA, 25 bp, Mus musculus
aactggaacccttctctcataaatg

SEQ ID NO: 40083 - DNA, 25 bp, Mus musculus
aactggaaccggatgcgagatcgac

SEQ ID NO: 40084 - DNA, 25 bp, Mus musculus
aactggaaccggttgcgagatcgac

SEQ ID NO: 40085 - DNA, 25 bp, Mus musculus
aactggaacctacatgccctggaga

SEQ ID NO: 40086 - DNA, 25 bp, Mus musculus
aactggaacctagatgccctggaga

SEQ ID NO: 40087 - DNA, 25 bp, Mus musculus
aactggaacggtcaaggcgacagca

SEQ ID NO: 40088 - DNA, 25 bp, Mus musculus
aactggaacggtgaaggcgacagca

SEQ ID NO: 40089 - DNA, 25 bp, Mus musculus
aactggaactttatgcaatattctg

SEQ ID NO: 40090 - DNA, 25 bp, Mus musculus
aactggaactttttgcaatattctg

SEQ ID NO: 40091 - DNA, 25 bp, Mus musculus
aactggaagcacaggaaactgcctt

SEQ ID NO: 40092 - DNA, 25 bp, Mus musculus
aactggaagcactggaaactgcctt

SEQ ID NO: 40093 - DNA, 25 bp, Mus musculus
aactggaagcccatatctggactct

SEQ ID NO: 40094 - DNA, 25 bp, Mus musculus
aactggaagcccttatctggactct

SEQ ID NO: 40095 - DNA, 25 bp, Mus musculus
aactggaagcgtcggagcagccatc

SEQ ID NO: 40096 - DNA, 25 bp, Mus musculus
aactggaagcgtgggagcagccatc

SEQ ID NO: 40097 - DNA, 25 bp, Mus musculus
aactggaagctaagggttcaatcga

SEQ ID NO: 40098 - DNA, 25 bp, Mus musculus
aactggaagctatgggttcaatcga

SEQ ID NO: 40099 - DNA, 25 bp, Mus musculus
aactggaaggatcgctgctgtgtgc

SEQ ID NO: 40100 - DNA, 25 bp, Mus musculus
aactggaaggatggctgctgtgtgc

SEQ ID NO: 40101 - DNA, 25 bp, Mus musculus
aactggaaggcaatatcgcaccgaa

SEQ ID NO: 40102 - DNA, 25 bp, Mus musculus
aactggaaggcattatcgcaccgaa

SEQ ID NO: 40103 - DNA, 25 bp, Mus musculus
aactggaagggaacgtggtactcaa

SEQ ID NO: 40104 - DNA, 25 bp, Mus musculus
aactggaagggatcgtggtactcaa

SEQ ID NO: 40105 - DNA, 25 bp, Mus musculus
aactggaagtaaaatttgactcaac

SEQ ID NO: 40106 - DNA, 25 bp, Mus musculus
aactggaagtaatatttgactcaac

SEQ ID NO: 40107 - DNA, 25 bp, Mus musculus
aactggaagttcaactcctgttccg

SEQ ID NO: 40108 - DNA, 25 bp, Mus musculus
aactggaagttctactcctgttccg

SEQ ID NO: 40109 - DNA, 25 bp, Mus musculus
aactggaatattacatcttcattat

SEQ ID NO: 40110 - DNA, 25 bp, Mus musculus
aactggaatatttcatcttcattat

SEQ ID NO: 40111 - DNA, 25 bp, Mus musculus
aactggaattacaagtgaccaacca

SEQ ID NO: 40112 - DNA, 25 bp, Mus musculus
aactggaattactagtgaccaacca

SEQ ID NO: 40113 - DNA, 25 bp, Mus musculus
aactggaattctatatccctcttgt

SEQ ID NO: 40114 - DNA, 25 bp, Mus musculus
aactggaattctttatccctcttgt

SEQ ID NO: 40115 - DNA, 25 bp, Mus musculus
aactggaattttcccagccaactat

SEQ ID NO: 40116 - DNA, 25 bp, Mus musculus
aactggaattttgccagccaactat

SEQ ID NO: 40117 - DNA, 25 bp, Mus musculus
aactggacaacacagccagcactgt

SEQ ID NO: 40118 - DNA, 25 bp, Mus musculus
aactggacaacagagccagcactgt

SEQ ID NO: 40119 - DNA, 25 bp, Mus musculus
aactggacacttacatattacgaat

SEQ ID NO: 40120 - DNA, 25 bp, Mus musculus
aactggacacttagagggagaaact

SEQ ID NO: 40121 - DNA, 25 bp, Mus musculus
aactggacactttcatattacgaat

SEQ ID NO: 40122 - DNA, 25 bp, Mus musculus
aactggacactttgagggagaaact

SEQ ID NO: 40123 - DNA, 25 bp, Mus musculus
aactggacagatcattacggagcat

SEQ ID NO: 40124 - DNA, 25 bp, Mus musculus
aactggacagatgattacggagcat

SEQ ID NO: 40125 - DNA, 25 bp, Mus musculus
aactggacagcaaaccccggctgat

SEQ ID NO: 40126 - DNA, 25 bp, Mus musculus
aactggacagcataccccggctgat

SEQ ID NO: 40127 - DNA, 25 bp, Mus musculus
aactggacatttagcaacgccaaag

SEQ ID NO: 40128 - DNA, 25 bp, Mus musculus
aactggacatttatggagcctcgta

SEQ ID NO: 40129 - DNA, 25 bp, Mus musculus
aactggacattttgcaacgccaaag

SEQ ID NO: 40130 - DNA, 25 bp, Mus musculus
aactggacatttttggagcctcgta

SEQ ID NO: 40131 - DNA, 25 bp, Mus musculus
aactggaccattcttgacatctgtg

SEQ ID NO: 40132 - DNA, 25 bp, Mus musculus
aactggaccattgttgacatctgtg

SEQ ID NO: 40133 - DNA, 25 bp, Mus musculus
aactggacgctcagtgcatgcattt

SEQ ID NO: 40134 - DNA, 25 bp, Mus musculus
aactggacgctctgtgcatgcattt

SEQ ID NO: 40135 - DNA, 25 bp, Mus musculus
aactggacgtggaactggtgcctga

SEQ ID NO: 40136 - DNA, 25 bp, Mus musculus
aactggacgtggtactggtgcctga

SEQ ID NO: 40137 - DNA, 25 bp, Mus musculus
aactggactctgctggagcatgctt

SEQ ID NO: 40138 - DNA, 25 bp, Mus musculus
aactggactctggtggagcatgctt

SEQ ID NO: 40139 - DNA, 25 bp, Mus musculus
aactggactgacctcatcaggctag

SEQ ID NO: 40140 - DNA, 25 bp, Mus musculus
aactggactgacgtcatcaggctag

SEQ ID NO: 40141 - DNA, 25 bp, Mus musculus
aactggactgtcaccagacctatta

SEQ ID NO: 40142 - DNA, 25 bp, Mus musculus
aactggactgtctccagacctatta

SEQ ID NO: 40143 - DNA, 25 bp, Mus musculus
aactggagagccatgttctctgact

SEQ ID NO: 40144 - DNA, 25 bp, Mus musculus
aactggagagccttgttctctgact

SEQ ID NO: 40145 - DNA, 25 bp, Mus musculus
aactggagagcgaaggccttgtcct

SEQ ID NO: 40146 - DNA, 25 bp, Mus musculus
aactggagagcgactatctgaccca

SEQ ID NO: 40147 - DNA, 25 bp, Mus musculus
aactggagagcgtaggccttgtcct

SEQ ID NO: 40148 - DNA, 25 bp, Mus musculus
aactggagagcgtctatctgaccca

SEQ ID NO: 40149 - DNA, 25 bp, Mus musculus
aactggagatctcatccgtgtgtgt

SEQ ID NO: 40150 - DNA, 25 bp, Mus musculus
aactggagatctcggtacaggctct

SEQ ID NO: 40151 - DNA, 25 bp, Mus musculus
aactggagatctgatccgtgtgtgt

SEQ ID NO: 40152 - DNA, 25 bp, Mus musculus
aactggagatctgggtacaggctct

SEQ ID NO: 40153 - DNA, 25 bp, Mus musculus
aactggagatgaaacacctgtaatc

SEQ ID NO: 40154 - DNA, 25 bp, Mus musculus
aactggagatgatacacctgtaatc

SEQ ID NO: 40155 - DNA, 25 bp, Mus musculus
aactggagcatacacttgcccgaga

SEQ ID NO: 40156 - DNA, 25 bp, Mus musculus
aactggagcatagacttgcccgaga

SEQ ID NO: 40157 - DNA, 25 bp, Mus musculus
aactggagccagatcgcttcgttaa

SEQ ID NO: 40158 - DNA, 25 bp, Mus musculus
aactggagccagttcgcttcgttaa

SEQ ID NO: 40159 - DNA, 25 bp, Mus musculus
aactggagcggaacattgctgactt

SEQ ID NO: 40160 - DNA, 25 bp, Mus musculus
aactggagcggatcattgctgactt

SEQ ID NO: 40161 - DNA, 25 bp, Mus musculus
aactggagcgtgattttcccttgag

SEQ ID NO: 40162 - DNA, 25 bp, Mus musculus
aactggagcgtgtttttcccttgag

SEQ ID NO: 40163 - DNA, 25 bp, Mus musculus
aactggagctctcgtgcactgtggt

SEQ ID NO: 40164 - DNA, 25 bp, Mus musculus
aactggagctctggtgcactgtggt

SEQ ID NO: 40165 - DNA, 25 bp, Mus musculus
aactggagctggagtactctgtgct

SEQ ID NO: 40166 - DNA, 25 bp, Mus musculus
aactggagctggtgtactctgtgct

SEQ ID NO: 40167 - DNA, 25 bp, Mus musculus
aactggaggaaaaggctgggcctgc

SEQ ID NO: 40168 - DNA, 25 bp, Mus musculus
aactggaggaaatggctgggcctgc

SEQ ID NO: 40169 - DNA, 25 bp, Mus musculus
aactggaggaagagctccctgctga

SEQ ID NO: 40170 - DNA, 25 bp, Mus musculus
aactggaggaagtgctccctgctga

SEQ ID NO: 40171 - DNA, 25 bp, Mus musculus
aactggagggcacatgcttgtccat

SEQ ID NO: 40172 - DNA, 25 bp, Mus musculus
aactggagggcagatgcttgtccat

SEQ ID NO: 40173 - DNA, 25 bp, Mus musculus
aactggaggtagctggtcattgcat

SEQ ID NO: 40174 - DNA, 25 bp, Mus musculus
aactggaggtaggtggtcattgcat

SEQ ID NO: 40175 - DNA, 25 bp, Mus musculus
aactggaggtccagagtctccagca

SEQ ID NO: 40176 - DNA, 25 bp, Mus musculus
aactggaggtccattttgtgccttg

SEQ ID NO: 40177 - DNA, 25 bp, Mus musculus
aactggaggtcctgagtctccagca

SEQ ID NO: 40178 - DNA, 25 bp, Mus musculus
aactggaggtcctttttgtgccttg

SEQ ID NO: 40179 - DNA, 25 bp, Mus musculus
aactggagtaatagcttcccgacca

SEQ ID NO: 40180 - DNA, 25 bp, Mus musculus
aactggagtaattgcttcccgacca

SEQ ID NO: 40181 - DNA, 25 bp, Mus musculus
aactggagtcaacacatgcttgcaa

SEQ ID NO: 40182 - DNA, 25 bp, Mus musculus
aactggagtcaagacatgcttgcaa

SEQ ID NO: 40183 - DNA, 25 bp, Mus musculus
aactggagtctaactgctagggcca

SEQ ID NO: 40184 - DNA, 25 bp, Mus musculus
aactggagtctatctgctagggcca

SEQ ID NO: 40185 - DNA, 25 bp, Mus musculus
aactggagtctcctgttcaaaccca

SEQ ID NO: 40186 - DNA, 25 bp, Mus musculus
aactggagtctcgtgttcaaaccca

SEQ ID NO: 40187 - DNA, 25 bp, Mus musculus
aactggagtgctattccggttgcaa

SEQ ID NO: 40188 - DNA, 25 bp, Mus musculus
aactggagtgcttttccggttgcaa

SEQ ID NO: 40189 - DNA, 25 bp, Mus musculus
aactggagtttgcaaagtcaacctg

SEQ ID NO: 40190 - DNA, 25 bp, Mus musculus
aactggagtttggaaagtcaacctg

SEQ ID NO: 40191 - DNA, 25 bp, Mus musculus
aactggataagcaggtgggcgcatc

SEQ ID NO: 40192 - DNA, 25 bp, Mus musculus
aactggataagctggtgggcgcatc

SEQ ID NO: 40193 - DNA, 25 bp, Mus musculus
aactggatactgatccatatcgctt

SEQ ID NO: 40194 - DNA, 25 bp, Mus musculus
aactggatactgttccatatcgctt

SEQ ID NO: 40195 - DNA, 25 bp, Mus musculus
aactggatataactcttctgtgatg

SEQ ID NO: 40196 - DNA, 25 bp, Mus musculus
aactggatataagtcttctgtgatg

SEQ ID NO: 40197 - DNA, 25 bp, Mus musculus
aactggatcaaacggtcgcagtgtt

SEQ ID NO: 40198 - DNA, 25 bp, Mus musculus
aactggatcaaagggtcgcagtgtt

SEQ ID NO: 40199 - DNA, 25 bp, Mus musculus
aactggatcaatctggaccctagcc

SEQ ID NO: 40200 - DNA, 25 bp, Mus musculus
aactggatcaatgtggaccctagcc

SEQ ID NO: 40201 - DNA, 25 bp, Mus musculus
aactggatcaggaggctgtccctaa

SEQ ID NO: 40202 - DNA, 25 bp, Mus musculus
aactggatcaggctggctgtgtcca

SEQ ID NO: 40203 - DNA, 25 bp, Mus musculus
aactggatcagggtggctgtgtcca

SEQ ID NO: 40204 - DNA, 25 bp, Mus musculus
aactggatcaggtggctgtccctaa

SEQ ID NO: 40205 - DNA, 25 bp, Mus musculus
aactggatcattaccctggttaact

SEQ ID NO: 40206 - DNA, 25 bp, Mus musculus
aactggatcatttccctggttaact

SEQ ID NO: 40207 - DNA, 25 bp, Mus musculus
aactggatccctagtgtgttgctga

SEQ ID NO: 40208 - DNA, 25 bp, Mus musculus
aactggatcccttgtgtgttgctga

SEQ ID NO: 40209 - DNA, 25 bp, Mus musculus
aactggatcctacggaatgaggtga

SEQ ID NO: 40210 - DNA, 25 bp, Mus musculus
aactggatcctagggaatgaggtga

SEQ ID NO: 40211 - DNA, 25 bp, Mus musculus
aactggatcggcagtgtagaggcca

SEQ ID NO: 40212 - DNA, 25 bp, Mus musculus
aactggatcggctgtgtagaggcca

SEQ ID NO: 40213 - DNA, 25 bp, Mus musculus
aactggatcgggacatgcaggacat

SEQ ID NO: 40214 - DNA, 25 bp, Mus musculus
aactggatcgggtcatgcaggacat

SEQ ID NO: 40215 - DNA, 25 bp, Mus musculus
aactggatcgtgattccaacggcct

SEQ ID NO: 40216 - DNA, 25 bp, Mus musculus
aactggatcgtgtttccaacggcct

SEQ ID NO: 40217 - DNA, 25 bp, Mus musculus
aactggatctatctccctgtggtta

SEQ ID NO: 40218 - DNA, 25 bp, Mus musculus
aactggatctatgtccctgtggtta

SEQ ID NO: 40219 - DNA, 25 bp, Mus musculus
aactggatctgtacaagcctgggct

SEQ ID NO: 40220 - DNA, 25 bp, Mus musculus
aactggatctgttcaagcctgggct

SEQ ID NO: 40221 - DNA, 25 bp, Mus musculus
aactggatgacgatctcctagacaa

SEQ ID NO: 40222 - DNA, 25 bp, Mus musculus
aactggatgacgttctcctagacaa

SEQ ID NO: 40223 - DNA, 25 bp, Mus musculus
aactggatgagtaagtcggtgccat

SEQ ID NO: 40224 - DNA, 25 bp, Mus musculus
aactggatgagttagtcggtgccat

SEQ ID NO: 40225 - DNA, 25 bp, Mus musculus
aactggatgatcctctggcccaaaa

SEQ ID NO: 40226 - DNA, 25 bp, Mus musculus
aactggatgatcgtctggcccaaaa

SEQ ID NO: 40227 - DNA, 25 bp, Mus musculus
aactggatgcacaggccatagctag

SEQ ID NO: 40228 - DNA, 25 bp, Mus musculus
aactggatgcactggccatagctag

SEQ ID NO: 40229 - DNA, 25 bp, Mus musculus
aactggatgcagatgagatggactg

SEQ ID NO: 40230 - DNA, 25 bp, Mus musculus
aactggatgcagttgagatggactg

SEQ ID NO: 40231 - DNA, 25 bp, Mus musculus
aactggatgcctatgaagccgagaa

SEQ ID NO: 40232 - DNA, 25 bp, Mus musculus
aactggatgcctttgaagccgagaa

SEQ ID NO: 40233 - DNA, 25 bp, Mus musculus
aactggatgggacgtgtttcttcat

SEQ ID NO: 40234 - DNA, 25 bp, Mus musculus
aactggatgggaggtgtttcttcat

SEQ ID NO: 40235 - DNA, 25 bp, Mus musculus
aactggatgggcacggaatctgttt

SEQ ID NO: 40236 - DNA, 25 bp, Mus musculus
aactggatgggctcggaatctgttt

SEQ ID NO: 40237 - DNA, 25 bp, Mus musculus
aactggatgttcattcttttggata

SEQ ID NO: 40238 - DNA, 25 bp, Mus musculus
aactggatgttctttcttttggata

SEQ ID NO: 40239 - DNA, 25 bp, Mus musculus
aactggattcccctgcccagtggtg

SEQ ID NO: 40240 - DNA, 25 bp, Mus musculus
aactggattcccgtgcccagtggtg

SEQ ID NO: 40241 - DNA, 25 bp, Mus musculus
aactggattgcactggtcctgggat

SEQ ID NO: 40242 - DNA, 25 bp, Mus musculus
aactggattgcagtggtcctgggat

SEQ ID NO: 40243 - DNA, 25 bp, Mus musculus
aactggattgtgacttcttcgggtg

SEQ ID NO: 40244 - DNA, 25 bp, Mus musculus
aactggattgtgtcttcttcgggtg

SEQ ID NO: 40245 - DNA, 25 bp, Mus musculus
aactggcaagagatgtcttcaagaa

SEQ ID NO: 40246 - DNA, 25 bp, Mus musculus
aactggcaagagttgtcttcaagaa

SEQ ID NO: 40247 - DNA, 25 bp, Mus musculus
aactggcaagatatctccctggatg

SEQ ID NO: 40248 - DNA, 25 bp, Mus musculus
aactggcaagatttctccctggatg

SEQ ID NO: 40249 - DNA, 25 bp, Mus musculus
aactggcacaggaagcatccatgtg

SEQ ID NO: 40250 - DNA, 25 bp, Mus musculus
aactggcacaggacttactgagcct

SEQ ID NO: 40251 - DNA, 25 bp, Mus musculus
aactggcacaggtagcatccatgtg

SEQ ID NO: 40252 - DNA, 25 bp, Mus musculus
aactggcacaggtcttactgagcct

SEQ ID NO: 40253 - DNA, 25 bp, Mus musculus
aactggcaccggcactctgctgata

SEQ ID NO: 40254 - DNA, 25 bp, Mus musculus
aactggcaccgggactctgctgata

SEQ ID NO: 40255 - DNA, 25 bp, Mus musculus
aactggcactgaaagctactctggt

SEQ ID NO: 40256 - DNA, 25 bp, Mus musculus
aactggcactgatagctactctggt

SEQ ID NO: 40257 - DNA, 25 bp, Mus musculus
aactggcactgcacatgactggagg

SEQ ID NO: 40258 - DNA, 25 bp, Mus musculus
aactggcactgctcatgactggagg

SEQ ID NO: 40259 - DNA, 25 bp, Mus musculus
aactggcacttccactgaactcttg

SEQ ID NO: 40260 - DNA, 25 bp, Mus musculus
aactggcacttcgactgaactcttg

SEQ ID NO: 40261 - DNA, 25 bp, Mus musculus
aactggcagaacaaataacactgga

SEQ ID NO: 40262 - DNA, 25 bp, Mus musculus
aactggcagaactaataacactgga

SEQ ID NO: 40263 - DNA, 25 bp, Mus musculus
aactggcagaagcaggctctacctg

SEQ ID NO: 40264 - DNA, 25 bp, Mus musculus
aactggcagaaggaggctctacctg

SEQ ID NO: 40265 - DNA, 25 bp, Mus musculus
aactggcagcagctttcatttacag

SEQ ID NO: 40266 - DNA, 25 bp, Mus musculus
aactggcagcaggtttcatttacag

SEQ ID NO: 40267 - DNA, 25 bp, Mus musculus
aactggcaggcccaatgcatgaaca

SEQ ID NO: 40268 - DNA, 25 bp, Mus musculus
aactggcaggccgaatgcatgaaca

SEQ ID NO: 40269 - DNA, 25 bp, Mus musculus
aactggcagggtcgcatcttgtctg

SEQ ID NO: 40270 - DNA, 25 bp, Mus musculus
aactggcagggtggcatcttgtctg

SEQ ID NO: 40271 - DNA, 25 bp, Mus musculus
aactggcatagaactataggtgtct

SEQ ID NO: 40272 - DNA, 25 bp, Mus musculus
aactggcatagatctataggtgtct

SEQ ID NO: 40273 - DNA, 25 bp, Mus musculus
aactggcatcttactatgagctcca

SEQ ID NO: 40274 - DNA, 25 bp, Mus musculus
aactggcatctttctatgagctcca

SEQ ID NO: 40275 - DNA, 25 bp, Mus musculus
aactggcatgggaaagtctggctca

SEQ ID NO: 40276 - DNA, 25 bp, Mus musculus
aactggcatgggtaagtctggctca

SEQ ID NO: 40277 - DNA, 25 bp, Mus musculus
aactggcattgtcaacgcctgtcac

SEQ ID NO: 40278 - DNA, 25 bp, Mus musculus
aactggcattgtgaacgcctgtcac

SEQ ID NO: 40279 - DNA, 25 bp, Mus musculus
aactggccaatcagtgtcccaaagt

SEQ ID NO: 40280 - DNA, 25 bp, Mus musculus
aactggccaatctgtgtcccaaagt

SEQ ID NO: 40281 - DNA, 25 bp, Mus musculus
aactggcccatcaactactttagag

SEQ ID NO: 40282 - DNA, 25 bp, Mus musculus
aactggcccatctactactttagag

SEQ ID NO: 40283 - DNA, 25 bp, Mus musculus
aactggccccagagcagattaaggt

SEQ ID NO: 40284 - DNA, 25 bp, Mus musculus
aactggccccagtgcagattaaggt

SEQ ID NO: 40285 - DNA, 25 bp, Mus musculus
aactggccgggaatacagatactgc

SEQ ID NO: 40286 - DNA, 25 bp, Mus musculus
aactggccgggattacagatactgc

SEQ ID NO: 40287 - DNA, 25 bp, Mus musculus
aactggcctatgaatacttttgact

SEQ ID NO: 40288 - DNA, 25 bp, Mus musculus
aactggcctatgtatacttttgact

SEQ ID NO: 40289 - DNA, 25 bp, Mus musculus
aactggcctgtaatatttatgcact

SEQ ID NO: 40290 - DNA, 25 bp, Mus musculus
aactggcctgtattatttatgcact

SEQ ID NO: 40291 - DNA, 25 bp, Mus musculus
aactggccttctaggcaggagcgct

SEQ ID NO: 40292 - DNA, 25 bp, Mus musculus
aactggccttcttggcaggagcgct

SEQ ID NO: 40293 - DNA, 25 bp, Mus musculus
aactggcgaaccatgggtgttcctt

SEQ ID NO: 40294 - DNA, 25 bp, Mus musculus
aactggcgaaccttgggtgttcctt

SEQ ID NO: 40295 - DNA, 25 bp, Mus musculus
aactggcgctcgagctacgaggagc

SEQ ID NO: 40296 - DNA, 25 bp, Mus musculus
aactggcgctcgtgctacgaggagc

SEQ ID NO: 40297 - DNA, 25 bp, Mus musculus
aactggcggcagctcaaggagtaca

SEQ ID NO: 40298 - DNA, 25 bp, Mus musculus
aactggcggcaggtcaaggagtaca

SEQ ID NO: 40299 - DNA, 25 bp, Mus musculus
aactggcggcgcatctctggacgca

SEQ ID NO: 40300 - DNA, 25 bp, Mus musculus
aactggcggcgcttctctggacgca

SEQ ID NO: 40301 - DNA, 25 bp, Mus musculus
aactggcgtggaacttgtagcaatc

SEQ ID NO: 40302 - DNA, 25 bp, Mus musculus
aactggcgtggatcttgtagcaatc

SEQ ID NO: 40303 - DNA, 25 bp, Mus musculus
aactggcgttggaagcacggcagca

SEQ ID NO: 40304 - DNA, 25 bp, Mus musculus
aactggcgttggtagcacggcagca

SEQ ID NO: 40305 - DNA, 25 bp, Mus musculus
aactggctaatgaactggtcgcttg

SEQ ID NO: 40306 - DNA, 25 bp, Mus musculus
aactggctaatgtactggtcgcttg

SEQ ID NO: 40307 - DNA, 25 bp, Mus musculus
aactggctaccaaatactgacgctt

SEQ ID NO: 40308 - DNA, 25 bp, Mus musculus
aactggctaccatatactgacgctt

SEQ ID NO: 40309 - DNA, 25 bp, Mus musculus
aactggctagcacatatatatatat

SEQ ID NO: 40310 - DNA, 25 bp, Mus musculus
aactggctagcagatatatatatat

SEQ ID NO: 40311 - DNA, 25 bp, Mus musculus
aactggctagctatctggtcaggtc

SEQ ID NO: 40312 - DNA, 25 bp, Mus musculus
aactggctagctttctggtcaggtc

SEQ ID NO: 40313 - DNA, 25 bp, Mus musculus
aactggctcctaagaatagctgact

SEQ ID NO: 40314 - DNA, 25 bp, Mus musculus
aactggctcctatgaatagctgact

SEQ ID NO: 40315 - DNA, 25 bp, Mus musculus
aactggctccttccgggactggagt

SEQ ID NO: 40316 - DNA, 25 bp, Mus musculus
aactggctccttgcgggactggagt

SEQ ID NO: 40317 - DNA, 25 bp, Mus musculus
aactggctcgcaactgtgtataaat

SEQ ID NO: 40318 - DNA, 25 bp, Mus musculus
aactggctcgcatctgtgtataaat

SEQ ID NO: 40319 - DNA, 25 bp, Mus musculus
aactggctctgcatggcatactatg

SEQ ID NO: 40320 - DNA, 25 bp, Mus musculus
aactggctctgcttggcatactatg

SEQ ID NO: 40321 - DNA, 25 bp, Mus musculus
aactggctctggagacgcccatgaa

SEQ ID NO: 40322 - DNA, 25 bp, Mus musculus
aactggctctggtgacgcccatgaa

SEQ ID NO: 40323 - DNA, 25 bp, Mus musculus
aactggctctgtcttaaccaggtga

SEQ ID NO: 40324 - DNA, 25 bp, Mus musculus
aactggctctgtgttaaccaggtga

SEQ ID NO: 40325 - DNA, 25 bp, Mus musculus
aactggctcttccaaaatcctgatc

SEQ ID NO: 40326 - DNA, 25 bp, Mus musculus
aactggctcttcgaaaatcctgatc

SEQ ID NO: 40327 - DNA, 25 bp, Mus musculus
aactggctgctaactatgtccccgt

SEQ ID NO: 40328 - DNA, 25 bp, Mus musculus
aactggctgctaaggtttgggtaag

SEQ ID NO: 40329 - DNA, 25 bp, Mus musculus
aactggctgctatctatgtccccgt

SEQ ID NO: 40330 - DNA, 25 bp, Mus musculus
aactggctgctatggtttgggtaag

SEQ ID NO: 40331 - DNA, 25 bp, Mus musculus
aactggctggcacatgtgttttgaa

SEQ ID NO: 40332 - DNA, 25 bp, Mus musculus
aactggctggcagatgtgttttgaa

SEQ ID NO: 40333 - DNA, 25 bp, Mus musculus
aactggctgggaagcgaagatgctc

SEQ ID NO: 40334 - DNA, 25 bp, Mus musculus
aactggctgggatgcgaagatgctc

SEQ ID NO: 40335 - DNA, 25 bp, Mus musculus
aactggctgggtattgaggagtcat

SEQ ID NO: 40336 - DNA, 25 bp, Mus musculus
aactggctgggtcgtgttcaaaaca

SEQ ID NO: 40337 - DNA, 25 bp, Mus musculus
aactggctgggtggtgttcaaaaca

SEQ ID NO: 40338 - DNA, 25 bp, Mus musculus
aactggctgggttttgaggagtcat

SEQ ID NO: 40339 - DNA, 25 bp, Mus musculus
aactggcttaagcattctgtacaac

SEQ ID NO: 40340 - DNA, 25 bp, Mus musculus
aactggcttaaggattctgtacaac

SEQ ID NO: 40341 - DNA, 25 bp, Mus musculus
aactggcttatccttgagtgtttac

SEQ ID NO: 40342 - DNA, 25 bp, Mus musculus
aactggcttatcgttgagtgtttac

SEQ ID NO: 40343 - DNA, 25 bp, Mus musculus
aactggcttcagcattctcggtgaa

SEQ ID NO: 40344 - DNA, 25 bp, Mus musculus
aactggcttcaggattctcggtgaa

SEQ ID NO: 40345 - DNA, 25 bp, Mus musculus
aactggcttctaacaataggtacac

SEQ ID NO: 40346 - DNA, 25 bp, Mus musculus
aactggcttctatcaataggtacac

SEQ ID NO: 40347 - DNA, 25 bp, Mus musculus
aactggcttgaccatgatctttttt

SEQ ID NO: 40348 - DNA, 25 bp, Mus musculus
aactggcttgacgatgatctttttt

SEQ ID NO: 40349 - DNA, 25 bp, Mus musculus
aactggcttgctctttctagtggtt

SEQ ID NO: 40350 - DNA, 25 bp, Mus musculus
aactggcttgctgtttctagtggtt

SEQ ID NO: 40351 - DNA, 25 bp, Mus musculus
aactggcttgggaacattctggatg

SEQ ID NO: 40352 - DNA, 25 bp, Mus musculus
aactggcttgggtacattctggatg

SEQ ID NO: 40353 - DNA, 25 bp, Mus musculus
aactggcttgtaagatatttctttc

SEQ ID NO: 40354 - DNA, 25 bp, Mus musculus
aactggcttgtatgatatttctttc

SEQ ID NO: 40355 - DNA, 25 bp, Mus musculus
aactggcttgtgcaagttgtccttt

SEQ ID NO: 40356 - DNA, 25 bp, Mus musculus
aactggcttgtggaagttgtccttt

SEQ ID NO: 40357 - DNA, 25 bp, Mus musculus
aactggctttatctgttggtgattt

SEQ ID NO: 40358 - DNA, 25 bp, Mus musculus
aactggctttatgtgttggtgattt

SEQ ID NO: 40359 - DNA, 25 bp, Mus musculus
aactggctttctatgtaaagctcac

SEQ ID NO: 40360 - DNA, 25 bp, Mus musculus
aactggctttctttgtaaagctcac

SEQ ID NO: 40361 - DNA, 25 bp, Mus musculus
aactggctttgaagactctgtccga

SEQ ID NO: 40362 - DNA, 25 bp, Mus musculus
aactggctttgatgactctgtccga

SEQ ID NO: 40363 - DNA, 25 bp, Mus musculus
aactgggaaactcgttcattgtaga

SEQ ID NO: 40364 - DNA, 25 bp, Mus musculus
aactgggaaactggttcattgtaga

SEQ ID NO: 40365 - DNA, 25 bp, Mus musculus
aactgggaaattcctggcattttag

SEQ ID NO: 40366 - DNA, 25 bp, Mus musculus
aactgggaaattgctggcattttag

SEQ ID NO: 40367 - DNA, 25 bp, Mus musculus
aactgggaactcacgatgactgtct

SEQ ID NO: 40368 - DNA, 25 bp, Mus musculus
aactgggaactctcgatgactgtct

SEQ ID NO: 40369 - DNA, 25 bp, Mus musculus
aactgggaactgactctgggcttaa

SEQ ID NO: 40370 - DNA, 25 bp, Mus musculus
aactgggaactgtctctgggcttaa

SEQ ID NO: 40371 - DNA, 25 bp, Mus musculus
aactgggaagatcagcagtcgttta

SEQ ID NO: 40372 - DNA, 25 bp, Mus musculus
aactgggaagatgagcagtcgttta

SEQ ID NO: 40373 - DNA, 25 bp, Mus musculus
aactgggaagctcgacataaatact

SEQ ID NO: 40374 - DNA, 25 bp, Mus musculus
aactgggaagctggacataaatact

SEQ ID NO: 40375 - DNA, 25 bp, Mus musculus
aactgggaagttaaagcgggcatgc

SEQ ID NO: 40376 - DNA, 25 bp, Mus musculus
aactgggaagtttaagcgggcatgc

SEQ ID NO: 40377 - DNA, 25 bp, Mus musculus
aactgggacgaacctgatattggac

SEQ ID NO: 40378 - DNA, 25 bp, Mus musculus
aactgggacgaagctgatattggac

SEQ ID NO: 40379 - DNA, 25 bp, Mus musculus
aactgggactctcaggctacctggc

SEQ ID NO: 40380 - DNA, 25 bp, Mus musculus
aactgggactctgaggctacctggc

SEQ ID NO: 40381 - DNA, 25 bp, Mus musculus
aactgggagacgaatccttcctctt

SEQ ID NO: 40382 - DNA, 25 bp, Mus musculus
aactgggagacgtatccttcctctt

SEQ ID NO: 40383 - DNA, 25 bp, Mus musculus
aactgggagagccacactgtattag

SEQ ID NO: 40384 - DNA, 25 bp, Mus musculus
aactgggagagcgacactgtattag

SEQ ID NO: 40385 - DNA, 25 bp, Mus musculus
aactgggagatcattaacgctgaaa

SEQ ID NO: 40386 - DNA, 25 bp, Mus musculus
aactgggagatctttaacgctgaaa

SEQ ID NO: 40387 - DNA, 25 bp, Mus musculus
aactgggagccacaggtcctctttg

SEQ ID NO: 40388 - DNA, 25 bp, Mus musculus
aactgggagccagaggtcctctttg

SEQ ID NO: 40389 - DNA, 25 bp, Mus musculus
aactgggagcgcagcatagaggtca

SEQ ID NO: 40390 - DNA, 25 bp, Mus musculus
aactgggagcgctgcatagaggtca

SEQ ID NO: 40391 - DNA, 25 bp, Mus musculus
aactgggagctcaataatcaagggc

SEQ ID NO: 40392 - DNA, 25 bp, Mus musculus
aactgggagctctataatcaagggc

SEQ ID NO: 40393 - DNA, 25 bp, Mus musculus
aactgggaggcccacacagctgtga

SEQ ID NO: 40394 - DNA, 25 bp, Mus musculus
aactgggaggccgacacagctgtga

SEQ ID NO: 40395 - DNA, 25 bp, Mus musculus
aactgggagtacatctacagcctgc

SEQ ID NO: 40396 - DNA, 25 bp, Mus musculus
aactgggagtacttctacagcctgc

SEQ ID NO: 40397 - DNA, 25 bp, Mus musculus
aactgggagtcccacttacctactg

SEQ ID NO: 40398 - DNA, 25 bp, Mus musculus
aactgggagtccgacttacctactg

SEQ ID NO: 40399 - DNA, 25 bp, Mus musculus
aactgggagtgaagcggccaacctc

SEQ ID NO: 40400 - DNA, 25 bp, Mus musculus
aactgggagtgatgcggccaacctc

SEQ ID NO: 40401 - DNA, 25 bp, Mus musculus
aactgggagttgacgttcccacact

SEQ ID NO: 40402 - DNA, 25 bp, Mus musculus
aactgggagttgtcgttcccacact

SEQ ID NO: 40403 - DNA, 25 bp, Mus musculus
aactgggatagaagttgagtgccaa

SEQ ID NO: 40404 - DNA, 25 bp, Mus musculus
aactgggatagatgttgagtgccaa

SEQ ID NO: 40405 - DNA, 25 bp, Mus musculus
aactgggatataaatacttgagaga

SEQ ID NO: 40406 - DNA, 25 bp, Mus musculus
aactgggatatatatacttgagaga

SEQ ID NO: 40407 - DNA, 25 bp, Mus musculus
aactgggatatcagtccccatgact

SEQ ID NO: 40408 - DNA, 25 bp, Mus musculus
aactgggatatctgtccccatgact

SEQ ID NO: 40409 - DNA, 25 bp, Mus musculus
aactgggatccacattctccattct

SEQ ID NO: 40410 - DNA, 25 bp, Mus musculus
aactgggatccagattctccattct

SEQ ID NO: 40411 - DNA, 25 bp, Mus musculus
aactgggatcctctcgctgtggcta

SEQ ID NO: 40412 - DNA, 25 bp, Mus musculus
aactgggatcctgtcgctgtggcta

SEQ ID NO: 40413 - DNA, 25 bp, Mus musculus
aactgggatgatcccatcttagaaa

SEQ ID NO: 40414 - DNA, 25 bp, Mus musculus
aactgggatgatgccatcttagaaa

SEQ ID NO: 40415 - DNA, 25 bp, Mus musculus
aactgggattgtcctcgtgaaggca

SEQ ID NO: 40416 - DNA, 25 bp, Mus musculus
aactgggattgtgctcgtgaaggca

SEQ ID NO: 40417 - DNA, 25 bp, Mus musculus
aactgggatttaattctgaactaga

SEQ ID NO: 40418 - DNA, 25 bp, Mus musculus
aactgggatttatttctgaactaga

SEQ ID NO: 40419 - DNA, 25 bp, Mus musculus
aactgggatttcaaaggcaacgcta

SEQ ID NO: 40420 - DNA, 25 bp, Mus musculus
aactgggatttctaaggcaacgcta

SEQ ID NO: 40421 - DNA, 25 bp, Mus musculus
aactgggcaacccaagactctggct

SEQ ID NO: 40422 - DNA, 25 bp, Mus musculus
aactgggcaaccgaagactctggct

SEQ ID NO: 40423 - DNA, 25 bp, Mus musculus
aactgggcactgctatgcatctata

SEQ ID NO: 40424 - DNA, 25 bp, Mus musculus
aactgggcactggtatgcatctata

SEQ ID NO: 40425 - DNA, 25 bp, Mus musculus
aactgggcagcaagcatgtcctcta

SEQ ID NO: 40426 - DNA, 25 bp, Mus musculus
aactgggcagcatgcatgtcctcta

SEQ ID NO: 40427 - DNA, 25 bp, Mus musculus
aactgggcagtaaaaactcggatcc

SEQ ID NO: 40428 - DNA, 25 bp, Mus musculus
aactgggcagtataaactcggatcc

SEQ ID NO: 40429 - DNA, 25 bp, Mus musculus
aactgggcatcacggcagtgttgca

SEQ ID NO: 40430 - DNA, 25 bp, Mus musculus
aactgggcatcagggcagtgttgca

SEQ ID NO: 40431 - DNA, 25 bp, Mus musculus
aactgggcatgacttttctctggat

SEQ ID NO: 40432 - DNA, 25 bp, Mus musculus
aactgggcatgagttttctctggat

SEQ ID NO: 40433 - DNA, 25 bp, Mus musculus
aactgggcatggatgcagaaagacc

SEQ ID NO: 40434 - DNA, 25 bp, Mus musculus
aactgggcatggttgcagaaagacc

SEQ ID NO: 40435 - DNA, 25 bp, Mus musculus
aactgggccaacactcctagcaaag

SEQ ID NO: 40436 - DNA, 25 bp, Mus musculus
aactgggccaactctcctagcaaag

SEQ ID NO: 40437 - DNA, 25 bp, Mus musculus
aactgggccacccttaatctgtgtg

SEQ ID NO: 40438 - DNA, 25 bp, Mus musculus
aactgggccaccgttaatctgtgtg

SEQ ID NO: 40439 - DNA, 25 bp, Mus musculus
aactgggccagtcatatcttttaga

SEQ ID NO: 40440 - DNA, 25 bp, Mus musculus
aactgggccagtcatcattaacaat

SEQ ID NO: 40441 - DNA, 25 bp, Mus musculus
aactgggccagtgatatcttttaga

SEQ ID NO: 40442 - DNA, 25 bp, Mus musculus
aactgggccagtgatcattaacaat

SEQ ID NO: 40443 - DNA, 25 bp, Mus musculus
aactgggccatgatttgcccatttt

SEQ ID NO: 40444 - DNA, 25 bp, Mus musculus
aactgggccatgttttgcccatttt

SEQ ID NO: 40445 - DNA, 25 bp, Mus musculus
aactgggccggtaattcaatggcta

SEQ ID NO: 40446 - DNA, 25 bp, Mus musculus
aactgggccggttattcaatggcta

SEQ ID NO: 40447 - DNA, 25 bp, Mus musculus
aactgggcctctcgatttgccaaga

SEQ ID NO: 40448 - DNA, 25 bp, Mus musculus
aactgggcctctggatttgccaaga

SEQ ID NO: 40449 - DNA, 25 bp, Mus musculus
aactgggcctgtatgtagaggatcc

SEQ ID NO: 40450 - DNA, 25 bp, Mus musculus
aactgggcctgtttgtagaggatcc

SEQ ID NO: 40451 - DNA, 25 bp, Mus musculus
aactgggcgattcctctggcattgg

SEQ ID NO: 40452 - DNA, 25 bp, Mus musculus
aactgggcgattgctctggcattgg

SEQ ID NO: 40453 - DNA, 25 bp, Mus musculus
aactgggcggaacgagcaaaatcct

SEQ ID NO: 40454 - DNA, 25 bp, Mus musculus
aactgggcggaaggagcaaaatcct

SEQ ID NO: 40455 - DNA, 25 bp, Mus musculus
aactgggcgtctcggcaagacctgc

SEQ ID NO: 40456 - DNA, 25 bp, Mus musculus
aactgggcgtctgggcaagacctgc

SEQ ID NO: 40457 - DNA, 25 bp, Mus musculus
aactgggctctgatcgtagacctga

SEQ ID NO: 40458 - DNA, 25 bp, Mus musculus
aactgggctctgttcgtagacctga

SEQ ID NO: 40459 - DNA, 25 bp, Mus musculus
aactgggctgagctgacacctgagc

SEQ ID NO: 40460 - DNA, 25 bp, Mus musculus
aactgggctgaggtgacacctgagc

SEQ ID NO: 40461 - DNA, 25 bp, Mus musculus
aactgggctgcaaatcgtgacaaaa

SEQ ID NO: 40462 - DNA, 25 bp, Mus musculus
aactgggctgcatatcgtgacaaaa

SEQ ID NO: 40463 - DNA, 25 bp, Mus musculus
aactgggcttgcatgagggctcgct

SEQ ID NO: 40464 - DNA, 25 bp, Mus musculus
aactgggcttgcttgagggctcgct

SEQ ID NO: 40465 - DNA, 25 bp, Mus musculus
aactgggtaaccatatactgctaat

SEQ ID NO: 40466 - DNA, 25 bp, Mus musculus
aactgggtaaccttatactgctaat

SEQ ID NO: 40467 - DNA, 25 bp, Mus musculus
aactgggtaataaggctgcttggaa

SEQ ID NO: 40468 - DNA, 25 bp, Mus musculus
aactgggtaatatggctgcttggaa

SEQ ID NO: 40469 - DNA, 25 bp, Mus musculus
aactgggtactgatgtctctgggaa

SEQ ID NO: 40470 - DNA, 25 bp, Mus musculus
aactgggtactgttgtctctgggaa

SEQ ID NO: 40471 - DNA, 25 bp, Mus musculus
aactgggtccgcaactttgtcgata

SEQ ID NO: 40472 - DNA, 25 bp, Mus musculus
aactgggtccgccagtctccagaaa

SEQ ID NO: 40473 - DNA, 25 bp, Mus musculus
aactgggtccgcgagtctccagaaa

SEQ ID NO: 40474 - DNA, 25 bp, Mus musculus
aactgggtccgctactttgtcgata

SEQ ID NO: 40475 - DNA, 25 bp, Mus musculus
aactgggtcctaaccactggcattg

SEQ ID NO: 40476 - DNA, 25 bp, Mus musculus
aactgggtcctatccactggcattg

SEQ ID NO: 40477 - DNA, 25 bp, Mus musculus
aactgggtctatctggtgatgagct

SEQ ID NO: 40478 - DNA, 25 bp, Mus musculus
aactgggtctatgtggtgatgagct

SEQ ID NO: 40479 - DNA, 25 bp, Mus musculus
aactgggtctctacgctatggctga

SEQ ID NO: 40480 - DNA, 25 bp, Mus musculus
aactgggtctcttcgctatggctga

SEQ ID NO: 40481 - DNA, 25 bp, Mus musculus
aactgggtgaccattgtaattcata

SEQ ID NO: 40482 - DNA, 25 bp, Mus musculus
aactgggtgacctttgtaattcata

SEQ ID NO: 40483 - DNA, 25 bp, Mus musculus
aactgggtgccacctcggaaaacgt

SEQ ID NO: 40484 - DNA, 25 bp, Mus musculus
aactgggtgccagctcggaaaacgt

SEQ ID NO: 40485 - DNA, 25 bp, Mus musculus
aactgggtgggaaactcactgatca

SEQ ID NO: 40486 - DNA, 25 bp, Mus musculus
aactgggtgggatactcactgatca

SEQ ID NO: 40487 - DNA, 25 bp, Mus musculus
aactgggtgggcaaagtcctccatg

SEQ ID NO: 40488 - DNA, 25 bp, Mus musculus
aactgggtgggcatatccttgactg

SEQ ID NO: 40489 - DNA, 25 bp, Mus musculus
aactgggtgggctaagtcctccatg

SEQ ID NO: 40490 - DNA, 25 bp, Mus musculus
aactgggtgggcttatccttgactg

SEQ ID NO: 40491 - DNA, 25 bp, Mus musculus
aactgggtggtcctatcggctgaaa

SEQ ID NO: 40492 - DNA, 25 bp, Mus musculus
aactgggtggtcgtatcggctgaaa

SEQ ID NO: 40493 - DNA, 25 bp, Mus musculus
aactgggtgtgcatacatcacgaga

SEQ ID NO: 40494 - DNA, 25 bp, Mus musculus
aactgggtgtgcttacatcacgaga

SEQ ID NO: 40495 - DNA, 25 bp, Mus musculus
aactgggtgtgtctgacttgctatc

SEQ ID NO: 40496 - DNA, 25 bp, Mus musculus
aactgggtgtgtgtgacttgctatc

SEQ ID NO: 40497 - DNA, 25 bp, Mus musculus
aactgggttcaaactctgtcttctc

SEQ ID NO: 40498 - DNA, 25 bp, Mus musculus
aactgggttcaatctctgtcttctc

SEQ ID NO: 40499 - DNA, 25 bp, Mus musculus
aactgggttcttatatcccttgctc

SEQ ID NO: 40500 - DNA, 25 bp, Mus musculus
aactgggttcttttatcccttgctc

SEQ ID NO: 40501 - DNA, 25 bp, Mus musculus
aactgggttgccctgtctagtctta

SEQ ID NO: 40502 - DNA, 25 bp, Mus musculus
aactgggttgccgtgtctagtctta

SEQ ID NO: 40503 - DNA, 25 bp, Mus musculus
aactggtaaacaacctacctcttca

SEQ ID NO: 40504 - DNA, 25 bp, Mus musculus
aactggtaaacatcctacctcttca

SEQ ID NO: 40505 - DNA, 25 bp, Mus musculus
aactggtaacttattgcttctcagg

SEQ ID NO: 40506 - DNA, 25 bp, Mus musculus
aactggtaactttttgcttctcagg

SEQ ID NO: 40507 - DNA, 25 bp, Mus musculus
aactggtaaggtacattcctggctc

SEQ ID NO: 40508 - DNA, 25 bp, Mus musculus
aactggtaaggttcattcctggctc

SEQ ID NO: 40509 - DNA, 25 bp, Mus musculus
aactggtaagttctccttcctgtgg

SEQ ID NO: 40510 - DNA, 25 bp, Mus musculus
aactggtaagttgtccttcctgtgg

SEQ ID NO: 40511 - DNA, 25 bp, Mus musculus
aactggtaatatattgtatgatgaa

SEQ ID NO: 40512 - DNA, 25 bp, Mus musculus
aactggtaatattttgtatgatgaa

SEQ ID NO: 40513 - DNA, 25 bp, Mus musculus
aactggtaatgcagtggccaggaag

SEQ ID NO: 40514 - DNA, 25 bp, Mus musculus
aactggtaatgctgtggccaggaag

SEQ ID NO: 40515 - DNA, 25 bp, Mus musculus
aactggtacatacagcatatactct

SEQ ID NO: 40516 - DNA, 25 bp, Mus musculus
aactggtacatagagcatatactct

SEQ ID NO: 40517 - DNA, 25 bp, Mus musculus
aactggtaccagacgctggcagctg

SEQ ID NO: 40518 - DNA, 25 bp, Mus musculus
aactggtaccagagtctgtacctca

SEQ ID NO: 40519 - DNA, 25 bp, Mus musculus
aactggtaccagtcgctggcagctg

SEQ ID NO: 40520 - DNA, 25 bp, Mus musculus
aactggtaccagtgtctgtacctca

SEQ ID NO: 40521 - DNA, 25 bp, Mus musculus
aactggtagccaattgaggtctcaa

SEQ ID NO: 40522 - DNA, 25 bp, Mus musculus
aactggtagccatttgaggtctcaa

SEQ ID NO: 40523 - DNA, 25 bp, Mus musculus
aactggtaggttcgtttgtgtgcat

SEQ ID NO: 40524 - DNA, 25 bp, Mus musculus
aactggtaggttggtttgtgtgcat

SEQ ID NO: 40525 - DNA, 25 bp, Mus musculus
aactggtataccaggtgccccagag

SEQ ID NO: 40526 - DNA, 25 bp, Mus musculus
aactggtatacctggtgccccagag

SEQ ID NO: 40527 - DNA, 25 bp, Mus musculus
aactggtatcaaaattctgcccctt

SEQ ID NO: 40528 - DNA, 25 bp, Mus musculus
aactggtatcaatattctgcccctt

SEQ ID NO: 40529 - DNA, 25 bp, Mus musculus
aactggtatgagctactgctgaagc

SEQ ID NO: 40530 - DNA, 25 bp, Mus musculus
aactggtatgaggtactgctgaagc

SEQ ID NO: 40531 - DNA, 25 bp, Mus musculus
aactggtatgatccagatatggcct

SEQ ID NO: 40532 - DNA, 25 bp, Mus musculus
aactggtatgatgcagatatggcct

SEQ ID NO: 40533 - DNA, 25 bp, Mus musculus
aactggtatgtgcatgagccttcct

SEQ ID NO: 40534 - DNA, 25 bp, Mus musculus
aactggtatgtggatgagccttcct

SEQ ID NO: 40535 - DNA, 25 bp, Mus musculus
aactggtcacataatccatctctga

SEQ ID NO: 40536 - DNA, 25 bp, Mus musculus
aactggtcacattatccatctctga

SEQ ID NO: 40537 - DNA, 25 bp, Mus musculus
aactggtcagctaggttctttaaag

SEQ ID NO: 40538 - DNA, 25 bp, Mus musculus
aactggtcagcttggttctttaaag

SEQ ID NO: 40539 - DNA, 25 bp, Mus musculus
aactggtcaggaaggcttgctggat

SEQ ID NO: 40540 - DNA, 25 bp, Mus musculus
aactggtcaggatggcttgctggat

SEQ ID NO: 40541 - DNA, 25 bp, Mus musculus
aactggtcaggtagtgcctggcttc

SEQ ID NO: 40542 - DNA, 25 bp, Mus musculus
aactggtcaggttgtgcctggcttc

SEQ ID NO: 40543 - DNA, 25 bp, Mus musculus
aactggtcattgagagcctactggc

SEQ ID NO: 40544 - DNA, 25 bp, Mus musculus
aactggtcattgtgagcctactggc

SEQ ID NO: 40545 - DNA, 25 bp, Mus musculus
aactggtcatttcccttctttcata

SEQ ID NO: 40546 - DNA, 25 bp, Mus musculus
aactggtcatttgccttctttcata

SEQ ID NO: 40547 - DNA, 25 bp, Mus musculus
aactggtccacaatcatctctgttt

SEQ ID NO: 40548 - DNA, 25 bp, Mus musculus
aactggtccacattcatctctgttt

SEQ ID NO: 40549 - DNA, 25 bp, Mus musculus
aactggtccatgaaagtactttcca

SEQ ID NO: 40550 - DNA, 25 bp, Mus musculus
aactggtccatgtaagtactttcca

SEQ ID NO: 40551 - DNA, 25 bp, Mus musculus
aactggtcccatcagccaatgtatt

SEQ ID NO: 40552 - DNA, 25 bp, Mus musculus
aactggtcccatgagccaatgtatt

SEQ ID NO: 40553 - DNA, 25 bp, Mus musculus
aactggtccctcctggagaagcgga

SEQ ID NO: 40554 - DNA, 25 bp, Mus musculus
aactggtccctcgtggagaagcgga

SEQ ID NO: 40555 - DNA, 25 bp, Mus musculus
aactggtcctccattttgaaatgag

SEQ ID NO: 40556 - DNA, 25 bp, Mus musculus
aactggtcctcctttttgaaatgag

SEQ ID NO: 40557 - DNA, 25 bp, Mus musculus
aactggtcgggcaattctgaattcc

SEQ ID NO: 40558 - DNA, 25 bp, Mus musculus
aactggtcgggctattctgaattcc

SEQ ID NO: 40559 - DNA, 25 bp, Mus musculus
aactggtctaaaacggtcatagcta

SEQ ID NO: 40560 - DNA, 25 bp, Mus musculus
aactggtctaaatcggtcatagcta

SEQ ID NO: 40561 - DNA, 25 bp, Mus musculus
aactggtctatcatcccgtatgtga

SEQ ID NO: 40562 - DNA, 25 bp, Mus musculus
aactggtctatcttcccgtatgtga

SEQ ID NO: 40563 - DNA, 25 bp, Mus musculus
aactggtctccacgatatcctcaat

SEQ ID NO: 40564 - DNA, 25 bp, Mus musculus
aactggtctccaggatatcctcaat

SEQ ID NO: 40565 - DNA, 25 bp, Mus musculus
aactggtctctaattgcaggactcc

SEQ ID NO: 40566 - DNA, 25 bp, Mus musculus
aactggtctctatttgcaggactcc

SEQ ID NO: 40567 - DNA, 25 bp, Mus musculus
aactggtctgcaatgctgttggtgc

SEQ ID NO: 40568 - DNA, 25 bp, Mus musculus
aactggtctgcattgctgttggtgc

SEQ ID NO: 40569 - DNA, 25 bp, Mus musculus
aactggtctgctatgtctggtctca

SEQ ID NO: 40570 - DNA, 25 bp, Mus musculus
aactggtctgctttgtctggtctca

SEQ ID NO: 40571 - DNA, 25 bp, Mus musculus
aactggtctgtgataatgtctgtat

SEQ ID NO: 40572 - DNA, 25 bp, Mus musculus
aactggtctgtgttaatgtctgtat

SEQ ID NO: 40573 - DNA, 25 bp, Mus musculus
aactggtgaccacctctctgtgcag

SEQ ID NO: 40574 - DNA, 25 bp, Mus musculus
aactggtgaccagctctctgtgcag

SEQ ID NO: 40575 - DNA, 25 bp, Mus musculus
aactggtgacttattgcactcaaga

SEQ ID NO: 40576 - DNA, 25 bp, Mus musculus
aactggtgacttctgcatttgattg

SEQ ID NO: 40577 - DNA, 25 bp, Mus musculus
aactggtgacttgtgcatttgattg

SEQ ID NO: 40578 - DNA, 25 bp, Mus musculus
aactggtgactttttgcactcaaga

SEQ ID NO: 40579 - DNA, 25 bp, Mus musculus
aactggtgagctcgattcaatccct

SEQ ID NO: 40580 - DNA, 25 bp, Mus musculus
aactggtgagctggattcaatccct

SEQ ID NO: 40581 - DNA, 25 bp, Mus musculus
aactggtgcagaagacataatctct

SEQ ID NO: 40582 - DNA, 25 bp, Mus musculus
aactggtgcagatgacataatctct

SEQ ID NO: 40583 - DNA, 25 bp, Mus musculus
aactggtgcaggcttcttcttttag

SEQ ID NO: 40584 - DNA, 25 bp, Mus musculus
aactggtgcagggttcttcttttag

SEQ ID NO: 40585 - DNA, 25 bp, Mus musculus
aactggtgcagtactccttctggct

SEQ ID NO: 40586 - DNA, 25 bp, Mus musculus
aactggtgcagttctccttctggct

SEQ ID NO: 40587 - DNA, 25 bp, Mus musculus
aactggtgccaaagtggtggtatct

SEQ ID NO: 40588 - DNA, 25 bp, Mus musculus
aactggtgccaatgtggtggtatct

SEQ ID NO: 40589 - DNA, 25 bp, Mus musculus
aactggtgccatatggtgtcttgcc

SEQ ID NO: 40590 - DNA, 25 bp, Mus musculus
aactggtgccatttggtgtcttgcc

SEQ ID NO: 40591 - DNA, 25 bp, Mus musculus
aactggtgctaaaccatggctttaa

SEQ ID NO: 40592 - DNA, 25 bp, Mus musculus
aactggtgctaatccatggctttaa

SEQ ID NO: 40593 - DNA, 25 bp, Mus musculus
aactggtgctgactaatttctgtaa

SEQ ID NO: 40594 - DNA, 25 bp, Mus musculus
aactggtgctgagtaatttctgtaa

SEQ ID NO: 40595 - DNA, 25 bp, Mus musculus
aactggtgctggactcagtgtcagt

SEQ ID NO: 40596 - DNA, 25 bp, Mus musculus
aactggtgctggagtgttgtcctca

SEQ ID NO: 40597 - DNA, 25 bp, Mus musculus
aactggtgctggtctcagtgtcagt

SEQ ID NO: 40598 - DNA, 25 bp, Mus musculus
aactggtgctggtgtgttgtcctca

SEQ ID NO: 40599 - DNA, 25 bp, Mus musculus
aactggtggcaaatttcgctccttc

SEQ ID NO: 40600 - DNA, 25 bp, Mus musculus
aactggtggcaattttcgctccttc

SEQ ID NO: 40601 - DNA, 25 bp, Mus musculus
aactggtggcatacaggtcaatgtt

SEQ ID NO: 40602 - DNA, 25 bp, Mus musculus
aactggtggcattcaggtcaatgtt

SEQ ID NO: 40603 - DNA, 25 bp, Mus musculus
aactggtgtaagacctccagacaca

SEQ ID NO: 40604 - DNA, 25 bp, Mus musculus
aactggtgtaagtcctccagacaca

SEQ ID NO: 40605 - DNA, 25 bp, Mus musculus
aactggtgtcagatagctgcaggta

SEQ ID NO: 40606 - DNA, 25 bp, Mus musculus
aactggtgtcagttagctgcaggta

SEQ ID NO: 40607 - DNA, 25 bp, Mus musculus
aactggtgtctgagccagatttgca

SEQ ID NO: 40608 - DNA, 25 bp, Mus musculus
aactggtgtctgctttattttacat

SEQ ID NO: 40609 - DNA, 25 bp, Mus musculus
aactggtgtctggtttattttacat

SEQ ID NO: 40610 - DNA, 25 bp, Mus musculus
aactggtgtctgtgccagatttgca

SEQ ID NO: 40611 - DNA, 25 bp, Mus musculus
aactggtgtcttatcggttgtactg

SEQ ID NO: 40612 - DNA, 25 bp, Mus musculus
aactggtgtcttttcggttgtactg

SEQ ID NO: 40613 - DNA, 25 bp, Mus musculus
aactggtgtgagactggttgtcgcc

SEQ ID NO: 40614 - DNA, 25 bp, Mus musculus
aactggtgtgagtctggttgtcgcc

SEQ ID NO: 40615 - DNA, 25 bp, Mus musculus
aactggtgtgctacctggagccaag

SEQ ID NO: 40616 - DNA, 25 bp, Mus musculus
aactggtgtgctcgacctttttcaa

SEQ ID NO: 40617 - DNA, 25 bp, Mus musculus
aactggtgtgctggacctttttcaa

SEQ ID NO: 40618 - DNA, 25 bp, Mus musculus
aactggtgtgcttcctggagccaag

SEQ ID NO: 40619 - DNA, 25 bp, Mus musculus
aactggttaaccatgaagtgactgt

SEQ ID NO: 40620 - DNA, 25 bp, Mus musculus
aactggttaaccttgaagtgactgt

SEQ ID NO: 40621 - DNA, 25 bp, Mus musculus
aactggttattgagacccgctaaat

SEQ ID NO: 40622 - DNA, 25 bp, Mus musculus
aactggttattgtgacccgctaaat

SEQ ID NO: 40623 - DNA, 25 bp, Mus musculus
aactggttatttacgtggtgctcta

SEQ ID NO: 40624 - DNA, 25 bp, Mus musculus
aactggttattttcgtggtgctcta

SEQ ID NO: 40625 - DNA, 25 bp, Mus musculus
aactggttcagcacgtgaccggctg

SEQ ID NO: 40626 - DNA, 25 bp, Mus musculus
aactggttcagctcgtgaccggctg

SEQ ID NO: 40627 - DNA, 25 bp, Mus musculus
aactggttccgacagaagcttcctt

SEQ ID NO: 40628 - DNA, 25 bp, Mus musculus
aactggttccgagagaagcttcctt

SEQ ID NO: 40629 - DNA, 25 bp, Mus musculus
aactggttgactactcggtctgtaa

SEQ ID NO: 40630 - DNA, 25 bp, Mus musculus
aactggttgacttctcggtctgtaa

SEQ ID NO: 40631 - DNA, 25 bp, Mus musculus
aactggttgagcacttgccaagcat

SEQ ID NO: 40632 - DNA, 25 bp, Mus musculus
aactggttgagctcttgccaagcat

SEQ ID NO: 40633 - DNA, 25 bp, Mus musculus
aactggttggaaacactgcccgtaa

SEQ ID NO: 40634 - DNA, 25 bp, Mus musculus
aactggttggaatcactgcccgtaa

SEQ ID NO: 40635 - DNA, 25 bp, Mus musculus
aactggttggttaatgatgcttggg

SEQ ID NO: 40636 - DNA, 25 bp, Mus musculus
aactggttggtttatgatgcttggg

SEQ ID NO: 40637 - DNA, 25 bp, Mus musculus
aactggtttaccctgctgttgtcac

SEQ ID NO: 40638 - DNA, 25 bp, Mus musculus
aactggtttaccgtgctgttgtcac

SEQ ID NO: 40639 - DNA, 25 bp, Mus musculus
aactggttttagacttcataaggat

SEQ ID NO: 40640 - DNA, 25 bp, Mus musculus
aactggttttagagccttgatataa

SEQ ID NO: 40641 - DNA, 25 bp, Mus musculus
aactggttttagtcttcataaggat

SEQ ID NO: 40642 - DNA, 25 bp, Mus musculus
aactggttttagtgccttgatataa

SEQ ID NO: 40643 - DNA, 25 bp, Mus musculus
aactggttttatattattgctgcta

SEQ ID NO: 40644 - DNA, 25 bp, Mus musculus
aactggttttattttattgctgcta

SEQ ID NO: 40645 - DNA, 25 bp, Mus musculus
aactggttttctcccactaggtggg

SEQ ID NO: 40646 - DNA, 25 bp, Mus musculus
aactggttttctgccactaggtggg

SEQ ID NO: 40647 - DNA, 25 bp, Mus musculus
aactgtaaagtaaccggctcaccta

SEQ ID NO: 40648 - DNA, 25 bp, Mus musculus
aactgtaaagtatccggctcaccta

SEQ ID NO: 40649 - DNA, 25 bp, Mus musculus
aactgtaaatctaaagcgaaagcgg

SEQ ID NO: 40650 - DNA, 25 bp, Mus musculus
aactgtaaatcttaagcgaaagcgg

SEQ ID NO: 40651 - DNA, 25 bp, Mus musculus
aactgtaaatgtctgccccttatgt

SEQ ID NO: 40652 - DNA, 25 bp, Mus musculus
aactgtaaatgtgtgccccttatgt

SEQ ID NO: 40653 - DNA, 25 bp, Mus musculus
aactgtaaccttatcagcgtgagca

SEQ ID NO: 40654 - DNA, 25 bp, Mus musculus
aactgtaaccttttcagcgtgagca

SEQ ID NO: 40655 - DNA, 25 bp, Mus musculus
aactgtaactgtattttcattctgt

SEQ ID NO: 40656 - DNA, 25 bp, Mus musculus
aactgtaactgttttttcattctgt

SEQ ID NO: 40657 - DNA, 25 bp, Mus musculus
aactgtaagaagagctccctgtctc

SEQ ID NO: 40658 - DNA, 25 bp, Mus musculus
aactgtaagaagtgctccctgtctc

SEQ ID NO: 40659 - DNA, 25 bp, Mus musculus
aactgtaagtgtcttccttaaatat

SEQ ID NO: 40660 - DNA, 25 bp, Mus musculus
aactgtaagtgtgttccttaaatat

SEQ ID NO: 40661 - DNA, 25 bp, Mus musculus
aactgtaatactaagcctccctgat

SEQ ID NO: 40662 - DNA, 25 bp, Mus musculus
aactgtaatacttagcctccctgat

SEQ ID NO: 40663 - DNA, 25 bp, Mus musculus
aactgtaatctgagagactgtcatt

SEQ ID NO: 40664 - DNA, 25 bp, Mus musculus
aactgtaatctgtgagactgtcatt

SEQ ID NO: 40665 - DNA, 25 bp, Mus musculus
aactgtaatgtaagccaggccctct

SEQ ID NO: 40666 - DNA, 25 bp, Mus musculus
aactgtaatgtatgccaggccctct

SEQ ID NO: 40667 - DNA, 25 bp, Mus musculus
aactgtaatgttcacctgtttggaa

SEQ ID NO: 40668 - DNA, 25 bp, Mus musculus
aactgtaatgttgacctgtttggaa

SEQ ID NO: 40669 - DNA, 25 bp, Mus musculus
aactgtaattcaagtaatgtatgtt

SEQ ID NO: 40670 - DNA, 25 bp, Mus musculus
aactgtaattcatgtaatgtatgtt

SEQ ID NO: 40671 - DNA, 25 bp, Mus musculus
aactgtacacagatcacatcttgga

SEQ ID NO: 40672 - DNA, 25 bp, Mus musculus
aactgtacacagttcacatcttgga

SEQ ID NO: 40673 - DNA, 25 bp, Mus musculus
aactgtacagatctcacatacccac

SEQ ID NO: 40674 - DNA, 25 bp, Mus musculus
aactgtacagatgtcacatacccac

SEQ ID NO: 40675 - DNA, 25 bp, Mus musculus
aactgtacaggtcctcggctatatt

SEQ ID NO: 40676 - DNA, 25 bp, Mus musculus
aactgtacaggtgctcggctatatt

SEQ ID NO: 40677 - DNA, 25 bp, Mus musculus
aactgtacatagctatctgcacgga

SEQ ID NO: 40678 - DNA, 25 bp, Mus musculus
aactgtacataggtatctgcacgga

SEQ ID NO: 40679 - DNA, 25 bp, Mus musculus
aactgtaccagaccggatgcaccgg

SEQ ID NO: 40680 - DNA, 25 bp, Mus musculus
aactgtaccagagcggatgcaccgg

SEQ ID NO: 40681 - DNA, 25 bp, Mus musculus
aactgtaccagcagtccaaagacaa

SEQ ID NO: 40682 - DNA, 25 bp, Mus musculus
aactgtaccagctgtccaaagacaa

SEQ ID NO: 40683 - DNA, 25 bp, Mus musculus
aactgtacccagatactcatgaaat

SEQ ID NO: 40684 - DNA, 25 bp, Mus musculus
aactgtacccagttactcatgaaat

SEQ ID NO: 40685 - DNA, 25 bp, Mus musculus
aactgtaccgacaggttttgtgtca

SEQ ID NO: 40686 - DNA, 25 bp, Mus musculus
aactgtaccgactggttttgtgtca

SEQ ID NO: 40687 - DNA, 25 bp, Mus musculus
aactgtaccgtacgattagtgtgtt

SEQ ID NO: 40688 - DNA, 25 bp, Mus musculus
aactgtaccgtaggattagtgtgtt

SEQ ID NO: 40689 - DNA, 25 bp, Mus musculus
aactgtacgcttaagatttgaacat

SEQ ID NO: 40690 - DNA, 25 bp, Mus musculus
aactgtacgctttagatttgaacat

SEQ ID NO: 40691 - DNA, 25 bp, Mus musculus
aactgtactagccaaatacgctgaa

SEQ ID NO: 40692 - DNA, 25 bp, Mus musculus
aactgtactagcgaaatacgctgaa

SEQ ID NO: 40693 - DNA, 25 bp, Mus musculus
aactgtactatcatcaattcccaat

SEQ ID NO: 40694 - DNA, 25 bp, Mus musculus
aactgtactatcttcaattcccaat

SEQ ID NO: 40695 - DNA, 25 bp, Mus musculus
aactgtactcccagattggaacgac

SEQ ID NO: 40696 - DNA, 25 bp, Mus musculus
aactgtactccctgattggaacgac

SEQ ID NO: 40697 - DNA, 25 bp, Mus musculus
aactgtactgtcagaactttgcccc

SEQ ID NO: 40698 - DNA, 25 bp, Mus musculus
aactgtactgtctgaactttgcccc

SEQ ID NO: 40699 - DNA, 25 bp, Mus musculus
aactgtacttcacggatctgccaat

SEQ ID NO: 40700 - DNA, 25 bp, Mus musculus
aactgtacttcagggatctgccaat

SEQ ID NO: 40701 - DNA, 25 bp, Mus musculus
aactgtacttttactcgtgacgatg

SEQ ID NO: 40702 - DNA, 25 bp, Mus musculus
aactgtactttttctcgtgacgatg

SEQ ID NO: 40703 - DNA, 25 bp, Mus musculus
aactgtagacgccttggtcttcctg

SEQ ID NO: 40704 - DNA, 25 bp, Mus musculus
aactgtagacgcgttggtcttcctg

SEQ ID NO: 40705 - DNA, 25 bp, Mus musculus
aactgtagcaccagaacccattctt

SEQ ID NO: 40706 - DNA, 25 bp, Mus musculus
aactgtagcacctgaacccattctt

SEQ ID NO: 40707 - DNA, 25 bp, Mus musculus
aactgtaggaagcttggtgccaaca

SEQ ID NO: 40708 - DNA, 25 bp, Mus musculus
aactgtaggaaggttggtgccaaca

SEQ ID NO: 40709 - DNA, 25 bp, Mus musculus
aactgtaggacgaggcttctgggac

SEQ ID NO: 40710 - DNA, 25 bp, Mus musculus
aactgtaggacgtggcttctgggac

SEQ ID NO: 40711 - DNA, 25 bp, Mus musculus
aactgtaggctacggaagtaggcca

SEQ ID NO: 40712 - DNA, 25 bp, Mus musculus
aactgtaggctactattgcaactgg

SEQ ID NO: 40713 - DNA, 25 bp, Mus musculus
aactgtaggctagggaagtaggcca

SEQ ID NO: 40714 - DNA, 25 bp, Mus musculus
aactgtaggctagtattgcaactgg

SEQ ID NO: 40715 - DNA, 25 bp, Mus musculus
aactgtagggcgatgtctccaaaca

SEQ ID NO: 40716 - DNA, 25 bp, Mus musculus
aactgtagggcgttgtctccaaaca

SEQ ID NO: 40717 - DNA, 25 bp, Mus musculus
aactgtaggtggcactgttccaggt

SEQ ID NO: 40718 - DNA, 25 bp, Mus musculus
aactgtaggtgggactgttccaggt

SEQ ID NO: 40719 - DNA, 25 bp, Mus musculus
aactgtataatgaacttcctgggca

SEQ ID NO: 40720 - DNA, 25 bp, Mus musculus
aactgtataatgtacttcctgggca

SEQ ID NO: 40721 - DNA, 25 bp, Mus musculus
aactgtatactgactttagtgaaac

SEQ ID NO: 40722 - DNA, 25 bp, Mus musculus
aactgtatactgtctttagtgaaac

SEQ ID NO: 40723 - DNA, 25 bp, Mus musculus
aactgtatagatagtcacctctgtg

SEQ ID NO: 40724 - DNA, 25 bp, Mus musculus
aactgtatagattgtcacctctgtg

SEQ ID NO: 40725 - DNA, 25 bp, Mus musculus
aactgtatcaagagcccgtgttgga

SEQ ID NO: 40726 - DNA, 25 bp, Mus musculus
aactgtatcaagtgcccgtgttgga

SEQ ID NO: 40727 - DNA, 25 bp, Mus musculus
aactgtatcaatccagccatcttgg

SEQ ID NO: 40728 - DNA, 25 bp, Mus musculus
aactgtatcaatgcagccatcttgg

SEQ ID NO: 40729 - DNA, 25 bp, Mus musculus
aactgtatcacgattatacctgcag

SEQ ID NO: 40730 - DNA, 25 bp, Mus musculus
aactgtatcacgtttatacctgcag

SEQ ID NO: 40731 - DNA, 25 bp, Mus musculus
aactgtatcagacttgttacggctc

SEQ ID NO: 40732 - DNA, 25 bp, Mus musculus
aactgtatcagagttgttacggctc

SEQ ID NO: 40733 - DNA, 25 bp, Mus musculus
aactgtatctacatgctgtgttgca

SEQ ID NO: 40734 - DNA, 25 bp, Mus musculus
aactgtatctacttgctgtgttgca

SEQ ID NO: 40735 - DNA, 25 bp, Mus musculus
aactgtatctatcattttcccttcc

SEQ ID NO: 40736 - DNA, 25 bp, Mus musculus
aactgtatctatgattttcccttcc

SEQ ID NO: 40737 - DNA, 25 bp, Mus musculus
aactgtatctgaaccagctcctaag

SEQ ID NO: 40738 - DNA, 25 bp, Mus musculus
aactgtatctgatccagctcctaag

SEQ ID NO: 40739 - DNA, 25 bp, Mus musculus
aactgtatcttcactttgtcttatg

SEQ ID NO: 40740 - DNA, 25 bp, Mus musculus
aactgtatcttctctttgtcttatg

SEQ ID NO: 40741 - DNA, 25 bp, Mus musculus
aactgtatctttaggatggagtgcg

SEQ ID NO: 40742 - DNA, 25 bp, Mus musculus
aactgtatcttttggatggagtgcg

SEQ ID NO: 40743 - DNA, 25 bp, Mus musculus
aactgtatgctacatgtatgctggt

SEQ ID NO: 40744 - DNA, 25 bp, Mus musculus
aactgtatgctagatgtatgctggt

SEQ ID NO: 40745 - DNA, 25 bp, Mus musculus
aactgtatggttcgactgctcttaa

SEQ ID NO: 40746 - DNA, 25 bp, Mus musculus
aactgtatggttggactgctcttaa

SEQ ID NO: 40747 - DNA, 25 bp, Mus musculus
aactgtattacaacccagggctgga

SEQ ID NO: 40748 - DNA, 25 bp, Mus musculus
aactgtattacaatgccagccccaa

SEQ ID NO: 40749 - DNA, 25 bp, Mus musculus
aactgtattacatcccagggctgga

SEQ ID NO: 40750 - DNA, 25 bp, Mus musculus
aactgtattacattgccagccccaa

SEQ ID NO: 40751 - DNA, 25 bp, Mus musculus
aactgtattatcaaagggctttaat

SEQ ID NO: 40752 - DNA, 25 bp, Mus musculus
aactgtattatctaagggctttaat

SEQ ID NO: 40753 - DNA, 25 bp, Mus musculus
aactgtattattccagtgctgagga

SEQ ID NO: 40754 - DNA, 25 bp, Mus musculus
aactgtattattgcagtgctgagga

SEQ ID NO: 40755 - DNA, 25 bp, Mus musculus
aactgtattctgaaccatttagggt

SEQ ID NO: 40756 - DNA, 25 bp, Mus musculus
aactgtattctgtaccatttagggt

SEQ ID NO: 40757 - DNA, 25 bp, Mus musculus
aactgtattgctatgcattaattat

SEQ ID NO: 40758 - DNA, 25 bp, Mus musculus
aactgtattgctttgcattaattat

SEQ ID NO: 40759 - DNA, 25 bp, Mus musculus
aactgtatttgcaaatccaacactg

SEQ ID NO: 40760 - DNA, 25 bp, Mus musculus
aactgtatttgctaatccaacactg

SEQ ID NO: 40761 - DNA, 25 bp, Mus musculus
aactgtattttaatcctgagattcc

SEQ ID NO: 40762 - DNA, 25 bp, Mus musculus
aactgtattttattcctgagattcc

SEQ ID NO: 40763 - DNA, 25 bp, Mus musculus
aactgtcaaattatatcggtcatta

SEQ ID NO: 40764 - DNA, 25 bp, Mus musculus
aactgtcaaattttatcggtcatta

SEQ ID NO: 40765 - DNA, 25 bp, Mus musculus
aactgtcacagtagcagaggccctg

SEQ ID NO: 40766 - DNA, 25 bp, Mus musculus
aactgtcacagttgcagaggccctg

SEQ ID NO: 40767 - DNA, 25 bp, Mus musculus
aactgtcacataacttttcaatggg

SEQ ID NO: 40768 - DNA, 25 bp, Mus musculus
aactgtcacatatcttttcaatggg

SEQ ID NO: 40769 - DNA, 25 bp, Mus musculus
aactgtcaccaacgtggctcctagt

SEQ ID NO: 40770 - DNA, 25 bp, Mus musculus
aactgtcaccaaggtggctcctagt

SEQ ID NO: 40771 - DNA, 25 bp, Mus musculus
aactgtcacccaagattcttgttat

SEQ ID NO: 40772 - DNA, 25 bp, Mus musculus
aactgtcacccatgattcttgttat

SEQ ID NO: 40773 - DNA, 25 bp, Mus musculus
aactgtcacgaaaaactgttaggag

SEQ ID NO: 40774 - DNA, 25 bp, Mus musculus
aactgtcacgaataactgttaggag

SEQ ID NO: 40775 - DNA, 25 bp, Mus musculus
aactgtcacggcagggtcagaactg

SEQ ID NO: 40776 - DNA, 25 bp, Mus musculus
aactgtcacggctgggtcagaactg

SEQ ID NO: 40777 - DNA, 25 bp, Mus musculus
aactgtcactagactgattctcttc

SEQ ID NO: 40778 - DNA, 25 bp, Mus musculus
aactgtcactagtctgattctcttc

SEQ ID NO: 40779 - DNA, 25 bp, Mus musculus
aactgtcactccaatactagcccaa

SEQ ID NO: 40780 - DNA, 25 bp, Mus musculus
aactgtcactcctatactagcccaa

SEQ ID NO: 40781 - DNA, 25 bp, Mus musculus
aactgtcacttcacagtggtcagag

SEQ ID NO: 40782 - DNA, 25 bp, Mus musculus
aactgtcacttctcagtggtcagag

SEQ ID NO: 40783 - DNA, 25 bp, Mus musculus
aactgtcacttgacaggttaggact

SEQ ID NO: 40784 - DNA, 25 bp, Mus musculus
aactgtcacttgtcaggttaggact

SEQ ID NO: 40785 - DNA, 25 bp, Mus musculus
aactgtcagattccttgtctgtgac

SEQ ID NO: 40786 - DNA, 25 bp, Mus musculus
aactgtcagattgcttgtctgtgac

SEQ ID NO: 40787 - DNA, 25 bp, Mus musculus
aactgtcagcagcttcaatcgctca

SEQ ID NO: 40788 - DNA, 25 bp, Mus musculus
aactgtcagcaggttcaatcgctca

SEQ ID NO: 40789 - DNA, 25 bp, Mus musculus
aactgtcaggaccagttctttcctc

SEQ ID NO: 40790 - DNA, 25 bp, Mus musculus
aactgtcaggacgagttctttcctc

SEQ ID NO: 40791 - DNA, 25 bp, Mus musculus
aactgtcagggtcagcagtcagtga

SEQ ID NO: 40792 - DNA, 25 bp, Mus musculus
aactgtcagggtgagcagtcagtga

SEQ ID NO: 40793 - DNA, 25 bp, Mus musculus
aactgtcagtgtctgctggagtcac

SEQ ID NO: 40794 - DNA, 25 bp, Mus musculus
aactgtcagtgtgtgctggagtcac

SEQ ID NO: 40795 - DNA, 25 bp, Mus musculus
aactgtcagttcagcagacccaggc

SEQ ID NO: 40796 - DNA, 25 bp, Mus musculus
aactgtcagttctgcagacccaggc

SEQ ID NO: 40797 - DNA, 25 bp, Mus musculus
aactgtcattggcacggtttcctgc

SEQ ID NO: 40798 - DNA, 25 bp, Mus musculus
aactgtcattggcaggcctttccaa

SEQ ID NO: 40799 - DNA, 25 bp, Mus musculus
aactgtcattgggacggtttcctgc

SEQ ID NO: 40800 - DNA, 25 bp, Mus musculus
aactgtcattgggaggcctttccaa

SEQ ID NO: 40801 - DNA, 25 bp, Mus musculus
aactgtcatttcagtgtcatcctgg

SEQ ID NO: 40802 - DNA, 25 bp, Mus musculus
aactgtcatttctgtgtcatcctgg

SEQ ID NO: 40803 - DNA, 25 bp, Mus musculus
aactgtccaagcacagtgattgtct

SEQ ID NO: 40804 - DNA, 25 bp, Mus musculus
aactgtccaagctcagtgattgtct

SEQ ID NO: 40805 - DNA, 25 bp, Mus musculus
aactgtccacagaaatcattgagaa

SEQ ID NO: 40806 - DNA, 25 bp, Mus musculus
aactgtccacagtaatcattgagaa

SEQ ID NO: 40807 - DNA, 25 bp, Mus musculus
aactgtccagctatgaggaaatctg

SEQ ID NO: 40808 - DNA, 25 bp, Mus musculus
aactgtccagctttgaggaaatctg

SEQ ID NO: 40809 - DNA, 25 bp, Mus musculus
aactgtccagggaaatcatcagggc

SEQ ID NO: 40810 - DNA, 25 bp, Mus musculus
aactgtccagggtaatcatcagggc

SEQ ID NO: 40811 - DNA, 25 bp, Mus musculus
aactgtccagtactgtctgagcctc

SEQ ID NO: 40812 - DNA, 25 bp, Mus musculus
aactgtccagtagtgtctgagcctc

SEQ ID NO: 40813 - DNA, 25 bp, Mus musculus
aactgtccatccaccaggttgagat

SEQ ID NO: 40814 - DNA, 25 bp, Mus musculus
aactgtccatcctccaggttgagat

SEQ ID NO: 40815 - DNA, 25 bp, Mus musculus
aactgtccatctaccttatttattt

SEQ ID NO: 40816 - DNA, 25 bp, Mus musculus
aactgtccatcttccttatttattt

SEQ ID NO: 40817 - DNA, 25 bp, Mus musculus
aactgtccatttctccattttactg

SEQ ID NO: 40818 - DNA, 25 bp, Mus musculus
aactgtccatttgtccattttactg

SEQ ID NO: 40819 - DNA, 25 bp, Mus musculus
aactgtcccatgcttgtaagtagtg

SEQ ID NO: 40820 - DNA, 25 bp, Mus musculus
aactgtcccatggttgtaagtagtg

SEQ ID NO: 40821 - DNA, 25 bp, Mus musculus
aactgtccccagaataaccctgtag

SEQ ID NO: 40822 - DNA, 25 bp, Mus musculus
aactgtccccagtataaccctgtag

SEQ ID NO: 40823 - DNA, 25 bp, Mus musculus
aactgtcctgaactggagcccggga

SEQ ID NO: 40824 - DNA, 25 bp, Mus musculus
aactgtcctgaagtggagcccggga

SEQ ID NO: 40825 - DNA, 25 bp, Mus musculus
aactgtcctgacagaggcttactca

SEQ ID NO: 40826 - DNA, 25 bp, Mus musculus
aactgtcctgacatcatgaatgcca

SEQ ID NO: 40827 - DNA, 25 bp, Mus musculus
aactgtcctgactgaggcttactca

SEQ ID NO: 40828 - DNA, 25 bp, Mus musculus
aactgtcctgacttcatgaatgcca

SEQ ID NO: 40829 - DNA, 25 bp, Mus musculus
aactgtcctggtaaagctgcttctc

SEQ ID NO: 40830 - DNA, 25 bp, Mus musculus
aactgtcctggttaagctgcttctc

SEQ ID NO: 40831 - DNA, 25 bp, Mus musculus
aactgtcctgtgcatatctaaggta

SEQ ID NO: 40832 - DNA, 25 bp, Mus musculus
aactgtcctgtggatatctaaggta

SEQ ID NO: 40833 - DNA, 25 bp, Mus musculus
aactgtccttgactctgaatcatct

SEQ ID NO: 40834 - DNA, 25 bp, Mus musculus
aactgtccttgacttttcttctcag

SEQ ID NO: 40835 - DNA, 25 bp, Mus musculus
aactgtccttgagtctgaatcatct

SEQ ID NO: 40836 - DNA, 25 bp, Mus musculus
aactgtccttgagttttcttctcag

SEQ ID NO: 40837 - DNA, 25 bp, Mus musculus
aactgtcctttcattacctgtattg

SEQ ID NO: 40838 - DNA, 25 bp, Mus musculus
aactgtcctttctttacctgtattg

SEQ ID NO: 40839 - DNA, 25 bp, Mus musculus
aactgtcgaagtcgccaacctatta

SEQ ID NO: 40840 - DNA, 25 bp, Mus musculus
aactgtcgaagtggccaacctatta

SEQ ID NO: 40841 - DNA, 25 bp, Mus musculus
aactgtcgactgcagtgtgactgga

SEQ ID NO: 40842 - DNA, 25 bp, Mus musculus
aactgtcgactggagtgtgactgga

SEQ ID NO: 40843 - DNA, 25 bp, Mus musculus
aactgtcgtgataattcctgtgaga

SEQ ID NO: 40844 - DNA, 25 bp, Mus musculus
aactgtcgtgattattcctgtgaga

SEQ ID NO: 40845 - DNA, 25 bp, Mus musculus
aactgtctaaatcatggcatcgtaa

SEQ ID NO: 40846 - DNA, 25 bp, Mus musculus
aactgtctaaatgatggcatcgtaa

SEQ ID NO: 40847 - DNA, 25 bp, Mus musculus
aactgtctaagcatctatctgctgg

SEQ ID NO: 40848 - DNA, 25 bp, Mus musculus
aactgtctaagcttctatctgctgg

SEQ ID NO: 40849 - DNA, 25 bp, Mus musculus
aactgtctacctcctgagatagcct

SEQ ID NO: 40850 - DNA, 25 bp, Mus musculus
aactgtctacctgctgagatagcct

SEQ ID NO: 40851 - DNA, 25 bp, Mus musculus
aactgtctcatgaaactcttctacg

SEQ ID NO: 40852 - DNA, 25 bp, Mus musculus
aactgtctcatgtaactcttctacg

SEQ ID NO: 40853 - DNA, 25 bp, Mus musculus
aactgtctccagagcttccaagggt

SEQ ID NO: 40854 - DNA, 25 bp, Mus musculus
aactgtctccagtgcttccaagggt

SEQ ID NO: 40855 - DNA, 25 bp, Mus musculus
aactgtctcctgaaactgttggttc

SEQ ID NO: 40856 - DNA, 25 bp, Mus musculus
aactgtctcctgtaactgttggttc

SEQ ID NO: 40857 - DNA, 25 bp, Mus musculus
aactgtctctagatctggaaccaaa

SEQ ID NO: 40858 - DNA, 25 bp, Mus musculus
aactgtctctagttctggaaccaaa

SEQ ID NO: 40859 - DNA, 25 bp, Mus musculus
aactgtctcttactgcttgttttct

SEQ ID NO: 40860 - DNA, 25 bp, Mus musculus
aactgtctcttagtgcttgttttct

SEQ ID NO: 40861 - DNA, 25 bp, Mus musculus
aactgtctggttagtactttttatg

SEQ ID NO: 40862 - DNA, 25 bp, Mus musculus
aactgtctggtttgtactttttatg

SEQ ID NO: 40863 - DNA, 25 bp, Mus musculus
aactgtctgtcgcaaataaagcatc

SEQ ID NO: 40864 - DNA, 25 bp, Mus musculus
aactgtctgtcggaaataaagcatc

SEQ ID NO: 40865 - DNA, 25 bp, Mus musculus
aactgtctgtctatagtcattttac

SEQ ID NO: 40866 - DNA, 25 bp, Mus musculus
aactgtctgtctttagtcattttac

SEQ ID NO: 40867 - DNA, 25 bp, Mus musculus
aactgtctgtgtcgttgatcctgct

SEQ ID NO: 40868 - DNA, 25 bp, Mus musculus
aactgtctgtgtggttgatcctgct

SEQ ID NO: 40869 - DNA, 25 bp, Mus musculus
aactgtctgttacctaggctcttaa

SEQ ID NO: 40870 - DNA, 25 bp, Mus musculus
aactgtctgttagctaggctcttaa

SEQ ID NO: 40871 - DNA, 25 bp, Mus musculus
aactgtctgtttaccatttgttggt

SEQ ID NO: 40872 - DNA, 25 bp, Mus musculus
aactgtctgttttccatttgttggt

SEQ ID NO: 40873 - DNA, 25 bp, Mus musculus
aactgtcttaagcatcctgagtaac

SEQ ID NO: 40874 - DNA, 25 bp, Mus musculus
aactgtcttaaggatcctgagtaac

SEQ ID NO: 40875 - DNA, 25 bp, Mus musculus
aactgtcttcccatgcactcagtat

SEQ ID NO: 40876 - DNA, 25 bp, Mus musculus
aactgtcttcccttgcactcagtat

SEQ ID NO: 40877 - DNA, 25 bp, Mus musculus
aactgtcttctactcagaaccaagc

SEQ ID NO: 40878 - DNA, 25 bp, Mus musculus
aactgtcttctagtcagaaccaagc

SEQ ID NO: 40879 - DNA, 25 bp, Mus musculus
aactgtcttcttcatgattcggtaa

SEQ ID NO: 40880 - DNA, 25 bp, Mus musculus
aactgtcttcttgatgattcggtaa

SEQ ID NO: 40881 - DNA, 25 bp, Mus musculus
aactgtcttgccattttcattattt

SEQ ID NO: 40882 - DNA, 25 bp, Mus musculus
aactgtcttgcctttttcattattt

SEQ ID NO: 40883 - DNA, 25 bp, Mus musculus
aactgtctttatatatcattaacca

SEQ ID NO: 40884 - DNA, 25 bp, Mus musculus
aactgtctttatttatcattaacca

SEQ ID NO: 40885 - DNA, 25 bp, Mus musculus
aactgtctttgtcacttgatagcca

SEQ ID NO: 40886 - DNA, 25 bp, Mus musculus
aactgtctttgtgacttgatagcca

SEQ ID NO: 40887 - DNA, 25 bp, Mus musculus
aactgtgaaactcactattggtttt

SEQ ID NO: 40888 - DNA, 25 bp, Mus musculus
aactgtgaaactgactattggtttt

SEQ ID NO: 40889 - DNA, 25 bp, Mus musculus
aactgtgaacagaggcttgcttgct

SEQ ID NO: 40890 - DNA, 25 bp, Mus musculus
aactgtgaacagtggcttgcttgct

SEQ ID NO: 40891 - DNA, 25 bp, Mus musculus
aactgtgaacgaactacatatatgt

SEQ ID NO: 40892 - DNA, 25 bp, Mus musculus
aactgtgaacgatctacatatatgt

SEQ ID NO: 40893 - DNA, 25 bp, Mus musculus
aactgtgaaggaaccccaggccagc

SEQ ID NO: 40894 - DNA, 25 bp, Mus musculus
aactgtgaaggatccccaggccagc

SEQ ID NO: 40895 - DNA, 25 bp, Mus musculus
aactgtgaagtccatggtcatccaa

SEQ ID NO: 40896 - DNA, 25 bp, Mus musculus
aactgtgaagtcgatggtcatccaa

SEQ ID NO: 40897 - DNA, 25 bp, Mus musculus
aactgtgaatacacttcctgaaggg

SEQ ID NO: 40898 - DNA, 25 bp, Mus musculus
aactgtgaatactcttcctgaaggg

SEQ ID NO: 40899 - DNA, 25 bp, Mus musculus
aactgtgacaaaaccattgatccta

SEQ ID NO: 40900 - DNA, 25 bp, Mus musculus
aactgtgacaaatccattgatccta

SEQ ID NO: 40901 - DNA, 25 bp, Mus musculus
aactgtgacaagcatggccggtaca

SEQ ID NO: 40902 - DNA, 25 bp, Mus musculus
aactgtgacaaggatggccggtaca

SEQ ID NO: 40903 - DNA, 25 bp, Mus musculus
aactgtgacagtatactctgaaaac

SEQ ID NO: 40904 - DNA, 25 bp, Mus musculus
aactgtgacagtttactctgaaaac

SEQ ID NO: 40905 - DNA, 25 bp, Mus musculus
aactgtgacattcccgcatcgctgg

SEQ ID NO: 40906 - DNA, 25 bp, Mus musculus
aactgtgacattgccgcatcgctgg

SEQ ID NO: 40907 - DNA, 25 bp, Mus musculus
aactgtgaccctactgttctgaacc

SEQ ID NO: 40908 - DNA, 25 bp, Mus musculus
aactgtgacccttctgttctgaacc

SEQ ID NO: 40909 - DNA, 25 bp, Mus musculus
aactgtgacctcatggtagtcctgg

SEQ ID NO: 40910 - DNA, 25 bp, Mus musculus
aactgtgacctcttggtagtcctgg

SEQ ID NO: 40911 - DNA, 25 bp, Mus musculus
aactgtgacctgatacattcacaaa

SEQ ID NO: 40912 - DNA, 25 bp, Mus musculus
aactgtgacctgttacattcacaaa

SEQ ID NO: 40913 - DNA, 25 bp, Mus musculus
aactgtgaccttaaacacatctgtt

SEQ ID NO: 40914 - DNA, 25 bp, Mus musculus
aactgtgacctttaacacatctgtt

SEQ ID NO: 40915 - DNA, 25 bp, Mus musculus
aactgtgacgagattatgtctctat

SEQ ID NO: 40916 - DNA, 25 bp, Mus musculus
aactgtgacgagtttatgtctctat

SEQ ID NO: 40917 - DNA, 25 bp, Mus musculus
aactgtgactcacgtccgacaggtc

SEQ ID NO: 40918 - DNA, 25 bp, Mus musculus
aactgtgactcaggtccgacaggtc

SEQ ID NO: 40919 - DNA, 25 bp, Mus musculus
aactgtgactcccagcggtgtgtcc

SEQ ID NO: 40920 - DNA, 25 bp, Mus musculus
aactgtgactccgagcggtgtgtcc

SEQ ID NO: 40921 - DNA, 25 bp, Mus musculus
aactgtgagcacatgtcacgcgttc

SEQ ID NO: 40922 - DNA, 25 bp, Mus musculus
aactgtgagcacttgtcacgcgttc

SEQ ID NO: 40923 - DNA, 25 bp, Mus musculus
aactgtgagcgccatggccgtgtac

SEQ ID NO: 40924 - DNA, 25 bp, Mus musculus
aactgtgagcgcgatggccgtgtac

SEQ ID NO: 40925 - DNA, 25 bp, Mus musculus
aactgtgaggttctactaatcagct

SEQ ID NO: 40926 - DNA, 25 bp, Mus musculus
aactgtgaggttgtactaatcagct

SEQ ID NO: 40927 - DNA, 25 bp, Mus musculus
aactgtgatctgaactataatgtac

SEQ ID NO: 40928 - DNA, 25 bp, Mus musculus
aactgtgatctgtactataatgtac

SEQ ID NO: 40929 - DNA, 25 bp, Mus musculus
aactgtgatgagactgtcatctgga

SEQ ID NO: 40930 - DNA, 25 bp, Mus musculus
aactgtgatgagtctgtcatctgga

SEQ ID NO: 40931 - DNA, 25 bp, Mus musculus
aactgtgatgcaccagctaactcag

SEQ ID NO: 40932 - DNA, 25 bp, Mus musculus
aactgtgatgcagcagctaactcag

SEQ ID NO: 40933 - DNA, 25 bp, Mus musculus
aactgtgatgtcaccatgcggctga

SEQ ID NO: 40934 - DNA, 25 bp, Mus musculus
aactgtgatgtcagtggtcatggca

SEQ ID NO: 40935 - DNA, 25 bp, Mus musculus
aactgtgatgtctccatgcggctga

SEQ ID NO: 40936 - DNA, 25 bp, Mus musculus
aactgtgatgtctgtggtcatggca

SEQ ID NO: 40937 - DNA, 25 bp, Mus musculus
aactgtgatgtgagcgtagaatatt

SEQ ID NO: 40938 - DNA, 25 bp, Mus musculus
aactgtgatgtgtgcgtagaatatt

SEQ ID NO: 40939 - DNA, 25 bp, Mus musculus
aactgtgattccatctcttgtaact

SEQ ID NO: 40940 - DNA, 25 bp, Mus musculus
aactgtgattccttctcttgtaact

SEQ ID NO: 40941 - DNA, 25 bp, Mus musculus
aactgtgcaactcaatcccttccag

SEQ ID NO: 40942 - DNA, 25 bp, Mus musculus
aactgtgcaactgaatcccttccag

SEQ ID NO: 40943 - DNA, 25 bp, Mus musculus
aactgtgcaagcaatctggtcatac

SEQ ID NO: 40944 - DNA, 25 bp, Mus musculus
aactgtgcaagctatctggtcatac

SEQ ID NO: 40945 - DNA, 25 bp, Mus musculus
aactgtgcagctatgttccatggag

SEQ ID NO: 40946 - DNA, 25 bp, Mus musculus
aactgtgcagctcgtttagttccaa

SEQ ID NO: 40947 - DNA, 25 bp, Mus musculus
aactgtgcagctggtttagttccaa

SEQ ID NO: 40948 - DNA, 25 bp, Mus musculus
aactgtgcagctttgttccatggag

SEQ ID NO: 40949 - DNA, 25 bp, Mus musculus
aactgtgcagtcactgtggacatca

SEQ ID NO: 40950 - DNA, 25 bp, Mus musculus
aactgtgcagtccactataatcttg

SEQ ID NO: 40951 - DNA, 25 bp, Mus musculus
aactgtgcagtcgactataatcttg

SEQ ID NO: 40952 - DNA, 25 bp, Mus musculus
aactgtgcagtctctgtggacatca

SEQ ID NO: 40953 - DNA, 25 bp, Mus musculus
aactgtgcatacatcattcacgaca

SEQ ID NO: 40954 - DNA, 25 bp, Mus musculus
aactgtgcatacttcattcacgaca

SEQ ID NO: 40955 - DNA, 25 bp, Mus musculus
aactgtgcatcgattgcagagctgc

SEQ ID NO: 40956 - DNA, 25 bp, Mus musculus
aactgtgcatcgtttgcagagctgc

SEQ ID NO: 40957 - DNA, 25 bp, Mus musculus
aactgtgccaatagagcaccttcca

SEQ ID NO: 40958 - DNA, 25 bp, Mus musculus
aactgtgccaattgagcaccttcca

SEQ ID NO: 40959 - DNA, 25 bp, Mus musculus
aactgtgcccacatgccagccattt

SEQ ID NO: 40960 - DNA, 25 bp, Mus musculus
aactgtgcccacttgccagccattt

SEQ ID NO: 40961 - DNA, 25 bp, Mus musculus
aactgtgccccacaggacacagggc

SEQ ID NO: 40962 - DNA, 25 bp, Mus musculus
aactgtgccccagaggacacagggc

SEQ ID NO: 40963 - DNA, 25 bp, Mus musculus
aactgtgccccgattggtgagaagg

SEQ ID NO: 40964 - DNA, 25 bp, Mus musculus
aactgtgccccgtttggtgagaagg

SEQ ID NO: 40965 - DNA, 25 bp, Mus musculus
aactgtgccctaagaatttgatgtc

SEQ ID NO: 40966 - DNA, 25 bp, Mus musculus
aactgtgccctactgttgtctgtgg

SEQ ID NO: 40967 - DNA, 25 bp, Mus musculus
aactgtgccctagtgttgtctgtgg

SEQ ID NO: 40968 - DNA, 25 bp, Mus musculus
aactgtgccctatgaatttgatgtc

SEQ ID NO: 40969 - DNA, 25 bp, Mus musculus
aactgtgcctttccccaacttgtgg

SEQ ID NO: 40970 - DNA, 25 bp, Mus musculus
aactgtgcctttgcccaacttgtgg

SEQ ID NO: 40971 - DNA, 25 bp, Mus musculus
aactgtgcgtaacaactttgaaagc

SEQ ID NO: 40972 - DNA, 25 bp, Mus musculus
aactgtgcgtaagaactttgaaagc

SEQ ID NO: 40973 - DNA, 25 bp, Mus musculus
aactgtgcgtgtagtaagcctcccg

SEQ ID NO: 40974 - DNA, 25 bp, Mus musculus
aactgtgcgtgttgtaagcctcccg

SEQ ID NO: 40975 - DNA, 25 bp, Mus musculus
aactgtgcgtttacagattggttac

SEQ ID NO: 40976 - DNA, 25 bp, Mus musculus
aactgtgcgttttcagattggttac

SEQ ID NO: 40977 - DNA, 25 bp, Mus musculus
aactgtgctagccaggcagacctaa

SEQ ID NO: 40978 - DNA, 25 bp, Mus musculus
aactgtgctagcgaggcagacctaa

SEQ ID NO: 40979 - DNA, 25 bp, Mus musculus
aactgtgctcatactcatgtcttga

SEQ ID NO: 40980 - DNA, 25 bp, Mus musculus
aactgtgctcattctcatgtcttga

SEQ ID NO: 40981 - DNA, 25 bp, Mus musculus
aactgtgctccccagagtattgcca

SEQ ID NO: 40982 - DNA, 25 bp, Mus musculus
aactgtgctcccgagagtattgcca

SEQ ID NO: 40983 - DNA, 25 bp, Mus musculus
aactgtgctgaacacatgcgccgct

SEQ ID NO: 40984 - DNA, 25 bp, Mus musculus
aactgtgctgaagacatgcgccgct

SEQ ID NO: 40985 - DNA, 25 bp, Mus musculus
aactgtgctgatcgtgtgtaactga

SEQ ID NO: 40986 - DNA, 25 bp, Mus musculus
aactgtgctgatggtgtgtaactga

SEQ ID NO: 40987 - DNA, 25 bp, Mus musculus
aactgtgctgcaaatggactgtcac

SEQ ID NO: 40988 - DNA, 25 bp, Mus musculus
aactgtgctgcatatggactgtcac

SEQ ID NO: 40989 - DNA, 25 bp, Mus musculus
aactgtgctggcaagactctcaggc

SEQ ID NO: 40990 - DNA, 25 bp, Mus musculus
aactgtgctggctagactctcaggc

SEQ ID NO: 40991 - DNA, 25 bp, Mus musculus
aactgtgctggtacctttcttgagg

SEQ ID NO: 40992 - DNA, 25 bp, Mus musculus
aactgtgctggttcctttcttgagg

SEQ ID NO: 40993 - DNA, 25 bp, Mus musculus
aactgtgctgtacgatacaaatcta

SEQ ID NO: 40994 - DNA, 25 bp, Mus musculus
aactgtgctgtaggatacaaatcta

SEQ ID NO: 40995 - DNA, 25 bp, Mus musculus
aactgtggaacccattacaagctgg

SEQ ID NO: 40996 - DNA, 25 bp, Mus musculus
aactgtggaaccgattacaagctgg

SEQ ID NO: 40997 - DNA, 25 bp, Mus musculus
aactgtggaccccatgtccttactg

SEQ ID NO: 40998 - DNA, 25 bp, Mus musculus
aactgtggacccgatgtccttactg

SEQ ID NO: 40999 - DNA, 25 bp, Mus musculus
aactgtggacctcggtgcagttcct

SEQ ID NO: 41000 - DNA, 25 bp, Mus musculus
aactgtggacctgggtgcagttcct

SEQ ID NO: 41001 - DNA, 25 bp, Mus musculus
aactgtggagaaactggcagcagca

SEQ ID NO: 41002 - DNA, 25 bp, Mus musculus
aactgtggagaatctggcagcagca

SEQ ID NO: 41003 - DNA, 25 bp, Mus musculus
aactgtggagcgctctttacttaga

SEQ ID NO: 41004 - DNA, 25 bp, Mus musculus
aactgtggagcggtctttacttaga

SEQ ID NO: 41005 - DNA, 25 bp, Mus musculus
aactgtggaggtccactctccaaaa

SEQ ID NO: 41006 - DNA, 25 bp, Mus musculus
aactgtggaggtgcactctccaaaa

SEQ ID NO: 41007 - DNA, 25 bp, Mus musculus
aactgtggatcaatcggacccagaa

SEQ ID NO: 41008 - DNA, 25 bp, Mus musculus
aactgtggatcattcggacccagaa

SEQ ID NO: 41009 - DNA, 25 bp, Mus musculus
aactgtggatctctcaggccaggat

SEQ ID NO: 41010 - DNA, 25 bp, Mus musculus
aactgtggatctgtcaggccaggat

SEQ ID NO: 41011 - DNA, 25 bp, Mus musculus
aactgtggcaaaagtggtggtgcac

SEQ ID NO: 41012 - DNA, 25 bp, Mus musculus
aactgtggcaaatgtggtggtgcac

SEQ ID NO: 41013 - DNA, 25 bp, Mus musculus
aactgtggcacaaaggctaattacc

SEQ ID NO: 41014 - DNA, 25 bp, Mus musculus
aactgtggcacataggctaattacc

SEQ ID NO: 41015 - DNA, 25 bp, Mus musculus
aactgtggcactatagaaatgtatc

SEQ ID NO: 41016 - DNA, 25 bp, Mus musculus
aactgtggcactttagaaatgtatc

SEQ ID NO: 41017 - DNA, 25 bp, Mus musculus
aactgtggccataaactaagtgaac

SEQ ID NO: 41018 - DNA, 25 bp, Mus musculus
aactgtggccatagatacttgtaga

SEQ ID NO: 41019 - DNA, 25 bp, Mus musculus
aactgtggccattaactaagtgaac

SEQ ID NO: 41020 - DNA, 25 bp, Mus musculus
aactgtggccattgatacttgtaga

SEQ ID NO: 41021 - DNA, 25 bp, Mus musculus
aactgtggccggagctttgcccaat

SEQ ID NO: 41022 - DNA, 25 bp, Mus musculus
aactgtggccggtgctttgcccaat

SEQ ID NO: 41023 - DNA, 25 bp, Mus musculus
aactgtggcttacgacttttccaga

SEQ ID NO: 41024 - DNA, 25 bp, Mus musculus
aactgtggcttaggacttttccaga

SEQ ID NO: 41025 - DNA, 25 bp, Mus musculus
aactgtggcttccaggtgcaactct

SEQ ID NO: 41026 - DNA, 25 bp, Mus musculus
aactgtggcttcgaggtgcaactct

SEQ ID NO: 41027 - DNA, 25 bp, Mus musculus
aactgtgggaggactgtgtctccat

SEQ ID NO: 41028 - DNA, 25 bp, Mus musculus
aactgtgggaggtctgtgtctccat

SEQ ID NO: 41029 - DNA, 25 bp, Mus musculus
aactgtgggccaaacggcacaacat

SEQ ID NO: 41030 - DNA, 25 bp, Mus musculus
aactgtgggccatacggcacaacat

SEQ ID NO: 41031 - DNA, 25 bp, Mus musculus
aactgtgggccgaaactttcagaga

SEQ ID NO: 41032 - DNA, 25 bp, Mus musculus
aactgtgggccgtaactttcagaga

SEQ ID NO: 41033 - DNA, 25 bp, Mus musculus
aactgtgggctcaattcctagtggg

SEQ ID NO: 41034 - DNA, 25 bp, Mus musculus
aactgtgggctctattcctagtggg

SEQ ID NO: 41035 - DNA, 25 bp, Mus musculus
aactgtgggttgaaatcctgtgcta

SEQ ID NO: 41036 - DNA, 25 bp, Mus musculus
aactgtgggttgtaatcctgtgcta

SEQ ID NO: 41037 - DNA, 25 bp, Mus musculus
aactgtggtagcacaccaccctaat

SEQ ID NO: 41038 - DNA, 25 bp, Mus musculus
aactgtggtagctcaccaccctaat

SEQ ID NO: 41039 - DNA, 25 bp, Mus musculus
aactgtggtataactatatcaatgc

SEQ ID NO: 41040 - DNA, 25 bp, Mus musculus
aactgtggtatatctatatcaatgc

SEQ ID NO: 41041 - DNA, 25 bp, Mus musculus
aactgtggtcaaaacttgaaggcac

SEQ ID NO: 41042 - DNA, 25 bp, Mus musculus
aactgtggtcaatacttgaaggcac

SEQ ID NO: 41043 - DNA, 25 bp, Mus musculus
aactgtggtgaaacctgctcatcag

SEQ ID NO: 41044 - DNA, 25 bp, Mus musculus
aactgtggtgaatcctgctcatcag

SEQ ID NO: 41045 - DNA, 25 bp, Mus musculus
aactgtggttatcaaaattgtgacc

SEQ ID NO: 41046 - DNA, 25 bp, Mus musculus
aactgtggttatgaaaattgtgacc

SEQ ID NO: 41047 - DNA, 25 bp, Mus musculus
aactgtggttccaaacgtgtgatct

SEQ ID NO: 41048 - DNA, 25 bp, Mus musculus
aactgtggttcctaacgtgtgatct

SEQ ID NO: 41049 - DNA, 25 bp, Mus musculus
aactgtggttgtatcagtccggtct

SEQ ID NO: 41050 - DNA, 25 bp, Mus musculus
aactgtggttgtttcagtccggtct

SEQ ID NO: 41051 - DNA, 25 bp, Mus musculus
aactgtggtttcactcttgccatga

SEQ ID NO: 41052 - DNA, 25 bp, Mus musculus
aactgtggtttctctcttgccatga

SEQ ID NO: 41053 - DNA, 25 bp, Mus musculus
aactgtggttttcgtgactgtccta

SEQ ID NO: 41054 - DNA, 25 bp, Mus musculus
aactgtggttttggtgactgtccta

SEQ ID NO: 41055 - DNA, 25 bp, Mus musculus
aactgtgtaaaactctcgcctggaa

SEQ ID NO: 41056 - DNA, 25 bp, Mus musculus
aactgtgtaaaagtctcgcctggaa

SEQ ID NO: 41057 - DNA, 25 bp, Mus musculus
aactgtgtaacaagtctcccttttc

SEQ ID NO: 41058 - DNA, 25 bp, Mus musculus
aactgtgtaacatgtctcccttttc

SEQ ID NO: 41059 - DNA, 25 bp, Mus musculus
aactgtgtaactctggagaccagaa

SEQ ID NO: 41060 - DNA, 25 bp, Mus musculus
aactgtgtaactgtggagaccagaa

SEQ ID NO: 41061 - DNA, 25 bp, Mus musculus
aactgtgtaagcatctgctcatcaa

SEQ ID NO: 41062 - DNA, 25 bp, Mus musculus
aactgtgtaagcttctgctcatcaa

SEQ ID NO: 41063 - DNA, 25 bp, Mus musculus
aactgtgtactacagtgttcgtgag

SEQ ID NO: 41064 - DNA, 25 bp, Mus musculus
aactgtgtactagagtgttcgtgag

SEQ ID NO: 41065 - DNA, 25 bp, Mus musculus
aactgtgtacttcatgctttttgac

SEQ ID NO: 41066 - DNA, 25 bp, Mus musculus
aactgtgtacttgatgctttttgac

SEQ ID NO: 41067 - DNA, 25 bp, Mus musculus
aactgtgtagacagagccgggcagt

SEQ ID NO: 41068 - DNA, 25 bp, Mus musculus
aactgtgtagactgagccgggcagt

SEQ ID NO: 41069 - DNA, 25 bp, Mus musculus
aactgtgtagctcctggcaaacgtt

SEQ ID NO: 41070 - DNA, 25 bp, Mus musculus
aactgtgtagctgctggcaaacgtt

SEQ ID NO: 41071 - DNA, 25 bp, Mus musculus
aactgtgtagtcatgctggtaactc

SEQ ID NO: 41072 - DNA, 25 bp, Mus musculus
aactgtgtagtcttgctggtaactc

SEQ ID NO: 41073 - DNA, 25 bp, Mus musculus
aactgtgtatctattgtaacctata

SEQ ID NO: 41074 - DNA, 25 bp, Mus musculus
aactgtgtatcttttgtaacctata

SEQ ID NO: 41075 - DNA, 25 bp, Mus musculus
aactgtgtcaataaccagtgggtga

SEQ ID NO: 41076 - DNA, 25 bp, Mus musculus
aactgtgtcaattaccagtgggtga

SEQ ID NO: 41077 - DNA, 25 bp, Mus musculus
aactgtgtcaggagccactatgtca

SEQ ID NO: 41078 - DNA, 25 bp, Mus musculus
aactgtgtcaggtgccactatgtca

SEQ ID NO: 41079 - DNA, 25 bp, Mus musculus
aactgtgtcagtctactcactcaga

SEQ ID NO: 41080 - DNA, 25 bp, Mus musculus
aactgtgtcagtgtactcactcaga

SEQ ID NO: 41081 - DNA, 25 bp, Mus musculus
aactgtgtcattcaggagcttcgct

SEQ ID NO: 41082 - DNA, 25 bp, Mus musculus
aactgtgtcattgaggagcttcgct

SEQ ID NO: 41083 - DNA, 25 bp, Mus musculus
aactgtgtcccaccatgtggcactg

SEQ ID NO: 41084 - DNA, 25 bp, Mus musculus
aactgtgtcccagcatgtggcactg

SEQ ID NO: 41085 - DNA, 25 bp, Mus musculus
aactgtgtctatatgactacggctc

SEQ ID NO: 41086 - DNA, 25 bp, Mus musculus
aactgtgtctatttgactacggctc

SEQ ID NO: 41087 - DNA, 25 bp, Mus musculus
aactgtgtctgacctgtttgctagt

SEQ ID NO: 41088 - DNA, 25 bp, Mus musculus
aactgtgtctgagctgtttgctagt

SEQ ID NO: 41089 - DNA, 25 bp, Mus musculus
aactgtgtcttcatagttggaccag

SEQ ID NO: 41090 - DNA, 25 bp, Mus musculus
aactgtgtcttcttagttggaccag

SEQ ID NO: 41091 - DNA, 25 bp, Mus musculus
aactgtgtctttcaattgttcttac

SEQ ID NO: 41092 - DNA, 25 bp, Mus musculus
aactgtgtctttgaattgttcttac

SEQ ID NO: 41093 - DNA, 25 bp, Mus musculus
aactgtgtgaaaactctttcccgga

SEQ ID NO: 41094 - DNA, 25 bp, Mus musculus
aactgtgtgaaatctctttcccgga

SEQ ID NO: 41095 - DNA, 25 bp, Mus musculus
aactgtgtgaagaccccattagcca

SEQ ID NO: 41096 - DNA, 25 bp, Mus musculus
aactgtgtgaagaggctggcgttct

SEQ ID NO: 41097 - DNA, 25 bp, Mus musculus
aactgtgtgaagtccccattagcca

SEQ ID NO: 41098 - DNA, 25 bp, Mus musculus
aactgtgtgaagtggctggcgttct

SEQ ID NO: 41099 - DNA, 25 bp, Mus musculus
aactgtgtgactacactgcagcctt

SEQ ID NO: 41100 - DNA, 25 bp, Mus musculus
aactgtgtgacttcactgcagcctt

SEQ ID NO: 41101 - DNA, 25 bp, Mus musculus
aactgtgtgccacaagcatctcatc

SEQ ID NO: 41102 - DNA, 25 bp, Mus musculus
aactgtgtgccagaagcatctcatc

SEQ ID NO: 41103 - DNA, 25 bp, Mus musculus
aactgtgtgcctattgaacttccct

SEQ ID NO: 41104 - DNA, 25 bp, Mus musculus
aactgtgtgccttttgaacttccct

SEQ ID NO: 41105 - DNA, 25 bp, Mus musculus
aactgtgtgcttacatttgctgcag

SEQ ID NO: 41106 - DNA, 25 bp, Mus musculus
aactgtgtgctttcatttgctgcag

SEQ ID NO: 41107 - DNA, 25 bp, Mus musculus
aactgtgtggaaagaccttgtctca

SEQ ID NO: 41108 - DNA, 25 bp, Mus musculus
aactgtgtggaatgaccttgtctca

SEQ ID NO: 41109 - DNA, 25 bp, Mus musculus
aactgtgtgggcatgcatagatgac

SEQ ID NO: 41110 - DNA, 25 bp, Mus musculus
aactgtgtgggcttgcatagatgac

SEQ ID NO: 41111 - DNA, 25 bp, Mus musculus
aactgtgtggtcaacttgcctttat

SEQ ID NO: 41112 - DNA, 25 bp, Mus musculus
aactgtgtggtctacttgcctttat

SEQ ID NO: 41113 - DNA, 25 bp, Mus musculus
aactgtgtggttcctccagagctgc

SEQ ID NO: 41114 - DNA, 25 bp, Mus musculus
aactgtgtggttgctccagagctgc

SEQ ID NO: 41115 - DNA, 25 bp, Mus musculus
aactgtgtgtaactgcagctcctga

SEQ ID NO: 41116 - DNA, 25 bp, Mus musculus
aactgtgtgtaagtgcagctcctga

SEQ ID NO: 41117 - DNA, 25 bp, Mus musculus
aactgtgtgtacaggttgccaggcc

SEQ ID NO: 41118 - DNA, 25 bp, Mus musculus
aactgtgtgtactggttgccaggcc

SEQ ID NO: 41119 - DNA, 25 bp, Mus musculus
aactgtgtgtgcagatctgtgacca

SEQ ID NO: 41120 - DNA, 25 bp, Mus musculus
aactgtgtgtgctgatctgtgacca

SEQ ID NO: 41121 - DNA, 25 bp, Mus musculus
aactgtgtgtggagacatcgcaaca

SEQ ID NO: 41122 - DNA, 25 bp, Mus musculus
aactgtgtgtggtgacatcgcaaca

SEQ ID NO: 41123 - DNA, 25 bp, Mus musculus
aactgtgttcagactgtgctgtcaa

SEQ ID NO: 41124 - DNA, 25 bp, Mus musculus
aactgtgttcagtctgtgctgtcaa

SEQ ID NO: 41125 - DNA, 25 bp, Mus musculus
aactgtgtttaaaaagctcatgcta

SEQ ID NO: 41126 - DNA, 25 bp, Mus musculus
aactgtgtttaataagctcatgcta

SEQ ID NO: 41127 - DNA, 25 bp, Mus musculus
aactgtgtttcaattgctgtaatca

SEQ ID NO: 41128 - DNA, 25 bp, Mus musculus
aactgtgtttcatttgctgtaatca

SEQ ID NO: 41129 - DNA, 25 bp, Mus musculus
aactgtgtttccagcgctgtgtgcc

SEQ ID NO: 41130 - DNA, 25 bp, Mus musculus
aactgtgtttcctgcgctgtgtgcc

SEQ ID NO: 41131 - DNA, 25 bp, Mus musculus
aactgtgtttctcgatgtaatgtaa

SEQ ID NO: 41132 - DNA, 25 bp, Mus musculus
aactgtgtttctggatgtaatgtaa

SEQ ID NO: 41133 - DNA, 25 bp, Mus musculus
aactgtgtttggaactctgctgaag

SEQ ID NO: 41134 - DNA, 25 bp, Mus musculus
aactgtgtttggtactctgctgaag

SEQ ID NO: 41135 - DNA, 25 bp, Mus musculus
aactgtgttttgagtgttctctgga

SEQ ID NO: 41136 - DNA, 25 bp, Mus musculus
aactgtgttttgattatttgaccca

SEQ ID NO: 41137 - DNA, 25 bp, Mus musculus
aactgtgttttgtgtgttctctgga

SEQ ID NO: 41138 - DNA, 25 bp, Mus musculus
aactgtgttttgtttatttgaccca

SEQ ID NO: 41139 - DNA, 25 bp, Mus musculus
aactgttaaacaaggcgctggagct

SEQ ID NO: 41140 - DNA, 25 bp, Mus musculus
aactgttaaacatggcgctggagct

SEQ ID NO: 41141 - DNA, 25 bp, Mus musculus
aactgttaagaaacattcctagtgc

SEQ ID NO: 41142 - DNA, 25 bp, Mus musculus
aactgttaagaatcattcctagtgc

SEQ ID NO: 41143 - DNA, 25 bp, Mus musculus
aactgttaatagagcatgctcggcc

SEQ ID NO: 41144 - DNA, 25 bp, Mus musculus
aactgttaatagtgcatgctcggcc

SEQ ID NO: 41145 - DNA, 25 bp, Mus musculus
aactgttaattcacttatctggatg

SEQ ID NO: 41146 - DNA, 25 bp, Mus musculus
aactgttaattctcttatctggatg

SEQ ID NO: 41147 - DNA, 25 bp, Mus musculus
aactgttacctgactaaacctggct

SEQ ID NO: 41148 - DNA, 25 bp, Mus musculus
aactgttacctgtctaaacctggct

SEQ ID NO: 41149 - DNA, 25 bp, Mus musculus
aactgttagataataagcttggcaa

SEQ ID NO: 41150 - DNA, 25 bp, Mus musculus
aactgttagatattaagcttggcaa

SEQ ID NO: 41151 - DNA, 25 bp, Mus musculus
aactgttaggatctacttgtctctg

SEQ ID NO: 41152 - DNA, 25 bp, Mus musculus
aactgttaggatgtacttgtctctg

SEQ ID NO: 41153 - DNA, 25 bp, Mus musculus
aactgttaggttacatagtgttatt

SEQ ID NO: 41154 - DNA, 25 bp, Mus musculus
aactgttaggtttcatagtgttatt

SEQ ID NO: 41155 - DNA, 25 bp, Mus musculus
aactgttcacaacgagcacggctct

SEQ ID NO: 41156 - DNA, 25 bp, Mus musculus
aactgttcacaaggagcacggctct

SEQ ID NO: 41157 - DNA, 25 bp, Mus musculus
aactgttcaggacctgcaagcagaa

SEQ ID NO: 41158 - DNA, 25 bp, Mus musculus
aactgttcaggagctgcaagcagaa

SEQ ID NO: 41159 - DNA, 25 bp, Mus musculus
aactgttcatatattggagagctgg

SEQ ID NO: 41160 - DNA, 25 bp, Mus musculus
aactgttcatatctccatcttctct

SEQ ID NO: 41161 - DNA, 25 bp, Mus musculus
aactgttcatatgtccatcttctct

SEQ ID NO: 41162 - DNA, 25 bp, Mus musculus
aactgttcatattttggagagctgg

SEQ ID NO: 41163 - DNA, 25 bp, Mus musculus
aactgttcatggatcacactctttc

SEQ ID NO: 41164 - DNA, 25 bp, Mus musculus
aactgttcatggttcacactctttc

SEQ ID NO: 41165 - DNA, 25 bp, Mus musculus
aactgttccacacagcacactatct

SEQ ID NO: 41166 - DNA, 25 bp, Mus musculus
aactgttccacagagcacactatct

SEQ ID NO: 41167 - DNA, 25 bp, Mus musculus
aactgttccagtaaagtgcaccgct

SEQ ID NO: 41168 - DNA, 25 bp, Mus musculus
aactgttccagttaagtgcaccgct

SEQ ID NO: 41169 - DNA, 25 bp, Mus musculus
aactgttcccctccggaaagactga

SEQ ID NO: 41170 - DNA, 25 bp, Mus musculus
aactgttcccctgcggaaagactga

SEQ ID NO: 41171 - DNA, 25 bp, Mus musculus
aactgttcctagcagctgtccggga

SEQ ID NO: 41172 - DNA, 25 bp, Mus musculus
aactgttcctaggagctgtccggga

SEQ ID NO: 41173 - DNA, 25 bp, Mus musculus
aactgttcctcaatggttggttgtt

SEQ ID NO: 41174 - DNA, 25 bp, Mus musculus
aactgttcctcattggttggttgtt

SEQ ID NO: 41175 - DNA, 25 bp, Mus musculus
aactgttccttactgcatgctccaa

SEQ ID NO: 41176 - DNA, 25 bp, Mus musculus
aactgttccttagtgcatgctccaa

SEQ ID NO: 41177 - DNA, 25 bp, Mus musculus
aactgttcgcagatggctgttcgtg

SEQ ID NO: 41178 - DNA, 25 bp, Mus musculus
aactgttcgcagttggctgttcgtg

SEQ ID NO: 41179 - DNA, 25 bp, Mus musculus
aactgttcgtttagcttactctgcc

SEQ ID NO: 41180 - DNA, 25 bp, Mus musculus
aactgttcgttttgcttactctgcc

SEQ ID NO: 41181 - DNA, 25 bp, Mus musculus
aactgttctaggctgccctgacttt

SEQ ID NO: 41182 - DNA, 25 bp, Mus musculus
aactgttctagggtgccctgacttt

SEQ ID NO: 41183 - DNA, 25 bp, Mus musculus
aactgttctcaaaaaagtccttgaa

SEQ ID NO: 41184 - DNA, 25 bp, Mus musculus
aactgttctcaataaagtccttgaa

SEQ ID NO: 41185 - DNA, 25 bp, Mus musculus
aactgttctcagacatttaagctaa

SEQ ID NO: 41186 - DNA, 25 bp, Mus musculus
aactgttctcagactggttggctct

SEQ ID NO: 41187 - DNA, 25 bp, Mus musculus
aactgttctcagtcatttaagctaa

SEQ ID NO: 41188 - DNA, 25 bp, Mus musculus
aactgttctcagtctggttggctct

SEQ ID NO: 41189 - DNA, 25 bp, Mus musculus
aactgttctgcaagtctttttgtaa

SEQ ID NO: 41190 - DNA, 25 bp, Mus musculus
aactgttctgcacgtacatttgtca

SEQ ID NO: 41191 - DNA, 25 bp, Mus musculus
aactgttctgcaggtacatttgtca

SEQ ID NO: 41192 - DNA, 25 bp, Mus musculus
aactgttctgcatgtctttttgtaa

SEQ ID NO: 41193 - DNA, 25 bp, Mus musculus
aactgttctgctctgttgaactgct

SEQ ID NO: 41194 - DNA, 25 bp, Mus musculus
aactgttctgctgtgttgaactgct

SEQ ID NO: 41195 - DNA, 25 bp, Mus musculus
aactgttctggcacaatacttcagc

SEQ ID NO: 41196 - DNA, 25 bp, Mus musculus
aactgttctggctcaatacttcagc

SEQ ID NO: 41197 - DNA, 25 bp, Mus musculus
aactgttctggtatacatccgtggg

SEQ ID NO: 41198 - DNA, 25 bp, Mus musculus
aactgttctggtttacatccgtggg

SEQ ID NO: 41199 - DNA, 25 bp, Mus musculus
aactgttctgttccctagttcatgg

SEQ ID NO: 41200 - DNA, 25 bp, Mus musculus
aactgttctgttgcctagttcatgg

SEQ ID NO: 41201 - DNA, 25 bp, Mus musculus
aactgttgaacaatccacttacatg

SEQ ID NO: 41202 - DNA, 25 bp, Mus musculus
aactgttgaacattccacttacatg

SEQ ID NO: 41203 - DNA, 25 bp, Mus musculus
aactgttgacggcttatggatgcat

SEQ ID NO: 41204 - DNA, 25 bp, Mus musculus
aactgttgacgggttatggatgcat

SEQ ID NO: 41205 - DNA, 25 bp, Mus musculus
aactgttgagacaactctccagcac

SEQ ID NO: 41206 - DNA, 25 bp, Mus musculus
aactgttgagactactctccagcac

SEQ ID NO: 41207 - DNA, 25 bp, Mus musculus
aactgttgagtaatggttggactgc

SEQ ID NO: 41208 - DNA, 25 bp, Mus musculus
aactgttgagtattggttggactgc

SEQ ID NO: 41209 - DNA, 25 bp, Mus musculus
aactgttgatctacttgtccaaaag

SEQ ID NO: 41210 - DNA, 25 bp, Mus musculus
aactgttgatcttcttgtccaaaag

SEQ ID NO: 41211 - DNA, 25 bp, Mus musculus
aactgttgcactattgaatgtccaa

SEQ ID NO: 41212 - DNA, 25 bp, Mus musculus
aactgttgcacttttgaatgtccaa

SEQ ID NO: 41213 - DNA, 25 bp, Mus musculus
aactgttgcagcatgtgaagacgct

SEQ ID NO: 41214 - DNA, 25 bp, Mus musculus
aactgttgcagcttgtgaagacgct

SEQ ID NO: 41215 - DNA, 25 bp, Mus musculus
aactgttgcattaggatattttact

SEQ ID NO: 41216 - DNA, 25 bp, Mus musculus
aactgttgcatttggatattttact

SEQ ID NO: 41217 - DNA, 25 bp, Mus musculus
aactgttgccatcttgctgtatgtc

SEQ ID NO: 41218 - DNA, 25 bp, Mus musculus
aactgttgccatgttgctgtatgtc

SEQ ID NO: 41219 - DNA, 25 bp, Mus musculus
aactgttgctgaagctggctgagac

SEQ ID NO: 41220 - DNA, 25 bp, Mus musculus
aactgttgctgatgctggctgagac

SEQ ID NO: 41221 - DNA, 25 bp, Mus musculus
aactgttgctttagtatgcccttcg

SEQ ID NO: 41222 - DNA, 25 bp, Mus musculus
aactgttgcttttgtatgcccttcg

SEQ ID NO: 41223 - DNA, 25 bp, Mus musculus
aactgttggcatactctggcagtgt

SEQ ID NO: 41224 - DNA, 25 bp, Mus musculus
aactgttggcattctctggcagtgt

SEQ ID NO: 41225 - DNA, 25 bp, Mus musculus
aactgttggttcaggccattgagct

SEQ ID NO: 41226 - DNA, 25 bp, Mus musculus
aactgttggttctggccattgagct

SEQ ID NO: 41227 - DNA, 25 bp, Mus musculus
aactgttgtaacactttataagacg

SEQ ID NO: 41228 - DNA, 25 bp, Mus musculus
aactgttgtaactctttataagacg

SEQ ID NO: 41229 - DNA, 25 bp, Mus musculus
aactgttgtcgtagctcggaaaaga

SEQ ID NO: 41230 - DNA, 25 bp, Mus musculus
aactgttgtcgttgctcggaaaaga

SEQ ID NO: 41231 - DNA, 25 bp, Mus musculus
aactgttgtgacacagcctgttgac

SEQ ID NO: 41232 - DNA, 25 bp, Mus musculus
aactgttgtgactcagcctgttgac

SEQ ID NO: 41233 - DNA, 25 bp, Mus musculus
aactgttgtgcccaactgatggaca

SEQ ID NO: 41234 - DNA, 25 bp, Mus musculus
aactgttgtgccgaactgatggaca

SEQ ID NO: 41235 - DNA, 25 bp, Mus musculus
aactgttgtgggaggcatctcgcag

SEQ ID NO: 41236 - DNA, 25 bp, Mus musculus
aactgttgtgggtggcatctcgcag

SEQ ID NO: 41237 - DNA, 25 bp, Mus musculus
aactgttgttaaatcggtgccagaa

SEQ ID NO: 41238 - DNA, 25 bp, Mus musculus
aactgttgttaaatgagcctggcta

SEQ ID NO: 41239 - DNA, 25 bp, Mus musculus
aactgttgttaattcggtgccagaa

SEQ ID NO: 41240 - DNA, 25 bp, Mus musculus
aactgttgttaattgagcctggcta

SEQ ID NO: 41241 - DNA, 25 bp, Mus musculus
aactgtttatgcagactctgccttt

SEQ ID NO: 41242 - DNA, 25 bp, Mus musculus
aactgtttatgctgactctgccttt

SEQ ID NO: 41243 - DNA, 25 bp, Mus musculus
aactgtttcacaagcatccgtgctc

SEQ ID NO: 41244 - DNA, 25 bp, Mus musculus
aactgtttcacatgcatccgtgctc

SEQ ID NO: 41245 - DNA, 25 bp, Mus musculus
aactgtttcagtacagcttgggagc

SEQ ID NO: 41246 - DNA, 25 bp, Mus musculus
aactgtttcagttcagcttgggagc

SEQ ID NO: 41247 - DNA, 25 bp, Mus musculus
aactgtttccaaatcaacaagaaat

SEQ ID NO: 41248 - DNA, 25 bp, Mus musculus
aactgtttccaattcaacaagaaat

SEQ ID NO: 41249 - DNA, 25 bp, Mus musculus
aactgtttccttaatgtgacgcctc

SEQ ID NO: 41250 - DNA, 25 bp, Mus musculus
aactgtttcctttatgtgacgcctc

SEQ ID NO: 41251 - DNA, 25 bp, Mus musculus
aactgtttctccaagacattatcaa

SEQ ID NO: 41252 - DNA, 25 bp, Mus musculus
aactgtttctcctagacattatcaa

SEQ ID NO: 41253 - DNA, 25 bp, Mus musculus
aactgtttctgcctagtgtttccat

SEQ ID NO: 41254 - DNA, 25 bp, Mus musculus
aactgtttctgcgtagtgtttccat

SEQ ID NO: 41255 - DNA, 25 bp, Mus musculus
aactgtttcttaaagcggctctgaa

SEQ ID NO: 41256 - DNA, 25 bp, Mus musculus
aactgtttcttatagcggctctgaa

SEQ ID NO: 41257 - DNA, 25 bp, Mus musculus
aactgtttgcagatgatgccttact

SEQ ID NO: 41258 - DNA, 25 bp, Mus musculus
aactgtttgcagttgatgccttact

SEQ ID NO: 41259 - DNA, 25 bp, Mus musculus
aactgtttgcatagccattctgcaa

SEQ ID NO: 41260 - DNA, 25 bp, Mus musculus
aactgtttgcatcccaggtggactt

SEQ ID NO: 41261 - DNA, 25 bp, Mus musculus
aactgtttgcatgccaggtggactt

SEQ ID NO: 41262 - DNA, 25 bp, Mus musculus
aactgtttgcattgccattctgcaa

SEQ ID NO: 41263 - DNA, 25 bp, Mus musculus
aactgtttgcgcagacacccatgga

SEQ ID NO: 41264 - DNA, 25 bp, Mus musculus
aactgtttgcgctgacacccatgga

SEQ ID NO: 41265 - DNA, 25 bp, Mus musculus
aactgtttgctgagatggcctgttg

SEQ ID NO: 41266 - DNA, 25 bp, Mus musculus
aactgtttgctgtgatggcctgttg

SEQ ID NO: 41267 - DNA, 25 bp, Mus musculus
aactgtttgcttcggaagcctacga

SEQ ID NO: 41268 - DNA, 25 bp, Mus musculus
aactgtttgcttgggaagcctacga

SEQ ID NO: 41269 - DNA, 25 bp, Mus musculus
aactgtttggccatatggccttcag

SEQ ID NO: 41270 - DNA, 25 bp, Mus musculus
aactgtttggccatcacatgttgat

SEQ ID NO: 41271 - DNA, 25 bp, Mus musculus
aactgtttggccttatggccttcag

SEQ ID NO: 41272 - DNA, 25 bp, Mus musculus
aactgtttggccttcacatgttgat

SEQ ID NO: 41273 - DNA, 25 bp, Mus musculus
aactgtttgggtatcaggcttgctt

SEQ ID NO: 41274 - DNA, 25 bp, Mus musculus
aactgtttgggtttcaggcttgctt

SEQ ID NO: 41275 - DNA, 25 bp, Mus musculus
aactgtttgtttagctgttcattac

SEQ ID NO: 41276 - DNA, 25 bp, Mus musculus
aactgtttgttttgctgttcattac

SEQ ID NO: 41277 - DNA, 25 bp, Mus musculus
aactgttttatcctgcccagggagg

SEQ ID NO: 41278 - DNA, 25 bp, Mus musculus
aactgttttatcgtgcccagggagg

SEQ ID NO: 41279 - DNA, 25 bp, Mus musculus
aactgttttcacaagctgttgtttg

SEQ ID NO: 41280 - DNA, 25 bp, Mus musculus
aactgttttcactagctgttgtttg

SEQ ID NO: 41281 - DNA, 25 bp, Mus musculus
aactgttttctcaggagttccaact

SEQ ID NO: 41282 - DNA, 25 bp, Mus musculus
aactgttttctctggagttccaact

SEQ ID NO: 41283 - DNA, 25 bp, Mus musculus
aactgttttctgacagcaatgtcaa

SEQ ID NO: 41284 - DNA, 25 bp, Mus musculus
aactgttttctgtcagcaatgtcaa

SEQ ID NO: 41285 - DNA, 25 bp, Mus musculus
aactgttttgggatccttctctctg

SEQ ID NO: 41286 - DNA, 25 bp, Mus musculus
aactgttttgggttccttctctctg

SEQ ID NO: 41287 - DNA, 25 bp, Mus musculus
aactgttttgttctaaggctcagag

SEQ ID NO: 41288 - DNA, 25 bp, Mus musculus
aactgttttgttgtaaggctcagag

SEQ ID NO: 41289 - DNA, 25 bp, Mus musculus
aactgtttttctaccttatagcagg

SEQ ID NO: 41290 - DNA, 25 bp, Mus musculus
aactgtttttcttccttatagcagg

SEQ ID NO: 41291 - DNA, 25 bp, Mus musculus
aacttaaaactccaacacagattat

SEQ ID NO: 41292 - DNA, 25 bp, Mus musculus
aacttaaaactcgaacacagattat

SEQ ID NO: 41293 - DNA, 25 bp, Mus musculus
aacttaaatgacagccacatcttta

SEQ ID NO: 41294 - DNA, 25 bp, Mus musculus
aacttaaatgactgccacatcttta

SEQ ID NO: 41295 - DNA, 25 bp, Mus musculus
aacttaaattggctgttagcttgag

SEQ ID NO: 41296 - DNA, 25 bp, Mus musculus
aacttaaattgggtgttagcttgag

SEQ ID NO: 41297 - DNA, 25 bp, Mus musculus
aacttaaccaagatgggctgggctc

SEQ ID NO: 41298 - DNA, 25 bp, Mus musculus
aacttaaccaagttgggctgggctc

SEQ ID NO: 41299 - DNA, 25 bp, Mus musculus
aacttaaccctgacctctgaaagag

SEQ ID NO: 41300 - DNA, 25 bp, Mus musculus
aacttaaccctgtcctctgaaagag

SEQ ID NO: 41301 - DNA, 25 bp, Mus musculus
aacttaacctcactaatgtagtggg

SEQ ID NO: 41302 - DNA, 25 bp, Mus musculus
aacttaacctcagtaatgtagtggg

SEQ ID NO: 41303 - DNA, 25 bp, Mus musculus
aacttaagagagagcaggggagcca

SEQ ID NO: 41304 - DNA, 25 bp, Mus musculus
aacttaagagagtgcaggggagcca

SEQ ID NO: 41305 - DNA, 25 bp, Mus musculus
aacttaagccctcaaatgtagctgg

SEQ ID NO: 41306 - DNA, 25 bp, Mus musculus
aacttaagccctgaaatgtagctgg

SEQ ID NO: 41307 - DNA, 25 bp, Mus musculus
aacttaagctgcctgcgcacaaaaa

SEQ ID NO: 41308 - DNA, 25 bp, Mus musculus
aacttaagctgcgtgcgcacaaaaa

SEQ ID NO: 41309 - DNA, 25 bp, Mus musculus
aacttaagctttcctgtctactaca

SEQ ID NO: 41310 - DNA, 25 bp, Mus musculus
aacttaagctttgctgtctactaca

SEQ ID NO: 41311 - DNA, 25 bp, Mus musculus
aacttaagggacaccacctctggag

SEQ ID NO: 41312 - DNA, 25 bp, Mus musculus
aacttaagggactccacctctggag

SEQ ID NO: 41313 - DNA, 25 bp, Mus musculus
aacttaaggttgagtgtctcgatgt

SEQ ID NO: 41314 - DNA, 25 bp, Mus musculus
aacttaaggttgtgtgtctcgatgt

SEQ ID NO: 41315 - DNA, 25 bp, Mus musculus
aacttaagtattccagccatgctgc

SEQ ID NO: 41316 - DNA, 25 bp, Mus musculus
aacttaagtattgcagccatgctgc

SEQ ID NO: 41317 - DNA, 25 bp, Mus musculus
aacttaagtcggcctttctgttatg

SEQ ID NO: 41318 - DNA, 25 bp, Mus musculus
aacttaagtcgggctttctgttatg

SEQ ID NO: 41319 - DNA, 25 bp, Mus musculus
aacttaagttgtacatcccaagaga

SEQ ID NO: 41320 - DNA, 25 bp, Mus musculus
aacttaagttgttcatcccaagaga

SEQ ID NO: 41321 - DNA, 25 bp, Mus musculus
aacttaataaacatgggctgagttc

SEQ ID NO: 41322 - DNA, 25 bp, Mus musculus
aacttaataaacttgggctgagttc

SEQ ID NO: 41323 - DNA, 25 bp, Mus musculus
aacttaattccaatgatcccaccag

SEQ ID NO: 41324 - DNA, 25 bp, Mus musculus
aacttaattccattgatcccaccag

SEQ ID NO: 41325 - DNA, 25 bp, Mus musculus
aacttaattcctagggccaccagag

SEQ ID NO: 41326 - DNA, 25 bp, Mus musculus
aacttaattccttgggccaccagag

SEQ ID NO: 41327 - DNA, 25 bp, Mus musculus
aacttaattgcccagatatttttgc

SEQ ID NO: 41328 - DNA, 25 bp, Mus musculus
aacttaattgccgagatatttttgc

SEQ ID NO: 41329 - DNA, 25 bp, Mus musculus
aacttacaaagtagctcctgcgtct

SEQ ID NO: 41330 - DNA, 25 bp, Mus musculus
aacttacaaagttgctcctgcgtct

SEQ ID NO: 41331 - DNA, 25 bp, Mus musculus
aacttacaagtaacggctgcctcca

SEQ ID NO: 41332 - DNA, 25 bp, Mus musculus
aacttacaagtatcggctgcctcca

SEQ ID NO: 41333 - DNA, 25 bp, Mus musculus
aacttacactgaccctagagcttag

SEQ ID NO: 41334 - DNA, 25 bp, Mus musculus
aacttacactgagcctagagcttag

SEQ ID NO: 41335 - DNA, 25 bp, Mus musculus
aacttacatggaatggactccaagt

SEQ ID NO: 41336 - DNA, 25 bp, Mus musculus
aacttacatggattggactccaagt

SEQ ID NO: 41337 - DNA, 25 bp, Mus musculus
aacttacatgttacactatctctaa

SEQ ID NO: 41338 - DNA, 25 bp, Mus musculus
aacttacatgttactatagcgcaca

SEQ ID NO: 41339 - DNA, 25 bp, Mus musculus
aacttacatgtttcactatctctaa

SEQ ID NO: 41340 - DNA, 25 bp, Mus musculus
aacttacatgtttctatagcgcaca

SEQ ID NO: 41341 - DNA, 25 bp, Mus musculus
aacttacattcactaccgagcttac

SEQ ID NO: 41342 - DNA, 25 bp, Mus musculus
aacttacattcagtaccgagcttac

SEQ ID NO: 41343 - DNA, 25 bp, Mus musculus
aacttacctgtaagcccaacactga

SEQ ID NO: 41344 - DNA, 25 bp, Mus musculus
aacttacctgtatgcccaacactga

SEQ ID NO: 41345 - DNA, 25 bp, Mus musculus
aacttactaatcatcgtcttctggg

SEQ ID NO: 41346 - DNA, 25 bp, Mus musculus
aacttactaatcttcgtcttctggg

SEQ ID NO: 41347 - DNA, 25 bp, Mus musculus
aacttactagcacagagcacttgtt

SEQ ID NO: 41348 - DNA, 25 bp, Mus musculus
aacttactagcagagagcacttgtt

SEQ ID NO: 41349 - DNA, 25 bp, Mus musculus
aacttactcatcaccgctgaacgat

SEQ ID NO: 41350 - DNA, 25 bp, Mus musculus
aacttactcatctccgctgaacgat

SEQ ID NO: 41351 - DNA, 25 bp, Mus musculus
aacttactccttacggagccaagca

SEQ ID NO: 41352 - DNA, 25 bp, Mus musculus
aacttactcctttcggagccaagca

SEQ ID NO: 41353 - DNA, 25 bp, Mus musculus
aacttactctgcagctgatgtggaa

SEQ ID NO: 41354 - DNA, 25 bp, Mus musculus
aacttactctgctgctgatgtggaa

SEQ ID NO: 41355 - DNA, 25 bp, Mus musculus
aacttactctgtagtgttcttgcca

SEQ ID NO: 41356 - DNA, 25 bp, Mus musculus
aacttactctgttgtgttcttgcca

SEQ ID NO: 41357 - DNA, 25 bp, Mus musculus
aacttactcttgaacagggcctaat

SEQ ID NO: 41358 - DNA, 25 bp, Mus musculus
aacttactcttgtacagggcctaat

SEQ ID NO: 41359 - DNA, 25 bp, Mus musculus
aacttactgagcatctaaaacctaa

SEQ ID NO: 41360 - DNA, 25 bp, Mus musculus
aacttactgagcttctaaaacctaa

SEQ ID NO: 41361 - DNA, 25 bp, Mus musculus
aacttactgccaacatttcacacaa

SEQ ID NO: 41362 - DNA, 25 bp, Mus musculus
aacttactgccatcatttcacacaa

SEQ ID NO: 41363 - DNA, 25 bp, Mus musculus
aacttactggagacagttctaccct

SEQ ID NO: 41364 - DNA, 25 bp, Mus musculus
aacttactggagtcagttctaccct

SEQ ID NO: 41365 - DNA, 25 bp, Mus musculus
aacttactggcaatctgatggctct

SEQ ID NO: 41366 - DNA, 25 bp, Mus musculus
aacttactggcattctgatggctct

SEQ ID NO: 41367 - DNA, 25 bp, Mus musculus
aacttactgtaaatgcatgaagcac

SEQ ID NO: 41368 - DNA, 25 bp, Mus musculus
aacttactgtaattgcatgaagcac

SEQ ID NO: 41369 - DNA, 25 bp, Mus musculus
aacttactgtgtacttagcagttaa

SEQ ID NO: 41370 - DNA, 25 bp, Mus musculus
aacttactgtgtcaaagctcgccaa

SEQ ID NO: 41371 - DNA, 25 bp, Mus musculus
aacttactgtgtcgtccagggtggc

SEQ ID NO: 41372 - DNA, 25 bp, Mus musculus
aacttactgtgtgaaagctcgccaa

SEQ ID NO: 41373 - DNA, 25 bp, Mus musculus
aacttactgtgtggtccagggtggc

SEQ ID NO: 41374 - DNA, 25 bp, Mus musculus
aacttactgtgttcttagcagttaa

SEQ ID NO: 41375 - DNA, 25 bp, Mus musculus
aacttacttcaaacagctcaggcat

SEQ ID NO: 41376 - DNA, 25 bp, Mus musculus
aacttacttcaatcagctcaggcat

SEQ ID NO: 41377 - DNA, 25 bp, Mus musculus
aacttacttgtgaagggccttgccg

SEQ ID NO: 41378 - DNA, 25 bp, Mus musculus
aacttacttgtgtagggccttgccg

SEQ ID NO: 41379 - DNA, 25 bp, Mus musculus
aacttagaacacaccagtccttagc

SEQ ID NO: 41380 - DNA, 25 bp, Mus musculus
aacttagaacactccagtccttagc

SEQ ID NO: 41381 - DNA, 25 bp, Mus musculus
aacttagaattacagccgaggcact

SEQ ID NO: 41382 - DNA, 25 bp, Mus musculus
aacttagaattagagccgaggcact

SEQ ID NO: 41383 - DNA, 25 bp, Mus musculus
aacttagactttctatgcacatagg

SEQ ID NO: 41384 - DNA, 25 bp, Mus musculus
aacttagactttgtatgcacatagg

SEQ ID NO: 41385 - DNA, 25 bp, Mus musculus
aacttagagcctaagcagcagattg

SEQ ID NO: 41386 - DNA, 25 bp, Mus musculus
aacttagagccttagcagcagattg

SEQ ID NO: 41387 - DNA, 25 bp, Mus musculus
aacttagaggacatggattaacttt

SEQ ID NO: 41388 - DNA, 25 bp, Mus musculus
aacttagaggacttggattaacttt

SEQ ID NO: 41389 - DNA, 25 bp, Mus musculus
aacttagaggatcgcctgcgggcac

SEQ ID NO: 41390 - DNA, 25 bp, Mus musculus
aacttagaggatggcctgcgggcac

SEQ ID NO: 41391 - DNA, 25 bp, Mus musculus
aacttagagttaccctatgtctgca

SEQ ID NO: 41392 - DNA, 25 bp, Mus musculus
aacttagagttagcctatgtctgca

SEQ ID NO: 41393 - DNA, 25 bp, Mus musculus
aacttagatcagatggcttctccat

SEQ ID NO: 41394 - DNA, 25 bp, Mus musculus
aacttagatcagttggcttctccat

SEQ ID NO: 41395 - DNA, 25 bp, Mus musculus
aacttagatctaacggtggtaggat

SEQ ID NO: 41396 - DNA, 25 bp, Mus musculus
aacttagatctatcggtggtaggat

SEQ ID NO: 41397 - DNA, 25 bp, Mus musculus
aacttagatgtgctgaacctcagaa

SEQ ID NO: 41398 - DNA, 25 bp, Mus musculus
aacttagatgtggtgaacctcagaa

SEQ ID NO: 41399 - DNA, 25 bp, Mus musculus
aacttagattaactctgtagtactt

SEQ ID NO: 41400 - DNA, 25 bp, Mus musculus
aacttagattaagtctgtagtactt

SEQ ID NO: 41401 - DNA, 25 bp, Mus musculus
aacttagatttacctcagacccatg

SEQ ID NO: 41402 - DNA, 25 bp, Mus musculus
aacttagatttagctcagacccatg

SEQ ID NO: 41403 - DNA, 25 bp, Mus musculus
aacttagcagaacccttgatgagga

SEQ ID NO: 41404 - DNA, 25 bp, Mus musculus
aacttagcagaagccttgatgagga

SEQ ID NO: 41405 - DNA, 25 bp, Mus musculus
aacttagccaaactgaagatttcac

SEQ ID NO: 41406 - DNA, 25 bp, Mus musculus
aacttagccaaagtgaagatttcac

SEQ ID NO: 41407 - DNA, 25 bp, Mus musculus
aacttagccattatacagaagactg

SEQ ID NO: 41408 - DNA, 25 bp, Mus musculus
aacttagccattttacagaagactg

SEQ ID NO: 41409 - DNA, 25 bp, Mus musculus
aacttagcctaaaggacttcactgg

SEQ ID NO: 41410 - DNA, 25 bp, Mus musculus
aacttagcctaatggacttcactgg

SEQ ID NO: 41411 - DNA, 25 bp, Mus musculus
aacttagccttgcagttccttttct

SEQ ID NO: 41412 - DNA, 25 bp, Mus musculus
aacttagccttggagttccttttct

SEQ ID NO: 41413 - DNA, 25 bp, Mus musculus
aacttagctctgaagtctaactgga

SEQ ID NO: 41414 - DNA, 25 bp, Mus musculus
aacttagctctgtagtctaactgga

SEQ ID NO: 41415 - DNA, 25 bp, Mus musculus
aacttagctcttcacagttgtgaca

SEQ ID NO: 41416 - DNA, 25 bp, Mus musculus
aacttagctcttgacagttgtgaca

SEQ ID NO: 41417 - DNA, 25 bp, Mus musculus
aacttagctttcaggattctgagca

SEQ ID NO: 41418 - DNA, 25 bp, Mus musculus
aacttagctttctggattctgagca

SEQ ID NO: 41419 - DNA, 25 bp, Mus musculus
aacttaggccatcatcagacgctcc

SEQ ID NO: 41420 - DNA, 25 bp, Mus musculus
aacttaggccatgatcagacgctcc

SEQ ID NO: 41421 - DNA, 25 bp, Mus musculus
aacttaggcctcctagtccattgag

SEQ ID NO: 41422 - DNA, 25 bp, Mus musculus
aacttaggcctcgtagtccattgag

SEQ ID NO: 41423 - DNA, 25 bp, Mus musculus
aacttaggctatcctcacttgtctg

SEQ ID NO: 41424 - DNA, 25 bp, Mus musculus
aacttaggctatgctcacttgtctg

SEQ ID NO: 41425 - DNA, 25 bp, Mus musculus
aacttaggctgtaggaatttacgca

SEQ ID NO: 41426 - DNA, 25 bp, Mus musculus
aacttaggctgttggaatttacgca

SEQ ID NO: 41427 - DNA, 25 bp, Mus musculus
aacttaggtgatctttcaaagagca

SEQ ID NO: 41428 - DNA, 25 bp, Mus musculus
aacttaggtgatgtttcaaagagca

SEQ ID NO: 41429 - DNA, 25 bp, Mus musculus
aacttagtactacagcccaggctag

SEQ ID NO: 41430 - DNA, 25 bp, Mus musculus
aacttagtactagagcccaggctag

SEQ ID NO: 41431 - DNA, 25 bp, Mus musculus
aacttagtcaaaaatcctctctggg

SEQ ID NO: 41432 - DNA, 25 bp, Mus musculus
aacttagtcaaatatcctctctggg

SEQ ID NO: 41433 - DNA, 25 bp, Mus musculus
aacttagtcatgcttctgtaggctg

SEQ ID NO: 41434 - DNA, 25 bp, Mus musculus
aacttagtcatggttctgtaggctg

SEQ ID NO: 41435 - DNA, 25 bp, Mus musculus
aacttagtctgtcttggaactttga

SEQ ID NO: 41436 - DNA, 25 bp, Mus musculus
aacttagtctgtgttggaactttga

SEQ ID NO: 41437 - DNA, 25 bp, Mus musculus
aacttagtgacaagcatgccttccc

SEQ ID NO: 41438 - DNA, 25 bp, Mus musculus
aacttagtgacatgcatgccttccc

SEQ ID NO: 41439 - DNA, 25 bp, Mus musculus
aacttagtgctgaaggctttcgtag

SEQ ID NO: 41440 - DNA, 25 bp, Mus musculus
aacttagtgctgtaggctttcgtag

SEQ ID NO: 41441 - DNA, 25 bp, Mus musculus
aacttagtgtgtacgatagactcga

SEQ ID NO: 41442 - DNA, 25 bp, Mus musculus
aacttagtgtgttcgatagactcga

SEQ ID NO: 41443 - DNA, 25 bp, Mus musculus
aacttagttcagaatttttgatgtt

SEQ ID NO: 41444 - DNA, 25 bp, Mus musculus
aacttagttcagtatttttgatgtt

SEQ ID NO: 41445 - DNA, 25 bp, Mus musculus
aacttagttgccacactttcctgcg

SEQ ID NO: 41446 - DNA, 25 bp, Mus musculus
aacttagttgcctcactttcctgcg

SEQ ID NO: 41447 - DNA, 25 bp, Mus musculus
aacttagtttctctagatacagcat

SEQ ID NO: 41448 - DNA, 25 bp, Mus musculus
aacttagtttctgtagatacagcat

SEQ ID NO: 41449 - DNA, 25 bp, Mus musculus
aacttataaccccagctgtggtctc

SEQ ID NO: 41450 - DNA, 25 bp, Mus musculus
aacttataacccgagctgtggtctc

SEQ ID NO: 41451 - DNA, 25 bp, Mus musculus
aacttataattgagattgtagcttt

SEQ ID NO: 41452 - DNA, 25 bp, Mus musculus
aacttataattgtgattgtagcttt

SEQ ID NO: 41453 - DNA, 25 bp, Mus musculus
aacttatacttgaacctacctgcta

SEQ ID NO: 41454 - DNA, 25 bp, Mus musculus
aacttatacttgtacctacctgcta

SEQ ID NO: 41455 - DNA, 25 bp, Mus musculus
aacttatcaagtcagcaaccaacaa

SEQ ID NO: 41456 - DNA, 25 bp, Mus musculus
aacttatcaagtgagcaaccaacaa

SEQ ID NO: 41457 - DNA, 25 bp, Mus musculus
aacttatcagacagcaaacatcccg

SEQ ID NO: 41458 - DNA, 25 bp, Mus musculus
aacttatcagactgcaaacatcccg

SEQ ID NO: 41459 - DNA, 25 bp, Mus musculus
aacttatcccttctgcattcagtgg

SEQ ID NO: 41460 - DNA, 25 bp, Mus musculus
aacttatcccttgtgcattcagtgg

SEQ ID NO: 41461 - DNA, 25 bp, Mus musculus
aacttatctttccattatactgtag

SEQ ID NO: 41462 - DNA, 25 bp, Mus musculus
aacttatctttcgattatactgtag

SEQ ID NO: 41463 - DNA, 25 bp, Mus musculus
aacttatgagctcttatgtctttag

SEQ ID NO: 41464 - DNA, 25 bp, Mus musculus
aacttatgagctgttatgtctttag

SEQ ID NO: 41465 - DNA, 25 bp, Mus musculus
aacttatgctgaaatctggacctca

SEQ ID NO: 41466 - DNA, 25 bp, Mus musculus
aacttatgctgatatctggacctca

SEQ ID NO: 41467 - DNA, 25 bp, Mus musculus
aacttatggtcgatcattcctgtgg

SEQ ID NO: 41468 - DNA, 25 bp, Mus musculus
aacttatggtcgttcattcctgtgg

SEQ ID NO: 41469 - DNA, 25 bp, Mus musculus
aacttatggtgccttcagctccaag

SEQ ID NO: 41470 - DNA, 25 bp, Mus musculus
aacttatggtgcgttcagctccaag

SEQ ID NO: 41471 - DNA, 25 bp, Mus musculus
aacttatgtagtcaccaacttgttc

SEQ ID NO: 41472 - DNA, 25 bp, Mus musculus
aacttatgtagtgaccaacttgttc

SEQ ID NO: 41473 - DNA, 25 bp, Mus musculus
aacttatgtggacacttccaggtaa

SEQ ID NO: 41474 - DNA, 25 bp, Mus musculus
aacttatgtggagacttccaggtaa

SEQ ID NO: 41475 - DNA, 25 bp, Mus musculus
aacttatgttgtctgggtcccagga

SEQ ID NO: 41476 - DNA, 25 bp, Mus musculus
aacttatgttgtgtgggtcccagga

SEQ ID NO: 41477 - DNA, 25 bp, Mus musculus
aacttattccagagcttggtcaagg

SEQ ID NO: 41478 - DNA, 25 bp, Mus musculus
aacttattccagtgcttggtcaagg

SEQ ID NO: 41479 - DNA, 25 bp, Mus musculus
aacttattccatatagcactatctt

SEQ ID NO: 41480 - DNA, 25 bp, Mus musculus
aacttattccatttagcactatctt

SEQ ID NO: 41481 - DNA, 25 bp, Mus musculus
aacttattcttaatttgttctgtct

SEQ ID NO: 41482 - DNA, 25 bp, Mus musculus
aacttattcttattttgttctgtct

SEQ ID NO: 41483 - DNA, 25 bp, Mus musculus
aacttattgggtcaccaggcctagg

SEQ ID NO: 41484 - DNA, 25 bp, Mus musculus
aacttattgggtgaccaggcctagg

SEQ ID NO: 41485 - DNA, 25 bp, Mus musculus
aacttattgttcaccttgtggcatg

SEQ ID NO: 41486 - DNA, 25 bp, Mus musculus
aacttattgttcatattcatttcta

SEQ ID NO: 41487 - DNA, 25 bp, Mus musculus
aacttattgttctccttgtggcatg

SEQ ID NO: 41488 - DNA, 25 bp, Mus musculus
aacttattgttcttattcatttcta

SEQ ID NO: 41489 - DNA, 25 bp, Mus musculus
aacttatttcatcatgcttttgaca

SEQ ID NO: 41490 - DNA, 25 bp, Mus musculus
aacttatttcatgatgcttttgaca

SEQ ID NO: 41491 - DNA, 25 bp, Mus musculus
aacttatttctcaggtgtctgactc

SEQ ID NO: 41492 - DNA, 25 bp, Mus musculus
aacttatttctctggtgtctgactc

SEQ ID NO: 41493 - DNA, 25 bp, Mus musculus
aacttatttggcatcacccttatcc

SEQ ID NO: 41494 - DNA, 25 bp, Mus musculus
aacttatttggcttcacccttatcc

SEQ ID NO: 41495 - DNA, 25 bp, Mus musculus
aacttattttctcctgtagccagcc

SEQ ID NO: 41496 - DNA, 25 bp, Mus musculus
aacttattttctgctgtagccagcc

SEQ ID NO: 41497 - DNA, 25 bp, Mus musculus
aacttcaaaagacagtgggaggtct

SEQ ID NO: 41498 - DNA, 25 bp, Mus musculus
aacttcaaaagagagtgggaggtct

SEQ ID NO: 41499 - DNA, 25 bp, Mus musculus
aacttcaaacatacctggtgcgtgt

SEQ ID NO: 41500 - DNA, 25 bp, Mus musculus
aacttcaaacattcctggtgcgtgt

SEQ ID NO: 41501 - DNA, 25 bp, Mus musculus
aacttcaaactgcagctcagaccta

SEQ ID NO: 41502 - DNA, 25 bp, Mus musculus
aacttcaaactggagctcagaccta

SEQ ID NO: 41503 - DNA, 25 bp, Mus musculus
aacttcaaagaacgtgggctctgca

SEQ ID NO: 41504 - DNA, 25 bp, Mus musculus
aacttcaaagaaggtgggctctgca

SEQ ID NO: 41505 - DNA, 25 bp, Mus musculus
aacttcaacaggcaggtctctggtt

SEQ ID NO: 41506 - DNA, 25 bp, Mus musculus
aacttcaacagggaggtctctggtt

SEQ ID NO: 41507 - DNA, 25 bp, Mus musculus
aacttcaaccttctagctcagtagt

SEQ ID NO: 41508 - DNA, 25 bp, Mus musculus
aacttcaaccttgtagctcagtagt

SEQ ID NO: 41509 - DNA, 25 bp, Mus musculus
aacttcaagaacaggcttcgagaac

SEQ ID NO: 41510 - DNA, 25 bp, Mus musculus
aacttcaagaactggcttcgagaac

SEQ ID NO: 41511 - DNA, 25 bp, Mus musculus
aacttcaatcaaaactgccttcaca

SEQ ID NO: 41512 - DNA, 25 bp, Mus musculus
aacttcaatcaatactgccttcaca

SEQ ID NO: 41513 - DNA, 25 bp, Mus musculus
aacttcaatcatccaatgcaggctt

SEQ ID NO: 41514 - DNA, 25 bp, Mus musculus
aacttcaatcatgcaatgcaggctt

SEQ ID NO: 41515 - DNA, 25 bp, Mus musculus
aacttcaatgccaaatacgtctccc

SEQ ID NO: 41516 - DNA, 25 bp, Mus musculus
aacttcaatgcctaatacgtctccc

SEQ ID NO: 41517 - DNA, 25 bp, Mus musculus
aacttcaatgctcactgcttggatt

SEQ ID NO: 41518 - DNA, 25 bp, Mus musculus
aacttcaatgctgactgcttggatt

SEQ ID NO: 41519 - DNA, 25 bp, Mus musculus
aacttcaatttgcttagtacaacag

SEQ ID NO: 41520 - DNA, 25 bp, Mus musculus
aacttcaatttggttagtacaacag

SEQ ID NO: 41521 - DNA, 25 bp, Mus musculus
aacttcacaaagacctcacacgttg

SEQ ID NO: 41522 - DNA, 25 bp, Mus musculus
aacttcacaaagtcctcacacgttg

SEQ ID NO: 41523 - DNA, 25 bp, Mus musculus
aacttcacaataaccttagccactt

SEQ ID NO: 41524 - DNA, 25 bp, Mus musculus
aacttcacaatatccttagccactt

SEQ ID NO: 41525 - DNA, 25 bp, Mus musculus
aacttcacaccccatttatatgctg

SEQ ID NO: 41526 - DNA, 25 bp, Mus musculus
aacttcacacccgatttatatgctg

SEQ ID NO: 41527 - DNA, 25 bp, Mus musculus
aacttcacacgcactggggatgggg

SEQ ID NO: 41528 - DNA, 25 bp, Mus musculus
aacttcacacgctctggggatgggg

SEQ ID NO: 41529 - DNA, 25 bp, Mus musculus
aacttcacatatcttatggccctgt

SEQ ID NO: 41530 - DNA, 25 bp, Mus musculus
aacttcacatatgttatggccctgt

SEQ ID NO: 41531 - DNA, 25 bp, Mus musculus
aacttcacattcctttgctctattc

SEQ ID NO: 41532 - DNA, 25 bp, Mus musculus
aacttcacattcgtttgctctattc

SEQ ID NO: 41533 - DNA, 25 bp, Mus musculus
aacttcacatttcctcctagcacag

SEQ ID NO: 41534 - DNA, 25 bp, Mus musculus
aacttcacatttgctcctagcacag

SEQ ID NO: 41535 - DNA, 25 bp, Mus musculus
aacttcaccgctccgatgctcaggg

SEQ ID NO: 41536 - DNA, 25 bp, Mus musculus
aacttcaccgctgcgatgctcaggg

SEQ ID NO: 41537 - DNA, 25 bp, Mus musculus
aacttcacctatcgatgacagcaca

SEQ ID NO: 41538 - DNA, 25 bp, Mus musculus
aacttcacctatggatgacagcaca

SEQ ID NO: 41539 - DNA, 25 bp, Mus musculus
aacttcacgggcaagattacctgtt

SEQ ID NO: 41540 - DNA, 25 bp, Mus musculus
aacttcacgggccagtgcctagagt

SEQ ID NO: 41541 - DNA, 25 bp, Mus musculus
aacttcacgggcgagtgcctagagt

SEQ ID NO: 41542 - DNA, 25 bp, Mus musculus
aacttcacgggctagattacctgtt

SEQ ID NO: 41543 - DNA, 25 bp, Mus musculus
aacttcacggttcagccggaatgaa

SEQ ID NO: 41544 - DNA, 25 bp, Mus musculus
aacttcacggttgagccggaatgaa

SEQ ID NO: 41545 - DNA, 25 bp, Mus musculus
aacttcacgtgaccagacatgctag

SEQ ID NO: 41546 - DNA, 25 bp, Mus musculus
aacttcacgtgagcagacatgctag

SEQ ID NO: 41547 - DNA, 25 bp, Mus musculus
aacttcacgtgcctttttcagtgag

SEQ ID NO: 41548 - DNA, 25 bp, Mus musculus
aacttcacgtgcgtttttcagtgag

SEQ ID NO: 41549 - DNA, 25 bp, Mus musculus
aacttcacgtggacttttcatggct

SEQ ID NO: 41550 - DNA, 25 bp, Mus musculus
aacttcacgtggtcttttcatggct

SEQ ID NO: 41551 - DNA, 25 bp, Mus musculus
aacttcacgttcctcagcgtcatcg

SEQ ID NO: 41552 - DNA, 25 bp, Mus musculus
aacttcacgttcgtcagcgtcatcg

SEQ ID NO: 41553 - DNA, 25 bp, Mus musculus
aacttcacttcacgcagtctcactg

SEQ ID NO: 41554 - DNA, 25 bp, Mus musculus
aacttcacttcacttagcctgggtg

SEQ ID NO: 41555 - DNA, 25 bp, Mus musculus
aacttcacttcaggcagtctcactg

SEQ ID NO: 41556 - DNA, 25 bp, Mus musculus
aacttcacttcagttagcctgggtg

SEQ ID NO: 41557 - DNA, 25 bp, Mus musculus
aacttcacttgcatcctacagataa

SEQ ID NO: 41558 - DNA, 25 bp, Mus musculus
aacttcacttgcttcctacagataa

SEQ ID NO: 41559 - DNA, 25 bp, Mus musculus
aacttcagaaatatgcgtctcacaa

SEQ ID NO: 41560 - DNA, 25 bp, Mus musculus
aacttcagaaatttgcgtctcacaa

SEQ ID NO: 41561 - DNA, 25 bp, Mus musculus
aacttcagacctacaacagttgctg

SEQ ID NO: 41562 - DNA, 25 bp, Mus musculus
aacttcagaccttcaacagttgctg

SEQ ID NO: 41563 - DNA, 25 bp, Mus musculus
aacttcagactgctaaggctcctta

SEQ ID NO: 41564 - DNA, 25 bp, Mus musculus
aacttcagactggtaaggctcctta

SEQ ID NO: 41565 - DNA, 25 bp, Mus musculus
aacttcagagagctccttggattgt

SEQ ID NO: 41566 - DNA, 25 bp, Mus musculus
aacttcagagaggtccttggattgt

SEQ ID NO: 41567 - DNA, 25 bp, Mus musculus
aacttcagaggcaaggacatctcac

SEQ ID NO: 41568 - DNA, 25 bp, Mus musculus
aacttcagaggctaggacatctcac

SEQ ID NO: 41569 - DNA, 25 bp, Mus musculus
aacttcagagggatcctgggcacat

SEQ ID NO: 41570 - DNA, 25 bp, Mus musculus
aacttcagagggttcctgggcacat

SEQ ID NO: 41571 - DNA, 25 bp, Mus musculus
aacttcagatccagggtcctgccta

SEQ ID NO: 41572 - DNA, 25 bp, Mus musculus
aacttcagatcctgggtcctgccta

SEQ ID NO: 41573 - DNA, 25 bp, Mus musculus
aacttcagcaccaagagacatcttc

SEQ ID NO: 41574 - DNA, 25 bp, Mus musculus
aacttcagcacctagagacatcttc

SEQ ID NO: 41575 - DNA, 25 bp, Mus musculus
aacttcagccgtctgttgagaacct

SEQ ID NO: 41576 - DNA, 25 bp, Mus musculus
aacttcagccgtgtgttgagaacct

SEQ ID NO: 41577 - DNA, 25 bp, Mus musculus
aacttcagctaaatcttattttcct

SEQ ID NO: 41578 - DNA, 25 bp, Mus musculus
aacttcagctaattcttattttcct

SEQ ID NO: 41579 - DNA, 25 bp, Mus musculus
aacttcagctgaactgttgctgcct

SEQ ID NO: 41580 - DNA, 25 bp, Mus musculus
aacttcagctgatctgttgctgcct

SEQ ID NO: 41581 - DNA, 25 bp, Mus musculus
aacttcagctgtatattctctcaga

SEQ ID NO: 41582 - DNA, 25 bp, Mus musculus
aacttcagctgtttattctctcaga

SEQ ID NO: 41583 - DNA, 25 bp, Mus musculus
aacttcagggagatcagggctccct

SEQ ID NO: 41584 - DNA, 25 bp, Mus musculus
aacttcagggagttcagggctccct

SEQ ID NO: 41585 - DNA, 25 bp, Mus musculus
aacttcaggtttagcttctgtcctc

SEQ ID NO: 41586 - DNA, 25 bp, Mus musculus
aacttcaggttttgcttctgtcctc

SEQ ID NO: 41587 - DNA, 25 bp, Mus musculus
aacttcagtgtcaaccagagctgta

SEQ ID NO: 41588 - DNA, 25 bp, Mus musculus
aacttcagtgtctaccagagctgta

SEQ ID NO: 41589 - DNA, 25 bp, Mus musculus
aacttcagtttcacctggtgtcagt

SEQ ID NO: 41590 - DNA, 25 bp, Mus musculus
aacttcagtttctcctggtgtcagt

SEQ ID NO: 41591 - DNA, 25 bp, Mus musculus
aacttcataaacaccggcttcatca

SEQ ID NO: 41592 - DNA, 25 bp, Mus musculus
aacttcataaactccggcttcatca

SEQ ID NO: 41593 - DNA, 25 bp, Mus musculus
aacttcataccaatgtaccctacta

SEQ ID NO: 41594 - DNA, 25 bp, Mus musculus
aacttcataccattgtaccctacta

SEQ ID NO: 41595 - DNA, 25 bp, Mus musculus
aacttcatcaggcacaaggcctcga

SEQ ID NO: 41596 - DNA, 25 bp, Mus musculus
aacttcatcagggacaaggcctcga

SEQ ID NO: 41597 - DNA, 25 bp, Mus musculus
aacttcatcatcctaagattaggca

SEQ ID NO: 41598 - DNA, 25 bp, Mus musculus
aacttcatcatcgtaagattaggca

SEQ ID NO: 41599 - DNA, 25 bp, Mus musculus
aacttcatccacaacaatggctcca

SEQ ID NO: 41600 - DNA, 25 bp, Mus musculus
aacttcatccactacaatggctcca

SEQ ID NO: 41601 - DNA, 25 bp, Mus musculus
aacttcatctataaatctcaccacc

SEQ ID NO: 41602 - DNA, 25 bp, Mus musculus
aacttcatctattaatctcaccacc

SEQ ID NO: 41603 - DNA, 25 bp, Mus musculus
aacttcatgaagatcacacagctaa

SEQ ID NO: 41604 - DNA, 25 bp, Mus musculus
aacttcatgaagttcacacagctaa

SEQ ID NO: 41605 - DNA, 25 bp, Mus musculus
aacttcatgattcggctttttgtag

SEQ ID NO: 41606 - DNA, 25 bp, Mus musculus
aacttcatgattgggctttttgtag

SEQ ID NO: 41607 - DNA, 25 bp, Mus musculus
aacttcatgtgtctgggtattttgc

SEQ ID NO: 41608 - DNA, 25 bp, Mus musculus
aacttcatgtgtgtgggtattttgc

SEQ ID NO: 41609 - DNA, 25 bp, Mus musculus
aacttcattccgatgttgctgcacc

SEQ ID NO: 41610 - DNA, 25 bp, Mus musculus
aacttcattccgttgttgctgcacc

SEQ ID NO: 41611 - DNA, 25 bp, Mus musculus
aacttcattgttcacgggacactct

SEQ ID NO: 41612 - DNA, 25 bp, Mus musculus
aacttcattgttgacgggacactct

SEQ ID NO: 41613 - DNA, 25 bp, Mus musculus
aacttcatttttatgcactgctatt

SEQ ID NO: 41614 - DNA, 25 bp, Mus musculus
aacttcatttttttgcactgctatt

SEQ ID NO: 41615 - DNA, 25 bp, Mus musculus
aacttccaaaacctgtttgtctgtg

SEQ ID NO: 41616 - DNA, 25 bp, Mus musculus
aacttccaaaacgtgtttgtctgtg

SEQ ID NO: 41617 - DNA, 25 bp, Mus musculus
aacttccaaccaactgatcactgat

SEQ ID NO: 41618 - DNA, 25 bp, Mus musculus
aacttccaaccaatagccgtgctaa

SEQ ID NO: 41619 - DNA, 25 bp, Mus musculus
aacttccaaccatctgatcactgat

SEQ ID NO: 41620 - DNA, 25 bp, Mus musculus
aacttccaaccattagccgtgctaa

SEQ ID NO: 41621 - DNA, 25 bp, Mus musculus
aacttccaacttagacgaggcaatg

SEQ ID NO: 41622 - DNA, 25 bp, Mus musculus
aacttccaactttgacgaggcaatg

SEQ ID NO: 41623 - DNA, 25 bp, Mus musculus
aacttccaaggaacatcatgtgcgc

SEQ ID NO: 41624 - DNA, 25 bp, Mus musculus
aacttccaaggatcatcatgtgcgc

SEQ ID NO: 41625 - DNA, 25 bp, Mus musculus
aacttccaagtgacatgatttaaga

SEQ ID NO: 41626 - DNA, 25 bp, Mus musculus
aacttccaagtgatctccaagtggg

SEQ ID NO: 41627 - DNA, 25 bp, Mus musculus
aacttccaagtgtcatgatttaaga

SEQ ID NO: 41628 - DNA, 25 bp, Mus musculus
aacttccaagtgttctccaagtggg

SEQ ID NO: 41629 - DNA, 25 bp, Mus musculus
aacttccaatatcgtctcatgttgt

SEQ ID NO: 41630 - DNA, 25 bp, Mus musculus
aacttccaatatggtctcatgttgt

SEQ ID NO: 41631 - DNA, 25 bp, Mus musculus
aacttccaatgcagggcgtgttcac

SEQ ID NO: 41632 - DNA, 25 bp, Mus musculus
aacttccaatgctgggcgtgttcac

SEQ ID NO: 41633 - DNA, 25 bp, Mus musculus
aacttccacaagataccctctggct

SEQ ID NO: 41634 - DNA, 25 bp, Mus musculus
aacttccacaagttaccctctggct

SEQ ID NO: 41635 - DNA, 25 bp, Mus musculus
aacttccactacactggcagggaat

SEQ ID NO: 41636 - DNA, 25 bp, Mus musculus
aacttccactactctggcagggaat

SEQ ID NO: 41637 - DNA, 25 bp, Mus musculus
aacttccagaaactacacctcagag

SEQ ID NO: 41638 - DNA, 25 bp, Mus musculus
aacttccagaaagtacacctcagag

SEQ ID NO: 41639 - DNA, 25 bp, Mus musculus
aacttccagagccaccagcagagca

SEQ ID NO: 41640 - DNA, 25 bp, Mus musculus
aacttccagagcgaccagcagagca

SEQ ID NO: 41641 - DNA, 25 bp, Mus musculus
aacttccaggcaattgtgtgggagc

SEQ ID NO: 41642 - DNA, 25 bp, Mus musculus
aacttccaggcatttgtgtgggagc

SEQ ID NO: 41643 - DNA, 25 bp, Mus musculus
aacttccaggttcattagaggcttg

SEQ ID NO: 41644 - DNA, 25 bp, Mus musculus
aacttccaggttgattagaggcttg

SEQ ID NO: 41645 - DNA, 25 bp, Mus musculus
aacttccagtcacgatcagacccgt

SEQ ID NO: 41646 - DNA, 25 bp, Mus musculus
aacttccagtcaggatcagacccgt

SEQ ID NO: 41647 - DNA, 25 bp, Mus musculus
aacttccagtccactaagtggtact

SEQ ID NO: 41648 - DNA, 25 bp, Mus musculus
aacttccagtcctctaagtggtact

SEQ ID NO: 41649 - DNA, 25 bp, Mus musculus
aacttccatagtctcttgtatttac

SEQ ID NO: 41650 - DNA, 25 bp, Mus musculus
aacttccatagtgtcttgtatttac

SEQ ID NO: 41651 - DNA, 25 bp, Mus musculus
aacttccatctgatcatatgtagga

SEQ ID NO: 41652 - DNA, 25 bp, Mus musculus
aacttccatctgttcatatgtagga

SEQ ID NO: 41653 - DNA, 25 bp, Mus musculus
aacttcccaaccattgatgatgatg

SEQ ID NO: 41654 - DNA, 25 bp, Mus musculus
aacttcccaacctttgatgatgatg

SEQ ID NO: 41655 - DNA, 25 bp, Mus musculus
aacttcccaagtattgagaggattc

SEQ ID NO: 41656 - DNA, 25 bp, Mus musculus
aacttcccaagttttgagaggattc

SEQ ID NO: 41657 - DNA, 25 bp, Mus musculus
aacttcccagacactgtgagataca

SEQ ID NO: 41658 - DNA, 25 bp, Mus musculus
aacttcccagactctgtgagataca

SEQ ID NO: 41659 - DNA, 25 bp, Mus musculus
aacttcccagatccagcacggcagg

SEQ ID NO: 41660 - DNA, 25 bp, Mus musculus
aacttcccagatgcagcacggcagg

SEQ ID NO: 41661 - DNA, 25 bp, Mus musculus
aacttcccagggaatataggtgatg

SEQ ID NO: 41662 - DNA, 25 bp, Mus musculus
aacttcccagggtatataggtgatg

SEQ ID NO: 41663 - DNA, 25 bp, Mus musculus
aacttcccagtaacgatgttccaag

SEQ ID NO: 41664 - DNA, 25 bp, Mus musculus
aacttcccagtatcgatgttccaag

SEQ ID NO: 41665 - DNA, 25 bp, Mus musculus
aacttcccatgccttcaagagtatg

SEQ ID NO: 41666 - DNA, 25 bp, Mus musculus
aacttcccatgcgttcaagagtatg

SEQ ID NO: 41667 - DNA, 25 bp, Mus musculus
aacttcccgaggcacgtgatagcgt

SEQ ID NO: 41668 - DNA, 25 bp, Mus musculus
aacttcccgagggacgtgatagcgt

SEQ ID NO: 41669 - DNA, 25 bp, Mus musculus
aacttccctcaaatagaattatgcg

SEQ ID NO: 41670 - DNA, 25 bp, Mus musculus
aacttccctcaattagaattatgcg

SEQ ID NO: 41671 - DNA, 25 bp, Mus musculus
aacttccctgcccaatattgtatca

SEQ ID NO: 41672 - DNA, 25 bp, Mus musculus
aacttccctgccgaatattgtatca

SEQ ID NO: 41673 - DNA, 25 bp, Mus musculus
aacttccctgggagagtgtgactcc

SEQ ID NO: 41674 - DNA, 25 bp, Mus musculus
aacttccctgggtgagtgtgactcc

SEQ ID NO: 41675 - DNA, 25 bp, Mus musculus
aacttccgagtcctctctgcaaagc

SEQ ID NO: 41676 - DNA, 25 bp, Mus musculus
aacttccgagtcgtctctgcaaagc

SEQ ID NO: 41677 - DNA, 25 bp, Mus musculus
aacttcctagttactgacagtgatc

SEQ ID NO: 41678 - DNA, 25 bp, Mus musculus
aacttcctagtttctgacagtgatc

SEQ ID NO: 41679 - DNA, 25 bp, Mus musculus
aacttcctcaagaataccctctggc

SEQ ID NO: 41680 - DNA, 25 bp, Mus musculus
aacttcctcaagtataccctctggc

SEQ ID NO: 41681 - DNA, 25 bp, Mus musculus
aacttcctcagactgtgcactgttt

SEQ ID NO: 41682 - DNA, 25 bp, Mus musculus
aacttcctcagagtgtgcactgttt

SEQ ID NO: 41683 - DNA, 25 bp, Mus musculus
aacttcctcctgagtcagaactttg

SEQ ID NO: 41684 - DNA, 25 bp, Mus musculus
aacttcctcctgtgtcagaactttg

SEQ ID NO: 41685 - DNA, 25 bp, Mus musculus
aacttcctcgtgagcccgtgtgtaa

SEQ ID NO: 41686 - DNA, 25 bp, Mus musculus
aacttcctcgtgtgcccgtgtgtaa

SEQ ID NO: 41687 - DNA, 25 bp, Mus musculus
aacttcctctgtcgagcagactggc

SEQ ID NO: 41688 - DNA, 25 bp, Mus musculus
aacttcctctgtggagcagactggc

SEQ ID NO: 41689 - DNA, 25 bp, Mus musculus
aacttcctctttataccagagtagc

SEQ ID NO: 41690 - DNA, 25 bp, Mus musculus
aacttcctctttttaccagagtagc

SEQ ID NO: 41691 - DNA, 25 bp, Mus musculus
aacttcctgaagatatcacagccgg

SEQ ID NO: 41692 - DNA, 25 bp, Mus musculus
aacttcctgaagttatcacagccgg

SEQ ID NO: 41693 - DNA, 25 bp, Mus musculus
aacttcctgactagataaacctgag

SEQ ID NO: 41694 - DNA, 25 bp, Mus musculus
aacttcctgacttgataaacctgag

SEQ ID NO: 41695 - DNA, 25 bp, Mus musculus
aacttcctgagccttgttcagctgc

SEQ ID NO: 41696 - DNA, 25 bp, Mus musculus
aacttcctgagcgttgttcagctgc

SEQ ID NO: 41697 - DNA, 25 bp, Mus musculus
aacttcctgattagcattttcggct

SEQ ID NO: 41698 - DNA, 25 bp, Mus musculus
aacttcctgatttgcattttcggct

SEQ ID NO: 41699 - DNA, 25 bp, Mus musculus
aacttcctgcccaagcaagtgatgg

SEQ ID NO: 41700 - DNA, 25 bp, Mus musculus
aacttcctgccctagcaagtgatgg

SEQ ID NO: 41701 - DNA, 25 bp, Mus musculus
aacttcctgcctctgaaatttctat

SEQ ID NO: 41702 - DNA, 25 bp, Mus musculus
aacttcctgcctgtgaaatttctat

SEQ ID NO: 41703 - DNA, 25 bp, Mus musculus
aacttcctggacactacactagcat

SEQ ID NO: 41704 - DNA, 25 bp, Mus musculus
aacttcctggactctacactagcat

SEQ ID NO: 41705 - DNA, 25 bp, Mus musculus
aacttccttaggactggcactggtg

SEQ ID NO: 41706 - DNA, 25 bp, Mus musculus
aacttccttaggtctggcactggtg

SEQ ID NO: 41707 - DNA, 25 bp, Mus musculus
aacttccttctcaagggacttggca

SEQ ID NO: 41708 - DNA, 25 bp, Mus musculus
aacttccttctctagggacttggca

SEQ ID NO: 41709 - DNA, 25 bp, Mus musculus
aacttccttgagatggatacggcgg

SEQ ID NO: 41710 - DNA, 25 bp, Mus musculus
aacttccttgagttggatacggcgg

SEQ ID NO: 41711 - DNA, 25 bp, Mus musculus
aacttccttggaatgctgcccctac

SEQ ID NO: 41712 - DNA, 25 bp, Mus musculus
aacttccttggattgctgcccctac

SEQ ID NO: 41713 - DNA, 25 bp, Mus musculus
aacttccttggtcattttctgctgg

SEQ ID NO: 41714 - DNA, 25 bp, Mus musculus
aacttccttggtgattttctgctgg

SEQ ID NO: 41715 - DNA, 25 bp, Mus musculus
aacttcctttatcccctgacagatt

SEQ ID NO: 41716 - DNA, 25 bp, Mus musculus
aacttcctttatgccctgacagatt

SEQ ID NO: 41717 - DNA, 25 bp, Mus musculus
aacttcctttctcactacagtcata

SEQ ID NO: 41718 - DNA, 25 bp, Mus musculus
aacttcctttctgactacagtcata

SEQ ID NO: 41719 - DNA, 25 bp, Mus musculus
aacttcctttgaactctgccaatat

SEQ ID NO: 41720 - DNA, 25 bp, Mus musculus
aacttcctttgactagcgtcagaat

SEQ ID NO: 41721 - DNA, 25 bp, Mus musculus
aacttcctttgagtagcgtcagaat

SEQ ID NO: 41722 - DNA, 25 bp, Mus musculus
aacttcctttgatctctgccaatat

SEQ ID NO: 41723 - DNA, 25 bp, Mus musculus
aacttccttttgaatctagccacca

SEQ ID NO: 41724 - DNA, 25 bp, Mus musculus
aacttccttttgaggtcttcattag

SEQ ID NO: 41725 - DNA, 25 bp, Mus musculus
aacttccttttgtatctagccacca

SEQ ID NO: 41726 - DNA, 25 bp, Mus musculus
aacttccttttgtggtcttcattag

SEQ ID NO: 41727 - DNA, 25 bp, Mus musculus
aacttcctttttcaggtaagagcat

SEQ ID NO: 41728 - DNA, 25 bp, Mus musculus
aacttcctttttgaggtaagagcat

SEQ ID NO: 41729 - DNA, 25 bp, Mus musculus
aacttcgagtgcctctggagtgact

SEQ ID NO: 41730 - DNA, 25 bp, Mus musculus
aacttcgagtgcgtctggagtgact

SEQ ID NO: 41731 - DNA, 25 bp, Mus musculus
aacttcgcaggcagcgcagtgtgca

SEQ ID NO: 41732 - DNA, 25 bp, Mus musculus
aacttcgcaggctgcgcagtgtgca

SEQ ID NO: 41733 - DNA, 25 bp, Mus musculus
aacttcgccaggcacagaatgtcat

SEQ ID NO: 41734 - DNA, 25 bp, Mus musculus
aacttcgccagggacagaatgtcat

SEQ ID NO: 41735 - DNA, 25 bp, Mus musculus
aacttcgccgtccttaaactcatgg

SEQ ID NO: 41736 - DNA, 25 bp, Mus musculus
aacttcgccgtcgttaaactcatgg

SEQ ID NO: 41737 - DNA, 25 bp, Mus musculus
aacttcgcctccattgtggttgcca

SEQ ID NO: 41738 - DNA, 25 bp, Mus musculus
aacttcgcctcctttgtggttgcca

SEQ ID NO: 41739 - DNA, 25 bp, Mus musculus
aacttcgcggagcagatcggctgca

SEQ ID NO: 41740 - DNA, 25 bp, Mus musculus
aacttcgcggaggagatcggctgca

SEQ ID NO: 41741 - DNA, 25 bp, Mus musculus
aacttcgcttcacctgtcgtgtgca

SEQ ID NO: 41742 - DNA, 25 bp, Mus musculus
aacttcgcttcagctgtcgtgtgca

SEQ ID NO: 41743 - DNA, 25 bp, Mus musculus
aacttcggaatccagtccgctgtca

SEQ ID NO: 41744 - DNA, 25 bp, Mus musculus
aacttcggaatcgagtccgctgtca

SEQ ID NO: 41745 - DNA, 25 bp, Mus musculus
aacttcggcaacatcttcatattta

SEQ ID NO: 41746 - DNA, 25 bp, Mus musculus
aacttcggcaacttcttcatattta

SEQ ID NO: 41747 - DNA, 25 bp, Mus musculus
aacttcgtgcgtcaggtggtgacca

SEQ ID NO: 41748 - DNA, 25 bp, Mus musculus
aacttcgtgcgtgaggtggtgacca

SEQ ID NO: 41749 - DNA, 25 bp, Mus musculus
aacttcgtgctgactagctctagag

SEQ ID NO: 41750 - DNA, 25 bp, Mus musculus
aacttcgtgctgtctagctctagag

SEQ ID NO: 41751 - DNA, 25 bp, Mus musculus
aacttcgtttgtccctgatgatcag

SEQ ID NO: 41752 - DNA, 25 bp, Mus musculus
aacttcgtttgtgcctgatgatcag

SEQ ID NO: 41753 - DNA, 25 bp, Mus musculus
aacttctaaattagctttactgttg

SEQ ID NO: 41754 - DNA, 25 bp, Mus musculus
aacttctaaatttgctttactgttg

SEQ ID NO: 41755 - DNA, 25 bp, Mus musculus
aacttctaacaaaagggcacctgtg

SEQ ID NO: 41756 - DNA, 25 bp, Mus musculus
aacttctaacaatagggcacctgtg

SEQ ID NO: 41757 - DNA, 25 bp, Mus musculus
aacttctacagcacacatccaagct

SEQ ID NO: 41758 - DNA, 25 bp, Mus musculus
aacttctacagctcacatccaagct

SEQ ID NO: 41759 - DNA, 25 bp, Mus musculus
aacttctacatgagaccaagagcaa

SEQ ID NO: 41760 - DNA, 25 bp, Mus musculus
aacttctacatgtgaccaagagcaa

SEQ ID NO: 41761 - DNA, 25 bp, Mus musculus
aacttctactctatctctgctgaca

SEQ ID NO: 41762 - DNA, 25 bp, Mus musculus
aacttctactctcctcagcggaatg

SEQ ID NO: 41763 - DNA, 25 bp, Mus musculus
aacttctactctgctcagcggaatg

SEQ ID NO: 41764 - DNA, 25 bp, Mus musculus
aacttctactctttctctgctgaca

SEQ ID NO: 41765 - DNA, 25 bp, Mus musculus
aacttctactgcactcaacatctag

SEQ ID NO: 41766 - DNA, 25 bp, Mus musculus
aacttctactgctctcaacatctag

SEQ ID NO: 41767 - DNA, 25 bp, Mus musculus
aacttctactttctgaggttagtca

SEQ ID NO: 41768 - DNA, 25 bp, Mus musculus
aacttctactttgtgaggttagtca

SEQ ID NO: 41769 - DNA, 25 bp, Mus musculus
aacttctagagactgtgttgagact

SEQ ID NO: 41770 - DNA, 25 bp, Mus musculus
aacttctagagagtgtgttgagact

SEQ ID NO: 41771 - DNA, 25 bp, Mus musculus
aacttctagcaaccttagagagaaa

SEQ ID NO: 41772 - DNA, 25 bp, Mus musculus
aacttctagcaagcttagagagaaa

SEQ ID NO: 41773 - DNA, 25 bp, Mus musculus
aacttctagccgctgttttggtcct

SEQ ID NO: 41774 - DNA, 25 bp, Mus musculus
aacttctagccggtgttttggtcct

SEQ ID NO: 41775 - DNA, 25 bp, Mus musculus
aacttctataacagttcaatttgca

SEQ ID NO: 41776 - DNA, 25 bp, Mus musculus
aacttctataactgttcaatttgca

SEQ ID NO: 41777 - DNA, 25 bp, Mus musculus
aacttctatctgctagtggctggtc

SEQ ID NO: 41778 - DNA, 25 bp, Mus musculus
aacttctatctggtagtggctggtc

SEQ ID NO: 41779 - DNA, 25 bp, Mus musculus
aacttctatgctactatagacacac

SEQ ID NO: 41780 - DNA, 25 bp, Mus musculus
aacttctatgcttctatagacacac

SEQ ID NO: 41781 - DNA, 25 bp, Mus musculus
aacttctcaacgaactccacagaat

SEQ ID NO: 41782 - DNA, 25 bp, Mus musculus
aacttctcaacgtactccacagaat

SEQ ID NO: 41783 - DNA, 25 bp, Mus musculus
aacttctcaaggctgctaaggacag

SEQ ID NO: 41784 - DNA, 25 bp, Mus musculus
aacttctcaaggctgggacgatgtc

SEQ ID NO: 41785 - DNA, 25 bp, Mus musculus
aacttctcaagggtgctaaggacag

SEQ ID NO: 41786 - DNA, 25 bp, Mus musculus
aacttctcaagggtgggacgatgtc

SEQ ID NO: 41787 - DNA, 25 bp, Mus musculus
aacttctcagatattgtttacatat

SEQ ID NO: 41788 - DNA, 25 bp, Mus musculus
aacttctcagattttgtttacatat

SEQ ID NO: 41789 - DNA, 25 bp, Mus musculus
aacttctccagaagtgctaggccaa

SEQ ID NO: 41790 - DNA, 25 bp, Mus musculus
aacttctccagatgtgctaggccaa

SEQ ID NO: 41791 - DNA, 25 bp, Mus musculus
aacttctccctgcttgaaagtgggc

SEQ ID NO: 41792 - DNA, 25 bp, Mus musculus
aacttctccctggttgaaagtgggc

SEQ ID NO: 41793 - DNA, 25 bp, Mus musculus
aacttctcctagaactcaggcagtg

SEQ ID NO: 41794 - DNA, 25 bp, Mus musculus
aacttctcctagtactcaggcagtg

SEQ ID NO: 41795 - DNA, 25 bp, Mus musculus
aacttctcctgaaagccggtgctga

SEQ ID NO: 41796 - DNA, 25 bp, Mus musculus
aacttctcctgatagccggtgctga

SEQ ID NO: 41797 - DNA, 25 bp, Mus musculus
aacttctcgaaaacaattcaggcag

SEQ ID NO: 41798 - DNA, 25 bp, Mus musculus
aacttctcgaaatcaattcaggcag

SEQ ID NO: 41799 - DNA, 25 bp, Mus musculus
aacttctctgaaatgcctcgacaaa

SEQ ID NO: 41800 - DNA, 25 bp, Mus musculus
aacttctctgaattgcctcgacaaa

SEQ ID NO: 41801 - DNA, 25 bp, Mus musculus
aacttctcttccatcttggtcagtc

SEQ ID NO: 41802 - DNA, 25 bp, Mus musculus
aacttctcttccttcttggtcagtc

SEQ ID NO: 41803 - DNA, 25 bp, Mus musculus
aacttctgaagtcatttccccttag

SEQ ID NO: 41804 - DNA, 25 bp, Mus musculus
aacttctgaagtgatttccccttag

SEQ ID NO: 41805 - DNA, 25 bp, Mus musculus
aacttctgacttactatcttccaat

SEQ ID NO: 41806 - DNA, 25 bp, Mus musculus
aacttctgactttctatcttccaat

SEQ ID NO: 41807 - DNA, 25 bp, Mus musculus
aacttctgagacactccctcttggg

SEQ ID NO: 41808 - DNA, 25 bp, Mus musculus
aacttctgagactctccctcttggg

SEQ ID NO: 41809 - DNA, 25 bp, Mus musculus
aacttctgagccaatttctgtagcc

SEQ ID NO: 41810 - DNA, 25 bp, Mus musculus
aacttctgagcctatttctgtagcc

SEQ ID NO: 41811 - DNA, 25 bp, Mus musculus
aacttctgatggcaccatccatctt

SEQ ID NO: 41812 - DNA, 25 bp, Mus musculus
aacttctgatgggaccatccatctt

SEQ ID NO: 41813 - DNA, 25 bp, Mus musculus
aacttctgcattatgttggcaaaga

SEQ ID NO: 41814 - DNA, 25 bp, Mus musculus
aacttctgcattcgttggattttag

SEQ ID NO: 41815 - DNA, 25 bp, Mus musculus
aacttctgcattggttggattttag

SEQ ID NO: 41816 - DNA, 25 bp, Mus musculus
aacttctgcattttgttggcaaaga

SEQ ID NO: 41817 - DNA, 25 bp, Mus musculus
aacttctggaacattaaatactcaa

SEQ ID NO: 41818 - DNA, 25 bp, Mus musculus
aacttctggaactttaaatactcaa

SEQ ID NO: 41819 - DNA, 25 bp, Mus musculus
aacttctgggaaaacatatactcat

SEQ ID NO: 41820 - DNA, 25 bp, Mus musculus
aacttctgggaatacatatactcat

SEQ ID NO: 41821 - DNA, 25 bp, Mus musculus
aacttctgggctagtgttcttgcaa

SEQ ID NO: 41822 - DNA, 25 bp, Mus musculus
aacttctgggcttgtgttcttgcaa

SEQ ID NO: 41823 - DNA, 25 bp, Mus musculus
aacttctggtcactgctgagtcaca

SEQ ID NO: 41824 - DNA, 25 bp, Mus musculus
aacttctggtcagtgctgagtcaca

SEQ ID NO: 41825 - DNA, 25 bp, Mus musculus
aacttctggtggatacctgtcgtgg

SEQ ID NO: 41826 - DNA, 25 bp, Mus musculus
aacttctggtggttacctgtcgtgg

SEQ ID NO: 41827 - DNA, 25 bp, Mus musculus
aacttctgtgatatccacctacaac

SEQ ID NO: 41828 - DNA, 25 bp, Mus musculus
aacttctgtgatttccacctacaac

SEQ ID NO: 41829 - DNA, 25 bp, Mus musculus
aacttcttattcacactaccctctt

SEQ ID NO: 41830 - DNA, 25 bp, Mus musculus
aacttcttattctcactaccctctt

SEQ ID NO: 41831 - DNA, 25 bp, Mus musculus
aacttcttcaagctgatatgggcgt

SEQ ID NO: 41832 - DNA, 25 bp, Mus musculus
aacttcttcaaggtgatatgggcgt

SEQ ID NO: 41833 - DNA, 25 bp, Mus musculus
aacttcttcaccaagcatttggctt

SEQ ID NO: 41834 - DNA, 25 bp, Mus musculus
aacttcttcacctagcatttggctt

SEQ ID NO: 41835 - DNA, 25 bp, Mus musculus
aacttcttcaggataccctctgact

SEQ ID NO: 41836 - DNA, 25 bp, Mus musculus
aacttcttcaggttaccctctgact

SEQ ID NO: 41837 - DNA, 25 bp, Mus musculus
aacttcttcagtctcatgtctgcct

SEQ ID NO: 41838 - DNA, 25 bp, Mus musculus
aacttcttcagtgtcatgtctgcct

SEQ ID NO: 41839 - DNA, 25 bp, Mus musculus
aacttcttccagatgcccgtgagtg

SEQ ID NO: 41840 - DNA, 25 bp, Mus musculus
aacttcttccagttgcccgtgagtg

SEQ ID NO: 41841 - DNA, 25 bp, Mus musculus
aacttcttctagcctggacctagtg

SEQ ID NO: 41842 - DNA, 25 bp, Mus musculus
aacttcttctaggctggacctagtg

SEQ ID NO: 41843 - DNA, 25 bp, Mus musculus
aacttcttctggcatgggcagattt

SEQ ID NO: 41844 - DNA, 25 bp, Mus musculus
aacttcttctgggatgggcagattt

SEQ ID NO: 41845 - DNA, 25 bp, Mus musculus
aacttcttgaggctccaagtgcaat

SEQ ID NO: 41846 - DNA, 25 bp, Mus musculus
aacttcttgagggtccaagtgcaat

SEQ ID NO: 41847 - DNA, 25 bp, Mus musculus
aacttcttggccaacccgagcaagt

SEQ ID NO: 41848 - DNA, 25 bp, Mus musculus
aacttcttggcctacccgagcaagt

SEQ ID NO: 41849 - DNA, 25 bp, Mus musculus
aacttcttgggaatcgcatggacgc

SEQ ID NO: 41850 - DNA, 25 bp, Mus musculus
aacttcttgggattcgcatggacgc

SEQ ID NO: 41851 - DNA, 25 bp, Mus musculus
aacttcttgtttactttcatgctcc

SEQ ID NO: 41852 - DNA, 25 bp, Mus musculus
aacttcttgttttctttcatgctcc

SEQ ID NO: 41853 - DNA, 25 bp, Mus musculus
aacttctttactcctgcatacctga

SEQ ID NO: 41854 - DNA, 25 bp, Mus musculus
aacttctttactgctgcatacctga

SEQ ID NO: 41855 - DNA, 25 bp, Mus musculus
aacttctttccacatgtttcacagg

SEQ ID NO: 41856 - DNA, 25 bp, Mus musculus
aacttctttccagatgtttcacagg

SEQ ID NO: 41857 - DNA, 25 bp, Mus musculus
aacttctttgatatacaagcacatc

SEQ ID NO: 41858 - DNA, 25 bp, Mus musculus
aacttctttgatttacaagcacatc

SEQ ID NO: 41859 - DNA, 25 bp, Mus musculus
aacttctttgggacagtgcagtgta

SEQ ID NO: 41860 - DNA, 25 bp, Mus musculus
aacttctttgggtcagtgcagtgta

SEQ ID NO: 41861 - DNA, 25 bp, Mus musculus
aacttgaaagccagcacgtcataca

SEQ ID NO: 41862 - DNA, 25 bp, Mus musculus
aacttgaaagcctgcacgtcataca

SEQ ID NO: 41863 - DNA, 25 bp, Mus musculus
aacttgaaatgcatagccttatgtg

SEQ ID NO: 41864 - DNA, 25 bp, Mus musculus
aacttgaaatgcttagccttatgtg

SEQ ID NO: 41865 - DNA, 25 bp, Mus musculus
aacttgaacattccagagagcccca

SEQ ID NO: 41866 - DNA, 25 bp, Mus musculus
aacttgaacattgcagagagcccca

SEQ ID NO: 41867 - DNA, 25 bp, Mus musculus
aacttgaaccacaggcaaacgccat

SEQ ID NO: 41868 - DNA, 25 bp, Mus musculus
aacttgaaccactggcaaacgccat

SEQ ID NO: 41869 - DNA, 25 bp, Mus musculus
aacttgaagaggctaggcacacagc

SEQ ID NO: 41870 - DNA, 25 bp, Mus musculus
aacttgaagagggtaggcacacagc

SEQ ID NO: 41871 - DNA, 25 bp, Mus musculus
aacttgaagatcacattggtgtttc

SEQ ID NO: 41872 - DNA, 25 bp, Mus musculus
aacttgaagatctcattggtgtttc

SEQ ID NO: 41873 - DNA, 25 bp, Mus musculus
aacttgaagcaaagccccagctgtg

SEQ ID NO: 41874 - DNA, 25 bp, Mus musculus
aacttgaagcaatgccccagctgtg

SEQ ID NO: 41875 - DNA, 25 bp, Mus musculus
aacttgaagcatccactgaacattt

SEQ ID NO: 41876 - DNA, 25 bp, Mus musculus
aacttgaagcatgcactgaacattt

SEQ ID NO: 41877 - DNA, 25 bp, Mus musculus
aacttgaagccaacaccgtgtttgg

SEQ ID NO: 41878 - DNA, 25 bp, Mus musculus
aacttgaagccatcaccgtgtttgg

SEQ ID NO: 41879 - DNA, 25 bp, Mus musculus
aacttgaagcccagttggaggctcc

SEQ ID NO: 41880 - DNA, 25 bp, Mus musculus
aacttgaagccctgttggaggctcc

SEQ ID NO: 41881 - DNA, 25 bp, Mus musculus
aacttgaaggctctatcgtcagaac

SEQ ID NO: 41882 - DNA, 25 bp, Mus musculus
aacttgaaggctgtatcgtcagaac

SEQ ID NO: 41883 - DNA, 25 bp, Mus musculus
aacttgaatgcccactcaggagctt

SEQ ID NO: 41884 - DNA, 25 bp, Mus musculus
aacttgaatgccgactcaggagctt

SEQ ID NO: 41885 - DNA, 25 bp, Mus musculus
aacttgaattatatcctcatcctgt

SEQ ID NO: 41886 - DNA, 25 bp, Mus musculus
aacttgaattatttcctcatcctgt

SEQ ID NO: 41887 - DNA, 25 bp, Mus musculus
aacttgaccgaccttttcttctatg

SEQ ID NO: 41888 - DNA, 25 bp, Mus musculus
aacttgaccgacgttttcttctatg

SEQ ID NO: 41889 - DNA, 25 bp, Mus musculus
aacttgaccttgatagcagtgggaa

SEQ ID NO: 41890 - DNA, 25 bp, Mus musculus
aacttgaccttgttagcagtgggaa

SEQ ID NO: 41891 - DNA, 25 bp, Mus musculus
aacttgacggacagtggcagaggct

SEQ ID NO: 41892 - DNA, 25 bp, Mus musculus
aacttgacggactgtggcagaggct

SEQ ID NO: 41893 - DNA, 25 bp, Mus musculus
aacttgactgtaattttctgctttt

SEQ ID NO: 41894 - DNA, 25 bp, Mus musculus
aacttgactgtactactgaaccaaa

SEQ ID NO: 41895 - DNA, 25 bp, Mus musculus
aacttgactgtagtactgaaccaaa

SEQ ID NO: 41896 - DNA, 25 bp, Mus musculus
aacttgactgtatttttctgctttt

SEQ ID NO: 41897 - DNA, 25 bp, Mus musculus
aacttgacttgcactagggaacctt

SEQ ID NO: 41898 - DNA, 25 bp, Mus musculus
aacttgacttgctctagggaacctt

SEQ ID NO: 41899 - DNA, 25 bp, Mus musculus
aacttgagaggacatcatagttttc

SEQ ID NO: 41900 - DNA, 25 bp, Mus musculus
aacttgagaggagatcatagttttc

SEQ ID NO: 41901 - DNA, 25 bp, Mus musculus
aacttgagcagcctttgctgccttc

SEQ ID NO: 41902 - DNA, 25 bp, Mus musculus
aacttgagcagcgtttgctgccttc

SEQ ID NO: 41903 - DNA, 25 bp, Mus musculus
aacttgagcaggactctggaagcca

SEQ ID NO: 41904 - DNA, 25 bp, Mus musculus
aacttgagcaggtctctggaagcca

SEQ ID NO: 41905 - DNA, 25 bp, Mus musculus
aacttgaggaagatcccctagggca

SEQ ID NO: 41906 - DNA, 25 bp, Mus musculus
aacttgaggaagttcccctagggca

SEQ ID NO: 41907 - DNA, 25 bp, Mus musculus
aacttgaggatccttctcttgagaa

SEQ ID NO: 41908 - DNA, 25 bp, Mus musculus
aacttgaggatcgttctcttgagaa

SEQ ID NO: 41909 - DNA, 25 bp, Mus musculus
aacttgaggattctagcttttgtga

SEQ ID NO: 41910 - DNA, 25 bp, Mus musculus
aacttgaggattgtagcttttgtga

SEQ ID NO: 41911 - DNA, 25 bp, Mus musculus
aacttgaggcaactcctgggtttgc

SEQ ID NO: 41912 - DNA, 25 bp, Mus musculus
aacttgaggcaagtcctgggtttgc

SEQ ID NO: 41913 - DNA, 25 bp, Mus musculus
aacttgagggctcaactctgctgtc

SEQ ID NO: 41914 - DNA, 25 bp, Mus musculus
aacttgagggctgaactctgctgtc

SEQ ID NO: 41915 - DNA, 25 bp, Mus musculus
aacttgaggttccttgaatttgcga

SEQ ID NO: 41916 - DNA, 25 bp, Mus musculus
aacttgaggttcgttgaatttgcga

SEQ ID NO: 41917 - DNA, 25 bp, Mus musculus
aacttgaggttgacaggcggctcag

SEQ ID NO: 41918 - DNA, 25 bp, Mus musculus
aacttgaggttgtcaggcggctcag

SEQ ID NO: 41919 - DNA, 25 bp, Mus musculus
aacttgagtgttctgtgtgagacca

SEQ ID NO: 41920 - DNA, 25 bp, Mus musculus
aacttgagtgttgtgtgtgagacca

SEQ ID NO: 41921 - DNA, 25 bp, Mus musculus
aacttgagttccacttacctctatg

SEQ ID NO: 41922 - DNA, 25 bp, Mus musculus
aacttgagttcctcttacctctatg

SEQ ID NO: 41923 - DNA, 25 bp, Mus musculus
aacttgagtttgattcttgtgtgtt

SEQ ID NO: 41924 - DNA, 25 bp, Mus musculus
aacttgagtttgctctttacttcat

SEQ ID NO: 41925 - DNA, 25 bp, Mus musculus
aacttgagtttggtctttacttcat

SEQ ID NO: 41926 - DNA, 25 bp, Mus musculus
aacttgagtttgtttcttgtgtgtt

SEQ ID NO: 41927 - DNA, 25 bp, Mus musculus
aacttgatactgaagtctttcttga

SEQ ID NO: 41928 - DNA, 25 bp, Mus musculus
aacttgatactgtagtctttcttga

SEQ ID NO: 41929 - DNA, 25 bp, Mus musculus
aacttgatcacaaaaccatatggat

SEQ ID NO: 41930 - DNA, 25 bp, Mus musculus
aacttgatcacataaccatatggat

SEQ ID NO: 41931 - DNA, 25 bp, Mus musculus
aacttgatgactactgcatgcttgc

SEQ ID NO: 41932 - DNA, 25 bp, Mus musculus
aacttgatgacttctgcatgcttgc

SEQ ID NO: 41933 - DNA, 25 bp, Mus musculus
aacttgatgagccaatgttatctga

SEQ ID NO: 41934 - DNA, 25 bp, Mus musculus
aacttgatgagcgaatgttatctga

SEQ ID NO: 41935 - DNA, 25 bp, Mus musculus
aacttgatgcccctaatgggcagaa

SEQ ID NO: 41936 - DNA, 25 bp, Mus musculus
aacttgatgcccgtaatgggcagaa

SEQ ID NO: 41937 - DNA, 25 bp, Mus musculus
aacttgatgtagctgttccctagca

SEQ ID NO: 41938 - DNA, 25 bp, Mus musculus
aacttgatgtaggtgttccctagca

SEQ ID NO: 41939 - DNA, 25 bp, Mus musculus
aacttgatgtctagattacaaagct

SEQ ID NO: 41940 - DNA, 25 bp, Mus musculus
aacttgatgtcttgattacaaagct

SEQ ID NO: 41941 - DNA, 25 bp, Mus musculus
aacttgatgtttctggtcactttgc

SEQ ID NO: 41942 - DNA, 25 bp, Mus musculus
aacttgatgtttgtggtcactttgc

SEQ ID NO: 41943 - DNA, 25 bp, Mus musculus
aacttgattccaattgttttctctc

SEQ ID NO: 41944 - DNA, 25 bp, Mus musculus
aacttgattccatttgttttctctc

SEQ ID NO: 41945 - DNA, 25 bp, Mus musculus
aacttgattgtcacaccattggtta

SEQ ID NO: 41946 - DNA, 25 bp, Mus musculus
aacttgattgtctcaccattggtta

SEQ ID NO: 41947 - DNA, 25 bp, Mus musculus
aacttgatttgtactggttacatgc

SEQ ID NO: 41948 - DNA, 25 bp, Mus musculus
aacttgatttgttctggttacatgc

SEQ ID NO: 41949 - DNA, 25 bp, Mus musculus
aacttgcaaacacccattcaccagt

SEQ ID NO: 41950 - DNA, 25 bp, Mus musculus
aacttgcaaacagccattcaccagt

SEQ ID NO: 41951 - DNA, 25 bp, Mus musculus
aacttgcaacttccaggccattgtt

SEQ ID NO: 41952 - DNA, 25 bp, Mus musculus
aacttgcaacttgcaggccattgtt

SEQ ID NO: 41953 - DNA, 25 bp, Mus musculus
aacttgcacatgcagaggtgagaga

SEQ ID NO: 41954 - DNA, 25 bp, Mus musculus
aacttgcacatggagaggtgagaga

SEQ ID NO: 41955 - DNA, 25 bp, Mus musculus
aacttgcacgttaatttccagatgg

SEQ ID NO: 41956 - DNA, 25 bp, Mus musculus
aacttgcacgtttatttccagatgg

SEQ ID NO: 41957 - DNA, 25 bp, Mus musculus
aacttgcagaccagactgggcttga

SEQ ID NO: 41958 - DNA, 25 bp, Mus musculus
aacttgcagacctgactgggcttga

SEQ ID NO: 41959 - DNA, 25 bp, Mus musculus
aacttgcagagaactctctcctgtc

SEQ ID NO: 41960 - DNA, 25 bp, Mus musculus
aacttgcagagatctctctcctgtc

SEQ ID NO: 41961 - DNA, 25 bp, Mus musculus
aacttgcagcttacggtggcacggg

SEQ ID NO: 41962 - DNA, 25 bp, Mus musculus
aacttgcagctttcggtggcacggg

SEQ ID NO: 41963 - DNA, 25 bp, Mus musculus
aacttgcaggttatatctaatcaga

SEQ ID NO: 41964 - DNA, 25 bp, Mus musculus
aacttgcaggttttatctaatcaga

SEQ ID NO: 41965 - DNA, 25 bp, Mus musculus
aacttgcattcccaagactgacctt

SEQ ID NO: 41966 - DNA, 25 bp, Mus musculus
aacttgcattccgaagactgacctt

SEQ ID NO: 41967 - DNA, 25 bp, Mus musculus
aacttgcatttaagaacatggtaat

SEQ ID NO: 41968 - DNA, 25 bp, Mus musculus
aacttgcatttatgaacatggtaat

SEQ ID NO: 41969 - DNA, 25 bp, Mus musculus
aacttgcattttcctgtagcttagg

SEQ ID NO: 41970 - DNA, 25 bp, Mus musculus
aacttgcattttgctgtagcttagg

SEQ ID NO: 41971 - DNA, 25 bp, Mus musculus
aacttgccataaaccccaatctctg

SEQ ID NO: 41972 - DNA, 25 bp, Mus musculus
aacttgccataatccccaatctctg

SEQ ID NO: 41973 - DNA, 25 bp, Mus musculus
aacttgccatagagaaatgtataat

SEQ ID NO: 41974 - DNA, 25 bp, Mus musculus
aacttgccatagtgaaatgtataat

SEQ ID NO: 41975 - DNA, 25 bp, Mus musculus
aacttgccatcacattctcactcat

SEQ ID NO: 41976 - DNA, 25 bp, Mus musculus
aacttgccatcagattctcactcat

SEQ ID NO: 41977 - DNA, 25 bp, Mus musculus
aacttgccatccatcctgtgaaagg

SEQ ID NO: 41978 - DNA, 25 bp, Mus musculus
aacttgccatccttcctgtgaaagg

SEQ ID NO: 41979 - DNA, 25 bp, Mus musculus
aacttgccccacagtagaattgcct

SEQ ID NO: 41980 - DNA, 25 bp, Mus musculus
aacttgccccactgtagaattgcct

SEQ ID NO: 41981 - DNA, 25 bp, Mus musculus
aacttgcccctcaccattggcattt

SEQ ID NO: 41982 - DNA, 25 bp, Mus musculus
aacttgcccctctccattggcattt

SEQ ID NO: 41983 - DNA, 25 bp, Mus musculus
aacttgcccttgccatgggtcctgc

SEQ ID NO: 41984 - DNA, 25 bp, Mus musculus
aacttgcccttggcatgggtcctgc

SEQ ID NO: 41985 - DNA, 25 bp, Mus musculus
aacttgccgacaactgctctgggaa

SEQ ID NO: 41986 - DNA, 25 bp, Mus musculus
aacttgccgacatctgctctgggaa

SEQ ID NO: 41987 - DNA, 25 bp, Mus musculus
aacttgccggccatgattagagaaa

SEQ ID NO: 41988 - DNA, 25 bp, Mus musculus
aacttgccggccttgattagagaaa

SEQ ID NO: 41989 - DNA, 25 bp, Mus musculus
aacttgcctctaatgaacaggaagt

SEQ ID NO: 41990 - DNA, 25 bp, Mus musculus
aacttgcctctattgaacaggaagt

SEQ ID NO: 41991 - DNA, 25 bp, Mus musculus
aacttgcctctgcaacagtgattaa

SEQ ID NO: 41992 - DNA, 25 bp, Mus musculus
aacttgcctctggaacagtgattaa

SEQ ID NO: 41993 - DNA, 25 bp, Mus musculus
aacttgcctgggatactactgcagt

SEQ ID NO: 41994 - DNA, 25 bp, Mus musculus
aacttgcctgggttactactgcagt

SEQ ID NO: 41995 - DNA, 25 bp, Mus musculus
aacttgcctgtcagcagttgggcgg

SEQ ID NO: 41996 - DNA, 25 bp, Mus musculus
aacttgcctgtctgcagttgggcgg

SEQ ID NO: 41997 - DNA, 25 bp, Mus musculus
aacttgctactaatttcctaccata

SEQ ID NO: 41998 - DNA, 25 bp, Mus musculus
aacttgctactattttcctaccata

SEQ ID NO: 41999 - DNA, 25 bp, Mus musculus
aacttgctaggcaaactgcagacca

SEQ ID NO: 42000 - DNA, 25 bp, Mus musculus
aacttgctaggctaactgcagacca

SEQ ID NO: 42001 - DNA, 25 bp, Mus musculus
aacttgctaggtcttggtggtacat

SEQ ID NO: 42002 - DNA, 25 bp, Mus musculus
aacttgctaggtgttggtggtacat

SEQ ID NO: 42003 - DNA, 25 bp, Mus musculus
aacttgctagtcattcacatggcca

SEQ ID NO: 42004 - DNA, 25 bp, Mus musculus
aacttgctagtctttcacatggcca

SEQ ID NO: 42005 - DNA, 25 bp, Mus musculus
aacttgctccaacacgaatcgacag

SEQ ID NO: 42006 - DNA, 25 bp, Mus musculus
aacttgctccaagacgaatcgacag

SEQ ID NO: 42007 - DNA, 25 bp, Mus musculus
aacttgctcctcacatattattgtg

SEQ ID NO: 42008 - DNA, 25 bp, Mus musculus
aacttgctcctctcatattattgtg

SEQ ID NO: 42009 - DNA, 25 bp, Mus musculus
aacttgctcggtctgaattcttcga

SEQ ID NO: 42010 - DNA, 25 bp, Mus musculus
aacttgctcggtgtgaattcttcga

SEQ ID NO: 42011 - DNA, 25 bp, Mus musculus
aacttgctctgaagtgggtccctaa

SEQ ID NO: 42012 - DNA, 25 bp, Mus musculus
aacttgctctgatgtgggtccctaa

SEQ ID NO: 42013 - DNA, 25 bp, Mus musculus
aacttgctctgcatgaacagcgtat

SEQ ID NO: 42014 - DNA, 25 bp, Mus musculus
aacttgctctgcttgaacagcgtat

SEQ ID NO: 42015 - DNA, 25 bp, Mus musculus
aacttgctctgtactacgatgcagc

SEQ ID NO: 42016 - DNA, 25 bp, Mus musculus
aacttgctctgttctacgatgcagc

SEQ ID NO: 42017 - DNA, 25 bp, Mus musculus
aacttgctcttacaccctggctttt

SEQ ID NO: 42018 - DNA, 25 bp, Mus musculus
aacttgctcttagaccctggctttt

SEQ ID NO: 42019 - DNA, 25 bp, Mus musculus
aacttgctgggacctataacgtctt

SEQ ID NO: 42020 - DNA, 25 bp, Mus musculus
aacttgctgggagctataacgtctt

SEQ ID NO: 42021 - DNA, 25 bp, Mus musculus
aacttgctggttcttgctagtggtc

SEQ ID NO: 42022 - DNA, 25 bp, Mus musculus
aacttgctggttgttgctagtggtc

SEQ ID NO: 42023 - DNA, 25 bp, Mus musculus
aacttgcttaacatgtcttcagagg

SEQ ID NO: 42024 - DNA, 25 bp, Mus musculus
aacttgcttaacttgtcttcagagg

SEQ ID NO: 42025 - DNA, 25 bp, Mus musculus
aacttgcttatcaaatgtgcgctga

SEQ ID NO: 42026 - DNA, 25 bp, Mus musculus
aacttgcttatccagcaggccatgg

SEQ ID NO: 42027 - DNA, 25 bp, Mus musculus
aacttgcttatcgagcaggccatgg

SEQ ID NO: 42028 - DNA, 25 bp, Mus musculus
aacttgcttatctaatgtgcgctga

SEQ ID NO: 42029 - DNA, 25 bp, Mus musculus
aacttgcttcatagtgtttggcgac

SEQ ID NO: 42030 - DNA, 25 bp, Mus musculus
aacttgcttcattgtgtttggcgac

SEQ ID NO: 42031 - DNA, 25 bp, Mus musculus
aacttgcttctgattggttggaaag

SEQ ID NO: 42032 - DNA, 25 bp, Mus musculus
aacttgcttctgtttggttggaaag

SEQ ID NO: 42033 - DNA, 25 bp, Mus musculus
aacttgcttgagctttttctagcct

SEQ ID NO: 42034 - DNA, 25 bp, Mus musculus
aacttgcttgaggtttttctagcct

SEQ ID NO: 42035 - DNA, 25 bp, Mus musculus
aacttgctttacactcatcttgttg

SEQ ID NO: 42036 - DNA, 25 bp, Mus musculus
aacttgctttactctcatcttgttg

SEQ ID NO: 42037 - DNA, 25 bp, Mus musculus
aacttggaaatgatcactccttcga

SEQ ID NO: 42038 - DNA, 25 bp, Mus musculus
aacttggaaatgttcactccttcga

SEQ ID NO: 42039 - DNA, 25 bp, Mus musculus
aacttggaactgactttcattgtag

SEQ ID NO: 42040 - DNA, 25 bp, Mus musculus
aacttggaactgtctttcattgtag

SEQ ID NO: 42041 - DNA, 25 bp, Mus musculus
aacttggaagccactggaactgtgc

SEQ ID NO: 42042 - DNA, 25 bp, Mus musculus
aacttggaagcctctggaactgtgc

SEQ ID NO: 42043 - DNA, 25 bp, Mus musculus
aacttggaagttagtatttctcttg

SEQ ID NO: 42044 - DNA, 25 bp, Mus musculus
aacttggaagtttgtatttctcttg

SEQ ID NO: 42045 - DNA, 25 bp, Mus musculus
aacttggacaatatgacaacggcat

SEQ ID NO: 42046 - DNA, 25 bp, Mus musculus
aacttggacaatttgacaacggcat

SEQ ID NO: 42047 - DNA, 25 bp, Mus musculus
aacttggacagcctcatgggccttg

SEQ ID NO: 42048 - DNA, 25 bp, Mus musculus
aacttggacagcgtcatgggccttg

SEQ ID NO: 42049 - DNA, 25 bp, Mus musculus
aacttggacccacaattgttcatat

SEQ ID NO: 42050 - DNA, 25 bp, Mus musculus
aacttggacccagaattgttcatat

SEQ ID NO: 42051 - DNA, 25 bp, Mus musculus
aacttggacctaagactcaccactg

SEQ ID NO: 42052 - DNA, 25 bp, Mus musculus
aacttggacctatgactcaccactg

SEQ ID NO: 42053 - DNA, 25 bp, Mus musculus
aacttggacttacctttagtgcagg

SEQ ID NO: 42054 - DNA, 25 bp, Mus musculus
aacttggacttagctttagtgcagg

SEQ ID NO: 42055 - DNA, 25 bp, Mus musculus
aacttggagggcacttcagctaacc

SEQ ID NO: 42056 - DNA, 25 bp, Mus musculus
aacttggagggccaggtttgcagga

SEQ ID NO: 42057 - DNA, 25 bp, Mus musculus
aacttggagggcgaggtttgcagga

SEQ ID NO: 42058 - DNA, 25 bp, Mus musculus
aacttggagggctcttcagctaacc

SEQ ID NO: 42059 - DNA, 25 bp, Mus musculus
aacttggatagcatgattttacaca

SEQ ID NO: 42060 - DNA, 25 bp, Mus musculus
aacttggatagcttgattttacaca

SEQ ID NO: 42061 - DNA, 25 bp, Mus musculus
aacttggatgaaactgtcatgtcat

SEQ ID NO: 42062 - DNA, 25 bp, Mus musculus
aacttggatgaatctgtcatgtcat

SEQ ID NO: 42063 - DNA, 25 bp, Mus musculus
aacttggattccagcacataggcaa

SEQ ID NO: 42064 - DNA, 25 bp, Mus musculus
aacttggattcctgcacataggcaa

SEQ ID NO: 42065 - DNA, 25 bp, Mus musculus
aacttggatttcaaagcgttcttga

SEQ ID NO: 42066 - DNA, 25 bp, Mus musculus
aacttggatttctaagcgttcttga

SEQ ID NO: 42067 - DNA, 25 bp, Mus musculus
aacttggcacttacatggagatggt

SEQ ID NO: 42068 - DNA, 25 bp, Mus musculus
aacttggcactttcatggagatggt

SEQ ID NO: 42069 - DNA, 25 bp, Mus musculus
aacttggcagaaaagtttcttgtct

SEQ ID NO: 42070 - DNA, 25 bp, Mus musculus
aacttggcagaatagtttcttgtct

SEQ ID NO: 42071 - DNA, 25 bp, Mus musculus
aacttggcagggaccaggcagagta

SEQ ID NO: 42072 - DNA, 25 bp, Mus musculus
aacttggcagggtccaggcagagta

SEQ ID NO: 42073 - DNA, 25 bp, Mus musculus
aacttggcatacatttcttttcctg

SEQ ID NO: 42074 - DNA, 25 bp, Mus musculus
aacttggcatacttttcttttcctg

SEQ ID NO: 42075 - DNA, 25 bp, Mus musculus
aacttggcatccattccctttttat

SEQ ID NO: 42076 - DNA, 25 bp, Mus musculus
aacttggcatcctttccctttttat

SEQ ID NO: 42077 - DNA, 25 bp, Mus musculus
aacttggccactagaagtcttgcat

SEQ ID NO: 42078 - DNA, 25 bp, Mus musculus
aacttggccacttgaagtcttgcat

SEQ ID NO: 42079 - DNA, 25 bp, Mus musculus
aacttggcctgaagtttttcttggg

SEQ ID NO: 42080 - DNA, 25 bp, Mus musculus
aacttggcctgatgtttttcttggg

SEQ ID NO: 42081 - DNA, 25 bp, Mus musculus
aacttggccttgcagctcctgtgat

SEQ ID NO: 42082 - DNA, 25 bp, Mus musculus
aacttggccttggagctcctgtgat

SEQ ID NO: 42083 - DNA, 25 bp, Mus musculus
aacttggcggtgaacacaggcctgt

SEQ ID NO: 42084 - DNA, 25 bp, Mus musculus
aacttggcggtgtacacaggcctgt

SEQ ID NO: 42085 - DNA, 25 bp, Mus musculus
aacttggctcacagttaggttctga

SEQ ID NO: 42086 - DNA, 25 bp, Mus musculus
aacttggctcactgttaggttctga

SEQ ID NO: 42087 - DNA, 25 bp, Mus musculus
aacttggctgcgatggatctggaac

SEQ ID NO: 42088 - DNA, 25 bp, Mus musculus
aacttggctgcgttggatctggaac

SEQ ID NO: 42089 - DNA, 25 bp, Mus musculus
aacttggctgctagtgggatccagt

SEQ ID NO: 42090 - DNA, 25 bp, Mus musculus
aacttggctgcttgtgggatccagt

SEQ ID NO: 42091 - DNA, 25 bp, Mus musculus
aacttggctggacagcactgatggt

SEQ ID NO: 42092 - DNA, 25 bp, Mus musculus
aacttggctggagagcactgatggt

SEQ ID NO: 42093 - DNA, 25 bp, Mus musculus
aacttggctgtacgtgcggaatccc

SEQ ID NO: 42094 - DNA, 25 bp, Mus musculus
aacttggctgtaggtgcggaatccc

SEQ ID NO: 42095 - DNA, 25 bp, Mus musculus
aacttggctgttacaagacctgaac

SEQ ID NO: 42096 - DNA, 25 bp, Mus musculus
aacttggctgtttcaagacctgaac

SEQ ID NO: 42097 - DNA, 25 bp, Mus musculus
aacttgggatccatggtgggtgcta

SEQ ID NO: 42098 - DNA, 25 bp, Mus musculus
aacttgggatccttggtgggtgcta

SEQ ID NO: 42099 - DNA, 25 bp, Mus musculus
aacttgggcaacaaacacacaagga

SEQ ID NO: 42100 - DNA, 25 bp, Mus musculus
aacttgggcaactaacacacaagga

SEQ ID NO: 42101 - DNA, 25 bp, Mus musculus
aacttgggcccaccaaaatggctcc

SEQ ID NO: 42102 - DNA, 25 bp, Mus musculus
aacttgggcccagcaaaatggctcc

SEQ ID NO: 42103 - DNA, 25 bp, Mus musculus
aacttgggctaacggtactaccatg

SEQ ID NO: 42104 - DNA, 25 bp, Mus musculus
aacttgggctaagggtactaccatg

SEQ ID NO: 42105 - DNA, 25 bp, Mus musculus
aacttgggctacacaacaagaccct

SEQ ID NO: 42106 - DNA, 25 bp, Mus musculus
aacttgggctactcaacaagaccct

SEQ ID NO: 42107 - DNA, 25 bp, Mus musculus
aacttgggtcctccggtgcagagca

SEQ ID NO: 42108 - DNA, 25 bp, Mus musculus
aacttgggtcctgcggtgcagagca

SEQ ID NO: 42109 - DNA, 25 bp, Mus musculus
aacttgggtctgctttctacagtca

SEQ ID NO: 42110 - DNA, 25 bp, Mus musculus
aacttgggtctggtttctacagtca

SEQ ID NO: 42111 - DNA, 25 bp, Mus musculus
aacttggtactcagctctctaagaa

SEQ ID NO: 42112 - DNA, 25 bp, Mus musculus
aacttggtactctgctctctaagaa

SEQ ID NO: 42113 - DNA, 25 bp, Mus musculus
aacttggtatgcagcctagggtggc

SEQ ID NO: 42114 - DNA, 25 bp, Mus musculus
aacttggtatgctgcctagggtggc

SEQ ID NO: 42115 - DNA, 25 bp, Mus musculus
aacttggtcagaagtcttgttccag

SEQ ID NO: 42116 - DNA, 25 bp, Mus musculus
aacttggtcagatgtcttgttccag

SEQ ID NO: 42117 - DNA, 25 bp, Mus musculus
aacttggtccttctggagatggtca

SEQ ID NO: 42118 - DNA, 25 bp, Mus musculus
aacttggtccttgtggagatggtca

SEQ ID NO: 42119 - DNA, 25 bp, Mus musculus
aacttggtgcagacattccgtgacg

SEQ ID NO: 42120 - DNA, 25 bp, Mus musculus
aacttggtgcagtcattccgtgacg

SEQ ID NO: 42121 - DNA, 25 bp, Mus musculus
aacttggtgcctaccgttcagtatt

SEQ ID NO: 42122 - DNA, 25 bp, Mus musculus
aacttggtgccttccgttcagtatt

SEQ ID NO: 42123 - DNA, 25 bp, Mus musculus
aacttggtgctcatccaatattttt

SEQ ID NO: 42124 - DNA, 25 bp, Mus musculus
aacttggtgctcttccaatattttt

SEQ ID NO: 42125 - DNA, 25 bp, Mus musculus
aacttggtggtgactgcaagtgtgc

SEQ ID NO: 42126 - DNA, 25 bp, Mus musculus
aacttggtggtgtctgcaagtgtgc

SEQ ID NO: 42127 - DNA, 25 bp, Mus musculus
aacttggtgtggagctgagccctac

SEQ ID NO: 42128 - DNA, 25 bp, Mus musculus
aacttggtgtggtgctgagccctac

SEQ ID NO: 42129 - DNA, 25 bp, Mus musculus
aacttggtgttcagagactccctta

SEQ ID NO: 42130 - DNA, 25 bp, Mus musculus
aacttggtgttcatgcctctgcttc

SEQ ID NO: 42131 - DNA, 25 bp, Mus musculus
aacttggtgttctgagactccctta

SEQ ID NO: 42132 - DNA, 25 bp, Mus musculus
aacttggtgttcttgcctctgcttc

SEQ ID NO: 42133 - DNA, 25 bp, Mus musculus
aacttggttggtaagtctccacctg

SEQ ID NO: 42134 - DNA, 25 bp, Mus musculus
aacttggttggttagtctccacctg

SEQ ID NO: 42135 - DNA, 25 bp, Mus musculus
aacttggttgtgctgcacaaagtgt

SEQ ID NO: 42136 - DNA, 25 bp, Mus musculus
aacttggttgtggtgcacaaagtgt

SEQ ID NO: 42137 - DNA, 25 bp, Mus musculus
aacttggtttacagatgacatttaa

SEQ ID NO: 42138 - DNA, 25 bp, Mus musculus
aacttggtttactgatgacatttaa

SEQ ID NO: 42139 - DNA, 25 bp, Mus musculus
aacttgtaagtaagcttgatggact

SEQ ID NO: 42140 - DNA, 25 bp, Mus musculus
aacttgtaagtatgcttgatggact

SEQ ID NO: 42141 - DNA, 25 bp, Mus musculus
aacttgtaattcatctgcttcgacc

SEQ ID NO: 42142 - DNA, 25 bp, Mus musculus
aacttgtaattcttctgcttcgacc

SEQ ID NO: 42143 - DNA, 25 bp, Mus musculus
aacttgtagctgatctagacccacc

SEQ ID NO: 42144 - DNA, 25 bp, Mus musculus
aacttgtagctgttctagacccacc

SEQ ID NO: 42145 - DNA, 25 bp, Mus musculus
aacttgtaggcaatgctccttcttc

SEQ ID NO: 42146 - DNA, 25 bp, Mus musculus
aacttgtaggcattgctccttcttc

SEQ ID NO: 42147 - DNA, 25 bp, Mus musculus
aacttgtatatcatctctgtgaagg

SEQ ID NO: 42148 - DNA, 25 bp, Mus musculus
aacttgtatatcttctctgtgaagg

SEQ ID NO: 42149 - DNA, 25 bp, Mus musculus
aacttgtatctccttgaaatatcag

SEQ ID NO: 42150 - DNA, 25 bp, Mus musculus
aacttgtatctcgttgaaatatcag

SEQ ID NO: 42151 - DNA, 25 bp, Mus musculus
aacttgtatgtaaccttcttctctg

SEQ ID NO: 42152 - DNA, 25 bp, Mus musculus
aacttgtatgtatccttcttctctg

SEQ ID NO: 42153 - DNA, 25 bp, Mus musculus
aacttgtattaacacgccagccttt

SEQ ID NO: 42154 - DNA, 25 bp, Mus musculus
aacttgtattaagacgccagccttt

SEQ ID NO: 42155 - DNA, 25 bp, Mus musculus
aacttgtcagcaatgttggtaacat

SEQ ID NO: 42156 - DNA, 25 bp, Mus musculus
aacttgtcagcattgttggtaacat

SEQ ID NO: 42157 - DNA, 25 bp, Mus musculus
aacttgtccatgacacttgcgagtc

SEQ ID NO: 42158 - DNA, 25 bp, Mus musculus
aacttgtccatgtcacttgcgagtc

SEQ ID NO: 42159 - DNA, 25 bp, Mus musculus
aacttgtcctgcacctgcgtatgat

SEQ ID NO: 42160 - DNA, 25 bp, Mus musculus
aacttgtcctgctcctgcgtatgat

SEQ ID NO: 42161 - DNA, 25 bp, Mus musculus
aacttgtgaggacgcttctatgaac

SEQ ID NO: 42162 - DNA, 25 bp, Mus musculus
aacttgtgaggaggcttctatgaac

SEQ ID NO: 42163 - DNA, 25 bp, Mus musculus
aacttgtgagttatatgtgctttgt

SEQ ID NO: 42164 - DNA, 25 bp, Mus musculus
aacttgtgagttttatgtgctttgt

SEQ ID NO: 42165 - DNA, 25 bp, Mus musculus
aacttgtgatgtccccgcctgatct

SEQ ID NO: 42166 - DNA, 25 bp, Mus musculus
aacttgtgatgtgcccgcctgatct

SEQ ID NO: 42167 - DNA, 25 bp, Mus musculus
aacttgtgccaccagaatgccattg

SEQ ID NO: 42168 - DNA, 25 bp, Mus musculus
aacttgtgccacgagaatgccattg

SEQ ID NO: 42169 - DNA, 25 bp, Mus musculus
aacttgtgccccaggtcagggcagt

SEQ ID NO: 42170 - DNA, 25 bp, Mus musculus
aacttgtgcccctggtcagggcagt

SEQ ID NO: 42171 - DNA, 25 bp, Mus musculus
aacttgtggatgctcttattttctt

SEQ ID NO: 42172 - DNA, 25 bp, Mus musculus
aacttgtggatggtcttattttctt

SEQ ID NO: 42173 - DNA, 25 bp, Mus musculus
aacttgtggctgacttcatggctaa

SEQ ID NO: 42174 - DNA, 25 bp, Mus musculus
aacttgtggctgtcttcatggctaa

SEQ ID NO: 42175 - DNA, 25 bp, Mus musculus
aacttgtgtgcacgagccgtgaaaa

SEQ ID NO: 42176 - DNA, 25 bp, Mus musculus
aacttgtgtgcaggagccgtgaaaa

SEQ ID NO: 42177 - DNA, 25 bp, Mus musculus
aacttgtgtgtgcaccagttgtttt

SEQ ID NO: 42178 - DNA, 25 bp, Mus musculus
aacttgtgtgtggaccagttgtttt

SEQ ID NO: 42179 - DNA, 25 bp, Mus musculus
aacttgtgtgttatgtggctgtaaa

SEQ ID NO: 42180 - DNA, 25 bp, Mus musculus
aacttgtgtgttttgtggctgtaaa

SEQ ID NO: 42181 - DNA, 25 bp, Mus musculus
aacttgtgttctccacagcttcagt

SEQ ID NO: 42182 - DNA, 25 bp, Mus musculus
aacttgtgttctgcacagcttcagt

SEQ ID NO: 42183 - DNA, 25 bp, Mus musculus
aacttgttaagtctctagcagataa

SEQ ID NO: 42184 - DNA, 25 bp, Mus musculus
aacttgttaagtgtctagcagataa

SEQ ID NO: 42185 - DNA, 25 bp, Mus musculus
aacttgttaatcaccatagtgcaga

SEQ ID NO: 42186 - DNA, 25 bp, Mus musculus
aacttgttaatctccatagtgcaga

SEQ ID NO: 42187 - DNA, 25 bp, Mus musculus
aacttgttacgtacaatcaaatctt

SEQ ID NO: 42188 - DNA, 25 bp, Mus musculus
aacttgttacgttcaatcaaatctt

SEQ ID NO: 42189 - DNA, 25 bp, Mus musculus
aacttgttagctcaatttttctctc

SEQ ID NO: 42190 - DNA, 25 bp, Mus musculus
aacttgttagctgaatttttctctc

SEQ ID NO: 42191 - DNA, 25 bp, Mus musculus
aacttgttatgaatgggtgccctgc

SEQ ID NO: 42192 - DNA, 25 bp, Mus musculus
aacttgttatgattgggtgccctgc

SEQ ID NO: 42193 - DNA, 25 bp, Mus musculus
aacttgttcaacagtctagtggtac

SEQ ID NO: 42194 - DNA, 25 bp, Mus musculus
aacttgttcaactgtctagtggtac

SEQ ID NO: 42195 - DNA, 25 bp, Mus musculus
aacttgttccacactgcatagtctc

SEQ ID NO: 42196 - DNA, 25 bp, Mus musculus
aacttgttccactctgcatagtctc

SEQ ID NO: 42197 - DNA, 25 bp, Mus musculus
aacttgttccggaggcatggccctg

SEQ ID NO: 42198 - DNA, 25 bp, Mus musculus
aacttgttccggtggcatggccctg

SEQ ID NO: 42199 - DNA, 25 bp, Mus musculus
aacttgttcctcaccagcaacgaaa

SEQ ID NO: 42200 - DNA, 25 bp, Mus musculus
aacttgttcctctccagcaacgaaa

SEQ ID NO: 42201 - DNA, 25 bp, Mus musculus
aacttgttctggagagtgttctggt

SEQ ID NO: 42202 - DNA, 25 bp, Mus musculus
aacttgttctggtgagtgttctggt

SEQ ID NO: 42203 - DNA, 25 bp, Mus musculus
aacttgttgaatctgttctgtgaga

SEQ ID NO: 42204 - DNA, 25 bp, Mus musculus
aacttgttgaatgtgttctgtgaga

SEQ ID NO: 42205 - DNA, 25 bp, Mus musculus
aacttgttgcagctaagacgctggg

SEQ ID NO: 42206 - DNA, 25 bp, Mus musculus
aacttgttgcaggtaagacgctggg

SEQ ID NO: 42207 - DNA, 25 bp, Mus musculus
aacttgttgccaccgcacaaaaata

SEQ ID NO: 42208 - DNA, 25 bp, Mus musculus
aacttgttgccagcgcacaaaaata

SEQ ID NO: 42209 - DNA, 25 bp, Mus musculus
aacttgttgctgcttcctaatagga

SEQ ID NO: 42210 - DNA, 25 bp, Mus musculus
aacttgttgctggttcctaatagga

SEQ ID NO: 42211 - DNA, 25 bp, Mus musculus
aacttgttgtttccggtgtgaattc

SEQ ID NO: 42212 - DNA, 25 bp, Mus musculus
aacttgttgtttgcggtgtgaattc

SEQ ID NO: 42213 - DNA, 25 bp, Mus musculus
aacttgtttaatatccagcatacca

SEQ ID NO: 42214 - DNA, 25 bp, Mus musculus
aacttgtttaatttccagcatacca

SEQ ID NO: 42215 - DNA, 25 bp, Mus musculus
aacttgtttacgcttcaattgtaca

SEQ ID NO: 42216 - DNA, 25 bp, Mus musculus
aacttgtttacggttcaattgtaca

SEQ ID NO: 42217 - DNA, 25 bp, Mus musculus
aacttgttttcaagccttgcatcca

SEQ ID NO: 42218 - DNA, 25 bp, Mus musculus
aacttgttttcatgccttgcatcca

SEQ ID NO: 42219 - DNA, 25 bp, Mus musculus
aacttgtttttaaaatgccctcatt

SEQ ID NO: 42220 - DNA, 25 bp, Mus musculus
aacttgtttttataatgccctcatt

SEQ ID NO: 42221 - DNA, 25 bp, Mus musculus
aactttaaaaccacagtagtggcag

SEQ ID NO: 42222 - DNA, 25 bp, Mus musculus
aactttaaaaccagcataattctgc

SEQ ID NO: 42223 - DNA, 25 bp, Mus musculus
aactttaaaacctcagtagtggcag

SEQ ID NO: 42224 - DNA, 25 bp, Mus musculus
aactttaaaacctgcataattctgc

SEQ ID NO: 42225 - DNA, 25 bp, Mus musculus
aactttaaatcacatttcccacctg

SEQ ID NO: 42226 - DNA, 25 bp, Mus musculus
aactttaaatcagatttcccacctg

SEQ ID NO: 42227 - DNA, 25 bp, Mus musculus
aactttaatgtgctggcctggtggc

SEQ ID NO: 42228 - DNA, 25 bp, Mus musculus
aactttaatgtggtggcctggtggc

SEQ ID NO: 42229 - DNA, 25 bp, Mus musculus
aactttacacagcttaatctttcag

SEQ ID NO: 42230 - DNA, 25 bp, Mus musculus
aactttacacaggttaatctttcag

SEQ ID NO: 42231 - DNA, 25 bp, Mus musculus
aactttacagatctgccttccagct

SEQ ID NO: 42232 - DNA, 25 bp, Mus musculus
aactttacagatgtgccttccagct

SEQ ID NO: 42233 - DNA, 25 bp, Mus musculus
aactttacctaaagattgtccgtcg

SEQ ID NO: 42234 - DNA, 25 bp, Mus musculus
aactttacctaatgattgtccgtcg

SEQ ID NO: 42235 - DNA, 25 bp, Mus musculus
aactttaccttgaagatgtttctga

SEQ ID NO: 42236 - DNA, 25 bp, Mus musculus
aactttaccttgtagatgtttctga

SEQ ID NO: 42237 - DNA, 25 bp, Mus musculus
aactttactcgacgctgcttccagg

SEQ ID NO: 42238 - DNA, 25 bp, Mus musculus
aactttactcgaggctgcttccagg

SEQ ID NO: 42239 - DNA, 25 bp, Mus musculus
aactttagccatcaacatttccctt

SEQ ID NO: 42240 - DNA, 25 bp, Mus musculus
aactttagccatgaacatttccctt

SEQ ID NO: 42241 - DNA, 25 bp, Mus musculus
aactttagctgcaaaactcccctga

SEQ ID NO: 42242 - DNA, 25 bp, Mus musculus
aactttagctgctaaactcccctga

SEQ ID NO: 42243 - DNA, 25 bp, Mus musculus
aactttaggaataggcacattggct

SEQ ID NO: 42244 - DNA, 25 bp, Mus musculus
aactttaggaattggcacattggct

SEQ ID NO: 42245 - DNA, 25 bp, Mus musculus
aactttagggtgcttgcccactcat

SEQ ID NO: 42246 - DNA, 25 bp, Mus musculus
aactttagggtggttgcccactcat

SEQ ID NO: 42247 - DNA, 25 bp, Mus musculus
aactttagtgagctccagtgtaact

SEQ ID NO: 42248 - DNA, 25 bp, Mus musculus
aactttagtgaggtccagtgtaact

SEQ ID NO: 42249 - DNA, 25 bp, Mus musculus
aactttataactactgctactgccc

SEQ ID NO: 42250 - DNA, 25 bp, Mus musculus
aactttataacttctgctactgccc

SEQ ID NO: 42251 - DNA, 25 bp, Mus musculus
aactttatagtgaggccatcgtgac

SEQ ID NO: 42252 - DNA, 25 bp, Mus musculus
aactttatagtgtggccatcgtgac

SEQ ID NO: 42253 - DNA, 25 bp, Mus musculus
aactttatccaaagctgacccctga

SEQ ID NO: 42254 - DNA, 25 bp, Mus musculus
aactttatccaactgagcacccttc

SEQ ID NO: 42255 - DNA, 25 bp, Mus musculus
aactttatccaagtgagcacccttc

SEQ ID NO: 42256 - DNA, 25 bp, Mus musculus
aactttatccaatgctgacccctga

SEQ ID NO: 42257 - DNA, 25 bp, Mus musculus
aactttatccggagccctagactgg

SEQ ID NO: 42258 - DNA, 25 bp, Mus musculus
aactttatccggtgccctagactgg

SEQ ID NO: 42259 - DNA, 25 bp, Mus musculus
aactttatctaacgtgctgctggca

SEQ ID NO: 42260 - DNA, 25 bp, Mus musculus
aactttatctaaggtgctgctggca

SEQ ID NO: 42261 - DNA, 25 bp, Mus musculus
aactttatctctagagcttcatctc

SEQ ID NO: 42262 - DNA, 25 bp, Mus musculus
aactttatctcttgagcttcatctc

SEQ ID NO: 42263 - DNA, 25 bp, Mus musculus
aactttatgcacctacggcccatat

SEQ ID NO: 42264 - DNA, 25 bp, Mus musculus
aactttatgcacgtacggcccatat

SEQ ID NO: 42265 - DNA, 25 bp, Mus musculus
aactttatgcttcttctgtggctca

SEQ ID NO: 42266 - DNA, 25 bp, Mus musculus
aactttatgcttgttctgtggctca

SEQ ID NO: 42267 - DNA, 25 bp, Mus musculus
aactttatgggtcctcacatccagc

SEQ ID NO: 42268 - DNA, 25 bp, Mus musculus
aactttatgggtgctcacatccagc

SEQ ID NO: 42269 - DNA, 25 bp, Mus musculus
aactttatgttgcaaacaagatgat

SEQ ID NO: 42270 - DNA, 25 bp, Mus musculus
aactttatgttggaaacaagatgat

SEQ ID NO: 42271 - DNA, 25 bp, Mus musculus
aactttattatgcacatgggcttga

SEQ ID NO: 42272 - DNA, 25 bp, Mus musculus
aactttattatggacatgggcttga

SEQ ID NO: 42273 - DNA, 25 bp, Mus musculus
aactttattcttaccaattgtatga

SEQ ID NO: 42274 - DNA, 25 bp, Mus musculus
aactttattctttccaattgtatga

SEQ ID NO: 42275 - DNA, 25 bp, Mus musculus
aactttcaaccgcttgtagaacaga

SEQ ID NO: 42276 - DNA, 25 bp, Mus musculus
aactttcaaccggttgtagaacaga

SEQ ID NO: 42277 - DNA, 25 bp, Mus musculus
aactttcaacgacagtcatcactga

SEQ ID NO: 42278 - DNA, 25 bp, Mus musculus
aactttcaacgagagtcatcactga

SEQ ID NO: 42279 - DNA, 25 bp, Mus musculus
aactttcacgtcattggtttcagag

SEQ ID NO: 42280 - DNA, 25 bp, Mus musculus
aactttcacgtccagcaagattcac

SEQ ID NO: 42281 - DNA, 25 bp, Mus musculus
aactttcacgtcgagcaagattcac

SEQ ID NO: 42282 - DNA, 25 bp, Mus musculus
aactttcacgtctttggtttcagag

SEQ ID NO: 42283 - DNA, 25 bp, Mus musculus
aactttcagaggattccctgcaata

SEQ ID NO: 42284 - DNA, 25 bp, Mus musculus
aactttcagaggtttccctgcaata

SEQ ID NO: 42285 - DNA, 25 bp, Mus musculus
aactttcagcatagccctcagtgca

SEQ ID NO: 42286 - DNA, 25 bp, Mus musculus
aactttcagcattgccctcagtgca

SEQ ID NO: 42287 - DNA, 25 bp, Mus musculus
aactttcagtagaaaactttctctg

SEQ ID NO: 42288 - DNA, 25 bp, Mus musculus
aactttcagtagtaaactttctctg

SEQ ID NO: 42289 - DNA, 25 bp, Mus musculus
aactttcattgacctcttactgtat

SEQ ID NO: 42290 - DNA, 25 bp, Mus musculus
aactttcattgagctcttactgtat

SEQ ID NO: 42291 - DNA, 25 bp, Mus musculus
aactttcattttagtgccaacttgt

SEQ ID NO: 42292 - DNA, 25 bp, Mus musculus
aactttcatttttgtgccaacttgt

SEQ ID NO: 42293 - DNA, 25 bp, Mus musculus
aactttccaagtaaaatgtgcatct

SEQ ID NO: 42294 - DNA, 25 bp, Mus musculus
aactttccaagtattgatgcttact

SEQ ID NO: 42295 - DNA, 25 bp, Mus musculus
aactttccaagttaaatgtgcatct

SEQ ID NO: 42296 - DNA, 25 bp, Mus musculus
aactttccaagttttgatgcttact

SEQ ID NO: 42297 - DNA, 25 bp, Mus musculus
aactttccactgagtgacagctgga

SEQ ID NO: 42298 - DNA, 25 bp, Mus musculus
aactttccactgtgtgacagctgga

SEQ ID NO: 42299 - DNA, 25 bp, Mus musculus
aactttccagatagctgcgaacctc

SEQ ID NO: 42300 - DNA, 25 bp, Mus musculus
aactttccagattgctgcgaacctc

SEQ ID NO: 42301 - DNA, 25 bp, Mus musculus
aactttccaggaacatagggctaga

SEQ ID NO: 42302 - DNA, 25 bp, Mus musculus
aactttccaggatcatagggctaga

SEQ ID NO: 42303 - DNA, 25 bp, Mus musculus
aactttcccaaaacactgcctgagg

SEQ ID NO: 42304 - DNA, 25 bp, Mus musculus
aactttcccaaatcactgcctgagg

SEQ ID NO: 42305 - DNA, 25 bp, Mus musculus
aactttccccaccattagtgacagt

SEQ ID NO: 42306 - DNA, 25 bp, Mus musculus
aactttccccacgattagtgacagt

SEQ ID NO: 42307 - DNA, 25 bp, Mus musculus
aactttccgtatctctggcatccat

SEQ ID NO: 42308 - DNA, 25 bp, Mus musculus
aactttccgtatgtctggcatccat

SEQ ID NO: 42309 - DNA, 25 bp, Mus musculus
aactttcctatgaattgagctgtga

SEQ ID NO: 42310 - DNA, 25 bp, Mus musculus
aactttcctatgtattgagctgtga

SEQ ID NO: 42311 - DNA, 25 bp, Mus musculus
aactttcctgaaacattatgatgct

SEQ ID NO: 42312 - DNA, 25 bp, Mus musculus
aactttcctgaatcattatgatgct

SEQ ID NO: 42313 - DNA, 25 bp, Mus musculus
aactttcctgtcactatcacgtctt

SEQ ID NO: 42314 - DNA, 25 bp, Mus musculus
aactttcctgtctctatcacgtctt

SEQ ID NO: 42315 - DNA, 25 bp, Mus musculus
aactttcgaggtcttccaatctcct

SEQ ID NO: 42316 - DNA, 25 bp, Mus musculus
aactttcgaggtgttccaatctcct

SEQ ID NO: 42317 - DNA, 25 bp, Mus musculus
aactttcgccatcttggatttctaa

SEQ ID NO: 42318 - DNA, 25 bp, Mus musculus
aactttcgccatgttggatttctaa

SEQ ID NO: 42319 - DNA, 25 bp, Mus musculus
aactttcgcgcactgtaaacctatt

SEQ ID NO: 42320 - DNA, 25 bp, Mus musculus
aactttcgcgcagtgtaaacctatt

SEQ ID NO: 42321 - DNA, 25 bp, Mus musculus
aactttcgctttagccgcctgaaga

SEQ ID NO: 42322 - DNA, 25 bp, Mus musculus
aactttcgcttttgccgcctgaaga

SEQ ID NO: 42323 - DNA, 25 bp, Mus musculus
aactttcggaagatctccagccgca

SEQ ID NO: 42324 - DNA, 25 bp, Mus musculus
aactttcggaagttctccagccgca

SEQ ID NO: 42325 - DNA, 25 bp, Mus musculus
aactttcgggacatcccaggatatc

SEQ ID NO: 42326 - DNA, 25 bp, Mus musculus
aactttcgggacttcccaggatatc

SEQ ID NO: 42327 - DNA, 25 bp, Mus musculus
aactttctaaaacgcatgtctggga

SEQ ID NO: 42328 - DNA, 25 bp, Mus musculus
aactttctaaaaggcatgtctggga

SEQ ID NO: 42329 - DNA, 25 bp, Mus musculus
aactttctaaacacccttcagtgtg

SEQ ID NO: 42330 - DNA, 25 bp, Mus musculus
aactttctaaactcccttcagtgtg

SEQ ID NO: 42331 - DNA, 25 bp, Mus musculus
aactttctacggctttgatgaggac

SEQ ID NO: 42332 - DNA, 25 bp, Mus musculus
aactttctacgggtttgatgaggac

SEQ ID NO: 42333 - DNA, 25 bp, Mus musculus
aactttctagatcatgctgttccta

SEQ ID NO: 42334 - DNA, 25 bp, Mus musculus
aactttctagatgatgctgttccta

SEQ ID NO: 42335 - DNA, 25 bp, Mus musculus
aactttctcatcatgggccgcaagg

SEQ ID NO: 42336 - DNA, 25 bp, Mus musculus
aactttctcatcttgggccgcaagg

SEQ ID NO: 42337 - DNA, 25 bp, Mus musculus
aactttctccatctgtagtgtcgat

SEQ ID NO: 42338 - DNA, 25 bp, Mus musculus
aactttctccatgtgtagtgtcgat

SEQ ID NO: 42339 - DNA, 25 bp, Mus musculus
aactttctccccagtatatactcat

SEQ ID NO: 42340 - DNA, 25 bp, Mus musculus
aactttctcccctgtatatactcat

SEQ ID NO: 42341 - DNA, 25 bp, Mus musculus
aactttctcctacactatcctaggt

SEQ ID NO: 42342 - DNA, 25 bp, Mus musculus
aactttctcctagactatcctaggt

SEQ ID NO: 42343 - DNA, 25 bp, Mus musculus
aactttctcgttactattcatgtaa

SEQ ID NO: 42344 - DNA, 25 bp, Mus musculus
aactttctcgtttctattcatgtaa

SEQ ID NO: 42345 - DNA, 25 bp, Mus musculus
aactttctctaaatacagtgtgctg

SEQ ID NO: 42346 - DNA, 25 bp, Mus musculus
aactttctctaattacagtgtgctg

SEQ ID NO: 42347 - DNA, 25 bp, Mus musculus
aactttctgaaaagctcccttgccg

SEQ ID NO: 42348 - DNA, 25 bp, Mus musculus
aactttctgaaatgctcccttgccg

SEQ ID NO: 42349 - DNA, 25 bp, Mus musculus
aactttctgcagaagatggtccttg

SEQ ID NO: 42350 - DNA, 25 bp, Mus musculus
aactttctgcagacagggtctgtcg

SEQ ID NO: 42351 - DNA, 25 bp, Mus musculus
aactttctgcagtagatggtccttg

SEQ ID NO: 42352 - DNA, 25 bp, Mus musculus
aactttctgcagtcagggtctgtcg

SEQ ID NO: 42353 - DNA, 25 bp, Mus musculus
aactttctgtagcagtggttctata

SEQ ID NO: 42354 - DNA, 25 bp, Mus musculus
aactttctgtaggagtggttctata

SEQ ID NO: 42355 - DNA, 25 bp, Mus musculus
aactttctgtgcattcatttctcca

SEQ ID NO: 42356 - DNA, 25 bp, Mus musculus
aactttctgtgctttcatttctcca

SEQ ID NO: 42357 - DNA, 25 bp, Mus musculus
aactttctgttaagataattatcag

SEQ ID NO: 42358 - DNA, 25 bp, Mus musculus
aactttctgttatgataattatcag

SEQ ID NO: 42359 - DNA, 25 bp, Mus musculus
aactttctgttcacatttgatagag

SEQ ID NO: 42360 - DNA, 25 bp, Mus musculus
aactttctgttctcatttgatagag

SEQ ID NO: 42361 - DNA, 25 bp, Mus musculus
aactttcttatacggtcacagcact

SEQ ID NO: 42362 - DNA, 25 bp, Mus musculus
aactttcttatagggtcacagcact

SEQ ID NO: 42363 - DNA, 25 bp, Mus musculus
aactttcttatcatcatccgtgtca

SEQ ID NO: 42364 - DNA, 25 bp, Mus musculus
aactttcttatcttcatccgtgtca

SEQ ID NO: 42365 - DNA, 25 bp, Mus musculus
aactttcttcttcgccatgtttgga

SEQ ID NO: 42366 - DNA, 25 bp, Mus musculus
aactttcttcttggccatgtttgga

SEQ ID NO: 42367 - DNA, 25 bp, Mus musculus
aactttgaaagcctgtcgcccgcca

SEQ ID NO: 42368 - DNA, 25 bp, Mus musculus
aactttgaaagcgtgtcgcccgcca

SEQ ID NO: 42369 - DNA, 25 bp, Mus musculus
aactttgaagctcagccagagtgaa

SEQ ID NO: 42370 - DNA, 25 bp, Mus musculus
aactttgaagctgagccagagtgaa

SEQ ID NO: 42371 - DNA, 25 bp, Mus musculus
aactttgaatgtaaaatctctggct

SEQ ID NO: 42372 - DNA, 25 bp, Mus musculus
aactttgaatgttaaatctctggct

SEQ ID NO: 42373 - DNA, 25 bp, Mus musculus
aactttgacatcagcacaccctttt

SEQ ID NO: 42374 - DNA, 25 bp, Mus musculus
aactttgacatctgcacaccctttt

SEQ ID NO: 42375 - DNA, 25 bp, Mus musculus
aactttgaccggcttgtgagcaacc

SEQ ID NO: 42376 - DNA, 25 bp, Mus musculus
aactttgaccgggttgtgagcaacc

SEQ ID NO: 42377 - DNA, 25 bp, Mus musculus
aactttgagacaatcaacctggtca

SEQ ID NO: 42378 - DNA, 25 bp, Mus musculus
aactttgagacattcaacctggtca

SEQ ID NO: 42379 - DNA, 25 bp, Mus musculus
aactttgagagaagaaattgaccct

SEQ ID NO: 42380 - DNA, 25 bp, Mus musculus
aactttgagagatgaaattgaccct

SEQ ID NO: 42381 - DNA, 25 bp, Mus musculus
aactttgagagcatgtccctgggca

SEQ ID NO: 42382 - DNA, 25 bp, Mus musculus
aactttgagagcttgtccctgggca

SEQ ID NO: 42383 - DNA, 25 bp, Mus musculus
aactttgaggctctttttcctgctt

SEQ ID NO: 42384 - DNA, 25 bp, Mus musculus
aactttgaggctgtttttcctgctt

SEQ ID NO: 42385 - DNA, 25 bp, Mus musculus
aactttgaggtgagggaccattcag

SEQ ID NO: 42386 - DNA, 25 bp, Mus musculus
aactttgaggtgtgggaccattcag

SEQ ID NO: 42387 - DNA, 25 bp, Mus musculus
aactttgatgatcctagtcccacat

SEQ ID NO: 42388 - DNA, 25 bp, Mus musculus
aactttgatgatgctagtcccacat

SEQ ID NO: 42389 - DNA, 25 bp, Mus musculus
aactttgatgccctcttcactgaag

SEQ ID NO: 42390 - DNA, 25 bp, Mus musculus
aactttgatgccgtcttcactgaag

SEQ ID NO: 42391 - DNA, 25 bp, Mus musculus
aactttgatgttacctgcctgtgca

SEQ ID NO: 42392 - DNA, 25 bp, Mus musculus
aactttgatgtttcctgcctgtgca

SEQ ID NO: 42393 - DNA, 25 bp, Mus musculus
aactttgcaaagaagtagccagcgg

SEQ ID NO: 42394 - DNA, 25 bp, Mus musculus
aactttgcaaagtagtagccagcgg

SEQ ID NO: 42395 - DNA, 25 bp, Mus musculus
aactttgcaagaatagctgactttt

SEQ ID NO: 42396 - DNA, 25 bp, Mus musculus
aactttgcaagactttcctcggcgg

SEQ ID NO: 42397 - DNA, 25 bp, Mus musculus
aactttgcaagagtttcctcggcgg

SEQ ID NO: 42398 - DNA, 25 bp, Mus musculus
aactttgcaagattagctgactttt

SEQ ID NO: 42399 - DNA, 25 bp, Mus musculus
aactttgcaaggacccagcaagcat

SEQ ID NO: 42400 - DNA, 25 bp, Mus musculus
aactttgcaaggtcccagcaagcat

SEQ ID NO: 42401 - DNA, 25 bp, Mus musculus
aactttgcacggatcttagtccaag

SEQ ID NO: 42402 - DNA, 25 bp, Mus musculus
aactttgcacggttcttagtccaag

SEQ ID NO: 42403 - DNA, 25 bp, Mus musculus
aactttgcagcactgttatcttaca

SEQ ID NO: 42404 - DNA, 25 bp, Mus musculus
aactttgcagcagtgttatcttaca

SEQ ID NO: 42405 - DNA, 25 bp, Mus musculus
aactttgccattcatttgatagcac

SEQ ID NO: 42406 - DNA, 25 bp, Mus musculus
aactttgccattgatttgatagcac

SEQ ID NO: 42407 - DNA, 25 bp, Mus musculus
aactttgcccaccagcagggttgtc

SEQ ID NO: 42408 - DNA, 25 bp, Mus musculus
aactttgcccacgagcagggttgtc

SEQ ID NO: 42409 - DNA, 25 bp, Mus musculus
aactttgctctcatcctaaggcctc

SEQ ID NO: 42410 - DNA, 25 bp, Mus musculus
aactttgctctcttcctaaggcctc

SEQ ID NO: 42411 - DNA, 25 bp, Mus musculus
aactttgctgagatggtcgctctgc

SEQ ID NO: 42412 - DNA, 25 bp, Mus musculus
aactttgctgagttggtcgctctgc

SEQ ID NO: 42413 - DNA, 25 bp, Mus musculus
aactttgctgcgacttctaggaaat

SEQ ID NO: 42414 - DNA, 25 bp, Mus musculus
aactttgctgcgtcttctaggaaat

SEQ ID NO: 42415 - DNA, 25 bp, Mus musculus
aactttgctgttcgcagtgtggcta

SEQ ID NO: 42416 - DNA, 25 bp, Mus musculus
aactttgctgttggcagtgtggcta

SEQ ID NO: 42417 - DNA, 25 bp, Mus musculus
aactttgctttgagttcgtttgaat

SEQ ID NO: 42418 - DNA, 25 bp, Mus musculus
aactttgctttgtgttcgtttgaat

SEQ ID NO: 42419 - DNA, 25 bp, Mus musculus
aactttggactgagctatgccagac

SEQ ID NO: 42420 - DNA, 25 bp, Mus musculus
aactttggactgtgctatgccagac

SEQ ID NO: 42421 - DNA, 25 bp, Mus musculus
aactttggatctaaggcatttgatc

SEQ ID NO: 42422 - DNA, 25 bp, Mus musculus
aactttggatcttaggcatttgatc

SEQ ID NO: 42423 - DNA, 25 bp, Mus musculus
aactttgggatgaagctgctcttat

SEQ ID NO: 42424 - DNA, 25 bp, Mus musculus
aactttgggatgtagctgctcttat

SEQ ID NO: 42425 - DNA, 25 bp, Mus musculus
aactttgggctcatctgtatcactc

SEQ ID NO: 42426 - DNA, 25 bp, Mus musculus
aactttgggctcttctgtatcactc

SEQ ID NO: 42427 - DNA, 25 bp, Mus musculus
aactttggttatcacagcatttctg

SEQ ID NO: 42428 - DNA, 25 bp, Mus musculus
aactttggttatgacagcatttctg

SEQ ID NO: 42429 - DNA, 25 bp, Mus musculus
aactttggttccatcaccatcaagt

SEQ ID NO: 42430 - DNA, 25 bp, Mus musculus
aactttggttccttcaccatcaagt

SEQ ID NO: 42431 - DNA, 25 bp, Mus musculus
aactttggtttacatccattctggt

SEQ ID NO: 42432 - DNA, 25 bp, Mus musculus
aactttggtttagatccattctggt

SEQ ID NO: 42433 - DNA, 25 bp, Mus musculus
aactttgtaattccagagcccttgt

SEQ ID NO: 42434 - DNA, 25 bp, Mus musculus
aactttgtaattcctgtccactgta

SEQ ID NO: 42435 - DNA, 25 bp, Mus musculus
aactttgtaattgcagagcccttgt

SEQ ID NO: 42436 - DNA, 25 bp, Mus musculus
aactttgtaattgctgtccactgta

SEQ ID NO: 42437 - DNA, 25 bp, Mus musculus
aactttgtacaaattatccacggca

SEQ ID NO: 42438 - DNA, 25 bp, Mus musculus
aactttgtacaatttatccacggca

SEQ ID NO: 42439 - DNA, 25 bp, Mus musculus
aactttgtagagacggtgtctcccg

SEQ ID NO: 42440 - DNA, 25 bp, Mus musculus
aactttgtagagtcggtgtctcccg

SEQ ID NO: 42441 - DNA, 25 bp, Mus musculus
aactttgtagtaccccgatcgcacc

SEQ ID NO: 42442 - DNA, 25 bp, Mus musculus
aactttgtagtaccctgatcgaaca

SEQ ID NO: 42443 - DNA, 25 bp, Mus musculus
aactttgtagtactctgcttgctgt

SEQ ID NO: 42444 - DNA, 25 bp, Mus musculus
aactttgtagtagcccgatcgcacc

SEQ ID NO: 42445 - DNA, 25 bp, Mus musculus
aactttgtagtagcctgatcgaaca

SEQ ID NO: 42446 - DNA, 25 bp, Mus musculus
aactttgtagtagtctgcttgctgt

SEQ ID NO: 42447 - DNA, 25 bp, Mus musculus
aactttgtcaagatggatctcgtct

SEQ ID NO: 42448 - DNA, 25 bp, Mus musculus
aactttgtcaagttggatctcgtct

SEQ ID NO: 42449 - DNA, 25 bp, Mus musculus
aactttgtcaatatgtcttgaggac

SEQ ID NO: 42450 - DNA, 25 bp, Mus musculus
aactttgtcaatttgtcttgaggac

SEQ ID NO: 42451 - DNA, 25 bp, Mus musculus
aactttgtcctcagctctatggaaa

SEQ ID NO: 42452 - DNA, 25 bp, Mus musculus
aactttgtcctctgctctatggaaa

SEQ ID NO: 42453 - DNA, 25 bp, Mus musculus
aactttgtccttatcaccaagcaag

SEQ ID NO: 42454 - DNA, 25 bp, Mus musculus
aactttgtccttttcaccaagcaag

SEQ ID NO: 42455 - DNA, 25 bp, Mus musculus
aactttgtcgatagccccattattg

SEQ ID NO: 42456 - DNA, 25 bp, Mus musculus
aactttgtcgattgccccattattg

SEQ ID NO: 42457 - DNA, 25 bp, Mus musculus
aactttgtgacactcccaccaggag

SEQ ID NO: 42458 - DNA, 25 bp, Mus musculus
aactttgtgacagtcccaccaggag

SEQ ID NO: 42459 - DNA, 25 bp, Mus musculus
aactttgtgattcccttacaatcta

SEQ ID NO: 42460 - DNA, 25 bp, Mus musculus
aactttgtgattgccttacaatcta

SEQ ID NO: 42461 - DNA, 25 bp, Mus musculus
aactttgtgctaatacagatctggc

SEQ ID NO: 42462 - DNA, 25 bp, Mus musculus
aactttgtgctattacagatctggc

SEQ ID NO: 42463 - DNA, 25 bp, Mus musculus
aactttgtgctgatatacccttctt

SEQ ID NO: 42464 - DNA, 25 bp, Mus musculus
aactttgtgctgttatacccttctt

SEQ ID NO: 42465 - DNA, 25 bp, Mus musculus
aactttgtggacctctgcagggccc

SEQ ID NO: 42466 - DNA, 25 bp, Mus musculus
aactttgtggacgtctgcagggccc

SEQ ID NO: 42467 - DNA, 25 bp, Mus musculus
aactttgtgggcactctgttgcttg

SEQ ID NO: 42468 - DNA, 25 bp, Mus musculus
aactttgtgggctctctgttgcttg

SEQ ID NO: 42469 - DNA, 25 bp, Mus musculus
aactttgtggtgactgtcctcttac

SEQ ID NO: 42470 - DNA, 25 bp, Mus musculus
aactttgtggtgtctgtcctcttac

SEQ ID NO: 42471 - DNA, 25 bp, Mus musculus
aactttgttccaatgatatttgtac

SEQ ID NO: 42472 - DNA, 25 bp, Mus musculus
aactttgttccattgatatttgtac

SEQ ID NO: 42473 - DNA, 25 bp, Mus musculus
aactttgttcgtcccattgaaacaa

SEQ ID NO: 42474 - DNA, 25 bp, Mus musculus
aactttgttcgtgccattgaaacaa

SEQ ID NO: 42475 - DNA, 25 bp, Mus musculus
aactttgttcttcagtccgatgtct

SEQ ID NO: 42476 - DNA, 25 bp, Mus musculus
aactttgttcttgagtccgatgtct

SEQ ID NO: 42477 - DNA, 25 bp, Mus musculus
aactttgttgccagatttgaatact

SEQ ID NO: 42478 - DNA, 25 bp, Mus musculus
aactttgttgcctgatttgaatact

SEQ ID NO: 42479 - DNA, 25 bp, Mus musculus
aactttgttggcacatcacacctta

SEQ ID NO: 42480 - DNA, 25 bp, Mus musculus
aactttgttggctcatcacacctta

SEQ ID NO: 42481 - DNA, 25 bp, Mus musculus
aactttgttgggattctgcaagaga

SEQ ID NO: 42482 - DNA, 25 bp, Mus musculus
aactttgttgggtttctgcaagaga

SEQ ID NO: 42483 - DNA, 25 bp, Mus musculus
aactttgttgtgacccttgctgtgg

SEQ ID NO: 42484 - DNA, 25 bp, Mus musculus
aactttgttgtgtcccttgctgtgg

SEQ ID NO: 42485 - DNA, 25 bp, Mus musculus
aactttgtttgacactgggccttat

SEQ ID NO: 42486 - DNA, 25 bp, Mus musculus
aactttgtttgagactgggccttat

SEQ ID NO: 42487 - DNA, 25 bp, Mus musculus
aactttgtttgtctggcacaaggac

SEQ ID NO: 42488 - DNA, 25 bp, Mus musculus
aactttgtttgtctgttacattctt

SEQ ID NO: 42489 - DNA, 25 bp, Mus musculus
aactttgtttgtgtggcacaaggac

SEQ ID NO: 42490 - DNA, 25 bp, Mus musculus
aactttgtttgtgtgttacattctt

SEQ ID NO: 42491 - DNA, 25 bp, Mus musculus
aactttgttttacctgtcagcaact

SEQ ID NO: 42492 - DNA, 25 bp, Mus musculus
aactttgttttagctgtcagcaact

SEQ ID NO: 42493 - DNA, 25 bp, Mus musculus
aactttgttttcagatatctcttct

SEQ ID NO: 42494 - DNA, 25 bp, Mus musculus
aactttgttttctgatatctcttct

SEQ ID NO: 42495 - DNA, 25 bp, Mus musculus
aactttgtttttagtcacctatgag

SEQ ID NO: 42496 - DNA, 25 bp, Mus musculus
aactttgttttttgtcacctatgag

SEQ ID NO: 42497 - DNA, 25 bp, Mus musculus
aacttttaacaaacactgtggacat

SEQ ID NO: 42498 - DNA, 25 bp, Mus musculus
aacttttaacaatcactgtggacat

SEQ ID NO: 42499 - DNA, 25 bp, Mus musculus
aacttttacaagctgagctgactgc

SEQ ID NO: 42500 - DNA, 25 bp, Mus musculus
aacttttacaaggtgagctgactgc

SEQ ID NO: 42501 - DNA, 25 bp, Mus musculus
aacttttacacacagacctcatggg

SEQ ID NO: 42502 - DNA, 25 bp, Mus musculus
aacttttacacagagacctcatggg

SEQ ID NO: 42503 - DNA, 25 bp, Mus musculus
aacttttacggacatagctcctaga

SEQ ID NO: 42504 - DNA, 25 bp, Mus musculus
aacttttacggagatagctcctaga

SEQ ID NO: 42505 - DNA, 25 bp, Mus musculus
aacttttagcatcatgcagcctgaa

SEQ ID NO: 42506 - DNA, 25 bp, Mus musculus
aacttttagcatgatgcagcctgaa

SEQ ID NO: 42507 - DNA, 25 bp, Mus musculus
aacttttattccacttacatgaact

SEQ ID NO: 42508 - DNA, 25 bp, Mus musculus
aacttttattcctcttacatgaact

SEQ ID NO: 42509 - DNA, 25 bp, Mus musculus
aacttttcaagtctggtgctgactg

SEQ ID NO: 42510 - DNA, 25 bp, Mus musculus
aacttttcaagtgtggtgctgactg

SEQ ID NO: 42511 - DNA, 25 bp, Mus musculus
aacttttcagcactgcatgtggccc

SEQ ID NO: 42512 - DNA, 25 bp, Mus musculus
aacttttcagcagtgcatgtggccc

SEQ ID NO: 42513 - DNA, 25 bp, Mus musculus
aacttttcagggacaatgtcatcta

SEQ ID NO: 42514 - DNA, 25 bp, Mus musculus
aacttttcagggtcaatgtcatcta

SEQ ID NO: 42515 - DNA, 25 bp, Mus musculus
aacttttcatcaaagtcggcgcttt

SEQ ID NO: 42516 - DNA, 25 bp, Mus musculus
aacttttcatcatagtcggcgcttt

SEQ ID NO: 42517 - DNA, 25 bp, Mus musculus
aacttttccagaagaatccggcgtg

SEQ ID NO: 42518 - DNA, 25 bp, Mus musculus
aacttttccagatgaatccggcgtg

SEQ ID NO: 42519 - DNA, 25 bp, Mus musculus
aacttttccggaccggtcagtgcat

SEQ ID NO: 42520 - DNA, 25 bp, Mus musculus
aacttttccggagcggtcagtgcat

SEQ ID NO: 42521 - DNA, 25 bp, Mus musculus
aacttttcctatctgtcaccggaat

SEQ ID NO: 42522 - DNA, 25 bp, Mus musculus
aacttttcctatgtgtcaccggaat

SEQ ID NO: 42523 - DNA, 25 bp, Mus musculus
aacttttcctcccaagatgcttttg

SEQ ID NO: 42524 - DNA, 25 bp, Mus musculus
aacttttcctccgaagatgcttttg

SEQ ID NO: 42525 - DNA, 25 bp, Mus musculus
aacttttctagaccacatgcttgct

SEQ ID NO: 42526 - DNA, 25 bp, Mus musculus
aacttttctagagcacatgcttgct

SEQ ID NO: 42527 - DNA, 25 bp, Mus musculus
aacttttctctgatctgttgacatc

SEQ ID NO: 42528 - DNA, 25 bp, Mus musculus
aacttttctctgttctgttgacatc

SEQ ID NO: 42529 - DNA, 25 bp, Mus musculus
aacttttctgagatcatgtccaggt

SEQ ID NO: 42530 - DNA, 25 bp, Mus musculus
aacttttctgagttcatgtccaggt

SEQ ID NO: 42531 - DNA, 25 bp, Mus musculus
aacttttctgttccacaagcttccc

SEQ ID NO: 42532 - DNA, 25 bp, Mus musculus
aacttttctgttctgccaatgatgc

SEQ ID NO: 42533 - DNA, 25 bp, Mus musculus
aacttttctgttgcacaagcttccc

SEQ ID NO: 42534 - DNA, 25 bp, Mus musculus
aacttttctgttgtgccaatgatgc

SEQ ID NO: 42535 - DNA, 25 bp, Mus musculus
aacttttctttcctctgagtgtatc

SEQ ID NO: 42536 - DNA, 25 bp, Mus musculus
aacttttctttcgtctgagtgtatc

SEQ ID NO: 42537 - DNA, 25 bp, Mus musculus
aacttttgacaaacctagcctgact

SEQ ID NO: 42538 - DNA, 25 bp, Mus musculus
aacttttgacaatcctagcctgact

SEQ ID NO: 42539 - DNA, 25 bp, Mus musculus
aacttttgagccaacttttcacata

SEQ ID NO: 42540 - DNA, 25 bp, Mus musculus
aacttttgagccacatggccattcc

SEQ ID NO: 42541 - DNA, 25 bp, Mus musculus
aacttttgagcctacttttcacata

SEQ ID NO: 42542 - DNA, 25 bp, Mus musculus
aacttttgagcctcatggccattcc

SEQ ID NO: 42543 - DNA, 25 bp, Mus musculus
aacttttgattgaaatccctggtga

SEQ ID NO: 42544 - DNA, 25 bp, Mus musculus
aacttttgattgtaatccctggtga

SEQ ID NO: 42545 - DNA, 25 bp, Mus musculus
aacttttgccgacgatggccagcac

SEQ ID NO: 42546 - DNA, 25 bp, Mus musculus
aacttttgccgaggatggccagcac

SEQ ID NO: 42547 - DNA, 25 bp, Mus musculus
aacttttggaacagcgtgcccagta

SEQ ID NO: 42548 - DNA, 25 bp, Mus musculus
aacttttggaactgcgtgcccagta

SEQ ID NO: 42549 - DNA, 25 bp, Mus musculus
aacttttggactaacctgccaggca

SEQ ID NO: 42550 - DNA, 25 bp, Mus musculus
aacttttggacttacctgccaggca

SEQ ID NO: 42551 - DNA, 25 bp, Mus musculus
aacttttggaggctggactgacctg

SEQ ID NO: 42552 - DNA, 25 bp, Mus musculus
aacttttggagggtggactgacctg

SEQ ID NO: 42553 - DNA, 25 bp, Mus musculus
aacttttgggcgagagcctgcagca

SEQ ID NO: 42554 - DNA, 25 bp, Mus musculus
aacttttgggcgtgagcctgcagca

SEQ ID NO: 42555 - DNA, 25 bp, Mus musculus
aacttttgggttagatcatctgcac

SEQ ID NO: 42556 - DNA, 25 bp, Mus musculus
aacttttgggtttgatcatctgcac

SEQ ID NO: 42557 - DNA, 25 bp, Mus musculus
aacttttgtaccaggtatctctaga

SEQ ID NO: 42558 - DNA, 25 bp, Mus musculus
aacttttgtacctggtatctctaga

SEQ ID NO: 42559 - DNA, 25 bp, Mus musculus
aacttttgtgcgatttcctgtatag

SEQ ID NO: 42560 - DNA, 25 bp, Mus musculus
aacttttgtgcgttttcctgtatag

SEQ ID NO: 42561 - DNA, 25 bp, Mus musculus
aacttttgttgtcttccccagctga

SEQ ID NO: 42562 - DNA, 25 bp, Mus musculus
aacttttgttgtgttccccagctga

SEQ ID NO: 42563 - DNA, 25 bp, Mus musculus
aactttttcagacagcaactccgcc

SEQ ID NO: 42564 - DNA, 25 bp, Mus musculus
aactttttcagagagcaactccgcc

SEQ ID NO: 42565 - DNA, 25 bp, Mus musculus
aactttttcctaattatagtgtgat

SEQ ID NO: 42566 - DNA, 25 bp, Mus musculus
aactttttcctatttatagtgtgat

SEQ ID NO: 42567 - DNA, 25 bp, Mus musculus
aactttttccttccactgagagaat

SEQ ID NO: 42568 - DNA, 25 bp, Mus musculus
aactttttccttgcactgagagaat

SEQ ID NO: 42569 - DNA, 25 bp, Mus musculus
aactttttcttgcaacacttggaag

SEQ ID NO: 42570 - DNA, 25 bp, Mus musculus
aactttttcttggaacacttggaag

SEQ ID NO: 42571 - DNA, 25 bp, Mus musculus
aactttttgaagacctgccatgcct

SEQ ID NO: 42572 - DNA, 25 bp, Mus musculus
aactttttgaagtcctgccatgcct

SEQ ID NO: 42573 - DNA, 25 bp, Mus musculus
aactttttgacacaaccttctctca

SEQ ID NO: 42574 - DNA, 25 bp, Mus musculus
aactttttgacagaaccttctctca

SEQ ID NO: 42575 - DNA, 25 bp, Mus musculus
aactttttgcagcttcattctgaga

SEQ ID NO: 42576 - DNA, 25 bp, Mus musculus
aactttttgcaggttcattctgaga

SEQ ID NO: 42577 - DNA, 25 bp, Mus musculus
aacttttttatactgattcctgatc

SEQ ID NO: 42578 - DNA, 25 bp, Mus musculus
aacttttttatagtgattcctgatc

SEQ ID NO: 42579 - DNA, 25 bp, Mus musculus
aacttttttctgctgaaggtcaagg

SEQ ID NO: 42580 - DNA, 25 bp, Mus musculus
aacttttttctggtgaaggtcaagg

SEQ ID NO: 42581 - DNA, 25 bp, Mus musculus
aagaaaaacatcctgctgcggctgc

SEQ ID NO: 42582 - DNA, 25 bp, Mus musculus
aagaaaaacatcgtgctgcggctgc

SEQ ID NO: 42583 - DNA, 25 bp, Mus musculus
aagaaaaagcatctagccctaattt

SEQ ID NO: 42584 - DNA, 25 bp, Mus musculus
aagaaaaagcatgtagccctaattt

SEQ ID NO: 42585 - DNA, 25 bp, Mus musculus
aagaaaaagcgcactggtcctcaag

SEQ ID NO: 42586 - DNA, 25 bp, Mus musculus
aagaaaaagcgctctggtcctcaag

SEQ ID NO: 42587 - DNA, 25 bp, Mus musculus
aagaaaaagcggatggtggtccctg

SEQ ID NO: 42588 - DNA, 25 bp, Mus musculus
aagaaaaagcggttggtggtccctg

SEQ ID NO: 42589 - DNA, 25 bp, Mus musculus
aagaaaaagtctcggccaacctctg

SEQ ID NO: 42590 - DNA, 25 bp, Mus musculus
aagaaaaagtctgggccaacctctg

SEQ ID NO: 42591 - DNA, 25 bp, Mus musculus
aagaaaacaaatctctggttcagta

SEQ ID NO: 42592 - DNA, 25 bp, Mus musculus
aagaaaacaaatgtctggttcagta

SEQ ID NO: 42593 - DNA, 25 bp, Mus musculus
aagaaaacaaccctgctccttactg

SEQ ID NO: 42594 - DNA, 25 bp, Mus musculus
aagaaaacaaccgtgctccttactg

SEQ ID NO: 42595 - DNA, 25 bp, Mus musculus
aagaaaacactcagccctggagggc

SEQ ID NO: 42596 - DNA, 25 bp, Mus musculus
aagaaaacactctgccctggagggc

SEQ ID NO: 42597 - DNA, 25 bp, Mus musculus
aagaaaacatggaccgaactttgag

SEQ ID NO: 42598 - DNA, 25 bp, Mus musculus
aagaaaacatggtccgaactttgag

SEQ ID NO: 42599 - DNA, 25 bp, Mus musculus
aagaaaacccacagatgctccaaaa

SEQ ID NO: 42600 - DNA, 25 bp, Mus musculus
aagaaaacccactgatgctccaaaa

SEQ ID NO: 42601 - DNA, 25 bp, Mus musculus
aagaaaacccgcagcattcagcagg

SEQ ID NO: 42602 - DNA, 25 bp, Mus musculus
aagaaaacccgctgcattcagcagg

SEQ ID NO: 42603 - DNA, 25 bp, Mus musculus
aagaaaaccgatctttcagaggtct

SEQ ID NO: 42604 - DNA, 25 bp, Mus musculus
aagaaaaccgatgtttcagaggtct

SEQ ID NO: 42605 - DNA, 25 bp, Mus musculus
aagaaaacctggctcgcaccagcac

SEQ ID NO: 42606 - DNA, 25 bp, Mus musculus
aagaaaacctgggtcgcaccagcac

SEQ ID NO: 42607 - DNA, 25 bp, Mus musculus
aagaaaacctgtcatgtgccatgcc

SEQ ID NO: 42608 - DNA, 25 bp, Mus musculus
aagaaaacctgtgatgtgccatgcc

SEQ ID NO: 42609 - DNA, 25 bp, Mus musculus
aagaaaactcagcatgccctccaga

SEQ ID NO: 42610 - DNA, 25 bp, Mus musculus
aagaaaactcaggatgccctccaga

SEQ ID NO: 42611 - DNA, 25 bp, Mus musculus
aagaaaactccccagtcagactcat

SEQ ID NO: 42612 - DNA, 25 bp, Mus musculus
aagaaaactcccgagtcagactcat

SEQ ID NO: 42613 - DNA, 25 bp, Mus musculus
aagaaaactgctccgagtaacaggg

SEQ ID NO: 42614 - DNA, 25 bp, Mus musculus
aagaaaactgctgcgagtaacaggg

SEQ ID NO: 42615 - DNA, 25 bp, Mus musculus
aagaaaagatatatggaccagacag

SEQ ID NO: 42616 - DNA, 25 bp, Mus musculus
aagaaaagatatttggaccagacag

SEQ ID NO: 42617 - DNA, 25 bp, Mus musculus
aagaaaagatcgctccaagtcaagg

SEQ ID NO: 42618 - DNA, 25 bp, Mus musculus
aagaaaagatcggtccaagtcaagg

SEQ ID NO: 42619 - DNA, 25 bp, Mus musculus
aagaaaagcactccactgccagcag

SEQ ID NO: 42620 - DNA, 25 bp, Mus musculus
aagaaaagcactgcactgccagcag

SEQ ID NO: 42621 - DNA, 25 bp, Mus musculus
aagaaaagcttcatgccaacccaac

SEQ ID NO: 42622 - DNA, 25 bp, Mus musculus
aagaaaagcttcttgccaacccaac

SEQ ID NO: 42623 - DNA, 25 bp, Mus musculus
aagaaaagggaaacttggcatgctg

SEQ ID NO: 42624 - DNA, 25 bp, Mus musculus
aagaaaagggaatcttggcatgctg

SEQ ID NO: 42625 - DNA, 25 bp, Mus musculus
aagaaaagtccaagtgctagcagca

SEQ ID NO: 42626 - DNA, 25 bp, Mus musculus
aagaaaagtccatgtgctagcagca

SEQ ID NO: 42627 - DNA, 25 bp, Mus musculus
aagaaaagtttcctcgagccacagc

SEQ ID NO: 42628 - DNA, 25 bp, Mus musculus
aagaaaagtttcgtcgagccacagc

SEQ ID NO: 42629 - DNA, 25 bp, Mus musculus
aagaaaataacacccacattcccat

SEQ ID NO: 42630 - DNA, 25 bp, Mus musculus
aagaaaataacacctccactctact

SEQ ID NO: 42631 - DNA, 25 bp, Mus musculus
aagaaaataacagccacattcccat

SEQ ID NO: 42632 - DNA, 25 bp, Mus musculus
aagaaaataacagctccactctact

SEQ ID NO: 42633 - DNA, 25 bp, Mus musculus
aagaaaatagctccggtacctcgcg

SEQ ID NO: 42634 - DNA, 25 bp, Mus musculus
aagaaaatagctgcggtacctcgcg

SEQ ID NO: 42635 - DNA, 25 bp, Mus musculus
aagaaaatatctcgcgggaaggaag

SEQ ID NO: 42636 - DNA, 25 bp, Mus musculus
aagaaaatatctggcgggaaggaag

SEQ ID NO: 42637 - DNA, 25 bp, Mus musculus
aagaaaatcctcattttgcatattt

SEQ ID NO: 42638 - DNA, 25 bp, Mus musculus
aagaaaatcctctttttgcatattt

SEQ ID NO: 42639 - DNA, 25 bp, Mus musculus
aagaaaatcgtcaccaagctcaaag

SEQ ID NO: 42640 - DNA, 25 bp, Mus musculus
aagaaaatcgtctccaagctcaaag

SEQ ID NO: 42641 - DNA, 25 bp, Mus musculus
aagaaaatcttgacactcctggcac

SEQ ID NO: 42642 - DNA, 25 bp, Mus musculus
aagaaaatcttgtcactcctggcac

SEQ ID NO: 42643 - DNA, 25 bp, Mus musculus
aagaaaatgcctatgacatcatcta

SEQ ID NO: 42644 - DNA, 25 bp, Mus musculus
aagaaaatgcctttgacatcatcta

SEQ ID NO: 42645 - DNA, 25 bp, Mus musculus
aagaaaatggcacacaagccggaca

SEQ ID NO: 42646 - DNA, 25 bp, Mus musculus
aagaaaatggcagacaagccggaca

SEQ ID NO: 42647 - DNA, 25 bp, Mus musculus
aagaaaatgttccatcatcaaaata

SEQ ID NO: 42648 - DNA, 25 bp, Mus musculus
aagaaaatgttcgatcatcaaaata

SEQ ID NO: 42649 - DNA, 25 bp, Mus musculus
aagaaaattatacgcgctccccatt

SEQ ID NO: 42650 - DNA, 25 bp, Mus musculus
aagaaaattataggcgctccccatt

SEQ ID NO: 42651 - DNA, 25 bp, Mus musculus
aagaaaattcccctccaggcagaat

SEQ ID NO: 42652 - DNA, 25 bp, Mus musculus
aagaaaattccccttacatctctgt

SEQ ID NO: 42653 - DNA, 25 bp, Mus musculus
aagaaaattcccgtccaggcagaat

SEQ ID NO: 42654 - DNA, 25 bp, Mus musculus
aagaaaattcccgttacatctctgt

SEQ ID NO: 42655 - DNA, 25 bp, Mus musculus
aagaaaattcgaccccatagagggc

SEQ ID NO: 42656 - DNA, 25 bp, Mus musculus
aagaaaattcgagcccatagagggc

SEQ ID NO: 42657 - DNA, 25 bp, Mus musculus
aagaaacaaaataatagccaggcgt

SEQ ID NO: 42658 - DNA, 25 bp, Mus musculus
aagaaacaaaattatagccaggcgt

SEQ ID NO: 42659 - DNA, 25 bp, Mus musculus
aagaaacaaacacccctactcgact

SEQ ID NO: 42660 - DNA, 25 bp, Mus musculus
aagaaacaaacagccctactcgact

SEQ ID NO: 42661 - DNA, 25 bp, Mus musculus
aagaaacaatatccttctacttctt

SEQ ID NO: 42662 - DNA, 25 bp, Mus musculus
aagaaacaatatgcttctacttctt

SEQ ID NO: 42663 - DNA, 25 bp, Mus musculus
aagaaacacctcctagttcacgcca

SEQ ID NO: 42664 - DNA, 25 bp, Mus musculus
aagaaacacctcgtagttcacgcca

SEQ ID NO: 42665 - DNA, 25 bp, Mus musculus
aagaaacacggcatcttacagcctc

SEQ ID NO: 42666 - DNA, 25 bp, Mus musculus
aagaaacacggcttcttacagcctc

SEQ ID NO: 42667 - DNA, 25 bp, Mus musculus
aagaaacacgtgcttcttctgtggc

SEQ ID NO: 42668 - DNA, 25 bp, Mus musculus
aagaaacacgtggttcttctgtggc

SEQ ID NO: 42669 - DNA, 25 bp, Mus musculus
aagaaacacttcaattaagctgcat

SEQ ID NO: 42670 - DNA, 25 bp, Mus musculus
aagaaacacttctattaagctgcat

SEQ ID NO: 42671 - DNA, 25 bp, Mus musculus
aagaaacagcacaaagacctgttta

SEQ ID NO: 42672 - DNA, 25 bp, Mus musculus
aagaaacagcactaagacctgttta

SEQ ID NO: 42673 - DNA, 25 bp, Mus musculus
aagaaacagcatagtccacctgtcc

SEQ ID NO: 42674 - DNA, 25 bp, Mus musculus
aagaaacagcattgtccacctgtcc

SEQ ID NO: 42675 - DNA, 25 bp, Mus musculus
aagaaacagcctcccagtctgtcat

SEQ ID NO: 42676 - DNA, 25 bp, Mus musculus
aagaaacagcctgccagtctgtcat

SEQ ID NO: 42677 - DNA, 25 bp, Mus musculus
aagaaacagcgtcatctctagtccc

SEQ ID NO: 42678 - DNA, 25 bp, Mus musculus
aagaaacagcgtgatctctagtccc

SEQ ID NO: 42679 - DNA, 25 bp, Mus musculus
aagaaacaggaccagtgcctcttcc

SEQ ID NO: 42680 - DNA, 25 bp, Mus musculus
aagaaacaggacgagtgcctcttcc

SEQ ID NO: 42681 - DNA, 25 bp, Mus musculus
aagaaacaggtcactcaacttctcc

SEQ ID NO: 42682 - DNA, 25 bp, Mus musculus
aagaaacaggtctctcaacttctcc

SEQ ID NO: 42683 - DNA, 25 bp, Mus musculus
aagaaacagtagacattggaaggag

SEQ ID NO: 42684 - DNA, 25 bp, Mus musculus
aagaaacagtagtcattggaaggag

SEQ ID NO: 42685 - DNA, 25 bp, Mus musculus
aagaaacagtgaactccccagctat

SEQ ID NO: 42686 - DNA, 25 bp, Mus musculus
aagaaacagtgatctccccagctat

SEQ ID NO: 42687 - DNA, 25 bp, Mus musculus
aagaaacatagccttcagctccaat

SEQ ID NO: 42688 - DNA, 25 bp, Mus musculus
aagaaacatagcgttcagctccaat

SEQ ID NO: 42689 - DNA, 25 bp, Mus musculus
aagaaacatcccagaatcgaccctt

SEQ ID NO: 42690 - DNA, 25 bp, Mus musculus
aagaaacatccctgaatcgaccctt

SEQ ID NO: 42691 - DNA, 25 bp, Mus musculus
aagaaacatctacctggatttgctg

SEQ ID NO: 42692 - DNA, 25 bp, Mus musculus
aagaaacatctagctggatttgctg

SEQ ID NO: 42693 - DNA, 25 bp, Mus musculus
aagaaacatgctactaactctggag

SEQ ID NO: 42694 - DNA, 25 bp, Mus musculus
aagaaacatgcttctaactctggag

SEQ ID NO: 42695 - DNA, 25 bp, Mus musculus
aagaaaccaaagagcaccaagatag

SEQ ID NO: 42696 - DNA, 25 bp, Mus musculus
aagaaaccaaagtgcaccaagatag

SEQ ID NO: 42697 - DNA, 25 bp, Mus musculus
aagaaaccacacatgcaccaacaga

SEQ ID NO: 42698 - DNA, 25 bp, Mus musculus
aagaaaccacacttgcaccaacaga

SEQ ID NO: 42699 - DNA, 25 bp, Mus musculus
aagaaaccactcatcttcttcggtt

SEQ ID NO: 42700 - DNA, 25 bp, Mus musculus
aagaaaccactcttcttcttcggtt

SEQ ID NO: 42701 - DNA, 25 bp, Mus musculus
aagaaaccatatcttgatagtattc

SEQ ID NO: 42702 - DNA, 25 bp, Mus musculus
aagaaaccatatgttgatagtattc

SEQ ID NO: 42703 - DNA, 25 bp, Mus musculus
aagaaaccatctccggatcaaccac

SEQ ID NO: 42704 - DNA, 25 bp, Mus musculus
aagaaaccatctgcggatcaaccac

SEQ ID NO: 42705 - DNA, 25 bp, Mus musculus
aagaaacccaaacctcattcgctct

SEQ ID NO: 42706 - DNA, 25 bp, Mus musculus
aagaaacccaaagctcattcgctct

SEQ ID NO: 42707 - DNA, 25 bp, Mus musculus
aagaaacccacacgcggacttggat

SEQ ID NO: 42708 - DNA, 25 bp, Mus musculus
aagaaacccacaggcggacttggat

SEQ ID NO: 42709 - DNA, 25 bp, Mus musculus
aagaaacccaggctccagccttcat

SEQ ID NO: 42710 - DNA, 25 bp, Mus musculus
aagaaacccagggtccagccttcat

SEQ ID NO: 42711 - DNA, 25 bp, Mus musculus
aagaaacccagtatcatagatgtgg

SEQ ID NO: 42712 - DNA, 25 bp, Mus musculus
aagaaacccagtttcatagatgtgg

SEQ ID NO: 42713 - DNA, 25 bp, Mus musculus
aagaaaccccgcctcttctgtgaca

SEQ ID NO: 42714 - DNA, 25 bp, Mus musculus
aagaaaccccgcgtcttctgtgaca

SEQ ID NO: 42715 - DNA, 25 bp, Mus musculus
aagaaaccctgtagcagcctgtatt

SEQ ID NO: 42716 - DNA, 25 bp, Mus musculus
aagaaaccctgttgcagcctgtatt

SEQ ID NO: 42717 - DNA, 25 bp, Mus musculus
aagaaaccgcgaccccagaatggaa

SEQ ID NO: 42718 - DNA, 25 bp, Mus musculus
aagaaaccgcgagcccagaatggaa

SEQ ID NO: 42719 - DNA, 25 bp, Mus musculus
aagaaaccgctgacatggacgacct

SEQ ID NO: 42720 - DNA, 25 bp, Mus musculus
aagaaaccgctgtcatggacgacct

SEQ ID NO: 42721 - DNA, 25 bp, Mus musculus
aagaaaccggtcatcgcagctgtca

SEQ ID NO: 42722 - DNA, 25 bp, Mus musculus
aagaaaccggtcttcgcagctgtca

SEQ ID NO: 42723 - DNA, 25 bp, Mus musculus
aagaaacctataccttgccttctga

SEQ ID NO: 42724 - DNA, 25 bp, Mus musculus
aagaaacctatagcttgccttctga

SEQ ID NO: 42725 - DNA, 25 bp, Mus musculus
aagaaacctccaagtgccacacgta

SEQ ID NO: 42726 - DNA, 25 bp, Mus musculus
aagaaacctccacgtggtgttctgc

SEQ ID NO: 42727 - DNA, 25 bp, Mus musculus
aagaaacctccaggtggtgttctgc

SEQ ID NO: 42728 - DNA, 25 bp, Mus musculus
aagaaacctccatgtgccacacgta

SEQ ID NO: 42729 - DNA, 25 bp, Mus musculus
aagaaacctgaacgcccatataaag

SEQ ID NO: 42730 - DNA, 25 bp, Mus musculus
aagaaacctgaaggcccatataaag

SEQ ID NO: 42731 - DNA, 25 bp, Mus musculus
aagaaacctgacaatagaccataaa

SEQ ID NO: 42732 - DNA, 25 bp, Mus musculus
aagaaacctgactatagaccataaa

SEQ ID NO: 42733 - DNA, 25 bp, Mus musculus
aagaaacctgctatcactgctatgt

SEQ ID NO: 42734 - DNA, 25 bp, Mus musculus
aagaaacctgctttcactgctatgt

SEQ ID NO: 42735 - DNA, 25 bp, Mus musculus
aagaaacctgttcgcttctatcatg

SEQ ID NO: 42736 - DNA, 25 bp, Mus musculus
aagaaacctgttggcttctatcatg

SEQ ID NO: 42737 - DNA, 25 bp, Mus musculus
aagaaaccttgcctgttgtggacca

SEQ ID NO: 42738 - DNA, 25 bp, Mus musculus
aagaaaccttgcgtgttgtggacca

SEQ ID NO: 42739 - DNA, 25 bp, Mus musculus
aagaaacctttacctgtcacagtag

SEQ ID NO: 42740 - DNA, 25 bp, Mus musculus
aagaaacctttagctgtcacagtag

SEQ ID NO: 42741 - DNA, 25 bp, Mus musculus
aagaaacgcctcatccgtactgcat

SEQ ID NO: 42742 - DNA, 25 bp, Mus musculus
aagaaacgcctcttccgtactgcat

SEQ ID NO: 42743 - DNA, 25 bp, Mus musculus
aagaaacgcgaactggcgcaggcca

SEQ ID NO: 42744 - DNA, 25 bp, Mus musculus
aagaaacgcgaagtggcgcaggcca

SEQ ID NO: 42745 - DNA, 25 bp, Mus musculus
aagaaacggagcatgcgtgttagcg

SEQ ID NO: 42746 - DNA, 25 bp, Mus musculus
aagaaacggagcttgcgtgttagcg

SEQ ID NO: 42747 - DNA, 25 bp, Mus musculus
aagaaacgggacatttgacacctat

SEQ ID NO: 42748 - DNA, 25 bp, Mus musculus
aagaaacgggacttttgacacctat

SEQ ID NO: 42749 - DNA, 25 bp, Mus musculus
aagaaacgggccagtcatctaagct

SEQ ID NO: 42750 - DNA, 25 bp, Mus musculus
aagaaacgggcctgtcatctaagct

SEQ ID NO: 42751 - DNA, 25 bp, Mus musculus
aagaaactacccacagtcacagtgc

SEQ ID NO: 42752 - DNA, 25 bp, Mus musculus
aagaaactaccctcagtcacagtgc

SEQ ID NO: 42753 - DNA, 25 bp, Mus musculus
aagaaactacttacatctaagacca

SEQ ID NO: 42754 - DNA, 25 bp, Mus musculus
aagaaactactttcatctaagacca

SEQ ID NO: 42755 - DNA, 25 bp, Mus musculus
aagaaactccgaagtctgcttgctg

SEQ ID NO: 42756 - DNA, 25 bp, Mus musculus
aagaaactccgatgtctgcttgctg

SEQ ID NO: 42757 - DNA, 25 bp, Mus musculus
aagaaactcctcagcattgcagtga

SEQ ID NO: 42758 - DNA, 25 bp, Mus musculus
aagaaactcctctgcattgcagtga

SEQ ID NO: 42759 - DNA, 25 bp, Mus musculus
aagaaactcctgctggcagtacaga

SEQ ID NO: 42760 - DNA, 25 bp, Mus musculus
aagaaactcctggtggcagtacaga

SEQ ID NO: 42761 - DNA, 25 bp, Mus musculus
aagaaactctcaccctggagcggtt

SEQ ID NO: 42762 - DNA, 25 bp, Mus musculus
aagaaactctcagcctggagcggtt

SEQ ID NO: 42763 - DNA, 25 bp, Mus musculus
aagaaactctctctactcagttgga

SEQ ID NO: 42764 - DNA, 25 bp, Mus musculus
aagaaactctctgtactcagttgga

SEQ ID NO: 42765 - DNA, 25 bp, Mus musculus
aagaaactcttcctatctccgccat

SEQ ID NO: 42766 - DNA, 25 bp, Mus musculus
aagaaactcttcgtatctccgccat

SEQ ID NO: 42767 - DNA, 25 bp, Mus musculus
aagaaactctttaatgtatttgcga

SEQ ID NO: 42768 - DNA, 25 bp, Mus musculus
aagaaactcttttatgtatttgcga

SEQ ID NO: 42769 - DNA, 25 bp, Mus musculus
aagaaactgcctcgcgaggagcctc

SEQ ID NO: 42770 - DNA, 25 bp, Mus musculus
aagaaactgcctggcgaggagcctc

SEQ ID NO: 42771 - DNA, 25 bp, Mus musculus
aagaaactggatcatttccctggtt

SEQ ID NO: 42772 - DNA, 25 bp, Mus musculus
aagaaactggatgatttccctggtt

SEQ ID NO: 42773 - DNA, 25 bp, Mus musculus
aagaaacttccgagtcctctctgca

SEQ ID NO: 42774 - DNA, 25 bp, Mus musculus
aagaaacttccgtgtcctctctgca

SEQ ID NO: 42775 - DNA, 25 bp, Mus musculus
aagaaacttctcatcaaaagcaaag

SEQ ID NO: 42776 - DNA, 25 bp, Mus musculus
aagaaacttctcttcaaaagcaaag

SEQ ID NO: 42777 - DNA, 25 bp, Mus musculus
aagaaacttgcaatgcctctctttg

SEQ ID NO: 42778 - DNA, 25 bp, Mus musculus
aagaaacttgcattgcctctctttg

SEQ ID NO: 42779 - DNA, 25 bp, Mus musculus
aagaaacttgttcttctctctgcct

SEQ ID NO: 42780 - DNA, 25 bp, Mus musculus
aagaaacttgttgttctctctgcct

SEQ ID NO: 42781 - DNA, 25 bp, Mus musculus
aagaaactttagagaagctcaaagc

SEQ ID NO: 42782 - DNA, 25 bp, Mus musculus
aagaaactttagtgaagctcaaagc

SEQ ID NO: 42783 - DNA, 25 bp, Mus musculus
aagaaagaagctccccagaaggtgg

SEQ ID NO: 42784 - DNA, 25 bp, Mus musculus
aagaaagaagctgcccagaaggtgg

SEQ ID NO: 42785 - DNA, 25 bp, Mus musculus
aagaaagaagtacccgcgcctggtg

SEQ ID NO: 42786 - DNA, 25 bp, Mus musculus
aagaaagaagtagccgcgcctggtg

SEQ ID NO: 42787 - DNA, 25 bp, Mus musculus
aagaaagacaatccacccctctctt

SEQ ID NO: 42788 - DNA, 25 bp, Mus musculus
aagaaagacaatgcacccctctctt

SEQ ID NO: 42789 - DNA, 25 bp, Mus musculus
aagaaagaccagagacgaagatgat

SEQ ID NO: 42790 - DNA, 25 bp, Mus musculus
aagaaagaccagtgacgaagatgat

SEQ ID NO: 42791 - DNA, 25 bp, Mus musculus
aagaaagactgcaactgttacttcc

SEQ ID NO: 42792 - DNA, 25 bp, Mus musculus
aagaaagactgctactgttacttcc

SEQ ID NO: 42793 - DNA, 25 bp, Mus musculus
aagaaagagagccagtgaactgtca

SEQ ID NO: 42794 - DNA, 25 bp, Mus musculus
aagaaagagagcgagtgaactgtca

SEQ ID NO: 42795 - DNA, 25 bp, Mus musculus
aagaaagagctcactatacaagttg

SEQ ID NO: 42796 - DNA, 25 bp, Mus musculus
aagaaagagctctctatacaagttg

SEQ ID NO: 42797 - DNA, 25 bp, Mus musculus
aagaaagagctgatgggtgcacccc

SEQ ID NO: 42798 - DNA, 25 bp, Mus musculus
aagaaagagctgttgggtgcacccc

SEQ ID NO: 42799 - DNA, 25 bp, Mus musculus
aagaaagaggtgatggctgctccat

SEQ ID NO: 42800 - DNA, 25 bp, Mus musculus
aagaaagaggtgttggctgctccat

SEQ ID NO: 42801 - DNA, 25 bp, Mus musculus
aagaaagatcccaaaaatgtgctga

SEQ ID NO: 42802 - DNA, 25 bp, Mus musculus
aagaaagatccctaaaatgtgctga

SEQ ID NO: 42803 - DNA, 25 bp, Mus musculus
aagaaagcacgtagtctgtccacct

SEQ ID NO: 42804 - DNA, 25 bp, Mus musculus
aagaaagcacgttgtctgtccacct

SEQ ID NO: 42805 - DNA, 25 bp, Mus musculus
aagaaagcagcactggaaccaggga

SEQ ID NO: 42806 - DNA, 25 bp, Mus musculus
aagaaagcagcagtggaaccaggga

SEQ ID NO: 42807 - DNA, 25 bp, Mus musculus
aagaaagcagcgctccgggactaag

SEQ ID NO: 42808 - DNA, 25 bp, Mus musculus
aagaaagcagcggtccgggactaag

SEQ ID NO: 42809 - DNA, 25 bp, Mus musculus
aagaaagccaccctctttctcaatc

SEQ ID NO: 42810 - DNA, 25 bp, Mus musculus
aagaaagccaccgtctttctcaatc

SEQ ID NO: 42811 - DNA, 25 bp, Mus musculus
aagaaagcccgaccctatggcagag

SEQ ID NO: 42812 - DNA, 25 bp, Mus musculus
aagaaagcccgagcctatggcagag

SEQ ID NO: 42813 - DNA, 25 bp, Mus musculus
aagaaagcctttatgttgctcacag

SEQ ID NO: 42814 - DNA, 25 bp, Mus musculus
aagaaagcctttttgttgctcacag

SEQ ID NO: 42815 - DNA, 25 bp, Mus musculus
aagaaagcgactcaaactgttgcat

SEQ ID NO: 42816 - DNA, 25 bp, Mus musculus
aagaaagcgactgaaactgttgcat

SEQ ID NO: 42817 - DNA, 25 bp, Mus musculus
aagaaagcgctgctctctgggtact

SEQ ID NO: 42818 - DNA, 25 bp, Mus musculus
aagaaagcgctggtctctgggtact

SEQ ID NO: 42819 - DNA, 25 bp, Mus musculus
aagaaagcggagagacctgagacag

SEQ ID NO: 42820 - DNA, 25 bp, Mus musculus
aagaaagcggagtgacctgagacag

SEQ ID NO: 42821 - DNA, 25 bp, Mus musculus
aagaaagcgtgacgctacacagaat

SEQ ID NO: 42822 - DNA, 25 bp, Mus musculus
aagaaagcgtgaggctacacagaat

SEQ ID NO: 42823 - DNA, 25 bp, Mus musculus
aagaaagctagacgctaccccaggt

SEQ ID NO: 42824 - DNA, 25 bp, Mus musculus
aagaaagctagaggctaccccaggt

SEQ ID NO: 42825 - DNA, 25 bp, Mus musculus
aagaaagctcatcgtctgctctgct

SEQ ID NO: 42826 - DNA, 25 bp, Mus musculus
aagaaagctcatggtctgctctgct

SEQ ID NO: 42827 - DNA, 25 bp, Mus musculus
aagaaagctcttctctgggtagtga

SEQ ID NO: 42828 - DNA, 25 bp, Mus musculus
aagaaagctcttgtctgggtagtga

SEQ ID NO: 42829 - DNA, 25 bp, Mus musculus
aagaaagctgccatagctgctcaga

SEQ ID NO: 42830 - DNA, 25 bp, Mus musculus
aagaaagctgccttagctgctcaga

SEQ ID NO: 42831 - DNA, 25 bp, Mus musculus
aagaaagctggcacttgccattacc

SEQ ID NO: 42832 - DNA, 25 bp, Mus musculus
aagaaagctggctcttgccattacc

SEQ ID NO: 42833 - DNA, 25 bp, Mus musculus
aagaaagcttccatcctggttgcta

SEQ ID NO: 42834 - DNA, 25 bp, Mus musculus
aagaaagcttccttcctggttgcta

SEQ ID NO: 42835 - DNA, 25 bp, Mus musculus
aagaaagctttcaccaatccaacct

SEQ ID NO: 42836 - DNA, 25 bp, Mus musculus
aagaaagctttctccaatccaacct

SEQ ID NO: 42837 - DNA, 25 bp, Mus musculus
aagaaaggaacgctggcacatcttc

SEQ ID NO: 42838 - DNA, 25 bp, Mus musculus
aagaaaggaacggtggcacatcttc

SEQ ID NO: 42839 - DNA, 25 bp, Mus musculus
aagaaaggaagcaggccccttcttg

SEQ ID NO: 42840 - DNA, 25 bp, Mus musculus
aagaaaggaagctggccccttcttg

SEQ ID NO: 42841 - DNA, 25 bp, Mus musculus
aagaaaggactgaccgtctccctct

SEQ ID NO: 42842 - DNA, 25 bp, Mus musculus
aagaaaggactgtccgtctccctct

SEQ ID NO: 42843 - DNA, 25 bp, Mus musculus
aagaaaggagatccgctcttcccgt

SEQ ID NO: 42844 - DNA, 25 bp, Mus musculus
aagaaaggagatgcgctcttcccgt

SEQ ID NO: 42845 - DNA, 25 bp, Mus musculus
aagaaaggccaccttcaattctcag

SEQ ID NO: 42846 - DNA, 25 bp, Mus musculus
aagaaaggccacgttcaattctcag

SEQ ID NO: 42847 - DNA, 25 bp, Mus musculus
aagaaaggcgtcactctgccagagt

SEQ ID NO: 42848 - DNA, 25 bp, Mus musculus
aagaaaggcgtctctctgccagagt

SEQ ID NO: 42849 - DNA, 25 bp, Mus musculus
aagaaagggacacgccattgctctg

SEQ ID NO: 42850 - DNA, 25 bp, Mus musculus
aagaaagggacaggccattgctctg

SEQ ID NO: 42851 - DNA, 25 bp, Mus musculus
aagaaagggcctacgggatgcctct

SEQ ID NO: 42852 - DNA, 25 bp, Mus musculus
aagaaagggccttcgggatgcctct

SEQ ID NO: 42853 - DNA, 25 bp, Mus musculus
aagaaaggtagcaggccctccacat

SEQ ID NO: 42854 - DNA, 25 bp, Mus musculus
aagaaaggtagctggccctccacat

SEQ ID NO: 42855 - DNA, 25 bp, Mus musculus
aagaaagtagcacccatcatggacc

SEQ ID NO: 42856 - DNA, 25 bp, Mus musculus
aagaaagtagcagccatcatggacc

SEQ ID NO: 42857 - DNA, 25 bp, Mus musculus
aagaaagtatctcccaaatccccac

SEQ ID NO: 42858 - DNA, 25 bp, Mus musculus
aagaaagtatctgccaaatccccac

SEQ ID NO: 42859 - DNA, 25 bp, Mus musculus
aagaaagtctttctccctgatgaac

SEQ ID NO: 42860 - DNA, 25 bp, Mus musculus
aagaaagtctttgtccctgatgaac

SEQ ID NO: 42861 - DNA, 25 bp, Mus musculus
aagaaagtgaccaccgtacccacag

SEQ ID NO: 42862 - DNA, 25 bp, Mus musculus
aagaaagtgacctccgtacccacag

SEQ ID NO: 42863 - DNA, 25 bp, Mus musculus
aagaaagtgagtctcccctcagtgt

SEQ ID NO: 42864 - DNA, 25 bp, Mus musculus
aagaaagtgagtgtcccctcagtgt

SEQ ID NO: 42865 - DNA, 25 bp, Mus musculus
aagaaagtgataccccaggcgtgag

SEQ ID NO: 42866 - DNA, 25 bp, Mus musculus
aagaaagtgatagcccaggcgtgag

SEQ ID NO: 42867 - DNA, 25 bp, Mus musculus
aagaaagtgctccaagaccctaggc

SEQ ID NO: 42868 - DNA, 25 bp, Mus musculus
aagaaagtgctcgaagaccctaggc

SEQ ID NO: 42869 - DNA, 25 bp, Mus musculus
aagaaagtggccatgtgtgctgctc

SEQ ID NO: 42870 - DNA, 25 bp, Mus musculus
aagaaagtggccttgtgtgctgctc

SEQ ID NO: 42871 - DNA, 25 bp, Mus musculus
aagaaagtggctcgcaccatcggca

SEQ ID NO: 42872 - DNA, 25 bp, Mus musculus
aagaaagtggctggcaccatcggca

SEQ ID NO: 42873 - DNA, 25 bp, Mus musculus
aagaaagtgtctcggcagatccttg

SEQ ID NO: 42874 - DNA, 25 bp, Mus musculus
aagaaagtgtctgggcagatccttg

SEQ ID NO: 42875 - DNA, 25 bp, Mus musculus
aagaaagtgttgactaatcctagta

SEQ ID NO: 42876 - DNA, 25 bp, Mus musculus
aagaaagtgttgtctaatcctagta

SEQ ID NO: 42877 - DNA, 25 bp, Mus musculus
aagaaagttactcggccctgatgcg

SEQ ID NO: 42878 - DNA, 25 bp, Mus musculus
aagaaagttactgggccctgatgcg

SEQ ID NO: 42879 - DNA, 25 bp, Mus musculus
aagaaagttctcatggggctggtga

SEQ ID NO: 42880 - DNA, 25 bp, Mus musculus
aagaaagttctcttggggctggtga

SEQ ID NO: 42881 - DNA, 25 bp, Mus musculus
aagaaagttgttagtcaccaagcct

SEQ ID NO: 42882 - DNA, 25 bp, Mus musculus
aagaaagttgtttgtcaccaagcct

SEQ ID NO: 42883 - DNA, 25 bp, Mus musculus
aagaaagtttatatggagctcacag

SEQ ID NO: 42884 - DNA, 25 bp, Mus musculus
aagaaagtttatttggagctcacag

SEQ ID NO: 42885 - DNA, 25 bp, Mus musculus
aagaaagtttctcccgactcagagg

SEQ ID NO: 42886 - DNA, 25 bp, Mus musculus
aagaaagtttctgccgactcagagg

SEQ ID NO: 42887 - DNA, 25 bp, Mus musculus
aagaaataatctacctcagggagga

SEQ ID NO: 42888 - DNA, 25 bp, Mus musculus
aagaaataatcttcctcagggagga

SEQ ID NO: 42889 - DNA, 25 bp, Mus musculus
aagaaataccagcatgtcacattaa

SEQ ID NO: 42890 - DNA, 25 bp, Mus musculus
aagaaataccaggatgtcacattaa

SEQ ID NO: 42891 - DNA, 25 bp, Mus musculus
aagaaatactatcacattccttatg

SEQ ID NO: 42892 - DNA, 25 bp, Mus musculus
aagaaatactatgacattccttatg

SEQ ID NO: 42893 - DNA, 25 bp, Mus musculus
aagaaatagctgcattcagcatgca

SEQ ID NO: 42894 - DNA, 25 bp, Mus musculus
aagaaatagctggattcagcatgca

SEQ ID NO: 42895 - DNA, 25 bp, Mus musculus
aagaaatagcttcccgtcttcctat

SEQ ID NO: 42896 - DNA, 25 bp, Mus musculus
aagaaatagcttgccgtcttcctat

SEQ ID NO: 42897 - DNA, 25 bp, Mus musculus
aagaaatcacccagtgtcgtggtcc

SEQ ID NO: 42898 - DNA, 25 bp, Mus musculus
aagaaatcaccctgtgtcgtggtcc

SEQ ID NO: 42899 - DNA, 25 bp, Mus musculus
aagaaatcactcacccacctgatgg

SEQ ID NO: 42900 - DNA, 25 bp, Mus musculus
aagaaatcactctcccacctgatgg

SEQ ID NO: 42901 - DNA, 25 bp, Mus musculus
aagaaatcagtgactgcctgttaca

SEQ ID NO: 42902 - DNA, 25 bp, Mus musculus
aagaaatcagtgtctgcctgttaca

SEQ ID NO: 42903 - DNA, 25 bp, Mus musculus
aagaaatcatagagctggagaccat

SEQ ID NO: 42904 - DNA, 25 bp, Mus musculus
aagaaatcatagtgctggagaccat

SEQ ID NO: 42905 - DNA, 25 bp, Mus musculus
aagaaatcccaacagtccctcggct

SEQ ID NO: 42906 - DNA, 25 bp, Mus musculus
aagaaatcccaagagtccctcggct

SEQ ID NO: 42907 - DNA, 25 bp, Mus musculus
aagaaatcccacagtgttctctctg

SEQ ID NO: 42908 - DNA, 25 bp, Mus musculus
aagaaatcccactgtgttctctctg

SEQ ID NO: 42909 - DNA, 25 bp, Mus musculus
aagaaatccctcaattacacgaata

SEQ ID NO: 42910 - DNA, 25 bp, Mus musculus
aagaaatccctctattacacgaata

SEQ ID NO: 42911 - DNA, 25 bp, Mus musculus
aagaaatccggtctcgtttcctgat

SEQ ID NO: 42912 - DNA, 25 bp, Mus musculus
aagaaatccggtgtcgtttcctgat

SEQ ID NO: 42913 - DNA, 25 bp, Mus musculus
aagaaatccgtgcacactctgagga

SEQ ID NO: 42914 - DNA, 25 bp, Mus musculus
aagaaatccgtggacactctgagga

SEQ ID NO: 42915 - DNA, 25 bp, Mus musculus
aagaaatcctatcatgttggatcag

SEQ ID NO: 42916 - DNA, 25 bp, Mus musculus
aagaaatcctatgatgttggatcag

SEQ ID NO: 42917 - DNA, 25 bp, Mus musculus
aagaaatcctgccttagactctgca

SEQ ID NO: 42918 - DNA, 25 bp, Mus musculus
aagaaatcctgcgttagactctgca

SEQ ID NO: 42919 - DNA, 25 bp, Mus musculus
aagaaatcgtgcatcagctgcccag

SEQ ID NO: 42920 - DNA, 25 bp, Mus musculus
aagaaatcgtgcttcagctgcccag

SEQ ID NO: 42921 - DNA, 25 bp, Mus musculus
aagaaatctacacccttcaaggtga

SEQ ID NO: 42922 - DNA, 25 bp, Mus musculus
aagaaatctacagccttcaaggtga

SEQ ID NO: 42923 - DNA, 25 bp, Mus musculus
aagaaatctggcatagtagaaccca

SEQ ID NO: 42924 - DNA, 25 bp, Mus musculus
aagaaatctggccttcattttcgac

SEQ ID NO: 42925 - DNA, 25 bp, Mus musculus
aagaaatctggcgttcattttcgac

SEQ ID NO: 42926 - DNA, 25 bp, Mus musculus
aagaaatctggcttagtagaaccca

SEQ ID NO: 42927 - DNA, 25 bp, Mus musculus
aagaaatctgtactctctggtgacc

SEQ ID NO: 42928 - DNA, 25 bp, Mus musculus
aagaaatctgtagtctctggtgacc

SEQ ID NO: 42929 - DNA, 25 bp, Mus musculus
aagaaatctgtccacagctcaggaa

SEQ ID NO: 42930 - DNA, 25 bp, Mus musculus
aagaaatctgtcgacagctcaggaa

SEQ ID NO: 42931 - DNA, 25 bp, Mus musculus
aagaaatcttgtcctagaatacttt

SEQ ID NO: 42932 - DNA, 25 bp, Mus musculus
aagaaatcttgtgctagaatacttt

SEQ ID NO: 42933 - DNA, 25 bp, Mus musculus
aagaaatgaagacccgggccgccct

SEQ ID NO: 42934 - DNA, 25 bp, Mus musculus
aagaaatgaagagccgggccgccct

SEQ ID NO: 42935 - DNA, 25 bp, Mus musculus
aagaaatgaagccagcagccccagt

SEQ ID NO: 42936 - DNA, 25 bp, Mus musculus
aagaaatgaagcgagcagccccagt

SEQ ID NO: 42937 - DNA, 25 bp, Mus musculus
aagaaatgaccaacaaaaccaccag

SEQ ID NO: 42938 - DNA, 25 bp, Mus musculus
aagaaatgaccatcaaaaccaccag

SEQ ID NO: 42939 - DNA, 25 bp, Mus musculus
aagaaatgactccagctatgcaagc

SEQ ID NO: 42940 - DNA, 25 bp, Mus musculus
aagaaatgactcgagctatgcaagc

SEQ ID NO: 42941 - DNA, 25 bp, Mus musculus
aagaaatgcaaaacgaaccaaccct

SEQ ID NO: 42942 - DNA, 25 bp, Mus musculus
aagaaatgcaaatcgaaccaaccct

SEQ ID NO: 42943 - DNA, 25 bp, Mus musculus
aagaaatgcagcctacacacccgat

SEQ ID NO: 42944 - DNA, 25 bp, Mus musculus
aagaaatgcagcgtacacacccgat

SEQ ID NO: 42945 - DNA, 25 bp, Mus musculus
aagaaatgcattccctcagttttac

SEQ ID NO: 42946 - DNA, 25 bp, Mus musculus
aagaaatgcattgcctcagttttac

SEQ ID NO: 42947 - DNA, 25 bp, Mus musculus
aagaaatgccagcatggccacagcc

SEQ ID NO: 42948 - DNA, 25 bp, Mus musculus
aagaaatgccaggatggccacagcc

SEQ ID NO: 42949 - DNA, 25 bp, Mus musculus
aagaaatgccataacgtatgttaca

SEQ ID NO: 42950 - DNA, 25 bp, Mus musculus
aagaaatgccattacgtatgttaca

SEQ ID NO: 42951 - DNA, 25 bp, Mus musculus
aagaaatgcgccctcagtggttcca

SEQ ID NO: 42952 - DNA, 25 bp, Mus musculus
aagaaatgcgccgtcagtggttcca

SEQ ID NO: 42953 - DNA, 25 bp, Mus musculus
aagaaatgctacaccggtttcgtct

SEQ ID NO: 42954 - DNA, 25 bp, Mus musculus
aagaaatgctactccggtttcgtct

SEQ ID NO: 42955 - DNA, 25 bp, Mus musculus
aagaaatggaaaccgcccgtatgca

SEQ ID NO: 42956 - DNA, 25 bp, Mus musculus
aagaaatggaaagcgcccgtatgca

SEQ ID NO: 42957 - DNA, 25 bp, Mus musculus
aagaaatgtcgcatgccttgtgttt

SEQ ID NO: 42958 - DNA, 25 bp, Mus musculus
aagaaatgtcgcttgccttgtgttt

SEQ ID NO: 42959 - DNA, 25 bp, Mus musculus
aagaaatgtgtcaagtccccttcgc

SEQ ID NO: 42960 - DNA, 25 bp, Mus musculus
aagaaatgtgtctagtccccttcgc

SEQ ID NO: 42961 - DNA, 25 bp, Mus musculus
aagaaatgttccatatcttgctctg

SEQ ID NO: 42962 - DNA, 25 bp, Mus musculus
aagaaatgttccttatcttgctctg

SEQ ID NO: 42963 - DNA, 25 bp, Mus musculus
aagaaattacctcctgatgatccag

SEQ ID NO: 42964 - DNA, 25 bp, Mus musculus
aagaaattacctgctgatgatccag

SEQ ID NO: 42965 - DNA, 25 bp, Mus musculus
aagaaattactcagctatggtcatc

SEQ ID NO: 42966 - DNA, 25 bp, Mus musculus
aagaaattactctgctatggtcatc

SEQ ID NO: 42967 - DNA, 25 bp, Mus musculus
aagaaattcatcagctccccagaga

SEQ ID NO: 42968 - DNA, 25 bp, Mus musculus
aagaaattcatctgctccccagaga

SEQ ID NO: 42969 - DNA, 25 bp, Mus musculus
aagaaattccagaggtaccaccata

SEQ ID NO: 42970 - DNA, 25 bp, Mus musculus
aagaaattccagtggtaccaccata

SEQ ID NO: 42971 - DNA, 25 bp, Mus musculus
aagaaattccgacaacaacatgaga

SEQ ID NO: 42972 - DNA, 25 bp, Mus musculus
aagaaattccgagaacaacatgaga

SEQ ID NO: 42973 - DNA, 25 bp, Mus musculus
aagaaattccgccaggcctgcatag

SEQ ID NO: 42974 - DNA, 25 bp, Mus musculus
aagaaattccgcgaggcctgcatag

SEQ ID NO: 42975 - DNA, 25 bp, Mus musculus
aagaaattctgaatcttcgggacag

SEQ ID NO: 42976 - DNA, 25 bp, Mus musculus
aagaaattctgattcttcgggacag

SEQ ID NO: 42977 - DNA, 25 bp, Mus musculus
aagaaattgcatactaattccggag

SEQ ID NO: 42978 - DNA, 25 bp, Mus musculus
aagaaattgcatcctgattttttcc

SEQ ID NO: 42979 - DNA, 25 bp, Mus musculus
aagaaattgcatgctgattttttcc

SEQ ID NO: 42980 - DNA, 25 bp, Mus musculus
aagaaattgcattctaattccggag

SEQ ID NO: 42981 - DNA, 25 bp, Mus musculus
aagaaattggcacaactccaccact

SEQ ID NO: 42982 - DNA, 25 bp, Mus musculus
aagaaattggcagaactccaccact

SEQ ID NO: 42983 - DNA, 25 bp, Mus musculus
aagaaattggtcagccaagcccctc

SEQ ID NO: 42984 - DNA, 25 bp, Mus musculus
aagaaattggtctgccaagcccctc

SEQ ID NO: 42985 - DNA, 25 bp, Mus musculus
aagaaatttccactcaggtctgttt

SEQ ID NO: 42986 - DNA, 25 bp, Mus musculus
aagaaatttccagtcaggtctgttt

SEQ ID NO: 42987 - DNA, 25 bp, Mus musculus
aagaaatttcctctagggctggaga

SEQ ID NO: 42988 - DNA, 25 bp, Mus musculus
aagaaatttcctgtagggctggaga

SEQ ID NO: 42989 - DNA, 25 bp, Mus musculus
aagaaatttgagacttttagccatt

SEQ ID NO: 42990 - DNA, 25 bp, Mus musculus
aagaaatttgagtcttttagccatt

SEQ ID NO: 42991 - DNA, 25 bp, Mus musculus
aagaacaaaattcggtgcctgctca

SEQ ID NO: 42992 - DNA, 25 bp, Mus musculus
aagaacaaaattgggtgcctgctca

SEQ ID NO: 42993 - DNA, 25 bp, Mus musculus
aagaacaaacaaacggccacagcat

SEQ ID NO: 42994 - DNA, 25 bp, Mus musculus
aagaacaaacaatcggccacagcat

SEQ ID NO: 42995 - DNA, 25 bp, Mus musculus
aagaacaaaccactgtctctgcttc

SEQ ID NO: 42996 - DNA, 25 bp, Mus musculus
aagaacaaaccagtgtctctgcttc

SEQ ID NO: 42997 - DNA, 25 bp, Mus musculus
aagaacaaagccatctcatctgcac

SEQ ID NO: 42998 - DNA, 25 bp, Mus musculus
aagaacaaagccttctcatctgcac

SEQ ID NO: 42999 - DNA, 25 bp, Mus musculus
aagaacaaattgatgccccaccagc

SEQ ID NO: 43000 - DNA, 25 bp, Mus musculus
aagaacaaattgttgccccaccagc

SEQ ID NO: 43001 - DNA, 25 bp, Mus musculus
aagaacaactctacttccatctcat

SEQ ID NO: 43002 - DNA, 25 bp, Mus musculus
aagaacaactcttcttccatctcat

SEQ ID NO: 43003 - DNA, 25 bp, Mus musculus
aagaacaagtccatggtatccccat

SEQ ID NO: 43004 - DNA, 25 bp, Mus musculus
aagaacaagtccttggtatccccat

SEQ ID NO: 43005 - DNA, 25 bp, Mus musculus
aagaacaataagatccctgaatgga

SEQ ID NO: 43006 - DNA, 25 bp, Mus musculus
aagaacaataagttccctgaatgga

SEQ ID NO: 43007 - DNA, 25 bp, Mus musculus
aagaacaatctacgagctggtggct

SEQ ID NO: 43008 - DNA, 25 bp, Mus musculus
aagaacaatctaggagctggtggct

SEQ ID NO: 43009 - DNA, 25 bp, Mus musculus
aagaacacaaaccataccagaccat

SEQ ID NO: 43010 - DNA, 25 bp, Mus musculus
aagaacacaaacgataccagaccat

SEQ ID NO: 43011 - DNA, 25 bp, Mus musculus
aagaacacactgactctggagagtt

SEQ ID NO: 43012 - DNA, 25 bp, Mus musculus
aagaacacactgagatccctttgcc

SEQ ID NO: 43013 - DNA, 25 bp, Mus musculus
aagaacacactgtctctggagagtt

SEQ ID NO: 43014 - DNA, 25 bp, Mus musculus
aagaacacactgtgatccctttgcc

SEQ ID NO: 43015 - DNA, 25 bp, Mus musculus
aagaacacagctatctcacccacag

SEQ ID NO: 43016 - DNA, 25 bp, Mus musculus
aagaacacagctttctcacccacag

SEQ ID NO: 43017 - DNA, 25 bp, Mus musculus
aagaacacaggtccttatgctgcgg

SEQ ID NO: 43018 - DNA, 25 bp, Mus musculus
aagaacacaggtgcttatgctgcgg

SEQ ID NO: 43019 - DNA, 25 bp, Mus musculus
aagaacaccatcagaaatgccgtct

SEQ ID NO: 43020 - DNA, 25 bp, Mus musculus
aagaacaccatctgaaatgccgtct

SEQ ID NO: 43021 - DNA, 25 bp, Mus musculus
aagaacaccccaatctggattctag

SEQ ID NO: 43022 - DNA, 25 bp, Mus musculus
aagaacaccccattctggattctag

SEQ ID NO: 43023 - DNA, 25 bp, Mus musculus
aagaacaccctgcaaatgtacacag

SEQ ID NO: 43024 - DNA, 25 bp, Mus musculus
aagaacaccctggaaatgtacacag

SEQ ID NO: 43025 - DNA, 25 bp, Mus musculus
aagaacacctcaatgccgactgaag

SEQ ID NO: 43026 - DNA, 25 bp, Mus musculus
aagaacacctcattgccgactgaag

SEQ ID NO: 43027 - DNA, 25 bp, Mus musculus
aagaacacctttacagctgtggata

SEQ ID NO: 43028 - DNA, 25 bp, Mus musculus
aagaacaccttttcagctgtggata

SEQ ID NO: 43029 - DNA, 25 bp, Mus musculus
aagaacacggctctctggatcggaa

SEQ ID NO: 43030 - DNA, 25 bp, Mus musculus
aagaacacggctgtctggatcggaa

SEQ ID NO: 43031 - DNA, 25 bp, Mus musculus
aagaacactactatgactgcctgtc

SEQ ID NO: 43032 - DNA, 25 bp, Mus musculus
aagaacactactttgactgcctgtc

SEQ ID NO: 43033 - DNA, 25 bp, Mus musculus
aagaacactggcagcgccaggcggt

SEQ ID NO: 43034 - DNA, 25 bp, Mus musculus
aagaacactggcctgtgtgagtcct

SEQ ID NO: 43035 - DNA, 25 bp, Mus musculus
aagaacactggcgtgtgtgagtcct

SEQ ID NO: 43036 - DNA, 25 bp, Mus musculus
aagaacactggctgcgccaggcggt

SEQ ID NO: 43037 - DNA, 25 bp, Mus musculus
aagaacacttacagcaggttgcaga

SEQ ID NO: 43038 - DNA, 25 bp, Mus musculus
aagaacacttaccttccaatctggg

SEQ ID NO: 43039 - DNA, 25 bp, Mus musculus
aagaacacttacgttccaatctggg

SEQ ID NO: 43040 - DNA, 25 bp, Mus musculus
aagaacacttactgcaggttgcaga

SEQ ID NO: 43041 - DNA, 25 bp, Mus musculus
aagaacactttgaggcttcatcaga

SEQ ID NO: 43042 - DNA, 25 bp, Mus musculus
aagaacactttgtggcttcatcaga

SEQ ID NO: 43043 - DNA, 25 bp, Mus musculus
aagaacagaactacatccagccagc

SEQ ID NO: 43044 - DNA, 25 bp, Mus musculus
aagaacagaacttcatccagccagc

SEQ ID NO: 43045 - DNA, 25 bp, Mus musculus
aagaacagactgagctgcacgccac

SEQ ID NO: 43046 - DNA, 25 bp, Mus musculus
aagaacagactgtgctgcacgccac

SEQ ID NO: 43047 - DNA, 25 bp, Mus musculus
aagaacagagaaccaaggtttccac

SEQ ID NO: 43048 - DNA, 25 bp, Mus musculus
aagaacagagaagcaaggtttccac

SEQ ID NO: 43049 - DNA, 25 bp, Mus musculus
aagaacagattcacccggcgataaa

SEQ ID NO: 43050 - DNA, 25 bp, Mus musculus
aagaacagattctcccggcgataaa

SEQ ID NO: 43051 - DNA, 25 bp, Mus musculus
aagaacagccatcgtgaaagatggg

SEQ ID NO: 43052 - DNA, 25 bp, Mus musculus
aagaacagccatggtgaaagatggg

SEQ ID NO: 43053 - DNA, 25 bp, Mus musculus
aagaacagccccaactttgaggcgg

SEQ ID NO: 43054 - DNA, 25 bp, Mus musculus
aagaacagcccctactttgaggcgg

SEQ ID NO: 43055 - DNA, 25 bp, Mus musculus
aagaacagccttcaacagctcagga

SEQ ID NO: 43056 - DNA, 25 bp, Mus musculus
aagaacagccttgaacagctcagga

SEQ ID NO: 43057 - DNA, 25 bp, Mus musculus
aagaacaggaagcatcggcgccagc

SEQ ID NO: 43058 - DNA, 25 bp, Mus musculus
aagaacaggaaggatcggcgccagc

SEQ ID NO: 43059 - DNA, 25 bp, Mus musculus
aagaacaggactcgccccatgggtc

SEQ ID NO: 43060 - DNA, 25 bp, Mus musculus
aagaacaggactggccccatgggtc

SEQ ID NO: 43061 - DNA, 25 bp, Mus musculus
aagaacaggcccctcagcctacaga

SEQ ID NO: 43062 - DNA, 25 bp, Mus musculus
aagaacaggcccgtcagcctacaga

SEQ ID NO: 43063 - DNA, 25 bp, Mus musculus
aagaacaggcctcggatcctcacag

SEQ ID NO: 43064 - DNA, 25 bp, Mus musculus
aagaacaggcctgggatcctcacag

SEQ ID NO: 43065 - DNA, 25 bp, Mus musculus
aagaacaggctgcactcagttttca

SEQ ID NO: 43066 - DNA, 25 bp, Mus musculus
aagaacaggctggactcagttttca

SEQ ID NO: 43067 - DNA, 25 bp, Mus musculus
aagaacagtccaccacttcaaggga

SEQ ID NO: 43068 - DNA, 25 bp, Mus musculus
aagaacagtccagcacttcaaggga

SEQ ID NO: 43069 - DNA, 25 bp, Mus musculus
aagaacagtggtccaatgtctgtct

SEQ ID NO: 43070 - DNA, 25 bp, Mus musculus
aagaacagtggtgcaatgtctgtct

SEQ ID NO: 43071 - DNA, 25 bp, Mus musculus
aagaacagttcacggcagcgcaaaa

SEQ ID NO: 43072 - DNA, 25 bp, Mus musculus
aagaacagttcagggcagcgcaaaa

SEQ ID NO: 43073 - DNA, 25 bp, Mus musculus
aagaacagtttgctttccggtcacg

SEQ ID NO: 43074 - DNA, 25 bp, Mus musculus
aagaacagtttggtttccggtcacg

SEQ ID NO: 43075 - DNA, 25 bp, Mus musculus
aagaacatcagcatccgcagggagt

SEQ ID NO: 43076 - DNA, 25 bp, Mus musculus
aagaacatcagcttccgcagggagt

SEQ ID NO: 43077 - DNA, 25 bp, Mus musculus
aagaacatccagacagcttgcctcc

SEQ ID NO: 43078 - DNA, 25 bp, Mus musculus
aagaacatccagtcagcttgcctcc

SEQ ID NO: 43079 - DNA, 25 bp, Mus musculus
aagaacatcccaacggtgaattcaa

SEQ ID NO: 43080 - DNA, 25 bp, Mus musculus
aagaacatcccatcggtgaattcaa

SEQ ID NO: 43081 - DNA, 25 bp, Mus musculus
aagaacatccctactctatcccaga

SEQ ID NO: 43082 - DNA, 25 bp, Mus musculus
aagaacatcccttctctatcccaga

SEQ ID NO: 43083 - DNA, 25 bp, Mus musculus
aagaacatcctgagctctcaaccac

SEQ ID NO: 43084 - DNA, 25 bp, Mus musculus
aagaacatcctgtgctctcaaccac

SEQ ID NO: 43085 - DNA, 25 bp, Mus musculus
aagaacatctgccagtttcttctgg

SEQ ID NO: 43086 - DNA, 25 bp, Mus musculus
aagaacatctgcgagtttcttctgg

SEQ ID NO: 43087 - DNA, 25 bp, Mus musculus
aagaacatctttcgcacacccgagt

SEQ ID NO: 43088 - DNA, 25 bp, Mus musculus
aagaacatctttggcacacccgagt

SEQ ID NO: 43089 - DNA, 25 bp, Mus musculus
aagaacatgcatacagggactcaat

SEQ ID NO: 43090 - DNA, 25 bp, Mus musculus
aagaacatgcattcagggactcaat

SEQ ID NO: 43091 - DNA, 25 bp, Mus musculus
aagaacatgctcctctggactatgt

SEQ ID NO: 43092 - DNA, 25 bp, Mus musculus
aagaacatgctcgtctggactatgt

SEQ ID NO: 43093 - DNA, 25 bp, Mus musculus
aagaacatggacatgcccttcatgc

SEQ ID NO: 43094 - DNA, 25 bp, Mus musculus
aagaacatggacttgcccttcatgc

SEQ ID NO: 43095 - DNA, 25 bp, Mus musculus
aagaacatggctaattttccctcag

SEQ ID NO: 43096 - DNA, 25 bp, Mus musculus
aagaacatggcttattttccctcag

SEQ ID NO: 43097 - DNA, 25 bp, Mus musculus
aagaacatgtaacggcttaaatact

SEQ ID NO: 43098 - DNA, 25 bp, Mus musculus
aagaacatgtaagggcttaaatact

SEQ ID NO: 43099 - DNA, 25 bp, Mus musculus
aagaacatgtatagtggctccctcc

SEQ ID NO: 43100 - DNA, 25 bp, Mus musculus
aagaacatgtattgtggctccctcc

SEQ ID NO: 43101 - DNA, 25 bp, Mus musculus
aagaacatgtcgcagcgcatcggag

SEQ ID NO: 43102 - DNA, 25 bp, Mus musculus
aagaacatgtcggagcgcatcggag

SEQ ID NO: 43103 - DNA, 25 bp, Mus musculus
aagaacatgtctctgcacctgtccc

SEQ ID NO: 43104 - DNA, 25 bp, Mus musculus
aagaacatgtctgtgcacctgtccc

SEQ ID NO: 43105 - DNA, 25 bp, Mus musculus
aagaacattagcaccttcaactcac

SEQ ID NO: 43106 - DNA, 25 bp, Mus musculus
aagaacattagctccttcaactcac

SEQ ID NO: 43107 - DNA, 25 bp, Mus musculus
aagaacattcacatcaaccccagat

SEQ ID NO: 43108 - DNA, 25 bp, Mus musculus
aagaacattcacttcaaccccagat

SEQ ID NO: 43109 - DNA, 25 bp, Mus musculus
aagaacattccaagggattcacaaa

SEQ ID NO: 43110 - DNA, 25 bp, Mus musculus
aagaacattccatgggattcacaaa

SEQ ID NO: 43111 - DNA, 25 bp, Mus musculus
aagaacattcttaggcagctgtgtg

SEQ ID NO: 43112 - DNA, 25 bp, Mus musculus
aagaacattctttggcagctgtgtg

SEQ ID NO: 43113 - DNA, 25 bp, Mus musculus
aagaacattgaaaggcttatgccaa

SEQ ID NO: 43114 - DNA, 25 bp, Mus musculus
aagaacattgaatggcttatgccaa

SEQ ID NO: 43115 - DNA, 25 bp, Mus musculus
aagaacattgagcatgtcatcgctc

SEQ ID NO: 43116 - DNA, 25 bp, Mus musculus
aagaacattgaggatgtcatcgctc

SEQ ID NO: 43117 - DNA, 25 bp, Mus musculus
aagaaccaacggcacaagtcgtcct

SEQ ID NO: 43118 - DNA, 25 bp, Mus musculus
aagaaccaacgggacaagtcgtcct

SEQ ID NO: 43119 - DNA, 25 bp, Mus musculus
aagaaccaacgtccttcgcgtcgtc

SEQ ID NO: 43120 - DNA, 25 bp, Mus musculus
aagaaccaacgtgcttcgcgtcgtc

SEQ ID NO: 43121 - DNA, 25 bp, Mus musculus
aagaaccaacttctacacttgtcct

SEQ ID NO: 43122 - DNA, 25 bp, Mus musculus
aagaaccaacttgtacacttgtcct

SEQ ID NO: 43123 - DNA, 25 bp, Mus musculus
aagaaccaagaacgcatagatactg

SEQ ID NO: 43124 - DNA, 25 bp, Mus musculus
aagaaccaagaaggcatagatactg

SEQ ID NO: 43125 - DNA, 25 bp, Mus musculus
aagaaccacattccaccatttcagc

SEQ ID NO: 43126 - DNA, 25 bp, Mus musculus
aagaaccacattgcaccatttcagc

SEQ ID NO: 43127 - DNA, 25 bp, Mus musculus
aagaaccaccagacggttgccgaat

SEQ ID NO: 43128 - DNA, 25 bp, Mus musculus
aagaaccaccagtcggttgccgaat

SEQ ID NO: 43129 - DNA, 25 bp, Mus musculus
aagaaccaccctaatgatccagcat

SEQ ID NO: 43130 - DNA, 25 bp, Mus musculus
aagaaccacccttatgatccagcat

SEQ ID NO: 43131 - DNA, 25 bp, Mus musculus
aagaaccaccgaaggaaatgaaaag

SEQ ID NO: 43132 - DNA, 25 bp, Mus musculus
aagaaccaccgatggaaatgaaaag

SEQ ID NO: 43133 - DNA, 25 bp, Mus musculus
aagaaccacgtcagcgatgcaaaga

SEQ ID NO: 43134 - DNA, 25 bp, Mus musculus
aagaaccacgtctgcgatgcaaaga

SEQ ID NO: 43135 - DNA, 25 bp, Mus musculus
aagaaccagctgattggccctgtat

SEQ ID NO: 43136 - DNA, 25 bp, Mus musculus
aagaaccagctgtttggccctgtat

SEQ ID NO: 43137 - DNA, 25 bp, Mus musculus
aagaaccaggagaagattctgcgtg

SEQ ID NO: 43138 - DNA, 25 bp, Mus musculus
aagaaccaggagtagattctgcgtg

SEQ ID NO: 43139 - DNA, 25 bp, Mus musculus
aagaaccaggtgctcttctcttggc

SEQ ID NO: 43140 - DNA, 25 bp, Mus musculus
aagaaccaggtggtcttctcttggc

SEQ ID NO: 43141 - DNA, 25 bp, Mus musculus
aagaaccatatcagaccaagtcgat

SEQ ID NO: 43142 - DNA, 25 bp, Mus musculus
aagaaccatatctgaccaagtcgat

SEQ ID NO: 43143 - DNA, 25 bp, Mus musculus
aagaaccatattctggagaccttca

SEQ ID NO: 43144 - DNA, 25 bp, Mus musculus
aagaaccatattgtggagaccttca

SEQ ID NO: 43145 - DNA, 25 bp, Mus musculus
aagaaccatcatacactgtgccatg

SEQ ID NO: 43146 - DNA, 25 bp, Mus musculus
aagaaccatcattcactgtgccatg

SEQ ID NO: 43147 - DNA, 25 bp, Mus musculus
aagaaccatcttccccgggctaata

SEQ ID NO: 43148 - DNA, 25 bp, Mus musculus
aagaaccatcttgcccgggctaata

SEQ ID NO: 43149 - DNA, 25 bp, Mus musculus
aagaaccatgagacagccgaggagt

SEQ ID NO: 43150 - DNA, 25 bp, Mus musculus
aagaaccatgagtcagccgaggagt

SEQ ID NO: 43151 - DNA, 25 bp, Mus musculus
aagaaccatgccatggtcagcactg

SEQ ID NO: 43152 - DNA, 25 bp, Mus musculus
aagaaccatgccttggtcagcactg

SEQ ID NO: 43153 - DNA, 25 bp, Mus musculus
aagaacccaatgacctattaataag

SEQ ID NO: 43154 - DNA, 25 bp, Mus musculus
aagaacccaatgtcctattaataag

SEQ ID NO: 43155 - DNA, 25 bp, Mus musculus
aagaacccatcacactgatcagaag

SEQ ID NO: 43156 - DNA, 25 bp, Mus musculus
aagaacccatcagactgatcagaag

SEQ ID NO: 43157 - DNA, 25 bp, Mus musculus
aagaaccccaccaccagagaagttg

SEQ ID NO: 43158 - DNA, 25 bp, Mus musculus
aagaaccccacctccagagaagttg

SEQ ID NO: 43159 - DNA, 25 bp, Mus musculus
aagaacccccagatatgtgctggct

SEQ ID NO: 43160 - DNA, 25 bp, Mus musculus
aagaacccccagttatgtgctggct

SEQ ID NO: 43161 - DNA, 25 bp, Mus musculus
aagaacccctgactctggtaatgtc

SEQ ID NO: 43162 - DNA, 25 bp, Mus musculus
aagaacccctgagtctggtaatgtc

SEQ ID NO: 43163 - DNA, 25 bp, Mus musculus
aagaaccctcagacattgtgcttcc

SEQ ID NO: 43164 - DNA, 25 bp, Mus musculus
aagaaccctcagtcattgtgcttcc

SEQ ID NO: 43165 - DNA, 25 bp, Mus musculus
aagaaccctgcccaatgggctaaga

SEQ ID NO: 43166 - DNA, 25 bp, Mus musculus
aagaaccctgccgaatgggctaaga

SEQ ID NO: 43167 - DNA, 25 bp, Mus musculus
aagaaccgaccaccgaggcaggtgt

SEQ ID NO: 43168 - DNA, 25 bp, Mus musculus
aagaaccgaccagcgaggcaggtgt

SEQ ID NO: 43169 - DNA, 25 bp, Mus musculus
aagaaccgagccatcacattgggtg

SEQ ID NO: 43170 - DNA, 25 bp, Mus musculus
aagaaccgagccttcacattgggtg

SEQ ID NO: 43171 - DNA, 25 bp, Mus musculus
aagaaccgatttcctagttgaccag

SEQ ID NO: 43172 - DNA, 25 bp, Mus musculus
aagaaccgatttgctagttgaccag

SEQ ID NO: 43173 - DNA, 25 bp, Mus musculus
aagaacctaactatgcaaccattgg

SEQ ID NO: 43174 - DNA, 25 bp, Mus musculus
aagaacctaactttgcaaccattgg

SEQ ID NO: 43175 - DNA, 25 bp, Mus musculus
aagaacctacatactcagcctgtgt

SEQ ID NO: 43176 - DNA, 25 bp, Mus musculus
aagaacctacattctcagcctgtgt

SEQ ID NO: 43177 - DNA, 25 bp, Mus musculus
aagaacctactgatgggagcacaaa

SEQ ID NO: 43178 - DNA, 25 bp, Mus musculus
aagaacctactgttgggagcacaaa

SEQ ID NO: 43179 - DNA, 25 bp, Mus musculus
aagaacctatgcaagcagacccaag

SEQ ID NO: 43180 - DNA, 25 bp, Mus musculus
aagaacctatgctagcagacccaag

SEQ ID NO: 43181 - DNA, 25 bp, Mus musculus
aagaacctcactaccatgatttggg

SEQ ID NO: 43182 - DNA, 25 bp, Mus musculus
aagaacctcacttccatgatttggg

SEQ ID NO: 43183 - DNA, 25 bp, Mus musculus
aagaacctcagccatctgatcgacc

SEQ ID NO: 43184 - DNA, 25 bp, Mus musculus
aagaacctcagcgatctgatcgacc

SEQ ID NO: 43185 - DNA, 25 bp, Mus musculus
aagaacctcctgatgcagtataaca

SEQ ID NO: 43186 - DNA, 25 bp, Mus musculus
aagaacctcctgttgcagtataaca

SEQ ID NO: 43187 - DNA, 25 bp, Mus musculus
aagaacctgagcacttagctgctgc

SEQ ID NO: 43188 - DNA, 25 bp, Mus musculus
aagaacctgagctcttagctgctgc

SEQ ID NO: 43189 - DNA, 25 bp, Mus musculus
aagaacctgatgctgcagcgcctgt

SEQ ID NO: 43190 - DNA, 25 bp, Mus musculus
aagaacctgatggtgcagcgcctgt

SEQ ID NO: 43191 - DNA, 25 bp, Mus musculus
aagaacctgcctcccaatgtcagct

SEQ ID NO: 43192 - DNA, 25 bp, Mus musculus
aagaacctgcctgccaatgtcagct

SEQ ID NO: 43193 - DNA, 25 bp, Mus musculus
aagaacctgtagaacctagtctgtt

SEQ ID NO: 43194 - DNA, 25 bp, Mus musculus
aagaacctgtagtacctagtctgtt

SEQ ID NO: 43195 - DNA, 25 bp, Mus musculus
aagaacctgtgacaagctgcttcca

SEQ ID NO: 43196 - DNA, 25 bp, Mus musculus
aagaacctgtgagaagctgcttcca

SEQ ID NO: 43197 - DNA, 25 bp, Mus musculus
aagaaccttgctacggattggagat

SEQ ID NO: 43198 - DNA, 25 bp, Mus musculus
aagaaccttgcttcggattggagat

SEQ ID NO: 43199 - DNA, 25 bp, Mus musculus
aagaaccttggaagtggaagctcct

SEQ ID NO: 43200 - DNA, 25 bp, Mus musculus
aagaaccttggatgtggaagctcct

SEQ ID NO: 43201 - DNA, 25 bp, Mus musculus
aagaaccttgttatcccagagtgat

SEQ ID NO: 43202 - DNA, 25 bp, Mus musculus
aagaaccttgttttcccagagtgat

SEQ ID NO: 43203 - DNA, 25 bp, Mus musculus
aagaacctttaactgcttccatgtt

SEQ ID NO: 43204 - DNA, 25 bp, Mus musculus
aagaacctttaagtgcttccatgtt

SEQ ID NO: 43205 - DNA, 25 bp, Mus musculus
aagaacctttcccttcatgaatgta

SEQ ID NO: 43206 - DNA, 25 bp, Mus musculus
aagaacctttccgttcatgaatgta

SEQ ID NO: 43207 - DNA, 25 bp, Mus musculus
aagaacctttttcggactggcagtg

SEQ ID NO: 43208 - DNA, 25 bp, Mus musculus
aagaacctttttgggactggcagtg

SEQ ID NO: 43209 - DNA, 25 bp, Mus musculus
aagaacgaaagcatccctaccatta

SEQ ID NO: 43210 - DNA, 25 bp, Mus musculus
aagaacgaaagcttccctaccatta

SEQ ID NO: 43211 - DNA, 25 bp, Mus musculus
aagaacgagacgcttcgcttggcaa

SEQ ID NO: 43212 - DNA, 25 bp, Mus musculus
aagaacgagacggttcgcttggcaa

SEQ ID NO: 43213 - DNA, 25 bp, Mus musculus
aagaacgagagtagcctggctacta

SEQ ID NO: 43214 - DNA, 25 bp, Mus musculus
aagaacgagagttgcctggctacta

SEQ ID NO: 43215 - DNA, 25 bp, Mus musculus
aagaacgcattgagctgaccctgac

SEQ ID NO: 43216 - DNA, 25 bp, Mus musculus
aagaacgcattgtgctgaccctgac

SEQ ID NO: 43217 - DNA, 25 bp, Mus musculus
aagaacgccagcagctactttgaca

SEQ ID NO: 43218 - DNA, 25 bp, Mus musculus
aagaacgccagctgctactttgaca

SEQ ID NO: 43219 - DNA, 25 bp, Mus musculus
aagaacgcgaaacgccatttataag

SEQ ID NO: 43220 - DNA, 25 bp, Mus musculus
aagaacgcgaaaggccatttataag

SEQ ID NO: 43221 - DNA, 25 bp, Mus musculus
aagaacgcgggcctgcatgttgcct

SEQ ID NO: 43222 - DNA, 25 bp, Mus musculus
aagaacgcgggcgtgcatgttgcct

SEQ ID NO: 43223 - DNA, 25 bp, Mus musculus
aagaacgctttgaacggcatccgct

SEQ ID NO: 43224 - DNA, 25 bp, Mus musculus
aagaacgctttgtacggcatccgct

SEQ ID NO: 43225 - DNA, 25 bp, Mus musculus
aagaacggaagcacctgttgtctct

SEQ ID NO: 43226 - DNA, 25 bp, Mus musculus
aagaacggaagctcctgttgtctct

SEQ ID NO: 43227 - DNA, 25 bp, Mus musculus
aagaacggaatgcaccccgcaaaga

SEQ ID NO: 43228 - DNA, 25 bp, Mus musculus
aagaacggaatggaccccgcaaaga

SEQ ID NO: 43229 - DNA, 25 bp, Mus musculus
aagaacggcaggaatgtgacatcca

SEQ ID NO: 43230 - DNA, 25 bp, Mus musculus
aagaacggcaggtatgtgacatcca

SEQ ID NO: 43231 - DNA, 25 bp, Mus musculus
aagaacggtgtactcccttctgagc

SEQ ID NO: 43232 - DNA, 25 bp, Mus musculus
aagaacggtgtagtcccttctgagc

SEQ ID NO: 43233 - DNA, 25 bp, Mus musculus
aagaacgtgaggacagcttccgcca

SEQ ID NO: 43234 - DNA, 25 bp, Mus musculus
aagaacgtgaggtcagcttccgcca

SEQ ID NO: 43235 - DNA, 25 bp, Mus musculus
aagaacgtgcttagggcggtctcga

SEQ ID NO: 43236 - DNA, 25 bp, Mus musculus
aagaacgtgctttgggcggtctcga

SEQ ID NO: 43237 - DNA, 25 bp, Mus musculus
aagaacgtgggcatccagatgctgc

SEQ ID NO: 43238 - DNA, 25 bp, Mus musculus
aagaacgtgggcttccagatgctgc

SEQ ID NO: 43239 - DNA, 25 bp, Mus musculus
aagaactaaatgcaagcgggcgacc

SEQ ID NO: 43240 - DNA, 25 bp, Mus musculus
aagaactaaatggaagcgggcgacc

SEQ ID NO: 43241 - DNA, 25 bp, Mus musculus
aagaactaaggcatctctgcactgc

SEQ ID NO: 43242 - DNA, 25 bp, Mus musculus
aagaactaaggcttctctgcactgc

SEQ ID NO: 43243 - DNA, 25 bp, Mus musculus
aagaactaagttctgctctggagaa

SEQ ID NO: 43244 - DNA, 25 bp, Mus musculus
aagaactaagttgtgctctggagaa

SEQ ID NO: 43245 - DNA, 25 bp, Mus musculus
aagaactaatggagctacctccttc

SEQ ID NO: 43246 - DNA, 25 bp, Mus musculus
aagaactaatggtgctacctccttc

SEQ ID NO: 43247 - DNA, 25 bp, Mus musculus
aagaactaatgtccctccagtaccc

SEQ ID NO: 43248 - DNA, 25 bp, Mus musculus
aagaactaatgtgcctccagtaccc

SEQ ID NO: 43249 - DNA, 25 bp, Mus musculus
aagaactacatacgcctgctgccaa

SEQ ID NO: 43250 - DNA, 25 bp, Mus musculus
aagaactacataggcctgctgccaa

SEQ ID NO: 43251 - DNA, 25 bp, Mus musculus
aagaactaccttatatttgacattt

SEQ ID NO: 43252 - DNA, 25 bp, Mus musculus
aagaactaccttttatttgacattt

SEQ ID NO: 43253 - DNA, 25 bp, Mus musculus
aagaactactgacctgctgcaccag

SEQ ID NO: 43254 - DNA, 25 bp, Mus musculus
aagaactactgagctgctgcaccag

SEQ ID NO: 43255 - DNA, 25 bp, Mus musculus
aagaactactggctcttcactcggc

SEQ ID NO: 43256 - DNA, 25 bp, Mus musculus
aagaactactgggtcttcactcggc

SEQ ID NO: 43257 - DNA, 25 bp, Mus musculus
aagaactatgacatttcaccccgtc

SEQ ID NO: 43258 - DNA, 25 bp, Mus musculus
aagaactatgacttttcaccccgtc

SEQ ID NO: 43259 - DNA, 25 bp, Mus musculus
aagaactcaaagcatcacggtcttt

SEQ ID NO: 43260 - DNA, 25 bp, Mus musculus
aagaactcaaaggatcacggtcttt

SEQ ID NO: 43261 - DNA, 25 bp, Mus musculus
aagaactcagatctgctccagtctc

SEQ ID NO: 43262 - DNA, 25 bp, Mus musculus
aagaactcagatgtgctccagtctc

SEQ ID NO: 43263 - DNA, 25 bp, Mus musculus
aagaactcaggtctagtccccggct

SEQ ID NO: 43264 - DNA, 25 bp, Mus musculus
aagaactcaggtgtagtccccggct

SEQ ID NO: 43265 - DNA, 25 bp, Mus musculus
aagaactcatcactgtctcttcacc

SEQ ID NO: 43266 - DNA, 25 bp, Mus musculus
aagaactcatcagtgtctcttcacc

SEQ ID NO: 43267 - DNA, 25 bp, Mus musculus
aagaactccgaccagaagccaagaa

SEQ ID NO: 43268 - DNA, 25 bp, Mus musculus
aagaactccgacgagaagccaagaa

SEQ ID NO: 43269 - DNA, 25 bp, Mus musculus
aagaactccgtgcacgcgtgcgcgc

SEQ ID NO: 43270 - DNA, 25 bp, Mus musculus
aagaactccgtggacgcgtgcgcgc

SEQ ID NO: 43271 - DNA, 25 bp, Mus musculus
aagaactcgagcctactttcctgca

SEQ ID NO: 43272 - DNA, 25 bp, Mus musculus
aagaactcgagcgtactttcctgca

SEQ ID NO: 43273 - DNA, 25 bp, Mus musculus
aagaactcgaggcatgctgcccttg

SEQ ID NO: 43274 - DNA, 25 bp, Mus musculus
aagaactcgagggatgctgcccttg

SEQ ID NO: 43275 - DNA, 25 bp, Mus musculus
aagaactcgcagatgggtgaggcca

SEQ ID NO: 43276 - DNA, 25 bp, Mus musculus
aagaactcgcagttgggtgaggcca

SEQ ID NO: 43277 - DNA, 25 bp, Mus musculus
aagaactcggacctgactgtagtac

SEQ ID NO: 43278 - DNA, 25 bp, Mus musculus
aagaactcggacgtgactgtagtac

SEQ ID NO: 43279 - DNA, 25 bp, Mus musculus
aagaactcggatcataccctcagaa

SEQ ID NO: 43280 - DNA, 25 bp, Mus musculus
aagaactcggatgataccctcagaa

SEQ ID NO: 43281 - DNA, 25 bp, Mus musculus
aagaactcggtaactcaggcctggt

SEQ ID NO: 43282 - DNA, 25 bp, Mus musculus
aagaactcggtatctcaggcctggt

SEQ ID NO: 43283 - DNA, 25 bp, Mus musculus
aagaactcttcacacaaggaccagt

SEQ ID NO: 43284 - DNA, 25 bp, Mus musculus
aagaactcttcagacaaggaccagt

SEQ ID NO: 43285 - DNA, 25 bp, Mus musculus
aagaactgaagcaagggaccccgag

SEQ ID NO: 43286 - DNA, 25 bp, Mus musculus
aagaactgaagctagggaccccgag

SEQ ID NO: 43287 - DNA, 25 bp, Mus musculus
aagaactgaaggctatccaggatca

SEQ ID NO: 43288 - DNA, 25 bp, Mus musculus
aagaactgaagggtatccaggatca

SEQ ID NO: 43289 - DNA, 25 bp, Mus musculus
aagaactgacctacagtctcggcaa

SEQ ID NO: 43290 - DNA, 25 bp, Mus musculus
aagaactgaccttcagtctcggcaa

SEQ ID NO: 43291 - DNA, 25 bp, Mus musculus
aagaactgagagcttccctcgggag

SEQ ID NO: 43292 - DNA, 25 bp, Mus musculus
aagaactgagaggttccctcgggag

SEQ ID NO: 43293 - DNA, 25 bp, Mus musculus
aagaactgagcaccctggaggccga

SEQ ID NO: 43294 - DNA, 25 bp, Mus musculus
aagaactgagcagcctggaggccga

SEQ ID NO: 43295 - DNA, 25 bp, Mus musculus
aagaactgaggtccatggtccatcc

SEQ ID NO: 43296 - DNA, 25 bp, Mus musculus
aagaactgaggtgcatggtccatcc

SEQ ID NO: 43297 - DNA, 25 bp, Mus musculus
aagaactgcaagcaactgactgctg

SEQ ID NO: 43298 - DNA, 25 bp, Mus musculus
aagaactgcaaggaactgactgctg

SEQ ID NO: 43299 - DNA, 25 bp, Mus musculus
aagaactgcattatcggctgggcat

SEQ ID NO: 43300 - DNA, 25 bp, Mus musculus
aagaactgcattttcggctgggcat

SEQ ID NO: 43301 - DNA, 25 bp, Mus musculus
aagaactgccagcagtcgatgtgct

SEQ ID NO: 43302 - DNA, 25 bp, Mus musculus
aagaactgccaggagtcgatgtgct

SEQ ID NO: 43303 - DNA, 25 bp, Mus musculus
aagaactgcctaatgtttgacttaa

SEQ ID NO: 43304 - DNA, 25 bp, Mus musculus
aagaactgcctattgtttgacttaa

SEQ ID NO: 43305 - DNA, 25 bp, Mus musculus
aagaactgcctgctagacctgcttg

SEQ ID NO: 43306 - DNA, 25 bp, Mus musculus
aagaactgcctggtagacctgcttg

SEQ ID NO: 43307 - DNA, 25 bp, Mus musculus
aagaactgctaaaatgccgggcgtg

SEQ ID NO: 43308 - DNA, 25 bp, Mus musculus
aagaactgctaatatgccgggcgtg

SEQ ID NO: 43309 - DNA, 25 bp, Mus musculus
aagaactgctggactaagatcaaat

SEQ ID NO: 43310 - DNA, 25 bp, Mus musculus
aagaactgctggaggaaacactgga

SEQ ID NO: 43311 - DNA, 25 bp, Mus musculus
aagaactgctggcacctggatgctg

SEQ ID NO: 43312 - DNA, 25 bp, Mus musculus
aagaactgctgggacctggatgctg

SEQ ID NO: 43313 - DNA, 25 bp, Mus musculus
aagaactgctggtctaagatcaaat

SEQ ID NO: 43314 - DNA, 25 bp, Mus musculus
aagaactgctggtggaaacactgga

SEQ ID NO: 43315 - DNA, 25 bp, Mus musculus
aagaactgcttccacagatgtgtca

SEQ ID NO: 43316 - DNA, 25 bp, Mus musculus
aagaactgcttcgacagatgtgtca

SEQ ID NO: 43317 - DNA, 25 bp, Mus musculus
aagaactgcttgcttctgtgtaaaa

SEQ ID NO: 43318 - DNA, 25 bp, Mus musculus
aagaactgcttggttctgtgtaaaa

SEQ ID NO: 43319 - DNA, 25 bp, Mus musculus
aagaactgtataattgttcctcatt

SEQ ID NO: 43320 - DNA, 25 bp, Mus musculus
aagaactgtataccccagacctcag

SEQ ID NO: 43321 - DNA, 25 bp, Mus musculus
aagaactgtatagcccagacctcag

SEQ ID NO: 43322 - DNA, 25 bp, Mus musculus
aagaactgtatatttgttcctcatt

SEQ ID NO: 43323 - DNA, 25 bp, Mus musculus
aagaactgtcacatgtccttttaca

SEQ ID NO: 43324 - DNA, 25 bp, Mus musculus
aagaactgtcacttgtccttttaca

SEQ ID NO: 43325 - DNA, 25 bp, Mus musculus
aagaactgtcagcagctgcctgcac

SEQ ID NO: 43326 - DNA, 25 bp, Mus musculus
aagaactgtcaggagctgcctgcac

SEQ ID NO: 43327 - DNA, 25 bp, Mus musculus
aagaactgtccacgagggcctgaag

SEQ ID NO: 43328 - DNA, 25 bp, Mus musculus
aagaactgtccaggagggcctgaag

SEQ ID NO: 43329 - DNA, 25 bp, Mus musculus
aagaactgttcaatcctgcttgtac

SEQ ID NO: 43330 - DNA, 25 bp, Mus musculus
aagaactgttcattcctgcttgtac

SEQ ID NO: 43331 - DNA, 25 bp, Mus musculus
aagaacttagttccatattgaaatg

SEQ ID NO: 43332 - DNA, 25 bp, Mus musculus
aagaacttagttgcatattgaaatg

SEQ ID NO: 43333 - DNA, 25 bp, Mus musculus
aagaacttatctctagcaatggcca

SEQ ID NO: 43334 - DNA, 25 bp, Mus musculus
aagaacttatctgtagcaatggcca

SEQ ID NO: 43335 - DNA, 25 bp, Mus musculus
aagaacttattgatatccttcctgt

SEQ ID NO: 43336 - DNA, 25 bp, Mus musculus
aagaacttattgttatccttcctgt

SEQ ID NO: 43337 - DNA, 25 bp, Mus musculus
aagaacttatttaggctcctgcctg

SEQ ID NO: 43338 - DNA, 25 bp, Mus musculus
aagaacttattttggctcctgcctg

SEQ ID NO: 43339 - DNA, 25 bp, Mus musculus
aagaacttcaaaacccaaccgtcag

SEQ ID NO: 43340 - DNA, 25 bp, Mus musculus
aagaacttcaaatcccaaccgtcag

SEQ ID NO: 43341 - DNA, 25 bp, Mus musculus
aagaacttcaagcagatgcgtgcta

SEQ ID NO: 43342 - DNA, 25 bp, Mus musculus
aagaacttcaaggagatgcgtgcta

SEQ ID NO: 43343 - DNA, 25 bp, Mus musculus
aagaacttcctgcaaagctgactcc

SEQ ID NO: 43344 - DNA, 25 bp, Mus musculus
aagaacttcctggaaagctgactcc

SEQ ID NO: 43345 - DNA, 25 bp, Mus musculus
aagaacttcgcaaacctccatcttt

SEQ ID NO: 43346 - DNA, 25 bp, Mus musculus
aagaacttcgcatacctccatcttt

SEQ ID NO: 43347 - DNA, 25 bp, Mus musculus
aagaacttctacactttctctgctg

SEQ ID NO: 43348 - DNA, 25 bp, Mus musculus
aagaacttctactctttctctgctg

SEQ ID NO: 43349 - DNA, 25 bp, Mus musculus
aagaacttctccctgaggttcctgc

SEQ ID NO: 43350 - DNA, 25 bp, Mus musculus
aagaacttctccgtgaggttcctgc

SEQ ID NO: 43351 - DNA, 25 bp, Mus musculus
aagaacttgaccatggaacatggaa

SEQ ID NO: 43352 - DNA, 25 bp, Mus musculus
aagaacttgaccttggaacatggaa

SEQ ID NO: 43353 - DNA, 25 bp, Mus musculus
aagaacttgactcctgtaccctcgg

SEQ ID NO: 43354 - DNA, 25 bp, Mus musculus
aagaacttgactgctgtaccctcgg

SEQ ID NO: 43355 - DNA, 25 bp, Mus musculus
aagaacttgccaatccttgtcttgc

SEQ ID NO: 43356 - DNA, 25 bp, Mus musculus
aagaacttgccattccttgtcttgc

SEQ ID NO: 43357 - DNA, 25 bp, Mus musculus
aagaacttgcggcttccgcgtgaac

SEQ ID NO: 43358 - DNA, 25 bp, Mus musculus
aagaacttgcgggttccgcgtgaac

SEQ ID NO: 43359 - DNA, 25 bp, Mus musculus
aagaacttgctgaaatcattgtcca

SEQ ID NO: 43360 - DNA, 25 bp, Mus musculus
aagaacttgctgtaatcattgtcca

SEQ ID NO: 43361 - DNA, 25 bp, Mus musculus
aagaactttatcacttccaggcaaa

SEQ ID NO: 43362 - DNA, 25 bp, Mus musculus
aagaactttatctcttccaggcaaa

SEQ ID NO: 43363 - DNA, 25 bp, Mus musculus
aagaactttctgactagctcactgt

SEQ ID NO: 43364 - DNA, 25 bp, Mus musculus
aagaactttctgcatgggaatcaag

SEQ ID NO: 43365 - DNA, 25 bp, Mus musculus
aagaactttctggatgggaatcaag

SEQ ID NO: 43366 - DNA, 25 bp, Mus musculus
aagaactttctgtctagctcactgt

SEQ ID NO: 43367 - DNA, 25 bp, Mus musculus
aagaactttcttatatctctgaaat

SEQ ID NO: 43368 - DNA, 25 bp, Mus musculus
aagaactttcttttatctctgaaat

SEQ ID NO: 43369 - DNA, 25 bp, Mus musculus
aagaacttttgaccagaagaaatcg

SEQ ID NO: 43370 - DNA, 25 bp, Mus musculus
aagaacttttgagcagaagaaatcg

SEQ ID NO: 43371 - DNA, 25 bp, Mus musculus
aagaagaaagaccacacggcctcct

SEQ ID NO: 43372 - DNA, 25 bp, Mus musculus
aagaagaaagacgacacggcctcct

SEQ ID NO: 43373 - DNA, 25 bp, Mus musculus
aagaagaaagtgataccccaggcgt

SEQ ID NO: 43374 - DNA, 25 bp, Mus musculus
aagaagaaagtgttaccccaggcgt

SEQ ID NO: 43375 - DNA, 25 bp, Mus musculus
aagaagaaatccagtgccatgcaaa

SEQ ID NO: 43376 - DNA, 25 bp, Mus musculus
aagaagaaatcctgtgccatgcaaa

SEQ ID NO: 43377 - DNA, 25 bp, Mus musculus
aagaagaacactactccactgctgg

SEQ ID NO: 43378 - DNA, 25 bp, Mus musculus
aagaagaacacttctccactgctgg

SEQ ID NO: 43379 - DNA, 25 bp, Mus musculus
aagaagaacatcatttcccctcatc

SEQ ID NO: 43380 - DNA, 25 bp, Mus musculus
aagaagaacatcttttcccctcatc

SEQ ID NO: 43381 - DNA, 25 bp, Mus musculus
aagaagaacatgaagaatccagatt

SEQ ID NO: 43382 - DNA, 25 bp, Mus musculus
aagaagaacatgtagaatccagatt

SEQ ID NO: 43383 - DNA, 25 bp, Mus musculus
aagaagaacattaatcccttcaggg

SEQ ID NO: 43384 - DNA, 25 bp, Mus musculus
aagaagaacatttatcccttcaggg

SEQ ID NO: 43385 - DNA, 25 bp, Mus musculus
aagaagaacctgctgtgcgctcctg

SEQ ID NO: 43386 - DNA, 25 bp, Mus musculus
aagaagaacctggtgtgcgctcctg

SEQ ID NO: 43387 - DNA, 25 bp, Mus musculus
aagaagaactctaatgccgatgaaa

SEQ ID NO: 43388 - DNA, 25 bp, Mus musculus
aagaagaactcttatgccgatgaaa

SEQ ID NO: 43389 - DNA, 25 bp, Mus musculus
aagaagaactggatcctgggacaga

SEQ ID NO: 43390 - DNA, 25 bp, Mus musculus
aagaagaactggttcctgggacaga

SEQ ID NO: 43391 - DNA, 25 bp, Mus musculus
aagaagaacttaatgcggctgcagg

SEQ ID NO: 43392 - DNA, 25 bp, Mus musculus
aagaagaacttattgcggctgcagg

SEQ ID NO: 43393 - DNA, 25 bp, Mus musculus
aagaagaaggaccactctccactgc

SEQ ID NO: 43394 - DNA, 25 bp, Mus musculus
aagaagaaggacgactctccactgc

SEQ ID NO: 43395 - DNA, 25 bp, Mus musculus
aagaagaaggccagcctcacccatg

SEQ ID NO: 43396 - DNA, 25 bp, Mus musculus
aagaagaaggcctgcctcacccatg

SEQ ID NO: 43397 - DNA, 25 bp, Mus musculus
aagaagaaggtcagctacatgcagc

SEQ ID NO: 43398 - DNA, 25 bp, Mus musculus
aagaagaaggtctgctacatgcagc

SEQ ID NO: 43399 - DNA, 25 bp, Mus musculus
aagaagaagtgtctacatacctctt

SEQ ID NO: 43400 - DNA, 25 bp, Mus musculus
aagaagaagtgtgtacatacctctt

SEQ ID NO: 43401 - DNA, 25 bp, Mus musculus
aagaagaatcatcccctaggaaaag

SEQ ID NO: 43402 - DNA, 25 bp, Mus musculus
aagaagaatcatgccctaggaaaag

SEQ ID NO: 43403 - DNA, 25 bp, Mus musculus
aagaagaatgctagcccattgcctc

SEQ ID NO: 43404 - DNA, 25 bp, Mus musculus
aagaagaatgcttgcccattgcctc

SEQ ID NO: 43405 - DNA, 25 bp, Mus musculus
aagaagacaacacgacacgcagcgc

SEQ ID NO: 43406 - DNA, 25 bp, Mus musculus
aagaagacaacaggacacgcagcgc

SEQ ID NO: 43407 - DNA, 25 bp, Mus musculus
aagaagacagcccttcccaaaccag

SEQ ID NO: 43408 - DNA, 25 bp, Mus musculus
aagaagacagccgttcccaaaccag

SEQ ID NO: 43409 - DNA, 25 bp, Mus musculus
aagaagacagtcagcgttgcctcaa

SEQ ID NO: 43410 - DNA, 25 bp, Mus musculus
aagaagacagtctgcgttgcctcaa

SEQ ID NO: 43411 - DNA, 25 bp, Mus musculus
aagaagacagtgatccagcccgtgc

SEQ ID NO: 43412 - DNA, 25 bp, Mus musculus
aagaagacagtgttccagcccgtgc

SEQ ID NO: 43413 - DNA, 25 bp, Mus musculus
aagaagacatgacctcctattccta

SEQ ID NO: 43414 - DNA, 25 bp, Mus musculus
aagaagacatgagctcctattccta

SEQ ID NO: 43415 - DNA, 25 bp, Mus musculus
aagaagaccaccaacgtgttccgcg

SEQ ID NO: 43416 - DNA, 25 bp, Mus musculus
aagaagaccacccaggctcccttat

SEQ ID NO: 43417 - DNA, 25 bp, Mus musculus
aagaagaccaccgaggctcccttat

SEQ ID NO: 43418 - DNA, 25 bp, Mus musculus
aagaagaccacctacgtgttccgcg

SEQ ID NO: 43419 - DNA, 25 bp, Mus musculus
aagaagaccactacagcagactcat

SEQ ID NO: 43420 - DNA, 25 bp, Mus musculus
aagaagaccactcgagcagctcaag

SEQ ID NO: 43421 - DNA, 25 bp, Mus musculus
aagaagaccactggagcagctcaag

SEQ ID NO: 43422 - DNA, 25 bp, Mus musculus
aagaagaccacttcagcagactcat

SEQ ID NO: 43423 - DNA, 25 bp, Mus musculus
aagaagaccccactatacatcgact

SEQ ID NO: 43424 - DNA, 25 bp, Mus musculus
aagaagaccccagtatacatcgact

SEQ ID NO: 43425 - DNA, 25 bp, Mus musculus
aagaagacccggcagctggcctttg

SEQ ID NO: 43426 - DNA, 25 bp, Mus musculus
aagaagacccgggagctggcctttg

SEQ ID NO: 43427 - DNA, 25 bp, Mus musculus
aagaagaccgagaccgacgcagcgc

SEQ ID NO: 43428 - DNA, 25 bp, Mus musculus
aagaagaccgagtccgacgcagcgc

SEQ ID NO: 43429 - DNA, 25 bp, Mus musculus
aagaagacgcccctcgatcatgagc

SEQ ID NO: 43430 - DNA, 25 bp, Mus musculus
aagaagacgcccgtcgatcatgagc

SEQ ID NO: 43431 - DNA, 25 bp, Mus musculus
aagaagacgcctactttgaacaaga

SEQ ID NO: 43432 - DNA, 25 bp, Mus musculus
aagaagacgccttctttgaacaaga

SEQ ID NO: 43433 - DNA, 25 bp, Mus musculus
aagaagacgttccactgcgacatct

SEQ ID NO: 43434 - DNA, 25 bp, Mus musculus
aagaagacgttcgactgcgacatct

SEQ ID NO: 43435 - DNA, 25 bp, Mus musculus
aagaagactagacccatgcgccgcc

SEQ ID NO: 43436 - DNA, 25 bp, Mus musculus
aagaagactagagccatgcgccgcc

SEQ ID NO: 43437 - DNA, 25 bp, Mus musculus
aagaagactccaccacaccaggtag

SEQ ID NO: 43438 - DNA, 25 bp, Mus musculus
aagaagactccagcacaccaggtag

SEQ ID NO: 43439 - DNA, 25 bp, Mus musculus
aagaagactcgactgaagctgcctt

SEQ ID NO: 43440 - DNA, 25 bp, Mus musculus
aagaagactcgagtgaagctgcctt

SEQ ID NO: 43441 - DNA, 25 bp, Mus musculus
aagaagagaaatacccagcttgcct

SEQ ID NO: 43442 - DNA, 25 bp, Mus musculus
aagaagagaaattcccagcttgcct

SEQ ID NO: 43443 - DNA, 25 bp, Mus musculus
aagaagagaagacccggcaacccca

SEQ ID NO: 43444 - DNA, 25 bp, Mus musculus
aagaagagaagagccggcaacccca

SEQ ID NO: 43445 - DNA, 25 bp, Mus musculus
aagaagagacttcgctgacctgtca

SEQ ID NO: 43446 - DNA, 25 bp, Mus musculus
aagaagagacttggctgacctgtca

SEQ ID NO: 43447 - DNA, 25 bp, Mus musculus
aagaagagagctcccacgagaggca

SEQ ID NO: 43448 - DNA, 25 bp, Mus musculus
aagaagagagctgccacgagaggca

SEQ ID NO: 43449 - DNA, 25 bp, Mus musculus
aagaagagcaccacaagctcgccgg

SEQ ID NO: 43450 - DNA, 25 bp, Mus musculus
aagaagagcacctcaagctcgccgg

SEQ ID NO: 43451 - DNA, 25 bp, Mus musculus
aagaagagcactccgggttgctcca

SEQ ID NO: 43452 - DNA, 25 bp, Mus musculus
aagaagagcactgcgggttgctcca

SEQ ID NO: 43453 - DNA, 25 bp, Mus musculus
aagaagaggattagcctgtgtacct

SEQ ID NO: 43454 - DNA, 25 bp, Mus musculus
aagaagaggatttgcctgtgtacct

SEQ ID NO: 43455 - DNA, 25 bp, Mus musculus
aagaagaggctcatttgccctgctc

SEQ ID NO: 43456 - DNA, 25 bp, Mus musculus
aagaagaggctcttttgccctgctc

SEQ ID NO: 43457 - DNA, 25 bp, Mus musculus
aagaagagtcccaccttaactggct

SEQ ID NO: 43458 - DNA, 25 bp, Mus musculus
aagaagagtccccaggttagcatct

SEQ ID NO: 43459 - DNA, 25 bp, Mus musculus
aagaagagtcccgaggttagcatct

SEQ ID NO: 43460 - DNA, 25 bp, Mus musculus
aagaagagtccctccttaactggct

SEQ ID NO: 43461 - DNA, 25 bp, Mus musculus
aagaagagtctcatcccgggattct

SEQ ID NO: 43462 - DNA, 25 bp, Mus musculus
aagaagagtctcttcccgggattct

SEQ ID NO: 43463 - DNA, 25 bp, Mus musculus
aagaagagtcttccgcatgtgcatt

SEQ ID NO: 43464 - DNA, 25 bp, Mus musculus
aagaagagtcttgcgcatgtgcatt

SEQ ID NO: 43465 - DNA, 25 bp, Mus musculus
aagaagagtgacagcgcgtcgctga

SEQ ID NO: 43466 - DNA, 25 bp, Mus musculus
aagaagagtgactgcgcgtcgctga

SEQ ID NO: 43467 - DNA, 25 bp, Mus musculus
aagaagagtgagatgggacaccttg

SEQ ID NO: 43468 - DNA, 25 bp, Mus musculus
aagaagagtgagttgggacaccttg

SEQ ID NO: 43469 - DNA, 25 bp, Mus musculus
aagaagagtgctcagttccctctgt

SEQ ID NO: 43470 - DNA, 25 bp, Mus musculus
aagaagagtgctgagttccctctgt

SEQ ID NO: 43471 - DNA, 25 bp, Mus musculus
aagaagagtgttcttttctgtcagc

SEQ ID NO: 43472 - DNA, 25 bp, Mus musculus
aagaagagtgttgttttctgtcagc

SEQ ID NO: 43473 - DNA, 25 bp, Mus musculus
aagaagataaaacctgggcctggag

SEQ ID NO: 43474 - DNA, 25 bp, Mus musculus
aagaagataaaagctgggcctggag

SEQ ID NO: 43475 - DNA, 25 bp, Mus musculus
aagaagatacaacagttcccagtta

SEQ ID NO: 43476 - DNA, 25 bp, Mus musculus
aagaagatacaagagttcccagtta

SEQ ID NO: 43477 - DNA, 25 bp, Mus musculus
aagaagatatgaactctttaggaga

SEQ ID NO: 43478 - DNA, 25 bp, Mus musculus
aagaagatatgatctctttaggaga

SEQ ID NO: 43479 - DNA, 25 bp, Mus musculus
aagaagatcaaacagcattgccgct

SEQ ID NO: 43480 - DNA, 25 bp, Mus musculus
aagaagatcaaagagcattgccgct

SEQ ID NO: 43481 - DNA, 25 bp, Mus musculus
aagaagatcaagacagctacgggag

SEQ ID NO: 43482 - DNA, 25 bp, Mus musculus
aagaagatcaagtcagctacgggag

SEQ ID NO: 43483 - DNA, 25 bp, Mus musculus
aagaagatcacaccgttcgtgccca

SEQ ID NO: 43484 - DNA, 25 bp, Mus musculus
aagaagatcacagcgttcgtgccca

SEQ ID NO: 43485 - DNA, 25 bp, Mus musculus
aagaagatcaccagtctcttctcag

SEQ ID NO: 43486 - DNA, 25 bp, Mus musculus
aagaagatcacctgtctcttctcag

SEQ ID NO: 43487 - DNA, 25 bp, Mus musculus
aagaagatcatccagctggaaaagc

SEQ ID NO: 43488 - DNA, 25 bp, Mus musculus
aagaagatcatcgagctggaaaagc

SEQ ID NO: 43489 - DNA, 25 bp, Mus musculus
aagaagatccagaggcacctatacg

SEQ ID NO: 43490 - DNA, 25 bp, Mus musculus
aagaagatccagtggcacctatacg

SEQ ID NO: 43491 - DNA, 25 bp, Mus musculus
aagaagatccctcttaacacagaag

SEQ ID NO: 43492 - DNA, 25 bp, Mus musculus
aagaagatccctgttaacacagaag

SEQ ID NO: 43493 - DNA, 25 bp, Mus musculus
aagaagatccgaaggtttcagccag

SEQ ID NO: 43494 - DNA, 25 bp, Mus musculus
aagaagatccgatggtttcagccag

SEQ ID NO: 43495 - DNA, 25 bp, Mus musculus
aagaagatctcactggctcatgcct

SEQ ID NO: 43496 - DNA, 25 bp, Mus musculus
aagaagatctcagtggctcatgcct

SEQ ID NO: 43497 - DNA, 25 bp, Mus musculus
aagaagatctgcaccggctgtaccc

SEQ ID NO: 43498 - DNA, 25 bp, Mus musculus
aagaagatctgctccggctgtaccc

SEQ ID NO: 43499 - DNA, 25 bp, Mus musculus
aagaagatgcacagcgggcgccgcc

SEQ ID NO: 43500 - DNA, 25 bp, Mus musculus
aagaagatgcactgcgggcgccgcc

SEQ ID NO: 43501 - DNA, 25 bp, Mus musculus
aagaagatggctcccgcgcgattca

SEQ ID NO: 43502 - DNA, 25 bp, Mus musculus
aagaagatggctgccgcgcgattca

SEQ ID NO: 43503 - DNA, 25 bp, Mus musculus
aagaagatgggcagaggcctcccac

SEQ ID NO: 43504 - DNA, 25 bp, Mus musculus
aagaagatgggctgaggcctcccac

SEQ ID NO: 43505 - DNA, 25 bp, Mus musculus
aagaagatgtgcctgctctgtccac

SEQ ID NO: 43506 - DNA, 25 bp, Mus musculus
aagaagatgtgcgtgctctgtccac

SEQ ID NO: 43507 - DNA, 25 bp, Mus musculus
aagaagatgttccagtgtccctact

SEQ ID NO: 43508 - DNA, 25 bp, Mus musculus
aagaagatgttcgagtgtccctact

SEQ ID NO: 43509 - DNA, 25 bp, Mus musculus
aagaagattctactctaggcaagga

SEQ ID NO: 43510 - DNA, 25 bp, Mus musculus
aagaagattctagtctaggcaagga

SEQ ID NO: 43511 - DNA, 25 bp, Mus musculus
aagaagattgacaccatctcccgag

SEQ ID NO: 43512 - DNA, 25 bp, Mus musculus
aagaagattgactccatctcccgag

SEQ ID NO: 43513 - DNA, 25 bp, Mus musculus
aagaagattggtaaagactgaggct

SEQ ID NO: 43514 - DNA, 25 bp, Mus musculus
aagaagattggttaagactgaggct

SEQ ID NO: 43515 - DNA, 25 bp, Mus musculus
aagaagattgtcaggatggcctgct

SEQ ID NO: 43516 - DNA, 25 bp, Mus musculus
aagaagattgtctggatggcctgct

SEQ ID NO: 43517 - DNA, 25 bp, Mus musculus
aagaagcaaactccagaccagctgc

SEQ ID NO: 43518 - DNA, 25 bp, Mus musculus
aagaagcaaactgcagaccagctgc

SEQ ID NO: 43519 - DNA, 25 bp, Mus musculus
aagaagcaactaagcctcctttctc

SEQ ID NO: 43520 - DNA, 25 bp, Mus musculus
aagaagcaactatgcctcctttctc

SEQ ID NO: 43521 - DNA, 25 bp, Mus musculus
aagaagcaagccactgggaatgtct

SEQ ID NO: 43522 - DNA, 25 bp, Mus musculus
aagaagcaagccacttgcagcccct

SEQ ID NO: 43523 - DNA, 25 bp, Mus musculus
aagaagcaagcctctgggaatgtct

SEQ ID NO: 43524 - DNA, 25 bp, Mus musculus
aagaagcaagcctcttgcagcccct

SEQ ID NO: 43525 - DNA, 25 bp, Mus musculus
aagaagcaatatagccccatacccc

SEQ ID NO: 43526 - DNA, 25 bp, Mus musculus
aagaagcaatatcggcacgggccta

SEQ ID NO: 43527 - DNA, 25 bp, Mus musculus
aagaagcaatatgggcacgggccta

SEQ ID NO: 43528 - DNA, 25 bp, Mus musculus
aagaagcaatattgccccatacccc

SEQ ID NO: 43529 - DNA, 25 bp, Mus musculus
aagaagcacacgactgaggcacctc

SEQ ID NO: 43530 - DNA, 25 bp, Mus musculus
aagaagcacacgtctgaggcacctc

SEQ ID NO: 43531 - DNA, 25 bp, Mus musculus
aagaagcacagactctggagttccc

SEQ ID NO: 43532 - DNA, 25 bp, Mus musculus
aagaagcacagagtctggagttccc

SEQ ID NO: 43533 - DNA, 25 bp, Mus musculus
aagaagcacaggacagcatggcaga

SEQ ID NO: 43534 - DNA, 25 bp, Mus musculus
aagaagcacaggtcagcatggcaga

SEQ ID NO: 43535 - DNA, 25 bp, Mus musculus
aagaagcactgtctgcggcatacaa

SEQ ID NO: 43536 - DNA, 25 bp, Mus musculus
aagaagcactgtgtgcggcatacaa

SEQ ID NO: 43537 - DNA, 25 bp, Mus musculus
aagaagcacttcagccacaggaaag

SEQ ID NO: 43538 - DNA, 25 bp, Mus musculus
aagaagcacttctgccacaggaaag

SEQ ID NO: 43539 - DNA, 25 bp, Mus musculus
aagaagcagcagcacccctacttgc

SEQ ID NO: 43540 - DNA, 25 bp, Mus musculus
aagaagcagcaggacccctacttgc

SEQ ID NO: 43541 - DNA, 25 bp, Mus musculus
aagaagcagccgctcgacttgggtc

SEQ ID NO: 43542 - DNA, 25 bp, Mus musculus
aagaagcagccggtcgacttgggtc

SEQ ID NO: 43543 - DNA, 25 bp, Mus musculus
aagaagcagctgctacactcctgta

SEQ ID NO: 43544 - DNA, 25 bp, Mus musculus
aagaagcagctggtacactcctgta

SEQ ID NO: 43545 - DNA, 25 bp, Mus musculus
aagaagcagcttacgctgcacttgc

SEQ ID NO: 43546 - DNA, 25 bp, Mus musculus
aagaagcagctttcgctgcacttgc

SEQ ID NO: 43547 - DNA, 25 bp, Mus musculus
aagaagcagggcaggatcactgtcg

SEQ ID NO: 43548 - DNA, 25 bp, Mus musculus
aagaagcagggctggatcactgtcg

SEQ ID NO: 43549 - DNA, 25 bp, Mus musculus
aagaagcaggtccttgcagctgtct

SEQ ID NO: 43550 - DNA, 25 bp, Mus musculus
aagaagcaggtcgttgcagctgtct

SEQ ID NO: 43551 - DNA, 25 bp, Mus musculus
aagaagcaggttacctgactcgtga

SEQ ID NO: 43552 - DNA, 25 bp, Mus musculus
aagaagcaggtttcctgactcgtga

SEQ ID NO: 43553 - DNA, 25 bp, Mus musculus
aagaagcagtgacgaccttgttgga

SEQ ID NO: 43554 - DNA, 25 bp, Mus musculus
aagaagcagtgaggaccttgttgga

SEQ ID NO: 43555 - DNA, 25 bp, Mus musculus
aagaagcagtgtcatcgtggctgaa

SEQ ID NO: 43556 - DNA, 25 bp, Mus musculus
aagaagcagtgtgatcgtggctgaa

SEQ ID NO: 43557 - DNA, 25 bp, Mus musculus
aagaagcagtttctggagcgagccc

SEQ ID NO: 43558 - DNA, 25 bp, Mus musculus
aagaagcagtttgtggagcgagccc

SEQ ID NO: 43559 - DNA, 25 bp, Mus musculus
aagaagcatagaaccaggtcccgat

SEQ ID NO: 43560 - DNA, 25 bp, Mus musculus
aagaagcatagatccaggtcccgat

SEQ ID NO: 43561 - DNA, 25 bp, Mus musculus
aagaagcatcccagcttgattcctc

SEQ ID NO: 43562 - DNA, 25 bp, Mus musculus
aagaagcatccctgcttgattcctc

SEQ ID NO: 43563 - DNA, 25 bp, Mus musculus
aagaagcatgcaacttcctgcttta

SEQ ID NO: 43564 - DNA, 25 bp, Mus musculus
aagaagcatgcatcttcctgcttta

SEQ ID NO: 43565 - DNA, 25 bp, Mus musculus
aagaagcatggcattcttccgtggc

SEQ ID NO: 43566 - DNA, 25 bp, Mus musculus
aagaagcatggctttcttccgtggc

SEQ ID NO: 43567 - DNA, 25 bp, Mus musculus
aagaagcattagatggttttctctt

SEQ ID NO: 43568 - DNA, 25 bp, Mus musculus
aagaagcattagttggttttctctt

SEQ ID NO: 43569 - DNA, 25 bp, Mus musculus
aagaagcatttaacaagtgcctcgc

SEQ ID NO: 43570 - DNA, 25 bp, Mus musculus
aagaagcatttatcaagtgcctcgc

SEQ ID NO: 43571 - DNA, 25 bp, Mus musculus
aagaagcatttgaccagtctgaagc

SEQ ID NO: 43572 - DNA, 25 bp, Mus musculus
aagaagcatttgtccagtctgaagc

SEQ ID NO: 43573 - DNA, 25 bp, Mus musculus
aagaagccaagaagcgccgggcagt

SEQ ID NO: 43574 - DNA, 25 bp, Mus musculus
aagaagccaagatgcgccgggcagt

SEQ ID NO: 43575 - DNA, 25 bp, Mus musculus
aagaagccactgaaccgcttgttct

SEQ ID NO: 43576 - DNA, 25 bp, Mus musculus
aagaagccactgatgctattgggca

SEQ ID NO: 43577 - DNA, 25 bp, Mus musculus
aagaagccactgcaggatcccaagt

SEQ ID NO: 43578 - DNA, 25 bp, Mus musculus
aagaagccactggaggatcccaagt

SEQ ID NO: 43579 - DNA, 25 bp, Mus musculus
aagaagccactgtaccgcttgttct

SEQ ID NO: 43580 - DNA, 25 bp, Mus musculus
aagaagccactgttgctattgggca

SEQ ID NO: 43581 - DNA, 25 bp, Mus musculus
aagaagccaggacctgcatcctaca

SEQ ID NO: 43582 - DNA, 25 bp, Mus musculus
aagaagccaggagctgcatcctaca

SEQ ID NO: 43583 - DNA, 25 bp, Mus musculus
aagaagccagtcatgccacaactag

SEQ ID NO: 43584 - DNA, 25 bp, Mus musculus
aagaagccagtcttgccacaactag

SEQ ID NO: 43585 - DNA, 25 bp, Mus musculus
aagaagccatacacctccctggcat

SEQ ID NO: 43586 - DNA, 25 bp, Mus musculus
aagaagccatactcctccctggcat

SEQ ID NO: 43587 - DNA, 25 bp, Mus musculus
aagaagccctgacagcattttgtcc

SEQ ID NO: 43588 - DNA, 25 bp, Mus musculus
aagaagccctgagagcattttgtcc

SEQ ID NO: 43589 - DNA, 25 bp, Mus musculus
aagaagccctgccaagacaatcaca

SEQ ID NO: 43590 - DNA, 25 bp, Mus musculus
aagaagccctgcgaagacaatcaca

SEQ ID NO: 43591 - DNA, 25 bp, Mus musculus
aagaagccctgtcaccccttcggtg

SEQ ID NO: 43592 - DNA, 25 bp, Mus musculus
aagaagccctgtgaccccttcggtg

SEQ ID NO: 43593 - DNA, 25 bp, Mus musculus
aagaagcccttgaaggcatctccgg

SEQ ID NO: 43594 - DNA, 25 bp, Mus musculus
aagaagcccttgtaggcatctccgg

SEQ ID NO: 43595 - DNA, 25 bp, Mus musculus
aagaagccgcacagggacatgagag

SEQ ID NO: 43596 - DNA, 25 bp, Mus musculus
aagaagccgcactgggacatgagag

SEQ ID NO: 43597 - DNA, 25 bp, Mus musculus
aagaagccggctctgcgtactgctg

SEQ ID NO: 43598 - DNA, 25 bp, Mus musculus
aagaagccggctgtgcgtactgctg

SEQ ID NO: 43599 - DNA, 25 bp, Mus musculus
aagaagccgtacatacatggtccct

SEQ ID NO: 43600 - DNA, 25 bp, Mus musculus
aagaagccgtacttacatggtccct

SEQ ID NO: 43601 - DNA, 25 bp, Mus musculus
aagaagcctaacagtggatacgtca

SEQ ID NO: 43602 - DNA, 25 bp, Mus musculus
aagaagcctaactgtggatacgtca

SEQ ID NO: 43603 - DNA, 25 bp, Mus musculus
aagaagcctaagaagtccacctgga

SEQ ID NO: 43604 - DNA, 25 bp, Mus musculus
aagaagcctaagtagtccacctgga

SEQ ID NO: 43605 - DNA, 25 bp, Mus musculus
aagaagcctcagcactctctgggag

SEQ ID NO: 43606 - DNA, 25 bp, Mus musculus
aagaagcctcaggactctctgggag

SEQ ID NO: 43607 - DNA, 25 bp, Mus musculus
aagaagcctcatatgccactagtct

SEQ ID NO: 43608 - DNA, 25 bp, Mus musculus
aagaagcctcatttgccactagtct

SEQ ID NO: 43609 - DNA, 25 bp, Mus musculus
aagaagcctgccatagtgactaccc

SEQ ID NO: 43610 - DNA, 25 bp, Mus musculus
aagaagcctgccttagtgactaccc

SEQ ID NO: 43611 - DNA, 25 bp, Mus musculus
aagaagcctggtcagggaacaccaa

SEQ ID NO: 43612 - DNA, 25 bp, Mus musculus
aagaagcctggtgagggaacaccaa

SEQ ID NO: 43613 - DNA, 25 bp, Mus musculus
aagaagcctgtgctctgtacttgac

SEQ ID NO: 43614 - DNA, 25 bp, Mus musculus
aagaagcctgtggtctgtacttgac

SEQ ID NO: 43615 - DNA, 25 bp, Mus musculus
aagaagccttctcaggttgtggaaa

SEQ ID NO: 43616 - DNA, 25 bp, Mus musculus
aagaagccttctctaatctgcagac

SEQ ID NO: 43617 - DNA, 25 bp, Mus musculus
aagaagccttctgaggttgtggaaa

SEQ ID NO: 43618 - DNA, 25 bp, Mus musculus
aagaagccttctgtaatctgcagac

SEQ ID NO: 43619 - DNA, 25 bp, Mus musculus
aagaagcctttcaatagctgatgaa

SEQ ID NO: 43620 - DNA, 25 bp, Mus musculus
aagaagcctttcacgtgtgccactt

SEQ ID NO: 43621 - DNA, 25 bp, Mus musculus
aagaagcctttctatagctgatgaa

SEQ ID NO: 43622 - DNA, 25 bp, Mus musculus
aagaagcctttctcgtgtgccactt

SEQ ID NO: 43623 - DNA, 25 bp, Mus musculus
aagaagcctttgcagtttgagtgca

SEQ ID NO: 43624 - DNA, 25 bp, Mus musculus
aagaagcctttggagtttgagtgca

SEQ ID NO: 43625 - DNA, 25 bp, Mus musculus
aagaagcgagatatccctgactact

SEQ ID NO: 43626 - DNA, 25 bp, Mus musculus
aagaagcgagatttccctgactact

SEQ ID NO: 43627 - DNA, 25 bp, Mus musculus
aagaagcgcaccaacatcatcccgg

SEQ ID NO: 43628 - DNA, 25 bp, Mus musculus
aagaagcgcacctacatcatcccgg

SEQ ID NO: 43629 - DNA, 25 bp, Mus musculus
aagaagcgcccgatggacctcgaag

SEQ ID NO: 43630 - DNA, 25 bp, Mus musculus
aagaagcgcccgttggacctcgaag

SEQ ID NO: 43631 - DNA, 25 bp, Mus musculus
aagaagcgcctgatctcgatttgca

SEQ ID NO: 43632 - DNA, 25 bp, Mus musculus
aagaagcgcctgttctcgatttgca

SEQ ID NO: 43633 - DNA, 25 bp, Mus musculus
aagaagcgcgctatggatgctgcct

SEQ ID NO: 43634 - DNA, 25 bp, Mus musculus
aagaagcgcgctttggatgctgcct

SEQ ID NO: 43635 - DNA, 25 bp, Mus musculus
aagaagcgcttccagtccacggtga

SEQ ID NO: 43636 - DNA, 25 bp, Mus musculus
aagaagcgcttcgagtccacggtga

SEQ ID NO: 43637 - DNA, 25 bp, Mus musculus
aagaagcgggcaacacagtgactct

SEQ ID NO: 43638 - DNA, 25 bp, Mus musculus
aagaagcgggcacctgcgatgcaac

SEQ ID NO: 43639 - DNA, 25 bp, Mus musculus
aagaagcgggcagctgcgatgcaac

SEQ ID NO: 43640 - DNA, 25 bp, Mus musculus
aagaagcgggcatcacagtgactct

SEQ ID NO: 43641 - DNA, 25 bp, Mus musculus
aagaagctaaccaggcaccatgcga

SEQ ID NO: 43642 - DNA, 25 bp, Mus musculus
aagaagctaacctggcaccatgcga

SEQ ID NO: 43643 - DNA, 25 bp, Mus musculus
aagaagctaagccatgacacccacg

SEQ ID NO: 43644 - DNA, 25 bp, Mus musculus
aagaagctaagcgatgacacccacg

SEQ ID NO: 43645 - DNA, 25 bp, Mus musculus
aagaagctactgacgtgtctccttg

SEQ ID NO: 43646 - DNA, 25 bp, Mus musculus
aagaagctactgtcgtgtctccttg

SEQ ID NO: 43647 - DNA, 25 bp, Mus musculus
aagaagctagggatctgaggttacc

SEQ ID NO: 43648 - DNA, 25 bp, Mus musculus
aagaagctagggttctgaggttacc

SEQ ID NO: 43649 - DNA, 25 bp, Mus musculus
aagaagctcactctggtgctcatga

SEQ ID NO: 43650 - DNA, 25 bp, Mus musculus
aagaagctcactgtggtgctcatga

SEQ ID NO: 43651 - DNA, 25 bp, Mus musculus
aagaagctcaggctggttcagatta

SEQ ID NO: 43652 - DNA, 25 bp, Mus musculus
aagaagctcagggtggttcagatta

SEQ ID NO: 43653 - DNA, 25 bp, Mus musculus
aagaagctcatcagggctgctctaa

SEQ ID NO: 43654 - DNA, 25 bp, Mus musculus
aagaagctcatctgggctgctctaa

SEQ ID NO: 43655 - DNA, 25 bp, Mus musculus
aagaagctccagattggtccacaac

SEQ ID NO: 43656 - DNA, 25 bp, Mus musculus
aagaagctccagtttggtccacaac

SEQ ID NO: 43657 - DNA, 25 bp, Mus musculus
aagaagctcccaccattgattagga

SEQ ID NO: 43658 - DNA, 25 bp, Mus musculus
aagaagctcccagcattgattagga

SEQ ID NO: 43659 - DNA, 25 bp, Mus musculus
aagaagctccttcctcatattcagc

SEQ ID NO: 43660 - DNA, 25 bp, Mus musculus
aagaagctccttgctcatattcagc

SEQ ID NO: 43661 - DNA, 25 bp, Mus musculus
aagaagctctcgcaatcattggtga

SEQ ID NO: 43662 - DNA, 25 bp, Mus musculus
aagaagctctcggaatcattggtga

SEQ ID NO: 43663 - DNA, 25 bp, Mus musculus
aagaagctctgcactgagatgttga

SEQ ID NO: 43664 - DNA, 25 bp, Mus musculus
aagaagctctgctctgagatgttga

SEQ ID NO: 43665 - DNA, 25 bp, Mus musculus
aagaagctcttgacctttaccgcat

SEQ ID NO: 43666 - DNA, 25 bp, Mus musculus
aagaagctcttgtcctttaccgcat

SEQ ID NO: 43667 - DNA, 25 bp, Mus musculus
aagaagctgacaaaggtgagtgctg

SEQ ID NO: 43668 - DNA, 25 bp, Mus musculus
aagaagctgacataggtgagtgctg

SEQ ID NO: 43669 - DNA, 25 bp, Mus musculus
aagaagctgagtcggcagcgggcat

SEQ ID NO: 43670 - DNA, 25 bp, Mus musculus
aagaagctgagtgggcagcgggcat

SEQ ID NO: 43671 - DNA, 25 bp, Mus musculus
aagaagctgccccacggccttggga

SEQ ID NO: 43672 - DNA, 25 bp, Mus musculus
aagaagctgcccgacggccttggga

SEQ ID NO: 43673 - DNA, 25 bp, Mus musculus
aagaagctggccatggacatggcca

SEQ ID NO: 43674 - DNA, 25 bp, Mus musculus
aagaagctggcccaccaagaggagt

SEQ ID NO: 43675 - DNA, 25 bp, Mus musculus
aagaagctggcccactaaacaatgc

SEQ ID NO: 43676 - DNA, 25 bp, Mus musculus
aagaagctggccgaccaagaggagt

SEQ ID NO: 43677 - DNA, 25 bp, Mus musculus
aagaagctggccgactaaacaatgc

SEQ ID NO: 43678 - DNA, 25 bp, Mus musculus
aagaagctggccttggacatggcca

SEQ ID NO: 43679 - DNA, 25 bp, Mus musculus
aagaagctggtcagtgtccttttgc

SEQ ID NO: 43680 - DNA, 25 bp, Mus musculus
aagaagctggtctgtgtccttttgc

SEQ ID NO: 43681 - DNA, 25 bp, Mus musculus
aagaagctggtgaatcctccttttt

SEQ ID NO: 43682 - DNA, 25 bp, Mus musculus
aagaagctggtgacatccatgctgc

SEQ ID NO: 43683 - DNA, 25 bp, Mus musculus
aagaagctggtgtatcctccttttt

SEQ ID NO: 43684 - DNA, 25 bp, Mus musculus
aagaagctggtgtcatccatgctgc

SEQ ID NO: 43685 - DNA, 25 bp, Mus musculus
aagaagctgtacacggtttgatcat

SEQ ID NO: 43686 - DNA, 25 bp, Mus musculus
aagaagctgtactcggtttgatcat

SEQ ID NO: 43687 - DNA, 25 bp, Mus musculus
aagaagcttctcacggtggttggta

SEQ ID NO: 43688 - DNA, 25 bp, Mus musculus
aagaagcttctctcggtggttggta

SEQ ID NO: 43689 - DNA, 25 bp, Mus musculus
aagaagctttaaccacctcaccact

SEQ ID NO: 43690 - DNA, 25 bp, Mus musculus
aagaagctttaagcacctcaccact

SEQ ID NO: 43691 - DNA, 25 bp, Mus musculus
aagaagctttcactgctggcatgca

SEQ ID NO: 43692 - DNA, 25 bp, Mus musculus
aagaagctttcagtgctggcatgca

SEQ ID NO: 43693 - DNA, 25 bp, Mus musculus
aagaagcttttgactgtgtctttcc

SEQ ID NO: 43694 - DNA, 25 bp, Mus musculus
aagaagcttttgtctgtgtctttcc

SEQ ID NO: 43695 - DNA, 25 bp, Mus musculus
aagaaggaacttcaggaacgcctga

SEQ ID NO: 43696 - DNA, 25 bp, Mus musculus
aagaaggaacttgaggaacgcctga

SEQ ID NO: 43697 - DNA, 25 bp, Mus musculus
aagaaggaatcacatgccttggaaa

SEQ ID NO: 43698 - DNA, 25 bp, Mus musculus
aagaaggaatcactgccttccagac

SEQ ID NO: 43699 - DNA, 25 bp, Mus musculus
aagaaggaatcagatgccttggaaa

SEQ ID NO: 43700 - DNA, 25 bp, Mus musculus
aagaaggaatcagtgccttccagac

SEQ ID NO: 43701 - DNA, 25 bp, Mus musculus
aagaaggaattcatgctgggcaaag

SEQ ID NO: 43702 - DNA, 25 bp, Mus musculus
aagaaggaattcttgctgggcaaag

SEQ ID NO: 43703 - DNA, 25 bp, Mus musculus
aagaaggacaagactgttggaccag

SEQ ID NO: 43704 - DNA, 25 bp, Mus musculus
aagaaggacaagtctgttggaccag

SEQ ID NO: 43705 - DNA, 25 bp, Mus musculus
aagaaggaccaacccgctgaacaat

SEQ ID NO: 43706 - DNA, 25 bp, Mus musculus
aagaaggaccaagccgctgaacaat

SEQ ID NO: 43707 - DNA, 25 bp, Mus musculus
aagaaggacctcacagtctgtcatt

SEQ ID NO: 43708 - DNA, 25 bp, Mus musculus
aagaaggacctccatgccctgctgt

SEQ ID NO: 43709 - DNA, 25 bp, Mus musculus
aagaaggacctcgatgccctgctgt

SEQ ID NO: 43710 - DNA, 25 bp, Mus musculus
aagaaggacctctcagtctgtcatt

SEQ ID NO: 43711 - DNA, 25 bp, Mus musculus
aagaaggacctgcacaaagcggaga

SEQ ID NO: 43712 - DNA, 25 bp, Mus musculus
aagaaggacctggacaaagcggaga

SEQ ID NO: 43713 - DNA, 25 bp, Mus musculus
aagaaggacggtacacggtgctagc

SEQ ID NO: 43714 - DNA, 25 bp, Mus musculus
aagaaggacggttcacggtgctagc

SEQ ID NO: 43715 - DNA, 25 bp, Mus musculus
aagaaggagagtcacaagccgctgt

SEQ ID NO: 43716 - DNA, 25 bp, Mus musculus
aagaaggagagtctgccagccccat

SEQ ID NO: 43717 - DNA, 25 bp, Mus musculus
aagaaggagagtgacaagccgctgt

SEQ ID NO: 43718 - DNA, 25 bp, Mus musculus
aagaaggagagtgtgccagccccat

SEQ ID NO: 43719 - DNA, 25 bp, Mus musculus
aagaaggagccaatgctgtctacag

SEQ ID NO: 43720 - DNA, 25 bp, Mus musculus
aagaaggagccattgctgtctacag

SEQ ID NO: 43721 - DNA, 25 bp, Mus musculus
aagaaggagcccaggcacatcctgt

SEQ ID NO: 43722 - DNA, 25 bp, Mus musculus
aagaaggagccctggcacatcctgt

SEQ ID NO: 43723 - DNA, 25 bp, Mus musculus
aagaaggagctactacaggtcgaaa

SEQ ID NO: 43724 - DNA, 25 bp, Mus musculus
aagaaggagctagtacaggtcgaaa

SEQ ID NO: 43725 - DNA, 25 bp, Mus musculus
aagaaggaggagctgttgaaacaac

SEQ ID NO: 43726 - DNA, 25 bp, Mus musculus
aagaaggaggaggtgttgaaacaac

SEQ ID NO: 43727 - DNA, 25 bp, Mus musculus
aagaaggaggcaccatgtctgtctg

SEQ ID NO: 43728 - DNA, 25 bp, Mus musculus
aagaaggaggcagcatgtctgtctg

SEQ ID NO: 43729 - DNA, 25 bp, Mus musculus
aagaaggatccacccagaggttccg

SEQ ID NO: 43730 - DNA, 25 bp, Mus musculus
aagaaggatccagccagaggttccg

SEQ ID NO: 43731 - DNA, 25 bp, Mus musculus
aagaaggatgaacagccccgggatt

SEQ ID NO: 43732 - DNA, 25 bp, Mus musculus
aagaaggatgaagagccccgggatt

SEQ ID NO: 43733 - DNA, 25 bp, Mus musculus
aagaaggatgctctctctaccttta

SEQ ID NO: 43734 - DNA, 25 bp, Mus musculus
aagaaggatgctgtctctaccttta

SEQ ID NO: 43735 - DNA, 25 bp, Mus musculus
aagaaggatggactgccctcaagtc

SEQ ID NO: 43736 - DNA, 25 bp, Mus musculus
aagaaggatggagtgccctcaagtc

SEQ ID NO: 43737 - DNA, 25 bp, Mus musculus
aagaaggattccagagccgcctctg

SEQ ID NO: 43738 - DNA, 25 bp, Mus musculus
aagaaggattccagcgtccccgtat

SEQ ID NO: 43739 - DNA, 25 bp, Mus musculus
aagaaggattcctgagccgcctctg

SEQ ID NO: 43740 - DNA, 25 bp, Mus musculus
aagaaggattcctgcgtccccgtat

SEQ ID NO: 43741 - DNA, 25 bp, Mus musculus
aagaaggatttactgggcccatgga

SEQ ID NO: 43742 - DNA, 25 bp, Mus musculus
aagaaggatttagtgggcccatgga

SEQ ID NO: 43743 - DNA, 25 bp, Mus musculus
aagaaggcacagaccttgcatccta

SEQ ID NO: 43744 - DNA, 25 bp, Mus musculus
aagaaggcacagtccttgcatccta

SEQ ID NO: 43745 - DNA, 25 bp, Mus musculus
aagaaggcacgtctactcctgagga

SEQ ID NO: 43746 - DNA, 25 bp, Mus musculus
aagaaggcacgtgtactcctgagga

SEQ ID NO: 43747 - DNA, 25 bp, Mus musculus
aagaaggcacttactgtgaaccaga

SEQ ID NO: 43748 - DNA, 25 bp, Mus musculus
aagaaggcactttctgtgaaccaga

SEQ ID NO: 43749 - DNA, 25 bp, Mus musculus
aagaaggcagagatcccctcaaact

SEQ ID NO: 43750 - DNA, 25 bp, Mus musculus
aagaaggcagagttcccctcaaact

SEQ ID NO: 43751 - DNA, 25 bp, Mus musculus
aagaaggcagcccagtacctgaagc

SEQ ID NO: 43752 - DNA, 25 bp, Mus musculus
aagaaggcagccgagtacctgaagc

SEQ ID NO: 43753 - DNA, 25 bp, Mus musculus
aagaaggcagctacggctactcttt

SEQ ID NO: 43754 - DNA, 25 bp, Mus musculus
aagaaggcagctatgcgtcctcatc

SEQ ID NO: 43755 - DNA, 25 bp, Mus musculus
aagaaggcagctcggacactagaac

SEQ ID NO: 43756 - DNA, 25 bp, Mus musculus
aagaaggcagctgggacactagaac

SEQ ID NO: 43757 - DNA, 25 bp, Mus musculus
aagaaggcagcttcggctactcttt

SEQ ID NO: 43758 - DNA, 25 bp, Mus musculus
aagaaggcagctttgcgtcctcatc

SEQ ID NO: 43759 - DNA, 25 bp, Mus musculus
aagaaggcattcaacctctggccta

SEQ ID NO: 43760 - DNA, 25 bp, Mus musculus
aagaaggcattcagcagttgttggt

SEQ ID NO: 43761 - DNA, 25 bp, Mus musculus
aagaaggcattctacctctggccta

SEQ ID NO: 43762 - DNA, 25 bp, Mus musculus
aagaaggcattctgcagttgttggt

SEQ ID NO: 43763 - DNA, 25 bp, Mus musculus
aagaaggccaccaggaaccacccag

SEQ ID NO: 43764 - DNA, 25 bp, Mus musculus
aagaaggccacctggaaccacccag

SEQ ID NO: 43765 - DNA, 25 bp, Mus musculus
aagaaggccagacccgtcagactca

SEQ ID NO: 43766 - DNA, 25 bp, Mus musculus
aagaaggccagagccgtcagactca

SEQ ID NO: 43767 - DNA, 25 bp, Mus musculus
aagaaggccattccgttcgagccct

SEQ ID NO: 43768 - DNA, 25 bp, Mus musculus
aagaaggccattgcgttcgagccct

SEQ ID NO: 43769 - DNA, 25 bp, Mus musculus
aagaaggccgcccagacactcagtg

SEQ ID NO: 43770 - DNA, 25 bp, Mus musculus
aagaaggccgccgagacactcagtg

SEQ ID NO: 43771 - DNA, 25 bp, Mus musculus
aagaaggccttgctcatccagggct

SEQ ID NO: 43772 - DNA, 25 bp, Mus musculus
aagaaggccttggtcatccagggct

SEQ ID NO: 43773 - DNA, 25 bp, Mus musculus
aagaaggcgctgatgaagttctccg

SEQ ID NO: 43774 - DNA, 25 bp, Mus musculus
aagaaggcgctgttgaagttctccg

SEQ ID NO: 43775 - DNA, 25 bp, Mus musculus
aagaaggcggatcctccacaccagc

SEQ ID NO: 43776 - DNA, 25 bp, Mus musculus
aagaaggcggatgctccacaccagc

SEQ ID NO: 43777 - DNA, 25 bp, Mus musculus
aagaaggcggccaaacccagcgtgc

SEQ ID NO: 43778 - DNA, 25 bp, Mus musculus
aagaaggcggcctaacccagcgtgc

SEQ ID NO: 43779 - DNA, 25 bp, Mus musculus
aagaaggcgtttcccctgctggcca

SEQ ID NO: 43780 - DNA, 25 bp, Mus musculus
aagaaggcgtttgccctgctggcca

SEQ ID NO: 43781 - DNA, 25 bp, Mus musculus
aagaaggctaccagcctctgaaact

SEQ ID NO: 43782 - DNA, 25 bp, Mus musculus
aagaaggctacctgcctctgaaact

SEQ ID NO: 43783 - DNA, 25 bp, Mus musculus
aagaaggctgcaaagtgactgagaa

SEQ ID NO: 43784 - DNA, 25 bp, Mus musculus
aagaaggctgcatagtgactgagaa

SEQ ID NO: 43785 - DNA, 25 bp, Mus musculus
aagaaggctggcagtgcacctctgt

SEQ ID NO: 43786 - DNA, 25 bp, Mus musculus
aagaaggctggctgtgcacctctgt

SEQ ID NO: 43787 - DNA, 25 bp, Mus musculus
aagaaggcttgtcctgagctgtgcc

SEQ ID NO: 43788 - DNA, 25 bp, Mus musculus
aagaaggcttgtgctgagctgtgcc

SEQ ID NO: 43789 - DNA, 25 bp, Mus musculus
aagaagggacccaggatgccctgga

SEQ ID NO: 43790 - DNA, 25 bp, Mus musculus
aagaagggaccctggatgccctgga

SEQ ID NO: 43791 - DNA, 25 bp, Mus musculus
aagaagggactgacttgacccatca

SEQ ID NO: 43792 - DNA, 25 bp, Mus musculus
aagaagggactgtcttgacccatca

SEQ ID NO: 43793 - DNA, 25 bp, Mus musculus
aagaagggagccactgccttcctgt

SEQ ID NO: 43794 - DNA, 25 bp, Mus musculus
aagaagggagcctctgccttcctgt

SEQ ID NO: 43795 - DNA, 25 bp, Mus musculus
aagaagggatacaatccttggccag

SEQ ID NO: 43796 - DNA, 25 bp, Mus musculus
aagaagggatacctgcatttcctgg

SEQ ID NO: 43797 - DNA, 25 bp, Mus musculus
aagaagggatacgtgcatttcctgg

SEQ ID NO: 43798 - DNA, 25 bp, Mus musculus
aagaagggatactatccttggccag

SEQ ID NO: 43799 - DNA, 25 bp, Mus musculus
aagaagggcgatcctactcccgtga

SEQ ID NO: 43800 - DNA, 25 bp, Mus musculus
aagaagggcgatgctactcccgtga

SEQ ID NO: 43801 - DNA, 25 bp, Mus musculus
aagaagggcgtaccttagccatcct

SEQ ID NO: 43802 - DNA, 25 bp, Mus musculus
aagaagggcgtagcttagccatcct

SEQ ID NO: 43803 - DNA, 25 bp, Mus musculus
aagaagggcgtcagtctttccaagc

SEQ ID NO: 43804 - DNA, 25 bp, Mus musculus
aagaagggcgtctgtctttccaagc

SEQ ID NO: 43805 - DNA, 25 bp, Mus musculus
aagaagggctacacttggtccataa

SEQ ID NO: 43806 - DNA, 25 bp, Mus musculus
aagaagggctactcttggtccataa

SEQ ID NO: 43807 - DNA, 25 bp, Mus musculus
aagaagggctctcgtcagtttccct

SEQ ID NO: 43808 - DNA, 25 bp, Mus musculus
aagaagggctctggtcagtttccct

SEQ ID NO: 43809 - DNA, 25 bp, Mus musculus
aagaagggctgacttaggaatacct

SEQ ID NO: 43810 - DNA, 25 bp, Mus musculus
aagaagggctgagttaggaatacct

SEQ ID NO: 43811 - DNA, 25 bp, Mus musculus
aagaagggtcagaagccgctgcagc

SEQ ID NO: 43812 - DNA, 25 bp, Mus musculus
aagaagggtcagtagccgctgcagc

SEQ ID NO: 43813 - DNA, 25 bp, Mus musculus
aagaagggtgtaatcctgttcctgc

SEQ ID NO: 43814 - DNA, 25 bp, Mus musculus
aagaagggtgtacctcacatctgga

SEQ ID NO: 43815 - DNA, 25 bp, Mus musculus
aagaagggtgtagctcacatctgga

SEQ ID NO: 43816 - DNA, 25 bp, Mus musculus
aagaagggtgtattcctgttcctgc

SEQ ID NO: 43817 - DNA, 25 bp, Mus musculus
aagaagggttatcccagccgcagat

SEQ ID NO: 43818 - DNA, 25 bp, Mus musculus
aagaagggttatgccagccgcagat

SEQ ID NO: 43819 - DNA, 25 bp, Mus musculus
aagaaggtaaggcatgccctgttgc

SEQ ID NO: 43820 - DNA, 25 bp, Mus musculus
aagaaggtaagggatgccctgttgc

SEQ ID NO: 43821 - DNA, 25 bp, Mus musculus
aagaaggtcattcggccttcagttg

SEQ ID NO: 43822 - DNA, 25 bp, Mus musculus
aagaaggtcattgggccttcagttg

SEQ ID NO: 43823 - DNA, 25 bp, Mus musculus
aagaaggtcctcaggcagtatgact

SEQ ID NO: 43824 - DNA, 25 bp, Mus musculus
aagaaggtcctctggcagtatgact

SEQ ID NO: 43825 - DNA, 25 bp, Mus musculus
aagaaggtcggcatcgtcggcaagt

SEQ ID NO: 43826 - DNA, 25 bp, Mus musculus
aagaaggtcggcttcgtcggcaagt

SEQ ID NO: 43827 - DNA, 25 bp, Mus musculus
aagaaggtcgttcgagtgtgccttt

SEQ ID NO: 43828 - DNA, 25 bp, Mus musculus
aagaaggtcgttggagtgtgccttt

SEQ ID NO: 43829 - DNA, 25 bp, Mus musculus
aagaaggtctctatcatgctcgcaa

SEQ ID NO: 43830 - DNA, 25 bp, Mus musculus
aagaaggtctctttcatgctcgcaa

SEQ ID NO: 43831 - DNA, 25 bp, Mus musculus
aagaaggtcttgactgcacagagtt

SEQ ID NO: 43832 - DNA, 25 bp, Mus musculus
aagaaggtcttgtctgcacagagtt

SEQ ID NO: 43833 - DNA, 25 bp, Mus musculus
aagaaggtgccaactttactgccac

SEQ ID NO: 43834 - DNA, 25 bp, Mus musculus
aagaaggtgccatctttactgccac

SEQ ID NO: 43835 - DNA, 25 bp, Mus musculus
aagaaggtgcggctttctgccatcg

SEQ ID NO: 43836 - DNA, 25 bp, Mus musculus
aagaaggtgcgggtttctgccatcg

SEQ ID NO: 43837 - DNA, 25 bp, Mus musculus
aagaaggtgggcactgcactagaaa

SEQ ID NO: 43838 - DNA, 25 bp, Mus musculus
aagaaggtgggctctgcactagaaa

SEQ ID NO: 43839 - DNA, 25 bp, Mus musculus
aagaaggtgtagctttgttccacag

SEQ ID NO: 43840 - DNA, 25 bp, Mus musculus
aagaaggtgtaggtttgttccacag

SEQ ID NO: 43841 - DNA, 25 bp, Mus musculus
aagaaggttatcagcatgggtgcga

SEQ ID NO: 43842 - DNA, 25 bp, Mus musculus
aagaaggttatctgcatgggtgcga

SEQ ID NO: 43843 - DNA, 25 bp, Mus musculus
aagaagtaatccacgtgatcacaag

SEQ ID NO: 43844 - DNA, 25 bp, Mus musculus
aagaagtaatcctcgtgatcacaag

SEQ ID NO: 43845 - DNA, 25 bp, Mus musculus
aagaagtaatctactctcaccgtcc

SEQ ID NO: 43846 - DNA, 25 bp, Mus musculus
aagaagtaatcttctctcaccgtcc

SEQ ID NO: 43847 - DNA, 25 bp, Mus musculus
aagaagtacaaacctctggccctct

SEQ ID NO: 43848 - DNA, 25 bp, Mus musculus
aagaagtacaaagctctggccctct

SEQ ID NO: 43849 - DNA, 25 bp, Mus musculus
aagaagtacaggagcgccgtgtgcc

SEQ ID NO: 43850 - DNA, 25 bp, Mus musculus
aagaagtacaggtgcgccgtgtgcc

SEQ ID NO: 43851 - DNA, 25 bp, Mus musculus
aagaagtaccagctgaacctgccat

SEQ ID NO: 43852 - DNA, 25 bp, Mus musculus
aagaagtaccaggtgaacctgccat

SEQ ID NO: 43853 - DNA, 25 bp, Mus musculus
aagaagtacgaccacgacatctccc

SEQ ID NO: 43854 - DNA, 25 bp, Mus musculus
aagaagtacgacctgccttttgctt

SEQ ID NO: 43855 - DNA, 25 bp, Mus musculus
aagaagtacgacgacgacatctccc

SEQ ID NO: 43856 - DNA, 25 bp, Mus musculus
aagaagtacgacgtgccttttgctt

SEQ ID NO: 43857 - DNA, 25 bp, Mus musculus
aagaagtacggccaagtccccatgt

SEQ ID NO: 43858 - DNA, 25 bp, Mus musculus
aagaagtacggcgaagtccccatgt

SEQ ID NO: 43859 - DNA, 25 bp, Mus musculus
aagaagtatcttattgtgttgtctc

SEQ ID NO: 43860 - DNA, 25 bp, Mus musculus
aagaagtatctttttgtgttgtctc

SEQ ID NO: 43861 - DNA, 25 bp, Mus musculus
aagaagtattttcagctcctgcagc

SEQ ID NO: 43862 - DNA, 25 bp, Mus musculus
aagaagtattttgagctcctgcagc

SEQ ID NO: 43863 - DNA, 25 bp, Mus musculus
aagaagtcaaggactccactgcgaa

SEQ ID NO: 43864 - DNA, 25 bp, Mus musculus
aagaagtcaaggtctccactgcgaa

SEQ ID NO: 43865 - DNA, 25 bp, Mus musculus
aagaagtcatccaaagccttagcag

SEQ ID NO: 43866 - DNA, 25 bp, Mus musculus
aagaagtcatcctaagccttagcag

SEQ ID NO: 43867 - DNA, 25 bp, Mus musculus
aagaagtccaaacctgagagaaaag

SEQ ID NO: 43868 - DNA, 25 bp, Mus musculus
aagaagtccaaagctgagagaaaag

SEQ ID NO: 43869 - DNA, 25 bp, Mus musculus
aagaagtccaccaggtccggaagct

SEQ ID NO: 43870 - DNA, 25 bp, Mus musculus
aagaagtccacctggtccggaagct

SEQ ID NO: 43871 - DNA, 25 bp, Mus musculus
aagaagtccatactgcctagtgcat

SEQ ID NO: 43872 - DNA, 25 bp, Mus musculus
aagaagtccatagtgcctagtgcat

SEQ ID NO: 43873 - DNA, 25 bp, Mus musculus
aagaagtccatcaggtggtcctctg

SEQ ID NO: 43874 - DNA, 25 bp, Mus musculus
aagaagtccatctggtggtcctctg

SEQ ID NO: 43875 - DNA, 25 bp, Mus musculus
aagaagtcctcgcttatggtggccc

SEQ ID NO: 43876 - DNA, 25 bp, Mus musculus
aagaagtcctcggttatggtggccc

SEQ ID NO: 43877 - DNA, 25 bp, Mus musculus
aagaagtccttaccttcaagcccct

SEQ ID NO: 43878 - DNA, 25 bp, Mus musculus
aagaagtccttagcttcaagcccct

SEQ ID NO: 43879 - DNA, 25 bp, Mus musculus
aagaagtctagaaattctgtgcaag

SEQ ID NO: 43880 - DNA, 25 bp, Mus musculus
aagaagtctagatattctgtgcaag

SEQ ID NO: 43881 - DNA, 25 bp, Mus musculus
aagaagtctatacctccacacatat

SEQ ID NO: 43882 - DNA, 25 bp, Mus musculus
aagaagtctatagctccacacatat

SEQ ID NO: 43883 - DNA, 25 bp, Mus musculus
aagaagtctcatctctgtgcacaag

SEQ ID NO: 43884 - DNA, 25 bp, Mus musculus
aagaagtctcatgtctgtgcacaag

SEQ ID NO: 43885 - DNA, 25 bp, Mus musculus
aagaagtctctacttctgccatacc

SEQ ID NO: 43886 - DNA, 25 bp, Mus musculus
aagaagtctctagttctgccatacc

SEQ ID NO: 43887 - DNA, 25 bp, Mus musculus
aagaagtctctgactgtagtgggca

SEQ ID NO: 43888 - DNA, 25 bp, Mus musculus
aagaagtctctgagcagcacctgtc

SEQ ID NO: 43889 - DNA, 25 bp, Mus musculus
aagaagtctctgtctgtagtgggca

SEQ ID NO: 43890 - DNA, 25 bp, Mus musculus
aagaagtctctgtgcagcacctgtc

SEQ ID NO: 43891 - DNA, 25 bp, Mus musculus
aagaagtctgcgagggtaacgcaca

SEQ ID NO: 43892 - DNA, 25 bp, Mus musculus
aagaagtctgcgtgggtaacgcaca

SEQ ID NO: 43893 - DNA, 25 bp, Mus musculus
aagaagtctgctcgctatgggtgtt

SEQ ID NO: 43894 - DNA, 25 bp, Mus musculus
aagaagtctgctggctatgggtgtt

SEQ ID NO: 43895 - DNA, 25 bp, Mus musculus
aagaagtctgttcaatcctgtcaca

SEQ ID NO: 43896 - DNA, 25 bp, Mus musculus
aagaagtctgttgaatcctgtcaca

SEQ ID NO: 43897 - DNA, 25 bp, Mus musculus
aagaagtcttatataccagcagcag

SEQ ID NO: 43898 - DNA, 25 bp, Mus musculus
aagaagtcttatttaccagcagcag

SEQ ID NO: 43899 - DNA, 25 bp, Mus musculus
aagaagtcttcaccccagactgctg

SEQ ID NO: 43900 - DNA, 25 bp, Mus musculus
aagaagtcttcagcccagactgctg

SEQ ID NO: 43901 - DNA, 25 bp, Mus musculus
aagaagtcttcgaggttggttctgt

SEQ ID NO: 43902 - DNA, 25 bp, Mus musculus
aagaagtcttcgtggttggttctgt

SEQ ID NO: 43903 - DNA, 25 bp, Mus musculus
aagaagtcttctctgcttagtagga

SEQ ID NO: 43904 - DNA, 25 bp, Mus musculus
aagaagtcttctgtgcttagtagga

SEQ ID NO: 43905 - DNA, 25 bp, Mus musculus
aagaagtcttgcacacattgttggg

SEQ ID NO: 43906 - DNA, 25 bp, Mus musculus
aagaagtcttgctcacattgttggg

SEQ ID NO: 43907 - DNA, 25 bp, Mus musculus
aagaagtgaacaatccagggagtgg

SEQ ID NO: 43908 - DNA, 25 bp, Mus musculus
aagaagtgaacaccctgcaacccgt

SEQ ID NO: 43909 - DNA, 25 bp, Mus musculus
aagaagtgaacagcctgcaacccgt

SEQ ID NO: 43910 - DNA, 25 bp, Mus musculus
aagaagtgaacattccagggagtgg

SEQ ID NO: 43911 - DNA, 25 bp, Mus musculus
aagaagtgagaaagccacccagaac

SEQ ID NO: 43912 - DNA, 25 bp, Mus musculus
aagaagtgagaatgccacccagaac

SEQ ID NO: 43913 - DNA, 25 bp, Mus musculus
aagaagtgagcaataacccagacag

SEQ ID NO: 43914 - DNA, 25 bp, Mus musculus
aagaagtgagcattaacccagacag

SEQ ID NO: 43915 - DNA, 25 bp, Mus musculus
aagaagtgagctcttccatccctct

SEQ ID NO: 43916 - DNA, 25 bp, Mus musculus
aagaagtgagctgttccatccctct

SEQ ID NO: 43917 - DNA, 25 bp, Mus musculus
aagaagtgagttattgggctgagct

SEQ ID NO: 43918 - DNA, 25 bp, Mus musculus
aagaagtgagtttttgggctgagct

SEQ ID NO: 43919 - DNA, 25 bp, Mus musculus
aagaagtgcactatgaaccccgtct

SEQ ID NO: 43920 - DNA, 25 bp, Mus musculus
aagaagtgcactttgaaccccgtct

SEQ ID NO: 43921 - DNA, 25 bp, Mus musculus
aagaagtgcaggactgggccctgct

SEQ ID NO: 43922 - DNA, 25 bp, Mus musculus
aagaagtgcaggtctgggccctgct

SEQ ID NO: 43923 - DNA, 25 bp, Mus musculus
aagaagtgccccagtcacggcccat

SEQ ID NO: 43924 - DNA, 25 bp, Mus musculus
aagaagtgcccctgtcacggcccat

SEQ ID NO: 43925 - DNA, 25 bp, Mus musculus
aagaagtgctgcaatgctgcgctgc

SEQ ID NO: 43926 - DNA, 25 bp, Mus musculus
aagaagtgctgctatgctgcgctgc

SEQ ID NO: 43927 - DNA, 25 bp, Mus musculus
aagaagtgctttattccaggacaat

SEQ ID NO: 43928 - DNA, 25 bp, Mus musculus
aagaagtgcttttttccaggacaat

SEQ ID NO: 43929 - DNA, 25 bp, Mus musculus
aagaagtggccaagcgcaagctggt

SEQ ID NO: 43930 - DNA, 25 bp, Mus musculus
aagaagtggccatgcgcaagctggt

SEQ ID NO: 43931 - DNA, 25 bp, Mus musculus
aagaagtggcctcgacttcggacta

SEQ ID NO: 43932 - DNA, 25 bp, Mus musculus
aagaagtggcctggacttcggacta

SEQ ID NO: 43933 - DNA, 25 bp, Mus musculus
aagaagtgggccagagcgctaccag

SEQ ID NO: 43934 - DNA, 25 bp, Mus musculus
aagaagtgggccagggcacacacca

SEQ ID NO: 43935 - DNA, 25 bp, Mus musculus
aagaagtgggcctgagcgctaccag

SEQ ID NO: 43936 - DNA, 25 bp, Mus musculus
aagaagtgggcctgggcacacacca

SEQ ID NO: 43937 - DNA, 25 bp, Mus musculus
aagaagtggtcaaccacagagtctt

SEQ ID NO: 43938 - DNA, 25 bp, Mus musculus
aagaagtggtcatccacagagtctt

SEQ ID NO: 43939 - DNA, 25 bp, Mus musculus
aagaagtggtgactcccaggcacag

SEQ ID NO: 43940 - DNA, 25 bp, Mus musculus
aagaagtggtgagtcccaggcacag

SEQ ID NO: 43941 - DNA, 25 bp, Mus musculus
aagaagtggtgcctccagcctacct

SEQ ID NO: 43942 - DNA, 25 bp, Mus musculus
aagaagtggtgcgtccagcctacct

SEQ ID NO: 43943 - DNA, 25 bp, Mus musculus
aagaagtgtgctaggcctgatgaca

SEQ ID NO: 43944 - DNA, 25 bp, Mus musculus
aagaagtgtgcttggcctgatgaca

SEQ ID NO: 43945 - DNA, 25 bp, Mus musculus
aagaagttaattcgcctcagtggta

SEQ ID NO: 43946 - DNA, 25 bp, Mus musculus
aagaagttaattggcctcagtggta

SEQ ID NO: 43947 - DNA, 25 bp, Mus musculus
aagaagttactgcacaagcccacca

SEQ ID NO: 43948 - DNA, 25 bp, Mus musculus
aagaagttactggacaagcccacca

SEQ ID NO: 43949 - DNA, 25 bp, Mus musculus
aagaagttagatcaggtgcgcctga

SEQ ID NO: 43950 - DNA, 25 bp, Mus musculus
aagaagttagatgaggtgcgcctga

SEQ ID NO: 43951 - DNA, 25 bp, Mus musculus
aagaagttaggccattcaccgcatc

SEQ ID NO: 43952 - DNA, 25 bp, Mus musculus
aagaagttaggcgattcaccgcatc

SEQ ID NO: 43953 - DNA, 25 bp, Mus musculus
aagaagttattcagcctgagtctca

SEQ ID NO: 43954 - DNA, 25 bp, Mus musculus
aagaagttattctgcctgagtctca

SEQ ID NO: 43955 - DNA, 25 bp, Mus musculus
aagaagttcatgctggcaccgagcc

SEQ ID NO: 43956 - DNA, 25 bp, Mus musculus
aagaagttcatggtggcaccgagcc

SEQ ID NO: 43957 - DNA, 25 bp, Mus musculus
aagaagttccccaaggtgattgaca

SEQ ID NO: 43958 - DNA, 25 bp, Mus musculus
aagaagttcccctaggtgattgaca

SEQ ID NO: 43959 - DNA, 25 bp, Mus musculus
aagaagttccctaaagtctatcaag

SEQ ID NO: 43960 - DNA, 25 bp, Mus musculus
aagaagttcccttaagtctatcaag

SEQ ID NO: 43961 - DNA, 25 bp, Mus musculus
aagaagttccggcatgccttggcca

SEQ ID NO: 43962 - DNA, 25 bp, Mus musculus
aagaagttccgggatgccttggcca

SEQ ID NO: 43963 - DNA, 25 bp, Mus musculus
aagaagttcctaagtgccctttcag

SEQ ID NO: 43964 - DNA, 25 bp, Mus musculus
aagaagttcctatgtgccctttcag

SEQ ID NO: 43965 - DNA, 25 bp, Mus musculus
aagaagttcgcacgctcggacgagc

SEQ ID NO: 43966 - DNA, 25 bp, Mus musculus
aagaagttcgcaggctcggacgagc

SEQ ID NO: 43967 - DNA, 25 bp, Mus musculus
aagaagttgctccatggctactacg

SEQ ID NO: 43968 - DNA, 25 bp, Mus musculus
aagaagttgctcgatggctactacg

SEQ ID NO: 43969 - DNA, 25 bp, Mus musculus
aagaagttgggcatctcatttccat

SEQ ID NO: 43970 - DNA, 25 bp, Mus musculus
aagaagttgggcttctcatttccat

SEQ ID NO: 43971 - DNA, 25 bp, Mus musculus
aagaagtttactcccacgctggtgc

SEQ ID NO: 43972 - DNA, 25 bp, Mus musculus
aagaagtttactgccacgctggtgc

SEQ ID NO: 43973 - DNA, 25 bp, Mus musculus
aagaagtttcccagcataacctcag

SEQ ID NO: 43974 - DNA, 25 bp, Mus musculus
aagaagtttccctgcataacctcag

SEQ ID NO: 43975 - DNA, 25 bp, Mus musculus
aagaagtttctcagactcgattccc

SEQ ID NO: 43976 - DNA, 25 bp, Mus musculus
aagaagtttctctgactcgattccc

SEQ ID NO: 43977 - DNA, 25 bp, Mus musculus
aagaagtttctgctcgatgtaagaa

SEQ ID NO: 43978 - DNA, 25 bp, Mus musculus
aagaagtttctggtcgatgtaagaa

SEQ ID NO: 43979 - DNA, 25 bp, Mus musculus
aagaagttttctcccatcctgtgac

SEQ ID NO: 43980 - DNA, 25 bp, Mus musculus
aagaagttttctgccatcctgtgac

SEQ ID NO: 43981 - DNA, 25 bp, Mus musculus
aagaataactaccaggcaggctatg

SEQ ID NO: 43982 - DNA, 25 bp, Mus musculus
aagaataactacgaggcaggctatg

SEQ ID NO: 43983 - DNA, 25 bp, Mus musculus
aagaataacttaaagctccagctaa

SEQ ID NO: 43984 - DNA, 25 bp, Mus musculus
aagaataacttatagctccagctaa

SEQ ID NO: 43985 - DNA, 25 bp, Mus musculus
aagaataactttcactcctgtcctg

SEQ ID NO: 43986 - DNA, 25 bp, Mus musculus
aagaataactttgactcctgtcctg

SEQ ID NO: 43987 - DNA, 25 bp, Mus musculus
aagaataagaacagccgtcgccatt

SEQ ID NO: 43988 - DNA, 25 bp, Mus musculus
aagaataagaactgccgtcgccatt

SEQ ID NO: 43989 - DNA, 25 bp, Mus musculus
aagaataagttgactgctcccttcc

SEQ ID NO: 43990 - DNA, 25 bp, Mus musculus
aagaataagttgtctgctcccttcc

SEQ ID NO: 43991 - DNA, 25 bp, Mus musculus
aagaataatattacacatcctgata

SEQ ID NO: 43992 - DNA, 25 bp, Mus musculus
aagaataatatttcacatcctgata

SEQ ID NO: 43993 - DNA, 25 bp, Mus musculus
aagaataatgaccaaatttccacag

SEQ ID NO: 43994 - DNA, 25 bp, Mus musculus
aagaataatgacgaaatttccacag

SEQ ID NO: 43995 - DNA, 25 bp, Mus musculus
aagaatacacatccttgccaaacat

SEQ ID NO: 43996 - DNA, 25 bp, Mus musculus
aagaatacacatgcttgccaaacat

SEQ ID NO: 43997 - DNA, 25 bp, Mus musculus
aagaatacagctactgggtccctgg

SEQ ID NO: 43998 - DNA, 25 bp, Mus musculus
aagaatacagcttctgggtccctgg

SEQ ID NO: 43999 - DNA, 25 bp, Mus musculus
aagaataccgtgacagcctgcacac

SEQ ID NO: 44000 - DNA, 25 bp, Mus musculus
aagaataccgtgtcagcctgcacac

SEQ ID NO: 44001 - DNA, 25 bp, Mus musculus
aagaatacctcccatgctcactgat

SEQ ID NO: 44002 - DNA, 25 bp, Mus musculus
aagaatacctccgatgctcactgat

SEQ ID NO: 44003 - DNA, 25 bp, Mus musculus
aagaatacgatgctggtcatcacag

SEQ ID NO: 44004 - DNA, 25 bp, Mus musculus
aagaatacgatggtggtcatcacag

SEQ ID NO: 44005 - DNA, 25 bp, Mus musculus
aagaatactaggacctctgagccaa

SEQ ID NO: 44006 - DNA, 25 bp, Mus musculus
aagaatactaggtcctctgagccaa

SEQ ID NO: 44007 - DNA, 25 bp, Mus musculus
aagaatactcctaactggcttggct

SEQ ID NO: 44008 - DNA, 25 bp, Mus musculus
aagaatactccttactggcttggct

SEQ ID NO: 44009 - DNA, 25 bp, Mus musculus
aagaatactctcaactttcttcctc

SEQ ID NO: 44010 - DNA, 25 bp, Mus musculus
aagaatactctctactttcttcctc

SEQ ID NO: 44011 - DNA, 25 bp, Mus musculus
aagaatactggtccttttgcagagc

SEQ ID NO: 44012 - DNA, 25 bp, Mus musculus
aagaatactggtgcttttgcagagc

SEQ ID NO: 44013 - DNA, 25 bp, Mus musculus
aagaatactttaaactcattgtagt

SEQ ID NO: 44014 - DNA, 25 bp, Mus musculus
aagaatactttatactcattgtagt

SEQ ID NO: 44015 - DNA, 25 bp, Mus musculus
aagaatagagtaaggccaacattac

SEQ ID NO: 44016 - DNA, 25 bp, Mus musculus
aagaatagagtatggccaacattac

SEQ ID NO: 44017 - DNA, 25 bp, Mus musculus
aagaatagcaggctgtttgttgaag

SEQ ID NO: 44018 - DNA, 25 bp, Mus musculus
aagaatagcagggtgtttgttgaag

SEQ ID NO: 44019 - DNA, 25 bp, Mus musculus
aagaatagccatcccgctggagcta

SEQ ID NO: 44020 - DNA, 25 bp, Mus musculus
aagaatagccatgccgctggagcta

SEQ ID NO: 44021 - DNA, 25 bp, Mus musculus
aagaatagctcacggatcatcaaga

SEQ ID NO: 44022 - DNA, 25 bp, Mus musculus
aagaatagctcagggatcatcaaga

SEQ ID NO: 44023 - DNA, 25 bp, Mus musculus
aagaataggctcatcagacggccca

SEQ ID NO: 44024 - DNA, 25 bp, Mus musculus
aagaataggctcttcagacggccca

SEQ ID NO: 44025 - DNA, 25 bp, Mus musculus
aagaataggtgacctttgctcgctt

SEQ ID NO: 44026 - DNA, 25 bp, Mus musculus
aagaataggtgagctttgctcgctt

SEQ ID NO: 44027 - DNA, 25 bp, Mus musculus
aagaatagtgctctgctttcccctc

SEQ ID NO: 44028 - DNA, 25 bp, Mus musculus
aagaatagtgctgtgctttcccctc

SEQ ID NO: 44029 - DNA, 25 bp, Mus musculus
aagaatataaccatgaatccaattg

SEQ ID NO: 44030 - DNA, 25 bp, Mus musculus
aagaatataaccttgaatccaattg

SEQ ID NO: 44031 - DNA, 25 bp, Mus musculus
aagaatataatccagccaccgtcat

SEQ ID NO: 44032 - DNA, 25 bp, Mus musculus
aagaatataatcgagccaccgtcat

SEQ ID NO: 44033 - DNA, 25 bp, Mus musculus
aagaatatacttccttccccactat

SEQ ID NO: 44034 - DNA, 25 bp, Mus musculus
aagaatatacttgcttccccactat

SEQ ID NO: 44035 - DNA, 25 bp, Mus musculus
aagaatatctagctaccacttgaaa

SEQ ID NO: 44036 - DNA, 25 bp, Mus musculus
aagaatatctaggtaccacttgaaa

SEQ ID NO: 44037 - DNA, 25 bp, Mus musculus
aagaatatctcgcatggtttcccca

SEQ ID NO: 44038 - DNA, 25 bp, Mus musculus
aagaatatctcggatggtttcccca

SEQ ID NO: 44039 - DNA, 25 bp, Mus musculus
aagaatatctttctagctgggcaaa

SEQ ID NO: 44040 - DNA, 25 bp, Mus musculus
aagaatatctttgtagctgggcaaa

SEQ ID NO: 44041 - DNA, 25 bp, Mus musculus
aagaatatggagactaatgcctgct

SEQ ID NO: 44042 - DNA, 25 bp, Mus musculus
aagaatatggagtctaatgcctgct

SEQ ID NO: 44043 - DNA, 25 bp, Mus musculus
aagaatatgttacccgccaagcctc

SEQ ID NO: 44044 - DNA, 25 bp, Mus musculus
aagaatatgttagccgccaagcctc

SEQ ID NO: 44045 - DNA, 25 bp, Mus musculus
aagaatattaatccacccgcagaag

SEQ ID NO: 44046 - DNA, 25 bp, Mus musculus
aagaatattaatgcacccgcagaag

SEQ ID NO: 44047 - DNA, 25 bp, Mus musculus
aagaatattaccatcaggcagccaa

SEQ ID NO: 44048 - DNA, 25 bp, Mus musculus
aagaatattaccttcaggcagccaa

SEQ ID NO: 44049 - DNA, 25 bp, Mus musculus
aagaatattgaccttggactggaga

SEQ ID NO: 44050 - DNA, 25 bp, Mus musculus
aagaatattgacgttggactggaga

SEQ ID NO: 44051 - DNA, 25 bp, Mus musculus
aagaatatttctctagccttgtcag

SEQ ID NO: 44052 - DNA, 25 bp, Mus musculus
aagaatatttctgtagccttgtcag

SEQ ID NO: 44053 - DNA, 25 bp, Mus musculus
aagaatatttgtcgtgcctcccgtt

SEQ ID NO: 44054 - DNA, 25 bp, Mus musculus
aagaatatttgtggtgcctcccgtt

SEQ ID NO: 44055 - DNA, 25 bp, Mus musculus
aagaatcaaataagtcagggaaaag

SEQ ID NO: 44056 - DNA, 25 bp, Mus musculus
aagaatcaaatatgtcagggaaaag

SEQ ID NO: 44057 - DNA, 25 bp, Mus musculus
aagaatcaacttcagtccctgcctg

SEQ ID NO: 44058 - DNA, 25 bp, Mus musculus
aagaatcaacttgagtccctgcctg

SEQ ID NO: 44059 - DNA, 25 bp, Mus musculus
aagaatcaagttcggcttcacgcaa

SEQ ID NO: 44060 - DNA, 25 bp, Mus musculus
aagaatcaagttgggcttcacgcaa

SEQ ID NO: 44061 - DNA, 25 bp, Mus musculus
aagaatcacaacacccacatgtggt

SEQ ID NO: 44062 - DNA, 25 bp, Mus musculus
aagaatcacaactcccacatgtggt

SEQ ID NO: 44063 - DNA, 25 bp, Mus musculus
aagaatcacatgagctcggtcctcg

SEQ ID NO: 44064 - DNA, 25 bp, Mus musculus
aagaatcacatgtgctcggtcctcg

SEQ ID NO: 44065 - DNA, 25 bp, Mus musculus
aagaatcaccctcattgttgaaagt

SEQ ID NO: 44066 - DNA, 25 bp, Mus musculus
aagaatcaccctgattgttgaaagt

SEQ ID NO: 44067 - DNA, 25 bp, Mus musculus
aagaatcacttcacccagtaacctt

SEQ ID NO: 44068 - DNA, 25 bp, Mus musculus
aagaatcacttcatacctccttttg

SEQ ID NO: 44069 - DNA, 25 bp, Mus musculus
aagaatcacttctcccagtaacctt

SEQ ID NO: 44070 - DNA, 25 bp, Mus musculus
aagaatcacttcttacctccttttg

SEQ ID NO: 44071 - DNA, 25 bp, Mus musculus
aagaatcagccgaggcaagccagtt

SEQ ID NO: 44072 - DNA, 25 bp, Mus musculus
aagaatcagccgtggcaagccagtt

SEQ ID NO: 44073 - DNA, 25 bp, Mus musculus
aagaatcaggacacgggcttgctgc

SEQ ID NO: 44074 - DNA, 25 bp, Mus musculus
aagaatcaggactcgggcttgctgc

SEQ ID NO: 44075 - DNA, 25 bp, Mus musculus
aagaatcaggcactgctcacagaaa

SEQ ID NO: 44076 - DNA, 25 bp, Mus musculus
aagaatcaggcagtgctcacagaaa

SEQ ID NO: 44077 - DNA, 25 bp, Mus musculus
aagaatcagtagatcccagttggaa

SEQ ID NO: 44078 - DNA, 25 bp, Mus musculus
aagaatcagtagttcccagttggaa

SEQ ID NO: 44079 - DNA, 25 bp, Mus musculus
aagaatcagtcaccccttttcaatg

SEQ ID NO: 44080 - DNA, 25 bp, Mus musculus
aagaatcagtcagcccttttcaatg

SEQ ID NO: 44081 - DNA, 25 bp, Mus musculus
aagaatcataccatggcctttacaa

SEQ ID NO: 44082 - DNA, 25 bp, Mus musculus
aagaatcataccttggcctttacaa

SEQ ID NO: 44083 - DNA, 25 bp, Mus musculus
aagaatcatcttaaatgcccttcct

SEQ ID NO: 44084 - DNA, 25 bp, Mus musculus
aagaatcatctttaatgcccttcct

SEQ ID NO: 44085 - DNA, 25 bp, Mus musculus
aagaatcatgctattttccttccct

SEQ ID NO: 44086 - DNA, 25 bp, Mus musculus
aagaatcatgcttttttccttccct

SEQ ID NO: 44087 - DNA, 25 bp, Mus musculus
aagaatcattacattagccagcagt

SEQ ID NO: 44088 - DNA, 25 bp, Mus musculus
aagaatcattactttagccagcagt

SEQ ID NO: 44089 - DNA, 25 bp, Mus musculus
aagaatcattctcgctcactgtttg

SEQ ID NO: 44090 - DNA, 25 bp, Mus musculus
aagaatcattctggctcactgtttg

SEQ ID NO: 44091 - DNA, 25 bp, Mus musculus
aagaatccaaagaccccgcggatga

SEQ ID NO: 44092 - DNA, 25 bp, Mus musculus
aagaatccaaagtccccgcggatga

SEQ ID NO: 44093 - DNA, 25 bp, Mus musculus
aagaatccaaggatgccctgagcaa

SEQ ID NO: 44094 - DNA, 25 bp, Mus musculus
aagaatccaaggttgccctgagcaa

SEQ ID NO: 44095 - DNA, 25 bp, Mus musculus
aagaatccaatccatttcaaacttg

SEQ ID NO: 44096 - DNA, 25 bp, Mus musculus
aagaatccaatcgatttcaaacttg

SEQ ID NO: 44097 - DNA, 25 bp, Mus musculus
aagaatccagacatcaaagccctcc

SEQ ID NO: 44098 - DNA, 25 bp, Mus musculus
aagaatccagacttcaaagccctcc

SEQ ID NO: 44099 - DNA, 25 bp, Mus musculus
aagaatccagtcagctcgtgcttca

SEQ ID NO: 44100 - DNA, 25 bp, Mus musculus
aagaatccagtctgctcgtgcttca

SEQ ID NO: 44101 - DNA, 25 bp, Mus musculus
aagaatccatcaaccccattgtatt

SEQ ID NO: 44102 - DNA, 25 bp, Mus musculus
aagaatccatcatccccattgtatt

SEQ ID NO: 44103 - DNA, 25 bp, Mus musculus
aagaatccccaacgcaggcttgaag

SEQ ID NO: 44104 - DNA, 25 bp, Mus musculus
aagaatccccaaggcaggcttgaag

SEQ ID NO: 44105 - DNA, 25 bp, Mus musculus
aagaatcccgtactggaccacttgg

SEQ ID NO: 44106 - DNA, 25 bp, Mus musculus
aagaatcccgtagtggaccacttgg

SEQ ID NO: 44107 - DNA, 25 bp, Mus musculus
aagaatccgcttattgtgcaaatgc

SEQ ID NO: 44108 - DNA, 25 bp, Mus musculus
aagaatccgctttttgtgcaaatgc

SEQ ID NO: 44109 - DNA, 25 bp, Mus musculus
aagaatccggaacatccctggcgtc

SEQ ID NO: 44110 - DNA, 25 bp, Mus musculus
aagaatccggaagatccctggcgtc

SEQ ID NO: 44111 - DNA, 25 bp, Mus musculus
aagaatccggtgcaaaagaggtgca

SEQ ID NO: 44112 - DNA, 25 bp, Mus musculus
aagaatccggtggaaaagaggtgca

SEQ ID NO: 44113 - DNA, 25 bp, Mus musculus
aagaatcctcatcttcacccttgag

SEQ ID NO: 44114 - DNA, 25 bp, Mus musculus
aagaatcctcatgttcacccttgag

SEQ ID NO: 44115 - DNA, 25 bp, Mus musculus
aagaatcctccccacgcttgtagat

SEQ ID NO: 44116 - DNA, 25 bp, Mus musculus
aagaatcctcccgacgcttgtagat

SEQ ID NO: 44117 - DNA, 25 bp, Mus musculus
aagaatcctctaagctggaacgtag

SEQ ID NO: 44118 - DNA, 25 bp, Mus musculus
aagaatcctctatgctggaacgtag

SEQ ID NO: 44119 - DNA, 25 bp, Mus musculus
aagaatcctcttaagctgtggcctg

SEQ ID NO: 44120 - DNA, 25 bp, Mus musculus
aagaatcctctttagctgtggcctg

SEQ ID NO: 44121 - DNA, 25 bp, Mus musculus
aagaatcctgccaagttctacacct

SEQ ID NO: 44122 - DNA, 25 bp, Mus musculus
aagaatcctgcctagttctacacct

SEQ ID NO: 44123 - DNA, 25 bp, Mus musculus
aagaatcctggccacattcaccaat

SEQ ID NO: 44124 - DNA, 25 bp, Mus musculus
aagaatcctggcgacattcaccaat

SEQ ID NO: 44125 - DNA, 25 bp, Mus musculus
aagaatcctgtgaacggcgacgcta

SEQ ID NO: 44126 - DNA, 25 bp, Mus musculus
aagaatcctgtgacaacctgtggcc

SEQ ID NO: 44127 - DNA, 25 bp, Mus musculus
aagaatcctgtgatggttgtataat

SEQ ID NO: 44128 - DNA, 25 bp, Mus musculus
aagaatcctgtgtacggcgacgcta

SEQ ID NO: 44129 - DNA, 25 bp, Mus musculus
aagaatcctgtgtcaacctgtggcc

SEQ ID NO: 44130 - DNA, 25 bp, Mus musculus
aagaatcctgtgttggttgtataat

SEQ ID NO: 44131 - DNA, 25 bp, Mus musculus
aagaatccttctacgggagtcatat

SEQ ID NO: 44132 - DNA, 25 bp, Mus musculus
aagaatccttcttcgggagtcatat

SEQ ID NO: 44133 - DNA, 25 bp, Mus musculus
aagaatccttgactcatttacaatg

SEQ ID NO: 44134 - DNA, 25 bp, Mus musculus
aagaatccttgagtcatttacaatg

SEQ ID NO: 44135 - DNA, 25 bp, Mus musculus
aagaatcgagtacctgcagagccat

SEQ ID NO: 44136 - DNA, 25 bp, Mus musculus
aagaatcgagtagctgcagagccat

SEQ ID NO: 44137 - DNA, 25 bp, Mus musculus
aagaatcgatcgatcctctcgccgt

SEQ ID NO: 44138 - DNA, 25 bp, Mus musculus
aagaatcgatcgttcctctcgccgt

SEQ ID NO: 44139 - DNA, 25 bp, Mus musculus
aagaatcgcattaccagggccctgg

SEQ ID NO: 44140 - DNA, 25 bp, Mus musculus
aagaatcgcatttccagggccctgg

SEQ ID NO: 44141 - DNA, 25 bp, Mus musculus
aagaatcgccccagtacccttgtca

SEQ ID NO: 44142 - DNA, 25 bp, Mus musculus
aagaatcgcccctgtacccttgtca

SEQ ID NO: 44143 - DNA, 25 bp, Mus musculus
aagaatcgctgtatcatgtgcagga

SEQ ID NO: 44144 - DNA, 25 bp, Mus musculus
aagaatcgctgtttcatgtgcagga

SEQ ID NO: 44145 - DNA, 25 bp, Mus musculus
aagaatcggcctactaggacatcct

SEQ ID NO: 44146 - DNA, 25 bp, Mus musculus
aagaatcggccttctaggacatcct

SEQ ID NO: 44147 - DNA, 25 bp, Mus musculus
aagaatcggcttcgcacagtacagt

SEQ ID NO: 44148 - DNA, 25 bp, Mus musculus
aagaatcggcttggcacagtacagt

SEQ ID NO: 44149 - DNA, 25 bp, Mus musculus
aagaatctaagccaggttgccatga

SEQ ID NO: 44150 - DNA, 25 bp, Mus musculus
aagaatctaagcgaggttgccatga

SEQ ID NO: 44151 - DNA, 25 bp, Mus musculus
aagaatctagaaaagtggtgcagaa

SEQ ID NO: 44152 - DNA, 25 bp, Mus musculus
aagaatctagaatagtggtgcagaa

SEQ ID NO: 44153 - DNA, 25 bp, Mus musculus
aagaatctataaacttcccatcgaa

SEQ ID NO: 44154 - DNA, 25 bp, Mus musculus
aagaatctataatcttcccatcgaa

SEQ ID NO: 44155 - DNA, 25 bp, Mus musculus
aagaatctcttcaagacttccctgg

SEQ ID NO: 44156 - DNA, 25 bp, Mus musculus
aagaatctcttctagacttccctgg

SEQ ID NO: 44157 - DNA, 25 bp, Mus musculus
aagaatctgactctggaattcctcc

SEQ ID NO: 44158 - DNA, 25 bp, Mus musculus
aagaatctgactgtggaattcctcc

SEQ ID NO: 44159 - DNA, 25 bp, Mus musculus
aagaatctgagtatgggcaagccca

SEQ ID NO: 44160 - DNA, 25 bp, Mus musculus
aagaatctgagtttgggcaagccca

SEQ ID NO: 44161 - DNA, 25 bp, Mus musculus
aagaatctgatcaactttaagcaag

SEQ ID NO: 44162 - DNA, 25 bp, Mus musculus
aagaatctgatctactttaagcaag

SEQ ID NO: 44163 - DNA, 25 bp, Mus musculus
aagaatctgccaaaagagctggccc

SEQ ID NO: 44164 - DNA, 25 bp, Mus musculus
aagaatctgccataagagctggccc

SEQ ID NO: 44165 - DNA, 25 bp, Mus musculus
aagaatctgcttactttccagtctt

SEQ ID NO: 44166 - DNA, 25 bp, Mus musculus
aagaatctgctttctttccagtctt

SEQ ID NO: 44167 - DNA, 25 bp, Mus musculus
aagaatctggctcgagactggagat

SEQ ID NO: 44168 - DNA, 25 bp, Mus musculus
aagaatctggctggagactggagat

SEQ ID NO: 44169 - DNA, 25 bp, Mus musculus
aagaatctgtgtctgtctgggaaac

SEQ ID NO: 44170 - DNA, 25 bp, Mus musculus
aagaatctgtgtgtgtctgggaaac

SEQ ID NO: 44171 - DNA, 25 bp, Mus musculus
aagaatcttcgacacggactggaga

SEQ ID NO: 44172 - DNA, 25 bp, Mus musculus
aagaatcttcgagacggactggaga

SEQ ID NO: 44173 - DNA, 25 bp, Mus musculus
aagaatcttcggagaacttcccaag

SEQ ID NO: 44174 - DNA, 25 bp, Mus musculus
aagaatcttcggtgaacttcccaag

SEQ ID NO: 44175 - DNA, 25 bp, Mus musculus
aagaatcttgccaaacctgtcagag

SEQ ID NO: 44176 - DNA, 25 bp, Mus musculus
aagaatcttgcctaacctgtcagag

SEQ ID NO: 44177 - DNA, 25 bp, Mus musculus
aagaatcttgctcctgtcttattcc

SEQ ID NO: 44178 - DNA, 25 bp, Mus musculus
aagaatcttgctgctgtcttattcc

SEQ ID NO: 44179 - DNA, 25 bp, Mus musculus
aagaatgaaattacgccgggcagtg

SEQ ID NO: 44180 - DNA, 25 bp, Mus musculus
aagaatgaaatttcgccgggcagtg

SEQ ID NO: 44181 - DNA, 25 bp, Mus musculus
aagaatgaacgactccgtgctgcct

SEQ ID NO: 44182 - DNA, 25 bp, Mus musculus
aagaatgaacgagtccgtgctgcct

SEQ ID NO: 44183 - DNA, 25 bp, Mus musculus
aagaatgaaggcagccaggtgtacg

SEQ ID NO: 44184 - DNA, 25 bp, Mus musculus
aagaatgaaggctgccaggtgtacg

SEQ ID NO: 44185 - DNA, 25 bp, Mus musculus
aagaatgacctgattgaccgtgttg

SEQ ID NO: 44186 - DNA, 25 bp, Mus musculus
aagaatgacctgtttgaccgtgttg

SEQ ID NO: 44187 - DNA, 25 bp, Mus musculus
aagaatgagcccagaagaactagcc

SEQ ID NO: 44188 - DNA, 25 bp, Mus musculus
aagaatgagccctgaagaactagcc

SEQ ID NO: 44189 - DNA, 25 bp, Mus musculus
aagaatgagtgtcccacaggcctgg

SEQ ID NO: 44190 - DNA, 25 bp, Mus musculus
aagaatgagtgtgccacaggcctgg

SEQ ID NO: 44191 - DNA, 25 bp, Mus musculus
aagaatgatcgtattccagccagca

SEQ ID NO: 44192 - DNA, 25 bp, Mus musculus
aagaatgatcgttttccagccagca

SEQ ID NO: 44193 - DNA, 25 bp, Mus musculus
aagaatgatgcccaaacccaacgct

SEQ ID NO: 44194 - DNA, 25 bp, Mus musculus
aagaatgatgccgaaacccaacgct

SEQ ID NO: 44195 - DNA, 25 bp, Mus musculus
aagaatgatggaccccagtctaccc

SEQ ID NO: 44196 - DNA, 25 bp, Mus musculus
aagaatgatggagcccagtctaccc

SEQ ID NO: 44197 - DNA, 25 bp, Mus musculus
aagaatgatgtcagccgtccagggc

SEQ ID NO: 44198 - DNA, 25 bp, Mus musculus
aagaatgatgtctgccgtccagggc

SEQ ID NO: 44199 - DNA, 25 bp, Mus musculus
aagaatgcaacgacagttcccctta

SEQ ID NO: 44200 - DNA, 25 bp, Mus musculus
aagaatgcaacgtcagttcccctta

SEQ ID NO: 44201 - DNA, 25 bp, Mus musculus
aagaatgcacatcccctgactctag

SEQ ID NO: 44202 - DNA, 25 bp, Mus musculus
aagaatgcacatgccctgactctag

SEQ ID NO: 44203 - DNA, 25 bp, Mus musculus
aagaatgcacttatagctgactagg

SEQ ID NO: 44204 - DNA, 25 bp, Mus musculus
aagaatgcacttttagctgactagg

SEQ ID NO: 44205 - DNA, 25 bp, Mus musculus
aagaatgcagacacgtctcagctgg

SEQ ID NO: 44206 - DNA, 25 bp, Mus musculus
aagaatgcagactcgtctcagctgg

SEQ ID NO: 44207 - DNA, 25 bp, Mus musculus
aagaatgcatctacctctcatgtac

SEQ ID NO: 44208 - DNA, 25 bp, Mus musculus
aagaatgcatcttcctctcatgtac

SEQ ID NO: 44209 - DNA, 25 bp, Mus musculus
aagaatgccaaccacttttgtctct

SEQ ID NO: 44210 - DNA, 25 bp, Mus musculus
aagaatgccaacgacttttgtctct

SEQ ID NO: 44211 - DNA, 25 bp, Mus musculus
aagaatgccacacacctttccgtag

SEQ ID NO: 44212 - DNA, 25 bp, Mus musculus
aagaatgccacagacctttccgtag

SEQ ID NO: 44213 - DNA, 25 bp, Mus musculus
aagaatgccatcctgcttagagcca

SEQ ID NO: 44214 - DNA, 25 bp, Mus musculus
aagaatgccatcgtgcttagagcca

SEQ ID NO: 44215 - DNA, 25 bp, Mus musculus
aagaatgcccacaatagatccataa

SEQ ID NO: 44216 - DNA, 25 bp, Mus musculus
aagaatgcccactatagatccataa

SEQ ID NO: 44217 - DNA, 25 bp, Mus musculus
aagaatgcccagaagctctgtgtcc

SEQ ID NO: 44218 - DNA, 25 bp, Mus musculus
aagaatgcccagcagtagctctcac

SEQ ID NO: 44219 - DNA, 25 bp, Mus musculus
aagaatgcccaggagtagctctcac

SEQ ID NO: 44220 - DNA, 25 bp, Mus musculus
aagaatgcccagtagctctgtgtcc

SEQ ID NO: 44221 - DNA, 25 bp, Mus musculus
aagaatgcccttacttattatgtgg

SEQ ID NO: 44222 - DNA, 25 bp, Mus musculus
aagaatgccctttcttattatgtgg

SEQ ID NO: 44223 - DNA, 25 bp, Mus musculus
aagaatgccgcaacaccgagtgggt

SEQ ID NO: 44224 - DNA, 25 bp, Mus musculus
aagaatgccgcatcaccgagtgggt

SEQ ID NO: 44225 - DNA, 25 bp, Mus musculus
aagaatgccgttagacgcacgctgt

SEQ ID NO: 44226 - DNA, 25 bp, Mus musculus
aagaatgccgtttgacgcacgctgt

SEQ ID NO: 44227 - DNA, 25 bp, Mus musculus
aagaatgcctgcagggattgctcgc

SEQ ID NO: 44228 - DNA, 25 bp, Mus musculus
aagaatgcctgctgggattgctcgc

SEQ ID NO: 44229 - DNA, 25 bp, Mus musculus
aagaatgcctggaaaatgaagcccc

SEQ ID NO: 44230 - DNA, 25 bp, Mus musculus
aagaatgcctggtaaatgaagcccc

SEQ ID NO: 44231 - DNA, 25 bp, Mus musculus
aagaatgccttcaccgaggaagtaa

SEQ ID NO: 44232 - DNA, 25 bp, Mus musculus
aagaatgccttctccgaggaagtaa

SEQ ID NO: 44233 - DNA, 25 bp, Mus musculus
aagaatgcgcccaggaaacctggcc

SEQ ID NO: 44234 - DNA, 25 bp, Mus musculus
aagaatgcgccctggaaacctggcc

SEQ ID NO: 44235 - DNA, 25 bp, Mus musculus
aagaatgcgtccactttatccactc

SEQ ID NO: 44236 - DNA, 25 bp, Mus musculus
aagaatgcgtcctctttatccactc

SEQ ID NO: 44237 - DNA, 25 bp, Mus musculus
aagaatgctataatcctgggtggac

SEQ ID NO: 44238 - DNA, 25 bp, Mus musculus
aagaatgctatattcctgggtggac

SEQ ID NO: 44239 - DNA, 25 bp, Mus musculus
aagaatgctcacaagtggacatgat

SEQ ID NO: 44240 - DNA, 25 bp, Mus musculus
aagaatgctcactagtggacatgat

SEQ ID NO: 44241 - DNA, 25 bp, Mus musculus
aagaatgctcagaaccaggtgatgt

SEQ ID NO: 44242 - DNA, 25 bp, Mus musculus
aagaatgctcagtaccaggtgatgt

SEQ ID NO: 44243 - DNA, 25 bp, Mus musculus
aagaatgctgggatctgattgtttt

SEQ ID NO: 44244 - DNA, 25 bp, Mus musculus
aagaatgctgggttctgattgtttt

SEQ ID NO: 44245 - DNA, 25 bp, Mus musculus
aagaatggaaaactgccctggcaaa

SEQ ID NO: 44246 - DNA, 25 bp, Mus musculus
aagaatggaaaagtgccctggcaaa

SEQ ID NO: 44247 - DNA, 25 bp, Mus musculus
aagaatggaaggctcccttagaagc

SEQ ID NO: 44248 - DNA, 25 bp, Mus musculus
aagaatggaagggtcccttagaagc

SEQ ID NO: 44249 - DNA, 25 bp, Mus musculus
aagaatggacagctggccaaggaac

SEQ ID NO: 44250 - DNA, 25 bp, Mus musculus
aagaatggacaggtggccaaggaac

SEQ ID NO: 44251 - DNA, 25 bp, Mus musculus
aagaatggacccctacatgttgttc

SEQ ID NO: 44252 - DNA, 25 bp, Mus musculus
aagaatggacccgtacatgttgttc

SEQ ID NO: 44253 - DNA, 25 bp, Mus musculus
aagaatggccaacatcccgaagaaa

SEQ ID NO: 44254 - DNA, 25 bp, Mus musculus
aagaatggccaagatcccgaagaaa

SEQ ID NO: 44255 - DNA, 25 bp, Mus musculus
aagaatggccaccttctgttctact

SEQ ID NO: 44256 - DNA, 25 bp, Mus musculus
aagaatggccacgttctgttctact

SEQ ID NO: 44257 - DNA, 25 bp, Mus musculus
aagaatggccatactggtgatgtca

SEQ ID NO: 44258 - DNA, 25 bp, Mus musculus
aagaatggccattctggtgatgtca

SEQ ID NO: 44259 - DNA, 25 bp, Mus musculus
aagaatggcctaaccttgtggcgac

SEQ ID NO: 44260 - DNA, 25 bp, Mus musculus
aagaatggcctatccttgtggcgac

SEQ ID NO: 44261 - DNA, 25 bp, Mus musculus
aagaatggctggattggccatgcat

SEQ ID NO: 44262 - DNA, 25 bp, Mus musculus
aagaatggctggtttggccatgcat

SEQ ID NO: 44263 - DNA, 25 bp, Mus musculus
aagaatgggcatactctctaggaga

SEQ ID NO: 44264 - DNA, 25 bp, Mus musculus
aagaatgggcattctctctaggaga

SEQ ID NO: 44265 - DNA, 25 bp, Mus musculus
aagaatggtactcctaccccagtga

SEQ ID NO: 44266 - DNA, 25 bp, Mus musculus
aagaatggtactgctaccccagtga

SEQ ID NO: 44267 - DNA, 25 bp, Mus musculus
aagaatggtctcagtacctcatgcc

SEQ ID NO: 44268 - DNA, 25 bp, Mus musculus
aagaatggtctctgtacctcatgcc

SEQ ID NO: 44269 - DNA, 25 bp, Mus musculus
aagaatggttgtcctcttggtgcct

SEQ ID NO: 44270 - DNA, 25 bp, Mus musculus
aagaatggttgtgctcttggtgcct

SEQ ID NO: 44271 - DNA, 25 bp, Mus musculus
aagaatgtaaaccatccgccggacg

SEQ ID NO: 44272 - DNA, 25 bp, Mus musculus
aagaatgtaaacgatccgccggacg

SEQ ID NO: 44273 - DNA, 25 bp, Mus musculus
aagaatgtaacacctcagcctccct

SEQ ID NO: 44274 - DNA, 25 bp, Mus musculus
aagaatgtaacagctcagcctccct

SEQ ID NO: 44275 - DNA, 25 bp, Mus musculus
aagaatgtaggcaatctaaaaagac

SEQ ID NO: 44276 - DNA, 25 bp, Mus musculus
aagaatgtaggctatctaaaaagac

SEQ ID NO: 44277 - DNA, 25 bp, Mus musculus
aagaatgtataaccgcctgctcttg

SEQ ID NO: 44278 - DNA, 25 bp, Mus musculus
aagaatgtataagcgcctgctcttg

SEQ ID NO: 44279 - DNA, 25 bp, Mus musculus
aagaatgtatacatgcctaagaagc

SEQ ID NO: 44280 - DNA, 25 bp, Mus musculus
aagaatgtatacttgcctaagaagc

SEQ ID NO: 44281 - DNA, 25 bp, Mus musculus
aagaatgtatcacgccgggaagcca

SEQ ID NO: 44282 - DNA, 25 bp, Mus musculus
aagaatgtatcaggccgggaagcca

SEQ ID NO: 44283 - DNA, 25 bp, Mus musculus
aagaatgtcatcatcgtaccacgaa

SEQ ID NO: 44284 - DNA, 25 bp, Mus musculus
aagaatgtcatcctctgtgttctct

SEQ ID NO: 44285 - DNA, 25 bp, Mus musculus
aagaatgtcatcgtctgtgttctct

SEQ ID NO: 44286 - DNA, 25 bp, Mus musculus
aagaatgtcatcttcgtaccacgaa

SEQ ID NO: 44287 - DNA, 25 bp, Mus musculus
aagaatgtccccaacgtatttgtgc

SEQ ID NO: 44288 - DNA, 25 bp, Mus musculus
aagaatgtcccctacgtatttgtgc

SEQ ID NO: 44289 - DNA, 25 bp, Mus musculus
aagaatgtctagaggccacggaacg

SEQ ID NO: 44290 - DNA, 25 bp, Mus musculus
aagaatgtctagtggccacggaacg

SEQ ID NO: 44291 - DNA, 25 bp, Mus musculus
aagaatgtcttcagcaccttccgaa

SEQ ID NO: 44292 - DNA, 25 bp, Mus musculus
aagaatgtcttcatgcatgcaacaa

SEQ ID NO: 44293 - DNA, 25 bp, Mus musculus
aagaatgtcttctgcaccttccgaa

SEQ ID NO: 44294 - DNA, 25 bp, Mus musculus
aagaatgtcttcttgcatgcaacaa

SEQ ID NO: 44295 - DNA, 25 bp, Mus musculus
aagaatgtgaaaagcagaccatggg

SEQ ID NO: 44296 - DNA, 25 bp, Mus musculus
aagaatgtgaaatgcagaccatggg

SEQ ID NO: 44297 - DNA, 25 bp, Mus musculus
aagaatgtgcacaagctgctgcctt

SEQ ID NO: 44298 - DNA, 25 bp, Mus musculus
aagaatgtgcactagctgctgcctt

SEQ ID NO: 44299 - DNA, 25 bp, Mus musculus
aagaatgtgccacgctctaaggagg

SEQ ID NO: 44300 - DNA, 25 bp, Mus musculus
aagaatgtgccaggctctaaggagg

SEQ ID NO: 44301 - DNA, 25 bp, Mus musculus
aagaatgtgcccagccacagcgtta

SEQ ID NO: 44302 - DNA, 25 bp, Mus musculus
aagaatgtgcccaggtaccgagtgc

SEQ ID NO: 44303 - DNA, 25 bp, Mus musculus
aagaatgtgccctgccacagcgtta

SEQ ID NO: 44304 - DNA, 25 bp, Mus musculus
aagaatgtgccctggtaccgagtgc

SEQ ID NO: 44305 - DNA, 25 bp, Mus musculus
aagaatgtgctcagtctggctctgc

SEQ ID NO: 44306 - DNA, 25 bp, Mus musculus
aagaatgtgctctgtctggctctgc

SEQ ID NO: 44307 - DNA, 25 bp, Mus musculus
aagaatgtgtaccagcagctactta

SEQ ID NO: 44308 - DNA, 25 bp, Mus musculus
aagaatgtgtacgagcagctactta

SEQ ID NO: 44309 - DNA, 25 bp, Mus musculus
aagaatgttcagctgctgactcccc

SEQ ID NO: 44310 - DNA, 25 bp, Mus musculus
aagaatgttcaggtgctgactcccc

SEQ ID NO: 44311 - DNA, 25 bp, Mus musculus
aagaatgttgagctcctggccagca

SEQ ID NO: 44312 - DNA, 25 bp, Mus musculus
aagaatgttgaggtcctggccagca

SEQ ID NO: 44313 - DNA, 25 bp, Mus musculus
aagaatgttggtaggcgccttgatt

SEQ ID NO: 44314 - DNA, 25 bp, Mus musculus
aagaatgttggttggcgccttgatt

SEQ ID NO: 44315 - DNA, 25 bp, Mus musculus
aagaatgttgtaaggcttcctaata

SEQ ID NO: 44316 - DNA, 25 bp, Mus musculus
aagaatgttgtatggcttcctaata

SEQ ID NO: 44317 - DNA, 25 bp, Mus musculus
aagaatgtttataacctcctggaga

SEQ ID NO: 44318 - DNA, 25 bp, Mus musculus
aagaatgtttattacctcctggaga

SEQ ID NO: 44319 - DNA, 25 bp, Mus musculus
aagaatgttttaccctgtagactca

SEQ ID NO: 44320 - DNA, 25 bp, Mus musculus
aagaatgttttagcctgtagactca

SEQ ID NO: 44321 - DNA, 25 bp, Mus musculus
aagaattaaagtacctgttcctcat

SEQ ID NO: 44322 - DNA, 25 bp, Mus musculus
aagaattaaagttcctgttcctcat

SEQ ID NO: 44323 - DNA, 25 bp, Mus musculus
aagaattacaacaccacttccacct

SEQ ID NO: 44324 - DNA, 25 bp, Mus musculus
aagaattacaactccacttccacct

SEQ ID NO: 44325 - DNA, 25 bp, Mus musculus
aagaattacaggacccaggccaagt

SEQ ID NO: 44326 - DNA, 25 bp, Mus musculus
aagaattacaggaggattccccagt

SEQ ID NO: 44327 - DNA, 25 bp, Mus musculus
aagaattacaggtcccaggccaagt

SEQ ID NO: 44328 - DNA, 25 bp, Mus musculus
aagaattacaggtggattccccagt

SEQ ID NO: 44329 - DNA, 25 bp, Mus musculus
aagaattacgctagcctttgtcgct

SEQ ID NO: 44330 - DNA, 25 bp, Mus musculus
aagaattacgcttgcctttgtcgct

SEQ ID NO: 44331 - DNA, 25 bp, Mus musculus
aagaattactaccagtcccaccttg

SEQ ID NO: 44332 - DNA, 25 bp, Mus musculus
aagaattactacgagtcccaccttg

SEQ ID NO: 44333 - DNA, 25 bp, Mus musculus
aagaattactccatgggacctcatg

SEQ ID NO: 44334 - DNA, 25 bp, Mus musculus
aagaattactccttgggacctcatg

SEQ ID NO: 44335 - DNA, 25 bp, Mus musculus
aagaattactcgatattcattttat

SEQ ID NO: 44336 - DNA, 25 bp, Mus musculus
aagaattactcgttattcattttat

SEQ ID NO: 44337 - DNA, 25 bp, Mus musculus
aagaattagcccagtcttcttcccg

SEQ ID NO: 44338 - DNA, 25 bp, Mus musculus
aagaattagccctgtcttcttcccg

SEQ ID NO: 44339 - DNA, 25 bp, Mus musculus
aagaattagctccaggactctatcc

SEQ ID NO: 44340 - DNA, 25 bp, Mus musculus
aagaattagctcgaggactctatcc

SEQ ID NO: 44341 - DNA, 25 bp, Mus musculus
aagaattagtccatcgggcatccct

SEQ ID NO: 44342 - DNA, 25 bp, Mus musculus
aagaattagtccttcgggcatccct

SEQ ID NO: 44343 - DNA, 25 bp, Mus musculus
aagaattagttcacgggctggtgag

SEQ ID NO: 44344 - DNA, 25 bp, Mus musculus
aagaattagttctcgggctggtgag

SEQ ID NO: 44345 - DNA, 25 bp, Mus musculus
aagaattattctcctgtgggctcat

SEQ ID NO: 44346 - DNA, 25 bp, Mus musculus
aagaattattctgctgtgggctcat

SEQ ID NO: 44347 - DNA, 25 bp, Mus musculus
aagaattcacttctctggtttaaat

SEQ ID NO: 44348 - DNA, 25 bp, Mus musculus
aagaattcacttgtctggtttaaat

SEQ ID NO: 44349 - DNA, 25 bp, Mus musculus
aagaattcagcaatcctctttggag

SEQ ID NO: 44350 - DNA, 25 bp, Mus musculus
aagaattcagcattcctctttggag

SEQ ID NO: 44351 - DNA, 25 bp, Mus musculus
aagaattcagctaacgcttccagac

SEQ ID NO: 44352 - DNA, 25 bp, Mus musculus
aagaattcagcttacgcttccagac

SEQ ID NO: 44353 - DNA, 25 bp, Mus musculus
aagaattcagtgctccagttgggtg

SEQ ID NO: 44354 - DNA, 25 bp, Mus musculus
aagaattcagtggtccagttgggtg

SEQ ID NO: 44355 - DNA, 25 bp, Mus musculus
aagaattcattgacctctggagaca

SEQ ID NO: 44356 - DNA, 25 bp, Mus musculus
aagaattcattgtcctctggagaca

SEQ ID NO: 44357 - DNA, 25 bp, Mus musculus
aagaattcatttccaccctggatta

SEQ ID NO: 44358 - DNA, 25 bp, Mus musculus
aagaattcatttgcaccctggatta

SEQ ID NO: 44359 - DNA, 25 bp, Mus musculus
aagaattcccagatctatgtacata

SEQ ID NO: 44360 - DNA, 25 bp, Mus musculus
aagaattcccagttctatgtacata

SEQ ID NO: 44361 - DNA, 25 bp, Mus musculus
aagaattccctgagtagtactgatg

SEQ ID NO: 44362 - DNA, 25 bp, Mus musculus
aagaattccctgtgtagtactgatg

SEQ ID NO: 44363 - DNA, 25 bp, Mus musculus
aagaattccggaactgctcagtata

SEQ ID NO: 44364 - DNA, 25 bp, Mus musculus
aagaattccggatctgctcagtata

SEQ ID NO: 44365 - DNA, 25 bp, Mus musculus
aagaattcctgtagctgagggccct

SEQ ID NO: 44366 - DNA, 25 bp, Mus musculus
aagaattcctgttgctgagggccct

SEQ ID NO: 44367 - DNA, 25 bp, Mus musculus
aagaattctcagctcatcataatta

SEQ ID NO: 44368 - DNA, 25 bp, Mus musculus
aagaattctcaggtcatcataatta

SEQ ID NO: 44369 - DNA, 25 bp, Mus musculus
aagaattctgtccttacatttgcaa

SEQ ID NO: 44370 - DNA, 25 bp, Mus musculus
aagaattctgtcgttacatttgcaa

SEQ ID NO: 44371 - DNA, 25 bp, Mus musculus
aagaattctgttacactttgagatt

SEQ ID NO: 44372 - DNA, 25 bp, Mus musculus
aagaattctgtttcactttgagatt

SEQ ID NO: 44373 - DNA, 25 bp, Mus musculus
aagaattcttccaccctcgatacca

SEQ ID NO: 44374 - DNA, 25 bp, Mus musculus
aagaattcttcctccctcgatacca

SEQ ID NO: 44375 - DNA, 25 bp, Mus musculus
aagaattgcaggaaacctcggccgg

SEQ ID NO: 44376 - DNA, 25 bp, Mus musculus
aagaattgcaggtaacctcggccgg

SEQ ID NO: 44377 - DNA, 25 bp, Mus musculus
aagaattgctcaccctggccttggg

SEQ ID NO: 44378 - DNA, 25 bp, Mus musculus
aagaattgctcagcctggccttggg

SEQ ID NO: 44379 - DNA, 25 bp, Mus musculus
aagaattgcttcctgtttacagtgg

SEQ ID NO: 44380 - DNA, 25 bp, Mus musculus
aagaattgcttcgtgtttacagtgg

SEQ ID NO: 44381 - DNA, 25 bp, Mus musculus
aagaattgggacctcgcttgggatc

SEQ ID NO: 44382 - DNA, 25 bp, Mus musculus
aagaattgggacgtcgcttgggatc

SEQ ID NO: 44383 - DNA, 25 bp, Mus musculus
aagaattgtcctcctgtaggttcca

SEQ ID NO: 44384 - DNA, 25 bp, Mus musculus
aagaattgtcctgctgtaggttcca

SEQ ID NO: 44385 - DNA, 25 bp, Mus musculus
aagaattgtgcgacgggctaacgca

SEQ ID NO: 44386 - DNA, 25 bp, Mus musculus
aagaattgtgcgagtaactctacag

SEQ ID NO: 44387 - DNA, 25 bp, Mus musculus
aagaattgtgcgtcgggctaacgca

SEQ ID NO: 44388 - DNA, 25 bp, Mus musculus
aagaattgtgcgtgtaactctacag

SEQ ID NO: 44389 - DNA, 25 bp, Mus musculus
aagaattgttacacattgtcacgtt

SEQ ID NO: 44390 - DNA, 25 bp, Mus musculus
aagaattgttactcattgtcacgtt

SEQ ID NO: 44391 - DNA, 25 bp, Mus musculus
aagaattgttgcagcagtcttcctg

SEQ ID NO: 44392 - DNA, 25 bp, Mus musculus
aagaattgttgctgcagtcttcctg

SEQ ID NO: 44393 - DNA, 25 bp, Mus musculus
aagaatttaactccacttgtgagat

SEQ ID NO: 44394 - DNA, 25 bp, Mus musculus
aagaatttaactgcacttgtgagat

SEQ ID NO: 44395 - DNA, 25 bp, Mus musculus
aagaatttagccactcactctgaca

SEQ ID NO: 44396 - DNA, 25 bp, Mus musculus
aagaatttagcctctcactctgaca

SEQ ID NO: 44397 - DNA, 25 bp, Mus musculus
aagaatttagtcactccactgagca

SEQ ID NO: 44398 - DNA, 25 bp, Mus musculus
aagaatttagtctctccactgagca

SEQ ID NO: 44399 - DNA, 25 bp, Mus musculus
aagaatttattacacctcaggagca

SEQ ID NO: 44400 - DNA, 25 bp, Mus musculus
aagaatttattagacctcaggagca

SEQ ID NO: 44401 - DNA, 25 bp, Mus musculus
aagaatttattgacctcgggctggt

SEQ ID NO: 44402 - DNA, 25 bp, Mus musculus
aagaatttattgtcctcgggctggt

SEQ ID NO: 44403 - DNA, 25 bp, Mus musculus
aagaatttcactccaaagacctctt

SEQ ID NO: 44404 - DNA, 25 bp, Mus musculus
aagaatttcactgcaaagacctctt

SEQ ID NO: 44405 - DNA, 25 bp, Mus musculus
aagaatttccagaagcacatgcgct

SEQ ID NO: 44406 - DNA, 25 bp, Mus musculus
aagaatttccagtagcacatgcgct

SEQ ID NO: 44407 - DNA, 25 bp, Mus musculus
aagaatttctctacctgatgtaaaa

SEQ ID NO: 44408 - DNA, 25 bp, Mus musculus
aagaatttctcttcctgatgtaaaa

SEQ ID NO: 44409 - DNA, 25 bp, Mus musculus
aagaatttgaatctcccacctgtat

SEQ ID NO: 44410 - DNA, 25 bp, Mus musculus
aagaatttgaatgtcccacctgtat

SEQ ID NO: 44411 - DNA, 25 bp, Mus musculus
aagaatttgacaaccgcggctggct

SEQ ID NO: 44412 - DNA, 25 bp, Mus musculus
aagaatttgacatccgcggctggct

SEQ ID NO: 44413 - DNA, 25 bp, Mus musculus
aagaatttgaggctgcactctccct

SEQ ID NO: 44414 - DNA, 25 bp, Mus musculus
aagaatttgagggtgcactctccct

SEQ ID NO: 44415 - DNA, 25 bp, Mus musculus
aagaatttgagtcccgcttgccaag

SEQ ID NO: 44416 - DNA, 25 bp, Mus musculus
aagaatttgagtgccgcttgccaag

SEQ ID NO: 44417 - DNA, 25 bp, Mus musculus
aagaatttgcgaacgtgcccttgca

SEQ ID NO: 44418 - DNA, 25 bp, Mus musculus
aagaatttgcgatcgtgcccttgca

SEQ ID NO: 44419 - DNA, 25 bp, Mus musculus
aagaatttggcccagttagtcactc

SEQ ID NO: 44420 - DNA, 25 bp, Mus musculus
aagaatttggccgagttagtcactc

SEQ ID NO: 44421 - DNA, 25 bp, Mus musculus
aagaatttggttctgctcgtttcag

SEQ ID NO: 44422 - DNA, 25 bp, Mus musculus
aagaatttggttgtgctcgtttcag

SEQ ID NO: 44423 - DNA, 25 bp, Mus musculus
aagaatttgtacagctcctccataa

SEQ ID NO: 44424 - DNA, 25 bp, Mus musculus
aagaatttgtactgctcctccataa

SEQ ID NO: 44425 - DNA, 25 bp, Mus musculus
aagaatttgtctcctcccagatgta

SEQ ID NO: 44426 - DNA, 25 bp, Mus musculus
aagaatttgtctgctcccagatgta

SEQ ID NO: 44427 - DNA, 25 bp, Mus musculus
aagaatttgttcctgagggactgga

SEQ ID NO: 44428 - DNA, 25 bp, Mus musculus
aagaatttgttcgtgagggactgga

SEQ ID NO: 44429 - DNA, 25 bp, Mus musculus
aagaattttcacaaatgagcctcga

SEQ ID NO: 44430 - DNA, 25 bp, Mus musculus
aagaattttcactaatgagcctcga

SEQ ID NO: 44431 - DNA, 25 bp, Mus musculus
aagaattttgaaaggctgggtatcg

SEQ ID NO: 44432 - DNA, 25 bp, Mus musculus
aagaattttgaatggctgggtatcg

SEQ ID NO: 44433 - DNA, 25 bp, Mus musculus
aagacaaaaacacagtcccctatgt

SEQ ID NO: 44434 - DNA, 25 bp, Mus musculus
aagacaaaaacagagtcccctatgt

SEQ ID NO: 44435 - DNA, 25 bp, Mus musculus
aagacaaaagtgcttgcccttccta

SEQ ID NO: 44436 - DNA, 25 bp, Mus musculus
aagacaaaagtggttgcccttccta

SEQ ID NO: 44437 - DNA, 25 bp, Mus musculus
aagacaaacaaaaccttgcctccat

SEQ ID NO: 44438 - DNA, 25 bp, Mus musculus
aagacaaacaaatccttgcctccat

SEQ ID NO: 44439 - DNA, 25 bp, Mus musculus
aagacaaacactcgctcggcgatgc

SEQ ID NO: 44440 - DNA, 25 bp, Mus musculus
aagacaaacactggctcggcgatgc

SEQ ID NO: 44441 - DNA, 25 bp, Mus musculus
aagacaaacctacaagctgccacta

SEQ ID NO: 44442 - DNA, 25 bp, Mus musculus
aagacaaacctagaagctgccacta

SEQ ID NO: 44443 - DNA, 25 bp, Mus musculus
aagacaaactctattcctgcattcc

SEQ ID NO: 44444 - DNA, 25 bp, Mus musculus
aagacaaactcttttcctgcattcc

SEQ ID NO: 44445 - DNA, 25 bp, Mus musculus
aagacaaactgtagcatttccaccc

SEQ ID NO: 44446 - DNA, 25 bp, Mus musculus
aagacaaactgttgcatttccaccc

SEQ ID NO: 44447 - DNA, 25 bp, Mus musculus
aagacaaactttccagtaagcggac

SEQ ID NO: 44448 - DNA, 25 bp, Mus musculus
aagacaaactttgcagtaagcggac

SEQ ID NO: 44449 - DNA, 25 bp, Mus musculus
aagacaaagcagatactcttctatc

SEQ ID NO: 44450 - DNA, 25 bp, Mus musculus
aagacaaagcagttactcttctatc

SEQ ID NO: 44451 - DNA, 25 bp, Mus musculus
aagacaaagcgacgttgggtccctg

SEQ ID NO: 44452 - DNA, 25 bp, Mus musculus
aagacaaagcgaggttgggtccctg

SEQ ID NO: 44453 - DNA, 25 bp, Mus musculus
aagacaaagtgtcctctgaagacca

SEQ ID NO: 44454 - DNA, 25 bp, Mus musculus
aagacaaagtgtgctctgaagacca

SEQ ID NO: 44455 - DNA, 25 bp, Mus musculus
aagacaaatagtcctaagtgtaaat

SEQ ID NO: 44456 - DNA, 25 bp, Mus musculus
aagacaaatagtgctaagtgtaaat

SEQ ID NO: 44457 - DNA, 25 bp, Mus musculus
aagacaaatgacctgctgcttctag

SEQ ID NO: 44458 - DNA, 25 bp, Mus musculus
aagacaaatgacgtgctgcttctag

SEQ ID NO: 44459 - DNA, 25 bp, Mus musculus
aagacaaattctagcctctcttctc

SEQ ID NO: 44460 - DNA, 25 bp, Mus musculus
aagacaaattcttgcctctcttctc

SEQ ID NO: 44461 - DNA, 25 bp, Mus musculus
aagacaaatttcacagccataactg

SEQ ID NO: 44462 - DNA, 25 bp, Mus musculus
aagacaaatttcattaagattcatc

SEQ ID NO: 44463 - DNA, 25 bp, Mus musculus
aagacaaatttctcagccataactg

SEQ ID NO: 44464 - DNA, 25 bp, Mus musculus
aagacaaatttctttaagattcatc

SEQ ID NO: 44465 - DNA, 25 bp, Mus musculus
aagacaacaagcagagacacacctc

SEQ ID NO: 44466 - DNA, 25 bp, Mus musculus
aagacaacaagctgagacacacctc

SEQ ID NO: 44467 - DNA, 25 bp, Mus musculus
aagacaacagctccaggctttcagc

SEQ ID NO: 44468 - DNA, 25 bp, Mus musculus
aagacaacagctgcaggctttcagc

SEQ ID NO: 44469 - DNA, 25 bp, Mus musculus
aagacaacagtaacgcctgtctggc

SEQ ID NO: 44470 - DNA, 25 bp, Mus musculus
aagacaacagtatcgcctgtctggc

SEQ ID NO: 44471 - DNA, 25 bp, Mus musculus
aagacaacatgcagtcctctcaagg

SEQ ID NO: 44472 - DNA, 25 bp, Mus musculus
aagacaacatgctgtcctctcaagg

SEQ ID NO: 44473 - DNA, 25 bp, Mus musculus
aagacaaccaagaccttcaagccta

SEQ ID NO: 44474 - DNA, 25 bp, Mus musculus
aagacaaccaagtccttcaagccta

SEQ ID NO: 44475 - DNA, 25 bp, Mus musculus
aagacaaccaccaagcactcatttg

SEQ ID NO: 44476 - DNA, 25 bp, Mus musculus
aagacaaccacctagcactcatttg

SEQ ID NO: 44477 - DNA, 25 bp, Mus musculus
aagacaaccagcacaatgtccttag

SEQ ID NO: 44478 - DNA, 25 bp, Mus musculus
aagacaaccagctcaatgtccttag

SEQ ID NO: 44479 - DNA, 25 bp, Mus musculus
aagacaacccaaaatctgccacaga

SEQ ID NO: 44480 - DNA, 25 bp, Mus musculus
aagacaacccaatatctgccacaga

SEQ ID NO: 44481 - DNA, 25 bp, Mus musculus
aagacaacccgaaggtggtgcatgc

SEQ ID NO: 44482 - DNA, 25 bp, Mus musculus
aagacaacccgatggtggtgcatgc

SEQ ID NO: 44483 - DNA, 25 bp, Mus musculus
aagacaacctatctgctgtgtacac

SEQ ID NO: 44484 - DNA, 25 bp, Mus musculus
aagacaacctatgtgctgtgtacac

SEQ ID NO: 44485 - DNA, 25 bp, Mus musculus
aagacaacctggatatcgccctgca

SEQ ID NO: 44486 - DNA, 25 bp, Mus musculus
aagacaacctggttatcgccctgca

SEQ ID NO: 44487 - DNA, 25 bp, Mus musculus
aagacaactaccagtagctccgcgg

SEQ ID NO: 44488 - DNA, 25 bp, Mus musculus
aagacaactacctgtagctccgcgg

SEQ ID NO: 44489 - DNA, 25 bp, Mus musculus
aagacaactctcagagcagctcttg

SEQ ID NO: 44490 - DNA, 25 bp, Mus musculus
aagacaactctctgagcagctcttg

SEQ ID NO: 44491 - DNA, 25 bp, Mus musculus
aagacaacttggagctcatcctcac

SEQ ID NO: 44492 - DNA, 25 bp, Mus musculus
aagacaacttggtgctcatcctcac

SEQ ID NO: 44493 - DNA, 25 bp, Mus musculus
aagacaagacaaatgtgcccaggga

SEQ ID NO: 44494 - DNA, 25 bp, Mus musculus
aagacaagacaattgtgcccaggga

SEQ ID NO: 44495 - DNA, 25 bp, Mus musculus
aagacaagagcaccagcacccggca

SEQ ID NO: 44496 - DNA, 25 bp, Mus musculus
aagacaagagcagcagcacccggca

SEQ ID NO: 44497 - DNA, 25 bp, Mus musculus
aagacaagatcaccaccaggacgct

SEQ ID NO: 44498 - DNA, 25 bp, Mus musculus
aagacaagatcagcaccaggacgct

SEQ ID NO: 44499 - DNA, 25 bp, Mus musculus
aagacaagccacagaattttctaag

SEQ ID NO: 44500 - DNA, 25 bp, Mus musculus
aagacaagccactgaattttctaag

SEQ ID NO: 44501 - DNA, 25 bp, Mus musculus
aagacaagccagattctctgccaga

SEQ ID NO: 44502 - DNA, 25 bp, Mus musculus
aagacaagccagtttctctgccaga

SEQ ID NO: 44503 - DNA, 25 bp, Mus musculus
aagacaagcccaaggtgatcattat

SEQ ID NO: 44504 - DNA, 25 bp, Mus musculus
aagacaagcccatggtgatcattat

SEQ ID NO: 44505 - DNA, 25 bp, Mus musculus
aagacaagccgaaatgtttccccta

SEQ ID NO: 44506 - DNA, 25 bp, Mus musculus
aagacaagccgatatgtttccccta

SEQ ID NO: 44507 - DNA, 25 bp, Mus musculus
aagacaagccttcgtgtgcaatcac

SEQ ID NO: 44508 - DNA, 25 bp, Mus musculus
aagacaagccttggtgtgcaatcac

SEQ ID NO: 44509 - DNA, 25 bp, Mus musculus
aagacaagctagctcctgttgtact

SEQ ID NO: 44510 - DNA, 25 bp, Mus musculus
aagacaagctaggtcctgttgtact

SEQ ID NO: 44511 - DNA, 25 bp, Mus musculus
aagacaagcttcatctcagccaaga

SEQ ID NO: 44512 - DNA, 25 bp, Mus musculus
aagacaagcttcttctcagccaaga

SEQ ID NO: 44513 - DNA, 25 bp, Mus musculus
aagacaaggacaatagccccagtgt

SEQ ID NO: 44514 - DNA, 25 bp, Mus musculus
aagacaaggacattagccccagtgt

SEQ ID NO: 44515 - DNA, 25 bp, Mus musculus
aagacaaggccaaccgatacttctc

SEQ ID NO: 44516 - DNA, 25 bp, Mus musculus
aagacaaggccatccgatacttctc

SEQ ID NO: 44517 - DNA, 25 bp, Mus musculus
aagacaaggccccttacatgggcca

SEQ ID NO: 44518 - DNA, 25 bp, Mus musculus
aagacaaggcccgttacatgggcca

SEQ ID NO: 44519 - DNA, 25 bp, Mus musculus
aagacaaggctaatccaggctgggc

SEQ ID NO: 44520 - DNA, 25 bp, Mus musculus
aagacaaggctattccaggctgggc

SEQ ID NO: 44521 - DNA, 25 bp, Mus musculus
aagacaagtgctatactgcaccacc

SEQ ID NO: 44522 - DNA, 25 bp, Mus musculus
aagacaagtgctttactgcaccacc

SEQ ID NO: 44523 - DNA, 25 bp, Mus musculus
aagacaagttctctagactcttcag

SEQ ID NO: 44524 - DNA, 25 bp, Mus musculus
aagacaagttctgtagactcttcag

SEQ ID NO: 44525 - DNA, 25 bp, Mus musculus
aagacaatacaaagcaactgctatg

SEQ ID NO: 44526 - DNA, 25 bp, Mus musculus
aagacaatacaatgcaactgctatg

SEQ ID NO: 44527 - DNA, 25 bp, Mus musculus
aagacaatgtcactttttcccaggc

SEQ ID NO: 44528 - DNA, 25 bp, Mus musculus
aagacaatgtcagtttttcccaggc

SEQ ID NO: 44529 - DNA, 25 bp, Mus musculus
aagacaatgtccactgtgctgtatt

SEQ ID NO: 44530 - DNA, 25 bp, Mus musculus
aagacaatgtcctctgtgctgtatt

SEQ ID NO: 44531 - DNA, 25 bp, Mus musculus
aagacaatgtgcaatggtttcctga

SEQ ID NO: 44532 - DNA, 25 bp, Mus musculus
aagacaatgtgctatggtttcctga

SEQ ID NO: 44533 - DNA, 25 bp, Mus musculus
aagacaattcttatcctctgaaaga

SEQ ID NO: 44534 - DNA, 25 bp, Mus musculus
aagacaattcttttcctctgaaaga

SEQ ID NO: 44535 - DNA, 25 bp, Mus musculus
aagacacaaaccagaccttccttct

SEQ ID NO: 44536 - DNA, 25 bp, Mus musculus
aagacacaaacctgaccttccttct

SEQ ID NO: 44537 - DNA, 25 bp, Mus musculus
aagacacaaggaagagccagcccac

SEQ ID NO: 44538 - DNA, 25 bp, Mus musculus
aagacacaaggatgagccagcccac

SEQ ID NO: 44539 - DNA, 25 bp, Mus musculus
aagacacaatgcagtaattccaaac

SEQ ID NO: 44540 - DNA, 25 bp, Mus musculus
aagacacaatgctgtaattccaaac

SEQ ID NO: 44541 - DNA, 25 bp, Mus musculus
aagacacacaacattatttcacaga

SEQ ID NO: 44542 - DNA, 25 bp, Mus musculus
aagacacacaactttatttcacaga

SEQ ID NO: 44543 - DNA, 25 bp, Mus musculus
aagacacacaagctcctcactgaga

SEQ ID NO: 44544 - DNA, 25 bp, Mus musculus
aagacacacaaggtcctcactgaga

SEQ ID NO: 44545 - DNA, 25 bp, Mus musculus
aagacacaccctctagatcgcctaa

SEQ ID NO: 44546 - DNA, 25 bp, Mus musculus
aagacacaccctgtagatcgcctaa

SEQ ID NO: 44547 - DNA, 25 bp, Mus musculus
aagacacactggcagcacccacaat

SEQ ID NO: 44548 - DNA, 25 bp, Mus musculus
aagacacactgggagcacccacaat

SEQ ID NO: 44549 - DNA, 25 bp, Mus musculus
aagacacagccacttccggaactca

SEQ ID NO: 44550 - DNA, 25 bp, Mus musculus
aagacacagccagttccggaactca

SEQ ID NO: 44551 - DNA, 25 bp, Mus musculus
aagacacagcccagcagactcatta

SEQ ID NO: 44552 - DNA, 25 bp, Mus musculus
aagacacagccctgcagactcatta

SEQ ID NO: 44553 - DNA, 25 bp, Mus musculus
aagacacagctcattcttttcctga

SEQ ID NO: 44554 - DNA, 25 bp, Mus musculus
aagacacagctctttcttttcctga

SEQ ID NO: 44555 - DNA, 25 bp, Mus musculus
aagacacaggccaaactgctctgag

SEQ ID NO: 44556 - DNA, 25 bp, Mus musculus
aagacacaggcctaactgctctgag

SEQ ID NO: 44557 - DNA, 25 bp, Mus musculus
aagacacagggccactcatcaatga

SEQ ID NO: 44558 - DNA, 25 bp, Mus musculus
aagacacagggcgactcatcaatga

SEQ ID NO: 44559 - DNA, 25 bp, Mus musculus
aagacacaggtcctaggagctgcct

SEQ ID NO: 44560 - DNA, 25 bp, Mus musculus
aagacacaggtcgtaggagctgcct

SEQ ID NO: 44561 - DNA, 25 bp, Mus musculus
aagacacatggactgttgtggcagt

SEQ ID NO: 44562 - DNA, 25 bp, Mus musculus
aagacacatggagtgttgtggcagt

SEQ ID NO: 44563 - DNA, 25 bp, Mus musculus
aagacacatgtcagcccttcctaag

SEQ ID NO: 44564 - DNA, 25 bp, Mus musculus
aagacacatgtctgcccttcctaag

SEQ ID NO: 44565 - DNA, 25 bp, Mus musculus
aagacacattacaggccaaggagca

SEQ ID NO: 44566 - DNA, 25 bp, Mus musculus
aagacacattactggccaaggagca

SEQ ID NO: 44567 - DNA, 25 bp, Mus musculus
aagacaccaagactgttcttcctca

SEQ ID NO: 44568 - DNA, 25 bp, Mus musculus
aagacaccaagagtgttcttcctca

SEQ ID NO: 44569 - DNA, 25 bp, Mus musculus
aagacaccaataccactgacgtgaa

SEQ ID NO: 44570 - DNA, 25 bp, Mus musculus
aagacaccaatagcactgacgtgaa

SEQ ID NO: 44571 - DNA, 25 bp, Mus musculus
aagacaccactccacccacagagag

SEQ ID NO: 44572 - DNA, 25 bp, Mus musculus
aagacaccactcgacccacagagag

SEQ ID NO: 44573 - DNA, 25 bp, Mus musculus
aagacaccagcacctacgaacaggg

SEQ ID NO: 44574 - DNA, 25 bp, Mus musculus
aagacaccagcagctacgaacaggg

SEQ ID NO: 44575 - DNA, 25 bp, Mus musculus
aagacaccagtcctaggccagcaga

SEQ ID NO: 44576 - DNA, 25 bp, Mus musculus
aagacaccagtcgtaggccagcaga

SEQ ID NO: 44577 - DNA, 25 bp, Mus musculus
aagacaccagttagattttccaaca

SEQ ID NO: 44578 - DNA, 25 bp, Mus musculus
aagacaccagtttgattttccaaca

SEQ ID NO: 44579 - DNA, 25 bp, Mus musculus
aagacacccaacacattcgctgtgt

SEQ ID NO: 44580 - DNA, 25 bp, Mus musculus
aagacacccaactcattcgctgtgt

SEQ ID NO: 44581 - DNA, 25 bp, Mus musculus
aagacacccaggactgaggagtcac

SEQ ID NO: 44582 - DNA, 25 bp, Mus musculus
aagacacccaggccatgaaggagat

SEQ ID NO: 44583 - DNA, 25 bp, Mus musculus
aagacacccagggcatgaaggagat

SEQ ID NO: 44584 - DNA, 25 bp, Mus musculus
aagacacccaggtctgaggagtcac

SEQ ID NO: 44585 - DNA, 25 bp, Mus musculus
aagacacccctgaggtgaagtctct

SEQ ID NO: 44586 - DNA, 25 bp, Mus musculus
aagacacccctgcaagtggccaaag

SEQ ID NO: 44587 - DNA, 25 bp, Mus musculus
aagacacccctggaagtggccaaag

SEQ ID NO: 44588 - DNA, 25 bp, Mus musculus
aagacacccctgtggtgaagtctct

SEQ ID NO: 44589 - DNA, 25 bp, Mus musculus
aagacacccgtaccaaaggcccttg

SEQ ID NO: 44590 - DNA, 25 bp, Mus musculus
aagacacccgtagcaaaggcccttg

SEQ ID NO: 44591 - DNA, 25 bp, Mus musculus
aagacaccctgactttacctggcct

SEQ ID NO: 44592 - DNA, 25 bp, Mus musculus
aagacaccctgagtttacctggcct

SEQ ID NO: 44593 - DNA, 25 bp, Mus musculus
aagacacccttgcaacatgtgtaca

SEQ ID NO: 44594 - DNA, 25 bp, Mus musculus
aagacacccttggaacatgtgtaca

SEQ ID NO: 44595 - DNA, 25 bp, Mus musculus
aagacaccgattacgctacattcca

SEQ ID NO: 44596 - DNA, 25 bp, Mus musculus
aagacaccgatttcgctacattcca

SEQ ID NO: 44597 - DNA, 25 bp, Mus musculus
aagacacctaacactcgatatgtgg

SEQ ID NO: 44598 - DNA, 25 bp, Mus musculus
aagacacctaactctcgatatgtgg

SEQ ID NO: 44599 - DNA, 25 bp, Mus musculus
aagacacctctacttccgagttagt

SEQ ID NO: 44600 - DNA, 25 bp, Mus musculus
aagacacctctagttccgagttagt

SEQ ID NO: 44601 - DNA, 25 bp, Mus musculus
aagacacctgaccagtacccaatgt

SEQ ID NO: 44602 - DNA, 25 bp, Mus musculus
aagacacctgacgagtacccaatgt

SEQ ID NO: 44603 - DNA, 25 bp, Mus musculus
aagacacctgatatgtgacaagatg

SEQ ID NO: 44604 - DNA, 25 bp, Mus musculus
aagacacctgatttgtgacaagatg

SEQ ID NO: 44605 - DNA, 25 bp, Mus musculus
aagacacctgccactatgagtgttc

SEQ ID NO: 44606 - DNA, 25 bp, Mus musculus
aagacacctgcctctatgagtgttc

SEQ ID NO: 44607 - DNA, 25 bp, Mus musculus
aagacacctgctctaagcgaaatgg

SEQ ID NO: 44608 - DNA, 25 bp, Mus musculus
aagacacctgctgtaagcgaaatgg

SEQ ID NO: 44609 - DNA, 25 bp, Mus musculus
aagacacctgttaggcttgtactgt

SEQ ID NO: 44610 - DNA, 25 bp, Mus musculus
aagacacctgttctttagaaagcac

SEQ ID NO: 44611 - DNA, 25 bp, Mus musculus
aagacacctgttgtttagaaagcac

SEQ ID NO: 44612 - DNA, 25 bp, Mus musculus
aagacacctgtttggcttgtactgt

SEQ ID NO: 44613 - DNA, 25 bp, Mus musculus
aagacaccttgtccctgtgtgggtc

SEQ ID NO: 44614 - DNA, 25 bp, Mus musculus
aagacaccttgtgcctgtgtgggtc

SEQ ID NO: 44615 - DNA, 25 bp, Mus musculus
aagacacgaaatccctctctaggag

SEQ ID NO: 44616 - DNA, 25 bp, Mus musculus
aagacacgaaatgcctctctaggag

SEQ ID NO: 44617 - DNA, 25 bp, Mus musculus
aagacacgacgtaccttaactgcct

SEQ ID NO: 44618 - DNA, 25 bp, Mus musculus
aagacacgacgttccttaactgcct

SEQ ID NO: 44619 - DNA, 25 bp, Mus musculus
aagacacggcatcggacagcgtcga

SEQ ID NO: 44620 - DNA, 25 bp, Mus musculus
aagacacggcatgggacagcgtcga

SEQ ID NO: 44621 - DNA, 25 bp, Mus musculus
aagacacggcttctgaggcaggcac

SEQ ID NO: 44622 - DNA, 25 bp, Mus musculus
aagacacggcttgtgaggcaggcac

SEQ ID NO: 44623 - DNA, 25 bp, Mus musculus
aagacacgggctagtatacactaca

SEQ ID NO: 44624 - DNA, 25 bp, Mus musculus
aagacacgggcttgtatacactaca

SEQ ID NO: 44625 - DNA, 25 bp, Mus musculus
aagacacgtaagatgcacctacccc

SEQ ID NO: 44626 - DNA, 25 bp, Mus musculus
aagacacgtaagttgcacctacccc

SEQ ID NO: 44627 - DNA, 25 bp, Mus musculus
aagacacgttctaggtctgttgttt

SEQ ID NO: 44628 - DNA, 25 bp, Mus musculus
aagacacgttcttggtctgttgttt

SEQ ID NO: 44629 - DNA, 25 bp, Mus musculus
aagacacgttgcaggcttccctcat

SEQ ID NO: 44630 - DNA, 25 bp, Mus musculus
aagacacgttgctggcttccctcat

SEQ ID NO: 44631 - DNA, 25 bp, Mus musculus
aagacactaatgaggccaggctctc

SEQ ID NO: 44632 - DNA, 25 bp, Mus musculus
aagacactaatgtggccaggctctc

SEQ ID NO: 44633 - DNA, 25 bp, Mus musculus
aagacactacagaccctggacagaa

SEQ ID NO: 44634 - DNA, 25 bp, Mus musculus
aagacactacagagcctccaggctg

SEQ ID NO: 44635 - DNA, 25 bp, Mus musculus
aagacactacagtccctggacagaa

SEQ ID NO: 44636 - DNA, 25 bp, Mus musculus
aagacactacagtgcctccaggctg

SEQ ID NO: 44637 - DNA, 25 bp, Mus musculus
aagacactaccaagttgactttaat

SEQ ID NO: 44638 - DNA, 25 bp, Mus musculus
aagacactaccatgttgactttaat

SEQ ID NO: 44639 - DNA, 25 bp, Mus musculus
aagacactagaaagatggtcgctgt

SEQ ID NO: 44640 - DNA, 25 bp, Mus musculus
aagacactagaatgatggtcgctgt

SEQ ID NO: 44641 - DNA, 25 bp, Mus musculus
aagacactatggacgtatggtgcaa

SEQ ID NO: 44642 - DNA, 25 bp, Mus musculus
aagacactatggtcgtatggtgcaa

SEQ ID NO: 44643 - DNA, 25 bp, Mus musculus
aagacactattcctgtcactgccca

SEQ ID NO: 44644 - DNA, 25 bp, Mus musculus
aagacactattcgtgtcactgccca

SEQ ID NO: 44645 - DNA, 25 bp, Mus musculus
aagacactatttatgcagctatttg

SEQ ID NO: 44646 - DNA, 25 bp, Mus musculus
aagacactatttttgcagctatttg

SEQ ID NO: 44647 - DNA, 25 bp, Mus musculus
aagacactcaggcagtcgctggctc

SEQ ID NO: 44648 - DNA, 25 bp, Mus musculus
aagacactcagggagtcgctggctc

SEQ ID NO: 44649 - DNA, 25 bp, Mus musculus
aagacactccctagacattaacggt

SEQ ID NO: 44650 - DNA, 25 bp, Mus musculus
aagacactcccttgacattaacggt

SEQ ID NO: 44651 - DNA, 25 bp, Mus musculus
aagacactcctgagatgcactgaac

SEQ ID NO: 44652 - DNA, 25 bp, Mus musculus
aagacactcctgtgatgcactgaac

SEQ ID NO: 44653 - DNA, 25 bp, Mus musculus
aagacactcgcactttcatgccttt

SEQ ID NO: 44654 - DNA, 25 bp, Mus musculus
aagacactcgcagtttcatgccttt

SEQ ID NO: 44655 - DNA, 25 bp, Mus musculus
aagacactcgtcacattggattcag

SEQ ID NO: 44656 - DNA, 25 bp, Mus musculus
aagacactcgtctcattggattcag

SEQ ID NO: 44657 - DNA, 25 bp, Mus musculus
aagacactctctactttggtttgct

SEQ ID NO: 44658 - DNA, 25 bp, Mus musculus
aagacactctcttctttggtttgct

SEQ ID NO: 44659 - DNA, 25 bp, Mus musculus
aagacactctgcacgaactgaaggt

SEQ ID NO: 44660 - DNA, 25 bp, Mus musculus
aagacactctgctcgaactgaaggt

SEQ ID NO: 44661 - DNA, 25 bp, Mus musculus
aagacactcttcataacagcaaacc

SEQ ID NO: 44662 - DNA, 25 bp, Mus musculus
aagacactcttcttaacagcaaacc

SEQ ID NO: 44663 - DNA, 25 bp, Mus musculus
aagacactgaggatgctctactggt

SEQ ID NO: 44664 - DNA, 25 bp, Mus musculus
aagacactgaggttgctctactggt

SEQ ID NO: 44665 - DNA, 25 bp, Mus musculus
aagacactgccaagggctgtgggct

SEQ ID NO: 44666 - DNA, 25 bp, Mus musculus
aagacactgccatgggctgtgggct

SEQ ID NO: 44667 - DNA, 25 bp, Mus musculus
aagacactgcgtcccctgagggaga

SEQ ID NO: 44668 - DNA, 25 bp, Mus musculus
aagacactgcgtgccctgagggaga

SEQ ID NO: 44669 - DNA, 25 bp, Mus musculus
aagacactgctgagccctgaagctg

SEQ ID NO: 44670 - DNA, 25 bp, Mus musculus
aagacactgctgtgccctgaagctg

SEQ ID NO: 44671 - DNA, 25 bp, Mus musculus
aagacactggtgctggtgcccctac

SEQ ID NO: 44672 - DNA, 25 bp, Mus musculus
aagacactggtggtggtgcccctac

SEQ ID NO: 44673 - DNA, 25 bp, Mus musculus
aagacactgtaaacacctatctgcc

SEQ ID NO: 44674 - DNA, 25 bp, Mus musculus
aagacactgtaatcacctatctgcc

SEQ ID NO: 44675 - DNA, 25 bp, Mus musculus
aagacactgtctacgtatgttaaat

SEQ ID NO: 44676 - DNA, 25 bp, Mus musculus
aagacactgtctcaactgtggttgt

SEQ ID NO: 44677 - DNA, 25 bp, Mus musculus
aagacactgtctgaactgtggttgt

SEQ ID NO: 44678 - DNA, 25 bp, Mus musculus
aagacactgtcttcgtatgttaaat

SEQ ID NO: 44679 - DNA, 25 bp, Mus musculus
aagacacttaatctactgagtttaa

SEQ ID NO: 44680 - DNA, 25 bp, Mus musculus
aagacacttaatgtactgagtttaa

SEQ ID NO: 44681 - DNA, 25 bp, Mus musculus
aagacacttacaacccttggaaatg

SEQ ID NO: 44682 - DNA, 25 bp, Mus musculus
aagacacttacatcccttggaaatg

SEQ ID NO: 44683 - DNA, 25 bp, Mus musculus
aagacacttatcctatctctggtac

SEQ ID NO: 44684 - DNA, 25 bp, Mus musculus
aagacacttatcgtatctctggtac

SEQ ID NO: 44685 - DNA, 25 bp, Mus musculus
aagacacttctaatctgtggcccag

SEQ ID NO: 44686 - DNA, 25 bp, Mus musculus
aagacacttctattctgtggcccag

SEQ ID NO: 44687 - DNA, 25 bp, Mus musculus
aagacacttgacaccactgagccgt

SEQ ID NO: 44688 - DNA, 25 bp, Mus musculus
aagacacttgactccactgagccgt

SEQ ID NO: 44689 - DNA, 25 bp, Mus musculus
aagacacttgatcaacccgtatggg

SEQ ID NO: 44690 - DNA, 25 bp, Mus musculus
aagacacttgatgaacccgtatggg

SEQ ID NO: 44691 - DNA, 25 bp, Mus musculus
aagacacttgccactgtagagagga

SEQ ID NO: 44692 - DNA, 25 bp, Mus musculus
aagacacttgcctctgtagagagga

SEQ ID NO: 44693 - DNA, 25 bp, Mus musculus
aagacacttgctctccagtctaaag

SEQ ID NO: 44694 - DNA, 25 bp, Mus musculus
aagacacttgctgtccagtctaaag

SEQ ID NO: 44695 - DNA, 25 bp, Mus musculus
aagacacttttcaccagcctgtgaa

SEQ ID NO: 44696 - DNA, 25 bp, Mus musculus
aagacacttttcctgcgaagtctgc

SEQ ID NO: 44697 - DNA, 25 bp, Mus musculus
aagacacttttcgtgcgaagtctgc

SEQ ID NO: 44698 - DNA, 25 bp, Mus musculus
aagacacttttctccagcctgtgaa

SEQ ID NO: 44699 - DNA, 25 bp, Mus musculus
aagacagaaaagaacccgctcccag

SEQ ID NO: 44700 - DNA, 25 bp, Mus musculus
aagacagaaaagtacccgctcccag

SEQ ID NO: 44701 - DNA, 25 bp, Mus musculus
aagacagaaatgatgactccacgtg

SEQ ID NO: 44702 - DNA, 25 bp, Mus musculus
aagacagaaatgttgactccacgtg

SEQ ID NO: 44703 - DNA, 25 bp, Mus musculus
aagacagaacgcaggatccttgact

SEQ ID NO: 44704 - DNA, 25 bp, Mus musculus
aagacagaacgctggatccttgact

SEQ ID NO: 44705 - DNA, 25 bp, Mus musculus
aagacagaacttctgggtcaccagt

SEQ ID NO: 44706 - DNA, 25 bp, Mus musculus
aagacagaacttgtgggtcaccagt

SEQ ID NO: 44707 - DNA, 25 bp, Mus musculus
aagacagaatctacaggtctgtggg

SEQ ID NO: 44708 - DNA, 25 bp, Mus musculus
aagacagaatcttcaggtctgtggg

SEQ ID NO: 44709 - DNA, 25 bp, Mus musculus
aagacagaatttacccagtgccaat

SEQ ID NO: 44710 - DNA, 25 bp, Mus musculus
aagacagaattttcccagtgccaat

SEQ ID NO: 44711 - DNA, 25 bp, Mus musculus
aagacagacatcctggcagtgaaga

SEQ ID NO: 44712 - DNA, 25 bp, Mus musculus
aagacagacatcgtggcagtgaaga

SEQ ID NO: 44713 - DNA, 25 bp, Mus musculus
aagacagacatgcattgcgtggttg

SEQ ID NO: 44714 - DNA, 25 bp, Mus musculus
aagacagacatggattgcgtggttg

SEQ ID NO: 44715 - DNA, 25 bp, Mus musculus
aagacagacctgcatgcaagcctca

SEQ ID NO: 44716 - DNA, 25 bp, Mus musculus
aagacagacctggatgcaagcctca

SEQ ID NO: 44717 - DNA, 25 bp, Mus musculus
aagacagacggaagggcatgtgacc

SEQ ID NO: 44718 - DNA, 25 bp, Mus musculus
aagacagacggactgctgtgacaca

SEQ ID NO: 44719 - DNA, 25 bp, Mus musculus
aagacagacggagtgctgtgacaca

SEQ ID NO: 44720 - DNA, 25 bp, Mus musculus
aagacagacggatgggcatgtgacc

SEQ ID NO: 44721 - DNA, 25 bp, Mus musculus
aagacagactacatcaatgggtaaa

SEQ ID NO: 44722 - DNA, 25 bp, Mus musculus
aagacagactacttcaatgggtaaa

SEQ ID NO: 44723 - DNA, 25 bp, Mus musculus
aagacagactgactttctccggctc

SEQ ID NO: 44724 - DNA, 25 bp, Mus musculus
aagacagactgagtttctccggctc

SEQ ID NO: 44725 - DNA, 25 bp, Mus musculus
aagacagactggacaatgggtccca

SEQ ID NO: 44726 - DNA, 25 bp, Mus musculus
aagacagactggtcaatgggtccca

SEQ ID NO: 44727 - DNA, 25 bp, Mus musculus
aagacagactgtaccagcttagccc

SEQ ID NO: 44728 - DNA, 25 bp, Mus musculus
aagacagactgttccagcttagccc

SEQ ID NO: 44729 - DNA, 25 bp, Mus musculus
aagacagactttattcccacatgta

SEQ ID NO: 44730 - DNA, 25 bp, Mus musculus
aagacagacttttttcccacatgta

SEQ ID NO: 44731 - DNA, 25 bp, Mus musculus
aagacagatattagcccacatttgg

SEQ ID NO: 44732 - DNA, 25 bp, Mus musculus
aagacagatatttgcccacatttgg

SEQ ID NO: 44733 - DNA, 25 bp, Mus musculus
aagacagatccaaactaccagacgc

SEQ ID NO: 44734 - DNA, 25 bp, Mus musculus
aagacagatccatactaccagacgc

SEQ ID NO: 44735 - DNA, 25 bp, Mus musculus
aagacagatgcaacagcctctacca

SEQ ID NO: 44736 - DNA, 25 bp, Mus musculus
aagacagatgcatcagcctctacca

SEQ ID NO: 44737 - DNA, 25 bp, Mus musculus
aagacagatgtccaggcctcttgag

SEQ ID NO: 44738 - DNA, 25 bp, Mus musculus
aagacagatgtcgaggcctcttgag

SEQ ID NO: 44739 - DNA, 25 bp, Mus musculus
aagacagatgtgctgctgcggttcc

SEQ ID NO: 44740 - DNA, 25 bp, Mus musculus
aagacagatgtggtgctgcggttcc

SEQ ID NO: 44741 - DNA, 25 bp, Mus musculus
aagacagcaacaacctgtgcctaca

SEQ ID NO: 44742 - DNA, 25 bp, Mus musculus
aagacagcaacatcctgtgcctaca

SEQ ID NO: 44743 - DNA, 25 bp, Mus musculus
aagacagcaatgcagtctctctcat

SEQ ID NO: 44744 - DNA, 25 bp, Mus musculus
aagacagcaatggagtctctctcat

SEQ ID NO: 44745 - DNA, 25 bp, Mus musculus
aagacagcacttcaccttgaagact

SEQ ID NO: 44746 - DNA, 25 bp, Mus musculus
aagacagcacttgaccttgaagact

SEQ ID NO: 44747 - DNA, 25 bp, Mus musculus
aagacagcagccaaaacagacaact

SEQ ID NO: 44748 - DNA, 25 bp, Mus musculus
aagacagcagcctaaacagacaact

SEQ ID NO: 44749 - DNA, 25 bp, Mus musculus
aagacagcagtgaccagctctgttt

SEQ ID NO: 44750 - DNA, 25 bp, Mus musculus
aagacagcagtgtccagctctgttt

SEQ ID NO: 44751 - DNA, 25 bp, Mus musculus
aagacagcagttcaccacgccaagg

SEQ ID NO: 44752 - DNA, 25 bp, Mus musculus
aagacagcagttgaccacgccaagg

SEQ ID NO: 44753 - DNA, 25 bp, Mus musculus
aagacagcatctccccatggtaggt

SEQ ID NO: 44754 - DNA, 25 bp, Mus musculus
aagacagcatctgcccatggtaggt

SEQ ID NO: 44755 - DNA, 25 bp, Mus musculus
aagacagcatggacgttttccagaa

SEQ ID NO: 44756 - DNA, 25 bp, Mus musculus
aagacagcatggagtgcgggtcctc

SEQ ID NO: 44757 - DNA, 25 bp, Mus musculus
aagacagcatggcttcactttcctg

SEQ ID NO: 44758 - DNA, 25 bp, Mus musculus
aagacagcatgggttcactttcctg

SEQ ID NO: 44759 - DNA, 25 bp, Mus musculus
aagacagcatggtcgttttccagaa

SEQ ID NO: 44760 - DNA, 25 bp, Mus musculus
aagacagcatggtgtgcgggtcctc

SEQ ID NO: 44761 - DNA, 25 bp, Mus musculus
aagacagcatgtcgacagaggacaa

SEQ ID NO: 44762 - DNA, 25 bp, Mus musculus
aagacagcatgtggacagaggacaa

SEQ ID NO: 44763 - DNA, 25 bp, Mus musculus
aagacagccaacagagacctgtgga

SEQ ID NO: 44764 - DNA, 25 bp, Mus musculus
aagacagccaactgagacctgtgga

SEQ ID NO: 44765 - DNA, 25 bp, Mus musculus
aagacagccaagatccttgtgacct

SEQ ID NO: 44766 - DNA, 25 bp, Mus musculus
aagacagccaagttccttgtgacct

SEQ ID NO: 44767 - DNA, 25 bp, Mus musculus
aagacagccacaactactctatatt

SEQ ID NO: 44768 - DNA, 25 bp, Mus musculus
aagacagccacatctactctatatt

SEQ ID NO: 44769 - DNA, 25 bp, Mus musculus
aagacagccagacttccttataggg

SEQ ID NO: 44770 - DNA, 25 bp, Mus musculus
aagacagccagagttccttataggg

SEQ ID NO: 44771 - DNA, 25 bp, Mus musculus
aagacagcccacaaaatcgcctcgg

SEQ ID NO: 44772 - DNA, 25 bp, Mus musculus
aagacagcccactaaatcgcctcgg

SEQ ID NO: 44773 - DNA, 25 bp, Mus musculus
aagacagcccataagctctcattaa

SEQ ID NO: 44774 - DNA, 25 bp, Mus musculus
aagacagcccatacactctgtctca

SEQ ID NO: 44775 - DNA, 25 bp, Mus musculus
aagacagcccattagctctcattaa

SEQ ID NO: 44776 - DNA, 25 bp, Mus musculus
aagacagcccattcactctgtctca

SEQ ID NO: 44777 - DNA, 25 bp, Mus musculus
aagacagccctgacatttgccggga

SEQ ID NO: 44778 - DNA, 25 bp, Mus musculus
aagacagccctgtcatttgccggga

SEQ ID NO: 44779 - DNA, 25 bp, Mus musculus
aagacagcctggaccgtctgctttt

SEQ ID NO: 44780 - DNA, 25 bp, Mus musculus
aagacagcctggtccgtctgctttt

SEQ ID NO: 44781 - DNA, 25 bp, Mus musculus
aagacagccttgctgacttcagtgg

SEQ ID NO: 44782 - DNA, 25 bp, Mus musculus
aagacagccttggtgacttcagtgg

SEQ ID NO: 44783 - DNA, 25 bp, Mus musculus
aagacagcgctcaccagtggttgaa

SEQ ID NO: 44784 - DNA, 25 bp, Mus musculus
aagacagcgctctccagtggttgaa

SEQ ID NO: 44785 - DNA, 25 bp, Mus musculus
aagacagcgggcatctaggagccta

SEQ ID NO: 44786 - DNA, 25 bp, Mus musculus
aagacagcgggcttctaggagccta

SEQ ID NO: 44787 - DNA, 25 bp, Mus musculus
aagacagctcagaagcttgccttcc

SEQ ID NO: 44788 - DNA, 25 bp, Mus musculus
aagacagctcagtagcttgccttcc

SEQ ID NO: 44789 - DNA, 25 bp, Mus musculus
aagacagctcccaaagaagctgaaa

SEQ ID NO: 44790 - DNA, 25 bp, Mus musculus
aagacagctccctaagaagctgaaa

SEQ ID NO: 44791 - DNA, 25 bp, Mus musculus
aagacagctctgctctcgctcagta

SEQ ID NO: 44792 - DNA, 25 bp, Mus musculus
aagacagctctggtctcgctcagta

SEQ ID NO: 44793 - DNA, 25 bp, Mus musculus
aagacagctgaccatctctttgatg

SEQ ID NO: 44794 - DNA, 25 bp, Mus musculus
aagacagctgacgatctctttgatg

SEQ ID NO: 44795 - DNA, 25 bp, Mus musculus
aagacagctgcccttcctgatctgt

SEQ ID NO: 44796 - DNA, 25 bp, Mus musculus
aagacagctgccgttcctgatctgt

SEQ ID NO: 44797 - DNA, 25 bp, Mus musculus
aagacagctgtcactttgaagccat

SEQ ID NO: 44798 - DNA, 25 bp, Mus musculus
aagacagctgtctctttgaagccat

SEQ ID NO: 44799 - DNA, 25 bp, Mus musculus
aagacaggaactcggcccaaagtca

SEQ ID NO: 44800 - DNA, 25 bp, Mus musculus
aagacaggaactgggcccaaagtca

SEQ ID NO: 44801 - DNA, 25 bp, Mus musculus
aagacaggacctcccactgaagcgg

SEQ ID NO: 44802 - DNA, 25 bp, Mus musculus
aagacaggacctcgctgttgggctc

SEQ ID NO: 44803 - DNA, 25 bp, Mus musculus
aagacaggacctgccactgaagcgg

SEQ ID NO: 44804 - DNA, 25 bp, Mus musculus
aagacaggacctggctgttgggctc

SEQ ID NO: 44805 - DNA, 25 bp, Mus musculus
aagacaggactcaccatgtgctcgg

SEQ ID NO: 44806 - DNA, 25 bp, Mus musculus
aagacaggactctccatgtgctcgg

SEQ ID NO: 44807 - DNA, 25 bp, Mus musculus
aagacaggacttatcatttgaagca

SEQ ID NO: 44808 - DNA, 25 bp, Mus musculus
aagacaggacttttcatttgaagca

SEQ ID NO: 44809 - DNA, 25 bp, Mus musculus
aagacaggagacagctactcattct

SEQ ID NO: 44810 - DNA, 25 bp, Mus musculus
aagacaggagactgctactcattct

SEQ ID NO: 44811 - DNA, 25 bp, Mus musculus
aagacaggcaccctacagacatgag

SEQ ID NO: 44812 - DNA, 25 bp, Mus musculus
aagacaggcaccgtacagacatgag

SEQ ID NO: 44813 - DNA, 25 bp, Mus musculus
aagacaggcagtagagcaggcccag

SEQ ID NO: 44814 - DNA, 25 bp, Mus musculus
aagacaggcagttgagcaggcccag

SEQ ID NO: 44815 - DNA, 25 bp, Mus musculus
aagacaggccagatctgcacaggga

SEQ ID NO: 44816 - DNA, 25 bp, Mus musculus
aagacaggccagttctgcacaggga

SEQ ID NO: 44817 - DNA, 25 bp, Mus musculus
aagacaggctacatgctagcacgct

SEQ ID NO: 44818 - DNA, 25 bp, Mus musculus
aagacaggctacttgctagcacgct

SEQ ID NO: 44819 - DNA, 25 bp, Mus musculus
aagacaggctgcaaggtcaggcctt

SEQ ID NO: 44820 - DNA, 25 bp, Mus musculus
aagacaggctgctaggtcaggcctt

SEQ ID NO: 44821 - DNA, 25 bp, Mus musculus
aagacaggctggcacacgtcagaaa

SEQ ID NO: 44822 - DNA, 25 bp, Mus musculus
aagacaggctgggacacgtcagaaa

SEQ ID NO: 44823 - DNA, 25 bp, Mus musculus
aagacagggagtatatgggctaacc

SEQ ID NO: 44824 - DNA, 25 bp, Mus musculus
aagacagggagtttatgggctaacc

SEQ ID NO: 44825 - DNA, 25 bp, Mus musculus
aagacagggcaactgtgtccacaga

SEQ ID NO: 44826 - DNA, 25 bp, Mus musculus
aagacagggcaagtgtgtccacaga

SEQ ID NO: 44827 - DNA, 25 bp, Mus musculus
aagacagggccaagacagaattcca

SEQ ID NO: 44828 - DNA, 25 bp, Mus musculus
aagacagggccatgacagaattcca

SEQ ID NO: 44829 - DNA, 25 bp, Mus musculus
aagacagggtccactgaagccagat

SEQ ID NO: 44830 - DNA, 25 bp, Mus musculus
aagacagggtcctctgaagccagat

SEQ ID NO: 44831 - DNA, 25 bp, Mus musculus
aagacagggtttcacagcctgcttg

SEQ ID NO: 44832 - DNA, 25 bp, Mus musculus
aagacagggtttgacagcctgcttg

SEQ ID NO: 44833 - DNA, 25 bp, Mus musculus
aagacaggtatgcatctctggatac

SEQ ID NO: 44834 - DNA, 25 bp, Mus musculus
aagacaggtatggatctctggatac

SEQ ID NO: 44835 - DNA, 25 bp, Mus musculus
aagacaggtgttctttcttgtcaag

SEQ ID NO: 44836 - DNA, 25 bp, Mus musculus
aagacaggtgttgtttcttgtcaag

SEQ ID NO: 44837 - DNA, 25 bp, Mus musculus
aagacaggttcactatcagagcatg

SEQ ID NO: 44838 - DNA, 25 bp, Mus musculus
aagacaggttcagtatcagagcatg

SEQ ID NO: 44839 - DNA, 25 bp, Mus musculus
aagacagtaagtatcagccgggcat

SEQ ID NO: 44840 - DNA, 25 bp, Mus musculus
aagacagtaagtttcagccgggcat

SEQ ID NO: 44841 - DNA, 25 bp, Mus musculus
aagacagtaatcctcattagccaag

SEQ ID NO: 44842 - DNA, 25 bp, Mus musculus
aagacagtaatcgtcattagccaag

SEQ ID NO: 44843 - DNA, 25 bp, Mus musculus
aagacagtaatgagcatcgactaga

SEQ ID NO: 44844 - DNA, 25 bp, Mus musculus
aagacagtaatgtgcatcgactaga

SEQ ID NO: 44845 - DNA, 25 bp, Mus musculus
aagacagtagtcctgtcccactaac

SEQ ID NO: 44846 - DNA, 25 bp, Mus musculus
aagacagtagtcgtgtcccactaac

SEQ ID NO: 44847 - DNA, 25 bp, Mus musculus
aagacagtcagtccctgcaaatcag

SEQ ID NO: 44848 - DNA, 25 bp, Mus musculus
aagacagtcagtgcctgcaaatcag

SEQ ID NO: 44849 - DNA, 25 bp, Mus musculus
aagacagtccttatcttctgaagta

SEQ ID NO: 44850 - DNA, 25 bp, Mus musculus
aagacagtccttttcttctgaagta

SEQ ID NO: 44851 - DNA, 25 bp, Mus musculus
aagacagtctcactagccagttcca

SEQ ID NO: 44852 - DNA, 25 bp, Mus musculus
aagacagtctcactttaatgccctc

SEQ ID NO: 44853 - DNA, 25 bp, Mus musculus
aagacagtctcagtagccagttcca

SEQ ID NO: 44854 - DNA, 25 bp, Mus musculus
aagacagtctcagtttaatgccctc

SEQ ID NO: 44855 - DNA, 25 bp, Mus musculus
aagacagtctgtagtgttccaggct

SEQ ID NO: 44856 - DNA, 25 bp, Mus musculus
aagacagtctgttgtgttccaggct

SEQ ID NO: 44857 - DNA, 25 bp, Mus musculus
aagacagtgacaatctccacattga

SEQ ID NO: 44858 - DNA, 25 bp, Mus musculus
aagacagtgacattctccacattga

SEQ ID NO: 44859 - DNA, 25 bp, Mus musculus
aagacagtgactattgcccttcgta

SEQ ID NO: 44860 - DNA, 25 bp, Mus musculus
aagacagtgacttttgcccttcgta

SEQ ID NO: 44861 - DNA, 25 bp, Mus musculus
aagacagtgcatcagggctgctccc

SEQ ID NO: 44862 - DNA, 25 bp, Mus musculus
aagacagtgcatgagggctgctccc

SEQ ID NO: 44863 - DNA, 25 bp, Mus musculus
aagacagtgcccaaggtgccgaagt

SEQ ID NO: 44864 - DNA, 25 bp, Mus musculus
aagacagtgccctaggtgccgaagt

SEQ ID NO: 44865 - DNA, 25 bp, Mus musculus
aagacagtgctaaggttcagctccg

SEQ ID NO: 44866 - DNA, 25 bp, Mus musculus
aagacagtgctatggttcagctccg

SEQ ID NO: 44867 - DNA, 25 bp, Mus musculus
aagacagtgctgagatgctgcccca

SEQ ID NO: 44868 - DNA, 25 bp, Mus musculus
aagacagtgctgaggttctgaccct

SEQ ID NO: 44869 - DNA, 25 bp, Mus musculus
aagacagtgctgtgatgctgcccca

SEQ ID NO: 44870 - DNA, 25 bp, Mus musculus
aagacagtgctgtggttctgaccct

SEQ ID NO: 44871 - DNA, 25 bp, Mus musculus
aagacagtggagcttctggctctga

SEQ ID NO: 44872 - DNA, 25 bp, Mus musculus
aagacagtggaggttctggctctga

SEQ ID NO: 44873 - DNA, 25 bp, Mus musculus
aagacagtggccatcatcagcatct

SEQ ID NO: 44874 - DNA, 25 bp, Mus musculus
aagacagtggccttcatcagcatct

SEQ ID NO: 44875 - DNA, 25 bp, Mus musculus
aagacagtggcgctggcacgggaag

SEQ ID NO: 44876 - DNA, 25 bp, Mus musculus
aagacagtggcggtggcacgggaag

SEQ ID NO: 44877 - DNA, 25 bp, Mus musculus
aagacagtggctacaacggacttgt

SEQ ID NO: 44878 - DNA, 25 bp, Mus musculus
aagacagtggcttcaacggacttgt

SEQ ID NO: 44879 - DNA, 25 bp, Mus musculus
aagacagtgggcaccatgcctcttt

SEQ ID NO: 44880 - DNA, 25 bp, Mus musculus
aagacagtgggctccatgcctcttt

SEQ ID NO: 44881 - DNA, 25 bp, Mus musculus
aagacagtgtacatctggcccaatc

SEQ ID NO: 44882 - DNA, 25 bp, Mus musculus
aagacagtgtacttctggcccaatc

SEQ ID NO: 44883 - DNA, 25 bp, Mus musculus
aagacagtgtatagccaggctggat

SEQ ID NO: 44884 - DNA, 25 bp, Mus musculus
aagacagtgtattgccaggctggat

SEQ ID NO: 44885 - DNA, 25 bp, Mus musculus
aagacagtgtgtagcgctctggcct

SEQ ID NO: 44886 - DNA, 25 bp, Mus musculus
aagacagtgtgtcaaaaactcatga

SEQ ID NO: 44887 - DNA, 25 bp, Mus musculus
aagacagtgtgtgaaaaactcatga

SEQ ID NO: 44888 - DNA, 25 bp, Mus musculus
aagacagtgtgttgcgctctggcct

SEQ ID NO: 44889 - DNA, 25 bp, Mus musculus
aagacagtgtttcacgaagctatcc

SEQ ID NO: 44890 - DNA, 25 bp, Mus musculus
aagacagtgtttgacgaagctatcc

SEQ ID NO: 44891 - DNA, 25 bp, Mus musculus
aagacagttaccactaacattagtg

SEQ ID NO: 44892 - DNA, 25 bp, Mus musculus
aagacagttacctctaacattagtg

SEQ ID NO: 44893 - DNA, 25 bp, Mus musculus
aagacagttccgctgtggtgtgcct

SEQ ID NO: 44894 - DNA, 25 bp, Mus musculus
aagacagttccggtgtggtgtgcct

SEQ ID NO: 44895 - DNA, 25 bp, Mus musculus
aagacagttcttactggttgataat

SEQ ID NO: 44896 - DNA, 25 bp, Mus musculus
aagacagttctttctggttgataat

SEQ ID NO: 44897 - DNA, 25 bp, Mus musculus
aagacagttgaacacacctcagggt

SEQ ID NO: 44898 - DNA, 25 bp, Mus musculus
aagacagttgaagacacctcagggt

SEQ ID NO: 44899 - DNA, 25 bp, Mus musculus
aagacagttgtgatccccaatatgg

SEQ ID NO: 44900 - DNA, 25 bp, Mus musculus
aagacagttgtgttccccaatatgg

SEQ ID NO: 44901 - DNA, 25 bp, Mus musculus
aagacagtttgcatctggttataac

SEQ ID NO: 44902 - DNA, 25 bp, Mus musculus
aagacagtttgcttctggttataac

SEQ ID NO: 44903 - DNA, 25 bp, Mus musculus
aagacatacaacatacccattcgct

SEQ ID NO: 44904 - DNA, 25 bp, Mus musculus
aagacatacaacttacccattcgct

SEQ ID NO: 44905 - DNA, 25 bp, Mus musculus
aagacataccagctcatgcgggact

SEQ ID NO: 44906 - DNA, 25 bp, Mus musculus
aagacataccaggtcatgcgggact

SEQ ID NO: 44907 - DNA, 25 bp, Mus musculus
aagacataccttcctatatactaag

SEQ ID NO: 44908 - DNA, 25 bp, Mus musculus
aagacataccttgctatatactaag

SEQ ID NO: 44909 - DNA, 25 bp, Mus musculus
aagacatatgctctactctctgaaa

SEQ ID NO: 44910 - DNA, 25 bp, Mus musculus
aagacatatgctgtactctctgaaa

SEQ ID NO: 44911 - DNA, 25 bp, Mus musculus
aagacatcaaacacagattacctga

SEQ ID NO: 44912 - DNA, 25 bp, Mus musculus
aagacatcaaactcagattacctga

SEQ ID NO: 44913 - DNA, 25 bp, Mus musculus
aagacatcaggccagaccaggagtt

SEQ ID NO: 44914 - DNA, 25 bp, Mus musculus
aagacatcaggcgagaccaggagtt

SEQ ID NO: 44915 - DNA, 25 bp, Mus musculus
aagacatcagggacagtttggtgaa

SEQ ID NO: 44916 - DNA, 25 bp, Mus musculus
aagacatcagggtcagtttggtgaa

SEQ ID NO: 44917 - DNA, 25 bp, Mus musculus
aagacatcatatcgcaagcaggaaa

SEQ ID NO: 44918 - DNA, 25 bp, Mus musculus
aagacatcatatggcaagcaggaaa

SEQ ID NO: 44919 - DNA, 25 bp, Mus musculus
aagacatccaacagagagcaagttc

SEQ ID NO: 44920 - DNA, 25 bp, Mus musculus
aagacatccaactgagagcaagttc

SEQ ID NO: 44921 - DNA, 25 bp, Mus musculus
aagacatccaagactttctcgcttt

SEQ ID NO: 44922 - DNA, 25 bp, Mus musculus
aagacatccaagtctttctcgcttt

SEQ ID NO: 44923 - DNA, 25 bp, Mus musculus
aagacatccgagaggccatcaaaaa

SEQ ID NO: 44924 - DNA, 25 bp, Mus musculus
aagacatccgagtggccatcaaaaa

SEQ ID NO: 44925 - DNA, 25 bp, Mus musculus
aagacatccgtgactgtgtatcccg

SEQ ID NO: 44926 - DNA, 25 bp, Mus musculus
aagacatccgtgtctgtgtatcccg

SEQ ID NO: 44927 - DNA, 25 bp, Mus musculus
aagacatcctccacaaatcgcctga

SEQ ID NO: 44928 - DNA, 25 bp, Mus musculus
aagacatcctcctcaaatcgcctga

SEQ ID NO: 44929 - DNA, 25 bp, Mus musculus
aagacatcctctatgcccggcagaa

SEQ ID NO: 44930 - DNA, 25 bp, Mus musculus
aagacatcctctctggtggcatcag

SEQ ID NO: 44931 - DNA, 25 bp, Mus musculus
aagacatcctctgtggtggcatcag

SEQ ID NO: 44932 - DNA, 25 bp, Mus musculus
aagacatcctctttgcccggcagaa

SEQ ID NO: 44933 - DNA, 25 bp, Mus musculus
aagacatcctgcacagaagcctgta

SEQ ID NO: 44934 - DNA, 25 bp, Mus musculus
aagacatcctgccacttaggaaata

SEQ ID NO: 44935 - DNA, 25 bp, Mus musculus
aagacatcctgcgacttaggaaata

SEQ ID NO: 44936 - DNA, 25 bp, Mus musculus
aagacatcctgctcagaagcctgta

SEQ ID NO: 44937 - DNA, 25 bp, Mus musculus
aagacatcctgtcgcccagacgtgt

SEQ ID NO: 44938 - DNA, 25 bp, Mus musculus
aagacatcctgtggcccagacgtgt

SEQ ID NO: 44939 - DNA, 25 bp, Mus musculus
aagacatcgactcaacgtttcacct

SEQ ID NO: 44940 - DNA, 25 bp, Mus musculus
aagacatcgactgaacgtttcacct

SEQ ID NO: 44941 - DNA, 25 bp, Mus musculus
aagacatcgatgctgctcttttggg

SEQ ID NO: 44942 - DNA, 25 bp, Mus musculus
aagacatcgatggtgctcttttggg

SEQ ID NO: 44943 - DNA, 25 bp, Mus musculus
aagacatcgcagacactttgttaat

SEQ ID NO: 44944 - DNA, 25 bp, Mus musculus
aagacatcgcagtcactttgttaat

SEQ ID NO: 44945 - DNA, 25 bp, Mus musculus
aagacatcgggtagaagctgggtat

SEQ ID NO: 44946 - DNA, 25 bp, Mus musculus
aagacatcgggttgaagctgggtat

SEQ ID NO: 44947 - DNA, 25 bp, Mus musculus
aagacatcgtgtacattggcttgcg

SEQ ID NO: 44948 - DNA, 25 bp, Mus musculus
aagacatcgtgttcattggcttgcg

SEQ ID NO: 44949 - DNA, 25 bp, Mus musculus
aagacatcgtttacaatggctttaa

SEQ ID NO: 44950 - DNA, 25 bp, Mus musculus
aagacatcgttttcaatggctttaa

SEQ ID NO: 44951 - DNA, 25 bp, Mus musculus
aagacatctctcagggaccgcagca

SEQ ID NO: 44952 - DNA, 25 bp, Mus musculus
aagacatctctctgggaccgcagca

SEQ ID NO: 44953 - DNA, 25 bp, Mus musculus
aagacatcttccaattgcttgccct

SEQ ID NO: 44954 - DNA, 25 bp, Mus musculus
aagacatcttcctattgcttgccct

SEQ ID NO: 44955 - DNA, 25 bp, Mus musculus
aagacatcttcgctttattccagaa

SEQ ID NO: 44956 - DNA, 25 bp, Mus musculus
aagacatcttcggtttattccagaa

SEQ ID NO: 44957 - DNA, 25 bp, Mus musculus
aagacatctttcacactgcatgata

SEQ ID NO: 44958 - DNA, 25 bp, Mus musculus
aagacatctttctcactgcatgata

SEQ ID NO: 44959 - DNA, 25 bp, Mus musculus
aagacatctttgaccattcgcaaaa

SEQ ID NO: 44960 - DNA, 25 bp, Mus musculus
aagacatctttgtccattcgcaaaa

SEQ ID NO: 44961 - DNA, 25 bp, Mus musculus
aagacatgactcaagacaggatagt

SEQ ID NO: 44962 - DNA, 25 bp, Mus musculus
aagacatgactctagacaggatagt

SEQ ID NO: 44963 - DNA, 25 bp, Mus musculus
aagacatgagtgagagctagagcac

SEQ ID NO: 44964 - DNA, 25 bp, Mus musculus
aagacatgagtgtgagctagagcac

SEQ ID NO: 44965 - DNA, 25 bp, Mus musculus
aagacatgatctaggcctccataaa

SEQ ID NO: 44966 - DNA, 25 bp, Mus musculus
aagacatgatcttggcctccataaa

SEQ ID NO: 44967 - DNA, 25 bp, Mus musculus
aagacatgcctcaagtgctagctgc

SEQ ID NO: 44968 - DNA, 25 bp, Mus musculus
aagacatgcctctagtgctagctgc

SEQ ID NO: 44969 - DNA, 25 bp, Mus musculus
aagacatgctctaaactaacccaag

SEQ ID NO: 44970 - DNA, 25 bp, Mus musculus
aagacatgctcttaactaacccaag

SEQ ID NO: 44971 - DNA, 25 bp, Mus musculus
aagacatgctgcacctaccaaggtt

SEQ ID NO: 44972 - DNA, 25 bp, Mus musculus
aagacatgctgctcctaccaaggtt

SEQ ID NO: 44973 - DNA, 25 bp, Mus musculus
aagacatggacacctgcctggtcta

SEQ ID NO: 44974 - DNA, 25 bp, Mus musculus
aagacatggacagctgcctggtcta

SEQ ID NO: 44975 - DNA, 25 bp, Mus musculus
aagacatggactacctgctggatga

SEQ ID NO: 44976 - DNA, 25 bp, Mus musculus
aagacatggacttcctgctggatga

SEQ ID NO: 44977 - DNA, 25 bp, Mus musculus
aagacatggcatctgtaccaacaaa

SEQ ID NO: 44978 - DNA, 25 bp, Mus musculus
aagacatggcatgtgtaccaacaaa

SEQ ID NO: 44979 - DNA, 25 bp, Mus musculus
aagacatggcttacgtactctttga

SEQ ID NO: 44980 - DNA, 25 bp, Mus musculus
aagacatggcttattgcgacacaca

SEQ ID NO: 44981 - DNA, 25 bp, Mus musculus
aagacatggctttcgtactctttga

SEQ ID NO: 44982 - DNA, 25 bp, Mus musculus
aagacatggctttttgcgacacaca

SEQ ID NO: 44983 - DNA, 25 bp, Mus musculus
aagacatgggccacattgatctctt

SEQ ID NO: 44984 - DNA, 25 bp, Mus musculus
aagacatgggcctcattgatctctt

SEQ ID NO: 44985 - DNA, 25 bp, Mus musculus
aagacatgggcgctacttgactgtg

SEQ ID NO: 44986 - DNA, 25 bp, Mus musculus
aagacatgggcggtacttgactgtg

SEQ ID NO: 44987 - DNA, 25 bp, Mus musculus
aagacatgtatcacgccagcaagag

SEQ ID NO: 44988 - DNA, 25 bp, Mus musculus
aagacatgtatctcgccagcaagag

SEQ ID NO: 44989 - DNA, 25 bp, Mus musculus
aagacatgtctgatctccctagata

SEQ ID NO: 44990 - DNA, 25 bp, Mus musculus
aagacatgtctgttctccctagata

SEQ ID NO: 44991 - DNA, 25 bp, Mus musculus
aagacatgtgacagctagtgactca

SEQ ID NO: 44992 - DNA, 25 bp, Mus musculus
aagacatgtgactgctagtgactca

SEQ ID NO: 44993 - DNA, 25 bp, Mus musculus
aagacatgtggaacacggctgcaga

SEQ ID NO: 44994 - DNA, 25 bp, Mus musculus
aagacatgtggatcacggctgcaga

SEQ ID NO: 44995 - DNA, 25 bp, Mus musculus
aagacatgttatatctctatcatta

SEQ ID NO: 44996 - DNA, 25 bp, Mus musculus
aagacatgttatttctctatcatta

SEQ ID NO: 44997 - DNA, 25 bp, Mus musculus
aagacatgttctacctgtgaaccaa

SEQ ID NO: 44998 - DNA, 25 bp, Mus musculus
aagacatgttcttcctgtgaaccaa

SEQ ID NO: 44999 - DNA, 25 bp, Mus musculus
aagacatgttggacctattactggg

SEQ ID NO: 45000 - DNA, 25 bp, Mus musculus
aagacatgttggtcctattactggg

SEQ ID NO: 45001 - DNA, 25 bp, Mus musculus
aagacatgttttcctttcataacaa

SEQ ID NO: 45002 - DNA, 25 bp, Mus musculus
aagacatgttttgctttcataacaa

SEQ ID NO: 45003 - DNA, 25 bp, Mus musculus
aagacattacggcaaagcttccttt

SEQ ID NO: 45004 - DNA, 25 bp, Mus musculus
aagacattacgggaaagcttccttt

SEQ ID NO: 45005 - DNA, 25 bp, Mus musculus
aagacattacttagaggccaaccag

SEQ ID NO: 45006 - DNA, 25 bp, Mus musculus
aagacattactttgaggccaaccag

SEQ ID NO: 45007 - DNA, 25 bp, Mus musculus
aagacattagatcccacacgcaagt

SEQ ID NO: 45008 - DNA, 25 bp, Mus musculus
aagacattagatgccacacgcaagt

SEQ ID NO: 45009 - DNA, 25 bp, Mus musculus
aagacattagcaaagccggacgtgg

SEQ ID NO: 45010 - DNA, 25 bp, Mus musculus
aagacattagcatagccggacgtgg

SEQ ID NO: 45011 - DNA, 25 bp, Mus musculus
aagacattcaggaccccaacctgtg

SEQ ID NO: 45012 - DNA, 25 bp, Mus musculus
aagacattcaggtccccaacctgtg

SEQ ID NO: 45013 - DNA, 25 bp, Mus musculus
aagacattccatattccaggacatg

SEQ ID NO: 45014 - DNA, 25 bp, Mus musculus
aagacattccattttccaggacatg

SEQ ID NO: 45015 - DNA, 25 bp, Mus musculus
aagacattctgcatgaagatctgag

SEQ ID NO: 45016 - DNA, 25 bp, Mus musculus
aagacattctgcttgaagatctgag

SEQ ID NO: 45017 - DNA, 25 bp, Mus musculus
aagacattcttcagctaagactgga

SEQ ID NO: 45018 - DNA, 25 bp, Mus musculus
aagacattcttctgctaagactgga

SEQ ID NO: 45019 - DNA, 25 bp, Mus musculus
aagacattgaaacccacaccaaaga

SEQ ID NO: 45020 - DNA, 25 bp, Mus musculus
aagacattgaaagccacaccaaaga

SEQ ID NO: 45021 - DNA, 25 bp, Mus musculus
aagacattgaagctgttttccctct

SEQ ID NO: 45022 - DNA, 25 bp, Mus musculus
aagacattgaaggtgttttccctct

SEQ ID NO: 45023 - DNA, 25 bp, Mus musculus
aagacattgcacaacactgatggag

SEQ ID NO: 45024 - DNA, 25 bp, Mus musculus
aagacattgcactacactgatggag

SEQ ID NO: 45025 - DNA, 25 bp, Mus musculus
aagacattgctaaccctttatcata

SEQ ID NO: 45026 - DNA, 25 bp, Mus musculus
aagacattgctatccctttatcata

SEQ ID NO: 45027 - DNA, 25 bp, Mus musculus
aagacattgcttaaaggacacctag

SEQ ID NO: 45028 - DNA, 25 bp, Mus musculus
aagacattgctttaaggacacctag

SEQ ID NO: 45029 - DNA, 25 bp, Mus musculus
aagacattggatcgatcccctggga

SEQ ID NO: 45030 - DNA, 25 bp, Mus musculus
aagacattggatggatcccctggga

SEQ ID NO: 45031 - DNA, 25 bp, Mus musculus
aagacattggcgaatttgctgcctg

SEQ ID NO: 45032 - DNA, 25 bp, Mus musculus
aagacattggcgtatttgctgcctg

SEQ ID NO: 45033 - DNA, 25 bp, Mus musculus
aagacattgtctcccacgcagatat

SEQ ID NO: 45034 - DNA, 25 bp, Mus musculus
aagacattgtctgccacgcagatat

SEQ ID NO: 45035 - DNA, 25 bp, Mus musculus
aagacatttacaaggctgtggcaga

SEQ ID NO: 45036 - DNA, 25 bp, Mus musculus
aagacatttacatggctgtggcaga

SEQ ID NO: 45037 - DNA, 25 bp, Mus musculus
aagacatttcagagctaattaggta

SEQ ID NO: 45038 - DNA, 25 bp, Mus musculus
aagacatttcagtgctaattaggta

SEQ ID NO: 45039 - DNA, 25 bp, Mus musculus
aagacatttcccatatcctgctgtt

SEQ ID NO: 45040 - DNA, 25 bp, Mus musculus
aagacatttcccttatcctgctgtt

SEQ ID NO: 45041 - DNA, 25 bp, Mus musculus
aagacatttcctagcaaacgattca

SEQ ID NO: 45042 - DNA, 25 bp, Mus musculus
aagacatttccttgcaaacgattca

SEQ ID NO: 45043 - DNA, 25 bp, Mus musculus
aagacatttctaccacaaccatcag

SEQ ID NO: 45044 - DNA, 25 bp, Mus musculus
aagacatttctagcacaaccatcag

SEQ ID NO: 45045 - DNA, 25 bp, Mus musculus
aagacatttctgcaagtgcccacat

SEQ ID NO: 45046 - DNA, 25 bp, Mus musculus
aagacatttctggaagtgcccacat

SEQ ID NO: 45047 - DNA, 25 bp, Mus musculus
aagacatttcttcgaggacatgtga

SEQ ID NO: 45048 - DNA, 25 bp, Mus musculus
aagacatttcttggaggacatgtga

SEQ ID NO: 45049 - DNA, 25 bp, Mus musculus
aagacatttgcaacacacacatttg

SEQ ID NO: 45050 - DNA, 25 bp, Mus musculus
aagacatttgcatcacacacatttg

SEQ ID NO: 45051 - DNA, 25 bp, Mus musculus
aagacatttgctcaactcggcacat

SEQ ID NO: 45052 - DNA, 25 bp, Mus musculus
aagacatttgctgaactcggcacat

SEQ ID NO: 45053 - DNA, 25 bp, Mus musculus
aagacattttacacgccgggcggtg

SEQ ID NO: 45054 - DNA, 25 bp, Mus musculus
aagacattttactcgccgggcggtg

SEQ ID NO: 45055 - DNA, 25 bp, Mus musculus
aagacattttagaacctggttgtgc

SEQ ID NO: 45056 - DNA, 25 bp, Mus musculus
aagacattttagtacctggttgtgc

SEQ ID NO: 45057 - DNA, 25 bp, Mus musculus
aagacattttccacttcctgtatgg

SEQ ID NO: 45058 - DNA, 25 bp, Mus musculus
aagacattttcctcttcctgtatgg

SEQ ID NO: 45059 - DNA, 25 bp, Mus musculus
aagacattttgaaagcttcacagct

SEQ ID NO: 45060 - DNA, 25 bp, Mus musculus
aagacattttgatagcttcacagct

SEQ ID NO: 45061 - DNA, 25 bp, Mus musculus
aagacattttttcctctgtaatcat

SEQ ID NO: 45062 - DNA, 25 bp, Mus musculus
aagacattttttgctctgtaatcat

SEQ ID NO: 45063 - DNA, 25 bp, Mus musculus
aagaccaaaagcaccctatggctgg

SEQ ID NO: 45064 - DNA, 25 bp, Mus musculus
aagaccaaaagctccctatggctgg

SEQ ID NO: 45065 - DNA, 25 bp, Mus musculus
aagaccaaatacatgagcccacttc

SEQ ID NO: 45066 - DNA, 25 bp, Mus musculus
aagaccaaatacttgagcccacttc

SEQ ID NO: 45067 - DNA, 25 bp, Mus musculus
aagaccaaatctcatgatcgccctt

SEQ ID NO: 45068 - DNA, 25 bp, Mus musculus
aagaccaaatctgatgatcgccctt

SEQ ID NO: 45069 - DNA, 25 bp, Mus musculus
aagaccaaccaacttcataagatgt

SEQ ID NO: 45070 - DNA, 25 bp, Mus musculus
aagaccaaccaagttcataagatgt

SEQ ID NO: 45071 - DNA, 25 bp, Mus musculus
aagaccaaccgtcagtggacgctct

SEQ ID NO: 45072 - DNA, 25 bp, Mus musculus
aagaccaaccgtgagtggacgctct

SEQ ID NO: 45073 - DNA, 25 bp, Mus musculus
aagaccaacggactcctggtgtgaa

SEQ ID NO: 45074 - DNA, 25 bp, Mus musculus
aagaccaacggagtcctggtgtgaa

SEQ ID NO: 45075 - DNA, 25 bp, Mus musculus
aagaccaactgtatgacacgctgcc

SEQ ID NO: 45076 - DNA, 25 bp, Mus musculus
aagaccaactgtttgacacgctgcc

SEQ ID NO: 45077 - DNA, 25 bp, Mus musculus
aagaccaagccccaggttctggagg

SEQ ID NO: 45078 - DNA, 25 bp, Mus musculus
aagaccaagcccgaggttctggagg

SEQ ID NO: 45079 - DNA, 25 bp, Mus musculus
aagaccaaggtgatccttcaagaag

SEQ ID NO: 45080 - DNA, 25 bp, Mus musculus
aagaccaaggtgttccttcaagaag

SEQ ID NO: 45081 - DNA, 25 bp, Mus musculus
aagaccaagtatctgcctggctcct

SEQ ID NO: 45082 - DNA, 25 bp, Mus musculus
aagaccaagtatgtgcctggctcct

SEQ ID NO: 45083 - DNA, 25 bp, Mus musculus
aagaccaagttaatgactgtaaagt

SEQ ID NO: 45084 - DNA, 25 bp, Mus musculus
aagaccaagttattgactgtaaagt

SEQ ID NO: 45085 - DNA, 25 bp, Mus musculus
aagaccaatcagatggctgccacca

SEQ ID NO: 45086 - DNA, 25 bp, Mus musculus
aagaccaatcagttggctgccacca

SEQ ID NO: 45087 - DNA, 25 bp, Mus musculus
aagaccaattatcagcactagctgt

SEQ ID NO: 45088 - DNA, 25 bp, Mus musculus
aagaccaattatgagcactagctgt

SEQ ID NO: 45089 - DNA, 25 bp, Mus musculus
aagaccaattcactccactaaactg

SEQ ID NO: 45090 - DNA, 25 bp, Mus musculus
aagaccaattcagtccactaaactg

SEQ ID NO: 45091 - DNA, 25 bp, Mus musculus
aagaccaatttgcacgaccatcaga

SEQ ID NO: 45092 - DNA, 25 bp, Mus musculus
aagaccaatttggacgaccatcaga

SEQ ID NO: 45093 - DNA, 25 bp, Mus musculus
aagaccacaaagagtacctgcaacc

SEQ ID NO: 45094 - DNA, 25 bp, Mus musculus
aagaccacaaagtgtacctgcaacc

SEQ ID NO: 45095 - DNA, 25 bp, Mus musculus
aagaccacaactactagccataggg

SEQ ID NO: 45096 - DNA, 25 bp, Mus musculus
aagaccacaacttctagccataggg

SEQ ID NO: 45097 - DNA, 25 bp, Mus musculus
aagaccacacaaccaaactggaaat

SEQ ID NO: 45098 - DNA, 25 bp, Mus musculus
aagaccacacaagcaaactggaaat

SEQ ID NO: 45099 - DNA, 25 bp, Mus musculus
aagaccacacgcacaaggtcctaaa

SEQ ID NO: 45100 - DNA, 25 bp, Mus musculus
aagaccacacgctcaaggtcctaaa

SEQ ID NO: 45101 - DNA, 25 bp, Mus musculus
aagaccacagatctgcccggtgtca

SEQ ID NO: 45102 - DNA, 25 bp, Mus musculus
aagaccacagatgtgcccggtgtca

SEQ ID NO: 45103 - DNA, 25 bp, Mus musculus
aagaccacagccatgactgggaaga

SEQ ID NO: 45104 - DNA, 25 bp, Mus musculus
aagaccacagccttgactgggaaga

SEQ ID NO: 45105 - DNA, 25 bp, Mus musculus
aagaccacagctccaacaggctgga

SEQ ID NO: 45106 - DNA, 25 bp, Mus musculus
aagaccacagctgcaacaggctgga

SEQ ID NO: 45107 - DNA, 25 bp, Mus musculus
aagaccaccactccatgtgtactga

SEQ ID NO: 45108 - DNA, 25 bp, Mus musculus
aagaccaccactgcatgtgtactga

SEQ ID NO: 45109 - DNA, 25 bp, Mus musculus
aagaccaccagcatgttcttgtcca

SEQ ID NO: 45110 - DNA, 25 bp, Mus musculus
aagaccaccagcttgttcttgtcca

SEQ ID NO: 45111 - DNA, 25 bp, Mus musculus
aagaccaccatacccgaggaggagg

SEQ ID NO: 45112 - DNA, 25 bp, Mus musculus
aagaccaccatagccgaggaggagg

SEQ ID NO: 45113 - DNA, 25 bp, Mus musculus
aagaccaccattcccataggccagt

SEQ ID NO: 45114 - DNA, 25 bp, Mus musculus
aagaccaccattgccataggccagt

SEQ ID NO: 45115 - DNA, 25 bp, Mus musculus
aagaccaccctcatcgcaggcgtag

SEQ ID NO: 45116 - DNA, 25 bp, Mus musculus
aagaccaccctcttcgcaggcgtag

SEQ ID NO: 45117 - DNA, 25 bp, Mus musculus
aagaccaccgaacagaagctcaata

SEQ ID NO: 45118 - DNA, 25 bp, Mus musculus
aagaccaccgaagagaagctcaata

SEQ ID NO: 45119 - DNA, 25 bp, Mus musculus
aagaccaccgcacccttgagtaagg

SEQ ID NO: 45120 - DNA, 25 bp, Mus musculus
aagaccaccgcagccttgagtaagg

SEQ ID NO: 45121 - DNA, 25 bp, Mus musculus
aagaccacctccagatttcttgttt

SEQ ID NO: 45122 - DNA, 25 bp, Mus musculus
aagaccacctcctgatttcttgttt

SEQ ID NO: 45123 - DNA, 25 bp, Mus musculus
aagaccacctcgataaaacactatg

SEQ ID NO: 45124 - DNA, 25 bp, Mus musculus
aagaccacctcgttaaaacactatg

SEQ ID NO: 45125 - DNA, 25 bp, Mus musculus
aagaccacctgtagctgggccacac

SEQ ID NO: 45126 - DNA, 25 bp, Mus musculus
aagaccacctgttgctgggccacac

SEQ ID NO: 45127 - DNA, 25 bp, Mus musculus
aagaccaccttgcgccgcagctgga

SEQ ID NO: 45128 - DNA, 25 bp, Mus musculus
aagaccaccttgggccgcagctgga

SEQ ID NO: 45129 - DNA, 25 bp, Mus musculus
aagaccacgcagcaagcggacattt

SEQ ID NO: 45130 - DNA, 25 bp, Mus musculus
aagaccacgcaggaagcggacattt

SEQ ID NO: 45131 - DNA, 25 bp, Mus musculus
aagaccactagaatccttatgcctg

SEQ ID NO: 45132 - DNA, 25 bp, Mus musculus
aagaccactagattccttatgcctg

SEQ ID NO: 45133 - DNA, 25 bp, Mus musculus
aagaccactcaactgcatccctgtg

SEQ ID NO: 45134 - DNA, 25 bp, Mus musculus
aagaccactcaagtgcatccctgtg

SEQ ID NO: 45135 - DNA, 25 bp, Mus musculus
aagaccactcacagggtgttcggag

SEQ ID NO: 45136 - DNA, 25 bp, Mus musculus
aagaccactcactgggtgttcggag

SEQ ID NO: 45137 - DNA, 25 bp, Mus musculus
aagaccactctcatgtgtagggttc

SEQ ID NO: 45138 - DNA, 25 bp, Mus musculus
aagaccactctcttgtgtagggttc

SEQ ID NO: 45139 - DNA, 25 bp, Mus musculus
aagaccactggtagctcatcctgaa

SEQ ID NO: 45140 - DNA, 25 bp, Mus musculus
aagaccactggttgctcatcctgaa

SEQ ID NO: 45141 - DNA, 25 bp, Mus musculus
aagaccacttaaccctcactcaggg

SEQ ID NO: 45142 - DNA, 25 bp, Mus musculus
aagaccacttaagcctcactcaggg

SEQ ID NO: 45143 - DNA, 25 bp, Mus musculus
aagaccagagaaactccttgcaggg

SEQ ID NO: 45144 - DNA, 25 bp, Mus musculus
aagaccagagaatctccttgcaggg

SEQ ID NO: 45145 - DNA, 25 bp, Mus musculus
aagaccagagccagtcctttaagcc

SEQ ID NO: 45146 - DNA, 25 bp, Mus musculus
aagaccagagcctgtcctttaagcc

SEQ ID NO: 45147 - DNA, 25 bp, Mus musculus
aagaccagaggcaaagcgcgctgag

SEQ ID NO: 45148 - DNA, 25 bp, Mus musculus
aagaccagaggctaagcgcgctgag

SEQ ID NO: 45149 - DNA, 25 bp, Mus musculus
aagaccagaggtcggataaagactc

SEQ ID NO: 45150 - DNA, 25 bp, Mus musculus
aagaccagaggtgggataaagactc

SEQ ID NO: 45151 - DNA, 25 bp, Mus musculus
aagaccagagtaaaagaaccattga

SEQ ID NO: 45152 - DNA, 25 bp, Mus musculus
aagaccagagtataagaaccattga

SEQ ID NO: 45153 - DNA, 25 bp, Mus musculus
aagaccagcatcacttcaggaatcc

SEQ ID NO: 45154 - DNA, 25 bp, Mus musculus
aagaccagcatctcttcaggaatcc

SEQ ID NO: 45155 - DNA, 25 bp, Mus musculus
aagaccagcatgctgtaccgggaca

SEQ ID NO: 45156 - DNA, 25 bp, Mus musculus
aagaccagcatggtgtaccgggaca

SEQ ID NO: 45157 - DNA, 25 bp, Mus musculus
aagaccagccaacaccggaaggatc

SEQ ID NO: 45158 - DNA, 25 bp, Mus musculus
aagaccagccaagaccggaaggatc

SEQ ID NO: 45159 - DNA, 25 bp, Mus musculus
aagaccagcccaaatgcaggagcct

SEQ ID NO: 45160 - DNA, 25 bp, Mus musculus
aagaccagcccatatgcaggagcct

SEQ ID NO: 45161 - DNA, 25 bp, Mus musculus
aagaccagcctgctgtttaaagcaa

SEQ ID NO: 45162 - DNA, 25 bp, Mus musculus
aagaccagcctggtgtttaaagcaa

SEQ ID NO: 45163 - DNA, 25 bp, Mus musculus
aagaccagctagaaggagcccggca

SEQ ID NO: 45164 - DNA, 25 bp, Mus musculus
aagaccagctagtaggagcccggca

SEQ ID NO: 45165 - DNA, 25 bp, Mus musculus
aagaccagctctcctatcttttgtc

SEQ ID NO: 45166 - DNA, 25 bp, Mus musculus
aagaccagctctgctatcttttgtc

SEQ ID NO: 45167 - DNA, 25 bp, Mus musculus
aagaccagcttgcaaagccaagatt

SEQ ID NO: 45168 - DNA, 25 bp, Mus musculus
aagaccagcttggaaagccaagatt

SEQ ID NO: 45169 - DNA, 25 bp, Mus musculus
aagaccagggctatgacactcacag

SEQ ID NO: 45170 - DNA, 25 bp, Mus musculus
aagaccagggctttgacactcacag

SEQ ID NO: 45171 - DNA, 25 bp, Mus musculus
aagaccagggtcctgagcatccagt

SEQ ID NO: 45172 - DNA, 25 bp, Mus musculus
aagaccagggtcgtgagcatccagt

SEQ ID NO: 45173 - DNA, 25 bp, Mus musculus
aagaccaggtcaaccatttgtgagt

SEQ ID NO: 45174 - DNA, 25 bp, Mus musculus
aagaccaggtcatccatttgtgagt

SEQ ID NO: 45175 - DNA, 25 bp, Mus musculus
aagaccaggtgcagcatccagcttg

SEQ ID NO: 45176 - DNA, 25 bp, Mus musculus
aagaccaggtgcatgatgtgtccgg

SEQ ID NO: 45177 - DNA, 25 bp, Mus musculus
aagaccaggtgctgcatccagcttg

SEQ ID NO: 45178 - DNA, 25 bp, Mus musculus
aagaccaggtgcttgatgtgtccgg

SEQ ID NO: 45179 - DNA, 25 bp, Mus musculus
aagaccagtataatgccaccaccag

SEQ ID NO: 45180 - DNA, 25 bp, Mus musculus
aagaccagtatattgccaccaccag

SEQ ID NO: 45181 - DNA, 25 bp, Mus musculus
aagaccagtctaccaccgtatgtga

SEQ ID NO: 45182 - DNA, 25 bp, Mus musculus
aagaccagtctagcaccgtatgtga

SEQ ID NO: 45183 - DNA, 25 bp, Mus musculus
aagaccagtggactctatatagtaa

SEQ ID NO: 45184 - DNA, 25 bp, Mus musculus
aagaccagtggagtctatatagtaa

SEQ ID NO: 45185 - DNA, 25 bp, Mus musculus
aagaccataagcaccattttgcagt

SEQ ID NO: 45186 - DNA, 25 bp, Mus musculus
aagaccataagctccattttgcagt

SEQ ID NO: 45187 - DNA, 25 bp, Mus musculus
aagaccatagagcaccttacaggag

SEQ ID NO: 45188 - DNA, 25 bp, Mus musculus
aagaccatagaggaccttacaggag

SEQ ID NO: 45189 - DNA, 25 bp, Mus musculus
aagaccataggcatctggaggcagt

SEQ ID NO: 45190 - DNA, 25 bp, Mus musculus
aagaccataggcttctggaggcagt

SEQ ID NO: 45191 - DNA, 25 bp, Mus musculus
aagaccatagggatactgtgacctt

SEQ ID NO: 45192 - DNA, 25 bp, Mus musculus
aagaccatagggttactgtgacctt

SEQ ID NO: 45193 - DNA, 25 bp, Mus musculus
aagaccatcaaccagctgcagggcc

SEQ ID NO: 45194 - DNA, 25 bp, Mus musculus
aagaccatcaacgagctgcagggcc

SEQ ID NO: 45195 - DNA, 25 bp, Mus musculus
aagaccatcagcatgtgtgtggcca

SEQ ID NO: 45196 - DNA, 25 bp, Mus musculus
aagaccatcagcttgtgtgtggcca

SEQ ID NO: 45197 - DNA, 25 bp, Mus musculus
aagaccatcagtcagttcaatgcca

SEQ ID NO: 45198 - DNA, 25 bp, Mus musculus
aagaccatcagtgagttcaatgcca

SEQ ID NO: 45199 - DNA, 25 bp, Mus musculus
aagaccatcctgctattggcgctta

SEQ ID NO: 45200 - DNA, 25 bp, Mus musculus
aagaccatcctggtattggcgctta

SEQ ID NO: 45201 - DNA, 25 bp, Mus musculus
aagaccatcgtgctgatcttctcag

SEQ ID NO: 45202 - DNA, 25 bp, Mus musculus
aagaccatcgtggtgatcttctcag

SEQ ID NO: 45203 - DNA, 25 bp, Mus musculus
aagaccatctgcctacctaaagtat

SEQ ID NO: 45204 - DNA, 25 bp, Mus musculus
aagaccatctgcgtacctaaagtat

SEQ ID NO: 45205 - DNA, 25 bp, Mus musculus
aagaccatgcagcacatcaccttgg

SEQ ID NO: 45206 - DNA, 25 bp, Mus musculus
aagaccatgcaggacatcaccttgg

SEQ ID NO: 45207 - DNA, 25 bp, Mus musculus
aagaccatgcgcatcatcgtgtggc

SEQ ID NO: 45208 - DNA, 25 bp, Mus musculus
aagaccatgcgcttcatcgtgtggc

SEQ ID NO: 45209 - DNA, 25 bp, Mus musculus
aagaccatggatacaaaggcatttt

SEQ ID NO: 45210 - DNA, 25 bp, Mus musculus
aagaccatggattcaaaggcatttt

SEQ ID NO: 45211 - DNA, 25 bp, Mus musculus
aagaccatggtaactttatgttcct

SEQ ID NO: 45212 - DNA, 25 bp, Mus musculus
aagaccatggtatctttatgttcct

SEQ ID NO: 45213 - DNA, 25 bp, Mus musculus
aagaccatggtgaaacgctgcaaac

SEQ ID NO: 45214 - DNA, 25 bp, Mus musculus
aagaccatggtgtaacgctgcaaac

SEQ ID NO: 45215 - DNA, 25 bp, Mus musculus
aagaccatgtggaacgtaatgcaat

SEQ ID NO: 45216 - DNA, 25 bp, Mus musculus
aagaccatgtggtacgtaatgcaat

SEQ ID NO: 45217 - DNA, 25 bp, Mus musculus
aagaccattaacattctgttgtcta

SEQ ID NO: 45218 - DNA, 25 bp, Mus musculus
aagaccattaactttctgttgtcta

SEQ ID NO: 45219 - DNA, 25 bp, Mus musculus
aagaccattatgcatgatccctttg

SEQ ID NO: 45220 - DNA, 25 bp, Mus musculus
aagaccattatggatgatccctttg

SEQ ID NO: 45221 - DNA, 25 bp, Mus musculus
aagaccattcacactgcatagcagc

SEQ ID NO: 45222 - DNA, 25 bp, Mus musculus
aagaccattcactctgcatagcagc

SEQ ID NO: 45223 - DNA, 25 bp, Mus musculus
aagaccattctgagctgcctaattg

SEQ ID NO: 45224 - DNA, 25 bp, Mus musculus
aagaccattctgtgctgcctaattg

SEQ ID NO: 45225 - DNA, 25 bp, Mus musculus
aagaccattcttaagcatctgttta

SEQ ID NO: 45226 - DNA, 25 bp, Mus musculus
aagaccattctttagcatctgttta

SEQ ID NO: 45227 - DNA, 25 bp, Mus musculus
aagaccattgatctcgtggtttatg

SEQ ID NO: 45228 - DNA, 25 bp, Mus musculus
aagaccattgatgtcgtggtttatg

SEQ ID NO: 45229 - DNA, 25 bp, Mus musculus
aagaccattgcaagtgaacacccta

SEQ ID NO: 45230 - DNA, 25 bp, Mus musculus
aagaccattgcatgtgaacacccta

SEQ ID NO: 45231 - DNA, 25 bp, Mus musculus
aagaccattgttaattagccattgt

SEQ ID NO: 45232 - DNA, 25 bp, Mus musculus
aagaccattgtttattagccattgt

SEQ ID NO: 45233 - DNA, 25 bp, Mus musculus
aagaccatttacacatcagattttg

SEQ ID NO: 45234 - DNA, 25 bp, Mus musculus
aagaccatttactcatcagattttg

SEQ ID NO: 45235 - DNA, 25 bp, Mus musculus
aagaccatttgacatcagtcatgga

SEQ ID NO: 45236 - DNA, 25 bp, Mus musculus
aagaccatttgagatcagtcatgga

SEQ ID NO: 45237 - DNA, 25 bp, Mus musculus
aagacccaaataatgacttcagaca

SEQ ID NO: 45238 - DNA, 25 bp, Mus musculus
aagacccaaatattgacttcagaca

SEQ ID NO: 45239 - DNA, 25 bp, Mus musculus
aagacccaagagactcacaaggtga

SEQ ID NO: 45240 - DNA, 25 bp, Mus musculus
aagacccaagagcatcccggctaaa

SEQ ID NO: 45241 - DNA, 25 bp, Mus musculus
aagacccaagaggatcccggctaaa

SEQ ID NO: 45242 - DNA, 25 bp, Mus musculus
aagacccaagagtctcacaaggtga

SEQ ID NO: 45243 - DNA, 25 bp, Mus musculus
aagacccaagtcagcattccggtgg

SEQ ID NO: 45244 - DNA, 25 bp, Mus musculus
aagacccaagtcagtgttgacatgg

SEQ ID NO: 45245 - DNA, 25 bp, Mus musculus
aagacccaagtctgcattccggtgg

SEQ ID NO: 45246 - DNA, 25 bp, Mus musculus
aagacccaagtctgtgttgacatgg

SEQ ID NO: 45247 - DNA, 25 bp, Mus musculus
aagacccaatgacagcagttagatt

SEQ ID NO: 45248 - DNA, 25 bp, Mus musculus
aagacccaatgagagcagttagatt

SEQ ID NO: 45249 - DNA, 25 bp, Mus musculus
aagacccaattgagtactgttgata

SEQ ID NO: 45250 - DNA, 25 bp, Mus musculus
aagacccaattgtgtactgttgata

SEQ ID NO: 45251 - DNA, 25 bp, Mus musculus
aagacccacaaaccaggctgggtgt

SEQ ID NO: 45252 - DNA, 25 bp, Mus musculus
aagacccacaaagcaggctgggtgt

SEQ ID NO: 45253 - DNA, 25 bp, Mus musculus
aagacccacagtagccgaaaagtct

SEQ ID NO: 45254 - DNA, 25 bp, Mus musculus
aagacccacagttgccgaaaagtct

SEQ ID NO: 45255 - DNA, 25 bp, Mus musculus
aagacccaccataacatactgcttt

SEQ ID NO: 45256 - DNA, 25 bp, Mus musculus
aagacccaccattacatactgcttt

SEQ ID NO: 45257 - DNA, 25 bp, Mus musculus
aagacccacccaacaggaatggtga

SEQ ID NO: 45258 - DNA, 25 bp, Mus musculus
aagacccacccatcaggaatggtga

SEQ ID NO: 45259 - DNA, 25 bp, Mus musculus
aagacccacctacctgtcaggatgg

SEQ ID NO: 45260 - DNA, 25 bp, Mus musculus
aagacccacctagctgtcaggatgg

SEQ ID NO: 45261 - DNA, 25 bp, Mus musculus
aagacccacggacgagaggcttgca

SEQ ID NO: 45262 - DNA, 25 bp, Mus musculus
aagacccacggaggagaggcttgca

SEQ ID NO: 45263 - DNA, 25 bp, Mus musculus
aagacccacggtattgtgcctcatt

SEQ ID NO: 45264 - DNA, 25 bp, Mus musculus
aagacccacggttttgtgcctcatt

SEQ ID NO: 45265 - DNA, 25 bp, Mus musculus
aagacccactttccataacattcaa

SEQ ID NO: 45266 - DNA, 25 bp, Mus musculus
aagacccactttgcataacattcaa

SEQ ID NO: 45267 - DNA, 25 bp, Mus musculus
aagacccagaccaagccttagagtg

SEQ ID NO: 45268 - DNA, 25 bp, Mus musculus
aagacccagaccagtggaaagtgat

SEQ ID NO: 45269 - DNA, 25 bp, Mus musculus
aagacccagacctagccttagagtg

SEQ ID NO: 45270 - DNA, 25 bp, Mus musculus
aagacccagacctgtggaaagtgat

SEQ ID NO: 45271 - DNA, 25 bp, Mus musculus
aagacccagatgctactttcccttg

SEQ ID NO: 45272 - DNA, 25 bp, Mus musculus
aagacccagatggtactttcccttg

SEQ ID NO: 45273 - DNA, 25 bp, Mus musculus
aagacccagcttctgtcttacccat

SEQ ID NO: 45274 - DNA, 25 bp, Mus musculus
aagacccagcttgtgtcttacccat

SEQ ID NO: 45275 - DNA, 25 bp, Mus musculus
aagacccaggaccagatcagcaata

SEQ ID NO: 45276 - DNA, 25 bp, Mus musculus
aagacccaggacgagatcagcaata

SEQ ID NO: 45277 - DNA, 25 bp, Mus musculus
aagacccaggtaatgagctagcagt

SEQ ID NO: 45278 - DNA, 25 bp, Mus musculus
aagacccaggtattgagctagcagt

SEQ ID NO: 45279 - DNA, 25 bp, Mus musculus
aagacccagtacattgtatgtatgt

SEQ ID NO: 45280 - DNA, 25 bp, Mus musculus
aagacccagtactttgtatgtatgt

SEQ ID NO: 45281 - DNA, 25 bp, Mus musculus
aagacccagtcaattaccagagatt

SEQ ID NO: 45282 - DNA, 25 bp, Mus musculus
aagacccagtcatttaccagagatt

SEQ ID NO: 45283 - DNA, 25 bp, Mus musculus
aagacccagttcattcgcagccgct

SEQ ID NO: 45284 - DNA, 25 bp, Mus musculus
aagacccagttctttcgcagccgct

SEQ ID NO: 45285 - DNA, 25 bp, Mus musculus
aagacccagttgagtgcctttgcaa

SEQ ID NO: 45286 - DNA, 25 bp, Mus musculus
aagacccagttgtgtgcctttgcaa

SEQ ID NO: 45287 - DNA, 25 bp, Mus musculus
aagacccatatcagagcactggctt

SEQ ID NO: 45288 - DNA, 25 bp, Mus musculus
aagacccatatctgagcactggctt

SEQ ID NO: 45289 - DNA, 25 bp, Mus musculus
aagacccatgagctgcacctgtgac

SEQ ID NO: 45290 - DNA, 25 bp, Mus musculus
aagacccatgaggtgcacctgtgac

SEQ ID NO: 45291 - DNA, 25 bp, Mus musculus
aagacccattagaggctagagagat

SEQ ID NO: 45292 - DNA, 25 bp, Mus musculus
aagacccattagtggctagagagat

SEQ ID NO: 45293 - DNA, 25 bp, Mus musculus
aagaccccaatgacttctctgtgtc

SEQ ID NO: 45294 - DNA, 25 bp, Mus musculus
aagaccccaatgtcttctctgtgtc

SEQ ID NO: 45295 - DNA, 25 bp, Mus musculus
aagaccccaccgatctcgcaggaat

SEQ ID NO: 45296 - DNA, 25 bp, Mus musculus
aagaccccaccgttctcgcaggaat

SEQ ID NO: 45297 - DNA, 25 bp, Mus musculus
aagaccccagcacagcttgtagctt

SEQ ID NO: 45298 - DNA, 25 bp, Mus musculus
aagaccccagcagagcttgtagctt

SEQ ID NO: 45299 - DNA, 25 bp, Mus musculus
aagaccccagcccagaaagcacctg

SEQ ID NO: 45300 - DNA, 25 bp, Mus musculus
aagaccccagccgagaaagcacctg

SEQ ID NO: 45301 - DNA, 25 bp, Mus musculus
aagaccccgcggaagatgtcatcaa

SEQ ID NO: 45302 - DNA, 25 bp, Mus musculus
aagaccccgcggtagatgtcatcaa

SEQ ID NO: 45303 - DNA, 25 bp, Mus musculus
aagaccccggctcctataatacatg

SEQ ID NO: 45304 - DNA, 25 bp, Mus musculus
aagaccccggctgctataatacatg

SEQ ID NO: 45305 - DNA, 25 bp, Mus musculus
aagacccctcaacattctacgtatg

SEQ ID NO: 45306 - DNA, 25 bp, Mus musculus
aagacccctcaagattctacgtatg

SEQ ID NO: 45307 - DNA, 25 bp, Mus musculus
aagacccctgaaagtgacccatgct

SEQ ID NO: 45308 - DNA, 25 bp, Mus musculus
aagacccctgaatgtgacccatgct

SEQ ID NO: 45309 - DNA, 25 bp, Mus musculus
aagacccgaaggactgtggctccct

SEQ ID NO: 45310 - DNA, 25 bp, Mus musculus
aagacccgaaggtctgtggctccct

SEQ ID NO: 45311 - DNA, 25 bp, Mus musculus
aagacccgcgagaaccagcaagatg

SEQ ID NO: 45312 - DNA, 25 bp, Mus musculus
aagacccgcgagtaccagcaagatg

SEQ ID NO: 45313 - DNA, 25 bp, Mus musculus
aagacccgcggcaacgagcacgtgg

SEQ ID NO: 45314 - DNA, 25 bp, Mus musculus
aagacccgcggctacgagcacgtgg

SEQ ID NO: 45315 - DNA, 25 bp, Mus musculus
aagacccgctgcagctcaaatgctg

SEQ ID NO: 45316 - DNA, 25 bp, Mus musculus
aagacccgctgctgctcaaatgctg

SEQ ID NO: 45317 - DNA, 25 bp, Mus musculus
aagacccggagcctgtcaaagaaga

SEQ ID NO: 45318 - DNA, 25 bp, Mus musculus
aagacccggagcgtgtcaaagaaga

SEQ ID NO: 45319 - DNA, 25 bp, Mus musculus
aagacccgggttcccagaagaatgt

SEQ ID NO: 45320 - DNA, 25 bp, Mus musculus
aagacccgggttgccagaagaatgt

SEQ ID NO: 45321 - DNA, 25 bp, Mus musculus
aagacccgtagtatcgcgagacaac

SEQ ID NO: 45322 - DNA, 25 bp, Mus musculus
aagacccgtagtttcgcgagacaac

SEQ ID NO: 45323 - DNA, 25 bp, Mus musculus
aagacccgtggtcatggatcattat

SEQ ID NO: 45324 - DNA, 25 bp, Mus musculus
aagacccgtggtgatggatcattat

SEQ ID NO: 45325 - DNA, 25 bp, Mus musculus
aagaccctagagattgtaacatcag

SEQ ID NO: 45326 - DNA, 25 bp, Mus musculus
aagaccctagagtttgtaacatcag

SEQ ID NO: 45327 - DNA, 25 bp, Mus musculus
aagaccctatcacttgagtaagaaa

SEQ ID NO: 45328 - DNA, 25 bp, Mus musculus
aagaccctatcagttgagtaagaaa

SEQ ID NO: 45329 - DNA, 25 bp, Mus musculus
aagaccctcatcaatggcctgtgga

SEQ ID NO: 45330 - DNA, 25 bp, Mus musculus
aagaccctcatctatggcctgtgga

SEQ ID NO: 45331 - DNA, 25 bp, Mus musculus
aagaccctcgccctgcaggcaagat

SEQ ID NO: 45332 - DNA, 25 bp, Mus musculus
aagaccctcgccgtgcaggcaagat

SEQ ID NO: 45333 - DNA, 25 bp, Mus musculus
aagaccctctcgcagcatgaagcag

SEQ ID NO: 45334 - DNA, 25 bp, Mus musculus
aagaccctctcggagcatgaagcag

SEQ ID NO: 45335 - DNA, 25 bp, Mus musculus
aagaccctgagccagaccttggaat

SEQ ID NO: 45336 - DNA, 25 bp, Mus musculus
aagaccctgagcgagaccttggaat

SEQ ID NO: 45337 - DNA, 25 bp, Mus musculus
aagaccctgaggcttgctcttcagc

SEQ ID NO: 45338 - DNA, 25 bp, Mus musculus
aagaccctgagggttgctcttcagc

SEQ ID NO: 45339 - DNA, 25 bp, Mus musculus
aagaccctgcccaaagggtggtgct

SEQ ID NO: 45340 - DNA, 25 bp, Mus musculus
aagaccctgcccatcgctttcaagg

SEQ ID NO: 45341 - DNA, 25 bp, Mus musculus
aagaccctgccccagtagagaggga

SEQ ID NO: 45342 - DNA, 25 bp, Mus musculus
aagaccctgcccctaagaagccatg

SEQ ID NO: 45343 - DNA, 25 bp, Mus musculus
aagaccctgcccgagtagagaggga

SEQ ID NO: 45344 - DNA, 25 bp, Mus musculus
aagaccctgcccgtaagaagccatg

SEQ ID NO: 45345 - DNA, 25 bp, Mus musculus
aagaccctgccctaagggtggtgct

SEQ ID NO: 45346 - DNA, 25 bp, Mus musculus
aagaccctgcccttcgctttcaagg

SEQ ID NO: 45347 - DNA, 25 bp, Mus musculus
aagaccctgcctcgataagaaaaca

SEQ ID NO: 45348 - DNA, 25 bp, Mus musculus
aagaccctgcctggataagaaaaca

SEQ ID NO: 45349 - DNA, 25 bp, Mus musculus
aagaccctgctaaagcacttttggg

SEQ ID NO: 45350 - DNA, 25 bp, Mus musculus
aagaccctgctatagcacttttggg

SEQ ID NO: 45351 - DNA, 25 bp, Mus musculus
aagaccctgctcattggcttgcttt

SEQ ID NO: 45352 - DNA, 25 bp, Mus musculus
aagaccctgctctttggcttgcttt

SEQ ID NO: 45353 - DNA, 25 bp, Mus musculus
aagaccctgcttcttgagatttttt

SEQ ID NO: 45354 - DNA, 25 bp, Mus musculus
aagaccctgcttgttgagatttttt

SEQ ID NO: 45355 - DNA, 25 bp, Mus musculus
aagaccctggaaatcgatgcaaaat

SEQ ID NO: 45356 - DNA, 25 bp, Mus musculus
aagaccctggaattcgatgcaaaat

SEQ ID NO: 45357 - DNA, 25 bp, Mus musculus
aagaccctggtcacctgggaaggca

SEQ ID NO: 45358 - DNA, 25 bp, Mus musculus
aagaccctggtctcctgggaaggca

SEQ ID NO: 45359 - DNA, 25 bp, Mus musculus
aagaccctggtgattcttgtgctgt

SEQ ID NO: 45360 - DNA, 25 bp, Mus musculus
aagaccctggtgtttcttgtgctgt

SEQ ID NO: 45361 - DNA, 25 bp, Mus musculus
aagaccctgtatcagaaccttgcat

SEQ ID NO: 45362 - DNA, 25 bp, Mus musculus
aagaccctgtatgagaaccttgcat

SEQ ID NO: 45363 - DNA, 25 bp, Mus musculus
aagaccctgtctacataaagtcaaa

SEQ ID NO: 45364 - DNA, 25 bp, Mus musculus
aagaccctgtcttcataaagtcaaa

SEQ ID NO: 45365 - DNA, 25 bp, Mus musculus
aagacccttattccatgggtggctt

SEQ ID NO: 45366 - DNA, 25 bp, Mus musculus
aagacccttattgcatgggtggctt

SEQ ID NO: 45367 - DNA, 25 bp, Mus musculus
aagacccttggaccttgtgcataca

SEQ ID NO: 45368 - DNA, 25 bp, Mus musculus
aagacccttggagcttgtgcataca

SEQ ID NO: 45369 - DNA, 25 bp, Mus musculus
aagacccttggtagattttgattag

SEQ ID NO: 45370 - DNA, 25 bp, Mus musculus
aagacccttggtcatacttttccat

SEQ ID NO: 45371 - DNA, 25 bp, Mus musculus
aagacccttggtgatacttttccat

SEQ ID NO: 45372 - DNA, 25 bp, Mus musculus
aagacccttggttgattttgattag

SEQ ID NO: 45373 - DNA, 25 bp, Mus musculus
aagacccttgtgcttgctcaggtat

SEQ ID NO: 45374 - DNA, 25 bp, Mus musculus
aagacccttgtggttgctcaggtat

SEQ ID NO: 45375 - DNA, 25 bp, Mus musculus
aagacccttgttcctaaggatcgtg

SEQ ID NO: 45376 - DNA, 25 bp, Mus musculus
aagacccttgttgctaaggatcgtg

SEQ ID NO: 45377 - DNA, 25 bp, Mus musculus
aagaccctttctcgttccagggctg

SEQ ID NO: 45378 - DNA, 25 bp, Mus musculus
aagaccctttctggttccagggctg

SEQ ID NO: 45379 - DNA, 25 bp, Mus musculus
aagaccgactataaccagggccacg

SEQ ID NO: 45380 - DNA, 25 bp, Mus musculus
aagaccgactattaccagggccacg

SEQ ID NO: 45381 - DNA, 25 bp, Mus musculus
aagaccgactttccaagagttagca

SEQ ID NO: 45382 - DNA, 25 bp, Mus musculus
aagaccgactttgcaagagttagca

SEQ ID NO: 45383 - DNA, 25 bp, Mus musculus
aagaccgagcttcagtctcgtgtgc

SEQ ID NO: 45384 - DNA, 25 bp, Mus musculus
aagaccgagcttgagtctcgtgtgc

SEQ ID NO: 45385 - DNA, 25 bp, Mus musculus
aagaccgaggagcatgactagacag

SEQ ID NO: 45386 - DNA, 25 bp, Mus musculus
aagaccgaggaggatgactagacag

SEQ ID NO: 45387 - DNA, 25 bp, Mus musculus
aagaccgatgcactaaattgtttac

SEQ ID NO: 45388 - DNA, 25 bp, Mus musculus
aagaccgatgcagtaaattgtttac

SEQ ID NO: 45389 - DNA, 25 bp, Mus musculus
aagaccgcactgcacaaaacactga

SEQ ID NO: 45390 - DNA, 25 bp, Mus musculus
aagaccgcactggacaaaacactga

SEQ ID NO: 45391 - DNA, 25 bp, Mus musculus
aagaccgcagtaaagtgtgcttaat

SEQ ID NO: 45392 - DNA, 25 bp, Mus musculus
aagaccgcagtatagtgtgcttaat

SEQ ID NO: 45393 - DNA, 25 bp, Mus musculus
aagaccgcagttcacgaagccttgt

SEQ ID NO: 45394 - DNA, 25 bp, Mus musculus
aagaccgcagttgacgaagccttgt

SEQ ID NO: 45395 - DNA, 25 bp, Mus musculus
aagaccggaaggcatgtttcatcat

SEQ ID NO: 45396 - DNA, 25 bp, Mus musculus
aagaccggaagggatgtttcatcat

SEQ ID NO: 45397 - DNA, 25 bp, Mus musculus
aagaccggcatgctgatgtcctcaa

SEQ ID NO: 45398 - DNA, 25 bp, Mus musculus
aagaccggcatggtgatgtcctcaa

SEQ ID NO: 45399 - DNA, 25 bp, Mus musculus
aagaccgggagcacttcctggaaag

SEQ ID NO: 45400 - DNA, 25 bp, Mus musculus
aagaccgggagctcttcctggaaag

SEQ ID NO: 45401 - DNA, 25 bp, Mus musculus
aagaccggttccagatcatggctgc

SEQ ID NO: 45402 - DNA, 25 bp, Mus musculus
aagaccggttcctgatcatggctgc

SEQ ID NO: 45403 - DNA, 25 bp, Mus musculus
aagaccgtaaccacgttcatattgg

SEQ ID NO: 45404 - DNA, 25 bp, Mus musculus
aagaccgtaacctcgttcatattgg

SEQ ID NO: 45405 - DNA, 25 bp, Mus musculus
aagaccgtaaggagctcttcagtgg

SEQ ID NO: 45406 - DNA, 25 bp, Mus musculus
aagaccgtaaggtgctcttcagtgg

SEQ ID NO: 45407 - DNA, 25 bp, Mus musculus
aagaccgtagagcaggctgctcagt

SEQ ID NO: 45408 - DNA, 25 bp, Mus musculus
aagaccgtagaggaggctgctcagt

SEQ ID NO: 45409 - DNA, 25 bp, Mus musculus
aagaccgtctacagggatcgagaca

SEQ ID NO: 45410 - DNA, 25 bp, Mus musculus
aagaccgtctactgggatcgagaca

SEQ ID NO: 45411 - DNA, 25 bp, Mus musculus
aagaccgtctgcactcactacctgt

SEQ ID NO: 45412 - DNA, 25 bp, Mus musculus
aagaccgtctgctctcactacctgt

SEQ ID NO: 45413 - DNA, 25 bp, Mus musculus
aagaccgtgatcaagaaagatgaac

SEQ ID NO: 45414 - DNA, 25 bp, Mus musculus
aagaccgtgatctagaaagatgaac

SEQ ID NO: 45415 - DNA, 25 bp, Mus musculus
aagaccgtgtgcaattccagctgag

SEQ ID NO: 45416 - DNA, 25 bp, Mus musculus
aagaccgtgtgctattccagctgag

SEQ ID NO: 45417 - DNA, 25 bp, Mus musculus
aagacctaagagatgctttttggat

SEQ ID NO: 45418 - DNA, 25 bp, Mus musculus
aagacctaagagttgctttttggat

SEQ ID NO: 45419 - DNA, 25 bp, Mus musculus
aagacctaagatcctgtggctaaaa

SEQ ID NO: 45420 - DNA, 25 bp, Mus musculus
aagacctaagatgctgtggctaaaa

SEQ ID NO: 45421 - DNA, 25 bp, Mus musculus
aagacctaatggctgccagccttgc

SEQ ID NO: 45422 - DNA, 25 bp, Mus musculus
aagacctaatgggtgccagccttgc

SEQ ID NO: 45423 - DNA, 25 bp, Mus musculus
aagacctaccatacgagagagtgca

SEQ ID NO: 45424 - DNA, 25 bp, Mus musculus
aagacctaccattcgagagagtgca

SEQ ID NO: 45425 - DNA, 25 bp, Mus musculus
aagacctagcctagaagatccccta

SEQ ID NO: 45426 - DNA, 25 bp, Mus musculus
aagacctagccttgaagatccccta

SEQ ID NO: 45427 - DNA, 25 bp, Mus musculus
aagacctaggaactctgggctacgt

SEQ ID NO: 45428 - DNA, 25 bp, Mus musculus
aagacctaggaagtctgggctacgt

SEQ ID NO: 45429 - DNA, 25 bp, Mus musculus
aagacctaggtgaccacatacctgc

SEQ ID NO: 45430 - DNA, 25 bp, Mus musculus
aagacctaggtgtccacatacctgc

SEQ ID NO: 45431 - DNA, 25 bp, Mus musculus
aagacctatggcagtgttcctgtgg

SEQ ID NO: 45432 - DNA, 25 bp, Mus musculus
aagacctatggctgtgttcctgtgg

SEQ ID NO: 45433 - DNA, 25 bp, Mus musculus
aagacctatgtccaagactggtgag

SEQ ID NO: 45434 - DNA, 25 bp, Mus musculus
aagacctatgtcgaagactggtgag

SEQ ID NO: 45435 - DNA, 25 bp, Mus musculus
aagacctcaacaagtttcacacctt

SEQ ID NO: 45436 - DNA, 25 bp, Mus musculus
aagacctcaacatgtttcacacctt

SEQ ID NO: 45437 - DNA, 25 bp, Mus musculus
aagacctcaaggaaagccccagaag

SEQ ID NO: 45438 - DNA, 25 bp, Mus musculus
aagacctcaaggtaagccccagaag

SEQ ID NO: 45439 - DNA, 25 bp, Mus musculus
aagacctcacccaggagcagagaga

SEQ ID NO: 45440 - DNA, 25 bp, Mus musculus
aagacctcaccctggagcagagaga

SEQ ID NO: 45441 - DNA, 25 bp, Mus musculus
aagacctcacggactttgcagttta

SEQ ID NO: 45442 - DNA, 25 bp, Mus musculus
aagacctcacggtctttgcagttta

SEQ ID NO: 45443 - DNA, 25 bp, Mus musculus
aagacctcagctagtggtactgccc

SEQ ID NO: 45444 - DNA, 25 bp, Mus musculus
aagacctcagctcatgggtgatgct

SEQ ID NO: 45445 - DNA, 25 bp, Mus musculus
aagacctcagctgatgggtgatgct

SEQ ID NO: 45446 - DNA, 25 bp, Mus musculus
aagacctcagcttgtggtactgccc

SEQ ID NO: 45447 - DNA, 25 bp, Mus musculus
aagacctcagtactgttcaacaagc

SEQ ID NO: 45448 - DNA, 25 bp, Mus musculus
aagacctcagtagtgttcaacaagc

SEQ ID NO: 45449 - DNA, 25 bp, Mus musculus
aagacctcatcacatcctgaaattc

SEQ ID NO: 45450 - DNA, 25 bp, Mus musculus
aagacctcatcagatcctgaaattc

SEQ ID NO: 45451 - DNA, 25 bp, Mus musculus
aagacctcattcacctgagattgga

SEQ ID NO: 45452 - DNA, 25 bp, Mus musculus
aagacctcattctcctgagattgga

SEQ ID NO: 45453 - DNA, 25 bp, Mus musculus
aagacctccgcaaccaagtgaaacc

SEQ ID NO: 45454 - DNA, 25 bp, Mus musculus
aagacctccgcatccaagtgaaacc

SEQ ID NO: 45455 - DNA, 25 bp, Mus musculus
aagacctcctcactgtaacaattct

SEQ ID NO: 45456 - DNA, 25 bp, Mus musculus
aagacctcctcagtgtaacaattct

SEQ ID NO: 45457 - DNA, 25 bp, Mus musculus
aagacctcctcgaccatgagtagtg

SEQ ID NO: 45458 - DNA, 25 bp, Mus musculus
aagacctcctcgtccatgagtagtg

SEQ ID NO: 45459 - DNA, 25 bp, Mus musculus
aagacctcctggagccgagaactga

SEQ ID NO: 45460 - DNA, 25 bp, Mus musculus
aagacctcctggtgccgagaactga

SEQ ID NO: 45461 - DNA, 25 bp, Mus musculus
aagacctccttcaacttggcagaaa

SEQ ID NO: 45462 - DNA, 25 bp, Mus musculus
aagacctccttctacttggcagaaa

SEQ ID NO: 45463 - DNA, 25 bp, Mus musculus
aagacctccttgagcaccaggtaca

SEQ ID NO: 45464 - DNA, 25 bp, Mus musculus
aagacctccttgtgcaccaggtaca

SEQ ID NO: 45465 - DNA, 25 bp, Mus musculus
aagacctcctttagtcacaacactt

SEQ ID NO: 45466 - DNA, 25 bp, Mus musculus
aagacctccttttgtcacaacactt

SEQ ID NO: 45467 - DNA, 25 bp, Mus musculus
aagacctcgaagaggactggagcct

SEQ ID NO: 45468 - DNA, 25 bp, Mus musculus
aagacctcgaagtggactggagcct

SEQ ID NO: 45469 - DNA, 25 bp, Mus musculus
aagacctcgcttccacagggacagg

SEQ ID NO: 45470 - DNA, 25 bp, Mus musculus
aagacctcgcttgcacagggacagg

SEQ ID NO: 45471 - DNA, 25 bp, Mus musculus
aagacctcgttgctgacactatgga

SEQ ID NO: 45472 - DNA, 25 bp, Mus musculus
aagacctcgttggtgacactatgga

SEQ ID NO: 45473 - DNA, 25 bp, Mus musculus
aagacctctagactccaggatctgg

SEQ ID NO: 45474 - DNA, 25 bp, Mus musculus
aagacctctagagtccaggatctgg

SEQ ID NO: 45475 - DNA, 25 bp, Mus musculus
aagacctctctaattaacacaatga

SEQ ID NO: 45476 - DNA, 25 bp, Mus musculus
aagacctctctatttaacacaatga

SEQ ID NO: 45477 - DNA, 25 bp, Mus musculus
aagacctctctgaaggttctctgtg

SEQ ID NO: 45478 - DNA, 25 bp, Mus musculus
aagacctctctgtaggttctctgtg

SEQ ID NO: 45479 - DNA, 25 bp, Mus musculus
aagacctctgagatttcacacagca

SEQ ID NO: 45480 - DNA, 25 bp, Mus musculus
aagacctctgagttttcacacagca

SEQ ID NO: 45481 - DNA, 25 bp, Mus musculus
aagacctctggtcatgcggcagcac

SEQ ID NO: 45482 - DNA, 25 bp, Mus musculus
aagacctctggtgatgcggcagcac

SEQ ID NO: 45483 - DNA, 25 bp, Mus musculus
aagacctcttagaaccatggagaaa

SEQ ID NO: 45484 - DNA, 25 bp, Mus musculus
aagacctcttagtaccatggagaaa

SEQ ID NO: 45485 - DNA, 25 bp, Mus musculus
aagacctcttatctgtattgatggg

SEQ ID NO: 45486 - DNA, 25 bp, Mus musculus
aagacctcttatgtgtattgatggg

SEQ ID NO: 45487 - DNA, 25 bp, Mus musculus
aagacctcttctcacaatttctaga

SEQ ID NO: 45488 - DNA, 25 bp, Mus musculus
aagacctcttctgacaatttctaga

SEQ ID NO: 45489 - DNA, 25 bp, Mus musculus
aagacctctttgaagccaaacaagt

SEQ ID NO: 45490 - DNA, 25 bp, Mus musculus
aagacctctttgtagccaaacaagt

SEQ ID NO: 45491 - DNA, 25 bp, Mus musculus
aagacctgactgaaactttgctttc

SEQ ID NO: 45492 - DNA, 25 bp, Mus musculus
aagacctgactgtaactttgctttc

SEQ ID NO: 45493 - DNA, 25 bp, Mus musculus
aagacctgagctactgttctgtatt

SEQ ID NO: 45494 - DNA, 25 bp, Mus musculus
aagacctgagcttctgttctgtatt

SEQ ID NO: 45495 - DNA, 25 bp, Mus musculus
aagacctgatggctccattcttgga

SEQ ID NO: 45496 - DNA, 25 bp, Mus musculus
aagacctgatgggtccattcttgga

SEQ ID NO: 45497 - DNA, 25 bp, Mus musculus
aagacctgcaagagccctgggcgta

SEQ ID NO: 45498 - DNA, 25 bp, Mus musculus
aagacctgcaagtgccctgggcgta

SEQ ID NO: 45499 - DNA, 25 bp, Mus musculus
aagacctgcatgacctctgtctaag

SEQ ID NO: 45500 - DNA, 25 bp, Mus musculus
aagacctgcatgtcctctgtctaag

SEQ ID NO: 45501 - DNA, 25 bp, Mus musculus
aagacctgccctagtgctgcctgct

SEQ ID NO: 45502 - DNA, 25 bp, Mus musculus
aagacctgcccttgtgctgcctgct

SEQ ID NO: 45503 - DNA, 25 bp, Mus musculus
aagacctgctaactggcatttggtt

SEQ ID NO: 45504 - DNA, 25 bp, Mus musculus
aagacctgctaagtggcatttggtt

SEQ ID NO: 45505 - DNA, 25 bp, Mus musculus
aagacctgctgcctggcatcgactg

SEQ ID NO: 45506 - DNA, 25 bp, Mus musculus
aagacctgctgcgtggcatcgactg

SEQ ID NO: 45507 - DNA, 25 bp, Mus musculus
aagacctggaaactgctgtttgact

SEQ ID NO: 45508 - DNA, 25 bp, Mus musculus
aagacctggaaagtgctgtttgact

SEQ ID NO: 45509 - DNA, 25 bp, Mus musculus
aagacctggaccacactgtgagcat

SEQ ID NO: 45510 - DNA, 25 bp, Mus musculus
aagacctggacctcactgtgagcat

SEQ ID NO: 45511 - DNA, 25 bp, Mus musculus
aagacctggaggactgaggccccaa

SEQ ID NO: 45512 - DNA, 25 bp, Mus musculus
aagacctggaggtctgaggccccaa

SEQ ID NO: 45513 - DNA, 25 bp, Mus musculus
aagacctggcaacaatatgactgtt

SEQ ID NO: 45514 - DNA, 25 bp, Mus musculus
aagacctggcaagaatatgactgtt

SEQ ID NO: 45515 - DNA, 25 bp, Mus musculus
aagacctgggagactgtcgcagttt

SEQ ID NO: 45516 - DNA, 25 bp, Mus musculus
aagacctgggagtctgtcgcagttt

SEQ ID NO: 45517 - DNA, 25 bp, Mus musculus
aagacctgggatcgattccagatga

SEQ ID NO: 45518 - DNA, 25 bp, Mus musculus
aagacctgggatggattccagatga

SEQ ID NO: 45519 - DNA, 25 bp, Mus musculus
aagacctgggcaacagactgacaga

SEQ ID NO: 45520 - DNA, 25 bp, Mus musculus
aagacctgggcatcagactgacaga

SEQ ID NO: 45521 - DNA, 25 bp, Mus musculus
aagacctgggctaggtacccagctt

SEQ ID NO: 45522 - DNA, 25 bp, Mus musculus
aagacctgggcttggtacccagctt

SEQ ID NO: 45523 - DNA, 25 bp, Mus musculus
aagacctggtacacaaacttgacga

SEQ ID NO: 45524 - DNA, 25 bp, Mus musculus
aagacctggtactcaaacttgacga

SEQ ID NO: 45525 - DNA, 25 bp, Mus musculus
aagacctggtgaaagccaatggtga

SEQ ID NO: 45526 - DNA, 25 bp, Mus musculus
aagacctggtgatagccaatggtga

SEQ ID NO: 45527 - DNA, 25 bp, Mus musculus
aagacctggttcacatcatggagca

SEQ ID NO: 45528 - DNA, 25 bp, Mus musculus
aagacctggttctcatcatggagca

SEQ ID NO: 45529 - DNA, 25 bp, Mus musculus
aagacctgtagtaagcaagcatgaa

SEQ ID NO: 45530 - DNA, 25 bp, Mus musculus
aagacctgtagttagcaagcatgaa

SEQ ID NO: 45531 - DNA, 25 bp, Mus musculus
aagacctgtcagatgatgcctcaga

SEQ ID NO: 45532 - DNA, 25 bp, Mus musculus
aagacctgtcagttgatgcctcaga

SEQ ID NO: 45533 - DNA, 25 bp, Mus musculus
aagacctgtctgctggaggataccc

SEQ ID NO: 45534 - DNA, 25 bp, Mus musculus
aagacctgtctggtggaggataccc

SEQ ID NO: 45535 - DNA, 25 bp, Mus musculus
aagacctgttatcatcagccttgcc

SEQ ID NO: 45536 - DNA, 25 bp, Mus musculus
aagacctgttatgatcagccttgcc

SEQ ID NO: 45537 - DNA, 25 bp, Mus musculus
aagacctgttctccgtttacatgag

SEQ ID NO: 45538 - DNA, 25 bp, Mus musculus
aagacctgttctgcgtttacatgag

SEQ ID NO: 45539 - DNA, 25 bp, Mus musculus
aagacctgtttacctgcctagatgg

SEQ ID NO: 45540 - DNA, 25 bp, Mus musculus
aagacctgtttagctgcctagatgg

SEQ ID NO: 45541 - DNA, 25 bp, Mus musculus
aagaccttaagcctgcgcttacagg

SEQ ID NO: 45542 - DNA, 25 bp, Mus musculus
aagaccttaagcgtgcgcttacagg

SEQ ID NO: 45543 - DNA, 25 bp, Mus musculus
aagaccttactaaatatgcgagact

SEQ ID NO: 45544 - DNA, 25 bp, Mus musculus
aagaccttactatatatgcgagact

SEQ ID NO: 45545 - DNA, 25 bp, Mus musculus
aagaccttcaaaccacagtgtaaat

SEQ ID NO: 45546 - DNA, 25 bp, Mus musculus
aagaccttcaaagcacagtgtaaat

SEQ ID NO: 45547 - DNA, 25 bp, Mus musculus
aagaccttccataacctgattctga

SEQ ID NO: 45548 - DNA, 25 bp, Mus musculus
aagaccttccattacctgattctga

SEQ ID NO: 45549 - DNA, 25 bp, Mus musculus
aagaccttccttctgccaaaatcaa

SEQ ID NO: 45550 - DNA, 25 bp, Mus musculus
aagaccttccttgtgccaaaatcaa

SEQ ID NO: 45551 - DNA, 25 bp, Mus musculus
aagaccttcgttagcattacgccag

SEQ ID NO: 45552 - DNA, 25 bp, Mus musculus
aagaccttcgtttgcattacgccag

SEQ ID NO: 45553 - DNA, 25 bp, Mus musculus
aagaccttctctccctcgatgatgc

SEQ ID NO: 45554 - DNA, 25 bp, Mus musculus
aagaccttctctgcctcgatgatgc

SEQ ID NO: 45555 - DNA, 25 bp, Mus musculus
aagaccttcttgcagcgggaatacc

SEQ ID NO: 45556 - DNA, 25 bp, Mus musculus
aagaccttcttggagcgggaatacc

SEQ ID NO: 45557 - DNA, 25 bp, Mus musculus
aagaccttgaagaactggatccaga

SEQ ID NO: 45558 - DNA, 25 bp, Mus musculus
aagaccttgaagcaccgtaaactat

SEQ ID NO: 45559 - DNA, 25 bp, Mus musculus
aagaccttgaaggaccgtaaactat

SEQ ID NO: 45560 - DNA, 25 bp, Mus musculus
aagaccttgaagtactggatccaga

SEQ ID NO: 45561 - DNA, 25 bp, Mus musculus
aagaccttgagcctcccatggaacc

SEQ ID NO: 45562 - DNA, 25 bp, Mus musculus
aagaccttgagcgtcccatggaacc

SEQ ID NO: 45563 - DNA, 25 bp, Mus musculus
aagaccttgaggacaatcccagcac

SEQ ID NO: 45564 - DNA, 25 bp, Mus musculus
aagaccttgaggtcaatcccagcac

SEQ ID NO: 45565 - DNA, 25 bp, Mus musculus
aagaccttgattcctacatgtggaa

SEQ ID NO: 45566 - DNA, 25 bp, Mus musculus
aagaccttgattgctacatgtggaa

SEQ ID NO: 45567 - DNA, 25 bp, Mus musculus
aagaccttgcagcagacaacgtaga

SEQ ID NO: 45568 - DNA, 25 bp, Mus musculus
aagaccttgcaggagacaacgtaga

SEQ ID NO: 45569 - DNA, 25 bp, Mus musculus
aagaccttgctgacccagagtgtac

SEQ ID NO: 45570 - DNA, 25 bp, Mus musculus
aagaccttgctgtcccagagtgtac

SEQ ID NO: 45571 - DNA, 25 bp, Mus musculus
aagaccttggtccacttatgcctga

SEQ ID NO: 45572 - DNA, 25 bp, Mus musculus
aagaccttggtcgacttatgcctga

SEQ ID NO: 45573 - DNA, 25 bp, Mus musculus
aagaccttgtagcatctctgaagcc

SEQ ID NO: 45574 - DNA, 25 bp, Mus musculus
aagaccttgtaggatctctgaagcc

SEQ ID NO: 45575 - DNA, 25 bp, Mus musculus
aagaccttgtatctttacgaattct

SEQ ID NO: 45576 - DNA, 25 bp, Mus musculus
aagaccttgtatgtttacgaattct

SEQ ID NO: 45577 - DNA, 25 bp, Mus musculus
aagaccttgtctatgagggctcagc

SEQ ID NO: 45578 - DNA, 25 bp, Mus musculus
aagaccttgtctttgagggctcagc

SEQ ID NO: 45579 - DNA, 25 bp, Mus musculus
aagacctttaatctctatctctctc

SEQ ID NO: 45580 - DNA, 25 bp, Mus musculus
aagacctttaatgtctatctctctc

SEQ ID NO: 45581 - DNA, 25 bp, Mus musculus
aagacctttcctagatacaagatag

SEQ ID NO: 45582 - DNA, 25 bp, Mus musculus
aagacctttccttgatacaagatag

SEQ ID NO: 45583 - DNA, 25 bp, Mus musculus
aagacctttcttcatggttcaaaat

SEQ ID NO: 45584 - DNA, 25 bp, Mus musculus
aagacctttcttgatggttcaaaat

SEQ ID NO: 45585 - DNA, 25 bp, Mus musculus
aagacctttgccatcaacttcaggg

SEQ ID NO: 45586 - DNA, 25 bp, Mus musculus
aagacctttgccttcaacttcaggg

SEQ ID NO: 45587 - DNA, 25 bp, Mus musculus
aagacctttggtagacattcgattt

SEQ ID NO: 45588 - DNA, 25 bp, Mus musculus
aagacctttggttgacattcgattt

SEQ ID NO: 45589 - DNA, 25 bp, Mus musculus
aagacctttgtacagtgaactgcct

SEQ ID NO: 45590 - DNA, 25 bp, Mus musculus
aagacctttgtagagtgaactgcct

SEQ ID NO: 45591 - DNA, 25 bp, Mus musculus
aagaccttttagcaccatgggacag

SEQ ID NO: 45592 - DNA, 25 bp, Mus musculus
aagaccttttaggaccatgggacag

SEQ ID NO: 45593 - DNA, 25 bp, Mus musculus
aagacgaaatgcctggaacccttca

SEQ ID NO: 45594 - DNA, 25 bp, Mus musculus
aagacgaaatgcgtggaacccttca

SEQ ID NO: 45595 - DNA, 25 bp, Mus musculus
aagacgaactgcatgccttgaccac

SEQ ID NO: 45596 - DNA, 25 bp, Mus musculus
aagacgaactgcttgccttgaccac

SEQ ID NO: 45597 - DNA, 25 bp, Mus musculus
aagacgaccactacacataggcttc

SEQ ID NO: 45598 - DNA, 25 bp, Mus musculus
aagacgaccacttcacataggcttc

SEQ ID NO: 45599 - DNA, 25 bp, Mus musculus
aagacgaccatgctgtgcgccggcg

SEQ ID NO: 45600 - DNA, 25 bp, Mus musculus
aagacgaccatggtgtgcgccggcg

SEQ ID NO: 45601 - DNA, 25 bp, Mus musculus
aagacgacctgaacagggccatcaa

SEQ ID NO: 45602 - DNA, 25 bp, Mus musculus
aagacgacctgatcagggccatcaa

SEQ ID NO: 45603 - DNA, 25 bp, Mus musculus
aagacgacgaggattcccttgctct

SEQ ID NO: 45604 - DNA, 25 bp, Mus musculus
aagacgacgaggtttcccttgctct

SEQ ID NO: 45605 - DNA, 25 bp, Mus musculus
aagacgacggagaagttctcgcaca

SEQ ID NO: 45606 - DNA, 25 bp, Mus musculus
aagacgacggagtagttctcgcaca

SEQ ID NO: 45607 - DNA, 25 bp, Mus musculus
aagacgacggcaaactggattttag

SEQ ID NO: 45608 - DNA, 25 bp, Mus musculus
aagacgacggcatactggattttag

SEQ ID NO: 45609 - DNA, 25 bp, Mus musculus
aagacgacggctcctttgtggcttc

SEQ ID NO: 45610 - DNA, 25 bp, Mus musculus
aagacgacggctgctttgtggcttc

SEQ ID NO: 45611 - DNA, 25 bp, Mus musculus
aagacgactacaaggtccaaacatt

SEQ ID NO: 45612 - DNA, 25 bp, Mus musculus
aagacgactacatggtccaaacatt

SEQ ID NO: 45613 - DNA, 25 bp, Mus musculus
aagacgagaattcccagtgccctac

SEQ ID NO: 45614 - DNA, 25 bp, Mus musculus
aagacgagaattgccagtgccctac

SEQ ID NO: 45615 - DNA, 25 bp, Mus musculus
aagacgagcgcaattccaagttgga

SEQ ID NO: 45616 - DNA, 25 bp, Mus musculus
aagacgagcgcatttccaagttgga

SEQ ID NO: 45617 - DNA, 25 bp, Mus musculus
aagacgagcgctatccgacgaggat

SEQ ID NO: 45618 - DNA, 25 bp, Mus musculus
aagacgagcgctttccgacgaggat

SEQ ID NO: 45619 - DNA, 25 bp, Mus musculus
aagacgagtcacagtttggaactgt

SEQ ID NO: 45620 - DNA, 25 bp, Mus musculus
aagacgagtcactgtttggaactgt

SEQ ID NO: 45621 - DNA, 25 bp, Mus musculus
aagacgagtgccatgagcctgagca

SEQ ID NO: 45622 - DNA, 25 bp, Mus musculus
aagacgagtgccttgagcctgagca

SEQ ID NO: 45623 - DNA, 25 bp, Mus musculus
aagacgatcattcagaaggttgttc

SEQ ID NO: 45624 - DNA, 25 bp, Mus musculus
aagacgatcattgagaaggttgttc

SEQ ID NO: 45625 - DNA, 25 bp, Mus musculus
aagacgatcgctatctcgttacttc

SEQ ID NO: 45626 - DNA, 25 bp, Mus musculus
aagacgatcgctcagggcagaccag

SEQ ID NO: 45627 - DNA, 25 bp, Mus musculus
aagacgatcgctgagggcagaccag

SEQ ID NO: 45628 - DNA, 25 bp, Mus musculus
aagacgatcgctttctcgttacttc

SEQ ID NO: 45629 - DNA, 25 bp, Mus musculus
aagacgatctgaacaggccccagtc

SEQ ID NO: 45630 - DNA, 25 bp, Mus musculus
aagacgatctgatcaggccccagtc

SEQ ID NO: 45631 - DNA, 25 bp, Mus musculus
aagacgatgactaccacctaaagga

SEQ ID NO: 45632 - DNA, 25 bp, Mus musculus
aagacgatgacttccacctaaagga

SEQ ID NO: 45633 - DNA, 25 bp, Mus musculus
aagacgatgcgcctcatgagctaga

SEQ ID NO: 45634 - DNA, 25 bp, Mus musculus
aagacgatgcgcgtcatgagctaga

SEQ ID NO: 45635 - DNA, 25 bp, Mus musculus
aagacgattccacttacaccagcag

SEQ ID NO: 45636 - DNA, 25 bp, Mus musculus
aagacgattccagttacaccagcag

SEQ ID NO: 45637 - DNA, 25 bp, Mus musculus
aagacgattgcactctccagtgaaa

SEQ ID NO: 45638 - DNA, 25 bp, Mus musculus
aagacgattgcagtctccagtgaaa

SEQ ID NO: 45639 - DNA, 25 bp, Mus musculus
aagacgattgtaaggcttgtgcaga

SEQ ID NO: 45640 - DNA, 25 bp, Mus musculus
aagacgattgtatggcttgtgcaga

SEQ ID NO: 45641 - DNA, 25 bp, Mus musculus
aagacgatttacctacaacattcca

SEQ ID NO: 45642 - DNA, 25 bp, Mus musculus
aagacgatttacgtacaacattcca

SEQ ID NO: 45643 - DNA, 25 bp, Mus musculus
aagacgcaaacacctcatgtgctca

SEQ ID NO: 45644 - DNA, 25 bp, Mus musculus
aagacgcaaacagctcatgtgctca

SEQ ID NO: 45645 - DNA, 25 bp, Mus musculus
aagacgcacactctgttcagacggt

SEQ ID NO: 45646 - DNA, 25 bp, Mus musculus
aagacgcacactgtgttcagacggt

SEQ ID NO: 45647 - DNA, 25 bp, Mus musculus
aagacgcacatgatgcaaagggcaa

SEQ ID NO: 45648 - DNA, 25 bp, Mus musculus
aagacgcacatgttgcaaagggcaa

SEQ ID NO: 45649 - DNA, 25 bp, Mus musculus
aagacgcagatacagcagttgccag

SEQ ID NO: 45650 - DNA, 25 bp, Mus musculus
aagacgcagatagagcagttgccag

SEQ ID NO: 45651 - DNA, 25 bp, Mus musculus
aagacgcaggctatcagagggtgac

SEQ ID NO: 45652 - DNA, 25 bp, Mus musculus
aagacgcaggctttcagagggtgac

SEQ ID NO: 45653 - DNA, 25 bp, Mus musculus
aagacgcagtagctgtcctgagcct

SEQ ID NO: 45654 - DNA, 25 bp, Mus musculus
aagacgcagtaggtgtcctgagcct

SEQ ID NO: 45655 - DNA, 25 bp, Mus musculus
aagacgcattccagactagcttaga

SEQ ID NO: 45656 - DNA, 25 bp, Mus musculus
aagacgcattcctgactagcttaga

SEQ ID NO: 45657 - DNA, 25 bp, Mus musculus
aagacgccaaagagaacggctccag

SEQ ID NO: 45658 - DNA, 25 bp, Mus musculus
aagacgccaaagtgaacggctccag

SEQ ID NO: 45659 - DNA, 25 bp, Mus musculus
aagacgcctgatcgtgttctctgca

SEQ ID NO: 45660 - DNA, 25 bp, Mus musculus
aagacgcctgatggtgttctctgca

SEQ ID NO: 45661 - DNA, 25 bp, Mus musculus
aagacgcctgttcaggtgtccccga

SEQ ID NO: 45662 - DNA, 25 bp, Mus musculus
aagacgcctgttgaggtgtccccga

SEQ ID NO: 45663 - DNA, 25 bp, Mus musculus
aagacgcgctcacaagaagttccag

SEQ ID NO: 45664 - DNA, 25 bp, Mus musculus
aagacgcgctcagaagaagttccag

SEQ ID NO: 45665 - DNA, 25 bp, Mus musculus
aagacgcggactcgtgataacccac

SEQ ID NO: 45666 - DNA, 25 bp, Mus musculus
aagacgcggactggtgataacccac

SEQ ID NO: 45667 - DNA, 25 bp, Mus musculus
aagacgctagtcctgctgatgggca

SEQ ID NO: 45668 - DNA, 25 bp, Mus musculus
aagacgctagtcgtgctgatgggca

SEQ ID NO: 45669 - DNA, 25 bp, Mus musculus
aagacgctcaggacaaatggttgct

SEQ ID NO: 45670 - DNA, 25 bp, Mus musculus
aagacgctcaggtcaaatggttgct

SEQ ID NO: 45671 - DNA, 25 bp, Mus musculus
aagacgctcagtcatctggaagcta

SEQ ID NO: 45672 - DNA, 25 bp, Mus musculus
aagacgctcagtgatctggaagcta

SEQ ID NO: 45673 - DNA, 25 bp, Mus musculus
aagacgctcatcacagctgcaccat

SEQ ID NO: 45674 - DNA, 25 bp, Mus musculus
aagacgctcatctcagctgcaccat

SEQ ID NO: 45675 - DNA, 25 bp, Mus musculus
aagacgctgcacatgtggactgctg

SEQ ID NO: 45676 - DNA, 25 bp, Mus musculus
aagacgctgcacttgtggactgctg

SEQ ID NO: 45677 - DNA, 25 bp, Mus musculus
aagacggaagctattgcactggaga

SEQ ID NO: 45678 - DNA, 25 bp, Mus musculus
aagacggaagctccagccgggcttt

SEQ ID NO: 45679 - DNA, 25 bp, Mus musculus
aagacggaagctgcagccgggcttt

SEQ ID NO: 45680 - DNA, 25 bp, Mus musculus
aagacggaagcttttgcactggaga

SEQ ID NO: 45681 - DNA, 25 bp, Mus musculus
aagacggacagacgcaaaactagtt

SEQ ID NO: 45682 - DNA, 25 bp, Mus musculus
aagacggacagactcctttgcactt

SEQ ID NO: 45683 - DNA, 25 bp, Mus musculus
aagacggacagaggcaaaactagtt

SEQ ID NO: 45684 - DNA, 25 bp, Mus musculus
aagacggacagagtcctttgcactt

SEQ ID NO: 45685 - DNA, 25 bp, Mus musculus
aagacggactttcaggtcctcacca

SEQ ID NO: 45686 - DNA, 25 bp, Mus musculus
aagacggactttgaggtcctcacca

SEQ ID NO: 45687 - DNA, 25 bp, Mus musculus
aagacggatcctagagggtctgagt

SEQ ID NO: 45688 - DNA, 25 bp, Mus musculus
aagacggatccttgagggtctgagt

SEQ ID NO: 45689 - DNA, 25 bp, Mus musculus
aagacggatttaagatctacagaga

SEQ ID NO: 45690 - DNA, 25 bp, Mus musculus
aagacggatttatgatctacagaga

SEQ ID NO: 45691 - DNA, 25 bp, Mus musculus
aagacggcacaaacaccacagcaag

SEQ ID NO: 45692 - DNA, 25 bp, Mus musculus
aagacggcacaatcaccacagcaag

SEQ ID NO: 45693 - DNA, 25 bp, Mus musculus
aagacggcacagacaagcttcacct

SEQ ID NO: 45694 - DNA, 25 bp, Mus musculus
aagacggcacagtcaagcttcacct

SEQ ID NO: 45695 - DNA, 25 bp, Mus musculus
aagacggcccacaattttggctaag

SEQ ID NO: 45696 - DNA, 25 bp, Mus musculus
aagacggcccactattttggctaag

SEQ ID NO: 45697 - DNA, 25 bp, Mus musculus
aagacggctccaaacgttctgtact

SEQ ID NO: 45698 - DNA, 25 bp, Mus musculus
aagacggctccatacgttctgtact

SEQ ID NO: 45699 - DNA, 25 bp, Mus musculus
aagacggctgttactgaccagcaga

SEQ ID NO: 45700 - DNA, 25 bp, Mus musculus
aagacggctgtttctgaccagcaga

SEQ ID NO: 45701 - DNA, 25 bp, Mus musculus
aagacggcttaacgatttccaggat

SEQ ID NO: 45702 - DNA, 25 bp, Mus musculus
aagacggcttaaggatttccaggat

SEQ ID NO: 45703 - DNA, 25 bp, Mus musculus
aagacggctttcaaataaaatccag

SEQ ID NO: 45704 - DNA, 25 bp, Mus musculus
aagacggctttctaataaaatccag

SEQ ID NO: 45705 - DNA, 25 bp, Mus musculus
aagacgggacatactgctgctggca

SEQ ID NO: 45706 - DNA, 25 bp, Mus musculus
aagacgggacattctgctgctggca

SEQ ID NO: 45707 - DNA, 25 bp, Mus musculus
aagacgggcatcagcggaggctcct

SEQ ID NO: 45708 - DNA, 25 bp, Mus musculus
aagacgggcatctgcggaggctcct

SEQ ID NO: 45709 - DNA, 25 bp, Mus musculus
aagacgggcttaattcatttgttga

SEQ ID NO: 45710 - DNA, 25 bp, Mus musculus
aagacgggcttatttcatttgttga

SEQ ID NO: 45711 - DNA, 25 bp, Mus musculus
aagacgggcttcaagaacctgctgc

SEQ ID NO: 45712 - DNA, 25 bp, Mus musculus
aagacgggcttctagaacctgctgc

SEQ ID NO: 45713 - DNA, 25 bp, Mus musculus
aagacgggtacaaactgcatggtat

SEQ ID NO: 45714 - DNA, 25 bp, Mus musculus
aagacgggtacatactgcatggtat

SEQ ID NO: 45715 - DNA, 25 bp, Mus musculus
aagacgggtttcaaagcatagcctg

SEQ ID NO: 45716 - DNA, 25 bp, Mus musculus
aagacgggtttctaagcatagcctg

SEQ ID NO: 45717 - DNA, 25 bp, Mus musculus
aagacggtaacgacagccagcagta

SEQ ID NO: 45718 - DNA, 25 bp, Mus musculus
aagacggtaacgtcagccagcagta

SEQ ID NO: 45719 - DNA, 25 bp, Mus musculus
aagacggtagaaattgaatcaaacg

SEQ ID NO: 45720 - DNA, 25 bp, Mus musculus
aagacggtagaatttgaatcaaacg

SEQ ID NO: 45721 - DNA, 25 bp, Mus musculus
aagacggtcttcagacacctgtggc

SEQ ID NO: 45722 - DNA, 25 bp, Mus musculus
aagacggtcttcatgctggtcatgt

SEQ ID NO: 45723 - DNA, 25 bp, Mus musculus
aagacggtcttctgacacctgtggc

SEQ ID NO: 45724 - DNA, 25 bp, Mus musculus
aagacggtcttcttgctggtcatgt

SEQ ID NO: 45725 - DNA, 25 bp, Mus musculus
aagacggtgattagggctcaagaga

SEQ ID NO: 45726 - DNA, 25 bp, Mus musculus
aagacggtgatttgggctcaagaga

SEQ ID NO: 45727 - DNA, 25 bp, Mus musculus
aagacggtgcggactttctagctgc

SEQ ID NO: 45728 - DNA, 25 bp, Mus musculus
aagacggtgcggtctttctagctgc

SEQ ID NO: 45729 - DNA, 25 bp, Mus musculus
aagacggtgctgatggtaagctaat

SEQ ID NO: 45730 - DNA, 25 bp, Mus musculus
aagacggtgctgttggtaagctaat

SEQ ID NO: 45731 - DNA, 25 bp, Mus musculus
aagacggtggatccttttttcatca

SEQ ID NO: 45732 - DNA, 25 bp, Mus musculus
aagacggtggatgcttttttcatca

SEQ ID NO: 45733 - DNA, 25 bp, Mus musculus
aagacggtgggactcactgttcgca

SEQ ID NO: 45734 - DNA, 25 bp, Mus musculus
aagacggtgggagtcactgttcgca

SEQ ID NO: 45735 - DNA, 25 bp, Mus musculus
aagacggttatgcttgacacgtgac

SEQ ID NO: 45736 - DNA, 25 bp, Mus musculus
aagacggttatggttgacacgtgac

SEQ ID NO: 45737 - DNA, 25 bp, Mus musculus
aagacggttgctcatactttcaaat

SEQ ID NO: 45738 - DNA, 25 bp, Mus musculus
aagacggttgctgatactttcaaat

SEQ ID NO: 45739 - DNA, 25 bp, Mus musculus
aagacggttgtgaggtacactacta

SEQ ID NO: 45740 - DNA, 25 bp, Mus musculus
aagacggttgtgtggtacactacta

SEQ ID NO: 45741 - DNA, 25 bp, Mus musculus
aagacgtaagtcagctcccagcata

SEQ ID NO: 45742 - DNA, 25 bp, Mus musculus
aagacgtaagtctgctcccagcata

SEQ ID NO: 45743 - DNA, 25 bp, Mus musculus
aagacgtacaatcgccttgcttttc

SEQ ID NO: 45744 - DNA, 25 bp, Mus musculus
aagacgtacaatggccttgcttttc

SEQ ID NO: 45745 - DNA, 25 bp, Mus musculus
aagacgtagcccattcttactcgtt

SEQ ID NO: 45746 - DNA, 25 bp, Mus musculus
aagacgtagccctttcttactcgtt

SEQ ID NO: 45747 - DNA, 25 bp, Mus musculus
aagacgtagcttaatctggcagaat

SEQ ID NO: 45748 - DNA, 25 bp, Mus musculus
aagacgtagctttatctggcagaat

SEQ ID NO: 45749 - DNA, 25 bp, Mus musculus
aagacgtaggctacaagatcctgtg

SEQ ID NO: 45750 - DNA, 25 bp, Mus musculus
aagacgtaggcttcaagatcctgtg

SEQ ID NO: 45751 - DNA, 25 bp, Mus musculus
aagacgtcaacaattctggaacatc

SEQ ID NO: 45752 - DNA, 25 bp, Mus musculus
aagacgtcaacatttctggaacatc

SEQ ID NO: 45753 - DNA, 25 bp, Mus musculus
aagacgtcaccacacatcatttgag

SEQ ID NO: 45754 - DNA, 25 bp, Mus musculus
aagacgtcaccagacatcatttgag

SEQ ID NO: 45755 - DNA, 25 bp, Mus musculus
aagacgtccctgatgattgtacatt

SEQ ID NO: 45756 - DNA, 25 bp, Mus musculus
aagacgtccctgttgattgtacatt

SEQ ID NO: 45757 - DNA, 25 bp, Mus musculus
aagacgtccgccagagctaggcgac

SEQ ID NO: 45758 - DNA, 25 bp, Mus musculus
aagacgtccgcctgagctaggcgac

SEQ ID NO: 45759 - DNA, 25 bp, Mus musculus
aagacgtcgcatattgctgctcttt

SEQ ID NO: 45760 - DNA, 25 bp, Mus musculus
aagacgtcgcattttgctgctcttt

SEQ ID NO: 45761 - DNA, 25 bp, Mus musculus
aagacgtctcccatcagtatttcat

SEQ ID NO: 45762 - DNA, 25 bp, Mus musculus
aagacgtctcccttcagtatttcat

SEQ ID NO: 45763 - DNA, 25 bp, Mus musculus
aagacgtgccctagagttgcagcca

SEQ ID NO: 45764 - DNA, 25 bp, Mus musculus
aagacgtgcccttgagttgcagcca

SEQ ID NO: 45765 - DNA, 25 bp, Mus musculus
aagacgtgcgaacacccgcttttca

SEQ ID NO: 45766 - DNA, 25 bp, Mus musculus
aagacgtgcgaagacccgcttttca

SEQ ID NO: 45767 - DNA, 25 bp, Mus musculus
aagacgtgcgagatctgctcttggc

SEQ ID NO: 45768 - DNA, 25 bp, Mus musculus
aagacgtgcgagttctgctcttggc

SEQ ID NO: 45769 - DNA, 25 bp, Mus musculus
aagacgtgctgcaccagagacaagt

SEQ ID NO: 45770 - DNA, 25 bp, Mus musculus
aagacgtgctgccacactagtgtgt

SEQ ID NO: 45771 - DNA, 25 bp, Mus musculus
aagacgtgctgcgacactagtgtgt

SEQ ID NO: 45772 - DNA, 25 bp, Mus musculus
aagacgtgctgctccagagacaagt

SEQ ID NO: 45773 - DNA, 25 bp, Mus musculus
aagacgtgcttcaacggcgaggagt

SEQ ID NO: 45774 - DNA, 25 bp, Mus musculus
aagacgtgcttctacggcgaggagt

SEQ ID NO: 45775 - DNA, 25 bp, Mus musculus
aagacgtggactccctggtgaacta

SEQ ID NO: 45776 - DNA, 25 bp, Mus musculus
aagacgtggactgcctggtgaacta

SEQ ID NO: 45777 - DNA, 25 bp, Mus musculus
aagacgtggtcgctactacagctgc

SEQ ID NO: 45778 - DNA, 25 bp, Mus musculus
aagacgtggtcggtactacagctgc

SEQ ID NO: 45779 - DNA, 25 bp, Mus musculus
aagacgtgtacaacggcaagcccag

SEQ ID NO: 45780 - DNA, 25 bp, Mus musculus
aagacgtgtacatcggcaagcccag

SEQ ID NO: 45781 - DNA, 25 bp, Mus musculus
aagacgtgttgacttcctggaagaa

SEQ ID NO: 45782 - DNA, 25 bp, Mus musculus
aagacgtgttgagttcctggaagaa

SEQ ID NO: 45783 - DNA, 25 bp, Mus musculus
aagacgttattgctcggctttgtgg

SEQ ID NO: 45784 - DNA, 25 bp, Mus musculus
aagacgttattggtcggctttgtgg

SEQ ID NO: 45785 - DNA, 25 bp, Mus musculus
aagacgttcagcacgagggattaca

SEQ ID NO: 45786 - DNA, 25 bp, Mus musculus
aagacgttcagctcgagggattaca

SEQ ID NO: 45787 - DNA, 25 bp, Mus musculus
aagacgttcccacactcagtaagtg

SEQ ID NO: 45788 - DNA, 25 bp, Mus musculus
aagacgttcccagactcagtaagtg

SEQ ID NO: 45789 - DNA, 25 bp, Mus musculus
aagacgttctcaacatataattcat

SEQ ID NO: 45790 - DNA, 25 bp, Mus musculus
aagacgttctcatcatataattcat

SEQ ID NO: 45791 - DNA, 25 bp, Mus musculus
aagacgttgaggagatagcaaccgt

SEQ ID NO: 45792 - DNA, 25 bp, Mus musculus
aagacgttgaggtgatagcaaccgt

SEQ ID NO: 45793 - DNA, 25 bp, Mus musculus
aagacgttgcctataatatctgttg

SEQ ID NO: 45794 - DNA, 25 bp, Mus musculus
aagacgttgcctttaatatctgttg

SEQ ID NO: 45795 - DNA, 25 bp, Mus musculus
aagacgttgggcatgctcggaagat

SEQ ID NO: 45796 - DNA, 25 bp, Mus musculus
aagacgttgggcattaaattgctga

SEQ ID NO: 45797 - DNA, 25 bp, Mus musculus
aagacgttgggcttgctcggaagat

SEQ ID NO: 45798 - DNA, 25 bp, Mus musculus
aagacgttgggctttaaattgctga

SEQ ID NO: 45799 - DNA, 25 bp, Mus musculus
aagacgtttaacactgtctgtctgt

SEQ ID NO: 45800 - DNA, 25 bp, Mus musculus
aagacgtttaactctgtctgtctgt

SEQ ID NO: 45801 - DNA, 25 bp, Mus musculus
aagacgtttctgcttctcttagcag

SEQ ID NO: 45802 - DNA, 25 bp, Mus musculus
aagacgtttctggttctcttagcag

SEQ ID NO: 45803 - DNA, 25 bp, Mus musculus
aagactaacctacatgcaatttcaa

SEQ ID NO: 45804 - DNA, 25 bp, Mus musculus
aagactaacctagatgcaatttcaa

SEQ ID NO: 45805 - DNA, 25 bp, Mus musculus
aagactaagactcacgtgcacgaat

SEQ ID NO: 45806 - DNA, 25 bp, Mus musculus
aagactaagactgacgtgcacgaat

SEQ ID NO: 45807 - DNA, 25 bp, Mus musculus
aagactaagctgcatgactgatgta

SEQ ID NO: 45808 - DNA, 25 bp, Mus musculus
aagactaagctggatgactgatgta

SEQ ID NO: 45809 - DNA, 25 bp, Mus musculus
aagactaatcagaacttccattaag

SEQ ID NO: 45810 - DNA, 25 bp, Mus musculus
aagactaatcagtacttccattaag

SEQ ID NO: 45811 - DNA, 25 bp, Mus musculus
aagactaattggatgctggcttaag

SEQ ID NO: 45812 - DNA, 25 bp, Mus musculus
aagactaattggttgctggcttaag

SEQ ID NO: 45813 - DNA, 25 bp, Mus musculus
aagactaattttctcactggagtga

SEQ ID NO: 45814 - DNA, 25 bp, Mus musculus
aagactaattttgtcactggagtga

SEQ ID NO: 45815 - DNA, 25 bp, Mus musculus
aagactacaacgatccctgtctgtt

SEQ ID NO: 45816 - DNA, 25 bp, Mus musculus
aagactacaacgttccctgtctgtt

SEQ ID NO: 45817 - DNA, 25 bp, Mus musculus
aagactacaactagttcccttctca

SEQ ID NO: 45818 - DNA, 25 bp, Mus musculus
aagactacaacttgttcccttctca

SEQ ID NO: 45819 - DNA, 25 bp, Mus musculus
aagactacaaggattcagaagcatt

SEQ ID NO: 45820 - DNA, 25 bp, Mus musculus
aagactacaaggtttcagaagcatt

SEQ ID NO: 45821 - DNA, 25 bp, Mus musculus
aagactacacaaagccggaagtatc

SEQ ID NO: 45822 - DNA, 25 bp, Mus musculus
aagactacacaaccctgcatttatg

SEQ ID NO: 45823 - DNA, 25 bp, Mus musculus
aagactacacaagcctgcatttatg

SEQ ID NO: 45824 - DNA, 25 bp, Mus musculus
aagactacacaatgccggaagtatc

SEQ ID NO: 45825 - DNA, 25 bp, Mus musculus
aagactacacccattgtcatcaaag

SEQ ID NO: 45826 - DNA, 25 bp, Mus musculus
aagactacaccctttgtcatcaaag

SEQ ID NO: 45827 - DNA, 25 bp, Mus musculus
aagactacagagaaggtccttgtgc

SEQ ID NO: 45828 - DNA, 25 bp, Mus musculus
aagactacagagtaggtccttgtgc

SEQ ID NO: 45829 - DNA, 25 bp, Mus musculus
aagactacagcgacctcatgtctac

SEQ ID NO: 45830 - DNA, 25 bp, Mus musculus
aagactacagcgtcctcatgtctac

SEQ ID NO: 45831 - DNA, 25 bp, Mus musculus
aagactacatatctgtgcactgtat

SEQ ID NO: 45832 - DNA, 25 bp, Mus musculus
aagactacatatgtgtgcactgtat

SEQ ID NO: 45833 - DNA, 25 bp, Mus musculus
aagactaccacaacaccatagtgat

SEQ ID NO: 45834 - DNA, 25 bp, Mus musculus
aagactaccacatcaccatagtgat

SEQ ID NO: 45835 - DNA, 25 bp, Mus musculus
aagactaccagcatcagcttccact

SEQ ID NO: 45836 - DNA, 25 bp, Mus musculus
aagactaccagcttcagcttccact

SEQ ID NO: 45837 - DNA, 25 bp, Mus musculus
aagactacccgacctggtcagattt

SEQ ID NO: 45838 - DNA, 25 bp, Mus musculus
aagactacccgagctggtcagattt

SEQ ID NO: 45839 - DNA, 25 bp, Mus musculus
aagactaccgctcgtggtggcgatc

SEQ ID NO: 45840 - DNA, 25 bp, Mus musculus
aagactaccgctggtggtggcgatc

SEQ ID NO: 45841 - DNA, 25 bp, Mus musculus
aagactaccttccaaaccattcatt

SEQ ID NO: 45842 - DNA, 25 bp, Mus musculus
aagactaccttcgaaaccattcatt

SEQ ID NO: 45843 - DNA, 25 bp, Mus musculus
aagactacctttctgagttcctcgt

SEQ ID NO: 45844 - DNA, 25 bp, Mus musculus
aagactacctttgtgagttcctcgt

SEQ ID NO: 45845 - DNA, 25 bp, Mus musculus
aagactactactatccagtcctggg

SEQ ID NO: 45846 - DNA, 25 bp, Mus musculus
aagactactactttccagtcctggg

SEQ ID NO: 45847 - DNA, 25 bp, Mus musculus
aagactactctgactctcagacaac

SEQ ID NO: 45848 - DNA, 25 bp, Mus musculus
aagactactctgtctctcagacaac

SEQ ID NO: 45849 - DNA, 25 bp, Mus musculus
aagactactgacaatgccatgctcg

SEQ ID NO: 45850 - DNA, 25 bp, Mus musculus
aagactactgactatgccatgctcg

SEQ ID NO: 45851 - DNA, 25 bp, Mus musculus
aagactactgatcctttcctctgaa

SEQ ID NO: 45852 - DNA, 25 bp, Mus musculus
aagactactgatgctttcctctgaa

SEQ ID NO: 45853 - DNA, 25 bp, Mus musculus
aagactactgtaactcctgacttct

SEQ ID NO: 45854 - DNA, 25 bp, Mus musculus
aagactactgtatctcctgacttct

SEQ ID NO: 45855 - DNA, 25 bp, Mus musculus
aagactacttacagaggcattgcaa

SEQ ID NO: 45856 - DNA, 25 bp, Mus musculus
aagactacttactgaggcattgcaa

SEQ ID NO: 45857 - DNA, 25 bp, Mus musculus
aagactacttgactgtctgtccagc

SEQ ID NO: 45858 - DNA, 25 bp, Mus musculus
aagactacttgagtgtctgtccagc

SEQ ID NO: 45859 - DNA, 25 bp, Mus musculus
aagactagaaccaggaagcttcctg

SEQ ID NO: 45860 - DNA, 25 bp, Mus musculus
aagactagaacctggaagcttcctg

SEQ ID NO: 45861 - DNA, 25 bp, Mus musculus
aagactagaccaagctgaggccgac

SEQ ID NO: 45862 - DNA, 25 bp, Mus musculus
aagactagaccatgctgaggccgac

SEQ ID NO: 45863 - DNA, 25 bp, Mus musculus
aagactagatctcaggagctgtgat

SEQ ID NO: 45864 - DNA, 25 bp, Mus musculus
aagactagatctgaggagctgtgat

SEQ ID NO: 45865 - DNA, 25 bp, Mus musculus
aagactagctatactgtctcctgga

SEQ ID NO: 45866 - DNA, 25 bp, Mus musculus
aagactagctattctgtctcctgga

SEQ ID NO: 45867 - DNA, 25 bp, Mus musculus
aagactaggcaaagtgtaagcacac

SEQ ID NO: 45868 - DNA, 25 bp, Mus musculus
aagactaggcaatgtgtaagcacac

SEQ ID NO: 45869 - DNA, 25 bp, Mus musculus
aagactaggcctcctgccaagggta

SEQ ID NO: 45870 - DNA, 25 bp, Mus musculus
aagactaggcctgctgccaagggta

SEQ ID NO: 45871 - DNA, 25 bp, Mus musculus
aagactaggcttatctctcagccag

SEQ ID NO: 45872 - DNA, 25 bp, Mus musculus
aagactaggcttttctctcagccag

SEQ ID NO: 45873 - DNA, 25 bp, Mus musculus
aagactagggtgatccacctaccct

SEQ ID NO: 45874 - DNA, 25 bp, Mus musculus
aagactagggtgttccacctaccct

SEQ ID NO: 45875 - DNA, 25 bp, Mus musculus
aagactagtcacatatcagtgtatg

SEQ ID NO: 45876 - DNA, 25 bp, Mus musculus
aagactagtcacttatcagtgtatg

SEQ ID NO: 45877 - DNA, 25 bp, Mus musculus
aagactagtcataacctactgtgtt

SEQ ID NO: 45878 - DNA, 25 bp, Mus musculus
aagactagtcattacctactgtgtt

SEQ ID NO: 45879 - DNA, 25 bp, Mus musculus
aagactagttccatttacgagtgct

SEQ ID NO: 45880 - DNA, 25 bp, Mus musculus
aagactagttccttttacgagtgct

SEQ ID NO: 45881 - DNA, 25 bp, Mus musculus
aagactataattaggacattcctga

SEQ ID NO: 45882 - DNA, 25 bp, Mus musculus
aagactataatttggacattcctga

SEQ ID NO: 45883 - DNA, 25 bp, Mus musculus
aagactatatcacaggtgtcagagt

SEQ ID NO: 45884 - DNA, 25 bp, Mus musculus
aagactatatcagaggtgtcagagt

SEQ ID NO: 45885 - DNA, 25 bp, Mus musculus
aagactatattgcaggcccttgcta

SEQ ID NO: 45886 - DNA, 25 bp, Mus musculus
aagactatattggaggcccttgcta

SEQ ID NO: 45887 - DNA, 25 bp, Mus musculus
aagactatcagtacattcacactgg

SEQ ID NO: 45888 - DNA, 25 bp, Mus musculus
aagactatcagttcattcacactgg

SEQ ID NO: 45889 - DNA, 25 bp, Mus musculus
aagactatcttgaccttctgagagt

SEQ ID NO: 45890 - DNA, 25 bp, Mus musculus
aagactatcttgtccttctgagagt

SEQ ID NO: 45891 - DNA, 25 bp, Mus musculus
aagactatgatgatggcgtccctat

SEQ ID NO: 45892 - DNA, 25 bp, Mus musculus
aagactatgatgttggcgtccctat

SEQ ID NO: 45893 - DNA, 25 bp, Mus musculus
aagactatgcatacttctgcaaccc

SEQ ID NO: 45894 - DNA, 25 bp, Mus musculus
aagactatgcattcttctgcaaccc

SEQ ID NO: 45895 - DNA, 25 bp, Mus musculus
aagactatggtacttcctttcctga

SEQ ID NO: 45896 - DNA, 25 bp, Mus musculus
aagactatggtagttcctttcctga

SEQ ID NO: 45897 - DNA, 25 bp, Mus musculus
aagactatggttcctccagtgcact

SEQ ID NO: 45898 - DNA, 25 bp, Mus musculus
aagactatggttgctccagtgcact

SEQ ID NO: 45899 - DNA, 25 bp, Mus musculus
aagactatgtggctcttgagaccta

SEQ ID NO: 45900 - DNA, 25 bp, Mus musculus
aagactatgtgggtcttgagaccta

SEQ ID NO: 45901 - DNA, 25 bp, Mus musculus
aagactattcgtcaggttcctgcag

SEQ ID NO: 45902 - DNA, 25 bp, Mus musculus
aagactattcgtgaggttcctgcag

SEQ ID NO: 45903 - DNA, 25 bp, Mus musculus
aagactattcttctccaaagtgttc

SEQ ID NO: 45904 - DNA, 25 bp, Mus musculus
aagactattcttgtccaaagtgttc

SEQ ID NO: 45905 - DNA, 25 bp, Mus musculus
aagactattgttacctgtgtggcaa

SEQ ID NO: 45906 - DNA, 25 bp, Mus musculus
aagactattgtttcctgtgtggcaa

SEQ ID NO: 45907 - DNA, 25 bp, Mus musculus
aagactatttccagattgtgatcca

SEQ ID NO: 45908 - DNA, 25 bp, Mus musculus
aagactatttccagtaagcttttga

SEQ ID NO: 45909 - DNA, 25 bp, Mus musculus
aagactatttcctgattgtgatcca

SEQ ID NO: 45910 - DNA, 25 bp, Mus musculus
aagactatttcctgtaagcttttga

SEQ ID NO: 45911 - DNA, 25 bp, Mus musculus
aagactatttcgatctcataagtag

SEQ ID NO: 45912 - DNA, 25 bp, Mus musculus
aagactatttcgttctcataagtag

SEQ ID NO: 45913 - DNA, 25 bp, Mus musculus
aagactcaaaagatgatctcatcta

SEQ ID NO: 45914 - DNA, 25 bp, Mus musculus
aagactcaaaagttgatctcatcta

SEQ ID NO: 45915 - DNA, 25 bp, Mus musculus
aagactcaaagcagctttcctataa

SEQ ID NO: 45916 - DNA, 25 bp, Mus musculus
aagactcaaagctgctttcctataa

SEQ ID NO: 45917 - DNA, 25 bp, Mus musculus
aagactcaaggtagcttcactctgg

SEQ ID NO: 45918 - DNA, 25 bp, Mus musculus
aagactcaaggttgcttcactctgg

SEQ ID NO: 45919 - DNA, 25 bp, Mus musculus
aagactcaatctaacaggctccagc

SEQ ID NO: 45920 - DNA, 25 bp, Mus musculus
aagactcaatcttacaggctccagc

SEQ ID NO: 45921 - DNA, 25 bp, Mus musculus
aagactcaattgctcccttggatgg

SEQ ID NO: 45922 - DNA, 25 bp, Mus musculus
aagactcaattggtcccttggatgg

SEQ ID NO: 45923 - DNA, 25 bp, Mus musculus
aagactcacagcactacgtatcaaa

SEQ ID NO: 45924 - DNA, 25 bp, Mus musculus
aagactcacagctctacgtatcaaa

SEQ ID NO: 45925 - DNA, 25 bp, Mus musculus
aagactcactccaggatcctggaac

SEQ ID NO: 45926 - DNA, 25 bp, Mus musculus
aagactcactcctggatcctggaac

SEQ ID NO: 45927 - DNA, 25 bp, Mus musculus
aagactcacttcagccctgatagct

SEQ ID NO: 45928 - DNA, 25 bp, Mus musculus
aagactcacttctgccctgatagct

SEQ ID NO: 45929 - DNA, 25 bp, Mus musculus
aagactcagaacagtcagagactct

SEQ ID NO: 45930 - DNA, 25 bp, Mus musculus
aagactcagaactgtcagagactct

SEQ ID NO: 45931 - DNA, 25 bp, Mus musculus
aagactcagacacgccttgatggtg

SEQ ID NO: 45932 - DNA, 25 bp, Mus musculus
aagactcagacaggccttgatggtg

SEQ ID NO: 45933 - DNA, 25 bp, Mus musculus
aagactcagcgacttgccagtgcct

SEQ ID NO: 45934 - DNA, 25 bp, Mus musculus
aagactcagcgagttgccagtgcct

SEQ ID NO: 45935 - DNA, 25 bp, Mus musculus
aagactcaggcaatcaagactcact

SEQ ID NO: 45936 - DNA, 25 bp, Mus musculus
aagactcaggcattcaagactcact

SEQ ID NO: 45937 - DNA, 25 bp, Mus musculus
aagactcaggtcattcctacaacag

SEQ ID NO: 45938 - DNA, 25 bp, Mus musculus
aagactcaggtctttcctacaacag

SEQ ID NO: 45939 - DNA, 25 bp, Mus musculus
aagactcaggttattacactctaca

SEQ ID NO: 45940 - DNA, 25 bp, Mus musculus
aagactcaggtttttacactctaca

SEQ ID NO: 45941 - DNA, 25 bp, Mus musculus
aagactcatcataccagggcacgga

SEQ ID NO: 45942 - DNA, 25 bp, Mus musculus
aagactcatcattccagggcacgga

SEQ ID NO: 45943 - DNA, 25 bp, Mus musculus
aagactcatcgacaaggcctcctag

SEQ ID NO: 45944 - DNA, 25 bp, Mus musculus
aagactcatcgagaaggcctcctag

SEQ ID NO: 45945 - DNA, 25 bp, Mus musculus
aagactcatggcatgaggagaggca

SEQ ID NO: 45946 - DNA, 25 bp, Mus musculus
aagactcatggcttgaggagaggca

SEQ ID NO: 45947 - DNA, 25 bp, Mus musculus
aagactcatgggagacgcactgcgc

SEQ ID NO: 45948 - DNA, 25 bp, Mus musculus
aagactcatgggtgacgcactgcgc

SEQ ID NO: 45949 - DNA, 25 bp, Mus musculus
aagactccaccaacttaggaataga

SEQ ID NO: 45950 - DNA, 25 bp, Mus musculus
aagactccaccatcttaggaataga

SEQ ID NO: 45951 - DNA, 25 bp, Mus musculus
aagactccagtgcacgacctttttg

SEQ ID NO: 45952 - DNA, 25 bp, Mus musculus
aagactccagtggacgacctttttg

SEQ ID NO: 45953 - DNA, 25 bp, Mus musculus
aagactccatcaataacgttcccag

SEQ ID NO: 45954 - DNA, 25 bp, Mus musculus
aagactccatcattaacgttcccag

SEQ ID NO: 45955 - DNA, 25 bp, Mus musculus
aagactccatctaatctctgtatgg

SEQ ID NO: 45956 - DNA, 25 bp, Mus musculus
aagactccatcttatctctgtatgg

SEQ ID NO: 45957 - DNA, 25 bp, Mus musculus
aagactcccagcctgattatcctaa

SEQ ID NO: 45958 - DNA, 25 bp, Mus musculus
aagactcccagcgtgattatcctaa

SEQ ID NO: 45959 - DNA, 25 bp, Mus musculus
aagactccccaaagcctgattctct

SEQ ID NO: 45960 - DNA, 25 bp, Mus musculus
aagactccccaatgcctgattctct

SEQ ID NO: 45961 - DNA, 25 bp, Mus musculus
aagactccctatcctcttttagctt

SEQ ID NO: 45962 - DNA, 25 bp, Mus musculus
aagactccctatgctcttttagctt

SEQ ID NO: 45963 - DNA, 25 bp, Mus musculus
aagactccctttcacatgtgggtta

SEQ ID NO: 45964 - DNA, 25 bp, Mus musculus
aagactccctttgacatgtgggtta

SEQ ID NO: 45965 - DNA, 25 bp, Mus musculus
aagactccggcgaaagcttggaaga

SEQ ID NO: 45966 - DNA, 25 bp, Mus musculus
aagactccggcgtaagcttggaaga

SEQ ID NO: 45967 - DNA, 25 bp, Mus musculus
aagactccggctacttgaggtacat

SEQ ID NO: 45968 - DNA, 25 bp, Mus musculus
aagactccggcttcttgaggtacat

SEQ ID NO: 45969 - DNA, 25 bp, Mus musculus
aagactccgtgtcgctgtgcaattt

SEQ ID NO: 45970 - DNA, 25 bp, Mus musculus
aagactccgtgtggctgtgcaattt

SEQ ID NO: 45971 - DNA, 25 bp, Mus musculus
aagactcctatacactgtcgcatag

SEQ ID NO: 45972 - DNA, 25 bp, Mus musculus
aagactcctatagactgtcgcatag

SEQ ID NO: 45973 - DNA, 25 bp, Mus musculus
aagactcctcaaatttcaagctccc

SEQ ID NO: 45974 - DNA, 25 bp, Mus musculus
aagactcctcaattttcaagctccc

SEQ ID NO: 45975 - DNA, 25 bp, Mus musculus
aagactcctgcaacctaccttattt

SEQ ID NO: 45976 - DNA, 25 bp, Mus musculus
aagactcctgcatcctaccttattt

SEQ ID NO: 45977 - DNA, 25 bp, Mus musculus
aagactccttataagctgtttgaat

SEQ ID NO: 45978 - DNA, 25 bp, Mus musculus
aagactccttattagctgtttgaat

SEQ ID NO: 45979 - DNA, 25 bp, Mus musculus
aagactccttcaaacagtgacctct

SEQ ID NO: 45980 - DNA, 25 bp, Mus musculus
aagactccttcacattccgagacgc

SEQ ID NO: 45981 - DNA, 25 bp, Mus musculus
aagactccttcagattccgagacgc

SEQ ID NO: 45982 - DNA, 25 bp, Mus musculus
aagactccttcatacagtgacctct

SEQ ID NO: 45983 - DNA, 25 bp, Mus musculus
aagactcctttaacaagttccctgt

SEQ ID NO: 45984 - DNA, 25 bp, Mus musculus
aagactcctttatcaagttccctgt

SEQ ID NO: 45985 - DNA, 25 bp, Mus musculus
aagactcctttcatgcttgttggga

SEQ ID NO: 45986 - DNA, 25 bp, Mus musculus
aagactcctttcttgcttgttggga

SEQ ID NO: 45987 - DNA, 25 bp, Mus musculus
aagactcgacctatgtgaggcaaca

SEQ ID NO: 45988 - DNA, 25 bp, Mus musculus
aagactcgacctttgtgaggcaaca

SEQ ID NO: 45989 - DNA, 25 bp, Mus musculus
aagactcgagtaaagctgctgtttc

SEQ ID NO: 45990 - DNA, 25 bp, Mus musculus
aagactcgagtatagctgctgtttc

SEQ ID NO: 45991 - DNA, 25 bp, Mus musculus
aagactcgctgcagatccggaggat

SEQ ID NO: 45992 - DNA, 25 bp, Mus musculus
aagactcgctgctgatccggaggat

SEQ ID NO: 45993 - DNA, 25 bp, Mus musculus
aagactcggacaagcctggctcgac

SEQ ID NO: 45994 - DNA, 25 bp, Mus musculus
aagactcggacatgcctggctcgac

SEQ ID NO: 45995 - DNA, 25 bp, Mus musculus
aagactcggacgactatgatggaga

SEQ ID NO: 45996 - DNA, 25 bp, Mus musculus
aagactcggacgtctatgatggaga

SEQ ID NO: 45997 - DNA, 25 bp, Mus musculus
aagactcggagacagagttactgct

SEQ ID NO: 45998 - DNA, 25 bp, Mus musculus
aagactcggagagagagttactgct

SEQ ID NO: 45999 - DNA, 25 bp, Mus musculus
aagactcgtattcacgcatgcacac

SEQ ID NO: 46000 - DNA, 25 bp, Mus musculus
aagactcgtattgacgcatgcacac

SEQ ID NO: 46001 - DNA, 25 bp, Mus musculus
aagactctaagtctcgctgttccct

SEQ ID NO: 46002 - DNA, 25 bp, Mus musculus
aagactctaagtgtcgctgttccct

SEQ ID NO: 46003 - DNA, 25 bp, Mus musculus
aagactctaataagcatgtgcgaga

SEQ ID NO: 46004 - DNA, 25 bp, Mus musculus
aagactctaatatgcatgtgcgaga

SEQ ID NO: 46005 - DNA, 25 bp, Mus musculus
aagactctacatagtgccagggttc

SEQ ID NO: 46006 - DNA, 25 bp, Mus musculus
aagactctacattgtgccagggttc

SEQ ID NO: 46007 - DNA, 25 bp, Mus musculus
aagactctagcaagactgttgtgga

SEQ ID NO: 46008 - DNA, 25 bp, Mus musculus
aagactctagcatgactgttgtgga

SEQ ID NO: 46009 - DNA, 25 bp, Mus musculus
aagactctaggaccatctgcctact

SEQ ID NO: 46010 - DNA, 25 bp, Mus musculus
aagactctaggagcatctgcctact

SEQ ID NO: 46011 - DNA, 25 bp, Mus musculus
aagactctagttctcacagacatag

SEQ ID NO: 46012 - DNA, 25 bp, Mus musculus
aagactctagttgtcacagacatag

SEQ ID NO: 46013 - DNA, 25 bp, Mus musculus
aagactctatagcagtcaccttaga

SEQ ID NO: 46014 - DNA, 25 bp, Mus musculus
aagactctataggagtcaccttaga

SEQ ID NO: 46015 - DNA, 25 bp, Mus musculus
aagactctatgcacaaccagctgat

SEQ ID NO: 46016 - DNA, 25 bp, Mus musculus
aagactctatgctcaaccagctgat

SEQ ID NO: 46017 - DNA, 25 bp, Mus musculus
aagactctatttatcagggcttcta

SEQ ID NO: 46018 - DNA, 25 bp, Mus musculus
aagactctatttctgctggcccaca

SEQ ID NO: 46019 - DNA, 25 bp, Mus musculus
aagactctatttgtgctggcccaca

SEQ ID NO: 46020 - DNA, 25 bp, Mus musculus
aagactctatttttcagggcttcta

SEQ ID NO: 46021 - DNA, 25 bp, Mus musculus
aagactctcaatcccagtgacgtgc

SEQ ID NO: 46022 - DNA, 25 bp, Mus musculus
aagactctcaatgccagtgacgtgc

SEQ ID NO: 46023 - DNA, 25 bp, Mus musculus
aagactctcaccaccttgaatgtga

SEQ ID NO: 46024 - DNA, 25 bp, Mus musculus
aagactctcacctccttgaatgtga

SEQ ID NO: 46025 - DNA, 25 bp, Mus musculus
aagactctcatgattccctgttatg

SEQ ID NO: 46026 - DNA, 25 bp, Mus musculus
aagactctcatgtttccctgttatg

SEQ ID NO: 46027 - DNA, 25 bp, Mus musculus
aagactctcgtgatatacatcagtt

SEQ ID NO: 46028 - DNA, 25 bp, Mus musculus
aagactctcgtgttatacatcagtt

SEQ ID NO: 46029 - DNA, 25 bp, Mus musculus
aagactctctctagcactagtgtca

SEQ ID NO: 46030 - DNA, 25 bp, Mus musculus
aagactctctcttgcactagtgtca

SEQ ID NO: 46031 - DNA, 25 bp, Mus musculus
aagactctgcttacactgataactg

SEQ ID NO: 46032 - DNA, 25 bp, Mus musculus
aagactctgcttagcagctattgca

SEQ ID NO: 46033 - DNA, 25 bp, Mus musculus
aagactctgcttcagtctcaggggc

SEQ ID NO: 46034 - DNA, 25 bp, Mus musculus
aagactctgcttgagtctcaggggc

SEQ ID NO: 46035 - DNA, 25 bp, Mus musculus
aagactctgctttcactgataactg

SEQ ID NO: 46036 - DNA, 25 bp, Mus musculus
aagactctgctttgcagctattgca

SEQ ID NO: 46037 - DNA, 25 bp, Mus musculus
aagactctggatcgcatcttctccg

SEQ ID NO: 46038 - DNA, 25 bp, Mus musculus
aagactctggatggcatcttctccg

SEQ ID NO: 46039 - DNA, 25 bp, Mus musculus
aagactctgtctccacgagagctga

SEQ ID NO: 46040 - DNA, 25 bp, Mus musculus
aagactctgtctgcacgagagctga

SEQ ID NO: 46041 - DNA, 25 bp, Mus musculus
aagactctgtggcaccacatggtaa

SEQ ID NO: 46042 - DNA, 25 bp, Mus musculus
aagactctgtgggaccacatggtaa

SEQ ID NO: 46043 - DNA, 25 bp, Mus musculus
aagactctgttacggcatggtgcaa

SEQ ID NO: 46044 - DNA, 25 bp, Mus musculus
aagactctgttagggcatggtgcaa

SEQ ID NO: 46045 - DNA, 25 bp, Mus musculus
aagactcttagcatcgtggtagaca

SEQ ID NO: 46046 - DNA, 25 bp, Mus musculus
aagactcttagcttcgtggtagaca

SEQ ID NO: 46047 - DNA, 25 bp, Mus musculus
aagactcttcagaatcaaatccaac

SEQ ID NO: 46048 - DNA, 25 bp, Mus musculus
aagactcttcagtatcaaatccaac

SEQ ID NO: 46049 - DNA, 25 bp, Mus musculus
aagactcttctgaaggcaaatcaat

SEQ ID NO: 46050 - DNA, 25 bp, Mus musculus
aagactcttctgctatcgatccaca

SEQ ID NO: 46051 - DNA, 25 bp, Mus musculus
aagactcttctggtatcgatccaca

SEQ ID NO: 46052 - DNA, 25 bp, Mus musculus
aagactcttctgtaggcaaatcaat

SEQ ID NO: 46053 - DNA, 25 bp, Mus musculus
aagactcttgaaacctgttacccct

SEQ ID NO: 46054 - DNA, 25 bp, Mus musculus
aagactcttgaatcctgttacccct

SEQ ID NO: 46055 - DNA, 25 bp, Mus musculus
aagactcttgacactgcttgcaaat

SEQ ID NO: 46056 - DNA, 25 bp, Mus musculus
aagactcttgactctgcttgcaaat

SEQ ID NO: 46057 - DNA, 25 bp, Mus musculus
aagactcttgcaacctgtcagtttt

SEQ ID NO: 46058 - DNA, 25 bp, Mus musculus
aagactcttgcacaggcatcatacc

SEQ ID NO: 46059 - DNA, 25 bp, Mus musculus
aagactcttgcagaggcatcatacc

SEQ ID NO: 46060 - DNA, 25 bp, Mus musculus
aagactcttgcatcctgtcagtttt

SEQ ID NO: 46061 - DNA, 25 bp, Mus musculus
aagactcttgtacttgttttccatg

SEQ ID NO: 46062 - DNA, 25 bp, Mus musculus
aagactcttgtagttgttttccatg

SEQ ID NO: 46063 - DNA, 25 bp, Mus musculus
aagactgaagatacactggtgcttt

SEQ ID NO: 46064 - DNA, 25 bp, Mus musculus
aagactgaagattcactggtgcttt

SEQ ID NO: 46065 - DNA, 25 bp, Mus musculus
aagactgaatgcagcctgttgacta

SEQ ID NO: 46066 - DNA, 25 bp, Mus musculus
aagactgaatgctgcctgttgacta

SEQ ID NO: 46067 - DNA, 25 bp, Mus musculus
aagactgacatacagatttgttgct

SEQ ID NO: 46068 - DNA, 25 bp, Mus musculus
aagactgacatagagatttgttgct

SEQ ID NO: 46069 - DNA, 25 bp, Mus musculus
aagactgactccataggctttcttt

SEQ ID NO: 46070 - DNA, 25 bp, Mus musculus
aagactgactccctccacacttttt

SEQ ID NO: 46071 - DNA, 25 bp, Mus musculus
aagactgactccgtccacacttttt

SEQ ID NO: 46072 - DNA, 25 bp, Mus musculus
aagactgactccttaggctttcttt

SEQ ID NO: 46073 - DNA, 25 bp, Mus musculus
aagactgactctctggttgacctgt

SEQ ID NO: 46074 - DNA, 25 bp, Mus musculus
aagactgactctgtggttgacctgt

SEQ ID NO: 46075 - DNA, 25 bp, Mus musculus
aagactgactgactacacttctcta

SEQ ID NO: 46076 - DNA, 25 bp, Mus musculus
aagactgactgagtacacttctcta

SEQ ID NO: 46077 - DNA, 25 bp, Mus musculus
aagactgactggcaccgagccaagt

SEQ ID NO: 46078 - DNA, 25 bp, Mus musculus
aagactgactgggaccgagccaagt

SEQ ID NO: 46079 - DNA, 25 bp, Mus musculus
aagactgagaccagccctttcagag

SEQ ID NO: 46080 - DNA, 25 bp, Mus musculus
aagactgagacctgccctttcagag

SEQ ID NO: 46081 - DNA, 25 bp, Mus musculus
aagactgagcccaaagacatgcagg

SEQ ID NO: 46082 - DNA, 25 bp, Mus musculus
aagactgagccctaagacatgcagg

SEQ ID NO: 46083 - DNA, 25 bp, Mus musculus
aagactgagcgtccgggtctctccg

SEQ ID NO: 46084 - DNA, 25 bp, Mus musculus
aagactgagcgtgcgggtctctccg

SEQ ID NO: 46085 - DNA, 25 bp, Mus musculus
aagactgaggatatatactgaattg

SEQ ID NO: 46086 - DNA, 25 bp, Mus musculus
aagactgaggatttatactgaattg

SEQ ID NO: 46087 - DNA, 25 bp, Mus musculus
aagactgaggctatttgccacacct

SEQ ID NO: 46088 - DNA, 25 bp, Mus musculus
aagactgaggctttttgccacacct

SEQ ID NO: 46089 - DNA, 25 bp, Mus musculus
aagactgaggtcacgcggagcttta

SEQ ID NO: 46090 - DNA, 25 bp, Mus musculus
aagactgaggtctcgcggagcttta

SEQ ID NO: 46091 - DNA, 25 bp, Mus musculus
aagactgagtggctggtcctcacct

SEQ ID NO: 46092 - DNA, 25 bp, Mus musculus
aagactgagtgggtggtcctcacct

SEQ ID NO: 46093 - DNA, 25 bp, Mus musculus
aagactgagttcctgcaatgccaag

SEQ ID NO: 46094 - DNA, 25 bp, Mus musculus
aagactgagttcgtgcaatgccaag

SEQ ID NO: 46095 - DNA, 25 bp, Mus musculus
aagactgagttgaacctggtgctgg

SEQ ID NO: 46096 - DNA, 25 bp, Mus musculus
aagactgagttgtacctggtgctgg

SEQ ID NO: 46097 - DNA, 25 bp, Mus musculus
aagactgatgaacaccccgaggtgc

SEQ ID NO: 46098 - DNA, 25 bp, Mus musculus
aagactgatgaagaccccgaggtgc

SEQ ID NO: 46099 - DNA, 25 bp, Mus musculus
aagactgatgacacactattttcgt

SEQ ID NO: 46100 - DNA, 25 bp, Mus musculus
aagactgatgactcactattttcgt

SEQ ID NO: 46101 - DNA, 25 bp, Mus musculus
aagactgatggccagcggatctcca

SEQ ID NO: 46102 - DNA, 25 bp, Mus musculus
aagactgatggcctgagttcagccc

SEQ ID NO: 46103 - DNA, 25 bp, Mus musculus
aagactgatggcgagcggatctcca

SEQ ID NO: 46104 - DNA, 25 bp, Mus musculus
aagactgatggcgtgagttcagccc

SEQ ID NO: 46105 - DNA, 25 bp, Mus musculus
aagactgattcaatccctgtcttct

SEQ ID NO: 46106 - DNA, 25 bp, Mus musculus
aagactgattcattccctgtcttct

SEQ ID NO: 46107 - DNA, 25 bp, Mus musculus
aagactgatttcagcagtgaacaaa

SEQ ID NO: 46108 - DNA, 25 bp, Mus musculus
aagactgatttctgcagtgaacaaa

SEQ ID NO: 46109 - DNA, 25 bp, Mus musculus
aagactgcaaccatgtcggcctgca

SEQ ID NO: 46110 - DNA, 25 bp, Mus musculus
aagactgcaaccttgtcggcctgca

SEQ ID NO: 46111 - DNA, 25 bp, Mus musculus
aagactgcacgacagtgatgcgcat

SEQ ID NO: 46112 - DNA, 25 bp, Mus musculus
aagactgcacgagagtgatgcgcat

SEQ ID NO: 46113 - DNA, 25 bp, Mus musculus
aagactgcagatccttgcctggcca

SEQ ID NO: 46114 - DNA, 25 bp, Mus musculus
aagactgcagatgcttgcctggcca

SEQ ID NO: 46115 - DNA, 25 bp, Mus musculus
aagactgcaggacacctatggctgg

SEQ ID NO: 46116 - DNA, 25 bp, Mus musculus
aagactgcaggagacctatggctgg

SEQ ID NO: 46117 - DNA, 25 bp, Mus musculus
aagactgcatccatactgtgctcaa

SEQ ID NO: 46118 - DNA, 25 bp, Mus musculus
aagactgcatccttactgtgctcaa

SEQ ID NO: 46119 - DNA, 25 bp, Mus musculus
aagactgcatctcagagggaacgat

SEQ ID NO: 46120 - DNA, 25 bp, Mus musculus
aagactgcatctgagagggaacgat

SEQ ID NO: 46121 - DNA, 25 bp, Mus musculus
aagactgcattgagcacccaacaga

SEQ ID NO: 46122 - DNA, 25 bp, Mus musculus
aagactgcattgtgcacccaacaga

SEQ ID NO: 46123 - DNA, 25 bp, Mus musculus
aagactgcccgaaggagtatgctgc

SEQ ID NO: 46124 - DNA, 25 bp, Mus musculus
aagactgcccgatggagtatgctgc

SEQ ID NO: 46125 - DNA, 25 bp, Mus musculus
aagactgcccttattagtgtttgaa

SEQ ID NO: 46126 - DNA, 25 bp, Mus musculus
aagactgccctttttagtgtttgaa

SEQ ID NO: 46127 - DNA, 25 bp, Mus musculus
aagactgcggccaggaagcagcctc

SEQ ID NO: 46128 - DNA, 25 bp, Mus musculus
aagactgcggcctggaagcagcctc

SEQ ID NO: 46129 - DNA, 25 bp, Mus musculus
aagactgcgggccttagtgacctct

SEQ ID NO: 46130 - DNA, 25 bp, Mus musculus
aagactgcgggcgttagtgacctct

SEQ ID NO: 46131 - DNA, 25 bp, Mus musculus
aagactgcgtctaggccagcacact

SEQ ID NO: 46132 - DNA, 25 bp, Mus musculus
aagactgcgtcttggccagcacact

SEQ ID NO: 46133 - DNA, 25 bp, Mus musculus
aagactgcgtgtacaccgagatcgt

SEQ ID NO: 46134 - DNA, 25 bp, Mus musculus
aagactgcgtgttcaccgagatcgt

SEQ ID NO: 46135 - DNA, 25 bp, Mus musculus
aagactgcgttactgtggtacctga

SEQ ID NO: 46136 - DNA, 25 bp, Mus musculus
aagactgcgttagtgtggtacctga

SEQ ID NO: 46137 - DNA, 25 bp, Mus musculus
aagactgctaatacctaccttgtat

SEQ ID NO: 46138 - DNA, 25 bp, Mus musculus
aagactgctaattcctaccttgtat

SEQ ID NO: 46139 - DNA, 25 bp, Mus musculus
aagactgctaccatgtactcacaag

SEQ ID NO: 46140 - DNA, 25 bp, Mus musculus
aagactgctaccttgtactcacaag

SEQ ID NO: 46141 - DNA, 25 bp, Mus musculus
aagactgctcatatgtgttgtgcat

SEQ ID NO: 46142 - DNA, 25 bp, Mus musculus
aagactgctcatttgtgttgtgcat

SEQ ID NO: 46143 - DNA, 25 bp, Mus musculus
aagactgctgcaatttaaagtacaa

SEQ ID NO: 46144 - DNA, 25 bp, Mus musculus
aagactgctgcactcccatcgcaat

SEQ ID NO: 46145 - DNA, 25 bp, Mus musculus
aagactgctgcagtcccatcgcaat

SEQ ID NO: 46146 - DNA, 25 bp, Mus musculus
aagactgctgcattttaaagtacaa

SEQ ID NO: 46147 - DNA, 25 bp, Mus musculus
aagactgctgcgcagagccaagatg

SEQ ID NO: 46148 - DNA, 25 bp, Mus musculus
aagactgctgcggagagccaagatg

SEQ ID NO: 46149 - DNA, 25 bp, Mus musculus
aagactgctgtgagtggtatgttca

SEQ ID NO: 46150 - DNA, 25 bp, Mus musculus
aagactgctgtgtgtggtatgttca

SEQ ID NO: 46151 - DNA, 25 bp, Mus musculus
aagactgcttacagtgatgtccaca

SEQ ID NO: 46152 - DNA, 25 bp, Mus musculus
aagactgcttactgtgatgtccaca

SEQ ID NO: 46153 - DNA, 25 bp, Mus musculus
aagactgcttagatgcctgctggta

SEQ ID NO: 46154 - DNA, 25 bp, Mus musculus
aagactgcttagttgcctgctggta

SEQ ID NO: 46155 - DNA, 25 bp, Mus musculus
aagactgcttccattatcaagcgca

SEQ ID NO: 46156 - DNA, 25 bp, Mus musculus
aagactgcttcctttatcaagcgca

SEQ ID NO: 46157 - DNA, 25 bp, Mus musculus
aagactgcttgtatctcctagccaa

SEQ ID NO: 46158 - DNA, 25 bp, Mus musculus
aagactgcttgtccagcaatcgcta

SEQ ID NO: 46159 - DNA, 25 bp, Mus musculus
aagactgcttgtgcagcaatcgcta

SEQ ID NO: 46160 - DNA, 25 bp, Mus musculus
aagactgcttgtttctcctagccaa

SEQ ID NO: 46161 - DNA, 25 bp, Mus musculus
aagactggaaatcctgggagccgct

SEQ ID NO: 46162 - DNA, 25 bp, Mus musculus
aagactggaaatgctgggagccgct

SEQ ID NO: 46163 - DNA, 25 bp, Mus musculus
aagactggaacaaccttcctgactg

SEQ ID NO: 46164 - DNA, 25 bp, Mus musculus
aagactggaacatccttcctgactg

SEQ ID NO: 46165 - DNA, 25 bp, Mus musculus
aagactggacagactctctggtctc

SEQ ID NO: 46166 - DNA, 25 bp, Mus musculus
aagactggacagatgattgtaaata

SEQ ID NO: 46167 - DNA, 25 bp, Mus musculus
aagactggacagtctctctggtctc

SEQ ID NO: 46168 - DNA, 25 bp, Mus musculus
aagactggacagttgattgtaaata

SEQ ID NO: 46169 - DNA, 25 bp, Mus musculus
aagactggaggaactttcttttctc

SEQ ID NO: 46170 - DNA, 25 bp, Mus musculus
aagactggaggatctttcttttctc

SEQ ID NO: 46171 - DNA, 25 bp, Mus musculus
aagactggagtgcacagccagccac

SEQ ID NO: 46172 - DNA, 25 bp, Mus musculus
aagactggagtggacagccagccac

SEQ ID NO: 46173 - DNA, 25 bp, Mus musculus
aagactggatgtcttctctgctcaa

SEQ ID NO: 46174 - DNA, 25 bp, Mus musculus
aagactggatgtgttctctgctcaa

SEQ ID NO: 46175 - DNA, 25 bp, Mus musculus
aagactggcaccaattctgtggaga

SEQ ID NO: 46176 - DNA, 25 bp, Mus musculus
aagactggcacctattctgtggaga

SEQ ID NO: 46177 - DNA, 25 bp, Mus musculus
aagactggcatacacccttattcgt

SEQ ID NO: 46178 - DNA, 25 bp, Mus musculus
aagactggcatagacccttattcgt

SEQ ID NO: 46179 - DNA, 25 bp, Mus musculus
aagactggccaaagacctcgggcac

SEQ ID NO: 46180 - DNA, 25 bp, Mus musculus
aagactggccaatgacctcgggcac

SEQ ID NO: 46181 - DNA, 25 bp, Mus musculus
aagactggcgagaccttctacacct

SEQ ID NO: 46182 - DNA, 25 bp, Mus musculus
aagactggcgagtccttctacacct

SEQ ID NO: 46183 - DNA, 25 bp, Mus musculus
aagactggcgttcgtttgcttcctt

SEQ ID NO: 46184 - DNA, 25 bp, Mus musculus
aagactggcgttggtttgcttcctt

SEQ ID NO: 46185 - DNA, 25 bp, Mus musculus
aagactggctgccagagtagccacc

SEQ ID NO: 46186 - DNA, 25 bp, Mus musculus
aagactggctgcgagagtagccacc

SEQ ID NO: 46187 - DNA, 25 bp, Mus musculus
aagactgggagtcagccacaaagca

SEQ ID NO: 46188 - DNA, 25 bp, Mus musculus
aagactgggagtgagccacaaagca

SEQ ID NO: 46189 - DNA, 25 bp, Mus musculus
aagactgggatcactttggtatgtg

SEQ ID NO: 46190 - DNA, 25 bp, Mus musculus
aagactgggatctctttggtatgtg

SEQ ID NO: 46191 - DNA, 25 bp, Mus musculus
aagactgggtttctcagcttccgtg

SEQ ID NO: 46192 - DNA, 25 bp, Mus musculus
aagactgggtttgtcagcttccgtg

SEQ ID NO: 46193 - DNA, 25 bp, Mus musculus
aagactggtctcaccatcttctggt

SEQ ID NO: 46194 - DNA, 25 bp, Mus musculus
aagactggtctctccatcttctggt

SEQ ID NO: 46195 - DNA, 25 bp, Mus musculus
aagactggtgcaatattgcccacca

SEQ ID NO: 46196 - DNA, 25 bp, Mus musculus
aagactggtgcattattgcccacca

SEQ ID NO: 46197 - DNA, 25 bp, Mus musculus
aagactggtgtcactcaagtgcaaa

SEQ ID NO: 46198 - DNA, 25 bp, Mus musculus
aagactggtgtctctcaagtgcaaa

SEQ ID NO: 46199 - DNA, 25 bp, Mus musculus
aagactggttctattgcactgggtg

SEQ ID NO: 46200 - DNA, 25 bp, Mus musculus
aagactggttcttttgcactgggtg

SEQ ID NO: 46201 - DNA, 25 bp, Mus musculus
aagactgtaaatatggtcaagtcaa

SEQ ID NO: 46202 - DNA, 25 bp, Mus musculus
aagactgtaaatttggtcaagtcaa

SEQ ID NO: 46203 - DNA, 25 bp, Mus musculus
aagactgtaagaaagtcagctcagc

SEQ ID NO: 46204 - DNA, 25 bp, Mus musculus
aagactgtaagatagtcagctcagc

SEQ ID NO: 46205 - DNA, 25 bp, Mus musculus
aagactgtagcacgcctccagtccg

SEQ ID NO: 46206 - DNA, 25 bp, Mus musculus
aagactgtagcaggcctccagtccg

SEQ ID NO: 46207 - DNA, 25 bp, Mus musculus
aagactgtagctacccagagcagag

SEQ ID NO: 46208 - DNA, 25 bp, Mus musculus
aagactgtagctctatcatgcctcg

SEQ ID NO: 46209 - DNA, 25 bp, Mus musculus
aagactgtagctgtatcatgcctcg

SEQ ID NO: 46210 - DNA, 25 bp, Mus musculus
aagactgtagcttcccagagcagag

SEQ ID NO: 46211 - DNA, 25 bp, Mus musculus
aagactgtcacacccgaacaagcct

SEQ ID NO: 46212 - DNA, 25 bp, Mus musculus
aagactgtcacagccgaacaagcct

SEQ ID NO: 46213 - DNA, 25 bp, Mus musculus
aagactgtcaggatctccagcagct

SEQ ID NO: 46214 - DNA, 25 bp, Mus musculus
aagactgtcaggttctccagcagct

SEQ ID NO: 46215 - DNA, 25 bp, Mus musculus
aagactgtcattccgtgtttgctgc

SEQ ID NO: 46216 - DNA, 25 bp, Mus musculus
aagactgtcattctcttctatgaac

SEQ ID NO: 46217 - DNA, 25 bp, Mus musculus
aagactgtcattgcgtgtttgctgc

SEQ ID NO: 46218 - DNA, 25 bp, Mus musculus
aagactgtcattgtcttctatgaac

SEQ ID NO: 46219 - DNA, 25 bp, Mus musculus
aagactgtccagcatttggttttat

SEQ ID NO: 46220 - DNA, 25 bp, Mus musculus
aagactgtccaggatttggttttat

SEQ ID NO: 46221 - DNA, 25 bp, Mus musculus
aagactgtccgactgtttcgcttta

SEQ ID NO: 46222 - DNA, 25 bp, Mus musculus
aagactgtccgagtgtttcgcttta

SEQ ID NO: 46223 - DNA, 25 bp, Mus musculus
aagactgtcctcaaccctcaactag

SEQ ID NO: 46224 - DNA, 25 bp, Mus musculus
aagactgtcctccagctgatcctgt

SEQ ID NO: 46225 - DNA, 25 bp, Mus musculus
aagactgtcctcgagctgatcctgt

SEQ ID NO: 46226 - DNA, 25 bp, Mus musculus
aagactgtcctctaccctcaactag

SEQ ID NO: 46227 - DNA, 25 bp, Mus musculus
aagactgtcctgaagatcatagaaa

SEQ ID NO: 46228 - DNA, 25 bp, Mus musculus
aagactgtcctgtagatcatagaaa

SEQ ID NO: 46229 - DNA, 25 bp, Mus musculus
aagactgtccttcaatgagaccaca

SEQ ID NO: 46230 - DNA, 25 bp, Mus musculus
aagactgtccttctatcatggagca

SEQ ID NO: 46231 - DNA, 25 bp, Mus musculus
aagactgtccttgaatgagaccaca

SEQ ID NO: 46232 - DNA, 25 bp, Mus musculus
aagactgtccttgtatcatggagca

SEQ ID NO: 46233 - DNA, 25 bp, Mus musculus
aagactgtgcatatgacctttcaag

SEQ ID NO: 46234 - DNA, 25 bp, Mus musculus
aagactgtgcatttgacctttcaag

SEQ ID NO: 46235 - DNA, 25 bp, Mus musculus
aagactgtgccaaaccagctgatct

SEQ ID NO: 46236 - DNA, 25 bp, Mus musculus
aagactgtgccataccagctgatct

SEQ ID NO: 46237 - DNA, 25 bp, Mus musculus
aagactgtgcgaatcaatgtgctca

SEQ ID NO: 46238 - DNA, 25 bp, Mus musculus
aagactgtgcgattcaatgtgctca

SEQ ID NO: 46239 - DNA, 25 bp, Mus musculus
aagactgtgcggcttattaccaagc

SEQ ID NO: 46240 - DNA, 25 bp, Mus musculus
aagactgtgcgggttattaccaagc

SEQ ID NO: 46241 - DNA, 25 bp, Mus musculus
aagactgtgcttccatgcagttcaa

SEQ ID NO: 46242 - DNA, 25 bp, Mus musculus
aagactgtgcttgcatgcagttcaa

SEQ ID NO: 46243 - DNA, 25 bp, Mus musculus
aagactgtggatcccacgtcagcca

SEQ ID NO: 46244 - DNA, 25 bp, Mus musculus
aagactgtggatgccacgtcagcca

SEQ ID NO: 46245 - DNA, 25 bp, Mus musculus
aagactgtggcaccgagagctccaa

SEQ ID NO: 46246 - DNA, 25 bp, Mus musculus
aagactgtggcagcgagagctccaa

SEQ ID NO: 46247 - DNA, 25 bp, Mus musculus
aagactgtgggcattaggcttctct

SEQ ID NO: 46248 - DNA, 25 bp, Mus musculus
aagactgtgggctttaggcttctct

SEQ ID NO: 46249 - DNA, 25 bp, Mus musculus
aagactgtggtcagggctggtccca

SEQ ID NO: 46250 - DNA, 25 bp, Mus musculus
aagactgtggtctgggctggtccca

SEQ ID NO: 46251 - DNA, 25 bp, Mus musculus
aagactgtgtatatctatgcctgga

SEQ ID NO: 46252 - DNA, 25 bp, Mus musculus
aagactgtgtatttctatgcctgga

SEQ ID NO: 46253 - DNA, 25 bp, Mus musculus
aagactgtgtctatgtgcctgtcct

SEQ ID NO: 46254 - DNA, 25 bp, Mus musculus
aagactgtgtctttgtgcctgtcct

SEQ ID NO: 46255 - DNA, 25 bp, Mus musculus
aagactgttacacggcttgcttcct

SEQ ID NO: 46256 - DNA, 25 bp, Mus musculus
aagactgttacactaggggctccac

SEQ ID NO: 46257 - DNA, 25 bp, Mus musculus
aagactgttacagggcttgcttcct

SEQ ID NO: 46258 - DNA, 25 bp, Mus musculus
aagactgttacagtaggggctccac

SEQ ID NO: 46259 - DNA, 25 bp, Mus musculus
aagactgttcttatcatggagcaac

SEQ ID NO: 46260 - DNA, 25 bp, Mus musculus
aagactgttcttttcatggagcaac

SEQ ID NO: 46261 - DNA, 25 bp, Mus musculus
aagactgttgccaccaaggttttct

SEQ ID NO: 46262 - DNA, 25 bp, Mus musculus
aagactgttgcctccaaggttttct

SEQ ID NO: 46263 - DNA, 25 bp, Mus musculus
aagactgttggactagaggaccgaa

SEQ ID NO: 46264 - DNA, 25 bp, Mus musculus
aagactgttggagtagaggaccgaa

SEQ ID NO: 46265 - DNA, 25 bp, Mus musculus
aagactgttgggaggtcctgagctt

SEQ ID NO: 46266 - DNA, 25 bp, Mus musculus
aagactgttgggtggtcctgagctt

SEQ ID NO: 46267 - DNA, 25 bp, Mus musculus
aagactgttgtcagctggatggatg

SEQ ID NO: 46268 - DNA, 25 bp, Mus musculus
aagactgttgtctgctggatggatg

SEQ ID NO: 46269 - DNA, 25 bp, Mus musculus
aagactgttgtgcttctgtttacaa

SEQ ID NO: 46270 - DNA, 25 bp, Mus musculus
aagactgttgtggttctgtttacaa

SEQ ID NO: 46271 - DNA, 25 bp, Mus musculus
aagactgtttaaatgcgctgttctg

SEQ ID NO: 46272 - DNA, 25 bp, Mus musculus
aagactgtttaattgcgctgttctg

SEQ ID NO: 46273 - DNA, 25 bp, Mus musculus
aagactgtttctacttctcagaccg

SEQ ID NO: 46274 - DNA, 25 bp, Mus musculus
aagactgtttctatggactatgcct

SEQ ID NO: 46275 - DNA, 25 bp, Mus musculus
aagactgtttcttcttctcagaccg

SEQ ID NO: 46276 - DNA, 25 bp, Mus musculus
aagactgtttctttggactatgcct

SEQ ID NO: 46277 - DNA, 25 bp, Mus musculus
aagacttaaagtagcaggcctcaga

SEQ ID NO: 46278 - DNA, 25 bp, Mus musculus
aagacttaaagttgcaggcctcaga

SEQ ID NO: 46279 - DNA, 25 bp, Mus musculus
aagacttacatcacccatgaattag

SEQ ID NO: 46280 - DNA, 25 bp, Mus musculus
aagacttacatctcccatgaattag

SEQ ID NO: 46281 - DNA, 25 bp, Mus musculus
aagacttacctcatagagctgctat

SEQ ID NO: 46282 - DNA, 25 bp, Mus musculus
aagacttacctcttagagctgctat

SEQ ID NO: 46283 - DNA, 25 bp, Mus musculus
aagacttactgaagcttcacgggta

SEQ ID NO: 46284 - DNA, 25 bp, Mus musculus
aagacttactgatgcttcacgggta

SEQ ID NO: 46285 - DNA, 25 bp, Mus musculus
aagacttagataatgcacatcgaat

SEQ ID NO: 46286 - DNA, 25 bp, Mus musculus
aagacttagatattgcacatcgaat

SEQ ID NO: 46287 - DNA, 25 bp, Mus musculus
aagacttagcacatgtgatgtctaa

SEQ ID NO: 46288 - DNA, 25 bp, Mus musculus
aagacttagcacttgtgatgtctaa

SEQ ID NO: 46289 - DNA, 25 bp, Mus musculus
aagacttagcttcctcatttgcaaa

SEQ ID NO: 46290 - DNA, 25 bp, Mus musculus
aagacttagcttgctcatttgcaaa

SEQ ID NO: 46291 - DNA, 25 bp, Mus musculus
aagacttatcccaattcggacaaca

SEQ ID NO: 46292 - DNA, 25 bp, Mus musculus
aagacttatccctattcggacaaca

SEQ ID NO: 46293 - DNA, 25 bp, Mus musculus
aagacttcaaacataaggctcccaa

SEQ ID NO: 46294 - DNA, 25 bp, Mus musculus
aagacttcaaacttaaggctcccaa

SEQ ID NO: 46295 - DNA, 25 bp, Mus musculus
aagacttcacctatggcccgggcga

SEQ ID NO: 46296 - DNA, 25 bp, Mus musculus
aagacttcacctttggcccgggcga

SEQ ID NO: 46297 - DNA, 25 bp, Mus musculus
aagacttcagacaaccttgagacag

SEQ ID NO: 46298 - DNA, 25 bp, Mus musculus
aagacttcagactaccttgagacag

SEQ ID NO: 46299 - DNA, 25 bp, Mus musculus
aagacttcagagatgcttgctctag

SEQ ID NO: 46300 - DNA, 25 bp, Mus musculus
aagacttcagagttgcttgctctag

SEQ ID NO: 46301 - DNA, 25 bp, Mus musculus
aagacttcattgctagtggcagcga

SEQ ID NO: 46302 - DNA, 25 bp, Mus musculus
aagacttcattggtagtggcagcga

SEQ ID NO: 46303 - DNA, 25 bp, Mus musculus
aagacttccaaacggcatttcggct

SEQ ID NO: 46304 - DNA, 25 bp, Mus musculus
aagacttccaaagggcatttcggct

SEQ ID NO: 46305 - DNA, 25 bp, Mus musculus
aagacttcccctcagttatactgac

SEQ ID NO: 46306 - DNA, 25 bp, Mus musculus
aagacttcccctgagttatactgac

SEQ ID NO: 46307 - DNA, 25 bp, Mus musculus
aagacttccctgagtctagatgccc

SEQ ID NO: 46308 - DNA, 25 bp, Mus musculus
aagacttccctgtgtctagatgccc

SEQ ID NO: 46309 - DNA, 25 bp, Mus musculus
aagacttccgggagagcaccgcgcc

SEQ ID NO: 46310 - DNA, 25 bp, Mus musculus
aagacttccgggtgagcaccgcgcc

SEQ ID NO: 46311 - DNA, 25 bp, Mus musculus
aagacttcctgccttctttcttctc

SEQ ID NO: 46312 - DNA, 25 bp, Mus musculus
aagacttcctgcgttctttcttctc

SEQ ID NO: 46313 - DNA, 25 bp, Mus musculus
aagacttcctttatagtgacaataa

SEQ ID NO: 46314 - DNA, 25 bp, Mus musculus
aagacttcctttcagcggtggacac

SEQ ID NO: 46315 - DNA, 25 bp, Mus musculus
aagacttcctttgagcggtggacac

SEQ ID NO: 46316 - DNA, 25 bp, Mus musculus
aagacttcctttttagtgacaataa

SEQ ID NO: 46317 - DNA, 25 bp, Mus musculus
aagacttcgacgcacgtgcaaagaa

SEQ ID NO: 46318 - DNA, 25 bp, Mus musculus
aagacttcgacggacgtgcaaagaa

SEQ ID NO: 46319 - DNA, 25 bp, Mus musculus
aagacttcgtgcagagatggaacat

SEQ ID NO: 46320 - DNA, 25 bp, Mus musculus
aagacttcgtgctgagatggaacat

SEQ ID NO: 46321 - DNA, 25 bp, Mus musculus
aagacttctagacgccttgagatac

SEQ ID NO: 46322 - DNA, 25 bp, Mus musculus
aagacttctagaggccttgagatac

SEQ ID NO: 46323 - DNA, 25 bp, Mus musculus
aagacttctcttcgccgggcagtgg

SEQ ID NO: 46324 - DNA, 25 bp, Mus musculus
aagacttctcttggccgggcagtgg

SEQ ID NO: 46325 - DNA, 25 bp, Mus musculus
aagacttctttaaatgctcaggaaa

SEQ ID NO: 46326 - DNA, 25 bp, Mus musculus
aagacttctttatatgctcaggaaa

SEQ ID NO: 46327 - DNA, 25 bp, Mus musculus
aagacttgaacgcagagaggttgat

SEQ ID NO: 46328 - DNA, 25 bp, Mus musculus
aagacttgaacggagagaggttgat

SEQ ID NO: 46329 - DNA, 25 bp, Mus musculus
aagacttgaactaggacctgaccct

SEQ ID NO: 46330 - DNA, 25 bp, Mus musculus
aagacttgaacttggacctgaccct

SEQ ID NO: 46331 - DNA, 25 bp, Mus musculus
aagacttgacttatgttcgcccttc

SEQ ID NO: 46332 - DNA, 25 bp, Mus musculus
aagacttgacttttgttcgcccttc

SEQ ID NO: 46333 - DNA, 25 bp, Mus musculus
aagacttgagacatcctttgccatt

SEQ ID NO: 46334 - DNA, 25 bp, Mus musculus
aagacttgagacttcctttgccatt

SEQ ID NO: 46335 - DNA, 25 bp, Mus musculus
aagacttgagccctagccttgtgct

SEQ ID NO: 46336 - DNA, 25 bp, Mus musculus
aagacttgagccgtagccttgtgct

SEQ ID NO: 46337 - DNA, 25 bp, Mus musculus
aagacttgaggcagccggagtcaac

SEQ ID NO: 46338 - DNA, 25 bp, Mus musculus
aagacttgaggctgccggagtcaac

SEQ ID NO: 46339 - DNA, 25 bp, Mus musculus
aagacttgagtcagaacttggacat

SEQ ID NO: 46340 - DNA, 25 bp, Mus musculus
aagacttgagtctgaacttggacat

SEQ ID NO: 46341 - DNA, 25 bp, Mus musculus
aagacttgatccagaagcccggagt

SEQ ID NO: 46342 - DNA, 25 bp, Mus musculus
aagacttgatcctgaagcccggagt

SEQ ID NO: 46343 - DNA, 25 bp, Mus musculus
aagacttgatgcagacctggcgcgc

SEQ ID NO: 46344 - DNA, 25 bp, Mus musculus
aagacttgatgctgacctggcgcgc

SEQ ID NO: 46345 - DNA, 25 bp, Mus musculus
aagacttgattaacacaggtgacga

SEQ ID NO: 46346 - DNA, 25 bp, Mus musculus
aagacttgattatcacaggtgacga

SEQ ID NO: 46347 - DNA, 25 bp, Mus musculus
aagacttgattgatagcatggtttc

SEQ ID NO: 46348 - DNA, 25 bp, Mus musculus
aagacttgattgttagcatggtttc

SEQ ID NO: 46349 - DNA, 25 bp, Mus musculus
aagacttgcatccatccctggcttt

SEQ ID NO: 46350 - DNA, 25 bp, Mus musculus
aagacttgcatccatgttacacatg

SEQ ID NO: 46351 - DNA, 25 bp, Mus musculus
aagacttgcatcgatccctggcttt

SEQ ID NO: 46352 - DNA, 25 bp, Mus musculus
aagacttgcatcgatgttacacatg

SEQ ID NO: 46353 - DNA, 25 bp, Mus musculus
aagacttgcatgcatggtcatccct

SEQ ID NO: 46354 - DNA, 25 bp, Mus musculus
aagacttgcatggatggtcatccct

SEQ ID NO: 46355 - DNA, 25 bp, Mus musculus
aagacttgccctatgcatttgcata

SEQ ID NO: 46356 - DNA, 25 bp, Mus musculus
aagacttgccctttgcatttgcata

SEQ ID NO: 46357 - DNA, 25 bp, Mus musculus
aagacttgcctacagccttatgaag

SEQ ID NO: 46358 - DNA, 25 bp, Mus musculus
aagacttgcctagagccttatgaag

SEQ ID NO: 46359 - DNA, 25 bp, Mus musculus
aagacttgccttcctgtgagcacat

SEQ ID NO: 46360 - DNA, 25 bp, Mus musculus
aagacttgccttgctgtgagcacat

SEQ ID NO: 46361 - DNA, 25 bp, Mus musculus
aagacttggactctgaggactgcaa

SEQ ID NO: 46362 - DNA, 25 bp, Mus musculus
aagacttggactgtgaggactgcaa

SEQ ID NO: 46363 - DNA, 25 bp, Mus musculus
aagacttggagcctgttgctattta

SEQ ID NO: 46364 - DNA, 25 bp, Mus musculus
aagacttggagcgtgttgctattta

SEQ ID NO: 46365 - DNA, 25 bp, Mus musculus
aagacttggcgaaactctgtgcagc

SEQ ID NO: 46366 - DNA, 25 bp, Mus musculus
aagacttggcgatactctgtgcagc

SEQ ID NO: 46367 - DNA, 25 bp, Mus musculus
aagacttggctaagtttcctctgaa

SEQ ID NO: 46368 - DNA, 25 bp, Mus musculus
aagacttggctatgtttcctctgaa

SEQ ID NO: 46369 - DNA, 25 bp, Mus musculus
aagacttgggagatctcatattgat

SEQ ID NO: 46370 - DNA, 25 bp, Mus musculus
aagacttgggagttctcatattgat

SEQ ID NO: 46371 - DNA, 25 bp, Mus musculus
aagacttgggcccagctgtccacca

SEQ ID NO: 46372 - DNA, 25 bp, Mus musculus
aagacttgggccgagctgtccacca

SEQ ID NO: 46373 - DNA, 25 bp, Mus musculus
aagacttggtacagctgatgactca

SEQ ID NO: 46374 - DNA, 25 bp, Mus musculus
aagacttggtactgctgatgactca

SEQ ID NO: 46375 - DNA, 25 bp, Mus musculus
aagacttgtaggattgtcaccacat

SEQ ID NO: 46376 - DNA, 25 bp, Mus musculus
aagacttgtaggtttgtcaccacat

SEQ ID NO: 46377 - DNA, 25 bp, Mus musculus
aagacttgtcctcatgattcttaac

SEQ ID NO: 46378 - DNA, 25 bp, Mus musculus
aagacttgtcctgatgattcttaac

SEQ ID NO: 46379 - DNA, 25 bp, Mus musculus
aagacttgtgttagagcttgggctg

SEQ ID NO: 46380 - DNA, 25 bp, Mus musculus
aagacttgtgtttgagcttgggctg

SEQ ID NO: 46381 - DNA, 25 bp, Mus musculus
aagactttaattactcagatgacta

SEQ ID NO: 46382 - DNA, 25 bp, Mus musculus
aagactttaatttctcagatgacta

SEQ ID NO: 46383 - DNA, 25 bp, Mus musculus
aagactttatgacttgctcaactat

SEQ ID NO: 46384 - DNA, 25 bp, Mus musculus
aagactttatgagttgctcaactat

SEQ ID NO: 46385 - DNA, 25 bp, Mus musculus
aagactttatggagactttccaggt

SEQ ID NO: 46386 - DNA, 25 bp, Mus musculus
aagactttatggtgactttccaggt

SEQ ID NO: 46387 - DNA, 25 bp, Mus musculus
aagactttattgaacactcatgtgc

SEQ ID NO: 46388 - DNA, 25 bp, Mus musculus
aagactttattgtacactcatgtgc

SEQ ID NO: 46389 - DNA, 25 bp, Mus musculus
aagactttcccacaggttgcctaag

SEQ ID NO: 46390 - DNA, 25 bp, Mus musculus
aagactttcccagaggttgcctaag

SEQ ID NO: 46391 - DNA, 25 bp, Mus musculus
aagactttcctaacagaacgtcaag

SEQ ID NO: 46392 - DNA, 25 bp, Mus musculus
aagactttcctatcagaacgtcaag

SEQ ID NO: 46393 - DNA, 25 bp, Mus musculus
aagactttcctgacttccgtatgca

SEQ ID NO: 46394 - DNA, 25 bp, Mus musculus
aagactttcctgtcttccgtatgca

SEQ ID NO: 46395 - DNA, 25 bp, Mus musculus
aagactttcgcacaattgtttccta

SEQ ID NO: 46396 - DNA, 25 bp, Mus musculus
aagactttcgcagaattgtttccta

SEQ ID NO: 46397 - DNA, 25 bp, Mus musculus
aagactttctctcactatctatcag

SEQ ID NO: 46398 - DNA, 25 bp, Mus musculus
aagactttctctgactatctatcag

SEQ ID NO: 46399 - DNA, 25 bp, Mus musculus
aagactttgctgatttagcctcact

SEQ ID NO: 46400 - DNA, 25 bp, Mus musculus
aagactttgctgttttagcctcact

SEQ ID NO: 46401 - DNA, 25 bp, Mus musculus
aagactttgcttagggtatggctga

SEQ ID NO: 46402 - DNA, 25 bp, Mus musculus
aagactttgctttgggtatggctga

SEQ ID NO: 46403 - DNA, 25 bp, Mus musculus
aagactttggaaacattcacacaat

SEQ ID NO: 46404 - DNA, 25 bp, Mus musculus
aagactttggaatcattcacacaat

SEQ ID NO: 46405 - DNA, 25 bp, Mus musculus
aagactttgtatcctagcacaccaa

SEQ ID NO: 46406 - DNA, 25 bp, Mus musculus
aagactttgtatgctagcacaccaa

SEQ ID NO: 46407 - DNA, 25 bp, Mus musculus
aagactttgtcaaccgttctagtgt

SEQ ID NO: 46408 - DNA, 25 bp, Mus musculus
aagactttgtcatccgttctagtgt

SEQ ID NO: 46409 - DNA, 25 bp, Mus musculus
aagactttgttacaactgattcctg

SEQ ID NO: 46410 - DNA, 25 bp, Mus musculus
aagactttgttagaactgattcctg

SEQ ID NO: 46411 - DNA, 25 bp, Mus musculus
aagacttttgccatcagctctactc

SEQ ID NO: 46412 - DNA, 25 bp, Mus musculus
aagacttttgccttcagctctactc

SEQ ID NO: 46413 - DNA, 25 bp, Mus musculus
aagacttttggtagagggcttctcg

SEQ ID NO: 46414 - DNA, 25 bp, Mus musculus
aagacttttggttgagggcttctcg

SEQ ID NO: 46415 - DNA, 25 bp, Mus musculus
aagacttttgtaaacagttgagtac

SEQ ID NO: 46416 - DNA, 25 bp, Mus musculus
aagacttttgtatacagttgagtac

SEQ ID NO: 46417 - DNA, 25 bp, Mus musculus
aagacttttgtcatctattcgtgta

SEQ ID NO: 46418 - DNA, 25 bp, Mus musculus
aagacttttgtcttctattcgtgta

SEQ ID NO: 46419 - DNA, 25 bp, Mus musculus
aagagaaaagccagttgtccgccca

SEQ ID NO: 46420 - DNA, 25 bp, Mus musculus
aagagaaaagcctgttgtccgccca

SEQ ID NO: 46421 - DNA, 25 bp, Mus musculus
aagagaaaataccatgtcacagaaa

SEQ ID NO: 46422 - DNA, 25 bp, Mus musculus
aagagaaaatacgatgtcacagaaa

SEQ ID NO: 46423 - DNA, 25 bp, Mus musculus
aagagaaaccttcccaatgtgtgtg

SEQ ID NO: 46424 - DNA, 25 bp, Mus musculus
aagagaaaccttgccaatgtgtgtg

SEQ ID NO: 46425 - DNA, 25 bp, Mus musculus
aagagaaacgccacctaacactgtt

SEQ ID NO: 46426 - DNA, 25 bp, Mus musculus
aagagaaacgcctcctaacactgtt

SEQ ID NO: 46427 - DNA, 25 bp, Mus musculus
aagagaaagagcatgtccggaacgg

SEQ ID NO: 46428 - DNA, 25 bp, Mus musculus
aagagaaagagcttgtccggaacgg

SEQ ID NO: 46429 - DNA, 25 bp, Mus musculus
aagagaaagctactcggccttgctt

SEQ ID NO: 46430 - DNA, 25 bp, Mus musculus
aagagaaagctagtcggccttgctt

SEQ ID NO: 46431 - DNA, 25 bp, Mus musculus
aagagaaagctcatccaccccattt

SEQ ID NO: 46432 - DNA, 25 bp, Mus musculus
aagagaaagctcttccaccccattt

SEQ ID NO: 46433 - DNA, 25 bp, Mus musculus
aagagaaagcttccatctttgtgat

SEQ ID NO: 46434 - DNA, 25 bp, Mus musculus
aagagaaagcttgcatctttgtgat

SEQ ID NO: 46435 - DNA, 25 bp, Mus musculus
aagagaaagggtccccacatttcca

SEQ ID NO: 46436 - DNA, 25 bp, Mus musculus
aagagaaagggtgcccacatttcca

SEQ ID NO: 46437 - DNA, 25 bp, Mus musculus
aagagaaagtcaccgcttccttcct

SEQ ID NO: 46438 - DNA, 25 bp, Mus musculus
aagagaaagtcagcgcttccttcct

SEQ ID NO: 46439 - DNA, 25 bp, Mus musculus
aagagaaatctgacacccttacacc

SEQ ID NO: 46440 - DNA, 25 bp, Mus musculus
aagagaaatctgtcacccttacacc

SEQ ID NO: 46441 - DNA, 25 bp, Mus musculus
aagagaacagctacttgccatcagc

SEQ ID NO: 46442 - DNA, 25 bp, Mus musculus
aagagaacagcttcttgccatcagc

SEQ ID NO: 46443 - DNA, 25 bp, Mus musculus
aagagaacagggaaggcaccggcaa

SEQ ID NO: 46444 - DNA, 25 bp, Mus musculus
aagagaacagggtaggcaccggcaa

SEQ ID NO: 46445 - DNA, 25 bp, Mus musculus
aagagaaccacacctgcagatcatg

SEQ ID NO: 46446 - DNA, 25 bp, Mus musculus
aagagaaccacagctgcagatcatg

SEQ ID NO: 46447 - DNA, 25 bp, Mus musculus
aagagaaccaggctatgtctgtttc

SEQ ID NO: 46448 - DNA, 25 bp, Mus musculus
aagagaaccagggtatgtctgtttc

SEQ ID NO: 46449 - DNA, 25 bp, Mus musculus
aagagaaccagtcctgccggttgtc

SEQ ID NO: 46450 - DNA, 25 bp, Mus musculus
aagagaaccagtgctgccggttgtc

SEQ ID NO: 46451 - DNA, 25 bp, Mus musculus
aagagaaccatgatacccagccaag

SEQ ID NO: 46452 - DNA, 25 bp, Mus musculus
aagagaaccatgttacccagccaag

SEQ ID NO: 46453 - DNA, 25 bp, Mus musculus
aagagaacgaggacgccagcaagat

SEQ ID NO: 46454 - DNA, 25 bp, Mus musculus
aagagaacgaggtcgccagcaagat

SEQ ID NO: 46455 - DNA, 25 bp, Mus musculus
aagagaacgcctcacattccttaaa

SEQ ID NO: 46456 - DNA, 25 bp, Mus musculus
aagagaacgcctgacattccttaaa

SEQ ID NO: 46457 - DNA, 25 bp, Mus musculus
aagagaactaggcacccacacacca

SEQ ID NO: 46458 - DNA, 25 bp, Mus musculus
aagagaactagggacccacacacca

SEQ ID NO: 46459 - DNA, 25 bp, Mus musculus
aagagaactatacccatctaccgaa

SEQ ID NO: 46460 - DNA, 25 bp, Mus musculus
aagagaactatagccatctaccgaa

SEQ ID NO: 46461 - DNA, 25 bp, Mus musculus
aagagaactcgtaatgtggcccctc

SEQ ID NO: 46462 - DNA, 25 bp, Mus musculus
aagagaactcgttatgtggcccctc

SEQ ID NO: 46463 - DNA, 25 bp, Mus musculus
aagagaactctccagaagcccggga

SEQ ID NO: 46464 - DNA, 25 bp, Mus musculus
aagagaactctcgagaagcccggga

SEQ ID NO: 46465 - DNA, 25 bp, Mus musculus
aagagaacttcgaggacattatgga

SEQ ID NO: 46466 - DNA, 25 bp, Mus musculus
aagagaacttcgtggacattatgga

SEQ ID NO: 46467 - DNA, 25 bp, Mus musculus
aagagaacttttatcctacatatgt

SEQ ID NO: 46468 - DNA, 25 bp, Mus musculus
aagagaacttttttcctacatatgt

SEQ ID NO: 46469 - DNA, 25 bp, Mus musculus
aagagaagacgcattacccgactct

SEQ ID NO: 46470 - DNA, 25 bp, Mus musculus
aagagaagacgctttacccgactct

SEQ ID NO: 46471 - DNA, 25 bp, Mus musculus
aagagaagacttcccgaagcccgat

SEQ ID NO: 46472 - DNA, 25 bp, Mus musculus
aagagaagacttgccgaagcccgat

SEQ ID NO: 46473 - DNA, 25 bp, Mus musculus
aagagaagagctagccgccccagca

SEQ ID NO: 46474 - DNA, 25 bp, Mus musculus
aagagaagagcttgccgccccagca

SEQ ID NO: 46475 - DNA, 25 bp, Mus musculus
aagagaagatccaactgcctcgtgc

SEQ ID NO: 46476 - DNA, 25 bp, Mus musculus
aagagaagatcctactgcctcgtgc

SEQ ID NO: 46477 - DNA, 25 bp, Mus musculus
aagagaagatctctcacacaccaga

SEQ ID NO: 46478 - DNA, 25 bp, Mus musculus
aagagaagatctgtcacacaccaga

SEQ ID NO: 46479 - DNA, 25 bp, Mus musculus
aagagaagcaacacggtggacactg

SEQ ID NO: 46480 - DNA, 25 bp, Mus musculus
aagagaagcaactcggtggacactg

SEQ ID NO: 46481 - DNA, 25 bp, Mus musculus
aagagaagcaagctttagagtccaa

SEQ ID NO: 46482 - DNA, 25 bp, Mus musculus
aagagaagcaaggtttagagtccaa

SEQ ID NO: 46483 - DNA, 25 bp, Mus musculus
aagagaagcaccaatcttgcctcct

SEQ ID NO: 46484 - DNA, 25 bp, Mus musculus
aagagaagcacctatcttgcctcct

SEQ ID NO: 46485 - DNA, 25 bp, Mus musculus
aagagaagcagactccatggccgct

SEQ ID NO: 46486 - DNA, 25 bp, Mus musculus
aagagaagcagagtccatggccgct

SEQ ID NO: 46487 - DNA, 25 bp, Mus musculus
aagagaagccccacaggtccatggg

SEQ ID NO: 46488 - DNA, 25 bp, Mus musculus
aagagaagcccctcaggtccatggg

SEQ ID NO: 46489 - DNA, 25 bp, Mus musculus
aagagaagcctccagcatgttgcca

SEQ ID NO: 46490 - DNA, 25 bp, Mus musculus
aagagaagcctcgagcatgttgcca

SEQ ID NO: 46491 - DNA, 25 bp, Mus musculus
aagagaagcctgacctcaccttgaa

SEQ ID NO: 46492 - DNA, 25 bp, Mus musculus
aagagaagcctgtcctcaccttgaa

SEQ ID NO: 46493 - DNA, 25 bp, Mus musculus
aagagaagcggcactcaccgacagg

SEQ ID NO: 46494 - DNA, 25 bp, Mus musculus
aagagaagcggctctcaccgacagg

SEQ ID NO: 46495 - DNA, 25 bp, Mus musculus
aagagaagctatatcctgtccacct

SEQ ID NO: 46496 - DNA, 25 bp, Mus musculus
aagagaagctatttcctgtccacct

SEQ ID NO: 46497 - DNA, 25 bp, Mus musculus
aagagaagctgtcaaatacatgcct

SEQ ID NO: 46498 - DNA, 25 bp, Mus musculus
aagagaagctgtgaaatacatgcct

SEQ ID NO: 46499 - DNA, 25 bp, Mus musculus
aagagaaggctcaggtcaacacggg

SEQ ID NO: 46500 - DNA, 25 bp, Mus musculus
aagagaaggctctggtcaacacggg

SEQ ID NO: 46501 - DNA, 25 bp, Mus musculus
aagagaaggctgaggccatcctgcg

SEQ ID NO: 46502 - DNA, 25 bp, Mus musculus
aagagaaggctgtggccatcctgcg

SEQ ID NO: 46503 - DNA, 25 bp, Mus musculus
aagagaaggtgtcctcagagcctcc

SEQ ID NO: 46504 - DNA, 25 bp, Mus musculus
aagagaaggtgtgctcagagcctcc

SEQ ID NO: 46505 - DNA, 25 bp, Mus musculus
aagagaagtagaattgtcccaggga

SEQ ID NO: 46506 - DNA, 25 bp, Mus musculus
aagagaagtagatttgtcccaggga

SEQ ID NO: 46507 - DNA, 25 bp, Mus musculus
aagagaagtctcattcgcctttgtc

SEQ ID NO: 46508 - DNA, 25 bp, Mus musculus
aagagaagtctctttcgcctttgtc

SEQ ID NO: 46509 - DNA, 25 bp, Mus musculus
aagagaagtgatccagggccttaca

SEQ ID NO: 46510 - DNA, 25 bp, Mus musculus
aagagaagtgatgcagggccttaca

SEQ ID NO: 46511 - DNA, 25 bp, Mus musculus
aagagaagtgtgatcggcgagccca

SEQ ID NO: 46512 - DNA, 25 bp, Mus musculus
aagagaagtgtgttcggcgagccca

SEQ ID NO: 46513 - DNA, 25 bp, Mus musculus
aagagaagttgcctgcatgccggtt

SEQ ID NO: 46514 - DNA, 25 bp, Mus musculus
aagagaagttgcgtgcatgccggtt

SEQ ID NO: 46515 - DNA, 25 bp, Mus musculus
aagagaatacacatggcagcccagg

SEQ ID NO: 46516 - DNA, 25 bp, Mus musculus
aagagaatacacttggcagcccagg

SEQ ID NO: 46517 - DNA, 25 bp, Mus musculus
aagagaatactcagagccccgttct

SEQ ID NO: 46518 - DNA, 25 bp, Mus musculus
aagagaatactctgagccccgttct

SEQ ID NO: 46519 - DNA, 25 bp, Mus musculus
aagagaatagctcaactttctgaaa

SEQ ID NO: 46520 - DNA, 25 bp, Mus musculus
aagagaatagctgaactttctgaaa

SEQ ID NO: 46521 - DNA, 25 bp, Mus musculus
aagagaatccatattgactccaata

SEQ ID NO: 46522 - DNA, 25 bp, Mus musculus
aagagaatccattttgactccaata

SEQ ID NO: 46523 - DNA, 25 bp, Mus musculus
aagagaatccccatctgtctgtctt

SEQ ID NO: 46524 - DNA, 25 bp, Mus musculus
aagagaatccccttctgtctgtctt

SEQ ID NO: 46525 - DNA, 25 bp, Mus musculus
aagagaatctgtatgcatgggaggc

SEQ ID NO: 46526 - DNA, 25 bp, Mus musculus
aagagaatctgtttgcatgggaggc

SEQ ID NO: 46527 - DNA, 25 bp, Mus musculus
aagagaatgagcctccatcccctct

SEQ ID NO: 46528 - DNA, 25 bp, Mus musculus
aagagaatgagcgtccatcccctct

SEQ ID NO: 46529 - DNA, 25 bp, Mus musculus
aagagaatgcccactgggaggaaga

SEQ ID NO: 46530 - DNA, 25 bp, Mus musculus
aagagaatgccctctgggaggaaga

SEQ ID NO: 46531 - DNA, 25 bp, Mus musculus
aagagaatgctgcttctccacaccc

SEQ ID NO: 46532 - DNA, 25 bp, Mus musculus
aagagaatgctggttctccacaccc

SEQ ID NO: 46533 - DNA, 25 bp, Mus musculus
aagagaattctcaggcacaaaaaga

SEQ ID NO: 46534 - DNA, 25 bp, Mus musculus
aagagaattctctggcacaaaaaga

SEQ ID NO: 46535 - DNA, 25 bp, Mus musculus
aagagaattgctccttgccaggagc

SEQ ID NO: 46536 - DNA, 25 bp, Mus musculus
aagagaattgctgcttgccaggagc

SEQ ID NO: 46537 - DNA, 25 bp, Mus musculus
aagagacaaattctctcctgagttc

SEQ ID NO: 46538 - DNA, 25 bp, Mus musculus
aagagacaaattgtctcctgagttc

SEQ ID NO: 46539 - DNA, 25 bp, Mus musculus
aagagacaacccacaggatccaggc

SEQ ID NO: 46540 - DNA, 25 bp, Mus musculus
aagagacaacccattgggccacagg

SEQ ID NO: 46541 - DNA, 25 bp, Mus musculus
aagagacaaccctcaggatccaggc

SEQ ID NO: 46542 - DNA, 25 bp, Mus musculus
aagagacaaccctttgggccacagg

SEQ ID NO: 46543 - DNA, 25 bp, Mus musculus
aagagacaacttcaagtgttgacct

SEQ ID NO: 46544 - DNA, 25 bp, Mus musculus
aagagacaacttgaagtgttgacct

SEQ ID NO: 46545 - DNA, 25 bp, Mus musculus
aagagacaagatacctcctgcctga

SEQ ID NO: 46546 - DNA, 25 bp, Mus musculus
aagagacaagattcctcctgcctga

SEQ ID NO: 46547 - DNA, 25 bp, Mus musculus
aagagacaagccaatcatccatgaa

SEQ ID NO: 46548 - DNA, 25 bp, Mus musculus
aagagacaagcctatcatccatgaa

SEQ ID NO: 46549 - DNA, 25 bp, Mus musculus
aagagacaattcctctgtctgcgct

SEQ ID NO: 46550 - DNA, 25 bp, Mus musculus
aagagacaattcgtctgtctgcgct

SEQ ID NO: 46551 - DNA, 25 bp, Mus musculus
aagagacacacacccgtgtacagga

SEQ ID NO: 46552 - DNA, 25 bp, Mus musculus
aagagacacacagccgtgtacagga

SEQ ID NO: 46553 - DNA, 25 bp, Mus musculus
aagagacaccacatactgggcctgt

SEQ ID NO: 46554 - DNA, 25 bp, Mus musculus
aagagacaccacttactgggcctgt

SEQ ID NO: 46555 - DNA, 25 bp, Mus musculus
aagagacaccatacttggcagcata

SEQ ID NO: 46556 - DNA, 25 bp, Mus musculus
aagagacaccatcctctcttcaact

SEQ ID NO: 46557 - DNA, 25 bp, Mus musculus
aagagacaccatgctctcttcaact

SEQ ID NO: 46558 - DNA, 25 bp, Mus musculus
aagagacaccattcttggcagcata

SEQ ID NO: 46559 - DNA, 25 bp, Mus musculus
aagagacaccccacatagtccagac

SEQ ID NO: 46560 - DNA, 25 bp, Mus musculus
aagagacacccctcatagtccagac

SEQ ID NO: 46561 - DNA, 25 bp, Mus musculus
aagagacacgacacaggctggctat

SEQ ID NO: 46562 - DNA, 25 bp, Mus musculus
aagagacacgactcaggctggctat

SEQ ID NO: 46563 - DNA, 25 bp, Mus musculus
aagagacacttgatccctgaaaggg

SEQ ID NO: 46564 - DNA, 25 bp, Mus musculus
aagagacacttgttccctgaaaggg

SEQ ID NO: 46565 - DNA, 25 bp, Mus musculus
aagagacagacactcagcctggctt

SEQ ID NO: 46566 - DNA, 25 bp, Mus musculus
aagagacagacagtcagcctggctt

SEQ ID NO: 46567 - DNA, 25 bp, Mus musculus
aagagacagagtcgccagactgacc

SEQ ID NO: 46568 - DNA, 25 bp, Mus musculus
aagagacagagtggccagactgacc

SEQ ID NO: 46569 - DNA, 25 bp, Mus musculus
aagagacagatcacagctccactgt

SEQ ID NO: 46570 - DNA, 25 bp, Mus musculus
aagagacagatctcagctccactgt

SEQ ID NO: 46571 - DNA, 25 bp, Mus musculus
aagagacagcctattctttcctact

SEQ ID NO: 46572 - DNA, 25 bp, Mus musculus
aagagacagccttttctttcctact

SEQ ID NO: 46573 - DNA, 25 bp, Mus musculus
aagagacagctccttacctgtggat

SEQ ID NO: 46574 - DNA, 25 bp, Mus musculus
aagagacagctcgttacctgtggat

SEQ ID NO: 46575 - DNA, 25 bp, Mus musculus
aagagacagctgatgcgctccttgt

SEQ ID NO: 46576 - DNA, 25 bp, Mus musculus
aagagacagctgttgcgctccttgt

SEQ ID NO: 46577 - DNA, 25 bp, Mus musculus
aagagacaggccaaatccagaatct

SEQ ID NO: 46578 - DNA, 25 bp, Mus musculus
aagagacaggcctaatccagaatct

SEQ ID NO: 46579 - DNA, 25 bp, Mus musculus
aagagacagtgtctgcttccagaag

SEQ ID NO: 46580 - DNA, 25 bp, Mus musculus
aagagacagtgtgtgcttccagaag

SEQ ID NO: 46581 - DNA, 25 bp, Mus musculus
aagagacagtttactcggaccctgg

SEQ ID NO: 46582 - DNA, 25 bp, Mus musculus
aagagacagttttctcggaccctgg

SEQ ID NO: 46583 - DNA, 25 bp, Mus musculus
aagagacatatgcaccacctgctat

SEQ ID NO: 46584 - DNA, 25 bp, Mus musculus
aagagacatatggaccacctgctat

SEQ ID NO: 46585 - DNA, 25 bp, Mus musculus
aagagacatctcagttactgcccct

SEQ ID NO: 46586 - DNA, 25 bp, Mus musculus
aagagacatctctgttactgcccct

SEQ ID NO: 46587 - DNA, 25 bp, Mus musculus
aagagacatgtcaccactagcttgt

SEQ ID NO: 46588 - DNA, 25 bp, Mus musculus
aagagacatgtctccactagcttgt

SEQ ID NO: 46589 - DNA, 25 bp, Mus musculus
aagagacattcaaccttaaggtaga

SEQ ID NO: 46590 - DNA, 25 bp, Mus musculus
aagagacattcatccttaaggtaga

SEQ ID NO: 46591 - DNA, 25 bp, Mus musculus
aagagaccaatgagcctgtttattt

SEQ ID NO: 46592 - DNA, 25 bp, Mus musculus
aagagaccaatgtgcctgtttattt

SEQ ID NO: 46593 - DNA, 25 bp, Mus musculus
aagagaccactcagtgccaagtcaa

SEQ ID NO: 46594 - DNA, 25 bp, Mus musculus
aagagaccactctgtgccaagtcaa

SEQ ID NO: 46595 - DNA, 25 bp, Mus musculus
aagagaccaggtatctgcctcactt

SEQ ID NO: 46596 - DNA, 25 bp, Mus musculus
aagagaccaggtttctgcctcactt

SEQ ID NO: 46597 - DNA, 25 bp, Mus musculus
aagagaccatgtccttttgtatgac

SEQ ID NO: 46598 - DNA, 25 bp, Mus musculus
aagagaccatgtgcttttgtatgac

SEQ ID NO: 46599 - DNA, 25 bp, Mus musculus
aagagacccaagctgctgagatctg

SEQ ID NO: 46600 - DNA, 25 bp, Mus musculus
aagagacccaaggtgctgagatctg

SEQ ID NO: 46601 - DNA, 25 bp, Mus musculus
aagagacccaccattcttaagagct

SEQ ID NO: 46602 - DNA, 25 bp, Mus musculus
aagagacccacctttcttaagagct

SEQ ID NO: 46603 - DNA, 25 bp, Mus musculus
aagagacccactcaaactgtagccc

SEQ ID NO: 46604 - DNA, 25 bp, Mus musculus
aagagacccactgaaactgtagccc

SEQ ID NO: 46605 - DNA, 25 bp, Mus musculus
aagagaccccagaatgccaaacata

SEQ ID NO: 46606 - DNA, 25 bp, Mus musculus
aagagaccccagtatgccaaacata

SEQ ID NO: 46607 - DNA, 25 bp, Mus musculus
aagagacccttgagcacgcaggcgg

SEQ ID NO: 46608 - DNA, 25 bp, Mus musculus
aagagacccttgtgcacgcaggcgg

SEQ ID NO: 46609 - DNA, 25 bp, Mus musculus
aagagaccgcaactgtatttttagt

SEQ ID NO: 46610 - DNA, 25 bp, Mus musculus
aagagaccgcaagtgtatttttagt

SEQ ID NO: 46611 - DNA, 25 bp, Mus musculus
aagagaccgtcaacacatgcctgct

SEQ ID NO: 46612 - DNA, 25 bp, Mus musculus
aagagaccgtcatcacatgcctgct

SEQ ID NO: 46613 - DNA, 25 bp, Mus musculus
aagagacctactattgacctcagcc

SEQ ID NO: 46614 - DNA, 25 bp, Mus musculus
aagagacctacttttgacctcagcc

SEQ ID NO: 46615 - DNA, 25 bp, Mus musculus
aagagacctagtctcaacctctggc

SEQ ID NO: 46616 - DNA, 25 bp, Mus musculus
aagagacctagtgtcaacctctggc

SEQ ID NO: 46617 - DNA, 25 bp, Mus musculus
aagagacctcaaatttatatgaatg

SEQ ID NO: 46618 - DNA, 25 bp, Mus musculus
aagagacctcaattttatatgaatg

SEQ ID NO: 46619 - DNA, 25 bp, Mus musculus
aagagacctcagacatcttttcctt

SEQ ID NO: 46620 - DNA, 25 bp, Mus musculus
aagagacctcagaggattacaggaa

SEQ ID NO: 46621 - DNA, 25 bp, Mus musculus
aagagacctcagtcatcttttcctt

SEQ ID NO: 46622 - DNA, 25 bp, Mus musculus
aagagacctcagtggattacaggaa

SEQ ID NO: 46623 - DNA, 25 bp, Mus musculus
aagagacctggacactctgggagct

SEQ ID NO: 46624 - DNA, 25 bp, Mus musculus
aagagacctggagactctgggagct

SEQ ID NO: 46625 - DNA, 25 bp, Mus musculus
aagagacctggcatggcctgaagac

SEQ ID NO: 46626 - DNA, 25 bp, Mus musculus
aagagacctggcttggcctgaagac

SEQ ID NO: 46627 - DNA, 25 bp, Mus musculus
aagagaccttctctgctagcagaaa

SEQ ID NO: 46628 - DNA, 25 bp, Mus musculus
aagagaccttctgtgctagcagaaa

SEQ ID NO: 46629 - DNA, 25 bp, Mus musculus
aagagaccttggatccaccggtgct

SEQ ID NO: 46630 - DNA, 25 bp, Mus musculus
aagagaccttggttccaccggtgct

SEQ ID NO: 46631 - DNA, 25 bp, Mus musculus
aagagaccttgtacagcctgtcaga

SEQ ID NO: 46632 - DNA, 25 bp, Mus musculus
aagagaccttgttcagcctgtcaga

SEQ ID NO: 46633 - DNA, 25 bp, Mus musculus
aagagacctttaccacctgggagat

SEQ ID NO: 46634 - DNA, 25 bp, Mus musculus
aagagacctttagcacctgggagat

SEQ ID NO: 46635 - DNA, 25 bp, Mus musculus
aagagacctttcattctgacactat

SEQ ID NO: 46636 - DNA, 25 bp, Mus musculus
aagagacctttctttctgacactat

SEQ ID NO: 46637 - DNA, 25 bp, Mus musculus
aagagacgaaacactaccgggactg

SEQ ID NO: 46638 - DNA, 25 bp, Mus musculus
aagagacgaaactctaccgggactg

SEQ ID NO: 46639 - DNA, 25 bp, Mus musculus
aagagacgaatgctgtacttcaaaa

SEQ ID NO: 46640 - DNA, 25 bp, Mus musculus
aagagacgaatggtgtacttcaaaa

SEQ ID NO: 46641 - DNA, 25 bp, Mus musculus
aagagacgcacgcagaagccgcccg

SEQ ID NO: 46642 - DNA, 25 bp, Mus musculus
aagagacgcacggagaagccgcccg

SEQ ID NO: 46643 - DNA, 25 bp, Mus musculus
aagagacgccgtaactgtcattact

SEQ ID NO: 46644 - DNA, 25 bp, Mus musculus
aagagacgccgttactgtcattact

SEQ ID NO: 46645 - DNA, 25 bp, Mus musculus
aagagacggtacacataccatcccc

SEQ ID NO: 46646 - DNA, 25 bp, Mus musculus
aagagacggtactcataccatcccc

SEQ ID NO: 46647 - DNA, 25 bp, Mus musculus
aagagacgttccaggtgttgcagac

SEQ ID NO: 46648 - DNA, 25 bp, Mus musculus
aagagacgttcctggtgttgcagac

SEQ ID NO: 46649 - DNA, 25 bp, Mus musculus
aagagacgtttgcagcagctatcag

SEQ ID NO: 46650 - DNA, 25 bp, Mus musculus
aagagacgtttggagcagctatcag

SEQ ID NO: 46651 - DNA, 25 bp, Mus musculus
aagagactacttcactggtcctggg

SEQ ID NO: 46652 - DNA, 25 bp, Mus musculus
aagagactacttgactggtcctggg

SEQ ID NO: 46653 - DNA, 25 bp, Mus musculus
aagagactatacagcacgccttcaa

SEQ ID NO: 46654 - DNA, 25 bp, Mus musculus
aagagactatactgcacgccttcaa

SEQ ID NO: 46655 - DNA, 25 bp, Mus musculus
aagagactatgcaggccaccatcca

SEQ ID NO: 46656 - DNA, 25 bp, Mus musculus
aagagactatgctggccaccatcca

SEQ ID NO: 46657 - DNA, 25 bp, Mus musculus
aagagactattcagcagagttggaa

SEQ ID NO: 46658 - DNA, 25 bp, Mus musculus
aagagactattctgcagagttggaa

SEQ ID NO: 46659 - DNA, 25 bp, Mus musculus
aagagactcaccagtttttgcctac

SEQ ID NO: 46660 - DNA, 25 bp, Mus musculus
aagagactcacctgtttttgcctac

SEQ ID NO: 46661 - DNA, 25 bp, Mus musculus
aagagactcgctaggtgtccatcat

SEQ ID NO: 46662 - DNA, 25 bp, Mus musculus
aagagactcgcttggtgtccatcat

SEQ ID NO: 46663 - DNA, 25 bp, Mus musculus
aagagactcggtcttagataacgga

SEQ ID NO: 46664 - DNA, 25 bp, Mus musculus
aagagactcggtgttagataacgga

SEQ ID NO: 46665 - DNA, 25 bp, Mus musculus
aagagactctcacgctcattttgga

SEQ ID NO: 46666 - DNA, 25 bp, Mus musculus
aagagactctcaggctcattttgga

SEQ ID NO: 46667 - DNA, 25 bp, Mus musculus
aagagactctgacttcttaaaagct

SEQ ID NO: 46668 - DNA, 25 bp, Mus musculus
aagagactctgagttcttaaaagct

SEQ ID NO: 46669 - DNA, 25 bp, Mus musculus
aagagactcttaccttgcggctgtg

SEQ ID NO: 46670 - DNA, 25 bp, Mus musculus
aagagactcttagcttgcggctgtg

SEQ ID NO: 46671 - DNA, 25 bp, Mus musculus
aagagactgagcctcaccatgtagc

SEQ ID NO: 46672 - DNA, 25 bp, Mus musculus
aagagactgagcgtcaccatgtagc

SEQ ID NO: 46673 - DNA, 25 bp, Mus musculus
aagagactgatacttaggcccagga

SEQ ID NO: 46674 - DNA, 25 bp, Mus musculus
aagagactgatagttaggcccagga

SEQ ID NO: 46675 - DNA, 25 bp, Mus musculus
aagagactgcgtactctggaacctg

SEQ ID NO: 46676 - DNA, 25 bp, Mus musculus
aagagactgcgttctctggaacctg

SEQ ID NO: 46677 - DNA, 25 bp, Mus musculus
aagagactgcttagagagccacctc

SEQ ID NO: 46678 - DNA, 25 bp, Mus musculus
aagagactgctttgagagccacctc

SEQ ID NO: 46679 - DNA, 25 bp, Mus musculus
aagagactgtttactgcattgggca

SEQ ID NO: 46680 - DNA, 25 bp, Mus musculus
aagagactgttttctgcattgggca

SEQ ID NO: 46681 - DNA, 25 bp, Mus musculus
aagagacttattctccagcttgcct

SEQ ID NO: 46682 - DNA, 25 bp, Mus musculus
aagagacttattctgtcactcccag

SEQ ID NO: 46683 - DNA, 25 bp, Mus musculus
aagagacttattgtccagcttgcct

SEQ ID NO: 46684 - DNA, 25 bp, Mus musculus
aagagacttattgtgtcactcccag

SEQ ID NO: 46685 - DNA, 25 bp, Mus musculus
aagagacttcctacagctgttgaaa

SEQ ID NO: 46686 - DNA, 25 bp, Mus musculus
aagagacttccttcagctgttgaaa

SEQ ID NO: 46687 - DNA, 25 bp, Mus musculus
aagagacttcgaccgatcccagttt

SEQ ID NO: 46688 - DNA, 25 bp, Mus musculus
aagagacttcgagcgatcccagttt

SEQ ID NO: 46689 - DNA, 25 bp, Mus musculus
aagagacttctacgagcttctcctg

SEQ ID NO: 46690 - DNA, 25 bp, Mus musculus
aagagacttctaggagcttctcctg

SEQ ID NO: 46691 - DNA, 25 bp, Mus musculus
aagagacttcttccttccttattct

SEQ ID NO: 46692 - DNA, 25 bp, Mus musculus
aagagacttcttgcttccttattct

SEQ ID NO: 46693 - DNA, 25 bp, Mus musculus
aagagacttgatcggaacagattcc

SEQ ID NO: 46694 - DNA, 25 bp, Mus musculus
aagagacttgatgggaacagattcc

SEQ ID NO: 46695 - DNA, 25 bp, Mus musculus
aagagacttggaaccttctctgctg

SEQ ID NO: 46696 - DNA, 25 bp, Mus musculus
aagagacttggatccttctctgctg

SEQ ID NO: 46697 - DNA, 25 bp, Mus musculus
aagagacttgtgactggccgttatc

SEQ ID NO: 46698 - DNA, 25 bp, Mus musculus
aagagacttgtgtctggccgttatc

SEQ ID NO: 46699 - DNA, 25 bp, Mus musculus
aagagacttgttaacataacattta

SEQ ID NO: 46700 - DNA, 25 bp, Mus musculus
aagagacttgtttacataacattta

SEQ ID NO: 46701 - DNA, 25 bp, Mus musculus
aagagactttacaacccaaacagat

SEQ ID NO: 46702 - DNA, 25 bp, Mus musculus
aagagactttactacccaaacagat

SEQ ID NO: 46703 - DNA, 25 bp, Mus musculus
aagagagaaccactaagcccacaca

SEQ ID NO: 46704 - DNA, 25 bp, Mus musculus
aagagagaaccagtaagcccacaca

SEQ ID NO: 46705 - DNA, 25 bp, Mus musculus
aagagagaaccccacaacagccata

SEQ ID NO: 46706 - DNA, 25 bp, Mus musculus
aagagagaacccgacaacagccata

SEQ ID NO: 46707 - DNA, 25 bp, Mus musculus
aagagagaccctacaggaccaggaa

SEQ ID NO: 46708 - DNA, 25 bp, Mus musculus
aagagagaccctcgtgactggactg

SEQ ID NO: 46709 - DNA, 25 bp, Mus musculus
aagagagaccctggtgactggactg

SEQ ID NO: 46710 - DNA, 25 bp, Mus musculus
aagagagacccttcaggaccaggaa

SEQ ID NO: 46711 - DNA, 25 bp, Mus musculus
aagagagacgccattgtctgctaag

SEQ ID NO: 46712 - DNA, 25 bp, Mus musculus
aagagagacgcctttgtctgctaag

SEQ ID NO: 46713 - DNA, 25 bp, Mus musculus
aagagagactccagacatctgtcct

SEQ ID NO: 46714 - DNA, 25 bp, Mus musculus
aagagagactccatcaagtacgaaa

SEQ ID NO: 46715 - DNA, 25 bp, Mus musculus
aagagagactcctgacatctgtcct

SEQ ID NO: 46716 - DNA, 25 bp, Mus musculus
aagagagactccttcaagtacgaaa

SEQ ID NO: 46717 - DNA, 25 bp, Mus musculus
aagagagactttccccttcacatag

SEQ ID NO: 46718 - DNA, 25 bp, Mus musculus
aagagagactttgcccttcacatag

SEQ ID NO: 46719 - DNA, 25 bp, Mus musculus
aagagagagacaccccatcacctaa

SEQ ID NO: 46720 - DNA, 25 bp, Mus musculus
aagagagagacagcccatcacctaa

SEQ ID NO: 46721 - DNA, 25 bp, Mus musculus
aagagagagctcaagacccacctga

SEQ ID NO: 46722 - DNA, 25 bp, Mus musculus
aagagagagctctagacccacctga

SEQ ID NO: 46723 - DNA, 25 bp, Mus musculus
aagagagagctgcttcagcgtccca

SEQ ID NO: 46724 - DNA, 25 bp, Mus musculus
aagagagagctggttcagcgtccca

SEQ ID NO: 46725 - DNA, 25 bp, Mus musculus
aagagagaggtcagtgctgacccca

SEQ ID NO: 46726 - DNA, 25 bp, Mus musculus
aagagagaggtctgtgctgacccca

SEQ ID NO: 46727 - DNA, 25 bp, Mus musculus
aagagagaggttcatcagacacact

SEQ ID NO: 46728 - DNA, 25 bp, Mus musculus
aagagagaggttgatcagacacact

SEQ ID NO: 46729 - DNA, 25 bp, Mus musculus
aagagagagttcacatggcacacac

SEQ ID NO: 46730 - DNA, 25 bp, Mus musculus
aagagagagttctcatggcacacac

SEQ ID NO: 46731 - DNA, 25 bp, Mus musculus
aagagagatgtgacgctctgccatc

SEQ ID NO: 46732 - DNA, 25 bp, Mus musculus
aagagagatgtgtcgctctgccatc

SEQ ID NO: 46733 - DNA, 25 bp, Mus musculus
aagagagcacggagtgtgccccgac

SEQ ID NO: 46734 - DNA, 25 bp, Mus musculus
aagagagcacggtgtgtgccccgac

SEQ ID NO: 46735 - DNA, 25 bp, Mus musculus
aagagagcactacgcctgacatggg

SEQ ID NO: 46736 - DNA, 25 bp, Mus musculus
aagagagcactaggcctgacatggg

SEQ ID NO: 46737 - DNA, 25 bp, Mus musculus
aagagagcagcacaaggccctggct

SEQ ID NO: 46738 - DNA, 25 bp, Mus musculus
aagagagcagcagaaggccctggct

SEQ ID NO: 46739 - DNA, 25 bp, Mus musculus
aagagagcatgccttccactgtggc

SEQ ID NO: 46740 - DNA, 25 bp, Mus musculus
aagagagcatgcgttccactgtggc

SEQ ID NO: 46741 - DNA, 25 bp, Mus musculus
aagagagcatttatactacatccta

SEQ ID NO: 46742 - DNA, 25 bp, Mus musculus
aagagagcatttttactacatccta

SEQ ID NO: 46743 - DNA, 25 bp, Mus musculus
aagagagccagacttcccagtcgtt

SEQ ID NO: 46744 - DNA, 25 bp, Mus musculus
aagagagccagagttcccagtcgtt

SEQ ID NO: 46745 - DNA, 25 bp, Mus musculus
aagagagccatccaccagagaacaa

SEQ ID NO: 46746 - DNA, 25 bp, Mus musculus
aagagagccatcgaccagagaacaa

SEQ ID NO: 46747 - DNA, 25 bp, Mus musculus
aagagagcccagagccttgagttaa

SEQ ID NO: 46748 - DNA, 25 bp, Mus musculus
aagagagcccagtgccttgagttaa

SEQ ID NO: 46749 - DNA, 25 bp, Mus musculus
aagagagcctccaaaaaccaacctg

SEQ ID NO: 46750 - DNA, 25 bp, Mus musculus
aagagagcctcctaaaaccaacctg

SEQ ID NO: 46751 - DNA, 25 bp, Mus musculus
aagagagccttgacactcctggtac

SEQ ID NO: 46752 - DNA, 25 bp, Mus musculus
aagagagccttgtcactcctggtac

SEQ ID NO: 46753 - DNA, 25 bp, Mus musculus
aagagagcgagactaagtataaaat

SEQ ID NO: 46754 - DNA, 25 bp, Mus musculus
aagagagcgagagtaagtataaaat

SEQ ID NO: 46755 - DNA, 25 bp, Mus musculus
aagagagcgcatcagttcccttgaa

SEQ ID NO: 46756 - DNA, 25 bp, Mus musculus
aagagagcgcatgagttcccttgaa

SEQ ID NO: 46757 - DNA, 25 bp, Mus musculus
aagagagcgccacagttcagaacaa

SEQ ID NO: 46758 - DNA, 25 bp, Mus musculus
aagagagcgccagagttcagaacaa

SEQ ID NO: 46759 - DNA, 25 bp, Mus musculus
aagagagcgcctatctcattcagaa

SEQ ID NO: 46760 - DNA, 25 bp, Mus musculus
aagagagcgcctttctcattcagaa

SEQ ID NO: 46761 - DNA, 25 bp, Mus musculus
aagagagcgcgcacttggtaacaaa

SEQ ID NO: 46762 - DNA, 25 bp, Mus musculus
aagagagcgcgctcttggtaacaaa

SEQ ID NO: 46763 - DNA, 25 bp, Mus musculus
aagagagcggatcctgtattccagc

SEQ ID NO: 46764 - DNA, 25 bp, Mus musculus
aagagagcggatgctgtattccagc

SEQ ID NO: 46765 - DNA, 25 bp, Mus musculus
aagagagcggccaccatcattcagg

SEQ ID NO: 46766 - DNA, 25 bp, Mus musculus
aagagagcggcctccatcattcagg

SEQ ID NO: 46767 - DNA, 25 bp, Mus musculus
aagagagcgtacatcccttgggact

SEQ ID NO: 46768 - DNA, 25 bp, Mus musculus
aagagagcgtacttcccttgggact

SEQ ID NO: 46769 - DNA, 25 bp, Mus musculus
aagagagctaaccaggttgactgcc

SEQ ID NO: 46770 - DNA, 25 bp, Mus musculus
aagagagctaacgaggttgactgcc

SEQ ID NO: 46771 - DNA, 25 bp, Mus musculus
aagagagctgatcatggtggctttc

SEQ ID NO: 46772 - DNA, 25 bp, Mus musculus
aagagagctgatgatggtggctttc

SEQ ID NO: 46773 - DNA, 25 bp, Mus musculus
aagagagctgccatcactttctcac

SEQ ID NO: 46774 - DNA, 25 bp, Mus musculus
aagagagctgccttcactttctcac

SEQ ID NO: 46775 - DNA, 25 bp, Mus musculus
aagagagctggcaagacccagatct

SEQ ID NO: 46776 - DNA, 25 bp, Mus musculus
aagagagctggctagacccagatct

SEQ ID NO: 46777 - DNA, 25 bp, Mus musculus
aagagaggagctcccaccggtgttc

SEQ ID NO: 46778 - DNA, 25 bp, Mus musculus
aagagaggagctgccaccggtgttc

SEQ ID NO: 46779 - DNA, 25 bp, Mus musculus
aagagaggcactcagaatcccctgt

SEQ ID NO: 46780 - DNA, 25 bp, Mus musculus
aagagaggcactgagaatcccctgt

SEQ ID NO: 46781 - DNA, 25 bp, Mus musculus
aagagaggcatcatccacgctcggg

SEQ ID NO: 46782 - DNA, 25 bp, Mus musculus
aagagaggcatcttccacgctcggg

SEQ ID NO: 46783 - DNA, 25 bp, Mus musculus
aagagaggccaaagctgttgtgagt

SEQ ID NO: 46784 - DNA, 25 bp, Mus musculus
aagagaggccaatgctgttgtgagt

SEQ ID NO: 46785 - DNA, 25 bp, Mus musculus
aagagaggccacaaggtccccactt

SEQ ID NO: 46786 - DNA, 25 bp, Mus musculus
aagagaggccactaggtccccactt

SEQ ID NO: 46787 - DNA, 25 bp, Mus musculus
aagagaggctcccagcattgttgca

SEQ ID NO: 46788 - DNA, 25 bp, Mus musculus
aagagaggctccgagcattgttgca

SEQ ID NO: 46789 - DNA, 25 bp, Mus musculus
aagagagggatccacctcgtcgtgt

SEQ ID NO: 46790 - DNA, 25 bp, Mus musculus
aagagagggatcgacctcgtcgtgt

SEQ ID NO: 46791 - DNA, 25 bp, Mus musculus
aagagagggcctctaccttgtagct

SEQ ID NO: 46792 - DNA, 25 bp, Mus musculus
aagagagggcctgtaccttgtagct

SEQ ID NO: 46793 - DNA, 25 bp, Mus musculus
aagagaggggctctattttcattct

SEQ ID NO: 46794 - DNA, 25 bp, Mus musculus
aagagaggggctgtattttcattct

SEQ ID NO: 46795 - DNA, 25 bp, Mus musculus
aagagaggtcttacttgttcctgga

SEQ ID NO: 46796 - DNA, 25 bp, Mus musculus
aagagaggtctttcttgttcctgga

SEQ ID NO: 46797 - DNA, 25 bp, Mus musculus
aagagaggtggactcgcccgtccct

SEQ ID NO: 46798 - DNA, 25 bp, Mus musculus
aagagaggtggagtcgcccgtccct

SEQ ID NO: 46799 - DNA, 25 bp, Mus musculus
aagagagtacctagtgcttatgaca

SEQ ID NO: 46800 - DNA, 25 bp, Mus musculus
aagagagtaccttgtgcttatgaca

SEQ ID NO: 46801 - DNA, 25 bp, Mus musculus
aagagagtacggcagctccttgact

SEQ ID NO: 46802 - DNA, 25 bp, Mus musculus
aagagagtacgggagctccttgact

SEQ ID NO: 46803 - DNA, 25 bp, Mus musculus
aagagagtactcatcatcctgctga

SEQ ID NO: 46804 - DNA, 25 bp, Mus musculus
aagagagtactcttcatcctgctga

SEQ ID NO: 46805 - DNA, 25 bp, Mus musculus
aagagagtacttctgacacttcacc

SEQ ID NO: 46806 - DNA, 25 bp, Mus musculus
aagagagtacttgtgacacttcacc

SEQ ID NO: 46807 - DNA, 25 bp, Mus musculus
aagagagtcagtccgtcaattccct

SEQ ID NO: 46808 - DNA, 25 bp, Mus musculus
aagagagtcagtctccaacatcctc

SEQ ID NO: 46809 - DNA, 25 bp, Mus musculus
aagagagtcagtgcgtcaattccct

SEQ ID NO: 46810 - DNA, 25 bp, Mus musculus
aagagagtcagtgtccaacatcctc

SEQ ID NO: 46811 - DNA, 25 bp, Mus musculus
aagagagtcctgaggtttcctggaa

SEQ ID NO: 46812 - DNA, 25 bp, Mus musculus
aagagagtcctgtggtttcctggaa

SEQ ID NO: 46813 - DNA, 25 bp, Mus musculus
aagagagtcgcgatggttgcctctc

SEQ ID NO: 46814 - DNA, 25 bp, Mus musculus
aagagagtcgcgttggttgcctctc

SEQ ID NO: 46815 - DNA, 25 bp, Mus musculus
aagagagtctctccatcactcacgg

SEQ ID NO: 46816 - DNA, 25 bp, Mus musculus
aagagagtctctgcatcactcacgg

SEQ ID NO: 46817 - DNA, 25 bp, Mus musculus
aagagagtctgcagtctacaggaca

SEQ ID NO: 46818 - DNA, 25 bp, Mus musculus
aagagagtctgctgtctacaggaca

SEQ ID NO: 46819 - DNA, 25 bp, Mus musculus
aagagagtctggagccttgtacatt

SEQ ID NO: 46820 - DNA, 25 bp, Mus musculus
aagagagtctggtgccttgtacatt

SEQ ID NO: 46821 - DNA, 25 bp, Mus musculus
aagagagtgagacccttggccttga

SEQ ID NO: 46822 - DNA, 25 bp, Mus musculus
aagagagtgagagccttggccttga

SEQ ID NO: 46823 - DNA, 25 bp, Mus musculus
aagagagtgcatcctgttaccacgc

SEQ ID NO: 46824 - DNA, 25 bp, Mus musculus
aagagagtgcatgctgttaccacgc

SEQ ID NO: 46825 - DNA, 25 bp, Mus musculus
aagagagtgccaccaggagccccga

SEQ ID NO: 46826 - DNA, 25 bp, Mus musculus
aagagagtgccagcaggagccccga

SEQ ID NO: 46827 - DNA, 25 bp, Mus musculus
aagagagtggtcctagtatctcccc

SEQ ID NO: 46828 - DNA, 25 bp, Mus musculus
aagagagtggtcgtagtatctcccc

SEQ ID NO: 46829 - DNA, 25 bp, Mus musculus
aagagagtgtccagctcgtgtttca

SEQ ID NO: 46830 - DNA, 25 bp, Mus musculus
aagagagtgtcctgctcgtgtttca

SEQ ID NO: 46831 - DNA, 25 bp, Mus musculus
aagagagtgtcgactgctctcatgt

SEQ ID NO: 46832 - DNA, 25 bp, Mus musculus
aagagagtgtcgtctgctctcatgt

SEQ ID NO: 46833 - DNA, 25 bp, Mus musculus
aagagagttcatctcctgagcagga

SEQ ID NO: 46834 - DNA, 25 bp, Mus musculus
aagagagttcatgtcctgagcagga

SEQ ID NO: 46835 - DNA, 25 bp, Mus musculus
aagagagttcggatacctctgcctg

SEQ ID NO: 46836 - DNA, 25 bp, Mus musculus
aagagagttcggttacctctgcctg

SEQ ID NO: 46837 - DNA, 25 bp, Mus musculus
aagagagtttccactgcactcttga

SEQ ID NO: 46838 - DNA, 25 bp, Mus musculus
aagagagtttcctctgcactcttga

SEQ ID NO: 46839 - DNA, 25 bp, Mus musculus
aagagagtttctcgagagccaccct

SEQ ID NO: 46840 - DNA, 25 bp, Mus musculus
aagagagtttctggagagccaccct

SEQ ID NO: 46841 - DNA, 25 bp, Mus musculus
aagagagttttacccctccaggatg

SEQ ID NO: 46842 - DNA, 25 bp, Mus musculus
aagagagttttagccctccaggatg

SEQ ID NO: 46843 - DNA, 25 bp, Mus musculus
aagagataaaaccttaagcacagaa

SEQ ID NO: 46844 - DNA, 25 bp, Mus musculus
aagagataaaacgttaagcacagaa

SEQ ID NO: 46845 - DNA, 25 bp, Mus musculus
aagagataagacaagaccctgtgat

SEQ ID NO: 46846 - DNA, 25 bp, Mus musculus
aagagataagactagaccctgtgat

SEQ ID NO: 46847 - DNA, 25 bp, Mus musculus
aagagatacagcagacggtgtgtct

SEQ ID NO: 46848 - DNA, 25 bp, Mus musculus
aagagatacagctgacggtgtgtct

SEQ ID NO: 46849 - DNA, 25 bp, Mus musculus
aagagatacagtcgccgtcctgtga

SEQ ID NO: 46850 - DNA, 25 bp, Mus musculus
aagagatacagtcttgccctgggtt

SEQ ID NO: 46851 - DNA, 25 bp, Mus musculus
aagagatacagtggccgtcctgtga

SEQ ID NO: 46852 - DNA, 25 bp, Mus musculus
aagagatacagtgttgccctgggtt

SEQ ID NO: 46853 - DNA, 25 bp, Mus musculus
aagagataggctcagctcctgctgt

SEQ ID NO: 46854 - DNA, 25 bp, Mus musculus
aagagataggctgagctcctgctgt

SEQ ID NO: 46855 - DNA, 25 bp, Mus musculus
aagagatatccccaactgggccaca

SEQ ID NO: 46856 - DNA, 25 bp, Mus musculus
aagagatatcccgaactgggccaca

SEQ ID NO: 46857 - DNA, 25 bp, Mus musculus
aagagatcaaacatctggaggagaa

SEQ ID NO: 46858 - DNA, 25 bp, Mus musculus
aagagatcaaacttctggaggagaa

SEQ ID NO: 46859 - DNA, 25 bp, Mus musculus
aagagatcacaacgcgactgagtat

SEQ ID NO: 46860 - DNA, 25 bp, Mus musculus
aagagatcacaaggcgactgagtat

SEQ ID NO: 46861 - DNA, 25 bp, Mus musculus
aagagatcacacattctgaaccctc

SEQ ID NO: 46862 - DNA, 25 bp, Mus musculus
aagagatcacacattgggccctgga

SEQ ID NO: 46863 - DNA, 25 bp, Mus musculus
aagagatcacactttctgaaccctc

SEQ ID NO: 46864 - DNA, 25 bp, Mus musculus
aagagatcacactttgggccctgga

SEQ ID NO: 46865 - DNA, 25 bp, Mus musculus
aagagatcatttagtatagaactat

SEQ ID NO: 46866 - DNA, 25 bp, Mus musculus
aagagatcattttgtatagaactat

SEQ ID NO: 46867 - DNA, 25 bp, Mus musculus
aagagatccagacctgtgtgggtct

SEQ ID NO: 46868 - DNA, 25 bp, Mus musculus
aagagatccagagctgtgtgggtct

SEQ ID NO: 46869 - DNA, 25 bp, Mus musculus
aagagatcccagaaccattgcctgt

SEQ ID NO: 46870 - DNA, 25 bp, Mus musculus
aagagatcccagtaccattgcctgt

SEQ ID NO: 46871 - DNA, 25 bp, Mus musculus
aagagatccctcctataccagaaaa

SEQ ID NO: 46872 - DNA, 25 bp, Mus musculus
aagagatccctcgtataccagaaaa

SEQ ID NO: 46873 - DNA, 25 bp, Mus musculus
aagagatccctgatgacgttcacca

SEQ ID NO: 46874 - DNA, 25 bp, Mus musculus
aagagatccctgttgacgttcacca

SEQ ID NO: 46875 - DNA, 25 bp, Mus musculus
aagagatccgaaaaccatcctctct

SEQ ID NO: 46876 - DNA, 25 bp, Mus musculus
aagagatccgaataccatcctctct

SEQ ID NO: 46877 - DNA, 25 bp, Mus musculus
aagagatccgagacagcccaatcgt

SEQ ID NO: 46878 - DNA, 25 bp, Mus musculus
aagagatccgagtcagcccaatcgt

SEQ ID NO: 46879 - DNA, 25 bp, Mus musculus
aagagatcctcgcttgtactgctgc

SEQ ID NO: 46880 - DNA, 25 bp, Mus musculus
aagagatcctcggttgtactgctgc

SEQ ID NO: 46881 - DNA, 25 bp, Mus musculus
aagagatcgtccaccactcactcaa

SEQ ID NO: 46882 - DNA, 25 bp, Mus musculus
aagagatcgtcctccactcactcaa

SEQ ID NO: 46883 - DNA, 25 bp, Mus musculus
aagagatctgacacctacaagctgg

SEQ ID NO: 46884 - DNA, 25 bp, Mus musculus
aagagatctgactcctacaagctgg

SEQ ID NO: 46885 - DNA, 25 bp, Mus musculus
aagagatcttcaaccctacagcgaa

SEQ ID NO: 46886 - DNA, 25 bp, Mus musculus
aagagatcttcatccctacagcgaa

SEQ ID NO: 46887 - DNA, 25 bp, Mus musculus
aagagatcttttactcacactgcct

SEQ ID NO: 46888 - DNA, 25 bp, Mus musculus
aagagatctttttctcacactgcct

SEQ ID NO: 46889 - DNA, 25 bp, Mus musculus
aagagatgacagaggtccctcagct

SEQ ID NO: 46890 - DNA, 25 bp, Mus musculus
aagagatgacagtggtccctcagct

SEQ ID NO: 46891 - DNA, 25 bp, Mus musculus
aagagatgaccaccagggtcctgct

SEQ ID NO: 46892 - DNA, 25 bp, Mus musculus
aagagatgaccagcagggtcctgct

SEQ ID NO: 46893 - DNA, 25 bp, Mus musculus
aagagatgaccccttgtgagatcaa

SEQ ID NO: 46894 - DNA, 25 bp, Mus musculus
aagagatgacccgttgtgagatcaa

SEQ ID NO: 46895 - DNA, 25 bp, Mus musculus
aagagatgagctccgcacaagtccc

SEQ ID NO: 46896 - DNA, 25 bp, Mus musculus
aagagatgagctgcgcacaagtccc

SEQ ID NO: 46897 - DNA, 25 bp, Mus musculus
aagagatgatgaatcgccaacgtga

SEQ ID NO: 46898 - DNA, 25 bp, Mus musculus
aagagatgatgattcgccaacgtga

SEQ ID NO: 46899 - DNA, 25 bp, Mus musculus
aagagatgcattatactttctgaaa

SEQ ID NO: 46900 - DNA, 25 bp, Mus musculus
aagagatgcattttactttctgaaa

SEQ ID NO: 46901 - DNA, 25 bp, Mus musculus
aagagatgccagaaacccggttata

SEQ ID NO: 46902 - DNA, 25 bp, Mus musculus
aagagatgccagtaacccggttata

SEQ ID NO: 46903 - DNA, 25 bp, Mus musculus
aagagatgccatctgaagagtctga

SEQ ID NO: 46904 - DNA, 25 bp, Mus musculus
aagagatgccatgtgaagagtctga

SEQ ID NO: 46905 - DNA, 25 bp, Mus musculus
aagagatgccccacaacgttgctga

SEQ ID NO: 46906 - DNA, 25 bp, Mus musculus
aagagatgcccctcaacgttgctga

SEQ ID NO: 46907 - DNA, 25 bp, Mus musculus
aagagatgcctacgagtctccttgt

SEQ ID NO: 46908 - DNA, 25 bp, Mus musculus
aagagatgcctaggagtctccttgt

SEQ ID NO: 46909 - DNA, 25 bp, Mus musculus
aagagatgctgcaccacctttctca

SEQ ID NO: 46910 - DNA, 25 bp, Mus musculus
aagagatgctgctccacctttctca

SEQ ID NO: 46911 - DNA, 25 bp, Mus musculus
aagagatgcttaaggattatgtcaa

SEQ ID NO: 46912 - DNA, 25 bp, Mus musculus
aagagatgcttatggattatgtcaa

SEQ ID NO: 46913 - DNA, 25 bp, Mus musculus
aagagatggacacaggccttacatt

SEQ ID NO: 46914 - DNA, 25 bp, Mus musculus
aagagatggacagaggccttacatt

SEQ ID NO: 46915 - DNA, 25 bp, Mus musculus
aagagatggcagctcagatccgtga

SEQ ID NO: 46916 - DNA, 25 bp, Mus musculus
aagagatggcaggtcagatccgtga

SEQ ID NO: 46917 - DNA, 25 bp, Mus musculus
aagagatggccactagcagtgctaa

SEQ ID NO: 46918 - DNA, 25 bp, Mus musculus
aagagatggccagtagcagtgctaa

SEQ ID NO: 46919 - DNA, 25 bp, Mus musculus
aagagatggcctctcaggacagcga

SEQ ID NO: 46920 - DNA, 25 bp, Mus musculus
aagagatggcctgtcaggacagcga

SEQ ID NO: 46921 - DNA, 25 bp, Mus musculus
aagagatggctaattctgcaaggca

SEQ ID NO: 46922 - DNA, 25 bp, Mus musculus
aagagatggctatttctgcaaggca

SEQ ID NO: 46923 - DNA, 25 bp, Mus musculus
aagagatggctcctcaccttcgtga

SEQ ID NO: 46924 - DNA, 25 bp, Mus musculus
aagagatggctcgtcaccttcgtga

SEQ ID NO: 46925 - DNA, 25 bp, Mus musculus
aagagatgggagacgaaaactgaac

SEQ ID NO: 46926 - DNA, 25 bp, Mus musculus
aagagatgggagtcgaaaactgaac

SEQ ID NO: 46927 - DNA, 25 bp, Mus musculus
aagagatgggtccttctgtgttgcc

SEQ ID NO: 46928 - DNA, 25 bp, Mus musculus
aagagatgggtcgttctgtgttgcc

SEQ ID NO: 46929 - DNA, 25 bp, Mus musculus
aagagatggtgcactatcctgaagg

SEQ ID NO: 46930 - DNA, 25 bp, Mus musculus
aagagatggtgctctatcctgaagg

SEQ ID NO: 46931 - DNA, 25 bp, Mus musculus
aagagatgtccgaagcattcccttg

SEQ ID NO: 46932 - DNA, 25 bp, Mus musculus
aagagatgtccgtagcattcccttg

SEQ ID NO: 46933 - DNA, 25 bp, Mus musculus
aagagatgtctcaggtgccatccat

SEQ ID NO: 46934 - DNA, 25 bp, Mus musculus
aagagatgtctctggtgccatccat

SEQ ID NO: 46935 - DNA, 25 bp, Mus musculus
aagagatgtcttcagcaggatgcaa

SEQ ID NO: 46936 - DNA, 25 bp, Mus musculus
aagagatgtcttgagcaggatgcaa

SEQ ID NO: 46937 - DNA, 25 bp, Mus musculus
aagagattacacctcgagtctaaag

SEQ ID NO: 46938 - DNA, 25 bp, Mus musculus
aagagattacacgtcgagtctaaag

SEQ ID NO: 46939 - DNA, 25 bp, Mus musculus
aagagattacctacgtctggccaga

SEQ ID NO: 46940 - DNA, 25 bp, Mus musculus
aagagattaccttcgtctggccaga

SEQ ID NO: 46941 - DNA, 25 bp, Mus musculus
aagagattactgaagccagcctgac

SEQ ID NO: 46942 - DNA, 25 bp, Mus musculus
aagagattactgtagccagcctgac

SEQ ID NO: 46943 - DNA, 25 bp, Mus musculus
aagagattagaccacaagccagcct

SEQ ID NO: 46944 - DNA, 25 bp, Mus musculus
aagagattagacgacaagccagcct

SEQ ID NO: 46945 - DNA, 25 bp, Mus musculus
aagagattcagaaacccaggtgtga

SEQ ID NO: 46946 - DNA, 25 bp, Mus musculus
aagagattcagatacccaggtgtga

SEQ ID NO: 46947 - DNA, 25 bp, Mus musculus
aagagattccctcagtagcaccttc

SEQ ID NO: 46948 - DNA, 25 bp, Mus musculus
aagagattccctgagtagcaccttc

SEQ ID NO: 46949 - DNA, 25 bp, Mus musculus
aagagattcctccaccaagctggga

SEQ ID NO: 46950 - DNA, 25 bp, Mus musculus
aagagattcctccagttcccgagaa

SEQ ID NO: 46951 - DNA, 25 bp, Mus musculus
aagagattcctcgaccaagctggga

SEQ ID NO: 46952 - DNA, 25 bp, Mus musculus
aagagattcctcgagttcccgagaa

SEQ ID NO: 46953 - DNA, 25 bp, Mus musculus
aagagattctatagagcccaaggat

SEQ ID NO: 46954 - DNA, 25 bp, Mus musculus
aagagattctattgagcccaaggat

SEQ ID NO: 46955 - DNA, 25 bp, Mus musculus
aagagattctctcgcgacccaaaga

SEQ ID NO: 46956 - DNA, 25 bp, Mus musculus
aagagattctctggcgacccaaaga

SEQ ID NO: 46957 - DNA, 25 bp, Mus musculus
aagagattctgtaccttgcccggtt

SEQ ID NO: 46958 - DNA, 25 bp, Mus musculus
aagagattctgtatcctcccatagg

SEQ ID NO: 46959 - DNA, 25 bp, Mus musculus
aagagattctgttccttgcccggtt

SEQ ID NO: 46960 - DNA, 25 bp, Mus musculus
aagagattctgtttcctcccatagg

SEQ ID NO: 46961 - DNA, 25 bp, Mus musculus
aagagattgttcagtcatgcctgtt

SEQ ID NO: 46962 - DNA, 25 bp, Mus musculus
aagagattgttctgtcatgcctgtt

SEQ ID NO: 46963 - DNA, 25 bp, Mus musculus
aagagatttatcaccggatccccaa

SEQ ID NO: 46964 - DNA, 25 bp, Mus musculus
aagagatttatctccggatccccaa

SEQ ID NO: 46965 - DNA, 25 bp, Mus musculus
aagagatttcaacctgccggcagaa

SEQ ID NO: 46966 - DNA, 25 bp, Mus musculus
aagagatttcaagctgccggcagaa

SEQ ID NO: 46967 - DNA, 25 bp, Mus musculus
aagagatttctcagcataaattgca

SEQ ID NO: 46968 - DNA, 25 bp, Mus musculus
aagagatttctctgcataaattgca

SEQ ID NO: 46969 - DNA, 25 bp, Mus musculus
aagagatttgttcttgggctgttct

SEQ ID NO: 46970 - DNA, 25 bp, Mus musculus
aagagatttgttgttgggctgttct

SEQ ID NO: 46971 - DNA, 25 bp, Mus musculus
aagagattttccatggcgggagctc

SEQ ID NO: 46972 - DNA, 25 bp, Mus musculus
aagagattttccttggcgggagctc

SEQ ID NO: 46973 - DNA, 25 bp, Mus musculus
aagagattttgcagctgcttctaac

SEQ ID NO: 46974 - DNA, 25 bp, Mus musculus
aagagattttgctgctgcttctaac

SEQ ID NO: 46975 - DNA, 25 bp, Mus musculus
aagagatttttccagggcatcacca

SEQ ID NO: 46976 - DNA, 25 bp, Mus musculus
aagagatttttcgagggcatcacca

SEQ ID NO: 46977 - DNA, 25 bp, Mus musculus
aagagcaaaagtcgagagcggaaac

SEQ ID NO: 46978 - DNA, 25 bp, Mus musculus
aagagcaaaagtggagagcggaaac

SEQ ID NO: 46979 - DNA, 25 bp, Mus musculus
aagagcaacatgctgtcctgcttct

SEQ ID NO: 46980 - DNA, 25 bp, Mus musculus
aagagcaacatggtgtcctgcttct

SEQ ID NO: 46981 - DNA, 25 bp, Mus musculus
aagagcaaccctaccttgaacgagt

SEQ ID NO: 46982 - DNA, 25 bp, Mus musculus
aagagcaacccttccttgaacgagt

SEQ ID NO: 46983 - DNA, 25 bp, Mus musculus
aagagcaagatccaaggcctccacg

SEQ ID NO: 46984 - DNA, 25 bp, Mus musculus
aagagcaagatcgaaggcctccacg

SEQ ID NO: 46985 - DNA, 25 bp, Mus musculus
aagagcaaggaacccctgcaggaca

SEQ ID NO: 46986 - DNA, 25 bp, Mus musculus
aagagcaaggaagccctgcaggaca

SEQ ID NO: 46987 - DNA, 25 bp, Mus musculus
aagagcaatgctcgcagcttcaaaa

SEQ ID NO: 46988 - DNA, 25 bp, Mus musculus
aagagcaatgctggcagcttcaaaa

SEQ ID NO: 46989 - DNA, 25 bp, Mus musculus
aagagcaatggaccagccccttagt

SEQ ID NO: 46990 - DNA, 25 bp, Mus musculus
aagagcaatggagcagccccttagt

SEQ ID NO: 46991 - DNA, 25 bp, Mus musculus
aagagcaatgtcaaccctggtgagc

SEQ ID NO: 46992 - DNA, 25 bp, Mus musculus
aagagcaatgtctaccctggtgagc

SEQ ID NO: 46993 - DNA, 25 bp, Mus musculus
aagagcacaaagcagtttcatagaa

SEQ ID NO: 46994 - DNA, 25 bp, Mus musculus
aagagcacaaaggagtttcatagaa

SEQ ID NO: 46995 - DNA, 25 bp, Mus musculus
aagagcacagacatgaagtaccgga

SEQ ID NO: 46996 - DNA, 25 bp, Mus musculus
aagagcacagacttgaagtaccgga

SEQ ID NO: 46997 - DNA, 25 bp, Mus musculus
aagagcacagcaaatccaggataag

SEQ ID NO: 46998 - DNA, 25 bp, Mus musculus
aagagcacagcacagtgtctgcctg

SEQ ID NO: 46999 - DNA, 25 bp, Mus musculus
aagagcacagcagagtgtctgcctg

SEQ ID NO: 47000 - DNA, 25 bp, Mus musculus
aagagcacagcatatccaggataag

SEQ ID NO: 47001 - DNA, 25 bp, Mus musculus
aagagcacccagatcgagcctgtgt

SEQ ID NO: 47002 - DNA, 25 bp, Mus musculus
aagagcacccagttcgagcctgtgt

SEQ ID NO: 47003 - DNA, 25 bp, Mus musculus
aagagcacccatccgctgtcagagg

SEQ ID NO: 47004 - DNA, 25 bp, Mus musculus
aagagcacccatgcgctgtcagagg

SEQ ID NO: 47005 - DNA, 25 bp, Mus musculus
aagagcacccctcctgcagaatggg

SEQ ID NO: 47006 - DNA, 25 bp, Mus musculus
aagagcacccctgctgcagaatggg

SEQ ID NO: 47007 - DNA, 25 bp, Mus musculus
aagagcaccctaatggttgcccgaa

SEQ ID NO: 47008 - DNA, 25 bp, Mus musculus
aagagcaccctattggttgcccgaa

SEQ ID NO: 47009 - DNA, 25 bp, Mus musculus
aagagcacctacagaattctccgag

SEQ ID NO: 47010 - DNA, 25 bp, Mus musculus
aagagcacctactgaattctccgag

SEQ ID NO: 47011 - DNA, 25 bp, Mus musculus
aagagcaccttcatatggccagtca

SEQ ID NO: 47012 - DNA, 25 bp, Mus musculus
aagagcaccttcttatggccagtca

SEQ ID NO: 47013 - DNA, 25 bp, Mus musculus
aagagcacgagtcattttactatat

SEQ ID NO: 47014 - DNA, 25 bp, Mus musculus
aagagcacgagtgattttactatat

SEQ ID NO: 47015 - DNA, 25 bp, Mus musculus
aagagcacggtgattcagcgctaat

SEQ ID NO: 47016 - DNA, 25 bp, Mus musculus
aagagcacggtgtttcagcgctaat

SEQ ID NO: 47017 - DNA, 25 bp, Mus musculus
aagagcacgtgcagcccttctcggc

SEQ ID NO: 47018 - DNA, 25 bp, Mus musculus
aagagcacgtgctgcccttctcggc

SEQ ID NO: 47019 - DNA, 25 bp, Mus musculus
aagagcactcttaccttgatctctc

SEQ ID NO: 47020 - DNA, 25 bp, Mus musculus
aagagcactctttccttgatctctc

SEQ ID NO: 47021 - DNA, 25 bp, Mus musculus
aagagcactgatcacggacccagaa

SEQ ID NO: 47022 - DNA, 25 bp, Mus musculus
aagagcactgatgacggacccagaa

SEQ ID NO: 47023 - DNA, 25 bp, Mus musculus
aagagcactgcaacacgctaatctt

SEQ ID NO: 47024 - DNA, 25 bp, Mus musculus
aagagcactgcatcacgctaatctt

SEQ ID NO: 47025 - DNA, 25 bp, Mus musculus
aagagcactgctaaaccatccttcc

SEQ ID NO: 47026 - DNA, 25 bp, Mus musculus
aagagcactgctcgatagttgccta

SEQ ID NO: 47027 - DNA, 25 bp, Mus musculus
aagagcactgctggatagttgccta

SEQ ID NO: 47028 - DNA, 25 bp, Mus musculus
aagagcactgcttaaccatccttcc

SEQ ID NO: 47029 - DNA, 25 bp, Mus musculus
aagagcactggaacgggcctctccg

SEQ ID NO: 47030 - DNA, 25 bp, Mus musculus
aagagcactggatcgggcctctccg

SEQ ID NO: 47031 - DNA, 25 bp, Mus musculus
aagagcacttagaacttccccagtt

SEQ ID NO: 47032 - DNA, 25 bp, Mus musculus
aagagcacttagtacttccccagtt

SEQ ID NO: 47033 - DNA, 25 bp, Mus musculus
aagagcacttcaacttggccattgt

SEQ ID NO: 47034 - DNA, 25 bp, Mus musculus
aagagcacttcatcttggccattgt

SEQ ID NO: 47035 - DNA, 25 bp, Mus musculus
aagagcacttgtatctctctttcgg

SEQ ID NO: 47036 - DNA, 25 bp, Mus musculus
aagagcacttgtttctctctttcgg

SEQ ID NO: 47037 - DNA, 25 bp, Mus musculus
aagagcactttcaggaagaatgtag

SEQ ID NO: 47038 - DNA, 25 bp, Mus musculus
aagagcactttctggaagaatgtag

SEQ ID NO: 47039 - DNA, 25 bp, Mus musculus
aagagcagacatcgcctcttgcttc

SEQ ID NO: 47040 - DNA, 25 bp, Mus musculus
aagagcagacatggcctcttgcttc

SEQ ID NO: 47041 - DNA, 25 bp, Mus musculus
aagagcagactaaacccctgaagaa

SEQ ID NO: 47042 - DNA, 25 bp, Mus musculus
aagagcagactatacccctgaagaa

SEQ ID NO: 47043 - DNA, 25 bp, Mus musculus
aagagcagactcacatatctcatga

SEQ ID NO: 47044 - DNA, 25 bp, Mus musculus
aagagcagactccatgtagtcacat

SEQ ID NO: 47045 - DNA, 25 bp, Mus musculus
aagagcagactcgatgtagtcacat

SEQ ID NO: 47046 - DNA, 25 bp, Mus musculus
aagagcagactctcatatctcatga

SEQ ID NO: 47047 - DNA, 25 bp, Mus musculus
aagagcagagaccaaattcacaaga

SEQ ID NO: 47048 - DNA, 25 bp, Mus musculus
aagagcagagacgaaattcacaaga

SEQ ID NO: 47049 - DNA, 25 bp, Mus musculus
aagagcagagcactaccaggactcc

SEQ ID NO: 47050 - DNA, 25 bp, Mus musculus
aagagcagagcagtaccaggactcc

SEQ ID NO: 47051 - DNA, 25 bp, Mus musculus
aagagcagcaagcagatccagtggt

SEQ ID NO: 47052 - DNA, 25 bp, Mus musculus
aagagcagcaaggagatccagtggt

SEQ ID NO: 47053 - DNA, 25 bp, Mus musculus
aagagcagcagtacgtcagagccaa

SEQ ID NO: 47054 - DNA, 25 bp, Mus musculus
aagagcagcagttcgtcagagccaa

SEQ ID NO: 47055 - DNA, 25 bp, Mus musculus
aagagcagccaaccataaccgcgca

SEQ ID NO: 47056 - DNA, 25 bp, Mus musculus
aagagcagccaagcataaccgcgca

SEQ ID NO: 47057 - DNA, 25 bp, Mus musculus
aagagcagccctatctcatgaggtt

SEQ ID NO: 47058 - DNA, 25 bp, Mus musculus
aagagcagccctttctcatgaggtt

SEQ ID NO: 47059 - DNA, 25 bp, Mus musculus
aagagcagcctcaacagctcaggtg

SEQ ID NO: 47060 - DNA, 25 bp, Mus musculus
aagagcagcctctacagctcaggtg

SEQ ID NO: 47061 - DNA, 25 bp, Mus musculus
aagagcagcgcacacagcacttcag

SEQ ID NO: 47062 - DNA, 25 bp, Mus musculus
aagagcagcgcagacagcacttcag

SEQ ID NO: 47063 - DNA, 25 bp, Mus musculus
aagagcagcgccctctgtcagcctg

SEQ ID NO: 47064 - DNA, 25 bp, Mus musculus
aagagcagcgccgtctgtcagcctg

SEQ ID NO: 47065 - DNA, 25 bp, Mus musculus
aagagcagcgtgatcatagcagcgt

SEQ ID NO: 47066 - DNA, 25 bp, Mus musculus
aagagcagcgtgttcatagcagcgt

SEQ ID NO: 47067 - DNA, 25 bp, Mus musculus
aagagcagcgttcctgagactggcc

SEQ ID NO: 47068 - DNA, 25 bp, Mus musculus
aagagcagcgttgctgagactggcc

SEQ ID NO: 47069 - DNA, 25 bp, Mus musculus
aagagcagctacagggcagtgttca

SEQ ID NO: 47070 - DNA, 25 bp, Mus musculus
aagagcagctactgggcagtgttca

SEQ ID NO: 47071 - DNA, 25 bp, Mus musculus
aagagcagctatatcctatttggga

SEQ ID NO: 47072 - DNA, 25 bp, Mus musculus
aagagcagctatttcctatttggga

SEQ ID NO: 47073 - DNA, 25 bp, Mus musculus
aagagcagctcaatggaatcccagt

SEQ ID NO: 47074 - DNA, 25 bp, Mus musculus
aagagcagctcattggaatcccagt

SEQ ID NO: 47075 - DNA, 25 bp, Mus musculus
aagagcagctctactgagtgactta

SEQ ID NO: 47076 - DNA, 25 bp, Mus musculus
aagagcagctcttctgagtgactta

SEQ ID NO: 47077 - DNA, 25 bp, Mus musculus
aagagcagctggcattgcccaccgg

SEQ ID NO: 47078 - DNA, 25 bp, Mus musculus
aagagcagctgggattgcccaccgg

SEQ ID NO: 47079 - DNA, 25 bp, Mus musculus
aagagcagctgtcacactcgagcca

SEQ ID NO: 47080 - DNA, 25 bp, Mus musculus
aagagcagctgtcatgagtttcata

SEQ ID NO: 47081 - DNA, 25 bp, Mus musculus
aagagcagctgtgacactcgagcca

SEQ ID NO: 47082 - DNA, 25 bp, Mus musculus
aagagcagctgtgatgagtttcata

SEQ ID NO: 47083 - DNA, 25 bp, Mus musculus
aagagcagcttcattccagcgagaa

SEQ ID NO: 47084 - DNA, 25 bp, Mus musculus
aagagcagcttctttccagcgagaa

SEQ ID NO: 47085 - DNA, 25 bp, Mus musculus
aagagcaggatgcattcttaacctc

SEQ ID NO: 47086 - DNA, 25 bp, Mus musculus
aagagcaggatggattcttaacctc

SEQ ID NO: 47087 - DNA, 25 bp, Mus musculus
aagagcaggccaaacgggaagagca

SEQ ID NO: 47088 - DNA, 25 bp, Mus musculus
aagagcaggccatacgggaagagca

SEQ ID NO: 47089 - DNA, 25 bp, Mus musculus
aagagcaggctgaggcgccactgca

SEQ ID NO: 47090 - DNA, 25 bp, Mus musculus
aagagcaggctgctatggccaccaa

SEQ ID NO: 47091 - DNA, 25 bp, Mus musculus
aagagcaggctggtatggccaccaa

SEQ ID NO: 47092 - DNA, 25 bp, Mus musculus
aagagcaggctgtggcgccactgca

SEQ ID NO: 47093 - DNA, 25 bp, Mus musculus
aagagcagggagctgagggtcaaca

SEQ ID NO: 47094 - DNA, 25 bp, Mus musculus
aagagcagggaggtgagggtcaaca

SEQ ID NO: 47095 - DNA, 25 bp, Mus musculus
aagagcaggtcacccgtgccaacca

SEQ ID NO: 47096 - DNA, 25 bp, Mus musculus
aagagcaggtcagccgtgccaacca

SEQ ID NO: 47097 - DNA, 25 bp, Mus musculus
aagagcaggtcgactcgttccaaga

SEQ ID NO: 47098 - DNA, 25 bp, Mus musculus
aagagcaggtcgtctcgttccaaga

SEQ ID NO: 47099 - DNA, 25 bp, Mus musculus
aagagcaggtggagtctaaggatac

SEQ ID NO: 47100 - DNA, 25 bp, Mus musculus
aagagcaggtggtgtctaaggatac

SEQ ID NO: 47101 - DNA, 25 bp, Mus musculus
aagagcaggtttcccagcatagtac

SEQ ID NO: 47102 - DNA, 25 bp, Mus musculus
aagagcaggtttgccagcatagtac

SEQ ID NO: 47103 - DNA, 25 bp, Mus musculus
aagagcagtgctatcacctaggaga

SEQ ID NO: 47104 - DNA, 25 bp, Mus musculus
aagagcagtgctttcacctaggaga

SEQ ID NO: 47105 - DNA, 25 bp, Mus musculus
aagagcagtggtatgccgggatcaa

SEQ ID NO: 47106 - DNA, 25 bp, Mus musculus
aagagcagtggtttgccgggatcaa

SEQ ID NO: 47107 - DNA, 25 bp, Mus musculus
aagagcagtgtcaggaaacatttcc

SEQ ID NO: 47108 - DNA, 25 bp, Mus musculus
aagagcagtgtctggaaacatttcc

SEQ ID NO: 47109 - DNA, 25 bp, Mus musculus
aagagcagttctatggcttgcccta

SEQ ID NO: 47110 - DNA, 25 bp, Mus musculus
aagagcagttctttggcttgcccta

SEQ ID NO: 47111 - DNA, 25 bp, Mus musculus
aagagcataaggatctgcacaccta

SEQ ID NO: 47112 - DNA, 25 bp, Mus musculus
aagagcataaggttctgcacaccta

SEQ ID NO: 47113 - DNA, 25 bp, Mus musculus
aagagcataccaagcctagcaggcc

SEQ ID NO: 47114 - DNA, 25 bp, Mus musculus
aagagcataccatgcctagcaggcc

SEQ ID NO: 47115 - DNA, 25 bp, Mus musculus
aagagcatagcactggccctagagc

SEQ ID NO: 47116 - DNA, 25 bp, Mus musculus
aagagcatagcagtggccctagagc

SEQ ID NO: 47117 - DNA, 25 bp, Mus musculus
aagagcatatgactctcactctctc

SEQ ID NO: 47118 - DNA, 25 bp, Mus musculus
aagagcatatgagtctcactctctc

SEQ ID NO: 47119 - DNA, 25 bp, Mus musculus
aagagcatcaatcggcaccaggcca

SEQ ID NO: 47120 - DNA, 25 bp, Mus musculus
aagagcatcaatgggcaccaggcca

SEQ ID NO: 47121 - DNA, 25 bp, Mus musculus
aagagcatcactaccaaatcctttt

SEQ ID NO: 47122 - DNA, 25 bp, Mus musculus
aagagcatcacttccaaatcctttt

SEQ ID NO: 47123 - DNA, 25 bp, Mus musculus
aagagcatccaacttgggtttgatt

SEQ ID NO: 47124 - DNA, 25 bp, Mus musculus
aagagcatccaagttgggtttgatt

SEQ ID NO: 47125 - DNA, 25 bp, Mus musculus
aagagcatccacacggttaatctag

SEQ ID NO: 47126 - DNA, 25 bp, Mus musculus
aagagcatccactcggttaatctag

SEQ ID NO: 47127 - DNA, 25 bp, Mus musculus
aagagcatcgcgagggttcgcactc

SEQ ID NO: 47128 - DNA, 25 bp, Mus musculus
aagagcatcgcgtgggttcgcactc

SEQ ID NO: 47129 - DNA, 25 bp, Mus musculus
aagagcatcgtccatgcggtgcaag

SEQ ID NO: 47130 - DNA, 25 bp, Mus musculus
aagagcatcgtcgatgcggtgcaag

SEQ ID NO: 47131 - DNA, 25 bp, Mus musculus
aagagcatctcactctgttccatca

SEQ ID NO: 47132 - DNA, 25 bp, Mus musculus
aagagcatctcagtctgttccatca

SEQ ID NO: 47133 - DNA, 25 bp, Mus musculus
aagagcatctgaacactggccagcc

SEQ ID NO: 47134 - DNA, 25 bp, Mus musculus
aagagcatctgatcactggccagcc

SEQ ID NO: 47135 - DNA, 25 bp, Mus musculus
aagagcatctggaccggattgcccc

SEQ ID NO: 47136 - DNA, 25 bp, Mus musculus
aagagcatctggtccggattgcccc

SEQ ID NO: 47137 - DNA, 25 bp, Mus musculus
aagagcatctttcgacatctgccct

SEQ ID NO: 47138 - DNA, 25 bp, Mus musculus
aagagcatctttggacatctgccct

SEQ ID NO: 47139 - DNA, 25 bp, Mus musculus
aagagcatgtctcttcgatcctggc

SEQ ID NO: 47140 - DNA, 25 bp, Mus musculus
aagagcatgtctgttcgatcctggc

SEQ ID NO: 47141 - DNA, 25 bp, Mus musculus
aagagcatgttgatcattcttttgc

SEQ ID NO: 47142 - DNA, 25 bp, Mus musculus
aagagcatgttgttcattcttttgc

SEQ ID NO: 47143 - DNA, 25 bp, Mus musculus
aagagcattaatccgtgaccacaca

SEQ ID NO: 47144 - DNA, 25 bp, Mus musculus
aagagcattaatgcgtgaccacaca

SEQ ID NO: 47145 - DNA, 25 bp, Mus musculus
aagagcattctcattgtcctgtgta

SEQ ID NO: 47146 - DNA, 25 bp, Mus musculus
aagagcattctctttgtcctgtgta

SEQ ID NO: 47147 - DNA, 25 bp, Mus musculus
aagagcattgcaaacctggtgttaa

SEQ ID NO: 47148 - DNA, 25 bp, Mus musculus
aagagcattgcatacctggtgttaa

SEQ ID NO: 47149 - DNA, 25 bp, Mus musculus
aagagcattgcccaccgatagaggt

SEQ ID NO: 47150 - DNA, 25 bp, Mus musculus
aagagcattgccgaccgatagaggt

SEQ ID NO: 47151 - DNA, 25 bp, Mus musculus
aagagcattgtaattcggagtataa

SEQ ID NO: 47152 - DNA, 25 bp, Mus musculus
aagagcattgtatttcggagtataa

SEQ ID NO: 47153 - DNA, 25 bp, Mus musculus
aagagcattgtgactccactggaaa

SEQ ID NO: 47154 - DNA, 25 bp, Mus musculus
aagagcattgtgtctccactggaaa

SEQ ID NO: 47155 - DNA, 25 bp, Mus musculus
aagagccaaaaccactccggacttg

SEQ ID NO: 47156 - DNA, 25 bp, Mus musculus
aagagccaaaacgactccggacttg

SEQ ID NO: 47157 - DNA, 25 bp, Mus musculus
aagagccaaaggagccacaggagcc

SEQ ID NO: 47158 - DNA, 25 bp, Mus musculus
aagagccaaaggtgccacaggagcc

SEQ ID NO: 47159 - DNA, 25 bp, Mus musculus
aagagccaagccagacttccaagct

SEQ ID NO: 47160 - DNA, 25 bp, Mus musculus
aagagccaagcctgacttccaagct

SEQ ID NO: 47161 - DNA, 25 bp, Mus musculus
aagagccaagctccaggacgggcac

SEQ ID NO: 47162 - DNA, 25 bp, Mus musculus
aagagccaagctgcaggacgggcac

SEQ ID NO: 47163 - DNA, 25 bp, Mus musculus
aagagccaagtacatatctcagact

SEQ ID NO: 47164 - DNA, 25 bp, Mus musculus
aagagccaagtagatatctcagact

SEQ ID NO: 47165 - DNA, 25 bp, Mus musculus
aagagccaagtgcagactccagtct

SEQ ID NO: 47166 - DNA, 25 bp, Mus musculus
aagagccaagtggagactccagtct

SEQ ID NO: 47167 - DNA, 25 bp, Mus musculus
aagagccaatatccatactcccctg

SEQ ID NO: 47168 - DNA, 25 bp, Mus musculus
aagagccaatatgcatactcccctg

SEQ ID NO: 47169 - DNA, 25 bp, Mus musculus
aagagccacacgcacttttagccac

SEQ ID NO: 47170 - DNA, 25 bp, Mus musculus
aagagccacacggacttttagccac

SEQ ID NO: 47171 - DNA, 25 bp, Mus musculus
aagagccacagccaggcagacactg

SEQ ID NO: 47172 - DNA, 25 bp, Mus musculus
aagagccacagcgaggcagacactg

SEQ ID NO: 47173 - DNA, 25 bp, Mus musculus
aagagccacattctcattgtactgg

SEQ ID NO: 47174 - DNA, 25 bp, Mus musculus
aagagccacattgtcattgtactgg

SEQ ID NO: 47175 - DNA, 25 bp, Mus musculus
aagagccaccagagccagtcagcgt

SEQ ID NO: 47176 - DNA, 25 bp, Mus musculus
aagagccaccagtgccagtcagcgt

SEQ ID NO: 47177 - DNA, 25 bp, Mus musculus
aagagccaccgcattcggtagtaat

SEQ ID NO: 47178 - DNA, 25 bp, Mus musculus
aagagccaccgctttcggtagtaat

SEQ ID NO: 47179 - DNA, 25 bp, Mus musculus
aagagccacggacaacatcacagcc

SEQ ID NO: 47180 - DNA, 25 bp, Mus musculus
aagagccacggagaacatcacagcc

SEQ ID NO: 47181 - DNA, 25 bp, Mus musculus
aagagccactgtacagttgattagt

SEQ ID NO: 47182 - DNA, 25 bp, Mus musculus
aagagccactgttcagttgattagt

SEQ ID NO: 47183 - DNA, 25 bp, Mus musculus
aagagccactttcaagctgcactga

SEQ ID NO: 47184 - DNA, 25 bp, Mus musculus
aagagccactttccagtaactgggc

SEQ ID NO: 47185 - DNA, 25 bp, Mus musculus
aagagccactttgaagctgcactga

SEQ ID NO: 47186 - DNA, 25 bp, Mus musculus
aagagccactttgcagtaactgggc

SEQ ID NO: 47187 - DNA, 25 bp, Mus musculus
aagagccagaaacgtggttcttcga

SEQ ID NO: 47188 - DNA, 25 bp, Mus musculus
aagagccagaaaggtggttcttcga

SEQ ID NO: 47189 - DNA, 25 bp, Mus musculus
aagagccagaagctatagcacccct

SEQ ID NO: 47190 - DNA, 25 bp, Mus musculus
aagagccagaaggtatagcacccct

SEQ ID NO: 47191 - DNA, 25 bp, Mus musculus
aagagccagactatgagacctacct

SEQ ID NO: 47192 - DNA, 25 bp, Mus musculus
aagagccagactttgagacctacct

SEQ ID NO: 47193 - DNA, 25 bp, Mus musculus
aagagccagcgactgcttgcataac

SEQ ID NO: 47194 - DNA, 25 bp, Mus musculus
aagagccagcgagtgcttgcataac

SEQ ID NO: 47195 - DNA, 25 bp, Mus musculus
aagagccaggcccaagcggcttatg

SEQ ID NO: 47196 - DNA, 25 bp, Mus musculus
aagagccaggccgaagcggcttatg

SEQ ID NO: 47197 - DNA, 25 bp, Mus musculus
aagagccaggtactacattttccct

SEQ ID NO: 47198 - DNA, 25 bp, Mus musculus
aagagccaggtagtacattttccct

SEQ ID NO: 47199 - DNA, 25 bp, Mus musculus
aagagccaggtcagacccagcagga

SEQ ID NO: 47200 - DNA, 25 bp, Mus musculus
aagagccaggtctgacccagcagga

SEQ ID NO: 47201 - DNA, 25 bp, Mus musculus
aagagccagtagagaatcccctcat

SEQ ID NO: 47202 - DNA, 25 bp, Mus musculus
aagagccagtagtgaatcccctcat

SEQ ID NO: 47203 - DNA, 25 bp, Mus musculus
aagagccataaaattcctgttagtg

SEQ ID NO: 47204 - DNA, 25 bp, Mus musculus
aagagccataaatttcctgttagtg

SEQ ID NO: 47205 - DNA, 25 bp, Mus musculus
aagagccatgagcaccattctgtgc

SEQ ID NO: 47206 - DNA, 25 bp, Mus musculus
aagagccatgaggaccattctgtgc

SEQ ID NO: 47207 - DNA, 25 bp, Mus musculus
aagagccatgtacactagaatcagt

SEQ ID NO: 47208 - DNA, 25 bp, Mus musculus
aagagccatgtagactagaatcagt

SEQ ID NO: 47209 - DNA, 25 bp, Mus musculus
aagagccatgtgcagttgtatgtct

SEQ ID NO: 47210 - DNA, 25 bp, Mus musculus
aagagccatgtggagttgtatgtct

SEQ ID NO: 47211 - DNA, 25 bp, Mus musculus
aagagccatgttaagtttctagcat

SEQ ID NO: 47212 - DNA, 25 bp, Mus musculus
aagagccatgtttagtttctagcat

SEQ ID NO: 47213 - DNA, 25 bp, Mus musculus
aagagccattcgaggtatctctgct

SEQ ID NO: 47214 - DNA, 25 bp, Mus musculus
aagagccattcgtggtatctctgct

SEQ ID NO: 47215 - DNA, 25 bp, Mus musculus
aagagccattggagcctatgttcac

SEQ ID NO: 47216 - DNA, 25 bp, Mus musculus
aagagccattggattttgagcagtg

SEQ ID NO: 47217 - DNA, 25 bp, Mus musculus
aagagccattggtgcctatgttcac

SEQ ID NO: 47218 - DNA, 25 bp, Mus musculus
aagagccattggtttttgagcagtg

SEQ ID NO: 47219 - DNA, 25 bp, Mus musculus
aagagccatttgagagccataggaa

SEQ ID NO: 47220 - DNA, 25 bp, Mus musculus
aagagccatttgtgagccataggaa

SEQ ID NO: 47221 - DNA, 25 bp, Mus musculus
aagagcccaactcttggcttactca

SEQ ID NO: 47222 - DNA, 25 bp, Mus musculus
aagagcccaactgttggcttactca

SEQ ID NO: 47223 - DNA, 25 bp, Mus musculus
aagagcccaccaaaggaggagctga

SEQ ID NO: 47224 - DNA, 25 bp, Mus musculus
aagagcccaccataggaggagctga

SEQ ID NO: 47225 - DNA, 25 bp, Mus musculus
aagagcccagagacctgtgctttgg

SEQ ID NO: 47226 - DNA, 25 bp, Mus musculus
aagagcccagagacgttcattgagt

SEQ ID NO: 47227 - DNA, 25 bp, Mus musculus
aagagcccagagtcctgtgctttgg

SEQ ID NO: 47228 - DNA, 25 bp, Mus musculus
aagagcccagagtcgttcattgagt

SEQ ID NO: 47229 - DNA, 25 bp, Mus musculus
aagagcccagcaaccatagacaaag

SEQ ID NO: 47230 - DNA, 25 bp, Mus musculus
aagagcccagcatccatagacaaag

SEQ ID NO: 47231 - DNA, 25 bp, Mus musculus
aagagcccaggtcctttatggcaga

SEQ ID NO: 47232 - DNA, 25 bp, Mus musculus
aagagcccaggtgctttatggcaga

SEQ ID NO: 47233 - DNA, 25 bp, Mus musculus
aagagcccagtccacaatgggcagt

SEQ ID NO: 47234 - DNA, 25 bp, Mus musculus
aagagcccagtcgacaatgggcagt

SEQ ID NO: 47235 - DNA, 25 bp, Mus musculus
aagagcccagtgacgttgtgaagat

SEQ ID NO: 47236 - DNA, 25 bp, Mus musculus
aagagcccagtgtcgttgtgaagat

SEQ ID NO: 47237 - DNA, 25 bp, Mus musculus
aagagcccatagcacagcacttatt

SEQ ID NO: 47238 - DNA, 25 bp, Mus musculus
aagagcccataggacagcacttatt

SEQ ID NO: 47239 - DNA, 25 bp, Mus musculus
aagagcccatcccagagtcaaagat

SEQ ID NO: 47240 - DNA, 25 bp, Mus musculus
aagagcccatccgagagtcaaagat

SEQ ID NO: 47241 - DNA, 25 bp, Mus musculus
aagagccccatcactgtggagtgga

SEQ ID NO: 47242 - DNA, 25 bp, Mus musculus
aagagccccatctctgtggagtgga

SEQ ID NO: 47243 - DNA, 25 bp, Mus musculus
aagagccccctcaggagggattcag

SEQ ID NO: 47244 - DNA, 25 bp, Mus musculus
aagagccccctctggagggattcag

SEQ ID NO: 47245 - DNA, 25 bp, Mus musculus
aagagcccctatctcactcaaagat

SEQ ID NO: 47246 - DNA, 25 bp, Mus musculus
aagagcccctatgtcactcaaagat

SEQ ID NO: 47247 - DNA, 25 bp, Mus musculus
aagagcccctgaaggcggtcagagt

SEQ ID NO: 47248 - DNA, 25 bp, Mus musculus
aagagcccctgatggcggtcagagt

SEQ ID NO: 47249 - DNA, 25 bp, Mus musculus
aagagccctaatcgctgcctaccaa

SEQ ID NO: 47250 - DNA, 25 bp, Mus musculus
aagagccctaatggctgcctaccaa

SEQ ID NO: 47251 - DNA, 25 bp, Mus musculus
aagagccctctgctcgagattgtag

SEQ ID NO: 47252 - DNA, 25 bp, Mus musculus
aagagccctctggtcgagattgtag

SEQ ID NO: 47253 - DNA, 25 bp, Mus musculus
aagagccctgaaacccacagcttgt

SEQ ID NO: 47254 - DNA, 25 bp, Mus musculus
aagagccctgaatcccacagcttgt

SEQ ID NO: 47255 - DNA, 25 bp, Mus musculus
aagagccctggcacaaactgggcca

SEQ ID NO: 47256 - DNA, 25 bp, Mus musculus
aagagccctggctcaaactgggcca

SEQ ID NO: 47257 - DNA, 25 bp, Mus musculus
aagagccctgggagatgaagacaga

SEQ ID NO: 47258 - DNA, 25 bp, Mus musculus
aagagccctgggtgatgaagacaga

SEQ ID NO: 47259 - DNA, 25 bp, Mus musculus
aagagccgaagcctgtaatagtcaa

SEQ ID NO: 47260 - DNA, 25 bp, Mus musculus
aagagccgaagcgtgtaatagtcaa

SEQ ID NO: 47261 - DNA, 25 bp, Mus musculus
aagagccgaatgattcgtgtccagt

SEQ ID NO: 47262 - DNA, 25 bp, Mus musculus
aagagccgaatgtttcgtgtccagt

SEQ ID NO: 47263 - DNA, 25 bp, Mus musculus
aagagccgacttaccggcattccac

SEQ ID NO: 47264 - DNA, 25 bp, Mus musculus
aagagccgactttccggcattccac

SEQ ID NO: 47265 - DNA, 25 bp, Mus musculus
aagagccgagccacttatagcctcc

SEQ ID NO: 47266 - DNA, 25 bp, Mus musculus
aagagccgagcctcttatagcctcc

SEQ ID NO: 47267 - DNA, 25 bp, Mus musculus
aagagccgatgcaggcttctttttt

SEQ ID NO: 47268 - DNA, 25 bp, Mus musculus
aagagccgatgctggcttctttttt

SEQ ID NO: 47269 - DNA, 25 bp, Mus musculus
aagagccgctgcaggaagcactgaa

SEQ ID NO: 47270 - DNA, 25 bp, Mus musculus
aagagccgctgctggaagcactgaa

SEQ ID NO: 47271 - DNA, 25 bp, Mus musculus
aagagccggcagcagtgatctgcat

SEQ ID NO: 47272 - DNA, 25 bp, Mus musculus
aagagccggcaggagtgatctgcat

SEQ ID NO: 47273 - DNA, 25 bp, Mus musculus
aagagccggctcacatgtttacagg

SEQ ID NO: 47274 - DNA, 25 bp, Mus musculus
aagagccggctctcatgtttacagg

SEQ ID NO: 47275 - DNA, 25 bp, Mus musculus
aagagccgtaacagactccatttct

SEQ ID NO: 47276 - DNA, 25 bp, Mus musculus
aagagccgtaactgactccatttct

SEQ ID NO: 47277 - DNA, 25 bp, Mus musculus
aagagccgtcggaagaacatgctga

SEQ ID NO: 47278 - DNA, 25 bp, Mus musculus
aagagccgtcggtagaacatgctga

SEQ ID NO: 47279 - DNA, 25 bp, Mus musculus
aagagccgtgttcttcaagctgggt

SEQ ID NO: 47280 - DNA, 25 bp, Mus musculus
aagagccgtgttgttcaagctgggt

SEQ ID NO: 47281 - DNA, 25 bp, Mus musculus
aagagcctactactgttcttcccgg

SEQ ID NO: 47282 - DNA, 25 bp, Mus musculus
aagagcctactagtgttcttcccgg

SEQ ID NO: 47283 - DNA, 25 bp, Mus musculus
aagagcctactcagagaccaccaag

SEQ ID NO: 47284 - DNA, 25 bp, Mus musculus
aagagcctactctgagaccaccaag

SEQ ID NO: 47285 - DNA, 25 bp, Mus musculus
aagagcctactgatcaagtctgtca

SEQ ID NO: 47286 - DNA, 25 bp, Mus musculus
aagagcctactgttcaagtctgtca

SEQ ID NO: 47287 - DNA, 25 bp, Mus musculus
aagagcctaggaacacaattgcaag

SEQ ID NO: 47288 - DNA, 25 bp, Mus musculus
aagagcctaggatcacaattgcaag

SEQ ID NO: 47289 - DNA, 25 bp, Mus musculus
aagagcctagtgaacctggctagaa

SEQ ID NO: 47290 - DNA, 25 bp, Mus musculus
aagagcctagtgtacctggctagaa

SEQ ID NO: 47291 - DNA, 25 bp, Mus musculus
aagagcctatacactgttgccaggg

SEQ ID NO: 47292 - DNA, 25 bp, Mus musculus
aagagcctatactctgttgccaggg

SEQ ID NO: 47293 - DNA, 25 bp, Mus musculus
aagagcctatgcagaaactaccaag

SEQ ID NO: 47294 - DNA, 25 bp, Mus musculus
aagagcctatgctgaaactaccaag

SEQ ID NO: 47295 - DNA, 25 bp, Mus musculus
aagagcctatttcccctagagctgt

SEQ ID NO: 47296 - DNA, 25 bp, Mus musculus
aagagcctatttgccctagagctgt

SEQ ID NO: 47297 - DNA, 25 bp, Mus musculus
aagagcctcagcctttcatttttgt

SEQ ID NO: 47298 - DNA, 25 bp, Mus musculus
aagagcctcagcgtttcatttttgt

SEQ ID NO: 47299 - DNA, 25 bp, Mus musculus
aagagcctcattctgtggatgtcac

SEQ ID NO: 47300 - DNA, 25 bp, Mus musculus
aagagcctcattgtgtggatgtcac

SEQ ID NO: 47301 - DNA, 25 bp, Mus musculus
aagagcctccagatgacgggaagca

SEQ ID NO: 47302 - DNA, 25 bp, Mus musculus
aagagcctccagttgacgggaagca

SEQ ID NO: 47303 - DNA, 25 bp, Mus musculus
aagagcctccctcgtgcaatgggaa

SEQ ID NO: 47304 - DNA, 25 bp, Mus musculus
aagagcctccctggtgcaatgggaa

SEQ ID NO: 47305 - DNA, 25 bp, Mus musculus
aagagcctcctacagatgttactcc

SEQ ID NO: 47306 - DNA, 25 bp, Mus musculus
aagagcctcctagagatgttactcc

SEQ ID NO: 47307 - DNA, 25 bp, Mus musculus
aagagcctcttaatatttcatttta

SEQ ID NO: 47308 - DNA, 25 bp, Mus musculus
aagagcctcttattatttcatttta

SEQ ID NO: 47309 - DNA, 25 bp, Mus musculus
aagagcctcttgactactctaagaa

SEQ ID NO: 47310 - DNA, 25 bp, Mus musculus
aagagcctcttgtctactctaagaa

SEQ ID NO: 47311 - DNA, 25 bp, Mus musculus
aagagcctgagactggtcgcttcca

SEQ ID NO: 47312 - DNA, 25 bp, Mus musculus
aagagcctgagagtggtcgcttcca

SEQ ID NO: 47313 - DNA, 25 bp, Mus musculus
aagagcctgagcctcaatgggatga

SEQ ID NO: 47314 - DNA, 25 bp, Mus musculus
aagagcctgagcgtcaatgggatga

SEQ ID NO: 47315 - DNA, 25 bp, Mus musculus
aagagcctgagtccccagggtcatc

SEQ ID NO: 47316 - DNA, 25 bp, Mus musculus
aagagcctgagtctcccaagggtcc

SEQ ID NO: 47317 - DNA, 25 bp, Mus musculus
aagagcctgagtgcccagggtcatc

SEQ ID NO: 47318 - DNA, 25 bp, Mus musculus
aagagcctgagtgtcccaagggtcc

SEQ ID NO: 47319 - DNA, 25 bp, Mus musculus
aagagcctgataatccttcatgtat

SEQ ID NO: 47320 - DNA, 25 bp, Mus musculus
aagagcctgatattccttcatgtat

SEQ ID NO: 47321 - DNA, 25 bp, Mus musculus
aagagcctgcttctgtatatgtgta

SEQ ID NO: 47322 - DNA, 25 bp, Mus musculus
aagagcctgcttgtgtatatgtgta

SEQ ID NO: 47323 - DNA, 25 bp, Mus musculus
aagagcctggaacctctgtgtgcca

SEQ ID NO: 47324 - DNA, 25 bp, Mus musculus
aagagcctggaagctctgtgtgcca

SEQ ID NO: 47325 - DNA, 25 bp, Mus musculus
aagagcctggaccatcacagagcta

SEQ ID NO: 47326 - DNA, 25 bp, Mus musculus
aagagcctggacgatcacagagcta

SEQ ID NO: 47327 - DNA, 25 bp, Mus musculus
aagagcctggagacattgccatcct

SEQ ID NO: 47328 - DNA, 25 bp, Mus musculus
aagagcctggagtcattgccatcct

SEQ ID NO: 47329 - DNA, 25 bp, Mus musculus
aagagcctgggtagataccgtccac

SEQ ID NO: 47330 - DNA, 25 bp, Mus musculus
aagagcctgggtatagtacagtcaa

SEQ ID NO: 47331 - DNA, 25 bp, Mus musculus
aagagcctgggttgataccgtccac

SEQ ID NO: 47332 - DNA, 25 bp, Mus musculus
aagagcctgggtttagtacagtcaa

SEQ ID NO: 47333 - DNA, 25 bp, Mus musculus
aagagcctggtaagatgtggtgcat

SEQ ID NO: 47334 - DNA, 25 bp, Mus musculus
aagagcctggtatgatgtggtgcat

SEQ ID NO: 47335 - DNA, 25 bp, Mus musculus
aagagcctgtagactgcctttagtc

SEQ ID NO: 47336 - DNA, 25 bp, Mus musculus
aagagcctgtagtctgcctttagtc

SEQ ID NO: 47337 - DNA, 25 bp, Mus musculus
aagagcctgtgacaggagcacatcc

SEQ ID NO: 47338 - DNA, 25 bp, Mus musculus
aagagcctgtgagaggagcacatcc

SEQ ID NO: 47339 - DNA, 25 bp, Mus musculus
aagagcctgtgtattcttgcagtag

SEQ ID NO: 47340 - DNA, 25 bp, Mus musculus
aagagcctgtgttttcttgcagtag

SEQ ID NO: 47341 - DNA, 25 bp, Mus musculus
aagagccttatgcagcagagcagac

SEQ ID NO: 47342 - DNA, 25 bp, Mus musculus
aagagccttatggagcagagcagac

SEQ ID NO: 47343 - DNA, 25 bp, Mus musculus
aagagccttgatattatctacatag

SEQ ID NO: 47344 - DNA, 25 bp, Mus musculus
aagagccttgattttatctacatag

SEQ ID NO: 47345 - DNA, 25 bp, Mus musculus
aagagccttgcacatctacgagata

SEQ ID NO: 47346 - DNA, 25 bp, Mus musculus
aagagccttgcagatctacgagata

SEQ ID NO: 47347 - DNA, 25 bp, Mus musculus
aagagccttggcaggttcatgccga

SEQ ID NO: 47348 - DNA, 25 bp, Mus musculus
aagagccttggctggttcatgccga

SEQ ID NO: 47349 - DNA, 25 bp, Mus musculus
aagagccttgttctgacttttcatg

SEQ ID NO: 47350 - DNA, 25 bp, Mus musculus
aagagccttgttgtgacttttcatg

SEQ ID NO: 47351 - DNA, 25 bp, Mus musculus
aagagcctttaaatgaccccaagag

SEQ ID NO: 47352 - DNA, 25 bp, Mus musculus
aagagcctttaattgaccccaagag

SEQ ID NO: 47353 - DNA, 25 bp, Mus musculus
aagagcctttacacattaagtcaac

SEQ ID NO: 47354 - DNA, 25 bp, Mus musculus
aagagcctttactcattaagtcaac

SEQ ID NO: 47355 - DNA, 25 bp, Mus musculus
aagagcctttcgaccagcttaagtt

SEQ ID NO: 47356 - DNA, 25 bp, Mus musculus
aagagcctttcgtccagcttaagtt

SEQ ID NO: 47357 - DNA, 25 bp, Mus musculus
aagagccttttaaaaggccagccag

SEQ ID NO: 47358 - DNA, 25 bp, Mus musculus
aagagccttttataaggccagccag

SEQ ID NO: 47359 - DNA, 25 bp, Mus musculus
aagagccttttgacacggatcagag

SEQ ID NO: 47360 - DNA, 25 bp, Mus musculus
aagagccttttgtcacggatcagag

SEQ ID NO: 47361 - DNA, 25 bp, Mus musculus
aagagcgaagttcccgagagaccca

SEQ ID NO: 47362 - DNA, 25 bp, Mus musculus
aagagcgaagttgccgagagaccca

SEQ ID NO: 47363 - DNA, 25 bp, Mus musculus
aagagcgaccttagtcctcaggaaa

SEQ ID NO: 47364 - DNA, 25 bp, Mus musculus
aagagcgacctttgtcctcaggaaa

SEQ ID NO: 47365 - DNA, 25 bp, Mus musculus
aagagcgagcttctcctgaaaggga

SEQ ID NO: 47366 - DNA, 25 bp, Mus musculus
aagagcgagcttgtcctgaaaggga

SEQ ID NO: 47367 - DNA, 25 bp, Mus musculus
aagagcgcacccagactgtgactga

SEQ ID NO: 47368 - DNA, 25 bp, Mus musculus
aagagcgcaccctgactgtgactga

SEQ ID NO: 47369 - DNA, 25 bp, Mus musculus
aagagcgcactcacgacattcttgt

SEQ ID NO: 47370 - DNA, 25 bp, Mus musculus
aagagcgcactctcgacattcttgt

SEQ ID NO: 47371 - DNA, 25 bp, Mus musculus
aagagcgcatagcaggatcatatca

SEQ ID NO: 47372 - DNA, 25 bp, Mus musculus
aagagcgcataggaggatcatatca

SEQ ID NO: 47373 - DNA, 25 bp, Mus musculus
aagagcgccatcaggacttcactca

SEQ ID NO: 47374 - DNA, 25 bp, Mus musculus
aagagcgccatctggacttcactca

SEQ ID NO: 47375 - DNA, 25 bp, Mus musculus
aagagcgcccatcaagcaggaccta

SEQ ID NO: 47376 - DNA, 25 bp, Mus musculus
aagagcgcccatgaagcaggaccta

SEQ ID NO: 47377 - DNA, 25 bp, Mus musculus
aagagcgcctcaccaaacagattgc

SEQ ID NO: 47378 - DNA, 25 bp, Mus musculus
aagagcgcctcagcaaacagattgc

SEQ ID NO: 47379 - DNA, 25 bp, Mus musculus
aagagcgcgtttcccagctgatgaa

SEQ ID NO: 47380 - DNA, 25 bp, Mus musculus
aagagcgcgtttgccagctgatgaa

SEQ ID NO: 47381 - DNA, 25 bp, Mus musculus
aagagcgctagcaggattcagagaa

SEQ ID NO: 47382 - DNA, 25 bp, Mus musculus
aagagcgctagctggattcagagaa

SEQ ID NO: 47383 - DNA, 25 bp, Mus musculus
aagagcgctggtagctccagcaaag

SEQ ID NO: 47384 - DNA, 25 bp, Mus musculus
aagagcgctggttgctccagcaaag

SEQ ID NO: 47385 - DNA, 25 bp, Mus musculus
aagagcggcggcagaaagcatccac

SEQ ID NO: 47386 - DNA, 25 bp, Mus musculus
aagagcggcggcatggctttgcctt

SEQ ID NO: 47387 - DNA, 25 bp, Mus musculus
aagagcggcggctgaaagcatccac

SEQ ID NO: 47388 - DNA, 25 bp, Mus musculus
aagagcggcggcttggctttgcctt

SEQ ID NO: 47389 - DNA, 25 bp, Mus musculus
aagagcggctccactccgggcagcg

SEQ ID NO: 47390 - DNA, 25 bp, Mus musculus
aagagcggctcctctccgggcagcg

SEQ ID NO: 47391 - DNA, 25 bp, Mus musculus
aagagcgggtgtccagtgccttaca

SEQ ID NO: 47392 - DNA, 25 bp, Mus musculus
aagagcgggtgtgcagtgccttaca

SEQ ID NO: 47393 - DNA, 25 bp, Mus musculus
aagagcgggttgagattcctggcac

SEQ ID NO: 47394 - DNA, 25 bp, Mus musculus
aagagcgggttgtgattcctggcac

SEQ ID NO: 47395 - DNA, 25 bp, Mus musculus
aagagcggtcagacctgaaaccaca

SEQ ID NO: 47396 - DNA, 25 bp, Mus musculus
aagagcggtcagtcctgaaaccaca

SEQ ID NO: 47397 - DNA, 25 bp, Mus musculus
aagagcggtcctagagccttagctg

SEQ ID NO: 47398 - DNA, 25 bp, Mus musculus
aagagcggtccttgagccttagctg

SEQ ID NO: 47399 - DNA, 25 bp, Mus musculus
aagagcggttgcatttaccagaaga

SEQ ID NO: 47400 - DNA, 25 bp, Mus musculus
aagagcggttgcttttaccagaaga

SEQ ID NO: 47401 - DNA, 25 bp, Mus musculus
aagagcgtacgtattattcctgatt

SEQ ID NO: 47402 - DNA, 25 bp, Mus musculus
aagagcgtacgttttattcctgatt

SEQ ID NO: 47403 - DNA, 25 bp, Mus musculus
aagagcgtcattctgtttgtttctg

SEQ ID NO: 47404 - DNA, 25 bp, Mus musculus
aagagcgtcattgtgtttgtttctg

SEQ ID NO: 47405 - DNA, 25 bp, Mus musculus
aagagcgtccgactttctagagaca

SEQ ID NO: 47406 - DNA, 25 bp, Mus musculus
aagagcgtccgagtttctagagaca

SEQ ID NO: 47407 - DNA, 25 bp, Mus musculus
aagagcgtcttgagagtctgaatat

SEQ ID NO: 47408 - DNA, 25 bp, Mus musculus
aagagcgtcttgtgagtctgaatat

SEQ ID NO: 47409 - DNA, 25 bp, Mus musculus
aagagcgtctttcggactgcagtct

SEQ ID NO: 47410 - DNA, 25 bp, Mus musculus
aagagcgtctttgggactgcagtct

SEQ ID NO: 47411 - DNA, 25 bp, Mus musculus
aagagcgtggatctcctcaatgcca

SEQ ID NO: 47412 - DNA, 25 bp, Mus musculus
aagagcgtggatgtcctcaatgcca

SEQ ID NO: 47413 - DNA, 25 bp, Mus musculus
aagagcgtggccaacccaggttctg

SEQ ID NO: 47414 - DNA, 25 bp, Mus musculus
aagagcgtggcctacccaggttctg

SEQ ID NO: 47415 - DNA, 25 bp, Mus musculus
aagagcgttaccagtgtgatgccca

SEQ ID NO: 47416 - DNA, 25 bp, Mus musculus
aagagcgttacctgtgtgatgccca

SEQ ID NO: 47417 - DNA, 25 bp, Mus musculus
aagagcgtttgtatgctctggcggt

SEQ ID NO: 47418 - DNA, 25 bp, Mus musculus
aagagcgtttgtttgctctggcggt

SEQ ID NO: 47419 - DNA, 25 bp, Mus musculus
aagagctaaagtacctgacaccagt

SEQ ID NO: 47420 - DNA, 25 bp, Mus musculus
aagagctaaagttcctgacaccagt

SEQ ID NO: 47421 - DNA, 25 bp, Mus musculus
aagagctaagaacagcctgctgcaa

SEQ ID NO: 47422 - DNA, 25 bp, Mus musculus
aagagctaagaagagcctgctgcaa

SEQ ID NO: 47423 - DNA, 25 bp, Mus musculus
aagagctaaggcagttcgcgcccag

SEQ ID NO: 47424 - DNA, 25 bp, Mus musculus
aagagctaaggctgttcgcgcccag

SEQ ID NO: 47425 - DNA, 25 bp, Mus musculus
aagagctaaggtattgtgtcatcac

SEQ ID NO: 47426 - DNA, 25 bp, Mus musculus
aagagctaaggttttgtgtcatcac

SEQ ID NO: 47427 - DNA, 25 bp, Mus musculus
aagagctaagtacgacctcactgta

SEQ ID NO: 47428 - DNA, 25 bp, Mus musculus
aagagctaagtaggacctcactgta

SEQ ID NO: 47429 - DNA, 25 bp, Mus musculus
aagagctaagtgaagaccccattgt

SEQ ID NO: 47430 - DNA, 25 bp, Mus musculus
aagagctaagtgtagaccccattgt

SEQ ID NO: 47431 - DNA, 25 bp, Mus musculus
aagagctacccgcttcatagttact

SEQ ID NO: 47432 - DNA, 25 bp, Mus musculus
aagagctacccggttcatagttact

SEQ ID NO: 47433 - DNA, 25 bp, Mus musculus
aagagctacgaccagcagagcgagc

SEQ ID NO: 47434 - DNA, 25 bp, Mus musculus
aagagctacgacgagcagagcgagc

SEQ ID NO: 47435 - DNA, 25 bp, Mus musculus
aagagctactatactagtcatacaa

SEQ ID NO: 47436 - DNA, 25 bp, Mus musculus
aagagctactattctagtcatacaa

SEQ ID NO: 47437 - DNA, 25 bp, Mus musculus
aagagctagaaaagcctccaggcag

SEQ ID NO: 47438 - DNA, 25 bp, Mus musculus
aagagctagaaatgcctccaggcag

SEQ ID NO: 47439 - DNA, 25 bp, Mus musculus
aagagctagaatccctgggctcggt

SEQ ID NO: 47440 - DNA, 25 bp, Mus musculus
aagagctagaatgcctgggctcggt

SEQ ID NO: 47441 - DNA, 25 bp, Mus musculus
aagagctagcgacagttttcagaaa

SEQ ID NO: 47442 - DNA, 25 bp, Mus musculus
aagagctagcgagagttttcagaaa

SEQ ID NO: 47443 - DNA, 25 bp, Mus musculus
aagagctagcggagctggctaaccg

SEQ ID NO: 47444 - DNA, 25 bp, Mus musculus
aagagctagcggtgctggctaaccg

SEQ ID NO: 47445 - DNA, 25 bp, Mus musculus
aagagctaggacatgcctgattcgc

SEQ ID NO: 47446 - DNA, 25 bp, Mus musculus
aagagctaggacttgcctgattcgc

SEQ ID NO: 47447 - DNA, 25 bp, Mus musculus
aagagctatatgatttgtttttcta

SEQ ID NO: 47448 - DNA, 25 bp, Mus musculus
aagagctatatgttttgtttttcta

SEQ ID NO: 47449 - DNA, 25 bp, Mus musculus
aagagctatcctattatcccttttc

SEQ ID NO: 47450 - DNA, 25 bp, Mus musculus
aagagctatccttttatcccttttc

SEQ ID NO: 47451 - DNA, 25 bp, Mus musculus
aagagctatctcagcctaaaggact

SEQ ID NO: 47452 - DNA, 25 bp, Mus musculus
aagagctatctctgcctaaaggact

SEQ ID NO: 47453 - DNA, 25 bp, Mus musculus
aagagctatgctccagttgcatgat

SEQ ID NO: 47454 - DNA, 25 bp, Mus musculus
aagagctatgctgcagttgcatgat

SEQ ID NO: 47455 - DNA, 25 bp, Mus musculus
aagagctatgtgaatggccccatcc

SEQ ID NO: 47456 - DNA, 25 bp, Mus musculus
aagagctatgtgtatggccccatcc

SEQ ID NO: 47457 - DNA, 25 bp, Mus musculus
aagagctatttcagcgactgtcgct

SEQ ID NO: 47458 - DNA, 25 bp, Mus musculus
aagagctatttctgcgactgtcgct

SEQ ID NO: 47459 - DNA, 25 bp, Mus musculus
aagagctattttaagctatcttcag

SEQ ID NO: 47460 - DNA, 25 bp, Mus musculus
aagagctatttttagctatcttcag

SEQ ID NO: 47461 - DNA, 25 bp, Mus musculus
aagagctcacacatccgaggcggaa

SEQ ID NO: 47462 - DNA, 25 bp, Mus musculus
aagagctcacacttccgaggcggaa

SEQ ID NO: 47463 - DNA, 25 bp, Mus musculus
aagagctcagaaccactctctccga

SEQ ID NO: 47464 - DNA, 25 bp, Mus musculus
aagagctcagaagcactctctccga

SEQ ID NO: 47465 - DNA, 25 bp, Mus musculus
aagagctcagacacccttggttaag

SEQ ID NO: 47466 - DNA, 25 bp, Mus musculus
aagagctcagactcccttggttaag

SEQ ID NO: 47467 - DNA, 25 bp, Mus musculus
aagagctcagctcagttccaagcac

SEQ ID NO: 47468 - DNA, 25 bp, Mus musculus
aagagctcagctgagttccaagcac

SEQ ID NO: 47469 - DNA, 25 bp, Mus musculus
aagagctcagtgaggctgcagccgc

SEQ ID NO: 47470 - DNA, 25 bp, Mus musculus
aagagctcagtgtggctgcagccgc

SEQ ID NO: 47471 - DNA, 25 bp, Mus musculus
aagagctccagtaacatgggtgaaa

SEQ ID NO: 47472 - DNA, 25 bp, Mus musculus
aagagctccagttacatgggtgaaa

SEQ ID NO: 47473 - DNA, 25 bp, Mus musculus
aagagctcccctctgtggctgtacg

SEQ ID NO: 47474 - DNA, 25 bp, Mus musculus
aagagctcccctgtgtggctgtacg

SEQ ID NO: 47475 - DNA, 25 bp, Mus musculus
aagagctcccttctcttcacggcag

SEQ ID NO: 47476 - DNA, 25 bp, Mus musculus
aagagctcccttgtcttcacggcag

SEQ ID NO: 47477 - DNA, 25 bp, Mus musculus
aagagctccgagatgacttacaaga

SEQ ID NO: 47478 - DNA, 25 bp, Mus musculus
aagagctccgagttgacttacaaga

SEQ ID NO: 47479 - DNA, 25 bp, Mus musculus
aagagctcctagcacctctccaatg

SEQ ID NO: 47480 - DNA, 25 bp, Mus musculus
aagagctcctaggacctctccaatg

SEQ ID NO: 47481 - DNA, 25 bp, Mus musculus
aagagctcctgcagagaggccgatg

SEQ ID NO: 47482 - DNA, 25 bp, Mus musculus
aagagctcctgccatgagctgggac

SEQ ID NO: 47483 - DNA, 25 bp, Mus musculus
aagagctcctgcgatgagctgggac

SEQ ID NO: 47484 - DNA, 25 bp, Mus musculus
aagagctcctgctgagaggccgatg

SEQ ID NO: 47485 - DNA, 25 bp, Mus musculus
aagagctcgaggcttcttaccttat

SEQ ID NO: 47486 - DNA, 25 bp, Mus musculus
aagagctcgagggttcttaccttat

SEQ ID NO: 47487 - DNA, 25 bp, Mus musculus
aagagctcggctcgaactgcacttc

SEQ ID NO: 47488 - DNA, 25 bp, Mus musculus
aagagctcggctggaactgcacttc

SEQ ID NO: 47489 - DNA, 25 bp, Mus musculus
aagagctcgtacatctgactgtggc

SEQ ID NO: 47490 - DNA, 25 bp, Mus musculus
aagagctcgtacttctgactgtggc

SEQ ID NO: 47491 - DNA, 25 bp, Mus musculus
aagagctcgtgtctgaacatcctgg

SEQ ID NO: 47492 - DNA, 25 bp, Mus musculus
aagagctcgtgtgtgaacatcctgg

SEQ ID NO: 47493 - DNA, 25 bp, Mus musculus
aagagctctaagaggtgccggccag

SEQ ID NO: 47494 - DNA, 25 bp, Mus musculus
aagagctctaagtggtgccggccag

SEQ ID NO: 47495 - DNA, 25 bp, Mus musculus
aagagctctaatatgctctccctta

SEQ ID NO: 47496 - DNA, 25 bp, Mus musculus
aagagctctaatctgtaacacttcc

SEQ ID NO: 47497 - DNA, 25 bp, Mus musculus
aagagctctaatgtgtaacacttcc

SEQ ID NO: 47498 - DNA, 25 bp, Mus musculus
aagagctctaatttgctctccctta

SEQ ID NO: 47499 - DNA, 25 bp, Mus musculus
aagagctctctacatgtgctgtcat

SEQ ID NO: 47500 - DNA, 25 bp, Mus musculus
aagagctctctagatgtgctgtcat

SEQ ID NO: 47501 - DNA, 25 bp, Mus musculus
aagagctctctgcagggtcttgaca

SEQ ID NO: 47502 - DNA, 25 bp, Mus musculus
aagagctctctgctatggcaagtcc

SEQ ID NO: 47503 - DNA, 25 bp, Mus musculus
aagagctctctggagggtcttgaca

SEQ ID NO: 47504 - DNA, 25 bp, Mus musculus
aagagctctctggtatggcaagtcc

SEQ ID NO: 47505 - DNA, 25 bp, Mus musculus
aagagctctgaaaatccagtgtctt

SEQ ID NO: 47506 - DNA, 25 bp, Mus musculus
aagagctctgaatatccagtgtctt

SEQ ID NO: 47507 - DNA, 25 bp, Mus musculus
aagagctctgaccaggcctgaagat

SEQ ID NO: 47508 - DNA, 25 bp, Mus musculus
aagagctctgacgaggcctgaagat

SEQ ID NO: 47509 - DNA, 25 bp, Mus musculus
aagagctctgccaggcttagaactc

SEQ ID NO: 47510 - DNA, 25 bp, Mus musculus
aagagctctgcctggcttagaactc

SEQ ID NO: 47511 - DNA, 25 bp, Mus musculus
aagagctctggccatgattccaagc

SEQ ID NO: 47512 - DNA, 25 bp, Mus musculus
aagagctctggcctagggttcatcc

SEQ ID NO: 47513 - DNA, 25 bp, Mus musculus
aagagctctggcgatgattccaagc

SEQ ID NO: 47514 - DNA, 25 bp, Mus musculus
aagagctctggcgtagggttcatcc

SEQ ID NO: 47515 - DNA, 25 bp, Mus musculus
aagagctcttctattcatacacggc

SEQ ID NO: 47516 - DNA, 25 bp, Mus musculus
aagagctcttcttttcatacacggc

SEQ ID NO: 47517 - DNA, 25 bp, Mus musculus
aagagctctttccttccacgtgatc

SEQ ID NO: 47518 - DNA, 25 bp, Mus musculus
aagagctctttcgttccacgtgatc

SEQ ID NO: 47519 - DNA, 25 bp, Mus musculus
aagagctgaaggagggtgcgcccct

SEQ ID NO: 47520 - DNA, 25 bp, Mus musculus
aagagctgaaggtgggtgcgcccct

SEQ ID NO: 47521 - DNA, 25 bp, Mus musculus
aagagctgaatcatcttggagcata

SEQ ID NO: 47522 - DNA, 25 bp, Mus musculus
aagagctgaatcttcttggagcata

SEQ ID NO: 47523 - DNA, 25 bp, Mus musculus
aagagctgacacctcacacagaggg

SEQ ID NO: 47524 - DNA, 25 bp, Mus musculus
aagagctgacacgtcacacagaggg

SEQ ID NO: 47525 - DNA, 25 bp, Mus musculus
aagagctgagccacggtgtgttcgc

SEQ ID NO: 47526 - DNA, 25 bp, Mus musculus
aagagctgagcctcggtgtgttcgc

SEQ ID NO: 47527 - DNA, 25 bp, Mus musculus
aagagctgagctatccatagacgat

SEQ ID NO: 47528 - DNA, 25 bp, Mus musculus
aagagctgagctttccatagacgat

SEQ ID NO: 47529 - DNA, 25 bp, Mus musculus
aagagctgaggcagacagtctcact

SEQ ID NO: 47530 - DNA, 25 bp, Mus musculus
aagagctgaggctgacagtctcact

SEQ ID NO: 47531 - DNA, 25 bp, Mus musculus
aagagctgagtactggccaagacgt

SEQ ID NO: 47532 - DNA, 25 bp, Mus musculus
aagagctgagtagtggccaagacgt

SEQ ID NO: 47533 - DNA, 25 bp, Mus musculus
aagagctgattcagctccgccaaga

SEQ ID NO: 47534 - DNA, 25 bp, Mus musculus
aagagctgattctgctccgccaaga

SEQ ID NO: 47535 - DNA, 25 bp, Mus musculus
aagagctgatttcccctttagaaat

SEQ ID NO: 47536 - DNA, 25 bp, Mus musculus
aagagctgatttgccctttagaaat

SEQ ID NO: 47537 - DNA, 25 bp, Mus musculus
aagagctgcaagacggagaccacac

SEQ ID NO: 47538 - DNA, 25 bp, Mus musculus
aagagctgcaagtcggagaccacac

SEQ ID NO: 47539 - DNA, 25 bp, Mus musculus
aagagctgcacgctttccattaact

SEQ ID NO: 47540 - DNA, 25 bp, Mus musculus
aagagctgcacggtttccattaact

SEQ ID NO: 47541 - DNA, 25 bp, Mus musculus
aagagctgcagtctttgtgggacaa

SEQ ID NO: 47542 - DNA, 25 bp, Mus musculus
aagagctgcagtgtttgtgggacaa

SEQ ID NO: 47543 - DNA, 25 bp, Mus musculus
aagagctgcatgacagcccacgcga

SEQ ID NO: 47544 - DNA, 25 bp, Mus musculus
aagagctgcatgagaaatttgaccg

SEQ ID NO: 47545 - DNA, 25 bp, Mus musculus
aagagctgcatgtcagcccacgcga

SEQ ID NO: 47546 - DNA, 25 bp, Mus musculus
aagagctgcatgtgaaatttgaccg

SEQ ID NO: 47547 - DNA, 25 bp, Mus musculus
aagagctgcccaagttttgagaaca

SEQ ID NO: 47548 - DNA, 25 bp, Mus musculus
aagagctgcccatgttttgagaaca

SEQ ID NO: 47549 - DNA, 25 bp, Mus musculus
aagagctgcctgagaatctaaatgt

SEQ ID NO: 47550 - DNA, 25 bp, Mus musculus
aagagctgcctgtgaatctaaatgt

SEQ ID NO: 47551 - DNA, 25 bp, Mus musculus
aagagctgccttcccttgtagagca

SEQ ID NO: 47552 - DNA, 25 bp, Mus musculus
aagagctgccttgccttgtagagca

SEQ ID NO: 47553 - DNA, 25 bp, Mus musculus
aagagctgcgtcatcacctacctgg

SEQ ID NO: 47554 - DNA, 25 bp, Mus musculus
aagagctgcgtcttcacctacctgg

SEQ ID NO: 47555 - DNA, 25 bp, Mus musculus
aagagctgctctagcaatctttttt

SEQ ID NO: 47556 - DNA, 25 bp, Mus musculus
aagagctgctcttgcaatctttttt

SEQ ID NO: 47557 - DNA, 25 bp, Mus musculus
aagagctgctgcagaaaagctattt

SEQ ID NO: 47558 - DNA, 25 bp, Mus musculus
aagagctgctgcctcgctatgaaaa

SEQ ID NO: 47559 - DNA, 25 bp, Mus musculus
aagagctgctgcgtcgctatgaaaa

SEQ ID NO: 47560 - DNA, 25 bp, Mus musculus
aagagctgctgctgaaaagctattt

SEQ ID NO: 47561 - DNA, 25 bp, Mus musculus
aagagctgctggactttaccaactg

SEQ ID NO: 47562 - DNA, 25 bp, Mus musculus
aagagctgctggtctttaccaactg

SEQ ID NO: 47563 - DNA, 25 bp, Mus musculus
aagagctgcttaactgggcttcagt

SEQ ID NO: 47564 - DNA, 25 bp, Mus musculus
aagagctgcttatctgggcttcagt

SEQ ID NO: 47565 - DNA, 25 bp, Mus musculus
aagagctgctttagcttctaccaac

SEQ ID NO: 47566 - DNA, 25 bp, Mus musculus
aagagctgcttttgcttctaccaac

SEQ ID NO: 47567 - DNA, 25 bp, Mus musculus
aagagctggacacgatctgtcccaa

SEQ ID NO: 47568 - DNA, 25 bp, Mus musculus
aagagctggacaggatctgtcccaa

SEQ ID NO: 47569 - DNA, 25 bp, Mus musculus
aagagctggacgactcactccagaa

SEQ ID NO: 47570 - DNA, 25 bp, Mus musculus
aagagctggacgtctcactccagaa

SEQ ID NO: 47571 - DNA, 25 bp, Mus musculus
aagagctggagccactgattcccat

SEQ ID NO: 47572 - DNA, 25 bp, Mus musculus
aagagctggagcgactgattcccat

SEQ ID NO: 47573 - DNA, 25 bp, Mus musculus
aagagctggccaacatgcacagcat

SEQ ID NO: 47574 - DNA, 25 bp, Mus musculus
aagagctggccatcatgcacagcat

SEQ ID NO: 47575 - DNA, 25 bp, Mus musculus
aagagctggtacagggaggcctaaa

SEQ ID NO: 47576 - DNA, 25 bp, Mus musculus
aagagctggtactgggaggcctaaa

SEQ ID NO: 47577 - DNA, 25 bp, Mus musculus
aagagctggtgtccggactgcgtgg

SEQ ID NO: 47578 - DNA, 25 bp, Mus musculus
aagagctggtgtgcggactgcgtgg

SEQ ID NO: 47579 - DNA, 25 bp, Mus musculus
aagagctggttcagaggaagccctg

SEQ ID NO: 47580 - DNA, 25 bp, Mus musculus
aagagctggttctgaggaagccctg

SEQ ID NO: 47581 - DNA, 25 bp, Mus musculus
aagagctgtatactcctctacctag

SEQ ID NO: 47582 - DNA, 25 bp, Mus musculus
aagagctgtatagtcctctacctag

SEQ ID NO: 47583 - DNA, 25 bp, Mus musculus
aagagctgtcacaaaaaggagaggt

SEQ ID NO: 47584 - DNA, 25 bp, Mus musculus
aagagctgtcactaaaaggagaggt

SEQ ID NO: 47585 - DNA, 25 bp, Mus musculus
aagagctgtcagagttttacccagt

SEQ ID NO: 47586 - DNA, 25 bp, Mus musculus
aagagctgtcagtgttttacccagt

SEQ ID NO: 47587 - DNA, 25 bp, Mus musculus
aagagctgtccacttacggtatgct

SEQ ID NO: 47588 - DNA, 25 bp, Mus musculus
aagagctgtccagttacggtatgct

SEQ ID NO: 47589 - DNA, 25 bp, Mus musculus
aagagctgtctaccggcctctgcag

SEQ ID NO: 47590 - DNA, 25 bp, Mus musculus
aagagctgtctagcggcctctgcag

SEQ ID NO: 47591 - DNA, 25 bp, Mus musculus
aagagctgtctcacatattaagtga

SEQ ID NO: 47592 - DNA, 25 bp, Mus musculus
aagagctgtctctcatattaagtga

SEQ ID NO: 47593 - DNA, 25 bp, Mus musculus
aagagctgtgtacgcctcatgttgg

SEQ ID NO: 47594 - DNA, 25 bp, Mus musculus
aagagctgtgtaggcctcatgttgg

SEQ ID NO: 47595 - DNA, 25 bp, Mus musculus
aagagctgtgtcagcggttcatgcg

SEQ ID NO: 47596 - DNA, 25 bp, Mus musculus
aagagctgtgtctgcggttcatgcg

SEQ ID NO: 47597 - DNA, 25 bp, Mus musculus
aagagctgttatagctagcatagta

SEQ ID NO: 47598 - DNA, 25 bp, Mus musculus
aagagctgttattgctagcatagta

SEQ ID NO: 47599 - DNA, 25 bp, Mus musculus
aagagctgttccactccaaagctgt

SEQ ID NO: 47600 - DNA, 25 bp, Mus musculus
aagagctgttccatttgtgtgacct

SEQ ID NO: 47601 - DNA, 25 bp, Mus musculus
aagagctgttcctctccaaagctgt

SEQ ID NO: 47602 - DNA, 25 bp, Mus musculus
aagagctgttccttttgtgtgacct

SEQ ID NO: 47603 - DNA, 25 bp, Mus musculus
aagagctgttctattccgttctgct

SEQ ID NO: 47604 - DNA, 25 bp, Mus musculus
aagagctgttcttttccgttctgct

SEQ ID NO: 47605 - DNA, 25 bp, Mus musculus
aagagctgttgaacctccatgacct

SEQ ID NO: 47606 - DNA, 25 bp, Mus musculus
aagagctgttgatcctccatgacct

SEQ ID NO: 47607 - DNA, 25 bp, Mus musculus
aagagctgtttgcagtttttcagat

SEQ ID NO: 47608 - DNA, 25 bp, Mus musculus
aagagctgtttggagtttttcagat

SEQ ID NO: 47609 - DNA, 25 bp, Mus musculus
aagagcttagaaatcctaagtgcat

SEQ ID NO: 47610 - DNA, 25 bp, Mus musculus
aagagcttagaattcctaagtgcat

SEQ ID NO: 47611 - DNA, 25 bp, Mus musculus
aagagcttagccaggcctgtcaaac

SEQ ID NO: 47612 - DNA, 25 bp, Mus musculus
aagagcttagcctggcctgtcaaac

SEQ ID NO: 47613 - DNA, 25 bp, Mus musculus
aagagcttagctacaccagtgatat

SEQ ID NO: 47614 - DNA, 25 bp, Mus musculus
aagagcttagcttcaccagtgatat

SEQ ID NO: 47615 - DNA, 25 bp, Mus musculus
aagagcttagtgaccgggcctgaca

SEQ ID NO: 47616 - DNA, 25 bp, Mus musculus
aagagcttagtgtccgggcctgaca

SEQ ID NO: 47617 - DNA, 25 bp, Mus musculus
aagagcttatcactgtttttcacat

SEQ ID NO: 47618 - DNA, 25 bp, Mus musculus
aagagcttatcagtgtttttcacat

SEQ ID NO: 47619 - DNA, 25 bp, Mus musculus
aagagcttcaacaggaatgagtgtt

SEQ ID NO: 47620 - DNA, 25 bp, Mus musculus
aagagcttcaactggaatgagtgtt

SEQ ID NO: 47621 - DNA, 25 bp, Mus musculus
aagagcttcagccattgtccgtggt

SEQ ID NO: 47622 - DNA, 25 bp, Mus musculus
aagagcttcagcgattgtccgtggt

SEQ ID NO: 47623 - DNA, 25 bp, Mus musculus
aagagcttcaggacttatgccgaca

SEQ ID NO: 47624 - DNA, 25 bp, Mus musculus
aagagcttcaggtcttatgccgaca

SEQ ID NO: 47625 - DNA, 25 bp, Mus musculus
aagagcttcattagtgtcatcccct

SEQ ID NO: 47626 - DNA, 25 bp, Mus musculus
aagagcttcatttgtgtcatcccct

SEQ ID NO: 47627 - DNA, 25 bp, Mus musculus
aagagcttccaacggcagcttttcc

SEQ ID NO: 47628 - DNA, 25 bp, Mus musculus
aagagcttccaagggcagcttttcc

SEQ ID NO: 47629 - DNA, 25 bp, Mus musculus
aagagcttccagacctctgactggc

SEQ ID NO: 47630 - DNA, 25 bp, Mus musculus
aagagcttccagtcctctgactggc

SEQ ID NO: 47631 - DNA, 25 bp, Mus musculus
aagagcttcccacccttaagtagaa

SEQ ID NO: 47632 - DNA, 25 bp, Mus musculus
aagagcttcccagccttaagtagaa

SEQ ID NO: 47633 - DNA, 25 bp, Mus musculus
aagagcttcctcagccacggagagt

SEQ ID NO: 47634 - DNA, 25 bp, Mus musculus
aagagcttcctctgccacggagagt

SEQ ID NO: 47635 - DNA, 25 bp, Mus musculus
aagagcttcctgatctttggtagaa

SEQ ID NO: 47636 - DNA, 25 bp, Mus musculus
aagagcttcctgttctttggtagaa

SEQ ID NO: 47637 - DNA, 25 bp, Mus musculus
aagagcttcgacatccttgtcaaat

SEQ ID NO: 47638 - DNA, 25 bp, Mus musculus
aagagcttcgacttccttgtcaaat

SEQ ID NO: 47639 - DNA, 25 bp, Mus musculus
aagagcttcgccaggatccacgaaa

SEQ ID NO: 47640 - DNA, 25 bp, Mus musculus
aagagcttcgcctggatccacgaaa

SEQ ID NO: 47641 - DNA, 25 bp, Mus musculus
aagagcttcggcaattccaggaatg

SEQ ID NO: 47642 - DNA, 25 bp, Mus musculus
aagagcttcggctattccaggaatg

SEQ ID NO: 47643 - DNA, 25 bp, Mus musculus
aagagcttctcaaccttgcgaacag

SEQ ID NO: 47644 - DNA, 25 bp, Mus musculus
aagagcttctcatccttgcgaacag

SEQ ID NO: 47645 - DNA, 25 bp, Mus musculus
aagagcttctgtaccacagtatcca

SEQ ID NO: 47646 - DNA, 25 bp, Mus musculus
aagagcttctgttccacagtatcca

SEQ ID NO: 47647 - DNA, 25 bp, Mus musculus
aagagcttgccaagggccgagctgt

SEQ ID NO: 47648 - DNA, 25 bp, Mus musculus
aagagcttgccacttcagccaagtt

SEQ ID NO: 47649 - DNA, 25 bp, Mus musculus
aagagcttgccagttcagccaagtt

SEQ ID NO: 47650 - DNA, 25 bp, Mus musculus
aagagcttgccatgggccgagctgt

SEQ ID NO: 47651 - DNA, 25 bp, Mus musculus
aagagcttgctcaatgtcagccgga

SEQ ID NO: 47652 - DNA, 25 bp, Mus musculus
aagagcttgctcagatctgtgactt

SEQ ID NO: 47653 - DNA, 25 bp, Mus musculus
aagagcttgctctatgtcagccgga

SEQ ID NO: 47654 - DNA, 25 bp, Mus musculus
aagagcttgctctgatctgtgactt

SEQ ID NO: 47655 - DNA, 25 bp, Mus musculus
aagagcttggaacaaactacaggaa

SEQ ID NO: 47656 - DNA, 25 bp, Mus musculus
aagagcttggaagaaactacaggaa

SEQ ID NO: 47657 - DNA, 25 bp, Mus musculus
aagagctttagcagtcagtgagcag

SEQ ID NO: 47658 - DNA, 25 bp, Mus musculus
aagagctttagctgtcagtgagcag

SEQ ID NO: 47659 - DNA, 25 bp, Mus musculus
aagagctttaggaactggccacggc

SEQ ID NO: 47660 - DNA, 25 bp, Mus musculus
aagagctttaggtactggccacggc

SEQ ID NO: 47661 - DNA, 25 bp, Mus musculus
aagagctttcagacagtgctggtga

SEQ ID NO: 47662 - DNA, 25 bp, Mus musculus
aagagctttcagtcagtgctggtga

SEQ ID NO: 47663 - DNA, 25 bp, Mus musculus
aagagctttgcccatcactgtgggt

SEQ ID NO: 47664 - DNA, 25 bp, Mus musculus
aagagctttgccgatcactgtgggt

SEQ ID NO: 47665 - DNA, 25 bp, Mus musculus
aagagctttgtcaactccatctgtt

SEQ ID NO: 47666 - DNA, 25 bp, Mus musculus
aagagctttgtctactccatctgtt

SEQ ID NO: 47667 - DNA, 25 bp, Mus musculus
aagagcttttctctgtattcatgtg

SEQ ID NO: 47668 - DNA, 25 bp, Mus musculus
aagagcttttctgtgtattcatgtg

SEQ ID NO: 47669 - DNA, 25 bp, Mus musculus
aagaggaaagaaccccattgagtaa

SEQ ID NO: 47670 - DNA, 25 bp, Mus musculus
aagaggaaagaagcccattgagtaa

SEQ ID NO: 47671 - DNA, 25 bp, Mus musculus
aagaggaaagctaggctgccccgtg

SEQ ID NO: 47672 - DNA, 25 bp, Mus musculus
aagaggaaagcttggctgccccgtg

SEQ ID NO: 47673 - DNA, 25 bp, Mus musculus
aagaggaacacgcagcactgtccag

SEQ ID NO: 47674 - DNA, 25 bp, Mus musculus
aagaggaacacggagcactgtccag

SEQ ID NO: 47675 - DNA, 25 bp, Mus musculus
aagaggaacatccagcgttacaaca

SEQ ID NO: 47676 - DNA, 25 bp, Mus musculus
aagaggaacatcgagcgttacaaca

SEQ ID NO: 47677 - DNA, 25 bp, Mus musculus
aagaggaacccacaagatagctaat

SEQ ID NO: 47678 - DNA, 25 bp, Mus musculus
aagaggaacccagaagatagctaat

SEQ ID NO: 47679 - DNA, 25 bp, Mus musculus
aagaggaacgatcagctgagcccct

SEQ ID NO: 47680 - DNA, 25 bp, Mus musculus
aagaggaacgatgagctgagcccct

SEQ ID NO: 47681 - DNA, 25 bp, Mus musculus
aagaggaactgcctagtgttttgac

SEQ ID NO: 47682 - DNA, 25 bp, Mus musculus
aagaggaactgcgtagtgttttgac

SEQ ID NO: 47683 - DNA, 25 bp, Mus musculus
aagaggaagaaaaaccaccacaact

SEQ ID NO: 47684 - DNA, 25 bp, Mus musculus
aagaggaagaaataccaccacaact

SEQ ID NO: 47685 - DNA, 25 bp, Mus musculus
aagaggaagagactcccacccacag

SEQ ID NO: 47686 - DNA, 25 bp, Mus musculus
aagaggaagagagtcccacccacag

SEQ ID NO: 47687 - DNA, 25 bp, Mus musculus
aagaggaagcccctaaagccctgct

SEQ ID NO: 47688 - DNA, 25 bp, Mus musculus
aagaggaagcccgtaaagccctgct

SEQ ID NO: 47689 - DNA, 25 bp, Mus musculus
aagaggaagccgcagtcctccactt

SEQ ID NO: 47690 - DNA, 25 bp, Mus musculus
aagaggaagccggagtcctccactt

SEQ ID NO: 47691 - DNA, 25 bp, Mus musculus
aagaggaagcggatgctgagaaaaa

SEQ ID NO: 47692 - DNA, 25 bp, Mus musculus
aagaggaagcggttgctgagaaaaa

SEQ ID NO: 47693 - DNA, 25 bp, Mus musculus
aagaggaagtctattcgcctgctca

SEQ ID NO: 47694 - DNA, 25 bp, Mus musculus
aagaggaagtcttttcgcctgctca

SEQ ID NO: 47695 - DNA, 25 bp, Mus musculus
aagaggaagtgaccgcatcatccca

SEQ ID NO: 47696 - DNA, 25 bp, Mus musculus
aagaggaagtgagcgcatcatccca

SEQ ID NO: 47697 - DNA, 25 bp, Mus musculus
aagaggaataacctgattttctcca

SEQ ID NO: 47698 - DNA, 25 bp, Mus musculus
aagaggaataacgtgattttctcca

SEQ ID NO: 47699 - DNA, 25 bp, Mus musculus
aagaggaatatgactctggagtgga

SEQ ID NO: 47700 - DNA, 25 bp, Mus musculus
aagaggaatatgtctctggagtgga

SEQ ID NO: 47701 - DNA, 25 bp, Mus musculus
aagaggacaacgctgtgcagagcca

SEQ ID NO: 47702 - DNA, 25 bp, Mus musculus
aagaggacaacggtgtgcagagcca

SEQ ID NO: 47703 - DNA, 25 bp, Mus musculus
aagaggacacaaactaggcctttgt

SEQ ID NO: 47704 - DNA, 25 bp, Mus musculus
aagaggacacaatctaggcctttgt

SEQ ID NO: 47705 - DNA, 25 bp, Mus musculus
aagaggacacagcagaccctccata

SEQ ID NO: 47706 - DNA, 25 bp, Mus musculus
aagaggacacaggagaccctccata

SEQ ID NO: 47707 - DNA, 25 bp, Mus musculus
aagaggacacatccccagtgtcata

SEQ ID NO: 47708 - DNA, 25 bp, Mus musculus
aagaggacacatgcccagtgtcata

SEQ ID NO: 47709 - DNA, 25 bp, Mus musculus
aagaggacaccaacctccagaggca

SEQ ID NO: 47710 - DNA, 25 bp, Mus musculus
aagaggacaccatcctccagaggca

SEQ ID NO: 47711 - DNA, 25 bp, Mus musculus
aagaggacacgaagacctgcaagaa

SEQ ID NO: 47712 - DNA, 25 bp, Mus musculus
aagaggacacgatgacctgcaagaa

SEQ ID NO: 47713 - DNA, 25 bp, Mus musculus
aagaggacagctagactgcctctca

SEQ ID NO: 47714 - DNA, 25 bp, Mus musculus
aagaggacagcttgactgcctctca

SEQ ID NO: 47715 - DNA, 25 bp, Mus musculus
aagaggaccaagagggcacatggct

SEQ ID NO: 47716 - DNA, 25 bp, Mus musculus
aagaggaccaagtgggcacatggct

SEQ ID NO: 47717 - DNA, 25 bp, Mus musculus
aagaggaccaggacaccagtggcag

SEQ ID NO: 47718 - DNA, 25 bp, Mus musculus
aagaggaccaggctgctttccaggt

SEQ ID NO: 47719 - DNA, 25 bp, Mus musculus
aagaggaccagggtgctttccaggt

SEQ ID NO: 47720 - DNA, 25 bp, Mus musculus
aagaggaccaggtcaccagtggcag

SEQ ID NO: 47721 - DNA, 25 bp, Mus musculus
aagaggacccctcgagcgtatcgat

SEQ ID NO: 47722 - DNA, 25 bp, Mus musculus
aagaggacccctggagcgtatcgat

SEQ ID NO: 47723 - DNA, 25 bp, Mus musculus
aagaggacccgactcatgtctcctg

SEQ ID NO: 47724 - DNA, 25 bp, Mus musculus
aagaggacccgagtcatgtctcctg

SEQ ID NO: 47725 - DNA, 25 bp, Mus musculus
aagaggacccggaatccgtgcttgg

SEQ ID NO: 47726 - DNA, 25 bp, Mus musculus
aagaggacccggtatccgtgcttgg

SEQ ID NO: 47727 - DNA, 25 bp, Mus musculus
aagaggaccctacgcagctgatgat

SEQ ID NO: 47728 - DNA, 25 bp, Mus musculus
aagaggaccctaggcagctgatgat

SEQ ID NO: 47729 - DNA, 25 bp, Mus musculus
aagaggacccttcccagggactgat

SEQ ID NO: 47730 - DNA, 25 bp, Mus musculus
aagaggacccttgccagggactgat

SEQ ID NO: 47731 - DNA, 25 bp, Mus musculus
aagaggacctgaaccgggcggctca

SEQ ID NO: 47732 - DNA, 25 bp, Mus musculus
aagaggacctgatccgggcggctca

SEQ ID NO: 47733 - DNA, 25 bp, Mus musculus
aagaggacgcttaacaccttcgagc

SEQ ID NO: 47734 - DNA, 25 bp, Mus musculus
aagaggacgctttacaccttcgagc

SEQ ID NO: 47735 - DNA, 25 bp, Mus musculus
aagaggacgggtattctccagtcat

SEQ ID NO: 47736 - DNA, 25 bp, Mus musculus
aagaggacgggttttctccagtcat

SEQ ID NO: 47737 - DNA, 25 bp, Mus musculus
aagaggactcagacacagcgggcag

SEQ ID NO: 47738 - DNA, 25 bp, Mus musculus
aagaggactcagtcacagcgggcag

SEQ ID NO: 47739 - DNA, 25 bp, Mus musculus
aagaggactcttctacctgctgacg

SEQ ID NO: 47740 - DNA, 25 bp, Mus musculus
aagaggactcttctcgctacagcat

SEQ ID NO: 47741 - DNA, 25 bp, Mus musculus
aagaggactcttgtacctgctgacg

SEQ ID NO: 47742 - DNA, 25 bp, Mus musculus
aagaggactcttgtcgctacagcat

SEQ ID NO: 47743 - DNA, 25 bp, Mus musculus
aagaggactgatcgcgttcctgttc

SEQ ID NO: 47744 - DNA, 25 bp, Mus musculus
aagaggactgatggcgttcctgttc

SEQ ID NO: 47745 - DNA, 25 bp, Mus musculus
aagaggactgtcagtgatgtccaca

SEQ ID NO: 47746 - DNA, 25 bp, Mus musculus
aagaggactgtctgtgatgtccaca

SEQ ID NO: 47747 - DNA, 25 bp, Mus musculus
aagaggagaccactgatgaccccga

SEQ ID NO: 47748 - DNA, 25 bp, Mus musculus
aagaggagaccagtgatgaccccga

SEQ ID NO: 47749 - DNA, 25 bp, Mus musculus
aagaggagactcatccctacagatc

SEQ ID NO: 47750 - DNA, 25 bp, Mus musculus
aagaggagactcttccctacagatc

SEQ ID NO: 47751 - DNA, 25 bp, Mus musculus
aagaggagagtgaccagttcctgga

SEQ ID NO: 47752 - DNA, 25 bp, Mus musculus
aagaggagagtgtccagttcctgga

SEQ ID NO: 47753 - DNA, 25 bp, Mus musculus
aagaggagattgaccgtgcggccat

SEQ ID NO: 47754 - DNA, 25 bp, Mus musculus
aagaggagattgtccgtgcggccat

SEQ ID NO: 47755 - DNA, 25 bp, Mus musculus
aagaggagatttcctttgctctgtc

SEQ ID NO: 47756 - DNA, 25 bp, Mus musculus
aagaggagatttgctttgctctgtc

SEQ ID NO: 47757 - DNA, 25 bp, Mus musculus
aagaggagcaacaaagcagaaggat

SEQ ID NO: 47758 - DNA, 25 bp, Mus musculus
aagaggagcaactaagcagaaggat

SEQ ID NO: 47759 - DNA, 25 bp, Mus musculus
aagaggagccacatcaagcacatcc

SEQ ID NO: 47760 - DNA, 25 bp, Mus musculus
aagaggagccacttcaagcacatcc

SEQ ID NO: 47761 - DNA, 25 bp, Mus musculus
aagaggagccatacactgtgagcaa

SEQ ID NO: 47762 - DNA, 25 bp, Mus musculus
aagaggagccattcactgtgagcaa

SEQ ID NO: 47763 - DNA, 25 bp, Mus musculus
aagaggagcggtacattgccatgct

SEQ ID NO: 47764 - DNA, 25 bp, Mus musculus
aagaggagcggttcattgccatgct

SEQ ID NO: 47765 - DNA, 25 bp, Mus musculus
aagaggagctgaagccacaggacct

SEQ ID NO: 47766 - DNA, 25 bp, Mus musculus
aagaggagctgatgccacaggacct

SEQ ID NO: 47767 - DNA, 25 bp, Mus musculus
aagaggaggagcaactgtgacacag

SEQ ID NO: 47768 - DNA, 25 bp, Mus musculus
aagaggaggagctactgtgacacag

SEQ ID NO: 47769 - DNA, 25 bp, Mus musculus
aagaggaggcctcttccctggccag

SEQ ID NO: 47770 - DNA, 25 bp, Mus musculus
aagaggaggcctgttccctggccag

SEQ ID NO: 47771 - DNA, 25 bp, Mus musculus
aagaggaggctgactcgcaagctca

SEQ ID NO: 47772 - DNA, 25 bp, Mus musculus
aagaggaggctgtctcgcaagctca

SEQ ID NO: 47773 - DNA, 25 bp, Mus musculus
aagaggaggttgatcacctgcaggc

SEQ ID NO: 47774 - DNA, 25 bp, Mus musculus
aagaggaggttgttcacctgcaggc

SEQ ID NO: 47775 - DNA, 25 bp, Mus musculus
aagaggagttggaagcggtgtctga

SEQ ID NO: 47776 - DNA, 25 bp, Mus musculus
aagaggagttggtagcggtgtctga

SEQ ID NO: 47777 - DNA, 25 bp, Mus musculus
aagaggatactcacgaactcgataa

SEQ ID NO: 47778 - DNA, 25 bp, Mus musculus
aagaggatactctcgaactcgataa

SEQ ID NO: 47779 - DNA, 25 bp, Mus musculus
aagaggatactgagccagcagggct

SEQ ID NO: 47780 - DNA, 25 bp, Mus musculus
aagaggatactgtgccagcagggct

SEQ ID NO: 47781 - DNA, 25 bp, Mus musculus
aagaggatagcccagtagcccgcct

SEQ ID NO: 47782 - DNA, 25 bp, Mus musculus
aagaggatagccgagtagcccgcct

SEQ ID NO: 47783 - DNA, 25 bp, Mus musculus
aagaggatccggctactgcagtttg

SEQ ID NO: 47784 - DNA, 25 bp, Mus musculus
aagaggatccgggtactgcagtttg

SEQ ID NO: 47785 - DNA, 25 bp, Mus musculus
aagaggatctctccagcccgagaaa

SEQ ID NO: 47786 - DNA, 25 bp, Mus musculus
aagaggatctctgcagcccgagaaa

SEQ ID NO: 47787 - DNA, 25 bp, Mus musculus
aagaggatctggactccaaactgac

SEQ ID NO: 47788 - DNA, 25 bp, Mus musculus
aagaggatctggtctccaaactgac

SEQ ID NO: 47789 - DNA, 25 bp, Mus musculus
aagaggatctgtcgccaaacccact

SEQ ID NO: 47790 - DNA, 25 bp, Mus musculus
aagaggatctgtctcttgctcgttc

SEQ ID NO: 47791 - DNA, 25 bp, Mus musculus
aagaggatctgtggccaaacccact

SEQ ID NO: 47792 - DNA, 25 bp, Mus musculus
aagaggatctgtgtcttgctcgttc

SEQ ID NO: 47793 - DNA, 25 bp, Mus musculus
aagaggatgaatcccaacagccctt

SEQ ID NO: 47794 - DNA, 25 bp, Mus musculus
aagaggatgaatgccaacagccctt

SEQ ID NO: 47795 - DNA, 25 bp, Mus musculus
aagaggatgacgacatggctttgga

SEQ ID NO: 47796 - DNA, 25 bp, Mus musculus
aagaggatgacgtcatggctttgga

SEQ ID NO: 47797 - DNA, 25 bp, Mus musculus
aagaggatgatgagcccagcctctg

SEQ ID NO: 47798 - DNA, 25 bp, Mus musculus
aagaggatgatgtgcccagcctctg

SEQ ID NO: 47799 - DNA, 25 bp, Mus musculus
aagaggatgcacactgcactgccaa

SEQ ID NO: 47800 - DNA, 25 bp, Mus musculus
aagaggatgcactctgcactgccaa

SEQ ID NO: 47801 - DNA, 25 bp, Mus musculus
aagaggatgctcctgctgcatttta

SEQ ID NO: 47802 - DNA, 25 bp, Mus musculus
aagaggatgctcgtgctgcatttta

SEQ ID NO: 47803 - DNA, 25 bp, Mus musculus
aagaggatgctgaaagctgctccag

SEQ ID NO: 47804 - DNA, 25 bp, Mus musculus
aagaggatgctgtaagctgctccag

SEQ ID NO: 47805 - DNA, 25 bp, Mus musculus
aagaggatggacagcccggccctcc

SEQ ID NO: 47806 - DNA, 25 bp, Mus musculus
aagaggatggactgcccggccctcc

SEQ ID NO: 47807 - DNA, 25 bp, Mus musculus
aagaggatgtccagagccgttaacc

SEQ ID NO: 47808 - DNA, 25 bp, Mus musculus
aagaggatgtcctgagccgttaacc

SEQ ID NO: 47809 - DNA, 25 bp, Mus musculus
aagaggattaaacggcgcaccggct

SEQ ID NO: 47810 - DNA, 25 bp, Mus musculus
aagaggattaaagggcgcaccggct

SEQ ID NO: 47811 - DNA, 25 bp, Mus musculus
aagaggattatgatcgctatgccca

SEQ ID NO: 47812 - DNA, 25 bp, Mus musculus
aagaggattatgttcgctatgccca

SEQ ID NO: 47813 - DNA, 25 bp, Mus musculus
aagaggatttcccaaggcatcttct

SEQ ID NO: 47814 - DNA, 25 bp, Mus musculus
aagaggatttccgaaggcatcttct

SEQ ID NO: 47815 - DNA, 25 bp, Mus musculus
aagaggattttgctatgatgctgaa

SEQ ID NO: 47816 - DNA, 25 bp, Mus musculus
aagaggattttggtatgatgctgaa

SEQ ID NO: 47817 - DNA, 25 bp, Mus musculus
aagaggcacacacttgtatcacttt

SEQ ID NO: 47818 - DNA, 25 bp, Mus musculus
aagaggcacacagttgtatcacttt

SEQ ID NO: 47819 - DNA, 25 bp, Mus musculus
aagaggcacaggcagttcccagctt

SEQ ID NO: 47820 - DNA, 25 bp, Mus musculus
aagaggcacagggagttcccagctt

SEQ ID NO: 47821 - DNA, 25 bp, Mus musculus
aagaggcacattcacgacaaactgt

SEQ ID NO: 47822 - DNA, 25 bp, Mus musculus
aagaggcacattgacgacaaactgt

SEQ ID NO: 47823 - DNA, 25 bp, Mus musculus
aagaggcaccacagaagagaaagct

SEQ ID NO: 47824 - DNA, 25 bp, Mus musculus
aagaggcaccactgaagagaaagct

SEQ ID NO: 47825 - DNA, 25 bp, Mus musculus
aagaggcactggctccctttaagga

SEQ ID NO: 47826 - DNA, 25 bp, Mus musculus
aagaggcactgggtccctttaagga

SEQ ID NO: 47827 - DNA, 25 bp, Mus musculus
aagaggcacttgaatatgaactaac

SEQ ID NO: 47828 - DNA, 25 bp, Mus musculus
aagaggcacttgtatatgaactaac

SEQ ID NO: 47829 - DNA, 25 bp, Mus musculus
aagaggcagccaaacacttcatcca

SEQ ID NO: 47830 - DNA, 25 bp, Mus musculus
aagaggcagccatacacttcatcca

SEQ ID NO: 47831 - DNA, 25 bp, Mus musculus
aagaggcagctaccgcaaggctttg

SEQ ID NO: 47832 - DNA, 25 bp, Mus musculus
aagaggcagctagcgcaaggctttg

SEQ ID NO: 47833 - DNA, 25 bp, Mus musculus
aagaggcagcttcggctgacccagc

SEQ ID NO: 47834 - DNA, 25 bp, Mus musculus
aagaggcagcttgggctgacccagc

SEQ ID NO: 47835 - DNA, 25 bp, Mus musculus
aagaggcaggcgacagagtccagca

SEQ ID NO: 47836 - DNA, 25 bp, Mus musculus
aagaggcaggcgtcagagtccagca

SEQ ID NO: 47837 - DNA, 25 bp, Mus musculus
aagaggcagttgacctgtggcagag

SEQ ID NO: 47838 - DNA, 25 bp, Mus musculus
aagaggcagttgtcctgtggcagag

SEQ ID NO: 47839 - DNA, 25 bp, Mus musculus
aagaggcatcctcccatttttcata

SEQ ID NO: 47840 - DNA, 25 bp, Mus musculus
aagaggcatcctgccatttttcata

SEQ ID NO: 47841 - DNA, 25 bp, Mus musculus
aagaggcatcttctacagcatggcc

SEQ ID NO: 47842 - DNA, 25 bp, Mus musculus
aagaggcatcttgtacagcatggcc

SEQ ID NO: 47843 - DNA, 25 bp, Mus musculus
aagaggcattgaacctgtccatggc

SEQ ID NO: 47844 - DNA, 25 bp, Mus musculus
aagaggcattgatcctgtccatggc

SEQ ID NO: 47845 - DNA, 25 bp, Mus musculus
aagaggcattgtagccccaattttc

SEQ ID NO: 47846 - DNA, 25 bp, Mus musculus
aagaggcattgttgccccaattttc

SEQ ID NO: 47847 - DNA, 25 bp, Mus musculus
aagaggccaagcaccagaacccgga

SEQ ID NO: 47848 - DNA, 25 bp, Mus musculus
aagaggccaagctccagaacccgga

SEQ ID NO: 47849 - DNA, 25 bp, Mus musculus
aagaggccaattagttcagcacgtg

SEQ ID NO: 47850 - DNA, 25 bp, Mus musculus
aagaggccaatttgttcagcacgtg

SEQ ID NO: 47851 - DNA, 25 bp, Mus musculus
aagaggccacaacgcttcagctcta

SEQ ID NO: 47852 - DNA, 25 bp, Mus musculus
aagaggccacaaggcttcagctcta

SEQ ID NO: 47853 - DNA, 25 bp, Mus musculus
aagaggccacatattgctgagcaat

SEQ ID NO: 47854 - DNA, 25 bp, Mus musculus
aagaggccacattttgctgagcaat

SEQ ID NO: 47855 - DNA, 25 bp, Mus musculus
aagaggccaccactagctgggagaa

SEQ ID NO: 47856 - DNA, 25 bp, Mus musculus
aagaggccaccagtagctgggagaa

SEQ ID NO: 47857 - DNA, 25 bp, Mus musculus
aagaggccaccccaggaggacttca

SEQ ID NO: 47858 - DNA, 25 bp, Mus musculus
aagaggccacccgaggaggacttca

SEQ ID NO: 47859 - DNA, 25 bp, Mus musculus
aagaggccaccgagatgtgccatct

SEQ ID NO: 47860 - DNA, 25 bp, Mus musculus
aagaggccaccgtgatgtgccatct

SEQ ID NO: 47861 - DNA, 25 bp, Mus musculus
aagaggccactcagtccggccagtg

SEQ ID NO: 47862 - DNA, 25 bp, Mus musculus
aagaggccactctgtccggccagtg

SEQ ID NO: 47863 - DNA, 25 bp, Mus musculus
aagaggccactgagcatccaggaca

SEQ ID NO: 47864 - DNA, 25 bp, Mus musculus
aagaggccactgtgcatccaggaca

SEQ ID NO: 47865 - DNA, 25 bp, Mus musculus
aagaggccagagactaagggtgacc

SEQ ID NO: 47866 - DNA, 25 bp, Mus musculus
aagaggccagagtctaagggtgacc

SEQ ID NO: 47867 - DNA, 25 bp, Mus musculus
aagaggccagctacctggtgcgcaa

SEQ ID NO: 47868 - DNA, 25 bp, Mus musculus
aagaggccagctcagatccatgcac

SEQ ID NO: 47869 - DNA, 25 bp, Mus musculus
aagaggccagctgagatccatgcac

SEQ ID NO: 47870 - DNA, 25 bp, Mus musculus
aagaggccagcttcctggtgcgcaa

SEQ ID NO: 47871 - DNA, 25 bp, Mus musculus
aagaggcccagcagatccgtatggg

SEQ ID NO: 47872 - DNA, 25 bp, Mus musculus
aagaggcccagctgatccgtatggg

SEQ ID NO: 47873 - DNA, 25 bp, Mus musculus
aagaggcccaggaaggacgcaccct

SEQ ID NO: 47874 - DNA, 25 bp, Mus musculus
aagaggcccaggtaggacgcaccct

SEQ ID NO: 47875 - DNA, 25 bp, Mus musculus
aagaggccctgacattcgggtgcca

SEQ ID NO: 47876 - DNA, 25 bp, Mus musculus
aagaggccctgagattcgggtgcca

SEQ ID NO: 47877 - DNA, 25 bp, Mus musculus
aagaggccgtgcaactgggtgcatc

SEQ ID NO: 47878 - DNA, 25 bp, Mus musculus
aagaggccgtgctactgggtgcatc

SEQ ID NO: 47879 - DNA, 25 bp, Mus musculus
aagaggcctagtcagggctcccagc

SEQ ID NO: 47880 - DNA, 25 bp, Mus musculus
aagaggcctagtgagggctcccagc

SEQ ID NO: 47881 - DNA, 25 bp, Mus musculus
aagaggcctatgaccacaagagtgt

SEQ ID NO: 47882 - DNA, 25 bp, Mus musculus
aagaggcctatgactgcgtacatgc

SEQ ID NO: 47883 - DNA, 25 bp, Mus musculus
aagaggcctatgtccacaagagtgt

SEQ ID NO: 47884 - DNA, 25 bp, Mus musculus
aagaggcctatgtctgcgtacatgc

SEQ ID NO: 47885 - DNA, 25 bp, Mus musculus
aagaggcctgacagttgcatctcca

SEQ ID NO: 47886 - DNA, 25 bp, Mus musculus
aagaggcctgactgttgcatctcca

SEQ ID NO: 47887 - DNA, 25 bp, Mus musculus
aagaggcctggacgacacctcgtat

SEQ ID NO: 47888 - DNA, 25 bp, Mus musculus
aagaggcctggaggacacctcgtat

SEQ ID NO: 47889 - DNA, 25 bp, Mus musculus
aagaggcctgtaaaccaacatggtg

SEQ ID NO: 47890 - DNA, 25 bp, Mus musculus
aagaggcctgtacagcaaccactgg

SEQ ID NO: 47891 - DNA, 25 bp, Mus musculus
aagaggcctgtagagcaaccactgg

SEQ ID NO: 47892 - DNA, 25 bp, Mus musculus
aagaggcctgtataccaacatggtg

SEQ ID NO: 47893 - DNA, 25 bp, Mus musculus
aagaggcctgttagtcaattgtaca

SEQ ID NO: 47894 - DNA, 25 bp, Mus musculus
aagaggcctgtttgtcaattgtaca

SEQ ID NO: 47895 - DNA, 25 bp, Mus musculus
aagaggccttgcacagatccaacaa

SEQ ID NO: 47896 - DNA, 25 bp, Mus musculus
aagaggccttgctcagatccaacaa

SEQ ID NO: 47897 - DNA, 25 bp, Mus musculus
aagaggccttgtcctcagggcaagc

SEQ ID NO: 47898 - DNA, 25 bp, Mus musculus
aagaggccttgtgctcagggcaagc

SEQ ID NO: 47899 - DNA, 25 bp, Mus musculus
aagaggcgactcatttttaccgtgg

SEQ ID NO: 47900 - DNA, 25 bp, Mus musculus
aagaggcgactcttttttaccgtgg

SEQ ID NO: 47901 - DNA, 25 bp, Mus musculus
aagaggcgcaagatctcggcagcca

SEQ ID NO: 47902 - DNA, 25 bp, Mus musculus
aagaggcgcaagttctcggcagcca

SEQ ID NO: 47903 - DNA, 25 bp, Mus musculus
aagaggcgcgacatgtcagaagaca

SEQ ID NO: 47904 - DNA, 25 bp, Mus musculus
aagaggcgcgacttgtcagaagaca

SEQ ID NO: 47905 - DNA, 25 bp, Mus musculus
aagaggcgcggtagccataacacca

SEQ ID NO: 47906 - DNA, 25 bp, Mus musculus
aagaggcgcggttgccataacacca

SEQ ID NO: 47907 - DNA, 25 bp, Mus musculus
aagaggcgctaaagcacttccgggt

SEQ ID NO: 47908 - DNA, 25 bp, Mus musculus
aagaggcgctaatgcacttccgggt

SEQ ID NO: 47909 - DNA, 25 bp, Mus musculus
aagaggcggaatatttggtctccag

SEQ ID NO: 47910 - DNA, 25 bp, Mus musculus
aagaggcggaatttttggtctccag

SEQ ID NO: 47911 - DNA, 25 bp, Mus musculus
aagaggcggcaacagggccatctct

SEQ ID NO: 47912 - DNA, 25 bp, Mus musculus
aagaggcggcaagagggccatctct

SEQ ID NO: 47913 - DNA, 25 bp, Mus musculus
aagaggcggctgatgccagaagtca

SEQ ID NO: 47914 - DNA, 25 bp, Mus musculus
aagaggcggctgttgccagaagtca

SEQ ID NO: 47915 - DNA, 25 bp, Mus musculus
aagaggcgtgtgaaatcctgtgctc

SEQ ID NO: 47916 - DNA, 25 bp, Mus musculus
aagaggcgtgtgtaatcctgtgctc

SEQ ID NO: 47917 - DNA, 25 bp, Mus musculus
aagaggctaatccttgcaggtccct

SEQ ID NO: 47918 - DNA, 25 bp, Mus musculus
aagaggctaatcgttgcaggtccct

SEQ ID NO: 47919 - DNA, 25 bp, Mus musculus
aagaggctacagactgcctttcagt

SEQ ID NO: 47920 - DNA, 25 bp, Mus musculus
aagaggctacagtctgcctttcagt

SEQ ID NO: 47921 - DNA, 25 bp, Mus musculus
aagaggctacctccctgaaagagag

SEQ ID NO: 47922 - DNA, 25 bp, Mus musculus
aagaggctacctgcctgaaagagag

SEQ ID NO: 47923 - DNA, 25 bp, Mus musculus
aagaggctacggcagctcctctgat

SEQ ID NO: 47924 - DNA, 25 bp, Mus musculus
aagaggctacgggagctcctctgat

SEQ ID NO: 47925 - DNA, 25 bp, Mus musculus
aagaggctagttcccatgatgcagt

SEQ ID NO: 47926 - DNA, 25 bp, Mus musculus
aagaggctagttctgacccacttca

SEQ ID NO: 47927 - DNA, 25 bp, Mus musculus
aagaggctagttgccatgatgcagt

SEQ ID NO: 47928 - DNA, 25 bp, Mus musculus
aagaggctagttgtgacccacttca

SEQ ID NO: 47929 - DNA, 25 bp, Mus musculus
aagaggctatgcagttcaatgttgc

SEQ ID NO: 47930 - DNA, 25 bp, Mus musculus
aagaggctatgctgttcaatgttgc

SEQ ID NO: 47931 - DNA, 25 bp, Mus musculus
aagaggctcacgactgcctacaacc

SEQ ID NO: 47932 - DNA, 25 bp, Mus musculus
aagaggctcacgtctgcctacaacc

SEQ ID NO: 47933 - DNA, 25 bp, Mus musculus
aagaggctcagcctttgtgcttgac

SEQ ID NO: 47934 - DNA, 25 bp, Mus musculus
aagaggctcagcgtttgtgcttgac

SEQ ID NO: 47935 - DNA, 25 bp, Mus musculus
aagaggctcattactttggttaaat

SEQ ID NO: 47936 - DNA, 25 bp, Mus musculus
aagaggctcatttctttggttaaat

SEQ ID NO: 47937 - DNA, 25 bp, Mus musculus
aagaggctcctcacatatcactgtg

SEQ ID NO: 47938 - DNA, 25 bp, Mus musculus
aagaggctcctctcatatcactgtg

SEQ ID NO: 47939 - DNA, 25 bp, Mus musculus
aagaggctctcaagtttgttcccag

SEQ ID NO: 47940 - DNA, 25 bp, Mus musculus
aagaggctctcatgtttgttcccag

SEQ ID NO: 47941 - DNA, 25 bp, Mus musculus
aagaggctctggcataatgactcca

SEQ ID NO: 47942 - DNA, 25 bp, Mus musculus
aagaggctctgggataatgactcca

SEQ ID NO: 47943 - DNA, 25 bp, Mus musculus
aagaggctgataaccctgggatcct

SEQ ID NO: 47944 - DNA, 25 bp, Mus musculus
aagaggctgatatccctgggatcct

SEQ ID NO: 47945 - DNA, 25 bp, Mus musculus
aagaggctgcctatctgatacccca

SEQ ID NO: 47946 - DNA, 25 bp, Mus musculus
aagaggctgcctttctgatacccca

SEQ ID NO: 47947 - DNA, 25 bp, Mus musculus
aagaggctgcgaaaccatgggagac

SEQ ID NO: 47948 - DNA, 25 bp, Mus musculus
aagaggctgcgataccatgggagac

SEQ ID NO: 47949 - DNA, 25 bp, Mus musculus
aagaggctgctcagttggaccagca

SEQ ID NO: 47950 - DNA, 25 bp, Mus musculus
aagaggctgctctgttggaccagca

SEQ ID NO: 47951 - DNA, 25 bp, Mus musculus
aagaggctgctgatcaggagttcaa

SEQ ID NO: 47952 - DNA, 25 bp, Mus musculus
aagaggctgctgttcaggagttcaa

SEQ ID NO: 47953 - DNA, 25 bp, Mus musculus
aagaggctggagcacacttttccct

SEQ ID NO: 47954 - DNA, 25 bp, Mus musculus
aagaggctggaggacacttttccct

SEQ ID NO: 47955 - DNA, 25 bp, Mus musculus
aagaggctgggcagcttgtccgtac

SEQ ID NO: 47956 - DNA, 25 bp, Mus musculus
aagaggctgggctgcttgtccgtac

SEQ ID NO: 47957 - DNA, 25 bp, Mus musculus
aagaggctggttatggcatctatct

SEQ ID NO: 47958 - DNA, 25 bp, Mus musculus
aagaggctggttttggcatctatct

SEQ ID NO: 47959 - DNA, 25 bp, Mus musculus
aagaggctgtacatgggtgagatcc

SEQ ID NO: 47960 - DNA, 25 bp, Mus musculus
aagaggctgtacttgggtgagatcc

SEQ ID NO: 47961 - DNA, 25 bp, Mus musculus
aagaggctgtagaacttgagcaagc

SEQ ID NO: 47962 - DNA, 25 bp, Mus musculus
aagaggctgtagtacttgagcaagc

SEQ ID NO: 47963 - DNA, 25 bp, Mus musculus
aagaggctgttgagccagactgaag

SEQ ID NO: 47964 - DNA, 25 bp, Mus musculus
aagaggctgttgtgccagactgaag

SEQ ID NO: 47965 - DNA, 25 bp, Mus musculus
aagaggcttatcatgactcctggtt

SEQ ID NO: 47966 - DNA, 25 bp, Mus musculus
aagaggcttatcttgactcctggtt

SEQ ID NO: 47967 - DNA, 25 bp, Mus musculus
aagaggcttcctcactaaccatgag

SEQ ID NO: 47968 - DNA, 25 bp, Mus musculus
aagaggcttcctgactaaccatgag

SEQ ID NO: 47969 - DNA, 25 bp, Mus musculus
aagaggcttcggctcattacgataa

SEQ ID NO: 47970 - DNA, 25 bp, Mus musculus
aagaggcttcgggtcattacgataa

SEQ ID NO: 47971 - DNA, 25 bp, Mus musculus
aagaggcttgtaacccctatttagt

SEQ ID NO: 47972 - DNA, 25 bp, Mus musculus
aagaggcttgtatcccctatttagt

SEQ ID NO: 47973 - DNA, 25 bp, Mus musculus
aagaggctttaccatgtgacttaca

SEQ ID NO: 47974 - DNA, 25 bp, Mus musculus
aagaggctttacgatgtgacttaca

SEQ ID NO: 47975 - DNA, 25 bp, Mus musculus
aagaggctttctctactggagtagt

SEQ ID NO: 47976 - DNA, 25 bp, Mus musculus
aagaggctttctgtactggagtagt

SEQ ID NO: 47977 - DNA, 25 bp, Mus musculus
aagagggaaactacagctgcagaga

SEQ ID NO: 47978 - DNA, 25 bp, Mus musculus
aagagggaaacttcagctgcagaga

SEQ ID NO: 47979 - DNA, 25 bp, Mus musculus
aagagggaatgaactctgtctttcc

SEQ ID NO: 47980 - DNA, 25 bp, Mus musculus
aagagggaatgatctctgtctttcc

SEQ ID NO: 47981 - DNA, 25 bp, Mus musculus
aagagggacaagcttcctcggctca

SEQ ID NO: 47982 - DNA, 25 bp, Mus musculus
aagagggacaaggttcctcggctca

SEQ ID NO: 47983 - DNA, 25 bp, Mus musculus
aagagggacatccaccccagatggt

SEQ ID NO: 47984 - DNA, 25 bp, Mus musculus
aagagggacatcgaccccagatggt

SEQ ID NO: 47985 - DNA, 25 bp, Mus musculus
aagagggacccacgctctaatagct

SEQ ID NO: 47986 - DNA, 25 bp, Mus musculus
aagagggacccaggctctaatagct

SEQ ID NO: 47987 - DNA, 25 bp, Mus musculus
aagagggaccttcctacctgatagc

SEQ ID NO: 47988 - DNA, 25 bp, Mus musculus
aagagggaccttgctacctgatagc

SEQ ID NO: 47989 - DNA, 25 bp, Mus musculus
aagagggagagcacacggccaccgc

SEQ ID NO: 47990 - DNA, 25 bp, Mus musculus
aagagggagagctcacggccaccgc

SEQ ID NO: 47991 - DNA, 25 bp, Mus musculus
aagagggagcaccttcctttctgtg

SEQ ID NO: 47992 - DNA, 25 bp, Mus musculus
aagagggagcacgttcctttctgtg

SEQ ID NO: 47993 - DNA, 25 bp, Mus musculus
aagagggagcggactcgcagcccaa

SEQ ID NO: 47994 - DNA, 25 bp, Mus musculus
aagagggagcggtctcgcagcccaa

SEQ ID NO: 47995 - DNA, 25 bp, Mus musculus
aagagggaggacatgctgctgcatc

SEQ ID NO: 47996 - DNA, 25 bp, Mus musculus
aagagggaggacttgctgctgcatc

SEQ ID NO: 47997 - DNA, 25 bp, Mus musculus
aagagggaggctcacagctgctcct

SEQ ID NO: 47998 - DNA, 25 bp, Mus musculus
aagagggaggctgacagctgctcct

SEQ ID NO: 47999 - DNA, 25 bp, Mus musculus
aagagggattttcctgatagagtat

SEQ ID NO: 48000 - DNA, 25 bp, Mus musculus
aagagggattttgctgatagagtat

SEQ ID NO: 48001 - DNA, 25 bp, Mus musculus
aagagggcaaagaccgacgccacca

SEQ ID NO: 48002 - DNA, 25 bp, Mus musculus
aagagggcaaagtccgacgccacca

SEQ ID NO: 48003 - DNA, 25 bp, Mus musculus
aagagggcaacccagtggcttccat

SEQ ID NO: 48004 - DNA, 25 bp, Mus musculus
aagagggcaaccgagtggcttccat

SEQ ID NO: 48005 - DNA, 25 bp, Mus musculus
aagagggcaactatgtactgttcag

SEQ ID NO: 48006 - DNA, 25 bp, Mus musculus
aagagggcaactttgtactgttcag

SEQ ID NO: 48007 - DNA, 25 bp, Mus musculus
aagagggcactcacctcattagcat

SEQ ID NO: 48008 - DNA, 25 bp, Mus musculus
aagagggcactctcctcattagcat

SEQ ID NO: 48009 - DNA, 25 bp, Mus musculus
aagagggcagagctctgctccactg

SEQ ID NO: 48010 - DNA, 25 bp, Mus musculus
aagagggcagaggtctgctccactg

SEQ ID NO: 48011 - DNA, 25 bp, Mus musculus
aagagggcagccaccggacaagccc

SEQ ID NO: 48012 - DNA, 25 bp, Mus musculus
aagagggcagcctccggacaagccc

SEQ ID NO: 48013 - DNA, 25 bp, Mus musculus
aagagggcatcaaacaggagggaat

SEQ ID NO: 48014 - DNA, 25 bp, Mus musculus
aagagggcatcatacaggagggaat

SEQ ID NO: 48015 - DNA, 25 bp, Mus musculus
aagagggcattgcatctccttggaa

SEQ ID NO: 48016 - DNA, 25 bp, Mus musculus
aagagggcattggatctccttggaa

SEQ ID NO: 48017 - DNA, 25 bp, Mus musculus
aagagggccaggacgccttctctgg

SEQ ID NO: 48018 - DNA, 25 bp, Mus musculus
aagagggccaggtcgccttctctgg

SEQ ID NO: 48019 - DNA, 25 bp, Mus musculus
aagagggccgagattatcaaaattg

SEQ ID NO: 48020 - DNA, 25 bp, Mus musculus
aagagggccgagtttatcaaaattg

SEQ ID NO: 48021 - DNA, 25 bp, Mus musculus
aagagggccgcactcattgaggatc

SEQ ID NO: 48022 - DNA, 25 bp, Mus musculus
aagagggccgcagtcattgaggatc

SEQ ID NO: 48023 - DNA, 25 bp, Mus musculus
aagagggccttgacaatttctccaa

SEQ ID NO: 48024 - DNA, 25 bp, Mus musculus
aagagggccttgtcaatttctccaa

SEQ ID NO: 48025 - DNA, 25 bp, Mus musculus
aagagggcgaatattcgcctcccac

SEQ ID NO: 48026 - DNA, 25 bp, Mus musculus
aagagggcgaattttcgcctcccac

SEQ ID NO: 48027 - DNA, 25 bp, Mus musculus
aagagggcgtagataccttggactg

SEQ ID NO: 48028 - DNA, 25 bp, Mus musculus
aagagggcgtagttaccttggactg

SEQ ID NO: 48029 - DNA, 25 bp, Mus musculus
aagagggctcctctagtagccactg

SEQ ID NO: 48030 - DNA, 25 bp, Mus musculus
aagagggctcctgtagtagccactg

SEQ ID NO: 48031 - DNA, 25 bp, Mus musculus
aagagggctctgattggcgtctacg

SEQ ID NO: 48032 - DNA, 25 bp, Mus musculus
aagagggctctgtttggcgtctacg

SEQ ID NO: 48033 - DNA, 25 bp, Mus musculus
aagagggctcttattgtaatttgtg

SEQ ID NO: 48034 - DNA, 25 bp, Mus musculus
aagagggctctttttgtaatttgtg

SEQ ID NO: 48035 - DNA, 25 bp, Mus musculus
aagagggctgatatccaaggtgcta

SEQ ID NO: 48036 - DNA, 25 bp, Mus musculus
aagagggctgatttccaaggtgcta

SEQ ID NO: 48037 - DNA, 25 bp, Mus musculus
aagagggcttggaagcccttctcta

SEQ ID NO: 48038 - DNA, 25 bp, Mus musculus
aagagggcttggtagcccttctcta

SEQ ID NO: 48039 - DNA, 25 bp, Mus musculus
aagagggctttgcacttggacccga

SEQ ID NO: 48040 - DNA, 25 bp, Mus musculus
aagagggctttggacttggacccga

SEQ ID NO: 48041 - DNA, 25 bp, Mus musculus
aagagggcttttatgagaatagcca

SEQ ID NO: 48042 - DNA, 25 bp, Mus musculus
aagagggcttttttgagaatagcca

SEQ ID NO: 48043 - DNA, 25 bp, Mus musculus
aagagggtaatccagctgtaagaaa

SEQ ID NO: 48044 - DNA, 25 bp, Mus musculus
aagagggtaatcgagctgtaagaaa

SEQ ID NO: 48045 - DNA, 25 bp, Mus musculus
aagagggtcccaagcctgttggaag

SEQ ID NO: 48046 - DNA, 25 bp, Mus musculus
aagagggtcccatgcctgttggaag

SEQ ID NO: 48047 - DNA, 25 bp, Mus musculus
aagagggtcgcgagcatggctacca

SEQ ID NO: 48048 - DNA, 25 bp, Mus musculus
aagagggtcgcgtgcatggctacca

SEQ ID NO: 48049 - DNA, 25 bp, Mus musculus
aagagggtctgtccattgtgtgaac

SEQ ID NO: 48050 - DNA, 25 bp, Mus musculus
aagagggtctgtgcattgtgtgaac

SEQ ID NO: 48051 - DNA, 25 bp, Mus musculus
aagagggtgaaacatctctggaact

SEQ ID NO: 48052 - DNA, 25 bp, Mus musculus
aagagggtgaaagatctctggaact

SEQ ID NO: 48053 - DNA, 25 bp, Mus musculus
aagagggtgagaaccaccaccaggg

SEQ ID NO: 48054 - DNA, 25 bp, Mus musculus
aagagggtgagatccaccaccaggg

SEQ ID NO: 48055 - DNA, 25 bp, Mus musculus
aagagggtgagcaggaaatgtttcc

SEQ ID NO: 48056 - DNA, 25 bp, Mus musculus
aagagggtgagctggaaatgtttcc

SEQ ID NO: 48057 - DNA, 25 bp, Mus musculus
aagagggtgccaagctatcctggtg

SEQ ID NO: 48058 - DNA, 25 bp, Mus musculus
aagagggtgccatgctatcctggtg

SEQ ID NO: 48059 - DNA, 25 bp, Mus musculus
aagagggtggctcctggagcctgca

SEQ ID NO: 48060 - DNA, 25 bp, Mus musculus
aagagggtggctgctggagcctgca

SEQ ID NO: 48061 - DNA, 25 bp, Mus musculus
aagagggtgtacatcctaatgaaat

SEQ ID NO: 48062 - DNA, 25 bp, Mus musculus
aagagggtgtacttcctaatgaaat

SEQ ID NO: 48063 - DNA, 25 bp, Mus musculus
aagagggtgtcgcaatcctctggaa

SEQ ID NO: 48064 - DNA, 25 bp, Mus musculus
aagagggtgtcggaatcctctggaa

SEQ ID NO: 48065 - DNA, 25 bp, Mus musculus
aagagggtgttgcactcctagcgct

SEQ ID NO: 48066 - DNA, 25 bp, Mus musculus
aagagggtgttggactcctagcgct

SEQ ID NO: 48067 - DNA, 25 bp, Mus musculus
aagagggttgtcatggctctttgtc

SEQ ID NO: 48068 - DNA, 25 bp, Mus musculus
aagagggttgtcttggctctttgtc

SEQ ID NO: 48069 - DNA, 25 bp, Mus musculus
aagagggtttctagagtgcatgatg

SEQ ID NO: 48070 - DNA, 25 bp, Mus musculus
aagagggtttcttgagtgcatgatg

SEQ ID NO: 48071 - DNA, 25 bp, Mus musculus
aagagggttttacatcatctgatgc

SEQ ID NO: 48072 - DNA, 25 bp, Mus musculus
aagagggttttagatcatctgatgc

SEQ ID NO: 48073 - DNA, 25 bp, Mus musculus
aagaggtaagaaactggccttccag

SEQ ID NO: 48074 - DNA, 25 bp, Mus musculus
aagaggtaagaatctggccttccag

SEQ ID NO: 48075 - DNA, 25 bp, Mus musculus
aagaggtaagcgaaactgcattagt

SEQ ID NO: 48076 - DNA, 25 bp, Mus musculus
aagaggtaagcgtaactgcattagt

SEQ ID NO: 48077 - DNA, 25 bp, Mus musculus
aagaggtaagtcactggtgcccagc

SEQ ID NO: 48078 - DNA, 25 bp, Mus musculus
aagaggtaagtctctggtgcccagc

SEQ ID NO: 48079 - DNA, 25 bp, Mus musculus
aagaggtacagtccatatccccatg

SEQ ID NO: 48080 - DNA, 25 bp, Mus musculus
aagaggtacagtgcatatccccatg

SEQ ID NO: 48081 - DNA, 25 bp, Mus musculus
aagaggtagattatcccaaagtatg

SEQ ID NO: 48082 - DNA, 25 bp, Mus musculus
aagaggtagattttcccaaagtatg

SEQ ID NO: 48083 - DNA, 25 bp, Mus musculus
aagaggtagggtcacctcctctgct

SEQ ID NO: 48084 - DNA, 25 bp, Mus musculus
aagaggtagggtgacctcctctgct

SEQ ID NO: 48085 - DNA, 25 bp, Mus musculus
aagaggtcaaagaggcgccagctga

SEQ ID NO: 48086 - DNA, 25 bp, Mus musculus
aagaggtcaaagtggcgccagctga

SEQ ID NO: 48087 - DNA, 25 bp, Mus musculus
aagaggtcaagtaggcctgagcaag

SEQ ID NO: 48088 - DNA, 25 bp, Mus musculus
aagaggtcaagttggcctgagcaag

SEQ ID NO: 48089 - DNA, 25 bp, Mus musculus
aagaggtcagccaaactgttcttca

SEQ ID NO: 48090 - DNA, 25 bp, Mus musculus
aagaggtcagcctaactgttcttca

SEQ ID NO: 48091 - DNA, 25 bp, Mus musculus
aagaggtcaggacccgcaggtcaca

SEQ ID NO: 48092 - DNA, 25 bp, Mus musculus
aagaggtcaggagccgcaggtcaca

SEQ ID NO: 48093 - DNA, 25 bp, Mus musculus
aagaggtcagggaactctcatgcca

SEQ ID NO: 48094 - DNA, 25 bp, Mus musculus
aagaggtcagggtactctcatgcca

SEQ ID NO: 48095 - DNA, 25 bp, Mus musculus
aagaggtccgagaatccccagagaa

SEQ ID NO: 48096 - DNA, 25 bp, Mus musculus
aagaggtccgagactgggtgctcac

SEQ ID NO: 48097 - DNA, 25 bp, Mus musculus
aagaggtccgagtatccccagagaa

SEQ ID NO: 48098 - DNA, 25 bp, Mus musculus
aagaggtccgagtctgggtgctcac

SEQ ID NO: 48099 - DNA, 25 bp, Mus musculus
aagaggtcctttcccctgatggctc

SEQ ID NO: 48100 - DNA, 25 bp, Mus musculus
aagaggtcctttgccctgatggctc

SEQ ID NO: 48101 - DNA, 25 bp, Mus musculus
aagaggtcggtacccacacgttcct

SEQ ID NO: 48102 - DNA, 25 bp, Mus musculus
aagaggtcggtagccacacgttcct

SEQ ID NO: 48103 - DNA, 25 bp, Mus musculus
aagaggtctcccactgagctgtaac

SEQ ID NO: 48104 - DNA, 25 bp, Mus musculus
aagaggtctccctctgagctgtaac

SEQ ID NO: 48105 - DNA, 25 bp, Mus musculus
aagaggtctgcaagggaccacagca

SEQ ID NO: 48106 - DNA, 25 bp, Mus musculus
aagaggtctgcatgggaccacagca

SEQ ID NO: 48107 - DNA, 25 bp, Mus musculus
aagaggtctgggagttcaaacaaat

SEQ ID NO: 48108 - DNA, 25 bp, Mus musculus
aagaggtctgggtgttcaaacaaat

SEQ ID NO: 48109 - DNA, 25 bp, Mus musculus
aagaggtcttatctttgcatttata

SEQ ID NO: 48110 - DNA, 25 bp, Mus musculus
aagaggtcttatgtttgcatttata

SEQ ID NO: 48111 - DNA, 25 bp, Mus musculus
aagaggtcttgtacgtggctcgctc

SEQ ID NO: 48112 - DNA, 25 bp, Mus musculus
aagaggtcttgttcgtggctcgctc

SEQ ID NO: 48113 - DNA, 25 bp, Mus musculus
aagaggtgaattcctcctaccttgt

SEQ ID NO: 48114 - DNA, 25 bp, Mus musculus
aagaggtgaattgctcctaccttgt

SEQ ID NO: 48115 - DNA, 25 bp, Mus musculus
aagaggtgaccaacctgtagtccat

SEQ ID NO: 48116 - DNA, 25 bp, Mus musculus
aagaggtgaccatcctgtagtccat

SEQ ID NO: 48117 - DNA, 25 bp, Mus musculus
aagaggtgagaaactttcctaggaa

SEQ ID NO: 48118 - DNA, 25 bp, Mus musculus
aagaggtgagaatctttcctaggaa

SEQ ID NO: 48119 - DNA, 25 bp, Mus musculus
aagaggtgattcatcaggctgaaaa

SEQ ID NO: 48120 - DNA, 25 bp, Mus musculus
aagaggtgattcttcaggctgaaaa

SEQ ID NO: 48121 - DNA, 25 bp, Mus musculus
aagaggtgcctgacattggtaaaca

SEQ ID NO: 48122 - DNA, 25 bp, Mus musculus
aagaggtgcctgtcattggtaaaca

SEQ ID NO: 48123 - DNA, 25 bp, Mus musculus
aagaggtgcgcacgactcctttcca

SEQ ID NO: 48124 - DNA, 25 bp, Mus musculus
aagaggtgcgcaggactcctttcca

SEQ ID NO: 48125 - DNA, 25 bp, Mus musculus
aagaggtgcggtatggctcactaaa

SEQ ID NO: 48126 - DNA, 25 bp, Mus musculus
aagaggtgcggtttggctcactaaa

SEQ ID NO: 48127 - DNA, 25 bp, Mus musculus
aagaggtgctgtcattggtgcctat

SEQ ID NO: 48128 - DNA, 25 bp, Mus musculus
aagaggtgctgtgattggtgcctat

SEQ ID NO: 48129 - DNA, 25 bp, Mus musculus
aagaggtggcccctaagctggtcat

SEQ ID NO: 48130 - DNA, 25 bp, Mus musculus
aagaggtggcccgtaagctggtcat

SEQ ID NO: 48131 - DNA, 25 bp, Mus musculus
aagaggtggcgcagcgtatcaccac

SEQ ID NO: 48132 - DNA, 25 bp, Mus musculus
aagaggtggcgctgcgtatcaccac

SEQ ID NO: 48133 - DNA, 25 bp, Mus musculus
aagaggtgggctcttcaggttccat

SEQ ID NO: 48134 - DNA, 25 bp, Mus musculus
aagaggtgggctgttcaggttccat

SEQ ID NO: 48135 - DNA, 25 bp, Mus musculus
aagaggtggttcatcctactgaggt

SEQ ID NO: 48136 - DNA, 25 bp, Mus musculus
aagaggtggttcttcctactgaggt

SEQ ID NO: 48137 - DNA, 25 bp, Mus musculus
aagaggtggtttcttcagctgcctt

SEQ ID NO: 48138 - DNA, 25 bp, Mus musculus
aagaggtggtttgttcagctgcctt

SEQ ID NO: 48139 - DNA, 25 bp, Mus musculus
aagaggtgtgccatgttatctggat

SEQ ID NO: 48140 - DNA, 25 bp, Mus musculus
aagaggtgtgccttgttatctggat

SEQ ID NO: 48141 - DNA, 25 bp, Mus musculus
aagaggtgttcaaggccaacccggt

SEQ ID NO: 48142 - DNA, 25 bp, Mus musculus
aagaggtgttcatggccaacccggt

SEQ ID NO: 48143 - DNA, 25 bp, Mus musculus
aagaggttcacgaggaagcttccag

SEQ ID NO: 48144 - DNA, 25 bp, Mus musculus
aagaggttcacgtggaagcttccag

SEQ ID NO: 48145 - DNA, 25 bp, Mus musculus
aagaggttccgtctggaccaaagca

SEQ ID NO: 48146 - DNA, 25 bp, Mus musculus
aagaggttccgtgtggaccaaagca

SEQ ID NO: 48147 - DNA, 25 bp, Mus musculus
aagaggttctggcatcggttcatgt

SEQ ID NO: 48148 - DNA, 25 bp, Mus musculus
aagaggttctgggatcggttcatgt

SEQ ID NO: 48149 - DNA, 25 bp, Mus musculus
aagaggttctgtcaagccgcatgga

SEQ ID NO: 48150 - DNA, 25 bp, Mus musculus
aagaggttctgtgaagccgcatgga

SEQ ID NO: 48151 - DNA, 25 bp, Mus musculus
aagaggttcttgcatcagggatgca

SEQ ID NO: 48152 - DNA, 25 bp, Mus musculus
aagaggttcttggatcagggatgca

SEQ ID NO: 48153 - DNA, 25 bp, Mus musculus
aagaggttgactaggcagactggca

SEQ ID NO: 48154 - DNA, 25 bp, Mus musculus
aagaggttgacttggcagactggca

SEQ ID NO: 48155 - DNA, 25 bp, Mus musculus
aagaggttgagtaccgatcccatgc

SEQ ID NO: 48156 - DNA, 25 bp, Mus musculus
aagaggttgagttccgatcccatgc

SEQ ID NO: 48157 - DNA, 25 bp, Mus musculus
aagaggttgatacagcgtttgttat

SEQ ID NO: 48158 - DNA, 25 bp, Mus musculus
aagaggttgatagagcgtttgttat

SEQ ID NO: 48159 - DNA, 25 bp, Mus musculus
aagaggttgcagattagttctaaga

SEQ ID NO: 48160 - DNA, 25 bp, Mus musculus
aagaggttgcagtttagttctaaga

SEQ ID NO: 48161 - DNA, 25 bp, Mus musculus
aagaggttgcctcttctgagcagct

SEQ ID NO: 48162 - DNA, 25 bp, Mus musculus
aagaggttgcctgttctgagcagct

SEQ ID NO: 48163 - DNA, 25 bp, Mus musculus
aagaggttgtccagcagtgcatgcg

SEQ ID NO: 48164 - DNA, 25 bp, Mus musculus
aagaggttgtcctgcagtgcatgcg

SEQ ID NO: 48165 - DNA, 25 bp, Mus musculus
aagaggttgttcatgagccgaacca

SEQ ID NO: 48166 - DNA, 25 bp, Mus musculus
aagaggttgttcttgagccgaacca

SEQ ID NO: 48167 - DNA, 25 bp, Mus musculus
aagaggtttagcacactgactactc

SEQ ID NO: 48168 - DNA, 25 bp, Mus musculus
aagaggtttagctcactgactactc

SEQ ID NO: 48169 - DNA, 25 bp, Mus musculus
aagaggtttccaaagctgctaacat

SEQ ID NO: 48170 - DNA, 25 bp, Mus musculus
aagaggtttccatagctgctaacat

SEQ ID NO: 48171 - DNA, 25 bp, Mus musculus
aagaggttttgcaaggcccaggcca

SEQ ID NO: 48172 - DNA, 25 bp, Mus musculus
aagaggttttgcagcctctcgacaa

SEQ ID NO: 48173 - DNA, 25 bp, Mus musculus
aagaggttttgctaggcccaggcca

SEQ ID NO: 48174 - DNA, 25 bp, Mus musculus
aagaggttttgctgcctctcgacaa

SEQ ID NO: 48175 - DNA, 25 bp, Mus musculus
aagaggttttgtatcttatggcgct

SEQ ID NO: 48176 - DNA, 25 bp, Mus musculus
aagaggttttgtttcttatggcgct

SEQ ID NO: 48177 - DNA, 25 bp, Mus musculus
aagaggttttttatagtgctgacat

SEQ ID NO: 48178 - DNA, 25 bp, Mus musculus
aagaggttttttttagtgctgacat

SEQ ID NO: 48179 - DNA, 25 bp, Mus musculus
aagagtaaaattcgcctccctctgc

SEQ ID NO: 48180 - DNA, 25 bp, Mus musculus
aagagtaaaattggcctccctctgc

SEQ ID NO: 48181 - DNA, 25 bp, Mus musculus
aagagtaaagacaggagacagctac

SEQ ID NO: 48182 - DNA, 25 bp, Mus musculus
aagagtaaagactggagacagctac

SEQ ID NO: 48183 - DNA, 25 bp, Mus musculus
aagagtaaagtccacttggctgatg

SEQ ID NO: 48184 - DNA, 25 bp, Mus musculus
aagagtaaagtcgacttggctgatg

SEQ ID NO: 48185 - DNA, 25 bp, Mus musculus
aagagtaacgatcccttggactaag

SEQ ID NO: 48186 - DNA, 25 bp, Mus musculus
aagagtaacgatgccttggactaag

SEQ ID NO: 48187 - DNA, 25 bp, Mus musculus
aagagtaagcgaagctcgacaggct

SEQ ID NO: 48188 - DNA, 25 bp, Mus musculus
aagagtaagcgatgctcgacaggct

SEQ ID NO: 48189 - DNA, 25 bp, Mus musculus
aagagtaaggctctcccgatgctgt

SEQ ID NO: 48190 - DNA, 25 bp, Mus musculus
aagagtaaggctgtcccgatgctgt

SEQ ID NO: 48191 - DNA, 25 bp, Mus musculus
aagagtaatcatccttaagaaagag

SEQ ID NO: 48192 - DNA, 25 bp, Mus musculus
aagagtaatcatgcttaagaaagag

SEQ ID NO: 48193 - DNA, 25 bp, Mus musculus
aagagtaattccagttccggcccag

SEQ ID NO: 48194 - DNA, 25 bp, Mus musculus
aagagtaattcctgttccggcccag

SEQ ID NO: 48195 - DNA, 25 bp, Mus musculus
aagagtacaactaccttggattgct

SEQ ID NO: 48196 - DNA, 25 bp, Mus musculus
aagagtacaacttccttggattgct

SEQ ID NO: 48197 - DNA, 25 bp, Mus musculus
aagagtacacctctgtgttgtcact

SEQ ID NO: 48198 - DNA, 25 bp, Mus musculus
aagagtacacctgtgtgttgtcact

SEQ ID NO: 48199 - DNA, 25 bp, Mus musculus
aagagtacagcacccacttaccttg

SEQ ID NO: 48200 - DNA, 25 bp, Mus musculus
aagagtacagcagccacttaccttg

SEQ ID NO: 48201 - DNA, 25 bp, Mus musculus
aagagtacccagcttgtcagcagct

SEQ ID NO: 48202 - DNA, 25 bp, Mus musculus
aagagtacccaggttgtcagcagct

SEQ ID NO: 48203 - DNA, 25 bp, Mus musculus
aagagtaccttaaatcccttctaca

SEQ ID NO: 48204 - DNA, 25 bp, Mus musculus
aagagtaccttatatcccttctaca

SEQ ID NO: 48205 - DNA, 25 bp, Mus musculus
aagagtactgaaaattgtgtcccca

SEQ ID NO: 48206 - DNA, 25 bp, Mus musculus
aagagtactgaatattgtgtcccca

SEQ ID NO: 48207 - DNA, 25 bp, Mus musculus
aagagtactgcaagcttttctcaga

SEQ ID NO: 48208 - DNA, 25 bp, Mus musculus
aagagtactgcatgcttttctcaga

SEQ ID NO: 48209 - DNA, 25 bp, Mus musculus
aagagtactggcactcacatgtgca

SEQ ID NO: 48210 - DNA, 25 bp, Mus musculus
aagagtactggctctcacatgtgca

SEQ ID NO: 48211 - DNA, 25 bp, Mus musculus
aagagtacttacaactcctgcttct

SEQ ID NO: 48212 - DNA, 25 bp, Mus musculus
aagagtacttactactcctgcttct

SEQ ID NO: 48213 - DNA, 25 bp, Mus musculus
aagagtagaccgctacttggagcct

SEQ ID NO: 48214 - DNA, 25 bp, Mus musculus
aagagtagaccgcttgtgttctcac

SEQ ID NO: 48215 - DNA, 25 bp, Mus musculus
aagagtagaccggtacttggagcct

SEQ ID NO: 48216 - DNA, 25 bp, Mus musculus
aagagtagaccggttgtgttctcac

SEQ ID NO: 48217 - DNA, 25 bp, Mus musculus
aagagtagccaaagcccttgactgc

SEQ ID NO: 48218 - DNA, 25 bp, Mus musculus
aagagtagccaatgcccttgactgc

SEQ ID NO: 48219 - DNA, 25 bp, Mus musculus
aagagtagccgcaacatcgcaacac

SEQ ID NO: 48220 - DNA, 25 bp, Mus musculus
aagagtagccgctacatcgcaacac

SEQ ID NO: 48221 - DNA, 25 bp, Mus musculus
aagagtaggctcctgcagttcacag

SEQ ID NO: 48222 - DNA, 25 bp, Mus musculus
aagagtaggctcgtgcagttcacag

SEQ ID NO: 48223 - DNA, 25 bp, Mus musculus
aagagtagtctacaactttgaagaa

SEQ ID NO: 48224 - DNA, 25 bp, Mus musculus
aagagtagtctagaactttgaagaa

SEQ ID NO: 48225 - DNA, 25 bp, Mus musculus
aagagtagtctcatccagcactctc

SEQ ID NO: 48226 - DNA, 25 bp, Mus musculus
aagagtagtctcttccagcactctc

SEQ ID NO: 48227 - DNA, 25 bp, Mus musculus
aagagtagtgctcgtctccgctcag

SEQ ID NO: 48228 - DNA, 25 bp, Mus musculus
aagagtagtgctggtctccgctcag

SEQ ID NO: 48229 - DNA, 25 bp, Mus musculus
aagagtatacatcggcttactttca

SEQ ID NO: 48230 - DNA, 25 bp, Mus musculus
aagagtatacatgggcttactttca

SEQ ID NO: 48231 - DNA, 25 bp, Mus musculus
aagagtatactaaccatgaagcagg

SEQ ID NO: 48232 - DNA, 25 bp, Mus musculus
aagagtatactatccatgaagcagg

SEQ ID NO: 48233 - DNA, 25 bp, Mus musculus
aagagtatactcagccaggcttatg

SEQ ID NO: 48234 - DNA, 25 bp, Mus musculus
aagagtatactctgccaggcttatg

SEQ ID NO: 48235 - DNA, 25 bp, Mus musculus
aagagtatagtcatggccaacagca

SEQ ID NO: 48236 - DNA, 25 bp, Mus musculus
aagagtatagtcttggccaacagca

SEQ ID NO: 48237 - DNA, 25 bp, Mus musculus
aagagtatcactacccttcagggag

SEQ ID NO: 48238 - DNA, 25 bp, Mus musculus
aagagtatcactcttctgaagctaa

SEQ ID NO: 48239 - DNA, 25 bp, Mus musculus
aagagtatcactgttctgaagctaa

SEQ ID NO: 48240 - DNA, 25 bp, Mus musculus
aagagtatcacttcccttcagggag

SEQ ID NO: 48241 - DNA, 25 bp, Mus musculus
aagagtatctcgagagcctcatcaa

SEQ ID NO: 48242 - DNA, 25 bp, Mus musculus
aagagtatctcgtgagcctcatcaa

SEQ ID NO: 48243 - DNA, 25 bp, Mus musculus
aagagtatctgtctgccattcatca

SEQ ID NO: 48244 - DNA, 25 bp, Mus musculus
aagagtatctgtgtgccattcatca

SEQ ID NO: 48245 - DNA, 25 bp, Mus musculus
aagagtatgatacccggcaagcctc

SEQ ID NO: 48246 - DNA, 25 bp, Mus musculus
aagagtatgatagccggcaagcctc

SEQ ID NO: 48247 - DNA, 25 bp, Mus musculus
aagagtatgccacatccgcctggag

SEQ ID NO: 48248 - DNA, 25 bp, Mus musculus
aagagtatgccagatccgcctggag

SEQ ID NO: 48249 - DNA, 25 bp, Mus musculus
aagagtatggtcacttccagccaaa

SEQ ID NO: 48250 - DNA, 25 bp, Mus musculus
aagagtatggtctcttccagccaaa

SEQ ID NO: 48251 - DNA, 25 bp, Mus musculus
aagagtatgtccatccatctcttaa

SEQ ID NO: 48252 - DNA, 25 bp, Mus musculus
aagagtatgtccttccatctcttaa

SEQ ID NO: 48253 - DNA, 25 bp, Mus musculus
aagagtattatgctgctgcttccca

SEQ ID NO: 48254 - DNA, 25 bp, Mus musculus
aagagtattatggtgctgcttccca

SEQ ID NO: 48255 - DNA, 25 bp, Mus musculus
aagagtattcaaagtccttgatcat

SEQ ID NO: 48256 - DNA, 25 bp, Mus musculus
aagagtattcaatgtccttgatcat

SEQ ID NO: 48257 - DNA, 25 bp, Mus musculus
aagagtattctcagctggcttctat

SEQ ID NO: 48258 - DNA, 25 bp, Mus musculus
aagagtattctctgctggcttctat

SEQ ID NO: 48259 - DNA, 25 bp, Mus musculus
aagagtattgctcggtcacgtgaca

SEQ ID NO: 48260 - DNA, 25 bp, Mus musculus
aagagtattgctgggtcacgtgaca

SEQ ID NO: 48261 - DNA, 25 bp, Mus musculus
aagagtcaagtaaggcttcctagcc

SEQ ID NO: 48262 - DNA, 25 bp, Mus musculus
aagagtcaagtatggcttcctagcc

SEQ ID NO: 48263 - DNA, 25 bp, Mus musculus
aagagtcacacacctagtgctcact

SEQ ID NO: 48264 - DNA, 25 bp, Mus musculus
aagagtcacacagctagtgctcact

SEQ ID NO: 48265 - DNA, 25 bp, Mus musculus
aagagtcacactaatgatctagctg

SEQ ID NO: 48266 - DNA, 25 bp, Mus musculus
aagagtcacacttatgatctagctg

SEQ ID NO: 48267 - DNA, 25 bp, Mus musculus
aagagtcaccttacacttcgatgtt

SEQ ID NO: 48268 - DNA, 25 bp, Mus musculus
aagagtcacctttcacttcgatgtt

SEQ ID NO: 48269 - DNA, 25 bp, Mus musculus
aagagtcagatgcaactgtgagcaa

SEQ ID NO: 48270 - DNA, 25 bp, Mus musculus
aagagtcagatggaactgtgagcaa

SEQ ID NO: 48271 - DNA, 25 bp, Mus musculus
aagagtcagcctcacctgacgtgtg

SEQ ID NO: 48272 - DNA, 25 bp, Mus musculus
aagagtcagcctctcagttcttctt

SEQ ID NO: 48273 - DNA, 25 bp, Mus musculus
aagagtcagcctgacctgacgtgtg

SEQ ID NO: 48274 - DNA, 25 bp, Mus musculus
aagagtcagcctgtcagttcttctt

SEQ ID NO: 48275 - DNA, 25 bp, Mus musculus
aagagtcagcttacacgggactcac

SEQ ID NO: 48276 - DNA, 25 bp, Mus musculus
aagagtcagctttcacgggactcac

SEQ ID NO: 48277 - DNA, 25 bp, Mus musculus
aagagtcagggcaactggagccaag

SEQ ID NO: 48278 - DNA, 25 bp, Mus musculus
aagagtcagggccttgtctcagcat

SEQ ID NO: 48279 - DNA, 25 bp, Mus musculus
aagagtcagggcgttgtctcagcat

SEQ ID NO: 48280 - DNA, 25 bp, Mus musculus
aagagtcagggctactggagccaag

SEQ ID NO: 48281 - DNA, 25 bp, Mus musculus
aagagtcagtgacgacgtccctggc

SEQ ID NO: 48282 - DNA, 25 bp, Mus musculus
aagagtcagtgaggacgtccctggc

SEQ ID NO: 48283 - DNA, 25 bp, Mus musculus
aagagtcatatacccctacgcgtgg

SEQ ID NO: 48284 - DNA, 25 bp, Mus musculus
aagagtcatatagccctacgcgtgg

SEQ ID NO: 48285 - DNA, 25 bp, Mus musculus
aagagtcatgctaagttggaatcta

SEQ ID NO: 48286 - DNA, 25 bp, Mus musculus
aagagtcatgcttagttggaatcta

SEQ ID NO: 48287 - DNA, 25 bp, Mus musculus
aagagtccacccctgggaagcaagt

SEQ ID NO: 48288 - DNA, 25 bp, Mus musculus
aagagtccacccgtgggaagcaagt

SEQ ID NO: 48289 - DNA, 25 bp, Mus musculus
aagagtccagaaaggccgtcctcta

SEQ ID NO: 48290 - DNA, 25 bp, Mus musculus
aagagtccagaatggccgtcctcta

SEQ ID NO: 48291 - DNA, 25 bp, Mus musculus
aagagtccagcacatcaacaccgaa

SEQ ID NO: 48292 - DNA, 25 bp, Mus musculus
aagagtccagcagatcaacaccgaa

SEQ ID NO: 48293 - DNA, 25 bp, Mus musculus
aagagtccagggatacaagtccatc

SEQ ID NO: 48294 - DNA, 25 bp, Mus musculus
aagagtccagggttacaagtccatc

SEQ ID NO: 48295 - DNA, 25 bp, Mus musculus
aagagtccagtcacattggtctctg

SEQ ID NO: 48296 - DNA, 25 bp, Mus musculus
aagagtccagtctcattggtctctg

SEQ ID NO: 48297 - DNA, 25 bp, Mus musculus
aagagtccatcaatgcggccgaggg

SEQ ID NO: 48298 - DNA, 25 bp, Mus musculus
aagagtccatcattgcggccgaggg

SEQ ID NO: 48299 - DNA, 25 bp, Mus musculus
aagagtccatccatagcattcaggg

SEQ ID NO: 48300 - DNA, 25 bp, Mus musculus
aagagtccatccttagcattcaggg

SEQ ID NO: 48301 - DNA, 25 bp, Mus musculus
aagagtcccagcaagcagctgactg

SEQ ID NO: 48302 - DNA, 25 bp, Mus musculus
aagagtcccagctagcagctgactg

SEQ ID NO: 48303 - DNA, 25 bp, Mus musculus
aagagtcccaggagtttgatgacct

SEQ ID NO: 48304 - DNA, 25 bp, Mus musculus
aagagtcccaggtgtttgatgacct

SEQ ID NO: 48305 - DNA, 25 bp, Mus musculus
aagagtccccaaataatgatgtcta

SEQ ID NO: 48306 - DNA, 25 bp, Mus musculus
aagagtccccaattaatgatgtcta

SEQ ID NO: 48307 - DNA, 25 bp, Mus musculus
aagagtcccttgaataaaactgaga

SEQ ID NO: 48308 - DNA, 25 bp, Mus musculus
aagagtcccttgtataaaactgaga

SEQ ID NO: 48309 - DNA, 25 bp, Mus musculus
aagagtccgactcgcatttgtggca

SEQ ID NO: 48310 - DNA, 25 bp, Mus musculus
aagagtccgactcttccctgtaaag

SEQ ID NO: 48311 - DNA, 25 bp, Mus musculus
aagagtccgactggcatttgtggca

SEQ ID NO: 48312 - DNA, 25 bp, Mus musculus
aagagtccgactgttccctgtaaag

SEQ ID NO: 48313 - DNA, 25 bp, Mus musculus
aagagtccgcaaagccaaagtcatg

SEQ ID NO: 48314 - DNA, 25 bp, Mus musculus
aagagtccgcaatgccaaagtcatg

SEQ ID NO: 48315 - DNA, 25 bp, Mus musculus
aagagtcctcatcttgagctttcag

SEQ ID NO: 48316 - DNA, 25 bp, Mus musculus
aagagtcctcatgttgagctttcag

SEQ ID NO: 48317 - DNA, 25 bp, Mus musculus
aagagtcctcctcatgtgctcctga

SEQ ID NO: 48318 - DNA, 25 bp, Mus musculus
aagagtcctcctgatgtgctcctga

SEQ ID NO: 48319 - DNA, 25 bp, Mus musculus
aagagtcctcttagagggaccttgt

SEQ ID NO: 48320 - DNA, 25 bp, Mus musculus
aagagtcctcttcgcctactgagaa

SEQ ID NO: 48321 - DNA, 25 bp, Mus musculus
aagagtcctcttggcctactgagaa

SEQ ID NO: 48322 - DNA, 25 bp, Mus musculus
aagagtcctctttgagggaccttgt

SEQ ID NO: 48323 - DNA, 25 bp, Mus musculus
aagagtcctgttccttatctgtggt

SEQ ID NO: 48324 - DNA, 25 bp, Mus musculus
aagagtcctgttctcagctggatca

SEQ ID NO: 48325 - DNA, 25 bp, Mus musculus
aagagtcctgttgcttatctgtggt

SEQ ID NO: 48326 - DNA, 25 bp, Mus musculus
aagagtcctgttgtcagctggatca

SEQ ID NO: 48327 - DNA, 25 bp, Mus musculus
aagagtccttgtccacttctctgag

SEQ ID NO: 48328 - DNA, 25 bp, Mus musculus
aagagtccttgtgcacttctctgag

SEQ ID NO: 48329 - DNA, 25 bp, Mus musculus
aagagtcggaatagacattaccaaa

SEQ ID NO: 48330 - DNA, 25 bp, Mus musculus
aagagtcggaattgacattaccaaa

SEQ ID NO: 48331 - DNA, 25 bp, Mus musculus
aagagtcggcggaacttgtcctagc

SEQ ID NO: 48332 - DNA, 25 bp, Mus musculus
aagagtcggcggtacttgtcctagc

SEQ ID NO: 48333 - DNA, 25 bp, Mus musculus
aagagtcgggacacatctccaggaa

SEQ ID NO: 48334 - DNA, 25 bp, Mus musculus
aagagtcgggactcatctccaggaa

SEQ ID NO: 48335 - DNA, 25 bp, Mus musculus
aagagtcgtcagatcagttccaaaa

SEQ ID NO: 48336 - DNA, 25 bp, Mus musculus
aagagtcgtcagttcagttccaaaa

SEQ ID NO: 48337 - DNA, 25 bp, Mus musculus
aagagtctaaccatctcatggtccc

SEQ ID NO: 48338 - DNA, 25 bp, Mus musculus
aagagtctaaccttctcatggtccc

SEQ ID NO: 48339 - DNA, 25 bp, Mus musculus
aagagtctaatgcagctcctgtcct

SEQ ID NO: 48340 - DNA, 25 bp, Mus musculus
aagagtctaatggagctcctgtcct

SEQ ID NO: 48341 - DNA, 25 bp, Mus musculus
aagagtctaccaaatctcacctctg

SEQ ID NO: 48342 - DNA, 25 bp, Mus musculus
aagagtctaccatatctcacctctg

SEQ ID NO: 48343 - DNA, 25 bp, Mus musculus
aagagtctagctcgctaagaaacca

SEQ ID NO: 48344 - DNA, 25 bp, Mus musculus
aagagtctagctctctggtgggcac

SEQ ID NO: 48345 - DNA, 25 bp, Mus musculus
aagagtctagctggctaagaaacca

SEQ ID NO: 48346 - DNA, 25 bp, Mus musculus
aagagtctagctgtctggtgggcac

SEQ ID NO: 48347 - DNA, 25 bp, Mus musculus
aagagtctatcgctaatcactacaa

SEQ ID NO: 48348 - DNA, 25 bp, Mus musculus
aagagtctatcggtaatcactacaa

SEQ ID NO: 48349 - DNA, 25 bp, Mus musculus
aagagtctcccacagtcatgtcttc

SEQ ID NO: 48350 - DNA, 25 bp, Mus musculus
aagagtctcccagagtcatgtcttc

SEQ ID NO: 48351 - DNA, 25 bp, Mus musculus
aagagtctcgccaacaatggaaaac

SEQ ID NO: 48352 - DNA, 25 bp, Mus musculus
aagagtctcgcctacaatggaaaac

SEQ ID NO: 48353 - DNA, 25 bp, Mus musculus
aagagtctcggtagatttctgtaac

SEQ ID NO: 48354 - DNA, 25 bp, Mus musculus
aagagtctcggttgatttctgtaac

SEQ ID NO: 48355 - DNA, 25 bp, Mus musculus
aagagtctctacatagccttgggta

SEQ ID NO: 48356 - DNA, 25 bp, Mus musculus
aagagtctctacttagccttgggta

SEQ ID NO: 48357 - DNA, 25 bp, Mus musculus
aagagtctctatcctgagctgtcaa

SEQ ID NO: 48358 - DNA, 25 bp, Mus musculus
aagagtctctatgctgagctgtcaa

SEQ ID NO: 48359 - DNA, 25 bp, Mus musculus
aagagtctctccatctgcccaggaa

SEQ ID NO: 48360 - DNA, 25 bp, Mus musculus
aagagtctctccctaatgtacactg

SEQ ID NO: 48361 - DNA, 25 bp, Mus musculus
aagagtctctccgtaatgtacactg

SEQ ID NO: 48362 - DNA, 25 bp, Mus musculus
aagagtctctccttctgcccaggaa

SEQ ID NO: 48363 - DNA, 25 bp, Mus musculus
aagagtctctctccgttggttctga

SEQ ID NO: 48364 - DNA, 25 bp, Mus musculus
aagagtctctctgcgttggttctga

SEQ ID NO: 48365 - DNA, 25 bp, Mus musculus
aagagtctctgcatttgccttaact

SEQ ID NO: 48366 - DNA, 25 bp, Mus musculus
aagagtctctgcttttgccttaact

SEQ ID NO: 48367 - DNA, 25 bp, Mus musculus
aagagtctctggaaattacataaat

SEQ ID NO: 48368 - DNA, 25 bp, Mus musculus
aagagtctctggtaattacataaat

SEQ ID NO: 48369 - DNA, 25 bp, Mus musculus
aagagtctgactaccattgggccag

SEQ ID NO: 48370 - DNA, 25 bp, Mus musculus
aagagtctgacttccattgggccag

SEQ ID NO: 48371 - DNA, 25 bp, Mus musculus
aagagtctgcagctgcttctagcac

SEQ ID NO: 48372 - DNA, 25 bp, Mus musculus
aagagtctgcaggtgcttctagcac

SEQ ID NO: 48373 - DNA, 25 bp, Mus musculus
aagagtctgctgcattctacctttt

SEQ ID NO: 48374 - DNA, 25 bp, Mus musculus
aagagtctgctggattctacctttt

SEQ ID NO: 48375 - DNA, 25 bp, Mus musculus
aagagtctggaacaggccgctcact

SEQ ID NO: 48376 - DNA, 25 bp, Mus musculus
aagagtctggaagaggccgctcact

SEQ ID NO: 48377 - DNA, 25 bp, Mus musculus
aagagtctggccagtattttgtact

SEQ ID NO: 48378 - DNA, 25 bp, Mus musculus
aagagtctggcctgtattttgtact

SEQ ID NO: 48379 - DNA, 25 bp, Mus musculus
aagagtctggtgatgctcctctgga

SEQ ID NO: 48380 - DNA, 25 bp, Mus musculus
aagagtctggtgttgctcctctgga

SEQ ID NO: 48381 - DNA, 25 bp, Mus musculus
aagagtctgtcacactgaggcaggc

SEQ ID NO: 48382 - DNA, 25 bp, Mus musculus
aagagtctgtcagactgaggcaggc

SEQ ID NO: 48383 - DNA, 25 bp, Mus musculus
aagagtctgttcaaatcatcatttt

SEQ ID NO: 48384 - DNA, 25 bp, Mus musculus
aagagtctgttctaatcatcatttt

SEQ ID NO: 48385 - DNA, 25 bp, Mus musculus
aagagtcttgaaacttgaaagagcc

SEQ ID NO: 48386 - DNA, 25 bp, Mus musculus
aagagtcttgaatcttgaaagagcc

SEQ ID NO: 48387 - DNA, 25 bp, Mus musculus
aagagtcttgccatctcttacagag

SEQ ID NO: 48388 - DNA, 25 bp, Mus musculus
aagagtcttgccttctcttacagag

SEQ ID NO: 48389 - DNA, 25 bp, Mus musculus
aagagtcttggtaactgccactttt

SEQ ID NO: 48390 - DNA, 25 bp, Mus musculus
aagagtcttggttactgccactttt

SEQ ID NO: 48391 - DNA, 25 bp, Mus musculus
aagagtcttgtgcacatggcagaat

SEQ ID NO: 48392 - DNA, 25 bp, Mus musculus
aagagtcttgtggacatggcagaat

SEQ ID NO: 48393 - DNA, 25 bp, Mus musculus
aagagtctttggattgcaggagcta

SEQ ID NO: 48394 - DNA, 25 bp, Mus musculus
aagagtctttggtttgcaggagcta

SEQ ID NO: 48395 - DNA, 25 bp, Mus musculus
aagagtcttttgctctggtatccct

SEQ ID NO: 48396 - DNA, 25 bp, Mus musculus
aagagtcttttggtctggtatccct

SEQ ID NO: 48397 - DNA, 25 bp, Mus musculus
aagagtgaaaccagatccacgcctt

SEQ ID NO: 48398 - DNA, 25 bp, Mus musculus
aagagtgaaacctgatccacgcctt

SEQ ID NO: 48399 - DNA, 25 bp, Mus musculus
aagagtgaaatgcagcccagccccg

SEQ ID NO: 48400 - DNA, 25 bp, Mus musculus
aagagtgaaatggagcccagccccg

SEQ ID NO: 48401 - DNA, 25 bp, Mus musculus
aagagtgaacaaaccagactctacc

SEQ ID NO: 48402 - DNA, 25 bp, Mus musculus
aagagtgaacaatccagactctacc

SEQ ID NO: 48403 - DNA, 25 bp, Mus musculus
aagagtgaacccaagcctatttgcc

SEQ ID NO: 48404 - DNA, 25 bp, Mus musculus
aagagtgaacccagtgcctcaagac

SEQ ID NO: 48405 - DNA, 25 bp, Mus musculus
aagagtgaaccctagcctatttgcc

SEQ ID NO: 48406 - DNA, 25 bp, Mus musculus
aagagtgaaccctgtgcctcaagac

SEQ ID NO: 48407 - DNA, 25 bp, Mus musculus
aagagtgaacgtcagctcctattct

SEQ ID NO: 48408 - DNA, 25 bp, Mus musculus
aagagtgaacgtgagctcctattct

SEQ ID NO: 48409 - DNA, 25 bp, Mus musculus
aagagtgaacttccactaggatcct

SEQ ID NO: 48410 - DNA, 25 bp, Mus musculus
aagagtgaacttgcactaggatcct

SEQ ID NO: 48411 - DNA, 25 bp, Mus musculus
aagagtgacagcatccactgatggt

SEQ ID NO: 48412 - DNA, 25 bp, Mus musculus
aagagtgacagcttccactgatggt

SEQ ID NO: 48413 - DNA, 25 bp, Mus musculus
aagagtgactaccaagattccccaa

SEQ ID NO: 48414 - DNA, 25 bp, Mus musculus
aagagtgactacgaagattccccaa

SEQ ID NO: 48415 - DNA, 25 bp, Mus musculus
aagagtgactctaaggcagtcgtat

SEQ ID NO: 48416 - DNA, 25 bp, Mus musculus
aagagtgactcttaggcagtcgtat

SEQ ID NO: 48417 - DNA, 25 bp, Mus musculus
aagagtgagacaagtgctgaggcac

SEQ ID NO: 48418 - DNA, 25 bp, Mus musculus
aagagtgagacatgtgctgaggcac

SEQ ID NO: 48419 - DNA, 25 bp, Mus musculus
aagagtgaggagaactgctcccgca

SEQ ID NO: 48420 - DNA, 25 bp, Mus musculus
aagagtgaggagtactgctcccgca

SEQ ID NO: 48421 - DNA, 25 bp, Mus musculus
aagagtgagttcatgcagcatccag

SEQ ID NO: 48422 - DNA, 25 bp, Mus musculus
aagagtgagttcttgcagcatccag

SEQ ID NO: 48423 - DNA, 25 bp, Mus musculus
aagagtgatcacaaacacccacatg

SEQ ID NO: 48424 - DNA, 25 bp, Mus musculus
aagagtgatcacagttacctcattt

SEQ ID NO: 48425 - DNA, 25 bp, Mus musculus
aagagtgatcactaacacccacatg

SEQ ID NO: 48426 - DNA, 25 bp, Mus musculus
aagagtgatcactgttacctcattt

SEQ ID NO: 48427 - DNA, 25 bp, Mus musculus
aagagtgatcgaaaacccggctgaa

SEQ ID NO: 48428 - DNA, 25 bp, Mus musculus
aagagtgatcgataacccggctgaa

SEQ ID NO: 48429 - DNA, 25 bp, Mus musculus
aagagtgatctacttggaggctgca

SEQ ID NO: 48430 - DNA, 25 bp, Mus musculus
aagagtgatctagttggaggctgca

SEQ ID NO: 48431 - DNA, 25 bp, Mus musculus
aagagtgatctgaccccttgggcag

SEQ ID NO: 48432 - DNA, 25 bp, Mus musculus
aagagtgatctgtccccttgggcag

SEQ ID NO: 48433 - DNA, 25 bp, Mus musculus
aagagtgattgaaccaagtgcagga

SEQ ID NO: 48434 - DNA, 25 bp, Mus musculus
aagagtgattgatccaagtgcagga

SEQ ID NO: 48435 - DNA, 25 bp, Mus musculus
aagagtgcaatgaattgtccaggct

SEQ ID NO: 48436 - DNA, 25 bp, Mus musculus
aagagtgcaatgtattgtccaggct

SEQ ID NO: 48437 - DNA, 25 bp, Mus musculus
aagagtgcactgaaatatatttggt

SEQ ID NO: 48438 - DNA, 25 bp, Mus musculus
aagagtgcactgtaatatatttggt

SEQ ID NO: 48439 - DNA, 25 bp, Mus musculus
aagagtgcaggcaagccgccaagtg

SEQ ID NO: 48440 - DNA, 25 bp, Mus musculus
aagagtgcaggctagccgccaagtg

SEQ ID NO: 48441 - DNA, 25 bp, Mus musculus
aagagtgcagttagtctcctaccat

SEQ ID NO: 48442 - DNA, 25 bp, Mus musculus
aagagtgcagtttgtctcctaccat

SEQ ID NO: 48443 - DNA, 25 bp, Mus musculus
aagagtgcatccaggccagcgtggt

SEQ ID NO: 48444 - DNA, 25 bp, Mus musculus
aagagtgcatcctggccagcgtggt

SEQ ID NO: 48445 - DNA, 25 bp, Mus musculus
aagagtgcatgtcagttgcccctta

SEQ ID NO: 48446 - DNA, 25 bp, Mus musculus
aagagtgcatgtgagttgcccctta

SEQ ID NO: 48447 - DNA, 25 bp, Mus musculus
aagagtgccatacccaggcatgaac

SEQ ID NO: 48448 - DNA, 25 bp, Mus musculus
aagagtgccatagccaggcatgaac

SEQ ID NO: 48449 - DNA, 25 bp, Mus musculus
aagagtgcccttatcagcacacaca

SEQ ID NO: 48450 - DNA, 25 bp, Mus musculus
aagagtgcccttttcagcacacaca

SEQ ID NO: 48451 - DNA, 25 bp, Mus musculus
aagagtgccgcgctgacatggctca

SEQ ID NO: 48452 - DNA, 25 bp, Mus musculus
aagagtgccgcggtgacatggctca

SEQ ID NO: 48453 - DNA, 25 bp, Mus musculus
aagagtgcctaaatttaaaactcag

SEQ ID NO: 48454 - DNA, 25 bp, Mus musculus
aagagtgcctaattttaaaactcag

SEQ ID NO: 48455 - DNA, 25 bp, Mus musculus
aagagtgcctcccaggcggaatcaa

SEQ ID NO: 48456 - DNA, 25 bp, Mus musculus
aagagtgcctccgaggcggaatcaa

SEQ ID NO: 48457 - DNA, 25 bp, Mus musculus
aagagtgcctgcagccttgcagaaa

SEQ ID NO: 48458 - DNA, 25 bp, Mus musculus
aagagtgcctgctgccttgcagaaa

SEQ ID NO: 48459 - DNA, 25 bp, Mus musculus
aagagtgccttgaagaagttaatca

SEQ ID NO: 48460 - DNA, 25 bp, Mus musculus
aagagtgccttgtagaagttaatca

SEQ ID NO: 48461 - DNA, 25 bp, Mus musculus
aagagtgcgcccaggagaaacaagc

SEQ ID NO: 48462 - DNA, 25 bp, Mus musculus
aagagtgcgccctggagaaacaagc

SEQ ID NO: 48463 - DNA, 25 bp, Mus musculus
aagagtgcggacaccctgtgggaca

SEQ ID NO: 48464 - DNA, 25 bp, Mus musculus
aagagtgcggactccctgtgggaca

SEQ ID NO: 48465 - DNA, 25 bp, Mus musculus
aagagtgcgtagagttttctttgca

SEQ ID NO: 48466 - DNA, 25 bp, Mus musculus
aagagtgcgtagtgttttctttgca

SEQ ID NO: 48467 - DNA, 25 bp, Mus musculus
aagagtgcgttcatgtgaccaaaga

SEQ ID NO: 48468 - DNA, 25 bp, Mus musculus
aagagtgcgttcttgtgaccaaaga

SEQ ID NO: 48469 - DNA, 25 bp, Mus musculus
aagagtgctcacctgaacctcagca

SEQ ID NO: 48470 - DNA, 25 bp, Mus musculus
aagagtgctcacgtgaacctcagca

SEQ ID NO: 48471 - DNA, 25 bp, Mus musculus
aagagtgctgtgacatgctggaatt

SEQ ID NO: 48472 - DNA, 25 bp, Mus musculus
aagagtgctgtgtcatgctggaatt

SEQ ID NO: 48473 - DNA, 25 bp, Mus musculus
aagagtgcttgcaggtccagggttt

SEQ ID NO: 48474 - DNA, 25 bp, Mus musculus
aagagtgcttgctggtccagggttt

SEQ ID NO: 48475 - DNA, 25 bp, Mus musculus
aagagtggacatacccaggtccctg

SEQ ID NO: 48476 - DNA, 25 bp, Mus musculus
aagagtggacatatacccagcctct

SEQ ID NO: 48477 - DNA, 25 bp, Mus musculus
aagagtggacattcccaggtccctg

SEQ ID NO: 48478 - DNA, 25 bp, Mus musculus
aagagtggacatttacccagcctct

SEQ ID NO: 48479 - DNA, 25 bp, Mus musculus
aagagtggagtacgtgagacttcaa

SEQ ID NO: 48480 - DNA, 25 bp, Mus musculus
aagagtggagtaggtgagacttcaa

SEQ ID NO: 48481 - DNA, 25 bp, Mus musculus
aagagtggcagaccctacctcatgg

SEQ ID NO: 48482 - DNA, 25 bp, Mus musculus
aagagtggcagagcctacctcatgg

SEQ ID NO: 48483 - DNA, 25 bp, Mus musculus
aagagtggccccaactttctactgt

SEQ ID NO: 48484 - DNA, 25 bp, Mus musculus
aagagtggcccctactttctactgt

SEQ ID NO: 48485 - DNA, 25 bp, Mus musculus
aagagtggcctgcaaagctccagcc

SEQ ID NO: 48486 - DNA, 25 bp, Mus musculus
aagagtggcctggaaagctccagcc

SEQ ID NO: 48487 - DNA, 25 bp, Mus musculus
aagagtggctgaccccacagctctg

SEQ ID NO: 48488 - DNA, 25 bp, Mus musculus
aagagtggctgagcccacagctctg

SEQ ID NO: 48489 - DNA, 25 bp, Mus musculus
aagagtgggaagactcgccccgtag

SEQ ID NO: 48490 - DNA, 25 bp, Mus musculus
aagagtgggaagtctcgccccgtag

SEQ ID NO: 48491 - DNA, 25 bp, Mus musculus
aagagtgggattatgttcaattgcc

SEQ ID NO: 48492 - DNA, 25 bp, Mus musculus
aagagtgggattttgttcaattgcc

SEQ ID NO: 48493 - DNA, 25 bp, Mus musculus
aagagtgggcacacacctttcttag

SEQ ID NO: 48494 - DNA, 25 bp, Mus musculus
aagagtgggcactcacctttcttag

SEQ ID NO: 48495 - DNA, 25 bp, Mus musculus
aagagtgggcagcagctccttccag

SEQ ID NO: 48496 - DNA, 25 bp, Mus musculus
aagagtgggcaggagctccttccag

SEQ ID NO: 48497 - DNA, 25 bp, Mus musculus
aagagtgggccgctgttatgtaaca

SEQ ID NO: 48498 - DNA, 25 bp, Mus musculus
aagagtgggccggtgttatgtaaca

SEQ ID NO: 48499 - DNA, 25 bp, Mus musculus
aagagtgggcgaaggatgtcttcct

SEQ ID NO: 48500 - DNA, 25 bp, Mus musculus
aagagtgggcgatggatgtcttcct

SEQ ID NO: 48501 - DNA, 25 bp, Mus musculus
aagagtgggcttctttgcagtctgt

SEQ ID NO: 48502 - DNA, 25 bp, Mus musculus
aagagtgggcttgtttgcagtctgt

SEQ ID NO: 48503 - DNA, 25 bp, Mus musculus
aagagtggggttaccagcctgcaga

SEQ ID NO: 48504 - DNA, 25 bp, Mus musculus
aagagtggggtttccagcctgcaga

SEQ ID NO: 48505 - DNA, 25 bp, Mus musculus
aagagtgggtaaatgcttggtcgta

SEQ ID NO: 48506 - DNA, 25 bp, Mus musculus
aagagtgggtaattgcttggtcgta

SEQ ID NO: 48507 - DNA, 25 bp, Mus musculus
aagagtgggtatcctagccctacct

SEQ ID NO: 48508 - DNA, 25 bp, Mus musculus
aagagtgggtatgctagccctacct

SEQ ID NO: 48509 - DNA, 25 bp, Mus musculus
aagagtgggtccaccagctcggaga

SEQ ID NO: 48510 - DNA, 25 bp, Mus musculus
aagagtgggtcctccagctcggaga

SEQ ID NO: 48511 - DNA, 25 bp, Mus musculus
aagagtggtctcaccagacttactc

SEQ ID NO: 48512 - DNA, 25 bp, Mus musculus
aagagtggtctctccagacttactc

SEQ ID NO: 48513 - DNA, 25 bp, Mus musculus
aagagtgtacgtcggccttcagaga

SEQ ID NO: 48514 - DNA, 25 bp, Mus musculus
aagagtgtacgtgggccttcagaga

SEQ ID NO: 48515 - DNA, 25 bp, Mus musculus
aagagtgtagttaatggcccagtag

SEQ ID NO: 48516 - DNA, 25 bp, Mus musculus
aagagtgtagtttatggcccagtag

SEQ ID NO: 48517 - DNA, 25 bp, Mus musculus
aagagtgtcactcctggctgtctca

SEQ ID NO: 48518 - DNA, 25 bp, Mus musculus
aagagtgtcactctgaaagccagtg

SEQ ID NO: 48519 - DNA, 25 bp, Mus musculus
aagagtgtcactgctggctgtctca

SEQ ID NO: 48520 - DNA, 25 bp, Mus musculus
aagagtgtcactgtgaaagccagtg

SEQ ID NO: 48521 - DNA, 25 bp, Mus musculus
aagagtgtccctctttccaaagctg

SEQ ID NO: 48522 - DNA, 25 bp, Mus musculus
aagagtgtccctgtttccaaagctg

SEQ ID NO: 48523 - DNA, 25 bp, Mus musculus
aagagtgtcctcctaacagtgctgg

SEQ ID NO: 48524 - DNA, 25 bp, Mus musculus
aagagtgtcctcgtaacagtgctgg

SEQ ID NO: 48525 - DNA, 25 bp, Mus musculus
aagagtgtctatattttccatattc

SEQ ID NO: 48526 - DNA, 25 bp, Mus musculus
aagagtgtctattttttccatattc

SEQ ID NO: 48527 - DNA, 25 bp, Mus musculus
aagagtgtgacgcttctcagctcac

SEQ ID NO: 48528 - DNA, 25 bp, Mus musculus
aagagtgtgacggttctcagctcac

SEQ ID NO: 48529 - DNA, 25 bp, Mus musculus
aagagtgtgactaccctacccagag

SEQ ID NO: 48530 - DNA, 25 bp, Mus musculus
aagagtgtgacttccctacccagag

SEQ ID NO: 48531 - DNA, 25 bp, Mus musculus
aagagtgtgcagagttcgagagacc

SEQ ID NO: 48532 - DNA, 25 bp, Mus musculus
aagagtgtgcagtgttcgagagacc

SEQ ID NO: 48533 - DNA, 25 bp, Mus musculus
aagagtgtggacagaatggagtccc

SEQ ID NO: 48534 - DNA, 25 bp, Mus musculus
aagagtgtggactgaatggagtccc

SEQ ID NO: 48535 - DNA, 25 bp, Mus musculus
aagagtgtggcccatcactgctctg

SEQ ID NO: 48536 - DNA, 25 bp, Mus musculus
aagagtgtggccgatcactgctctg

SEQ ID NO: 48537 - DNA, 25 bp, Mus musculus
aagagtgtggtgagccctggtcact

SEQ ID NO: 48538 - DNA, 25 bp, Mus musculus
aagagtgtggtgtgccctggtcact

SEQ ID NO: 48539 - DNA, 25 bp, Mus musculus
aagagtgtgtcaactttagagtggt

SEQ ID NO: 48540 - DNA, 25 bp, Mus musculus
aagagtgtgtcatctttagagtggt

SEQ ID NO: 48541 - DNA, 25 bp, Mus musculus
aagagtgtgtctcattctgcttgcc

SEQ ID NO: 48542 - DNA, 25 bp, Mus musculus
aagagtgtgtctgattctgcttgcc

SEQ ID NO: 48543 - DNA, 25 bp, Mus musculus
aagagtgtgtgcactccaaacgctg

SEQ ID NO: 48544 - DNA, 25 bp, Mus musculus
aagagtgtgtgctctccaaacgctg

SEQ ID NO: 48545 - DNA, 25 bp, Mus musculus
aagagtgttactccagctaggcctg

SEQ ID NO: 48546 - DNA, 25 bp, Mus musculus
aagagtgttactgcagctaggcctg

SEQ ID NO: 48547 - DNA, 25 bp, Mus musculus
aagagtgttagtatcaccaggcagt

SEQ ID NO: 48548 - DNA, 25 bp, Mus musculus
aagagtgttagtttcaccaggcagt

SEQ ID NO: 48549 - DNA, 25 bp, Mus musculus
aagagtgttcaacaccagaaagaca

SEQ ID NO: 48550 - DNA, 25 bp, Mus musculus
aagagtgttcaagaccagaaagaca

SEQ ID NO: 48551 - DNA, 25 bp, Mus musculus
aagagtgttcttcagccaggcgtgg

SEQ ID NO: 48552 - DNA, 25 bp, Mus musculus
aagagtgttcttccttcacccagag

SEQ ID NO: 48553 - DNA, 25 bp, Mus musculus
aagagtgttcttcgcagggctacct

SEQ ID NO: 48554 - DNA, 25 bp, Mus musculus
aagagtgttcttgagccaggcgtgg

SEQ ID NO: 48555 - DNA, 25 bp, Mus musculus
aagagtgttcttgcttcacccagag

SEQ ID NO: 48556 - DNA, 25 bp, Mus musculus
aagagtgttcttggcagggctacct

SEQ ID NO: 48557 - DNA, 25 bp, Mus musculus
aagagtgttgtcatcacgaatcccc

SEQ ID NO: 48558 - DNA, 25 bp, Mus musculus
aagagtgttgtcttcacgaatcccc

SEQ ID NO: 48559 - DNA, 25 bp, Mus musculus
aagagtgttgttcagccacgctgat

SEQ ID NO: 48560 - DNA, 25 bp, Mus musculus
aagagtgttgttcttctgaccttgg

SEQ ID NO: 48561 - DNA, 25 bp, Mus musculus
aagagtgttgttgagccacgctgat

SEQ ID NO: 48562 - DNA, 25 bp, Mus musculus
aagagtgttgttgttctgaccttgg

SEQ ID NO: 48563 - DNA, 25 bp, Mus musculus
aagagtgtttgccagcactactcct

SEQ ID NO: 48564 - DNA, 25 bp, Mus musculus
aagagtgtttgcgagcactactcct

SEQ ID NO: 48565 - DNA, 25 bp, Mus musculus
aagagtgtttttcatccccatttgg

SEQ ID NO: 48566 - DNA, 25 bp, Mus musculus
aagagtgtttttgatccccatttgg

SEQ ID NO: 48567 - DNA, 25 bp, Mus musculus
aagagttaacacatcctggccaaca

SEQ ID NO: 48568 - DNA, 25 bp, Mus musculus
aagagttaacacttcctggccaaca

SEQ ID NO: 48569 - DNA, 25 bp, Mus musculus
aagagttaacctctcagccggagcc

SEQ ID NO: 48570 - DNA, 25 bp, Mus musculus
aagagttaacctgtcagccggagcc

SEQ ID NO: 48571 - DNA, 25 bp, Mus musculus
aagagttacaacagggccgtcacca

SEQ ID NO: 48572 - DNA, 25 bp, Mus musculus
aagagttacaactgggccgtcacca

SEQ ID NO: 48573 - DNA, 25 bp, Mus musculus
aagagttacagacccctgtggctgc

SEQ ID NO: 48574 - DNA, 25 bp, Mus musculus
aagagttacagagccctgtggctgc

SEQ ID NO: 48575 - DNA, 25 bp, Mus musculus
aagagttaccctctagccaagacta

SEQ ID NO: 48576 - DNA, 25 bp, Mus musculus
aagagttaccctgtagccaagacta

SEQ ID NO: 48577 - DNA, 25 bp, Mus musculus
aagagttactttactgactgtcaag

SEQ ID NO: 48578 - DNA, 25 bp, Mus musculus
aagagttacttttctgactgtcaag

SEQ ID NO: 48579 - DNA, 25 bp, Mus musculus
aagagttagtctctgcctatggcct

SEQ ID NO: 48580 - DNA, 25 bp, Mus musculus
aagagttagtctgtgcctatggcct

SEQ ID NO: 48581 - DNA, 25 bp, Mus musculus
aagagttatctccaagcagcttaga

SEQ ID NO: 48582 - DNA, 25 bp, Mus musculus
aagagttatctcgaagcagcttaga

SEQ ID NO: 48583 - DNA, 25 bp, Mus musculus
aagagttcacccatgccgtagatgt

SEQ ID NO: 48584 - DNA, 25 bp, Mus musculus
aagagttcacccttgccgtagatgt

SEQ ID NO: 48585 - DNA, 25 bp, Mus musculus
aagagttcacgacacaggttcatgt

SEQ ID NO: 48586 - DNA, 25 bp, Mus musculus
aagagttcacgagacaggttcatgt

SEQ ID NO: 48587 - DNA, 25 bp, Mus musculus
aagagttcactcagacttcgagatt

SEQ ID NO: 48588 - DNA, 25 bp, Mus musculus
aagagttcactctgacttcgagatt

SEQ ID NO: 48589 - DNA, 25 bp, Mus musculus
aagagttcagccctgtctattcagc

SEQ ID NO: 48590 - DNA, 25 bp, Mus musculus
aagagttcagccgtgtctattcagc

SEQ ID NO: 48591 - DNA, 25 bp, Mus musculus
aagagttcaggacccagcactacct

SEQ ID NO: 48592 - DNA, 25 bp, Mus musculus
aagagttcaggagccagcactacct

SEQ ID NO: 48593 - DNA, 25 bp, Mus musculus
aagagttcatccaccatagtacata

SEQ ID NO: 48594 - DNA, 25 bp, Mus musculus
aagagttcatcctccatagtacata

SEQ ID NO: 48595 - DNA, 25 bp, Mus musculus
aagagttcatctcgaaccgctagca

SEQ ID NO: 48596 - DNA, 25 bp, Mus musculus
aagagttcatctctccgtcatggaa

SEQ ID NO: 48597 - DNA, 25 bp, Mus musculus
aagagttcatctggaaccgctagca

SEQ ID NO: 48598 - DNA, 25 bp, Mus musculus
aagagttcatctgtccgtcatggaa

SEQ ID NO: 48599 - DNA, 25 bp, Mus musculus
aagagttcatgacgctgcctgagct

SEQ ID NO: 48600 - DNA, 25 bp, Mus musculus
aagagttcatgaggctgcctgagct

SEQ ID NO: 48601 - DNA, 25 bp, Mus musculus
aagagttccaggcagcagcgccaat

SEQ ID NO: 48602 - DNA, 25 bp, Mus musculus
aagagttccagggagcagcgccaat

SEQ ID NO: 48603 - DNA, 25 bp, Mus musculus
aagagttccatcacaccttatggca

SEQ ID NO: 48604 - DNA, 25 bp, Mus musculus
aagagttccatctcaccttatggca

SEQ ID NO: 48605 - DNA, 25 bp, Mus musculus
aagagttccctcatactcagctact

SEQ ID NO: 48606 - DNA, 25 bp, Mus musculus
aagagttccctcttactcagctact

SEQ ID NO: 48607 - DNA, 25 bp, Mus musculus
aagagttcctctccaaggcttcaag

SEQ ID NO: 48608 - DNA, 25 bp, Mus musculus
aagagttcctctgcaaggcttcaag

SEQ ID NO: 48609 - DNA, 25 bp, Mus musculus
aagagttccttgacacctctgtggt

SEQ ID NO: 48610 - DNA, 25 bp, Mus musculus
aagagttccttgcataagccactaa

SEQ ID NO: 48611 - DNA, 25 bp, Mus musculus
aagagttccttggataagccactaa

SEQ ID NO: 48612 - DNA, 25 bp, Mus musculus
aagagttccttgtcacctctgtggt

SEQ ID NO: 48613 - DNA, 25 bp, Mus musculus
aagagttcgtgcaatggcgtaccca

SEQ ID NO: 48614 - DNA, 25 bp, Mus musculus
aagagttcgtgctatggcgtaccca

SEQ ID NO: 48615 - DNA, 25 bp, Mus musculus
aagagttctacacagctgctccggc

SEQ ID NO: 48616 - DNA, 25 bp, Mus musculus
aagagttctacagagctgctccggc

SEQ ID NO: 48617 - DNA, 25 bp, Mus musculus
aagagttctaggaaggcccaatgcc

SEQ ID NO: 48618 - DNA, 25 bp, Mus musculus
aagagttctaggacgggtctctgga

SEQ ID NO: 48619 - DNA, 25 bp, Mus musculus
aagagttctaggactccgagtgccc

SEQ ID NO: 48620 - DNA, 25 bp, Mus musculus
aagagttctaggtaggcccaatgcc

SEQ ID NO: 48621 - DNA, 25 bp, Mus musculus
aagagttctaggtcgggtctctgga

SEQ ID NO: 48622 - DNA, 25 bp, Mus musculus
aagagttctaggtctccgagtgccc

SEQ ID NO: 48623 - DNA, 25 bp, Mus musculus
aagagttctcagaggctgctagggc

SEQ ID NO: 48624 - DNA, 25 bp, Mus musculus
aagagttctcagtggctgctagggc

SEQ ID NO: 48625 - DNA, 25 bp, Mus musculus
aagagttctccaaggtttgagcaga

SEQ ID NO: 48626 - DNA, 25 bp, Mus musculus
aagagttctccatggtttgagcaga

SEQ ID NO: 48627 - DNA, 25 bp, Mus musculus
aagagttctcccagggtatcttcag

SEQ ID NO: 48628 - DNA, 25 bp, Mus musculus
aagagttctccccaccatgttgatc

SEQ ID NO: 48629 - DNA, 25 bp, Mus musculus
aagagttctcccgaccatgttgatc

SEQ ID NO: 48630 - DNA, 25 bp, Mus musculus
aagagttctccctgggtatcttcag

SEQ ID NO: 48631 - DNA, 25 bp, Mus musculus
aagagttctgtgatgttgcagtctc

SEQ ID NO: 48632 - DNA, 25 bp, Mus musculus
aagagttctgtgttgttgcagtctc

SEQ ID NO: 48633 - DNA, 25 bp, Mus musculus
aagagttctgttcccaatggacttc

SEQ ID NO: 48634 - DNA, 25 bp, Mus musculus
aagagttctgttgccaatggacttc

SEQ ID NO: 48635 - DNA, 25 bp, Mus musculus
aagagttcttgcaggaatcccagcc

SEQ ID NO: 48636 - DNA, 25 bp, Mus musculus
aagagttcttgctggaatcccagcc

SEQ ID NO: 48637 - DNA, 25 bp, Mus musculus
aagagttctttgcacaattgtccca

SEQ ID NO: 48638 - DNA, 25 bp, Mus musculus
aagagttctttggacaattgtccca

SEQ ID NO: 48639 - DNA, 25 bp, Mus musculus
aagagttcttttataggacctccag

SEQ ID NO: 48640 - DNA, 25 bp, Mus musculus
aagagttcttttttaggacctccag

SEQ ID NO: 48641 - DNA, 25 bp, Mus musculus
aagagttgaacgcttcggcctccaa

SEQ ID NO: 48642 - DNA, 25 bp, Mus musculus
aagagttgaacggttcggcctccaa

SEQ ID NO: 48643 - DNA, 25 bp, Mus musculus
aagagttgacttaaggtccctgcaa

SEQ ID NO: 48644 - DNA, 25 bp, Mus musculus
aagagttgactttaggtccctgcaa

SEQ ID NO: 48645 - DNA, 25 bp, Mus musculus
aagagttgagcaccttgtccgacag

SEQ ID NO: 48646 - DNA, 25 bp, Mus musculus
aagagttgagcagcttgtccgacag

SEQ ID NO: 48647 - DNA, 25 bp, Mus musculus
aagagttgagccaaggcttccacca

SEQ ID NO: 48648 - DNA, 25 bp, Mus musculus
aagagttgagcctaggcttccacca

SEQ ID NO: 48649 - DNA, 25 bp, Mus musculus
aagagttgccaaagtggtgtccaga

SEQ ID NO: 48650 - DNA, 25 bp, Mus musculus
aagagttgccaatgtggtgtccaga

SEQ ID NO: 48651 - DNA, 25 bp, Mus musculus
aagagttgccttccttcaaacagga

SEQ ID NO: 48652 - DNA, 25 bp, Mus musculus
aagagttgccttcgccctaaagtgg

SEQ ID NO: 48653 - DNA, 25 bp, Mus musculus
aagagttgccttgcttcaaacagga

SEQ ID NO: 48654 - DNA, 25 bp, Mus musculus
aagagttgccttggccctaaagtgg

SEQ ID NO: 48655 - DNA, 25 bp, Mus musculus
aagagttgctgcaccatgtaagact

SEQ ID NO: 48656 - DNA, 25 bp, Mus musculus
aagagttgctgctccatgtaagact

SEQ ID NO: 48657 - DNA, 25 bp, Mus musculus
aagagttgcttcaggcagtggccca

SEQ ID NO: 48658 - DNA, 25 bp, Mus musculus
aagagttgcttcattccatctcgga

SEQ ID NO: 48659 - DNA, 25 bp, Mus musculus
aagagttgcttctggcagtggccca

SEQ ID NO: 48660 - DNA, 25 bp, Mus musculus
aagagttgcttctttccatctcgga

SEQ ID NO: 48661 - DNA, 25 bp, Mus musculus
aagagttgctttctctcgttttgca

SEQ ID NO: 48662 - DNA, 25 bp, Mus musculus
aagagttgctttgtctcgttttgca

SEQ ID NO: 48663 - DNA, 25 bp, Mus musculus
aagagttggccacattcatcttttc

SEQ ID NO: 48664 - DNA, 25 bp, Mus musculus
aagagttggccagattcatcttttc

SEQ ID NO: 48665 - DNA, 25 bp, Mus musculus
aagagttggcgcctttatttgctat

SEQ ID NO: 48666 - DNA, 25 bp, Mus musculus
aagagttggcgcgtttatttgctat

SEQ ID NO: 48667 - DNA, 25 bp, Mus musculus
aagagttggctccaaactgcccgca

SEQ ID NO: 48668 - DNA, 25 bp, Mus musculus
aagagttggctcgaaactgcccgca

SEQ ID NO: 48669 - DNA, 25 bp, Mus musculus
aagagttgggacactccatcagcac

SEQ ID NO: 48670 - DNA, 25 bp, Mus musculus
aagagttgggactctccatcagcac

SEQ ID NO: 48671 - DNA, 25 bp, Mus musculus
aagagttgggatcgagcgcccctac

SEQ ID NO: 48672 - DNA, 25 bp, Mus musculus
aagagttgggatggagcgcccctac

SEQ ID NO: 48673 - DNA, 25 bp, Mus musculus
aagagttgggctactggcttctggc

SEQ ID NO: 48674 - DNA, 25 bp, Mus musculus
aagagttgggcttctggcttctggc

SEQ ID NO: 48675 - DNA, 25 bp, Mus musculus
aagagttggtttctccagggataag

SEQ ID NO: 48676 - DNA, 25 bp, Mus musculus
aagagttggtttgtccagggataag

SEQ ID NO: 48677 - DNA, 25 bp, Mus musculus
aagagttgtagtcccctgtgtgaag

SEQ ID NO: 48678 - DNA, 25 bp, Mus musculus
aagagttgtagtgccctgtgtgaag

SEQ ID NO: 48679 - DNA, 25 bp, Mus musculus
aagagttgtcatatattttccattc

SEQ ID NO: 48680 - DNA, 25 bp, Mus musculus
aagagttgtcatttattttccattc

SEQ ID NO: 48681 - DNA, 25 bp, Mus musculus
aagagttgtgctcctttaccatgag

SEQ ID NO: 48682 - DNA, 25 bp, Mus musculus
aagagttgtgctgctttaccatgag

SEQ ID NO: 48683 - DNA, 25 bp, Mus musculus
aagagttgttctcacatttatcaca

SEQ ID NO: 48684 - DNA, 25 bp, Mus musculus
aagagttgttctcttttgggatcat

SEQ ID NO: 48685 - DNA, 25 bp, Mus musculus
aagagttgttctgacatttatcaca

SEQ ID NO: 48686 - DNA, 25 bp, Mus musculus
aagagttgttctgttttgggatcat

SEQ ID NO: 48687 - DNA, 25 bp, Mus musculus
aagagtttacaactccctgtggcta

SEQ ID NO: 48688 - DNA, 25 bp, Mus musculus
aagagtttacaagtccctgtggcta

SEQ ID NO: 48689 - DNA, 25 bp, Mus musculus
aagagtttagaaccgccccattcat

SEQ ID NO: 48690 - DNA, 25 bp, Mus musculus
aagagtttagaagcgccccattcat

SEQ ID NO: 48691 - DNA, 25 bp, Mus musculus
aagagtttagtacacttcgccagct

SEQ ID NO: 48692 - DNA, 25 bp, Mus musculus
aagagtttagtagacttcgccagct

SEQ ID NO: 48693 - DNA, 25 bp, Mus musculus
aagagtttcaacacctagcctcagc

SEQ ID NO: 48694 - DNA, 25 bp, Mus musculus
aagagtttcaactcctagcctcagc

SEQ ID NO: 48695 - DNA, 25 bp, Mus musculus
aagagtttcagcctgggcagtatcc

SEQ ID NO: 48696 - DNA, 25 bp, Mus musculus
aagagtttcagcgtgggcagtatcc

SEQ ID NO: 48697 - DNA, 25 bp, Mus musculus
aagagtttcctcagcatgagtattt

SEQ ID NO: 48698 - DNA, 25 bp, Mus musculus
aagagtttcctcagccattgtggca

SEQ ID NO: 48699 - DNA, 25 bp, Mus musculus
aagagtttcctctgcatgagtattt

SEQ ID NO: 48700 - DNA, 25 bp, Mus musculus
aagagtttcctctgccattgtggca

SEQ ID NO: 48701 - DNA, 25 bp, Mus musculus
aagagtttccttagaccaggcatgg

SEQ ID NO: 48702 - DNA, 25 bp, Mus musculus
aagagtttcctttgaccaggcatgg

SEQ ID NO: 48703 - DNA, 25 bp, Mus musculus
aagagtttctagatttctgcccaag

SEQ ID NO: 48704 - DNA, 25 bp, Mus musculus
aagagtttctagttttctgcccaag

SEQ ID NO: 48705 - DNA, 25 bp, Mus musculus
aagagtttctctacagctacggaac

SEQ ID NO: 48706 - DNA, 25 bp, Mus musculus
aagagtttctcttcagctacggaac

SEQ ID NO: 48707 - DNA, 25 bp, Mus musculus
aagagtttctgcactggaagtcctc

SEQ ID NO: 48708 - DNA, 25 bp, Mus musculus
aagagtttctgctctggaagtcctc

SEQ ID NO: 48709 - DNA, 25 bp, Mus musculus
aagagtttgcagattcaccagtggg

SEQ ID NO: 48710 - DNA, 25 bp, Mus musculus
aagagtttgcagtttcaccagtggg

SEQ ID NO: 48711 - DNA, 25 bp, Mus musculus
aagagtttggcaacttggacaaggt

SEQ ID NO: 48712 - DNA, 25 bp, Mus musculus
aagagtttggcacaactttgatgta

SEQ ID NO: 48713 - DNA, 25 bp, Mus musculus
aagagtttggcagaactttgatgta

SEQ ID NO: 48714 - DNA, 25 bp, Mus musculus
aagagtttggcatcttggacaaggt

SEQ ID NO: 48715 - DNA, 25 bp, Mus musculus
aagagtttgttaacaattccataaa

SEQ ID NO: 48716 - DNA, 25 bp, Mus musculus
aagagtttgttatcaattccataaa

SEQ ID NO: 48717 - DNA, 25 bp, Mus musculus
aagagtttgttccttggtcagctgg

SEQ ID NO: 48718 - DNA, 25 bp, Mus musculus
aagagtttgttcgttggtcagctgg

SEQ ID NO: 48719 - DNA, 25 bp, Mus musculus
aagagtttgtttacgtgccatggtc

SEQ ID NO: 48720 - DNA, 25 bp, Mus musculus
aagagtttgttttcgtgccatggtc

SEQ ID NO: 48721 - DNA, 25 bp, Mus musculus
aagagttttaaacccacttggactg

SEQ ID NO: 48722 - DNA, 25 bp, Mus musculus
aagagttttaaagccacttggactg

SEQ ID NO: 48723 - DNA, 25 bp, Mus musculus
aagagttttctgctttcagagcaga

SEQ ID NO: 48724 - DNA, 25 bp, Mus musculus
aagagttttctggtttcagagcaga

SEQ ID NO: 48725 - DNA, 25 bp, Mus musculus
aagagttttgagagtcattgcagga

SEQ ID NO: 48726 - DNA, 25 bp, Mus musculus
aagagttttgagtgtcattgcagga

SEQ ID NO: 48727 - DNA, 25 bp, Mus musculus
aagagtttttagcatggagtaccag

SEQ ID NO: 48728 - DNA, 25 bp, Mus musculus
aagagtttttaggatggagtaccag

SEQ ID NO: 48729 - DNA, 25 bp, Mus musculus
aagagtttttgcatggtccatgtgg

SEQ ID NO: 48730 - DNA, 25 bp, Mus musculus
aagagtttttgcttggtccatgtgg

SEQ ID NO: 48731 - DNA, 25 bp, Mus musculus
aagataaacccgatgccgctggagc

SEQ ID NO: 48732 - DNA, 25 bp, Mus musculus
aagataaacccgttgccgctggagc

SEQ ID NO: 48733 - DNA, 25 bp, Mus musculus
aagataaatattaccaccctcctgg

SEQ ID NO: 48734 - DNA, 25 bp, Mus musculus
aagataaatatttccaccctcctgg

SEQ ID NO: 48735 - DNA, 25 bp, Mus musculus
aagataaatgccagagcttccccat

SEQ ID NO: 48736 - DNA, 25 bp, Mus musculus
aagataaatgcctgagcttccccat

SEQ ID NO: 48737 - DNA, 25 bp, Mus musculus
aagataaatggcacacgtagttttg

SEQ ID NO: 48738 - DNA, 25 bp, Mus musculus
aagataaatggctcacgtagttttg

SEQ ID NO: 48739 - DNA, 25 bp, Mus musculus
aagataaattgtcggcttggtgagc

SEQ ID NO: 48740 - DNA, 25 bp, Mus musculus
aagataaattgtgggcttggtgagc

SEQ ID NO: 48741 - DNA, 25 bp, Mus musculus
aagataacaaagacctcaccccact

SEQ ID NO: 48742 - DNA, 25 bp, Mus musculus
aagataacaaagtcctcaccccact

SEQ ID NO: 48743 - DNA, 25 bp, Mus musculus
aagataacagaaccccacccagaaa

SEQ ID NO: 48744 - DNA, 25 bp, Mus musculus
aagataacagaagcccacccagaaa

SEQ ID NO: 48745 - DNA, 25 bp, Mus musculus
aagataacaggaccggaccccattt

SEQ ID NO: 48746 - DNA, 25 bp, Mus musculus
aagataacaggagcggaccccattt

SEQ ID NO: 48747 - DNA, 25 bp, Mus musculus
aagataacccagaagcccggcattt

SEQ ID NO: 48748 - DNA, 25 bp, Mus musculus
aagataacccagtagcccggcattt

SEQ ID NO: 48749 - DNA, 25 bp, Mus musculus
aagataaccttacaccaacatgatt

SEQ ID NO: 48750 - DNA, 25 bp, Mus musculus
aagataaccttagaccaacatgatt

SEQ ID NO: 48751 - DNA, 25 bp, Mus musculus
aagataactatgagtccccgtatgg

SEQ ID NO: 48752 - DNA, 25 bp, Mus musculus
aagataactatgtgtccccgtatgg

SEQ ID NO: 48753 - DNA, 25 bp, Mus musculus
aagataactcaaagctgggcagtgg

SEQ ID NO: 48754 - DNA, 25 bp, Mus musculus
aagataactcaatgctgggcagtgg

SEQ ID NO: 48755 - DNA, 25 bp, Mus musculus
aagataactgacaaccacctaagga

SEQ ID NO: 48756 - DNA, 25 bp, Mus musculus
aagataactgactaccacctaagga

SEQ ID NO: 48757 - DNA, 25 bp, Mus musculus
aagataactgtcacagaggcccctt

SEQ ID NO: 48758 - DNA, 25 bp, Mus musculus
aagataactgtctcagaggcccctt

SEQ ID NO: 48759 - DNA, 25 bp, Mus musculus
aagataactttccagttcccaccat

SEQ ID NO: 48760 - DNA, 25 bp, Mus musculus
aagataactttcgagttcccaccat

SEQ ID NO: 48761 - DNA, 25 bp, Mus musculus
aagataagacaaacgctctccgcta

SEQ ID NO: 48762 - DNA, 25 bp, Mus musculus
aagataagacaacagcgcacccgca

SEQ ID NO: 48763 - DNA, 25 bp, Mus musculus
aagataagacaagagcgcacccgca

SEQ ID NO: 48764 - DNA, 25 bp, Mus musculus
aagataagacaatcgctctccgcta

SEQ ID NO: 48765 - DNA, 25 bp, Mus musculus
aagataagctctaccccgaaatgaa

SEQ ID NO: 48766 - DNA, 25 bp, Mus musculus
aagataagctctaccttcgtcacag

SEQ ID NO: 48767 - DNA, 25 bp, Mus musculus
aagataagctcttccccgaaatgaa

SEQ ID NO: 48768 - DNA, 25 bp, Mus musculus
aagataagctcttccttcgtcacag

SEQ ID NO: 48769 - DNA, 25 bp, Mus musculus
aagataaggctgaccacgatcccca

SEQ ID NO: 48770 - DNA, 25 bp, Mus musculus
aagataaggctgtccacgatcccca

SEQ ID NO: 48771 - DNA, 25 bp, Mus musculus
aagataaggtccagcacttttgttc

SEQ ID NO: 48772 - DNA, 25 bp, Mus musculus
aagataaggtcctgcacttttgttc

SEQ ID NO: 48773 - DNA, 25 bp, Mus musculus
aagataagttctcatggtccctgaa

SEQ ID NO: 48774 - DNA, 25 bp, Mus musculus
aagataagttctgatggtccctgaa

SEQ ID NO: 48775 - DNA, 25 bp, Mus musculus
aagataagtttacgccagatatgga

SEQ ID NO: 48776 - DNA, 25 bp, Mus musculus
aagataagtttaggccagatatgga

SEQ ID NO: 48777 - DNA, 25 bp, Mus musculus
aagataataagccaaggattcacca

SEQ ID NO: 48778 - DNA, 25 bp, Mus musculus
aagataataagcgaaggattcacca

SEQ ID NO: 48779 - DNA, 25 bp, Mus musculus
aagataatcattccacccatttcta

SEQ ID NO: 48780 - DNA, 25 bp, Mus musculus
aagataatcattgcacccatttcta

SEQ ID NO: 48781 - DNA, 25 bp, Mus musculus
aagataatcctgacttacttccatt

SEQ ID NO: 48782 - DNA, 25 bp, Mus musculus
aagataatcctgtcttacttccatt

SEQ ID NO: 48783 - DNA, 25 bp, Mus musculus
aagataatgaccactcccctgagga

SEQ ID NO: 48784 - DNA, 25 bp, Mus musculus
aagataatgacctctcccctgagga

SEQ ID NO: 48785 - DNA, 25 bp, Mus musculus
aagataattgtccaggctgtgggct

SEQ ID NO: 48786 - DNA, 25 bp, Mus musculus
aagataattgtcgaggctgtgggct

SEQ ID NO: 48787 - DNA, 25 bp, Mus musculus
aagatacaagagcactcctcatgtg

SEQ ID NO: 48788 - DNA, 25 bp, Mus musculus
aagatacaagaggactcctcatgtg

SEQ ID NO: 48789 - DNA, 25 bp, Mus musculus
aagatacaagctatctttccggtag

SEQ ID NO: 48790 - DNA, 25 bp, Mus musculus
aagatacaagctttctttccggtag

SEQ ID NO: 48791 - DNA, 25 bp, Mus musculus
aagatacagtaacgtgctttgtcag

SEQ ID NO: 48792 - DNA, 25 bp, Mus musculus
aagatacagtaaggtgctttgtcag

SEQ ID NO: 48793 - DNA, 25 bp, Mus musculus
aagatacagttcatcctcctaaaga

SEQ ID NO: 48794 - DNA, 25 bp, Mus musculus
aagatacagttcttcctcctaaaga

SEQ ID NO: 48795 - DNA, 25 bp, Mus musculus
aagatacataaccttccccatgttg

SEQ ID NO: 48796 - DNA, 25 bp, Mus musculus
aagatacataacgttccccatgttg

SEQ ID NO: 48797 - DNA, 25 bp, Mus musculus
aagatacatggcagagctctctacc

SEQ ID NO: 48798 - DNA, 25 bp, Mus musculus
aagatacatggctgagctctctacc

SEQ ID NO: 48799 - DNA, 25 bp, Mus musculus
aagatacattcaattctcccggaat

SEQ ID NO: 48800 - DNA, 25 bp, Mus musculus
aagatacattcatttctcccggaat

SEQ ID NO: 48801 - DNA, 25 bp, Mus musculus
aagataccagatagccctgtcccag

SEQ ID NO: 48802 - DNA, 25 bp, Mus musculus
aagataccagattgccctgtcccag

SEQ ID NO: 48803 - DNA, 25 bp, Mus musculus
aagataccatgtctggcagtggcca

SEQ ID NO: 48804 - DNA, 25 bp, Mus musculus
aagataccatgtgtggcagtggcca

SEQ ID NO: 48805 - DNA, 25 bp, Mus musculus
aagataccatttctgttacaccctg

SEQ ID NO: 48806 - DNA, 25 bp, Mus musculus
aagataccatttgtgttacaccctg

SEQ ID NO: 48807 - DNA, 25 bp, Mus musculus
aagatacccaaacaacaccttcaga

SEQ ID NO: 48808 - DNA, 25 bp, Mus musculus
aagatacccaaagaacaccttcaga

SEQ ID NO: 48809 - DNA, 25 bp, Mus musculus
aagatacccatacaataatttcagg

SEQ ID NO: 48810 - DNA, 25 bp, Mus musculus
aagatacccatagaataatttcagg

SEQ ID NO: 48811 - DNA, 25 bp, Mus musculus
aagataccctgcatttcagtgctag

SEQ ID NO: 48812 - DNA, 25 bp, Mus musculus
aagataccctgcttttcagtgctag

SEQ ID NO: 48813 - DNA, 25 bp, Mus musculus
aagatacccttaccctttccacatg

SEQ ID NO: 48814 - DNA, 25 bp, Mus musculus
aagatacccttagcctttccacatg

SEQ ID NO: 48815 - DNA, 25 bp, Mus musculus
aagatacctaccaccgctactgggc

SEQ ID NO: 48816 - DNA, 25 bp, Mus musculus
aagatacctacctccgctactgggc

SEQ ID NO: 48817 - DNA, 25 bp, Mus musculus
aagatacctggcatagagcatgcaa

SEQ ID NO: 48818 - DNA, 25 bp, Mus musculus
aagatacctggcttagagcatgcaa

SEQ ID NO: 48819 - DNA, 25 bp, Mus musculus
aagataccttcaaaggaggcagtca

SEQ ID NO: 48820 - DNA, 25 bp, Mus musculus
aagataccttcataggaggcagtca

SEQ ID NO: 48821 - DNA, 25 bp, Mus musculus
aagatacgccaacagagtcaaagaa

SEQ ID NO: 48822 - DNA, 25 bp, Mus musculus
aagatacgccaagagagtcaaagaa

SEQ ID NO: 48823 - DNA, 25 bp, Mus musculus
aagatactacacaacactccttggc

SEQ ID NO: 48824 - DNA, 25 bp, Mus musculus
aagatactacactacactccttggc

SEQ ID NO: 48825 - DNA, 25 bp, Mus musculus
aagatactacccatggaccactacg

SEQ ID NO: 48826 - DNA, 25 bp, Mus musculus
aagatactacccttggaccactacg

SEQ ID NO: 48827 - DNA, 25 bp, Mus musculus
aagatactactaactcagtcccggg

SEQ ID NO: 48828 - DNA, 25 bp, Mus musculus
aagatactactatctcagtcccggg

SEQ ID NO: 48829 - DNA, 25 bp, Mus musculus
aagatactaggtatgtgagcactga

SEQ ID NO: 48830 - DNA, 25 bp, Mus musculus
aagatactaggtttgtgagcactga

SEQ ID NO: 48831 - DNA, 25 bp, Mus musculus
aagatactatgaacctctggagggc

SEQ ID NO: 48832 - DNA, 25 bp, Mus musculus
aagatactatgatcctctggagggc

SEQ ID NO: 48833 - DNA, 25 bp, Mus musculus
aagatactcatgcacacgatgcaaa

SEQ ID NO: 48834 - DNA, 25 bp, Mus musculus
aagatactcatggacacgatgcaaa

SEQ ID NO: 48835 - DNA, 25 bp, Mus musculus
aagatactccggctaccaacgtttg

SEQ ID NO: 48836 - DNA, 25 bp, Mus musculus
aagatactccgggtaccaacgtttg

SEQ ID NO: 48837 - DNA, 25 bp, Mus musculus
aagatactcgatacattgttgcaga

SEQ ID NO: 48838 - DNA, 25 bp, Mus musculus
aagatactcgattcattgttgcaga

SEQ ID NO: 48839 - DNA, 25 bp, Mus musculus
aagatactctggatgctctaagcat

SEQ ID NO: 48840 - DNA, 25 bp, Mus musculus
aagatactctggttgctctaagcat

SEQ ID NO: 48841 - DNA, 25 bp, Mus musculus
aagatactcttaatatggaagcatg

SEQ ID NO: 48842 - DNA, 25 bp, Mus musculus
aagatactcttattatggaagcatg

SEQ ID NO: 48843 - DNA, 25 bp, Mus musculus
aagatactcttcagctactcagtgc

SEQ ID NO: 48844 - DNA, 25 bp, Mus musculus
aagatactcttctgctactcagtgc

SEQ ID NO: 48845 - DNA, 25 bp, Mus musculus
aagatactgataattctcatgactt

SEQ ID NO: 48846 - DNA, 25 bp, Mus musculus
aagatactgatatttctcatgactt

SEQ ID NO: 48847 - DNA, 25 bp, Mus musculus
aagatactgtttcttcctggtctct

SEQ ID NO: 48848 - DNA, 25 bp, Mus musculus
aagatactgtttgttcctggtctct

SEQ ID NO: 48849 - DNA, 25 bp, Mus musculus
aagatacttcccatggcatgtggtt

SEQ ID NO: 48850 - DNA, 25 bp, Mus musculus
aagatacttcccttggcatgtggtt

SEQ ID NO: 48851 - DNA, 25 bp, Mus musculus
aagatacttgacacctcatgcaacg

SEQ ID NO: 48852 - DNA, 25 bp, Mus musculus
aagatacttgactcctcatgcaacg

SEQ ID NO: 48853 - DNA, 25 bp, Mus musculus
aagatacttgttatggaatgctggc

SEQ ID NO: 48854 - DNA, 25 bp, Mus musculus
aagatacttgttttggaatgctggc

SEQ ID NO: 48855 - DNA, 25 bp, Mus musculus
aagatagaaacgagccctgccacat

SEQ ID NO: 48856 - DNA, 25 bp, Mus musculus
aagatagaaacgtgccctgccacat

SEQ ID NO: 48857 - DNA, 25 bp, Mus musculus
aagatagaaccacatcacacagcag

SEQ ID NO: 48858 - DNA, 25 bp, Mus musculus
aagatagaaccagatcacacagcag

SEQ ID NO: 48859 - DNA, 25 bp, Mus musculus
aagatagaatgtaatacgccccggg

SEQ ID NO: 48860 - DNA, 25 bp, Mus musculus
aagatagaatgttatacgccccggg

SEQ ID NO: 48861 - DNA, 25 bp, Mus musculus
aagatagaccctagaaattcagaaa

SEQ ID NO: 48862 - DNA, 25 bp, Mus musculus
aagatagacccttgaaattcagaaa

SEQ ID NO: 48863 - DNA, 25 bp, Mus musculus
aagatagactatacctgaggctaaa

SEQ ID NO: 48864 - DNA, 25 bp, Mus musculus
aagatagactattcctgaggctaaa

SEQ ID NO: 48865 - DNA, 25 bp, Mus musculus
aagatagactccacattctgacacg

SEQ ID NO: 48866 - DNA, 25 bp, Mus musculus
aagatagactcctcattctgacacg

SEQ ID NO: 48867 - DNA, 25 bp, Mus musculus
aagatagcaaagaggtcctagcctc

SEQ ID NO: 48868 - DNA, 25 bp, Mus musculus
aagatagcaaagtggtcctagcctc

SEQ ID NO: 48869 - DNA, 25 bp, Mus musculus
aagatagcatgcacttgagattgtg

SEQ ID NO: 48870 - DNA, 25 bp, Mus musculus
aagatagcatgctcttgagattgtg

SEQ ID NO: 48871 - DNA, 25 bp, Mus musculus
aagatagcctgcaaatagagtgagt

SEQ ID NO: 48872 - DNA, 25 bp, Mus musculus
aagatagcctgctaatagagtgagt

SEQ ID NO: 48873 - DNA, 25 bp, Mus musculus
aagatagcctggaactgatggttgt

SEQ ID NO: 48874 - DNA, 25 bp, Mus musculus
aagatagcctggcagcactgtctct

SEQ ID NO: 48875 - DNA, 25 bp, Mus musculus
aagatagcctgggagcactgtctct

SEQ ID NO: 48876 - DNA, 25 bp, Mus musculus
aagatagcctggtactgatggttgt

SEQ ID NO: 48877 - DNA, 25 bp, Mus musculus
aagatagccttaattctcctgcctg

SEQ ID NO: 48878 - DNA, 25 bp, Mus musculus
aagatagccttatttctcctgcctg

SEQ ID NO: 48879 - DNA, 25 bp, Mus musculus
aagatagccttgacacagattggaa

SEQ ID NO: 48880 - DNA, 25 bp, Mus musculus
aagatagccttgtcacagattggaa

SEQ ID NO: 48881 - DNA, 25 bp, Mus musculus
aagatagctgacatacacgctcccc

SEQ ID NO: 48882 - DNA, 25 bp, Mus musculus
aagatagctgacttacacgctcccc

SEQ ID NO: 48883 - DNA, 25 bp, Mus musculus
aagataggccatattgtcctgctga

SEQ ID NO: 48884 - DNA, 25 bp, Mus musculus
aagataggccattttgtcctgctga

SEQ ID NO: 48885 - DNA, 25 bp, Mus musculus
aagataggccctcaccttgctcttc

SEQ ID NO: 48886 - DNA, 25 bp, Mus musculus
aagataggccctgaccttgctcttc

SEQ ID NO: 48887 - DNA, 25 bp, Mus musculus
aagatagggctgactccaaggccat

SEQ ID NO: 48888 - DNA, 25 bp, Mus musculus
aagatagggctgtctccaaggccat

SEQ ID NO: 48889 - DNA, 25 bp, Mus musculus
aagatagggtgtccctgtactccaa

SEQ ID NO: 48890 - DNA, 25 bp, Mus musculus
aagatagggtgtgcctgtactccaa

SEQ ID NO: 48891 - DNA, 25 bp, Mus musculus
aagataggtccgctgctacagcagg

SEQ ID NO: 48892 - DNA, 25 bp, Mus musculus
aagataggtccggtgctacagcagg

SEQ ID NO: 48893 - DNA, 25 bp, Mus musculus
aagataggtttcagctactagacac

SEQ ID NO: 48894 - DNA, 25 bp, Mus musculus
aagataggtttctgctactagacac

SEQ ID NO: 48895 - DNA, 25 bp, Mus musculus
aagatagtatctctcactggcctga

SEQ ID NO: 48896 - DNA, 25 bp, Mus musculus
aagatagtatctctgcactgggtga

SEQ ID NO: 48897 - DNA, 25 bp, Mus musculus
aagatagtatctgtcactggcctga

SEQ ID NO: 48898 - DNA, 25 bp, Mus musculus
aagatagtatctgtgcactgggtga

SEQ ID NO: 48899 - DNA, 25 bp, Mus musculus
aagatagtcaaaacctaacgatgat

SEQ ID NO: 48900 - DNA, 25 bp, Mus musculus
aagatagtcaaatcctaacgatgat

SEQ ID NO: 48901 - DNA, 25 bp, Mus musculus
aagatagtcctaatgaacatgggta

SEQ ID NO: 48902 - DNA, 25 bp, Mus musculus
aagatagtcctattgaacatgggta

SEQ ID NO: 48903 - DNA, 25 bp, Mus musculus
aagatagtcttgcttaccatctaaa

SEQ ID NO: 48904 - DNA, 25 bp, Mus musculus
aagatagtcttggttaccatctaaa

SEQ ID NO: 48905 - DNA, 25 bp, Mus musculus
aagatagtgaagattctgttgcgaa

SEQ ID NO: 48906 - DNA, 25 bp, Mus musculus
aagatagtgaagtttctgttgcgaa

SEQ ID NO: 48907 - DNA, 25 bp, Mus musculus
aagatagtgagaagggcccctgccg

SEQ ID NO: 48908 - DNA, 25 bp, Mus musculus
aagatagtgagatgggcccctgccg

SEQ ID NO: 48909 - DNA, 25 bp, Mus musculus
aagatagtgggcattttctcatgac

SEQ ID NO: 48910 - DNA, 25 bp, Mus musculus
aagatagtgggctttttctcatgac

SEQ ID NO: 48911 - DNA, 25 bp, Mus musculus
aagatagtgtttccaggccatgagc

SEQ ID NO: 48912 - DNA, 25 bp, Mus musculus
aagatagtgtttgcaggccatgagc

SEQ ID NO: 48913 - DNA, 25 bp, Mus musculus
aagatagttgtccttgtcaaaccaa

SEQ ID NO: 48914 - DNA, 25 bp, Mus musculus
aagatagttgtcgttgtcaaaccaa

SEQ ID NO: 48915 - DNA, 25 bp, Mus musculus
aagatatacacactgtacttataaa

SEQ ID NO: 48916 - DNA, 25 bp, Mus musculus
aagatatacacagtgtacttataaa

SEQ ID NO: 48917 - DNA, 25 bp, Mus musculus
aagatatacactcaccctattggtt

SEQ ID NO: 48918 - DNA, 25 bp, Mus musculus
aagatatacactgaccctattggtt

SEQ ID NO: 48919 - DNA, 25 bp, Mus musculus
aagatataccccaggatctaggaag

SEQ ID NO: 48920 - DNA, 25 bp, Mus musculus
aagatatacccctggatctaggaag

SEQ ID NO: 48921 - DNA, 25 bp, Mus musculus
aagatatactgaacctaaaaccaag

SEQ ID NO: 48922 - DNA, 25 bp, Mus musculus
aagatatactgatcctaaaaccaag

SEQ ID NO: 48923 - DNA, 25 bp, Mus musculus
aagatatattcgagtcaaggaccaa

SEQ ID NO: 48924 - DNA, 25 bp, Mus musculus
aagatatattcgtgtcaaggaccaa

SEQ ID NO: 48925 - DNA, 25 bp, Mus musculus
aagatatatttgaccagtacagaga

SEQ ID NO: 48926 - DNA, 25 bp, Mus musculus
aagatatatttgtccagtacagaga

SEQ ID NO: 48927 - DNA, 25 bp, Mus musculus
aagatatcaatgagtcccctacacc

SEQ ID NO: 48928 - DNA, 25 bp, Mus musculus
aagatatcaatgtgtcccctacacc

SEQ ID NO: 48929 - DNA, 25 bp, Mus musculus
aagatatcagtgaccctttctggcc

SEQ ID NO: 48930 - DNA, 25 bp, Mus musculus
aagatatcagtgtccctttctggcc

SEQ ID NO: 48931 - DNA, 25 bp, Mus musculus
aagatatccatgctgctattgccac

SEQ ID NO: 48932 - DNA, 25 bp, Mus musculus
aagatatccatggtgctattgccac

SEQ ID NO: 48933 - DNA, 25 bp, Mus musculus
aagatatcgtccactctgtaccagg

SEQ ID NO: 48934 - DNA, 25 bp, Mus musculus
aagatatcgtcctctctgtaccagg

SEQ ID NO: 48935 - DNA, 25 bp, Mus musculus
aagatatctcacctactgacggtgg

SEQ ID NO: 48936 - DNA, 25 bp, Mus musculus
aagatatctcacgtactgacggtgg

SEQ ID NO: 48937 - DNA, 25 bp, Mus musculus
aagatatctcgcagtacccatggtg

SEQ ID NO: 48938 - DNA, 25 bp, Mus musculus
aagatatctcgctgtacccatggtg

SEQ ID NO: 48939 - DNA, 25 bp, Mus musculus
aagatatctcttaaagcccaccact

SEQ ID NO: 48940 - DNA, 25 bp, Mus musculus
aagatatctctttaagcccaccact

SEQ ID NO: 48941 - DNA, 25 bp, Mus musculus
aagatatctggaaccttctatgccc

SEQ ID NO: 48942 - DNA, 25 bp, Mus musculus
aagatatctggatccttctatgccc

SEQ ID NO: 48943 - DNA, 25 bp, Mus musculus
aagatatgacccaacccttatctca

SEQ ID NO: 48944 - DNA, 25 bp, Mus musculus
aagatatgaccctacccttatctca

SEQ ID NO: 48945 - DNA, 25 bp, Mus musculus
aagatatgacctatgtgatcactag

SEQ ID NO: 48946 - DNA, 25 bp, Mus musculus
aagatatgacctttgtgatcactag

SEQ ID NO: 48947 - DNA, 25 bp, Mus musculus
aagatatgcattcccttttcctctg

SEQ ID NO: 48948 - DNA, 25 bp, Mus musculus
aagatatgcattgccttttcctctg

SEQ ID NO: 48949 - DNA, 25 bp, Mus musculus
aagatatgtcctatctaccctgaat

SEQ ID NO: 48950 - DNA, 25 bp, Mus musculus
aagatatgtcctttctaccctgaat

SEQ ID NO: 48951 - DNA, 25 bp, Mus musculus
aagatattagctatcaccatgtcta

SEQ ID NO: 48952 - DNA, 25 bp, Mus musculus
aagatattagctttcaccatgtcta

SEQ ID NO: 48953 - DNA, 25 bp, Mus musculus
aagatattattactggccgggtgtg

SEQ ID NO: 48954 - DNA, 25 bp, Mus musculus
aagatattattagtggccgggtgtg

SEQ ID NO: 48955 - DNA, 25 bp, Mus musculus
aagatattcataagctagttgggtc

SEQ ID NO: 48956 - DNA, 25 bp, Mus musculus
aagatattcatatgctagttgggtc

SEQ ID NO: 48957 - DNA, 25 bp, Mus musculus
aagatattcgctctacagtcacaga

SEQ ID NO: 48958 - DNA, 25 bp, Mus musculus
aagatattcgctgtacagtcacaga

SEQ ID NO: 48959 - DNA, 25 bp, Mus musculus
aagatattgttcactggctacagtc

SEQ ID NO: 48960 - DNA, 25 bp, Mus musculus
aagatattgttctctggctacagtc

SEQ ID NO: 48961 - DNA, 25 bp, Mus musculus
aagatatttgtcaccacggctgtgt

SEQ ID NO: 48962 - DNA, 25 bp, Mus musculus
aagatatttgtctccacggctgtgt

SEQ ID NO: 48963 - DNA, 25 bp, Mus musculus
aagatcaaacagcattgccgcttct

SEQ ID NO: 48964 - DNA, 25 bp, Mus musculus
aagatcaaacaggattgccgcttct

SEQ ID NO: 48965 - DNA, 25 bp, Mus musculus
aagatcaaacctaccagccggtgta

SEQ ID NO: 48966 - DNA, 25 bp, Mus musculus
aagatcaaaccttccagccggtgta

SEQ ID NO: 48967 - DNA, 25 bp, Mus musculus
aagatcaaagatcgcttctcactgt

SEQ ID NO: 48968 - DNA, 25 bp, Mus musculus
aagatcaaagatggcttctcactgt

SEQ ID NO: 48969 - DNA, 25 bp, Mus musculus
aagatcaaccctagactctcagaga

SEQ ID NO: 48970 - DNA, 25 bp, Mus musculus
aagatcaacccttgactctcagaga

SEQ ID NO: 48971 - DNA, 25 bp, Mus musculus
aagatcaacctgaaaactggccatt

SEQ ID NO: 48972 - DNA, 25 bp, Mus musculus
aagatcaacctgtaaactggccatt

SEQ ID NO: 48973 - DNA, 25 bp, Mus musculus
aagatcaactctaaccacttcttac

SEQ ID NO: 48974 - DNA, 25 bp, Mus musculus
aagatcaactcttaccacttcttac

SEQ ID NO: 48975 - DNA, 25 bp, Mus musculus
aagatcaagagcaaaggatcggaga

SEQ ID NO: 48976 - DNA, 25 bp, Mus musculus
aagatcaagagctaaggatcggaga

SEQ ID NO: 48977 - DNA, 25 bp, Mus musculus
aagatcaagctgactaccctcctag

SEQ ID NO: 48978 - DNA, 25 bp, Mus musculus
aagatcaagctgtctaccctcctag

SEQ ID NO: 48979 - DNA, 25 bp, Mus musculus
aagatcaagtcacctacgggaggga

SEQ ID NO: 48980 - DNA, 25 bp, Mus musculus
aagatcaagtcagctacgggaggga

SEQ ID NO: 48981 - DNA, 25 bp, Mus musculus
aagatcaatcagaccatcgtctgga

SEQ ID NO: 48982 - DNA, 25 bp, Mus musculus
aagatcaatcagtccatcgtctgga

SEQ ID NO: 48983 - DNA, 25 bp, Mus musculus
aagatcaatgtgattaagagataac

SEQ ID NO: 48984 - DNA, 25 bp, Mus musculus
aagatcaatgtgtttaagagataac

SEQ ID NO: 48985 - DNA, 25 bp, Mus musculus
aagatcaatgttacgggaattcccg

SEQ ID NO: 48986 - DNA, 25 bp, Mus musculus
aagatcaatgtttcgggaattcccg

SEQ ID NO: 48987 - DNA, 25 bp, Mus musculus
aagatcacacagatgccagcccaga

SEQ ID NO: 48988 - DNA, 25 bp, Mus musculus
aagatcacacagttgccagcccaga

SEQ ID NO: 48989 - DNA, 25 bp, Mus musculus
aagatcacagacaagagagccccac

SEQ ID NO: 48990 - DNA, 25 bp, Mus musculus
aagatcacagacagttggccccctg

SEQ ID NO: 48991 - DNA, 25 bp, Mus musculus
aagatcacagactagagagccccac

SEQ ID NO: 48992 - DNA, 25 bp, Mus musculus
aagatcacagactgttggccccctg

SEQ ID NO: 48993 - DNA, 25 bp, Mus musculus
aagatcacaggaactctctgtctcc

SEQ ID NO: 48994 - DNA, 25 bp, Mus musculus
aagatcacaggatctctctgtctcc

SEQ ID NO: 48995 - DNA, 25 bp, Mus musculus
aagatcacagtgcttccaacttaaa

SEQ ID NO: 48996 - DNA, 25 bp, Mus musculus
aagatcacagtggttccaacttaaa

SEQ ID NO: 48997 - DNA, 25 bp, Mus musculus
aagatcacatcaactctttctctcc

SEQ ID NO: 48998 - DNA, 25 bp, Mus musculus
aagatcacatcatctctttctctcc

SEQ ID NO: 48999 - DNA, 25 bp, Mus musculus
aagatcacatggagcttggcttctc

SEQ ID NO: 49000 - DNA, 25 bp, Mus musculus
aagatcacatggtgcttggcttctc

SEQ ID NO: 49001 - DNA, 25 bp, Mus musculus
aagatcacattgacctcacagtagg

SEQ ID NO: 49002 - DNA, 25 bp, Mus musculus
aagatcacattgtcctcacagtagg

SEQ ID NO: 49003 - DNA, 25 bp, Mus musculus
aagatcaccaccaggacgctgaagg

SEQ ID NO: 49004 - DNA, 25 bp, Mus musculus
aagatcaccacctggacgctgaagg

SEQ ID NO: 49005 - DNA, 25 bp, Mus musculus
aagatcaccccacagtgaggcggta

SEQ ID NO: 49006 - DNA, 25 bp, Mus musculus
aagatcaccccagagtgaggcggta

SEQ ID NO: 49007 - DNA, 25 bp, Mus musculus
aagatcacccttcaatgtctaccac

SEQ ID NO: 49008 - DNA, 25 bp, Mus musculus
aagatcacccttgaatgtctaccac

SEQ ID NO: 49009 - DNA, 25 bp, Mus musculus
aagatcacctgtctagctctgcagt

SEQ ID NO: 49010 - DNA, 25 bp, Mus musculus
aagatcacctgtgtagctctgcagt

SEQ ID NO: 49011 - DNA, 25 bp, Mus musculus
aagatcacgtgcatgtgccaggttc

SEQ ID NO: 49012 - DNA, 25 bp, Mus musculus
aagatcacgtgcttgtgccaggttc

SEQ ID NO: 49013 - DNA, 25 bp, Mus musculus
aagatcactacacttgttcaacata

SEQ ID NO: 49014 - DNA, 25 bp, Mus musculus
aagatcactacagttgttcaacata

SEQ ID NO: 49015 - DNA, 25 bp, Mus musculus
aagatcactcagcttccagccatgg

SEQ ID NO: 49016 - DNA, 25 bp, Mus musculus
aagatcactcaggttccagccatgg

SEQ ID NO: 49017 - DNA, 25 bp, Mus musculus
aagatcagaaccagaagcccttcct

SEQ ID NO: 49018 - DNA, 25 bp, Mus musculus
aagatcagaacctgaagcccttcct

SEQ ID NO: 49019 - DNA, 25 bp, Mus musculus
aagatcagaggccaccaggtactgt

SEQ ID NO: 49020 - DNA, 25 bp, Mus musculus
aagatcagaggcgaccaggtactgt

SEQ ID NO: 49021 - DNA, 25 bp, Mus musculus
aagatcagagtgaccgcctggagtc

SEQ ID NO: 49022 - DNA, 25 bp, Mus musculus
aagatcagagtgtccgcctggagtc

SEQ ID NO: 49023 - DNA, 25 bp, Mus musculus
aagatcagatcccagatccgtctgt

SEQ ID NO: 49024 - DNA, 25 bp, Mus musculus
aagatcagatccgagatccgtctgt

SEQ ID NO: 49025 - DNA, 25 bp, Mus musculus
aagatcagcaccctggtgagctcca

SEQ ID NO: 49026 - DNA, 25 bp, Mus musculus
aagatcagcaccgtggtgagctcca

SEQ ID NO: 49027 - DNA, 25 bp, Mus musculus
aagatcagcagtagccgggcatggt

SEQ ID NO: 49028 - DNA, 25 bp, Mus musculus
aagatcagcagttgccgggcatggt

SEQ ID NO: 49029 - DNA, 25 bp, Mus musculus
aagatcagccaaaactcccagcatg

SEQ ID NO: 49030 - DNA, 25 bp, Mus musculus
aagatcagccaatactcccagcatg

SEQ ID NO: 49031 - DNA, 25 bp, Mus musculus
aagatcagccggaaacccctagcag

SEQ ID NO: 49032 - DNA, 25 bp, Mus musculus
aagatcagccggtaacccctagcag

SEQ ID NO: 49033 - DNA, 25 bp, Mus musculus
aagatcagcctgaaccttatctgcc

SEQ ID NO: 49034 - DNA, 25 bp, Mus musculus
aagatcagcctgtaccttatctgcc

SEQ ID NO: 49035 - DNA, 25 bp, Mus musculus
aagatcagctgtctcttttcccctt

SEQ ID NO: 49036 - DNA, 25 bp, Mus musculus
aagatcagctgtgtcttttcccctt

SEQ ID NO: 49037 - DNA, 25 bp, Mus musculus
aagatcaggaccacaaggttagcct

SEQ ID NO: 49038 - DNA, 25 bp, Mus musculus
aagatcaggacctcaaggttagcct

SEQ ID NO: 49039 - DNA, 25 bp, Mus musculus
aagatcaggaggcaatagagctaca

SEQ ID NO: 49040 - DNA, 25 bp, Mus musculus
aagatcaggagggaatagagctaca

SEQ ID NO: 49041 - DNA, 25 bp, Mus musculus
aagatcagggtcacagtgcctgccc

SEQ ID NO: 49042 - DNA, 25 bp, Mus musculus
aagatcagggtctcagtgcctgccc

SEQ ID NO: 49043 - DNA, 25 bp, Mus musculus
aagatcagtggacaccagctgctac

SEQ ID NO: 49044 - DNA, 25 bp, Mus musculus
aagatcagtggagaccagctgctac

SEQ ID NO: 49045 - DNA, 25 bp, Mus musculus
aagatcatactgcaatcgagagcat

SEQ ID NO: 49046 - DNA, 25 bp, Mus musculus
aagatcatactggaatcgagagcat

SEQ ID NO: 49047 - DNA, 25 bp, Mus musculus
aagatcatatttattatacaggtat

SEQ ID NO: 49048 - DNA, 25 bp, Mus musculus
aagatcatattttttatacaggtat

SEQ ID NO: 49049 - DNA, 25 bp, Mus musculus
aagatcatcaccagcgcggctgcaa

SEQ ID NO: 49050 - DNA, 25 bp, Mus musculus
aagatcatcaccatgactttcccgg

SEQ ID NO: 49051 - DNA, 25 bp, Mus musculus
aagatcatcacctgcgcggctgcaa

SEQ ID NO: 49052 - DNA, 25 bp, Mus musculus
aagatcatcaccttgactttcccgg

SEQ ID NO: 49053 - DNA, 25 bp, Mus musculus
aagatcatcagaccagactggagca

SEQ ID NO: 49054 - DNA, 25 bp, Mus musculus
aagatcatcagagcagactggagca

SEQ ID NO: 49055 - DNA, 25 bp, Mus musculus
aagatcatcattcgtgtgcagacca

SEQ ID NO: 49056 - DNA, 25 bp, Mus musculus
aagatcatcattggtgtgcagacca

SEQ ID NO: 49057 - DNA, 25 bp, Mus musculus
aagatcatccgcatccagagttctg

SEQ ID NO: 49058 - DNA, 25 bp, Mus musculus
aagatcatccgcttccagagttctg

SEQ ID NO: 49059 - DNA, 25 bp, Mus musculus
aagatcatccggcaccccaattata

SEQ ID NO: 49060 - DNA, 25 bp, Mus musculus
aagatcatccgggaccccaattata

SEQ ID NO: 49061 - DNA, 25 bp, Mus musculus
aagatcatccgtcgcttaacagcaa

SEQ ID NO: 49062 - DNA, 25 bp, Mus musculus
aagatcatccgtggcttaacagcaa

SEQ ID NO: 49063 - DNA, 25 bp, Mus musculus
aagatcatcttccaggacgaccggt

SEQ ID NO: 49064 - DNA, 25 bp, Mus musculus
aagatcatcttcgaggacgaccggt

SEQ ID NO: 49065 - DNA, 25 bp, Mus musculus
aagatcatgcctagaaaccgcgtca

SEQ ID NO: 49066 - DNA, 25 bp, Mus musculus
aagatcatgccttgaaaccgcgtca

SEQ ID NO: 49067 - DNA, 25 bp, Mus musculus
aagatcatgctcctgcagctgaatc

SEQ ID NO: 49068 - DNA, 25 bp, Mus musculus
aagatcatgctcgtgcagctgaatc

SEQ ID NO: 49069 - DNA, 25 bp, Mus musculus
aagatcatggatccagcggtgatat

SEQ ID NO: 49070 - DNA, 25 bp, Mus musculus
aagatcatggatgcagcggtgatat

SEQ ID NO: 49071 - DNA, 25 bp, Mus musculus
aagatcatggtactgcagcctgcgg

SEQ ID NO: 49072 - DNA, 25 bp, Mus musculus
aagatcatggtagtgcagcctgcgg

SEQ ID NO: 49073 - DNA, 25 bp, Mus musculus
aagatcatgtctcaaggtggcactt

SEQ ID NO: 49074 - DNA, 25 bp, Mus musculus
aagatcatgtctgaaggtggcactt

SEQ ID NO: 49075 - DNA, 25 bp, Mus musculus
aagatcattacaatctcatcacccg

SEQ ID NO: 49076 - DNA, 25 bp, Mus musculus
aagatcattacattctcatcacccg

SEQ ID NO: 49077 - DNA, 25 bp, Mus musculus
aagatcattggtcttcactgctcca

SEQ ID NO: 49078 - DNA, 25 bp, Mus musculus
aagatcattggtgttcactgctcca

SEQ ID NO: 49079 - DNA, 25 bp, Mus musculus
aagatccaagataacacctccattc

SEQ ID NO: 49080 - DNA, 25 bp, Mus musculus
aagatccaagattacacctccattc

SEQ ID NO: 49081 - DNA, 25 bp, Mus musculus
aagatccaagcaccggaatcgtaga

SEQ ID NO: 49082 - DNA, 25 bp, Mus musculus
aagatccaagcagcggaatcgtaga

SEQ ID NO: 49083 - DNA, 25 bp, Mus musculus
aagatccacctactttttcagctga

SEQ ID NO: 49084 - DNA, 25 bp, Mus musculus
aagatccacctagtttttcagctga

SEQ ID NO: 49085 - DNA, 25 bp, Mus musculus
aagatccactacacaccgaaactgc

SEQ ID NO: 49086 - DNA, 25 bp, Mus musculus
aagatccactactcaccgaaactgc

SEQ ID NO: 49087 - DNA, 25 bp, Mus musculus
aagatccactgaagtttgctcccag

SEQ ID NO: 49088 - DNA, 25 bp, Mus musculus
aagatccactgatgtttgctcccag

SEQ ID NO: 49089 - DNA, 25 bp, Mus musculus
aagatccactgcatctcaacaacag

SEQ ID NO: 49090 - DNA, 25 bp, Mus musculus
aagatccactgcttctcaacaacag

SEQ ID NO: 49091 - DNA, 25 bp, Mus musculus
aagatccactttagacattccacta

SEQ ID NO: 49092 - DNA, 25 bp, Mus musculus
aagatccacttttgacattccacta

SEQ ID NO: 49093 - DNA, 25 bp, Mus musculus
aagatccagagtagacttatgagta

SEQ ID NO: 49094 - DNA, 25 bp, Mus musculus
aagatccagagttgacttatgagta

SEQ ID NO: 49095 - DNA, 25 bp, Mus musculus
aagatccagattaattttgcttgag

SEQ ID NO: 49096 - DNA, 25 bp, Mus musculus
aagatccagattcagaggccccagg

SEQ ID NO: 49097 - DNA, 25 bp, Mus musculus
aagatccagattgagaggccccagg

SEQ ID NO: 49098 - DNA, 25 bp, Mus musculus
aagatccagatttattttgcttgag

SEQ ID NO: 49099 - DNA, 25 bp, Mus musculus
aagatccaggatagcttcaatgagg

SEQ ID NO: 49100 - DNA, 25 bp, Mus musculus
aagatccaggattgcttcaatgagg

SEQ ID NO: 49101 - DNA, 25 bp, Mus musculus
aagatccaggctaaaatccccggcg

SEQ ID NO: 49102 - DNA, 25 bp, Mus musculus
aagatccaggcttaaatccccggcg

SEQ ID NO: 49103 - DNA, 25 bp, Mus musculus
aagatccagtttacggtcccgctgc

SEQ ID NO: 49104 - DNA, 25 bp, Mus musculus
aagatccagttttcggtcccgctgc

SEQ ID NO: 49105 - DNA, 25 bp, Mus musculus
aagatccataaaccctatgatcatc

SEQ ID NO: 49106 - DNA, 25 bp, Mus musculus
aagatccataaagcctatgatcatc

SEQ ID NO: 49107 - DNA, 25 bp, Mus musculus
aagatccatggccagactcattctc

SEQ ID NO: 49108 - DNA, 25 bp, Mus musculus
aagatccatggcgagactcattctc

SEQ ID NO: 49109 - DNA, 25 bp, Mus musculus
aagatccattacaaatgccaagaag

SEQ ID NO: 49110 - DNA, 25 bp, Mus musculus
aagatccattactaatgccaagaag

SEQ ID NO: 49111 - DNA, 25 bp, Mus musculus
aagatcccaattcagtactaccata

SEQ ID NO: 49112 - DNA, 25 bp, Mus musculus
aagatcccaattgagtactaccata

SEQ ID NO: 49113 - DNA, 25 bp, Mus musculus
aagatcccagacaactgccaggagc

SEQ ID NO: 49114 - DNA, 25 bp, Mus musculus
aagatcccagactactgccaggagc

SEQ ID NO: 49115 - DNA, 25 bp, Mus musculus
aagatcccaggacccttgagatgtt

SEQ ID NO: 49116 - DNA, 25 bp, Mus musculus
aagatcccaggagccttgagatgtt

SEQ ID NO: 49117 - DNA, 25 bp, Mus musculus
aagatccccatcatcaatgagtggc

SEQ ID NO: 49118 - DNA, 25 bp, Mus musculus
aagatccccatcttcaatgagtggc

SEQ ID NO: 49119 - DNA, 25 bp, Mus musculus
aagatccccgagcagtcccagcttg

SEQ ID NO: 49120 - DNA, 25 bp, Mus musculus
aagatccccgaggagtcccagcttg

SEQ ID NO: 49121 - DNA, 25 bp, Mus musculus
aagatccccgcccgtggactgcaga

SEQ ID NO: 49122 - DNA, 25 bp, Mus musculus
aagatccccgccggtggactgcaga

SEQ ID NO: 49123 - DNA, 25 bp, Mus musculus
aagatcccctagctagctggaggta

SEQ ID NO: 49124 - DNA, 25 bp, Mus musculus
aagatcccctaggtagctggaggta

SEQ ID NO: 49125 - DNA, 25 bp, Mus musculus
aagatcccctctaatagtccaataa

SEQ ID NO: 49126 - DNA, 25 bp, Mus musculus
aagatcccctcttatagtccaataa

SEQ ID NO: 49127 - DNA, 25 bp, Mus musculus
aagatcccgtacaaggtggtggcac

SEQ ID NO: 49128 - DNA, 25 bp, Mus musculus
aagatcccgtactaggtggtggcac

SEQ ID NO: 49129 - DNA, 25 bp, Mus musculus
aagatccctaaaactctttttatgt

SEQ ID NO: 49130 - DNA, 25 bp, Mus musculus
aagatccctaaatctctttttatgt

SEQ ID NO: 49131 - DNA, 25 bp, Mus musculus
aagatccctcagcacttcattctag

SEQ ID NO: 49132 - DNA, 25 bp, Mus musculus
aagatccctcaggacttcattctag

SEQ ID NO: 49133 - DNA, 25 bp, Mus musculus
aagatccctgatccaagctggccgc

SEQ ID NO: 49134 - DNA, 25 bp, Mus musculus
aagatccctgatgcaagctggccgc

SEQ ID NO: 49135 - DNA, 25 bp, Mus musculus
aagatccctgcacaccgataccggg

SEQ ID NO: 49136 - DNA, 25 bp, Mus musculus
aagatccctgcagaccgataccggg

SEQ ID NO: 49137 - DNA, 25 bp, Mus musculus
aagatccctggcattgctgacctgc

SEQ ID NO: 49138 - DNA, 25 bp, Mus musculus
aagatccctggctttgctgacctgc

SEQ ID NO: 49139 - DNA, 25 bp, Mus musculus
aagatccctgttcagtctaacctta

SEQ ID NO: 49140 - DNA, 25 bp, Mus musculus
aagatccctgttgagtctaacctta

SEQ ID NO: 49141 - DNA, 25 bp, Mus musculus
aagatcccttagatcgtcgctgaat

SEQ ID NO: 49142 - DNA, 25 bp, Mus musculus
aagatcccttagttcgtcgctgaat

SEQ ID NO: 49143 - DNA, 25 bp, Mus musculus
aagatcccttgtaaatatccaccaa

SEQ ID NO: 49144 - DNA, 25 bp, Mus musculus
aagatcccttgttaatatccaccaa

SEQ ID NO: 49145 - DNA, 25 bp, Mus musculus
aagatccctttaattctgcggtcaa

SEQ ID NO: 49146 - DNA, 25 bp, Mus musculus
aagatccctttatttctgcggtcaa

SEQ ID NO: 49147 - DNA, 25 bp, Mus musculus
aagatccgaacacagcggtcgacat

SEQ ID NO: 49148 - DNA, 25 bp, Mus musculus
aagatccgaacagagcggtcgacat

SEQ ID NO: 49149 - DNA, 25 bp, Mus musculus
aagatccgaagtctctcagaacgcc

SEQ ID NO: 49150 - DNA, 25 bp, Mus musculus
aagatccgaagtgtctcagaacgcc

SEQ ID NO: 49151 - DNA, 25 bp, Mus musculus
aagatccgctacagcgacgtgaaga

SEQ ID NO: 49152 - DNA, 25 bp, Mus musculus
aagatccgctactgcgacgtgaaga

SEQ ID NO: 49153 - DNA, 25 bp, Mus musculus
aagatccgggacaccttggtgtacg

SEQ ID NO: 49154 - DNA, 25 bp, Mus musculus
aagatccgggactccttggtgtacg

SEQ ID NO: 49155 - DNA, 25 bp, Mus musculus
aagatccggttgatcatgtcatgag

SEQ ID NO: 49156 - DNA, 25 bp, Mus musculus
aagatccggttgttcatgtcatgag

SEQ ID NO: 49157 - DNA, 25 bp, Mus musculus
aagatccgtattacctattgtgaac

SEQ ID NO: 49158 - DNA, 25 bp, Mus musculus
aagatccgtatttcctattgtgaac

SEQ ID NO: 49159 - DNA, 25 bp, Mus musculus
aagatccgtgcactgtccgctttct

SEQ ID NO: 49160 - DNA, 25 bp, Mus musculus
aagatccgtgcagtgtccgctttct

SEQ ID NO: 49161 - DNA, 25 bp, Mus musculus
aagatccgtttccatgacctccaag

SEQ ID NO: 49162 - DNA, 25 bp, Mus musculus
aagatccgtttcgatgacctccaag

SEQ ID NO: 49163 - DNA, 25 bp, Mus musculus
aagatcctagccagctttcgagaaa

SEQ ID NO: 49164 - DNA, 25 bp, Mus musculus
aagatcctagcctgctttcgagaaa

SEQ ID NO: 49165 - DNA, 25 bp, Mus musculus
aagatcctagctcaaaagagacgtc

SEQ ID NO: 49166 - DNA, 25 bp, Mus musculus
aagatcctagctgaaaagagacgtc

SEQ ID NO: 49167 - DNA, 25 bp, Mus musculus
aagatcctagttattgtagcggtag

SEQ ID NO: 49168 - DNA, 25 bp, Mus musculus
aagatcctagtttttgtagcggtag

SEQ ID NO: 49169 - DNA, 25 bp, Mus musculus
aagatcctataactggccctctgac

SEQ ID NO: 49170 - DNA, 25 bp, Mus musculus
aagatcctataagtggccctctgac

SEQ ID NO: 49171 - DNA, 25 bp, Mus musculus
aagatcctcaacagctcagcctggg

SEQ ID NO: 49172 - DNA, 25 bp, Mus musculus
aagatcctcaactgctcagcctggg

SEQ ID NO: 49173 - DNA, 25 bp, Mus musculus
aagatcctcaagctcctatttcagt

SEQ ID NO: 49174 - DNA, 25 bp, Mus musculus
aagatcctcaaggtcctatttcagt

SEQ ID NO: 49175 - DNA, 25 bp, Mus musculus
aagatcctctatactgcgccgcgat

SEQ ID NO: 49176 - DNA, 25 bp, Mus musculus
aagatcctctatcggcagaaccgac

SEQ ID NO: 49177 - DNA, 25 bp, Mus musculus
aagatcctctatgggcagaaccgac

SEQ ID NO: 49178 - DNA, 25 bp, Mus musculus
aagatcctctattctgcgccgcgat

SEQ ID NO: 49179 - DNA, 25 bp, Mus musculus
aagatcctctcgctaaatggccaag

SEQ ID NO: 49180 - DNA, 25 bp, Mus musculus
aagatcctctcggtaaatggccaag

SEQ ID NO: 49181 - DNA, 25 bp, Mus musculus
aagatcctctggactggtagtggca

SEQ ID NO: 49182 - DNA, 25 bp, Mus musculus
aagatcctctggacttagcttcggg

SEQ ID NO: 49183 - DNA, 25 bp, Mus musculus
aagatcctctggtctggtagtggca

SEQ ID NO: 49184 - DNA, 25 bp, Mus musculus
aagatcctctggtcttagcttcggg

SEQ ID NO: 49185 - DNA, 25 bp, Mus musculus
aagatcctgacccagcgtggctaca

SEQ ID NO: 49186 - DNA, 25 bp, Mus musculus
aagatcctgaccgagcgtggctaca

SEQ ID NO: 49187 - DNA, 25 bp, Mus musculus
aagatcctgaggcacaggtgcagca

SEQ ID NO: 49188 - DNA, 25 bp, Mus musculus
aagatcctgagggacaggtgcagca

SEQ ID NO: 49189 - DNA, 25 bp, Mus musculus
aagatcctgcacacacacttggtcg

SEQ ID NO: 49190 - DNA, 25 bp, Mus musculus
aagatcctgcactcacacttggtcg

SEQ ID NO: 49191 - DNA, 25 bp, Mus musculus
aagatcctgcctagcgcacatgcgt

SEQ ID NO: 49192 - DNA, 25 bp, Mus musculus
aagatcctgccttgcgcacatgcgt

SEQ ID NO: 49193 - DNA, 25 bp, Mus musculus
aagatcctggcacactctatcgaac

SEQ ID NO: 49194 - DNA, 25 bp, Mus musculus
aagatcctggcagactctatcgaac

SEQ ID NO: 49195 - DNA, 25 bp, Mus musculus
aagatcctggccactaagtcataga

SEQ ID NO: 49196 - DNA, 25 bp, Mus musculus
aagatcctggcctctaagtcataga

SEQ ID NO: 49197 - DNA, 25 bp, Mus musculus
aagatcctgggaagcctcctcagtt

SEQ ID NO: 49198 - DNA, 25 bp, Mus musculus
aagatcctgggactggtttttctgg

SEQ ID NO: 49199 - DNA, 25 bp, Mus musculus
aagatcctgggagtggtttttctgg

SEQ ID NO: 49200 - DNA, 25 bp, Mus musculus
aagatcctgggatgcctcctcagtt

SEQ ID NO: 49201 - DNA, 25 bp, Mus musculus
aagatcctggtgatcgccatcgtgt

SEQ ID NO: 49202 - DNA, 25 bp, Mus musculus
aagatcctggtgttcgccatcgtgt

SEQ ID NO: 49203 - DNA, 25 bp, Mus musculus
aagatcctgtctagcatctcttgtc

SEQ ID NO: 49204 - DNA, 25 bp, Mus musculus
aagatcctgtcttgcatctcttgtc

SEQ ID NO: 49205 - DNA, 25 bp, Mus musculus
aagatcctgtgaagttattatggca

SEQ ID NO: 49206 - DNA, 25 bp, Mus musculus
aagatcctgtgatgttattatggca

SEQ ID NO: 49207 - DNA, 25 bp, Mus musculus
aagatcctgttcaagcaactaccac

SEQ ID NO: 49208 - DNA, 25 bp, Mus musculus
aagatcctgttctagcaactaccac

SEQ ID NO: 49209 - DNA, 25 bp, Mus musculus
aagatccttaacatgttgaccttat

SEQ ID NO: 49210 - DNA, 25 bp, Mus musculus
aagatccttaacttgttgaccttat

SEQ ID NO: 49211 - DNA, 25 bp, Mus musculus
aagatccttccacatcgccaaagga

SEQ ID NO: 49212 - DNA, 25 bp, Mus musculus
aagatccttccagatcgccaaagga

SEQ ID NO: 49213 - DNA, 25 bp, Mus musculus
aagatccttcttctaggcctgaggt

SEQ ID NO: 49214 - DNA, 25 bp, Mus musculus
aagatccttcttgtaggcctgaggt

SEQ ID NO: 49215 - DNA, 25 bp, Mus musculus
aagatccttgatcaaccgtttccaa

SEQ ID NO: 49216 - DNA, 25 bp, Mus musculus
aagatccttgatgaaccgtttccaa

SEQ ID NO: 49217 - DNA, 25 bp, Mus musculus
aagatccttggcacttgggttctca

SEQ ID NO: 49218 - DNA, 25 bp, Mus musculus
aagatccttggctcttgggttctca

SEQ ID NO: 49219 - DNA, 25 bp, Mus musculus
aagatcgaaatgagtacccagaaga

SEQ ID NO: 49220 - DNA, 25 bp, Mus musculus
aagatcgaaatgtgtacccagaaga

SEQ ID NO: 49221 - DNA, 25 bp, Mus musculus
aagatcgaccaaagggagctttcct

SEQ ID NO: 49222 - DNA, 25 bp, Mus musculus
aagatcgaccaatgggagctttcct

SEQ ID NO: 49223 - DNA, 25 bp, Mus musculus
aagatcgaccacatcctggatgctc

SEQ ID NO: 49224 - DNA, 25 bp, Mus musculus
aagatcgaccacttcctggatgctc

SEQ ID NO: 49225 - DNA, 25 bp, Mus musculus
aagatcgactatctttcctggtgaa

SEQ ID NO: 49226 - DNA, 25 bp, Mus musculus
aagatcgactatgtttcctggtgaa

SEQ ID NO: 49227 - DNA, 25 bp, Mus musculus
aagatcgagataacccactgatgag

SEQ ID NO: 49228 - DNA, 25 bp, Mus musculus
aagatcgagatatcccactgatgag

SEQ ID NO: 49229 - DNA, 25 bp, Mus musculus
aagatcgagcgcagcctagccagca

SEQ ID NO: 49230 - DNA, 25 bp, Mus musculus
aagatcgagcgctgcctagccagca

SEQ ID NO: 49231 - DNA, 25 bp, Mus musculus
aagatcgagtctccatgttaccctt

SEQ ID NO: 49232 - DNA, 25 bp, Mus musculus
aagatcgagtctgcatgttaccctt

SEQ ID NO: 49233 - DNA, 25 bp, Mus musculus
aagatcgatctcccgcaagccagag

SEQ ID NO: 49234 - DNA, 25 bp, Mus musculus
aagatcgatctcgcgcaagccagag

SEQ ID NO: 49235 - DNA, 25 bp, Mus musculus
aagatcgatgtaataacgaccccga

SEQ ID NO: 49236 - DNA, 25 bp, Mus musculus
aagatcgatgtattaacgaccccga

SEQ ID NO: 49237 - DNA, 25 bp, Mus musculus
aagatcgcctttaacgctggcctca

SEQ ID NO: 49238 - DNA, 25 bp, Mus musculus
aagatcgccttttacgctggcctca

SEQ ID NO: 49239 - DNA, 25 bp, Mus musculus
aagatcgcgccgcattattgctgca

SEQ ID NO: 49240 - DNA, 25 bp, Mus musculus
aagatcgcgccggattattgctgca

SEQ ID NO: 49241 - DNA, 25 bp, Mus musculus
aagatcggaaggactcagccaggaa

SEQ ID NO: 49242 - DNA, 25 bp, Mus musculus
aagatcggaaggtctcagccaggaa

SEQ ID NO: 49243 - DNA, 25 bp, Mus musculus
aagatcgtcatccagtgttcaaagc

SEQ ID NO: 49244 - DNA, 25 bp, Mus musculus
aagatcgtcatcgagtgttcaaagc

SEQ ID NO: 49245 - DNA, 25 bp, Mus musculus
aagatcgtcattaccttggtttctg

SEQ ID NO: 49246 - DNA, 25 bp, Mus musculus
aagatcgtcatttccttggtttctg

SEQ ID NO: 49247 - DNA, 25 bp, Mus musculus
aagatcgtctcaatcatctgtcgtc

SEQ ID NO: 49248 - DNA, 25 bp, Mus musculus
aagatcgtctcattcatctgtcgtc

SEQ ID NO: 49249 - DNA, 25 bp, Mus musculus
aagatcgtggcaagatcacagccgg

SEQ ID NO: 49250 - DNA, 25 bp, Mus musculus
aagatcgtggcatgatcacagccgg

SEQ ID NO: 49251 - DNA, 25 bp, Mus musculus
aagatcgttcagatctaccactgca

SEQ ID NO: 49252 - DNA, 25 bp, Mus musculus
aagatcgttcagttctaccactgca

SEQ ID NO: 49253 - DNA, 25 bp, Mus musculus
aagatctaactgaggcgaactggaa

SEQ ID NO: 49254 - DNA, 25 bp, Mus musculus
aagatctaactgtggcgaactggaa

SEQ ID NO: 49255 - DNA, 25 bp, Mus musculus
aagatctacaatcatgcttgacctt

SEQ ID NO: 49256 - DNA, 25 bp, Mus musculus
aagatctacaatgatgcttgacctt

SEQ ID NO: 49257 - DNA, 25 bp, Mus musculus
aagatctacatccatcgggttggcc

SEQ ID NO: 49258 - DNA, 25 bp, Mus musculus
aagatctacatcgatcgggttggcc

SEQ ID NO: 49259 - DNA, 25 bp, Mus musculus
aagatctacctactgtacttcccat

SEQ ID NO: 49260 - DNA, 25 bp, Mus musculus
aagatctacctagtgtacttcccat

SEQ ID NO: 49261 - DNA, 25 bp, Mus musculus
aagatctacggtacccacgcattgc

SEQ ID NO: 49262 - DNA, 25 bp, Mus musculus
aagatctacggttcccacgcattgc

SEQ ID NO: 49263 - DNA, 25 bp, Mus musculus
aagatctactccatagctgttccat

SEQ ID NO: 49264 - DNA, 25 bp, Mus musculus
aagatctactccttagctgttccat

SEQ ID NO: 49265 - DNA, 25 bp, Mus musculus
aagatctactgaacagaaattttgg

SEQ ID NO: 49266 - DNA, 25 bp, Mus musculus
aagatctactgatcagaaattttgg

SEQ ID NO: 49267 - DNA, 25 bp, Mus musculus
aagatctataggacaatttcccaga

SEQ ID NO: 49268 - DNA, 25 bp, Mus musculus
aagatctataggtcaatttcccaga

SEQ ID NO: 49269 - DNA, 25 bp, Mus musculus
aagatctatcccatcgtactcgatt

SEQ ID NO: 49270 - DNA, 25 bp, Mus musculus
aagatctatcccttcgtactcgatt

SEQ ID NO: 49271 - DNA, 25 bp, Mus musculus
aagatctatctaaaaatgttcccag

SEQ ID NO: 49272 - DNA, 25 bp, Mus musculus
aagatctatctataaatgttcccag

SEQ ID NO: 49273 - DNA, 25 bp, Mus musculus
aagatctatggcagcgcaggcccct

SEQ ID NO: 49274 - DNA, 25 bp, Mus musculus
aagatctatggctgcgcaggcccct

SEQ ID NO: 49275 - DNA, 25 bp, Mus musculus
aagatctatgtaacatatacagagc

SEQ ID NO: 49276 - DNA, 25 bp, Mus musculus
aagatctatgtatcatatacagagc

SEQ ID NO: 49277 - DNA, 25 bp, Mus musculus
aagatctatttcctggtttcccaga

SEQ ID NO: 49278 - DNA, 25 bp, Mus musculus
aagatctatttcgtggtttcccaga

SEQ ID NO: 49279 - DNA, 25 bp, Mus musculus
aagatctcactcaatcttggctggc

SEQ ID NO: 49280 - DNA, 25 bp, Mus musculus
aagatctcactctatcttggctggc

SEQ ID NO: 49281 - DNA, 25 bp, Mus musculus
aagatctcagacatcggcatggcga

SEQ ID NO: 49282 - DNA, 25 bp, Mus musculus
aagatctcagacttcggcatggcga

SEQ ID NO: 49283 - DNA, 25 bp, Mus musculus
aagatctcagcacaatagagccgct

SEQ ID NO: 49284 - DNA, 25 bp, Mus musculus
aagatctcagcagaatagagccgct

SEQ ID NO: 49285 - DNA, 25 bp, Mus musculus
aagatctcaggtctctatctccatt

SEQ ID NO: 49286 - DNA, 25 bp, Mus musculus
aagatctcaggtgtctatctccatt

SEQ ID NO: 49287 - DNA, 25 bp, Mus musculus
aagatctcatctacagactgcattc

SEQ ID NO: 49288 - DNA, 25 bp, Mus musculus
aagatctcatcttcagactgcattc

SEQ ID NO: 49289 - DNA, 25 bp, Mus musculus
aagatctccaggcacactttggctc

SEQ ID NO: 49290 - DNA, 25 bp, Mus musculus
aagatctccagggacactttggctc

SEQ ID NO: 49291 - DNA, 25 bp, Mus musculus
aagatctccagtatcgtgttttgtt

SEQ ID NO: 49292 - DNA, 25 bp, Mus musculus
aagatctccagtttcgtgttttgtt

SEQ ID NO: 49293 - DNA, 25 bp, Mus musculus
aagatctccattcttagctgctcag

SEQ ID NO: 49294 - DNA, 25 bp, Mus musculus
aagatctccattgttagctgctcag

SEQ ID NO: 49295 - DNA, 25 bp, Mus musculus
aagatctccgacatggttgcttttc

SEQ ID NO: 49296 - DNA, 25 bp, Mus musculus
aagatctccgacttggttgcttttc

SEQ ID NO: 49297 - DNA, 25 bp, Mus musculus
aagatctccgcaacagaagacagca

SEQ ID NO: 49298 - DNA, 25 bp, Mus musculus
aagatctccgcatcagaagacagca

SEQ ID NO: 49299 - DNA, 25 bp, Mus musculus
aagatctcctttcagatcaccgagg

SEQ ID NO: 49300 - DNA, 25 bp, Mus musculus
aagatctcctttccggaagcaagca

SEQ ID NO: 49301 - DNA, 25 bp, Mus musculus
aagatctcctttgagatcaccgagg

SEQ ID NO: 49302 - DNA, 25 bp, Mus musculus
aagatctcctttgcggaagcaagca

SEQ ID NO: 49303 - DNA, 25 bp, Mus musculus
aagatctcgattccctggatcagca

SEQ ID NO: 49304 - DNA, 25 bp, Mus musculus
aagatctcgattgcctggatcagca

SEQ ID NO: 49305 - DNA, 25 bp, Mus musculus
aagatctctactctcagtggtgact

SEQ ID NO: 49306 - DNA, 25 bp, Mus musculus
aagatctctactgtcagtggtgact

SEQ ID NO: 49307 - DNA, 25 bp, Mus musculus
aagatctctaggctccagtgaggac

SEQ ID NO: 49308 - DNA, 25 bp, Mus musculus
aagatctctagggtccagtgaggac

SEQ ID NO: 49309 - DNA, 25 bp, Mus musculus
aagatctctctaacattttcatccc

SEQ ID NO: 49310 - DNA, 25 bp, Mus musculus
aagatctctctatcattttcatccc

SEQ ID NO: 49311 - DNA, 25 bp, Mus musculus
aagatctctggacttgggcttcttc

SEQ ID NO: 49312 - DNA, 25 bp, Mus musculus
aagatctctggagttgggcttcttc

SEQ ID NO: 49313 - DNA, 25 bp, Mus musculus
aagatctctgtcacggtgggattcc

SEQ ID NO: 49314 - DNA, 25 bp, Mus musculus
aagatctctgtctcggtgggattcc

SEQ ID NO: 49315 - DNA, 25 bp, Mus musculus
aagatctctgtgcagttcaaaatgt

SEQ ID NO: 49316 - DNA, 25 bp, Mus musculus
aagatctctgtggagttcaaaatgt

SEQ ID NO: 49317 - DNA, 25 bp, Mus musculus
aagatctcttctatctagttaagtt

SEQ ID NO: 49318 - DNA, 25 bp, Mus musculus
aagatctcttctttctagttaagtt

SEQ ID NO: 49319 - DNA, 25 bp, Mus musculus
aagatctgaaatccaaacctcaccc

SEQ ID NO: 49320 - DNA, 25 bp, Mus musculus
aagatctgaaatgcaaacctcaccc

SEQ ID NO: 49321 - DNA, 25 bp, Mus musculus
aagatctgaatgaccgagagagtgt

SEQ ID NO: 49322 - DNA, 25 bp, Mus musculus
aagatctgaatgtccgagagagtgt

SEQ ID NO: 49323 - DNA, 25 bp, Mus musculus
aagatctgaattctgctcccattag

SEQ ID NO: 49324 - DNA, 25 bp, Mus musculus
aagatctgaattgtgctcccattag

SEQ ID NO: 49325 - DNA, 25 bp, Mus musculus
aagatctgacatcctttctggcctc

SEQ ID NO: 49326 - DNA, 25 bp, Mus musculus
aagatctgacatgctttctggcctc

SEQ ID NO: 49327 - DNA, 25 bp, Mus musculus
aagatctgacctaaggcctccaaat

SEQ ID NO: 49328 - DNA, 25 bp, Mus musculus
aagatctgaccttaggcctccaaat

SEQ ID NO: 49329 - DNA, 25 bp, Mus musculus
aagatctgaggcactgggctcttga

SEQ ID NO: 49330 - DNA, 25 bp, Mus musculus
aagatctgaggctctgggctcttga

SEQ ID NO: 49331 - DNA, 25 bp, Mus musculus
aagatctgaggtatacaggtcacac

SEQ ID NO: 49332 - DNA, 25 bp, Mus musculus
aagatctgaggtttacaggtcacac

SEQ ID NO: 49333 - DNA, 25 bp, Mus musculus
aagatctgagtcagggtccccaaga

SEQ ID NO: 49334 - DNA, 25 bp, Mus musculus
aagatctgagtctgggtccccaaga

SEQ ID NO: 49335 - DNA, 25 bp, Mus musculus
aagatctgatcccatcgtctgcaaa

SEQ ID NO: 49336 - DNA, 25 bp, Mus musculus
aagatctgatccgatcgtctgcaaa

SEQ ID NO: 49337 - DNA, 25 bp, Mus musculus
aagatctgatctctccgtggttaaa

SEQ ID NO: 49338 - DNA, 25 bp, Mus musculus
aagatctgatctgtccgtggttaaa

SEQ ID NO: 49339 - DNA, 25 bp, Mus musculus
aagatctgatgtactgtgttttaac

SEQ ID NO: 49340 - DNA, 25 bp, Mus musculus
aagatctgatgttctgtgttttaac

SEQ ID NO: 49341 - DNA, 25 bp, Mus musculus
aagatctgccccatcctttttcgga

SEQ ID NO: 49342 - DNA, 25 bp, Mus musculus
aagatctgccccttcctttttcgga

SEQ ID NO: 49343 - DNA, 25 bp, Mus musculus
aagatctgctgcaccgatgggaacc

SEQ ID NO: 49344 - DNA, 25 bp, Mus musculus
aagatctgctgctccgatgggaacc

SEQ ID NO: 49345 - DNA, 25 bp, Mus musculus
aagatctgcttaatcaaccctctgt

SEQ ID NO: 49346 - DNA, 25 bp, Mus musculus
aagatctgcttattcaaccctctgt

SEQ ID NO: 49347 - DNA, 25 bp, Mus musculus
aagatctggaagaaaccctccctgg

SEQ ID NO: 49348 - DNA, 25 bp, Mus musculus
aagatctggaagtaaccctccctgg

SEQ ID NO: 49349 - DNA, 25 bp, Mus musculus
aagatctggctgaagttgcttcgct

SEQ ID NO: 49350 - DNA, 25 bp, Mus musculus
aagatctggctgtagttgcttcgct

SEQ ID NO: 49351 - DNA, 25 bp, Mus musculus
aagatctgggaccacttccacatgt

SEQ ID NO: 49352 - DNA, 25 bp, Mus musculus
aagatctgggacgacttccacatgt

SEQ ID NO: 49353 - DNA, 25 bp, Mus musculus
aagatctgtcttccattcattcatc

SEQ ID NO: 49354 - DNA, 25 bp, Mus musculus
aagatctgtcttgcattcattcatc

SEQ ID NO: 49355 - DNA, 25 bp, Mus musculus
aagatctgtgacaagtttctccctt

SEQ ID NO: 49356 - DNA, 25 bp, Mus musculus
aagatctgtgacatcctagggaaaa

SEQ ID NO: 49357 - DNA, 25 bp, Mus musculus
aagatctgtgactagtttctccctt

SEQ ID NO: 49358 - DNA, 25 bp, Mus musculus
aagatctgtgacttcctagggaaaa

SEQ ID NO: 49359 - DNA, 25 bp, Mus musculus
aagatctgtgataacctctcaccac

SEQ ID NO: 49360 - DNA, 25 bp, Mus musculus
aagatctgtgattacctctcaccac

SEQ ID NO: 49361 - DNA, 25 bp, Mus musculus
aagatctgtgcacatggtccttcat

SEQ ID NO: 49362 - DNA, 25 bp, Mus musculus
aagatctgtgcagatggtccttcat

SEQ ID NO: 49363 - DNA, 25 bp, Mus musculus
aagatcttaagtagctgccttcact

SEQ ID NO: 49364 - DNA, 25 bp, Mus musculus
aagatcttaagttgctgccttcact

SEQ ID NO: 49365 - DNA, 25 bp, Mus musculus
aagatcttagaccacctgtttctcc

SEQ ID NO: 49366 - DNA, 25 bp, Mus musculus
aagatcttagacgacctgtttctcc

SEQ ID NO: 49367 - DNA, 25 bp, Mus musculus
aagatcttagatacgttgcttacag

SEQ ID NO: 49368 - DNA, 25 bp, Mus musculus
aagatcttagattcgttgcttacag

SEQ ID NO: 49369 - DNA, 25 bp, Mus musculus
aagatcttagctcttaccctagtct

SEQ ID NO: 49370 - DNA, 25 bp, Mus musculus
aagatcttagctgttaccctagtct

SEQ ID NO: 49371 - DNA, 25 bp, Mus musculus
aagatcttataaataggctgcaggc

SEQ ID NO: 49372 - DNA, 25 bp, Mus musculus
aagatcttataattaggctgcaggc

SEQ ID NO: 49373 - DNA, 25 bp, Mus musculus
aagatcttatcaaccagtctgctgc

SEQ ID NO: 49374 - DNA, 25 bp, Mus musculus
aagatcttatcatccagtctgctgc

SEQ ID NO: 49375 - DNA, 25 bp, Mus musculus
aagatcttcatgctgttccggtata

SEQ ID NO: 49376 - DNA, 25 bp, Mus musculus
aagatcttcatggtgttccggtata

SEQ ID NO: 49377 - DNA, 25 bp, Mus musculus
aagatcttccccagatggcactgcc

SEQ ID NO: 49378 - DNA, 25 bp, Mus musculus
aagatcttcccctgatggcactgcc

SEQ ID NO: 49379 - DNA, 25 bp, Mus musculus
aagatcttctgtatctccaagacca

SEQ ID NO: 49380 - DNA, 25 bp, Mus musculus
aagatcttctgtttctccaagacca

SEQ ID NO: 49381 - DNA, 25 bp, Mus musculus
aagatcttgaatactgtcagcttaa

SEQ ID NO: 49382 - DNA, 25 bp, Mus musculus
aagatcttgaattctgtcagcttaa

SEQ ID NO: 49383 - DNA, 25 bp, Mus musculus
aagatcttgactcccaggtttccca

SEQ ID NO: 49384 - DNA, 25 bp, Mus musculus
aagatcttgactgccaggtttccca

SEQ ID NO: 49385 - DNA, 25 bp, Mus musculus
aagatcttgatactttacactgaca

SEQ ID NO: 49386 - DNA, 25 bp, Mus musculus
aagatcttgatagtttacactgaca

SEQ ID NO: 49387 - DNA, 25 bp, Mus musculus
aagatcttgtctcgtgaggtagctc

SEQ ID NO: 49388 - DNA, 25 bp, Mus musculus
aagatcttgtctggtgaggtagctc

SEQ ID NO: 49389 - DNA, 25 bp, Mus musculus
aagatcttgttacagtgtccaggct

SEQ ID NO: 49390 - DNA, 25 bp, Mus musculus
aagatcttgttagagtgtccaggct

SEQ ID NO: 49391 - DNA, 25 bp, Mus musculus
aagatctttagtcctgcactgcctc

SEQ ID NO: 49392 - DNA, 25 bp, Mus musculus
aagatctttagtgctgcactgcctc

SEQ ID NO: 49393 - DNA, 25 bp, Mus musculus
aagatctttattcctcactgtggct

SEQ ID NO: 49394 - DNA, 25 bp, Mus musculus
aagatctttattgctcactgtggct

SEQ ID NO: 49395 - DNA, 25 bp, Mus musculus
aagatctttgcaacagtttgaccaa

SEQ ID NO: 49396 - DNA, 25 bp, Mus musculus
aagatctttgcatcagtttgaccaa

SEQ ID NO: 49397 - DNA, 25 bp, Mus musculus
aagatctttgtcacagaagtctgtt

SEQ ID NO: 49398 - DNA, 25 bp, Mus musculus
aagatctttgtctcagaagtctgtt

SEQ ID NO: 49399 - DNA, 25 bp, Mus musculus
aagatctttttcctatccccacagg

SEQ ID NO: 49400 - DNA, 25 bp, Mus musculus
aagatctttttcgtatccccacagg

SEQ ID NO: 49401 - DNA, 25 bp, Mus musculus
aagatgaaactgagttgccatacaa

SEQ ID NO: 49402 - DNA, 25 bp, Mus musculus
aagatgaaactgtgttgccatacaa

SEQ ID NO: 49403 - DNA, 25 bp, Mus musculus
aagatgaaagcccaagtgcagacct

SEQ ID NO: 49404 - DNA, 25 bp, Mus musculus
aagatgaaagccgaagtgcagacct

SEQ ID NO: 49405 - DNA, 25 bp, Mus musculus
aagatgaaagtcctcagtcgtctag

SEQ ID NO: 49406 - DNA, 25 bp, Mus musculus
aagatgaaagtcgtcagtcgtctag

SEQ ID NO: 49407 - DNA, 25 bp, Mus musculus
aagatgaaatcccttgcctttcact

SEQ ID NO: 49408 - DNA, 25 bp, Mus musculus
aagatgaaatccgttgcctttcact

SEQ ID NO: 49409 - DNA, 25 bp, Mus musculus
aagatgaaattgaatatgggctaaa

SEQ ID NO: 49410 - DNA, 25 bp, Mus musculus
aagatgaaattgtatatgggctaaa

SEQ ID NO: 49411 - DNA, 25 bp, Mus musculus
aagatgaaccgtagcagcctccaga

SEQ ID NO: 49412 - DNA, 25 bp, Mus musculus
aagatgaaccgttgcagcctccaga

SEQ ID NO: 49413 - DNA, 25 bp, Mus musculus
aagatgaacttgcacctctgcggca

SEQ ID NO: 49414 - DNA, 25 bp, Mus musculus
aagatgaacttggacctctgcggca

SEQ ID NO: 49415 - DNA, 25 bp, Mus musculus
aagatgaagaagatgccctgcagga

SEQ ID NO: 49416 - DNA, 25 bp, Mus musculus
aagatgaagaagttgccctgcagga

SEQ ID NO: 49417 - DNA, 25 bp, Mus musculus
aagatgaagaccacttccgagaatg

SEQ ID NO: 49418 - DNA, 25 bp, Mus musculus
aagatgaagacctcttccgagaatg

SEQ ID NO: 49419 - DNA, 25 bp, Mus musculus
aagatgaaggatacagacagcgagg

SEQ ID NO: 49420 - DNA, 25 bp, Mus musculus
aagatgaaggattcagacagcgagg

SEQ ID NO: 49421 - DNA, 25 bp, Mus musculus
aagatgaaggccacaattttgctac

SEQ ID NO: 49422 - DNA, 25 bp, Mus musculus
aagatgaaggcctcaattttgctac

SEQ ID NO: 49423 - DNA, 25 bp, Mus musculus
aagatgaatagcctcttacccagta

SEQ ID NO: 49424 - DNA, 25 bp, Mus musculus
aagatgaatagcgtcttacccagta

SEQ ID NO: 49425 - DNA, 25 bp, Mus musculus
aagatgaatcctcatcctgtgatga

SEQ ID NO: 49426 - DNA, 25 bp, Mus musculus
aagatgaatcctgatcctgtgatga

SEQ ID NO: 49427 - DNA, 25 bp, Mus musculus
aagatgaatggccaatgtgaagctg

SEQ ID NO: 49428 - DNA, 25 bp, Mus musculus
aagatgaatggcgaatgtgaagctg

SEQ ID NO: 49429 - DNA, 25 bp, Mus musculus
aagatgacacacagaagtctcggca

SEQ ID NO: 49430 - DNA, 25 bp, Mus musculus
aagatgacacactgaagtctcggca

SEQ ID NO: 49431 - DNA, 25 bp, Mus musculus
aagatgacagagatctagcggccct

SEQ ID NO: 49432 - DNA, 25 bp, Mus musculus
aagatgacagagttctagcggccct

SEQ ID NO: 49433 - DNA, 25 bp, Mus musculus
aagatgacagcactgtcaccccagc

SEQ ID NO: 49434 - DNA, 25 bp, Mus musculus
aagatgacagcagtgtcaccccagc

SEQ ID NO: 49435 - DNA, 25 bp, Mus musculus
aagatgacattgaagcctgacccag

SEQ ID NO: 49436 - DNA, 25 bp, Mus musculus
aagatgacattgtagcctgacccag

SEQ ID NO: 49437 - DNA, 25 bp, Mus musculus
aagatgaccaagaccgccgatgagt

SEQ ID NO: 49438 - DNA, 25 bp, Mus musculus
aagatgaccaagtccgccgatgagt

SEQ ID NO: 49439 - DNA, 25 bp, Mus musculus
aagatgaccatgagtactgaggcca

SEQ ID NO: 49440 - DNA, 25 bp, Mus musculus
aagatgaccatgtgtactgaggcca

SEQ ID NO: 49441 - DNA, 25 bp, Mus musculus
aagatgaccctgctgaaccaatgca

SEQ ID NO: 49442 - DNA, 25 bp, Mus musculus
aagatgaccctggtgaaccaatgca

SEQ ID NO: 49443 - DNA, 25 bp, Mus musculus
aagatgaccgtgacacagccgatgc

SEQ ID NO: 49444 - DNA, 25 bp, Mus musculus
aagatgaccgtgaccactctaggga

SEQ ID NO: 49445 - DNA, 25 bp, Mus musculus
aagatgaccgtgtcacagccgatgc

SEQ ID NO: 49446 - DNA, 25 bp, Mus musculus
aagatgaccgtgtccactctaggga

SEQ ID NO: 49447 - DNA, 25 bp, Mus musculus
aagatgacctgaccatctcatcttt

SEQ ID NO: 49448 - DNA, 25 bp, Mus musculus
aagatgacctgagcatctcatcttt

SEQ ID NO: 49449 - DNA, 25 bp, Mus musculus
aagatgactagcatttaactcataa

SEQ ID NO: 49450 - DNA, 25 bp, Mus musculus
aagatgactagcttttaactcataa

SEQ ID NO: 49451 - DNA, 25 bp, Mus musculus
aagatgactggtccaggatgctctg

SEQ ID NO: 49452 - DNA, 25 bp, Mus musculus
aagatgactggtgcaggatgctctg

SEQ ID NO: 49453 - DNA, 25 bp, Mus musculus
aagatgagaaaacctgccactccct

SEQ ID NO: 49454 - DNA, 25 bp, Mus musculus
aagatgagaaaagctgccactccct

SEQ ID NO: 49455 - DNA, 25 bp, Mus musculus
aagatgagaaacagccccttgaggc

SEQ ID NO: 49456 - DNA, 25 bp, Mus musculus
aagatgagaaactgccccttgaggc

SEQ ID NO: 49457 - DNA, 25 bp, Mus musculus
aagatgagaagaagcctccatctct

SEQ ID NO: 49458 - DNA, 25 bp, Mus musculus
aagatgagaagatgcctccatctct

SEQ ID NO: 49459 - DNA, 25 bp, Mus musculus
aagatgagactccaggagccccaag

SEQ ID NO: 49460 - DNA, 25 bp, Mus musculus
aagatgagactcgaggagccccaag

SEQ ID NO: 49461 - DNA, 25 bp, Mus musculus
aagatgagagacagcatggccctag

SEQ ID NO: 49462 - DNA, 25 bp, Mus musculus
aagatgagagactgcatggccctag

SEQ ID NO: 49463 - DNA, 25 bp, Mus musculus
aagatgagagccacaaagggaggta

SEQ ID NO: 49464 - DNA, 25 bp, Mus musculus
aagatgagagcctcaaagggaggta

SEQ ID NO: 49465 - DNA, 25 bp, Mus musculus
aagatgagagtcagccatctcccaa

SEQ ID NO: 49466 - DNA, 25 bp, Mus musculus
aagatgagagtctgccatctcccaa

SEQ ID NO: 49467 - DNA, 25 bp, Mus musculus
aagatgagcagaccggagcaatcac

SEQ ID NO: 49468 - DNA, 25 bp, Mus musculus
aagatgagcagagcggagcaatcac

SEQ ID NO: 49469 - DNA, 25 bp, Mus musculus
aagatgagcattcctcgctgcacgt

SEQ ID NO: 49470 - DNA, 25 bp, Mus musculus
aagatgagcattgctcgctgcacgt

SEQ ID NO: 49471 - DNA, 25 bp, Mus musculus
aagatgagccaactcctggtgccag

SEQ ID NO: 49472 - DNA, 25 bp, Mus musculus
aagatgagccaagtcctggtgccag

SEQ ID NO: 49473 - DNA, 25 bp, Mus musculus
aagatgagcctcaagtgcctggctg

SEQ ID NO: 49474 - DNA, 25 bp, Mus musculus
aagatgagcctctagtgcctggctg

SEQ ID NO: 49475 - DNA, 25 bp, Mus musculus
aagatgagctaaagcggtctgccat

SEQ ID NO: 49476 - DNA, 25 bp, Mus musculus
aagatgagctaatgcggtctgccat

SEQ ID NO: 49477 - DNA, 25 bp, Mus musculus
aagatgaggaggcagccgccgcatt

SEQ ID NO: 49478 - DNA, 25 bp, Mus musculus
aagatgaggagggagccgccgcatt

SEQ ID NO: 49479 - DNA, 25 bp, Mus musculus
aagatgaggatcacttaccagagaa

SEQ ID NO: 49480 - DNA, 25 bp, Mus musculus
aagatgaggatctcttaccagagaa

SEQ ID NO: 49481 - DNA, 25 bp, Mus musculus
aagatgaggccaaaaccccgctcca

SEQ ID NO: 49482 - DNA, 25 bp, Mus musculus
aagatgaggccataaccccgctcca

SEQ ID NO: 49483 - DNA, 25 bp, Mus musculus
aagatgaggcttcagaacttctcag

SEQ ID NO: 49484 - DNA, 25 bp, Mus musculus
aagatgaggcttgagaacttctcag

SEQ ID NO: 49485 - DNA, 25 bp, Mus musculus
aagatgagggaacctgccagctcag

SEQ ID NO: 49486 - DNA, 25 bp, Mus musculus
aagatgagggaagctgccagctcag

SEQ ID NO: 49487 - DNA, 25 bp, Mus musculus
aagatgagggacagccacagcctct

SEQ ID NO: 49488 - DNA, 25 bp, Mus musculus
aagatgagggactgccacagcctct

SEQ ID NO: 49489 - DNA, 25 bp, Mus musculus
aagatgaggttgaccgattccaggt

SEQ ID NO: 49490 - DNA, 25 bp, Mus musculus
aagatgaggttgtccgattccaggt

SEQ ID NO: 49491 - DNA, 25 bp, Mus musculus
aagatgagtaaacagaacctggcct

SEQ ID NO: 49492 - DNA, 25 bp, Mus musculus
aagatgagtaaagagaacctggcct

SEQ ID NO: 49493 - DNA, 25 bp, Mus musculus
aagatgagtagacaccttccctgtt

SEQ ID NO: 49494 - DNA, 25 bp, Mus musculus
aagatgagtagagaccttccctgtt

SEQ ID NO: 49495 - DNA, 25 bp, Mus musculus
aagatgagtatcatttcccctcaaa

SEQ ID NO: 49496 - DNA, 25 bp, Mus musculus
aagatgagtatcttttcccctcaaa

SEQ ID NO: 49497 - DNA, 25 bp, Mus musculus
aagatgagtctccatttcttatctc

SEQ ID NO: 49498 - DNA, 25 bp, Mus musculus
aagatgagtctcgatttcttatctc

SEQ ID NO: 49499 - DNA, 25 bp, Mus musculus
aagatgagtgctaacgggactggct

SEQ ID NO: 49500 - DNA, 25 bp, Mus musculus
aagatgagtgcttacgggactggct

SEQ ID NO: 49501 - DNA, 25 bp, Mus musculus
aagatgagttgtaccaggccagact

SEQ ID NO: 49502 - DNA, 25 bp, Mus musculus
aagatgagttgttccaggccagact

SEQ ID NO: 49503 - DNA, 25 bp, Mus musculus
aagatgatcaagatctgcctcctgc

SEQ ID NO: 49504 - DNA, 25 bp, Mus musculus
aagatgatcaagttctgcctcctgc

SEQ ID NO: 49505 - DNA, 25 bp, Mus musculus
aagatgatcaatcgtgcggtgggta

SEQ ID NO: 49506 - DNA, 25 bp, Mus musculus
aagatgatcaatggtgcggtgggta

SEQ ID NO: 49507 - DNA, 25 bp, Mus musculus
aagatgatgaaccgcttcatgccac

SEQ ID NO: 49508 - DNA, 25 bp, Mus musculus
aagatgatgaacggcttcatgccac

SEQ ID NO: 49509 - DNA, 25 bp, Mus musculus
aagatgatgaatccctccgagaaat

SEQ ID NO: 49510 - DNA, 25 bp, Mus musculus
aagatgatgaatgcctccgagaaat

SEQ ID NO: 49511 - DNA, 25 bp, Mus musculus
aagatgatgccacctggctgcatgc

SEQ ID NO: 49512 - DNA, 25 bp, Mus musculus
aagatgatgccagctggctgcatgc

SEQ ID NO: 49513 - DNA, 25 bp, Mus musculus
aagatgatgccgacaccaagaccct

SEQ ID NO: 49514 - DNA, 25 bp, Mus musculus
aagatgatgccgtcaccaagaccct

SEQ ID NO: 49515 - DNA, 25 bp, Mus musculus
aagatgatgctgacccggagagctg

SEQ ID NO: 49516 - DNA, 25 bp, Mus musculus
aagatgatgctgactatcctcgctc

SEQ ID NO: 49517 - DNA, 25 bp, Mus musculus
aagatgatgctgtcccggagagctg

SEQ ID NO: 49518 - DNA, 25 bp, Mus musculus
aagatgatgctgtctatcctcgctc

SEQ ID NO: 49519 - DNA, 25 bp, Mus musculus
aagatgatggacagccctgaggatg

SEQ ID NO: 49520 - DNA, 25 bp, Mus musculus
aagatgatggactgccctgaggatg

SEQ ID NO: 49521 - DNA, 25 bp, Mus musculus
aagatgatggcacctagggccctgt

SEQ ID NO: 49522 - DNA, 25 bp, Mus musculus
aagatgatggcagctagggccctgt

SEQ ID NO: 49523 - DNA, 25 bp, Mus musculus
aagatgatgggaatgacctcacaca

SEQ ID NO: 49524 - DNA, 25 bp, Mus musculus
aagatgatgggattgacctcacaca

SEQ ID NO: 49525 - DNA, 25 bp, Mus musculus
aagatgattatgacggctctcacaa

SEQ ID NO: 49526 - DNA, 25 bp, Mus musculus
aagatgattatgtcggctctcacaa

SEQ ID NO: 49527 - DNA, 25 bp, Mus musculus
aagatgattcgaatctccccagtga

SEQ ID NO: 49528 - DNA, 25 bp, Mus musculus
aagatgattcgattctccccagtga

SEQ ID NO: 49529 - DNA, 25 bp, Mus musculus
aagatgcaaagtccctgctgcttgg

SEQ ID NO: 49530 - DNA, 25 bp, Mus musculus
aagatgcaaagtgcctgctgcttgg

SEQ ID NO: 49531 - DNA, 25 bp, Mus musculus
aagatgcaagcaagcaggactcaga

SEQ ID NO: 49532 - DNA, 25 bp, Mus musculus
aagatgcaagcatgcaggactcaga

SEQ ID NO: 49533 - DNA, 25 bp, Mus musculus
aagatgcaataacccatttccctgg

SEQ ID NO: 49534 - DNA, 25 bp, Mus musculus
aagatgcaataagccatttccctgg

SEQ ID NO: 49535 - DNA, 25 bp, Mus musculus
aagatgcaatgtcgctcttttcttt

SEQ ID NO: 49536 - DNA, 25 bp, Mus musculus
aagatgcaatgtggctcttttcttt

SEQ ID NO: 49537 - DNA, 25 bp, Mus musculus
aagatgcacaacatacaccatccgc

SEQ ID NO: 49538 - DNA, 25 bp, Mus musculus
aagatgcacaacttacaccatccgc

SEQ ID NO: 49539 - DNA, 25 bp, Mus musculus
aagatgcacaatatcggcctctgtc

SEQ ID NO: 49540 - DNA, 25 bp, Mus musculus
aagatgcacaatttcggcctctgtc

SEQ ID NO: 49541 - DNA, 25 bp, Mus musculus
aagatgcacaggctagccttggctt

SEQ ID NO: 49542 - DNA, 25 bp, Mus musculus
aagatgcacagggtagccttggctt

SEQ ID NO: 49543 - DNA, 25 bp, Mus musculus
aagatgcacattaaacttggaaagt

SEQ ID NO: 49544 - DNA, 25 bp, Mus musculus
aagatgcacatttaacttggaaagt

SEQ ID NO: 49545 - DNA, 25 bp, Mus musculus
aagatgcacgaccaggaataacctc

SEQ ID NO: 49546 - DNA, 25 bp, Mus musculus
aagatgcacgacgaggaataacctc

SEQ ID NO: 49547 - DNA, 25 bp, Mus musculus
aagatgcactatcggaagaagaagc

SEQ ID NO: 49548 - DNA, 25 bp, Mus musculus
aagatgcactatgggaagaagaagc

SEQ ID NO: 49549 - DNA, 25 bp, Mus musculus
aagatgcacttgcaagcctccattc

SEQ ID NO: 49550 - DNA, 25 bp, Mus musculus
aagatgcacttggaagcctccattc

SEQ ID NO: 49551 - DNA, 25 bp, Mus musculus
aagatgcaggcaaggtcgtgctctg

SEQ ID NO: 49552 - DNA, 25 bp, Mus musculus
aagatgcaggcatggtcgtgctctg

SEQ ID NO: 49553 - DNA, 25 bp, Mus musculus
aagatgcatcaacgccaactggaga

SEQ ID NO: 49554 - DNA, 25 bp, Mus musculus
aagatgcatcaaggccaactggaga

SEQ ID NO: 49555 - DNA, 25 bp, Mus musculus
aagatgcatccaaacaacaggtctg

SEQ ID NO: 49556 - DNA, 25 bp, Mus musculus
aagatgcatccatacaacaggtctg

SEQ ID NO: 49557 - DNA, 25 bp, Mus musculus
aagatgcatgcacggcttgtgatcc

SEQ ID NO: 49558 - DNA, 25 bp, Mus musculus
aagatgcatgcagggcttgtgatcc

SEQ ID NO: 49559 - DNA, 25 bp, Mus musculus
aagatgcatgtcacctgtattccct

SEQ ID NO: 49560 - DNA, 25 bp, Mus musculus
aagatgcatgtctcctgtattccct

SEQ ID NO: 49561 - DNA, 25 bp, Mus musculus
aagatgcattataaccacgggtgtg

SEQ ID NO: 49562 - DNA, 25 bp, Mus musculus
aagatgcattattaccacgggtgtg

SEQ ID NO: 49563 - DNA, 25 bp, Mus musculus
aagatgcattcacagccacttcggc

SEQ ID NO: 49564 - DNA, 25 bp, Mus musculus
aagatgcattcagagccacttcggc

SEQ ID NO: 49565 - DNA, 25 bp, Mus musculus
aagatgccaccactttctaagaaga

SEQ ID NO: 49566 - DNA, 25 bp, Mus musculus
aagatgccaccagtttctaagaaga

SEQ ID NO: 49567 - DNA, 25 bp, Mus musculus
aagatgccaccgagcttggtagaga

SEQ ID NO: 49568 - DNA, 25 bp, Mus musculus
aagatgccaccgtgcttggtagaga

SEQ ID NO: 49569 - DNA, 25 bp, Mus musculus
aagatgccactgacaaggctgggtg

SEQ ID NO: 49570 - DNA, 25 bp, Mus musculus
aagatgccactgtcaaggctgggtg

SEQ ID NO: 49571 - DNA, 25 bp, Mus musculus
aagatgccagccaggcagccataaa

SEQ ID NO: 49572 - DNA, 25 bp, Mus musculus
aagatgccagccagtagacaatata

SEQ ID NO: 49573 - DNA, 25 bp, Mus musculus
aagatgccagcctggcagccataaa

SEQ ID NO: 49574 - DNA, 25 bp, Mus musculus
aagatgccagcctgtagacaatata

SEQ ID NO: 49575 - DNA, 25 bp, Mus musculus
aagatgccagttatgttcgaccgga

SEQ ID NO: 49576 - DNA, 25 bp, Mus musculus
aagatgccagttttgttcgaccgga

SEQ ID NO: 49577 - DNA, 25 bp, Mus musculus
aagatgccatctatgtgacttgctg

SEQ ID NO: 49578 - DNA, 25 bp, Mus musculus
aagatgccatctttgtgacttgctg

SEQ ID NO: 49579 - DNA, 25 bp, Mus musculus
aagatgcccaagcttgcccaaacgt

SEQ ID NO: 49580 - DNA, 25 bp, Mus musculus
aagatgcccaaggttgcccaaacgt

SEQ ID NO: 49581 - DNA, 25 bp, Mus musculus
aagatgcccagccacagctgacaat

SEQ ID NO: 49582 - DNA, 25 bp, Mus musculus
aagatgcccagcgacagctgacaat

SEQ ID NO: 49583 - DNA, 25 bp, Mus musculus
aagatgcccaggatttaatgccaag

SEQ ID NO: 49584 - DNA, 25 bp, Mus musculus
aagatgcccaggttttaatgccaag

SEQ ID NO: 49585 - DNA, 25 bp, Mus musculus
aagatgccctggatctcaccagcct

SEQ ID NO: 49586 - DNA, 25 bp, Mus musculus
aagatgccctggttctcaccagcct

SEQ ID NO: 49587 - DNA, 25 bp, Mus musculus
aagatgccctgtattggtcttgctt

SEQ ID NO: 49588 - DNA, 25 bp, Mus musculus
aagatgccctgttttggtcttgctt

SEQ ID NO: 49589 - DNA, 25 bp, Mus musculus
aagatgccgccgatgcctgtgacat

SEQ ID NO: 49590 - DNA, 25 bp, Mus musculus
aagatgccgccgttgcctgtgacat

SEQ ID NO: 49591 - DNA, 25 bp, Mus musculus
aagatgcctagccacttggcaccag

SEQ ID NO: 49592 - DNA, 25 bp, Mus musculus
aagatgcctagcgacttggcaccag

SEQ ID NO: 49593 - DNA, 25 bp, Mus musculus
aagatgcctcgactgtgtgtgtaca

SEQ ID NO: 49594 - DNA, 25 bp, Mus musculus
aagatgcctcgagtgtgtgtgtaca

SEQ ID NO: 49595 - DNA, 25 bp, Mus musculus
aagatgcctctaagtttgttttgtc

SEQ ID NO: 49596 - DNA, 25 bp, Mus musculus
aagatgcctctatgtttgttttgtc

SEQ ID NO: 49597 - DNA, 25 bp, Mus musculus
aagatgcctggaagtacctctgtgc

SEQ ID NO: 49598 - DNA, 25 bp, Mus musculus
aagatgcctggatgtacctctgtgc

SEQ ID NO: 49599 - DNA, 25 bp, Mus musculus
aagatgcctggcactcatgatctgg

SEQ ID NO: 49600 - DNA, 25 bp, Mus musculus
aagatgcctggcattgaaatacata

SEQ ID NO: 49601 - DNA, 25 bp, Mus musculus
aagatgcctggctctcatgatctgg

SEQ ID NO: 49602 - DNA, 25 bp, Mus musculus
aagatgcctggctttgaaatacata

SEQ ID NO: 49603 - DNA, 25 bp, Mus musculus
aagatgcctgtcatgtggatggcta

SEQ ID NO: 49604 - DNA, 25 bp, Mus musculus
aagatgcctgtcttgtggatggcta

SEQ ID NO: 49605 - DNA, 25 bp, Mus musculus
aagatgcgactgatcttccgtgagc

SEQ ID NO: 49606 - DNA, 25 bp, Mus musculus
aagatgcgactgttcttccgtgagc

SEQ ID NO: 49607 - DNA, 25 bp, Mus musculus
aagatgcgcaggatgatcactcgag

SEQ ID NO: 49608 - DNA, 25 bp, Mus musculus
aagatgcgcaggttgatcactcgag

SEQ ID NO: 49609 - DNA, 25 bp, Mus musculus
aagatgcgcatgctggccctcaagg

SEQ ID NO: 49610 - DNA, 25 bp, Mus musculus
aagatgcgcatggtggccctcaagg

SEQ ID NO: 49611 - DNA, 25 bp, Mus musculus
aagatgcgccagacaacgcagtcca

SEQ ID NO: 49612 - DNA, 25 bp, Mus musculus
aagatgcgccagtcaacgcagtcca

SEQ ID NO: 49613 - DNA, 25 bp, Mus musculus
aagatgcgtgagaccttggagttga

SEQ ID NO: 49614 - DNA, 25 bp, Mus musculus
aagatgcgtgagtccttggagttga

SEQ ID NO: 49615 - DNA, 25 bp, Mus musculus
aagatgcgtgcaaagctgttccggt

SEQ ID NO: 49616 - DNA, 25 bp, Mus musculus
aagatgcgtgcaagcctttcaggga

SEQ ID NO: 49617 - DNA, 25 bp, Mus musculus
aagatgcgtgcatagctgttccggt

SEQ ID NO: 49618 - DNA, 25 bp, Mus musculus
aagatgcgtgcatgcctttcaggga

SEQ ID NO: 49619 - DNA, 25 bp, Mus musculus
aagatgcgtggaaggaacagtcgat

SEQ ID NO: 49620 - DNA, 25 bp, Mus musculus
aagatgcgtggatggaacagtcgat

SEQ ID NO: 49621 - DNA, 25 bp, Mus musculus
aagatgcgttgtagtttacccatat

SEQ ID NO: 49622 - DNA, 25 bp, Mus musculus
aagatgcgttgttgtttacccatat

SEQ ID NO: 49623 - DNA, 25 bp, Mus musculus
aagatgctaacccacacaatttata

SEQ ID NO: 49624 - DNA, 25 bp, Mus musculus
aagatgctaaccgacacaatttata

SEQ ID NO: 49625 - DNA, 25 bp, Mus musculus
aagatgctaccacctggatggaagc

SEQ ID NO: 49626 - DNA, 25 bp, Mus musculus
aagatgctaccagctggatggaagc

SEQ ID NO: 49627 - DNA, 25 bp, Mus musculus
aagatgctatcaacatttccccact

SEQ ID NO: 49628 - DNA, 25 bp, Mus musculus
aagatgctatcatcatttccccact

SEQ ID NO: 49629 - DNA, 25 bp, Mus musculus
aagatgctatccaactgtgtgctca

SEQ ID NO: 49630 - DNA, 25 bp, Mus musculus
aagatgctatcctactgtgtgctca

SEQ ID NO: 49631 - DNA, 25 bp, Mus musculus
aagatgctatctctcttactcttct

SEQ ID NO: 49632 - DNA, 25 bp, Mus musculus
aagatgctatctgtcttactcttct

SEQ ID NO: 49633 - DNA, 25 bp, Mus musculus
aagatgctatggatcctttcttttc

SEQ ID NO: 49634 - DNA, 25 bp, Mus musculus
aagatgctatggttcctttcttttc

SEQ ID NO: 49635 - DNA, 25 bp, Mus musculus
aagatgctcaccaatgacccaatgc

SEQ ID NO: 49636 - DNA, 25 bp, Mus musculus
aagatgctcacctatgacccaatgc

SEQ ID NO: 49637 - DNA, 25 bp, Mus musculus
aagatgctcagcctggtgtccacgc

SEQ ID NO: 49638 - DNA, 25 bp, Mus musculus
aagatgctcagcgtggtgtccacgc

SEQ ID NO: 49639 - DNA, 25 bp, Mus musculus
aagatgctcagtaagatggttgcca

SEQ ID NO: 49640 - DNA, 25 bp, Mus musculus
aagatgctcagttagatggttgcca

SEQ ID NO: 49641 - DNA, 25 bp, Mus musculus
aagatgctcggcatcagagactcag

SEQ ID NO: 49642 - DNA, 25 bp, Mus musculus
aagatgctcggcttcagagactcag

SEQ ID NO: 49643 - DNA, 25 bp, Mus musculus
aagatgctctggatgaggcaaacat

SEQ ID NO: 49644 - DNA, 25 bp, Mus musculus
aagatgctctggttgaggcaaacat

SEQ ID NO: 49645 - DNA, 25 bp, Mus musculus
aagatgctgacgactgaagccccat

SEQ ID NO: 49646 - DNA, 25 bp, Mus musculus
aagatgctgacgtctgaagccccat

SEQ ID NO: 49647 - DNA, 25 bp, Mus musculus
aagatgctgagaaccttggccactt

SEQ ID NO: 49648 - DNA, 25 bp, Mus musculus
aagatgctgagatccttggccactt

SEQ ID NO: 49649 - DNA, 25 bp, Mus musculus
aagatgctgatgacgctgccgctgc

SEQ ID NO: 49650 - DNA, 25 bp, Mus musculus
aagatgctgatgtcgctgccgctgc

SEQ ID NO: 49651 - DNA, 25 bp, Mus musculus
aagatgctgattagtacctattaga

SEQ ID NO: 49652 - DNA, 25 bp, Mus musculus
aagatgctgatttgtacctattaga

SEQ ID NO: 49653 - DNA, 25 bp, Mus musculus
aagatgctgcaaattgtgctgcccg

SEQ ID NO: 49654 - DNA, 25 bp, Mus musculus
aagatgctgcaatttgtgctgcccg

SEQ ID NO: 49655 - DNA, 25 bp, Mus musculus
aagatgctgcacctgggtgatccca

SEQ ID NO: 49656 - DNA, 25 bp, Mus musculus
aagatgctgcacgtgggtgatccca

SEQ ID NO: 49657 - DNA, 25 bp, Mus musculus
aagatgctgcctctgctcggatgcc

SEQ ID NO: 49658 - DNA, 25 bp, Mus musculus
aagatgctgcctgtgctcggatgcc

SEQ ID NO: 49659 - DNA, 25 bp, Mus musculus
aagatgctgcttccagcgttactct

SEQ ID NO: 49660 - DNA, 25 bp, Mus musculus
aagatgctgcttgcagcgttactct

SEQ ID NO: 49661 - DNA, 25 bp, Mus musculus
aagatgctggagatctctgggtccc

SEQ ID NO: 49662 - DNA, 25 bp, Mus musculus
aagatgctggagttctctgggtccc

SEQ ID NO: 49663 - DNA, 25 bp, Mus musculus
aagatgctggatactactggtgtga

SEQ ID NO: 49664 - DNA, 25 bp, Mus musculus
aagatgctggatagtacccaaatca

SEQ ID NO: 49665 - DNA, 25 bp, Mus musculus
aagatgctggattctactggtgtga

SEQ ID NO: 49666 - DNA, 25 bp, Mus musculus
aagatgctggattgtacccaaatca

SEQ ID NO: 49667 - DNA, 25 bp, Mus musculus
aagatgctggctcagctgtacggct

SEQ ID NO: 49668 - DNA, 25 bp, Mus musculus
aagatgctggctctcaggtgctgaa

SEQ ID NO: 49669 - DNA, 25 bp, Mus musculus
aagatgctggctgagctgtacggct

SEQ ID NO: 49670 - DNA, 25 bp, Mus musculus
aagatgctggctgtcaggtgctgaa

SEQ ID NO: 49671 - DNA, 25 bp, Mus musculus
aagatgctgtaacaccctccttaag

SEQ ID NO: 49672 - DNA, 25 bp, Mus musculus
aagatgctgtaagaccctccttaag

SEQ ID NO: 49673 - DNA, 25 bp, Mus musculus
aagatgctgtgcagtccatccagga

SEQ ID NO: 49674 - DNA, 25 bp, Mus musculus
aagatgctgtgcattctcaggaagt

SEQ ID NO: 49675 - DNA, 25 bp, Mus musculus
aagatgctgtgctgtccatccagga

SEQ ID NO: 49676 - DNA, 25 bp, Mus musculus
aagatgctgtgctttctcaggaagt

SEQ ID NO: 49677 - DNA, 25 bp, Mus musculus
aagatgctgtttacacaataaccaa

SEQ ID NO: 49678 - DNA, 25 bp, Mus musculus
aagatgctgtttccaagggaccctc

SEQ ID NO: 49679 - DNA, 25 bp, Mus musculus
aagatgctgtttctcttggtcctcg

SEQ ID NO: 49680 - DNA, 25 bp, Mus musculus
aagatgctgtttgcaagggaccctc

SEQ ID NO: 49681 - DNA, 25 bp, Mus musculus
aagatgctgtttgtcttggtcctcg

SEQ ID NO: 49682 - DNA, 25 bp, Mus musculus
aagatgctgttttcacaataaccaa

SEQ ID NO: 49683 - DNA, 25 bp, Mus musculus
aagatgcttagcattgttctgcaag

SEQ ID NO: 49684 - DNA, 25 bp, Mus musculus
aagatgcttagctttgttctgcaag

SEQ ID NO: 49685 - DNA, 25 bp, Mus musculus
aagatgcttcctattttgtcatatc

SEQ ID NO: 49686 - DNA, 25 bp, Mus musculus
aagatgcttccttttttgtcatatc

SEQ ID NO: 49687 - DNA, 25 bp, Mus musculus
aagatgcttgcaagtcgcttttgat

SEQ ID NO: 49688 - DNA, 25 bp, Mus musculus
aagatgcttgcatgtcgcttttgat

SEQ ID NO: 49689 - DNA, 25 bp, Mus musculus
aagatgcttgctaacaccaggaggt

SEQ ID NO: 49690 - DNA, 25 bp, Mus musculus
aagatgcttgcttacaccaggaggt

SEQ ID NO: 49691 - DNA, 25 bp, Mus musculus
aagatgcttgtgactgtctgcagtt

SEQ ID NO: 49692 - DNA, 25 bp, Mus musculus
aagatgcttgtgtctgtctgcagtt

SEQ ID NO: 49693 - DNA, 25 bp, Mus musculus
aagatgctttctattgccttgtgta

SEQ ID NO: 49694 - DNA, 25 bp, Mus musculus
aagatgctttcttttgccttgtgta

SEQ ID NO: 49695 - DNA, 25 bp, Mus musculus
aagatggaaagcagcttcctgccat

SEQ ID NO: 49696 - DNA, 25 bp, Mus musculus
aagatggaaagctgcttcctgccat

SEQ ID NO: 49697 - DNA, 25 bp, Mus musculus
aagatggaacccaggccacagcggg

SEQ ID NO: 49698 - DNA, 25 bp, Mus musculus
aagatggaaccctggccacagcggg

SEQ ID NO: 49699 - DNA, 25 bp, Mus musculus
aagatggaaccgcaggaaccgcacc

SEQ ID NO: 49700 - DNA, 25 bp, Mus musculus
aagatggaaccggaggaaccgcacc

SEQ ID NO: 49701 - DNA, 25 bp, Mus musculus
aagatggaacctaggctcagcttca

SEQ ID NO: 49702 - DNA, 25 bp, Mus musculus
aagatggaaccttggctcagcttca

SEQ ID NO: 49703 - DNA, 25 bp, Mus musculus
aagatggaactcagcgcatgtgccc

SEQ ID NO: 49704 - DNA, 25 bp, Mus musculus
aagatggaactctgcgcatgtgccc

SEQ ID NO: 49705 - DNA, 25 bp, Mus musculus
aagatggaccaactcaccaagtgtc

SEQ ID NO: 49706 - DNA, 25 bp, Mus musculus
aagatggaccaagtcaccaagtgtc

SEQ ID NO: 49707 - DNA, 25 bp, Mus musculus
aagatggaccacaaagccatccctg

SEQ ID NO: 49708 - DNA, 25 bp, Mus musculus
aagatggaccactaagccatccctg

SEQ ID NO: 49709 - DNA, 25 bp, Mus musculus
aagatggacccacaagcaagagagc

SEQ ID NO: 49710 - DNA, 25 bp, Mus musculus
aagatggacccagaagcaagagagc

SEQ ID NO: 49711 - DNA, 25 bp, Mus musculus
aagatggacgatactgtgaagggaa

SEQ ID NO: 49712 - DNA, 25 bp, Mus musculus
aagatggacgattctgtgaagggaa

SEQ ID NO: 49713 - DNA, 25 bp, Mus musculus
aagatggactggcttgcgacctgac

SEQ ID NO: 49714 - DNA, 25 bp, Mus musculus
aagatggactgggttgcgacctgac

SEQ ID NO: 49715 - DNA, 25 bp, Mus musculus
aagatggagactctcgcccagtgtt

SEQ ID NO: 49716 - DNA, 25 bp, Mus musculus
aagatggagactgtcgcccagtgtt

SEQ ID NO: 49717 - DNA, 25 bp, Mus musculus
aagatggagccaccagtgagcagcc

SEQ ID NO: 49718 - DNA, 25 bp, Mus musculus
aagatggagccagcagtgagcagcc

SEQ ID NO: 49719 - DNA, 25 bp, Mus musculus
aagatggagctaaagacctgtaaaa

SEQ ID NO: 49720 - DNA, 25 bp, Mus musculus
aagatggagctatagacctgtaaaa

SEQ ID NO: 49721 - DNA, 25 bp, Mus musculus
aagatggagctgacctttgtttcta

SEQ ID NO: 49722 - DNA, 25 bp, Mus musculus
aagatggagctgtcctttgtttcta

SEQ ID NO: 49723 - DNA, 25 bp, Mus musculus
aagatggagcttagcctaggaaggt

SEQ ID NO: 49724 - DNA, 25 bp, Mus musculus
aagatggagctttgcctaggaaggt

SEQ ID NO: 49725 - DNA, 25 bp, Mus musculus
aagatggagttcattgcctcacctg

SEQ ID NO: 49726 - DNA, 25 bp, Mus musculus
aagatggagttctttgcctcacctg

SEQ ID NO: 49727 - DNA, 25 bp, Mus musculus
aagatggataataccgggctggact

SEQ ID NO: 49728 - DNA, 25 bp, Mus musculus
aagatggataattccgggctggact

SEQ ID NO: 49729 - DNA, 25 bp, Mus musculus
aagatggatctgatgcagcctgctc

SEQ ID NO: 49730 - DNA, 25 bp, Mus musculus
aagatggatctgttgcagcctgctc

SEQ ID NO: 49731 - DNA, 25 bp, Mus musculus
aagatggattctatgctcaggctag

SEQ ID NO: 49732 - DNA, 25 bp, Mus musculus
aagatggattctttgctcaggctag

SEQ ID NO: 49733 - DNA, 25 bp, Mus musculus
aagatggcaaagactattggtgtca

SEQ ID NO: 49734 - DNA, 25 bp, Mus musculus
aagatggcaaagtctattggtgtca

SEQ ID NO: 49735 - DNA, 25 bp, Mus musculus
aagatggcaagacctctgagctaaa

SEQ ID NO: 49736 - DNA, 25 bp, Mus musculus
aagatggcaagagctctgagctaaa

SEQ ID NO: 49737 - DNA, 25 bp, Mus musculus
aagatggcacacatggctatggctg

SEQ ID NO: 49738 - DNA, 25 bp, Mus musculus
aagatggcacacttggctatggctg

SEQ ID NO: 49739 - DNA, 25 bp, Mus musculus
aagatggcaccactcctggaggatt

SEQ ID NO: 49740 - DNA, 25 bp, Mus musculus
aagatggcaccagtcctggaggatt

SEQ ID NO: 49741 - DNA, 25 bp, Mus musculus
aagatggcacgtactagcccggaag

SEQ ID NO: 49742 - DNA, 25 bp, Mus musculus
aagatggcacgttctagcccggaag

SEQ ID NO: 49743 - DNA, 25 bp, Mus musculus
aagatggcatcgagcggctgaagct

SEQ ID NO: 49744 - DNA, 25 bp, Mus musculus
aagatggcatcgtgcggctgaagct

SEQ ID NO: 49745 - DNA, 25 bp, Mus musculus
aagatggcatctcaacgggaaggtt

SEQ ID NO: 49746 - DNA, 25 bp, Mus musculus
aagatggcatctgaacgggaaggtt

SEQ ID NO: 49747 - DNA, 25 bp, Mus musculus
aagatggcatgcaagaaaccctcta

SEQ ID NO: 49748 - DNA, 25 bp, Mus musculus
aagatggcatgctagaaaccctcta

SEQ ID NO: 49749 - DNA, 25 bp, Mus musculus
aagatggcattcctgatctcagaat

SEQ ID NO: 49750 - DNA, 25 bp, Mus musculus
aagatggcattcgtgatctcagaat

SEQ ID NO: 49751 - DNA, 25 bp, Mus musculus
aagatggccaaacctccatcggctg

SEQ ID NO: 49752 - DNA, 25 bp, Mus musculus
aagatggccaaagctccatcggctg

SEQ ID NO: 49753 - DNA, 25 bp, Mus musculus
aagatggccaacaaagcaccttctc

SEQ ID NO: 49754 - DNA, 25 bp, Mus musculus
aagatggccaactaagcaccttctc

SEQ ID NO: 49755 - DNA, 25 bp, Mus musculus
aagatggccacaatgttaagtctac

SEQ ID NO: 49756 - DNA, 25 bp, Mus musculus
aagatggccacattgttaagtctac

SEQ ID NO: 49757 - DNA, 25 bp, Mus musculus
aagatggccactctttatcctgaac

SEQ ID NO: 49758 - DNA, 25 bp, Mus musculus
aagatggccactgtttatcctgaac

SEQ ID NO: 49759 - DNA, 25 bp, Mus musculus
aagatggccagtccgttgtctgcac

SEQ ID NO: 49760 - DNA, 25 bp, Mus musculus
aagatggccagtgcgttgtctgcac

SEQ ID NO: 49761 - DNA, 25 bp, Mus musculus
aagatggccctgacctaagccttgg

SEQ ID NO: 49762 - DNA, 25 bp, Mus musculus
aagatggccctgtcctaagccttgg

SEQ ID NO: 49763 - DNA, 25 bp, Mus musculus
aagatggccgatctcctgtcgtact

SEQ ID NO: 49764 - DNA, 25 bp, Mus musculus
aagatggccgatgtcctgtcgtact

SEQ ID NO: 49765 - DNA, 25 bp, Mus musculus
aagatggccgcactctctctgatta

SEQ ID NO: 49766 - DNA, 25 bp, Mus musculus
aagatggccgcagtctctctgatta

SEQ ID NO: 49767 - DNA, 25 bp, Mus musculus
aagatggccgctccccggagaaaag

SEQ ID NO: 49768 - DNA, 25 bp, Mus musculus
aagatggccgctgcccggagaaaag

SEQ ID NO: 49769 - DNA, 25 bp, Mus musculus
aagatggcctagcatgtcagctgca

SEQ ID NO: 49770 - DNA, 25 bp, Mus musculus
aagatggcctaggatgtcagctgca

SEQ ID NO: 49771 - DNA, 25 bp, Mus musculus
aagatggcctccagaagctctggaa

SEQ ID NO: 49772 - DNA, 25 bp, Mus musculus
aagatggcctcctgaagctctggaa

SEQ ID NO: 49773 - DNA, 25 bp, Mus musculus
aagatggcctgacctgccagggtca

SEQ ID NO: 49774 - DNA, 25 bp, Mus musculus
aagatggcctgagctgccagggtca

SEQ ID NO: 49775 - DNA, 25 bp, Mus musculus
aagatggcgactacactgtgtatga

SEQ ID NO: 49776 - DNA, 25 bp, Mus musculus
aagatggcgactctgttgactgccc

SEQ ID NO: 49777 - DNA, 25 bp, Mus musculus
aagatggcgactgtgttgactgccc

SEQ ID NO: 49778 - DNA, 25 bp, Mus musculus
aagatggcgacttcactgtgtatga

SEQ ID NO: 49779 - DNA, 25 bp, Mus musculus
aagatggcgccgaccgtagtgctgc

SEQ ID NO: 49780 - DNA, 25 bp, Mus musculus
aagatggcgccgtccgtagtgctgc

SEQ ID NO: 49781 - DNA, 25 bp, Mus musculus
aagatggcggcccagctacgcagac

SEQ ID NO: 49782 - DNA, 25 bp, Mus musculus
aagatggcggccgagctacgcagac

SEQ ID NO: 49783 - DNA, 25 bp, Mus musculus
aagatggcggtgcagtcgcgcgtta

SEQ ID NO: 49784 - DNA, 25 bp, Mus musculus
aagatggcggtggagtcgcgcgtta

SEQ ID NO: 49785 - DNA, 25 bp, Mus musculus
aagatggcgtctatgcatggcactg

SEQ ID NO: 49786 - DNA, 25 bp, Mus musculus
aagatggcgtctttgcatggcactg

SEQ ID NO: 49787 - DNA, 25 bp, Mus musculus
aagatggcgttgcattccttggaat

SEQ ID NO: 49788 - DNA, 25 bp, Mus musculus
aagatggcgttggattccttggaat

SEQ ID NO: 49789 - DNA, 25 bp, Mus musculus
aagatggcgtttcctcctatgtaaa

SEQ ID NO: 49790 - DNA, 25 bp, Mus musculus
aagatggcgtttgctcctatgtaaa

SEQ ID NO: 49791 - DNA, 25 bp, Mus musculus
aagatggctaatctcttgcactctc

SEQ ID NO: 49792 - DNA, 25 bp, Mus musculus
aagatggctaatgtcttgcactctc

SEQ ID NO: 49793 - DNA, 25 bp, Mus musculus
aagatggctagacctctcttcactg

SEQ ID NO: 49794 - DNA, 25 bp, Mus musculus
aagatggctagagctctcttcactg

SEQ ID NO: 49795 - DNA, 25 bp, Mus musculus
aagatggctcatcaacttgcatata

SEQ ID NO: 49796 - DNA, 25 bp, Mus musculus
aagatggctcatgaacttgcatata

SEQ ID NO: 49797 - DNA, 25 bp, Mus musculus
aagatggctcctacaacattttcag

SEQ ID NO: 49798 - DNA, 25 bp, Mus musculus
aagatggctccttcaacattttcag

SEQ ID NO: 49799 - DNA, 25 bp, Mus musculus
aagatggctctcagcaaaatctgtt

SEQ ID NO: 49800 - DNA, 25 bp, Mus musculus
aagatggctctctgcaaaatctgtt

SEQ ID NO: 49801 - DNA, 25 bp, Mus musculus
aagatggctgatctttggagacccc

SEQ ID NO: 49802 - DNA, 25 bp, Mus musculus
aagatggctgatgtttggagacccc

SEQ ID NO: 49803 - DNA, 25 bp, Mus musculus
aagatggctgccatgactggatgag

SEQ ID NO: 49804 - DNA, 25 bp, Mus musculus
aagatggctgccctctgacctgctg

SEQ ID NO: 49805 - DNA, 25 bp, Mus musculus
aagatggctgccgtctgacctgctg

SEQ ID NO: 49806 - DNA, 25 bp, Mus musculus
aagatggctgccttgactggatgag

SEQ ID NO: 49807 - DNA, 25 bp, Mus musculus
aagatggctgctcaggccgagccca

SEQ ID NO: 49808 - DNA, 25 bp, Mus musculus
aagatggctgctgaggccgagccca

SEQ ID NO: 49809 - DNA, 25 bp, Mus musculus
aagatggctggcctacttttctact

SEQ ID NO: 49810 - DNA, 25 bp, Mus musculus
aagatggctggcgtacttttctact

SEQ ID NO: 49811 - DNA, 25 bp, Mus musculus
aagatggctgtgcttttcttggtgt

SEQ ID NO: 49812 - DNA, 25 bp, Mus musculus
aagatggctgtggttttcttggtgt

SEQ ID NO: 49813 - DNA, 25 bp, Mus musculus
aagatggcttccatgcagtgttggc

SEQ ID NO: 49814 - DNA, 25 bp, Mus musculus
aagatggcttccttgcagtgttggc

SEQ ID NO: 49815 - DNA, 25 bp, Mus musculus
aagatggcttggacgacacagctgg

SEQ ID NO: 49816 - DNA, 25 bp, Mus musculus
aagatggcttggtcgacacagctgg

SEQ ID NO: 49817 - DNA, 25 bp, Mus musculus
aagatggctttaaactgggcagtgg

SEQ ID NO: 49818 - DNA, 25 bp, Mus musculus
aagatggctttatactgggcagtgg

SEQ ID NO: 49819 - DNA, 25 bp, Mus musculus
aagatgggaacacctatcccttcag

SEQ ID NO: 49820 - DNA, 25 bp, Mus musculus
aagatgggaacagctatcccttcag

SEQ ID NO: 49821 - DNA, 25 bp, Mus musculus
aagatgggactgctttccgttccac

SEQ ID NO: 49822 - DNA, 25 bp, Mus musculus
aagatgggactggtttccgttccac

SEQ ID NO: 49823 - DNA, 25 bp, Mus musculus
aagatgggagcccttgcgctaaagc

SEQ ID NO: 49824 - DNA, 25 bp, Mus musculus
aagatgggagccgttgcgctaaagc

SEQ ID NO: 49825 - DNA, 25 bp, Mus musculus
aagatgggcaagatgggactcctcc

SEQ ID NO: 49826 - DNA, 25 bp, Mus musculus
aagatgggcaagttgggactcctcc

SEQ ID NO: 49827 - DNA, 25 bp, Mus musculus
aagatgggcatcatttgtattaaga

SEQ ID NO: 49828 - DNA, 25 bp, Mus musculus
aagatgggcatcttttgtattaaga

SEQ ID NO: 49829 - DNA, 25 bp, Mus musculus
aagatgggcattcttccattataga

SEQ ID NO: 49830 - DNA, 25 bp, Mus musculus
aagatgggcattgttccattataga

SEQ ID NO: 49831 - DNA, 25 bp, Mus musculus
aagatgggcccaattccgtgcattg

SEQ ID NO: 49832 - DNA, 25 bp, Mus musculus
aagatgggcccaccatagagctcct

SEQ ID NO: 49833 - DNA, 25 bp, Mus musculus
aagatgggcccagcatagagctcct

SEQ ID NO: 49834 - DNA, 25 bp, Mus musculus
aagatgggcccatttccgtgcattg

SEQ ID NO: 49835 - DNA, 25 bp, Mus musculus
aagatgggcgagacctagtcctgcc

SEQ ID NO: 49836 - DNA, 25 bp, Mus musculus
aagatgggcgagtcctagtcctgcc

SEQ ID NO: 49837 - DNA, 25 bp, Mus musculus
aagatgggcttcaggcaatcaacaa

SEQ ID NO: 49838 - DNA, 25 bp, Mus musculus
aagatgggcttctggcaatcaacaa

SEQ ID NO: 49839 - DNA, 25 bp, Mus musculus
aagatgggtctcagtggccacagct

SEQ ID NO: 49840 - DNA, 25 bp, Mus musculus
aagatgggtctctgtggccacagct

SEQ ID NO: 49841 - DNA, 25 bp, Mus musculus
aagatgggtgacactggcctttgcc

SEQ ID NO: 49842 - DNA, 25 bp, Mus musculus
aagatgggtgactctggcctttgcc

SEQ ID NO: 49843 - DNA, 25 bp, Mus musculus
aagatggtacaacccggcggactga

SEQ ID NO: 49844 - DNA, 25 bp, Mus musculus
aagatggtacaagccggcggactga

SEQ ID NO: 49845 - DNA, 25 bp, Mus musculus
aagatggtacgcaatccaggccaga

SEQ ID NO: 49846 - DNA, 25 bp, Mus musculus
aagatggtacgctatccaggccaga

SEQ ID NO: 49847 - DNA, 25 bp, Mus musculus
aagatggtataccttctcttgtctg

SEQ ID NO: 49848 - DNA, 25 bp, Mus musculus
aagatggtatacgttctcttgtctg

SEQ ID NO: 49849 - DNA, 25 bp, Mus musculus
aagatggtcaacactctgacaccgg

SEQ ID NO: 49850 - DNA, 25 bp, Mus musculus
aagatggtcaactctctgacaccgg

SEQ ID NO: 49851 - DNA, 25 bp, Mus musculus
aagatggtcagtccggtggtcccca

SEQ ID NO: 49852 - DNA, 25 bp, Mus musculus
aagatggtcagtgcggtggtcccca

SEQ ID NO: 49853 - DNA, 25 bp, Mus musculus
aagatggtcatccaccccattgagg

SEQ ID NO: 49854 - DNA, 25 bp, Mus musculus
aagatggtcatcgaccccattgagg

SEQ ID NO: 49855 - DNA, 25 bp, Mus musculus
aagatggtccatacctaatgcctca

SEQ ID NO: 49856 - DNA, 25 bp, Mus musculus
aagatggtccattcctaatgcctca

SEQ ID NO: 49857 - DNA, 25 bp, Mus musculus
aagatggtcgctcatttcactctca

SEQ ID NO: 49858 - DNA, 25 bp, Mus musculus
aagatggtcgctgatttcactctca

SEQ ID NO: 49859 - DNA, 25 bp, Mus musculus
aagatggtcgtgactcttacctttg

SEQ ID NO: 49860 - DNA, 25 bp, Mus musculus
aagatggtcgtgtctcttacctttg

SEQ ID NO: 49861 - DNA, 25 bp, Mus musculus
aagatggtcttaccctgcttgaagt

SEQ ID NO: 49862 - DNA, 25 bp, Mus musculus
aagatggtcttagcctgcttgaagt

SEQ ID NO: 49863 - DNA, 25 bp, Mus musculus
aagatggtgagcacggcttgatgta

SEQ ID NO: 49864 - DNA, 25 bp, Mus musculus
aagatggtgagctcggcttgatgta

SEQ ID NO: 49865 - DNA, 25 bp, Mus musculus
aagatggtgcacagatctccacggt

SEQ ID NO: 49866 - DNA, 25 bp, Mus musculus
aagatggtgcactgatctccacggt

SEQ ID NO: 49867 - DNA, 25 bp, Mus musculus
aagatggtgcctcggtcagaccact

SEQ ID NO: 49868 - DNA, 25 bp, Mus musculus
aagatggtgcctgggtcagaccact

SEQ ID NO: 49869 - DNA, 25 bp, Mus musculus
aagatggtgctgctatccactgcct

SEQ ID NO: 49870 - DNA, 25 bp, Mus musculus
aagatggtgctggtatccactgcct

SEQ ID NO: 49871 - DNA, 25 bp, Mus musculus
aagatggtggccatcgatcccgcaa

SEQ ID NO: 49872 - DNA, 25 bp, Mus musculus
aagatggtggccttcgatcccgcaa

SEQ ID NO: 49873 - DNA, 25 bp, Mus musculus
aagatggtgtatccttcctgcatac

SEQ ID NO: 49874 - DNA, 25 bp, Mus musculus
aagatggtgtatgcttcctgcatac

SEQ ID NO: 49875 - DNA, 25 bp, Mus musculus
aagatggtgtggcacagcaatactg

SEQ ID NO: 49876 - DNA, 25 bp, Mus musculus
aagatggtgtgggacagcaatactg

SEQ ID NO: 49877 - DNA, 25 bp, Mus musculus
aagatggttacgaccgcatccacta

SEQ ID NO: 49878 - DNA, 25 bp, Mus musculus
aagatggttacgtccgcatccacta

SEQ ID NO: 49879 - DNA, 25 bp, Mus musculus
aagatggttagaaccctacctcatg

SEQ ID NO: 49880 - DNA, 25 bp, Mus musculus
aagatggttagatccctacctcatg

SEQ ID NO: 49881 - DNA, 25 bp, Mus musculus
aagatggttaggagcctgtcctcta

SEQ ID NO: 49882 - DNA, 25 bp, Mus musculus
aagatggttaggtgcctgtcctcta

SEQ ID NO: 49883 - DNA, 25 bp, Mus musculus
aagatggttctcaaacatggccaca

SEQ ID NO: 49884 - DNA, 25 bp, Mus musculus
aagatggttctctaacatggccaca

SEQ ID NO: 49885 - DNA, 25 bp, Mus musculus
aagatggtttctagctatagccctg

SEQ ID NO: 49886 - DNA, 25 bp, Mus musculus
aagatggtttctattgctcgtcact

SEQ ID NO: 49887 - DNA, 25 bp, Mus musculus
aagatggtttctcccttgaagtcgg

SEQ ID NO: 49888 - DNA, 25 bp, Mus musculus
aagatggtttctgccttgaagtcgg

SEQ ID NO: 49889 - DNA, 25 bp, Mus musculus
aagatggtttcttgctatagccctg

SEQ ID NO: 49890 - DNA, 25 bp, Mus musculus
aagatggtttcttttgctcgtcact

SEQ ID NO: 49891 - DNA, 25 bp, Mus musculus
aagatgtaattgcagcccttgttaa

SEQ ID NO: 49892 - DNA, 25 bp, Mus musculus
aagatgtaattggagcccttgttaa

SEQ ID NO: 49893 - DNA, 25 bp, Mus musculus
aagatgtaatttctaaacctcaaat

SEQ ID NO: 49894 - DNA, 25 bp, Mus musculus
aagatgtaatttgtaaacctcaaat

SEQ ID NO: 49895 - DNA, 25 bp, Mus musculus
aagatgtacatgatttctgaactag

SEQ ID NO: 49896 - DNA, 25 bp, Mus musculus
aagatgtacatgttttctgaactag

SEQ ID NO: 49897 - DNA, 25 bp, Mus musculus
aagatgtaccacacacttgaaaata

SEQ ID NO: 49898 - DNA, 25 bp, Mus musculus
aagatgtaccactcacttgaaaata

SEQ ID NO: 49899 - DNA, 25 bp, Mus musculus
aagatgtacgttcacactagaatca

SEQ ID NO: 49900 - DNA, 25 bp, Mus musculus
aagatgtacgttgacactagaatca

SEQ ID NO: 49901 - DNA, 25 bp, Mus musculus
aagatgtagcttccgaatttgaacc

SEQ ID NO: 49902 - DNA, 25 bp, Mus musculus
aagatgtagcttgcgaatttgaacc

SEQ ID NO: 49903 - DNA, 25 bp, Mus musculus
aagatgtagtctcagccaagttaac

SEQ ID NO: 49904 - DNA, 25 bp, Mus musculus
aagatgtagtctgagccaagttaac

SEQ ID NO: 49905 - DNA, 25 bp, Mus musculus
aagatgtatacacacttccatgcta

SEQ ID NO: 49906 - DNA, 25 bp, Mus musculus
aagatgtatacagacttccatgcta

SEQ ID NO: 49907 - DNA, 25 bp, Mus musculus
aagatgtatgagctattatgttgtc

SEQ ID NO: 49908 - DNA, 25 bp, Mus musculus
aagatgtatgaggtattatgttgtc

SEQ ID NO: 49909 - DNA, 25 bp, Mus musculus
aagatgtatgcactctgccccagga

SEQ ID NO: 49910 - DNA, 25 bp, Mus musculus
aagatgtatgcagtctgccccagga

SEQ ID NO: 49911 - DNA, 25 bp, Mus musculus
aagatgtatgtgattcagagctgga

SEQ ID NO: 49912 - DNA, 25 bp, Mus musculus
aagatgtatgtgtttcagagctgga

SEQ ID NO: 49913 - DNA, 25 bp, Mus musculus
aagatgtattgcccgatgcaatgag

SEQ ID NO: 49914 - DNA, 25 bp, Mus musculus
aagatgtattgcgcgatgcaatgag

SEQ ID NO: 49915 - DNA, 25 bp, Mus musculus
aagatgtcaagcaggacccaccgtc

SEQ ID NO: 49916 - DNA, 25 bp, Mus musculus
aagatgtcaagctggacccaccgtc

SEQ ID NO: 49917 - DNA, 25 bp, Mus musculus
aagatgtcagatcccctaattgtag

SEQ ID NO: 49918 - DNA, 25 bp, Mus musculus
aagatgtcagatgccctaattgtag

SEQ ID NO: 49919 - DNA, 25 bp, Mus musculus
aagatgtcaggcagagtcccttctc

SEQ ID NO: 49920 - DNA, 25 bp, Mus musculus
aagatgtcaggctgagtcccttctc

SEQ ID NO: 49921 - DNA, 25 bp, Mus musculus
aagatgtcatcaagctagcctgcgc

SEQ ID NO: 49922 - DNA, 25 bp, Mus musculus
aagatgtcatcatgctagcctgcgc

SEQ ID NO: 49923 - DNA, 25 bp, Mus musculus
aagatgtcatctcaagctgccgtca

SEQ ID NO: 49924 - DNA, 25 bp, Mus musculus
aagatgtcatctgaagctgccgtca

SEQ ID NO: 49925 - DNA, 25 bp, Mus musculus
aagatgtcctggaccgggccaggaa

SEQ ID NO: 49926 - DNA, 25 bp, Mus musculus
aagatgtcctggtccgggccaggaa

SEQ ID NO: 49927 - DNA, 25 bp, Mus musculus
aagatgtccttgacacaaccgtcaa

SEQ ID NO: 49928 - DNA, 25 bp, Mus musculus
aagatgtccttgtcacaaccgtcaa

SEQ ID NO: 49929 - DNA, 25 bp, Mus musculus
aagatgtcggtgactgtatcacaat

SEQ ID NO: 49930 - DNA, 25 bp, Mus musculus
aagatgtcggtgtctgtatcacaat

SEQ ID NO: 49931 - DNA, 25 bp, Mus musculus
aagatgtctaatactctgcaagaga

SEQ ID NO: 49932 - DNA, 25 bp, Mus musculus
aagatgtctaattctctgcaagaga

SEQ ID NO: 49933 - DNA, 25 bp, Mus musculus
aagatgtctattcacgtctcaaagg

SEQ ID NO: 49934 - DNA, 25 bp, Mus musculus
aagatgtctattgacgtctcaaagg

SEQ ID NO: 49935 - DNA, 25 bp, Mus musculus
aagatgtctcctattttactctgag

SEQ ID NO: 49936 - DNA, 25 bp, Mus musculus
aagatgtctccttttttactctgag

SEQ ID NO: 49937 - DNA, 25 bp, Mus musculus
aagatgtctctcctctaccctaact

SEQ ID NO: 49938 - DNA, 25 bp, Mus musculus
aagatgtctctcgtctaccctaact

SEQ ID NO: 49939 - DNA, 25 bp, Mus musculus
aagatgtctctgcaggacctgcact

SEQ ID NO: 49940 - DNA, 25 bp, Mus musculus
aagatgtctctggaggacctgcact

SEQ ID NO: 49941 - DNA, 25 bp, Mus musculus
aagatgtctgacacgatggacacag

SEQ ID NO: 49942 - DNA, 25 bp, Mus musculus
aagatgtctgactcgatggacacag

SEQ ID NO: 49943 - DNA, 25 bp, Mus musculus
aagatgtctgcaaactttggctgca

SEQ ID NO: 49944 - DNA, 25 bp, Mus musculus
aagatgtctgcactctgtctcattt

SEQ ID NO: 49945 - DNA, 25 bp, Mus musculus
aagatgtctgcagtctgtctcattt

SEQ ID NO: 49946 - DNA, 25 bp, Mus musculus
aagatgtctgcatactttggctgca

SEQ ID NO: 49947 - DNA, 25 bp, Mus musculus
aagatgtcttgactccgccatacag

SEQ ID NO: 49948 - DNA, 25 bp, Mus musculus
aagatgtcttgagtccgccatacag

SEQ ID NO: 49949 - DNA, 25 bp, Mus musculus
aagatgtcttgcacccacaaatatg

SEQ ID NO: 49950 - DNA, 25 bp, Mus musculus
aagatgtcttgcagctgttttagaa

SEQ ID NO: 49951 - DNA, 25 bp, Mus musculus
aagatgtcttgcaggaacctggcac

SEQ ID NO: 49952 - DNA, 25 bp, Mus musculus
aagatgtcttgctcccacaaatatg

SEQ ID NO: 49953 - DNA, 25 bp, Mus musculus
aagatgtcttgctgctgttttagaa

SEQ ID NO: 49954 - DNA, 25 bp, Mus musculus
aagatgtcttgctggaacctggcac

SEQ ID NO: 49955 - DNA, 25 bp, Mus musculus
aagatgtgaagaataaatgcctatt

SEQ ID NO: 49956 - DNA, 25 bp, Mus musculus
aagatgtgaagattaaatgcctatt

SEQ ID NO: 49957 - DNA, 25 bp, Mus musculus
aagatgtgaagcactgctgctctag

SEQ ID NO: 49958 - DNA, 25 bp, Mus musculus
aagatgtgaagctctgctgctctag

SEQ ID NO: 49959 - DNA, 25 bp, Mus musculus
aagatgtgaccaccgaactgttcgt

SEQ ID NO: 49960 - DNA, 25 bp, Mus musculus
aagatgtgaccagcgaactgttcgt

SEQ ID NO: 49961 - DNA, 25 bp, Mus musculus
aagatgtgagttaatccacgcctcc

SEQ ID NO: 49962 - DNA, 25 bp, Mus musculus
aagatgtgagtttatccacgcctcc

SEQ ID NO: 49963 - DNA, 25 bp, Mus musculus
aagatgtgatcactgcaggcgcagc

SEQ ID NO: 49964 - DNA, 25 bp, Mus musculus
aagatgtgatcagtgcaggcgcagc

SEQ ID NO: 49965 - DNA, 25 bp, Mus musculus
aagatgtgatccaatactggccaat

SEQ ID NO: 49966 - DNA, 25 bp, Mus musculus
aagatgtgatcctatactggccaat

SEQ ID NO: 49967 - DNA, 25 bp, Mus musculus
aagatgtgcaagattattccggaac

SEQ ID NO: 49968 - DNA, 25 bp, Mus musculus
aagatgtgcaagtttattccggaac

SEQ ID NO: 49969 - DNA, 25 bp, Mus musculus
aagatgtgcgtcacctacagcttac

SEQ ID NO: 49970 - DNA, 25 bp, Mus musculus
aagatgtgcgtctcctacagcttac

SEQ ID NO: 49971 - DNA, 25 bp, Mus musculus
aagatgtgctacacctgcggcttgg

SEQ ID NO: 49972 - DNA, 25 bp, Mus musculus
aagatgtgctactcctgcggcttgg

SEQ ID NO: 49973 - DNA, 25 bp, Mus musculus
aagatgtgctagacacgccgggcca

SEQ ID NO: 49974 - DNA, 25 bp, Mus musculus
aagatgtgctagtcacgccgggcca

SEQ ID NO: 49975 - DNA, 25 bp, Mus musculus
aagatgtgctctattgcccttgggc

SEQ ID NO: 49976 - DNA, 25 bp, Mus musculus
aagatgtgctcttttgcccttgggc

SEQ ID NO: 49977 - DNA, 25 bp, Mus musculus
aagatgtgctgtacagtgctcaact

SEQ ID NO: 49978 - DNA, 25 bp, Mus musculus
aagatgtgctgttcagtgctcaact

SEQ ID NO: 49979 - DNA, 25 bp, Mus musculus
aagatgtggcttagcttggtgccgc

SEQ ID NO: 49980 - DNA, 25 bp, Mus musculus
aagatgtggctttgcttggtgccgc

SEQ ID NO: 49981 - DNA, 25 bp, Mus musculus
aagatgtgggtccacgccagtccca

SEQ ID NO: 49982 - DNA, 25 bp, Mus musculus
aagatgtgggtcgacgccagtccca

SEQ ID NO: 49983 - DNA, 25 bp, Mus musculus
aagatgtggtccaggttttgagctc

SEQ ID NO: 49984 - DNA, 25 bp, Mus musculus
aagatgtggtcctggttttgagctc

SEQ ID NO: 49985 - DNA, 25 bp, Mus musculus
aagatgtgtatgctcactccgtagt

SEQ ID NO: 49986 - DNA, 25 bp, Mus musculus
aagatgtgtatggtcactccgtagt

SEQ ID NO: 49987 - DNA, 25 bp, Mus musculus
aagatgtgtcagacctacttgtgat

SEQ ID NO: 49988 - DNA, 25 bp, Mus musculus
aagatgtgtcagtcctacttgtgat

SEQ ID NO: 49989 - DNA, 25 bp, Mus musculus
aagatgtgtcatccctgaggaacat

SEQ ID NO: 49990 - DNA, 25 bp, Mus musculus
aagatgtgtcatgcctgaggaacat

SEQ ID NO: 49991 - DNA, 25 bp, Mus musculus
aagatgtgtccgagtacagctgccg

SEQ ID NO: 49992 - DNA, 25 bp, Mus musculus
aagatgtgtccgtgtacagctgccg

SEQ ID NO: 49993 - DNA, 25 bp, Mus musculus
aagatgtgtctgcttgacctttctc

SEQ ID NO: 49994 - DNA, 25 bp, Mus musculus
aagatgtgtctggttgacctttctc

SEQ ID NO: 49995 - DNA, 25 bp, Mus musculus
aagatgtgtcttctgccggttgtac

SEQ ID NO: 49996 - DNA, 25 bp, Mus musculus
aagatgtgtcttgtgccggttgtac

SEQ ID NO: 49997 - DNA, 25 bp, Mus musculus
aagatgtgtgggatcctgtacttac

SEQ ID NO: 49998 - DNA, 25 bp, Mus musculus
aagatgtgtgggttcctgtacttac

SEQ ID NO: 49999 - DNA, 25 bp, Mus musculus
aagatgtgtgtacccactacccagc

SEQ ID NO: 50000 - DNA, 25 bp, Mus musculus
aagatgtgtgtagccactacccagc

SEQ ID NO: 50001 - DNA, 25 bp, Mus musculus
aagatgttacttctggtggtgctcc

SEQ ID NO: 50002 - DNA, 25 bp, Mus musculus
aagatgttacttgtggtggtgctcc

SEQ ID NO: 50003 - DNA, 25 bp, Mus musculus
aagatgttattcatgctgttagaac

SEQ ID NO: 50004 - DNA, 25 bp, Mus musculus
aagatgttattcttgctgttagaac

SEQ ID NO: 50005 - DNA, 25 bp, Mus musculus
aagatgttcacactaaagagagaga

SEQ ID NO: 50006 - DNA, 25 bp, Mus musculus
aagatgttcacagtaaagagagaga

SEQ ID NO: 50007 - DNA, 25 bp, Mus musculus
aagatgttcagtccgctcaagcgct

SEQ ID NO: 50008 - DNA, 25 bp, Mus musculus
aagatgttcagtgcgctcaagcgct

SEQ ID NO: 50009 - DNA, 25 bp, Mus musculus
aagatgttcataacctttaggcatt

SEQ ID NO: 50010 - DNA, 25 bp, Mus musculus
aagatgttcatatcctttaggcatt

SEQ ID NO: 50011 - DNA, 25 bp, Mus musculus
aagatgttccaaatgcaagagtaac

SEQ ID NO: 50012 - DNA, 25 bp, Mus musculus
aagatgttccaattgcaagagtaac

SEQ ID NO: 50013 - DNA, 25 bp, Mus musculus
aagatgttccatattcacaccagca

SEQ ID NO: 50014 - DNA, 25 bp, Mus musculus
aagatgttccattttcacaccagca

SEQ ID NO: 50015 - DNA, 25 bp, Mus musculus
aagatgttcccaattaagccaagag

SEQ ID NO: 50016 - DNA, 25 bp, Mus musculus
aagatgttcccatttaagccaagag

SEQ ID NO: 50017 - DNA, 25 bp, Mus musculus
aagatgttcctcaatcttagttgtg

SEQ ID NO: 50018 - DNA, 25 bp, Mus musculus
aagatgttcctctatcttagttgtg

SEQ ID NO: 50019 - DNA, 25 bp, Mus musculus
aagatgttcctgagttatggctgaa

SEQ ID NO: 50020 - DNA, 25 bp, Mus musculus
aagatgttcctgtgttatggctgaa

SEQ ID NO: 50021 - DNA, 25 bp, Mus musculus
aagatgttcgctatattccttttgg

SEQ ID NO: 50022 - DNA, 25 bp, Mus musculus
aagatgttcgctttattccttttgg

SEQ ID NO: 50023 - DNA, 25 bp, Mus musculus
aagatgttctctataccgggcgaat

SEQ ID NO: 50024 - DNA, 25 bp, Mus musculus
aagatgttctctttaccgggcgaat

SEQ ID NO: 50025 - DNA, 25 bp, Mus musculus
aagatgttctggctttattctgtaa

SEQ ID NO: 50026 - DNA, 25 bp, Mus musculus
aagatgttctgggtttattctgtaa

SEQ ID NO: 50027 - DNA, 25 bp, Mus musculus
aagatgttgaagctcctctgtgtgg

SEQ ID NO: 50028 - DNA, 25 bp, Mus musculus
aagatgttgaaggtcctctgtgtgg

SEQ ID NO: 50029 - DNA, 25 bp, Mus musculus
aagatgttgcggaatctgctggccc

SEQ ID NO: 50030 - DNA, 25 bp, Mus musculus
aagatgttgcggtatctgctggccc

SEQ ID NO: 50031 - DNA, 25 bp, Mus musculus
aagatgttggcaatctgggcagcct

SEQ ID NO: 50032 - DNA, 25 bp, Mus musculus
aagatgttggcattctgggcagcct

SEQ ID NO: 50033 - DNA, 25 bp, Mus musculus
aagatgttgggcatatgacccttta

SEQ ID NO: 50034 - DNA, 25 bp, Mus musculus
aagatgttgggcttatgacccttta

SEQ ID NO: 50035 - DNA, 25 bp, Mus musculus
aagatgttgtagagtcattgtcccc

SEQ ID NO: 50036 - DNA, 25 bp, Mus musculus
aagatgttgtagtgtcattgtcccc

SEQ ID NO: 50037 - DNA, 25 bp, Mus musculus
aagatgtttatacgtggacacacct

SEQ ID NO: 50038 - DNA, 25 bp, Mus musculus
aagatgtttataggtggacacacct

SEQ ID NO: 50039 - DNA, 25 bp, Mus musculus
aagatgtttcacaatgcaggaacct

SEQ ID NO: 50040 - DNA, 25 bp, Mus musculus
aagatgtttcactatgcaggaacct

SEQ ID NO: 50041 - DNA, 25 bp, Mus musculus
aagatgttttcgctgattccctgac

SEQ ID NO: 50042 - DNA, 25 bp, Mus musculus
aagatgttttcggtgattccctgac

SEQ ID NO: 50043 - DNA, 25 bp, Mus musculus
aagatgttttctcgcaaaggcttcc

SEQ ID NO: 50044 - DNA, 25 bp, Mus musculus
aagatgttttctggcaaaggcttcc

SEQ ID NO: 50045 - DNA, 25 bp, Mus musculus
aagattaaatagctcctccttggag

SEQ ID NO: 50046 - DNA, 25 bp, Mus musculus
aagattaaataggtcctccttggag

SEQ ID NO: 50047 - DNA, 25 bp, Mus musculus
aagattaaatctagcttccccacac

SEQ ID NO: 50048 - DNA, 25 bp, Mus musculus
aagattaaatcttgcttccccacac

SEQ ID NO: 50049 - DNA, 25 bp, Mus musculus
aagattaaatgcctattcttactga

SEQ ID NO: 50050 - DNA, 25 bp, Mus musculus
aagattaaatgcgtattcttactga

SEQ ID NO: 50051 - DNA, 25 bp, Mus musculus
aagattaagtgcctggcctttgagt

SEQ ID NO: 50052 - DNA, 25 bp, Mus musculus
aagattaagtgcgtggcctttgagt

SEQ ID NO: 50053 - DNA, 25 bp, Mus musculus
aagattaatacacccctcatgccag

SEQ ID NO: 50054 - DNA, 25 bp, Mus musculus
aagattaatacagccctcatgccag

SEQ ID NO: 50055 - DNA, 25 bp, Mus musculus
aagattaatcacacaatagaggcat

SEQ ID NO: 50056 - DNA, 25 bp, Mus musculus
aagattaatcactcaatagaggcat

SEQ ID NO: 50057 - DNA, 25 bp, Mus musculus
aagattacaggcacgtaccctactg

SEQ ID NO: 50058 - DNA, 25 bp, Mus musculus
aagattacaggcctatgacatcatg

SEQ ID NO: 50059 - DNA, 25 bp, Mus musculus
aagattacaggcgtatgacatcatg

SEQ ID NO: 50060 - DNA, 25 bp, Mus musculus
aagattacaggctcgtaccctactg

SEQ ID NO: 50061 - DNA, 25 bp, Mus musculus
aagattaccaacagcacttttgtgc

SEQ ID NO: 50062 - DNA, 25 bp, Mus musculus
aagattaccaacctcactttgtaga

SEQ ID NO: 50063 - DNA, 25 bp, Mus musculus
aagattaccaacgtcactttgtaga

SEQ ID NO: 50064 - DNA, 25 bp, Mus musculus
aagattaccaactgcacttttgtgc

SEQ ID NO: 50065 - DNA, 25 bp, Mus musculus
aagattacccttcgctacgcattta

SEQ ID NO: 50066 - DNA, 25 bp, Mus musculus
aagattacccttggctacgcattta

SEQ ID NO: 50067 - DNA, 25 bp, Mus musculus
aagattacctttctcgtctactaca

SEQ ID NO: 50068 - DNA, 25 bp, Mus musculus
aagattacctttgtcgtctactaca

SEQ ID NO: 50069 - DNA, 25 bp, Mus musculus
aagattactatcctctgccagcagg

SEQ ID NO: 50070 - DNA, 25 bp, Mus musculus
aagattactatcgtctgccagcagg

SEQ ID NO: 50071 - DNA, 25 bp, Mus musculus
aagattactgaacctgtgaccaaat

SEQ ID NO: 50072 - DNA, 25 bp, Mus musculus
aagattactgaagctgtgaccaaat

SEQ ID NO: 50073 - DNA, 25 bp, Mus musculus
aagattactgataagctggagacct

SEQ ID NO: 50074 - DNA, 25 bp, Mus musculus
aagattactgattagctggagacct

SEQ ID NO: 50075 - DNA, 25 bp, Mus musculus
aagattactgcaacaccaggtgtgt

SEQ ID NO: 50076 - DNA, 25 bp, Mus musculus
aagattactgcatcaccaggtgtgt

SEQ ID NO: 50077 - DNA, 25 bp, Mus musculus
aagattagactgagagtctgaccct

SEQ ID NO: 50078 - DNA, 25 bp, Mus musculus
aagattagactgtgagtctgaccct

SEQ ID NO: 50079 - DNA, 25 bp, Mus musculus
aagattagctatcgaaggatcttgt

SEQ ID NO: 50080 - DNA, 25 bp, Mus musculus
aagattagctatggaaggatcttgt

SEQ ID NO: 50081 - DNA, 25 bp, Mus musculus
aagattataagtccttctgagaaga

SEQ ID NO: 50082 - DNA, 25 bp, Mus musculus
aagattataagtgcttctgagaaga

SEQ ID NO: 50083 - DNA, 25 bp, Mus musculus
aagattatactcaccgcatctggtc

SEQ ID NO: 50084 - DNA, 25 bp, Mus musculus
aagattatactctccgcatctggtc

SEQ ID NO: 50085 - DNA, 25 bp, Mus musculus
aagattatcagcaaggccttctgct

SEQ ID NO: 50086 - DNA, 25 bp, Mus musculus
aagattatcagctaggccttctgct

SEQ ID NO: 50087 - DNA, 25 bp, Mus musculus
aagattatccatattcaagggggtg

SEQ ID NO: 50088 - DNA, 25 bp, Mus musculus
aagattatccattttcaagggggtg

SEQ ID NO: 50089 - DNA, 25 bp, Mus musculus
aagattatcctcaatgcttccatcc

SEQ ID NO: 50090 - DNA, 25 bp, Mus musculus
aagattatcctctatgcttccatcc

SEQ ID NO: 50091 - DNA, 25 bp, Mus musculus
aagattatgaagcaggtgacaggtc

SEQ ID NO: 50092 - DNA, 25 bp, Mus musculus
aagattatgaaggaggtgacaggtc

SEQ ID NO: 50093 - DNA, 25 bp, Mus musculus
aagattatgtttagagagaacttcc

SEQ ID NO: 50094 - DNA, 25 bp, Mus musculus
aagattatgttttgagagaacttcc

SEQ ID NO: 50095 - DNA, 25 bp, Mus musculus
aagattattctaattgtgcattgaa

SEQ ID NO: 50096 - DNA, 25 bp, Mus musculus
aagattattctatttgtgcattgaa

SEQ ID NO: 50097 - DNA, 25 bp, Mus musculus
aagattatttctcatgccttcctct

SEQ ID NO: 50098 - DNA, 25 bp, Mus musculus
aagattatttctgatgccttcctct

SEQ ID NO: 50099 - DNA, 25 bp, Mus musculus
aagattcacagtattagcctttatg

SEQ ID NO: 50100 - DNA, 25 bp, Mus musculus
aagattcacagttttagcctttatg

SEQ ID NO: 50101 - DNA, 25 bp, Mus musculus
aagattcacctgaactgccagggta

SEQ ID NO: 50102 - DNA, 25 bp, Mus musculus
aagattcacctgtactgccagggta

SEQ ID NO: 50103 - DNA, 25 bp, Mus musculus
aagattcagaaaaagtccagtccct

SEQ ID NO: 50104 - DNA, 25 bp, Mus musculus
aagattcagaaatagtccagtccct

SEQ ID NO: 50105 - DNA, 25 bp, Mus musculus
aagattcagactcgcgcttgtttcc

SEQ ID NO: 50106 - DNA, 25 bp, Mus musculus
aagattcagactggcgcttgtttcc

SEQ ID NO: 50107 - DNA, 25 bp, Mus musculus
aagattcagcaactcacagccctgg

SEQ ID NO: 50108 - DNA, 25 bp, Mus musculus
aagattcagcaagtcacagccctgg

SEQ ID NO: 50109 - DNA, 25 bp, Mus musculus
aagattcagccacaactttcaaata

SEQ ID NO: 50110 - DNA, 25 bp, Mus musculus
aagattcagccagaactttcaaata

SEQ ID NO: 50111 - DNA, 25 bp, Mus musculus
aagattcagcccctacttgtagtgt

SEQ ID NO: 50112 - DNA, 25 bp, Mus musculus
aagattcagcccctggagccagaca

SEQ ID NO: 50113 - DNA, 25 bp, Mus musculus
aagattcagcccgtacttgtagtgt

SEQ ID NO: 50114 - DNA, 25 bp, Mus musculus
aagattcagcccgtggagccagaca

SEQ ID NO: 50115 - DNA, 25 bp, Mus musculus
aagattcagcgacttgttactcctc

SEQ ID NO: 50116 - DNA, 25 bp, Mus musculus
aagattcagcgagttgttactcctc

SEQ ID NO: 50117 - DNA, 25 bp, Mus musculus
aagattcaggagcagtctgacatgt

SEQ ID NO: 50118 - DNA, 25 bp, Mus musculus
aagattcaggaggagtctgacatgt

SEQ ID NO: 50119 - DNA, 25 bp, Mus musculus
aagattcatatcctggcgggagcat

SEQ ID NO: 50120 - DNA, 25 bp, Mus musculus
aagattcatatcgtggcgggagcat

SEQ ID NO: 50121 - DNA, 25 bp, Mus musculus
aagattcatattaatcacctgtaca

SEQ ID NO: 50122 - DNA, 25 bp, Mus musculus
aagattcatatttatcacctgtaca

SEQ ID NO: 50123 - DNA, 25 bp, Mus musculus
aagattcatcctaactgcagtgtga

SEQ ID NO: 50124 - DNA, 25 bp, Mus musculus
aagattcatccttactgcagtgtga

SEQ ID NO: 50125 - DNA, 25 bp, Mus musculus
aagattcatgaaagggttccacctt

SEQ ID NO: 50126 - DNA, 25 bp, Mus musculus
aagattcatgaatgggttccacctt

SEQ ID NO: 50127 - DNA, 25 bp, Mus musculus
aagattcattctacacaaaagggtg

SEQ ID NO: 50128 - DNA, 25 bp, Mus musculus
aagattcattcttcacaaaagggtg

SEQ ID NO: 50129 - DNA, 25 bp, Mus musculus
aagattccacagacaatgatcacaa

SEQ ID NO: 50130 - DNA, 25 bp, Mus musculus
aagattccacagtcaatgatcacaa

SEQ ID NO: 50131 - DNA, 25 bp, Mus musculus
aagattccacccaatgcaactctga

SEQ ID NO: 50132 - DNA, 25 bp, Mus musculus
aagattccaccctatgcaactctga

SEQ ID NO: 50133 - DNA, 25 bp, Mus musculus
aagattccacgccaattcatcgttg

SEQ ID NO: 50134 - DNA, 25 bp, Mus musculus
aagattccacgcgaattcatcgttg

SEQ ID NO: 50135 - DNA, 25 bp, Mus musculus
aagattccagaacacattgtgggtt

SEQ ID NO: 50136 - DNA, 25 bp, Mus musculus
aagattccagaagacattgtgggtt

SEQ ID NO: 50137 - DNA, 25 bp, Mus musculus
aagattccagagacagtgtcacaaa

SEQ ID NO: 50138 - DNA, 25 bp, Mus musculus
aagattccagagtcagtgtcacaaa

SEQ ID NO: 50139 - DNA, 25 bp, Mus musculus
aagattccaggaaaccttactgtaa

SEQ ID NO: 50140 - DNA, 25 bp, Mus musculus
aagattccaggataccttactgtaa

SEQ ID NO: 50141 - DNA, 25 bp, Mus musculus
aagattccatgtccgccattggaga

SEQ ID NO: 50142 - DNA, 25 bp, Mus musculus
aagattccatgtgcgccattggaga

SEQ ID NO: 50143 - DNA, 25 bp, Mus musculus
aagattcccattccttcatgtagac

SEQ ID NO: 50144 - DNA, 25 bp, Mus musculus
aagattcccattgcttcatgtagac

SEQ ID NO: 50145 - DNA, 25 bp, Mus musculus
aagattccctacatctttcttgagc

SEQ ID NO: 50146 - DNA, 25 bp, Mus musculus
aagattccctacttctttcttgagc

SEQ ID NO: 50147 - DNA, 25 bp, Mus musculus
aagattccgtgtaaggctcagcaca

SEQ ID NO: 50148 - DNA, 25 bp, Mus musculus
aagattccgtgttaggctcagcaca

SEQ ID NO: 50149 - DNA, 25 bp, Mus musculus
aagattcctaagatgctaactgcaa

SEQ ID NO: 50150 - DNA, 25 bp, Mus musculus
aagattcctaagttgctaactgcaa

SEQ ID NO: 50151 - DNA, 25 bp, Mus musculus
aagattcctaccatccttagccatt

SEQ ID NO: 50152 - DNA, 25 bp, Mus musculus
aagattcctaccttccttagccatt

SEQ ID NO: 50153 - DNA, 25 bp, Mus musculus
aagattcctgaacctttctccacag

SEQ ID NO: 50154 - DNA, 25 bp, Mus musculus
aagattcctgaagctttctccacag

SEQ ID NO: 50155 - DNA, 25 bp, Mus musculus
aagattcctggtatgtgtagagtat

SEQ ID NO: 50156 - DNA, 25 bp, Mus musculus
aagattcctggtttgtgtagagtat

SEQ ID NO: 50157 - DNA, 25 bp, Mus musculus
aagattcctgtgagttttttattca

SEQ ID NO: 50158 - DNA, 25 bp, Mus musculus
aagattcctgtgcttgactaccaat

SEQ ID NO: 50159 - DNA, 25 bp, Mus musculus
aagattcctgtggttgactaccaat

SEQ ID NO: 50160 - DNA, 25 bp, Mus musculus
aagattcctgtgtgttttttattca

SEQ ID NO: 50161 - DNA, 25 bp, Mus musculus
aagattccttagctagctcctctct

SEQ ID NO: 50162 - DNA, 25 bp, Mus musculus
aagattccttaggtagctcctctct

SEQ ID NO: 50163 - DNA, 25 bp, Mus musculus
aagattcgaatccagcaactcccaa

SEQ ID NO: 50164 - DNA, 25 bp, Mus musculus
aagattcgaatcgagcaactcccaa

SEQ ID NO: 50165 - DNA, 25 bp, Mus musculus
aagattcgacgcctggaactggaaa

SEQ ID NO: 50166 - DNA, 25 bp, Mus musculus
aagattcgacgcgtggaactggaaa

SEQ ID NO: 50167 - DNA, 25 bp, Mus musculus
aagattcgagatctcaccaagtgtc

SEQ ID NO: 50168 - DNA, 25 bp, Mus musculus
aagattcgagatgtcaccaagtgtc

SEQ ID NO: 50169 - DNA, 25 bp, Mus musculus
aagattcgaggcaccctggccaggg

SEQ ID NO: 50170 - DNA, 25 bp, Mus musculus
aagattcgaggctccctggccaggg

SEQ ID NO: 50171 - DNA, 25 bp, Mus musculus
aagattcgagtcacttgctttcttc

SEQ ID NO: 50172 - DNA, 25 bp, Mus musculus
aagattcgagtctcttgctttcttc

SEQ ID NO: 50173 - DNA, 25 bp, Mus musculus
aagattcgcgtcctgaaacgtcaga

SEQ ID NO: 50174 - DNA, 25 bp, Mus musculus
aagattcgcgtcgtgaaacgtcaga

SEQ ID NO: 50175 - DNA, 25 bp, Mus musculus
aagattcggtgccaatctccccaat

SEQ ID NO: 50176 - DNA, 25 bp, Mus musculus
aagattcggtgcgaatctccccaat

SEQ ID NO: 50177 - DNA, 25 bp, Mus musculus
aagattctagctactcatcgaggca

SEQ ID NO: 50178 - DNA, 25 bp, Mus musculus
aagattctagcttctcatcgaggca

SEQ ID NO: 50179 - DNA, 25 bp, Mus musculus
aagattctaggcagggcatgtcagt

SEQ ID NO: 50180 - DNA, 25 bp, Mus musculus
aagattctaggctgggcatgtcagt

SEQ ID NO: 50181 - DNA, 25 bp, Mus musculus
aagattctatagaacccttcaaggt

SEQ ID NO: 50182 - DNA, 25 bp, Mus musculus
aagattctatagtacccttcaaggt

SEQ ID NO: 50183 - DNA, 25 bp, Mus musculus
aagattctatcgaatcccccatgaa

SEQ ID NO: 50184 - DNA, 25 bp, Mus musculus
aagattctatcgactgtgccatgaa

SEQ ID NO: 50185 - DNA, 25 bp, Mus musculus
aagattctatcgtatcccccatgaa

SEQ ID NO: 50186 - DNA, 25 bp, Mus musculus
aagattctatcgtctgtgccatgaa

SEQ ID NO: 50187 - DNA, 25 bp, Mus musculus
aagattctcagcattccctggtaaa

SEQ ID NO: 50188 - DNA, 25 bp, Mus musculus
aagattctcagctttccctggtaaa

SEQ ID NO: 50189 - DNA, 25 bp, Mus musculus
aagattctcataacagtcaataggg

SEQ ID NO: 50190 - DNA, 25 bp, Mus musculus
aagattctcatatcagtcaataggg

SEQ ID NO: 50191 - DNA, 25 bp, Mus musculus
aagattctcatgagcaatgcttgct

SEQ ID NO: 50192 - DNA, 25 bp, Mus musculus
aagattctcatgtgcaatgcttgct

SEQ ID NO: 50193 - DNA, 25 bp, Mus musculus
aagattctccatagcccaatgtcct

SEQ ID NO: 50194 - DNA, 25 bp, Mus musculus
aagattctccatattgtgatggcaa

SEQ ID NO: 50195 - DNA, 25 bp, Mus musculus
aagattctccattgcccaatgtcct

SEQ ID NO: 50196 - DNA, 25 bp, Mus musculus
aagattctccattttgtgatggcaa

SEQ ID NO: 50197 - DNA, 25 bp, Mus musculus
aagattctctgtccattcatgagta

SEQ ID NO: 50198 - DNA, 25 bp, Mus musculus
aagattctctgtgcattcatgagta

SEQ ID NO: 50199 - DNA, 25 bp, Mus musculus
aagattctgaaaatggaaccctatt

SEQ ID NO: 50200 - DNA, 25 bp, Mus musculus
aagattctgaaattggaaccctatt

SEQ ID NO: 50201 - DNA, 25 bp, Mus musculus
aagattctgaacatcctggctggct

SEQ ID NO: 50202 - DNA, 25 bp, Mus musculus
aagattctgaacttcctggctggct

SEQ ID NO: 50203 - DNA, 25 bp, Mus musculus
aagattctgaagctcactggatttc

SEQ ID NO: 50204 - DNA, 25 bp, Mus musculus
aagattctgaaggtcactggatttc

SEQ ID NO: 50205 - DNA, 25 bp, Mus musculus
aagattctgaataccatcaaagggc

SEQ ID NO: 50206 - DNA, 25 bp, Mus musculus
aagattctgaattccatcaaagggc

SEQ ID NO: 50207 - DNA, 25 bp, Mus musculus
aagattctgcggagtctgctttaaa

SEQ ID NO: 50208 - DNA, 25 bp, Mus musculus
aagattctgcggtgtctgctttaaa

SEQ ID NO: 50209 - DNA, 25 bp, Mus musculus
aagattctgctaattggagtttgga

SEQ ID NO: 50210 - DNA, 25 bp, Mus musculus
aagattctgctatttggagtttgga

SEQ ID NO: 50211 - DNA, 25 bp, Mus musculus
aagattctggatactttactccgcc

SEQ ID NO: 50212 - DNA, 25 bp, Mus musculus
aagattctggattctttactccgcc

SEQ ID NO: 50213 - DNA, 25 bp, Mus musculus
aagattctgggccaagcgatatgga

SEQ ID NO: 50214 - DNA, 25 bp, Mus musculus
aagattctgggcgaagcgatatgga

SEQ ID NO: 50215 - DNA, 25 bp, Mus musculus
aagattcttcaaaggccttctcatc

SEQ ID NO: 50216 - DNA, 25 bp, Mus musculus
aagattcttcaatggccttctcatc

SEQ ID NO: 50217 - DNA, 25 bp, Mus musculus
aagattcttcatcaagctcacaaag

SEQ ID NO: 50218 - DNA, 25 bp, Mus musculus
aagattcttcatgaagctcacaaag

SEQ ID NO: 50219 - DNA, 25 bp, Mus musculus
aagattcttggaaccctgaatagaa

SEQ ID NO: 50220 - DNA, 25 bp, Mus musculus
aagattcttggatccctgaatagaa

SEQ ID NO: 50221 - DNA, 25 bp, Mus musculus
aagattgaaatcacgggcacccctg

SEQ ID NO: 50222 - DNA, 25 bp, Mus musculus
aagattgaaatctcgggcacccctg

SEQ ID NO: 50223 - DNA, 25 bp, Mus musculus
aagattgaagcaaggcgccgagcat

SEQ ID NO: 50224 - DNA, 25 bp, Mus musculus
aagattgaagcatggcgccgagcat

SEQ ID NO: 50225 - DNA, 25 bp, Mus musculus
aagattgaatacatgctggttttta

SEQ ID NO: 50226 - DNA, 25 bp, Mus musculus
aagattgaatacttgctggttttta

SEQ ID NO: 50227 - DNA, 25 bp, Mus musculus
aagattgaatccctgggctgctctg

SEQ ID NO: 50228 - DNA, 25 bp, Mus musculus
aagattgaatccgtgggctgctctg

SEQ ID NO: 50229 - DNA, 25 bp, Mus musculus
aagattgacactagcattgctgccg

SEQ ID NO: 50230 - DNA, 25 bp, Mus musculus
aagattgacacttgcattgctgccg

SEQ ID NO: 50231 - DNA, 25 bp, Mus musculus
aagattgaccttcgctcaagactgc

SEQ ID NO: 50232 - DNA, 25 bp, Mus musculus
aagattgaccttggctcaagactgc

SEQ ID NO: 50233 - DNA, 25 bp, Mus musculus
aagattgacgtgaagtccaggtcag

SEQ ID NO: 50234 - DNA, 25 bp, Mus musculus
aagattgacgtgtagtccaggtcag

SEQ ID NO: 50235 - DNA, 25 bp, Mus musculus
aagattgagaagatagccaggcagt

SEQ ID NO: 50236 - DNA, 25 bp, Mus musculus
aagattgagaagttagccaggcagt

SEQ ID NO: 50237 - DNA, 25 bp, Mus musculus
aagattgagcggacccaacgggaca

SEQ ID NO: 50238 - DNA, 25 bp, Mus musculus
aagattgagcggtcccaacgggaca

SEQ ID NO: 50239 - DNA, 25 bp, Mus musculus
aagattgagggcaggatggccccaa

SEQ ID NO: 50240 - DNA, 25 bp, Mus musculus
aagattgagggctggatggccccaa

SEQ ID NO: 50241 - DNA, 25 bp, Mus musculus
aagattgagtctcataggagctaac

SEQ ID NO: 50242 - DNA, 25 bp, Mus musculus
aagattgagtctgataggagctaac

SEQ ID NO: 50243 - DNA, 25 bp, Mus musculus
aagattgagtgacgtctccctgact

SEQ ID NO: 50244 - DNA, 25 bp, Mus musculus
aagattgagtgaggtctccctgact

SEQ ID NO: 50245 - DNA, 25 bp, Mus musculus
aagattgatcaaatgttcccttctg

SEQ ID NO: 50246 - DNA, 25 bp, Mus musculus
aagattgatcaattgttcccttctg

SEQ ID NO: 50247 - DNA, 25 bp, Mus musculus
aagattgatctgagggctggtgaac

SEQ ID NO: 50248 - DNA, 25 bp, Mus musculus
aagattgatctgtgggctggtgaac

SEQ ID NO: 50249 - DNA, 25 bp, Mus musculus
aagattgattccacagcttgtctga

SEQ ID NO: 50250 - DNA, 25 bp, Mus musculus
aagattgattcctcagcttgtctga

SEQ ID NO: 50251 - DNA, 25 bp, Mus musculus
aagattgattttcccaacactgtcc

SEQ ID NO: 50252 - DNA, 25 bp, Mus musculus
aagattgattttgccaacactgtcc

SEQ ID NO: 50253 - DNA, 25 bp, Mus musculus
aagattgcaataaagccgcttcatc

SEQ ID NO: 50254 - DNA, 25 bp, Mus musculus
aagattgcaatatagccgcttcatc

SEQ ID NO: 50255 - DNA, 25 bp, Mus musculus
aagattgcagatatggtagcccagc

SEQ ID NO: 50256 - DNA, 25 bp, Mus musculus
aagattgcagatttggtagcccagc

SEQ ID NO: 50257 - DNA, 25 bp, Mus musculus
aagattgcagcgcacgtctctggca

SEQ ID NO: 50258 - DNA, 25 bp, Mus musculus
aagattgcagcggacgtctctggca

SEQ ID NO: 50259 - DNA, 25 bp, Mus musculus
aagattgcaggcacttgctggactt

SEQ ID NO: 50260 - DNA, 25 bp, Mus musculus
aagattgcaggctcttgctggactt

SEQ ID NO: 50261 - DNA, 25 bp, Mus musculus
aagattgcaggtctctgagccgtcg

SEQ ID NO: 50262 - DNA, 25 bp, Mus musculus
aagattgcaggtgtctgagccgtcg

SEQ ID NO: 50263 - DNA, 25 bp, Mus musculus
aagattgccattaccgcatagtggc

SEQ ID NO: 50264 - DNA, 25 bp, Mus musculus
aagattgccatttccgcatagtggc

SEQ ID NO: 50265 - DNA, 25 bp, Mus musculus
aagattgcccaaagatccacttgtg

SEQ ID NO: 50266 - DNA, 25 bp, Mus musculus
aagattgcccaatgatccacttgtg

SEQ ID NO: 50267 - DNA, 25 bp, Mus musculus
aagattgcccggctgctgaataaaa

SEQ ID NO: 50268 - DNA, 25 bp, Mus musculus
aagattgcccgggtgctgaataaaa

SEQ ID NO: 50269 - DNA, 25 bp, Mus musculus
aagattgccttcatttgtcctctga

SEQ ID NO: 50270 - DNA, 25 bp, Mus musculus
aagattgccttcttttgtcctctga

SEQ ID NO: 50271 - DNA, 25 bp, Mus musculus
aagattgcctttcattacatagtaa

SEQ ID NO: 50272 - DNA, 25 bp, Mus musculus
aagattgcctttgattacatagtaa

SEQ ID NO: 50273 - DNA, 25 bp, Mus musculus
aagattgcgattagtacgcccacct

SEQ ID NO: 50274 - DNA, 25 bp, Mus musculus
aagattgcgatttgtacgcccacct

SEQ ID NO: 50275 - DNA, 25 bp, Mus musculus
aagattgctcctcagatgccagcgt

SEQ ID NO: 50276 - DNA, 25 bp, Mus musculus
aagattgctcctgagatgccagcgt

SEQ ID NO: 50277 - DNA, 25 bp, Mus musculus
aagattgcttagatccaggtgaaat

SEQ ID NO: 50278 - DNA, 25 bp, Mus musculus
aagattgcttagttccaggtgaaat

SEQ ID NO: 50279 - DNA, 25 bp, Mus musculus
aagattgcttcaattgctttcccca

SEQ ID NO: 50280 - DNA, 25 bp, Mus musculus
aagattgcttcatttgctttcccca

SEQ ID NO: 50281 - DNA, 25 bp, Mus musculus
aagattgctttgagagaccgaggcg

SEQ ID NO: 50282 - DNA, 25 bp, Mus musculus
aagattgctttgtgagaccgaggcg

SEQ ID NO: 50283 - DNA, 25 bp, Mus musculus
aagattggacttcacctgggtcctt

SEQ ID NO: 50284 - DNA, 25 bp, Mus musculus
aagattggacttgacctgggtcctt

SEQ ID NO: 50285 - DNA, 25 bp, Mus musculus
aagattggatgtcaggctcctcagc

SEQ ID NO: 50286 - DNA, 25 bp, Mus musculus
aagattggatgtgaggctcctcagc

SEQ ID NO: 50287 - DNA, 25 bp, Mus musculus
aagattggcggcactgagcgctgtc

SEQ ID NO: 50288 - DNA, 25 bp, Mus musculus
aagattggcggctctgagcgctgtc

SEQ ID NO: 50289 - DNA, 25 bp, Mus musculus
aagattgggcatcaggcctgtgtcc

SEQ ID NO: 50290 - DNA, 25 bp, Mus musculus
aagattgggcatgaggcctgtgtcc

SEQ ID NO: 50291 - DNA, 25 bp, Mus musculus
aagattggtcccaagaagcctctgc

SEQ ID NO: 50292 - DNA, 25 bp, Mus musculus
aagattggtccctagaagcctctgc

SEQ ID NO: 50293 - DNA, 25 bp, Mus musculus
aagattggtcgaaccttggtaaggg

SEQ ID NO: 50294 - DNA, 25 bp, Mus musculus
aagattggtcgatccttggtaaggg

SEQ ID NO: 50295 - DNA, 25 bp, Mus musculus
aagattggttacacgcagctccagt

SEQ ID NO: 50296 - DNA, 25 bp, Mus musculus
aagattggttactcgcagctccagt

SEQ ID NO: 50297 - DNA, 25 bp, Mus musculus
aagattgtactccaagccgggcagt

SEQ ID NO: 50298 - DNA, 25 bp, Mus musculus
aagattgtactcgaagccgggcagt

SEQ ID NO: 50299 - DNA, 25 bp, Mus musculus
aagattgtcaagaatgtcagctgtc

SEQ ID NO: 50300 - DNA, 25 bp, Mus musculus
aagattgtcaagtatgtcagctgtc

SEQ ID NO: 50301 - DNA, 25 bp, Mus musculus
aagattgtcagcaatgcatcctgca

SEQ ID NO: 50302 - DNA, 25 bp, Mus musculus
aagattgtcagctatgcatcctgca

SEQ ID NO: 50303 - DNA, 25 bp, Mus musculus
aagattgtcattcacttgatgaaca

SEQ ID NO: 50304 - DNA, 25 bp, Mus musculus
aagattgtcattgacttgatgaaca

SEQ ID NO: 50305 - DNA, 25 bp, Mus musculus
aagattgtccatatagccgttgcct

SEQ ID NO: 50306 - DNA, 25 bp, Mus musculus
aagattgtccatttagccgttgcct

SEQ ID NO: 50307 - DNA, 25 bp, Mus musculus
aagattgtctagatcagattggcct

SEQ ID NO: 50308 - DNA, 25 bp, Mus musculus
aagattgtctagttcagattggcct

SEQ ID NO: 50309 - DNA, 25 bp, Mus musculus
aagattgtctcaacttctgcatcac

SEQ ID NO: 50310 - DNA, 25 bp, Mus musculus
aagattgtctcatcttctgcatcac

SEQ ID NO: 50311 - DNA, 25 bp, Mus musculus
aagattgtgcagatcctagtgacag

SEQ ID NO: 50312 - DNA, 25 bp, Mus musculus
aagattgtgcagttcctagtgacag

SEQ ID NO: 50313 - DNA, 25 bp, Mus musculus
aagattgtggtcctgccatagacct

SEQ ID NO: 50314 - DNA, 25 bp, Mus musculus
aagattgtggtcgtgccatagacct

SEQ ID NO: 50315 - DNA, 25 bp, Mus musculus
aagattgtgtccagagcttcccatg

SEQ ID NO: 50316 - DNA, 25 bp, Mus musculus
aagattgtgtcctgagcttcccatg

SEQ ID NO: 50317 - DNA, 25 bp, Mus musculus
aagattgtgtgtccatccaacaggg

SEQ ID NO: 50318 - DNA, 25 bp, Mus musculus
aagattgtgtgtgcatccaacaggg

SEQ ID NO: 50319 - DNA, 25 bp, Mus musculus
aagattgttcatatccagattgact

SEQ ID NO: 50320 - DNA, 25 bp, Mus musculus
aagattgttcatttccagattgact

SEQ ID NO: 50321 - DNA, 25 bp, Mus musculus
aagatttaaaggcacgtggcttcat

SEQ ID NO: 50322 - DNA, 25 bp, Mus musculus
aagatttaaagggacgtggcttcat

SEQ ID NO: 50323 - DNA, 25 bp, Mus musculus
aagatttatacaaccgtttttaatg

SEQ ID NO: 50324 - DNA, 25 bp, Mus musculus
aagatttatacatccgtttttaatg

SEQ ID NO: 50325 - DNA, 25 bp, Mus musculus
aagatttatataaggcctggtgacc

SEQ ID NO: 50326 - DNA, 25 bp, Mus musculus
aagatttatatatggcctggtgacc

SEQ ID NO: 50327 - DNA, 25 bp, Mus musculus
aagatttatgagagtctcccctgca

SEQ ID NO: 50328 - DNA, 25 bp, Mus musculus
aagatttatgagtgtctcccctgca

SEQ ID NO: 50329 - DNA, 25 bp, Mus musculus
aagatttatgttagttattggcgca

SEQ ID NO: 50330 - DNA, 25 bp, Mus musculus
aagatttatgtttgttattggcgca

SEQ ID NO: 50331 - DNA, 25 bp, Mus musculus
aagatttcaaaacctgtctgcttat

SEQ ID NO: 50332 - DNA, 25 bp, Mus musculus
aagatttcaaaagctgtctgcttat

SEQ ID NO: 50333 - DNA, 25 bp, Mus musculus
aagatttcacccaacagagtcactg

SEQ ID NO: 50334 - DNA, 25 bp, Mus musculus
aagatttcaccctacagagtcactg

SEQ ID NO: 50335 - DNA, 25 bp, Mus musculus
aagatttcagccatagccgggtgtg

SEQ ID NO: 50336 - DNA, 25 bp, Mus musculus
aagatttcagccttagccgggtgtg

SEQ ID NO: 50337 - DNA, 25 bp, Mus musculus
aagatttcagctctggctgcttact

SEQ ID NO: 50338 - DNA, 25 bp, Mus musculus
aagatttcagctgtggctgcttact

SEQ ID NO: 50339 - DNA, 25 bp, Mus musculus
aagatttcatctatcatggcttgaa

SEQ ID NO: 50340 - DNA, 25 bp, Mus musculus
aagatttcatctttcatggcttgaa

SEQ ID NO: 50341 - DNA, 25 bp, Mus musculus
aagatttcatgcaaagtgttctata

SEQ ID NO: 50342 - DNA, 25 bp, Mus musculus
aagatttcatgctaagtgttctata

SEQ ID NO: 50343 - DNA, 25 bp, Mus musculus
aagatttccaaaatcctcacactgt

SEQ ID NO: 50344 - DNA, 25 bp, Mus musculus
aagatttccaaattcctcacactgt

SEQ ID NO: 50345 - DNA, 25 bp, Mus musculus
aagatttccaggctcagcgtggact

SEQ ID NO: 50346 - DNA, 25 bp, Mus musculus
aagatttccagggtcagcgtggact

SEQ ID NO: 50347 - DNA, 25 bp, Mus musculus
aagatttccttacaagctcataaga

SEQ ID NO: 50348 - DNA, 25 bp, Mus musculus
aagatttccttagaagctcataaga

SEQ ID NO: 50349 - DNA, 25 bp, Mus musculus
aagatttccttcactaccctgagtg

SEQ ID NO: 50350 - DNA, 25 bp, Mus musculus
aagatttccttctctaccctgagtg

SEQ ID NO: 50351 - DNA, 25 bp, Mus musculus
aagatttctatcatcattattggaa

SEQ ID NO: 50352 - DNA, 25 bp, Mus musculus
aagatttctatcttcattattggaa

SEQ ID NO: 50353 - DNA, 25 bp, Mus musculus
aagatttctcaacattcagtaagga

SEQ ID NO: 50354 - DNA, 25 bp, Mus musculus
aagatttctcaagattcagtaagga

SEQ ID NO: 50355 - DNA, 25 bp, Mus musculus
aagatttctcatactgtttctagtt

SEQ ID NO: 50356 - DNA, 25 bp, Mus musculus
aagatttctcattctgtttctagtt

SEQ ID NO: 50357 - DNA, 25 bp, Mus musculus
aagatttctcgaatgctggcagcca

SEQ ID NO: 50358 - DNA, 25 bp, Mus musculus
aagatttctcgattgctggcagcca

SEQ ID NO: 50359 - DNA, 25 bp, Mus musculus
aagatttctcttaaagaactggcaa

SEQ ID NO: 50360 - DNA, 25 bp, Mus musculus
aagatttctctttaagaactggcaa

SEQ ID NO: 50361 - DNA, 25 bp, Mus musculus
aagatttctgagattgtttcaatgt

SEQ ID NO: 50362 - DNA, 25 bp, Mus musculus
aagatttctgagtttgtttcaatgt

SEQ ID NO: 50363 - DNA, 25 bp, Mus musculus
aagatttctggactctttcaccatg

SEQ ID NO: 50364 - DNA, 25 bp, Mus musculus
aagatttctggagtctttcaccatg

SEQ ID NO: 50365 - DNA, 25 bp, Mus musculus
aagatttctggtatgcctgtgtccc

SEQ ID NO: 50366 - DNA, 25 bp, Mus musculus
aagatttctggtttgcctgtgtccc

SEQ ID NO: 50367 - DNA, 25 bp, Mus musculus
aagatttcttttccgggatacattc

SEQ ID NO: 50368 - DNA, 25 bp, Mus musculus
aagatttcttttgcgggatacattc

SEQ ID NO: 50369 - DNA, 25 bp, Mus musculus
aagatttgcatcctacaactatgtg

SEQ ID NO: 50370 - DNA, 25 bp, Mus musculus
aagatttgcatcgtacaactatgtg

SEQ ID NO: 50371 - DNA, 25 bp, Mus musculus
aagatttgcatgcaaggctctgtat

SEQ ID NO: 50372 - DNA, 25 bp, Mus musculus
aagatttgcatggaaggctctgtat

SEQ ID NO: 50373 - DNA, 25 bp, Mus musculus
aagatttgctccctgtatgtgcctt

SEQ ID NO: 50374 - DNA, 25 bp, Mus musculus
aagatttgctccgtgtatgtgcctt

SEQ ID NO: 50375 - DNA, 25 bp, Mus musculus
aagatttgctgtaaagtctctcccc

SEQ ID NO: 50376 - DNA, 25 bp, Mus musculus
aagatttgctgtagctgccgagcca

SEQ ID NO: 50377 - DNA, 25 bp, Mus musculus
aagatttgctgtcttgtccttgtac

SEQ ID NO: 50378 - DNA, 25 bp, Mus musculus
aagatttgctgtgttgtccttgtac

SEQ ID NO: 50379 - DNA, 25 bp, Mus musculus
aagatttgctgttaagtctctcccc

SEQ ID NO: 50380 - DNA, 25 bp, Mus musculus
aagatttgctgttgctgccgagcca

SEQ ID NO: 50381 - DNA, 25 bp, Mus musculus
aagatttggatgaggcctccgtcct

SEQ ID NO: 50382 - DNA, 25 bp, Mus musculus
aagatttggatgtggcctccgtcct

SEQ ID NO: 50383 - DNA, 25 bp, Mus musculus
aagatttgggccactgtgattggcc

SEQ ID NO: 50384 - DNA, 25 bp, Mus musculus
aagatttgggcctctgtgattggcc

SEQ ID NO: 50385 - DNA, 25 bp, Mus musculus
aagatttgtttcagcactatttcat

SEQ ID NO: 50386 - DNA, 25 bp, Mus musculus
aagatttgtttctgcactatttcat

SEQ ID NO: 50387 - DNA, 25 bp, Mus musculus
aagattttaccaaccgtgggctggg

SEQ ID NO: 50388 - DNA, 25 bp, Mus musculus
aagattttaccatccgtgggctggg

SEQ ID NO: 50389 - DNA, 25 bp, Mus musculus
aagattttacccagagcctgaagga

SEQ ID NO: 50390 - DNA, 25 bp, Mus musculus
aagattttaccctgagcctgaagga

SEQ ID NO: 50391 - DNA, 25 bp, Mus musculus
aagattttattgacactagaagtgg

SEQ ID NO: 50392 - DNA, 25 bp, Mus musculus
aagattttattgtcactagaagtgg

SEQ ID NO: 50393 - DNA, 25 bp, Mus musculus
aagattttcattactatcctgtctc

SEQ ID NO: 50394 - DNA, 25 bp, Mus musculus
aagattttcatttctatcctgtctc

SEQ ID NO: 50395 - DNA, 25 bp, Mus musculus
aagattttctacaggcagtctcctc

SEQ ID NO: 50396 - DNA, 25 bp, Mus musculus
aagattttctactggcagtctcctc

SEQ ID NO: 50397 - DNA, 25 bp, Mus musculus
aagattttctcactcatcagtcctg

SEQ ID NO: 50398 - DNA, 25 bp, Mus musculus
aagattttctcagtcatcagtcctg

SEQ ID NO: 50399 - DNA, 25 bp, Mus musculus
aagattttcttgattgtcctctgtc

SEQ ID NO: 50400 - DNA, 25 bp, Mus musculus
aagattttcttgtttgtcctctgtc

SEQ ID NO: 50401 - DNA, 25 bp, Mus musculus
aagattttctttacgtctctccatg

SEQ ID NO: 50402 - DNA, 25 bp, Mus musculus
aagattttcttttcgtctctccatg

SEQ ID NO: 50403 - DNA, 25 bp, Mus musculus
aagattttgaggacccatctgctgt

SEQ ID NO: 50404 - DNA, 25 bp, Mus musculus
aagattttgaggtcccatctgctgt

SEQ ID NO: 50405 - DNA, 25 bp, Mus musculus
aagattttgcaactcctgaacgtcc

SEQ ID NO: 50406 - DNA, 25 bp, Mus musculus
aagattttgcaagtcctgaacgtcc

SEQ ID NO: 50407 - DNA, 25 bp, Mus musculus
aagattttgccaataccattcccgg

SEQ ID NO: 50408 - DNA, 25 bp, Mus musculus
aagattttgccattaccattcccgg

SEQ ID NO: 50409 - DNA, 25 bp, Mus musculus
aagattttgtacatacgtgtgtgca

SEQ ID NO: 50410 - DNA, 25 bp, Mus musculus
aagattttgtacttacgtgtgtgca

SEQ ID NO: 50411 - DNA, 25 bp, Mus musculus
aagattttgtctatcaagcaggtaa

SEQ ID NO: 50412 - DNA, 25 bp, Mus musculus
aagattttgtctttcaagcaggtaa

SEQ ID NO: 50413 - DNA, 25 bp, Mus musculus
aagatttttaatccctatggacaaa

SEQ ID NO: 50414 - DNA, 25 bp, Mus musculus
aagatttttaatgcctatggacaaa

SEQ ID NO: 50415 - DNA, 25 bp, Mus musculus
aagcaaaaatggcttaaacatacac

SEQ ID NO: 50416 - DNA, 25 bp, Mus musculus
aagcaaaaatgggttaaacatacac

SEQ ID NO: 50417 - DNA, 25 bp, Mus musculus
aagcaaaaccacacatttctctaca

SEQ ID NO: 50418 - DNA, 25 bp, Mus musculus
aagcaaaaccactcatttctctaca

SEQ ID NO: 50419 - DNA, 25 bp, Mus musculus
aagcaaaacccaagagcccttgacc

SEQ ID NO: 50420 - DNA, 25 bp, Mus musculus
aagcaaaacccacaattacatcaat

SEQ ID NO: 50421 - DNA, 25 bp, Mus musculus
aagcaaaacccagaattacatcaat

SEQ ID NO: 50422 - DNA, 25 bp, Mus musculus
aagcaaaacccatgagcccttgacc

SEQ ID NO: 50423 - DNA, 25 bp, Mus musculus
aagcaaaaccttcagtgggcattgt

SEQ ID NO: 50424 - DNA, 25 bp, Mus musculus
aagcaaaaccttgagtgggcattgt

SEQ ID NO: 50425 - DNA, 25 bp, Mus musculus
aagcaaaacgacattcagactctga

SEQ ID NO: 50426 - DNA, 25 bp, Mus musculus
aagcaaaacgactttcagactctga

SEQ ID NO: 50427 - DNA, 25 bp, Mus musculus
aagcaaaactatccacgttgtccct

SEQ ID NO: 50428 - DNA, 25 bp, Mus musculus
aagcaaaactatgcacgttgtccct

SEQ ID NO: 50429 - DNA, 25 bp, Mus musculus
aagcaaaagcagacgggtggcccaa

SEQ ID NO: 50430 - DNA, 25 bp, Mus musculus
aagcaaaagcagtcgggtggcccaa

SEQ ID NO: 50431 - DNA, 25 bp, Mus musculus
aagcaaaagtgtcgacttgcagcaa

SEQ ID NO: 50432 - DNA, 25 bp, Mus musculus
aagcaaaagtgtggacttgcagcaa

SEQ ID NO: 50433 - DNA, 25 bp, Mus musculus
aagcaaaatctcactgtatgtctga

SEQ ID NO: 50434 - DNA, 25 bp, Mus musculus
aagcaaaatctctctgtatgtctga

SEQ ID NO: 50435 - DNA, 25 bp, Mus musculus
aagcaaaatgcaatcgtccaataat

SEQ ID NO: 50436 - DNA, 25 bp, Mus musculus
aagcaaaatgcattcgtccaataat

SEQ ID NO: 50437 - DNA, 25 bp, Mus musculus
aagcaaacacgcagagccactggag

SEQ ID NO: 50438 - DNA, 25 bp, Mus musculus
aagcaaacacgctgagccactggag

SEQ ID NO: 50439 - DNA, 25 bp, Mus musculus
aagcaaacacttatataaggcggag

SEQ ID NO: 50440 - DNA, 25 bp, Mus musculus
aagcaaacacttttataaggcggag

SEQ ID NO: 50441 - DNA, 25 bp, Mus musculus
aagcaaacagaacattccctaaaag

SEQ ID NO: 50442 - DNA, 25 bp, Mus musculus
aagcaaacagaagattccctaaaag

SEQ ID NO: 50443 - DNA, 25 bp, Mus musculus
aagcaaacagcacagaacccggtca

SEQ ID NO: 50444 - DNA, 25 bp, Mus musculus
aagcaaacagcactgagctctgcct

SEQ ID NO: 50445 - DNA, 25 bp, Mus musculus
aagcaaacagcagagaacccggtca

SEQ ID NO: 50446 - DNA, 25 bp, Mus musculus
aagcaaacagcagtgagctctgcct

SEQ ID NO: 50447 - DNA, 25 bp, Mus musculus
aagcaaacagcgcagggtcttggaa

SEQ ID NO: 50448 - DNA, 25 bp, Mus musculus
aagcaaacagcggagggtcttggaa

SEQ ID NO: 50449 - DNA, 25 bp, Mus musculus
aagcaaaccacgaccaaggagtcct

SEQ ID NO: 50450 - DNA, 25 bp, Mus musculus
aagcaaaccacgtccaaggagtcct

SEQ ID NO: 50451 - DNA, 25 bp, Mus musculus
aagcaaaccctgcttcacatggaag

SEQ ID NO: 50452 - DNA, 25 bp, Mus musculus
aagcaaaccctggttcacatggaag

SEQ ID NO: 50453 - DNA, 25 bp, Mus musculus
aagcaaacctgcaagctctgatagc

SEQ ID NO: 50454 - DNA, 25 bp, Mus musculus
aagcaaacctgctagctctgatagc

SEQ ID NO: 50455 - DNA, 25 bp, Mus musculus
aagcaaacggagctgccagacctaa

SEQ ID NO: 50456 - DNA, 25 bp, Mus musculus
aagcaaacggaggtgccagacctaa

SEQ ID NO: 50457 - DNA, 25 bp, Mus musculus
aagcaaactcaaacaacaaccctca

SEQ ID NO: 50458 - DNA, 25 bp, Mus musculus
aagcaaactcaatcaacaaccctca

SEQ ID NO: 50459 - DNA, 25 bp, Mus musculus
aagcaaactgctctcacatgaaatc

SEQ ID NO: 50460 - DNA, 25 bp, Mus musculus
aagcaaactgctgtcacatgaaatc

SEQ ID NO: 50461 - DNA, 25 bp, Mus musculus
aagcaaagaagccagctctcctaag

SEQ ID NO: 50462 - DNA, 25 bp, Mus musculus
aagcaaagaagcgagctctcctaag

SEQ ID NO: 50463 - DNA, 25 bp, Mus musculus
aagcaaagacttctcagctctgacc

SEQ ID NO: 50464 - DNA, 25 bp, Mus musculus
aagcaaagacttgtcagctctgacc

SEQ ID NO: 50465 - DNA, 25 bp, Mus musculus
aagcaaagagagaacgcctgtggat

SEQ ID NO: 50466 - DNA, 25 bp, Mus musculus
aagcaaagagagtacgcctgtggat

SEQ ID NO: 50467 - DNA, 25 bp, Mus musculus
aagcaaagagatactgttccttgcc

SEQ ID NO: 50468 - DNA, 25 bp, Mus musculus
aagcaaagagattctgttccttgcc

SEQ ID NO: 50469 - DNA, 25 bp, Mus musculus
aagcaaagatgacaccaaccaagaa

SEQ ID NO: 50470 - DNA, 25 bp, Mus musculus
aagcaaagatgagaccaaccaagaa

SEQ ID NO: 50471 - DNA, 25 bp, Mus musculus
aagcaaagattaagacagtccctct

SEQ ID NO: 50472 - DNA, 25 bp, Mus musculus
aagcaaagattatgacagtccctct

SEQ ID NO: 50473 - DNA, 25 bp, Mus musculus
aagcaaagcagcactccagcttcgg

SEQ ID NO: 50474 - DNA, 25 bp, Mus musculus
aagcaaagcagctctccagcttcgg

SEQ ID NO: 50475 - DNA, 25 bp, Mus musculus
aagcaaaggcacactgtagcacctc

SEQ ID NO: 50476 - DNA, 25 bp, Mus musculus
aagcaaaggcacagtgacaggtcaa

SEQ ID NO: 50477 - DNA, 25 bp, Mus musculus
aagcaaaggcaccaacttcaccgct

SEQ ID NO: 50478 - DNA, 25 bp, Mus musculus
aagcaaaggcacgaacttcaccgct

SEQ ID NO: 50479 - DNA, 25 bp, Mus musculus
aagcaaaggcactctgtagcacctc

SEQ ID NO: 50480 - DNA, 25 bp, Mus musculus
aagcaaaggcactgtgacaggtcaa

SEQ ID NO: 50481 - DNA, 25 bp, Mus musculus
aagcaaaggctaaccctactactct

SEQ ID NO: 50482 - DNA, 25 bp, Mus musculus
aagcaaaggctatccctactactct

SEQ ID NO: 50483 - DNA, 25 bp, Mus musculus
aagcaaagggacaccattcacgcca

SEQ ID NO: 50484 - DNA, 25 bp, Mus musculus
aagcaaagggactccattcacgcca

SEQ ID NO: 50485 - DNA, 25 bp, Mus musculus
aagcaaaggtgcagatcccaaatct

SEQ ID NO: 50486 - DNA, 25 bp, Mus musculus
aagcaaaggtgctgatcccaaatct

SEQ ID NO: 50487 - DNA, 25 bp, Mus musculus
aagcaaagtcaaattggattcctgg

SEQ ID NO: 50488 - DNA, 25 bp, Mus musculus
aagcaaagtcaatttggattcctgg

SEQ ID NO: 50489 - DNA, 25 bp, Mus musculus
aagcaaagttaccttcacgcagcag

SEQ ID NO: 50490 - DNA, 25 bp, Mus musculus
aagcaaagttacgttcacgcagcag

SEQ ID NO: 50491 - DNA, 25 bp, Mus musculus
aagcaaataatcattgtactgtgca

SEQ ID NO: 50492 - DNA, 25 bp, Mus musculus
aagcaaataatctttgtactgtgca

SEQ ID NO: 50493 - DNA, 25 bp, Mus musculus
aagcaaatactaatgtacatggaat

SEQ ID NO: 50494 - DNA, 25 bp, Mus musculus
aagcaaatactattgtacatggaat

SEQ ID NO: 50495 - DNA, 25 bp, Mus musculus
aagcaaatcaagatctgagggatga

SEQ ID NO: 50496 - DNA, 25 bp, Mus musculus
aagcaaatcaagttctgagggatga

SEQ ID NO: 50497 - DNA, 25 bp, Mus musculus
aagcaaatcattaaggacccaccct

SEQ ID NO: 50498 - DNA, 25 bp, Mus musculus
aagcaaatcatttaggacccaccct

SEQ ID NO: 50499 - DNA, 25 bp, Mus musculus
aagcaaatccccagatgcggccttt

SEQ ID NO: 50500 - DNA, 25 bp, Mus musculus
aagcaaatcccctgatgcggccttt

SEQ ID NO: 50501 - DNA, 25 bp, Mus musculus
aagcaaatcgctaaacttatctgag

SEQ ID NO: 50502 - DNA, 25 bp, Mus musculus
aagcaaatcgcttaacttatctgag

SEQ ID NO: 50503 - DNA, 25 bp, Mus musculus
aagcaaatctggctgtcttctcctt

SEQ ID NO: 50504 - DNA, 25 bp, Mus musculus
aagcaaatctgggtgtcttctcctt

SEQ ID NO: 50505 - DNA, 25 bp, Mus musculus
aagcaaatgaagagctctttgtgaa

SEQ ID NO: 50506 - DNA, 25 bp, Mus musculus
aagcaaatgaagtgctctttgtgaa

SEQ ID NO: 50507 - DNA, 25 bp, Mus musculus
aagcaaatgaatcccttgacgccca

SEQ ID NO: 50508 - DNA, 25 bp, Mus musculus
aagcaaatgaatgccttgacgccca

SEQ ID NO: 50509 - DNA, 25 bp, Mus musculus
aagcaaatgcatactatcgttatta

SEQ ID NO: 50510 - DNA, 25 bp, Mus musculus
aagcaaatgcattctatcgttatta

SEQ ID NO: 50511 - DNA, 25 bp, Mus musculus
aagcaaatggccctgctcttagcag

SEQ ID NO: 50512 - DNA, 25 bp, Mus musculus
aagcaaatggccgtgctcttagcag

SEQ ID NO: 50513 - DNA, 25 bp, Mus musculus
aagcaaatggtccttcctgttcagc

SEQ ID NO: 50514 - DNA, 25 bp, Mus musculus
aagcaaatggtcgttcctgttcagc

SEQ ID NO: 50515 - DNA, 25 bp, Mus musculus
aagcaaatgtctcccttggtgagtc

SEQ ID NO: 50516 - DNA, 25 bp, Mus musculus
aagcaaatgtctctgctcagcacta

SEQ ID NO: 50517 - DNA, 25 bp, Mus musculus
aagcaaatgtctgccttggtgagtc

SEQ ID NO: 50518 - DNA, 25 bp, Mus musculus
aagcaaatgtctgtgctcagcacta

SEQ ID NO: 50519 - DNA, 25 bp, Mus musculus
aagcaaatgtgaaatcagctggcat

SEQ ID NO: 50520 - DNA, 25 bp, Mus musculus
aagcaaatgtgatatcagctggcat

SEQ ID NO: 50521 - DNA, 25 bp, Mus musculus
aagcaaattaacacggtctcagata

SEQ ID NO: 50522 - DNA, 25 bp, Mus musculus
aagcaaattaactcggtctcagata

SEQ ID NO: 50523 - DNA, 25 bp, Mus musculus
aagcaaattcctattcatgacccgt

SEQ ID NO: 50524 - DNA, 25 bp, Mus musculus
aagcaaattccttttcatgacccgt

SEQ ID NO: 50525 - DNA, 25 bp, Mus musculus
aagcaaattctgaggccgtggatgt

SEQ ID NO: 50526 - DNA, 25 bp, Mus musculus
aagcaaattctgtggccgtggatgt

SEQ ID NO: 50527 - DNA, 25 bp, Mus musculus
aagcaacaacaaactgcagtctcta

SEQ ID NO: 50528 - DNA, 25 bp, Mus musculus
aagcaacaacaatctgcagtctcta

SEQ ID NO: 50529 - DNA, 25 bp, Mus musculus
aagcaacaatcgatcttccttcagg

SEQ ID NO: 50530 - DNA, 25 bp, Mus musculus
aagcaacaatcgttcttccttcagg

SEQ ID NO: 50531 - DNA, 25 bp, Mus musculus
aagcaacaccagatgccattgctca

SEQ ID NO: 50532 - DNA, 25 bp, Mus musculus
aagcaacaccagttgccattgctca

SEQ ID NO: 50533 - DNA, 25 bp, Mus musculus
aagcaacactcgaatctatttcatg

SEQ ID NO: 50534 - DNA, 25 bp, Mus musculus
aagcaacactcgtatctatttcatg

SEQ ID NO: 50535 - DNA, 25 bp, Mus musculus
aagcaacacttgaccctatttgaac

SEQ ID NO: 50536 - DNA, 25 bp, Mus musculus
aagcaacacttgagctgcagctgac

SEQ ID NO: 50537 - DNA, 25 bp, Mus musculus
aagcaacacttgtccctatttgaac

SEQ ID NO: 50538 - DNA, 25 bp, Mus musculus
aagcaacacttgtgctgcagctgac

SEQ ID NO: 50539 - DNA, 25 bp, Mus musculus
aagcaacactttagtttgatacaga

SEQ ID NO: 50540 - DNA, 25 bp, Mus musculus
aagcaacacttttgtttgatacaga

SEQ ID NO: 50541 - DNA, 25 bp, Mus musculus
aagcaacagcacagaatcaccacac

SEQ ID NO: 50542 - DNA, 25 bp, Mus musculus
aagcaacagcaccagcctgacacag

SEQ ID NO: 50543 - DNA, 25 bp, Mus musculus
aagcaacagcacgagcctgacacag

SEQ ID NO: 50544 - DNA, 25 bp, Mus musculus
aagcaacagcactgaatcaccacac

SEQ ID NO: 50545 - DNA, 25 bp, Mus musculus
aagcaacagcgaagaccggttccca

SEQ ID NO: 50546 - DNA, 25 bp, Mus musculus
aagcaacagcgatgaccggttccca

SEQ ID NO: 50547 - DNA, 25 bp, Mus musculus
aagcaacagcgcacttcaagaagat

SEQ ID NO: 50548 - DNA, 25 bp, Mus musculus
aagcaacagcgctcttcaagaagat

SEQ ID NO: 50549 - DNA, 25 bp, Mus musculus
aagcaacagcttatccagagccaca

SEQ ID NO: 50550 - DNA, 25 bp, Mus musculus
aagcaacagcttttccagagccaca

SEQ ID NO: 50551 - DNA, 25 bp, Mus musculus
aagcaacaggttccctttgtcctat

SEQ ID NO: 50552 - DNA, 25 bp, Mus musculus
aagcaacaggttgcctttgtcctat

SEQ ID NO: 50553 - DNA, 25 bp, Mus musculus
aagcaacagtcacggtgttccagac

SEQ ID NO: 50554 - DNA, 25 bp, Mus musculus
aagcaacagtcagggtgttccagac

SEQ ID NO: 50555 - DNA, 25 bp, Mus musculus
aagcaacagtggatctgcaactcct

SEQ ID NO: 50556 - DNA, 25 bp, Mus musculus
aagcaacagtggttctgcaactcct

SEQ ID NO: 50557 - DNA, 25 bp, Mus musculus
aagcaacatagaactcgcagaggga

SEQ ID NO: 50558 - DNA, 25 bp, Mus musculus
aagcaacatagatctcgcagaggga

SEQ ID NO: 50559 - DNA, 25 bp, Mus musculus
aagcaacatgagctagcgactctga

SEQ ID NO: 50560 - DNA, 25 bp, Mus musculus
aagcaacatgaggtagcgactctga

SEQ ID NO: 50561 - DNA, 25 bp, Mus musculus
aagcaacattaaaattccctctgat

SEQ ID NO: 50562 - DNA, 25 bp, Mus musculus
aagcaacattaatattccctctgat

SEQ ID NO: 50563 - DNA, 25 bp, Mus musculus
aagcaacatttgcagcaggatctga

SEQ ID NO: 50564 - DNA, 25 bp, Mus musculus
aagcaacatttggagcaggatctga

SEQ ID NO: 50565 - DNA, 25 bp, Mus musculus
aagcaaccactgagtcggacatttt

SEQ ID NO: 50566 - DNA, 25 bp, Mus musculus
aagcaaccactgtgtcggacatttt

SEQ ID NO: 50567 - DNA, 25 bp, Mus musculus
aagcaaccatctcagtcctattctg

SEQ ID NO: 50568 - DNA, 25 bp, Mus musculus
aagcaaccatctgagtcctattctg

SEQ ID NO: 50569 - DNA, 25 bp, Mus musculus
aagcaacccattcaaacagcaatcc

SEQ ID NO: 50570 - DNA, 25 bp, Mus musculus
aagcaacccattgaaacagcaatcc

SEQ ID NO: 50571 - DNA, 25 bp, Mus musculus
aagcaaccccatagtgatgggttag

SEQ ID NO: 50572 - DNA, 25 bp, Mus musculus
aagcaaccccattgtgatgggttag

SEQ ID NO: 50573 - DNA, 25 bp, Mus musculus
aagcaacccgagaactgaatacatc

SEQ ID NO: 50574 - DNA, 25 bp, Mus musculus
aagcaacccgagtactgaatacatc

SEQ ID NO: 50575 - DNA, 25 bp, Mus musculus
aagcaacccgtgagaaagcactggc

SEQ ID NO: 50576 - DNA, 25 bp, Mus musculus
aagcaacccgtgtgaaagcactggc

SEQ ID NO: 50577 - DNA, 25 bp, Mus musculus
aagcaaccctgcaatgtcgaattca

SEQ ID NO: 50578 - DNA, 25 bp, Mus musculus
aagcaaccctgctatgtcgaattca

SEQ ID NO: 50579 - DNA, 25 bp, Mus musculus
aagcaaccgtgcatggtggtcccca

SEQ ID NO: 50580 - DNA, 25 bp, Mus musculus
aagcaaccgtgcttggtggtcccca

SEQ ID NO: 50581 - DNA, 25 bp, Mus musculus
aagcaacctgctataacaccgagtc

SEQ ID NO: 50582 - DNA, 25 bp, Mus musculus
aagcaacctgctcttcttgagtgac

SEQ ID NO: 50583 - DNA, 25 bp, Mus musculus
aagcaacctgctgttcttgagtgac

SEQ ID NO: 50584 - DNA, 25 bp, Mus musculus
aagcaacctgctttaacaccgagtc

SEQ ID NO: 50585 - DNA, 25 bp, Mus musculus
aagcaacctggcaatcccagagaga

SEQ ID NO: 50586 - DNA, 25 bp, Mus musculus
aagcaacctggctatcccagagaga

SEQ ID NO: 50587 - DNA, 25 bp, Mus musculus
aagcaaccttatcttttggtgcaaa

SEQ ID NO: 50588 - DNA, 25 bp, Mus musculus
aagcaaccttatgttttggtgcaaa

SEQ ID NO: 50589 - DNA, 25 bp, Mus musculus
aagcaaccttgaagtaatactgaaa

SEQ ID NO: 50590 - DNA, 25 bp, Mus musculus
aagcaaccttgatgtaatactgaaa

SEQ ID NO: 50591 - DNA, 25 bp, Mus musculus
aagcaacgaaaccaggtcatccacc

SEQ ID NO: 50592 - DNA, 25 bp, Mus musculus
aagcaacgaaacgaggtcatccacc

SEQ ID NO: 50593 - DNA, 25 bp, Mus musculus
aagcaacgacttaacctatgagcat

SEQ ID NO: 50594 - DNA, 25 bp, Mus musculus
aagcaacgactttacctatgagcat

SEQ ID NO: 50595 - DNA, 25 bp, Mus musculus
aagcaacggcccagctgggattgtc

SEQ ID NO: 50596 - DNA, 25 bp, Mus musculus
aagcaacggccctgctgggattgtc

SEQ ID NO: 50597 - DNA, 25 bp, Mus musculus
aagcaacggctaaaggagtgccgac

SEQ ID NO: 50598 - DNA, 25 bp, Mus musculus
aagcaacggctataggagtgccgac

SEQ ID NO: 50599 - DNA, 25 bp, Mus musculus
aagcaacgtggaatgagtttgtcat

SEQ ID NO: 50600 - DNA, 25 bp, Mus musculus
aagcaacgtggattgagtttgtcat

SEQ ID NO: 50601 - DNA, 25 bp, Mus musculus
aagcaacgttcccagcccatgatgt

SEQ ID NO: 50602 - DNA, 25 bp, Mus musculus
aagcaacgttccgagcccatgatgt

SEQ ID NO: 50603 - DNA, 25 bp, Mus musculus
aagcaactacacctggatttttcca

SEQ ID NO: 50604 - DNA, 25 bp, Mus musculus
aagcaactacacgtggatttttcca

SEQ ID NO: 50605 - DNA, 25 bp, Mus musculus
aagcaactacagcaattgggccttc

SEQ ID NO: 50606 - DNA, 25 bp, Mus musculus
aagcaactacaggaattgggccttc

SEQ ID NO: 50607 - DNA, 25 bp, Mus musculus
aagcaactagttactaattcccagt

SEQ ID NO: 50608 - DNA, 25 bp, Mus musculus
aagcaactagtttctaattcccagt

SEQ ID NO: 50609 - DNA, 25 bp, Mus musculus
aagcaactatgtacccaaaaagcga

SEQ ID NO: 50610 - DNA, 25 bp, Mus musculus
aagcaactatgttcccaaaaagcga

SEQ ID NO: 50611 - DNA, 25 bp, Mus musculus
aagcaactccgtatggtattccatg

SEQ ID NO: 50612 - DNA, 25 bp, Mus musculus
aagcaactccgtttggtattccatg

SEQ ID NO: 50613 - DNA, 25 bp, Mus musculus
aagcaactcctcattagccatctgt

SEQ ID NO: 50614 - DNA, 25 bp, Mus musculus
aagcaactcctctttagccatctgt

SEQ ID NO: 50615 - DNA, 25 bp, Mus musculus
aagcaactctccactttatgcagga

SEQ ID NO: 50616 - DNA, 25 bp, Mus musculus
aagcaactctcctctttatgcagga

SEQ ID NO: 50617 - DNA, 25 bp, Mus musculus
aagcaactgaagactttccaccatc

SEQ ID NO: 50618 - DNA, 25 bp, Mus musculus
aagcaactgaagcaacaatgggttc

SEQ ID NO: 50619 - DNA, 25 bp, Mus musculus
aagcaactgaaggaacaatgggttc

SEQ ID NO: 50620 - DNA, 25 bp, Mus musculus
aagcaactgaagtctttccaccatc

SEQ ID NO: 50621 - DNA, 25 bp, Mus musculus
aagcaactgatgctgtccatgcccc

SEQ ID NO: 50622 - DNA, 25 bp, Mus musculus
aagcaactgatggtgtccatgcccc

SEQ ID NO: 50623 - DNA, 25 bp, Mus musculus
aagcaactgcaacctgtccttcagt

SEQ ID NO: 50624 - DNA, 25 bp, Mus musculus
aagcaactgcaagctgtccttcagt

SEQ ID NO: 50625 - DNA, 25 bp, Mus musculus
aagcaactgggcactggactgttag

SEQ ID NO: 50626 - DNA, 25 bp, Mus musculus
aagcaactgggctctggactgttag

SEQ ID NO: 50627 - DNA, 25 bp, Mus musculus
aagcaactgttgagacctatagtta

SEQ ID NO: 50628 - DNA, 25 bp, Mus musculus
aagcaactgttgtgacctatagtta

SEQ ID NO: 50629 - DNA, 25 bp, Mus musculus
aagcaacttaggcagacataggaac

SEQ ID NO: 50630 - DNA, 25 bp, Mus musculus
aagcaacttagggagacataggaac

SEQ ID NO: 50631 - DNA, 25 bp, Mus musculus
aagcaacttctacttttgagcccca

SEQ ID NO: 50632 - DNA, 25 bp, Mus musculus
aagcaacttctagttttgagcccca

SEQ ID NO: 50633 - DNA, 25 bp, Mus musculus
aagcaacttctgcaggaccttggga

SEQ ID NO: 50634 - DNA, 25 bp, Mus musculus
aagcaacttctggaggaccttggga

SEQ ID NO: 50635 - DNA, 25 bp, Mus musculus
aagcaacttgagatttttcatagta

SEQ ID NO: 50636 - DNA, 25 bp, Mus musculus
aagcaacttgagttttttcatagta

SEQ ID NO: 50637 - DNA, 25 bp, Mus musculus
aagcaactttacatcgagcagcatt

SEQ ID NO: 50638 - DNA, 25 bp, Mus musculus
aagcaactttacttcgagcagcatt

SEQ ID NO: 50639 - DNA, 25 bp, Mus musculus
aagcaactttgaccttaagcagata

SEQ ID NO: 50640 - DNA, 25 bp, Mus musculus
aagcaactttgagcttaagcagata

SEQ ID NO: 50641 - DNA, 25 bp, Mus musculus
aagcaagaatctaggacctcagatt

SEQ ID NO: 50642 - DNA, 25 bp, Mus musculus
aagcaagaatcttggacctcagatt

SEQ ID NO: 50643 - DNA, 25 bp, Mus musculus
aagcaagaattcctgtgatcaccat

SEQ ID NO: 50644 - DNA, 25 bp, Mus musculus
aagcaagaattcgtgtgatcaccat

SEQ ID NO: 50645 - DNA, 25 bp, Mus musculus
aagcaagacaacagagatgaaccca

SEQ ID NO: 50646 - DNA, 25 bp, Mus musculus
aagcaagacaactgagatgaaccca

SEQ ID NO: 50647 - DNA, 25 bp, Mus musculus
aagcaagacattaatctgttttttc

SEQ ID NO: 50648 - DNA, 25 bp, Mus musculus
aagcaagacatttatctgttttttc

SEQ ID NO: 50649 - DNA, 25 bp, Mus musculus
aagcaagacctgaggctgtgggcaa

SEQ ID NO: 50650 - DNA, 25 bp, Mus musculus
aagcaagacctgtggctgtgggcaa

SEQ ID NO: 50651 - DNA, 25 bp, Mus musculus
aagcaagaccttactaattctatgt

SEQ ID NO: 50652 - DNA, 25 bp, Mus musculus
aagcaagacctttctaattctatgt

SEQ ID NO: 50653 - DNA, 25 bp, Mus musculus
aagcaagacgtaccagactctccat

SEQ ID NO: 50654 - DNA, 25 bp, Mus musculus
aagcaagacgtagcagactctccat

SEQ ID NO: 50655 - DNA, 25 bp, Mus musculus
aagcaagactagagagtttccctta

SEQ ID NO: 50656 - DNA, 25 bp, Mus musculus
aagcaagactagtgagtttccctta

SEQ ID NO: 50657 - DNA, 25 bp, Mus musculus
aagcaagactgaccagactctcggg

SEQ ID NO: 50658 - DNA, 25 bp, Mus musculus
aagcaagactgagcagactctcggg

SEQ ID NO: 50659 - DNA, 25 bp, Mus musculus
aagcaagacttgaactcgccatgaa

SEQ ID NO: 50660 - DNA, 25 bp, Mus musculus
aagcaagacttgtactcgccatgaa

SEQ ID NO: 50661 - DNA, 25 bp, Mus musculus
aagcaagagagacacacaccccgac

SEQ ID NO: 50662 - DNA, 25 bp, Mus musculus
aagcaagagagagacacaccccgac

SEQ ID NO: 50663 - DNA, 25 bp, Mus musculus
aagcaagagatccacagcggctgtt

SEQ ID NO: 50664 - DNA, 25 bp, Mus musculus
aagcaagagatcgacagcggctgtt

SEQ ID NO: 50665 - DNA, 25 bp, Mus musculus
aagcaagagcatagtcctggctgtc

SEQ ID NO: 50666 - DNA, 25 bp, Mus musculus
aagcaagagcattgtcctggctgtc

SEQ ID NO: 50667 - DNA, 25 bp, Mus musculus
aagcaagaggatcagtcgctctaac

SEQ ID NO: 50668 - DNA, 25 bp, Mus musculus
aagcaagaggatgagtcgctctaac

SEQ ID NO: 50669 - DNA, 25 bp, Mus musculus
aagcaagatcataattttggtccac

SEQ ID NO: 50670 - DNA, 25 bp, Mus musculus
aagcaagatcattattttggtccac

SEQ ID NO: 50671 - DNA, 25 bp, Mus musculus
aagcaagattcaatgtcactgggac

SEQ ID NO: 50672 - DNA, 25 bp, Mus musculus
aagcaagattcattgtcactgggac

SEQ ID NO: 50673 - DNA, 25 bp, Mus musculus
aagcaagatttgattcgggtcagca

SEQ ID NO: 50674 - DNA, 25 bp, Mus musculus
aagcaagatttgtttcgggtcagca

SEQ ID NO: 50675 - DNA, 25 bp, Mus musculus
aagcaagcaaaaccctgtcaataat

SEQ ID NO: 50676 - DNA, 25 bp, Mus musculus
aagcaagcaaaagcctgtcaataat

SEQ ID NO: 50677 - DNA, 25 bp, Mus musculus
aagcaagcaacaattaggtatcact

SEQ ID NO: 50678 - DNA, 25 bp, Mus musculus
aagcaagcaacatttaggtatcact

SEQ ID NO: 50679 - DNA, 25 bp, Mus musculus
aagcaagcaccaatctacatttaat

SEQ ID NO: 50680 - DNA, 25 bp, Mus musculus
aagcaagcaccattctacatttaat

SEQ ID NO: 50681 - DNA, 25 bp, Mus musculus
aagcaagcacccaacactgaaaatg

SEQ ID NO: 50682 - DNA, 25 bp, Mus musculus
aagcaagcaccctacactgaaaatg

SEQ ID NO: 50683 - DNA, 25 bp, Mus musculus
aagcaagcacgtaggcatcgccacc

SEQ ID NO: 50684 - DNA, 25 bp, Mus musculus
aagcaagcacgttggcatcgccacc

SEQ ID NO: 50685 - DNA, 25 bp, Mus musculus
aagcaagcacttaacacacattcca

SEQ ID NO: 50686 - DNA, 25 bp, Mus musculus
aagcaagcactttacacacattcca

SEQ ID NO: 50687 - DNA, 25 bp, Mus musculus
aagcaagcagtcaggacacccggat

SEQ ID NO: 50688 - DNA, 25 bp, Mus musculus
aagcaagcagtctggacacccggat

SEQ ID NO: 50689 - DNA, 25 bp, Mus musculus
aagcaagcatgaatggcggccaacc

SEQ ID NO: 50690 - DNA, 25 bp, Mus musculus
aagcaagcatgattggcggccaacc

SEQ ID NO: 50691 - DNA, 25 bp, Mus musculus
aagcaagcattgaccatgtccctgt

SEQ ID NO: 50692 - DNA, 25 bp, Mus musculus
aagcaagcattgtccatgtccctgt

SEQ ID NO: 50693 - DNA, 25 bp, Mus musculus
aagcaagccaacaggtctcatctac

SEQ ID NO: 50694 - DNA, 25 bp, Mus musculus
aagcaagccaactggtctcatctac

SEQ ID NO: 50695 - DNA, 25 bp, Mus musculus
aagcaagccaagatcaactctcaga

SEQ ID NO: 50696 - DNA, 25 bp, Mus musculus
aagcaagccaagttcaactctcaga

SEQ ID NO: 50697 - DNA, 25 bp, Mus musculus
aagcaagccaatcatagcatttctc

SEQ ID NO: 50698 - DNA, 25 bp, Mus musculus
aagcaagccaatgatagcatttctc

SEQ ID NO: 50699 - DNA, 25 bp, Mus musculus
aagcaagccacgctgatcagtgcct

SEQ ID NO: 50700 - DNA, 25 bp, Mus musculus
aagcaagccacggtgatcagtgcct

SEQ ID NO: 50701 - DNA, 25 bp, Mus musculus
aagcaagccactctggagcccaagc

SEQ ID NO: 50702 - DNA, 25 bp, Mus musculus
aagcaagccactgtggagcccaagc

SEQ ID NO: 50703 - DNA, 25 bp, Mus musculus
aagcaagccagcaaggtgcaaaata

SEQ ID NO: 50704 - DNA, 25 bp, Mus musculus
aagcaagccagctaggtgcaaaata

SEQ ID NO: 50705 - DNA, 25 bp, Mus musculus
aagcaagccatcacgcaggtggtca

SEQ ID NO: 50706 - DNA, 25 bp, Mus musculus
aagcaagccatctcgcaggtggtca

SEQ ID NO: 50707 - DNA, 25 bp, Mus musculus
aagcaagcccagcaaaggtgacctc

SEQ ID NO: 50708 - DNA, 25 bp, Mus musculus
aagcaagcccaggaaaggtgacctc

SEQ ID NO: 50709 - DNA, 25 bp, Mus musculus
aagcaagcccctccatgtatatgga

SEQ ID NO: 50710 - DNA, 25 bp, Mus musculus
aagcaagcccctgcatgtatatgga

SEQ ID NO: 50711 - DNA, 25 bp, Mus musculus
aagcaagccctgatgtgtgtttcct

SEQ ID NO: 50712 - DNA, 25 bp, Mus musculus
aagcaagccctgttgtgtgtttcct

SEQ ID NO: 50713 - DNA, 25 bp, Mus musculus
aagcaagccggaagctcagaacact

SEQ ID NO: 50714 - DNA, 25 bp, Mus musculus
aagcaagccggatgctcagaacact

SEQ ID NO: 50715 - DNA, 25 bp, Mus musculus
aagcaagcctacagaacgtgttcag

SEQ ID NO: 50716 - DNA, 25 bp, Mus musculus
aagcaagcctactgaacgtgttcag

SEQ ID NO: 50717 - DNA, 25 bp, Mus musculus
aagcaagccttgattacatcttcaa

SEQ ID NO: 50718 - DNA, 25 bp, Mus musculus
aagcaagccttgtttacatcttcaa

SEQ ID NO: 50719 - DNA, 25 bp, Mus musculus
aagcaagcgaaacgtgtcatcagga

SEQ ID NO: 50720 - DNA, 25 bp, Mus musculus
aagcaagcgaaaggtgtcatcagga

SEQ ID NO: 50721 - DNA, 25 bp, Mus musculus
aagcaagcgatcatagctgcgctgt

SEQ ID NO: 50722 - DNA, 25 bp, Mus musculus
aagcaagcgatcttagctgcgctgt

SEQ ID NO: 50723 - DNA, 25 bp, Mus musculus
aagcaagcgctcaccacggactggt

SEQ ID NO: 50724 - DNA, 25 bp, Mus musculus
aagcaagcgctctccacggactggt

SEQ ID NO: 50725 - DNA, 25 bp, Mus musculus
aagcaagcggcgcaaatatgtcttc

SEQ ID NO: 50726 - DNA, 25 bp, Mus musculus
aagcaagcggcggaaatatgtcttc

SEQ ID NO: 50727 - DNA, 25 bp, Mus musculus
aagcaagctcatcctttgatctctg

SEQ ID NO: 50728 - DNA, 25 bp, Mus musculus
aagcaagctcatgctttgatctctg

SEQ ID NO: 50729 - DNA, 25 bp, Mus musculus
aagcaagctcctcttgactgtgttt

SEQ ID NO: 50730 - DNA, 25 bp, Mus musculus
aagcaagctcctgttgactgtgttt

SEQ ID NO: 50731 - DNA, 25 bp, Mus musculus
aagcaagctctcctggcagcaagta

SEQ ID NO: 50732 - DNA, 25 bp, Mus musculus
aagcaagctctcgtggcagcaagta

SEQ ID NO: 50733 - DNA, 25 bp, Mus musculus
aagcaagctcttaccaacatcactt

SEQ ID NO: 50734 - DNA, 25 bp, Mus musculus
aagcaagctcttaggtttaggaaat

SEQ ID NO: 50735 - DNA, 25 bp, Mus musculus
aagcaagctctttccaacatcactt

SEQ ID NO: 50736 - DNA, 25 bp, Mus musculus
aagcaagctctttggtttaggaaat

SEQ ID NO: 50737 - DNA, 25 bp, Mus musculus
aagcaagctgagaactggcgtccac

SEQ ID NO: 50738 - DNA, 25 bp, Mus musculus
aagcaagctgagtactggcgtccac

SEQ ID NO: 50739 - DNA, 25 bp, Mus musculus
aagcaagctgcacgatggtcgaaac

SEQ ID NO: 50740 - DNA, 25 bp, Mus musculus
aagcaagctgcaggatggtcgaaac

SEQ ID NO: 50741 - DNA, 25 bp, Mus musculus
aagcaagctgctacctgacattttc

SEQ ID NO: 50742 - DNA, 25 bp, Mus musculus
aagcaagctgcttcctgacattttc

SEQ ID NO: 50743 - DNA, 25 bp, Mus musculus
aagcaagcttcaatactgtaacaca

SEQ ID NO: 50744 - DNA, 25 bp, Mus musculus
aagcaagcttcattactgtaacaca

SEQ ID NO: 50745 - DNA, 25 bp, Mus musculus
aagcaagctttaacttaccatctta

SEQ ID NO: 50746 - DNA, 25 bp, Mus musculus
aagcaagctttatcttaccatctta

SEQ ID NO: 50747 - DNA, 25 bp, Mus musculus
aagcaagcttttactgcgtgtaccc

SEQ ID NO: 50748 - DNA, 25 bp, Mus musculus
aagcaagctttttctgcgtgtaccc

SEQ ID NO: 50749 - DNA, 25 bp, Mus musculus
aagcaaggacagaactctcccatgg

SEQ ID NO: 50750 - DNA, 25 bp, Mus musculus
aagcaaggacagtactctcccatgg

SEQ ID NO: 50751 - DNA, 25 bp, Mus musculus
aagcaaggagacctcgccgccatgg

SEQ ID NO: 50752 - DNA, 25 bp, Mus musculus
aagcaaggagacgtcgccgccatgg

SEQ ID NO: 50753 - DNA, 25 bp, Mus musculus
aagcaaggagccatgaaccacaggg

SEQ ID NO: 50754 - DNA, 25 bp, Mus musculus
aagcaaggagccttgaaccacaggg

SEQ ID NO: 50755 - DNA, 25 bp, Mus musculus
aagcaaggataacccaggatgaact

SEQ ID NO: 50756 - DNA, 25 bp, Mus musculus
aagcaaggataagccaggatgaact

SEQ ID NO: 50757 - DNA, 25 bp, Mus musculus
aagcaaggatccctgtttacctctc

SEQ ID NO: 50758 - DNA, 25 bp, Mus musculus
aagcaaggatccgtgtttacctctc

SEQ ID NO: 50759 - DNA, 25 bp, Mus musculus
aagcaaggcatcaatgtgaggagta

SEQ ID NO: 50760 - DNA, 25 bp, Mus musculus
aagcaaggcatctatgtgaggagta

SEQ ID NO: 50761 - DNA, 25 bp, Mus musculus
aagcaaggcctcctgtctatagcag

SEQ ID NO: 50762 - DNA, 25 bp, Mus musculus
aagcaaggcctcgtgtctatagcag

SEQ ID NO: 50763 - DNA, 25 bp, Mus musculus
aagcaagggatgatcccgacccgtt

SEQ ID NO: 50764 - DNA, 25 bp, Mus musculus
aagcaagggatgttcccgacccgtt

SEQ ID NO: 50765 - DNA, 25 bp, Mus musculus
aagcaagggattctccactgtccac

SEQ ID NO: 50766 - DNA, 25 bp, Mus musculus
aagcaagggattgtccactgtccac

SEQ ID NO: 50767 - DNA, 25 bp, Mus musculus
aagcaagggcagacccgactgtcta

SEQ ID NO: 50768 - DNA, 25 bp, Mus musculus
aagcaagggcagtcccgactgtcta

SEQ ID NO: 50769 - DNA, 25 bp, Mus musculus
aagcaagggccaacagcgtaagtct

SEQ ID NO: 50770 - DNA, 25 bp, Mus musculus
aagcaagggccatcagcgtaagtct

SEQ ID NO: 50771 - DNA, 25 bp, Mus musculus
aagcaagggtcaccttcccaaatat

SEQ ID NO: 50772 - DNA, 25 bp, Mus musculus
aagcaagggtcagcttcccaaatat

SEQ ID NO: 50773 - DNA, 25 bp, Mus musculus
aagcaaggtacgcttcctagccagt

SEQ ID NO: 50774 - DNA, 25 bp, Mus musculus
aagcaaggtacggttcctagccagt

SEQ ID NO: 50775 - DNA, 25 bp, Mus musculus
aagcaaggtggcaaacgatccaaag

SEQ ID NO: 50776 - DNA, 25 bp, Mus musculus
aagcaaggtggctaacgatccaaag

SEQ ID NO: 50777 - DNA, 25 bp, Mus musculus
aagcaaggtgtacctgtggtcccca

SEQ ID NO: 50778 - DNA, 25 bp, Mus musculus
aagcaaggtgtagctgtggtcccca

SEQ ID NO: 50779 - DNA, 25 bp, Mus musculus
aagcaaggtgttagttgcaactcac

SEQ ID NO: 50780 - DNA, 25 bp, Mus musculus
aagcaaggtgtttgttgcaactcac

SEQ ID NO: 50781 - DNA, 25 bp, Mus musculus
aagcaaggttgcctggtagctccag

SEQ ID NO: 50782 - DNA, 25 bp, Mus musculus
aagcaaggttgcgtggtagctccag

SEQ ID NO: 50783 - DNA, 25 bp, Mus musculus
aagcaaggtttaagtttcagagtag

SEQ ID NO: 50784 - DNA, 25 bp, Mus musculus
aagcaaggtttatgtttcagagtag

SEQ ID NO: 50785 - DNA, 25 bp, Mus musculus
aagcaagtaaggactctttagctaa

SEQ ID NO: 50786 - DNA, 25 bp, Mus musculus
aagcaagtaaggtctctttagctaa

SEQ ID NO: 50787 - DNA, 25 bp, Mus musculus
aagcaagtaccaactcttcatctga

SEQ ID NO: 50788 - DNA, 25 bp, Mus musculus
aagcaagtaccatctcttcatctga

SEQ ID NO: 50789 - DNA, 25 bp, Mus musculus
aagcaagtccttcgtctcagtaaac

SEQ ID NO: 50790 - DNA, 25 bp, Mus musculus
aagcaagtccttggtctcagtaaac

SEQ ID NO: 50791 - DNA, 25 bp, Mus musculus
aagcaagtcgttagccaaccgattt

SEQ ID NO: 50792 - DNA, 25 bp, Mus musculus
aagcaagtcgtttgccaaccgattt

SEQ ID NO: 50793 - DNA, 25 bp, Mus musculus
aagcaagtctatccagccatgccca

SEQ ID NO: 50794 - DNA, 25 bp, Mus musculus
aagcaagtctatgcagccatgccca

SEQ ID NO: 50795 - DNA, 25 bp, Mus musculus
aagcaagtgagtattggcccttcag

SEQ ID NO: 50796 - DNA, 25 bp, Mus musculus
aagcaagtgagttttggcccttcag

SEQ ID NO: 50797 - DNA, 25 bp, Mus musculus
aagcaagtgccaacagctctccatc

SEQ ID NO: 50798 - DNA, 25 bp, Mus musculus
aagcaagtgccatcagctctccatc

SEQ ID NO: 50799 - DNA, 25 bp, Mus musculus
aagcaagtgcccactcttaagtctt

SEQ ID NO: 50800 - DNA, 25 bp, Mus musculus
aagcaagtgccctctcttaagtctt

SEQ ID NO: 50801 - DNA, 25 bp, Mus musculus
aagcaagtgctaaacacccacgcag

SEQ ID NO: 50802 - DNA, 25 bp, Mus musculus
aagcaagtgctatacacccacgcag

SEQ ID NO: 50803 - DNA, 25 bp, Mus musculus
aagcaagtgctgagtctgcccagat

SEQ ID NO: 50804 - DNA, 25 bp, Mus musculus
aagcaagtgctgtgtctgcccagat

SEQ ID NO: 50805 - DNA, 25 bp, Mus musculus
aagcaagtgcttcgttcttctttcg

SEQ ID NO: 50806 - DNA, 25 bp, Mus musculus
aagcaagtgcttggttcttctttcg

SEQ ID NO: 50807 - DNA, 25 bp, Mus musculus
aagcaagtggtgactcagctcttcc

SEQ ID NO: 50808 - DNA, 25 bp, Mus musculus
aagcaagtggtgtctcagctcttcc

SEQ ID NO: 50809 - DNA, 25 bp, Mus musculus
aagcaagtgtagatgtcaccaccct

SEQ ID NO: 50810 - DNA, 25 bp, Mus musculus
aagcaagtgtagttgtcaccaccct

SEQ ID NO: 50811 - DNA, 25 bp, Mus musculus
aagcaagtgttgaactcctgagtca

SEQ ID NO: 50812 - DNA, 25 bp, Mus musculus
aagcaagtgttgtactcctgagtca

SEQ ID NO: 50813 - DNA, 25 bp, Mus musculus
aagcaagtgtttagactcttacggg

SEQ ID NO: 50814 - DNA, 25 bp, Mus musculus
aagcaagtgtttatcctgccggtca

SEQ ID NO: 50815 - DNA, 25 bp, Mus musculus
aagcaagtgttttgactcttacggg

SEQ ID NO: 50816 - DNA, 25 bp, Mus musculus
aagcaagtgtttttcctgccggtca

SEQ ID NO: 50817 - DNA, 25 bp, Mus musculus
aagcaagttcaaccgcaaccggaag

SEQ ID NO: 50818 - DNA, 25 bp, Mus musculus
aagcaagttcaagcgcaaccggaag

SEQ ID NO: 50819 - DNA, 25 bp, Mus musculus
aagcaatacaatatctcttgcaata

SEQ ID NO: 50820 - DNA, 25 bp, Mus musculus
aagcaatacaatttctcttgcaata

SEQ ID NO: 50821 - DNA, 25 bp, Mus musculus
aagcaatacccaagcccacaagtag

SEQ ID NO: 50822 - DNA, 25 bp, Mus musculus
aagcaatacccatgcccacaagtag

SEQ ID NO: 50823 - DNA, 25 bp, Mus musculus
aagcaatacccgctccagtctggag

SEQ ID NO: 50824 - DNA, 25 bp, Mus musculus
aagcaatacccggtccagtctggag

SEQ ID NO: 50825 - DNA, 25 bp, Mus musculus
aagcaataccttcaggtctgccatg

SEQ ID NO: 50826 - DNA, 25 bp, Mus musculus
aagcaataccttgaggtctgccatg

SEQ ID NO: 50827 - DNA, 25 bp, Mus musculus
aagcaatactccaacatactgccag

SEQ ID NO: 50828 - DNA, 25 bp, Mus musculus
aagcaatactcctacatactgccag

SEQ ID NO: 50829 - DNA, 25 bp, Mus musculus
aagcaatactgtagtcgaggagtca

SEQ ID NO: 50830 - DNA, 25 bp, Mus musculus
aagcaatactgttgtcgaggagtca

SEQ ID NO: 50831 - DNA, 25 bp, Mus musculus
aagcaatacttacaggctgacttat

SEQ ID NO: 50832 - DNA, 25 bp, Mus musculus
aagcaatacttagaggctgacttat

SEQ ID NO: 50833 - DNA, 25 bp, Mus musculus
aagcaatacttcaaaattaccctgt

SEQ ID NO: 50834 - DNA, 25 bp, Mus musculus
aagcaatacttctaaattaccctgt

SEQ ID NO: 50835 - DNA, 25 bp, Mus musculus
aagcaatatactacacacccttgtg

SEQ ID NO: 50836 - DNA, 25 bp, Mus musculus
aagcaatatacttcacacccttgtg

SEQ ID NO: 50837 - DNA, 25 bp, Mus musculus
aagcaatatcttcgtgttttgtata

SEQ ID NO: 50838 - DNA, 25 bp, Mus musculus
aagcaatatcttggtgttttgtata

SEQ ID NO: 50839 - DNA, 25 bp, Mus musculus
aagcaatattttacaaacgtggata

SEQ ID NO: 50840 - DNA, 25 bp, Mus musculus
aagcaatatttttcaaacgtggata

SEQ ID NO: 50841 - DNA, 25 bp, Mus musculus
aagcaatcaagtcacaccgtgtctc

SEQ ID NO: 50842 - DNA, 25 bp, Mus musculus
aagcaatcaagtgacaccgtgtctc

SEQ ID NO: 50843 - DNA, 25 bp, Mus musculus
aagcaatcattcagacccatggctg

SEQ ID NO: 50844 - DNA, 25 bp, Mus musculus
aagcaatcattctgacccatggctg

SEQ ID NO: 50845 - DNA, 25 bp, Mus musculus
aagcaatcatttctgaacgccgtga

SEQ ID NO: 50846 - DNA, 25 bp, Mus musculus
aagcaatcatttgtgaacgccgtga

SEQ ID NO: 50847 - DNA, 25 bp, Mus musculus
aagcaatcctgcagacaagtctcct

SEQ ID NO: 50848 - DNA, 25 bp, Mus musculus
aagcaatcctgctgacaagtctcct

SEQ ID NO: 50849 - DNA, 25 bp, Mus musculus
aagcaatcggctacgtcatggtacc

SEQ ID NO: 50850 - DNA, 25 bp, Mus musculus
aagcaatcggcttcgtcatggtacc

SEQ ID NO: 50851 - DNA, 25 bp, Mus musculus
aagcaatctcccctgggccatgatc

SEQ ID NO: 50852 - DNA, 25 bp, Mus musculus
aagcaatctcccgtgggccatgatc

SEQ ID NO: 50853 - DNA, 25 bp, Mus musculus
aagcaatcttggacacttaagtaaa

SEQ ID NO: 50854 - DNA, 25 bp, Mus musculus
aagcaatcttggtcacttaagtaaa

SEQ ID NO: 50855 - DNA, 25 bp, Mus musculus
aagcaatgatgaccagagccaccct

SEQ ID NO: 50856 - DNA, 25 bp, Mus musculus
aagcaatgatgagcagagccaccct

SEQ ID NO: 50857 - DNA, 25 bp, Mus musculus
aagcaatgccatctcttaccatgtc

SEQ ID NO: 50858 - DNA, 25 bp, Mus musculus
aagcaatgccatcttcctttattag

SEQ ID NO: 50859 - DNA, 25 bp, Mus musculus
aagcaatgccatgtcttaccatgtc

SEQ ID NO: 50860 - DNA, 25 bp, Mus musculus
aagcaatgccatgttcctttattag

SEQ ID NO: 50861 - DNA, 25 bp, Mus musculus
aagcaatgctccatcagccgaataa

SEQ ID NO: 50862 - DNA, 25 bp, Mus musculus
aagcaatgctccttcagccgaataa

SEQ ID NO: 50863 - DNA, 25 bp, Mus musculus
aagcaatgctctatgcactttgcaa

SEQ ID NO: 50864 - DNA, 25 bp, Mus musculus
aagcaatgctctttgcactttgcaa

SEQ ID NO: 50865 - DNA, 25 bp, Mus musculus
aagcaatgcttcaagtctggttcca

SEQ ID NO: 50866 - DNA, 25 bp, Mus musculus
aagcaatgcttcagtgtctcaacca

SEQ ID NO: 50867 - DNA, 25 bp, Mus musculus
aagcaatgcttctagtctggttcca

SEQ ID NO: 50868 - DNA, 25 bp, Mus musculus
aagcaatgcttctgtgtctcaacca

SEQ ID NO: 50869 - DNA, 25 bp, Mus musculus
aagcaatggatcaggtgtcttggaa

SEQ ID NO: 50870 - DNA, 25 bp, Mus musculus
aagcaatggatctggtgtcttggaa

SEQ ID NO: 50871 - DNA, 25 bp, Mus musculus
aagcaatgggaacgctgtgtgtcta

SEQ ID NO: 50872 - DNA, 25 bp, Mus musculus
aagcaatgggaaggctgtgtgtcta

SEQ ID NO: 50873 - DNA, 25 bp, Mus musculus
aagcaatggtctaggaggtcttttc

SEQ ID NO: 50874 - DNA, 25 bp, Mus musculus
aagcaatggtcttggaggtcttttc

SEQ ID NO: 50875 - DNA, 25 bp, Mus musculus
aagcaatgtagtcacctctggagat

SEQ ID NO: 50876 - DNA, 25 bp, Mus musculus
aagcaatgtagtgacctctggagat

SEQ ID NO: 50877 - DNA, 25 bp, Mus musculus
aagcaatgtgcaatgtttcttcaac

SEQ ID NO: 50878 - DNA, 25 bp, Mus musculus
aagcaatgtgcattgtttcttcaac

SEQ ID NO: 50879 - DNA, 25 bp, Mus musculus
aagcaatgtggcatcatcgtcgggc

SEQ ID NO: 50880 - DNA, 25 bp, Mus musculus
aagcaatgtggcttcatcgtcgggc

SEQ ID NO: 50881 - DNA, 25 bp, Mus musculus
aagcaatgtgtgagcggcagggtgg

SEQ ID NO: 50882 - DNA, 25 bp, Mus musculus
aagcaatgtgtgtgcggcagggtgg

SEQ ID NO: 50883 - DNA, 25 bp, Mus musculus
aagcaattaattatttctgaagatg

SEQ ID NO: 50884 - DNA, 25 bp, Mus musculus
aagcaattaattttttctgaagatg

SEQ ID NO: 50885 - DNA, 25 bp, Mus musculus
aagcaattcccgctatctcagactc

SEQ ID NO: 50886 - DNA, 25 bp, Mus musculus
aagcaattcccggtatctcagactc

SEQ ID NO: 50887 - DNA, 25 bp, Mus musculus
aagcaattcctccatgatcccaaat

SEQ ID NO: 50888 - DNA, 25 bp, Mus musculus
aagcaattcctcgatgatcccaaat

SEQ ID NO: 50889 - DNA, 25 bp, Mus musculus
aagcaattcgcaaaaacccttccat

SEQ ID NO: 50890 - DNA, 25 bp, Mus musculus
aagcaattcgcataaacccttccat

SEQ ID NO: 50891 - DNA, 25 bp, Mus musculus
aagcaattgaagagcgccgtgtgat

SEQ ID NO: 50892 - DNA, 25 bp, Mus musculus
aagcaattgaagtgcgccgtgtgat

SEQ ID NO: 50893 - DNA, 25 bp, Mus musculus
aagcaatttagcaccttatgggatg

SEQ ID NO: 50894 - DNA, 25 bp, Mus musculus
aagcaatttagctccttatgggatg

SEQ ID NO: 50895 - DNA, 25 bp, Mus musculus
aagcaattttggaagctaaccaggt

SEQ ID NO: 50896 - DNA, 25 bp, Mus musculus
aagcaattttggagggtgctgaccc

SEQ ID NO: 50897 - DNA, 25 bp, Mus musculus
aagcaattttggtagctaaccaggt

SEQ ID NO: 50898 - DNA, 25 bp, Mus musculus
aagcaattttggtgggtgctgaccc

SEQ ID NO: 50899 - DNA, 25 bp, Mus musculus
aagcaattttttctcctttcacaca

SEQ ID NO: 50900 - DNA, 25 bp, Mus musculus
aagcaattttttgtcctttcacaca

SEQ ID NO: 50901 - DNA, 25 bp, Mus musculus
aagcacaaacctctgacagcttttg

SEQ ID NO: 50902 - DNA, 25 bp, Mus musculus
aagcacaaacctgtgacagcttttg

SEQ ID NO: 50903 - DNA, 25 bp, Mus musculus
aagcacaaaggccagcgtgacagca

SEQ ID NO: 50904 - DNA, 25 bp, Mus musculus
aagcacaaaggcgagcgtgacagca

SEQ ID NO: 50905 - DNA, 25 bp, Mus musculus
aagcacaaagggacagagcaaggct

SEQ ID NO: 50906 - DNA, 25 bp, Mus musculus
aagcacaaagggtcagagcaaggct

SEQ ID NO: 50907 - DNA, 25 bp, Mus musculus
aagcacaaagtccagctgaggtgtt

SEQ ID NO: 50908 - DNA, 25 bp, Mus musculus
aagcacaaagtcgagctgaggtgtt

SEQ ID NO: 50909 - DNA, 25 bp, Mus musculus
aagcacaacaccaactattgtgggt

SEQ ID NO: 50910 - DNA, 25 bp, Mus musculus
aagcacaacacctactattgtgggt

SEQ ID NO: 50911 - DNA, 25 bp, Mus musculus
aagcacaacccaaaatcttgaagga

SEQ ID NO: 50912 - DNA, 25 bp, Mus musculus
aagcacaacccataatcttgaagga

SEQ ID NO: 50913 - DNA, 25 bp, Mus musculus
aagcacaactgaaacatctgaggaa

SEQ ID NO: 50914 - DNA, 25 bp, Mus musculus
aagcacaactgatacatctgaggaa

SEQ ID NO: 50915 - DNA, 25 bp, Mus musculus
aagcacaactttcaggtgtgggacc

SEQ ID NO: 50916 - DNA, 25 bp, Mus musculus
aagcacaactttgaggtgtgggacc

SEQ ID NO: 50917 - DNA, 25 bp, Mus musculus
aagcacaagaaacgcgagggcaacc

SEQ ID NO: 50918 - DNA, 25 bp, Mus musculus
aagcacaagaaaggcgagggcaacc

SEQ ID NO: 50919 - DNA, 25 bp, Mus musculus
aagcacaagagcacggtactggacc

SEQ ID NO: 50920 - DNA, 25 bp, Mus musculus
aagcacaagagctcggtactggacc

SEQ ID NO: 50921 - DNA, 25 bp, Mus musculus
aagcacaagcccaatccctacaagt

SEQ ID NO: 50922 - DNA, 25 bp, Mus musculus
aagcacaagccctatccctacaagt

SEQ ID NO: 50923 - DNA, 25 bp, Mus musculus
aagcacaagctgatgagttacgact

SEQ ID NO: 50924 - DNA, 25 bp, Mus musculus
aagcacaagctgttgagttacgact

SEQ ID NO: 50925 - DNA, 25 bp, Mus musculus
aagcacaagcttagggtttctacaa

SEQ ID NO: 50926 - DNA, 25 bp, Mus musculus
aagcacaagctttgggtttctacaa

SEQ ID NO: 50927 - DNA, 25 bp, Mus musculus
aagcacaagggcatatttttataca

SEQ ID NO: 50928 - DNA, 25 bp, Mus musculus
aagcacaagggcttatttttataca

SEQ ID NO: 50929 - DNA, 25 bp, Mus musculus
aagcacaatatgacccagagttctg

SEQ ID NO: 50930 - DNA, 25 bp, Mus musculus
aagcacaatatgtcccagagttctg

SEQ ID NO: 50931 - DNA, 25 bp, Mus musculus
aagcacaatcagactttcctttgaa

SEQ ID NO: 50932 - DNA, 25 bp, Mus musculus
aagcacaatcagtctttcctttgaa

SEQ ID NO: 50933 - DNA, 25 bp, Mus musculus
aagcacaatctacagctctgtgtgt

SEQ ID NO: 50934 - DNA, 25 bp, Mus musculus
aagcacaatctagagctctgtgtgt

SEQ ID NO: 50935 - DNA, 25 bp, Mus musculus
aagcacaatggcacgggcacagtct

SEQ ID NO: 50936 - DNA, 25 bp, Mus musculus
aagcacaatggctcgggcacagtct

SEQ ID NO: 50937 - DNA, 25 bp, Mus musculus
aagcacaattgcaggagcgtccgtc

SEQ ID NO: 50938 - DNA, 25 bp, Mus musculus
aagcacaattgctggagcgtccgtc

SEQ ID NO: 50939 - DNA, 25 bp, Mus musculus
aagcacacacacctttagtgggaac

SEQ ID NO: 50940 - DNA, 25 bp, Mus musculus
aagcacacacacgtttagtgggaac

SEQ ID NO: 50941 - DNA, 25 bp, Mus musculus
aagcacacaccaatgagtggcactg

SEQ ID NO: 50942 - DNA, 25 bp, Mus musculus
aagcacacaccattgagtggcactg

SEQ ID NO: 50943 - DNA, 25 bp, Mus musculus
aagcacacacctcggatactcggtt

SEQ ID NO: 50944 - DNA, 25 bp, Mus musculus
aagcacacacctgggatactcggtt

SEQ ID NO: 50945 - DNA, 25 bp, Mus musculus
aagcacacaggacaaagcctcaaag

SEQ ID NO: 50946 - DNA, 25 bp, Mus musculus
aagcacacaggagaaagcctcaaag

SEQ ID NO: 50947 - DNA, 25 bp, Mus musculus
aagcacacatggacacaacacaatc

SEQ ID NO: 50948 - DNA, 25 bp, Mus musculus
aagcacacatggtcacaacacaatc

SEQ ID NO: 50949 - DNA, 25 bp, Mus musculus
aagcacacccctacagaggaatctg

SEQ ID NO: 50950 - DNA, 25 bp, Mus musculus
aagcacaccccttcagaggaatctg

SEQ ID NO: 50951 - DNA, 25 bp, Mus musculus
aagcacacgacgaatgccagacacg

SEQ ID NO: 50952 - DNA, 25 bp, Mus musculus
aagcacacgacgtatgccagacacg

SEQ ID NO: 50953 - DNA, 25 bp, Mus musculus
aagcacacggttcagtggcattagt

SEQ ID NO: 50954 - DNA, 25 bp, Mus musculus
aagcacacggttgagtggcattagt

SEQ ID NO: 50955 - DNA, 25 bp, Mus musculus
aagcacacgtacatatgcacatgca

SEQ ID NO: 50956 - DNA, 25 bp, Mus musculus
aagcacacgtacttatgcacatgca

SEQ ID NO: 50957 - DNA, 25 bp, Mus musculus
aagcacactcagattgcactcattt

SEQ ID NO: 50958 - DNA, 25 bp, Mus musculus
aagcacactcagtttgcactcattt

SEQ ID NO: 50959 - DNA, 25 bp, Mus musculus
aagcacactctgaagttatcactag

SEQ ID NO: 50960 - DNA, 25 bp, Mus musculus
aagcacactctgtagttatcactag

SEQ ID NO: 50961 - DNA, 25 bp, Mus musculus
aagcacactggaagatttcaattac

SEQ ID NO: 50962 - DNA, 25 bp, Mus musculus
aagcacactggatgatttcaattac

SEQ ID NO: 50963 - DNA, 25 bp, Mus musculus
aagcacactgttccgacagggtcaa

SEQ ID NO: 50964 - DNA, 25 bp, Mus musculus
aagcacactgttgcgacagggtcaa

SEQ ID NO: 50965 - DNA, 25 bp, Mus musculus
aagcacagacaaatatgacttcttg

SEQ ID NO: 50966 - DNA, 25 bp, Mus musculus
aagcacagacaattatgacttcttg

SEQ ID NO: 50967 - DNA, 25 bp, Mus musculus
aagcacagaccgcagtgtccctttg

SEQ ID NO: 50968 - DNA, 25 bp, Mus musculus
aagcacagaccggagtgtccctttg

SEQ ID NO: 50969 - DNA, 25 bp, Mus musculus
aagcacagacctcttgtggctcctt

SEQ ID NO: 50970 - DNA, 25 bp, Mus musculus
aagcacagacctgttgtggctcctt

SEQ ID NO: 50971 - DNA, 25 bp, Mus musculus
aagcacagacggagacaacctgcct

SEQ ID NO: 50972 - DNA, 25 bp, Mus musculus
aagcacagacggtgacaacctgcct

SEQ ID NO: 50973 - DNA, 25 bp, Mus musculus
aagcacagagacaggctttgctctc

SEQ ID NO: 50974 - DNA, 25 bp, Mus musculus
aagcacagagactggctttgctctc

SEQ ID NO: 50975 - DNA, 25 bp, Mus musculus
aagcacagagagatgttacctatga

SEQ ID NO: 50976 - DNA, 25 bp, Mus musculus
aagcacagagagttgttacctatga

SEQ ID NO: 50977 - DNA, 25 bp, Mus musculus
aagcacagaggtcgacgtatgtatt

SEQ ID NO: 50978 - DNA, 25 bp, Mus musculus
aagcacagaggtggacgtatgtatt

SEQ ID NO: 50979 - DNA, 25 bp, Mus musculus
aagcacagagtgagccggccgtgtt

SEQ ID NO: 50980 - DNA, 25 bp, Mus musculus
aagcacagagtgcaggccttaccta

SEQ ID NO: 50981 - DNA, 25 bp, Mus musculus
aagcacagagtggaggccttaccta

SEQ ID NO: 50982 - DNA, 25 bp, Mus musculus
aagcacagagtgtgccggccgtgtt

SEQ ID NO: 50983 - DNA, 25 bp, Mus musculus
aagcacagagttctcccatggagaa

SEQ ID NO: 50984 - DNA, 25 bp, Mus musculus
aagcacagagttgtcccatggagaa

SEQ ID NO: 50985 - DNA, 25 bp, Mus musculus
aagcacagcaagactcatgagtcat

SEQ ID NO: 50986 - DNA, 25 bp, Mus musculus
aagcacagcaagtctcatgagtcat

SEQ ID NO: 50987 - DNA, 25 bp, Mus musculus
aagcacagcacaaataaggctttct

SEQ ID NO: 50988 - DNA, 25 bp, Mus musculus
aagcacagcacatataaggctttct

SEQ ID NO: 50989 - DNA, 25 bp, Mus musculus
aagcacagcagtactgacagtcttt

SEQ ID NO: 50990 - DNA, 25 bp, Mus musculus
aagcacagcagttctgacagtcttt

SEQ ID NO: 50991 - DNA, 25 bp, Mus musculus
aagcacagcctacattagaatgcac

SEQ ID NO: 50992 - DNA, 25 bp, Mus musculus
aagcacagcctagattagaatgcac

SEQ ID NO: 50993 - DNA, 25 bp, Mus musculus
aagcacagcctgagagtcctcagaa

SEQ ID NO: 50994 - DNA, 25 bp, Mus musculus
aagcacagcctgtgagtcctcagaa

SEQ ID NO: 50995 - DNA, 25 bp, Mus musculus
aagcacagcgaacccattgcggaga

SEQ ID NO: 50996 - DNA, 25 bp, Mus musculus
aagcacagcgaagccattgcggaga

SEQ ID NO: 50997 - DNA, 25 bp, Mus musculus
aagcacagcgacaggcacagttctt

SEQ ID NO: 50998 - DNA, 25 bp, Mus musculus
aagcacagcgactggcacagttctt

SEQ ID NO: 50999 - DNA, 25 bp, Mus musculus
aagcacagcgccatcttggtttaag

SEQ ID NO: 51000 - DNA, 25 bp, Mus musculus
aagcacagcgccttcttggtttaag

SEQ ID NO: 51001 - DNA, 25 bp, Mus musculus
aagcacagctttctcagtctctcag

SEQ ID NO: 51002 - DNA, 25 bp, Mus musculus
aagcacagctttgtcagtctctcag

SEQ ID NO: 51003 - DNA, 25 bp, Mus musculus
aagcacaggctgcataagcaggctt

SEQ ID NO: 51004 - DNA, 25 bp, Mus musculus
aagcacaggctggataagcaggctt

SEQ ID NO: 51005 - DNA, 25 bp, Mus musculus
aagcacagggatcgcacagagcact

SEQ ID NO: 51006 - DNA, 25 bp, Mus musculus
aagcacagggatggcacagagcact

SEQ ID NO: 51007 - DNA, 25 bp, Mus musculus
aagcacaggtacctcagtttgattc

SEQ ID NO: 51008 - DNA, 25 bp, Mus musculus
aagcacaggtacgtcagtttgattc

SEQ ID NO: 51009 - DNA, 25 bp, Mus musculus
aagcacagtcatagatctccctgag

SEQ ID NO: 51010 - DNA, 25 bp, Mus musculus
aagcacagtcattgatctccctgag

SEQ ID NO: 51011 - DNA, 25 bp, Mus musculus
aagcacagtgacctttgtatatgat

SEQ ID NO: 51012 - DNA, 25 bp, Mus musculus
aagcacagtgacgtttgtatatgat

SEQ ID NO: 51013 - DNA, 25 bp, Mus musculus
aagcacagtgtcctcttggcaccaa

SEQ ID NO: 51014 - DNA, 25 bp, Mus musculus
aagcacagtgtcgtcttggcaccaa

SEQ ID NO: 51015 - DNA, 25 bp, Mus musculus
aagcacagtgtgcattttacagcac

SEQ ID NO: 51016 - DNA, 25 bp, Mus musculus
aagcacagtgtggattttacagcac

SEQ ID NO: 51017 - DNA, 25 bp, Mus musculus
aagcacagttcaagttccatgaaac

SEQ ID NO: 51018 - DNA, 25 bp, Mus musculus
aagcacagttcatgttccatgaaac

SEQ ID NO: 51019 - DNA, 25 bp, Mus musculus
aagcacataagtatctgggtctcat

SEQ ID NO: 51020 - DNA, 25 bp, Mus musculus
aagcacataagtttctgggtctcat

SEQ ID NO: 51021 - DNA, 25 bp, Mus musculus
aagcacatagtacgccaggttcgtt

SEQ ID NO: 51022 - DNA, 25 bp, Mus musculus
aagcacatagtaggccaggttcgtt

SEQ ID NO: 51023 - DNA, 25 bp, Mus musculus
aagcacatcacaccctcaagaagga

SEQ ID NO: 51024 - DNA, 25 bp, Mus musculus
aagcacatcacagcctcaagaagga

SEQ ID NO: 51025 - DNA, 25 bp, Mus musculus
aagcacatcagcatgggctggttga

SEQ ID NO: 51026 - DNA, 25 bp, Mus musculus
aagcacatcagcttgggctggttga

SEQ ID NO: 51027 - DNA, 25 bp, Mus musculus
aagcacatcccactccatagggtta

SEQ ID NO: 51028 - DNA, 25 bp, Mus musculus
aagcacatcccagtccatagggtta

SEQ ID NO: 51029 - DNA, 25 bp, Mus musculus
aagcacatccggcacatgcatgacc

SEQ ID NO: 51030 - DNA, 25 bp, Mus musculus
aagcacatccggcagctgcctgtca

SEQ ID NO: 51031 - DNA, 25 bp, Mus musculus
aagcacatccgggacatgcatgacc

SEQ ID NO: 51032 - DNA, 25 bp, Mus musculus
aagcacatccgggagctgcctgtca

SEQ ID NO: 51033 - DNA, 25 bp, Mus musculus
aagcacatctccatgtatcagctgc

SEQ ID NO: 51034 - DNA, 25 bp, Mus musculus
aagcacatctccttgtatcagctgc

SEQ ID NO: 51035 - DNA, 25 bp, Mus musculus
aagcacatctgacgtcttttgattt

SEQ ID NO: 51036 - DNA, 25 bp, Mus musculus
aagcacatctgaggtcttttgattt

SEQ ID NO: 51037 - DNA, 25 bp, Mus musculus
aagcacatgcagaaacttcagaact

SEQ ID NO: 51038 - DNA, 25 bp, Mus musculus
aagcacatgcagtaacttcagaact

SEQ ID NO: 51039 - DNA, 25 bp, Mus musculus
aagcacatggaaaaggaccctggca

SEQ ID NO: 51040 - DNA, 25 bp, Mus musculus
aagcacatggaataggaccctggca

SEQ ID NO: 51041 - DNA, 25 bp, Mus musculus
aagcacatggcacgacagtcagatc

SEQ ID NO: 51042 - DNA, 25 bp, Mus musculus
aagcacatggcaggacagtcagatc

SEQ ID NO: 51043 - DNA, 25 bp, Mus musculus
aagcacatggctagctctcagtcac

SEQ ID NO: 51044 - DNA, 25 bp, Mus musculus
aagcacatggcttgctctcagtcac

SEQ ID NO: 51045 - DNA, 25 bp, Mus musculus
aagcacatgggcatgactctcctgg

SEQ ID NO: 51046 - DNA, 25 bp, Mus musculus
aagcacatgggcttgactctcctgg

SEQ ID NO: 51047 - DNA, 25 bp, Mus musculus
aagcacatggtaaatgacccagttt

SEQ ID NO: 51048 - DNA, 25 bp, Mus musculus
aagcacatggtatatgacccagttt

SEQ ID NO: 51049 - DNA, 25 bp, Mus musculus
aagcacatgtgccttagcacttgaa

SEQ ID NO: 51050 - DNA, 25 bp, Mus musculus
aagcacatgtgcgttagcacttgaa

SEQ ID NO: 51051 - DNA, 25 bp, Mus musculus
aagcacattcttaggctgaagccgc

SEQ ID NO: 51052 - DNA, 25 bp, Mus musculus
aagcacattctttggctgaagccgc

SEQ ID NO: 51053 - DNA, 25 bp, Mus musculus
aagcacattgctaaacgtctctgca

SEQ ID NO: 51054 - DNA, 25 bp, Mus musculus
aagcacattgctaaccactttgggc

SEQ ID NO: 51055 - DNA, 25 bp, Mus musculus
aagcacattgcttaacgtctctgca

SEQ ID NO: 51056 - DNA, 25 bp, Mus musculus
aagcacattgcttaccactttgggc

SEQ ID NO: 51057 - DNA, 25 bp, Mus musculus
aagcacattgtgactgcgcaccttg

SEQ ID NO: 51058 - DNA, 25 bp, Mus musculus
aagcacattgtgtctgcgcaccttg

SEQ ID NO: 51059 - DNA, 25 bp, Mus musculus
aagcacatttcaagaatgcctggta

SEQ ID NO: 51060 - DNA, 25 bp, Mus musculus
aagcacatttcatgaatgcctggta

SEQ ID NO: 51061 - DNA, 25 bp, Mus musculus
aagcacatttgtctctccagtctct

SEQ ID NO: 51062 - DNA, 25 bp, Mus musculus
aagcacatttgtgtctccagtctct

SEQ ID NO: 51063 - DNA, 25 bp, Mus musculus
aagcaccaaaccagagatacctcga

SEQ ID NO: 51064 - DNA, 25 bp, Mus musculus
aagcaccaaacctgagatacctcga

SEQ ID NO: 51065 - DNA, 25 bp, Mus musculus
aagcaccacatacgagtcgctcaga

SEQ ID NO: 51066 - DNA, 25 bp, Mus musculus
aagcaccacataggagtcgctcaga

SEQ ID NO: 51067 - DNA, 25 bp, Mus musculus
aagcaccacgtacatagctcctatt

SEQ ID NO: 51068 - DNA, 25 bp, Mus musculus
aagcaccacgtagatagctcctatt

SEQ ID NO: 51069 - DNA, 25 bp, Mus musculus
aagcaccactggattggagacacaa

SEQ ID NO: 51070 - DNA, 25 bp, Mus musculus
aagcaccactggtttggagacacaa

SEQ ID NO: 51071 - DNA, 25 bp, Mus musculus
aagcaccagcaccttgtgaagctga

SEQ ID NO: 51072 - DNA, 25 bp, Mus musculus
aagcaccagcacgttgtgaagctga

SEQ ID NO: 51073 - DNA, 25 bp, Mus musculus
aagcaccaggagattgctgggcgtt

SEQ ID NO: 51074 - DNA, 25 bp, Mus musculus
aagcaccaggagtttgctgggcgtt

SEQ ID NO: 51075 - DNA, 25 bp, Mus musculus
aagcaccaggcaacacagtttacat

SEQ ID NO: 51076 - DNA, 25 bp, Mus musculus
aagcaccaggcatcacagtttacat

SEQ ID NO: 51077 - DNA, 25 bp, Mus musculus
aagcaccaggttaatgctggacccc

SEQ ID NO: 51078 - DNA, 25 bp, Mus musculus
aagcaccaggtttatgctggacccc

SEQ ID NO: 51079 - DNA, 25 bp, Mus musculus
aagcaccagttcatatcttgggcct

SEQ ID NO: 51080 - DNA, 25 bp, Mus musculus
aagcaccagttcttatcttgggcct

SEQ ID NO: 51081 - DNA, 25 bp, Mus musculus
aagcaccataaacggtcacctggcc

SEQ ID NO: 51082 - DNA, 25 bp, Mus musculus
aagcaccataaagggtcacctggcc

SEQ ID NO: 51083 - DNA, 25 bp, Mus musculus
aagcaccatataaaatgttttctag

SEQ ID NO: 51084 - DNA, 25 bp, Mus musculus
aagcaccatatataatgttttctag

SEQ ID NO: 51085 - DNA, 25 bp, Mus musculus
aagcaccatgtgacaatggagctga

SEQ ID NO: 51086 - DNA, 25 bp, Mus musculus
aagcaccatgtgtcaatggagctga

SEQ ID NO: 51087 - DNA, 25 bp, Mus musculus
aagcaccattacctacttgtattgt

SEQ ID NO: 51088 - DNA, 25 bp, Mus musculus
aagcaccattacgtacttgtattgt

SEQ ID NO: 51089 - DNA, 25 bp, Mus musculus
aagcacccacctagatcctgaaaga

SEQ ID NO: 51090 - DNA, 25 bp, Mus musculus
aagcacccaccttgatcctgaaaga

SEQ ID NO: 51091 - DNA, 25 bp, Mus musculus
aagcacccatatcattttctgaagg

SEQ ID NO: 51092 - DNA, 25 bp, Mus musculus
aagcacccatatgattttctgaagg

SEQ ID NO: 51093 - DNA, 25 bp, Mus musculus
aagcacccctcaaggatgccctgaa

SEQ ID NO: 51094 - DNA, 25 bp, Mus musculus
aagcacccctcatggatgccctgaa

SEQ ID NO: 51095 - DNA, 25 bp, Mus musculus
aagcaccctcaaatggcagatggca

SEQ ID NO: 51096 - DNA, 25 bp, Mus musculus
aagcaccctcaattggcagatggca

SEQ ID NO: 51097 - DNA, 25 bp, Mus musculus
aagcaccctcagaaagcatcgcaga

SEQ ID NO: 51098 - DNA, 25 bp, Mus musculus
aagcaccctcagtaagcatcgcaga

SEQ ID NO: 51099 - DNA, 25 bp, Mus musculus
aagcaccctgccagagaactgagga

SEQ ID NO: 51100 - DNA, 25 bp, Mus musculus
aagcaccctgcctgagaactgagga

SEQ ID NO: 51101 - DNA, 25 bp, Mus musculus
aagcaccctgtaaagttcttctggc

SEQ ID NO: 51102 - DNA, 25 bp, Mus musculus
aagcaccctgtatagttcttctggc

SEQ ID NO: 51103 - DNA, 25 bp, Mus musculus
aagcaccctttcattatatcctctt

SEQ ID NO: 51104 - DNA, 25 bp, Mus musculus
aagcaccctttctttatatcctctt

SEQ ID NO: 51105 - DNA, 25 bp, Mus musculus
aagcaccgagagatgtagccatgtt

SEQ ID NO: 51106 - DNA, 25 bp, Mus musculus
aagcaccgagagttgtagccatgtt

SEQ ID NO: 51107 - DNA, 25 bp, Mus musculus
aagcaccgccggctaggagtcaact

SEQ ID NO: 51108 - DNA, 25 bp, Mus musculus
aagcaccgccgggtaggagtcaact

SEQ ID NO: 51109 - DNA, 25 bp, Mus musculus
aagcaccgtactaagatgggctcat

SEQ ID NO: 51110 - DNA, 25 bp, Mus musculus
aagcaccgtacttagatgggctcat

SEQ ID NO: 51111 - DNA, 25 bp, Mus musculus
aagcaccgtattaactagcctgtcc

SEQ ID NO: 51112 - DNA, 25 bp, Mus musculus
aagcaccgtatttactagcctgtcc

SEQ ID NO: 51113 - DNA, 25 bp, Mus musculus
aagcacctaatgaacacttcaggtt

SEQ ID NO: 51114 - DNA, 25 bp, Mus musculus
aagcacctaatgtacacttcaggtt

SEQ ID NO: 51115 - DNA, 25 bp, Mus musculus
aagcacctacgaagtgccgggtgtt

SEQ ID NO: 51116 - DNA, 25 bp, Mus musculus
aagcacctacgatgtgccgggtgtt

SEQ ID NO: 51117 - DNA, 25 bp, Mus musculus
aagcacctacggagagaacctgtac

SEQ ID NO: 51118 - DNA, 25 bp, Mus musculus
aagcacctacggtgagaacctgtac

SEQ ID NO: 51119 - DNA, 25 bp, Mus musculus
aagcacctagtaactcaccctagtt

SEQ ID NO: 51120 - DNA, 25 bp, Mus musculus
aagcacctagtatctcaccctagtt

SEQ ID NO: 51121 - DNA, 25 bp, Mus musculus
aagcacctagtgctgagaagctcac

SEQ ID NO: 51122 - DNA, 25 bp, Mus musculus
aagcacctagtggtgagaagctcac

SEQ ID NO: 51123 - DNA, 25 bp, Mus musculus
aagcacctagttcgtagagttacga

SEQ ID NO: 51124 - DNA, 25 bp, Mus musculus
aagcacctagttggtagagttacga

SEQ ID NO: 51125 - DNA, 25 bp, Mus musculus
aagcacctccagaagcgggatgcag

SEQ ID NO: 51126 - DNA, 25 bp, Mus musculus
aagcacctccagtagcgggatgcag

SEQ ID NO: 51127 - DNA, 25 bp, Mus musculus
aagcacctcggcctgcaccatggag

SEQ ID NO: 51128 - DNA, 25 bp, Mus musculus
aagcacctcggcgtgcaccatggag

SEQ ID NO: 51129 - DNA, 25 bp, Mus musculus
aagcacctctacacactgagctatc

SEQ ID NO: 51130 - DNA, 25 bp, Mus musculus
aagcacctctactcactgagctatc

SEQ ID NO: 51131 - DNA, 25 bp, Mus musculus
aagcacctctcacacagcgtgtgtg

SEQ ID NO: 51132 - DNA, 25 bp, Mus musculus
aagcacctctcagacagcgtgtgtg

SEQ ID NO: 51133 - DNA, 25 bp, Mus musculus
aagcacctgcccaaaataatctaat

SEQ ID NO: 51134 - DNA, 25 bp, Mus musculus
aagcacctgccctaaataatctaat

SEQ ID NO: 51135 - DNA, 25 bp, Mus musculus
aagcacctgcggataaccttgaact

SEQ ID NO: 51136 - DNA, 25 bp, Mus musculus
aagcacctgcggctgggcagaacaa

SEQ ID NO: 51137 - DNA, 25 bp, Mus musculus
aagcacctgcgggtgggcagaacaa

SEQ ID NO: 51138 - DNA, 25 bp, Mus musculus
aagcacctgcggttaaccttgaact

SEQ ID NO: 51139 - DNA, 25 bp, Mus musculus
aagcacctgctactcagacctggaa

SEQ ID NO: 51140 - DNA, 25 bp, Mus musculus
aagcacctgctagtcagacctggaa

SEQ ID NO: 51141 - DNA, 25 bp, Mus musculus
aagcacctgctccaaaggcggctgg

SEQ ID NO: 51142 - DNA, 25 bp, Mus musculus
aagcacctgctcgaaaggcggctgg

SEQ ID NO: 51143 - DNA, 25 bp, Mus musculus
aagcacctgcttaacttgccagtct

SEQ ID NO: 51144 - DNA, 25 bp, Mus musculus
aagcacctgctttacttgccagtct

SEQ ID NO: 51145 - DNA, 25 bp, Mus musculus
aagcacctggacacaattcctgaag

SEQ ID NO: 51146 - DNA, 25 bp, Mus musculus
aagcacctggactcaattcctgaag

SEQ ID NO: 51147 - DNA, 25 bp, Mus musculus
aagcacctggctagacatgctgagc

SEQ ID NO: 51148 - DNA, 25 bp, Mus musculus
aagcacctggcttgacatgctgagc

SEQ ID NO: 51149 - DNA, 25 bp, Mus musculus
aagcacctgggtcgcagaagtagct

SEQ ID NO: 51150 - DNA, 25 bp, Mus musculus
aagcacctgggtggcagaagtagct

SEQ ID NO: 51151 - DNA, 25 bp, Mus musculus
aagcacctggtcacggataagctga

SEQ ID NO: 51152 - DNA, 25 bp, Mus musculus
aagcacctggtctcggataagctga

SEQ ID NO: 51153 - DNA, 25 bp, Mus musculus
aagcacctggtgctcaacattggca

SEQ ID NO: 51154 - DNA, 25 bp, Mus musculus
aagcacctggtggtcaacattggca

SEQ ID NO: 51155 - DNA, 25 bp, Mus musculus
aagcacctgtacaaggtggtcccct

SEQ ID NO: 51156 - DNA, 25 bp, Mus musculus
aagcacctgtacatcgagtccgacg

SEQ ID NO: 51157 - DNA, 25 bp, Mus musculus
aagcacctgtactaggtggtcccct

SEQ ID NO: 51158 - DNA, 25 bp, Mus musculus
aagcacctgtacttcgagtccgacg

SEQ ID NO: 51159 - DNA, 25 bp, Mus musculus
aagcacctgtagcatcttggtctaa

SEQ ID NO: 51160 - DNA, 25 bp, Mus musculus
aagcacctgtaggatcttggtctaa

SEQ ID NO: 51161 - DNA, 25 bp, Mus musculus
aagcacctgtcactgtgggcctcgg

SEQ ID NO: 51162 - DNA, 25 bp, Mus musculus
aagcacctgtcagtgtgggcctcgg

SEQ ID NO: 51163 - DNA, 25 bp, Mus musculus
aagcacctgtctcaggccaaatggg

SEQ ID NO: 51164 - DNA, 25 bp, Mus musculus
aagcacctgtctgaggccaaatggg

SEQ ID NO: 51165 - DNA, 25 bp, Mus musculus
aagcaccttcatactagagggtaag

SEQ ID NO: 51166 - DNA, 25 bp, Mus musculus
aagcaccttcattctagagggtaag

SEQ ID NO: 51167 - DNA, 25 bp, Mus musculus
aagcaccttccacagggtcataaag

SEQ ID NO: 51168 - DNA, 25 bp, Mus musculus
aagcaccttccagagggtcataaag

SEQ ID NO: 51169 - DNA, 25 bp, Mus musculus
aagcaccttctcagatggagcgcag

SEQ ID NO: 51170 - DNA, 25 bp, Mus musculus
aagcaccttctctgatggagcgcag

SEQ ID NO: 51171 - DNA, 25 bp, Mus musculus
aagcaccttctgagctatgacggac

SEQ ID NO: 51172 - DNA, 25 bp, Mus musculus
aagcaccttctgtgctatgacggac

SEQ ID NO: 51173 - DNA, 25 bp, Mus musculus
aagcaccttcttccattttgtaaat

SEQ ID NO: 51174 - DNA, 25 bp, Mus musculus
aagcaccttcttgcattttgtaaat

SEQ ID NO: 51175 - DNA, 25 bp, Mus musculus
aagcaccttgccagacatgaccatg

SEQ ID NO: 51176 - DNA, 25 bp, Mus musculus
aagcaccttgcctgacatgaccatg

SEQ ID NO: 51177 - DNA, 25 bp, Mus musculus
aagcaccttttaaatcatgcgtgtg

SEQ ID NO: 51178 - DNA, 25 bp, Mus musculus
aagcaccttttaatagtcagttgag

SEQ ID NO: 51179 - DNA, 25 bp, Mus musculus
aagcaccttttatatcatgcgtgtg

SEQ ID NO: 51180 - DNA, 25 bp, Mus musculus
aagcaccttttattagtcagttgag

SEQ ID NO: 51181 - DNA, 25 bp, Mus musculus
aagcaccttttcctctgtaagtgga

SEQ ID NO: 51182 - DNA, 25 bp, Mus musculus
aagcaccttttcgtctgtaagtgga

SEQ ID NO: 51183 - DNA, 25 bp, Mus musculus
aagcacgaaggacccacactacagt

SEQ ID NO: 51184 - DNA, 25 bp, Mus musculus
aagcacgaaggagccacactacagt

SEQ ID NO: 51185 - DNA, 25 bp, Mus musculus
aagcacgaagggattccgagcaact

SEQ ID NO: 51186 - DNA, 25 bp, Mus musculus
aagcacgaagggtttccgagcaact

SEQ ID NO: 51187 - DNA, 25 bp, Mus musculus
aagcacgacaaactgagccggtccg

SEQ ID NO: 51188 - DNA, 25 bp, Mus musculus
aagcacgacaaagtgagccggtccg

SEQ ID NO: 51189 - DNA, 25 bp, Mus musculus
aagcacgacatcattggagagttca

SEQ ID NO: 51190 - DNA, 25 bp, Mus musculus
aagcacgacatctttggagagttca

SEQ ID NO: 51191 - DNA, 25 bp, Mus musculus
aagcacgagctcaaaggccatttcc

SEQ ID NO: 51192 - DNA, 25 bp, Mus musculus
aagcacgagctctaaggccatttcc

SEQ ID NO: 51193 - DNA, 25 bp, Mus musculus
aagcacgcagctatgttcagtaagg

SEQ ID NO: 51194 - DNA, 25 bp, Mus musculus
aagcacgcagctttgttcagtaagg

SEQ ID NO: 51195 - DNA, 25 bp, Mus musculus
aagcacgcctacagcttcaggataa

SEQ ID NO: 51196 - DNA, 25 bp, Mus musculus
aagcacgcctactgcttcaggataa

SEQ ID NO: 51197 - DNA, 25 bp, Mus musculus
aagcacgcgctgagcaggatgagca

SEQ ID NO: 51198 - DNA, 25 bp, Mus musculus
aagcacgcgctgtgcaggatgagca

SEQ ID NO: 51199 - DNA, 25 bp, Mus musculus
aagcacgctgccagggctccagcat

SEQ ID NO: 51200 - DNA, 25 bp, Mus musculus
aagcacgctgcctgggctccagcat

SEQ ID NO: 51201 - DNA, 25 bp, Mus musculus
aagcacgctgctacaatgttataga

SEQ ID NO: 51202 - DNA, 25 bp, Mus musculus
aagcacgctgcttcaatgttataga

SEQ ID NO: 51203 - DNA, 25 bp, Mus musculus
aagcacggatgcaggccgagctgct

SEQ ID NO: 51204 - DNA, 25 bp, Mus musculus
aagcacggatgctggccgagctgct

SEQ ID NO: 51205 - DNA, 25 bp, Mus musculus
aagcacgggcatactcatctgcatc

SEQ ID NO: 51206 - DNA, 25 bp, Mus musculus
aagcacgggcattctcatctgcatc

SEQ ID NO: 51207 - DNA, 25 bp, Mus musculus
aagcacgggcgtctctgctgtcctc

SEQ ID NO: 51208 - DNA, 25 bp, Mus musculus
aagcacgggcgtgtctgctgtcctc

SEQ ID NO: 51209 - DNA, 25 bp, Mus musculus
aagcacgggttaaggccacatgcgc

SEQ ID NO: 51210 - DNA, 25 bp, Mus musculus
aagcacgggttatggccacatgcgc

SEQ ID NO: 51211 - DNA, 25 bp, Mus musculus
aagcacgtcactctggctcgaggga

SEQ ID NO: 51212 - DNA, 25 bp, Mus musculus
aagcacgtcactgtggctcgaggga

SEQ ID NO: 51213 - DNA, 25 bp, Mus musculus
aagcacgtcagcaaactgttcagat

SEQ ID NO: 51214 - DNA, 25 bp, Mus musculus
aagcacgtcagcagggcctatggcg

SEQ ID NO: 51215 - DNA, 25 bp, Mus musculus
aagcacgtcagctaactgttcagat

SEQ ID NO: 51216 - DNA, 25 bp, Mus musculus
aagcacgtcagctgggcctatggcg

SEQ ID NO: 51217 - DNA, 25 bp, Mus musculus
aagcacgtcttgcaacagagcaccc

SEQ ID NO: 51218 - DNA, 25 bp, Mus musculus
aagcacgtcttggaacagagcaccc

SEQ ID NO: 51219 - DNA, 25 bp, Mus musculus
aagcacgtgacacaagcgctgagga

SEQ ID NO: 51220 - DNA, 25 bp, Mus musculus
aagcacgtgacagaagcgctgagga

SEQ ID NO: 51221 - DNA, 25 bp, Mus musculus
aagcacgtgcccctgggacaacgga

SEQ ID NO: 51222 - DNA, 25 bp, Mus musculus
aagcacgtgcccgtgggacaacgga

SEQ ID NO: 51223 - DNA, 25 bp, Mus musculus
aagcacgtggctattcttggctaca

SEQ ID NO: 51224 - DNA, 25 bp, Mus musculus
aagcacgtggcttttcttggctaca

SEQ ID NO: 51225 - DNA, 25 bp, Mus musculus
aagcacgttcttatggcattcttca

SEQ ID NO: 51226 - DNA, 25 bp, Mus musculus
aagcacgttcttccatcgtagtatg

SEQ ID NO: 51227 - DNA, 25 bp, Mus musculus
aagcacgttcttgcatcgtagtatg

SEQ ID NO: 51228 - DNA, 25 bp, Mus musculus
aagcacgttcttttggcattcttca

SEQ ID NO: 51229 - DNA, 25 bp, Mus musculus
aagcacgttgtcctctgctgtaaaa

SEQ ID NO: 51230 - DNA, 25 bp, Mus musculus
aagcacgttgtcgtctgctgtaaaa

SEQ ID NO: 51231 - DNA, 25 bp, Mus musculus
aagcactaacttagtaactattgga

SEQ ID NO: 51232 - DNA, 25 bp, Mus musculus
aagcactaactttgtaactattgga

SEQ ID NO: 51233 - DNA, 25 bp, Mus musculus
aagcactaagcaaatgcatcctgtg

SEQ ID NO: 51234 - DNA, 25 bp, Mus musculus
aagcactaagcatatgcatcctgtg

SEQ ID NO: 51235 - DNA, 25 bp, Mus musculus
aagcactaccaacgcgataacgata

SEQ ID NO: 51236 - DNA, 25 bp, Mus musculus
aagcactaccaaggcgataacgata

SEQ ID NO: 51237 - DNA, 25 bp, Mus musculus
aagcactactagatgtcacggccat

SEQ ID NO: 51238 - DNA, 25 bp, Mus musculus
aagcactactagttgtcacggccat

SEQ ID NO: 51239 - DNA, 25 bp, Mus musculus
aagcactactggagaggttcctgtt

SEQ ID NO: 51240 - DNA, 25 bp, Mus musculus
aagcactactggtgaggttcctgtt

SEQ ID NO: 51241 - DNA, 25 bp, Mus musculus
aagcactagaagctcaccagaccgg

SEQ ID NO: 51242 - DNA, 25 bp, Mus musculus
aagcactagaaggtcaccagaccgg

SEQ ID NO: 51243 - DNA, 25 bp, Mus musculus
aagcactagcctacctattttcttc

SEQ ID NO: 51244 - DNA, 25 bp, Mus musculus
aagcactagccttcctattttcttc

SEQ ID NO: 51245 - DNA, 25 bp, Mus musculus
aagcactaggctacccatgatggtt

SEQ ID NO: 51246 - DNA, 25 bp, Mus musculus
aagcactaggcttcccatgatggtt

SEQ ID NO: 51247 - DNA, 25 bp, Mus musculus
aagcactataggacagggactccct

SEQ ID NO: 51248 - DNA, 25 bp, Mus musculus
aagcactataggtcagggactccct

SEQ ID NO: 51249 - DNA, 25 bp, Mus musculus
aagcactatggcaactctctatact

SEQ ID NO: 51250 - DNA, 25 bp, Mus musculus
aagcactatggctactctctatact

SEQ ID NO: 51251 - DNA, 25 bp, Mus musculus
aagcactattcgactggctacggac

SEQ ID NO: 51252 - DNA, 25 bp, Mus musculus
aagcactattcgtctggctacggac

SEQ ID NO: 51253 - DNA, 25 bp, Mus musculus
aagcactcaaaacatgtccgacctg

SEQ ID NO: 51254 - DNA, 25 bp, Mus musculus
aagcactcaaaagatgtccgacctg

SEQ ID NO: 51255 - DNA, 25 bp, Mus musculus
aagcactcagctatcttccttaagg

SEQ ID NO: 51256 - DNA, 25 bp, Mus musculus
aagcactcagctttcttccttaagg

SEQ ID NO: 51257 - DNA, 25 bp, Mus musculus
aagcactcagggacagaccgaactg

SEQ ID NO: 51258 - DNA, 25 bp, Mus musculus
aagcactcagggtcagaccgaactg

SEQ ID NO: 51259 - DNA, 25 bp, Mus musculus
aagcactccatgacagagtggttca

SEQ ID NO: 51260 - DNA, 25 bp, Mus musculus
aagcactccatgtcagagtggttca

SEQ ID NO: 51261 - DNA, 25 bp, Mus musculus
aagcactcccgtcggtctgagaagt

SEQ ID NO: 51262 - DNA, 25 bp, Mus musculus
aagcactcccgtgggtctgagaagt

SEQ ID NO: 51263 - DNA, 25 bp, Mus musculus
aagcactccctgcatttccgagaga

SEQ ID NO: 51264 - DNA, 25 bp, Mus musculus
aagcactccctggatttccgagaga

SEQ ID NO: 51265 - DNA, 25 bp, Mus musculus
aagcactcccttctagagatttacc

SEQ ID NO: 51266 - DNA, 25 bp, Mus musculus
aagcactcccttgtagagatttacc

SEQ ID NO: 51267 - DNA, 25 bp, Mus musculus
aagcactcgtgcaatggccggttcc

SEQ ID NO: 51268 - DNA, 25 bp, Mus musculus
aagcactcgtgctatggccggttcc

SEQ ID NO: 51269 - DNA, 25 bp, Mus musculus
aagcactctcacaaaccctaaaaat

SEQ ID NO: 51270 - DNA, 25 bp, Mus musculus
aagcactctcactaaccctaaaaat

SEQ ID NO: 51271 - DNA, 25 bp, Mus musculus
aagcactctgttactgtgctgcgac

SEQ ID NO: 51272 - DNA, 25 bp, Mus musculus
aagcactctgtttctgtgctgcgac

SEQ ID NO: 51273 - DNA, 25 bp, Mus musculus
aagcactcttccctaaacaagctct

SEQ ID NO: 51274 - DNA, 25 bp, Mus musculus
aagcactcttccgtaaacaagctct

SEQ ID NO: 51275 - DNA, 25 bp, Mus musculus
aagcactctttcacatactagggtg

SEQ ID NO: 51276 - DNA, 25 bp, Mus musculus
aagcactctttctcatactagggtg

SEQ ID NO: 51277 - DNA, 25 bp, Mus musculus
aagcactgacccaaaccagctgtgg

SEQ ID NO: 51278 - DNA, 25 bp, Mus musculus
aagcactgaccctaaccagctgtgg

SEQ ID NO: 51279 - DNA, 25 bp, Mus musculus
aagcactgacttatgaactgagaaa

SEQ ID NO: 51280 - DNA, 25 bp, Mus musculus
aagcactgacttttgaactgagaaa

SEQ ID NO: 51281 - DNA, 25 bp, Mus musculus
aagcactgaggaagctggctcgaga

SEQ ID NO: 51282 - DNA, 25 bp, Mus musculus
aagcactgaggatgctggctcgaga

SEQ ID NO: 51283 - DNA, 25 bp, Mus musculus
aagcactgatctaagaccatcttag

SEQ ID NO: 51284 - DNA, 25 bp, Mus musculus
aagcactgatctacttgctgtccac

SEQ ID NO: 51285 - DNA, 25 bp, Mus musculus
aagcactgatcttagaccatcttag

SEQ ID NO: 51286 - DNA, 25 bp, Mus musculus
aagcactgatcttcttgctgtccac

SEQ ID NO: 51287 - DNA, 25 bp, Mus musculus
aagcactgcaacacttggtcctata

SEQ ID NO: 51288 - DNA, 25 bp, Mus musculus
aagcactgcaactcttggtcctata

SEQ ID NO: 51289 - DNA, 25 bp, Mus musculus
aagcactgcaggatgtgtgaccgct

SEQ ID NO: 51290 - DNA, 25 bp, Mus musculus
aagcactgcaggttgtgtgaccgct

SEQ ID NO: 51291 - DNA, 25 bp, Mus musculus
aagcactgccaaccgtggttattgt

SEQ ID NO: 51292 - DNA, 25 bp, Mus musculus
aagcactgccaagcgtggttattgt

SEQ ID NO: 51293 - DNA, 25 bp, Mus musculus
aagcactgccggcatatggaagaag

SEQ ID NO: 51294 - DNA, 25 bp, Mus musculus
aagcactgccgggatatggaagaag

SEQ ID NO: 51295 - DNA, 25 bp, Mus musculus
aagcactgccttcacgtgtgtgact

SEQ ID NO: 51296 - DNA, 25 bp, Mus musculus
aagcactgccttgacgtgtgtgact

SEQ ID NO: 51297 - DNA, 25 bp, Mus musculus
aagcactgcggaagggcacgctcgc

SEQ ID NO: 51298 - DNA, 25 bp, Mus musculus
aagcactgcggatgggcacgctcgc

SEQ ID NO: 51299 - DNA, 25 bp, Mus musculus
aagcactgcgtgctcatgtaccagg

SEQ ID NO: 51300 - DNA, 25 bp, Mus musculus
aagcactgcgtggtcatgtaccagg

SEQ ID NO: 51301 - DNA, 25 bp, Mus musculus
aagcactgctcccaaggtgacagga

SEQ ID NO: 51302 - DNA, 25 bp, Mus musculus
aagcactgctccgaaggtgacagga

SEQ ID NO: 51303 - DNA, 25 bp, Mus musculus
aagcactgctgaacattctgggaaa

SEQ ID NO: 51304 - DNA, 25 bp, Mus musculus
aagcactgctgacaactcttgagcc

SEQ ID NO: 51305 - DNA, 25 bp, Mus musculus
aagcactgctgagaactcttgagcc

SEQ ID NO: 51306 - DNA, 25 bp, Mus musculus
aagcactgctgatcattctgggaaa

SEQ ID NO: 51307 - DNA, 25 bp, Mus musculus
aagcactgcttactgtcatccatgg

SEQ ID NO: 51308 - DNA, 25 bp, Mus musculus
aagcactgcttagtgtcatccatgg

SEQ ID NO: 51309 - DNA, 25 bp, Mus musculus
aagcactggccaagaataccgtgac

SEQ ID NO: 51310 - DNA, 25 bp, Mus musculus
aagcactggccatgaataccgtgac

SEQ ID NO: 51311 - DNA, 25 bp, Mus musculus
aagcactggcttaaggaggcaggac

SEQ ID NO: 51312 - DNA, 25 bp, Mus musculus
aagcactggctttaggaggcaggac

SEQ ID NO: 51313 - DNA, 25 bp, Mus musculus
aagcactggtgtcgaacttccccat

SEQ ID NO: 51314 - DNA, 25 bp, Mus musculus
aagcactggtgtggaacttccccat

SEQ ID NO: 51315 - DNA, 25 bp, Mus musculus
aagcactgtgaacatgctggcttca

SEQ ID NO: 51316 - DNA, 25 bp, Mus musculus
aagcactgtgaagatgctggcttca

SEQ ID NO: 51317 - DNA, 25 bp, Mus musculus
aagcactgtgcgagatcacggctgt

SEQ ID NO: 51318 - DNA, 25 bp, Mus musculus
aagcactgtgcgtgatcacggctgt

SEQ ID NO: 51319 - DNA, 25 bp, Mus musculus
aagcactgtgtcagtccagcatgga

SEQ ID NO: 51320 - DNA, 25 bp, Mus musculus
aagcactgtgtctgtccagcatgga

SEQ ID NO: 51321 - DNA, 25 bp, Mus musculus
aagcactgtgtgagggctgctctct

SEQ ID NO: 51322 - DNA, 25 bp, Mus musculus
aagcactgtgtgtgggctgctctct

SEQ ID NO: 51323 - DNA, 25 bp, Mus musculus
aagcactgttagcttttcttgtttg

SEQ ID NO: 51324 - DNA, 25 bp, Mus musculus
aagcactgttaggttttcttgtttg

SEQ ID NO: 51325 - DNA, 25 bp, Mus musculus
aagcactgtttccagttgccacaac

SEQ ID NO: 51326 - DNA, 25 bp, Mus musculus
aagcactgtttcgagttgccacaac

SEQ ID NO: 51327 - DNA, 25 bp, Mus musculus
aagcactgtttgcttctcattgcgc

SEQ ID NO: 51328 - DNA, 25 bp, Mus musculus
aagcactgtttggttctcattgcgc

SEQ ID NO: 51329 - DNA, 25 bp, Mus musculus
aagcacttaataaatctcaccaagg

SEQ ID NO: 51330 - DNA, 25 bp, Mus musculus
aagcacttaatatatctcaccaagg

SEQ ID NO: 51331 - DNA, 25 bp, Mus musculus
aagcacttactgagtggtaaccatg

SEQ ID NO: 51332 - DNA, 25 bp, Mus musculus
aagcacttactgtgtggtaaccatg

SEQ ID NO: 51333 - DNA, 25 bp, Mus musculus
aagcacttagctcccctcatacaca

SEQ ID NO: 51334 - DNA, 25 bp, Mus musculus
aagcacttagctgccctcatacaca

SEQ ID NO: 51335 - DNA, 25 bp, Mus musculus
aagcacttatttatggactgaccgc

SEQ ID NO: 51336 - DNA, 25 bp, Mus musculus
aagcacttatttttggactgaccgc

SEQ ID NO: 51337 - DNA, 25 bp, Mus musculus
aagcacttcaccactggtctacata

SEQ ID NO: 51338 - DNA, 25 bp, Mus musculus
aagcacttcacctctggtctacata

SEQ ID NO: 51339 - DNA, 25 bp, Mus musculus
aagcacttcaggagggccagcacca

SEQ ID NO: 51340 - DNA, 25 bp, Mus musculus
aagcacttcaggctgtatgcatcaa

SEQ ID NO: 51341 - DNA, 25 bp, Mus musculus
aagcacttcagggtgtatgcatcaa

SEQ ID NO: 51342 - DNA, 25 bp, Mus musculus
aagcacttcaggtgggccagcacca

SEQ ID NO: 51343 - DNA, 25 bp, Mus musculus
aagcacttccctccctatgcaaggt

SEQ ID NO: 51344 - DNA, 25 bp, Mus musculus
aagcacttccctgcctatgcaaggt

SEQ ID NO: 51345 - DNA, 25 bp, Mus musculus
aagcacttccggctgaagttcaacg

SEQ ID NO: 51346 - DNA, 25 bp, Mus musculus
aagcacttccgggtgaagttcaacg

SEQ ID NO: 51347 - DNA, 25 bp, Mus musculus
aagcacttccttaactatttctaga

SEQ ID NO: 51348 - DNA, 25 bp, Mus musculus
aagcacttcctttactatttctaga

SEQ ID NO: 51349 - DNA, 25 bp, Mus musculus
aagcacttcgcacttgggtggcact

SEQ ID NO: 51350 - DNA, 25 bp, Mus musculus
aagcacttcgcagttgggtggcact

SEQ ID NO: 51351 - DNA, 25 bp, Mus musculus
aagcacttcgtaaccttgagggatc

SEQ ID NO: 51352 - DNA, 25 bp, Mus musculus
aagcacttcgtatccttgagggatc

SEQ ID NO: 51353 - DNA, 25 bp, Mus musculus
aagcacttgactcgtgagccctgtt

SEQ ID NO: 51354 - DNA, 25 bp, Mus musculus
aagcacttgactggtgagccctgtt

SEQ ID NO: 51355 - DNA, 25 bp, Mus musculus
aagcacttgcatccaagggcagtca

SEQ ID NO: 51356 - DNA, 25 bp, Mus musculus
aagcacttgcatgcaagggcagtca

SEQ ID NO: 51357 - DNA, 25 bp, Mus musculus
aagcacttgccccactgtatatata

SEQ ID NO: 51358 - DNA, 25 bp, Mus musculus
aagcacttgcccgactgtatatata

SEQ ID NO: 51359 - DNA, 25 bp, Mus musculus
aagcacttgcctactgagaatctag

SEQ ID NO: 51360 - DNA, 25 bp, Mus musculus
aagcacttgcctccaagccaaatgg

SEQ ID NO: 51361 - DNA, 25 bp, Mus musculus
aagcacttgcctgcaagccaaatgg

SEQ ID NO: 51362 - DNA, 25 bp, Mus musculus
aagcacttgccttctgagaatctag

SEQ ID NO: 51363 - DNA, 25 bp, Mus musculus
aagcacttgcgaaggacttttgttc

SEQ ID NO: 51364 - DNA, 25 bp, Mus musculus
aagcacttgcgatggacttttgttc

SEQ ID NO: 51365 - DNA, 25 bp, Mus musculus
aagcacttgcttacagatcccttga

SEQ ID NO: 51366 - DNA, 25 bp, Mus musculus
aagcacttgctttcagatcccttga

SEQ ID NO: 51367 - DNA, 25 bp, Mus musculus
aagcacttgtaactgcaccttgtta

SEQ ID NO: 51368 - DNA, 25 bp, Mus musculus
aagcacttgtaagtgcaccttgtta

SEQ ID NO: 51369 - DNA, 25 bp, Mus musculus
aagcactttatccagaatgtcttca

SEQ ID NO: 51370 - DNA, 25 bp, Mus musculus
aagcactttatcgagaatgtcttca

SEQ ID NO: 51371 - DNA, 25 bp, Mus musculus
aagcactttgctatactacagggta

SEQ ID NO: 51372 - DNA, 25 bp, Mus musculus
aagcactttgctttactacagggta

SEQ ID NO: 51373 - DNA, 25 bp, Mus musculus
aagcactttggaacccgactgagta

SEQ ID NO: 51374 - DNA, 25 bp, Mus musculus
aagcactttggatcccgactgagta

SEQ ID NO: 51375 - DNA, 25 bp, Mus musculus
aagcactttgtcatttgttgaaccc

SEQ ID NO: 51376 - DNA, 25 bp, Mus musculus
aagcactttgtcttttgttgaaccc

SEQ ID NO: 51377 - DNA, 25 bp, Mus musculus
aagcacttttatacattgcggtaga

SEQ ID NO: 51378 - DNA, 25 bp, Mus musculus
aagcacttttattcattgcggtaga

SEQ ID NO: 51379 - DNA, 25 bp, Mus musculus
aagcacttttccaaggtctgtgtta

SEQ ID NO: 51380 - DNA, 25 bp, Mus musculus
aagcacttttccatccctggcggga

SEQ ID NO: 51381 - DNA, 25 bp, Mus musculus
aagcacttttcctaggtctgtgtta

SEQ ID NO: 51382 - DNA, 25 bp, Mus musculus
aagcacttttccttccctggcggga

SEQ ID NO: 51383 - DNA, 25 bp, Mus musculus
aagcagaaaggcagtctggccggcc

SEQ ID NO: 51384 - DNA, 25 bp, Mus musculus
aagcagaaaggctgtctggccggcc

SEQ ID NO: 51385 - DNA, 25 bp, Mus musculus
aagcagaaatgcatctgggacaaac

SEQ ID NO: 51386 - DNA, 25 bp, Mus musculus
aagcagaaatgcttctgggacaaac

SEQ ID NO: 51387 - DNA, 25 bp, Mus musculus
aagcagaactcaagccagcttttca

SEQ ID NO: 51388 - DNA, 25 bp, Mus musculus
aagcagaactcatgccagcttttca

SEQ ID NO: 51389 - DNA, 25 bp, Mus musculus
aagcagaactgtatggcttgatttt

SEQ ID NO: 51390 - DNA, 25 bp, Mus musculus
aagcagaactgtttggcttgatttt

SEQ ID NO: 51391 - DNA, 25 bp, Mus musculus
aagcagaaggctagtctattggtga

SEQ ID NO: 51392 - DNA, 25 bp, Mus musculus
aagcagaaggcttgtctattggtga

SEQ ID NO: 51393 - DNA, 25 bp, Mus musculus
aagcagaagtctagccgtgggctga

SEQ ID NO: 51394 - DNA, 25 bp, Mus musculus
aagcagaagtctccggcaacagatt

SEQ ID NO: 51395 - DNA, 25 bp, Mus musculus
aagcagaagtctgcggcaacagatt

SEQ ID NO: 51396 - DNA, 25 bp, Mus musculus
aagcagaagtcttgccgtgggctga

SEQ ID NO: 51397 - DNA, 25 bp, Mus musculus
aagcagaagtgcctgcgtctgtcca

SEQ ID NO: 51398 - DNA, 25 bp, Mus musculus
aagcagaagtgcgtgcgtctgtcca

SEQ ID NO: 51399 - DNA, 25 bp, Mus musculus
aagcagaatcacagcttggtctctg

SEQ ID NO: 51400 - DNA, 25 bp, Mus musculus
aagcagaatcactgcttggtctctg

SEQ ID NO: 51401 - DNA, 25 bp, Mus musculus
aagcagacaagtcttctgggtcctc

SEQ ID NO: 51402 - DNA, 25 bp, Mus musculus
aagcagacaagtgttctgggtcctc

SEQ ID NO: 51403 - DNA, 25 bp, Mus musculus
aagcagacagatctgccacgcgtcg

SEQ ID NO: 51404 - DNA, 25 bp, Mus musculus
aagcagacagatgtgccacgcgtcg

SEQ ID NO: 51405 - DNA, 25 bp, Mus musculus
aagcagacagctcgactttgggcac

SEQ ID NO: 51406 - DNA, 25 bp, Mus musculus
aagcagacagctggactttgggcac

SEQ ID NO: 51407 - DNA, 25 bp, Mus musculus
aagcagacagtcactagtcctttgt

SEQ ID NO: 51408 - DNA, 25 bp, Mus musculus
aagcagacagtctctagtcctttgt

SEQ ID NO: 51409 - DNA, 25 bp, Mus musculus
aagcagacagtgaaaggccgacata

SEQ ID NO: 51410 - DNA, 25 bp, Mus musculus
aagcagacagtgacagtaccaccag

SEQ ID NO: 51411 - DNA, 25 bp, Mus musculus
aagcagacagtgtaaggccgacata

SEQ ID NO: 51412 - DNA, 25 bp, Mus musculus
aagcagacagtgtcagtaccaccag

SEQ ID NO: 51413 - DNA, 25 bp, Mus musculus
aagcagacatctcgtacatgaagtt

SEQ ID NO: 51414 - DNA, 25 bp, Mus musculus
aagcagacatctggtacatgaagtt

SEQ ID NO: 51415 - DNA, 25 bp, Mus musculus
aagcagacatttacttcacatcacc

SEQ ID NO: 51416 - DNA, 25 bp, Mus musculus
aagcagacattttcttcacatcacc

SEQ ID NO: 51417 - DNA, 25 bp, Mus musculus
aagcagaccatccactactatgaac

SEQ ID NO: 51418 - DNA, 25 bp, Mus musculus
aagcagaccatcgactactatgaac

SEQ ID NO: 51419 - DNA, 25 bp, Mus musculus
aagcagaccatgacttgggcctcat

SEQ ID NO: 51420 - DNA, 25 bp, Mus musculus
aagcagaccatgtcttgggcctcat

SEQ ID NO: 51421 - DNA, 25 bp, Mus musculus
aagcagaccctgagatgagaattta

SEQ ID NO: 51422 - DNA, 25 bp, Mus musculus
aagcagaccctgtgatgagaattta

SEQ ID NO: 51423 - DNA, 25 bp, Mus musculus
aagcagaccgccatgattgtagaca

SEQ ID NO: 51424 - DNA, 25 bp, Mus musculus
aagcagaccgccttgattgtagaca

SEQ ID NO: 51425 - DNA, 25 bp, Mus musculus
aagcagaccgggactggtacatgat

SEQ ID NO: 51426 - DNA, 25 bp, Mus musculus
aagcagaccgggtctggtacatgat

SEQ ID NO: 51427 - DNA, 25 bp, Mus musculus
aagcagaccgtcaatgccaagtcct

SEQ ID NO: 51428 - DNA, 25 bp, Mus musculus
aagcagaccgtctatgccaagtcct

SEQ ID NO: 51429 - DNA, 25 bp, Mus musculus
aagcagacgttcatgcagcgagtca

SEQ ID NO: 51430 - DNA, 25 bp, Mus musculus
aagcagacgttcttgcagcgagtca

SEQ ID NO: 51431 - DNA, 25 bp, Mus musculus
aagcagactccccaatggcagggtg

SEQ ID NO: 51432 - DNA, 25 bp, Mus musculus
aagcagactcccgaatggcagggtg

SEQ ID NO: 51433 - DNA, 25 bp, Mus musculus
aagcagactgtccatgaacattagg

SEQ ID NO: 51434 - DNA, 25 bp, Mus musculus
aagcagactgtcgatgaacattagg

SEQ ID NO: 51435 - DNA, 25 bp, Mus musculus
aagcagacttgacagcccttatcca

SEQ ID NO: 51436 - DNA, 25 bp, Mus musculus
aagcagacttgagagcccttatcca

SEQ ID NO: 51437 - DNA, 25 bp, Mus musculus
aagcagactttgaccatgcatgcct

SEQ ID NO: 51438 - DNA, 25 bp, Mus musculus
aagcagactttgtccatgcatgcct

SEQ ID NO: 51439 - DNA, 25 bp, Mus musculus
aagcagagacaaagaacacgcccct

SEQ ID NO: 51440 - DNA, 25 bp, Mus musculus
aagcagagacaatgaacacgcccct

SEQ ID NO: 51441 - DNA, 25 bp, Mus musculus
aagcagagactacgccctggcaggc

SEQ ID NO: 51442 - DNA, 25 bp, Mus musculus
aagcagagactaggccctggcaggc

SEQ ID NO: 51443 - DNA, 25 bp, Mus musculus
aagcagagacttaacagcctggcat

SEQ ID NO: 51444 - DNA, 25 bp, Mus musculus
aagcagagactttacagcctggcat

SEQ ID NO: 51445 - DNA, 25 bp, Mus musculus
aagcagagagcacccttggtgcctg

SEQ ID NO: 51446 - DNA, 25 bp, Mus musculus
aagcagagagcagccttggtgcctg

SEQ ID NO: 51447 - DNA, 25 bp, Mus musculus
aagcagagatcaccaagaagttccg

SEQ ID NO: 51448 - DNA, 25 bp, Mus musculus
aagcagagatcagcaagaagttccg

SEQ ID NO: 51449 - DNA, 25 bp, Mus musculus
aagcagagcagacccgagatccacg

SEQ ID NO: 51450 - DNA, 25 bp, Mus musculus
aagcagagcagagccgagatccacg

SEQ ID NO: 51451 - DNA, 25 bp, Mus musculus
aagcagagccacattgggtcacttc

SEQ ID NO: 51452 - DNA, 25 bp, Mus musculus
aagcagagccactttgggtcacttc

SEQ ID NO: 51453 - DNA, 25 bp, Mus musculus
aagcagagccatataagccctttta

SEQ ID NO: 51454 - DNA, 25 bp, Mus musculus
aagcagagccatttaagccctttta

SEQ ID NO: 51455 - DNA, 25 bp, Mus musculus
aagcagagcctcagagaacccagct

SEQ ID NO: 51456 - DNA, 25 bp, Mus musculus
aagcagagcctcatgagagccgcta

SEQ ID NO: 51457 - DNA, 25 bp, Mus musculus
aagcagagcctctgagaacccagct

SEQ ID NO: 51458 - DNA, 25 bp, Mus musculus
aagcagagcctcttgagagccgcta

SEQ ID NO: 51459 - DNA, 25 bp, Mus musculus
aagcagagcgacacggttaagggaa

SEQ ID NO: 51460 - DNA, 25 bp, Mus musculus
aagcagagcgactcggttaagggaa

SEQ ID NO: 51461 - DNA, 25 bp, Mus musculus
aagcagagctcccagcgtggcatga

SEQ ID NO: 51462 - DNA, 25 bp, Mus musculus
aagcagagctccgagcgtggcatga

SEQ ID NO: 51463 - DNA, 25 bp, Mus musculus
aagcagagctctagattgacagaac

SEQ ID NO: 51464 - DNA, 25 bp, Mus musculus
aagcagagctcttgattgacagaac

SEQ ID NO: 51465 - DNA, 25 bp, Mus musculus
aagcagaggactcgacggcagccct

SEQ ID NO: 51466 - DNA, 25 bp, Mus musculus
aagcagaggactggacggcagccct

SEQ ID NO: 51467 - DNA, 25 bp, Mus musculus
aagcagaggctactgctgttcaaga

SEQ ID NO: 51468 - DNA, 25 bp, Mus musculus
aagcagaggctagtgctgttcaaga

SEQ ID NO: 51469 - DNA, 25 bp, Mus musculus
aagcagaggtctcctctgcagctgc

SEQ ID NO: 51470 - DNA, 25 bp, Mus musculus
aagcagaggtctgctctgcagctgc

SEQ ID NO: 51471 - DNA, 25 bp, Mus musculus
aagcagaggtggctgcactcctact

SEQ ID NO: 51472 - DNA, 25 bp, Mus musculus
aagcagaggtgggtgcactcctact

SEQ ID NO: 51473 - DNA, 25 bp, Mus musculus
aagcagagtccgagttcgcggcgca

SEQ ID NO: 51474 - DNA, 25 bp, Mus musculus
aagcagagtccgtgttcgcggcgca

SEQ ID NO: 51475 - DNA, 25 bp, Mus musculus
aagcagagtctcagacttccgccaa

SEQ ID NO: 51476 - DNA, 25 bp, Mus musculus
aagcagagtctctgacttccgccaa

SEQ ID NO: 51477 - DNA, 25 bp, Mus musculus
aagcagatcactctcgccatcaacg

SEQ ID NO: 51478 - DNA, 25 bp, Mus musculus
aagcagatcactgtcgccatcaacg

SEQ ID NO: 51479 - DNA, 25 bp, Mus musculus
aagcagatccatcagtggcaggcat

SEQ ID NO: 51480 - DNA, 25 bp, Mus musculus
aagcagatccatgagtggcaggcat

SEQ ID NO: 51481 - DNA, 25 bp, Mus musculus
aagcagatcttgaggttacggaaac

SEQ ID NO: 51482 - DNA, 25 bp, Mus musculus
aagcagatcttgtggttacggaaac

SEQ ID NO: 51483 - DNA, 25 bp, Mus musculus
aagcagatgatcatcgtgacggaca

SEQ ID NO: 51484 - DNA, 25 bp, Mus musculus
aagcagatgatcttcgtgacggaca

SEQ ID NO: 51485 - DNA, 25 bp, Mus musculus
aagcagatgcacagggatctctgtt

SEQ ID NO: 51486 - DNA, 25 bp, Mus musculus
aagcagatgcacctgacctgggcct

SEQ ID NO: 51487 - DNA, 25 bp, Mus musculus
aagcagatgcacgtgacctgggcct

SEQ ID NO: 51488 - DNA, 25 bp, Mus musculus
aagcagatgcactgggatctctgtt

SEQ ID NO: 51489 - DNA, 25 bp, Mus musculus
aagcagatgccccaaaggtcacatt

SEQ ID NO: 51490 - DNA, 25 bp, Mus musculus
aagcagatgcccgaaaggtcacatt

SEQ ID NO: 51491 - DNA, 25 bp, Mus musculus
aagcagatggctccgaggatccaca

SEQ ID NO: 51492 - DNA, 25 bp, Mus musculus
aagcagatggctgcgaggatccaca

SEQ ID NO: 51493 - DNA, 25 bp, Mus musculus
aagcagattactaccatcagtattg

SEQ ID NO: 51494 - DNA, 25 bp, Mus musculus
aagcagattacttccatcagtattg

SEQ ID NO: 51495 - DNA, 25 bp, Mus musculus
aagcagattcctcacatttcacctc

SEQ ID NO: 51496 - DNA, 25 bp, Mus musculus
aagcagattcctgacatttcacctc

SEQ ID NO: 51497 - DNA, 25 bp, Mus musculus
aagcagattcgtcagtagggttgta

SEQ ID NO: 51498 - DNA, 25 bp, Mus musculus
aagcagattcgtgagtagggttgta

SEQ ID NO: 51499 - DNA, 25 bp, Mus musculus
aagcagcaaacacattgagggttgt

SEQ ID NO: 51500 - DNA, 25 bp, Mus musculus
aagcagcaaacagattgagggttgt

SEQ ID NO: 51501 - DNA, 25 bp, Mus musculus
aagcagcaaattctcaatctcccag

SEQ ID NO: 51502 - DNA, 25 bp, Mus musculus
aagcagcaaattgtcaatctcccag

SEQ ID NO: 51503 - DNA, 25 bp, Mus musculus
aagcagcaacacctgggcgttcatt

SEQ ID NO: 51504 - DNA, 25 bp, Mus musculus
aagcagcaacacgtgggcgttcatt

SEQ ID NO: 51505 - DNA, 25 bp, Mus musculus
aagcagcaacctaacaactgtgcaa

SEQ ID NO: 51506 - DNA, 25 bp, Mus musculus
aagcagcaaccttacaactgtgcaa

SEQ ID NO: 51507 - DNA, 25 bp, Mus musculus
aagcagcaacttatcttcatgtcct

SEQ ID NO: 51508 - DNA, 25 bp, Mus musculus
aagcagcaacttttcttcatgtcct

SEQ ID NO: 51509 - DNA, 25 bp, Mus musculus
aagcagcaagccagcgatggatcct

SEQ ID NO: 51510 - DNA, 25 bp, Mus musculus
aagcagcaagcctgcgatggatcct

SEQ ID NO: 51511 - DNA, 25 bp, Mus musculus
aagcagcaagtaacggacagcgcaa

SEQ ID NO: 51512 - DNA, 25 bp, Mus musculus
aagcagcaagtatcggacagcgcaa

SEQ ID NO: 51513 - DNA, 25 bp, Mus musculus
aagcagcaagtcatcactcatgaag

SEQ ID NO: 51514 - DNA, 25 bp, Mus musculus
aagcagcaagtcttcactcatgaag

SEQ ID NO: 51515 - DNA, 25 bp, Mus musculus
aagcagcaagttccactgctcagag

SEQ ID NO: 51516 - DNA, 25 bp, Mus musculus
aagcagcaagttgcactgctcagag

SEQ ID NO: 51517 - DNA, 25 bp, Mus musculus
aagcagcaattgcatgttcacagta

SEQ ID NO: 51518 - DNA, 25 bp, Mus musculus
aagcagcaattggatgttcacagta

SEQ ID NO: 51519 - DNA, 25 bp, Mus musculus
aagcagcacgccactttcagctatc

SEQ ID NO: 51520 - DNA, 25 bp, Mus musculus
aagcagcacgcctctttcagctatc

SEQ ID NO: 51521 - DNA, 25 bp, Mus musculus
aagcagcacgctcgaggtacagatg

SEQ ID NO: 51522 - DNA, 25 bp, Mus musculus
aagcagcacgctggaggtacagatg

SEQ ID NO: 51523 - DNA, 25 bp, Mus musculus
aagcagcacggccaggccagcattg

SEQ ID NO: 51524 - DNA, 25 bp, Mus musculus
aagcagcacggcgaggccagcattg

SEQ ID NO: 51525 - DNA, 25 bp, Mus musculus
aagcagcactcgacgtttggctatg

SEQ ID NO: 51526 - DNA, 25 bp, Mus musculus
aagcagcactcgtcgtttggctatg

SEQ ID NO: 51527 - DNA, 25 bp, Mus musculus
aagcagcactgaaagcccctgattg

SEQ ID NO: 51528 - DNA, 25 bp, Mus musculus
aagcagcactgatagcccctgattg

SEQ ID NO: 51529 - DNA, 25 bp, Mus musculus
aagcagcagcatcagaccttgcagg

SEQ ID NO: 51530 - DNA, 25 bp, Mus musculus
aagcagcagcatgagaccttgcagg

SEQ ID NO: 51531 - DNA, 25 bp, Mus musculus
aagcagcagcctacggtcgagctac

SEQ ID NO: 51532 - DNA, 25 bp, Mus musculus
aagcagcagccttcggtcgagctac

SEQ ID NO: 51533 - DNA, 25 bp, Mus musculus
aagcagcagctgcttcttctcggaa

SEQ ID NO: 51534 - DNA, 25 bp, Mus musculus
aagcagcagctggttcttctcggaa

SEQ ID NO: 51535 - DNA, 25 bp, Mus musculus
aagcagcagcttatgggcaccggga

SEQ ID NO: 51536 - DNA, 25 bp, Mus musculus
aagcagcagcttttgggcaccggga

SEQ ID NO: 51537 - DNA, 25 bp, Mus musculus
aagcagcaggagacacaggagacac

SEQ ID NO: 51538 - DNA, 25 bp, Mus musculus
aagcagcaggagctctggcttctga

SEQ ID NO: 51539 - DNA, 25 bp, Mus musculus
aagcagcaggaggtctggcttctga

SEQ ID NO: 51540 - DNA, 25 bp, Mus musculus
aagcagcaggagtcacaggagacac

SEQ ID NO: 51541 - DNA, 25 bp, Mus musculus
aagcagcagtagacttcaagattcc

SEQ ID NO: 51542 - DNA, 25 bp, Mus musculus
aagcagcagtagtcttcaagattcc

SEQ ID NO: 51543 - DNA, 25 bp, Mus musculus
aagcagcagtcactgtgaagcccct

SEQ ID NO: 51544 - DNA, 25 bp, Mus musculus
aagcagcagtcagtgtgaagcccct

SEQ ID NO: 51545 - DNA, 25 bp, Mus musculus
aagcagcagtccagggatcacacat

SEQ ID NO: 51546 - DNA, 25 bp, Mus musculus
aagcagcagtcctgggatcacacat

SEQ ID NO: 51547 - DNA, 25 bp, Mus musculus
aagcagcagtgaccctagagcggca

SEQ ID NO: 51548 - DNA, 25 bp, Mus musculus
aagcagcagtgagcctagagcggca

SEQ ID NO: 51549 - DNA, 25 bp, Mus musculus
aagcagcagtgcaaatggcatttgc

SEQ ID NO: 51550 - DNA, 25 bp, Mus musculus
aagcagcagtgctaatggcatttgc

SEQ ID NO: 51551 - DNA, 25 bp, Mus musculus
aagcagcagtgtacaggagttatca

SEQ ID NO: 51552 - DNA, 25 bp, Mus musculus
aagcagcagtgttcaggagttatca

SEQ ID NO: 51553 - DNA, 25 bp, Mus musculus
aagcagcagttaccgtcttccgtgc

SEQ ID NO: 51554 - DNA, 25 bp, Mus musculus
aagcagcagttagcgtcttccgtgc

SEQ ID NO: 51555 - DNA, 25 bp, Mus musculus
aagcagcagtttagtcctcaggagt

SEQ ID NO: 51556 - DNA, 25 bp, Mus musculus
aagcagcagttttgtcctcaggagt

SEQ ID NO: 51557 - DNA, 25 bp, Mus musculus
aagcagcatcatattccttgttcgg

SEQ ID NO: 51558 - DNA, 25 bp, Mus musculus
aagcagcatcatcgtggcagcgtgt

SEQ ID NO: 51559 - DNA, 25 bp, Mus musculus
aagcagcatcatggtggcagcgtgt

SEQ ID NO: 51560 - DNA, 25 bp, Mus musculus
aagcagcatcattttccttgttcgg

SEQ ID NO: 51561 - DNA, 25 bp, Mus musculus
aagcagcatccacggactggctcat

SEQ ID NO: 51562 - DNA, 25 bp, Mus musculus
aagcagcatccagggactggctcat

SEQ ID NO: 51563 - DNA, 25 bp, Mus musculus
aagcagcatgccaccttggaagtga

SEQ ID NO: 51564 - DNA, 25 bp, Mus musculus
aagcagcatgcctccttggaagtga

SEQ ID NO: 51565 - DNA, 25 bp, Mus musculus
aagcagcatggtatgaggtctctct

SEQ ID NO: 51566 - DNA, 25 bp, Mus musculus
aagcagcatggtttgaggtctctct

SEQ ID NO: 51567 - DNA, 25 bp, Mus musculus
aagcagcatgtaatggaggctttcc

SEQ ID NO: 51568 - DNA, 25 bp, Mus musculus
aagcagcatgtattggaggctttcc

SEQ ID NO: 51569 - DNA, 25 bp, Mus musculus
aagcagcattccattactaaaaaca

SEQ ID NO: 51570 - DNA, 25 bp, Mus musculus
aagcagcattcctttactaaaaaca

SEQ ID NO: 51571 - DNA, 25 bp, Mus musculus
aagcagcattgaccttgggcgaaca

SEQ ID NO: 51572 - DNA, 25 bp, Mus musculus
aagcagcattgactgaagacctgca

SEQ ID NO: 51573 - DNA, 25 bp, Mus musculus
aagcagcattgagcttgggcgaaca

SEQ ID NO: 51574 - DNA, 25 bp, Mus musculus
aagcagcattgagtgaagacctgca

SEQ ID NO: 51575 - DNA, 25 bp, Mus musculus
aagcagcatttcaacacatacaagg

SEQ ID NO: 51576 - DNA, 25 bp, Mus musculus
aagcagcatttctacacatacaagg

SEQ ID NO: 51577 - DNA, 25 bp, Mus musculus
aagcagccaaagcagtggtcacaca

SEQ ID NO: 51578 - DNA, 25 bp, Mus musculus
aagcagccaaaggagtggtcacaca

SEQ ID NO: 51579 - DNA, 25 bp, Mus musculus
aagcagccacacattggcccaaata

SEQ ID NO: 51580 - DNA, 25 bp, Mus musculus
aagcagccacactttggcccaaata

SEQ ID NO: 51581 - DNA, 25 bp, Mus musculus
aagcagccacataattgctttgaat

SEQ ID NO: 51582 - DNA, 25 bp, Mus musculus
aagcagccacattattgctttgaat

SEQ ID NO: 51583 - DNA, 25 bp, Mus musculus
aagcagccaccgcatgacagtctta

SEQ ID NO: 51584 - DNA, 25 bp, Mus musculus
aagcagccaccggatgacagtctta

SEQ ID NO: 51585 - DNA, 25 bp, Mus musculus
aagcagccacctattgaccaaaata

SEQ ID NO: 51586 - DNA, 25 bp, Mus musculus
aagcagccaccttttgaccaaaata

SEQ ID NO: 51587 - DNA, 25 bp, Mus musculus
aagcagccactgaaatcatgggcaa

SEQ ID NO: 51588 - DNA, 25 bp, Mus musculus
aagcagccactgtaatcatgggcaa

SEQ ID NO: 51589 - DNA, 25 bp, Mus musculus
aagcagccagcaacatcattttctc

SEQ ID NO: 51590 - DNA, 25 bp, Mus musculus
aagcagccagcaatgcaacagctct

SEQ ID NO: 51591 - DNA, 25 bp, Mus musculus
aagcagccagcatcatcattttctc

SEQ ID NO: 51592 - DNA, 25 bp, Mus musculus
aagcagccagcattgcaacagctct

SEQ ID NO: 51593 - DNA, 25 bp, Mus musculus
aagcagccaggcacccggtgaagat

SEQ ID NO: 51594 - DNA, 25 bp, Mus musculus
aagcagccaggctcccggtgaagat

SEQ ID NO: 51595 - DNA, 25 bp, Mus musculus
aagcagccagttcaggttgaccgtg

SEQ ID NO: 51596 - DNA, 25 bp, Mus musculus
aagcagccagttgaggttgaccgtg

SEQ ID NO: 51597 - DNA, 25 bp, Mus musculus
aagcagccatacagccacttagact

SEQ ID NO: 51598 - DNA, 25 bp, Mus musculus
aagcagccatactgccacttagact

SEQ ID NO: 51599 - DNA, 25 bp, Mus musculus
aagcagccatcccagcgaagactta

SEQ ID NO: 51600 - DNA, 25 bp, Mus musculus
aagcagccatccgagcgaagactta

SEQ ID NO: 51601 - DNA, 25 bp, Mus musculus
aagcagccattaccaagtgtgtgcc

SEQ ID NO: 51602 - DNA, 25 bp, Mus musculus
aagcagccattactggcctgctagt

SEQ ID NO: 51603 - DNA, 25 bp, Mus musculus
aagcagccattagcaagtgtgtgcc

SEQ ID NO: 51604 - DNA, 25 bp, Mus musculus
aagcagccattagtggcctgctagt

SEQ ID NO: 51605 - DNA, 25 bp, Mus musculus
aagcagcccatactagcagattcct

SEQ ID NO: 51606 - DNA, 25 bp, Mus musculus
aagcagcccatagtagcagattcct

SEQ ID NO: 51607 - DNA, 25 bp, Mus musculus
aagcagcccattatctctgcgctgg

SEQ ID NO: 51608 - DNA, 25 bp, Mus musculus
aagcagcccattttctctgcgctgg

SEQ ID NO: 51609 - DNA, 25 bp, Mus musculus
aagcagcccctaaactgggccctat

SEQ ID NO: 51610 - DNA, 25 bp, Mus musculus
aagcagcccctatactgggccctat

SEQ ID NO: 51611 - DNA, 25 bp, Mus musculus
aagcagcccgctcacagagagtgaa

SEQ ID NO: 51612 - DNA, 25 bp, Mus musculus
aagcagcccgctgacagagagtgaa

SEQ ID NO: 51613 - DNA, 25 bp, Mus musculus
aagcagccctagatagcgcctgcct

SEQ ID NO: 51614 - DNA, 25 bp, Mus musculus
aagcagccctagttagcgcctgcct

SEQ ID NO: 51615 - DNA, 25 bp, Mus musculus
aagcagccctataattgtgagtgtg

SEQ ID NO: 51616 - DNA, 25 bp, Mus musculus
aagcagccctattattgtgagtgtg

SEQ ID NO: 51617 - DNA, 25 bp, Mus musculus
aagcagccctggaaggcagtggctc

SEQ ID NO: 51618 - DNA, 25 bp, Mus musculus
aagcagccctggtaggcagtggctc

SEQ ID NO: 51619 - DNA, 25 bp, Mus musculus
aagcagccggtcacatagagccttg

SEQ ID NO: 51620 - DNA, 25 bp, Mus musculus
aagcagccggtctcatagagccttg

SEQ ID NO: 51621 - DNA, 25 bp, Mus musculus
aagcagccgtgtcaccttggcaagg

SEQ ID NO: 51622 - DNA, 25 bp, Mus musculus
aagcagccgtgtgaccttggcaagg

SEQ ID NO: 51623 - DNA, 25 bp, Mus musculus
aagcagcctacaccaaacgtgatgg

SEQ ID NO: 51624 - DNA, 25 bp, Mus musculus
aagcagcctacagcaaacgtgatgg

SEQ ID NO: 51625 - DNA, 25 bp, Mus musculus
aagcagcctcatatggttgcagtga

SEQ ID NO: 51626 - DNA, 25 bp, Mus musculus
aagcagcctcatttggttgcagtga

SEQ ID NO: 51627 - DNA, 25 bp, Mus musculus
aagcagcctctaattgtggcattgt

SEQ ID NO: 51628 - DNA, 25 bp, Mus musculus
aagcagcctctatttgtggcattgt

SEQ ID NO: 51629 - DNA, 25 bp, Mus musculus
aagcagcctctgctggacagtggac

SEQ ID NO: 51630 - DNA, 25 bp, Mus musculus
aagcagcctctggtggacagtggac

SEQ ID NO: 51631 - DNA, 25 bp, Mus musculus
aagcagcctgacctgttcaaggaca

SEQ ID NO: 51632 - DNA, 25 bp, Mus musculus
aagcagcctgacgtgttcaaggaca

SEQ ID NO: 51633 - DNA, 25 bp, Mus musculus
aagcagcctgagagctaggtggcca

SEQ ID NO: 51634 - DNA, 25 bp, Mus musculus
aagcagcctgagtgctaggtggcca

SEQ ID NO: 51635 - DNA, 25 bp, Mus musculus
aagcagcctgcaacagtgtgtgatt

SEQ ID NO: 51636 - DNA, 25 bp, Mus musculus
aagcagcctgcatcagtgtgtgatt

SEQ ID NO: 51637 - DNA, 25 bp, Mus musculus
aagcagcctgcgcagtttatgttgt

SEQ ID NO: 51638 - DNA, 25 bp, Mus musculus
aagcagcctgcgcatattcctaaca

SEQ ID NO: 51639 - DNA, 25 bp, Mus musculus
aagcagcctgcggagtttatgttgt

SEQ ID NO: 51640 - DNA, 25 bp, Mus musculus
aagcagcctgcggatattcctaaca

SEQ ID NO: 51641 - DNA, 25 bp, Mus musculus
aagcagcctgctacatggaaggata

SEQ ID NO: 51642 - DNA, 25 bp, Mus musculus
aagcagcctgcttcatggaaggata

SEQ ID NO: 51643 - DNA, 25 bp, Mus musculus
aagcagcctggaacacaacctgtga

SEQ ID NO: 51644 - DNA, 25 bp, Mus musculus
aagcagcctggatcacaacctgtga

SEQ ID NO: 51645 - DNA, 25 bp, Mus musculus
aagcagcctgttatccctcaaatgg

SEQ ID NO: 51646 - DNA, 25 bp, Mus musculus
aagcagcctgttccagatggaaccc

SEQ ID NO: 51647 - DNA, 25 bp, Mus musculus
aagcagcctgttgcagatggaaccc

SEQ ID NO: 51648 - DNA, 25 bp, Mus musculus
aagcagcctgttttccctcaaatgg

SEQ ID NO: 51649 - DNA, 25 bp, Mus musculus
aagcagccttcacctagccagggtg

SEQ ID NO: 51650 - DNA, 25 bp, Mus musculus
aagcagccttcagctagccagggtg

SEQ ID NO: 51651 - DNA, 25 bp, Mus musculus
aagcagccttggcatctcactggat

SEQ ID NO: 51652 - DNA, 25 bp, Mus musculus
aagcagccttgggatctcactggat

SEQ ID NO: 51653 - DNA, 25 bp, Mus musculus
aagcagccttgtacccagtgtggat

SEQ ID NO: 51654 - DNA, 25 bp, Mus musculus
aagcagccttgttcccagtgtggat

SEQ ID NO: 51655 - DNA, 25 bp, Mus musculus
aagcagcctttgaggaacatacaac

SEQ ID NO: 51656 - DNA, 25 bp, Mus musculus
aagcagcctttgtggaacatacaac

SEQ ID NO: 51657 - DNA, 25 bp, Mus musculus
aagcagcgagagacctcaaaccaaa

SEQ ID NO: 51658 - DNA, 25 bp, Mus musculus
aagcagcgagagtcctcaaaccaaa

SEQ ID NO: 51659 - DNA, 25 bp, Mus musculus
aagcagcgcaggaaagagcgacaaa

SEQ ID NO: 51660 - DNA, 25 bp, Mus musculus
aagcagcgcaggtaagagcgacaaa

SEQ ID NO: 51661 - DNA, 25 bp, Mus musculus
aagcagcgcggtcatttgcattcac

SEQ ID NO: 51662 - DNA, 25 bp, Mus musculus
aagcagcgcggtgatttgcattcac

SEQ ID NO: 51663 - DNA, 25 bp, Mus musculus
aagcagcggcgacacttgatgttca

SEQ ID NO: 51664 - DNA, 25 bp, Mus musculus
aagcagcggcgagacttgatgttca

SEQ ID NO: 51665 - DNA, 25 bp, Mus musculus
aagcagcggctgactcttgggaaac

SEQ ID NO: 51666 - DNA, 25 bp, Mus musculus
aagcagcggctgtctcttgggaaac

SEQ ID NO: 51667 - DNA, 25 bp, Mus musculus
aagcagcgtactagccccagcatta

SEQ ID NO: 51668 - DNA, 25 bp, Mus musculus
aagcagcgtacttgccccagcatta

SEQ ID NO: 51669 - DNA, 25 bp, Mus musculus
aagcagcgtatacctgcttcatctc

SEQ ID NO: 51670 - DNA, 25 bp, Mus musculus
aagcagcgtatagctgcttcatctc

SEQ ID NO: 51671 - DNA, 25 bp, Mus musculus
aagcagcgtctgctggttatgcaga

SEQ ID NO: 51672 - DNA, 25 bp, Mus musculus
aagcagcgtctggtggttatgcaga

SEQ ID NO: 51673 - DNA, 25 bp, Mus musculus
aagcagcgttttatgggtgacaagt

SEQ ID NO: 51674 - DNA, 25 bp, Mus musculus
aagcagcgttttttgggtgacaagt

SEQ ID NO: 51675 - DNA, 25 bp, Mus musculus
aagcagctaaagcacagacctcctg

SEQ ID NO: 51676 - DNA, 25 bp, Mus musculus
aagcagctaaaggacagacctcctg

SEQ ID NO: 51677 - DNA, 25 bp, Mus musculus
aagcagctacggctctgtgtttaag

SEQ ID NO: 51678 - DNA, 25 bp, Mus musculus
aagcagctacgggtctgtgtttaag

SEQ ID NO: 51679 - DNA, 25 bp, Mus musculus
aagcagctactgattacaaggccaa

SEQ ID NO: 51680 - DNA, 25 bp, Mus musculus
aagcagctactgtttacaaggccaa

SEQ ID NO: 51681 - DNA, 25 bp, Mus musculus
aagcagctacttcttttgagctcca

SEQ ID NO: 51682 - DNA, 25 bp, Mus musculus
aagcagctacttgttttgagctcca

SEQ ID NO: 51683 - DNA, 25 bp, Mus musculus
aagcagctagaaccgtgtcccagag

SEQ ID NO: 51684 - DNA, 25 bp, Mus musculus
aagcagctagaagcgtgtcccagag

SEQ ID NO: 51685 - DNA, 25 bp, Mus musculus
aagcagctagaccttggaaagtaga

SEQ ID NO: 51686 - DNA, 25 bp, Mus musculus
aagcagctagacgttggaaagtaga

SEQ ID NO: 51687 - DNA, 25 bp, Mus musculus
aagcagctagataatttcggtttaa

SEQ ID NO: 51688 - DNA, 25 bp, Mus musculus
aagcagctagatctacacacttgta

SEQ ID NO: 51689 - DNA, 25 bp, Mus musculus
aagcagctagatgtacacacttgta

SEQ ID NO: 51690 - DNA, 25 bp, Mus musculus
aagcagctagattatttcggtttaa

SEQ ID NO: 51691 - DNA, 25 bp, Mus musculus
aagcagctagcaacagtgtgtttaa

SEQ ID NO: 51692 - DNA, 25 bp, Mus musculus
aagcagctagcaatttccgttgttc

SEQ ID NO: 51693 - DNA, 25 bp, Mus musculus
aagcagctagcatcagtgtgtttaa

SEQ ID NO: 51694 - DNA, 25 bp, Mus musculus
aagcagctagcattttccgttgttc

SEQ ID NO: 51695 - DNA, 25 bp, Mus musculus
aagcagctatcgcttgcagcagcgg

SEQ ID NO: 51696 - DNA, 25 bp, Mus musculus
aagcagctatcggttgcagcagcgg

SEQ ID NO: 51697 - DNA, 25 bp, Mus musculus
aagcagctcaatatccactccaggg

SEQ ID NO: 51698 - DNA, 25 bp, Mus musculus
aagcagctcaatttccactccaggg

SEQ ID NO: 51699 - DNA, 25 bp, Mus musculus
aagcagctcattaagttattcactt

SEQ ID NO: 51700 - DNA, 25 bp, Mus musculus
aagcagctcatttagttattcactt

SEQ ID NO: 51701 - DNA, 25 bp, Mus musculus
aagcagctccgccaagagcttgcca

SEQ ID NO: 51702 - DNA, 25 bp, Mus musculus
aagcagctccgcgaagagcttgcca

SEQ ID NO: 51703 - DNA, 25 bp, Mus musculus
aagcagctcggtactgtgcagagat

SEQ ID NO: 51704 - DNA, 25 bp, Mus musculus
aagcagctcggttctgtgcagagat

SEQ ID NO: 51705 - DNA, 25 bp, Mus musculus
aagcagctcgtccaccatgattggg

SEQ ID NO: 51706 - DNA, 25 bp, Mus musculus
aagcagctcgtcgaccatgattggg

SEQ ID NO: 51707 - DNA, 25 bp, Mus musculus
aagcagctctgcatgtgaacccttc

SEQ ID NO: 51708 - DNA, 25 bp, Mus musculus
aagcagctctgcttgtgaacccttc

SEQ ID NO: 51709 - DNA, 25 bp, Mus musculus
aagcagctcttcaaggttgccaagg

SEQ ID NO: 51710 - DNA, 25 bp, Mus musculus
aagcagctcttctaggttgccaagg

SEQ ID NO: 51711 - DNA, 25 bp, Mus musculus
aagcagctcttgatgctctggacaa

SEQ ID NO: 51712 - DNA, 25 bp, Mus musculus
aagcagctcttgttgctctggacaa

SEQ ID NO: 51713 - DNA, 25 bp, Mus musculus
aagcagctgagccagaatacataca

SEQ ID NO: 51714 - DNA, 25 bp, Mus musculus
aagcagctgagcgagaatacataca

SEQ ID NO: 51715 - DNA, 25 bp, Mus musculus
aagcagctgatgctgttctaccaca

SEQ ID NO: 51716 - DNA, 25 bp, Mus musculus
aagcagctgatggtgttctaccaca

SEQ ID NO: 51717 - DNA, 25 bp, Mus musculus
aagcagctggcacgacacaggtaag

SEQ ID NO: 51718 - DNA, 25 bp, Mus musculus
aagcagctggcaggacacaggtaag

SEQ ID NO: 51719 - DNA, 25 bp, Mus musculus
aagcagctggccagggtaatgtccc

SEQ ID NO: 51720 - DNA, 25 bp, Mus musculus
aagcagctggcctgggtaatgtccc

SEQ ID NO: 51721 - DNA, 25 bp, Mus musculus
aagcagctggctccgttgaccctgg

SEQ ID NO: 51722 - DNA, 25 bp, Mus musculus
aagcagctggctgcgttgaccctgg

SEQ ID NO: 51723 - DNA, 25 bp, Mus musculus
aagcagctgggccatttctttggca

SEQ ID NO: 51724 - DNA, 25 bp, Mus musculus
aagcagctgggcgatttctttggca

SEQ ID NO: 51725 - DNA, 25 bp, Mus musculus
aagcagctgggtatagtgcttgcct

SEQ ID NO: 51726 - DNA, 25 bp, Mus musculus
aagcagctgggtttagtgcttgcct

SEQ ID NO: 51727 - DNA, 25 bp, Mus musculus
aagcagctgtagagctctagcccat

SEQ ID NO: 51728 - DNA, 25 bp, Mus musculus
aagcagctgtagtgctctagcccat

SEQ ID NO: 51729 - DNA, 25 bp, Mus musculus
aagcagctgtcccagacggccaacg

SEQ ID NO: 51730 - DNA, 25 bp, Mus musculus
aagcagctgtccgagacggccaacg

SEQ ID NO: 51731 - DNA, 25 bp, Mus musculus
aagcagctgtctccatttgctatat

SEQ ID NO: 51732 - DNA, 25 bp, Mus musculus
aagcagctgtctgcatttgctatat

SEQ ID NO: 51733 - DNA, 25 bp, Mus musculus
aagcagctgtggaccacctttaatt

SEQ ID NO: 51734 - DNA, 25 bp, Mus musculus
aagcagctgtggctgttgtcccact

SEQ ID NO: 51735 - DNA, 25 bp, Mus musculus
aagcagctgtgggtgttgtcccact

SEQ ID NO: 51736 - DNA, 25 bp, Mus musculus
aagcagctgtggtccacctttaatt

SEQ ID NO: 51737 - DNA, 25 bp, Mus musculus
aagcagctgtgtcaaatgcatgagt

SEQ ID NO: 51738 - DNA, 25 bp, Mus musculus
aagcagctgtgtgaaatgcatgagt

SEQ ID NO: 51739 - DNA, 25 bp, Mus musculus
aagcagctgttgatctctggcagca

SEQ ID NO: 51740 - DNA, 25 bp, Mus musculus
aagcagctgttgttctctggcagca

SEQ ID NO: 51741 - DNA, 25 bp, Mus musculus
aagcagctgtttcaggcccgagcgc

SEQ ID NO: 51742 - DNA, 25 bp, Mus musculus
aagcagctgtttgaggcccgagcgc

SEQ ID NO: 51743 - DNA, 25 bp, Mus musculus
aagcagcttcctaggtctcatattt

SEQ ID NO: 51744 - DNA, 25 bp, Mus musculus
aagcagcttcctccgcagactggag

SEQ ID NO: 51745 - DNA, 25 bp, Mus musculus
aagcagcttcctgcgcagactggag

SEQ ID NO: 51746 - DNA, 25 bp, Mus musculus
aagcagcttccttggtctcatattt

SEQ ID NO: 51747 - DNA, 25 bp, Mus musculus
aagcagcttcgacagagtttaatca

SEQ ID NO: 51748 - DNA, 25 bp, Mus musculus
aagcagcttcgagagagtttaatca

SEQ ID NO: 51749 - DNA, 25 bp, Mus musculus
aagcagcttctgagagccgcagaca

SEQ ID NO: 51750 - DNA, 25 bp, Mus musculus
aagcagcttctgctttctctgtagc

SEQ ID NO: 51751 - DNA, 25 bp, Mus musculus
aagcagcttctggtttctctgtagc

SEQ ID NO: 51752 - DNA, 25 bp, Mus musculus
aagcagcttctgtgagccgcagaca

SEQ ID NO: 51753 - DNA, 25 bp, Mus musculus
aagcagcttgagacacagtgtgtat

SEQ ID NO: 51754 - DNA, 25 bp, Mus musculus
aagcagcttgagtcacagtgtgtat

SEQ ID NO: 51755 - DNA, 25 bp, Mus musculus
aagcagcttgcgcaaggtagcctcc

SEQ ID NO: 51756 - DNA, 25 bp, Mus musculus
aagcagcttgcggaaggtagcctcc

SEQ ID NO: 51757 - DNA, 25 bp, Mus musculus
aagcagcttgctacttacctgtttg

SEQ ID NO: 51758 - DNA, 25 bp, Mus musculus
aagcagcttgcttcttacctgtttg

SEQ ID NO: 51759 - DNA, 25 bp, Mus musculus
aagcagctttagatcattgagtttt

SEQ ID NO: 51760 - DNA, 25 bp, Mus musculus
aagcagctttagttcattgagtttt

SEQ ID NO: 51761 - DNA, 25 bp, Mus musculus
aagcagcttttacctgaagcagggt

SEQ ID NO: 51762 - DNA, 25 bp, Mus musculus
aagcagcttttagctgaagcagggt

SEQ ID NO: 51763 - DNA, 25 bp, Mus musculus
aagcagcttttcatgccgaaattgg

SEQ ID NO: 51764 - DNA, 25 bp, Mus musculus
aagcagcttttcttgccgaaattgg

SEQ ID NO: 51765 - DNA, 25 bp, Mus musculus
aagcaggaaactacattcttctctt

SEQ ID NO: 51766 - DNA, 25 bp, Mus musculus
aagcaggaaacttcattcttctctt

SEQ ID NO: 51767 - DNA, 25 bp, Mus musculus
aagcaggaaagtcctgtcccgccat

SEQ ID NO: 51768 - DNA, 25 bp, Mus musculus
aagcaggaaagtgctgtcccgccat

SEQ ID NO: 51769 - DNA, 25 bp, Mus musculus
aagcaggaagctactgagagtaaat

SEQ ID NO: 51770 - DNA, 25 bp, Mus musculus
aagcaggaagcttctgagagtaaat

SEQ ID NO: 51771 - DNA, 25 bp, Mus musculus
aagcaggaagtccttggccagtgct

SEQ ID NO: 51772 - DNA, 25 bp, Mus musculus
aagcaggaagtcgttggccagtgct

SEQ ID NO: 51773 - DNA, 25 bp, Mus musculus
aagcaggaatcaaaaatggcccaag

SEQ ID NO: 51774 - DNA, 25 bp, Mus musculus
aagcaggaatcataaatggcccaag

SEQ ID NO: 51775 - DNA, 25 bp, Mus musculus
aagcaggaatccacctcagaatcga

SEQ ID NO: 51776 - DNA, 25 bp, Mus musculus
aagcaggaatcctcctcagaatcga

SEQ ID NO: 51777 - DNA, 25 bp, Mus musculus
aagcaggaatgacgcacatccacaa

SEQ ID NO: 51778 - DNA, 25 bp, Mus musculus
aagcaggaatgaggcacatccacaa

SEQ ID NO: 51779 - DNA, 25 bp, Mus musculus
aagcaggacaggattcacccgggcc

SEQ ID NO: 51780 - DNA, 25 bp, Mus musculus
aagcaggacaggtttcacccgggcc

SEQ ID NO: 51781 - DNA, 25 bp, Mus musculus
aagcaggacattatggctccttggc

SEQ ID NO: 51782 - DNA, 25 bp, Mus musculus
aagcaggacattttggctccttggc

SEQ ID NO: 51783 - DNA, 25 bp, Mus musculus
aagcaggaccagaaagggaccttca

SEQ ID NO: 51784 - DNA, 25 bp, Mus musculus
aagcaggaccagtaagggaccttca

SEQ ID NO: 51785 - DNA, 25 bp, Mus musculus
aagcaggaccgcatctcctgtgctc

SEQ ID NO: 51786 - DNA, 25 bp, Mus musculus
aagcaggaccgcttctcctgtgctc

SEQ ID NO: 51787 - DNA, 25 bp, Mus musculus
aagcaggacgacatgtgggagcaca

SEQ ID NO: 51788 - DNA, 25 bp, Mus musculus
aagcaggacgacttgtgggagcaca

SEQ ID NO: 51789 - DNA, 25 bp, Mus musculus
aagcaggacgggaccaagcatcacc

SEQ ID NO: 51790 - DNA, 25 bp, Mus musculus
aagcaggacgggtccaagcatcacc

SEQ ID NO: 51791 - DNA, 25 bp, Mus musculus
aagcaggactccatctactatgaac

SEQ ID NO: 51792 - DNA, 25 bp, Mus musculus
aagcaggactccttctactatgaac

SEQ ID NO: 51793 - DNA, 25 bp, Mus musculus
aagcaggactgaaggctagccccag

SEQ ID NO: 51794 - DNA, 25 bp, Mus musculus
aagcaggactgatggctagccccag

SEQ ID NO: 51795 - DNA, 25 bp, Mus musculus
aagcaggagcgcagctcagacctgt

SEQ ID NO: 51796 - DNA, 25 bp, Mus musculus
aagcaggagcgctgctcagacctgt

SEQ ID NO: 51797 - DNA, 25 bp, Mus musculus
aagcaggagctaaccctgggctagt

SEQ ID NO: 51798 - DNA, 25 bp, Mus musculus
aagcaggagctatccctgggctagt

SEQ ID NO: 51799 - DNA, 25 bp, Mus musculus
aagcaggaggataccagtcttcaca

SEQ ID NO: 51800 - DNA, 25 bp, Mus musculus
aagcaggaggattccagtcttcaca

SEQ ID NO: 51801 - DNA, 25 bp, Mus musculus
aagcaggatcctataaagtctttgt

SEQ ID NO: 51802 - DNA, 25 bp, Mus musculus
aagcaggatcctttaaagtctttgt

SEQ ID NO: 51803 - DNA, 25 bp, Mus musculus
aagcaggatcgactgagcccttcag

SEQ ID NO: 51804 - DNA, 25 bp, Mus musculus
aagcaggatcgagtgagcccttcag

SEQ ID NO: 51805 - DNA, 25 bp, Mus musculus
aagcaggattagaccgttgcatgca

SEQ ID NO: 51806 - DNA, 25 bp, Mus musculus
aagcaggattagtccgttgcatgca

SEQ ID NO: 51807 - DNA, 25 bp, Mus musculus
aagcaggattctactactggctcct

SEQ ID NO: 51808 - DNA, 25 bp, Mus musculus
aagcaggattcttctactggctcct

SEQ ID NO: 51809 - DNA, 25 bp, Mus musculus
aagcaggcaactcttctcaaaggta

SEQ ID NO: 51810 - DNA, 25 bp, Mus musculus
aagcaggcaactgttctcaaaggta

SEQ ID NO: 51811 - DNA, 25 bp, Mus musculus
aagcaggcaccaccatctgagactt

SEQ ID NO: 51812 - DNA, 25 bp, Mus musculus
aagcaggcaccagcatctgagactt

SEQ ID NO: 51813 - DNA, 25 bp, Mus musculus
aagcaggcactccttaacaatcaag

SEQ ID NO: 51814 - DNA, 25 bp, Mus musculus
aagcaggcactcgttaacaatcaag

SEQ ID NO: 51815 - DNA, 25 bp, Mus musculus
aagcaggcagagagcgaacttcctc

SEQ ID NO: 51816 - DNA, 25 bp, Mus musculus
aagcaggcagagtgcgaacttcctc

SEQ ID NO: 51817 - DNA, 25 bp, Mus musculus
aagcaggccccaaaaaccgggagat

SEQ ID NO: 51818 - DNA, 25 bp, Mus musculus
aagcaggccccataaaccgggagat

SEQ ID NO: 51819 - DNA, 25 bp, Mus musculus
aagcaggcccctcagtggaggatcc

SEQ ID NO: 51820 - DNA, 25 bp, Mus musculus
aagcaggcccctgagtggaggatcc

SEQ ID NO: 51821 - DNA, 25 bp, Mus musculus
aagcaggccgagagcgagtatcact

SEQ ID NO: 51822 - DNA, 25 bp, Mus musculus
aagcaggccgagtgcgagtatcact

SEQ ID NO: 51823 - DNA, 25 bp, Mus musculus
aagcaggcctgtctctgtactagtc

SEQ ID NO: 51824 - DNA, 25 bp, Mus musculus
aagcaggcctgtgtctgtactagtc

SEQ ID NO: 51825 - DNA, 25 bp, Mus musculus
aagcaggccttgcatgtgtcctaga

SEQ ID NO: 51826 - DNA, 25 bp, Mus musculus
aagcaggccttggatgtgtcctaga

SEQ ID NO: 51827 - DNA, 25 bp, Mus musculus
aagcaggcgaccaatggcgatgctg

SEQ ID NO: 51828 - DNA, 25 bp, Mus musculus
aagcaggcgacctatggcgatgctg

SEQ ID NO: 51829 - DNA, 25 bp, Mus musculus
aagcaggcgctacggatataaatta

SEQ ID NO: 51830 - DNA, 25 bp, Mus musculus
aagcaggcgctagggatataaatta

SEQ ID NO: 51831 - DNA, 25 bp, Mus musculus
aagcaggcggcaatgtgattgacac

SEQ ID NO: 51832 - DNA, 25 bp, Mus musculus
aagcaggcggcattgtgattgacac

SEQ ID NO: 51833 - DNA, 25 bp, Mus musculus
aagcaggctcaacacctgtgcctca

SEQ ID NO: 51834 - DNA, 25 bp, Mus musculus
aagcaggctcaacctgggtccaggt

SEQ ID NO: 51835 - DNA, 25 bp, Mus musculus
aagcaggctcaagacctgtgcctca

SEQ ID NO: 51836 - DNA, 25 bp, Mus musculus
aagcaggctcaagctgggtccaggt

SEQ ID NO: 51837 - DNA, 25 bp, Mus musculus
aagcaggctcacagtttttcaacag

SEQ ID NO: 51838 - DNA, 25 bp, Mus musculus
aagcaggctcactgtttttcaacag

SEQ ID NO: 51839 - DNA, 25 bp, Mus musculus
aagcaggctctgatcaccaggagga

SEQ ID NO: 51840 - DNA, 25 bp, Mus musculus
aagcaggctctgttcaccaggagga

SEQ ID NO: 51841 - DNA, 25 bp, Mus musculus
aagcaggctgagacactctgttttc

SEQ ID NO: 51842 - DNA, 25 bp, Mus musculus
aagcaggctgagtcactctgttttc

SEQ ID NO: 51843 - DNA, 25 bp, Mus musculus
aagcaggcttagattccatcgtctc

SEQ ID NO: 51844 - DNA, 25 bp, Mus musculus
aagcaggcttagtttccatcgtctc

SEQ ID NO: 51845 - DNA, 25 bp, Mus musculus
aagcaggcttcaactttgtggtcag

SEQ ID NO: 51846 - DNA, 25 bp, Mus musculus
aagcaggcttcactgtatgggatct

SEQ ID NO: 51847 - DNA, 25 bp, Mus musculus
aagcaggcttcagtgtatgggatct

SEQ ID NO: 51848 - DNA, 25 bp, Mus musculus
aagcaggcttcatctttgtggtcag

SEQ ID NO: 51849 - DNA, 25 bp, Mus musculus
aagcaggcttgtacacagtcagaca

SEQ ID NO: 51850 - DNA, 25 bp, Mus musculus
aagcaggcttgttcacagtcagaca

SEQ ID NO: 51851 - DNA, 25 bp, Mus musculus
aagcagggaaggcattacctctcta

SEQ ID NO: 51852 - DNA, 25 bp, Mus musculus
aagcagggaagggattacctctcta

SEQ ID NO: 51853 - DNA, 25 bp, Mus musculus
aagcagggacagcacagccagtttc

SEQ ID NO: 51854 - DNA, 25 bp, Mus musculus
aagcagggacaggacagccagtttc

SEQ ID NO: 51855 - DNA, 25 bp, Mus musculus
aagcagggcagtcccacagaagact

SEQ ID NO: 51856 - DNA, 25 bp, Mus musculus
aagcagggcagtgccacagaagact

SEQ ID NO: 51857 - DNA, 25 bp, Mus musculus
aagcagggccagacaagcccagatg

SEQ ID NO: 51858 - DNA, 25 bp, Mus musculus
aagcagggccagtcaagcccagatg

SEQ ID NO: 51859 - DNA, 25 bp, Mus musculus
aagcagggccctaccggtgcagtgc

SEQ ID NO: 51860 - DNA, 25 bp, Mus musculus
aagcagggcccttccggtgcagtgc

SEQ ID NO: 51861 - DNA, 25 bp, Mus musculus
aagcagggcctgatgtaggtacact

SEQ ID NO: 51862 - DNA, 25 bp, Mus musculus
aagcagggcctgttgtaggtacact

SEQ ID NO: 51863 - DNA, 25 bp, Mus musculus
aagcagggctgcagacccagtgaag

SEQ ID NO: 51864 - DNA, 25 bp, Mus musculus
aagcagggctgctgacccagtgaag

SEQ ID NO: 51865 - DNA, 25 bp, Mus musculus
aagcagggcttgagcatttgtcact

SEQ ID NO: 51866 - DNA, 25 bp, Mus musculus
aagcagggcttgattttgataccag

SEQ ID NO: 51867 - DNA, 25 bp, Mus musculus
aagcagggcttgtgcatttgtcact

SEQ ID NO: 51868 - DNA, 25 bp, Mus musculus
aagcagggcttgtttttgataccag

SEQ ID NO: 51869 - DNA, 25 bp, Mus musculus
aagcagggtaaaactttcctggcaa

SEQ ID NO: 51870 - DNA, 25 bp, Mus musculus
aagcagggtaaatctttcctggcaa

SEQ ID NO: 51871 - DNA, 25 bp, Mus musculus
aagcagggtctacaagcctcgcggc

SEQ ID NO: 51872 - DNA, 25 bp, Mus musculus
aagcagggtctagaagcctcgcggc

SEQ ID NO: 51873 - DNA, 25 bp, Mus musculus
aagcagggtgaaactttcccctttg

SEQ ID NO: 51874 - DNA, 25 bp, Mus musculus
aagcagggtgaatctttcccctttg

SEQ ID NO: 51875 - DNA, 25 bp, Mus musculus
aagcagggtgctaactttctcagag

SEQ ID NO: 51876 - DNA, 25 bp, Mus musculus
aagcagggtgcttactttctcagag

SEQ ID NO: 51877 - DNA, 25 bp, Mus musculus
aagcaggtacaaattccgtgatagt

SEQ ID NO: 51878 - DNA, 25 bp, Mus musculus
aagcaggtacaatttccgtgatagt

SEQ ID NO: 51879 - DNA, 25 bp, Mus musculus
aagcaggtactaaggttaagcagtg

SEQ ID NO: 51880 - DNA, 25 bp, Mus musculus
aagcaggtactatggttaagcagtg

SEQ ID NO: 51881 - DNA, 25 bp, Mus musculus
aagcaggtagctctctttccatgca

SEQ ID NO: 51882 - DNA, 25 bp, Mus musculus
aagcaggtagctgtctttccatgca

SEQ ID NO: 51883 - DNA, 25 bp, Mus musculus
aagcaggtccttccagctgtctagg

SEQ ID NO: 51884 - DNA, 25 bp, Mus musculus
aagcaggtccttgcagctgtctagg

SEQ ID NO: 51885 - DNA, 25 bp, Mus musculus
aagcaggtctcgcagtcacagtgaa

SEQ ID NO: 51886 - DNA, 25 bp, Mus musculus
aagcaggtctcggagtcacagtgaa

SEQ ID NO: 51887 - DNA, 25 bp, Mus musculus
aagcaggtctgtactgttagatgaa

SEQ ID NO: 51888 - DNA, 25 bp, Mus musculus
aagcaggtctgttctgttagatgaa

SEQ ID NO: 51889 - DNA, 25 bp, Mus musculus
aagcaggtcttcagtcaggttgttc

SEQ ID NO: 51890 - DNA, 25 bp, Mus musculus
aagcaggtcttctgtcaggttgttc

SEQ ID NO: 51891 - DNA, 25 bp, Mus musculus
aagcaggtctttcagtttgcagtca

SEQ ID NO: 51892 - DNA, 25 bp, Mus musculus
aagcaggtctttgagtttgcagtca

SEQ ID NO: 51893 - DNA, 25 bp, Mus musculus
aagcaggtgcacatggcttgtgcct

SEQ ID NO: 51894 - DNA, 25 bp, Mus musculus
aagcaggtgcacttggcttgtgcct

SEQ ID NO: 51895 - DNA, 25 bp, Mus musculus
aagcaggtgcatctctttgagttta

SEQ ID NO: 51896 - DNA, 25 bp, Mus musculus
aagcaggtgcatgtctttgagttta

SEQ ID NO: 51897 - DNA, 25 bp, Mus musculus
aagcaggtgcttccccaagagtcag

SEQ ID NO: 51898 - DNA, 25 bp, Mus musculus
aagcaggtgcttcctctagcaggtc

SEQ ID NO: 51899 - DNA, 25 bp, Mus musculus
aagcaggtgcttgcccaagagtcag

SEQ ID NO: 51900 - DNA, 25 bp, Mus musculus
aagcaggtgcttgctctagcaggtc

SEQ ID NO: 51901 - DNA, 25 bp, Mus musculus
aagcaggtgtaccttgggacttact

SEQ ID NO: 51902 - DNA, 25 bp, Mus musculus
aagcaggtgtacgttgggacttact

SEQ ID NO: 51903 - DNA, 25 bp, Mus musculus
aagcaggtgtctagttcccagggag

SEQ ID NO: 51904 - DNA, 25 bp, Mus musculus
aagcaggtgtcttgttcccagggag

SEQ ID NO: 51905 - DNA, 25 bp, Mus musculus
aagcaggttagactgttattggaca

SEQ ID NO: 51906 - DNA, 25 bp, Mus musculus
aagcaggttagagtgttattggaca

SEQ ID NO: 51907 - DNA, 25 bp, Mus musculus
aagcaggttgcgacctatccagtgg

SEQ ID NO: 51908 - DNA, 25 bp, Mus musculus
aagcaggttgcgtcctatccagtgg

SEQ ID NO: 51909 - DNA, 25 bp, Mus musculus
aagcaggtttcactcactcaggctg

SEQ ID NO: 51910 - DNA, 25 bp, Mus musculus
aagcaggtttcagtcactcaggctg

SEQ ID NO: 51911 - DNA, 25 bp, Mus musculus
aagcagtaacgtctttccagctgtc

SEQ ID NO: 51912 - DNA, 25 bp, Mus musculus
aagcagtaacgtgtttccagctgtc

SEQ ID NO: 51913 - DNA, 25 bp, Mus musculus
aagcagtaagttcatctctgttcct

SEQ ID NO: 51914 - DNA, 25 bp, Mus musculus
aagcagtaagttgatctctgttcct

SEQ ID NO: 51915 - DNA, 25 bp, Mus musculus
aagcagtaataaactcccagatcct

SEQ ID NO: 51916 - DNA, 25 bp, Mus musculus
aagcagtaataatctcccagatcct

SEQ ID NO: 51917 - DNA, 25 bp, Mus musculus
aagcagtacctaagacctcagactc

SEQ ID NO: 51918 - DNA, 25 bp, Mus musculus
aagcagtacctatgacctcagactc

SEQ ID NO: 51919 - DNA, 25 bp, Mus musculus
aagcagtacctcaattaccatgacc

SEQ ID NO: 51920 - DNA, 25 bp, Mus musculus
aagcagtacctctattaccatgacc

SEQ ID NO: 51921 - DNA, 25 bp, Mus musculus
aagcagtagcatcccatttgtacca

SEQ ID NO: 51922 - DNA, 25 bp, Mus musculus
aagcagtagcatgccatttgtacca

SEQ ID NO: 51923 - DNA, 25 bp, Mus musculus
aagcagtagccacaaatgaggtcct

SEQ ID NO: 51924 - DNA, 25 bp, Mus musculus
aagcagtagccagaaatgaggtcct

SEQ ID NO: 51925 - DNA, 25 bp, Mus musculus
aagcagtagtaaaaagccggacagt

SEQ ID NO: 51926 - DNA, 25 bp, Mus musculus
aagcagtagtaataagccggacagt

SEQ ID NO: 51927 - DNA, 25 bp, Mus musculus
aagcagtatgtacattctgaggcaa

SEQ ID NO: 51928 - DNA, 25 bp, Mus musculus
aagcagtatgtagattctgaggcaa

SEQ ID NO: 51929 - DNA, 25 bp, Mus musculus
aagcagtatttaaagccatatcaac

SEQ ID NO: 51930 - DNA, 25 bp, Mus musculus
aagcagtatttatagccatatcaac

SEQ ID NO: 51931 - DNA, 25 bp, Mus musculus
aagcagtcactccttggacatctga

SEQ ID NO: 51932 - DNA, 25 bp, Mus musculus
aagcagtcactcgttggacatctga

SEQ ID NO: 51933 - DNA, 25 bp, Mus musculus
aagcagtcagcccagaaaacatgca

SEQ ID NO: 51934 - DNA, 25 bp, Mus musculus
aagcagtcagccgagaaaacatgca

SEQ ID NO: 51935 - DNA, 25 bp, Mus musculus
aagcagtcatacaatgccggtctca

SEQ ID NO: 51936 - DNA, 25 bp, Mus musculus
aagcagtcatactatgccggtctca

SEQ ID NO: 51937 - DNA, 25 bp, Mus musculus
aagcagtcattaagggttgaggtat

SEQ ID NO: 51938 - DNA, 25 bp, Mus musculus
aagcagtcattatgggttgaggtat

SEQ ID NO: 51939 - DNA, 25 bp, Mus musculus
aagcagtcatttctcagtttttata

SEQ ID NO: 51940 - DNA, 25 bp, Mus musculus
aagcagtcatttgtcagtttttata

SEQ ID NO: 51941 - DNA, 25 bp, Mus musculus
aagcagtcccagagccatgaagcga

SEQ ID NO: 51942 - DNA, 25 bp, Mus musculus
aagcagtcccagtgccatgaagcga

SEQ ID NO: 51943 - DNA, 25 bp, Mus musculus
aagcagtcccgccacgagtatcagc

SEQ ID NO: 51944 - DNA, 25 bp, Mus musculus
aagcagtcccgcgacgagtatcagc

SEQ ID NO: 51945 - DNA, 25 bp, Mus musculus
aagcagtccgtgatgcaggtctgac

SEQ ID NO: 51946 - DNA, 25 bp, Mus musculus
aagcagtccgtgttgcaggtctgac

SEQ ID NO: 51947 - DNA, 25 bp, Mus musculus
aagcagtcctaaatttctttctgaa

SEQ ID NO: 51948 - DNA, 25 bp, Mus musculus
aagcagtcctaattttctttctgaa

SEQ ID NO: 51949 - DNA, 25 bp, Mus musculus
aagcagtcgagcatcttcctactct

SEQ ID NO: 51950 - DNA, 25 bp, Mus musculus
aagcagtcgagcttcttcctactct

SEQ ID NO: 51951 - DNA, 25 bp, Mus musculus
aagcagtcggtgacaggattccata

SEQ ID NO: 51952 - DNA, 25 bp, Mus musculus
aagcagtcggtgtcaggattccata

SEQ ID NO: 51953 - DNA, 25 bp, Mus musculus
aagcagtctgcaatttttcacttct

SEQ ID NO: 51954 - DNA, 25 bp, Mus musculus
aagcagtctgcattttttcacttct

SEQ ID NO: 51955 - DNA, 25 bp, Mus musculus
aagcagtctgtcctcagctgtacat

SEQ ID NO: 51956 - DNA, 25 bp, Mus musculus
aagcagtctgtcgtcagctgtacat

SEQ ID NO: 51957 - DNA, 25 bp, Mus musculus
aagcagtcttacactgtaggcctga

SEQ ID NO: 51958 - DNA, 25 bp, Mus musculus
aagcagtcttactctgtaggcctga

SEQ ID NO: 51959 - DNA, 25 bp, Mus musculus
aagcagtctttaacttcatcatctg

SEQ ID NO: 51960 - DNA, 25 bp, Mus musculus
aagcagtctttatcttcatcatctg

SEQ ID NO: 51961 - DNA, 25 bp, Mus musculus
aagcagtgaacccaaggaggaatca

SEQ ID NO: 51962 - DNA, 25 bp, Mus musculus
aagcagtgaaccgaaggaggaatca

SEQ ID NO: 51963 - DNA, 25 bp, Mus musculus
aagcagtgaataagcccctgggaat

SEQ ID NO: 51964 - DNA, 25 bp, Mus musculus
aagcagtgaatatgcccctgggaat

SEQ ID NO: 51965 - DNA, 25 bp, Mus musculus
aagcagtgactacctgagccctcca

SEQ ID NO: 51966 - DNA, 25 bp, Mus musculus
aagcagtgactagctgagccctcca

SEQ ID NO: 51967 - DNA, 25 bp, Mus musculus
aagcagtgaggccagtggctcccta

SEQ ID NO: 51968 - DNA, 25 bp, Mus musculus
aagcagtgaggcgagtggctcccta

SEQ ID NO: 51969 - DNA, 25 bp, Mus musculus
aagcagtgattcacattggtctgaa

SEQ ID NO: 51970 - DNA, 25 bp, Mus musculus
aagcagtgattctcattggtctgaa

SEQ ID NO: 51971 - DNA, 25 bp, Mus musculus
aagcagtgctccagatggtggccag

SEQ ID NO: 51972 - DNA, 25 bp, Mus musculus
aagcagtgctcctgatggtggccag

SEQ ID NO: 51973 - DNA, 25 bp, Mus musculus
aagcagtggatgattgtaccttcat

SEQ ID NO: 51974 - DNA, 25 bp, Mus musculus
aagcagtggatgtttgtaccttcat

SEQ ID NO: 51975 - DNA, 25 bp, Mus musculus
aagcagtggcaacctcccatgggag

SEQ ID NO: 51976 - DNA, 25 bp, Mus musculus
aagcagtggcaagctcccatgggag

SEQ ID NO: 51977 - DNA, 25 bp, Mus musculus
aagcagtggcaccaacgctgagctt

SEQ ID NO: 51978 - DNA, 25 bp, Mus musculus
aagcagtggcacgaacgctgagctt

SEQ ID NO: 51979 - DNA, 25 bp, Mus musculus
aagcagtggccgagggctggatacc

SEQ ID NO: 51980 - DNA, 25 bp, Mus musculus
aagcagtggccgtgggctggatacc

SEQ ID NO: 51981 - DNA, 25 bp, Mus musculus
aagcagtggcctagtcaggaactct

SEQ ID NO: 51982 - DNA, 25 bp, Mus musculus
aagcagtggccttgtcaggaactct

SEQ ID NO: 51983 - DNA, 25 bp, Mus musculus
aagcagtggctgaagaatagaatat

SEQ ID NO: 51984 - DNA, 25 bp, Mus musculus
aagcagtggctgtagaatagaatat

SEQ ID NO: 51985 - DNA, 25 bp, Mus musculus
aagcagtgggtcagcttcggttcag

SEQ ID NO: 51986 - DNA, 25 bp, Mus musculus
aagcagtgggtctgcttcggttcag

SEQ ID NO: 51987 - DNA, 25 bp, Mus musculus
aagcagtgggttacattatgatgtc

SEQ ID NO: 51988 - DNA, 25 bp, Mus musculus
aagcagtgggtttcattatgatgtc

SEQ ID NO: 51989 - DNA, 25 bp, Mus musculus
aagcagtgtacaatcttcaccatgg

SEQ ID NO: 51990 - DNA, 25 bp, Mus musculus
aagcagtgtacattcttcaccatgg

SEQ ID NO: 51991 - DNA, 25 bp, Mus musculus
aagcagtgtggtccccaaagtctaa

SEQ ID NO: 51992 - DNA, 25 bp, Mus musculus
aagcagtgtggtgcccaaagtctaa

SEQ ID NO: 51993 - DNA, 25 bp, Mus musculus
aagcagtgtgttaggtttgccatga

SEQ ID NO: 51994 - DNA, 25 bp, Mus musculus
aagcagtgtgtttggtttgccatga

SEQ ID NO: 51995 - DNA, 25 bp, Mus musculus
aagcagttaaccaagctataatggg

SEQ ID NO: 51996 - DNA, 25 bp, Mus musculus
aagcagttaacctagctataatggg

SEQ ID NO: 51997 - DNA, 25 bp, Mus musculus
aagcagttaatgcttggattagaac

SEQ ID NO: 51998 - DNA, 25 bp, Mus musculus
aagcagttaatggttggattagaac

SEQ ID NO: 51999 - DNA, 25 bp, Mus musculus
aagcagttactgagtaccgtcctag

SEQ ID NO: 52000 - DNA, 25 bp, Mus musculus
aagcagttactgtgtaccgtcctag

SEQ ID NO: 52001 - DNA, 25 bp, Mus musculus
aagcagttagccacggtagctgacc

SEQ ID NO: 52002 - DNA, 25 bp, Mus musculus
aagcagttagcctcggtagctgacc

SEQ ID NO: 52003 - DNA, 25 bp, Mus musculus
aagcagttagttcctgtacatggat

SEQ ID NO: 52004 - DNA, 25 bp, Mus musculus
aagcagttagttgctgtacatggat

SEQ ID NO: 52005 - DNA, 25 bp, Mus musculus
aagcagttatgtacagaccctaccc

SEQ ID NO: 52006 - DNA, 25 bp, Mus musculus
aagcagttatgttcagaccctaccc

SEQ ID NO: 52007 - DNA, 25 bp, Mus musculus
aagcagttcaaacccagggattcca

SEQ ID NO: 52008 - DNA, 25 bp, Mus musculus
aagcagttcaaagccagggattcca

SEQ ID NO: 52009 - DNA, 25 bp, Mus musculus
aagcagttcaacactcaacttctct

SEQ ID NO: 52010 - DNA, 25 bp, Mus musculus
aagcagttcaactctcaacttctct

SEQ ID NO: 52011 - DNA, 25 bp, Mus musculus
aagcagttccagctgggacggacat

SEQ ID NO: 52012 - DNA, 25 bp, Mus musculus
aagcagttccaggtgggacggacat

SEQ ID NO: 52013 - DNA, 25 bp, Mus musculus
aagcagttccttaaaatctcttagg

SEQ ID NO: 52014 - DNA, 25 bp, Mus musculus
aagcagttcctttaaatctcttagg

SEQ ID NO: 52015 - DNA, 25 bp, Mus musculus
aagcagttctatacacagaggcact

SEQ ID NO: 52016 - DNA, 25 bp, Mus musculus
aagcagttctattcacagaggcact

SEQ ID NO: 52017 - DNA, 25 bp, Mus musculus
aagcagttgctcaaggaaacctttc

SEQ ID NO: 52018 - DNA, 25 bp, Mus musculus
aagcagttgctctaggaaacctttc

SEQ ID NO: 52019 - DNA, 25 bp, Mus musculus
aagcagttgggaactgcccactgaa

SEQ ID NO: 52020 - DNA, 25 bp, Mus musculus
aagcagttgggatctgcccactgaa

SEQ ID NO: 52021 - DNA, 25 bp, Mus musculus
aagcagttgttcattcatagactta

SEQ ID NO: 52022 - DNA, 25 bp, Mus musculus
aagcagttgttctttcatagactta

SEQ ID NO: 52023 - DNA, 25 bp, Mus musculus
aagcagtttagtccatatgttacac

SEQ ID NO: 52024 - DNA, 25 bp, Mus musculus
aagcagtttagtgcatatgttacac

SEQ ID NO: 52025 - DNA, 25 bp, Mus musculus
aagcagtttctgacattgggcacga

SEQ ID NO: 52026 - DNA, 25 bp, Mus musculus
aagcagtttctgtcattgggcacga

SEQ ID NO: 52027 - DNA, 25 bp, Mus musculus
aagcagtttgctaatctgaaatagg

SEQ ID NO: 52028 - DNA, 25 bp, Mus musculus
aagcagtttgctccaagtgtccatt

SEQ ID NO: 52029 - DNA, 25 bp, Mus musculus
aagcagtttgctgcaagtgtccatt

SEQ ID NO: 52030 - DNA, 25 bp, Mus musculus
aagcagtttgcttatctgaaatagg

SEQ ID NO: 52031 - DNA, 25 bp, Mus musculus
aagcagtttggaccacttgtgcggt

SEQ ID NO: 52032 - DNA, 25 bp, Mus musculus
aagcagtttggagcacttgtgcggt

SEQ ID NO: 52033 - DNA, 25 bp, Mus musculus
aagcataaactaaatacatacatct

SEQ ID NO: 52034 - DNA, 25 bp, Mus musculus
aagcataaactatatacatacatct

SEQ ID NO: 52035 - DNA, 25 bp, Mus musculus
aagcatacaatgagaggctcttata

SEQ ID NO: 52036 - DNA, 25 bp, Mus musculus
aagcatacaatgtgaggctcttata

SEQ ID NO: 52037 - DNA, 25 bp, Mus musculus
aagcatacaattaagctcagcccag

SEQ ID NO: 52038 - DNA, 25 bp, Mus musculus
aagcatacaatttagctcagcccag

SEQ ID NO: 52039 - DNA, 25 bp, Mus musculus
aagcataccacaactgagctgtgcc

SEQ ID NO: 52040 - DNA, 25 bp, Mus musculus
aagcataccacatctgagctgtgcc

SEQ ID NO: 52041 - DNA, 25 bp, Mus musculus
aagcataccagcagtgtgacttggg

SEQ ID NO: 52042 - DNA, 25 bp, Mus musculus
aagcataccagctgtgtgacttggg

SEQ ID NO: 52043 - DNA, 25 bp, Mus musculus
aagcatacccacagatactttgcaa

SEQ ID NO: 52044 - DNA, 25 bp, Mus musculus
aagcatacccactgatactttgcaa

SEQ ID NO: 52045 - DNA, 25 bp, Mus musculus
aagcatacctgtacgacatcagtta

SEQ ID NO: 52046 - DNA, 25 bp, Mus musculus
aagcatacctgttcgacatcagtta

SEQ ID NO: 52047 - DNA, 25 bp, Mus musculus
aagcatactctgaagtactcttcta

SEQ ID NO: 52048 - DNA, 25 bp, Mus musculus
aagcatactctgtagtactcttcta

SEQ ID NO: 52049 - DNA, 25 bp, Mus musculus
aagcatactgtcactaatcgtttat

SEQ ID NO: 52050 - DNA, 25 bp, Mus musculus
aagcatactgtctctaatcgtttat

SEQ ID NO: 52051 - DNA, 25 bp, Mus musculus
aagcatagaggtacctttccaaagt

SEQ ID NO: 52052 - DNA, 25 bp, Mus musculus
aagcatagaggttcctttccaaagt

SEQ ID NO: 52053 - DNA, 25 bp, Mus musculus
aagcatagcctcagttttctagttt

SEQ ID NO: 52054 - DNA, 25 bp, Mus musculus
aagcatagcctctgttttctagttt

SEQ ID NO: 52055 - DNA, 25 bp, Mus musculus
aagcataggagcatcccggtgctct

SEQ ID NO: 52056 - DNA, 25 bp, Mus musculus
aagcataggagcttcccggtgctct

SEQ ID NO: 52057 - DNA, 25 bp, Mus musculus
aagcataggccaaagccagcccagg

SEQ ID NO: 52058 - DNA, 25 bp, Mus musculus
aagcataggccatagccagcccagg

SEQ ID NO: 52059 - DNA, 25 bp, Mus musculus
aagcatagtcccagtgcaagcacag

SEQ ID NO: 52060 - DNA, 25 bp, Mus musculus
aagcatagtccctgtgcaagcacag

SEQ ID NO: 52061 - DNA, 25 bp, Mus musculus
aagcatagtgttcagcccgcagcat

SEQ ID NO: 52062 - DNA, 25 bp, Mus musculus
aagcatagtgttgagcccgcagcat

SEQ ID NO: 52063 - DNA, 25 bp, Mus musculus
aagcatagttcacaccttaaaggat

SEQ ID NO: 52064 - DNA, 25 bp, Mus musculus
aagcatagttcagaccttaaaggat

SEQ ID NO: 52065 - DNA, 25 bp, Mus musculus
aagcatatatatctacgtgtacaca

SEQ ID NO: 52066 - DNA, 25 bp, Mus musculus
aagcatatatatgtacgtgtacaca

SEQ ID NO: 52067 - DNA, 25 bp, Mus musculus
aagcatatattcaacctggtataca

SEQ ID NO: 52068 - DNA, 25 bp, Mus musculus
aagcatatattctacctggtataca

SEQ ID NO: 52069 - DNA, 25 bp, Mus musculus
aagcatatgacaagtgaatacacag

SEQ ID NO: 52070 - DNA, 25 bp, Mus musculus
aagcatatgacatgtgaatacacag

SEQ ID NO: 52071 - DNA, 25 bp, Mus musculus
aagcatatgcaactgatcctcttat

SEQ ID NO: 52072 - DNA, 25 bp, Mus musculus
aagcatatgcaagtgatcctcttat

SEQ ID NO: 52073 - DNA, 25 bp, Mus musculus
aagcatattattcctcctgagtcat

SEQ ID NO: 52074 - DNA, 25 bp, Mus musculus
aagcatattattgctcctgagtcat

SEQ ID NO: 52075 - DNA, 25 bp, Mus musculus
aagcatattttaccctcaatggaaa

SEQ ID NO: 52076 - DNA, 25 bp, Mus musculus
aagcatattttagcctcaatggaaa

SEQ ID NO: 52077 - DNA, 25 bp, Mus musculus
aagcatattttgctcggtgcctttg

SEQ ID NO: 52078 - DNA, 25 bp, Mus musculus
aagcatattttggtcggtgcctttg

SEQ ID NO: 52079 - DNA, 25 bp, Mus musculus
aagcatcacaagaatcgcgcccact

SEQ ID NO: 52080 - DNA, 25 bp, Mus musculus
aagcatcacaagtatcgcgcccact

SEQ ID NO: 52081 - DNA, 25 bp, Mus musculus
aagcatcacaccagttaaccttggg

SEQ ID NO: 52082 - DNA, 25 bp, Mus musculus
aagcatcacacctgttaaccttggg

SEQ ID NO: 52083 - DNA, 25 bp, Mus musculus
aagcatcacaggacacaggccatga

SEQ ID NO: 52084 - DNA, 25 bp, Mus musculus
aagcatcacaggtcacaggccatga

SEQ ID NO: 52085 - DNA, 25 bp, Mus musculus
aagcatcaccagacgtggctgcaga

SEQ ID NO: 52086 - DNA, 25 bp, Mus musculus
aagcatcaccagtcgtggctgcaga

SEQ ID NO: 52087 - DNA, 25 bp, Mus musculus
aagcatcactttactcacatgttgt

SEQ ID NO: 52088 - DNA, 25 bp, Mus musculus
aagcatcacttttctcacatgttgt

SEQ ID NO: 52089 - DNA, 25 bp, Mus musculus
aagcatcagcagatgcgtgccagat

SEQ ID NO: 52090 - DNA, 25 bp, Mus musculus
aagcatcagcagttgcgtgccagat

SEQ ID NO: 52091 - DNA, 25 bp, Mus musculus
aagcatcagctaccgtgtgtttgaa

SEQ ID NO: 52092 - DNA, 25 bp, Mus musculus
aagcatcagctagcgtgtgtttgaa

SEQ ID NO: 52093 - DNA, 25 bp, Mus musculus
aagcatcagggacagcccagctaca

SEQ ID NO: 52094 - DNA, 25 bp, Mus musculus
aagcatcagggactgaggagcctcc

SEQ ID NO: 52095 - DNA, 25 bp, Mus musculus
aagcatcagggagagcccagctaca

SEQ ID NO: 52096 - DNA, 25 bp, Mus musculus
aagcatcagggagtgaggagcctcc

SEQ ID NO: 52097 - DNA, 25 bp, Mus musculus
aagcatcaggtcacttaccatccag

SEQ ID NO: 52098 - DNA, 25 bp, Mus musculus
aagcatcaggtctcttaccatccag

SEQ ID NO: 52099 - DNA, 25 bp, Mus musculus
aagcatcagtttcaagagctcatgg

SEQ ID NO: 52100 - DNA, 25 bp, Mus musculus
aagcatcagtttgaagagctcatgg

SEQ ID NO: 52101 - DNA, 25 bp, Mus musculus
aagcatcatcctagcgatgtcctgg

SEQ ID NO: 52102 - DNA, 25 bp, Mus musculus
aagcatcatccttgcgatgtcctgg

SEQ ID NO: 52103 - DNA, 25 bp, Mus musculus
aagcatcattatcaggcagccagtg

SEQ ID NO: 52104 - DNA, 25 bp, Mus musculus
aagcatcattatgaggcagccagtg

SEQ ID NO: 52105 - DNA, 25 bp, Mus musculus
aagcatcattggctgtccgcacatc

SEQ ID NO: 52106 - DNA, 25 bp, Mus musculus
aagcatcattgggtgtccgcacatc

SEQ ID NO: 52107 - DNA, 25 bp, Mus musculus
aagcatccacagctaactctgaggt

SEQ ID NO: 52108 - DNA, 25 bp, Mus musculus
aagcatccacaggtaactctgaggt

SEQ ID NO: 52109 - DNA, 25 bp, Mus musculus
aagcatccacgcagcattctgagga

SEQ ID NO: 52110 - DNA, 25 bp, Mus musculus
aagcatccacgctgcattctgagga

SEQ ID NO: 52111 - DNA, 25 bp, Mus musculus
aagcatccagagcacgccttctatg

SEQ ID NO: 52112 - DNA, 25 bp, Mus musculus
aagcatccagaggacgccttctatg

SEQ ID NO: 52113 - DNA, 25 bp, Mus musculus
aagcatccagataagcaactccacc

SEQ ID NO: 52114 - DNA, 25 bp, Mus musculus
aagcatccagattagcaactccacc

SEQ ID NO: 52115 - DNA, 25 bp, Mus musculus
aagcatccagcacagacttccaagg

SEQ ID NO: 52116 - DNA, 25 bp, Mus musculus
aagcatccagcagagacttccaagg

SEQ ID NO: 52117 - DNA, 25 bp, Mus musculus
aagcatccaggacgatttcagtagg

SEQ ID NO: 52118 - DNA, 25 bp, Mus musculus
aagcatccaggaggatttcagtagg

SEQ ID NO: 52119 - DNA, 25 bp, Mus musculus
aagcatccaggccaggttctgaaag

SEQ ID NO: 52120 - DNA, 25 bp, Mus musculus
aagcatccaggcgaggttctgaaag

SEQ ID NO: 52121 - DNA, 25 bp, Mus musculus
aagcatccatgacaatcttccagag

SEQ ID NO: 52122 - DNA, 25 bp, Mus musculus
aagcatccatgagaatcttccagag

SEQ ID NO: 52123 - DNA, 25 bp, Mus musculus
aagcatcccattctcattcatggta

SEQ ID NO: 52124 - DNA, 25 bp, Mus musculus
aagcatcccattgtcattcatggta

SEQ ID NO: 52125 - DNA, 25 bp, Mus musculus
aagcatccctaacgtttgtgtctgg

SEQ ID NO: 52126 - DNA, 25 bp, Mus musculus
aagcatccctaaggtttgtgtctgg

SEQ ID NO: 52127 - DNA, 25 bp, Mus musculus
aagcatccctggatacctgttcagc

SEQ ID NO: 52128 - DNA, 25 bp, Mus musculus
aagcatccctggttacctgttcagc

SEQ ID NO: 52129 - DNA, 25 bp, Mus musculus
aagcatcccttaaagatgttctgaa

SEQ ID NO: 52130 - DNA, 25 bp, Mus musculus
aagcatcccttatagatgttctgaa

SEQ ID NO: 52131 - DNA, 25 bp, Mus musculus
aagcatccgagtagagaggttcttt

SEQ ID NO: 52132 - DNA, 25 bp, Mus musculus
aagcatccgagttgagaggttcttt

SEQ ID NO: 52133 - DNA, 25 bp, Mus musculus
aagcatccgcctacagagttactgt

SEQ ID NO: 52134 - DNA, 25 bp, Mus musculus
aagcatccgccttcagagttactgt

SEQ ID NO: 52135 - DNA, 25 bp, Mus musculus
aagcatccgtatacgttcggatcgg

SEQ ID NO: 52136 - DNA, 25 bp, Mus musculus
aagcatccgtattcgttcggatcgg

SEQ ID NO: 52137 - DNA, 25 bp, Mus musculus
aagcatccgtccctggaggctttgc

SEQ ID NO: 52138 - DNA, 25 bp, Mus musculus
aagcatccgtccgtggaggctttgc

SEQ ID NO: 52139 - DNA, 25 bp, Mus musculus
aagcatcctgagaagccctgaagac

SEQ ID NO: 52140 - DNA, 25 bp, Mus musculus
aagcatcctgagtagccctgaagac

SEQ ID NO: 52141 - DNA, 25 bp, Mus musculus
aagcatcctgcgaggcttatagggt

SEQ ID NO: 52142 - DNA, 25 bp, Mus musculus
aagcatcctgcgtggcttatagggt

SEQ ID NO: 52143 - DNA, 25 bp, Mus musculus
aagcatcctgtcattctggagacag

SEQ ID NO: 52144 - DNA, 25 bp, Mus musculus
aagcatcctgtctttctggagacag

SEQ ID NO: 52145 - DNA, 25 bp, Mus musculus
aagcatccttcacttcacggcttca

SEQ ID NO: 52146 - DNA, 25 bp, Mus musculus
aagcatccttcagttcacggcttca

SEQ ID NO: 52147 - DNA, 25 bp, Mus musculus
aagcatcctttgaccaactgagaga

SEQ ID NO: 52148 - DNA, 25 bp, Mus musculus
aagcatcctttgtccaactgagaga

SEQ ID NO: 52149 - DNA, 25 bp, Mus musculus
aagcatccttttcgccaaattcctg

SEQ ID NO: 52150 - DNA, 25 bp, Mus musculus
aagcatccttttggccaaattcctg

SEQ ID NO: 52151 - DNA, 25 bp, Mus musculus
aagcatcgagccaaggagagccagg

SEQ ID NO: 52152 - DNA, 25 bp, Mus musculus
aagcatcgagcctaggagagccagg

SEQ ID NO: 52153 - DNA, 25 bp, Mus musculus
aagcatcgctgccttgcgcatgaag

SEQ ID NO: 52154 - DNA, 25 bp, Mus musculus
aagcatcgctgcgttgcgcatgaag

SEQ ID NO: 52155 - DNA, 25 bp, Mus musculus
aagcatcgctttaatcctctttcaa

SEQ ID NO: 52156 - DNA, 25 bp, Mus musculus
aagcatcgcttttatcctctttcaa

SEQ ID NO: 52157 - DNA, 25 bp, Mus musculus
aagcatcggaacatcaatcaaccag

SEQ ID NO: 52158 - DNA, 25 bp, Mus musculus
aagcatcggaacttcaatcaaccag

SEQ ID NO: 52159 - DNA, 25 bp, Mus musculus
aagcatcggccaagggaacttctga

SEQ ID NO: 52160 - DNA, 25 bp, Mus musculus
aagcatcggccatgggaacttctga

SEQ ID NO: 52161 - DNA, 25 bp, Mus musculus
aagcatcgggacagggcaagctctc

SEQ ID NO: 52162 - DNA, 25 bp, Mus musculus
aagcatcgggactgggcaagctctc

SEQ ID NO: 52163 - DNA, 25 bp, Mus musculus
aagcatcgggtcagagggactacac

SEQ ID NO: 52164 - DNA, 25 bp, Mus musculus
aagcatcgggtctgagggactacac

SEQ ID NO: 52165 - DNA, 25 bp, Mus musculus
aagcatctaagcatagaagttacat

SEQ ID NO: 52166 - DNA, 25 bp, Mus musculus
aagcatctaagcttagaagttacat

SEQ ID NO: 52167 - DNA, 25 bp, Mus musculus
aagcatctacatacctttttgaagc

SEQ ID NO: 52168 - DNA, 25 bp, Mus musculus
aagcatctacattcctttttgaagc

SEQ ID NO: 52169 - DNA, 25 bp, Mus musculus
aagcatctacttcttgcctgtaatc

SEQ ID NO: 52170 - DNA, 25 bp, Mus musculus
aagcatctacttgttgcctgtaatc

SEQ ID NO: 52171 - DNA, 25 bp, Mus musculus
aagcatctagctaaccagccagtat

SEQ ID NO: 52172 - DNA, 25 bp, Mus musculus
aagcatctagcttaccagccagtat

SEQ ID NO: 52173 - DNA, 25 bp, Mus musculus
aagcatctagtcagtgaaccatgga

SEQ ID NO: 52174 - DNA, 25 bp, Mus musculus
aagcatctagtctgtgaaccatgga

SEQ ID NO: 52175 - DNA, 25 bp, Mus musculus
aagcatctatggctgagtcctggca

SEQ ID NO: 52176 - DNA, 25 bp, Mus musculus
aagcatctatgggtgagtcctggca

SEQ ID NO: 52177 - DNA, 25 bp, Mus musculus
aagcatctcaacactggcgttcgac

SEQ ID NO: 52178 - DNA, 25 bp, Mus musculus
aagcatctcaactctggcgttcgac

SEQ ID NO: 52179 - DNA, 25 bp, Mus musculus
aagcatctcagactgtagctgtatt

SEQ ID NO: 52180 - DNA, 25 bp, Mus musculus
aagcatctcagagtgtagctgtatt

SEQ ID NO: 52181 - DNA, 25 bp, Mus musculus
aagcatctccatagtgtgtatccag

SEQ ID NO: 52182 - DNA, 25 bp, Mus musculus
aagcatctccattgtgtgtatccag

SEQ ID NO: 52183 - DNA, 25 bp, Mus musculus
aagcatctcccaaccatgatgctga

SEQ ID NO: 52184 - DNA, 25 bp, Mus musculus
aagcatctcccatccatgatgctga

SEQ ID NO: 52185 - DNA, 25 bp, Mus musculus
aagcatctctcaattgtacacaaga

SEQ ID NO: 52186 - DNA, 25 bp, Mus musculus
aagcatctctcatttgtacacaaga

SEQ ID NO: 52187 - DNA, 25 bp, Mus musculus
aagcatctctgtatacctgcctggg

SEQ ID NO: 52188 - DNA, 25 bp, Mus musculus
aagcatctctgtttacctgcctggg

SEQ ID NO: 52189 - DNA, 25 bp, Mus musculus
aagcatctgaaacgtgccagcctct

SEQ ID NO: 52190 - DNA, 25 bp, Mus musculus
aagcatctgaaaggtgccagcctct

SEQ ID NO: 52191 - DNA, 25 bp, Mus musculus
aagcatctgagaccacttgcataca

SEQ ID NO: 52192 - DNA, 25 bp, Mus musculus
aagcatctgagagcacttgcataca

SEQ ID NO: 52193 - DNA, 25 bp, Mus musculus
aagcatctgagtagggtgacggtcc

SEQ ID NO: 52194 - DNA, 25 bp, Mus musculus
aagcatctgagttgggtgacggtcc

SEQ ID NO: 52195 - DNA, 25 bp, Mus musculus
aagcatctgcgcatggatggcaatc

SEQ ID NO: 52196 - DNA, 25 bp, Mus musculus
aagcatctgcgcttggatggcaatc

SEQ ID NO: 52197 - DNA, 25 bp, Mus musculus
aagcatctgcttagccagtatcaca

SEQ ID NO: 52198 - DNA, 25 bp, Mus musculus
aagcatctgctttgccagtatcaca

SEQ ID NO: 52199 - DNA, 25 bp, Mus musculus
aagcatctgtaacttcggttccaga

SEQ ID NO: 52200 - DNA, 25 bp, Mus musculus
aagcatctgtaagttcggttccaga

SEQ ID NO: 52201 - DNA, 25 bp, Mus musculus
aagcatctgtccctttatttgttgt

SEQ ID NO: 52202 - DNA, 25 bp, Mus musculus
aagcatctgtccgtttatttgttgt

SEQ ID NO: 52203 - DNA, 25 bp, Mus musculus
aagcatcttcaaaatgtgcccatta

SEQ ID NO: 52204 - DNA, 25 bp, Mus musculus
aagcatcttcaatatgtgcccatta

SEQ ID NO: 52205 - DNA, 25 bp, Mus musculus
aagcatcttcctcagcgccaggtgt

SEQ ID NO: 52206 - DNA, 25 bp, Mus musculus
aagcatcttcctgagcgccaggtgt

SEQ ID NO: 52207 - DNA, 25 bp, Mus musculus
aagcatcttgcaatttggccccgaa

SEQ ID NO: 52208 - DNA, 25 bp, Mus musculus
aagcatcttgcattttggccccgaa

SEQ ID NO: 52209 - DNA, 25 bp, Mus musculus
aagcatctttatagactgagggtct

SEQ ID NO: 52210 - DNA, 25 bp, Mus musculus
aagcatctttattgactgagggtct

SEQ ID NO: 52211 - DNA, 25 bp, Mus musculus
aagcatctttggatgattccgttcc

SEQ ID NO: 52212 - DNA, 25 bp, Mus musculus
aagcatctttggttgattccgttcc

SEQ ID NO: 52213 - DNA, 25 bp, Mus musculus
aagcatctttgtacttcgtggcctc

SEQ ID NO: 52214 - DNA, 25 bp, Mus musculus
aagcatctttgttcttcgtggcctc

SEQ ID NO: 52215 - DNA, 25 bp, Mus musculus
aagcatgaacgacccgctgaaacat

SEQ ID NO: 52216 - DNA, 25 bp, Mus musculus
aagcatgaacgagccgctgaaacat

SEQ ID NO: 52217 - DNA, 25 bp, Mus musculus
aagcatgaagaaaaccaccggcctt

SEQ ID NO: 52218 - DNA, 25 bp, Mus musculus
aagcatgaagaataccaccggcctt

SEQ ID NO: 52219 - DNA, 25 bp, Mus musculus
aagcatgaagacagaacgcaaacat

SEQ ID NO: 52220 - DNA, 25 bp, Mus musculus
aagcatgaagacagatcccaaatat

SEQ ID NO: 52221 - DNA, 25 bp, Mus musculus
aagcatgaagactgaacgcaaacat

SEQ ID NO: 52222 - DNA, 25 bp, Mus musculus
aagcatgaagactgatcccaaatat

SEQ ID NO: 52223 - DNA, 25 bp, Mus musculus
aagcatgaagccacatgcccagctc

SEQ ID NO: 52224 - DNA, 25 bp, Mus musculus
aagcatgaagcctcatgcccagctc

SEQ ID NO: 52225 - DNA, 25 bp, Mus musculus
aagcatgaccccactgcttataaga

SEQ ID NO: 52226 - DNA, 25 bp, Mus musculus
aagcatgacccctctgcttataaga

SEQ ID NO: 52227 - DNA, 25 bp, Mus musculus
aagcatgaccctatgctggttgtgt

SEQ ID NO: 52228 - DNA, 25 bp, Mus musculus
aagcatgaccctttgctggttgtgt

SEQ ID NO: 52229 - DNA, 25 bp, Mus musculus
aagcatgacctcattatctaggcct

SEQ ID NO: 52230 - DNA, 25 bp, Mus musculus
aagcatgacctctttatctaggcct

SEQ ID NO: 52231 - DNA, 25 bp, Mus musculus
aagcatgacctgacattgacaccaa

SEQ ID NO: 52232 - DNA, 25 bp, Mus musculus
aagcatgacctgtcattgacaccaa

SEQ ID NO: 52233 - DNA, 25 bp, Mus musculus
aagcatgactgcctgcaggtgtgac

SEQ ID NO: 52234 - DNA, 25 bp, Mus musculus
aagcatgactgcgtgcaggtgtgac

SEQ ID NO: 52235 - DNA, 25 bp, Mus musculus
aagcatgacttcactgctacctgga

SEQ ID NO: 52236 - DNA, 25 bp, Mus musculus
aagcatgacttcctataggttatga

SEQ ID NO: 52237 - DNA, 25 bp, Mus musculus
aagcatgacttcgtataggttatga

SEQ ID NO: 52238 - DNA, 25 bp, Mus musculus
aagcatgacttctctgctacctgga

SEQ ID NO: 52239 - DNA, 25 bp, Mus musculus
aagcatgactttcatcttccagagt

SEQ ID NO: 52240 - DNA, 25 bp, Mus musculus
aagcatgactttgatcttccagagt

SEQ ID NO: 52241 - DNA, 25 bp, Mus musculus
aagcatgagaccatcgcggtggttt

SEQ ID NO: 52242 - DNA, 25 bp, Mus musculus
aagcatgagaccttcgcggtggttt

SEQ ID NO: 52243 - DNA, 25 bp, Mus musculus
aagcatgagcatctgagttcctaaa

SEQ ID NO: 52244 - DNA, 25 bp, Mus musculus
aagcatgagcatgtgagttcctaaa

SEQ ID NO: 52245 - DNA, 25 bp, Mus musculus
aagcatgagctacctatgctcagct

SEQ ID NO: 52246 - DNA, 25 bp, Mus musculus
aagcatgagctagctatgctcagct

SEQ ID NO: 52247 - DNA, 25 bp, Mus musculus
aagcatgaggtgcagttgcgccttt

SEQ ID NO: 52248 - DNA, 25 bp, Mus musculus
aagcatgaggtggagttgcgccttt

SEQ ID NO: 52249 - DNA, 25 bp, Mus musculus
aagcatgagtgtattacccacatgt

SEQ ID NO: 52250 - DNA, 25 bp, Mus musculus
aagcatgagtgttttacccacatgt

SEQ ID NO: 52251 - DNA, 25 bp, Mus musculus
aagcatgatgagcttgacatcctgg

SEQ ID NO: 52252 - DNA, 25 bp, Mus musculus
aagcatgatgaggttgacatcctgg

SEQ ID NO: 52253 - DNA, 25 bp, Mus musculus
aagcatgatgctatcctgttttgaa

SEQ ID NO: 52254 - DNA, 25 bp, Mus musculus
aagcatgatgctttcctgttttgaa

SEQ ID NO: 52255 - DNA, 25 bp, Mus musculus
aagcatgatgttaaggtcctatttt

SEQ ID NO: 52256 - DNA, 25 bp, Mus musculus
aagcatgatgtttaggtcctatttt

SEQ ID NO: 52257 - DNA, 25 bp, Mus musculus
aagcatgcaagcacagtcaactcca

SEQ ID NO: 52258 - DNA, 25 bp, Mus musculus
aagcatgcaagctcagtcaactcca

SEQ ID NO: 52259 - DNA, 25 bp, Mus musculus
aagcatgcaagtcgtccacagttct

SEQ ID NO: 52260 - DNA, 25 bp, Mus musculus
aagcatgcaagtggtccacagttct

SEQ ID NO: 52261 - DNA, 25 bp, Mus musculus
aagcatgcactcatctatcactgag

SEQ ID NO: 52262 - DNA, 25 bp, Mus musculus
aagcatgcactcttctatcactgag

SEQ ID NO: 52263 - DNA, 25 bp, Mus musculus
aagcatgcacttcaacttgatgggt

SEQ ID NO: 52264 - DNA, 25 bp, Mus musculus
aagcatgcacttgaacttgatgggt

SEQ ID NO: 52265 - DNA, 25 bp, Mus musculus
aagcatgcagagagcacttagagag

SEQ ID NO: 52266 - DNA, 25 bp, Mus musculus
aagcatgcagagtgcacttagagag

SEQ ID NO: 52267 - DNA, 25 bp, Mus musculus
aagcatgcagcaccccactatggaa

SEQ ID NO: 52268 - DNA, 25 bp, Mus musculus
aagcatgcagcagcccactatggaa

SEQ ID NO: 52269 - DNA, 25 bp, Mus musculus
aagcatgcagccatagacttctggg

SEQ ID NO: 52270 - DNA, 25 bp, Mus musculus
aagcatgcagccttagacttctggg

SEQ ID NO: 52271 - DNA, 25 bp, Mus musculus
aagcatgcatcgattgtgcgcacca

SEQ ID NO: 52272 - DNA, 25 bp, Mus musculus
aagcatgcatcgtttgtgcgcacca

SEQ ID NO: 52273 - DNA, 25 bp, Mus musculus
aagcatgcattcacatggaataaca

SEQ ID NO: 52274 - DNA, 25 bp, Mus musculus
aagcatgcattctcatggaataaca

SEQ ID NO: 52275 - DNA, 25 bp, Mus musculus
aagcatgccaggctgaatttttcac

SEQ ID NO: 52276 - DNA, 25 bp, Mus musculus
aagcatgccagggtgaatttttcac

SEQ ID NO: 52277 - DNA, 25 bp, Mus musculus
aagcatgcccacaggtcaggagaca

SEQ ID NO: 52278 - DNA, 25 bp, Mus musculus
aagcatgcccactggtcaggagaca

SEQ ID NO: 52279 - DNA, 25 bp, Mus musculus
aagcatgccctgagcagatgatgtg

SEQ ID NO: 52280 - DNA, 25 bp, Mus musculus
aagcatgccctgtgcagatgatgtg

SEQ ID NO: 52281 - DNA, 25 bp, Mus musculus
aagcatgcctatacattgactggtt

SEQ ID NO: 52282 - DNA, 25 bp, Mus musculus
aagcatgcctattcattgactggtt

SEQ ID NO: 52283 - DNA, 25 bp, Mus musculus
aagcatgcctgaagcgaaagcacaa

SEQ ID NO: 52284 - DNA, 25 bp, Mus musculus
aagcatgcctgaataaactctccct

SEQ ID NO: 52285 - DNA, 25 bp, Mus musculus
aagcatgcctgatgcgaaagcacaa

SEQ ID NO: 52286 - DNA, 25 bp, Mus musculus
aagcatgcctgattaaactctccct

SEQ ID NO: 52287 - DNA, 25 bp, Mus musculus
aagcatgctcataggatgacaaaca

SEQ ID NO: 52288 - DNA, 25 bp, Mus musculus
aagcatgctcattggatgacaaaca

SEQ ID NO: 52289 - DNA, 25 bp, Mus musculus
aagcatgctctgacagtgggagata

SEQ ID NO: 52290 - DNA, 25 bp, Mus musculus
aagcatgctctgctgctatggcttt

SEQ ID NO: 52291 - DNA, 25 bp, Mus musculus
aagcatgctctggtgctatggcttt

SEQ ID NO: 52292 - DNA, 25 bp, Mus musculus
aagcatgctctgtcagtgggagata

SEQ ID NO: 52293 - DNA, 25 bp, Mus musculus
aagcatgctgcgactttttcaaaag

SEQ ID NO: 52294 - DNA, 25 bp, Mus musculus
aagcatgctgcgtctttttcaaaag

SEQ ID NO: 52295 - DNA, 25 bp, Mus musculus
aagcatgctggtagtatttgtctca

SEQ ID NO: 52296 - DNA, 25 bp, Mus musculus
aagcatgctggttgtatttgtctca

SEQ ID NO: 52297 - DNA, 25 bp, Mus musculus
aagcatgcttgcacgcactgtgttg

SEQ ID NO: 52298 - DNA, 25 bp, Mus musculus
aagcatgcttgcattctcatcacag

SEQ ID NO: 52299 - DNA, 25 bp, Mus musculus
aagcatgcttgctcgcactgtgttg

SEQ ID NO: 52300 - DNA, 25 bp, Mus musculus
aagcatgcttgctttctcatcacag

SEQ ID NO: 52301 - DNA, 25 bp, Mus musculus
aagcatgctttgactccatggagtc

SEQ ID NO: 52302 - DNA, 25 bp, Mus musculus
aagcatgctttgtctccatggagtc

SEQ ID NO: 52303 - DNA, 25 bp, Mus musculus
aagcatgcttttatgctacgagcat

SEQ ID NO: 52304 - DNA, 25 bp, Mus musculus
aagcatgcttttttgctacgagcat

SEQ ID NO: 52305 - DNA, 25 bp, Mus musculus
aagcatggaccaaaaccacacccag

SEQ ID NO: 52306 - DNA, 25 bp, Mus musculus
aagcatggaccataaccacacccag

SEQ ID NO: 52307 - DNA, 25 bp, Mus musculus
aagcatggactgagccaaacaccca

SEQ ID NO: 52308 - DNA, 25 bp, Mus musculus
aagcatggactgtgccaaacaccca

SEQ ID NO: 52309 - DNA, 25 bp, Mus musculus
aagcatggagttcctgacgtctcag

SEQ ID NO: 52310 - DNA, 25 bp, Mus musculus
aagcatggagttgctgacgtctcag

SEQ ID NO: 52311 - DNA, 25 bp, Mus musculus
aagcatggattcagatttatggata

SEQ ID NO: 52312 - DNA, 25 bp, Mus musculus
aagcatggattctgatttatggata

SEQ ID NO: 52313 - DNA, 25 bp, Mus musculus
aagcatggcaagacccgcaagttca

SEQ ID NO: 52314 - DNA, 25 bp, Mus musculus
aagcatggcaagtcccgcaagttca

SEQ ID NO: 52315 - DNA, 25 bp, Mus musculus
aagcatggcacacagggtccctcag

SEQ ID NO: 52316 - DNA, 25 bp, Mus musculus
aagcatggcacagagggtccctcag

SEQ ID NO: 52317 - DNA, 25 bp, Mus musculus
aagcatggcatcacttaagacttag

SEQ ID NO: 52318 - DNA, 25 bp, Mus musculus
aagcatggcatctcttaagacttag

SEQ ID NO: 52319 - DNA, 25 bp, Mus musculus
aagcatggcatgcagctgtcttagg

SEQ ID NO: 52320 - DNA, 25 bp, Mus musculus
aagcatggcatggagctgtcttagg

SEQ ID NO: 52321 - DNA, 25 bp, Mus musculus
aagcatggcgctcattatactcgac

SEQ ID NO: 52322 - DNA, 25 bp, Mus musculus
aagcatggcgctgattatactcgac

SEQ ID NO: 52323 - DNA, 25 bp, Mus musculus
aagcatggctaacatgtcttctgtt

SEQ ID NO: 52324 - DNA, 25 bp, Mus musculus
aagcatggctaagatgtcttctgtt

SEQ ID NO: 52325 - DNA, 25 bp, Mus musculus
aagcatggctatccctatgggtatt

SEQ ID NO: 52326 - DNA, 25 bp, Mus musculus
aagcatggctatgcctatgggtatt

SEQ ID NO: 52327 - DNA, 25 bp, Mus musculus
aagcatgggcagacggcagtagtaa

SEQ ID NO: 52328 - DNA, 25 bp, Mus musculus
aagcatgggcagctcttgactttcc

SEQ ID NO: 52329 - DNA, 25 bp, Mus musculus
aagcatgggcaggtcttgactttcc

SEQ ID NO: 52330 - DNA, 25 bp, Mus musculus
aagcatgggcagtcggcagtagtaa

SEQ ID NO: 52331 - DNA, 25 bp, Mus musculus
aagcatgggtgcactgtacataagt

SEQ ID NO: 52332 - DNA, 25 bp, Mus musculus
aagcatgggtgctctgtacataagt

SEQ ID NO: 52333 - DNA, 25 bp, Mus musculus
aagcatgggtttccacagctgtcta

SEQ ID NO: 52334 - DNA, 25 bp, Mus musculus
aagcatgggtttgcacagctgtcta

SEQ ID NO: 52335 - DNA, 25 bp, Mus musculus
aagcatggtgagaggcacctctcac

SEQ ID NO: 52336 - DNA, 25 bp, Mus musculus
aagcatggtgagtggcacctctcac

SEQ ID NO: 52337 - DNA, 25 bp, Mus musculus
aagcatggtgccacctgagtggcac

SEQ ID NO: 52338 - DNA, 25 bp, Mus musculus
aagcatggtgcctcctgagtggcac

SEQ ID NO: 52339 - DNA, 25 bp, Mus musculus
aagcatggtgctacatagtacttag

SEQ ID NO: 52340 - DNA, 25 bp, Mus musculus
aagcatggtgcttcatagtacttag

SEQ ID NO: 52341 - DNA, 25 bp, Mus musculus
aagcatggttgaccattactaccgc

SEQ ID NO: 52342 - DNA, 25 bp, Mus musculus
aagcatggttgacctatgttcctga

SEQ ID NO: 52343 - DNA, 25 bp, Mus musculus
aagcatggttgagcattactaccgc

SEQ ID NO: 52344 - DNA, 25 bp, Mus musculus
aagcatggttgagctatgttcctga

SEQ ID NO: 52345 - DNA, 25 bp, Mus musculus
aagcatggttgtctttggtcctaga

SEQ ID NO: 52346 - DNA, 25 bp, Mus musculus
aagcatggttgtgtttggtcctaga

SEQ ID NO: 52347 - DNA, 25 bp, Mus musculus
aagcatggtttaatgctggccggcc

SEQ ID NO: 52348 - DNA, 25 bp, Mus musculus
aagcatggtttattgctggccggcc

SEQ ID NO: 52349 - DNA, 25 bp, Mus musculus
aagcatggttttcaactcattcaaa

SEQ ID NO: 52350 - DNA, 25 bp, Mus musculus
aagcatggttttgaactcattcaaa

SEQ ID NO: 52351 - DNA, 25 bp, Mus musculus
aagcatgtaaatacatcaggcgtga

SEQ ID NO: 52352 - DNA, 25 bp, Mus musculus
aagcatgtaaattcatcaggcgtga

SEQ ID NO: 52353 - DNA, 25 bp, Mus musculus
aagcatgtacatctccacgttcttc

SEQ ID NO: 52354 - DNA, 25 bp, Mus musculus
aagcatgtacatgtccacgttcttc

SEQ ID NO: 52355 - DNA, 25 bp, Mus musculus
aagcatgtacttagggttctatttg

SEQ ID NO: 52356 - DNA, 25 bp, Mus musculus
aagcatgtacttctgatagcacgga

SEQ ID NO: 52357 - DNA, 25 bp, Mus musculus
aagcatgtacttgtgatagcacgga

SEQ ID NO: 52358 - DNA, 25 bp, Mus musculus
aagcatgtactttgggttctatttg

SEQ ID NO: 52359 - DNA, 25 bp, Mus musculus
aagcatgtagacattctgggtggtg

SEQ ID NO: 52360 - DNA, 25 bp, Mus musculus
aagcatgtagactttctgggtggtg

SEQ ID NO: 52361 - DNA, 25 bp, Mus musculus
aagcatgtagcaccttacccagctt

SEQ ID NO: 52362 - DNA, 25 bp, Mus musculus
aagcatgtagcagcttacccagctt

SEQ ID NO: 52363 - DNA, 25 bp, Mus musculus
aagcatgtagtaatgccttggtatg

SEQ ID NO: 52364 - DNA, 25 bp, Mus musculus
aagcatgtagtaattgggtttgtta

SEQ ID NO: 52365 - DNA, 25 bp, Mus musculus
aagcatgtagtattgccttggtatg

SEQ ID NO: 52366 - DNA, 25 bp, Mus musculus
aagcatgtagtatttgggtttgtta

SEQ ID NO: 52367 - DNA, 25 bp, Mus musculus
aagcatgtccgcagctggtctgggc

SEQ ID NO: 52368 - DNA, 25 bp, Mus musculus
aagcatgtccgctgctggtctgggc

SEQ ID NO: 52369 - DNA, 25 bp, Mus musculus
aagcatgtccggaggagctcagtga

SEQ ID NO: 52370 - DNA, 25 bp, Mus musculus
aagcatgtccggtggagctcagtga

SEQ ID NO: 52371 - DNA, 25 bp, Mus musculus
aagcatgtgccaagtacgtatgcaa

SEQ ID NO: 52372 - DNA, 25 bp, Mus musculus
aagcatgtgccatgtacgtatgcaa

SEQ ID NO: 52373 - DNA, 25 bp, Mus musculus
aagcatgtggacactccgagaaggg

SEQ ID NO: 52374 - DNA, 25 bp, Mus musculus
aagcatgtggactctccgagaaggg

SEQ ID NO: 52375 - DNA, 25 bp, Mus musculus
aagcatgtggtcaagttgacaaaaa

SEQ ID NO: 52376 - DNA, 25 bp, Mus musculus
aagcatgtggtctagttgacaaaaa

SEQ ID NO: 52377 - DNA, 25 bp, Mus musculus
aagcatgtgtgccattgggctgaaa

SEQ ID NO: 52378 - DNA, 25 bp, Mus musculus
aagcatgtgtgcctgtttcatctaa

SEQ ID NO: 52379 - DNA, 25 bp, Mus musculus
aagcatgtgtgcgattgggctgaaa

SEQ ID NO: 52380 - DNA, 25 bp, Mus musculus
aagcatgtgtgcgtgtttcatctaa

SEQ ID NO: 52381 - DNA, 25 bp, Mus musculus
aagcatgttacccaagactgtgtgt

SEQ ID NO: 52382 - DNA, 25 bp, Mus musculus
aagcatgttaccgaagactgtgtgt

SEQ ID NO: 52383 - DNA, 25 bp, Mus musculus
aagcatgttggtcgtacacagacat

SEQ ID NO: 52384 - DNA, 25 bp, Mus musculus
aagcatgttggtggtacacagacat

SEQ ID NO: 52385 - DNA, 25 bp, Mus musculus
aagcatgttgtaactctgttcttct

SEQ ID NO: 52386 - DNA, 25 bp, Mus musculus
aagcatgttgtatctctgttcttct

SEQ ID NO: 52387 - DNA, 25 bp, Mus musculus
aagcatgtttaaattactcaggtca

SEQ ID NO: 52388 - DNA, 25 bp, Mus musculus
aagcatgtttaatttactcaggtca

SEQ ID NO: 52389 - DNA, 25 bp, Mus musculus
aagcatgtttccacatccaaggtaa

SEQ ID NO: 52390 - DNA, 25 bp, Mus musculus
aagcatgtttcctcatccaaggtaa

SEQ ID NO: 52391 - DNA, 25 bp, Mus musculus
aagcatgttttgattggtgctacag

SEQ ID NO: 52392 - DNA, 25 bp, Mus musculus
aagcatgttttgtttggtgctacag

SEQ ID NO: 52393 - DNA, 25 bp, Mus musculus
aagcattacccgctggccggacacg

SEQ ID NO: 52394 - DNA, 25 bp, Mus musculus
aagcattacccggtggccggacacg

SEQ ID NO: 52395 - DNA, 25 bp, Mus musculus
aagcattaggcccacaaccgagtcc

SEQ ID NO: 52396 - DNA, 25 bp, Mus musculus
aagcattaggccgacaaccgagtcc

SEQ ID NO: 52397 - DNA, 25 bp, Mus musculus
aagcattagtgacctgtctgtccag

SEQ ID NO: 52398 - DNA, 25 bp, Mus musculus
aagcattagtgagctgtctgtccag

SEQ ID NO: 52399 - DNA, 25 bp, Mus musculus
aagcattatattacctctctattca

SEQ ID NO: 52400 - DNA, 25 bp, Mus musculus
aagcattatatttcctctctattca

SEQ ID NO: 52401 - DNA, 25 bp, Mus musculus
aagcattatccaagctgtcacctgg

SEQ ID NO: 52402 - DNA, 25 bp, Mus musculus
aagcattatccatgctgtcacctgg

SEQ ID NO: 52403 - DNA, 25 bp, Mus musculus
aagcattatcgaatcttccgtcttc

SEQ ID NO: 52404 - DNA, 25 bp, Mus musculus
aagcattatcgattcttccgtcttc

SEQ ID NO: 52405 - DNA, 25 bp, Mus musculus
aagcattattgcacccatatctttt

SEQ ID NO: 52406 - DNA, 25 bp, Mus musculus
aagcattattgccagtgagttttaa

SEQ ID NO: 52407 - DNA, 25 bp, Mus musculus
aagcattattgcgagtgagttttaa

SEQ ID NO: 52408 - DNA, 25 bp, Mus musculus
aagcattattgctcccatatctttt

SEQ ID NO: 52409 - DNA, 25 bp, Mus musculus
aagcattcaacccttagccttagag

SEQ ID NO: 52410 - DNA, 25 bp, Mus musculus
aagcattcaaccgttagccttagag

SEQ ID NO: 52411 - DNA, 25 bp, Mus musculus
aagcattcaagcctgtgagtctatg

SEQ ID NO: 52412 - DNA, 25 bp, Mus musculus
aagcattcaagcgtgtgagtctatg

SEQ ID NO: 52413 - DNA, 25 bp, Mus musculus
aagcattcacatacgggtagagcaa

SEQ ID NO: 52414 - DNA, 25 bp, Mus musculus
aagcattcacattcgggtagagcaa

SEQ ID NO: 52415 - DNA, 25 bp, Mus musculus
aagcattcacctattgaatccgggt

SEQ ID NO: 52416 - DNA, 25 bp, Mus musculus
aagcattcaccttttgaatccgggt

SEQ ID NO: 52417 - DNA, 25 bp, Mus musculus
aagcattcactgacaaagaagatat

SEQ ID NO: 52418 - DNA, 25 bp, Mus musculus
aagcattcactgtcaaagaagatat

SEQ ID NO: 52419 - DNA, 25 bp, Mus musculus
aagcattcagtaatccacattttat

SEQ ID NO: 52420 - DNA, 25 bp, Mus musculus
aagcattcagtattccacattttat

SEQ ID NO: 52421 - DNA, 25 bp, Mus musculus
aagcattcatagatttacctactac

SEQ ID NO: 52422 - DNA, 25 bp, Mus musculus
aagcattcatagttttacctactac

SEQ ID NO: 52423 - DNA, 25 bp, Mus musculus
aagcattcatcaccttgttttccaa

SEQ ID NO: 52424 - DNA, 25 bp, Mus musculus
aagcattcatcagcttgttttccaa

SEQ ID NO: 52425 - DNA, 25 bp, Mus musculus
aagcattcatggcatttaaccagtg

SEQ ID NO: 52426 - DNA, 25 bp, Mus musculus
aagcattcatgggatttaaccagtg

SEQ ID NO: 52427 - DNA, 25 bp, Mus musculus
aagcattcatttcaaggtactcact

SEQ ID NO: 52428 - DNA, 25 bp, Mus musculus
aagcattcatttgaaggtactcact

SEQ ID NO: 52429 - DNA, 25 bp, Mus musculus
aagcattccaataacaaggccatga

SEQ ID NO: 52430 - DNA, 25 bp, Mus musculus
aagcattccaattacaaggccatga

SEQ ID NO: 52431 - DNA, 25 bp, Mus musculus
aagcattccactcactgagccatat

SEQ ID NO: 52432 - DNA, 25 bp, Mus musculus
aagcattccactgactgagccatat

SEQ ID NO: 52433 - DNA, 25 bp, Mus musculus
aagcattccagaatggcagttgtaa

SEQ ID NO: 52434 - DNA, 25 bp, Mus musculus
aagcattccagattggcagttgtaa

SEQ ID NO: 52435 - DNA, 25 bp, Mus musculus
aagcattccaggatcactccagtag

SEQ ID NO: 52436 - DNA, 25 bp, Mus musculus
aagcattccaggttcactccagtag

SEQ ID NO: 52437 - DNA, 25 bp, Mus musculus
aagcattcccaacgcttgcaagcca

SEQ ID NO: 52438 - DNA, 25 bp, Mus musculus
aagcattcccaaggcttgcaagcca

SEQ ID NO: 52439 - DNA, 25 bp, Mus musculus
aagcattcctccctgggtttccaga

SEQ ID NO: 52440 - DNA, 25 bp, Mus musculus
aagcattcctccgtgggtttccaga

SEQ ID NO: 52441 - DNA, 25 bp, Mus musculus
aagcattccttaagtgtatggtcat

SEQ ID NO: 52442 - DNA, 25 bp, Mus musculus
aagcattccttatgtgtatggtcat

SEQ ID NO: 52443 - DNA, 25 bp, Mus musculus
aagcattcctttctaggctgacttc

SEQ ID NO: 52444 - DNA, 25 bp, Mus musculus
aagcattcctttgtaggctgacttc

SEQ ID NO: 52445 - DNA, 25 bp, Mus musculus
aagcattcgctcaaaaaccttagtg

SEQ ID NO: 52446 - DNA, 25 bp, Mus musculus
aagcattcgctctaaaaccttagtg

SEQ ID NO: 52447 - DNA, 25 bp, Mus musculus
aagcattcgttactaatggcaggaa

SEQ ID NO: 52448 - DNA, 25 bp, Mus musculus
aagcattcgttagtaatggcaggaa

SEQ ID NO: 52449 - DNA, 25 bp, Mus musculus
aagcattctaccacgtgagacccat

SEQ ID NO: 52450 - DNA, 25 bp, Mus musculus
aagcattctaccataaagacagttt

SEQ ID NO: 52451 - DNA, 25 bp, Mus musculus
aagcattctacctcgtgagacccat

SEQ ID NO: 52452 - DNA, 25 bp, Mus musculus
aagcattctaccttaaagacagttt

SEQ ID NO: 52453 - DNA, 25 bp, Mus musculus
aagcattctgtacagagcctgttga

SEQ ID NO: 52454 - DNA, 25 bp, Mus musculus
aagcattctgtagagagcctgttga

SEQ ID NO: 52455 - DNA, 25 bp, Mus musculus
aagcattcttcaatgatcttaggta

SEQ ID NO: 52456 - DNA, 25 bp, Mus musculus
aagcattcttcattgatcttaggta

SEQ ID NO: 52457 - DNA, 25 bp, Mus musculus
aagcattctttaacgaggttgaggt

SEQ ID NO: 52458 - DNA, 25 bp, Mus musculus
aagcattctttatcgaggttgaggt

SEQ ID NO: 52459 - DNA, 25 bp, Mus musculus
aagcattgacttccaccgagcatag

SEQ ID NO: 52460 - DNA, 25 bp, Mus musculus
aagcattgacttgcaccgagcatag

SEQ ID NO: 52461 - DNA, 25 bp, Mus musculus
aagcattgataaatccagccaatgt

SEQ ID NO: 52462 - DNA, 25 bp, Mus musculus
aagcattgataattccagccaatgt

SEQ ID NO: 52463 - DNA, 25 bp, Mus musculus
aagcattgcaacaaggttacctcta

SEQ ID NO: 52464 - DNA, 25 bp, Mus musculus
aagcattgcaactaggttacctcta

SEQ ID NO: 52465 - DNA, 25 bp, Mus musculus
aagcattgcaatagcccagtgcctc

SEQ ID NO: 52466 - DNA, 25 bp, Mus musculus
aagcattgcaattgcccagtgcctc

SEQ ID NO: 52467 - DNA, 25 bp, Mus musculus
aagcattgcacactatttattagta

SEQ ID NO: 52468 - DNA, 25 bp, Mus musculus
aagcattgcacagtatttattagta

SEQ ID NO: 52469 - DNA, 25 bp, Mus musculus
aagcattgcctacacggacgttcta

SEQ ID NO: 52470 - DNA, 25 bp, Mus musculus
aagcattgcctagacggacgttcta

SEQ ID NO: 52471 - DNA, 25 bp, Mus musculus
aagcattgctccatgtcagtaacat

SEQ ID NO: 52472 - DNA, 25 bp, Mus musculus
aagcattgctccttgtcagtaacat

SEQ ID NO: 52473 - DNA, 25 bp, Mus musculus
aagcattgctgtatcatgccagtgc

SEQ ID NO: 52474 - DNA, 25 bp, Mus musculus
aagcattgctgtttcatgccagtgc

SEQ ID NO: 52475 - DNA, 25 bp, Mus musculus
aagcattgcttgagcctgtatctac

SEQ ID NO: 52476 - DNA, 25 bp, Mus musculus
aagcattgcttgtgcctgtatctac

SEQ ID NO: 52477 - DNA, 25 bp, Mus musculus
aagcattggaaaatcatgacagcat

SEQ ID NO: 52478 - DNA, 25 bp, Mus musculus
aagcattggaaattcatgacagcat

SEQ ID NO: 52479 - DNA, 25 bp, Mus musculus
aagcattgggctacctcagtacgag

SEQ ID NO: 52480 - DNA, 25 bp, Mus musculus
aagcattgggcttcctcagtacgag

SEQ ID NO: 52481 - DNA, 25 bp, Mus musculus
aagcattggtccaaccaggcccatc

SEQ ID NO: 52482 - DNA, 25 bp, Mus musculus
aagcattggtcctaccaggcccatc

SEQ ID NO: 52483 - DNA, 25 bp, Mus musculus
aagcattgtgtgcatgtttcccctt

SEQ ID NO: 52484 - DNA, 25 bp, Mus musculus
aagcattgtgtgctaagtgcccctc

SEQ ID NO: 52485 - DNA, 25 bp, Mus musculus
aagcattgtgtggatgtttcccctt

SEQ ID NO: 52486 - DNA, 25 bp, Mus musculus
aagcattgtgtggtaagtgcccctc

SEQ ID NO: 52487 - DNA, 25 bp, Mus musculus
aagcatttaaacagcgcccttgggt

SEQ ID NO: 52488 - DNA, 25 bp, Mus musculus
aagcatttaaactgcgcccttgggt

SEQ ID NO: 52489 - DNA, 25 bp, Mus musculus
aagcatttaaagcaccttctatcaa

SEQ ID NO: 52490 - DNA, 25 bp, Mus musculus
aagcatttaaaggaccttctatcaa

SEQ ID NO: 52491 - DNA, 25 bp, Mus musculus
aagcatttacttatcaaaatcttag

SEQ ID NO: 52492 - DNA, 25 bp, Mus musculus
aagcatttacttttcaaaatcttag

SEQ ID NO: 52493 - DNA, 25 bp, Mus musculus
aagcatttatccatctgttcaggtt

SEQ ID NO: 52494 - DNA, 25 bp, Mus musculus
aagcatttatccttctgttcaggtt

SEQ ID NO: 52495 - DNA, 25 bp, Mus musculus
aagcatttatgcagcaggtgcacca

SEQ ID NO: 52496 - DNA, 25 bp, Mus musculus
aagcatttatgctgcaggtgcacca

SEQ ID NO: 52497 - DNA, 25 bp, Mus musculus
aagcatttcaagctacttttctaag

SEQ ID NO: 52498 - DNA, 25 bp, Mus musculus
aagcatttcaaggtacttttctaag

SEQ ID NO: 52499 - DNA, 25 bp, Mus musculus
aagcatttccagagtttccagcaaa

SEQ ID NO: 52500 - DNA, 25 bp, Mus musculus
aagcatttccagtgtttccagcaaa

SEQ ID NO: 52501 - DNA, 25 bp, Mus musculus
aagcatttccgcaaaggtttccgca

SEQ ID NO: 52502 - DNA, 25 bp, Mus musculus
aagcatttccgctaaggtttccgca

SEQ ID NO: 52503 - DNA, 25 bp, Mus musculus
aagcatttcgggatcgctgcaatca

SEQ ID NO: 52504 - DNA, 25 bp, Mus musculus
aagcatttcgggttcgctgcaatca

SEQ ID NO: 52505 - DNA, 25 bp, Mus musculus
aagcatttctacaaagcgaggccct

SEQ ID NO: 52506 - DNA, 25 bp, Mus musculus
aagcatttctactaagcgaggccct

SEQ ID NO: 52507 - DNA, 25 bp, Mus musculus
aagcatttctcgctgcatcttcagg

SEQ ID NO: 52508 - DNA, 25 bp, Mus musculus
aagcatttctcggtgcatcttcagg

SEQ ID NO: 52509 - DNA, 25 bp, Mus musculus
aagcatttgctcaagccctgagttc

SEQ ID NO: 52510 - DNA, 25 bp, Mus musculus
aagcatttgctctagccctgagttc

SEQ ID NO: 52511 - DNA, 25 bp, Mus musculus
aagcatttgctgaaacttgaaaaac

SEQ ID NO: 52512 - DNA, 25 bp, Mus musculus
aagcatttgctgtaacttgaaaaac

SEQ ID NO: 52513 - DNA, 25 bp, Mus musculus
aagcatttggcacgttaccaccgta

SEQ ID NO: 52514 - DNA, 25 bp, Mus musculus
aagcatttggcaggttaccaccgta

SEQ ID NO: 52515 - DNA, 25 bp, Mus musculus
aagcatttggttatcatgttatcat

SEQ ID NO: 52516 - DNA, 25 bp, Mus musculus
aagcatttggttatgtacagacatt

SEQ ID NO: 52517 - DNA, 25 bp, Mus musculus
aagcatttggttttcatgttatcat

SEQ ID NO: 52518 - DNA, 25 bp, Mus musculus
aagcatttggttttgtacagacatt

SEQ ID NO: 52519 - DNA, 25 bp, Mus musculus
aagcatttgtgtatcacgtccctga

SEQ ID NO: 52520 - DNA, 25 bp, Mus musculus
aagcatttgtgtttcacgtccctga

SEQ ID NO: 52521 - DNA, 25 bp, Mus musculus
aagcattttactaaaactgtactgt

SEQ ID NO: 52522 - DNA, 25 bp, Mus musculus
aagcattttacttaaactgtactgt

SEQ ID NO: 52523 - DNA, 25 bp, Mus musculus
aagcatttttatatgcgggctcaaa

SEQ ID NO: 52524 - DNA, 25 bp, Mus musculus
aagcatttttatttgcgggctcaaa

SEQ ID NO: 52525 - DNA, 25 bp, Mus musculus
aagcatttttccacactaacattag

SEQ ID NO: 52526 - DNA, 25 bp, Mus musculus
aagcatttttcctcactaacattag

SEQ ID NO: 52527 - DNA, 25 bp, Mus musculus
aagccaaaagagacttccatccctc

SEQ ID NO: 52528 - DNA, 25 bp, Mus musculus
aagccaaaagagtcttccatccctc

SEQ ID NO: 52529 - DNA, 25 bp, Mus musculus
aagccaaaagccagtatgcctgtaa

SEQ ID NO: 52530 - DNA, 25 bp, Mus musculus
aagccaaaagcctgtatgcctgtaa

SEQ ID NO: 52531 - DNA, 25 bp, Mus musculus
aagccaaaaggcagtgatcagatca

SEQ ID NO: 52532 - DNA, 25 bp, Mus musculus
aagccaaaaggctgtgatcagatca

SEQ ID NO: 52533 - DNA, 25 bp, Mus musculus
aagccaaactcaacttgctgttgat

SEQ ID NO: 52534 - DNA, 25 bp, Mus musculus
aagccaaactcatcttgctgttgat

SEQ ID NO: 52535 - DNA, 25 bp, Mus musculus
aagccaaacttgcttgtgcagttct

SEQ ID NO: 52536 - DNA, 25 bp, Mus musculus
aagccaaacttggttgtgcagttct

SEQ ID NO: 52537 - DNA, 25 bp, Mus musculus
aagccaaagaaaaccgcagccaaga

SEQ ID NO: 52538 - DNA, 25 bp, Mus musculus
aagccaaagaaatccgcagccaaga

SEQ ID NO: 52539 - DNA, 25 bp, Mus musculus
aagccaaagccactatctccaataa

SEQ ID NO: 52540 - DNA, 25 bp, Mus musculus
aagccaaagccagtatctccaataa

SEQ ID NO: 52541 - DNA, 25 bp, Mus musculus
aagccaaagcgtccttcagagcaga

SEQ ID NO: 52542 - DNA, 25 bp, Mus musculus
aagccaaagcgtgcttcagagcaga

SEQ ID NO: 52543 - DNA, 25 bp, Mus musculus
aagccaaaggctctacaagaattag

SEQ ID NO: 52544 - DNA, 25 bp, Mus musculus
aagccaaaggctgtacaagaattag

SEQ ID NO: 52545 - DNA, 25 bp, Mus musculus
aagccaaaggtgcagtgctgtcaga

SEQ ID NO: 52546 - DNA, 25 bp, Mus musculus
aagccaaaggtggagtgctgtcaga

SEQ ID NO: 52547 - DNA, 25 bp, Mus musculus
aagccaaagtagaggctgtctggcc

SEQ ID NO: 52548 - DNA, 25 bp, Mus musculus
aagccaaagtagtggctgtctggcc

SEQ ID NO: 52549 - DNA, 25 bp, Mus musculus
aagccaaatcaacgtcacggttgta

SEQ ID NO: 52550 - DNA, 25 bp, Mus musculus
aagccaaatcaaggtcacggttgta

SEQ ID NO: 52551 - DNA, 25 bp, Mus musculus
aagccaaatcctcctcaataaacaa

SEQ ID NO: 52552 - DNA, 25 bp, Mus musculus
aagccaaatcctgctcaataaacaa

SEQ ID NO: 52553 - DNA, 25 bp, Mus musculus
aagccaaatctcagcgctgtatcag

SEQ ID NO: 52554 - DNA, 25 bp, Mus musculus
aagccaaatctctgcgctgtatcag

SEQ ID NO: 52555 - DNA, 25 bp, Mus musculus
aagccaaatgtgacaccttcagcct

SEQ ID NO: 52556 - DNA, 25 bp, Mus musculus
aagccaaatgtgtcaccttcagcct

SEQ ID NO: 52557 - DNA, 25 bp, Mus musculus
aagccaaattctactatcctctttc

SEQ ID NO: 52558 - DNA, 25 bp, Mus musculus
aagccaaattcttctatcctctttc

SEQ ID NO: 52559 - DNA, 25 bp, Mus musculus
aagccaaattggatatgtgtcccga

SEQ ID NO: 52560 - DNA, 25 bp, Mus musculus
aagccaaattggttatgtgtcccga

SEQ ID NO: 52561 - DNA, 25 bp, Mus musculus
aagccaacaacaaccgtgttctcgg

SEQ ID NO: 52562 - DNA, 25 bp, Mus musculus
aagccaacaacatccgtgttctcgg

SEQ ID NO: 52563 - DNA, 25 bp, Mus musculus
aagccaacacggaatttgctgctgt

SEQ ID NO: 52564 - DNA, 25 bp, Mus musculus
aagccaacacggtatttgctgctgt

SEQ ID NO: 52565 - DNA, 25 bp, Mus musculus
aagccaacagacatggccgcagtgg

SEQ ID NO: 52566 - DNA, 25 bp, Mus musculus
aagccaacagacttggccgcagtgg

SEQ ID NO: 52567 - DNA, 25 bp, Mus musculus
aagccaacaggaaggcccaccgatc

SEQ ID NO: 52568 - DNA, 25 bp, Mus musculus
aagccaacaggatggcccaccgatc

SEQ ID NO: 52569 - DNA, 25 bp, Mus musculus
aagccaaccagaatattcaccctga

SEQ ID NO: 52570 - DNA, 25 bp, Mus musculus
aagccaaccagattattcaccctga

SEQ ID NO: 52571 - DNA, 25 bp, Mus musculus
aagccaacccacatacatagttaat

SEQ ID NO: 52572 - DNA, 25 bp, Mus musculus
aagccaacccacttacatagttaat

SEQ ID NO: 52573 - DNA, 25 bp, Mus musculus
aagccaacccctaatgagggagagt

SEQ ID NO: 52574 - DNA, 25 bp, Mus musculus
aagccaaccccttatgagggagagt

SEQ ID NO: 52575 - DNA, 25 bp, Mus musculus
aagccaaccctacgatatgtattaa

SEQ ID NO: 52576 - DNA, 25 bp, Mus musculus
aagccaaccctaggatatgtattaa

SEQ ID NO: 52577 - DNA, 25 bp, Mus musculus
aagccaacgacaactcagaggagat

SEQ ID NO: 52578 - DNA, 25 bp, Mus musculus
aagccaacgacatctcagaggagat

SEQ ID NO: 52579 - DNA, 25 bp, Mus musculus
aagccaacgccaacaaacgcatcta

SEQ ID NO: 52580 - DNA, 25 bp, Mus musculus
aagccaacgccatcaaacgcatcta

SEQ ID NO: 52581 - DNA, 25 bp, Mus musculus
aagccaacgtacctcattttatctg

SEQ ID NO: 52582 - DNA, 25 bp, Mus musculus
aagccaacgtacgtcattttatctg

SEQ ID NO: 52583 - DNA, 25 bp, Mus musculus
aagccaacgtctaacaagtctctat

SEQ ID NO: 52584 - DNA, 25 bp, Mus musculus
aagccaacgtcttacaagtctctat

SEQ ID NO: 52585 - DNA, 25 bp, Mus musculus
aagccaacgtgtccttcccaaaggt

SEQ ID NO: 52586 - DNA, 25 bp, Mus musculus
aagccaacgtgtcggaaggtgcctc

SEQ ID NO: 52587 - DNA, 25 bp, Mus musculus
aagccaacgtgtgcttcccaaaggt

SEQ ID NO: 52588 - DNA, 25 bp, Mus musculus
aagccaacgtgtgggaaggtgcctc

SEQ ID NO: 52589 - DNA, 25 bp, Mus musculus
aagccaactacacgctcagctcagg

SEQ ID NO: 52590 - DNA, 25 bp, Mus musculus
aagccaactacaggctcagctcagg

SEQ ID NO: 52591 - DNA, 25 bp, Mus musculus
aagccaactagcaggaatgctgtat

SEQ ID NO: 52592 - DNA, 25 bp, Mus musculus
aagccaactagctggaatgctgtat

SEQ ID NO: 52593 - DNA, 25 bp, Mus musculus
aagccaactcacaagaaagcgcaga

SEQ ID NO: 52594 - DNA, 25 bp, Mus musculus
aagccaactcactagaaagcgcaga

SEQ ID NO: 52595 - DNA, 25 bp, Mus musculus
aagccaactggacagcttctcccaa

SEQ ID NO: 52596 - DNA, 25 bp, Mus musculus
aagccaactggagagcttctcccaa

SEQ ID NO: 52597 - DNA, 25 bp, Mus musculus
aagccaactgtacatgatgactgaa

SEQ ID NO: 52598 - DNA, 25 bp, Mus musculus
aagccaactgtagatgatgactgaa

SEQ ID NO: 52599 - DNA, 25 bp, Mus musculus
aagccaactgtgaaggagggtcaag

SEQ ID NO: 52600 - DNA, 25 bp, Mus musculus
aagccaactgtgtaggagggtcaag

SEQ ID NO: 52601 - DNA, 25 bp, Mus musculus
aagccaacttttcaatcatctgata

SEQ ID NO: 52602 - DNA, 25 bp, Mus musculus
aagccaacttttgaatcatctgata

SEQ ID NO: 52603 - DNA, 25 bp, Mus musculus
aagccaagaataccctgtaatccca

SEQ ID NO: 52604 - DNA, 25 bp, Mus musculus
aagccaagaatagcctgtaatccca

SEQ ID NO: 52605 - DNA, 25 bp, Mus musculus
aagccaagagtaccaacagactagt

SEQ ID NO: 52606 - DNA, 25 bp, Mus musculus
aagccaagagtagcaacagactagt

SEQ ID NO: 52607 - DNA, 25 bp, Mus musculus
aagccaagatatcgttcttccacta

SEQ ID NO: 52608 - DNA, 25 bp, Mus musculus
aagccaagatatggttcttccacta

SEQ ID NO: 52609 - DNA, 25 bp, Mus musculus
aagccaagatgcatctgggtgaaca

SEQ ID NO: 52610 - DNA, 25 bp, Mus musculus
aagccaagatgcttctgggtgaaca

SEQ ID NO: 52611 - DNA, 25 bp, Mus musculus
aagccaagcaaacccgcagtgagaa

SEQ ID NO: 52612 - DNA, 25 bp, Mus musculus
aagccaagcaaagccgcagtgagaa

SEQ ID NO: 52613 - DNA, 25 bp, Mus musculus
aagccaagcactaacactggacctc

SEQ ID NO: 52614 - DNA, 25 bp, Mus musculus
aagccaagcactacattctcaagag

SEQ ID NO: 52615 - DNA, 25 bp, Mus musculus
aagccaagcacttacactggacctc

SEQ ID NO: 52616 - DNA, 25 bp, Mus musculus
aagccaagcacttcattctcaagag

SEQ ID NO: 52617 - DNA, 25 bp, Mus musculus
aagccaagcagactcgaagtgagaa

SEQ ID NO: 52618 - DNA, 25 bp, Mus musculus
aagccaagcagagtcgaagtgagaa

SEQ ID NO: 52619 - DNA, 25 bp, Mus musculus
aagccaagcccaattctgttatgga

SEQ ID NO: 52620 - DNA, 25 bp, Mus musculus
aagccaagcccatttctgttatgga

SEQ ID NO: 52621 - DNA, 25 bp, Mus musculus
aagccaagcctcacatggatttctg

SEQ ID NO: 52622 - DNA, 25 bp, Mus musculus
aagccaagcctctcatggatttctg

SEQ ID NO: 52623 - DNA, 25 bp, Mus musculus
aagccaagctgcattcaacttttaa

SEQ ID NO: 52624 - DNA, 25 bp, Mus musculus
aagccaagctgctttcaacttttaa

SEQ ID NO: 52625 - DNA, 25 bp, Mus musculus
aagccaaggactcagatcttctagg

SEQ ID NO: 52626 - DNA, 25 bp, Mus musculus
aagccaaggactctctgaacgtgct

SEQ ID NO: 52627 - DNA, 25 bp, Mus musculus
aagccaaggactgagatcttctagg

SEQ ID NO: 52628 - DNA, 25 bp, Mus musculus
aagccaaggactgtctgaacgtgct

SEQ ID NO: 52629 - DNA, 25 bp, Mus musculus
aagccaaggagtatctgcctgttgt

SEQ ID NO: 52630 - DNA, 25 bp, Mus musculus
aagccaaggagtttctgcctgttgt

SEQ ID NO: 52631 - DNA, 25 bp, Mus musculus
aagccaaggctcctcgtaacagtca

SEQ ID NO: 52632 - DNA, 25 bp, Mus musculus
aagccaaggctcgtcgtaacagtca

SEQ ID NO: 52633 - DNA, 25 bp, Mus musculus
aagccaaggtcaagactgcggtgca

SEQ ID NO: 52634 - DNA, 25 bp, Mus musculus
aagccaaggtcatgactgcggtgca

SEQ ID NO: 52635 - DNA, 25 bp, Mus musculus
aagccaagtacgctctggagactct

SEQ ID NO: 52636 - DNA, 25 bp, Mus musculus
aagccaagtacggtctggagactct

SEQ ID NO: 52637 - DNA, 25 bp, Mus musculus
aagccaagtccaaagcattcaccat

SEQ ID NO: 52638 - DNA, 25 bp, Mus musculus
aagccaagtccatagcattcaccat

SEQ ID NO: 52639 - DNA, 25 bp, Mus musculus
aagccaagtgcaatttccttcacca

SEQ ID NO: 52640 - DNA, 25 bp, Mus musculus
aagccaagtgcattttccttcacca

SEQ ID NO: 52641 - DNA, 25 bp, Mus musculus
aagccaagttcaataattatgtgaa

SEQ ID NO: 52642 - DNA, 25 bp, Mus musculus
aagccaagttcattaattatgtgaa

SEQ ID NO: 52643 - DNA, 25 bp, Mus musculus
aagccaatacttatgagatccactg

SEQ ID NO: 52644 - DNA, 25 bp, Mus musculus
aagccaatacttttgagatccactg

SEQ ID NO: 52645 - DNA, 25 bp, Mus musculus
aagccaatatacaccagtagcatgt

SEQ ID NO: 52646 - DNA, 25 bp, Mus musculus
aagccaatatactccagtagcatgt

SEQ ID NO: 52647 - DNA, 25 bp, Mus musculus
aagccaatcatgagtaacctcgcaa

SEQ ID NO: 52648 - DNA, 25 bp, Mus musculus
aagccaatcatgtgtaacctcgcaa

SEQ ID NO: 52649 - DNA, 25 bp, Mus musculus
aagccaatcctaatcccaaagcaat

SEQ ID NO: 52650 - DNA, 25 bp, Mus musculus
aagccaatcctattcccaaagcaat

SEQ ID NO: 52651 - DNA, 25 bp, Mus musculus
aagccaatcctgcaagcatggtttg

SEQ ID NO: 52652 - DNA, 25 bp, Mus musculus
aagccaatcctggaagcatggtttg

SEQ ID NO: 52653 - DNA, 25 bp, Mus musculus
aagccaatccttcgcgtcggacatt

SEQ ID NO: 52654 - DNA, 25 bp, Mus musculus
aagccaatccttggcgtcggacatt

SEQ ID NO: 52655 - DNA, 25 bp, Mus musculus
aagccaatctgcagttcccgtgtcc

SEQ ID NO: 52656 - DNA, 25 bp, Mus musculus
aagccaatctgctgttcccgtgtcc

SEQ ID NO: 52657 - DNA, 25 bp, Mus musculus
aagccaatctttatgaggctcaagg

SEQ ID NO: 52658 - DNA, 25 bp, Mus musculus
aagccaatctttttgaggctcaagg

SEQ ID NO: 52659 - DNA, 25 bp, Mus musculus
aagccaatgactatgtatccactgc

SEQ ID NO: 52660 - DNA, 25 bp, Mus musculus
aagccaatgactttgtatccactgc

SEQ ID NO: 52661 - DNA, 25 bp, Mus musculus
aagccaatggcgctgcctaccagaa

SEQ ID NO: 52662 - DNA, 25 bp, Mus musculus
aagccaatggcggtgcctaccagaa

SEQ ID NO: 52663 - DNA, 25 bp, Mus musculus
aagccaatgtacagagcctcggtgt

SEQ ID NO: 52664 - DNA, 25 bp, Mus musculus
aagccaatgtactgagcctcggtgt

SEQ ID NO: 52665 - DNA, 25 bp, Mus musculus
aagccaattgtccagtcatgtttct

SEQ ID NO: 52666 - DNA, 25 bp, Mus musculus
aagccaattgtcgagtcatgtttct

SEQ ID NO: 52667 - DNA, 25 bp, Mus musculus
aagccaatttgcaagtgtcctcaca

SEQ ID NO: 52668 - DNA, 25 bp, Mus musculus
aagccaatttgctagtgtcctcaca

SEQ ID NO: 52669 - DNA, 25 bp, Mus musculus
aagccacaaaggagattgctagaca

SEQ ID NO: 52670 - DNA, 25 bp, Mus musculus
aagccacaaaggtgattgctagaca

SEQ ID NO: 52671 - DNA, 25 bp, Mus musculus
aagccacaagacatccttgggtgtg

SEQ ID NO: 52672 - DNA, 25 bp, Mus musculus
aagccacaagacttccttgggtgtg

SEQ ID NO: 52673 - DNA, 25 bp, Mus musculus
aagccacaaggaacccagtttctgc

SEQ ID NO: 52674 - DNA, 25 bp, Mus musculus
aagccacaaggatcccagtttctgc

SEQ ID NO: 52675 - DNA, 25 bp, Mus musculus
aagccacaataaccacttggtcaaa

SEQ ID NO: 52676 - DNA, 25 bp, Mus musculus
aagccacaataagcacttggtcaaa

SEQ ID NO: 52677 - DNA, 25 bp, Mus musculus
aagccacaattcagtcagtgctagt

SEQ ID NO: 52678 - DNA, 25 bp, Mus musculus
aagccacaattctgtcagtgctagt

SEQ ID NO: 52679 - DNA, 25 bp, Mus musculus
aagccacacaacagttcatttgcga

SEQ ID NO: 52680 - DNA, 25 bp, Mus musculus
aagccacacaactgttcatttgcga

SEQ ID NO: 52681 - DNA, 25 bp, Mus musculus
aagccacacagcagtgaaccttact

SEQ ID NO: 52682 - DNA, 25 bp, Mus musculus
aagccacacagctgtgaaccttact

SEQ ID NO: 52683 - DNA, 25 bp, Mus musculus
aagccacactgacgagtgctttgat

SEQ ID NO: 52684 - DNA, 25 bp, Mus musculus
aagccacactgaggagtgctttgat

SEQ ID NO: 52685 - DNA, 25 bp, Mus musculus
aagccacactttagcacgttccaaa

SEQ ID NO: 52686 - DNA, 25 bp, Mus musculus
aagccacacttttgcacgttccaaa

SEQ ID NO: 52687 - DNA, 25 bp, Mus musculus
aagccacagagcagtctgcgagtca

SEQ ID NO: 52688 - DNA, 25 bp, Mus musculus
aagccacagagccaattcaaggaca

SEQ ID NO: 52689 - DNA, 25 bp, Mus musculus
aagccacagagcgaattcaaggaca

SEQ ID NO: 52690 - DNA, 25 bp, Mus musculus
aagccacagagctgtctgcgagtca

SEQ ID NO: 52691 - DNA, 25 bp, Mus musculus
aagccacagagtaatgagtcgtctt

SEQ ID NO: 52692 - DNA, 25 bp, Mus musculus
aagccacagagttatgagtcgtctt

SEQ ID NO: 52693 - DNA, 25 bp, Mus musculus
aagccacagatcagccctatgatat

SEQ ID NO: 52694 - DNA, 25 bp, Mus musculus
aagccacagatctgccctatgatat

SEQ ID NO: 52695 - DNA, 25 bp, Mus musculus
aagccacaggcacagctgacagtgt

SEQ ID NO: 52696 - DNA, 25 bp, Mus musculus
aagccacaggcagagctgacagtgt

SEQ ID NO: 52697 - DNA, 25 bp, Mus musculus
aagccacaggctatccagacacgaa

SEQ ID NO: 52698 - DNA, 25 bp, Mus musculus
aagccacaggctttccagacacgaa

SEQ ID NO: 52699 - DNA, 25 bp, Mus musculus
aagccacaggtgagcaccatgataa

SEQ ID NO: 52700 - DNA, 25 bp, Mus musculus
aagccacaggtgtgcaccatgataa

SEQ ID NO: 52701 - DNA, 25 bp, Mus musculus
aagccacaggttcccttgcaggaag

SEQ ID NO: 52702 - DNA, 25 bp, Mus musculus
aagccacaggttgccttgcaggaag

SEQ ID NO: 52703 - DNA, 25 bp, Mus musculus
aagccacagtaaactctagctcttc

SEQ ID NO: 52704 - DNA, 25 bp, Mus musculus
aagccacagtaatctctagctcttc

SEQ ID NO: 52705 - DNA, 25 bp, Mus musculus
aagccacagtggacgctgaaggcaa

SEQ ID NO: 52706 - DNA, 25 bp, Mus musculus
aagccacagtggtcgctgaaggcaa

SEQ ID NO: 52707 - DNA, 25 bp, Mus musculus
aagccacagtgtcggttgtcacaaa

SEQ ID NO: 52708 - DNA, 25 bp, Mus musculus
aagccacagtgtgggttgtcacaaa

SEQ ID NO: 52709 - DNA, 25 bp, Mus musculus
aagccacagttacaactcctaggtc

SEQ ID NO: 52710 - DNA, 25 bp, Mus musculus
aagccacagttagaactcctaggtc

SEQ ID NO: 52711 - DNA, 25 bp, Mus musculus
aagccacagttcagagaacggcctt

SEQ ID NO: 52712 - DNA, 25 bp, Mus musculus
aagccacagttctgagaacggcctt

SEQ ID NO: 52713 - DNA, 25 bp, Mus musculus
aagccacatagcaggcacctctggg

SEQ ID NO: 52714 - DNA, 25 bp, Mus musculus
aagccacatagctggcacctctggg

SEQ ID NO: 52715 - DNA, 25 bp, Mus musculus
aagccacatattaagttagccccat

SEQ ID NO: 52716 - DNA, 25 bp, Mus musculus
aagccacatatttagttagccccat

SEQ ID NO: 52717 - DNA, 25 bp, Mus musculus
aagccacatcttacactgcaggcag

SEQ ID NO: 52718 - DNA, 25 bp, Mus musculus
aagccacatctttcactgcaggcag

SEQ ID NO: 52719 - DNA, 25 bp, Mus musculus
aagccacatgaacggaaggagaaat

SEQ ID NO: 52720 - DNA, 25 bp, Mus musculus
aagccacatgaagggaaggagaaat

SEQ ID NO: 52721 - DNA, 25 bp, Mus musculus
aagccacatgacacacttggtctag

SEQ ID NO: 52722 - DNA, 25 bp, Mus musculus
aagccacatgactcacttggtctag

SEQ ID NO: 52723 - DNA, 25 bp, Mus musculus
aagccacatgcaactcacaacagag

SEQ ID NO: 52724 - DNA, 25 bp, Mus musculus
aagccacatgcatctcacaacagag

SEQ ID NO: 52725 - DNA, 25 bp, Mus musculus
aagccacatgttatggctaccctga

SEQ ID NO: 52726 - DNA, 25 bp, Mus musculus
aagccacatgttttggctaccctga

SEQ ID NO: 52727 - DNA, 25 bp, Mus musculus
aagccacatttacttgtacacagtt

SEQ ID NO: 52728 - DNA, 25 bp, Mus musculus
aagccacatttagttgtacacagtt

SEQ ID NO: 52729 - DNA, 25 bp, Mus musculus
aagccaccaagacatgaatcattca

SEQ ID NO: 52730 - DNA, 25 bp, Mus musculus
aagccaccaagagatgaatcattca

SEQ ID NO: 52731 - DNA, 25 bp, Mus musculus
aagccaccactgacatttattgttg

SEQ ID NO: 52732 - DNA, 25 bp, Mus musculus
aagccaccactgtcatttattgttg

SEQ ID NO: 52733 - DNA, 25 bp, Mus musculus
aagccaccagcaatgacatcacatc

SEQ ID NO: 52734 - DNA, 25 bp, Mus musculus
aagccaccagcattgacatcacatc

SEQ ID NO: 52735 - DNA, 25 bp, Mus musculus
aagccaccaggaagcggacattgaa

SEQ ID NO: 52736 - DNA, 25 bp, Mus musculus
aagccaccaggatgcggacattgaa

SEQ ID NO: 52737 - DNA, 25 bp, Mus musculus
aagccaccattgaatctgtagagga

SEQ ID NO: 52738 - DNA, 25 bp, Mus musculus
aagccaccattgtatctgtagagga

SEQ ID NO: 52739 - DNA, 25 bp, Mus musculus
aagccacccacgagatttcaggttc

SEQ ID NO: 52740 - DNA, 25 bp, Mus musculus
aagccacccacgtgatttcaggttc

SEQ ID NO: 52741 - DNA, 25 bp, Mus musculus
aagccacccactcttaactttgaga

SEQ ID NO: 52742 - DNA, 25 bp, Mus musculus
aagccacccactgttaactttgaga

SEQ ID NO: 52743 - DNA, 25 bp, Mus musculus
aagccacccaggcaggcagcagaca

SEQ ID NO: 52744 - DNA, 25 bp, Mus musculus
aagccacccagggaggcagcagaca

SEQ ID NO: 52745 - DNA, 25 bp, Mus musculus
aagccaccctccaaattaccatatt

SEQ ID NO: 52746 - DNA, 25 bp, Mus musculus
aagccaccctcctaattaccatatt

SEQ ID NO: 52747 - DNA, 25 bp, Mus musculus
aagccaccctgaatcgaagcagact

SEQ ID NO: 52748 - DNA, 25 bp, Mus musculus
aagccaccctgattcgaagcagact

SEQ ID NO: 52749 - DNA, 25 bp, Mus musculus
aagccaccgggcagcaaggtaagac

SEQ ID NO: 52750 - DNA, 25 bp, Mus musculus
aagccaccgggctgcaaggtaagac

SEQ ID NO: 52751 - DNA, 25 bp, Mus musculus
aagccacctaagaagtctacatctg

SEQ ID NO: 52752 - DNA, 25 bp, Mus musculus
aagccacctaagtagtctacatctg

SEQ ID NO: 52753 - DNA, 25 bp, Mus musculus
aagccacctatgatcgtgtttacta

SEQ ID NO: 52754 - DNA, 25 bp, Mus musculus
aagccacctatgttcgtgtttacta

SEQ ID NO: 52755 - DNA, 25 bp, Mus musculus
aagccacctcatacagctgatcagt

SEQ ID NO: 52756 - DNA, 25 bp, Mus musculus
aagccacctcattcagctgatcagt

SEQ ID NO: 52757 - DNA, 25 bp, Mus musculus
aagccacctgtgcactttggcatga

SEQ ID NO: 52758 - DNA, 25 bp, Mus musculus
aagccacctgtggactttggcatga

SEQ ID NO: 52759 - DNA, 25 bp, Mus musculus
aagccacgcccacgatgaagcagga

SEQ ID NO: 52760 - DNA, 25 bp, Mus musculus
aagccacgcccaggatgaagcagga

SEQ ID NO: 52761 - DNA, 25 bp, Mus musculus
aagccacgctaaacatttgttctga

SEQ ID NO: 52762 - DNA, 25 bp, Mus musculus
aagccacgctaatcatttgttctga

SEQ ID NO: 52763 - DNA, 25 bp, Mus musculus
aagccacgctgccttggtgtttgtg

SEQ ID NO: 52764 - DNA, 25 bp, Mus musculus
aagccacgctgcgttggtgtttgtg

SEQ ID NO: 52765 - DNA, 25 bp, Mus musculus
aagccacggattacgtgttccgcat

SEQ ID NO: 52766 - DNA, 25 bp, Mus musculus
aagccacggatttcgtgttccgcat

SEQ ID NO: 52767 - DNA, 25 bp, Mus musculus
aagccacggctcaaggaaggacatg

SEQ ID NO: 52768 - DNA, 25 bp, Mus musculus
aagccacggctctaggaaggacatg

SEQ ID NO: 52769 - DNA, 25 bp, Mus musculus
aagccacgtgaaatgctagctgcag

SEQ ID NO: 52770 - DNA, 25 bp, Mus musculus
aagccacgtgaattgctagctgcag

SEQ ID NO: 52771 - DNA, 25 bp, Mus musculus
aagccactaagtaccttttgtgctg

SEQ ID NO: 52772 - DNA, 25 bp, Mus musculus
aagccactaagttccttttgtgctg

SEQ ID NO: 52773 - DNA, 25 bp, Mus musculus
aagccactacggatcagacagagca

SEQ ID NO: 52774 - DNA, 25 bp, Mus musculus
aagccactacggttcagacagagca

SEQ ID NO: 52775 - DNA, 25 bp, Mus musculus
aagccactacttatactgaattcaa

SEQ ID NO: 52776 - DNA, 25 bp, Mus musculus
aagccactacttttactgaattcaa

SEQ ID NO: 52777 - DNA, 25 bp, Mus musculus
aagccactagaaaaggcacatcttt

SEQ ID NO: 52778 - DNA, 25 bp, Mus musculus
aagccactagaataggcacatcttt

SEQ ID NO: 52779 - DNA, 25 bp, Mus musculus
aagccactaggcctcgaagcagcaa

SEQ ID NO: 52780 - DNA, 25 bp, Mus musculus
aagccactaggcgtcgaagcagcaa

SEQ ID NO: 52781 - DNA, 25 bp, Mus musculus
aagccactctaactgtagcaatgaa

SEQ ID NO: 52782 - DNA, 25 bp, Mus musculus
aagccactctaagtgtagcaatgaa

SEQ ID NO: 52783 - DNA, 25 bp, Mus musculus
aagccactctgccagattgtcttgt

SEQ ID NO: 52784 - DNA, 25 bp, Mus musculus
aagccactctgcgagattgtcttgt

SEQ ID NO: 52785 - DNA, 25 bp, Mus musculus
aagccactcttgctgggtattagat

SEQ ID NO: 52786 - DNA, 25 bp, Mus musculus
aagccactcttggtgggtattagat

SEQ ID NO: 52787 - DNA, 25 bp, Mus musculus
aagccactgaggcagcagttcacgc

SEQ ID NO: 52788 - DNA, 25 bp, Mus musculus
aagccactgagggagcagttcacgc

SEQ ID NO: 52789 - DNA, 25 bp, Mus musculus
aagccactgagtcaggcgacgccct

SEQ ID NO: 52790 - DNA, 25 bp, Mus musculus
aagccactgagtgaggcgacgccct

SEQ ID NO: 52791 - DNA, 25 bp, Mus musculus
aagccactgcacaatcctagctgag

SEQ ID NO: 52792 - DNA, 25 bp, Mus musculus
aagccactgcactatcctagctgag

SEQ ID NO: 52793 - DNA, 25 bp, Mus musculus
aagccactgcagaaaacaactaaag

SEQ ID NO: 52794 - DNA, 25 bp, Mus musculus
aagccactgcagtaaacaactaaag

SEQ ID NO: 52795 - DNA, 25 bp, Mus musculus
aagccactgcctactgcatagggaa

SEQ ID NO: 52796 - DNA, 25 bp, Mus musculus
aagccactgcctcagatggaaacca

SEQ ID NO: 52797 - DNA, 25 bp, Mus musculus
aagccactgcctgagatggaaacca

SEQ ID NO: 52798 - DNA, 25 bp, Mus musculus
aagccactgccttctgcatagggaa

SEQ ID NO: 52799 - DNA, 25 bp, Mus musculus
aagccactgcgacctgcaagaaact

SEQ ID NO: 52800 - DNA, 25 bp, Mus musculus
aagccactgcgagctgcaagaaact

SEQ ID NO: 52801 - DNA, 25 bp, Mus musculus
aagccactgcgtatttcccctgtgg

SEQ ID NO: 52802 - DNA, 25 bp, Mus musculus
aagccactgcgtttttcccctgtgg

SEQ ID NO: 52803 - DNA, 25 bp, Mus musculus
aagccactggttcaggtacctacct

SEQ ID NO: 52804 - DNA, 25 bp, Mus musculus
aagccactggttgaggtacctacct

SEQ ID NO: 52805 - DNA, 25 bp, Mus musculus
aagccactgttcactgcggaggagc

SEQ ID NO: 52806 - DNA, 25 bp, Mus musculus
aagccactgttctctgcggaggagc

SEQ ID NO: 52807 - DNA, 25 bp, Mus musculus
aagccactgttgatggctgtgtgac

SEQ ID NO: 52808 - DNA, 25 bp, Mus musculus
aagccactgttgttggctgtgtgac

SEQ ID NO: 52809 - DNA, 25 bp, Mus musculus
aagccacttaataattcaagccact

SEQ ID NO: 52810 - DNA, 25 bp, Mus musculus
aagccacttaattattcaagccact

SEQ ID NO: 52811 - DNA, 25 bp, Mus musculus
aagccacttagaagctactgtaaag

SEQ ID NO: 52812 - DNA, 25 bp, Mus musculus
aagccacttagatgctactgtaaag

SEQ ID NO: 52813 - DNA, 25 bp, Mus musculus
aagccacttagcatccgagggagaa

SEQ ID NO: 52814 - DNA, 25 bp, Mus musculus
aagccacttagcttccgagggagaa

SEQ ID NO: 52815 - DNA, 25 bp, Mus musculus
aagccacttctaacattaaaagcag

SEQ ID NO: 52816 - DNA, 25 bp, Mus musculus
aagccacttctatcattaaaagcag

SEQ ID NO: 52817 - DNA, 25 bp, Mus musculus
aagccacttctcaggctattgccaa

SEQ ID NO: 52818 - DNA, 25 bp, Mus musculus
aagccacttctctggctattgccaa

SEQ ID NO: 52819 - DNA, 25 bp, Mus musculus
aagccacttcttcatgtatcctgat

SEQ ID NO: 52820 - DNA, 25 bp, Mus musculus
aagccacttcttgatgtatcctgat

SEQ ID NO: 52821 - DNA, 25 bp, Mus musculus
aagccacttgctcttaaggttgatg

SEQ ID NO: 52822 - DNA, 25 bp, Mus musculus
aagccacttgctgttaaggttgatg

SEQ ID NO: 52823 - DNA, 25 bp, Mus musculus
aagccacttggcaagtcagggtgtg

SEQ ID NO: 52824 - DNA, 25 bp, Mus musculus
aagccacttggccatcctgaggttc

SEQ ID NO: 52825 - DNA, 25 bp, Mus musculus
aagccacttggcgatcctgaggttc

SEQ ID NO: 52826 - DNA, 25 bp, Mus musculus
aagccacttggctagtcagggtgtg

SEQ ID NO: 52827 - DNA, 25 bp, Mus musculus
aagccactttgacaggcattactgt

SEQ ID NO: 52828 - DNA, 25 bp, Mus musculus
aagccactttgagaggcattactgt

SEQ ID NO: 52829 - DNA, 25 bp, Mus musculus
aagccagaaaatccactgagccttc

SEQ ID NO: 52830 - DNA, 25 bp, Mus musculus
aagccagaaaatgcactgagccttc

SEQ ID NO: 52831 - DNA, 25 bp, Mus musculus
aagccagaaccaaccatgtgacaga

SEQ ID NO: 52832 - DNA, 25 bp, Mus musculus
aagccagaaccacatagcttgttgt

SEQ ID NO: 52833 - DNA, 25 bp, Mus musculus
aagccagaaccagatagcttgttgt

SEQ ID NO: 52834 - DNA, 25 bp, Mus musculus
aagccagaaccatccatgtgacaga

SEQ ID NO: 52835 - DNA, 25 bp, Mus musculus
aagccagaagagcaggttgcacaga

SEQ ID NO: 52836 - DNA, 25 bp, Mus musculus
aagccagaagaggaggttgcacaga

SEQ ID NO: 52837 - DNA, 25 bp, Mus musculus
aagccagaagcacccatttgatgac

SEQ ID NO: 52838 - DNA, 25 bp, Mus musculus
aagccagaagcagccatttgatgac

SEQ ID NO: 52839 - DNA, 25 bp, Mus musculus
aagccagaagctaccttctagctgc

SEQ ID NO: 52840 - DNA, 25 bp, Mus musculus
aagccagaagcttccttctagctgc

SEQ ID NO: 52841 - DNA, 25 bp, Mus musculus
aagccagaatctaaatgccctcctt

SEQ ID NO: 52842 - DNA, 25 bp, Mus musculus
aagccagaatcttaatgccctcctt

SEQ ID NO: 52843 - DNA, 25 bp, Mus musculus
aagccagacatccagacggttcgtt

SEQ ID NO: 52844 - DNA, 25 bp, Mus musculus
aagccagacatcgagacggttcgtt

SEQ ID NO: 52845 - DNA, 25 bp, Mus musculus
aagccagaccctaaaccagtgagtt

SEQ ID NO: 52846 - DNA, 25 bp, Mus musculus
aagccagacccttaaccagtgagtt

SEQ ID NO: 52847 - DNA, 25 bp, Mus musculus
aagccagactatcagaagctcaaga

SEQ ID NO: 52848 - DNA, 25 bp, Mus musculus
aagccagactatgagaagctcaaga

SEQ ID NO: 52849 - DNA, 25 bp, Mus musculus
aagccagactcacgtgacccagaat

SEQ ID NO: 52850 - DNA, 25 bp, Mus musculus
aagccagactcaggtgacccagaat

SEQ ID NO: 52851 - DNA, 25 bp, Mus musculus
aagccagacttgatggtgcgcacct

SEQ ID NO: 52852 - DNA, 25 bp, Mus musculus
aagccagacttgttggtgcgcacct

SEQ ID NO: 52853 - DNA, 25 bp, Mus musculus
aagccagagaaactgaaacgctgca

SEQ ID NO: 52854 - DNA, 25 bp, Mus musculus
aagccagagaaagtgaaacgctgca

SEQ ID NO: 52855 - DNA, 25 bp, Mus musculus
aagccagagagacgctaccgtggca

SEQ ID NO: 52856 - DNA, 25 bp, Mus musculus
aagccagagagaggctaccgtggca

SEQ ID NO: 52857 - DNA, 25 bp, Mus musculus
aagccagagcccatgtctggtcagc

SEQ ID NO: 52858 - DNA, 25 bp, Mus musculus
aagccagagcccctgaacttgaact

SEQ ID NO: 52859 - DNA, 25 bp, Mus musculus
aagccagagcccgtgaacttgaact

SEQ ID NO: 52860 - DNA, 25 bp, Mus musculus
aagccagagcccttgtctggtcagc

SEQ ID NO: 52861 - DNA, 25 bp, Mus musculus
aagccagagcctaacagctgctgtg

SEQ ID NO: 52862 - DNA, 25 bp, Mus musculus
aagccagagccttacagctgctgtg

SEQ ID NO: 52863 - DNA, 25 bp, Mus musculus
aagccagagctcactggtactcttt

SEQ ID NO: 52864 - DNA, 25 bp, Mus musculus
aagccagagctcatcaacggcagtg

SEQ ID NO: 52865 - DNA, 25 bp, Mus musculus
aagccagagctctctggtactcttt

SEQ ID NO: 52866 - DNA, 25 bp, Mus musculus
aagccagagctcttcaacggcagtg

SEQ ID NO: 52867 - DNA, 25 bp, Mus musculus
aagccagaggccaggaaccacgcca

SEQ ID NO: 52868 - DNA, 25 bp, Mus musculus
aagccagaggccaggcacggtgaca

SEQ ID NO: 52869 - DNA, 25 bp, Mus musculus
aagccagaggcctggaaccacgcca

SEQ ID NO: 52870 - DNA, 25 bp, Mus musculus
aagccagaggcctggcacggtgaca

SEQ ID NO: 52871 - DNA, 25 bp, Mus musculus
aagccagagggcacccacaaaactt

SEQ ID NO: 52872 - DNA, 25 bp, Mus musculus
aagccagagggctcccacaaaactt

SEQ ID NO: 52873 - DNA, 25 bp, Mus musculus
aagccagagtctccctcagatattt

SEQ ID NO: 52874 - DNA, 25 bp, Mus musculus
aagccagagtctcgagctggcctct

SEQ ID NO: 52875 - DNA, 25 bp, Mus musculus
aagccagagtctgcctcagatattt

SEQ ID NO: 52876 - DNA, 25 bp, Mus musculus
aagccagagtctggagctggcctct

SEQ ID NO: 52877 - DNA, 25 bp, Mus musculus
aagccagagttgagaagcatttaca

SEQ ID NO: 52878 - DNA, 25 bp, Mus musculus
aagccagagttgtgaagcatttaca

SEQ ID NO: 52879 - DNA, 25 bp, Mus musculus
aagccagagtttcacagcccagaat

SEQ ID NO: 52880 - DNA, 25 bp, Mus musculus
aagccagagtttgacagcccagaat

SEQ ID NO: 52881 - DNA, 25 bp, Mus musculus
aagccagatatcctaattccgggaa

SEQ ID NO: 52882 - DNA, 25 bp, Mus musculus
aagccagatatcgtaattccgggaa

SEQ ID NO: 52883 - DNA, 25 bp, Mus musculus
aagccagatctacgttcattcacaa

SEQ ID NO: 52884 - DNA, 25 bp, Mus musculus
aagccagatctaggttcattcacaa

SEQ ID NO: 52885 - DNA, 25 bp, Mus musculus
aagccagatcttaatatcccgtacc

SEQ ID NO: 52886 - DNA, 25 bp, Mus musculus
aagccagatctttatatcccgtacc

SEQ ID NO: 52887 - DNA, 25 bp, Mus musculus
aagccagatgctaccttagagagtg

SEQ ID NO: 52888 - DNA, 25 bp, Mus musculus
aagccagatgcttccttagagagtg

SEQ ID NO: 52889 - DNA, 25 bp, Mus musculus
aagccagatgtgacctagcactgag

SEQ ID NO: 52890 - DNA, 25 bp, Mus musculus
aagccagatgtgtcctagcactgag

SEQ ID NO: 52891 - DNA, 25 bp, Mus musculus
aagccagattgcctgagttctagcc

SEQ ID NO: 52892 - DNA, 25 bp, Mus musculus
aagccagattgcgtgagttctagcc

SEQ ID NO: 52893 - DNA, 25 bp, Mus musculus
aagccagcaagcatctttgcaaagc

SEQ ID NO: 52894 - DNA, 25 bp, Mus musculus
aagccagcaagccttagtgatcctt

SEQ ID NO: 52895 - DNA, 25 bp, Mus musculus
aagccagcaagcgttagtgatcctt

SEQ ID NO: 52896 - DNA, 25 bp, Mus musculus
aagccagcaagcttctttgcaaagc

SEQ ID NO: 52897 - DNA, 25 bp, Mus musculus
aagccagcaatccagtggtttcata

SEQ ID NO: 52898 - DNA, 25 bp, Mus musculus
aagccagcaatcgagtggtttcata

SEQ ID NO: 52899 - DNA, 25 bp, Mus musculus
aagccagcaattcttctaggctcca

SEQ ID NO: 52900 - DNA, 25 bp, Mus musculus
aagccagcaattgttctaggctcca

SEQ ID NO: 52901 - DNA, 25 bp, Mus musculus
aagccagcaccaagatgttcacaat

SEQ ID NO: 52902 - DNA, 25 bp, Mus musculus
aagccagcaccatgatgttcacaat

SEQ ID NO: 52903 - DNA, 25 bp, Mus musculus
aagccagcactacgtccagcagctt

SEQ ID NO: 52904 - DNA, 25 bp, Mus musculus
aagccagcactaggtccagcagctt

SEQ ID NO: 52905 - DNA, 25 bp, Mus musculus
aagccagcagacactgggattccat

SEQ ID NO: 52906 - DNA, 25 bp, Mus musculus
aagccagcagactctgggattccat

SEQ ID NO: 52907 - DNA, 25 bp, Mus musculus
aagccagcagatatccggaatcctg

SEQ ID NO: 52908 - DNA, 25 bp, Mus musculus
aagccagcagatttccggaatcctg

SEQ ID NO: 52909 - DNA, 25 bp, Mus musculus
aagccagcagcaacacagaagacag

SEQ ID NO: 52910 - DNA, 25 bp, Mus musculus
aagccagcagcacccgtgccatgaa

SEQ ID NO: 52911 - DNA, 25 bp, Mus musculus
aagccagcagcagccgtgccatgaa

SEQ ID NO: 52912 - DNA, 25 bp, Mus musculus
aagccagcagcatcacagaagacag

SEQ ID NO: 52913 - DNA, 25 bp, Mus musculus
aagccagcatacagcattgtgccta

SEQ ID NO: 52914 - DNA, 25 bp, Mus musculus
aagccagcatactgcattgtgccta

SEQ ID NO: 52915 - DNA, 25 bp, Mus musculus
aagccagcattgaccagtgtgtgca

SEQ ID NO: 52916 - DNA, 25 bp, Mus musculus
aagccagcattgtccagtgtgtgca

SEQ ID NO: 52917 - DNA, 25 bp, Mus musculus
aagccagccacgcatctgtgggagc

SEQ ID NO: 52918 - DNA, 25 bp, Mus musculus
aagccagccacggatctgtgggagc

SEQ ID NO: 52919 - DNA, 25 bp, Mus musculus
aagccagccagcatactgtgaggaa

SEQ ID NO: 52920 - DNA, 25 bp, Mus musculus
aagccagccagccatgccaattctg

SEQ ID NO: 52921 - DNA, 25 bp, Mus musculus
aagccagccagcgatgccaattctg

SEQ ID NO: 52922 - DNA, 25 bp, Mus musculus
aagccagccagcttactgtgaggaa

SEQ ID NO: 52923 - DNA, 25 bp, Mus musculus
aagccagccatcaactctttaaata

SEQ ID NO: 52924 - DNA, 25 bp, Mus musculus
aagccagccatctactctttaaata

SEQ ID NO: 52925 - DNA, 25 bp, Mus musculus
aagccagcccagcaggggtatgtta

SEQ ID NO: 52926 - DNA, 25 bp, Mus musculus
aagccagcccaggaggggtatgtta

SEQ ID NO: 52927 - DNA, 25 bp, Mus musculus
aagccagcccatctgtaatacattt

SEQ ID NO: 52928 - DNA, 25 bp, Mus musculus
aagccagcccatgtgtaatacattt

SEQ ID NO: 52929 - DNA, 25 bp, Mus musculus
aagccagccctacgctagactctgg

SEQ ID NO: 52930 - DNA, 25 bp, Mus musculus
aagccagccctaggctagactctgg

SEQ ID NO: 52931 - DNA, 25 bp, Mus musculus
aagccagccctgagctttcttttgt

SEQ ID NO: 52932 - DNA, 25 bp, Mus musculus
aagccagccctgtgctttcttttgt

SEQ ID NO: 52933 - DNA, 25 bp, Mus musculus
aagccagcccttagggattcagaac

SEQ ID NO: 52934 - DNA, 25 bp, Mus musculus
aagccagccctttgggattcagaac

SEQ ID NO: 52935 - DNA, 25 bp, Mus musculus
aagccagcctcgactatagaactag

SEQ ID NO: 52936 - DNA, 25 bp, Mus musculus
aagccagcctcgtctatagaactag

SEQ ID NO: 52937 - DNA, 25 bp, Mus musculus
aagccagcctggctctccataaaat

SEQ ID NO: 52938 - DNA, 25 bp, Mus musculus
aagccagcctgggtctccataaaat

SEQ ID NO: 52939 - DNA, 25 bp, Mus musculus
aagccagccttaaaatcttgatgtg

SEQ ID NO: 52940 - DNA, 25 bp, Mus musculus
aagccagccttataatcttgatgtg

SEQ ID NO: 52941 - DNA, 25 bp, Mus musculus
aagccagccttgcaggtaccatcta

SEQ ID NO: 52942 - DNA, 25 bp, Mus musculus
aagccagccttggaggtaccatcta

SEQ ID NO: 52943 - DNA, 25 bp, Mus musculus
aagccagcgacgaccatcaggtggt

SEQ ID NO: 52944 - DNA, 25 bp, Mus musculus
aagccagcgacgtccatcaggtggt

SEQ ID NO: 52945 - DNA, 25 bp, Mus musculus
aagccagcgatgattctagttctga

SEQ ID NO: 52946 - DNA, 25 bp, Mus musculus
aagccagcgatgtttctagttctga

SEQ ID NO: 52947 - DNA, 25 bp, Mus musculus
aagccagcggagcagaaactttcca

SEQ ID NO: 52948 - DNA, 25 bp, Mus musculus
aagccagcggaggagaaactttcca

SEQ ID NO: 52949 - DNA, 25 bp, Mus musculus
aagccagcgtggctaggagatacac

SEQ ID NO: 52950 - DNA, 25 bp, Mus musculus
aagccagcgtgggtaggagatacac

SEQ ID NO: 52951 - DNA, 25 bp, Mus musculus
aagccagctactacacatgagacct

SEQ ID NO: 52952 - DNA, 25 bp, Mus musculus
aagccagctacttcacatgagacct

SEQ ID NO: 52953 - DNA, 25 bp, Mus musculus
aagccagctaggagcaaaataacgc

SEQ ID NO: 52954 - DNA, 25 bp, Mus musculus
aagccagctaggtgcaaaataacgc

SEQ ID NO: 52955 - DNA, 25 bp, Mus musculus
aagccagctctgacaagagttccaa

SEQ ID NO: 52956 - DNA, 25 bp, Mus musculus
aagccagctctgtcaagagttccaa

SEQ ID NO: 52957 - DNA, 25 bp, Mus musculus
aagccagctggcacacaggtcacga

SEQ ID NO: 52958 - DNA, 25 bp, Mus musculus
aagccagctggccatggccttgtcc

SEQ ID NO: 52959 - DNA, 25 bp, Mus musculus
aagccagctggcgatggccttgtcc

SEQ ID NO: 52960 - DNA, 25 bp, Mus musculus
aagccagctggctcacaggtcacga

SEQ ID NO: 52961 - DNA, 25 bp, Mus musculus
aagccagctgtacgtatctttattt

SEQ ID NO: 52962 - DNA, 25 bp, Mus musculus
aagccagctgtaggtatctttattt

SEQ ID NO: 52963 - DNA, 25 bp, Mus musculus
aagccagctgtgctattcctgacca

SEQ ID NO: 52964 - DNA, 25 bp, Mus musculus
aagccagctgtggtattcctgacca

SEQ ID NO: 52965 - DNA, 25 bp, Mus musculus
aagccagcttgacggtgataactct

SEQ ID NO: 52966 - DNA, 25 bp, Mus musculus
aagccagcttgactccctggaaacg

SEQ ID NO: 52967 - DNA, 25 bp, Mus musculus
aagccagcttgagggtgataactct

SEQ ID NO: 52968 - DNA, 25 bp, Mus musculus
aagccagcttgagtccctggaaacg

SEQ ID NO: 52969 - DNA, 25 bp, Mus musculus
aagccagctttaaaaacccattcca

SEQ ID NO: 52970 - DNA, 25 bp, Mus musculus
aagccagctttataaacccattcca

SEQ ID NO: 52971 - DNA, 25 bp, Mus musculus
aagccagctttcagtcacttatcca

SEQ ID NO: 52972 - DNA, 25 bp, Mus musculus
aagccagctttctgtcacttatcca

SEQ ID NO: 52973 - DNA, 25 bp, Mus musculus
aagccaggaccaatgcaaatgtgaa

SEQ ID NO: 52974 - DNA, 25 bp, Mus musculus
aagccaggaccattgcaaatgtgaa

SEQ ID NO: 52975 - DNA, 25 bp, Mus musculus
aagccaggagacagtcctgtacaca

SEQ ID NO: 52976 - DNA, 25 bp, Mus musculus
aagccaggagactgtcctgtacaca

SEQ ID NO: 52977 - DNA, 25 bp, Mus musculus
aagccaggaggccagatgccacaaa

SEQ ID NO: 52978 - DNA, 25 bp, Mus musculus
aagccaggaggcgagatgccacaaa

SEQ ID NO: 52979 - DNA, 25 bp, Mus musculus
aagccaggatgcactgtacactctg

SEQ ID NO: 52980 - DNA, 25 bp, Mus musculus
aagccaggatgctctgtacactctg

SEQ ID NO: 52981 - DNA, 25 bp, Mus musculus
aagccaggcacccatctctggatgc

SEQ ID NO: 52982 - DNA, 25 bp, Mus musculus
aagccaggcaccgatctctggatgc

SEQ ID NO: 52983 - DNA, 25 bp, Mus musculus
aagccaggcacgatactacaactct

SEQ ID NO: 52984 - DNA, 25 bp, Mus musculus
aagccaggcacgctgactgatacct

SEQ ID NO: 52985 - DNA, 25 bp, Mus musculus
aagccaggcacggtgactgatacct

SEQ ID NO: 52986 - DNA, 25 bp, Mus musculus
aagccaggcacgttactacaactct

SEQ ID NO: 52987 - DNA, 25 bp, Mus musculus
aagccaggcagaaggtcctgtctgt

SEQ ID NO: 52988 - DNA, 25 bp, Mus musculus
aagccaggcagatggtcctgtctgt

SEQ ID NO: 52989 - DNA, 25 bp, Mus musculus
aagccaggcatcagtcatctcatta

SEQ ID NO: 52990 - DNA, 25 bp, Mus musculus
aagccaggcatcatctccaaagcag

SEQ ID NO: 52991 - DNA, 25 bp, Mus musculus
aagccaggcatctgtcatctcatta

SEQ ID NO: 52992 - DNA, 25 bp, Mus musculus
aagccaggcatcttctccaaagcag

SEQ ID NO: 52993 - DNA, 25 bp, Mus musculus
aagccaggcatgatcagttttgaga

SEQ ID NO: 52994 - DNA, 25 bp, Mus musculus
aagccaggcatgttcagttttgaga

SEQ ID NO: 52995 - DNA, 25 bp, Mus musculus
aagccaggcctacagacgaagatca

SEQ ID NO: 52996 - DNA, 25 bp, Mus musculus
aagccaggcctagagacgaagatca

SEQ ID NO: 52997 - DNA, 25 bp, Mus musculus
aagccaggcctccttttgttgtggg

SEQ ID NO: 52998 - DNA, 25 bp, Mus musculus
aagccaggcctcgttttgttgtggg

SEQ ID NO: 52999 - DNA, 25 bp, Mus musculus
aagccaggctctcaccatggcagat

SEQ ID NO: 53000 - DNA, 25 bp, Mus musculus
aagccaggctctgaccatggcagat

SEQ ID NO: 53001 - DNA, 25 bp, Mus musculus
aagccaggctgcaacaagagacccc

SEQ ID NO: 53002 - DNA, 25 bp, Mus musculus
aagccaggctgctacaagagacccc

SEQ ID NO: 53003 - DNA, 25 bp, Mus musculus
aagccaggctttacagttagtctga

SEQ ID NO: 53004 - DNA, 25 bp, Mus musculus
aagccaggcttttcagttagtctga

SEQ ID NO: 53005 - DNA, 25 bp, Mus musculus
aagccagggaccatggcagctgcca

SEQ ID NO: 53006 - DNA, 25 bp, Mus musculus
aagccagggaccttggcagctgcca

SEQ ID NO: 53007 - DNA, 25 bp, Mus musculus
aagccagggcagctaagaactgatg

SEQ ID NO: 53008 - DNA, 25 bp, Mus musculus
aagccagggcaggtaagaactgatg

SEQ ID NO: 53009 - DNA, 25 bp, Mus musculus
aagccagggccacgtgttcgtcagc

SEQ ID NO: 53010 - DNA, 25 bp, Mus musculus
aagccagggccaggtgttcgtcagc

SEQ ID NO: 53011 - DNA, 25 bp, Mus musculus
aagccagggcccagagcccttggct

SEQ ID NO: 53012 - DNA, 25 bp, Mus musculus
aagccagggccctgagcccttggct

SEQ ID NO: 53013 - DNA, 25 bp, Mus musculus
aagccaggggtgctgccaaacatct

SEQ ID NO: 53014 - DNA, 25 bp, Mus musculus
aagccaggggtggtgccaaacatct

SEQ ID NO: 53015 - DNA, 25 bp, Mus musculus
aagccagggtctaacacacatgtat

SEQ ID NO: 53016 - DNA, 25 bp, Mus musculus
aagccagggtcttacacacatgtat

SEQ ID NO: 53017 - DNA, 25 bp, Mus musculus
aagccaggtaagcagcctctttcat

SEQ ID NO: 53018 - DNA, 25 bp, Mus musculus
aagccaggtaaggagcctctttcat

SEQ ID NO: 53019 - DNA, 25 bp, Mus musculus
aagccaggtctacagcaagccacag

SEQ ID NO: 53020 - DNA, 25 bp, Mus musculus
aagccaggtctagagcaagccacag

SEQ ID NO: 53021 - DNA, 25 bp, Mus musculus
aagccaggtgaacctgaggtcgtca

SEQ ID NO: 53022 - DNA, 25 bp, Mus musculus
aagccaggtgaagctgaggtcgtca

SEQ ID NO: 53023 - DNA, 25 bp, Mus musculus
aagccaggtgacattacacacccat

SEQ ID NO: 53024 - DNA, 25 bp, Mus musculus
aagccaggtgactttacacacccat

SEQ ID NO: 53025 - DNA, 25 bp, Mus musculus
aagccaggtgagcaacgagcctcgc

SEQ ID NO: 53026 - DNA, 25 bp, Mus musculus
aagccaggtgaggaacgagcctcgc

SEQ ID NO: 53027 - DNA, 25 bp, Mus musculus
aagccaggtgctctcatagtgcagt

SEQ ID NO: 53028 - DNA, 25 bp, Mus musculus
aagccaggtgctgtcatagtgcagt

SEQ ID NO: 53029 - DNA, 25 bp, Mus musculus
aagccaggttacatccatcttgaaa

SEQ ID NO: 53030 - DNA, 25 bp, Mus musculus
aagccaggttacttccatcttgaaa

SEQ ID NO: 53031 - DNA, 25 bp, Mus musculus
aagccagtaaacctgcaagcagacc

SEQ ID NO: 53032 - DNA, 25 bp, Mus musculus
aagccagtaaacgtgcaagcagacc

SEQ ID NO: 53033 - DNA, 25 bp, Mus musculus
aagccagtaaggatgtagtctgctc

SEQ ID NO: 53034 - DNA, 25 bp, Mus musculus
aagccagtaaggttgtagtctgctc

SEQ ID NO: 53035 - DNA, 25 bp, Mus musculus
aagccagtacaccagagggctgacc

SEQ ID NO: 53036 - DNA, 25 bp, Mus musculus
aagccagtacacgagagggctgacc

SEQ ID NO: 53037 - DNA, 25 bp, Mus musculus
aagccagtacatagcctatgtctgt

SEQ ID NO: 53038 - DNA, 25 bp, Mus musculus
aagccagtacattgcctatgtctgt

SEQ ID NO: 53039 - DNA, 25 bp, Mus musculus
aagccagtacccagtctttgtcaag

SEQ ID NO: 53040 - DNA, 25 bp, Mus musculus
aagccagtaccctgtctttgtcaag

SEQ ID NO: 53041 - DNA, 25 bp, Mus musculus
aagccagtacttctcagcggaggag

SEQ ID NO: 53042 - DNA, 25 bp, Mus musculus
aagccagtacttgtcagcggaggag

SEQ ID NO: 53043 - DNA, 25 bp, Mus musculus
aagccagtagctatcacttctcttt

SEQ ID NO: 53044 - DNA, 25 bp, Mus musculus
aagccagtagctttcacttctcttt

SEQ ID NO: 53045 - DNA, 25 bp, Mus musculus
aagccagtcaatcgtccagcatgga

SEQ ID NO: 53046 - DNA, 25 bp, Mus musculus
aagccagtcaatggtccagcatgga

SEQ ID NO: 53047 - DNA, 25 bp, Mus musculus
aagccagtcacacattacaccatat

SEQ ID NO: 53048 - DNA, 25 bp, Mus musculus
aagccagtcacagattacaccatat

SEQ ID NO: 53049 - DNA, 25 bp, Mus musculus
aagccagtcggcctggtctttaagt

SEQ ID NO: 53050 - DNA, 25 bp, Mus musculus
aagccagtcggcgtggtctttaagt

SEQ ID NO: 53051 - DNA, 25 bp, Mus musculus
aagccagtctgacatatctaacaag

SEQ ID NO: 53052 - DNA, 25 bp, Mus musculus
aagccagtctgagatatctaacaag

SEQ ID NO: 53053 - DNA, 25 bp, Mus musculus
aagccagtcttcctggcatcaccaa

SEQ ID NO: 53054 - DNA, 25 bp, Mus musculus
aagccagtcttcgtggcatcaccaa

SEQ ID NO: 53055 - DNA, 25 bp, Mus musculus
aagccagtgacccagataactcaca

SEQ ID NO: 53056 - DNA, 25 bp, Mus musculus
aagccagtgaccgagataactcaca

SEQ ID NO: 53057 - DNA, 25 bp, Mus musculus
aagccagtgattccagagcgcaagt

SEQ ID NO: 53058 - DNA, 25 bp, Mus musculus
aagccagtgattgcagagcgcaagt

SEQ ID NO: 53059 - DNA, 25 bp, Mus musculus
aagccagtgctaatcagtttataaa

SEQ ID NO: 53060 - DNA, 25 bp, Mus musculus
aagccagtgctattcagtttataaa

SEQ ID NO: 53061 - DNA, 25 bp, Mus musculus
aagccagtggctatgccagcgggac

SEQ ID NO: 53062 - DNA, 25 bp, Mus musculus
aagccagtggctttgccagcgggac

SEQ ID NO: 53063 - DNA, 25 bp, Mus musculus
aagccagtgggccatcaaaactttt

SEQ ID NO: 53064 - DNA, 25 bp, Mus musculus
aagccagtgggcgatcaaaactttt

SEQ ID NO: 53065 - DNA, 25 bp, Mus musculus
aagccagtggtcactgtgaactcca

SEQ ID NO: 53066 - DNA, 25 bp, Mus musculus
aagccagtggtctctgtgaactcca

SEQ ID NO: 53067 - DNA, 25 bp, Mus musculus
aagccagtggtgattgcatagattc

SEQ ID NO: 53068 - DNA, 25 bp, Mus musculus
aagccagtggtgtttgcatagattc

SEQ ID NO: 53069 - DNA, 25 bp, Mus musculus
aagccagtggttccggctgagctct

SEQ ID NO: 53070 - DNA, 25 bp, Mus musculus
aagccagtggttgcggctgagctct

SEQ ID NO: 53071 - DNA, 25 bp, Mus musculus
aagccagtgtatctcttaagcctct

SEQ ID NO: 53072 - DNA, 25 bp, Mus musculus
aagccagtgtatgtcttaagcctct

SEQ ID NO: 53073 - DNA, 25 bp, Mus musculus
aagccagtgtttatatttgtgaggt

SEQ ID NO: 53074 - DNA, 25 bp, Mus musculus
aagccagtgtttttatttgtgaggt

SEQ ID NO: 53075 - DNA, 25 bp, Mus musculus
aagccagttaggaagactgactcgt

SEQ ID NO: 53076 - DNA, 25 bp, Mus musculus
aagccagttaggtagactgactcgt

SEQ ID NO: 53077 - DNA, 25 bp, Mus musculus
aagccagttagtactccagattgga

SEQ ID NO: 53078 - DNA, 25 bp, Mus musculus
aagccagttagttctccagattgga

SEQ ID NO: 53079 - DNA, 25 bp, Mus musculus
aagccagttcaaaatgtcctcgttg

SEQ ID NO: 53080 - DNA, 25 bp, Mus musculus
aagccagttcaatatgtcctcgttg

SEQ ID NO: 53081 - DNA, 25 bp, Mus musculus
aagccagttgtcacaagggtatcac

SEQ ID NO: 53082 - DNA, 25 bp, Mus musculus
aagccagttgtcatagcactcaggg

SEQ ID NO: 53083 - DNA, 25 bp, Mus musculus
aagccagttgtcattaaacaggtga

SEQ ID NO: 53084 - DNA, 25 bp, Mus musculus
aagccagttgtctcaagggtatcac

SEQ ID NO: 53085 - DNA, 25 bp, Mus musculus
aagccagttgtcttagcactcaggg

SEQ ID NO: 53086 - DNA, 25 bp, Mus musculus
aagccagttgtctttaaacaggtga

SEQ ID NO: 53087 - DNA, 25 bp, Mus musculus
aagccagtttacaccagtgtgctcc

SEQ ID NO: 53088 - DNA, 25 bp, Mus musculus
aagccagtttactccagtgtgctcc

SEQ ID NO: 53089 - DNA, 25 bp, Mus musculus
aagccagtttgtattcctttctgaa

SEQ ID NO: 53090 - DNA, 25 bp, Mus musculus
aagccagtttgtcactcagttcctt

SEQ ID NO: 53091 - DNA, 25 bp, Mus musculus
aagccagtttgtgactcagttcctt

SEQ ID NO: 53092 - DNA, 25 bp, Mus musculus
aagccagtttgttttcctttctgaa

SEQ ID NO: 53093 - DNA, 25 bp, Mus musculus
aagccagtttttcagatcctgccta

SEQ ID NO: 53094 - DNA, 25 bp, Mus musculus
aagccagtttttgagatcctgccta

SEQ ID NO: 53095 - DNA, 25 bp, Mus musculus
aagccataacagctttcattttgaa

SEQ ID NO: 53096 - DNA, 25 bp, Mus musculus
aagccataacaggtttcattttgaa

SEQ ID NO: 53097 - DNA, 25 bp, Mus musculus
aagccataaccacgcatctgctgat

SEQ ID NO: 53098 - DNA, 25 bp, Mus musculus
aagccataaccaggcatctgctgat

SEQ ID NO: 53099 - DNA, 25 bp, Mus musculus
aagccataaggcacgttgagtagaa

SEQ ID NO: 53100 - DNA, 25 bp, Mus musculus
aagccataaggctcgttgagtagaa

SEQ ID NO: 53101 - DNA, 25 bp, Mus musculus
aagccataatgtccgagcggctggt

SEQ ID NO: 53102 - DNA, 25 bp, Mus musculus
aagccataatgtgcgagcggctggt

SEQ ID NO: 53103 - DNA, 25 bp, Mus musculus
aagccatacagtattactactgata

SEQ ID NO: 53104 - DNA, 25 bp, Mus musculus
aagccatacagttttactactgata

SEQ ID NO: 53105 - DNA, 25 bp, Mus musculus
aagccatacgttatagtgctgacac

SEQ ID NO: 53106 - DNA, 25 bp, Mus musculus
aagccatacgttttagtgctgacac

SEQ ID NO: 53107 - DNA, 25 bp, Mus musculus
aagccatacttccacttgtacactt

SEQ ID NO: 53108 - DNA, 25 bp, Mus musculus
aagccatacttcgacttgtacactt

SEQ ID NO: 53109 - DNA, 25 bp, Mus musculus
aagccatagaatatcagcatccctg

SEQ ID NO: 53110 - DNA, 25 bp, Mus musculus
aagccatagaatttcagcatccctg

SEQ ID NO: 53111 - DNA, 25 bp, Mus musculus
aagccatagatacgcttttccttgt

SEQ ID NO: 53112 - DNA, 25 bp, Mus musculus
aagccatagataggcttttccttgt

SEQ ID NO: 53113 - DNA, 25 bp, Mus musculus
aagccatagctaatgtcattccctg

SEQ ID NO: 53114 - DNA, 25 bp, Mus musculus
aagccatagctattgtcattccctg

SEQ ID NO: 53115 - DNA, 25 bp, Mus musculus
aagccataggaaattccatcttcca

SEQ ID NO: 53116 - DNA, 25 bp, Mus musculus
aagccataggaatttccatcttcca

SEQ ID NO: 53117 - DNA, 25 bp, Mus musculus
aagccatagtagctgaagacctcta

SEQ ID NO: 53118 - DNA, 25 bp, Mus musculus
aagccatagtaggtgaagacctcta

SEQ ID NO: 53119 - DNA, 25 bp, Mus musculus
aagccatagtccaactcccatggga

SEQ ID NO: 53120 - DNA, 25 bp, Mus musculus
aagccatagtcctactcccatggga

SEQ ID NO: 53121 - DNA, 25 bp, Mus musculus
aagccatagtgccacagacctcaat

SEQ ID NO: 53122 - DNA, 25 bp, Mus musculus
aagccatagtgcgacagacctcaat

SEQ ID NO: 53123 - DNA, 25 bp, Mus musculus
aagccatagttaaacagggccatgt

SEQ ID NO: 53124 - DNA, 25 bp, Mus musculus
aagccatagttatacagggccatgt

SEQ ID NO: 53125 - DNA, 25 bp, Mus musculus
aagccatagttgcactgtcacttcc

SEQ ID NO: 53126 - DNA, 25 bp, Mus musculus
aagccatagttggactgtcacttcc

SEQ ID NO: 53127 - DNA, 25 bp, Mus musculus
aagccatatacactggccagatgtc

SEQ ID NO: 53128 - DNA, 25 bp, Mus musculus
aagccatatacagtggccagatgtc

SEQ ID NO: 53129 - DNA, 25 bp, Mus musculus
aagccatatgccagctcagagtgcg

SEQ ID NO: 53130 - DNA, 25 bp, Mus musculus
aagccatatgcctgctcagagtgcg

SEQ ID NO: 53131 - DNA, 25 bp, Mus musculus
aagccatattctccctgcgtgtatt

SEQ ID NO: 53132 - DNA, 25 bp, Mus musculus
aagccatattctgcctgcgtgtatt

SEQ ID NO: 53133 - DNA, 25 bp, Mus musculus
aagccatattgaccctgtgtctgac

SEQ ID NO: 53134 - DNA, 25 bp, Mus musculus
aagccatattgagcctgtgtctgac

SEQ ID NO: 53135 - DNA, 25 bp, Mus musculus
aagccatatttcagaccgacgttac

SEQ ID NO: 53136 - DNA, 25 bp, Mus musculus
aagccatatttctgaccgacgttac

SEQ ID NO: 53137 - DNA, 25 bp, Mus musculus
aagccatcaaagcaaagcacgtatt

SEQ ID NO: 53138 - DNA, 25 bp, Mus musculus
aagccatcaaaggaaagcacgtatt

SEQ ID NO: 53139 - DNA, 25 bp, Mus musculus
aagccatcagaaatcgatacaaata

SEQ ID NO: 53140 - DNA, 25 bp, Mus musculus
aagccatcagaattcgatacaaata

SEQ ID NO: 53141 - DNA, 25 bp, Mus musculus
aagccatcagcactcttggtagaga

SEQ ID NO: 53142 - DNA, 25 bp, Mus musculus
aagccatcagcactgggtgtgctca

SEQ ID NO: 53143 - DNA, 25 bp, Mus musculus
aagccatcagcagtcttggtagaga

SEQ ID NO: 53144 - DNA, 25 bp, Mus musculus
aagccatcagcagtgggtgtgctca

SEQ ID NO: 53145 - DNA, 25 bp, Mus musculus
aagccatcagtgaggtcttcaacaa

SEQ ID NO: 53146 - DNA, 25 bp, Mus musculus
aagccatcagtgtggtcttcaacaa

SEQ ID NO: 53147 - DNA, 25 bp, Mus musculus
aagccatcagttccagtcttgttat

SEQ ID NO: 53148 - DNA, 25 bp, Mus musculus
aagccatcagttgcagtcttgttat

SEQ ID NO: 53149 - DNA, 25 bp, Mus musculus
aagccatcattgaaagatccacctt

SEQ ID NO: 53150 - DNA, 25 bp, Mus musculus
aagccatcattgtaagatccacctt

SEQ ID NO: 53151 - DNA, 25 bp, Mus musculus
aagccatccaacatgagttctttga

SEQ ID NO: 53152 - DNA, 25 bp, Mus musculus
aagccatccaacttgagttctttga

SEQ ID NO: 53153 - DNA, 25 bp, Mus musculus
aagccatccaagagctctcattctt

SEQ ID NO: 53154 - DNA, 25 bp, Mus musculus
aagccatccaagtgctctcattctt

SEQ ID NO: 53155 - DNA, 25 bp, Mus musculus
aagccatccaatacttgcacaacac

SEQ ID NO: 53156 - DNA, 25 bp, Mus musculus
aagccatccaattcttgcacaacac

SEQ ID NO: 53157 - DNA, 25 bp, Mus musculus
aagccatccacaacatctgtcacat

SEQ ID NO: 53158 - DNA, 25 bp, Mus musculus
aagccatccacatcatctgtcacat

SEQ ID NO: 53159 - DNA, 25 bp, Mus musculus
aagccatccagtctgctgtgaacgt

SEQ ID NO: 53160 - DNA, 25 bp, Mus musculus
aagccatccagtgtgctgtgaacgt

SEQ ID NO: 53161 - DNA, 25 bp, Mus musculus
aagccatccccaagggtctgctgac

SEQ ID NO: 53162 - DNA, 25 bp, Mus musculus
aagccatccccatgggtctgctgac

SEQ ID NO: 53163 - DNA, 25 bp, Mus musculus
aagccatccccgagaaagccagtga

SEQ ID NO: 53164 - DNA, 25 bp, Mus musculus
aagccatccccgtgaaagccagtga

SEQ ID NO: 53165 - DNA, 25 bp, Mus musculus
aagccatcccgtcagaggtgtgcaa

SEQ ID NO: 53166 - DNA, 25 bp, Mus musculus
aagccatcccgtgagaggtgtgcaa

SEQ ID NO: 53167 - DNA, 25 bp, Mus musculus
aagccatccctgctctggacaaact

SEQ ID NO: 53168 - DNA, 25 bp, Mus musculus
aagccatccctgcttcaatgacatc

SEQ ID NO: 53169 - DNA, 25 bp, Mus musculus
aagccatccctggtctggacaaact

SEQ ID NO: 53170 - DNA, 25 bp, Mus musculus
aagccatccctggttcaatgacatc

SEQ ID NO: 53171 - DNA, 25 bp, Mus musculus
aagccatccggtcatgtgtgcagca

SEQ ID NO: 53172 - DNA, 25 bp, Mus musculus
aagccatccggtgatgtgtgcagca

SEQ ID NO: 53173 - DNA, 25 bp, Mus musculus
aagccatcctcgactctagaaatga

SEQ ID NO: 53174 - DNA, 25 bp, Mus musculus
aagccatcctcgtctctagaaatga

SEQ ID NO: 53175 - DNA, 25 bp, Mus musculus
aagccatcctgcctttaactttgtc

SEQ ID NO: 53176 - DNA, 25 bp, Mus musculus
aagccatcctgcgtttaactttgtc

SEQ ID NO: 53177 - DNA, 25 bp, Mus musculus
aagccatccttacccctatttaatg

SEQ ID NO: 53178 - DNA, 25 bp, Mus musculus
aagccatccttagccctatttaatg

SEQ ID NO: 53179 - DNA, 25 bp, Mus musculus
aagccatccttcagttttcctgttt

SEQ ID NO: 53180 - DNA, 25 bp, Mus musculus
aagccatccttctgttttcctgttt

SEQ ID NO: 53181 - DNA, 25 bp, Mus musculus
aagccatccttgagctaagagatct

SEQ ID NO: 53182 - DNA, 25 bp, Mus musculus
aagccatccttgtgctaagagatct

SEQ ID NO: 53183 - DNA, 25 bp, Mus musculus
aagccatcgagcacacacaggaaga

SEQ ID NO: 53184 - DNA, 25 bp, Mus musculus
aagccatcgagctcacacaggaaga

SEQ ID NO: 53185 - DNA, 25 bp, Mus musculus
aagccatcgggaatgtcgtgtccgc

SEQ ID NO: 53186 - DNA, 25 bp, Mus musculus
aagccatcgggattgtcgtgtccgc

SEQ ID NO: 53187 - DNA, 25 bp, Mus musculus
aagccatctacgctgcagtggatga

SEQ ID NO: 53188 - DNA, 25 bp, Mus musculus
aagccatctacggtgcagtggatga

SEQ ID NO: 53189 - DNA, 25 bp, Mus musculus
aagccatctcaaaatcctatcatga

SEQ ID NO: 53190 - DNA, 25 bp, Mus musculus
aagccatctcaacagtcagcagcca

SEQ ID NO: 53191 - DNA, 25 bp, Mus musculus
aagccatctcaagagtcagcagcca

SEQ ID NO: 53192 - DNA, 25 bp, Mus musculus
aagccatctcaatatcctatcatga

SEQ ID NO: 53193 - DNA, 25 bp, Mus musculus
aagccatctccaaagctccttggaa

SEQ ID NO: 53194 - DNA, 25 bp, Mus musculus
aagccatctccatagctccttggaa

SEQ ID NO: 53195 - DNA, 25 bp, Mus musculus
aagccatctcccagtcaggacaatt

SEQ ID NO: 53196 - DNA, 25 bp, Mus musculus
aagccatctccctgtcaggacaatt

SEQ ID NO: 53197 - DNA, 25 bp, Mus musculus
aagccatctcctacttaactgtttc

SEQ ID NO: 53198 - DNA, 25 bp, Mus musculus
aagccatctccttcttaactgtttc

SEQ ID NO: 53199 - DNA, 25 bp, Mus musculus
aagccatctcgcagtgattctttaa

SEQ ID NO: 53200 - DNA, 25 bp, Mus musculus
aagccatctcgctgtgattctttaa

SEQ ID NO: 53201 - DNA, 25 bp, Mus musculus
aagccatctctaccttagtcagggc

SEQ ID NO: 53202 - DNA, 25 bp, Mus musculus
aagccatctctagcttagtcagggc

SEQ ID NO: 53203 - DNA, 25 bp, Mus musculus
aagccatctgcgacttggtggttca

SEQ ID NO: 53204 - DNA, 25 bp, Mus musculus
aagccatctgcgaggtcatagacca

SEQ ID NO: 53205 - DNA, 25 bp, Mus musculus
aagccatctgcgtcttggtggttca

SEQ ID NO: 53206 - DNA, 25 bp, Mus musculus
aagccatctgcgtggtcatagacca

SEQ ID NO: 53207 - DNA, 25 bp, Mus musculus
aagccatcttctcactggtagagct

SEQ ID NO: 53208 - DNA, 25 bp, Mus musculus
aagccatcttctgactggtagagct

SEQ ID NO: 53209 - DNA, 25 bp, Mus musculus
aagccatgaaagaaggacggtacac

SEQ ID NO: 53210 - DNA, 25 bp, Mus musculus
aagccatgaaagtaggacggtacac

SEQ ID NO: 53211 - DNA, 25 bp, Mus musculus
aagccatgaagaccggcgtatgtct

SEQ ID NO: 53212 - DNA, 25 bp, Mus musculus
aagccatgaagagcggcgtatgtct

SEQ ID NO: 53213 - DNA, 25 bp, Mus musculus
aagccatgaccgaggagtccagaga

SEQ ID NO: 53214 - DNA, 25 bp, Mus musculus
aagccatgaccgtggagtccagaga

SEQ ID NO: 53215 - DNA, 25 bp, Mus musculus
aagccatgacggacaggcggctgtt

SEQ ID NO: 53216 - DNA, 25 bp, Mus musculus
aagccatgacggtcaggcggctgtt

SEQ ID NO: 53217 - DNA, 25 bp, Mus musculus
aagccatgacttccgttttagccag

SEQ ID NO: 53218 - DNA, 25 bp, Mus musculus
aagccatgacttgcgttttagccag

SEQ ID NO: 53219 - DNA, 25 bp, Mus musculus
aagccatgaggcagaagatctccaa

SEQ ID NO: 53220 - DNA, 25 bp, Mus musculus
aagccatgaggctgaagatctccaa

SEQ ID NO: 53221 - DNA, 25 bp, Mus musculus
aagccatgcagacacatcctgtaac

SEQ ID NO: 53222 - DNA, 25 bp, Mus musculus
aagccatgcagagacatcctgtaac

SEQ ID NO: 53223 - DNA, 25 bp, Mus musculus
aagccatgcatgactaagtacgcac

SEQ ID NO: 53224 - DNA, 25 bp, Mus musculus
aagccatgcatgtctaagtacgcac

SEQ ID NO: 53225 - DNA, 25 bp, Mus musculus
aagccatgcattcagacttcccaga

SEQ ID NO: 53226 - DNA, 25 bp, Mus musculus
aagccatgcattgagacttcccaga

SEQ ID NO: 53227 - DNA, 25 bp, Mus musculus
aagccatgcccgaagggtaattcca

SEQ ID NO: 53228 - DNA, 25 bp, Mus musculus
aagccatgcccgtagggtaattcca

SEQ ID NO: 53229 - DNA, 25 bp, Mus musculus
aagccatgccctatgagttaagtcg

SEQ ID NO: 53230 - DNA, 25 bp, Mus musculus
aagccatgccctttgagttaagtcg

SEQ ID NO: 53231 - DNA, 25 bp, Mus musculus
aagccatgccgcctggtcagaagac

SEQ ID NO: 53232 - DNA, 25 bp, Mus musculus
aagccatgccgcgtggtcagaagac

SEQ ID NO: 53233 - DNA, 25 bp, Mus musculus
aagccatgccttcatgttaatctaa

SEQ ID NO: 53234 - DNA, 25 bp, Mus musculus
aagccatgccttgatgttaatctaa

SEQ ID NO: 53235 - DNA, 25 bp, Mus musculus
aagccatgcggcaagtctcccagga

SEQ ID NO: 53236 - DNA, 25 bp, Mus musculus
aagccatgcggctagtctcccagga

SEQ ID NO: 53237 - DNA, 25 bp, Mus musculus
aagccatgctcacgttccacacaag

SEQ ID NO: 53238 - DNA, 25 bp, Mus musculus
aagccatgctcaggttccacacaag

SEQ ID NO: 53239 - DNA, 25 bp, Mus musculus
aagccatgctctacaaactggccag

SEQ ID NO: 53240 - DNA, 25 bp, Mus musculus
aagccatgctcttcaaactggccag

SEQ ID NO: 53241 - DNA, 25 bp, Mus musculus
aagccatggaaaccagctcccgcga

SEQ ID NO: 53242 - DNA, 25 bp, Mus musculus
aagccatggaaagcagctcccgcga

SEQ ID NO: 53243 - DNA, 25 bp, Mus musculus
aagccatggatgagaccacaacctc

SEQ ID NO: 53244 - DNA, 25 bp, Mus musculus
aagccatggatgtgaccacaacctc

SEQ ID NO: 53245 - DNA, 25 bp, Mus musculus
aagccatggcagagtctctaagttc

SEQ ID NO: 53246 - DNA, 25 bp, Mus musculus
aagccatggcagtgtctctaagttc

SEQ ID NO: 53247 - DNA, 25 bp, Mus musculus
aagccatggccaaatttaatgtcat

SEQ ID NO: 53248 - DNA, 25 bp, Mus musculus
aagccatggccatatttaatgtcat

SEQ ID NO: 53249 - DNA, 25 bp, Mus musculus
aagccatggctcagtgtctatgcag

SEQ ID NO: 53250 - DNA, 25 bp, Mus musculus
aagccatggctctgtgtctatgcag

SEQ ID NO: 53251 - DNA, 25 bp, Mus musculus
aagccatggtgcctgaaacccttaa

SEQ ID NO: 53252 - DNA, 25 bp, Mus musculus
aagccatggtgcgtgaaacccttaa

SEQ ID NO: 53253 - DNA, 25 bp, Mus musculus
aagccatgtcacaggtaacgccagc

SEQ ID NO: 53254 - DNA, 25 bp, Mus musculus
aagccatgtcactggtaacgccagc

SEQ ID NO: 53255 - DNA, 25 bp, Mus musculus
aagccatgtgttcatactttctgat

SEQ ID NO: 53256 - DNA, 25 bp, Mus musculus
aagccatgtgttgatactttctgat

SEQ ID NO: 53257 - DNA, 25 bp, Mus musculus
aagccatgttccagagtcggtcaaa

SEQ ID NO: 53258 - DNA, 25 bp, Mus musculus
aagccatgttcctgagtcggtcaaa

SEQ ID NO: 53259 - DNA, 25 bp, Mus musculus
aagccatgttctagatcagcgatca

SEQ ID NO: 53260 - DNA, 25 bp, Mus musculus
aagccatgttcttgatcagcgatca

SEQ ID NO: 53261 - DNA, 25 bp, Mus musculus
aagccatgttgaatcttgatcatct

SEQ ID NO: 53262 - DNA, 25 bp, Mus musculus
aagccatgttgattcttgatcatct

SEQ ID NO: 53263 - DNA, 25 bp, Mus musculus
aagccatgtttccaagacctgtgtt

SEQ ID NO: 53264 - DNA, 25 bp, Mus musculus
aagccatgtttcgaagacctgtgtt

SEQ ID NO: 53265 - DNA, 25 bp, Mus musculus
aagccattaacccaagactcagatt

SEQ ID NO: 53266 - DNA, 25 bp, Mus musculus
aagccattaaccgaagactcagatt

SEQ ID NO: 53267 - DNA, 25 bp, Mus musculus
aagccattacatcgaatgtcaagac

SEQ ID NO: 53268 - DNA, 25 bp, Mus musculus
aagccattacatggaatgtcaagac

SEQ ID NO: 53269 - DNA, 25 bp, Mus musculus
aagccattaccaccgtttggaccag

SEQ ID NO: 53270 - DNA, 25 bp, Mus musculus
aagccattaccagcgtttggaccag

SEQ ID NO: 53271 - DNA, 25 bp, Mus musculus
aagccattcaagctgcctgactgta

SEQ ID NO: 53272 - DNA, 25 bp, Mus musculus
aagccattcaaggtgcctgactgta

SEQ ID NO: 53273 - DNA, 25 bp, Mus musculus
aagccattcaatctaggactgtgtc

SEQ ID NO: 53274 - DNA, 25 bp, Mus musculus
aagccattcaatgtaggactgtgtc

SEQ ID NO: 53275 - DNA, 25 bp, Mus musculus
aagccattcagcaccaggtggtaaa

SEQ ID NO: 53276 - DNA, 25 bp, Mus musculus
aagccattcagctccaggtggtaaa

SEQ ID NO: 53277 - DNA, 25 bp, Mus musculus
aagccattcatgcttttctaattca

SEQ ID NO: 53278 - DNA, 25 bp, Mus musculus
aagccattcatggttttctaattca

SEQ ID NO: 53279 - DNA, 25 bp, Mus musculus
aagccattccacatcagacatgctg

SEQ ID NO: 53280 - DNA, 25 bp, Mus musculus
aagccattccacttcagacatgctg

SEQ ID NO: 53281 - DNA, 25 bp, Mus musculus
aagccattccgtctgctctgctggt

SEQ ID NO: 53282 - DNA, 25 bp, Mus musculus
aagccattccgtgtgctctgctggt

SEQ ID NO: 53283 - DNA, 25 bp, Mus musculus
aagccattctaacttaaatcctctg

SEQ ID NO: 53284 - DNA, 25 bp, Mus musculus
aagccattctaagttaaatcctctg

SEQ ID NO: 53285 - DNA, 25 bp, Mus musculus
aagccattctccctgagtggtgttc

SEQ ID NO: 53286 - DNA, 25 bp, Mus musculus
aagccattctccgtgagtggtgttc

SEQ ID NO: 53287 - DNA, 25 bp, Mus musculus
aagccattctgcacaagagtccatg

SEQ ID NO: 53288 - DNA, 25 bp, Mus musculus
aagccattctgctcaagagtccatg

SEQ ID NO: 53289 - DNA, 25 bp, Mus musculus
aagccattctggctactgtgaaact

SEQ ID NO: 53290 - DNA, 25 bp, Mus musculus
aagccattctgggtactgtgaaact

SEQ ID NO: 53291 - DNA, 25 bp, Mus musculus
aagccattcttaccagcctcatttt

SEQ ID NO: 53292 - DNA, 25 bp, Mus musculus
aagccattcttagcagcctcatttt

SEQ ID NO: 53293 - DNA, 25 bp, Mus musculus
aagccattcttcagagccttgattt

SEQ ID NO: 53294 - DNA, 25 bp, Mus musculus
aagccattcttctgagccttgattt

SEQ ID NO: 53295 - DNA, 25 bp, Mus musculus
aagccattgacaagttcaacaaagc

SEQ ID NO: 53296 - DNA, 25 bp, Mus musculus
aagccattgacatgttcaacaaagc

SEQ ID NO: 53297 - DNA, 25 bp, Mus musculus
aagccattgcaaacttgacctttag

SEQ ID NO: 53298 - DNA, 25 bp, Mus musculus
aagccattgcaatcttgacctttag

SEQ ID NO: 53299 - DNA, 25 bp, Mus musculus
aagccattggaaacacagagctgga

SEQ ID NO: 53300 - DNA, 25 bp, Mus musculus
aagccattggaatcacagagctgga

SEQ ID NO: 53301 - DNA, 25 bp, Mus musculus
aagccattggcaagtccaggatgag

SEQ ID NO: 53302 - DNA, 25 bp, Mus musculus
aagccattggcaatcctcgatgtca

SEQ ID NO: 53303 - DNA, 25 bp, Mus musculus
aagccattggcacgaattgcagcat

SEQ ID NO: 53304 - DNA, 25 bp, Mus musculus
aagccattggcaggaattgcagcat

SEQ ID NO: 53305 - DNA, 25 bp, Mus musculus
aagccattggcatgtccaggatgag

SEQ ID NO: 53306 - DNA, 25 bp, Mus musculus
aagccattggcattcctcgatgtca

SEQ ID NO: 53307 - DNA, 25 bp, Mus musculus
aagccattggtaactgcaccagtgc

SEQ ID NO: 53308 - DNA, 25 bp, Mus musculus
aagccattggtatctgcaccagtgc

SEQ ID NO: 53309 - DNA, 25 bp, Mus musculus
aagccattgttccatttaccactgt

SEQ ID NO: 53310 - DNA, 25 bp, Mus musculus
aagccattgttcgatttaccactgt

SEQ ID NO: 53311 - DNA, 25 bp, Mus musculus
aagccattgtttataatgcccactt

SEQ ID NO: 53312 - DNA, 25 bp, Mus musculus
aagccattgtttttaatgcccactt

SEQ ID NO: 53313 - DNA, 25 bp, Mus musculus
aagccatttatcaacttcccagctc

SEQ ID NO: 53314 - DNA, 25 bp, Mus musculus
aagccatttatctacttcccagctc

SEQ ID NO: 53315 - DNA, 25 bp, Mus musculus
aagccatttcaacggcgaggatgta

SEQ ID NO: 53316 - DNA, 25 bp, Mus musculus
aagccatttcaagggcgaggatgta

SEQ ID NO: 53317 - DNA, 25 bp, Mus musculus
aagccatttcagatctaacagttca

SEQ ID NO: 53318 - DNA, 25 bp, Mus musculus
aagccatttcagttctaacagttca

SEQ ID NO: 53319 - DNA, 25 bp, Mus musculus
aagccatttccaagagtttccaaga

SEQ ID NO: 53320 - DNA, 25 bp, Mus musculus
aagccatttccatgagtttccaaga

SEQ ID NO: 53321 - DNA, 25 bp, Mus musculus
aagccatttccccagtgtgtaaaca

SEQ ID NO: 53322 - DNA, 25 bp, Mus musculus
aagccatttcccgagtgtgtaaaca

SEQ ID NO: 53323 - DNA, 25 bp, Mus musculus
aagccattttagagctgtgatgcac

SEQ ID NO: 53324 - DNA, 25 bp, Mus musculus
aagccattttagtgctgtgatgcac

SEQ ID NO: 53325 - DNA, 25 bp, Mus musculus
aagccattttcgatgtgtgttccag

SEQ ID NO: 53326 - DNA, 25 bp, Mus musculus
aagccattttcgttgtgtgttccag

SEQ ID NO: 53327 - DNA, 25 bp, Mus musculus
aagcccaaacgtctgggatcccaga

SEQ ID NO: 53328 - DNA, 25 bp, Mus musculus
aagcccaaacgtgtgggatcccaga

SEQ ID NO: 53329 - DNA, 25 bp, Mus musculus
aagcccaaagccaagtcgagtgcca

SEQ ID NO: 53330 - DNA, 25 bp, Mus musculus
aagcccaaagcctagtcgagtgcca

SEQ ID NO: 53331 - DNA, 25 bp, Mus musculus
aagcccaaagtccaggtgcctggtt

SEQ ID NO: 53332 - DNA, 25 bp, Mus musculus
aagcccaaagtcgaggtgcctggtt

SEQ ID NO: 53333 - DNA, 25 bp, Mus musculus
aagcccaacaacctgacttcaagtc

SEQ ID NO: 53334 - DNA, 25 bp, Mus musculus
aagcccaacaacgtgacttcaagtc

SEQ ID NO: 53335 - DNA, 25 bp, Mus musculus
aagcccaacccgattcttaggacat

SEQ ID NO: 53336 - DNA, 25 bp, Mus musculus
aagcccaacccgtttcttaggacat

SEQ ID NO: 53337 - DNA, 25 bp, Mus musculus
aagcccaacgaaatcaccattcaga

SEQ ID NO: 53338 - DNA, 25 bp, Mus musculus
aagcccaacgaattcaccattcaga

SEQ ID NO: 53339 - DNA, 25 bp, Mus musculus
aagcccaactggcacgtggcagttt

SEQ ID NO: 53340 - DNA, 25 bp, Mus musculus
aagcccaactgggacgtggcagttt

SEQ ID NO: 53341 - DNA, 25 bp, Mus musculus
aagcccaacttacatgattcgtccg

SEQ ID NO: 53342 - DNA, 25 bp, Mus musculus
aagcccaacttagatgattcgtccg

SEQ ID NO: 53343 - DNA, 25 bp, Mus musculus
aagcccaactttctggttatgaagc

SEQ ID NO: 53344 - DNA, 25 bp, Mus musculus
aagcccaactttgtggttatgaagc

SEQ ID NO: 53345 - DNA, 25 bp, Mus musculus
aagcccaagaatcaggagacagggt

SEQ ID NO: 53346 - DNA, 25 bp, Mus musculus
aagcccaagaatgaggagacagggt

SEQ ID NO: 53347 - DNA, 25 bp, Mus musculus
aagcccaagacgaacagaggcccag

SEQ ID NO: 53348 - DNA, 25 bp, Mus musculus
aagcccaagacgtacagaggcccag

SEQ ID NO: 53349 - DNA, 25 bp, Mus musculus
aagcccaagattacagcggtctggc

SEQ ID NO: 53350 - DNA, 25 bp, Mus musculus
aagcccaagatttcagcggtctggc

SEQ ID NO: 53351 - DNA, 25 bp, Mus musculus
aagcccaaggctcaggacttaagaa

SEQ ID NO: 53352 - DNA, 25 bp, Mus musculus
aagcccaaggctgaggacttaagaa

SEQ ID NO: 53353 - DNA, 25 bp, Mus musculus
aagcccaagttgaggttcttcctgt

SEQ ID NO: 53354 - DNA, 25 bp, Mus musculus
aagcccaagttgtggttcttcctgt

SEQ ID NO: 53355 - DNA, 25 bp, Mus musculus
aagcccaagtttctaatgaagcact

SEQ ID NO: 53356 - DNA, 25 bp, Mus musculus
aagcccaagtttgtaatgaagcact

SEQ ID NO: 53357 - DNA, 25 bp, Mus musculus
aagcccaataacaccaaacgctgga

SEQ ID NO: 53358 - DNA, 25 bp, Mus musculus
aagcccaataactccaaacgctgga

SEQ ID NO: 53359 - DNA, 25 bp, Mus musculus
aagcccaatctcctagcaactgaga

SEQ ID NO: 53360 - DNA, 25 bp, Mus musculus
aagcccaatctcgtagcaactgaga

SEQ ID NO: 53361 - DNA, 25 bp, Mus musculus
aagcccaatgacagcgctcaaatct

SEQ ID NO: 53362 - DNA, 25 bp, Mus musculus
aagcccaatgactgcgctcaaatct

SEQ ID NO: 53363 - DNA, 25 bp, Mus musculus
aagcccaatggtcaggaagctgcaa

SEQ ID NO: 53364 - DNA, 25 bp, Mus musculus
aagcccaatggtgaggaagctgcaa

SEQ ID NO: 53365 - DNA, 25 bp, Mus musculus
aagcccaatttgatttcatccagta

SEQ ID NO: 53366 - DNA, 25 bp, Mus musculus
aagcccaatttgcttgcattttctg

SEQ ID NO: 53367 - DNA, 25 bp, Mus musculus
aagcccaatttggttgcattttctg

SEQ ID NO: 53368 - DNA, 25 bp, Mus musculus
aagcccaatttgttttcatccagta

SEQ ID NO: 53369 - DNA, 25 bp, Mus musculus
aagcccacaatgactttcccattca

SEQ ID NO: 53370 - DNA, 25 bp, Mus musculus
aagcccacaatgtctttcccattca

SEQ ID NO: 53371 - DNA, 25 bp, Mus musculus
aagcccacactaatgagattacaaa

SEQ ID NO: 53372 - DNA, 25 bp, Mus musculus
aagcccacactattgagattacaaa

SEQ ID NO: 53373 - DNA, 25 bp, Mus musculus
aagcccacatttatctcgcgaataa

SEQ ID NO: 53374 - DNA, 25 bp, Mus musculus
aagcccacatttttctcgcgaataa

SEQ ID NO: 53375 - DNA, 25 bp, Mus musculus
aagcccaccagcacagagatttaag

SEQ ID NO: 53376 - DNA, 25 bp, Mus musculus
aagcccaccagctcagagatttaag

SEQ ID NO: 53377 - DNA, 25 bp, Mus musculus
aagcccacccttacatagcctgtgt

SEQ ID NO: 53378 - DNA, 25 bp, Mus musculus
aagcccaccctttcatagcctgtgt

SEQ ID NO: 53379 - DNA, 25 bp, Mus musculus
aagcccaccgagcaggtagtagatt

SEQ ID NO: 53380 - DNA, 25 bp, Mus musculus
aagcccaccgaggaggtagtagatt

SEQ ID NO: 53381 - DNA, 25 bp, Mus musculus
aagcccacctacagtggccctggat

SEQ ID NO: 53382 - DNA, 25 bp, Mus musculus
aagcccacctactgtggccctggat

SEQ ID NO: 53383 - DNA, 25 bp, Mus musculus
aagcccactagacacatgctatcga

SEQ ID NO: 53384 - DNA, 25 bp, Mus musculus
aagcccactagagacatgctatcga

SEQ ID NO: 53385 - DNA, 25 bp, Mus musculus
aagcccactgatagcttcaatgcct

SEQ ID NO: 53386 - DNA, 25 bp, Mus musculus
aagcccactgattgcttcaatgcct

SEQ ID NO: 53387 - DNA, 25 bp, Mus musculus
aagcccactgtaagcacttcactta

SEQ ID NO: 53388 - DNA, 25 bp, Mus musculus
aagcccactgtatgcacttcactta

SEQ ID NO: 53389 - DNA, 25 bp, Mus musculus
aagcccactgttactttgctgataa

SEQ ID NO: 53390 - DNA, 25 bp, Mus musculus
aagcccactgtttctttgctgataa

SEQ ID NO: 53391 - DNA, 25 bp, Mus musculus
aagcccagaagaaaccctcattctc

SEQ ID NO: 53392 - DNA, 25 bp, Mus musculus
aagcccagaagataccctcattctc

SEQ ID NO: 53393 - DNA, 25 bp, Mus musculus
aagcccagacataatgactttcatg

SEQ ID NO: 53394 - DNA, 25 bp, Mus musculus
aagcccagacattatgactttcatg

SEQ ID NO: 53395 - DNA, 25 bp, Mus musculus
aagcccagacgaccctttgagaagc

SEQ ID NO: 53396 - DNA, 25 bp, Mus musculus
aagcccagacgagcctttgagaagc

SEQ ID NO: 53397 - DNA, 25 bp, Mus musculus
aagcccagactaacttcacactcag

SEQ ID NO: 53398 - DNA, 25 bp, Mus musculus
aagcccagactatcttcacactcag

SEQ ID NO: 53399 - DNA, 25 bp, Mus musculus
aagcccagagaaactgagcgcgtct

SEQ ID NO: 53400 - DNA, 25 bp, Mus musculus
aagcccagagaatctgagcgcgtct

SEQ ID NO: 53401 - DNA, 25 bp, Mus musculus
aagcccagagctagtcctttacacg

SEQ ID NO: 53402 - DNA, 25 bp, Mus musculus
aagcccagagcttgtcctttacacg

SEQ ID NO: 53403 - DNA, 25 bp, Mus musculus
aagcccagagttatcctgattgata

SEQ ID NO: 53404 - DNA, 25 bp, Mus musculus
aagcccagagttttcctgattgata

SEQ ID NO: 53405 - DNA, 25 bp, Mus musculus
aagcccagattcagaccgtgcctaa

SEQ ID NO: 53406 - DNA, 25 bp, Mus musculus
aagcccagattctgaccgtgcctaa

SEQ ID NO: 53407 - DNA, 25 bp, Mus musculus
aagcccagcacaccatgtgctgtga

SEQ ID NO: 53408 - DNA, 25 bp, Mus musculus
aagcccagcacagcatgtgctgtga

SEQ ID NO: 53409 - DNA, 25 bp, Mus musculus
aagcccagcacgcagtagcgattat

SEQ ID NO: 53410 - DNA, 25 bp, Mus musculus
aagcccagcacggagtagcgattat

SEQ ID NO: 53411 - DNA, 25 bp, Mus musculus
aagcccagccaacggtttaggcaga

SEQ ID NO: 53412 - DNA, 25 bp, Mus musculus
aagcccagccaagggtttaggcaga

SEQ ID NO: 53413 - DNA, 25 bp, Mus musculus
aagcccaggaaaacccaagtgtcag

SEQ ID NO: 53414 - DNA, 25 bp, Mus musculus
aagcccaggaaatcccaagtgtcag

SEQ ID NO: 53415 - DNA, 25 bp, Mus musculus
aagcccaggaataccaaagacatct

SEQ ID NO: 53416 - DNA, 25 bp, Mus musculus
aagcccaggaattccaaagacatct

SEQ ID NO: 53417 - DNA, 25 bp, Mus musculus
aagcccaggattctactcagttatg

SEQ ID NO: 53418 - DNA, 25 bp, Mus musculus
aagcccaggattgtactcagttatg

SEQ ID NO: 53419 - DNA, 25 bp, Mus musculus
aagcccaggcatcagggtggcacat

SEQ ID NO: 53420 - DNA, 25 bp, Mus musculus
aagcccaggcatgagggtggcacat

SEQ ID NO: 53421 - DNA, 25 bp, Mus musculus
aagcccaggctgatccagcattctg

SEQ ID NO: 53422 - DNA, 25 bp, Mus musculus
aagcccaggctgcaagagttaattc

SEQ ID NO: 53423 - DNA, 25 bp, Mus musculus
aagcccaggctggaagagttaattc

SEQ ID NO: 53424 - DNA, 25 bp, Mus musculus
aagcccaggctgttccagcattctg

SEQ ID NO: 53425 - DNA, 25 bp, Mus musculus
aagcccagggcaaaactaagaaggt

SEQ ID NO: 53426 - DNA, 25 bp, Mus musculus
aagcccagggcataactaagaaggt

SEQ ID NO: 53427 - DNA, 25 bp, Mus musculus
aagcccagggccagtttggcactga

SEQ ID NO: 53428 - DNA, 25 bp, Mus musculus
aagcccagggcctgtttggcactga

SEQ ID NO: 53429 - DNA, 25 bp, Mus musculus
aagcccagggtgaatgtacctgcgt

SEQ ID NO: 53430 - DNA, 25 bp, Mus musculus
aagcccagggtgtatgtacctgcgt

SEQ ID NO: 53431 - DNA, 25 bp, Mus musculus
aagcccaggtctcccttaatggtgt

SEQ ID NO: 53432 - DNA, 25 bp, Mus musculus
aagcccaggtctgccttaatggtgt

SEQ ID NO: 53433 - DNA, 25 bp, Mus musculus
aagcccaggtgacatcccttcaggg

SEQ ID NO: 53434 - DNA, 25 bp, Mus musculus
aagcccaggtgagatcccttcaggg

SEQ ID NO: 53435 - DNA, 25 bp, Mus musculus
aagcccagtcagagagccagaggaa

SEQ ID NO: 53436 - DNA, 25 bp, Mus musculus
aagcccagtcagtgagccagaggaa

SEQ ID NO: 53437 - DNA, 25 bp, Mus musculus
aagcccagtcccatcaacagtatgt

SEQ ID NO: 53438 - DNA, 25 bp, Mus musculus
aagcccagtcccttcaacagtatgt

SEQ ID NO: 53439 - DNA, 25 bp, Mus musculus
aagcccagtcctcttcgtgtgactc

SEQ ID NO: 53440 - DNA, 25 bp, Mus musculus
aagcccagtcctgttcgtgtgactc

SEQ ID NO: 53441 - DNA, 25 bp, Mus musculus
aagcccagtcttcgtatctcagaag

SEQ ID NO: 53442 - DNA, 25 bp, Mus musculus
aagcccagtcttggtatctcagaag

SEQ ID NO: 53443 - DNA, 25 bp, Mus musculus
aagcccagtgccctggatgttagac

SEQ ID NO: 53444 - DNA, 25 bp, Mus musculus
aagcccagtgccgtggatgttagac

SEQ ID NO: 53445 - DNA, 25 bp, Mus musculus
aagcccagtgggaatcagctctata

SEQ ID NO: 53446 - DNA, 25 bp, Mus musculus
aagcccagtgggacccctgtgtatg

SEQ ID NO: 53447 - DNA, 25 bp, Mus musculus
aagcccagtgggtatcagctctata

SEQ ID NO: 53448 - DNA, 25 bp, Mus musculus
aagcccagtgggtcccctgtgtatg

SEQ ID NO: 53449 - DNA, 25 bp, Mus musculus
aagcccagttcgcacagccagaaat

SEQ ID NO: 53450 - DNA, 25 bp, Mus musculus
aagcccagttcggacagccagaaat

SEQ ID NO: 53451 - DNA, 25 bp, Mus musculus
aagcccagtttcaaatcttgccaac

SEQ ID NO: 53452 - DNA, 25 bp, Mus musculus
aagcccagtttcatgtgtgaatcac

SEQ ID NO: 53453 - DNA, 25 bp, Mus musculus
aagcccagtttctaatcttgccaac

SEQ ID NO: 53454 - DNA, 25 bp, Mus musculus
aagcccagtttcttgtgtgaatcac

SEQ ID NO: 53455 - DNA, 25 bp, Mus musculus
aagcccatatgtagacagtttttgt

SEQ ID NO: 53456 - DNA, 25 bp, Mus musculus
aagcccatatgttgacagtttttgt

SEQ ID NO: 53457 - DNA, 25 bp, Mus musculus
aagcccatcactcgcaaaggtgttg

SEQ ID NO: 53458 - DNA, 25 bp, Mus musculus
aagcccatcactggcaaaggtgttg

SEQ ID NO: 53459 - DNA, 25 bp, Mus musculus
aagcccatcagtatgcaacagtttt

SEQ ID NO: 53460 - DNA, 25 bp, Mus musculus
aagcccatcagtttgcaacagtttt

SEQ ID NO: 53461 - DNA, 25 bp, Mus musculus
aagcccatccatcagatttgtacat

SEQ ID NO: 53462 - DNA, 25 bp, Mus musculus
aagcccatccatcccagtaaatata

SEQ ID NO: 53463 - DNA, 25 bp, Mus musculus
aagcccatccatgagatttgtacat

SEQ ID NO: 53464 - DNA, 25 bp, Mus musculus
aagcccatccatgccagtaaatata

SEQ ID NO: 53465 - DNA, 25 bp, Mus musculus
aagcccatcctgagagactttgtct

SEQ ID NO: 53466 - DNA, 25 bp, Mus musculus
aagcccatcctgtgagactttgtct

SEQ ID NO: 53467 - DNA, 25 bp, Mus musculus
aagcccatccttatgggatctgcac

SEQ ID NO: 53468 - DNA, 25 bp, Mus musculus
aagcccatccttttgggatctgcac

SEQ ID NO: 53469 - DNA, 25 bp, Mus musculus
aagcccatcgggacctaaagccagg

SEQ ID NO: 53470 - DNA, 25 bp, Mus musculus
aagcccatcgggtcctaaagccagg

SEQ ID NO: 53471 - DNA, 25 bp, Mus musculus
aagcccatgagactttatcagtgtt

SEQ ID NO: 53472 - DNA, 25 bp, Mus musculus
aagcccatgagagtttatcagtgtt

SEQ ID NO: 53473 - DNA, 25 bp, Mus musculus
aagcccatggcccttttgtaacatg

SEQ ID NO: 53474 - DNA, 25 bp, Mus musculus
aagcccatggccgttttgtaacatg

SEQ ID NO: 53475 - DNA, 25 bp, Mus musculus
aagcccatggtccacggtcagagga

SEQ ID NO: 53476 - DNA, 25 bp, Mus musculus
aagcccatggtcgacggtcagagga

SEQ ID NO: 53477 - DNA, 25 bp, Mus musculus
aagcccatgtgcctaacttcatttt

SEQ ID NO: 53478 - DNA, 25 bp, Mus musculus
aagcccatgtgcgtaacttcatttt

SEQ ID NO: 53479 - DNA, 25 bp, Mus musculus
aagcccattctcctttatatccagg

SEQ ID NO: 53480 - DNA, 25 bp, Mus musculus
aagcccattctcgtttatatccagg

SEQ ID NO: 53481 - DNA, 25 bp, Mus musculus
aagcccattgaccagacccttcatt

SEQ ID NO: 53482 - DNA, 25 bp, Mus musculus
aagcccattgacgagacccttcatt

SEQ ID NO: 53483 - DNA, 25 bp, Mus musculus
aagcccatttgcatttccttggcca

SEQ ID NO: 53484 - DNA, 25 bp, Mus musculus
aagcccatttgcttttccttggcca

SEQ ID NO: 53485 - DNA, 25 bp, Mus musculus
aagcccatttggaatctgatgagca

SEQ ID NO: 53486 - DNA, 25 bp, Mus musculus
aagcccatttggatggatcaacaca

SEQ ID NO: 53487 - DNA, 25 bp, Mus musculus
aagcccatttggtatctgatgagca

SEQ ID NO: 53488 - DNA, 25 bp, Mus musculus
aagcccatttggttggatcaacaca

SEQ ID NO: 53489 - DNA, 25 bp, Mus musculus
aagccccaactcaggcaaggcagaa

SEQ ID NO: 53490 - DNA, 25 bp, Mus musculus
aagccccaactctggcaaggcagaa

SEQ ID NO: 53491 - DNA, 25 bp, Mus musculus
aagccccaagatctcaagacgcaag

SEQ ID NO: 53492 - DNA, 25 bp, Mus musculus
aagccccaagatgtcaagacgcaag

SEQ ID NO: 53493 - DNA, 25 bp, Mus musculus
aagccccacctgcagacgaggactg

SEQ ID NO: 53494 - DNA, 25 bp, Mus musculus
aagccccacctggagacgaggactg

SEQ ID NO: 53495 - DNA, 25 bp, Mus musculus
aagccccactggagtcactcagaaa

SEQ ID NO: 53496 - DNA, 25 bp, Mus musculus
aagccccactggtgtcactcagaaa

SEQ ID NO: 53497 - DNA, 25 bp, Mus musculus
aagccccactgtctaagagcatcct

SEQ ID NO: 53498 - DNA, 25 bp, Mus musculus
aagccccactgtgtaagagcatcct

SEQ ID NO: 53499 - DNA, 25 bp, Mus musculus
aagccccagatcaaaatttgctaca

SEQ ID NO: 53500 - DNA, 25 bp, Mus musculus
aagccccagatctaaatttgctaca

SEQ ID NO: 53501 - DNA, 25 bp, Mus musculus
aagccccagctcaggtggcatggtt

SEQ ID NO: 53502 - DNA, 25 bp, Mus musculus
aagccccagctctggtggcatggtt

SEQ ID NO: 53503 - DNA, 25 bp, Mus musculus
aagccccaggagactggacttccct

SEQ ID NO: 53504 - DNA, 25 bp, Mus musculus
aagccccaggagtctggacttccct

SEQ ID NO: 53505 - DNA, 25 bp, Mus musculus
aagccccaggctcctgcgaggaatg

SEQ ID NO: 53506 - DNA, 25 bp, Mus musculus
aagccccaggctgctgcgaggaatg

SEQ ID NO: 53507 - DNA, 25 bp, Mus musculus
aagccccagttcactggtttctaat

SEQ ID NO: 53508 - DNA, 25 bp, Mus musculus
aagccccagttctctggtttctaat

SEQ ID NO: 53509 - DNA, 25 bp, Mus musculus
aagccccataaaatgtgctgtgcaa

SEQ ID NO: 53510 - DNA, 25 bp, Mus musculus
aagccccataaattgtgctgtgcaa

SEQ ID NO: 53511 - DNA, 25 bp, Mus musculus
aagccccataataacctgattgcct

SEQ ID NO: 53512 - DNA, 25 bp, Mus musculus
aagccccataattacctgattgcct

SEQ ID NO: 53513 - DNA, 25 bp, Mus musculus
aagccccatcatatgtcagatgtca

SEQ ID NO: 53514 - DNA, 25 bp, Mus musculus
aagccccatcatttgtcagatgtca

SEQ ID NO: 53515 - DNA, 25 bp, Mus musculus
aagccccatcgaaaattgtcatcct

SEQ ID NO: 53516 - DNA, 25 bp, Mus musculus
aagccccatcgataattgtcatcct

SEQ ID NO: 53517 - DNA, 25 bp, Mus musculus
aagccccatcttatggtatgccccg

SEQ ID NO: 53518 - DNA, 25 bp, Mus musculus
aagccccatcttttggtatgccccg

SEQ ID NO: 53519 - DNA, 25 bp, Mus musculus
aagccccatgaaagtatgcaaatag

SEQ ID NO: 53520 - DNA, 25 bp, Mus musculus
aagccccatgaatgtatgcaaatag

SEQ ID NO: 53521 - DNA, 25 bp, Mus musculus
aagccccatgctctttgatcttgga

SEQ ID NO: 53522 - DNA, 25 bp, Mus musculus
aagccccatgctgtttgatcttgga

SEQ ID NO: 53523 - DNA, 25 bp, Mus musculus
aagccccatgtaagcattccattgc

SEQ ID NO: 53524 - DNA, 25 bp, Mus musculus
aagccccatgtatgcattccattgc

SEQ ID NO: 53525 - DNA, 25 bp, Mus musculus
aagccccatgtgactcgcctctggg

SEQ ID NO: 53526 - DNA, 25 bp, Mus musculus
aagccccatgtgtctcgcctctggg

SEQ ID NO: 53527 - DNA, 25 bp, Mus musculus
aagccccattataagccttttatcg

SEQ ID NO: 53528 - DNA, 25 bp, Mus musculus
aagccccattattagccttttatcg

SEQ ID NO: 53529 - DNA, 25 bp, Mus musculus
aagccccattgtccttctgtctcta

SEQ ID NO: 53530 - DNA, 25 bp, Mus musculus
aagccccattgtgcttctgtctcta

SEQ ID NO: 53531 - DNA, 25 bp, Mus musculus
aagccccatttgatctatattcctg

SEQ ID NO: 53532 - DNA, 25 bp, Mus musculus
aagccccatttgttctatattcctg

SEQ ID NO: 53533 - DNA, 25 bp, Mus musculus
aagccccccaagaaaggcgtgcaag

SEQ ID NO: 53534 - DNA, 25 bp, Mus musculus
aagccccccaagtaaggcgtgcaag

SEQ ID NO: 53535 - DNA, 25 bp, Mus musculus
aagccccgagggaagctagtgaagc

SEQ ID NO: 53536 - DNA, 25 bp, Mus musculus
aagccccgagggtagctagtgaagc

SEQ ID NO: 53537 - DNA, 25 bp, Mus musculus
aagccccgcaagagatcgccagcat

SEQ ID NO: 53538 - DNA, 25 bp, Mus musculus
aagccccgcaagtgatcgccagcat

SEQ ID NO: 53539 - DNA, 25 bp, Mus musculus
aagccccgcagactggagcctgtgt

SEQ ID NO: 53540 - DNA, 25 bp, Mus musculus
aagccccgcagagtggagcctgtgt

SEQ ID NO: 53541 - DNA, 25 bp, Mus musculus
aagccccgcttcagagtgcgctgta

SEQ ID NO: 53542 - DNA, 25 bp, Mus musculus
aagccccgcttctgagtgcgctgta

SEQ ID NO: 53543 - DNA, 25 bp, Mus musculus
aagccccggagcagtatcgtttttg

SEQ ID NO: 53544 - DNA, 25 bp, Mus musculus
aagccccggagctgtatcgtttttg

SEQ ID NO: 53545 - DNA, 25 bp, Mus musculus
aagccccggattcctgcctgcagga

SEQ ID NO: 53546 - DNA, 25 bp, Mus musculus
aagccccggattgctgcctgcagga

SEQ ID NO: 53547 - DNA, 25 bp, Mus musculus
aagccccgtattacagagcaggtga

SEQ ID NO: 53548 - DNA, 25 bp, Mus musculus
aagccccgtatttcagagcaggtga

SEQ ID NO: 53549 - DNA, 25 bp, Mus musculus
aagccccgtgggactgagaaagcac

SEQ ID NO: 53550 - DNA, 25 bp, Mus musculus
aagccccgtgggtctgagaaagcac

SEQ ID NO: 53551 - DNA, 25 bp, Mus musculus
aagccccgtgttagtctggctaggt

SEQ ID NO: 53552 - DNA, 25 bp, Mus musculus
aagccccgtgtttgtctggctaggt

SEQ ID NO: 53553 - DNA, 25 bp, Mus musculus
aagccccgttgactaggagagccag

SEQ ID NO: 53554 - DNA, 25 bp, Mus musculus
aagccccgttgagtaggagagccag

SEQ ID NO: 53555 - DNA, 25 bp, Mus musculus
aagcccctagatactgccattatag

SEQ ID NO: 53556 - DNA, 25 bp, Mus musculus
aagcccctagattctgccattatag

SEQ ID NO: 53557 - DNA, 25 bp, Mus musculus
aagcccctcacgcaggcagagaaaa

SEQ ID NO: 53558 - DNA, 25 bp, Mus musculus
aagcccctcacggaggcagagaaaa

SEQ ID NO: 53559 - DNA, 25 bp, Mus musculus
aagcccctcagccagataacgatct

SEQ ID NO: 53560 - DNA, 25 bp, Mus musculus
aagcccctcagcgagataacgatct

SEQ ID NO: 53561 - DNA, 25 bp, Mus musculus
aagcccctcttgatcatcaaaatct

SEQ ID NO: 53562 - DNA, 25 bp, Mus musculus
aagcccctcttgttcatcaaaatct

SEQ ID NO: 53563 - DNA, 25 bp, Mus musculus
aagcccctgaagatttattgcatct

SEQ ID NO: 53564 - DNA, 25 bp, Mus musculus
aagcccctgaagttttattgcatct

SEQ ID NO: 53565 - DNA, 25 bp, Mus musculus
aagcccctgaataagcagcgatcct

SEQ ID NO: 53566 - DNA, 25 bp, Mus musculus
aagcccctgaattagcagcgatcct

SEQ ID NO: 53567 - DNA, 25 bp, Mus musculus
aagcccctgcctaatgaaaattgtg

SEQ ID NO: 53568 - DNA, 25 bp, Mus musculus
aagcccctgccttatgaaaattgtg

SEQ ID NO: 53569 - DNA, 25 bp, Mus musculus
aagcccctggccaagaagttgtcat

SEQ ID NO: 53570 - DNA, 25 bp, Mus musculus
aagcccctggcctagaagttgtcat

SEQ ID NO: 53571 - DNA, 25 bp, Mus musculus
aagcccctgttcatcaggaaagcca

SEQ ID NO: 53572 - DNA, 25 bp, Mus musculus
aagcccctgttccatggtattcaga

SEQ ID NO: 53573 - DNA, 25 bp, Mus musculus
aagcccctgttcgatggtattcaga

SEQ ID NO: 53574 - DNA, 25 bp, Mus musculus
aagcccctgttcttcaggaaagcca

SEQ ID NO: 53575 - DNA, 25 bp, Mus musculus
aagcccctgttgctgacatttggag

SEQ ID NO: 53576 - DNA, 25 bp, Mus musculus
aagcccctgttggtgacatttggag

SEQ ID NO: 53577 - DNA, 25 bp, Mus musculus
aagccccttacacgctgagctattt

SEQ ID NO: 53578 - DNA, 25 bp, Mus musculus
aagccccttacaggctgagctattt

SEQ ID NO: 53579 - DNA, 25 bp, Mus musculus
aagccccttagacgatcccagaaga

SEQ ID NO: 53580 - DNA, 25 bp, Mus musculus
aagccccttagaggatcccagaaga

SEQ ID NO: 53581 - DNA, 25 bp, Mus musculus
aagccccttcaactactgttttgag

SEQ ID NO: 53582 - DNA, 25 bp, Mus musculus
aagccccttcaagtactgttttgag

SEQ ID NO: 53583 - DNA, 25 bp, Mus musculus
aagccccttcacagtacagaaacaa

SEQ ID NO: 53584 - DNA, 25 bp, Mus musculus
aagccccttcactgtacagaaacaa

SEQ ID NO: 53585 - DNA, 25 bp, Mus musculus
aagccccttgctcatgttgttaata

SEQ ID NO: 53586 - DNA, 25 bp, Mus musculus
aagccccttgctgatgttgttaata

SEQ ID NO: 53587 - DNA, 25 bp, Mus musculus
aagccccttgtacatccttctttct

SEQ ID NO: 53588 - DNA, 25 bp, Mus musculus
aagccccttgtagatccttctttct

SEQ ID NO: 53589 - DNA, 25 bp, Mus musculus
aagccccttgtgcagcagggcacca

SEQ ID NO: 53590 - DNA, 25 bp, Mus musculus
aagccccttgtggagcagggcacca

SEQ ID NO: 53591 - DNA, 25 bp, Mus musculus
aagcccgaaagccacagatctgtgt

SEQ ID NO: 53592 - DNA, 25 bp, Mus musculus
aagcccgaaagcgacagatctgtgt

SEQ ID NO: 53593 - DNA, 25 bp, Mus musculus
aagcccgaagaactgatcgactaca

SEQ ID NO: 53594 - DNA, 25 bp, Mus musculus
aagcccgaagaagtgatcgactaca

SEQ ID NO: 53595 - DNA, 25 bp, Mus musculus
aagcccgaaggacccatatgccaac

SEQ ID NO: 53596 - DNA, 25 bp, Mus musculus
aagcccgaaggagccatatgccaac

SEQ ID NO: 53597 - DNA, 25 bp, Mus musculus
aagcccgaagggaagactctgtgta

SEQ ID NO: 53598 - DNA, 25 bp, Mus musculus
aagcccgaagggtagactctgtgta

SEQ ID NO: 53599 - DNA, 25 bp, Mus musculus
aagcccgacattctaagggcacctt

SEQ ID NO: 53600 - DNA, 25 bp, Mus musculus
aagcccgacattgtaagggcacctt

SEQ ID NO: 53601 - DNA, 25 bp, Mus musculus
aagcccgagacacataaagccagta

SEQ ID NO: 53602 - DNA, 25 bp, Mus musculus
aagcccgagacagataaagccagta

SEQ ID NO: 53603 - DNA, 25 bp, Mus musculus
aagcccgagagcactgggacagcat

SEQ ID NO: 53604 - DNA, 25 bp, Mus musculus
aagcccgagagctctgggacagcat

SEQ ID NO: 53605 - DNA, 25 bp, Mus musculus
aagcccgagccgaaggacacgtggt

SEQ ID NO: 53606 - DNA, 25 bp, Mus musculus
aagcccgagccgtaggacacgtggt

SEQ ID NO: 53607 - DNA, 25 bp, Mus musculus
aagcccgaggaaacggatccgcagt

SEQ ID NO: 53608 - DNA, 25 bp, Mus musculus
aagcccgaggaatcggatccgcagt

SEQ ID NO: 53609 - DNA, 25 bp, Mus musculus
aagcccgataatagagttggattcc

SEQ ID NO: 53610 - DNA, 25 bp, Mus musculus
aagcccgataattgagttggattcc

SEQ ID NO: 53611 - DNA, 25 bp, Mus musculus
aagcccgcccaaagactgaagacaa

SEQ ID NO: 53612 - DNA, 25 bp, Mus musculus
aagcccgcccaatgactgaagacaa

SEQ ID NO: 53613 - DNA, 25 bp, Mus musculus
aagcccgccggcagacaagttgcag

SEQ ID NO: 53614 - DNA, 25 bp, Mus musculus
aagcccgccggctgacaagttgcag

SEQ ID NO: 53615 - DNA, 25 bp, Mus musculus
aagcccgcctgacatttgaccagat

SEQ ID NO: 53616 - DNA, 25 bp, Mus musculus
aagcccgcctgagatttgaccagat

SEQ ID NO: 53617 - DNA, 25 bp, Mus musculus
aagcccggagatctcttcaggatta

SEQ ID NO: 53618 - DNA, 25 bp, Mus musculus
aagcccggagatgtcttcaggatta

SEQ ID NO: 53619 - DNA, 25 bp, Mus musculus
aagcccggcctcaggctctctttct

SEQ ID NO: 53620 - DNA, 25 bp, Mus musculus
aagcccggcctctggctctctttct

SEQ ID NO: 53621 - DNA, 25 bp, Mus musculus
aagcccgggcatcgacattgcagat

SEQ ID NO: 53622 - DNA, 25 bp, Mus musculus
aagcccgggcatggacattgcagat

SEQ ID NO: 53623 - DNA, 25 bp, Mus musculus
aagcccgggccacaagagctgcaaa

SEQ ID NO: 53624 - DNA, 25 bp, Mus musculus
aagcccgggccagaagagctgcaaa

SEQ ID NO: 53625 - DNA, 25 bp, Mus musculus
aagcccgggcttacatgtgtgagca

SEQ ID NO: 53626 - DNA, 25 bp, Mus musculus
aagcccgggctttcatgtgtgagca

SEQ ID NO: 53627 - DNA, 25 bp, Mus musculus
aagcccggtcttacaagactttctg

SEQ ID NO: 53628 - DNA, 25 bp, Mus musculus
aagcccggtctttcaagactttctg

SEQ ID NO: 53629 - DNA, 25 bp, Mus musculus
aagcccgtcagtcgttctgctgcat

SEQ ID NO: 53630 - DNA, 25 bp, Mus musculus
aagcccgtcagtggttctgctgcat

SEQ ID NO: 53631 - DNA, 25 bp, Mus musculus
aagcccgtcctgctaacctaaggat

SEQ ID NO: 53632 - DNA, 25 bp, Mus musculus
aagcccgtcctggtaacctaaggat

SEQ ID NO: 53633 - DNA, 25 bp, Mus musculus
aagcccgtcggaaataagattgtca

SEQ ID NO: 53634 - DNA, 25 bp, Mus musculus
aagcccgtcggatataagattgtca

SEQ ID NO: 53635 - DNA, 25 bp, Mus musculus
aagcccgttgccagctatttttccg

SEQ ID NO: 53636 - DNA, 25 bp, Mus musculus
aagcccgttgcctgctatttttccg

SEQ ID NO: 53637 - DNA, 25 bp, Mus musculus
aagccctaaattcaagaagccttgc

SEQ ID NO: 53638 - DNA, 25 bp, Mus musculus
aagccctaaattgaagaagccttgc

SEQ ID NO: 53639 - DNA, 25 bp, Mus musculus
aagccctaacccctatgtgaatggt

SEQ ID NO: 53640 - DNA, 25 bp, Mus musculus
aagccctaacccgtatgtgaatggt

SEQ ID NO: 53641 - DNA, 25 bp, Mus musculus
aagccctaacttatcattcatacca

SEQ ID NO: 53642 - DNA, 25 bp, Mus musculus
aagccctaacttttcattcatacca

SEQ ID NO: 53643 - DNA, 25 bp, Mus musculus
aagccctaaggcagcagtgtaactc

SEQ ID NO: 53644 - DNA, 25 bp, Mus musculus
aagccctaaggctgcagtgtaactc

SEQ ID NO: 53645 - DNA, 25 bp, Mus musculus
aagccctaccagagctcagagtgca

SEQ ID NO: 53646 - DNA, 25 bp, Mus musculus
aagccctaccagtgctcagagtgca

SEQ ID NO: 53647 - DNA, 25 bp, Mus musculus
aagccctaccttagagggagccaca

SEQ ID NO: 53648 - DNA, 25 bp, Mus musculus
aagccctacctttgagggagccaca

SEQ ID NO: 53649 - DNA, 25 bp, Mus musculus
aagccctactacagtaagattcgag

SEQ ID NO: 53650 - DNA, 25 bp, Mus musculus
aagccctactactgtaagattcgag

SEQ ID NO: 53651 - DNA, 25 bp, Mus musculus
aagccctactccaagtgacacactt

SEQ ID NO: 53652 - DNA, 25 bp, Mus musculus
aagccctactcctagtgacacactt

SEQ ID NO: 53653 - DNA, 25 bp, Mus musculus
aagccctagaacagtcttccaaggg

SEQ ID NO: 53654 - DNA, 25 bp, Mus musculus
aagccctagaactgtcttccaaggg

SEQ ID NO: 53655 - DNA, 25 bp, Mus musculus
aagccctagattccttttgcaatgt

SEQ ID NO: 53656 - DNA, 25 bp, Mus musculus
aagccctagattgcttttgcaatgt

SEQ ID NO: 53657 - DNA, 25 bp, Mus musculus
aagccctagctccatgcaggacgaa

SEQ ID NO: 53658 - DNA, 25 bp, Mus musculus
aagccctagctcgatgcaggacgaa

SEQ ID NO: 53659 - DNA, 25 bp, Mus musculus
aagccctagcttctatggttcagta

SEQ ID NO: 53660 - DNA, 25 bp, Mus musculus
aagccctagcttgtatggttcagta

SEQ ID NO: 53661 - DNA, 25 bp, Mus musculus
aagccctagtttcatacactttact

SEQ ID NO: 53662 - DNA, 25 bp, Mus musculus
aagccctagtttgatacactttact

SEQ ID NO: 53663 - DNA, 25 bp, Mus musculus
aagccctatagaagccgcgcgctga

SEQ ID NO: 53664 - DNA, 25 bp, Mus musculus
aagccctatagatgccgcgcgctga

SEQ ID NO: 53665 - DNA, 25 bp, Mus musculus
aagccctatctgcactgcactagaa

SEQ ID NO: 53666 - DNA, 25 bp, Mus musculus
aagccctatctggactgcactagaa

SEQ ID NO: 53667 - DNA, 25 bp, Mus musculus
aagccctatgagcttgattgataag

SEQ ID NO: 53668 - DNA, 25 bp, Mus musculus
aagccctatgaggttgattgataag

SEQ ID NO: 53669 - DNA, 25 bp, Mus musculus
aagccctatttacatcctaaggtag

SEQ ID NO: 53670 - DNA, 25 bp, Mus musculus
aagccctatttagatcctaaggtag

SEQ ID NO: 53671 - DNA, 25 bp, Mus musculus
aagccctcaactatctcaggcaatg

SEQ ID NO: 53672 - DNA, 25 bp, Mus musculus
aagccctcaactttctcaggcaatg

SEQ ID NO: 53673 - DNA, 25 bp, Mus musculus
aagccctcaaggctgatggcaacct

SEQ ID NO: 53674 - DNA, 25 bp, Mus musculus
aagccctcaagggtgatggcaacct

SEQ ID NO: 53675 - DNA, 25 bp, Mus musculus
aagccctcaagtcgagcgagtccct

SEQ ID NO: 53676 - DNA, 25 bp, Mus musculus
aagccctcaagtggagcgagtccct

SEQ ID NO: 53677 - DNA, 25 bp, Mus musculus
aagccctcaataactatgtacctcc

SEQ ID NO: 53678 - DNA, 25 bp, Mus musculus
aagccctcaatatctatgtacctcc

SEQ ID NO: 53679 - DNA, 25 bp, Mus musculus
aagccctcagagagcagagcctcaa

SEQ ID NO: 53680 - DNA, 25 bp, Mus musculus
aagccctcagagtgcagagcctcaa

SEQ ID NO: 53681 - DNA, 25 bp, Mus musculus
aagccctcagatcagctgcatcttt

SEQ ID NO: 53682 - DNA, 25 bp, Mus musculus
aagccctcagatgagctgcatcttt

SEQ ID NO: 53683 - DNA, 25 bp, Mus musculus
aagccctcagtgctgtccttgcaga

SEQ ID NO: 53684 - DNA, 25 bp, Mus musculus
aagccctcagtggtgtccttgcaga

SEQ ID NO: 53685 - DNA, 25 bp, Mus musculus
aagccctcatcacatataggtccac

SEQ ID NO: 53686 - DNA, 25 bp, Mus musculus
aagccctcatcagatataggtccac

SEQ ID NO: 53687 - DNA, 25 bp, Mus musculus
aagccctcatgtattaataaccgga

SEQ ID NO: 53688 - DNA, 25 bp, Mus musculus
aagccctcatgttttaataaccgga

SEQ ID NO: 53689 - DNA, 25 bp, Mus musculus
aagccctcattaacatttgctgcag

SEQ ID NO: 53690 - DNA, 25 bp, Mus musculus
aagccctcattatcatttgctgcag

SEQ ID NO: 53691 - DNA, 25 bp, Mus musculus
aagccctccaagcactaagagctga

SEQ ID NO: 53692 - DNA, 25 bp, Mus musculus
aagccctccaaggactaagagctga

SEQ ID NO: 53693 - DNA, 25 bp, Mus musculus
aagccctcccaaagattttcagaat

SEQ ID NO: 53694 - DNA, 25 bp, Mus musculus
aagccctcccaatgattttcagaat

SEQ ID NO: 53695 - DNA, 25 bp, Mus musculus
aagccctcctgtcgaagcatcttgc

SEQ ID NO: 53696 - DNA, 25 bp, Mus musculus
aagccctcctgtggaagcatcttgc

SEQ ID NO: 53697 - DNA, 25 bp, Mus musculus
aagccctcgctgatatgaaaactac

SEQ ID NO: 53698 - DNA, 25 bp, Mus musculus
aagccctcgctgttatgaaaactac

SEQ ID NO: 53699 - DNA, 25 bp, Mus musculus
aagccctcggtgacacagaacacag

SEQ ID NO: 53700 - DNA, 25 bp, Mus musculus
aagccctcggtgtcacagaacacag

SEQ ID NO: 53701 - DNA, 25 bp, Mus musculus
aagccctctaccctcaaaaattgag

SEQ ID NO: 53702 - DNA, 25 bp, Mus musculus
aagccctctaccgtcaaaaattgag

SEQ ID NO: 53703 - DNA, 25 bp, Mus musculus
aagccctctggcaagagttctcaaa

SEQ ID NO: 53704 - DNA, 25 bp, Mus musculus
aagccctctggctagagttctcaaa

SEQ ID NO: 53705 - DNA, 25 bp, Mus musculus
aagccctcttgtactgtgtgatggt

SEQ ID NO: 53706 - DNA, 25 bp, Mus musculus
aagccctcttgttctgtgtgatggt

SEQ ID NO: 53707 - DNA, 25 bp, Mus musculus
aagccctctttgacctgtctggaga

SEQ ID NO: 53708 - DNA, 25 bp, Mus musculus
aagccctctttgtcctgtctggaga

SEQ ID NO: 53709 - DNA, 25 bp, Mus musculus
aagccctgacctagaagatgtccag

SEQ ID NO: 53710 - DNA, 25 bp, Mus musculus
aagccctgaccttgaagatgtccag

SEQ ID NO: 53711 - DNA, 25 bp, Mus musculus
aagccctgacttaaaggattcatga

SEQ ID NO: 53712 - DNA, 25 bp, Mus musculus
aagccctgactttaaggattcatga

SEQ ID NO: 53713 - DNA, 25 bp, Mus musculus
aagccctgagccacggctgaagtgc

SEQ ID NO: 53714 - DNA, 25 bp, Mus musculus
aagccctgagcctcggctgaagtgc

SEQ ID NO: 53715 - DNA, 25 bp, Mus musculus
aagccctgagtaagctgcactgtgt

SEQ ID NO: 53716 - DNA, 25 bp, Mus musculus
aagccctgagtatgctgcactgtgt

SEQ ID NO: 53717 - DNA, 25 bp, Mus musculus
aagccctgagtgagtgtagtcctgg

SEQ ID NO: 53718 - DNA, 25 bp, Mus musculus
aagccctgagtgtgtgtagtcctgg

SEQ ID NO: 53719 - DNA, 25 bp, Mus musculus
aagccctgatgtacccacacagttg

SEQ ID NO: 53720 - DNA, 25 bp, Mus musculus
aagccctgatgttcccacacagttg

SEQ ID NO: 53721 - DNA, 25 bp, Mus musculus
aagccctgcaaaccttatgtcttga

SEQ ID NO: 53722 - DNA, 25 bp, Mus musculus
aagccctgcaaagcttatgtcttga

SEQ ID NO: 53723 - DNA, 25 bp, Mus musculus
aagccctgcaagatgtccggtttat

SEQ ID NO: 53724 - DNA, 25 bp, Mus musculus
aagccctgcaagttgtccggtttat

SEQ ID NO: 53725 - DNA, 25 bp, Mus musculus
aagccctgcagacgatcagcgagta

SEQ ID NO: 53726 - DNA, 25 bp, Mus musculus
aagccctgcagaggatcagcgagta

SEQ ID NO: 53727 - DNA, 25 bp, Mus musculus
aagccctgcagtacttgggagagga

SEQ ID NO: 53728 - DNA, 25 bp, Mus musculus
aagccctgcagttcttgggagagga

SEQ ID NO: 53729 - DNA, 25 bp, Mus musculus
aagccctgccaacatgggacaagca

SEQ ID NO: 53730 - DNA, 25 bp, Mus musculus
aagccctgccaagatgggacaagca

SEQ ID NO: 53731 - DNA, 25 bp, Mus musculus
aagccctgccagcagcatcagagag

SEQ ID NO: 53732 - DNA, 25 bp, Mus musculus
aagccctgccaggagcatcagagag

SEQ ID NO: 53733 - DNA, 25 bp, Mus musculus
aagccctgccatccagagcattgtt

SEQ ID NO: 53734 - DNA, 25 bp, Mus musculus
aagccctgccatgcagagcattgtt

SEQ ID NO: 53735 - DNA, 25 bp, Mus musculus
aagccctgcctcatggattctgatt

SEQ ID NO: 53736 - DNA, 25 bp, Mus musculus
aagccctgcctcttggattctgatt

SEQ ID NO: 53737 - DNA, 25 bp, Mus musculus
aagccctgctagcaggagcttgcat

SEQ ID NO: 53738 - DNA, 25 bp, Mus musculus
aagccctgctaggaggagcttgcat

SEQ ID NO: 53739 - DNA, 25 bp, Mus musculus
aagccctgctccacaagggaggtgt

SEQ ID NO: 53740 - DNA, 25 bp, Mus musculus
aagccctgctcctcaagggaggtgt

SEQ ID NO: 53741 - DNA, 25 bp, Mus musculus
aagccctgctctcactgaagatggt

SEQ ID NO: 53742 - DNA, 25 bp, Mus musculus
aagccctgctctgactgaagatggt

SEQ ID NO: 53743 - DNA, 25 bp, Mus musculus
aagccctggaacaagtttctatcag

SEQ ID NO: 53744 - DNA, 25 bp, Mus musculus
aagccctggaacatcatgtatttct

SEQ ID NO: 53745 - DNA, 25 bp, Mus musculus
aagccctggaactagtttctatcag

SEQ ID NO: 53746 - DNA, 25 bp, Mus musculus
aagccctggaacttcatgtatttct

SEQ ID NO: 53747 - DNA, 25 bp, Mus musculus
aagccctggaccaattgtaccttat

SEQ ID NO: 53748 - DNA, 25 bp, Mus musculus
aagccctggacctattgtaccttat

SEQ ID NO: 53749 - DNA, 25 bp, Mus musculus
aagccctggagcaaactcaagtcgg

SEQ ID NO: 53750 - DNA, 25 bp, Mus musculus
aagccctggagctaactcaagtcgg

SEQ ID NO: 53751 - DNA, 25 bp, Mus musculus
aagccctggcacctgtgaaaacctt

SEQ ID NO: 53752 - DNA, 25 bp, Mus musculus
aagccctggcacgtgtgaaaacctt

SEQ ID NO: 53753 - DNA, 25 bp, Mus musculus
aagccctggctcatttgccacagat

SEQ ID NO: 53754 - DNA, 25 bp, Mus musculus
aagccctggctcttttgccacagat

SEQ ID NO: 53755 - DNA, 25 bp, Mus musculus
aagccctgggcactggattcggcat

SEQ ID NO: 53756 - DNA, 25 bp, Mus musculus
aagccctgggcagtggattcggcat

SEQ ID NO: 53757 - DNA, 25 bp, Mus musculus
aagccctgggctagactgaagtaaa

SEQ ID NO: 53758 - DNA, 25 bp, Mus musculus
aagccctgggcttgactgaagtaaa

SEQ ID NO: 53759 - DNA, 25 bp, Mus musculus
aagccctgggtgctccttcaatgaa

SEQ ID NO: 53760 - DNA, 25 bp, Mus musculus
aagccctgggtggtccttcaatgaa

SEQ ID NO: 53761 - DNA, 25 bp, Mus musculus
aagccctgggttcgatccacagcaa

SEQ ID NO: 53762 - DNA, 25 bp, Mus musculus
aagccctgggttggatccacagcaa

SEQ ID NO: 53763 - DNA, 25 bp, Mus musculus
aagccctggtcgcattggcctgaga

SEQ ID NO: 53764 - DNA, 25 bp, Mus musculus
aagccctggtcggattggcctgaga

SEQ ID NO: 53765 - DNA, 25 bp, Mus musculus
aagccctggtgcactggaaccaatg

SEQ ID NO: 53766 - DNA, 25 bp, Mus musculus
aagccctggtgctctggaaccaatg

SEQ ID NO: 53767 - DNA, 25 bp, Mus musculus
aagccctggtggctctaatgtctag

SEQ ID NO: 53768 - DNA, 25 bp, Mus musculus
aagccctggtgggtctaatgtctag

SEQ ID NO: 53769 - DNA, 25 bp, Mus musculus
aagccctgtaatagtgtcccaagga

SEQ ID NO: 53770 - DNA, 25 bp, Mus musculus
aagccctgtaattgtgtcccaagga

SEQ ID NO: 53771 - DNA, 25 bp, Mus musculus
aagccctgtaggaatcaaccagcaa

SEQ ID NO: 53772 - DNA, 25 bp, Mus musculus
aagccctgtaggtatcaaccagcaa

SEQ ID NO: 53773 - DNA, 25 bp, Mus musculus
aagccctgtcagagtttccatgata

SEQ ID NO: 53774 - DNA, 25 bp, Mus musculus
aagccctgtcagtgtttccatgata

SEQ ID NO: 53775 - DNA, 25 bp, Mus musculus
aagccctgtgacaatgtctaggttc

SEQ ID NO: 53776 - DNA, 25 bp, Mus musculus
aagccctgtgactatgtctaggttc

SEQ ID NO: 53777 - DNA, 25 bp, Mus musculus
aagccctgtgccctgctatgaggaa

SEQ ID NO: 53778 - DNA, 25 bp, Mus musculus
aagccctgtgccgtgctatgaggaa

SEQ ID NO: 53779 - DNA, 25 bp, Mus musculus
aagccctgtggaccagtatggaaac

SEQ ID NO: 53780 - DNA, 25 bp, Mus musculus
aagccctgtggagcagtatggaaac

SEQ ID NO: 53781 - DNA, 25 bp, Mus musculus
aagccctgtgggaactctctctgaa

SEQ ID NO: 53782 - DNA, 25 bp, Mus musculus
aagccctgtgggtactctctctgaa

SEQ ID NO: 53783 - DNA, 25 bp, Mus musculus
aagccctgtggtacttcggctcggc

SEQ ID NO: 53784 - DNA, 25 bp, Mus musculus
aagccctgtggttcttcggctcggc

SEQ ID NO: 53785 - DNA, 25 bp, Mus musculus
aagccctgtgttccagctgctggtg

SEQ ID NO: 53786 - DNA, 25 bp, Mus musculus
aagccctgtgttgcagctgctggtg

SEQ ID NO: 53787 - DNA, 25 bp, Mus musculus
aagcccttacttcacagatggagac

SEQ ID NO: 53788 - DNA, 25 bp, Mus musculus
aagcccttacttgacagatggagac

SEQ ID NO: 53789 - DNA, 25 bp, Mus musculus
aagcccttagaaaccactggcagag

SEQ ID NO: 53790 - DNA, 25 bp, Mus musculus
aagcccttagaatccactggcagag

SEQ ID NO: 53791 - DNA, 25 bp, Mus musculus
aagcccttagagcaccagctctgct

SEQ ID NO: 53792 - DNA, 25 bp, Mus musculus
aagcccttagaggaccagctctgct

SEQ ID NO: 53793 - DNA, 25 bp, Mus musculus
aagcccttagggacatcagagccac

SEQ ID NO: 53794 - DNA, 25 bp, Mus musculus
aagcccttagggtcatcagagccac

SEQ ID NO: 53795 - DNA, 25 bp, Mus musculus
aagcccttagtaattcctctctagt

SEQ ID NO: 53796 - DNA, 25 bp, Mus musculus
aagcccttagtatttcctctctagt

SEQ ID NO: 53797 - DNA, 25 bp, Mus musculus
aagcccttcaagaggtacctggaca

SEQ ID NO: 53798 - DNA, 25 bp, Mus musculus
aagcccttcaagtggtacctggaca

SEQ ID NO: 53799 - DNA, 25 bp, Mus musculus
aagcccttcactagatgagcaacct

SEQ ID NO: 53800 - DNA, 25 bp, Mus musculus
aagcccttcacttgatgagcaacct

SEQ ID NO: 53801 - DNA, 25 bp, Mus musculus
aagcccttccacaggatgcgaagaa

SEQ ID NO: 53802 - DNA, 25 bp, Mus musculus
aagcccttccactggatgcgaagaa

SEQ ID NO: 53803 - DNA, 25 bp, Mus musculus
aagcccttctgtcatctcaaaaact

SEQ ID NO: 53804 - DNA, 25 bp, Mus musculus
aagcccttctgtgatctcaaaaact

SEQ ID NO: 53805 - DNA, 25 bp, Mus musculus
aagcccttctttacatggtggtagc

SEQ ID NO: 53806 - DNA, 25 bp, Mus musculus
aagcccttcttttcatggtggtagc

SEQ ID NO: 53807 - DNA, 25 bp, Mus musculus
aagcccttgaagatattatgcccaa

SEQ ID NO: 53808 - DNA, 25 bp, Mus musculus
aagcccttgaagttattatgcccaa

SEQ ID NO: 53809 - DNA, 25 bp, Mus musculus
aagcccttgacaatcgcagcacttg

SEQ ID NO: 53810 - DNA, 25 bp, Mus musculus
aagcccttgacattcgcagcacttg

SEQ ID NO: 53811 - DNA, 25 bp, Mus musculus
aagcccttgagacactttgctgcaa

SEQ ID NO: 53812 - DNA, 25 bp, Mus musculus
aagcccttgagagactttgctgcaa

SEQ ID NO: 53813 - DNA, 25 bp, Mus musculus
aagcccttgcagcagtacttgggaa

SEQ ID NO: 53814 - DNA, 25 bp, Mus musculus
aagcccttgcaggagtacttgggaa

SEQ ID NO: 53815 - DNA, 25 bp, Mus musculus
aagcccttgcgtatgcgtgtccgag

SEQ ID NO: 53816 - DNA, 25 bp, Mus musculus
aagcccttgcgtttgcgtgtccgag

SEQ ID NO: 53817 - DNA, 25 bp, Mus musculus
aagcccttgctgaaggttcagtagt

SEQ ID NO: 53818 - DNA, 25 bp, Mus musculus
aagcccttgctgtaggttcagtagt

SEQ ID NO: 53819 - DNA, 25 bp, Mus musculus
aagcccttggccaggttcacgtgga

SEQ ID NO: 53820 - DNA, 25 bp, Mus musculus
aagcccttggcctggttcacgtgga

SEQ ID NO: 53821 - DNA, 25 bp, Mus musculus
aagcccttgtctaaacccttgagtg

SEQ ID NO: 53822 - DNA, 25 bp, Mus musculus
aagcccttgtcttaacccttgagtg

SEQ ID NO: 53823 - DNA, 25 bp, Mus musculus
aagccctttctcaagttctggctat

SEQ ID NO: 53824 - DNA, 25 bp, Mus musculus
aagccctttctcaatgggctgacag

SEQ ID NO: 53825 - DNA, 25 bp, Mus musculus
aagccctttctctagttctggctat

SEQ ID NO: 53826 - DNA, 25 bp, Mus musculus
aagccctttctctatgggctgacag

SEQ ID NO: 53827 - DNA, 25 bp, Mus musculus
aagccctttctgactctgaggtatc

SEQ ID NO: 53828 - DNA, 25 bp, Mus musculus
aagccctttctgtctctgaggtatc

SEQ ID NO: 53829 - DNA, 25 bp, Mus musculus
aagccctttggcatcagattgccta

SEQ ID NO: 53830 - DNA, 25 bp, Mus musculus
aagccctttggcttcagattgccta

SEQ ID NO: 53831 - DNA, 25 bp, Mus musculus
aagccctttgtccttcagaacagga

SEQ ID NO: 53832 - DNA, 25 bp, Mus musculus
aagccctttgtcgttcagaacagga

SEQ ID NO: 53833 - DNA, 25 bp, Mus musculus
aagccctttgttcctttggctgtga

SEQ ID NO: 53834 - DNA, 25 bp, Mus musculus
aagccctttgttgctttggctgtga

SEQ ID NO: 53835 - DNA, 25 bp, Mus musculus
aagccgaacttcagattcagacccc

SEQ ID NO: 53836 - DNA, 25 bp, Mus musculus
aagccgaacttctgattcagacccc

SEQ ID NO: 53837 - DNA, 25 bp, Mus musculus
aagccgaagaccatagagacatata

SEQ ID NO: 53838 - DNA, 25 bp, Mus musculus
aagccgaagaccttagagacatata

SEQ ID NO: 53839 - DNA, 25 bp, Mus musculus
aagccgaagcctccttggaagtgag

SEQ ID NO: 53840 - DNA, 25 bp, Mus musculus
aagccgaagcctgcttggaagtgag

SEQ ID NO: 53841 - DNA, 25 bp, Mus musculus
aagccgaaggtgagccctttctgca

SEQ ID NO: 53842 - DNA, 25 bp, Mus musculus
aagccgaaggtgtgccctttctgca

SEQ ID NO: 53843 - DNA, 25 bp, Mus musculus
aagccgaagtgcctgcgccgcgcta

SEQ ID NO: 53844 - DNA, 25 bp, Mus musculus
aagccgaagtgcgtgcgccgcgcta

SEQ ID NO: 53845 - DNA, 25 bp, Mus musculus
aagccgacagcaacttcagcggatt

SEQ ID NO: 53846 - DNA, 25 bp, Mus musculus
aagccgacagcatcttcagcggatt

SEQ ID NO: 53847 - DNA, 25 bp, Mus musculus
aagccgaccatgagcgccgagagac

SEQ ID NO: 53848 - DNA, 25 bp, Mus musculus
aagccgaccatgtgcgccgagagac

SEQ ID NO: 53849 - DNA, 25 bp, Mus musculus
aagccgactcggaagattctcttga

SEQ ID NO: 53850 - DNA, 25 bp, Mus musculus
aagccgactcggtagattctcttga

SEQ ID NO: 53851 - DNA, 25 bp, Mus musculus
aagccgacttcccaggccagtgggt

SEQ ID NO: 53852 - DNA, 25 bp, Mus musculus
aagccgacttccgaggccagtgggt

SEQ ID NO: 53853 - DNA, 25 bp, Mus musculus
aagccgacttgccatcctgatgaaa

SEQ ID NO: 53854 - DNA, 25 bp, Mus musculus
aagccgacttgcgatcctgatgaaa

SEQ ID NO: 53855 - DNA, 25 bp, Mus musculus
aagccgagaccacaggttgcctcgt

SEQ ID NO: 53856 - DNA, 25 bp, Mus musculus
aagccgagaccagaggttgcctcgt

SEQ ID NO: 53857 - DNA, 25 bp, Mus musculus
aagccgagccagactctttcaacca

SEQ ID NO: 53858 - DNA, 25 bp, Mus musculus
aagccgagccagtctctttcaacca

SEQ ID NO: 53859 - DNA, 25 bp, Mus musculus
aagccgagcgggactgggtcgggct

SEQ ID NO: 53860 - DNA, 25 bp, Mus musculus
aagccgagcgggtctgggtcgggct

SEQ ID NO: 53861 - DNA, 25 bp, Mus musculus
aagccgagcggtagatggaagttga

SEQ ID NO: 53862 - DNA, 25 bp, Mus musculus
aagccgagcggttgatggaagttga

SEQ ID NO: 53863 - DNA, 25 bp, Mus musculus
aagccgaggctgatgtgttgacgct

SEQ ID NO: 53864 - DNA, 25 bp, Mus musculus
aagccgaggctgttgtgttgacgct

SEQ ID NO: 53865 - DNA, 25 bp, Mus musculus
aagccgaggtggcttcacaccaaat

SEQ ID NO: 53866 - DNA, 25 bp, Mus musculus
aagccgaggtgggttcacaccaaat

SEQ ID NO: 53867 - DNA, 25 bp, Mus musculus
aagccgagtcgaagttgtttctaga

SEQ ID NO: 53868 - DNA, 25 bp, Mus musculus
aagccgagtcgatgttgtttctaga

SEQ ID NO: 53869 - DNA, 25 bp, Mus musculus
aagccgatccacatgatcctatgtt

SEQ ID NO: 53870 - DNA, 25 bp, Mus musculus
aagccgatccacttgatcctatgtt

SEQ ID NO: 53871 - DNA, 25 bp, Mus musculus
aagccgattttcctgtaggaagatg

SEQ ID NO: 53872 - DNA, 25 bp, Mus musculus
aagccgattttcgtgtaggaagatg

SEQ ID NO: 53873 - DNA, 25 bp, Mus musculus
aagccgcaagcccaagaaccaaggt

SEQ ID NO: 53874 - DNA, 25 bp, Mus musculus
aagccgcaagccgaagaaccaaggt

SEQ ID NO: 53875 - DNA, 25 bp, Mus musculus
aagccgcactagacacaatcgcaga

SEQ ID NO: 53876 - DNA, 25 bp, Mus musculus
aagccgcactagtcacaatcgcaga

SEQ ID NO: 53877 - DNA, 25 bp, Mus musculus
aagccgcactgcctgggcaagacta

SEQ ID NO: 53878 - DNA, 25 bp, Mus musculus
aagccgcactgcgtgggcaagacta

SEQ ID NO: 53879 - DNA, 25 bp, Mus musculus
aagccgcagacccttttactgagaa

SEQ ID NO: 53880 - DNA, 25 bp, Mus musculus
aagccgcagaccgttttactgagaa

SEQ ID NO: 53881 - DNA, 25 bp, Mus musculus
aagccgcagcatactaccagaaggt

SEQ ID NO: 53882 - DNA, 25 bp, Mus musculus
aagccgcagcattctaccagaaggt

SEQ ID NO: 53883 - DNA, 25 bp, Mus musculus
aagccgcagcctatcctggattcat

SEQ ID NO: 53884 - DNA, 25 bp, Mus musculus
aagccgcagcctttcctggattcat

SEQ ID NO: 53885 - DNA, 25 bp, Mus musculus
aagccgcaggcgaattgtcagtctc

SEQ ID NO: 53886 - DNA, 25 bp, Mus musculus
aagccgcaggcgtattgtcagtctc

SEQ ID NO: 53887 - DNA, 25 bp, Mus musculus
aagccgcaggtaatcatgcagtaaa

SEQ ID NO: 53888 - DNA, 25 bp, Mus musculus
aagccgcaggtattcatgcagtaaa

SEQ ID NO: 53889 - DNA, 25 bp, Mus musculus
aagccgcatcaaatttgtccttcag

SEQ ID NO: 53890 - DNA, 25 bp, Mus musculus
aagccgcatcaattttgtccttcag

SEQ ID NO: 53891 - DNA, 25 bp, Mus musculus
aagccgcatggaatagttcgagcct

SEQ ID NO: 53892 - DNA, 25 bp, Mus musculus
aagccgcatggattagttcgagcct

SEQ ID NO: 53893 - DNA, 25 bp, Mus musculus
aagccgccacggaatctgtcagcag

SEQ ID NO: 53894 - DNA, 25 bp, Mus musculus
aagccgccacggtatctgtcagcag

SEQ ID NO: 53895 - DNA, 25 bp, Mus musculus
aagccgccagtgacatcaaccaggt

SEQ ID NO: 53896 - DNA, 25 bp, Mus musculus
aagccgccagtgtcatcaaccaggt

SEQ ID NO: 53897 - DNA, 25 bp, Mus musculus
aagccgccattcctcagtggagaaa

SEQ ID NO: 53898 - DNA, 25 bp, Mus musculus
aagccgccattcgtcagtggagaaa

SEQ ID NO: 53899 - DNA, 25 bp, Mus musculus
aagccgccgttcaagctacttaggt

SEQ ID NO: 53900 - DNA, 25 bp, Mus musculus
aagccgccgttctagctacttaggt

SEQ ID NO: 53901 - DNA, 25 bp, Mus musculus
aagccgcctcggcagcagccaagga

SEQ ID NO: 53902 - DNA, 25 bp, Mus musculus
aagccgcctcgggagcagccaagga

SEQ ID NO: 53903 - DNA, 25 bp, Mus musculus
aagccgccttctagttgagtttgaa

SEQ ID NO: 53904 - DNA, 25 bp, Mus musculus
aagccgccttcttgttgagtttgaa

SEQ ID NO: 53905 - DNA, 25 bp, Mus musculus
aagccgcggtccacgtagaaggtga

SEQ ID NO: 53906 - DNA, 25 bp, Mus musculus
aagccgcggtcctcgtagaaggtga

SEQ ID NO: 53907 - DNA, 25 bp, Mus musculus
aagccgctcctaccaccctgaaact

SEQ ID NO: 53908 - DNA, 25 bp, Mus musculus
aagccgctcctagcaccctgaaact

SEQ ID NO: 53909 - DNA, 25 bp, Mus musculus
aagccgctgtagagctgcgatccag

SEQ ID NO: 53910 - DNA, 25 bp, Mus musculus
aagccgctgtagtgctgcgatccag

SEQ ID NO: 53911 - DNA, 25 bp, Mus musculus
aagccgctgtatcatgctgggttcc

SEQ ID NO: 53912 - DNA, 25 bp, Mus musculus
aagccgctgtatgatgctgggttcc

SEQ ID NO: 53913 - DNA, 25 bp, Mus musculus
aagccgctgttcaaacacatcaaca

SEQ ID NO: 53914 - DNA, 25 bp, Mus musculus
aagccgctgttctaacacatcaaca

SEQ ID NO: 53915 - DNA, 25 bp, Mus musculus
aagccgcttgggagttctcttctgc

SEQ ID NO: 53916 - DNA, 25 bp, Mus musculus
aagccgcttgggtgttctcttctgc

SEQ ID NO: 53917 - DNA, 25 bp, Mus musculus
aagccggaacatcttacagcccaca

SEQ ID NO: 53918 - DNA, 25 bp, Mus musculus
aagccggaacatgttacagcccaca

SEQ ID NO: 53919 - DNA, 25 bp, Mus musculus
aagccggaagcgctatgagccatca

SEQ ID NO: 53920 - DNA, 25 bp, Mus musculus
aagccggaagcggtatgagccatca

SEQ ID NO: 53921 - DNA, 25 bp, Mus musculus
aagccggacaagagggccagcctca

SEQ ID NO: 53922 - DNA, 25 bp, Mus musculus
aagccggacaagtgggccagcctca

SEQ ID NO: 53923 - DNA, 25 bp, Mus musculus
aagccggatcaacgcatcgtgacgc

SEQ ID NO: 53924 - DNA, 25 bp, Mus musculus
aagccggatcaaggcatcgtgacgc

SEQ ID NO: 53925 - DNA, 25 bp, Mus musculus
aagccggatgtcatcaagagccccg

SEQ ID NO: 53926 - DNA, 25 bp, Mus musculus
aagccggatgtcttcaagagccccg

SEQ ID NO: 53927 - DNA, 25 bp, Mus musculus
aagccggcaagaaggacgtggtacc

SEQ ID NO: 53928 - DNA, 25 bp, Mus musculus
aagccggcaagatggacgtggtacc

SEQ ID NO: 53929 - DNA, 25 bp, Mus musculus
aagccggccaaacgcagtcaacagt

SEQ ID NO: 53930 - DNA, 25 bp, Mus musculus
aagccggccaaaggcagtcaacagt

SEQ ID NO: 53931 - DNA, 25 bp, Mus musculus
aagccggccagacatgggattgcat

SEQ ID NO: 53932 - DNA, 25 bp, Mus musculus
aagccggccagagatgggattgcat

SEQ ID NO: 53933 - DNA, 25 bp, Mus musculus
aagccggcctcaagctcatagcgag

SEQ ID NO: 53934 - DNA, 25 bp, Mus musculus
aagccggcctcatgctcatagcgag

SEQ ID NO: 53935 - DNA, 25 bp, Mus musculus
aagccggcgctaccatgttcttttt

SEQ ID NO: 53936 - DNA, 25 bp, Mus musculus
aagccggcgctagcatgttcttttt

SEQ ID NO: 53937 - DNA, 25 bp, Mus musculus
aagccggctagacaaaggtatagac

SEQ ID NO: 53938 - DNA, 25 bp, Mus musculus
aagccggctagagaaaggtatagac

SEQ ID NO: 53939 - DNA, 25 bp, Mus musculus
aagccggctcagagcgcgtcatctc

SEQ ID NO: 53940 - DNA, 25 bp, Mus musculus
aagccggctcagtgcgcgtcatctc

SEQ ID NO: 53941 - DNA, 25 bp, Mus musculus
aagccggctccacagaagggcatgt

SEQ ID NO: 53942 - DNA, 25 bp, Mus musculus
aagccggctccagagaagggcatgt

SEQ ID NO: 53943 - DNA, 25 bp, Mus musculus
aagccggctcgcagctgctcagtgt

SEQ ID NO: 53944 - DNA, 25 bp, Mus musculus
aagccggctcgctgctgctcagtgt

SEQ ID NO: 53945 - DNA, 25 bp, Mus musculus
aagccggctgacatgcctcagggat

SEQ ID NO: 53946 - DNA, 25 bp, Mus musculus
aagccggctgacttgcctcagggat

SEQ ID NO: 53947 - DNA, 25 bp, Mus musculus
aagccggcttcaaacctgtgatctt

SEQ ID NO: 53948 - DNA, 25 bp, Mus musculus
aagccggcttcatacctgtgatctt

SEQ ID NO: 53949 - DNA, 25 bp, Mus musculus
aagccgggaaacagctggctctgtg

SEQ ID NO: 53950 - DNA, 25 bp, Mus musculus
aagccgggaaactgctggctctgtg

SEQ ID NO: 53951 - DNA, 25 bp, Mus musculus
aagccgggaagcctatcccacgaag

SEQ ID NO: 53952 - DNA, 25 bp, Mus musculus
aagccgggaagcgtatcccacgaag

SEQ ID NO: 53953 - DNA, 25 bp, Mus musculus
aagccgggcagtccatttacagcac

SEQ ID NO: 53954 - DNA, 25 bp, Mus musculus
aagccgggcagtgcatttacagcac

SEQ ID NO: 53955 - DNA, 25 bp, Mus musculus
aagccgggtatcattcttagaagca

SEQ ID NO: 53956 - DNA, 25 bp, Mus musculus
aagccgggtatctttcttagaagca

SEQ ID NO: 53957 - DNA, 25 bp, Mus musculus
aagccgggttcaaaacgctgcagct

SEQ ID NO: 53958 - DNA, 25 bp, Mus musculus
aagccgggttcataacgctgcagct

SEQ ID NO: 53959 - DNA, 25 bp, Mus musculus
aagccggtaaccatcttctgaaatg

SEQ ID NO: 53960 - DNA, 25 bp, Mus musculus
aagccggtaaccttcttctgaaatg

SEQ ID NO: 53961 - DNA, 25 bp, Mus musculus
aagccggtacgtcctgcgagcaatc

SEQ ID NO: 53962 - DNA, 25 bp, Mus musculus
aagccggtacgtgctgcgagcaatc

SEQ ID NO: 53963 - DNA, 25 bp, Mus musculus
aagccggtattaactagtctgccaa

SEQ ID NO: 53964 - DNA, 25 bp, Mus musculus
aagccggtattatctagtctgccaa

SEQ ID NO: 53965 - DNA, 25 bp, Mus musculus
aagccggtcacccagttggtgtgct

SEQ ID NO: 53966 - DNA, 25 bp, Mus musculus
aagccggtcaccgagttggtgtgct

SEQ ID NO: 53967 - DNA, 25 bp, Mus musculus
aagccggtccagacttgtcttgttc

SEQ ID NO: 53968 - DNA, 25 bp, Mus musculus
aagccggtccagtcttgtcttgttc

SEQ ID NO: 53969 - DNA, 25 bp, Mus musculus
aagccggtccataagttccagcact

SEQ ID NO: 53970 - DNA, 25 bp, Mus musculus
aagccggtccattagttccagcact

SEQ ID NO: 53971 - DNA, 25 bp, Mus musculus
aagccggtccttaataatcagagaa

SEQ ID NO: 53972 - DNA, 25 bp, Mus musculus
aagccggtcctttataatcagagaa

SEQ ID NO: 53973 - DNA, 25 bp, Mus musculus
aagccggtctctcttaagacgttca

SEQ ID NO: 53974 - DNA, 25 bp, Mus musculus
aagccggtctctgttaagacgttca

SEQ ID NO: 53975 - DNA, 25 bp, Mus musculus
aagccggtgcgcagctgaaaacgat

SEQ ID NO: 53976 - DNA, 25 bp, Mus musculus
aagccggtgcgctgctgaaaacgat

SEQ ID NO: 53977 - DNA, 25 bp, Mus musculus
aagccggtgtggagccttctgttat

SEQ ID NO: 53978 - DNA, 25 bp, Mus musculus
aagccggtgtggtgccttctgttat

SEQ ID NO: 53979 - DNA, 25 bp, Mus musculus
aagccggttccaaattccatgtgag

SEQ ID NO: 53980 - DNA, 25 bp, Mus musculus
aagccggttccatattccatgtgag

SEQ ID NO: 53981 - DNA, 25 bp, Mus musculus
aagccggttcttccgaaagactcgt

SEQ ID NO: 53982 - DNA, 25 bp, Mus musculus
aagccggttcttgcgaaagactcgt

SEQ ID NO: 53983 - DNA, 25 bp, Mus musculus
aagccgtaccccagtgaaatctgtg

SEQ ID NO: 53984 - DNA, 25 bp, Mus musculus
aagccgtacccctgtgaaatctgtg

SEQ ID NO: 53985 - DNA, 25 bp, Mus musculus
aagccgtcaaggctcttcgtaagca

SEQ ID NO: 53986 - DNA, 25 bp, Mus musculus
aagccgtcaagggtcttcgtaagca

SEQ ID NO: 53987 - DNA, 25 bp, Mus musculus
aagccgtcacttaagtgtcagccta

SEQ ID NO: 53988 - DNA, 25 bp, Mus musculus
aagccgtcactttagtgtcagccta

SEQ ID NO: 53989 - DNA, 25 bp, Mus musculus
aagccgtcatttaatcttgcctctc

SEQ ID NO: 53990 - DNA, 25 bp, Mus musculus
aagccgtcattttatcttgcctctc

SEQ ID NO: 53991 - DNA, 25 bp, Mus musculus
aagccgtgaactaccatgatgaaac

SEQ ID NO: 53992 - DNA, 25 bp, Mus musculus
aagccgtgaacttccatgatgaaac

SEQ ID NO: 53993 - DNA, 25 bp, Mus musculus
aagccgtgagcgacctgcaggaaaa

SEQ ID NO: 53994 - DNA, 25 bp, Mus musculus
aagccgtgagcgtcctgcaggaaaa

SEQ ID NO: 53995 - DNA, 25 bp, Mus musculus
aagccgtgagctctcgaatcaatca

SEQ ID NO: 53996 - DNA, 25 bp, Mus musculus
aagccgtgagctgtcgaatcaatca

SEQ ID NO: 53997 - DNA, 25 bp, Mus musculus
aagccgtgcaaacttcttctactag

SEQ ID NO: 53998 - DNA, 25 bp, Mus musculus
aagccgtgcaaagttcttctactag

SEQ ID NO: 53999 - DNA, 25 bp, Mus musculus
aagccgtgcaccatgtgtttagaga

SEQ ID NO: 54000 - DNA, 25 bp, Mus musculus
aagccgtgcaccttgtgtttagaga

SEQ ID NO: 54001 - DNA, 25 bp, Mus musculus
aagccgtgcatcagtttggtgacta

SEQ ID NO: 54002 - DNA, 25 bp, Mus musculus
aagccgtgcatctgtttggtgacta

SEQ ID NO: 54003 - DNA, 25 bp, Mus musculus
aagccgtgcggtacaagagctccgg

SEQ ID NO: 54004 - DNA, 25 bp, Mus musculus
aagccgtgcggttcaagagctccgg

SEQ ID NO: 54005 - DNA, 25 bp, Mus musculus
aagccgtggctgaggaacctcctgg

SEQ ID NO: 54006 - DNA, 25 bp, Mus musculus
aagccgtggctgtggaacctcctgg

SEQ ID NO: 54007 - DNA, 25 bp, Mus musculus
aagccgtggttcacatgagccagga

SEQ ID NO: 54008 - DNA, 25 bp, Mus musculus
aagccgtggttctcatgagccagga

SEQ ID NO: 54009 - DNA, 25 bp, Mus musculus
aagccgtgtccgagtatttgaacag

SEQ ID NO: 54010 - DNA, 25 bp, Mus musculus
aagccgtgtccgtgtatttgaacag

SEQ ID NO: 54011 - DNA, 25 bp, Mus musculus
aagccgtgtctcctgttcacattgt

SEQ ID NO: 54012 - DNA, 25 bp, Mus musculus
aagccgtgtctcgtgttcacattgt

SEQ ID NO: 54013 - DNA, 25 bp, Mus musculus
aagccgtgtgcacagggtacctgat

SEQ ID NO: 54014 - DNA, 25 bp, Mus musculus
aagccgtgtgcagagggtacctgat

SEQ ID NO: 54015 - DNA, 25 bp, Mus musculus
aagccgtgtgccagggtgtatgaca

SEQ ID NO: 54016 - DNA, 25 bp, Mus musculus
aagccgtgtgcctgggtgtatgaca

SEQ ID NO: 54017 - DNA, 25 bp, Mus musculus
aagccgtgttagcacatctgtagta

SEQ ID NO: 54018 - DNA, 25 bp, Mus musculus
aagccgtgttaggacatctgtagta

SEQ ID NO: 54019 - DNA, 25 bp, Mus musculus
aagccgtgttctagactgcaccaga

SEQ ID NO: 54020 - DNA, 25 bp, Mus musculus
aagccgtgttcttgactgcaccaga

SEQ ID NO: 54021 - DNA, 25 bp, Mus musculus
aagccgtgtttcatctgctgtgaac

SEQ ID NO: 54022 - DNA, 25 bp, Mus musculus
aagccgtgtttcttctgctgtgaac

SEQ ID NO: 54023 - DNA, 25 bp, Mus musculus
aagccgttcctccaggacagggaag

SEQ ID NO: 54024 - DNA, 25 bp, Mus musculus
aagccgttcctcgaggacagggaag

SEQ ID NO: 54025 - DNA, 25 bp, Mus musculus
aagccgttctctcttggagctgcaa

SEQ ID NO: 54026 - DNA, 25 bp, Mus musculus
aagccgttctctgttggagctgcaa

SEQ ID NO: 54027 - DNA, 25 bp, Mus musculus
aagccgttgatgaagctgtctctca

SEQ ID NO: 54028 - DNA, 25 bp, Mus musculus
aagccgttgatgtagctgtctctca

SEQ ID NO: 54029 - DNA, 25 bp, Mus musculus
aagccgttgctacgtaactaatgag

SEQ ID NO: 54030 - DNA, 25 bp, Mus musculus
aagccgttgctaggtaactaatgag

SEQ ID NO: 54031 - DNA, 25 bp, Mus musculus
aagccgtttctcaggatgatttata

SEQ ID NO: 54032 - DNA, 25 bp, Mus musculus
aagccgtttctctggatgatttata

SEQ ID NO: 54033 - DNA, 25 bp, Mus musculus
aagccgtttgctaaccgtcctcaca

SEQ ID NO: 54034 - DNA, 25 bp, Mus musculus
aagccgtttgcttaccgtcctcaca

SEQ ID NO: 54035 - DNA, 25 bp, Mus musculus
aagcctaaattgagctccactggga

SEQ ID NO: 54036 - DNA, 25 bp, Mus musculus
aagcctaaattgtgctccactggga

SEQ ID NO: 54037 - DNA, 25 bp, Mus musculus
aagcctaacccaactttgtcgtttg

SEQ ID NO: 54038 - DNA, 25 bp, Mus musculus
aagcctaacccatctttgtcgtttg

SEQ ID NO: 54039 - DNA, 25 bp, Mus musculus
aagcctaactgcagagctgggcact

SEQ ID NO: 54040 - DNA, 25 bp, Mus musculus
aagcctaactgctgagctgggcact

SEQ ID NO: 54041 - DNA, 25 bp, Mus musculus
aagcctaagcgtcgccctgacagga

SEQ ID NO: 54042 - DNA, 25 bp, Mus musculus
aagcctaagcgtggccctgacagga

SEQ ID NO: 54043 - DNA, 25 bp, Mus musculus
aagcctaagctacattgacttcatg

SEQ ID NO: 54044 - DNA, 25 bp, Mus musculus
aagcctaagctagattgacttcatg

SEQ ID NO: 54045 - DNA, 25 bp, Mus musculus
aagcctaaggcacctaagccaaaga

SEQ ID NO: 54046 - DNA, 25 bp, Mus musculus
aagcctaaggcagctaagccaaaga

SEQ ID NO: 54047 - DNA, 25 bp, Mus musculus
aagcctaaggtgacctggatccacg

SEQ ID NO: 54048 - DNA, 25 bp, Mus musculus
aagcctaaggtgtcctggatccacg

SEQ ID NO: 54049 - DNA, 25 bp, Mus musculus
aagcctaatagtagtttttgtgtgt

SEQ ID NO: 54050 - DNA, 25 bp, Mus musculus
aagcctaatagttgtttttgtgtgt

SEQ ID NO: 54051 - DNA, 25 bp, Mus musculus
aagcctaatattcctgttttgctga

SEQ ID NO: 54052 - DNA, 25 bp, Mus musculus
aagcctaatattgctgttttgctga

SEQ ID NO: 54053 - DNA, 25 bp, Mus musculus
aagcctacactgacactttactgag

SEQ ID NO: 54054 - DNA, 25 bp, Mus musculus
aagcctacactgtcactttactgag

SEQ ID NO: 54055 - DNA, 25 bp, Mus musculus
aagcctacagctagttccagcctgg

SEQ ID NO: 54056 - DNA, 25 bp, Mus musculus
aagcctacagcttgttccagcctgg

SEQ ID NO: 54057 - DNA, 25 bp, Mus musculus
aagcctacagtgagatcggcacaaa

SEQ ID NO: 54058 - DNA, 25 bp, Mus musculus
aagcctacagtgtgatcggcacaaa

SEQ ID NO: 54059 - DNA, 25 bp, Mus musculus
aagcctaccagcaagtgttagttca

SEQ ID NO: 54060 - DNA, 25 bp, Mus musculus
aagcctaccagctagtgttagttca

SEQ ID NO: 54061 - DNA, 25 bp, Mus musculus
aagcctacctagcagctggtgatga

SEQ ID NO: 54062 - DNA, 25 bp, Mus musculus
aagcctacctaggagctggtgatga

SEQ ID NO: 54063 - DNA, 25 bp, Mus musculus
aagcctacctttaagtgccagcatt

SEQ ID NO: 54064 - DNA, 25 bp, Mus musculus
aagcctaccttttagtgccagcatt

SEQ ID NO: 54065 - DNA, 25 bp, Mus musculus
aagcctacgagaccatccaagctgc

SEQ ID NO: 54066 - DNA, 25 bp, Mus musculus
aagcctacgagagcatccaagctgc

SEQ ID NO: 54067 - DNA, 25 bp, Mus musculus
aagcctactcagctactcaagtatt

SEQ ID NO: 54068 - DNA, 25 bp, Mus musculus
aagcctactcaggtactcaagtatt

SEQ ID NO: 54069 - DNA, 25 bp, Mus musculus
aagcctagaaaacatgccatcgtgg

SEQ ID NO: 54070 - DNA, 25 bp, Mus musculus
aagcctagaaaagatgccatcgtgg

SEQ ID NO: 54071 - DNA, 25 bp, Mus musculus
aagcctagaacactgctacttcaag

SEQ ID NO: 54072 - DNA, 25 bp, Mus musculus
aagcctagaacagtgctacttcaag

SEQ ID NO: 54073 - DNA, 25 bp, Mus musculus
aagcctagcagaccctggagctggc

SEQ ID NO: 54074 - DNA, 25 bp, Mus musculus
aagcctagcagagcctggagctggc

SEQ ID NO: 54075 - DNA, 25 bp, Mus musculus
aagcctagccagcacctttgtattt

SEQ ID NO: 54076 - DNA, 25 bp, Mus musculus
aagcctagccaggacctttgtattt

SEQ ID NO: 54077 - DNA, 25 bp, Mus musculus
aagcctaggaggatcgagtccctat

SEQ ID NO: 54078 - DNA, 25 bp, Mus musculus
aagcctaggaggttcgagtccctat

SEQ ID NO: 54079 - DNA, 25 bp, Mus musculus
aagcctaggctgcacagggtttact

SEQ ID NO: 54080 - DNA, 25 bp, Mus musculus
aagcctaggctggacagggtttact

SEQ ID NO: 54081 - DNA, 25 bp, Mus musculus
aagcctagggagaagctctgagttt

SEQ ID NO: 54082 - DNA, 25 bp, Mus musculus
aagcctagggagtagctctgagttt

SEQ ID NO: 54083 - DNA, 25 bp, Mus musculus
aagcctagggctcaaaagtctcttc

SEQ ID NO: 54084 - DNA, 25 bp, Mus musculus
aagcctagggctgaaaagtctcttc

SEQ ID NO: 54085 - DNA, 25 bp, Mus musculus
aagcctagtatcctgctctttcggg

SEQ ID NO: 54086 - DNA, 25 bp, Mus musculus
aagcctagtatcgtgctctttcggg

SEQ ID NO: 54087 - DNA, 25 bp, Mus musculus
aagcctagtctaatgagtcccatga

SEQ ID NO: 54088 - DNA, 25 bp, Mus musculus
aagcctagtctattgagtcccatga

SEQ ID NO: 54089 - DNA, 25 bp, Mus musculus
aagcctagttctatatgctatgata

SEQ ID NO: 54090 - DNA, 25 bp, Mus musculus
aagcctagttctttatgctatgata

SEQ ID NO: 54091 - DNA, 25 bp, Mus musculus
aagcctataagaaacttgactccta

SEQ ID NO: 54092 - DNA, 25 bp, Mus musculus
aagcctataagatacttgactccta

SEQ ID NO: 54093 - DNA, 25 bp, Mus musculus
aagcctatagatcagaactcagtgg

SEQ ID NO: 54094 - DNA, 25 bp, Mus musculus
aagcctatagatgagaactcagtgg

SEQ ID NO: 54095 - DNA, 25 bp, Mus musculus
aagcctatatagagggttcctccca

SEQ ID NO: 54096 - DNA, 25 bp, Mus musculus
aagcctatatagtgggttcctccca

SEQ ID NO: 54097 - DNA, 25 bp, Mus musculus
aagcctatatccctgggcctctgaa

SEQ ID NO: 54098 - DNA, 25 bp, Mus musculus
aagcctatatccgtgggcctctgaa

SEQ ID NO: 54099 - DNA, 25 bp, Mus musculus
aagcctatcagaaatgcctcaggaa

SEQ ID NO: 54100 - DNA, 25 bp, Mus musculus
aagcctatcagatatgcctcaggaa

SEQ ID NO: 54101 - DNA, 25 bp, Mus musculus
aagcctatccttagacttccaattt

SEQ ID NO: 54102 - DNA, 25 bp, Mus musculus
aagcctatcctttgacttccaattt

SEQ ID NO: 54103 - DNA, 25 bp, Mus musculus
aagcctatcttaaaggctggccgtg

SEQ ID NO: 54104 - DNA, 25 bp, Mus musculus
aagcctatcttataggctggccgtg

SEQ ID NO: 54105 - DNA, 25 bp, Mus musculus
aagcctatgatacactaccaataaa

SEQ ID NO: 54106 - DNA, 25 bp, Mus musculus
aagcctatgatagactaccaataaa

SEQ ID NO: 54107 - DNA, 25 bp, Mus musculus
aagcctatggttctttctgaatgag

SEQ ID NO: 54108 - DNA, 25 bp, Mus musculus
aagcctatggttgtttctgaatgag

SEQ ID NO: 54109 - DNA, 25 bp, Mus musculus
aagcctattccaatctttctgcggg

SEQ ID NO: 54110 - DNA, 25 bp, Mus musculus
aagcctattccattctttctgcggg

SEQ ID NO: 54111 - DNA, 25 bp, Mus musculus
aagcctattgaacttccaccgaata

SEQ ID NO: 54112 - DNA, 25 bp, Mus musculus
aagcctattgaagttccaccgaata

SEQ ID NO: 54113 - DNA, 25 bp, Mus musculus
aagcctattgagagctaccattata

SEQ ID NO: 54114 - DNA, 25 bp, Mus musculus
aagcctattgagtgctaccattata

SEQ ID NO: 54115 - DNA, 25 bp, Mus musculus
aagcctatttatacctctgagaaat

SEQ ID NO: 54116 - DNA, 25 bp, Mus musculus
aagcctatttattcctctgagaaat

SEQ ID NO: 54117 - DNA, 25 bp, Mus musculus
aagcctcaaagcaattcttttggtc

SEQ ID NO: 54118 - DNA, 25 bp, Mus musculus
aagcctcaaagctattcttttggtc

SEQ ID NO: 54119 - DNA, 25 bp, Mus musculus
aagcctcaacaacactgttcaaaaa

SEQ ID NO: 54120 - DNA, 25 bp, Mus musculus
aagcctcaacaagactgttcaaaaa

SEQ ID NO: 54121 - DNA, 25 bp, Mus musculus
aagcctcaactgaaacctgcagcaa

SEQ ID NO: 54122 - DNA, 25 bp, Mus musculus
aagcctcaactgtaacctgcagcaa

SEQ ID NO: 54123 - DNA, 25 bp, Mus musculus
aagcctcaagaaagttggctacttc

SEQ ID NO: 54124 - DNA, 25 bp, Mus musculus
aagcctcaagaatgttggctacttc

SEQ ID NO: 54125 - DNA, 25 bp, Mus musculus
aagcctcaagagatcctgacttttg

SEQ ID NO: 54126 - DNA, 25 bp, Mus musculus
aagcctcaagagttcctgacttttg

SEQ ID NO: 54127 - DNA, 25 bp, Mus musculus
aagcctcaaggtaccattccagtag

SEQ ID NO: 54128 - DNA, 25 bp, Mus musculus
aagcctcaaggttccattccagtag

SEQ ID NO: 54129 - DNA, 25 bp, Mus musculus
aagcctcacagtcgctttgtgcaaa

SEQ ID NO: 54130 - DNA, 25 bp, Mus musculus
aagcctcacagtggctttgtgcaaa

SEQ ID NO: 54131 - DNA, 25 bp, Mus musculus
aagcctcacatgagttcagtctctc

SEQ ID NO: 54132 - DNA, 25 bp, Mus musculus
aagcctcacatgtgttcagtctctc

SEQ ID NO: 54133 - DNA, 25 bp, Mus musculus
aagcctcacctgatcagctagactg

SEQ ID NO: 54134 - DNA, 25 bp, Mus musculus
aagcctcacctgttcagctagactg

SEQ ID NO: 54135 - DNA, 25 bp, Mus musculus
aagcctcacgtgagtgcctttatga

SEQ ID NO: 54136 - DNA, 25 bp, Mus musculus
aagcctcacgtgtgtgcctttatga

SEQ ID NO: 54137 - DNA, 25 bp, Mus musculus
aagcctcactccatgcatagctcct

SEQ ID NO: 54138 - DNA, 25 bp, Mus musculus
aagcctcactccttgcatagctcct

SEQ ID NO: 54139 - DNA, 25 bp, Mus musculus
aagcctcagcgccttctagagaatg

SEQ ID NO: 54140 - DNA, 25 bp, Mus musculus
aagcctcagcgcgttctagagaatg

SEQ ID NO: 54141 - DNA, 25 bp, Mus musculus
aagcctcagcggcaccattgggaca

SEQ ID NO: 54142 - DNA, 25 bp, Mus musculus
aagcctcagcgggaccattgggaca

SEQ ID NO: 54143 - DNA, 25 bp, Mus musculus
aagcctcagctgatgaaatgttttt

SEQ ID NO: 54144 - DNA, 25 bp, Mus musculus
aagcctcagctgttgaaatgttttt

SEQ ID NO: 54145 - DNA, 25 bp, Mus musculus
aagcctcaggcacttccacagctgt

SEQ ID NO: 54146 - DNA, 25 bp, Mus musculus
aagcctcaggcagttccacagctgt

SEQ ID NO: 54147 - DNA, 25 bp, Mus musculus
aagcctcaggccataatggaagcat

SEQ ID NO: 54148 - DNA, 25 bp, Mus musculus
aagcctcaggccttaatggaagcat

SEQ ID NO: 54149 - DNA, 25 bp, Mus musculus
aagcctcataggcattctgccaatc

SEQ ID NO: 54150 - DNA, 25 bp, Mus musculus
aagcctcatagggattctgccaatc

SEQ ID NO: 54151 - DNA, 25 bp, Mus musculus
aagcctcatataatcaccagtggta

SEQ ID NO: 54152 - DNA, 25 bp, Mus musculus
aagcctcatatattcaccagtggta

SEQ ID NO: 54153 - DNA, 25 bp, Mus musculus
aagcctcatcatagttttctcactg

SEQ ID NO: 54154 - DNA, 25 bp, Mus musculus
aagcctcatcattgttttctcactg

SEQ ID NO: 54155 - DNA, 25 bp, Mus musculus
aagcctcatcgccagggcattgacc

SEQ ID NO: 54156 - DNA, 25 bp, Mus musculus
aagcctcatcgcgagggcattgacc

SEQ ID NO: 54157 - DNA, 25 bp, Mus musculus
aagcctcatcgtcactgattttcaa

SEQ ID NO: 54158 - DNA, 25 bp, Mus musculus
aagcctcatcgtgactgattttcaa

SEQ ID NO: 54159 - DNA, 25 bp, Mus musculus
aagcctcatgatagccttgttgcaa

SEQ ID NO: 54160 - DNA, 25 bp, Mus musculus
aagcctcatgattgccttgttgcaa

SEQ ID NO: 54161 - DNA, 25 bp, Mus musculus
aagcctcatgttaagtagacagtca

SEQ ID NO: 54162 - DNA, 25 bp, Mus musculus
aagcctcatgttcatcgagccgaga

SEQ ID NO: 54163 - DNA, 25 bp, Mus musculus
aagcctcatgttgatcgagccgaga

SEQ ID NO: 54164 - DNA, 25 bp, Mus musculus
aagcctcatgtttagtagacagtca

SEQ ID NO: 54165 - DNA, 25 bp, Mus musculus
aagcctcattctagagagaagccct

SEQ ID NO: 54166 - DNA, 25 bp, Mus musculus
aagcctcattcttgagagaagccct

SEQ ID NO: 54167 - DNA, 25 bp, Mus musculus
aagcctcattgcagtggtttccctt

SEQ ID NO: 54168 - DNA, 25 bp, Mus musculus
aagcctcattgccttgatggtctgt

SEQ ID NO: 54169 - DNA, 25 bp, Mus musculus
aagcctcattgcgttgatggtctgt

SEQ ID NO: 54170 - DNA, 25 bp, Mus musculus
aagcctcattgctgtggtttccctt

SEQ ID NO: 54171 - DNA, 25 bp, Mus musculus
aagcctcatttcaattttgctgatc

SEQ ID NO: 54172 - DNA, 25 bp, Mus musculus
aagcctcatttctattttgctgatc

SEQ ID NO: 54173 - DNA, 25 bp, Mus musculus
aagcctccaaagatctcacctgtgg

SEQ ID NO: 54174 - DNA, 25 bp, Mus musculus
aagcctccaaagttctcacctgtgg

SEQ ID NO: 54175 - DNA, 25 bp, Mus musculus
aagcctccacaacgtaccacataaa

SEQ ID NO: 54176 - DNA, 25 bp, Mus musculus
aagcctccacaaggtaccacataaa

SEQ ID NO: 54177 - DNA, 25 bp, Mus musculus
aagcctccagaactccatggcagag

SEQ ID NO: 54178 - DNA, 25 bp, Mus musculus
aagcctccagaagtccatggcagag

SEQ ID NO: 54179 - DNA, 25 bp, Mus musculus
aagcctccagtacctgataacgatg

SEQ ID NO: 54180 - DNA, 25 bp, Mus musculus
aagcctccagtagctgataacgatg

SEQ ID NO: 54181 - DNA, 25 bp, Mus musculus
aagcctccatgaagttccagtactt

SEQ ID NO: 54182 - DNA, 25 bp, Mus musculus
aagcctccatgatgttccagtactt

SEQ ID NO: 54183 - DNA, 25 bp, Mus musculus
aagcctccatttacagtcgctggga

SEQ ID NO: 54184 - DNA, 25 bp, Mus musculus
aagcctccattttcagtcgctggga

SEQ ID NO: 54185 - DNA, 25 bp, Mus musculus
aagcctcccaagaactgattcctat

SEQ ID NO: 54186 - DNA, 25 bp, Mus musculus
aagcctcccaagtactgattcctat

SEQ ID NO: 54187 - DNA, 25 bp, Mus musculus
aagcctcccaatagcaagatggcag

SEQ ID NO: 54188 - DNA, 25 bp, Mus musculus
aagcctcccaattgcaagatggcag

SEQ ID NO: 54189 - DNA, 25 bp, Mus musculus
aagcctcccggacctgattaaagcc

SEQ ID NO: 54190 - DNA, 25 bp, Mus musculus
aagcctcccggagctgattaaagcc

SEQ ID NO: 54191 - DNA, 25 bp, Mus musculus
aagcctcccgggacgcatttgagat

SEQ ID NO: 54192 - DNA, 25 bp, Mus musculus
aagcctcccgggtcgcatttgagat

SEQ ID NO: 54193 - DNA, 25 bp, Mus musculus
aagcctccgattcttccaggtttgt

SEQ ID NO: 54194 - DNA, 25 bp, Mus musculus
aagcctccgattgttccaggtttgt

SEQ ID NO: 54195 - DNA, 25 bp, Mus musculus
aagcctccggttctctgaaaggact

SEQ ID NO: 54196 - DNA, 25 bp, Mus musculus
aagcctccggttgtctgaaaggact

SEQ ID NO: 54197 - DNA, 25 bp, Mus musculus
aagcctcctcagcagaggtgttgca

SEQ ID NO: 54198 - DNA, 25 bp, Mus musculus
aagcctcctcaggagaggtgttgca

SEQ ID NO: 54199 - DNA, 25 bp, Mus musculus
aagcctcctcgtccctgaggtgcag

SEQ ID NO: 54200 - DNA, 25 bp, Mus musculus
aagcctcctcgtgcctgaggtgcag

SEQ ID NO: 54201 - DNA, 25 bp, Mus musculus
aagcctcctgaacataccaaacaaa

SEQ ID NO: 54202 - DNA, 25 bp, Mus musculus
aagcctcctgaagataccaaacaaa

SEQ ID NO: 54203 - DNA, 25 bp, Mus musculus
aagcctcctgcacaatgagtttctg

SEQ ID NO: 54204 - DNA, 25 bp, Mus musculus
aagcctcctgcagaatgagtttctg

SEQ ID NO: 54205 - DNA, 25 bp, Mus musculus
aagcctcctgccagtcttaaggtag

SEQ ID NO: 54206 - DNA, 25 bp, Mus musculus
aagcctcctgcctgtcttaaggtag

SEQ ID NO: 54207 - DNA, 25 bp, Mus musculus
aagcctccttgaagtccgattccca

SEQ ID NO: 54208 - DNA, 25 bp, Mus musculus
aagcctccttgatgtccgattccca

SEQ ID NO: 54209 - DNA, 25 bp, Mus musculus
aagcctcctttacctgggccaatga

SEQ ID NO: 54210 - DNA, 25 bp, Mus musculus
aagcctcctttagctgggccaatga

SEQ ID NO: 54211 - DNA, 25 bp, Mus musculus
aagcctccttttagaggactctgat

SEQ ID NO: 54212 - DNA, 25 bp, Mus musculus
aagcctcctttttgaggactctgat

SEQ ID NO: 54213 - DNA, 25 bp, Mus musculus
aagcctcgagctccttttaccatgt

SEQ ID NO: 54214 - DNA, 25 bp, Mus musculus
aagcctcgagctgcttttaccatgt

SEQ ID NO: 54215 - DNA, 25 bp, Mus musculus
aagcctcgccgacagtttgtctggg

SEQ ID NO: 54216 - DNA, 25 bp, Mus musculus
aagcctcgccgagagtttgtctggg

SEQ ID NO: 54217 - DNA, 25 bp, Mus musculus
aagcctcgctgtcgcatgttaagat

SEQ ID NO: 54218 - DNA, 25 bp, Mus musculus
aagcctcgctgtggcatgttaagat

SEQ ID NO: 54219 - DNA, 25 bp, Mus musculus
aagcctcgtggccgacttccattat

SEQ ID NO: 54220 - DNA, 25 bp, Mus musculus
aagcctcgtggcggacttccattat

SEQ ID NO: 54221 - DNA, 25 bp, Mus musculus
aagcctcgtgtaaagcagaaccaaa

SEQ ID NO: 54222 - DNA, 25 bp, Mus musculus
aagcctcgtgtatagcagaaccaaa

SEQ ID NO: 54223 - DNA, 25 bp, Mus musculus
aagcctcgtttaagtcactttcttg

SEQ ID NO: 54224 - DNA, 25 bp, Mus musculus
aagcctcgtttatgtcactttcttg

SEQ ID NO: 54225 - DNA, 25 bp, Mus musculus
aagcctctacaacatcttcgttaag

SEQ ID NO: 54226 - DNA, 25 bp, Mus musculus
aagcctctacaagatcttcgttaag

SEQ ID NO: 54227 - DNA, 25 bp, Mus musculus
aagcctctagttagggaactcagaa

SEQ ID NO: 54228 - DNA, 25 bp, Mus musculus
aagcctctagtttgggaactcagaa

SEQ ID NO: 54229 - DNA, 25 bp, Mus musculus
aagcctctatatctttcatttggga

SEQ ID NO: 54230 - DNA, 25 bp, Mus musculus
aagcctctatatgtttcatttggga

SEQ ID NO: 54231 - DNA, 25 bp, Mus musculus
aagcctctccgccagatggtgagct

SEQ ID NO: 54232 - DNA, 25 bp, Mus musculus
aagcctctccgcgagatggtgagct

SEQ ID NO: 54233 - DNA, 25 bp, Mus musculus
aagcctctcgctactggtatcttct

SEQ ID NO: 54234 - DNA, 25 bp, Mus musculus
aagcctctcgcttctggtatcttct

SEQ ID NO: 54235 - DNA, 25 bp, Mus musculus
aagcctctctgaatcacgttggata

SEQ ID NO: 54236 - DNA, 25 bp, Mus musculus
aagcctctctgattcacgttggata

SEQ ID NO: 54237 - DNA, 25 bp, Mus musculus
aagcctctctggaaaaattgtcagt

SEQ ID NO: 54238 - DNA, 25 bp, Mus musculus
aagcctctctggtaaaattgtcagt

SEQ ID NO: 54239 - DNA, 25 bp, Mus musculus
aagcctctgactcaatgcatccggg

SEQ ID NO: 54240 - DNA, 25 bp, Mus musculus
aagcctctgactgaatgcatccggg

SEQ ID NO: 54241 - DNA, 25 bp, Mus musculus
aagcctctgagaccaaacagtctaa

SEQ ID NO: 54242 - DNA, 25 bp, Mus musculus
aagcctctgagagcaaacagtctaa

SEQ ID NO: 54243 - DNA, 25 bp, Mus musculus
aagcctctggctctcaggaatttgt

SEQ ID NO: 54244 - DNA, 25 bp, Mus musculus
aagcctctggctgtcaggaatttgt

SEQ ID NO: 54245 - DNA, 25 bp, Mus musculus
aagcctctgggaaggtctaccctga

SEQ ID NO: 54246 - DNA, 25 bp, Mus musculus
aagcctctgggatggtctaccctga

SEQ ID NO: 54247 - DNA, 25 bp, Mus musculus
aagcctctgggccactggaaatgtc

SEQ ID NO: 54248 - DNA, 25 bp, Mus musculus
aagcctctgggcgactggaaatgtc

SEQ ID NO: 54249 - DNA, 25 bp, Mus musculus
aagcctctgggtaggatgttagtgc

SEQ ID NO: 54250 - DNA, 25 bp, Mus musculus
aagcctctgggtctgagaaacatgc

SEQ ID NO: 54251 - DNA, 25 bp, Mus musculus
aagcctctgggtgtgagaaacatgc

SEQ ID NO: 54252 - DNA, 25 bp, Mus musculus
aagcctctgggttggatgttagtgc

SEQ ID NO: 54253 - DNA, 25 bp, Mus musculus
aagcctctgtgcaccttttatactt

SEQ ID NO: 54254 - DNA, 25 bp, Mus musculus
aagcctctgtgctccttttatactt

SEQ ID NO: 54255 - DNA, 25 bp, Mus musculus
aagcctctgttcactaagagttcat

SEQ ID NO: 54256 - DNA, 25 bp, Mus musculus
aagcctctgttctctaagagttcat

SEQ ID NO: 54257 - DNA, 25 bp, Mus musculus
aagcctcttgttcatttgtagaatt

SEQ ID NO: 54258 - DNA, 25 bp, Mus musculus
aagcctcttgttgatttgtagaatt

SEQ ID NO: 54259 - DNA, 25 bp, Mus musculus
aagcctcttttcaccatccaagcta

SEQ ID NO: 54260 - DNA, 25 bp, Mus musculus
aagcctcttttctccatccaagcta

SEQ ID NO: 54261 - DNA, 25 bp, Mus musculus
aagcctcttttgcagtggtatggat

SEQ ID NO: 54262 - DNA, 25 bp, Mus musculus
aagcctcttttggagtggtatggat

SEQ ID NO: 54263 - DNA, 25 bp, Mus musculus
aagcctgaaagccacaaatgtctgt

SEQ ID NO: 54264 - DNA, 25 bp, Mus musculus
aagcctgaaagcgacaaatgtctgt

SEQ ID NO: 54265 - DNA, 25 bp, Mus musculus
aagcctgaaaggaagtactaccatt

SEQ ID NO: 54266 - DNA, 25 bp, Mus musculus
aagcctgaaaggtagtactaccatt

SEQ ID NO: 54267 - DNA, 25 bp, Mus musculus
aagcctgaacctctaactgatgtat

SEQ ID NO: 54268 - DNA, 25 bp, Mus musculus
aagcctgaacctgtaactgatgtat

SEQ ID NO: 54269 - DNA, 25 bp, Mus musculus
aagcctgaatgtagttggagtccca

SEQ ID NO: 54270 - DNA, 25 bp, Mus musculus
aagcctgaatgttgttggagtccca

SEQ ID NO: 54271 - DNA, 25 bp, Mus musculus
aagcctgacacaccaaggccattga

SEQ ID NO: 54272 - DNA, 25 bp, Mus musculus
aagcctgacacagcaaggccattga

SEQ ID NO: 54273 - DNA, 25 bp, Mus musculus
aagcctgaccgccaccgccatggta

SEQ ID NO: 54274 - DNA, 25 bp, Mus musculus
aagcctgaccgcgaccgccatggta

SEQ ID NO: 54275 - DNA, 25 bp, Mus musculus
aagcctgactgaagtgggatacgga

SEQ ID NO: 54276 - DNA, 25 bp, Mus musculus
aagcctgactgactatttctctatg

SEQ ID NO: 54277 - DNA, 25 bp, Mus musculus
aagcctgactgagtatttctctatg

SEQ ID NO: 54278 - DNA, 25 bp, Mus musculus
aagcctgactgatgtgggatacgga

SEQ ID NO: 54279 - DNA, 25 bp, Mus musculus
aagcctgagaacaatactgaccgca

SEQ ID NO: 54280 - DNA, 25 bp, Mus musculus
aagcctgagaactatactgaccgca

SEQ ID NO: 54281 - DNA, 25 bp, Mus musculus
aagcctgagagcaaagtctgttctt

SEQ ID NO: 54282 - DNA, 25 bp, Mus musculus
aagcctgagagctaagtctgttctt

SEQ ID NO: 54283 - DNA, 25 bp, Mus musculus
aagcctgagaggagtttgcctgact

SEQ ID NO: 54284 - DNA, 25 bp, Mus musculus
aagcctgagaggtgtttgcctgact

SEQ ID NO: 54285 - DNA, 25 bp, Mus musculus
aagcctgagcacctactttatggga

SEQ ID NO: 54286 - DNA, 25 bp, Mus musculus
aagcctgagcacgtactttatggga

SEQ ID NO: 54287 - DNA, 25 bp, Mus musculus
aagcctgagccacaaagggcgcacg

SEQ ID NO: 54288 - DNA, 25 bp, Mus musculus
aagcctgagccagaaagggcgcacg

SEQ ID NO: 54289 - DNA, 25 bp, Mus musculus
aagcctgagcggctgaccttcaaga

SEQ ID NO: 54290 - DNA, 25 bp, Mus musculus
aagcctgagcgggtgaccttcaaga

SEQ ID NO: 54291 - DNA, 25 bp, Mus musculus
aagcctgagcttctgttattacaac

SEQ ID NO: 54292 - DNA, 25 bp, Mus musculus
aagcctgagcttgtgttattacaac

SEQ ID NO: 54293 - DNA, 25 bp, Mus musculus
aagcctgaggagctcacagcctggc

SEQ ID NO: 54294 - DNA, 25 bp, Mus musculus
aagcctgaggaggtcacagcctggc

SEQ ID NO: 54295 - DNA, 25 bp, Mus musculus
aagcctgaggcgaagtctgtccatc

SEQ ID NO: 54296 - DNA, 25 bp, Mus musculus
aagcctgaggcgtagtctgtccatc

SEQ ID NO: 54297 - DNA, 25 bp, Mus musculus
aagcctgagggcacagccttgagag

SEQ ID NO: 54298 - DNA, 25 bp, Mus musculus
aagcctgagggctcagccttgagag

SEQ ID NO: 54299 - DNA, 25 bp, Mus musculus
aagcctgagtgcaggactctcatct

SEQ ID NO: 54300 - DNA, 25 bp, Mus musculus
aagcctgagtgctggactctcatct

SEQ ID NO: 54301 - DNA, 25 bp, Mus musculus
aagcctgataccacacacaagcaaa

SEQ ID NO: 54302 - DNA, 25 bp, Mus musculus
aagcctgatacctcacacaagcaaa

SEQ ID NO: 54303 - DNA, 25 bp, Mus musculus
aagcctgatcacactgttcaggtga

SEQ ID NO: 54304 - DNA, 25 bp, Mus musculus
aagcctgatcactctgttcaggtga

SEQ ID NO: 54305 - DNA, 25 bp, Mus musculus
aagcctgatgccacaggtctttgtg

SEQ ID NO: 54306 - DNA, 25 bp, Mus musculus
aagcctgatgcctcaggtctttgtg

SEQ ID NO: 54307 - DNA, 25 bp, Mus musculus
aagcctgattgtattttcctaagtt

SEQ ID NO: 54308 - DNA, 25 bp, Mus musculus
aagcctgattgttttttcctaagtt

SEQ ID NO: 54309 - DNA, 25 bp, Mus musculus
aagcctgcaacgagaggccttcaga

SEQ ID NO: 54310 - DNA, 25 bp, Mus musculus
aagcctgcaacgtgaggccttcaga

SEQ ID NO: 54311 - DNA, 25 bp, Mus musculus
aagcctgcaaggctctgtggagaca

SEQ ID NO: 54312 - DNA, 25 bp, Mus musculus
aagcctgcaagggtctgtggagaca

SEQ ID NO: 54313 - DNA, 25 bp, Mus musculus
aagcctgcacagatgtcttggtagg

SEQ ID NO: 54314 - DNA, 25 bp, Mus musculus
aagcctgcacagttgtcttggtagg

SEQ ID NO: 54315 - DNA, 25 bp, Mus musculus
aagcctgcactaaataccaatcgag

SEQ ID NO: 54316 - DNA, 25 bp, Mus musculus
aagcctgcactatataccaatcgag

SEQ ID NO: 54317 - DNA, 25 bp, Mus musculus
aagcctgcagatagttactggaaaa

SEQ ID NO: 54318 - DNA, 25 bp, Mus musculus
aagcctgcagattgttactggaaaa

SEQ ID NO: 54319 - DNA, 25 bp, Mus musculus
aagcctgcagctcttatggcccata

SEQ ID NO: 54320 - DNA, 25 bp, Mus musculus
aagcctgcagctgttatggcccata

SEQ ID NO: 54321 - DNA, 25 bp, Mus musculus
aagcctgcagtcactgcggcaatgg

SEQ ID NO: 54322 - DNA, 25 bp, Mus musculus
aagcctgcagtctctgcggcaatgg

SEQ ID NO: 54323 - DNA, 25 bp, Mus musculus
aagcctgcatccaggattccattaa

SEQ ID NO: 54324 - DNA, 25 bp, Mus musculus
aagcctgcatcctggattccattaa

SEQ ID NO: 54325 - DNA, 25 bp, Mus musculus
aagcctgcatggctttgctcagact

SEQ ID NO: 54326 - DNA, 25 bp, Mus musculus
aagcctgcatgggtttgctcagact

SEQ ID NO: 54327 - DNA, 25 bp, Mus musculus
aagcctgcattgcacaagggcccgg

SEQ ID NO: 54328 - DNA, 25 bp, Mus musculus
aagcctgcattggacaagggcccgg

SEQ ID NO: 54329 - DNA, 25 bp, Mus musculus
aagcctgccaaccagcgtaataatg

SEQ ID NO: 54330 - DNA, 25 bp, Mus musculus
aagcctgccaacgagcgtaataatg

SEQ ID NO: 54331 - DNA, 25 bp, Mus musculus
aagcctgcccctaacaatcagaaat

SEQ ID NO: 54332 - DNA, 25 bp, Mus musculus
aagcctgccccttacaatcagaaat

SEQ ID NO: 54333 - DNA, 25 bp, Mus musculus
aagcctgccgctcagagtgtgcatg

SEQ ID NO: 54334 - DNA, 25 bp, Mus musculus
aagcctgccgctgagagtgtgcatg

SEQ ID NO: 54335 - DNA, 25 bp, Mus musculus
aagcctgcctaaagcctagccttag

SEQ ID NO: 54336 - DNA, 25 bp, Mus musculus
aagcctgcctaatgcctagccttag

SEQ ID NO: 54337 - DNA, 25 bp, Mus musculus
aagcctgcctcaacagcttgggtta

SEQ ID NO: 54338 - DNA, 25 bp, Mus musculus
aagcctgcctcatcagcttgggtta

SEQ ID NO: 54339 - DNA, 25 bp, Mus musculus
aagcctgcctccaaatgacaatgtt

SEQ ID NO: 54340 - DNA, 25 bp, Mus musculus
aagcctgcctcctaatgacaatgtt

SEQ ID NO: 54341 - DNA, 25 bp, Mus musculus
aagcctgcctctaatgtgcaaactg

SEQ ID NO: 54342 - DNA, 25 bp, Mus musculus
aagcctgcctcttatgtgcaaactg

SEQ ID NO: 54343 - DNA, 25 bp, Mus musculus
aagcctgccttaagttttgttgtat

SEQ ID NO: 54344 - DNA, 25 bp, Mus musculus
aagcctgccttaatttctttgatga

SEQ ID NO: 54345 - DNA, 25 bp, Mus musculus
aagcctgccttatgttttgttgtat

SEQ ID NO: 54346 - DNA, 25 bp, Mus musculus
aagcctgccttattttctttgatga

SEQ ID NO: 54347 - DNA, 25 bp, Mus musculus
aagcctgcgggcacgctgaaggatt

SEQ ID NO: 54348 - DNA, 25 bp, Mus musculus
aagcctgcgggctcgctgaaggatt

SEQ ID NO: 54349 - DNA, 25 bp, Mus musculus
aagcctgcgtaccttactgcgagac

SEQ ID NO: 54350 - DNA, 25 bp, Mus musculus
aagcctgcgtacgttactgcgagac

SEQ ID NO: 54351 - DNA, 25 bp, Mus musculus
aagcctgctaagctcatttgcatat

SEQ ID NO: 54352 - DNA, 25 bp, Mus musculus
aagcctgctaaggtcatttgcatat

SEQ ID NO: 54353 - DNA, 25 bp, Mus musculus
aagcctgctaatactgtttttatcc

SEQ ID NO: 54354 - DNA, 25 bp, Mus musculus
aagcctgctaattctgtttttatcc

SEQ ID NO: 54355 - DNA, 25 bp, Mus musculus
aagcctgctactctttagggagtca

SEQ ID NO: 54356 - DNA, 25 bp, Mus musculus
aagcctgctactgtttagggagtca

SEQ ID NO: 54357 - DNA, 25 bp, Mus musculus
aagcctgctcaaactagggatccag

SEQ ID NO: 54358 - DNA, 25 bp, Mus musculus
aagcctgctcaatctagggatccag

SEQ ID NO: 54359 - DNA, 25 bp, Mus musculus
aagcctgctcacagaagagtccgac

SEQ ID NO: 54360 - DNA, 25 bp, Mus musculus
aagcctgctcactgaagagtccgac

SEQ ID NO: 54361 - DNA, 25 bp, Mus musculus
aagcctgctcccagtttagatggta

SEQ ID NO: 54362 - DNA, 25 bp, Mus musculus
aagcctgctccctgtttagatggta

SEQ ID NO: 54363 - DNA, 25 bp, Mus musculus
aagcctgctcctatcagttgatgta

SEQ ID NO: 54364 - DNA, 25 bp, Mus musculus
aagcctgctcctttcagttgatgta

SEQ ID NO: 54365 - DNA, 25 bp, Mus musculus
aagcctgctgacctggatttgttcc

SEQ ID NO: 54366 - DNA, 25 bp, Mus musculus
aagcctgctgacgtggatttgttcc

SEQ ID NO: 54367 - DNA, 25 bp, Mus musculus
aagcctgctgatattcatgtgatgg

SEQ ID NO: 54368 - DNA, 25 bp, Mus musculus
aagcctgctgattttcatgtgatgg

SEQ ID NO: 54369 - DNA, 25 bp, Mus musculus
aagcctgctgcacagatctcttggt

SEQ ID NO: 54370 - DNA, 25 bp, Mus musculus
aagcctgctgcagagatctcttggt

SEQ ID NO: 54371 - DNA, 25 bp, Mus musculus
aagcctgctggaccttagatactaa

SEQ ID NO: 54372 - DNA, 25 bp, Mus musculus
aagcctgctggagcttagatactaa

SEQ ID NO: 54373 - DNA, 25 bp, Mus musculus
aagcctgctggcattatcctgtctt

SEQ ID NO: 54374 - DNA, 25 bp, Mus musculus
aagcctgctggctttatcctgtctt

SEQ ID NO: 54375 - DNA, 25 bp, Mus musculus
aagcctgctgtcagcattaggaggg

SEQ ID NO: 54376 - DNA, 25 bp, Mus musculus
aagcctgctgtctgcattaggaggg

SEQ ID NO: 54377 - DNA, 25 bp, Mus musculus
aagcctgctgtgaggtaggacctgt

SEQ ID NO: 54378 - DNA, 25 bp, Mus musculus
aagcctgctgtgtggtaggacctgt

SEQ ID NO: 54379 - DNA, 25 bp, Mus musculus
aagcctgcttagcacagggtttcac

SEQ ID NO: 54380 - DNA, 25 bp, Mus musculus
aagcctgcttaggacagggtttcac

SEQ ID NO: 54381 - DNA, 25 bp, Mus musculus
aagcctgcttatactgtctcacttt

SEQ ID NO: 54382 - DNA, 25 bp, Mus musculus
aagcctgcttattctgtctcacttt

SEQ ID NO: 54383 - DNA, 25 bp, Mus musculus
aagcctggaagccatgatgtccgct

SEQ ID NO: 54384 - DNA, 25 bp, Mus musculus
aagcctggaagcgatgatgtccgct

SEQ ID NO: 54385 - DNA, 25 bp, Mus musculus
aagcctggaaggctctacttctgtc

SEQ ID NO: 54386 - DNA, 25 bp, Mus musculus
aagcctggaagggtctacttctgtc

SEQ ID NO: 54387 - DNA, 25 bp, Mus musculus
aagcctggaattctgcatagcctgg

SEQ ID NO: 54388 - DNA, 25 bp, Mus musculus
aagcctggaattgtgcatagcctgg

SEQ ID NO: 54389 - DNA, 25 bp, Mus musculus
aagcctggactgcacttactccctg

SEQ ID NO: 54390 - DNA, 25 bp, Mus musculus
aagcctggactggacttactccctg

SEQ ID NO: 54391 - DNA, 25 bp, Mus musculus
aagcctggacttactcgactaagga

SEQ ID NO: 54392 - DNA, 25 bp, Mus musculus
aagcctggactttctcgactaagga

SEQ ID NO: 54393 - DNA, 25 bp, Mus musculus
aagcctggagaaaccatcagtttca

SEQ ID NO: 54394 - DNA, 25 bp, Mus musculus
aagcctggagaatccatcagtttca

SEQ ID NO: 54395 - DNA, 25 bp, Mus musculus
aagcctggagagatgctagccttta

SEQ ID NO: 54396 - DNA, 25 bp, Mus musculus
aagcctggagagttgctagccttta

SEQ ID NO: 54397 - DNA, 25 bp, Mus musculus
aagcctggagcgaatgttccctgtt

SEQ ID NO: 54398 - DNA, 25 bp, Mus musculus
aagcctggagcgtatgttccctgtt

SEQ ID NO: 54399 - DNA, 25 bp, Mus musculus
aagcctggaggcatgacttctgtgt

SEQ ID NO: 54400 - DNA, 25 bp, Mus musculus
aagcctggaggcttgacttctgtgt

SEQ ID NO: 54401 - DNA, 25 bp, Mus musculus
aagcctggatcaagaagctgttgat

SEQ ID NO: 54402 - DNA, 25 bp, Mus musculus
aagcctggatcatgaagctgttgat

SEQ ID NO: 54403 - DNA, 25 bp, Mus musculus
aagcctggatctatccatctatcat

SEQ ID NO: 54404 - DNA, 25 bp, Mus musculus
aagcctggatctttccatctatcat

SEQ ID NO: 54405 - DNA, 25 bp, Mus musculus
aagcctggcacaactgtgtgtctga

SEQ ID NO: 54406 - DNA, 25 bp, Mus musculus
aagcctggcacatctgtgtgtctga

SEQ ID NO: 54407 - DNA, 25 bp, Mus musculus
aagcctggcaccatctgggacagtc

SEQ ID NO: 54408 - DNA, 25 bp, Mus musculus
aagcctggcaccttctgggacagtc

SEQ ID NO: 54409 - DNA, 25 bp, Mus musculus
aagcctggcagacccaatggtaaca

SEQ ID NO: 54410 - DNA, 25 bp, Mus musculus
aagcctggcagagccaatggtaaca

SEQ ID NO: 54411 - DNA, 25 bp, Mus musculus
aagcctggcattctgctgatgtgct

SEQ ID NO: 54412 - DNA, 25 bp, Mus musculus
aagcctggcattgtgctgatgtgct

SEQ ID NO: 54413 - DNA, 25 bp, Mus musculus
aagcctggcgacatgagttcgagcc

SEQ ID NO: 54414 - DNA, 25 bp, Mus musculus
aagcctggcgacttgagttcgagcc

SEQ ID NO: 54415 - DNA, 25 bp, Mus musculus
aagcctggctatctgagttccatcc

SEQ ID NO: 54416 - DNA, 25 bp, Mus musculus
aagcctggctatgtgagttccatcc

SEQ ID NO: 54417 - DNA, 25 bp, Mus musculus
aagcctggctgccagcatatcctgg

SEQ ID NO: 54418 - DNA, 25 bp, Mus musculus
aagcctggctgcgagcatatcctgg

SEQ ID NO: 54419 - DNA, 25 bp, Mus musculus
aagcctggcttgatggatatctacc

SEQ ID NO: 54420 - DNA, 25 bp, Mus musculus
aagcctggcttgttggatatctacc

SEQ ID NO: 54421 - DNA, 25 bp, Mus musculus
aagcctgggaagatcttctggcctc

SEQ ID NO: 54422 - DNA, 25 bp, Mus musculus
aagcctgggaagttcttctggcctc

SEQ ID NO: 54423 - DNA, 25 bp, Mus musculus
aagcctgggactagagccatcgtaa

SEQ ID NO: 54424 - DNA, 25 bp, Mus musculus
aagcctgggacttgagccatcgtaa

SEQ ID NO: 54425 - DNA, 25 bp, Mus musculus
aagcctgggagacttcaagacttct

SEQ ID NO: 54426 - DNA, 25 bp, Mus musculus
aagcctgggagagttcaagacttct

SEQ ID NO: 54427 - DNA, 25 bp, Mus musculus
aagcctgggaggagcgtcaaaactc

SEQ ID NO: 54428 - DNA, 25 bp, Mus musculus
aagcctgggaggtgcgtcaaaactc

SEQ ID NO: 54429 - DNA, 25 bp, Mus musculus
aagcctgggatcagtctgagattat

SEQ ID NO: 54430 - DNA, 25 bp, Mus musculus
aagcctgggatctgtctgagattat

SEQ ID NO: 54431 - DNA, 25 bp, Mus musculus
aagcctgggcaccaagcaagcagct

SEQ ID NO: 54432 - DNA, 25 bp, Mus musculus
aagcctgggcacgaagcaagcagct

SEQ ID NO: 54433 - DNA, 25 bp, Mus musculus
aagcctgggcccagactttcatggc

SEQ ID NO: 54434 - DNA, 25 bp, Mus musculus
aagcctgggccctgactttcatggc

SEQ ID NO: 54435 - DNA, 25 bp, Mus musculus
aagcctgggcctctgaacaaaagca

SEQ ID NO: 54436 - DNA, 25 bp, Mus musculus
aagcctgggcctgtgaacaaaagca

SEQ ID NO: 54437 - DNA, 25 bp, Mus musculus
aagcctgggctacactagaccatta

SEQ ID NO: 54438 - DNA, 25 bp, Mus musculus
aagcctgggctagactagaccatta

SEQ ID NO: 54439 - DNA, 25 bp, Mus musculus
aagcctgggctccaagacaacattg

SEQ ID NO: 54440 - DNA, 25 bp, Mus musculus
aagcctgggctcgaagacaacattg

SEQ ID NO: 54441 - DNA, 25 bp, Mus musculus
aagcctgggtcacggaacctctgga

SEQ ID NO: 54442 - DNA, 25 bp, Mus musculus
aagcctgggtcagggaacctctgga

SEQ ID NO: 54443 - DNA, 25 bp, Mus musculus
aagcctggtccaccttggcctgatg

SEQ ID NO: 54444 - DNA, 25 bp, Mus musculus
aagcctggtccagcttggcctgatg

SEQ ID NO: 54445 - DNA, 25 bp, Mus musculus
aagcctggtgtgcaagacgtgcact

SEQ ID NO: 54446 - DNA, 25 bp, Mus musculus
aagcctggtgtggaagacgtgcact

SEQ ID NO: 54447 - DNA, 25 bp, Mus musculus
aagcctggttcgcagtccatgcctg

SEQ ID NO: 54448 - DNA, 25 bp, Mus musculus
aagcctggttcggagtccatgcctg

SEQ ID NO: 54449 - DNA, 25 bp, Mus musculus
aagcctgtaagcctcaagagctaat

SEQ ID NO: 54450 - DNA, 25 bp, Mus musculus
aagcctgtaagcgtcaagagctaat

SEQ ID NO: 54451 - DNA, 25 bp, Mus musculus
aagcctgtacagactacgcaggaga

SEQ ID NO: 54452 - DNA, 25 bp, Mus musculus
aagcctgtacagtctacgcaggaga

SEQ ID NO: 54453 - DNA, 25 bp, Mus musculus
aagcctgtatcaatcttggaggtca

SEQ ID NO: 54454 - DNA, 25 bp, Mus musculus
aagcctgtatcattcttggaggtca

SEQ ID NO: 54455 - DNA, 25 bp, Mus musculus
aagcctgtcaaaaaatgtccttttt

SEQ ID NO: 54456 - DNA, 25 bp, Mus musculus
aagcctgtcaaataatgtccttttt

SEQ ID NO: 54457 - DNA, 25 bp, Mus musculus
aagcctgtcaacaaggaccgctaca

SEQ ID NO: 54458 - DNA, 25 bp, Mus musculus
aagcctgtcaactaggaccgctaca

SEQ ID NO: 54459 - DNA, 25 bp, Mus musculus
aagcctgtcacacaccggagaagac

SEQ ID NO: 54460 - DNA, 25 bp, Mus musculus
aagcctgtcacagaccggagaagac

SEQ ID NO: 54461 - DNA, 25 bp, Mus musculus
aagcctgtcccaaaatggcggatga

SEQ ID NO: 54462 - DNA, 25 bp, Mus musculus
aagcctgtcccataatggcggatga

SEQ ID NO: 54463 - DNA, 25 bp, Mus musculus
aagcctgtccttagggtgtctgcta

SEQ ID NO: 54464 - DNA, 25 bp, Mus musculus
aagcctgtcctttgggtgtctgcta

SEQ ID NO: 54465 - DNA, 25 bp, Mus musculus
aagcctgtcgtcagggttaatctgt

SEQ ID NO: 54466 - DNA, 25 bp, Mus musculus
aagcctgtcgtctgggttaatctgt

SEQ ID NO: 54467 - DNA, 25 bp, Mus musculus
aagcctgtcttaagtggatttttac

SEQ ID NO: 54468 - DNA, 25 bp, Mus musculus
aagcctgtcttatgtggatttttac

SEQ ID NO: 54469 - DNA, 25 bp, Mus musculus
aagcctgtcttgagactggactgtc

SEQ ID NO: 54470 - DNA, 25 bp, Mus musculus
aagcctgtcttgtgactggactgtc

SEQ ID NO: 54471 - DNA, 25 bp, Mus musculus
aagcctgtctttcagcaatatgcaa

SEQ ID NO: 54472 - DNA, 25 bp, Mus musculus
aagcctgtctttgagcaatatgcaa

SEQ ID NO: 54473 - DNA, 25 bp, Mus musculus
aagcctgtgactcaactaccattgg

SEQ ID NO: 54474 - DNA, 25 bp, Mus musculus
aagcctgtgactgaactaccattgg

SEQ ID NO: 54475 - DNA, 25 bp, Mus musculus
aagcctgtgaggatccaaaaagcga

SEQ ID NO: 54476 - DNA, 25 bp, Mus musculus
aagcctgtgaggttccaaaaagcga

SEQ ID NO: 54477 - DNA, 25 bp, Mus musculus
aagcctgtgagtagatgccggttct

SEQ ID NO: 54478 - DNA, 25 bp, Mus musculus
aagcctgtgagttgatgccggttct

SEQ ID NO: 54479 - DNA, 25 bp, Mus musculus
aagcctgtgcatctggatgatacct

SEQ ID NO: 54480 - DNA, 25 bp, Mus musculus
aagcctgtgcatgtggatgatacct

SEQ ID NO: 54481 - DNA, 25 bp, Mus musculus
aagcctgtgccactacagtacttgc

SEQ ID NO: 54482 - DNA, 25 bp, Mus musculus
aagcctgtgccagtacagtacttgc

SEQ ID NO: 54483 - DNA, 25 bp, Mus musculus
aagcctgtgcccaagatgtttgaat

SEQ ID NO: 54484 - DNA, 25 bp, Mus musculus
aagcctgtgccctagatgtttgaat

SEQ ID NO: 54485 - DNA, 25 bp, Mus musculus
aagcctgtggcccaaagtcagccca

SEQ ID NO: 54486 - DNA, 25 bp, Mus musculus
aagcctgtggccgaaagtcagccca

SEQ ID NO: 54487 - DNA, 25 bp, Mus musculus
aagcctgtggcgatggtgtgtctcc

SEQ ID NO: 54488 - DNA, 25 bp, Mus musculus
aagcctgtggcgttggtgtgtctcc

SEQ ID NO: 54489 - DNA, 25 bp, Mus musculus
aagcctgtggctaacatagctaaaa

SEQ ID NO: 54490 - DNA, 25 bp, Mus musculus
aagcctgtggctaactactgtatct

SEQ ID NO: 54491 - DNA, 25 bp, Mus musculus
aagcctgtggcttacatagctaaaa

SEQ ID NO: 54492 - DNA, 25 bp, Mus musculus
aagcctgtggcttactactgtatct

SEQ ID NO: 54493 - DNA, 25 bp, Mus musculus
aagcctgtgggaactatgctggccc

SEQ ID NO: 54494 - DNA, 25 bp, Mus musculus
aagcctgtgggatctatgctggccc

SEQ ID NO: 54495 - DNA, 25 bp, Mus musculus
aagcctgtggtgcacactgtcagcc

SEQ ID NO: 54496 - DNA, 25 bp, Mus musculus
aagcctgtggtggacactgtcagcc

SEQ ID NO: 54497 - DNA, 25 bp, Mus musculus
aagcctgtgtccatctctagatttt

SEQ ID NO: 54498 - DNA, 25 bp, Mus musculus
aagcctgtgtccttctctagatttt

SEQ ID NO: 54499 - DNA, 25 bp, Mus musculus
aagcctgtgtttactggtattgtag

SEQ ID NO: 54500 - DNA, 25 bp, Mus musculus
aagcctgtgttttctggtattgtag

SEQ ID NO: 54501 - DNA, 25 bp, Mus musculus
aagcctgttaatatccatagtgaga

SEQ ID NO: 54502 - DNA, 25 bp, Mus musculus
aagcctgttaatttccatagtgaga

SEQ ID NO: 54503 - DNA, 25 bp, Mus musculus
aagcctgttatgactgtatttgtgt

SEQ ID NO: 54504 - DNA, 25 bp, Mus musculus
aagcctgttatgtctgtatttgtgt

SEQ ID NO: 54505 - DNA, 25 bp, Mus musculus
aagcctgttcagctagttacttcac

SEQ ID NO: 54506 - DNA, 25 bp, Mus musculus
aagcctgttcaggtagttacttcac

SEQ ID NO: 54507 - DNA, 25 bp, Mus musculus
aagcctgttcatcggttttataaag

SEQ ID NO: 54508 - DNA, 25 bp, Mus musculus
aagcctgttcatgggttttataaag

SEQ ID NO: 54509 - DNA, 25 bp, Mus musculus
aagcctgttcttatccaataagaga

SEQ ID NO: 54510 - DNA, 25 bp, Mus musculus
aagcctgttcttttccaataagaga

SEQ ID NO: 54511 - DNA, 25 bp, Mus musculus
aagcctgttgctaaccatcagtaca

SEQ ID NO: 54512 - DNA, 25 bp, Mus musculus
aagcctgttgcttaccatcagtaca

SEQ ID NO: 54513 - DNA, 25 bp, Mus musculus
aagcctgttggacctggcttgcaga

SEQ ID NO: 54514 - DNA, 25 bp, Mus musculus
aagcctgttggagctggcttgcaga

SEQ ID NO: 54515 - DNA, 25 bp, Mus musculus
aagcctgtttacaaggatcccctgt

SEQ ID NO: 54516 - DNA, 25 bp, Mus musculus
aagcctgtttactaggatcccctgt

SEQ ID NO: 54517 - DNA, 25 bp, Mus musculus
aagcctgtttatcatacatcctggt

SEQ ID NO: 54518 - DNA, 25 bp, Mus musculus
aagcctgtttatgatacatcctggt

SEQ ID NO: 54519 - DNA, 25 bp, Mus musculus
aagcctgtttggacgggaatgtgtt

SEQ ID NO: 54520 - DNA, 25 bp, Mus musculus
aagcctgtttggtcgggaatgtgtt

SEQ ID NO: 54521 - DNA, 25 bp, Mus musculus
aagcctgttttcacaataccagcag

SEQ ID NO: 54522 - DNA, 25 bp, Mus musculus
aagcctgttttctcaataccagcag

SEQ ID NO: 54523 - DNA, 25 bp, Mus musculus
aagccttaaaccaaagctcttcaga

SEQ ID NO: 54524 - DNA, 25 bp, Mus musculus
aagccttaaacctaagctcttcaga

SEQ ID NO: 54525 - DNA, 25 bp, Mus musculus
aagccttaagctcttgtagttcatt

SEQ ID NO: 54526 - DNA, 25 bp, Mus musculus
aagccttaagctgttgtagttcatt

SEQ ID NO: 54527 - DNA, 25 bp, Mus musculus
aagccttacaccctcatgagcatgg

SEQ ID NO: 54528 - DNA, 25 bp, Mus musculus
aagccttacaccgtcatgagcatgg

SEQ ID NO: 54529 - DNA, 25 bp, Mus musculus
aagccttaccagctctcattttttg

SEQ ID NO: 54530 - DNA, 25 bp, Mus musculus
aagccttaccaggtctcattttttg

SEQ ID NO: 54531 - DNA, 25 bp, Mus musculus
aagccttaccttactcaggtatctg

SEQ ID NO: 54532 - DNA, 25 bp, Mus musculus
aagccttacctttctcaggtatctg

SEQ ID NO: 54533 - DNA, 25 bp, Mus musculus
aagccttactcactgggtcaccatc

SEQ ID NO: 54534 - DNA, 25 bp, Mus musculus
aagccttactcagtgggtcaccatc

SEQ ID NO: 54535 - DNA, 25 bp, Mus musculus
aagccttagaagagctggtggcatg

SEQ ID NO: 54536 - DNA, 25 bp, Mus musculus
aagccttagaagtgctggtggcatg

SEQ ID NO: 54537 - DNA, 25 bp, Mus musculus
aagccttagtcacaacataccagat

SEQ ID NO: 54538 - DNA, 25 bp, Mus musculus
aagccttagtcagaacataccagat

SEQ ID NO: 54539 - DNA, 25 bp, Mus musculus
aagccttagtccctgctgtatccta

SEQ ID NO: 54540 - DNA, 25 bp, Mus musculus
aagccttagtccgtgctgtatccta

SEQ ID NO: 54541 - DNA, 25 bp, Mus musculus
aagccttatacaatattcttcctaa

SEQ ID NO: 54542 - DNA, 25 bp, Mus musculus
aagccttatacattattcttcctaa

SEQ ID NO: 54543 - DNA, 25 bp, Mus musculus
aagccttatatacgttccaagccag

SEQ ID NO: 54544 - DNA, 25 bp, Mus musculus
aagccttatataggttccaagccag

SEQ ID NO: 54545 - DNA, 25 bp, Mus musculus
aagccttatggcaggtgtgacagta

SEQ ID NO: 54546 - DNA, 25 bp, Mus musculus
aagccttatggctggtgtgacagta

SEQ ID NO: 54547 - DNA, 25 bp, Mus musculus
aagccttatgtaccaggctggccat

SEQ ID NO: 54548 - DNA, 25 bp, Mus musculus
aagccttatgtagcaggctggccat

SEQ ID NO: 54549 - DNA, 25 bp, Mus musculus
aagccttcaaatacacggcagccat

SEQ ID NO: 54550 - DNA, 25 bp, Mus musculus
aagccttcaaattcacggcagccat

SEQ ID NO: 54551 - DNA, 25 bp, Mus musculus
aagccttcaaggacctgggccgtgg

SEQ ID NO: 54552 - DNA, 25 bp, Mus musculus
aagccttcaaggtcctgggccgtgg

SEQ ID NO: 54553 - DNA, 25 bp, Mus musculus
aagccttcaatactgcatctgtaga

SEQ ID NO: 54554 - DNA, 25 bp, Mus musculus
aagccttcaatagtgcatctgtaga

SEQ ID NO: 54555 - DNA, 25 bp, Mus musculus
aagccttcaatgcaaaatcacaact

SEQ ID NO: 54556 - DNA, 25 bp, Mus musculus
aagccttcaatggaaaatcacaact

SEQ ID NO: 54557 - DNA, 25 bp, Mus musculus
aagccttcacacatacgggtacttg

SEQ ID NO: 54558 - DNA, 25 bp, Mus musculus
aagccttcacacttacgggtacttg

SEQ ID NO: 54559 - DNA, 25 bp, Mus musculus
aagccttcagttctttttctcacct

SEQ ID NO: 54560 - DNA, 25 bp, Mus musculus
aagccttcagttgtttttctcacct

SEQ ID NO: 54561 - DNA, 25 bp, Mus musculus
aagccttcatcacacctctgttgta

SEQ ID NO: 54562 - DNA, 25 bp, Mus musculus
aagccttcatcagacctctgttgta

SEQ ID NO: 54563 - DNA, 25 bp, Mus musculus
aagccttcatctcaggttgtcagaa

SEQ ID NO: 54564 - DNA, 25 bp, Mus musculus
aagccttcatctgaggttgtcagaa

SEQ ID NO: 54565 - DNA, 25 bp, Mus musculus
aagccttccaagctgtccagaatct

SEQ ID NO: 54566 - DNA, 25 bp, Mus musculus
aagccttccaaggtgtccagaatct

SEQ ID NO: 54567 - DNA, 25 bp, Mus musculus
aagccttccacaagcatttgtaaat

SEQ ID NO: 54568 - DNA, 25 bp, Mus musculus
aagccttccacatgcatttgtaaat

SEQ ID NO: 54569 - DNA, 25 bp, Mus musculus
aagccttccagtctcagtttagatg

SEQ ID NO: 54570 - DNA, 25 bp, Mus musculus
aagccttccagtgtcagtttagatg

SEQ ID NO: 54571 - DNA, 25 bp, Mus musculus
aagccttcccatcccgctcacaggg

SEQ ID NO: 54572 - DNA, 25 bp, Mus musculus
aagccttcccatgccgctcacaggg

SEQ ID NO: 54573 - DNA, 25 bp, Mus musculus
aagccttccccgagagttgaacact

SEQ ID NO: 54574 - DNA, 25 bp, Mus musculus
aagccttccccgtgagttgaacact

SEQ ID NO: 54575 - DNA, 25 bp, Mus musculus
aagccttcccggagcagctatggaa

SEQ ID NO: 54576 - DNA, 25 bp, Mus musculus
aagccttcccggtgcagctatggaa

SEQ ID NO: 54577 - DNA, 25 bp, Mus musculus
aagccttccgccagcagaaatctct

SEQ ID NO: 54578 - DNA, 25 bp, Mus musculus
aagccttccgcctgcagaaatctct

SEQ ID NO: 54579 - DNA, 25 bp, Mus musculus
aagccttcctagacttgctttcctt

SEQ ID NO: 54580 - DNA, 25 bp, Mus musculus
aagccttcctagtcttgctttcctt

SEQ ID NO: 54581 - DNA, 25 bp, Mus musculus
aagccttcctcaccgatcaagaaag

SEQ ID NO: 54582 - DNA, 25 bp, Mus musculus
aagccttcctcagcgatcaagaaag

SEQ ID NO: 54583 - DNA, 25 bp, Mus musculus
aagccttcctccacatgagtttgga

SEQ ID NO: 54584 - DNA, 25 bp, Mus musculus
aagccttcctcctcatgagtttgga

SEQ ID NO: 54585 - DNA, 25 bp, Mus musculus
aagccttctccgatggaagcactat

SEQ ID NO: 54586 - DNA, 25 bp, Mus musculus
aagccttctccgttggaagcactat

SEQ ID NO: 54587 - DNA, 25 bp, Mus musculus
aagccttctgctaagttactgaaca

SEQ ID NO: 54588 - DNA, 25 bp, Mus musculus
aagccttctgcttagttactgaaca

SEQ ID NO: 54589 - DNA, 25 bp, Mus musculus
aagccttctgtcaatgccagggaga

SEQ ID NO: 54590 - DNA, 25 bp, Mus musculus
aagccttctgtctatgccagggaga

SEQ ID NO: 54591 - DNA, 25 bp, Mus musculus
aagccttctgtgaacttcatcaagt

SEQ ID NO: 54592 - DNA, 25 bp, Mus musculus
aagccttctgtgcagaatcacctgc

SEQ ID NO: 54593 - DNA, 25 bp, Mus musculus
aagccttctgtggagaatcacctgc

SEQ ID NO: 54594 - DNA, 25 bp, Mus musculus
aagccttctgtgtacttcatcaagt

SEQ ID NO: 54595 - DNA, 25 bp, Mus musculus
aagccttcttacctctcataagttt

SEQ ID NO: 54596 - DNA, 25 bp, Mus musculus
aagccttcttacgtctcataagttt

SEQ ID NO: 54597 - DNA, 25 bp, Mus musculus
aagccttcttagaggccctgtataa

SEQ ID NO: 54598 - DNA, 25 bp, Mus musculus
aagccttcttagtggccctgtataa

SEQ ID NO: 54599 - DNA, 25 bp, Mus musculus
aagccttcttgaccgactaggtgct

SEQ ID NO: 54600 - DNA, 25 bp, Mus musculus
aagccttcttgagcgactaggtgct

SEQ ID NO: 54601 - DNA, 25 bp, Mus musculus
aagccttgaactcaggcctgacagc

SEQ ID NO: 54602 - DNA, 25 bp, Mus musculus
aagccttgaactgaggcctgacagc

SEQ ID NO: 54603 - DNA, 25 bp, Mus musculus
aagccttgaagccacggtagagaaa

SEQ ID NO: 54604 - DNA, 25 bp, Mus musculus
aagccttgaagcgacggtagagaaa

SEQ ID NO: 54605 - DNA, 25 bp, Mus musculus
aagccttgaccactctctggattgg

SEQ ID NO: 54606 - DNA, 25 bp, Mus musculus
aagccttgaccagtctctggattgg

SEQ ID NO: 54607 - DNA, 25 bp, Mus musculus
aagccttgacttctgctaagcggta

SEQ ID NO: 54608 - DNA, 25 bp, Mus musculus
aagccttgacttgtgctaagcggta

SEQ ID NO: 54609 - DNA, 25 bp, Mus musculus
aagccttgcacacgatgcgagagtg

SEQ ID NO: 54610 - DNA, 25 bp, Mus musculus
aagccttgcacaggatgcgagagtg

SEQ ID NO: 54611 - DNA, 25 bp, Mus musculus
aagccttgcagcagttcagtttgcc

SEQ ID NO: 54612 - DNA, 25 bp, Mus musculus
aagccttgcagctgttcagtttgcc

SEQ ID NO: 54613 - DNA, 25 bp, Mus musculus
aagccttgcattcttcgggtatgac

SEQ ID NO: 54614 - DNA, 25 bp, Mus musculus
aagccttgcattgttcgggtatgac

SEQ ID NO: 54615 - DNA, 25 bp, Mus musculus
aagccttgccacatgtgttttagaa

SEQ ID NO: 54616 - DNA, 25 bp, Mus musculus
aagccttgccacttgtgttttagaa

SEQ ID NO: 54617 - DNA, 25 bp, Mus musculus
aagccttgcggtccagatgagcatg

SEQ ID NO: 54618 - DNA, 25 bp, Mus musculus
aagccttgcggtgcagatgagcatg

SEQ ID NO: 54619 - DNA, 25 bp, Mus musculus
aagccttgcgttacctgtctgtgat

SEQ ID NO: 54620 - DNA, 25 bp, Mus musculus
aagccttgcgtttcctgtctgtgat

SEQ ID NO: 54621 - DNA, 25 bp, Mus musculus
aagccttgctaacaaccctgcatgc

SEQ ID NO: 54622 - DNA, 25 bp, Mus musculus
aagccttgctaagaaccctgcatgc

SEQ ID NO: 54623 - DNA, 25 bp, Mus musculus
aagccttgctctcgagctaccctgt

SEQ ID NO: 54624 - DNA, 25 bp, Mus musculus
aagccttgctctggagctaccctgt

SEQ ID NO: 54625 - DNA, 25 bp, Mus musculus
aagccttgcttcattaatttattcc

SEQ ID NO: 54626 - DNA, 25 bp, Mus musculus
aagccttgcttctttaatttattcc

SEQ ID NO: 54627 - DNA, 25 bp, Mus musculus
aagccttgctttattactgaactat

SEQ ID NO: 54628 - DNA, 25 bp, Mus musculus
aagccttgcttttttactgaactat

SEQ ID NO: 54629 - DNA, 25 bp, Mus musculus
aagccttggaacagtgtcacctgag

SEQ ID NO: 54630 - DNA, 25 bp, Mus musculus
aagccttggaactgtgtcacctgag

SEQ ID NO: 54631 - DNA, 25 bp, Mus musculus
aagccttggccgagagatgcctggt

SEQ ID NO: 54632 - DNA, 25 bp, Mus musculus
aagccttggccgtgagatgcctggt

SEQ ID NO: 54633 - DNA, 25 bp, Mus musculus
aagccttggctaactacttttctgt

SEQ ID NO: 54634 - DNA, 25 bp, Mus musculus
aagccttggctatctacttttctgt

SEQ ID NO: 54635 - DNA, 25 bp, Mus musculus
aagccttgggctcttgggcaagtca

SEQ ID NO: 54636 - DNA, 25 bp, Mus musculus
aagccttgggctgttgggcaagtca

SEQ ID NO: 54637 - DNA, 25 bp, Mus musculus
aagccttgggttaagcactgtgtgc

SEQ ID NO: 54638 - DNA, 25 bp, Mus musculus
aagccttgggtttagcactgtgtgc

SEQ ID NO: 54639 - DNA, 25 bp, Mus musculus
aagccttggtgccatacagctcaga

SEQ ID NO: 54640 - DNA, 25 bp, Mus musculus
aagccttggtgcgatacagctcaga

SEQ ID NO: 54641 - DNA, 25 bp, Mus musculus
aagccttggtgtaagtttagccact

SEQ ID NO: 54642 - DNA, 25 bp, Mus musculus
aagccttggtgtagagaagtgtctc

SEQ ID NO: 54643 - DNA, 25 bp, Mus musculus
aagccttggtgttagtttagccact

SEQ ID NO: 54644 - DNA, 25 bp, Mus musculus
aagccttggtgttgagaagtgtctc

SEQ ID NO: 54645 - DNA, 25 bp, Mus musculus
aagccttggttacatctggaagcac

SEQ ID NO: 54646 - DNA, 25 bp, Mus musculus
aagccttggttagatctggaagcac

SEQ ID NO: 54647 - DNA, 25 bp, Mus musculus
aagccttggtttacttcaggtgtat

SEQ ID NO: 54648 - DNA, 25 bp, Mus musculus
aagccttggttttcttcaggtgtat

SEQ ID NO: 54649 - DNA, 25 bp, Mus musculus
aagccttgtatgacagctcacatgc

SEQ ID NO: 54650 - DNA, 25 bp, Mus musculus
aagccttgtatgtcagctcacatgc

SEQ ID NO: 54651 - DNA, 25 bp, Mus musculus
aagccttgtccacttgggtgggcct

SEQ ID NO: 54652 - DNA, 25 bp, Mus musculus
aagccttgtccagttgggtgggcct

SEQ ID NO: 54653 - DNA, 25 bp, Mus musculus
aagccttgtccgcattcttcaacca

SEQ ID NO: 54654 - DNA, 25 bp, Mus musculus
aagccttgtccggattcttcaacca

SEQ ID NO: 54655 - DNA, 25 bp, Mus musculus
aagccttgtcctccgtgcaggatgt

SEQ ID NO: 54656 - DNA, 25 bp, Mus musculus
aagccttgtcctgcgtgcaggatgt

SEQ ID NO: 54657 - DNA, 25 bp, Mus musculus
aagccttgtgaacggcagacctccc

SEQ ID NO: 54658 - DNA, 25 bp, Mus musculus
aagccttgtgaagggcagacctccc

SEQ ID NO: 54659 - DNA, 25 bp, Mus musculus
aagccttgtggcctgtgtgtgcatt

SEQ ID NO: 54660 - DNA, 25 bp, Mus musculus
aagccttgtggcgtgtgtgtgcatt

SEQ ID NO: 54661 - DNA, 25 bp, Mus musculus
aagcctttaaacctcgctcatacta

SEQ ID NO: 54662 - DNA, 25 bp, Mus musculus
aagcctttaaacgtcgctcatacta

SEQ ID NO: 54663 - DNA, 25 bp, Mus musculus
aagcctttaacaccggccataccat

SEQ ID NO: 54664 - DNA, 25 bp, Mus musculus
aagcctttaacactcagattctcag

SEQ ID NO: 54665 - DNA, 25 bp, Mus musculus
aagcctttaacagcggccataccat

SEQ ID NO: 54666 - DNA, 25 bp, Mus musculus
aagcctttaacagtcagattctcag

SEQ ID NO: 54667 - DNA, 25 bp, Mus musculus
aagcctttaagtaccaagtctgact

SEQ ID NO: 54668 - DNA, 25 bp, Mus musculus
aagcctttaagttccaagtctgact

SEQ ID NO: 54669 - DNA, 25 bp, Mus musculus
aagcctttactaactattatttcca

SEQ ID NO: 54670 - DNA, 25 bp, Mus musculus
aagcctttactatctattatttcca

SEQ ID NO: 54671 - DNA, 25 bp, Mus musculus
aagcctttagctatctctggtctat

SEQ ID NO: 54672 - DNA, 25 bp, Mus musculus
aagcctttagctttctctggtctat

SEQ ID NO: 54673 - DNA, 25 bp, Mus musculus
aagcctttagtaagagaagacacgt

SEQ ID NO: 54674 - DNA, 25 bp, Mus musculus
aagcctttagtacaactccgctctg

SEQ ID NO: 54675 - DNA, 25 bp, Mus musculus
aagcctttagtagaactccgctctg

SEQ ID NO: 54676 - DNA, 25 bp, Mus musculus
aagcctttagtatgagaagacacgt

SEQ ID NO: 54677 - DNA, 25 bp, Mus musculus
aagcctttagtcagctatcttgcct

SEQ ID NO: 54678 - DNA, 25 bp, Mus musculus
aagcctttagtctgctatcttgcct

SEQ ID NO: 54679 - DNA, 25 bp, Mus musculus
aagcctttagtgagtctatcaggga

SEQ ID NO: 54680 - DNA, 25 bp, Mus musculus
aagcctttagtgtgtctatcaggga

SEQ ID NO: 54681 - DNA, 25 bp, Mus musculus
aagcctttatacagcagcggcctag

SEQ ID NO: 54682 - DNA, 25 bp, Mus musculus
aagcctttatactgcagcggcctag

SEQ ID NO: 54683 - DNA, 25 bp, Mus musculus
aagcctttattcaaagcactagtag

SEQ ID NO: 54684 - DNA, 25 bp, Mus musculus
aagcctttattctaagcactagtag

SEQ ID NO: 54685 - DNA, 25 bp, Mus musculus
aagcctttcactcgcattatgttcc

SEQ ID NO: 54686 - DNA, 25 bp, Mus musculus
aagcctttcactcggaacgctattg

SEQ ID NO: 54687 - DNA, 25 bp, Mus musculus
aagcctttcactcggtatatggtta

SEQ ID NO: 54688 - DNA, 25 bp, Mus musculus
aagcctttcactggcattatgttcc

SEQ ID NO: 54689 - DNA, 25 bp, Mus musculus
aagcctttcactgggaacgctattg

SEQ ID NO: 54690 - DNA, 25 bp, Mus musculus
aagcctttcactgggtatatggtta

SEQ ID NO: 54691 - DNA, 25 bp, Mus musculus
aagcctttcaggcacagtgtctgac

SEQ ID NO: 54692 - DNA, 25 bp, Mus musculus
aagcctttcagggacagtgtctgac

SEQ ID NO: 54693 - DNA, 25 bp, Mus musculus
aagcctttcataattccctgtcaat

SEQ ID NO: 54694 - DNA, 25 bp, Mus musculus
aagcctttcatatttccctgtcaat

SEQ ID NO: 54695 - DNA, 25 bp, Mus musculus
aagcctttccctcaccagaggcaat

SEQ ID NO: 54696 - DNA, 25 bp, Mus musculus
aagcctttccctgaccagaggcaat

SEQ ID NO: 54697 - DNA, 25 bp, Mus musculus
aagcctttccgtacacaccaagttg

SEQ ID NO: 54698 - DNA, 25 bp, Mus musculus
aagcctttccgttcacaccaagttg

SEQ ID NO: 54699 - DNA, 25 bp, Mus musculus
aagcctttccttctgaagcacttag

SEQ ID NO: 54700 - DNA, 25 bp, Mus musculus
aagcctttccttgtgaagcacttag

SEQ ID NO: 54701 - DNA, 25 bp, Mus musculus
aagcctttcgagcacccacttggga

SEQ ID NO: 54702 - DNA, 25 bp, Mus musculus
aagcctttcgaggacccacttggga

SEQ ID NO: 54703 - DNA, 25 bp, Mus musculus
aagcctttctcaacggactcatggc

SEQ ID NO: 54704 - DNA, 25 bp, Mus musculus
aagcctttctcatcggactcatggc

SEQ ID NO: 54705 - DNA, 25 bp, Mus musculus
aagcctttctccaaaatgtgaggtc

SEQ ID NO: 54706 - DNA, 25 bp, Mus musculus
aagcctttctcctaaatgtgaggtc

SEQ ID NO: 54707 - DNA, 25 bp, Mus musculus
aagcctttctcgcaagtcttctgtg

SEQ ID NO: 54708 - DNA, 25 bp, Mus musculus
aagcctttctcggaagtcttctgtg

SEQ ID NO: 54709 - DNA, 25 bp, Mus musculus
aagcctttctctaaaatctgtgcag

SEQ ID NO: 54710 - DNA, 25 bp, Mus musculus
aagcctttctcttaaatctgtgcag

SEQ ID NO: 54711 - DNA, 25 bp, Mus musculus
aagcctttctgccatgtggctatag

SEQ ID NO: 54712 - DNA, 25 bp, Mus musculus
aagcctttctgcgatgtggctatag

SEQ ID NO: 54713 - DNA, 25 bp, Mus musculus
aagcctttctggcagcgctggtgtc

SEQ ID NO: 54714 - DNA, 25 bp, Mus musculus
aagcctttctgggagcgctggtgtc

SEQ ID NO: 54715 - DNA, 25 bp, Mus musculus
aagcctttgaaaatgcatacccaat

SEQ ID NO: 54716 - DNA, 25 bp, Mus musculus
aagcctttgaaattgcatacccaat

SEQ ID NO: 54717 - DNA, 25 bp, Mus musculus
aagcctttgaagctcttgcatgtct

SEQ ID NO: 54718 - DNA, 25 bp, Mus musculus
aagcctttgaaggtcttgcatgtct

SEQ ID NO: 54719 - DNA, 25 bp, Mus musculus
aagcctttgaatatgcacttcatgg

SEQ ID NO: 54720 - DNA, 25 bp, Mus musculus
aagcctttgaatttgcacttcatgg

SEQ ID NO: 54721 - DNA, 25 bp, Mus musculus
aagcctttgaggctatcacacagac

SEQ ID NO: 54722 - DNA, 25 bp, Mus musculus
aagcctttgagggtatcacacagac

SEQ ID NO: 54723 - DNA, 25 bp, Mus musculus
aagcctttgatcagatgcactcggg

SEQ ID NO: 54724 - DNA, 25 bp, Mus musculus
aagcctttgatctgatgcactcggg

SEQ ID NO: 54725 - DNA, 25 bp, Mus musculus
aagcctttgatgatgtacctgtagt

SEQ ID NO: 54726 - DNA, 25 bp, Mus musculus
aagcctttgatgttgtacctgtagt

SEQ ID NO: 54727 - DNA, 25 bp, Mus musculus
aagcctttgcacactagacccatgt

SEQ ID NO: 54728 - DNA, 25 bp, Mus musculus
aagcctttgcactctagacccatgt

SEQ ID NO: 54729 - DNA, 25 bp, Mus musculus
aagcctttgctccaattgggctctt

SEQ ID NO: 54730 - DNA, 25 bp, Mus musculus
aagcctttgctcgaattgggctctt

SEQ ID NO: 54731 - DNA, 25 bp, Mus musculus
aagcctttgctgctgccagggcaag

SEQ ID NO: 54732 - DNA, 25 bp, Mus musculus
aagcctttgctggtgccagggcaag

SEQ ID NO: 54733 - DNA, 25 bp, Mus musculus
aagcctttggacatagctcatctct

SEQ ID NO: 54734 - DNA, 25 bp, Mus musculus
aagcctttggacttagctcatctct

SEQ ID NO: 54735 - DNA, 25 bp, Mus musculus
aagcctttggccaacaagccataga

SEQ ID NO: 54736 - DNA, 25 bp, Mus musculus
aagcctttggcctacaagccataga

SEQ ID NO: 54737 - DNA, 25 bp, Mus musculus
aagccttttatgactggagctgcag

SEQ ID NO: 54738 - DNA, 25 bp, Mus musculus
aagccttttatgtctggagctgcag

SEQ ID NO: 54739 - DNA, 25 bp, Mus musculus
aagccttttcagagtcccaagtgcg

SEQ ID NO: 54740 - DNA, 25 bp, Mus musculus
aagccttttcagtgtcccaagtgcg

SEQ ID NO: 54741 - DNA, 25 bp, Mus musculus
aagccttttcataccattgtcatcc

SEQ ID NO: 54742 - DNA, 25 bp, Mus musculus
aagccttttcattccattgtcatcc

SEQ ID NO: 54743 - DNA, 25 bp, Mus musculus
aagccttttcccagcattataatct

SEQ ID NO: 54744 - DNA, 25 bp, Mus musculus
aagccttttccctgcattataatct

SEQ ID NO: 54745 - DNA, 25 bp, Mus musculus
aagccttttgacaggattctcactg

SEQ ID NO: 54746 - DNA, 25 bp, Mus musculus
aagccttttgactggattctcactg

SEQ ID NO: 54747 - DNA, 25 bp, Mus musculus
aagccttttgtaagctgttctagcg

SEQ ID NO: 54748 - DNA, 25 bp, Mus musculus
aagccttttgtatgctgttctagcg

SEQ ID NO: 54749 - DNA, 25 bp, Mus musculus
aagccttttgtgctctatgggttgt

SEQ ID NO: 54750 - DNA, 25 bp, Mus musculus
aagccttttgtggtctatgggttgt

SEQ ID NO: 54751 - DNA, 25 bp, Mus musculus
aagccttttgttcactacattcttg

SEQ ID NO: 54752 - DNA, 25 bp, Mus musculus
aagccttttgttgactacattcttg

SEQ ID NO: 54753 - DNA, 25 bp, Mus musculus
aagcctttttacagattgcatggaa

SEQ ID NO: 54754 - DNA, 25 bp, Mus musculus
aagcctttttactgattgcatggaa

SEQ ID NO: 54755 - DNA, 25 bp, Mus musculus
aagcgaaaatcaagggtagcagagt

SEQ ID NO: 54756 - DNA, 25 bp, Mus musculus
aagcgaaaatcatgggtagcagagt

SEQ ID NO: 54757 - DNA, 25 bp, Mus musculus
aagcgaaacactctgcgccaagcag

SEQ ID NO: 54758 - DNA, 25 bp, Mus musculus
aagcgaaacactgtgcgccaagcag

SEQ ID NO: 54759 - DNA, 25 bp, Mus musculus
aagcgaacctacatgagatgaatca

SEQ ID NO: 54760 - DNA, 25 bp, Mus musculus
aagcgaacctacttgagatgaatca

SEQ ID NO: 54761 - DNA, 25 bp, Mus musculus
aagcgaacgagcacatgcgccacat

SEQ ID NO: 54762 - DNA, 25 bp, Mus musculus
aagcgaacgagctcatgcgccacat

SEQ ID NO: 54763 - DNA, 25 bp, Mus musculus
aagcgaactggtagtttactgattt

SEQ ID NO: 54764 - DNA, 25 bp, Mus musculus
aagcgaactggttgtttactgattt

SEQ ID NO: 54765 - DNA, 25 bp, Mus musculus
aagcgaagatcaccatgtctccacg

SEQ ID NO: 54766 - DNA, 25 bp, Mus musculus
aagcgaagatcagcatgtctccacg

SEQ ID NO: 54767 - DNA, 25 bp, Mus musculus
aagcgaagcgcgcaagccttttgga

SEQ ID NO: 54768 - DNA, 25 bp, Mus musculus
aagcgaagcgcggaagccttttgga

SEQ ID NO: 54769 - DNA, 25 bp, Mus musculus
aagcgaagtcatcggcagtctctgc

SEQ ID NO: 54770 - DNA, 25 bp, Mus musculus
aagcgaagtcatgggcagtctctgc

SEQ ID NO: 54771 - DNA, 25 bp, Mus musculus
aagcgaagtccacctcagattgccc

SEQ ID NO: 54772 - DNA, 25 bp, Mus musculus
aagcgaagtccagctcagattgccc

SEQ ID NO: 54773 - DNA, 25 bp, Mus musculus
aagcgaatcagcacaattaccgtac

SEQ ID NO: 54774 - DNA, 25 bp, Mus musculus
aagcgaatcagctcaattaccgtac

SEQ ID NO: 54775 - DNA, 25 bp, Mus musculus
aagcgaatcaggcatgggactcaaa

SEQ ID NO: 54776 - DNA, 25 bp, Mus musculus
aagcgaatcagggatgggactcaaa

SEQ ID NO: 54777 - DNA, 25 bp, Mus musculus
aagcgaatctaaacctcttcagttt

SEQ ID NO: 54778 - DNA, 25 bp, Mus musculus
aagcgaatctaatcctcttcagttt

SEQ ID NO: 54779 - DNA, 25 bp, Mus musculus
aagcgaattcctcttcgggtgtcca

SEQ ID NO: 54780 - DNA, 25 bp, Mus musculus
aagcgaattcctgttcgggtgtcca

SEQ ID NO: 54781 - DNA, 25 bp, Mus musculus
aagcgacacaacaggtggccttatc

SEQ ID NO: 54782 - DNA, 25 bp, Mus musculus
aagcgacacaactggtggccttatc

SEQ ID NO: 54783 - DNA, 25 bp, Mus musculus
aagcgacacaagcatgcccgtagga

SEQ ID NO: 54784 - DNA, 25 bp, Mus musculus
aagcgacacaaggatgcccgtagga

SEQ ID NO: 54785 - DNA, 25 bp, Mus musculus
aagcgacagagcacacagagggcgt

SEQ ID NO: 54786 - DNA, 25 bp, Mus musculus
aagcgacagagctcacagagggcgt

SEQ ID NO: 54787 - DNA, 25 bp, Mus musculus
aagcgacagctcaggtttatcctga

SEQ ID NO: 54788 - DNA, 25 bp, Mus musculus
aagcgacagctctggtttatcctga

SEQ ID NO: 54789 - DNA, 25 bp, Mus musculus
aagcgacagcttcccttctttagtt

SEQ ID NO: 54790 - DNA, 25 bp, Mus musculus
aagcgacagcttgccttctttagtt

SEQ ID NO: 54791 - DNA, 25 bp, Mus musculus
aagcgacagggccacttgatacaga

SEQ ID NO: 54792 - DNA, 25 bp, Mus musculus
aagcgacagggcgacttgatacaga

SEQ ID NO: 54793 - DNA, 25 bp, Mus musculus
aagcgacatacgacaagctctgtaa

SEQ ID NO: 54794 - DNA, 25 bp, Mus musculus
aagcgacatacgtcaagctctgtaa

SEQ ID NO: 54795 - DNA, 25 bp, Mus musculus
aagcgacattatatccactcccgtt

SEQ ID NO: 54796 - DNA, 25 bp, Mus musculus
aagcgacattatttccactcccgtt

SEQ ID NO: 54797 - DNA, 25 bp, Mus musculus
aagcgaccacttcagctggtgtgga

SEQ ID NO: 54798 - DNA, 25 bp, Mus musculus
aagcgaccacttgagctggtgtgga

SEQ ID NO: 54799 - DNA, 25 bp, Mus musculus
aagcgacccaagattgacatgattg

SEQ ID NO: 54800 - DNA, 25 bp, Mus musculus
aagcgacccaagtttgacatgattg

SEQ ID NO: 54801 - DNA, 25 bp, Mus musculus
aagcgaccggaaactgttggatcca

SEQ ID NO: 54802 - DNA, 25 bp, Mus musculus
aagcgaccggaatctgttggatcca

SEQ ID NO: 54803 - DNA, 25 bp, Mus musculus
aagcgacctaatcctgacatcctgg

SEQ ID NO: 54804 - DNA, 25 bp, Mus musculus
aagcgacctaatgctgacatcctgg

SEQ ID NO: 54805 - DNA, 25 bp, Mus musculus
aagcgacctaccactgttgcggtgc

SEQ ID NO: 54806 - DNA, 25 bp, Mus musculus
aagcgacctacctctgttgcggtgc

SEQ ID NO: 54807 - DNA, 25 bp, Mus musculus
aagcgacctgccaaccagtttgtac

SEQ ID NO: 54808 - DNA, 25 bp, Mus musculus
aagcgacctgcctaccagtttgtac

SEQ ID NO: 54809 - DNA, 25 bp, Mus musculus
aagcgacgcatcactgcctactttg

SEQ ID NO: 54810 - DNA, 25 bp, Mus musculus
aagcgacgcatctctgcctactttg

SEQ ID NO: 54811 - DNA, 25 bp, Mus musculus
aagcgacgcgccatgggcacagtgc

SEQ ID NO: 54812 - DNA, 25 bp, Mus musculus
aagcgacgcgccttgggcacagtgc

SEQ ID NO: 54813 - DNA, 25 bp, Mus musculus
aagcgactcacgattcccttgacaa

SEQ ID NO: 54814 - DNA, 25 bp, Mus musculus
aagcgactcacgtttcccttgacaa

SEQ ID NO: 54815 - DNA, 25 bp, Mus musculus
aagcgactccacatagaagactact

SEQ ID NO: 54816 - DNA, 25 bp, Mus musculus
aagcgactccacttagaagactact

SEQ ID NO: 54817 - DNA, 25 bp, Mus musculus
aagcgactgaacatcaacgcagcga

SEQ ID NO: 54818 - DNA, 25 bp, Mus musculus
aagcgactgaacttcaacgcagcga

SEQ ID NO: 54819 - DNA, 25 bp, Mus musculus
aagcgactggagctctatttacagg

SEQ ID NO: 54820 - DNA, 25 bp, Mus musculus
aagcgactggaggtctatttacagg

SEQ ID NO: 54821 - DNA, 25 bp, Mus musculus
aagcgacttgccaaagatctctttt

SEQ ID NO: 54822 - DNA, 25 bp, Mus musculus
aagcgacttgcctaagatctctttt

SEQ ID NO: 54823 - DNA, 25 bp, Mus musculus
aagcgagaaaccatgcctcgctggg

SEQ ID NO: 54824 - DNA, 25 bp, Mus musculus
aagcgagaaaccttgcctcgctggg

SEQ ID NO: 54825 - DNA, 25 bp, Mus musculus
aagcgagacactaagtacatacatg

SEQ ID NO: 54826 - DNA, 25 bp, Mus musculus
aagcgagacacttagtacatacatg

SEQ ID NO: 54827 - DNA, 25 bp, Mus musculus
aagcgagatcttccctcaaaatagt

SEQ ID NO: 54828 - DNA, 25 bp, Mus musculus
aagcgagatcttgcctcaaaatagt

SEQ ID NO: 54829 - DNA, 25 bp, Mus musculus
aagcgagatggtaatggatccctca

SEQ ID NO: 54830 - DNA, 25 bp, Mus musculus
aagcgagatggttatggatccctca

SEQ ID NO: 54831 - DNA, 25 bp, Mus musculus
aagcgagcatagcagaggccatcaa

SEQ ID NO: 54832 - DNA, 25 bp, Mus musculus
aagcgagcataggagaggccatcaa

SEQ ID NO: 54833 - DNA, 25 bp, Mus musculus
aagcgagcgccaatagcactctcat

SEQ ID NO: 54834 - DNA, 25 bp, Mus musculus
aagcgagcgccattagcactctcat

SEQ ID NO: 54835 - DNA, 25 bp, Mus musculus
aagcgagcgcgcacgtgtaagcttg

SEQ ID NO: 54836 - DNA, 25 bp, Mus musculus
aagcgagcgcgctcgtgtaagcttg

SEQ ID NO: 54837 - DNA, 25 bp, Mus musculus
aagcgagcgctcctgctcagcttgc

SEQ ID NO: 54838 - DNA, 25 bp, Mus musculus
aagcgagcgctcgtgctcagcttgc

SEQ ID NO: 54839 - DNA, 25 bp, Mus musculus
aagcgagcggttaacagcgcacact

SEQ ID NO: 54840 - DNA, 25 bp, Mus musculus
aagcgagcggtttacagcgcacact

SEQ ID NO: 54841 - DNA, 25 bp, Mus musculus
aagcgagctctgcacaatgctgact

SEQ ID NO: 54842 - DNA, 25 bp, Mus musculus
aagcgagctctggacaatgctgact

SEQ ID NO: 54843 - DNA, 25 bp, Mus musculus
aagcgagctgttagactatacggaa

SEQ ID NO: 54844 - DNA, 25 bp, Mus musculus
aagcgagctgtttgactatacggaa

SEQ ID NO: 54845 - DNA, 25 bp, Mus musculus
aagcgaggacaaccccgtgagtcac

SEQ ID NO: 54846 - DNA, 25 bp, Mus musculus
aagcgaggacaagcccgtgagtcac

SEQ ID NO: 54847 - DNA, 25 bp, Mus musculus
aagcgaggacttcttggactgctcc

SEQ ID NO: 54848 - DNA, 25 bp, Mus musculus
aagcgaggacttgttggactgctcc

SEQ ID NO: 54849 - DNA, 25 bp, Mus musculus
aagcgaggccagaacccagaggcaa

SEQ ID NO: 54850 - DNA, 25 bp, Mus musculus
aagcgaggccagtacccagaggcaa

SEQ ID NO: 54851 - DNA, 25 bp, Mus musculus
aagcgaggcgctctccttgccgtcg

SEQ ID NO: 54852 - DNA, 25 bp, Mus musculus
aagcgaggcgctgtccttgccgtcg

SEQ ID NO: 54853 - DNA, 25 bp, Mus musculus
aagcgagggctcatcataaattctg

SEQ ID NO: 54854 - DNA, 25 bp, Mus musculus
aagcgagggctcttcataaattctg

SEQ ID NO: 54855 - DNA, 25 bp, Mus musculus
aagcgaggtactacttcgatccgtg

SEQ ID NO: 54856 - DNA, 25 bp, Mus musculus
aagcgaggtacttcttcgatccgtg

SEQ ID NO: 54857 - DNA, 25 bp, Mus musculus
aagcgagtaaagagcaccgccacaa

SEQ ID NO: 54858 - DNA, 25 bp, Mus musculus
aagcgagtaaagtgcaccgccacaa

SEQ ID NO: 54859 - DNA, 25 bp, Mus musculus
aagcgagtactgaccaatgacctaa

SEQ ID NO: 54860 - DNA, 25 bp, Mus musculus
aagcgagtactgtccaatgacctaa

SEQ ID NO: 54861 - DNA, 25 bp, Mus musculus
aagcgagtggccagtacccagactg

SEQ ID NO: 54862 - DNA, 25 bp, Mus musculus
aagcgagtggcctgtacccagactg

SEQ ID NO: 54863 - DNA, 25 bp, Mus musculus
aagcgagtggcgatccagttcctaa

SEQ ID NO: 54864 - DNA, 25 bp, Mus musculus
aagcgagtggcgttccagttcctaa

SEQ ID NO: 54865 - DNA, 25 bp, Mus musculus
aagcgataaaggacaaaaaccgatg

SEQ ID NO: 54866 - DNA, 25 bp, Mus musculus
aagcgataaaggtcaaaaaccgatg

SEQ ID NO: 54867 - DNA, 25 bp, Mus musculus
aagcgatctctcagcaattgcaact

SEQ ID NO: 54868 - DNA, 25 bp, Mus musculus
aagcgatctctctgcaattgcaact

SEQ ID NO: 54869 - DNA, 25 bp, Mus musculus
aagcgatctgtcatgctcagcacaa

SEQ ID NO: 54870 - DNA, 25 bp, Mus musculus
aagcgatctgtcttgctcagcacaa

SEQ ID NO: 54871 - DNA, 25 bp, Mus musculus
aagcgatcttgactactttgaggaa

SEQ ID NO: 54872 - DNA, 25 bp, Mus musculus
aagcgatcttgagtactttgaggaa

SEQ ID NO: 54873 - DNA, 25 bp, Mus musculus
aagcgatgaaggctgagtcctcctc

SEQ ID NO: 54874 - DNA, 25 bp, Mus musculus
aagcgatgaagggtgagtcctcctc

SEQ ID NO: 54875 - DNA, 25 bp, Mus musculus
aagcgatggcttctttcggcaacgt

SEQ ID NO: 54876 - DNA, 25 bp, Mus musculus
aagcgatggcttgtttcggcaacgt

SEQ ID NO: 54877 - DNA, 25 bp, Mus musculus
aagcgatgtcgcatctggtagccaa

SEQ ID NO: 54878 - DNA, 25 bp, Mus musculus
aagcgatgtcgcttctggtagccaa

SEQ ID NO: 54879 - DNA, 25 bp, Mus musculus
aagcgatgtgatactctagaagaac

SEQ ID NO: 54880 - DNA, 25 bp, Mus musculus
aagcgatgtgattctctagaagaac

SEQ ID NO: 54881 - DNA, 25 bp, Mus musculus
aagcgatgtttgcaatttacccttt

SEQ ID NO: 54882 - DNA, 25 bp, Mus musculus
aagcgatgtttggaatttacccttt

SEQ ID NO: 54883 - DNA, 25 bp, Mus musculus
aagcgattatctcccaagagtccca

SEQ ID NO: 54884 - DNA, 25 bp, Mus musculus
aagcgattatctgccaagagtccca

SEQ ID NO: 54885 - DNA, 25 bp, Mus musculus
aagcgattcacacagggagcccagg

SEQ ID NO: 54886 - DNA, 25 bp, Mus musculus
aagcgattcacagagggagcccagg

SEQ ID NO: 54887 - DNA, 25 bp, Mus musculus
aagcgattccgactctttactaagc

SEQ ID NO: 54888 - DNA, 25 bp, Mus musculus
aagcgattccgagtctttactaagc

SEQ ID NO: 54889 - DNA, 25 bp, Mus musculus
aagcgattcttaaaaatatagccag

SEQ ID NO: 54890 - DNA, 25 bp, Mus musculus
aagcgattcttataaatatagccag

SEQ ID NO: 54891 - DNA, 25 bp, Mus musculus
aagcgattggtgcatttcagatctt

SEQ ID NO: 54892 - DNA, 25 bp, Mus musculus
aagcgattggtggatttcagatctt

SEQ ID NO: 54893 - DNA, 25 bp, Mus musculus
aagcgattttcccatgctcatgtgt

SEQ ID NO: 54894 - DNA, 25 bp, Mus musculus
aagcgattttccgatgctcatgtgt

SEQ ID NO: 54895 - DNA, 25 bp, Mus musculus
aagcgcaacagaccagcagaaccct

SEQ ID NO: 54896 - DNA, 25 bp, Mus musculus
aagcgcaacagagcagcagaaccct

SEQ ID NO: 54897 - DNA, 25 bp, Mus musculus
aagcgcacacatccatagcaatgac

SEQ ID NO: 54898 - DNA, 25 bp, Mus musculus
aagcgcacacatgcatagcaatgac

SEQ ID NO: 54899 - DNA, 25 bp, Mus musculus
aagcgcacatgcatcgtggatggca

SEQ ID NO: 54900 - DNA, 25 bp, Mus musculus
aagcgcacatgcttcgtggatggca

SEQ ID NO: 54901 - DNA, 25 bp, Mus musculus
aagcgcactagcactgctgtttgga

SEQ ID NO: 54902 - DNA, 25 bp, Mus musculus
aagcgcactagctctgctgtttgga

SEQ ID NO: 54903 - DNA, 25 bp, Mus musculus
aagcgcacttttccatttgccgagc

SEQ ID NO: 54904 - DNA, 25 bp, Mus musculus
aagcgcacttttgcatttgccgagc

SEQ ID NO: 54905 - DNA, 25 bp, Mus musculus
aagcgcagaacacccctataagaac

SEQ ID NO: 54906 - DNA, 25 bp, Mus musculus
aagcgcagaacagccctataagaac

SEQ ID NO: 54907 - DNA, 25 bp, Mus musculus
aagcgcagcaaacgtcagtcactac

SEQ ID NO: 54908 - DNA, 25 bp, Mus musculus
aagcgcagcaaaggtcagtcactac

SEQ ID NO: 54909 - DNA, 25 bp, Mus musculus
aagcgcagccagctcaatcaattcc

SEQ ID NO: 54910 - DNA, 25 bp, Mus musculus
aagcgcagccaggtcaatcaattcc

SEQ ID NO: 54911 - DNA, 25 bp, Mus musculus
aagcgcagccccatgggcagtgtca

SEQ ID NO: 54912 - DNA, 25 bp, Mus musculus
aagcgcagccccttgggcagtgtca

SEQ ID NO: 54913 - DNA, 25 bp, Mus musculus
aagcgcagccttcactcgtcccggg

SEQ ID NO: 54914 - DNA, 25 bp, Mus musculus
aagcgcagccttgactcgtcccggg

SEQ ID NO: 54915 - DNA, 25 bp, Mus musculus
aagcgcagcgtcagggcagaagcat

SEQ ID NO: 54916 - DNA, 25 bp, Mus musculus
aagcgcagcgtctgggcagaagcat

SEQ ID NO: 54917 - DNA, 25 bp, Mus musculus
aagcgcaggagcacggtgtgaacca

SEQ ID NO: 54918 - DNA, 25 bp, Mus musculus
aagcgcaggagctcggtgtgaacca

SEQ ID NO: 54919 - DNA, 25 bp, Mus musculus
aagcgcagtattcctcagcccatat

SEQ ID NO: 54920 - DNA, 25 bp, Mus musculus
aagcgcagtattgctcagcccatat

SEQ ID NO: 54921 - DNA, 25 bp, Mus musculus
aagcgcagtgtgatgggctgtaata

SEQ ID NO: 54922 - DNA, 25 bp, Mus musculus
aagcgcagtgtgttgggctgtaata

SEQ ID NO: 54923 - DNA, 25 bp, Mus musculus
aagcgcatcagtccatagtctgcta

SEQ ID NO: 54924 - DNA, 25 bp, Mus musculus
aagcgcatcagtgcatagtctgcta

SEQ ID NO: 54925 - DNA, 25 bp, Mus musculus
aagcgcatcttcactgcactacgag

SEQ ID NO: 54926 - DNA, 25 bp, Mus musculus
aagcgcatcttctctgcactacgag

SEQ ID NO: 54927 - DNA, 25 bp, Mus musculus
aagcgcatgacaatggtacagttca

SEQ ID NO: 54928 - DNA, 25 bp, Mus musculus
aagcgcatgacattggtacagttca

SEQ ID NO: 54929 - DNA, 25 bp, Mus musculus
aagcgcattcgactaggcctacagg

SEQ ID NO: 54930 - DNA, 25 bp, Mus musculus
aagcgcattcgagtaggcctacagg

SEQ ID NO: 54931 - DNA, 25 bp, Mus musculus
aagcgcattctccattaaacatttg

SEQ ID NO: 54932 - DNA, 25 bp, Mus musculus
aagcgcattctcgattaaacatttg

SEQ ID NO: 54933 - DNA, 25 bp, Mus musculus
aagcgcattgaacatgttgtagcca

SEQ ID NO: 54934 - DNA, 25 bp, Mus musculus
aagcgcattgaagatgttgtagcca

SEQ ID NO: 54935 - DNA, 25 bp, Mus musculus
aagcgccaacagctttctagaaggg

SEQ ID NO: 54936 - DNA, 25 bp, Mus musculus
aagcgccaacaggtttctagaaggg

SEQ ID NO: 54937 - DNA, 25 bp, Mus musculus
aagcgccacaggagacgctgtgcgc

SEQ ID NO: 54938 - DNA, 25 bp, Mus musculus
aagcgccacaggtgacgctgtgcgc

SEQ ID NO: 54939 - DNA, 25 bp, Mus musculus
aagcgccaggaacagattgccaaga

SEQ ID NO: 54940 - DNA, 25 bp, Mus musculus
aagcgccaggaagagattgccaaga

SEQ ID NO: 54941 - DNA, 25 bp, Mus musculus
aagcgccagtaaagccagacgcatg

SEQ ID NO: 54942 - DNA, 25 bp, Mus musculus
aagcgccagtaatgccagacgcatg

SEQ ID NO: 54943 - DNA, 25 bp, Mus musculus
aagcgccagtatcagactccaatag

SEQ ID NO: 54944 - DNA, 25 bp, Mus musculus
aagcgccagtatgagactccaatag

SEQ ID NO: 54945 - DNA, 25 bp, Mus musculus
aagcgccagtgtaatcgccattatt

SEQ ID NO: 54946 - DNA, 25 bp, Mus musculus
aagcgccagtgttatcgccattatt

SEQ ID NO: 54947 - DNA, 25 bp, Mus musculus
aagcgccatcggaggtaatgcctac

SEQ ID NO: 54948 - DNA, 25 bp, Mus musculus
aagcgccatcggtggtaatgcctac

SEQ ID NO: 54949 - DNA, 25 bp, Mus musculus
aagcgccatggccatgtatgcgtat

SEQ ID NO: 54950 - DNA, 25 bp, Mus musculus
aagcgccatggcgatgtatgcgtat

SEQ ID NO: 54951 - DNA, 25 bp, Mus musculus
aagcgccatgttattgctgatcctt

SEQ ID NO: 54952 - DNA, 25 bp, Mus musculus
aagcgccatgtttttgctgatcctt

SEQ ID NO: 54953 - DNA, 25 bp, Mus musculus
aagcgcccagctattagaggtggct

SEQ ID NO: 54954 - DNA, 25 bp, Mus musculus
aagcgcccagcttttagaggtggct

SEQ ID NO: 54955 - DNA, 25 bp, Mus musculus
aagcgcccagtcaggataagtgttt

SEQ ID NO: 54956 - DNA, 25 bp, Mus musculus
aagcgcccagtctggataagtgttt

SEQ ID NO: 54957 - DNA, 25 bp, Mus musculus
aagcgccccatcacaggtgggagcg

SEQ ID NO: 54958 - DNA, 25 bp, Mus musculus
aagcgccccatctcaggtgggagcg

SEQ ID NO: 54959 - DNA, 25 bp, Mus musculus
aagcgcccctttctaagtcctggag

SEQ ID NO: 54960 - DNA, 25 bp, Mus musculus
aagcgcccctttgtaagtcctggag

SEQ ID NO: 54961 - DNA, 25 bp, Mus musculus
aagcgccctgatctttacaggctca

SEQ ID NO: 54962 - DNA, 25 bp, Mus musculus
aagcgccctgatgtttacaggctca

SEQ ID NO: 54963 - DNA, 25 bp, Mus musculus
aagcgccctggacggaccaagtcct

SEQ ID NO: 54964 - DNA, 25 bp, Mus musculus
aagcgccctggagggaccaagtcct

SEQ ID NO: 54965 - DNA, 25 bp, Mus musculus
aagcgccgagatcatgggctttctg

SEQ ID NO: 54966 - DNA, 25 bp, Mus musculus
aagcgccgagatgatgggctttctg

SEQ ID NO: 54967 - DNA, 25 bp, Mus musculus
aagcgccgcaacagttgcattggct

SEQ ID NO: 54968 - DNA, 25 bp, Mus musculus
aagcgccgcaaccaggagatgcagc

SEQ ID NO: 54969 - DNA, 25 bp, Mus musculus
aagcgccgcaacgaggagatgcagc

SEQ ID NO: 54970 - DNA, 25 bp, Mus musculus
aagcgccgcaactgttgcattggct

SEQ ID NO: 54971 - DNA, 25 bp, Mus musculus
aagcgccgccagaagcaccaggagt

SEQ ID NO: 54972 - DNA, 25 bp, Mus musculus
aagcgccgccagtagcaccaggagt

SEQ ID NO: 54973 - DNA, 25 bp, Mus musculus
aagcgccgtgccaagtttgctgtgg

SEQ ID NO: 54974 - DNA, 25 bp, Mus musculus
aagcgccgtgcctagtttgctgtgg

SEQ ID NO: 54975 - DNA, 25 bp, Mus musculus
aagcgccgtggtagcccaagctttt

SEQ ID NO: 54976 - DNA, 25 bp, Mus musculus
aagcgccgtggttgcccaagctttt

SEQ ID NO: 54977 - DNA, 25 bp, Mus musculus
aagcgcctaatcaatctggtgtcta

SEQ ID NO: 54978 - DNA, 25 bp, Mus musculus
aagcgcctaatctatctggtgtcta

SEQ ID NO: 54979 - DNA, 25 bp, Mus musculus
aagcgcctagctctgtacaaggcag

SEQ ID NO: 54980 - DNA, 25 bp, Mus musculus
aagcgcctagctgtgtacaaggcag

SEQ ID NO: 54981 - DNA, 25 bp, Mus musculus
aagcgcctcagtatgatagctgcag

SEQ ID NO: 54982 - DNA, 25 bp, Mus musculus
aagcgcctcagtttgatagctgcag

SEQ ID NO: 54983 - DNA, 25 bp, Mus musculus
aagcgcctccgtctcagcttggtct

SEQ ID NO: 54984 - DNA, 25 bp, Mus musculus
aagcgcctccgtgtcagcttggtct

SEQ ID NO: 54985 - DNA, 25 bp, Mus musculus
aagcgcctcgttcgttgatctgaat

SEQ ID NO: 54986 - DNA, 25 bp, Mus musculus
aagcgcctcgttggttgatctgaat

SEQ ID NO: 54987 - DNA, 25 bp, Mus musculus
aagcgcctctgaatatacctctgaa

SEQ ID NO: 54988 - DNA, 25 bp, Mus musculus
aagcgcctctgattatacctctgaa

SEQ ID NO: 54989 - DNA, 25 bp, Mus musculus
aagcgcctggccaaagtcccatgga

SEQ ID NO: 54990 - DNA, 25 bp, Mus musculus
aagcgcctggcctaagtcccatgga

SEQ ID NO: 54991 - DNA, 25 bp, Mus musculus
aagcgcgagagaacaaacagatatt

SEQ ID NO: 54992 - DNA, 25 bp, Mus musculus
aagcgcgagagatcaaacagatatt

SEQ ID NO: 54993 - DNA, 25 bp, Mus musculus
aagcgcgatttcaggtttctggtgg

SEQ ID NO: 54994 - DNA, 25 bp, Mus musculus
aagcgcgatttctggtttctggtgg

SEQ ID NO: 54995 - DNA, 25 bp, Mus musculus
aagcgcgcaaatctgctgatgctga

SEQ ID NO: 54996 - DNA, 25 bp, Mus musculus
aagcgcgcaaatgtgctgatgctga

SEQ ID NO: 54997 - DNA, 25 bp, Mus musculus
aagcgcgctagtaaatactctgaac

SEQ ID NO: 54998 - DNA, 25 bp, Mus musculus
aagcgcgctagttaatactctgaac

SEQ ID NO: 54999 - DNA, 25 bp, Mus musculus
aagcgcggaggtactgagctcagaa

SEQ ID NO: 55000 - DNA, 25 bp, Mus musculus
aagcgcggaggttctgagctcagaa

SEQ ID NO: 55001 - DNA, 25 bp, Mus musculus
aagcgcggtgtcactttggtagcca

SEQ ID NO: 55002 - DNA, 25 bp, Mus musculus
aagcgcggtgtctctttggtagcca

SEQ ID NO: 55003 - DNA, 25 bp, Mus musculus
aagcgcgtttccagatgtttctttc

SEQ ID NO: 55004 - DNA, 25 bp, Mus musculus
aagcgcgtttcctgatgtttctttc

SEQ ID NO: 55005 - DNA, 25 bp, Mus musculus
aagcgctaaactcaaggcctcttcc

SEQ ID NO: 55006 - DNA, 25 bp, Mus musculus
aagcgctaaactgaaggcctcttcc

SEQ ID NO: 55007 - DNA, 25 bp, Mus musculus
aagcgctaccacagcactgctaaaa

SEQ ID NO: 55008 - DNA, 25 bp, Mus musculus
aagcgctaccactgcactgctaaaa

SEQ ID NO: 55009 - DNA, 25 bp, Mus musculus
aagcgctatgacaggaccgggaaga

SEQ ID NO: 55010 - DNA, 25 bp, Mus musculus
aagcgctatgactggaccgggaaga

SEQ ID NO: 55011 - DNA, 25 bp, Mus musculus
aagcgctatggtctggctgctaaca

SEQ ID NO: 55012 - DNA, 25 bp, Mus musculus
aagcgctatggtgtggctgctaaca

SEQ ID NO: 55013 - DNA, 25 bp, Mus musculus
aagcgctattataatttgaagtatg

SEQ ID NO: 55014 - DNA, 25 bp, Mus musculus
aagcgctattattatttgaagtatg

SEQ ID NO: 55015 - DNA, 25 bp, Mus musculus
aagcgctcaagtacatgctgaccaa

SEQ ID NO: 55016 - DNA, 25 bp, Mus musculus
aagcgctcaagttcatgctgaccaa

SEQ ID NO: 55017 - DNA, 25 bp, Mus musculus
aagcgctcagagacggtgtgacgat

SEQ ID NO: 55018 - DNA, 25 bp, Mus musculus
aagcgctcagagtcggtgtgacgat

SEQ ID NO: 55019 - DNA, 25 bp, Mus musculus
aagcgctccacacacagctagggaa

SEQ ID NO: 55020 - DNA, 25 bp, Mus musculus
aagcgctccacagacagctagggaa

SEQ ID NO: 55021 - DNA, 25 bp, Mus musculus
aagcgctcggaaatcatcaagcagt

SEQ ID NO: 55022 - DNA, 25 bp, Mus musculus
aagcgctcggaattcatcaagcagt

SEQ ID NO: 55023 - DNA, 25 bp, Mus musculus
aagcgctctgccatcactgaagaag

SEQ ID NO: 55024 - DNA, 25 bp, Mus musculus
aagcgctctgccttcactgaagaag

SEQ ID NO: 55025 - DNA, 25 bp, Mus musculus
aagcgctgagatacaggcaggctgc

SEQ ID NO: 55026 - DNA, 25 bp, Mus musculus
aagcgctgagattcaggcaggctgc

SEQ ID NO: 55027 - DNA, 25 bp, Mus musculus
aagcgctgagctactctgaatatat

SEQ ID NO: 55028 - DNA, 25 bp, Mus musculus
aagcgctgagcttctctgaatatat

SEQ ID NO: 55029 - DNA, 25 bp, Mus musculus
aagcgctgatggacgcctgactccg

SEQ ID NO: 55030 - DNA, 25 bp, Mus musculus
aagcgctgatggtcgcctgactccg

SEQ ID NO: 55031 - DNA, 25 bp, Mus musculus
aagcgctgccagaccagggctgatg

SEQ ID NO: 55032 - DNA, 25 bp, Mus musculus
aagcgctgccagtccagggctgatg

SEQ ID NO: 55033 - DNA, 25 bp, Mus musculus
aagcgctgcgggagaatgacacctt

SEQ ID NO: 55034 - DNA, 25 bp, Mus musculus
aagcgctgcgggtgaatgacacctt

SEQ ID NO: 55035 - DNA, 25 bp, Mus musculus
aagcgctgctccagatgccagaatg

SEQ ID NO: 55036 - DNA, 25 bp, Mus musculus
aagcgctgctcctgatgccagaatg

SEQ ID NO: 55037 - DNA, 25 bp, Mus musculus
aagcgctgctgaatgtgcgagcctg

SEQ ID NO: 55038 - DNA, 25 bp, Mus musculus
aagcgctgctgattgtgcgagcctg

SEQ ID NO: 55039 - DNA, 25 bp, Mus musculus
aagcgctggaagagaaatacggaga

SEQ ID NO: 55040 - DNA, 25 bp, Mus musculus
aagcgctggaagtgaaatacggaga

SEQ ID NO: 55041 - DNA, 25 bp, Mus musculus
aagcgctggttgacaggagcctgat

SEQ ID NO: 55042 - DNA, 25 bp, Mus musculus
aagcgctggttgtcaggagcctgat

SEQ ID NO: 55043 - DNA, 25 bp, Mus musculus
aagcgctgtaaaacttcccttccag

SEQ ID NO: 55044 - DNA, 25 bp, Mus musculus
aagcgctgtaaatcttcccttccag

SEQ ID NO: 55045 - DNA, 25 bp, Mus musculus
aagcgctgtaatactgaaccaccta

SEQ ID NO: 55046 - DNA, 25 bp, Mus musculus
aagcgctgtaattctgaaccaccta

SEQ ID NO: 55047 - DNA, 25 bp, Mus musculus
aagcgctgtgctagaggttagcagt

SEQ ID NO: 55048 - DNA, 25 bp, Mus musculus
aagcgctgtgcttgaggttagcagt

SEQ ID NO: 55049 - DNA, 25 bp, Mus musculus
aagcgcttacctcgcacgctcaaag

SEQ ID NO: 55050 - DNA, 25 bp, Mus musculus
aagcgcttacctggcacgctcaaag

SEQ ID NO: 55051 - DNA, 25 bp, Mus musculus
aagcgcttagctacagggtatccga

SEQ ID NO: 55052 - DNA, 25 bp, Mus musculus
aagcgcttagcttcagggtatccga

SEQ ID NO: 55053 - DNA, 25 bp, Mus musculus
aagcgcttcaagcgcgctgagctgc

SEQ ID NO: 55054 - DNA, 25 bp, Mus musculus
aagcgcttcaagggcgctgagctgc

SEQ ID NO: 55055 - DNA, 25 bp, Mus musculus
aagcgcttcactatgacttagggtc

SEQ ID NO: 55056 - DNA, 25 bp, Mus musculus
aagcgcttcactttgacttagggtc

SEQ ID NO: 55057 - DNA, 25 bp, Mus musculus
aagcgcttcatcaagagcaggcatg

SEQ ID NO: 55058 - DNA, 25 bp, Mus musculus
aagcgcttcatctagagcaggcatg

SEQ ID NO: 55059 - DNA, 25 bp, Mus musculus
aagcgcttccggaagaagtcccgag

SEQ ID NO: 55060 - DNA, 25 bp, Mus musculus
aagcgcttccggtagaagtcccgag

SEQ ID NO: 55061 - DNA, 25 bp, Mus musculus
aagcgcttgtagcacttggccagcc

SEQ ID NO: 55062 - DNA, 25 bp, Mus musculus
aagcgcttgtaggacttggccagcc

SEQ ID NO: 55063 - DNA, 25 bp, Mus musculus
aagcgcttgtctacaggactctttt

SEQ ID NO: 55064 - DNA, 25 bp, Mus musculus
aagcgcttgtcttcaggactctttt

SEQ ID NO: 55065 - DNA, 25 bp, Mus musculus
aagcgctttgaaaaggcacttcagt

SEQ ID NO: 55066 - DNA, 25 bp, Mus musculus
aagcgctttgaataggcacttcagt

SEQ ID NO: 55067 - DNA, 25 bp, Mus musculus
aagcgctttggaaacctgactgccc

SEQ ID NO: 55068 - DNA, 25 bp, Mus musculus
aagcgctttggatacctgactgccc

SEQ ID NO: 55069 - DNA, 25 bp, Mus musculus
aagcgctttgttctagaagcttcct

SEQ ID NO: 55070 - DNA, 25 bp, Mus musculus
aagcgctttgttgtagaagcttcct

SEQ ID NO: 55071 - DNA, 25 bp, Mus musculus
aagcgctttttactttgatggacag

SEQ ID NO: 55072 - DNA, 25 bp, Mus musculus
aagcgctttttagtttgatggacag

SEQ ID NO: 55073 - DNA, 25 bp, Mus musculus
aagcggaaagagagcttcaggccaa

SEQ ID NO: 55074 - DNA, 25 bp, Mus musculus
aagcggaaagagtgcttcaggccaa

SEQ ID NO: 55075 - DNA, 25 bp, Mus musculus
aagcggaaagcaaccgtccattcgg

SEQ ID NO: 55076 - DNA, 25 bp, Mus musculus
aagcggaaagcatccgtccattcgg

SEQ ID NO: 55077 - DNA, 25 bp, Mus musculus
aagcggaaccagcaatagtttctga

SEQ ID NO: 55078 - DNA, 25 bp, Mus musculus
aagcggaaccaggaatagtttctga

SEQ ID NO: 55079 - DNA, 25 bp, Mus musculus
aagcggaaccccactcagcgaattg

SEQ ID NO: 55080 - DNA, 25 bp, Mus musculus
aagcggaacccctctcagcgaattg

SEQ ID NO: 55081 - DNA, 25 bp, Mus musculus
aagcggaactaaacgcattaattca

SEQ ID NO: 55082 - DNA, 25 bp, Mus musculus
aagcggaactaatcgcattaattca

SEQ ID NO: 55083 - DNA, 25 bp, Mus musculus
aagcggaagaggcaccgagggtctg

SEQ ID NO: 55084 - DNA, 25 bp, Mus musculus
aagcggaagagggaccgagggtctg

SEQ ID NO: 55085 - DNA, 25 bp, Mus musculus
aagcggacatcacggctattcagag

SEQ ID NO: 55086 - DNA, 25 bp, Mus musculus
aagcggacatcagggctattcagag

SEQ ID NO: 55087 - DNA, 25 bp, Mus musculus
aagcggaccaggacttggcggacat

SEQ ID NO: 55088 - DNA, 25 bp, Mus musculus
aagcggaccaggtcttggcggacat

SEQ ID NO: 55089 - DNA, 25 bp, Mus musculus
aagcggacgatgatcggctcaacaa

SEQ ID NO: 55090 - DNA, 25 bp, Mus musculus
aagcggacgatgttcggctcaacaa

SEQ ID NO: 55091 - DNA, 25 bp, Mus musculus
aagcggactgcaatcttttgaacag

SEQ ID NO: 55092 - DNA, 25 bp, Mus musculus
aagcggactgcattcttttgaacag

SEQ ID NO: 55093 - DNA, 25 bp, Mus musculus
aagcggagacctacctgcgggtcat

SEQ ID NO: 55094 - DNA, 25 bp, Mus musculus
aagcggagaccttcctgcgggtcat

SEQ ID NO: 55095 - DNA, 25 bp, Mus musculus
aagcggagagcacagcagcttcagc

SEQ ID NO: 55096 - DNA, 25 bp, Mus musculus
aagcggagagcagagcagcttcagc

SEQ ID NO: 55097 - DNA, 25 bp, Mus musculus
aagcggagcctcacttcactcacaa

SEQ ID NO: 55098 - DNA, 25 bp, Mus musculus
aagcggagcctctcttcactcacaa

SEQ ID NO: 55099 - DNA, 25 bp, Mus musculus
aagcggatagcgcagcttcacgcaa

SEQ ID NO: 55100 - DNA, 25 bp, Mus musculus
aagcggatagcggagcttcacgcaa

SEQ ID NO: 55101 - DNA, 25 bp, Mus musculus
aagcggatctttctagtcgcatgcc

SEQ ID NO: 55102 - DNA, 25 bp, Mus musculus
aagcggatctttgtagtcgcatgcc

SEQ ID NO: 55103 - DNA, 25 bp, Mus musculus
aagcggatgctgagatgtcttcagt

SEQ ID NO: 55104 - DNA, 25 bp, Mus musculus
aagcggatgctgtgatgtcttcagt

SEQ ID NO: 55105 - DNA, 25 bp, Mus musculus
aagcggatgttcactcagacatgga

SEQ ID NO: 55106 - DNA, 25 bp, Mus musculus
aagcggatgttctctcagacatgga

SEQ ID NO: 55107 - DNA, 25 bp, Mus musculus
aagcggattcgaagctacatggcca

SEQ ID NO: 55108 - DNA, 25 bp, Mus musculus
aagcggattcgatgctacatggcca

SEQ ID NO: 55109 - DNA, 25 bp, Mus musculus
aagcggattgagaccaaagccagac

SEQ ID NO: 55110 - DNA, 25 bp, Mus musculus
aagcggattgagtccaaagccagac

SEQ ID NO: 55111 - DNA, 25 bp, Mus musculus
aagcggcaaacactgactcttcagt

SEQ ID NO: 55112 - DNA, 25 bp, Mus musculus
aagcggcaaacagtgactcttcagt

SEQ ID NO: 55113 - DNA, 25 bp, Mus musculus
aagcggcaagccatcctttgaaggg

SEQ ID NO: 55114 - DNA, 25 bp, Mus musculus
aagcggcaagccttcctttgaaggg

SEQ ID NO: 55115 - DNA, 25 bp, Mus musculus
aagcggcagccaatcctggatgcca

SEQ ID NO: 55116 - DNA, 25 bp, Mus musculus
aagcggcagccattcctggatgcca

SEQ ID NO: 55117 - DNA, 25 bp, Mus musculus
aagcggcatctgaggttttagggtc

SEQ ID NO: 55118 - DNA, 25 bp, Mus musculus
aagcggcatctgtggttttagggtc

SEQ ID NO: 55119 - DNA, 25 bp, Mus musculus
aagcggcatgtgaccctttgtgttt

SEQ ID NO: 55120 - DNA, 25 bp, Mus musculus
aagcggcatgtgtccctttgtgttt

SEQ ID NO: 55121 - DNA, 25 bp, Mus musculus
aagcggccagggactttatcctgaa

SEQ ID NO: 55122 - DNA, 25 bp, Mus musculus
aagcggccagggtctttatcctgaa

SEQ ID NO: 55123 - DNA, 25 bp, Mus musculus
aagcggcccacgctgccaaagaaga

SEQ ID NO: 55124 - DNA, 25 bp, Mus musculus
aagcggcccacggtgccaaagaaga

SEQ ID NO: 55125 - DNA, 25 bp, Mus musculus
aagcggcccaggatttgtggatcat

SEQ ID NO: 55126 - DNA, 25 bp, Mus musculus
aagcggcccaggttttgtggatcat

SEQ ID NO: 55127 - DNA, 25 bp, Mus musculus
aagcggccgtccacaggcagggata

SEQ ID NO: 55128 - DNA, 25 bp, Mus musculus
aagcggccgtcctcaggcagggata

SEQ ID NO: 55129 - DNA, 25 bp, Mus musculus
aagcggcgcactagaacatggatca

SEQ ID NO: 55130 - DNA, 25 bp, Mus musculus
aagcggcgcacttgaacatggatca

SEQ ID NO: 55131 - DNA, 25 bp, Mus musculus
aagcggcgctataccagttccggaa

SEQ ID NO: 55132 - DNA, 25 bp, Mus musculus
aagcggcgctattccagttccggaa

SEQ ID NO: 55133 - DNA, 25 bp, Mus musculus
aagcggcgggcgaattacttgtcct

SEQ ID NO: 55134 - DNA, 25 bp, Mus musculus
aagcggcgggcgtattacttgtcct

SEQ ID NO: 55135 - DNA, 25 bp, Mus musculus
aagcggctcagaaacgttcccttga

SEQ ID NO: 55136 - DNA, 25 bp, Mus musculus
aagcggctcagatacgttcccttga

SEQ ID NO: 55137 - DNA, 25 bp, Mus musculus
aagcggctcattcctgatggctgtg

SEQ ID NO: 55138 - DNA, 25 bp, Mus musculus
aagcggctcattgctgatggctgtg

SEQ ID NO: 55139 - DNA, 25 bp, Mus musculus
aagcggctccgcagaggactgtact

SEQ ID NO: 55140 - DNA, 25 bp, Mus musculus
aagcggctccgctgaggactgtact

SEQ ID NO: 55141 - DNA, 25 bp, Mus musculus
aagcggctggctatcatcgctcacc

SEQ ID NO: 55142 - DNA, 25 bp, Mus musculus
aagcggctggctttcatcgctcacc

SEQ ID NO: 55143 - DNA, 25 bp, Mus musculus
aagcggcttcctaccatttcaagaa

SEQ ID NO: 55144 - DNA, 25 bp, Mus musculus
aagcggcttccttccatttcaagaa

SEQ ID NO: 55145 - DNA, 25 bp, Mus musculus
aagcgggaagctcctttacaatgga

SEQ ID NO: 55146 - DNA, 25 bp, Mus musculus
aagcgggaagctgctttacaatgga

SEQ ID NO: 55147 - DNA, 25 bp, Mus musculus
aagcgggaggttacagatcgtcaga

SEQ ID NO: 55148 - DNA, 25 bp, Mus musculus
aagcgggaggtttcagatcgtcaga

SEQ ID NO: 55149 - DNA, 25 bp, Mus musculus
aagcgggatcacacagcattaagat

SEQ ID NO: 55150 - DNA, 25 bp, Mus musculus
aagcgggatcactcagcattaagat

SEQ ID NO: 55151 - DNA, 25 bp, Mus musculus
aagcgggcagagatgcttcacacac

SEQ ID NO: 55152 - DNA, 25 bp, Mus musculus
aagcgggcagagttgcttcacacac

SEQ ID NO: 55153 - DNA, 25 bp, Mus musculus
aagcgggcagatatcttgtgaatca

SEQ ID NO: 55154 - DNA, 25 bp, Mus musculus
aagcgggcagatttcttgtgaatca

SEQ ID NO: 55155 - DNA, 25 bp, Mus musculus
aagcgggccaagaggctgctacgaa

SEQ ID NO: 55156 - DNA, 25 bp, Mus musculus
aagcgggccaagtggctgctacgaa

SEQ ID NO: 55157 - DNA, 25 bp, Mus musculus
aagcgggccgctagtgagcagctcc

SEQ ID NO: 55158 - DNA, 25 bp, Mus musculus
aagcgggccgcttgtgagcagctcc

SEQ ID NO: 55159 - DNA, 25 bp, Mus musculus
aagcgggcctccagcatctaagaag

SEQ ID NO: 55160 - DNA, 25 bp, Mus musculus
aagcgggcctcctgcatctaagaag

SEQ ID NO: 55161 - DNA, 25 bp, Mus musculus
aagcgggctagcactttctcttgag

SEQ ID NO: 55162 - DNA, 25 bp, Mus musculus
aagcgggctagctctttctcttgag

SEQ ID NO: 55163 - DNA, 25 bp, Mus musculus
aagcgggctcagcaaccgaattcac

SEQ ID NO: 55164 - DNA, 25 bp, Mus musculus
aagcgggctcaggaaccgaattcac

SEQ ID NO: 55165 - DNA, 25 bp, Mus musculus
aagcgggtaggtcagtctctctcta

SEQ ID NO: 55166 - DNA, 25 bp, Mus musculus
aagcgggtaggtgagtctctctcta

SEQ ID NO: 55167 - DNA, 25 bp, Mus musculus
aagcgggtctagcaatcggccaaca

SEQ ID NO: 55168 - DNA, 25 bp, Mus musculus
aagcgggtctaggaatcggccaaca

SEQ ID NO: 55169 - DNA, 25 bp, Mus musculus
aagcgggtcttaacattgtctcgga

SEQ ID NO: 55170 - DNA, 25 bp, Mus musculus
aagcgggtcttatcattgtctcgga

SEQ ID NO: 55171 - DNA, 25 bp, Mus musculus
aagcggtagtacaccgtgtgggcaa

SEQ ID NO: 55172 - DNA, 25 bp, Mus musculus
aagcggtagtactccgtgtgggcaa

SEQ ID NO: 55173 - DNA, 25 bp, Mus musculus
aagcggtatcgcaggaccacggatc

SEQ ID NO: 55174 - DNA, 25 bp, Mus musculus
aagcggtatcgctggaccacggatc

SEQ ID NO: 55175 - DNA, 25 bp, Mus musculus
aagcggtcatcactcaccagtgggt

SEQ ID NO: 55176 - DNA, 25 bp, Mus musculus
aagcggtcatcagtcaccagtgggt

SEQ ID NO: 55177 - DNA, 25 bp, Mus musculus
aagcggtccccaagactagaacctg

SEQ ID NO: 55178 - DNA, 25 bp, Mus musculus
aagcggtccccatgactagaacctg

SEQ ID NO: 55179 - DNA, 25 bp, Mus musculus
aagcggtccgagacgatcttccaca

SEQ ID NO: 55180 - DNA, 25 bp, Mus musculus
aagcggtccgagtcgatcttccaca

SEQ ID NO: 55181 - DNA, 25 bp, Mus musculus
aagcggtctcaacaacttgtggaca

SEQ ID NO: 55182 - DNA, 25 bp, Mus musculus
aagcggtctcaagaacttgtggaca

SEQ ID NO: 55183 - DNA, 25 bp, Mus musculus
aagcggtctcctaagtcccgagatg

SEQ ID NO: 55184 - DNA, 25 bp, Mus musculus
aagcggtctccttagtcccgagatg

SEQ ID NO: 55185 - DNA, 25 bp, Mus musculus
aagcggtgaaccagttgtgttgtca

SEQ ID NO: 55186 - DNA, 25 bp, Mus musculus
aagcggtgaacctgttgtgttgtca

SEQ ID NO: 55187 - DNA, 25 bp, Mus musculus
aagcggtgagcacgccgtgcttgct

SEQ ID NO: 55188 - DNA, 25 bp, Mus musculus
aagcggtgagcaggccgtgcttgct

SEQ ID NO: 55189 - DNA, 25 bp, Mus musculus
aagcggtgtgcccatccatctgtga

SEQ ID NO: 55190 - DNA, 25 bp, Mus musculus
aagcggtgtgccgatccatctgtga

SEQ ID NO: 55191 - DNA, 25 bp, Mus musculus
aagcggttcactatctccctactgt

SEQ ID NO: 55192 - DNA, 25 bp, Mus musculus
aagcggttcactttctccctactgt

SEQ ID NO: 55193 - DNA, 25 bp, Mus musculus
aagcggttcagtcagtttatgaggc

SEQ ID NO: 55194 - DNA, 25 bp, Mus musculus
aagcggttcagtgagtttatgaggc

SEQ ID NO: 55195 - DNA, 25 bp, Mus musculus
aagcgtacaacgaacaacacagaga

SEQ ID NO: 55196 - DNA, 25 bp, Mus musculus
aagcgtacaacgtacaacacagaga

SEQ ID NO: 55197 - DNA, 25 bp, Mus musculus
aagcgtataccacagaacactggct

SEQ ID NO: 55198 - DNA, 25 bp, Mus musculus
aagcgtataccagagaacactggct

SEQ ID NO: 55199 - DNA, 25 bp, Mus musculus
aagcgtataggtacactttcgaaga

SEQ ID NO: 55200 - DNA, 25 bp, Mus musculus
aagcgtataggttcactttcgaaga

SEQ ID NO: 55201 - DNA, 25 bp, Mus musculus
aagcgtatttgtacagtgaattcag

SEQ ID NO: 55202 - DNA, 25 bp, Mus musculus
aagcgtatttgttcagtgaattcag

SEQ ID NO: 55203 - DNA, 25 bp, Mus musculus
aagcgtattttgctgattctggcaa

SEQ ID NO: 55204 - DNA, 25 bp, Mus musculus
aagcgtattttggtgattctggcaa

SEQ ID NO: 55205 - DNA, 25 bp, Mus musculus
aagcgtcaactgctgcatggctgat

SEQ ID NO: 55206 - DNA, 25 bp, Mus musculus
aagcgtcaactggtgcatggctgat

SEQ ID NO: 55207 - DNA, 25 bp, Mus musculus
aagcgtcaacttagccaaatggaaa

SEQ ID NO: 55208 - DNA, 25 bp, Mus musculus
aagcgtcaactttgccaaatggaaa

SEQ ID NO: 55209 - DNA, 25 bp, Mus musculus
aagcgtcaatgcctactgaaccaat

SEQ ID NO: 55210 - DNA, 25 bp, Mus musculus
aagcgtcaatgcgtactgaaccaat

SEQ ID NO: 55211 - DNA, 25 bp, Mus musculus
aagcgtcactgaagcaggtgcagaa

SEQ ID NO: 55212 - DNA, 25 bp, Mus musculus
aagcgtcactgatgcaggtgcagaa

SEQ ID NO: 55213 - DNA, 25 bp, Mus musculus
aagcgtcccactagtgtgatcatgg

SEQ ID NO: 55214 - DNA, 25 bp, Mus musculus
aagcgtcccacttgtgtgatcatgg

SEQ ID NO: 55215 - DNA, 25 bp, Mus musculus
aagcgtcccgcgatgggcagtgcca

SEQ ID NO: 55216 - DNA, 25 bp, Mus musculus
aagcgtcccgcgttgggcagtgcca

SEQ ID NO: 55217 - DNA, 25 bp, Mus musculus
aagcgtcctgacatgactgatgttg

SEQ ID NO: 55218 - DNA, 25 bp, Mus musculus
aagcgtcctgacttgactgatgttg

SEQ ID NO: 55219 - DNA, 25 bp, Mus musculus
aagcgtctagagctatggcaacaga

SEQ ID NO: 55220 - DNA, 25 bp, Mus musculus
aagcgtctagaggtatggcaacaga

SEQ ID NO: 55221 - DNA, 25 bp, Mus musculus
aagcgtctcaagagcaccgaggatc

SEQ ID NO: 55222 - DNA, 25 bp, Mus musculus
aagcgtctcaagtgcaccgaggatc

SEQ ID NO: 55223 - DNA, 25 bp, Mus musculus
aagcgtctcccacagatttgaccct

SEQ ID NO: 55224 - DNA, 25 bp, Mus musculus
aagcgtctcccagagatttgaccct

SEQ ID NO: 55225 - DNA, 25 bp, Mus musculus
aagcgtctctcaaggtttgctgcat

SEQ ID NO: 55226 - DNA, 25 bp, Mus musculus
aagcgtctctcatggtttgctgcat

SEQ ID NO: 55227 - DNA, 25 bp, Mus musculus
aagcgtctctccatgttgctttttt

SEQ ID NO: 55228 - DNA, 25 bp, Mus musculus
aagcgtctctccttgttgctttttt

SEQ ID NO: 55229 - DNA, 25 bp, Mus musculus
aagcgtctgaagatacttgtccagg

SEQ ID NO: 55230 - DNA, 25 bp, Mus musculus
aagcgtctgaagttacttgtccagg

SEQ ID NO: 55231 - DNA, 25 bp, Mus musculus
aagcgtctgttgacattacgtgtcg

SEQ ID NO: 55232 - DNA, 25 bp, Mus musculus
aagcgtctgttgtcattacgtgtcg

SEQ ID NO: 55233 - DNA, 25 bp, Mus musculus
aagcgtcttcttcggaccagatttc

SEQ ID NO: 55234 - DNA, 25 bp, Mus musculus
aagcgtcttcttgggaccagatttc

SEQ ID NO: 55235 - DNA, 25 bp, Mus musculus
aagcgtcttgtaccccaagcaacag

SEQ ID NO: 55236 - DNA, 25 bp, Mus musculus
aagcgtcttgtagcccaagcaacag

SEQ ID NO: 55237 - DNA, 25 bp, Mus musculus
aagcgtgaaccaagagacttctgga

SEQ ID NO: 55238 - DNA, 25 bp, Mus musculus
aagcgtgaaccatgagacttctgga

SEQ ID NO: 55239 - DNA, 25 bp, Mus musculus
aagcgtgaggctacacagaataata

SEQ ID NO: 55240 - DNA, 25 bp, Mus musculus
aagcgtgaggcttcacagaataata

SEQ ID NO: 55241 - DNA, 25 bp, Mus musculus
aagcgtgagtcgacctgagcagcat

SEQ ID NO: 55242 - DNA, 25 bp, Mus musculus
aagcgtgagtcgtcctgagcagcat

SEQ ID NO: 55243 - DNA, 25 bp, Mus musculus
aagcgtgataagaatcctctgagca

SEQ ID NO: 55244 - DNA, 25 bp, Mus musculus
aagcgtgataagtatcctctgagca

SEQ ID NO: 55245 - DNA, 25 bp, Mus musculus
aagcgtgatcgccaaccctgtaagc

SEQ ID NO: 55246 - DNA, 25 bp, Mus musculus
aagcgtgatcgcgaaccctgtaagc

SEQ ID NO: 55247 - DNA, 25 bp, Mus musculus
aagcgtgcacagaagttgcccgtgt

SEQ ID NO: 55248 - DNA, 25 bp, Mus musculus
aagcgtgcacagtagttgcccgtgt

SEQ ID NO: 55249 - DNA, 25 bp, Mus musculus
aagcgtgcagtcataatgtacagtg

SEQ ID NO: 55250 - DNA, 25 bp, Mus musculus
aagcgtgcagtcttaatgtacagtg

SEQ ID NO: 55251 - DNA, 25 bp, Mus musculus
aagcgtgccaatcaacatgctggtg

SEQ ID NO: 55252 - DNA, 25 bp, Mus musculus
aagcgtgccaatgaacatgctggtg

SEQ ID NO: 55253 - DNA, 25 bp, Mus musculus
aagcgtgctactcaacttcgattga

SEQ ID NO: 55254 - DNA, 25 bp, Mus musculus
aagcgtgctactgaacttcgattga

SEQ ID NO: 55255 - DNA, 25 bp, Mus musculus
aagcgtgctagtcgacatgggcctc

SEQ ID NO: 55256 - DNA, 25 bp, Mus musculus
aagcgtgctagtggacatgggcctc

SEQ ID NO: 55257 - DNA, 25 bp, Mus musculus
aagcgtgctgctaagaaatttgaat

SEQ ID NO: 55258 - DNA, 25 bp, Mus musculus
aagcgtgctgcttagaaatttgaat

SEQ ID NO: 55259 - DNA, 25 bp, Mus musculus
aagcgtgctttcctggctgtgtgta

SEQ ID NO: 55260 - DNA, 25 bp, Mus musculus
aagcgtgctttcgtggctgtgtgta

SEQ ID NO: 55261 - DNA, 25 bp, Mus musculus
aagcgtggactcatgtctcacctca

SEQ ID NO: 55262 - DNA, 25 bp, Mus musculus
aagcgtggactcttgtctcacctca

SEQ ID NO: 55263 - DNA, 25 bp, Mus musculus
aagcgtggactgactgcatcctaaa

SEQ ID NO: 55264 - DNA, 25 bp, Mus musculus
aagcgtggactgtctgcatcctaaa

SEQ ID NO: 55265 - DNA, 25 bp, Mus musculus
aagcgtgtagtacgacgatccccac

SEQ ID NO: 55266 - DNA, 25 bp, Mus musculus
aagcgtgtagtaggacgatccccac

SEQ ID NO: 55267 - DNA, 25 bp, Mus musculus
aagcgtgtcttccacaacatctgac

SEQ ID NO: 55268 - DNA, 25 bp, Mus musculus
aagcgtgtcttcgacaacatctgac

SEQ ID NO: 55269 - DNA, 25 bp, Mus musculus
aagcgtgtggttctaatacactcaa

SEQ ID NO: 55270 - DNA, 25 bp, Mus musculus
aagcgtgtggttgtaatacactcaa

SEQ ID NO: 55271 - DNA, 25 bp, Mus musculus
aagcgtgtgtcaagctgggattaca

SEQ ID NO: 55272 - DNA, 25 bp, Mus musculus
aagcgtgtgtcatgctgggattaca

SEQ ID NO: 55273 - DNA, 25 bp, Mus musculus
aagcgtgttattactcagacttgga

SEQ ID NO: 55274 - DNA, 25 bp, Mus musculus
aagcgtgttatttctcagacttgga

SEQ ID NO: 55275 - DNA, 25 bp, Mus musculus
aagcgtgttgcgagtatcagctgaa

SEQ ID NO: 55276 - DNA, 25 bp, Mus musculus
aagcgtgttgcgtgtatcagctgaa

SEQ ID NO: 55277 - DNA, 25 bp, Mus musculus
aagcgtgtttgcaaatgtcccaggc

SEQ ID NO: 55278 - DNA, 25 bp, Mus musculus
aagcgtgtttgctaatgtcccaggc

SEQ ID NO: 55279 - DNA, 25 bp, Mus musculus
aagcgttacggcaagacgaggcaca

SEQ ID NO: 55280 - DNA, 25 bp, Mus musculus
aagcgttacggctagacgaggcaca

SEQ ID NO: 55281 - DNA, 25 bp, Mus musculus
aagcgttcagtcagagctcatctct

SEQ ID NO: 55282 - DNA, 25 bp, Mus musculus
aagcgttcagtctgagctcatctct

SEQ ID NO: 55283 - DNA, 25 bp, Mus musculus
aagcgttcatagcagagtgacttca

SEQ ID NO: 55284 - DNA, 25 bp, Mus musculus
aagcgttcataggagagtgacttca

SEQ ID NO: 55285 - DNA, 25 bp, Mus musculus
aagcgttcctaaatcatgttgtcaa

SEQ ID NO: 55286 - DNA, 25 bp, Mus musculus
aagcgttcctaattcatgttgtcaa

SEQ ID NO: 55287 - DNA, 25 bp, Mus musculus
aagcgttcctgcaactttttaacat

SEQ ID NO: 55288 - DNA, 25 bp, Mus musculus
aagcgttcctgctactttttaacat

SEQ ID NO: 55289 - DNA, 25 bp, Mus musculus
aagcgttgccatagacgactttttt

SEQ ID NO: 55290 - DNA, 25 bp, Mus musculus
aagcgttgccattgacgactttttt

SEQ ID NO: 55291 - DNA, 25 bp, Mus musculus
aagcgttggcgcactaggaaggccc

SEQ ID NO: 55292 - DNA, 25 bp, Mus musculus
aagcgttggcgctctaggaaggccc

SEQ ID NO: 55293 - DNA, 25 bp, Mus musculus
aagcgttggcttatagcagccttga

SEQ ID NO: 55294 - DNA, 25 bp, Mus musculus
aagcgttggcttttagcagccttga

SEQ ID NO: 55295 - DNA, 25 bp, Mus musculus
aagcgttgggcaattctgtaagttt

SEQ ID NO: 55296 - DNA, 25 bp, Mus musculus
aagcgttgggcatttctgtaagttt

SEQ ID NO: 55297 - DNA, 25 bp, Mus musculus
aagcgttgtcatcgttggaggtcaa

SEQ ID NO: 55298 - DNA, 25 bp, Mus musculus
aagcgttgtcatggttggaggtcaa

SEQ ID NO: 55299 - DNA, 25 bp, Mus musculus
aagcgttgtgagatctgggcactgc

SEQ ID NO: 55300 - DNA, 25 bp, Mus musculus
aagcgttgtgagttctgggcactgc

SEQ ID NO: 55301 - DNA, 25 bp, Mus musculus
aagcgttgttacctcttgtgctgaa

SEQ ID NO: 55302 - DNA, 25 bp, Mus musculus
aagcgttgttacgtcttgtgctgaa

SEQ ID NO: 55303 - DNA, 25 bp, Mus musculus
aagcgttgtttcaccaggctgtaaa

SEQ ID NO: 55304 - DNA, 25 bp, Mus musculus
aagcgttgtttctccaggctgtaaa

SEQ ID NO: 55305 - DNA, 25 bp, Mus musculus
aagcgtttaggacgcctgtgcccat

SEQ ID NO: 55306 - DNA, 25 bp, Mus musculus
aagcgtttaggaggcctgtgcccat

SEQ ID NO: 55307 - DNA, 25 bp, Mus musculus
aagcgtttctgcagaatcctgtgaa

SEQ ID NO: 55308 - DNA, 25 bp, Mus musculus
aagcgtttctgctgaatcctgtgaa

SEQ ID NO: 55309 - DNA, 25 bp, Mus musculus
aagcgtttctttaggagtctcttct

SEQ ID NO: 55310 - DNA, 25 bp, Mus musculus
aagcgtttcttttggagtctcttct

SEQ ID NO: 55311 - DNA, 25 bp, Mus musculus
aagcgtttgctgcacactctgaggt

SEQ ID NO: 55312 - DNA, 25 bp, Mus musculus
aagcgtttgctggacactctgaggt

SEQ ID NO: 55313 - DNA, 25 bp, Mus musculus
aagcgtttggccaagaattgtgata

SEQ ID NO: 55314 - DNA, 25 bp, Mus musculus
aagcgtttggcctagaattgtgata

SEQ ID NO: 55315 - DNA, 25 bp, Mus musculus
aagcgttttcttccactcaaccagg

SEQ ID NO: 55316 - DNA, 25 bp, Mus musculus
aagcgttttcttgcactcaaccagg

SEQ ID NO: 55317 - DNA, 25 bp, Mus musculus
aagcgttttgcgatcacgcccgtat

SEQ ID NO: 55318 - DNA, 25 bp, Mus musculus
aagcgttttgcgttcacgcccgtat

SEQ ID NO: 55319 - DNA, 25 bp, Mus musculus
aagcgtttttaaaccctcaagcaag

SEQ ID NO: 55320 - DNA, 25 bp, Mus musculus
aagcgtttttaatccctcaagcaag

SEQ ID NO: 55321 - DNA, 25 bp, Mus musculus
aagctaaaaagcacgcggccgccct

SEQ ID NO: 55322 - DNA, 25 bp, Mus musculus
aagctaaaaagctcgcggccgccct

SEQ ID NO: 55323 - DNA, 25 bp, Mus musculus
aagctaaaaagtactctgccgtcag

SEQ ID NO: 55324 - DNA, 25 bp, Mus musculus
aagctaaaaagttctctgccgtcag

SEQ ID NO: 55325 - DNA, 25 bp, Mus musculus
aagctaaaaatcaagccgggctggt

SEQ ID NO: 55326 - DNA, 25 bp, Mus musculus
aagctaaaaatctagccgggctggt

SEQ ID NO: 55327 - DNA, 25 bp, Mus musculus
aagctaaaagaaatgggatatgacc

SEQ ID NO: 55328 - DNA, 25 bp, Mus musculus
aagctaaaagaattgggatatgacc

SEQ ID NO: 55329 - DNA, 25 bp, Mus musculus
aagctaaaagctcgtcggtcttcca

SEQ ID NO: 55330 - DNA, 25 bp, Mus musculus
aagctaaaagctggtcggtcttcca

SEQ ID NO: 55331 - DNA, 25 bp, Mus musculus
aagctaaacttacctctgagcctct

SEQ ID NO: 55332 - DNA, 25 bp, Mus musculus
aagctaaacttagctctgagcctct

SEQ ID NO: 55333 - DNA, 25 bp, Mus musculus
aagctaaagcgtcagccgcatccct

SEQ ID NO: 55334 - DNA, 25 bp, Mus musculus
aagctaaagcgtgagccgcatccct

SEQ ID NO: 55335 - DNA, 25 bp, Mus musculus
aagctaaattctagcctcgctgcgt

SEQ ID NO: 55336 - DNA, 25 bp, Mus musculus
aagctaaattcttgcctcgctgcgt

SEQ ID NO: 55337 - DNA, 25 bp, Mus musculus
aagctaacaaccaaagtcacagatg

SEQ ID NO: 55338 - DNA, 25 bp, Mus musculus
aagctaacaacctaagtcacagatg

SEQ ID NO: 55339 - DNA, 25 bp, Mus musculus
aagctaacatgtctgcagacccgcc

SEQ ID NO: 55340 - DNA, 25 bp, Mus musculus
aagctaacatgtgtgcagacccgcc

SEQ ID NO: 55341 - DNA, 25 bp, Mus musculus
aagctaaccaggcaccatgcgagag

SEQ ID NO: 55342 - DNA, 25 bp, Mus musculus
aagctaaccagggaccatgcgagag

SEQ ID NO: 55343 - DNA, 25 bp, Mus musculus
aagctaacgactacttggagcctct

SEQ ID NO: 55344 - DNA, 25 bp, Mus musculus
aagctaacgacttcttggagcctct

SEQ ID NO: 55345 - DNA, 25 bp, Mus musculus
aagctaagagttcagagtccaggat

SEQ ID NO: 55346 - DNA, 25 bp, Mus musculus
aagctaagagttgagagtccaggat

SEQ ID NO: 55347 - DNA, 25 bp, Mus musculus
aagctaagcaatatccacttcaggc

SEQ ID NO: 55348 - DNA, 25 bp, Mus musculus
aagctaagcaatttccacttcaggc

SEQ ID NO: 55349 - DNA, 25 bp, Mus musculus
aagctaagccagcatatactcttat

SEQ ID NO: 55350 - DNA, 25 bp, Mus musculus
aagctaagccaggatatactcttat

SEQ ID NO: 55351 - DNA, 25 bp, Mus musculus
aagctaagcgcgattgcagccgtct

SEQ ID NO: 55352 - DNA, 25 bp, Mus musculus
aagctaagcgcgtttgcagccgtct

SEQ ID NO: 55353 - DNA, 25 bp, Mus musculus
aagctaagctgtcaggagtcccttt

SEQ ID NO: 55354 - DNA, 25 bp, Mus musculus
aagctaagctgtgaggagtcccttt

SEQ ID NO: 55355 - DNA, 25 bp, Mus musculus
aagctaaggactcgatgactggaga

SEQ ID NO: 55356 - DNA, 25 bp, Mus musculus
aagctaaggactggatgactggaga

SEQ ID NO: 55357 - DNA, 25 bp, Mus musculus
aagctaaggtaccagaagccccagc

SEQ ID NO: 55358 - DNA, 25 bp, Mus musculus
aagctaaggtacgagaagccccagc

SEQ ID NO: 55359 - DNA, 25 bp, Mus musculus
aagctaagtagaacatcctgaacta

SEQ ID NO: 55360 - DNA, 25 bp, Mus musculus
aagctaagtagatcatcctgaacta

SEQ ID NO: 55361 - DNA, 25 bp, Mus musculus
aagctaatattcatcatatcattga

SEQ ID NO: 55362 - DNA, 25 bp, Mus musculus
aagctaatattcttcatatcattga

SEQ ID NO: 55363 - DNA, 25 bp, Mus musculus
aagctaatcaaaaacagtctttcta

SEQ ID NO: 55364 - DNA, 25 bp, Mus musculus
aagctaatcaaatacagtctttcta

SEQ ID NO: 55365 - DNA, 25 bp, Mus musculus
aagctaatgcagctgccatgtgtgc

SEQ ID NO: 55366 - DNA, 25 bp, Mus musculus
aagctaatgcaggtgccatgtgtgc

SEQ ID NO: 55367 - DNA, 25 bp, Mus musculus
aagctacaaaatcagtgacccacta

SEQ ID NO: 55368 - DNA, 25 bp, Mus musculus
aagctacaaaatgagtgacccacta

SEQ ID NO: 55369 - DNA, 25 bp, Mus musculus
aagctacaacgaaattccacagaat

SEQ ID NO: 55370 - DNA, 25 bp, Mus musculus
aagctacaacgatattccacagaat

SEQ ID NO: 55371 - DNA, 25 bp, Mus musculus
aagctacaagaaaggatctcattcc

SEQ ID NO: 55372 - DNA, 25 bp, Mus musculus
aagctacaagaatggatctcattcc

SEQ ID NO: 55373 - DNA, 25 bp, Mus musculus
aagctacaatagacacagaggctgt

SEQ ID NO: 55374 - DNA, 25 bp, Mus musculus
aagctacaatagtcacagaggctgt

SEQ ID NO: 55375 - DNA, 25 bp, Mus musculus
aagctacaattgactaaatccccag

SEQ ID NO: 55376 - DNA, 25 bp, Mus musculus
aagctacaattgtctaaatccccag

SEQ ID NO: 55377 - DNA, 25 bp, Mus musculus
aagctacaccttcttaaaacattgc

SEQ ID NO: 55378 - DNA, 25 bp, Mus musculus
aagctacaccttgttaaaacattgc

SEQ ID NO: 55379 - DNA, 25 bp, Mus musculus
aagctacactgtatactgtcatgac

SEQ ID NO: 55380 - DNA, 25 bp, Mus musculus
aagctacactgtttactgtcatgac

SEQ ID NO: 55381 - DNA, 25 bp, Mus musculus
aagctacacttcctaggaggccagg

SEQ ID NO: 55382 - DNA, 25 bp, Mus musculus
aagctacacttcgtaggaggccagg

SEQ ID NO: 55383 - DNA, 25 bp, Mus musculus
aagctacacttgccagagaatgctg

SEQ ID NO: 55384 - DNA, 25 bp, Mus musculus
aagctacacttggcagagaatgctg

SEQ ID NO: 55385 - DNA, 25 bp, Mus musculus
aagctacagacgctcatagctccgt

SEQ ID NO: 55386 - DNA, 25 bp, Mus musculus
aagctacagacggtcatagctccgt

SEQ ID NO: 55387 - DNA, 25 bp, Mus musculus
aagctacaggagctggcccttggtc

SEQ ID NO: 55388 - DNA, 25 bp, Mus musculus
aagctacaggaggtggcccttggtc

SEQ ID NO: 55389 - DNA, 25 bp, Mus musculus
aagctacagtctacaagggccttca

SEQ ID NO: 55390 - DNA, 25 bp, Mus musculus
aagctacagtcttcaagggccttca

SEQ ID NO: 55391 - DNA, 25 bp, Mus musculus
aagctacatctccaggcagaccagt

SEQ ID NO: 55392 - DNA, 25 bp, Mus musculus
aagctacatctcgaggcagaccagt

SEQ ID NO: 55393 - DNA, 25 bp, Mus musculus
aagctacatggccttcaccaggatg

SEQ ID NO: 55394 - DNA, 25 bp, Mus musculus
aagctacatggcgttcaccaggatg

SEQ ID NO: 55395 - DNA, 25 bp, Mus musculus
aagctaccaccaacccaactgtggt

SEQ ID NO: 55396 - DNA, 25 bp, Mus musculus
aagctaccaccatcccaactgtggt

SEQ ID NO: 55397 - DNA, 25 bp, Mus musculus
aagctaccaggtcactccagatgag

SEQ ID NO: 55398 - DNA, 25 bp, Mus musculus
aagctaccaggtgactccagatgag

SEQ ID NO: 55399 - DNA, 25 bp, Mus musculus
aagctaccctccacgacaataatgg

SEQ ID NO: 55400 - DNA, 25 bp, Mus musculus
aagctaccctcctcgacaataatgg

SEQ ID NO: 55401 - DNA, 25 bp, Mus musculus
aagctacctagtctttgagccccta

SEQ ID NO: 55402 - DNA, 25 bp, Mus musculus
aagctacctagtgtttgagccccta

SEQ ID NO: 55403 - DNA, 25 bp, Mus musculus
aagctacctatgataaactctgtaa

SEQ ID NO: 55404 - DNA, 25 bp, Mus musculus
aagctacctatgttaaactctgtaa

SEQ ID NO: 55405 - DNA, 25 bp, Mus musculus
aagctacctcaaatggattcacagt

SEQ ID NO: 55406 - DNA, 25 bp, Mus musculus
aagctacctcaattggattcacagt

SEQ ID NO: 55407 - DNA, 25 bp, Mus musculus
aagctacctgacagctccattagag

SEQ ID NO: 55408 - DNA, 25 bp, Mus musculus
aagctacctgactgctccattagag

SEQ ID NO: 55409 - DNA, 25 bp, Mus musculus
aagctaccttgtagccatatctaaa

SEQ ID NO: 55410 - DNA, 25 bp, Mus musculus
aagctaccttgttgccatatctaaa

SEQ ID NO: 55411 - DNA, 25 bp, Mus musculus
aagctacggcctctgaagctgttct

SEQ ID NO: 55412 - DNA, 25 bp, Mus musculus
aagctacggcctgtgaagctgttct

SEQ ID NO: 55413 - DNA, 25 bp, Mus musculus
aagctactacaaacatcttttaaaa

SEQ ID NO: 55414 - DNA, 25 bp, Mus musculus
aagctactacaatcatcttttaaaa

SEQ ID NO: 55415 - DNA, 25 bp, Mus musculus
aagctactacttcagcattttaggg

SEQ ID NO: 55416 - DNA, 25 bp, Mus musculus
aagctactacttgagcattttaggg

SEQ ID NO: 55417 - DNA, 25 bp, Mus musculus
aagctactattgagttctgaatgtt

SEQ ID NO: 55418 - DNA, 25 bp, Mus musculus
aagctactattgtgttctgaatgtt

SEQ ID NO: 55419 - DNA, 25 bp, Mus musculus
aagctactcaacagggcttacaaac

SEQ ID NO: 55420 - DNA, 25 bp, Mus musculus
aagctactcaactgggcttacaaac

SEQ ID NO: 55421 - DNA, 25 bp, Mus musculus
aagctactctgactcagtgactttc

SEQ ID NO: 55422 - DNA, 25 bp, Mus musculus
aagctactctgagtcagtgactttc

SEQ ID NO: 55423 - DNA, 25 bp, Mus musculus
aagctactgaatcttgctccacgtg

SEQ ID NO: 55424 - DNA, 25 bp, Mus musculus
aagctactgaatgttgctccacgtg

SEQ ID NO: 55425 - DNA, 25 bp, Mus musculus
aagctactgatgagaccccatgcct

SEQ ID NO: 55426 - DNA, 25 bp, Mus musculus
aagctactgatgtgaccccatgcct

SEQ ID NO: 55427 - DNA, 25 bp, Mus musculus
aagctactgctaccacaagttcata

SEQ ID NO: 55428 - DNA, 25 bp, Mus musculus
aagctactgctaccatctcagtggg

SEQ ID NO: 55429 - DNA, 25 bp, Mus musculus
aagctactgctagcacaagttcata

SEQ ID NO: 55430 - DNA, 25 bp, Mus musculus
aagctactgctagcatctcagtggg

SEQ ID NO: 55431 - DNA, 25 bp, Mus musculus
aagctactgggcaggaggtcctttc

SEQ ID NO: 55432 - DNA, 25 bp, Mus musculus
aagctactgggctggaggtcctttc

SEQ ID NO: 55433 - DNA, 25 bp, Mus musculus
aagctactgtggatggatgtctgcc

SEQ ID NO: 55434 - DNA, 25 bp, Mus musculus
aagctactgtggttggatgtctgcc

SEQ ID NO: 55435 - DNA, 25 bp, Mus musculus
aagctacttactctgtggcccgtgt

SEQ ID NO: 55436 - DNA, 25 bp, Mus musculus
aagctacttactgtgtggcccgtgt

SEQ ID NO: 55437 - DNA, 25 bp, Mus musculus
aagctacttagtattgtacataaac

SEQ ID NO: 55438 - DNA, 25 bp, Mus musculus
aagctacttagttttgtacataaac

SEQ ID NO: 55439 - DNA, 25 bp, Mus musculus
aagctagaagccagacatttttctg

SEQ ID NO: 55440 - DNA, 25 bp, Mus musculus
aagctagaagcctgacatttttctg

SEQ ID NO: 55441 - DNA, 25 bp, Mus musculus
aagctagaagtcagattccttccta

SEQ ID NO: 55442 - DNA, 25 bp, Mus musculus
aagctagaagtctgattccttccta

SEQ ID NO: 55443 - DNA, 25 bp, Mus musculus
aagctagacaccaagttctattccc

SEQ ID NO: 55444 - DNA, 25 bp, Mus musculus
aagctagacacctagttctattccc

SEQ ID NO: 55445 - DNA, 25 bp, Mus musculus
aagctagacagaactcagaccatca

SEQ ID NO: 55446 - DNA, 25 bp, Mus musculus
aagctagacagatctcagaccatca

SEQ ID NO: 55447 - DNA, 25 bp, Mus musculus
aagctagacgacactcaccgagaag

SEQ ID NO: 55448 - DNA, 25 bp, Mus musculus
aagctagacgactctcaccgagaag

SEQ ID NO: 55449 - DNA, 25 bp, Mus musculus
aagctagacttgaccctcatacctg

SEQ ID NO: 55450 - DNA, 25 bp, Mus musculus
aagctagacttgtccctcatacctg

SEQ ID NO: 55451 - DNA, 25 bp, Mus musculus
aagctagagctacgccttctgggag

SEQ ID NO: 55452 - DNA, 25 bp, Mus musculus
aagctagagctaggccttctgggag

SEQ ID NO: 55453 - DNA, 25 bp, Mus musculus
aagctagaggacatggtacctccac

SEQ ID NO: 55454 - DNA, 25 bp, Mus musculus
aagctagaggacttggtacctccac

SEQ ID NO: 55455 - DNA, 25 bp, Mus musculus
aagctagatctcactgttttttcat

SEQ ID NO: 55456 - DNA, 25 bp, Mus musculus
aagctagatctctctgttttttcat

SEQ ID NO: 55457 - DNA, 25 bp, Mus musculus
aagctagcaaagacgcagccacggg

SEQ ID NO: 55458 - DNA, 25 bp, Mus musculus
aagctagcaaagtcgcagccacggg

SEQ ID NO: 55459 - DNA, 25 bp, Mus musculus
aagctagcaagaacagatcactggc

SEQ ID NO: 55460 - DNA, 25 bp, Mus musculus
aagctagcaagatcagatcactggc

SEQ ID NO: 55461 - DNA, 25 bp, Mus musculus
aagctagcacaaaaacggatcccaa

SEQ ID NO: 55462 - DNA, 25 bp, Mus musculus
aagctagcacaataacggatcccaa

SEQ ID NO: 55463 - DNA, 25 bp, Mus musculus
aagctagcacggacttgagaatcca

SEQ ID NO: 55464 - DNA, 25 bp, Mus musculus
aagctagcacggtcttgagaatcca

SEQ ID NO: 55465 - DNA, 25 bp, Mus musculus
aagctagcagccacgctcagtctag

SEQ ID NO: 55466 - DNA, 25 bp, Mus musculus
aagctagcagccatcttgacaaatg

SEQ ID NO: 55467 - DNA, 25 bp, Mus musculus
aagctagcagcctcgctcagtctag

SEQ ID NO: 55468 - DNA, 25 bp, Mus musculus
aagctagcagccttcttgacaaatg

SEQ ID NO: 55469 - DNA, 25 bp, Mus musculus
aagctagctctgctcatgcatgtcc

SEQ ID NO: 55470 - DNA, 25 bp, Mus musculus
aagctagctctggtcatgcatgtcc

SEQ ID NO: 55471 - DNA, 25 bp, Mus musculus
aagctagctgagagcatccgctggt

SEQ ID NO: 55472 - DNA, 25 bp, Mus musculus
aagctagctgagtgcatccgctggt

SEQ ID NO: 55473 - DNA, 25 bp, Mus musculus
aagctagctgatctttgctctgccc

SEQ ID NO: 55474 - DNA, 25 bp, Mus musculus
aagctagctgatgtttgctctgccc

SEQ ID NO: 55475 - DNA, 25 bp, Mus musculus
aagctagctttgatgaccttgagca

SEQ ID NO: 55476 - DNA, 25 bp, Mus musculus
aagctagctttgttgaccttgagca

SEQ ID NO: 55477 - DNA, 25 bp, Mus musculus
aagctaggactgatctgcaggtgat

SEQ ID NO: 55478 - DNA, 25 bp, Mus musculus
aagctaggactgttctgcaggtgat

SEQ ID NO: 55479 - DNA, 25 bp, Mus musculus
aagctaggacttcggtgccattcaa

SEQ ID NO: 55480 - DNA, 25 bp, Mus musculus
aagctaggacttgggtgccattcaa

SEQ ID NO: 55481 - DNA, 25 bp, Mus musculus
aagctaggcatgagctccaccatga

SEQ ID NO: 55482 - DNA, 25 bp, Mus musculus
aagctaggcatgtgctccaccatga

SEQ ID NO: 55483 - DNA, 25 bp, Mus musculus
aagctaggcggtcatgattcccatt

SEQ ID NO: 55484 - DNA, 25 bp, Mus musculus
aagctaggcggtgatgattcccatt

SEQ ID NO: 55485 - DNA, 25 bp, Mus musculus
aagctaggcgtccttcatcctgatg

SEQ ID NO: 55486 - DNA, 25 bp, Mus musculus
aagctaggcgtcgttcatcctgatg

SEQ ID NO: 55487 - DNA, 25 bp, Mus musculus
aagctaggtaagaccacgccaacag

SEQ ID NO: 55488 - DNA, 25 bp, Mus musculus
aagctaggtaagtccacgccaacag

SEQ ID NO: 55489 - DNA, 25 bp, Mus musculus
aagctaggtaggcagtggatttttt

SEQ ID NO: 55490 - DNA, 25 bp, Mus musculus
aagctaggtagggagtggatttttt

SEQ ID NO: 55491 - DNA, 25 bp, Mus musculus
aagctaggtctcctcctgtggaaat

SEQ ID NO: 55492 - DNA, 25 bp, Mus musculus
aagctaggtctcgtcctgtggaaat

SEQ ID NO: 55493 - DNA, 25 bp, Mus musculus
aagctagtaattaaagacacatacg

SEQ ID NO: 55494 - DNA, 25 bp, Mus musculus
aagctagtaatttaagacacatacg

SEQ ID NO: 55495 - DNA, 25 bp, Mus musculus
aagctagtccagaccgaatcagggt

SEQ ID NO: 55496 - DNA, 25 bp, Mus musculus
aagctagtccagtccgaatcagggt

SEQ ID NO: 55497 - DNA, 25 bp, Mus musculus
aagctagtccatccaaatggccaaa

SEQ ID NO: 55498 - DNA, 25 bp, Mus musculus
aagctagtccatgcaaatggccaaa

SEQ ID NO: 55499 - DNA, 25 bp, Mus musculus
aagctagtcctacaccctaagagta

SEQ ID NO: 55500 - DNA, 25 bp, Mus musculus
aagctagtcctagaccctaagagta

SEQ ID NO: 55501 - DNA, 25 bp, Mus musculus
aagctagtctctatgctaaattaca

SEQ ID NO: 55502 - DNA, 25 bp, Mus musculus
aagctagtctctttgctaaattaca

SEQ ID NO: 55503 - DNA, 25 bp, Mus musculus
aagctagtgatcaggcaactgtgcg

SEQ ID NO: 55504 - DNA, 25 bp, Mus musculus
aagctagtgatctggcaactgtgcg

SEQ ID NO: 55505 - DNA, 25 bp, Mus musculus
aagctagtggtacgatgtccctggc

SEQ ID NO: 55506 - DNA, 25 bp, Mus musculus
aagctagtggtaggatgtccctggc

SEQ ID NO: 55507 - DNA, 25 bp, Mus musculus
aagctagtggtgctctcacctgtga

SEQ ID NO: 55508 - DNA, 25 bp, Mus musculus
aagctagtggtggtctcacctgtga

SEQ ID NO: 55509 - DNA, 25 bp, Mus musculus
aagctagttagcactctgtgtccat

SEQ ID NO: 55510 - DNA, 25 bp, Mus musculus
aagctagttagctctctgtgtccat

SEQ ID NO: 55511 - DNA, 25 bp, Mus musculus
aagctagtttgcagtccttggacta

SEQ ID NO: 55512 - DNA, 25 bp, Mus musculus
aagctagtttgctgtccttggacta

SEQ ID NO: 55513 - DNA, 25 bp, Mus musculus
aagctatacaccctgaatgccgaag

SEQ ID NO: 55514 - DNA, 25 bp, Mus musculus
aagctatacaccgtgaatgccgaag

SEQ ID NO: 55515 - DNA, 25 bp, Mus musculus
aagctatacatcatcagctgacaga

SEQ ID NO: 55516 - DNA, 25 bp, Mus musculus
aagctatacatcttcagctgacaga

SEQ ID NO: 55517 - DNA, 25 bp, Mus musculus
aagctataggccaaaccgctgatgc

SEQ ID NO: 55518 - DNA, 25 bp, Mus musculus
aagctataggccaaagcactgatca

SEQ ID NO: 55519 - DNA, 25 bp, Mus musculus
aagctataggcctaaccgctgatgc

SEQ ID NO: 55520 - DNA, 25 bp, Mus musculus
aagctataggcctaagcactgatca

SEQ ID NO: 55521 - DNA, 25 bp, Mus musculus
aagctatatactatggttacctatg

SEQ ID NO: 55522 - DNA, 25 bp, Mus musculus
aagctatatactttggttacctatg

SEQ ID NO: 55523 - DNA, 25 bp, Mus musculus
aagctatatcatattacctgttcta

SEQ ID NO: 55524 - DNA, 25 bp, Mus musculus
aagctatatcattttacctgttcta

SEQ ID NO: 55525 - DNA, 25 bp, Mus musculus
aagctatatgctaccactggagagg

SEQ ID NO: 55526 - DNA, 25 bp, Mus musculus
aagctatatgcttccactggagagg

SEQ ID NO: 55527 - DNA, 25 bp, Mus musculus
aagctatatgtgcatctgctaaaag

SEQ ID NO: 55528 - DNA, 25 bp, Mus musculus
aagctatatgtggatctgctaaaag

SEQ ID NO: 55529 - DNA, 25 bp, Mus musculus
aagctatattcaagctagctatata

SEQ ID NO: 55530 - DNA, 25 bp, Mus musculus
aagctatattcatgctagctatata

SEQ ID NO: 55531 - DNA, 25 bp, Mus musculus
aagctatattccctcgggagctgag

SEQ ID NO: 55532 - DNA, 25 bp, Mus musculus
aagctatattccgtcgggagctgag

SEQ ID NO: 55533 - DNA, 25 bp, Mus musculus
aagctatcaatgattgtcctgtata

SEQ ID NO: 55534 - DNA, 25 bp, Mus musculus
aagctatcaatgtttgtcctgtata

SEQ ID NO: 55535 - DNA, 25 bp, Mus musculus
aagctatcagtcattctagtgagtt

SEQ ID NO: 55536 - DNA, 25 bp, Mus musculus
aagctatcagtctttctagtgagtt

SEQ ID NO: 55537 - DNA, 25 bp, Mus musculus
aagctatcatgtacccgaagtgcct

SEQ ID NO: 55538 - DNA, 25 bp, Mus musculus
aagctatcatgttcccgaagtgcct

SEQ ID NO: 55539 - DNA, 25 bp, Mus musculus
aagctatcccatatacaattctgtg

SEQ ID NO: 55540 - DNA, 25 bp, Mus musculus
aagctatcccatttacaattctgtg

SEQ ID NO: 55541 - DNA, 25 bp, Mus musculus
aagctatccctgcaacctcagggca

SEQ ID NO: 55542 - DNA, 25 bp, Mus musculus
aagctatccctggaacctcagggca

SEQ ID NO: 55543 - DNA, 25 bp, Mus musculus
aagctatcctaacccagtgtcactg

SEQ ID NO: 55544 - DNA, 25 bp, Mus musculus
aagctatcctaagccagtgtcactg

SEQ ID NO: 55545 - DNA, 25 bp, Mus musculus
aagctatctgtcaggtctgccttga

SEQ ID NO: 55546 - DNA, 25 bp, Mus musculus
aagctatctgtctggtctgccttga

SEQ ID NO: 55547 - DNA, 25 bp, Mus musculus
aagctatgaaacagagccgcatttt

SEQ ID NO: 55548 - DNA, 25 bp, Mus musculus
aagctatgaaactgagccgcatttt

SEQ ID NO: 55549 - DNA, 25 bp, Mus musculus
aagctatgaatgcagctgtctcttg

SEQ ID NO: 55550 - DNA, 25 bp, Mus musculus
aagctatgaatggagctgtctcttg

SEQ ID NO: 55551 - DNA, 25 bp, Mus musculus
aagctatgatgtctcagcacttgac

SEQ ID NO: 55552 - DNA, 25 bp, Mus musculus
aagctatgatgtgtcagcacttgac

SEQ ID NO: 55553 - DNA, 25 bp, Mus musculus
aagctatgcggccacacccacagat

SEQ ID NO: 55554 - DNA, 25 bp, Mus musculus
aagctatgcggcgacacccacagat

SEQ ID NO: 55555 - DNA, 25 bp, Mus musculus
aagctatggaccatcgtgcatgatt

SEQ ID NO: 55556 - DNA, 25 bp, Mus musculus
aagctatggaccttcgtgcatgatt

SEQ ID NO: 55557 - DNA, 25 bp, Mus musculus
aagctatggcctacggtacattata

SEQ ID NO: 55558 - DNA, 25 bp, Mus musculus
aagctatggccttcggtacattata

SEQ ID NO: 55559 - DNA, 25 bp, Mus musculus
aagctatgtatacggctggctgttt

SEQ ID NO: 55560 - DNA, 25 bp, Mus musculus
aagctatgtatagggctggctgttt

SEQ ID NO: 55561 - DNA, 25 bp, Mus musculus
aagctatgtcacattccccaactct

SEQ ID NO: 55562 - DNA, 25 bp, Mus musculus
aagctatgtcactttccccaactct

SEQ ID NO: 55563 - DNA, 25 bp, Mus musculus
aagctatgtggacgtgcgacgccct

SEQ ID NO: 55564 - DNA, 25 bp, Mus musculus
aagctatgtggaggtgcgacgccct

SEQ ID NO: 55565 - DNA, 25 bp, Mus musculus
aagctattaattcagcggctcgagg

SEQ ID NO: 55566 - DNA, 25 bp, Mus musculus
aagctattaattgagcggctcgagg

SEQ ID NO: 55567 - DNA, 25 bp, Mus musculus
aagctattctagcatcataggatca

SEQ ID NO: 55568 - DNA, 25 bp, Mus musculus
aagctattctaggatcataggatca

SEQ ID NO: 55569 - DNA, 25 bp, Mus musculus
aagctattctcaaacaggtgtatca

SEQ ID NO: 55570 - DNA, 25 bp, Mus musculus
aagctattctcatacaggtgtatca

SEQ ID NO: 55571 - DNA, 25 bp, Mus musculus
aagctattgacactgctgttccttg

SEQ ID NO: 55572 - DNA, 25 bp, Mus musculus
aagctattgacagtgctgttccttg

SEQ ID NO: 55573 - DNA, 25 bp, Mus musculus
aagctattgtagaacctcctaccct

SEQ ID NO: 55574 - DNA, 25 bp, Mus musculus
aagctattgtagtacctcctaccct

SEQ ID NO: 55575 - DNA, 25 bp, Mus musculus
aagctattgtctccacaggctactg

SEQ ID NO: 55576 - DNA, 25 bp, Mus musculus
aagctattgtctgcacaggctactg

SEQ ID NO: 55577 - DNA, 25 bp, Mus musculus
aagctattgtgcaatgttcccataa

SEQ ID NO: 55578 - DNA, 25 bp, Mus musculus
aagctattgtgctatgttcccataa

SEQ ID NO: 55579 - DNA, 25 bp, Mus musculus
aagctatttcagcaaaggcatcccc

SEQ ID NO: 55580 - DNA, 25 bp, Mus musculus
aagctatttcaggaaaggcatcccc

SEQ ID NO: 55581 - DNA, 25 bp, Mus musculus
aagctatttgggattgttgccggga

SEQ ID NO: 55582 - DNA, 25 bp, Mus musculus
aagctatttgggtttgttgccggga

SEQ ID NO: 55583 - DNA, 25 bp, Mus musculus
aagctcaaagctcatgcttgaatga

SEQ ID NO: 55584 - DNA, 25 bp, Mus musculus
aagctcaaagctgatgcttgaatga

SEQ ID NO: 55585 - DNA, 25 bp, Mus musculus
aagctcaaaggcctcaatcacagga

SEQ ID NO: 55586 - DNA, 25 bp, Mus musculus
aagctcaaaggcctcttcagccaca

SEQ ID NO: 55587 - DNA, 25 bp, Mus musculus
aagctcaaaggcgtcaatcacagga

SEQ ID NO: 55588 - DNA, 25 bp, Mus musculus
aagctcaaaggcgtcttcagccaca

SEQ ID NO: 55589 - DNA, 25 bp, Mus musculus
aagctcaacaacaataacctccatt

SEQ ID NO: 55590 - DNA, 25 bp, Mus musculus
aagctcaacaactataacctccatt

SEQ ID NO: 55591 - DNA, 25 bp, Mus musculus
aagctcaacccaagttggcttcctt

SEQ ID NO: 55592 - DNA, 25 bp, Mus musculus
aagctcaacccatgttggcttcctt

SEQ ID NO: 55593 - DNA, 25 bp, Mus musculus
aagctcaaccgtatgcttgtttgaa

SEQ ID NO: 55594 - DNA, 25 bp, Mus musculus
aagctcaaccgtttgcttgtttgaa

SEQ ID NO: 55595 - DNA, 25 bp, Mus musculus
aagctcaactatctggaccccagga

SEQ ID NO: 55596 - DNA, 25 bp, Mus musculus
aagctcaactatgtggaccccagga

SEQ ID NO: 55597 - DNA, 25 bp, Mus musculus
aagctcaactccctagcggcggcgg

SEQ ID NO: 55598 - DNA, 25 bp, Mus musculus
aagctcaactccgtagcggcggcgg

SEQ ID NO: 55599 - DNA, 25 bp, Mus musculus
aagctcaactggaaactggctgact

SEQ ID NO: 55600 - DNA, 25 bp, Mus musculus
aagctcaactggtaactggctgact

SEQ ID NO: 55601 - DNA, 25 bp, Mus musculus
aagctcaaggaactggtgcccagca

SEQ ID NO: 55602 - DNA, 25 bp, Mus musculus
aagctcaaggaagtggtgcccagca

SEQ ID NO: 55603 - DNA, 25 bp, Mus musculus
aagctcaagggcatgcgctccaggg

SEQ ID NO: 55604 - DNA, 25 bp, Mus musculus
aagctcaagggcttgcgctccaggg

SEQ ID NO: 55605 - DNA, 25 bp, Mus musculus
aagctcaatgttaatcctttgctga

SEQ ID NO: 55606 - DNA, 25 bp, Mus musculus
aagctcaatgtttatcctttgctga

SEQ ID NO: 55607 - DNA, 25 bp, Mus musculus
aagctcacagcaccagcatcttagt

SEQ ID NO: 55608 - DNA, 25 bp, Mus musculus
aagctcacagcagcagcatcttagt

SEQ ID NO: 55609 - DNA, 25 bp, Mus musculus
aagctcacaggaaaaccagccaaga

SEQ ID NO: 55610 - DNA, 25 bp, Mus musculus
aagctcacaggataaccagccaaga

SEQ ID NO: 55611 - DNA, 25 bp, Mus musculus
aagctcacaggtcactgtaccagaa

SEQ ID NO: 55612 - DNA, 25 bp, Mus musculus
aagctcacaggtctttgttggaatc

SEQ ID NO: 55613 - DNA, 25 bp, Mus musculus
aagctcacaggtgactgtaccagaa

SEQ ID NO: 55614 - DNA, 25 bp, Mus musculus
aagctcacaggtgtttgttggaatc

SEQ ID NO: 55615 - DNA, 25 bp, Mus musculus
aagctcacagtgacagcgtgttaag

SEQ ID NO: 55616 - DNA, 25 bp, Mus musculus
aagctcacagtgtcagcgtgttaag

SEQ ID NO: 55617 - DNA, 25 bp, Mus musculus
aagctcacatggagtctgtgtacaa

SEQ ID NO: 55618 - DNA, 25 bp, Mus musculus
aagctcacatggtgtctgtgtacaa

SEQ ID NO: 55619 - DNA, 25 bp, Mus musculus
aagctcacccagcttgtggccgata

SEQ ID NO: 55620 - DNA, 25 bp, Mus musculus
aagctcacccaggttgtggccgata

SEQ ID NO: 55621 - DNA, 25 bp, Mus musculus
aagctcacctacatgctgcagaact

SEQ ID NO: 55622 - DNA, 25 bp, Mus musculus
aagctcacctacttgctgcagaact

SEQ ID NO: 55623 - DNA, 25 bp, Mus musculus
aagctcacctccaaagaactatcgt

SEQ ID NO: 55624 - DNA, 25 bp, Mus musculus
aagctcacctcctaagaactatcgt

SEQ ID NO: 55625 - DNA, 25 bp, Mus musculus
aagctcacctgacgactcatacggg

SEQ ID NO: 55626 - DNA, 25 bp, Mus musculus
aagctcacctgaggactcatacggg

SEQ ID NO: 55627 - DNA, 25 bp, Mus musculus
aagctcaccttccagtgcagcgatg

SEQ ID NO: 55628 - DNA, 25 bp, Mus musculus
aagctcaccttcgagtgcagcgatg

SEQ ID NO: 55629 - DNA, 25 bp, Mus musculus
aagctcacctttcagacgtattttc

SEQ ID NO: 55630 - DNA, 25 bp, Mus musculus
aagctcacctttgagacgtattttc

SEQ ID NO: 55631 - DNA, 25 bp, Mus musculus
aagctcacggctatgtaaaaaggca

SEQ ID NO: 55632 - DNA, 25 bp, Mus musculus
aagctcacggctttgtaaaaaggca

SEQ ID NO: 55633 - DNA, 25 bp, Mus musculus
aagctcacggtgacgggctttctag

SEQ ID NO: 55634 - DNA, 25 bp, Mus musculus
aagctcacggtgtcgggctttctag

SEQ ID NO: 55635 - DNA, 25 bp, Mus musculus
aagctcacgttgcttctggcaagag

SEQ ID NO: 55636 - DNA, 25 bp, Mus musculus
aagctcacgttggttctggcaagag

SEQ ID NO: 55637 - DNA, 25 bp, Mus musculus
aagctcactatgaacagcccagtct

SEQ ID NO: 55638 - DNA, 25 bp, Mus musculus
aagctcactatgtacagcccagtct

SEQ ID NO: 55639 - DNA, 25 bp, Mus musculus
aagctcactcaaccaattactgaaa

SEQ ID NO: 55640 - DNA, 25 bp, Mus musculus
aagctcactcaagcaattactgaaa

SEQ ID NO: 55641 - DNA, 25 bp, Mus musculus
aagctcactcagactaaggtagcca

SEQ ID NO: 55642 - DNA, 25 bp, Mus musculus
aagctcactcagtctaaggtagcca

SEQ ID NO: 55643 - DNA, 25 bp, Mus musculus
aagctcactcatcaaggcgcctgag

SEQ ID NO: 55644 - DNA, 25 bp, Mus musculus
aagctcactcatgaaggcgcctgag

SEQ ID NO: 55645 - DNA, 25 bp, Mus musculus
aagctcactccacttatgtgcaata

SEQ ID NO: 55646 - DNA, 25 bp, Mus musculus
aagctcactccagttatgtgcaata

SEQ ID NO: 55647 - DNA, 25 bp, Mus musculus
aagctcactgctaatcggggtccca

SEQ ID NO: 55648 - DNA, 25 bp, Mus musculus
aagctcactgcttatcggggtccca

SEQ ID NO: 55649 - DNA, 25 bp, Mus musculus
aagctcactgtacccgacgacatgg

SEQ ID NO: 55650 - DNA, 25 bp, Mus musculus
aagctcactgtagccgacgacatgg

SEQ ID NO: 55651 - DNA, 25 bp, Mus musculus
aagctcactgtccatacccatatta

SEQ ID NO: 55652 - DNA, 25 bp, Mus musculus
aagctcactgtcgatacccatatta

SEQ ID NO: 55653 - DNA, 25 bp, Mus musculus
aagctcactgttctcagatcctatg

SEQ ID NO: 55654 - DNA, 25 bp, Mus musculus
aagctcactgttgtcagatcctatg

SEQ ID NO: 55655 - DNA, 25 bp, Mus musculus
aagctcacttggactaacctgggac

SEQ ID NO: 55656 - DNA, 25 bp, Mus musculus
aagctcacttggtctaacctgggac

SEQ ID NO: 55657 - DNA, 25 bp, Mus musculus
aagctcacttttcatacttcacatt

SEQ ID NO: 55658 - DNA, 25 bp, Mus musculus
aagctcacttttgatacttcacatt

SEQ ID NO: 55659 - DNA, 25 bp, Mus musculus
aagctcagaaacacccagcacacag

SEQ ID NO: 55660 - DNA, 25 bp, Mus musculus
aagctcagaaactcccagcacacag

SEQ ID NO: 55661 - DNA, 25 bp, Mus musculus
aagctcagaagaatcatggtggact

SEQ ID NO: 55662 - DNA, 25 bp, Mus musculus
aagctcagaagattcatggtggact

SEQ ID NO: 55663 - DNA, 25 bp, Mus musculus
aagctcagaagcaagacctcaaaag

SEQ ID NO: 55664 - DNA, 25 bp, Mus musculus
aagctcagaagctagacctcaaaag

SEQ ID NO: 55665 - DNA, 25 bp, Mus musculus
aagctcagactcattcatgcacaaa

SEQ ID NO: 55666 - DNA, 25 bp, Mus musculus
aagctcagactctttcatgcacaaa

SEQ ID NO: 55667 - DNA, 25 bp, Mus musculus
aagctcagacttagggatgtttccc

SEQ ID NO: 55668 - DNA, 25 bp, Mus musculus
aagctcagactttgggatgtttccc

SEQ ID NO: 55669 - DNA, 25 bp, Mus musculus
aagctcagagccaggaagtcccgat

SEQ ID NO: 55670 - DNA, 25 bp, Mus musculus
aagctcagagcctggaagtcccgat

SEQ ID NO: 55671 - DNA, 25 bp, Mus musculus
aagctcagatctcctcaatgctctg

SEQ ID NO: 55672 - DNA, 25 bp, Mus musculus
aagctcagatctgctcaatgctctg

SEQ ID NO: 55673 - DNA, 25 bp, Mus musculus
aagctcagatgccacttcagctgaa

SEQ ID NO: 55674 - DNA, 25 bp, Mus musculus
aagctcagatgcgacttcagctgaa

SEQ ID NO: 55675 - DNA, 25 bp, Mus musculus
aagctcagcaagcatccacgctttt

SEQ ID NO: 55676 - DNA, 25 bp, Mus musculus
aagctcagcaaggatccacgctttt

SEQ ID NO: 55677 - DNA, 25 bp, Mus musculus
aagctcagcagcaacatcactgtga

SEQ ID NO: 55678 - DNA, 25 bp, Mus musculus
aagctcagcagctacatcactgtga

SEQ ID NO: 55679 - DNA, 25 bp, Mus musculus
aagctcagcatgatgcctaacagta

SEQ ID NO: 55680 - DNA, 25 bp, Mus musculus
aagctcagcatgttgcctaacagta

SEQ ID NO: 55681 - DNA, 25 bp, Mus musculus
aagctcagcttaaatacacagtgca

SEQ ID NO: 55682 - DNA, 25 bp, Mus musculus
aagctcagcttatatacacagtgca

SEQ ID NO: 55683 - DNA, 25 bp, Mus musculus
aagctcagcttgacagtgttgccac

SEQ ID NO: 55684 - DNA, 25 bp, Mus musculus
aagctcagcttgtcagtgttgccac

SEQ ID NO: 55685 - DNA, 25 bp, Mus musculus
aagctcaggattcgagtccttccct

SEQ ID NO: 55686 - DNA, 25 bp, Mus musculus
aagctcaggattggagtccttccct

SEQ ID NO: 55687 - DNA, 25 bp, Mus musculus
aagctcagggctctcaatcttgaac

SEQ ID NO: 55688 - DNA, 25 bp, Mus musculus
aagctcagggctgtcaatcttgaac

SEQ ID NO: 55689 - DNA, 25 bp, Mus musculus
aagctcaggtaaaggcacggaagtc

SEQ ID NO: 55690 - DNA, 25 bp, Mus musculus
aagctcaggtaatggcacggaagtc

SEQ ID NO: 55691 - DNA, 25 bp, Mus musculus
aagctcagtctgaatactcatccca

SEQ ID NO: 55692 - DNA, 25 bp, Mus musculus
aagctcagtctgtatactcatccca

SEQ ID NO: 55693 - DNA, 25 bp, Mus musculus
aagctcagtggaacactcagtcctt

SEQ ID NO: 55694 - DNA, 25 bp, Mus musculus
aagctcagtggatcactcagtcctt

SEQ ID NO: 55695 - DNA, 25 bp, Mus musculus
aagctcagtgtaccagctcagcaca

SEQ ID NO: 55696 - DNA, 25 bp, Mus musculus
aagctcagtgtagcagctcagcaca

SEQ ID NO: 55697 - DNA, 25 bp, Mus musculus
aagctcagtgtgacaacttcaccgg

SEQ ID NO: 55698 - DNA, 25 bp, Mus musculus
aagctcagtgtgtcaacttcaccgg

SEQ ID NO: 55699 - DNA, 25 bp, Mus musculus
aagctcatagcgacttgacagcctc

SEQ ID NO: 55700 - DNA, 25 bp, Mus musculus
aagctcatagcgtcttgacagcctc

SEQ ID NO: 55701 - DNA, 25 bp, Mus musculus
aagctcatatgcacctgtcacttga

SEQ ID NO: 55702 - DNA, 25 bp, Mus musculus
aagctcatatgctcctgtcacttga

SEQ ID NO: 55703 - DNA, 25 bp, Mus musculus
aagctcatccctcattcagcacgaa

SEQ ID NO: 55704 - DNA, 25 bp, Mus musculus
aagctcatccctgattcagcacgaa

SEQ ID NO: 55705 - DNA, 25 bp, Mus musculus
aagctcatcctgagcagtggagacc

SEQ ID NO: 55706 - DNA, 25 bp, Mus musculus
aagctcatcctgtgcagtggagacc

SEQ ID NO: 55707 - DNA, 25 bp, Mus musculus
aagctcatctttacattcaagtctt

SEQ ID NO: 55708 - DNA, 25 bp, Mus musculus
aagctcatcttttcattcaagtctt

SEQ ID NO: 55709 - DNA, 25 bp, Mus musculus
aagctcatgatgacccagagggagt

SEQ ID NO: 55710 - DNA, 25 bp, Mus musculus
aagctcatgatgtcccagagggagt

SEQ ID NO: 55711 - DNA, 25 bp, Mus musculus
aagctcatggaaattttatacactc

SEQ ID NO: 55712 - DNA, 25 bp, Mus musculus
aagctcatggaatttttatacactc

SEQ ID NO: 55713 - DNA, 25 bp, Mus musculus
aagctcatggccaagcaggacccag

SEQ ID NO: 55714 - DNA, 25 bp, Mus musculus
aagctcatggcctagcaggacccag

SEQ ID NO: 55715 - DNA, 25 bp, Mus musculus
aagctcatgtaacctgttccccaaa

SEQ ID NO: 55716 - DNA, 25 bp, Mus musculus
aagctcatgtaagctgttccccaaa

SEQ ID NO: 55717 - DNA, 25 bp, Mus musculus
aagctcatgtctacatgcttgtaac

SEQ ID NO: 55718 - DNA, 25 bp, Mus musculus
aagctcatgtcttcatgcttgtaac

SEQ ID NO: 55719 - DNA, 25 bp, Mus musculus
aagctcattaccacatacaatatac

SEQ ID NO: 55720 - DNA, 25 bp, Mus musculus
aagctcattacctcatacaatatac

SEQ ID NO: 55721 - DNA, 25 bp, Mus musculus
aagctcattgatctgtccagttcct

SEQ ID NO: 55722 - DNA, 25 bp, Mus musculus
aagctcattgatgtgtccagttcct

SEQ ID NO: 55723 - DNA, 25 bp, Mus musculus
aagctcatttccaggtatgacaatg

SEQ ID NO: 55724 - DNA, 25 bp, Mus musculus
aagctcatttccctcatttcttact

SEQ ID NO: 55725 - DNA, 25 bp, Mus musculus
aagctcatttccgtcatttcttact

SEQ ID NO: 55726 - DNA, 25 bp, Mus musculus
aagctcatttcctggtatgacaatg

SEQ ID NO: 55727 - DNA, 25 bp, Mus musculus
aagctcatttgaaacagggcaggtg

SEQ ID NO: 55728 - DNA, 25 bp, Mus musculus
aagctcatttgatacagggcaggtg

SEQ ID NO: 55729 - DNA, 25 bp, Mus musculus
aagctcattttcagtgaccttcctt

SEQ ID NO: 55730 - DNA, 25 bp, Mus musculus
aagctcattttctgtgaccttcctt

SEQ ID NO: 55731 - DNA, 25 bp, Mus musculus
aagctccaaagactagagggactac

SEQ ID NO: 55732 - DNA, 25 bp, Mus musculus
aagctccaaagagtagagggactac

SEQ ID NO: 55733 - DNA, 25 bp, Mus musculus
aagctccaactgattgtataccaat

SEQ ID NO: 55734 - DNA, 25 bp, Mus musculus
aagctccaactgtttgtataccaat

SEQ ID NO: 55735 - DNA, 25 bp, Mus musculus
aagctccaagcacggtcccggtctg

SEQ ID NO: 55736 - DNA, 25 bp, Mus musculus
aagctccaagcagggtcccggtctg

SEQ ID NO: 55737 - DNA, 25 bp, Mus musculus
aagctccacagccattggtacaaag

SEQ ID NO: 55738 - DNA, 25 bp, Mus musculus
aagctccacagcgattggtacaaag

SEQ ID NO: 55739 - DNA, 25 bp, Mus musculus
aagctccaccacatgaactaatcaa

SEQ ID NO: 55740 - DNA, 25 bp, Mus musculus
aagctccaccacttgaactaatcaa

SEQ ID NO: 55741 - DNA, 25 bp, Mus musculus
aagctccagcatagaccttgaactg

SEQ ID NO: 55742 - DNA, 25 bp, Mus musculus
aagctccagcattgaccttgaactg

SEQ ID NO: 55743 - DNA, 25 bp, Mus musculus
aagctccagccacattgtcggcttc

SEQ ID NO: 55744 - DNA, 25 bp, Mus musculus
aagctccagccagattgtcggcttc

SEQ ID NO: 55745 - DNA, 25 bp, Mus musculus
aagctccaggaacctacacagccag

SEQ ID NO: 55746 - DNA, 25 bp, Mus musculus
aagctccaggaagctacacagccag

SEQ ID NO: 55747 - DNA, 25 bp, Mus musculus
aagctccaggacatccacgcagatg

SEQ ID NO: 55748 - DNA, 25 bp, Mus musculus
aagctccaggacttccacgcagatg

SEQ ID NO: 55749 - DNA, 25 bp, Mus musculus
aagctccagggtacctcatgactct

SEQ ID NO: 55750 - DNA, 25 bp, Mus musculus
aagctccagggttcctcatgactct

SEQ ID NO: 55751 - DNA, 25 bp, Mus musculus
aagctccagtttcctcagagtcaag

SEQ ID NO: 55752 - DNA, 25 bp, Mus musculus
aagctccagtttctagcgattccct

SEQ ID NO: 55753 - DNA, 25 bp, Mus musculus
aagctccagtttgctcagagtcaag

SEQ ID NO: 55754 - DNA, 25 bp, Mus musculus
aagctccagtttgtagcgattccct

SEQ ID NO: 55755 - DNA, 25 bp, Mus musculus
aagctccatcctcgagattctcttg

SEQ ID NO: 55756 - DNA, 25 bp, Mus musculus
aagctccatcctggagattctcttg

SEQ ID NO: 55757 - DNA, 25 bp, Mus musculus
aagctccatctaaacctagtatgtg

SEQ ID NO: 55758 - DNA, 25 bp, Mus musculus
aagctccatctatacctagtatgtg

SEQ ID NO: 55759 - DNA, 25 bp, Mus musculus
aagctccattaacggctgttttcct

SEQ ID NO: 55760 - DNA, 25 bp, Mus musculus
aagctccattaagggctgttttcct

SEQ ID NO: 55761 - DNA, 25 bp, Mus musculus
aagctcccactgattgtggctgaag

SEQ ID NO: 55762 - DNA, 25 bp, Mus musculus
aagctcccactgtttgtggctgaag

SEQ ID NO: 55763 - DNA, 25 bp, Mus musculus
aagctcccagaacaacctaactaga

SEQ ID NO: 55764 - DNA, 25 bp, Mus musculus
aagctcccagaagaacctaactaga

SEQ ID NO: 55765 - DNA, 25 bp, Mus musculus
aagctcccagctcgccatagtgaaa

SEQ ID NO: 55766 - DNA, 25 bp, Mus musculus
aagctcccagctggccatagtgaaa

SEQ ID NO: 55767 - DNA, 25 bp, Mus musculus
aagctccccaggacgtagctatgga

SEQ ID NO: 55768 - DNA, 25 bp, Mus musculus
aagctccccaggtcgtagctatgga

SEQ ID NO: 55769 - DNA, 25 bp, Mus musculus
aagctccccatccagttagagtctg

SEQ ID NO: 55770 - DNA, 25 bp, Mus musculus
aagctccccatcgagttagagtctg

SEQ ID NO: 55771 - DNA, 25 bp, Mus musculus
aagctcccctttcctaggtacatta

SEQ ID NO: 55772 - DNA, 25 bp, Mus musculus
aagctcccctttgctaggtacatta

SEQ ID NO: 55773 - DNA, 25 bp, Mus musculus
aagctcccggacaggtggatgtacc

SEQ ID NO: 55774 - DNA, 25 bp, Mus musculus
aagctcccggactggtggatgtacc

SEQ ID NO: 55775 - DNA, 25 bp, Mus musculus
aagctcccggagactgaggaactgt

SEQ ID NO: 55776 - DNA, 25 bp, Mus musculus
aagctcccggagtctgaggaactgt

SEQ ID NO: 55777 - DNA, 25 bp, Mus musculus
aagctcccggctaacacgttgtagg

SEQ ID NO: 55778 - DNA, 25 bp, Mus musculus
aagctcccggcttacacgttgtagg

SEQ ID NO: 55779 - DNA, 25 bp, Mus musculus
aagctcccgtccaggcggaaggaag

SEQ ID NO: 55780 - DNA, 25 bp, Mus musculus
aagctcccgtcctggcggaaggaag

SEQ ID NO: 55781 - DNA, 25 bp, Mus musculus
aagctccctccactgtagtcaatgg

SEQ ID NO: 55782 - DNA, 25 bp, Mus musculus
aagctccctccagtgtagtcaatgg

SEQ ID NO: 55783 - DNA, 25 bp, Mus musculus
aagctccctttcatggctcttaata

SEQ ID NO: 55784 - DNA, 25 bp, Mus musculus
aagctccctttcttggctcttaata

SEQ ID NO: 55785 - DNA, 25 bp, Mus musculus
aagctccggaacctcatcattgagg

SEQ ID NO: 55786 - DNA, 25 bp, Mus musculus
aagctccggaacgtcatcattgagg

SEQ ID NO: 55787 - DNA, 25 bp, Mus musculus
aagctccgggcgcactccatctaaa

SEQ ID NO: 55788 - DNA, 25 bp, Mus musculus
aagctccgggcggactccatctaaa

SEQ ID NO: 55789 - DNA, 25 bp, Mus musculus
aagctccgttggagctgcaagttga

SEQ ID NO: 55790 - DNA, 25 bp, Mus musculus
aagctccgttggtgctgcaagttga

SEQ ID NO: 55791 - DNA, 25 bp, Mus musculus
aagctcctaaagaccctttgtgagg

SEQ ID NO: 55792 - DNA, 25 bp, Mus musculus
aagctcctaaagtccctttgtgagg

SEQ ID NO: 55793 - DNA, 25 bp, Mus musculus
aagctcctactactcagggcgcctt

SEQ ID NO: 55794 - DNA, 25 bp, Mus musculus
aagctcctactagtcagggcgcctt

SEQ ID NO: 55795 - DNA, 25 bp, Mus musculus
aagctcctatatattatgtttgtca

SEQ ID NO: 55796 - DNA, 25 bp, Mus musculus
aagctcctatattttatgtttgtca

SEQ ID NO: 55797 - DNA, 25 bp, Mus musculus
aagctcctcaagagagaacctggtt

SEQ ID NO: 55798 - DNA, 25 bp, Mus musculus
aagctcctcaagtgagaacctggtt

SEQ ID NO: 55799 - DNA, 25 bp, Mus musculus
aagctcctcagaatgatcagcaggt

SEQ ID NO: 55800 - DNA, 25 bp, Mus musculus
aagctcctcagattgatcagcaggt

SEQ ID NO: 55801 - DNA, 25 bp, Mus musculus
aagctcctccttaggagtcgaggcg

SEQ ID NO: 55802 - DNA, 25 bp, Mus musculus
aagctcctccttcctatatggacat

SEQ ID NO: 55803 - DNA, 25 bp, Mus musculus
aagctcctccttgctatatggacat

SEQ ID NO: 55804 - DNA, 25 bp, Mus musculus
aagctcctcctttggagtcgaggcg

SEQ ID NO: 55805 - DNA, 25 bp, Mus musculus
aagctcctctggctctcaagaatgg

SEQ ID NO: 55806 - DNA, 25 bp, Mus musculus
aagctcctctgggtctcaagaatgg

SEQ ID NO: 55807 - DNA, 25 bp, Mus musculus
aagctcctcttcatagacatctcat

SEQ ID NO: 55808 - DNA, 25 bp, Mus musculus
aagctcctcttcttagacatctcat

SEQ ID NO: 55809 - DNA, 25 bp, Mus musculus
aagctcctcttgagtggaaggttcc

SEQ ID NO: 55810 - DNA, 25 bp, Mus musculus
aagctcctcttgtgtggaaggttcc

SEQ ID NO: 55811 - DNA, 25 bp, Mus musculus
aagctcctgaggcatgctctgcaga

SEQ ID NO: 55812 - DNA, 25 bp, Mus musculus
aagctcctgagggatgctctgcaga

SEQ ID NO: 55813 - DNA, 25 bp, Mus musculus
aagctcctgatcaacaaagtttcca

SEQ ID NO: 55814 - DNA, 25 bp, Mus musculus
aagctcctgatcagagtggcatgct

SEQ ID NO: 55815 - DNA, 25 bp, Mus musculus
aagctcctgatctacaaagtttcca

SEQ ID NO: 55816 - DNA, 25 bp, Mus musculus
aagctcctgatctgagtggcatgct

SEQ ID NO: 55817 - DNA, 25 bp, Mus musculus
aagctcctgggcaacgtcctgggaa

SEQ ID NO: 55818 - DNA, 25 bp, Mus musculus
aagctcctgggctacgtcctgggaa

SEQ ID NO: 55819 - DNA, 25 bp, Mus musculus
aagctcctgtagcaagtgtctcccc

SEQ ID NO: 55820 - DNA, 25 bp, Mus musculus
aagctcctgtaggaagtgtctcccc

SEQ ID NO: 55821 - DNA, 25 bp, Mus musculus
aagctcctgttgactcttacttttg

SEQ ID NO: 55822 - DNA, 25 bp, Mus musculus
aagctcctgttgtctcttacttttg

SEQ ID NO: 55823 - DNA, 25 bp, Mus musculus
aagctccttagccaaaactctgaaa

SEQ ID NO: 55824 - DNA, 25 bp, Mus musculus
aagctccttagcgaaaactctgaaa

SEQ ID NO: 55825 - DNA, 25 bp, Mus musculus
aagctccttcaacgttaattccaga

SEQ ID NO: 55826 - DNA, 25 bp, Mus musculus
aagctccttcaaggttaattccaga

SEQ ID NO: 55827 - DNA, 25 bp, Mus musculus
aagctccttgcaagtagccactgag

SEQ ID NO: 55828 - DNA, 25 bp, Mus musculus
aagctccttgcatgtagccactgag

SEQ ID NO: 55829 - DNA, 25 bp, Mus musculus
aagctccttgtacagagtctgctct

SEQ ID NO: 55830 - DNA, 25 bp, Mus musculus
aagctccttgtagagagtctgctct

SEQ ID NO: 55831 - DNA, 25 bp, Mus musculus
aagctcctttctaatgtacttgtgc

SEQ ID NO: 55832 - DNA, 25 bp, Mus musculus
aagctcctttcttatgtacttgtgc

SEQ ID NO: 55833 - DNA, 25 bp, Mus musculus
aagctcgaagtgctgctcttgggcc

SEQ ID NO: 55834 - DNA, 25 bp, Mus musculus
aagctcgaagtggtgctcttgggcc

SEQ ID NO: 55835 - DNA, 25 bp, Mus musculus
aagctcgaccggacatttgcagtga

SEQ ID NO: 55836 - DNA, 25 bp, Mus musculus
aagctcgaccggtcatttgcagtga

SEQ ID NO: 55837 - DNA, 25 bp, Mus musculus
aagctcgaggtgctgttcttgctgc

SEQ ID NO: 55838 - DNA, 25 bp, Mus musculus
aagctcgaggtggtgttcttgctgc

SEQ ID NO: 55839 - DNA, 25 bp, Mus musculus
aagctcgagtgcatcgtgcggacgc

SEQ ID NO: 55840 - DNA, 25 bp, Mus musculus
aagctcgagtgcttcgtgcggacgc

SEQ ID NO: 55841 - DNA, 25 bp, Mus musculus
aagctcgatatgctggtgacatcat

SEQ ID NO: 55842 - DNA, 25 bp, Mus musculus
aagctcgatatggtggtgacatcat

SEQ ID NO: 55843 - DNA, 25 bp, Mus musculus
aagctcgcaccgaggcgcccaggag

SEQ ID NO: 55844 - DNA, 25 bp, Mus musculus
aagctcgcaccgtggcgcccaggag

SEQ ID NO: 55845 - DNA, 25 bp, Mus musculus
aagctcgctgggaggaggcctccaa

SEQ ID NO: 55846 - DNA, 25 bp, Mus musculus
aagctcgctgggtggaggcctccaa

SEQ ID NO: 55847 - DNA, 25 bp, Mus musculus
aagctcgctgttatcaaagtctgac

SEQ ID NO: 55848 - DNA, 25 bp, Mus musculus
aagctcgctgttttcaaagtctgac

SEQ ID NO: 55849 - DNA, 25 bp, Mus musculus
aagctcggacgcacggagcatccta

SEQ ID NO: 55850 - DNA, 25 bp, Mus musculus
aagctcggacgctcggagcatccta

SEQ ID NO: 55851 - DNA, 25 bp, Mus musculus
aagctcggcaagactgtggtagcca

SEQ ID NO: 55852 - DNA, 25 bp, Mus musculus
aagctcggcaagtctgtggtagcca

SEQ ID NO: 55853 - DNA, 25 bp, Mus musculus
aagctcggccagctcatgtttggat

SEQ ID NO: 55854 - DNA, 25 bp, Mus musculus
aagctcggccaggtcatgtttggat

SEQ ID NO: 55855 - DNA, 25 bp, Mus musculus
aagctcgggaagaggctggctggct

SEQ ID NO: 55856 - DNA, 25 bp, Mus musculus
aagctcgggaagtggctggctggct

SEQ ID NO: 55857 - DNA, 25 bp, Mus musculus
aagctcgggccgatttcagagacaa

SEQ ID NO: 55858 - DNA, 25 bp, Mus musculus
aagctcgggccgttttcagagacaa

SEQ ID NO: 55859 - DNA, 25 bp, Mus musculus
aagctcggtaaaattctgtttgtag

SEQ ID NO: 55860 - DNA, 25 bp, Mus musculus
aagctcggtaaatttctgtttgtag

SEQ ID NO: 55861 - DNA, 25 bp, Mus musculus
aagctcggtactcccatctaggaaa

SEQ ID NO: 55862 - DNA, 25 bp, Mus musculus
aagctcggtactgccatctaggaaa

SEQ ID NO: 55863 - DNA, 25 bp, Mus musculus
aagctcgtggccagtgtgagtcaag

SEQ ID NO: 55864 - DNA, 25 bp, Mus musculus
aagctcgtggcctgtgtgagtcaag

SEQ ID NO: 55865 - DNA, 25 bp, Mus musculus
aagctcgttgtgctggcacatacat

SEQ ID NO: 55866 - DNA, 25 bp, Mus musculus
aagctcgttgtggtggcacatacat

SEQ ID NO: 55867 - DNA, 25 bp, Mus musculus
aagctcgtttaaatacagtcaagga

SEQ ID NO: 55868 - DNA, 25 bp, Mus musculus
aagctcgtttaattacagtcaagga

SEQ ID NO: 55869 - DNA, 25 bp, Mus musculus
aagctctaaagaaccatgtctcctc

SEQ ID NO: 55870 - DNA, 25 bp, Mus musculus
aagctctaaagatccatgtctcctc

SEQ ID NO: 55871 - DNA, 25 bp, Mus musculus
aagctctaacgaaatggccacggtt

SEQ ID NO: 55872 - DNA, 25 bp, Mus musculus
aagctctaacgatatggccacggtt

SEQ ID NO: 55873 - DNA, 25 bp, Mus musculus
aagctctaccataaacagcgccatg

SEQ ID NO: 55874 - DNA, 25 bp, Mus musculus
aagctctaccattaacagcgccatg

SEQ ID NO: 55875 - DNA, 25 bp, Mus musculus
aagctctacctcctgtttctgctat

SEQ ID NO: 55876 - DNA, 25 bp, Mus musculus
aagctctacctcgtgtttctgctat

SEQ ID NO: 55877 - DNA, 25 bp, Mus musculus
aagctctacgaacctctccagaagc

SEQ ID NO: 55878 - DNA, 25 bp, Mus musculus
aagctctacgaagctctccagaagc

SEQ ID NO: 55879 - DNA, 25 bp, Mus musculus
aagctctacggcaagccagcaaagt

SEQ ID NO: 55880 - DNA, 25 bp, Mus musculus
aagctctacggctagccagcaaagt

SEQ ID NO: 55881 - DNA, 25 bp, Mus musculus
aagctctagagccatgtgacttcat

SEQ ID NO: 55882 - DNA, 25 bp, Mus musculus
aagctctagagcgatgtgacttcat

SEQ ID NO: 55883 - DNA, 25 bp, Mus musculus
aagctctagtaacacatggacccat

SEQ ID NO: 55884 - DNA, 25 bp, Mus musculus
aagctctagtaagacatggacccat

SEQ ID NO: 55885 - DNA, 25 bp, Mus musculus
aagctctatataccttgtgacagag

SEQ ID NO: 55886 - DNA, 25 bp, Mus musculus
aagctctatatagcttgtgacagag

SEQ ID NO: 55887 - DNA, 25 bp, Mus musculus
aagctctatgagattgtcgacagtt

SEQ ID NO: 55888 - DNA, 25 bp, Mus musculus
aagctctatgagtttgtcgacagtt

SEQ ID NO: 55889 - DNA, 25 bp, Mus musculus
aagctctatgccaacatgtttgaga

SEQ ID NO: 55890 - DNA, 25 bp, Mus musculus
aagctctatgccactcttggagcaa

SEQ ID NO: 55891 - DNA, 25 bp, Mus musculus
aagctctatgcctacatgtttgaga

SEQ ID NO: 55892 - DNA, 25 bp, Mus musculus
aagctctatgcctctcttggagcaa

SEQ ID NO: 55893 - DNA, 25 bp, Mus musculus
aagctctcaagaagtgcccagctgg

SEQ ID NO: 55894 - DNA, 25 bp, Mus musculus
aagctctcaagatgtgcccagctgg

SEQ ID NO: 55895 - DNA, 25 bp, Mus musculus
aagctctcacaaatgtgtcccacag

SEQ ID NO: 55896 - DNA, 25 bp, Mus musculus
aagctctcacaattgtgtcccacag

SEQ ID NO: 55897 - DNA, 25 bp, Mus musculus
aagctctcacctctgaatgtctgga

SEQ ID NO: 55898 - DNA, 25 bp, Mus musculus
aagctctcacctgtgaatgtctgga

SEQ ID NO: 55899 - DNA, 25 bp, Mus musculus
aagctctcactcagcccgagtcgga

SEQ ID NO: 55900 - DNA, 25 bp, Mus musculus
aagctctcactctgcccgagtcgga

SEQ ID NO: 55901 - DNA, 25 bp, Mus musculus
aagctctcagatatcagatcctgca

SEQ ID NO: 55902 - DNA, 25 bp, Mus musculus
aagctctcagatttcagatcctgca

SEQ ID NO: 55903 - DNA, 25 bp, Mus musculus
aagctctcagccagcaaatggacct

SEQ ID NO: 55904 - DNA, 25 bp, Mus musculus
aagctctcagcctgcaaatggacct

SEQ ID NO: 55905 - DNA, 25 bp, Mus musculus
aagctctcagctaaatctgcatcca

SEQ ID NO: 55906 - DNA, 25 bp, Mus musculus
aagctctcagcttaatctgcatcca

SEQ ID NO: 55907 - DNA, 25 bp, Mus musculus
aagctctcatttacagttccaggtt

SEQ ID NO: 55908 - DNA, 25 bp, Mus musculus
aagctctcattttcagttccaggtt

SEQ ID NO: 55909 - DNA, 25 bp, Mus musculus
aagctctccagcaaaatgacctgtc

SEQ ID NO: 55910 - DNA, 25 bp, Mus musculus
aagctctccagctaaatgacctgtc

SEQ ID NO: 55911 - DNA, 25 bp, Mus musculus
aagctctcccatactgaataccgaa

SEQ ID NO: 55912 - DNA, 25 bp, Mus musculus
aagctctcccattctgaataccgaa

SEQ ID NO: 55913 - DNA, 25 bp, Mus musculus
aagctctcggagctagatgaccgcg

SEQ ID NO: 55914 - DNA, 25 bp, Mus musculus
aagctctcggaggtagatgaccgcg

SEQ ID NO: 55915 - DNA, 25 bp, Mus musculus
aagctctctaaacttagtctctctc

SEQ ID NO: 55916 - DNA, 25 bp, Mus musculus
aagctctctaaagttagtctctctc

SEQ ID NO: 55917 - DNA, 25 bp, Mus musculus
aagctctctagccatcgtggtagtg

SEQ ID NO: 55918 - DNA, 25 bp, Mus musculus
aagctctctagcgatcgtggtagtg

SEQ ID NO: 55919 - DNA, 25 bp, Mus musculus
aagctctctctgacttaggccaacc

SEQ ID NO: 55920 - DNA, 25 bp, Mus musculus
aagctctctctgtcttaggccaacc

SEQ ID NO: 55921 - DNA, 25 bp, Mus musculus
aagctctctgaaccctggtataatg

SEQ ID NO: 55922 - DNA, 25 bp, Mus musculus
aagctctctgaagcctggtataatg

SEQ ID NO: 55923 - DNA, 25 bp, Mus musculus
aagctctctgagagcaggcacctgt

SEQ ID NO: 55924 - DNA, 25 bp, Mus musculus
aagctctctgagtgcaggcacctgt

SEQ ID NO: 55925 - DNA, 25 bp, Mus musculus
aagctctctggcaggtgccctggga

SEQ ID NO: 55926 - DNA, 25 bp, Mus musculus
aagctctctggctggtgccctggga

SEQ ID NO: 55927 - DNA, 25 bp, Mus musculus
aagctctctgtccaattccattttg

SEQ ID NO: 55928 - DNA, 25 bp, Mus musculus
aagctctctgtcgaattccattttg

SEQ ID NO: 55929 - DNA, 25 bp, Mus musculus
aagctctctttcctttagtgctgtc

SEQ ID NO: 55930 - DNA, 25 bp, Mus musculus
aagctctctttcgtttagtgctgtc

SEQ ID NO: 55931 - DNA, 25 bp, Mus musculus
aagctctgaaggctgcttaccccta

SEQ ID NO: 55932 - DNA, 25 bp, Mus musculus
aagctctgaagggtgcttaccccta

SEQ ID NO: 55933 - DNA, 25 bp, Mus musculus
aagctctgaataactgacttcctat

SEQ ID NO: 55934 - DNA, 25 bp, Mus musculus
aagctctgaatatctgacttcctat

SEQ ID NO: 55935 - DNA, 25 bp, Mus musculus
aagctctgaattactcctttgtgca

SEQ ID NO: 55936 - DNA, 25 bp, Mus musculus
aagctctgaatttctcctttgtgca

SEQ ID NO: 55937 - DNA, 25 bp, Mus musculus
aagctctgaccaaaattctgtattt

SEQ ID NO: 55938 - DNA, 25 bp, Mus musculus
aagctctgaccataattctgtattt

SEQ ID NO: 55939 - DNA, 25 bp, Mus musculus
aagctctgagcaccgtgagtttgat

SEQ ID NO: 55940 - DNA, 25 bp, Mus musculus
aagctctgagcagcgtgagtttgat

SEQ ID NO: 55941 - DNA, 25 bp, Mus musculus
aagctctgagcgagatcgaggttct

SEQ ID NO: 55942 - DNA, 25 bp, Mus musculus
aagctctgagcgctttctttttctt

SEQ ID NO: 55943 - DNA, 25 bp, Mus musculus
aagctctgagcggtttctttttctt

SEQ ID NO: 55944 - DNA, 25 bp, Mus musculus
aagctctgagcgtgatcgaggttct

SEQ ID NO: 55945 - DNA, 25 bp, Mus musculus
aagctctgagtgatctattctccta

SEQ ID NO: 55946 - DNA, 25 bp, Mus musculus
aagctctgagtgttctattctccta

SEQ ID NO: 55947 - DNA, 25 bp, Mus musculus
aagctctgatagatgcctgcctgga

SEQ ID NO: 55948 - DNA, 25 bp, Mus musculus
aagctctgatagttgcctgcctgga

SEQ ID NO: 55949 - DNA, 25 bp, Mus musculus
aagctctgatccagggcatctacaa

SEQ ID NO: 55950 - DNA, 25 bp, Mus musculus
aagctctgatcctgggcatctacaa

SEQ ID NO: 55951 - DNA, 25 bp, Mus musculus
aagctctgatggactatctcttgtt

SEQ ID NO: 55952 - DNA, 25 bp, Mus musculus
aagctctgatggtctatctcttgtt

SEQ ID NO: 55953 - DNA, 25 bp, Mus musculus
aagctctgattcaatataaaatatc

SEQ ID NO: 55954 - DNA, 25 bp, Mus musculus
aagctctgattctatataaaatatc

SEQ ID NO: 55955 - DNA, 25 bp, Mus musculus
aagctctgcgctatgtagcagccgg

SEQ ID NO: 55956 - DNA, 25 bp, Mus musculus
aagctctgcgctttgtagcagccgg

SEQ ID NO: 55957 - DNA, 25 bp, Mus musculus
aagctctgctctctggatttagtgc

SEQ ID NO: 55958 - DNA, 25 bp, Mus musculus
aagctctgctctgtggatttagtgc

SEQ ID NO: 55959 - DNA, 25 bp, Mus musculus
aagctctgctgcattttgaagggca

SEQ ID NO: 55960 - DNA, 25 bp, Mus musculus
aagctctgctgctttttgaagggca

SEQ ID NO: 55961 - DNA, 25 bp, Mus musculus
aagctctgctggcttcttgaactgt

SEQ ID NO: 55962 - DNA, 25 bp, Mus musculus
aagctctgctgggttcttgaactgt

SEQ ID NO: 55963 - DNA, 25 bp, Mus musculus
aagctctggaatatacctccacatc

SEQ ID NO: 55964 - DNA, 25 bp, Mus musculus
aagctctggaatttacctccacatc

SEQ ID NO: 55965 - DNA, 25 bp, Mus musculus
aagctctggacaaggtcctgctggc

SEQ ID NO: 55966 - DNA, 25 bp, Mus musculus
aagctctggacatggtcctgctggc

SEQ ID NO: 55967 - DNA, 25 bp, Mus musculus
aagctctggcgacaggtagcacgta

SEQ ID NO: 55968 - DNA, 25 bp, Mus musculus
aagctctggcgagaggtagcacgta

SEQ ID NO: 55969 - DNA, 25 bp, Mus musculus
aagctctgggccatctgccaagaga

SEQ ID NO: 55970 - DNA, 25 bp, Mus musculus
aagctctgggccttctgccaagaga

SEQ ID NO: 55971 - DNA, 25 bp, Mus musculus
aagctctgggtacatgcctgctctg

SEQ ID NO: 55972 - DNA, 25 bp, Mus musculus
aagctctgggtagatgcctgctctg

SEQ ID NO: 55973 - DNA, 25 bp, Mus musculus
aagctctggtttatgaagcctcgta

SEQ ID NO: 55974 - DNA, 25 bp, Mus musculus
aagctctggtttttgaagcctcgta

SEQ ID NO: 55975 - DNA, 25 bp, Mus musculus
aagctctgtcacaagtatcgtggcg

SEQ ID NO: 55976 - DNA, 25 bp, Mus musculus
aagctctgtcactagtatcgtggcg

SEQ ID NO: 55977 - DNA, 25 bp, Mus musculus
aagctctgtgccaggagggctctaa

SEQ ID NO: 55978 - DNA, 25 bp, Mus musculus
aagctctgtgcctggagggctctaa

SEQ ID NO: 55979 - DNA, 25 bp, Mus musculus
aagctctgtgctagtactgttacca

SEQ ID NO: 55980 - DNA, 25 bp, Mus musculus
aagctctgtgctattccaacatggg

SEQ ID NO: 55981 - DNA, 25 bp, Mus musculus
aagctctgtgctctctatgggaagt

SEQ ID NO: 55982 - DNA, 25 bp, Mus musculus
aagctctgtgctgtctatgggaagt

SEQ ID NO: 55983 - DNA, 25 bp, Mus musculus
aagctctgtgcttgtactgttacca

SEQ ID NO: 55984 - DNA, 25 bp, Mus musculus
aagctctgtgcttttccaacatggg

SEQ ID NO: 55985 - DNA, 25 bp, Mus musculus
aagctctgtgtcatcctaaatgtaa

SEQ ID NO: 55986 - DNA, 25 bp, Mus musculus
aagctctgtgtcttcctaaatgtaa

SEQ ID NO: 55987 - DNA, 25 bp, Mus musculus
aagctctgtgtgactgggtctgcct

SEQ ID NO: 55988 - DNA, 25 bp, Mus musculus
aagctctgtgtgtctgggtctgcct

SEQ ID NO: 55989 - DNA, 25 bp, Mus musculus
aagctctgttgaattccctgaatcc

SEQ ID NO: 55990 - DNA, 25 bp, Mus musculus
aagctctgttgatttccctgaatcc

SEQ ID NO: 55991 - DNA, 25 bp, Mus musculus
aagctctgttgtagccgtcattggc

SEQ ID NO: 55992 - DNA, 25 bp, Mus musculus
aagctctgttgttgccgtcattggc

SEQ ID NO: 55993 - DNA, 25 bp, Mus musculus
aagctctgtttcagaacttccaggg

SEQ ID NO: 55994 - DNA, 25 bp, Mus musculus
aagctctgtttctgaacttccaggg

SEQ ID NO: 55995 - DNA, 25 bp, Mus musculus
aagctctgtttgacactaatgtctc

SEQ ID NO: 55996 - DNA, 25 bp, Mus musculus
aagctctgtttgtcactaatgtctc

SEQ ID NO: 55997 - DNA, 25 bp, Mus musculus
aagctcttaactattgacacctctc

SEQ ID NO: 55998 - DNA, 25 bp, Mus musculus
aagctcttaacttttgacacctctc

SEQ ID NO: 55999 - DNA, 25 bp, Mus musculus
aagctcttaagaagtgttcagtaat

SEQ ID NO: 56000 - DNA, 25 bp, Mus musculus
aagctcttaagatgtgttcagtaat

SEQ ID NO: 56001 - DNA, 25 bp, Mus musculus
aagctcttacagctggttcatcgat

SEQ ID NO: 56002 - DNA, 25 bp, Mus musculus
aagctcttacaggtggttcatcgat

SEQ ID NO: 56003 - DNA, 25 bp, Mus musculus
aagctcttacatccagaacctcaga

SEQ ID NO: 56004 - DNA, 25 bp, Mus musculus
aagctcttacatgcagaacctcaga

SEQ ID NO: 56005 - DNA, 25 bp, Mus musculus
aagctcttaggaattgtgtccatac

SEQ ID NO: 56006 - DNA, 25 bp, Mus musculus
aagctcttaggatttgtgtccatac

SEQ ID NO: 56007 - DNA, 25 bp, Mus musculus
aagctcttatggctgttgagacctt

SEQ ID NO: 56008 - DNA, 25 bp, Mus musculus
aagctcttatgggtgttgagacctt

SEQ ID NO: 56009 - DNA, 25 bp, Mus musculus
aagctcttattaccagctctagaga

SEQ ID NO: 56010 - DNA, 25 bp, Mus musculus
aagctcttattagcagctctagaga

SEQ ID NO: 56011 - DNA, 25 bp, Mus musculus
aagctcttcaagcttgcaggcttct

SEQ ID NO: 56012 - DNA, 25 bp, Mus musculus
aagctcttcaaggttgcaggcttct

SEQ ID NO: 56013 - DNA, 25 bp, Mus musculus
aagctcttcacaccctgatttagat

SEQ ID NO: 56014 - DNA, 25 bp, Mus musculus
aagctcttcacacgttcaagtcacg

SEQ ID NO: 56015 - DNA, 25 bp, Mus musculus
aagctcttcacagcctgatttagat

SEQ ID NO: 56016 - DNA, 25 bp, Mus musculus
aagctcttcacaggttcaagtcacg

SEQ ID NO: 56017 - DNA, 25 bp, Mus musculus
aagctcttcagccaactacacaaga

SEQ ID NO: 56018 - DNA, 25 bp, Mus musculus
aagctcttcagcgaactacacaaga

SEQ ID NO: 56019 - DNA, 25 bp, Mus musculus
aagctcttcaggcttgcctccatag

SEQ ID NO: 56020 - DNA, 25 bp, Mus musculus
aagctcttcagggttgcctccatag

SEQ ID NO: 56021 - DNA, 25 bp, Mus musculus
aagctcttcataatgcaagttgtag

SEQ ID NO: 56022 - DNA, 25 bp, Mus musculus
aagctcttcataatgtggctcgtcg

SEQ ID NO: 56023 - DNA, 25 bp, Mus musculus
aagctcttcatattgcaagttgtag

SEQ ID NO: 56024 - DNA, 25 bp, Mus musculus
aagctcttcatattgtggctcgtcg

SEQ ID NO: 56025 - DNA, 25 bp, Mus musculus
aagctcttcgctaggaatctacaga

SEQ ID NO: 56026 - DNA, 25 bp, Mus musculus
aagctcttcgcttggaatctacaga

SEQ ID NO: 56027 - DNA, 25 bp, Mus musculus
aagctcttcggtctgcctttcttta

SEQ ID NO: 56028 - DNA, 25 bp, Mus musculus
aagctcttcggtgtgcctttcttta

SEQ ID NO: 56029 - DNA, 25 bp, Mus musculus
aagctcttcgttatatatccacata

SEQ ID NO: 56030 - DNA, 25 bp, Mus musculus
aagctcttcgttttatatccacata

SEQ ID NO: 56031 - DNA, 25 bp, Mus musculus
aagctcttctctcacctccgggaga

SEQ ID NO: 56032 - DNA, 25 bp, Mus musculus
aagctcttctctgacctccgggaga

SEQ ID NO: 56033 - DNA, 25 bp, Mus musculus
aagctcttctgcacgagtttactca

SEQ ID NO: 56034 - DNA, 25 bp, Mus musculus
aagctcttctgctcgagtttactca

SEQ ID NO: 56035 - DNA, 25 bp, Mus musculus
aagctcttctgtatgaatttcacca

SEQ ID NO: 56036 - DNA, 25 bp, Mus musculus
aagctcttctgtttgaatttcacca

SEQ ID NO: 56037 - DNA, 25 bp, Mus musculus
aagctcttcttacacttcttagtca

SEQ ID NO: 56038 - DNA, 25 bp, Mus musculus
aagctcttcttagacttcttagtca

SEQ ID NO: 56039 - DNA, 25 bp, Mus musculus
aagctcttgctgatcatttgaagtg

SEQ ID NO: 56040 - DNA, 25 bp, Mus musculus
aagctcttgctgttcatttgaagtg

SEQ ID NO: 56041 - DNA, 25 bp, Mus musculus
aagctcttgcttcaggtgtctgaca

SEQ ID NO: 56042 - DNA, 25 bp, Mus musculus
aagctcttgcttgaggtgtctgaca

SEQ ID NO: 56043 - DNA, 25 bp, Mus musculus
aagctcttggaacctcctctaggaa

SEQ ID NO: 56044 - DNA, 25 bp, Mus musculus
aagctcttggaagctcctctaggaa

SEQ ID NO: 56045 - DNA, 25 bp, Mus musculus
aagctcttgtctcaggttagcccaa

SEQ ID NO: 56046 - DNA, 25 bp, Mus musculus
aagctcttgtctgaggttagcccaa

SEQ ID NO: 56047 - DNA, 25 bp, Mus musculus
aagctctttcttccctcaggaatag

SEQ ID NO: 56048 - DNA, 25 bp, Mus musculus
aagctctttcttgcctcaggaatag

SEQ ID NO: 56049 - DNA, 25 bp, Mus musculus
aagctctttgatccctgattgaggg

SEQ ID NO: 56050 - DNA, 25 bp, Mus musculus
aagctctttgatgcctgattgaggg

SEQ ID NO: 56051 - DNA, 25 bp, Mus musculus
aagctctttggcagtttgcacacat

SEQ ID NO: 56052 - DNA, 25 bp, Mus musculus
aagctctttggccttagtgccattt

SEQ ID NO: 56053 - DNA, 25 bp, Mus musculus
aagctctttggcgttagtgccattt

SEQ ID NO: 56054 - DNA, 25 bp, Mus musculus
aagctctttggctgtttgcacacat

SEQ ID NO: 56055 - DNA, 25 bp, Mus musculus
aagctcttttaaatggtgacagatc

SEQ ID NO: 56056 - DNA, 25 bp, Mus musculus
aagctcttttaattggtgacagatc

SEQ ID NO: 56057 - DNA, 25 bp, Mus musculus
aagctcttttcacagtagttctcct

SEQ ID NO: 56058 - DNA, 25 bp, Mus musculus
aagctcttttcagagtagttctcct

SEQ ID NO: 56059 - DNA, 25 bp, Mus musculus
aagctgaaacagagggcccctgctc

SEQ ID NO: 56060 - DNA, 25 bp, Mus musculus
aagctgaaacagtgggcccctgctc

SEQ ID NO: 56061 - DNA, 25 bp, Mus musculus
aagctgaaaccactgggtcctccaa

SEQ ID NO: 56062 - DNA, 25 bp, Mus musculus
aagctgaaaccagtgggtcctccaa

SEQ ID NO: 56063 - DNA, 25 bp, Mus musculus
aagctgaaagagaccatcccgctga

SEQ ID NO: 56064 - DNA, 25 bp, Mus musculus
aagctgaaagagtccatcccgctga

SEQ ID NO: 56065 - DNA, 25 bp, Mus musculus
aagctgaaagcgcaaaaggctccta

SEQ ID NO: 56066 - DNA, 25 bp, Mus musculus
aagctgaaagcggaaaaggctccta

SEQ ID NO: 56067 - DNA, 25 bp, Mus musculus
aagctgaaagtaagcctatgatttt

SEQ ID NO: 56068 - DNA, 25 bp, Mus musculus
aagctgaaagtatgcctatgatttt

SEQ ID NO: 56069 - DNA, 25 bp, Mus musculus
aagctgaaatgtacctttggtaagg

SEQ ID NO: 56070 - DNA, 25 bp, Mus musculus
aagctgaaatgttcctttggtaagg

SEQ ID NO: 56071 - DNA, 25 bp, Mus musculus
aagctgaacttcacagagctccaag

SEQ ID NO: 56072 - DNA, 25 bp, Mus musculus
aagctgaacttctcagagctccaag

SEQ ID NO: 56073 - DNA, 25 bp, Mus musculus
aagctgaacttgcagccccagccaa

SEQ ID NO: 56074 - DNA, 25 bp, Mus musculus
aagctgaacttggagccccagccaa

SEQ ID NO: 56075 - DNA, 25 bp, Mus musculus
aagctgaagattaacgttttggcaa

SEQ ID NO: 56076 - DNA, 25 bp, Mus musculus
aagctgaagatttacgttttggcaa

SEQ ID NO: 56077 - DNA, 25 bp, Mus musculus
aagctgaagctcagatccaggcact

SEQ ID NO: 56078 - DNA, 25 bp, Mus musculus
aagctgaagctctgatccaggcact

SEQ ID NO: 56079 - DNA, 25 bp, Mus musculus
aagctgaaggcacgagccatccctt

SEQ ID NO: 56080 - DNA, 25 bp, Mus musculus
aagctgaaggcaggagccatccctt

SEQ ID NO: 56081 - DNA, 25 bp, Mus musculus
aagctgaaggctctggtgccgtttc

SEQ ID NO: 56082 - DNA, 25 bp, Mus musculus
aagctgaaggctgtggtgccgtttc

SEQ ID NO: 56083 - DNA, 25 bp, Mus musculus
aagctgaagttcaccaaggcaaatg

SEQ ID NO: 56084 - DNA, 25 bp, Mus musculus
aagctgaagttctccaaggcaaatg

SEQ ID NO: 56085 - DNA, 25 bp, Mus musculus
aagctgaatcagcaggtttgcaatc

SEQ ID NO: 56086 - DNA, 25 bp, Mus musculus
aagctgaatcaggaggtttgcaatc

SEQ ID NO: 56087 - DNA, 25 bp, Mus musculus
aagctgaatccacgtgccactgtga

SEQ ID NO: 56088 - DNA, 25 bp, Mus musculus
aagctgaatccaggtgccactgtga

SEQ ID NO: 56089 - DNA, 25 bp, Mus musculus
aagctgaattctccattaagaagag

SEQ ID NO: 56090 - DNA, 25 bp, Mus musculus
aagctgaattctgcattaagaagag

SEQ ID NO: 56091 - DNA, 25 bp, Mus musculus
aagctgacaagcatccctgatttgt

SEQ ID NO: 56092 - DNA, 25 bp, Mus musculus
aagctgacaagcttccctgatttgt

SEQ ID NO: 56093 - DNA, 25 bp, Mus musculus
aagctgacactgaagattgttgtga

SEQ ID NO: 56094 - DNA, 25 bp, Mus musculus
aagctgacactgtagattgttgtga

SEQ ID NO: 56095 - DNA, 25 bp, Mus musculus
aagctgacagtcattgctgagcaaa

SEQ ID NO: 56096 - DNA, 25 bp, Mus musculus
aagctgacagtctttgctgagcaaa

SEQ ID NO: 56097 - DNA, 25 bp, Mus musculus
aagctgacatagagtgatttgccat

SEQ ID NO: 56098 - DNA, 25 bp, Mus musculus
aagctgacatagcacattcttggca

SEQ ID NO: 56099 - DNA, 25 bp, Mus musculus
aagctgacataggacattcttggca

SEQ ID NO: 56100 - DNA, 25 bp, Mus musculus
aagctgacatagtgtgatttgccat

SEQ ID NO: 56101 - DNA, 25 bp, Mus musculus
aagctgacatctactcttttggaat

SEQ ID NO: 56102 - DNA, 25 bp, Mus musculus
aagctgacatcttctcttttggaat

SEQ ID NO: 56103 - DNA, 25 bp, Mus musculus
aagctgaccactacaaggttgcggt

SEQ ID NO: 56104 - DNA, 25 bp, Mus musculus
aagctgaccacttcaaggttgcggt

SEQ ID NO: 56105 - DNA, 25 bp, Mus musculus
aagctgaccagcactgttccttgca

SEQ ID NO: 56106 - DNA, 25 bp, Mus musculus
aagctgaccagcatcaaattctctg

SEQ ID NO: 56107 - DNA, 25 bp, Mus musculus
aagctgaccagctctgttccttgca

SEQ ID NO: 56108 - DNA, 25 bp, Mus musculus
aagctgaccagcttcaaattctctg

SEQ ID NO: 56109 - DNA, 25 bp, Mus musculus
aagctgaccccactaagagacctca

SEQ ID NO: 56110 - DNA, 25 bp, Mus musculus
aagctgaccccagtaagagacctca

SEQ ID NO: 56111 - DNA, 25 bp, Mus musculus
aagctgacccggacctcggaggaat

SEQ ID NO: 56112 - DNA, 25 bp, Mus musculus
aagctgacccggtcctcggaggaat

SEQ ID NO: 56113 - DNA, 25 bp, Mus musculus
aagctgaccttaagccttatcctta

SEQ ID NO: 56114 - DNA, 25 bp, Mus musculus
aagctgaccttaagttacctatctg

SEQ ID NO: 56115 - DNA, 25 bp, Mus musculus
aagctgaccttatgccttatcctta

SEQ ID NO: 56116 - DNA, 25 bp, Mus musculus
aagctgaccttatgttacctatctg

SEQ ID NO: 56117 - DNA, 25 bp, Mus musculus
aagctgacgactccagacactccgt

SEQ ID NO: 56118 - DNA, 25 bp, Mus musculus
aagctgacgactgcagacactccgt

SEQ ID NO: 56119 - DNA, 25 bp, Mus musculus
aagctgacgcctcaggattcgcctg

SEQ ID NO: 56120 - DNA, 25 bp, Mus musculus
aagctgacgcctgaggattcgcctg

SEQ ID NO: 56121 - DNA, 25 bp, Mus musculus
aagctgacgtggaactaactgtgca

SEQ ID NO: 56122 - DNA, 25 bp, Mus musculus
aagctgacgtggtactaactgtgca

SEQ ID NO: 56123 - DNA, 25 bp, Mus musculus
aagctgactagcatgttctgtgaat

SEQ ID NO: 56124 - DNA, 25 bp, Mus musculus
aagctgactagcttgttctgtgaat

SEQ ID NO: 56125 - DNA, 25 bp, Mus musculus
aagctgactcagctgagctatgagc

SEQ ID NO: 56126 - DNA, 25 bp, Mus musculus
aagctgactcaggtgagctatgagc

SEQ ID NO: 56127 - DNA, 25 bp, Mus musculus
aagctgactccccatgagggttgga

SEQ ID NO: 56128 - DNA, 25 bp, Mus musculus
aagctgactcccgatgagggttgga

SEQ ID NO: 56129 - DNA, 25 bp, Mus musculus
aagctgactcgtcctcattaactgt

SEQ ID NO: 56130 - DNA, 25 bp, Mus musculus
aagctgactcgtgctcattaactgt

SEQ ID NO: 56131 - DNA, 25 bp, Mus musculus
aagctgactgcgaaggcagcaggat

SEQ ID NO: 56132 - DNA, 25 bp, Mus musculus
aagctgactgcgtaggcagcaggat

SEQ ID NO: 56133 - DNA, 25 bp, Mus musculus
aagctgactggcacagcctgcgtgg

SEQ ID NO: 56134 - DNA, 25 bp, Mus musculus
aagctgactggctcagcctgcgtgg

SEQ ID NO: 56135 - DNA, 25 bp, Mus musculus
aagctgacttgaattgttgtgagca

SEQ ID NO: 56136 - DNA, 25 bp, Mus musculus
aagctgacttgatttgttgtgagca

SEQ ID NO: 56137 - DNA, 25 bp, Mus musculus
aagctgactttacagcctggcatga

SEQ ID NO: 56138 - DNA, 25 bp, Mus musculus
aagctgactttagagcctggcatga

SEQ ID NO: 56139 - DNA, 25 bp, Mus musculus
aagctgagacagcacactggatgat

SEQ ID NO: 56140 - DNA, 25 bp, Mus musculus
aagctgagacagctgctgctattag

SEQ ID NO: 56141 - DNA, 25 bp, Mus musculus
aagctgagacaggacactggatgat

SEQ ID NO: 56142 - DNA, 25 bp, Mus musculus
aagctgagacaggtgctgctattag

SEQ ID NO: 56143 - DNA, 25 bp, Mus musculus
aagctgagagataggcggagatcta

SEQ ID NO: 56144 - DNA, 25 bp, Mus musculus
aagctgagagattggcggagatcta

SEQ ID NO: 56145 - DNA, 25 bp, Mus musculus
aagctgagataacccttgtctacat

SEQ ID NO: 56146 - DNA, 25 bp, Mus musculus
aagctgagataagccttgtctacat

SEQ ID NO: 56147 - DNA, 25 bp, Mus musculus
aagctgagcattctgccattggcac

SEQ ID NO: 56148 - DNA, 25 bp, Mus musculus
aagctgagcattgtgccattggcac

SEQ ID NO: 56149 - DNA, 25 bp, Mus musculus
aagctgagccacattgagctccaaa

SEQ ID NO: 56150 - DNA, 25 bp, Mus musculus
aagctgagccactttgagctccaaa

SEQ ID NO: 56151 - DNA, 25 bp, Mus musculus
aagctgagccagctcaagctgcatt

SEQ ID NO: 56152 - DNA, 25 bp, Mus musculus
aagctgagccaggtcaagctgcatt

SEQ ID NO: 56153 - DNA, 25 bp, Mus musculus
aagctgagccgcagactagcaatgc

SEQ ID NO: 56154 - DNA, 25 bp, Mus musculus
aagctgagccgctgactagcaatgc

SEQ ID NO: 56155 - DNA, 25 bp, Mus musculus
aagctgagcgagagtctccggcgaa

SEQ ID NO: 56156 - DNA, 25 bp, Mus musculus
aagctgagcgagtgtctccggcgaa

SEQ ID NO: 56157 - DNA, 25 bp, Mus musculus
aagctgagcgctacaaagctcggct

SEQ ID NO: 56158 - DNA, 25 bp, Mus musculus
aagctgagcgcttcaaagctcggct

SEQ ID NO: 56159 - DNA, 25 bp, Mus musculus
aagctgagctacaggcttcattcct

SEQ ID NO: 56160 - DNA, 25 bp, Mus musculus
aagctgagctacctggtgtgaagac

SEQ ID NO: 56161 - DNA, 25 bp, Mus musculus
aagctgagctacgtggtgtgaagac

SEQ ID NO: 56162 - DNA, 25 bp, Mus musculus
aagctgagctactggcttcattcct

SEQ ID NO: 56163 - DNA, 25 bp, Mus musculus
aagctgagctctaccatatatgcca

SEQ ID NO: 56164 - DNA, 25 bp, Mus musculus
aagctgagctcttccatatatgcca

SEQ ID NO: 56165 - DNA, 25 bp, Mus musculus
aagctgagctgcaggttcaaatgga

SEQ ID NO: 56166 - DNA, 25 bp, Mus musculus
aagctgagctgctggttcaaatgga

SEQ ID NO: 56167 - DNA, 25 bp, Mus musculus
aagctgagcttgaccgaatcaaaga

SEQ ID NO: 56168 - DNA, 25 bp, Mus musculus
aagctgagcttgtccgaatcaaaga

SEQ ID NO: 56169 - DNA, 25 bp, Mus musculus
aagctgaggaaccaccgaaagtgtt

SEQ ID NO: 56170 - DNA, 25 bp, Mus musculus
aagctgaggaacgaccgaaagtgtt

SEQ ID NO: 56171 - DNA, 25 bp, Mus musculus
aagctgaggatcacccttccagagt

SEQ ID NO: 56172 - DNA, 25 bp, Mus musculus
aagctgaggatctcccttccagagt

SEQ ID NO: 56173 - DNA, 25 bp, Mus musculus
aagctgaggattccatatcacttca

SEQ ID NO: 56174 - DNA, 25 bp, Mus musculus
aagctgaggattgcatatcacttca

SEQ ID NO: 56175 - DNA, 25 bp, Mus musculus
aagctgagggcccaaggtcatacag

SEQ ID NO: 56176 - DNA, 25 bp, Mus musculus
aagctgagggccgaaggtcatacag

SEQ ID NO: 56177 - DNA, 25 bp, Mus musculus
aagctgaggtccaaatggcgcgtga

SEQ ID NO: 56178 - DNA, 25 bp, Mus musculus
aagctgaggtcctaatggcgcgtga

SEQ ID NO: 56179 - DNA, 25 bp, Mus musculus
aagctgagtagcaatttgttcaaat

SEQ ID NO: 56180 - DNA, 25 bp, Mus musculus
aagctgagtagctatttgttcaaat

SEQ ID NO: 56181 - DNA, 25 bp, Mus musculus
aagctgagtctgctccttggcagaa

SEQ ID NO: 56182 - DNA, 25 bp, Mus musculus
aagctgagtctggtccttggcagaa

SEQ ID NO: 56183 - DNA, 25 bp, Mus musculus
aagctgagttctcctgagggtctcc

SEQ ID NO: 56184 - DNA, 25 bp, Mus musculus
aagctgagttctgctgagggtctcc

SEQ ID NO: 56185 - DNA, 25 bp, Mus musculus
aagctgagttttcccaacacctgtt

SEQ ID NO: 56186 - DNA, 25 bp, Mus musculus
aagctgagttttgccaacacctgtt

SEQ ID NO: 56187 - DNA, 25 bp, Mus musculus
aagctgatagcccacattctgtgca

SEQ ID NO: 56188 - DNA, 25 bp, Mus musculus
aagctgatagccgacattctgtgca

SEQ ID NO: 56189 - DNA, 25 bp, Mus musculus
aagctgatagttctctgatgttaca

SEQ ID NO: 56190 - DNA, 25 bp, Mus musculus
aagctgatagttgtctgatgttaca

SEQ ID NO: 56191 - DNA, 25 bp, Mus musculus
aagctgatcaagatgtactacattt

SEQ ID NO: 56192 - DNA, 25 bp, Mus musculus
aagctgatcaagttgtactacattt

SEQ ID NO: 56193 - DNA, 25 bp, Mus musculus
aagctgatcaggcacccctgggtga

SEQ ID NO: 56194 - DNA, 25 bp, Mus musculus
aagctgatcagggacccctgggtga

SEQ ID NO: 56195 - DNA, 25 bp, Mus musculus
aagctgatcatactgttggatgcct

SEQ ID NO: 56196 - DNA, 25 bp, Mus musculus
aagctgatcatagtgttggatgcct

SEQ ID NO: 56197 - DNA, 25 bp, Mus musculus
aagctgatcttgctttcagtgtcaa

SEQ ID NO: 56198 - DNA, 25 bp, Mus musculus
aagctgatcttggtttcagtgtcaa

SEQ ID NO: 56199 - DNA, 25 bp, Mus musculus
aagctgatgaccctgttatctgcct

SEQ ID NO: 56200 - DNA, 25 bp, Mus musculus
aagctgatgaccgtgttatctgcct

SEQ ID NO: 56201 - DNA, 25 bp, Mus musculus
aagctgatgcagcaccggagaaccc

SEQ ID NO: 56202 - DNA, 25 bp, Mus musculus
aagctgatgcaggaccggagaaccc

SEQ ID NO: 56203 - DNA, 25 bp, Mus musculus
aagctgatgcccagagtgctggcaa

SEQ ID NO: 56204 - DNA, 25 bp, Mus musculus
aagctgatgccctgagtgctggcaa

SEQ ID NO: 56205 - DNA, 25 bp, Mus musculus
aagctgatgctgatgagtttcacct

SEQ ID NO: 56206 - DNA, 25 bp, Mus musculus
aagctgatgctgatgctccgttcag

SEQ ID NO: 56207 - DNA, 25 bp, Mus musculus
aagctgatgctgattgtccgatgcc

SEQ ID NO: 56208 - DNA, 25 bp, Mus musculus
aagctgatgctgttgagtttcacct

SEQ ID NO: 56209 - DNA, 25 bp, Mus musculus
aagctgatgctgttgctccgttcag

SEQ ID NO: 56210 - DNA, 25 bp, Mus musculus
aagctgatgctgtttgtccgatgcc

SEQ ID NO: 56211 - DNA, 25 bp, Mus musculus
aagctgatggacactgatggcctcc

SEQ ID NO: 56212 - DNA, 25 bp, Mus musculus
aagctgatggactctgatggcctcc

SEQ ID NO: 56213 - DNA, 25 bp, Mus musculus
aagctgatggccacgtctataacta

SEQ ID NO: 56214 - DNA, 25 bp, Mus musculus
aagctgatggcctcgtctataacta

SEQ ID NO: 56215 - DNA, 25 bp, Mus musculus
aagctgatgtatacctagtttctaa

SEQ ID NO: 56216 - DNA, 25 bp, Mus musculus
aagctgatgtattcctagtttctaa

SEQ ID NO: 56217 - DNA, 25 bp, Mus musculus
aagctgatgtcactgtagggcccct

SEQ ID NO: 56218 - DNA, 25 bp, Mus musculus
aagctgatgtcagtgtagggcccct

SEQ ID NO: 56219 - DNA, 25 bp, Mus musculus
aagctgatgtgtataggcctctgtg

SEQ ID NO: 56220 - DNA, 25 bp, Mus musculus
aagctgatgtgtttaggcctctgtg

SEQ ID NO: 56221 - DNA, 25 bp, Mus musculus
aagctgattctgattctgcagtcca

SEQ ID NO: 56222 - DNA, 25 bp, Mus musculus
aagctgattctgtttctgcagtcca

SEQ ID NO: 56223 - DNA, 25 bp, Mus musculus
aagctgattggcagacgagcagaga

SEQ ID NO: 56224 - DNA, 25 bp, Mus musculus
aagctgattggctgacgagcagaga

SEQ ID NO: 56225 - DNA, 25 bp, Mus musculus
aagctgatttacagaaatcccataa

SEQ ID NO: 56226 - DNA, 25 bp, Mus musculus
aagctgatttactgaaatcccataa

SEQ ID NO: 56227 - DNA, 25 bp, Mus musculus
aagctgcaagcacatcttgggcaaa

SEQ ID NO: 56228 - DNA, 25 bp, Mus musculus
aagctgcaagcagatcttgggcaaa

SEQ ID NO: 56229 - DNA, 25 bp, Mus musculus
aagctgcacagaaaattaagtagca

SEQ ID NO: 56230 - DNA, 25 bp, Mus musculus
aagctgcacagataattaagtagca

SEQ ID NO: 56231 - DNA, 25 bp, Mus musculus
aagctgcacagccattgttggagaa

SEQ ID NO: 56232 - DNA, 25 bp, Mus musculus
aagctgcacagcgattgttggagaa

SEQ ID NO: 56233 - DNA, 25 bp, Mus musculus
aagctgcaccagctacatatagctt

SEQ ID NO: 56234 - DNA, 25 bp, Mus musculus
aagctgcaccaggtacatatagctt

SEQ ID NO: 56235 - DNA, 25 bp, Mus musculus
aagctgcacgggacggagtctgtaa

SEQ ID NO: 56236 - DNA, 25 bp, Mus musculus
aagctgcacgggtcggagtctgtaa

SEQ ID NO: 56237 - DNA, 25 bp, Mus musculus
aagctgcactgacaaaacacctctg

SEQ ID NO: 56238 - DNA, 25 bp, Mus musculus
aagctgcactgagaaaacacctctg

SEQ ID NO: 56239 - DNA, 25 bp, Mus musculus
aagctgcagactcaccattatggat

SEQ ID NO: 56240 - DNA, 25 bp, Mus musculus
aagctgcagactgaccattatggat

SEQ ID NO: 56241 - DNA, 25 bp, Mus musculus
aagctgcagagaacatgccgtacga

SEQ ID NO: 56242 - DNA, 25 bp, Mus musculus
aagctgcagagatcatgccgtacga

SEQ ID NO: 56243 - DNA, 25 bp, Mus musculus
aagctgcagattcgcaagtcgtcca

SEQ ID NO: 56244 - DNA, 25 bp, Mus musculus
aagctgcagattggcaagtcgtcca

SEQ ID NO: 56245 - DNA, 25 bp, Mus musculus
aagctgcagcatccacaggcataaa

SEQ ID NO: 56246 - DNA, 25 bp, Mus musculus
aagctgcagcatgcacaggcataaa

SEQ ID NO: 56247 - DNA, 25 bp, Mus musculus
aagctgcagcgcagcaaggagaagt

SEQ ID NO: 56248 - DNA, 25 bp, Mus musculus
aagctgcagcgctgcaaggagaagt

SEQ ID NO: 56249 - DNA, 25 bp, Mus musculus
aagctgcagctaatactggatccga

SEQ ID NO: 56250 - DNA, 25 bp, Mus musculus
aagctgcagctattactggatccga

SEQ ID NO: 56251 - DNA, 25 bp, Mus musculus
aagctgcaggagagttcgtgtccac

SEQ ID NO: 56252 - DNA, 25 bp, Mus musculus
aagctgcaggagtgttcgtgtccac

SEQ ID NO: 56253 - DNA, 25 bp, Mus musculus
aagctgcaggcgatggcgaatgccc

SEQ ID NO: 56254 - DNA, 25 bp, Mus musculus
aagctgcaggcgttggcgaatgccc

SEQ ID NO: 56255 - DNA, 25 bp, Mus musculus
aagctgcaggtgacaggtactccat

SEQ ID NO: 56256 - DNA, 25 bp, Mus musculus
aagctgcaggtgtcaggtactccat

SEQ ID NO: 56257 - DNA, 25 bp, Mus musculus
aagctgcaggttagttatgcaaagg

SEQ ID NO: 56258 - DNA, 25 bp, Mus musculus
aagctgcaggtttgttatgcaaagg

SEQ ID NO: 56259 - DNA, 25 bp, Mus musculus
aagctgcagtaccaccttcgaaaga

SEQ ID NO: 56260 - DNA, 25 bp, Mus musculus
aagctgcagtacgaccttcgaaaga

SEQ ID NO: 56261 - DNA, 25 bp, Mus musculus
aagctgcagtcaactccaagttttg

SEQ ID NO: 56262 - DNA, 25 bp, Mus musculus
aagctgcagtcatctccaagttttg

SEQ ID NO: 56263 - DNA, 25 bp, Mus musculus
aagctgcagtccagagggttgacag

SEQ ID NO: 56264 - DNA, 25 bp, Mus musculus
aagctgcagtcctgagggttgacag

SEQ ID NO: 56265 - DNA, 25 bp, Mus musculus
aagctgcagtgaacccttcattggg

SEQ ID NO: 56266 - DNA, 25 bp, Mus musculus
aagctgcagtgaccactgtgcgccg

SEQ ID NO: 56267 - DNA, 25 bp, Mus musculus
aagctgcagtgagcactgtgcgccg

SEQ ID NO: 56268 - DNA, 25 bp, Mus musculus
aagctgcagtgatcccttcattggg

SEQ ID NO: 56269 - DNA, 25 bp, Mus musculus
aagctgcagtgtatacatgtttctt

SEQ ID NO: 56270 - DNA, 25 bp, Mus musculus
aagctgcagtgtttacatgtttctt

SEQ ID NO: 56271 - DNA, 25 bp, Mus musculus
aagctgcatactctgcatccaaagg

SEQ ID NO: 56272 - DNA, 25 bp, Mus musculus
aagctgcatactgtgcatccaaagg

SEQ ID NO: 56273 - DNA, 25 bp, Mus musculus
aagctgcatcaaagattttccagga

SEQ ID NO: 56274 - DNA, 25 bp, Mus musculus
aagctgcatcaatgattttccagga

SEQ ID NO: 56275 - DNA, 25 bp, Mus musculus
aagctgcatcctagtctctaggact

SEQ ID NO: 56276 - DNA, 25 bp, Mus musculus
aagctgcatccttgtctctaggact

SEQ ID NO: 56277 - DNA, 25 bp, Mus musculus
aagctgcatctaaatcacaagcatg

SEQ ID NO: 56278 - DNA, 25 bp, Mus musculus
aagctgcatctatatcacaagcatg

SEQ ID NO: 56279 - DNA, 25 bp, Mus musculus
aagctgcatgaactgtgtttactca

SEQ ID NO: 56280 - DNA, 25 bp, Mus musculus
aagctgcatgaagtgtgtttactca

SEQ ID NO: 56281 - DNA, 25 bp, Mus musculus
aagctgcatgctccttgttaagatg

SEQ ID NO: 56282 - DNA, 25 bp, Mus musculus
aagctgcatgctgcttgttaagatg

SEQ ID NO: 56283 - DNA, 25 bp, Mus musculus
aagctgcattgcctgagtgagagca

SEQ ID NO: 56284 - DNA, 25 bp, Mus musculus
aagctgcattgcgtgagtgagagca

SEQ ID NO: 56285 - DNA, 25 bp, Mus musculus
aagctgccaaggatgagtctgaaga

SEQ ID NO: 56286 - DNA, 25 bp, Mus musculus
aagctgccaaggttgagtctgaaga

SEQ ID NO: 56287 - DNA, 25 bp, Mus musculus
aagctgccacagcttgtacttgctc

SEQ ID NO: 56288 - DNA, 25 bp, Mus musculus
aagctgccacaggttgtacttgctc

SEQ ID NO: 56289 - DNA, 25 bp, Mus musculus
aagctgccacctcgggtgtgctgtc

SEQ ID NO: 56290 - DNA, 25 bp, Mus musculus
aagctgccacctggggtgtgctgtc

SEQ ID NO: 56291 - DNA, 25 bp, Mus musculus
aagctgccactgaatagggcccagt

SEQ ID NO: 56292 - DNA, 25 bp, Mus musculus
aagctgccactgagtctacttttcc

SEQ ID NO: 56293 - DNA, 25 bp, Mus musculus
aagctgccactgtatagggcccagt

SEQ ID NO: 56294 - DNA, 25 bp, Mus musculus
aagctgccactgtgtctacttttcc

SEQ ID NO: 56295 - DNA, 25 bp, Mus musculus
aagctgccagaaagcctctgtaact

SEQ ID NO: 56296 - DNA, 25 bp, Mus musculus
aagctgccagaatgcctctgtaact

SEQ ID NO: 56297 - DNA, 25 bp, Mus musculus
aagctgccaggacggatttaccata

SEQ ID NO: 56298 - DNA, 25 bp, Mus musculus
aagctgccaggagggatttaccata

SEQ ID NO: 56299 - DNA, 25 bp, Mus musculus
aagctgccagtacaaccaggcttgc

SEQ ID NO: 56300 - DNA, 25 bp, Mus musculus
aagctgccagtagaaccaggcttgc

SEQ ID NO: 56301 - DNA, 25 bp, Mus musculus
aagctgccagtcagtttcttatcag

SEQ ID NO: 56302 - DNA, 25 bp, Mus musculus
aagctgccagtcctagagggatagt

SEQ ID NO: 56303 - DNA, 25 bp, Mus musculus
aagctgccagtcgtagagggatagt

SEQ ID NO: 56304 - DNA, 25 bp, Mus musculus
aagctgccagtctgtttcttatcag

SEQ ID NO: 56305 - DNA, 25 bp, Mus musculus
aagctgccattgacttttattcaac

SEQ ID NO: 56306 - DNA, 25 bp, Mus musculus
aagctgccattgtcttttattcaac

SEQ ID NO: 56307 - DNA, 25 bp, Mus musculus
aagctgcccacgagtcgaagctagg

SEQ ID NO: 56308 - DNA, 25 bp, Mus musculus
aagctgcccacgtgtcgaagctagg

SEQ ID NO: 56309 - DNA, 25 bp, Mus musculus
aagctgcccagcacaacagtgaact

SEQ ID NO: 56310 - DNA, 25 bp, Mus musculus
aagctgcccagctcaacagtgaact

SEQ ID NO: 56311 - DNA, 25 bp, Mus musculus
aagctgcccaggaaagacactgtct

SEQ ID NO: 56312 - DNA, 25 bp, Mus musculus
aagctgcccaggtaagacactgtct

SEQ ID NO: 56313 - DNA, 25 bp, Mus musculus
aagctgcccagtaacttccataagg

SEQ ID NO: 56314 - DNA, 25 bp, Mus musculus
aagctgcccagttacttccataagg

SEQ ID NO: 56315 - DNA, 25 bp, Mus musculus
aagctgccccagaaaatgagggtga

SEQ ID NO: 56316 - DNA, 25 bp, Mus musculus
aagctgccccagtaaatgagggtga

SEQ ID NO: 56317 - DNA, 25 bp, Mus musculus
aagctgcccgggaccatgagaagtt

SEQ ID NO: 56318 - DNA, 25 bp, Mus musculus
aagctgcccgggtccatgagaagtt

SEQ ID NO: 56319 - DNA, 25 bp, Mus musculus
aagctgccctacctaagaatcacat

SEQ ID NO: 56320 - DNA, 25 bp, Mus musculus
aagctgccctacgtaagaatcacat

SEQ ID NO: 56321 - DNA, 25 bp, Mus musculus
aagctgccctgccaaggttagtcag

SEQ ID NO: 56322 - DNA, 25 bp, Mus musculus
aagctgccctgcgaaggttagtcag

SEQ ID NO: 56323 - DNA, 25 bp, Mus musculus
aagctgccctgtaagtgcagtgctt

SEQ ID NO: 56324 - DNA, 25 bp, Mus musculus
aagctgccctgttagtgcagtgctt

SEQ ID NO: 56325 - DNA, 25 bp, Mus musculus
aagctgccgacacactcagcagtgt

SEQ ID NO: 56326 - DNA, 25 bp, Mus musculus
aagctgccgacagactcagcagtgt

SEQ ID NO: 56327 - DNA, 25 bp, Mus musculus
aagctgccgataccctctccttttg

SEQ ID NO: 56328 - DNA, 25 bp, Mus musculus
aagctgccgatagcctctccttttg

SEQ ID NO: 56329 - DNA, 25 bp, Mus musculus
aagctgccgccaaggaagaggagca

SEQ ID NO: 56330 - DNA, 25 bp, Mus musculus
aagctgccgccatggaagaggagca

SEQ ID NO: 56331 - DNA, 25 bp, Mus musculus
aagctgccgctgaccgagtgaggac

SEQ ID NO: 56332 - DNA, 25 bp, Mus musculus
aagctgccgctgtccgagtgaggac

SEQ ID NO: 56333 - DNA, 25 bp, Mus musculus
aagctgccggccagaccgcaatgag

SEQ ID NO: 56334 - DNA, 25 bp, Mus musculus
aagctgccggcctgaccgcaatgag

SEQ ID NO: 56335 - DNA, 25 bp, Mus musculus
aagctgccgttgaacgcatccgtca

SEQ ID NO: 56336 - DNA, 25 bp, Mus musculus
aagctgccgttgtacgcatccgtca

SEQ ID NO: 56337 - DNA, 25 bp, Mus musculus
aagctgcctaaaaagactctgtcta

SEQ ID NO: 56338 - DNA, 25 bp, Mus musculus
aagctgcctaaatagactctgtcta

SEQ ID NO: 56339 - DNA, 25 bp, Mus musculus
aagctgcctcagaacccatttgctt

SEQ ID NO: 56340 - DNA, 25 bp, Mus musculus
aagctgcctcagtacccatttgctt

SEQ ID NO: 56341 - DNA, 25 bp, Mus musculus
aagctgcctccactcgttgggatag

SEQ ID NO: 56342 - DNA, 25 bp, Mus musculus
aagctgcctccagtcgttgggatag

SEQ ID NO: 56343 - DNA, 25 bp, Mus musculus
aagctgcctctaattcagttcgctc

SEQ ID NO: 56344 - DNA, 25 bp, Mus musculus
aagctgcctctatttcagttcgctc

SEQ ID NO: 56345 - DNA, 25 bp, Mus musculus
aagctgcctgagaactcctgattgt

SEQ ID NO: 56346 - DNA, 25 bp, Mus musculus
aagctgcctgagactatcagtctcg

SEQ ID NO: 56347 - DNA, 25 bp, Mus musculus
aagctgcctgagtactcctgattgt

SEQ ID NO: 56348 - DNA, 25 bp, Mus musculus
aagctgcctgagtctatcagtctcg

SEQ ID NO: 56349 - DNA, 25 bp, Mus musculus
aagctgcctgggactgccgttatga

SEQ ID NO: 56350 - DNA, 25 bp, Mus musculus
aagctgcctgggtctgccgttatga

SEQ ID NO: 56351 - DNA, 25 bp, Mus musculus
aagctgccttctctaccctgaagat

SEQ ID NO: 56352 - DNA, 25 bp, Mus musculus
aagctgccttctgtaccctgaagat

SEQ ID NO: 56353 - DNA, 25 bp, Mus musculus
aagctgcctttccagaagttagaaa

SEQ ID NO: 56354 - DNA, 25 bp, Mus musculus
aagctgcctttcgagaagttagaaa

SEQ ID NO: 56355 - DNA, 25 bp, Mus musculus
aagctgcgaatcagatggccttaat

SEQ ID NO: 56356 - DNA, 25 bp, Mus musculus
aagctgcgaatctgatggccttaat

SEQ ID NO: 56357 - DNA, 25 bp, Mus musculus
aagctgcgcatccacttagatattc

SEQ ID NO: 56358 - DNA, 25 bp, Mus musculus
aagctgcgcatcgacttagatattc

SEQ ID NO: 56359 - DNA, 25 bp, Mus musculus
aagctgcggacacctcggcgtcgac

SEQ ID NO: 56360 - DNA, 25 bp, Mus musculus
aagctgcggacagctcggcgtcgac

SEQ ID NO: 56361 - DNA, 25 bp, Mus musculus
aagctgcggacccatcatagctgac

SEQ ID NO: 56362 - DNA, 25 bp, Mus musculus
aagctgcggaccgatcatagctgac

SEQ ID NO: 56363 - DNA, 25 bp, Mus musculus
aagctgcggcatagttttcatcatc

SEQ ID NO: 56364 - DNA, 25 bp, Mus musculus
aagctgcggcattgttttcatcatc

SEQ ID NO: 56365 - DNA, 25 bp, Mus musculus
aagctgctaactacatgaacacgaa

SEQ ID NO: 56366 - DNA, 25 bp, Mus musculus
aagctgctaacttcatgaacacgaa

SEQ ID NO: 56367 - DNA, 25 bp, Mus musculus
aagctgctacccatgttcttaggag

SEQ ID NO: 56368 - DNA, 25 bp, Mus musculus
aagctgctacccttgttcttaggag

SEQ ID NO: 56369 - DNA, 25 bp, Mus musculus
aagctgctagctccattgaccaatt

SEQ ID NO: 56370 - DNA, 25 bp, Mus musculus
aagctgctagctgcattgaccaatt

SEQ ID NO: 56371 - DNA, 25 bp, Mus musculus
aagctgctaggtcatcggcagtcgt

SEQ ID NO: 56372 - DNA, 25 bp, Mus musculus
aagctgctaggtgatcggcagtcgt

SEQ ID NO: 56373 - DNA, 25 bp, Mus musculus
aagctgctagtgaggtgtctgtcag

SEQ ID NO: 56374 - DNA, 25 bp, Mus musculus
aagctgctagtgtggtgtctgtcag

SEQ ID NO: 56375 - DNA, 25 bp, Mus musculus
aagctgctatgtatttctccatgtt

SEQ ID NO: 56376 - DNA, 25 bp, Mus musculus
aagctgctatgtttttctccatgtt

SEQ ID NO: 56377 - DNA, 25 bp, Mus musculus
aagctgctcactcagagtcccgttt

SEQ ID NO: 56378 - DNA, 25 bp, Mus musculus
aagctgctcactgagagtcccgttt

SEQ ID NO: 56379 - DNA, 25 bp, Mus musculus
aagctgctcagcaggctctagagac

SEQ ID NO: 56380 - DNA, 25 bp, Mus musculus
aagctgctcagctggctctagagac

SEQ ID NO: 56381 - DNA, 25 bp, Mus musculus
aagctgctcagtcacccattcttaa

SEQ ID NO: 56382 - DNA, 25 bp, Mus musculus
aagctgctcagtgacccattcttaa

SEQ ID NO: 56383 - DNA, 25 bp, Mus musculus
aagctgctcattctgtacagtgaat

SEQ ID NO: 56384 - DNA, 25 bp, Mus musculus
aagctgctcattgtgtacagtgaat

SEQ ID NO: 56385 - DNA, 25 bp, Mus musculus
aagctgctccggacctcattgtgta

SEQ ID NO: 56386 - DNA, 25 bp, Mus musculus
aagctgctccggtcctcattgtgta

SEQ ID NO: 56387 - DNA, 25 bp, Mus musculus
aagctgctcgagactacccggtgta

SEQ ID NO: 56388 - DNA, 25 bp, Mus musculus
aagctgctcgagtctacccggtgta

SEQ ID NO: 56389 - DNA, 25 bp, Mus musculus
aagctgctcgcaagctgcgggtgca

SEQ ID NO: 56390 - DNA, 25 bp, Mus musculus
aagctgctcgcatgctgcgggtgca

SEQ ID NO: 56391 - DNA, 25 bp, Mus musculus
aagctgctcgctaacactatatttc

SEQ ID NO: 56392 - DNA, 25 bp, Mus musculus
aagctgctcgcttacactatatttc

SEQ ID NO: 56393 - DNA, 25 bp, Mus musculus
aagctgctcggaatccctctattgc

SEQ ID NO: 56394 - DNA, 25 bp, Mus musculus
aagctgctcggattccctctattgc

SEQ ID NO: 56395 - DNA, 25 bp, Mus musculus
aagctgctcggtcggtttatttata

SEQ ID NO: 56396 - DNA, 25 bp, Mus musculus
aagctgctcggtctcactgatacag

SEQ ID NO: 56397 - DNA, 25 bp, Mus musculus
aagctgctcggtgggtttatttata

SEQ ID NO: 56398 - DNA, 25 bp, Mus musculus
aagctgctcggtgtcactgatacag

SEQ ID NO: 56399 - DNA, 25 bp, Mus musculus
aagctgctgaaacgttcccagctaa

SEQ ID NO: 56400 - DNA, 25 bp, Mus musculus
aagctgctgaaaggttcccagctaa

SEQ ID NO: 56401 - DNA, 25 bp, Mus musculus
aagctgctgagcagcattgcagatg

SEQ ID NO: 56402 - DNA, 25 bp, Mus musculus
aagctgctgagctgcattgcagatg

SEQ ID NO: 56403 - DNA, 25 bp, Mus musculus
aagctgctgagtagtatttggtatt

SEQ ID NO: 56404 - DNA, 25 bp, Mus musculus
aagctgctgagttgtatttggtatt

SEQ ID NO: 56405 - DNA, 25 bp, Mus musculus
aagctgctgcaaatagtgtgagtgt

SEQ ID NO: 56406 - DNA, 25 bp, Mus musculus
aagctgctgcaacgatcgtcccaga

SEQ ID NO: 56407 - DNA, 25 bp, Mus musculus
aagctgctgcaaggatcgtcccaga

SEQ ID NO: 56408 - DNA, 25 bp, Mus musculus
aagctgctgcaattagtgtgagtgt

SEQ ID NO: 56409 - DNA, 25 bp, Mus musculus
aagctgctgccacggatccaccaaa

SEQ ID NO: 56410 - DNA, 25 bp, Mus musculus
aagctgctgccagggatccaccaaa

SEQ ID NO: 56411 - DNA, 25 bp, Mus musculus
aagctgctggacatgagactttaca

SEQ ID NO: 56412 - DNA, 25 bp, Mus musculus
aagctgctggacttgagactttaca

SEQ ID NO: 56413 - DNA, 25 bp, Mus musculus
aagctgctggcgagtacgagccaca

SEQ ID NO: 56414 - DNA, 25 bp, Mus musculus
aagctgctggcgtgtacgagccaca

SEQ ID NO: 56415 - DNA, 25 bp, Mus musculus
aagctgctgggcctttttaatttgc

SEQ ID NO: 56416 - DNA, 25 bp, Mus musculus
aagctgctgggcgtttttaatttgc

SEQ ID NO: 56417 - DNA, 25 bp, Mus musculus
aagctgctggttcaactggtccaaa

SEQ ID NO: 56418 - DNA, 25 bp, Mus musculus
aagctgctggttgaactggtccaaa

SEQ ID NO: 56419 - DNA, 25 bp, Mus musculus
aagctgctgtcacacttggaagggt

SEQ ID NO: 56420 - DNA, 25 bp, Mus musculus
aagctgctgtcagacttggaagggt

SEQ ID NO: 56421 - DNA, 25 bp, Mus musculus
aagctgctgtccaagaatgcctttc

SEQ ID NO: 56422 - DNA, 25 bp, Mus musculus
aagctgctgtcctagaatgcctttc

SEQ ID NO: 56423 - DNA, 25 bp, Mus musculus
aagctgctgttcagaggttcctggg

SEQ ID NO: 56424 - DNA, 25 bp, Mus musculus
aagctgctgttctgaggttcctggg

SEQ ID NO: 56425 - DNA, 25 bp, Mus musculus
aagctgctgtttagtttccactata

SEQ ID NO: 56426 - DNA, 25 bp, Mus musculus
aagctgctgttttgtttccactata

SEQ ID NO: 56427 - DNA, 25 bp, Mus musculus
aagctgcttaaaagtgctttctcac

SEQ ID NO: 56428 - DNA, 25 bp, Mus musculus
aagctgcttaaatgtgctttctcac

SEQ ID NO: 56429 - DNA, 25 bp, Mus musculus
aagctgcttacaactgttcacctgg

SEQ ID NO: 56430 - DNA, 25 bp, Mus musculus
aagctgcttacatctgttcacctgg

SEQ ID NO: 56431 - DNA, 25 bp, Mus musculus
aagctgcttagcctcaattttaaca

SEQ ID NO: 56432 - DNA, 25 bp, Mus musculus
aagctgcttagcgtcaattttaaca

SEQ ID NO: 56433 - DNA, 25 bp, Mus musculus
aagctgcttatcagtgcctggtaca

SEQ ID NO: 56434 - DNA, 25 bp, Mus musculus
aagctgcttatctgtgcctggtaca

SEQ ID NO: 56435 - DNA, 25 bp, Mus musculus
aagctgcttcctcgtccacctgaag

SEQ ID NO: 56436 - DNA, 25 bp, Mus musculus
aagctgcttcctggtccacctgaag

SEQ ID NO: 56437 - DNA, 25 bp, Mus musculus
aagctgcttctcatagtgtctcgaa

SEQ ID NO: 56438 - DNA, 25 bp, Mus musculus
aagctgcttctcttagtgtctcgaa

SEQ ID NO: 56439 - DNA, 25 bp, Mus musculus
aagctgcttcttcacattagacgtg

SEQ ID NO: 56440 - DNA, 25 bp, Mus musculus
aagctgcttcttgacattagacgtg

SEQ ID NO: 56441 - DNA, 25 bp, Mus musculus
aagctgcttgataagaactctagtg

SEQ ID NO: 56442 - DNA, 25 bp, Mus musculus
aagctgcttgattagaactctagtg

SEQ ID NO: 56443 - DNA, 25 bp, Mus musculus
aagctgcttgcaatatgagagagat

SEQ ID NO: 56444 - DNA, 25 bp, Mus musculus
aagctgcttgcattatgagagagat

SEQ ID NO: 56445 - DNA, 25 bp, Mus musculus
aagctggaaaccaaggcatgcacca

SEQ ID NO: 56446 - DNA, 25 bp, Mus musculus
aagctggaaacctaggcatgcacca

SEQ ID NO: 56447 - DNA, 25 bp, Mus musculus
aagctggaaagacatcagttgatat

SEQ ID NO: 56448 - DNA, 25 bp, Mus musculus
aagctggaaagagatcagttgatat

SEQ ID NO: 56449 - DNA, 25 bp, Mus musculus
aagctggaagctcatacacaacaca

SEQ ID NO: 56450 - DNA, 25 bp, Mus musculus
aagctggaagctgatacacaacaca

SEQ ID NO: 56451 - DNA, 25 bp, Mus musculus
aagctggaaggaacacacttgcttt

SEQ ID NO: 56452 - DNA, 25 bp, Mus musculus
aagctggaaggatcacacttgcttt

SEQ ID NO: 56453 - DNA, 25 bp, Mus musculus
aagctggaatgtaatcccaacctct

SEQ ID NO: 56454 - DNA, 25 bp, Mus musculus
aagctggaatgttatcccaacctct

SEQ ID NO: 56455 - DNA, 25 bp, Mus musculus
aagctggacactccaagtgccacac

SEQ ID NO: 56456 - DNA, 25 bp, Mus musculus
aagctggacactgcaagtgccacac

SEQ ID NO: 56457 - DNA, 25 bp, Mus musculus
aagctggacataatatttgacccaa

SEQ ID NO: 56458 - DNA, 25 bp, Mus musculus
aagctggacatattatttgacccaa

SEQ ID NO: 56459 - DNA, 25 bp, Mus musculus
aagctggactacaaacctgtgtgat

SEQ ID NO: 56460 - DNA, 25 bp, Mus musculus
aagctggactactaacctgtgtgat

SEQ ID NO: 56461 - DNA, 25 bp, Mus musculus
aagctggactagagtgttctctctc

SEQ ID NO: 56462 - DNA, 25 bp, Mus musculus
aagctggactagtgtgttctctctc

SEQ ID NO: 56463 - DNA, 25 bp, Mus musculus
aagctggactcaccactttgccttc

SEQ ID NO: 56464 - DNA, 25 bp, Mus musculus
aagctggactcagcactttgccttc

SEQ ID NO: 56465 - DNA, 25 bp, Mus musculus
aagctggactgacgcataaaattta

SEQ ID NO: 56466 - DNA, 25 bp, Mus musculus
aagctggactgaggcataaaattta

SEQ ID NO: 56467 - DNA, 25 bp, Mus musculus
aagctggacttacttctgtgaaaca

SEQ ID NO: 56468 - DNA, 25 bp, Mus musculus
aagctggacttagttctgtgaaaca

SEQ ID NO: 56469 - DNA, 25 bp, Mus musculus
aagctggagagaattcgtccccgct

SEQ ID NO: 56470 - DNA, 25 bp, Mus musculus
aagctggagagatttcgtccccgct

SEQ ID NO: 56471 - DNA, 25 bp, Mus musculus
aagctggagagtatcctgagtcgaa

SEQ ID NO: 56472 - DNA, 25 bp, Mus musculus
aagctggagagtttcctgagtcgaa

SEQ ID NO: 56473 - DNA, 25 bp, Mus musculus
aagctggagataaggcctagtggtt

SEQ ID NO: 56474 - DNA, 25 bp, Mus musculus
aagctggagatatggcctagtggtt

SEQ ID NO: 56475 - DNA, 25 bp, Mus musculus
aagctggagatgacctcttcattcc

SEQ ID NO: 56476 - DNA, 25 bp, Mus musculus
aagctggagatgtcctcttcattcc

SEQ ID NO: 56477 - DNA, 25 bp, Mus musculus
aagctggagcacagggaaaatgaca

SEQ ID NO: 56478 - DNA, 25 bp, Mus musculus
aagctggagcactgggaaaatgaca

SEQ ID NO: 56479 - DNA, 25 bp, Mus musculus
aagctggagctgagcacactggccc

SEQ ID NO: 56480 - DNA, 25 bp, Mus musculus
aagctggagctgtgcacactggccc

SEQ ID NO: 56481 - DNA, 25 bp, Mus musculus
aagctggagcttcagatgtgtcccg

SEQ ID NO: 56482 - DNA, 25 bp, Mus musculus
aagctggagcttgagatgtgtcccg

SEQ ID NO: 56483 - DNA, 25 bp, Mus musculus
aagctggaggaacgctatcctgctt

SEQ ID NO: 56484 - DNA, 25 bp, Mus musculus
aagctggaggaaggctatcctgctt

SEQ ID NO: 56485 - DNA, 25 bp, Mus musculus
aagctggaggtgattcggatgtccc

SEQ ID NO: 56486 - DNA, 25 bp, Mus musculus
aagctggaggtgtttcggatgtccc

SEQ ID NO: 56487 - DNA, 25 bp, Mus musculus
aagctggatcctctggcaggttaat

SEQ ID NO: 56488 - DNA, 25 bp, Mus musculus
aagctggatcctgtggcaggttaat

SEQ ID NO: 56489 - DNA, 25 bp, Mus musculus
aagctggatctcctgtggtccctgt

SEQ ID NO: 56490 - DNA, 25 bp, Mus musculus
aagctggatctcgtgtggtccctgt

SEQ ID NO: 56491 - DNA, 25 bp, Mus musculus
aagctggatgccctcatgaaagccc

SEQ ID NO: 56492 - DNA, 25 bp, Mus musculus
aagctggatgccgtcatgaaagccc

SEQ ID NO: 56493 - DNA, 25 bp, Mus musculus
aagctggattctcgtaaatggtctt

SEQ ID NO: 56494 - DNA, 25 bp, Mus musculus
aagctggattctggtaaatggtctt

SEQ ID NO: 56495 - DNA, 25 bp, Mus musculus
aagctggattggaccggcttgctta

SEQ ID NO: 56496 - DNA, 25 bp, Mus musculus
aagctggattggtccggcttgctta

SEQ ID NO: 56497 - DNA, 25 bp, Mus musculus
aagctggcaccaagtgcttgtgcag

SEQ ID NO: 56498 - DNA, 25 bp, Mus musculus
aagctggcaccatgtgcttgtgcag

SEQ ID NO: 56499 - DNA, 25 bp, Mus musculus
aagctggcagaacctcatcgagcct

SEQ ID NO: 56500 - DNA, 25 bp, Mus musculus
aagctggcagaagctcatcgagcct

SEQ ID NO: 56501 - DNA, 25 bp, Mus musculus
aagctggcagcgagcaggtagacct

SEQ ID NO: 56502 - DNA, 25 bp, Mus musculus
aagctggcagcgtgcaggtagacct

SEQ ID NO: 56503 - DNA, 25 bp, Mus musculus
aagctggcaggcattgtcattccca

SEQ ID NO: 56504 - DNA, 25 bp, Mus musculus
aagctggcaggctttgtcattccca

SEQ ID NO: 56505 - DNA, 25 bp, Mus musculus
aagctggcatccctggaacaagact

SEQ ID NO: 56506 - DNA, 25 bp, Mus musculus
aagctggcatccgtggaacaagact

SEQ ID NO: 56507 - DNA, 25 bp, Mus musculus
aagctggcatttccaagtcgagcag

SEQ ID NO: 56508 - DNA, 25 bp, Mus musculus
aagctggcatttgcaagtcgagcag

SEQ ID NO: 56509 - DNA, 25 bp, Mus musculus
aagctggccaagactgagagcgcac

SEQ ID NO: 56510 - DNA, 25 bp, Mus musculus
aagctggccaagtctgagagcgcac

SEQ ID NO: 56511 - DNA, 25 bp, Mus musculus
aagctggccctcaagagacttgtga

SEQ ID NO: 56512 - DNA, 25 bp, Mus musculus
aagctggccctctagagacttgtga

SEQ ID NO: 56513 - DNA, 25 bp, Mus musculus
aagctggcctccctgtttcggctgc

SEQ ID NO: 56514 - DNA, 25 bp, Mus musculus
aagctggcctccgtgtttcggctgc

SEQ ID NO: 56515 - DNA, 25 bp, Mus musculus
aagctggcctctcgcacttactcta

SEQ ID NO: 56516 - DNA, 25 bp, Mus musculus
aagctggcctctggcacttactcta

SEQ ID NO: 56517 - DNA, 25 bp, Mus musculus
aagctggcctgaaccttttatgtgg

SEQ ID NO: 56518 - DNA, 25 bp, Mus musculus
aagctggcctgatccttttatgtgg

SEQ ID NO: 56519 - DNA, 25 bp, Mus musculus
aagctggcgatgctgccaccgcagc

SEQ ID NO: 56520 - DNA, 25 bp, Mus musculus
aagctggcgatggtgccaccgcagc

SEQ ID NO: 56521 - DNA, 25 bp, Mus musculus
aagctggcggataggagttttgttt

SEQ ID NO: 56522 - DNA, 25 bp, Mus musculus
aagctggcggattggagttttgttt

SEQ ID NO: 56523 - DNA, 25 bp, Mus musculus
aagctggctagactctcagagggtc

SEQ ID NO: 56524 - DNA, 25 bp, Mus musculus
aagctggctagagtctcagagggtc

SEQ ID NO: 56525 - DNA, 25 bp, Mus musculus
aagctggctcagagttagcaccaac

SEQ ID NO: 56526 - DNA, 25 bp, Mus musculus
aagctggctcagtgttagcaccaac

SEQ ID NO: 56527 - DNA, 25 bp, Mus musculus
aagctggctctgagcttgtgccgca

SEQ ID NO: 56528 - DNA, 25 bp, Mus musculus
aagctggctctgtgcttgtgccgca

SEQ ID NO: 56529 - DNA, 25 bp, Mus musculus
aagctggctggaaagatggagacaa

SEQ ID NO: 56530 - DNA, 25 bp, Mus musculus
aagctggctggatagatggagacaa

SEQ ID NO: 56531 - DNA, 25 bp, Mus musculus
aagctggctggcaccctagtagcgg

SEQ ID NO: 56532 - DNA, 25 bp, Mus musculus
aagctggctggctccctagtagcgg

SEQ ID NO: 56533 - DNA, 25 bp, Mus musculus
aagctggctggtatctgctccagta

SEQ ID NO: 56534 - DNA, 25 bp, Mus musculus
aagctggctggtttctgctccagta

SEQ ID NO: 56535 - DNA, 25 bp, Mus musculus
aagctggctgtgaatgtaccactgt

SEQ ID NO: 56536 - DNA, 25 bp, Mus musculus
aagctggctgtgtatgtaccactgt

SEQ ID NO: 56537 - DNA, 25 bp, Mus musculus
aagctggctgttagagtgtgtcctc

SEQ ID NO: 56538 - DNA, 25 bp, Mus musculus
aagctggctgtttgagtgtgtcctc

SEQ ID NO: 56539 - DNA, 25 bp, Mus musculus
aagctggcttatcggtgccaggaac

SEQ ID NO: 56540 - DNA, 25 bp, Mus musculus
aagctggcttatgggtgccaggaac

SEQ ID NO: 56541 - DNA, 25 bp, Mus musculus
aagctggcttctagtctgccatgac

SEQ ID NO: 56542 - DNA, 25 bp, Mus musculus
aagctggcttcttgtctgccatgac

SEQ ID NO: 56543 - DNA, 25 bp, Mus musculus
aagctggctttccttacctagtgag

SEQ ID NO: 56544 - DNA, 25 bp, Mus musculus
aagctggctttcgttacctagtgag

SEQ ID NO: 56545 - DNA, 25 bp, Mus musculus
aagctgggaatcacgcagttgcgct

SEQ ID NO: 56546 - DNA, 25 bp, Mus musculus
aagctgggaatctcgcagttgcgct

SEQ ID NO: 56547 - DNA, 25 bp, Mus musculus
aagctgggaatgcacctaactggtt

SEQ ID NO: 56548 - DNA, 25 bp, Mus musculus
aagctgggaatggacctaactggtt

SEQ ID NO: 56549 - DNA, 25 bp, Mus musculus
aagctgggagcacatcttgttcacc

SEQ ID NO: 56550 - DNA, 25 bp, Mus musculus
aagctgggagcagatcttgttcacc

SEQ ID NO: 56551 - DNA, 25 bp, Mus musculus
aagctgggagttcctgcaaagccac

SEQ ID NO: 56552 - DNA, 25 bp, Mus musculus
aagctgggagttgctgcaaagccac

SEQ ID NO: 56553 - DNA, 25 bp, Mus musculus
aagctgggatgtacttaagtctcaa

SEQ ID NO: 56554 - DNA, 25 bp, Mus musculus
aagctgggatgttcttaagtctcaa

SEQ ID NO: 56555 - DNA, 25 bp, Mus musculus
aagctgggattactacctctgatca

SEQ ID NO: 56556 - DNA, 25 bp, Mus musculus
aagctgggattagtacctctgatca

SEQ ID NO: 56557 - DNA, 25 bp, Mus musculus
aagctgggccagatcattcgagagg

SEQ ID NO: 56558 - DNA, 25 bp, Mus musculus
aagctgggccagttcattcgagagg

SEQ ID NO: 56559 - DNA, 25 bp, Mus musculus
aagctgggcctgatggtgtgctatc

SEQ ID NO: 56560 - DNA, 25 bp, Mus musculus
aagctgggcctgttggtgtgctatc

SEQ ID NO: 56561 - DNA, 25 bp, Mus musculus
aagctgggctttatggccattgctg

SEQ ID NO: 56562 - DNA, 25 bp, Mus musculus
aagctgggctttttggccattgctg

SEQ ID NO: 56563 - DNA, 25 bp, Mus musculus
aagctgggtatgctatcaaacatcc

SEQ ID NO: 56564 - DNA, 25 bp, Mus musculus
aagctgggtatggtatcaaacatcc

SEQ ID NO: 56565 - DNA, 25 bp, Mus musculus
aagctgggtcacaacatggccatga

SEQ ID NO: 56566 - DNA, 25 bp, Mus musculus
aagctgggtcactacatggccatga

SEQ ID NO: 56567 - DNA, 25 bp, Mus musculus
aagctgggtctgataacgggtttat

SEQ ID NO: 56568 - DNA, 25 bp, Mus musculus
aagctgggtctgttaacgggtttat

SEQ ID NO: 56569 - DNA, 25 bp, Mus musculus
aagctgggtcttagcaccagtgcaa

SEQ ID NO: 56570 - DNA, 25 bp, Mus musculus
aagctgggtctttgcaccagtgcaa

SEQ ID NO: 56571 - DNA, 25 bp, Mus musculus
aagctgggttatattgccaactgca

SEQ ID NO: 56572 - DNA, 25 bp, Mus musculus
aagctgggttattttgccaactgca

SEQ ID NO: 56573 - DNA, 25 bp, Mus musculus
aagctggtaattcctcgggacctca

SEQ ID NO: 56574 - DNA, 25 bp, Mus musculus
aagctggtaattgctcgggacctca

SEQ ID NO: 56575 - DNA, 25 bp, Mus musculus
aagctggtagccatcagcttcctaa

SEQ ID NO: 56576 - DNA, 25 bp, Mus musculus
aagctggtagccttcagcttcctaa

SEQ ID NO: 56577 - DNA, 25 bp, Mus musculus
aagctggtattcattacccctgcag

SEQ ID NO: 56578 - DNA, 25 bp, Mus musculus
aagctggtattctttacccctgcag

SEQ ID NO: 56579 - DNA, 25 bp, Mus musculus
aagctggtcaacagccaaacccatg

SEQ ID NO: 56580 - DNA, 25 bp, Mus musculus
aagctggtcaactgccaaacccatg

SEQ ID NO: 56581 - DNA, 25 bp, Mus musculus
aagctggtcagcactgggggattaa

SEQ ID NO: 56582 - DNA, 25 bp, Mus musculus
aagctggtcagctctgggggattaa

SEQ ID NO: 56583 - DNA, 25 bp, Mus musculus
aagctggtccagatagtatcataga

SEQ ID NO: 56584 - DNA, 25 bp, Mus musculus
aagctggtccagttagtatcataga

SEQ ID NO: 56585 - DNA, 25 bp, Mus musculus
aagctggtcgctagttgcttggcaa

SEQ ID NO: 56586 - DNA, 25 bp, Mus musculus
aagctggtcgcttgttgcttggcaa

SEQ ID NO: 56587 - DNA, 25 bp, Mus musculus
aagctggtcggtcttccagagctaa

SEQ ID NO: 56588 - DNA, 25 bp, Mus musculus
aagctggtcggtgttccagagctaa

SEQ ID NO: 56589 - DNA, 25 bp, Mus musculus
aagctggtctccaagctggacccct

SEQ ID NO: 56590 - DNA, 25 bp, Mus musculus
aagctggtctcctagctggacccct

SEQ ID NO: 56591 - DNA, 25 bp, Mus musculus
aagctggtgattcgagtggccaatg

SEQ ID NO: 56592 - DNA, 25 bp, Mus musculus
aagctggtgattggagtggccaatg

SEQ ID NO: 56593 - DNA, 25 bp, Mus musculus
aagctggtgctaagcatgagtgagc

SEQ ID NO: 56594 - DNA, 25 bp, Mus musculus
aagctggtgctaagggattcggctc

SEQ ID NO: 56595 - DNA, 25 bp, Mus musculus
aagctggtgctaaggtcctggctga

SEQ ID NO: 56596 - DNA, 25 bp, Mus musculus
aagctggtgctatgcatgagtgagc

SEQ ID NO: 56597 - DNA, 25 bp, Mus musculus
aagctggtgctatgggattcggctc

SEQ ID NO: 56598 - DNA, 25 bp, Mus musculus
aagctggtgctatggtcctggctga

SEQ ID NO: 56599 - DNA, 25 bp, Mus musculus
aagctggtggaactcgaccccaaga

SEQ ID NO: 56600 - DNA, 25 bp, Mus musculus
aagctggtggaagtcgaccccaaga

SEQ ID NO: 56601 - DNA, 25 bp, Mus musculus
aagctggtggatacagtgggctcct

SEQ ID NO: 56602 - DNA, 25 bp, Mus musculus
aagctggtggattcagtgggctcct

SEQ ID NO: 56603 - DNA, 25 bp, Mus musculus
aagctggtggtaacgttcatgaaag

SEQ ID NO: 56604 - DNA, 25 bp, Mus musculus
aagctggtggtatcgttcatgaaag

SEQ ID NO: 56605 - DNA, 25 bp, Mus musculus
aagctggtggttattggattctgat

SEQ ID NO: 56606 - DNA, 25 bp, Mus musculus
aagctggtggtttttggattctgat

SEQ ID NO: 56607 - DNA, 25 bp, Mus musculus
aagctggtgtcccagtcttctgatg

SEQ ID NO: 56608 - DNA, 25 bp, Mus musculus
aagctggtgtccgagtcttctgatg

SEQ ID NO: 56609 - DNA, 25 bp, Mus musculus
aagctggtgtgcatagtcttgttac

SEQ ID NO: 56610 - DNA, 25 bp, Mus musculus
aagctggtgtgcttagtcttgttac

SEQ ID NO: 56611 - DNA, 25 bp, Mus musculus
aagctggttgaactgtttcttccta

SEQ ID NO: 56612 - DNA, 25 bp, Mus musculus
aagctggttgaagtgtttcttccta

SEQ ID NO: 56613 - DNA, 25 bp, Mus musculus
aagctggttgacacctcctgcagaa

SEQ ID NO: 56614 - DNA, 25 bp, Mus musculus
aagctggttgactcctcctgcagaa

SEQ ID NO: 56615 - DNA, 25 bp, Mus musculus
aagctggttgagagcatcttggaac

SEQ ID NO: 56616 - DNA, 25 bp, Mus musculus
aagctggttgagtgcatcttggaac

SEQ ID NO: 56617 - DNA, 25 bp, Mus musculus
aagctggtttccaattgcagttaac

SEQ ID NO: 56618 - DNA, 25 bp, Mus musculus
aagctggtttcctattgcagttaac

SEQ ID NO: 56619 - DNA, 25 bp, Mus musculus
aagctgtaagctaagactgtgagag

SEQ ID NO: 56620 - DNA, 25 bp, Mus musculus
aagctgtaagcttagactgtgagag

SEQ ID NO: 56621 - DNA, 25 bp, Mus musculus
aagctgtacaggattctggccagac

SEQ ID NO: 56622 - DNA, 25 bp, Mus musculus
aagctgtacaggtttctggccagac

SEQ ID NO: 56623 - DNA, 25 bp, Mus musculus
aagctgtacatgattattcgcccct

SEQ ID NO: 56624 - DNA, 25 bp, Mus musculus
aagctgtacatgtttattcgcccct

SEQ ID NO: 56625 - DNA, 25 bp, Mus musculus
aagctgtacattattcaccctgact

SEQ ID NO: 56626 - DNA, 25 bp, Mus musculus
aagctgtacatttttcaccctgact

SEQ ID NO: 56627 - DNA, 25 bp, Mus musculus
aagctgtacctcatgatgctcttca

SEQ ID NO: 56628 - DNA, 25 bp, Mus musculus
aagctgtacctcttgatgctcttca

SEQ ID NO: 56629 - DNA, 25 bp, Mus musculus
aagctgtacgagctgcccgcagctg

SEQ ID NO: 56630 - DNA, 25 bp, Mus musculus
aagctgtacgaggtgcccgcagctg

SEQ ID NO: 56631 - DNA, 25 bp, Mus musculus
aagctgtactccaggcccgtgaaag

SEQ ID NO: 56632 - DNA, 25 bp, Mus musculus
aagctgtactcctggcccgtgaaag

SEQ ID NO: 56633 - DNA, 25 bp, Mus musculus
aagctgtagaacaggctcatcggat

SEQ ID NO: 56634 - DNA, 25 bp, Mus musculus
aagctgtagaactggctcatcggat

SEQ ID NO: 56635 - DNA, 25 bp, Mus musculus
aagctgtagaccctccagttgcttc

SEQ ID NO: 56636 - DNA, 25 bp, Mus musculus
aagctgtagaccgtccagttgcttc

SEQ ID NO: 56637 - DNA, 25 bp, Mus musculus
aagctgtagagaacccatcgtgact

SEQ ID NO: 56638 - DNA, 25 bp, Mus musculus
aagctgtagagatcccatcgtgact

SEQ ID NO: 56639 - DNA, 25 bp, Mus musculus
aagctgtaggcaaattttagcaggt

SEQ ID NO: 56640 - DNA, 25 bp, Mus musculus
aagctgtaggcatattttagcaggt

SEQ ID NO: 56641 - DNA, 25 bp, Mus musculus
aagctgtagttcatggagatcactg

SEQ ID NO: 56642 - DNA, 25 bp, Mus musculus
aagctgtagttcttggagatcactg

SEQ ID NO: 56643 - DNA, 25 bp, Mus musculus
aagctgtatctacactgctttccag

SEQ ID NO: 56644 - DNA, 25 bp, Mus musculus
aagctgtatctagactgctttccag

SEQ ID NO: 56645 - DNA, 25 bp, Mus musculus
aagctgtattcaaggccatggctcc

SEQ ID NO: 56646 - DNA, 25 bp, Mus musculus
aagctgtattcatggccatggctcc

SEQ ID NO: 56647 - DNA, 25 bp, Mus musculus
aagctgtatttcctgttctggtgtg

SEQ ID NO: 56648 - DNA, 25 bp, Mus musculus
aagctgtatttcgtgttctggtgtg

SEQ ID NO: 56649 - DNA, 25 bp, Mus musculus
aagctgtcaataaggcaggcttgcc

SEQ ID NO: 56650 - DNA, 25 bp, Mus musculus
aagctgtcaatatggcaggcttgcc

SEQ ID NO: 56651 - DNA, 25 bp, Mus musculus
aagctgtcacctcgtacacatggag

SEQ ID NO: 56652 - DNA, 25 bp, Mus musculus
aagctgtcacctggtacacatggag

SEQ ID NO: 56653 - DNA, 25 bp, Mus musculus
aagctgtcaggaccacccctcgtga

SEQ ID NO: 56654 - DNA, 25 bp, Mus musculus
aagctgtcaggagcacccctcgtga

SEQ ID NO: 56655 - DNA, 25 bp, Mus musculus
aagctgtcaggcctcaacattcgtc

SEQ ID NO: 56656 - DNA, 25 bp, Mus musculus
aagctgtcaggcgtcaacattcgtc

SEQ ID NO: 56657 - DNA, 25 bp, Mus musculus
aagctgtcagtaacacgctgttgaa

SEQ ID NO: 56658 - DNA, 25 bp, Mus musculus
aagctgtcagtatcacgctgttgaa

SEQ ID NO: 56659 - DNA, 25 bp, Mus musculus
aagctgtcattacacctgattttga

SEQ ID NO: 56660 - DNA, 25 bp, Mus musculus
aagctgtcattagacctgattttga

SEQ ID NO: 56661 - DNA, 25 bp, Mus musculus
aagctgtcattcatatggtggtgaa

SEQ ID NO: 56662 - DNA, 25 bp, Mus musculus
aagctgtcattcttatggtggtgaa

SEQ ID NO: 56663 - DNA, 25 bp, Mus musculus
aagctgtcatttagtgttgccttca

SEQ ID NO: 56664 - DNA, 25 bp, Mus musculus
aagctgtcattttgtgttgccttca

SEQ ID NO: 56665 - DNA, 25 bp, Mus musculus
aagctgtccactcgagacatttctg

SEQ ID NO: 56666 - DNA, 25 bp, Mus musculus
aagctgtccactggagacatttctg

SEQ ID NO: 56667 - DNA, 25 bp, Mus musculus
aagctgtcccaacgagctccaaggg

SEQ ID NO: 56668 - DNA, 25 bp, Mus musculus
aagctgtcccaaggagctccaaggg

SEQ ID NO: 56669 - DNA, 25 bp, Mus musculus
aagctgtcctgacggaataccacca

SEQ ID NO: 56670 - DNA, 25 bp, Mus musculus
aagctgtcctgagggaataccacca

SEQ ID NO: 56671 - DNA, 25 bp, Mus musculus
aagctgtccttaaagctaggaggga

SEQ ID NO: 56672 - DNA, 25 bp, Mus musculus
aagctgtccttatagctaggaggga

SEQ ID NO: 56673 - DNA, 25 bp, Mus musculus
aagctgtctatcagactctggcttc

SEQ ID NO: 56674 - DNA, 25 bp, Mus musculus
aagctgtctatctgactctggcttc

SEQ ID NO: 56675 - DNA, 25 bp, Mus musculus
aagctgtctattacattatcagaat

SEQ ID NO: 56676 - DNA, 25 bp, Mus musculus
aagctgtctatttcattatcagaat

SEQ ID NO: 56677 - DNA, 25 bp, Mus musculus
aagctgtctcataccagtcctctaa

SEQ ID NO: 56678 - DNA, 25 bp, Mus musculus
aagctgtctcattccagtcctctaa

SEQ ID NO: 56679 - DNA, 25 bp, Mus musculus
aagctgtctccccaagagtaagcaa

SEQ ID NO: 56680 - DNA, 25 bp, Mus musculus
aagctgtctcccgaagagtaagcaa

SEQ ID NO: 56681 - DNA, 25 bp, Mus musculus
aagctgtctctcctgttgaaagacg

SEQ ID NO: 56682 - DNA, 25 bp, Mus musculus
aagctgtctctcgtgttgaaagacg

SEQ ID NO: 56683 - DNA, 25 bp, Mus musculus
aagctgtctgacctcatgatactca

SEQ ID NO: 56684 - DNA, 25 bp, Mus musculus
aagctgtctgacgtcatgatactca

SEQ ID NO: 56685 - DNA, 25 bp, Mus musculus
aagctgtctgctacttgcatgatca

SEQ ID NO: 56686 - DNA, 25 bp, Mus musculus
aagctgtctgcttcttgcatgatca

SEQ ID NO: 56687 - DNA, 25 bp, Mus musculus
aagctgtcttcccttagcccttgca

SEQ ID NO: 56688 - DNA, 25 bp, Mus musculus
aagctgtcttccgttagcccttgca

SEQ ID NO: 56689 - DNA, 25 bp, Mus musculus
aagctgtctttcaagtcccagattt

SEQ ID NO: 56690 - DNA, 25 bp, Mus musculus
aagctgtctttctagtcccagattt

SEQ ID NO: 56691 - DNA, 25 bp, Mus musculus
aagctgtcttttcccaatcacatgc

SEQ ID NO: 56692 - DNA, 25 bp, Mus musculus
aagctgtcttttgccaatcacatgc

SEQ ID NO: 56693 - DNA, 25 bp, Mus musculus
aagctgtgaaatacatgcctcaaaa

SEQ ID NO: 56694 - DNA, 25 bp, Mus musculus
aagctgtgaaattcatgcctcaaaa

SEQ ID NO: 56695 - DNA, 25 bp, Mus musculus
aagctgtgacccatggctgtcagaa

SEQ ID NO: 56696 - DNA, 25 bp, Mus musculus
aagctgtgacccttggctgtcagaa

SEQ ID NO: 56697 - DNA, 25 bp, Mus musculus
aagctgtgacttcggtgtcaataaa

SEQ ID NO: 56698 - DNA, 25 bp, Mus musculus
aagctgtgacttgggtgtcaataaa

SEQ ID NO: 56699 - DNA, 25 bp, Mus musculus
aagctgtgagtgagatcgacgccct

SEQ ID NO: 56700 - DNA, 25 bp, Mus musculus
aagctgtgagtgtgatcgacgccct

SEQ ID NO: 56701 - DNA, 25 bp, Mus musculus
aagctgtgatccaaggccatgtggc

SEQ ID NO: 56702 - DNA, 25 bp, Mus musculus
aagctgtgatcctaggccatgtggc

SEQ ID NO: 56703 - DNA, 25 bp, Mus musculus
aagctgtgcagtcagggcctaggcc

SEQ ID NO: 56704 - DNA, 25 bp, Mus musculus
aagctgtgcagtgagggcctaggcc

SEQ ID NO: 56705 - DNA, 25 bp, Mus musculus
aagctgtgcatgcactattcaacta

SEQ ID NO: 56706 - DNA, 25 bp, Mus musculus
aagctgtgcatggactattcaacta

SEQ ID NO: 56707 - DNA, 25 bp, Mus musculus
aagctgtgccacctcctaaataaaa

SEQ ID NO: 56708 - DNA, 25 bp, Mus musculus
aagctgtgccacgtcctaaataaaa

SEQ ID NO: 56709 - DNA, 25 bp, Mus musculus
aagctgtgccatctctttctggaag

SEQ ID NO: 56710 - DNA, 25 bp, Mus musculus
aagctgtgccatgtctttctggaag

SEQ ID NO: 56711 - DNA, 25 bp, Mus musculus
aagctgtgcccactactgcttttgt

SEQ ID NO: 56712 - DNA, 25 bp, Mus musculus
aagctgtgcccagtactgcttttgt

SEQ ID NO: 56713 - DNA, 25 bp, Mus musculus
aagctgtgccctcccgaccaaggaa

SEQ ID NO: 56714 - DNA, 25 bp, Mus musculus
aagctgtgccctgccgaccaaggaa

SEQ ID NO: 56715 - DNA, 25 bp, Mus musculus
aagctgtgcctgacttgtgccaagt

SEQ ID NO: 56716 - DNA, 25 bp, Mus musculus
aagctgtgcctgtcttgtgccaagt

SEQ ID NO: 56717 - DNA, 25 bp, Mus musculus
aagctgtgccttagagtctatacta

SEQ ID NO: 56718 - DNA, 25 bp, Mus musculus
aagctgtgcctttgagtctatacta

SEQ ID NO: 56719 - DNA, 25 bp, Mus musculus
aagctgtgcgggaccacgagactca

SEQ ID NO: 56720 - DNA, 25 bp, Mus musculus
aagctgtgcgggtccacgagactca

SEQ ID NO: 56721 - DNA, 25 bp, Mus musculus
aagctgtgcgtgactgagtaggttc

SEQ ID NO: 56722 - DNA, 25 bp, Mus musculus
aagctgtgcgtgtctgagtaggttc

SEQ ID NO: 56723 - DNA, 25 bp, Mus musculus
aagctgtgctctccatgaactctgg

SEQ ID NO: 56724 - DNA, 25 bp, Mus musculus
aagctgtgctctgcatgaactctgg

SEQ ID NO: 56725 - DNA, 25 bp, Mus musculus
aagctgtgcttactgagcgctcttt

SEQ ID NO: 56726 - DNA, 25 bp, Mus musculus
aagctgtgcttagtgagcgctcttt

SEQ ID NO: 56727 - DNA, 25 bp, Mus musculus
aagctgtgctttcgctccctgaggc

SEQ ID NO: 56728 - DNA, 25 bp, Mus musculus
aagctgtgctttggctccctgaggc

SEQ ID NO: 56729 - DNA, 25 bp, Mus musculus
aagctgtggactaggatgcttgctg

SEQ ID NO: 56730 - DNA, 25 bp, Mus musculus
aagctgtggacttggatgcttgctg

SEQ ID NO: 56731 - DNA, 25 bp, Mus musculus
aagctgtggcagagatccagtccat

SEQ ID NO: 56732 - DNA, 25 bp, Mus musculus
aagctgtggcagtgatccagtccat

SEQ ID NO: 56733 - DNA, 25 bp, Mus musculus
aagctgtggtcaaacctggcatgtg

SEQ ID NO: 56734 - DNA, 25 bp, Mus musculus
aagctgtggtcatacctggcatgtg

SEQ ID NO: 56735 - DNA, 25 bp, Mus musculus
aagctgtgtactccattgacatcga

SEQ ID NO: 56736 - DNA, 25 bp, Mus musculus
aagctgtgtactgcattgacatcga

SEQ ID NO: 56737 - DNA, 25 bp, Mus musculus
aagctgtgtcaaccaagcccaggga

SEQ ID NO: 56738 - DNA, 25 bp, Mus musculus
aagctgtgtcaagcaagcccaggga

SEQ ID NO: 56739 - DNA, 25 bp, Mus musculus
aagctgtgtgaaccagcgccttcag

SEQ ID NO: 56740 - DNA, 25 bp, Mus musculus
aagctgtgtgaagcagcgccttcag

SEQ ID NO: 56741 - DNA, 25 bp, Mus musculus
aagctgtgtgaccagctgttgccag

SEQ ID NO: 56742 - DNA, 25 bp, Mus musculus
aagctgtgtgacgagctgttgccag

SEQ ID NO: 56743 - DNA, 25 bp, Mus musculus
aagctgtgtgccctctccattggct

SEQ ID NO: 56744 - DNA, 25 bp, Mus musculus
aagctgtgtgccgtctccattggct

SEQ ID NO: 56745 - DNA, 25 bp, Mus musculus
aagctgtgtgtcctgcacttctctg

SEQ ID NO: 56746 - DNA, 25 bp, Mus musculus
aagctgtgtgtcgtgcacttctctg

SEQ ID NO: 56747 - DNA, 25 bp, Mus musculus
aagctgtgtgtgcagccatctctag

SEQ ID NO: 56748 - DNA, 25 bp, Mus musculus
aagctgtgtgtgctagcaggctaaa

SEQ ID NO: 56749 - DNA, 25 bp, Mus musculus
aagctgtgtgtggagccatctctag

SEQ ID NO: 56750 - DNA, 25 bp, Mus musculus
aagctgtgtgtggtagcaggctaaa

SEQ ID NO: 56751 - DNA, 25 bp, Mus musculus
aagctgtgtgttcataatgaccctc

SEQ ID NO: 56752 - DNA, 25 bp, Mus musculus
aagctgtgtgttgataatgaccctc

SEQ ID NO: 56753 - DNA, 25 bp, Mus musculus
aagctgtgttctcttgtagtctggt

SEQ ID NO: 56754 - DNA, 25 bp, Mus musculus
aagctgtgttctgttgtagtctggt

SEQ ID NO: 56755 - DNA, 25 bp, Mus musculus
aagctgtgttgacattaggttgcca

SEQ ID NO: 56756 - DNA, 25 bp, Mus musculus
aagctgtgttgagattaggttgcca

SEQ ID NO: 56757 - DNA, 25 bp, Mus musculus
aagctgtgttgcatcggcctgtcac

SEQ ID NO: 56758 - DNA, 25 bp, Mus musculus
aagctgtgttgcttcggcctgtcac

SEQ ID NO: 56759 - DNA, 25 bp, Mus musculus
aagctgtgtttacctgcggtttggt

SEQ ID NO: 56760 - DNA, 25 bp, Mus musculus
aagctgtgtttagctgcggtttggt

SEQ ID NO: 56761 - DNA, 25 bp, Mus musculus
aagctgtgtttcacactgcctaagt

SEQ ID NO: 56762 - DNA, 25 bp, Mus musculus
aagctgtgtttctcactgcctaagt

SEQ ID NO: 56763 - DNA, 25 bp, Mus musculus
aagctgttaacaagtttcattgcac

SEQ ID NO: 56764 - DNA, 25 bp, Mus musculus
aagctgttaacatgtttcattgcac

SEQ ID NO: 56765 - DNA, 25 bp, Mus musculus
aagctgttacatctactgtccaatg

SEQ ID NO: 56766 - DNA, 25 bp, Mus musculus
aagctgttacatgtactgtccaatg

SEQ ID NO: 56767 - DNA, 25 bp, Mus musculus
aagctgttactacaaccaatgttcg

SEQ ID NO: 56768 - DNA, 25 bp, Mus musculus
aagctgttactagaaccaatgttcg

SEQ ID NO: 56769 - DNA, 25 bp, Mus musculus
aagctgttactcactgcttggcatc

SEQ ID NO: 56770 - DNA, 25 bp, Mus musculus
aagctgttactctctgcttggcatc

SEQ ID NO: 56771 - DNA, 25 bp, Mus musculus
aagctgttatgtagacccggcttgt

SEQ ID NO: 56772 - DNA, 25 bp, Mus musculus
aagctgttatgttgacccggcttgt

SEQ ID NO: 56773 - DNA, 25 bp, Mus musculus
aagctgttcactctcgatacctgat

SEQ ID NO: 56774 - DNA, 25 bp, Mus musculus
aagctgttcactgtcgatacctgat

SEQ ID NO: 56775 - DNA, 25 bp, Mus musculus
aagctgttcaggctctcactccttt

SEQ ID NO: 56776 - DNA, 25 bp, Mus musculus
aagctgttcagggtctcactccttt

SEQ ID NO: 56777 - DNA, 25 bp, Mus musculus
aagctgttccggattgcttcagaga

SEQ ID NO: 56778 - DNA, 25 bp, Mus musculus
aagctgttccggtttgcttcagaga

SEQ ID NO: 56779 - DNA, 25 bp, Mus musculus
aagctgttctccatcaatgaatgca

SEQ ID NO: 56780 - DNA, 25 bp, Mus musculus
aagctgttctccttcaatgaatgca

SEQ ID NO: 56781 - DNA, 25 bp, Mus musculus
aagctgttctctatccggtcaggga

SEQ ID NO: 56782 - DNA, 25 bp, Mus musculus
aagctgttctctttccggtcaggga

SEQ ID NO: 56783 - DNA, 25 bp, Mus musculus
aagctgttctggctatttttactgt

SEQ ID NO: 56784 - DNA, 25 bp, Mus musculus
aagctgttctgggtatttttactgt

SEQ ID NO: 56785 - DNA, 25 bp, Mus musculus
aagctgttctttctcctgaaacacc

SEQ ID NO: 56786 - DNA, 25 bp, Mus musculus
aagctgttctttgtcctgaaacacc

SEQ ID NO: 56787 - DNA, 25 bp, Mus musculus
aagctgttgaaacagggccaccgca

SEQ ID NO: 56788 - DNA, 25 bp, Mus musculus
aagctgttgaaagagggccaccgca

SEQ ID NO: 56789 - DNA, 25 bp, Mus musculus
aagctgttgacaaactcgttgccta

SEQ ID NO: 56790 - DNA, 25 bp, Mus musculus
aagctgttgacatactcgttgccta

SEQ ID NO: 56791 - DNA, 25 bp, Mus musculus
aagctgttgctactggacgcgccct

SEQ ID NO: 56792 - DNA, 25 bp, Mus musculus
aagctgttgctagtggacgcgccct

SEQ ID NO: 56793 - DNA, 25 bp, Mus musculus
aagctgttgcttaacagcctcgagg

SEQ ID NO: 56794 - DNA, 25 bp, Mus musculus
aagctgttgctttacagcctcgagg

SEQ ID NO: 56795 - DNA, 25 bp, Mus musculus
aagctgttgtccattggaaatacca

SEQ ID NO: 56796 - DNA, 25 bp, Mus musculus
aagctgttgtcctttggaaatacca

SEQ ID NO: 56797 - DNA, 25 bp, Mus musculus
aagctgtttacaatctaactcccac

SEQ ID NO: 56798 - DNA, 25 bp, Mus musculus
aagctgtttacattctaactcccac

SEQ ID NO: 56799 - DNA, 25 bp, Mus musculus
aagctgtttattcagacctgtctat

SEQ ID NO: 56800 - DNA, 25 bp, Mus musculus
aagctgtttattgagacctgtctat

SEQ ID NO: 56801 - DNA, 25 bp, Mus musculus
aagctgtttcccctcaaggctgagt

SEQ ID NO: 56802 - DNA, 25 bp, Mus musculus
aagctgtttcccgtcaaggctgagt

SEQ ID NO: 56803 - DNA, 25 bp, Mus musculus
aagctgtttgacactgaccccatca

SEQ ID NO: 56804 - DNA, 25 bp, Mus musculus
aagctgtttgactctgaccccatca

SEQ ID NO: 56805 - DNA, 25 bp, Mus musculus
aagctgtttgccagggacaacttca

SEQ ID NO: 56806 - DNA, 25 bp, Mus musculus
aagctgtttgcctgggacaacttca

SEQ ID NO: 56807 - DNA, 25 bp, Mus musculus
aagctgtttggcatcgccccacaaa

SEQ ID NO: 56808 - DNA, 25 bp, Mus musculus
aagctgtttggcttcgccccacaaa

SEQ ID NO: 56809 - DNA, 25 bp, Mus musculus
aagctgttttatcttggaaaagaca

SEQ ID NO: 56810 - DNA, 25 bp, Mus musculus
aagctgttttatgttggaaaagaca

SEQ ID NO: 56811 - DNA, 25 bp, Mus musculus
aagctgttttctagctactctctaa

SEQ ID NO: 56812 - DNA, 25 bp, Mus musculus
aagctgttttcttgctactctctaa

SEQ ID NO: 56813 - DNA, 25 bp, Mus musculus
aagctgttttgcacagctcctgtaa

SEQ ID NO: 56814 - DNA, 25 bp, Mus musculus
aagctgttttgctcagctcctgtaa

SEQ ID NO: 56815 - DNA, 25 bp, Mus musculus
aagctgttttgtagtgtgacggtgt

SEQ ID NO: 56816 - DNA, 25 bp, Mus musculus
aagctgttttgttgtgtgacggtgt

SEQ ID NO: 56817 - DNA, 25 bp, Mus musculus
aagcttaaaacgctgtctttgggca

SEQ ID NO: 56818 - DNA, 25 bp, Mus musculus
aagcttaaaacggtgtctttgggca

SEQ ID NO: 56819 - DNA, 25 bp, Mus musculus
aagcttaaacttaattccatctcag

SEQ ID NO: 56820 - DNA, 25 bp, Mus musculus
aagcttaaactttattccatctcag

SEQ ID NO: 56821 - DNA, 25 bp, Mus musculus
aagcttaaatcacctttcagcaagt

SEQ ID NO: 56822 - DNA, 25 bp, Mus musculus
aagcttaaatcagctttcagcaagt

SEQ ID NO: 56823 - DNA, 25 bp, Mus musculus
aagcttaactcgattctacagagga

SEQ ID NO: 56824 - DNA, 25 bp, Mus musculus
aagcttaactcgtttctacagagga

SEQ ID NO: 56825 - DNA, 25 bp, Mus musculus
aagcttaattgcaacctgactggga

SEQ ID NO: 56826 - DNA, 25 bp, Mus musculus
aagcttaattgctacctgactggga

SEQ ID NO: 56827 - DNA, 25 bp, Mus musculus
aagcttaattgtccacatccgcgtc

SEQ ID NO: 56828 - DNA, 25 bp, Mus musculus
aagcttaattgtgcacatccgcgtc

SEQ ID NO: 56829 - DNA, 25 bp, Mus musculus
aagcttacacctccagtcctggttc

SEQ ID NO: 56830 - DNA, 25 bp, Mus musculus
aagcttacacctgcagtcctggttc

SEQ ID NO: 56831 - DNA, 25 bp, Mus musculus
aagcttacactgactgctctggtag

SEQ ID NO: 56832 - DNA, 25 bp, Mus musculus
aagcttacactgtctgctctggtag

SEQ ID NO: 56833 - DNA, 25 bp, Mus musculus
aagcttacacttcgcacagtgctgt

SEQ ID NO: 56834 - DNA, 25 bp, Mus musculus
aagcttacacttggcacagtgctgt

SEQ ID NO: 56835 - DNA, 25 bp, Mus musculus
aagcttacagctagcacgagttcag

SEQ ID NO: 56836 - DNA, 25 bp, Mus musculus
aagcttacagcttgcacgagttcag

SEQ ID NO: 56837 - DNA, 25 bp, Mus musculus
aagcttacagttaggtgaccagaag

SEQ ID NO: 56838 - DNA, 25 bp, Mus musculus
aagcttacagtttggtgaccagaag

SEQ ID NO: 56839 - DNA, 25 bp, Mus musculus
aagcttaccagaattcatgtgacca

SEQ ID NO: 56840 - DNA, 25 bp, Mus musculus
aagcttaccagatttcatgtgacca

SEQ ID NO: 56841 - DNA, 25 bp, Mus musculus
aagcttaccagtcagtctgggctca

SEQ ID NO: 56842 - DNA, 25 bp, Mus musculus
aagcttaccagtgagtctgggctca

SEQ ID NO: 56843 - DNA, 25 bp, Mus musculus
aagcttacccatccaggccagggca

SEQ ID NO: 56844 - DNA, 25 bp, Mus musculus
aagcttacccatgcaggccagggca

SEQ ID NO: 56845 - DNA, 25 bp, Mus musculus
aagcttaccccaagtcctctcatgc

SEQ ID NO: 56846 - DNA, 25 bp, Mus musculus
aagcttaccccatgtcctctcatgc

SEQ ID NO: 56847 - DNA, 25 bp, Mus musculus
aagcttacctatagtcttctgtccc

SEQ ID NO: 56848 - DNA, 25 bp, Mus musculus
aagcttacctattgtcttctgtccc

SEQ ID NO: 56849 - DNA, 25 bp, Mus musculus
aagcttacctccagtgttttggtga

SEQ ID NO: 56850 - DNA, 25 bp, Mus musculus
aagcttacctcctgtgttttggtga

SEQ ID NO: 56851 - DNA, 25 bp, Mus musculus
aagcttacctcgaacctgctgtgga

SEQ ID NO: 56852 - DNA, 25 bp, Mus musculus
aagcttacctcgtacctgctgtgga

SEQ ID NO: 56853 - DNA, 25 bp, Mus musculus
aagcttactcaaaagaattccgtct

SEQ ID NO: 56854 - DNA, 25 bp, Mus musculus
aagcttactcaatagaattccgtct

SEQ ID NO: 56855 - DNA, 25 bp, Mus musculus
aagcttactcatataaagtcagtgt

SEQ ID NO: 56856 - DNA, 25 bp, Mus musculus
aagcttactcatttaaagtcagtgt

SEQ ID NO: 56857 - DNA, 25 bp, Mus musculus
aagcttactcccatcaaatgtcccg

SEQ ID NO: 56858 - DNA, 25 bp, Mus musculus
aagcttactcccttcaaatgtcccg

SEQ ID NO: 56859 - DNA, 25 bp, Mus musculus
aagcttactgttatgttggctccca

SEQ ID NO: 56860 - DNA, 25 bp, Mus musculus
aagcttactgttttgttggctccca

SEQ ID NO: 56861 - DNA, 25 bp, Mus musculus
aagcttacttttcgctctgttactg

SEQ ID NO: 56862 - DNA, 25 bp, Mus musculus
aagcttacttttggctctgttactg

SEQ ID NO: 56863 - DNA, 25 bp, Mus musculus
aagcttagcactcactgtaggatga

SEQ ID NO: 56864 - DNA, 25 bp, Mus musculus
aagcttagcactgactgtaggatga

SEQ ID NO: 56865 - DNA, 25 bp, Mus musculus
aagcttagctcacgatataagtctg

SEQ ID NO: 56866 - DNA, 25 bp, Mus musculus
aagcttagctcaggatataagtctg

SEQ ID NO: 56867 - DNA, 25 bp, Mus musculus
aagcttagctgacggttcatgccac

SEQ ID NO: 56868 - DNA, 25 bp, Mus musculus
aagcttagctgagggttcatgccac

SEQ ID NO: 56869 - DNA, 25 bp, Mus musculus
aagcttaggctaatctgactgggca

SEQ ID NO: 56870 - DNA, 25 bp, Mus musculus
aagcttaggctattctgactgggca

SEQ ID NO: 56871 - DNA, 25 bp, Mus musculus
aagcttagggccagtgtgaggaccc

SEQ ID NO: 56872 - DNA, 25 bp, Mus musculus
aagcttagggcctgtgtgaggaccc

SEQ ID NO: 56873 - DNA, 25 bp, Mus musculus
aagcttagtttgatgggttcataca

SEQ ID NO: 56874 - DNA, 25 bp, Mus musculus
aagcttagtttgttgggttcataca

SEQ ID NO: 56875 - DNA, 25 bp, Mus musculus
aagcttataaaacacgatagtactg

SEQ ID NO: 56876 - DNA, 25 bp, Mus musculus
aagcttataaaagacgatagtactg

SEQ ID NO: 56877 - DNA, 25 bp, Mus musculus
aagcttataggcatgcagtaatccg

SEQ ID NO: 56878 - DNA, 25 bp, Mus musculus
aagcttataggcttgcagtaatccg

SEQ ID NO: 56879 - DNA, 25 bp, Mus musculus
aagcttatatgtcatttccaactag

SEQ ID NO: 56880 - DNA, 25 bp, Mus musculus
aagcttatatgtgatttccaactag

SEQ ID NO: 56881 - DNA, 25 bp, Mus musculus
aagcttatcaagacccggcagacca

SEQ ID NO: 56882 - DNA, 25 bp, Mus musculus
aagcttatcaagtcccggcagacca

SEQ ID NO: 56883 - DNA, 25 bp, Mus musculus
aagcttatgacgcaggctgaccggt

SEQ ID NO: 56884 - DNA, 25 bp, Mus musculus
aagcttatgacggaggctgaccggt

SEQ ID NO: 56885 - DNA, 25 bp, Mus musculus
aagcttatttctatactggagttct

SEQ ID NO: 56886 - DNA, 25 bp, Mus musculus
aagcttatttctttactggagttct

SEQ ID NO: 56887 - DNA, 25 bp, Mus musculus
aagcttatttgccttatcttcctca

SEQ ID NO: 56888 - DNA, 25 bp, Mus musculus
aagcttatttgcgttatcttcctca

SEQ ID NO: 56889 - DNA, 25 bp, Mus musculus
aagcttcaaatacaactacattcag

SEQ ID NO: 56890 - DNA, 25 bp, Mus musculus
aagcttcaaatagaactacattcag

SEQ ID NO: 56891 - DNA, 25 bp, Mus musculus
aagcttcaaccaagcagaggaggaa

SEQ ID NO: 56892 - DNA, 25 bp, Mus musculus
aagcttcaaccaatgaccaagcttg

SEQ ID NO: 56893 - DNA, 25 bp, Mus musculus
aagcttcaaccaatgtaggcttgag

SEQ ID NO: 56894 - DNA, 25 bp, Mus musculus
aagcttcaaccatgcagaggaggaa

SEQ ID NO: 56895 - DNA, 25 bp, Mus musculus
aagcttcaaccattgaccaagcttg

SEQ ID NO: 56896 - DNA, 25 bp, Mus musculus
aagcttcaaccattgtaggcttgag

SEQ ID NO: 56897 - DNA, 25 bp, Mus musculus
aagcttcaaccgcagggagagcctc

SEQ ID NO: 56898 - DNA, 25 bp, Mus musculus
aagcttcaaccggagggagagcctc

SEQ ID NO: 56899 - DNA, 25 bp, Mus musculus
aagcttcaagacagcccaagaacgg

SEQ ID NO: 56900 - DNA, 25 bp, Mus musculus
aagcttcaagactgcccaagaacgg

SEQ ID NO: 56901 - DNA, 25 bp, Mus musculus
aagcttcaagatagttttccctgcc

SEQ ID NO: 56902 - DNA, 25 bp, Mus musculus
aagcttcaagattgttttccctgcc

SEQ ID NO: 56903 - DNA, 25 bp, Mus musculus
aagcttcaagtgctatgctcctgac

SEQ ID NO: 56904 - DNA, 25 bp, Mus musculus
aagcttcaagtggtatgctcctgac

SEQ ID NO: 56905 - DNA, 25 bp, Mus musculus
aagcttcacagcaaaaattcccaaa

SEQ ID NO: 56906 - DNA, 25 bp, Mus musculus
aagcttcacagctaaaattcccaaa

SEQ ID NO: 56907 - DNA, 25 bp, Mus musculus
aagcttcaccttatcagaggacaag

SEQ ID NO: 56908 - DNA, 25 bp, Mus musculus
aagcttcaccttttcagaggacaag

SEQ ID NO: 56909 - DNA, 25 bp, Mus musculus
aagcttcacttcaaccctagattat

SEQ ID NO: 56910 - DNA, 25 bp, Mus musculus
aagcttcacttctaccctagattat

SEQ ID NO: 56911 - DNA, 25 bp, Mus musculus
aagcttcagaaacatcttcctgccc

SEQ ID NO: 56912 - DNA, 25 bp, Mus musculus
aagcttcagaaagatcttcctgccc

SEQ ID NO: 56913 - DNA, 25 bp, Mus musculus
aagcttcagcggcagttttctgaca

SEQ ID NO: 56914 - DNA, 25 bp, Mus musculus
aagcttcagcgggagttttctgaca

SEQ ID NO: 56915 - DNA, 25 bp, Mus musculus
aagcttcagctgacatcctcgtacg

SEQ ID NO: 56916 - DNA, 25 bp, Mus musculus
aagcttcagctgtcatcctcgtacg

SEQ ID NO: 56917 - DNA, 25 bp, Mus musculus
aagcttcagcttatgggacagagta

SEQ ID NO: 56918 - DNA, 25 bp, Mus musculus
aagcttcagcttttgggacagagta

SEQ ID NO: 56919 - DNA, 25 bp, Mus musculus
aagcttcaggccagcagagacctta

SEQ ID NO: 56920 - DNA, 25 bp, Mus musculus
aagcttcaggcctgcagagacctta

SEQ ID NO: 56921 - DNA, 25 bp, Mus musculus
aagcttcagggtacttcattttgac

SEQ ID NO: 56922 - DNA, 25 bp, Mus musculus
aagcttcagggttcttcattttgac

SEQ ID NO: 56923 - DNA, 25 bp, Mus musculus
aagcttcaggttccaagcaggcagt

SEQ ID NO: 56924 - DNA, 25 bp, Mus musculus
aagcttcaggttgcaagcaggcagt

SEQ ID NO: 56925 - DNA, 25 bp, Mus musculus
aagcttcagtcaccgaggcagcctg

SEQ ID NO: 56926 - DNA, 25 bp, Mus musculus
aagcttcagtcagcgaggcagcctg

SEQ ID NO: 56927 - DNA, 25 bp, Mus musculus
aagcttcatacacaaactttccgtg

SEQ ID NO: 56928 - DNA, 25 bp, Mus musculus
aagcttcatacagaaactttccgtg

SEQ ID NO: 56929 - DNA, 25 bp, Mus musculus
aagcttcatcaactaatccaacagg

SEQ ID NO: 56930 - DNA, 25 bp, Mus musculus
aagcttcatcaagtaatccaacagg

SEQ ID NO: 56931 - DNA, 25 bp, Mus musculus
aagcttcatcgaaccattagcagaa

SEQ ID NO: 56932 - DNA, 25 bp, Mus musculus
aagcttcatcgatccattagcagaa

SEQ ID NO: 56933 - DNA, 25 bp, Mus musculus
aagcttcatggtagtggtcccaatg

SEQ ID NO: 56934 - DNA, 25 bp, Mus musculus
aagcttcatggttgtggtcccaatg

SEQ ID NO: 56935 - DNA, 25 bp, Mus musculus
aagcttcatgtcctcaattcaatcc

SEQ ID NO: 56936 - DNA, 25 bp, Mus musculus
aagcttcatgtcgtcaattcaatcc

SEQ ID NO: 56937 - DNA, 25 bp, Mus musculus
aagcttcattgacctactgtcctct

SEQ ID NO: 56938 - DNA, 25 bp, Mus musculus
aagcttcattgacctaggctctttg

SEQ ID NO: 56939 - DNA, 25 bp, Mus musculus
aagcttcattgagctactgtcctct

SEQ ID NO: 56940 - DNA, 25 bp, Mus musculus
aagcttcattgagctaggctctttg

SEQ ID NO: 56941 - DNA, 25 bp, Mus musculus
aagcttccaattactcctaagcgta

SEQ ID NO: 56942 - DNA, 25 bp, Mus musculus
aagcttccaatttctcctaagcgta

SEQ ID NO: 56943 - DNA, 25 bp, Mus musculus
aagcttccacagctaagtggctgga

SEQ ID NO: 56944 - DNA, 25 bp, Mus musculus
aagcttccacaggtaagtggctgga

SEQ ID NO: 56945 - DNA, 25 bp, Mus musculus
aagcttccagagcactcgagaaaaa

SEQ ID NO: 56946 - DNA, 25 bp, Mus musculus
aagcttccagaggactcgagaaaaa

SEQ ID NO: 56947 - DNA, 25 bp, Mus musculus
aagcttccaggaacactaccatgaa

SEQ ID NO: 56948 - DNA, 25 bp, Mus musculus
aagcttccaggatcactaccatgaa

SEQ ID NO: 56949 - DNA, 25 bp, Mus musculus
aagcttccccagagtggcacacttg

SEQ ID NO: 56950 - DNA, 25 bp, Mus musculus
aagcttccccagtgtggcacacttg

SEQ ID NO: 56951 - DNA, 25 bp, Mus musculus
aagcttcccctaatagtcacctatt

SEQ ID NO: 56952 - DNA, 25 bp, Mus musculus
aagcttcccctattagtcacctatt

SEQ ID NO: 56953 - DNA, 25 bp, Mus musculus
aagcttccccttatatactcttaga

SEQ ID NO: 56954 - DNA, 25 bp, Mus musculus
aagcttccccttttatactcttaga

SEQ ID NO: 56955 - DNA, 25 bp, Mus musculus
aagcttcccttccattttcatgaga

SEQ ID NO: 56956 - DNA, 25 bp, Mus musculus
aagcttcccttcgattttcatgaga

SEQ ID NO: 56957 - DNA, 25 bp, Mus musculus
aagcttccctttcactggctccaaa

SEQ ID NO: 56958 - DNA, 25 bp, Mus musculus
aagcttccctttgactggctccaaa

SEQ ID NO: 56959 - DNA, 25 bp, Mus musculus
aagcttccgaagatcttctcaagga

SEQ ID NO: 56960 - DNA, 25 bp, Mus musculus
aagcttccgaagttcttctcaagga

SEQ ID NO: 56961 - DNA, 25 bp, Mus musculus
aagcttccgccacgattcaagtatg

SEQ ID NO: 56962 - DNA, 25 bp, Mus musculus
aagcttccgccaggattcaagtatg

SEQ ID NO: 56963 - DNA, 25 bp, Mus musculus
aagcttccgcttagaaacaaacaga

SEQ ID NO: 56964 - DNA, 25 bp, Mus musculus
aagcttccgctttgaaacaaacaga

SEQ ID NO: 56965 - DNA, 25 bp, Mus musculus
aagcttccggacacacaggcggcaa

SEQ ID NO: 56966 - DNA, 25 bp, Mus musculus
aagcttccggactcacaggcggcaa

SEQ ID NO: 56967 - DNA, 25 bp, Mus musculus
aagcttccgtttctgcagtttttat

SEQ ID NO: 56968 - DNA, 25 bp, Mus musculus
aagcttccgtttgtgcagtttttat

SEQ ID NO: 56969 - DNA, 25 bp, Mus musculus
aagcttcctagcaggaggtatgatc

SEQ ID NO: 56970 - DNA, 25 bp, Mus musculus
aagcttcctagctggaggtatgatc

SEQ ID NO: 56971 - DNA, 25 bp, Mus musculus
aagcttcctctgatgccttttttct

SEQ ID NO: 56972 - DNA, 25 bp, Mus musculus
aagcttcctctgttgccttttttct

SEQ ID NO: 56973 - DNA, 25 bp, Mus musculus
aagcttcctggacctcattttaaca

SEQ ID NO: 56974 - DNA, 25 bp, Mus musculus
aagcttcctggagctcattttaaca

SEQ ID NO: 56975 - DNA, 25 bp, Mus musculus
aagcttcctgtaagtgcatccaggc

SEQ ID NO: 56976 - DNA, 25 bp, Mus musculus
aagcttcctgtatgtgcatccaggc

SEQ ID NO: 56977 - DNA, 25 bp, Mus musculus
aagcttcctgtgaaacaatggctcc

SEQ ID NO: 56978 - DNA, 25 bp, Mus musculus
aagcttcctgtgtaacaatggctcc

SEQ ID NO: 56979 - DNA, 25 bp, Mus musculus
aagcttccttgacaactgcctgaag

SEQ ID NO: 56980 - DNA, 25 bp, Mus musculus
aagcttccttgagaactgcctgaag

SEQ ID NO: 56981 - DNA, 25 bp, Mus musculus
aagcttccttgccttggtatcagat

SEQ ID NO: 56982 - DNA, 25 bp, Mus musculus
aagcttccttgcgttggtatcagat

SEQ ID NO: 56983 - DNA, 25 bp, Mus musculus
aagcttcgagatctcattgcccagt

SEQ ID NO: 56984 - DNA, 25 bp, Mus musculus
aagcttcgagatgtcattgcccagt

SEQ ID NO: 56985 - DNA, 25 bp, Mus musculus
aagcttcgagtacttccctgtgctc

SEQ ID NO: 56986 - DNA, 25 bp, Mus musculus
aagcttcgagtagttccctgtgctc

SEQ ID NO: 56987 - DNA, 25 bp, Mus musculus
aagcttcgattcagtgtgtggtggt

SEQ ID NO: 56988 - DNA, 25 bp, Mus musculus
aagcttcgattctgtgtgtggtggt

SEQ ID NO: 56989 - DNA, 25 bp, Mus musculus
aagcttcggaacaagatagccggct

SEQ ID NO: 56990 - DNA, 25 bp, Mus musculus
aagcttcggaactagatagccggct

SEQ ID NO: 56991 - DNA, 25 bp, Mus musculus
aagcttcgtggaacggtgtcaggaa

SEQ ID NO: 56992 - DNA, 25 bp, Mus musculus
aagcttcgtggaagacagtcactga

SEQ ID NO: 56993 - DNA, 25 bp, Mus musculus
aagcttcgtggatcggtgtcaggaa

SEQ ID NO: 56994 - DNA, 25 bp, Mus musculus
aagcttcgtggatgacagtcactga

SEQ ID NO: 56995 - DNA, 25 bp, Mus musculus
aagcttctacaaccaggcaggccag

SEQ ID NO: 56996 - DNA, 25 bp, Mus musculus
aagcttctacaagcaggcaggccag

SEQ ID NO: 56997 - DNA, 25 bp, Mus musculus
aagcttctactgatactatatgcat

SEQ ID NO: 56998 - DNA, 25 bp, Mus musculus
aagcttctactgttactatatgcat

SEQ ID NO: 56999 - DNA, 25 bp, Mus musculus
aagcttctacttacctctctgaata

SEQ ID NO: 57000 - DNA, 25 bp, Mus musculus
aagcttctactttcctctctgaata

SEQ ID NO: 57001 - DNA, 25 bp, Mus musculus
aagcttctagtcagactgagtcccc

SEQ ID NO: 57002 - DNA, 25 bp, Mus musculus
aagcttctagtctgactgagtcccc

SEQ ID NO: 57003 - DNA, 25 bp, Mus musculus
aagcttctcaggaggcacagtttct

SEQ ID NO: 57004 - DNA, 25 bp, Mus musculus
aagcttctcaggtggcacagtttct

SEQ ID NO: 57005 - DNA, 25 bp, Mus musculus
aagcttctcccgatgagagtcacta

SEQ ID NO: 57006 - DNA, 25 bp, Mus musculus
aagcttctcccgttgagagtcacta

SEQ ID NO: 57007 - DNA, 25 bp, Mus musculus
aagcttctcctacttgaacgaattg

SEQ ID NO: 57008 - DNA, 25 bp, Mus musculus
aagcttctcctagttgaacgaattg

SEQ ID NO: 57009 - DNA, 25 bp, Mus musculus
aagcttctcgtactgtttggtgtat

SEQ ID NO: 57010 - DNA, 25 bp, Mus musculus
aagcttctcgtagtgtttggtgtat

SEQ ID NO: 57011 - DNA, 25 bp, Mus musculus
aagcttctctgaaatttcaccctgc

SEQ ID NO: 57012 - DNA, 25 bp, Mus musculus
aagcttctctgatatttcaccctgc

SEQ ID NO: 57013 - DNA, 25 bp, Mus musculus
aagcttctctggcacctggttatgg

SEQ ID NO: 57014 - DNA, 25 bp, Mus musculus
aagcttctctgggacctggttatgg

SEQ ID NO: 57015 - DNA, 25 bp, Mus musculus
aagcttctgaagaggcttgacaatg

SEQ ID NO: 57016 - DNA, 25 bp, Mus musculus
aagcttctgaagtggcttgacaatg

SEQ ID NO: 57017 - DNA, 25 bp, Mus musculus
aagcttctgaatacctacttggaaa

SEQ ID NO: 57018 - DNA, 25 bp, Mus musculus
aagcttctgaattcctacttggaaa

SEQ ID NO: 57019 - DNA, 25 bp, Mus musculus
aagcttctgacaaattgtgcatatc

SEQ ID NO: 57020 - DNA, 25 bp, Mus musculus
aagcttctgacatattgtgcatatc

SEQ ID NO: 57021 - DNA, 25 bp, Mus musculus
aagcttctgccccaagttcttcagg

SEQ ID NO: 57022 - DNA, 25 bp, Mus musculus
aagcttctgcccgaagttcttcagg

SEQ ID NO: 57023 - DNA, 25 bp, Mus musculus
aagcttctgtctctggttgtttcct

SEQ ID NO: 57024 - DNA, 25 bp, Mus musculus
aagcttctgtctgtggttgtttcct

SEQ ID NO: 57025 - DNA, 25 bp, Mus musculus
aagcttctgttcatagcttggctca

SEQ ID NO: 57026 - DNA, 25 bp, Mus musculus
aagcttctgttcttagcttggctca

SEQ ID NO: 57027 - DNA, 25 bp, Mus musculus
aagcttcttacgaccaagatcgggt

SEQ ID NO: 57028 - DNA, 25 bp, Mus musculus
aagcttcttacgtccaagatcgggt

SEQ ID NO: 57029 - DNA, 25 bp, Mus musculus
aagcttcttctgatcgttgtgggtt

SEQ ID NO: 57030 - DNA, 25 bp, Mus musculus
aagcttcttctgttcgttgtgggtt

SEQ ID NO: 57031 - DNA, 25 bp, Mus musculus
aagcttcttgcaacagcctcagatg

SEQ ID NO: 57032 - DNA, 25 bp, Mus musculus
aagcttcttgcatcagcctcagatg

SEQ ID NO: 57033 - DNA, 25 bp, Mus musculus
aagcttcttggacagagggccttat

SEQ ID NO: 57034 - DNA, 25 bp, Mus musculus
aagcttcttggagagagggccttat

SEQ ID NO: 57035 - DNA, 25 bp, Mus musculus
aagcttgaccacaggctcgctgtgt

SEQ ID NO: 57036 - DNA, 25 bp, Mus musculus
aagcttgaccactggctcgctgtgt

SEQ ID NO: 57037 - DNA, 25 bp, Mus musculus
aagcttgacggcactcagaccggtg

SEQ ID NO: 57038 - DNA, 25 bp, Mus musculus
aagcttgacggctctcagaccggtg

SEQ ID NO: 57039 - DNA, 25 bp, Mus musculus
aagcttgactacagacatgctcgcc

SEQ ID NO: 57040 - DNA, 25 bp, Mus musculus
aagcttgactactgacatgctcgcc

SEQ ID NO: 57041 - DNA, 25 bp, Mus musculus
aagcttgagacccacttgagcatca

SEQ ID NO: 57042 - DNA, 25 bp, Mus musculus
aagcttgagaccgacttgagcatca

SEQ ID NO: 57043 - DNA, 25 bp, Mus musculus
aagcttgagactattgagcaactta

SEQ ID NO: 57044 - DNA, 25 bp, Mus musculus
aagcttgagacttttgagcaactta

SEQ ID NO: 57045 - DNA, 25 bp, Mus musculus
aagcttgagcacatgtgtcctggaa

SEQ ID NO: 57046 - DNA, 25 bp, Mus musculus
aagcttgagcacttgtgtcctggaa

SEQ ID NO: 57047 - DNA, 25 bp, Mus musculus
aagcttgaggatactccagacacct

SEQ ID NO: 57048 - DNA, 25 bp, Mus musculus
aagcttgaggattctccagacacct

SEQ ID NO: 57049 - DNA, 25 bp, Mus musculus
aagcttgaggccacacatactagag

SEQ ID NO: 57050 - DNA, 25 bp, Mus musculus
aagcttgaggcctcacatactagag

SEQ ID NO: 57051 - DNA, 25 bp, Mus musculus
aagcttgagggacagggcccatctt

SEQ ID NO: 57052 - DNA, 25 bp, Mus musculus
aagcttgagggagagggcccatctt

SEQ ID NO: 57053 - DNA, 25 bp, Mus musculus
aagcttgataccatcagttgggcat

SEQ ID NO: 57054 - DNA, 25 bp, Mus musculus
aagcttgataccttcagttgggcat

SEQ ID NO: 57055 - DNA, 25 bp, Mus musculus
aagcttgatcccaaacatctttact

SEQ ID NO: 57056 - DNA, 25 bp, Mus musculus
aagcttgatccctaacatctttact

SEQ ID NO: 57057 - DNA, 25 bp, Mus musculus
aagcttgatgtgaagtcctctagaa

SEQ ID NO: 57058 - DNA, 25 bp, Mus musculus
aagcttgatgtgtagtcctctagaa

SEQ ID NO: 57059 - DNA, 25 bp, Mus musculus
aagcttgatttcagcaccacggata

SEQ ID NO: 57060 - DNA, 25 bp, Mus musculus
aagcttgatttctgcaccacggata

SEQ ID NO: 57061 - DNA, 25 bp, Mus musculus
aagcttgcaagcagcaagtgtgctc

SEQ ID NO: 57062 - DNA, 25 bp, Mus musculus
aagcttgcaagctgcaagtgtgctc

SEQ ID NO: 57063 - DNA, 25 bp, Mus musculus
aagcttgcaaggcaagcttccccaa

SEQ ID NO: 57064 - DNA, 25 bp, Mus musculus
aagcttgcaagggaagcttccccaa

SEQ ID NO: 57065 - DNA, 25 bp, Mus musculus
aagcttgcaagtcgaatcctgggaa

SEQ ID NO: 57066 - DNA, 25 bp, Mus musculus
aagcttgcaagtggaatcctgggaa

SEQ ID NO: 57067 - DNA, 25 bp, Mus musculus
aagcttgcaatgagaaatcccttct

SEQ ID NO: 57068 - DNA, 25 bp, Mus musculus
aagcttgcaatgtgaaatcccttct

SEQ ID NO: 57069 - DNA, 25 bp, Mus musculus
aagcttgcaccacgtctgtttctgt

SEQ ID NO: 57070 - DNA, 25 bp, Mus musculus
aagcttgcaccaggtctgtttctgt

SEQ ID NO: 57071 - DNA, 25 bp, Mus musculus
aagcttgcagacaagggagccgccc

SEQ ID NO: 57072 - DNA, 25 bp, Mus musculus
aagcttgcagactagggagccgccc

SEQ ID NO: 57073 - DNA, 25 bp, Mus musculus
aagcttgcagtgacctgtgggtcat

SEQ ID NO: 57074 - DNA, 25 bp, Mus musculus
aagcttgcagtgtcctgtgggtcat

SEQ ID NO: 57075 - DNA, 25 bp, Mus musculus
aagcttgccaggcacttgcagctgg

SEQ ID NO: 57076 - DNA, 25 bp, Mus musculus
aagcttgccagggacttgcagctgg

SEQ ID NO: 57077 - DNA, 25 bp, Mus musculus
aagcttgccatgatgactggtgtcc

SEQ ID NO: 57078 - DNA, 25 bp, Mus musculus
aagcttgccatgttgactggtgtcc

SEQ ID NO: 57079 - DNA, 25 bp, Mus musculus
aagcttgccggtagtgttgctttga

SEQ ID NO: 57080 - DNA, 25 bp, Mus musculus
aagcttgccggttgtgttgctttga

SEQ ID NO: 57081 - DNA, 25 bp, Mus musculus
aagcttgcctgacggcttctgtttc

SEQ ID NO: 57082 - DNA, 25 bp, Mus musculus
aagcttgcctgagggcttctgtttc

SEQ ID NO: 57083 - DNA, 25 bp, Mus musculus
aagcttgccttccaggcggctgtat

SEQ ID NO: 57084 - DNA, 25 bp, Mus musculus
aagcttgccttcgaggcggctgtat

SEQ ID NO: 57085 - DNA, 25 bp, Mus musculus
aagcttgcgcttctttgttgcagta

SEQ ID NO: 57086 - DNA, 25 bp, Mus musculus
aagcttgcgcttgtttgttgcagta

SEQ ID NO: 57087 - DNA, 25 bp, Mus musculus
aagcttgctatccagcctatccagt

SEQ ID NO: 57088 - DNA, 25 bp, Mus musculus
aagcttgctatcgagcctatccagt

SEQ ID NO: 57089 - DNA, 25 bp, Mus musculus
aagcttgctcaccaattcctctttt

SEQ ID NO: 57090 - DNA, 25 bp, Mus musculus
aagcttgctcacgaattcctctttt

SEQ ID NO: 57091 - DNA, 25 bp, Mus musculus
aagcttgctcttctcctatgtgagg

SEQ ID NO: 57092 - DNA, 25 bp, Mus musculus
aagcttgctcttgtcctatgtgagg

SEQ ID NO: 57093 - DNA, 25 bp, Mus musculus
aagcttgctgcacatacatgagaca

SEQ ID NO: 57094 - DNA, 25 bp, Mus musculus
aagcttgctgcagatacatgagaca

SEQ ID NO: 57095 - DNA, 25 bp, Mus musculus
aagcttgctggcaggtgcacacatg

SEQ ID NO: 57096 - DNA, 25 bp, Mus musculus
aagcttgctggctggtgcacacatg

SEQ ID NO: 57097 - DNA, 25 bp, Mus musculus
aagcttgctggtactattctggcag

SEQ ID NO: 57098 - DNA, 25 bp, Mus musculus
aagcttgctggttctattctggcag

SEQ ID NO: 57099 - DNA, 25 bp, Mus musculus
aagcttgcttctaactataaaggta

SEQ ID NO: 57100 - DNA, 25 bp, Mus musculus
aagcttgcttctcttctcattttgc

SEQ ID NO: 57101 - DNA, 25 bp, Mus musculus
aagcttgcttctgttctcattttgc

SEQ ID NO: 57102 - DNA, 25 bp, Mus musculus
aagcttgcttcttactataaaggta

SEQ ID NO: 57103 - DNA, 25 bp, Mus musculus
aagcttgcttggattctagactgaa

SEQ ID NO: 57104 - DNA, 25 bp, Mus musculus
aagcttgcttggtttctagactgaa

SEQ ID NO: 57105 - DNA, 25 bp, Mus musculus
aagcttgctttccactgacactcag

SEQ ID NO: 57106 - DNA, 25 bp, Mus musculus
aagcttgctttcgactgacactcag

SEQ ID NO: 57107 - DNA, 25 bp, Mus musculus
aagcttgctttgcagggcagacacc

SEQ ID NO: 57108 - DNA, 25 bp, Mus musculus
aagcttgctttggagggcagacacc

SEQ ID NO: 57109 - DNA, 25 bp, Mus musculus
aagcttggacccattcattaacctg

SEQ ID NO: 57110 - DNA, 25 bp, Mus musculus
aagcttggaccctttcattaacctg

SEQ ID NO: 57111 - DNA, 25 bp, Mus musculus
aagcttggagcacttctcaggccag

SEQ ID NO: 57112 - DNA, 25 bp, Mus musculus
aagcttggagcagttctcaggccag

SEQ ID NO: 57113 - DNA, 25 bp, Mus musculus
aagcttggccaacgtgtccaccatg

SEQ ID NO: 57114 - DNA, 25 bp, Mus musculus
aagcttggccaaggtgtccaccatg

SEQ ID NO: 57115 - DNA, 25 bp, Mus musculus
aagcttggcccaagtatttgaccca

SEQ ID NO: 57116 - DNA, 25 bp, Mus musculus
aagcttggcccatgtatttgaccca

SEQ ID NO: 57117 - DNA, 25 bp, Mus musculus
aagcttggcccgcacctgatgggta

SEQ ID NO: 57118 - DNA, 25 bp, Mus musculus
aagcttggcccggacctgatgggta

SEQ ID NO: 57119 - DNA, 25 bp, Mus musculus
aagcttggccctctgccctgtagtg

SEQ ID NO: 57120 - DNA, 25 bp, Mus musculus
aagcttggccctgtgccctgtagtg

SEQ ID NO: 57121 - DNA, 25 bp, Mus musculus
aagcttggctaaccctcctggtgcg

SEQ ID NO: 57122 - DNA, 25 bp, Mus musculus
aagcttggctaagcctcctggtgcg

SEQ ID NO: 57123 - DNA, 25 bp, Mus musculus
aagcttggctagactgaactggact

SEQ ID NO: 57124 - DNA, 25 bp, Mus musculus
aagcttggctagtctgaactggact

SEQ ID NO: 57125 - DNA, 25 bp, Mus musculus
aagcttggcttaaggctgcacgcct

SEQ ID NO: 57126 - DNA, 25 bp, Mus musculus
aagcttggcttatggctgcacgcct

SEQ ID NO: 57127 - DNA, 25 bp, Mus musculus
aagcttggcttgctgtaaatgtgtt

SEQ ID NO: 57128 - DNA, 25 bp, Mus musculus
aagcttggcttggtgtaaatgtgtt

SEQ ID NO: 57129 - DNA, 25 bp, Mus musculus
aagcttgggactcggaacgcattct

SEQ ID NO: 57130 - DNA, 25 bp, Mus musculus
aagcttgggactgggaacgcattct

SEQ ID NO: 57131 - DNA, 25 bp, Mus musculus
aagcttgggcccatttctagcttct

SEQ ID NO: 57132 - DNA, 25 bp, Mus musculus
aagcttgggcccttttctagcttct

SEQ ID NO: 57133 - DNA, 25 bp, Mus musculus
aagcttgggtaccaggcttgcatgt

SEQ ID NO: 57134 - DNA, 25 bp, Mus musculus
aagcttgggtacgaggcttgcatgt

SEQ ID NO: 57135 - DNA, 25 bp, Mus musculus
aagcttgggtagcaacacctttgag

SEQ ID NO: 57136 - DNA, 25 bp, Mus musculus
aagcttgggtaggaacacctttgag

SEQ ID NO: 57137 - DNA, 25 bp, Mus musculus
aagcttgggtgcatggtcaccacct

SEQ ID NO: 57138 - DNA, 25 bp, Mus musculus
aagcttgggtgcttggtcaccacct

SEQ ID NO: 57139 - DNA, 25 bp, Mus musculus
aagcttgggtttcagagtccattcc

SEQ ID NO: 57140 - DNA, 25 bp, Mus musculus
aagcttgggtttgagagtccattcc

SEQ ID NO: 57141 - DNA, 25 bp, Mus musculus
aagcttggtcaactatggccaccag

SEQ ID NO: 57142 - DNA, 25 bp, Mus musculus
aagcttggtcaagtatggccaccag

SEQ ID NO: 57143 - DNA, 25 bp, Mus musculus
aagcttggtcttctatagtgggctc

SEQ ID NO: 57144 - DNA, 25 bp, Mus musculus
aagcttggtcttgtatagtgggctc

SEQ ID NO: 57145 - DNA, 25 bp, Mus musculus
aagcttggtgctcagctgttcagac

SEQ ID NO: 57146 - DNA, 25 bp, Mus musculus
aagcttggtgctgagctgttcagac

SEQ ID NO: 57147 - DNA, 25 bp, Mus musculus
aagcttggtggtcgcttttgcaaca

SEQ ID NO: 57148 - DNA, 25 bp, Mus musculus
aagcttggtggtggcttttgcaaca

SEQ ID NO: 57149 - DNA, 25 bp, Mus musculus
aagcttggtgttcgcactcaagcgc

SEQ ID NO: 57150 - DNA, 25 bp, Mus musculus
aagcttggtgttggcactcaagcgc

SEQ ID NO: 57151 - DNA, 25 bp, Mus musculus
aagcttggttacactaagacacagg

SEQ ID NO: 57152 - DNA, 25 bp, Mus musculus
aagcttggttactctaagacacagg

SEQ ID NO: 57153 - DNA, 25 bp, Mus musculus
aagcttgtatccctttgtgatttct

SEQ ID NO: 57154 - DNA, 25 bp, Mus musculus
aagcttgtatccgtttgtgatttct

SEQ ID NO: 57155 - DNA, 25 bp, Mus musculus
aagcttgtatctctgaatttgcaac

SEQ ID NO: 57156 - DNA, 25 bp, Mus musculus
aagcttgtatctgtgaatttgcaac

SEQ ID NO: 57157 - DNA, 25 bp, Mus musculus
aagcttgtatggacgctgcctgtca

SEQ ID NO: 57158 - DNA, 25 bp, Mus musculus
aagcttgtatggtcgctgcctgtca

SEQ ID NO: 57159 - DNA, 25 bp, Mus musculus
aagcttgtccaacttaggcgagtcc

SEQ ID NO: 57160 - DNA, 25 bp, Mus musculus
aagcttgtccaagttaggcgagtcc

SEQ ID NO: 57161 - DNA, 25 bp, Mus musculus
aagcttgtccccagttggtaaagca

SEQ ID NO: 57162 - DNA, 25 bp, Mus musculus
aagcttgtcccctgttggtaaagca

SEQ ID NO: 57163 - DNA, 25 bp, Mus musculus
aagcttgtcgtaagaaagccagcca

SEQ ID NO: 57164 - DNA, 25 bp, Mus musculus
aagcttgtcgtatgaaagccagcca

SEQ ID NO: 57165 - DNA, 25 bp, Mus musculus
aagcttgtctcaatgacggtgctca

SEQ ID NO: 57166 - DNA, 25 bp, Mus musculus
aagcttgtctcaatggctgtttgct

SEQ ID NO: 57167 - DNA, 25 bp, Mus musculus
aagcttgtctcattgacggtgctca

SEQ ID NO: 57168 - DNA, 25 bp, Mus musculus
aagcttgtctcattggctgtttgct

SEQ ID NO: 57169 - DNA, 25 bp, Mus musculus
aagcttgtgacaagcatttcctggg

SEQ ID NO: 57170 - DNA, 25 bp, Mus musculus
aagcttgtgacatgcatttcctggg

SEQ ID NO: 57171 - DNA, 25 bp, Mus musculus
aagcttgtgcacatctggtatccca

SEQ ID NO: 57172 - DNA, 25 bp, Mus musculus
aagcttgtgcacttctggtatccca

SEQ ID NO: 57173 - DNA, 25 bp, Mus musculus
aagcttgtgcctcttactcagctgt

SEQ ID NO: 57174 - DNA, 25 bp, Mus musculus
aagcttgtgcctgttactcagctgt

SEQ ID NO: 57175 - DNA, 25 bp, Mus musculus
aagcttgtggcaacggaagtctgga

SEQ ID NO: 57176 - DNA, 25 bp, Mus musculus
aagcttgtggcaacttgggcagagt

SEQ ID NO: 57177 - DNA, 25 bp, Mus musculus
aagcttgtggcatcggaagtctgga

SEQ ID NO: 57178 - DNA, 25 bp, Mus musculus
aagcttgtggcatcttgggcagagt

SEQ ID NO: 57179 - DNA, 25 bp, Mus musculus
aagcttgtggctatgactatcgtgg

SEQ ID NO: 57180 - DNA, 25 bp, Mus musculus
aagcttgtggctttgactatcgtgg

SEQ ID NO: 57181 - DNA, 25 bp, Mus musculus
aagcttgtgtaccttacctgtatgc

SEQ ID NO: 57182 - DNA, 25 bp, Mus musculus
aagcttgtgtacgttacctgtatgc

SEQ ID NO: 57183 - DNA, 25 bp, Mus musculus
aagcttgtgtccaatgccttcagaa

SEQ ID NO: 57184 - DNA, 25 bp, Mus musculus
aagcttgtgtcctatgccttcagaa

SEQ ID NO: 57185 - DNA, 25 bp, Mus musculus
aagcttgtgtgcctgtctacactgg

SEQ ID NO: 57186 - DNA, 25 bp, Mus musculus
aagcttgtgtgcgtgtctacactgg

SEQ ID NO: 57187 - DNA, 25 bp, Mus musculus
aagcttgtgttcagtactgttggag

SEQ ID NO: 57188 - DNA, 25 bp, Mus musculus
aagcttgtgttctgtactgttggag

SEQ ID NO: 57189 - DNA, 25 bp, Mus musculus
aagcttgtgtttcccaggcctggga

SEQ ID NO: 57190 - DNA, 25 bp, Mus musculus
aagcttgtgtttctctgggtttcac

SEQ ID NO: 57191 - DNA, 25 bp, Mus musculus
aagcttgtgtttgccaggcctggga

SEQ ID NO: 57192 - DNA, 25 bp, Mus musculus
aagcttgtgtttgtctgggtttcac

SEQ ID NO: 57193 - DNA, 25 bp, Mus musculus
aagcttgttaagatcctgagccata

SEQ ID NO: 57194 - DNA, 25 bp, Mus musculus
aagcttgttaagttcctgagccata

SEQ ID NO: 57195 - DNA, 25 bp, Mus musculus
aagcttgttcttaagtcacgatgac

SEQ ID NO: 57196 - DNA, 25 bp, Mus musculus
aagcttgttctttagtcacgatgac

SEQ ID NO: 57197 - DNA, 25 bp, Mus musculus
aagcttgtttccaacaatgtcatag

SEQ ID NO: 57198 - DNA, 25 bp, Mus musculus
aagcttgtttcctacaatgtcatag

SEQ ID NO: 57199 - DNA, 25 bp, Mus musculus
aagctttaagttcgccgtgttctgg

SEQ ID NO: 57200 - DNA, 25 bp, Mus musculus
aagctttaagttggccgtgttctgg

SEQ ID NO: 57201 - DNA, 25 bp, Mus musculus
aagctttacatgctattatgggtga

SEQ ID NO: 57202 - DNA, 25 bp, Mus musculus
aagctttacatggtattatgggtga

SEQ ID NO: 57203 - DNA, 25 bp, Mus musculus
aagctttaccgactcatctaatcac

SEQ ID NO: 57204 - DNA, 25 bp, Mus musculus
aagctttaccgagtcatctaatcac

SEQ ID NO: 57205 - DNA, 25 bp, Mus musculus
aagctttaccgtcatgcctgacatg

SEQ ID NO: 57206 - DNA, 25 bp, Mus musculus
aagctttaccgtgatgcctgacatg

SEQ ID NO: 57207 - DNA, 25 bp, Mus musculus
aagctttactttacattaacagtct

SEQ ID NO: 57208 - DNA, 25 bp, Mus musculus
aagctttacttttcattaacagtct

SEQ ID NO: 57209 - DNA, 25 bp, Mus musculus
aagctttagagtccaagccgtgcca

SEQ ID NO: 57210 - DNA, 25 bp, Mus musculus
aagctttagagtgcaagccgtgcca

SEQ ID NO: 57211 - DNA, 25 bp, Mus musculus
aagctttagggcacttctcaggtgt

SEQ ID NO: 57212 - DNA, 25 bp, Mus musculus
aagctttagggcatcgactttccat

SEQ ID NO: 57213 - DNA, 25 bp, Mus musculus
aagctttagggctcttctcaggtgt

SEQ ID NO: 57214 - DNA, 25 bp, Mus musculus
aagctttagggcttcgactttccat

SEQ ID NO: 57215 - DNA, 25 bp, Mus musculus
aagctttagtcaccacaggcctagc

SEQ ID NO: 57216 - DNA, 25 bp, Mus musculus
aagctttagtcagcacaggcctagc

SEQ ID NO: 57217 - DNA, 25 bp, Mus musculus
aagctttatagtcctggctccttgg

SEQ ID NO: 57218 - DNA, 25 bp, Mus musculus
aagctttatagtgctggctccttgg

SEQ ID NO: 57219 - DNA, 25 bp, Mus musculus
aagctttatcataggtgtgtggtat

SEQ ID NO: 57220 - DNA, 25 bp, Mus musculus
aagctttatcattggtgtgtggtat

SEQ ID NO: 57221 - DNA, 25 bp, Mus musculus
aagctttatcttagtctccttctga

SEQ ID NO: 57222 - DNA, 25 bp, Mus musculus
aagctttatctttgtctccttctga

SEQ ID NO: 57223 - DNA, 25 bp, Mus musculus
aagctttatgggaaagtgtccacaa

SEQ ID NO: 57224 - DNA, 25 bp, Mus musculus
aagctttatgggtaagtgtccacaa

SEQ ID NO: 57225 - DNA, 25 bp, Mus musculus
aagctttcaaaccacagtacccagg

SEQ ID NO: 57226 - DNA, 25 bp, Mus musculus
aagctttcaaacgacagtacccagg

SEQ ID NO: 57227 - DNA, 25 bp, Mus musculus
aagctttcactacttcaagtgcccg

SEQ ID NO: 57228 - DNA, 25 bp, Mus musculus
aagctttcactagttcaagtgcccg

SEQ ID NO: 57229 - DNA, 25 bp, Mus musculus
aagctttcactgagtaccggcattg

SEQ ID NO: 57230 - DNA, 25 bp, Mus musculus
aagctttcactgtgtaccggcattg

SEQ ID NO: 57231 - DNA, 25 bp, Mus musculus
aagctttcagaactgtttctaccaa

SEQ ID NO: 57232 - DNA, 25 bp, Mus musculus
aagctttcagaagtgtttctaccaa

SEQ ID NO: 57233 - DNA, 25 bp, Mus musculus
aagctttcagacacttctcataatg

SEQ ID NO: 57234 - DNA, 25 bp, Mus musculus
aagctttcagactcttctcataatg

SEQ ID NO: 57235 - DNA, 25 bp, Mus musculus
aagctttcatggctatggtcttgcc

SEQ ID NO: 57236 - DNA, 25 bp, Mus musculus
aagctttcatgggtatggtcttgcc

SEQ ID NO: 57237 - DNA, 25 bp, Mus musculus
aagctttccggacgcaagaccacct

SEQ ID NO: 57238 - DNA, 25 bp, Mus musculus
aagctttccggaggcaagaccacct

SEQ ID NO: 57239 - DNA, 25 bp, Mus musculus
aagctttccgggaggaggccattca

SEQ ID NO: 57240 - DNA, 25 bp, Mus musculus
aagctttccgggtggaggccattca

SEQ ID NO: 57241 - DNA, 25 bp, Mus musculus
aagctttctattctgcaaaactatt

SEQ ID NO: 57242 - DNA, 25 bp, Mus musculus
aagctttctattgtgcaaaactatt

SEQ ID NO: 57243 - DNA, 25 bp, Mus musculus
aagctttctccgaggaattgctgaa

SEQ ID NO: 57244 - DNA, 25 bp, Mus musculus
aagctttctccgtggaattgctgaa

SEQ ID NO: 57245 - DNA, 25 bp, Mus musculus
aagctttctgcaaatccagggacca

SEQ ID NO: 57246 - DNA, 25 bp, Mus musculus
aagctttctgcatatccagggacca

SEQ ID NO: 57247 - DNA, 25 bp, Mus musculus
aagctttctgtcaagctgtggtgac

SEQ ID NO: 57248 - DNA, 25 bp, Mus musculus
aagctttctgtctagctgtggtgac

SEQ ID NO: 57249 - DNA, 25 bp, Mus musculus
aagctttcttatcgcgtggtctttc

SEQ ID NO: 57250 - DNA, 25 bp, Mus musculus
aagctttcttatggcgtggtctttc

SEQ ID NO: 57251 - DNA, 25 bp, Mus musculus
aagctttcttctatgctactggaga

SEQ ID NO: 57252 - DNA, 25 bp, Mus musculus
aagctttcttctttgctactggaga

SEQ ID NO: 57253 - DNA, 25 bp, Mus musculus
aagctttcttgcagatggtatcaca

SEQ ID NO: 57254 - DNA, 25 bp, Mus musculus
aagctttcttgctgatggtatcaca

SEQ ID NO: 57255 - DNA, 25 bp, Mus musculus
aagctttgaagaagagcctctcagc

SEQ ID NO: 57256 - DNA, 25 bp, Mus musculus
aagctttgaagatgagcctctcagc

SEQ ID NO: 57257 - DNA, 25 bp, Mus musculus
aagctttgacacatcatagtatcag

SEQ ID NO: 57258 - DNA, 25 bp, Mus musculus
aagctttgacacttcatagtatcag

SEQ ID NO: 57259 - DNA, 25 bp, Mus musculus
aagctttgacatctccttggcaatg

SEQ ID NO: 57260 - DNA, 25 bp, Mus musculus
aagctttgacatgtccttggcaatg

SEQ ID NO: 57261 - DNA, 25 bp, Mus musculus
aagctttgaggaccagcttcgcctg

SEQ ID NO: 57262 - DNA, 25 bp, Mus musculus
aagctttgaggagcagcttcgcctg

SEQ ID NO: 57263 - DNA, 25 bp, Mus musculus
aagctttgagtaatctatcccctgt

SEQ ID NO: 57264 - DNA, 25 bp, Mus musculus
aagctttgagtattctatcccctgt

SEQ ID NO: 57265 - DNA, 25 bp, Mus musculus
aagctttgagttcgtggcttctttg

SEQ ID NO: 57266 - DNA, 25 bp, Mus musculus
aagctttgagttggtggcttctttg

SEQ ID NO: 57267 - DNA, 25 bp, Mus musculus
aagctttgatttccccagagctttc

SEQ ID NO: 57268 - DNA, 25 bp, Mus musculus
aagctttgatttgcccagagctttc

SEQ ID NO: 57269 - DNA, 25 bp, Mus musculus
aagctttgcaagaccgctgctgatt

SEQ ID NO: 57270 - DNA, 25 bp, Mus musculus
aagctttgcaagtccgctgctgatt

SEQ ID NO: 57271 - DNA, 25 bp, Mus musculus
aagctttgcagacgtatttccctgg

SEQ ID NO: 57272 - DNA, 25 bp, Mus musculus
aagctttgcagaggtatttccctgg

SEQ ID NO: 57273 - DNA, 25 bp, Mus musculus
aagctttgcagcaagctcagaggga

SEQ ID NO: 57274 - DNA, 25 bp, Mus musculus
aagctttgcagctagctcagaggga

SEQ ID NO: 57275 - DNA, 25 bp, Mus musculus
aagctttgcattctttttgtctctc

SEQ ID NO: 57276 - DNA, 25 bp, Mus musculus
aagctttgcattgtttttgtctctc

SEQ ID NO: 57277 - DNA, 25 bp, Mus musculus
aagctttgccaaaatgagtctagtt

SEQ ID NO: 57278 - DNA, 25 bp, Mus musculus
aagctttgccaatatgagtctagtt

SEQ ID NO: 57279 - DNA, 25 bp, Mus musculus
aagctttgccatagttgagcctcct

SEQ ID NO: 57280 - DNA, 25 bp, Mus musculus
aagctttgccatatacatgccatgt

SEQ ID NO: 57281 - DNA, 25 bp, Mus musculus
aagctttgccattgttgagcctcct

SEQ ID NO: 57282 - DNA, 25 bp, Mus musculus
aagctttgccatttacatgccatgt

SEQ ID NO: 57283 - DNA, 25 bp, Mus musculus
aagctttgcccgcacagccttgact

SEQ ID NO: 57284 - DNA, 25 bp, Mus musculus
aagctttgcccggacagccttgact

SEQ ID NO: 57285 - DNA, 25 bp, Mus musculus
aagctttgctcgctgtcaatgatta

SEQ ID NO: 57286 - DNA, 25 bp, Mus musculus
aagctttgctcggtgtcaatgatta

SEQ ID NO: 57287 - DNA, 25 bp, Mus musculus
aagctttggcttagcggatgagatc

SEQ ID NO: 57288 - DNA, 25 bp, Mus musculus
aagctttggctttgcggatgagatc

SEQ ID NO: 57289 - DNA, 25 bp, Mus musculus
aagctttgggccctagagccagtag

SEQ ID NO: 57290 - DNA, 25 bp, Mus musculus
aagctttgggccgtagagccagtag

SEQ ID NO: 57291 - DNA, 25 bp, Mus musculus
aagctttggtctacaaggtgctctc

SEQ ID NO: 57292 - DNA, 25 bp, Mus musculus
aagctttggtcttcaaggtgctctc

SEQ ID NO: 57293 - DNA, 25 bp, Mus musculus
aagctttggtggaggtgtcttgaca

SEQ ID NO: 57294 - DNA, 25 bp, Mus musculus
aagctttggtggtggtgtcttgaca

SEQ ID NO: 57295 - DNA, 25 bp, Mus musculus
aagctttgtgatcgacggtggcacc

SEQ ID NO: 57296 - DNA, 25 bp, Mus musculus
aagctttgtgatggacggtggcacc

SEQ ID NO: 57297 - DNA, 25 bp, Mus musculus
aagctttgtgtaagacttctgcctt

SEQ ID NO: 57298 - DNA, 25 bp, Mus musculus
aagctttgtgtatgacttctgcctt

SEQ ID NO: 57299 - DNA, 25 bp, Mus musculus
aagctttgtgttagttactatggca

SEQ ID NO: 57300 - DNA, 25 bp, Mus musculus
aagctttgtgtttgttactatggca

SEQ ID NO: 57301 - DNA, 25 bp, Mus musculus
aagctttgtttgagtatttgggcgg

SEQ ID NO: 57302 - DNA, 25 bp, Mus musculus
aagctttgtttgtgtatttgggcgg

SEQ ID NO: 57303 - DNA, 25 bp, Mus musculus
aagcttttactgaacctcttctgat

SEQ ID NO: 57304 - DNA, 25 bp, Mus musculus
aagcttttactgtacctcttctgat

SEQ ID NO: 57305 - DNA, 25 bp, Mus musculus
aagcttttatctccagccgatacag

SEQ ID NO: 57306 - DNA, 25 bp, Mus musculus
aagcttttatctgcagccgatacag

SEQ ID NO: 57307 - DNA, 25 bp, Mus musculus
aagcttttatgtatgcagttttgta

SEQ ID NO: 57308 - DNA, 25 bp, Mus musculus
aagcttttatgtttgcagttttgta

SEQ ID NO: 57309 - DNA, 25 bp, Mus musculus
aagcttttccacatgatatttcatt

SEQ ID NO: 57310 - DNA, 25 bp, Mus musculus
aagcttttccacttgatatttcatt

SEQ ID NO: 57311 - DNA, 25 bp, Mus musculus
aagcttttccctctgtgtagttcta

SEQ ID NO: 57312 - DNA, 25 bp, Mus musculus
aagcttttccctgtgtgtagttcta

SEQ ID NO: 57313 - DNA, 25 bp, Mus musculus
aagcttttcctcacagttcacttgc

SEQ ID NO: 57314 - DNA, 25 bp, Mus musculus
aagcttttcctctcagttcacttgc

SEQ ID NO: 57315 - DNA, 25 bp, Mus musculus
aagcttttcctgacagtggttgcta

SEQ ID NO: 57316 - DNA, 25 bp, Mus musculus
aagcttttcctgtcagtggttgcta

SEQ ID NO: 57317 - DNA, 25 bp, Mus musculus
aagcttttgaggacacagcctgtcc

SEQ ID NO: 57318 - DNA, 25 bp, Mus musculus
aagcttttgaggacacaggtgcact

SEQ ID NO: 57319 - DNA, 25 bp, Mus musculus
aagcttttgaggtcacagcctgtcc

SEQ ID NO: 57320 - DNA, 25 bp, Mus musculus
aagcttttgaggtcacaggtgcact

SEQ ID NO: 57321 - DNA, 25 bp, Mus musculus
aagcttttgcatacgctggaaggcc

SEQ ID NO: 57322 - DNA, 25 bp, Mus musculus
aagcttttgcattcgctggaaggcc

SEQ ID NO: 57323 - DNA, 25 bp, Mus musculus
aagcttttgcctctgtggtgctgtc

SEQ ID NO: 57324 - DNA, 25 bp, Mus musculus
aagcttttgcctgtgtggtgctgtc

SEQ ID NO: 57325 - DNA, 25 bp, Mus musculus
aagcttttggaaaatgacaccactc

SEQ ID NO: 57326 - DNA, 25 bp, Mus musculus
aagcttttggaatatgacaccactc

SEQ ID NO: 57327 - DNA, 25 bp, Mus musculus
aagcttttggctcggtccagggatt

SEQ ID NO: 57328 - DNA, 25 bp, Mus musculus
aagcttttggctgggtccagggatt

SEQ ID NO: 57329 - DNA, 25 bp, Mus musculus
aagcttttgtatacctactgtgtca

SEQ ID NO: 57330 - DNA, 25 bp, Mus musculus
aagcttttgtattcctactgtgtca

SEQ ID NO: 57331 - DNA, 25 bp, Mus musculus
aagcttttgtcgctgtgtgtatttt

SEQ ID NO: 57332 - DNA, 25 bp, Mus musculus
aagcttttgtcggtgtgtgtatttt

SEQ ID NO: 57333 - DNA, 25 bp, Mus musculus
aagctttttaatacaattgcataac

SEQ ID NO: 57334 - DNA, 25 bp, Mus musculus
aagctttttaattcaattgcataac

SEQ ID NO: 57335 - DNA, 25 bp, Mus musculus
aagctttttactactgatccattgt

SEQ ID NO: 57336 - DNA, 25 bp, Mus musculus
aagctttttacttctgatccattgt

SEQ ID NO: 57337 - DNA, 25 bp, Mus musculus
aagctttttctcaagcaacactgtg

SEQ ID NO: 57338 - DNA, 25 bp, Mus musculus
aagctttttctctagcaacactgtg

SEQ ID NO: 57339 - DNA, 25 bp, Mus musculus
aagcttttttcccatagcccttgca

SEQ ID NO: 57340 - DNA, 25 bp, Mus musculus
aagcttttttccgatagcccttgca

SEQ ID NO: 57341 - DNA, 25 bp, Mus musculus
aaggaaaaaagcctggcgctgagac

SEQ ID NO: 57342 - DNA, 25 bp, Mus musculus
aaggaaaaaagcgtggcgctgagac

SEQ ID NO: 57343 - DNA, 25 bp, Mus musculus
aaggaaaaacacctctgctcacttc

SEQ ID NO: 57344 - DNA, 25 bp, Mus musculus
aaggaaaaacacgtctgctcacttc

SEQ ID NO: 57345 - DNA, 25 bp, Mus musculus
aaggaaaaaggcctcattcgctctt

SEQ ID NO: 57346 - DNA, 25 bp, Mus musculus
aaggaaaaaggcgtcattcgctctt

SEQ ID NO: 57347 - DNA, 25 bp, Mus musculus
aaggaaaacatgatctcatctcagg

SEQ ID NO: 57348 - DNA, 25 bp, Mus musculus
aaggaaaacatgttctcatctcagg

SEQ ID NO: 57349 - DNA, 25 bp, Mus musculus
aaggaaaacccacctcactatgagt

SEQ ID NO: 57350 - DNA, 25 bp, Mus musculus
aaggaaaacccagctcactatgagt

SEQ ID NO: 57351 - DNA, 25 bp, Mus musculus
aaggaaaacctgatgcagcgaaaaa

SEQ ID NO: 57352 - DNA, 25 bp, Mus musculus
aaggaaaacctgttgcagcgaaaaa

SEQ ID NO: 57353 - DNA, 25 bp, Mus musculus
aaggaaaagccaacaccacctcaaa

SEQ ID NO: 57354 - DNA, 25 bp, Mus musculus
aaggaaaagccatcaccacctcaaa

SEQ ID NO: 57355 - DNA, 25 bp, Mus musculus
aaggaaaagcgcaatggtgtggata

SEQ ID NO: 57356 - DNA, 25 bp, Mus musculus
aaggaaaagcgcagggcccatcgac

SEQ ID NO: 57357 - DNA, 25 bp, Mus musculus
aaggaaaagcgctatggtgtggata

SEQ ID NO: 57358 - DNA, 25 bp, Mus musculus
aaggaaaagcgctgggcccatcgac

SEQ ID NO: 57359 - DNA, 25 bp, Mus musculus
aaggaaaatgacacggacccaacag

SEQ ID NO: 57360 - DNA, 25 bp, Mus musculus
aaggaaaatgactcggacccaacag

SEQ ID NO: 57361 - DNA, 25 bp, Mus musculus
aaggaaaatgccctcaaccacattg

SEQ ID NO: 57362 - DNA, 25 bp, Mus musculus
aaggaaaatgccgtcaaccacattg

SEQ ID NO: 57363 - DNA, 25 bp, Mus musculus
aaggaaaatgttaatacactggaga

SEQ ID NO: 57364 - DNA, 25 bp, Mus musculus
aaggaaaatgtttatacactggaga

SEQ ID NO: 57365 - DNA, 25 bp, Mus musculus
aaggaaacaaacaatttcttgctat

SEQ ID NO: 57366 - DNA, 25 bp, Mus musculus
aaggaaacaaactatttcttgctat

SEQ ID NO: 57367 - DNA, 25 bp, Mus musculus
aaggaaacagccacccatcttgttc

SEQ ID NO: 57368 - DNA, 25 bp, Mus musculus
aaggaaacagcctcccatcttgttc

SEQ ID NO: 57369 - DNA, 25 bp, Mus musculus
aaggaaacatgacccctctgatgtg

SEQ ID NO: 57370 - DNA, 25 bp, Mus musculus
aaggaaacatgagccctctgatgtg

SEQ ID NO: 57371 - DNA, 25 bp, Mus musculus
aaggaaaccggcacctgacgggcag

SEQ ID NO: 57372 - DNA, 25 bp, Mus musculus
aaggaaaccggctcctgacgggcag

SEQ ID NO: 57373 - DNA, 25 bp, Mus musculus
aaggaaaccttcaggagcctccgat

SEQ ID NO: 57374 - DNA, 25 bp, Mus musculus
aaggaaaccttctggagcctccgat

SEQ ID NO: 57375 - DNA, 25 bp, Mus musculus
aaggaaacgcggctgaccctgatgg

SEQ ID NO: 57376 - DNA, 25 bp, Mus musculus
aaggaaacgcgggtgaccctgatgg

SEQ ID NO: 57377 - DNA, 25 bp, Mus musculus
aaggaaacgggacgatgaatctact

SEQ ID NO: 57378 - DNA, 25 bp, Mus musculus
aaggaaacgggaggatgaatctact

SEQ ID NO: 57379 - DNA, 25 bp, Mus musculus
aaggaaactagaattctctctcttt

SEQ ID NO: 57380 - DNA, 25 bp, Mus musculus
aaggaaactagatttctctctcttt

SEQ ID NO: 57381 - DNA, 25 bp, Mus musculus
aaggaaactagtcttcacataccca

SEQ ID NO: 57382 - DNA, 25 bp, Mus musculus
aaggaaactagtgttcacataccca

SEQ ID NO: 57383 - DNA, 25 bp, Mus musculus
aaggaaactggaagcacgctgccca

SEQ ID NO: 57384 - DNA, 25 bp, Mus musculus
aaggaaactggatgcacgctgccca

SEQ ID NO: 57385 - DNA, 25 bp, Mus musculus
aaggaaactgttatgccaatgcaca

SEQ ID NO: 57386 - DNA, 25 bp, Mus musculus
aaggaaactgttttgccaatgcaca

SEQ ID NO: 57387 - DNA, 25 bp, Mus musculus
aaggaaacttataccatgtgtgtct

SEQ ID NO: 57388 - DNA, 25 bp, Mus musculus
aaggaaacttattccatgtgtgtct

SEQ ID NO: 57389 - DNA, 25 bp, Mus musculus
aaggaaagaaggctgcatctcctgt

SEQ ID NO: 57390 - DNA, 25 bp, Mus musculus
aaggaaagaagggtgcatctcctgt

SEQ ID NO: 57391 - DNA, 25 bp, Mus musculus
aaggaaagatctctggtgctaaccc

SEQ ID NO: 57392 - DNA, 25 bp, Mus musculus
aaggaaagatctgtggtgctaaccc

SEQ ID NO: 57393 - DNA, 25 bp, Mus musculus
aaggaaagccatccaacgtgtttat

SEQ ID NO: 57394 - DNA, 25 bp, Mus musculus
aaggaaagccatgcaacgtgtttat

SEQ ID NO: 57395 - DNA, 25 bp, Mus musculus
aaggaaagcccaagatatagtctgg

SEQ ID NO: 57396 - DNA, 25 bp, Mus musculus
aaggaaagcccatgatatagtctgg

SEQ ID NO: 57397 - DNA, 25 bp, Mus musculus
aaggaaagcgcacggccagcttgtc

SEQ ID NO: 57398 - DNA, 25 bp, Mus musculus
aaggaaagcgcagggccagcttgtc

SEQ ID NO: 57399 - DNA, 25 bp, Mus musculus
aaggaaagctgaccgagttctgaac

SEQ ID NO: 57400 - DNA, 25 bp, Mus musculus
aaggaaagctgagcgagttctgaac

SEQ ID NO: 57401 - DNA, 25 bp, Mus musculus
aaggaaagtacaccccaagcaatga

SEQ ID NO: 57402 - DNA, 25 bp, Mus musculus
aaggaaagtacagcccaagcaatga

SEQ ID NO: 57403 - DNA, 25 bp, Mus musculus
aaggaaagtcccacgcaggtgtgcc

SEQ ID NO: 57404 - DNA, 25 bp, Mus musculus
aaggaaagtccctcgcaggtgtgcc

SEQ ID NO: 57405 - DNA, 25 bp, Mus musculus
aaggaaagtcttcgtgctcggtgat

SEQ ID NO: 57406 - DNA, 25 bp, Mus musculus
aaggaaagtcttggtgctcggtgat

SEQ ID NO: 57407 - DNA, 25 bp, Mus musculus
aaggaaagtgtaactgccgcggcca

SEQ ID NO: 57408 - DNA, 25 bp, Mus musculus
aaggaaagtgtatctgccgcggcca

SEQ ID NO: 57409 - DNA, 25 bp, Mus musculus
aaggaaatcgacatcagactgctgc

SEQ ID NO: 57410 - DNA, 25 bp, Mus musculus
aaggaaatcgacttcagactgctgc

SEQ ID NO: 57411 - DNA, 25 bp, Mus musculus
aaggaaatcggtactgtcatgcaga

SEQ ID NO: 57412 - DNA, 25 bp, Mus musculus
aaggaaatcggttctgtcatgcaga

SEQ ID NO: 57413 - DNA, 25 bp, Mus musculus
aaggaaatctgcaccacgcatcaac

SEQ ID NO: 57414 - DNA, 25 bp, Mus musculus
aaggaaatctgctccacgcatcaac

SEQ ID NO: 57415 - DNA, 25 bp, Mus musculus
aaggaaatctttccgtgctgttgtg

SEQ ID NO: 57416 - DNA, 25 bp, Mus musculus
aaggaaatctttgcgtgctgttgtg

SEQ ID NO: 57417 - DNA, 25 bp, Mus musculus
aaggaaatgacgctttgcccaacga

SEQ ID NO: 57418 - DNA, 25 bp, Mus musculus
aaggaaatgacggtttgcccaacga

SEQ ID NO: 57419 - DNA, 25 bp, Mus musculus
aaggaaatgtacctctctcttcaga

SEQ ID NO: 57420 - DNA, 25 bp, Mus musculus
aaggaaatgtacgtctctcttcaga

SEQ ID NO: 57421 - DNA, 25 bp, Mus musculus
aaggaaatgtgacctggctgtgttt

SEQ ID NO: 57422 - DNA, 25 bp, Mus musculus
aaggaaatgtgagctggctgtgttt

SEQ ID NO: 57423 - DNA, 25 bp, Mus musculus
aaggaaattttcactcccactattg

SEQ ID NO: 57424 - DNA, 25 bp, Mus musculus
aaggaaattttctctcccactattg

SEQ ID NO: 57425 - DNA, 25 bp, Mus musculus
aaggaacaatcaccagccctgtctg

SEQ ID NO: 57426 - DNA, 25 bp, Mus musculus
aaggaacaatcagcagccctgtctg

SEQ ID NO: 57427 - DNA, 25 bp, Mus musculus
aaggaacaatggaagcatctgtata

SEQ ID NO: 57428 - DNA, 25 bp, Mus musculus
aaggaacaatggtagcatctgtata

SEQ ID NO: 57429 - DNA, 25 bp, Mus musculus
aaggaacacagacaatacaaagcaa

SEQ ID NO: 57430 - DNA, 25 bp, Mus musculus
aaggaacacagagaatacaaagcaa

SEQ ID NO: 57431 - DNA, 25 bp, Mus musculus
aaggaacaccacattgaggccatcg

SEQ ID NO: 57432 - DNA, 25 bp, Mus musculus
aaggaacaccactttgaggccatcg

SEQ ID NO: 57433 - DNA, 25 bp, Mus musculus
aaggaacaccataagtagccaccat

SEQ ID NO: 57434 - DNA, 25 bp, Mus musculus
aaggaacaccattagtagccaccat

SEQ ID NO: 57435 - DNA, 25 bp, Mus musculus
aaggaacacggcatactgactgctc

SEQ ID NO: 57436 - DNA, 25 bp, Mus musculus
aaggaacacggcttactgactgctc

SEQ ID NO: 57437 - DNA, 25 bp, Mus musculus
aaggaacactacctgcagtcagaac

SEQ ID NO: 57438 - DNA, 25 bp, Mus musculus
aaggaacactacgtgcagtcagaac

SEQ ID NO: 57439 - DNA, 25 bp, Mus musculus
aaggaacactgaactgggcgttcag

SEQ ID NO: 57440 - DNA, 25 bp, Mus musculus
aaggaacactgaagcgctccaccag

SEQ ID NO: 57441 - DNA, 25 bp, Mus musculus
aaggaacactgatctgggcgttcag

SEQ ID NO: 57442 - DNA, 25 bp, Mus musculus
aaggaacactgatgcgctccaccag

SEQ ID NO: 57443 - DNA, 25 bp, Mus musculus
aaggaacagagtctgtggctgcatc

SEQ ID NO: 57444 - DNA, 25 bp, Mus musculus
aaggaacagagtgtgtggctgcatc

SEQ ID NO: 57445 - DNA, 25 bp, Mus musculus
aaggaacagcttaacgcctctgtcc

SEQ ID NO: 57446 - DNA, 25 bp, Mus musculus
aaggaacagctttacgcctctgtcc

SEQ ID NO: 57447 - DNA, 25 bp, Mus musculus
aaggaacaggtcagaggcgttgctc

SEQ ID NO: 57448 - DNA, 25 bp, Mus musculus
aaggaacaggtctgaggcgttgctc

SEQ ID NO: 57449 - DNA, 25 bp, Mus musculus
aaggaacatcagagtgtcttggctc

SEQ ID NO: 57450 - DNA, 25 bp, Mus musculus
aaggaacatcagtgtgtcttggctc

SEQ ID NO: 57451 - DNA, 25 bp, Mus musculus
aaggaacatgcaacctagctcacga

SEQ ID NO: 57452 - DNA, 25 bp, Mus musculus
aaggaacatgcatcctagctcacga

SEQ ID NO: 57453 - DNA, 25 bp, Mus musculus
aaggaacatgtgattgaggctctgc

SEQ ID NO: 57454 - DNA, 25 bp, Mus musculus
aaggaacatgtgtttgaggctctgc

SEQ ID NO: 57455 - DNA, 25 bp, Mus musculus
aaggaaccacaactatatgtataca

SEQ ID NO: 57456 - DNA, 25 bp, Mus musculus
aaggaaccacaagtatatgtataca

SEQ ID NO: 57457 - DNA, 25 bp, Mus musculus
aaggaaccacagcaatgcccagttt

SEQ ID NO: 57458 - DNA, 25 bp, Mus musculus
aaggaaccacaggaatgcccagttt

SEQ ID NO: 57459 - DNA, 25 bp, Mus musculus
aaggaaccagatatgattgctaaca

SEQ ID NO: 57460 - DNA, 25 bp, Mus musculus
aaggaaccagatttgattgctaaca

SEQ ID NO: 57461 - DNA, 25 bp, Mus musculus
aaggaacccaatccaacctctgatt

SEQ ID NO: 57462 - DNA, 25 bp, Mus musculus
aaggaacccaatgcaacctctgatt

SEQ ID NO: 57463 - DNA, 25 bp, Mus musculus
aaggaacccataagagcccagcacg

SEQ ID NO: 57464 - DNA, 25 bp, Mus musculus
aaggaacccatatgagcccagcacg

SEQ ID NO: 57465 - DNA, 25 bp, Mus musculus
aaggaacccctcaagaatctcaaca

SEQ ID NO: 57466 - DNA, 25 bp, Mus musculus
aaggaacccctctagaatctcaaca

SEQ ID NO: 57467 - DNA, 25 bp, Mus musculus
aaggaacccgttcctatatgctctt

SEQ ID NO: 57468 - DNA, 25 bp, Mus musculus
aaggaacccgttgctatatgctctt

SEQ ID NO: 57469 - DNA, 25 bp, Mus musculus
aaggaaccctaaagcacctgtggtc

SEQ ID NO: 57470 - DNA, 25 bp, Mus musculus
aaggaaccctaatgcacctgtggtc

SEQ ID NO: 57471 - DNA, 25 bp, Mus musculus
aaggaaccctagcagcctagatgga

SEQ ID NO: 57472 - DNA, 25 bp, Mus musculus
aaggaaccctaggagcctagatgga

SEQ ID NO: 57473 - DNA, 25 bp, Mus musculus
aaggaaccctatcagggtctcccag

SEQ ID NO: 57474 - DNA, 25 bp, Mus musculus
aaggaaccctatgagggtctcccag

SEQ ID NO: 57475 - DNA, 25 bp, Mus musculus
aaggaaccgccaagtgtgtgccaac

SEQ ID NO: 57476 - DNA, 25 bp, Mus musculus
aaggaaccgccatgtgtgtgccaac

SEQ ID NO: 57477 - DNA, 25 bp, Mus musculus
aaggaacctacgctgacgactgctt

SEQ ID NO: 57478 - DNA, 25 bp, Mus musculus
aaggaacctacggtgacgactgctt

SEQ ID NO: 57479 - DNA, 25 bp, Mus musculus
aaggaacctgctacatcagcctgac

SEQ ID NO: 57480 - DNA, 25 bp, Mus musculus
aaggaacctgcttcatcagcctgac

SEQ ID NO: 57481 - DNA, 25 bp, Mus musculus
aaggaacctggaacgcagagctgcc

SEQ ID NO: 57482 - DNA, 25 bp, Mus musculus
aaggaacctggatcgcagagctgcc

SEQ ID NO: 57483 - DNA, 25 bp, Mus musculus
aaggaacctggcaaactctggatct

SEQ ID NO: 57484 - DNA, 25 bp, Mus musculus
aaggaacctggctaactctggatct

SEQ ID NO: 57485 - DNA, 25 bp, Mus musculus
aaggaacctgttcctctcagactat

SEQ ID NO: 57486 - DNA, 25 bp, Mus musculus
aaggaacctgttgctctcagactat

SEQ ID NO: 57487 - DNA, 25 bp, Mus musculus
aaggaaccttatcctgtctacctcg

SEQ ID NO: 57488 - DNA, 25 bp, Mus musculus
aaggaaccttatgctgtctacctcg

SEQ ID NO: 57489 - DNA, 25 bp, Mus musculus
aaggaaccttgtagggtctgctgct

SEQ ID NO: 57490 - DNA, 25 bp, Mus musculus
aaggaaccttgttgggtctgctgct

SEQ ID NO: 57491 - DNA, 25 bp, Mus musculus
aaggaacgatatcatgtacacggca

SEQ ID NO: 57492 - DNA, 25 bp, Mus musculus
aaggaacgatatgatgtacacggca

SEQ ID NO: 57493 - DNA, 25 bp, Mus musculus
aaggaacgcatcacggtcgcagcag

SEQ ID NO: 57494 - DNA, 25 bp, Mus musculus
aaggaacgcatctcggtcgcagcag

SEQ ID NO: 57495 - DNA, 25 bp, Mus musculus
aaggaacgccttcagctcgcttggg

SEQ ID NO: 57496 - DNA, 25 bp, Mus musculus
aaggaacgccttgagctcgcttggg

SEQ ID NO: 57497 - DNA, 25 bp, Mus musculus
aaggaacggacactggctcagataa

SEQ ID NO: 57498 - DNA, 25 bp, Mus musculus
aaggaacggacagtggctcagataa

SEQ ID NO: 57499 - DNA, 25 bp, Mus musculus
aaggaacggtgtagctgtctctcca

SEQ ID NO: 57500 - DNA, 25 bp, Mus musculus
aaggaacggtgttgctgtctctcca

SEQ ID NO: 57501 - DNA, 25 bp, Mus musculus
aaggaacgtggtctggcctcacagt

SEQ ID NO: 57502 - DNA, 25 bp, Mus musculus
aaggaacgtggtgtggcctcacagt

SEQ ID NO: 57503 - DNA, 25 bp, Mus musculus
aaggaactagctcccaggctgcaat

SEQ ID NO: 57504 - DNA, 25 bp, Mus musculus
aaggaactagctgccaggctgcaat

SEQ ID NO: 57505 - DNA, 25 bp, Mus musculus
aaggaactcagcctgtgcctctgac

SEQ ID NO: 57506 - DNA, 25 bp, Mus musculus
aaggaactcagcgtgtgcctctgac

SEQ ID NO: 57507 - DNA, 25 bp, Mus musculus
aaggaactctctcagtggcagcagc

SEQ ID NO: 57508 - DNA, 25 bp, Mus musculus
aaggaactctctgagtggcagcagc

SEQ ID NO: 57509 - DNA, 25 bp, Mus musculus
aaggaactgaaacacaacggtgaat

SEQ ID NO: 57510 - DNA, 25 bp, Mus musculus
aaggaactgaaagacaacggtgaat

SEQ ID NO: 57511 - DNA, 25 bp, Mus musculus
aaggaactgaacatctgggccaaga

SEQ ID NO: 57512 - DNA, 25 bp, Mus musculus
aaggaactgaacttctgggccaaga

SEQ ID NO: 57513 - DNA, 25 bp, Mus musculus
aaggaactgacccattctttcttca

SEQ ID NO: 57514 - DNA, 25 bp, Mus musculus
aaggaactgaccgattctttcttca

SEQ ID NO: 57515 - DNA, 25 bp, Mus musculus
aaggaactgctcagttaccgagatg

SEQ ID NO: 57516 - DNA, 25 bp, Mus musculus
aaggaactgctctgttaccgagatg

SEQ ID NO: 57517 - DNA, 25 bp, Mus musculus
aaggaactgggcatggaatctcgcc

SEQ ID NO: 57518 - DNA, 25 bp, Mus musculus
aaggaactgggcttggaatctcgcc

SEQ ID NO: 57519 - DNA, 25 bp, Mus musculus
aaggaactggtgaagctcactcagt

SEQ ID NO: 57520 - DNA, 25 bp, Mus musculus
aaggaactggtgctgtccggcacac

SEQ ID NO: 57521 - DNA, 25 bp, Mus musculus
aaggaactggtggtgtccggcacac

SEQ ID NO: 57522 - DNA, 25 bp, Mus musculus
aaggaactggtgtagctcactcagt

SEQ ID NO: 57523 - DNA, 25 bp, Mus musculus
aaggaactgtaccacttcgctcagg

SEQ ID NO: 57524 - DNA, 25 bp, Mus musculus
aaggaactgtacgacttcgctcagg

SEQ ID NO: 57525 - DNA, 25 bp, Mus musculus
aaggaacttcagattacatcttgtt

SEQ ID NO: 57526 - DNA, 25 bp, Mus musculus
aaggaacttcagtttacatcttgtt

SEQ ID NO: 57527 - DNA, 25 bp, Mus musculus
aaggaacttcctcacttcatgtgaa

SEQ ID NO: 57528 - DNA, 25 bp, Mus musculus
aaggaacttcctgacttcatgtgaa

SEQ ID NO: 57529 - DNA, 25 bp, Mus musculus
aaggaacttcttcccaatccagcta

SEQ ID NO: 57530 - DNA, 25 bp, Mus musculus
aaggaacttcttgccaatccagcta

SEQ ID NO: 57531 - DNA, 25 bp, Mus musculus
aaggaacttgccagcatttccactt

SEQ ID NO: 57532 - DNA, 25 bp, Mus musculus
aaggaacttgcctgcatttccactt

SEQ ID NO: 57533 - DNA, 25 bp, Mus musculus
aaggaacttggcaggcataaccaaa

SEQ ID NO: 57534 - DNA, 25 bp, Mus musculus
aaggaacttggctggcataaccaaa

SEQ ID NO: 57535 - DNA, 25 bp, Mus musculus
aaggaacttgtgcatgtgctggtta

SEQ ID NO: 57536 - DNA, 25 bp, Mus musculus
aaggaacttgtggatgtgctggtta

SEQ ID NO: 57537 - DNA, 25 bp, Mus musculus
aaggaagaagagaatctgcaagccc

SEQ ID NO: 57538 - DNA, 25 bp, Mus musculus
aaggaagaagagtatctgcaagccc

SEQ ID NO: 57539 - DNA, 25 bp, Mus musculus
aaggaagaagcgctgcccctacacc

SEQ ID NO: 57540 - DNA, 25 bp, Mus musculus
aaggaagaagcggtgcccctacacc

SEQ ID NO: 57541 - DNA, 25 bp, Mus musculus
aaggaagaaggcaggtgctccccag

SEQ ID NO: 57542 - DNA, 25 bp, Mus musculus
aaggaagaaggctggtgctccccag

SEQ ID NO: 57543 - DNA, 25 bp, Mus musculus
aaggaagaatcgctgctaccgcctg

SEQ ID NO: 57544 - DNA, 25 bp, Mus musculus
aaggaagaatcggtgctaccgcctg

SEQ ID NO: 57545 - DNA, 25 bp, Mus musculus
aaggaagacatcatttctttgaagt

SEQ ID NO: 57546 - DNA, 25 bp, Mus musculus
aaggaagacatcttttctttgaagt

SEQ ID NO: 57547 - DNA, 25 bp, Mus musculus
aaggaagacgcaactctacccaggc

SEQ ID NO: 57548 - DNA, 25 bp, Mus musculus
aaggaagacgcatctctacccaggc

SEQ ID NO: 57549 - DNA, 25 bp, Mus musculus
aaggaagactccaggacacctccca

SEQ ID NO: 57550 - DNA, 25 bp, Mus musculus
aaggaagactcccacgccatggatt

SEQ ID NO: 57551 - DNA, 25 bp, Mus musculus
aaggaagactccgacgccatggatt

SEQ ID NO: 57552 - DNA, 25 bp, Mus musculus
aaggaagactcctggacacctccca

SEQ ID NO: 57553 - DNA, 25 bp, Mus musculus
aaggaagactgactccctccacact

SEQ ID NO: 57554 - DNA, 25 bp, Mus musculus
aaggaagactgagtccctccacact

SEQ ID NO: 57555 - DNA, 25 bp, Mus musculus
aaggaagagcccagacacctcaagt

SEQ ID NO: 57556 - DNA, 25 bp, Mus musculus
aaggaagagcccatggccgtccctt

SEQ ID NO: 57557 - DNA, 25 bp, Mus musculus
aaggaagagccctgacacctcaagt

SEQ ID NO: 57558 - DNA, 25 bp, Mus musculus
aaggaagagcccttggccgtccctt

SEQ ID NO: 57559 - DNA, 25 bp, Mus musculus
aaggaagagcgtcctgtctctgcca

SEQ ID NO: 57560 - DNA, 25 bp, Mus musculus
aaggaagagcgtgctgtctctgcca

SEQ ID NO: 57561 - DNA, 25 bp, Mus musculus
aaggaagagctgcactccctgctgt

SEQ ID NO: 57562 - DNA, 25 bp, Mus musculus
aaggaagagctgctccgcgtgaaca

SEQ ID NO: 57563 - DNA, 25 bp, Mus musculus
aaggaagagctggactccctgctgt

SEQ ID NO: 57564 - DNA, 25 bp, Mus musculus
aaggaagagctggtccgcgtgaaca

SEQ ID NO: 57565 - DNA, 25 bp, Mus musculus
aaggaagatcaacgccccgggtgct

SEQ ID NO: 57566 - DNA, 25 bp, Mus musculus
aaggaagatcaaggccccgggtgct

SEQ ID NO: 57567 - DNA, 25 bp, Mus musculus
aaggaagattgtactgaccgtcaca

SEQ ID NO: 57568 - DNA, 25 bp, Mus musculus
aaggaagattgttctgaccgtcaca

SEQ ID NO: 57569 - DNA, 25 bp, Mus musculus
aaggaagcaggtaggctgcctcctt

SEQ ID NO: 57570 - DNA, 25 bp, Mus musculus
aaggaagcaggttggctgcctcctt

SEQ ID NO: 57571 - DNA, 25 bp, Mus musculus
aaggaagcagtcaacggtcttgcct

SEQ ID NO: 57572 - DNA, 25 bp, Mus musculus
aaggaagcagtctacggtcttgcct

SEQ ID NO: 57573 - DNA, 25 bp, Mus musculus
aaggaagcatgtcctgtcagccgag

SEQ ID NO: 57574 - DNA, 25 bp, Mus musculus
aaggaagcatgtgctgtcagccgag

SEQ ID NO: 57575 - DNA, 25 bp, Mus musculus
aaggaagcattgatcccctggaact

SEQ ID NO: 57576 - DNA, 25 bp, Mus musculus
aaggaagcattgttcccctggaact

SEQ ID NO: 57577 - DNA, 25 bp, Mus musculus
aaggaagccaaccttctcaacgctg

SEQ ID NO: 57578 - DNA, 25 bp, Mus musculus
aaggaagccaacgttctcaacgctg

SEQ ID NO: 57579 - DNA, 25 bp, Mus musculus
aaggaagccagtcggcccatcaact

SEQ ID NO: 57580 - DNA, 25 bp, Mus musculus
aaggaagccagtgggcccatcaact

SEQ ID NO: 57581 - DNA, 25 bp, Mus musculus
aaggaagccattagactccacactg

SEQ ID NO: 57582 - DNA, 25 bp, Mus musculus
aaggaagccatttgactccacactg

SEQ ID NO: 57583 - DNA, 25 bp, Mus musculus
aaggaagccccaaagttatcagcca

SEQ ID NO: 57584 - DNA, 25 bp, Mus musculus
aaggaagccccatagttatcagcca

SEQ ID NO: 57585 - DNA, 25 bp, Mus musculus
aaggaagcccggaccacagacatgg

SEQ ID NO: 57586 - DNA, 25 bp, Mus musculus
aaggaagcccggatctcagaccagg

SEQ ID NO: 57587 - DNA, 25 bp, Mus musculus
aaggaagcccggtccacagacatgg

SEQ ID NO: 57588 - DNA, 25 bp, Mus musculus
aaggaagcccggttctcagaccagg

SEQ ID NO: 57589 - DNA, 25 bp, Mus musculus
aaggaagccctaccgatgtctgttt

SEQ ID NO: 57590 - DNA, 25 bp, Mus musculus
aaggaagccctagcgatgtctgttt

SEQ ID NO: 57591 - DNA, 25 bp, Mus musculus
aaggaagccgtcaccatctgcaaag

SEQ ID NO: 57592 - DNA, 25 bp, Mus musculus
aaggaagccgtctccatctgcaaag

SEQ ID NO: 57593 - DNA, 25 bp, Mus musculus
aaggaagcctatactggcgtccagc

SEQ ID NO: 57594 - DNA, 25 bp, Mus musculus
aaggaagcctattctggcgtccagc

SEQ ID NO: 57595 - DNA, 25 bp, Mus musculus
aaggaagcctctagcctgattacct

SEQ ID NO: 57596 - DNA, 25 bp, Mus musculus
aaggaagcctcttgcctgattacct

SEQ ID NO: 57597 - DNA, 25 bp, Mus musculus
aaggaagcctgcactcagcagtacc

SEQ ID NO: 57598 - DNA, 25 bp, Mus musculus
aaggaagcctgctctcagcagtacc

SEQ ID NO: 57599 - DNA, 25 bp, Mus musculus
aaggaagcctggatcctgagagcat

SEQ ID NO: 57600 - DNA, 25 bp, Mus musculus
aaggaagcctggttcctgagagcat

SEQ ID NO: 57601 - DNA, 25 bp, Mus musculus
aaggaagcctgtaagttcattttat

SEQ ID NO: 57602 - DNA, 25 bp, Mus musculus
aaggaagcctgttagttcattttat

SEQ ID NO: 57603 - DNA, 25 bp, Mus musculus
aaggaagccttcagcaaagccgcgc

SEQ ID NO: 57604 - DNA, 25 bp, Mus musculus
aaggaagccttctgcaaagccgcgc

SEQ ID NO: 57605 - DNA, 25 bp, Mus musculus
aaggaagcggcgaccggcgtcacgg

SEQ ID NO: 57606 - DNA, 25 bp, Mus musculus
aaggaagcggcgtccggcgtcacgg

SEQ ID NO: 57607 - DNA, 25 bp, Mus musculus
aaggaagcgggcattcggcagttcc

SEQ ID NO: 57608 - DNA, 25 bp, Mus musculus
aaggaagcgggctttcggcagttcc

SEQ ID NO: 57609 - DNA, 25 bp, Mus musculus
aaggaagcgtccagctttccctggt

SEQ ID NO: 57610 - DNA, 25 bp, Mus musculus
aaggaagcgtcctgctttccctggt

SEQ ID NO: 57611 - DNA, 25 bp, Mus musculus
aaggaagctacccagtaccttgcaa

SEQ ID NO: 57612 - DNA, 25 bp, Mus musculus
aaggaagctaccgagtaccttgcaa

SEQ ID NO: 57613 - DNA, 25 bp, Mus musculus
aaggaagctatacccacgaagcctc

SEQ ID NO: 57614 - DNA, 25 bp, Mus musculus
aaggaagctatagccacgaagcctc

SEQ ID NO: 57615 - DNA, 25 bp, Mus musculus
aaggaagctcttcgaactctggctt

SEQ ID NO: 57616 - DNA, 25 bp, Mus musculus
aaggaagctcttggaactctggctt

SEQ ID NO: 57617 - DNA, 25 bp, Mus musculus
aaggaaggaaacatgatgccatatt

SEQ ID NO: 57618 - DNA, 25 bp, Mus musculus
aaggaaggaaacttgatgccatatt

SEQ ID NO: 57619 - DNA, 25 bp, Mus musculus
aaggaaggacacaacagcatcctca

SEQ ID NO: 57620 - DNA, 25 bp, Mus musculus
aaggaaggacactacagcatcctca

SEQ ID NO: 57621 - DNA, 25 bp, Mus musculus
aaggaaggatggctctctctcatct

SEQ ID NO: 57622 - DNA, 25 bp, Mus musculus
aaggaaggatgggtctctctcatct

SEQ ID NO: 57623 - DNA, 25 bp, Mus musculus
aaggaaggcccaccaaacggatcgt

SEQ ID NO: 57624 - DNA, 25 bp, Mus musculus
aaggaaggcccagcaaacggatcgt

SEQ ID NO: 57625 - DNA, 25 bp, Mus musculus
aaggaaggccgtctggcccagttca

SEQ ID NO: 57626 - DNA, 25 bp, Mus musculus
aaggaaggccgtgtggcccagttca

SEQ ID NO: 57627 - DNA, 25 bp, Mus musculus
aaggaaggcgatccggaccagctct

SEQ ID NO: 57628 - DNA, 25 bp, Mus musculus
aaggaaggcgatgcggaccagctct

SEQ ID NO: 57629 - DNA, 25 bp, Mus musculus
aaggaaggctctacttggcgctgga

SEQ ID NO: 57630 - DNA, 25 bp, Mus musculus
aaggaaggctctcataagtctcaat

SEQ ID NO: 57631 - DNA, 25 bp, Mus musculus
aaggaaggctctgataagtctcaat

SEQ ID NO: 57632 - DNA, 25 bp, Mus musculus
aaggaaggctcttcttggcgctgga

SEQ ID NO: 57633 - DNA, 25 bp, Mus musculus
aaggaaggcttgaacatcctcccag

SEQ ID NO: 57634 - DNA, 25 bp, Mus musculus
aaggaaggcttgtacatcctcccag

SEQ ID NO: 57635 - DNA, 25 bp, Mus musculus
aaggaagggccaccatggtctttgt

SEQ ID NO: 57636 - DNA, 25 bp, Mus musculus
aaggaagggccagcatggtctttgt

SEQ ID NO: 57637 - DNA, 25 bp, Mus musculus
aaggaagggctcatcacagctaaga

SEQ ID NO: 57638 - DNA, 25 bp, Mus musculus
aaggaagggctcttcacagctaaga

SEQ ID NO: 57639 - DNA, 25 bp, Mus musculus
aaggaagggcttctcaggcaactgt

SEQ ID NO: 57640 - DNA, 25 bp, Mus musculus
aaggaagggcttgtcaggcaactgt

SEQ ID NO: 57641 - DNA, 25 bp, Mus musculus
aaggaagggtgtctccttgtcacct

SEQ ID NO: 57642 - DNA, 25 bp, Mus musculus
aaggaagggtgtgtccttgtcacct

SEQ ID NO: 57643 - DNA, 25 bp, Mus musculus
aaggaaggtcccacagatgtgtgtg

SEQ ID NO: 57644 - DNA, 25 bp, Mus musculus
aaggaaggtccctcagatgtgtgtg

SEQ ID NO: 57645 - DNA, 25 bp, Mus musculus
aaggaagtatttcctgcagtttttt

SEQ ID NO: 57646 - DNA, 25 bp, Mus musculus
aaggaagtatttgctgcagtttttt

SEQ ID NO: 57647 - DNA, 25 bp, Mus musculus
aaggaagtcaaacccctgatcactg

SEQ ID NO: 57648 - DNA, 25 bp, Mus musculus
aaggaagtcaaagccctgatcactg

SEQ ID NO: 57649 - DNA, 25 bp, Mus musculus
aaggaagtcagaatagtcacagatt

SEQ ID NO: 57650 - DNA, 25 bp, Mus musculus
aaggaagtcagattagtcacagatt

SEQ ID NO: 57651 - DNA, 25 bp, Mus musculus
aaggaagtcctcaagcagagccctc

SEQ ID NO: 57652 - DNA, 25 bp, Mus musculus
aaggaagtcctctagcagagccctc

SEQ ID NO: 57653 - DNA, 25 bp, Mus musculus
aaggaagtcgccaacatccttcttt

SEQ ID NO: 57654 - DNA, 25 bp, Mus musculus
aaggaagtcgcctacatccttcttt

SEQ ID NO: 57655 - DNA, 25 bp, Mus musculus
aaggaagtctctccaaccaggccat

SEQ ID NO: 57656 - DNA, 25 bp, Mus musculus
aaggaagtctctgcaaccaggccat

SEQ ID NO: 57657 - DNA, 25 bp, Mus musculus
aaggaagtcttccaagagtctctgc

SEQ ID NO: 57658 - DNA, 25 bp, Mus musculus
aaggaagtcttcgaagagtctctgc

SEQ ID NO: 57659 - DNA, 25 bp, Mus musculus
aaggaagtgaaaactggctctctac

SEQ ID NO: 57660 - DNA, 25 bp, Mus musculus
aaggaagtgaaatctggctctctac

SEQ ID NO: 57661 - DNA, 25 bp, Mus musculus
aaggaagtgcccatttgtgtctcct

SEQ ID NO: 57662 - DNA, 25 bp, Mus musculus
aaggaagtgcccttttgtgtctcct

SEQ ID NO: 57663 - DNA, 25 bp, Mus musculus
aaggaagtgcctatgcatgcatttg

SEQ ID NO: 57664 - DNA, 25 bp, Mus musculus
aaggaagtgcctttgcatgcatttg

SEQ ID NO: 57665 - DNA, 25 bp, Mus musculus
aaggaagtggacactccccacgcta

SEQ ID NO: 57666 - DNA, 25 bp, Mus musculus
aaggaagtggactctccccacgcta

SEQ ID NO: 57667 - DNA, 25 bp, Mus musculus
aaggaagtggctctgactttaacca

SEQ ID NO: 57668 - DNA, 25 bp, Mus musculus
aaggaagtggctgtgactttaacca

SEQ ID NO: 57669 - DNA, 25 bp, Mus musculus
aaggaagtggtgaccgccaaccgct

SEQ ID NO: 57670 - DNA, 25 bp, Mus musculus
aaggaagtggtgtccgccaaccgct

SEQ ID NO: 57671 - DNA, 25 bp, Mus musculus
aaggaagtgtccatctaccagggct

SEQ ID NO: 57672 - DNA, 25 bp, Mus musculus
aaggaagtgtcccatggcgtcctca

SEQ ID NO: 57673 - DNA, 25 bp, Mus musculus
aaggaagtgtccgatggcgtcctca

SEQ ID NO: 57674 - DNA, 25 bp, Mus musculus
aaggaagtgtccttctaccagggct

SEQ ID NO: 57675 - DNA, 25 bp, Mus musculus
aaggaagttagcattcaggccactg

SEQ ID NO: 57676 - DNA, 25 bp, Mus musculus
aaggaagttagctttcaggccactg

SEQ ID NO: 57677 - DNA, 25 bp, Mus musculus
aaggaagttctgcaaccgcccacat

SEQ ID NO: 57678 - DNA, 25 bp, Mus musculus
aaggaagttctggaaccgcccacat

SEQ ID NO: 57679 - DNA, 25 bp, Mus musculus
aaggaagttggcaaagacgtgtcag

SEQ ID NO: 57680 - DNA, 25 bp, Mus musculus
aaggaagttggccaagatgcatcag

SEQ ID NO: 57681 - DNA, 25 bp, Mus musculus
aaggaagttggcgaagatgcatcag

SEQ ID NO: 57682 - DNA, 25 bp, Mus musculus
aaggaagttggctaagacgtgtcag

SEQ ID NO: 57683 - DNA, 25 bp, Mus musculus
aaggaatacacacggcactgccgcg

SEQ ID NO: 57684 - DNA, 25 bp, Mus musculus
aaggaatacacagggcactgccgcg

SEQ ID NO: 57685 - DNA, 25 bp, Mus musculus
aaggaatacgatagctcaccttgtg

SEQ ID NO: 57686 - DNA, 25 bp, Mus musculus
aaggaatacgattgctcaccttgtg

SEQ ID NO: 57687 - DNA, 25 bp, Mus musculus
aaggaatacttgatcagcagaggcc

SEQ ID NO: 57688 - DNA, 25 bp, Mus musculus
aaggaatacttgttcagcagaggcc

SEQ ID NO: 57689 - DNA, 25 bp, Mus musculus
aaggaatagcacatgcaggtgtcta

SEQ ID NO: 57690 - DNA, 25 bp, Mus musculus
aaggaatagcacttgcaggtgtcta

SEQ ID NO: 57691 - DNA, 25 bp, Mus musculus
aaggaatagctgagggacctcctgt

SEQ ID NO: 57692 - DNA, 25 bp, Mus musculus
aaggaatagctgtgggacctcctgt

SEQ ID NO: 57693 - DNA, 25 bp, Mus musculus
aaggaatccaagaagccaccagcta

SEQ ID NO: 57694 - DNA, 25 bp, Mus musculus
aaggaatccaagtagccaccagcta

SEQ ID NO: 57695 - DNA, 25 bp, Mus musculus
aaggaatcctacatgccatcttcag

SEQ ID NO: 57696 - DNA, 25 bp, Mus musculus
aaggaatcctacttgccatcttcag

SEQ ID NO: 57697 - DNA, 25 bp, Mus musculus
aaggaatccttcatcctgtgtcctt

SEQ ID NO: 57698 - DNA, 25 bp, Mus musculus
aaggaatccttcttcctgtgtcctt

SEQ ID NO: 57699 - DNA, 25 bp, Mus musculus
aaggaatctacacgcctgttttcac

SEQ ID NO: 57700 - DNA, 25 bp, Mus musculus
aaggaatctacaggcctgttttcac

SEQ ID NO: 57701 - DNA, 25 bp, Mus musculus
aaggaatctagtctatctctgtgca

SEQ ID NO: 57702 - DNA, 25 bp, Mus musculus
aaggaatctagtgtatctctgtgca

SEQ ID NO: 57703 - DNA, 25 bp, Mus musculus
aaggaatctggtctccattcctcgg

SEQ ID NO: 57704 - DNA, 25 bp, Mus musculus
aaggaatctggtgtccattcctcgg

SEQ ID NO: 57705 - DNA, 25 bp, Mus musculus
aaggaatctgtgactgtgctcaacc

SEQ ID NO: 57706 - DNA, 25 bp, Mus musculus
aaggaatctgtgtctgtgctcaacc

SEQ ID NO: 57707 - DNA, 25 bp, Mus musculus
aaggaatgcagtacctgtatttacc

SEQ ID NO: 57708 - DNA, 25 bp, Mus musculus
aaggaatgcagttcctgtatttacc

SEQ ID NO: 57709 - DNA, 25 bp, Mus musculus
aaggaatgcatcacgtgctcttact

SEQ ID NO: 57710 - DNA, 25 bp, Mus musculus
aaggaatgcatctcgtgctcttact

SEQ ID NO: 57711 - DNA, 25 bp, Mus musculus
aaggaatggaccaatgctccttccc

SEQ ID NO: 57712 - DNA, 25 bp, Mus musculus
aaggaatggacctatgctccttccc

SEQ ID NO: 57713 - DNA, 25 bp, Mus musculus
aaggaatggcttatctctggcgccc

SEQ ID NO: 57714 - DNA, 25 bp, Mus musculus
aaggaatggcttttctctggcgccc

SEQ ID NO: 57715 - DNA, 25 bp, Mus musculus
aaggaatgggcacctcagtaccgag

SEQ ID NO: 57716 - DNA, 25 bp, Mus musculus
aaggaatgggcagctcagtaccgag

SEQ ID NO: 57717 - DNA, 25 bp, Mus musculus
aaggaatggtcacttggagctgtca

SEQ ID NO: 57718 - DNA, 25 bp, Mus musculus
aaggaatggtcagttggagctgtca

SEQ ID NO: 57719 - DNA, 25 bp, Mus musculus
aaggaatgtcaccagtctcaggaaa

SEQ ID NO: 57720 - DNA, 25 bp, Mus musculus
aaggaatgtcacgagtctcaggaaa

SEQ ID NO: 57721 - DNA, 25 bp, Mus musculus
aaggaatgtgtcatctcaagtacag

SEQ ID NO: 57722 - DNA, 25 bp, Mus musculus
aaggaatgtgtcttctcaagtacag

SEQ ID NO: 57723 - DNA, 25 bp, Mus musculus
aaggaattaacaagtgcgctgacca

SEQ ID NO: 57724 - DNA, 25 bp, Mus musculus
aaggaattaacatgtgcgctgacca

SEQ ID NO: 57725 - DNA, 25 bp, Mus musculus
aaggaattaacgctcttctcgtatt

SEQ ID NO: 57726 - DNA, 25 bp, Mus musculus
aaggaattaacggtcttctcgtatt

SEQ ID NO: 57727 - DNA, 25 bp, Mus musculus
aaggaattactcaacagtcaataac

SEQ ID NO: 57728 - DNA, 25 bp, Mus musculus
aaggaattactctacagtcaataac

SEQ ID NO: 57729 - DNA, 25 bp, Mus musculus
aaggaattatctcacctgccatttg

SEQ ID NO: 57730 - DNA, 25 bp, Mus musculus
aaggaattatctgacctgccatttg

SEQ ID NO: 57731 - DNA, 25 bp, Mus musculus
aaggaattccatcggaagcacccaa

SEQ ID NO: 57732 - DNA, 25 bp, Mus musculus
aaggaattccatgggaagcacccaa

SEQ ID NO: 57733 - DNA, 25 bp, Mus musculus
aaggaattccctcggaggctcatca

SEQ ID NO: 57734 - DNA, 25 bp, Mus musculus
aaggaattccctgggaggctcatca

SEQ ID NO: 57735 - DNA, 25 bp, Mus musculus
aaggaattgaatcacctggctcgag

SEQ ID NO: 57736 - DNA, 25 bp, Mus musculus
aaggaattgaatgacctggctcgag

SEQ ID NO: 57737 - DNA, 25 bp, Mus musculus
aaggaattgagaccgtacctgtctg

SEQ ID NO: 57738 - DNA, 25 bp, Mus musculus
aaggaattgagagcgtacctgtctg

SEQ ID NO: 57739 - DNA, 25 bp, Mus musculus
aaggaattgatcaccactctgtgga

SEQ ID NO: 57740 - DNA, 25 bp, Mus musculus
aaggaattgatctccactctgtgga

SEQ ID NO: 57741 - DNA, 25 bp, Mus musculus
aaggaattgcagacggtcctctcgg

SEQ ID NO: 57742 - DNA, 25 bp, Mus musculus
aaggaattgcagtcggtcctctcgg

SEQ ID NO: 57743 - DNA, 25 bp, Mus musculus
aaggaattgcctattgtaattttgt

SEQ ID NO: 57744 - DNA, 25 bp, Mus musculus
aaggaattgcctctgtcagcttgac

SEQ ID NO: 57745 - DNA, 25 bp, Mus musculus
aaggaattgcctgtgtcagcttgac

SEQ ID NO: 57746 - DNA, 25 bp, Mus musculus
aaggaattgccttttgtaattttgt

SEQ ID NO: 57747 - DNA, 25 bp, Mus musculus
aaggaattgcttaactttcagctca

SEQ ID NO: 57748 - DNA, 25 bp, Mus musculus
aaggaattgcttacctgtgggacaa

SEQ ID NO: 57749 - DNA, 25 bp, Mus musculus
aaggaattgctttactttcagctca

SEQ ID NO: 57750 - DNA, 25 bp, Mus musculus
aaggaattgctttcctgtgggacaa

SEQ ID NO: 57751 - DNA, 25 bp, Mus musculus
aaggaattttgtatctctggtcttc

SEQ ID NO: 57752 - DNA, 25 bp, Mus musculus
aaggaattttgtttctctggtcttc

SEQ ID NO: 57753 - DNA, 25 bp, Mus musculus
aaggacaacatgattcatggactgg

SEQ ID NO: 57754 - DNA, 25 bp, Mus musculus
aaggacaacatgtttcatggactgg

SEQ ID NO: 57755 - DNA, 25 bp, Mus musculus
aaggacaaccttcaatttctcagcc

SEQ ID NO: 57756 - DNA, 25 bp, Mus musculus
aaggacaaccttgaatttctcagcc

SEQ ID NO: 57757 - DNA, 25 bp, Mus musculus
aaggacaacggaaggtcatctgcct

SEQ ID NO: 57758 - DNA, 25 bp, Mus musculus
aaggacaacggatggtcatctgcct

SEQ ID NO: 57759 - DNA, 25 bp, Mus musculus
aaggacaactgccaagcacatgtgt

SEQ ID NO: 57760 - DNA, 25 bp, Mus musculus
aaggacaactgcgaagcacatgtgt

SEQ ID NO: 57761 - DNA, 25 bp, Mus musculus
aaggacaacttacctctctgcatac

SEQ ID NO: 57762 - DNA, 25 bp, Mus musculus
aaggacaacttagctctctgcatac

SEQ ID NO: 57763 - DNA, 25 bp, Mus musculus
aaggacaagacgaccattgtgcatc

SEQ ID NO: 57764 - DNA, 25 bp, Mus musculus
aaggacaagacgtccattgtgcatc

SEQ ID NO: 57765 - DNA, 25 bp, Mus musculus
aaggacaagcatcgtgtcaccagaa

SEQ ID NO: 57766 - DNA, 25 bp, Mus musculus
aaggacaagcatggtgtcaccagaa

SEQ ID NO: 57767 - DNA, 25 bp, Mus musculus
aaggacaagcccacctatgatgaga

SEQ ID NO: 57768 - DNA, 25 bp, Mus musculus
aaggacaagcccatgagctccatca

SEQ ID NO: 57769 - DNA, 25 bp, Mus musculus
aaggacaagccctcctatgatgaga

SEQ ID NO: 57770 - DNA, 25 bp, Mus musculus
aaggacaagcccttgagctccatca

SEQ ID NO: 57771 - DNA, 25 bp, Mus musculus
aaggacaagttacccagtctccctg

SEQ ID NO: 57772 - DNA, 25 bp, Mus musculus
aaggacaagttagccagtctccctg

SEQ ID NO: 57773 - DNA, 25 bp, Mus musculus
aaggacaatatccaactcactccag

SEQ ID NO: 57774 - DNA, 25 bp, Mus musculus
aaggacaatatcgaactcactccag

SEQ ID NO: 57775 - DNA, 25 bp, Mus musculus
aaggacaatcgtatgcgcgctgcaa

SEQ ID NO: 57776 - DNA, 25 bp, Mus musculus
aaggacaatcgtttgcgcgctgcaa

SEQ ID NO: 57777 - DNA, 25 bp, Mus musculus
aaggacaatggacaccctccgcatt

SEQ ID NO: 57778 - DNA, 25 bp, Mus musculus
aaggacaatggagaccctccgcatt

SEQ ID NO: 57779 - DNA, 25 bp, Mus musculus
aaggacaatggcagaattctctccc

SEQ ID NO: 57780 - DNA, 25 bp, Mus musculus
aaggacaatggctgaattctctccc

SEQ ID NO: 57781 - DNA, 25 bp, Mus musculus
aaggacaatgtgaggcccctgcagc

SEQ ID NO: 57782 - DNA, 25 bp, Mus musculus
aaggacaatgtgtggcccctgcagc

SEQ ID NO: 57783 - DNA, 25 bp, Mus musculus
aaggacaatttccatgacattcatt

SEQ ID NO: 57784 - DNA, 25 bp, Mus musculus
aaggacaatttcgatgacattcatt

SEQ ID NO: 57785 - DNA, 25 bp, Mus musculus
aaggacaatttgaatcaaccacttt

SEQ ID NO: 57786 - DNA, 25 bp, Mus musculus
aaggacaatttgtatcaaccacttt

SEQ ID NO: 57787 - DNA, 25 bp, Mus musculus
aaggacacaacccagtgggctcaga

SEQ ID NO: 57788 - DNA, 25 bp, Mus musculus
aaggacacaaccgagtgggctcaga

SEQ ID NO: 57789 - DNA, 25 bp, Mus musculus
aaggacacacttcccaaggctgaag

SEQ ID NO: 57790 - DNA, 25 bp, Mus musculus
aaggacacacttgccaaggctgaag

SEQ ID NO: 57791 - DNA, 25 bp, Mus musculus
aaggacacagagctcggcactccac

SEQ ID NO: 57792 - DNA, 25 bp, Mus musculus
aaggacacagaggtcggcactccac

SEQ ID NO: 57793 - DNA, 25 bp, Mus musculus
aaggacacagtacaccacactcctg

SEQ ID NO: 57794 - DNA, 25 bp, Mus musculus
aaggacacagtagaccacactcctg

SEQ ID NO: 57795 - DNA, 25 bp, Mus musculus
aaggacacatgtaagctgctctgtt

SEQ ID NO: 57796 - DNA, 25 bp, Mus musculus
aaggacacatgttagctgctctgtt

SEQ ID NO: 57797 - DNA, 25 bp, Mus musculus
aaggacaccagaccctaccttcgtg

SEQ ID NO: 57798 - DNA, 25 bp, Mus musculus
aaggacaccagagcctaccttcgtg

SEQ ID NO: 57799 - DNA, 25 bp, Mus musculus
aaggacaccagcagcactctgtgct

SEQ ID NO: 57800 - DNA, 25 bp, Mus musculus
aaggacaccagctgcactctgtgct

SEQ ID NO: 57801 - DNA, 25 bp, Mus musculus
aaggacacctccagggattcagtgg

SEQ ID NO: 57802 - DNA, 25 bp, Mus musculus
aaggacacctcctgggattcagtgg

SEQ ID NO: 57803 - DNA, 25 bp, Mus musculus
aaggacacctgcatctcgactgagg

SEQ ID NO: 57804 - DNA, 25 bp, Mus musculus
aaggacacctgcttctcgactgagg

SEQ ID NO: 57805 - DNA, 25 bp, Mus musculus
aaggacacgagtctgcggtcatttc

SEQ ID NO: 57806 - DNA, 25 bp, Mus musculus
aaggacacgagtgtgcggtcatttc

SEQ ID NO: 57807 - DNA, 25 bp, Mus musculus
aaggacacggagatctcctgcagtt

SEQ ID NO: 57808 - DNA, 25 bp, Mus musculus
aaggacacggagttctcctgcagtt

SEQ ID NO: 57809 - DNA, 25 bp, Mus musculus
aaggacactaccctaaagtcattct

SEQ ID NO: 57810 - DNA, 25 bp, Mus musculus
aaggacactaccgtaaagtcattct

SEQ ID NO: 57811 - DNA, 25 bp, Mus musculus
aaggacactactccctgtatttctg

SEQ ID NO: 57812 - DNA, 25 bp, Mus musculus
aaggacactactgcctgtatttctg

SEQ ID NO: 57813 - DNA, 25 bp, Mus musculus
aaggacactgacacccctgggcagg

SEQ ID NO: 57814 - DNA, 25 bp, Mus musculus
aaggacactgactcccctgggcagg

SEQ ID NO: 57815 - DNA, 25 bp, Mus musculus
aaggacactgatccatctggtcccc

SEQ ID NO: 57816 - DNA, 25 bp, Mus musculus
aaggacactgatgcatctggtcccc

SEQ ID NO: 57817 - DNA, 25 bp, Mus musculus
aaggacactgcaaaagaggagaacg

SEQ ID NO: 57818 - DNA, 25 bp, Mus musculus
aaggacactgcataagaggagaacg

SEQ ID NO: 57819 - DNA, 25 bp, Mus musculus
aaggacactgttagccatgcagggc

SEQ ID NO: 57820 - DNA, 25 bp, Mus musculus
aaggacactgtttgccatgcagggc

SEQ ID NO: 57821 - DNA, 25 bp, Mus musculus
aaggacacttatatctagattacga

SEQ ID NO: 57822 - DNA, 25 bp, Mus musculus
aaggacacttatttctagattacga

SEQ ID NO: 57823 - DNA, 25 bp, Mus musculus
aaggacagaagcacttgcctttcca

SEQ ID NO: 57824 - DNA, 25 bp, Mus musculus
aaggacagaagctcttgcctttcca

SEQ ID NO: 57825 - DNA, 25 bp, Mus musculus
aaggacagagctaatctccacactt

SEQ ID NO: 57826 - DNA, 25 bp, Mus musculus
aaggacagagcttatctccacactt

SEQ ID NO: 57827 - DNA, 25 bp, Mus musculus
aaggacagagtcacgtttctttggc

SEQ ID NO: 57828 - DNA, 25 bp, Mus musculus
aaggacagagtctcgtttctttggc

SEQ ID NO: 57829 - DNA, 25 bp, Mus musculus
aaggacagatggagcctgggcaata

SEQ ID NO: 57830 - DNA, 25 bp, Mus musculus
aaggacagatggtgcctgggcaata

SEQ ID NO: 57831 - DNA, 25 bp, Mus musculus
aaggacagatgtagctgttctctgc

SEQ ID NO: 57832 - DNA, 25 bp, Mus musculus
aaggacagatgttgctgttctctgc

SEQ ID NO: 57833 - DNA, 25 bp, Mus musculus
aaggacagcagcacatactcacggc

SEQ ID NO: 57834 - DNA, 25 bp, Mus musculus
aaggacagcagcctacaagtctcca

SEQ ID NO: 57835 - DNA, 25 bp, Mus musculus
aaggacagcagcgtacaagtctcca

SEQ ID NO: 57836 - DNA, 25 bp, Mus musculus
aaggacagcagctcatactcacggc

SEQ ID NO: 57837 - DNA, 25 bp, Mus musculus
aaggacagcccgctgtggttaccca

SEQ ID NO: 57838 - DNA, 25 bp, Mus musculus
aaggacagcccggtgtggttaccca

SEQ ID NO: 57839 - DNA, 25 bp, Mus musculus
aaggacagcgaacaccaccggcttt

SEQ ID NO: 57840 - DNA, 25 bp, Mus musculus
aaggacagcgaagaccaccggcttt

SEQ ID NO: 57841 - DNA, 25 bp, Mus musculus
aaggacagctacatgtgtgcagtgt

SEQ ID NO: 57842 - DNA, 25 bp, Mus musculus
aaggacagctacttgtgtgcagtgt

SEQ ID NO: 57843 - DNA, 25 bp, Mus musculus
aaggacagctgcacctgcagagtga

SEQ ID NO: 57844 - DNA, 25 bp, Mus musculus
aaggacagctgctcctgcagagtga

SEQ ID NO: 57845 - DNA, 25 bp, Mus musculus
aaggacagcttcagtcttgtctctg

SEQ ID NO: 57846 - DNA, 25 bp, Mus musculus
aaggacagcttctgtcttgtctctg

SEQ ID NO: 57847 - DNA, 25 bp, Mus musculus
aaggacaggagacagctcccgacgc

SEQ ID NO: 57848 - DNA, 25 bp, Mus musculus
aaggacaggagagagctcccgacgc

SEQ ID NO: 57849 - DNA, 25 bp, Mus musculus
aaggacaggatgactccttctgcct

SEQ ID NO: 57850 - DNA, 25 bp, Mus musculus
aaggacaggatgtctccttctgcct

SEQ ID NO: 57851 - DNA, 25 bp, Mus musculus
aaggacaggcaaacaggaatcttct

SEQ ID NO: 57852 - DNA, 25 bp, Mus musculus
aaggacaggcaatcaggaatcttct

SEQ ID NO: 57853 - DNA, 25 bp, Mus musculus
aaggacaggctgaagcgagccctct

SEQ ID NO: 57854 - DNA, 25 bp, Mus musculus
aaggacaggctgtagcgagccctct

SEQ ID NO: 57855 - DNA, 25 bp, Mus musculus
aaggacagggccaacatgcagcaca

SEQ ID NO: 57856 - DNA, 25 bp, Mus musculus
aaggacagggcctacatgcagcaca

SEQ ID NO: 57857 - DNA, 25 bp, Mus musculus
aaggacagggcgcacatctcccgaa

SEQ ID NO: 57858 - DNA, 25 bp, Mus musculus
aaggacagggcggacatctcccgaa

SEQ ID NO: 57859 - DNA, 25 bp, Mus musculus
aaggacagtaaacgttcaagcagat

SEQ ID NO: 57860 - DNA, 25 bp, Mus musculus
aaggacagtaaaggttcaagcagat

SEQ ID NO: 57861 - DNA, 25 bp, Mus musculus
aaggacagtcatacgcggtctgcca

SEQ ID NO: 57862 - DNA, 25 bp, Mus musculus
aaggacagtcattcgcggtctgcca

SEQ ID NO: 57863 - DNA, 25 bp, Mus musculus
aaggacagtgaaaccgctcctgttg

SEQ ID NO: 57864 - DNA, 25 bp, Mus musculus
aaggacagtgaatccgctcctgttg

SEQ ID NO: 57865 - DNA, 25 bp, Mus musculus
aaggacagtgacagggtttggtcac

SEQ ID NO: 57866 - DNA, 25 bp, Mus musculus
aaggacagtgactgggtttggtcac

SEQ ID NO: 57867 - DNA, 25 bp, Mus musculus
aaggacagtgatatttaggtggcaa

SEQ ID NO: 57868 - DNA, 25 bp, Mus musculus
aaggacagtgatttttaggtggcaa

SEQ ID NO: 57869 - DNA, 25 bp, Mus musculus
aaggacagtgcacttgctggacaat

SEQ ID NO: 57870 - DNA, 25 bp, Mus musculus
aaggacagtgcagttgctggacaat

SEQ ID NO: 57871 - DNA, 25 bp, Mus musculus
aaggacagtgctcctactgcagtga

SEQ ID NO: 57872 - DNA, 25 bp, Mus musculus
aaggacagtgctgctactgcagtga

SEQ ID NO: 57873 - DNA, 25 bp, Mus musculus
aaggacagttggagcagcctgttct

SEQ ID NO: 57874 - DNA, 25 bp, Mus musculus
aaggacagttggtgcagcctgttct

SEQ ID NO: 57875 - DNA, 25 bp, Mus musculus
aaggacataattctttccgtgagaa

SEQ ID NO: 57876 - DNA, 25 bp, Mus musculus
aaggacataattgtttccgtgagaa

SEQ ID NO: 57877 - DNA, 25 bp, Mus musculus
aaggacatacccctgctgttagagg

SEQ ID NO: 57878 - DNA, 25 bp, Mus musculus
aaggacatacccgtgctgttagagg

SEQ ID NO: 57879 - DNA, 25 bp, Mus musculus
aaggacatagcaaccaactttatct

SEQ ID NO: 57880 - DNA, 25 bp, Mus musculus
aaggacatagcatccaactttatct

SEQ ID NO: 57881 - DNA, 25 bp, Mus musculus
aaggacatcaggcagcgcaaccaga

SEQ ID NO: 57882 - DNA, 25 bp, Mus musculus
aaggacatcagggagcgcaaccaga

SEQ ID NO: 57883 - DNA, 25 bp, Mus musculus
aaggacatccatacccaagtgaatg

SEQ ID NO: 57884 - DNA, 25 bp, Mus musculus
aaggacatccattcccaagtgaatg

SEQ ID NO: 57885 - DNA, 25 bp, Mus musculus
aaggacatcctgactcacgggcgat

SEQ ID NO: 57886 - DNA, 25 bp, Mus musculus
aaggacatcctgtctcacgggcgat

SEQ ID NO: 57887 - DNA, 25 bp, Mus musculus
aaggacatcgcaaaggcctatctgt

SEQ ID NO: 57888 - DNA, 25 bp, Mus musculus
aaggacatcgcataggcctatctgt

SEQ ID NO: 57889 - DNA, 25 bp, Mus musculus
aaggacatcgtaaggctggagagca

SEQ ID NO: 57890 - DNA, 25 bp, Mus musculus
aaggacatcgtatggctggagagca

SEQ ID NO: 57891 - DNA, 25 bp, Mus musculus
aaggacatctcaatgtggctgggat

SEQ ID NO: 57892 - DNA, 25 bp, Mus musculus
aaggacatctcattgtggctgggat

SEQ ID NO: 57893 - DNA, 25 bp, Mus musculus
aaggacatctgtctccactgggtgg

SEQ ID NO: 57894 - DNA, 25 bp, Mus musculus
aaggacatctgtgtccactgggtgg

SEQ ID NO: 57895 - DNA, 25 bp, Mus musculus
aaggacatgccaaccaggctgggaa

SEQ ID NO: 57896 - DNA, 25 bp, Mus musculus
aaggacatgccaactcggagaaagc

SEQ ID NO: 57897 - DNA, 25 bp, Mus musculus
aaggacatgccatccaggctgggaa

SEQ ID NO: 57898 - DNA, 25 bp, Mus musculus
aaggacatgccatctcggagaaagc

SEQ ID NO: 57899 - DNA, 25 bp, Mus musculus
aaggacatgcctatttaccttctgc

SEQ ID NO: 57900 - DNA, 25 bp, Mus musculus
aaggacatgcctcccatgggttccc

SEQ ID NO: 57901 - DNA, 25 bp, Mus musculus
aaggacatgcctgccatgggttccc

SEQ ID NO: 57902 - DNA, 25 bp, Mus musculus
aaggacatgcctttttaccttctgc

SEQ ID NO: 57903 - DNA, 25 bp, Mus musculus
aaggacatgggaatcaacattttta

SEQ ID NO: 57904 - DNA, 25 bp, Mus musculus
aaggacatgggattcaacattttta

SEQ ID NO: 57905 - DNA, 25 bp, Mus musculus
aaggacatgtagcaagccccagcat

SEQ ID NO: 57906 - DNA, 25 bp, Mus musculus
aaggacatgtaggaagccccagcat

SEQ ID NO: 57907 - DNA, 25 bp, Mus musculus
aaggacatgtcgcatggcttcatct

SEQ ID NO: 57908 - DNA, 25 bp, Mus musculus
aaggacatgtcggatggcttcatct

SEQ ID NO: 57909 - DNA, 25 bp, Mus musculus
aaggacatgtgcacaactgtacaga

SEQ ID NO: 57910 - DNA, 25 bp, Mus musculus
aaggacatgtgctcaactgtacaga

SEQ ID NO: 57911 - DNA, 25 bp, Mus musculus
aaggacatgttgacctacctcacag

SEQ ID NO: 57912 - DNA, 25 bp, Mus musculus
aaggacatgttgctggttatcagat

SEQ ID NO: 57913 - DNA, 25 bp, Mus musculus
aaggacatgttggtggttatcagat

SEQ ID NO: 57914 - DNA, 25 bp, Mus musculus
aaggacatgttgtcctacctcacag

SEQ ID NO: 57915 - DNA, 25 bp, Mus musculus
aaggacattagcacttcgtaggaaa

SEQ ID NO: 57916 - DNA, 25 bp, Mus musculus
aaggacattagctcttcgtaggaaa

SEQ ID NO: 57917 - DNA, 25 bp, Mus musculus
aaggacattcttagctgcacagtga

SEQ ID NO: 57918 - DNA, 25 bp, Mus musculus
aaggacattctttgctgcacagtga

SEQ ID NO: 57919 - DNA, 25 bp, Mus musculus
aaggacattgccctggaaaataaat

SEQ ID NO: 57920 - DNA, 25 bp, Mus musculus
aaggacattgccgtggaaaataaat

SEQ ID NO: 57921 - DNA, 25 bp, Mus musculus
aaggacattggcatccgtgctgtgg

SEQ ID NO: 57922 - DNA, 25 bp, Mus musculus
aaggacattggcttccgtgctgtgg

SEQ ID NO: 57923 - DNA, 25 bp, Mus musculus
aaggacatttatactgactactctg

SEQ ID NO: 57924 - DNA, 25 bp, Mus musculus
aaggacatttatcgccgctttgggc

SEQ ID NO: 57925 - DNA, 25 bp, Mus musculus
aaggacatttatggccgctttgggc

SEQ ID NO: 57926 - DNA, 25 bp, Mus musculus
aaggacatttattctgactactctg

SEQ ID NO: 57927 - DNA, 25 bp, Mus musculus
aaggacatttcacaagtcaaaaaat

SEQ ID NO: 57928 - DNA, 25 bp, Mus musculus
aaggacatttcagaagtcaaaaaat

SEQ ID NO: 57929 - DNA, 25 bp, Mus musculus
aaggaccaacgccacgctgtagagc

SEQ ID NO: 57930 - DNA, 25 bp, Mus musculus
aaggaccaacgcgacgctgtagagc

SEQ ID NO: 57931 - DNA, 25 bp, Mus musculus
aaggaccaactcaaactctgtcttt

SEQ ID NO: 57932 - DNA, 25 bp, Mus musculus
aaggaccaactctaactctgtcttt

SEQ ID NO: 57933 - DNA, 25 bp, Mus musculus
aaggaccaagcaatcagcaggcgga

SEQ ID NO: 57934 - DNA, 25 bp, Mus musculus
aaggaccaagcattcagcaggcgga

SEQ ID NO: 57935 - DNA, 25 bp, Mus musculus
aaggaccaaggcatggatcttgagc

SEQ ID NO: 57936 - DNA, 25 bp, Mus musculus
aaggaccaaggcttggatcttgagc

SEQ ID NO: 57937 - DNA, 25 bp, Mus musculus
aaggaccaagtccacggctgacaag

SEQ ID NO: 57938 - DNA, 25 bp, Mus musculus
aaggaccaagtcgacggctgacaag

SEQ ID NO: 57939 - DNA, 25 bp, Mus musculus
aaggaccaattgctccagtggcttt

SEQ ID NO: 57940 - DNA, 25 bp, Mus musculus
aaggaccaattggtccagtggcttt

SEQ ID NO: 57941 - DNA, 25 bp, Mus musculus
aaggaccacacactggactgacttg

SEQ ID NO: 57942 - DNA, 25 bp, Mus musculus
aaggaccacacagtggactgacttg

SEQ ID NO: 57943 - DNA, 25 bp, Mus musculus
aaggaccaccttattcagatacatc

SEQ ID NO: 57944 - DNA, 25 bp, Mus musculus
aaggaccacctttttcagatacatc

SEQ ID NO: 57945 - DNA, 25 bp, Mus musculus
aaggaccactgtctacagcatctcc

SEQ ID NO: 57946 - DNA, 25 bp, Mus musculus
aaggaccactgtgtacagcatctcc

SEQ ID NO: 57947 - DNA, 25 bp, Mus musculus
aaggaccagaagaatcctgggatgt

SEQ ID NO: 57948 - DNA, 25 bp, Mus musculus
aaggaccagaagtatcctgggatgt

SEQ ID NO: 57949 - DNA, 25 bp, Mus musculus
aaggaccagacacctaagggccagt

SEQ ID NO: 57950 - DNA, 25 bp, Mus musculus
aaggaccagacagctaagggccagt

SEQ ID NO: 57951 - DNA, 25 bp, Mus musculus
aaggaccagcacaaagtttgccagt

SEQ ID NO: 57952 - DNA, 25 bp, Mus musculus
aaggaccagcactaagtttgccagt

SEQ ID NO: 57953 - DNA, 25 bp, Mus musculus
aaggaccagccaattataacaaact

SEQ ID NO: 57954 - DNA, 25 bp, Mus musculus
aaggaccagccatttataacaaact

SEQ ID NO: 57955 - DNA, 25 bp, Mus musculus
aaggaccagcctccagtgcaagcag

SEQ ID NO: 57956 - DNA, 25 bp, Mus musculus
aaggaccagcctgcagtgcaagcag

SEQ ID NO: 57957 - DNA, 25 bp, Mus musculus
aaggaccagctgaacagctcggctt

SEQ ID NO: 57958 - DNA, 25 bp, Mus musculus
aaggaccagctgtacagctcggctt

SEQ ID NO: 57959 - DNA, 25 bp, Mus musculus
aaggaccaggccaggaagaccctga

SEQ ID NO: 57960 - DNA, 25 bp, Mus musculus
aaggaccaggcctggaagaccctga

SEQ ID NO: 57961 - DNA, 25 bp, Mus musculus
aaggaccaggtacttccccaggctg

SEQ ID NO: 57962 - DNA, 25 bp, Mus musculus
aaggaccaggtagttccccaggctg

SEQ ID NO: 57963 - DNA, 25 bp, Mus musculus
aaggaccaggttcctaactccgcct

SEQ ID NO: 57964 - DNA, 25 bp, Mus musculus
aaggaccaggttgctaactccgcct

SEQ ID NO: 57965 - DNA, 25 bp, Mus musculus
aaggaccagtggaccattctgacaa

SEQ ID NO: 57966 - DNA, 25 bp, Mus musculus
aaggaccagtggtccattctgacaa

SEQ ID NO: 57967 - DNA, 25 bp, Mus musculus
aaggaccagttcaaggtgcctcggg

SEQ ID NO: 57968 - DNA, 25 bp, Mus musculus
aaggaccagttctaggtgcctcggg

SEQ ID NO: 57969 - DNA, 25 bp, Mus musculus
aaggaccagttgactctcagtcaaa

SEQ ID NO: 57970 - DNA, 25 bp, Mus musculus
aaggaccagttgtctctcagtcaaa

SEQ ID NO: 57971 - DNA, 25 bp, Mus musculus
aaggaccatcaccattgtgacccaa

SEQ ID NO: 57972 - DNA, 25 bp, Mus musculus
aaggaccatcacgattgtgacccaa

SEQ ID NO: 57973 - DNA, 25 bp, Mus musculus
aaggaccatcagctgccagcccttg

SEQ ID NO: 57974 - DNA, 25 bp, Mus musculus
aaggaccatcaggtgccagcccttg

SEQ ID NO: 57975 - DNA, 25 bp, Mus musculus
aaggaccatgcgaatttcaaggagg

SEQ ID NO: 57976 - DNA, 25 bp, Mus musculus
aaggaccatgcgtatttcaaggagg

SEQ ID NO: 57977 - DNA, 25 bp, Mus musculus
aaggaccatgctacgtatacatccc

SEQ ID NO: 57978 - DNA, 25 bp, Mus musculus
aaggaccatgcttcgtatacatccc

SEQ ID NO: 57979 - DNA, 25 bp, Mus musculus
aaggacccagcacctttggtgcaca

SEQ ID NO: 57980 - DNA, 25 bp, Mus musculus
aaggacccagcagctttggtgcaca

SEQ ID NO: 57981 - DNA, 25 bp, Mus musculus
aaggaccccacaaatcagagatcaa

SEQ ID NO: 57982 - DNA, 25 bp, Mus musculus
aaggaccccacatatcagagatcaa

SEQ ID NO: 57983 - DNA, 25 bp, Mus musculus
aaggaccccagcatagttctcagca

SEQ ID NO: 57984 - DNA, 25 bp, Mus musculus
aaggaccccagcttagttctcagca

SEQ ID NO: 57985 - DNA, 25 bp, Mus musculus
aaggaccccatcatgttagcaattg

SEQ ID NO: 57986 - DNA, 25 bp, Mus musculus
aaggaccccatcttgttagcaattg

SEQ ID NO: 57987 - DNA, 25 bp, Mus musculus
aaggacccctgcagttgaacatgaa

SEQ ID NO: 57988 - DNA, 25 bp, Mus musculus
aaggacccctgctgttgaacatgaa

SEQ ID NO: 57989 - DNA, 25 bp, Mus musculus
aaggacccgatgactttctgggaag

SEQ ID NO: 57990 - DNA, 25 bp, Mus musculus
aaggacccgatgtctttctgggaag

SEQ ID NO: 57991 - DNA, 25 bp, Mus musculus
aaggacccggaacgcacagttcagc

SEQ ID NO: 57992 - DNA, 25 bp, Mus musculus
aaggacccggaaggcacagttcagc

SEQ ID NO: 57993 - DNA, 25 bp, Mus musculus
aaggaccctaagcagagcgcacagg

SEQ ID NO: 57994 - DNA, 25 bp, Mus musculus
aaggaccctaaggagagcgcacagg

SEQ ID NO: 57995 - DNA, 25 bp, Mus musculus
aaggaccctaccagagctcctgggt

SEQ ID NO: 57996 - DNA, 25 bp, Mus musculus
aaggaccctacctgagctcctgggt

SEQ ID NO: 57997 - DNA, 25 bp, Mus musculus
aaggaccctgcaaacatcgcacaga

SEQ ID NO: 57998 - DNA, 25 bp, Mus musculus
aaggaccctgcatacatcgcacaga

SEQ ID NO: 57999 - DNA, 25 bp, Mus musculus
aaggaccctggactcattcttaatt

SEQ ID NO: 58000 - DNA, 25 bp, Mus musculus
aaggaccctggagtcattcttaatt

SEQ ID NO: 58001 - DNA, 25 bp, Mus musculus
aaggaccctggcagggagccccact

SEQ ID NO: 58002 - DNA, 25 bp, Mus musculus
aaggaccctggctgggagccccact

SEQ ID NO: 58003 - DNA, 25 bp, Mus musculus
aaggaccgacgaacggccaacaagt

SEQ ID NO: 58004 - DNA, 25 bp, Mus musculus
aaggaccgacgatcggccaacaagt

SEQ ID NO: 58005 - DNA, 25 bp, Mus musculus
aaggaccgagatcatgaccgtagga

SEQ ID NO: 58006 - DNA, 25 bp, Mus musculus
aaggaccgagatgatgaccgtagga

SEQ ID NO: 58007 - DNA, 25 bp, Mus musculus
aaggaccgcaagaaggccgtgctct

SEQ ID NO: 58008 - DNA, 25 bp, Mus musculus
aaggaccgcaagtaggccgtgctct

SEQ ID NO: 58009 - DNA, 25 bp, Mus musculus
aaggaccggaacctgcgacgcatca

SEQ ID NO: 58010 - DNA, 25 bp, Mus musculus
aaggaccggaacgtgcgacgcatca

SEQ ID NO: 58011 - DNA, 25 bp, Mus musculus
aaggaccggaagctccaggtcactt

SEQ ID NO: 58012 - DNA, 25 bp, Mus musculus
aaggaccggaaggtccaggtcactt

SEQ ID NO: 58013 - DNA, 25 bp, Mus musculus
aaggaccgtctgcagctttggtgca

SEQ ID NO: 58014 - DNA, 25 bp, Mus musculus
aaggaccgtctggagctttggtgca

SEQ ID NO: 58015 - DNA, 25 bp, Mus musculus
aaggacctaagtcctggctgtgttc

SEQ ID NO: 58016 - DNA, 25 bp, Mus musculus
aaggacctaagtgctggctgtgttc

SEQ ID NO: 58017 - DNA, 25 bp, Mus musculus
aaggacctagacaactcacagggcc

SEQ ID NO: 58018 - DNA, 25 bp, Mus musculus
aaggacctagactactcacagggcc

SEQ ID NO: 58019 - DNA, 25 bp, Mus musculus
aaggacctatccaagattgcagtag

SEQ ID NO: 58020 - DNA, 25 bp, Mus musculus
aaggacctatcctagattgcagtag

SEQ ID NO: 58021 - DNA, 25 bp, Mus musculus
aaggacctatctcagttgccattaa

SEQ ID NO: 58022 - DNA, 25 bp, Mus musculus
aaggacctatctgagttgccattaa

SEQ ID NO: 58023 - DNA, 25 bp, Mus musculus
aaggacctcatcaacagaatgttac

SEQ ID NO: 58024 - DNA, 25 bp, Mus musculus
aaggacctcatctacagaatgttac

SEQ ID NO: 58025 - DNA, 25 bp, Mus musculus
aaggacctcattcaacggcagccat

SEQ ID NO: 58026 - DNA, 25 bp, Mus musculus
aaggacctcattgaacggcagccat

SEQ ID NO: 58027 - DNA, 25 bp, Mus musculus
aaggacctccagcaaatgggctcta

SEQ ID NO: 58028 - DNA, 25 bp, Mus musculus
aaggacctccaggaaatgggctcta

SEQ ID NO: 58029 - DNA, 25 bp, Mus musculus
aaggacctcgaactagtggaccagt

SEQ ID NO: 58030 - DNA, 25 bp, Mus musculus
aaggacctcgaagtagtggaccagt

SEQ ID NO: 58031 - DNA, 25 bp, Mus musculus
aaggacctctccacaagagactgtt

SEQ ID NO: 58032 - DNA, 25 bp, Mus musculus
aaggacctctcctcaagagactgtt

SEQ ID NO: 58033 - DNA, 25 bp, Mus musculus
aaggacctgaaaagaccctgtgcct

SEQ ID NO: 58034 - DNA, 25 bp, Mus musculus
aaggacctgaaatgaccctgtgcct

SEQ ID NO: 58035 - DNA, 25 bp, Mus musculus
aaggacctgagacatgctttccgca

SEQ ID NO: 58036 - DNA, 25 bp, Mus musculus
aaggacctgagagatgctttccgca

SEQ ID NO: 58037 - DNA, 25 bp, Mus musculus
aaggacctgatcactctgggaactg

SEQ ID NO: 58038 - DNA, 25 bp, Mus musculus
aaggacctgatctctctgggaactg

SEQ ID NO: 58039 - DNA, 25 bp, Mus musculus
aaggacctgcagaacggtatcctgg

SEQ ID NO: 58040 - DNA, 25 bp, Mus musculus
aaggacctgcagtacggtatcctgg

SEQ ID NO: 58041 - DNA, 25 bp, Mus musculus
aaggacctgcccatacatattgtgg

SEQ ID NO: 58042 - DNA, 25 bp, Mus musculus
aaggacctgcccttacatattgtgg

SEQ ID NO: 58043 - DNA, 25 bp, Mus musculus
aaggacctgccgctgccccgattgg

SEQ ID NO: 58044 - DNA, 25 bp, Mus musculus
aaggacctgccggtgccccgattgg

SEQ ID NO: 58045 - DNA, 25 bp, Mus musculus
aaggacctggaaaagctattggaag

SEQ ID NO: 58046 - DNA, 25 bp, Mus musculus
aaggacctggaatagctattggaag

SEQ ID NO: 58047 - DNA, 25 bp, Mus musculus
aaggacctggagattgtgctctgca

SEQ ID NO: 58048 - DNA, 25 bp, Mus musculus
aaggacctggagtttgtgctctgca

SEQ ID NO: 58049 - DNA, 25 bp, Mus musculus
aaggacctggccaacaaggccgcca

SEQ ID NO: 58050 - DNA, 25 bp, Mus musculus
aaggacctggcctacaaggccgcca

SEQ ID NO: 58051 - DNA, 25 bp, Mus musculus
aaggacctggctcgctgtatccatg

SEQ ID NO: 58052 - DNA, 25 bp, Mus musculus
aaggacctggctggctgtatccatg

SEQ ID NO: 58053 - DNA, 25 bp, Mus musculus
aaggacctgtatacacaccttcttt

SEQ ID NO: 58054 - DNA, 25 bp, Mus musculus
aaggacctgtatcagctggctttct

SEQ ID NO: 58055 - DNA, 25 bp, Mus musculus
aaggacctgtatgagctggctttct

SEQ ID NO: 58056 - DNA, 25 bp, Mus musculus
aaggacctgtattcacaccttcttt

SEQ ID NO: 58057 - DNA, 25 bp, Mus musculus
aaggacctgtctctaatacaagcaa

SEQ ID NO: 58058 - DNA, 25 bp, Mus musculus
aaggacctgtctgtaatacaagcaa

SEQ ID NO: 58059 - DNA, 25 bp, Mus musculus
aaggacctgtgcctcagagttcatg

SEQ ID NO: 58060 - DNA, 25 bp, Mus musculus
aaggacctgtgcgtcagagttcatg

SEQ ID NO: 58061 - DNA, 25 bp, Mus musculus
aaggacctgttgaactcagtcccct

SEQ ID NO: 58062 - DNA, 25 bp, Mus musculus
aaggacctgttgtactcagtcccct

SEQ ID NO: 58063 - DNA, 25 bp, Mus musculus
aaggacctttacagtgtgcagcaac

SEQ ID NO: 58064 - DNA, 25 bp, Mus musculus
aaggacctttactgtgtgcagcaac

SEQ ID NO: 58065 - DNA, 25 bp, Mus musculus
aaggacctttatatggacatcaata

SEQ ID NO: 58066 - DNA, 25 bp, Mus musculus
aaggacctttatttggacatcaata

SEQ ID NO: 58067 - DNA, 25 bp, Mus musculus
aaggacctttgcatactgagccatc

SEQ ID NO: 58068 - DNA, 25 bp, Mus musculus
aaggacctttgcttactgagccatc

SEQ ID NO: 58069 - DNA, 25 bp, Mus musculus
aaggacctttggattctctatgtct

SEQ ID NO: 58070 - DNA, 25 bp, Mus musculus
aaggacctttggtttctctatgtct

SEQ ID NO: 58071 - DNA, 25 bp, Mus musculus
aaggaccttttcaacgctagcagct

SEQ ID NO: 58072 - DNA, 25 bp, Mus musculus
aaggaccttttctacgctagcagct

SEQ ID NO: 58073 - DNA, 25 bp, Mus musculus
aaggacgacccgactgcgtgcacgc

SEQ ID NO: 58074 - DNA, 25 bp, Mus musculus
aaggacgacccgtctgcgtgcacgc

SEQ ID NO: 58075 - DNA, 25 bp, Mus musculus
aaggacgaccttcatcaggaaagat

SEQ ID NO: 58076 - DNA, 25 bp, Mus musculus
aaggacgaccttgatcaggaaagat

SEQ ID NO: 58077 - DNA, 25 bp, Mus musculus
aaggacgactggattcggcctgcct

SEQ ID NO: 58078 - DNA, 25 bp, Mus musculus
aaggacgactggtttcggcctgcct

SEQ ID NO: 58079 - DNA, 25 bp, Mus musculus
aaggacgagaacacccctcggacag

SEQ ID NO: 58080 - DNA, 25 bp, Mus musculus
aaggacgagaactcccctcggacag

SEQ ID NO: 58081 - DNA, 25 bp, Mus musculus
aaggacgagcgaaggattgtaaaat

SEQ ID NO: 58082 - DNA, 25 bp, Mus musculus
aaggacgagcgatggattgtaaaat

SEQ ID NO: 58083 - DNA, 25 bp, Mus musculus
aaggacgagctcaattgctgggccc

SEQ ID NO: 58084 - DNA, 25 bp, Mus musculus
aaggacgagctctattgctgggccc

SEQ ID NO: 58085 - DNA, 25 bp, Mus musculus
aaggacgagtcgaagccaccgtact

SEQ ID NO: 58086 - DNA, 25 bp, Mus musculus
aaggacgagtcgtagccaccgtact

SEQ ID NO: 58087 - DNA, 25 bp, Mus musculus
aaggacgataggcatgatcaggaat

SEQ ID NO: 58088 - DNA, 25 bp, Mus musculus
aaggacgatagggatgatcaggaat

SEQ ID NO: 58089 - DNA, 25 bp, Mus musculus
aaggacgatgggatgctcagcaagc

SEQ ID NO: 58090 - DNA, 25 bp, Mus musculus
aaggacgatgggttgctcagcaagc

SEQ ID NO: 58091 - DNA, 25 bp, Mus musculus
aaggacgatgtaactctgcggctga

SEQ ID NO: 58092 - DNA, 25 bp, Mus musculus
aaggacgatgtatctctgcggctga

SEQ ID NO: 58093 - DNA, 25 bp, Mus musculus
aaggacgcaaatcccgccgccgaag

SEQ ID NO: 58094 - DNA, 25 bp, Mus musculus
aaggacgcaaatgccgccgccgaag

SEQ ID NO: 58095 - DNA, 25 bp, Mus musculus
aaggacgcacccagtgctttgggca

SEQ ID NO: 58096 - DNA, 25 bp, Mus musculus
aaggacgcaccctgtgctttgggca

SEQ ID NO: 58097 - DNA, 25 bp, Mus musculus
aaggacgcagttatgtgccctgctc

SEQ ID NO: 58098 - DNA, 25 bp, Mus musculus
aaggacgcagttttgtgccctgctc

SEQ ID NO: 58099 - DNA, 25 bp, Mus musculus
aaggacgccaggctttgccaggaat

SEQ ID NO: 58100 - DNA, 25 bp, Mus musculus
aaggacgccagggtttgccaggaat

SEQ ID NO: 58101 - DNA, 25 bp, Mus musculus
aaggacgccgcacccacgaaggaga

SEQ ID NO: 58102 - DNA, 25 bp, Mus musculus
aaggacgccgcagccacgaaggaga

SEQ ID NO: 58103 - DNA, 25 bp, Mus musculus
aaggacgctgacatcaacgacatta

SEQ ID NO: 58104 - DNA, 25 bp, Mus musculus
aaggacgctgacttcaacgacatta

SEQ ID NO: 58105 - DNA, 25 bp, Mus musculus
aaggacgctgtcacacagcagacat

SEQ ID NO: 58106 - DNA, 25 bp, Mus musculus
aaggacgctgtctcacagcagacat

SEQ ID NO: 58107 - DNA, 25 bp, Mus musculus
aaggacggaactctggtctcaccca

SEQ ID NO: 58108 - DNA, 25 bp, Mus musculus
aaggacggaactgtggtctcaccca

SEQ ID NO: 58109 - DNA, 25 bp, Mus musculus
aaggacggacatccacagagagaac

SEQ ID NO: 58110 - DNA, 25 bp, Mus musculus
aaggacggacatgcacagagagaac

SEQ ID NO: 58111 - DNA, 25 bp, Mus musculus
aaggacggaggcagaccatctatct

SEQ ID NO: 58112 - DNA, 25 bp, Mus musculus
aaggacggaggctgaccatctatct

SEQ ID NO: 58113 - DNA, 25 bp, Mus musculus
aaggacggatttccagaattctggt

SEQ ID NO: 58114 - DNA, 25 bp, Mus musculus
aaggacggatttgcagaattctggt

SEQ ID NO: 58115 - DNA, 25 bp, Mus musculus
aaggacggcaacctgacctgcgagc

SEQ ID NO: 58116 - DNA, 25 bp, Mus musculus
aaggacggcaacgtgacctgcgagc

SEQ ID NO: 58117 - DNA, 25 bp, Mus musculus
aaggacggcctcagcttggagagct

SEQ ID NO: 58118 - DNA, 25 bp, Mus musculus
aaggacggcctctgcttggagagct

SEQ ID NO: 58119 - DNA, 25 bp, Mus musculus
aaggacggcttcatttgtcatgcaa

SEQ ID NO: 58120 - DNA, 25 bp, Mus musculus
aaggacggcttcttttgtcatgcaa

SEQ ID NO: 58121 - DNA, 25 bp, Mus musculus
aaggacggtgcaaggtgtgccctca

SEQ ID NO: 58122 - DNA, 25 bp, Mus musculus
aaggacggtgcatggtgtgccctca

SEQ ID NO: 58123 - DNA, 25 bp, Mus musculus
aaggacgtaattagtggctgtctca

SEQ ID NO: 58124 - DNA, 25 bp, Mus musculus
aaggacgtaatttgtggctgtctca

SEQ ID NO: 58125 - DNA, 25 bp, Mus musculus
aaggacgtcttcaagcacttaggcc

SEQ ID NO: 58126 - DNA, 25 bp, Mus musculus
aaggacgtcttctagcacttaggcc

SEQ ID NO: 58127 - DNA, 25 bp, Mus musculus
aaggacgtgaatccccaaagctttt

SEQ ID NO: 58128 - DNA, 25 bp, Mus musculus
aaggacgtgaatgcccaaagctttt

SEQ ID NO: 58129 - DNA, 25 bp, Mus musculus
aaggacgtgggcactctagatgaaa

SEQ ID NO: 58130 - DNA, 25 bp, Mus musculus
aaggacgtgggctctctagatgaaa

SEQ ID NO: 58131 - DNA, 25 bp, Mus musculus
aaggacgtgttgcacgcctgtgcct

SEQ ID NO: 58132 - DNA, 25 bp, Mus musculus
aaggacgtgttggacgcctgtgcct

SEQ ID NO: 58133 - DNA, 25 bp, Mus musculus
aaggacgttctgattccaagctcaa

SEQ ID NO: 58134 - DNA, 25 bp, Mus musculus
aaggacgttctgtttccaagctcaa

SEQ ID NO: 58135 - DNA, 25 bp, Mus musculus
aaggacgttgagatcagagctccag

SEQ ID NO: 58136 - DNA, 25 bp, Mus musculus
aaggacgttgagttcagagctccag

SEQ ID NO: 58137 - DNA, 25 bp, Mus musculus
aaggactacagcacttcaaagttta

SEQ ID NO: 58138 - DNA, 25 bp, Mus musculus
aaggactacagctcttcaaagttta

SEQ ID NO: 58139 - DNA, 25 bp, Mus musculus
aaggactacaggacagctgccaacg

SEQ ID NO: 58140 - DNA, 25 bp, Mus musculus
aaggactacaggtcagctgccaacg

SEQ ID NO: 58141 - DNA, 25 bp, Mus musculus
aaggactacatgcatttcatcttac

SEQ ID NO: 58142 - DNA, 25 bp, Mus musculus
aaggactacatggatttcatcttac

SEQ ID NO: 58143 - DNA, 25 bp, Mus musculus
aaggactacccaagataacatgcca

SEQ ID NO: 58144 - DNA, 25 bp, Mus musculus
aaggactacccatgataacatgcca

SEQ ID NO: 58145 - DNA, 25 bp, Mus musculus
aaggactacctgatactcttggagt

SEQ ID NO: 58146 - DNA, 25 bp, Mus musculus
aaggactacctgttactcttggagt

SEQ ID NO: 58147 - DNA, 25 bp, Mus musculus
aaggactactgaatcgctctgttca

SEQ ID NO: 58148 - DNA, 25 bp, Mus musculus
aaggactactgattcgctctgttca

SEQ ID NO: 58149 - DNA, 25 bp, Mus musculus
aaggactagataagagttacattca

SEQ ID NO: 58150 - DNA, 25 bp, Mus musculus
aaggactagatatgagttacattca

SEQ ID NO: 58151 - DNA, 25 bp, Mus musculus
aaggactagcctccttcatgtgagt

SEQ ID NO: 58152 - DNA, 25 bp, Mus musculus
aaggactagcctgcttcatgtgagt

SEQ ID NO: 58153 - DNA, 25 bp, Mus musculus
aaggactagctcaggttcaacaaat

SEQ ID NO: 58154 - DNA, 25 bp, Mus musculus
aaggactagctctggttcaacaaat

SEQ ID NO: 58155 - DNA, 25 bp, Mus musculus
aaggactaggctctaagcatccctg

SEQ ID NO: 58156 - DNA, 25 bp, Mus musculus
aaggactaggctgtaagcatccctg

SEQ ID NO: 58157 - DNA, 25 bp, Mus musculus
aaggactagtgaatgttcatgtttc

SEQ ID NO: 58158 - DNA, 25 bp, Mus musculus
aaggactagtgattgttcatgtttc

SEQ ID NO: 58159 - DNA, 25 bp, Mus musculus
aaggactatcctcacttttttatga

SEQ ID NO: 58160 - DNA, 25 bp, Mus musculus
aaggactatcctgacttttttatga

SEQ ID NO: 58161 - DNA, 25 bp, Mus musculus
aaggactatggcacagcactccgag

SEQ ID NO: 58162 - DNA, 25 bp, Mus musculus
aaggactatggctcagcactccgag

SEQ ID NO: 58163 - DNA, 25 bp, Mus musculus
aaggactatggtaagccctgctaga

SEQ ID NO: 58164 - DNA, 25 bp, Mus musculus
aaggactatggttagccctgctaga

SEQ ID NO: 58165 - DNA, 25 bp, Mus musculus
aaggactatgttctcaggcccaagt

SEQ ID NO: 58166 - DNA, 25 bp, Mus musculus
aaggactatgttgtcaggcccaagt

SEQ ID NO: 58167 - DNA, 25 bp, Mus musculus
aaggactattagctcgaacttcgat

SEQ ID NO: 58168 - DNA, 25 bp, Mus musculus
aaggactattaggtcgaacttcgat

SEQ ID NO: 58169 - DNA, 25 bp, Mus musculus
aaggactcaaatactgccgctaggg

SEQ ID NO: 58170 - DNA, 25 bp, Mus musculus
aaggactcaaattctgccgctaggg

SEQ ID NO: 58171 - DNA, 25 bp, Mus musculus
aaggactcactgattgacaggagac

SEQ ID NO: 58172 - DNA, 25 bp, Mus musculus
aaggactcactgtttgacaggagac

SEQ ID NO: 58173 - DNA, 25 bp, Mus musculus
aaggactcagggaagccgctacaca

SEQ ID NO: 58174 - DNA, 25 bp, Mus musculus
aaggactcagggtagccgctacaca

SEQ ID NO: 58175 - DNA, 25 bp, Mus musculus
aaggactccaataacatcttcaagg

SEQ ID NO: 58176 - DNA, 25 bp, Mus musculus
aaggactccaattacatcttcaagg

SEQ ID NO: 58177 - DNA, 25 bp, Mus musculus
aaggactccaccacatcaacctttc

SEQ ID NO: 58178 - DNA, 25 bp, Mus musculus
aaggactccacctcatcaacctttc

SEQ ID NO: 58179 - DNA, 25 bp, Mus musculus
aaggactccagcacagtcgtagagt

SEQ ID NO: 58180 - DNA, 25 bp, Mus musculus
aaggactccagctcagtcgtagagt

SEQ ID NO: 58181 - DNA, 25 bp, Mus musculus
aaggactcccagcataagcgttctg

SEQ ID NO: 58182 - DNA, 25 bp, Mus musculus
aaggactcccaggataagcgttctg

SEQ ID NO: 58183 - DNA, 25 bp, Mus musculus
aaggactccctgaggacatagttca

SEQ ID NO: 58184 - DNA, 25 bp, Mus musculus
aaggactccctgtggacatagttca

SEQ ID NO: 58185 - DNA, 25 bp, Mus musculus
aaggactccgagctgactctgcatg

SEQ ID NO: 58186 - DNA, 25 bp, Mus musculus
aaggactccgaggtgactctgcatg

SEQ ID NO: 58187 - DNA, 25 bp, Mus musculus
aaggactcctggacacactagtgca

SEQ ID NO: 58188 - DNA, 25 bp, Mus musculus
aaggactcctggtcacactagtgca

SEQ ID NO: 58189 - DNA, 25 bp, Mus musculus
aaggactcggcaaccacgtcgtgga

SEQ ID NO: 58190 - DNA, 25 bp, Mus musculus
aaggactcggcatccacgtcgtgga

SEQ ID NO: 58191 - DNA, 25 bp, Mus musculus
aaggactcgggtagtctgacatcgc

SEQ ID NO: 58192 - DNA, 25 bp, Mus musculus
aaggactcgggttgtctgacatcgc

SEQ ID NO: 58193 - DNA, 25 bp, Mus musculus
aaggactcggtcacttggcctttca

SEQ ID NO: 58194 - DNA, 25 bp, Mus musculus
aaggactcggtctcttggcctttca

SEQ ID NO: 58195 - DNA, 25 bp, Mus musculus
aaggactcgtaacgcgaactggcat

SEQ ID NO: 58196 - DNA, 25 bp, Mus musculus
aaggactcgtaaggcgaactggcat

SEQ ID NO: 58197 - DNA, 25 bp, Mus musculus
aaggactctgaaaacaccgtgttct

SEQ ID NO: 58198 - DNA, 25 bp, Mus musculus
aaggactctgaatacaccgtgttct

SEQ ID NO: 58199 - DNA, 25 bp, Mus musculus
aaggactctgatctctatcagctgc

SEQ ID NO: 58200 - DNA, 25 bp, Mus musculus
aaggactctgatgtctatcagctgc

SEQ ID NO: 58201 - DNA, 25 bp, Mus musculus
aaggactctgtaaaaccaggttcaa

SEQ ID NO: 58202 - DNA, 25 bp, Mus musculus
aaggactctgtataaccaggttcaa

SEQ ID NO: 58203 - DNA, 25 bp, Mus musculus
aaggactcttcacccagtgttagaa

SEQ ID NO: 58204 - DNA, 25 bp, Mus musculus
aaggactcttcagccagtgttagaa

SEQ ID NO: 58205 - DNA, 25 bp, Mus musculus
aaggactgacatccctgtgttccca

SEQ ID NO: 58206 - DNA, 25 bp, Mus musculus
aaggactgacatgcctgtgttccca

SEQ ID NO: 58207 - DNA, 25 bp, Mus musculus
aaggactgacgccaccatgtgcaat

SEQ ID NO: 58208 - DNA, 25 bp, Mus musculus
aaggactgacgcgaccatgtgcaat

SEQ ID NO: 58209 - DNA, 25 bp, Mus musculus
aaggactgactcataattggatcta

SEQ ID NO: 58210 - DNA, 25 bp, Mus musculus
aaggactgactcttaattggatcta

SEQ ID NO: 58211 - DNA, 25 bp, Mus musculus
aaggactgacttatccttgatccca

SEQ ID NO: 58212 - DNA, 25 bp, Mus musculus
aaggactgacttttccttgatccca

SEQ ID NO: 58213 - DNA, 25 bp, Mus musculus
aaggactgagggactgtcttttctc

SEQ ID NO: 58214 - DNA, 25 bp, Mus musculus
aaggactgagggtctgtcttttctc

SEQ ID NO: 58215 - DNA, 25 bp, Mus musculus
aaggactgagtgaagctggccacac

SEQ ID NO: 58216 - DNA, 25 bp, Mus musculus
aaggactgagtgagctctcttctgc

SEQ ID NO: 58217 - DNA, 25 bp, Mus musculus
aaggactgagtgtagctggccacac

SEQ ID NO: 58218 - DNA, 25 bp, Mus musculus
aaggactgagtgtgctctcttctgc

SEQ ID NO: 58219 - DNA, 25 bp, Mus musculus
aaggactgcaacatctaggtacaag

SEQ ID NO: 58220 - DNA, 25 bp, Mus musculus
aaggactgcaacttctaggtacaag

SEQ ID NO: 58221 - DNA, 25 bp, Mus musculus
aaggactgcagcattggttgaagaa

SEQ ID NO: 58222 - DNA, 25 bp, Mus musculus
aaggactgcagctttggttgaagaa

SEQ ID NO: 58223 - DNA, 25 bp, Mus musculus
aaggactgcatccaccagccggagc

SEQ ID NO: 58224 - DNA, 25 bp, Mus musculus
aaggactgcatccacgtaggctggt

SEQ ID NO: 58225 - DNA, 25 bp, Mus musculus
aaggactgcatcgaccagccggagc

SEQ ID NO: 58226 - DNA, 25 bp, Mus musculus
aaggactgcatcgacgtaggctggt

SEQ ID NO: 58227 - DNA, 25 bp, Mus musculus
aaggactgccataatcacacatgcc

SEQ ID NO: 58228 - DNA, 25 bp, Mus musculus
aaggactgccattatcacacatgcc

SEQ ID NO: 58229 - DNA, 25 bp, Mus musculus
aaggactgcctacgtgtcagggcct

SEQ ID NO: 58230 - DNA, 25 bp, Mus musculus
aaggactgcctaggtgtcagggcct

SEQ ID NO: 58231 - DNA, 25 bp, Mus musculus
aaggactgctggcatacccagcctc

SEQ ID NO: 58232 - DNA, 25 bp, Mus musculus
aaggactgctgggatacccagcctc

SEQ ID NO: 58233 - DNA, 25 bp, Mus musculus
aaggactgcttgctgtcccgtgcaa

SEQ ID NO: 58234 - DNA, 25 bp, Mus musculus
aaggactgcttggtgtcccgtgcaa

SEQ ID NO: 58235 - DNA, 25 bp, Mus musculus
aaggactggaggaggcagtgtgccc

SEQ ID NO: 58236 - DNA, 25 bp, Mus musculus
aaggactggaggtggcagtgtgccc

SEQ ID NO: 58237 - DNA, 25 bp, Mus musculus
aaggactggcatcgtccctgcctga

SEQ ID NO: 58238 - DNA, 25 bp, Mus musculus
aaggactggcatggtccctgcctga

SEQ ID NO: 58239 - DNA, 25 bp, Mus musculus
aaggactggcgtacattcaagaccc

SEQ ID NO: 58240 - DNA, 25 bp, Mus musculus
aaggactggcgttcattcaagaccc

SEQ ID NO: 58241 - DNA, 25 bp, Mus musculus
aaggactgggaaaggacttctcatc

SEQ ID NO: 58242 - DNA, 25 bp, Mus musculus
aaggactgggaatggacttctcatc

SEQ ID NO: 58243 - DNA, 25 bp, Mus musculus
aaggactggtacacgggtcgcactg

SEQ ID NO: 58244 - DNA, 25 bp, Mus musculus
aaggactggtactcgggtcgcactg

SEQ ID NO: 58245 - DNA, 25 bp, Mus musculus
aaggactggtctatctatatcctgg

SEQ ID NO: 58246 - DNA, 25 bp, Mus musculus
aaggactggtctttctatatcctgg

SEQ ID NO: 58247 - DNA, 25 bp, Mus musculus
aaggactgtacccatgttattttat

SEQ ID NO: 58248 - DNA, 25 bp, Mus musculus
aaggactgtaccgatgttattttat

SEQ ID NO: 58249 - DNA, 25 bp, Mus musculus
aaggactgtcacagatgttcctccc

SEQ ID NO: 58250 - DNA, 25 bp, Mus musculus
aaggactgtcactgatgttcctccc

SEQ ID NO: 58251 - DNA, 25 bp, Mus musculus
aaggactgtcccacctcgttgttag

SEQ ID NO: 58252 - DNA, 25 bp, Mus musculus
aaggactgtccctcctcgttgttag

SEQ ID NO: 58253 - DNA, 25 bp, Mus musculus
aaggactgtctacaacattggtgaa

SEQ ID NO: 58254 - DNA, 25 bp, Mus musculus
aaggactgtctagaacattggtgaa

SEQ ID NO: 58255 - DNA, 25 bp, Mus musculus
aaggactgtgccagtgctgatgtcc

SEQ ID NO: 58256 - DNA, 25 bp, Mus musculus
aaggactgtgcctgtgctgatgtcc

SEQ ID NO: 58257 - DNA, 25 bp, Mus musculus
aaggactgtgggagcttccgaatgc

SEQ ID NO: 58258 - DNA, 25 bp, Mus musculus
aaggactgtgggatctgtaaagcta

SEQ ID NO: 58259 - DNA, 25 bp, Mus musculus
aaggactgtgggtgcttccgaatgc

SEQ ID NO: 58260 - DNA, 25 bp, Mus musculus
aaggactgtgggttctgtaaagcta

SEQ ID NO: 58261 - DNA, 25 bp, Mus musculus
aaggactgttcaaatctactgtaaa

SEQ ID NO: 58262 - DNA, 25 bp, Mus musculus
aaggactgttcatatctactgtaaa

SEQ ID NO: 58263 - DNA, 25 bp, Mus musculus
aaggacttaactcctattgctactt

SEQ ID NO: 58264 - DNA, 25 bp, Mus musculus
aaggacttaactgctattgctactt

SEQ ID NO: 58265 - DNA, 25 bp, Mus musculus
aaggacttacaaaccaccagagcct

SEQ ID NO: 58266 - DNA, 25 bp, Mus musculus
aaggacttacaatccaccagagcct

SEQ ID NO: 58267 - DNA, 25 bp, Mus musculus
aaggacttactcagccacaaatggg

SEQ ID NO: 58268 - DNA, 25 bp, Mus musculus
aaggacttactctgccacaaatggg

SEQ ID NO: 58269 - DNA, 25 bp, Mus musculus
aaggacttagccatggacctggtct

SEQ ID NO: 58270 - DNA, 25 bp, Mus musculus
aaggacttagccttggacctggtct

SEQ ID NO: 58271 - DNA, 25 bp, Mus musculus
aaggacttagtcagctgtgtaaaca

SEQ ID NO: 58272 - DNA, 25 bp, Mus musculus
aaggacttagtctgctgtgtaaaca

SEQ ID NO: 58273 - DNA, 25 bp, Mus musculus
aaggacttcaaaataccacttgtga

SEQ ID NO: 58274 - DNA, 25 bp, Mus musculus
aaggacttcaaattaccacttgtga

SEQ ID NO: 58275 - DNA, 25 bp, Mus musculus
aaggacttcagccaatttgacttca

SEQ ID NO: 58276 - DNA, 25 bp, Mus musculus
aaggacttcagcgaatttgacttca

SEQ ID NO: 58277 - DNA, 25 bp, Mus musculus
aaggacttcattcccttctactcta

SEQ ID NO: 58278 - DNA, 25 bp, Mus musculus
aaggacttcattgccttctactcta

SEQ ID NO: 58279 - DNA, 25 bp, Mus musculus
aaggacttccacaatgtcaaatgaa

SEQ ID NO: 58280 - DNA, 25 bp, Mus musculus
aaggacttccactatgtcaaatgaa

SEQ ID NO: 58281 - DNA, 25 bp, Mus musculus
aaggacttccctcagatgggacgtt

SEQ ID NO: 58282 - DNA, 25 bp, Mus musculus
aaggacttccctgagatgggacgtt

SEQ ID NO: 58283 - DNA, 25 bp, Mus musculus
aaggacttcctactgccaagtactg

SEQ ID NO: 58284 - DNA, 25 bp, Mus musculus
aaggacttcctagtgccaagtactg

SEQ ID NO: 58285 - DNA, 25 bp, Mus musculus
aaggacttccttaaagcatcattac

SEQ ID NO: 58286 - DNA, 25 bp, Mus musculus
aaggacttcctttaagcatcattac

SEQ ID NO: 58287 - DNA, 25 bp, Mus musculus
aaggacttcgaaccattccctatgg

SEQ ID NO: 58288 - DNA, 25 bp, Mus musculus
aaggacttcgaagcattccctatgg

SEQ ID NO: 58289 - DNA, 25 bp, Mus musculus
aaggacttctgtctgctgtttgtct

SEQ ID NO: 58290 - DNA, 25 bp, Mus musculus
aaggacttctgtgtgctgtttgtct

SEQ ID NO: 58291 - DNA, 25 bp, Mus musculus
aaggacttgactcctgcgtttctgt

SEQ ID NO: 58292 - DNA, 25 bp, Mus musculus
aaggacttgactgctgcgtttctgt

SEQ ID NO: 58293 - DNA, 25 bp, Mus musculus
aaggacttgctgctcagtgctgcca

SEQ ID NO: 58294 - DNA, 25 bp, Mus musculus
aaggacttgctggtcagtgctgcca

SEQ ID NO: 58295 - DNA, 25 bp, Mus musculus
aaggacttgcttcttaccacacaag

SEQ ID NO: 58296 - DNA, 25 bp, Mus musculus
aaggacttgcttgttaccacacaag

SEQ ID NO: 58297 - DNA, 25 bp, Mus musculus
aaggacttggttcccatgcagcagt

SEQ ID NO: 58298 - DNA, 25 bp, Mus musculus
aaggacttggttgccatgcagcagt

SEQ ID NO: 58299 - DNA, 25 bp, Mus musculus
aaggacttgtgacccagcagtgcaa

SEQ ID NO: 58300 - DNA, 25 bp, Mus musculus
aaggacttgtgacctctgtactgaa

SEQ ID NO: 58301 - DNA, 25 bp, Mus musculus
aaggacttgtgagccagcagtgcaa

SEQ ID NO: 58302 - DNA, 25 bp, Mus musculus
aaggacttgtgagctctgtactgaa

SEQ ID NO: 58303 - DNA, 25 bp, Mus musculus
aaggactttacacactgccctatta

SEQ ID NO: 58304 - DNA, 25 bp, Mus musculus
aaggactttacagactgccctatta

SEQ ID NO: 58305 - DNA, 25 bp, Mus musculus
aaggactttatgctggcatctgaca

SEQ ID NO: 58306 - DNA, 25 bp, Mus musculus
aaggactttatgctttgcaactgtg

SEQ ID NO: 58307 - DNA, 25 bp, Mus musculus
aaggactttatggtggcatctgaca

SEQ ID NO: 58308 - DNA, 25 bp, Mus musculus
aaggactttatggtttgcaactgtg

SEQ ID NO: 58309 - DNA, 25 bp, Mus musculus
aaggactttcatacttgggcaacaa

SEQ ID NO: 58310 - DNA, 25 bp, Mus musculus
aaggactttcattcttgggcaacaa

SEQ ID NO: 58311 - DNA, 25 bp, Mus musculus
aaggactttctcagtacagtatatt

SEQ ID NO: 58312 - DNA, 25 bp, Mus musculus
aaggactttctctgtacagtatatt

SEQ ID NO: 58313 - DNA, 25 bp, Mus musculus
aaggactttgagcttcggcacggca

SEQ ID NO: 58314 - DNA, 25 bp, Mus musculus
aaggactttgaggttcggcacggca

SEQ ID NO: 58315 - DNA, 25 bp, Mus musculus
aaggactttgtgctgcttgtgtcac

SEQ ID NO: 58316 - DNA, 25 bp, Mus musculus
aaggactttgtggtgcttgtgtcac

SEQ ID NO: 58317 - DNA, 25 bp, Mus musculus
aaggagaaagtgacccctcacttgc

SEQ ID NO: 58318 - DNA, 25 bp, Mus musculus
aaggagaaagtgtcccctcacttgc

SEQ ID NO: 58319 - DNA, 25 bp, Mus musculus
aaggagaaatgacgcagcgctgcct

SEQ ID NO: 58320 - DNA, 25 bp, Mus musculus
aaggagaaatgaggcagcgctgcct

SEQ ID NO: 58321 - DNA, 25 bp, Mus musculus
aaggagaagactcccattatagaag

SEQ ID NO: 58322 - DNA, 25 bp, Mus musculus
aaggagaagactgccattatagaag

SEQ ID NO: 58323 - DNA, 25 bp, Mus musculus
aaggagaagcacaagctcttaacag

SEQ ID NO: 58324 - DNA, 25 bp, Mus musculus
aaggagaagcactagctcttaacag

SEQ ID NO: 58325 - DNA, 25 bp, Mus musculus
aaggagaagccacccacgacctggg

SEQ ID NO: 58326 - DNA, 25 bp, Mus musculus
aaggagaagccagccacgacctggg

SEQ ID NO: 58327 - DNA, 25 bp, Mus musculus
aaggagaagctaaattccctcggga

SEQ ID NO: 58328 - DNA, 25 bp, Mus musculus
aaggagaagctatattccctcggga

SEQ ID NO: 58329 - DNA, 25 bp, Mus musculus
aaggagaaggaaaccccagatggaa

SEQ ID NO: 58330 - DNA, 25 bp, Mus musculus
aaggagaaggaatccccagatggaa

SEQ ID NO: 58331 - DNA, 25 bp, Mus musculus
aaggagaatacacctaccctctgag

SEQ ID NO: 58332 - DNA, 25 bp, Mus musculus
aaggagaatacagctaccctctgag

SEQ ID NO: 58333 - DNA, 25 bp, Mus musculus
aaggagaatcacattcttccactga

SEQ ID NO: 58334 - DNA, 25 bp, Mus musculus
aaggagaatcactttcttccactga

SEQ ID NO: 58335 - DNA, 25 bp, Mus musculus
aaggagaatgcacctgccatcatct

SEQ ID NO: 58336 - DNA, 25 bp, Mus musculus
aaggagaatgcagctgccatcatct

SEQ ID NO: 58337 - DNA, 25 bp, Mus musculus
aaggagacaagcaggctcagcagcc

SEQ ID NO: 58338 - DNA, 25 bp, Mus musculus
aaggagacaagctggctcagcagcc

SEQ ID NO: 58339 - DNA, 25 bp, Mus musculus
aaggagacaatgaatgttctggaac

SEQ ID NO: 58340 - DNA, 25 bp, Mus musculus
aaggagacaatgtatgttctggaac

SEQ ID NO: 58341 - DNA, 25 bp, Mus musculus
aaggagacaattacctttggagaag

SEQ ID NO: 58342 - DNA, 25 bp, Mus musculus
aaggagacaatttcctttggagaag

SEQ ID NO: 58343 - DNA, 25 bp, Mus musculus
aaggagacacgcagtatcccaatgc

SEQ ID NO: 58344 - DNA, 25 bp, Mus musculus
aaggagacacgctgtatcccaatgc

SEQ ID NO: 58345 - DNA, 25 bp, Mus musculus
aaggagacagacctagtgtccccac

SEQ ID NO: 58346 - DNA, 25 bp, Mus musculus
aaggagacagacgtagtgtccccac

SEQ ID NO: 58347 - DNA, 25 bp, Mus musculus
aaggagacagctagaccccgagggc

SEQ ID NO: 58348 - DNA, 25 bp, Mus musculus
aaggagacagcttgaccccgagggc

SEQ ID NO: 58349 - DNA, 25 bp, Mus musculus
aaggagacagtcattccagctcagc

SEQ ID NO: 58350 - DNA, 25 bp, Mus musculus
aaggagacagtctttccagctcagc

SEQ ID NO: 58351 - DNA, 25 bp, Mus musculus
aaggagacatggactttcgtgccct

SEQ ID NO: 58352 - DNA, 25 bp, Mus musculus
aaggagacatggtctttcgtgccct

SEQ ID NO: 58353 - DNA, 25 bp, Mus musculus
aaggagaccagcaggtaggctgctt

SEQ ID NO: 58354 - DNA, 25 bp, Mus musculus
aaggagaccagcatacacagtccgt

SEQ ID NO: 58355 - DNA, 25 bp, Mus musculus
aaggagaccagctggtaggctgctt

SEQ ID NO: 58356 - DNA, 25 bp, Mus musculus
aaggagaccagcttacacagtccgt

SEQ ID NO: 58357 - DNA, 25 bp, Mus musculus
aaggagacccagagcgtcttggaga

SEQ ID NO: 58358 - DNA, 25 bp, Mus musculus
aaggagacccagtgcgtcttggaga

SEQ ID NO: 58359 - DNA, 25 bp, Mus musculus
aaggagaccctcagaatcctgtgtt

SEQ ID NO: 58360 - DNA, 25 bp, Mus musculus
aaggagaccctctgaatcctgtgtt

SEQ ID NO: 58361 - DNA, 25 bp, Mus musculus
aaggagacctaactgaccctctgca

SEQ ID NO: 58362 - DNA, 25 bp, Mus musculus
aaggagacctaagtgaccctctgca

SEQ ID NO: 58363 - DNA, 25 bp, Mus musculus
aaggagacctatacccagctcggga

SEQ ID NO: 58364 - DNA, 25 bp, Mus musculus
aaggagacctattcccagctcggga

SEQ ID NO: 58365 - DNA, 25 bp, Mus musculus
aaggagacgctgaccctgtgtttga

SEQ ID NO: 58366 - DNA, 25 bp, Mus musculus
aaggagacgctgtccctgtgtttga

SEQ ID NO: 58367 - DNA, 25 bp, Mus musculus
aaggagactccaatgtttactttct

SEQ ID NO: 58368 - DNA, 25 bp, Mus musculus
aaggagactccattgtttactttct

SEQ ID NO: 58369 - DNA, 25 bp, Mus musculus
aaggagactgacatactgagggtat

SEQ ID NO: 58370 - DNA, 25 bp, Mus musculus
aaggagactgacttactgagggtat

SEQ ID NO: 58371 - DNA, 25 bp, Mus musculus
aaggagactgatcacatcttggctt

SEQ ID NO: 58372 - DNA, 25 bp, Mus musculus
aaggagactgatgacatcttggctt

SEQ ID NO: 58373 - DNA, 25 bp, Mus musculus
aaggagactgcacctgggattctgt

SEQ ID NO: 58374 - DNA, 25 bp, Mus musculus
aaggagactgcagctgggattctgt

SEQ ID NO: 58375 - DNA, 25 bp, Mus musculus
aaggagactgggagctgctgtgcag

SEQ ID NO: 58376 - DNA, 25 bp, Mus musculus
aaggagactgggtgctgctgtgcag

SEQ ID NO: 58377 - DNA, 25 bp, Mus musculus
aaggagactggtcttactgccgcta

SEQ ID NO: 58378 - DNA, 25 bp, Mus musculus
aaggagactggtgttactgccgcta

SEQ ID NO: 58379 - DNA, 25 bp, Mus musculus
aaggagacttccacagccttgccct

SEQ ID NO: 58380 - DNA, 25 bp, Mus musculus
aaggagacttcctcagccttgccct

SEQ ID NO: 58381 - DNA, 25 bp, Mus musculus
aaggagagaagcctcttccctggct

SEQ ID NO: 58382 - DNA, 25 bp, Mus musculus
aaggagagaagcgtcttccctggct

SEQ ID NO: 58383 - DNA, 25 bp, Mus musculus
aaggagagaccactcttcagtgtat

SEQ ID NO: 58384 - DNA, 25 bp, Mus musculus
aaggagagaccagtcttcagtgtat

SEQ ID NO: 58385 - DNA, 25 bp, Mus musculus
aaggagagagctcggctttccaagt

SEQ ID NO: 58386 - DNA, 25 bp, Mus musculus
aaggagagagctgggctttccaagt

SEQ ID NO: 58387 - DNA, 25 bp, Mus musculus
aaggagagattgagggccttcacca

SEQ ID NO: 58388 - DNA, 25 bp, Mus musculus
aaggagagattgtgggccttcacca

SEQ ID NO: 58389 - DNA, 25 bp, Mus musculus
aaggagagcctactgtaccaaaatg

SEQ ID NO: 58390 - DNA, 25 bp, Mus musculus
aaggagagcctagtgtaccaaaatg

SEQ ID NO: 58391 - DNA, 25 bp, Mus musculus
aaggagagcctcagtctcattcatc

SEQ ID NO: 58392 - DNA, 25 bp, Mus musculus
aaggagagcctccagaactcatcgc

SEQ ID NO: 58393 - DNA, 25 bp, Mus musculus
aaggagagcctcgagaactcatcgc

SEQ ID NO: 58394 - DNA, 25 bp, Mus musculus
aaggagagcctctgtctcattcatc

SEQ ID NO: 58395 - DNA, 25 bp, Mus musculus
aaggagagcggcatctgcatggact

SEQ ID NO: 58396 - DNA, 25 bp, Mus musculus
aaggagagcggcttctgcatggact

SEQ ID NO: 58397 - DNA, 25 bp, Mus musculus
aaggagagctacacggtgtacgtgt

SEQ ID NO: 58398 - DNA, 25 bp, Mus musculus
aaggagagctactcggtgtacgtgt

SEQ ID NO: 58399 - DNA, 25 bp, Mus musculus
aaggagagctcacagacccgaagct

SEQ ID NO: 58400 - DNA, 25 bp, Mus musculus
aaggagagctcagagacccgaagct

SEQ ID NO: 58401 - DNA, 25 bp, Mus musculus
aaggagagctgacccaggtctgatc

SEQ ID NO: 58402 - DNA, 25 bp, Mus musculus
aaggagagctgagccaggtctgatc

SEQ ID NO: 58403 - DNA, 25 bp, Mus musculus
aaggagagctttcatggcggtacat

SEQ ID NO: 58404 - DNA, 25 bp, Mus musculus
aaggagagctttgatggcggtacat

SEQ ID NO: 58405 - DNA, 25 bp, Mus musculus
aaggagaggctcctcttggtaccgc

SEQ ID NO: 58406 - DNA, 25 bp, Mus musculus
aaggagaggctcgtcttggtaccgc

SEQ ID NO: 58407 - DNA, 25 bp, Mus musculus
aaggagaggtgcctagtcttactgc

SEQ ID NO: 58408 - DNA, 25 bp, Mus musculus
aaggagaggtgcgtagtcttactgc

SEQ ID NO: 58409 - DNA, 25 bp, Mus musculus
aaggagagtcccatccagccagagg

SEQ ID NO: 58410 - DNA, 25 bp, Mus musculus
aaggagagtcccttccagccagagg

SEQ ID NO: 58411 - DNA, 25 bp, Mus musculus
aaggagagtcgaagctgttcccact

SEQ ID NO: 58412 - DNA, 25 bp, Mus musculus
aaggagagtcgatgctgttcccact

SEQ ID NO: 58413 - DNA, 25 bp, Mus musculus
aaggagagtgccatggctaccacct

SEQ ID NO: 58414 - DNA, 25 bp, Mus musculus
aaggagagtgccttggctaccacct

SEQ ID NO: 58415 - DNA, 25 bp, Mus musculus
aaggagagttccaggcgctacgaag

SEQ ID NO: 58416 - DNA, 25 bp, Mus musculus
aaggagagttcctggcgctacgaag

SEQ ID NO: 58417 - DNA, 25 bp, Mus musculus
aaggagagttgcaggtctgatcaaa

SEQ ID NO: 58418 - DNA, 25 bp, Mus musculus
aaggagagttgctggtctgatcaaa

SEQ ID NO: 58419 - DNA, 25 bp, Mus musculus
aaggagataggtcctttccccagag

SEQ ID NO: 58420 - DNA, 25 bp, Mus musculus
aaggagataggtgctttccccagag

SEQ ID NO: 58421 - DNA, 25 bp, Mus musculus
aaggagatcaagcaggagcttctgc

SEQ ID NO: 58422 - DNA, 25 bp, Mus musculus
aaggagatcaaggaggagcttctgc

SEQ ID NO: 58423 - DNA, 25 bp, Mus musculus
aaggagatcacacacggcaaccgac

SEQ ID NO: 58424 - DNA, 25 bp, Mus musculus
aaggagatcacagacggcaaccgac

SEQ ID NO: 58425 - DNA, 25 bp, Mus musculus
aaggagatcactagtgagagctgaa

SEQ ID NO: 58426 - DNA, 25 bp, Mus musculus
aaggagatcacttgtgagagctgaa

SEQ ID NO: 58427 - DNA, 25 bp, Mus musculus
aaggagatcagtatgccaagtgcat

SEQ ID NO: 58428 - DNA, 25 bp, Mus musculus
aaggagatcagtttgccaagtgcat

SEQ ID NO: 58429 - DNA, 25 bp, Mus musculus
aaggagatccctcagcatgtaccgt

SEQ ID NO: 58430 - DNA, 25 bp, Mus musculus
aaggagatccctgagcatgtaccgt

SEQ ID NO: 58431 - DNA, 25 bp, Mus musculus
aaggagatcgccaacggatgccaac

SEQ ID NO: 58432 - DNA, 25 bp, Mus musculus
aaggagatcgcctacggatgccaac

SEQ ID NO: 58433 - DNA, 25 bp, Mus musculus
aaggagatctacacgcacttcacgt

SEQ ID NO: 58434 - DNA, 25 bp, Mus musculus
aaggagatctactcgcacttcacgt

SEQ ID NO: 58435 - DNA, 25 bp, Mus musculus
aaggagatctcaacccgtcggccat

SEQ ID NO: 58436 - DNA, 25 bp, Mus musculus
aaggagatctcatcccgtcggccat

SEQ ID NO: 58437 - DNA, 25 bp, Mus musculus
aaggagatctcccagttaatagcag

SEQ ID NO: 58438 - DNA, 25 bp, Mus musculus
aaggagatctccgagttaatagcag

SEQ ID NO: 58439 - DNA, 25 bp, Mus musculus
aaggagatctgcaatgcccttcggg

SEQ ID NO: 58440 - DNA, 25 bp, Mus musculus
aaggagatctgcactgtggctatca

SEQ ID NO: 58441 - DNA, 25 bp, Mus musculus
aaggagatctgctatgcccttcggg

SEQ ID NO: 58442 - DNA, 25 bp, Mus musculus
aaggagatctgctctgtggctatca

SEQ ID NO: 58443 - DNA, 25 bp, Mus musculus
aaggagatcttcagctctagggagc

SEQ ID NO: 58444 - DNA, 25 bp, Mus musculus
aaggagatcttctgctctagggagc

SEQ ID NO: 58445 - DNA, 25 bp, Mus musculus
aaggagatgaaccacccaagccagc

SEQ ID NO: 58446 - DNA, 25 bp, Mus musculus
aaggagatgaacgacccaagccagc

SEQ ID NO: 58447 - DNA, 25 bp, Mus musculus
aaggagatgactccttccttgggac

SEQ ID NO: 58448 - DNA, 25 bp, Mus musculus
aaggagatgactgcttccttgggac

SEQ ID NO: 58449 - DNA, 25 bp, Mus musculus
aaggagatgcatatcactgtacatt

SEQ ID NO: 58450 - DNA, 25 bp, Mus musculus
aaggagatgcatttcactgtacatt

SEQ ID NO: 58451 - DNA, 25 bp, Mus musculus
aaggagatgcccacatagacccttc

SEQ ID NO: 58452 - DNA, 25 bp, Mus musculus
aaggagatgccctcatagacccttc

SEQ ID NO: 58453 - DNA, 25 bp, Mus musculus
aaggagatgcgtcctgcaccaggaa

SEQ ID NO: 58454 - DNA, 25 bp, Mus musculus
aaggagatgcgtgctgcaccaggaa

SEQ ID NO: 58455 - DNA, 25 bp, Mus musculus
aaggagatggatcccatacaggcca

SEQ ID NO: 58456 - DNA, 25 bp, Mus musculus
aaggagatggatgccatacaggcca

SEQ ID NO: 58457 - DNA, 25 bp, Mus musculus
aaggagatggcaattcagggaccaa

SEQ ID NO: 58458 - DNA, 25 bp, Mus musculus
aaggagatggcatttcagggaccaa

SEQ ID NO: 58459 - DNA, 25 bp, Mus musculus
aaggagatgttcagtgcctttctca

SEQ ID NO: 58460 - DNA, 25 bp, Mus musculus
aaggagatgttctgtgcctttctca

SEQ ID NO: 58461 - DNA, 25 bp, Mus musculus
aaggagatgttgagactggaagaaa

SEQ ID NO: 58462 - DNA, 25 bp, Mus musculus
aaggagatgttgtgactggaagaaa

SEQ ID NO: 58463 - DNA, 25 bp, Mus musculus
aaggagattactcctctggctccta

SEQ ID NO: 58464 - DNA, 25 bp, Mus musculus
aaggagattactgctctggctccta

SEQ ID NO: 58465 - DNA, 25 bp, Mus musculus
aaggagattcctcaactagcaatgg

SEQ ID NO: 58466 - DNA, 25 bp, Mus musculus
aaggagattcctgaactagcaatgg

SEQ ID NO: 58467 - DNA, 25 bp, Mus musculus
aaggagattctacactgcaggtttc

SEQ ID NO: 58468 - DNA, 25 bp, Mus musculus
aaggagattctagactgcaggtttc

SEQ ID NO: 58469 - DNA, 25 bp, Mus musculus
aaggagattcttagctgtaccaccc

SEQ ID NO: 58470 - DNA, 25 bp, Mus musculus
aaggagattctttgctgtaccaccc

SEQ ID NO: 58471 - DNA, 25 bp, Mus musculus
aaggagatttcgatgattatggaca

SEQ ID NO: 58472 - DNA, 25 bp, Mus musculus
aaggagatttcgttgattatggaca

SEQ ID NO: 58473 - DNA, 25 bp, Mus musculus
aaggagatttgcatctttctcccaa

SEQ ID NO: 58474 - DNA, 25 bp, Mus musculus
aaggagatttgcttctttctcccaa

SEQ ID NO: 58475 - DNA, 25 bp, Mus musculus
aaggagcaaacgcttccagctgttg

SEQ ID NO: 58476 - DNA, 25 bp, Mus musculus
aaggagcaaacggttccagctgttg

SEQ ID NO: 58477 - DNA, 25 bp, Mus musculus
aaggagcaaagcattcccagcctat

SEQ ID NO: 58478 - DNA, 25 bp, Mus musculus
aaggagcaaagctttcccagcctat

SEQ ID NO: 58479 - DNA, 25 bp, Mus musculus
aaggagcaccaaacggccaggtagg

SEQ ID NO: 58480 - DNA, 25 bp, Mus musculus
aaggagcaccaatcggccaggtagg

SEQ ID NO: 58481 - DNA, 25 bp, Mus musculus
aaggagcaccctcagatatgaggaa

SEQ ID NO: 58482 - DNA, 25 bp, Mus musculus
aaggagcaccctgagatatgaggaa

SEQ ID NO: 58483 - DNA, 25 bp, Mus musculus
aaggagcaccttccgtggcttaaat

SEQ ID NO: 58484 - DNA, 25 bp, Mus musculus
aaggagcaccttgcgtggcttaaat

SEQ ID NO: 58485 - DNA, 25 bp, Mus musculus
aaggagcacgttctcgtctaatgaa

SEQ ID NO: 58486 - DNA, 25 bp, Mus musculus
aaggagcacgttgtcgtctaatgaa

SEQ ID NO: 58487 - DNA, 25 bp, Mus musculus
aaggagcactacactgacctgaagg

SEQ ID NO: 58488 - DNA, 25 bp, Mus musculus
aaggagcactactctgacctgaagg

SEQ ID NO: 58489 - DNA, 25 bp, Mus musculus
aaggagcactggagcttctgcaaga

SEQ ID NO: 58490 - DNA, 25 bp, Mus musculus
aaggagcactggtgcttctgcaaga

SEQ ID NO: 58491 - DNA, 25 bp, Mus musculus
aaggagcacttcatcgagtttctct

SEQ ID NO: 58492 - DNA, 25 bp, Mus musculus
aaggagcacttcttcgagtttctct

SEQ ID NO: 58493 - DNA, 25 bp, Mus musculus
aaggagcagccacctcactggccgg

SEQ ID NO: 58494 - DNA, 25 bp, Mus musculus
aaggagcagccagctcactggccgg

SEQ ID NO: 58495 - DNA, 25 bp, Mus musculus
aaggagcagtatcttagcccagctg

SEQ ID NO: 58496 - DNA, 25 bp, Mus musculus
aaggagcagtatgttagcccagctg

SEQ ID NO: 58497 - DNA, 25 bp, Mus musculus
aaggagcatcagcttttgaaagttt

SEQ ID NO: 58498 - DNA, 25 bp, Mus musculus
aaggagcatcaggttttgaaagttt

SEQ ID NO: 58499 - DNA, 25 bp, Mus musculus
aaggagcatcgaagtctgctggcga

SEQ ID NO: 58500 - DNA, 25 bp, Mus musculus
aaggagcatcgatgtctgctggcga

SEQ ID NO: 58501 - DNA, 25 bp, Mus musculus
aaggagcatgaacacccaccttcct

SEQ ID NO: 58502 - DNA, 25 bp, Mus musculus
aaggagcatgaagacccaccttcct

SEQ ID NO: 58503 - DNA, 25 bp, Mus musculus
aaggagcattaaccccaatctatgt

SEQ ID NO: 58504 - DNA, 25 bp, Mus musculus
aaggagcattaagcccaatctatgt

SEQ ID NO: 58505 - DNA, 25 bp, Mus musculus
aaggagcattgtcgtacaggagcaa

SEQ ID NO: 58506 - DNA, 25 bp, Mus musculus
aaggagcattgtggtacaggagcaa

SEQ ID NO: 58507 - DNA, 25 bp, Mus musculus
aaggagccaacacccggccggtgaa

SEQ ID NO: 58508 - DNA, 25 bp, Mus musculus
aaggagccaacagccggccggtgaa

SEQ ID NO: 58509 - DNA, 25 bp, Mus musculus
aaggagccaaccagccagagacgga

SEQ ID NO: 58510 - DNA, 25 bp, Mus musculus
aaggagccaacctgccagagacgga

SEQ ID NO: 58511 - DNA, 25 bp, Mus musculus
aaggagccaacgatttagaattaat

SEQ ID NO: 58512 - DNA, 25 bp, Mus musculus
aaggagccaacgttttagaattaat

SEQ ID NO: 58513 - DNA, 25 bp, Mus musculus
aaggagccaatcaccaatgtctggt

SEQ ID NO: 58514 - DNA, 25 bp, Mus musculus
aaggagccaatctccaatgtctggt

SEQ ID NO: 58515 - DNA, 25 bp, Mus musculus
aaggagccagcaccttcatggagca

SEQ ID NO: 58516 - DNA, 25 bp, Mus musculus
aaggagccagcagcttcatggagca

SEQ ID NO: 58517 - DNA, 25 bp, Mus musculus
aaggagccaggaacgccatcctcac

SEQ ID NO: 58518 - DNA, 25 bp, Mus musculus
aaggagccaggatcgccatcctcac

SEQ ID NO: 58519 - DNA, 25 bp, Mus musculus
aaggagccaggccagggagccacca

SEQ ID NO: 58520 - DNA, 25 bp, Mus musculus
aaggagccaggcgagggagccacca

SEQ ID NO: 58521 - DNA, 25 bp, Mus musculus
aaggagccccttcggccagcactgg

SEQ ID NO: 58522 - DNA, 25 bp, Mus musculus
aaggagccccttgggccagcactgg

SEQ ID NO: 58523 - DNA, 25 bp, Mus musculus
aaggagcctaagaacctgcctccag

SEQ ID NO: 58524 - DNA, 25 bp, Mus musculus
aaggagcctaagtacctgcctccag

SEQ ID NO: 58525 - DNA, 25 bp, Mus musculus
aaggagcctatcctagctgcccaag

SEQ ID NO: 58526 - DNA, 25 bp, Mus musculus
aaggagcctatcgtagctgcccaag

SEQ ID NO: 58527 - DNA, 25 bp, Mus musculus
aaggagcctcagcttgactcctaca

SEQ ID NO: 58528 - DNA, 25 bp, Mus musculus
aaggagcctcaggttgactcctaca

SEQ ID NO: 58529 - DNA, 25 bp, Mus musculus
aaggagcctcttcatttcacagatg

SEQ ID NO: 58530 - DNA, 25 bp, Mus musculus
aaggagcctcttgatttcacagatg

SEQ ID NO: 58531 - DNA, 25 bp, Mus musculus
aaggagcctgcgattgcccggaagc

SEQ ID NO: 58532 - DNA, 25 bp, Mus musculus
aaggagcctgcgtttgcccggaagc

SEQ ID NO: 58533 - DNA, 25 bp, Mus musculus
aaggagcctggcatgtttgacctgg

SEQ ID NO: 58534 - DNA, 25 bp, Mus musculus
aaggagcctggcttgtttgacctgg

SEQ ID NO: 58535 - DNA, 25 bp, Mus musculus
aaggagcctgggagccgttgacaat

SEQ ID NO: 58536 - DNA, 25 bp, Mus musculus
aaggagcctgggtgccgttgacaat

SEQ ID NO: 58537 - DNA, 25 bp, Mus musculus
aaggagcctgttcagatgtctactg

SEQ ID NO: 58538 - DNA, 25 bp, Mus musculus
aaggagcctgttgagatgtctactg

SEQ ID NO: 58539 - DNA, 25 bp, Mus musculus
aaggagcgcctgctagagtattccc

SEQ ID NO: 58540 - DNA, 25 bp, Mus musculus
aaggagcgcctggtagagtattccc

SEQ ID NO: 58541 - DNA, 25 bp, Mus musculus
aaggagcgccttcaggacacaggct

SEQ ID NO: 58542 - DNA, 25 bp, Mus musculus
aaggagcgccttgaggacacaggct

SEQ ID NO: 58543 - DNA, 25 bp, Mus musculus
aaggagcgctgtaggcttcctactg

SEQ ID NO: 58544 - DNA, 25 bp, Mus musculus
aaggagcgctgttggcttcctactg

SEQ ID NO: 58545 - DNA, 25 bp, Mus musculus
aaggagcgcttcaggcagcgctgcc

SEQ ID NO: 58546 - DNA, 25 bp, Mus musculus
aaggagcgcttctggcagcgctgcc

SEQ ID NO: 58547 - DNA, 25 bp, Mus musculus
aaggagcgcttgcttttcatctctg

SEQ ID NO: 58548 - DNA, 25 bp, Mus musculus
aaggagcgcttggttttcatctctg

SEQ ID NO: 58549 - DNA, 25 bp, Mus musculus
aaggagcggcatcaacttcaatgag

SEQ ID NO: 58550 - DNA, 25 bp, Mus musculus
aaggagcggcatgaacttcaatgag

SEQ ID NO: 58551 - DNA, 25 bp, Mus musculus
aaggagcggctgcagtccctagtaa

SEQ ID NO: 58552 - DNA, 25 bp, Mus musculus
aaggagcggctggagtccctagtaa

SEQ ID NO: 58553 - DNA, 25 bp, Mus musculus
aaggagctaaagagatctgcttccc

SEQ ID NO: 58554 - DNA, 25 bp, Mus musculus
aaggagctaaagtgatctgcttccc

SEQ ID NO: 58555 - DNA, 25 bp, Mus musculus
aaggagctacacaattcttcctgta

SEQ ID NO: 58556 - DNA, 25 bp, Mus musculus
aaggagctacactattcttcctgta

SEQ ID NO: 58557 - DNA, 25 bp, Mus musculus
aaggagctaggccacagcactcagc

SEQ ID NO: 58558 - DNA, 25 bp, Mus musculus
aaggagctaggcgacagcactcagc

SEQ ID NO: 58559 - DNA, 25 bp, Mus musculus
aaggagctatgtactgaggcttgtt

SEQ ID NO: 58560 - DNA, 25 bp, Mus musculus
aaggagctatgtatgcgttccctcg

SEQ ID NO: 58561 - DNA, 25 bp, Mus musculus
aaggagctatgttctgaggcttgtt

SEQ ID NO: 58562 - DNA, 25 bp, Mus musculus
aaggagctatgtttgcgttccctcg

SEQ ID NO: 58563 - DNA, 25 bp, Mus musculus
aaggagctcaacaacgaccgggagg

SEQ ID NO: 58564 - DNA, 25 bp, Mus musculus
aaggagctcaactacgaccgggagg

SEQ ID NO: 58565 - DNA, 25 bp, Mus musculus
aaggagctcagtccagtcagacctg

SEQ ID NO: 58566 - DNA, 25 bp, Mus musculus
aaggagctcagtgcagtcagacctg

SEQ ID NO: 58567 - DNA, 25 bp, Mus musculus
aaggagctccaaacgccatcatagc

SEQ ID NO: 58568 - DNA, 25 bp, Mus musculus
aaggagctccaatcgccatcatagc

SEQ ID NO: 58569 - DNA, 25 bp, Mus musculus
aaggagctccttcagtctaggctgc

SEQ ID NO: 58570 - DNA, 25 bp, Mus musculus
aaggagctccttccctctgttactg

SEQ ID NO: 58571 - DNA, 25 bp, Mus musculus
aaggagctccttgagtctaggctgc

SEQ ID NO: 58572 - DNA, 25 bp, Mus musculus
aaggagctccttgcctctgttactg

SEQ ID NO: 58573 - DNA, 25 bp, Mus musculus
aaggagctcggaatgtggccgccac

SEQ ID NO: 58574 - DNA, 25 bp, Mus musculus
aaggagctcggattgtggccgccac

SEQ ID NO: 58575 - DNA, 25 bp, Mus musculus
aaggagctcgtgactgaagggtata

SEQ ID NO: 58576 - DNA, 25 bp, Mus musculus
aaggagctcgtgtctgaagggtata

SEQ ID NO: 58577 - DNA, 25 bp, Mus musculus
aaggagctctgtccttggcgtaatt

SEQ ID NO: 58578 - DNA, 25 bp, Mus musculus
aaggagctctgtgcttggcgtaatt

SEQ ID NO: 58579 - DNA, 25 bp, Mus musculus
aaggagctgaacctcttgctgttca

SEQ ID NO: 58580 - DNA, 25 bp, Mus musculus
aaggagctgaacgtcttgctgttca

SEQ ID NO: 58581 - DNA, 25 bp, Mus musculus
aaggagctgaggaaagccctcgcca

SEQ ID NO: 58582 - DNA, 25 bp, Mus musculus
aaggagctgaggtaagccctcgcca

SEQ ID NO: 58583 - DNA, 25 bp, Mus musculus
aaggagctgatcacaggtcacggct

SEQ ID NO: 58584 - DNA, 25 bp, Mus musculus
aaggagctgatctcaggtcacggct

SEQ ID NO: 58585 - DNA, 25 bp, Mus musculus
aaggagctgcacaggcctgatgaag

SEQ ID NO: 58586 - DNA, 25 bp, Mus musculus
aaggagctgcactggcctgatgaag

SEQ ID NO: 58587 - DNA, 25 bp, Mus musculus
aaggagctgccaaggcggcaacttc

SEQ ID NO: 58588 - DNA, 25 bp, Mus musculus
aaggagctgccaagtcaaaggacat

SEQ ID NO: 58589 - DNA, 25 bp, Mus musculus
aaggagctgccaatgcatgtcttgg

SEQ ID NO: 58590 - DNA, 25 bp, Mus musculus
aaggagctgccatggcggcaacttc

SEQ ID NO: 58591 - DNA, 25 bp, Mus musculus
aaggagctgccatgtcaaaggacat

SEQ ID NO: 58592 - DNA, 25 bp, Mus musculus
aaggagctgccattgcatgtcttgg

SEQ ID NO: 58593 - DNA, 25 bp, Mus musculus
aaggagctgccccaactctggctgg

SEQ ID NO: 58594 - DNA, 25 bp, Mus musculus
aaggagctgcccgaactctggctgg

SEQ ID NO: 58595 - DNA, 25 bp, Mus musculus
aaggagctgctgaacacctaccctt

SEQ ID NO: 58596 - DNA, 25 bp, Mus musculus
aaggagctgctgtacacctaccctt

SEQ ID NO: 58597 - DNA, 25 bp, Mus musculus
aaggagctggatcttcacgggctct

SEQ ID NO: 58598 - DNA, 25 bp, Mus musculus
aaggagctggatgttcacgggctct

SEQ ID NO: 58599 - DNA, 25 bp, Mus musculus
aaggagctggcgcacacaccgatcc

SEQ ID NO: 58600 - DNA, 25 bp, Mus musculus
aaggagctggcggacacaccgatcc

SEQ ID NO: 58601 - DNA, 25 bp, Mus musculus
aaggagctgggacaaaactgcttca

SEQ ID NO: 58602 - DNA, 25 bp, Mus musculus
aaggagctgggagaaaactgcttca

SEQ ID NO: 58603 - DNA, 25 bp, Mus musculus
aaggagctgggccttacaccaccca

SEQ ID NO: 58604 - DNA, 25 bp, Mus musculus
aaggagctgggcgttacaccaccca

SEQ ID NO: 58605 - DNA, 25 bp, Mus musculus
aaggagctggtgactgcctggtaca

SEQ ID NO: 58606 - DNA, 25 bp, Mus musculus
aaggagctggtgtctgcctggtaca

SEQ ID NO: 58607 - DNA, 25 bp, Mus musculus
aaggagctgtacattgagctcagct

SEQ ID NO: 58608 - DNA, 25 bp, Mus musculus
aaggagctgtactttgagctcagct

SEQ ID NO: 58609 - DNA, 25 bp, Mus musculus
aaggagcttctcatcctgagtattt

SEQ ID NO: 58610 - DNA, 25 bp, Mus musculus
aaggagcttctcttcctgagtattt

SEQ ID NO: 58611 - DNA, 25 bp, Mus musculus
aaggagcttgagaatgaagtcacga

SEQ ID NO: 58612 - DNA, 25 bp, Mus musculus
aaggagcttgagtatgaagtcacga

SEQ ID NO: 58613 - DNA, 25 bp, Mus musculus
aaggagcttgctccccaaacccggt

SEQ ID NO: 58614 - DNA, 25 bp, Mus musculus
aaggagcttgctgcccaaacccggt

SEQ ID NO: 58615 - DNA, 25 bp, Mus musculus
aaggagctttctatcgttcattctt

SEQ ID NO: 58616 - DNA, 25 bp, Mus musculus
aaggagctttctttcgttcattctt

SEQ ID NO: 58617 - DNA, 25 bp, Mus musculus
aaggagctttttctcttgccgggag

SEQ ID NO: 58618 - DNA, 25 bp, Mus musculus
aaggagctttttgtcttgccgggag

SEQ ID NO: 58619 - DNA, 25 bp, Mus musculus
aaggaggaaaccagctcctgcaggc

SEQ ID NO: 58620 - DNA, 25 bp, Mus musculus
aaggaggaaacctgctcctgcaggc

SEQ ID NO: 58621 - DNA, 25 bp, Mus musculus
aaggaggaaatcacttgccccagct

SEQ ID NO: 58622 - DNA, 25 bp, Mus musculus
aaggaggaaatctcttgccccagct

SEQ ID NO: 58623 - DNA, 25 bp, Mus musculus
aaggaggaacacctgttcgcccaag

SEQ ID NO: 58624 - DNA, 25 bp, Mus musculus
aaggaggaacacgtgttcgcccaag

SEQ ID NO: 58625 - DNA, 25 bp, Mus musculus
aaggaggaagacactccctctgaca

SEQ ID NO: 58626 - DNA, 25 bp, Mus musculus
aaggaggaagactctccctctgaca

SEQ ID NO: 58627 - DNA, 25 bp, Mus musculus
aaggaggaagctagggacccacagc

SEQ ID NO: 58628 - DNA, 25 bp, Mus musculus
aaggaggaagcttgggacccacagc

SEQ ID NO: 58629 - DNA, 25 bp, Mus musculus
aaggaggaagtaactgcatccacac

SEQ ID NO: 58630 - DNA, 25 bp, Mus musculus
aaggaggaagtatctgcatccacac

SEQ ID NO: 58631 - DNA, 25 bp, Mus musculus
aaggaggaatgtccctgtcttgttc

SEQ ID NO: 58632 - DNA, 25 bp, Mus musculus
aaggaggaatgtgcctgtcttgttc

SEQ ID NO: 58633 - DNA, 25 bp, Mus musculus
aaggaggacaggcattcagttacaa

SEQ ID NO: 58634 - DNA, 25 bp, Mus musculus
aaggaggacagggattcagttacaa

SEQ ID NO: 58635 - DNA, 25 bp, Mus musculus
aaggaggacattaaaccaatctttg

SEQ ID NO: 58636 - DNA, 25 bp, Mus musculus
aaggaggacatttaaccaatctttg

SEQ ID NO: 58637 - DNA, 25 bp, Mus musculus
aaggaggaccacatctgtctgtgct

SEQ ID NO: 58638 - DNA, 25 bp, Mus musculus
aaggaggaccacttctgtctgtgct

SEQ ID NO: 58639 - DNA, 25 bp, Mus musculus
aaggaggaccatccacctgtattgt

SEQ ID NO: 58640 - DNA, 25 bp, Mus musculus
aaggaggaccatgcacctgtattgt

SEQ ID NO: 58641 - DNA, 25 bp, Mus musculus
aaggaggacggcctgatcaccgcta

SEQ ID NO: 58642 - DNA, 25 bp, Mus musculus
aaggaggacggcgtgatcaccgcta

SEQ ID NO: 58643 - DNA, 25 bp, Mus musculus
aaggaggagatgagcaatgccaact

SEQ ID NO: 58644 - DNA, 25 bp, Mus musculus
aaggaggagatgtgcaatgccaact

SEQ ID NO: 58645 - DNA, 25 bp, Mus musculus
aaggaggagccaactcactggaagg

SEQ ID NO: 58646 - DNA, 25 bp, Mus musculus
aaggaggagccatctcactggaagg

SEQ ID NO: 58647 - DNA, 25 bp, Mus musculus
aaggaggaggacaaccacacccagg

SEQ ID NO: 58648 - DNA, 25 bp, Mus musculus
aaggaggaggactaccacacccagg

SEQ ID NO: 58649 - DNA, 25 bp, Mus musculus
aaggaggaggtacagacccatgaat

SEQ ID NO: 58650 - DNA, 25 bp, Mus musculus
aaggaggaggtagagacccatgaat

SEQ ID NO: 58651 - DNA, 25 bp, Mus musculus
aaggaggcacatcccattatactct

SEQ ID NO: 58652 - DNA, 25 bp, Mus musculus
aaggaggcacatgccattatactct

SEQ ID NO: 58653 - DNA, 25 bp, Mus musculus
aaggaggcagaacgccaccacagca

SEQ ID NO: 58654 - DNA, 25 bp, Mus musculus
aaggaggcagaaggccaccacagca

SEQ ID NO: 58655 - DNA, 25 bp, Mus musculus
aaggaggcagacaggccaggtctca

SEQ ID NO: 58656 - DNA, 25 bp, Mus musculus
aaggaggcagactggccaggtctca

SEQ ID NO: 58657 - DNA, 25 bp, Mus musculus
aaggaggcagctatttcattggtct

SEQ ID NO: 58658 - DNA, 25 bp, Mus musculus
aaggaggcagctttttcattggtct

SEQ ID NO: 58659 - DNA, 25 bp, Mus musculus
aaggaggcattgaatcggcggaacc

SEQ ID NO: 58660 - DNA, 25 bp, Mus musculus
aaggaggcattgtatcggcggaacc

SEQ ID NO: 58661 - DNA, 25 bp, Mus musculus
aaggaggccacacctgtagcctggc

SEQ ID NO: 58662 - DNA, 25 bp, Mus musculus
aaggaggccacagctgtagcctggc

SEQ ID NO: 58663 - DNA, 25 bp, Mus musculus
aaggaggccagtctccagtcagctc

SEQ ID NO: 58664 - DNA, 25 bp, Mus musculus
aaggaggccagtgtccagtcagctc

SEQ ID NO: 58665 - DNA, 25 bp, Mus musculus
aaggaggcccagagttctcaggcca

SEQ ID NO: 58666 - DNA, 25 bp, Mus musculus
aaggaggcccagtgttctcaggcca

SEQ ID NO: 58667 - DNA, 25 bp, Mus musculus
aaggaggcccgcaaagcagactgaa

SEQ ID NO: 58668 - DNA, 25 bp, Mus musculus
aaggaggcccgctaagcagactgaa

SEQ ID NO: 58669 - DNA, 25 bp, Mus musculus
aaggaggcctctcagatggcgccat

SEQ ID NO: 58670 - DNA, 25 bp, Mus musculus
aaggaggcctctgagatggcgccat

SEQ ID NO: 58671 - DNA, 25 bp, Mus musculus
aaggaggcctgaacttcgcgggcct

SEQ ID NO: 58672 - DNA, 25 bp, Mus musculus
aaggaggcctgatcttcgcgggcct

SEQ ID NO: 58673 - DNA, 25 bp, Mus musculus
aaggaggcgacccactgatctcttc

SEQ ID NO: 58674 - DNA, 25 bp, Mus musculus
aaggaggcgaccgactgatctcttc

SEQ ID NO: 58675 - DNA, 25 bp, Mus musculus
aaggaggcgactccttagtcctgaa

SEQ ID NO: 58676 - DNA, 25 bp, Mus musculus
aaggaggcgactgcttagtcctgaa

SEQ ID NO: 58677 - DNA, 25 bp, Mus musculus
aaggaggcgcctcctaagccggctt

SEQ ID NO: 58678 - DNA, 25 bp, Mus musculus
aaggaggcgcctgctaagccggctt

SEQ ID NO: 58679 - DNA, 25 bp, Mus musculus
aaggaggctacactcaggtcactaa

SEQ ID NO: 58680 - DNA, 25 bp, Mus musculus
aaggaggctacagtcaggtcactaa

SEQ ID NO: 58681 - DNA, 25 bp, Mus musculus
aaggaggctcttcccgggtacatca

SEQ ID NO: 58682 - DNA, 25 bp, Mus musculus
aaggaggctcttgccgggtacatca

SEQ ID NO: 58683 - DNA, 25 bp, Mus musculus
aaggaggctgcccataccttagaag

SEQ ID NO: 58684 - DNA, 25 bp, Mus musculus
aaggaggctgccgataccttagaag

SEQ ID NO: 58685 - DNA, 25 bp, Mus musculus
aaggaggctgtccagataccacttt

SEQ ID NO: 58686 - DNA, 25 bp, Mus musculus
aaggaggctgtcgagataccacttt

SEQ ID NO: 58687 - DNA, 25 bp, Mus musculus
aaggaggctgtgagatttcataggc

SEQ ID NO: 58688 - DNA, 25 bp, Mus musculus
aaggaggctgtgtgatttcataggc

SEQ ID NO: 58689 - DNA, 25 bp, Mus musculus
aaggaggctgttcctgccctaccct

SEQ ID NO: 58690 - DNA, 25 bp, Mus musculus
aaggaggctgttgctgccctaccct

SEQ ID NO: 58691 - DNA, 25 bp, Mus musculus
aaggagggacttactcaccaacaag

SEQ ID NO: 58692 - DNA, 25 bp, Mus musculus
aaggagggactttctcaccaacaag

SEQ ID NO: 58693 - DNA, 25 bp, Mus musculus
aaggagggagatcatcgccccttct

SEQ ID NO: 58694 - DNA, 25 bp, Mus musculus
aaggagggagatgatcgccccttct

SEQ ID NO: 58695 - DNA, 25 bp, Mus musculus
aaggagggcaggagactctcgtcat

SEQ ID NO: 58696 - DNA, 25 bp, Mus musculus
aaggagggcaggtgactctcgtcat

SEQ ID NO: 58697 - DNA, 25 bp, Mus musculus
aaggagggcattactgagcgccacc

SEQ ID NO: 58698 - DNA, 25 bp, Mus musculus
aaggagggcatttctgagcgccacc

SEQ ID NO: 58699 - DNA, 25 bp, Mus musculus
aaggagggccacacaagtcgcgagc

SEQ ID NO: 58700 - DNA, 25 bp, Mus musculus
aaggagggccactcaagtcgcgagc

SEQ ID NO: 58701 - DNA, 25 bp, Mus musculus
aaggagggccagatgttctttagag

SEQ ID NO: 58702 - DNA, 25 bp, Mus musculus
aaggagggccagttgttctttagag

SEQ ID NO: 58703 - DNA, 25 bp, Mus musculus
aaggagggcgacacaaaagacaaga

SEQ ID NO: 58704 - DNA, 25 bp, Mus musculus
aaggagggcgacctcatcacgctgc

SEQ ID NO: 58705 - DNA, 25 bp, Mus musculus
aaggagggcgacgtcatcacgctgc

SEQ ID NO: 58706 - DNA, 25 bp, Mus musculus
aaggagggcgactcaaaagacaaga

SEQ ID NO: 58707 - DNA, 25 bp, Mus musculus
aaggagggcgttccctgatgtcact

SEQ ID NO: 58708 - DNA, 25 bp, Mus musculus
aaggagggcgttgcctgatgtcact

SEQ ID NO: 58709 - DNA, 25 bp, Mus musculus
aaggagggtctcagagccgaagact

SEQ ID NO: 58710 - DNA, 25 bp, Mus musculus
aaggagggtctctgagccgaagact

SEQ ID NO: 58711 - DNA, 25 bp, Mus musculus
aaggagggtctgctggactactaca

SEQ ID NO: 58712 - DNA, 25 bp, Mus musculus
aaggagggtctggtggactactaca

SEQ ID NO: 58713 - DNA, 25 bp, Mus musculus
aaggaggtagacacttccttccata

SEQ ID NO: 58714 - DNA, 25 bp, Mus musculus
aaggaggtagactcttccttccata

SEQ ID NO: 58715 - DNA, 25 bp, Mus musculus
aaggaggtagtcaaagtgtcaataa

SEQ ID NO: 58716 - DNA, 25 bp, Mus musculus
aaggaggtagtcaggccaccgctgc

SEQ ID NO: 58717 - DNA, 25 bp, Mus musculus
aaggaggtagtctaagtgtcaataa

SEQ ID NO: 58718 - DNA, 25 bp, Mus musculus
aaggaggtagtctggccaccgctgc

SEQ ID NO: 58719 - DNA, 25 bp, Mus musculus
aaggaggtagtgaacatgggacctt

SEQ ID NO: 58720 - DNA, 25 bp, Mus musculus
aaggaggtagtgtacatgggacctt

SEQ ID NO: 58721 - DNA, 25 bp, Mus musculus
aaggaggtccaaccccaggatgaca

SEQ ID NO: 58722 - DNA, 25 bp, Mus musculus
aaggaggtccaagcccaggatgaca

SEQ ID NO: 58723 - DNA, 25 bp, Mus musculus
aaggaggtccagctgccttcacttg

SEQ ID NO: 58724 - DNA, 25 bp, Mus musculus
aaggaggtccaggtgccttcacttg

SEQ ID NO: 58725 - DNA, 25 bp, Mus musculus
aaggaggtccccagctgctttagga

SEQ ID NO: 58726 - DNA, 25 bp, Mus musculus
aaggaggtcccctgctgctttagga

SEQ ID NO: 58727 - DNA, 25 bp, Mus musculus
aaggaggtccctaggcagaattata

SEQ ID NO: 58728 - DNA, 25 bp, Mus musculus
aaggaggtcccttggcagaattata

SEQ ID NO: 58729 - DNA, 25 bp, Mus musculus
aaggaggtccttagctgtaactctg

SEQ ID NO: 58730 - DNA, 25 bp, Mus musculus
aaggaggtcctttgctgtaactctg

SEQ ID NO: 58731 - DNA, 25 bp, Mus musculus
aaggaggtctccaacctggatgatg

SEQ ID NO: 58732 - DNA, 25 bp, Mus musculus
aaggaggtctcctacctggatgatg

SEQ ID NO: 58733 - DNA, 25 bp, Mus musculus
aaggaggtcttaatatctgcccctg

SEQ ID NO: 58734 - DNA, 25 bp, Mus musculus
aaggaggtcttattatctgcccctg

SEQ ID NO: 58735 - DNA, 25 bp, Mus musculus
aaggaggtgcccatgaggcatctcc

SEQ ID NO: 58736 - DNA, 25 bp, Mus musculus
aaggaggtgcccttgaggcatctcc

SEQ ID NO: 58737 - DNA, 25 bp, Mus musculus
aaggaggtgcttcaacttgctttct

SEQ ID NO: 58738 - DNA, 25 bp, Mus musculus
aaggaggtgcttgaacttgctttct

SEQ ID NO: 58739 - DNA, 25 bp, Mus musculus
aaggaggtggctccagtttctcgct

SEQ ID NO: 58740 - DNA, 25 bp, Mus musculus
aaggaggtggctgcagtttctcgct

SEQ ID NO: 58741 - DNA, 25 bp, Mus musculus
aaggaggttagccaatgtggtcaat

SEQ ID NO: 58742 - DNA, 25 bp, Mus musculus
aaggaggttagcgaatgtggtcaat

SEQ ID NO: 58743 - DNA, 25 bp, Mus musculus
aaggagtaacacctggctcctccta

SEQ ID NO: 58744 - DNA, 25 bp, Mus musculus
aaggagtaacacgtggctcctccta

SEQ ID NO: 58745 - DNA, 25 bp, Mus musculus
aaggagtaagtcagggtgtctgtaa

SEQ ID NO: 58746 - DNA, 25 bp, Mus musculus
aaggagtaagtctgggtgtctgtaa

SEQ ID NO: 58747 - DNA, 25 bp, Mus musculus
aaggagtacaagaaaatggaggcaa

SEQ ID NO: 58748 - DNA, 25 bp, Mus musculus
aaggagtacaagtaaatggaggcaa

SEQ ID NO: 58749 - DNA, 25 bp, Mus musculus
aaggagtaccgtcatgttccctcag

SEQ ID NO: 58750 - DNA, 25 bp, Mus musculus
aaggagtaccgtgatgttccctcag

SEQ ID NO: 58751 - DNA, 25 bp, Mus musculus
aaggagtaggaacctgctgcccaca

SEQ ID NO: 58752 - DNA, 25 bp, Mus musculus
aaggagtaggaagctgctgcccaca

SEQ ID NO: 58753 - DNA, 25 bp, Mus musculus
aaggagtagtagaccctgtgaaact

SEQ ID NO: 58754 - DNA, 25 bp, Mus musculus
aaggagtagtagtccctgtgaaact

SEQ ID NO: 58755 - DNA, 25 bp, Mus musculus
aaggagtataatcccttggttgccc

SEQ ID NO: 58756 - DNA, 25 bp, Mus musculus
aaggagtataatgccttggttgccc

SEQ ID NO: 58757 - DNA, 25 bp, Mus musculus
aaggagtataccaccactttctagc

SEQ ID NO: 58758 - DNA, 25 bp, Mus musculus
aaggagtatacctccactttctagc

SEQ ID NO: 58759 - DNA, 25 bp, Mus musculus
aaggagtatacgacattgttcatat

SEQ ID NO: 58760 - DNA, 25 bp, Mus musculus
aaggagtatacgtcattgttcatat

SEQ ID NO: 58761 - DNA, 25 bp, Mus musculus
aaggagtattcaaggctgctcgctg

SEQ ID NO: 58762 - DNA, 25 bp, Mus musculus
aaggagtattcatggctgctcgctg

SEQ ID NO: 58763 - DNA, 25 bp, Mus musculus
aaggagtattggacccagcggcgac

SEQ ID NO: 58764 - DNA, 25 bp, Mus musculus
aaggagtattggtcccagcggcgac

SEQ ID NO: 58765 - DNA, 25 bp, Mus musculus
aaggagtattttagcattttcatgc

SEQ ID NO: 58766 - DNA, 25 bp, Mus musculus
aaggagtatttttgcattttcatgc

SEQ ID NO: 58767 - DNA, 25 bp, Mus musculus
aaggagtcagtgcacccgagacaga

SEQ ID NO: 58768 - DNA, 25 bp, Mus musculus
aaggagtcagtggacccgagacaga

SEQ ID NO: 58769 - DNA, 25 bp, Mus musculus
aaggagtccaacactgtctgggtcc

SEQ ID NO: 58770 - DNA, 25 bp, Mus musculus
aaggagtccaactctgtctgggtcc

SEQ ID NO: 58771 - DNA, 25 bp, Mus musculus
aaggagtccaccaccagtgagcaga

SEQ ID NO: 58772 - DNA, 25 bp, Mus musculus
aaggagtccacctccagtgagcaga

SEQ ID NO: 58773 - DNA, 25 bp, Mus musculus
aaggagtccctgatggtttgcaccg

SEQ ID NO: 58774 - DNA, 25 bp, Mus musculus
aaggagtccctgttggtttgcaccg

SEQ ID NO: 58775 - DNA, 25 bp, Mus musculus
aaggagtcggagacagcactggcaa

SEQ ID NO: 58776 - DNA, 25 bp, Mus musculus
aaggagtcggagtcagcactggcaa

SEQ ID NO: 58777 - DNA, 25 bp, Mus musculus
aaggagtctatgacacagtgagaga

SEQ ID NO: 58778 - DNA, 25 bp, Mus musculus
aaggagtctatgtcacagtgagaga

SEQ ID NO: 58779 - DNA, 25 bp, Mus musculus
aaggagtctctgcatgattccgtta

SEQ ID NO: 58780 - DNA, 25 bp, Mus musculus
aaggagtctctggatgattccgtta

SEQ ID NO: 58781 - DNA, 25 bp, Mus musculus
aaggagtcttccatcttcaacgaag

SEQ ID NO: 58782 - DNA, 25 bp, Mus musculus
aaggagtcttccttcttcaacgaag

SEQ ID NO: 58783 - DNA, 25 bp, Mus musculus
aaggagtctttgaatgccttccctt

SEQ ID NO: 58784 - DNA, 25 bp, Mus musculus
aaggagtctttgtatgccttccctt

SEQ ID NO: 58785 - DNA, 25 bp, Mus musculus
aaggagtgaactccctgctgcagat

SEQ ID NO: 58786 - DNA, 25 bp, Mus musculus
aaggagtgaactgcctgctgcagat

SEQ ID NO: 58787 - DNA, 25 bp, Mus musculus
aaggagtgaagcagcctgctttctc

SEQ ID NO: 58788 - DNA, 25 bp, Mus musculus
aaggagtgaagctgcctgctttctc

SEQ ID NO: 58789 - DNA, 25 bp, Mus musculus
aaggagtgagataccactgccctga

SEQ ID NO: 58790 - DNA, 25 bp, Mus musculus
aaggagtgagattccactgccctga

SEQ ID NO: 58791 - DNA, 25 bp, Mus musculus
aaggagtgatcccagcatcggcaag

SEQ ID NO: 58792 - DNA, 25 bp, Mus musculus
aaggagtgatccgagcatcggcaag

SEQ ID NO: 58793 - DNA, 25 bp, Mus musculus
aaggagtgcactccatcatgtccct

SEQ ID NO: 58794 - DNA, 25 bp, Mus musculus
aaggagtgcactgcatcatgtccct

SEQ ID NO: 58795 - DNA, 25 bp, Mus musculus
aaggagtgctctcggaacttccaca

SEQ ID NO: 58796 - DNA, 25 bp, Mus musculus
aaggagtgctctgggaacttccaca

SEQ ID NO: 58797 - DNA, 25 bp, Mus musculus
aaggagtggattctgtctcctccaa

SEQ ID NO: 58798 - DNA, 25 bp, Mus musculus
aaggagtggattgtgtctcctccaa

SEQ ID NO: 58799 - DNA, 25 bp, Mus musculus
aaggagtggcccatgggacttctgc

SEQ ID NO: 58800 - DNA, 25 bp, Mus musculus
aaggagtggcccttgggacttctgc

SEQ ID NO: 58801 - DNA, 25 bp, Mus musculus
aaggagtggtgtaacagccataaaa

SEQ ID NO: 58802 - DNA, 25 bp, Mus musculus
aaggagtggtgttacagccataaaa

SEQ ID NO: 58803 - DNA, 25 bp, Mus musculus
aaggagtgtaagatgcggcccagaa

SEQ ID NO: 58804 - DNA, 25 bp, Mus musculus
aaggagtgtaagttgcggcccagaa

SEQ ID NO: 58805 - DNA, 25 bp, Mus musculus
aaggagtgtaccacatggccagcaa

SEQ ID NO: 58806 - DNA, 25 bp, Mus musculus
aaggagtgtacctcatggccagcaa

SEQ ID NO: 58807 - DNA, 25 bp, Mus musculus
aaggagtgtgagctgccatagacaa

SEQ ID NO: 58808 - DNA, 25 bp, Mus musculus
aaggagtgtgaggtgccatagacaa

SEQ ID NO: 58809 - DNA, 25 bp, Mus musculus
aaggagtgtgtcagcttccatgcta

SEQ ID NO: 58810 - DNA, 25 bp, Mus musculus
aaggagtgtgtctgcttccatgcta

SEQ ID NO: 58811 - DNA, 25 bp, Mus musculus
aaggagtgttcgctctcctggagct

SEQ ID NO: 58812 - DNA, 25 bp, Mus musculus
aaggagtgttcggtctcctggagct

SEQ ID NO: 58813 - DNA, 25 bp, Mus musculus
aaggagtgtttcaaccagcccatgc

SEQ ID NO: 58814 - DNA, 25 bp, Mus musculus
aaggagtgtttctaccagcccatgc

SEQ ID NO: 58815 - DNA, 25 bp, Mus musculus
aaggagttactgactttgtgctgac

SEQ ID NO: 58816 - DNA, 25 bp, Mus musculus
aaggagttactgtctttgtgctgac

SEQ ID NO: 58817 - DNA, 25 bp, Mus musculus
aaggagttatatacatggttcattc

SEQ ID NO: 58818 - DNA, 25 bp, Mus musculus
aaggagttatattcatggttcattc

SEQ ID NO: 58819 - DNA, 25 bp, Mus musculus
aaggagttcaaacgcgccttcatgc

SEQ ID NO: 58820 - DNA, 25 bp, Mus musculus
aaggagttcaaaggcgccttcatgc

SEQ ID NO: 58821 - DNA, 25 bp, Mus musculus
aaggagttccaacaggagacaagca

SEQ ID NO: 58822 - DNA, 25 bp, Mus musculus
aaggagttccaagaggagacaagca

SEQ ID NO: 58823 - DNA, 25 bp, Mus musculus
aaggagttcccaacctggtatactt

SEQ ID NO: 58824 - DNA, 25 bp, Mus musculus
aaggagttcccatcctggtatactt

SEQ ID NO: 58825 - DNA, 25 bp, Mus musculus
aaggagttctcgctctacatgacaa

SEQ ID NO: 58826 - DNA, 25 bp, Mus musculus
aaggagttctcggtctacatgacaa

SEQ ID NO: 58827 - DNA, 25 bp, Mus musculus
aaggagttctgccagggacaccacc

SEQ ID NO: 58828 - DNA, 25 bp, Mus musculus
aaggagttctgcgagggacaccacc

SEQ ID NO: 58829 - DNA, 25 bp, Mus musculus
aaggagttgatcacaaaggcacaaa

SEQ ID NO: 58830 - DNA, 25 bp, Mus musculus
aaggagttgatctcaaaggcacaaa

SEQ ID NO: 58831 - DNA, 25 bp, Mus musculus
aaggagttgcccctactcgcgagtg

SEQ ID NO: 58832 - DNA, 25 bp, Mus musculus
aaggagttgcccgtactcgcgagtg

SEQ ID NO: 58833 - DNA, 25 bp, Mus musculus
aaggagttgctaatttggcacccat

SEQ ID NO: 58834 - DNA, 25 bp, Mus musculus
aaggagttgctattttggcacccat

SEQ ID NO: 58835 - DNA, 25 bp, Mus musculus
aaggagttgggcctttgctcagcca

SEQ ID NO: 58836 - DNA, 25 bp, Mus musculus
aaggagttgggcgtttgctcagcca

SEQ ID NO: 58837 - DNA, 25 bp, Mus musculus
aaggagttggttatgagcctcaagg

SEQ ID NO: 58838 - DNA, 25 bp, Mus musculus
aaggagttggttttgagcctcaagg

SEQ ID NO: 58839 - DNA, 25 bp, Mus musculus
aaggagttgtatctactttgcacac

SEQ ID NO: 58840 - DNA, 25 bp, Mus musculus
aaggagttgtatgtactttgcacac

SEQ ID NO: 58841 - DNA, 25 bp, Mus musculus
aaggagtttaatacaggcttctgta

SEQ ID NO: 58842 - DNA, 25 bp, Mus musculus
aaggagtttaattcaggcttctgta

SEQ ID NO: 58843 - DNA, 25 bp, Mus musculus
aaggagtttagccatgttgcataga

SEQ ID NO: 58844 - DNA, 25 bp, Mus musculus
aaggagtttagcgatgttgcataga

SEQ ID NO: 58845 - DNA, 25 bp, Mus musculus
aaggagtttctccaagacttgaagg

SEQ ID NO: 58846 - DNA, 25 bp, Mus musculus
aaggagtttctcgaagacttgaagg

SEQ ID NO: 58847 - DNA, 25 bp, Mus musculus
aaggagtttgcacgtttgaaggtca

SEQ ID NO: 58848 - DNA, 25 bp, Mus musculus
aaggagtttgcaggtttgaaggtca

SEQ ID NO: 58849 - DNA, 25 bp, Mus musculus
aaggagtttgccaactcttctcttg

SEQ ID NO: 58850 - DNA, 25 bp, Mus musculus
aaggagtttgcctactcttctcttg

SEQ ID NO: 58851 - DNA, 25 bp, Mus musculus
aaggagtttggccacagtatttatc

SEQ ID NO: 58852 - DNA, 25 bp, Mus musculus
aaggagtttggcgacagtatttatc

SEQ ID NO: 58853 - DNA, 25 bp, Mus musculus
aaggataaacccaagctcaaccgct

SEQ ID NO: 58854 - DNA, 25 bp, Mus musculus
aaggataaaccctagctcaaccgct

SEQ ID NO: 58855 - DNA, 25 bp, Mus musculus
aaggataacgatccctctgacccat

SEQ ID NO: 58856 - DNA, 25 bp, Mus musculus
aaggataacgatgcctctgacccat

SEQ ID NO: 58857 - DNA, 25 bp, Mus musculus
aaggataactatattccagtgatta

SEQ ID NO: 58858 - DNA, 25 bp, Mus musculus
aaggataactattttccagtgatta

SEQ ID NO: 58859 - DNA, 25 bp, Mus musculus
aaggataagaccacgtgaaaactgt

SEQ ID NO: 58860 - DNA, 25 bp, Mus musculus
aaggataagacctcgtgaaaactgt

SEQ ID NO: 58861 - DNA, 25 bp, Mus musculus
aaggataaggtcatcccagagtaca

SEQ ID NO: 58862 - DNA, 25 bp, Mus musculus
aaggataaggtcttcccagagtaca

SEQ ID NO: 58863 - DNA, 25 bp, Mus musculus
aaggataatcgtcctgttggacagt

SEQ ID NO: 58864 - DNA, 25 bp, Mus musculus
aaggataatcgtgctgttggacagt

SEQ ID NO: 58865 - DNA, 25 bp, Mus musculus
aaggataatgcacttcctcaccttt

SEQ ID NO: 58866 - DNA, 25 bp, Mus musculus
aaggataatgcagttcctcaccttt

SEQ ID NO: 58867 - DNA, 25 bp, Mus musculus
aaggatacacccacccaaaatctag

SEQ ID NO: 58868 - DNA, 25 bp, Mus musculus
aaggatacacccaggagtgtcttct

SEQ ID NO: 58869 - DNA, 25 bp, Mus musculus
aaggatacaccctcccaaaatctag

SEQ ID NO: 58870 - DNA, 25 bp, Mus musculus
aaggatacaccctggagtgtcttct

SEQ ID NO: 58871 - DNA, 25 bp, Mus musculus
aaggataccaatagctgacacccac

SEQ ID NO: 58872 - DNA, 25 bp, Mus musculus
aaggataccaattgctgacacccac

SEQ ID NO: 58873 - DNA, 25 bp, Mus musculus
aaggataccacaacagtcttctgtc

SEQ ID NO: 58874 - DNA, 25 bp, Mus musculus
aaggataccacatcagtcttctgtc

SEQ ID NO: 58875 - DNA, 25 bp, Mus musculus
aaggataccatcactaggcactgca

SEQ ID NO: 58876 - DNA, 25 bp, Mus musculus
aaggataccatctctaggcactgca

SEQ ID NO: 58877 - DNA, 25 bp, Mus musculus
aaggataccctgaaatcctccttga

SEQ ID NO: 58878 - DNA, 25 bp, Mus musculus
aaggataccctgtaatcctccttga

SEQ ID NO: 58879 - DNA, 25 bp, Mus musculus
aaggatactctcatgttctgtttgc

SEQ ID NO: 58880 - DNA, 25 bp, Mus musculus
aaggatactctccaataacctcacc

SEQ ID NO: 58881 - DNA, 25 bp, Mus musculus
aaggatactctcgaataacctcacc

SEQ ID NO: 58882 - DNA, 25 bp, Mus musculus
aaggatactctcttgttctgtttgc

SEQ ID NO: 58883 - DNA, 25 bp, Mus musculus
aaggatacttcaatctttggcctgc

SEQ ID NO: 58884 - DNA, 25 bp, Mus musculus
aaggatacttcattctttggcctgc

SEQ ID NO: 58885 - DNA, 25 bp, Mus musculus
aaggatacttccatccgtggcttct

SEQ ID NO: 58886 - DNA, 25 bp, Mus musculus
aaggatacttccttccgtggcttct

SEQ ID NO: 58887 - DNA, 25 bp, Mus musculus
aaggatactttcagccaagtgcaaa

SEQ ID NO: 58888 - DNA, 25 bp, Mus musculus
aaggatactttctgccaagtgcaaa

SEQ ID NO: 58889 - DNA, 25 bp, Mus musculus
aaggatacttttatgatcaagttca

SEQ ID NO: 58890 - DNA, 25 bp, Mus musculus
aaggatacttttttgatcaagttca

SEQ ID NO: 58891 - DNA, 25 bp, Mus musculus
aaggatagcaccaatcgcccaggga

SEQ ID NO: 58892 - DNA, 25 bp, Mus musculus
aaggatagcacctatcgcccaggga

SEQ ID NO: 58893 - DNA, 25 bp, Mus musculus
aaggataggcagagcagaccggaaa

SEQ ID NO: 58894 - DNA, 25 bp, Mus musculus
aaggataggcagtgcagaccggaaa

SEQ ID NO: 58895 - DNA, 25 bp, Mus musculus
aaggataggcctaagggtcacttag

SEQ ID NO: 58896 - DNA, 25 bp, Mus musculus
aaggataggcctattctgagcagga

SEQ ID NO: 58897 - DNA, 25 bp, Mus musculus
aaggataggcctcccgcaggcagaa

SEQ ID NO: 58898 - DNA, 25 bp, Mus musculus
aaggataggcctgccgcaggcagaa

SEQ ID NO: 58899 - DNA, 25 bp, Mus musculus
aaggataggccttagggtcacttag

SEQ ID NO: 58900 - DNA, 25 bp, Mus musculus
aaggataggccttttctgagcagga

SEQ ID NO: 58901 - DNA, 25 bp, Mus musculus
aaggatagtgctctagaaaaagaaa

SEQ ID NO: 58902 - DNA, 25 bp, Mus musculus
aaggatagtgctgtagaaaaagaaa

SEQ ID NO: 58903 - DNA, 25 bp, Mus musculus
aaggatagtggccatcctgtccctt

SEQ ID NO: 58904 - DNA, 25 bp, Mus musculus
aaggatagtggcgatcctgtccctt

SEQ ID NO: 58905 - DNA, 25 bp, Mus musculus
aaggatagtttaaagtctttccagt

SEQ ID NO: 58906 - DNA, 25 bp, Mus musculus
aaggatagtttatagtctttccagt

SEQ ID NO: 58907 - DNA, 25 bp, Mus musculus
aaggatatcaccaactggcagagga

SEQ ID NO: 58908 - DNA, 25 bp, Mus musculus
aaggatatcacctactggcagagga

SEQ ID NO: 58909 - DNA, 25 bp, Mus musculus
aaggatatcttccatggccagctta

SEQ ID NO: 58910 - DNA, 25 bp, Mus musculus
aaggatatcttcgatggccagctta

SEQ ID NO: 58911 - DNA, 25 bp, Mus musculus
aaggatatcttgagcaatacagaaa

SEQ ID NO: 58912 - DNA, 25 bp, Mus musculus
aaggatatcttgtgcaatacagaaa

SEQ ID NO: 58913 - DNA, 25 bp, Mus musculus
aaggatatctttagccagcacctaa

SEQ ID NO: 58914 - DNA, 25 bp, Mus musculus
aaggatatcttttgccagcacctaa

SEQ ID NO: 58915 - DNA, 25 bp, Mus musculus
aaggatatgaaaccccttgctccgg

SEQ ID NO: 58916 - DNA, 25 bp, Mus musculus
aaggatatgaaagcccttgctccgg

SEQ ID NO: 58917 - DNA, 25 bp, Mus musculus
aaggatatgaagcagtctgactggt

SEQ ID NO: 58918 - DNA, 25 bp, Mus musculus
aaggatatgaaggagtctgactggt

SEQ ID NO: 58919 - DNA, 25 bp, Mus musculus
aaggatatgaatacaactgtccaag

SEQ ID NO: 58920 - DNA, 25 bp, Mus musculus
aaggatatgaattcaactgtccaag

SEQ ID NO: 58921 - DNA, 25 bp, Mus musculus
aaggatattcctcgactgacagaca

SEQ ID NO: 58922 - DNA, 25 bp, Mus musculus
aaggatattcctggactgacagaca

SEQ ID NO: 58923 - DNA, 25 bp, Mus musculus
aaggatattttcaaataaacagagt

SEQ ID NO: 58924 - DNA, 25 bp, Mus musculus
aaggatattttctaataaacagagt

SEQ ID NO: 58925 - DNA, 25 bp, Mus musculus
aaggatcaacacattcccagtggtc

SEQ ID NO: 58926 - DNA, 25 bp, Mus musculus
aaggatcaacactttcccagtggtc

SEQ ID NO: 58927 - DNA, 25 bp, Mus musculus
aaggatcaactgctgttctggagta

SEQ ID NO: 58928 - DNA, 25 bp, Mus musculus
aaggatcaactggtgttctggagta

SEQ ID NO: 58929 - DNA, 25 bp, Mus musculus
aaggatcaaggcactttaggacaag

SEQ ID NO: 58930 - DNA, 25 bp, Mus musculus
aaggatcaaggctctttaggacaag

SEQ ID NO: 58931 - DNA, 25 bp, Mus musculus
aaggatcaatcactctgtcttctca

SEQ ID NO: 58932 - DNA, 25 bp, Mus musculus
aaggatcaatcagtctgtcttctca

SEQ ID NO: 58933 - DNA, 25 bp, Mus musculus
aaggatcaatccagtgttcttcatc

SEQ ID NO: 58934 - DNA, 25 bp, Mus musculus
aaggatcaatcctgtgttcttcatc

SEQ ID NO: 58935 - DNA, 25 bp, Mus musculus
aaggatcaatttctacacctgtttg

SEQ ID NO: 58936 - DNA, 25 bp, Mus musculus
aaggatcaatttgtacacctgtttg

SEQ ID NO: 58937 - DNA, 25 bp, Mus musculus
aaggatcacagcattcggatgtttg

SEQ ID NO: 58938 - DNA, 25 bp, Mus musculus
aaggatcacagctttcggatgtttg

SEQ ID NO: 58939 - DNA, 25 bp, Mus musculus
aaggatcacagtactttcaaggaga

SEQ ID NO: 58940 - DNA, 25 bp, Mus musculus
aaggatcacagttctttcaaggaga

SEQ ID NO: 58941 - DNA, 25 bp, Mus musculus
aaggatcaccgcattgagagtgtca

SEQ ID NO: 58942 - DNA, 25 bp, Mus musculus
aaggatcaccgctttgagagtgtca

SEQ ID NO: 58943 - DNA, 25 bp, Mus musculus
aaggatcactgcctgtgtctctttt

SEQ ID NO: 58944 - DNA, 25 bp, Mus musculus
aaggatcactgcgtgtgtctctttt

SEQ ID NO: 58945 - DNA, 25 bp, Mus musculus
aaggatcagggccaagaccttccat

SEQ ID NO: 58946 - DNA, 25 bp, Mus musculus
aaggatcagggcgaagaccttccat

SEQ ID NO: 58947 - DNA, 25 bp, Mus musculus
aaggatcagtgaagggcacccagct

SEQ ID NO: 58948 - DNA, 25 bp, Mus musculus
aaggatcagtgatgggcacccagct

SEQ ID NO: 58949 - DNA, 25 bp, Mus musculus
aaggatcagtgtagtgactccagga

SEQ ID NO: 58950 - DNA, 25 bp, Mus musculus
aaggatcagtgttgtgactccagga

SEQ ID NO: 58951 - DNA, 25 bp, Mus musculus
aaggatcataccaagaggtgagggt

SEQ ID NO: 58952 - DNA, 25 bp, Mus musculus
aaggatcatacctagaggtgagggt

SEQ ID NO: 58953 - DNA, 25 bp, Mus musculus
aaggatcatgctctacttctcatat

SEQ ID NO: 58954 - DNA, 25 bp, Mus musculus
aaggatcatgctgtacttctcatat

SEQ ID NO: 58955 - DNA, 25 bp, Mus musculus
aaggatcatggcagctttttacaaa

SEQ ID NO: 58956 - DNA, 25 bp, Mus musculus
aaggatcatggctgctttttacaaa

SEQ ID NO: 58957 - DNA, 25 bp, Mus musculus
aaggatccaaaaccctgctcggttt

SEQ ID NO: 58958 - DNA, 25 bp, Mus musculus
aaggatccaaaagcctgctcggttt

SEQ ID NO: 58959 - DNA, 25 bp, Mus musculus
aaggatccccagacaaggtcagctc

SEQ ID NO: 58960 - DNA, 25 bp, Mus musculus
aaggatccccagtcaaggtcagctc

SEQ ID NO: 58961 - DNA, 25 bp, Mus musculus
aaggatcccctgaaggtcttggagc

SEQ ID NO: 58962 - DNA, 25 bp, Mus musculus
aaggatcccctgtaggtcttggagc

SEQ ID NO: 58963 - DNA, 25 bp, Mus musculus
aaggatcccgaaccagagcgactca

SEQ ID NO: 58964 - DNA, 25 bp, Mus musculus
aaggatcccgaagcagagcgactca

SEQ ID NO: 58965 - DNA, 25 bp, Mus musculus
aaggatccctgaccagggtgtttca

SEQ ID NO: 58966 - DNA, 25 bp, Mus musculus
aaggatccctgagcagggtgtttca

SEQ ID NO: 58967 - DNA, 25 bp, Mus musculus
aaggatccctgcattgggctttgga

SEQ ID NO: 58968 - DNA, 25 bp, Mus musculus
aaggatccctgctttgggctttgga

SEQ ID NO: 58969 - DNA, 25 bp, Mus musculus
aaggatccctttcacactttggcaa

SEQ ID NO: 58970 - DNA, 25 bp, Mus musculus
aaggatccctttgacactttggcaa

SEQ ID NO: 58971 - DNA, 25 bp, Mus musculus
aaggatccgaccattcagagtaatt

SEQ ID NO: 58972 - DNA, 25 bp, Mus musculus
aaggatccgacctttcagagtaatt

SEQ ID NO: 58973 - DNA, 25 bp, Mus musculus
aaggatccggcaccaccaaggacag

SEQ ID NO: 58974 - DNA, 25 bp, Mus musculus
aaggatccggcagcaccaaggacag

SEQ ID NO: 58975 - DNA, 25 bp, Mus musculus
aaggatccggtcaactcctgcattt

SEQ ID NO: 58976 - DNA, 25 bp, Mus musculus
aaggatccggtctactcctgcattt

SEQ ID NO: 58977 - DNA, 25 bp, Mus musculus
aaggatcctcgaaacgtgggctgga

SEQ ID NO: 58978 - DNA, 25 bp, Mus musculus
aaggatcctcgatacgtgggctgga

SEQ ID NO: 58979 - DNA, 25 bp, Mus musculus
aaggatcctgagcttatcctccatc

SEQ ID NO: 58980 - DNA, 25 bp, Mus musculus
aaggatcctgaggttatcctccatc

SEQ ID NO: 58981 - DNA, 25 bp, Mus musculus
aaggatcctggcagagaaccactct

SEQ ID NO: 58982 - DNA, 25 bp, Mus musculus
aaggatcctggcatggtatagatca

SEQ ID NO: 58983 - DNA, 25 bp, Mus musculus
aaggatcctggctgagaaccactct

SEQ ID NO: 58984 - DNA, 25 bp, Mus musculus
aaggatcctggcttggtatagatca

SEQ ID NO: 58985 - DNA, 25 bp, Mus musculus
aaggatcctgttcgtgcactgtggc

SEQ ID NO: 58986 - DNA, 25 bp, Mus musculus
aaggatcctgttggtgcactgtggc

SEQ ID NO: 58987 - DNA, 25 bp, Mus musculus
aaggatccttaaccttggagcacaa

SEQ ID NO: 58988 - DNA, 25 bp, Mus musculus
aaggatccttaagcttggagcacaa

SEQ ID NO: 58989 - DNA, 25 bp, Mus musculus
aaggatccttggaaggcacaactag

SEQ ID NO: 58990 - DNA, 25 bp, Mus musculus
aaggatccttggaaggtgactgcaa

SEQ ID NO: 58991 - DNA, 25 bp, Mus musculus
aaggatccttggtaggcacaactag

SEQ ID NO: 58992 - DNA, 25 bp, Mus musculus
aaggatccttggtaggtgactgcaa

SEQ ID NO: 58993 - DNA, 25 bp, Mus musculus
aaggatcgaccaatcttttcttaat

SEQ ID NO: 58994 - DNA, 25 bp, Mus musculus
aaggatcgaccattcttttcttaat

SEQ ID NO: 58995 - DNA, 25 bp, Mus musculus
aaggatcgccccagtagctctactt

SEQ ID NO: 58996 - DNA, 25 bp, Mus musculus
aaggatcgcccctgtagctctactt

SEQ ID NO: 58997 - DNA, 25 bp, Mus musculus
aaggatcgccgaagcgctggccagt

SEQ ID NO: 58998 - DNA, 25 bp, Mus musculus
aaggatcgccgatgcgctggccagt

SEQ ID NO: 58999 - DNA, 25 bp, Mus musculus
aaggatcgggagcaacatatgttca

SEQ ID NO: 59000 - DNA, 25 bp, Mus musculus
aaggatcgggaggaacatatgttca

SEQ ID NO: 59001 - DNA, 25 bp, Mus musculus
aaggatcggtgtcacccacgtacaa

SEQ ID NO: 59002 - DNA, 25 bp, Mus musculus
aaggatcggtgtgacccacgtacaa

SEQ ID NO: 59003 - DNA, 25 bp, Mus musculus
aaggatctaagaccctgcctgactc

SEQ ID NO: 59004 - DNA, 25 bp, Mus musculus
aaggatctaagagcctgcctgactc

SEQ ID NO: 59005 - DNA, 25 bp, Mus musculus
aaggatctcacactgctctgccatt

SEQ ID NO: 59006 - DNA, 25 bp, Mus musculus
aaggatctcacagtgctctgccatt

SEQ ID NO: 59007 - DNA, 25 bp, Mus musculus
aaggatctcaccatgcagccttggc

SEQ ID NO: 59008 - DNA, 25 bp, Mus musculus
aaggatctcaccttgcagccttggc

SEQ ID NO: 59009 - DNA, 25 bp, Mus musculus
aaggatctcttgcatttttggtaga

SEQ ID NO: 59010 - DNA, 25 bp, Mus musculus
aaggatctcttggatttttggtaga

SEQ ID NO: 59011 - DNA, 25 bp, Mus musculus
aaggatctgatcacacatgcttcta

SEQ ID NO: 59012 - DNA, 25 bp, Mus musculus
aaggatctgatctcacatgcttcta

SEQ ID NO: 59013 - DNA, 25 bp, Mus musculus
aaggatctgatgatgttcttttcaa

SEQ ID NO: 59014 - DNA, 25 bp, Mus musculus
aaggatctgatgttgttcttttcaa

SEQ ID NO: 59015 - DNA, 25 bp, Mus musculus
aaggatctgcttagttccttgttgc

SEQ ID NO: 59016 - DNA, 25 bp, Mus musculus
aaggatctgctttgttccttgttgc

SEQ ID NO: 59017 - DNA, 25 bp, Mus musculus
aaggatctggaaccacactgcctgt

SEQ ID NO: 59018 - DNA, 25 bp, Mus musculus
aaggatctggaagcacactgcctgt

SEQ ID NO: 59019 - DNA, 25 bp, Mus musculus
aaggatctgtctcggaagtgccgaa

SEQ ID NO: 59020 - DNA, 25 bp, Mus musculus
aaggatctgtctgggaagtgccgaa

SEQ ID NO: 59021 - DNA, 25 bp, Mus musculus
aaggatctgtgcagatgctcagagt

SEQ ID NO: 59022 - DNA, 25 bp, Mus musculus
aaggatctgtgctgatgctcagagt

SEQ ID NO: 59023 - DNA, 25 bp, Mus musculus
aaggatctgttgaagtgactcttga

SEQ ID NO: 59024 - DNA, 25 bp, Mus musculus
aaggatctgttgtagtgactcttga

SEQ ID NO: 59025 - DNA, 25 bp, Mus musculus
aaggatcttggtcctggtacagtga

SEQ ID NO: 59026 - DNA, 25 bp, Mus musculus
aaggatcttggtgctggtacagtga

SEQ ID NO: 59027 - DNA, 25 bp, Mus musculus
aaggatcttttgcacctggctaatc

SEQ ID NO: 59028 - DNA, 25 bp, Mus musculus
aaggatcttttggacctggctaatc

SEQ ID NO: 59029 - DNA, 25 bp, Mus musculus
aaggatctttttcttcagcgcgtgc

SEQ ID NO: 59030 - DNA, 25 bp, Mus musculus
aaggatctttttgttcagcgcgtgc

SEQ ID NO: 59031 - DNA, 25 bp, Mus musculus
aaggatgaacggctgactactcaag

SEQ ID NO: 59032 - DNA, 25 bp, Mus musculus
aaggatgaacgggtgactactcaag

SEQ ID NO: 59033 - DNA, 25 bp, Mus musculus
aaggatgaagtcaccagcctgtgga

SEQ ID NO: 59034 - DNA, 25 bp, Mus musculus
aaggatgaagtctccagcctgtgga

SEQ ID NO: 59035 - DNA, 25 bp, Mus musculus
aaggatgacaacagtgatgcccaat

SEQ ID NO: 59036 - DNA, 25 bp, Mus musculus
aaggatgacaactgtgatgcccaat

SEQ ID NO: 59037 - DNA, 25 bp, Mus musculus
aaggatgacattagcaccattacaa

SEQ ID NO: 59038 - DNA, 25 bp, Mus musculus
aaggatgacatttgcaccattacaa

SEQ ID NO: 59039 - DNA, 25 bp, Mus musculus
aaggatgaccctcagaagctcttct

SEQ ID NO: 59040 - DNA, 25 bp, Mus musculus
aaggatgaccctgagaagctcttct

SEQ ID NO: 59041 - DNA, 25 bp, Mus musculus
aaggatgacctcatgctgttgaatg

SEQ ID NO: 59042 - DNA, 25 bp, Mus musculus
aaggatgacctcttgctgttgaatg

SEQ ID NO: 59043 - DNA, 25 bp, Mus musculus
aaggatgaccttacattcaaagtac

SEQ ID NO: 59044 - DNA, 25 bp, Mus musculus
aaggatgacctttcattcaaagtac

SEQ ID NO: 59045 - DNA, 25 bp, Mus musculus
aaggatgacggcaggtttaccacca

SEQ ID NO: 59046 - DNA, 25 bp, Mus musculus
aaggatgacggctggtttaccacca

SEQ ID NO: 59047 - DNA, 25 bp, Mus musculus
aaggatgagactacttcttgaacag

SEQ ID NO: 59048 - DNA, 25 bp, Mus musculus
aaggatgagacttcttcttgaacag

SEQ ID NO: 59049 - DNA, 25 bp, Mus musculus
aaggatgatcccacttaagtgctgg

SEQ ID NO: 59050 - DNA, 25 bp, Mus musculus
aaggatgatccctcttaagtgctgg

SEQ ID NO: 59051 - DNA, 25 bp, Mus musculus
aaggatgatggacctactggaccca

SEQ ID NO: 59052 - DNA, 25 bp, Mus musculus
aaggatgatggagctactggaccca

SEQ ID NO: 59053 - DNA, 25 bp, Mus musculus
aaggatgcacatatctgacaacagt

SEQ ID NO: 59054 - DNA, 25 bp, Mus musculus
aaggatgcacatttctgacaacagt

SEQ ID NO: 59055 - DNA, 25 bp, Mus musculus
aaggatgcacctctgtttaaggatt

SEQ ID NO: 59056 - DNA, 25 bp, Mus musculus
aaggatgcacctgtgtttaaggatt

SEQ ID NO: 59057 - DNA, 25 bp, Mus musculus
aaggatgcactactggaccatgatc

SEQ ID NO: 59058 - DNA, 25 bp, Mus musculus
aaggatgcactagtggaccatgatc

SEQ ID NO: 59059 - DNA, 25 bp, Mus musculus
aaggatgcagcaaccaactacgagc

SEQ ID NO: 59060 - DNA, 25 bp, Mus musculus
aaggatgcagcatccaactacgagc

SEQ ID NO: 59061 - DNA, 25 bp, Mus musculus
aaggatgcaggcctgtgtgctgtgg

SEQ ID NO: 59062 - DNA, 25 bp, Mus musculus
aaggatgcaggcgtgtgtgctgtgg

SEQ ID NO: 59063 - DNA, 25 bp, Mus musculus
aaggatgcatctcttggttaaaagc

SEQ ID NO: 59064 - DNA, 25 bp, Mus musculus
aaggatgcatctgttggttaaaagc

SEQ ID NO: 59065 - DNA, 25 bp, Mus musculus
aaggatgccacaagcttttcggtcc

SEQ ID NO: 59066 - DNA, 25 bp, Mus musculus
aaggatgccacatgcttttcggtcc

SEQ ID NO: 59067 - DNA, 25 bp, Mus musculus
aaggatgccagcctggatgtttctg

SEQ ID NO: 59068 - DNA, 25 bp, Mus musculus
aaggatgccagcgtggatgtttctg

SEQ ID NO: 59069 - DNA, 25 bp, Mus musculus
aaggatgccagtattccagcacgaa

SEQ ID NO: 59070 - DNA, 25 bp, Mus musculus
aaggatgccagttttccagcacgaa

SEQ ID NO: 59071 - DNA, 25 bp, Mus musculus
aaggatgcccatcctacagaggagt

SEQ ID NO: 59072 - DNA, 25 bp, Mus musculus
aaggatgcccatgctacagaggagt

SEQ ID NO: 59073 - DNA, 25 bp, Mus musculus
aaggatgcccggctcactgggaaca

SEQ ID NO: 59074 - DNA, 25 bp, Mus musculus
aaggatgcccgggtcactgggaaca

SEQ ID NO: 59075 - DNA, 25 bp, Mus musculus
aaggatgcccttatgacttaggaat

SEQ ID NO: 59076 - DNA, 25 bp, Mus musculus
aaggatgcccttttgacttaggaat

SEQ ID NO: 59077 - DNA, 25 bp, Mus musculus
aaggatgctaggaggccagcaccca

SEQ ID NO: 59078 - DNA, 25 bp, Mus musculus
aaggatgctaggtggccagcaccca

SEQ ID NO: 59079 - DNA, 25 bp, Mus musculus
aaggatgctcagctgttattttaca

SEQ ID NO: 59080 - DNA, 25 bp, Mus musculus
aaggatgctcaggtgttattttaca

SEQ ID NO: 59081 - DNA, 25 bp, Mus musculus
aaggatgctctacggcctctggatc

SEQ ID NO: 59082 - DNA, 25 bp, Mus musculus
aaggatgctctagggcctctggatc

SEQ ID NO: 59083 - DNA, 25 bp, Mus musculus
aaggatgctgtgatccaactgacag

SEQ ID NO: 59084 - DNA, 25 bp, Mus musculus
aaggatgctgtgttccaactgacag

SEQ ID NO: 59085 - DNA, 25 bp, Mus musculus
aaggatgcttccctacttaagtcat

SEQ ID NO: 59086 - DNA, 25 bp, Mus musculus
aaggatgcttccgtacttaagtcat

SEQ ID NO: 59087 - DNA, 25 bp, Mus musculus
aaggatgctttaccctggttgtgat

SEQ ID NO: 59088 - DNA, 25 bp, Mus musculus
aaggatgctttagcctggttgtgat

SEQ ID NO: 59089 - DNA, 25 bp, Mus musculus
aaggatggaaccagggccacacaca

SEQ ID NO: 59090 - DNA, 25 bp, Mus musculus
aaggatggaacctgggccacacaca

SEQ ID NO: 59091 - DNA, 25 bp, Mus musculus
aaggatggaagcagtgcacctccca

SEQ ID NO: 59092 - DNA, 25 bp, Mus musculus
aaggatggaagctgtgcacctccca

SEQ ID NO: 59093 - DNA, 25 bp, Mus musculus
aaggatggacatattgccctggaag

SEQ ID NO: 59094 - DNA, 25 bp, Mus musculus
aaggatggacattttgccctggaag

SEQ ID NO: 59095 - DNA, 25 bp, Mus musculus
aaggatggaccaaactccactgtat

SEQ ID NO: 59096 - DNA, 25 bp, Mus musculus
aaggatggaccaacccacctgtgta

SEQ ID NO: 59097 - DNA, 25 bp, Mus musculus
aaggatggaccatactccactgtat

SEQ ID NO: 59098 - DNA, 25 bp, Mus musculus
aaggatggaccatcccacctgtgta

SEQ ID NO: 59099 - DNA, 25 bp, Mus musculus
aaggatggactcaacctggtacctg

SEQ ID NO: 59100 - DNA, 25 bp, Mus musculus
aaggatggactctacctggtacctg

SEQ ID NO: 59101 - DNA, 25 bp, Mus musculus
aaggatggaggcacccacatagact

SEQ ID NO: 59102 - DNA, 25 bp, Mus musculus
aaggatggaggctcccacatagact

SEQ ID NO: 59103 - DNA, 25 bp, Mus musculus
aaggatggatggcaccctaggactc

SEQ ID NO: 59104 - DNA, 25 bp, Mus musculus
aaggatggatgggaccctaggactc

SEQ ID NO: 59105 - DNA, 25 bp, Mus musculus
aaggatggatttcaagcttggacaa

SEQ ID NO: 59106 - DNA, 25 bp, Mus musculus
aaggatggatttgaagcttggacaa

SEQ ID NO: 59107 - DNA, 25 bp, Mus musculus
aaggatggcaacaccgggtgcacag

SEQ ID NO: 59108 - DNA, 25 bp, Mus musculus
aaggatggcaactccgggtgcacag

SEQ ID NO: 59109 - DNA, 25 bp, Mus musculus
aaggatggcacccatcttcattcca

SEQ ID NO: 59110 - DNA, 25 bp, Mus musculus
aaggatggcaccgatcttcattcca

SEQ ID NO: 59111 - DNA, 25 bp, Mus musculus
aaggatggcatcactgtcaagggtg

SEQ ID NO: 59112 - DNA, 25 bp, Mus musculus
aaggatggcatctctgtcaagggtg

SEQ ID NO: 59113 - DNA, 25 bp, Mus musculus
aaggatggccttacctatcagatct

SEQ ID NO: 59114 - DNA, 25 bp, Mus musculus
aaggatggcctttcctatcagatct

SEQ ID NO: 59115 - DNA, 25 bp, Mus musculus
aaggatggctcgcattggtaaaaga

SEQ ID NO: 59116 - DNA, 25 bp, Mus musculus
aaggatggctcggattggtaaaaga

SEQ ID NO: 59117 - DNA, 25 bp, Mus musculus
aaggatggctgcatgtacttctatg

SEQ ID NO: 59118 - DNA, 25 bp, Mus musculus
aaggatggctgcttgtacttctatg

SEQ ID NO: 59119 - DNA, 25 bp, Mus musculus
aaggatgggaatccgctcacactgg

SEQ ID NO: 59120 - DNA, 25 bp, Mus musculus
aaggatgggaatgcgctcacactgg

SEQ ID NO: 59121 - DNA, 25 bp, Mus musculus
aaggatgggctcatcggttatcgat

SEQ ID NO: 59122 - DNA, 25 bp, Mus musculus
aaggatgggctcttcggttatcgat

SEQ ID NO: 59123 - DNA, 25 bp, Mus musculus
aaggatgggctgatcatccgcaagc

SEQ ID NO: 59124 - DNA, 25 bp, Mus musculus
aaggatgggctgttcatccgcaagc

SEQ ID NO: 59125 - DNA, 25 bp, Mus musculus
aaggatggtcccagcgcaggctgta

SEQ ID NO: 59126 - DNA, 25 bp, Mus musculus
aaggatggtccctgcgcaggctgta

SEQ ID NO: 59127 - DNA, 25 bp, Mus musculus
aaggatggtgatatgtttcctggtt

SEQ ID NO: 59128 - DNA, 25 bp, Mus musculus
aaggatggtgatttgtttcctggtt

SEQ ID NO: 59129 - DNA, 25 bp, Mus musculus
aaggatggtgtgaatttgctgacgt

SEQ ID NO: 59130 - DNA, 25 bp, Mus musculus
aaggatggtgtgtatttgctgacgt

SEQ ID NO: 59131 - DNA, 25 bp, Mus musculus
aaggatgtcaaacgccaggtggtac

SEQ ID NO: 59132 - DNA, 25 bp, Mus musculus
aaggatgtcaaaggccaggtggtac

SEQ ID NO: 59133 - DNA, 25 bp, Mus musculus
aaggatgtcacactgcatcaggcct

SEQ ID NO: 59134 - DNA, 25 bp, Mus musculus
aaggatgtcacagtgcatcaggcct

SEQ ID NO: 59135 - DNA, 25 bp, Mus musculus
aaggatgtccacatgcctaagcacc

SEQ ID NO: 59136 - DNA, 25 bp, Mus musculus
aaggatgtccacttgcctaagcacc

SEQ ID NO: 59137 - DNA, 25 bp, Mus musculus
aaggatgtccagcaaaccccagtgt

SEQ ID NO: 59138 - DNA, 25 bp, Mus musculus
aaggatgtccaggaaaccccagtgt

SEQ ID NO: 59139 - DNA, 25 bp, Mus musculus
aaggatgtctcaacattcttctgtg

SEQ ID NO: 59140 - DNA, 25 bp, Mus musculus
aaggatgtctcatcattcttctgtg

SEQ ID NO: 59141 - DNA, 25 bp, Mus musculus
aaggatgtcttacggtttttcatat

SEQ ID NO: 59142 - DNA, 25 bp, Mus musculus
aaggatgtcttagggtttttcatat

SEQ ID NO: 59143 - DNA, 25 bp, Mus musculus
aaggatgtgactatgcctgggccca

SEQ ID NO: 59144 - DNA, 25 bp, Mus musculus
aaggatgtgactttgcctgggccca

SEQ ID NO: 59145 - DNA, 25 bp, Mus musculus
aaggatgtgcccaacaaccagctgc

SEQ ID NO: 59146 - DNA, 25 bp, Mus musculus
aaggatgtgccctacaaccagctgc

SEQ ID NO: 59147 - DNA, 25 bp, Mus musculus
aaggatgtggagctttctgccatga

SEQ ID NO: 59148 - DNA, 25 bp, Mus musculus
aaggatgtggaggtttctgccatga

SEQ ID NO: 59149 - DNA, 25 bp, Mus musculus
aaggatgtggccatggactttacgc

SEQ ID NO: 59150 - DNA, 25 bp, Mus musculus
aaggatgtggccttggactttacgc

SEQ ID NO: 59151 - DNA, 25 bp, Mus musculus
aaggatgtggctactcaggctacag

SEQ ID NO: 59152 - DNA, 25 bp, Mus musculus
aaggatgtggcttctcaggctacag

SEQ ID NO: 59153 - DNA, 25 bp, Mus musculus
aaggatgtgtcaccgctactgacta

SEQ ID NO: 59154 - DNA, 25 bp, Mus musculus
aaggatgtgtcagcgctactgacta

SEQ ID NO: 59155 - DNA, 25 bp, Mus musculus
aaggatgtgtcgactctcaaagtta

SEQ ID NO: 59156 - DNA, 25 bp, Mus musculus
aaggatgtgtcgtctctcaaagtta

SEQ ID NO: 59157 - DNA, 25 bp, Mus musculus
aaggatgttaaactctgtaggcagt

SEQ ID NO: 59158 - DNA, 25 bp, Mus musculus
aaggatgttaaagtctgtaggcagt

SEQ ID NO: 59159 - DNA, 25 bp, Mus musculus
aaggatgttatcatggcagggcatc

SEQ ID NO: 59160 - DNA, 25 bp, Mus musculus
aaggatgttatcttggcagggcatc

SEQ ID NO: 59161 - DNA, 25 bp, Mus musculus
aaggatgttggaagccctgcaacta

SEQ ID NO: 59162 - DNA, 25 bp, Mus musculus
aaggatgttggatgccctgcaacta

SEQ ID NO: 59163 - DNA, 25 bp, Mus musculus
aaggattaactcatctaccatctct

SEQ ID NO: 59164 - DNA, 25 bp, Mus musculus
aaggattaactcttctaccatctct

SEQ ID NO: 59165 - DNA, 25 bp, Mus musculus
aaggattacaccagcggagccatgc

SEQ ID NO: 59166 - DNA, 25 bp, Mus musculus
aaggattacacctgcggagccatgc

SEQ ID NO: 59167 - DNA, 25 bp, Mus musculus
aaggattacagtccaccttctgttc

SEQ ID NO: 59168 - DNA, 25 bp, Mus musculus
aaggattacagtgcaccttctgttc

SEQ ID NO: 59169 - DNA, 25 bp, Mus musculus
aaggattacctaccactggatttgg

SEQ ID NO: 59170 - DNA, 25 bp, Mus musculus
aaggattacctagcactggatttgg

SEQ ID NO: 59171 - DNA, 25 bp, Mus musculus
aaggattaccttctgaccacctcaa

SEQ ID NO: 59172 - DNA, 25 bp, Mus musculus
aaggattaccttgtgaccacctcaa

SEQ ID NO: 59173 - DNA, 25 bp, Mus musculus
aaggattacttaatgtaccacacaa

SEQ ID NO: 59174 - DNA, 25 bp, Mus musculus
aaggattacttattgtaccacacaa

SEQ ID NO: 59175 - DNA, 25 bp, Mus musculus
aaggattacttcagtccgttggatt

SEQ ID NO: 59176 - DNA, 25 bp, Mus musculus
aaggattacttctgtccgttggatt

SEQ ID NO: 59177 - DNA, 25 bp, Mus musculus
aaggattagaggctgtgtctttgtt

SEQ ID NO: 59178 - DNA, 25 bp, Mus musculus
aaggattagagggtgtgtctttgtt

SEQ ID NO: 59179 - DNA, 25 bp, Mus musculus
aaggattaggccatctccacagtgg

SEQ ID NO: 59180 - DNA, 25 bp, Mus musculus
aaggattaggccttctccacagtgg

SEQ ID NO: 59181 - DNA, 25 bp, Mus musculus
aaggattataacaggagcttcacta

SEQ ID NO: 59182 - DNA, 25 bp, Mus musculus
aaggattataactggagcttcacta

SEQ ID NO: 59183 - DNA, 25 bp, Mus musculus
aaggattatgctccacttgtgtggg

SEQ ID NO: 59184 - DNA, 25 bp, Mus musculus
aaggattatgctgcacttgtgtggg

SEQ ID NO: 59185 - DNA, 25 bp, Mus musculus
aaggattatggcatcacgcctgagt

SEQ ID NO: 59186 - DNA, 25 bp, Mus musculus
aaggattatggcttcacgcctgagt

SEQ ID NO: 59187 - DNA, 25 bp, Mus musculus
aaggattcagaccacaataccctct

SEQ ID NO: 59188 - DNA, 25 bp, Mus musculus
aaggattcagacgacaataccctct

SEQ ID NO: 59189 - DNA, 25 bp, Mus musculus
aaggattcagctaggccaggaggct

SEQ ID NO: 59190 - DNA, 25 bp, Mus musculus
aaggattcagcttggccaggaggct

SEQ ID NO: 59191 - DNA, 25 bp, Mus musculus
aaggattccaacaccctggcttact

SEQ ID NO: 59192 - DNA, 25 bp, Mus musculus
aaggattccaactccctggcttact

SEQ ID NO: 59193 - DNA, 25 bp, Mus musculus
aaggattccacacccgtcaaggcag

SEQ ID NO: 59194 - DNA, 25 bp, Mus musculus
aaggattccacagccgtcaaggcag

SEQ ID NO: 59195 - DNA, 25 bp, Mus musculus
aaggattccaggataatccaggcct

SEQ ID NO: 59196 - DNA, 25 bp, Mus musculus
aaggattccaggttaatccaggcct

SEQ ID NO: 59197 - DNA, 25 bp, Mus musculus
aaggattcccagagcaggctggcca

SEQ ID NO: 59198 - DNA, 25 bp, Mus musculus
aaggattcccagcttttgcataaga

SEQ ID NO: 59199 - DNA, 25 bp, Mus musculus
aaggattcccaggttttgcataaga

SEQ ID NO: 59200 - DNA, 25 bp, Mus musculus
aaggattcccagtgcaggctggcca

SEQ ID NO: 59201 - DNA, 25 bp, Mus musculus
aaggattcccttattatatggccag

SEQ ID NO: 59202 - DNA, 25 bp, Mus musculus
aaggattccctttttatatggccag

SEQ ID NO: 59203 - DNA, 25 bp, Mus musculus
aaggattcctgcagctggctcctga

SEQ ID NO: 59204 - DNA, 25 bp, Mus musculus
aaggattcctgctgctggctcctga

SEQ ID NO: 59205 - DNA, 25 bp, Mus musculus
aaggattccttgcaaatgccagggt

SEQ ID NO: 59206 - DNA, 25 bp, Mus musculus
aaggattccttggaaatgccagggt

SEQ ID NO: 59207 - DNA, 25 bp, Mus musculus
aaggattcggtcacagctgttgttt

SEQ ID NO: 59208 - DNA, 25 bp, Mus musculus
aaggattcggtctcagctgttgttt

SEQ ID NO: 59209 - DNA, 25 bp, Mus musculus
aaggattctaatcttgaccagcaat

SEQ ID NO: 59210 - DNA, 25 bp, Mus musculus
aaggattctaatgttgaccagcaat

SEQ ID NO: 59211 - DNA, 25 bp, Mus musculus
aaggattctccactggtgttgagca

SEQ ID NO: 59212 - DNA, 25 bp, Mus musculus
aaggattctccagtggtgttgagca

SEQ ID NO: 59213 - DNA, 25 bp, Mus musculus
aaggattctgatctctgacctccca

SEQ ID NO: 59214 - DNA, 25 bp, Mus musculus
aaggattctgatgtctgacctccca

SEQ ID NO: 59215 - DNA, 25 bp, Mus musculus
aaggattctggcatctaagactaag

SEQ ID NO: 59216 - DNA, 25 bp, Mus musculus
aaggattctggcttctaagactaag

SEQ ID NO: 59217 - DNA, 25 bp, Mus musculus
aaggattctgtgaaacatgccgaca

SEQ ID NO: 59218 - DNA, 25 bp, Mus musculus
aaggattctgtgtaacatgccgaca

SEQ ID NO: 59219 - DNA, 25 bp, Mus musculus
aaggattcttctatggctacacgta

SEQ ID NO: 59220 - DNA, 25 bp, Mus musculus
aaggattcttctttggctacacgta

SEQ ID NO: 59221 - DNA, 25 bp, Mus musculus
aaggattctttgaatgcccagggaa

SEQ ID NO: 59222 - DNA, 25 bp, Mus musculus
aaggattctttgtatgcccagggaa

SEQ ID NO: 59223 - DNA, 25 bp, Mus musculus
aaggattgcagtcagttcaggacca

SEQ ID NO: 59224 - DNA, 25 bp, Mus musculus
aaggattgcagtgagttcaggacca

SEQ ID NO: 59225 - DNA, 25 bp, Mus musculus
aaggattgccagagacctcatgcag

SEQ ID NO: 59226 - DNA, 25 bp, Mus musculus
aaggattgccagtgacctcatgcag

SEQ ID NO: 59227 - DNA, 25 bp, Mus musculus
aaggattgccctcctgagtggaaat

SEQ ID NO: 59228 - DNA, 25 bp, Mus musculus
aaggattgccctgctgagtggaaat

SEQ ID NO: 59229 - DNA, 25 bp, Mus musculus
aaggattgctatcctgtccaggaaa

SEQ ID NO: 59230 - DNA, 25 bp, Mus musculus
aaggattgctatgctgtccaggaaa

SEQ ID NO: 59231 - DNA, 25 bp, Mus musculus
aaggattgctccagacccctatcct

SEQ ID NO: 59232 - DNA, 25 bp, Mus musculus
aaggattgctcctgacccctatcct

SEQ ID NO: 59233 - DNA, 25 bp, Mus musculus
aaggattgctggagtctcctgggct

SEQ ID NO: 59234 - DNA, 25 bp, Mus musculus
aaggattgctggtgtctcctgggct

SEQ ID NO: 59235 - DNA, 25 bp, Mus musculus
aaggattggaatactctgagctgaa

SEQ ID NO: 59236 - DNA, 25 bp, Mus musculus
aaggattggaattctctgagctgaa

SEQ ID NO: 59237 - DNA, 25 bp, Mus musculus
aaggattggcttatggaggccttct

SEQ ID NO: 59238 - DNA, 25 bp, Mus musculus
aaggattggcttattgcgcctcatt

SEQ ID NO: 59239 - DNA, 25 bp, Mus musculus
aaggattggcttttggaggccttct

SEQ ID NO: 59240 - DNA, 25 bp, Mus musculus
aaggattggctttttgcgcctcatt

SEQ ID NO: 59241 - DNA, 25 bp, Mus musculus
aaggattgggatactggtccagcct

SEQ ID NO: 59242 - DNA, 25 bp, Mus musculus
aaggattgggattctggtccagcct

SEQ ID NO: 59243 - DNA, 25 bp, Mus musculus
aaggattggtagctcatgttaacat

SEQ ID NO: 59244 - DNA, 25 bp, Mus musculus
aaggattggtaggtcatgttaacat

SEQ ID NO: 59245 - DNA, 25 bp, Mus musculus
aaggattggtccatacaccagcgtg

SEQ ID NO: 59246 - DNA, 25 bp, Mus musculus
aaggattggtccttacaccagcgtg

SEQ ID NO: 59247 - DNA, 25 bp, Mus musculus
aaggattgtaccctcagtggtgctg

SEQ ID NO: 59248 - DNA, 25 bp, Mus musculus
aaggattgtaccgtcagtggtgctg

SEQ ID NO: 59249 - DNA, 25 bp, Mus musculus
aaggattgtagaccttgcccaccca

SEQ ID NO: 59250 - DNA, 25 bp, Mus musculus
aaggattgtagagcttgcccaccca

SEQ ID NO: 59251 - DNA, 25 bp, Mus musculus
aaggattgtcgcacatggacagtgg

SEQ ID NO: 59252 - DNA, 25 bp, Mus musculus
aaggattgtcgctcatggacagtgg

SEQ ID NO: 59253 - DNA, 25 bp, Mus musculus
aaggattgtgctacagttgctagtg

SEQ ID NO: 59254 - DNA, 25 bp, Mus musculus
aaggattgtgcttcagttgctagtg

SEQ ID NO: 59255 - DNA, 25 bp, Mus musculus
aaggatttaagtcattggcgcctag

SEQ ID NO: 59256 - DNA, 25 bp, Mus musculus
aaggatttaagtgattggcgcctag

SEQ ID NO: 59257 - DNA, 25 bp, Mus musculus
aaggatttatccatagatttagttc

SEQ ID NO: 59258 - DNA, 25 bp, Mus musculus
aaggatttatccttagatttagttc

SEQ ID NO: 59259 - DNA, 25 bp, Mus musculus
aaggatttcagacgattctagcgat

SEQ ID NO: 59260 - DNA, 25 bp, Mus musculus
aaggatttcagaggattctagcgat

SEQ ID NO: 59261 - DNA, 25 bp, Mus musculus
aaggatttcaggagaccgacttgat

SEQ ID NO: 59262 - DNA, 25 bp, Mus musculus
aaggatttcaggctcatctttgact

SEQ ID NO: 59263 - DNA, 25 bp, Mus musculus
aaggatttcagggtcatctttgact

SEQ ID NO: 59264 - DNA, 25 bp, Mus musculus
aaggatttcaggtgaccgacttgat

SEQ ID NO: 59265 - DNA, 25 bp, Mus musculus
aaggatttccagactgttctgcctt

SEQ ID NO: 59266 - DNA, 25 bp, Mus musculus
aaggatttccagtctgttctgcctt

SEQ ID NO: 59267 - DNA, 25 bp, Mus musculus
aaggatttccatctccacgaagcgg

SEQ ID NO: 59268 - DNA, 25 bp, Mus musculus
aaggatttccatgtccacgaagcgg

SEQ ID NO: 59269 - DNA, 25 bp, Mus musculus
aaggatttccctctactcaatgaca

SEQ ID NO: 59270 - DNA, 25 bp, Mus musculus
aaggatttccctgtactcaatgaca

SEQ ID NO: 59271 - DNA, 25 bp, Mus musculus
aaggatttccttacattgtccatga

SEQ ID NO: 59272 - DNA, 25 bp, Mus musculus
aaggatttcctttcattgtccatga

SEQ ID NO: 59273 - DNA, 25 bp, Mus musculus
aaggatttgaaaacagccctgtgaa

SEQ ID NO: 59274 - DNA, 25 bp, Mus musculus
aaggatttgaaatcagccctgtgaa

SEQ ID NO: 59275 - DNA, 25 bp, Mus musculus
aaggatttgacaaaacgctcaagtc

SEQ ID NO: 59276 - DNA, 25 bp, Mus musculus
aaggatttgacataacgctcaagtc

SEQ ID NO: 59277 - DNA, 25 bp, Mus musculus
aaggatttgatactcatctgctaga

SEQ ID NO: 59278 - DNA, 25 bp, Mus musculus
aaggatttgatagtcatctgctaga

SEQ ID NO: 59279 - DNA, 25 bp, Mus musculus
aaggatttgcgaccccgagtggact

SEQ ID NO: 59280 - DNA, 25 bp, Mus musculus
aaggatttgcgagcccgagtggact

SEQ ID NO: 59281 - DNA, 25 bp, Mus musculus
aaggatttggagacctgaagccaca

SEQ ID NO: 59282 - DNA, 25 bp, Mus musculus
aaggatttggagtcctgaagccaca

SEQ ID NO: 59283 - DNA, 25 bp, Mus musculus
aaggatttggttacactccaccaag

SEQ ID NO: 59284 - DNA, 25 bp, Mus musculus
aaggatttggtttcactccaccaag

SEQ ID NO: 59285 - DNA, 25 bp, Mus musculus
aaggattttagcagtctttgcgaca

SEQ ID NO: 59286 - DNA, 25 bp, Mus musculus
aaggattttagctgtctttgcgaca

SEQ ID NO: 59287 - DNA, 25 bp, Mus musculus
aaggattttgcccttcaagtgtgaa

SEQ ID NO: 59288 - DNA, 25 bp, Mus musculus
aaggattttgccgttcaagtgtgaa

SEQ ID NO: 59289 - DNA, 25 bp, Mus musculus
aaggattttggacacaccactgttt

SEQ ID NO: 59290 - DNA, 25 bp, Mus musculus
aaggattttggagacaccactgttt

SEQ ID NO: 59291 - DNA, 25 bp, Mus musculus
aaggcaaaacaaacggctggctgaa

SEQ ID NO: 59292 - DNA, 25 bp, Mus musculus
aaggcaaaacaatcggctggctgaa

SEQ ID NO: 59293 - DNA, 25 bp, Mus musculus
aaggcaaaacctcaaccaccttctg

SEQ ID NO: 59294 - DNA, 25 bp, Mus musculus
aaggcaaaacctgaaccaccttctg

SEQ ID NO: 59295 - DNA, 25 bp, Mus musculus
aaggcaaaagaaacgttctcataga

SEQ ID NO: 59296 - DNA, 25 bp, Mus musculus
aaggcaaaagaatcgttctcataga

SEQ ID NO: 59297 - DNA, 25 bp, Mus musculus
aaggcaaaagacagttacactaggg

SEQ ID NO: 59298 - DNA, 25 bp, Mus musculus
aaggcaaaagactgttacactaggg

SEQ ID NO: 59299 - DNA, 25 bp, Mus musculus
aaggcaaaagccaccatctgacttc

SEQ ID NO: 59300 - DNA, 25 bp, Mus musculus
aaggcaaaagcctccatctgacttc

SEQ ID NO: 59301 - DNA, 25 bp, Mus musculus
aaggcaaaatctctcctgtcacaga

SEQ ID NO: 59302 - DNA, 25 bp, Mus musculus
aaggcaaaatctgtcctgtcacaga

SEQ ID NO: 59303 - DNA, 25 bp, Mus musculus
aaggcaaaattgaaaagtagcttgt

SEQ ID NO: 59304 - DNA, 25 bp, Mus musculus
aaggcaaaattgtaaagtagcttgt

SEQ ID NO: 59305 - DNA, 25 bp, Mus musculus
aaggcaaacagtagaaacgttatgt

SEQ ID NO: 59306 - DNA, 25 bp, Mus musculus
aaggcaaacagttgaaacgttatgt

SEQ ID NO: 59307 - DNA, 25 bp, Mus musculus
aaggcaaaccataccatgcatgttg

SEQ ID NO: 59308 - DNA, 25 bp, Mus musculus
aaggcaaaccattccatgcatgttg

SEQ ID NO: 59309 - DNA, 25 bp, Mus musculus
aaggcaaacctgatctatgtagtga

SEQ ID NO: 59310 - DNA, 25 bp, Mus musculus
aaggcaaacctgttctatgtagtga

SEQ ID NO: 59311 - DNA, 25 bp, Mus musculus
aaggcaaacgttctagattgtacta

SEQ ID NO: 59312 - DNA, 25 bp, Mus musculus
aaggcaaacgttgtagattgtacta

SEQ ID NO: 59313 - DNA, 25 bp, Mus musculus
aaggcaaactagaccttcctgtggc

SEQ ID NO: 59314 - DNA, 25 bp, Mus musculus
aaggcaaactagtccttcctgtggc

SEQ ID NO: 59315 - DNA, 25 bp, Mus musculus
aaggcaaagcaaccaggcacctttt

SEQ ID NO: 59316 - DNA, 25 bp, Mus musculus
aaggcaaagcaagcaggcacctttt

SEQ ID NO: 59317 - DNA, 25 bp, Mus musculus
aaggcaaagctcataggtgcgccct

SEQ ID NO: 59318 - DNA, 25 bp, Mus musculus
aaggcaaagctcttaggtgcgccct

SEQ ID NO: 59319 - DNA, 25 bp, Mus musculus
aaggcaaaggacacagtattgttct

SEQ ID NO: 59320 - DNA, 25 bp, Mus musculus
aaggcaaaggactcagtattgttct

SEQ ID NO: 59321 - DNA, 25 bp, Mus musculus
aaggcaaaggccaacattctgtttt

SEQ ID NO: 59322 - DNA, 25 bp, Mus musculus
aaggcaaaggcctacattctgtttt

SEQ ID NO: 59323 - DNA, 25 bp, Mus musculus
aaggcaaaggtcctcagcacaagca

SEQ ID NO: 59324 - DNA, 25 bp, Mus musculus
aaggcaaaggtcgtcagcacaagca

SEQ ID NO: 59325 - DNA, 25 bp, Mus musculus
aaggcaaagtccatcccagacttag

SEQ ID NO: 59326 - DNA, 25 bp, Mus musculus
aaggcaaagtccttcccagacttag

SEQ ID NO: 59327 - DNA, 25 bp, Mus musculus
aaggcaaagtgaccctttggtgacc

SEQ ID NO: 59328 - DNA, 25 bp, Mus musculus
aaggcaaagtgagcctttggtgacc

SEQ ID NO: 59329 - DNA, 25 bp, Mus musculus
aaggcaaagtggctgcttgatccct

SEQ ID NO: 59330 - DNA, 25 bp, Mus musculus
aaggcaaagtgggtgcttgatccct

SEQ ID NO: 59331 - DNA, 25 bp, Mus musculus
aaggcaaatcataccatggcagtga

SEQ ID NO: 59332 - DNA, 25 bp, Mus musculus
aaggcaaatcattccatggcagtga

SEQ ID NO: 59333 - DNA, 25 bp, Mus musculus
aaggcaaatgctaactcttccgcta

SEQ ID NO: 59334 - DNA, 25 bp, Mus musculus
aaggcaaatgctcccagacggctgt

SEQ ID NO: 59335 - DNA, 25 bp, Mus musculus
aaggcaaatgctgccagacggctgt

SEQ ID NO: 59336 - DNA, 25 bp, Mus musculus
aaggcaaatgcttactcttccgcta

SEQ ID NO: 59337 - DNA, 25 bp, Mus musculus
aaggcaaatggtaagctgctctcca

SEQ ID NO: 59338 - DNA, 25 bp, Mus musculus
aaggcaaatggttagctgctctcca

SEQ ID NO: 59339 - DNA, 25 bp, Mus musculus
aaggcaacacacctggcatttccct

SEQ ID NO: 59340 - DNA, 25 bp, Mus musculus
aaggcaacacacgtggcatttccct

SEQ ID NO: 59341 - DNA, 25 bp, Mus musculus
aaggcaacacagcaagtaacgagac

SEQ ID NO: 59342 - DNA, 25 bp, Mus musculus
aaggcaacacaggaagtaacgagac

SEQ ID NO: 59343 - DNA, 25 bp, Mus musculus
aaggcaacacctactttgtagatga

SEQ ID NO: 59344 - DNA, 25 bp, Mus musculus
aaggcaacaccttctttgtagatga

SEQ ID NO: 59345 - DNA, 25 bp, Mus musculus
aaggcaacactgagccatggccaca

SEQ ID NO: 59346 - DNA, 25 bp, Mus musculus
aaggcaacactgtgccatggccaca

SEQ ID NO: 59347 - DNA, 25 bp, Mus musculus
aaggcaacagccagactagcagtgg

SEQ ID NO: 59348 - DNA, 25 bp, Mus musculus
aaggcaacagcctgactagcagtgg

SEQ ID NO: 59349 - DNA, 25 bp, Mus musculus
aaggcaacagtgagggagtgaccca

SEQ ID NO: 59350 - DNA, 25 bp, Mus musculus
aaggcaacagtgtgggagtgaccca

SEQ ID NO: 59351 - DNA, 25 bp, Mus musculus
aaggcaacatgaactcagtgagagt

SEQ ID NO: 59352 - DNA, 25 bp, Mus musculus
aaggcaacatgatctcagtgagagt

SEQ ID NO: 59353 - DNA, 25 bp, Mus musculus
aaggcaacattaacacgggtggcta

SEQ ID NO: 59354 - DNA, 25 bp, Mus musculus
aaggcaacattatcacgggtggcta

SEQ ID NO: 59355 - DNA, 25 bp, Mus musculus
aaggcaaccatactcccagtacttg

SEQ ID NO: 59356 - DNA, 25 bp, Mus musculus
aaggcaaccatagtcccagtacttg

SEQ ID NO: 59357 - DNA, 25 bp, Mus musculus
aaggcaaccatgactaatctaagtg

SEQ ID NO: 59358 - DNA, 25 bp, Mus musculus
aaggcaaccatgtctaatctaagtg

SEQ ID NO: 59359 - DNA, 25 bp, Mus musculus
aaggcaacctcccaggagatcgtat

SEQ ID NO: 59360 - DNA, 25 bp, Mus musculus
aaggcaacctccgaggagatcgtat

SEQ ID NO: 59361 - DNA, 25 bp, Mus musculus
aaggcaacctctcctccagatggat

SEQ ID NO: 59362 - DNA, 25 bp, Mus musculus
aaggcaacctctgctccagatggat

SEQ ID NO: 59363 - DNA, 25 bp, Mus musculus
aaggcaacctgtattctggtcgagt

SEQ ID NO: 59364 - DNA, 25 bp, Mus musculus
aaggcaacctgttttctggtcgagt

SEQ ID NO: 59365 - DNA, 25 bp, Mus musculus
aaggcaacgattcctgtcagggtga

SEQ ID NO: 59366 - DNA, 25 bp, Mus musculus
aaggcaacgattgctgtcagggtga

SEQ ID NO: 59367 - DNA, 25 bp, Mus musculus
aaggcaacgctaatgtcctgatctc

SEQ ID NO: 59368 - DNA, 25 bp, Mus musculus
aaggcaacgctattgtcctgatctc

SEQ ID NO: 59369 - DNA, 25 bp, Mus musculus
aaggcaacgtttagccatgacccct

SEQ ID NO: 59370 - DNA, 25 bp, Mus musculus
aaggcaacgttttgccatgacccct

SEQ ID NO: 59371 - DNA, 25 bp, Mus musculus
aaggcaactcagacacatgcatagt

SEQ ID NO: 59372 - DNA, 25 bp, Mus musculus
aaggcaactcagtcacatgcatagt

SEQ ID NO: 59373 - DNA, 25 bp, Mus musculus
aaggcaactcatactggcagagaaa

SEQ ID NO: 59374 - DNA, 25 bp, Mus musculus
aaggcaactcattctggcagagaaa

SEQ ID NO: 59375 - DNA, 25 bp, Mus musculus
aaggcaactcctcaaagctgaagac

SEQ ID NO: 59376 - DNA, 25 bp, Mus musculus
aaggcaactcctgaaagctgaagac

SEQ ID NO: 59377 - DNA, 25 bp, Mus musculus
aaggcaactctgagcatgtgctgtg

SEQ ID NO: 59378 - DNA, 25 bp, Mus musculus
aaggcaactctgtgcatgtgctgtg

SEQ ID NO: 59379 - DNA, 25 bp, Mus musculus
aaggcaacttccactttctggataa

SEQ ID NO: 59380 - DNA, 25 bp, Mus musculus
aaggcaacttcctctttctggataa

SEQ ID NO: 59381 - DNA, 25 bp, Mus musculus
aaggcaagacaaccgcaggtcttca

SEQ ID NO: 59382 - DNA, 25 bp, Mus musculus
aaggcaagacaagcgcaggtcttca

SEQ ID NO: 59383 - DNA, 25 bp, Mus musculus
aaggcaagaccgagaaggtacccat

SEQ ID NO: 59384 - DNA, 25 bp, Mus musculus
aaggcaagaccgtgaaggtacccat

SEQ ID NO: 59385 - DNA, 25 bp, Mus musculus
aaggcaagacttctgcagcaattgt

SEQ ID NO: 59386 - DNA, 25 bp, Mus musculus
aaggcaagacttgtgcagcaattgt

SEQ ID NO: 59387 - DNA, 25 bp, Mus musculus
aaggcaagagttcctggcatctgtc

SEQ ID NO: 59388 - DNA, 25 bp, Mus musculus
aaggcaagagttgctggcatctgtc

SEQ ID NO: 59389 - DNA, 25 bp, Mus musculus
aaggcaagatatctctgtgcagccc

SEQ ID NO: 59390 - DNA, 25 bp, Mus musculus
aaggcaagatatgtctgtgcagccc

SEQ ID NO: 59391 - DNA, 25 bp, Mus musculus
aaggcaagatctacagctcctctgg

SEQ ID NO: 59392 - DNA, 25 bp, Mus musculus
aaggcaagatcttcagctcctctgg

SEQ ID NO: 59393 - DNA, 25 bp, Mus musculus
aaggcaagcaccactacactttaga

SEQ ID NO: 59394 - DNA, 25 bp, Mus musculus
aaggcaagcacctctacactttaga

SEQ ID NO: 59395 - DNA, 25 bp, Mus musculus
aaggcaagccttcgcaagtgttggt

SEQ ID NO: 59396 - DNA, 25 bp, Mus musculus
aaggcaagccttggcaagtgttggt

SEQ ID NO: 59397 - DNA, 25 bp, Mus musculus
aaggcaagcgtcaactaacagtgtg

SEQ ID NO: 59398 - DNA, 25 bp, Mus musculus
aaggcaagcgtctactaacagtgtg

SEQ ID NO: 59399 - DNA, 25 bp, Mus musculus
aaggcaagctctccacagtctgaac

SEQ ID NO: 59400 - DNA, 25 bp, Mus musculus
aaggcaagctctctttccattgatc

SEQ ID NO: 59401 - DNA, 25 bp, Mus musculus
aaggcaagctctgcacagtctgaac

SEQ ID NO: 59402 - DNA, 25 bp, Mus musculus
aaggcaagctctgtttccattgatc

SEQ ID NO: 59403 - DNA, 25 bp, Mus musculus
aaggcaagctttaggaattctgtgt

SEQ ID NO: 59404 - DNA, 25 bp, Mus musculus
aaggcaagcttttggaattctgtgt

SEQ ID NO: 59405 - DNA, 25 bp, Mus musculus
aaggcaaggaccaatgtacgagcat

SEQ ID NO: 59406 - DNA, 25 bp, Mus musculus
aaggcaaggacctatgtacgagcat

SEQ ID NO: 59407 - DNA, 25 bp, Mus musculus
aaggcaaggactccgtattcacaga

SEQ ID NO: 59408 - DNA, 25 bp, Mus musculus
aaggcaaggactgcgtattcacaga

SEQ ID NO: 59409 - DNA, 25 bp, Mus musculus
aaggcaaggattactcctgagtttt

SEQ ID NO: 59410 - DNA, 25 bp, Mus musculus
aaggcaaggatttctcctgagtttt

SEQ ID NO: 59411 - DNA, 25 bp, Mus musculus
aaggcaaggccaattgcttattgca

SEQ ID NO: 59412 - DNA, 25 bp, Mus musculus
aaggcaaggccatttgcttattgca

SEQ ID NO: 59413 - DNA, 25 bp, Mus musculus
aaggcaaggtatcctcacttgggac

SEQ ID NO: 59414 - DNA, 25 bp, Mus musculus
aaggcaaggtatgctcacttgggac

SEQ ID NO: 59415 - DNA, 25 bp, Mus musculus
aaggcaaggtcactggctttcataa

SEQ ID NO: 59416 - DNA, 25 bp, Mus musculus
aaggcaaggtcagtggctttcataa

SEQ ID NO: 59417 - DNA, 25 bp, Mus musculus
aaggcaagttggactttatgattct

SEQ ID NO: 59418 - DNA, 25 bp, Mus musculus
aaggcaagttggtctttatgattct

SEQ ID NO: 59419 - DNA, 25 bp, Mus musculus
aaggcaataatgcagccctgccctg

SEQ ID NO: 59420 - DNA, 25 bp, Mus musculus
aaggcaataatggagccctgccctg

SEQ ID NO: 59421 - DNA, 25 bp, Mus musculus
aaggcaatatcaacctatagttcag

SEQ ID NO: 59422 - DNA, 25 bp, Mus musculus
aaggcaatatcatcctatagttcag

SEQ ID NO: 59423 - DNA, 25 bp, Mus musculus
aaggcaatcaggctctcattttaat

SEQ ID NO: 59424 - DNA, 25 bp, Mus musculus
aaggcaatcagggtctcattttaat

SEQ ID NO: 59425 - DNA, 25 bp, Mus musculus
aaggcaatcccaaagaggctgctcc

SEQ ID NO: 59426 - DNA, 25 bp, Mus musculus
aaggcaatcccatagaggctgctcc

SEQ ID NO: 59427 - DNA, 25 bp, Mus musculus
aaggcaatccttaggtgtcacatgg

SEQ ID NO: 59428 - DNA, 25 bp, Mus musculus
aaggcaatcctttggtgtcacatgg

SEQ ID NO: 59429 - DNA, 25 bp, Mus musculus
aaggcaatcgctcctaggtatcacg

SEQ ID NO: 59430 - DNA, 25 bp, Mus musculus
aaggcaatcgctgctaggtatcacg

SEQ ID NO: 59431 - DNA, 25 bp, Mus musculus
aaggcaatctcacgtgctttaatat

SEQ ID NO: 59432 - DNA, 25 bp, Mus musculus
aaggcaatctcaggtgctttaatat

SEQ ID NO: 59433 - DNA, 25 bp, Mus musculus
aaggcaatgaccacagtagaaggct

SEQ ID NO: 59434 - DNA, 25 bp, Mus musculus
aaggcaatgacctcagtagaaggct

SEQ ID NO: 59435 - DNA, 25 bp, Mus musculus
aaggcaatgcttactctctgctgca

SEQ ID NO: 59436 - DNA, 25 bp, Mus musculus
aaggcaatgctttctctctgctgca

SEQ ID NO: 59437 - DNA, 25 bp, Mus musculus
aaggcaatggccatcacttctccag

SEQ ID NO: 59438 - DNA, 25 bp, Mus musculus
aaggcaatggccttcacttctccag

SEQ ID NO: 59439 - DNA, 25 bp, Mus musculus
aaggcaattcagatcagttcagcat

SEQ ID NO: 59440 - DNA, 25 bp, Mus musculus
aaggcaattcagttcagttcagcat

SEQ ID NO: 59441 - DNA, 25 bp, Mus musculus
aaggcaattgaaatatcccgagaaa

SEQ ID NO: 59442 - DNA, 25 bp, Mus musculus
aaggcaattgaattatcccgagaaa

SEQ ID NO: 59443 - DNA, 25 bp, Mus musculus
aaggcaattgccctgctgaaaaata

SEQ ID NO: 59444 - DNA, 25 bp, Mus musculus
aaggcaattgccgtgctgaaaaata

SEQ ID NO: 59445 - DNA, 25 bp, Mus musculus
aaggcaatttgcaaacattcaatac

SEQ ID NO: 59446 - DNA, 25 bp, Mus musculus
aaggcaatttgctaacattcaatac

SEQ ID NO: 59447 - DNA, 25 bp, Mus musculus
aaggcacaaatcacgggtacacagc

SEQ ID NO: 59448 - DNA, 25 bp, Mus musculus
aaggcacaaatctcgggtacacagc

SEQ ID NO: 59449 - DNA, 25 bp, Mus musculus
aaggcacaagctacgggactgtcct

SEQ ID NO: 59450 - DNA, 25 bp, Mus musculus
aaggcacaagctatgagggactcaa

SEQ ID NO: 59451 - DNA, 25 bp, Mus musculus
aaggcacaagcttcgggactgtcct

SEQ ID NO: 59452 - DNA, 25 bp, Mus musculus
aaggcacaagctttgagggactcaa

SEQ ID NO: 59453 - DNA, 25 bp, Mus musculus
aaggcacaatataggctgggcacag

SEQ ID NO: 59454 - DNA, 25 bp, Mus musculus
aaggcacaatattggctgggcacag

SEQ ID NO: 59455 - DNA, 25 bp, Mus musculus
aaggcacacaagagtccatggactt

SEQ ID NO: 59456 - DNA, 25 bp, Mus musculus
aaggcacacaagcagcgacacccag

SEQ ID NO: 59457 - DNA, 25 bp, Mus musculus
aaggcacacaagcatttacgtttca

SEQ ID NO: 59458 - DNA, 25 bp, Mus musculus
aaggcacacaaggagcgacacccag

SEQ ID NO: 59459 - DNA, 25 bp, Mus musculus
aaggcacacaaggatttacgtttca

SEQ ID NO: 59460 - DNA, 25 bp, Mus musculus
aaggcacacaagtgtccatggactt

SEQ ID NO: 59461 - DNA, 25 bp, Mus musculus
aaggcacacagtaacttgaacagca

SEQ ID NO: 59462 - DNA, 25 bp, Mus musculus
aaggcacacagttacttgaacagca

SEQ ID NO: 59463 - DNA, 25 bp, Mus musculus
aaggcacacatacacacttggctgt

SEQ ID NO: 59464 - DNA, 25 bp, Mus musculus
aaggcacacatagacacttggctgt

SEQ ID NO: 59465 - DNA, 25 bp, Mus musculus
aaggcacacattagtgtaagcctga

SEQ ID NO: 59466 - DNA, 25 bp, Mus musculus
aaggcacacatttgtgtaagcctga

SEQ ID NO: 59467 - DNA, 25 bp, Mus musculus
aaggcacaccccaaatgacctataa

SEQ ID NO: 59468 - DNA, 25 bp, Mus musculus
aaggcacacccctaatgacctataa

SEQ ID NO: 59469 - DNA, 25 bp, Mus musculus
aaggcacacctaccaaggagcgctt

SEQ ID NO: 59470 - DNA, 25 bp, Mus musculus
aaggcacacctagcaaggagcgctt

SEQ ID NO: 59471 - DNA, 25 bp, Mus musculus
aaggcacacctcatatgttcagaga

SEQ ID NO: 59472 - DNA, 25 bp, Mus musculus
aaggcacacctcttatgttcagaga

SEQ ID NO: 59473 - DNA, 25 bp, Mus musculus
aaggcacacgttcagcactctcagt

SEQ ID NO: 59474 - DNA, 25 bp, Mus musculus
aaggcacacgttgagcactctcagt

SEQ ID NO: 59475 - DNA, 25 bp, Mus musculus
aaggcacactagacacagtctcgac

SEQ ID NO: 59476 - DNA, 25 bp, Mus musculus
aaggcacactagtcacagtctcgac

SEQ ID NO: 59477 - DNA, 25 bp, Mus musculus
aaggcacactgcattcattactcac

SEQ ID NO: 59478 - DNA, 25 bp, Mus musculus
aaggcacactgctttcattactcac

SEQ ID NO: 59479 - DNA, 25 bp, Mus musculus
aaggcacactgtaaagaggtaatta

SEQ ID NO: 59480 - DNA, 25 bp, Mus musculus
aaggcacactgttaagaggtaatta

SEQ ID NO: 59481 - DNA, 25 bp, Mus musculus
aaggcacagaggacatctggctcac

SEQ ID NO: 59482 - DNA, 25 bp, Mus musculus
aaggcacagaggagctcacacccta

SEQ ID NO: 59483 - DNA, 25 bp, Mus musculus
aaggcacagaggtcatctggctcac

SEQ ID NO: 59484 - DNA, 25 bp, Mus musculus
aaggcacagaggtgctcacacccta

SEQ ID NO: 59485 - DNA, 25 bp, Mus musculus
aaggcacagataatctccctcaggc

SEQ ID NO: 59486 - DNA, 25 bp, Mus musculus
aaggcacagatattctccctcaggc

SEQ ID NO: 59487 - DNA, 25 bp, Mus musculus
aaggcacagcagacttgagctgctc

SEQ ID NO: 59488 - DNA, 25 bp, Mus musculus
aaggcacagcagtcttgagctgctc

SEQ ID NO: 59489 - DNA, 25 bp, Mus musculus
aaggcacagctcaacgcaaaagcga

SEQ ID NO: 59490 - DNA, 25 bp, Mus musculus
aaggcacagctctacgcaaaagcga

SEQ ID NO: 59491 - DNA, 25 bp, Mus musculus
aaggcacaggatcctgaggagccaa

SEQ ID NO: 59492 - DNA, 25 bp, Mus musculus
aaggcacaggatgctgaggagccaa

SEQ ID NO: 59493 - DNA, 25 bp, Mus musculus
aaggcacaggccagtatgatgggct

SEQ ID NO: 59494 - DNA, 25 bp, Mus musculus
aaggcacaggcctgtatgatgggct

SEQ ID NO: 59495 - DNA, 25 bp, Mus musculus
aaggcacagttgctcagtcctaggt

SEQ ID NO: 59496 - DNA, 25 bp, Mus musculus
aaggcacagttggtcagtcctaggt

SEQ ID NO: 59497 - DNA, 25 bp, Mus musculus
aaggcacataacctccgggagtaat

SEQ ID NO: 59498 - DNA, 25 bp, Mus musculus
aaggcacataacgtccgggagtaat

SEQ ID NO: 59499 - DNA, 25 bp, Mus musculus
aaggcacatattctcagttttatag

SEQ ID NO: 59500 - DNA, 25 bp, Mus musculus
aaggcacatattgtcagttttatag

SEQ ID NO: 59501 - DNA, 25 bp, Mus musculus
aaggcacattatatctcaagtcagg

SEQ ID NO: 59502 - DNA, 25 bp, Mus musculus
aaggcacattatttctcaagtcagg

SEQ ID NO: 59503 - DNA, 25 bp, Mus musculus
aaggcacattttaactcattagctg

SEQ ID NO: 59504 - DNA, 25 bp, Mus musculus
aaggcacatttttactcattagctg

SEQ ID NO: 59505 - DNA, 25 bp, Mus musculus
aaggcaccacaaagggagcagcatt

SEQ ID NO: 59506 - DNA, 25 bp, Mus musculus
aaggcaccacaatgggagcagcatt

SEQ ID NO: 59507 - DNA, 25 bp, Mus musculus
aaggcaccacgaaaagccattagtg

SEQ ID NO: 59508 - DNA, 25 bp, Mus musculus
aaggcaccacgataagccattagtg

SEQ ID NO: 59509 - DNA, 25 bp, Mus musculus
aaggcaccactgacactgtctcttc

SEQ ID NO: 59510 - DNA, 25 bp, Mus musculus
aaggcaccactgtcactgtctcttc

SEQ ID NO: 59511 - DNA, 25 bp, Mus musculus
aaggcaccacttcagctggacactg

SEQ ID NO: 59512 - DNA, 25 bp, Mus musculus
aaggcaccacttgagctggacactg

SEQ ID NO: 59513 - DNA, 25 bp, Mus musculus
aaggcaccagacaaatatctcatca

SEQ ID NO: 59514 - DNA, 25 bp, Mus musculus
aaggcaccagactaatatctcatca

SEQ ID NO: 59515 - DNA, 25 bp, Mus musculus
aaggcaccagtacctttgggtcgag

SEQ ID NO: 59516 - DNA, 25 bp, Mus musculus
aaggcaccagtagctttgggtcgag

SEQ ID NO: 59517 - DNA, 25 bp, Mus musculus
aaggcaccattcctctgtgagagac

SEQ ID NO: 59518 - DNA, 25 bp, Mus musculus
aaggcaccattcgtctgtgagagac

SEQ ID NO: 59519 - DNA, 25 bp, Mus musculus
aaggcacccatactcacttgtaatt

SEQ ID NO: 59520 - DNA, 25 bp, Mus musculus
aaggcacccatagtcacttgtaatt

SEQ ID NO: 59521 - DNA, 25 bp, Mus musculus
aaggcacccttgatgactacagcaa

SEQ ID NO: 59522 - DNA, 25 bp, Mus musculus
aaggcacccttgttgactacagcaa

SEQ ID NO: 59523 - DNA, 25 bp, Mus musculus
aaggcaccgatcattacaagtgagc

SEQ ID NO: 59524 - DNA, 25 bp, Mus musculus
aaggcaccgatctttacaagtgagc

SEQ ID NO: 59525 - DNA, 25 bp, Mus musculus
aaggcaccggcaagctgagtgtgtt

SEQ ID NO: 59526 - DNA, 25 bp, Mus musculus
aaggcaccggcatgctgagtgtgtt

SEQ ID NO: 59527 - DNA, 25 bp, Mus musculus
aaggcaccgggacacacagatgagc

SEQ ID NO: 59528 - DNA, 25 bp, Mus musculus
aaggcaccgggagacacagatgagc

SEQ ID NO: 59529 - DNA, 25 bp, Mus musculus
aaggcacctaggactgtggctttgt

SEQ ID NO: 59530 - DNA, 25 bp, Mus musculus
aaggcacctaggtctgtggctttgt

SEQ ID NO: 59531 - DNA, 25 bp, Mus musculus
aaggcacctatgatcacaccattga

SEQ ID NO: 59532 - DNA, 25 bp, Mus musculus
aaggcacctatgttcacaccattga

SEQ ID NO: 59533 - DNA, 25 bp, Mus musculus
aaggcacctggtctacagtgcatgc

SEQ ID NO: 59534 - DNA, 25 bp, Mus musculus
aaggcacctggtgtacagtgcatgc

SEQ ID NO: 59535 - DNA, 25 bp, Mus musculus
aaggcacctgtaaatctgcgacttc

SEQ ID NO: 59536 - DNA, 25 bp, Mus musculus
aaggcacctgtatatctgcgacttc

SEQ ID NO: 59537 - DNA, 25 bp, Mus musculus
aaggcaccttacaccagaacctgat

SEQ ID NO: 59538 - DNA, 25 bp, Mus musculus
aaggcaccttactccagaacctgat

SEQ ID NO: 59539 - DNA, 25 bp, Mus musculus
aaggcaccttagagaaggcccctca

SEQ ID NO: 59540 - DNA, 25 bp, Mus musculus
aaggcaccttagtgaaggcccctca

SEQ ID NO: 59541 - DNA, 25 bp, Mus musculus
aaggcaccttggctagactgtgaac

SEQ ID NO: 59542 - DNA, 25 bp, Mus musculus
aaggcaccttgggtagactgtgaac

SEQ ID NO: 59543 - DNA, 25 bp, Mus musculus
aaggcacgagctctgacaggtcctg

SEQ ID NO: 59544 - DNA, 25 bp, Mus musculus
aaggcacgagctgtgacaggtcctg

SEQ ID NO: 59545 - DNA, 25 bp, Mus musculus
aaggcacgaggaacagtatttcaga

SEQ ID NO: 59546 - DNA, 25 bp, Mus musculus
aaggcacgaggatcagtatttcaga

SEQ ID NO: 59547 - DNA, 25 bp, Mus musculus
aaggcacgaggcatttcaaaagaaa

SEQ ID NO: 59548 - DNA, 25 bp, Mus musculus
aaggcacgaggcttttcaaaagaaa

SEQ ID NO: 59549 - DNA, 25 bp, Mus musculus
aaggcacgattacctgctctggata

SEQ ID NO: 59550 - DNA, 25 bp, Mus musculus
aaggcacgattagctgctctggata

SEQ ID NO: 59551 - DNA, 25 bp, Mus musculus
aaggcacgccctcaagatgtggtga

SEQ ID NO: 59552 - DNA, 25 bp, Mus musculus
aaggcacgccctgaagatgtggtga

SEQ ID NO: 59553 - DNA, 25 bp, Mus musculus
aaggcacggattcatcggctgcatc

SEQ ID NO: 59554 - DNA, 25 bp, Mus musculus
aaggcacggattgatcggctgcatc

SEQ ID NO: 59555 - DNA, 25 bp, Mus musculus
aaggcacggccacttgtccgacttg

SEQ ID NO: 59556 - DNA, 25 bp, Mus musculus
aaggcacggccagttgtccgacttg

SEQ ID NO: 59557 - DNA, 25 bp, Mus musculus
aaggcacggcgtcacctttaggcct

SEQ ID NO: 59558 - DNA, 25 bp, Mus musculus
aaggcacggcgtgacctttaggcct

SEQ ID NO: 59559 - DNA, 25 bp, Mus musculus
aaggcacgggtgactattctcatct

SEQ ID NO: 59560 - DNA, 25 bp, Mus musculus
aaggcacgggtgtctattctcatct

SEQ ID NO: 59561 - DNA, 25 bp, Mus musculus
aaggcacgtcgtagcgcaggcttat

SEQ ID NO: 59562 - DNA, 25 bp, Mus musculus
aaggcacgtcgttgcgcaggcttat

SEQ ID NO: 59563 - DNA, 25 bp, Mus musculus
aaggcacgtcttctgatgtgggact

SEQ ID NO: 59564 - DNA, 25 bp, Mus musculus
aaggcacgtcttgtgatgtgggact

SEQ ID NO: 59565 - DNA, 25 bp, Mus musculus
aaggcacgtgtgagttcatggagaa

SEQ ID NO: 59566 - DNA, 25 bp, Mus musculus
aaggcacgtgtgtgttcatggagaa

SEQ ID NO: 59567 - DNA, 25 bp, Mus musculus
aaggcacgtttgctcaggctgcatc

SEQ ID NO: 59568 - DNA, 25 bp, Mus musculus
aaggcacgtttggtcaggctgcatc

SEQ ID NO: 59569 - DNA, 25 bp, Mus musculus
aaggcactactgcttcaatgtcctg

SEQ ID NO: 59570 - DNA, 25 bp, Mus musculus
aaggcactactggttcaatgtcctg

SEQ ID NO: 59571 - DNA, 25 bp, Mus musculus
aaggcactagcccttttacaggcta

SEQ ID NO: 59572 - DNA, 25 bp, Mus musculus
aaggcactagccgttttacaggcta

SEQ ID NO: 59573 - DNA, 25 bp, Mus musculus
aaggcactaggtcgagtcattatga

SEQ ID NO: 59574 - DNA, 25 bp, Mus musculus
aaggcactaggtggagtcattatga

SEQ ID NO: 59575 - DNA, 25 bp, Mus musculus
aaggcactcccacacagtattaaga

SEQ ID NO: 59576 - DNA, 25 bp, Mus musculus
aaggcactcccagacagtattaaga

SEQ ID NO: 59577 - DNA, 25 bp, Mus musculus
aaggcactcctgaagattctgggca

SEQ ID NO: 59578 - DNA, 25 bp, Mus musculus
aaggcactcctgtagattctgggca

SEQ ID NO: 59579 - DNA, 25 bp, Mus musculus
aaggcactcggcaaagcggtccgag

SEQ ID NO: 59580 - DNA, 25 bp, Mus musculus
aaggcactcggctaagcggtccgag

SEQ ID NO: 59581 - DNA, 25 bp, Mus musculus
aaggcactctcgaatccatcaatga

SEQ ID NO: 59582 - DNA, 25 bp, Mus musculus
aaggcactctcgtatccatcaatga

SEQ ID NO: 59583 - DNA, 25 bp, Mus musculus
aaggcactgaaaactgtcctgagat

SEQ ID NO: 59584 - DNA, 25 bp, Mus musculus
aaggcactgaaatctgtcctgagat

SEQ ID NO: 59585 - DNA, 25 bp, Mus musculus
aaggcactgaacctggagccagatg

SEQ ID NO: 59586 - DNA, 25 bp, Mus musculus
aaggcactgaacgtggagccagatg

SEQ ID NO: 59587 - DNA, 25 bp, Mus musculus
aaggcactgactcctagctaacaca

SEQ ID NO: 59588 - DNA, 25 bp, Mus musculus
aaggcactgactgctagctaacaca

SEQ ID NO: 59589 - DNA, 25 bp, Mus musculus
aaggcactgcagaaactgggtctta

SEQ ID NO: 59590 - DNA, 25 bp, Mus musculus
aaggcactgcagtaactgggtctta

SEQ ID NO: 59591 - DNA, 25 bp, Mus musculus
aaggcactgctgatagctgatgcat

SEQ ID NO: 59592 - DNA, 25 bp, Mus musculus
aaggcactgctgttagctgatgcat

SEQ ID NO: 59593 - DNA, 25 bp, Mus musculus
aaggcactggacaaagctcggacta

SEQ ID NO: 59594 - DNA, 25 bp, Mus musculus
aaggcactggactaagctcggacta

SEQ ID NO: 59595 - DNA, 25 bp, Mus musculus
aaggcactggagagggtcttctcac

SEQ ID NO: 59596 - DNA, 25 bp, Mus musculus
aaggcactggagtgggtcttctcac

SEQ ID NO: 59597 - DNA, 25 bp, Mus musculus
aaggcactggcaaaccgctggaggt

SEQ ID NO: 59598 - DNA, 25 bp, Mus musculus
aaggcactggcataccgctggaggt

SEQ ID NO: 59599 - DNA, 25 bp, Mus musculus
aaggcactggccaaatctgaagaag

SEQ ID NO: 59600 - DNA, 25 bp, Mus musculus
aaggcactggcctaatctgaagaag

SEQ ID NO: 59601 - DNA, 25 bp, Mus musculus
aaggcactgggactttgctggtcac

SEQ ID NO: 59602 - DNA, 25 bp, Mus musculus
aaggcactgggagtttgctggtcac

SEQ ID NO: 59603 - DNA, 25 bp, Mus musculus
aaggcactggttcctcattgaacag

SEQ ID NO: 59604 - DNA, 25 bp, Mus musculus
aaggcactggttgctcattgaacag

SEQ ID NO: 59605 - DNA, 25 bp, Mus musculus
aaggcactgtccctgatatggctgc

SEQ ID NO: 59606 - DNA, 25 bp, Mus musculus
aaggcactgtccgtgatatggctgc

SEQ ID NO: 59607 - DNA, 25 bp, Mus musculus
aaggcactgtggatatagcaaggct

SEQ ID NO: 59608 - DNA, 25 bp, Mus musculus
aaggcactgtggttatagcaaggct

SEQ ID NO: 59609 - DNA, 25 bp, Mus musculus
aaggcactgtgtccaatcctagcat

SEQ ID NO: 59610 - DNA, 25 bp, Mus musculus
aaggcactgtgtgcaatcctagcat

SEQ ID NO: 59611 - DNA, 25 bp, Mus musculus
aaggcacttcaaaccatcataagat

SEQ ID NO: 59612 - DNA, 25 bp, Mus musculus
aaggcacttcaatccatcataagat

SEQ ID NO: 59613 - DNA, 25 bp, Mus musculus
aaggcactttatagtttgagtagca

SEQ ID NO: 59614 - DNA, 25 bp, Mus musculus
aaggcactttattgtttgagtagca

SEQ ID NO: 59615 - DNA, 25 bp, Mus musculus
aaggcactttctcaatatcactggg

SEQ ID NO: 59616 - DNA, 25 bp, Mus musculus
aaggcactttctgaatatcactggg

SEQ ID NO: 59617 - DNA, 25 bp, Mus musculus
aaggcagaacctccgagacctctgg

SEQ ID NO: 59618 - DNA, 25 bp, Mus musculus
aaggcagaacctgcgagacctctgg

SEQ ID NO: 59619 - DNA, 25 bp, Mus musculus
aaggcagaagccatgtaggaataca

SEQ ID NO: 59620 - DNA, 25 bp, Mus musculus
aaggcagaagccttgtaggaataca

SEQ ID NO: 59621 - DNA, 25 bp, Mus musculus
aaggcagaagtcaaaccgctggtcc

SEQ ID NO: 59622 - DNA, 25 bp, Mus musculus
aaggcagaagtcacctcactgaggc

SEQ ID NO: 59623 - DNA, 25 bp, Mus musculus
aaggcagaagtctaaccgctggtcc

SEQ ID NO: 59624 - DNA, 25 bp, Mus musculus
aaggcagaagtctcctcactgaggc

SEQ ID NO: 59625 - DNA, 25 bp, Mus musculus
aaggcagaatcaagagtaccaggtg

SEQ ID NO: 59626 - DNA, 25 bp, Mus musculus
aaggcagaatcaccccataatcttg

SEQ ID NO: 59627 - DNA, 25 bp, Mus musculus
aaggcagaatcagcccataatcttg

SEQ ID NO: 59628 - DNA, 25 bp, Mus musculus
aaggcagaatcatgagtaccaggtg

SEQ ID NO: 59629 - DNA, 25 bp, Mus musculus
aaggcagaatccaatgcattcagaa

SEQ ID NO: 59630 - DNA, 25 bp, Mus musculus
aaggcagaatcccacctaggagaca

SEQ ID NO: 59631 - DNA, 25 bp, Mus musculus
aaggcagaatccgacctaggagaca

SEQ ID NO: 59632 - DNA, 25 bp, Mus musculus
aaggcagaatcctatgcattcagaa

SEQ ID NO: 59633 - DNA, 25 bp, Mus musculus
aaggcagaattcagggtttccaaag

SEQ ID NO: 59634 - DNA, 25 bp, Mus musculus
aaggcagaattctgggtttccaaag

SEQ ID NO: 59635 - DNA, 25 bp, Mus musculus
aaggcagacaacctgtcacctttgc

SEQ ID NO: 59636 - DNA, 25 bp, Mus musculus
aaggcagacaacgtgtcacctttgc

SEQ ID NO: 59637 - DNA, 25 bp, Mus musculus
aaggcagaccaaaacttgtgtgttg

SEQ ID NO: 59638 - DNA, 25 bp, Mus musculus
aaggcagaccaatacttgtgtgttg

SEQ ID NO: 59639 - DNA, 25 bp, Mus musculus
aaggcagaccacacagacatggatt

SEQ ID NO: 59640 - DNA, 25 bp, Mus musculus
aaggcagaccactcagacatggatt

SEQ ID NO: 59641 - DNA, 25 bp, Mus musculus
aaggcagaccatatcaagttcaagc

SEQ ID NO: 59642 - DNA, 25 bp, Mus musculus
aaggcagaccatttcaagttcaagc

SEQ ID NO: 59643 - DNA, 25 bp, Mus musculus
aaggcagaccgtaggtgtgtagtca

SEQ ID NO: 59644 - DNA, 25 bp, Mus musculus
aaggcagaccgttggtgtgtagtca

SEQ ID NO: 59645 - DNA, 25 bp, Mus musculus
aaggcagacgctcgaccaggcctca

SEQ ID NO: 59646 - DNA, 25 bp, Mus musculus
aaggcagacgctggaccaggcctca

SEQ ID NO: 59647 - DNA, 25 bp, Mus musculus
aaggcagacttaaggctcttccggc

SEQ ID NO: 59648 - DNA, 25 bp, Mus musculus
aaggcagacttatggctcttccggc

SEQ ID NO: 59649 - DNA, 25 bp, Mus musculus
aaggcagagactaccgtgacaacac

SEQ ID NO: 59650 - DNA, 25 bp, Mus musculus
aaggcagagacttccgtgacaacac

SEQ ID NO: 59651 - DNA, 25 bp, Mus musculus
aaggcagagatccattacaaattca

SEQ ID NO: 59652 - DNA, 25 bp, Mus musculus
aaggcagagatcgattacaaattca

SEQ ID NO: 59653 - DNA, 25 bp, Mus musculus
aaggcagagctcacgggatcaggat

SEQ ID NO: 59654 - DNA, 25 bp, Mus musculus
aaggcagagctcatgcagcaatcta

SEQ ID NO: 59655 - DNA, 25 bp, Mus musculus
aaggcagagctctcgggatcaggat

SEQ ID NO: 59656 - DNA, 25 bp, Mus musculus
aaggcagagctcttgcagcaatcta

SEQ ID NO: 59657 - DNA, 25 bp, Mus musculus
aaggcagagcttcatcgacagtgga

SEQ ID NO: 59658 - DNA, 25 bp, Mus musculus
aaggcagagcttgatcgacagtgga

SEQ ID NO: 59659 - DNA, 25 bp, Mus musculus
aaggcagaggatccagacactcttc

SEQ ID NO: 59660 - DNA, 25 bp, Mus musculus
aaggcagaggatcctggtctatgta

SEQ ID NO: 59661 - DNA, 25 bp, Mus musculus
aaggcagaggatgcagacactcttc

SEQ ID NO: 59662 - DNA, 25 bp, Mus musculus
aaggcagaggatgctggtctatgta

SEQ ID NO: 59663 - DNA, 25 bp, Mus musculus
aaggcagaggctcgcaccaatccat

SEQ ID NO: 59664 - DNA, 25 bp, Mus musculus
aaggcagaggctggcaccaatccat

SEQ ID NO: 59665 - DNA, 25 bp, Mus musculus
aaggcagaggttccttctccatgtg

SEQ ID NO: 59666 - DNA, 25 bp, Mus musculus
aaggcagaggttgcttctccatgtg

SEQ ID NO: 59667 - DNA, 25 bp, Mus musculus
aaggcagagttcacaagcccttgtt

SEQ ID NO: 59668 - DNA, 25 bp, Mus musculus
aaggcagagttctcaagcccttgtt

SEQ ID NO: 59669 - DNA, 25 bp, Mus musculus
aaggcagagttgctcagctggtact

SEQ ID NO: 59670 - DNA, 25 bp, Mus musculus
aaggcagagttggtcagctggtact

SEQ ID NO: 59671 - DNA, 25 bp, Mus musculus
aaggcagatagcactttcagtcccc

SEQ ID NO: 59672 - DNA, 25 bp, Mus musculus
aaggcagatagctctttcagtcccc

SEQ ID NO: 59673 - DNA, 25 bp, Mus musculus
aaggcagatcatcagcatggccagc

SEQ ID NO: 59674 - DNA, 25 bp, Mus musculus
aaggcagatcatgagcatggccagc

SEQ ID NO: 59675 - DNA, 25 bp, Mus musculus
aaggcagatctgagctcctttcaca

SEQ ID NO: 59676 - DNA, 25 bp, Mus musculus
aaggcagatctgtgctcctttcaca

SEQ ID NO: 59677 - DNA, 25 bp, Mus musculus
aaggcagatcttcacagctttcgac

SEQ ID NO: 59678 - DNA, 25 bp, Mus musculus
aaggcagatcttgacagctttcgac

SEQ ID NO: 59679 - DNA, 25 bp, Mus musculus
aaggcagcaaggacgtagctgtgtt

SEQ ID NO: 59680 - DNA, 25 bp, Mus musculus
aaggcagcaaggtcgtagctgtgtt

SEQ ID NO: 59681 - DNA, 25 bp, Mus musculus
aaggcagcaagtacaggtcgttcgt

SEQ ID NO: 59682 - DNA, 25 bp, Mus musculus
aaggcagcaagtcaagatctagcag

SEQ ID NO: 59683 - DNA, 25 bp, Mus musculus
aaggcagcaagtgaagatctagcag

SEQ ID NO: 59684 - DNA, 25 bp, Mus musculus
aaggcagcaagttcaggtcgttcgt

SEQ ID NO: 59685 - DNA, 25 bp, Mus musculus
aaggcagcaccaacagcacaaaatt

SEQ ID NO: 59686 - DNA, 25 bp, Mus musculus
aaggcagcaccaagcagggaagcat

SEQ ID NO: 59687 - DNA, 25 bp, Mus musculus
aaggcagcaccatcagcacaaaatt

SEQ ID NO: 59688 - DNA, 25 bp, Mus musculus
aaggcagcaccatgcagggaagcat

SEQ ID NO: 59689 - DNA, 25 bp, Mus musculus
aaggcagcaggcacttgctatcaag

SEQ ID NO: 59690 - DNA, 25 bp, Mus musculus
aaggcagcaggcccgcaaattaccc

SEQ ID NO: 59691 - DNA, 25 bp, Mus musculus
aaggcagcaggcgcgcaaattaccc

SEQ ID NO: 59692 - DNA, 25 bp, Mus musculus
aaggcagcaggctcttgctatcaag

SEQ ID NO: 59693 - DNA, 25 bp, Mus musculus
aaggcagcatccctaatctgtgctt

SEQ ID NO: 59694 - DNA, 25 bp, Mus musculus
aaggcagcatccgtaatctgtgctt

SEQ ID NO: 59695 - DNA, 25 bp, Mus musculus
aaggcagcatcgctgctagcaggat

SEQ ID NO: 59696 - DNA, 25 bp, Mus musculus
aaggcagcatcggtgctagcaggat

SEQ ID NO: 59697 - DNA, 25 bp, Mus musculus
aaggcagcatgcaggaaggtaccag

SEQ ID NO: 59698 - DNA, 25 bp, Mus musculus
aaggcagcatgctggaaggtaccag

SEQ ID NO: 59699 - DNA, 25 bp, Mus musculus
aaggcagcatttcatcttgacctca

SEQ ID NO: 59700 - DNA, 25 bp, Mus musculus
aaggcagcatttgatcttgacctca

SEQ ID NO: 59701 - DNA, 25 bp, Mus musculus
aaggcagccaacacaagcgccatgt

SEQ ID NO: 59702 - DNA, 25 bp, Mus musculus
aaggcagccaactcaagcgccatgt

SEQ ID NO: 59703 - DNA, 25 bp, Mus musculus
aaggcagccaagactttatgtgtca

SEQ ID NO: 59704 - DNA, 25 bp, Mus musculus
aaggcagccaagtctttatgtgtca

SEQ ID NO: 59705 - DNA, 25 bp, Mus musculus
aaggcagccactcggctattggctt

SEQ ID NO: 59706 - DNA, 25 bp, Mus musculus
aaggcagccactgggctattggctt

SEQ ID NO: 59707 - DNA, 25 bp, Mus musculus
aaggcagccagcaagtcagcgagga

SEQ ID NO: 59708 - DNA, 25 bp, Mus musculus
aaggcagccagctagtcagcgagga

SEQ ID NO: 59709 - DNA, 25 bp, Mus musculus
aaggcagcccagcaggagtacatca

SEQ ID NO: 59710 - DNA, 25 bp, Mus musculus
aaggcagcccaggaggagtacatca

SEQ ID NO: 59711 - DNA, 25 bp, Mus musculus
aaggcagcccctaagtaaactctgg

SEQ ID NO: 59712 - DNA, 25 bp, Mus musculus
aaggcagccccttagtaaactctgg

SEQ ID NO: 59713 - DNA, 25 bp, Mus musculus
aaggcagcccttatgctaagattgc

SEQ ID NO: 59714 - DNA, 25 bp, Mus musculus
aaggcagcccttttgctaagattgc

SEQ ID NO: 59715 - DNA, 25 bp, Mus musculus
aaggcagcctgcaggcaagcccagt

SEQ ID NO: 59716 - DNA, 25 bp, Mus musculus
aaggcagcctgcattgctgagcagt

SEQ ID NO: 59717 - DNA, 25 bp, Mus musculus
aaggcagcctgctggcaagcccagt

SEQ ID NO: 59718 - DNA, 25 bp, Mus musculus
aaggcagcctgctttgctgagcagt

SEQ ID NO: 59719 - DNA, 25 bp, Mus musculus
aaggcagcctttcgtcatcggcagg

SEQ ID NO: 59720 - DNA, 25 bp, Mus musculus
aaggcagcctttggtcatcggcagg

SEQ ID NO: 59721 - DNA, 25 bp, Mus musculus
aaggcagcgggccacttgcttaaaa

SEQ ID NO: 59722 - DNA, 25 bp, Mus musculus
aaggcagcgggcgacttgcttaaaa

SEQ ID NO: 59723 - DNA, 25 bp, Mus musculus
aaggcagcgtgcacggtatcgtgtc

SEQ ID NO: 59724 - DNA, 25 bp, Mus musculus
aaggcagcgtgctcggtatcgtgtc

SEQ ID NO: 59725 - DNA, 25 bp, Mus musculus
aaggcagcgtggaggatactgacta

SEQ ID NO: 59726 - DNA, 25 bp, Mus musculus
aaggcagcgtggtggatactgacta

SEQ ID NO: 59727 - DNA, 25 bp, Mus musculus
aaggcagctacaaaacgcacaccaa

SEQ ID NO: 59728 - DNA, 25 bp, Mus musculus
aaggcagctacaacgtaacttcaag

SEQ ID NO: 59729 - DNA, 25 bp, Mus musculus
aaggcagctacataacgcacaccaa

SEQ ID NO: 59730 - DNA, 25 bp, Mus musculus
aaggcagctacatcgtaacttcaag

SEQ ID NO: 59731 - DNA, 25 bp, Mus musculus
aaggcagctatcatacaggcttatc

SEQ ID NO: 59732 - DNA, 25 bp, Mus musculus
aaggcagctatcttacaggcttatc

SEQ ID NO: 59733 - DNA, 25 bp, Mus musculus
aaggcagctctcaggattgccattt

SEQ ID NO: 59734 - DNA, 25 bp, Mus musculus
aaggcagctctcagttctgatttta

SEQ ID NO: 59735 - DNA, 25 bp, Mus musculus
aaggcagctctctggattgccattt

SEQ ID NO: 59736 - DNA, 25 bp, Mus musculus
aaggcagctctctgttctgatttta

SEQ ID NO: 59737 - DNA, 25 bp, Mus musculus
aaggcagctgagattgccacacctt

SEQ ID NO: 59738 - DNA, 25 bp, Mus musculus
aaggcagctgagtttgccacacctt

SEQ ID NO: 59739 - DNA, 25 bp, Mus musculus
aaggcagctgccagggactcaaaag

SEQ ID NO: 59740 - DNA, 25 bp, Mus musculus
aaggcagctgcctgggactcaaaag

SEQ ID NO: 59741 - DNA, 25 bp, Mus musculus
aaggcagctgctcgtagtatcctcc

SEQ ID NO: 59742 - DNA, 25 bp, Mus musculus
aaggcagctgctggtagtatcctcc

SEQ ID NO: 59743 - DNA, 25 bp, Mus musculus
aaggcagctgtcaaaatagactcaa

SEQ ID NO: 59744 - DNA, 25 bp, Mus musculus
aaggcagctgtcatcctgtaagagt

SEQ ID NO: 59745 - DNA, 25 bp, Mus musculus
aaggcagctgtcatcctttaagcct

SEQ ID NO: 59746 - DNA, 25 bp, Mus musculus
aaggcagctgtctaaatagactcaa

SEQ ID NO: 59747 - DNA, 25 bp, Mus musculus
aaggcagctgtcttcctgtaagagt

SEQ ID NO: 59748 - DNA, 25 bp, Mus musculus
aaggcagctgtcttcctttaagcct

SEQ ID NO: 59749 - DNA, 25 bp, Mus musculus
aaggcagcttgaaggtttaatgcat

SEQ ID NO: 59750 - DNA, 25 bp, Mus musculus
aaggcagcttgatggtttaatgcat

SEQ ID NO: 59751 - DNA, 25 bp, Mus musculus
aaggcagcttggattgtgtatatct

SEQ ID NO: 59752 - DNA, 25 bp, Mus musculus
aaggcagcttggtttgtgtatatct

SEQ ID NO: 59753 - DNA, 25 bp, Mus musculus
aaggcagcttgtaggcccttgttac

SEQ ID NO: 59754 - DNA, 25 bp, Mus musculus
aaggcagcttgttggcccttgttac

SEQ ID NO: 59755 - DNA, 25 bp, Mus musculus
aaggcagctttacaagtgagcccct

SEQ ID NO: 59756 - DNA, 25 bp, Mus musculus
aaggcagctttagaagtgagcccct

SEQ ID NO: 59757 - DNA, 25 bp, Mus musculus
aaggcaggacatctctcaccttctg

SEQ ID NO: 59758 - DNA, 25 bp, Mus musculus
aaggcaggacatgtctcaccttctg

SEQ ID NO: 59759 - DNA, 25 bp, Mus musculus
aaggcaggcactatgaatcagatac

SEQ ID NO: 59760 - DNA, 25 bp, Mus musculus
aaggcaggcactttgaatcagatac

SEQ ID NO: 59761 - DNA, 25 bp, Mus musculus
aaggcaggcatactttttaaggact

SEQ ID NO: 59762 - DNA, 25 bp, Mus musculus
aaggcaggcatagtttttaaggact

SEQ ID NO: 59763 - DNA, 25 bp, Mus musculus
aaggcaggcatgctagaagaactga

SEQ ID NO: 59764 - DNA, 25 bp, Mus musculus
aaggcaggcatggtagaagaactga

SEQ ID NO: 59765 - DNA, 25 bp, Mus musculus
aaggcaggccaacgtgtcagcgccc

SEQ ID NO: 59766 - DNA, 25 bp, Mus musculus
aaggcaggccaaggtgtcagcgccc

SEQ ID NO: 59767 - DNA, 25 bp, Mus musculus
aaggcaggccacacaggaacccatt

SEQ ID NO: 59768 - DNA, 25 bp, Mus musculus
aaggcaggccacctccaacctgtgg

SEQ ID NO: 59769 - DNA, 25 bp, Mus musculus
aaggcaggccacgtccaacctgtgg

SEQ ID NO: 59770 - DNA, 25 bp, Mus musculus
aaggcaggccactcaggaacccatt

SEQ ID NO: 59771 - DNA, 25 bp, Mus musculus
aaggcaggccgtccagtctgaaact

SEQ ID NO: 59772 - DNA, 25 bp, Mus musculus
aaggcaggccgtgcagtctgaaact

SEQ ID NO: 59773 - DNA, 25 bp, Mus musculus
aaggcaggcgaaaacacacccacgt

SEQ ID NO: 59774 - DNA, 25 bp, Mus musculus
aaggcaggcgaatacacacccacgt

SEQ ID NO: 59775 - DNA, 25 bp, Mus musculus
aaggcaggcgggacttcagagttct

SEQ ID NO: 59776 - DNA, 25 bp, Mus musculus
aaggcaggcgggtcttcagagttct

SEQ ID NO: 59777 - DNA, 25 bp, Mus musculus
aaggcaggcgttaagttgactggtc

SEQ ID NO: 59778 - DNA, 25 bp, Mus musculus
aaggcaggcgttatccttgtctggt

SEQ ID NO: 59779 - DNA, 25 bp, Mus musculus
aaggcaggcgtttagttgactggtc

SEQ ID NO: 59780 - DNA, 25 bp, Mus musculus
aaggcaggcgttttccttgtctggt

SEQ ID NO: 59781 - DNA, 25 bp, Mus musculus
aaggcaggctcactgtccctggaca

SEQ ID NO: 59782 - DNA, 25 bp, Mus musculus
aaggcaggctcagtgtccctggaca

SEQ ID NO: 59783 - DNA, 25 bp, Mus musculus
aaggcaggctcgatggttttgagta

SEQ ID NO: 59784 - DNA, 25 bp, Mus musculus
aaggcaggctcgttggttttgagta

SEQ ID NO: 59785 - DNA, 25 bp, Mus musculus
aaggcaggctctctagtcctttgca

SEQ ID NO: 59786 - DNA, 25 bp, Mus musculus
aaggcaggctctgtagtcctttgca

SEQ ID NO: 59787 - DNA, 25 bp, Mus musculus
aaggcaggctgcacatttccagtga

SEQ ID NO: 59788 - DNA, 25 bp, Mus musculus
aaggcaggctgctcatttccagtga

SEQ ID NO: 59789 - DNA, 25 bp, Mus musculus
aaggcagggactaggatgctgctct

SEQ ID NO: 59790 - DNA, 25 bp, Mus musculus
aaggcagggacttggatgctgctct

SEQ ID NO: 59791 - DNA, 25 bp, Mus musculus
aaggcagggataagcctcgactcct

SEQ ID NO: 59792 - DNA, 25 bp, Mus musculus
aaggcagggatatgcctcgactcct

SEQ ID NO: 59793 - DNA, 25 bp, Mus musculus
aaggcagggctacaacagaaatgtc

SEQ ID NO: 59794 - DNA, 25 bp, Mus musculus
aaggcagggctagaacagaaatgtc

SEQ ID NO: 59795 - DNA, 25 bp, Mus musculus
aaggcagggtaaacccagagcccag

SEQ ID NO: 59796 - DNA, 25 bp, Mus musculus
aaggcagggtaatcccagagcccag

SEQ ID NO: 59797 - DNA, 25 bp, Mus musculus
aaggcagggtgcatcaccaccgtgg

SEQ ID NO: 59798 - DNA, 25 bp, Mus musculus
aaggcagggtgcttcaccaccgtgg

SEQ ID NO: 59799 - DNA, 25 bp, Mus musculus
aaggcaggtaaactctttctcctct

SEQ ID NO: 59800 - DNA, 25 bp, Mus musculus
aaggcaggtaaagtctttctcctct

SEQ ID NO: 59801 - DNA, 25 bp, Mus musculus
aaggcaggtaagatggcttttgtga

SEQ ID NO: 59802 - DNA, 25 bp, Mus musculus
aaggcaggtaagttggcttttgtga

SEQ ID NO: 59803 - DNA, 25 bp, Mus musculus
aaggcaggtcaactacgctattccc

SEQ ID NO: 59804 - DNA, 25 bp, Mus musculus
aaggcaggtcaacttcatcgctcca

SEQ ID NO: 59805 - DNA, 25 bp, Mus musculus
aaggcaggtcaagtacgctattccc

SEQ ID NO: 59806 - DNA, 25 bp, Mus musculus
aaggcaggtcaagttcatcgctcca

SEQ ID NO: 59807 - DNA, 25 bp, Mus musculus
aaggcaggtcatccagaggaaccat

SEQ ID NO: 59808 - DNA, 25 bp, Mus musculus
aaggcaggtcatgcagaggaaccat

SEQ ID NO: 59809 - DNA, 25 bp, Mus musculus
aaggcaggtccaagtccagtgctca

SEQ ID NO: 59810 - DNA, 25 bp, Mus musculus
aaggcaggtccatgtccagtgctca

SEQ ID NO: 59811 - DNA, 25 bp, Mus musculus
aaggcaggtgggctgttcatcccat

SEQ ID NO: 59812 - DNA, 25 bp, Mus musculus
aaggcaggtggggtgttcatcccat

SEQ ID NO: 59813 - DNA, 25 bp, Mus musculus
aaggcaggtgttcctattattactt

SEQ ID NO: 59814 - DNA, 25 bp, Mus musculus
aaggcaggtgttgctattattactt

SEQ ID NO: 59815 - DNA, 25 bp, Mus musculus
aaggcaggttagcattcatgaactt

SEQ ID NO: 59816 - DNA, 25 bp, Mus musculus
aaggcaggttaggattcatgaactt

SEQ ID NO: 59817 - DNA, 25 bp, Mus musculus
aaggcaggttccacaccaataactt

SEQ ID NO: 59818 - DNA, 25 bp, Mus musculus
aaggcaggttcctcaccaataactt

SEQ ID NO: 59819 - DNA, 25 bp, Mus musculus
aaggcaggttggcaattctcatttt

SEQ ID NO: 59820 - DNA, 25 bp, Mus musculus
aaggcaggttgggaattctcatttt

SEQ ID NO: 59821 - DNA, 25 bp, Mus musculus
aaggcagtacttccttcttcaaaga

SEQ ID NO: 59822 - DNA, 25 bp, Mus musculus
aaggcagtacttgcttcttcaaaga

SEQ ID NO: 59823 - DNA, 25 bp, Mus musculus
aaggcagtagccctagcgtgctttt

SEQ ID NO: 59824 - DNA, 25 bp, Mus musculus
aaggcagtagccgtagcgtgctttt

SEQ ID NO: 59825 - DNA, 25 bp, Mus musculus
aaggcagtatttcccaggtcattgt

SEQ ID NO: 59826 - DNA, 25 bp, Mus musculus
aaggcagtatttgccaggtcattgt

SEQ ID NO: 59827 - DNA, 25 bp, Mus musculus
aaggcagtcaacatgcatgtgatac

SEQ ID NO: 59828 - DNA, 25 bp, Mus musculus
aaggcagtcaacttgcatgtgatac

SEQ ID NO: 59829 - DNA, 25 bp, Mus musculus
aaggcagtcaccacactaagtgtaa

SEQ ID NO: 59830 - DNA, 25 bp, Mus musculus
aaggcagtcacctcactaagtgtaa

SEQ ID NO: 59831 - DNA, 25 bp, Mus musculus
aaggcagtcattcttgctgtctgta

SEQ ID NO: 59832 - DNA, 25 bp, Mus musculus
aaggcagtcattgttgctgtctgta

SEQ ID NO: 59833 - DNA, 25 bp, Mus musculus
aaggcagtcgatactgcttgagcag

SEQ ID NO: 59834 - DNA, 25 bp, Mus musculus
aaggcagtcgattctgcttgagcag

SEQ ID NO: 59835 - DNA, 25 bp, Mus musculus
aaggcagtctagcttcctagttaga

SEQ ID NO: 59836 - DNA, 25 bp, Mus musculus
aaggcagtctaggttcctagttaga

SEQ ID NO: 59837 - DNA, 25 bp, Mus musculus
aaggcagtctatagattcagtgcaa

SEQ ID NO: 59838 - DNA, 25 bp, Mus musculus
aaggcagtctattgattcagtgcaa

SEQ ID NO: 59839 - DNA, 25 bp, Mus musculus
aaggcagtgaatctggacgtattta

SEQ ID NO: 59840 - DNA, 25 bp, Mus musculus
aaggcagtgaatgtggacgtattta

SEQ ID NO: 59841 - DNA, 25 bp, Mus musculus
aaggcagtgactctcctgcactacc

SEQ ID NO: 59842 - DNA, 25 bp, Mus musculus
aaggcagtgactgtcctgcactacc

SEQ ID NO: 59843 - DNA, 25 bp, Mus musculus
aaggcagtgcagcaggttcaccgtc

SEQ ID NO: 59844 - DNA, 25 bp, Mus musculus
aaggcagtgcaggaggttcaccgtc

SEQ ID NO: 59845 - DNA, 25 bp, Mus musculus
aaggcagtgctcagtcttctacaga

SEQ ID NO: 59846 - DNA, 25 bp, Mus musculus
aaggcagtgctctgtcttctacaga

SEQ ID NO: 59847 - DNA, 25 bp, Mus musculus
aaggcagtgctgaagttcacgtctg

SEQ ID NO: 59848 - DNA, 25 bp, Mus musculus
aaggcagtgctgcagcgcgaacaca

SEQ ID NO: 59849 - DNA, 25 bp, Mus musculus
aaggcagtgctgcagtgctagtctc

SEQ ID NO: 59850 - DNA, 25 bp, Mus musculus
aaggcagtgctggagcgcgaacaca

SEQ ID NO: 59851 - DNA, 25 bp, Mus musculus
aaggcagtgctggagtgctagtctc

SEQ ID NO: 59852 - DNA, 25 bp, Mus musculus
aaggcagtgctgtagttcacgtctg

SEQ ID NO: 59853 - DNA, 25 bp, Mus musculus
aaggcagtggccatatccagctaaa

SEQ ID NO: 59854 - DNA, 25 bp, Mus musculus
aaggcagtggccttatccagctaaa

SEQ ID NO: 59855 - DNA, 25 bp, Mus musculus
aaggcagtggcgaaaagccctaaag

SEQ ID NO: 59856 - DNA, 25 bp, Mus musculus
aaggcagtggcgtaaagccctaaag

SEQ ID NO: 59857 - DNA, 25 bp, Mus musculus
aaggcagtggctcttcgtgttgcct

SEQ ID NO: 59858 - DNA, 25 bp, Mus musculus
aaggcagtggctgttcgtgttgcct

SEQ ID NO: 59859 - DNA, 25 bp, Mus musculus
aaggcagtgggaacttcctgcgact

SEQ ID NO: 59860 - DNA, 25 bp, Mus musculus
aaggcagtgggatcttcctgcgact

SEQ ID NO: 59861 - DNA, 25 bp, Mus musculus
aaggcagtgggtacagctgtacaga

SEQ ID NO: 59862 - DNA, 25 bp, Mus musculus
aaggcagtgggttcagctgtacaga

SEQ ID NO: 59863 - DNA, 25 bp, Mus musculus
aaggcagtggtgacatcaggcctcg

SEQ ID NO: 59864 - DNA, 25 bp, Mus musculus
aaggcagtggtgaggcccaacgact

SEQ ID NO: 59865 - DNA, 25 bp, Mus musculus
aaggcagtggtgattcacaagtcca

SEQ ID NO: 59866 - DNA, 25 bp, Mus musculus
aaggcagtggtgctcacaggatctc

SEQ ID NO: 59867 - DNA, 25 bp, Mus musculus
aaggcagtggtggtcacaggatctc

SEQ ID NO: 59868 - DNA, 25 bp, Mus musculus
aaggcagtggtgtcatcaggcctcg

SEQ ID NO: 59869 - DNA, 25 bp, Mus musculus
aaggcagtggtgtggcccaacgact

SEQ ID NO: 59870 - DNA, 25 bp, Mus musculus
aaggcagtggtgtttcacaagtcca

SEQ ID NO: 59871 - DNA, 25 bp, Mus musculus
aaggcagtgtcgcacctgaccagac

SEQ ID NO: 59872 - DNA, 25 bp, Mus musculus
aaggcagtgtcggacctgaccagac

SEQ ID NO: 59873 - DNA, 25 bp, Mus musculus
aaggcagtgtgccatattccctcac

SEQ ID NO: 59874 - DNA, 25 bp, Mus musculus
aaggcagtgtgcgatattccctcac

SEQ ID NO: 59875 - DNA, 25 bp, Mus musculus
aaggcagtgttcagtatacttaaac

SEQ ID NO: 59876 - DNA, 25 bp, Mus musculus
aaggcagtgttctgtatacttaaac

SEQ ID NO: 59877 - DNA, 25 bp, Mus musculus
aaggcagtgttgacttctaccagct

SEQ ID NO: 59878 - DNA, 25 bp, Mus musculus
aaggcagtgttgctttctctgcatc

SEQ ID NO: 59879 - DNA, 25 bp, Mus musculus
aaggcagtgttggtttctctgcatc

SEQ ID NO: 59880 - DNA, 25 bp, Mus musculus
aaggcagtgttgtcttctaccagct

SEQ ID NO: 59881 - DNA, 25 bp, Mus musculus
aaggcagttaagaatgtctcaacac

SEQ ID NO: 59882 - DNA, 25 bp, Mus musculus
aaggcagttaagtatgtctcaacac

SEQ ID NO: 59883 - DNA, 25 bp, Mus musculus
aaggcagttcaactctttcctggga

SEQ ID NO: 59884 - DNA, 25 bp, Mus musculus
aaggcagttcaagtctttcctggga

SEQ ID NO: 59885 - DNA, 25 bp, Mus musculus
aaggcagttctcaaagccagtgcca

SEQ ID NO: 59886 - DNA, 25 bp, Mus musculus
aaggcagttctctaagccagtgcca

SEQ ID NO: 59887 - DNA, 25 bp, Mus musculus
aaggcagttgccactgttatgcagt

SEQ ID NO: 59888 - DNA, 25 bp, Mus musculus
aaggcagttgcctctgttatgcagt

SEQ ID NO: 59889 - DNA, 25 bp, Mus musculus
aaggcagttgtcatacttgctaaag

SEQ ID NO: 59890 - DNA, 25 bp, Mus musculus
aaggcagttgtcttacttgctaaag

SEQ ID NO: 59891 - DNA, 25 bp, Mus musculus
aaggcatacaccaacacatctggct

SEQ ID NO: 59892 - DNA, 25 bp, Mus musculus
aaggcatacacctacacatctggct

SEQ ID NO: 59893 - DNA, 25 bp, Mus musculus
aaggcataccctaggcaactggaca

SEQ ID NO: 59894 - DNA, 25 bp, Mus musculus
aaggcatacccttggcaactggaca

SEQ ID NO: 59895 - DNA, 25 bp, Mus musculus
aaggcatactgcatctccagtttaa

SEQ ID NO: 59896 - DNA, 25 bp, Mus musculus
aaggcatactgcttctccagtttaa

SEQ ID NO: 59897 - DNA, 25 bp, Mus musculus
aaggcatacttgcaattcagtaaaa

SEQ ID NO: 59898 - DNA, 25 bp, Mus musculus
aaggcatacttgcactcaacagaga

SEQ ID NO: 59899 - DNA, 25 bp, Mus musculus
aaggcatacttggaattcagtaaaa

SEQ ID NO: 59900 - DNA, 25 bp, Mus musculus
aaggcatacttggactcaacagaga

SEQ ID NO: 59901 - DNA, 25 bp, Mus musculus
aaggcatagaaacccctgttccgtc

SEQ ID NO: 59902 - DNA, 25 bp, Mus musculus
aaggcatagaaagccctgttccgtc

SEQ ID NO: 59903 - DNA, 25 bp, Mus musculus
aaggcatagagccaaccctgccgtg

SEQ ID NO: 59904 - DNA, 25 bp, Mus musculus
aaggcatagagcgaaccctgccgtg

SEQ ID NO: 59905 - DNA, 25 bp, Mus musculus
aaggcatatagtccctgtcacacat

SEQ ID NO: 59906 - DNA, 25 bp, Mus musculus
aaggcatatagtgcctgtcacacat

SEQ ID NO: 59907 - DNA, 25 bp, Mus musculus
aaggcatatctgcactgactggtac

SEQ ID NO: 59908 - DNA, 25 bp, Mus musculus
aaggcatatctggactgactggtac

SEQ ID NO: 59909 - DNA, 25 bp, Mus musculus
aaggcatatggcagcttcctttcta

SEQ ID NO: 59910 - DNA, 25 bp, Mus musculus
aaggcatatggctgcttcctttcta

SEQ ID NO: 59911 - DNA, 25 bp, Mus musculus
aaggcatatgtgaggtgttccccta

SEQ ID NO: 59912 - DNA, 25 bp, Mus musculus
aaggcatatgtgtggtgttccccta

SEQ ID NO: 59913 - DNA, 25 bp, Mus musculus
aaggcatattgtcaccacatttaca

SEQ ID NO: 59914 - DNA, 25 bp, Mus musculus
aaggcatattgtgaccacatttaca

SEQ ID NO: 59915 - DNA, 25 bp, Mus musculus
aaggcatcacacaacaattcatttt

SEQ ID NO: 59916 - DNA, 25 bp, Mus musculus
aaggcatcacactacaattcatttt

SEQ ID NO: 59917 - DNA, 25 bp, Mus musculus
aaggcatcacccaggtgtggacgtc

SEQ ID NO: 59918 - DNA, 25 bp, Mus musculus
aaggcatcaccctggtgtggacgtc

SEQ ID NO: 59919 - DNA, 25 bp, Mus musculus
aaggcatcactgaccaggagtgtct

SEQ ID NO: 59920 - DNA, 25 bp, Mus musculus
aaggcatcactgcagcagcagacct

SEQ ID NO: 59921 - DNA, 25 bp, Mus musculus
aaggcatcactggagcagcagacct

SEQ ID NO: 59922 - DNA, 25 bp, Mus musculus
aaggcatcactgtccaggagtgtct

SEQ ID NO: 59923 - DNA, 25 bp, Mus musculus
aaggcatcagagcaagcttcgacat

SEQ ID NO: 59924 - DNA, 25 bp, Mus musculus
aaggcatcagaggaagcttcgacat

SEQ ID NO: 59925 - DNA, 25 bp, Mus musculus
aaggcatcagcacggcacttgtgaa

SEQ ID NO: 59926 - DNA, 25 bp, Mus musculus
aaggcatcagcagggcacttgtgaa

SEQ ID NO: 59927 - DNA, 25 bp, Mus musculus
aaggcatcattgattccatttgtgt

SEQ ID NO: 59928 - DNA, 25 bp, Mus musculus
aaggcatcattgtttccatttgtgt

SEQ ID NO: 59929 - DNA, 25 bp, Mus musculus
aaggcatcccaacgatccttgttag

SEQ ID NO: 59930 - DNA, 25 bp, Mus musculus
aaggcatcccaaggatccttgttag

SEQ ID NO: 59931 - DNA, 25 bp, Mus musculus
aaggcatccgtcagctgacaagtca

SEQ ID NO: 59932 - DNA, 25 bp, Mus musculus
aaggcatccgtctgctgacaagtca

SEQ ID NO: 59933 - DNA, 25 bp, Mus musculus
aaggcatccgttcaacaaacgcatt

SEQ ID NO: 59934 - DNA, 25 bp, Mus musculus
aaggcatccgttgaacaaacgcatt

SEQ ID NO: 59935 - DNA, 25 bp, Mus musculus
aaggcatcctcactgtgtacatttt

SEQ ID NO: 59936 - DNA, 25 bp, Mus musculus
aaggcatcctcagtgtgtacatttt

SEQ ID NO: 59937 - DNA, 25 bp, Mus musculus
aaggcatcctgcaggaaactgagct

SEQ ID NO: 59938 - DNA, 25 bp, Mus musculus
aaggcatcctgccatattgtttgct

SEQ ID NO: 59939 - DNA, 25 bp, Mus musculus
aaggcatcctgcgatattgtttgct

SEQ ID NO: 59940 - DNA, 25 bp, Mus musculus
aaggcatcctgctggaaactgagct

SEQ ID NO: 59941 - DNA, 25 bp, Mus musculus
aaggcatccttgaccaagcagatcg

SEQ ID NO: 59942 - DNA, 25 bp, Mus musculus
aaggcatccttgctggtgagctcaa

SEQ ID NO: 59943 - DNA, 25 bp, Mus musculus
aaggcatccttggtggtgagctcaa

SEQ ID NO: 59944 - DNA, 25 bp, Mus musculus
aaggcatccttgtccaagcagatcg

SEQ ID NO: 59945 - DNA, 25 bp, Mus musculus
aaggcatcctttcaggtctcctcca

SEQ ID NO: 59946 - DNA, 25 bp, Mus musculus
aaggcatcctttgaggtctcctcca

SEQ ID NO: 59947 - DNA, 25 bp, Mus musculus
aaggcatcgagaaagctcgccatga

SEQ ID NO: 59948 - DNA, 25 bp, Mus musculus
aaggcatcgagatagctcgccatga

SEQ ID NO: 59949 - DNA, 25 bp, Mus musculus
aaggcatcgcctagatcatccagaa

SEQ ID NO: 59950 - DNA, 25 bp, Mus musculus
aaggcatcgccttgatcatccagaa

SEQ ID NO: 59951 - DNA, 25 bp, Mus musculus
aaggcatctccaacatcctgcagag

SEQ ID NO: 59952 - DNA, 25 bp, Mus musculus
aaggcatctccatcatcctgcagag

SEQ ID NO: 59953 - DNA, 25 bp, Mus musculus
aaggcatctgcaaccatcgacattg

SEQ ID NO: 59954 - DNA, 25 bp, Mus musculus
aaggcatctgcatccatcgacattg

SEQ ID NO: 59955 - DNA, 25 bp, Mus musculus
aaggcatcttatctgttttacacaa

SEQ ID NO: 59956 - DNA, 25 bp, Mus musculus
aaggcatcttatgtgttttacacaa

SEQ ID NO: 59957 - DNA, 25 bp, Mus musculus
aaggcatctttcaagcacctgagaa

SEQ ID NO: 59958 - DNA, 25 bp, Mus musculus
aaggcatctttctagcacctgagaa

SEQ ID NO: 59959 - DNA, 25 bp, Mus musculus
aaggcatgatggctctatgtgacat

SEQ ID NO: 59960 - DNA, 25 bp, Mus musculus
aaggcatgatgggtctatgtgacat

SEQ ID NO: 59961 - DNA, 25 bp, Mus musculus
aaggcatgcatgaccttccttttct

SEQ ID NO: 59962 - DNA, 25 bp, Mus musculus
aaggcatgcatgtccttccttttct

SEQ ID NO: 59963 - DNA, 25 bp, Mus musculus
aaggcatgcctcaatatattggcta

SEQ ID NO: 59964 - DNA, 25 bp, Mus musculus
aaggcatgcctctatatattggcta

SEQ ID NO: 59965 - DNA, 25 bp, Mus musculus
aaggcatgctcacgtcgtgtttcgg

SEQ ID NO: 59966 - DNA, 25 bp, Mus musculus
aaggcatgctcaggtcgtgtttcgg

SEQ ID NO: 59967 - DNA, 25 bp, Mus musculus
aaggcatgctcccagcatttgtcta

SEQ ID NO: 59968 - DNA, 25 bp, Mus musculus
aaggcatgctccgagcatttgtcta

SEQ ID NO: 59969 - DNA, 25 bp, Mus musculus
aaggcatgctgcagcttataccaca

SEQ ID NO: 59970 - DNA, 25 bp, Mus musculus
aaggcatgctgcagttttcatccac

SEQ ID NO: 59971 - DNA, 25 bp, Mus musculus
aaggcatgctgctgcttataccaca

SEQ ID NO: 59972 - DNA, 25 bp, Mus musculus
aaggcatgctgctgttttcatccac

SEQ ID NO: 59973 - DNA, 25 bp, Mus musculus
aaggcatggagtaactctgggctac

SEQ ID NO: 59974 - DNA, 25 bp, Mus musculus
aaggcatggagtaccagagtgcttt

SEQ ID NO: 59975 - DNA, 25 bp, Mus musculus
aaggcatggagttactctgggctac

SEQ ID NO: 59976 - DNA, 25 bp, Mus musculus
aaggcatggagttccagagtgcttt

SEQ ID NO: 59977 - DNA, 25 bp, Mus musculus
aaggcatggcgcagactagaggtac

SEQ ID NO: 59978 - DNA, 25 bp, Mus musculus
aaggcatggcgctgactagaggtac

SEQ ID NO: 59979 - DNA, 25 bp, Mus musculus
aaggcatggctaacacttgtggccc

SEQ ID NO: 59980 - DNA, 25 bp, Mus musculus
aaggcatggctatcacttgtggccc

SEQ ID NO: 59981 - DNA, 25 bp, Mus musculus
aaggcatggcttctgcagcacaatt

SEQ ID NO: 59982 - DNA, 25 bp, Mus musculus
aaggcatggcttgtgcagcacaatt

SEQ ID NO: 59983 - DNA, 25 bp, Mus musculus
aaggcatggttgctctcctcaggga

SEQ ID NO: 59984 - DNA, 25 bp, Mus musculus
aaggcatggttggtctcctcaggga

SEQ ID NO: 59985 - DNA, 25 bp, Mus musculus
aaggcatgtatgactccaggtcgga

SEQ ID NO: 59986 - DNA, 25 bp, Mus musculus
aaggcatgtatgtctccaggtcgga

SEQ ID NO: 59987 - DNA, 25 bp, Mus musculus
aaggcatgttccattactgctggct

SEQ ID NO: 59988 - DNA, 25 bp, Mus musculus
aaggcatgttcctttactgctggct

SEQ ID NO: 59989 - DNA, 25 bp, Mus musculus
aaggcatgttgccacgttgctgctt

SEQ ID NO: 59990 - DNA, 25 bp, Mus musculus
aaggcatgttgcgacgttgctgctt

SEQ ID NO: 59991 - DNA, 25 bp, Mus musculus
aaggcattaatcctttccataccgc

SEQ ID NO: 59992 - DNA, 25 bp, Mus musculus
aaggcattaatcgtttccataccgc

SEQ ID NO: 59993 - DNA, 25 bp, Mus musculus
aaggcattactaaggcaggatgagc

SEQ ID NO: 59994 - DNA, 25 bp, Mus musculus
aaggcattactaattttatctgaat

SEQ ID NO: 59995 - DNA, 25 bp, Mus musculus
aaggcattactatggcaggatgagc

SEQ ID NO: 59996 - DNA, 25 bp, Mus musculus
aaggcattactatttttatctgaat

SEQ ID NO: 59997 - DNA, 25 bp, Mus musculus
aaggcattagtcattttgtagatct

SEQ ID NO: 59998 - DNA, 25 bp, Mus musculus
aaggcattagtctttttgtagatct

SEQ ID NO: 59999 - DNA, 25 bp, Mus musculus
aaggcattcatcaagtcctgcttag

SEQ ID NO: 60000 - DNA, 25 bp, Mus musculus
aaggcattcatctagtcctgcttag

SEQ ID NO: 60001 - DNA, 25 bp, Mus musculus
aaggcattcattaacctctcaagaa

SEQ ID NO: 60002 - DNA, 25 bp, Mus musculus
aaggcattcatttacctctcaagaa

SEQ ID NO: 60003 - DNA, 25 bp, Mus musculus
aaggcattccacatggctgagtgct

SEQ ID NO: 60004 - DNA, 25 bp, Mus musculus
aaggcattccacttggctgagtgct

SEQ ID NO: 60005 - DNA, 25 bp, Mus musculus
aaggcattccagctggaaaccttaa

SEQ ID NO: 60006 - DNA, 25 bp, Mus musculus
aaggcattccaggtggaaaccttaa

SEQ ID NO: 60007 - DNA, 25 bp, Mus musculus
aaggcattcccacgcaaggcagacg

SEQ ID NO: 60008 - DNA, 25 bp, Mus musculus
aaggcattcccaggcaaggcagacg

SEQ ID NO: 60009 - DNA, 25 bp, Mus musculus
aaggcattcgccactgtgccttgcg

SEQ ID NO: 60010 - DNA, 25 bp, Mus musculus
aaggcattcgcctctgtgccttgcg

SEQ ID NO: 60011 - DNA, 25 bp, Mus musculus
aaggcattctcaaatgataacgcaa

SEQ ID NO: 60012 - DNA, 25 bp, Mus musculus
aaggcattctcatatgataacgcaa

SEQ ID NO: 60013 - DNA, 25 bp, Mus musculus
aaggcattctgaaccttactactca

SEQ ID NO: 60014 - DNA, 25 bp, Mus musculus
aaggcattctgatccttactactca

SEQ ID NO: 60015 - DNA, 25 bp, Mus musculus
aaggcattcttcaaccaactggaaa

SEQ ID NO: 60016 - DNA, 25 bp, Mus musculus
aaggcattcttctaccaactggaaa

SEQ ID NO: 60017 - DNA, 25 bp, Mus musculus
aaggcattcttgactcacagtttga

SEQ ID NO: 60018 - DNA, 25 bp, Mus musculus
aaggcattcttgtctcacagtttga

SEQ ID NO: 60019 - DNA, 25 bp, Mus musculus
aaggcattgactccttcatccgagg

SEQ ID NO: 60020 - DNA, 25 bp, Mus musculus
aaggcattgactgcttcatccgagg

SEQ ID NO: 60021 - DNA, 25 bp, Mus musculus
aaggcattgatgagcgggtcctcca

SEQ ID NO: 60022 - DNA, 25 bp, Mus musculus
aaggcattgatgtgcgggtcctcca

SEQ ID NO: 60023 - DNA, 25 bp, Mus musculus
aaggcattgcatcagctttgggctg

SEQ ID NO: 60024 - DNA, 25 bp, Mus musculus
aaggcattgcatcggagcctgccat

SEQ ID NO: 60025 - DNA, 25 bp, Mus musculus
aaggcattgcatgagctttgggctg

SEQ ID NO: 60026 - DNA, 25 bp, Mus musculus
aaggcattgcatgggagcctgccat

SEQ ID NO: 60027 - DNA, 25 bp, Mus musculus
aaggcattgcccaccaagtctgatg

SEQ ID NO: 60028 - DNA, 25 bp, Mus musculus
aaggcattgccctccaagtctgatg

SEQ ID NO: 60029 - DNA, 25 bp, Mus musculus
aaggcattgcctcatggacctgtca

SEQ ID NO: 60030 - DNA, 25 bp, Mus musculus
aaggcattgcctgatggacctgtca

SEQ ID NO: 60031 - DNA, 25 bp, Mus musculus
aaggcattgctgcaggagtcctaca

SEQ ID NO: 60032 - DNA, 25 bp, Mus musculus
aaggcattgctggaggagtcctaca

SEQ ID NO: 60033 - DNA, 25 bp, Mus musculus
aaggcattggaactcctcaaaggaa

SEQ ID NO: 60034 - DNA, 25 bp, Mus musculus
aaggcattggaagtcctcaaaggaa

SEQ ID NO: 60035 - DNA, 25 bp, Mus musculus
aaggcattggccacaagtgtaagca

SEQ ID NO: 60036 - DNA, 25 bp, Mus musculus
aaggcattggcctcaagtgtaagca

SEQ ID NO: 60037 - DNA, 25 bp, Mus musculus
aaggcattgtccattgcctttgagt

SEQ ID NO: 60038 - DNA, 25 bp, Mus musculus
aaggcattgtcctttgcctttgagt

SEQ ID NO: 60039 - DNA, 25 bp, Mus musculus
aaggcatttcaaacaggtatggtag

SEQ ID NO: 60040 - DNA, 25 bp, Mus musculus
aaggcatttcaatcaggtatggtag

SEQ ID NO: 60041 - DNA, 25 bp, Mus musculus
aaggcatttcagattgccacgcacc

SEQ ID NO: 60042 - DNA, 25 bp, Mus musculus
aaggcatttcagtttgccacgcacc

SEQ ID NO: 60043 - DNA, 25 bp, Mus musculus
aaggcatttccaccagatgaagttc

SEQ ID NO: 60044 - DNA, 25 bp, Mus musculus
aaggcatttccaccccagaacaagg

SEQ ID NO: 60045 - DNA, 25 bp, Mus musculus
aaggcatttccagcagatgaagttc

SEQ ID NO: 60046 - DNA, 25 bp, Mus musculus
aaggcatttccagcccagaacaagg

SEQ ID NO: 60047 - DNA, 25 bp, Mus musculus
aaggcatttctaatttgcttttctg

SEQ ID NO: 60048 - DNA, 25 bp, Mus musculus
aaggcatttctattttgcttttctg

SEQ ID NO: 60049 - DNA, 25 bp, Mus musculus
aaggcatttgctcgcaccatcgtgg

SEQ ID NO: 60050 - DNA, 25 bp, Mus musculus
aaggcatttgctggcaccatcgtgg

SEQ ID NO: 60051 - DNA, 25 bp, Mus musculus
aaggcatttgtcacatgtcattcta

SEQ ID NO: 60052 - DNA, 25 bp, Mus musculus
aaggcatttgtctcatgtcattcta

SEQ ID NO: 60053 - DNA, 25 bp, Mus musculus
aaggcattttgcacaagtactttgt

SEQ ID NO: 60054 - DNA, 25 bp, Mus musculus
aaggcattttgcacgtggcccctat

SEQ ID NO: 60055 - DNA, 25 bp, Mus musculus
aaggcattttgctcaagtactttgt

SEQ ID NO: 60056 - DNA, 25 bp, Mus musculus
aaggcattttgctcgtggcccctat

SEQ ID NO: 60057 - DNA, 25 bp, Mus musculus
aaggcattttggagaaccacccctg

SEQ ID NO: 60058 - DNA, 25 bp, Mus musculus
aaggcattttggtgaaccacccctg

SEQ ID NO: 60059 - DNA, 25 bp, Mus musculus
aaggccaaagaccaacagctgtatt

SEQ ID NO: 60060 - DNA, 25 bp, Mus musculus
aaggccaaagacgaacagctgtatt

SEQ ID NO: 60061 - DNA, 25 bp, Mus musculus
aaggccaaagagcagagacgcctgc

SEQ ID NO: 60062 - DNA, 25 bp, Mus musculus
aaggccaaagaggagagacgcctgc

SEQ ID NO: 60063 - DNA, 25 bp, Mus musculus
aaggccaaagttcagatatcccaga

SEQ ID NO: 60064 - DNA, 25 bp, Mus musculus
aaggccaaagttgagatatcccaga

SEQ ID NO: 60065 - DNA, 25 bp, Mus musculus
aaggccaacactagaggagagagca

SEQ ID NO: 60066 - DNA, 25 bp, Mus musculus
aaggccaacacttgaggagagagca

SEQ ID NO: 60067 - DNA, 25 bp, Mus musculus
aaggccaacataacaaatagggaca

SEQ ID NO: 60068 - DNA, 25 bp, Mus musculus
aaggccaacatatcaaatagggaca

SEQ ID NO: 60069 - DNA, 25 bp, Mus musculus
aaggccaaccatctctaagttgagg

SEQ ID NO: 60070 - DNA, 25 bp, Mus musculus
aaggccaaccatgtctaagttgagg

SEQ ID NO: 60071 - DNA, 25 bp, Mus musculus
aaggccaacccactcaacagagttc

SEQ ID NO: 60072 - DNA, 25 bp, Mus musculus
aaggccaacccagtcaacagagttc

SEQ ID NO: 60073 - DNA, 25 bp, Mus musculus
aaggccaaccccacagaatgactgt

SEQ ID NO: 60074 - DNA, 25 bp, Mus musculus
aaggccaacccctcagaatgactgt

SEQ ID NO: 60075 - DNA, 25 bp, Mus musculus
aaggccaactatcgagccccaagtt

SEQ ID NO: 60076 - DNA, 25 bp, Mus musculus
aaggccaactatggagccccaagtt

SEQ ID NO: 60077 - DNA, 25 bp, Mus musculus
aaggccaactggctctacgcaatta

SEQ ID NO: 60078 - DNA, 25 bp, Mus musculus
aaggccaactgggtctacgcaatta

SEQ ID NO: 60079 - DNA, 25 bp, Mus musculus
aaggccaagagcaaacgcaaacgca

SEQ ID NO: 60080 - DNA, 25 bp, Mus musculus
aaggccaagagctaacgcaaacgca

SEQ ID NO: 60081 - DNA, 25 bp, Mus musculus
aaggccaagatgcactatcggaaga

SEQ ID NO: 60082 - DNA, 25 bp, Mus musculus
aaggccaagatggactatcggaaga

SEQ ID NO: 60083 - DNA, 25 bp, Mus musculus
aaggccaagcaaccactgcagtgag

SEQ ID NO: 60084 - DNA, 25 bp, Mus musculus
aaggccaagcaacttcgagcgctta

SEQ ID NO: 60085 - DNA, 25 bp, Mus musculus
aaggccaagcaagcactgcagtgag

SEQ ID NO: 60086 - DNA, 25 bp, Mus musculus
aaggccaagcaagttcgagcgctta

SEQ ID NO: 60087 - DNA, 25 bp, Mus musculus
aaggccaagcatcccagtttctgta

SEQ ID NO: 60088 - DNA, 25 bp, Mus musculus
aaggccaagcatgccagtttctgta

SEQ ID NO: 60089 - DNA, 25 bp, Mus musculus
aaggccaagcccaagtttagcatct

SEQ ID NO: 60090 - DNA, 25 bp, Mus musculus
aaggccaagccctagtttagcatct

SEQ ID NO: 60091 - DNA, 25 bp, Mus musculus
aaggccaagctgctgaccctgctga

SEQ ID NO: 60092 - DNA, 25 bp, Mus musculus
aaggccaagctggtgaccctgctga

SEQ ID NO: 60093 - DNA, 25 bp, Mus musculus
aaggccaaggacatggagactttgt

SEQ ID NO: 60094 - DNA, 25 bp, Mus musculus
aaggccaaggaccttcacgttctgc

SEQ ID NO: 60095 - DNA, 25 bp, Mus musculus
aaggccaaggacgttcacgttctgc

SEQ ID NO: 60096 - DNA, 25 bp, Mus musculus
aaggccaaggacttggagactttgt

SEQ ID NO: 60097 - DNA, 25 bp, Mus musculus
aaggccaaggccattgctcagcagc

SEQ ID NO: 60098 - DNA, 25 bp, Mus musculus
aaggccaaggcctttgctcagcagc

SEQ ID NO: 60099 - DNA, 25 bp, Mus musculus
aaggccaaggtgactgctaaagcag

SEQ ID NO: 60100 - DNA, 25 bp, Mus musculus
aaggccaaggtgtctgctaaagcag

SEQ ID NO: 60101 - DNA, 25 bp, Mus musculus
aaggccaagtgcacacagttctgca

SEQ ID NO: 60102 - DNA, 25 bp, Mus musculus
aaggccaagtgctcacagttctgca

SEQ ID NO: 60103 - DNA, 25 bp, Mus musculus
aaggccaagtggacgcgtaccgtgc

SEQ ID NO: 60104 - DNA, 25 bp, Mus musculus
aaggccaagtggtcgcgtaccgtgc

SEQ ID NO: 60105 - DNA, 25 bp, Mus musculus
aaggccaatctcacatttgaccgta

SEQ ID NO: 60106 - DNA, 25 bp, Mus musculus
aaggccaatctctcatttgaccgta

SEQ ID NO: 60107 - DNA, 25 bp, Mus musculus
aaggccaatctgaccattatatttt

SEQ ID NO: 60108 - DNA, 25 bp, Mus musculus
aaggccaatctgtccattatatttt

SEQ ID NO: 60109 - DNA, 25 bp, Mus musculus
aaggccaatgcccagatgaaagaga

SEQ ID NO: 60110 - DNA, 25 bp, Mus musculus
aaggccaatgccgagatgaaagaga

SEQ ID NO: 60111 - DNA, 25 bp, Mus musculus
aaggccaatgtgagtggtcagaatt

SEQ ID NO: 60112 - DNA, 25 bp, Mus musculus
aaggccaatgtgtgtggtcagaatt

SEQ ID NO: 60113 - DNA, 25 bp, Mus musculus
aaggccacaaagcacccattgtgtg

SEQ ID NO: 60114 - DNA, 25 bp, Mus musculus
aaggccacaaaggacccattgtgtg

SEQ ID NO: 60115 - DNA, 25 bp, Mus musculus
aaggccacaatgaagcccttctagg

SEQ ID NO: 60116 - DNA, 25 bp, Mus musculus
aaggccacaatgtagcccttctagg

SEQ ID NO: 60117 - DNA, 25 bp, Mus musculus
aaggccacaattactgctcagtgaa

SEQ ID NO: 60118 - DNA, 25 bp, Mus musculus
aaggccacaatttctgctcagtgaa

SEQ ID NO: 60119 - DNA, 25 bp, Mus musculus
aaggccacacacagtctgtttgtaa

SEQ ID NO: 60120 - DNA, 25 bp, Mus musculus
aaggccacacactgtctgtttgtaa

SEQ ID NO: 60121 - DNA, 25 bp, Mus musculus
aaggccacacggagactcaggcggc

SEQ ID NO: 60122 - DNA, 25 bp, Mus musculus
aaggccacacggtgactcaggcggc

SEQ ID NO: 60123 - DNA, 25 bp, Mus musculus
aaggccacactgacggcagacactt

SEQ ID NO: 60124 - DNA, 25 bp, Mus musculus
aaggccacactgtcggcagacactt

SEQ ID NO: 60125 - DNA, 25 bp, Mus musculus
aaggccacagatcactaccactatg

SEQ ID NO: 60126 - DNA, 25 bp, Mus musculus
aaggccacagatgactaccactatg

SEQ ID NO: 60127 - DNA, 25 bp, Mus musculus
aaggccacaggacaagcaacctcga

SEQ ID NO: 60128 - DNA, 25 bp, Mus musculus
aaggccacaggagaagcaacctcga

SEQ ID NO: 60129 - DNA, 25 bp, Mus musculus
aaggccacagggaactgcctatcct

SEQ ID NO: 60130 - DNA, 25 bp, Mus musculus
aaggccacagggtactgcctatcct

SEQ ID NO: 60131 - DNA, 25 bp, Mus musculus
aaggccacatcaactcctagtttta

SEQ ID NO: 60132 - DNA, 25 bp, Mus musculus
aaggccacatcatctcctagtttta

SEQ ID NO: 60133 - DNA, 25 bp, Mus musculus
aaggccacatctcaactaagatcat

SEQ ID NO: 60134 - DNA, 25 bp, Mus musculus
aaggccacatctgaactaagatcat

SEQ ID NO: 60135 - DNA, 25 bp, Mus musculus
aaggccacatggactcactgctcag

SEQ ID NO: 60136 - DNA, 25 bp, Mus musculus
aaggccacatggtctcactgctcag

SEQ ID NO: 60137 - DNA, 25 bp, Mus musculus
aaggccacatttattagcggtacaa

SEQ ID NO: 60138 - DNA, 25 bp, Mus musculus
aaggccacattttttagcggtacaa

SEQ ID NO: 60139 - DNA, 25 bp, Mus musculus
aaggccaccagcagttctttgccat

SEQ ID NO: 60140 - DNA, 25 bp, Mus musculus
aaggccaccagctgttctttgccat

SEQ ID NO: 60141 - DNA, 25 bp, Mus musculus
aaggccacccatacagggcatattt

SEQ ID NO: 60142 - DNA, 25 bp, Mus musculus
aaggccacccattcagggcatattt

SEQ ID NO: 60143 - DNA, 25 bp, Mus musculus
aaggccaccctacacgtgaatgaag

SEQ ID NO: 60144 - DNA, 25 bp, Mus musculus
aaggccaccctagacgtgaatgaag

SEQ ID NO: 60145 - DNA, 25 bp, Mus musculus
aaggccacctatcgtgccggcattg

SEQ ID NO: 60146 - DNA, 25 bp, Mus musculus
aaggccacctatggtgccggcattg

SEQ ID NO: 60147 - DNA, 25 bp, Mus musculus
aaggccacctcactgtggaccaaag

SEQ ID NO: 60148 - DNA, 25 bp, Mus musculus
aaggccacctcagtgtggaccaaag

SEQ ID NO: 60149 - DNA, 25 bp, Mus musculus
aaggccacctccctgtggtggagtt

SEQ ID NO: 60150 - DNA, 25 bp, Mus musculus
aaggccacctccgtgtggtggagtt

SEQ ID NO: 60151 - DNA, 25 bp, Mus musculus
aaggccacggacctgattgactcta

SEQ ID NO: 60152 - DNA, 25 bp, Mus musculus
aaggccacggacgtgattgactcta

SEQ ID NO: 60153 - DNA, 25 bp, Mus musculus
aaggccacggagatcagaggttaat

SEQ ID NO: 60154 - DNA, 25 bp, Mus musculus
aaggccacggagttcagaggttaat

SEQ ID NO: 60155 - DNA, 25 bp, Mus musculus
aaggccacgggtatcagtgcattgc

SEQ ID NO: 60156 - DNA, 25 bp, Mus musculus
aaggccacgggtttcagtgcattgc

SEQ ID NO: 60157 - DNA, 25 bp, Mus musculus
aaggccacgtggctacttgaacatt

SEQ ID NO: 60158 - DNA, 25 bp, Mus musculus
aaggccacgtgggtacttgaacatt

SEQ ID NO: 60159 - DNA, 25 bp, Mus musculus
aaggccactccacgatttctgtctt

SEQ ID NO: 60160 - DNA, 25 bp, Mus musculus
aaggccactccaggatttctgtctt

SEQ ID NO: 60161 - DNA, 25 bp, Mus musculus
aaggccactcccaggtaaaatccag

SEQ ID NO: 60162 - DNA, 25 bp, Mus musculus
aaggccactccctggtaaaatccag

SEQ ID NO: 60163 - DNA, 25 bp, Mus musculus
aaggccactctgagaccagcgagat

SEQ ID NO: 60164 - DNA, 25 bp, Mus musculus
aaggccactctgtgaccagcgagat

SEQ ID NO: 60165 - DNA, 25 bp, Mus musculus
aaggccactgagcttgaagtctact

SEQ ID NO: 60166 - DNA, 25 bp, Mus musculus
aaggccactgaggttgaagtctact

SEQ ID NO: 60167 - DNA, 25 bp, Mus musculus
aaggccactgtacacgggcgcaagc

SEQ ID NO: 60168 - DNA, 25 bp, Mus musculus
aaggccactgtagacgggcgcaagc

SEQ ID NO: 60169 - DNA, 25 bp, Mus musculus
aaggccactgtcaccagccttactg

SEQ ID NO: 60170 - DNA, 25 bp, Mus musculus
aaggccactgtctccagccttactg

SEQ ID NO: 60171 - DNA, 25 bp, Mus musculus
aaggccactgtgctagtgcttccct

SEQ ID NO: 60172 - DNA, 25 bp, Mus musculus
aaggccactgtgctcctaggttatc

SEQ ID NO: 60173 - DNA, 25 bp, Mus musculus
aaggccactgtggtagtgcttccct

SEQ ID NO: 60174 - DNA, 25 bp, Mus musculus
aaggccactgtggtcctaggttatc

SEQ ID NO: 60175 - DNA, 25 bp, Mus musculus
aaggccacttagcaagaccccatgt

SEQ ID NO: 60176 - DNA, 25 bp, Mus musculus
aaggccacttaggaagaccccatgt

SEQ ID NO: 60177 - DNA, 25 bp, Mus musculus
aaggccacttggctagatgttgctg

SEQ ID NO: 60178 - DNA, 25 bp, Mus musculus
aaggccacttgggtagatgttgctg

SEQ ID NO: 60179 - DNA, 25 bp, Mus musculus
aaggccagaagcaagctgtacatca

SEQ ID NO: 60180 - DNA, 25 bp, Mus musculus
aaggccagaagctagctgtacatca

SEQ ID NO: 60181 - DNA, 25 bp, Mus musculus
aaggccagacacaacaggtaacagg

SEQ ID NO: 60182 - DNA, 25 bp, Mus musculus
aaggccagacactacaggtaacagg

SEQ ID NO: 60183 - DNA, 25 bp, Mus musculus
aaggccagacttccttctaggccac

SEQ ID NO: 60184 - DNA, 25 bp, Mus musculus
aaggccagacttgcttctaggccac

SEQ ID NO: 60185 - DNA, 25 bp, Mus musculus
aaggccagagctattgccacccaca

SEQ ID NO: 60186 - DNA, 25 bp, Mus musculus
aaggccagagcttttgccacccaca

SEQ ID NO: 60187 - DNA, 25 bp, Mus musculus
aaggccagaggtaccaggcgctgaa

SEQ ID NO: 60188 - DNA, 25 bp, Mus musculus
aaggccagaggtacctttctgtaat

SEQ ID NO: 60189 - DNA, 25 bp, Mus musculus
aaggccagaggttccaggcgctgaa

SEQ ID NO: 60190 - DNA, 25 bp, Mus musculus
aaggccagaggttcctttctgtaat

SEQ ID NO: 60191 - DNA, 25 bp, Mus musculus
aaggccagcaagatcgaggtctacc

SEQ ID NO: 60192 - DNA, 25 bp, Mus musculus
aaggccagcaagttcgaggtctacc

SEQ ID NO: 60193 - DNA, 25 bp, Mus musculus
aaggccagcacaagcgattcccaag

SEQ ID NO: 60194 - DNA, 25 bp, Mus musculus
aaggccagcacactgagccatctgt

SEQ ID NO: 60195 - DNA, 25 bp, Mus musculus
aaggccagcacagtgagccatctgt

SEQ ID NO: 60196 - DNA, 25 bp, Mus musculus
aaggccagcacatgcgattcccaag

SEQ ID NO: 60197 - DNA, 25 bp, Mus musculus
aaggccagcatactctgcatggtga

SEQ ID NO: 60198 - DNA, 25 bp, Mus musculus
aaggccagcatagtctgcatggtga

SEQ ID NO: 60199 - DNA, 25 bp, Mus musculus
aaggccagccacagagcaggcagct

SEQ ID NO: 60200 - DNA, 25 bp, Mus musculus
aaggccagccacctgtgtcaaggac

SEQ ID NO: 60201 - DNA, 25 bp, Mus musculus
aaggccagccacgtgtgtcaaggac

SEQ ID NO: 60202 - DNA, 25 bp, Mus musculus
aaggccagccactgagcaggcagct

SEQ ID NO: 60203 - DNA, 25 bp, Mus musculus
aaggccagccgaaatgcagagtgag

SEQ ID NO: 60204 - DNA, 25 bp, Mus musculus
aaggccagccgatatgcagagtgag

SEQ ID NO: 60205 - DNA, 25 bp, Mus musculus
aaggccagcctcaggtatatggtga

SEQ ID NO: 60206 - DNA, 25 bp, Mus musculus
aaggccagcctctggtatatggtga

SEQ ID NO: 60207 - DNA, 25 bp, Mus musculus
aaggccagcctgagattcatgaaac

SEQ ID NO: 60208 - DNA, 25 bp, Mus musculus
aaggccagcctgtgattcatgaaac

SEQ ID NO: 60209 - DNA, 25 bp, Mus musculus
aaggccagccttaacgacttaagtg

SEQ ID NO: 60210 - DNA, 25 bp, Mus musculus
aaggccagccttcggctaataagga

SEQ ID NO: 60211 - DNA, 25 bp, Mus musculus
aaggccagccttgggctaataagga

SEQ ID NO: 60212 - DNA, 25 bp, Mus musculus
aaggccagcctttacgacttaagtg

SEQ ID NO: 60213 - DNA, 25 bp, Mus musculus
aaggccagctagatcccagctgcca

SEQ ID NO: 60214 - DNA, 25 bp, Mus musculus
aaggccagctagttcccagctgcca

SEQ ID NO: 60215 - DNA, 25 bp, Mus musculus
aaggccagctgcaacctgagaaata

SEQ ID NO: 60216 - DNA, 25 bp, Mus musculus
aaggccagctgctacctgagaaata

SEQ ID NO: 60217 - DNA, 25 bp, Mus musculus
aaggccagctgtaaatgcttttccc

SEQ ID NO: 60218 - DNA, 25 bp, Mus musculus
aaggccagctgttaatgcttttccc

SEQ ID NO: 60219 - DNA, 25 bp, Mus musculus
aaggccaggatcaccaagacactgc

SEQ ID NO: 60220 - DNA, 25 bp, Mus musculus
aaggccaggatctccaagacactgc

SEQ ID NO: 60221 - DNA, 25 bp, Mus musculus
aaggccaggatgagcaccttgaggt

SEQ ID NO: 60222 - DNA, 25 bp, Mus musculus
aaggccaggatgtgcaccttgaggt

SEQ ID NO: 60223 - DNA, 25 bp, Mus musculus
aaggccaggcacaactcagcatgtc

SEQ ID NO: 60224 - DNA, 25 bp, Mus musculus
aaggccaggcactactcagcatgtc

SEQ ID NO: 60225 - DNA, 25 bp, Mus musculus
aaggccaggcagagtcccaacaggc

SEQ ID NO: 60226 - DNA, 25 bp, Mus musculus
aaggccaggcagtgtcccaacaggc

SEQ ID NO: 60227 - DNA, 25 bp, Mus musculus
aaggccagggacaactacagcaggg

SEQ ID NO: 60228 - DNA, 25 bp, Mus musculus
aaggccagggactactacagcaggg

SEQ ID NO: 60229 - DNA, 25 bp, Mus musculus
aaggccaggtctagctgtggtccac

SEQ ID NO: 60230 - DNA, 25 bp, Mus musculus
aaggccaggtcttgctgtggtccac

SEQ ID NO: 60231 - DNA, 25 bp, Mus musculus
aaggccaggttcagtgttcctcctc

SEQ ID NO: 60232 - DNA, 25 bp, Mus musculus
aaggccaggttctgtgttcctcctc

SEQ ID NO: 60233 - DNA, 25 bp, Mus musculus
aaggccagtccccagcgcaggaaca

SEQ ID NO: 60234 - DNA, 25 bp, Mus musculus
aaggccagtcccgagcgcaggaaca

SEQ ID NO: 60235 - DNA, 25 bp, Mus musculus
aaggccagtctgaacaagtctcctg

SEQ ID NO: 60236 - DNA, 25 bp, Mus musculus
aaggccagtctgtacaagtctcctg

SEQ ID NO: 60237 - DNA, 25 bp, Mus musculus
aaggccagtgccaacaggcctctgc

SEQ ID NO: 60238 - DNA, 25 bp, Mus musculus
aaggccagtgccaatgaggatcagc

SEQ ID NO: 60239 - DNA, 25 bp, Mus musculus
aaggccagtgcctacaggcctctgc

SEQ ID NO: 60240 - DNA, 25 bp, Mus musculus
aaggccagtgcctatgaggatcagc

SEQ ID NO: 60241 - DNA, 25 bp, Mus musculus
aaggccagtggacctaatacagaca

SEQ ID NO: 60242 - DNA, 25 bp, Mus musculus
aaggccagtggagctaatacagaca

SEQ ID NO: 60243 - DNA, 25 bp, Mus musculus
aaggccagttaccagattacacatc

SEQ ID NO: 60244 - DNA, 25 bp, Mus musculus
aaggccagttacgagattacacatc

SEQ ID NO: 60245 - DNA, 25 bp, Mus musculus
aaggccagttagagtcacggagtga

SEQ ID NO: 60246 - DNA, 25 bp, Mus musculus
aaggccagttagtgtcacggagtga

SEQ ID NO: 60247 - DNA, 25 bp, Mus musculus
aaggccagtttacggctacttcctg

SEQ ID NO: 60248 - DNA, 25 bp, Mus musculus
aaggccagtttagggctacttcctg

SEQ ID NO: 60249 - DNA, 25 bp, Mus musculus
aaggccagttttcaacgtgactaca

SEQ ID NO: 60250 - DNA, 25 bp, Mus musculus
aaggccagttttgaacgtgactaca

SEQ ID NO: 60251 - DNA, 25 bp, Mus musculus
aaggccataaagactcactccgaag

SEQ ID NO: 60252 - DNA, 25 bp, Mus musculus
aaggccataaagtctcactccgaag

SEQ ID NO: 60253 - DNA, 25 bp, Mus musculus
aaggccataactactattttgcaag

SEQ ID NO: 60254 - DNA, 25 bp, Mus musculus
aaggccataacttctattttgcaag

SEQ ID NO: 60255 - DNA, 25 bp, Mus musculus
aaggccatagcaaaactcccaaggg

SEQ ID NO: 60256 - DNA, 25 bp, Mus musculus
aaggccatagcataactcccaaggg

SEQ ID NO: 60257 - DNA, 25 bp, Mus musculus
aaggccataggcaaaatctccagaa

SEQ ID NO: 60258 - DNA, 25 bp, Mus musculus
aaggccataggctaaatctccagaa

SEQ ID NO: 60259 - DNA, 25 bp, Mus musculus
aaggccatcaatcattgccattatg

SEQ ID NO: 60260 - DNA, 25 bp, Mus musculus
aaggccatcaatgattgccattatg

SEQ ID NO: 60261 - DNA, 25 bp, Mus musculus
aaggccatcaccactggtttgatac

SEQ ID NO: 60262 - DNA, 25 bp, Mus musculus
aaggccatcacctctggtttgatac

SEQ ID NO: 60263 - DNA, 25 bp, Mus musculus
aaggccatccagctgctaggatata

SEQ ID NO: 60264 - DNA, 25 bp, Mus musculus
aaggccatccaggtgctaggatata

SEQ ID NO: 60265 - DNA, 25 bp, Mus musculus
aaggccatccctctctacagagtaa

SEQ ID NO: 60266 - DNA, 25 bp, Mus musculus
aaggccatccctgtctacagagtaa

SEQ ID NO: 60267 - DNA, 25 bp, Mus musculus
aaggccatccggcaatggtactgtc

SEQ ID NO: 60268 - DNA, 25 bp, Mus musculus
aaggccatccgggaatggtactgtc

SEQ ID NO: 60269 - DNA, 25 bp, Mus musculus
aaggccatccttccctaggtagtga

SEQ ID NO: 60270 - DNA, 25 bp, Mus musculus
aaggccatccttgcctaggtagtga

SEQ ID NO: 60271 - DNA, 25 bp, Mus musculus
aaggccatcgacatgtggcacaaac

SEQ ID NO: 60272 - DNA, 25 bp, Mus musculus
aaggccatcgacttgtggcacaaac

SEQ ID NO: 60273 - DNA, 25 bp, Mus musculus
aaggccatcgagctctgtatcacag

SEQ ID NO: 60274 - DNA, 25 bp, Mus musculus
aaggccatcgaggtctgtatcacag

SEQ ID NO: 60275 - DNA, 25 bp, Mus musculus
aaggccatcttactatactactcag

SEQ ID NO: 60276 - DNA, 25 bp, Mus musculus
aaggccatcttagtatactactcag

SEQ ID NO: 60277 - DNA, 25 bp, Mus musculus
aaggccatcttcctgacgtggaggt

SEQ ID NO: 60278 - DNA, 25 bp, Mus musculus
aaggccatcttcgtgacgtggaggt

SEQ ID NO: 60279 - DNA, 25 bp, Mus musculus
aaggccatgatcctggctgaccata

SEQ ID NO: 60280 - DNA, 25 bp, Mus musculus
aaggccatgatcgtggctgaccata

SEQ ID NO: 60281 - DNA, 25 bp, Mus musculus
aaggccatggagcaagccgtaaaga

SEQ ID NO: 60282 - DNA, 25 bp, Mus musculus
aaggccatggaggaagccgtaaaga

SEQ ID NO: 60283 - DNA, 25 bp, Mus musculus
aaggccatggcactgttaccagaaa

SEQ ID NO: 60284 - DNA, 25 bp, Mus musculus
aaggccatggcagtgttaccagaaa

SEQ ID NO: 60285 - DNA, 25 bp, Mus musculus
aaggccatgggcactatgaacagac

SEQ ID NO: 60286 - DNA, 25 bp, Mus musculus
aaggccatgggctctatgaacagac

SEQ ID NO: 60287 - DNA, 25 bp, Mus musculus
aaggccatgtgaccatctacccagt

SEQ ID NO: 60288 - DNA, 25 bp, Mus musculus
aaggccatgtgagcatctacccagt

SEQ ID NO: 60289 - DNA, 25 bp, Mus musculus
aaggccatgtggatcaccgatgggt

SEQ ID NO: 60290 - DNA, 25 bp, Mus musculus
aaggccatgtggatgtcctggcacc

SEQ ID NO: 60291 - DNA, 25 bp, Mus musculus
aaggccatgtggttcaccgatgggt

SEQ ID NO: 60292 - DNA, 25 bp, Mus musculus
aaggccatgtggttgtcctggcacc

SEQ ID NO: 60293 - DNA, 25 bp, Mus musculus
aaggccattccaactttctggtaaa

SEQ ID NO: 60294 - DNA, 25 bp, Mus musculus
aaggccattccatctttctggtaaa

SEQ ID NO: 60295 - DNA, 25 bp, Mus musculus
aaggccattctcagctatgttggca

SEQ ID NO: 60296 - DNA, 25 bp, Mus musculus
aaggccattctctgctatgttggca

SEQ ID NO: 60297 - DNA, 25 bp, Mus musculus
aaggccattgcaactcacctgaggt

SEQ ID NO: 60298 - DNA, 25 bp, Mus musculus
aaggccattgcatctcacctgaggt

SEQ ID NO: 60299 - DNA, 25 bp, Mus musculus
aaggccattggcactagaattttgg

SEQ ID NO: 60300 - DNA, 25 bp, Mus musculus
aaggccattggctctagaattttgg

SEQ ID NO: 60301 - DNA, 25 bp, Mus musculus
aaggccattgtacaactgggtaaca

SEQ ID NO: 60302 - DNA, 25 bp, Mus musculus
aaggccattgtagaactgggtaaca

SEQ ID NO: 60303 - DNA, 25 bp, Mus musculus
aaggccattgtcagtctgagttgtc

SEQ ID NO: 60304 - DNA, 25 bp, Mus musculus
aaggccattgtctgtctgagttgtc

SEQ ID NO: 60305 - DNA, 25 bp, Mus musculus
aaggccatttacaaggtcatctgca

SEQ ID NO: 60306 - DNA, 25 bp, Mus musculus
aaggccatttactaggtcatctgca

SEQ ID NO: 60307 - DNA, 25 bp, Mus musculus
aaggcccaacaaatgtcagaaggaa

SEQ ID NO: 60308 - DNA, 25 bp, Mus musculus
aaggcccaacaattgtcagaaggaa

SEQ ID NO: 60309 - DNA, 25 bp, Mus musculus
aaggcccaactcagcaaccggaatg

SEQ ID NO: 60310 - DNA, 25 bp, Mus musculus
aaggcccaactctgcaaccggaatg

SEQ ID NO: 60311 - DNA, 25 bp, Mus musculus
aaggcccaagagatactggcgtttg

SEQ ID NO: 60312 - DNA, 25 bp, Mus musculus
aaggcccaagagttactggcgtttg

SEQ ID NO: 60313 - DNA, 25 bp, Mus musculus
aaggcccaagcaacacagtagttta

SEQ ID NO: 60314 - DNA, 25 bp, Mus musculus
aaggcccaagcatcacagtagttta

SEQ ID NO: 60315 - DNA, 25 bp, Mus musculus
aaggcccaaggtcagttctaagctc

SEQ ID NO: 60316 - DNA, 25 bp, Mus musculus
aaggcccaaggtgagttctaagctc

SEQ ID NO: 60317 - DNA, 25 bp, Mus musculus
aaggcccacaggagcatcggttaga

SEQ ID NO: 60318 - DNA, 25 bp, Mus musculus
aaggcccacaggtgcatcggttaga

SEQ ID NO: 60319 - DNA, 25 bp, Mus musculus
aaggcccaccagactgttgtcatgt

SEQ ID NO: 60320 - DNA, 25 bp, Mus musculus
aaggcccaccagtctgttgtcatgt

SEQ ID NO: 60321 - DNA, 25 bp, Mus musculus
aaggcccactacctgctgtcaggtt

SEQ ID NO: 60322 - DNA, 25 bp, Mus musculus
aaggcccactacgtgctgtcaggtt

SEQ ID NO: 60323 - DNA, 25 bp, Mus musculus
aaggcccactcgaattggacaagat

SEQ ID NO: 60324 - DNA, 25 bp, Mus musculus
aaggcccactcgtattggacaagat

SEQ ID NO: 60325 - DNA, 25 bp, Mus musculus
aaggcccactgaaatgatgctttat

SEQ ID NO: 60326 - DNA, 25 bp, Mus musculus
aaggcccactgatatgatgctttat

SEQ ID NO: 60327 - DNA, 25 bp, Mus musculus
aaggcccactttaacctggatgaga

SEQ ID NO: 60328 - DNA, 25 bp, Mus musculus
aaggcccacttttacctggatgaga

SEQ ID NO: 60329 - DNA, 25 bp, Mus musculus
aaggcccagagccatgcatggcagc

SEQ ID NO: 60330 - DNA, 25 bp, Mus musculus
aaggcccagagcgatgcatggcagc

SEQ ID NO: 60331 - DNA, 25 bp, Mus musculus
aaggcccagatcagatttacccaaa

SEQ ID NO: 60332 - DNA, 25 bp, Mus musculus
aaggcccagatctgatttacccaaa

SEQ ID NO: 60333 - DNA, 25 bp, Mus musculus
aaggcccagattcgttgcgccaagt

SEQ ID NO: 60334 - DNA, 25 bp, Mus musculus
aaggcccagattggttgcgccaagt

SEQ ID NO: 60335 - DNA, 25 bp, Mus musculus
aaggcccagcagattccaaaccata

SEQ ID NO: 60336 - DNA, 25 bp, Mus musculus
aaggcccagcagtttccaaaccata

SEQ ID NO: 60337 - DNA, 25 bp, Mus musculus
aaggcccagctaatcttacttcgtt

SEQ ID NO: 60338 - DNA, 25 bp, Mus musculus
aaggcccagctaccagagactgtga

SEQ ID NO: 60339 - DNA, 25 bp, Mus musculus
aaggcccagctagcagagactgtga

SEQ ID NO: 60340 - DNA, 25 bp, Mus musculus
aaggcccagctattcttacttcgtt

SEQ ID NO: 60341 - DNA, 25 bp, Mus musculus
aaggcccagctcaattgattctttt

SEQ ID NO: 60342 - DNA, 25 bp, Mus musculus
aaggcccagctctattgattctttt

SEQ ID NO: 60343 - DNA, 25 bp, Mus musculus
aaggcccaggatattcactggctca

SEQ ID NO: 60344 - DNA, 25 bp, Mus musculus
aaggcccaggattttcactggctca

SEQ ID NO: 60345 - DNA, 25 bp, Mus musculus
aaggcccagggacacatagcaggta

SEQ ID NO: 60346 - DNA, 25 bp, Mus musculus
aaggcccagggaccttcacggaaga

SEQ ID NO: 60347 - DNA, 25 bp, Mus musculus
aaggcccagggagacatagcaggta

SEQ ID NO: 60348 - DNA, 25 bp, Mus musculus
aaggcccagggagcttcacggaaga

SEQ ID NO: 60349 - DNA, 25 bp, Mus musculus
aaggcccaggtacatctcctgctag

SEQ ID NO: 60350 - DNA, 25 bp, Mus musculus
aaggcccaggtagatctcctgctag

SEQ ID NO: 60351 - DNA, 25 bp, Mus musculus
aaggcccaggtcagaacttgagtca

SEQ ID NO: 60352 - DNA, 25 bp, Mus musculus
aaggcccaggtctgaacttgagtca

SEQ ID NO: 60353 - DNA, 25 bp, Mus musculus
aaggcccagtcccatattctagtat

SEQ ID NO: 60354 - DNA, 25 bp, Mus musculus
aaggcccagtccgatattctagtat

SEQ ID NO: 60355 - DNA, 25 bp, Mus musculus
aaggcccagtgcacttctggtcctg

SEQ ID NO: 60356 - DNA, 25 bp, Mus musculus
aaggcccagtgctcttctggtcctg

SEQ ID NO: 60357 - DNA, 25 bp, Mus musculus
aaggcccagttcagctgcttcaacc

SEQ ID NO: 60358 - DNA, 25 bp, Mus musculus
aaggcccagttctgctgcttcaacc

SEQ ID NO: 60359 - DNA, 25 bp, Mus musculus
aaggcccataggatttagcccacag

SEQ ID NO: 60360 - DNA, 25 bp, Mus musculus
aaggcccataggttttagcccacag

SEQ ID NO: 60361 - DNA, 25 bp, Mus musculus
aaggcccatctaagctacagagtga

SEQ ID NO: 60362 - DNA, 25 bp, Mus musculus
aaggcccatctatgctacagagtga

SEQ ID NO: 60363 - DNA, 25 bp, Mus musculus
aaggcccatggcattggctatgacc

SEQ ID NO: 60364 - DNA, 25 bp, Mus musculus
aaggcccatggctttggctatgacc

SEQ ID NO: 60365 - DNA, 25 bp, Mus musculus
aaggcccatggtacacattttatga

SEQ ID NO: 60366 - DNA, 25 bp, Mus musculus
aaggcccatggttcacattttatga

SEQ ID NO: 60367 - DNA, 25 bp, Mus musculus
aaggcccatgtaaggccatcctggg

SEQ ID NO: 60368 - DNA, 25 bp, Mus musculus
aaggcccatgtatggccatcctggg

SEQ ID NO: 60369 - DNA, 25 bp, Mus musculus
aaggcccattaaatctgatgccata

SEQ ID NO: 60370 - DNA, 25 bp, Mus musculus
aaggcccattaattctgatgccata

SEQ ID NO: 60371 - DNA, 25 bp, Mus musculus
aaggcccattgaacccagagtgaga

SEQ ID NO: 60372 - DNA, 25 bp, Mus musculus
aaggcccattgatcccagagtgaga

SEQ ID NO: 60373 - DNA, 25 bp, Mus musculus
aaggccccaaacagtagacattcat

SEQ ID NO: 60374 - DNA, 25 bp, Mus musculus
aaggccccaaactgtagacattcat

SEQ ID NO: 60375 - DNA, 25 bp, Mus musculus
aaggccccaagtccgaaagcacttg

SEQ ID NO: 60376 - DNA, 25 bp, Mus musculus
aaggccccaagtgcgaaagcacttg

SEQ ID NO: 60377 - DNA, 25 bp, Mus musculus
aaggccccacttcttaggagtgcta

SEQ ID NO: 60378 - DNA, 25 bp, Mus musculus
aaggccccacttgttaggagtgcta

SEQ ID NO: 60379 - DNA, 25 bp, Mus musculus
aaggccccagcaatcctgtatgata

SEQ ID NO: 60380 - DNA, 25 bp, Mus musculus
aaggccccagcattcctgtatgata

SEQ ID NO: 60381 - DNA, 25 bp, Mus musculus
aaggccccagccatggatgtagtga

SEQ ID NO: 60382 - DNA, 25 bp, Mus musculus
aaggccccagccttggatgtagtga

SEQ ID NO: 60383 - DNA, 25 bp, Mus musculus
aaggccccagtactgttctgactaa

SEQ ID NO: 60384 - DNA, 25 bp, Mus musculus
aaggccccagtagtgttctgactaa

SEQ ID NO: 60385 - DNA, 25 bp, Mus musculus
aaggccccggctcaagaatgtggac

SEQ ID NO: 60386 - DNA, 25 bp, Mus musculus
aaggccccggctgaagaatgtggac

SEQ ID NO: 60387 - DNA, 25 bp, Mus musculus
aaggcccctaccattgatattcgtc

SEQ ID NO: 60388 - DNA, 25 bp, Mus musculus
aaggcccctacctttgatattcgtc

SEQ ID NO: 60389 - DNA, 25 bp, Mus musculus
aaggcccctcagaactaagcaagga

SEQ ID NO: 60390 - DNA, 25 bp, Mus musculus
aaggcccctcagtactaagcaagga

SEQ ID NO: 60391 - DNA, 25 bp, Mus musculus
aaggcccctgatagggtggattcct

SEQ ID NO: 60392 - DNA, 25 bp, Mus musculus
aaggcccctgattgggtggattcct

SEQ ID NO: 60393 - DNA, 25 bp, Mus musculus
aaggcccctgccaagggatgcaaga

SEQ ID NO: 60394 - DNA, 25 bp, Mus musculus
aaggcccctgccaggcggcgggacg

SEQ ID NO: 60395 - DNA, 25 bp, Mus musculus
aaggcccctgcctagggatgcaaga

SEQ ID NO: 60396 - DNA, 25 bp, Mus musculus
aaggcccctgcctggcggcgggacg

SEQ ID NO: 60397 - DNA, 25 bp, Mus musculus
aaggcccctgtgattatggagaagc

SEQ ID NO: 60398 - DNA, 25 bp, Mus musculus
aaggcccctgtgctgaaggctaaag

SEQ ID NO: 60399 - DNA, 25 bp, Mus musculus
aaggcccctgtggtgaaggctaaag

SEQ ID NO: 60400 - DNA, 25 bp, Mus musculus
aaggcccctgtgtttatggagaagc

SEQ ID NO: 60401 - DNA, 25 bp, Mus musculus
aaggccccttacagtggacagctaa

SEQ ID NO: 60402 - DNA, 25 bp, Mus musculus
aaggccccttaccagtgggctgctg

SEQ ID NO: 60403 - DNA, 25 bp, Mus musculus
aaggccccttacgagtgggctgctg

SEQ ID NO: 60404 - DNA, 25 bp, Mus musculus
aaggccccttactgtggacagctaa

SEQ ID NO: 60405 - DNA, 25 bp, Mus musculus
aaggccccttgacccagttactgaa

SEQ ID NO: 60406 - DNA, 25 bp, Mus musculus
aaggccccttgacgctgattacagg

SEQ ID NO: 60407 - DNA, 25 bp, Mus musculus
aaggccccttgagccagttactgaa

SEQ ID NO: 60408 - DNA, 25 bp, Mus musculus
aaggccccttgaggctgattacagg

SEQ ID NO: 60409 - DNA, 25 bp, Mus musculus
aaggcccgaggtcaggatcccagat

SEQ ID NO: 60410 - DNA, 25 bp, Mus musculus
aaggcccgaggtgaggatcccagat

SEQ ID NO: 60411 - DNA, 25 bp, Mus musculus
aaggcccgcatgctcagcataatga

SEQ ID NO: 60412 - DNA, 25 bp, Mus musculus
aaggcccgcatggtcagcataatga

SEQ ID NO: 60413 - DNA, 25 bp, Mus musculus
aaggcccggcgacaacagatggacc

SEQ ID NO: 60414 - DNA, 25 bp, Mus musculus
aaggcccggcgagaacagatggacc

SEQ ID NO: 60415 - DNA, 25 bp, Mus musculus
aaggcccgggtaatggctaccattg

SEQ ID NO: 60416 - DNA, 25 bp, Mus musculus
aaggcccgggtattggctaccattg

SEQ ID NO: 60417 - DNA, 25 bp, Mus musculus
aaggcccgtccaactacagcatagg

SEQ ID NO: 60418 - DNA, 25 bp, Mus musculus
aaggcccgtccatctacagcatagg

SEQ ID NO: 60419 - DNA, 25 bp, Mus musculus
aaggccctaataagcgtcggagata

SEQ ID NO: 60420 - DNA, 25 bp, Mus musculus
aaggccctaatatgcgtcggagata

SEQ ID NO: 60421 - DNA, 25 bp, Mus musculus
aaggccctactgacatcttgatttc

SEQ ID NO: 60422 - DNA, 25 bp, Mus musculus
aaggccctactgtcatcttgatttc

SEQ ID NO: 60423 - DNA, 25 bp, Mus musculus
aaggccctagttatgaagcgtgaca

SEQ ID NO: 60424 - DNA, 25 bp, Mus musculus
aaggccctagttttgaagcgtgaca

SEQ ID NO: 60425 - DNA, 25 bp, Mus musculus
aaggccctctggaaaatcattatct

SEQ ID NO: 60426 - DNA, 25 bp, Mus musculus
aaggccctctggactgagcttctca

SEQ ID NO: 60427 - DNA, 25 bp, Mus musculus
aaggccctctggatggttaggctct

SEQ ID NO: 60428 - DNA, 25 bp, Mus musculus
aaggccctctggtaaatcattatct

SEQ ID NO: 60429 - DNA, 25 bp, Mus musculus
aaggccctctggtctgagcttctca

SEQ ID NO: 60430 - DNA, 25 bp, Mus musculus
aaggccctctggttggttaggctct

SEQ ID NO: 60431 - DNA, 25 bp, Mus musculus
aaggccctgaatacagccacctgta

SEQ ID NO: 60432 - DNA, 25 bp, Mus musculus
aaggccctgaatacctctattatta

SEQ ID NO: 60433 - DNA, 25 bp, Mus musculus
aaggccctgaattcagccacctgta

SEQ ID NO: 60434 - DNA, 25 bp, Mus musculus
aaggccctgaattcctctattatta

SEQ ID NO: 60435 - DNA, 25 bp, Mus musculus
aaggccctgacgactatgggattca

SEQ ID NO: 60436 - DNA, 25 bp, Mus musculus
aaggccctgacgtctatgggattca

SEQ ID NO: 60437 - DNA, 25 bp, Mus musculus
aaggccctgactccaagcgtgagga

SEQ ID NO: 60438 - DNA, 25 bp, Mus musculus
aaggccctgactgcaagcgtgagga

SEQ ID NO: 60439 - DNA, 25 bp, Mus musculus
aaggccctgaggctgcagcaaagct

SEQ ID NO: 60440 - DNA, 25 bp, Mus musculus
aaggccctgagggtgcagcaaagct

SEQ ID NO: 60441 - DNA, 25 bp, Mus musculus
aaggccctgagtacgaaccgtgacg

SEQ ID NO: 60442 - DNA, 25 bp, Mus musculus
aaggccctgagttcgaaccgtgacg

SEQ ID NO: 60443 - DNA, 25 bp, Mus musculus
aaggccctgatgacccacgagagaa

SEQ ID NO: 60444 - DNA, 25 bp, Mus musculus
aaggccctgatgtcccacgagagaa

SEQ ID NO: 60445 - DNA, 25 bp, Mus musculus
aaggccctgctgagaagaccgtttg

SEQ ID NO: 60446 - DNA, 25 bp, Mus musculus
aaggccctgctgtgaagaccgtttg

SEQ ID NO: 60447 - DNA, 25 bp, Mus musculus
aaggccctggatacagttcaactcc

SEQ ID NO: 60448 - DNA, 25 bp, Mus musculus
aaggccctggattcagttcaactcc

SEQ ID NO: 60449 - DNA, 25 bp, Mus musculus
aaggccctggccagaggagacgcaa

SEQ ID NO: 60450 - DNA, 25 bp, Mus musculus
aaggccctggcctgaggagacgcaa

SEQ ID NO: 60451 - DNA, 25 bp, Mus musculus
aaggccctggcgctcagcaaattcc

SEQ ID NO: 60452 - DNA, 25 bp, Mus musculus
aaggccctggcggtcagcaaattcc

SEQ ID NO: 60453 - DNA, 25 bp, Mus musculus
aaggccctggtgaagcctcaggcca

SEQ ID NO: 60454 - DNA, 25 bp, Mus musculus
aaggccctggtgtagcctcaggcca

SEQ ID NO: 60455 - DNA, 25 bp, Mus musculus
aaggccctgtggagcgcgtgcacac

SEQ ID NO: 60456 - DNA, 25 bp, Mus musculus
aaggccctgtggtgcgcgtgcacac

SEQ ID NO: 60457 - DNA, 25 bp, Mus musculus
aaggccctgtgtctcaaagaccagc

SEQ ID NO: 60458 - DNA, 25 bp, Mus musculus
aaggccctgtgtgtcaaagaccagc

SEQ ID NO: 60459 - DNA, 25 bp, Mus musculus
aaggccctgttcagtaccgttgtga

SEQ ID NO: 60460 - DNA, 25 bp, Mus musculus
aaggccctgttctgtaccgttgtga

SEQ ID NO: 60461 - DNA, 25 bp, Mus musculus
aaggcccttgcccatgagtaagtac

SEQ ID NO: 60462 - DNA, 25 bp, Mus musculus
aaggcccttgccgatgagtaagtac

SEQ ID NO: 60463 - DNA, 25 bp, Mus musculus
aaggcccttggcagtttgcaaatgg

SEQ ID NO: 60464 - DNA, 25 bp, Mus musculus
aaggcccttggctgtttgcaaatgg

SEQ ID NO: 60465 - DNA, 25 bp, Mus musculus
aaggccctttgaagtctagcccagt

SEQ ID NO: 60466 - DNA, 25 bp, Mus musculus
aaggccctttgatgtctagcccagt

SEQ ID NO: 60467 - DNA, 25 bp, Mus musculus
aaggccctttgtaagttcctgcagg

SEQ ID NO: 60468 - DNA, 25 bp, Mus musculus
aaggccctttgttagttcctgcagg

SEQ ID NO: 60469 - DNA, 25 bp, Mus musculus
aaggcccttttgaatacagctatat

SEQ ID NO: 60470 - DNA, 25 bp, Mus musculus
aaggcccttttgtatacagctatat

SEQ ID NO: 60471 - DNA, 25 bp, Mus musculus
aaggccgaagttctcagccaagaaa

SEQ ID NO: 60472 - DNA, 25 bp, Mus musculus
aaggccgaagttgtcagccaagaaa

SEQ ID NO: 60473 - DNA, 25 bp, Mus musculus
aaggccgagccgagctaccgaggta

SEQ ID NO: 60474 - DNA, 25 bp, Mus musculus
aaggccgagccgtgctaccgaggta

SEQ ID NO: 60475 - DNA, 25 bp, Mus musculus
aaggccgagcctatagagcaaccat

SEQ ID NO: 60476 - DNA, 25 bp, Mus musculus
aaggccgagcctttagagcaaccat

SEQ ID NO: 60477 - DNA, 25 bp, Mus musculus
aaggccgatttcatacctattggag

SEQ ID NO: 60478 - DNA, 25 bp, Mus musculus
aaggccgatttcttacctattggag

SEQ ID NO: 60479 - DNA, 25 bp, Mus musculus
aaggccgcactgcaggcgtcagtgc

SEQ ID NO: 60480 - DNA, 25 bp, Mus musculus
aaggccgcactggaggcgtcagtgc

SEQ ID NO: 60481 - DNA, 25 bp, Mus musculus
aaggccgcatgacaagtgtgtccaa

SEQ ID NO: 60482 - DNA, 25 bp, Mus musculus
aaggccgcatgagaagtgtgtccaa

SEQ ID NO: 60483 - DNA, 25 bp, Mus musculus
aaggccgctatgcaaccgccctgta

SEQ ID NO: 60484 - DNA, 25 bp, Mus musculus
aaggccgctatggaaccgccctgta

SEQ ID NO: 60485 - DNA, 25 bp, Mus musculus
aaggccgctcttccttgtgtatcaa

SEQ ID NO: 60486 - DNA, 25 bp, Mus musculus
aaggccgctcttgcttgtgtatcaa

SEQ ID NO: 60487 - DNA, 25 bp, Mus musculus
aaggccgctgatcccatagcacatg

SEQ ID NO: 60488 - DNA, 25 bp, Mus musculus
aaggccgctgatgccatagcacatg

SEQ ID NO: 60489 - DNA, 25 bp, Mus musculus
aaggccgctggtaccatttcaatga

SEQ ID NO: 60490 - DNA, 25 bp, Mus musculus
aaggccgctggttccatttcaatga

SEQ ID NO: 60491 - DNA, 25 bp, Mus musculus
aaggccgctgtcattgctgaagctt

SEQ ID NO: 60492 - DNA, 25 bp, Mus musculus
aaggccgctgtctttgctgaagctt

SEQ ID NO: 60493 - DNA, 25 bp, Mus musculus
aaggccggacatagcggttcatgct

SEQ ID NO: 60494 - DNA, 25 bp, Mus musculus
aaggccggacattgcggttcatgct

SEQ ID NO: 60495 - DNA, 25 bp, Mus musculus
aaggccggagatcagctcaccaagc

SEQ ID NO: 60496 - DNA, 25 bp, Mus musculus
aaggccggagatgagctcaccaagc

SEQ ID NO: 60497 - DNA, 25 bp, Mus musculus
aaggccggccggaacgtatcaggag

SEQ ID NO: 60498 - DNA, 25 bp, Mus musculus
aaggccggccggtacgtatcaggag

SEQ ID NO: 60499 - DNA, 25 bp, Mus musculus
aaggccggcctgaaagtactgtgta

SEQ ID NO: 60500 - DNA, 25 bp, Mus musculus
aaggccggcctgtaagtactgtgta

SEQ ID NO: 60501 - DNA, 25 bp, Mus musculus
aaggccgggacaaggcaaacaggat

SEQ ID NO: 60502 - DNA, 25 bp, Mus musculus
aaggccgggacatggcaaacaggat

SEQ ID NO: 60503 - DNA, 25 bp, Mus musculus
aaggccggtagacattcaggtgaaa

SEQ ID NO: 60504 - DNA, 25 bp, Mus musculus
aaggccggtagagattcaggtgaaa

SEQ ID NO: 60505 - DNA, 25 bp, Mus musculus
aaggccggttggcacgtcaatcaat

SEQ ID NO: 60506 - DNA, 25 bp, Mus musculus
aaggccggttgggacgtcaatcaat

SEQ ID NO: 60507 - DNA, 25 bp, Mus musculus
aaggccgtacaacaggttgtcaaga

SEQ ID NO: 60508 - DNA, 25 bp, Mus musculus
aaggccgtacaagaggttgtcaaga

SEQ ID NO: 60509 - DNA, 25 bp, Mus musculus
aaggccgtacacacaggaactgcga

SEQ ID NO: 60510 - DNA, 25 bp, Mus musculus
aaggccgtacactcaggaactgcga

SEQ ID NO: 60511 - DNA, 25 bp, Mus musculus
aaggccgtacagatgcgaagcttgc

SEQ ID NO: 60512 - DNA, 25 bp, Mus musculus
aaggccgtacagttgcgaagcttgc

SEQ ID NO: 60513 - DNA, 25 bp, Mus musculus
aaggccgtagagacaaaggctgttt

SEQ ID NO: 60514 - DNA, 25 bp, Mus musculus
aaggccgtagagtcaaaggctgttt

SEQ ID NO: 60515 - DNA, 25 bp, Mus musculus
aaggccgtagtacttttgtgcctca

SEQ ID NO: 60516 - DNA, 25 bp, Mus musculus
aaggccgtagtagttttgtgcctca

SEQ ID NO: 60517 - DNA, 25 bp, Mus musculus
aaggccgtatggctacactcacatg

SEQ ID NO: 60518 - DNA, 25 bp, Mus musculus
aaggccgtatgggtacactcacatg

SEQ ID NO: 60519 - DNA, 25 bp, Mus musculus
aaggccgtccggcatcgcaaagcac

SEQ ID NO: 60520 - DNA, 25 bp, Mus musculus
aaggccgtccgggatcgcaaagcac

SEQ ID NO: 60521 - DNA, 25 bp, Mus musculus
aaggccgtcctcacctacatagtga

SEQ ID NO: 60522 - DNA, 25 bp, Mus musculus
aaggccgtcctctcctacatagtga

SEQ ID NO: 60523 - DNA, 25 bp, Mus musculus
aaggccgtgattagcagcatccagt

SEQ ID NO: 60524 - DNA, 25 bp, Mus musculus
aaggccgtgatttgcagcatccagt

SEQ ID NO: 60525 - DNA, 25 bp, Mus musculus
aaggccgtggcaagagaggaccctt

SEQ ID NO: 60526 - DNA, 25 bp, Mus musculus
aaggccgtggcatgagaggaccctt

SEQ ID NO: 60527 - DNA, 25 bp, Mus musculus
aaggccgtgggcatgtgtattcaga

SEQ ID NO: 60528 - DNA, 25 bp, Mus musculus
aaggccgtgggcttgtgtattcaga

SEQ ID NO: 60529 - DNA, 25 bp, Mus musculus
aaggccgtgttaaggaatctgctga

SEQ ID NO: 60530 - DNA, 25 bp, Mus musculus
aaggccgtgttatggaatctgctga

SEQ ID NO: 60531 - DNA, 25 bp, Mus musculus
aaggccgttcatccttccagcagta

SEQ ID NO: 60532 - DNA, 25 bp, Mus musculus
aaggccgttcatgcttccagcagta

SEQ ID NO: 60533 - DNA, 25 bp, Mus musculus
aaggcctaaaatcatcgcgattcga

SEQ ID NO: 60534 - DNA, 25 bp, Mus musculus
aaggcctaaaatgatcgcgattcga

SEQ ID NO: 60535 - DNA, 25 bp, Mus musculus
aaggcctaagctctgtgagtgcaag

SEQ ID NO: 60536 - DNA, 25 bp, Mus musculus
aaggcctaagctgtgtgagtgcaag

SEQ ID NO: 60537 - DNA, 25 bp, Mus musculus
aaggcctaaggaagattgacagaga

SEQ ID NO: 60538 - DNA, 25 bp, Mus musculus
aaggcctaaggatgattgacagaga

SEQ ID NO: 60539 - DNA, 25 bp, Mus musculus
aaggcctacctaactggaacaggga

SEQ ID NO: 60540 - DNA, 25 bp, Mus musculus
aaggcctacctatctggaacaggga

SEQ ID NO: 60541 - DNA, 25 bp, Mus musculus
aaggcctacgtgaacatgtcgctgt

SEQ ID NO: 60542 - DNA, 25 bp, Mus musculus
aaggcctacgtgtacatgtcgctgt

SEQ ID NO: 60543 - DNA, 25 bp, Mus musculus
aaggcctacgttcccaagaacactg

SEQ ID NO: 60544 - DNA, 25 bp, Mus musculus
aaggcctacgttgccaagaacactg

SEQ ID NO: 60545 - DNA, 25 bp, Mus musculus
aaggcctactatcgaggagcccagg

SEQ ID NO: 60546 - DNA, 25 bp, Mus musculus
aaggcctactatggaggagcccagg

SEQ ID NO: 60547 - DNA, 25 bp, Mus musculus
aaggcctagaggagaccccaagctg

SEQ ID NO: 60548 - DNA, 25 bp, Mus musculus
aaggcctagaggtgaccccaagctg

SEQ ID NO: 60549 - DNA, 25 bp, Mus musculus
aaggcctaggtcactttgcccaaga

SEQ ID NO: 60550 - DNA, 25 bp, Mus musculus
aaggcctaggtctctttgcccaaga

SEQ ID NO: 60551 - DNA, 25 bp, Mus musculus
aaggcctagtagctccaagtcagac

SEQ ID NO: 60552 - DNA, 25 bp, Mus musculus
aaggcctagtaggtccaagtcagac

SEQ ID NO: 60553 - DNA, 25 bp, Mus musculus
aaggcctattggctcgacaggacga

SEQ ID NO: 60554 - DNA, 25 bp, Mus musculus
aaggcctattgggtcgacaggacga

SEQ ID NO: 60555 - DNA, 25 bp, Mus musculus
aaggcctatttaacttgtccaagtg

SEQ ID NO: 60556 - DNA, 25 bp, Mus musculus
aaggcctatttatcttgtccaagtg

SEQ ID NO: 60557 - DNA, 25 bp, Mus musculus
aaggcctatttgagtgtgcacatgc

SEQ ID NO: 60558 - DNA, 25 bp, Mus musculus
aaggcctatttgtgtgtgcacatgc

SEQ ID NO: 60559 - DNA, 25 bp, Mus musculus
aaggcctattttagagcttgtccaa

SEQ ID NO: 60560 - DNA, 25 bp, Mus musculus
aaggcctatttttgagcttgtccaa

SEQ ID NO: 60561 - DNA, 25 bp, Mus musculus
aaggcctcaatcagtgcatgcatgt

SEQ ID NO: 60562 - DNA, 25 bp, Mus musculus
aaggcctcaatctgtgcatgcatgt

SEQ ID NO: 60563 - DNA, 25 bp, Mus musculus
aaggcctcacctaaggttgtctgta

SEQ ID NO: 60564 - DNA, 25 bp, Mus musculus
aaggcctcaccttaggttgtctgta

SEQ ID NO: 60565 - DNA, 25 bp, Mus musculus
aaggcctcagagaccctgcgggagt

SEQ ID NO: 60566 - DNA, 25 bp, Mus musculus
aaggcctcagagcatttctaccaga

SEQ ID NO: 60567 - DNA, 25 bp, Mus musculus
aaggcctcagaggatttctaccaga

SEQ ID NO: 60568 - DNA, 25 bp, Mus musculus
aaggcctcagagtccctgcgggagt

SEQ ID NO: 60569 - DNA, 25 bp, Mus musculus
aaggcctcaggcacatagttataga

SEQ ID NO: 60570 - DNA, 25 bp, Mus musculus
aaggcctcaggctcatagttataga

SEQ ID NO: 60571 - DNA, 25 bp, Mus musculus
aaggcctcagttatcagaggtcttc

SEQ ID NO: 60572 - DNA, 25 bp, Mus musculus
aaggcctcagttttcagaggtcttc

SEQ ID NO: 60573 - DNA, 25 bp, Mus musculus
aaggcctcatagagaacggactcag

SEQ ID NO: 60574 - DNA, 25 bp, Mus musculus
aaggcctcatagtgaacggactcag

SEQ ID NO: 60575 - DNA, 25 bp, Mus musculus
aaggcctcatctaggtttttcatca

SEQ ID NO: 60576 - DNA, 25 bp, Mus musculus
aaggcctcatcttggtttttcatca

SEQ ID NO: 60577 - DNA, 25 bp, Mus musculus
aaggcctccccaactgggaaataga

SEQ ID NO: 60578 - DNA, 25 bp, Mus musculus
aaggcctccccatctgggaaataga

SEQ ID NO: 60579 - DNA, 25 bp, Mus musculus
aaggcctccgacactcgagaaatta

SEQ ID NO: 60580 - DNA, 25 bp, Mus musculus
aaggcctccgactctcgagaaatta

SEQ ID NO: 60581 - DNA, 25 bp, Mus musculus
aaggcctcctaacagtacccagctt

SEQ ID NO: 60582 - DNA, 25 bp, Mus musculus
aaggcctcctaagagtacccagctt

SEQ ID NO: 60583 - DNA, 25 bp, Mus musculus
aaggcctcctgacaccttttctggg

SEQ ID NO: 60584 - DNA, 25 bp, Mus musculus
aaggcctcctgagaccttttctggg

SEQ ID NO: 60585 - DNA, 25 bp, Mus musculus
aaggcctcgactatactaactcctg

SEQ ID NO: 60586 - DNA, 25 bp, Mus musculus
aaggcctcgactttactaactcctg

SEQ ID NO: 60587 - DNA, 25 bp, Mus musculus
aaggcctcgcaaacccaaagggata

SEQ ID NO: 60588 - DNA, 25 bp, Mus musculus
aaggcctcgcaatcccaaagggata

SEQ ID NO: 60589 - DNA, 25 bp, Mus musculus
aaggcctcgtttcaagtatcctcca

SEQ ID NO: 60590 - DNA, 25 bp, Mus musculus
aaggcctcgtttgaagtatcctcca

SEQ ID NO: 60591 - DNA, 25 bp, Mus musculus
aaggcctctaagaaatatgtctcaa

SEQ ID NO: 60592 - DNA, 25 bp, Mus musculus
aaggcctctaagtaatatgtctcaa

SEQ ID NO: 60593 - DNA, 25 bp, Mus musculus
aaggcctctcttagacgcttgcaaa

SEQ ID NO: 60594 - DNA, 25 bp, Mus musculus
aaggcctctctttgacgcttgcaaa

SEQ ID NO: 60595 - DNA, 25 bp, Mus musculus
aaggcctctgagaaacttctgggtt

SEQ ID NO: 60596 - DNA, 25 bp, Mus musculus
aaggcctctgagtaacttctgggtt

SEQ ID NO: 60597 - DNA, 25 bp, Mus musculus
aaggcctctgcgcataactacagat

SEQ ID NO: 60598 - DNA, 25 bp, Mus musculus
aaggcctctgcggataactacagat

SEQ ID NO: 60599 - DNA, 25 bp, Mus musculus
aaggcctctggcctcaacacgtcag

SEQ ID NO: 60600 - DNA, 25 bp, Mus musculus
aaggcctctggcgtcaacacgtcag

SEQ ID NO: 60601 - DNA, 25 bp, Mus musculus
aaggcctcttatccaggagcgtaga

SEQ ID NO: 60602 - DNA, 25 bp, Mus musculus
aaggcctcttatgcaggagcgtaga

SEQ ID NO: 60603 - DNA, 25 bp, Mus musculus
aaggcctcttcacaagtcaacgtgg

SEQ ID NO: 60604 - DNA, 25 bp, Mus musculus
aaggcctcttcagaagtcaacgtgg

SEQ ID NO: 60605 - DNA, 25 bp, Mus musculus
aaggcctcttggaaaaccgcagcat

SEQ ID NO: 60606 - DNA, 25 bp, Mus musculus
aaggcctcttggtaaaccgcagcat

SEQ ID NO: 60607 - DNA, 25 bp, Mus musculus
aaggcctcttgtaactctgtttagc

SEQ ID NO: 60608 - DNA, 25 bp, Mus musculus
aaggcctcttgttactctgtttagc

SEQ ID NO: 60609 - DNA, 25 bp, Mus musculus
aaggcctgaacgctatatgcctcag

SEQ ID NO: 60610 - DNA, 25 bp, Mus musculus
aaggcctgaacggtatatgcctcag

SEQ ID NO: 60611 - DNA, 25 bp, Mus musculus
aaggcctgaagccagtcttgcaaag

SEQ ID NO: 60612 - DNA, 25 bp, Mus musculus
aaggcctgaagcgagtcttgcaaag

SEQ ID NO: 60613 - DNA, 25 bp, Mus musculus
aaggcctgacagaattggatacaat

SEQ ID NO: 60614 - DNA, 25 bp, Mus musculus
aaggcctgacagtattggatacaat

SEQ ID NO: 60615 - DNA, 25 bp, Mus musculus
aaggcctgaccgaacggcagctgaa

SEQ ID NO: 60616 - DNA, 25 bp, Mus musculus
aaggcctgaccgtacggcagctgaa

SEQ ID NO: 60617 - DNA, 25 bp, Mus musculus
aaggcctgacctcaagggagccttt

SEQ ID NO: 60618 - DNA, 25 bp, Mus musculus
aaggcctgacctgaagggagccttt

SEQ ID NO: 60619 - DNA, 25 bp, Mus musculus
aaggcctgactcaggtctgctggca

SEQ ID NO: 60620 - DNA, 25 bp, Mus musculus
aaggcctgactctggtctgctggca

SEQ ID NO: 60621 - DNA, 25 bp, Mus musculus
aaggcctgagaaccactggcacctt

SEQ ID NO: 60622 - DNA, 25 bp, Mus musculus
aaggcctgagaagcactggcacctt

SEQ ID NO: 60623 - DNA, 25 bp, Mus musculus
aaggcctgagatcacaacgacaata

SEQ ID NO: 60624 - DNA, 25 bp, Mus musculus
aaggcctgagatgacaacgacaata

SEQ ID NO: 60625 - DNA, 25 bp, Mus musculus
aaggcctgagcaacagacgtgtgct

SEQ ID NO: 60626 - DNA, 25 bp, Mus musculus
aaggcctgagcaattattgccctcc

SEQ ID NO: 60627 - DNA, 25 bp, Mus musculus
aaggcctgagcatcagacgtgtgct

SEQ ID NO: 60628 - DNA, 25 bp, Mus musculus
aaggcctgagcatttattgccctcc

SEQ ID NO: 60629 - DNA, 25 bp, Mus musculus
aaggcctgagccctcaagcctgtgc

SEQ ID NO: 60630 - DNA, 25 bp, Mus musculus
aaggcctgagccgtcaagcctgtgc

SEQ ID NO: 60631 - DNA, 25 bp, Mus musculus
aaggcctgagtactgaggccctaca

SEQ ID NO: 60632 - DNA, 25 bp, Mus musculus
aaggcctgagtagtgaggccctaca

SEQ ID NO: 60633 - DNA, 25 bp, Mus musculus
aaggcctgatggaatctttgcttga

SEQ ID NO: 60634 - DNA, 25 bp, Mus musculus
aaggcctgatggtatctttgcttga

SEQ ID NO: 60635 - DNA, 25 bp, Mus musculus
aaggcctgcaggatcatgaatggca

SEQ ID NO: 60636 - DNA, 25 bp, Mus musculus
aaggcctgcaggttcatgaatggca

SEQ ID NO: 60637 - DNA, 25 bp, Mus musculus
aaggcctgccaaccagtgcaggttg

SEQ ID NO: 60638 - DNA, 25 bp, Mus musculus
aaggcctgccaagcagtgcaggttg

SEQ ID NO: 60639 - DNA, 25 bp, Mus musculus
aaggcctgccagatatttgtgagaa

SEQ ID NO: 60640 - DNA, 25 bp, Mus musculus
aaggcctgccagttatttgtgagaa

SEQ ID NO: 60641 - DNA, 25 bp, Mus musculus
aaggcctgcctcagggctgtaagtg

SEQ ID NO: 60642 - DNA, 25 bp, Mus musculus
aaggcctgcctctgggctgtaagtg

SEQ ID NO: 60643 - DNA, 25 bp, Mus musculus
aaggcctgcgatcaggtggcacctc

SEQ ID NO: 60644 - DNA, 25 bp, Mus musculus
aaggcctgcgatgaggtggcacctc

SEQ ID NO: 60645 - DNA, 25 bp, Mus musculus
aaggcctgcgtgacctctctgtgct

SEQ ID NO: 60646 - DNA, 25 bp, Mus musculus
aaggcctgcgtgtcctctctgtgct

SEQ ID NO: 60647 - DNA, 25 bp, Mus musculus
aaggcctgctagagccgcatgctta

SEQ ID NO: 60648 - DNA, 25 bp, Mus musculus
aaggcctgctagtgccgcatgctta

SEQ ID NO: 60649 - DNA, 25 bp, Mus musculus
aaggcctggaagatggtcatgacga

SEQ ID NO: 60650 - DNA, 25 bp, Mus musculus
aaggcctggaagttggtcatgacga

SEQ ID NO: 60651 - DNA, 25 bp, Mus musculus
aaggcctggaatctgtgacacccca

SEQ ID NO: 60652 - DNA, 25 bp, Mus musculus
aaggcctggaatgtgtgacacccca

SEQ ID NO: 60653 - DNA, 25 bp, Mus musculus
aaggcctggagaccaagttcaagca

SEQ ID NO: 60654 - DNA, 25 bp, Mus musculus
aaggcctggagagcaagttcaagca

SEQ ID NO: 60655 - DNA, 25 bp, Mus musculus
aaggcctggatgacttgcggcagat

SEQ ID NO: 60656 - DNA, 25 bp, Mus musculus
aaggcctggatgagttcctctgtgc

SEQ ID NO: 60657 - DNA, 25 bp, Mus musculus
aaggcctggatgtcttgcggcagat

SEQ ID NO: 60658 - DNA, 25 bp, Mus musculus
aaggcctggatgtgttcctctgtgc

SEQ ID NO: 60659 - DNA, 25 bp, Mus musculus
aaggcctggcagaacattcgtttga

SEQ ID NO: 60660 - DNA, 25 bp, Mus musculus
aaggcctggcagtacattcgtttga

SEQ ID NO: 60661 - DNA, 25 bp, Mus musculus
aaggcctggcggaagcagtcacgaa

SEQ ID NO: 60662 - DNA, 25 bp, Mus musculus
aaggcctggcggtagcagtcacgaa

SEQ ID NO: 60663 - DNA, 25 bp, Mus musculus
aaggcctgggatccctttgtccaga

SEQ ID NO: 60664 - DNA, 25 bp, Mus musculus
aaggcctgggatgcctttgtccaga

SEQ ID NO: 60665 - DNA, 25 bp, Mus musculus
aaggcctgggtaatcctagctcaat

SEQ ID NO: 60666 - DNA, 25 bp, Mus musculus
aaggcctgggtattcctagctcaat

SEQ ID NO: 60667 - DNA, 25 bp, Mus musculus
aaggcctgggtcagagcacctggct

SEQ ID NO: 60668 - DNA, 25 bp, Mus musculus
aaggcctgggtctgagcacctggct

SEQ ID NO: 60669 - DNA, 25 bp, Mus musculus
aaggcctgggtgattacctgcttct

SEQ ID NO: 60670 - DNA, 25 bp, Mus musculus
aaggcctgggtgtttacctgcttct

SEQ ID NO: 60671 - DNA, 25 bp, Mus musculus
aaggcctgggttaatggcttcagct

SEQ ID NO: 60672 - DNA, 25 bp, Mus musculus
aaggcctgggttcgagggtctgcca

SEQ ID NO: 60673 - DNA, 25 bp, Mus musculus
aaggcctgggttggagggtctgcca

SEQ ID NO: 60674 - DNA, 25 bp, Mus musculus
aaggcctgggtttatggcttcagct

SEQ ID NO: 60675 - DNA, 25 bp, Mus musculus
aaggcctggtccagtgagatccctt

SEQ ID NO: 60676 - DNA, 25 bp, Mus musculus
aaggcctggtcctgtgagatccctt

SEQ ID NO: 60677 - DNA, 25 bp, Mus musculus
aaggcctggttcatcaaggccacga

SEQ ID NO: 60678 - DNA, 25 bp, Mus musculus
aaggcctggttcttcaaggccacga

SEQ ID NO: 60679 - DNA, 25 bp, Mus musculus
aaggcctggtttcagacaccatacg

SEQ ID NO: 60680 - DNA, 25 bp, Mus musculus
aaggcctggtttgagacaccatacg

SEQ ID NO: 60681 - DNA, 25 bp, Mus musculus
aaggcctgtactagcaaacacaccc

SEQ ID NO: 60682 - DNA, 25 bp, Mus musculus
aaggcctgtacttgcaaacacaccc

SEQ ID NO: 60683 - DNA, 25 bp, Mus musculus
aaggcctgtcttaggcttacaatga

SEQ ID NO: 60684 - DNA, 25 bp, Mus musculus
aaggcctgtctttggcttacaatga

SEQ ID NO: 60685 - DNA, 25 bp, Mus musculus
aaggcctgttatctttgcttaggtc

SEQ ID NO: 60686 - DNA, 25 bp, Mus musculus
aaggcctgttatgtttgcttaggtc

SEQ ID NO: 60687 - DNA, 25 bp, Mus musculus
aaggcctgttctccataggtgaaca

SEQ ID NO: 60688 - DNA, 25 bp, Mus musculus
aaggcctgttctgcataggtgaaca

SEQ ID NO: 60689 - DNA, 25 bp, Mus musculus
aaggcctgttgccttggttcagcct

SEQ ID NO: 60690 - DNA, 25 bp, Mus musculus
aaggcctgttgcgttggttcagcct

SEQ ID NO: 60691 - DNA, 25 bp, Mus musculus
aaggccttaaatagtcttcagtgac

SEQ ID NO: 60692 - DNA, 25 bp, Mus musculus
aaggccttaaattgtcttcagtgac

SEQ ID NO: 60693 - DNA, 25 bp, Mus musculus
aaggccttaagcagcctgcagactt

SEQ ID NO: 60694 - DNA, 25 bp, Mus musculus
aaggccttaagctgcctgcagactt

SEQ ID NO: 60695 - DNA, 25 bp, Mus musculus
aaggccttaccacattattcacaca

SEQ ID NO: 60696 - DNA, 25 bp, Mus musculus
aaggccttaccagattattcacaca

SEQ ID NO: 60697 - DNA, 25 bp, Mus musculus
aaggccttagatcggaaattgcagg

SEQ ID NO: 60698 - DNA, 25 bp, Mus musculus
aaggccttagatgggaaattgcagg

SEQ ID NO: 60699 - DNA, 25 bp, Mus musculus
aaggccttagtcattgacacatcat

SEQ ID NO: 60700 - DNA, 25 bp, Mus musculus
aaggccttagtctttgacacatcat

SEQ ID NO: 60701 - DNA, 25 bp, Mus musculus
aaggccttagttctgattcccaggg

SEQ ID NO: 60702 - DNA, 25 bp, Mus musculus
aaggccttagttgtgattcccaggg

SEQ ID NO: 60703 - DNA, 25 bp, Mus musculus
aaggccttatgcctggacggtgtac

SEQ ID NO: 60704 - DNA, 25 bp, Mus musculus
aaggccttatgcgtggacggtgtac

SEQ ID NO: 60705 - DNA, 25 bp, Mus musculus
aaggccttatgtccctccatgtgtt

SEQ ID NO: 60706 - DNA, 25 bp, Mus musculus
aaggccttatgtgcctccatgtgtt

SEQ ID NO: 60707 - DNA, 25 bp, Mus musculus
aaggccttcagcagcattgaccaga

SEQ ID NO: 60708 - DNA, 25 bp, Mus musculus
aaggccttcagctgcattgaccaga

SEQ ID NO: 60709 - DNA, 25 bp, Mus musculus
aaggccttcagtccttcagtcttta

SEQ ID NO: 60710 - DNA, 25 bp, Mus musculus
aaggccttcagtgcttcagtcttta

SEQ ID NO: 60711 - DNA, 25 bp, Mus musculus
aaggccttcatcactgctgccaaag

SEQ ID NO: 60712 - DNA, 25 bp, Mus musculus
aaggccttcatctctgctgccaaag

SEQ ID NO: 60713 - DNA, 25 bp, Mus musculus
aaggccttcatgcaactggatttta

SEQ ID NO: 60714 - DNA, 25 bp, Mus musculus
aaggccttcatgcactcctacacaa

SEQ ID NO: 60715 - DNA, 25 bp, Mus musculus
aaggccttcatggaactggatttta

SEQ ID NO: 60716 - DNA, 25 bp, Mus musculus
aaggccttcatggactcctacacaa

SEQ ID NO: 60717 - DNA, 25 bp, Mus musculus
aaggccttccagctctccaaggctg

SEQ ID NO: 60718 - DNA, 25 bp, Mus musculus
aaggccttccaggtctccaaggctg

SEQ ID NO: 60719 - DNA, 25 bp, Mus musculus
aaggccttccatcagagctctcggc

SEQ ID NO: 60720 - DNA, 25 bp, Mus musculus
aaggccttccatgagagctctcggc

SEQ ID NO: 60721 - DNA, 25 bp, Mus musculus
aaggccttccgacacgtcaaggttg

SEQ ID NO: 60722 - DNA, 25 bp, Mus musculus
aaggccttccgagacgtcaaggttg

SEQ ID NO: 60723 - DNA, 25 bp, Mus musculus
aaggccttccgcaaggagctacaga

SEQ ID NO: 60724 - DNA, 25 bp, Mus musculus
aaggccttccgctaggagctacaga

SEQ ID NO: 60725 - DNA, 25 bp, Mus musculus
aaggccttcctacctctggaggtga

SEQ ID NO: 60726 - DNA, 25 bp, Mus musculus
aaggccttcctagctctggaggtga

SEQ ID NO: 60727 - DNA, 25 bp, Mus musculus
aaggccttcctgcagcgatatttgg

SEQ ID NO: 60728 - DNA, 25 bp, Mus musculus
aaggccttcctggagcgatatttgg

SEQ ID NO: 60729 - DNA, 25 bp, Mus musculus
aaggccttcgatatcattctccttg

SEQ ID NO: 60730 - DNA, 25 bp, Mus musculus
aaggccttcgatttcattctccttg

SEQ ID NO: 60731 - DNA, 25 bp, Mus musculus
aaggccttcggtcatggctcgttgc

SEQ ID NO: 60732 - DNA, 25 bp, Mus musculus
aaggccttcggtgatggctcgttgc

SEQ ID NO: 60733 - DNA, 25 bp, Mus musculus
aaggccttctatagagtcccccaga

SEQ ID NO: 60734 - DNA, 25 bp, Mus musculus
aaggccttctattgagtcccccaga

SEQ ID NO: 60735 - DNA, 25 bp, Mus musculus
aaggccttctccacagagtctcaaa

SEQ ID NO: 60736 - DNA, 25 bp, Mus musculus
aaggccttctcctcagagtctcaaa

SEQ ID NO: 60737 - DNA, 25 bp, Mus musculus
aaggccttctctcttaattttgtat

SEQ ID NO: 60738 - DNA, 25 bp, Mus musculus
aaggccttctctgttaattttgtat

SEQ ID NO: 60739 - DNA, 25 bp, Mus musculus
aaggccttctgtccagacatcttat

SEQ ID NO: 60740 - DNA, 25 bp, Mus musculus
aaggccttctgtgcagacatcttat

SEQ ID NO: 60741 - DNA, 25 bp, Mus musculus
aaggccttcttcagtggcaggctga

SEQ ID NO: 60742 - DNA, 25 bp, Mus musculus
aaggccttcttctgtggcaggctga

SEQ ID NO: 60743 - DNA, 25 bp, Mus musculus
aaggccttgaacacagacttcccta

SEQ ID NO: 60744 - DNA, 25 bp, Mus musculus
aaggccttgaactcagacttcccta

SEQ ID NO: 60745 - DNA, 25 bp, Mus musculus
aaggccttgagcagatccagcctgg

SEQ ID NO: 60746 - DNA, 25 bp, Mus musculus
aaggccttgagctgatccagcctgg

SEQ ID NO: 60747 - DNA, 25 bp, Mus musculus
aaggccttgatgaacgacatggtca

SEQ ID NO: 60748 - DNA, 25 bp, Mus musculus
aaggccttgatgtacgacatggtca

SEQ ID NO: 60749 - DNA, 25 bp, Mus musculus
aaggccttgcttcaccatttaattt

SEQ ID NO: 60750 - DNA, 25 bp, Mus musculus
aaggccttgcttgaccatttaattt

SEQ ID NO: 60751 - DNA, 25 bp, Mus musculus
aaggccttggcacggaccactggaa

SEQ ID NO: 60752 - DNA, 25 bp, Mus musculus
aaggccttggcagggaccactggaa

SEQ ID NO: 60753 - DNA, 25 bp, Mus musculus
aaggccttgggcctgaacactgtcg

SEQ ID NO: 60754 - DNA, 25 bp, Mus musculus
aaggccttgggcgtgaacactgtcg

SEQ ID NO: 60755 - DNA, 25 bp, Mus musculus
aaggcctttactccagagcagggtg

SEQ ID NO: 60756 - DNA, 25 bp, Mus musculus
aaggcctttactgcagagcagggtg

SEQ ID NO: 60757 - DNA, 25 bp, Mus musculus
aaggcctttatgattatcacttgca

SEQ ID NO: 60758 - DNA, 25 bp, Mus musculus
aaggcctttatgtttatcacttgca

SEQ ID NO: 60759 - DNA, 25 bp, Mus musculus
aaggcctttcagcatgtgtgttgct

SEQ ID NO: 60760 - DNA, 25 bp, Mus musculus
aaggcctttcaggatgtgtgttgct

SEQ ID NO: 60761 - DNA, 25 bp, Mus musculus
aaggcctttccaaatggtctgagca

SEQ ID NO: 60762 - DNA, 25 bp, Mus musculus
aaggcctttccatatggtctgagca

SEQ ID NO: 60763 - DNA, 25 bp, Mus musculus
aaggcctttctgaatgttgtcaccg

SEQ ID NO: 60764 - DNA, 25 bp, Mus musculus
aaggcctttctgtatgttgtcaccg

SEQ ID NO: 60765 - DNA, 25 bp, Mus musculus
aaggcctttcttaggcacatctatc

SEQ ID NO: 60766 - DNA, 25 bp, Mus musculus
aaggcctttctttggcacatctatc

SEQ ID NO: 60767 - DNA, 25 bp, Mus musculus
aaggcctttgcactttacgtggtga

SEQ ID NO: 60768 - DNA, 25 bp, Mus musculus
aaggcctttgcagtttacgtggtga

SEQ ID NO: 60769 - DNA, 25 bp, Mus musculus
aaggcctttgtactatcccagagtc

SEQ ID NO: 60770 - DNA, 25 bp, Mus musculus
aaggcctttgtagtatcccagagtc

SEQ ID NO: 60771 - DNA, 25 bp, Mus musculus
aaggcgaatcttaccaacgcgtccg

SEQ ID NO: 60772 - DNA, 25 bp, Mus musculus
aaggcgaatctttccaacgcgtccg

SEQ ID NO: 60773 - DNA, 25 bp, Mus musculus
aaggcgactcagacctctcagagac

SEQ ID NO: 60774 - DNA, 25 bp, Mus musculus
aaggcgactcagtcctctcagagac

SEQ ID NO: 60775 - DNA, 25 bp, Mus musculus
aaggcgactgctcaacacactcagg

SEQ ID NO: 60776 - DNA, 25 bp, Mus musculus
aaggcgactgctgaacacactcagg

SEQ ID NO: 60777 - DNA, 25 bp, Mus musculus
aaggcgactgtgcactccagtgtaa

SEQ ID NO: 60778 - DNA, 25 bp, Mus musculus
aaggcgactgtggactccagtgtaa

SEQ ID NO: 60779 - DNA, 25 bp, Mus musculus
aaggcgagaaccaacttccacaagt

SEQ ID NO: 60780 - DNA, 25 bp, Mus musculus
aaggcgagaacctacttccacaagt

SEQ ID NO: 60781 - DNA, 25 bp, Mus musculus
aaggcgagccccaaaagggcagcct

SEQ ID NO: 60782 - DNA, 25 bp, Mus musculus
aaggcgagcccctaaagggcagcct

SEQ ID NO: 60783 - DNA, 25 bp, Mus musculus
aaggcgagctgaacgatgactatcc

SEQ ID NO: 60784 - DNA, 25 bp, Mus musculus
aaggcgagctgatcgatgactatcc

SEQ ID NO: 60785 - DNA, 25 bp, Mus musculus
aaggcgaggatactatccgtttcca

SEQ ID NO: 60786 - DNA, 25 bp, Mus musculus
aaggcgaggatagtatccgtttcca

SEQ ID NO: 60787 - DNA, 25 bp, Mus musculus
aaggcgatactgacggtttcagcaa

SEQ ID NO: 60788 - DNA, 25 bp, Mus musculus
aaggcgatactgtcggtttcagcaa

SEQ ID NO: 60789 - DNA, 25 bp, Mus musculus
aaggcgatcatcatggacacagttt

SEQ ID NO: 60790 - DNA, 25 bp, Mus musculus
aaggcgatcatcttggacacagttt

SEQ ID NO: 60791 - DNA, 25 bp, Mus musculus
aaggcgatccagagaatcccgggaa

SEQ ID NO: 60792 - DNA, 25 bp, Mus musculus
aaggcgatccagtgaatcccgggaa

SEQ ID NO: 60793 - DNA, 25 bp, Mus musculus
aaggcgatgactataaccccatagc

SEQ ID NO: 60794 - DNA, 25 bp, Mus musculus
aaggcgatgactttaaccccatagc

SEQ ID NO: 60795 - DNA, 25 bp, Mus musculus
aaggcgatgcctattgacatgtcct

SEQ ID NO: 60796 - DNA, 25 bp, Mus musculus
aaggcgatgccttttgacatgtcct

SEQ ID NO: 60797 - DNA, 25 bp, Mus musculus
aaggcgatgttccacagtacggttt

SEQ ID NO: 60798 - DNA, 25 bp, Mus musculus
aaggcgatgttcgacagtacggttt

SEQ ID NO: 60799 - DNA, 25 bp, Mus musculus
aaggcgattacgaatcatatttttt

SEQ ID NO: 60800 - DNA, 25 bp, Mus musculus
aaggcgattacgtatcatatttttt

SEQ ID NO: 60801 - DNA, 25 bp, Mus musculus
aaggcgcaagccactgaacattgac

SEQ ID NO: 60802 - DNA, 25 bp, Mus musculus
aaggcgcaagcctctgaacattgac

SEQ ID NO: 60803 - DNA, 25 bp, Mus musculus
aaggcgcaggcgatagccattgaga

SEQ ID NO: 60804 - DNA, 25 bp, Mus musculus
aaggcgcaggcgttagccattgaga

SEQ ID NO: 60805 - DNA, 25 bp, Mus musculus
aaggcgcagttcctacattcacgtt

SEQ ID NO: 60806 - DNA, 25 bp, Mus musculus
aaggcgcagttcgtacattcacgtt

SEQ ID NO: 60807 - DNA, 25 bp, Mus musculus
aaggcgccaagcatagcagtgtgat

SEQ ID NO: 60808 - DNA, 25 bp, Mus musculus
aaggcgccaagcttagcagtgtgat

SEQ ID NO: 60809 - DNA, 25 bp, Mus musculus
aaggcgccactcctgtcttgtaatg

SEQ ID NO: 60810 - DNA, 25 bp, Mus musculus
aaggcgccactcgtgtcttgtaatg

SEQ ID NO: 60811 - DNA, 25 bp, Mus musculus
aaggcgcccgaaccattgttgagtg

SEQ ID NO: 60812 - DNA, 25 bp, Mus musculus
aaggcgcccgaagcattgttgagtg

SEQ ID NO: 60813 - DNA, 25 bp, Mus musculus
aaggcgcctctgaacttttcatgaa

SEQ ID NO: 60814 - DNA, 25 bp, Mus musculus
aaggcgcctctgtacttttcatgaa

SEQ ID NO: 60815 - DNA, 25 bp, Mus musculus
aaggcgcctgatagcttgtttgtac

SEQ ID NO: 60816 - DNA, 25 bp, Mus musculus
aaggcgcctgattgcttgtttgtac

SEQ ID NO: 60817 - DNA, 25 bp, Mus musculus
aaggcgcctggtacatcataccgat

SEQ ID NO: 60818 - DNA, 25 bp, Mus musculus
aaggcgcctggttcatcataccgat

SEQ ID NO: 60819 - DNA, 25 bp, Mus musculus
aaggcgcctttcctgtactatggtt

SEQ ID NO: 60820 - DNA, 25 bp, Mus musculus
aaggcgcctttcgtgtactatggtt

SEQ ID NO: 60821 - DNA, 25 bp, Mus musculus
aaggcgcgagacatcttgtgaggaa

SEQ ID NO: 60822 - DNA, 25 bp, Mus musculus
aaggcgcgagacttcttgtgaggaa

SEQ ID NO: 60823 - DNA, 25 bp, Mus musculus
aaggcgcgcggtagttgctattgca

SEQ ID NO: 60824 - DNA, 25 bp, Mus musculus
aaggcgcgcggttgttgctattgca

SEQ ID NO: 60825 - DNA, 25 bp, Mus musculus
aaggcgctaattcaataagacagag

SEQ ID NO: 60826 - DNA, 25 bp, Mus musculus
aaggcgctaattgaataagacagag

SEQ ID NO: 60827 - DNA, 25 bp, Mus musculus
aaggcgctaccactagtcccagaag

SEQ ID NO: 60828 - DNA, 25 bp, Mus musculus
aaggcgctaccagtagtcccagaag

SEQ ID NO: 60829 - DNA, 25 bp, Mus musculus
aaggcgctcgagcacacagtctcca

SEQ ID NO: 60830 - DNA, 25 bp, Mus musculus
aaggcgctcgaggacacagtctcca

SEQ ID NO: 60831 - DNA, 25 bp, Mus musculus
aaggcgctctggcaacactctgctc

SEQ ID NO: 60832 - DNA, 25 bp, Mus musculus
aaggcgctctgggaacactctgctc

SEQ ID NO: 60833 - DNA, 25 bp, Mus musculus
aaggcgctgaggcagccatttcttt

SEQ ID NO: 60834 - DNA, 25 bp, Mus musculus
aaggcgctgagggagccatttcttt

SEQ ID NO: 60835 - DNA, 25 bp, Mus musculus
aaggcgctgccgatcacgtgaaaaa

SEQ ID NO: 60836 - DNA, 25 bp, Mus musculus
aaggcgctgccgttcacgtgaaaaa

SEQ ID NO: 60837 - DNA, 25 bp, Mus musculus
aaggcgctggccacattgcatgggc

SEQ ID NO: 60838 - DNA, 25 bp, Mus musculus
aaggcgctggcctcattgcatgggc

SEQ ID NO: 60839 - DNA, 25 bp, Mus musculus
aaggcgcttccaccatcaaaatgag

SEQ ID NO: 60840 - DNA, 25 bp, Mus musculus
aaggcgcttccagcatcaaaatgag

SEQ ID NO: 60841 - DNA, 25 bp, Mus musculus
aaggcgcttcgtcactttgccctac

SEQ ID NO: 60842 - DNA, 25 bp, Mus musculus
aaggcgcttcgtgactttgccctac

SEQ ID NO: 60843 - DNA, 25 bp, Mus musculus
aaggcggaacatccatgtccactct

SEQ ID NO: 60844 - DNA, 25 bp, Mus musculus
aaggcggaacatgcatgtccactct

SEQ ID NO: 60845 - DNA, 25 bp, Mus musculus
aaggcggaaggaactgtcgtcccac

SEQ ID NO: 60846 - DNA, 25 bp, Mus musculus
aaggcggaaggatctgtcgtcccac

SEQ ID NO: 60847 - DNA, 25 bp, Mus musculus
aaggcggacgctatgtttccagaga

SEQ ID NO: 60848 - DNA, 25 bp, Mus musculus
aaggcggacgctttgtttccagaga

SEQ ID NO: 60849 - DNA, 25 bp, Mus musculus
aaggcggagactaggtatcccactc

SEQ ID NO: 60850 - DNA, 25 bp, Mus musculus
aaggcggagacttggtatcccactc

SEQ ID NO: 60851 - DNA, 25 bp, Mus musculus
aaggcggaggagacactcctgccgc

SEQ ID NO: 60852 - DNA, 25 bp, Mus musculus
aaggcggaggagtcactcctgccgc

SEQ ID NO: 60853 - DNA, 25 bp, Mus musculus
aaggcggataagacccagcagaata

SEQ ID NO: 60854 - DNA, 25 bp, Mus musculus
aaggcggataagtcccagcagaata

SEQ ID NO: 60855 - DNA, 25 bp, Mus musculus
aaggcggatatcactgccaacatct

SEQ ID NO: 60856 - DNA, 25 bp, Mus musculus
aaggcggatatctctgccaacatct

SEQ ID NO: 60857 - DNA, 25 bp, Mus musculus
aaggcggcacagaagccacagcgcg

SEQ ID NO: 60858 - DNA, 25 bp, Mus musculus
aaggcggcacagtagccacagcgcg

SEQ ID NO: 60859 - DNA, 25 bp, Mus musculus
aaggcggcagtgaactctttttgtt

SEQ ID NO: 60860 - DNA, 25 bp, Mus musculus
aaggcggcagtgtactctttttgtt

SEQ ID NO: 60861 - DNA, 25 bp, Mus musculus
aaggcggccacacaaccatctggac

SEQ ID NO: 60862 - DNA, 25 bp, Mus musculus
aaggcggccacagaaccatctggac

SEQ ID NO: 60863 - DNA, 25 bp, Mus musculus
aaggcggccgtgaaatctgagcaca

SEQ ID NO: 60864 - DNA, 25 bp, Mus musculus
aaggcggccgtgtaatctgagcaca

SEQ ID NO: 60865 - DNA, 25 bp, Mus musculus
aaggcggcctcacatgctgtctgtg

SEQ ID NO: 60866 - DNA, 25 bp, Mus musculus
aaggcggcctcagatgctgtctgtg

SEQ ID NO: 60867 - DNA, 25 bp, Mus musculus
aaggcggcgcagcaacaactgcagc

SEQ ID NO: 60868 - DNA, 25 bp, Mus musculus
aaggcggcgcaggaacaactgcagc

SEQ ID NO: 60869 - DNA, 25 bp, Mus musculus
aaggcggcggccaagaaggattgat

SEQ ID NO: 60870 - DNA, 25 bp, Mus musculus
aaggcggcggcctagaaggattgat

SEQ ID NO: 60871 - DNA, 25 bp, Mus musculus
aaggcggcgtctcagctctacatag

SEQ ID NO: 60872 - DNA, 25 bp, Mus musculus
aaggcggcgtctgagctctacatag

SEQ ID NO: 60873 - DNA, 25 bp, Mus musculus
aaggcggctaatccaagaggccaaa

SEQ ID NO: 60874 - DNA, 25 bp, Mus musculus
aaggcggctaatgcaagaggccaaa

SEQ ID NO: 60875 - DNA, 25 bp, Mus musculus
aaggcggctatgaggtccttaacat

SEQ ID NO: 60876 - DNA, 25 bp, Mus musculus
aaggcggctatgtggtccttaacat

SEQ ID NO: 60877 - DNA, 25 bp, Mus musculus
aaggcggctccaagtcccagaaggg

SEQ ID NO: 60878 - DNA, 25 bp, Mus musculus
aaggcggctccacgatgttatacaa

SEQ ID NO: 60879 - DNA, 25 bp, Mus musculus
aaggcggctccaggatgttatacaa

SEQ ID NO: 60880 - DNA, 25 bp, Mus musculus
aaggcggctccatgtcccagaaggg

SEQ ID NO: 60881 - DNA, 25 bp, Mus musculus
aaggcggctccgcaagcctcaggac

SEQ ID NO: 60882 - DNA, 25 bp, Mus musculus
aaggcggctccggaagcctcaggac

SEQ ID NO: 60883 - DNA, 25 bp, Mus musculus
aaggcggctgttatagcttggagct

SEQ ID NO: 60884 - DNA, 25 bp, Mus musculus
aaggcggctgttttagcttggagct

SEQ ID NO: 60885 - DNA, 25 bp, Mus musculus
aaggcgggagtacctgcactctact

SEQ ID NO: 60886 - DNA, 25 bp, Mus musculus
aaggcgggagtagctgcactctact

SEQ ID NO: 60887 - DNA, 25 bp, Mus musculus
aaggcgggcacaacgctggaaccaa

SEQ ID NO: 60888 - DNA, 25 bp, Mus musculus
aaggcgggcacatcgctggaaccaa

SEQ ID NO: 60889 - DNA, 25 bp, Mus musculus
aaggcgggcattctgtaatcccagc

SEQ ID NO: 60890 - DNA, 25 bp, Mus musculus
aaggcgggcattgtgtaatcccagc

SEQ ID NO: 60891 - DNA, 25 bp, Mus musculus
aaggcgggccccatgaccaagagac

SEQ ID NO: 60892 - DNA, 25 bp, Mus musculus
aaggcgggccccttgaccaagagac

SEQ ID NO: 60893 - DNA, 25 bp, Mus musculus
aaggcggtcagcaacaagctcccaa

SEQ ID NO: 60894 - DNA, 25 bp, Mus musculus
aaggcggtcagctacaagctcccaa

SEQ ID NO: 60895 - DNA, 25 bp, Mus musculus
aaggcggtcttcaggtggtatctgt

SEQ ID NO: 60896 - DNA, 25 bp, Mus musculus
aaggcggtcttctggtggtatctgt

SEQ ID NO: 60897 - DNA, 25 bp, Mus musculus
aaggcggtgatcactttgattctga

SEQ ID NO: 60898 - DNA, 25 bp, Mus musculus
aaggcggtgatctctttgattctga

SEQ ID NO: 60899 - DNA, 25 bp, Mus musculus
aaggcggtgctgaaaggcgtccaca

SEQ ID NO: 60900 - DNA, 25 bp, Mus musculus
aaggcggtgctgtaaggcgtccaca

SEQ ID NO: 60901 - DNA, 25 bp, Mus musculus
aaggcggttgctagactggactcca

SEQ ID NO: 60902 - DNA, 25 bp, Mus musculus
aaggcggttgcttgactggactcca

SEQ ID NO: 60903 - DNA, 25 bp, Mus musculus
aaggcgtatcgacgacactggcccg

SEQ ID NO: 60904 - DNA, 25 bp, Mus musculus
aaggcgtatcgaggacactggcccg

SEQ ID NO: 60905 - DNA, 25 bp, Mus musculus
aaggcgtcacagacttggatggctc

SEQ ID NO: 60906 - DNA, 25 bp, Mus musculus
aaggcgtcacagtcttggatggctc

SEQ ID NO: 60907 - DNA, 25 bp, Mus musculus
aaggcgtcactacactctcctggga

SEQ ID NO: 60908 - DNA, 25 bp, Mus musculus
aaggcgtcactagactctcctggga

SEQ ID NO: 60909 - DNA, 25 bp, Mus musculus
aaggcgtcagcaagcatcagggcct

SEQ ID NO: 60910 - DNA, 25 bp, Mus musculus
aaggcgtcagcatgcatcagggcct

SEQ ID NO: 60911 - DNA, 25 bp, Mus musculus
aaggcgtccaccaacaattgtttgt

SEQ ID NO: 60912 - DNA, 25 bp, Mus musculus
aaggcgtccacctacaattgtttgt

SEQ ID NO: 60913 - DNA, 25 bp, Mus musculus
aaggcgtcctgtataaccagttcct

SEQ ID NO: 60914 - DNA, 25 bp, Mus musculus
aaggcgtcctgtttaaccagttcct

SEQ ID NO: 60915 - DNA, 25 bp, Mus musculus
aaggcgtctaagatcaagaagccat

SEQ ID NO: 60916 - DNA, 25 bp, Mus musculus
aaggcgtctaagttcaagaagccat

SEQ ID NO: 60917 - DNA, 25 bp, Mus musculus
aaggcgtctcatactgaaagttcat

SEQ ID NO: 60918 - DNA, 25 bp, Mus musculus
aaggcgtctcattctgaaagttcat

SEQ ID NO: 60919 - DNA, 25 bp, Mus musculus
aaggcgtcttgcacagtgcctggca

SEQ ID NO: 60920 - DNA, 25 bp, Mus musculus
aaggcgtcttgctcagtgcctggca

SEQ ID NO: 60921 - DNA, 25 bp, Mus musculus
aaggcgtgcactacctggcttgact

SEQ ID NO: 60922 - DNA, 25 bp, Mus musculus
aaggcgtgcacttcctggcttgact

SEQ ID NO: 60923 - DNA, 25 bp, Mus musculus
aaggcgtgcatcattgtagtgtgtg

SEQ ID NO: 60924 - DNA, 25 bp, Mus musculus
aaggcgtgcatctttgtagtgtgtg

SEQ ID NO: 60925 - DNA, 25 bp, Mus musculus
aaggcgtgcattagccacttgtctt

SEQ ID NO: 60926 - DNA, 25 bp, Mus musculus
aaggcgtgcatttgccacttgtctt

SEQ ID NO: 60927 - DNA, 25 bp, Mus musculus
aaggcgtgctctagttcccgtctgg

SEQ ID NO: 60928 - DNA, 25 bp, Mus musculus
aaggcgtgctcttgttcccgtctgg

SEQ ID NO: 60929 - DNA, 25 bp, Mus musculus
aaggcgtggaatcttctacagaagc

SEQ ID NO: 60930 - DNA, 25 bp, Mus musculus
aaggcgtggaatgttctacagaagc

SEQ ID NO: 60931 - DNA, 25 bp, Mus musculus
aaggcgtgtcagcagctctttacaa

SEQ ID NO: 60932 - DNA, 25 bp, Mus musculus
aaggcgtgtcaggagctctttacaa

SEQ ID NO: 60933 - DNA, 25 bp, Mus musculus
aaggcgtgtttgatattattactga

SEQ ID NO: 60934 - DNA, 25 bp, Mus musculus
aaggcgtgtttgttattattactga

SEQ ID NO: 60935 - DNA, 25 bp, Mus musculus
aaggcgttcaccaaagagcttagac

SEQ ID NO: 60936 - DNA, 25 bp, Mus musculus
aaggcgttcacctaagagcttagac

SEQ ID NO: 60937 - DNA, 25 bp, Mus musculus
aaggcgttcatcacacaagtggaaa

SEQ ID NO: 60938 - DNA, 25 bp, Mus musculus
aaggcgttcatctcacaagtggaaa

SEQ ID NO: 60939 - DNA, 25 bp, Mus musculus
aaggcgttcctcacattagctgaag

SEQ ID NO: 60940 - DNA, 25 bp, Mus musculus
aaggcgttcctctcattagctgaag

SEQ ID NO: 60941 - DNA, 25 bp, Mus musculus
aaggcgttctggacccacgagggat

SEQ ID NO: 60942 - DNA, 25 bp, Mus musculus
aaggcgttctggtcccacgagggat

SEQ ID NO: 60943 - DNA, 25 bp, Mus musculus
aaggcgtttcttaccatgtactgca

SEQ ID NO: 60944 - DNA, 25 bp, Mus musculus
aaggcgtttctttccatgtactgca

SEQ ID NO: 60945 - DNA, 25 bp, Mus musculus
aaggcgttttgacacatgttaggac

SEQ ID NO: 60946 - DNA, 25 bp, Mus musculus
aaggcgttttgagacatgttaggac

SEQ ID NO: 60947 - DNA, 25 bp, Mus musculus
aaggctaaactcacaacactccata

SEQ ID NO: 60948 - DNA, 25 bp, Mus musculus
aaggctaaactctcaacactccata

SEQ ID NO: 60949 - DNA, 25 bp, Mus musculus
aaggctaaactgatgtcctggccac

SEQ ID NO: 60950 - DNA, 25 bp, Mus musculus
aaggctaaactgttgtcctggccac

SEQ ID NO: 60951 - DNA, 25 bp, Mus musculus
aaggctaaatttccactctccccaa

SEQ ID NO: 60952 - DNA, 25 bp, Mus musculus
aaggctaaatttgcactctccccaa

SEQ ID NO: 60953 - DNA, 25 bp, Mus musculus
aaggctaaccacacaaaattgatct

SEQ ID NO: 60954 - DNA, 25 bp, Mus musculus
aaggctaaccactcaaaattgatct

SEQ ID NO: 60955 - DNA, 25 bp, Mus musculus
aaggctaaccccattacagtggatt

SEQ ID NO: 60956 - DNA, 25 bp, Mus musculus
aaggctaacccctttacagtggatt

SEQ ID NO: 60957 - DNA, 25 bp, Mus musculus
aaggctaaccggatggcagacaccc

SEQ ID NO: 60958 - DNA, 25 bp, Mus musculus
aaggctaaccggttggcagacaccc

SEQ ID NO: 60959 - DNA, 25 bp, Mus musculus
aaggctaacggtctctgtgttcact

SEQ ID NO: 60960 - DNA, 25 bp, Mus musculus
aaggctaacggtgtctgtgttcact

SEQ ID NO: 60961 - DNA, 25 bp, Mus musculus
aaggctaactagcacctgcaacatc

SEQ ID NO: 60962 - DNA, 25 bp, Mus musculus
aaggctaactaggacctgcaacatc

SEQ ID NO: 60963 - DNA, 25 bp, Mus musculus
aaggctaagagacgaaacactaccg

SEQ ID NO: 60964 - DNA, 25 bp, Mus musculus
aaggctaagagaggaaacactaccg

SEQ ID NO: 60965 - DNA, 25 bp, Mus musculus
aaggctaagccaaaacgactctaat

SEQ ID NO: 60966 - DNA, 25 bp, Mus musculus
aaggctaagccataacgactctaat

SEQ ID NO: 60967 - DNA, 25 bp, Mus musculus
aaggctaagcctcattttgggctca

SEQ ID NO: 60968 - DNA, 25 bp, Mus musculus
aaggctaagcctgattttgggctca

SEQ ID NO: 60969 - DNA, 25 bp, Mus musculus
aaggctaagtatctcctgctctgct

SEQ ID NO: 60970 - DNA, 25 bp, Mus musculus
aaggctaagtatgtcctgctctgct

SEQ ID NO: 60971 - DNA, 25 bp, Mus musculus
aaggctaagttgattcattgaaatc

SEQ ID NO: 60972 - DNA, 25 bp, Mus musculus
aaggctaagttgtttcattgaaatc

SEQ ID NO: 60973 - DNA, 25 bp, Mus musculus
aaggctaatatgacctctctgcagc

SEQ ID NO: 60974 - DNA, 25 bp, Mus musculus
aaggctaatatgtcctctctgcagc

SEQ ID NO: 60975 - DNA, 25 bp, Mus musculus
aaggctaatggcacaaccgtccatg

SEQ ID NO: 60976 - DNA, 25 bp, Mus musculus
aaggctaatggctcaaccgtccatg

SEQ ID NO: 60977 - DNA, 25 bp, Mus musculus
aaggctaatttgagttgcctattaa

SEQ ID NO: 60978 - DNA, 25 bp, Mus musculus
aaggctaatttgtgttgcctattaa

SEQ ID NO: 60979 - DNA, 25 bp, Mus musculus
aaggctacaaacagtgctactccct

SEQ ID NO: 60980 - DNA, 25 bp, Mus musculus
aaggctacaaactgtgctactccct

SEQ ID NO: 60981 - DNA, 25 bp, Mus musculus
aaggctacaccaaagcactcactag

SEQ ID NO: 60982 - DNA, 25 bp, Mus musculus
aaggctacaccatagcactcactag

SEQ ID NO: 60983 - DNA, 25 bp, Mus musculus
aaggctacactcagacagcactggg

SEQ ID NO: 60984 - DNA, 25 bp, Mus musculus
aaggctacactctgacagcactggg

SEQ ID NO: 60985 - DNA, 25 bp, Mus musculus
aaggctacagcacgtgctgttttga

SEQ ID NO: 60986 - DNA, 25 bp, Mus musculus
aaggctacagcaggtgctgttttga

SEQ ID NO: 60987 - DNA, 25 bp, Mus musculus
aaggctacagccactgacttctgta

SEQ ID NO: 60988 - DNA, 25 bp, Mus musculus
aaggctacagcctctgacttctgta

SEQ ID NO: 60989 - DNA, 25 bp, Mus musculus
aaggctacagttcgtcgatggtgaa

SEQ ID NO: 60990 - DNA, 25 bp, Mus musculus
aaggctacagttggtcgatggtgaa

SEQ ID NO: 60991 - DNA, 25 bp, Mus musculus
aaggctacatgtacggaccctgtgt

SEQ ID NO: 60992 - DNA, 25 bp, Mus musculus
aaggctacatgttcggaccctgtgt

SEQ ID NO: 60993 - DNA, 25 bp, Mus musculus
aaggctaccacaccaaagcttcatt

SEQ ID NO: 60994 - DNA, 25 bp, Mus musculus
aaggctaccacagcaaagcttcatt

SEQ ID NO: 60995 - DNA, 25 bp, Mus musculus
aaggctaccagccatttttggtcca

SEQ ID NO: 60996 - DNA, 25 bp, Mus musculus
aaggctaccagcgatttttggtcca

SEQ ID NO: 60997 - DNA, 25 bp, Mus musculus
aaggctaccagtaatatttgctgtt

SEQ ID NO: 60998 - DNA, 25 bp, Mus musculus
aaggctaccagttatatttgctgtt

SEQ ID NO: 60999 - DNA, 25 bp, Mus musculus
aaggctaccgttaatgaggtcatct

SEQ ID NO: 61000 - DNA, 25 bp, Mus musculus
aaggctaccgtttatgaggtcatct

SEQ ID NO: 61001 - DNA, 25 bp, Mus musculus
aaggctacgagaaacaaggcattat

SEQ ID NO: 61002 - DNA, 25 bp, Mus musculus
aaggctacgagatacaaggcattat

SEQ ID NO: 61003 - DNA, 25 bp, Mus musculus
aaggctacgcccacaaaagcttctg

SEQ ID NO: 61004 - DNA, 25 bp, Mus musculus
aaggctacgccctcaaaagcttctg

SEQ ID NO: 61005 - DNA, 25 bp, Mus musculus
aaggctacggcacctgtcagcagcg

SEQ ID NO: 61006 - DNA, 25 bp, Mus musculus
aaggctacggcagctgtcagcagcg

SEQ ID NO: 61007 - DNA, 25 bp, Mus musculus
aaggctactactagcagatgcaccc

SEQ ID NO: 61008 - DNA, 25 bp, Mus musculus
aaggctactacttgcagatgcaccc

SEQ ID NO: 61009 - DNA, 25 bp, Mus musculus
aaggctactagaaacttgtgattgt

SEQ ID NO: 61010 - DNA, 25 bp, Mus musculus
aaggctactagaaattccattggtc

SEQ ID NO: 61011 - DNA, 25 bp, Mus musculus
aaggctactagatacttgtgattgt

SEQ ID NO: 61012 - DNA, 25 bp, Mus musculus
aaggctactagatattccattggtc

SEQ ID NO: 61013 - DNA, 25 bp, Mus musculus
aaggctactccaaaggcttccaatg

SEQ ID NO: 61014 - DNA, 25 bp, Mus musculus
aaggctactccataggcttccaatg

SEQ ID NO: 61015 - DNA, 25 bp, Mus musculus
aaggctactcggctgcagacattac

SEQ ID NO: 61016 - DNA, 25 bp, Mus musculus
aaggctactcgggtgcagacattac

SEQ ID NO: 61017 - DNA, 25 bp, Mus musculus
aaggctactggacggcaacttatac

SEQ ID NO: 61018 - DNA, 25 bp, Mus musculus
aaggctactggagggcaacttatac

SEQ ID NO: 61019 - DNA, 25 bp, Mus musculus
aaggctactgtacgctgttggttgt

SEQ ID NO: 61020 - DNA, 25 bp, Mus musculus
aaggctactgtaggctgttggttgt

SEQ ID NO: 61021 - DNA, 25 bp, Mus musculus
aaggctacttctcctaccacagggt

SEQ ID NO: 61022 - DNA, 25 bp, Mus musculus
aaggctacttctgctaccacagggt

SEQ ID NO: 61023 - DNA, 25 bp, Mus musculus
aaggctagaagaatattgccaaagc

SEQ ID NO: 61024 - DNA, 25 bp, Mus musculus
aaggctagaagattattgccaaagc

SEQ ID NO: 61025 - DNA, 25 bp, Mus musculus
aaggctagatgtattgccacttctt

SEQ ID NO: 61026 - DNA, 25 bp, Mus musculus
aaggctagatgttttgccacttctt

SEQ ID NO: 61027 - DNA, 25 bp, Mus musculus
aaggctagccccagaggtctcagtg

SEQ ID NO: 61028 - DNA, 25 bp, Mus musculus
aaggctagcccctgaggtctcagtg

SEQ ID NO: 61029 - DNA, 25 bp, Mus musculus
aaggctagccctcgacacttgagat

SEQ ID NO: 61030 - DNA, 25 bp, Mus musculus
aaggctagccctggacacttgagat

SEQ ID NO: 61031 - DNA, 25 bp, Mus musculus
aaggctagccgactcagaattgtta

SEQ ID NO: 61032 - DNA, 25 bp, Mus musculus
aaggctagccgagtcagaattgtta

SEQ ID NO: 61033 - DNA, 25 bp, Mus musculus
aaggctagcctcagcaagttagcaa

SEQ ID NO: 61034 - DNA, 25 bp, Mus musculus
aaggctagcctctgcaagttagcaa

SEQ ID NO: 61035 - DNA, 25 bp, Mus musculus
aaggctagcctgaggccaaccagtg

SEQ ID NO: 61036 - DNA, 25 bp, Mus musculus
aaggctagcctgtggccaaccagtg

SEQ ID NO: 61037 - DNA, 25 bp, Mus musculus
aaggctagcgccacagccccaggat

SEQ ID NO: 61038 - DNA, 25 bp, Mus musculus
aaggctagcgcctcagccccaggat

SEQ ID NO: 61039 - DNA, 25 bp, Mus musculus
aaggctaggcgtctggctcagcaac

SEQ ID NO: 61040 - DNA, 25 bp, Mus musculus
aaggctaggcgtgtggctcagcaac

SEQ ID NO: 61041 - DNA, 25 bp, Mus musculus
aaggctaggcttacagttggttgcg

SEQ ID NO: 61042 - DNA, 25 bp, Mus musculus
aaggctaggctttcagttggttgcg

SEQ ID NO: 61043 - DNA, 25 bp, Mus musculus
aaggctaggtcaaggcttcttcatg

SEQ ID NO: 61044 - DNA, 25 bp, Mus musculus
aaggctaggtcatggcttcttcatg

SEQ ID NO: 61045 - DNA, 25 bp, Mus musculus
aaggctagtctccagacagtggctc

SEQ ID NO: 61046 - DNA, 25 bp, Mus musculus
aaggctagtctcgagacagtggctc

SEQ ID NO: 61047 - DNA, 25 bp, Mus musculus
aaggctagtggcataattacttcaa

SEQ ID NO: 61048 - DNA, 25 bp, Mus musculus
aaggctagtggcttaattacttcaa

SEQ ID NO: 61049 - DNA, 25 bp, Mus musculus
aaggctagtttcctggcttcaggaa

SEQ ID NO: 61050 - DNA, 25 bp, Mus musculus
aaggctagtttcgtggcttcaggaa

SEQ ID NO: 61051 - DNA, 25 bp, Mus musculus
aaggctataaacctgcagcgctatg

SEQ ID NO: 61052 - DNA, 25 bp, Mus musculus
aaggctataaacgtgcagcgctatg

SEQ ID NO: 61053 - DNA, 25 bp, Mus musculus
aaggctatagccaaagctgttattt

SEQ ID NO: 61054 - DNA, 25 bp, Mus musculus
aaggctatagcctaagctgttattt

SEQ ID NO: 61055 - DNA, 25 bp, Mus musculus
aaggctatagttcgcattgatcaaa

SEQ ID NO: 61056 - DNA, 25 bp, Mus musculus
aaggctatagttggcattgatcaaa

SEQ ID NO: 61057 - DNA, 25 bp, Mus musculus
aaggctatatagcatgcatctggag

SEQ ID NO: 61058 - DNA, 25 bp, Mus musculus
aaggctatataggatgcatctggag

SEQ ID NO: 61059 - DNA, 25 bp, Mus musculus
aaggctatcacaaagtgggtttcaa

SEQ ID NO: 61060 - DNA, 25 bp, Mus musculus
aaggctatcacatagtgggtttcaa

SEQ ID NO: 61061 - DNA, 25 bp, Mus musculus
aaggctatcactcctggcagcaagt

SEQ ID NO: 61062 - DNA, 25 bp, Mus musculus
aaggctatcactgctggcagcaagt

SEQ ID NO: 61063 - DNA, 25 bp, Mus musculus
aaggctatcagacgcgttgtcctgg

SEQ ID NO: 61064 - DNA, 25 bp, Mus musculus
aaggctatcagaggcgttgtcctgg

SEQ ID NO: 61065 - DNA, 25 bp, Mus musculus
aaggctatcctaccaaaattagtgt

SEQ ID NO: 61066 - DNA, 25 bp, Mus musculus
aaggctatcctagcaaaattagtgt

SEQ ID NO: 61067 - DNA, 25 bp, Mus musculus
aaggctatcgcaatgctggtttggc

SEQ ID NO: 61068 - DNA, 25 bp, Mus musculus
aaggctatcgcattgctggtttggc

SEQ ID NO: 61069 - DNA, 25 bp, Mus musculus
aaggctatctctacagctcagatgt

SEQ ID NO: 61070 - DNA, 25 bp, Mus musculus
aaggctatctcttcagctcagatgt

SEQ ID NO: 61071 - DNA, 25 bp, Mus musculus
aaggctatctgtagtcattctcttc

SEQ ID NO: 61072 - DNA, 25 bp, Mus musculus
aaggctatctgttgtcattctcttc

SEQ ID NO: 61073 - DNA, 25 bp, Mus musculus
aaggctatggccaggcatttgctgc

SEQ ID NO: 61074 - DNA, 25 bp, Mus musculus
aaggctatggcctggcatttgctgc

SEQ ID NO: 61075 - DNA, 25 bp, Mus musculus
aaggctatggctatgagatcccaga

SEQ ID NO: 61076 - DNA, 25 bp, Mus musculus
aaggctatggctcctgctagaattg

SEQ ID NO: 61077 - DNA, 25 bp, Mus musculus
aaggctatggctgctgctagaattg

SEQ ID NO: 61078 - DNA, 25 bp, Mus musculus
aaggctatggctttgagatcccaga

SEQ ID NO: 61079 - DNA, 25 bp, Mus musculus
aaggctatggtgaagcgacgcccaa

SEQ ID NO: 61080 - DNA, 25 bp, Mus musculus
aaggctatggtgtagcgacgcccaa

SEQ ID NO: 61081 - DNA, 25 bp, Mus musculus
aaggctatgtccaaactgggtcttc

SEQ ID NO: 61082 - DNA, 25 bp, Mus musculus
aaggctatgtcctaactgggtcttc

SEQ ID NO: 61083 - DNA, 25 bp, Mus musculus
aaggctatgtgaaaggcccctttct

SEQ ID NO: 61084 - DNA, 25 bp, Mus musculus
aaggctatgtgataggcccctttct

SEQ ID NO: 61085 - DNA, 25 bp, Mus musculus
aaggctatgttgagtggtccaggtc

SEQ ID NO: 61086 - DNA, 25 bp, Mus musculus
aaggctatgttgtgtggtccaggtc

SEQ ID NO: 61087 - DNA, 25 bp, Mus musculus
aaggctatgtttctgaccggtccta

SEQ ID NO: 61088 - DNA, 25 bp, Mus musculus
aaggctatgtttgtgaccggtccta

SEQ ID NO: 61089 - DNA, 25 bp, Mus musculus
aaggctattcctaggtcatgtccac

SEQ ID NO: 61090 - DNA, 25 bp, Mus musculus
aaggctattccttggtcatgtccac

SEQ ID NO: 61091 - DNA, 25 bp, Mus musculus
aaggctattgatagctttgctccct

SEQ ID NO: 61092 - DNA, 25 bp, Mus musculus
aaggctattgattgctttgctccct

SEQ ID NO: 61093 - DNA, 25 bp, Mus musculus
aaggctatttagattggagtgacat

SEQ ID NO: 61094 - DNA, 25 bp, Mus musculus
aaggctatttagtttggagtgacat

SEQ ID NO: 61095 - DNA, 25 bp, Mus musculus
aaggctatttctagtctcttgaata

SEQ ID NO: 61096 - DNA, 25 bp, Mus musculus
aaggctatttcttgtctcttgaata

SEQ ID NO: 61097 - DNA, 25 bp, Mus musculus
aaggctattttccttggctctacaa

SEQ ID NO: 61098 - DNA, 25 bp, Mus musculus
aaggctattttcgttggctctacaa

SEQ ID NO: 61099 - DNA, 25 bp, Mus musculus
aaggctcaagcaccctcactgacgt

SEQ ID NO: 61100 - DNA, 25 bp, Mus musculus
aaggctcaagcagcctcactgacgt

SEQ ID NO: 61101 - DNA, 25 bp, Mus musculus
aaggctcaagggagctcacttaccc

SEQ ID NO: 61102 - DNA, 25 bp, Mus musculus
aaggctcaagggtgctcacttaccc

SEQ ID NO: 61103 - DNA, 25 bp, Mus musculus
aaggctcaatgcaagggctgctgtc

SEQ ID NO: 61104 - DNA, 25 bp, Mus musculus
aaggctcaatgctagggctgctgtc

SEQ ID NO: 61105 - DNA, 25 bp, Mus musculus
aaggctcaattccttgctgcttttc

SEQ ID NO: 61106 - DNA, 25 bp, Mus musculus
aaggctcaattcgttgctgcttttc

SEQ ID NO: 61107 - DNA, 25 bp, Mus musculus
aaggctcaccacacctttgttgtga

SEQ ID NO: 61108 - DNA, 25 bp, Mus musculus
aaggctcaccactcctttgttgtga

SEQ ID NO: 61109 - DNA, 25 bp, Mus musculus
aaggctcacctaacattgtaccagt

SEQ ID NO: 61110 - DNA, 25 bp, Mus musculus
aaggctcacctatcattgtaccagt

SEQ ID NO: 61111 - DNA, 25 bp, Mus musculus
aaggctcaccttcacgaggtccgag

SEQ ID NO: 61112 - DNA, 25 bp, Mus musculus
aaggctcaccttgacgaggtccgag

SEQ ID NO: 61113 - DNA, 25 bp, Mus musculus
aaggctcacgaaagacatggaaact

SEQ ID NO: 61114 - DNA, 25 bp, Mus musculus
aaggctcacgaatgacatggaaact

SEQ ID NO: 61115 - DNA, 25 bp, Mus musculus
aaggctcactcgatgaagctctaga

SEQ ID NO: 61116 - DNA, 25 bp, Mus musculus
aaggctcactcgttgaagctctaga

SEQ ID NO: 61117 - DNA, 25 bp, Mus musculus
aaggctcactggaacgttatctaat

SEQ ID NO: 61118 - DNA, 25 bp, Mus musculus
aaggctcactggagggttcctgaga

SEQ ID NO: 61119 - DNA, 25 bp, Mus musculus
aaggctcactggatcatttggaact

SEQ ID NO: 61120 - DNA, 25 bp, Mus musculus
aaggctcactggtacgttatctaat

SEQ ID NO: 61121 - DNA, 25 bp, Mus musculus
aaggctcactggtgggttcctgaga

SEQ ID NO: 61122 - DNA, 25 bp, Mus musculus
aaggctcactggttcatttggaact

SEQ ID NO: 61123 - DNA, 25 bp, Mus musculus
aaggctcagaaacacttcgtgacag

SEQ ID NO: 61124 - DNA, 25 bp, Mus musculus
aaggctcagaaagacttcgtgacag

SEQ ID NO: 61125 - DNA, 25 bp, Mus musculus
aaggctcagaaccaactacaccttt

SEQ ID NO: 61126 - DNA, 25 bp, Mus musculus
aaggctcagaacgaactacaccttt

SEQ ID NO: 61127 - DNA, 25 bp, Mus musculus
aaggctcagagaacagctccattga

SEQ ID NO: 61128 - DNA, 25 bp, Mus musculus
aaggctcagagatcagctccattga

SEQ ID NO: 61129 - DNA, 25 bp, Mus musculus
aaggctcagagtcttcatctcctac

SEQ ID NO: 61130 - DNA, 25 bp, Mus musculus
aaggctcagagtgttcatctcctac

SEQ ID NO: 61131 - DNA, 25 bp, Mus musculus
aaggctcagatcactttcacataaa

SEQ ID NO: 61132 - DNA, 25 bp, Mus musculus
aaggctcagatctctttcacataaa

SEQ ID NO: 61133 - DNA, 25 bp, Mus musculus
aaggctcagcaaatttatactccaa

SEQ ID NO: 61134 - DNA, 25 bp, Mus musculus
aaggctcagcaattttatactccaa

SEQ ID NO: 61135 - DNA, 25 bp, Mus musculus
aaggctcagcccagaaagttggcac

SEQ ID NO: 61136 - DNA, 25 bp, Mus musculus
aaggctcagccctgaaagttggcac

SEQ ID NO: 61137 - DNA, 25 bp, Mus musculus
aaggctcagcgcatatcaggtgaca

SEQ ID NO: 61138 - DNA, 25 bp, Mus musculus
aaggctcagcgcttatcaggtgaca

SEQ ID NO: 61139 - DNA, 25 bp, Mus musculus
aaggctcagctgctggtgattgccc

SEQ ID NO: 61140 - DNA, 25 bp, Mus musculus
aaggctcagctgcttctacctgaca

SEQ ID NO: 61141 - DNA, 25 bp, Mus musculus
aaggctcagctggtggtgattgccc

SEQ ID NO: 61142 - DNA, 25 bp, Mus musculus
aaggctcagctggttctacctgaca

SEQ ID NO: 61143 - DNA, 25 bp, Mus musculus
aaggctcaggacagttgtggtttct

SEQ ID NO: 61144 - DNA, 25 bp, Mus musculus
aaggctcaggactgttgtggtttct

SEQ ID NO: 61145 - DNA, 25 bp, Mus musculus
aaggctcaggatatcctcagctgac

SEQ ID NO: 61146 - DNA, 25 bp, Mus musculus
aaggctcaggatttcctcagctgac

SEQ ID NO: 61147 - DNA, 25 bp, Mus musculus
aaggctcaggcaacccacaggatat

SEQ ID NO: 61148 - DNA, 25 bp, Mus musculus
aaggctcaggcatcccacaggatat

SEQ ID NO: 61149 - DNA, 25 bp, Mus musculus
aaggctcagggcatcatcctcagca

SEQ ID NO: 61150 - DNA, 25 bp, Mus musculus
aaggctcagggcttcatcctcagca

SEQ ID NO: 61151 - DNA, 25 bp, Mus musculus
aaggctcaggtacgaactgtttcca

SEQ ID NO: 61152 - DNA, 25 bp, Mus musculus
aaggctcaggtaggaactgtttcca

SEQ ID NO: 61153 - DNA, 25 bp, Mus musculus
aaggctcagttccagatttctgcag

SEQ ID NO: 61154 - DNA, 25 bp, Mus musculus
aaggctcagttcgagatttctgcag

SEQ ID NO: 61155 - DNA, 25 bp, Mus musculus
aaggctcatcaaaaattcatcaggc

SEQ ID NO: 61156 - DNA, 25 bp, Mus musculus
aaggctcatcaataattcatcaggc

SEQ ID NO: 61157 - DNA, 25 bp, Mus musculus
aaggctcatgatacctttgagggtc

SEQ ID NO: 61158 - DNA, 25 bp, Mus musculus
aaggctcatgattcctttgagggtc

SEQ ID NO: 61159 - DNA, 25 bp, Mus musculus
aaggctcatggcacaactgtccagc

SEQ ID NO: 61160 - DNA, 25 bp, Mus musculus
aaggctcatggctcaactgtccagc

SEQ ID NO: 61161 - DNA, 25 bp, Mus musculus
aaggctcatggtaggatgtggccca

SEQ ID NO: 61162 - DNA, 25 bp, Mus musculus
aaggctcatggttggatgtggccca

SEQ ID NO: 61163 - DNA, 25 bp, Mus musculus
aaggctcattgcacaacggtactta

SEQ ID NO: 61164 - DNA, 25 bp, Mus musculus
aaggctcattgctcaacggtactta

SEQ ID NO: 61165 - DNA, 25 bp, Mus musculus
aaggctcattttacactgggaacaa

SEQ ID NO: 61166 - DNA, 25 bp, Mus musculus
aaggctcatttttcactgggaacaa

SEQ ID NO: 61167 - DNA, 25 bp, Mus musculus
aaggctccagaacctggcttctgaa

SEQ ID NO: 61168 - DNA, 25 bp, Mus musculus
aaggctccagaagctggcttctgaa

SEQ ID NO: 61169 - DNA, 25 bp, Mus musculus
aaggctccagctactttagcacaaa

SEQ ID NO: 61170 - DNA, 25 bp, Mus musculus
aaggctccagcttctttagcacaaa

SEQ ID NO: 61171 - DNA, 25 bp, Mus musculus
aaggctccagtgatttctatttcta

SEQ ID NO: 61172 - DNA, 25 bp, Mus musculus
aaggctccagtgttttctatttcta

SEQ ID NO: 61173 - DNA, 25 bp, Mus musculus
aaggctccataaaactaacaggcag

SEQ ID NO: 61174 - DNA, 25 bp, Mus musculus
aaggctccataatactaacaggcag

SEQ ID NO: 61175 - DNA, 25 bp, Mus musculus
aaggctccatccatcaggaggactg

SEQ ID NO: 61176 - DNA, 25 bp, Mus musculus
aaggctccatccttcaggaggactg

SEQ ID NO: 61177 - DNA, 25 bp, Mus musculus
aaggctcccacgaggcagactcctt

SEQ ID NO: 61178 - DNA, 25 bp, Mus musculus
aaggctcccacgtggcagactcctt

SEQ ID NO: 61179 - DNA, 25 bp, Mus musculus
aaggctcccatcctactggtaaagg

SEQ ID NO: 61180 - DNA, 25 bp, Mus musculus
aaggctcccatcgtactggtaaagg

SEQ ID NO: 61181 - DNA, 25 bp, Mus musculus
aaggctcccgacaacaactatgacg

SEQ ID NO: 61182 - DNA, 25 bp, Mus musculus
aaggctcccgactacaactatgacg

SEQ ID NO: 61183 - DNA, 25 bp, Mus musculus
aaggctcccttgacaaaggatcaaa

SEQ ID NO: 61184 - DNA, 25 bp, Mus musculus
aaggctcccttgtcaaaggatcaaa

SEQ ID NO: 61185 - DNA, 25 bp, Mus musculus
aaggctccgagcacaatgggtttga

SEQ ID NO: 61186 - DNA, 25 bp, Mus musculus
aaggctccgagctcaatgggtttga

SEQ ID NO: 61187 - DNA, 25 bp, Mus musculus
aaggctccgcacatagtattttctg

SEQ ID NO: 61188 - DNA, 25 bp, Mus musculus
aaggctccgcacttagtattttctg

SEQ ID NO: 61189 - DNA, 25 bp, Mus musculus
aaggctccggctaagaagcccttga

SEQ ID NO: 61190 - DNA, 25 bp, Mus musculus
aaggctccggcttagaagcccttga

SEQ ID NO: 61191 - DNA, 25 bp, Mus musculus
aaggctcctcaaagagcatcttgga

SEQ ID NO: 61192 - DNA, 25 bp, Mus musculus
aaggctcctcaatgagcatcttgga

SEQ ID NO: 61193 - DNA, 25 bp, Mus musculus
aaggctcctctaccatgcccagtgt

SEQ ID NO: 61194 - DNA, 25 bp, Mus musculus
aaggctcctctagcatgcccagtgt

SEQ ID NO: 61195 - DNA, 25 bp, Mus musculus
aaggctcctgacattgatccttatc

SEQ ID NO: 61196 - DNA, 25 bp, Mus musculus
aaggctcctgactttgatccttatc

SEQ ID NO: 61197 - DNA, 25 bp, Mus musculus
aaggctcctgtcaattccccttatt

SEQ ID NO: 61198 - DNA, 25 bp, Mus musculus
aaggctcctgtctattccccttatt

SEQ ID NO: 61199 - DNA, 25 bp, Mus musculus
aaggctccttaaaggctctttgtga

SEQ ID NO: 61200 - DNA, 25 bp, Mus musculus
aaggctccttaaatgtgcgcacgtg

SEQ ID NO: 61201 - DNA, 25 bp, Mus musculus
aaggctccttaatggctctttgtga

SEQ ID NO: 61202 - DNA, 25 bp, Mus musculus
aaggctccttaattgtgcgcacgtg

SEQ ID NO: 61203 - DNA, 25 bp, Mus musculus
aaggctccttgtctgggtccatcaa

SEQ ID NO: 61204 - DNA, 25 bp, Mus musculus
aaggctccttgtgtgggtccatcaa

SEQ ID NO: 61205 - DNA, 25 bp, Mus musculus
aaggctcctttcagtatgctcttag

SEQ ID NO: 61206 - DNA, 25 bp, Mus musculus
aaggctcctttcatggtgctccgga

SEQ ID NO: 61207 - DNA, 25 bp, Mus musculus
aaggctcctttctgtatgctcttag

SEQ ID NO: 61208 - DNA, 25 bp, Mus musculus
aaggctcctttcttggtgctccgga

SEQ ID NO: 61209 - DNA, 25 bp, Mus musculus
aaggctccttttccacattctttcc

SEQ ID NO: 61210 - DNA, 25 bp, Mus musculus
aaggctccttttgcacattctttcc

SEQ ID NO: 61211 - DNA, 25 bp, Mus musculus
aaggctcgagagaatccaagtgaag

SEQ ID NO: 61212 - DNA, 25 bp, Mus musculus
aaggctcgagagtatccaagtgaag

SEQ ID NO: 61213 - DNA, 25 bp, Mus musculus
aaggctcgatttagtatctgcaggc

SEQ ID NO: 61214 - DNA, 25 bp, Mus musculus
aaggctcgattttgtatctgcaggc

SEQ ID NO: 61215 - DNA, 25 bp, Mus musculus
aaggctcgcgccaaggccaagaccc

SEQ ID NO: 61216 - DNA, 25 bp, Mus musculus
aaggctcgcgcctaggccaagaccc

SEQ ID NO: 61217 - DNA, 25 bp, Mus musculus
aaggctcgctagcaattggtccaca

SEQ ID NO: 61218 - DNA, 25 bp, Mus musculus
aaggctcgctaggaattggtccaca

SEQ ID NO: 61219 - DNA, 25 bp, Mus musculus
aaggctcgctcactgatgaccaagt

SEQ ID NO: 61220 - DNA, 25 bp, Mus musculus
aaggctcgctcagtgatgaccaagt

SEQ ID NO: 61221 - DNA, 25 bp, Mus musculus
aaggctcgctgacactgggatccca

SEQ ID NO: 61222 - DNA, 25 bp, Mus musculus
aaggctcgctgagactgggatccca

SEQ ID NO: 61223 - DNA, 25 bp, Mus musculus
aaggctcgctttaagagagaaccaa

SEQ ID NO: 61224 - DNA, 25 bp, Mus musculus
aaggctcgcttttagagagaaccaa

SEQ ID NO: 61225 - DNA, 25 bp, Mus musculus
aaggctcggaagaggagttcttcga

SEQ ID NO: 61226 - DNA, 25 bp, Mus musculus
aaggctcggaagctgtccagtgcaa

SEQ ID NO: 61227 - DNA, 25 bp, Mus musculus
aaggctcggaaggtgtccagtgcaa

SEQ ID NO: 61228 - DNA, 25 bp, Mus musculus
aaggctcggaagtggagttcttcga

SEQ ID NO: 61229 - DNA, 25 bp, Mus musculus
aaggctcggcacatcacagtgagca

SEQ ID NO: 61230 - DNA, 25 bp, Mus musculus
aaggctcggcacttcacagtgagca

SEQ ID NO: 61231 - DNA, 25 bp, Mus musculus
aaggctcggcgccagaaacaatctg

SEQ ID NO: 61232 - DNA, 25 bp, Mus musculus
aaggctcggcgcgagaaacaatctg

SEQ ID NO: 61233 - DNA, 25 bp, Mus musculus
aaggctcggtctagttttaccacag

SEQ ID NO: 61234 - DNA, 25 bp, Mus musculus
aaggctcggtcttgttttaccacag

SEQ ID NO: 61235 - DNA, 25 bp, Mus musculus
aaggctcgtctgagggcaatgctct

SEQ ID NO: 61236 - DNA, 25 bp, Mus musculus
aaggctcgtctgtgggcaatgctct

SEQ ID NO: 61237 - DNA, 25 bp, Mus musculus
aaggctctacctctgaagagcatca

SEQ ID NO: 61238 - DNA, 25 bp, Mus musculus
aaggctctacctgtgaagagcatca

SEQ ID NO: 61239 - DNA, 25 bp, Mus musculus
aaggctctagataccatctctaaca

SEQ ID NO: 61240 - DNA, 25 bp, Mus musculus
aaggctctagattccatctctaaca

SEQ ID NO: 61241 - DNA, 25 bp, Mus musculus
aaggctctaggacgcactgacaaga

SEQ ID NO: 61242 - DNA, 25 bp, Mus musculus
aaggctctaggaggcactgacaaga

SEQ ID NO: 61243 - DNA, 25 bp, Mus musculus
aaggctctcaacaaggttcacggga

SEQ ID NO: 61244 - DNA, 25 bp, Mus musculus
aaggctctcaactaggttcacggga

SEQ ID NO: 61245 - DNA, 25 bp, Mus musculus
aaggctctcagacgcttgctgtggc

SEQ ID NO: 61246 - DNA, 25 bp, Mus musculus
aaggctctcagaggcttgctgtggc

SEQ ID NO: 61247 - DNA, 25 bp, Mus musculus
aaggctctcctccaatatggcagca

SEQ ID NO: 61248 - DNA, 25 bp, Mus musculus
aaggctctcctcgaatatggcagca

SEQ ID NO: 61249 - DNA, 25 bp, Mus musculus
aaggctctcgacaccaggagctgtt

SEQ ID NO: 61250 - DNA, 25 bp, Mus musculus
aaggctctcgactccaggagctgtt

SEQ ID NO: 61251 - DNA, 25 bp, Mus musculus
aaggctctcgctcagcagctcctgt

SEQ ID NO: 61252 - DNA, 25 bp, Mus musculus
aaggctctcgctgagcagctcctgt

SEQ ID NO: 61253 - DNA, 25 bp, Mus musculus
aaggctctctatctagctcttaaga

SEQ ID NO: 61254 - DNA, 25 bp, Mus musculus
aaggctctctatgtagctcttaaga

SEQ ID NO: 61255 - DNA, 25 bp, Mus musculus
aaggctctctttattacttctgtcc

SEQ ID NO: 61256 - DNA, 25 bp, Mus musculus
aaggctctcttttttacttctgtcc

SEQ ID NO: 61257 - DNA, 25 bp, Mus musculus
aaggctctgaagagtttcctcatcc

SEQ ID NO: 61258 - DNA, 25 bp, Mus musculus
aaggctctgaagtgtttcctcatcc

SEQ ID NO: 61259 - DNA, 25 bp, Mus musculus
aaggctctgaatctcctaccatttg

SEQ ID NO: 61260 - DNA, 25 bp, Mus musculus
aaggctctgaatgtcctaccatttg

SEQ ID NO: 61261 - DNA, 25 bp, Mus musculus
aaggctctgagaatctatggctcta

SEQ ID NO: 61262 - DNA, 25 bp, Mus musculus
aaggctctgagattctatggctcta

SEQ ID NO: 61263 - DNA, 25 bp, Mus musculus
aaggctctgaggagcccatgtacat

SEQ ID NO: 61264 - DNA, 25 bp, Mus musculus
aaggctctgaggtgcccatgtacat

SEQ ID NO: 61265 - DNA, 25 bp, Mus musculus
aaggctctgcagatctaaccgtaga

SEQ ID NO: 61266 - DNA, 25 bp, Mus musculus
aaggctctgcagttctaaccgtaga

SEQ ID NO: 61267 - DNA, 25 bp, Mus musculus
aaggctctgccaagagatgtgttca

SEQ ID NO: 61268 - DNA, 25 bp, Mus musculus
aaggctctgccatgagatgtgttca

SEQ ID NO: 61269 - DNA, 25 bp, Mus musculus
aaggctctgcctatggcgcttgtgt

SEQ ID NO: 61270 - DNA, 25 bp, Mus musculus
aaggctctgcctttggcgcttgtgt

SEQ ID NO: 61271 - DNA, 25 bp, Mus musculus
aaggctctgctgacatagcatcatc

SEQ ID NO: 61272 - DNA, 25 bp, Mus musculus
aaggctctgctgtcatagcatcatc

SEQ ID NO: 61273 - DNA, 25 bp, Mus musculus
aaggctctggaaatttcttcttcaa

SEQ ID NO: 61274 - DNA, 25 bp, Mus musculus
aaggctctggaattttcttcttcaa

SEQ ID NO: 61275 - DNA, 25 bp, Mus musculus
aaggctctggacaagaaccgtacaa

SEQ ID NO: 61276 - DNA, 25 bp, Mus musculus
aaggctctggactagaaccgtacaa

SEQ ID NO: 61277 - DNA, 25 bp, Mus musculus
aaggctctggagacaacggtgctgt

SEQ ID NO: 61278 - DNA, 25 bp, Mus musculus
aaggctctggagtcaacggtgctgt

SEQ ID NO: 61279 - DNA, 25 bp, Mus musculus
aaggctctggcaaatcgtcagggta

SEQ ID NO: 61280 - DNA, 25 bp, Mus musculus
aaggctctggcatatcgtcagggta

SEQ ID NO: 61281 - DNA, 25 bp, Mus musculus
aaggctctggccatcttcggagagg

SEQ ID NO: 61282 - DNA, 25 bp, Mus musculus
aaggctctggccatgctcatgctgg

SEQ ID NO: 61283 - DNA, 25 bp, Mus musculus
aaggctctggccttcttcggagagg

SEQ ID NO: 61284 - DNA, 25 bp, Mus musculus
aaggctctggccttgctcatgctgg

SEQ ID NO: 61285 - DNA, 25 bp, Mus musculus
aaggctctgggaagcatttacacca

SEQ ID NO: 61286 - DNA, 25 bp, Mus musculus
aaggctctgggatgcatttacacca

SEQ ID NO: 61287 - DNA, 25 bp, Mus musculus
aaggctctgggcacactcgtttaaa

SEQ ID NO: 61288 - DNA, 25 bp, Mus musculus
aaggctctgggctcactcgtttaaa

SEQ ID NO: 61289 - DNA, 25 bp, Mus musculus
aaggctctgggtctagtttcaggaa

SEQ ID NO: 61290 - DNA, 25 bp, Mus musculus
aaggctctgggtgtagtttcaggaa

SEQ ID NO: 61291 - DNA, 25 bp, Mus musculus
aaggctctggtacctggctttagtt

SEQ ID NO: 61292 - DNA, 25 bp, Mus musculus
aaggctctggtagctggctttagtt

SEQ ID NO: 61293 - DNA, 25 bp, Mus musculus
aaggctctgtataggctgcttgaca

SEQ ID NO: 61294 - DNA, 25 bp, Mus musculus
aaggctctgtattggctgcttgaca

SEQ ID NO: 61295 - DNA, 25 bp, Mus musculus
aaggctctgtcaccgtcccaggatg

SEQ ID NO: 61296 - DNA, 25 bp, Mus musculus
aaggctctgtcagcgtcccaggatg

SEQ ID NO: 61297 - DNA, 25 bp, Mus musculus
aaggctctgtgcactgcatacggtc

SEQ ID NO: 61298 - DNA, 25 bp, Mus musculus
aaggctctgtgctctgcatacggtc

SEQ ID NO: 61299 - DNA, 25 bp, Mus musculus
aaggctctgtggcttagaacttaat

SEQ ID NO: 61300 - DNA, 25 bp, Mus musculus
aaggctctgtgggttagaacttaat

SEQ ID NO: 61301 - DNA, 25 bp, Mus musculus
aaggctctgttccttagagacccaa

SEQ ID NO: 61302 - DNA, 25 bp, Mus musculus
aaggctctgttcgttagagacccaa

SEQ ID NO: 61303 - DNA, 25 bp, Mus musculus
aaggctcttagaaacacttgtttct

SEQ ID NO: 61304 - DNA, 25 bp, Mus musculus
aaggctcttagatacacttgtttct

SEQ ID NO: 61305 - DNA, 25 bp, Mus musculus
aaggctcttcatcccaggaagcgca

SEQ ID NO: 61306 - DNA, 25 bp, Mus musculus
aaggctcttcatgccaggaagcgca

SEQ ID NO: 61307 - DNA, 25 bp, Mus musculus
aaggctcttccacagctgtgggcaa

SEQ ID NO: 61308 - DNA, 25 bp, Mus musculus
aaggctcttccagagctgtgggcaa

SEQ ID NO: 61309 - DNA, 25 bp, Mus musculus
aaggctcttggcacaggactcacat

SEQ ID NO: 61310 - DNA, 25 bp, Mus musculus
aaggctcttggctcaggactcacat

SEQ ID NO: 61311 - DNA, 25 bp, Mus musculus
aaggctcttgtgaataggctcagga

SEQ ID NO: 61312 - DNA, 25 bp, Mus musculus
aaggctcttgtgtataggctcagga

SEQ ID NO: 61313 - DNA, 25 bp, Mus musculus
aaggctcttgttaccactgtatcat

SEQ ID NO: 61314 - DNA, 25 bp, Mus musculus
aaggctcttgttcattgggcttccc

SEQ ID NO: 61315 - DNA, 25 bp, Mus musculus
aaggctcttgttcccttgagagtct

SEQ ID NO: 61316 - DNA, 25 bp, Mus musculus
aaggctcttgttgattgggcttccc

SEQ ID NO: 61317 - DNA, 25 bp, Mus musculus
aaggctcttgttgccttgagagtct

SEQ ID NO: 61318 - DNA, 25 bp, Mus musculus
aaggctcttgtttccactgtatcat

SEQ ID NO: 61319 - DNA, 25 bp, Mus musculus
aaggctctttcaactaaactgtagg

SEQ ID NO: 61320 - DNA, 25 bp, Mus musculus
aaggctctttcatctaaactgtagg

SEQ ID NO: 61321 - DNA, 25 bp, Mus musculus
aaggctgaaagcagctggcttctgg

SEQ ID NO: 61322 - DNA, 25 bp, Mus musculus
aaggctgaaagctgctggcttctgg

SEQ ID NO: 61323 - DNA, 25 bp, Mus musculus
aaggctgaacatcggctgttgatcc

SEQ ID NO: 61324 - DNA, 25 bp, Mus musculus
aaggctgaacatgggctgttgatcc

SEQ ID NO: 61325 - DNA, 25 bp, Mus musculus
aaggctgaacctaccaacgtgctga

SEQ ID NO: 61326 - DNA, 25 bp, Mus musculus
aaggctgaaccttccaacgtgctga

SEQ ID NO: 61327 - DNA, 25 bp, Mus musculus
aaggctgaagaaccctccaatgcac

SEQ ID NO: 61328 - DNA, 25 bp, Mus musculus
aaggctgaagaagcctccaatgcac

SEQ ID NO: 61329 - DNA, 25 bp, Mus musculus
aaggctgaagagatagctgccagac

SEQ ID NO: 61330 - DNA, 25 bp, Mus musculus
aaggctgaagagttagctgccagac

SEQ ID NO: 61331 - DNA, 25 bp, Mus musculus
aaggctgaagccaggcgcatggcct

SEQ ID NO: 61332 - DNA, 25 bp, Mus musculus
aaggctgaagcctggcgcatggcct

SEQ ID NO: 61333 - DNA, 25 bp, Mus musculus
aaggctgaaggcatgcgagcagtca

SEQ ID NO: 61334 - DNA, 25 bp, Mus musculus
aaggctgaaggcttgcgagcagtca

SEQ ID NO: 61335 - DNA, 25 bp, Mus musculus
aaggctgaataacctccctgttctt

SEQ ID NO: 61336 - DNA, 25 bp, Mus musculus
aaggctgaataagctccctgttctt

SEQ ID NO: 61337 - DNA, 25 bp, Mus musculus
aaggctgaatgtcgataggttacca

SEQ ID NO: 61338 - DNA, 25 bp, Mus musculus
aaggctgaatgtggataggttacca

SEQ ID NO: 61339 - DNA, 25 bp, Mus musculus
aaggctgacaatacacttcctcgtg

SEQ ID NO: 61340 - DNA, 25 bp, Mus musculus
aaggctgacaattcacttcctcgtg

SEQ ID NO: 61341 - DNA, 25 bp, Mus musculus
aaggctgacagcatgaatttacccc

SEQ ID NO: 61342 - DNA, 25 bp, Mus musculus
aaggctgacagcttgaatttacccc

SEQ ID NO: 61343 - DNA, 25 bp, Mus musculus
aaggctgaccagaacccaagcggtt

SEQ ID NO: 61344 - DNA, 25 bp, Mus musculus
aaggctgaccagtacccaagcggtt

SEQ ID NO: 61345 - DNA, 25 bp, Mus musculus
aaggctgaccatcgtgatgaaattt

SEQ ID NO: 61346 - DNA, 25 bp, Mus musculus
aaggctgaccatcttcgagcaggag

SEQ ID NO: 61347 - DNA, 25 bp, Mus musculus
aaggctgaccatggtgatgaaattt

SEQ ID NO: 61348 - DNA, 25 bp, Mus musculus
aaggctgaccatgttcgagcaggag

SEQ ID NO: 61349 - DNA, 25 bp, Mus musculus
aaggctgaccccatggctaggaaga

SEQ ID NO: 61350 - DNA, 25 bp, Mus musculus
aaggctgaccccttggctaggaaga

SEQ ID NO: 61351 - DNA, 25 bp, Mus musculus
aaggctgactgcacaatcaccatgg

SEQ ID NO: 61352 - DNA, 25 bp, Mus musculus
aaggctgactgctcaatcaccatgg

SEQ ID NO: 61353 - DNA, 25 bp, Mus musculus
aaggctgagacaccttcgtcctcca

SEQ ID NO: 61354 - DNA, 25 bp, Mus musculus
aaggctgagacagcttcgtcctcca

SEQ ID NO: 61355 - DNA, 25 bp, Mus musculus
aaggctgagaggcatgcttaaatca

SEQ ID NO: 61356 - DNA, 25 bp, Mus musculus
aaggctgagagggatgcttaaatca

SEQ ID NO: 61357 - DNA, 25 bp, Mus musculus
aaggctgagcctattttctgcctgt

SEQ ID NO: 61358 - DNA, 25 bp, Mus musculus
aaggctgagccttttttctgcctgt

SEQ ID NO: 61359 - DNA, 25 bp, Mus musculus
aaggctgagcggctacactgaagct

SEQ ID NO: 61360 - DNA, 25 bp, Mus musculus
aaggctgagcgggtacactgaagct

SEQ ID NO: 61361 - DNA, 25 bp, Mus musculus
aaggctgagctccttagccctgagg

SEQ ID NO: 61362 - DNA, 25 bp, Mus musculus
aaggctgagctcgttagccctgagg

SEQ ID NO: 61363 - DNA, 25 bp, Mus musculus
aaggctgagcttcagagccctactc

SEQ ID NO: 61364 - DNA, 25 bp, Mus musculus
aaggctgagcttgagagccctactc

SEQ ID NO: 61365 - DNA, 25 bp, Mus musculus
aaggctgaggacataagaactgagt

SEQ ID NO: 61366 - DNA, 25 bp, Mus musculus
aaggctgaggacttaagaactgagt

SEQ ID NO: 61367 - DNA, 25 bp, Mus musculus
aaggctgagtgtacacgtgccagca

SEQ ID NO: 61368 - DNA, 25 bp, Mus musculus
aaggctgagtgttcacgtgccagca

SEQ ID NO: 61369 - DNA, 25 bp, Mus musculus
aaggctgagttcatgcagggtctcc

SEQ ID NO: 61370 - DNA, 25 bp, Mus musculus
aaggctgagttcttgcagggtctcc

SEQ ID NO: 61371 - DNA, 25 bp, Mus musculus
aaggctgatgaacgtatctctttca

SEQ ID NO: 61372 - DNA, 25 bp, Mus musculus
aaggctgatgaaggtatctctttca

SEQ ID NO: 61373 - DNA, 25 bp, Mus musculus
aaggctgcaagcagtggaactcatg

SEQ ID NO: 61374 - DNA, 25 bp, Mus musculus
aaggctgcaagctgtggaactcatg

SEQ ID NO: 61375 - DNA, 25 bp, Mus musculus
aaggctgcaagtagtacagagccgc

SEQ ID NO: 61376 - DNA, 25 bp, Mus musculus
aaggctgcaagttgtacagagccgc

SEQ ID NO: 61377 - DNA, 25 bp, Mus musculus
aaggctgcacgtcgaagttcgctcg

SEQ ID NO: 61378 - DNA, 25 bp, Mus musculus
aaggctgcacgtggaagttcgctcg

SEQ ID NO: 61379 - DNA, 25 bp, Mus musculus
aaggctgcactcaaggctgaaccat

SEQ ID NO: 61380 - DNA, 25 bp, Mus musculus
aaggctgcactctaggctgaaccat

SEQ ID NO: 61381 - DNA, 25 bp, Mus musculus
aaggctgcactgaatgtcccagcag

SEQ ID NO: 61382 - DNA, 25 bp, Mus musculus
aaggctgcactgtatgtcccagcag

SEQ ID NO: 61383 - DNA, 25 bp, Mus musculus
aaggctgcagccatactgtgttaca

SEQ ID NO: 61384 - DNA, 25 bp, Mus musculus
aaggctgcagccttactgtgttaca

SEQ ID NO: 61385 - DNA, 25 bp, Mus musculus
aaggctgcaggcctccttgcttata

SEQ ID NO: 61386 - DNA, 25 bp, Mus musculus
aaggctgcaggcgtccttgcttata

SEQ ID NO: 61387 - DNA, 25 bp, Mus musculus
aaggctgcagtcagctgagcacaga

SEQ ID NO: 61388 - DNA, 25 bp, Mus musculus
aaggctgcagtctgctgagcacaga

SEQ ID NO: 61389 - DNA, 25 bp, Mus musculus
aaggctgcatgcatcaacttctacc

SEQ ID NO: 61390 - DNA, 25 bp, Mus musculus
aaggctgcatgcttcaacttctacc

SEQ ID NO: 61391 - DNA, 25 bp, Mus musculus
aaggctgcatggcactaacctaggc

SEQ ID NO: 61392 - DNA, 25 bp, Mus musculus
aaggctgcatgggactaacctaggc

SEQ ID NO: 61393 - DNA, 25 bp, Mus musculus
aaggctgcattccagtatggcatca

SEQ ID NO: 61394 - DNA, 25 bp, Mus musculus
aaggctgcattcgagtatggcatca

SEQ ID NO: 61395 - DNA, 25 bp, Mus musculus
aaggctgccaccagtcaggtgctga

SEQ ID NO: 61396 - DNA, 25 bp, Mus musculus
aaggctgccacctgtcaggtgctga

SEQ ID NO: 61397 - DNA, 25 bp, Mus musculus
aaggctgcccagaatggccttggtg

SEQ ID NO: 61398 - DNA, 25 bp, Mus musculus
aaggctgcccagtatggccttggtg

SEQ ID NO: 61399 - DNA, 25 bp, Mus musculus
aaggctgccctgaaagcaacgcaaa

SEQ ID NO: 61400 - DNA, 25 bp, Mus musculus
aaggctgccctgtaagcaacgcaaa

SEQ ID NO: 61401 - DNA, 25 bp, Mus musculus
aaggctgcccttaaagatgagtaac

SEQ ID NO: 61402 - DNA, 25 bp, Mus musculus
aaggctgcccttccaatagacgcca

SEQ ID NO: 61403 - DNA, 25 bp, Mus musculus
aaggctgcccttgcaatagacgcca

SEQ ID NO: 61404 - DNA, 25 bp, Mus musculus
aaggctgccctttaagatgagtaac

SEQ ID NO: 61405 - DNA, 25 bp, Mus musculus
aaggctgccgtgaccacaaattgca

SEQ ID NO: 61406 - DNA, 25 bp, Mus musculus
aaggctgccgtgtccacaaattgca

SEQ ID NO: 61407 - DNA, 25 bp, Mus musculus
aaggctgcctatcagagtctgatac

SEQ ID NO: 61408 - DNA, 25 bp, Mus musculus
aaggctgcctatgagagtctgatac

SEQ ID NO: 61409 - DNA, 25 bp, Mus musculus
aaggctgcctgaagcttccggattg

SEQ ID NO: 61410 - DNA, 25 bp, Mus musculus
aaggctgcctgatgcttccggattg

SEQ ID NO: 61411 - DNA, 25 bp, Mus musculus
aaggctgcctgcactggaagacagc

SEQ ID NO: 61412 - DNA, 25 bp, Mus musculus
aaggctgcctgctctggaagacagc

SEQ ID NO: 61413 - DNA, 25 bp, Mus musculus
aaggctgccttgaaactctgtgctc

SEQ ID NO: 61414 - DNA, 25 bp, Mus musculus
aaggctgccttgtaactctgtgctc

SEQ ID NO: 61415 - DNA, 25 bp, Mus musculus
aaggctgcctttcacatgttcgatg

SEQ ID NO: 61416 - DNA, 25 bp, Mus musculus
aaggctgcctttcagcccaaggcca

SEQ ID NO: 61417 - DNA, 25 bp, Mus musculus
aaggctgcctttctctttggtgatc

SEQ ID NO: 61418 - DNA, 25 bp, Mus musculus
aaggctgcctttgacatgttcgatg

SEQ ID NO: 61419 - DNA, 25 bp, Mus musculus
aaggctgcctttgagcccaaggcca

SEQ ID NO: 61420 - DNA, 25 bp, Mus musculus
aaggctgcctttgtctttggtgatc

SEQ ID NO: 61421 - DNA, 25 bp, Mus musculus
aaggctgcgactcgttttggcttta

SEQ ID NO: 61422 - DNA, 25 bp, Mus musculus
aaggctgcgactggttttggcttta

SEQ ID NO: 61423 - DNA, 25 bp, Mus musculus
aaggctgctcaactgtcgagtggct

SEQ ID NO: 61424 - DNA, 25 bp, Mus musculus
aaggctgctcaagtgtcgagtggct

SEQ ID NO: 61425 - DNA, 25 bp, Mus musculus
aaggctgctcacaatcacctggaac

SEQ ID NO: 61426 - DNA, 25 bp, Mus musculus
aaggctgctcactatcacctggaac

SEQ ID NO: 61427 - DNA, 25 bp, Mus musculus
aaggctgctcagagtcctgaccttg

SEQ ID NO: 61428 - DNA, 25 bp, Mus musculus
aaggctgctcagtgtcctgaccttg

SEQ ID NO: 61429 - DNA, 25 bp, Mus musculus
aaggctgctcatcctcagagcgatg

SEQ ID NO: 61430 - DNA, 25 bp, Mus musculus
aaggctgctcatgctcagagcgatg

SEQ ID NO: 61431 - DNA, 25 bp, Mus musculus
aaggctgctgagatcattaagggaa

SEQ ID NO: 61432 - DNA, 25 bp, Mus musculus
aaggctgctgagttcattaagggaa

SEQ ID NO: 61433 - DNA, 25 bp, Mus musculus
aaggctgctgccatgggtgtagcta

SEQ ID NO: 61434 - DNA, 25 bp, Mus musculus
aaggctgctgccttgggtgtagcta

SEQ ID NO: 61435 - DNA, 25 bp, Mus musculus
aaggctgctgctatcaggacccatt

SEQ ID NO: 61436 - DNA, 25 bp, Mus musculus
aaggctgctgctttcaggacccatt

SEQ ID NO: 61437 - DNA, 25 bp, Mus musculus
aaggctgctgggatgctttgtcaga

SEQ ID NO: 61438 - DNA, 25 bp, Mus musculus
aaggctgctgggttgctttgtcaga

SEQ ID NO: 61439 - DNA, 25 bp, Mus musculus
aaggctgctgtcatgatgcttctta

SEQ ID NO: 61440 - DNA, 25 bp, Mus musculus
aaggctgctgtcttgatgcttctta

SEQ ID NO: 61441 - DNA, 25 bp, Mus musculus
aaggctgcttaacacatttcccaca

SEQ ID NO: 61442 - DNA, 25 bp, Mus musculus
aaggctgcttaagacatttcccaca

SEQ ID NO: 61443 - DNA, 25 bp, Mus musculus
aaggctgcttctcacagggcactgg

SEQ ID NO: 61444 - DNA, 25 bp, Mus musculus
aaggctgcttctgacagggcactgg

SEQ ID NO: 61445 - DNA, 25 bp, Mus musculus
aaggctggaagaacgctgaaattgc

SEQ ID NO: 61446 - DNA, 25 bp, Mus musculus
aaggctggaagatcgctgaaattgc

SEQ ID NO: 61447 - DNA, 25 bp, Mus musculus
aaggctggaagcaacaccgtgtcta

SEQ ID NO: 61448 - DNA, 25 bp, Mus musculus
aaggctggaagctacaccgtgtcta

SEQ ID NO: 61449 - DNA, 25 bp, Mus musculus
aaggctggaaggcattgtgtcaaac

SEQ ID NO: 61450 - DNA, 25 bp, Mus musculus
aaggctggaagggattgtgtcaaac

SEQ ID NO: 61451 - DNA, 25 bp, Mus musculus
aaggctggaatcatagaggagatgt

SEQ ID NO: 61452 - DNA, 25 bp, Mus musculus
aaggctggaatcttagaggagatgt

SEQ ID NO: 61453 - DNA, 25 bp, Mus musculus
aaggctggactccaggtggcatcca

SEQ ID NO: 61454 - DNA, 25 bp, Mus musculus
aaggctggactcgaggtggcatcca

SEQ ID NO: 61455 - DNA, 25 bp, Mus musculus
aaggctggacttatgatctgcaaga

SEQ ID NO: 61456 - DNA, 25 bp, Mus musculus
aaggctggacttttgatctgcaaga

SEQ ID NO: 61457 - DNA, 25 bp, Mus musculus
aaggctggagttatccctggatatg

SEQ ID NO: 61458 - DNA, 25 bp, Mus musculus
aaggctggagttttccctggatatg

SEQ ID NO: 61459 - DNA, 25 bp, Mus musculus
aaggctggatagactgcgaccactt

SEQ ID NO: 61460 - DNA, 25 bp, Mus musculus
aaggctggatagtctgcgaccactt

SEQ ID NO: 61461 - DNA, 25 bp, Mus musculus
aaggctggatatctcaagtgatctt

SEQ ID NO: 61462 - DNA, 25 bp, Mus musculus
aaggctggatatgtcaagtgatctt

SEQ ID NO: 61463 - DNA, 25 bp, Mus musculus
aaggctggcacaagtttcttcagtc

SEQ ID NO: 61464 - DNA, 25 bp, Mus musculus
aaggctggcacatgtttcttcagtc

SEQ ID NO: 61465 - DNA, 25 bp, Mus musculus
aaggctggcatgacttcagcgccac

SEQ ID NO: 61466 - DNA, 25 bp, Mus musculus
aaggctggcatgtcttcagcgccac

SEQ ID NO: 61467 - DNA, 25 bp, Mus musculus
aaggctggccaaagaccatgggtct

SEQ ID NO: 61468 - DNA, 25 bp, Mus musculus
aaggctggccaatgaccatgggtct

SEQ ID NO: 61469 - DNA, 25 bp, Mus musculus
aaggctggccagctattgcctgatg

SEQ ID NO: 61470 - DNA, 25 bp, Mus musculus
aaggctggccaggtattgcctgatg

SEQ ID NO: 61471 - DNA, 25 bp, Mus musculus
aaggctggccatcagatcccaggct

SEQ ID NO: 61472 - DNA, 25 bp, Mus musculus
aaggctggccatgagatcccaggct

SEQ ID NO: 61473 - DNA, 25 bp, Mus musculus
aaggctggcctactgcttgagccca

SEQ ID NO: 61474 - DNA, 25 bp, Mus musculus
aaggctggcctagtgcttgagccca

SEQ ID NO: 61475 - DNA, 25 bp, Mus musculus
aaggctggcctgagttacataaaca

SEQ ID NO: 61476 - DNA, 25 bp, Mus musculus
aaggctggcctgctagatagagcta

SEQ ID NO: 61477 - DNA, 25 bp, Mus musculus
aaggctggcctggtagatagagcta

SEQ ID NO: 61478 - DNA, 25 bp, Mus musculus
aaggctggcctgtgttacataaaca

SEQ ID NO: 61479 - DNA, 25 bp, Mus musculus
aaggctggccttctaagccactgag

SEQ ID NO: 61480 - DNA, 25 bp, Mus musculus
aaggctggccttgtaagccactgag

SEQ ID NO: 61481 - DNA, 25 bp, Mus musculus
aaggctggctccacccagaggacag

SEQ ID NO: 61482 - DNA, 25 bp, Mus musculus
aaggctggctcctcccagaggacag

SEQ ID NO: 61483 - DNA, 25 bp, Mus musculus
aaggctgggacacctcaccacagaa

SEQ ID NO: 61484 - DNA, 25 bp, Mus musculus
aaggctgggacagctcaccacagaa

SEQ ID NO: 61485 - DNA, 25 bp, Mus musculus
aaggctgggcacagatgagttatgc

SEQ ID NO: 61486 - DNA, 25 bp, Mus musculus
aaggctgggcacctcatgcgacgct

SEQ ID NO: 61487 - DNA, 25 bp, Mus musculus
aaggctgggcacgtcatgcgacgct

SEQ ID NO: 61488 - DNA, 25 bp, Mus musculus
aaggctgggcactgatgagttatgc

SEQ ID NO: 61489 - DNA, 25 bp, Mus musculus
aaggctgggcctcatgtcctgttag

SEQ ID NO: 61490 - DNA, 25 bp, Mus musculus
aaggctgggcctgatgtcctgttag

SEQ ID NO: 61491 - DNA, 25 bp, Mus musculus
aaggctggggagacttctctgggtg

SEQ ID NO: 61492 - DNA, 25 bp, Mus musculus
aaggctggggagtcttctctgggtg

SEQ ID NO: 61493 - DNA, 25 bp, Mus musculus
aaggctgggtatcgcagcacatgcc

SEQ ID NO: 61494 - DNA, 25 bp, Mus musculus
aaggctgggtatggcagcacatgcc

SEQ ID NO: 61495 - DNA, 25 bp, Mus musculus
aaggctgggtcactgattgctctcc

SEQ ID NO: 61496 - DNA, 25 bp, Mus musculus
aaggctgggtcagtgattgctctcc

SEQ ID NO: 61497 - DNA, 25 bp, Mus musculus
aaggctgggtttaatattgcacatt

SEQ ID NO: 61498 - DNA, 25 bp, Mus musculus
aaggctgggtttaccaggcctgcct

SEQ ID NO: 61499 - DNA, 25 bp, Mus musculus
aaggctgggttttatattgcacatt

SEQ ID NO: 61500 - DNA, 25 bp, Mus musculus
aaggctgggttttccaggcctgcct

SEQ ID NO: 61501 - DNA, 25 bp, Mus musculus
aaggctggtattagctacggctgac

SEQ ID NO: 61502 - DNA, 25 bp, Mus musculus
aaggctggtatttgctacggctgac

SEQ ID NO: 61503 - DNA, 25 bp, Mus musculus
aaggctggtcagcacactgtccttt

SEQ ID NO: 61504 - DNA, 25 bp, Mus musculus
aaggctggtcagctcaagctaaaac

SEQ ID NO: 61505 - DNA, 25 bp, Mus musculus
aaggctggtcaggacactgtccttt

SEQ ID NO: 61506 - DNA, 25 bp, Mus musculus
aaggctggtcaggtcaagctaaaac

SEQ ID NO: 61507 - DNA, 25 bp, Mus musculus
aaggctggtctaccagcttgggacc

SEQ ID NO: 61508 - DNA, 25 bp, Mus musculus
aaggctggtctagcagcttgggacc

SEQ ID NO: 61509 - DNA, 25 bp, Mus musculus
aaggctggtctcaggagagctccag

SEQ ID NO: 61510 - DNA, 25 bp, Mus musculus
aaggctggtctcatttacattgctc

SEQ ID NO: 61511 - DNA, 25 bp, Mus musculus
aaggctggtctctggagagctccag

SEQ ID NO: 61512 - DNA, 25 bp, Mus musculus
aaggctggtctcttttacattgctc

SEQ ID NO: 61513 - DNA, 25 bp, Mus musculus
aaggctggtctgatggtgattctag

SEQ ID NO: 61514 - DNA, 25 bp, Mus musculus
aaggctggtctgttggtgattctag

SEQ ID NO: 61515 - DNA, 25 bp, Mus musculus
aaggctggtgaacactgttcccact

SEQ ID NO: 61516 - DNA, 25 bp, Mus musculus
aaggctggtgaagactgttcccact

SEQ ID NO: 61517 - DNA, 25 bp, Mus musculus
aaggctggtgacataagccagagtc

SEQ ID NO: 61518 - DNA, 25 bp, Mus musculus
aaggctggtgacatgtgggccattc

SEQ ID NO: 61519 - DNA, 25 bp, Mus musculus
aaggctggtgacttaagccagagtc

SEQ ID NO: 61520 - DNA, 25 bp, Mus musculus
aaggctggtgacttgtgggccattc

SEQ ID NO: 61521 - DNA, 25 bp, Mus musculus
aaggctggtgcgctgcgaccactca

SEQ ID NO: 61522 - DNA, 25 bp, Mus musculus
aaggctggtgcggtgcgaccactca

SEQ ID NO: 61523 - DNA, 25 bp, Mus musculus
aaggctggtggacacccagatccag

SEQ ID NO: 61524 - DNA, 25 bp, Mus musculus
aaggctggtggagacccagatccag

SEQ ID NO: 61525 - DNA, 25 bp, Mus musculus
aaggctggtggtccctgatatgccc

SEQ ID NO: 61526 - DNA, 25 bp, Mus musculus
aaggctggtggtgcctgatatgccc

SEQ ID NO: 61527 - DNA, 25 bp, Mus musculus
aaggctggtttcatcaaacgtcagt

SEQ ID NO: 61528 - DNA, 25 bp, Mus musculus
aaggctggtttcttcaaacgtcagt

SEQ ID NO: 61529 - DNA, 25 bp, Mus musculus
aaggctgtaacaaacctgtactgca

SEQ ID NO: 61530 - DNA, 25 bp, Mus musculus
aaggctgtaacatacctgtactgca

SEQ ID NO: 61531 - DNA, 25 bp, Mus musculus
aaggctgtaactacttcacttgcac

SEQ ID NO: 61532 - DNA, 25 bp, Mus musculus
aaggctgtaacttcttcacttgcac

SEQ ID NO: 61533 - DNA, 25 bp, Mus musculus
aaggctgtacaaagtgctgatgcaa

SEQ ID NO: 61534 - DNA, 25 bp, Mus musculus
aaggctgtacaatgtgctgatgcaa

SEQ ID NO: 61535 - DNA, 25 bp, Mus musculus
aaggctgtacacaatcagctctcag

SEQ ID NO: 61536 - DNA, 25 bp, Mus musculus
aaggctgtacactatcagctctcag

SEQ ID NO: 61537 - DNA, 25 bp, Mus musculus
aaggctgtaccactgcaggacctca

SEQ ID NO: 61538 - DNA, 25 bp, Mus musculus
aaggctgtaccagtgcaggacctca

SEQ ID NO: 61539 - DNA, 25 bp, Mus musculus
aaggctgtacttaaattcttcatgt

SEQ ID NO: 61540 - DNA, 25 bp, Mus musculus
aaggctgtactttaattcttcatgt

SEQ ID NO: 61541 - DNA, 25 bp, Mus musculus
aaggctgtagccctctaggacctga

SEQ ID NO: 61542 - DNA, 25 bp, Mus musculus
aaggctgtagccgtctaggacctga

SEQ ID NO: 61543 - DNA, 25 bp, Mus musculus
aaggctgtagctatcatccctcgag

SEQ ID NO: 61544 - DNA, 25 bp, Mus musculus
aaggctgtagctttcatccctcgag

SEQ ID NO: 61545 - DNA, 25 bp, Mus musculus
aaggctgtaggccaggttagtacaa

SEQ ID NO: 61546 - DNA, 25 bp, Mus musculus
aaggctgtaggcgaggttagtacaa

SEQ ID NO: 61547 - DNA, 25 bp, Mus musculus
aaggctgtatccacattggtctcac

SEQ ID NO: 61548 - DNA, 25 bp, Mus musculus
aaggctgtatcctcattggtctcac

SEQ ID NO: 61549 - DNA, 25 bp, Mus musculus
aaggctgtatttcacatcccaacaa

SEQ ID NO: 61550 - DNA, 25 bp, Mus musculus
aaggctgtatttcacgtcatgcacc

SEQ ID NO: 61551 - DNA, 25 bp, Mus musculus
aaggctgtatttgacatcccaacaa

SEQ ID NO: 61552 - DNA, 25 bp, Mus musculus
aaggctgtatttgacgtcatgcacc

SEQ ID NO: 61553 - DNA, 25 bp, Mus musculus
aaggctgtcaagacctctacaggtc

SEQ ID NO: 61554 - DNA, 25 bp, Mus musculus
aaggctgtcaagtcctctacaggtc

SEQ ID NO: 61555 - DNA, 25 bp, Mus musculus
aaggctgtcagtatcagtagcaaca

SEQ ID NO: 61556 - DNA, 25 bp, Mus musculus
aaggctgtcagtttcagtagcaaca

SEQ ID NO: 61557 - DNA, 25 bp, Mus musculus
aaggctgtccagcaggctgtttcat

SEQ ID NO: 61558 - DNA, 25 bp, Mus musculus
aaggctgtccaggaggctgtttcat

SEQ ID NO: 61559 - DNA, 25 bp, Mus musculus
aaggctgtcccacattcagatggcc

SEQ ID NO: 61560 - DNA, 25 bp, Mus musculus
aaggctgtcccagattcagatggcc

SEQ ID NO: 61561 - DNA, 25 bp, Mus musculus
aaggctgtcctccaggatgcagaga

SEQ ID NO: 61562 - DNA, 25 bp, Mus musculus
aaggctgtcctcgaggatgcagaga

SEQ ID NO: 61563 - DNA, 25 bp, Mus musculus
aaggctgtcgcacttgcctacaaca

SEQ ID NO: 61564 - DNA, 25 bp, Mus musculus
aaggctgtcgcagttgcctacaaca

SEQ ID NO: 61565 - DNA, 25 bp, Mus musculus
aaggctgtctccagtgttagaccgt

SEQ ID NO: 61566 - DNA, 25 bp, Mus musculus
aaggctgtctcctgtgttagaccgt

SEQ ID NO: 61567 - DNA, 25 bp, Mus musculus
aaggctgtctctccagatgtcgtca

SEQ ID NO: 61568 - DNA, 25 bp, Mus musculus
aaggctgtctctgcagatgtcgtca

SEQ ID NO: 61569 - DNA, 25 bp, Mus musculus
aaggctgtcttgactgtgagttcac

SEQ ID NO: 61570 - DNA, 25 bp, Mus musculus
aaggctgtcttgtctgtgagttcac

SEQ ID NO: 61571 - DNA, 25 bp, Mus musculus
aaggctgtgaatagttaactatcca

SEQ ID NO: 61572 - DNA, 25 bp, Mus musculus
aaggctgtgaattgttaactatcca

SEQ ID NO: 61573 - DNA, 25 bp, Mus musculus
aaggctgtgaccatagccaccccag

SEQ ID NO: 61574 - DNA, 25 bp, Mus musculus
aaggctgtgaccttagccaccccag

SEQ ID NO: 61575 - DNA, 25 bp, Mus musculus
aaggctgtgaggatagtccagagca

SEQ ID NO: 61576 - DNA, 25 bp, Mus musculus
aaggctgtgaggttagtccagagca

SEQ ID NO: 61577 - DNA, 25 bp, Mus musculus
aaggctgtgcagagttccgagaaca

SEQ ID NO: 61578 - DNA, 25 bp, Mus musculus
aaggctgtgcagtgttccgagaaca

SEQ ID NO: 61579 - DNA, 25 bp, Mus musculus
aaggctgtgcttaacctggagtgaa

SEQ ID NO: 61580 - DNA, 25 bp, Mus musculus
aaggctgtgcttccaatgtgtccaa

SEQ ID NO: 61581 - DNA, 25 bp, Mus musculus
aaggctgtgcttgcaatgtgtccaa

SEQ ID NO: 61582 - DNA, 25 bp, Mus musculus
aaggctgtgctttacctggagtgaa

SEQ ID NO: 61583 - DNA, 25 bp, Mus musculus
aaggctgtggagaaaggctgaaacc

SEQ ID NO: 61584 - DNA, 25 bp, Mus musculus
aaggctgtggagtaaggctgaaacc

SEQ ID NO: 61585 - DNA, 25 bp, Mus musculus
aaggctgtggatctgaccttacctg

SEQ ID NO: 61586 - DNA, 25 bp, Mus musculus
aaggctgtggatgtgaccttacctg

SEQ ID NO: 61587 - DNA, 25 bp, Mus musculus
aaggctgtggcaatgtcgttttaac

SEQ ID NO: 61588 - DNA, 25 bp, Mus musculus
aaggctgtggcattgtcgttttaac

SEQ ID NO: 61589 - DNA, 25 bp, Mus musculus
aaggctgtggcgatcacatctgtcc

SEQ ID NO: 61590 - DNA, 25 bp, Mus musculus
aaggctgtggcgttcacatctgtcc

SEQ ID NO: 61591 - DNA, 25 bp, Mus musculus
aaggctgtggttaccttgcgccaga

SEQ ID NO: 61592 - DNA, 25 bp, Mus musculus
aaggctgtggtttccttgcgccaga

SEQ ID NO: 61593 - DNA, 25 bp, Mus musculus
aaggctgtgtatagtccatttccca

SEQ ID NO: 61594 - DNA, 25 bp, Mus musculus
aaggctgtgtatctttgcactgaac

SEQ ID NO: 61595 - DNA, 25 bp, Mus musculus
aaggctgtgtatgtttgcactgaac

SEQ ID NO: 61596 - DNA, 25 bp, Mus musculus
aaggctgtgtattgtccatttccca

SEQ ID NO: 61597 - DNA, 25 bp, Mus musculus
aaggctgtgtgtctagaactcatgg

SEQ ID NO: 61598 - DNA, 25 bp, Mus musculus
aaggctgtgtgtgtagaactcatgg

SEQ ID NO: 61599 - DNA, 25 bp, Mus musculus
aaggctgtgttacagctcaacgcga

SEQ ID NO: 61600 - DNA, 25 bp, Mus musculus
aaggctgtgttagagctcaacgcga

SEQ ID NO: 61601 - DNA, 25 bp, Mus musculus
aaggctgttcctctacataggctat

SEQ ID NO: 61602 - DNA, 25 bp, Mus musculus
aaggctgttcctgtacataggctat

SEQ ID NO: 61603 - DNA, 25 bp, Mus musculus
aaggctgttcttatcccatggatag

SEQ ID NO: 61604 - DNA, 25 bp, Mus musculus
aaggctgttcttatggaactgtcag

SEQ ID NO: 61605 - DNA, 25 bp, Mus musculus
aaggctgttcttttcccatggatag

SEQ ID NO: 61606 - DNA, 25 bp, Mus musculus
aaggctgttcttttggaactgtcag

SEQ ID NO: 61607 - DNA, 25 bp, Mus musculus
aaggctgttgacctgtacgtgtgca

SEQ ID NO: 61608 - DNA, 25 bp, Mus musculus
aaggctgttgacgtgtacgtgtgca

SEQ ID NO: 61609 - DNA, 25 bp, Mus musculus
aaggctgttgatcatttctgtagaa

SEQ ID NO: 61610 - DNA, 25 bp, Mus musculus
aaggctgttgatgatttctgtagaa

SEQ ID NO: 61611 - DNA, 25 bp, Mus musculus
aaggctgtttacactgagaaatcct

SEQ ID NO: 61612 - DNA, 25 bp, Mus musculus
aaggctgtttactctgagaaatcct

SEQ ID NO: 61613 - DNA, 25 bp, Mus musculus
aaggctgtttagaacaagcaccctc

SEQ ID NO: 61614 - DNA, 25 bp, Mus musculus
aaggctgtttagtacaagcaccctc

SEQ ID NO: 61615 - DNA, 25 bp, Mus musculus
aaggctgttttcatggtcagttcat

SEQ ID NO: 61616 - DNA, 25 bp, Mus musculus
aaggctgttttcttggtcagttcat

SEQ ID NO: 61617 - DNA, 25 bp, Mus musculus
aaggcttaaaggactatctggatgt

SEQ ID NO: 61618 - DNA, 25 bp, Mus musculus
aaggcttaaaggtctatctggatgt

SEQ ID NO: 61619 - DNA, 25 bp, Mus musculus
aaggcttaaccaaggaggcccacct

SEQ ID NO: 61620 - DNA, 25 bp, Mus musculus
aaggcttaaccaatcttctcttcac

SEQ ID NO: 61621 - DNA, 25 bp, Mus musculus
aaggcttaaccatggaggcccacct

SEQ ID NO: 61622 - DNA, 25 bp, Mus musculus
aaggcttaaccattcttctcttcac

SEQ ID NO: 61623 - DNA, 25 bp, Mus musculus
aaggcttaattcacctgtattctaa

SEQ ID NO: 61624 - DNA, 25 bp, Mus musculus
aaggcttaattctcctgtattctaa

SEQ ID NO: 61625 - DNA, 25 bp, Mus musculus
aaggcttacgagcactcgtcaggaa

SEQ ID NO: 61626 - DNA, 25 bp, Mus musculus
aaggcttacgaggactcgtcaggaa

SEQ ID NO: 61627 - DNA, 25 bp, Mus musculus
aaggcttactagagccctgacagac

SEQ ID NO: 61628 - DNA, 25 bp, Mus musculus
aaggcttactagtgccctgacagac

SEQ ID NO: 61629 - DNA, 25 bp, Mus musculus
aaggcttaggagatgcagtcttctt

SEQ ID NO: 61630 - DNA, 25 bp, Mus musculus
aaggcttaggagttgcagtcttctt

SEQ ID NO: 61631 - DNA, 25 bp, Mus musculus
aaggcttaggatagaactcagtgat

SEQ ID NO: 61632 - DNA, 25 bp, Mus musculus
aaggcttaggattgaactcagtgat

SEQ ID NO: 61633 - DNA, 25 bp, Mus musculus
aaggcttaggccactggactttcat

SEQ ID NO: 61634 - DNA, 25 bp, Mus musculus
aaggcttaggcctctggactttcat

SEQ ID NO: 61635 - DNA, 25 bp, Mus musculus
aaggcttataatctgacccgaggga

SEQ ID NO: 61636 - DNA, 25 bp, Mus musculus
aaggcttataatgtgacccgaggga

SEQ ID NO: 61637 - DNA, 25 bp, Mus musculus
aaggcttatagtcccctgtctgggc

SEQ ID NO: 61638 - DNA, 25 bp, Mus musculus
aaggcttatagtgccctgtctgggc

SEQ ID NO: 61639 - DNA, 25 bp, Mus musculus
aaggcttatcacactatgcctggct

SEQ ID NO: 61640 - DNA, 25 bp, Mus musculus
aaggcttatcactctatgcctggct

SEQ ID NO: 61641 - DNA, 25 bp, Mus musculus
aaggcttatcagatcctctgaggca

SEQ ID NO: 61642 - DNA, 25 bp, Mus musculus
aaggcttatcagttcctctgaggca

SEQ ID NO: 61643 - DNA, 25 bp, Mus musculus
aaggcttattagacactccctgtga

SEQ ID NO: 61644 - DNA, 25 bp, Mus musculus
aaggcttattagtcactccctgtga

SEQ ID NO: 61645 - DNA, 25 bp, Mus musculus
aaggcttcaatacctgtgcaggcac

SEQ ID NO: 61646 - DNA, 25 bp, Mus musculus
aaggcttcaatagctgtgcaggcac

SEQ ID NO: 61647 - DNA, 25 bp, Mus musculus
aaggcttcaattaacatgctgcgga

SEQ ID NO: 61648 - DNA, 25 bp, Mus musculus
aaggcttcaatttacatgctgcgga

SEQ ID NO: 61649 - DNA, 25 bp, Mus musculus
aaggcttcacatcgacgacttggac

SEQ ID NO: 61650 - DNA, 25 bp, Mus musculus
aaggcttcacatggacgacttggac

SEQ ID NO: 61651 - DNA, 25 bp, Mus musculus
aaggcttcacctatgagtaccgcta

SEQ ID NO: 61652 - DNA, 25 bp, Mus musculus
aaggcttcacctccgattgtttcga

SEQ ID NO: 61653 - DNA, 25 bp, Mus musculus
aaggcttcacctgcgattgtttcga

SEQ ID NO: 61654 - DNA, 25 bp, Mus musculus
aaggcttcacctttgagtaccgcta

SEQ ID NO: 61655 - DNA, 25 bp, Mus musculus
aaggcttcagaactgggttcccgct

SEQ ID NO: 61656 - DNA, 25 bp, Mus musculus
aaggcttcagaagtgggttcccgct

SEQ ID NO: 61657 - DNA, 25 bp, Mus musculus
aaggcttcagagcatttccctgtat

SEQ ID NO: 61658 - DNA, 25 bp, Mus musculus
aaggcttcagaggatttccctgtat

SEQ ID NO: 61659 - DNA, 25 bp, Mus musculus
aaggcttcagatatcttcgcagtaa

SEQ ID NO: 61660 - DNA, 25 bp, Mus musculus
aaggcttcagatccaaccatttcaa

SEQ ID NO: 61661 - DNA, 25 bp, Mus musculus
aaggcttcagatgcaaccatttcaa

SEQ ID NO: 61662 - DNA, 25 bp, Mus musculus
aaggcttcagatttcttcgcagtaa

SEQ ID NO: 61663 - DNA, 25 bp, Mus musculus
aaggcttcagcacacttgagcaccg

SEQ ID NO: 61664 - DNA, 25 bp, Mus musculus
aaggcttcagcagacttgagcaccg

SEQ ID NO: 61665 - DNA, 25 bp, Mus musculus
aaggcttcaggcaataccttcaccg

SEQ ID NO: 61666 - DNA, 25 bp, Mus musculus
aaggcttcaggcagttagtcagaac

SEQ ID NO: 61667 - DNA, 25 bp, Mus musculus
aaggcttcaggctataccttcaccg

SEQ ID NO: 61668 - DNA, 25 bp, Mus musculus
aaggcttcaggctgttagtcagaac

SEQ ID NO: 61669 - DNA, 25 bp, Mus musculus
aaggcttcatccacatgcactatag

SEQ ID NO: 61670 - DNA, 25 bp, Mus musculus
aaggcttcatcccatatgttctgta

SEQ ID NO: 61671 - DNA, 25 bp, Mus musculus
aaggcttcatccgatatgttctgta

SEQ ID NO: 61672 - DNA, 25 bp, Mus musculus
aaggcttcatcctcatgcactatag

SEQ ID NO: 61673 - DNA, 25 bp, Mus musculus
aaggcttcatgtctccctgcgagga

SEQ ID NO: 61674 - DNA, 25 bp, Mus musculus
aaggcttcatgtgtccctgcgagga

SEQ ID NO: 61675 - DNA, 25 bp, Mus musculus
aaggcttcattacatggtgatcttc

SEQ ID NO: 61676 - DNA, 25 bp, Mus musculus
aaggcttcattagatggtgatcttc

SEQ ID NO: 61677 - DNA, 25 bp, Mus musculus
aaggcttccagcaggttcaaccagc

SEQ ID NO: 61678 - DNA, 25 bp, Mus musculus
aaggcttccagctggttcaaccagc

SEQ ID NO: 61679 - DNA, 25 bp, Mus musculus
aaggcttccatgcacagtgcgttca

SEQ ID NO: 61680 - DNA, 25 bp, Mus musculus
aaggcttccatggacagtgcgttca

SEQ ID NO: 61681 - DNA, 25 bp, Mus musculus
aaggcttcccacaagcgtgaacgga

SEQ ID NO: 61682 - DNA, 25 bp, Mus musculus
aaggcttcccactagcgtgaacgga

SEQ ID NO: 61683 - DNA, 25 bp, Mus musculus
aaggcttctagactggctcctaaga

SEQ ID NO: 61684 - DNA, 25 bp, Mus musculus
aaggcttctagagtggctcctaaga

SEQ ID NO: 61685 - DNA, 25 bp, Mus musculus
aaggcttctaggattgcaatcatat

SEQ ID NO: 61686 - DNA, 25 bp, Mus musculus
aaggcttctaggtttgcaatcatat

SEQ ID NO: 61687 - DNA, 25 bp, Mus musculus
aaggcttctattaccaacagatgtc

SEQ ID NO: 61688 - DNA, 25 bp, Mus musculus
aaggcttctatttccaacagatgtc

SEQ ID NO: 61689 - DNA, 25 bp, Mus musculus
aaggcttctctgattacgagagtaa

SEQ ID NO: 61690 - DNA, 25 bp, Mus musculus
aaggcttctctgtttacgagagtaa

SEQ ID NO: 61691 - DNA, 25 bp, Mus musculus
aaggcttctcttactattactgatg

SEQ ID NO: 61692 - DNA, 25 bp, Mus musculus
aaggcttctctttctattactgatg

SEQ ID NO: 61693 - DNA, 25 bp, Mus musculus
aaggcttctgatagtatgtgactgt

SEQ ID NO: 61694 - DNA, 25 bp, Mus musculus
aaggcttctgattgtatgtgactgt

SEQ ID NO: 61695 - DNA, 25 bp, Mus musculus
aaggcttctgccacaagggtgctgc

SEQ ID NO: 61696 - DNA, 25 bp, Mus musculus
aaggcttctgcctcaagggtgctgc

SEQ ID NO: 61697 - DNA, 25 bp, Mus musculus
aaggcttctgtccagtagcttcatc

SEQ ID NO: 61698 - DNA, 25 bp, Mus musculus
aaggcttctgtcgagtagcttcatc

SEQ ID NO: 61699 - DNA, 25 bp, Mus musculus
aaggcttctgtgaacttgccggaaa

SEQ ID NO: 61700 - DNA, 25 bp, Mus musculus
aaggcttctgtgtacttgccggaaa

SEQ ID NO: 61701 - DNA, 25 bp, Mus musculus
aaggcttcttagcaccaggaatatc

SEQ ID NO: 61702 - DNA, 25 bp, Mus musculus
aaggcttcttaggaccaggaatatc

SEQ ID NO: 61703 - DNA, 25 bp, Mus musculus
aaggcttcttcaacctgctgaccca

SEQ ID NO: 61704 - DNA, 25 bp, Mus musculus
aaggcttcttcatcctgctgaccca

SEQ ID NO: 61705 - DNA, 25 bp, Mus musculus
aaggcttcttgcagtttagcagact

SEQ ID NO: 61706 - DNA, 25 bp, Mus musculus
aaggcttcttgctgtttagcagact

SEQ ID NO: 61707 - DNA, 25 bp, Mus musculus
aaggcttcttggagggagatagtca

SEQ ID NO: 61708 - DNA, 25 bp, Mus musculus
aaggcttcttggtgggagatagtca

SEQ ID NO: 61709 - DNA, 25 bp, Mus musculus
aaggcttgaaagctcctgcttgcaa

SEQ ID NO: 61710 - DNA, 25 bp, Mus musculus
aaggcttgaaaggtcctgcttgcaa

SEQ ID NO: 61711 - DNA, 25 bp, Mus musculus
aaggcttgaaggctttttatgacat

SEQ ID NO: 61712 - DNA, 25 bp, Mus musculus
aaggcttgaagggtttttatgacat

SEQ ID NO: 61713 - DNA, 25 bp, Mus musculus
aaggcttgacaaactgcggtgcatg

SEQ ID NO: 61714 - DNA, 25 bp, Mus musculus
aaggcttgacaaatgcatctgttac

SEQ ID NO: 61715 - DNA, 25 bp, Mus musculus
aaggcttgacaatctgcggtgcatg

SEQ ID NO: 61716 - DNA, 25 bp, Mus musculus
aaggcttgacaattgcatctgttac

SEQ ID NO: 61717 - DNA, 25 bp, Mus musculus
aaggcttgaccaatgggaccactac

SEQ ID NO: 61718 - DNA, 25 bp, Mus musculus
aaggcttgaccattgggaccactac

SEQ ID NO: 61719 - DNA, 25 bp, Mus musculus
aaggcttgacttcagcttcatatag

SEQ ID NO: 61720 - DNA, 25 bp, Mus musculus
aaggcttgacttgagcttcatatag

SEQ ID NO: 61721 - DNA, 25 bp, Mus musculus
aaggcttgccagcaggttccaaatt

SEQ ID NO: 61722 - DNA, 25 bp, Mus musculus
aaggcttgccagctaagagattact

SEQ ID NO: 61723 - DNA, 25 bp, Mus musculus
aaggcttgccaggaggttccaaatt

SEQ ID NO: 61724 - DNA, 25 bp, Mus musculus
aaggcttgccaggtaagagattact

SEQ ID NO: 61725 - DNA, 25 bp, Mus musculus
aaggcttgccctctaagtggtttgc

SEQ ID NO: 61726 - DNA, 25 bp, Mus musculus
aaggcttgccctgtaagtggtttgc

SEQ ID NO: 61727 - DNA, 25 bp, Mus musculus
aaggcttgccttatgcacagtggga

SEQ ID NO: 61728 - DNA, 25 bp, Mus musculus
aaggcttgccttttgcacagtggga

SEQ ID NO: 61729 - DNA, 25 bp, Mus musculus
aaggcttgcgcaaagtggcctgcat

SEQ ID NO: 61730 - DNA, 25 bp, Mus musculus
aaggcttgcgcatagtggcctgcat

SEQ ID NO: 61731 - DNA, 25 bp, Mus musculus
aaggcttggaagacctcgtcggtat

SEQ ID NO: 61732 - DNA, 25 bp, Mus musculus
aaggcttggaagtcctcgtcggtat

SEQ ID NO: 61733 - DNA, 25 bp, Mus musculus
aaggcttggatgagcctgatggcaa

SEQ ID NO: 61734 - DNA, 25 bp, Mus musculus
aaggcttggatgtgcctgatggcaa

SEQ ID NO: 61735 - DNA, 25 bp, Mus musculus
aaggcttggcacactaggagtagtt

SEQ ID NO: 61736 - DNA, 25 bp, Mus musculus
aaggcttggcactctaggagtagtt

SEQ ID NO: 61737 - DNA, 25 bp, Mus musculus
aaggcttggcagagtttctccgagg

SEQ ID NO: 61738 - DNA, 25 bp, Mus musculus
aaggcttggcagtgtttctccgagg

SEQ ID NO: 61739 - DNA, 25 bp, Mus musculus
aaggcttggcgcatggacaatcttc

SEQ ID NO: 61740 - DNA, 25 bp, Mus musculus
aaggcttggcgcttggacaatcttc

SEQ ID NO: 61741 - DNA, 25 bp, Mus musculus
aaggcttggcttattgtctgctgac

SEQ ID NO: 61742 - DNA, 25 bp, Mus musculus
aaggcttggctttttgtctgctgac

SEQ ID NO: 61743 - DNA, 25 bp, Mus musculus
aaggcttgggatatgcaatgtacaa

SEQ ID NO: 61744 - DNA, 25 bp, Mus musculus
aaggcttgggatttgcaatgtacaa

SEQ ID NO: 61745 - DNA, 25 bp, Mus musculus
aaggcttgggccattgagcagcagt

SEQ ID NO: 61746 - DNA, 25 bp, Mus musculus
aaggcttgggcctttgagcagcagt

SEQ ID NO: 61747 - DNA, 25 bp, Mus musculus
aaggcttgggcgctcagtgtttcta

SEQ ID NO: 61748 - DNA, 25 bp, Mus musculus
aaggcttgggcggtcagtgtttcta

SEQ ID NO: 61749 - DNA, 25 bp, Mus musculus
aaggcttggtggactccttttctca

SEQ ID NO: 61750 - DNA, 25 bp, Mus musculus
aaggcttggtggtctccttttctca

SEQ ID NO: 61751 - DNA, 25 bp, Mus musculus
aaggcttggtttccatacggcagac

SEQ ID NO: 61752 - DNA, 25 bp, Mus musculus
aaggcttggtttgcatacggcagac

SEQ ID NO: 61753 - DNA, 25 bp, Mus musculus
aaggcttgtacaaacacttttccag

SEQ ID NO: 61754 - DNA, 25 bp, Mus musculus
aaggcttgtacatacacttttccag

SEQ ID NO: 61755 - DNA, 25 bp, Mus musculus
aaggcttgtcagacaattcaggaac

SEQ ID NO: 61756 - DNA, 25 bp, Mus musculus
aaggcttgtcagtcaattcaggaac

SEQ ID NO: 61757 - DNA, 25 bp, Mus musculus
aaggcttgtctaatggtgatgatgt

SEQ ID NO: 61758 - DNA, 25 bp, Mus musculus
aaggcttgtctattggtgatgatgt

SEQ ID NO: 61759 - DNA, 25 bp, Mus musculus
aaggcttgtcttcattatgaagtca

SEQ ID NO: 61760 - DNA, 25 bp, Mus musculus
aaggcttgtcttgattatgaagtca

SEQ ID NO: 61761 - DNA, 25 bp, Mus musculus
aaggcttgtgacacgaatcccacgg

SEQ ID NO: 61762 - DNA, 25 bp, Mus musculus
aaggcttgtgactcgaatcccacgg

SEQ ID NO: 61763 - DNA, 25 bp, Mus musculus
aaggcttgttacacggagcggtgca

SEQ ID NO: 61764 - DNA, 25 bp, Mus musculus
aaggcttgttactcggagcggtgca

SEQ ID NO: 61765 - DNA, 25 bp, Mus musculus
aaggctttaagtctcatctcatccg

SEQ ID NO: 61766 - DNA, 25 bp, Mus musculus
aaggctttaagtgtcatctcatccg

SEQ ID NO: 61767 - DNA, 25 bp, Mus musculus
aaggctttaatgctactgatttctg

SEQ ID NO: 61768 - DNA, 25 bp, Mus musculus
aaggctttaatggtactgatttctg

SEQ ID NO: 61769 - DNA, 25 bp, Mus musculus
aaggctttactaagtgtctgggcag

SEQ ID NO: 61770 - DNA, 25 bp, Mus musculus
aaggctttactatgtgtctgggcag

SEQ ID NO: 61771 - DNA, 25 bp, Mus musculus
aaggctttagtgacactcattctat

SEQ ID NO: 61772 - DNA, 25 bp, Mus musculus
aaggctttagtgtcactcattctat

SEQ ID NO: 61773 - DNA, 25 bp, Mus musculus
aaggctttcaacatctagattgtca

SEQ ID NO: 61774 - DNA, 25 bp, Mus musculus
aaggctttcaacttctagattgtca

SEQ ID NO: 61775 - DNA, 25 bp, Mus musculus
aaggctttcactctatttcaacgca

SEQ ID NO: 61776 - DNA, 25 bp, Mus musculus
aaggctttcactgtatttcaacgca

SEQ ID NO: 61777 - DNA, 25 bp, Mus musculus
aaggctttcagcagcatatcgacat

SEQ ID NO: 61778 - DNA, 25 bp, Mus musculus
aaggctttcagctgcatatcgacat

SEQ ID NO: 61779 - DNA, 25 bp, Mus musculus
aaggctttcattctgtggacacaat

SEQ ID NO: 61780 - DNA, 25 bp, Mus musculus
aaggctttcattgtgtggacacaat

SEQ ID NO: 61781 - DNA, 25 bp, Mus musculus
aaggctttcgccagattgggtggaa

SEQ ID NO: 61782 - DNA, 25 bp, Mus musculus
aaggctttcgccattacagacgcga

SEQ ID NO: 61783 - DNA, 25 bp, Mus musculus
aaggctttcgcctgattgggtggaa

SEQ ID NO: 61784 - DNA, 25 bp, Mus musculus
aaggctttcgcctttacagacgcga

SEQ ID NO: 61785 - DNA, 25 bp, Mus musculus
aaggctttcggaatgcagaaccttt

SEQ ID NO: 61786 - DNA, 25 bp, Mus musculus
aaggctttcggattgcagaaccttt

SEQ ID NO: 61787 - DNA, 25 bp, Mus musculus
aaggctttcgttcaacagttcttgt

SEQ ID NO: 61788 - DNA, 25 bp, Mus musculus
aaggctttcgttgaacagttcttgt

SEQ ID NO: 61789 - DNA, 25 bp, Mus musculus
aaggctttctgcaggcaatgctggc

SEQ ID NO: 61790 - DNA, 25 bp, Mus musculus
aaggctttctgctggcaatgctggc

SEQ ID NO: 61791 - DNA, 25 bp, Mus musculus
aaggctttctggcatccaattaaag

SEQ ID NO: 61792 - DNA, 25 bp, Mus musculus
aaggctttctgggatccaattaaag

SEQ ID NO: 61793 - DNA, 25 bp, Mus musculus
aaggctttctttaatcagtcagaga

SEQ ID NO: 61794 - DNA, 25 bp, Mus musculus
aaggctttcttttatcagtcagaga

SEQ ID NO: 61795 - DNA, 25 bp, Mus musculus
aaggctttgaaaagaaccaagttgc

SEQ ID NO: 61796 - DNA, 25 bp, Mus musculus
aaggctttgaaacccatggaagtct

SEQ ID NO: 61797 - DNA, 25 bp, Mus musculus
aaggctttgaaactcccagcaaaag

SEQ ID NO: 61798 - DNA, 25 bp, Mus musculus
aaggctttgaaagccatggaagtct

SEQ ID NO: 61799 - DNA, 25 bp, Mus musculus
aaggctttgaaagtcccagcaaaag

SEQ ID NO: 61800 - DNA, 25 bp, Mus musculus
aaggctttgaaatgaaccaagttgc

SEQ ID NO: 61801 - DNA, 25 bp, Mus musculus
aaggctttgcatctggaaaccatcc

SEQ ID NO: 61802 - DNA, 25 bp, Mus musculus
aaggctttgcatgtggaaaccatcc

SEQ ID NO: 61803 - DNA, 25 bp, Mus musculus
aaggctttgcccaaacaaatctcct

SEQ ID NO: 61804 - DNA, 25 bp, Mus musculus
aaggctttgccctaacaaatctcct

SEQ ID NO: 61805 - DNA, 25 bp, Mus musculus
aaggctttgcctaagtctagtgctg

SEQ ID NO: 61806 - DNA, 25 bp, Mus musculus
aaggctttgccttagtctagtgctg

SEQ ID NO: 61807 - DNA, 25 bp, Mus musculus
aaggctttgcgtacacatgtactgt

SEQ ID NO: 61808 - DNA, 25 bp, Mus musculus
aaggctttgcgttcacatgtactgt

SEQ ID NO: 61809 - DNA, 25 bp, Mus musculus
aaggctttgctactgaaggctgaac

SEQ ID NO: 61810 - DNA, 25 bp, Mus musculus
aaggctttgctagtgaaggctgaac

SEQ ID NO: 61811 - DNA, 25 bp, Mus musculus
aaggctttgctcacctaataaagga

SEQ ID NO: 61812 - DNA, 25 bp, Mus musculus
aaggctttgctctcctaataaagga

SEQ ID NO: 61813 - DNA, 25 bp, Mus musculus
aaggctttgctgaatgtctcatccg

SEQ ID NO: 61814 - DNA, 25 bp, Mus musculus
aaggctttgctgtatgtctcatccg

SEQ ID NO: 61815 - DNA, 25 bp, Mus musculus
aaggctttgcttctattaaatgaga

SEQ ID NO: 61816 - DNA, 25 bp, Mus musculus
aaggctttgcttgtattaaatgaga

SEQ ID NO: 61817 - DNA, 25 bp, Mus musculus
aaggctttggagacaatgggcttct

SEQ ID NO: 61818 - DNA, 25 bp, Mus musculus
aaggctttggagtcaatgggcttct

SEQ ID NO: 61819 - DNA, 25 bp, Mus musculus
aaggctttggatattgaaggatatt

SEQ ID NO: 61820 - DNA, 25 bp, Mus musculus
aaggctttggatcctaccaaggccc

SEQ ID NO: 61821 - DNA, 25 bp, Mus musculus
aaggctttggatgctaccaaggccc

SEQ ID NO: 61822 - DNA, 25 bp, Mus musculus
aaggctttggattttgaaggatatt

SEQ ID NO: 61823 - DNA, 25 bp, Mus musculus
aaggctttgtaactagctgaaggct

SEQ ID NO: 61824 - DNA, 25 bp, Mus musculus
aaggctttgtaagtagctgaaggct

SEQ ID NO: 61825 - DNA, 25 bp, Mus musculus
aaggctttgtaccatttctagttca

SEQ ID NO: 61826 - DNA, 25 bp, Mus musculus
aaggctttgtacgatttctagttca

SEQ ID NO: 61827 - DNA, 25 bp, Mus musculus
aaggctttgtcaaggctgacttcat

SEQ ID NO: 61828 - DNA, 25 bp, Mus musculus
aaggctttgtcatggctgacttcat

SEQ ID NO: 61829 - DNA, 25 bp, Mus musculus
aaggctttgtggatatggctgtcag

SEQ ID NO: 61830 - DNA, 25 bp, Mus musculus
aaggctttgtggttatggctgtcag

SEQ ID NO: 61831 - DNA, 25 bp, Mus musculus
aaggctttgttccagaagctcgtcc

SEQ ID NO: 61832 - DNA, 25 bp, Mus musculus
aaggctttgttcgagaagctcgtcc

SEQ ID NO: 61833 - DNA, 25 bp, Mus musculus
aaggctttgtttccagaggccagct

SEQ ID NO: 61834 - DNA, 25 bp, Mus musculus
aaggctttgtttgcagaggccagct

SEQ ID NO: 61835 - DNA, 25 bp, Mus musculus
aaggcttttctactcatatgattca

SEQ ID NO: 61836 - DNA, 25 bp, Mus musculus
aaggcttttctagtcatatgattca

SEQ ID NO: 61837 - DNA, 25 bp, Mus musculus
aaggcttttgcaaatttaactcgaa

SEQ ID NO: 61838 - DNA, 25 bp, Mus musculus
aaggcttttgcatatttaactcgaa

SEQ ID NO: 61839 - DNA, 25 bp, Mus musculus
aaggcttttgccagtctccgaatgg

SEQ ID NO: 61840 - DNA, 25 bp, Mus musculus
aaggcttttgcctgtctccgaatgg

SEQ ID NO: 61841 - DNA, 25 bp, Mus musculus
aaggcttttgttcactctggtgccc

SEQ ID NO: 61842 - DNA, 25 bp, Mus musculus
aaggcttttgttctcttcgaaatcg

SEQ ID NO: 61843 - DNA, 25 bp, Mus musculus
aaggcttttgttgactctggtgccc

SEQ ID NO: 61844 - DNA, 25 bp, Mus musculus
aaggcttttgttgtcttcgaaatcg

SEQ ID NO: 61845 - DNA, 25 bp, Mus musculus
aaggctttttgaattctcatcctga

SEQ ID NO: 61846 - DNA, 25 bp, Mus musculus
aaggctttttgatttctcatcctga

SEQ ID NO: 61847 - DNA, 25 bp, Mus musculus
aaggcttttttccagctcacctgtt

SEQ ID NO: 61848 - DNA, 25 bp, Mus musculus
aaggcttttttcgagctcacctgtt

SEQ ID NO: 61849 - DNA, 25 bp, Mus musculus
aagggaaaactacagccaccacaca

SEQ ID NO: 61850 - DNA, 25 bp, Mus musculus
aagggaaaactagagccaccacaca

SEQ ID NO: 61851 - DNA, 25 bp, Mus musculus
aagggaaacagtcctccattgctgg

SEQ ID NO: 61852 - DNA, 25 bp, Mus musculus
aagggaaacagtgctccattgctgg

SEQ ID NO: 61853 - DNA, 25 bp, Mus musculus
aagggaaacatgatcttgtcctgaa

SEQ ID NO: 61854 - DNA, 25 bp, Mus musculus
aagggaaacatgttcttgtcctgaa

SEQ ID NO: 61855 - DNA, 25 bp, Mus musculus
aagggaaaggcactctcgttctcat

SEQ ID NO: 61856 - DNA, 25 bp, Mus musculus
aagggaaaggcagtctcgttctcat

SEQ ID NO: 61857 - DNA, 25 bp, Mus musculus
aagggaaatcagcttgctagtacat

SEQ ID NO: 61858 - DNA, 25 bp, Mus musculus
aagggaaatcaggttgctagtacat

SEQ ID NO: 61859 - DNA, 25 bp, Mus musculus
aagggaaatgctcttctcatccaag

SEQ ID NO: 61860 - DNA, 25 bp, Mus musculus
aagggaaatgctgttctcatccaag

SEQ ID NO: 61861 - DNA, 25 bp, Mus musculus
aagggaacagcactcttccacggtc

SEQ ID NO: 61862 - DNA, 25 bp, Mus musculus
aagggaacagcagtcttccacggtc

SEQ ID NO: 61863 - DNA, 25 bp, Mus musculus
aagggaacagctagtgctggagaac

SEQ ID NO: 61864 - DNA, 25 bp, Mus musculus
aagggaacagcttgtgctggagaac

SEQ ID NO: 61865 - DNA, 25 bp, Mus musculus
aagggaacatcgcacgtttcctgtt

SEQ ID NO: 61866 - DNA, 25 bp, Mus musculus
aagggaacatcggacgtttcctgtt

SEQ ID NO: 61867 - DNA, 25 bp, Mus musculus
aagggaacatctactgaccccgcta

SEQ ID NO: 61868 - DNA, 25 bp, Mus musculus
aagggaacatcttctgaccccgcta

SEQ ID NO: 61869 - DNA, 25 bp, Mus musculus
aagggaaccacactgtgtaccgcat

SEQ ID NO: 61870 - DNA, 25 bp, Mus musculus
aagggaaccacagtgtgtaccgcat

SEQ ID NO: 61871 - DNA, 25 bp, Mus musculus
aagggaacctcacctcgttaggcag

SEQ ID NO: 61872 - DNA, 25 bp, Mus musculus
aagggaacctcagctcgttaggcag

SEQ ID NO: 61873 - DNA, 25 bp, Mus musculus
aagggaacgctgacatcctgacaac

SEQ ID NO: 61874 - DNA, 25 bp, Mus musculus
aagggaacgctgtcatcctgacaac

SEQ ID NO: 61875 - DNA, 25 bp, Mus musculus
aagggaactcgcaccttgttcttgg

SEQ ID NO: 61876 - DNA, 25 bp, Mus musculus
aagggaactcgctccttgttcttgg

SEQ ID NO: 61877 - DNA, 25 bp, Mus musculus
aagggaactcgtcgtaactgtgtca

SEQ ID NO: 61878 - DNA, 25 bp, Mus musculus
aagggaactcgtggtaactgtgtca

SEQ ID NO: 61879 - DNA, 25 bp, Mus musculus
aagggaagacccagctccagttgtt

SEQ ID NO: 61880 - DNA, 25 bp, Mus musculus
aagggaagacccatgttgcacctct

SEQ ID NO: 61881 - DNA, 25 bp, Mus musculus
aagggaagaccctgctccagttgtt

SEQ ID NO: 61882 - DNA, 25 bp, Mus musculus
aagggaagacccttgttgcacctct

SEQ ID NO: 61883 - DNA, 25 bp, Mus musculus
aagggaagatccctcctgctccgtt

SEQ ID NO: 61884 - DNA, 25 bp, Mus musculus
aagggaagatccgtcctgctccgtt

SEQ ID NO: 61885 - DNA, 25 bp, Mus musculus
aagggaagcccaaggcctcagccag

SEQ ID NO: 61886 - DNA, 25 bp, Mus musculus
aagggaagcccatggcctcagccag

SEQ ID NO: 61887 - DNA, 25 bp, Mus musculus
aagggaaggatcctgtcttctggaa

SEQ ID NO: 61888 - DNA, 25 bp, Mus musculus
aagggaaggatcgtgtcttctggaa

SEQ ID NO: 61889 - DNA, 25 bp, Mus musculus
aagggaaggctcagcctgagaccat

SEQ ID NO: 61890 - DNA, 25 bp, Mus musculus
aagggaaggctctgcctgagaccat

SEQ ID NO: 61891 - DNA, 25 bp, Mus musculus
aagggaaggttgcacactggaaaca

SEQ ID NO: 61892 - DNA, 25 bp, Mus musculus
aagggaaggttggacactggaaaca

SEQ ID NO: 61893 - DNA, 25 bp, Mus musculus
aagggaagtcttccatgccccaaga

SEQ ID NO: 61894 - DNA, 25 bp, Mus musculus
aagggaagtcttgcatgccccaaga

SEQ ID NO: 61895 - DNA, 25 bp, Mus musculus
aagggaagttgtccatcaccttcag

SEQ ID NO: 61896 - DNA, 25 bp, Mus musculus
aagggaagttgtgcatcaccttcag

SEQ ID NO: 61897 - DNA, 25 bp, Mus musculus
aagggaatactgaatgctggaaaac

SEQ ID NO: 61898 - DNA, 25 bp, Mus musculus
aagggaatactgtatgctggaaaac

SEQ ID NO: 61899 - DNA, 25 bp, Mus musculus
aagggaatctctacaaggctgggaa

SEQ ID NO: 61900 - DNA, 25 bp, Mus musculus
aagggaatctcttcaaggctgggaa

SEQ ID NO: 61901 - DNA, 25 bp, Mus musculus
aagggaatctgaagcatgtggtcta

SEQ ID NO: 61902 - DNA, 25 bp, Mus musculus
aagggaatctgatgcatgtggtcta

SEQ ID NO: 61903 - DNA, 25 bp, Mus musculus
aagggaatctgccttagtcaccctc

SEQ ID NO: 61904 - DNA, 25 bp, Mus musculus
aagggaatctgcgttagtcaccctc

SEQ ID NO: 61905 - DNA, 25 bp, Mus musculus
aagggaatctgtagctcttcttcaa

SEQ ID NO: 61906 - DNA, 25 bp, Mus musculus
aagggaatctgttgctcttcttcaa

SEQ ID NO: 61907 - DNA, 25 bp, Mus musculus
aagggaatcttaagcaacaccgtgg

SEQ ID NO: 61908 - DNA, 25 bp, Mus musculus
aagggaatcttatgcaacaccgtgg

SEQ ID NO: 61909 - DNA, 25 bp, Mus musculus
aagggaatgcccacgaaactgtcag

SEQ ID NO: 61910 - DNA, 25 bp, Mus musculus
aagggaatgccctcgaaactgtcag

SEQ ID NO: 61911 - DNA, 25 bp, Mus musculus
aagggaatgctgatatggatctcaa

SEQ ID NO: 61912 - DNA, 25 bp, Mus musculus
aagggaatgctgttatggatctcaa

SEQ ID NO: 61913 - DNA, 25 bp, Mus musculus
aagggaattacccactgattaagat

SEQ ID NO: 61914 - DNA, 25 bp, Mus musculus
aagggaattaccgactgattaagat

SEQ ID NO: 61915 - DNA, 25 bp, Mus musculus
aagggaattgaacggcagtctgcac

SEQ ID NO: 61916 - DNA, 25 bp, Mus musculus
aagggaattgaagggcagtctgcac

SEQ ID NO: 61917 - DNA, 25 bp, Mus musculus
aagggaattggcatcctcacacagg

SEQ ID NO: 61918 - DNA, 25 bp, Mus musculus
aagggaattggcttcctcacacagg

SEQ ID NO: 61919 - DNA, 25 bp, Mus musculus
aagggaatttctctattggctagga

SEQ ID NO: 61920 - DNA, 25 bp, Mus musculus
aagggaatttctgtattggctagga

SEQ ID NO: 61921 - DNA, 25 bp, Mus musculus
aagggacaatcacaagaatcttcaa

SEQ ID NO: 61922 - DNA, 25 bp, Mus musculus
aagggacaatcagaagaatcttcaa

SEQ ID NO: 61923 - DNA, 25 bp, Mus musculus
aagggacaattacccacttgccccg

SEQ ID NO: 61924 - DNA, 25 bp, Mus musculus
aagggacaattagccacttgccccg

SEQ ID NO: 61925 - DNA, 25 bp, Mus musculus
aagggacactagctttgcttttggg

SEQ ID NO: 61926 - DNA, 25 bp, Mus musculus
aagggacactaggtttgcttttggg

SEQ ID NO: 61927 - DNA, 25 bp, Mus musculus
aagggacactgcagagatgccccac

SEQ ID NO: 61928 - DNA, 25 bp, Mus musculus
aagggacactgctgagatgccccac

SEQ ID NO: 61929 - DNA, 25 bp, Mus musculus
aagggacagaatacagcacagatgc

SEQ ID NO: 61930 - DNA, 25 bp, Mus musculus
aagggacagaattcagcacagatgc

SEQ ID NO: 61931 - DNA, 25 bp, Mus musculus
aagggacagactccggttcactgaa

SEQ ID NO: 61932 - DNA, 25 bp, Mus musculus
aagggacagactgcggttcactgaa

SEQ ID NO: 61933 - DNA, 25 bp, Mus musculus
aagggacagattctcagagccctca

SEQ ID NO: 61934 - DNA, 25 bp, Mus musculus
aagggacagattgtcagagccctca

SEQ ID NO: 61935 - DNA, 25 bp, Mus musculus
aagggacagcacagggccttttgct

SEQ ID NO: 61936 - DNA, 25 bp, Mus musculus
aagggacagcactgggccttttgct

SEQ ID NO: 61937 - DNA, 25 bp, Mus musculus
aagggacagcgcaggacagtacaga

SEQ ID NO: 61938 - DNA, 25 bp, Mus musculus
aagggacagcgctggacagtacaga

SEQ ID NO: 61939 - DNA, 25 bp, Mus musculus
aagggacaggacagaagccagctcc

SEQ ID NO: 61940 - DNA, 25 bp, Mus musculus
aagggacaggactgaagccagctcc

SEQ ID NO: 61941 - DNA, 25 bp, Mus musculus
aagggacaggagagtgcgttctcac

SEQ ID NO: 61942 - DNA, 25 bp, Mus musculus
aagggacaggagtgtgcgttctcac

SEQ ID NO: 61943 - DNA, 25 bp, Mus musculus
aagggacagtaaatcacctgtagct

SEQ ID NO: 61944 - DNA, 25 bp, Mus musculus
aagggacagtaattcacctgtagct

SEQ ID NO: 61945 - DNA, 25 bp, Mus musculus
aagggacagttgcaatctacattaa

SEQ ID NO: 61946 - DNA, 25 bp, Mus musculus
aagggacagttggaatctacattaa

SEQ ID NO: 61947 - DNA, 25 bp, Mus musculus
aagggacataaacacatggatttta

SEQ ID NO: 61948 - DNA, 25 bp, Mus musculus
aagggacataaagacatggatttta

SEQ ID NO: 61949 - DNA, 25 bp, Mus musculus
aagggacataacatgggactcaaag

SEQ ID NO: 61950 - DNA, 25 bp, Mus musculus
aagggacataacttgggactcaaag

SEQ ID NO: 61951 - DNA, 25 bp, Mus musculus
aagggacatcgtccagaccgggttc

SEQ ID NO: 61952 - DNA, 25 bp, Mus musculus
aagggacatcgtgcagaccgggttc

SEQ ID NO: 61953 - DNA, 25 bp, Mus musculus
aagggaccaacccagtgtctgcagg

SEQ ID NO: 61954 - DNA, 25 bp, Mus musculus
aagggaccaaccgagtgtctgcagg

SEQ ID NO: 61955 - DNA, 25 bp, Mus musculus
aagggaccaactacatcatctgggt

SEQ ID NO: 61956 - DNA, 25 bp, Mus musculus
aagggaccaacttcatcatctgggt

SEQ ID NO: 61957 - DNA, 25 bp, Mus musculus
aagggaccacaaactggttttccat

SEQ ID NO: 61958 - DNA, 25 bp, Mus musculus
aagggaccacaatctggttttccat

SEQ ID NO: 61959 - DNA, 25 bp, Mus musculus
aagggaccacccagtggctgactgc

SEQ ID NO: 61960 - DNA, 25 bp, Mus musculus
aagggaccaccctgtggctgactgc

SEQ ID NO: 61961 - DNA, 25 bp, Mus musculus
aagggaccacctagtgtgatggctc

SEQ ID NO: 61962 - DNA, 25 bp, Mus musculus
aagggaccaccttgtgtgatggctc

SEQ ID NO: 61963 - DNA, 25 bp, Mus musculus
aagggaccactcactcacatttgac

SEQ ID NO: 61964 - DNA, 25 bp, Mus musculus
aagggaccactctctcacatttgac

SEQ ID NO: 61965 - DNA, 25 bp, Mus musculus
aagggaccagtaacttgtaactcaa

SEQ ID NO: 61966 - DNA, 25 bp, Mus musculus
aagggaccagtatcttgtaactcaa

SEQ ID NO: 61967 - DNA, 25 bp, Mus musculus
aagggaccagtcattattacagatt

SEQ ID NO: 61968 - DNA, 25 bp, Mus musculus
aagggaccagtctttattacagatt

SEQ ID NO: 61969 - DNA, 25 bp, Mus musculus
aagggacccgagagctcattggccg

SEQ ID NO: 61970 - DNA, 25 bp, Mus musculus
aagggacccgagtgctcattggccg

SEQ ID NO: 61971 - DNA, 25 bp, Mus musculus
aagggaccgtaacagcctcaaggct

SEQ ID NO: 61972 - DNA, 25 bp, Mus musculus
aagggaccgtaagagcctcaaggct

SEQ ID NO: 61973 - DNA, 25 bp, Mus musculus
aagggacctaccatgctagcctgga

SEQ ID NO: 61974 - DNA, 25 bp, Mus musculus
aagggacctaccttgctagcctgga

SEQ ID NO: 61975 - DNA, 25 bp, Mus musculus
aagggacctcgtactgcactggaag

SEQ ID NO: 61976 - DNA, 25 bp, Mus musculus
aagggacctcgttctgcactggaag

SEQ ID NO: 61977 - DNA, 25 bp, Mus musculus
aagggacctgctatttctatataac

SEQ ID NO: 61978 - DNA, 25 bp, Mus musculus
aagggacctgctttttctatataac

SEQ ID NO: 61979 - DNA, 25 bp, Mus musculus
aagggacctgtccttggatctacag

SEQ ID NO: 61980 - DNA, 25 bp, Mus musculus
aagggacctgtcgttggatctacag

SEQ ID NO: 61981 - DNA, 25 bp, Mus musculus
aagggacctgtgaatactttcactc

SEQ ID NO: 61982 - DNA, 25 bp, Mus musculus
aagggacctgtgtatactttcactc

SEQ ID NO: 61983 - DNA, 25 bp, Mus musculus
aagggaccttttcttgattgatgta

SEQ ID NO: 61984 - DNA, 25 bp, Mus musculus
aagggaccttttgttgattgatgta

SEQ ID NO: 61985 - DNA, 25 bp, Mus musculus
aagggacgacatcctgtgctgagca

SEQ ID NO: 61986 - DNA, 25 bp, Mus musculus
aagggacgacatgctgtgctgagca

SEQ ID NO: 61987 - DNA, 25 bp, Mus musculus
aagggacgcatcaaccatcagagac

SEQ ID NO: 61988 - DNA, 25 bp, Mus musculus
aagggacgcatctaccatcagagac

SEQ ID NO: 61989 - DNA, 25 bp, Mus musculus
aagggacgctgtcatttcattgcct

SEQ ID NO: 61990 - DNA, 25 bp, Mus musculus
aagggacgctgtgatttcattgcct

SEQ ID NO: 61991 - DNA, 25 bp, Mus musculus
aagggacggacacagggtcgatgct

SEQ ID NO: 61992 - DNA, 25 bp, Mus musculus
aagggacggacagagggtcgatgct

SEQ ID NO: 61993 - DNA, 25 bp, Mus musculus
aagggactaagtcccaactgtataa

SEQ ID NO: 61994 - DNA, 25 bp, Mus musculus
aagggactaagtgccaactgtataa

SEQ ID NO: 61995 - DNA, 25 bp, Mus musculus
aagggactagaacatcatctcggat

SEQ ID NO: 61996 - DNA, 25 bp, Mus musculus
aagggactagaagatcatctcggat

SEQ ID NO: 61997 - DNA, 25 bp, Mus musculus
aagggactcaggctgttaatgcaaa

SEQ ID NO: 61998 - DNA, 25 bp, Mus musculus
aagggactcagggtgttaatgcaaa

SEQ ID NO: 61999 - DNA, 25 bp, Mus musculus
aagggactctctccaggttgtcctg

SEQ ID NO: 62000 - DNA, 25 bp, Mus musculus
aagggactctctgcaggttgtcctg

SEQ ID NO: 62001 - DNA, 25 bp, Mus musculus
aagggactgacaatggaccatcttc

SEQ ID NO: 62002 - DNA, 25 bp, Mus musculus
aagggactgacattggaccatcttc

SEQ ID NO: 62003 - DNA, 25 bp, Mus musculus
aagggactgaccacacaagagcctc

SEQ ID NO: 62004 - DNA, 25 bp, Mus musculus
aagggactgacctcacaagagcctc

SEQ ID NO: 62005 - DNA, 25 bp, Mus musculus
aagggactgcagaagcctggaagat

SEQ ID NO: 62006 - DNA, 25 bp, Mus musculus
aagggactgcagtagcctggaagat

SEQ ID NO: 62007 - DNA, 25 bp, Mus musculus
aagggactgcttagtgccatgtgga

SEQ ID NO: 62008 - DNA, 25 bp, Mus musculus
aagggactgctttgtgccatgtgga

SEQ ID NO: 62009 - DNA, 25 bp, Mus musculus
aagggactggctatcctggacgagc

SEQ ID NO: 62010 - DNA, 25 bp, Mus musculus
aagggactggctttcctggacgagc

SEQ ID NO: 62011 - DNA, 25 bp, Mus musculus
aagggactggtaccttgaacttgga

SEQ ID NO: 62012 - DNA, 25 bp, Mus musculus
aagggactggtagcttgaacttgga

SEQ ID NO: 62013 - DNA, 25 bp, Mus musculus
aagggactggtcataattgctctag

SEQ ID NO: 62014 - DNA, 25 bp, Mus musculus
aagggactggtcttaattgctctag

SEQ ID NO: 62015 - DNA, 25 bp, Mus musculus
aagggactgtatatcctgattcctc

SEQ ID NO: 62016 - DNA, 25 bp, Mus musculus
aagggactgtatttcctgattcctc

SEQ ID NO: 62017 - DNA, 25 bp, Mus musculus
aagggactgttcacacaagatcagg

SEQ ID NO: 62018 - DNA, 25 bp, Mus musculus
aagggactgttctcacaagatcagg

SEQ ID NO: 62019 - DNA, 25 bp, Mus musculus
aagggacttacacaggcctggcagt

SEQ ID NO: 62020 - DNA, 25 bp, Mus musculus
aagggacttacagaggcctggcagt

SEQ ID NO: 62021 - DNA, 25 bp, Mus musculus
aagggacttagcctcagacacctct

SEQ ID NO: 62022 - DNA, 25 bp, Mus musculus
aagggacttagcgtcagacacctct

SEQ ID NO: 62023 - DNA, 25 bp, Mus musculus
aagggacttatgaggccagcctact

SEQ ID NO: 62024 - DNA, 25 bp, Mus musculus
aagggacttatgtggccagcctact

SEQ ID NO: 62025 - DNA, 25 bp, Mus musculus
aagggacttcacaaaggcaggctct

SEQ ID NO: 62026 - DNA, 25 bp, Mus musculus
aagggacttcacagtcagtccgaga

SEQ ID NO: 62027 - DNA, 25 bp, Mus musculus
aagggacttcactaaggcaggctct

SEQ ID NO: 62028 - DNA, 25 bp, Mus musculus
aagggacttcactgtcagtccgaga

SEQ ID NO: 62029 - DNA, 25 bp, Mus musculus
aagggacttcatagagacacagatg

SEQ ID NO: 62030 - DNA, 25 bp, Mus musculus
aagggacttcattgagacacagatg

SEQ ID NO: 62031 - DNA, 25 bp, Mus musculus
aagggacttcctactcattacagtt

SEQ ID NO: 62032 - DNA, 25 bp, Mus musculus
aagggacttccttctcattacagtt

SEQ ID NO: 62033 - DNA, 25 bp, Mus musculus
aagggacttctcagatggagccacc

SEQ ID NO: 62034 - DNA, 25 bp, Mus musculus
aagggacttctctgatggagccacc

SEQ ID NO: 62035 - DNA, 25 bp, Mus musculus
aagggacttgtgagcccagggtcac

SEQ ID NO: 62036 - DNA, 25 bp, Mus musculus
aagggacttgtgtgcccagggtcac

SEQ ID NO: 62037 - DNA, 25 bp, Mus musculus
aagggactttacagagaagcccact

SEQ ID NO: 62038 - DNA, 25 bp, Mus musculus
aagggactttactgagaagcccact

SEQ ID NO: 62039 - DNA, 25 bp, Mus musculus
aagggagaagctagcaagacgagtt

SEQ ID NO: 62040 - DNA, 25 bp, Mus musculus
aagggagaagcttgcaagacgagtt

SEQ ID NO: 62041 - DNA, 25 bp, Mus musculus
aagggagacactccagcttcagcag

SEQ ID NO: 62042 - DNA, 25 bp, Mus musculus
aagggagacactgcagcttcagcag

SEQ ID NO: 62043 - DNA, 25 bp, Mus musculus
aagggagaccaacggcttcatctgc

SEQ ID NO: 62044 - DNA, 25 bp, Mus musculus
aagggagaccaagggcttcatctgc

SEQ ID NO: 62045 - DNA, 25 bp, Mus musculus
aagggagaccttagccttcccatct

SEQ ID NO: 62046 - DNA, 25 bp, Mus musculus
aagggagacctttgccttcccatct

SEQ ID NO: 62047 - DNA, 25 bp, Mus musculus
aagggagacgacatgctggccatga

SEQ ID NO: 62048 - DNA, 25 bp, Mus musculus
aagggagacgacttgctggccatga

SEQ ID NO: 62049 - DNA, 25 bp, Mus musculus
aagggagacttgatcaatgctagag

SEQ ID NO: 62050 - DNA, 25 bp, Mus musculus
aagggagacttgttcaatgctagag

SEQ ID NO: 62051 - DNA, 25 bp, Mus musculus
aagggagagactcgctctctgctca

SEQ ID NO: 62052 - DNA, 25 bp, Mus musculus
aagggagagactggctctctgctca

SEQ ID NO: 62053 - DNA, 25 bp, Mus musculus
aagggagagccacagtcccttgcca

SEQ ID NO: 62054 - DNA, 25 bp, Mus musculus
aagggagagccagagtcccttgcca

SEQ ID NO: 62055 - DNA, 25 bp, Mus musculus
aagggagagctcctttggtggcagc

SEQ ID NO: 62056 - DNA, 25 bp, Mus musculus
aagggagagctcgtttggtggcagc

SEQ ID NO: 62057 - DNA, 25 bp, Mus musculus
aagggagaggtcatctcagaagcct

SEQ ID NO: 62058 - DNA, 25 bp, Mus musculus
aagggagaggtcttctcagaagcct

SEQ ID NO: 62059 - DNA, 25 bp, Mus musculus
aagggagatttcactgccctcagct

SEQ ID NO: 62060 - DNA, 25 bp, Mus musculus
aagggagatttctctgccctcagct

SEQ ID NO: 62061 - DNA, 25 bp, Mus musculus
aagggagcaatcctcagtgggacat

SEQ ID NO: 62062 - DNA, 25 bp, Mus musculus
aagggagcaatcgtcagtgggacat

SEQ ID NO: 62063 - DNA, 25 bp, Mus musculus
aagggagcaatgagacgccccacca

SEQ ID NO: 62064 - DNA, 25 bp, Mus musculus
aagggagcaatgtgacgccccacca

SEQ ID NO: 62065 - DNA, 25 bp, Mus musculus
aagggagcagcaaccacggcagtgt

SEQ ID NO: 62066 - DNA, 25 bp, Mus musculus
aagggagcagcatccacggcagtgt

SEQ ID NO: 62067 - DNA, 25 bp, Mus musculus
aagggagcagtcacacctgtctgtg

SEQ ID NO: 62068 - DNA, 25 bp, Mus musculus
aagggagcagtctcacctgtctgtg

SEQ ID NO: 62069 - DNA, 25 bp, Mus musculus
aagggagcatcaaacggacggctaa

SEQ ID NO: 62070 - DNA, 25 bp, Mus musculus
aagggagcatcatacggacggctaa

SEQ ID NO: 62071 - DNA, 25 bp, Mus musculus
aagggagcatctactatggtgtaca

SEQ ID NO: 62072 - DNA, 25 bp, Mus musculus
aagggagcatctcgcttagacggaa

SEQ ID NO: 62073 - DNA, 25 bp, Mus musculus
aagggagcatctggcttagacggaa

SEQ ID NO: 62074 - DNA, 25 bp, Mus musculus
aagggagcatcttctatggtgtaca

SEQ ID NO: 62075 - DNA, 25 bp, Mus musculus
aagggagcatgtacaagccacttct

SEQ ID NO: 62076 - DNA, 25 bp, Mus musculus
aagggagcatgttcaagccacttct

SEQ ID NO: 62077 - DNA, 25 bp, Mus musculus
aagggagccaagatacaattcagaa

SEQ ID NO: 62078 - DNA, 25 bp, Mus musculus
aagggagccaagttacaattcagaa

SEQ ID NO: 62079 - DNA, 25 bp, Mus musculus
aagggagccattctgtatccaccat

SEQ ID NO: 62080 - DNA, 25 bp, Mus musculus
aagggagccattgtgtatccaccat

SEQ ID NO: 62081 - DNA, 25 bp, Mus musculus
aagggagccccaagtgcgacccaga

SEQ ID NO: 62082 - DNA, 25 bp, Mus musculus
aagggagccccacagaaaggcagct

SEQ ID NO: 62083 - DNA, 25 bp, Mus musculus
aagggagccccagagaaaggcagct

SEQ ID NO: 62084 - DNA, 25 bp, Mus musculus
aagggagccccatgtgcgacccaga

SEQ ID NO: 62085 - DNA, 25 bp, Mus musculus
aagggagcccctacaagatacaagt

SEQ ID NO: 62086 - DNA, 25 bp, Mus musculus
aagggagccccttcaagatacaagt

SEQ ID NO: 62087 - DNA, 25 bp, Mus musculus
aagggagcccgacatctctttgcgt

SEQ ID NO: 62088 - DNA, 25 bp, Mus musculus
aagggagcccgagatctctttgcgt

SEQ ID NO: 62089 - DNA, 25 bp, Mus musculus
aagggagccctactgcatagccagt

SEQ ID NO: 62090 - DNA, 25 bp, Mus musculus
aagggagccctagtgcatagccagt

SEQ ID NO: 62091 - DNA, 25 bp, Mus musculus
aagggagccgctcagctaaccagag

SEQ ID NO: 62092 - DNA, 25 bp, Mus musculus
aagggagccgctcatgtgcgatttt

SEQ ID NO: 62093 - DNA, 25 bp, Mus musculus
aagggagccgctgagctaaccagag

SEQ ID NO: 62094 - DNA, 25 bp, Mus musculus
aagggagccgctgatgtgcgatttt

SEQ ID NO: 62095 - DNA, 25 bp, Mus musculus
aagggagcctgtacaaatgcctctg

SEQ ID NO: 62096 - DNA, 25 bp, Mus musculus
aagggagcctgttcaaatgcctctg

SEQ ID NO: 62097 - DNA, 25 bp, Mus musculus
aagggagccttgcaaccggcagaca

SEQ ID NO: 62098 - DNA, 25 bp, Mus musculus
aagggagccttggaaccggcagaca

SEQ ID NO: 62099 - DNA, 25 bp, Mus musculus
aagggagcgacaagatcgagtccgt

SEQ ID NO: 62100 - DNA, 25 bp, Mus musculus
aagggagcgacatgatcgagtccgt

SEQ ID NO: 62101 - DNA, 25 bp, Mus musculus
aagggagcggctactcagagcccga

SEQ ID NO: 62102 - DNA, 25 bp, Mus musculus
aagggagcggcttctcagagcccga

SEQ ID NO: 62103 - DNA, 25 bp, Mus musculus
aagggagctctgcaccctcagggcc

SEQ ID NO: 62104 - DNA, 25 bp, Mus musculus
aagggagctctggaccctcagggcc

SEQ ID NO: 62105 - DNA, 25 bp, Mus musculus
aagggagctgcccactcattctgac

SEQ ID NO: 62106 - DNA, 25 bp, Mus musculus
aagggagctgccgactcattctgac

SEQ ID NO: 62107 - DNA, 25 bp, Mus musculus
aagggagcttctatagtaattggga

SEQ ID NO: 62108 - DNA, 25 bp, Mus musculus
aagggagcttctttagtaattggga

SEQ ID NO: 62109 - DNA, 25 bp, Mus musculus
aagggagcttgcctctatagctccc

SEQ ID NO: 62110 - DNA, 25 bp, Mus musculus
aagggagcttgcgtctatagctccc

SEQ ID NO: 62111 - DNA, 25 bp, Mus musculus
aagggagcttttcacagtctcccac

SEQ ID NO: 62112 - DNA, 25 bp, Mus musculus
aagggagcttttcaggctcttgtcc

SEQ ID NO: 62113 - DNA, 25 bp, Mus musculus
aagggagcttttgacagtctcccac

SEQ ID NO: 62114 - DNA, 25 bp, Mus musculus
aagggagcttttgaggctcttgtcc

SEQ ID NO: 62115 - DNA, 25 bp, Mus musculus
aagggaggaacacccctcgctgcac

SEQ ID NO: 62116 - DNA, 25 bp, Mus musculus
aagggaggaacagccctcgctgcac

SEQ ID NO: 62117 - DNA, 25 bp, Mus musculus
aagggaggagaaattccaatgtcaa

SEQ ID NO: 62118 - DNA, 25 bp, Mus musculus
aagggaggagaatttccaatgtcaa

SEQ ID NO: 62119 - DNA, 25 bp, Mus musculus
aagggaggagttccatgacagctaa

SEQ ID NO: 62120 - DNA, 25 bp, Mus musculus
aagggaggagttgcatgacagctaa

SEQ ID NO: 62121 - DNA, 25 bp, Mus musculus
aagggaggatggcactcatttctag

SEQ ID NO: 62122 - DNA, 25 bp, Mus musculus
aagggaggatgggactcatttctag

SEQ ID NO: 62123 - DNA, 25 bp, Mus musculus
aagggaggattcacatggttttcct

SEQ ID NO: 62124 - DNA, 25 bp, Mus musculus
aagggaggattctcatggttttcct

SEQ ID NO: 62125 - DNA, 25 bp, Mus musculus
aagggaggccagctctgccctagaa

SEQ ID NO: 62126 - DNA, 25 bp, Mus musculus
aagggaggccaggtctgccctagaa

SEQ ID NO: 62127 - DNA, 25 bp, Mus musculus
aagggaggctgactcacagtcatcc

SEQ ID NO: 62128 - DNA, 25 bp, Mus musculus
aagggaggctgacttggacccacca

SEQ ID NO: 62129 - DNA, 25 bp, Mus musculus
aagggaggctgagtcacagtcatcc

SEQ ID NO: 62130 - DNA, 25 bp, Mus musculus
aagggaggctgagttggacccacca

SEQ ID NO: 62131 - DNA, 25 bp, Mus musculus
aagggaggctgtcccacactgccag

SEQ ID NO: 62132 - DNA, 25 bp, Mus musculus
aagggaggctgtgccacactgccag

SEQ ID NO: 62133 - DNA, 25 bp, Mus musculus
aagggaggctttcccattctctgag

SEQ ID NO: 62134 - DNA, 25 bp, Mus musculus
aagggaggctttgccattctctgag

SEQ ID NO: 62135 - DNA, 25 bp, Mus musculus
aagggagggctcacttgggcccact

SEQ ID NO: 62136 - DNA, 25 bp, Mus musculus
aagggagggctctcttgggcccact

SEQ ID NO: 62137 - DNA, 25 bp, Mus musculus
aagggaggtctcagacatgcagcct

SEQ ID NO: 62138 - DNA, 25 bp, Mus musculus
aagggaggtctctgacatgcagcct

SEQ ID NO: 62139 - DNA, 25 bp, Mus musculus
aagggaggtttgattgcgccttgct

SEQ ID NO: 62140 - DNA, 25 bp, Mus musculus
aagggaggtttgtttgcgccttgct

SEQ ID NO: 62141 - DNA, 25 bp, Mus musculus
aagggagtacgaactcctagccaag

SEQ ID NO: 62142 - DNA, 25 bp, Mus musculus
aagggagtacgatctcctagccaag

SEQ ID NO: 62143 - DNA, 25 bp, Mus musculus
aagggagtcattccatcactagcta

SEQ ID NO: 62144 - DNA, 25 bp, Mus musculus
aagggagtcattgcatcactagcta

SEQ ID NO: 62145 - DNA, 25 bp, Mus musculus
aagggagtccgcactgcagcctaag

SEQ ID NO: 62146 - DNA, 25 bp, Mus musculus
aagggagtccgctctgcagcctaag

SEQ ID NO: 62147 - DNA, 25 bp, Mus musculus
aagggagtcctcactaatgctccta

SEQ ID NO: 62148 - DNA, 25 bp, Mus musculus
aagggagtcctctctaatgctccta

SEQ ID NO: 62149 - DNA, 25 bp, Mus musculus
aagggagtctgtaccttcttgagcc

SEQ ID NO: 62150 - DNA, 25 bp, Mus musculus
aagggagtctgtcatgttctctcaa

SEQ ID NO: 62151 - DNA, 25 bp, Mus musculus
aagggagtctgtgatgttctctcaa

SEQ ID NO: 62152 - DNA, 25 bp, Mus musculus
aagggagtctgttccttcttgagcc

SEQ ID NO: 62153 - DNA, 25 bp, Mus musculus
aagggagtgcctcctggacttgcaa

SEQ ID NO: 62154 - DNA, 25 bp, Mus musculus
aagggagtgcctgctggacttgcaa

SEQ ID NO: 62155 - DNA, 25 bp, Mus musculus
aagggagtggatacctttccaggtg

SEQ ID NO: 62156 - DNA, 25 bp, Mus musculus
aagggagtggatcacacccgtgcca

SEQ ID NO: 62157 - DNA, 25 bp, Mus musculus
aagggagtggatgacacccgtgcca

SEQ ID NO: 62158 - DNA, 25 bp, Mus musculus
aagggagtggattcctttccaggtg

SEQ ID NO: 62159 - DNA, 25 bp, Mus musculus
aagggagtggcccagaccagcttct

SEQ ID NO: 62160 - DNA, 25 bp, Mus musculus
aagggagtggccgagaccagcttct

SEQ ID NO: 62161 - DNA, 25 bp, Mus musculus
aagggagtgggacgctcctgccaca

SEQ ID NO: 62162 - DNA, 25 bp, Mus musculus
aagggagtgggaggctcctgccaca

SEQ ID NO: 62163 - DNA, 25 bp, Mus musculus
aagggagtgttacgcccatgctaga

SEQ ID NO: 62164 - DNA, 25 bp, Mus musculus
aagggagtgttaggcccatgctaga

SEQ ID NO: 62165 - DNA, 25 bp, Mus musculus
aagggagtgttgaagactgatacat

SEQ ID NO: 62166 - DNA, 25 bp, Mus musculus
aagggagtgttgtagactgatacat

SEQ ID NO: 62167 - DNA, 25 bp, Mus musculus
aagggagttatgatggtatcaggac

SEQ ID NO: 62168 - DNA, 25 bp, Mus musculus
aagggagttatgttggtatcaggac

SEQ ID NO: 62169 - DNA, 25 bp, Mus musculus
aagggagttcccagtcacattctga

SEQ ID NO: 62170 - DNA, 25 bp, Mus musculus
aagggagttccctgtcacattctga

SEQ ID NO: 62171 - DNA, 25 bp, Mus musculus
aagggagtttcactgctcggtgctc

SEQ ID NO: 62172 - DNA, 25 bp, Mus musculus
aagggagtttcagtgctcggtgctc

SEQ ID NO: 62173 - DNA, 25 bp, Mus musculus
aagggagtttcgagctccaactttg

SEQ ID NO: 62174 - DNA, 25 bp, Mus musculus
aagggagtttcgtgctccaactttg

SEQ ID NO: 62175 - DNA, 25 bp, Mus musculus
aagggagttttcatatcaccaattt

SEQ ID NO: 62176 - DNA, 25 bp, Mus musculus
aagggagttttcttatcaccaattt

SEQ ID NO: 62177 - DNA, 25 bp, Mus musculus
aagggataacatattcactgaccaa

SEQ ID NO: 62178 - DNA, 25 bp, Mus musculus
aagggataacattttcactgaccaa

SEQ ID NO: 62179 - DNA, 25 bp, Mus musculus
aagggatactggctcatagtgtaca

SEQ ID NO: 62180 - DNA, 25 bp, Mus musculus
aagggatactgggtcatagtgtaca

SEQ ID NO: 62181 - DNA, 25 bp, Mus musculus
aagggatactttctcattctgatga

SEQ ID NO: 62182 - DNA, 25 bp, Mus musculus
aagggatactttgtcattctgatga

SEQ ID NO: 62183 - DNA, 25 bp, Mus musculus
aagggataggatcaaatctctctcc

SEQ ID NO: 62184 - DNA, 25 bp, Mus musculus
aagggataggatgaaatctctctcc

SEQ ID NO: 62185 - DNA, 25 bp, Mus musculus
aagggatagggcagttgcccttctg

SEQ ID NO: 62186 - DNA, 25 bp, Mus musculus
aagggatagggctgttgcccttctg

SEQ ID NO: 62187 - DNA, 25 bp, Mus musculus
aagggatagtttcgtttctcaatat

SEQ ID NO: 62188 - DNA, 25 bp, Mus musculus
aagggatagtttggtttctcaatat

SEQ ID NO: 62189 - DNA, 25 bp, Mus musculus
aagggatatcgcactgcacttgaac

SEQ ID NO: 62190 - DNA, 25 bp, Mus musculus
aagggatatcgctctgcacttgaac

SEQ ID NO: 62191 - DNA, 25 bp, Mus musculus
aagggatcacagcactgctagacat

SEQ ID NO: 62192 - DNA, 25 bp, Mus musculus
aagggatcacaggactgctagacat

SEQ ID NO: 62193 - DNA, 25 bp, Mus musculus
aagggatcacatcgcatgtccattc

SEQ ID NO: 62194 - DNA, 25 bp, Mus musculus
aagggatcacatggcatgtccattc

SEQ ID NO: 62195 - DNA, 25 bp, Mus musculus
aagggatcactcatgaatgctagac

SEQ ID NO: 62196 - DNA, 25 bp, Mus musculus
aagggatcactcttgaatgctagac

SEQ ID NO: 62197 - DNA, 25 bp, Mus musculus
aagggatcacttcccattttgttgt

SEQ ID NO: 62198 - DNA, 25 bp, Mus musculus
aagggatcacttgccattttgttgt

SEQ ID NO: 62199 - DNA, 25 bp, Mus musculus
aagggatcagcccttcctctggtgc

SEQ ID NO: 62200 - DNA, 25 bp, Mus musculus
aagggatcagccgttcctctggtgc

SEQ ID NO: 62201 - DNA, 25 bp, Mus musculus
aagggatcatcaacatgcagaagga

SEQ ID NO: 62202 - DNA, 25 bp, Mus musculus
aagggatcatcatcatgcagaagga

SEQ ID NO: 62203 - DNA, 25 bp, Mus musculus
aagggatcatctagctgttctgtgc

SEQ ID NO: 62204 - DNA, 25 bp, Mus musculus
aagggatcatcttgctgttctgtgc

SEQ ID NO: 62205 - DNA, 25 bp, Mus musculus
aagggatcatggatttggcaggaga

SEQ ID NO: 62206 - DNA, 25 bp, Mus musculus
aagggatcatggttttggcaggaga

SEQ ID NO: 62207 - DNA, 25 bp, Mus musculus
aagggatccagcagccaatataggg

SEQ ID NO: 62208 - DNA, 25 bp, Mus musculus
aagggatccagctgccaatataggg

SEQ ID NO: 62209 - DNA, 25 bp, Mus musculus
aagggatccctgcatctgacagctt

SEQ ID NO: 62210 - DNA, 25 bp, Mus musculus
aagggatccctggatctgacagctt

SEQ ID NO: 62211 - DNA, 25 bp, Mus musculus
aagggatccgaaccccttgtctggc

SEQ ID NO: 62212 - DNA, 25 bp, Mus musculus
aagggatccgaagcccttgtctggc

SEQ ID NO: 62213 - DNA, 25 bp, Mus musculus
aagggatcctatatttcctgctgat

SEQ ID NO: 62214 - DNA, 25 bp, Mus musculus
aagggatcctatttttcctgctgat

SEQ ID NO: 62215 - DNA, 25 bp, Mus musculus
aagggatcggccacgaaaatggact

SEQ ID NO: 62216 - DNA, 25 bp, Mus musculus
aagggatcggcctcgaaaatggact

SEQ ID NO: 62217 - DNA, 25 bp, Mus musculus
aagggatctcggattcgtttcgctg

SEQ ID NO: 62218 - DNA, 25 bp, Mus musculus
aagggatctcggtttcgtttcgctg

SEQ ID NO: 62219 - DNA, 25 bp, Mus musculus
aagggatctctcatcgttttcctcg

SEQ ID NO: 62220 - DNA, 25 bp, Mus musculus
aagggatctctcttcgttttcctcg

SEQ ID NO: 62221 - DNA, 25 bp, Mus musculus
aagggatcttgaagtgcaggaacaa

SEQ ID NO: 62222 - DNA, 25 bp, Mus musculus
aagggatcttgatgtgcaggaacaa

SEQ ID NO: 62223 - DNA, 25 bp, Mus musculus
aagggatcttggagccacatggtta

SEQ ID NO: 62224 - DNA, 25 bp, Mus musculus
aagggatcttggcagcactcgagat

SEQ ID NO: 62225 - DNA, 25 bp, Mus musculus
aagggatcttgggagcactcgagat

SEQ ID NO: 62226 - DNA, 25 bp, Mus musculus
aagggatcttggtgccacatggtta

SEQ ID NO: 62227 - DNA, 25 bp, Mus musculus
aagggatcttttaacgccagtgtgc

SEQ ID NO: 62228 - DNA, 25 bp, Mus musculus
aagggatctttttacgccagtgtgc

SEQ ID NO: 62229 - DNA, 25 bp, Mus musculus
aagggatgacctccttaagctcatt

SEQ ID NO: 62230 - DNA, 25 bp, Mus musculus
aagggatgacctgcttaagctcatt

SEQ ID NO: 62231 - DNA, 25 bp, Mus musculus
aagggatgcaccactttccaacaag

SEQ ID NO: 62232 - DNA, 25 bp, Mus musculus
aagggatgcacctctttccaacaag

SEQ ID NO: 62233 - DNA, 25 bp, Mus musculus
aagggatgcactctctttgaccctc

SEQ ID NO: 62234 - DNA, 25 bp, Mus musculus
aagggatgcactgtctttgaccctc

SEQ ID NO: 62235 - DNA, 25 bp, Mus musculus
aagggatgcagcaaacctacctgcc

SEQ ID NO: 62236 - DNA, 25 bp, Mus musculus
aagggatgcagcctgctcatcacag

SEQ ID NO: 62237 - DNA, 25 bp, Mus musculus
aagggatgcagcgtgctcatcacag

SEQ ID NO: 62238 - DNA, 25 bp, Mus musculus
aagggatgcagctaacctacctgcc

SEQ ID NO: 62239 - DNA, 25 bp, Mus musculus
aagggatggcaaatctactctcaag

SEQ ID NO: 62240 - DNA, 25 bp, Mus musculus
aagggatggcaattctactctcaag

SEQ ID NO: 62241 - DNA, 25 bp, Mus musculus
aagggatgggctactgcttcagcaa

SEQ ID NO: 62242 - DNA, 25 bp, Mus musculus
aagggatgggcttctgcttcagcaa

SEQ ID NO: 62243 - DNA, 25 bp, Mus musculus
aagggatggttcatgtccagagaat

SEQ ID NO: 62244 - DNA, 25 bp, Mus musculus
aagggatggttcttgtccagagaat

SEQ ID NO: 62245 - DNA, 25 bp, Mus musculus
aagggatgtccgaccaggccatcat

SEQ ID NO: 62246 - DNA, 25 bp, Mus musculus
aagggatgtccgtccaggccatcat

SEQ ID NO: 62247 - DNA, 25 bp, Mus musculus
aagggatgtgccatgtgccgccgcc

SEQ ID NO: 62248 - DNA, 25 bp, Mus musculus
aagggatgtgccttgtgccgccgcc

SEQ ID NO: 62249 - DNA, 25 bp, Mus musculus
aagggattaccaagccctagggcca

SEQ ID NO: 62250 - DNA, 25 bp, Mus musculus
aagggattaccatgccctagggcca

SEQ ID NO: 62251 - DNA, 25 bp, Mus musculus
aagggattagtgaggacccagtcta

SEQ ID NO: 62252 - DNA, 25 bp, Mus musculus
aagggattagtgtggacccagtcta

SEQ ID NO: 62253 - DNA, 25 bp, Mus musculus
aagggattatgcaagagctcttctc

SEQ ID NO: 62254 - DNA, 25 bp, Mus musculus
aagggattatgctagagctcttctc

SEQ ID NO: 62255 - DNA, 25 bp, Mus musculus
aagggattatttcttatagctcaat

SEQ ID NO: 62256 - DNA, 25 bp, Mus musculus
aagggattatttgttatagctcaat

SEQ ID NO: 62257 - DNA, 25 bp, Mus musculus
aagggattcatacaatgcagacgca

SEQ ID NO: 62258 - DNA, 25 bp, Mus musculus
aagggattcatagaatgcagacgca

SEQ ID NO: 62259 - DNA, 25 bp, Mus musculus
aagggattcattcaccagcagcttt

SEQ ID NO: 62260 - DNA, 25 bp, Mus musculus
aagggattcattgaccagcagcttt

SEQ ID NO: 62261 - DNA, 25 bp, Mus musculus
aagggattccttcagcttacctggt

SEQ ID NO: 62262 - DNA, 25 bp, Mus musculus
aagggattccttgagcttacctggt

SEQ ID NO: 62263 - DNA, 25 bp, Mus musculus
aagggattctccacagaacccattg

SEQ ID NO: 62264 - DNA, 25 bp, Mus musculus
aagggattctcctcagaacccattg

SEQ ID NO: 62265 - DNA, 25 bp, Mus musculus
aagggattgcctacatgacatggat

SEQ ID NO: 62266 - DNA, 25 bp, Mus musculus
aagggattgccttcatgacatggat

SEQ ID NO: 62267 - DNA, 25 bp, Mus musculus
aagggattgcgtatgacacagagga

SEQ ID NO: 62268 - DNA, 25 bp, Mus musculus
aagggattgcgtttgacacagagga

SEQ ID NO: 62269 - DNA, 25 bp, Mus musculus
aagggatttattacaccactggata

SEQ ID NO: 62270 - DNA, 25 bp, Mus musculus
aagggatttatttcaccactggata

SEQ ID NO: 62271 - DNA, 25 bp, Mus musculus
aagggatttgccaggtgtccagcca

SEQ ID NO: 62272 - DNA, 25 bp, Mus musculus
aagggatttgccatctctctgggaa

SEQ ID NO: 62273 - DNA, 25 bp, Mus musculus
aagggatttgcctggtgtccagcca

SEQ ID NO: 62274 - DNA, 25 bp, Mus musculus
aagggatttgccttctctctgggaa

SEQ ID NO: 62275 - DNA, 25 bp, Mus musculus
aagggatttgctacagttaggtctg

SEQ ID NO: 62276 - DNA, 25 bp, Mus musculus
aagggatttgcttcagttaggtctg

SEQ ID NO: 62277 - DNA, 25 bp, Mus musculus
aagggatttgttatgtctgtaaagt

SEQ ID NO: 62278 - DNA, 25 bp, Mus musculus
aagggatttgttttgtctgtaaagt

SEQ ID NO: 62279 - DNA, 25 bp, Mus musculus
aagggattttggactttggtgagca

SEQ ID NO: 62280 - DNA, 25 bp, Mus musculus
aagggattttggtctttggtgagca

SEQ ID NO: 62281 - DNA, 25 bp, Mus musculus
aagggattttgtcatgtccgccaga

SEQ ID NO: 62282 - DNA, 25 bp, Mus musculus
aagggattttgtgatgtccgccaga

SEQ ID NO: 62283 - DNA, 25 bp, Mus musculus
aagggatttttaccagtgcctctga

SEQ ID NO: 62284 - DNA, 25 bp, Mus musculus
aagggatttttagcagtgcctctga

SEQ ID NO: 62285 - DNA, 25 bp, Mus musculus
aagggcaaacccactagctgtcggg

SEQ ID NO: 62286 - DNA, 25 bp, Mus musculus
aagggcaaaccctctagctgtcggg

SEQ ID NO: 62287 - DNA, 25 bp, Mus musculus
aagggcaaagcaccttcccagtgtc

SEQ ID NO: 62288 - DNA, 25 bp, Mus musculus
aagggcaaagcagcttcccagtgtc

SEQ ID NO: 62289 - DNA, 25 bp, Mus musculus
aagggcaaatctactttcacaagta

SEQ ID NO: 62290 - DNA, 25 bp, Mus musculus
aagggcaaatcttctttcacaagta

SEQ ID NO: 62291 - DNA, 25 bp, Mus musculus
aagggcaaattaagctgtcatgaac

SEQ ID NO: 62292 - DNA, 25 bp, Mus musculus
aagggcaaattatgctgtcatgaac

SEQ ID NO: 62293 - DNA, 25 bp, Mus musculus
aagggcaacaccatggagatccaag

SEQ ID NO: 62294 - DNA, 25 bp, Mus musculus
aagggcaacaccttggagatccaag

SEQ ID NO: 62295 - DNA, 25 bp, Mus musculus
aagggcaacaggaatgggagtcatt

SEQ ID NO: 62296 - DNA, 25 bp, Mus musculus
aagggcaacaggtatgggagtcatt

SEQ ID NO: 62297 - DNA, 25 bp, Mus musculus
aagggcaacttcaactacgtggagt

SEQ ID NO: 62298 - DNA, 25 bp, Mus musculus
aagggcaacttctactacgtggagt

SEQ ID NO: 62299 - DNA, 25 bp, Mus musculus
aagggcaagactcacccagatcttc

SEQ ID NO: 62300 - DNA, 25 bp, Mus musculus
aagggcaagactgacccagatcttc

SEQ ID NO: 62301 - DNA, 25 bp, Mus musculus
aagggcaaggtcacccttgacatgt

SEQ ID NO: 62302 - DNA, 25 bp, Mus musculus
aagggcaaggtctcccttgacatgt

SEQ ID NO: 62303 - DNA, 25 bp, Mus musculus
aagggcaagtctcgcgaccacgtcc

SEQ ID NO: 62304 - DNA, 25 bp, Mus musculus
aagggcaagtctggcgaccacgtcc

SEQ ID NO: 62305 - DNA, 25 bp, Mus musculus
aagggcaatattccagagcacatgt

SEQ ID NO: 62306 - DNA, 25 bp, Mus musculus
aagggcaatattgcagagcacatgt

SEQ ID NO: 62307 - DNA, 25 bp, Mus musculus
aagggcaatctcaaccgctgcattg

SEQ ID NO: 62308 - DNA, 25 bp, Mus musculus
aagggcaatctctaccgctgcattg

SEQ ID NO: 62309 - DNA, 25 bp, Mus musculus
aagggcaatgccacagggacagaca

SEQ ID NO: 62310 - DNA, 25 bp, Mus musculus
aagggcaatgcctcagggacagaca

SEQ ID NO: 62311 - DNA, 25 bp, Mus musculus
aagggcaatggcaacagctgccgtt

SEQ ID NO: 62312 - DNA, 25 bp, Mus musculus
aagggcaatggctacagctgccgtt

SEQ ID NO: 62313 - DNA, 25 bp, Mus musculus
aagggcacaccaatccagggaagca

SEQ ID NO: 62314 - DNA, 25 bp, Mus musculus
aagggcacaccattccagggaagca

SEQ ID NO: 62315 - DNA, 25 bp, Mus musculus
aagggcacagaaccacatcccaaga

SEQ ID NO: 62316 - DNA, 25 bp, Mus musculus
aagggcacagaagcacatcccaaga

SEQ ID NO: 62317 - DNA, 25 bp, Mus musculus
aagggcacagacagagggcagcacc

SEQ ID NO: 62318 - DNA, 25 bp, Mus musculus
aagggcacagactgagggcagcacc

SEQ ID NO: 62319 - DNA, 25 bp, Mus musculus
aagggcacaggtacacactgtcttt

SEQ ID NO: 62320 - DNA, 25 bp, Mus musculus
aagggcacaggttcacactgtcttt

SEQ ID NO: 62321 - DNA, 25 bp, Mus musculus
aagggcacatttcccatcagttgga

SEQ ID NO: 62322 - DNA, 25 bp, Mus musculus
aagggcacatttgccatcagttgga

SEQ ID NO: 62323 - DNA, 25 bp, Mus musculus
aagggcaccctgagcctgcaggagc

SEQ ID NO: 62324 - DNA, 25 bp, Mus musculus
aagggcaccctgtgcctgcaggagc

SEQ ID NO: 62325 - DNA, 25 bp, Mus musculus
aagggcacctacaggtatgagctgc

SEQ ID NO: 62326 - DNA, 25 bp, Mus musculus
aagggcacctactggtatgagctgc

SEQ ID NO: 62327 - DNA, 25 bp, Mus musculus
aagggcacctggctacagttgatgt

SEQ ID NO: 62328 - DNA, 25 bp, Mus musculus
aagggcacctgggtacagttgatgt

SEQ ID NO: 62329 - DNA, 25 bp, Mus musculus
aagggcaccttaaccagctcctgat

SEQ ID NO: 62330 - DNA, 25 bp, Mus musculus
aagggcaccttatccagctcctgat

SEQ ID NO: 62331 - DNA, 25 bp, Mus musculus
aagggcacgctgagacgccatgacg

SEQ ID NO: 62332 - DNA, 25 bp, Mus musculus
aagggcacgctgtgacgccatgacg

SEQ ID NO: 62333 - DNA, 25 bp, Mus musculus
aagggcactcataggctgtaagtct

SEQ ID NO: 62334 - DNA, 25 bp, Mus musculus
aagggcactcattggctgtaagtct

SEQ ID NO: 62335 - DNA, 25 bp, Mus musculus
aagggcactccgagtctcagggcag

SEQ ID NO: 62336 - DNA, 25 bp, Mus musculus
aagggcactccgtgtctcagggcag

SEQ ID NO: 62337 - DNA, 25 bp, Mus musculus
aagggcactgacagacaccgtggaa

SEQ ID NO: 62338 - DNA, 25 bp, Mus musculus
aagggcactgactgacaccgtggaa

SEQ ID NO: 62339 - DNA, 25 bp, Mus musculus
aagggcactgcaactttgtctcaga

SEQ ID NO: 62340 - DNA, 25 bp, Mus musculus
aagggcactgcatctttgtctcaga

SEQ ID NO: 62341 - DNA, 25 bp, Mus musculus
aagggcactgccacctggtggacga

SEQ ID NO: 62342 - DNA, 25 bp, Mus musculus
aagggcactgcctcctggtggacga

SEQ ID NO: 62343 - DNA, 25 bp, Mus musculus
aagggcactggtcactcttccaggg

SEQ ID NO: 62344 - DNA, 25 bp, Mus musculus
aagggcactggtgactcttccaggg

SEQ ID NO: 62345 - DNA, 25 bp, Mus musculus
aagggcacttatcaatccatgacag

SEQ ID NO: 62346 - DNA, 25 bp, Mus musculus
aagggcacttatgaatccatgacag

SEQ ID NO: 62347 - DNA, 25 bp, Mus musculus
aagggcactttcaatcccgaatgct

SEQ ID NO: 62348 - DNA, 25 bp, Mus musculus
aagggcactttctatcccgaatgct

SEQ ID NO: 62349 - DNA, 25 bp, Mus musculus
aagggcagaaccatcatttatctgt

SEQ ID NO: 62350 - DNA, 25 bp, Mus musculus
aagggcagaaccttcatttatctgt

SEQ ID NO: 62351 - DNA, 25 bp, Mus musculus
aagggcagacatcaatactcccgca

SEQ ID NO: 62352 - DNA, 25 bp, Mus musculus
aagggcagacatgaatactcccgca

SEQ ID NO: 62353 - DNA, 25 bp, Mus musculus
aagggcagagccatgacttatacct

SEQ ID NO: 62354 - DNA, 25 bp, Mus musculus
aagggcagagccttgacttatacct

SEQ ID NO: 62355 - DNA, 25 bp, Mus musculus
aagggcagcaacctcctgctgagcg

SEQ ID NO: 62356 - DNA, 25 bp, Mus musculus
aagggcagcaacgtcctgctgagcg

SEQ ID NO: 62357 - DNA, 25 bp, Mus musculus
aagggcagcatcagtttggccctga

SEQ ID NO: 62358 - DNA, 25 bp, Mus musculus
aagggcagcatctgtttggccctga

SEQ ID NO: 62359 - DNA, 25 bp, Mus musculus
aagggcagccagactgatttcattt

SEQ ID NO: 62360 - DNA, 25 bp, Mus musculus
aagggcagccagtctgatttcattt

SEQ ID NO: 62361 - DNA, 25 bp, Mus musculus
aagggcagcgccatatacagaggga

SEQ ID NO: 62362 - DNA, 25 bp, Mus musculus
aagggcagcgccttatacagaggga

SEQ ID NO: 62363 - DNA, 25 bp, Mus musculus
aagggcagcgtgagctttcagagtt

SEQ ID NO: 62364 - DNA, 25 bp, Mus musculus
aagggcagcgtgtgctttcagagtt

SEQ ID NO: 62365 - DNA, 25 bp, Mus musculus
aagggcagctacctgcttgttccaa

SEQ ID NO: 62366 - DNA, 25 bp, Mus musculus
aagggcagctacgtgcttgttccaa

SEQ ID NO: 62367 - DNA, 25 bp, Mus musculus
aagggcagctatcctcacttggcat

SEQ ID NO: 62368 - DNA, 25 bp, Mus musculus
aagggcagctatgctcacttggcat

SEQ ID NO: 62369 - DNA, 25 bp, Mus musculus
aagggcagctctagaatggcctgag

SEQ ID NO: 62370 - DNA, 25 bp, Mus musculus
aagggcagctcttgaatggcctgag

SEQ ID NO: 62371 - DNA, 25 bp, Mus musculus
aagggcagctgaattacttttgttg

SEQ ID NO: 62372 - DNA, 25 bp, Mus musculus
aagggcagctgatttacttttgttg

SEQ ID NO: 62373 - DNA, 25 bp, Mus musculus
aagggcagctgcaatttattttcct

SEQ ID NO: 62374 - DNA, 25 bp, Mus musculus
aagggcagctgctatttattttcct

SEQ ID NO: 62375 - DNA, 25 bp, Mus musculus
aagggcagctgtacacttaggagga

SEQ ID NO: 62376 - DNA, 25 bp, Mus musculus
aagggcagctgttcacttaggagga

SEQ ID NO: 62377 - DNA, 25 bp, Mus musculus
aagggcaggcacaccctggctcctg

SEQ ID NO: 62378 - DNA, 25 bp, Mus musculus
aagggcaggcactccctggctcctg

SEQ ID NO: 62379 - DNA, 25 bp, Mus musculus
aagggcagggcacacaagtacaaag

SEQ ID NO: 62380 - DNA, 25 bp, Mus musculus
aagggcagggcagacaagtacaaag

SEQ ID NO: 62381 - DNA, 25 bp, Mus musculus
aagggcagtgagcacattgtctcca

SEQ ID NO: 62382 - DNA, 25 bp, Mus musculus
aagggcagtgaggacattgtctcca

SEQ ID NO: 62383 - DNA, 25 bp, Mus musculus
aagggcagtgctctcatgacttcat

SEQ ID NO: 62384 - DNA, 25 bp, Mus musculus
aagggcagtgctgtcatgacttcat

SEQ ID NO: 62385 - DNA, 25 bp, Mus musculus
aagggcagtgtcacagactgtcgga

SEQ ID NO: 62386 - DNA, 25 bp, Mus musculus
aagggcagtgtctcagactgtcgga

SEQ ID NO: 62387 - DNA, 25 bp, Mus musculus
aagggcagtgtgctttctttagaat

SEQ ID NO: 62388 - DNA, 25 bp, Mus musculus
aagggcagtgtggtttctttagaat

SEQ ID NO: 62389 - DNA, 25 bp, Mus musculus
aagggcagttgtctgaactagtcag

SEQ ID NO: 62390 - DNA, 25 bp, Mus musculus
aagggcagttgtgtgaactagtcag

SEQ ID NO: 62391 - DNA, 25 bp, Mus musculus
aagggcatccaaaggttcctatcat

SEQ ID NO: 62392 - DNA, 25 bp, Mus musculus
aagggcatccaaccgccatagggca

SEQ ID NO: 62393 - DNA, 25 bp, Mus musculus
aagggcatccaagcgccatagggca

SEQ ID NO: 62394 - DNA, 25 bp, Mus musculus
aagggcatccaatggttcctatcat

SEQ ID NO: 62395 - DNA, 25 bp, Mus musculus
aagggcatcccacagcatgaacaga

SEQ ID NO: 62396 - DNA, 25 bp, Mus musculus
aagggcatcccagagcatgaacaga

SEQ ID NO: 62397 - DNA, 25 bp, Mus musculus
aagggcatctgacccgtgctatttg

SEQ ID NO: 62398 - DNA, 25 bp, Mus musculus
aagggcatctgagccgtgctatttg

SEQ ID NO: 62399 - DNA, 25 bp, Mus musculus
aagggcatctgtcgcttgaggctca

SEQ ID NO: 62400 - DNA, 25 bp, Mus musculus
aagggcatctgtggcttgaggctca

SEQ ID NO: 62401 - DNA, 25 bp, Mus musculus
aagggcatcttccatcttcaaaggg

SEQ ID NO: 62402 - DNA, 25 bp, Mus musculus
aagggcatcttcgatcttcaaaggg

SEQ ID NO: 62403 - DNA, 25 bp, Mus musculus
aagggcatgaacacagcacctactg

SEQ ID NO: 62404 - DNA, 25 bp, Mus musculus
aagggcatgaactcagcacctactg

SEQ ID NO: 62405 - DNA, 25 bp, Mus musculus
aagggcatgaatacccaacttcaaa

SEQ ID NO: 62406 - DNA, 25 bp, Mus musculus
aagggcatgaattcccaacttcaaa

SEQ ID NO: 62407 - DNA, 25 bp, Mus musculus
aagggcatgatcacccatgatggga

SEQ ID NO: 62408 - DNA, 25 bp, Mus musculus
aagggcatgatctcccatgatggga

SEQ ID NO: 62409 - DNA, 25 bp, Mus musculus
aagggcatgcgtagctaggcttagc

SEQ ID NO: 62410 - DNA, 25 bp, Mus musculus
aagggcatgcgtcccatggtatgca

SEQ ID NO: 62411 - DNA, 25 bp, Mus musculus
aagggcatgcgtgccatggtatgca

SEQ ID NO: 62412 - DNA, 25 bp, Mus musculus
aagggcatgcgttgctaggcttagc

SEQ ID NO: 62413 - DNA, 25 bp, Mus musculus
aagggcatgctcctgagccttacaa

SEQ ID NO: 62414 - DNA, 25 bp, Mus musculus
aagggcatgctcgtgagccttacaa

SEQ ID NO: 62415 - DNA, 25 bp, Mus musculus
aagggcatggaactctgtcgctgaa

SEQ ID NO: 62416 - DNA, 25 bp, Mus musculus
aagggcatggaagtctgtcgctgaa

SEQ ID NO: 62417 - DNA, 25 bp, Mus musculus
aagggcatggagctcttgcacttga

SEQ ID NO: 62418 - DNA, 25 bp, Mus musculus
aagggcatggaggtcttgcacttga

SEQ ID NO: 62419 - DNA, 25 bp, Mus musculus
aagggcatgtggcatgcacctagta

SEQ ID NO: 62420 - DNA, 25 bp, Mus musculus
aagggcatgtgggatgcacctagta

SEQ ID NO: 62421 - DNA, 25 bp, Mus musculus
aagggccaaccaatttagaggacag

SEQ ID NO: 62422 - DNA, 25 bp, Mus musculus
aagggccaaccattttagaggacag

SEQ ID NO: 62423 - DNA, 25 bp, Mus musculus
aagggccaacctcaaagatagtcta

SEQ ID NO: 62424 - DNA, 25 bp, Mus musculus
aagggccaacctgaaagatagtcta

SEQ ID NO: 62425 - DNA, 25 bp, Mus musculus
aagggccaactgattgtcaatacat

SEQ ID NO: 62426 - DNA, 25 bp, Mus musculus
aagggccaactgtttgtcaatacat

SEQ ID NO: 62427 - DNA, 25 bp, Mus musculus
aagggccaagacatgccgcatcacc

SEQ ID NO: 62428 - DNA, 25 bp, Mus musculus
aagggccaagacttgccgcatcacc

SEQ ID NO: 62429 - DNA, 25 bp, Mus musculus
aagggccaagctatctcagagatgt

SEQ ID NO: 62430 - DNA, 25 bp, Mus musculus
aagggccaagctttctcagagatgt

SEQ ID NO: 62431 - DNA, 25 bp, Mus musculus
aagggccaatgaattcactcgataa

SEQ ID NO: 62432 - DNA, 25 bp, Mus musculus
aagggccaatgatttcactcgataa

SEQ ID NO: 62433 - DNA, 25 bp, Mus musculus
aagggccaatgtagctaatccaagg

SEQ ID NO: 62434 - DNA, 25 bp, Mus musculus
aagggccaatgttgctaatccaagg

SEQ ID NO: 62435 - DNA, 25 bp, Mus musculus
aagggccacaaaactaccagctttg

SEQ ID NO: 62436 - DNA, 25 bp, Mus musculus
aagggccacaaatctaccagctttg

SEQ ID NO: 62437 - DNA, 25 bp, Mus musculus
aagggccacaccacagtcacaagaa

SEQ ID NO: 62438 - DNA, 25 bp, Mus musculus
aagggccacacctcagtcacaagaa

SEQ ID NO: 62439 - DNA, 25 bp, Mus musculus
aagggccacgccattatcctggtgt

SEQ ID NO: 62440 - DNA, 25 bp, Mus musculus
aagggccacgcctttatcctggtgt

SEQ ID NO: 62441 - DNA, 25 bp, Mus musculus
aagggccacttaaactacttcactg

SEQ ID NO: 62442 - DNA, 25 bp, Mus musculus
aagggccacttatactacttcactg

SEQ ID NO: 62443 - DNA, 25 bp, Mus musculus
aagggccagacacgctaatacagta

SEQ ID NO: 62444 - DNA, 25 bp, Mus musculus
aagggccagacaggctaatacagta

SEQ ID NO: 62445 - DNA, 25 bp, Mus musculus
aagggccagcagaacccaaagtcag

SEQ ID NO: 62446 - DNA, 25 bp, Mus musculus
aagggccagcagtacccaaagtcag

SEQ ID NO: 62447 - DNA, 25 bp, Mus musculus
aagggccagcccattactacatgga

SEQ ID NO: 62448 - DNA, 25 bp, Mus musculus
aagggccagccctttactacatgga

SEQ ID NO: 62449 - DNA, 25 bp, Mus musculus
aagggccaggccagcatcaaatgcg

SEQ ID NO: 62450 - DNA, 25 bp, Mus musculus
aagggccaggcctgcatcaaatgcg

SEQ ID NO: 62451 - DNA, 25 bp, Mus musculus
aagggccaggctacatttttctcat

SEQ ID NO: 62452 - DNA, 25 bp, Mus musculus
aagggccaggcttcatttttctcat

SEQ ID NO: 62453 - DNA, 25 bp, Mus musculus
aagggccaggtaccgtgcttactgc

SEQ ID NO: 62454 - DNA, 25 bp, Mus musculus
aagggccaggtagcgtgcttactgc

SEQ ID NO: 62455 - DNA, 25 bp, Mus musculus
aagggccataatattgcaagcacca

SEQ ID NO: 62456 - DNA, 25 bp, Mus musculus
aagggccataattttgcaagcacca

SEQ ID NO: 62457 - DNA, 25 bp, Mus musculus
aagggccatagaaacattgcttcac

SEQ ID NO: 62458 - DNA, 25 bp, Mus musculus
aagggccatagatacattgcttcac

SEQ ID NO: 62459 - DNA, 25 bp, Mus musculus
aagggccatttcattgtagaggatc

SEQ ID NO: 62460 - DNA, 25 bp, Mus musculus
aagggccatttctttgtagaggatc

SEQ ID NO: 62461 - DNA, 25 bp, Mus musculus
aagggccattttctctgttagctca

SEQ ID NO: 62462 - DNA, 25 bp, Mus musculus
aagggccattttgtctgttagctca

SEQ ID NO: 62463 - DNA, 25 bp, Mus musculus
aagggcccacataaggcacaacgag

SEQ ID NO: 62464 - DNA, 25 bp, Mus musculus
aagggcccacattaggcacaacgag

SEQ ID NO: 62465 - DNA, 25 bp, Mus musculus
aagggcccagacagcctgttaggtt

SEQ ID NO: 62466 - DNA, 25 bp, Mus musculus
aagggcccagactgcctgttaggtt

SEQ ID NO: 62467 - DNA, 25 bp, Mus musculus
aagggcccagatagcttcaaatgtg

SEQ ID NO: 62468 - DNA, 25 bp, Mus musculus
aagggcccagattgcttcaaatgtg

SEQ ID NO: 62469 - DNA, 25 bp, Mus musculus
aagggcccagcaatatgttgtacat

SEQ ID NO: 62470 - DNA, 25 bp, Mus musculus
aagggcccagcattatgttgtacat

SEQ ID NO: 62471 - DNA, 25 bp, Mus musculus
aagggcccagtaagataggtgtcta

SEQ ID NO: 62472 - DNA, 25 bp, Mus musculus
aagggcccagtatgataggtgtcta

SEQ ID NO: 62473 - DNA, 25 bp, Mus musculus
aagggccccagaacagagcaacagt

SEQ ID NO: 62474 - DNA, 25 bp, Mus musculus
aagggccccagatcagagcaacagt

SEQ ID NO: 62475 - DNA, 25 bp, Mus musculus
aagggccccattagcctggaatgta

SEQ ID NO: 62476 - DNA, 25 bp, Mus musculus
aagggccccatttgcctggaatgta

SEQ ID NO: 62477 - DNA, 25 bp, Mus musculus
aagggccctagtcgcctaagaagca

SEQ ID NO: 62478 - DNA, 25 bp, Mus musculus
aagggccctagtggcctaagaagca

SEQ ID NO: 62479 - DNA, 25 bp, Mus musculus
aagggccctcacaagaagctcagaa

SEQ ID NO: 62480 - DNA, 25 bp, Mus musculus
aagggccctcactagaagctcagaa

SEQ ID NO: 62481 - DNA, 25 bp, Mus musculus
aagggccctcttcctgtaggtggta

SEQ ID NO: 62482 - DNA, 25 bp, Mus musculus
aagggccctcttgctgtaggtggta

SEQ ID NO: 62483 - DNA, 25 bp, Mus musculus
aagggccctgacattagagtcaatt

SEQ ID NO: 62484 - DNA, 25 bp, Mus musculus
aagggccctgactttagagtcaatt

SEQ ID NO: 62485 - DNA, 25 bp, Mus musculus
aagggccctgtcagtgtatggagcc

SEQ ID NO: 62486 - DNA, 25 bp, Mus musculus
aagggccctgtcatagttctgggag

SEQ ID NO: 62487 - DNA, 25 bp, Mus musculus
aagggccctgtctgtgtatggagcc

SEQ ID NO: 62488 - DNA, 25 bp, Mus musculus
aagggccctgtcttagttctgggag

SEQ ID NO: 62489 - DNA, 25 bp, Mus musculus
aagggccctgtgatgtaggcttgcc

SEQ ID NO: 62490 - DNA, 25 bp, Mus musculus
aagggccctgtgttgtaggcttgcc

SEQ ID NO: 62491 - DNA, 25 bp, Mus musculus
aagggcccttccagttagggagcat

SEQ ID NO: 62492 - DNA, 25 bp, Mus musculus
aagggcccttcctgttagggagcat

SEQ ID NO: 62493 - DNA, 25 bp, Mus musculus
aagggccgagctctctctctgtctt

SEQ ID NO: 62494 - DNA, 25 bp, Mus musculus
aagggccgagctgtctctctgtctt

SEQ ID NO: 62495 - DNA, 25 bp, Mus musculus
aagggccgccgtacatcagcgaggc

SEQ ID NO: 62496 - DNA, 25 bp, Mus musculus
aagggccgccgttcatcagcgaggc

SEQ ID NO: 62497 - DNA, 25 bp, Mus musculus
aagggccgctacacgctggatgtat

SEQ ID NO: 62498 - DNA, 25 bp, Mus musculus
aagggccgctactcgctggatgtat

SEQ ID NO: 62499 - DNA, 25 bp, Mus musculus
aagggccggcccaattatgcggcgc

SEQ ID NO: 62500 - DNA, 25 bp, Mus musculus
aagggccggccctattatgcggcgc

SEQ ID NO: 62501 - DNA, 25 bp, Mus musculus
aagggccggttaaggcaactgcaat

SEQ ID NO: 62502 - DNA, 25 bp, Mus musculus
aagggccggttatggcaactgcaat

SEQ ID NO: 62503 - DNA, 25 bp, Mus musculus
aagggccgtgttctaaccgcagctg

SEQ ID NO: 62504 - DNA, 25 bp, Mus musculus
aagggccgtgttgtaaccgcagctg

SEQ ID NO: 62505 - DNA, 25 bp, Mus musculus
aagggccgttctagtagcatgcctg

SEQ ID NO: 62506 - DNA, 25 bp, Mus musculus
aagggccgttcttgtagcatgcctg

SEQ ID NO: 62507 - DNA, 25 bp, Mus musculus
aagggcctaacaaatactatcgtgc

SEQ ID NO: 62508 - DNA, 25 bp, Mus musculus
aagggcctaacatatactatcgtgc

SEQ ID NO: 62509 - DNA, 25 bp, Mus musculus
aagggcctaagtatgatctccagca

SEQ ID NO: 62510 - DNA, 25 bp, Mus musculus
aagggcctaagtttgatctccagca

SEQ ID NO: 62511 - DNA, 25 bp, Mus musculus
aagggcctattcacccattgacaag

SEQ ID NO: 62512 - DNA, 25 bp, Mus musculus
aagggcctattctcccattgacaag

SEQ ID NO: 62513 - DNA, 25 bp, Mus musculus
aagggcctcaagaggctgtgccaca

SEQ ID NO: 62514 - DNA, 25 bp, Mus musculus
aagggcctcaagtggctgtgccaca

SEQ ID NO: 62515 - DNA, 25 bp, Mus musculus
aagggcctcatcaagctgtgcccat

SEQ ID NO: 62516 - DNA, 25 bp, Mus musculus
aagggcctcatctagctgtgcccat

SEQ ID NO: 62517 - DNA, 25 bp, Mus musculus
aagggcctcattatggtcactcaca

SEQ ID NO: 62518 - DNA, 25 bp, Mus musculus
aagggcctcattttggtcactcaca

SEQ ID NO: 62519 - DNA, 25 bp, Mus musculus
aagggcctccagcttatggcaagat

SEQ ID NO: 62520 - DNA, 25 bp, Mus musculus
aagggcctccaggttatggcaagat

SEQ ID NO: 62521 - DNA, 25 bp, Mus musculus
aagggcctccccagagattgggtct

SEQ ID NO: 62522 - DNA, 25 bp, Mus musculus
aagggcctcccctgagattgggtct

SEQ ID NO: 62523 - DNA, 25 bp, Mus musculus
aagggcctcctgcatagaccttgtc

SEQ ID NO: 62524 - DNA, 25 bp, Mus musculus
aagggcctcctggatagaccttgtc

SEQ ID NO: 62525 - DNA, 25 bp, Mus musculus
aagggcctctttctgagccacatga

SEQ ID NO: 62526 - DNA, 25 bp, Mus musculus
aagggcctctttgtgagccacatga

SEQ ID NO: 62527 - DNA, 25 bp, Mus musculus
aagggcctgaaacagggcatcccag

SEQ ID NO: 62528 - DNA, 25 bp, Mus musculus
aagggcctgaaagagggcatcccag

SEQ ID NO: 62529 - DNA, 25 bp, Mus musculus
aagggcctgagaccgttgctgactc

SEQ ID NO: 62530 - DNA, 25 bp, Mus musculus
aagggcctgagagcgttgctgactc

SEQ ID NO: 62531 - DNA, 25 bp, Mus musculus
aagggcctgatccagcttggcccca

SEQ ID NO: 62532 - DNA, 25 bp, Mus musculus
aagggcctgatcgagcttggcccca

SEQ ID NO: 62533 - DNA, 25 bp, Mus musculus
aagggcctgattatcgtctccgtgc

SEQ ID NO: 62534 - DNA, 25 bp, Mus musculus
aagggcctgattttcgtctccgtgc

SEQ ID NO: 62535 - DNA, 25 bp, Mus musculus
aagggcctgcaccaagttgcttttg

SEQ ID NO: 62536 - DNA, 25 bp, Mus musculus
aagggcctgcacgaagttgcttttg

SEQ ID NO: 62537 - DNA, 25 bp, Mus musculus
aagggcctgcctctggtccgaagac

SEQ ID NO: 62538 - DNA, 25 bp, Mus musculus
aagggcctgcctgtggtccgaagac

SEQ ID NO: 62539 - DNA, 25 bp, Mus musculus
aagggcctgctcagtctaaacactg

SEQ ID NO: 62540 - DNA, 25 bp, Mus musculus
aagggcctgctctgtctaaacactg

SEQ ID NO: 62541 - DNA, 25 bp, Mus musculus
aagggcctggaaaacattgactaag

SEQ ID NO: 62542 - DNA, 25 bp, Mus musculus
aagggcctggaatacattgactaag

SEQ ID NO: 62543 - DNA, 25 bp, Mus musculus
aagggcctggagaactcgacattcc

SEQ ID NO: 62544 - DNA, 25 bp, Mus musculus
aagggcctggagtactcgacattcc

SEQ ID NO: 62545 - DNA, 25 bp, Mus musculus
aagggcctggcaacttgctgaaaat

SEQ ID NO: 62546 - DNA, 25 bp, Mus musculus
aagggcctggcatcttgctgaaaat

SEQ ID NO: 62547 - DNA, 25 bp, Mus musculus
aagggcctggccatgaggacttcct

SEQ ID NO: 62548 - DNA, 25 bp, Mus musculus
aagggcctggccttgaggacttcct

SEQ ID NO: 62549 - DNA, 25 bp, Mus musculus
aagggcctggttaaatgcaatagtt

SEQ ID NO: 62550 - DNA, 25 bp, Mus musculus
aagggcctggttacgacagagtcgt

SEQ ID NO: 62551 - DNA, 25 bp, Mus musculus
aagggcctggtttaatgcaatagtt

SEQ ID NO: 62552 - DNA, 25 bp, Mus musculus
aagggcctggtttcgacagagtcgt

SEQ ID NO: 62553 - DNA, 25 bp, Mus musculus
aagggcctgttacaagcaccactgc

SEQ ID NO: 62554 - DNA, 25 bp, Mus musculus
aagggcctgttagaagcaccactgc

SEQ ID NO: 62555 - DNA, 25 bp, Mus musculus
aagggccttcttccagtgtgtacat

SEQ ID NO: 62556 - DNA, 25 bp, Mus musculus
aagggccttcttgcagtgtgtacat

SEQ ID NO: 62557 - DNA, 25 bp, Mus musculus
aagggccttgacagcaggccagcat

SEQ ID NO: 62558 - DNA, 25 bp, Mus musculus
aagggccttgactgcaggccagcat

SEQ ID NO: 62559 - DNA, 25 bp, Mus musculus
aagggccttggacggcatctgcaac

SEQ ID NO: 62560 - DNA, 25 bp, Mus musculus
aagggccttggagggcatctgcaac

SEQ ID NO: 62561 - DNA, 25 bp, Mus musculus
aagggccttgtaacactagtgacca

SEQ ID NO: 62562 - DNA, 25 bp, Mus musculus
aagggccttgtatcactagtgacca

SEQ ID NO: 62563 - DNA, 25 bp, Mus musculus
aagggcctttctcggtagcccacag

SEQ ID NO: 62564 - DNA, 25 bp, Mus musculus
aagggcctttctgggtagcccacag

SEQ ID NO: 62565 - DNA, 25 bp, Mus musculus
aagggcctttgaaaccatggtgact

SEQ ID NO: 62566 - DNA, 25 bp, Mus musculus
aagggcctttgataccatggtgact

SEQ ID NO: 62567 - DNA, 25 bp, Mus musculus
aagggcgaccccattgctgccctgt

SEQ ID NO: 62568 - DNA, 25 bp, Mus musculus
aagggcgacccctttgctgccctgt

SEQ ID NO: 62569 - DNA, 25 bp, Mus musculus
aagggcgactagacagcatccacag

SEQ ID NO: 62570 - DNA, 25 bp, Mus musculus
aagggcgactagtcagcatccacag

SEQ ID NO: 62571 - DNA, 25 bp, Mus musculus
aagggcgactttatcaatctgccgc

SEQ ID NO: 62572 - DNA, 25 bp, Mus musculus
aagggcgactttttcaatctgccgc

SEQ ID NO: 62573 - DNA, 25 bp, Mus musculus
aagggcgagacacccatgacttgga

SEQ ID NO: 62574 - DNA, 25 bp, Mus musculus
aagggcgagacactttttcctcatc

SEQ ID NO: 62575 - DNA, 25 bp, Mus musculus
aagggcgagacagccatgacttgga

SEQ ID NO: 62576 - DNA, 25 bp, Mus musculus
aagggcgagacagtttttcctcatc

SEQ ID NO: 62577 - DNA, 25 bp, Mus musculus
aagggcgagccacagtttctcacat

SEQ ID NO: 62578 - DNA, 25 bp, Mus musculus
aagggcgagccagagtttctcacat

SEQ ID NO: 62579 - DNA, 25 bp, Mus musculus
aagggcgagctcagggagaccactc

SEQ ID NO: 62580 - DNA, 25 bp, Mus musculus
aagggcgagctctgggagaccactc

SEQ ID NO: 62581 - DNA, 25 bp, Mus musculus
aagggcgagggcattttcatgagta

SEQ ID NO: 62582 - DNA, 25 bp, Mus musculus
aagggcgagggctttttcatgagta

SEQ ID NO: 62583 - DNA, 25 bp, Mus musculus
aagggcgatagcagtcctcgaatcc

SEQ ID NO: 62584 - DNA, 25 bp, Mus musculus
aagggcgatagctgtcctcgaatcc

SEQ ID NO: 62585 - DNA, 25 bp, Mus musculus
aagggcgatgctattcttctccaca

SEQ ID NO: 62586 - DNA, 25 bp, Mus musculus
aagggcgatgcttttcttctccaca

SEQ ID NO: 62587 - DNA, 25 bp, Mus musculus
aagggcgattcaatctacattctct

SEQ ID NO: 62588 - DNA, 25 bp, Mus musculus
aagggcgattcattctacattctct

SEQ ID NO: 62589 - DNA, 25 bp, Mus musculus
aagggcgattgtcttccagaagacc

SEQ ID NO: 62590 - DNA, 25 bp, Mus musculus
aagggcgattgtgttccagaagacc

SEQ ID NO: 62591 - DNA, 25 bp, Mus musculus
aagggcgcatggaccaacgttctca

SEQ ID NO: 62592 - DNA, 25 bp, Mus musculus
aagggcgcatggtccaacgttctca

SEQ ID NO: 62593 - DNA, 25 bp, Mus musculus
aagggcgcctgaaagctgcctgtaa

SEQ ID NO: 62594 - DNA, 25 bp, Mus musculus
aagggcgcctgatagctgcctgtaa

SEQ ID NO: 62595 - DNA, 25 bp, Mus musculus
aagggcgccttgaacatgacagcca

SEQ ID NO: 62596 - DNA, 25 bp, Mus musculus
aagggcgccttgtacatgacagcca

SEQ ID NO: 62597 - DNA, 25 bp, Mus musculus
aagggcgcttgcactcggtccacaa

SEQ ID NO: 62598 - DNA, 25 bp, Mus musculus
aagggcgcttgctctcggtccacaa

SEQ ID NO: 62599 - DNA, 25 bp, Mus musculus
aagggcggaacgattctccaggaca

SEQ ID NO: 62600 - DNA, 25 bp, Mus musculus
aagggcggaacgtttctccaggaca

SEQ ID NO: 62601 - DNA, 25 bp, Mus musculus
aagggcggaatgaagttactagaga

SEQ ID NO: 62602 - DNA, 25 bp, Mus musculus
aagggcggaatgtagttactagaga

SEQ ID NO: 62603 - DNA, 25 bp, Mus musculus
aagggcggacctaggagaactgcta

SEQ ID NO: 62604 - DNA, 25 bp, Mus musculus
aagggcggaccttggagaactgcta

SEQ ID NO: 62605 - DNA, 25 bp, Mus musculus
aagggcggagccatcagcaggaaaa

SEQ ID NO: 62606 - DNA, 25 bp, Mus musculus
aagggcggagccttcagcaggaaaa

SEQ ID NO: 62607 - DNA, 25 bp, Mus musculus
aagggcggagctatcttatggaata

SEQ ID NO: 62608 - DNA, 25 bp, Mus musculus
aagggcggagctttcttatggaata

SEQ ID NO: 62609 - DNA, 25 bp, Mus musculus
aagggcggatttctggaaccattct

SEQ ID NO: 62610 - DNA, 25 bp, Mus musculus
aagggcggatttgtggaaccattct

SEQ ID NO: 62611 - DNA, 25 bp, Mus musculus
aagggcggcagcagctagttaatct

SEQ ID NO: 62612 - DNA, 25 bp, Mus musculus
aagggcggcagctgctagttaatct

SEQ ID NO: 62613 - DNA, 25 bp, Mus musculus
aagggcggcggcagccacatccata

SEQ ID NO: 62614 - DNA, 25 bp, Mus musculus
aagggcggcggctgccacatccata

SEQ ID NO: 62615 - DNA, 25 bp, Mus musculus
aagggcgggcttctaatttctcatc

SEQ ID NO: 62616 - DNA, 25 bp, Mus musculus
aagggcgggcttgtaatttctcatc

SEQ ID NO: 62617 - DNA, 25 bp, Mus musculus
aagggcggtcctacaagtccgctgt

SEQ ID NO: 62618 - DNA, 25 bp, Mus musculus
aagggcggtccttcaagtccgctgt

SEQ ID NO: 62619 - DNA, 25 bp, Mus musculus
aagggcgtcagtatgcctcccaaca

SEQ ID NO: 62620 - DNA, 25 bp, Mus musculus
aagggcgtcagtttgcctcccaaca

SEQ ID NO: 62621 - DNA, 25 bp, Mus musculus
aagggcgtgcttcctgtatttcact

SEQ ID NO: 62622 - DNA, 25 bp, Mus musculus
aagggcgtgcttgctgtatttcact

SEQ ID NO: 62623 - DNA, 25 bp, Mus musculus
aagggcgtggccctcaagtctgtca

SEQ ID NO: 62624 - DNA, 25 bp, Mus musculus
aagggcgtggccgtcaagtctgtca

SEQ ID NO: 62625 - DNA, 25 bp, Mus musculus
aagggcgttaagactgatctgtgaa

SEQ ID NO: 62626 - DNA, 25 bp, Mus musculus
aagggcgttaagtctgatctgtgaa

SEQ ID NO: 62627 - DNA, 25 bp, Mus musculus
aagggcgttgtaaccagcgttgtga

SEQ ID NO: 62628 - DNA, 25 bp, Mus musculus
aagggcgttgtatccagcgttgtga

SEQ ID NO: 62629 - DNA, 25 bp, Mus musculus
aagggcgtttatctgtccattcatc

SEQ ID NO: 62630 - DNA, 25 bp, Mus musculus
aagggcgtttatgtgtccattcatc

SEQ ID NO: 62631 - DNA, 25 bp, Mus musculus
aagggctaacacataacatgcagag

SEQ ID NO: 62632 - DNA, 25 bp, Mus musculus
aagggctaacacttaacatgcagag

SEQ ID NO: 62633 - DNA, 25 bp, Mus musculus
aagggctaacagagtaacttattgt

SEQ ID NO: 62634 - DNA, 25 bp, Mus musculus
aagggctaacagtgtaacttattgt

SEQ ID NO: 62635 - DNA, 25 bp, Mus musculus
aagggctaactgactttatggaagg

SEQ ID NO: 62636 - DNA, 25 bp, Mus musculus
aagggctaactgtctttatggaagg

SEQ ID NO: 62637 - DNA, 25 bp, Mus musculus
aagggctacaagacacagcgaatgt

SEQ ID NO: 62638 - DNA, 25 bp, Mus musculus
aagggctacaagtcacagcgaatgt

SEQ ID NO: 62639 - DNA, 25 bp, Mus musculus
aagggctacatgaaaccatctggaa

SEQ ID NO: 62640 - DNA, 25 bp, Mus musculus
aagggctacatgtaaccatctggaa

SEQ ID NO: 62641 - DNA, 25 bp, Mus musculus
aagggctaccttaccagagaagtca

SEQ ID NO: 62642 - DNA, 25 bp, Mus musculus
aagggctacctttccagagaagtca

SEQ ID NO: 62643 - DNA, 25 bp, Mus musculus
aagggctactatcgctgccgtggcc

SEQ ID NO: 62644 - DNA, 25 bp, Mus musculus
aagggctactatggctgccgtggcc

SEQ ID NO: 62645 - DNA, 25 bp, Mus musculus
aagggctagacacctccatgttctt

SEQ ID NO: 62646 - DNA, 25 bp, Mus musculus
aagggctagacagctccatgttctt

SEQ ID NO: 62647 - DNA, 25 bp, Mus musculus
aagggctataagatggacgctccgg

SEQ ID NO: 62648 - DNA, 25 bp, Mus musculus
aagggctataagttggacgctccgg

SEQ ID NO: 62649 - DNA, 25 bp, Mus musculus
aagggctatccgacgaaggccggct

SEQ ID NO: 62650 - DNA, 25 bp, Mus musculus
aagggctatccgtcgaaggccggct

SEQ ID NO: 62651 - DNA, 25 bp, Mus musculus
aagggctatgggactgatggtctaa

SEQ ID NO: 62652 - DNA, 25 bp, Mus musculus
aagggctatgggtctgatggtctaa

SEQ ID NO: 62653 - DNA, 25 bp, Mus musculus
aagggctattcacggcaaggctttg

SEQ ID NO: 62654 - DNA, 25 bp, Mus musculus
aagggctattcagggcaaggctttg

SEQ ID NO: 62655 - DNA, 25 bp, Mus musculus
aagggctcaacaatgacttcatctt

SEQ ID NO: 62656 - DNA, 25 bp, Mus musculus
aagggctcaacattgacttcatctt

SEQ ID NO: 62657 - DNA, 25 bp, Mus musculus
aagggctcaagcatggcacatagga

SEQ ID NO: 62658 - DNA, 25 bp, Mus musculus
aagggctcaagcttggcacatagga

SEQ ID NO: 62659 - DNA, 25 bp, Mus musculus
aagggctcaatgctagtcttccaga

SEQ ID NO: 62660 - DNA, 25 bp, Mus musculus
aagggctcaatggtagtcttccaga

SEQ ID NO: 62661 - DNA, 25 bp, Mus musculus
aagggctcacctactcagggccgag

SEQ ID NO: 62662 - DNA, 25 bp, Mus musculus
aagggctcaccttctcagggccgag

SEQ ID NO: 62663 - DNA, 25 bp, Mus musculus
aagggctcactaagccagaggccaa

SEQ ID NO: 62664 - DNA, 25 bp, Mus musculus
aagggctcactatgccagaggccaa

SEQ ID NO: 62665 - DNA, 25 bp, Mus musculus
aagggctcagaaaacaagctgtgac

SEQ ID NO: 62666 - DNA, 25 bp, Mus musculus
aagggctcagaatacaagctgtgac

SEQ ID NO: 62667 - DNA, 25 bp, Mus musculus
aagggctcagcgctactgctgctta

SEQ ID NO: 62668 - DNA, 25 bp, Mus musculus
aagggctcagcggtactgctgctta

SEQ ID NO: 62669 - DNA, 25 bp, Mus musculus
aagggctcagctagcttcttcaaga

SEQ ID NO: 62670 - DNA, 25 bp, Mus musculus
aagggctcagcttgcttcttcaaga

SEQ ID NO: 62671 - DNA, 25 bp, Mus musculus
aagggctcaggcacaaggcagctgc

SEQ ID NO: 62672 - DNA, 25 bp, Mus musculus
aagggctcaggctcaaggcagctgc

SEQ ID NO: 62673 - DNA, 25 bp, Mus musculus
aagggctccatccttagtgatgtca

SEQ ID NO: 62674 - DNA, 25 bp, Mus musculus
aagggctccatcgttagtgatgtca

SEQ ID NO: 62675 - DNA, 25 bp, Mus musculus
aagggctccattcggattccacggt

SEQ ID NO: 62676 - DNA, 25 bp, Mus musculus
aagggctccattgggattccacggt

SEQ ID NO: 62677 - DNA, 25 bp, Mus musculus
aagggctcccttagccagacgtaga

SEQ ID NO: 62678 - DNA, 25 bp, Mus musculus
aagggctccctttgccagacgtaga

SEQ ID NO: 62679 - DNA, 25 bp, Mus musculus
aagggctccgttcctagaactcttg

SEQ ID NO: 62680 - DNA, 25 bp, Mus musculus
aagggctccgttgctagaactcttg

SEQ ID NO: 62681 - DNA, 25 bp, Mus musculus
aagggctcctagctaggataggatc

SEQ ID NO: 62682 - DNA, 25 bp, Mus musculus
aagggctcctaggtaggataggatc

SEQ ID NO: 62683 - DNA, 25 bp, Mus musculus
aagggctcctcgaggaagtccatga

SEQ ID NO: 62684 - DNA, 25 bp, Mus musculus
aagggctcctcgtggaagtccatga

SEQ ID NO: 62685 - DNA, 25 bp, Mus musculus
aagggctcggcacaatgagctctga

SEQ ID NO: 62686 - DNA, 25 bp, Mus musculus
aagggctcggcagaatgagctctga

SEQ ID NO: 62687 - DNA, 25 bp, Mus musculus
aagggctcgtgaagactgaagtcca

SEQ ID NO: 62688 - DNA, 25 bp, Mus musculus
aagggctcgtgatgactgaagtcca

SEQ ID NO: 62689 - DNA, 25 bp, Mus musculus
aagggctctctgaaggacatctata

SEQ ID NO: 62690 - DNA, 25 bp, Mus musculus
aagggctctctgtaggacatctata

SEQ ID NO: 62691 - DNA, 25 bp, Mus musculus
aagggctctgagacgtacaacccca

SEQ ID NO: 62692 - DNA, 25 bp, Mus musculus
aagggctctgagtcgtacaacccca

SEQ ID NO: 62693 - DNA, 25 bp, Mus musculus
aagggctctgatccagggccgccta

SEQ ID NO: 62694 - DNA, 25 bp, Mus musculus
aagggctctgatgcagggccgccta

SEQ ID NO: 62695 - DNA, 25 bp, Mus musculus
aagggctctggtatcaagtcccttg

SEQ ID NO: 62696 - DNA, 25 bp, Mus musculus
aagggctctggtttcaagtcccttg

SEQ ID NO: 62697 - DNA, 25 bp, Mus musculus
aagggctctgtaatataaccagctg

SEQ ID NO: 62698 - DNA, 25 bp, Mus musculus
aagggctctgtattataaccagctg

SEQ ID NO: 62699 - DNA, 25 bp, Mus musculus
aagggctctgtgactggttgcatgt

SEQ ID NO: 62700 - DNA, 25 bp, Mus musculus
aagggctctgtgtctggttgcatgt

SEQ ID NO: 62701 - DNA, 25 bp, Mus musculus
aagggctcttccagcttatgccagg

SEQ ID NO: 62702 - DNA, 25 bp, Mus musculus
aagggctcttccatcagtacaggta

SEQ ID NO: 62703 - DNA, 25 bp, Mus musculus
aagggctcttcctgcttatgccagg

SEQ ID NO: 62704 - DNA, 25 bp, Mus musculus
aagggctcttccttcagtacaggta

SEQ ID NO: 62705 - DNA, 25 bp, Mus musculus
aagggctctttcattgttcgttggc

SEQ ID NO: 62706 - DNA, 25 bp, Mus musculus
aagggctctttctttgttcgttggc

SEQ ID NO: 62707 - DNA, 25 bp, Mus musculus
aagggctgacacatttctgtgaaac

SEQ ID NO: 62708 - DNA, 25 bp, Mus musculus
aagggctgacacttttctgtgaaac

SEQ ID NO: 62709 - DNA, 25 bp, Mus musculus
aagggctgactacgaagcaccacct

SEQ ID NO: 62710 - DNA, 25 bp, Mus musculus
aagggctgactaggaagcaccacct

SEQ ID NO: 62711 - DNA, 25 bp, Mus musculus
aagggctgagccattggccttcaaa

SEQ ID NO: 62712 - DNA, 25 bp, Mus musculus
aagggctgagcctttggccttcaaa

SEQ ID NO: 62713 - DNA, 25 bp, Mus musculus
aagggctgattcattatacagagga

SEQ ID NO: 62714 - DNA, 25 bp, Mus musculus
aagggctgattctttatacagagga

SEQ ID NO: 62715 - DNA, 25 bp, Mus musculus
aagggctgcaccacagaagttggac

SEQ ID NO: 62716 - DNA, 25 bp, Mus musculus
aagggctgcacctcagaagttggac

SEQ ID NO: 62717 - DNA, 25 bp, Mus musculus
aagggctgcctaaatattgcatatg

SEQ ID NO: 62718 - DNA, 25 bp, Mus musculus
aagggctgcctatatattgcatatg

SEQ ID NO: 62719 - DNA, 25 bp, Mus musculus
aagggctgcgggagctcccttgtcc

SEQ ID NO: 62720 - DNA, 25 bp, Mus musculus
aagggctgcgggtgctcccttgtcc

SEQ ID NO: 62721 - DNA, 25 bp, Mus musculus
aagggctgctatctggcaccagcac

SEQ ID NO: 62722 - DNA, 25 bp, Mus musculus
aagggctgctatgtggcaccagcac

SEQ ID NO: 62723 - DNA, 25 bp, Mus musculus
aagggctgctcccaggacgacgaat

SEQ ID NO: 62724 - DNA, 25 bp, Mus musculus
aagggctgctccgaggacgacgaat

SEQ ID NO: 62725 - DNA, 25 bp, Mus musculus
aagggctgctgacccgtgcttacaa

SEQ ID NO: 62726 - DNA, 25 bp, Mus musculus
aagggctgctgagccgtgcttacaa

SEQ ID NO: 62727 - DNA, 25 bp, Mus musculus
aagggctgctgccttcatttaggag

SEQ ID NO: 62728 - DNA, 25 bp, Mus musculus
aagggctgctgcgttcatttaggag

SEQ ID NO: 62729 - DNA, 25 bp, Mus musculus
aagggctgctggcttttcggctaca

SEQ ID NO: 62730 - DNA, 25 bp, Mus musculus
aagggctgctgggttttcggctaca

SEQ ID NO: 62731 - DNA, 25 bp, Mus musculus
aagggctggaagatattcttgaaat

SEQ ID NO: 62732 - DNA, 25 bp, Mus musculus
aagggctggaagttattcttgaaat

SEQ ID NO: 62733 - DNA, 25 bp, Mus musculus
aagggctggactagtaatggctgac

SEQ ID NO: 62734 - DNA, 25 bp, Mus musculus
aagggctggacttgtaatggctgac

SEQ ID NO: 62735 - DNA, 25 bp, Mus musculus
aagggctggagcactgaccaggaca

SEQ ID NO: 62736 - DNA, 25 bp, Mus musculus
aagggctggagccacacaatgacaa

SEQ ID NO: 62737 - DNA, 25 bp, Mus musculus
aagggctggagcgacacaatgacaa

SEQ ID NO: 62738 - DNA, 25 bp, Mus musculus
aagggctggagctctgaccaggaca

SEQ ID NO: 62739 - DNA, 25 bp, Mus musculus
aagggctggcaacgcactcaggaca

SEQ ID NO: 62740 - DNA, 25 bp, Mus musculus
aagggctggcaaggcactcaggaca

SEQ ID NO: 62741 - DNA, 25 bp, Mus musculus
aagggctgggttacattcttggatc

SEQ ID NO: 62742 - DNA, 25 bp, Mus musculus
aagggctgggtttcattcttggatc

SEQ ID NO: 62743 - DNA, 25 bp, Mus musculus
aagggctggtgtacacttgtttact

SEQ ID NO: 62744 - DNA, 25 bp, Mus musculus
aagggctggtgttcacttgtttact

SEQ ID NO: 62745 - DNA, 25 bp, Mus musculus
aagggctgtgctctgatcactgcgt

SEQ ID NO: 62746 - DNA, 25 bp, Mus musculus
aagggctgtgctgtgatcactgcgt

SEQ ID NO: 62747 - DNA, 25 bp, Mus musculus
aagggctgtggcaacctggaactcg

SEQ ID NO: 62748 - DNA, 25 bp, Mus musculus
aagggctgtggcaataactcgatcc

SEQ ID NO: 62749 - DNA, 25 bp, Mus musculus
aagggctgtggctacctggaactcg

SEQ ID NO: 62750 - DNA, 25 bp, Mus musculus
aagggctgtggctataactcgatcc

SEQ ID NO: 62751 - DNA, 25 bp, Mus musculus
aagggctgtgtgcagatctacccac

SEQ ID NO: 62752 - DNA, 25 bp, Mus musculus
aagggctgtgtggagatctacccac

SEQ ID NO: 62753 - DNA, 25 bp, Mus musculus
aagggctgttatcatctggtgacca

SEQ ID NO: 62754 - DNA, 25 bp, Mus musculus
aagggctgttatgatctggtgacca

SEQ ID NO: 62755 - DNA, 25 bp, Mus musculus
aagggctgtttcacttggttgtaca

SEQ ID NO: 62756 - DNA, 25 bp, Mus musculus
aagggctgtttctcttggttgtaca

SEQ ID NO: 62757 - DNA, 25 bp, Mus musculus
aagggcttacttacatagcgctggg

SEQ ID NO: 62758 - DNA, 25 bp, Mus musculus
aagggcttactttcatagcgctggg

SEQ ID NO: 62759 - DNA, 25 bp, Mus musculus
aagggcttagctatcttgggacatc

SEQ ID NO: 62760 - DNA, 25 bp, Mus musculus
aagggcttagctttcttgggacatc

SEQ ID NO: 62761 - DNA, 25 bp, Mus musculus
aagggcttagtcactagcagcagca

SEQ ID NO: 62762 - DNA, 25 bp, Mus musculus
aagggcttagtctctagcagcagca

SEQ ID NO: 62763 - DNA, 25 bp, Mus musculus
aagggcttcaggattgccacatggt

SEQ ID NO: 62764 - DNA, 25 bp, Mus musculus
aagggcttcaggtttgccacatggt

SEQ ID NO: 62765 - DNA, 25 bp, Mus musculus
aagggcttcatgagcgagaccgcca

SEQ ID NO: 62766 - DNA, 25 bp, Mus musculus
aagggcttcatgtgcgagaccgcca

SEQ ID NO: 62767 - DNA, 25 bp, Mus musculus
aagggcttcccacctattattctag

SEQ ID NO: 62768 - DNA, 25 bp, Mus musculus
aagggcttcccagctattattctag

SEQ ID NO: 62769 - DNA, 25 bp, Mus musculus
aagggcttccgactgctgagcatga

SEQ ID NO: 62770 - DNA, 25 bp, Mus musculus
aagggcttccgagtgctgagcatga

SEQ ID NO: 62771 - DNA, 25 bp, Mus musculus
aagggcttctacagcctgcgggaca

SEQ ID NO: 62772 - DNA, 25 bp, Mus musculus
aagggcttctactgcctgcgggaca

SEQ ID NO: 62773 - DNA, 25 bp, Mus musculus
aagggcttctccacagatgccagag

SEQ ID NO: 62774 - DNA, 25 bp, Mus musculus
aagggcttctcctcagatgccagag

SEQ ID NO: 62775 - DNA, 25 bp, Mus musculus
aagggcttctggaatctttcacaat

SEQ ID NO: 62776 - DNA, 25 bp, Mus musculus
aagggcttctggtatctttcacaat

SEQ ID NO: 62777 - DNA, 25 bp, Mus musculus
aagggcttcttcatcctggaagact

SEQ ID NO: 62778 - DNA, 25 bp, Mus musculus
aagggcttcttcttcctggaagact

SEQ ID NO: 62779 - DNA, 25 bp, Mus musculus
aagggcttcttgaatctcttccaag

SEQ ID NO: 62780 - DNA, 25 bp, Mus musculus
aagggcttcttgtatctcttccaag

SEQ ID NO: 62781 - DNA, 25 bp, Mus musculus
aagggcttgacaaaatgttcatcat

SEQ ID NO: 62782 - DNA, 25 bp, Mus musculus
aagggcttgacataatgttcatcat

SEQ ID NO: 62783 - DNA, 25 bp, Mus musculus
aagggcttgacgcacctttgatcca

SEQ ID NO: 62784 - DNA, 25 bp, Mus musculus
aagggcttgacggacctttgatcca

SEQ ID NO: 62785 - DNA, 25 bp, Mus musculus
aagggcttgactaaaacctgtgata

SEQ ID NO: 62786 - DNA, 25 bp, Mus musculus
aagggcttgacttaaacctgtgata

SEQ ID NO: 62787 - DNA, 25 bp, Mus musculus
aagggcttgagcatcctcagattct

SEQ ID NO: 62788 - DNA, 25 bp, Mus musculus
aagggcttgagcttcctcagattct

SEQ ID NO: 62789 - DNA, 25 bp, Mus musculus
aagggcttgataacacttgtgtctc

SEQ ID NO: 62790 - DNA, 25 bp, Mus musculus
aagggcttgatatcacttgtgtctc

SEQ ID NO: 62791 - DNA, 25 bp, Mus musculus
aagggcttgccaagcatctacaagg

SEQ ID NO: 62792 - DNA, 25 bp, Mus musculus
aagggcttgccatgcatctacaagg

SEQ ID NO: 62793 - DNA, 25 bp, Mus musculus
aagggcttgctcatctagattgcat

SEQ ID NO: 62794 - DNA, 25 bp, Mus musculus
aagggcttgctccagttccaaatgg

SEQ ID NO: 62795 - DNA, 25 bp, Mus musculus
aagggcttgctcgagttccaaatgg

SEQ ID NO: 62796 - DNA, 25 bp, Mus musculus
aagggcttgctcttctagattgcat

SEQ ID NO: 62797 - DNA, 25 bp, Mus musculus
aagggcttgcttaagtggcctcaga

SEQ ID NO: 62798 - DNA, 25 bp, Mus musculus
aagggcttgcttctactgctgagat

SEQ ID NO: 62799 - DNA, 25 bp, Mus musculus
aagggcttgcttgtactgctgagat

SEQ ID NO: 62800 - DNA, 25 bp, Mus musculus
aagggcttgctttagtggcctcaga

SEQ ID NO: 62801 - DNA, 25 bp, Mus musculus
aagggcttggatacctatgaggaaa

SEQ ID NO: 62802 - DNA, 25 bp, Mus musculus
aagggcttggatcacttcttcccag

SEQ ID NO: 62803 - DNA, 25 bp, Mus musculus
aagggcttggatcctgccctgtcat

SEQ ID NO: 62804 - DNA, 25 bp, Mus musculus
aagggcttggatgacttcttcccag

SEQ ID NO: 62805 - DNA, 25 bp, Mus musculus
aagggcttggatgctgccctgtcat

SEQ ID NO: 62806 - DNA, 25 bp, Mus musculus
aagggcttggattcctatgaggaaa

SEQ ID NO: 62807 - DNA, 25 bp, Mus musculus
aagggcttggctctaggaaatctaa

SEQ ID NO: 62808 - DNA, 25 bp, Mus musculus
aagggcttggctgtaggaaatctaa

SEQ ID NO: 62809 - DNA, 25 bp, Mus musculus
aagggcttgttcatcaacacattga

SEQ ID NO: 62810 - DNA, 25 bp, Mus musculus
aagggcttgttcttcaacacattga

SEQ ID NO: 62811 - DNA, 25 bp, Mus musculus
aagggctttatcagaattaagtcaa

SEQ ID NO: 62812 - DNA, 25 bp, Mus musculus
aagggctttatctgaattaagtcaa

SEQ ID NO: 62813 - DNA, 25 bp, Mus musculus
aagggctttctgcatttcttatggg

SEQ ID NO: 62814 - DNA, 25 bp, Mus musculus
aagggctttctggatttcttatggg

SEQ ID NO: 62815 - DNA, 25 bp, Mus musculus
aagggctttgacagcaggacttcca

SEQ ID NO: 62816 - DNA, 25 bp, Mus musculus
aagggctttgactgcaggacttcca

SEQ ID NO: 62817 - DNA, 25 bp, Mus musculus
aagggctttgctagtatgacccaaa

SEQ ID NO: 62818 - DNA, 25 bp, Mus musculus
aagggctttgctcgttttggtatca

SEQ ID NO: 62819 - DNA, 25 bp, Mus musculus
aagggctttgctggttttggtatca

SEQ ID NO: 62820 - DNA, 25 bp, Mus musculus
aagggctttgcttgtatgacccaaa

SEQ ID NO: 62821 - DNA, 25 bp, Mus musculus
aagggctttggaagacagttatcat

SEQ ID NO: 62822 - DNA, 25 bp, Mus musculus
aagggctttggatgacagttatcat

SEQ ID NO: 62823 - DNA, 25 bp, Mus musculus
aaggggaagcagagtaccacggtct

SEQ ID NO: 62824 - DNA, 25 bp, Mus musculus
aaggggaagcagtgtaccacggtct

SEQ ID NO: 62825 - DNA, 25 bp, Mus musculus
aaggggaggtttcctcctgccatga

SEQ ID NO: 62826 - DNA, 25 bp, Mus musculus
aaggggaggtttgctcctgccatga

SEQ ID NO: 62827 - DNA, 25 bp, Mus musculus
aaggggatggagacctgctccccag

SEQ ID NO: 62828 - DNA, 25 bp, Mus musculus
aaggggatggagtcctgctccccag

SEQ ID NO: 62829 - DNA, 25 bp, Mus musculus
aagggggagatgacagagaccatcc

SEQ ID NO: 62830 - DNA, 25 bp, Mus musculus
aagggggagatgtcagagaccatcc

SEQ ID NO: 62831 - DNA, 25 bp, Mus musculus
aaggggggcccaccaaggtcattct

SEQ ID NO: 62832 - DNA, 25 bp, Mus musculus
aaggggggcccagcaaggtcattct

SEQ ID NO: 62833 - DNA, 25 bp, Mus musculus
aagggtaacacacgttctggcagga

SEQ ID NO: 62834 - DNA, 25 bp, Mus musculus
aagggtaacacaggttctggcagga

SEQ ID NO: 62835 - DNA, 25 bp, Mus musculus
aagggtaagtatccttgtaacacac

SEQ ID NO: 62836 - DNA, 25 bp, Mus musculus
aagggtaagtatgcttgtaacacac

SEQ ID NO: 62837 - DNA, 25 bp, Mus musculus
aagggtacagacatcctaatgacaa

SEQ ID NO: 62838 - DNA, 25 bp, Mus musculus
aagggtacagacttcctaatgacaa

SEQ ID NO: 62839 - DNA, 25 bp, Mus musculus
aagggtacagatacagcctcagaat

SEQ ID NO: 62840 - DNA, 25 bp, Mus musculus
aagggtacagattcagcctcagaat

SEQ ID NO: 62841 - DNA, 25 bp, Mus musculus
aagggtacaggacatctagctcaga

SEQ ID NO: 62842 - DNA, 25 bp, Mus musculus
aagggtacaggagatctagctcaga

SEQ ID NO: 62843 - DNA, 25 bp, Mus musculus
aagggtaccactccctgaggacagc

SEQ ID NO: 62844 - DNA, 25 bp, Mus musculus
aagggtaccactgcctgaggacagc

SEQ ID NO: 62845 - DNA, 25 bp, Mus musculus
aagggtacctagagccctcaggact

SEQ ID NO: 62846 - DNA, 25 bp, Mus musculus
aagggtacctagtgccctcaggact

SEQ ID NO: 62847 - DNA, 25 bp, Mus musculus
aagggtacgtgcagttccaggcatc

SEQ ID NO: 62848 - DNA, 25 bp, Mus musculus
aagggtacgtgctgttccaggcatc

SEQ ID NO: 62849 - DNA, 25 bp, Mus musculus
aagggtactcagctcaggccacagt

SEQ ID NO: 62850 - DNA, 25 bp, Mus musculus
aagggtactcaggtcaggccacagt

SEQ ID NO: 62851 - DNA, 25 bp, Mus musculus
aagggtactcatagctcttgcagag

SEQ ID NO: 62852 - DNA, 25 bp, Mus musculus
aagggtactcattgctcttgcagag

SEQ ID NO: 62853 - DNA, 25 bp, Mus musculus
aagggtactgctacaaccaacccag

SEQ ID NO: 62854 - DNA, 25 bp, Mus musculus
aagggtactgcttcaaccaacccag

SEQ ID NO: 62855 - DNA, 25 bp, Mus musculus
aagggtagataaaccctgccgccac

SEQ ID NO: 62856 - DNA, 25 bp, Mus musculus
aagggtagataatccctgccgccac

SEQ ID NO: 62857 - DNA, 25 bp, Mus musculus
aagggtagccaaacacgaagagcgt

SEQ ID NO: 62858 - DNA, 25 bp, Mus musculus
aagggtagccaatcacgaagagcgt

SEQ ID NO: 62859 - DNA, 25 bp, Mus musculus
aagggtagctgcaggcagcatgaac

SEQ ID NO: 62860 - DNA, 25 bp, Mus musculus
aagggtagctgctggcagcatgaac

SEQ ID NO: 62861 - DNA, 25 bp, Mus musculus
aagggtaggcacagtgttcccagca

SEQ ID NO: 62862 - DNA, 25 bp, Mus musculus
aagggtaggcactgtgttcccagca

SEQ ID NO: 62863 - DNA, 25 bp, Mus musculus
aagggtaggcccataacgatctgcc

SEQ ID NO: 62864 - DNA, 25 bp, Mus musculus
aagggtaggcccttaacgatctgcc

SEQ ID NO: 62865 - DNA, 25 bp, Mus musculus
aagggtagggcccagctcttcccat

SEQ ID NO: 62866 - DNA, 25 bp, Mus musculus
aagggtagggccgagctcttcccat

SEQ ID NO: 62867 - DNA, 25 bp, Mus musculus
aagggtagtatcagggtatattctc

SEQ ID NO: 62868 - DNA, 25 bp, Mus musculus
aagggtagtatctgggtatattctc

SEQ ID NO: 62869 - DNA, 25 bp, Mus musculus
aagggtagttccactgtcaggagaa

SEQ ID NO: 62870 - DNA, 25 bp, Mus musculus
aagggtagttcctctgtcaggagaa

SEQ ID NO: 62871 - DNA, 25 bp, Mus musculus
aagggtatatgtcccagcctggtgc

SEQ ID NO: 62872 - DNA, 25 bp, Mus musculus
aagggtatatgtgccagcctggtgc

SEQ ID NO: 62873 - DNA, 25 bp, Mus musculus
aagggtatcagaccccagagctggc

SEQ ID NO: 62874 - DNA, 25 bp, Mus musculus
aagggtatcagagcccagagctggc

SEQ ID NO: 62875 - DNA, 25 bp, Mus musculus
aagggtatccagagctccctgtgac

SEQ ID NO: 62876 - DNA, 25 bp, Mus musculus
aagggtatccagtgctccctgtgac

SEQ ID NO: 62877 - DNA, 25 bp, Mus musculus
aagggtatgcgccatttctctgaga

SEQ ID NO: 62878 - DNA, 25 bp, Mus musculus
aagggtatgcgcgatttctctgaga

SEQ ID NO: 62879 - DNA, 25 bp, Mus musculus
aagggtatgcttctagatcttacta

SEQ ID NO: 62880 - DNA, 25 bp, Mus musculus
aagggtatgcttgtagatcttacta

SEQ ID NO: 62881 - DNA, 25 bp, Mus musculus
aagggtatggtgatgactccagaca

SEQ ID NO: 62882 - DNA, 25 bp, Mus musculus
aagggtatggtgttgactccagaca

SEQ ID NO: 62883 - DNA, 25 bp, Mus musculus
aagggtatggttacatcacttttga

SEQ ID NO: 62884 - DNA, 25 bp, Mus musculus
aagggtatggttagcctactgcctc

SEQ ID NO: 62885 - DNA, 25 bp, Mus musculus
aagggtatggtttcatcacttttga

SEQ ID NO: 62886 - DNA, 25 bp, Mus musculus
aagggtatggtttgcctactgcctc

SEQ ID NO: 62887 - DNA, 25 bp, Mus musculus
aagggtcaactcagtttcttgccta

SEQ ID NO: 62888 - DNA, 25 bp, Mus musculus
aagggtcaactctgtttcttgccta

SEQ ID NO: 62889 - DNA, 25 bp, Mus musculus
aagggtcaatcgcagagccatccgc

SEQ ID NO: 62890 - DNA, 25 bp, Mus musculus
aagggtcaatcggagagccatccgc

SEQ ID NO: 62891 - DNA, 25 bp, Mus musculus
aagggtcaatgcctgctgctacaaa

SEQ ID NO: 62892 - DNA, 25 bp, Mus musculus
aagggtcaatgcgtgctgctacaaa

SEQ ID NO: 62893 - DNA, 25 bp, Mus musculus
aagggtcacaggcttggacactccg

SEQ ID NO: 62894 - DNA, 25 bp, Mus musculus
aagggtcacagggttggacactccg

SEQ ID NO: 62895 - DNA, 25 bp, Mus musculus
aagggtcacattaccttcgattcca

SEQ ID NO: 62896 - DNA, 25 bp, Mus musculus
aagggtcacatttccttcgattcca

SEQ ID NO: 62897 - DNA, 25 bp, Mus musculus
aagggtcacctgagaccatcggcaa

SEQ ID NO: 62898 - DNA, 25 bp, Mus musculus
aagggtcacctgtgaccatcggcaa

SEQ ID NO: 62899 - DNA, 25 bp, Mus musculus
aagggtcaccttctaactcagcaat

SEQ ID NO: 62900 - DNA, 25 bp, Mus musculus
aagggtcaccttgtaactcagcaat

SEQ ID NO: 62901 - DNA, 25 bp, Mus musculus
aagggtcacgagcacatttgctccc

SEQ ID NO: 62902 - DNA, 25 bp, Mus musculus
aagggtcacgaggacatttgctccc

SEQ ID NO: 62903 - DNA, 25 bp, Mus musculus
aagggtcacggtagcatctgatgcc

SEQ ID NO: 62904 - DNA, 25 bp, Mus musculus
aagggtcacggttgcatctgatgcc

SEQ ID NO: 62905 - DNA, 25 bp, Mus musculus
aagggtcactgcaggcatgaagctt

SEQ ID NO: 62906 - DNA, 25 bp, Mus musculus
aagggtcactgctggcatgaagctt

SEQ ID NO: 62907 - DNA, 25 bp, Mus musculus
aagggtcagaccacaggctcctgaa

SEQ ID NO: 62908 - DNA, 25 bp, Mus musculus
aagggtcagacctcaggctcctgaa

SEQ ID NO: 62909 - DNA, 25 bp, Mus musculus
aagggtcagaggctctgccaaccga

SEQ ID NO: 62910 - DNA, 25 bp, Mus musculus
aagggtcagagggtctgccaaccga

SEQ ID NO: 62911 - DNA, 25 bp, Mus musculus
aagggtcagcacagccagagcaagc

SEQ ID NO: 62912 - DNA, 25 bp, Mus musculus
aagggtcagcactgccagagcaagc

SEQ ID NO: 62913 - DNA, 25 bp, Mus musculus
aagggtcagtgtcagaaggttcata

SEQ ID NO: 62914 - DNA, 25 bp, Mus musculus
aagggtcagtgtgagaaggttcata

SEQ ID NO: 62915 - DNA, 25 bp, Mus musculus
aagggtcatgatcccaccacagtta

SEQ ID NO: 62916 - DNA, 25 bp, Mus musculus
aagggtcatgatgccaccacagtta

SEQ ID NO: 62917 - DNA, 25 bp, Mus musculus
aagggtcattaaaaagctgtgctct

SEQ ID NO: 62918 - DNA, 25 bp, Mus musculus
aagggtcattaataagctgtgctct

SEQ ID NO: 62919 - DNA, 25 bp, Mus musculus
aagggtcattgactgttccctctgc

SEQ ID NO: 62920 - DNA, 25 bp, Mus musculus
aagggtcattgagtgttccctctgc

SEQ ID NO: 62921 - DNA, 25 bp, Mus musculus
aagggtccacaaagctctagactgg

SEQ ID NO: 62922 - DNA, 25 bp, Mus musculus
aagggtccacaatgctctagactgg

SEQ ID NO: 62923 - DNA, 25 bp, Mus musculus
aagggtccagctaatggcccaagct

SEQ ID NO: 62924 - DNA, 25 bp, Mus musculus
aagggtccagcttatggcccaagct

SEQ ID NO: 62925 - DNA, 25 bp, Mus musculus
aagggtccagtcagaagcagttttc

SEQ ID NO: 62926 - DNA, 25 bp, Mus musculus
aagggtccagtctgaagcagttttc

SEQ ID NO: 62927 - DNA, 25 bp, Mus musculus
aagggtccagttaatcctctgctct

SEQ ID NO: 62928 - DNA, 25 bp, Mus musculus
aagggtccagtttatcctctgctct

SEQ ID NO: 62929 - DNA, 25 bp, Mus musculus
aagggtccatacagtcctgggagca

SEQ ID NO: 62930 - DNA, 25 bp, Mus musculus
aagggtccatactgtcctgggagca

SEQ ID NO: 62931 - DNA, 25 bp, Mus musculus
aagggtccattgatcaacagatttg

SEQ ID NO: 62932 - DNA, 25 bp, Mus musculus
aagggtccattgttcaacagatttg

SEQ ID NO: 62933 - DNA, 25 bp, Mus musculus
aagggtcccctcaccataggatgag

SEQ ID NO: 62934 - DNA, 25 bp, Mus musculus
aagggtcccctctccataggatgag

SEQ ID NO: 62935 - DNA, 25 bp, Mus musculus
aagggtccctagactggactggcag

SEQ ID NO: 62936 - DNA, 25 bp, Mus musculus
aagggtccctagtctggactggcag

SEQ ID NO: 62937 - DNA, 25 bp, Mus musculus
aagggtccctggaatgtgttggcca

SEQ ID NO: 62938 - DNA, 25 bp, Mus musculus
aagggtccctggtatgtgttggcca

SEQ ID NO: 62939 - DNA, 25 bp, Mus musculus
aagggtcccttacaactggaatcag

SEQ ID NO: 62940 - DNA, 25 bp, Mus musculus
aagggtcccttagaactggaatcag

SEQ ID NO: 62941 - DNA, 25 bp, Mus musculus
aagggtcctaacatccaaggccagt

SEQ ID NO: 62942 - DNA, 25 bp, Mus musculus
aagggtcctaacttccaaggccagt

SEQ ID NO: 62943 - DNA, 25 bp, Mus musculus
aagggtcctaccctcatgtcgtata

SEQ ID NO: 62944 - DNA, 25 bp, Mus musculus
aagggtcctaccgtcatgtcgtata

SEQ ID NO: 62945 - DNA, 25 bp, Mus musculus
aagggtcctctgacaaaggctccat

SEQ ID NO: 62946 - DNA, 25 bp, Mus musculus
aagggtcctctgtcaaaggctccat

SEQ ID NO: 62947 - DNA, 25 bp, Mus musculus
aagggtcctgagacattggctacca

SEQ ID NO: 62948 - DNA, 25 bp, Mus musculus
aagggtcctgagtcattggctacca

SEQ ID NO: 62949 - DNA, 25 bp, Mus musculus
aagggtcctgatatcctggtggtac

SEQ ID NO: 62950 - DNA, 25 bp, Mus musculus
aagggtcctgatttcctggtggtac

SEQ ID NO: 62951 - DNA, 25 bp, Mus musculus
aagggtcctgtgcatccgtctatca

SEQ ID NO: 62952 - DNA, 25 bp, Mus musculus
aagggtcctgtggatccgtctatca

SEQ ID NO: 62953 - DNA, 25 bp, Mus musculus
aagggtccttatatgcaaggctact

SEQ ID NO: 62954 - DNA, 25 bp, Mus musculus
aagggtccttatttgcaaggctact

SEQ ID NO: 62955 - DNA, 25 bp, Mus musculus
aagggtccttcaagagggccaggct

SEQ ID NO: 62956 - DNA, 25 bp, Mus musculus
aagggtccttcatgagggccaggct

SEQ ID NO: 62957 - DNA, 25 bp, Mus musculus
aagggtccttccaagcttggaagag

SEQ ID NO: 62958 - DNA, 25 bp, Mus musculus
aagggtccttcctagcttggaagag

SEQ ID NO: 62959 - DNA, 25 bp, Mus musculus
aagggtccttcgaagaactgtgcag

SEQ ID NO: 62960 - DNA, 25 bp, Mus musculus
aagggtccttcgtagaactgtgcag

SEQ ID NO: 62961 - DNA, 25 bp, Mus musculus
aagggtcggaataaggcgctcattt

SEQ ID NO: 62962 - DNA, 25 bp, Mus musculus
aagggtcggaattaggcgctcattt

SEQ ID NO: 62963 - DNA, 25 bp, Mus musculus
aagggtcggtctctggtcatatata

SEQ ID NO: 62964 - DNA, 25 bp, Mus musculus
aagggtcggtctgtggtcatatata

SEQ ID NO: 62965 - DNA, 25 bp, Mus musculus
aagggtcgtctaatccagctgggca

SEQ ID NO: 62966 - DNA, 25 bp, Mus musculus
aagggtcgtctattccagctgggca

SEQ ID NO: 62967 - DNA, 25 bp, Mus musculus
aagggtctacagcaagtggagttcc

SEQ ID NO: 62968 - DNA, 25 bp, Mus musculus
aagggtctacaggaagtggagttcc

SEQ ID NO: 62969 - DNA, 25 bp, Mus musculus
aagggtctatacctttcacgctggc

SEQ ID NO: 62970 - DNA, 25 bp, Mus musculus
aagggtctatacgtttcacgctggc

SEQ ID NO: 62971 - DNA, 25 bp, Mus musculus
aagggtctcaggacactagcatcct

SEQ ID NO: 62972 - DNA, 25 bp, Mus musculus
aagggtctcaggtcactagcatcct

SEQ ID NO: 62973 - DNA, 25 bp, Mus musculus
aagggtctcatcattcttaaattag

SEQ ID NO: 62974 - DNA, 25 bp, Mus musculus
aagggtctcatctttcttaaattag

SEQ ID NO: 62975 - DNA, 25 bp, Mus musculus
aagggtctccacattagtttcagag

SEQ ID NO: 62976 - DNA, 25 bp, Mus musculus
aagggtctccactttagtttcagag

SEQ ID NO: 62977 - DNA, 25 bp, Mus musculus
aagggtctcccacgcacgctgtgct

SEQ ID NO: 62978 - DNA, 25 bp, Mus musculus
aagggtctcccaggcacgctgtgct

SEQ ID NO: 62979 - DNA, 25 bp, Mus musculus
aagggtctcctcagttctgggtgaa

SEQ ID NO: 62980 - DNA, 25 bp, Mus musculus
aagggtctcctctgttctgggtgaa

SEQ ID NO: 62981 - DNA, 25 bp, Mus musculus
aagggtctcgtaatgccgctgctgg

SEQ ID NO: 62982 - DNA, 25 bp, Mus musculus
aagggtctcgtattgccgctgctgg

SEQ ID NO: 62983 - DNA, 25 bp, Mus musculus
aagggtctgaatcggtgttcaccta

SEQ ID NO: 62984 - DNA, 25 bp, Mus musculus
aagggtctgaatgggtgttcaccta

SEQ ID NO: 62985 - DNA, 25 bp, Mus musculus
aagggtctggatccctgagctgaca

SEQ ID NO: 62986 - DNA, 25 bp, Mus musculus
aagggtctggatgcctgagctgaca

SEQ ID NO: 62987 - DNA, 25 bp, Mus musculus
aagggtctggcgagctacatatgaa

SEQ ID NO: 62988 - DNA, 25 bp, Mus musculus
aagggtctggcgtgctacatatgaa

SEQ ID NO: 62989 - DNA, 25 bp, Mus musculus
aagggtctgggtacttttcatgcag

SEQ ID NO: 62990 - DNA, 25 bp, Mus musculus
aagggtctgggttcttttcatgcag

SEQ ID NO: 62991 - DNA, 25 bp, Mus musculus
aagggtcttacaatccagcagacac

SEQ ID NO: 62992 - DNA, 25 bp, Mus musculus
aagggtcttacattccagcagacac

SEQ ID NO: 62993 - DNA, 25 bp, Mus musculus
aagggtcttagactgctgcagaaaa

SEQ ID NO: 62994 - DNA, 25 bp, Mus musculus
aagggtcttagagtgctgcagaaaa

SEQ ID NO: 62995 - DNA, 25 bp, Mus musculus
aagggtcttcaaagcttgcccctgt

SEQ ID NO: 62996 - DNA, 25 bp, Mus musculus
aagggtcttcaatgcttgcccctgt

SEQ ID NO: 62997 - DNA, 25 bp, Mus musculus
aagggtcttcacagatctcatttct

SEQ ID NO: 62998 - DNA, 25 bp, Mus musculus
aagggtcttcactgatctcatttct

SEQ ID NO: 62999 - DNA, 25 bp, Mus musculus
aagggtcttgtgcttgtctttcact

SEQ ID NO: 63000 - DNA, 25 bp, Mus musculus
aagggtcttgtggttgtctttcact

SEQ ID NO: 63001 - DNA, 25 bp, Mus musculus
aagggtgaattcctcacattccagc

SEQ ID NO: 63002 - DNA, 25 bp, Mus musculus
aagggtgaattcgtcacattccagc

SEQ ID NO: 63003 - DNA, 25 bp, Mus musculus
aagggtgacacgagccctggacact

SEQ ID NO: 63004 - DNA, 25 bp, Mus musculus
aagggtgacacgtgccctggacact

SEQ ID NO: 63005 - DNA, 25 bp, Mus musculus
aagggtgacactctgaacgtactcc

SEQ ID NO: 63006 - DNA, 25 bp, Mus musculus
aagggtgacactgtgaacgtactcc

SEQ ID NO: 63007 - DNA, 25 bp, Mus musculus
aagggtgaccaaagccactgggttg

SEQ ID NO: 63008 - DNA, 25 bp, Mus musculus
aagggtgaccaatgccactgggttg

SEQ ID NO: 63009 - DNA, 25 bp, Mus musculus
aagggtgaccgactcttctgtgtct

SEQ ID NO: 63010 - DNA, 25 bp, Mus musculus
aagggtgaccgagtcttctgtgtct

SEQ ID NO: 63011 - DNA, 25 bp, Mus musculus
aagggtgaccgtccaggtgtcctcg

SEQ ID NO: 63012 - DNA, 25 bp, Mus musculus
aagggtgaccgtgcaggtgtcctcg

SEQ ID NO: 63013 - DNA, 25 bp, Mus musculus
aagggtgacgtcacatccctgtaac

SEQ ID NO: 63014 - DNA, 25 bp, Mus musculus
aagggtgacgtctcatccctgtaac

SEQ ID NO: 63015 - DNA, 25 bp, Mus musculus
aagggtgactctctctatttcaagg

SEQ ID NO: 63016 - DNA, 25 bp, Mus musculus
aagggtgactctgtctatttcaagg

SEQ ID NO: 63017 - DNA, 25 bp, Mus musculus
aagggtgacttgctgttcactgcca

SEQ ID NO: 63018 - DNA, 25 bp, Mus musculus
aagggtgacttggtgttcactgcca

SEQ ID NO: 63019 - DNA, 25 bp, Mus musculus
aagggtgagcttatgtgatcctctc

SEQ ID NO: 63020 - DNA, 25 bp, Mus musculus
aagggtgagcttcttggtccttcac

SEQ ID NO: 63021 - DNA, 25 bp, Mus musculus
aagggtgagcttgttggtccttcac

SEQ ID NO: 63022 - DNA, 25 bp, Mus musculus
aagggtgagcttttgtgatcctctc

SEQ ID NO: 63023 - DNA, 25 bp, Mus musculus
aagggtgaggatcccccaaatcaga

SEQ ID NO: 63024 - DNA, 25 bp, Mus musculus
aagggtgaggatgccccaaatcaga

SEQ ID NO: 63025 - DNA, 25 bp, Mus musculus
aagggtgatactacaacatttcata

SEQ ID NO: 63026 - DNA, 25 bp, Mus musculus
aagggtgatacttcaacatttcata

SEQ ID NO: 63027 - DNA, 25 bp, Mus musculus
aagggtgatcctattgctggtccat

SEQ ID NO: 63028 - DNA, 25 bp, Mus musculus
aagggtgatccttttgctggtccat

SEQ ID NO: 63029 - DNA, 25 bp, Mus musculus
aagggtgatggtatcatgctgctta

SEQ ID NO: 63030 - DNA, 25 bp, Mus musculus
aagggtgatggtttcatgctgctta

SEQ ID NO: 63031 - DNA, 25 bp, Mus musculus
aagggtgatgtgctcactgcactgt

SEQ ID NO: 63032 - DNA, 25 bp, Mus musculus
aagggtgatgtggtcactgcactgt

SEQ ID NO: 63033 - DNA, 25 bp, Mus musculus
aagggtgcaaagcaccttccttctg

SEQ ID NO: 63034 - DNA, 25 bp, Mus musculus
aagggtgcaaaggaccttccttctg

SEQ ID NO: 63035 - DNA, 25 bp, Mus musculus
aagggtgcaattaagctctttcagc

SEQ ID NO: 63036 - DNA, 25 bp, Mus musculus
aagggtgcaatttagctctttcagc

SEQ ID NO: 63037 - DNA, 25 bp, Mus musculus
aagggtgcacctctaataggacaca

SEQ ID NO: 63038 - DNA, 25 bp, Mus musculus
aagggtgcacctgtaataggacaca

SEQ ID NO: 63039 - DNA, 25 bp, Mus musculus
aagggtgcatagctgttttagccga

SEQ ID NO: 63040 - DNA, 25 bp, Mus musculus
aagggtgcataggtgttttagccga

SEQ ID NO: 63041 - DNA, 25 bp, Mus musculus
aagggtgcatttatgagatatatac

SEQ ID NO: 63042 - DNA, 25 bp, Mus musculus
aagggtgcatttttgagatatatac

SEQ ID NO: 63043 - DNA, 25 bp, Mus musculus
aagggtgcccgtcaagccctcagac

SEQ ID NO: 63044 - DNA, 25 bp, Mus musculus
aagggtgcccgtgaagccctcagac

SEQ ID NO: 63045 - DNA, 25 bp, Mus musculus
aagggtgccggacacatggtcccca

SEQ ID NO: 63046 - DNA, 25 bp, Mus musculus
aagggtgccggagacatggtcccca

SEQ ID NO: 63047 - DNA, 25 bp, Mus musculus
aagggtgcctacaggcgtgagcaac

SEQ ID NO: 63048 - DNA, 25 bp, Mus musculus
aagggtgcctactggcgtgagcaac

SEQ ID NO: 63049 - DNA, 25 bp, Mus musculus
aagggtgcctccatgggaatggcca

SEQ ID NO: 63050 - DNA, 25 bp, Mus musculus
aagggtgcctccttgggaatggcca

SEQ ID NO: 63051 - DNA, 25 bp, Mus musculus
aagggtgccttacaccaaactgcag

SEQ ID NO: 63052 - DNA, 25 bp, Mus musculus
aagggtgccttagaccaaactgcag

SEQ ID NO: 63053 - DNA, 25 bp, Mus musculus
aagggtgcctttaatgctccagact

SEQ ID NO: 63054 - DNA, 25 bp, Mus musculus
aagggtgccttttatgctccagact

SEQ ID NO: 63055 - DNA, 25 bp, Mus musculus
aagggtgctacaagcctgcaatcct

SEQ ID NO: 63056 - DNA, 25 bp, Mus musculus
aagggtgctacatgcctgcaatcct

SEQ ID NO: 63057 - DNA, 25 bp, Mus musculus
aagggtgctacgaactggtttgctc

SEQ ID NO: 63058 - DNA, 25 bp, Mus musculus
aagggtgctacgtactggtttgctc

SEQ ID NO: 63059 - DNA, 25 bp, Mus musculus
aagggtgctattcgccacagcagga

SEQ ID NO: 63060 - DNA, 25 bp, Mus musculus
aagggtgctattggccacagcagga

SEQ ID NO: 63061 - DNA, 25 bp, Mus musculus
aagggtgctcacatcgtccagctgt

SEQ ID NO: 63062 - DNA, 25 bp, Mus musculus
aagggtgctcacttcgtccagctgt

SEQ ID NO: 63063 - DNA, 25 bp, Mus musculus
aagggtgctgagaccagatgccaac

SEQ ID NO: 63064 - DNA, 25 bp, Mus musculus
aagggtgctgagtccagatgccaac

SEQ ID NO: 63065 - DNA, 25 bp, Mus musculus
aagggtggactgcagctccgtggtg

SEQ ID NO: 63066 - DNA, 25 bp, Mus musculus
aagggtggactggagctccgtggtg

SEQ ID NO: 63067 - DNA, 25 bp, Mus musculus
aagggtggatgcatctaagtccgta

SEQ ID NO: 63068 - DNA, 25 bp, Mus musculus
aagggtggatgcttctaagtccgta

SEQ ID NO: 63069 - DNA, 25 bp, Mus musculus
aagggtggcagtcgccagttttctc

SEQ ID NO: 63070 - DNA, 25 bp, Mus musculus
aagggtggcagtggccagttttctc

SEQ ID NO: 63071 - DNA, 25 bp, Mus musculus
aagggtggccacagcttttaactgc

SEQ ID NO: 63072 - DNA, 25 bp, Mus musculus
aagggtggccactgcttttaactgc

SEQ ID NO: 63073 - DNA, 25 bp, Mus musculus
aagggtgggcatcatgcacgtcccc

SEQ ID NO: 63074 - DNA, 25 bp, Mus musculus
aagggtgggcatgatgcacgtcccc

SEQ ID NO: 63075 - DNA, 25 bp, Mus musculus
aagggtggtcctactgccaaagtca

SEQ ID NO: 63076 - DNA, 25 bp, Mus musculus
aagggtggtccttctgccaaagtca

SEQ ID NO: 63077 - DNA, 25 bp, Mus musculus
aagggtggtcgacctgtgccaccca

SEQ ID NO: 63078 - DNA, 25 bp, Mus musculus
aagggtggtcgagctgtgccaccca

SEQ ID NO: 63079 - DNA, 25 bp, Mus musculus
aagggtgtaaccaatccgcaatcct

SEQ ID NO: 63080 - DNA, 25 bp, Mus musculus
aagggtgtaacctatccgcaatcct

SEQ ID NO: 63081 - DNA, 25 bp, Mus musculus
aagggtgtacatagacagcatacca

SEQ ID NO: 63082 - DNA, 25 bp, Mus musculus
aagggtgtacattgacagcatacca

SEQ ID NO: 63083 - DNA, 25 bp, Mus musculus
aagggtgtgaccctcaggcccctgt

SEQ ID NO: 63084 - DNA, 25 bp, Mus musculus
aagggtgtgaccgtcaggcccctgt

SEQ ID NO: 63085 - DNA, 25 bp, Mus musculus
aagggtgtgatccaagctatccaga

SEQ ID NO: 63086 - DNA, 25 bp, Mus musculus
aagggtgtgatcgaagctatccaga

SEQ ID NO: 63087 - DNA, 25 bp, Mus musculus
aagggtgtgcatatgtactacgttg

SEQ ID NO: 63088 - DNA, 25 bp, Mus musculus
aagggtgtgcatttgtactacgttg

SEQ ID NO: 63089 - DNA, 25 bp, Mus musculus
aagggtgtgcttaagttgtacaaca

SEQ ID NO: 63090 - DNA, 25 bp, Mus musculus
aagggtgtgctttagttgtacaaca

SEQ ID NO: 63091 - DNA, 25 bp, Mus musculus
aagggtgtggacaggatcattttat

SEQ ID NO: 63092 - DNA, 25 bp, Mus musculus
aagggtgtggactggatcattttat

SEQ ID NO: 63093 - DNA, 25 bp, Mus musculus
aagggtgtggtgatgcgcacattca

SEQ ID NO: 63094 - DNA, 25 bp, Mus musculus
aagggtgtggtgttgcgcacattca

SEQ ID NO: 63095 - DNA, 25 bp, Mus musculus
aagggtgtgtcacagtactccctga

SEQ ID NO: 63096 - DNA, 25 bp, Mus musculus
aagggtgtgtcagagtactccctga

SEQ ID NO: 63097 - DNA, 25 bp, Mus musculus
aagggtgttagtattggcatcagtc

SEQ ID NO: 63098 - DNA, 25 bp, Mus musculus
aagggtgttagttttggcatcagtc

SEQ ID NO: 63099 - DNA, 25 bp, Mus musculus
aagggtgttctgatccgatatcgcc

SEQ ID NO: 63100 - DNA, 25 bp, Mus musculus
aagggtgttctgttccgatatcgcc

SEQ ID NO: 63101 - DNA, 25 bp, Mus musculus
aagggtgtttatctctactagttag

SEQ ID NO: 63102 - DNA, 25 bp, Mus musculus
aagggtgtttatgtctactagttag

SEQ ID NO: 63103 - DNA, 25 bp, Mus musculus
aagggtgtttctagggctttctgca

SEQ ID NO: 63104 - DNA, 25 bp, Mus musculus
aagggtgtttcttgggctttctgca

SEQ ID NO: 63105 - DNA, 25 bp, Mus musculus
aagggtgttttcagactactcagac

SEQ ID NO: 63106 - DNA, 25 bp, Mus musculus
aagggtgttttctgactactcagac

SEQ ID NO: 63107 - DNA, 25 bp, Mus musculus
aagggttacataaattcagcgcaga

SEQ ID NO: 63108 - DNA, 25 bp, Mus musculus
aagggttacatatattcagcgcaga

SEQ ID NO: 63109 - DNA, 25 bp, Mus musculus
aagggttaccatcacagcttttcca

SEQ ID NO: 63110 - DNA, 25 bp, Mus musculus
aagggttaccatgacagcttttcca

SEQ ID NO: 63111 - DNA, 25 bp, Mus musculus
aagggttatcacattgctcttctaa

SEQ ID NO: 63112 - DNA, 25 bp, Mus musculus
aagggttatcactttgctcttctaa

SEQ ID NO: 63113 - DNA, 25 bp, Mus musculus
aagggttatcctatcggaagctgct

SEQ ID NO: 63114 - DNA, 25 bp, Mus musculus
aagggttatcctttcggaagctgct

SEQ ID NO: 63115 - DNA, 25 bp, Mus musculus
aagggttatgcacgctcttccatat

SEQ ID NO: 63116 - DNA, 25 bp, Mus musculus
aagggttatgcaggctcttccatat

SEQ ID NO: 63117 - DNA, 25 bp, Mus musculus
aagggttcaaccagggctggagaca

SEQ ID NO: 63118 - DNA, 25 bp, Mus musculus
aagggttcaacctgggctggagaca

SEQ ID NO: 63119 - DNA, 25 bp, Mus musculus
aagggttcaaggatatctgaccctg

SEQ ID NO: 63120 - DNA, 25 bp, Mus musculus
aagggttcaaggttatctgaccctg

SEQ ID NO: 63121 - DNA, 25 bp, Mus musculus
aagggttcacgcaggagtcctgcag

SEQ ID NO: 63122 - DNA, 25 bp, Mus musculus
aagggttcacgctggagtcctgcag

SEQ ID NO: 63123 - DNA, 25 bp, Mus musculus
aagggttcagatatgtctccaccct

SEQ ID NO: 63124 - DNA, 25 bp, Mus musculus
aagggttcagatttgtctccaccct

SEQ ID NO: 63125 - DNA, 25 bp, Mus musculus
aagggttccagtccattcttctgac

SEQ ID NO: 63126 - DNA, 25 bp, Mus musculus
aagggttccagtgcattcttctgac

SEQ ID NO: 63127 - DNA, 25 bp, Mus musculus
aagggttccctccatggtgagcacc

SEQ ID NO: 63128 - DNA, 25 bp, Mus musculus
aagggttccctcgatggtgagcacc

SEQ ID NO: 63129 - DNA, 25 bp, Mus musculus
aagggttccctgagagctcttctga

SEQ ID NO: 63130 - DNA, 25 bp, Mus musculus
aagggttccctgtgagctcttctga

SEQ ID NO: 63131 - DNA, 25 bp, Mus musculus
aagggttcccttctgccaagcagtt

SEQ ID NO: 63132 - DNA, 25 bp, Mus musculus
aagggttcccttgtgccaagcagtt

SEQ ID NO: 63133 - DNA, 25 bp, Mus musculus
aagggttcgcccagctcactgtcca

SEQ ID NO: 63134 - DNA, 25 bp, Mus musculus
aagggttcgccctgctcactgtcca

SEQ ID NO: 63135 - DNA, 25 bp, Mus musculus
aagggttcgtcccagcggcagtcct

SEQ ID NO: 63136 - DNA, 25 bp, Mus musculus
aagggttcgtccgagcggcagtcct

SEQ ID NO: 63137 - DNA, 25 bp, Mus musculus
aagggttctcagcacaagcatgcag

SEQ ID NO: 63138 - DNA, 25 bp, Mus musculus
aagggttctcaggacaagcatgcag

SEQ ID NO: 63139 - DNA, 25 bp, Mus musculus
aagggttctggcatgtagagctact

SEQ ID NO: 63140 - DNA, 25 bp, Mus musculus
aagggttctggcttgtagagctact

SEQ ID NO: 63141 - DNA, 25 bp, Mus musculus
aagggttctgtgctccagtactgaa

SEQ ID NO: 63142 - DNA, 25 bp, Mus musculus
aagggttctgtggtccagtactgaa

SEQ ID NO: 63143 - DNA, 25 bp, Mus musculus
aagggttgaaacctgtgcttgcctc

SEQ ID NO: 63144 - DNA, 25 bp, Mus musculus
aagggttgaaacgtgtgcttgcctc

SEQ ID NO: 63145 - DNA, 25 bp, Mus musculus
aagggttgagcgaccacactcacat

SEQ ID NO: 63146 - DNA, 25 bp, Mus musculus
aagggttgagcgtccacactcacat

SEQ ID NO: 63147 - DNA, 25 bp, Mus musculus
aagggttgatttcgaggtgacttca

SEQ ID NO: 63148 - DNA, 25 bp, Mus musculus
aagggttgatttggaggtgacttca

SEQ ID NO: 63149 - DNA, 25 bp, Mus musculus
aagggttgcctactgcattatcaat

SEQ ID NO: 63150 - DNA, 25 bp, Mus musculus
aagggttgcctagtgcattatcaat

SEQ ID NO: 63151 - DNA, 25 bp, Mus musculus
aagggttgggccacacgcagatcct

SEQ ID NO: 63152 - DNA, 25 bp, Mus musculus
aagggttgggcctcacgcagatcct

SEQ ID NO: 63153 - DNA, 25 bp, Mus musculus
aagggttgggtgattctccctcaag

SEQ ID NO: 63154 - DNA, 25 bp, Mus musculus
aagggttgggtgtttctccctcaag

SEQ ID NO: 63155 - DNA, 25 bp, Mus musculus
aagggttgtctgatttgggcagctt

SEQ ID NO: 63156 - DNA, 25 bp, Mus musculus
aagggttgtctgttttgggcagctt

SEQ ID NO: 63157 - DNA, 25 bp, Mus musculus
aagggttgtgctccacgaggccact

SEQ ID NO: 63158 - DNA, 25 bp, Mus musculus
aagggttgtgctgcacgaggccact

SEQ ID NO: 63159 - DNA, 25 bp, Mus musculus
aagggttgtgtgcatcttttgccgc

SEQ ID NO: 63160 - DNA, 25 bp, Mus musculus
aagggttgtgtggatcttttgccgc

SEQ ID NO: 63161 - DNA, 25 bp, Mus musculus
aagggtttaataacatcacagtcta

SEQ ID NO: 63162 - DNA, 25 bp, Mus musculus
aagggtttaatatcatcacagtcta

SEQ ID NO: 63163 - DNA, 25 bp, Mus musculus
aagggtttagttccttcagttcatg

SEQ ID NO: 63164 - DNA, 25 bp, Mus musculus
aagggtttagttgcttcagttcatg

SEQ ID NO: 63165 - DNA, 25 bp, Mus musculus
aagggtttatgcaacttggtcattc

SEQ ID NO: 63166 - DNA, 25 bp, Mus musculus
aagggtttatgctacttggtcattc

SEQ ID NO: 63167 - DNA, 25 bp, Mus musculus
aagggtttcagaatgcagtctgtca

SEQ ID NO: 63168 - DNA, 25 bp, Mus musculus
aagggtttcagattgcagtctgtca

SEQ ID NO: 63169 - DNA, 25 bp, Mus musculus
aagggtttccagcatctgcgcctat

SEQ ID NO: 63170 - DNA, 25 bp, Mus musculus
aagggtttccaggatctgcgcctat

SEQ ID NO: 63171 - DNA, 25 bp, Mus musculus
aagggtttcgaaatccatggttgag

SEQ ID NO: 63172 - DNA, 25 bp, Mus musculus
aagggtttcgaattccatggttgag

SEQ ID NO: 63173 - DNA, 25 bp, Mus musculus
aagggtttcgagaacctgcacttgg

SEQ ID NO: 63174 - DNA, 25 bp, Mus musculus
aagggtttcgagtacctgcacttgg

SEQ ID NO: 63175 - DNA, 25 bp, Mus musculus
aagggtttcgtacccacaggactca

SEQ ID NO: 63176 - DNA, 25 bp, Mus musculus
aagggtttcgtagccacaggactca

SEQ ID NO: 63177 - DNA, 25 bp, Mus musculus
aagggtttctagcttctggtccact

SEQ ID NO: 63178 - DNA, 25 bp, Mus musculus
aagggtttctaggttctggtccact

SEQ ID NO: 63179 - DNA, 25 bp, Mus musculus
aagggtttctctacatgaatcctaa

SEQ ID NO: 63180 - DNA, 25 bp, Mus musculus
aagggtttctcttcatgaatcctaa

SEQ ID NO: 63181 - DNA, 25 bp, Mus musculus
aagggtttcttcacaccacttatct

SEQ ID NO: 63182 - DNA, 25 bp, Mus musculus
aagggtttcttctcaccacttatct

SEQ ID NO: 63183 - DNA, 25 bp, Mus musculus
aagggtttgctgctgacctaatgag

SEQ ID NO: 63184 - DNA, 25 bp, Mus musculus
aagggtttgctggtgacctaatgag

SEQ ID NO: 63185 - DNA, 25 bp, Mus musculus
aagggtttgcttctactgaattctc

SEQ ID NO: 63186 - DNA, 25 bp, Mus musculus
aagggtttgcttgtactgaattctc

SEQ ID NO: 63187 - DNA, 25 bp, Mus musculus
aagggtttggagagattactccgca

SEQ ID NO: 63188 - DNA, 25 bp, Mus musculus
aagggtttggagtgattactccgca

SEQ ID NO: 63189 - DNA, 25 bp, Mus musculus
aagggtttggctacaatgcagagtg

SEQ ID NO: 63190 - DNA, 25 bp, Mus musculus
aagggtttggcttcaatgcagagtg

SEQ ID NO: 63191 - DNA, 25 bp, Mus musculus
aagggtttgttcctgccaagttgtg

SEQ ID NO: 63192 - DNA, 25 bp, Mus musculus
aagggtttgttcgtgccaagttgtg

SEQ ID NO: 63193 - DNA, 25 bp, Mus musculus
aagggttttaacagcatcactccat

SEQ ID NO: 63194 - DNA, 25 bp, Mus musculus
aagggttttaactgcatcactccat

SEQ ID NO: 63195 - DNA, 25 bp, Mus musculus
aagggttttcacacattggcagcaa

SEQ ID NO: 63196 - DNA, 25 bp, Mus musculus
aagggttttcactcattggcagcaa

SEQ ID NO: 63197 - DNA, 25 bp, Mus musculus
aagggttttctaagactgagctagc

SEQ ID NO: 63198 - DNA, 25 bp, Mus musculus
aagggttttctatgactgagctagc

SEQ ID NO: 63199 - DNA, 25 bp, Mus musculus
aagggttttttgcatctctagccaa

SEQ ID NO: 63200 - DNA, 25 bp, Mus musculus
aagggttttttggatctctagccaa

SEQ ID NO: 63201 - DNA, 25 bp, Mus musculus
aaggtaaacaaaccaagcctccctg

SEQ ID NO: 63202 - DNA, 25 bp, Mus musculus
aaggtaaacaaagcaagcctccctg

SEQ ID NO: 63203 - DNA, 25 bp, Mus musculus
aaggtaaatgtcagctctgagaagc

SEQ ID NO: 63204 - DNA, 25 bp, Mus musculus
aaggtaaatgtctgctctgagaagc

SEQ ID NO: 63205 - DNA, 25 bp, Mus musculus
aaggtaaattatccctggctctcag

SEQ ID NO: 63206 - DNA, 25 bp, Mus musculus
aaggtaaattatgcctggctctcag

SEQ ID NO: 63207 - DNA, 25 bp, Mus musculus
aaggtaacacagaggaagctgtctt

SEQ ID NO: 63208 - DNA, 25 bp, Mus musculus
aaggtaacacagtggaagctgtctt

SEQ ID NO: 63209 - DNA, 25 bp, Mus musculus
aaggtaaccaagatcttcaaatgaa

SEQ ID NO: 63210 - DNA, 25 bp, Mus musculus
aaggtaaccaagttcttcaaatgaa

SEQ ID NO: 63211 - DNA, 25 bp, Mus musculus
aaggtaaccgccagatacacaaaat

SEQ ID NO: 63212 - DNA, 25 bp, Mus musculus
aaggtaaccgcctgatacacaaaat

SEQ ID NO: 63213 - DNA, 25 bp, Mus musculus
aaggtaacctatatgctgctctgct

SEQ ID NO: 63214 - DNA, 25 bp, Mus musculus
aaggtaacctatttgctgctctgct

SEQ ID NO: 63215 - DNA, 25 bp, Mus musculus
aaggtaactgagagggatggctaca

SEQ ID NO: 63216 - DNA, 25 bp, Mus musculus
aaggtaactgagtgggatggctaca

SEQ ID NO: 63217 - DNA, 25 bp, Mus musculus
aaggtaactgttcctacctcatgcc

SEQ ID NO: 63218 - DNA, 25 bp, Mus musculus
aaggtaactgttgctacctcatgcc

SEQ ID NO: 63219 - DNA, 25 bp, Mus musculus
aaggtaagagatagtcccgtccagc

SEQ ID NO: 63220 - DNA, 25 bp, Mus musculus
aaggtaagagattgtcccgtccagc

SEQ ID NO: 63221 - DNA, 25 bp, Mus musculus
aaggtaagcgcacagactcactgct

SEQ ID NO: 63222 - DNA, 25 bp, Mus musculus
aaggtaagcgcagagactcactgct

SEQ ID NO: 63223 - DNA, 25 bp, Mus musculus
aaggtaaggctgaagtcatctcact

SEQ ID NO: 63224 - DNA, 25 bp, Mus musculus
aaggtaaggctgtagtcatctcact

SEQ ID NO: 63225 - DNA, 25 bp, Mus musculus
aaggtaaggtgtctcctgtctgacc

SEQ ID NO: 63226 - DNA, 25 bp, Mus musculus
aaggtaaggtgtgtcctgtctgacc

SEQ ID NO: 63227 - DNA, 25 bp, Mus musculus
aaggtaagtgatcgcttctaccctg

SEQ ID NO: 63228 - DNA, 25 bp, Mus musculus
aaggtaagtgatggcttctaccctg

SEQ ID NO: 63229 - DNA, 25 bp, Mus musculus
aaggtaatcacaaagctagctggca

SEQ ID NO: 63230 - DNA, 25 bp, Mus musculus
aaggtaatcacatagctagctggca

SEQ ID NO: 63231 - DNA, 25 bp, Mus musculus
aaggtaatccaaatcatgtcttatt

SEQ ID NO: 63232 - DNA, 25 bp, Mus musculus
aaggtaatccaattcatgtcttatt

SEQ ID NO: 63233 - DNA, 25 bp, Mus musculus
aaggtaatctgaaacttcagccaga

SEQ ID NO: 63234 - DNA, 25 bp, Mus musculus
aaggtaatctgatacttcagccaga

SEQ ID NO: 63235 - DNA, 25 bp, Mus musculus
aaggtaatgtttattcactgggaat

SEQ ID NO: 63236 - DNA, 25 bp, Mus musculus
aaggtaatgttttttcactgggaat

SEQ ID NO: 63237 - DNA, 25 bp, Mus musculus
aaggtaattgcgatgactgttaaat

SEQ ID NO: 63238 - DNA, 25 bp, Mus musculus
aaggtaattgcgttgactgttaaat

SEQ ID NO: 63239 - DNA, 25 bp, Mus musculus
aaggtacaaatcagtcgttctgccc

SEQ ID NO: 63240 - DNA, 25 bp, Mus musculus
aaggtacaaatctgtcgttctgccc

SEQ ID NO: 63241 - DNA, 25 bp, Mus musculus
aaggtacacactactttccctcaag

SEQ ID NO: 63242 - DNA, 25 bp, Mus musculus
aaggtacacacttctttccctcaag

SEQ ID NO: 63243 - DNA, 25 bp, Mus musculus
aaggtacacgggagctttccactct

SEQ ID NO: 63244 - DNA, 25 bp, Mus musculus
aaggtacacgggtgctttccactct

SEQ ID NO: 63245 - DNA, 25 bp, Mus musculus
aaggtacactgcatttgtctgtttt

SEQ ID NO: 63246 - DNA, 25 bp, Mus musculus
aaggtacactgcttttgtctgtttt

SEQ ID NO: 63247 - DNA, 25 bp, Mus musculus
aaggtacagagcatgccagctcacc

SEQ ID NO: 63248 - DNA, 25 bp, Mus musculus
aaggtacagagcttgccagctcacc

SEQ ID NO: 63249 - DNA, 25 bp, Mus musculus
aaggtacagttgaagcctctgtggt

SEQ ID NO: 63250 - DNA, 25 bp, Mus musculus
aaggtacagttgtagcctctgtggt

SEQ ID NO: 63251 - DNA, 25 bp, Mus musculus
aaggtaccactactgaggacccgcg

SEQ ID NO: 63252 - DNA, 25 bp, Mus musculus
aaggtaccactagtgaggacccgcg

SEQ ID NO: 63253 - DNA, 25 bp, Mus musculus
aaggtaccatgcctgtgtcattact

SEQ ID NO: 63254 - DNA, 25 bp, Mus musculus
aaggtaccatgcgtgtgtcattact

SEQ ID NO: 63255 - DNA, 25 bp, Mus musculus
aaggtaccatgtctgctcgctaggc

SEQ ID NO: 63256 - DNA, 25 bp, Mus musculus
aaggtaccatgtgtgctcgctaggc

SEQ ID NO: 63257 - DNA, 25 bp, Mus musculus
aaggtacccctgagtggctttccag

SEQ ID NO: 63258 - DNA, 25 bp, Mus musculus
aaggtacccctgtgtggctttccag

SEQ ID NO: 63259 - DNA, 25 bp, Mus musculus
aaggtaccctttatgaggccaagag

SEQ ID NO: 63260 - DNA, 25 bp, Mus musculus
aaggtaccctttttgaggccaagag

SEQ ID NO: 63261 - DNA, 25 bp, Mus musculus
aaggtacgagtgagtgccctggttt

SEQ ID NO: 63262 - DNA, 25 bp, Mus musculus
aaggtacgagtgtgtgccctggttt

SEQ ID NO: 63263 - DNA, 25 bp, Mus musculus
aaggtacgcactaccttattctgat

SEQ ID NO: 63264 - DNA, 25 bp, Mus musculus
aaggtacgcacttccttattctgat

SEQ ID NO: 63265 - DNA, 25 bp, Mus musculus
aaggtacggcagcatttcagagtga

SEQ ID NO: 63266 - DNA, 25 bp, Mus musculus
aaggtacggcaggatttcagagtga

SEQ ID NO: 63267 - DNA, 25 bp, Mus musculus
aaggtacggctcctgtgcaagcaag

SEQ ID NO: 63268 - DNA, 25 bp, Mus musculus
aaggtacggctcgtgtgcaagcaag

SEQ ID NO: 63269 - DNA, 25 bp, Mus musculus
aaggtactactgaggctaagcccga

SEQ ID NO: 63270 - DNA, 25 bp, Mus musculus
aaggtactactgtggctaagcccga

SEQ ID NO: 63271 - DNA, 25 bp, Mus musculus
aaggtactatctctatctttgtatg

SEQ ID NO: 63272 - DNA, 25 bp, Mus musculus
aaggtactatctgtatctttgtatg

SEQ ID NO: 63273 - DNA, 25 bp, Mus musculus
aaggtactatgacgtctcctgccca

SEQ ID NO: 63274 - DNA, 25 bp, Mus musculus
aaggtactatgaggtctcctgccca

SEQ ID NO: 63275 - DNA, 25 bp, Mus musculus
aaggtactccgcctgacggtgcaca

SEQ ID NO: 63276 - DNA, 25 bp, Mus musculus
aaggtactccgcgtgacggtgcaca

SEQ ID NO: 63277 - DNA, 25 bp, Mus musculus
aaggtactctcacacggctcatgtg

SEQ ID NO: 63278 - DNA, 25 bp, Mus musculus
aaggtactctcagacggctcatgtg

SEQ ID NO: 63279 - DNA, 25 bp, Mus musculus
aaggtactgaacatggctgcttctg

SEQ ID NO: 63280 - DNA, 25 bp, Mus musculus
aaggtactgaacttggctgcttctg

SEQ ID NO: 63281 - DNA, 25 bp, Mus musculus
aaggtactgaatccaccagccacgt

SEQ ID NO: 63282 - DNA, 25 bp, Mus musculus
aaggtactgaatgcaccagccacgt

SEQ ID NO: 63283 - DNA, 25 bp, Mus musculus
aaggtactgagtcacaagtccccga

SEQ ID NO: 63284 - DNA, 25 bp, Mus musculus
aaggtactgagtgacaagtccccga

SEQ ID NO: 63285 - DNA, 25 bp, Mus musculus
aaggtactgggcagctctttggtga

SEQ ID NO: 63286 - DNA, 25 bp, Mus musculus
aaggtactgggctgctctttggtga

SEQ ID NO: 63287 - DNA, 25 bp, Mus musculus
aaggtactggtccaatatggctgaa

SEQ ID NO: 63288 - DNA, 25 bp, Mus musculus
aaggtactggtcgaatatggctgaa

SEQ ID NO: 63289 - DNA, 25 bp, Mus musculus
aaggtactgttcacttgtccgtgga

SEQ ID NO: 63290 - DNA, 25 bp, Mus musculus
aaggtactgttctcttgtccgtgga

SEQ ID NO: 63291 - DNA, 25 bp, Mus musculus
aaggtacttagcacgcaagctcatt

SEQ ID NO: 63292 - DNA, 25 bp, Mus musculus
aaggtacttagctcgcaagctcatt

SEQ ID NO: 63293 - DNA, 25 bp, Mus musculus
aaggtacttggcctgattccagctg

SEQ ID NO: 63294 - DNA, 25 bp, Mus musculus
aaggtacttggcgtgattccagctg

SEQ ID NO: 63295 - DNA, 25 bp, Mus musculus
aaggtactttccacgaagctgttgg

SEQ ID NO: 63296 - DNA, 25 bp, Mus musculus
aaggtactttcctcgaagctgttgg

SEQ ID NO: 63297 - DNA, 25 bp, Mus musculus
aaggtagaacagctttttggagaag

SEQ ID NO: 63298 - DNA, 25 bp, Mus musculus
aaggtagaacaggtttttggagaag

SEQ ID NO: 63299 - DNA, 25 bp, Mus musculus
aaggtagaagcccttccttccagag

SEQ ID NO: 63300 - DNA, 25 bp, Mus musculus
aaggtagaagccgttccttccagag

SEQ ID NO: 63301 - DNA, 25 bp, Mus musculus
aaggtagactctcacctccatggga

SEQ ID NO: 63302 - DNA, 25 bp, Mus musculus
aaggtagactctgacctccatggga

SEQ ID NO: 63303 - DNA, 25 bp, Mus musculus
aaggtagaggttatataggcaggaa

SEQ ID NO: 63304 - DNA, 25 bp, Mus musculus
aaggtagaggttttataggcaggaa

SEQ ID NO: 63305 - DNA, 25 bp, Mus musculus
aaggtagatgctctctctcaacatc

SEQ ID NO: 63306 - DNA, 25 bp, Mus musculus
aaggtagatgctgtctctcaacatc

SEQ ID NO: 63307 - DNA, 25 bp, Mus musculus
aaggtagcaatgctgttcctctgcc

SEQ ID NO: 63308 - DNA, 25 bp, Mus musculus
aaggtagcaatggtgttcctctgcc

SEQ ID NO: 63309 - DNA, 25 bp, Mus musculus
aaggtagcacacacacgcctggaga

SEQ ID NO: 63310 - DNA, 25 bp, Mus musculus
aaggtagcacactcacgcctggaga

SEQ ID NO: 63311 - DNA, 25 bp, Mus musculus
aaggtagcacctacattgggagccc

SEQ ID NO: 63312 - DNA, 25 bp, Mus musculus
aaggtagcacctctgtactaggcac

SEQ ID NO: 63313 - DNA, 25 bp, Mus musculus
aaggtagcacctgtgtactaggcac

SEQ ID NO: 63314 - DNA, 25 bp, Mus musculus
aaggtagcaccttcattgggagccc

SEQ ID NO: 63315 - DNA, 25 bp, Mus musculus
aaggtagcaggtcgcgtcttctccc

SEQ ID NO: 63316 - DNA, 25 bp, Mus musculus
aaggtagcaggtggcgtcttctccc

SEQ ID NO: 63317 - DNA, 25 bp, Mus musculus
aaggtagccaagacttcacttcaaa

SEQ ID NO: 63318 - DNA, 25 bp, Mus musculus
aaggtagccaagtcttcacttcaaa

SEQ ID NO: 63319 - DNA, 25 bp, Mus musculus
aaggtagccctgcactaagcttgct

SEQ ID NO: 63320 - DNA, 25 bp, Mus musculus
aaggtagccctggactaagcttgct

SEQ ID NO: 63321 - DNA, 25 bp, Mus musculus
aaggtagcctgtctcggtaagccca

SEQ ID NO: 63322 - DNA, 25 bp, Mus musculus
aaggtagcctgtcttagggccctgc

SEQ ID NO: 63323 - DNA, 25 bp, Mus musculus
aaggtagcctgtgtcggtaagccca

SEQ ID NO: 63324 - DNA, 25 bp, Mus musculus
aaggtagcctgtgttagggccctgc

SEQ ID NO: 63325 - DNA, 25 bp, Mus musculus
aaggtagcggtcaactctgacagga

SEQ ID NO: 63326 - DNA, 25 bp, Mus musculus
aaggtagcggtctactctgacagga

SEQ ID NO: 63327 - DNA, 25 bp, Mus musculus
aaggtagctatacggtgctggcacc

SEQ ID NO: 63328 - DNA, 25 bp, Mus musculus
aaggtagctatagggtgctggcacc

SEQ ID NO: 63329 - DNA, 25 bp, Mus musculus
aaggtagctgtcagttgctaggcag

SEQ ID NO: 63330 - DNA, 25 bp, Mus musculus
aaggtagctgtctgttgctaggcag

SEQ ID NO: 63331 - DNA, 25 bp, Mus musculus
aaggtagcttctaggcttgtggcaa

SEQ ID NO: 63332 - DNA, 25 bp, Mus musculus
aaggtagcttcttggcttgtggcaa

SEQ ID NO: 63333 - DNA, 25 bp, Mus musculus
aaggtaggagtcactgcatgcgctt

SEQ ID NO: 63334 - DNA, 25 bp, Mus musculus
aaggtaggagtctctgcatgcgctt

SEQ ID NO: 63335 - DNA, 25 bp, Mus musculus
aaggtaggatgacaccgggctctct

SEQ ID NO: 63336 - DNA, 25 bp, Mus musculus
aaggtaggatgagaccgggctctct

SEQ ID NO: 63337 - DNA, 25 bp, Mus musculus
aaggtaggcaagactggttccctct

SEQ ID NO: 63338 - DNA, 25 bp, Mus musculus
aaggtaggcaagtctggttccctct

SEQ ID NO: 63339 - DNA, 25 bp, Mus musculus
aaggtaggcttcacggtctgggact

SEQ ID NO: 63340 - DNA, 25 bp, Mus musculus
aaggtaggcttctcggtctgggact

SEQ ID NO: 63341 - DNA, 25 bp, Mus musculus
aaggtagggcacaccggctgctgca

SEQ ID NO: 63342 - DNA, 25 bp, Mus musculus
aaggtagggcactccggctgctgca

SEQ ID NO: 63343 - DNA, 25 bp, Mus musculus
aaggtaggtgtaagccatctcccca

SEQ ID NO: 63344 - DNA, 25 bp, Mus musculus
aaggtaggtgtatgccatctcccca

SEQ ID NO: 63345 - DNA, 25 bp, Mus musculus
aaggtaggtgtcacagcttgggcat

SEQ ID NO: 63346 - DNA, 25 bp, Mus musculus
aaggtaggtgtctcagcttgggcat

SEQ ID NO: 63347 - DNA, 25 bp, Mus musculus
aaggtagtacctcaaggcttctcgc

SEQ ID NO: 63348 - DNA, 25 bp, Mus musculus
aaggtagtacctgaaggcttctcgc

SEQ ID NO: 63349 - DNA, 25 bp, Mus musculus
aaggtagtagttagctcatgttcca

SEQ ID NO: 63350 - DNA, 25 bp, Mus musculus
aaggtagtagtttgctcatgttcca

SEQ ID NO: 63351 - DNA, 25 bp, Mus musculus
aaggtagtcatcatcatcctctagg

SEQ ID NO: 63352 - DNA, 25 bp, Mus musculus
aaggtagtcatcttcatcctctagg

SEQ ID NO: 63353 - DNA, 25 bp, Mus musculus
aaggtagtgaacagactccggcgct

SEQ ID NO: 63354 - DNA, 25 bp, Mus musculus
aaggtagtgaactgactccggcgct

SEQ ID NO: 63355 - DNA, 25 bp, Mus musculus
aaggtagtgactcaggccaggccat

SEQ ID NO: 63356 - DNA, 25 bp, Mus musculus
aaggtagtgactgaggccaggccat

SEQ ID NO: 63357 - DNA, 25 bp, Mus musculus
aaggtagtggacactcggatgaaga

SEQ ID NO: 63358 - DNA, 25 bp, Mus musculus
aaggtagtggactctcggatgaaga

SEQ ID NO: 63359 - DNA, 25 bp, Mus musculus
aaggtagtggccatcagtccggtca

SEQ ID NO: 63360 - DNA, 25 bp, Mus musculus
aaggtagtggccttcagtccggtca

SEQ ID NO: 63361 - DNA, 25 bp, Mus musculus
aaggtagttcataccaaaagccaga

SEQ ID NO: 63362 - DNA, 25 bp, Mus musculus
aaggtagttcattccaaaagccaga

SEQ ID NO: 63363 - DNA, 25 bp, Mus musculus
aaggtataagaaaaggactgtgcca

SEQ ID NO: 63364 - DNA, 25 bp, Mus musculus
aaggtataagaataggactgtgcca

SEQ ID NO: 63365 - DNA, 25 bp, Mus musculus
aaggtataccatcttttccatcagc

SEQ ID NO: 63366 - DNA, 25 bp, Mus musculus
aaggtataccatgttttccatcagc

SEQ ID NO: 63367 - DNA, 25 bp, Mus musculus
aaggtatacctcagttccacggttg

SEQ ID NO: 63368 - DNA, 25 bp, Mus musculus
aaggtatacctctgttccacggttg

SEQ ID NO: 63369 - DNA, 25 bp, Mus musculus
aaggtatagatcatctcatgtctgg

SEQ ID NO: 63370 - DNA, 25 bp, Mus musculus
aaggtatagatcttctcatgtctgg

SEQ ID NO: 63371 - DNA, 25 bp, Mus musculus
aaggtatatttgcttctcgggaaag

SEQ ID NO: 63372 - DNA, 25 bp, Mus musculus
aaggtatatttggttctcgggaaag

SEQ ID NO: 63373 - DNA, 25 bp, Mus musculus
aaggtatcactgaaagcctgcccac

SEQ ID NO: 63374 - DNA, 25 bp, Mus musculus
aaggtatcactgtaagcctgcccac

SEQ ID NO: 63375 - DNA, 25 bp, Mus musculus
aaggtatcacttcatggcgcaacaa

SEQ ID NO: 63376 - DNA, 25 bp, Mus musculus
aaggtatcacttgatggcgcaacaa

SEQ ID NO: 63377 - DNA, 25 bp, Mus musculus
aaggtatcatgcagccccttggcaa

SEQ ID NO: 63378 - DNA, 25 bp, Mus musculus
aaggtatcatgctgccccttggcaa

SEQ ID NO: 63379 - DNA, 25 bp, Mus musculus
aaggtatccagtcgatttctctctc

SEQ ID NO: 63380 - DNA, 25 bp, Mus musculus
aaggtatccagtggatttctctctc

SEQ ID NO: 63381 - DNA, 25 bp, Mus musculus
aaggtatctgtgctctatcctagaa

SEQ ID NO: 63382 - DNA, 25 bp, Mus musculus
aaggtatctgtggtctatcctagaa

SEQ ID NO: 63383 - DNA, 25 bp, Mus musculus
aaggtatcttaacccttcttctggg

SEQ ID NO: 63384 - DNA, 25 bp, Mus musculus
aaggtatcttaagccttcttctggg

SEQ ID NO: 63385 - DNA, 25 bp, Mus musculus
aaggtatgctctaccacacctggct

SEQ ID NO: 63386 - DNA, 25 bp, Mus musculus
aaggtatgctcttccacacctggct

SEQ ID NO: 63387 - DNA, 25 bp, Mus musculus
aaggtatggattacctcttctccca

SEQ ID NO: 63388 - DNA, 25 bp, Mus musculus
aaggtatggatttcctcttctccca

SEQ ID NO: 63389 - DNA, 25 bp, Mus musculus
aaggtatgttcaccacaggcttcta

SEQ ID NO: 63390 - DNA, 25 bp, Mus musculus
aaggtatgttcagcacaggcttcta

SEQ ID NO: 63391 - DNA, 25 bp, Mus musculus
aaggtattatctagcaacttgttaa

SEQ ID NO: 63392 - DNA, 25 bp, Mus musculus
aaggtattatcttgcaacttgttaa

SEQ ID NO: 63393 - DNA, 25 bp, Mus musculus
aaggtattcatccatgccggaagct

SEQ ID NO: 63394 - DNA, 25 bp, Mus musculus
aaggtattcatcgatgccggaagct

SEQ ID NO: 63395 - DNA, 25 bp, Mus musculus
aaggtattccagcagtctacacgaa

SEQ ID NO: 63396 - DNA, 25 bp, Mus musculus
aaggtattccaggagtctacacgaa

SEQ ID NO: 63397 - DNA, 25 bp, Mus musculus
aaggtattccatctactcactatta

SEQ ID NO: 63398 - DNA, 25 bp, Mus musculus
aaggtattccatgtactcactatta

SEQ ID NO: 63399 - DNA, 25 bp, Mus musculus
aaggtattcttgcatgccggacata

SEQ ID NO: 63400 - DNA, 25 bp, Mus musculus
aaggtattcttggatgccggacata

SEQ ID NO: 63401 - DNA, 25 bp, Mus musculus
aaggtattgtccagggctttctcac

SEQ ID NO: 63402 - DNA, 25 bp, Mus musculus
aaggtattgtcctgggctttctcac

SEQ ID NO: 63403 - DNA, 25 bp, Mus musculus
aaggtatttatgatggtcccaggag

SEQ ID NO: 63404 - DNA, 25 bp, Mus musculus
aaggtatttatgttggtcccaggag

SEQ ID NO: 63405 - DNA, 25 bp, Mus musculus
aaggtatttttcctcatctctagaa

SEQ ID NO: 63406 - DNA, 25 bp, Mus musculus
aaggtatttttcgtcatctctagaa

SEQ ID NO: 63407 - DNA, 25 bp, Mus musculus
aaggtcaaaatgagtattgccctaa

SEQ ID NO: 63408 - DNA, 25 bp, Mus musculus
aaggtcaaaatgtgtattgccctaa

SEQ ID NO: 63409 - DNA, 25 bp, Mus musculus
aaggtcaaacgcagtgggagcaggc

SEQ ID NO: 63410 - DNA, 25 bp, Mus musculus
aaggtcaaacgctgtgggagcaggc

SEQ ID NO: 63411 - DNA, 25 bp, Mus musculus
aaggtcaaatacacttacggcagaa

SEQ ID NO: 63412 - DNA, 25 bp, Mus musculus
aaggtcaaatactcttacggcagaa

SEQ ID NO: 63413 - DNA, 25 bp, Mus musculus
aaggtcaacacaacatagcacagag

SEQ ID NO: 63414 - DNA, 25 bp, Mus musculus
aaggtcaacacatcatagcacagag

SEQ ID NO: 63415 - DNA, 25 bp, Mus musculus
aaggtcaacattcggcatcttcctc

SEQ ID NO: 63416 - DNA, 25 bp, Mus musculus
aaggtcaacattgggcatcttcctc

SEQ ID NO: 63417 - DNA, 25 bp, Mus musculus
aaggtcaaccttcagtacacagcaa

SEQ ID NO: 63418 - DNA, 25 bp, Mus musculus
aaggtcaaccttgagtacacagcaa

SEQ ID NO: 63419 - DNA, 25 bp, Mus musculus
aaggtcaactgcaagggtcaactcc

SEQ ID NO: 63420 - DNA, 25 bp, Mus musculus
aaggtcaactgctagggtcaactcc

SEQ ID NO: 63421 - DNA, 25 bp, Mus musculus
aaggtcaacttgaaagttcttacat

SEQ ID NO: 63422 - DNA, 25 bp, Mus musculus
aaggtcaacttgtaagttcttacat

SEQ ID NO: 63423 - DNA, 25 bp, Mus musculus
aaggtcaagcgaaacttctggatgc

SEQ ID NO: 63424 - DNA, 25 bp, Mus musculus
aaggtcaagcgatacttctggatgc

SEQ ID NO: 63425 - DNA, 25 bp, Mus musculus
aaggtcaagctgcacgtcagacgtc

SEQ ID NO: 63426 - DNA, 25 bp, Mus musculus
aaggtcaagctggacgtcagacgtc

SEQ ID NO: 63427 - DNA, 25 bp, Mus musculus
aaggtcaagtccatggtgcctggcc

SEQ ID NO: 63428 - DNA, 25 bp, Mus musculus
aaggtcaagtccttggtgcctggcc

SEQ ID NO: 63429 - DNA, 25 bp, Mus musculus
aaggtcaatgatcaaaatggcacat

SEQ ID NO: 63430 - DNA, 25 bp, Mus musculus
aaggtcaatgatgaaaatggcacat

SEQ ID NO: 63431 - DNA, 25 bp, Mus musculus
aaggtcaatttgaagaagggattat

SEQ ID NO: 63432 - DNA, 25 bp, Mus musculus
aaggtcaatttgtagaagggattat

SEQ ID NO: 63433 - DNA, 25 bp, Mus musculus
aaggtcacaaacaagcagcggcggg

SEQ ID NO: 63434 - DNA, 25 bp, Mus musculus
aaggtcacaaactagcagcggcggg

SEQ ID NO: 63435 - DNA, 25 bp, Mus musculus
aaggtcacaccgaggatgcgtccga

SEQ ID NO: 63436 - DNA, 25 bp, Mus musculus
aaggtcacaccgtggatgcgtccga

SEQ ID NO: 63437 - DNA, 25 bp, Mus musculus
aaggtcaccaagaccgcacagaagg

SEQ ID NO: 63438 - DNA, 25 bp, Mus musculus
aaggtcaccaagtccgcacagaagg

SEQ ID NO: 63439 - DNA, 25 bp, Mus musculus
aaggtcaccagtacttttttctgat

SEQ ID NO: 63440 - DNA, 25 bp, Mus musculus
aaggtcaccagttcttttttctgat

SEQ ID NO: 63441 - DNA, 25 bp, Mus musculus
aaggtcaccattcactgcagctgga

SEQ ID NO: 63442 - DNA, 25 bp, Mus musculus
aaggtcaccattgactgcagctgga

SEQ ID NO: 63443 - DNA, 25 bp, Mus musculus
aaggtcacctgactggagcactgcc

SEQ ID NO: 63444 - DNA, 25 bp, Mus musculus
aaggtcacctgagtggagcactgcc

SEQ ID NO: 63445 - DNA, 25 bp, Mus musculus
aaggtcacctgtccccacaaagtgg

SEQ ID NO: 63446 - DNA, 25 bp, Mus musculus
aaggtcacctgtgcccacaaagtgg

SEQ ID NO: 63447 - DNA, 25 bp, Mus musculus
aaggtcacgcggatttcacttgtca

SEQ ID NO: 63448 - DNA, 25 bp, Mus musculus
aaggtcacgcggttttcacttgtca

SEQ ID NO: 63449 - DNA, 25 bp, Mus musculus
aaggtcacggaaacttttgctcttc

SEQ ID NO: 63450 - DNA, 25 bp, Mus musculus
aaggtcacggaatcttttgctcttc

SEQ ID NO: 63451 - DNA, 25 bp, Mus musculus
aaggtcacggacattgtgtgaacaa

SEQ ID NO: 63452 - DNA, 25 bp, Mus musculus
aaggtcacggactttgtgtgaacaa

SEQ ID NO: 63453 - DNA, 25 bp, Mus musculus
aaggtcacgtcactaaaggtacaag

SEQ ID NO: 63454 - DNA, 25 bp, Mus musculus
aaggtcacgtcagtaaaggtacaag

SEQ ID NO: 63455 - DNA, 25 bp, Mus musculus
aaggtcactacgatcacgctggcaa

SEQ ID NO: 63456 - DNA, 25 bp, Mus musculus
aaggtcactacgttcacgctggcaa

SEQ ID NO: 63457 - DNA, 25 bp, Mus musculus
aaggtcactgtcactgtggcgggac

SEQ ID NO: 63458 - DNA, 25 bp, Mus musculus
aaggtcactgtctctgtggcgggac

SEQ ID NO: 63459 - DNA, 25 bp, Mus musculus
aaggtcagaatccactgttgtcaat

SEQ ID NO: 63460 - DNA, 25 bp, Mus musculus
aaggtcagaatcgactgttgtcaat

SEQ ID NO: 63461 - DNA, 25 bp, Mus musculus
aaggtcagacacattctgtgtgaaa

SEQ ID NO: 63462 - DNA, 25 bp, Mus musculus
aaggtcagacactttctgtgtgaaa

SEQ ID NO: 63463 - DNA, 25 bp, Mus musculus
aaggtcagacagagccacttggcca

SEQ ID NO: 63464 - DNA, 25 bp, Mus musculus
aaggtcagacagaggcttcctagga

SEQ ID NO: 63465 - DNA, 25 bp, Mus musculus
aaggtcagacagtgccacttggcca

SEQ ID NO: 63466 - DNA, 25 bp, Mus musculus
aaggtcagacagtggcttcctagga

SEQ ID NO: 63467 - DNA, 25 bp, Mus musculus
aaggtcagactcataccctggctgt

SEQ ID NO: 63468 - DNA, 25 bp, Mus musculus
aaggtcagactccttggaccagggc

SEQ ID NO: 63469 - DNA, 25 bp, Mus musculus
aaggtcagactcgttggaccagggc

SEQ ID NO: 63470 - DNA, 25 bp, Mus musculus
aaggtcagactcttaccctggctgt

SEQ ID NO: 63471 - DNA, 25 bp, Mus musculus
aaggtcagagctatctacacccaga

SEQ ID NO: 63472 - DNA, 25 bp, Mus musculus
aaggtcagagctttctacacccaga

SEQ ID NO: 63473 - DNA, 25 bp, Mus musculus
aaggtcagagtaccagtctccagtc

SEQ ID NO: 63474 - DNA, 25 bp, Mus musculus
aaggtcagagtagcagtctccagtc

SEQ ID NO: 63475 - DNA, 25 bp, Mus musculus
aaggtcagcagccacctcaacgtcg

SEQ ID NO: 63476 - DNA, 25 bp, Mus musculus
aaggtcagcagcgacctcaacgtcg

SEQ ID NO: 63477 - DNA, 25 bp, Mus musculus
aaggtcagcatcagtcgtttcacgg

SEQ ID NO: 63478 - DNA, 25 bp, Mus musculus
aaggtcagcatctgtcgtttcacgg

SEQ ID NO: 63479 - DNA, 25 bp, Mus musculus
aaggtcagccagaaaccactcagga

SEQ ID NO: 63480 - DNA, 25 bp, Mus musculus
aaggtcagccagacactgcactcaa

SEQ ID NO: 63481 - DNA, 25 bp, Mus musculus
aaggtcagccagtaaccactcagga

SEQ ID NO: 63482 - DNA, 25 bp, Mus musculus
aaggtcagccagtcactgcactcaa

SEQ ID NO: 63483 - DNA, 25 bp, Mus musculus
aaggtcagccgactatggtagtgca

SEQ ID NO: 63484 - DNA, 25 bp, Mus musculus
aaggtcagccgagtatggtagtgca

SEQ ID NO: 63485 - DNA, 25 bp, Mus musculus
aaggtcagccttagcgatggagaga

SEQ ID NO: 63486 - DNA, 25 bp, Mus musculus
aaggtcagcctttgcgatggagaga

SEQ ID NO: 63487 - DNA, 25 bp, Mus musculus
aaggtcagctgactctggcaacaca

SEQ ID NO: 63488 - DNA, 25 bp, Mus musculus
aaggtcagctgagtctggcaacaca

SEQ ID NO: 63489 - DNA, 25 bp, Mus musculus
aaggtcaggaggctcctcatgctct

SEQ ID NO: 63490 - DNA, 25 bp, Mus musculus
aaggtcaggagggtcctcatgctct

SEQ ID NO: 63491 - DNA, 25 bp, Mus musculus
aaggtcaggcccaacattgcagagg

SEQ ID NO: 63492 - DNA, 25 bp, Mus musculus
aaggtcaggccctacattgcagagg

SEQ ID NO: 63493 - DNA, 25 bp, Mus musculus
aaggtcaggcctaacaaccaggctc

SEQ ID NO: 63494 - DNA, 25 bp, Mus musculus
aaggtcaggccttacaaccaggctc

SEQ ID NO: 63495 - DNA, 25 bp, Mus musculus
aaggtcaggctacattggctctcct

SEQ ID NO: 63496 - DNA, 25 bp, Mus musculus
aaggtcaggctactctgggttacaa

SEQ ID NO: 63497 - DNA, 25 bp, Mus musculus
aaggtcaggctagattggctctcct

SEQ ID NO: 63498 - DNA, 25 bp, Mus musculus
aaggtcaggctagtctgggttacaa

SEQ ID NO: 63499 - DNA, 25 bp, Mus musculus
aaggtcaggctgacttgcatgtccc

SEQ ID NO: 63500 - DNA, 25 bp, Mus musculus
aaggtcaggctgtcttgcatgtccc

SEQ ID NO: 63501 - DNA, 25 bp, Mus musculus
aaggtcagggatacaggcatcgaga

SEQ ID NO: 63502 - DNA, 25 bp, Mus musculus
aaggtcagggattcaggcatcgaga

SEQ ID NO: 63503 - DNA, 25 bp, Mus musculus
aaggtcaggttcaatgggcagcaaa

SEQ ID NO: 63504 - DNA, 25 bp, Mus musculus
aaggtcaggttcagacgtgtcttcc

SEQ ID NO: 63505 - DNA, 25 bp, Mus musculus
aaggtcaggttctatgggcagcaaa

SEQ ID NO: 63506 - DNA, 25 bp, Mus musculus
aaggtcaggttctgacgtgtcttcc

SEQ ID NO: 63507 - DNA, 25 bp, Mus musculus
aaggtcagtgaacaccttatggtgt

SEQ ID NO: 63508 - DNA, 25 bp, Mus musculus
aaggtcagtgaagaccttatggtgt

SEQ ID NO: 63509 - DNA, 25 bp, Mus musculus
aaggtcagttggctggttcccctct

SEQ ID NO: 63510 - DNA, 25 bp, Mus musculus
aaggtcagttgggtggttcccctct

SEQ ID NO: 63511 - DNA, 25 bp, Mus musculus
aaggtcataagaatggaatggccaa

SEQ ID NO: 63512 - DNA, 25 bp, Mus musculus
aaggtcataagattggaatggccaa

SEQ ID NO: 63513 - DNA, 25 bp, Mus musculus
aaggtcatatcaagcctgctctaca

SEQ ID NO: 63514 - DNA, 25 bp, Mus musculus
aaggtcatatcatgcctgctctaca

SEQ ID NO: 63515 - DNA, 25 bp, Mus musculus
aaggtcatcaatcactgccccactt

SEQ ID NO: 63516 - DNA, 25 bp, Mus musculus
aaggtcatcaatgactgccccactt

SEQ ID NO: 63517 - DNA, 25 bp, Mus musculus
aaggtcatcatacaaaggcattttc

SEQ ID NO: 63518 - DNA, 25 bp, Mus musculus
aaggtcatcataccgttcaattaaa

SEQ ID NO: 63519 - DNA, 25 bp, Mus musculus
aaggtcatcatagaaaggcattttc

SEQ ID NO: 63520 - DNA, 25 bp, Mus musculus
aaggtcatcatagcgttcaattaaa

SEQ ID NO: 63521 - DNA, 25 bp, Mus musculus
aaggtcatcatgagctctctgtaag

SEQ ID NO: 63522 - DNA, 25 bp, Mus musculus
aaggtcatcatgtgctctctgtaag

SEQ ID NO: 63523 - DNA, 25 bp, Mus musculus
aaggtcatccccagctgtatactga

SEQ ID NO: 63524 - DNA, 25 bp, Mus musculus
aaggtcatcccctgctgtatactga

SEQ ID NO: 63525 - DNA, 25 bp, Mus musculus
aaggtcatccgtccctggcttcaaa

SEQ ID NO: 63526 - DNA, 25 bp, Mus musculus
aaggtcatccgtgcctggcttcaaa

SEQ ID NO: 63527 - DNA, 25 bp, Mus musculus
aaggtcatcctgaaactgggtggtc

SEQ ID NO: 63528 - DNA, 25 bp, Mus musculus
aaggtcatcctgtaactgggtggtc

SEQ ID NO: 63529 - DNA, 25 bp, Mus musculus
aaggtcatccttcgcccactagtga

SEQ ID NO: 63530 - DNA, 25 bp, Mus musculus
aaggtcatccttggcccactagtga

SEQ ID NO: 63531 - DNA, 25 bp, Mus musculus
aaggtcatcggacccaaggtggtca

SEQ ID NO: 63532 - DNA, 25 bp, Mus musculus
aaggtcatcggagccaaggtggtca

SEQ ID NO: 63533 - DNA, 25 bp, Mus musculus
aaggtcatcttcaaagggctactgc

SEQ ID NO: 63534 - DNA, 25 bp, Mus musculus
aaggtcatcttcagtgctagggaga

SEQ ID NO: 63535 - DNA, 25 bp, Mus musculus
aaggtcatcttctaagggctactgc

SEQ ID NO: 63536 - DNA, 25 bp, Mus musculus
aaggtcatcttctgtgctagggaga

SEQ ID NO: 63537 - DNA, 25 bp, Mus musculus
aaggtcatgacccatgtcagcaacg

SEQ ID NO: 63538 - DNA, 25 bp, Mus musculus
aaggtcatgaccctaatctggtacg

SEQ ID NO: 63539 - DNA, 25 bp, Mus musculus
aaggtcatgaccgatgtcagcaacg

SEQ ID NO: 63540 - DNA, 25 bp, Mus musculus
aaggtcatgaccgtaatctggtacg

SEQ ID NO: 63541 - DNA, 25 bp, Mus musculus
aaggtcatgccactgagcttcttgt

SEQ ID NO: 63542 - DNA, 25 bp, Mus musculus
aaggtcatgccagtgagcttcttgt

SEQ ID NO: 63543 - DNA, 25 bp, Mus musculus
aaggtcatgctcacttatccaggag

SEQ ID NO: 63544 - DNA, 25 bp, Mus musculus
aaggtcatgctctcttatccaggag

SEQ ID NO: 63545 - DNA, 25 bp, Mus musculus
aaggtcatggcacgcccattgaact

SEQ ID NO: 63546 - DNA, 25 bp, Mus musculus
aaggtcatggcaggcccattgaact

SEQ ID NO: 63547 - DNA, 25 bp, Mus musculus
aaggtcattccaaagtactgtcagt

SEQ ID NO: 63548 - DNA, 25 bp, Mus musculus
aaggtcattccatagtactgtcagt

SEQ ID NO: 63549 - DNA, 25 bp, Mus musculus
aaggtccaacccagatgatctacct

SEQ ID NO: 63550 - DNA, 25 bp, Mus musculus
aaggtccaaccctgatgatctacct

SEQ ID NO: 63551 - DNA, 25 bp, Mus musculus
aaggtccaagaacctgtctccacgg

SEQ ID NO: 63552 - DNA, 25 bp, Mus musculus
aaggtccaagaagctgtctccacgg

SEQ ID NO: 63553 - DNA, 25 bp, Mus musculus
aaggtccaagatatccattgtgcca

SEQ ID NO: 63554 - DNA, 25 bp, Mus musculus
aaggtccaagatttccattgtgcca

SEQ ID NO: 63555 - DNA, 25 bp, Mus musculus
aaggtccaaggactgtctcactgtc

SEQ ID NO: 63556 - DNA, 25 bp, Mus musculus
aaggtccaaggagtgtctcactgtc

SEQ ID NO: 63557 - DNA, 25 bp, Mus musculus
aaggtccaaggccatccagagaatc

SEQ ID NO: 63558 - DNA, 25 bp, Mus musculus
aaggtccaaggccatttccagcagc

SEQ ID NO: 63559 - DNA, 25 bp, Mus musculus
aaggtccaaggcgatccagagaatc

SEQ ID NO: 63560 - DNA, 25 bp, Mus musculus
aaggtccaaggcgatttccagcagc

SEQ ID NO: 63561 - DNA, 25 bp, Mus musculus
aaggtccacagacttgctgcagctg

SEQ ID NO: 63562 - DNA, 25 bp, Mus musculus
aaggtccacagagttgctgcagctg

SEQ ID NO: 63563 - DNA, 25 bp, Mus musculus
aaggtccacatcatcttccaggatg

SEQ ID NO: 63564 - DNA, 25 bp, Mus musculus
aaggtccacatcttcttccaggatg

SEQ ID NO: 63565 - DNA, 25 bp, Mus musculus
aaggtccacgtcagtcagcagagta

SEQ ID NO: 63566 - DNA, 25 bp, Mus musculus
aaggtccacgtctgtcagcagagta

SEQ ID NO: 63567 - DNA, 25 bp, Mus musculus
aaggtccacttgagagagccagcac

SEQ ID NO: 63568 - DNA, 25 bp, Mus musculus
aaggtccacttgtgagagccagcac

SEQ ID NO: 63569 - DNA, 25 bp, Mus musculus
aaggtccagattaacaacccagcct

SEQ ID NO: 63570 - DNA, 25 bp, Mus musculus
aaggtccagatttacaacccagcct

SEQ ID NO: 63571 - DNA, 25 bp, Mus musculus
aaggtccagcccacgtctaggaggg

SEQ ID NO: 63572 - DNA, 25 bp, Mus musculus
aaggtccagccctcgtctaggaggg

SEQ ID NO: 63573 - DNA, 25 bp, Mus musculus
aaggtccaggttactgtcctattag

SEQ ID NO: 63574 - DNA, 25 bp, Mus musculus
aaggtccaggtttctgtcctattag

SEQ ID NO: 63575 - DNA, 25 bp, Mus musculus
aaggtccagtggactgacaccctgg

SEQ ID NO: 63576 - DNA, 25 bp, Mus musculus
aaggtccagtggtctgacaccctgg

SEQ ID NO: 63577 - DNA, 25 bp, Mus musculus
aaggtccatcccactggaatgggaa

SEQ ID NO: 63578 - DNA, 25 bp, Mus musculus
aaggtccatccctctggaatgggaa

SEQ ID NO: 63579 - DNA, 25 bp, Mus musculus
aaggtccatcggcttcccatgcttg

SEQ ID NO: 63580 - DNA, 25 bp, Mus musculus
aaggtccatcgggttcccatgcttg

SEQ ID NO: 63581 - DNA, 25 bp, Mus musculus
aaggtccattaaaggctgcagtttc

SEQ ID NO: 63582 - DNA, 25 bp, Mus musculus
aaggtccattaatggctgcagtttc

SEQ ID NO: 63583 - DNA, 25 bp, Mus musculus
aaggtcccaaggcacagcagcgcac

SEQ ID NO: 63584 - DNA, 25 bp, Mus musculus
aaggtcccaagggacagcagcgcac

SEQ ID NO: 63585 - DNA, 25 bp, Mus musculus
aaggtcccacaacacacgaggagca

SEQ ID NO: 63586 - DNA, 25 bp, Mus musculus
aaggtcccacaagacacgaggagca

SEQ ID NO: 63587 - DNA, 25 bp, Mus musculus
aaggtcccacccagcaatgaagtgg

SEQ ID NO: 63588 - DNA, 25 bp, Mus musculus
aaggtcccaccctgcaatgaagtgg

SEQ ID NO: 63589 - DNA, 25 bp, Mus musculus
aaggtccccaccactgttgaggaca

SEQ ID NO: 63590 - DNA, 25 bp, Mus musculus
aaggtccccacctctgttgaggaca

SEQ ID NO: 63591 - DNA, 25 bp, Mus musculus
aaggtccccatgacatcagttaagc

SEQ ID NO: 63592 - DNA, 25 bp, Mus musculus
aaggtccccatgtcatcagttaagc

SEQ ID NO: 63593 - DNA, 25 bp, Mus musculus
aaggtcccgtagagaatcacagttt

SEQ ID NO: 63594 - DNA, 25 bp, Mus musculus
aaggtcccgtagtgaatcacagttt

SEQ ID NO: 63595 - DNA, 25 bp, Mus musculus
aaggtccctatacacattccattcc

SEQ ID NO: 63596 - DNA, 25 bp, Mus musculus
aaggtccctatagacattccattcc

SEQ ID NO: 63597 - DNA, 25 bp, Mus musculus
aaggtccctatgaatcatttctgcc

SEQ ID NO: 63598 - DNA, 25 bp, Mus musculus
aaggtccctatgtatcatttctgcc

SEQ ID NO: 63599 - DNA, 25 bp, Mus musculus
aaggtccctggacgattgggctgaa

SEQ ID NO: 63600 - DNA, 25 bp, Mus musculus
aaggtccctggaggattgggctgaa

SEQ ID NO: 63601 - DNA, 25 bp, Mus musculus
aaggtccctgggatctcgtgggcat

SEQ ID NO: 63602 - DNA, 25 bp, Mus musculus
aaggtccctgggttctcgtgggcat

SEQ ID NO: 63603 - DNA, 25 bp, Mus musculus
aaggtccctgtgcagcaacgactgt

SEQ ID NO: 63604 - DNA, 25 bp, Mus musculus
aaggtccctgtggagcaacgactgt

SEQ ID NO: 63605 - DNA, 25 bp, Mus musculus
aaggtcccttgactagccgctggcc

SEQ ID NO: 63606 - DNA, 25 bp, Mus musculus
aaggtcccttgagtagccgctggcc

SEQ ID NO: 63607 - DNA, 25 bp, Mus musculus
aaggtccgaatcctagagctcctgc

SEQ ID NO: 63608 - DNA, 25 bp, Mus musculus
aaggtccgaatcgtagagctcctgc

SEQ ID NO: 63609 - DNA, 25 bp, Mus musculus
aaggtccgagctcgaactagctttt

SEQ ID NO: 63610 - DNA, 25 bp, Mus musculus
aaggtccgagctggaactagctttt

SEQ ID NO: 63611 - DNA, 25 bp, Mus musculus
aaggtccgcactaggtgctacctga

SEQ ID NO: 63612 - DNA, 25 bp, Mus musculus
aaggtccgcacttggtgctacctga

SEQ ID NO: 63613 - DNA, 25 bp, Mus musculus
aaggtccgccaaaggcttgaacttg

SEQ ID NO: 63614 - DNA, 25 bp, Mus musculus
aaggtccgccaatggcttgaacttg

SEQ ID NO: 63615 - DNA, 25 bp, Mus musculus
aaggtccggtgcagctgatccaaca

SEQ ID NO: 63616 - DNA, 25 bp, Mus musculus
aaggtccggtgctgctgatccaaca

SEQ ID NO: 63617 - DNA, 25 bp, Mus musculus
aaggtcctactcagtaatgatattg

SEQ ID NO: 63618 - DNA, 25 bp, Mus musculus
aaggtcctactctgtaatgatattg

SEQ ID NO: 63619 - DNA, 25 bp, Mus musculus
aaggtcctagagacagtgtttcgta

SEQ ID NO: 63620 - DNA, 25 bp, Mus musculus
aaggtcctagagtcagtgtttcgta

SEQ ID NO: 63621 - DNA, 25 bp, Mus musculus
aaggtcctagctccctgtagataca

SEQ ID NO: 63622 - DNA, 25 bp, Mus musculus
aaggtcctagctgcctgtagataca

SEQ ID NO: 63623 - DNA, 25 bp, Mus musculus
aaggtcctcaccaaccaggagagtc

SEQ ID NO: 63624 - DNA, 25 bp, Mus musculus
aaggtcctcacctaccaggagagtc

SEQ ID NO: 63625 - DNA, 25 bp, Mus musculus
aaggtcctccagaagttgcttccca

SEQ ID NO: 63626 - DNA, 25 bp, Mus musculus
aaggtcctccagtagttgcttccca

SEQ ID NO: 63627 - DNA, 25 bp, Mus musculus
aaggtcctcgcacccatggtcttgg

SEQ ID NO: 63628 - DNA, 25 bp, Mus musculus
aaggtcctcgcagccatggtcttgg

SEQ ID NO: 63629 - DNA, 25 bp, Mus musculus
aaggtcctcgctcgctttacattaa

SEQ ID NO: 63630 - DNA, 25 bp, Mus musculus
aaggtcctcgctggctttacattaa

SEQ ID NO: 63631 - DNA, 25 bp, Mus musculus
aaggtcctctgtcgtgtggtgacca

SEQ ID NO: 63632 - DNA, 25 bp, Mus musculus
aaggtcctctgtggtgtggtgacca

SEQ ID NO: 63633 - DNA, 25 bp, Mus musculus
aaggtcctcttgctgtcagatcaac

SEQ ID NO: 63634 - DNA, 25 bp, Mus musculus
aaggtcctcttggtgtcagatcaac

SEQ ID NO: 63635 - DNA, 25 bp, Mus musculus
aaggtcctctttacatttacaaatg

SEQ ID NO: 63636 - DNA, 25 bp, Mus musculus
aaggtcctcttttcatttacaaatg

SEQ ID NO: 63637 - DNA, 25 bp, Mus musculus
aaggtcctgacacagcttctggagc

SEQ ID NO: 63638 - DNA, 25 bp, Mus musculus
aaggtcctgacagagcttctggagc

SEQ ID NO: 63639 - DNA, 25 bp, Mus musculus
aaggtcctgactccatcgggcaaca

SEQ ID NO: 63640 - DNA, 25 bp, Mus musculus
aaggtcctgactgcatcgggcaaca

SEQ ID NO: 63641 - DNA, 25 bp, Mus musculus
aaggtcctgagaactagctccagtg

SEQ ID NO: 63642 - DNA, 25 bp, Mus musculus
aaggtcctgagatctagctccagtg

SEQ ID NO: 63643 - DNA, 25 bp, Mus musculus
aaggtcctgaggagcctgcgctgcc

SEQ ID NO: 63644 - DNA, 25 bp, Mus musculus
aaggtcctgaggtgcctgcgctgcc

SEQ ID NO: 63645 - DNA, 25 bp, Mus musculus
aaggtcctgattaacagtggataaa

SEQ ID NO: 63646 - DNA, 25 bp, Mus musculus
aaggtcctgatttacagtggataaa

SEQ ID NO: 63647 - DNA, 25 bp, Mus musculus
aaggtcctgcagaataatttgtatc

SEQ ID NO: 63648 - DNA, 25 bp, Mus musculus
aaggtcctgcagtataatttgtatc

SEQ ID NO: 63649 - DNA, 25 bp, Mus musculus
aaggtcctgctcacaggctggaaga

SEQ ID NO: 63650 - DNA, 25 bp, Mus musculus
aaggtcctgctctcaggctggaaga

SEQ ID NO: 63651 - DNA, 25 bp, Mus musculus
aaggtcctgctgaagcatgactgac

SEQ ID NO: 63652 - DNA, 25 bp, Mus musculus
aaggtcctgctgtagcatgactgac

SEQ ID NO: 63653 - DNA, 25 bp, Mus musculus
aaggtccttaggcttctggccgatg

SEQ ID NO: 63654 - DNA, 25 bp, Mus musculus
aaggtccttagggttctggccgatg

SEQ ID NO: 63655 - DNA, 25 bp, Mus musculus
aaggtccttcaacagctttcacagt

SEQ ID NO: 63656 - DNA, 25 bp, Mus musculus
aaggtccttcaagagctttcacagt

SEQ ID NO: 63657 - DNA, 25 bp, Mus musculus
aaggtccttcttacaagagatcctg

SEQ ID NO: 63658 - DNA, 25 bp, Mus musculus
aaggtccttctttcaagagatcctg

SEQ ID NO: 63659 - DNA, 25 bp, Mus musculus
aaggtccttgagagttttgttgtct

SEQ ID NO: 63660 - DNA, 25 bp, Mus musculus
aaggtccttgagtgttttgttgtct

SEQ ID NO: 63661 - DNA, 25 bp, Mus musculus
aaggtccttgtccatcaaacaggaa

SEQ ID NO: 63662 - DNA, 25 bp, Mus musculus
aaggtccttgtcgatcaaacaggaa

SEQ ID NO: 63663 - DNA, 25 bp, Mus musculus
aaggtcgaagtgaaaccagtcacag

SEQ ID NO: 63664 - DNA, 25 bp, Mus musculus
aaggtcgaagtgtaaccagtcacag

SEQ ID NO: 63665 - DNA, 25 bp, Mus musculus
aaggtcgactttcaactccttgatc

SEQ ID NO: 63666 - DNA, 25 bp, Mus musculus
aaggtcgactttgaactccttgatc

SEQ ID NO: 63667 - DNA, 25 bp, Mus musculus
aaggtcgagcacctggattctctac

SEQ ID NO: 63668 - DNA, 25 bp, Mus musculus
aaggtcgagcacgtggattctctac

SEQ ID NO: 63669 - DNA, 25 bp, Mus musculus
aaggtcgagtgacatctagcccact

SEQ ID NO: 63670 - DNA, 25 bp, Mus musculus
aaggtcgagtgagatctagcccact

SEQ ID NO: 63671 - DNA, 25 bp, Mus musculus
aaggtcgcaaggacgaggccagcca

SEQ ID NO: 63672 - DNA, 25 bp, Mus musculus
aaggtcgcaaggtcgaggccagcca

SEQ ID NO: 63673 - DNA, 25 bp, Mus musculus
aaggtcgccgatcctctggccaatg

SEQ ID NO: 63674 - DNA, 25 bp, Mus musculus
aaggtcgccgatgctctggccaatg

SEQ ID NO: 63675 - DNA, 25 bp, Mus musculus
aaggtcgcctccagctgggagcaga

SEQ ID NO: 63676 - DNA, 25 bp, Mus musculus
aaggtcgcctcctgctgggagcaga

SEQ ID NO: 63677 - DNA, 25 bp, Mus musculus
aaggtcgctcttccaaaaggtctct

SEQ ID NO: 63678 - DNA, 25 bp, Mus musculus
aaggtcgctcttgcaaaaggtctct

SEQ ID NO: 63679 - DNA, 25 bp, Mus musculus
aaggtcgcttacagattgctgcctg

SEQ ID NO: 63680 - DNA, 25 bp, Mus musculus
aaggtcgcttactgattgctgcctg

SEQ ID NO: 63681 - DNA, 25 bp, Mus musculus
aaggtcggagtacgcaaggttatca

SEQ ID NO: 63682 - DNA, 25 bp, Mus musculus
aaggtcggagtaggcaaggttatca

SEQ ID NO: 63683 - DNA, 25 bp, Mus musculus
aaggtcggatgtcgagttgacactt

SEQ ID NO: 63684 - DNA, 25 bp, Mus musculus
aaggtcggatgtggagttgacactt

SEQ ID NO: 63685 - DNA, 25 bp, Mus musculus
aaggtcggcacacggctgagcctct

SEQ ID NO: 63686 - DNA, 25 bp, Mus musculus
aaggtcggcacagggctgagcctct

SEQ ID NO: 63687 - DNA, 25 bp, Mus musculus
aaggtcggcagtagtgacctccagg

SEQ ID NO: 63688 - DNA, 25 bp, Mus musculus
aaggtcggcagttgtgacctccagg

SEQ ID NO: 63689 - DNA, 25 bp, Mus musculus
aaggtcggcatcctcggcaagtacg

SEQ ID NO: 63690 - DNA, 25 bp, Mus musculus
aaggtcggcatcgtcggcaagtacg

SEQ ID NO: 63691 - DNA, 25 bp, Mus musculus
aaggtcggccgactcagtgtttatg

SEQ ID NO: 63692 - DNA, 25 bp, Mus musculus
aaggtcggccgagtcagtgtttatg

SEQ ID NO: 63693 - DNA, 25 bp, Mus musculus
aaggtcggctaaccgtcctttgcct

SEQ ID NO: 63694 - DNA, 25 bp, Mus musculus
aaggtcggctaagcgtcctttgcct

SEQ ID NO: 63695 - DNA, 25 bp, Mus musculus
aaggtcgggccacgttcagcatgtc

SEQ ID NO: 63696 - DNA, 25 bp, Mus musculus
aaggtcgggccaggttcagcatgtc

SEQ ID NO: 63697 - DNA, 25 bp, Mus musculus
aaggtcggttttctttctctgatca

SEQ ID NO: 63698 - DNA, 25 bp, Mus musculus
aaggtcggttttgtttctctgatca

SEQ ID NO: 63699 - DNA, 25 bp, Mus musculus
aaggtcgtcaaaacctgctgaccac

SEQ ID NO: 63700 - DNA, 25 bp, Mus musculus
aaggtcgtcaaatcctgctgaccac

SEQ ID NO: 63701 - DNA, 25 bp, Mus musculus
aaggtcgtgaatccctgtgcgtgaa

SEQ ID NO: 63702 - DNA, 25 bp, Mus musculus
aaggtcgtgaatgcctgtgcgtgaa

SEQ ID NO: 63703 - DNA, 25 bp, Mus musculus
aaggtcgttaccaagccaggccata

SEQ ID NO: 63704 - DNA, 25 bp, Mus musculus
aaggtcgttacctagccaggccata

SEQ ID NO: 63705 - DNA, 25 bp, Mus musculus
aaggtcgttcttctgcactcagtct

SEQ ID NO: 63706 - DNA, 25 bp, Mus musculus
aaggtcgttcttgtgcactcagtct

SEQ ID NO: 63707 - DNA, 25 bp, Mus musculus
aaggtctaatcacatgagctccaag

SEQ ID NO: 63708 - DNA, 25 bp, Mus musculus
aaggtctaatcagatgagctccaag

SEQ ID NO: 63709 - DNA, 25 bp, Mus musculus
aaggtctacctgctgctgggtgaca

SEQ ID NO: 63710 - DNA, 25 bp, Mus musculus
aaggtctacctggtgctgggtgaca

SEQ ID NO: 63711 - DNA, 25 bp, Mus musculus
aaggtctacgttcaggacatcctgc

SEQ ID NO: 63712 - DNA, 25 bp, Mus musculus
aaggtctacgttgaggacatcctgc

SEQ ID NO: 63713 - DNA, 25 bp, Mus musculus
aaggtctagactcccatgcttcatt

SEQ ID NO: 63714 - DNA, 25 bp, Mus musculus
aaggtctagactgccatgcttcatt

SEQ ID NO: 63715 - DNA, 25 bp, Mus musculus
aaggtctagctcagtgggaaaagtg

SEQ ID NO: 63716 - DNA, 25 bp, Mus musculus
aaggtctagctcagttcctagttga

SEQ ID NO: 63717 - DNA, 25 bp, Mus musculus
aaggtctagctctgtgggaaaagtg

SEQ ID NO: 63718 - DNA, 25 bp, Mus musculus
aaggtctagctctgttcctagttga

SEQ ID NO: 63719 - DNA, 25 bp, Mus musculus
aaggtctaggatagacttttgcaaa

SEQ ID NO: 63720 - DNA, 25 bp, Mus musculus
aaggtctaggattgacttttgcaaa

SEQ ID NO: 63721 - DNA, 25 bp, Mus musculus
aaggtctaggtcacagccccataga

SEQ ID NO: 63722 - DNA, 25 bp, Mus musculus
aaggtctaggtctcagccccataga

SEQ ID NO: 63723 - DNA, 25 bp, Mus musculus
aaggtctatcctcaaaatgcccaca

SEQ ID NO: 63724 - DNA, 25 bp, Mus musculus
aaggtctatcctgaaaatgcccaca

SEQ ID NO: 63725 - DNA, 25 bp, Mus musculus
aaggtctatctcatgggttctacaa

SEQ ID NO: 63726 - DNA, 25 bp, Mus musculus
aaggtctatctcttgggttctacaa

SEQ ID NO: 63727 - DNA, 25 bp, Mus musculus
aaggtctattacaccttcctttgca

SEQ ID NO: 63728 - DNA, 25 bp, Mus musculus
aaggtctattactccttcctttgca

SEQ ID NO: 63729 - DNA, 25 bp, Mus musculus
aaggtctcactaatttcacaggctg

SEQ ID NO: 63730 - DNA, 25 bp, Mus musculus
aaggtctcactattttcacaggctg

SEQ ID NO: 63731 - DNA, 25 bp, Mus musculus
aaggtctcatccaatctgatgcctg

SEQ ID NO: 63732 - DNA, 25 bp, Mus musculus
aaggtctcatcctatctgatgcctg

SEQ ID NO: 63733 - DNA, 25 bp, Mus musculus
aaggtctcatttcccagtgtgacat

SEQ ID NO: 63734 - DNA, 25 bp, Mus musculus
aaggtctcatttgccagtgtgacat

SEQ ID NO: 63735 - DNA, 25 bp, Mus musculus
aaggtctccaagattacactctcgt

SEQ ID NO: 63736 - DNA, 25 bp, Mus musculus
aaggtctccaagtttacactctcgt

SEQ ID NO: 63737 - DNA, 25 bp, Mus musculus
aaggtctccagtaagcctagtccca

SEQ ID NO: 63738 - DNA, 25 bp, Mus musculus
aaggtctccagttagcctagtccca

SEQ ID NO: 63739 - DNA, 25 bp, Mus musculus
aaggtctccatgctctcaaattgtc

SEQ ID NO: 63740 - DNA, 25 bp, Mus musculus
aaggtctccatggtctcaaattgtc

SEQ ID NO: 63741 - DNA, 25 bp, Mus musculus
aaggtctcccctaagagatctacta

SEQ ID NO: 63742 - DNA, 25 bp, Mus musculus
aaggtctccccttagagatctacta

SEQ ID NO: 63743 - DNA, 25 bp, Mus musculus
aaggtctcccttctcaggctgcaac

SEQ ID NO: 63744 - DNA, 25 bp, Mus musculus
aaggtctcccttgtcaggctgcaac

SEQ ID NO: 63745 - DNA, 25 bp, Mus musculus
aaggtctcctgacacataacatgga

SEQ ID NO: 63746 - DNA, 25 bp, Mus musculus
aaggtctcctgagacataacatgga

SEQ ID NO: 63747 - DNA, 25 bp, Mus musculus
aaggtctcgaggatgacccttgtct

SEQ ID NO: 63748 - DNA, 25 bp, Mus musculus
aaggtctcgaggttgacccttgtct

SEQ ID NO: 63749 - DNA, 25 bp, Mus musculus
aaggtctcgatgcacactatcctgg

SEQ ID NO: 63750 - DNA, 25 bp, Mus musculus
aaggtctcgatggacactatcctgg

SEQ ID NO: 63751 - DNA, 25 bp, Mus musculus
aaggtctcggttaatgttgcatccc

SEQ ID NO: 63752 - DNA, 25 bp, Mus musculus
aaggtctcggtttatgttgcatccc

SEQ ID NO: 63753 - DNA, 25 bp, Mus musculus
aaggtctctccaaatatcccagact

SEQ ID NO: 63754 - DNA, 25 bp, Mus musculus
aaggtctctccatatatcccagact

SEQ ID NO: 63755 - DNA, 25 bp, Mus musculus
aaggtctctcctccggcagagatga

SEQ ID NO: 63756 - DNA, 25 bp, Mus musculus
aaggtctctcctgcggcagagatga

SEQ ID NO: 63757 - DNA, 25 bp, Mus musculus
aaggtctctcttcggtgcctcagat

SEQ ID NO: 63758 - DNA, 25 bp, Mus musculus
aaggtctctcttcgtgctaggtgca

SEQ ID NO: 63759 - DNA, 25 bp, Mus musculus
aaggtctctcttgggtgcctcagat

SEQ ID NO: 63760 - DNA, 25 bp, Mus musculus
aaggtctctcttggtgctaggtgca

SEQ ID NO: 63761 - DNA, 25 bp, Mus musculus
aaggtctctgacatgtggatcatgg

SEQ ID NO: 63762 - DNA, 25 bp, Mus musculus
aaggtctctgacttgtggatcatgg

SEQ ID NO: 63763 - DNA, 25 bp, Mus musculus
aaggtctctgagaatgcccgtcgct

SEQ ID NO: 63764 - DNA, 25 bp, Mus musculus
aaggtctctgagtatgcccgtcgct

SEQ ID NO: 63765 - DNA, 25 bp, Mus musculus
aaggtctcttagacttgtatactca

SEQ ID NO: 63766 - DNA, 25 bp, Mus musculus
aaggtctcttagtcttgtatactca

SEQ ID NO: 63767 - DNA, 25 bp, Mus musculus
aaggtctcttatcagcccatcacta

SEQ ID NO: 63768 - DNA, 25 bp, Mus musculus
aaggtctcttatgagcccatcacta

SEQ ID NO: 63769 - DNA, 25 bp, Mus musculus
aaggtctgaagacatcctagtttgt

SEQ ID NO: 63770 - DNA, 25 bp, Mus musculus
aaggtctgaagagatcctagtttgt

SEQ ID NO: 63771 - DNA, 25 bp, Mus musculus
aaggtctgaagtcatgtcacccaca

SEQ ID NO: 63772 - DNA, 25 bp, Mus musculus
aaggtctgaagtgatgtcacccaca

SEQ ID NO: 63773 - DNA, 25 bp, Mus musculus
aaggtctgactcatggtgctgcttc

SEQ ID NO: 63774 - DNA, 25 bp, Mus musculus
aaggtctgactcttggtgctgcttc

SEQ ID NO: 63775 - DNA, 25 bp, Mus musculus
aaggtctgagacattctggaaaagc

SEQ ID NO: 63776 - DNA, 25 bp, Mus musculus
aaggtctgagactttctggaaaagc

SEQ ID NO: 63777 - DNA, 25 bp, Mus musculus
aaggtctgagtaaaccaggtctcta

SEQ ID NO: 63778 - DNA, 25 bp, Mus musculus
aaggtctgagtataccaggtctcta

SEQ ID NO: 63779 - DNA, 25 bp, Mus musculus
aaggtctgatcacttatctgaacat

SEQ ID NO: 63780 - DNA, 25 bp, Mus musculus
aaggtctgatcagttatctgaacat

SEQ ID NO: 63781 - DNA, 25 bp, Mus musculus
aaggtctgcaaacacttccaaggct

SEQ ID NO: 63782 - DNA, 25 bp, Mus musculus
aaggtctgcaaagacttccaaggct

SEQ ID NO: 63783 - DNA, 25 bp, Mus musculus
aaggtctgcgttagggactgccacc

SEQ ID NO: 63784 - DNA, 25 bp, Mus musculus
aaggtctgcgtttgggactgccacc

SEQ ID NO: 63785 - DNA, 25 bp, Mus musculus
aaggtctgctatccccagaggttta

SEQ ID NO: 63786 - DNA, 25 bp, Mus musculus
aaggtctgctatgcccagaggttta

SEQ ID NO: 63787 - DNA, 25 bp, Mus musculus
aaggtctgctcaaggagactgctcc

SEQ ID NO: 63788 - DNA, 25 bp, Mus musculus
aaggtctgctcatggagactgctcc

SEQ ID NO: 63789 - DNA, 25 bp, Mus musculus
aaggtctgctttcgagacttcccga

SEQ ID NO: 63790 - DNA, 25 bp, Mus musculus
aaggtctgctttggagacttcccga

SEQ ID NO: 63791 - DNA, 25 bp, Mus musculus
aaggtctggactcagctgcagcctg

SEQ ID NO: 63792 - DNA, 25 bp, Mus musculus
aaggtctggactgagctgcagcctg

SEQ ID NO: 63793 - DNA, 25 bp, Mus musculus
aaggtctggatgaagttctcttcat

SEQ ID NO: 63794 - DNA, 25 bp, Mus musculus
aaggtctggatgtagttctcttcat

SEQ ID NO: 63795 - DNA, 25 bp, Mus musculus
aaggtctgggacaggatggccactc

SEQ ID NO: 63796 - DNA, 25 bp, Mus musculus
aaggtctgggactggatggccactc

SEQ ID NO: 63797 - DNA, 25 bp, Mus musculus
aaggtctgggccaagggttcctcat

SEQ ID NO: 63798 - DNA, 25 bp, Mus musculus
aaggtctgggcctagggttcctcat

SEQ ID NO: 63799 - DNA, 25 bp, Mus musculus
aaggtctgtatccttcctaaccgag

SEQ ID NO: 63800 - DNA, 25 bp, Mus musculus
aaggtctgtatcgttcctaaccgag

SEQ ID NO: 63801 - DNA, 25 bp, Mus musculus
aaggtctgtctaaataactcccgtg

SEQ ID NO: 63802 - DNA, 25 bp, Mus musculus
aaggtctgtctatataactcccgtg

SEQ ID NO: 63803 - DNA, 25 bp, Mus musculus
aaggtctgtctgaggataccactga

SEQ ID NO: 63804 - DNA, 25 bp, Mus musculus
aaggtctgtctgtggataccactga

SEQ ID NO: 63805 - DNA, 25 bp, Mus musculus
aaggtctgtgacagtagcgactgaa

SEQ ID NO: 63806 - DNA, 25 bp, Mus musculus
aaggtctgtgactgtagcgactgaa

SEQ ID NO: 63807 - DNA, 25 bp, Mus musculus
aaggtctgtttgaagtccgagccca

SEQ ID NO: 63808 - DNA, 25 bp, Mus musculus
aaggtctgtttgtagtccgagccca

SEQ ID NO: 63809 - DNA, 25 bp, Mus musculus
aaggtcttctcactcaagctgttga

SEQ ID NO: 63810 - DNA, 25 bp, Mus musculus
aaggtcttctcagtcaagctgttga

SEQ ID NO: 63811 - DNA, 25 bp, Mus musculus
aaggtcttctggaggtctttaatga

SEQ ID NO: 63812 - DNA, 25 bp, Mus musculus
aaggtcttctggtggtctttaatga

SEQ ID NO: 63813 - DNA, 25 bp, Mus musculus
aaggtcttcttcaccaagcaacaat

SEQ ID NO: 63814 - DNA, 25 bp, Mus musculus
aaggtcttcttcatcaaagctctgc

SEQ ID NO: 63815 - DNA, 25 bp, Mus musculus
aaggtcttcttctccaagcaacaat

SEQ ID NO: 63816 - DNA, 25 bp, Mus musculus
aaggtcttcttcttcaaagctctgc

SEQ ID NO: 63817 - DNA, 25 bp, Mus musculus
aaggtcttcttgctgttttagtgga

SEQ ID NO: 63818 - DNA, 25 bp, Mus musculus
aaggtcttcttggtgttttagtgga

SEQ ID NO: 63819 - DNA, 25 bp, Mus musculus
aaggtcttgaggacattctccactc

SEQ ID NO: 63820 - DNA, 25 bp, Mus musculus
aaggtcttgaggtcattctccactc

SEQ ID NO: 63821 - DNA, 25 bp, Mus musculus
aaggtcttgatacttcttcttccaa

SEQ ID NO: 63822 - DNA, 25 bp, Mus musculus
aaggtcttgatagttcttcttccaa

SEQ ID NO: 63823 - DNA, 25 bp, Mus musculus
aaggtcttgatgactgtttgcagca

SEQ ID NO: 63824 - DNA, 25 bp, Mus musculus
aaggtcttgatgtctgtttgcagca

SEQ ID NO: 63825 - DNA, 25 bp, Mus musculus
aaggtcttgattccatcaccttcta

SEQ ID NO: 63826 - DNA, 25 bp, Mus musculus
aaggtcttgattgcatcaccttcta

SEQ ID NO: 63827 - DNA, 25 bp, Mus musculus
aaggtcttgggcatctgttcattct

SEQ ID NO: 63828 - DNA, 25 bp, Mus musculus
aaggtcttgggcttctgttcattct

SEQ ID NO: 63829 - DNA, 25 bp, Mus musculus
aaggtcttggtcatggtctctgaac

SEQ ID NO: 63830 - DNA, 25 bp, Mus musculus
aaggtcttggtcttggtctctgaac

SEQ ID NO: 63831 - DNA, 25 bp, Mus musculus
aaggtcttgtctcctttgttgtcca

SEQ ID NO: 63832 - DNA, 25 bp, Mus musculus
aaggtcttgtctgctttgttgtcca

SEQ ID NO: 63833 - DNA, 25 bp, Mus musculus
aaggtcttgtgcagggacccagtag

SEQ ID NO: 63834 - DNA, 25 bp, Mus musculus
aaggtcttgtgctgggacccagtag

SEQ ID NO: 63835 - DNA, 25 bp, Mus musculus
aaggtctttatgctttgccatgagg

SEQ ID NO: 63836 - DNA, 25 bp, Mus musculus
aaggtctttatggtttgccatgagg

SEQ ID NO: 63837 - DNA, 25 bp, Mus musculus
aaggtctttcatacttgaccgtgga

SEQ ID NO: 63838 - DNA, 25 bp, Mus musculus
aaggtctttcattcttgaccgtgga

SEQ ID NO: 63839 - DNA, 25 bp, Mus musculus
aaggtctttctgagaagtcctgact

SEQ ID NO: 63840 - DNA, 25 bp, Mus musculus
aaggtctttctgtgaagtcctgact

SEQ ID NO: 63841 - DNA, 25 bp, Mus musculus
aaggtctttgcaactagctttcaga

SEQ ID NO: 63842 - DNA, 25 bp, Mus musculus
aaggtctttgcatctagctttcaga

SEQ ID NO: 63843 - DNA, 25 bp, Mus musculus
aaggtctttgctactgttattcatc

SEQ ID NO: 63844 - DNA, 25 bp, Mus musculus
aaggtctttgcttctgttattcatc

SEQ ID NO: 63845 - DNA, 25 bp, Mus musculus
aaggtctttgtgatctacatactat

SEQ ID NO: 63846 - DNA, 25 bp, Mus musculus
aaggtctttgtgttctacatactat

SEQ ID NO: 63847 - DNA, 25 bp, Mus musculus
aaggtgaaactcaagggtgcccaca

SEQ ID NO: 63848 - DNA, 25 bp, Mus musculus
aaggtgaaactctagggtgcccaca

SEQ ID NO: 63849 - DNA, 25 bp, Mus musculus
aaggtgaacgtcaactacggcagaa

SEQ ID NO: 63850 - DNA, 25 bp, Mus musculus
aaggtgaacgtctactacggcagaa

SEQ ID NO: 63851 - DNA, 25 bp, Mus musculus
aaggtgaagagcaccctgtggcaga

SEQ ID NO: 63852 - DNA, 25 bp, Mus musculus
aaggtgaagagctccctgtggcaga

SEQ ID NO: 63853 - DNA, 25 bp, Mus musculus
aaggtgaagcccctggacattctcc

SEQ ID NO: 63854 - DNA, 25 bp, Mus musculus
aaggtgaagcccgtggacattctcc

SEQ ID NO: 63855 - DNA, 25 bp, Mus musculus
aaggtgaaggccaacaagcgccagg

SEQ ID NO: 63856 - DNA, 25 bp, Mus musculus
aaggtgaaggcctacaagcgccagg

SEQ ID NO: 63857 - DNA, 25 bp, Mus musculus
aaggtgaaggttccagctcctgtct

SEQ ID NO: 63858 - DNA, 25 bp, Mus musculus
aaggtgaaggttgcagctcctgtct

SEQ ID NO: 63859 - DNA, 25 bp, Mus musculus
aaggtgaagtgtatctgtcatccag

SEQ ID NO: 63860 - DNA, 25 bp, Mus musculus
aaggtgaagtgtttctgtcatccag

SEQ ID NO: 63861 - DNA, 25 bp, Mus musculus
aaggtgaatcagaacccagaggctt

SEQ ID NO: 63862 - DNA, 25 bp, Mus musculus
aaggtgaatcagtacccagaggctt

SEQ ID NO: 63863 - DNA, 25 bp, Mus musculus
aaggtgaatcctccagttacaatcc

SEQ ID NO: 63864 - DNA, 25 bp, Mus musculus
aaggtgaatcctgcagttacaatcc

SEQ ID NO: 63865 - DNA, 25 bp, Mus musculus
aaggtgaatcgcatccgcaagagcc

SEQ ID NO: 63866 - DNA, 25 bp, Mus musculus
aaggtgaatcgcttccgcaagagcc

SEQ ID NO: 63867 - DNA, 25 bp, Mus musculus
aaggtgaattagaccagaggtcaga

SEQ ID NO: 63868 - DNA, 25 bp, Mus musculus
aaggtgaattagtccagaggtcaga

SEQ ID NO: 63869 - DNA, 25 bp, Mus musculus
aaggtgacaacgcaagcctctcgag

SEQ ID NO: 63870 - DNA, 25 bp, Mus musculus
aaggtgacaacggaagcctctcgag

SEQ ID NO: 63871 - DNA, 25 bp, Mus musculus
aaggtgacaccaagcccgtaacaat

SEQ ID NO: 63872 - DNA, 25 bp, Mus musculus
aaggtgacaccatgcccgtaacaat

SEQ ID NO: 63873 - DNA, 25 bp, Mus musculus
aaggtgacacctaactgggtttgat

SEQ ID NO: 63874 - DNA, 25 bp, Mus musculus
aaggtgacaccttactgggtttgat

SEQ ID NO: 63875 - DNA, 25 bp, Mus musculus
aaggtgacacgcatggtgctgcctg

SEQ ID NO: 63876 - DNA, 25 bp, Mus musculus
aaggtgacacgcttggtgctgcctg

SEQ ID NO: 63877 - DNA, 25 bp, Mus musculus
aaggtgacacggattgtactcttat

SEQ ID NO: 63878 - DNA, 25 bp, Mus musculus
aaggtgacacggtttgtactcttat

SEQ ID NO: 63879 - DNA, 25 bp, Mus musculus
aaggtgacaggaagatgggacccca

SEQ ID NO: 63880 - DNA, 25 bp, Mus musculus
aaggtgacaggatgatgggacccca

SEQ ID NO: 63881 - DNA, 25 bp, Mus musculus
aaggtgacatgaccagctctgtggc

SEQ ID NO: 63882 - DNA, 25 bp, Mus musculus
aaggtgacatgagcagctctgtggc

SEQ ID NO: 63883 - DNA, 25 bp, Mus musculus
aaggtgacatgcagacgggtccctg

SEQ ID NO: 63884 - DNA, 25 bp, Mus musculus
aaggtgacatgctgacgggtccctg

SEQ ID NO: 63885 - DNA, 25 bp, Mus musculus
aaggtgacattcagctctgctagac

SEQ ID NO: 63886 - DNA, 25 bp, Mus musculus
aaggtgacattctgctctgctagac

SEQ ID NO: 63887 - DNA, 25 bp, Mus musculus
aaggtgacattgcaagccctgcatg

SEQ ID NO: 63888 - DNA, 25 bp, Mus musculus
aaggtgacattggaagccctgcatg

SEQ ID NO: 63889 - DNA, 25 bp, Mus musculus
aaggtgaccatgactgtgtccacag

SEQ ID NO: 63890 - DNA, 25 bp, Mus musculus
aaggtgaccatgtctgtgtccacag

SEQ ID NO: 63891 - DNA, 25 bp, Mus musculus
aaggtgacccagctgagctatgaga

SEQ ID NO: 63892 - DNA, 25 bp, Mus musculus
aaggtgacccaggtgagctatgaga

SEQ ID NO: 63893 - DNA, 25 bp, Mus musculus
aaggtgacccgtatgtgcttcgcag

SEQ ID NO: 63894 - DNA, 25 bp, Mus musculus
aaggtgacccgtttgtgcttcgcag

SEQ ID NO: 63895 - DNA, 25 bp, Mus musculus
aaggtgaccctaagcagacctgctt

SEQ ID NO: 63896 - DNA, 25 bp, Mus musculus
aaggtgaccctatgcagacctgctt

SEQ ID NO: 63897 - DNA, 25 bp, Mus musculus
aaggtgacccttccctatgtggaat

SEQ ID NO: 63898 - DNA, 25 bp, Mus musculus
aaggtgacccttgcctatgtggaat

SEQ ID NO: 63899 - DNA, 25 bp, Mus musculus
aaggtgacctaacccaccacagctt

SEQ ID NO: 63900 - DNA, 25 bp, Mus musculus
aaggtgacctaagccaccacagctt

SEQ ID NO: 63901 - DNA, 25 bp, Mus musculus
aaggtgacctatcatgcgatgtttc

SEQ ID NO: 63902 - DNA, 25 bp, Mus musculus
aaggtgacctatgatgcgatgtttc

SEQ ID NO: 63903 - DNA, 25 bp, Mus musculus
aaggtgacgaggaggctgccttact

SEQ ID NO: 63904 - DNA, 25 bp, Mus musculus
aaggtgacgaggtggctgccttact

SEQ ID NO: 63905 - DNA, 25 bp, Mus musculus
aaggtgacgatcaatgaccatcatt

SEQ ID NO: 63906 - DNA, 25 bp, Mus musculus
aaggtgacgatctatgaccatcatt

SEQ ID NO: 63907 - DNA, 25 bp, Mus musculus
aaggtgactcaacacagggctgctg

SEQ ID NO: 63908 - DNA, 25 bp, Mus musculus
aaggtgactcaagacagggctgctg

SEQ ID NO: 63909 - DNA, 25 bp, Mus musculus
aaggtgactctgagaccccaggaga

SEQ ID NO: 63910 - DNA, 25 bp, Mus musculus
aaggtgactctgtgaccccaggaga

SEQ ID NO: 63911 - DNA, 25 bp, Mus musculus
aaggtgactgacaacatcgcagaga

SEQ ID NO: 63912 - DNA, 25 bp, Mus musculus
aaggtgactgactacatcgcagaga

SEQ ID NO: 63913 - DNA, 25 bp, Mus musculus
aaggtgactgtcactgctgaaaaag

SEQ ID NO: 63914 - DNA, 25 bp, Mus musculus
aaggtgactgtccagttccagtgct

SEQ ID NO: 63915 - DNA, 25 bp, Mus musculus
aaggtgactgtcgagttccagtgct

SEQ ID NO: 63916 - DNA, 25 bp, Mus musculus
aaggtgactgtctctgctgaaaaag

SEQ ID NO: 63917 - DNA, 25 bp, Mus musculus
aaggtgactttcagctacaataagg

SEQ ID NO: 63918 - DNA, 25 bp, Mus musculus
aaggtgactttctgctacaataagg

SEQ ID NO: 63919 - DNA, 25 bp, Mus musculus
aaggtgacttttctcctgagtgcct

SEQ ID NO: 63920 - DNA, 25 bp, Mus musculus
aaggtgacttttgtcctgagtgcct

SEQ ID NO: 63921 - DNA, 25 bp, Mus musculus
aaggtgagaccacagatgcagatgc

SEQ ID NO: 63922 - DNA, 25 bp, Mus musculus
aaggtgagaccagagatgcagatgc

SEQ ID NO: 63923 - DNA, 25 bp, Mus musculus
aaggtgagacctatctgccagggct

SEQ ID NO: 63924 - DNA, 25 bp, Mus musculus
aaggtgagacctttctgccagggct

SEQ ID NO: 63925 - DNA, 25 bp, Mus musculus
aaggtgagagcaaagattcggtttt

SEQ ID NO: 63926 - DNA, 25 bp, Mus musculus
aaggtgagagcatagattcggtttt

SEQ ID NO: 63927 - DNA, 25 bp, Mus musculus
aaggtgagcagacccgccaacagga

SEQ ID NO: 63928 - DNA, 25 bp, Mus musculus
aaggtgagcagagccgccaacagga

SEQ ID NO: 63929 - DNA, 25 bp, Mus musculus
aaggtgagccgcctctctcagtaca

SEQ ID NO: 63930 - DNA, 25 bp, Mus musculus
aaggtgagccgcgtctctcagtaca

SEQ ID NO: 63931 - DNA, 25 bp, Mus musculus
aaggtgagcctgaaacatagcagaa

SEQ ID NO: 63932 - DNA, 25 bp, Mus musculus
aaggtgagcctgtaacatagcagaa

SEQ ID NO: 63933 - DNA, 25 bp, Mus musculus
aaggtgagcttgatagtaatatact

SEQ ID NO: 63934 - DNA, 25 bp, Mus musculus
aaggtgagcttgttagtaatatact

SEQ ID NO: 63935 - DNA, 25 bp, Mus musculus
aaggtgagctttccacttgcttttc

SEQ ID NO: 63936 - DNA, 25 bp, Mus musculus
aaggtgagctttgcacttgcttttc

SEQ ID NO: 63937 - DNA, 25 bp, Mus musculus
aaggtgaggagcagctttaccacag

SEQ ID NO: 63938 - DNA, 25 bp, Mus musculus
aaggtgaggagctgctttaccacag

SEQ ID NO: 63939 - DNA, 25 bp, Mus musculus
aaggtgaggctgctagcattctaat

SEQ ID NO: 63940 - DNA, 25 bp, Mus musculus
aaggtgaggctggtagcattctaat

SEQ ID NO: 63941 - DNA, 25 bp, Mus musculus
aaggtgagggccatgaccagaacat

SEQ ID NO: 63942 - DNA, 25 bp, Mus musculus
aaggtgagggccttgaccagaacat

SEQ ID NO: 63943 - DNA, 25 bp, Mus musculus
aaggtgaggtctagcttgtctccac

SEQ ID NO: 63944 - DNA, 25 bp, Mus musculus
aaggtgaggtcttgcttgtctccac

SEQ ID NO: 63945 - DNA, 25 bp, Mus musculus
aaggtgagtccaagatccctcctcc

SEQ ID NO: 63946 - DNA, 25 bp, Mus musculus
aaggtgagtccatgatccctcctcc

SEQ ID NO: 63947 - DNA, 25 bp, Mus musculus
aaggtgatacttccagaaattacag

SEQ ID NO: 63948 - DNA, 25 bp, Mus musculus
aaggtgatacttgcagaaattacag

SEQ ID NO: 63949 - DNA, 25 bp, Mus musculus
aaggtgatcaccaacgcgaacgaga

SEQ ID NO: 63950 - DNA, 25 bp, Mus musculus
aaggtgatcacctacgcgaacgaga

SEQ ID NO: 63951 - DNA, 25 bp, Mus musculus
aaggtgatccgaaccagatctggaa

SEQ ID NO: 63952 - DNA, 25 bp, Mus musculus
aaggtgatccgatccagatctggaa

SEQ ID NO: 63953 - DNA, 25 bp, Mus musculus
aaggtgatccttatgctgttagaca

SEQ ID NO: 63954 - DNA, 25 bp, Mus musculus
aaggtgatccttttgctgttagaca

SEQ ID NO: 63955 - DNA, 25 bp, Mus musculus
aaggtgatcttaccaatgtttctgt

SEQ ID NO: 63956 - DNA, 25 bp, Mus musculus
aaggtgatcttagcaatgtttctgt

SEQ ID NO: 63957 - DNA, 25 bp, Mus musculus
aaggtgatgacgctctcacgctgta

SEQ ID NO: 63958 - DNA, 25 bp, Mus musculus
aaggtgatgacggtctcacgctgta

SEQ ID NO: 63959 - DNA, 25 bp, Mus musculus
aaggtgatgatacttccccaacctg

SEQ ID NO: 63960 - DNA, 25 bp, Mus musculus
aaggtgatgatagttccccaacctg

SEQ ID NO: 63961 - DNA, 25 bp, Mus musculus
aaggtgatgctcatcggcttgggaa

SEQ ID NO: 63962 - DNA, 25 bp, Mus musculus
aaggtgatgctcttcggcttgggaa

SEQ ID NO: 63963 - DNA, 25 bp, Mus musculus
aaggtgatgggaaactatcagacaa

SEQ ID NO: 63964 - DNA, 25 bp, Mus musculus
aaggtgatgggatactatcagacaa

SEQ ID NO: 63965 - DNA, 25 bp, Mus musculus
aaggtgatgtaaaccctgcattcta

SEQ ID NO: 63966 - DNA, 25 bp, Mus musculus
aaggtgatgtaatccctgcattcta

SEQ ID NO: 63967 - DNA, 25 bp, Mus musculus
aaggtgattctaaactcaataacca

SEQ ID NO: 63968 - DNA, 25 bp, Mus musculus
aaggtgattctatactcaataacca

SEQ ID NO: 63969 - DNA, 25 bp, Mus musculus
aaggtgcaaactcaggtcctgcaga

SEQ ID NO: 63970 - DNA, 25 bp, Mus musculus
aaggtgcaaactgaggtcctgcaga

SEQ ID NO: 63971 - DNA, 25 bp, Mus musculus
aaggtgcaacctattaatgtgacaa

SEQ ID NO: 63972 - DNA, 25 bp, Mus musculus
aaggtgcaaccttttaatgtgacaa

SEQ ID NO: 63973 - DNA, 25 bp, Mus musculus
aaggtgcaaggcagagtgctccccg

SEQ ID NO: 63974 - DNA, 25 bp, Mus musculus
aaggtgcaaggctgagtgctccccg

SEQ ID NO: 63975 - DNA, 25 bp, Mus musculus
aaggtgcaatcaaagctacgagttt

SEQ ID NO: 63976 - DNA, 25 bp, Mus musculus
aaggtgcaatcatagctacgagttt

SEQ ID NO: 63977 - DNA, 25 bp, Mus musculus
aaggtgcacaggcaccaagcaggaa

SEQ ID NO: 63978 - DNA, 25 bp, Mus musculus
aaggtgcacagggaccaagcaggaa

SEQ ID NO: 63979 - DNA, 25 bp, Mus musculus
aaggtgcactggaactaacctcaaa

SEQ ID NO: 63980 - DNA, 25 bp, Mus musculus
aaggtgcactggtactaacctcaaa

SEQ ID NO: 63981 - DNA, 25 bp, Mus musculus
aaggtgcagcataacgtggcctact

SEQ ID NO: 63982 - DNA, 25 bp, Mus musculus
aaggtgcagcattacgtggcctact

SEQ ID NO: 63983 - DNA, 25 bp, Mus musculus
aaggtgcagctcactattcttacaa

SEQ ID NO: 63984 - DNA, 25 bp, Mus musculus
aaggtgcagctctctattcttacaa

SEQ ID NO: 63985 - DNA, 25 bp, Mus musculus
aaggtgcaggcaatggctgtcccaa

SEQ ID NO: 63986 - DNA, 25 bp, Mus musculus
aaggtgcaggcattggctgtcccaa

SEQ ID NO: 63987 - DNA, 25 bp, Mus musculus
aaggtgcagtgcattgaccccaagg

SEQ ID NO: 63988 - DNA, 25 bp, Mus musculus
aaggtgcagtgctttgaccccaagg

SEQ ID NO: 63989 - DNA, 25 bp, Mus musculus
aaggtgcataggctccaggcaacac

SEQ ID NO: 63990 - DNA, 25 bp, Mus musculus
aaggtgcatagggtccaggcaacac

SEQ ID NO: 63991 - DNA, 25 bp, Mus musculus
aaggtgcattcgaatttgccctggc

SEQ ID NO: 63992 - DNA, 25 bp, Mus musculus
aaggtgcattcgtatttgccctggc

SEQ ID NO: 63993 - DNA, 25 bp, Mus musculus
aaggtgcattttctccagtttgtat

SEQ ID NO: 63994 - DNA, 25 bp, Mus musculus
aaggtgcattttgtccagtttgtat

SEQ ID NO: 63995 - DNA, 25 bp, Mus musculus
aaggtgccaaatccctggctccaga

SEQ ID NO: 63996 - DNA, 25 bp, Mus musculus
aaggtgccaaatcttgtggcttaaa

SEQ ID NO: 63997 - DNA, 25 bp, Mus musculus
aaggtgccaaatgcctggctccaga

SEQ ID NO: 63998 - DNA, 25 bp, Mus musculus
aaggtgccaaatgttgtggcttaaa

SEQ ID NO: 63999 - DNA, 25 bp, Mus musculus
aaggtgccaaggattccttcgcctt

SEQ ID NO: 64000 - DNA, 25 bp, Mus musculus
aaggtgccaaggtttccttcgcctt

SEQ ID NO: 64001 - DNA, 25 bp, Mus musculus
aaggtgccaccgaatccagaactga

SEQ ID NO: 64002 - DNA, 25 bp, Mus musculus
aaggtgccaccgtatccagaactga

SEQ ID NO: 64003 - DNA, 25 bp, Mus musculus
aaggtgccacttcggttacacagtg

SEQ ID NO: 64004 - DNA, 25 bp, Mus musculus
aaggtgccacttgggttacacagtg

SEQ ID NO: 64005 - DNA, 25 bp, Mus musculus
aaggtgccatctcgcccattatttt

SEQ ID NO: 64006 - DNA, 25 bp, Mus musculus
aaggtgccatctggcccattatttt

SEQ ID NO: 64007 - DNA, 25 bp, Mus musculus
aaggtgcccagtacctgttgagcgg

SEQ ID NO: 64008 - DNA, 25 bp, Mus musculus
aaggtgcccagtcctcaaaggccca

SEQ ID NO: 64009 - DNA, 25 bp, Mus musculus
aaggtgcccagtgctcaaaggccca

SEQ ID NO: 64010 - DNA, 25 bp, Mus musculus
aaggtgcccagttcctgttgagcgg

SEQ ID NO: 64011 - DNA, 25 bp, Mus musculus
aaggtgcccatcatggaatgccgcg

SEQ ID NO: 64012 - DNA, 25 bp, Mus musculus
aaggtgcccatcttggaatgccgcg

SEQ ID NO: 64013 - DNA, 25 bp, Mus musculus
aaggtgcccctaaagtgctatcaga

SEQ ID NO: 64014 - DNA, 25 bp, Mus musculus
aaggtgcccctatagtgctatcaga

SEQ ID NO: 64015 - DNA, 25 bp, Mus musculus
aaggtgccctttcactagcctagaa

SEQ ID NO: 64016 - DNA, 25 bp, Mus musculus
aaggtgccctttgactagcctagaa

SEQ ID NO: 64017 - DNA, 25 bp, Mus musculus
aaggtgccgcgccagccgggcaatc

SEQ ID NO: 64018 - DNA, 25 bp, Mus musculus
aaggtgccgcgcgagccgggcaatc

SEQ ID NO: 64019 - DNA, 25 bp, Mus musculus
aaggtgccggtgctacgagtcttcg

SEQ ID NO: 64020 - DNA, 25 bp, Mus musculus
aaggtgccggtggtacgagtcttcg

SEQ ID NO: 64021 - DNA, 25 bp, Mus musculus
aaggtgcctacaaggcattgttccc

SEQ ID NO: 64022 - DNA, 25 bp, Mus musculus
aaggtgcctacatggcattgttccc

SEQ ID NO: 64023 - DNA, 25 bp, Mus musculus
aaggtgcctcggcactgaggcacac

SEQ ID NO: 64024 - DNA, 25 bp, Mus musculus
aaggtgcctcgggactgaggcacac

SEQ ID NO: 64025 - DNA, 25 bp, Mus musculus
aaggtgcctgagatgcccaatgtgc

SEQ ID NO: 64026 - DNA, 25 bp, Mus musculus
aaggtgcctgagttgcccaatgtgc

SEQ ID NO: 64027 - DNA, 25 bp, Mus musculus
aaggtgcctgccaccgagcttgact

SEQ ID NO: 64028 - DNA, 25 bp, Mus musculus
aaggtgcctgcctccgagcttgact

SEQ ID NO: 64029 - DNA, 25 bp, Mus musculus
aaggtgcctgctagccattgtataa

SEQ ID NO: 64030 - DNA, 25 bp, Mus musculus
aaggtgcctgcttgccattgtataa

SEQ ID NO: 64031 - DNA, 25 bp, Mus musculus
aaggtgcctggcatgctggctgcaa

SEQ ID NO: 64032 - DNA, 25 bp, Mus musculus
aaggtgcctggcttgctggctgcaa

SEQ ID NO: 64033 - DNA, 25 bp, Mus musculus
aaggtgcgagttccccagaaacatc

SEQ ID NO: 64034 - DNA, 25 bp, Mus musculus
aaggtgcgagttgcccagaaacatc

SEQ ID NO: 64035 - DNA, 25 bp, Mus musculus
aaggtgcggctgagatttccatgag

SEQ ID NO: 64036 - DNA, 25 bp, Mus musculus
aaggtgcggctgtgatttccatgag

SEQ ID NO: 64037 - DNA, 25 bp, Mus musculus
aaggtgctacaaaaactgtcgggag

SEQ ID NO: 64038 - DNA, 25 bp, Mus musculus
aaggtgctacaataactgtcgggag

SEQ ID NO: 64039 - DNA, 25 bp, Mus musculus
aaggtgctacccatgtctaaatgga

SEQ ID NO: 64040 - DNA, 25 bp, Mus musculus
aaggtgctacccttgtctaaatgga

SEQ ID NO: 64041 - DNA, 25 bp, Mus musculus
aaggtgctacctacctcagatgtct

SEQ ID NO: 64042 - DNA, 25 bp, Mus musculus
aaggtgctaccttcctcagatgtct

SEQ ID NO: 64043 - DNA, 25 bp, Mus musculus
aaggtgctagctcgccaggtacaga

SEQ ID NO: 64044 - DNA, 25 bp, Mus musculus
aaggtgctagctctgcaagcttagc

SEQ ID NO: 64045 - DNA, 25 bp, Mus musculus
aaggtgctagctggccaggtacaga

SEQ ID NO: 64046 - DNA, 25 bp, Mus musculus
aaggtgctagctgtgcaagcttagc

SEQ ID NO: 64047 - DNA, 25 bp, Mus musculus
aaggtgctatgcctttgaacctcgc

SEQ ID NO: 64048 - DNA, 25 bp, Mus musculus
aaggtgctatgcgtttgaacctcgc

SEQ ID NO: 64049 - DNA, 25 bp, Mus musculus
aaggtgctatggctactgctattgc

SEQ ID NO: 64050 - DNA, 25 bp, Mus musculus
aaggtgctatgggtactgctattgc

SEQ ID NO: 64051 - DNA, 25 bp, Mus musculus
aaggtgctccccatgcatgcagaaa

SEQ ID NO: 64052 - DNA, 25 bp, Mus musculus
aaggtgctccccttgcatgcagaaa

SEQ ID NO: 64053 - DNA, 25 bp, Mus musculus
aaggtgctccttcctagacagaaac

SEQ ID NO: 64054 - DNA, 25 bp, Mus musculus
aaggtgctccttgctagacagaaac

SEQ ID NO: 64055 - DNA, 25 bp, Mus musculus
aaggtgctctatcgcctcaagtgag

SEQ ID NO: 64056 - DNA, 25 bp, Mus musculus
aaggtgctctatggcctcaagtgag

SEQ ID NO: 64057 - DNA, 25 bp, Mus musculus
aaggtgctctgaagtcaggcgcttt

SEQ ID NO: 64058 - DNA, 25 bp, Mus musculus
aaggtgctctgatgtcaggcgcttt

SEQ ID NO: 64059 - DNA, 25 bp, Mus musculus
aaggtgctctgcctgtccaaacaca

SEQ ID NO: 64060 - DNA, 25 bp, Mus musculus
aaggtgctctgcgtgtccaaacaca

SEQ ID NO: 64061 - DNA, 25 bp, Mus musculus
aaggtgctctgtagatgcccctgga

SEQ ID NO: 64062 - DNA, 25 bp, Mus musculus
aaggtgctctgttgatgcccctgga

SEQ ID NO: 64063 - DNA, 25 bp, Mus musculus
aaggtgctcttcaaagcaactccca

SEQ ID NO: 64064 - DNA, 25 bp, Mus musculus
aaggtgctcttctaagcaactccca

SEQ ID NO: 64065 - DNA, 25 bp, Mus musculus
aaggtgctgaccactgagtgctagg

SEQ ID NO: 64066 - DNA, 25 bp, Mus musculus
aaggtgctgacccaatcgctgccaa

SEQ ID NO: 64067 - DNA, 25 bp, Mus musculus
aaggtgctgaccgaatcgctgccaa

SEQ ID NO: 64068 - DNA, 25 bp, Mus musculus
aaggtgctgacctctgagtgctagg

SEQ ID NO: 64069 - DNA, 25 bp, Mus musculus
aaggtgctgatcatgcttgcttcca

SEQ ID NO: 64070 - DNA, 25 bp, Mus musculus
aaggtgctgatcttgcttgcttcca

SEQ ID NO: 64071 - DNA, 25 bp, Mus musculus
aaggtgctgcacagctcaggacata

SEQ ID NO: 64072 - DNA, 25 bp, Mus musculus
aaggtgctgcactgctcaggacata

SEQ ID NO: 64073 - DNA, 25 bp, Mus musculus
aaggtgctgcagaactcacttctag

SEQ ID NO: 64074 - DNA, 25 bp, Mus musculus
aaggtgctgcagtactcacttctag

SEQ ID NO: 64075 - DNA, 25 bp, Mus musculus
aaggtgctgtcccagatgattctgt

SEQ ID NO: 64076 - DNA, 25 bp, Mus musculus
aaggtgctgtccgagatgattctgt

SEQ ID NO: 64077 - DNA, 25 bp, Mus musculus
aaggtgctgtgcaggatgaagctaa

SEQ ID NO: 64078 - DNA, 25 bp, Mus musculus
aaggtgctgtgctggatgaagctaa

SEQ ID NO: 64079 - DNA, 25 bp, Mus musculus
aaggtgcttattaatggttctccag

SEQ ID NO: 64080 - DNA, 25 bp, Mus musculus
aaggtgcttatttatggttctccag

SEQ ID NO: 64081 - DNA, 25 bp, Mus musculus
aaggtgcttgctaagcttgacctta

SEQ ID NO: 64082 - DNA, 25 bp, Mus musculus
aaggtgcttgctacccaacttgtga

SEQ ID NO: 64083 - DNA, 25 bp, Mus musculus
aaggtgcttgcttagcttgacctta

SEQ ID NO: 64084 - DNA, 25 bp, Mus musculus
aaggtgcttgcttcccaacttgtga

SEQ ID NO: 64085 - DNA, 25 bp, Mus musculus
aaggtgcttgtcaactgtgtcagcc

SEQ ID NO: 64086 - DNA, 25 bp, Mus musculus
aaggtgcttgtctactgtgtcagcc

SEQ ID NO: 64087 - DNA, 25 bp, Mus musculus
aaggtgctttaacgttgctgactgc

SEQ ID NO: 64088 - DNA, 25 bp, Mus musculus
aaggtgctttaaggttgctgactgc

SEQ ID NO: 64089 - DNA, 25 bp, Mus musculus
aaggtgctttctcaaccattctcaa

SEQ ID NO: 64090 - DNA, 25 bp, Mus musculus
aaggtgctttctccttactgactta

SEQ ID NO: 64091 - DNA, 25 bp, Mus musculus
aaggtgctttctgaaccattctcaa

SEQ ID NO: 64092 - DNA, 25 bp, Mus musculus
aaggtgctttctgcttactgactta

SEQ ID NO: 64093 - DNA, 25 bp, Mus musculus
aaggtgcttttccagtcggacatct

SEQ ID NO: 64094 - DNA, 25 bp, Mus musculus
aaggtgcttttcgagtcggacatct

SEQ ID NO: 64095 - DNA, 25 bp, Mus musculus
aaggtgctttttcttacagcggtga

SEQ ID NO: 64096 - DNA, 25 bp, Mus musculus
aaggtgctttttgttacagcggtga

SEQ ID NO: 64097 - DNA, 25 bp, Mus musculus
aaggtggaacccaggcagagcccct

SEQ ID NO: 64098 - DNA, 25 bp, Mus musculus
aaggtggaaccctggcagagcccct

SEQ ID NO: 64099 - DNA, 25 bp, Mus musculus
aaggtggaacgcagattgcccggaa

SEQ ID NO: 64100 - DNA, 25 bp, Mus musculus
aaggtggaacgctgattgcccggaa

SEQ ID NO: 64101 - DNA, 25 bp, Mus musculus
aaggtggaatccagattagtggctc

SEQ ID NO: 64102 - DNA, 25 bp, Mus musculus
aaggtggaatcctgattagtggctc

SEQ ID NO: 64103 - DNA, 25 bp, Mus musculus
aaggtggacaatagcagcctgctga

SEQ ID NO: 64104 - DNA, 25 bp, Mus musculus
aaggtggacaattgcagcctgctga

SEQ ID NO: 64105 - DNA, 25 bp, Mus musculus
aaggtggacaccaagccctggagat

SEQ ID NO: 64106 - DNA, 25 bp, Mus musculus
aaggtggacacctagccctggagat

SEQ ID NO: 64107 - DNA, 25 bp, Mus musculus
aaggtggactccagttcagaccgag

SEQ ID NO: 64108 - DNA, 25 bp, Mus musculus
aaggtggactcctgttcagaccgag

SEQ ID NO: 64109 - DNA, 25 bp, Mus musculus
aaggtggactttacgatgcccaggg

SEQ ID NO: 64110 - DNA, 25 bp, Mus musculus
aaggtggacttttcgatgcccaggg

SEQ ID NO: 64111 - DNA, 25 bp, Mus musculus
aaggtggagagaaaactgccccgaa

SEQ ID NO: 64112 - DNA, 25 bp, Mus musculus
aaggtggagagataactgccccgaa

SEQ ID NO: 64113 - DNA, 25 bp, Mus musculus
aaggtggagaggacgcacgcccctt

SEQ ID NO: 64114 - DNA, 25 bp, Mus musculus
aaggtggagaggtcgcacgcccctt

SEQ ID NO: 64115 - DNA, 25 bp, Mus musculus
aaggtggagatcagaggctacttct

SEQ ID NO: 64116 - DNA, 25 bp, Mus musculus
aaggtggagatctgaggctacttct

SEQ ID NO: 64117 - DNA, 25 bp, Mus musculus
aaggtggagcagcagctcaccccag

SEQ ID NO: 64118 - DNA, 25 bp, Mus musculus
aaggtggagcaggagctcaccccag

SEQ ID NO: 64119 - DNA, 25 bp, Mus musculus
aaggtggagccccagatccttggcc

SEQ ID NO: 64120 - DNA, 25 bp, Mus musculus
aaggtggagcccgagatccttggcc

SEQ ID NO: 64121 - DNA, 25 bp, Mus musculus
aaggtggagggcatccctaccatct

SEQ ID NO: 64122 - DNA, 25 bp, Mus musculus
aaggtggagggccacagactcccaa

SEQ ID NO: 64123 - DNA, 25 bp, Mus musculus
aaggtggagggcgacagactcccaa

SEQ ID NO: 64124 - DNA, 25 bp, Mus musculus
aaggtggagggcttccctaccatct

SEQ ID NO: 64125 - DNA, 25 bp, Mus musculus
aaggtggatgttcgcatgattgact

SEQ ID NO: 64126 - DNA, 25 bp, Mus musculus
aaggtggatgttggcatgattgact

SEQ ID NO: 64127 - DNA, 25 bp, Mus musculus
aaggtggattacaatgaacagggca

SEQ ID NO: 64128 - DNA, 25 bp, Mus musculus
aaggtggattacagaccctgcactg

SEQ ID NO: 64129 - DNA, 25 bp, Mus musculus
aaggtggattactatgaacagggca

SEQ ID NO: 64130 - DNA, 25 bp, Mus musculus
aaggtggattactgaccctgcactg

SEQ ID NO: 64131 - DNA, 25 bp, Mus musculus
aaggtggattcacggtccgactgcc

SEQ ID NO: 64132 - DNA, 25 bp, Mus musculus
aaggtggattcagggtccgactgcc

SEQ ID NO: 64133 - DNA, 25 bp, Mus musculus
aaggtggcaaacagggcccaccaca

SEQ ID NO: 64134 - DNA, 25 bp, Mus musculus
aaggtggcaaactgggcccaccaca

SEQ ID NO: 64135 - DNA, 25 bp, Mus musculus
aaggtggcaccaagatgaaacttaa

SEQ ID NO: 64136 - DNA, 25 bp, Mus musculus
aaggtggcaccatgatgaaacttaa

SEQ ID NO: 64137 - DNA, 25 bp, Mus musculus
aaggtggcacccacaaggttccaat

SEQ ID NO: 64138 - DNA, 25 bp, Mus musculus
aaggtggcaccctcaaggttccaat

SEQ ID NO: 64139 - DNA, 25 bp, Mus musculus
aaggtggcagagagctccctgcctg

SEQ ID NO: 64140 - DNA, 25 bp, Mus musculus
aaggtggcagagtgctccctgcctg

SEQ ID NO: 64141 - DNA, 25 bp, Mus musculus
aaggtggcagctcttcaaagaattt

SEQ ID NO: 64142 - DNA, 25 bp, Mus musculus
aaggtggcagctgttcaaagaattt

SEQ ID NO: 64143 - DNA, 25 bp, Mus musculus
aaggtggcagtgatctccatacaga

SEQ ID NO: 64144 - DNA, 25 bp, Mus musculus
aaggtggcagtgttctccatacaga

SEQ ID NO: 64145 - DNA, 25 bp, Mus musculus
aaggtggcatggagtctgacgctcc

SEQ ID NO: 64146 - DNA, 25 bp, Mus musculus
aaggtggcatggtgtctgacgctcc

SEQ ID NO: 64147 - DNA, 25 bp, Mus musculus
aaggtggcatgtatcctccactctt

SEQ ID NO: 64148 - DNA, 25 bp, Mus musculus
aaggtggcatgtttcctccactctt

SEQ ID NO: 64149 - DNA, 25 bp, Mus musculus
aaggtggcccatacacttacaggct

SEQ ID NO: 64150 - DNA, 25 bp, Mus musculus
aaggtggcccattcacttacaggct

SEQ ID NO: 64151 - DNA, 25 bp, Mus musculus
aaggtggccctcaggcctgagtttt

SEQ ID NO: 64152 - DNA, 25 bp, Mus musculus
aaggtggccctctggcctgagtttt

SEQ ID NO: 64153 - DNA, 25 bp, Mus musculus
aaggtggcggcgacagctggatgat

SEQ ID NO: 64154 - DNA, 25 bp, Mus musculus
aaggtggcggcgtcagctggatgat

SEQ ID NO: 64155 - DNA, 25 bp, Mus musculus
aaggtggcgtgaaccatggtgtcaa

SEQ ID NO: 64156 - DNA, 25 bp, Mus musculus
aaggtggcgtgatccatggtgtcaa

SEQ ID NO: 64157 - DNA, 25 bp, Mus musculus
aaggtggctatcatccagtgaaaat

SEQ ID NO: 64158 - DNA, 25 bp, Mus musculus
aaggtggctatcttccagtgaaaat

SEQ ID NO: 64159 - DNA, 25 bp, Mus musculus
aaggtggctattctctttaaactgc

SEQ ID NO: 64160 - DNA, 25 bp, Mus musculus
aaggtggctattgtctttaaactgc

SEQ ID NO: 64161 - DNA, 25 bp, Mus musculus
aaggtggctctacctaactgttcca

SEQ ID NO: 64162 - DNA, 25 bp, Mus musculus
aaggtggctctagctaactgttcca

SEQ ID NO: 64163 - DNA, 25 bp, Mus musculus
aaggtggctgcgagacatgtcattc

SEQ ID NO: 64164 - DNA, 25 bp, Mus musculus
aaggtggctgcgtgacatgtcattc

SEQ ID NO: 64165 - DNA, 25 bp, Mus musculus
aaggtggcttctacatctctaccca

SEQ ID NO: 64166 - DNA, 25 bp, Mus musculus
aaggtggcttcttcatctctaccca

SEQ ID NO: 64167 - DNA, 25 bp, Mus musculus
aaggtgggacgaaatcagcagaaga

SEQ ID NO: 64168 - DNA, 25 bp, Mus musculus
aaggtgggacgatatcagcagaaga

SEQ ID NO: 64169 - DNA, 25 bp, Mus musculus
aaggtgggatgcaccattcctagtc

SEQ ID NO: 64170 - DNA, 25 bp, Mus musculus
aaggtgggatgctccattcctagtc

SEQ ID NO: 64171 - DNA, 25 bp, Mus musculus
aaggtgggcagcaactggcacacct

SEQ ID NO: 64172 - DNA, 25 bp, Mus musculus
aaggtgggcagctactggcacacct

SEQ ID NO: 64173 - DNA, 25 bp, Mus musculus
aaggtgggctgcaccctaaggacct

SEQ ID NO: 64174 - DNA, 25 bp, Mus musculus
aaggtgggctgctccctaaggacct

SEQ ID NO: 64175 - DNA, 25 bp, Mus musculus
aaggtgggcttcagtgacctgagac

SEQ ID NO: 64176 - DNA, 25 bp, Mus musculus
aaggtgggcttctgtgacctgagac

SEQ ID NO: 64177 - DNA, 25 bp, Mus musculus
aaggtgggtataacagtctctgcag

SEQ ID NO: 64178 - DNA, 25 bp, Mus musculus
aaggtgggtatatcagtctctgcag

SEQ ID NO: 64179 - DNA, 25 bp, Mus musculus
aaggtgggtgctcagacatcagaat

SEQ ID NO: 64180 - DNA, 25 bp, Mus musculus
aaggtgggtgctgagacatcagaat

SEQ ID NO: 64181 - DNA, 25 bp, Mus musculus
aaggtgggttggcaagcctctcact

SEQ ID NO: 64182 - DNA, 25 bp, Mus musculus
aaggtgggttgggaagcctctcact

SEQ ID NO: 64183 - DNA, 25 bp, Mus musculus
aaggtggtacagcttgcagaaagca

SEQ ID NO: 64184 - DNA, 25 bp, Mus musculus
aaggtggtacaggttgcagaaagca

SEQ ID NO: 64185 - DNA, 25 bp, Mus musculus
aaggtggtatcacctctatcacgct

SEQ ID NO: 64186 - DNA, 25 bp, Mus musculus
aaggtggtatcagctctatcacgct

SEQ ID NO: 64187 - DNA, 25 bp, Mus musculus
aaggtggtattcacccaaatcactc

SEQ ID NO: 64188 - DNA, 25 bp, Mus musculus
aaggtggtattctcccaaatcactc

SEQ ID NO: 64189 - DNA, 25 bp, Mus musculus
aaggtggtcaaccccacagcacagc

SEQ ID NO: 64190 - DNA, 25 bp, Mus musculus
aaggtggtcaacgccacagcacagc

SEQ ID NO: 64191 - DNA, 25 bp, Mus musculus
aaggtggtcaccaatgcccgcagtc

SEQ ID NO: 64192 - DNA, 25 bp, Mus musculus
aaggtggtcacctatgcccgcagtc

SEQ ID NO: 64193 - DNA, 25 bp, Mus musculus
aaggtggtcgtcctcggaaccacag

SEQ ID NO: 64194 - DNA, 25 bp, Mus musculus
aaggtggtcgtcgtcggaaccacag

SEQ ID NO: 64195 - DNA, 25 bp, Mus musculus
aaggtggtcgtgatcatcaagccca

SEQ ID NO: 64196 - DNA, 25 bp, Mus musculus
aaggtggtcgtgttcatcaagccca

SEQ ID NO: 64197 - DNA, 25 bp, Mus musculus
aaggtggtctcacttccacaccaag

SEQ ID NO: 64198 - DNA, 25 bp, Mus musculus
aaggtggtctcagttccacaccaag

SEQ ID NO: 64199 - DNA, 25 bp, Mus musculus
aaggtggtctgaaggcactgtccct

SEQ ID NO: 64200 - DNA, 25 bp, Mus musculus
aaggtggtctgatggcactgtccct

SEQ ID NO: 64201 - DNA, 25 bp, Mus musculus
aaggtggtgactactggtgacatag

SEQ ID NO: 64202 - DNA, 25 bp, Mus musculus
aaggtggtgacttctggtgacatag

SEQ ID NO: 64203 - DNA, 25 bp, Mus musculus
aaggtggtgattctgatggcccttc

SEQ ID NO: 64204 - DNA, 25 bp, Mus musculus
aaggtggtgattgtgatggcccttc

SEQ ID NO: 64205 - DNA, 25 bp, Mus musculus
aaggtggtgcagactttccggtacg

SEQ ID NO: 64206 - DNA, 25 bp, Mus musculus
aaggtggtgcagtctttccggtacg

SEQ ID NO: 64207 - DNA, 25 bp, Mus musculus
aaggtggtgcccacatctatgtctg

SEQ ID NO: 64208 - DNA, 25 bp, Mus musculus
aaggtggtgccctcatctatgtctg

SEQ ID NO: 64209 - DNA, 25 bp, Mus musculus
aaggtggtgccgactcctatagtga

SEQ ID NO: 64210 - DNA, 25 bp, Mus musculus
aaggtggtgccgtctcctatagtga

SEQ ID NO: 64211 - DNA, 25 bp, Mus musculus
aaggtggtgctacccgagaccacca

SEQ ID NO: 64212 - DNA, 25 bp, Mus musculus
aaggtggtgctagccgagaccacca

SEQ ID NO: 64213 - DNA, 25 bp, Mus musculus
aaggtggtggcaaggccagccagga

SEQ ID NO: 64214 - DNA, 25 bp, Mus musculus
aaggtggtggcatggccagccagga

SEQ ID NO: 64215 - DNA, 25 bp, Mus musculus
aaggtggtggctatgtaaccctggc

SEQ ID NO: 64216 - DNA, 25 bp, Mus musculus
aaggtggtggctttgtaaccctggc

SEQ ID NO: 64217 - DNA, 25 bp, Mus musculus
aaggtggttacccagatcactgtcc

SEQ ID NO: 64218 - DNA, 25 bp, Mus musculus
aaggtggttaccgagatcactgtcc

SEQ ID NO: 64219 - DNA, 25 bp, Mus musculus
aaggtggttactctggcattctgct

SEQ ID NO: 64220 - DNA, 25 bp, Mus musculus
aaggtggttactgtggcattctgct

SEQ ID NO: 64221 - DNA, 25 bp, Mus musculus
aaggtggttcacagtaagccgctgg

SEQ ID NO: 64222 - DNA, 25 bp, Mus musculus
aaggtggttcactgtaagccgctgg

SEQ ID NO: 64223 - DNA, 25 bp, Mus musculus
aaggtggttgctcctgagcctaatg

SEQ ID NO: 64224 - DNA, 25 bp, Mus musculus
aaggtggttgctgctgagcctaatg

SEQ ID NO: 64225 - DNA, 25 bp, Mus musculus
aaggtggttgttctaagctaagtat

SEQ ID NO: 64226 - DNA, 25 bp, Mus musculus
aaggtggttgttgtaagctaagtat

SEQ ID NO: 64227 - DNA, 25 bp, Mus musculus
aaggtgtacatgaagcacaagtgac

SEQ ID NO: 64228 - DNA, 25 bp, Mus musculus
aaggtgtacatgtagcacaagtgac

SEQ ID NO: 64229 - DNA, 25 bp, Mus musculus
aaggtgtagaaacaacgcccatgtt

SEQ ID NO: 64230 - DNA, 25 bp, Mus musculus
aaggtgtagaaagaacgcccatgtt

SEQ ID NO: 64231 - DNA, 25 bp, Mus musculus
aaggtgtagacaatcctagggacat

SEQ ID NO: 64232 - DNA, 25 bp, Mus musculus
aaggtgtagacattcctagggacat

SEQ ID NO: 64233 - DNA, 25 bp, Mus musculus
aaggtgtagtcccttattgccacag

SEQ ID NO: 64234 - DNA, 25 bp, Mus musculus
aaggtgtagtccgttattgccacag

SEQ ID NO: 64235 - DNA, 25 bp, Mus musculus
aaggtgtatatgcattgccccttct

SEQ ID NO: 64236 - DNA, 25 bp, Mus musculus
aaggtgtatatggattgccccttct

SEQ ID NO: 64237 - DNA, 25 bp, Mus musculus
aaggtgtatgaaaggctgtcagccg

SEQ ID NO: 64238 - DNA, 25 bp, Mus musculus
aaggtgtatgaatggctgtcagccg

SEQ ID NO: 64239 - DNA, 25 bp, Mus musculus
aaggtgtatgacaagctcttcccac

SEQ ID NO: 64240 - DNA, 25 bp, Mus musculus
aaggtgtatgactagctcttcccac

SEQ ID NO: 64241 - DNA, 25 bp, Mus musculus
aaggtgtattgcctcttagcagaga

SEQ ID NO: 64242 - DNA, 25 bp, Mus musculus
aaggtgtattgcgtcttagcagaga

SEQ ID NO: 64243 - DNA, 25 bp, Mus musculus
aaggtgtcacctctctaagcttttc

SEQ ID NO: 64244 - DNA, 25 bp, Mus musculus
aaggtgtcacctgtctaagcttttc

SEQ ID NO: 64245 - DNA, 25 bp, Mus musculus
aaggtgtcacggaccttgcagacca

SEQ ID NO: 64246 - DNA, 25 bp, Mus musculus
aaggtgtcacggtccttgcagacca

SEQ ID NO: 64247 - DNA, 25 bp, Mus musculus
aaggtgtcactgctcctagatgaat

SEQ ID NO: 64248 - DNA, 25 bp, Mus musculus
aaggtgtcactggtcctagatgaat

SEQ ID NO: 64249 - DNA, 25 bp, Mus musculus
aaggtgtcagtcactgtgctctgct

SEQ ID NO: 64250 - DNA, 25 bp, Mus musculus
aaggtgtcagtctctgtgctctgct

SEQ ID NO: 64251 - DNA, 25 bp, Mus musculus
aaggtgtcatgtcttctaagcagga

SEQ ID NO: 64252 - DNA, 25 bp, Mus musculus
aaggtgtcatgtgttctaagcagga

SEQ ID NO: 64253 - DNA, 25 bp, Mus musculus
aaggtgtccaatagccctatctctg

SEQ ID NO: 64254 - DNA, 25 bp, Mus musculus
aaggtgtccaattgccctatctctg

SEQ ID NO: 64255 - DNA, 25 bp, Mus musculus
aaggtgtccacgacgggccagatcc

SEQ ID NO: 64256 - DNA, 25 bp, Mus musculus
aaggtgtccacgtcgggccagatcc

SEQ ID NO: 64257 - DNA, 25 bp, Mus musculus
aaggtgtccaggacgggactcttga

SEQ ID NO: 64258 - DNA, 25 bp, Mus musculus
aaggtgtccaggtcgggactcttga

SEQ ID NO: 64259 - DNA, 25 bp, Mus musculus
aaggtgtccatgcatctgcgggcca

SEQ ID NO: 64260 - DNA, 25 bp, Mus musculus
aaggtgtccatggatctgcgggcca

SEQ ID NO: 64261 - DNA, 25 bp, Mus musculus
aaggtgtccattctccgcagcaggt

SEQ ID NO: 64262 - DNA, 25 bp, Mus musculus
aaggtgtccattgtccgcagcaggt

SEQ ID NO: 64263 - DNA, 25 bp, Mus musculus
aaggtgtcccctacaggaaacatct

SEQ ID NO: 64264 - DNA, 25 bp, Mus musculus
aaggtgtccccttcaggaaacatct

SEQ ID NO: 64265 - DNA, 25 bp, Mus musculus
aaggtgtccctgaacagctgtcagc

SEQ ID NO: 64266 - DNA, 25 bp, Mus musculus
aaggtgtccctgacaccccatggtg

SEQ ID NO: 64267 - DNA, 25 bp, Mus musculus
aaggtgtccctgtacagctgtcagc

SEQ ID NO: 64268 - DNA, 25 bp, Mus musculus
aaggtgtccctgtcaccccatggtg

SEQ ID NO: 64269 - DNA, 25 bp, Mus musculus
aaggtgtcccttcgatcatagttga

SEQ ID NO: 64270 - DNA, 25 bp, Mus musculus
aaggtgtcccttggatcatagttga

SEQ ID NO: 64271 - DNA, 25 bp, Mus musculus
aaggtgtcctccctgcaggtaagat

SEQ ID NO: 64272 - DNA, 25 bp, Mus musculus
aaggtgtcctccgtgcaggtaagat

SEQ ID NO: 64273 - DNA, 25 bp, Mus musculus
aaggtgtcctctcatggccacacgg

SEQ ID NO: 64274 - DNA, 25 bp, Mus musculus
aaggtgtcctctgatggccacacgg

SEQ ID NO: 64275 - DNA, 25 bp, Mus musculus
aaggtgtcctggctgtatgcactca

SEQ ID NO: 64276 - DNA, 25 bp, Mus musculus
aaggtgtcctgggtgtatgcactca

SEQ ID NO: 64277 - DNA, 25 bp, Mus musculus
aaggtgtccttcaacctctatgtat

SEQ ID NO: 64278 - DNA, 25 bp, Mus musculus
aaggtgtccttctacctctatgtat

SEQ ID NO: 64279 - DNA, 25 bp, Mus musculus
aaggtgtcgcctcttactgaattgg

SEQ ID NO: 64280 - DNA, 25 bp, Mus musculus
aaggtgtcgcctgttactgaattgg

SEQ ID NO: 64281 - DNA, 25 bp, Mus musculus
aaggtgtcggacaatgtgcaggaca

SEQ ID NO: 64282 - DNA, 25 bp, Mus musculus
aaggtgtcggactatgtgcaggaca

SEQ ID NO: 64283 - DNA, 25 bp, Mus musculus
aaggtgtcggtccatagtgtacaga

SEQ ID NO: 64284 - DNA, 25 bp, Mus musculus
aaggtgtcggtcgatagtgtacaga

SEQ ID NO: 64285 - DNA, 25 bp, Mus musculus
aaggtgtctcctctcagtgcaggga

SEQ ID NO: 64286 - DNA, 25 bp, Mus musculus
aaggtgtctcctgtcagtgcaggga

SEQ ID NO: 64287 - DNA, 25 bp, Mus musculus
aaggtgtctgagaaattctggatcc

SEQ ID NO: 64288 - DNA, 25 bp, Mus musculus
aaggtgtctgagtaattctggatcc

SEQ ID NO: 64289 - DNA, 25 bp, Mus musculus
aaggtgtcttgcagcaggtaactaa

SEQ ID NO: 64290 - DNA, 25 bp, Mus musculus
aaggtgtcttgctgcaggtaactaa

SEQ ID NO: 64291 - DNA, 25 bp, Mus musculus
aaggtgtgaaaaccgtcttcttcgg

SEQ ID NO: 64292 - DNA, 25 bp, Mus musculus
aaggtgtgaaaagcgtcttcttcgg

SEQ ID NO: 64293 - DNA, 25 bp, Mus musculus
aaggtgtgaatacgttctgtactcc

SEQ ID NO: 64294 - DNA, 25 bp, Mus musculus
aaggtgtgaataggttctgtactcc

SEQ ID NO: 64295 - DNA, 25 bp, Mus musculus
aaggtgtgacacactaggtttggtt

SEQ ID NO: 64296 - DNA, 25 bp, Mus musculus
aaggtgtgacactctaggtttggtt

SEQ ID NO: 64297 - DNA, 25 bp, Mus musculus
aaggtgtgactcatagccgtctatg

SEQ ID NO: 64298 - DNA, 25 bp, Mus musculus
aaggtgtgactcttagccgtctatg

SEQ ID NO: 64299 - DNA, 25 bp, Mus musculus
aaggtgtgatacatacaggttttaa

SEQ ID NO: 64300 - DNA, 25 bp, Mus musculus
aaggtgtgatacttacaggttttaa

SEQ ID NO: 64301 - DNA, 25 bp, Mus musculus
aaggtgtgcaccaggacagctaggc

SEQ ID NO: 64302 - DNA, 25 bp, Mus musculus
aaggtgtgcacctggacagctaggc

SEQ ID NO: 64303 - DNA, 25 bp, Mus musculus
aaggtgtgcagcctatatgatacgc

SEQ ID NO: 64304 - DNA, 25 bp, Mus musculus
aaggtgtgcagcgtatatgatacgc

SEQ ID NO: 64305 - DNA, 25 bp, Mus musculus
aaggtgtgcatcaagcgactgtggc

SEQ ID NO: 64306 - DNA, 25 bp, Mus musculus
aaggtgtgcatctagcgactgtggc

SEQ ID NO: 64307 - DNA, 25 bp, Mus musculus
aaggtgtgcatgagaccgcccagtt

SEQ ID NO: 64308 - DNA, 25 bp, Mus musculus
aaggtgtgcatgtgaccgcccagtt

SEQ ID NO: 64309 - DNA, 25 bp, Mus musculus
aaggtgtgccacagtgtcattgcag

SEQ ID NO: 64310 - DNA, 25 bp, Mus musculus
aaggtgtgccactgtgtcattgcag

SEQ ID NO: 64311 - DNA, 25 bp, Mus musculus
aaggtgtgcctgcaccgagccgtct

SEQ ID NO: 64312 - DNA, 25 bp, Mus musculus
aaggtgtgcctggaccgagccgtct

SEQ ID NO: 64313 - DNA, 25 bp, Mus musculus
aaggtgtgccttacccttgggcgca

SEQ ID NO: 64314 - DNA, 25 bp, Mus musculus
aaggtgtgcctttcccttgggcgca

SEQ ID NO: 64315 - DNA, 25 bp, Mus musculus
aaggtgtgcgttcagcctttagcaa

SEQ ID NO: 64316 - DNA, 25 bp, Mus musculus
aaggtgtgcgttgagcctttagcaa

SEQ ID NO: 64317 - DNA, 25 bp, Mus musculus
aaggtgtggactagaaagctggttc

SEQ ID NO: 64318 - DNA, 25 bp, Mus musculus
aaggtgtggacttgaaagctggttc

SEQ ID NO: 64319 - DNA, 25 bp, Mus musculus
aaggtgtggcttagctttagtcttc

SEQ ID NO: 64320 - DNA, 25 bp, Mus musculus
aaggtgtggctttgctttagtcttc

SEQ ID NO: 64321 - DNA, 25 bp, Mus musculus
aaggtgtgtaatagggtctctctgc

SEQ ID NO: 64322 - DNA, 25 bp, Mus musculus
aaggtgtgtaattgggtctctctgc

SEQ ID NO: 64323 - DNA, 25 bp, Mus musculus
aaggtgtgtgccatcacatccacca

SEQ ID NO: 64324 - DNA, 25 bp, Mus musculus
aaggtgtgtgccttcacatccacca

SEQ ID NO: 64325 - DNA, 25 bp, Mus musculus
aaggtgtgtggacaaatgcgctttc

SEQ ID NO: 64326 - DNA, 25 bp, Mus musculus
aaggtgtgtggagaaatgcgctttc

SEQ ID NO: 64327 - DNA, 25 bp, Mus musculus
aaggtgtgtggccttcttcaacttt

SEQ ID NO: 64328 - DNA, 25 bp, Mus musculus
aaggtgtgtggcgttcttcaacttt

SEQ ID NO: 64329 - DNA, 25 bp, Mus musculus
aaggtgtgtggtaccacatctggcc

SEQ ID NO: 64330 - DNA, 25 bp, Mus musculus
aaggtgtgtggttccacatctggcc

SEQ ID NO: 64331 - DNA, 25 bp, Mus musculus
aaggtgtgtgttaatgctatgcatc

SEQ ID NO: 64332 - DNA, 25 bp, Mus musculus
aaggtgtgtgttccggcttgaatct

SEQ ID NO: 64333 - DNA, 25 bp, Mus musculus
aaggtgtgtgttgcggcttgaatct

SEQ ID NO: 64334 - DNA, 25 bp, Mus musculus
aaggtgtgtgtttatgctatgcatc

SEQ ID NO: 64335 - DNA, 25 bp, Mus musculus
aaggtgtgttccctgacacgatttg

SEQ ID NO: 64336 - DNA, 25 bp, Mus musculus
aaggtgtgttccgtgacacgatttg

SEQ ID NO: 64337 - DNA, 25 bp, Mus musculus
aaggtgtgttctctgacgtcagtca

SEQ ID NO: 64338 - DNA, 25 bp, Mus musculus
aaggtgtgttctgtgacgtcagtca

SEQ ID NO: 64339 - DNA, 25 bp, Mus musculus
aaggtgtgtttgaccatcggatgaa

SEQ ID NO: 64340 - DNA, 25 bp, Mus musculus
aaggtgtgtttgtccatcggatgaa

SEQ ID NO: 64341 - DNA, 25 bp, Mus musculus
aaggtgttacacagtgaacttcaca

SEQ ID NO: 64342 - DNA, 25 bp, Mus musculus
aaggtgttacactgtgaacttcaca

SEQ ID NO: 64343 - DNA, 25 bp, Mus musculus
aaggtgttagttcacgctccatgtt

SEQ ID NO: 64344 - DNA, 25 bp, Mus musculus
aaggtgttagttgacgctccatgtt

SEQ ID NO: 64345 - DNA, 25 bp, Mus musculus
aaggtgttatatcagttcccagtct

SEQ ID NO: 64346 - DNA, 25 bp, Mus musculus
aaggtgttatatgagttcccagtct

SEQ ID NO: 64347 - DNA, 25 bp, Mus musculus
aaggtgttccctaatagccaatccg

SEQ ID NO: 64348 - DNA, 25 bp, Mus musculus
aaggtgttcccttatagccaatccg

SEQ ID NO: 64349 - DNA, 25 bp, Mus musculus
aaggtgttcgacattgagcgctcag

SEQ ID NO: 64350 - DNA, 25 bp, Mus musculus
aaggtgttcgactttgagcgctcag

SEQ ID NO: 64351 - DNA, 25 bp, Mus musculus
aaggtgttctaaatctgaggcactt

SEQ ID NO: 64352 - DNA, 25 bp, Mus musculus
aaggtgttctaattctgaggcactt

SEQ ID NO: 64353 - DNA, 25 bp, Mus musculus
aaggtgttctgcatgttctacgcgc

SEQ ID NO: 64354 - DNA, 25 bp, Mus musculus
aaggtgttctgcttgttctacgcgc

SEQ ID NO: 64355 - DNA, 25 bp, Mus musculus
aaggtgttcttgaatttgctgccta

SEQ ID NO: 64356 - DNA, 25 bp, Mus musculus
aaggtgttcttgtatttgctgccta

SEQ ID NO: 64357 - DNA, 25 bp, Mus musculus
aaggtgttgaaccagtggatccaga

SEQ ID NO: 64358 - DNA, 25 bp, Mus musculus
aaggtgttgaacgagtggatccaga

SEQ ID NO: 64359 - DNA, 25 bp, Mus musculus
aaggtgttgccaccaggcggcatca

SEQ ID NO: 64360 - DNA, 25 bp, Mus musculus
aaggtgttgccagcaggcggcatca

SEQ ID NO: 64361 - DNA, 25 bp, Mus musculus
aaggtgttgcttcaatcggccaaag

SEQ ID NO: 64362 - DNA, 25 bp, Mus musculus
aaggtgttgcttgaatcggccaaag

SEQ ID NO: 64363 - DNA, 25 bp, Mus musculus
aaggtgttggagctagaccctgccc

SEQ ID NO: 64364 - DNA, 25 bp, Mus musculus
aaggtgttggaggtagaccctgccc

SEQ ID NO: 64365 - DNA, 25 bp, Mus musculus
aaggtgttggatccccaagaactga

SEQ ID NO: 64366 - DNA, 25 bp, Mus musculus
aaggtgttggatgcccaagaactga

SEQ ID NO: 64367 - DNA, 25 bp, Mus musculus
aaggtgtttccaagacctgaccaga

SEQ ID NO: 64368 - DNA, 25 bp, Mus musculus
aaggtgtttccatgacctgaccaga

SEQ ID NO: 64369 - DNA, 25 bp, Mus musculus
aaggtgtttgccctggactagaact

SEQ ID NO: 64370 - DNA, 25 bp, Mus musculus
aaggtgtttgccgtggactagaact

SEQ ID NO: 64371 - DNA, 25 bp, Mus musculus
aaggtgtttggacaccggactcact

SEQ ID NO: 64372 - DNA, 25 bp, Mus musculus
aaggtgtttggagaccggactcact

SEQ ID NO: 64373 - DNA, 25 bp, Mus musculus
aaggtgtttggtcccacacccgaag

SEQ ID NO: 64374 - DNA, 25 bp, Mus musculus
aaggtgtttggtgccacacccgaag

SEQ ID NO: 64375 - DNA, 25 bp, Mus musculus
aaggtgtttgtcctttctctctgta

SEQ ID NO: 64376 - DNA, 25 bp, Mus musculus
aaggtgtttgtcgtttctctctgta

SEQ ID NO: 64377 - DNA, 25 bp, Mus musculus
aaggtgtttgttaagcccctctgca

SEQ ID NO: 64378 - DNA, 25 bp, Mus musculus
aaggtgtttgttccaactcactaca

SEQ ID NO: 64379 - DNA, 25 bp, Mus musculus
aaggtgtttgttgcaactcactaca

SEQ ID NO: 64380 - DNA, 25 bp, Mus musculus
aaggtgtttgtttagcccctctgca

SEQ ID NO: 64381 - DNA, 25 bp, Mus musculus
aaggttaagatgaccctgacctagg

SEQ ID NO: 64382 - DNA, 25 bp, Mus musculus
aaggttaagatgtccctgacctagg

SEQ ID NO: 64383 - DNA, 25 bp, Mus musculus
aaggttaagctgatcccaggaatat

SEQ ID NO: 64384 - DNA, 25 bp, Mus musculus
aaggttaagctgttcccaggaatat

SEQ ID NO: 64385 - DNA, 25 bp, Mus musculus
aaggttaatataaccaggtgctcac

SEQ ID NO: 64386 - DNA, 25 bp, Mus musculus
aaggttaatatatccaggtgctcac

SEQ ID NO: 64387 - DNA, 25 bp, Mus musculus
aaggttaatgtgaatccagccccag

SEQ ID NO: 64388 - DNA, 25 bp, Mus musculus
aaggttaatgtgtatccagccccag

SEQ ID NO: 64389 - DNA, 25 bp, Mus musculus
aaggttacacccaggacaatagcca

SEQ ID NO: 64390 - DNA, 25 bp, Mus musculus
aaggttacaccctggacaatagcca

SEQ ID NO: 64391 - DNA, 25 bp, Mus musculus
aaggttacagagaatatggccctcc

SEQ ID NO: 64392 - DNA, 25 bp, Mus musculus
aaggttacagagtatatggccctcc

SEQ ID NO: 64393 - DNA, 25 bp, Mus musculus
aaggttacagatccagccatcttgg

SEQ ID NO: 64394 - DNA, 25 bp, Mus musculus
aaggttacagatgcagccatcttgg

SEQ ID NO: 64395 - DNA, 25 bp, Mus musculus
aaggttacatctacacatatcgagt

SEQ ID NO: 64396 - DNA, 25 bp, Mus musculus
aaggttacatcttcacatatcgagt

SEQ ID NO: 64397 - DNA, 25 bp, Mus musculus
aaggttacattgctgaccctgcagt

SEQ ID NO: 64398 - DNA, 25 bp, Mus musculus
aaggttacattggtgaccctgcagt

SEQ ID NO: 64399 - DNA, 25 bp, Mus musculus
aaggttaccatacttatgcaacaag

SEQ ID NO: 64400 - DNA, 25 bp, Mus musculus
aaggttaccatagttatgcaacaag

SEQ ID NO: 64401 - DNA, 25 bp, Mus musculus
aaggttacctctattttgccacaag

SEQ ID NO: 64402 - DNA, 25 bp, Mus musculus
aaggttacctcttttttgccacaag

SEQ ID NO: 64403 - DNA, 25 bp, Mus musculus
aaggttacctgcaagagcggcgtac

SEQ ID NO: 64404 - DNA, 25 bp, Mus musculus
aaggttacctgctagagcggcgtac

SEQ ID NO: 64405 - DNA, 25 bp, Mus musculus
aaggttactcggcaaggcaagttca

SEQ ID NO: 64406 - DNA, 25 bp, Mus musculus
aaggttactcgggaaggcaagttca

SEQ ID NO: 64407 - DNA, 25 bp, Mus musculus
aaggttagagagaaagacttcagaa

SEQ ID NO: 64408 - DNA, 25 bp, Mus musculus
aaggttagagagtaagacttcagaa

SEQ ID NO: 64409 - DNA, 25 bp, Mus musculus
aaggttatactcattctcgtggtta

SEQ ID NO: 64410 - DNA, 25 bp, Mus musculus
aaggttatactctttctcgtggtta

SEQ ID NO: 64411 - DNA, 25 bp, Mus musculus
aaggttatccacagtgcttgatgag

SEQ ID NO: 64412 - DNA, 25 bp, Mus musculus
aaggttatccactgtgcttgatgag

SEQ ID NO: 64413 - DNA, 25 bp, Mus musculus
aaggttatctcaacagcacacagcc

SEQ ID NO: 64414 - DNA, 25 bp, Mus musculus
aaggttatctcatcagcacacagcc

SEQ ID NO: 64415 - DNA, 25 bp, Mus musculus
aaggttatgatcagcctttccctgt

SEQ ID NO: 64416 - DNA, 25 bp, Mus musculus
aaggttatgatctgcctttccctgt

SEQ ID NO: 64417 - DNA, 25 bp, Mus musculus
aaggttatggcacatagttcaccac

SEQ ID NO: 64418 - DNA, 25 bp, Mus musculus
aaggttatggcagatagttcaccac

SEQ ID NO: 64419 - DNA, 25 bp, Mus musculus
aaggttattagaccactgtctggct

SEQ ID NO: 64420 - DNA, 25 bp, Mus musculus
aaggttattagagcactgtctggct

SEQ ID NO: 64421 - DNA, 25 bp, Mus musculus
aaggttattctaatcctggagagca

SEQ ID NO: 64422 - DNA, 25 bp, Mus musculus
aaggttattctattcctggagagca

SEQ ID NO: 64423 - DNA, 25 bp, Mus musculus
aaggttatttgcaacattgtgtgtt

SEQ ID NO: 64424 - DNA, 25 bp, Mus musculus
aaggttatttgctacattgtgtgtt

SEQ ID NO: 64425 - DNA, 25 bp, Mus musculus
aaggttcaacttccttgcagcttct

SEQ ID NO: 64426 - DNA, 25 bp, Mus musculus
aaggttcaacttgcttgcagcttct

SEQ ID NO: 64427 - DNA, 25 bp, Mus musculus
aaggttcaggtgatcttagcagagt

SEQ ID NO: 64428 - DNA, 25 bp, Mus musculus
aaggttcaggtgttcttagcagagt

SEQ ID NO: 64429 - DNA, 25 bp, Mus musculus
aaggttcatgtaaagccctggttta

SEQ ID NO: 64430 - DNA, 25 bp, Mus musculus
aaggttcatgtatagccctggttta

SEQ ID NO: 64431 - DNA, 25 bp, Mus musculus
aaggttccaagcagaacaccctgac

SEQ ID NO: 64432 - DNA, 25 bp, Mus musculus
aaggttccaagcatagctgctacat

SEQ ID NO: 64433 - DNA, 25 bp, Mus musculus
aaggttccaagctgaacaccctgac

SEQ ID NO: 64434 - DNA, 25 bp, Mus musculus
aaggttccaagcttagctgctacat

SEQ ID NO: 64435 - DNA, 25 bp, Mus musculus
aaggttccaccactcccaggaggat

SEQ ID NO: 64436 - DNA, 25 bp, Mus musculus
aaggttccaccagtcccaggaggat

SEQ ID NO: 64437 - DNA, 25 bp, Mus musculus
aaggttccagatccagctgagtgcg

SEQ ID NO: 64438 - DNA, 25 bp, Mus musculus
aaggttccagatgcagctgagtgcg

SEQ ID NO: 64439 - DNA, 25 bp, Mus musculus
aaggttccattaaagctcaaggctg

SEQ ID NO: 64440 - DNA, 25 bp, Mus musculus
aaggttccattatagctcaaggctg

SEQ ID NO: 64441 - DNA, 25 bp, Mus musculus
aaggttcccaaccatctatacagct

SEQ ID NO: 64442 - DNA, 25 bp, Mus musculus
aaggttcccaacgatctatacagct

SEQ ID NO: 64443 - DNA, 25 bp, Mus musculus
aaggttcccacaatccaggaacgtg

SEQ ID NO: 64444 - DNA, 25 bp, Mus musculus
aaggttcccacattccaggaacgtg

SEQ ID NO: 64445 - DNA, 25 bp, Mus musculus
aaggttcccgttcatcctcttgctt

SEQ ID NO: 64446 - DNA, 25 bp, Mus musculus
aaggttcccgttgatcctcttgctt

SEQ ID NO: 64447 - DNA, 25 bp, Mus musculus
aaggttcctcaacatgtggcgctgg

SEQ ID NO: 64448 - DNA, 25 bp, Mus musculus
aaggttcctcaagatgtggcgctgg

SEQ ID NO: 64449 - DNA, 25 bp, Mus musculus
aaggttcctgacctatctgaagtca

SEQ ID NO: 64450 - DNA, 25 bp, Mus musculus
aaggttcctgacgtatctgaagtca

SEQ ID NO: 64451 - DNA, 25 bp, Mus musculus
aaggttcctgccacagttgtttgag

SEQ ID NO: 64452 - DNA, 25 bp, Mus musculus
aaggttcctgcctcagttgtttgag

SEQ ID NO: 64453 - DNA, 25 bp, Mus musculus
aaggttcctggcagagattggctct

SEQ ID NO: 64454 - DNA, 25 bp, Mus musculus
aaggttcctggctgagattggctct

SEQ ID NO: 64455 - DNA, 25 bp, Mus musculus
aaggttcctgggaagctggtgcaat

SEQ ID NO: 64456 - DNA, 25 bp, Mus musculus
aaggttcctgggtagctggtgcaat

SEQ ID NO: 64457 - DNA, 25 bp, Mus musculus
aaggttcctgtaactgaccccactg

SEQ ID NO: 64458 - DNA, 25 bp, Mus musculus
aaggttcctgtatctgaccccactg

SEQ ID NO: 64459 - DNA, 25 bp, Mus musculus
aaggttcctgtcaagctttgataaa

SEQ ID NO: 64460 - DNA, 25 bp, Mus musculus
aaggttcctgtctagctttgataaa

SEQ ID NO: 64461 - DNA, 25 bp, Mus musculus
aaggttcgaaccaattggctcctcg

SEQ ID NO: 64462 - DNA, 25 bp, Mus musculus
aaggttcgaacctattggctcctcg

SEQ ID NO: 64463 - DNA, 25 bp, Mus musculus
aaggttcggcgcaaggagcccaaga

SEQ ID NO: 64464 - DNA, 25 bp, Mus musculus
aaggttcggcgctaggagcccaaga

SEQ ID NO: 64465 - DNA, 25 bp, Mus musculus
aaggttcggttaagcccagagccat

SEQ ID NO: 64466 - DNA, 25 bp, Mus musculus
aaggttcggttatgcccagagccat

SEQ ID NO: 64467 - DNA, 25 bp, Mus musculus
aaggttcgtaagcttctgcagctcc

SEQ ID NO: 64468 - DNA, 25 bp, Mus musculus
aaggttcgtaaggttctgcagctcc

SEQ ID NO: 64469 - DNA, 25 bp, Mus musculus
aaggttctacagagctaggtatcca

SEQ ID NO: 64470 - DNA, 25 bp, Mus musculus
aaggttctacagtgctaggtatcca

SEQ ID NO: 64471 - DNA, 25 bp, Mus musculus
aaggttctagaacatctcgaaagga

SEQ ID NO: 64472 - DNA, 25 bp, Mus musculus
aaggttctagaagatctcgaaagga

SEQ ID NO: 64473 - DNA, 25 bp, Mus musculus
aaggttctagctaattttgcactct

SEQ ID NO: 64474 - DNA, 25 bp, Mus musculus
aaggttctagcttattttgcactct

SEQ ID NO: 64475 - DNA, 25 bp, Mus musculus
aaggttctattgaggcttccctggg

SEQ ID NO: 64476 - DNA, 25 bp, Mus musculus
aaggttctattgtggcttccctggg

SEQ ID NO: 64477 - DNA, 25 bp, Mus musculus
aaggttctcactaagtagcttcact

SEQ ID NO: 64478 - DNA, 25 bp, Mus musculus
aaggttctcacttagtagcttcact

SEQ ID NO: 64479 - DNA, 25 bp, Mus musculus
aaggttctcagcacaacgtatagat

SEQ ID NO: 64480 - DNA, 25 bp, Mus musculus
aaggttctcagcaggctcctcctat

SEQ ID NO: 64481 - DNA, 25 bp, Mus musculus
aaggttctcagctcaacgtatagat

SEQ ID NO: 64482 - DNA, 25 bp, Mus musculus
aaggttctcagctggctcctcctat

SEQ ID NO: 64483 - DNA, 25 bp, Mus musculus
aaggttctcataagccatgtttgac

SEQ ID NO: 64484 - DNA, 25 bp, Mus musculus
aaggttctcatatgccatgtttgac

SEQ ID NO: 64485 - DNA, 25 bp, Mus musculus
aaggttctccagatggctgtgtgac

SEQ ID NO: 64486 - DNA, 25 bp, Mus musculus
aaggttctccagttggctgtgtgac

SEQ ID NO: 64487 - DNA, 25 bp, Mus musculus
aaggttctcctgacacattttctca

SEQ ID NO: 64488 - DNA, 25 bp, Mus musculus
aaggttctcctgtcacattttctca

SEQ ID NO: 64489 - DNA, 25 bp, Mus musculus
aaggttctctcactcggcggaagac

SEQ ID NO: 64490 - DNA, 25 bp, Mus musculus
aaggttctctcagtcggcggaagac

SEQ ID NO: 64491 - DNA, 25 bp, Mus musculus
aaggttctctccaccagagttcaca

SEQ ID NO: 64492 - DNA, 25 bp, Mus musculus
aaggttctctcctccagagttcaca

SEQ ID NO: 64493 - DNA, 25 bp, Mus musculus
aaggttctctgtctactccacgctg

SEQ ID NO: 64494 - DNA, 25 bp, Mus musculus
aaggttctctgtgtactccacgctg

SEQ ID NO: 64495 - DNA, 25 bp, Mus musculus
aaggttctcttcagctagagtgtac

SEQ ID NO: 64496 - DNA, 25 bp, Mus musculus
aaggttctcttctgctagagtgtac

SEQ ID NO: 64497 - DNA, 25 bp, Mus musculus
aaggttctgccaacaagcattctgc

SEQ ID NO: 64498 - DNA, 25 bp, Mus musculus
aaggttctgccatcaagcattctgc

SEQ ID NO: 64499 - DNA, 25 bp, Mus musculus
aaggttctgctaactctgagtccaa

SEQ ID NO: 64500 - DNA, 25 bp, Mus musculus
aaggttctgctatctctgagtccaa

SEQ ID NO: 64501 - DNA, 25 bp, Mus musculus
aaggttctggaacttctggcactgg

SEQ ID NO: 64502 - DNA, 25 bp, Mus musculus
aaggttctggaagttctggcactgg

SEQ ID NO: 64503 - DNA, 25 bp, Mus musculus
aaggttctggtgaccaccaacgtgt

SEQ ID NO: 64504 - DNA, 25 bp, Mus musculus
aaggttctggtgattgagctgagct

SEQ ID NO: 64505 - DNA, 25 bp, Mus musculus
aaggttctggtgtccaccaacgtgt

SEQ ID NO: 64506 - DNA, 25 bp, Mus musculus
aaggttctggtgtttgagctgagct

SEQ ID NO: 64507 - DNA, 25 bp, Mus musculus
aaggttctgtcgagaccgcccattc

SEQ ID NO: 64508 - DNA, 25 bp, Mus musculus
aaggttctgtcgctgaggccttctc

SEQ ID NO: 64509 - DNA, 25 bp, Mus musculus
aaggttctgtcggtgaggccttctc

SEQ ID NO: 64510 - DNA, 25 bp, Mus musculus
aaggttctgtcgtgaccgcccattc

SEQ ID NO: 64511 - DNA, 25 bp, Mus musculus
aaggttcttagacactcgcagcaca

SEQ ID NO: 64512 - DNA, 25 bp, Mus musculus
aaggttcttagagactcgcagcaca

SEQ ID NO: 64513 - DNA, 25 bp, Mus musculus
aaggttcttggcatgatgcagatgt

SEQ ID NO: 64514 - DNA, 25 bp, Mus musculus
aaggttcttggcttgatgcagatgt

SEQ ID NO: 64515 - DNA, 25 bp, Mus musculus
aaggttctttttactatggtcatga

SEQ ID NO: 64516 - DNA, 25 bp, Mus musculus
aaggttcttttttctatggtcatga

SEQ ID NO: 64517 - DNA, 25 bp, Mus musculus
aaggttgaacttcacggctcatcac

SEQ ID NO: 64518 - DNA, 25 bp, Mus musculus
aaggttgaacttgacggctcatcac

SEQ ID NO: 64519 - DNA, 25 bp, Mus musculus
aaggttgaatgcctccatgggtcct

SEQ ID NO: 64520 - DNA, 25 bp, Mus musculus
aaggttgaatgcgtccatgggtcct

SEQ ID NO: 64521 - DNA, 25 bp, Mus musculus
aaggttgacacaatctttcagatga

SEQ ID NO: 64522 - DNA, 25 bp, Mus musculus
aaggttgacacattctttcagatga

SEQ ID NO: 64523 - DNA, 25 bp, Mus musculus
aaggttgactctaagtgccatggga

SEQ ID NO: 64524 - DNA, 25 bp, Mus musculus
aaggttgactcttagtgccatggga

SEQ ID NO: 64525 - DNA, 25 bp, Mus musculus
aaggttgacttcaccatgactcaat

SEQ ID NO: 64526 - DNA, 25 bp, Mus musculus
aaggttgacttctccatgactcaat

SEQ ID NO: 64527 - DNA, 25 bp, Mus musculus
aaggttgagctcaatgccaggttcc

SEQ ID NO: 64528 - DNA, 25 bp, Mus musculus
aaggttgagctctatgccaggttcc

SEQ ID NO: 64529 - DNA, 25 bp, Mus musculus
aaggttgagtatagactggcttgca

SEQ ID NO: 64530 - DNA, 25 bp, Mus musculus
aaggttgagtattgactggcttgca

SEQ ID NO: 64531 - DNA, 25 bp, Mus musculus
aaggttgataggcttcagtctgaaa

SEQ ID NO: 64532 - DNA, 25 bp, Mus musculus
aaggttgatagggttcagtctgaaa

SEQ ID NO: 64533 - DNA, 25 bp, Mus musculus
aaggttgatgcacccagcctgaaag

SEQ ID NO: 64534 - DNA, 25 bp, Mus musculus
aaggttgatgcaccgcttcatacta

SEQ ID NO: 64535 - DNA, 25 bp, Mus musculus
aaggttgatgcagccagcctgaaag

SEQ ID NO: 64536 - DNA, 25 bp, Mus musculus
aaggttgatgcagcgcttcatacta

SEQ ID NO: 64537 - DNA, 25 bp, Mus musculus
aaggttgatgctactctggcttccc

SEQ ID NO: 64538 - DNA, 25 bp, Mus musculus
aaggttgatgcttctctggcttccc

SEQ ID NO: 64539 - DNA, 25 bp, Mus musculus
aaggttgattttacattgagaggtc

SEQ ID NO: 64540 - DNA, 25 bp, Mus musculus
aaggttgatttttcattgagaggtc

SEQ ID NO: 64541 - DNA, 25 bp, Mus musculus
aaggttgcaagtacaaatccccgag

SEQ ID NO: 64542 - DNA, 25 bp, Mus musculus
aaggttgcaagttcaaatccccgag

SEQ ID NO: 64543 - DNA, 25 bp, Mus musculus
aaggttgcacctctgtatgttggga

SEQ ID NO: 64544 - DNA, 25 bp, Mus musculus
aaggttgcacctgtgtatgttggga

SEQ ID NO: 64545 - DNA, 25 bp, Mus musculus
aaggttgcactccagtacttcaaga

SEQ ID NO: 64546 - DNA, 25 bp, Mus musculus
aaggttgcactcgagtacttcaaga

SEQ ID NO: 64547 - DNA, 25 bp, Mus musculus
aaggttgcagaaatcaccctggtga

SEQ ID NO: 64548 - DNA, 25 bp, Mus musculus
aaggttgcagaattcaccctggtga

SEQ ID NO: 64549 - DNA, 25 bp, Mus musculus
aaggttgcagttcgcaatattacta

SEQ ID NO: 64550 - DNA, 25 bp, Mus musculus
aaggttgcagttggcaatattacta

SEQ ID NO: 64551 - DNA, 25 bp, Mus musculus
aaggttgcatcccaatgtacgaatt

SEQ ID NO: 64552 - DNA, 25 bp, Mus musculus
aaggttgcatccgaatgtacgaatt

SEQ ID NO: 64553 - DNA, 25 bp, Mus musculus
aaggttgccatgaggatccctctgt

SEQ ID NO: 64554 - DNA, 25 bp, Mus musculus
aaggttgccatgtggatccctctgt

SEQ ID NO: 64555 - DNA, 25 bp, Mus musculus
aaggttgccgagctaatgcattcag

SEQ ID NO: 64556 - DNA, 25 bp, Mus musculus
aaggttgccgaggtaatgcattcag

SEQ ID NO: 64557 - DNA, 25 bp, Mus musculus
aaggttgcctcgcacaagcttacaa

SEQ ID NO: 64558 - DNA, 25 bp, Mus musculus
aaggttgcctcggacaagcttacaa

SEQ ID NO: 64559 - DNA, 25 bp, Mus musculus
aaggttgcctgtagaaacgtaatgc

SEQ ID NO: 64560 - DNA, 25 bp, Mus musculus
aaggttgcctgttgaaacgtaatgc

SEQ ID NO: 64561 - DNA, 25 bp, Mus musculus
aaggttgcggtcaacgatgctcacc

SEQ ID NO: 64562 - DNA, 25 bp, Mus musculus
aaggttgcggtctacgatgctcacc

SEQ ID NO: 64563 - DNA, 25 bp, Mus musculus
aaggttgcgttaatcttgcagctgg

SEQ ID NO: 64564 - DNA, 25 bp, Mus musculus
aaggttgcgttattcttgcagctgg

SEQ ID NO: 64565 - DNA, 25 bp, Mus musculus
aaggttgctaggctggtcatcgtaa

SEQ ID NO: 64566 - DNA, 25 bp, Mus musculus
aaggttgctagggtggtcatcgtaa

SEQ ID NO: 64567 - DNA, 25 bp, Mus musculus
aaggttgctgcacggctttgagctc

SEQ ID NO: 64568 - DNA, 25 bp, Mus musculus
aaggttgctgcagggctttgagctc

SEQ ID NO: 64569 - DNA, 25 bp, Mus musculus
aaggttgcttatcataacattacaa

SEQ ID NO: 64570 - DNA, 25 bp, Mus musculus
aaggttgcttatgataacattacaa

SEQ ID NO: 64571 - DNA, 25 bp, Mus musculus
aaggttgcttggagactcgggtctc

SEQ ID NO: 64572 - DNA, 25 bp, Mus musculus
aaggttgcttggtgactcgggtctc

SEQ ID NO: 64573 - DNA, 25 bp, Mus musculus
aaggttggacctctgggctctaagc

SEQ ID NO: 64574 - DNA, 25 bp, Mus musculus
aaggttggacctgtgggctctaagc

SEQ ID NO: 64575 - DNA, 25 bp, Mus musculus
aaggttggctcccttagcctcagag

SEQ ID NO: 64576 - DNA, 25 bp, Mus musculus
aaggttggctccgttagcctcagag

SEQ ID NO: 64577 - DNA, 25 bp, Mus musculus
aaggttgggagtcctagttctcgca

SEQ ID NO: 64578 - DNA, 25 bp, Mus musculus
aaggttgggagtgctagttctcgca

SEQ ID NO: 64579 - DNA, 25 bp, Mus musculus
aaggttgggcaaccacaaaagggat

SEQ ID NO: 64580 - DNA, 25 bp, Mus musculus
aaggttgggcaagcacaaaagggat

SEQ ID NO: 64581 - DNA, 25 bp, Mus musculus
aaggttgggcttctcatgagctgtc

SEQ ID NO: 64582 - DNA, 25 bp, Mus musculus
aaggttgggcttgtcatgagctgtc

SEQ ID NO: 64583 - DNA, 25 bp, Mus musculus
aaggttgggttgaggtagcatatac

SEQ ID NO: 64584 - DNA, 25 bp, Mus musculus
aaggttgggttgtggtagcatatac

SEQ ID NO: 64585 - DNA, 25 bp, Mus musculus
aaggttggtacgaggccagcagcct

SEQ ID NO: 64586 - DNA, 25 bp, Mus musculus
aaggttggtacgtggccagcagcct

SEQ ID NO: 64587 - DNA, 25 bp, Mus musculus
aaggttggtcagctacctgcagaga

SEQ ID NO: 64588 - DNA, 25 bp, Mus musculus
aaggttggtcaggtacctgcagaga

SEQ ID NO: 64589 - DNA, 25 bp, Mus musculus
aaggttgtagcccaaatgagcccct

SEQ ID NO: 64590 - DNA, 25 bp, Mus musculus
aaggttgtagccgaaatgagcccct

SEQ ID NO: 64591 - DNA, 25 bp, Mus musculus
aaggttgtaggcagaaccaccctgg

SEQ ID NO: 64592 - DNA, 25 bp, Mus musculus
aaggttgtaggctgaaccaccctgg

SEQ ID NO: 64593 - DNA, 25 bp, Mus musculus
aaggttgtcaaacgcctaatctgag

SEQ ID NO: 64594 - DNA, 25 bp, Mus musculus
aaggttgtcaaaggcctaatctgag

SEQ ID NO: 64595 - DNA, 25 bp, Mus musculus
aaggttgtcacacttttctgaaaag

SEQ ID NO: 64596 - DNA, 25 bp, Mus musculus
aaggttgtcacagttttctgaaaag

SEQ ID NO: 64597 - DNA, 25 bp, Mus musculus
aaggttgtccctctggcttcctttg

SEQ ID NO: 64598 - DNA, 25 bp, Mus musculus
aaggttgtccctgtggcttcctttg

SEQ ID NO: 64599 - DNA, 25 bp, Mus musculus
aaggttgtcctcagatttgcagata

SEQ ID NO: 64600 - DNA, 25 bp, Mus musculus
aaggttgtcctctgatttgcagata

SEQ ID NO: 64601 - DNA, 25 bp, Mus musculus
aaggttgtccttatccattcccatg

SEQ ID NO: 64602 - DNA, 25 bp, Mus musculus
aaggttgtccttttccattcccatg

SEQ ID NO: 64603 - DNA, 25 bp, Mus musculus
aaggttgtcttccaacacgcactta

SEQ ID NO: 64604 - DNA, 25 bp, Mus musculus
aaggttgtcttcgaacacgcactta

SEQ ID NO: 64605 - DNA, 25 bp, Mus musculus
aaggttgtgcagcttgagtgcctca

SEQ ID NO: 64606 - DNA, 25 bp, Mus musculus
aaggttgtgcaggttgagtgcctca

SEQ ID NO: 64607 - DNA, 25 bp, Mus musculus
aaggttgtggatatccctgatcctc

SEQ ID NO: 64608 - DNA, 25 bp, Mus musculus
aaggttgtggatttccctgatcctc

SEQ ID NO: 64609 - DNA, 25 bp, Mus musculus
aaggttgtgtttctacttgtgtaga

SEQ ID NO: 64610 - DNA, 25 bp, Mus musculus
aaggttgtgtttgtacttgtgtaga

SEQ ID NO: 64611 - DNA, 25 bp, Mus musculus
aaggttgttaataaactctgccctg

SEQ ID NO: 64612 - DNA, 25 bp, Mus musculus
aaggttgttaattaactctgccctg

SEQ ID NO: 64613 - DNA, 25 bp, Mus musculus
aaggttgttagaactgacactggag

SEQ ID NO: 64614 - DNA, 25 bp, Mus musculus
aaggttgttagatctgacactggag

SEQ ID NO: 64615 - DNA, 25 bp, Mus musculus
aaggttgttctccaacatccacgtg

SEQ ID NO: 64616 - DNA, 25 bp, Mus musculus
aaggttgttctcgaacatccacgtg

SEQ ID NO: 64617 - DNA, 25 bp, Mus musculus
aaggttgttcttctcagtatttcat

SEQ ID NO: 64618 - DNA, 25 bp, Mus musculus
aaggttgttcttgtcagtatttcat

SEQ ID NO: 64619 - DNA, 25 bp, Mus musculus
aaggttgttgtccacacttgataaa

SEQ ID NO: 64620 - DNA, 25 bp, Mus musculus
aaggttgttgtcgacacttgataaa

SEQ ID NO: 64621 - DNA, 25 bp, Mus musculus
aaggtttaatctattgtcatcatgg

SEQ ID NO: 64622 - DNA, 25 bp, Mus musculus
aaggtttaatcttttgtcatcatgg

SEQ ID NO: 64623 - DNA, 25 bp, Mus musculus
aaggtttacaatcgtggtgtgagcc

SEQ ID NO: 64624 - DNA, 25 bp, Mus musculus
aaggtttacaatggtggtgtgagcc

SEQ ID NO: 64625 - DNA, 25 bp, Mus musculus
aaggtttacagcagagattcttctc

SEQ ID NO: 64626 - DNA, 25 bp, Mus musculus
aaggtttacagctgagattcttctc

SEQ ID NO: 64627 - DNA, 25 bp, Mus musculus
aaggtttaccatcaaggcgttgatc

SEQ ID NO: 64628 - DNA, 25 bp, Mus musculus
aaggtttaccatgaaggcgttgatc

SEQ ID NO: 64629 - DNA, 25 bp, Mus musculus
aaggtttacctaattctcactgcct

SEQ ID NO: 64630 - DNA, 25 bp, Mus musculus
aaggtttacctatttctcactgcct

SEQ ID NO: 64631 - DNA, 25 bp, Mus musculus
aaggtttactctacttggtgtaatg

SEQ ID NO: 64632 - DNA, 25 bp, Mus musculus
aaggtttactcttcttggtgtaatg

SEQ ID NO: 64633 - DNA, 25 bp, Mus musculus
aaggtttactggacgtgcccaacag

SEQ ID NO: 64634 - DNA, 25 bp, Mus musculus
aaggtttactggtcgtgcccaacag

SEQ ID NO: 64635 - DNA, 25 bp, Mus musculus
aaggtttatttcagtactgagtatg

SEQ ID NO: 64636 - DNA, 25 bp, Mus musculus
aaggtttatttctgtactgagtatg

SEQ ID NO: 64637 - DNA, 25 bp, Mus musculus
aaggtttcaaaccatgccagcggaa

SEQ ID NO: 64638 - DNA, 25 bp, Mus musculus
aaggtttcaaacgatgccagcggaa

SEQ ID NO: 64639 - DNA, 25 bp, Mus musculus
aaggtttcaacacaccatctgtggg

SEQ ID NO: 64640 - DNA, 25 bp, Mus musculus
aaggtttcaacagaccatctgtggg

SEQ ID NO: 64641 - DNA, 25 bp, Mus musculus
aaggtttcaagacattttcgtctca

SEQ ID NO: 64642 - DNA, 25 bp, Mus musculus
aaggtttcaagagattttcgtctca

SEQ ID NO: 64643 - DNA, 25 bp, Mus musculus
aaggtttcaagcagaattgattcat

SEQ ID NO: 64644 - DNA, 25 bp, Mus musculus
aaggtttcaagctgaattgattcat

SEQ ID NO: 64645 - DNA, 25 bp, Mus musculus
aaggtttcaataaacatttacatac

SEQ ID NO: 64646 - DNA, 25 bp, Mus musculus
aaggtttcaatatacatttacatac

SEQ ID NO: 64647 - DNA, 25 bp, Mus musculus
aaggtttcacttcgccagtgcagac

SEQ ID NO: 64648 - DNA, 25 bp, Mus musculus
aaggtttcacttggccagtgcagac

SEQ ID NO: 64649 - DNA, 25 bp, Mus musculus
aaggtttcagaacacaatggcctgt

SEQ ID NO: 64650 - DNA, 25 bp, Mus musculus
aaggtttcagaactgtcatcttgta

SEQ ID NO: 64651 - DNA, 25 bp, Mus musculus
aaggtttcagaagacaatggcctgt

SEQ ID NO: 64652 - DNA, 25 bp, Mus musculus
aaggtttcagaagtgtcatcttgta

SEQ ID NO: 64653 - DNA, 25 bp, Mus musculus
aaggtttcagtaccgcggagtagtc

SEQ ID NO: 64654 - DNA, 25 bp, Mus musculus
aaggtttcagtagcgcggagtagtc

SEQ ID NO: 64655 - DNA, 25 bp, Mus musculus
aaggtttcatgcctgtgtttcatca

SEQ ID NO: 64656 - DNA, 25 bp, Mus musculus
aaggtttcatgcgtgtgtttcatca

SEQ ID NO: 64657 - DNA, 25 bp, Mus musculus
aaggtttcatttctttatctgcaaa

SEQ ID NO: 64658 - DNA, 25 bp, Mus musculus
aaggtttcatttgtttatctgcaaa

SEQ ID NO: 64659 - DNA, 25 bp, Mus musculus
aaggtttccactctgttcactagct

SEQ ID NO: 64660 - DNA, 25 bp, Mus musculus
aaggtttccactgtgttcactagct

SEQ ID NO: 64661 - DNA, 25 bp, Mus musculus
aaggtttccagtccacctgattcta

SEQ ID NO: 64662 - DNA, 25 bp, Mus musculus
aaggtttccagtgcacctgattcta

SEQ ID NO: 64663 - DNA, 25 bp, Mus musculus
aaggtttcccagaccagatctggat

SEQ ID NO: 64664 - DNA, 25 bp, Mus musculus
aaggtttcccagtccagatctggat

SEQ ID NO: 64665 - DNA, 25 bp, Mus musculus
aaggtttccctaagaagccctggat

SEQ ID NO: 64666 - DNA, 25 bp, Mus musculus
aaggtttccctatgaagccctggat

SEQ ID NO: 64667 - DNA, 25 bp, Mus musculus
aaggtttccggtagcactgattgta

SEQ ID NO: 64668 - DNA, 25 bp, Mus musculus
aaggtttccggttgcactgattgta

SEQ ID NO: 64669 - DNA, 25 bp, Mus musculus
aaggtttcctcaagtagcgttccca

SEQ ID NO: 64670 - DNA, 25 bp, Mus musculus
aaggtttcctcatgtagcgttccca

SEQ ID NO: 64671 - DNA, 25 bp, Mus musculus
aaggtttcctccatttctgcatcag

SEQ ID NO: 64672 - DNA, 25 bp, Mus musculus
aaggtttcctccttttctgcatcag

SEQ ID NO: 64673 - DNA, 25 bp, Mus musculus
aaggtttcctgacaagcctggcaac

SEQ ID NO: 64674 - DNA, 25 bp, Mus musculus
aaggtttcctgagaagcctggcaac

SEQ ID NO: 64675 - DNA, 25 bp, Mus musculus
aaggtttcctgccaacttgcaagtc

SEQ ID NO: 64676 - DNA, 25 bp, Mus musculus
aaggtttcctgcgaacttgcaagtc

SEQ ID NO: 64677 - DNA, 25 bp, Mus musculus
aaggtttcctgtcggatgttctaag

SEQ ID NO: 64678 - DNA, 25 bp, Mus musculus
aaggtttcctgtgggatgttctaag

SEQ ID NO: 64679 - DNA, 25 bp, Mus musculus
aaggtttccttaactgtattatagt

SEQ ID NO: 64680 - DNA, 25 bp, Mus musculus
aaggtttccttatctgtattatagt

SEQ ID NO: 64681 - DNA, 25 bp, Mus musculus
aaggtttctatgctgatctctccct

SEQ ID NO: 64682 - DNA, 25 bp, Mus musculus
aaggtttctatggtgatctctccct

SEQ ID NO: 64683 - DNA, 25 bp, Mus musculus
aaggtttctcttactagactgcaac

SEQ ID NO: 64684 - DNA, 25 bp, Mus musculus
aaggtttctctttctagactgcaac

SEQ ID NO: 64685 - DNA, 25 bp, Mus musculus
aaggtttctgccatgtctttttcca

SEQ ID NO: 64686 - DNA, 25 bp, Mus musculus
aaggtttctgccttgtctttttcca

SEQ ID NO: 64687 - DNA, 25 bp, Mus musculus
aaggtttcttatccccaagcttgaa

SEQ ID NO: 64688 - DNA, 25 bp, Mus musculus
aaggtttcttatgcccaagcttgaa

SEQ ID NO: 64689 - DNA, 25 bp, Mus musculus
aaggtttcttccatgctccgaggat

SEQ ID NO: 64690 - DNA, 25 bp, Mus musculus
aaggtttcttccttgctccgaggat

SEQ ID NO: 64691 - DNA, 25 bp, Mus musculus
aaggtttgcactcacacttgctccc

SEQ ID NO: 64692 - DNA, 25 bp, Mus musculus
aaggtttgcactgacacttgctccc

SEQ ID NO: 64693 - DNA, 25 bp, Mus musculus
aaggtttgcctgagtacagacctct

SEQ ID NO: 64694 - DNA, 25 bp, Mus musculus
aaggtttgcctgtgtacagacctct

SEQ ID NO: 64695 - DNA, 25 bp, Mus musculus
aaggtttgctcacgagatgtgtgga

SEQ ID NO: 64696 - DNA, 25 bp, Mus musculus
aaggtttgctcaggagatgtgtgga

SEQ ID NO: 64697 - DNA, 25 bp, Mus musculus
aaggtttgctctctgtcttacagtc

SEQ ID NO: 64698 - DNA, 25 bp, Mus musculus
aaggtttgctctgtgtcttacagtc

SEQ ID NO: 64699 - DNA, 25 bp, Mus musculus
aaggtttgctgcattctgcccagtg

SEQ ID NO: 64700 - DNA, 25 bp, Mus musculus
aaggtttgctgctttctgcccagtg

SEQ ID NO: 64701 - DNA, 25 bp, Mus musculus
aaggtttgctgtctgtccacccctc

SEQ ID NO: 64702 - DNA, 25 bp, Mus musculus
aaggtttgctgtgtgtccacccctc

SEQ ID NO: 64703 - DNA, 25 bp, Mus musculus
aaggtttgcttgatcttcatcctgt

SEQ ID NO: 64704 - DNA, 25 bp, Mus musculus
aaggtttgcttgttcttcatcctgt

SEQ ID NO: 64705 - DNA, 25 bp, Mus musculus
aaggtttgctttactctgtgttctc

SEQ ID NO: 64706 - DNA, 25 bp, Mus musculus
aaggtttgcttttctctgtgttctc

SEQ ID NO: 64707 - DNA, 25 bp, Mus musculus
aaggtttggagcaattgccctggct

SEQ ID NO: 64708 - DNA, 25 bp, Mus musculus
aaggtttggagctattgccctggct

SEQ ID NO: 64709 - DNA, 25 bp, Mus musculus
aaggtttgggtgacgcaagctgtca

SEQ ID NO: 64710 - DNA, 25 bp, Mus musculus
aaggtttgggtgtcgcaagctgtca

SEQ ID NO: 64711 - DNA, 25 bp, Mus musculus
aaggtttggtccctttcatgactgg

SEQ ID NO: 64712 - DNA, 25 bp, Mus musculus
aaggtttggtccgtttcatgactgg

SEQ ID NO: 64713 - DNA, 25 bp, Mus musculus
aaggtttgtgccaggccagttccgt

SEQ ID NO: 64714 - DNA, 25 bp, Mus musculus
aaggtttgtgcctggccagttccgt

SEQ ID NO: 64715 - DNA, 25 bp, Mus musculus
aaggttttacatccacttctgaagg

SEQ ID NO: 64716 - DNA, 25 bp, Mus musculus
aaggttttacatgcacttctgaagg

SEQ ID NO: 64717 - DNA, 25 bp, Mus musculus
aaggttttacttcttggatctgcaa

SEQ ID NO: 64718 - DNA, 25 bp, Mus musculus
aaggttttacttgttggatctgcaa

SEQ ID NO: 64719 - DNA, 25 bp, Mus musculus
aaggttttagctcttgactgcccat

SEQ ID NO: 64720 - DNA, 25 bp, Mus musculus
aaggttttagctgttgactgcccat

SEQ ID NO: 64721 - DNA, 25 bp, Mus musculus
aaggttttaggacaggattcacaat

SEQ ID NO: 64722 - DNA, 25 bp, Mus musculus
aaggttttaggagaggattcacaat

SEQ ID NO: 64723 - DNA, 25 bp, Mus musculus
aaggttttcagtagggcgctccagg

SEQ ID NO: 64724 - DNA, 25 bp, Mus musculus
aaggttttcagttgggcgctccagg

SEQ ID NO: 64725 - DNA, 25 bp, Mus musculus
aaggttttccctcaaatgagcacat

SEQ ID NO: 64726 - DNA, 25 bp, Mus musculus
aaggttttccctgaaatgagcacat

SEQ ID NO: 64727 - DNA, 25 bp, Mus musculus
aaggttttgatacacttgtcttgag

SEQ ID NO: 64728 - DNA, 25 bp, Mus musculus
aaggttttgatagacttgtcttgag

SEQ ID NO: 64729 - DNA, 25 bp, Mus musculus
aaggttttgcccattgcattcaggt

SEQ ID NO: 64730 - DNA, 25 bp, Mus musculus
aaggttttgccctttgcattcaggt

SEQ ID NO: 64731 - DNA, 25 bp, Mus musculus
aaggttttgctcagcttgggtggac

SEQ ID NO: 64732 - DNA, 25 bp, Mus musculus
aaggttttgctctgcttgggtggac

SEQ ID NO: 64733 - DNA, 25 bp, Mus musculus
aaggttttgctgagctaacccacct

SEQ ID NO: 64734 - DNA, 25 bp, Mus musculus
aaggttttgctgtgctaacccacct

SEQ ID NO: 64735 - DNA, 25 bp, Mus musculus
aaggtttttcagcatatttctcagt

SEQ ID NO: 64736 - DNA, 25 bp, Mus musculus
aaggtttttcaggatatttctcagt

SEQ ID NO: 64737 - DNA, 25 bp, Mus musculus
aagtaaaatcaaacggtcctcagag

SEQ ID NO: 64738 - DNA, 25 bp, Mus musculus
aagtaaaatcaatcggtcctcagag

SEQ ID NO: 64739 - DNA, 25 bp, Mus musculus
aagtaaacaagacaaggtggctcat

SEQ ID NO: 64740 - DNA, 25 bp, Mus musculus
aagtaaacaagagaaggtggctcat

SEQ ID NO: 64741 - DNA, 25 bp, Mus musculus
aagtaaacacaaagatcagcttaga

SEQ ID NO: 64742 - DNA, 25 bp, Mus musculus
aagtaaacacaatgatcagcttaga

SEQ ID NO: 64743 - DNA, 25 bp, Mus musculus
aagtaaaccatgcagtcctggcggt

SEQ ID NO: 64744 - DNA, 25 bp, Mus musculus
aagtaaaccatggagtcctggcggt

SEQ ID NO: 64745 - DNA, 25 bp, Mus musculus
aagtaaactaccattcctctctgtt

SEQ ID NO: 64746 - DNA, 25 bp, Mus musculus
aagtaaactacctttcctctctgtt

SEQ ID NO: 64747 - DNA, 25 bp, Mus musculus
aagtaaactgaaattggctgctatg

SEQ ID NO: 64748 - DNA, 25 bp, Mus musculus
aagtaaactgaatttggctgctatg

SEQ ID NO: 64749 - DNA, 25 bp, Mus musculus
aagtaaactgcacctttgtaacata

SEQ ID NO: 64750 - DNA, 25 bp, Mus musculus
aagtaaactgcagctttgtaacata

SEQ ID NO: 64751 - DNA, 25 bp, Mus musculus
aagtaaactgtgatccggatgttgg

SEQ ID NO: 64752 - DNA, 25 bp, Mus musculus
aagtaaactgtgttccggatgttgg

SEQ ID NO: 64753 - DNA, 25 bp, Mus musculus
aagtaaacttcaaaccacaggacac

SEQ ID NO: 64754 - DNA, 25 bp, Mus musculus
aagtaaacttcataccacaggacac

SEQ ID NO: 64755 - DNA, 25 bp, Mus musculus
aagtaaagacttaggaatcattcac

SEQ ID NO: 64756 - DNA, 25 bp, Mus musculus
aagtaaagactttggaatcattcac

SEQ ID NO: 64757 - DNA, 25 bp, Mus musculus
aagtaaagagcacctaagatgtcct

SEQ ID NO: 64758 - DNA, 25 bp, Mus musculus
aagtaaagagcagctaagatgtcct

SEQ ID NO: 64759 - DNA, 25 bp, Mus musculus
aagtaaagcattctacacacgacat

SEQ ID NO: 64760 - DNA, 25 bp, Mus musculus
aagtaaagcattgtacacacgacat

SEQ ID NO: 64761 - DNA, 25 bp, Mus musculus
aagtaaagcgccctgcgggtgactt

SEQ ID NO: 64762 - DNA, 25 bp, Mus musculus
aagtaaagcgccgtgcgggtgactt

SEQ ID NO: 64763 - DNA, 25 bp, Mus musculus
aagtaaagtcctctggatccccgct

SEQ ID NO: 64764 - DNA, 25 bp, Mus musculus
aagtaaagtcctgtggatccccgct

SEQ ID NO: 64765 - DNA, 25 bp, Mus musculus
aagtaaatcacgacagcagcctcct

SEQ ID NO: 64766 - DNA, 25 bp, Mus musculus
aagtaaatcacgtcagcagcctcct

SEQ ID NO: 64767 - DNA, 25 bp, Mus musculus
aagtaaatcccaaaacagcttcagg

SEQ ID NO: 64768 - DNA, 25 bp, Mus musculus
aagtaaatcccataacagcttcagg

SEQ ID NO: 64769 - DNA, 25 bp, Mus musculus
aagtaaatgagcaattccgccctgc

SEQ ID NO: 64770 - DNA, 25 bp, Mus musculus
aagtaaatgagctattccgccctgc

SEQ ID NO: 64771 - DNA, 25 bp, Mus musculus
aagtaaatgcagatctgcccaccgc

SEQ ID NO: 64772 - DNA, 25 bp, Mus musculus
aagtaaatgcagttctgcccaccgc

SEQ ID NO: 64773 - DNA, 25 bp, Mus musculus
aagtaaatgcctcgacttccggcca

SEQ ID NO: 64774 - DNA, 25 bp, Mus musculus
aagtaaatgcctggacttccggcca

SEQ ID NO: 64775 - DNA, 25 bp, Mus musculus
aagtaaatggtaccgctgtcgtgct

SEQ ID NO: 64776 - DNA, 25 bp, Mus musculus
aagtaaatggtagcgctgtcgtgct

SEQ ID NO: 64777 - DNA, 25 bp, Mus musculus
aagtaacaaagactcccagcctgac

SEQ ID NO: 64778 - DNA, 25 bp, Mus musculus
aagtaacaaagagtcccagcctgac

SEQ ID NO: 64779 - DNA, 25 bp, Mus musculus
aagtaacaagggaatctggcagaac

SEQ ID NO: 64780 - DNA, 25 bp, Mus musculus
aagtaacaagggtatctggcagaac

SEQ ID NO: 64781 - DNA, 25 bp, Mus musculus
aagtaacaatttcactgacctttgc

SEQ ID NO: 64782 - DNA, 25 bp, Mus musculus
aagtaacaatttgactgacctttgc

SEQ ID NO: 64783 - DNA, 25 bp, Mus musculus
aagtaacagcagctcctgaggtctg

SEQ ID NO: 64784 - DNA, 25 bp, Mus musculus
aagtaacagcaggtcctgaggtctg

SEQ ID NO: 64785 - DNA, 25 bp, Mus musculus
aagtaacatcagacttagcatgtgt

SEQ ID NO: 64786 - DNA, 25 bp, Mus musculus
aagtaacatcagtcttagcatgtgt

SEQ ID NO: 64787 - DNA, 25 bp, Mus musculus
aagtaacatgatatccagaccagtg

SEQ ID NO: 64788 - DNA, 25 bp, Mus musculus
aagtaacatgatttccagaccagtg

SEQ ID NO: 64789 - DNA, 25 bp, Mus musculus
aagtaaccagccctaacagttcctg

SEQ ID NO: 64790 - DNA, 25 bp, Mus musculus
aagtaaccagccgtaacagttcctg

SEQ ID NO: 64791 - DNA, 25 bp, Mus musculus
aagtaaccggaaccctgccctgaag

SEQ ID NO: 64792 - DNA, 25 bp, Mus musculus
aagtaaccggaagcctgccctgaag

SEQ ID NO: 64793 - DNA, 25 bp, Mus musculus
aagtaacgtgtgagttcatgcagtt

SEQ ID NO: 64794 - DNA, 25 bp, Mus musculus
aagtaacgtgtgtgttcatgcagtt

SEQ ID NO: 64795 - DNA, 25 bp, Mus musculus
aagtaacgttctatgggctgagcaa

SEQ ID NO: 64796 - DNA, 25 bp, Mus musculus
aagtaacgttctttgggctgagcaa

SEQ ID NO: 64797 - DNA, 25 bp, Mus musculus
aagtaactaacccagaggtagctca

SEQ ID NO: 64798 - DNA, 25 bp, Mus musculus
aagtaactaaccgagaggtagctca

SEQ ID NO: 64799 - DNA, 25 bp, Mus musculus
aagtaactaatccagaagccccaag

SEQ ID NO: 64800 - DNA, 25 bp, Mus musculus
aagtaactaatcgagaagccccaag

SEQ ID NO: 64801 - DNA, 25 bp, Mus musculus
aagtaactagctatgtgaacacatt

SEQ ID NO: 64802 - DNA, 25 bp, Mus musculus
aagtaactagctttgtgaacacatt

SEQ ID NO: 64803 - DNA, 25 bp, Mus musculus
aagtaactgggcatccaacgcttga

SEQ ID NO: 64804 - DNA, 25 bp, Mus musculus
aagtaactgggcttccaacgcttga

SEQ ID NO: 64805 - DNA, 25 bp, Mus musculus
aagtaactgtaactagctgagcatg

SEQ ID NO: 64806 - DNA, 25 bp, Mus musculus
aagtaactgtaagtagctgagcatg

SEQ ID NO: 64807 - DNA, 25 bp, Mus musculus
aagtaactgtatattgatgtgggaa

SEQ ID NO: 64808 - DNA, 25 bp, Mus musculus
aagtaactgtattttgatgtgggaa

SEQ ID NO: 64809 - DNA, 25 bp, Mus musculus
aagtaacttatgacctgcactcctg

SEQ ID NO: 64810 - DNA, 25 bp, Mus musculus
aagtaacttatgtcctgcactcctg

SEQ ID NO: 64811 - DNA, 25 bp, Mus musculus
aagtaacttcatatattatcaggag

SEQ ID NO: 64812 - DNA, 25 bp, Mus musculus
aagtaacttcatttattatcaggag

SEQ ID NO: 64813 - DNA, 25 bp, Mus musculus
aagtaacttggccaccacgtgctgg

SEQ ID NO: 64814 - DNA, 25 bp, Mus musculus
aagtaacttggcgaccacgtgctgg

SEQ ID NO: 64815 - DNA, 25 bp, Mus musculus
aagtaagaacctccacaccaagtat

SEQ ID NO: 64816 - DNA, 25 bp, Mus musculus
aagtaagaacctgcacaccaagtat

SEQ ID NO: 64817 - DNA, 25 bp, Mus musculus
aagtaagacacacccccccctctga

SEQ ID NO: 64818 - DNA, 25 bp, Mus musculus
aagtaagacacagccccccctctga

SEQ ID NO: 64819 - DNA, 25 bp, Mus musculus
aagtaagacaccatgcttcctatgt

SEQ ID NO: 64820 - DNA, 25 bp, Mus musculus
aagtaagacaccttgcttcctatgt

SEQ ID NO: 64821 - DNA, 25 bp, Mus musculus
aagtaagactctcgcaactggcagc

SEQ ID NO: 64822 - DNA, 25 bp, Mus musculus
aagtaagactctggcaactggcagc

SEQ ID NO: 64823 - DNA, 25 bp, Mus musculus
aagtaagagacaaccctcaggatcc

SEQ ID NO: 64824 - DNA, 25 bp, Mus musculus
aagtaagagacatccctcaggatcc

SEQ ID NO: 64825 - DNA, 25 bp, Mus musculus
aagtaagagagtcaccttgatttcc

SEQ ID NO: 64826 - DNA, 25 bp, Mus musculus
aagtaagagagtgaccttgatttcc

SEQ ID NO: 64827 - DNA, 25 bp, Mus musculus
aagtaagaggacaggctgtgaccct

SEQ ID NO: 64828 - DNA, 25 bp, Mus musculus
aagtaagaggactggctgtgaccct

SEQ ID NO: 64829 - DNA, 25 bp, Mus musculus
aagtaagatggacccgggcacctga

SEQ ID NO: 64830 - DNA, 25 bp, Mus musculus
aagtaagatggagccgggcacctga

SEQ ID NO: 64831 - DNA, 25 bp, Mus musculus
aagtaagatgtgcactgtgacctaa

SEQ ID NO: 64832 - DNA, 25 bp, Mus musculus
aagtaagatgtggactgtgacctaa

SEQ ID NO: 64833 - DNA, 25 bp, Mus musculus
aagtaagattgaaccagctccccac

SEQ ID NO: 64834 - DNA, 25 bp, Mus musculus
aagtaagattgatccagctccccac

SEQ ID NO: 64835 - DNA, 25 bp, Mus musculus
aagtaagcaaggatctgttctcact

SEQ ID NO: 64836 - DNA, 25 bp, Mus musculus
aagtaagcaaggttctgttctcact

SEQ ID NO: 64837 - DNA, 25 bp, Mus musculus
aagtaagcacaaatccaagcaatta

SEQ ID NO: 64838 - DNA, 25 bp, Mus musculus
aagtaagcacaattccaagcaatta

SEQ ID NO: 64839 - DNA, 25 bp, Mus musculus
aagtaagcaccgagcagtcttcgtt

SEQ ID NO: 64840 - DNA, 25 bp, Mus musculus
aagtaagcaccgtgcagtcttcgtt

SEQ ID NO: 64841 - DNA, 25 bp, Mus musculus
aagtaagcagcaagtccatcgagat

SEQ ID NO: 64842 - DNA, 25 bp, Mus musculus
aagtaagcagcatgtccatcgagat

SEQ ID NO: 64843 - DNA, 25 bp, Mus musculus
aagtaagcatcgactgatacctcag

SEQ ID NO: 64844 - DNA, 25 bp, Mus musculus
aagtaagcatcgtctgatacctcag

SEQ ID NO: 64845 - DNA, 25 bp, Mus musculus
aagtaagcattcaaccacagagccc

SEQ ID NO: 64846 - DNA, 25 bp, Mus musculus
aagtaagcattctaccacagagccc

SEQ ID NO: 64847 - DNA, 25 bp, Mus musculus
aagtaagccagcaagcaggaccagg

SEQ ID NO: 64848 - DNA, 25 bp, Mus musculus
aagtaagccagctagcaggaccagg

SEQ ID NO: 64849 - DNA, 25 bp, Mus musculus
aagtaagccatcacttgctctgatt

SEQ ID NO: 64850 - DNA, 25 bp, Mus musculus
aagtaagccatctcttgctctgatt

SEQ ID NO: 64851 - DNA, 25 bp, Mus musculus
aagtaagccatgaggccgccttgca

SEQ ID NO: 64852 - DNA, 25 bp, Mus musculus
aagtaagccatgtggccgccttgca

SEQ ID NO: 64853 - DNA, 25 bp, Mus musculus
aagtaagccattcaactcttgagac

SEQ ID NO: 64854 - DNA, 25 bp, Mus musculus
aagtaagccattgaactcttgagac

SEQ ID NO: 64855 - DNA, 25 bp, Mus musculus
aagtaagcccatatgtttctcagaa

SEQ ID NO: 64856 - DNA, 25 bp, Mus musculus
aagtaagcccatttgtttctcagaa

SEQ ID NO: 64857 - DNA, 25 bp, Mus musculus
aagtaagccttcactccggaggcct

SEQ ID NO: 64858 - DNA, 25 bp, Mus musculus
aagtaagccttctctccggaggcct

SEQ ID NO: 64859 - DNA, 25 bp, Mus musculus
aagtaagccttgacccttatcaagt

SEQ ID NO: 64860 - DNA, 25 bp, Mus musculus
aagtaagccttgtcccttatcaagt

SEQ ID NO: 64861 - DNA, 25 bp, Mus musculus
aagtaagctaagactctaccccaca

SEQ ID NO: 64862 - DNA, 25 bp, Mus musculus
aagtaagctaagtctctaccccaca

SEQ ID NO: 64863 - DNA, 25 bp, Mus musculus
aagtaagctggtatggaggtcctgt

SEQ ID NO: 64864 - DNA, 25 bp, Mus musculus
aagtaagctggtttggaggtcctgt

SEQ ID NO: 64865 - DNA, 25 bp, Mus musculus
aagtaagctgtacccgttggagcca

SEQ ID NO: 64866 - DNA, 25 bp, Mus musculus
aagtaagctgtagccgttggagcca

SEQ ID NO: 64867 - DNA, 25 bp, Mus musculus
aagtaagctttcatgtgagttcagg

SEQ ID NO: 64868 - DNA, 25 bp, Mus musculus
aagtaagctttcttgtgagttcagg

SEQ ID NO: 64869 - DNA, 25 bp, Mus musculus
aagtaaggcacacctctgattgtcc

SEQ ID NO: 64870 - DNA, 25 bp, Mus musculus
aagtaaggcacagctctgattgtcc

SEQ ID NO: 64871 - DNA, 25 bp, Mus musculus
aagtaaggcatcacctcctgtggta

SEQ ID NO: 64872 - DNA, 25 bp, Mus musculus
aagtaaggcatctcctcctgtggta

SEQ ID NO: 64873 - DNA, 25 bp, Mus musculus
aagtaaggcattaccagtgccccaa

SEQ ID NO: 64874 - DNA, 25 bp, Mus musculus
aagtaaggcatttccagtgccccaa

SEQ ID NO: 64875 - DNA, 25 bp, Mus musculus
aagtaaggctctcagcttgccctct

SEQ ID NO: 64876 - DNA, 25 bp, Mus musculus
aagtaaggctctgagcttgccctct

SEQ ID NO: 64877 - DNA, 25 bp, Mus musculus
aagtaagggctcagcttgttacaga

SEQ ID NO: 64878 - DNA, 25 bp, Mus musculus
aagtaagggctctgcttgttacaga

SEQ ID NO: 64879 - DNA, 25 bp, Mus musculus
aagtaagggctgagacatgtggacc

SEQ ID NO: 64880 - DNA, 25 bp, Mus musculus
aagtaagggctgtgacatgtggacc

SEQ ID NO: 64881 - DNA, 25 bp, Mus musculus
aagtaaggtctgactctctgatcta

SEQ ID NO: 64882 - DNA, 25 bp, Mus musculus
aagtaaggtctgtctctctgatcta

SEQ ID NO: 64883 - DNA, 25 bp, Mus musculus
aagtaagtagacaaagcctcatgtt

SEQ ID NO: 64884 - DNA, 25 bp, Mus musculus
aagtaagtagactaagcctcatgtt

SEQ ID NO: 64885 - DNA, 25 bp, Mus musculus
aagtaagtggcccttgctctccagg

SEQ ID NO: 64886 - DNA, 25 bp, Mus musculus
aagtaagtggccgttgctctccagg

SEQ ID NO: 64887 - DNA, 25 bp, Mus musculus
aagtaagtgttacagcatgctgcca

SEQ ID NO: 64888 - DNA, 25 bp, Mus musculus
aagtaagtgttagagcatgctgcca

SEQ ID NO: 64889 - DNA, 25 bp, Mus musculus
aagtaatagattcagggccctccct

SEQ ID NO: 64890 - DNA, 25 bp, Mus musculus
aagtaatagattgagggccctccct

SEQ ID NO: 64891 - DNA, 25 bp, Mus musculus
aagtaatagcttcagggcggttcct

SEQ ID NO: 64892 - DNA, 25 bp, Mus musculus
aagtaatagcttgagggcggttcct

SEQ ID NO: 64893 - DNA, 25 bp, Mus musculus
aagtaatatctcagcggttaggcct

SEQ ID NO: 64894 - DNA, 25 bp, Mus musculus
aagtaatatctctgcggttaggcct

SEQ ID NO: 64895 - DNA, 25 bp, Mus musculus
aagtaatatgtaactgtagctggtt

SEQ ID NO: 64896 - DNA, 25 bp, Mus musculus
aagtaatatgtatctgtagctggtt

SEQ ID NO: 64897 - DNA, 25 bp, Mus musculus
aagtaatcagtaaccaagccctaaa

SEQ ID NO: 64898 - DNA, 25 bp, Mus musculus
aagtaatcagtatccaagccctaaa

SEQ ID NO: 64899 - DNA, 25 bp, Mus musculus
aagtaatccatcctaaagcacccag

SEQ ID NO: 64900 - DNA, 25 bp, Mus musculus
aagtaatccatcgtaaagcacccag

SEQ ID NO: 64901 - DNA, 25 bp, Mus musculus
aagtaatgaaatcccctccacggat

SEQ ID NO: 64902 - DNA, 25 bp, Mus musculus
aagtaatgaaatgccctccacggat

SEQ ID NO: 64903 - DNA, 25 bp, Mus musculus
aagtaatgcattctccttctgttag

SEQ ID NO: 64904 - DNA, 25 bp, Mus musculus
aagtaatgcattgtccttctgttag

SEQ ID NO: 64905 - DNA, 25 bp, Mus musculus
aagtaatgccaacatcttgtatgag

SEQ ID NO: 64906 - DNA, 25 bp, Mus musculus
aagtaatgccaagatcttgtatgag

SEQ ID NO: 64907 - DNA, 25 bp, Mus musculus
aagtaatgccccagttgagtttgtg

SEQ ID NO: 64908 - DNA, 25 bp, Mus musculus
aagtaatgcccctgttgagtttgtg

SEQ ID NO: 64909 - DNA, 25 bp, Mus musculus
aagtaatgcttgagttagtttggaa

SEQ ID NO: 64910 - DNA, 25 bp, Mus musculus
aagtaatgcttgtgttagtttggaa

SEQ ID NO: 64911 - DNA, 25 bp, Mus musculus
aagtaatggctcacgggttggactg

SEQ ID NO: 64912 - DNA, 25 bp, Mus musculus
aagtaatggctctcgggttggactg

SEQ ID NO: 64913 - DNA, 25 bp, Mus musculus
aagtaatgtcctcactggtcgctct

SEQ ID NO: 64914 - DNA, 25 bp, Mus musculus
aagtaatgtcctctgttgtcaggga

SEQ ID NO: 64915 - DNA, 25 bp, Mus musculus
aagtaatgtcctgactggtcgctct

SEQ ID NO: 64916 - DNA, 25 bp, Mus musculus
aagtaatgtcctgtgttgtcaggga

SEQ ID NO: 64917 - DNA, 25 bp, Mus musculus
aagtaattcagtcctttgtcctatg

SEQ ID NO: 64918 - DNA, 25 bp, Mus musculus
aagtaattcagtgctttgtcctatg

SEQ ID NO: 64919 - DNA, 25 bp, Mus musculus
aagtaattgactctgttcctatccc

SEQ ID NO: 64920 - DNA, 25 bp, Mus musculus
aagtaattgactgtgttcctatccc

SEQ ID NO: 64921 - DNA, 25 bp, Mus musculus
aagtaatttaggcagctgtcagaaa

SEQ ID NO: 64922 - DNA, 25 bp, Mus musculus
aagtaatttagggagctgtcagaaa

SEQ ID NO: 64923 - DNA, 25 bp, Mus musculus
aagtaatttggacctcctagcgtcc

SEQ ID NO: 64924 - DNA, 25 bp, Mus musculus
aagtaatttggagctcctagcgtcc

SEQ ID NO: 64925 - DNA, 25 bp, Mus musculus
aagtaatttgtaatggtgaagctcc

SEQ ID NO: 64926 - DNA, 25 bp, Mus musculus
aagtaatttgtattggtgaagctcc

SEQ ID NO: 64927 - DNA, 25 bp, Mus musculus
aagtacaaacacattcccgttggca

SEQ ID NO: 64928 - DNA, 25 bp, Mus musculus
aagtacaaacactttcccgttggca

SEQ ID NO: 64929 - DNA, 25 bp, Mus musculus
aagtacaacatccagagtataatca

SEQ ID NO: 64930 - DNA, 25 bp, Mus musculus
aagtacaacatcgagagtataatca

SEQ ID NO: 64931 - DNA, 25 bp, Mus musculus
aagtacaacggtcagcaggctgatc

SEQ ID NO: 64932 - DNA, 25 bp, Mus musculus
aagtacaacggtgagcaggctgatc

SEQ ID NO: 64933 - DNA, 25 bp, Mus musculus
aagtacaacttcaattccaatctcc

SEQ ID NO: 64934 - DNA, 25 bp, Mus musculus
aagtacaacttctattccaatctcc

SEQ ID NO: 64935 - DNA, 25 bp, Mus musculus
aagtacaagttaccgcctatgcttt

SEQ ID NO: 64936 - DNA, 25 bp, Mus musculus
aagtacaagttagcgcctatgcttt

SEQ ID NO: 64937 - DNA, 25 bp, Mus musculus
aagtacaatctccttattctgaccc

SEQ ID NO: 64938 - DNA, 25 bp, Mus musculus
aagtacaatctcgttattctgaccc

SEQ ID NO: 64939 - DNA, 25 bp, Mus musculus
aagtacaatgaaaccttccagttca

SEQ ID NO: 64940 - DNA, 25 bp, Mus musculus
aagtacaatgaatccttccagttca

SEQ ID NO: 64941 - DNA, 25 bp, Mus musculus
aagtacaattccatcgtctgagccg

SEQ ID NO: 64942 - DNA, 25 bp, Mus musculus
aagtacaattccttcgtctgagccg

SEQ ID NO: 64943 - DNA, 25 bp, Mus musculus
aagtacacaagcagtttcccctcaa

SEQ ID NO: 64944 - DNA, 25 bp, Mus musculus
aagtacacaagctgtttcccctcaa

SEQ ID NO: 64945 - DNA, 25 bp, Mus musculus
aagtacacacaaacagcactgaacg

SEQ ID NO: 64946 - DNA, 25 bp, Mus musculus
aagtacacacaatcagcactgaacg

SEQ ID NO: 64947 - DNA, 25 bp, Mus musculus
aagtacacacttcagcccctttgga

SEQ ID NO: 64948 - DNA, 25 bp, Mus musculus
aagtacacacttgagcccctttgga

SEQ ID NO: 64949 - DNA, 25 bp, Mus musculus
aagtacacagatcgtgccctgcggg

SEQ ID NO: 64950 - DNA, 25 bp, Mus musculus
aagtacacagatggtgccctgcggg

SEQ ID NO: 64951 - DNA, 25 bp, Mus musculus
aagtacacatacctgacattcaaag

SEQ ID NO: 64952 - DNA, 25 bp, Mus musculus
aagtacacatacgtgacattcaaag

SEQ ID NO: 64953 - DNA, 25 bp, Mus musculus
aagtacacatgacgtcacctttcac

SEQ ID NO: 64954 - DNA, 25 bp, Mus musculus
aagtacacatgaggtcacctttcac

SEQ ID NO: 64955 - DNA, 25 bp, Mus musculus
aagtacacatttattcccatggttg

SEQ ID NO: 64956 - DNA, 25 bp, Mus musculus
aagtacacattttttcccatggttg

SEQ ID NO: 64957 - DNA, 25 bp, Mus musculus
aagtacaccactctatttaacactc

SEQ ID NO: 64958 - DNA, 25 bp, Mus musculus
aagtacaccactgtatttaacactc

SEQ ID NO: 64959 - DNA, 25 bp, Mus musculus
aagtacaccctaatctgtctatctt

SEQ ID NO: 64960 - DNA, 25 bp, Mus musculus
aagtacaccctaccttttttcgatg

SEQ ID NO: 64961 - DNA, 25 bp, Mus musculus
aagtacaccctagcttttttcgatg

SEQ ID NO: 64962 - DNA, 25 bp, Mus musculus
aagtacaccctattctgtctatctt

SEQ ID NO: 64963 - DNA, 25 bp, Mus musculus
aagtacacggtccatgagcgctgtg

SEQ ID NO: 64964 - DNA, 25 bp, Mus musculus
aagtacacggtcgatgagcgctgtg

SEQ ID NO: 64965 - DNA, 25 bp, Mus musculus
aagtacactagcagcgtgcttcaat

SEQ ID NO: 64966 - DNA, 25 bp, Mus musculus
aagtacactagctgcgtgcttcaat

SEQ ID NO: 64967 - DNA, 25 bp, Mus musculus
aagtacactgacatgccccgtggga

SEQ ID NO: 64968 - DNA, 25 bp, Mus musculus
aagtacactgacttgccccgtggga

SEQ ID NO: 64969 - DNA, 25 bp, Mus musculus
aagtacacttgcagctcttatagag

SEQ ID NO: 64970 - DNA, 25 bp, Mus musculus
aagtacacttgctgctcttatagag

SEQ ID NO: 64971 - DNA, 25 bp, Mus musculus
aagtacagagccagggtcatgccat

SEQ ID NO: 64972 - DNA, 25 bp, Mus musculus
aagtacagagcctgggtcatgccat

SEQ ID NO: 64973 - DNA, 25 bp, Mus musculus
aagtacagagcgctcgcctctgagt

SEQ ID NO: 64974 - DNA, 25 bp, Mus musculus
aagtacagagcggtcgcctctgagt

SEQ ID NO: 64975 - DNA, 25 bp, Mus musculus
aagtacagaggcaactgtcttccac

SEQ ID NO: 64976 - DNA, 25 bp, Mus musculus
aagtacagaggctactgtcttccac

SEQ ID NO: 64977 - DNA, 25 bp, Mus musculus
aagtacagcaccaagttcctcagca

SEQ ID NO: 64978 - DNA, 25 bp, Mus musculus
aagtacagcacctagttcctcagca

SEQ ID NO: 64979 - DNA, 25 bp, Mus musculus
aagtacagcactacgagttttaaag

SEQ ID NO: 64980 - DNA, 25 bp, Mus musculus
aagtacagcacttcgagttttaaag

SEQ ID NO: 64981 - DNA, 25 bp, Mus musculus
aagtacagcatcagcaagagcggtt

SEQ ID NO: 64982 - DNA, 25 bp, Mus musculus
aagtacagcatctgcaagagcggtt

SEQ ID NO: 64983 - DNA, 25 bp, Mus musculus
aagtacagccggatagaagttcaag

SEQ ID NO: 64984 - DNA, 25 bp, Mus musculus
aagtacagccggttagaagttcaag

SEQ ID NO: 64985 - DNA, 25 bp, Mus musculus
aagtacagcgttcgtgctgttccca

SEQ ID NO: 64986 - DNA, 25 bp, Mus musculus
aagtacagcgttggtgctgttccca

SEQ ID NO: 64987 - DNA, 25 bp, Mus musculus
aagtacaggagcattgtcatccccg

SEQ ID NO: 64988 - DNA, 25 bp, Mus musculus
aagtacaggagctttgtcatccccg

SEQ ID NO: 64989 - DNA, 25 bp, Mus musculus
aagtacagggtgctgggctcactac

SEQ ID NO: 64990 - DNA, 25 bp, Mus musculus
aagtacagggtggtgggctcactac

SEQ ID NO: 64991 - DNA, 25 bp, Mus musculus
aagtacagtcggcttctggatccat

SEQ ID NO: 64992 - DNA, 25 bp, Mus musculus
aagtacagtcgggttctggatccat

SEQ ID NO: 64993 - DNA, 25 bp, Mus musculus
aagtacagtgctctacgccggaagt

SEQ ID NO: 64994 - DNA, 25 bp, Mus musculus
aagtacagtgctgtacgccggaagt

SEQ ID NO: 64995 - DNA, 25 bp, Mus musculus
aagtacagtgttagcaactccaact

SEQ ID NO: 64996 - DNA, 25 bp, Mus musculus
aagtacagtgtttgcaactccaact

SEQ ID NO: 64997 - DNA, 25 bp, Mus musculus
aagtacataggaattcgggcagcat

SEQ ID NO: 64998 - DNA, 25 bp, Mus musculus
aagtacataggatttcgggcagcat

SEQ ID NO: 64999 - DNA, 25 bp, Mus musculus
aagtacatcacccaactcttcagaa

SEQ ID NO: 65000 - DNA, 25 bp, Mus musculus
aagtacatcaccgaactcttcagaa

SEQ ID NO: 65001 - DNA, 25 bp, Mus musculus
aagtacatcattctgggagtgggct

SEQ ID NO: 65002 - DNA, 25 bp, Mus musculus
aagtacatcattgtgggagtgggct

SEQ ID NO: 65003 - DNA, 25 bp, Mus musculus
aagtacatcctgcagcatctgtgca

SEQ ID NO: 65004 - DNA, 25 bp, Mus musculus
aagtacatcctggagcatctgtgca

SEQ ID NO: 65005 - DNA, 25 bp, Mus musculus
aagtacatcggaattctctggaatg

SEQ ID NO: 65006 - DNA, 25 bp, Mus musculus
aagtacatcggatttctctggaatg

SEQ ID NO: 65007 - DNA, 25 bp, Mus musculus
aagtacatcggcacgggccacgccg

SEQ ID NO: 65008 - DNA, 25 bp, Mus musculus
aagtacatcggctcgggccacgccg

SEQ ID NO: 65009 - DNA, 25 bp, Mus musculus
aagtacatgcaccagtttgcccata

SEQ ID NO: 65010 - DNA, 25 bp, Mus musculus
aagtacatgcacgagtttgcccata

SEQ ID NO: 65011 - DNA, 25 bp, Mus musculus
aagtacatggtcacctccagttttt

SEQ ID NO: 65012 - DNA, 25 bp, Mus musculus
aagtacatggtctcctccagttttt

SEQ ID NO: 65013 - DNA, 25 bp, Mus musculus
aagtacattcagacaccagagtgga

SEQ ID NO: 65014 - DNA, 25 bp, Mus musculus
aagtacattcagtcaccagagtgga

SEQ ID NO: 65015 - DNA, 25 bp, Mus musculus
aagtacattccgatcacggggcaca

SEQ ID NO: 65016 - DNA, 25 bp, Mus musculus
aagtacattccgttcacggggcaca

SEQ ID NO: 65017 - DNA, 25 bp, Mus musculus
aagtacattgcactgtcctcagagg

SEQ ID NO: 65018 - DNA, 25 bp, Mus musculus
aagtacattgcagtgtcctcagagg

SEQ ID NO: 65019 - DNA, 25 bp, Mus musculus
aagtacattgtcaaccgtcctgcaa

SEQ ID NO: 65020 - DNA, 25 bp, Mus musculus
aagtacattgtctaccgtcctgcaa

SEQ ID NO: 65021 - DNA, 25 bp, Mus musculus
aagtacattttcaggtcttgagacc

SEQ ID NO: 65022 - DNA, 25 bp, Mus musculus
aagtacattttctggtcttgagacc

SEQ ID NO: 65023 - DNA, 25 bp, Mus musculus
aagtacatttttcacttgggaggca

SEQ ID NO: 65024 - DNA, 25 bp, Mus musculus
aagtacatttttccaactgttgcta

SEQ ID NO: 65025 - DNA, 25 bp, Mus musculus
aagtacatttttgacttgggaggca

SEQ ID NO: 65026 - DNA, 25 bp, Mus musculus
aagtacatttttgcaactgttgcta

SEQ ID NO: 65027 - DNA, 25 bp, Mus musculus
aagtaccacaggatgctcaccataa

SEQ ID NO: 65028 - DNA, 25 bp, Mus musculus
aagtaccacaggttgctcaccataa

SEQ ID NO: 65029 - DNA, 25 bp, Mus musculus
aagtaccaccagctgactgttctct

SEQ ID NO: 65030 - DNA, 25 bp, Mus musculus
aagtaccaccaggtgactgttctct

SEQ ID NO: 65031 - DNA, 25 bp, Mus musculus
aagtaccactgacaggctgttcttt

SEQ ID NO: 65032 - DNA, 25 bp, Mus musculus
aagtaccactgagaggctgttcttt

SEQ ID NO: 65033 - DNA, 25 bp, Mus musculus
aagtaccagagtcagagacctggat

SEQ ID NO: 65034 - DNA, 25 bp, Mus musculus
aagtaccagagtgagagacctggat

SEQ ID NO: 65035 - DNA, 25 bp, Mus musculus
aagtaccagcatcgttcttttgcca

SEQ ID NO: 65036 - DNA, 25 bp, Mus musculus
aagtaccagcatggttcttttgcca

SEQ ID NO: 65037 - DNA, 25 bp, Mus musculus
aagtaccaggacagcattcgacgca

SEQ ID NO: 65038 - DNA, 25 bp, Mus musculus
aagtaccaggactgcattcgacgca

SEQ ID NO: 65039 - DNA, 25 bp, Mus musculus
aagtaccaggcaattctaacgaggg

SEQ ID NO: 65040 - DNA, 25 bp, Mus musculus
aagtaccaggcatttctaacgaggg

SEQ ID NO: 65041 - DNA, 25 bp, Mus musculus
aagtaccatactctctagtcatcaa

SEQ ID NO: 65042 - DNA, 25 bp, Mus musculus
aagtaccatactgtctagtcatcaa

SEQ ID NO: 65043 - DNA, 25 bp, Mus musculus
aagtaccatcttacagtgttcctgc

SEQ ID NO: 65044 - DNA, 25 bp, Mus musculus
aagtaccatctttcagtgttcctgc

SEQ ID NO: 65045 - DNA, 25 bp, Mus musculus
aagtaccatgatatttattctgcag

SEQ ID NO: 65046 - DNA, 25 bp, Mus musculus
aagtaccatgatttttattctgcag

SEQ ID NO: 65047 - DNA, 25 bp, Mus musculus
aagtaccatgctatctcttagttcc

SEQ ID NO: 65048 - DNA, 25 bp, Mus musculus
aagtaccatgctttctcttagttcc

SEQ ID NO: 65049 - DNA, 25 bp, Mus musculus
aagtaccatggaatctactcttccc

SEQ ID NO: 65050 - DNA, 25 bp, Mus musculus
aagtaccatggattctactcttccc

SEQ ID NO: 65051 - DNA, 25 bp, Mus musculus
aagtaccatgtgacaattgcccctt

SEQ ID NO: 65052 - DNA, 25 bp, Mus musculus
aagtaccatgtgtcaattgcccctt

SEQ ID NO: 65053 - DNA, 25 bp, Mus musculus
aagtaccattaaactccattccagt

SEQ ID NO: 65054 - DNA, 25 bp, Mus musculus
aagtaccattaatctccattccagt

SEQ ID NO: 65055 - DNA, 25 bp, Mus musculus
aagtaccatttgaattcatcctcaa

SEQ ID NO: 65056 - DNA, 25 bp, Mus musculus
aagtaccatttgtattcatcctcaa

SEQ ID NO: 65057 - DNA, 25 bp, Mus musculus
aagtacccaagaaagttcctgatga

SEQ ID NO: 65058 - DNA, 25 bp, Mus musculus
aagtacccaagatagttcctgatga

SEQ ID NO: 65059 - DNA, 25 bp, Mus musculus
aagtacccacacagcgaggagaaga

SEQ ID NO: 65060 - DNA, 25 bp, Mus musculus
aagtacccacactgcgaggagaaga

SEQ ID NO: 65061 - DNA, 25 bp, Mus musculus
aagtacccactgaggcgagaggcca

SEQ ID NO: 65062 - DNA, 25 bp, Mus musculus
aagtacccactgtggcgagaggcca

SEQ ID NO: 65063 - DNA, 25 bp, Mus musculus
aagtacccagacactgaggtggtgg

SEQ ID NO: 65064 - DNA, 25 bp, Mus musculus
aagtacccagactctgaggtggtgg

SEQ ID NO: 65065 - DNA, 25 bp, Mus musculus
aagtacccagagactcttgaacagg

SEQ ID NO: 65066 - DNA, 25 bp, Mus musculus
aagtacccagagtctcttgaacagg

SEQ ID NO: 65067 - DNA, 25 bp, Mus musculus
aagtacccaggcaacacagactgaa

SEQ ID NO: 65068 - DNA, 25 bp, Mus musculus
aagtacccaggctacacagactgaa

SEQ ID NO: 65069 - DNA, 25 bp, Mus musculus
aagtacccctggatcatgtccgagt

SEQ ID NO: 65070 - DNA, 25 bp, Mus musculus
aagtacccctggttcatgtccgagt

SEQ ID NO: 65071 - DNA, 25 bp, Mus musculus
aagtacccgtgcagatgccttacgg

SEQ ID NO: 65072 - DNA, 25 bp, Mus musculus
aagtacccgtgctgatgccttacgg

SEQ ID NO: 65073 - DNA, 25 bp, Mus musculus
aagtaccctcagagcttacatatgt

SEQ ID NO: 65074 - DNA, 25 bp, Mus musculus
aagtaccctcagtgcttacatatgt

SEQ ID NO: 65075 - DNA, 25 bp, Mus musculus
aagtaccctgaacaatatttagcac

SEQ ID NO: 65076 - DNA, 25 bp, Mus musculus
aagtaccctgaagaatatttagcac

SEQ ID NO: 65077 - DNA, 25 bp, Mus musculus
aagtaccctgccagtataattgcat

SEQ ID NO: 65078 - DNA, 25 bp, Mus musculus
aagtaccctgcctgtataattgcat

SEQ ID NO: 65079 - DNA, 25 bp, Mus musculus
aagtaccgagcccaggcccttctga

SEQ ID NO: 65080 - DNA, 25 bp, Mus musculus
aagtaccgagccgaggcccttctga

SEQ ID NO: 65081 - DNA, 25 bp, Mus musculus
aagtaccggcctaagcagagactga

SEQ ID NO: 65082 - DNA, 25 bp, Mus musculus
aagtaccggccttagcagagactga

SEQ ID NO: 65083 - DNA, 25 bp, Mus musculus
aagtaccgggagcttgccttgtcag

SEQ ID NO: 65084 - DNA, 25 bp, Mus musculus
aagtaccgggaggttgccttgtcag

SEQ ID NO: 65085 - DNA, 25 bp, Mus musculus
aagtaccgtgccctctccgagcaag

SEQ ID NO: 65086 - DNA, 25 bp, Mus musculus
aagtaccgtgccgtctccgagcaag

SEQ ID NO: 65087 - DNA, 25 bp, Mus musculus
aagtacctagagagtcagattcata

SEQ ID NO: 65088 - DNA, 25 bp, Mus musculus
aagtacctagagtgtcagattcata

SEQ ID NO: 65089 - DNA, 25 bp, Mus musculus
aagtacctcaataggaacctcctgt

SEQ ID NO: 65090 - DNA, 25 bp, Mus musculus
aagtacctcaattggaacctcctgt

SEQ ID NO: 65091 - DNA, 25 bp, Mus musculus
aagtacctcaccagttactgtgtaa

SEQ ID NO: 65092 - DNA, 25 bp, Mus musculus
aagtacctcacctgttactgtgtaa

SEQ ID NO: 65093 - DNA, 25 bp, Mus musculus
aagtacctcagaccgtgtttcctgg

SEQ ID NO: 65094 - DNA, 25 bp, Mus musculus
aagtacctcagagcgtgtttcctgg

SEQ ID NO: 65095 - DNA, 25 bp, Mus musculus
aagtacctcattcgtgctgcacctg

SEQ ID NO: 65096 - DNA, 25 bp, Mus musculus
aagtacctcattggtgctgcacctg

SEQ ID NO: 65097 - DNA, 25 bp, Mus musculus
aagtacctccatcccaaattgggat

SEQ ID NO: 65098 - DNA, 25 bp, Mus musculus
aagtacctccatgccaaattgggat

SEQ ID NO: 65099 - DNA, 25 bp, Mus musculus
aagtacctcggactttcctgacatt

SEQ ID NO: 65100 - DNA, 25 bp, Mus musculus
aagtacctcggagtttcctgacatt

SEQ ID NO: 65101 - DNA, 25 bp, Mus musculus
aagtacctctctactgagcatgccc

SEQ ID NO: 65102 - DNA, 25 bp, Mus musculus
aagtacctctcttctgagcatgccc

SEQ ID NO: 65103 - DNA, 25 bp, Mus musculus
aagtacctctggcagttgtttcgga

SEQ ID NO: 65104 - DNA, 25 bp, Mus musculus
aagtacctctgggagttgtttcgga

SEQ ID NO: 65105 - DNA, 25 bp, Mus musculus
aagtacctctttcccatgtacaggg

SEQ ID NO: 65106 - DNA, 25 bp, Mus musculus
aagtacctctttgccatgtacaggg

SEQ ID NO: 65107 - DNA, 25 bp, Mus musculus
aagtacctgagcagttaggccccag

SEQ ID NO: 65108 - DNA, 25 bp, Mus musculus
aagtacctgagctgttaggccccag

SEQ ID NO: 65109 - DNA, 25 bp, Mus musculus
aagtacctgatgaccatgatcgtgg

SEQ ID NO: 65110 - DNA, 25 bp, Mus musculus
aagtacctgatgtccatgatcgtgg

SEQ ID NO: 65111 - DNA, 25 bp, Mus musculus
aagtacctgcatcgtgtgatctcac

SEQ ID NO: 65112 - DNA, 25 bp, Mus musculus
aagtacctgcatggtgtgatctcac

SEQ ID NO: 65113 - DNA, 25 bp, Mus musculus
aagtacctgctcaagtatgttttta

SEQ ID NO: 65114 - DNA, 25 bp, Mus musculus
aagtacctgctctagtatgttttta

SEQ ID NO: 65115 - DNA, 25 bp, Mus musculus
aagtacctgctgacaaaccctaaat

SEQ ID NO: 65116 - DNA, 25 bp, Mus musculus
aagtacctgctgtcaaaccctaaat

SEQ ID NO: 65117 - DNA, 25 bp, Mus musculus
aagtacctggacattggtctccttt

SEQ ID NO: 65118 - DNA, 25 bp, Mus musculus
aagtacctggactttggtctccttt

SEQ ID NO: 65119 - DNA, 25 bp, Mus musculus
aagtacctggcaatgaagcctccca

SEQ ID NO: 65120 - DNA, 25 bp, Mus musculus
aagtacctggcattgaagcctccca

SEQ ID NO: 65121 - DNA, 25 bp, Mus musculus
aagtacctggcccatgggctaccag

SEQ ID NO: 65122 - DNA, 25 bp, Mus musculus
aagtacctggccgatgggctaccag

SEQ ID NO: 65123 - DNA, 25 bp, Mus musculus
aagtacctgtttaagtggtcaagca

SEQ ID NO: 65124 - DNA, 25 bp, Mus musculus
aagtacctgttttagtggtcaagca

SEQ ID NO: 65125 - DNA, 25 bp, Mus musculus
aagtaccttcagcagggccgcagtg

SEQ ID NO: 65126 - DNA, 25 bp, Mus musculus
aagtaccttcaggagggccgcagtg

SEQ ID NO: 65127 - DNA, 25 bp, Mus musculus
aagtaccttccactccttagatgag

SEQ ID NO: 65128 - DNA, 25 bp, Mus musculus
aagtaccttccagtccttagatgag

SEQ ID NO: 65129 - DNA, 25 bp, Mus musculus
aagtaccttcctagagttacacagg

SEQ ID NO: 65130 - DNA, 25 bp, Mus musculus
aagtaccttccttgagttacacagg

SEQ ID NO: 65131 - DNA, 25 bp, Mus musculus
aagtaccttcggcagctgtttcaaa

SEQ ID NO: 65132 - DNA, 25 bp, Mus musculus
aagtaccttcgggagctgtttcaaa

SEQ ID NO: 65133 - DNA, 25 bp, Mus musculus
aagtaccttggcagctggcatgaga

SEQ ID NO: 65134 - DNA, 25 bp, Mus musculus
aagtaccttggctgctggcatgaga

SEQ ID NO: 65135 - DNA, 25 bp, Mus musculus
aagtacctttttctcaatccaacag

SEQ ID NO: 65136 - DNA, 25 bp, Mus musculus
aagtacctttttgtcaatccaacag

SEQ ID NO: 65137 - DNA, 25 bp, Mus musculus
aagtacgaccaaagcctgtggcgat

SEQ ID NO: 65138 - DNA, 25 bp, Mus musculus
aagtacgaccaatgcctgtggcgat

SEQ ID NO: 65139 - DNA, 25 bp, Mus musculus
aagtacgctattacccatcataagg

SEQ ID NO: 65140 - DNA, 25 bp, Mus musculus
aagtacgctatttcccatcataagg

SEQ ID NO: 65141 - DNA, 25 bp, Mus musculus
aagtacgctgctctgtctgtggatg

SEQ ID NO: 65142 - DNA, 25 bp, Mus musculus
aagtacgctgctgtgtctgtggatg

SEQ ID NO: 65143 - DNA, 25 bp, Mus musculus
aagtacggagatccgttcatccgag

SEQ ID NO: 65144 - DNA, 25 bp, Mus musculus
aagtacggagatgcgttcatccgag

SEQ ID NO: 65145 - DNA, 25 bp, Mus musculus
aagtacggagtcagctgtgccattt

SEQ ID NO: 65146 - DNA, 25 bp, Mus musculus
aagtacggagtctgctgtgccattt

SEQ ID NO: 65147 - DNA, 25 bp, Mus musculus
aagtacggccagcagagagccgcca

SEQ ID NO: 65148 - DNA, 25 bp, Mus musculus
aagtacggccaggagagagccgcca

SEQ ID NO: 65149 - DNA, 25 bp, Mus musculus
aagtacggcgtgattatgcgagtga

SEQ ID NO: 65150 - DNA, 25 bp, Mus musculus
aagtacggcgtgtttatgcgagtga

SEQ ID NO: 65151 - DNA, 25 bp, Mus musculus
aagtacgtctctagcatactgcacg

SEQ ID NO: 65152 - DNA, 25 bp, Mus musculus
aagtacgtctcttgcatactgcacg

SEQ ID NO: 65153 - DNA, 25 bp, Mus musculus
aagtacgtggacaagcttcttccca

SEQ ID NO: 65154 - DNA, 25 bp, Mus musculus
aagtacgtggactagcttcttccca

SEQ ID NO: 65155 - DNA, 25 bp, Mus musculus
aagtacgtgtacatcaccatcgtca

SEQ ID NO: 65156 - DNA, 25 bp, Mus musculus
aagtacgtgtacttcaccatcgtca

SEQ ID NO: 65157 - DNA, 25 bp, Mus musculus
aagtacgttgacatgttgctccgga

SEQ ID NO: 65158 - DNA, 25 bp, Mus musculus
aagtacgttgacttgttgctccgga

SEQ ID NO: 65159 - DNA, 25 bp, Mus musculus
aagtacgttggcattttgtttctgt

SEQ ID NO: 65160 - DNA, 25 bp, Mus musculus
aagtacgttggctttttgtttctgt

SEQ ID NO: 65161 - DNA, 25 bp, Mus musculus
aagtactaaactccacctctaatgt

SEQ ID NO: 65162 - DNA, 25 bp, Mus musculus
aagtactaaactgcacctctaatgt

SEQ ID NO: 65163 - DNA, 25 bp, Mus musculus
aagtactaagtcacccaggttaatg

SEQ ID NO: 65164 - DNA, 25 bp, Mus musculus
aagtactaagtctcccaggttaatg

SEQ ID NO: 65165 - DNA, 25 bp, Mus musculus
aagtactacgagcatgtggacatta

SEQ ID NO: 65166 - DNA, 25 bp, Mus musculus
aagtactacgaggatgtggacatta

SEQ ID NO: 65167 - DNA, 25 bp, Mus musculus
aagtactactcaattccacttctct

SEQ ID NO: 65168 - DNA, 25 bp, Mus musculus
aagtactactcatttccacttctct

SEQ ID NO: 65169 - DNA, 25 bp, Mus musculus
aagtactactttccagtgcgcgcca

SEQ ID NO: 65170 - DNA, 25 bp, Mus musculus
aagtactactttgcagtgcgcgcca

SEQ ID NO: 65171 - DNA, 25 bp, Mus musculus
aagtactatgtacgtttgactccat

SEQ ID NO: 65172 - DNA, 25 bp, Mus musculus
aagtactatgtaggtttgactccat

SEQ ID NO: 65173 - DNA, 25 bp, Mus musculus
aagtactatgttaccttgtggtgta

SEQ ID NO: 65174 - DNA, 25 bp, Mus musculus
aagtactatgtttccttgtggtgta

SEQ ID NO: 65175 - DNA, 25 bp, Mus musculus
aagtactattcgctcactaccacct

SEQ ID NO: 65176 - DNA, 25 bp, Mus musculus
aagtactattcggtcactaccacct

SEQ ID NO: 65177 - DNA, 25 bp, Mus musculus
aagtactcacaacctggttctcaac

SEQ ID NO: 65178 - DNA, 25 bp, Mus musculus
aagtactcacaagctggttctcaac

SEQ ID NO: 65179 - DNA, 25 bp, Mus musculus
aagtactccgaaaatgcagcatgct

SEQ ID NO: 65180 - DNA, 25 bp, Mus musculus
aagtactccgaatatgcagcatgct

SEQ ID NO: 65181 - DNA, 25 bp, Mus musculus
aagtactccgctaacagaactgttg

SEQ ID NO: 65182 - DNA, 25 bp, Mus musculus
aagtactccgcttacagaactgttg

SEQ ID NO: 65183 - DNA, 25 bp, Mus musculus
aagtactccggcatcaagctgcgat

SEQ ID NO: 65184 - DNA, 25 bp, Mus musculus
aagtactccggcttcaagctgcgat

SEQ ID NO: 65185 - DNA, 25 bp, Mus musculus
aagtactcggcaaattgtcagggac

SEQ ID NO: 65186 - DNA, 25 bp, Mus musculus
aagtactcggcatattgtcagggac

SEQ ID NO: 65187 - DNA, 25 bp, Mus musculus
aagtactctagtccctttatgcaga

SEQ ID NO: 65188 - DNA, 25 bp, Mus musculus
aagtactctagtgcctttatgcaga

SEQ ID NO: 65189 - DNA, 25 bp, Mus musculus
aagtactctcagaaggaagacaaat

SEQ ID NO: 65190 - DNA, 25 bp, Mus musculus
aagtactctcagtaggaagacaaat

SEQ ID NO: 65191 - DNA, 25 bp, Mus musculus
aagtactctcttcatgatcagccat

SEQ ID NO: 65192 - DNA, 25 bp, Mus musculus
aagtactctcttgatgatcagccat

SEQ ID NO: 65193 - DNA, 25 bp, Mus musculus
aagtactcttgcatgtagtgaccag

SEQ ID NO: 65194 - DNA, 25 bp, Mus musculus
aagtactcttgcttgtagtgaccag

SEQ ID NO: 65195 - DNA, 25 bp, Mus musculus
aagtactcttttcatatggttgggt

SEQ ID NO: 65196 - DNA, 25 bp, Mus musculus
aagtactcttttgatatggttgggt

SEQ ID NO: 65197 - DNA, 25 bp, Mus musculus
aagtactgaagcctctgctgagtgg

SEQ ID NO: 65198 - DNA, 25 bp, Mus musculus
aagtactgaagcgtctgctgagtgg

SEQ ID NO: 65199 - DNA, 25 bp, Mus musculus
aagtactgacagatgccttccacta

SEQ ID NO: 65200 - DNA, 25 bp, Mus musculus
aagtactgacagttgccttccacta

SEQ ID NO: 65201 - DNA, 25 bp, Mus musculus
aagtactgactaagatccgaaggaa

SEQ ID NO: 65202 - DNA, 25 bp, Mus musculus
aagtactgactatgatccgaaggaa

SEQ ID NO: 65203 - DNA, 25 bp, Mus musculus
aagtactgatggcagactcctccca

SEQ ID NO: 65204 - DNA, 25 bp, Mus musculus
aagtactgatgggagactcctccca

SEQ ID NO: 65205 - DNA, 25 bp, Mus musculus
aagtactgatgtagtagctggccat

SEQ ID NO: 65206 - DNA, 25 bp, Mus musculus
aagtactgatgttgtagctggccat

SEQ ID NO: 65207 - DNA, 25 bp, Mus musculus
aagtactgcacaagtgggacccctt

SEQ ID NO: 65208 - DNA, 25 bp, Mus musculus
aagtactgcacatgtgggacccctt

SEQ ID NO: 65209 - DNA, 25 bp, Mus musculus
aagtactgcatccaggatcacccag

SEQ ID NO: 65210 - DNA, 25 bp, Mus musculus
aagtactgcatcgaggatcacccag

SEQ ID NO: 65211 - DNA, 25 bp, Mus musculus
aagtactgccttagagagcacacac

SEQ ID NO: 65212 - DNA, 25 bp, Mus musculus
aagtactgcctttgagagcacacac

SEQ ID NO: 65213 - DNA, 25 bp, Mus musculus
aagtactgctccacaggctttgtaa

SEQ ID NO: 65214 - DNA, 25 bp, Mus musculus
aagtactgctcctcaggctttgtaa

SEQ ID NO: 65215 - DNA, 25 bp, Mus musculus
aagtactgctgcagcgagccgggca

SEQ ID NO: 65216 - DNA, 25 bp, Mus musculus
aagtactgctgcatatgctgtttgc

SEQ ID NO: 65217 - DNA, 25 bp, Mus musculus
aagtactgctgctgcgagccgggca

SEQ ID NO: 65218 - DNA, 25 bp, Mus musculus
aagtactgctgcttatgctgtttgc

SEQ ID NO: 65219 - DNA, 25 bp, Mus musculus
aagtactggacactgacggcgaccg

SEQ ID NO: 65220 - DNA, 25 bp, Mus musculus
aagtactggacagtgacggcgaccg

SEQ ID NO: 65221 - DNA, 25 bp, Mus musculus
aagtactggacgactcggacgacga

SEQ ID NO: 65222 - DNA, 25 bp, Mus musculus
aagtactggacgtctcggacgacga

SEQ ID NO: 65223 - DNA, 25 bp, Mus musculus
aagtactggagcaccttggtaagga

SEQ ID NO: 65224 - DNA, 25 bp, Mus musculus
aagtactggagcacgggaggtcctt

SEQ ID NO: 65225 - DNA, 25 bp, Mus musculus
aagtactggagctccttggtaagga

SEQ ID NO: 65226 - DNA, 25 bp, Mus musculus
aagtactggagctcgggaggtcctt

SEQ ID NO: 65227 - DNA, 25 bp, Mus musculus
aagtactggattcggcatgagcaca

SEQ ID NO: 65228 - DNA, 25 bp, Mus musculus
aagtactggattgggcatgagcaca

SEQ ID NO: 65229 - DNA, 25 bp, Mus musculus
aagtactgggatactgcctggctta

SEQ ID NO: 65230 - DNA, 25 bp, Mus musculus
aagtactgggattctgcctggctta

SEQ ID NO: 65231 - DNA, 25 bp, Mus musculus
aagtactggtcgcagatcccactgc

SEQ ID NO: 65232 - DNA, 25 bp, Mus musculus
aagtactggtcggagatcccactgc

SEQ ID NO: 65233 - DNA, 25 bp, Mus musculus
aagtactggtttcaggctccgccaa

SEQ ID NO: 65234 - DNA, 25 bp, Mus musculus
aagtactggtttgaggctccgccaa

SEQ ID NO: 65235 - DNA, 25 bp, Mus musculus
aagtactgtaagagctttactgctg

SEQ ID NO: 65236 - DNA, 25 bp, Mus musculus
aagtactgtaagtgctttactgctg

SEQ ID NO: 65237 - DNA, 25 bp, Mus musculus
aagtactgtagccttaaaattctgt

SEQ ID NO: 65238 - DNA, 25 bp, Mus musculus
aagtactgtagcgttaaaattctgt

SEQ ID NO: 65239 - DNA, 25 bp, Mus musculus
aagtactgtcaccttgagctcacaa

SEQ ID NO: 65240 - DNA, 25 bp, Mus musculus
aagtactgtcacgttgagctcacaa

SEQ ID NO: 65241 - DNA, 25 bp, Mus musculus
aagtactgttaacccctgagccagg

SEQ ID NO: 65242 - DNA, 25 bp, Mus musculus
aagtactgttaagccctgagccagg

SEQ ID NO: 65243 - DNA, 25 bp, Mus musculus
aagtactgttctatgattcctgtca

SEQ ID NO: 65244 - DNA, 25 bp, Mus musculus
aagtactgttctttgattcctgtca

SEQ ID NO: 65245 - DNA, 25 bp, Mus musculus
aagtacttagcaccctcggagcaga

SEQ ID NO: 65246 - DNA, 25 bp, Mus musculus
aagtacttagcagcctcggagcaga

SEQ ID NO: 65247 - DNA, 25 bp, Mus musculus
aagtacttaggcaggcttagattaa

SEQ ID NO: 65248 - DNA, 25 bp, Mus musculus
aagtacttaggctggcttagattaa

SEQ ID NO: 65249 - DNA, 25 bp, Mus musculus
aagtacttagtgaatggacatccaa

SEQ ID NO: 65250 - DNA, 25 bp, Mus musculus
aagtacttagtgtatggacatccaa

SEQ ID NO: 65251 - DNA, 25 bp, Mus musculus
aagtacttatatcttgaaggccaga

SEQ ID NO: 65252 - DNA, 25 bp, Mus musculus
aagtacttatatgttgaaggccaga

SEQ ID NO: 65253 - DNA, 25 bp, Mus musculus
aagtacttatgtcggtgcaggttaa

SEQ ID NO: 65254 - DNA, 25 bp, Mus musculus
aagtacttatgtgggtgcaggttaa

SEQ ID NO: 65255 - DNA, 25 bp, Mus musculus
aagtacttcaatccttgctatgcca

SEQ ID NO: 65256 - DNA, 25 bp, Mus musculus
aagtacttcaatgcttgctatgcca

SEQ ID NO: 65257 - DNA, 25 bp, Mus musculus
aagtacttcacaacagtgctgagca

SEQ ID NO: 65258 - DNA, 25 bp, Mus musculus
aagtacttcacatcagtgctgagca

SEQ ID NO: 65259 - DNA, 25 bp, Mus musculus
aagtacttcactcggagccttgaga

SEQ ID NO: 65260 - DNA, 25 bp, Mus musculus
aagtacttcactgggagccttgaga

SEQ ID NO: 65261 - DNA, 25 bp, Mus musculus
aagtacttgaccacacatggtaagg

SEQ ID NO: 65262 - DNA, 25 bp, Mus musculus
aagtacttgacctcacatggtaagg

SEQ ID NO: 65263 - DNA, 25 bp, Mus musculus
aagtacttgctacacgagcctggtg

SEQ ID NO: 65264 - DNA, 25 bp, Mus musculus
aagtacttgctagacgagcctggtg

SEQ ID NO: 65265 - DNA, 25 bp, Mus musculus
aagtacttgctcatccagtgttgca

SEQ ID NO: 65266 - DNA, 25 bp, Mus musculus
aagtacttgctcttccagtgttgca

SEQ ID NO: 65267 - DNA, 25 bp, Mus musculus
aagtacttgctgatgggtaatgccg

SEQ ID NO: 65268 - DNA, 25 bp, Mus musculus
aagtacttgctgttgggtaatgccg

SEQ ID NO: 65269 - DNA, 25 bp, Mus musculus
aagtacttgggaattcatgagatga

SEQ ID NO: 65270 - DNA, 25 bp, Mus musculus
aagtacttgggatttcatgagatga

SEQ ID NO: 65271 - DNA, 25 bp, Mus musculus
aagtacttgtttagagacatcctag

SEQ ID NO: 65272 - DNA, 25 bp, Mus musculus
aagtacttgttttgagacatcctag

SEQ ID NO: 65273 - DNA, 25 bp, Mus musculus
aagtactttattcgctgaccccatc

SEQ ID NO: 65274 - DNA, 25 bp, Mus musculus
aagtactttattggctgaccccatc

SEQ ID NO: 65275 - DNA, 25 bp, Mus musculus
aagtactttgggattcattacgagt

SEQ ID NO: 65276 - DNA, 25 bp, Mus musculus
aagtactttgggtttcattacgagt

SEQ ID NO: 65277 - DNA, 25 bp, Mus musculus
aagtactttgtcacttccagtagcc

SEQ ID NO: 65278 - DNA, 25 bp, Mus musculus
aagtactttgtctcttccagtagcc

SEQ ID NO: 65279 - DNA, 25 bp, Mus musculus
aagtactttgtgagtgcagttgtct

SEQ ID NO: 65280 - DNA, 25 bp, Mus musculus
aagtactttgtgtgtgcagttgtct

SEQ ID NO: 65281 - DNA, 25 bp, Mus musculus
aagtacttttgaatcacctcacaat

SEQ ID NO: 65282 - DNA, 25 bp, Mus musculus
aagtacttttgattcacctcacaat

SEQ ID NO: 65283 - DNA, 25 bp, Mus musculus
aagtagaaaacccttctcacctgag

SEQ ID NO: 65284 - DNA, 25 bp, Mus musculus
aagtagaaaaccgttctcacctgag

SEQ ID NO: 65285 - DNA, 25 bp, Mus musculus
aagtagaaatatccatgaccccaat

SEQ ID NO: 65286 - DNA, 25 bp, Mus musculus
aagtagaaatatgcatgaccccaat

SEQ ID NO: 65287 - DNA, 25 bp, Mus musculus
aagtagaactacaccatcctttgga

SEQ ID NO: 65288 - DNA, 25 bp, Mus musculus
aagtagaactactccatcctttgga

SEQ ID NO: 65289 - DNA, 25 bp, Mus musculus
aagtagaagacactcaggtccctga

SEQ ID NO: 65290 - DNA, 25 bp, Mus musculus
aagtagaagacagtcaggtccctga

SEQ ID NO: 65291 - DNA, 25 bp, Mus musculus
aagtagaagactagcccagcatgca

SEQ ID NO: 65292 - DNA, 25 bp, Mus musculus
aagtagaagacttgcccagcatgca

SEQ ID NO: 65293 - DNA, 25 bp, Mus musculus
aagtagaagatcataaatgtaagcc

SEQ ID NO: 65294 - DNA, 25 bp, Mus musculus
aagtagaagatcttaaatgtaagcc

SEQ ID NO: 65295 - DNA, 25 bp, Mus musculus
aagtagaagccccttcagtcacatg

SEQ ID NO: 65296 - DNA, 25 bp, Mus musculus
aagtagaagcccgttcagtcacatg

SEQ ID NO: 65297 - DNA, 25 bp, Mus musculus
aagtagaagcctcgcttcccagctt

SEQ ID NO: 65298 - DNA, 25 bp, Mus musculus
aagtagaagcctggcttcccagctt

SEQ ID NO: 65299 - DNA, 25 bp, Mus musculus
aagtagacattcatctacgcctgtc

SEQ ID NO: 65300 - DNA, 25 bp, Mus musculus
aagtagacattcttctacgcctgtc

SEQ ID NO: 65301 - DNA, 25 bp, Mus musculus
aagtagaccttaccatacagttaat

SEQ ID NO: 65302 - DNA, 25 bp, Mus musculus
aagtagaccttagcatacagttaat

SEQ ID NO: 65303 - DNA, 25 bp, Mus musculus
aagtagacgctcaagtgggcatcgg

SEQ ID NO: 65304 - DNA, 25 bp, Mus musculus
aagtagacgctctagtgggcatcgg

SEQ ID NO: 65305 - DNA, 25 bp, Mus musculus
aagtagagtcctagtctagcatgca

SEQ ID NO: 65306 - DNA, 25 bp, Mus musculus
aagtagagtccttgtctagcatgca

SEQ ID NO: 65307 - DNA, 25 bp, Mus musculus
aagtagatacccaaagccctgaaga

SEQ ID NO: 65308 - DNA, 25 bp, Mus musculus
aagtagataccctaagccctgaaga

SEQ ID NO: 65309 - DNA, 25 bp, Mus musculus
aagtagatattgagcctagtgacag

SEQ ID NO: 65310 - DNA, 25 bp, Mus musculus
aagtagatattgtgcctagtgacag

SEQ ID NO: 65311 - DNA, 25 bp, Mus musculus
aagtagatcacactctcactgcctt

SEQ ID NO: 65312 - DNA, 25 bp, Mus musculus
aagtagatcacagtctcactgcctt

SEQ ID NO: 65313 - DNA, 25 bp, Mus musculus
aagtagatcagtatcatttggatga

SEQ ID NO: 65314 - DNA, 25 bp, Mus musculus
aagtagatcagtttcatttggatga

SEQ ID NO: 65315 - DNA, 25 bp, Mus musculus
aagtagatcctaaccagggacttca

SEQ ID NO: 65316 - DNA, 25 bp, Mus musculus
aagtagatcctatccagggacttca

SEQ ID NO: 65317 - DNA, 25 bp, Mus musculus
aagtagatcctcatttctctatatc

SEQ ID NO: 65318 - DNA, 25 bp, Mus musculus
aagtagatcctcttttctctatatc

SEQ ID NO: 65319 - DNA, 25 bp, Mus musculus
aagtagatgattagcctgagggaac

SEQ ID NO: 65320 - DNA, 25 bp, Mus musculus
aagtagatgatttgcctgagggaac

SEQ ID NO: 65321 - DNA, 25 bp, Mus musculus
aagtagatgccactgaaacaacagt

SEQ ID NO: 65322 - DNA, 25 bp, Mus musculus
aagtagatgccagtgaaacaacagt

SEQ ID NO: 65323 - DNA, 25 bp, Mus musculus
aagtagatgtggactcaagtggaaa

SEQ ID NO: 65324 - DNA, 25 bp, Mus musculus
aagtagatgtggtctcaagtggaaa

SEQ ID NO: 65325 - DNA, 25 bp, Mus musculus
aagtagatttttcatcaaagccaga

SEQ ID NO: 65326 - DNA, 25 bp, Mus musculus
aagtagatttttgatcaaagccaga

SEQ ID NO: 65327 - DNA, 25 bp, Mus musculus
aagtagcaatccagccaaaggctgt

SEQ ID NO: 65328 - DNA, 25 bp, Mus musculus
aagtagcaatcctgccaaaggctgt

SEQ ID NO: 65329 - DNA, 25 bp, Mus musculus
aagtagcaatgtatgccaagccaaa

SEQ ID NO: 65330 - DNA, 25 bp, Mus musculus
aagtagcaatgtttgccaagccaaa

SEQ ID NO: 65331 - DNA, 25 bp, Mus musculus
aagtagcacctcactaacctcgtta

SEQ ID NO: 65332 - DNA, 25 bp, Mus musculus
aagtagcacctctctaacctcgtta

SEQ ID NO: 65333 - DNA, 25 bp, Mus musculus
aagtagcacctgacaatgttttttc

SEQ ID NO: 65334 - DNA, 25 bp, Mus musculus
aagtagcacctgtcaatgttttttc

SEQ ID NO: 65335 - DNA, 25 bp, Mus musculus
aagtagcagcatcataacagcgtga

SEQ ID NO: 65336 - DNA, 25 bp, Mus musculus
aagtagcagcatgataacagcgtga

SEQ ID NO: 65337 - DNA, 25 bp, Mus musculus
aagtagcagccaacatggacctgga

SEQ ID NO: 65338 - DNA, 25 bp, Mus musculus
aagtagcagccatcatggacctgga

SEQ ID NO: 65339 - DNA, 25 bp, Mus musculus
aagtagcaggacattggagaatcca

SEQ ID NO: 65340 - DNA, 25 bp, Mus musculus
aagtagcaggactttggagaatcca

SEQ ID NO: 65341 - DNA, 25 bp, Mus musculus
aagtagcaggcactgaacagacaga

SEQ ID NO: 65342 - DNA, 25 bp, Mus musculus
aagtagcaggcagtgaacagacaga

SEQ ID NO: 65343 - DNA, 25 bp, Mus musculus
aagtagcagtatattcccttagagg

SEQ ID NO: 65344 - DNA, 25 bp, Mus musculus
aagtagcagtattttcccttagagg

SEQ ID NO: 65345 - DNA, 25 bp, Mus musculus
aagtagcagtttacctaatgtgtct

SEQ ID NO: 65346 - DNA, 25 bp, Mus musculus
aagtagcagttttcctaatgtgtct

SEQ ID NO: 65347 - DNA, 25 bp, Mus musculus
aagtagcatcccactgcagtgatgg

SEQ ID NO: 65348 - DNA, 25 bp, Mus musculus
aagtagcatccctctgcagtgatgg

SEQ ID NO: 65349 - DNA, 25 bp, Mus musculus
aagtagcatgacagatctgctcttt

SEQ ID NO: 65350 - DNA, 25 bp, Mus musculus
aagtagcatgactgatctgctcttt

SEQ ID NO: 65351 - DNA, 25 bp, Mus musculus
aagtagcatgctcctacttttataa

SEQ ID NO: 65352 - DNA, 25 bp, Mus musculus
aagtagcatgctgctacttttataa

SEQ ID NO: 65353 - DNA, 25 bp, Mus musculus
aagtagcatgttacattttgattaa

SEQ ID NO: 65354 - DNA, 25 bp, Mus musculus
aagtagcatgtttcattttgattaa

SEQ ID NO: 65355 - DNA, 25 bp, Mus musculus
aagtagccaaagcaggcccttgtct

SEQ ID NO: 65356 - DNA, 25 bp, Mus musculus
aagtagccaaaggaggcccttgtct

SEQ ID NO: 65357 - DNA, 25 bp, Mus musculus
aagtagccaagcctactatccacat

SEQ ID NO: 65358 - DNA, 25 bp, Mus musculus
aagtagccaagcgtactatccacat

SEQ ID NO: 65359 - DNA, 25 bp, Mus musculus
aagtagccaattcattttctgtata

SEQ ID NO: 65360 - DNA, 25 bp, Mus musculus
aagtagccaattgattttctgtata

SEQ ID NO: 65361 - DNA, 25 bp, Mus musculus
aagtagccacaaatccttattccgc

SEQ ID NO: 65362 - DNA, 25 bp, Mus musculus
aagtagccacaattccttattccgc

SEQ ID NO: 65363 - DNA, 25 bp, Mus musculus
aagtagccacatcgagggactcttc

SEQ ID NO: 65364 - DNA, 25 bp, Mus musculus
aagtagccacatggagggactcttc

SEQ ID NO: 65365 - DNA, 25 bp, Mus musculus
aagtagcccagtcctcaacgttgga

SEQ ID NO: 65366 - DNA, 25 bp, Mus musculus
aagtagcccagtgctcaacgttgga

SEQ ID NO: 65367 - DNA, 25 bp, Mus musculus
aagtagcccgagactgtgggactga

SEQ ID NO: 65368 - DNA, 25 bp, Mus musculus
aagtagcccgagtctgtgggactga

SEQ ID NO: 65369 - DNA, 25 bp, Mus musculus
aagtagccctcccagattctcagac

SEQ ID NO: 65370 - DNA, 25 bp, Mus musculus
aagtagccctccgagattctcagac

SEQ ID NO: 65371 - DNA, 25 bp, Mus musculus
aagtagccctgaatcaacccagctt

SEQ ID NO: 65372 - DNA, 25 bp, Mus musculus
aagtagccctgaattttctatttgt

SEQ ID NO: 65373 - DNA, 25 bp, Mus musculus
aagtagccctgattcaacccagctt

SEQ ID NO: 65374 - DNA, 25 bp, Mus musculus
aagtagccctgatttttctatttgt

SEQ ID NO: 65375 - DNA, 25 bp, Mus musculus
aagtagccctgtctgtaagctcatg

SEQ ID NO: 65376 - DNA, 25 bp, Mus musculus
aagtagccctgtgtgtaagctcatg

SEQ ID NO: 65377 - DNA, 25 bp, Mus musculus
aagtagccgatgagatcgccttcag

SEQ ID NO: 65378 - DNA, 25 bp, Mus musculus
aagtagccgatgtgatcgccttcag

SEQ ID NO: 65379 - DNA, 25 bp, Mus musculus
aagtagcctgagctcttccttagat

SEQ ID NO: 65380 - DNA, 25 bp, Mus musculus
aagtagcctgaggtcttccttagat

SEQ ID NO: 65381 - DNA, 25 bp, Mus musculus
aagtagcctggcctgacccttaagg

SEQ ID NO: 65382 - DNA, 25 bp, Mus musculus
aagtagcctggcgtgacccttaagg

SEQ ID NO: 65383 - DNA, 25 bp, Mus musculus
aagtagcgctggaacagacgctcca

SEQ ID NO: 65384 - DNA, 25 bp, Mus musculus
aagtagcgctggtacagacgctcca

SEQ ID NO: 65385 - DNA, 25 bp, Mus musculus
aagtagctatcacctctgcctggga

SEQ ID NO: 65386 - DNA, 25 bp, Mus musculus
aagtagctatcagctctgcctggga

SEQ ID NO: 65387 - DNA, 25 bp, Mus musculus
aagtagctatttagggcactggttt

SEQ ID NO: 65388 - DNA, 25 bp, Mus musculus
aagtagctattttgggcactggttt

SEQ ID NO: 65389 - DNA, 25 bp, Mus musculus
aagtagctcagcacattcagggagg

SEQ ID NO: 65390 - DNA, 25 bp, Mus musculus
aagtagctcagctcattcagggagg

SEQ ID NO: 65391 - DNA, 25 bp, Mus musculus
aagtagctgagcacgtgcagtacat

SEQ ID NO: 65392 - DNA, 25 bp, Mus musculus
aagtagctgagctcgtgcagtacat

SEQ ID NO: 65393 - DNA, 25 bp, Mus musculus
aagtagctgctgatgctctggtaaa

SEQ ID NO: 65394 - DNA, 25 bp, Mus musculus
aagtagctgctgttgctctggtaaa

SEQ ID NO: 65395 - DNA, 25 bp, Mus musculus
aagtagctggtgagtatattcaatc

SEQ ID NO: 65396 - DNA, 25 bp, Mus musculus
aagtagctggtgtgtatattcaatc

SEQ ID NO: 65397 - DNA, 25 bp, Mus musculus
aagtagctgtgtctccagcacgcac

SEQ ID NO: 65398 - DNA, 25 bp, Mus musculus
aagtagctgtgtgtccagcacgcac

SEQ ID NO: 65399 - DNA, 25 bp, Mus musculus
aagtagcttgacacctggtgttcca

SEQ ID NO: 65400 - DNA, 25 bp, Mus musculus
aagtagcttgactcctggtgttcca

SEQ ID NO: 65401 - DNA, 25 bp, Mus musculus
aagtaggaagttcttgccccactca

SEQ ID NO: 65402 - DNA, 25 bp, Mus musculus
aagtaggaagttgttgccccactca

SEQ ID NO: 65403 - DNA, 25 bp, Mus musculus
aagtaggacctcactgtaagttgaa

SEQ ID NO: 65404 - DNA, 25 bp, Mus musculus
aagtaggacctctctgtaagttgaa

SEQ ID NO: 65405 - DNA, 25 bp, Mus musculus
aagtaggagaatccatttaggataa

SEQ ID NO: 65406 - DNA, 25 bp, Mus musculus
aagtaggagaatgcatttaggataa

SEQ ID NO: 65407 - DNA, 25 bp, Mus musculus
aagtaggagagcctgcggtttccct

SEQ ID NO: 65408 - DNA, 25 bp, Mus musculus
aagtaggagagcgtgcggtttccct

SEQ ID NO: 65409 - DNA, 25 bp, Mus musculus
aagtaggagattcacccaaaggtca

SEQ ID NO: 65410 - DNA, 25 bp, Mus musculus
aagtaggagattgacccaaaggtca

SEQ ID NO: 65411 - DNA, 25 bp, Mus musculus
aagtaggcaacacagctcggccttc

SEQ ID NO: 65412 - DNA, 25 bp, Mus musculus
aagtaggcaacagagctcggccttc

SEQ ID NO: 65413 - DNA, 25 bp, Mus musculus
aagtaggcagacatcatcactgagc

SEQ ID NO: 65414 - DNA, 25 bp, Mus musculus
aagtaggcagacttcatcactgagc

SEQ ID NO: 65415 - DNA, 25 bp, Mus musculus
aagtaggccaccagaatcagtctta

SEQ ID NO: 65416 - DNA, 25 bp, Mus musculus
aagtaggccacctgaatcagtctta

SEQ ID NO: 65417 - DNA, 25 bp, Mus musculus
aagtaggcccttcctacacgggcac

SEQ ID NO: 65418 - DNA, 25 bp, Mus musculus
aagtaggcccttgctacacgggcac

SEQ ID NO: 65419 - DNA, 25 bp, Mus musculus
aagtaggcgctgatcaggatatctc

SEQ ID NO: 65420 - DNA, 25 bp, Mus musculus
aagtaggcgctgttcaggatatctc

SEQ ID NO: 65421 - DNA, 25 bp, Mus musculus
aagtaggcggagatccagttagcag

SEQ ID NO: 65422 - DNA, 25 bp, Mus musculus
aagtaggcggagttccagttagcag

SEQ ID NO: 65423 - DNA, 25 bp, Mus musculus
aagtaggctaccagtcattataaaa

SEQ ID NO: 65424 - DNA, 25 bp, Mus musculus
aagtaggctacctgtcattataaaa

SEQ ID NO: 65425 - DNA, 25 bp, Mus musculus
aagtaggctcctatcaatctgaccc

SEQ ID NO: 65426 - DNA, 25 bp, Mus musculus
aagtaggctcctttcaatctgaccc

SEQ ID NO: 65427 - DNA, 25 bp, Mus musculus
aagtaggcttacatccagcagagga

SEQ ID NO: 65428 - DNA, 25 bp, Mus musculus
aagtaggcttacttccagcagagga

SEQ ID NO: 65429 - DNA, 25 bp, Mus musculus
aagtagggagtacccacttgtgcat

SEQ ID NO: 65430 - DNA, 25 bp, Mus musculus
aagtagggagtagccacttgtgcat

SEQ ID NO: 65431 - DNA, 25 bp, Mus musculus
aagtagggtgtgactcgagtcctca

SEQ ID NO: 65432 - DNA, 25 bp, Mus musculus
aagtagggtgtgtctcgagtcctca

SEQ ID NO: 65433 - DNA, 25 bp, Mus musculus
aagtaggtccttacccaggtgtgct

SEQ ID NO: 65434 - DNA, 25 bp, Mus musculus
aagtaggtcctttcccaggtgtgct

SEQ ID NO: 65435 - DNA, 25 bp, Mus musculus
aagtaggtctgacggcttcaaattc

SEQ ID NO: 65436 - DNA, 25 bp, Mus musculus
aagtaggtctgagggcttcaaattc

SEQ ID NO: 65437 - DNA, 25 bp, Mus musculus
aagtaggtcttgacctgtgtgtgcc

SEQ ID NO: 65438 - DNA, 25 bp, Mus musculus
aagtaggtcttgtcctgtgtgtgcc

SEQ ID NO: 65439 - DNA, 25 bp, Mus musculus
aagtaggtggcaagccttcctagac

SEQ ID NO: 65440 - DNA, 25 bp, Mus musculus
aagtaggtggcatgccttcctagac

SEQ ID NO: 65441 - DNA, 25 bp, Mus musculus
aagtaggtgggcaaaggctttctct

SEQ ID NO: 65442 - DNA, 25 bp, Mus musculus
aagtaggtgggctaaggctttctct

SEQ ID NO: 65443 - DNA, 25 bp, Mus musculus
aagtaggttcagcatgggtgccagt

SEQ ID NO: 65444 - DNA, 25 bp, Mus musculus
aagtaggttcaggatgggtgccagt

SEQ ID NO: 65445 - DNA, 25 bp, Mus musculus
aagtagtacactccaggctggacaa

SEQ ID NO: 65446 - DNA, 25 bp, Mus musculus
aagtagtacactgcaggctggacaa

SEQ ID NO: 65447 - DNA, 25 bp, Mus musculus
aagtagtacgggaatgggtcacatc

SEQ ID NO: 65448 - DNA, 25 bp, Mus musculus
aagtagtacgggtatgggtcacatc

SEQ ID NO: 65449 - DNA, 25 bp, Mus musculus
aagtagtactgcagttaccattctg

SEQ ID NO: 65450 - DNA, 25 bp, Mus musculus
aagtagtactgctgttaccattctg

SEQ ID NO: 65451 - DNA, 25 bp, Mus musculus
aagtagtagctcaggcacaactcag

SEQ ID NO: 65452 - DNA, 25 bp, Mus musculus
aagtagtagctctggcacaactcag

SEQ ID NO: 65453 - DNA, 25 bp, Mus musculus
aagtagtagtgcatgataagtctca

SEQ ID NO: 65454 - DNA, 25 bp, Mus musculus
aagtagtagtgcttgataagtctca

SEQ ID NO: 65455 - DNA, 25 bp, Mus musculus
aagtagtagtggctcttgtctcctg

SEQ ID NO: 65456 - DNA, 25 bp, Mus musculus
aagtagtagtgggtcttgtctcctg

SEQ ID NO: 65457 - DNA, 25 bp, Mus musculus
aagtagtccagccagagcttttcta

SEQ ID NO: 65458 - DNA, 25 bp, Mus musculus
aagtagtccagcgagagcttttcta

SEQ ID NO: 65459 - DNA, 25 bp, Mus musculus
aagtagtcccagaatatgtctggat

SEQ ID NO: 65460 - DNA, 25 bp, Mus musculus
aagtagtcccagtatatgtctggat

SEQ ID NO: 65461 - DNA, 25 bp, Mus musculus
aagtagtcctgaatgtcctgggccc

SEQ ID NO: 65462 - DNA, 25 bp, Mus musculus
aagtagtcctgacctgaccagcagc

SEQ ID NO: 65463 - DNA, 25 bp, Mus musculus
aagtagtcctgagctgaccagcagc

SEQ ID NO: 65464 - DNA, 25 bp, Mus musculus
aagtagtcctgattgtcctgggccc

SEQ ID NO: 65465 - DNA, 25 bp, Mus musculus
aagtagtcctggaatctgcaggccc

SEQ ID NO: 65466 - DNA, 25 bp, Mus musculus
aagtagtcctggtatctgcaggccc

SEQ ID NO: 65467 - DNA, 25 bp, Mus musculus
aagtagtcggtgattgcttgcttat

SEQ ID NO: 65468 - DNA, 25 bp, Mus musculus
aagtagtcggtgtttgcttgcttat

SEQ ID NO: 65469 - DNA, 25 bp, Mus musculus
aagtagtctcacaatggagttgaac

SEQ ID NO: 65470 - DNA, 25 bp, Mus musculus
aagtagtctcactatggagttgaac

SEQ ID NO: 65471 - DNA, 25 bp, Mus musculus
aagtagtctcatctcatccttccaa

SEQ ID NO: 65472 - DNA, 25 bp, Mus musculus
aagtagtctcatgtcatccttccaa

SEQ ID NO: 65473 - DNA, 25 bp, Mus musculus
aagtagtgctgacccaaagcttact

SEQ ID NO: 65474 - DNA, 25 bp, Mus musculus
aagtagtgctgagccaaagcttact

SEQ ID NO: 65475 - DNA, 25 bp, Mus musculus
aagtagtggcccacatatccacaat

SEQ ID NO: 65476 - DNA, 25 bp, Mus musculus
aagtagtggccctcatatccacaat

SEQ ID NO: 65477 - DNA, 25 bp, Mus musculus
aagtagtggtgacggactagctctt

SEQ ID NO: 65478 - DNA, 25 bp, Mus musculus
aagtagtggtgagggactagctctt

SEQ ID NO: 65479 - DNA, 25 bp, Mus musculus
aagtagtgttcgctggtctgtgttc

SEQ ID NO: 65480 - DNA, 25 bp, Mus musculus
aagtagtgttcggtggtctgtgttc

SEQ ID NO: 65481 - DNA, 25 bp, Mus musculus
aagtagttaatgattcctccacaaa

SEQ ID NO: 65482 - DNA, 25 bp, Mus musculus
aagtagttaatgtttcctccacaaa

SEQ ID NO: 65483 - DNA, 25 bp, Mus musculus
aagtagttaattagtctccagcacc

SEQ ID NO: 65484 - DNA, 25 bp, Mus musculus
aagtagttaatttgtctccagcacc

SEQ ID NO: 65485 - DNA, 25 bp, Mus musculus
aagtagttctacagcctccaacacg

SEQ ID NO: 65486 - DNA, 25 bp, Mus musculus
aagtagttctactgcctccaacacg

SEQ ID NO: 65487 - DNA, 25 bp, Mus musculus
aagtagttgactcttgccccagtgt

SEQ ID NO: 65488 - DNA, 25 bp, Mus musculus
aagtagttgactgttgccccagtgt

SEQ ID NO: 65489 - DNA, 25 bp, Mus musculus
aagtagttgtgaccctttgcaggag

SEQ ID NO: 65490 - DNA, 25 bp, Mus musculus
aagtagttgtgagcctttgcaggag

SEQ ID NO: 65491 - DNA, 25 bp, Mus musculus
aagtagtttacaacctttcagaaag

SEQ ID NO: 65492 - DNA, 25 bp, Mus musculus
aagtagtttacatcctttcagaaag

SEQ ID NO: 65493 - DNA, 25 bp, Mus musculus
aagtagtttatcacatcttccctca

SEQ ID NO: 65494 - DNA, 25 bp, Mus musculus
aagtagtttatctcatcttccctca

SEQ ID NO: 65495 - DNA, 25 bp, Mus musculus
aagtagttttccagcccatgtgtaa

SEQ ID NO: 65496 - DNA, 25 bp, Mus musculus
aagtagttttcctgcccatgtgtaa

SEQ ID NO: 65497 - DNA, 25 bp, Mus musculus
aagtataacgaaccgctgctacagt

SEQ ID NO: 65498 - DNA, 25 bp, Mus musculus
aagtataacgaagcgctgctacagt

SEQ ID NO: 65499 - DNA, 25 bp, Mus musculus
aagtataacgttcggtctatgccca

SEQ ID NO: 65500 - DNA, 25 bp, Mus musculus
aagtataacgttgggtctatgccca

SEQ ID NO: 65501 - DNA, 25 bp, Mus musculus
aagtataagcagctctaccaggaag

SEQ ID NO: 65502 - DNA, 25 bp, Mus musculus
aagtataagcaggtctaccaggaag

SEQ ID NO: 65503 - DNA, 25 bp, Mus musculus
aagtataatcttcctgttctcccga

SEQ ID NO: 65504 - DNA, 25 bp, Mus musculus
aagtataatcttgctgttctcccga

SEQ ID NO: 65505 - DNA, 25 bp, Mus musculus
aagtatacattcatcctatccactg

SEQ ID NO: 65506 - DNA, 25 bp, Mus musculus
aagtatacattcttcctatccactg

SEQ ID NO: 65507 - DNA, 25 bp, Mus musculus
aagtatacctatccccttgtgcgcg

SEQ ID NO: 65508 - DNA, 25 bp, Mus musculus
aagtatacctatgcccttgtgcgcg

SEQ ID NO: 65509 - DNA, 25 bp, Mus musculus
aagtatacctgcatgtttggcctaa

SEQ ID NO: 65510 - DNA, 25 bp, Mus musculus
aagtatacctgcttgtttggcctaa

SEQ ID NO: 65511 - DNA, 25 bp, Mus musculus
aagtatactacgagcctgggacaac

SEQ ID NO: 65512 - DNA, 25 bp, Mus musculus
aagtatactacgtgcctgggacaac

SEQ ID NO: 65513 - DNA, 25 bp, Mus musculus
aagtatagcatacccctaaactgat

SEQ ID NO: 65514 - DNA, 25 bp, Mus musculus
aagtatagcatagccctaaactgat

SEQ ID NO: 65515 - DNA, 25 bp, Mus musculus
aagtatagccagctgcctttacagg

SEQ ID NO: 65516 - DNA, 25 bp, Mus musculus
aagtatagccaggtgcctttacagg

SEQ ID NO: 65517 - DNA, 25 bp, Mus musculus
aagtatagccttagtcattgccctg

SEQ ID NO: 65518 - DNA, 25 bp, Mus musculus
aagtatagcctttgtcattgccctg

SEQ ID NO: 65519 - DNA, 25 bp, Mus musculus
aagtatagggcacatgggtgttcaa

SEQ ID NO: 65520 - DNA, 25 bp, Mus musculus
aagtatagggcagatgggtgttcaa

SEQ ID NO: 65521 - DNA, 25 bp, Mus musculus
aagtatatccagctcctaaccggga

SEQ ID NO: 65522 - DNA, 25 bp, Mus musculus
aagtatatccaggtcctaaccggga

SEQ ID NO: 65523 - DNA, 25 bp, Mus musculus
aagtatatccttatctcttcctttg

SEQ ID NO: 65524 - DNA, 25 bp, Mus musculus
aagtatatccttttctcttcctttg

SEQ ID NO: 65525 - DNA, 25 bp, Mus musculus
aagtatatggctcctttgccctaga

SEQ ID NO: 65526 - DNA, 25 bp, Mus musculus
aagtatatggctgctttgccctaga

SEQ ID NO: 65527 - DNA, 25 bp, Mus musculus
aagtatattccaatattttgcattt

SEQ ID NO: 65528 - DNA, 25 bp, Mus musculus
aagtatattccattattttgcattt

SEQ ID NO: 65529 - DNA, 25 bp, Mus musculus
aagtatattttcatgcagggcagtt

SEQ ID NO: 65530 - DNA, 25 bp, Mus musculus
aagtatattttcttgcagggcagtt

SEQ ID NO: 65531 - DNA, 25 bp, Mus musculus
aagtatcaaattcccttggtcaaag

SEQ ID NO: 65532 - DNA, 25 bp, Mus musculus
aagtatcaaattgccttggtcaaag

SEQ ID NO: 65533 - DNA, 25 bp, Mus musculus
aagtatcaaggcctaagactcacag

SEQ ID NO: 65534 - DNA, 25 bp, Mus musculus
aagtatcaaggcgtaagactcacag

SEQ ID NO: 65535 - DNA, 25 bp, Mus musculus
aagtatcaccatacatgcgaaaggg

SEQ ID NO: 65536 - DNA, 25 bp, Mus musculus
aagtatcaccattcatgcgaaaggg

SEQ ID NO: 65537 - DNA, 25 bp, Mus musculus
aagtatcactcaccaagccgaaaca

SEQ ID NO: 65538 - DNA, 25 bp, Mus musculus
aagtatcactcacgatgtggtctcg

SEQ ID NO: 65539 - DNA, 25 bp, Mus musculus
aagtatcactcagcaagccgaaaca

SEQ ID NO: 65540 - DNA, 25 bp, Mus musculus
aagtatcactcaggatgtggtctcg

SEQ ID NO: 65541 - DNA, 25 bp, Mus musculus
aagtatcactcgagccctttatgag

SEQ ID NO: 65542 - DNA, 25 bp, Mus musculus
aagtatcactcgtgccctttatgag

SEQ ID NO: 65543 - DNA, 25 bp, Mus musculus
aagtatcagcataacattacctggg

SEQ ID NO: 65544 - DNA, 25 bp, Mus musculus
aagtatcagcattacattacctggg

SEQ ID NO: 65545 - DNA, 25 bp, Mus musculus
aagtatcagcttatggactcattaa

SEQ ID NO: 65546 - DNA, 25 bp, Mus musculus
aagtatcagcttttggactcattaa

SEQ ID NO: 65547 - DNA, 25 bp, Mus musculus
aagtatcaggatagactccctcttg

SEQ ID NO: 65548 - DNA, 25 bp, Mus musculus
aagtatcaggattgactccctcttg

SEQ ID NO: 65549 - DNA, 25 bp, Mus musculus
aagtatcagtttctcagctcgtcct

SEQ ID NO: 65550 - DNA, 25 bp, Mus musculus
aagtatcagtttgtcagctcgtcct

SEQ ID NO: 65551 - DNA, 25 bp, Mus musculus
aagtatcatattatctgcccatcat

SEQ ID NO: 65552 - DNA, 25 bp, Mus musculus
aagtatcatattttctgcccatcat

SEQ ID NO: 65553 - DNA, 25 bp, Mus musculus
aagtatcatcttagtttccacgaaa

SEQ ID NO: 65554 - DNA, 25 bp, Mus musculus
aagtatcatctttgtttccacgaaa

SEQ ID NO: 65555 - DNA, 25 bp, Mus musculus
aagtatcatttgctaggcttgtata

SEQ ID NO: 65556 - DNA, 25 bp, Mus musculus
aagtatcatttggtaggcttgtata

SEQ ID NO: 65557 - DNA, 25 bp, Mus musculus
aagtatccaccaatagcttaaaaat

SEQ ID NO: 65558 - DNA, 25 bp, Mus musculus
aagtatccaccattagcttaaaaat

SEQ ID NO: 65559 - DNA, 25 bp, Mus musculus
aagtatccagacaccgaagaccaag

SEQ ID NO: 65560 - DNA, 25 bp, Mus musculus
aagtatccagactccgaagaccaag

SEQ ID NO: 65561 - DNA, 25 bp, Mus musculus
aagtatccagcgaccacagtacaga

SEQ ID NO: 65562 - DNA, 25 bp, Mus musculus
aagtatccagcgtccacagtacaga

SEQ ID NO: 65563 - DNA, 25 bp, Mus musculus
aagtatccaggaagatctcgctaat

SEQ ID NO: 65564 - DNA, 25 bp, Mus musculus
aagtatccaggatgatctcgctaat

SEQ ID NO: 65565 - DNA, 25 bp, Mus musculus
aagtatccaggtagcgttgtcctat

SEQ ID NO: 65566 - DNA, 25 bp, Mus musculus
aagtatccaggttgcgttgtcctat

SEQ ID NO: 65567 - DNA, 25 bp, Mus musculus
aagtatcccagtacatggcttcagg

SEQ ID NO: 65568 - DNA, 25 bp, Mus musculus
aagtatcccagttcatggcttcagg

SEQ ID NO: 65569 - DNA, 25 bp, Mus musculus
aagtatccctgtcttggactgtgag

SEQ ID NO: 65570 - DNA, 25 bp, Mus musculus
aagtatccctgtgttggactgtgag

SEQ ID NO: 65571 - DNA, 25 bp, Mus musculus
aagtatcccttcacagctcaagtgg

SEQ ID NO: 65572 - DNA, 25 bp, Mus musculus
aagtatcccttctcagctcaagtgg

SEQ ID NO: 65573 - DNA, 25 bp, Mus musculus
aagtatcctacaaggccaactctct

SEQ ID NO: 65574 - DNA, 25 bp, Mus musculus
aagtatcctacatggccaactctct

SEQ ID NO: 65575 - DNA, 25 bp, Mus musculus
aagtatcctgtcagtgttgcgacta

SEQ ID NO: 65576 - DNA, 25 bp, Mus musculus
aagtatcctgtctgtgttgcgacta

SEQ ID NO: 65577 - DNA, 25 bp, Mus musculus
aagtatcgaataactgttgcacaca

SEQ ID NO: 65578 - DNA, 25 bp, Mus musculus
aagtatcgaatatctgttgcacaca

SEQ ID NO: 65579 - DNA, 25 bp, Mus musculus
aagtatcgagagctctgtccctcat

SEQ ID NO: 65580 - DNA, 25 bp, Mus musculus
aagtatcgagaggtctgtccctcat

SEQ ID NO: 65581 - DNA, 25 bp, Mus musculus
aagtatcgctggattcacaacgcct

SEQ ID NO: 65582 - DNA, 25 bp, Mus musculus
aagtatcgctggtttcacaacgcct

SEQ ID NO: 65583 - DNA, 25 bp, Mus musculus
aagtatcggctgacccatagatttt

SEQ ID NO: 65584 - DNA, 25 bp, Mus musculus
aagtatcggctgtcccatagatttt

SEQ ID NO: 65585 - DNA, 25 bp, Mus musculus
aagtatcggtggcagctacgctgac

SEQ ID NO: 65586 - DNA, 25 bp, Mus musculus
aagtatcggtgggagctacgctgac

SEQ ID NO: 65587 - DNA, 25 bp, Mus musculus
aagtatcgtgcgcatctctgcgtct

SEQ ID NO: 65588 - DNA, 25 bp, Mus musculus
aagtatcgtgcggatctctgcgtct

SEQ ID NO: 65589 - DNA, 25 bp, Mus musculus
aagtatcgttacacctatcttcctt

SEQ ID NO: 65590 - DNA, 25 bp, Mus musculus
aagtatcgttactcctatcttcctt

SEQ ID NO: 65591 - DNA, 25 bp, Mus musculus
aagtatctaaatctatctctctctc

SEQ ID NO: 65592 - DNA, 25 bp, Mus musculus
aagtatctaaatgtatctctctctc

SEQ ID NO: 65593 - DNA, 25 bp, Mus musculus
aagtatctagataaccctgcgcctt

SEQ ID NO: 65594 - DNA, 25 bp, Mus musculus
aagtatctagattaccctgcgcctt

SEQ ID NO: 65595 - DNA, 25 bp, Mus musculus
aagtatctatatcccacgtcagaac

SEQ ID NO: 65596 - DNA, 25 bp, Mus musculus
aagtatctatatgccacgtcagaac

SEQ ID NO: 65597 - DNA, 25 bp, Mus musculus
aagtatctcgttaactagcctctga

SEQ ID NO: 65598 - DNA, 25 bp, Mus musculus
aagtatctcgtttactagcctctga

SEQ ID NO: 65599 - DNA, 25 bp, Mus musculus
aagtatctgaagcatgtcaccttaa

SEQ ID NO: 65600 - DNA, 25 bp, Mus musculus
aagtatctgaaggatgtcaccttaa

SEQ ID NO: 65601 - DNA, 25 bp, Mus musculus
aagtatctgagccataggcacatcc

SEQ ID NO: 65602 - DNA, 25 bp, Mus musculus
aagtatctgagcgataggcacatcc

SEQ ID NO: 65603 - DNA, 25 bp, Mus musculus
aagtatctgattatgtggtagctga

SEQ ID NO: 65604 - DNA, 25 bp, Mus musculus
aagtatctgattttgtggtagctga

SEQ ID NO: 65605 - DNA, 25 bp, Mus musculus
aagtatctgctacatttgtgtgtat

SEQ ID NO: 65606 - DNA, 25 bp, Mus musculus
aagtatctgctagatttgtgtgtat

SEQ ID NO: 65607 - DNA, 25 bp, Mus musculus
aagtatcttattccctgtgcttaaa

SEQ ID NO: 65608 - DNA, 25 bp, Mus musculus
aagtatcttattgcctgtgcttaaa

SEQ ID NO: 65609 - DNA, 25 bp, Mus musculus
aagtatcttgtgctcagtgacagtg

SEQ ID NO: 65610 - DNA, 25 bp, Mus musculus
aagtatcttgtggtcagtgacagtg

SEQ ID NO: 65611 - DNA, 25 bp, Mus musculus
aagtatctttgtccatccagagccc

SEQ ID NO: 65612 - DNA, 25 bp, Mus musculus
aagtatctttgtgcatccagagccc

SEQ ID NO: 65613 - DNA, 25 bp, Mus musculus
aagtatgaaaatccgcttaacccat

SEQ ID NO: 65614 - DNA, 25 bp, Mus musculus
aagtatgaaaatgcgcttaacccat

SEQ ID NO: 65615 - DNA, 25 bp, Mus musculus
aagtatgactccagtgtgctgacgc

SEQ ID NO: 65616 - DNA, 25 bp, Mus musculus
aagtatgactcctgtgtgctgacgc

SEQ ID NO: 65617 - DNA, 25 bp, Mus musculus
aagtatgcacccaccaagatcctct

SEQ ID NO: 65618 - DNA, 25 bp, Mus musculus
aagtatgcaccctccaagatcctct

SEQ ID NO: 65619 - DNA, 25 bp, Mus musculus
aagtatgcagcgcttccataggccg

SEQ ID NO: 65620 - DNA, 25 bp, Mus musculus
aagtatgcagcggttccataggccg

SEQ ID NO: 65621 - DNA, 25 bp, Mus musculus
aagtatgcatgtcaccttcaaggtt

SEQ ID NO: 65622 - DNA, 25 bp, Mus musculus
aagtatgcatgtgaccttcaaggtt

SEQ ID NO: 65623 - DNA, 25 bp, Mus musculus
aagtatgccagtctcatggaccctg

SEQ ID NO: 65624 - DNA, 25 bp, Mus musculus
aagtatgccagtgtcatggaccctg

SEQ ID NO: 65625 - DNA, 25 bp, Mus musculus
aagtatgcgcaaacccagctgagca

SEQ ID NO: 65626 - DNA, 25 bp, Mus musculus
aagtatgcgcaatcccagctgagca

SEQ ID NO: 65627 - DNA, 25 bp, Mus musculus
aagtatgctcatctttctgtgtcca

SEQ ID NO: 65628 - DNA, 25 bp, Mus musculus
aagtatgctcatgtttctgtgtcca

SEQ ID NO: 65629 - DNA, 25 bp, Mus musculus
aagtatgctgacaacatcctcaagg

SEQ ID NO: 65630 - DNA, 25 bp, Mus musculus
aagtatgctgactacatcctcaagg

SEQ ID NO: 65631 - DNA, 25 bp, Mus musculus
aagtatgcttgtaattccctctatg

SEQ ID NO: 65632 - DNA, 25 bp, Mus musculus
aagtatgcttgttattccctctatg

SEQ ID NO: 65633 - DNA, 25 bp, Mus musculus
aagtatgctttacatgtggaagttt

SEQ ID NO: 65634 - DNA, 25 bp, Mus musculus
aagtatgctttagatgtggaagttt

SEQ ID NO: 65635 - DNA, 25 bp, Mus musculus
aagtatggaagcacctagggctggt

SEQ ID NO: 65636 - DNA, 25 bp, Mus musculus
aagtatggaagctcctagggctggt

SEQ ID NO: 65637 - DNA, 25 bp, Mus musculus
aagtatggacacatccctgtctaca

SEQ ID NO: 65638 - DNA, 25 bp, Mus musculus
aagtatggacacttccctgtctaca

SEQ ID NO: 65639 - DNA, 25 bp, Mus musculus
aagtatggacagctttgaacgcgcc

SEQ ID NO: 65640 - DNA, 25 bp, Mus musculus
aagtatggacaggtttgaacgcgcc

SEQ ID NO: 65641 - DNA, 25 bp, Mus musculus
aagtatggagtgacagaaatgcagc

SEQ ID NO: 65642 - DNA, 25 bp, Mus musculus
aagtatggagtgtcagaaatgcagc

SEQ ID NO: 65643 - DNA, 25 bp, Mus musculus
aagtatggcatcaacacagatcctc

SEQ ID NO: 65644 - DNA, 25 bp, Mus musculus
aagtatggcatctacacagatcctc

SEQ ID NO: 65645 - DNA, 25 bp, Mus musculus
aagtatggctttcccttagctaaca

SEQ ID NO: 65646 - DNA, 25 bp, Mus musculus
aagtatggctttgccttagctaaca

SEQ ID NO: 65647 - DNA, 25 bp, Mus musculus
aagtatggtacccttgaagtctcat

SEQ ID NO: 65648 - DNA, 25 bp, Mus musculus
aagtatggtaccgttgaagtctcat

SEQ ID NO: 65649 - DNA, 25 bp, Mus musculus
aagtatggtctaatttctggagatt

SEQ ID NO: 65650 - DNA, 25 bp, Mus musculus
aagtatggtctattttctggagatt

SEQ ID NO: 65651 - DNA, 25 bp, Mus musculus
aagtatggtctcacctttgaaccta

SEQ ID NO: 65652 - DNA, 25 bp, Mus musculus
aagtatggtctctcctttgaaccta

SEQ ID NO: 65653 - DNA, 25 bp, Mus musculus
aagtatggttttatcttcatcatgg

SEQ ID NO: 65654 - DNA, 25 bp, Mus musculus
aagtatggttttttcttcatcatgg

SEQ ID NO: 65655 - DNA, 25 bp, Mus musculus
aagtatgtaagtcgagcagagatca

SEQ ID NO: 65656 - DNA, 25 bp, Mus musculus
aagtatgtaagtggagcagagatca

SEQ ID NO: 65657 - DNA, 25 bp, Mus musculus
aagtatgtagtgatcttgcaggttc

SEQ ID NO: 65658 - DNA, 25 bp, Mus musculus
aagtatgtagtgttcttgcaggttc

SEQ ID NO: 65659 - DNA, 25 bp, Mus musculus
aagtatgtattcatggcaggtggca

SEQ ID NO: 65660 - DNA, 25 bp, Mus musculus
aagtatgtattcttggcaggtggca

SEQ ID NO: 65661 - DNA, 25 bp, Mus musculus
aagtatgtcactctctgtcctgttc

SEQ ID NO: 65662 - DNA, 25 bp, Mus musculus
aagtatgtcactgtctgtcctgttc

SEQ ID NO: 65663 - DNA, 25 bp, Mus musculus
aagtatgtcagtatagatagaacct

SEQ ID NO: 65664 - DNA, 25 bp, Mus musculus
aagtatgtcagtttagatagaacct

SEQ ID NO: 65665 - DNA, 25 bp, Mus musculus
aagtatgtccgaaaagcttgggaga

SEQ ID NO: 65666 - DNA, 25 bp, Mus musculus
aagtatgtccgataagcttgggaga

SEQ ID NO: 65667 - DNA, 25 bp, Mus musculus
aagtatgtctgcagagtatcacgtg

SEQ ID NO: 65668 - DNA, 25 bp, Mus musculus
aagtatgtctgctgagtatcacgtg

SEQ ID NO: 65669 - DNA, 25 bp, Mus musculus
aagtatgtgattagtgttgttgcca

SEQ ID NO: 65670 - DNA, 25 bp, Mus musculus
aagtatgtgatttgtgttgttgcca

SEQ ID NO: 65671 - DNA, 25 bp, Mus musculus
aagtatgtgcgtcttctgacaataa

SEQ ID NO: 65672 - DNA, 25 bp, Mus musculus
aagtatgtgcgtgttctgacaataa

SEQ ID NO: 65673 - DNA, 25 bp, Mus musculus
aagtatgtgctactgcattcccttc

SEQ ID NO: 65674 - DNA, 25 bp, Mus musculus
aagtatgtgctagtgcattcccttc

SEQ ID NO: 65675 - DNA, 25 bp, Mus musculus
aagtatgtgggaatgtcttctgttt

SEQ ID NO: 65676 - DNA, 25 bp, Mus musculus
aagtatgtgggattgtcttctgttt

SEQ ID NO: 65677 - DNA, 25 bp, Mus musculus
aagtatgtgggccactctgcacatg

SEQ ID NO: 65678 - DNA, 25 bp, Mus musculus
aagtatgtgggcgactctgcacatg

SEQ ID NO: 65679 - DNA, 25 bp, Mus musculus
aagtatgtggtcagacgacttacta

SEQ ID NO: 65680 - DNA, 25 bp, Mus musculus
aagtatgtggtctgacgacttacta

SEQ ID NO: 65681 - DNA, 25 bp, Mus musculus
aagtatgtgtaactggtgcctgccg

SEQ ID NO: 65682 - DNA, 25 bp, Mus musculus
aagtatgtgtaagtggtgcctgccg

SEQ ID NO: 65683 - DNA, 25 bp, Mus musculus
aagtatgtgtttcctactccagtga

SEQ ID NO: 65684 - DNA, 25 bp, Mus musculus
aagtatgtgtttgctactccagtga

SEQ ID NO: 65685 - DNA, 25 bp, Mus musculus
aagtatgttatgcactgctgtgaag

SEQ ID NO: 65686 - DNA, 25 bp, Mus musculus
aagtatgttatggactgctgtgaag

SEQ ID NO: 65687 - DNA, 25 bp, Mus musculus
aagtatgttcttagcttcgaagtgg

SEQ ID NO: 65688 - DNA, 25 bp, Mus musculus
aagtatgttcttatcactgctgttt

SEQ ID NO: 65689 - DNA, 25 bp, Mus musculus
aagtatgttctttgcttcgaagtgg

SEQ ID NO: 65690 - DNA, 25 bp, Mus musculus
aagtatgttcttttcactgctgttt

SEQ ID NO: 65691 - DNA, 25 bp, Mus musculus
aagtatgttggtcccatcgagaaac

SEQ ID NO: 65692 - DNA, 25 bp, Mus musculus
aagtatgttggtgccatcgagaaac

SEQ ID NO: 65693 - DNA, 25 bp, Mus musculus
aagtatgtttcaagtgccttctggg

SEQ ID NO: 65694 - DNA, 25 bp, Mus musculus
aagtatgtttcatgtgccttctggg

SEQ ID NO: 65695 - DNA, 25 bp, Mus musculus
aagtattaaggcaaggatgccccaa

SEQ ID NO: 65696 - DNA, 25 bp, Mus musculus
aagtattaaggctaggatgccccaa

SEQ ID NO: 65697 - DNA, 25 bp, Mus musculus
aagtattaagtgaccctttcatcat

SEQ ID NO: 65698 - DNA, 25 bp, Mus musculus
aagtattaagtgtccctttcatcat

SEQ ID NO: 65699 - DNA, 25 bp, Mus musculus
aagtattaatgtagtgcacccaaat

SEQ ID NO: 65700 - DNA, 25 bp, Mus musculus
aagtattaatgttgtgcacccaaat

SEQ ID NO: 65701 - DNA, 25 bp, Mus musculus
aagtattacacacggattggcattc

SEQ ID NO: 65702 - DNA, 25 bp, Mus musculus
aagtattacacagggattggcattc

SEQ ID NO: 65703 - DNA, 25 bp, Mus musculus
aagtattaccttaagcttgctagct

SEQ ID NO: 65704 - DNA, 25 bp, Mus musculus
aagtattacctttagcttgctagct

SEQ ID NO: 65705 - DNA, 25 bp, Mus musculus
aagtattagcagcagtatttctccc

SEQ ID NO: 65706 - DNA, 25 bp, Mus musculus
aagtattagcaggagtatttctccc

SEQ ID NO: 65707 - DNA, 25 bp, Mus musculus
aagtattatcctaccccaagcagta

SEQ ID NO: 65708 - DNA, 25 bp, Mus musculus
aagtattatccttccccaagcagta

SEQ ID NO: 65709 - DNA, 25 bp, Mus musculus
aagtattatgccactcaccaaaagt

SEQ ID NO: 65710 - DNA, 25 bp, Mus musculus
aagtattatgcctctcaccaaaagt

SEQ ID NO: 65711 - DNA, 25 bp, Mus musculus
aagtattatttacctacccactgtg

SEQ ID NO: 65712 - DNA, 25 bp, Mus musculus
aagtattatttagctacccactgtg

SEQ ID NO: 65713 - DNA, 25 bp, Mus musculus
aagtattcaagaattatgtccctct

SEQ ID NO: 65714 - DNA, 25 bp, Mus musculus
aagtattcaagatttatgtccctct

SEQ ID NO: 65715 - DNA, 25 bp, Mus musculus
aagtattcacacagacttcctgatg

SEQ ID NO: 65716 - DNA, 25 bp, Mus musculus
aagtattcacactgacttcctgatg

SEQ ID NO: 65717 - DNA, 25 bp, Mus musculus
aagtattcacatcgtgccgtttctt

SEQ ID NO: 65718 - DNA, 25 bp, Mus musculus
aagtattcacatggtgccgtttctt

SEQ ID NO: 65719 - DNA, 25 bp, Mus musculus
aagtattcagaaaaggtccatttca

SEQ ID NO: 65720 - DNA, 25 bp, Mus musculus
aagtattcagaataggtccatttca

SEQ ID NO: 65721 - DNA, 25 bp, Mus musculus
aagtattcagtcatgtgctcttgtg

SEQ ID NO: 65722 - DNA, 25 bp, Mus musculus
aagtattcagtcttgtgctcttgtg

SEQ ID NO: 65723 - DNA, 20 bp, Mus musculus
aagtattcagtgtcctgcca

SEQ ID NO: 65724 - DNA, 25 bp, Mus musculus
aagtattcatcccttataggtgtgt

SEQ ID NO: 65725 - DNA, 25 bp, Mus musculus
aagtattcatccgttataggtgtgt

SEQ ID NO: 65726 - DNA, 25 bp, Mus musculus
aagtattcattgaagagcatcctga

SEQ ID NO: 65727 - DNA, 25 bp, Mus musculus
aagtattcattgtagagcatcctga

SEQ ID NO: 65728 - DNA, 25 bp, Mus musculus
aagtattcatttaccaactggcaac

SEQ ID NO: 65729 - DNA, 25 bp, Mus musculus
aagtattcattttccaactggcaac

SEQ ID NO: 65730 - DNA, 25 bp, Mus musculus
aagtattccaaacacgcctggacca

SEQ ID NO: 65731 - DNA, 25 bp, Mus musculus
aagtattccaaagacgcctggacca

SEQ ID NO: 65732 - DNA, 25 bp, Mus musculus
aagtattccagtagggtgttgcata

SEQ ID NO: 65733 - DNA, 25 bp, Mus musculus
aagtattccagttgggtgttgcata

SEQ ID NO: 65734 - DNA, 25 bp, Mus musculus
aagtattcccggctccagaagatcg

SEQ ID NO: 65735 - DNA, 25 bp, Mus musculus
aagtattcccgggtccagaagatcg

SEQ ID NO: 65736 - DNA, 20 bp, Mus musculus
aagtattccgtgtcctgcca

SEQ ID NO: 65737 - DNA, 25 bp, Mus musculus
aagtattcctatcccagagcggtgt

SEQ ID NO: 65738 - DNA, 25 bp, Mus musculus
aagtattcctatgccagagcggtgt

SEQ ID NO: 65739 - DNA, 20 bp, Mus musculus
aagtattcggtgtcctgcca

SEQ ID NO: 65740 - DNA, 25 bp, Mus musculus
aagtattctacacccaggaactgaa

SEQ ID NO: 65741 - DNA, 25 bp, Mus musculus
aagtattctacagccaggaactgaa

SEQ ID NO: 65742 - DNA, 25 bp, Mus musculus
aagtattctaggcatatgtgtatgc

SEQ ID NO: 65743 - DNA, 25 bp, Mus musculus
aagtattctagggatatgtgtatgc

SEQ ID NO: 65744 - DNA, 25 bp, Mus musculus
aagtattctctaacttggcttccag

SEQ ID NO: 65745 - DNA, 25 bp, Mus musculus
aagtattctctatcttggcttccag

SEQ ID NO: 65746 - DNA, 20 bp, Mus musculus
aagtattctgtgtcctgcca

SEQ ID NO: 65747 - DNA, 25 bp, Mus musculus
aagtattgacagacagtatccgaac

SEQ ID NO: 65748 - DNA, 25 bp, Mus musculus
aagtattgacagtcagtatccgaac

SEQ ID NO: 65749 - DNA, 25 bp, Mus musculus
aagtattgaccaagctctgaggaca

SEQ ID NO: 65750 - DNA, 25 bp, Mus musculus
aagtattgaccatgctctgaggaca

SEQ ID NO: 65751 - DNA, 25 bp, Mus musculus
aagtattgagtaatcccaacgagaa

SEQ ID NO: 65752 - DNA, 25 bp, Mus musculus
aagtattgagtattcccaacgagaa

SEQ ID NO: 65753 - DNA, 25 bp, Mus musculus
aagtattgcagacggcctgacgctt

SEQ ID NO: 65754 - DNA, 25 bp, Mus musculus
aagtattgcagagggcctgacgctt

SEQ ID NO: 65755 - DNA, 25 bp, Mus musculus
aagtattggcatagcctgtggcact

SEQ ID NO: 65756 - DNA, 25 bp, Mus musculus
aagtattggcattgcctgtggcact

SEQ ID NO: 65757 - DNA, 25 bp, Mus musculus
aagtattggccaactcatctggctg

SEQ ID NO: 65758 - DNA, 25 bp, Mus musculus
aagtattggccatctcatctggctg

SEQ ID NO: 65759 - DNA, 25 bp, Mus musculus
aagtattgttgtcgactgtgtccct

SEQ ID NO: 65760 - DNA, 25 bp, Mus musculus
aagtattgttgtggactgtgtccct

SEQ ID NO: 65761 - DNA, 25 bp, Mus musculus
aagtatttaacgacccagtcaatgg

SEQ ID NO: 65762 - DNA, 25 bp, Mus musculus
aagtatttaacgtcccagtcaatgg

SEQ ID NO: 65763 - DNA, 25 bp, Mus musculus
aagtatttacgtcgtcgacgctccg

SEQ ID NO: 65764 - DNA, 25 bp, Mus musculus
aagtatttacgtggtcgacgctccg

SEQ ID NO: 65765 - DNA, 25 bp, Mus musculus
aagtatttacttccctatcgtggag

SEQ ID NO: 65766 - DNA, 25 bp, Mus musculus
aagtatttacttgcctatcgtggag

SEQ ID NO: 65767 - DNA, 25 bp, Mus musculus
aagtatttagggaacaccacatgga

SEQ ID NO: 65768 - DNA, 25 bp, Mus musculus
aagtatttagggtacaccacatgga

SEQ ID NO: 65769 - DNA, 25 bp, Mus musculus
aagtatttatctcaacatttccgtt

SEQ ID NO: 65770 - DNA, 25 bp, Mus musculus
aagtatttatctgaacatttccgtt

SEQ ID NO: 65771 - DNA, 25 bp, Mus musculus
aagtatttattcaagccatattagg

SEQ ID NO: 65772 - DNA, 25 bp, Mus musculus
aagtatttattctagccatattagg

SEQ ID NO: 65773 - DNA, 25 bp, Mus musculus
aagtatttcacaagcaccttctcat

SEQ ID NO: 65774 - DNA, 25 bp, Mus musculus
aagtatttcacatgcaccttctcat

SEQ ID NO: 65775 - DNA, 25 bp, Mus musculus
aagtatttccagcacctttgcaatg

SEQ ID NO: 65776 - DNA, 25 bp, Mus musculus
aagtatttccaggacctttgcaatg

SEQ ID NO: 65777 - DNA, 25 bp, Mus musculus
aagtatttcccgagatcggcgatgt

SEQ ID NO: 65778 - DNA, 25 bp, Mus musculus
aagtatttcccgtgatcggcgatgt

SEQ ID NO: 65779 - DNA, 25 bp, Mus musculus
aagtatttcctactgcttacagctg

SEQ ID NO: 65780 - DNA, 25 bp, Mus musculus
aagtatttcctagtgcttacagctg

SEQ ID NO: 65781 - DNA, 25 bp, Mus musculus
aagtatttctcgaccataccttttg

SEQ ID NO: 65782 - DNA, 25 bp, Mus musculus
aagtatttctcgtccataccttttg

SEQ ID NO: 65783 - DNA, 25 bp, Mus musculus
aagtatttctctagcatggccgagt

SEQ ID NO: 65784 - DNA, 25 bp, Mus musculus
aagtatttctcttgcatggccgagt

SEQ ID NO: 65785 - DNA, 25 bp, Mus musculus
aagtatttctgactccagcagctgg

SEQ ID NO: 65786 - DNA, 25 bp, Mus musculus
aagtatttctgagtccagcagctgg

SEQ ID NO: 65787 - DNA, 25 bp, Mus musculus
aagtatttcttgatggtgccagacc

SEQ ID NO: 65788 - DNA, 25 bp, Mus musculus
aagtatttcttgttggtgccagacc

SEQ ID NO: 65789 - DNA, 25 bp, Mus musculus
aagtatttctttctccatagaccca

SEQ ID NO: 65790 - DNA, 25 bp, Mus musculus
aagtatttctttgtccatagaccca

SEQ ID NO: 65791 - DNA, 25 bp, Mus musculus
aagtatttgaaacctgtgtttgtaa

SEQ ID NO: 65792 - DNA, 25 bp, Mus musculus
aagtatttgaaagctgtgtttgtaa

SEQ ID NO: 65793 - DNA, 25 bp, Mus musculus
aagtatttgctgactgctccaattc

SEQ ID NO: 65794 - DNA, 25 bp, Mus musculus
aagtatttgctgagcacccactcgt

SEQ ID NO: 65795 - DNA, 25 bp, Mus musculus
aagtatttgctgtctgctccaattc

SEQ ID NO: 65796 - DNA, 25 bp, Mus musculus
aagtatttgctgtgcacccactcgt

SEQ ID NO: 65797 - DNA, 25 bp, Mus musculus
aagtattttattctccacggtcatt

SEQ ID NO: 65798 - DNA, 25 bp, Mus musculus
aagtattttattgtccacggtcatt

SEQ ID NO: 65799 - DNA, 25 bp, Mus musculus
aagtattttccaacttctgagtccc

SEQ ID NO: 65800 - DNA, 25 bp, Mus musculus
aagtattttccatcttctgagtccc

SEQ ID NO: 65801 - DNA, 25 bp, Mus musculus
aagtattttcggcacacatcacaat

SEQ ID NO: 65802 - DNA, 25 bp, Mus musculus
aagtattttcgggacacatcacaat

SEQ ID NO: 65803 - DNA, 25 bp, Mus musculus
aagtattttgatagagcttttcatt

SEQ ID NO: 65804 - DNA, 25 bp, Mus musculus
aagtattttgattgagcttttcatt

SEQ ID NO: 65805 - DNA, 25 bp, Mus musculus
aagtattttgctcttacctataaag

SEQ ID NO: 65806 - DNA, 25 bp, Mus musculus
aagtattttgctgttacctataaag

SEQ ID NO: 65807 - DNA, 25 bp, Mus musculus
aagtatttttgtactcgtgctggga

SEQ ID NO: 65808 - DNA, 25 bp, Mus musculus
aagtatttttgttctcgtgctggga

SEQ ID NO: 65809 - DNA, 25 bp, Mus musculus
aagtcaaaaggcactgtcttcagtg

SEQ ID NO: 65810 - DNA, 25 bp, Mus musculus
aagtcaaaaggctctgtcttcagtg

SEQ ID NO: 65811 - DNA, 25 bp, Mus musculus
aagtcaaaatcccaacacgcagcag

SEQ ID NO: 65812 - DNA, 25 bp, Mus musculus
aagtcaaaatccgaacacgcagcag

SEQ ID NO: 65813 - DNA, 25 bp, Mus musculus
aagtcaaacatcaaggcccggagaa

SEQ ID NO: 65814 - DNA, 25 bp, Mus musculus
aagtcaaacatctaggcccggagaa

SEQ ID NO: 65815 - DNA, 25 bp, Mus musculus
aagtcaaaccttaagcggcatcaga

SEQ ID NO: 65816 - DNA, 25 bp, Mus musculus
aagtcaaacctttagcggcatcaga

SEQ ID NO: 65817 - DNA, 25 bp, Mus musculus
aagtcaaactcactcttttcctcac

SEQ ID NO: 65818 - DNA, 25 bp, Mus musculus
aagtcaaactcagtcttttcctcac

SEQ ID NO: 65819 - DNA, 25 bp, Mus musculus
aagtcaaactgcagtgattctctcc

SEQ ID NO: 65820 - DNA, 25 bp, Mus musculus
aagtcaaactgctgtgattctctcc

SEQ ID NO: 65821 - DNA, 25 bp, Mus musculus
aagtcaaagcttcgttcctggccac

SEQ ID NO: 65822 - DNA, 25 bp, Mus musculus
aagtcaaagcttggttcctggccac

SEQ ID NO: 65823 - DNA, 25 bp, Mus musculus
aagtcaaagggcacccttagccaga

SEQ ID NO: 65824 - DNA, 25 bp, Mus musculus
aagtcaaagggctcccttagccaga

SEQ ID NO: 65825 - DNA, 25 bp, Mus musculus
aagtcaaaggtgcttcagccttgta

SEQ ID NO: 65826 - DNA, 25 bp, Mus musculus
aagtcaaaggtggttcagccttgta

SEQ ID NO: 65827 - DNA, 25 bp, Mus musculus
aagtcaaatatcactgctctctgtg

SEQ ID NO: 65828 - DNA, 25 bp, Mus musculus
aagtcaaatatctctgctctctgtg

SEQ ID NO: 65829 - DNA, 25 bp, Mus musculus
aagtcaaatccaaggccatcctggg

SEQ ID NO: 65830 - DNA, 25 bp, Mus musculus
aagtcaaatccatggccatcctggg

SEQ ID NO: 65831 - DNA, 25 bp, Mus musculus
aagtcaaatcctcccttcatgagtt

SEQ ID NO: 65832 - DNA, 25 bp, Mus musculus
aagtcaaatcctgccttcatgagtt

SEQ ID NO: 65833 - DNA, 25 bp, Mus musculus
aagtcaaatctaagccatgtgtctg

SEQ ID NO: 65834 - DNA, 25 bp, Mus musculus
aagtcaaatctatgccatgtgtctg

SEQ ID NO: 65835 - DNA, 25 bp, Mus musculus
aagtcaaatctgcttctcagcttat

SEQ ID NO: 65836 - DNA, 25 bp, Mus musculus
aagtcaaatctggttctcagcttat

SEQ ID NO: 65837 - DNA, 25 bp, Mus musculus
aagtcaaatgttcactcaggcttta

SEQ ID NO: 65838 - DNA, 25 bp, Mus musculus
aagtcaaatgttcctatcctgctgc

SEQ ID NO: 65839 - DNA, 25 bp, Mus musculus
aagtcaaatgttgactcaggcttta

SEQ ID NO: 65840 - DNA, 25 bp, Mus musculus
aagtcaaatgttgctatcctgctgc

SEQ ID NO: 65841 - DNA, 25 bp, Mus musculus
aagtcaaattggattcctggaacga

SEQ ID NO: 65842 - DNA, 25 bp, Mus musculus
aagtcaaattggtttcctggaacga

SEQ ID NO: 65843 - DNA, 25 bp, Mus musculus
aagtcaaattgtcaaaggcctcttt

SEQ ID NO: 65844 - DNA, 25 bp, Mus musculus
aagtcaaattgtgaaaggcctcttt

SEQ ID NO: 65845 - DNA, 25 bp, Mus musculus
aagtcaaatttcaacctgaaacttg

SEQ ID NO: 65846 - DNA, 25 bp, Mus musculus
aagtcaaatttctacctgaaacttg

SEQ ID NO: 65847 - DNA, 25 bp, Mus musculus
aagtcaacaattcgtgaccgctcct

SEQ ID NO: 65848 - DNA, 25 bp, Mus musculus
aagtcaacaattggtgaccgctcct

SEQ ID NO: 65849 - DNA, 25 bp, Mus musculus
aagtcaacactcatgcggaagaaag

SEQ ID NO: 65850 - DNA, 25 bp, Mus musculus
aagtcaacactcttgcggaagaaag

SEQ ID NO: 65851 - DNA, 25 bp, Mus musculus
aagtcaacagaaagaacagagcttt

SEQ ID NO: 65852 - DNA, 25 bp, Mus musculus
aagtcaacagaatgaacagagcttt

SEQ ID NO: 65853 - DNA, 25 bp, Mus musculus
aagtcaacagcgactcacgagcgtt

SEQ ID NO: 65854 - DNA, 25 bp, Mus musculus
aagtcaacagcgtctcacgagcgtt

SEQ ID NO: 65855 - DNA, 25 bp, Mus musculus
aagtcaaccagcaaattgctgaagt

SEQ ID NO: 65856 - DNA, 25 bp, Mus musculus
aagtcaaccagctaattgctgaagt

SEQ ID NO: 65857 - DNA, 25 bp, Mus musculus
aagtcaacccttcgtgtacatcaaa

SEQ ID NO: 65858 - DNA, 25 bp, Mus musculus
aagtcaacccttggtgtacatcaaa

SEQ ID NO: 65859 - DNA, 25 bp, Mus musculus
aagtcaaccgctaaactgctgtgtt

SEQ ID NO: 65860 - DNA, 25 bp, Mus musculus
aagtcaaccgcttaactgctgtgtt

SEQ ID NO: 65861 - DNA, 25 bp, Mus musculus
aagtcaacgctcagtgattcctcca

SEQ ID NO: 65862 - DNA, 25 bp, Mus musculus
aagtcaacgctctgtgattcctcca

SEQ ID NO: 65863 - DNA, 25 bp, Mus musculus
aagtcaacgcttctttcattttaag

SEQ ID NO: 65864 - DNA, 25 bp, Mus musculus
aagtcaacgcttgtttcattttaag

SEQ ID NO: 65865 - DNA, 25 bp, Mus musculus
aagtcaacgttgcaggcgtcagctc

SEQ ID NO: 65866 - DNA, 25 bp, Mus musculus
aagtcaacgttggaggcgtcagctc

SEQ ID NO: 65867 - DNA, 25 bp, Mus musculus
aagtcaacgtttccccagctggaca

SEQ ID NO: 65868 - DNA, 25 bp, Mus musculus
aagtcaacgtttgcccagctggaca

SEQ ID NO: 65869 - DNA, 25 bp, Mus musculus
aagtcaactaacctggaccactagg

SEQ ID NO: 65870 - DNA, 25 bp, Mus musculus
aagtcaactaacgtggaccactagg

SEQ ID NO: 65871 - DNA, 25 bp, Mus musculus
aagtcaactagccttgccttgctgg

SEQ ID NO: 65872 - DNA, 25 bp, Mus musculus
aagtcaactagcgttgccttgctgg

SEQ ID NO: 65873 - DNA, 25 bp, Mus musculus
aagtcaactcatcagtctgtggttt

SEQ ID NO: 65874 - DNA, 25 bp, Mus musculus
aagtcaactcatgagtctgtggttt

SEQ ID NO: 65875 - DNA, 25 bp, Mus musculus
aagtcaactcgtatatagcaaggtg

SEQ ID NO: 65876 - DNA, 25 bp, Mus musculus
aagtcaactcgtttatagcaaggtg

SEQ ID NO: 65877 - DNA, 25 bp, Mus musculus
aagtcaacttatccttccaggtcac

SEQ ID NO: 65878 - DNA, 25 bp, Mus musculus
aagtcaacttatgcttccaggtcac

SEQ ID NO: 65879 - DNA, 25 bp, Mus musculus
aagtcaacttctagagatgtgtctc

SEQ ID NO: 65880 - DNA, 25 bp, Mus musculus
aagtcaacttcttgagatgtgtctc

SEQ ID NO: 65881 - DNA, 25 bp, Mus musculus
aagtcaagaagcaaccactctggtt

SEQ ID NO: 65882 - DNA, 25 bp, Mus musculus
aagtcaagaagctaccactctggtt

SEQ ID NO: 65883 - DNA, 25 bp, Mus musculus
aagtcaagacagaagcctcacaaag

SEQ ID NO: 65884 - DNA, 25 bp, Mus musculus
aagtcaagacagtagcctcacaaag

SEQ ID NO: 65885 - DNA, 25 bp, Mus musculus
aagtcaagatacaaagcccacctgc

SEQ ID NO: 65886 - DNA, 25 bp, Mus musculus
aagtcaagatactaagcccacctgc

SEQ ID NO: 65887 - DNA, 25 bp, Mus musculus
aagtcaagatccaagttttctgggt

SEQ ID NO: 65888 - DNA, 25 bp, Mus musculus
aagtcaagatcctagttttctgggt

SEQ ID NO: 65889 - DNA, 25 bp, Mus musculus
aagtcaaggcagacgtcaagctgga

SEQ ID NO: 65890 - DNA, 25 bp, Mus musculus
aagtcaaggcagtcgtcaagctgga

SEQ ID NO: 65891 - DNA, 25 bp, Mus musculus
aagtcaaggcttcatgctacacaga

SEQ ID NO: 65892 - DNA, 25 bp, Mus musculus
aagtcaaggcttgatgctacacaga

SEQ ID NO: 65893 - DNA, 25 bp, Mus musculus
aagtcaagtcaaaggaacacgcaag

SEQ ID NO: 65894 - DNA, 25 bp, Mus musculus
aagtcaagtcaatggaacacgcaag

SEQ ID NO: 65895 - DNA, 25 bp, Mus musculus
aagtcaagtcccacactgtgagtgg

SEQ ID NO: 65896 - DNA, 25 bp, Mus musculus
aagtcaagtccctcactgtgagtgg

SEQ ID NO: 65897 - DNA, 25 bp, Mus musculus
aagtcaagtgacaccctgcaggcgt

SEQ ID NO: 65898 - DNA, 25 bp, Mus musculus
aagtcaagtgactccctgcaggcgt

SEQ ID NO: 65899 - DNA, 25 bp, Mus musculus
aagtcaagtgccatcaatgctaaag

SEQ ID NO: 65900 - DNA, 25 bp, Mus musculus
aagtcaagtgccttcaatgctaaag

SEQ ID NO: 65901 - DNA, 25 bp, Mus musculus
aagtcaatatataggctttgtatca

SEQ ID NO: 65902 - DNA, 25 bp, Mus musculus
aagtcaatatattggctttgtatca

SEQ ID NO: 65903 - DNA, 25 bp, Mus musculus
aagtcaatcaagattctttcagaaa

SEQ ID NO: 65904 - DNA, 25 bp, Mus musculus
aagtcaatcaagtttctttcagaaa

SEQ ID NO: 65905 - DNA, 25 bp, Mus musculus
aagtcaatcacacggcaacttccgc

SEQ ID NO: 65906 - DNA, 25 bp, Mus musculus
aagtcaatcacagggcaacttccgc

SEQ ID NO: 65907 - DNA, 25 bp, Mus musculus
aagtcaatgagtcttttctctgagc

SEQ ID NO: 65908 - DNA, 25 bp, Mus musculus
aagtcaatgagtgttttctctgagc

SEQ ID NO: 65909 - DNA, 25 bp, Mus musculus
aagtcaatgcatcctcgtgctgttc

SEQ ID NO: 65910 - DNA, 25 bp, Mus musculus
aagtcaatgcatgctcgtgctgttc

SEQ ID NO: 65911 - DNA, 25 bp, Mus musculus
aagtcaatgtatcattacggctgaa

SEQ ID NO: 65912 - DNA, 25 bp, Mus musculus
aagtcaatgtatgattacggctgaa

SEQ ID NO: 65913 - DNA, 25 bp, Mus musculus
aagtcaattaccactgtcaagagca

SEQ ID NO: 65914 - DNA, 25 bp, Mus musculus
aagtcaattacctctgtcaagagca

SEQ ID NO: 65915 - DNA, 25 bp, Mus musculus
aagtcacaaggtcatcggtatctgt

SEQ ID NO: 65916 - DNA, 25 bp, Mus musculus
aagtcacaaggtgatcggtatctgt

SEQ ID NO: 65917 - DNA, 25 bp, Mus musculus
aagtcacaatttagaatccctgctg

SEQ ID NO: 65918 - DNA, 25 bp, Mus musculus
aagtcacaattttgaatccctgctg

SEQ ID NO: 65919 - DNA, 25 bp, Mus musculus
aagtcacacagcctgctgagtccaa

SEQ ID NO: 65920 - DNA, 25 bp, Mus musculus
aagtcacacagcgtgctgagtccaa

SEQ ID NO: 65921 - DNA, 25 bp, Mus musculus
aagtcacacatgatctgctgttgca

SEQ ID NO: 65922 - DNA, 25 bp, Mus musculus
aagtcacacatgttctgctgttgca

SEQ ID NO: 65923 - DNA, 25 bp, Mus musculus
aagtcacacattaagcatagcggag

SEQ ID NO: 65924 - DNA, 25 bp, Mus musculus
aagtcacacatttagcatagcggag

SEQ ID NO: 65925 - DNA, 25 bp, Mus musculus
aagtcacaccagaaaccagtgcaat

SEQ ID NO: 65926 - DNA, 25 bp, Mus musculus
aagtcacaccagtaaccagtgcaat

SEQ ID NO: 65927 - DNA, 25 bp, Mus musculus
aagtcacacctcaacgtgtcagtaa

SEQ ID NO: 65928 - DNA, 25 bp, Mus musculus
aagtcacacctctacgtgtcagtaa

SEQ ID NO: 65929 - DNA, 25 bp, Mus musculus
aagtcacactcaactccaagtacat

SEQ ID NO: 65930 - DNA, 25 bp, Mus musculus
aagtcacactcaatctcatgtttta

SEQ ID NO: 65931 - DNA, 25 bp, Mus musculus
aagtcacactcatctccaagtacat

SEQ ID NO: 65932 - DNA, 25 bp, Mus musculus
aagtcacactcattctcatgtttta

SEQ ID NO: 65933 - DNA, 25 bp, Mus musculus
aagtcacagaagctactgaccgcta

SEQ ID NO: 65934 - DNA, 25 bp, Mus musculus
aagtcacagaaggtactgaccgcta

SEQ ID NO: 65935 - DNA, 25 bp, Mus musculus
aagtcacagactaagctgcgttccg

SEQ ID NO: 65936 - DNA, 25 bp, Mus musculus
aagtcacagacttagctgcgttccg

SEQ ID NO: 65937 - DNA, 25 bp, Mus musculus
aagtcacagctcacacatgagcaaa

SEQ ID NO: 65938 - DNA, 25 bp, Mus musculus
aagtcacagctctcacatgagcaaa

SEQ ID NO: 65939 - DNA, 25 bp, Mus musculus
aagtcacaggcaatcctttgacagc

SEQ ID NO: 65940 - DNA, 25 bp, Mus musculus
aagtcacaggcattcctttgacagc

SEQ ID NO: 65941 - DNA, 25 bp, Mus musculus
aagtcacaggctagcttcattcctt

SEQ ID NO: 65942 - DNA, 25 bp, Mus musculus
aagtcacaggcttgcttcattcctt

SEQ ID NO: 65943 - DNA, 25 bp, Mus musculus
aagtcacaggtcaagtactgattta

SEQ ID NO: 65944 - DNA, 25 bp, Mus musculus
aagtcacaggtctagtactgattta

SEQ ID NO: 65945 - DNA, 25 bp, Mus musculus
aagtcacagtcacatcccctttaag

SEQ ID NO: 65946 - DNA, 25 bp, Mus musculus
aagtcacagtcagatcccctttaag

SEQ ID NO: 65947 - DNA, 25 bp, Mus musculus
aagtcacataatactacccttccat

SEQ ID NO: 65948 - DNA, 25 bp, Mus musculus
aagtcacataattctacccttccat

SEQ ID NO: 65949 - DNA, 25 bp, Mus musculus
aagtcacatagtattggcagtagct

SEQ ID NO: 65950 - DNA, 25 bp, Mus musculus
aagtcacatagttttggcagtagct

SEQ ID NO: 65951 - DNA, 25 bp, Mus musculus
aagtcacatcctcgaagaccttctc

SEQ ID NO: 65952 - DNA, 25 bp, Mus musculus
aagtcacatcctggaagaccttctc

SEQ ID NO: 65953 - DNA, 25 bp, Mus musculus
aagtcacatgacagtcttccttcca

SEQ ID NO: 65954 - DNA, 25 bp, Mus musculus
aagtcacatgactgtcttccttcca

SEQ ID NO: 65955 - DNA, 25 bp, Mus musculus
aagtcacatgggaatcaagtgcaga

SEQ ID NO: 65956 - DNA, 25 bp, Mus musculus
aagtcacatgggtatcaagtgcaga

SEQ ID NO: 65957 - DNA, 25 bp, Mus musculus
aagtcaccaaataatgacgcacagc

SEQ ID NO: 65958 - DNA, 25 bp, Mus musculus
aagtcaccaaattatgacgcacagc

SEQ ID NO: 65959 - DNA, 25 bp, Mus musculus
aagtcaccaaccatgtggtctgcag

SEQ ID NO: 65960 - DNA, 25 bp, Mus musculus
aagtcaccaaccttgtggtctgcag

SEQ ID NO: 65961 - DNA, 25 bp, Mus musculus
aagtcaccacctcaagttgcagaga

SEQ ID NO: 65962 - DNA, 25 bp, Mus musculus
aagtcaccacctgaagttgcagaga

SEQ ID NO: 65963 - DNA, 25 bp, Mus musculus
aagtcaccagagacatccgggccac

SEQ ID NO: 65964 - DNA, 25 bp, Mus musculus
aagtcaccagagtcatccgggccac

SEQ ID NO: 65965 - DNA, 25 bp, Mus musculus
aagtcaccaggcagatcttggattt

SEQ ID NO: 65966 - DNA, 25 bp, Mus musculus
aagtcaccaggctgatcttggattt

SEQ ID NO: 65967 - DNA, 25 bp, Mus musculus
aagtcaccaggtagcttccatgagg

SEQ ID NO: 65968 - DNA, 25 bp, Mus musculus
aagtcaccaggttgcttccatgagg

SEQ ID NO: 65969 - DNA, 25 bp, Mus musculus
aagtcaccagtgaggccagagcaag

SEQ ID NO: 65970 - DNA, 25 bp, Mus musculus
aagtcaccagtgtggccagagcaag

SEQ ID NO: 65971 - DNA, 25 bp, Mus musculus
aagtcaccatttaactcttgtctct

SEQ ID NO: 65972 - DNA, 25 bp, Mus musculus
aagtcaccatttctttgcctatcca

SEQ ID NO: 65973 - DNA, 25 bp, Mus musculus
aagtcaccatttgtttgcctatcca

SEQ ID NO: 65974 - DNA, 25 bp, Mus musculus
aagtcaccattttactcttgtctct

SEQ ID NO: 65975 - DNA, 25 bp, Mus musculus
aagtcacccactacctgaggcttgg

SEQ ID NO: 65976 - DNA, 25 bp, Mus musculus
aagtcacccacttcctgaggcttgg

SEQ ID NO: 65977 - DNA, 25 bp, Mus musculus
aagtcaccccacagagataccgctg

SEQ ID NO: 65978 - DNA, 25 bp, Mus musculus
aagtcaccccactgagataccgctg

SEQ ID NO: 65979 - DNA, 25 bp, Mus musculus
aagtcaccccagaaagtctctcatg

SEQ ID NO: 65980 - DNA, 25 bp, Mus musculus
aagtcaccccagtaagtctctcatg

SEQ ID NO: 65981 - DNA, 25 bp, Mus musculus
aagtcaccccgaaagcggcttctgg

SEQ ID NO: 65982 - DNA, 25 bp, Mus musculus
aagtcaccccgatagcggcttctgg

SEQ ID NO: 65983 - DNA, 25 bp, Mus musculus
aagtcaccgcagagttttcataata

SEQ ID NO: 65984 - DNA, 25 bp, Mus musculus
aagtcaccgcagtgttttcataata

SEQ ID NO: 65985 - DNA, 25 bp, Mus musculus
aagtcaccggctctgagctgcaggc

SEQ ID NO: 65986 - DNA, 25 bp, Mus musculus
aagtcaccggctgtgagctgcaggc

SEQ ID NO: 65987 - DNA, 25 bp, Mus musculus
aagtcaccgggaacatagaataaat

SEQ ID NO: 65988 - DNA, 25 bp, Mus musculus
aagtcaccgggatcatagaataaat

SEQ ID NO: 65989 - DNA, 25 bp, Mus musculus
aagtcacctatcatcatcttcattc

SEQ ID NO: 65990 - DNA, 25 bp, Mus musculus
aagtcacctatcttcatcttcattc

SEQ ID NO: 65991 - DNA, 25 bp, Mus musculus
aagtcacctcaaaggaagccctgca

SEQ ID NO: 65992 - DNA, 25 bp, Mus musculus
aagtcacctcaatggaagccctgca

SEQ ID NO: 65993 - DNA, 25 bp, Mus musculus
aagtcacctccgaatcagcttggga

SEQ ID NO: 65994 - DNA, 25 bp, Mus musculus
aagtcacctccgtatcagcttggga

SEQ ID NO: 65995 - DNA, 25 bp, Mus musculus
aagtcacctctaccgctcattggga

SEQ ID NO: 65996 - DNA, 25 bp, Mus musculus
aagtcacctctagcgctcattggga

SEQ ID NO: 65997 - DNA, 25 bp, Mus musculus
aagtcacctgacagagcatggccct

SEQ ID NO: 65998 - DNA, 25 bp, Mus musculus
aagtcacctgactgagcatggccct

SEQ ID NO: 65999 - DNA, 25 bp, Mus musculus
aagtcacctggcataagctgaaggc

SEQ ID NO: 66000 - DNA, 25 bp, Mus musculus
aagtcacctggcatgggtgcactga

SEQ ID NO: 66001 - DNA, 25 bp, Mus musculus
aagtcacctggcttaagctgaaggc

SEQ ID NO: 66002 - DNA, 25 bp, Mus musculus
aagtcacctggcttgggtgcactga

SEQ ID NO: 66003 - DNA, 25 bp, Mus musculus
aagtcacctggtaagaacagctaaa

SEQ ID NO: 66004 - DNA, 25 bp, Mus musculus
aagtcacctggttagaacagctaaa

SEQ ID NO: 66005 - DNA, 25 bp, Mus musculus
aagtcacctgtcaccaagtcttggt

SEQ ID NO: 66006 - DNA, 25 bp, Mus musculus
aagtcacctgtctccaagtcttggt

SEQ ID NO: 66007 - DNA, 25 bp, Mus musculus
aagtcacctgttcctaagacgtcag

SEQ ID NO: 66008 - DNA, 25 bp, Mus musculus
aagtcacctgttgctaagacgtcag

SEQ ID NO: 66009 - DNA, 25 bp, Mus musculus
aagtcaccttcacgattagattaaa

SEQ ID NO: 66010 - DNA, 25 bp, Mus musculus
aagtcaccttcaggattagattaaa

SEQ ID NO: 66011 - DNA, 25 bp, Mus musculus
aagtcaccttgcagctgtggcacat

SEQ ID NO: 66012 - DNA, 25 bp, Mus musculus
aagtcaccttgctgctgtggcacat

SEQ ID NO: 66013 - DNA, 25 bp, Mus musculus
aagtcacctttacaactgggaatat

SEQ ID NO: 66014 - DNA, 25 bp, Mus musculus
aagtcacctttagaactgggaatat

SEQ ID NO: 66015 - DNA, 25 bp, Mus musculus
aagtcacgaagacctctctttacgg

SEQ ID NO: 66016 - DNA, 25 bp, Mus musculus
aagtcacgaagagctctctttacgg

SEQ ID NO: 66017 - DNA, 25 bp, Mus musculus
aagtcacgactcagccatcataaaa

SEQ ID NO: 66018 - DNA, 25 bp, Mus musculus
aagtcacgactctgccatcataaaa

SEQ ID NO: 66019 - DNA, 25 bp, Mus musculus
aagtcacgctgtatgggcttggacg

SEQ ID NO: 66020 - DNA, 25 bp, Mus musculus
aagtcacgctgtttgggcttggacg

SEQ ID NO: 66021 - DNA, 25 bp, Mus musculus
aagtcacgggcccagttattgcacc

SEQ ID NO: 66022 - DNA, 25 bp, Mus musculus
aagtcacgggccgagttattgcacc

SEQ ID NO: 66023 - DNA, 25 bp, Mus musculus
aagtcacgtttccacctagagaaat

SEQ ID NO: 66024 - DNA, 25 bp, Mus musculus
aagtcacgtttcgacctagagaaat

SEQ ID NO: 66025 - DNA, 25 bp, Mus musculus
aagtcactaaacaattacttcataa

SEQ ID NO: 66026 - DNA, 25 bp, Mus musculus
aagtcactaaactattacttcataa

SEQ ID NO: 66027 - DNA, 25 bp, Mus musculus
aagtcactacatcaactggtcgaca

SEQ ID NO: 66028 - DNA, 25 bp, Mus musculus
aagtcactacatgaactggtcgaca

SEQ ID NO: 66029 - DNA, 25 bp, Mus musculus
aagtcactagcaacagcctggtggt

SEQ ID NO: 66030 - DNA, 25 bp, Mus musculus
aagtcactagcatcagcctggtggt

SEQ ID NO: 66031 - DNA, 25 bp, Mus musculus
aagtcactaggcaggttttctctgt

SEQ ID NO: 66032 - DNA, 25 bp, Mus musculus
aagtcactaggctggttttctctgt

SEQ ID NO: 66033 - DNA, 25 bp, Mus musculus
aagtcactcaagctctagatcgcgt

SEQ ID NO: 66034 - DNA, 25 bp, Mus musculus
aagtcactcaaggtctagatcgcgt

SEQ ID NO: 66035 - DNA, 25 bp, Mus musculus
aagtcactcagcagatgtagtgcag

SEQ ID NO: 66036 - DNA, 25 bp, Mus musculus
aagtcactcagctgatgtagtgcag

SEQ ID NO: 66037 - DNA, 25 bp, Mus musculus
aagtcactcgtacaagcgcagcctt

SEQ ID NO: 66038 - DNA, 25 bp, Mus musculus
aagtcactcgtagaagcgcagcctt

SEQ ID NO: 66039 - DNA, 25 bp, Mus musculus
aagtcactcgtccaatgcaggaaat

SEQ ID NO: 66040 - DNA, 25 bp, Mus musculus
aagtcactcgtcgaatgcaggaaat

SEQ ID NO: 66041 - DNA, 25 bp, Mus musculus
aagtcactctggacttgtgggttaa

SEQ ID NO: 66042 - DNA, 25 bp, Mus musculus
aagtcactctggtcttgtgggttaa

SEQ ID NO: 66043 - DNA, 25 bp, Mus musculus
aagtcactcttcctgttgtactttg

SEQ ID NO: 66044 - DNA, 25 bp, Mus musculus
aagtcactcttcgtgttgtactttg

SEQ ID NO: 66045 - DNA, 25 bp, Mus musculus
aagtcactgagtaggttttcctgag

SEQ ID NO: 66046 - DNA, 25 bp, Mus musculus
aagtcactgagttggttttcctgag

SEQ ID NO: 66047 - DNA, 25 bp, Mus musculus
aagtcactgcccagctttgagcctt

SEQ ID NO: 66048 - DNA, 25 bp, Mus musculus
aagtcactgccctgctttgagcctt

SEQ ID NO: 66049 - DNA, 25 bp, Mus musculus
aagtcactgctacatccctggagtt

SEQ ID NO: 66050 - DNA, 25 bp, Mus musculus
aagtcactgctagatccctggagtt

SEQ ID NO: 66051 - DNA, 25 bp, Mus musculus
aagtcactgctcatacactgtggtt

SEQ ID NO: 66052 - DNA, 25 bp, Mus musculus
aagtcactgctcttacactgtggtt

SEQ ID NO: 66053 - DNA, 25 bp, Mus musculus
aagtcactggcaaggctccagggct

SEQ ID NO: 66054 - DNA, 25 bp, Mus musculus
aagtcactggcatggctccagggct

SEQ ID NO: 66055 - DNA, 25 bp, Mus musculus
aagtcactgtccagctctgttggct

SEQ ID NO: 66056 - DNA, 25 bp, Mus musculus
aagtcactgtcctgctctgttggct

SEQ ID NO: 66057 - DNA, 25 bp, Mus musculus
aagtcactgtctatgctgtcagaag

SEQ ID NO: 66058 - DNA, 25 bp, Mus musculus
aagtcactgtctttgctgtcagaag

SEQ ID NO: 66059 - DNA, 25 bp, Mus musculus
aagtcactgtgtatgctgtcaggac

SEQ ID NO: 66060 - DNA, 25 bp, Mus musculus
aagtcactgtgtttgctgtcaggac

SEQ ID NO: 66061 - DNA, 25 bp, Mus musculus
aagtcacttaacagttctgatgaat

SEQ ID NO: 66062 - DNA, 25 bp, Mus musculus
aagtcacttaactgttctgatgaat

SEQ ID NO: 66063 - DNA, 25 bp, Mus musculus
aagtcacttacgattcttgctctgt

SEQ ID NO: 66064 - DNA, 25 bp, Mus musculus
aagtcacttacgtttcttgctctgt

SEQ ID NO: 66065 - DNA, 25 bp, Mus musculus
aagtcacttagcattcaaatttgaa

SEQ ID NO: 66066 - DNA, 25 bp, Mus musculus
aagtcacttagctttcaaatttgaa

SEQ ID NO: 66067 - DNA, 25 bp, Mus musculus
aagtcacttagtactctgtttcaga

SEQ ID NO: 66068 - DNA, 25 bp, Mus musculus
aagtcacttagttctctgtttcaga

SEQ ID NO: 66069 - DNA, 25 bp, Mus musculus
aagtcacttcagatgtcattctttg

SEQ ID NO: 66070 - DNA, 25 bp, Mus musculus
aagtcacttcagttgtcattctttg

SEQ ID NO: 66071 - DNA, 25 bp, Mus musculus
aagtcacttccgcaggtggtcacct

SEQ ID NO: 66072 - DNA, 25 bp, Mus musculus
aagtcacttccggaggtggtcacct

SEQ ID NO: 66073 - DNA, 25 bp, Mus musculus
aagtcacttgagaactatgcttaca

SEQ ID NO: 66074 - DNA, 25 bp, Mus musculus
aagtcacttgagtactatgcttaca

SEQ ID NO: 66075 - DNA, 25 bp, Mus musculus
aagtcacttgatatagaaattccga

SEQ ID NO: 66076 - DNA, 25 bp, Mus musculus
aagtcacttgatttagaaattccga

SEQ ID NO: 66077 - DNA, 25 bp, Mus musculus
aagtcacttgttactgttgatgcat

SEQ ID NO: 66078 - DNA, 25 bp, Mus musculus
aagtcacttgtttctgttgatgcat

SEQ ID NO: 66079 - DNA, 25 bp, Mus musculus
aagtcactttacaggacatggacag

SEQ ID NO: 66080 - DNA, 25 bp, Mus musculus
aagtcactttactggacatggacag

SEQ ID NO: 66081 - DNA, 25 bp, Mus musculus
aagtcactttagcataaacagatgg

SEQ ID NO: 66082 - DNA, 25 bp, Mus musculus
aagtcactttaggataaacagatgg

SEQ ID NO: 66083 - DNA, 25 bp, Mus musculus
aagtcactttcgaggcagttgttat

SEQ ID NO: 66084 - DNA, 25 bp, Mus musculus
aagtcactttcgtggcagttgttat

SEQ ID NO: 66085 - DNA, 25 bp, Mus musculus
aagtcactttgacatctactcggca

SEQ ID NO: 66086 - DNA, 25 bp, Mus musculus
aagtcactttgagatctactcggca

SEQ ID NO: 66087 - DNA, 25 bp, Mus musculus
aagtcactttgccagaaacagctcc

SEQ ID NO: 66088 - DNA, 25 bp, Mus musculus
aagtcactttgcgagaaacagctcc

SEQ ID NO: 66089 - DNA, 25 bp, Mus musculus
aagtcagaactcaagctacagccaa

SEQ ID NO: 66090 - DNA, 25 bp, Mus musculus
aagtcagaactctagctacagccaa

SEQ ID NO: 66091 - DNA, 25 bp, Mus musculus
aagtcagaattcagccttccgtttc

SEQ ID NO: 66092 - DNA, 25 bp, Mus musculus
aagtcagaattctgccttccgtttc

SEQ ID NO: 66093 - DNA, 25 bp, Mus musculus
aagtcagacaccaggaatacgtcca

SEQ ID NO: 66094 - DNA, 25 bp, Mus musculus
aagtcagacacctggaatacgtcca

SEQ ID NO: 66095 - DNA, 25 bp, Mus musculus
aagtcagacagcatgtgtatttctc

SEQ ID NO: 66096 - DNA, 25 bp, Mus musculus
aagtcagacagcttgtgtatttctc

SEQ ID NO: 66097 - DNA, 25 bp, Mus musculus
aagtcagacgcaattgcacagtgat

SEQ ID NO: 66098 - DNA, 25 bp, Mus musculus
aagtcagacgcatttgcacagtgat

SEQ ID NO: 66099 - DNA, 25 bp, Mus musculus
aagtcagactctactttatctaaaa

SEQ ID NO: 66100 - DNA, 25 bp, Mus musculus
aagtcagactcttctttatctaaaa

SEQ ID NO: 66101 - DNA, 25 bp, Mus musculus
aagtcagactgcatcttggtaagaa

SEQ ID NO: 66102 - DNA, 25 bp, Mus musculus
aagtcagactgcttcttggtaagaa

SEQ ID NO: 66103 - DNA, 25 bp, Mus musculus
aagtcagactgtcttgtgtgcaatg

SEQ ID NO: 66104 - DNA, 25 bp, Mus musculus
aagtcagactgtgttgtgtgcaatg

SEQ ID NO: 66105 - DNA, 25 bp, Mus musculus
aagtcagagaaaacgtctgtcccca

SEQ ID NO: 66106 - DNA, 25 bp, Mus musculus
aagtcagagaaactgagccccagca

SEQ ID NO: 66107 - DNA, 25 bp, Mus musculus
aagtcagagaaagtgagccccagca

SEQ ID NO: 66108 - DNA, 25 bp, Mus musculus
aagtcagagaaatcgtctgtcccca

SEQ ID NO: 66109 - DNA, 25 bp, Mus musculus
aagtcagagacacgcctccagcagc

SEQ ID NO: 66110 - DNA, 25 bp, Mus musculus
aagtcagagacacggcatcaccggt

SEQ ID NO: 66111 - DNA, 25 bp, Mus musculus
aagtcagagacaggcctccagcagc

SEQ ID NO: 66112 - DNA, 25 bp, Mus musculus
aagtcagagacagggcatcaccggt

SEQ ID NO: 66113 - DNA, 25 bp, Mus musculus
aagtcagagcctagctttcggtttc

SEQ ID NO: 66114 - DNA, 25 bp, Mus musculus
aagtcagagcctcagtacctgtcac

SEQ ID NO: 66115 - DNA, 25 bp, Mus musculus
aagtcagagcctgagtacctgtcac

SEQ ID NO: 66116 - DNA, 25 bp, Mus musculus
aagtcagagccttgctttcggtttc

SEQ ID NO: 66117 - DNA, 25 bp, Mus musculus
aagtcagagtgacgccagctggctc

SEQ ID NO: 66118 - DNA, 25 bp, Mus musculus
aagtcagagtgaggccagctggctc

SEQ ID NO: 66119 - DNA, 25 bp, Mus musculus
aagtcagagtgcagattcaaaccaa

SEQ ID NO: 66120 - DNA, 25 bp, Mus musculus
aagtcagagtgctgattcaaaccaa

SEQ ID NO: 66121 - DNA, 25 bp, Mus musculus
aagtcagagtggactctttctgcct

SEQ ID NO: 66122 - DNA, 25 bp, Mus musculus
aagtcagagtggtctctttctgcct

SEQ ID NO: 66123 - DNA, 25 bp, Mus musculus
aagtcagagttcacagtcaccgtca

SEQ ID NO: 66124 - DNA, 25 bp, Mus musculus
aagtcagagttcagaggcgtcctct

SEQ ID NO: 66125 - DNA, 25 bp, Mus musculus
aagtcagagttctcagtcaccgtca

SEQ ID NO: 66126 - DNA, 25 bp, Mus musculus
aagtcagagttctgaggcgtcctct

SEQ ID NO: 66127 - DNA, 25 bp, Mus musculus
aagtcagatcttactccgttttgca

SEQ ID NO: 66128 - DNA, 25 bp, Mus musculus
aagtcagatctttctccgttttgca

SEQ ID NO: 66129 - DNA, 25 bp, Mus musculus
aagtcagatgccactttgttgttta

SEQ ID NO: 66130 - DNA, 25 bp, Mus musculus
aagtcagatgcctctttgttgttta

SEQ ID NO: 66131 - DNA, 25 bp, Mus musculus
aagtcagatgttcccatttggttat

SEQ ID NO: 66132 - DNA, 25 bp, Mus musculus
aagtcagatgttgccatttggttat

SEQ ID NO: 66133 - DNA, 25 bp, Mus musculus
aagtcagattgtcccgctaggtcat

SEQ ID NO: 66134 - DNA, 25 bp, Mus musculus
aagtcagattgtgccgctaggtcat

SEQ ID NO: 66135 - DNA, 25 bp, Mus musculus
aagtcagatttcaacaagttgtcct

SEQ ID NO: 66136 - DNA, 25 bp, Mus musculus
aagtcagatttctacaagttgtcct

SEQ ID NO: 66137 - DNA, 25 bp, Mus musculus
aagtcagcaagtagtccaggctagc

SEQ ID NO: 66138 - DNA, 25 bp, Mus musculus
aagtcagcaagttgtccaggctagc

SEQ ID NO: 66139 - DNA, 25 bp, Mus musculus
aagtcagcactgaggtcaggacgga

SEQ ID NO: 66140 - DNA, 25 bp, Mus musculus
aagtcagcactgcacaagccacctg

SEQ ID NO: 66141 - DNA, 25 bp, Mus musculus
aagtcagcactggacaagccacctg

SEQ ID NO: 66142 - DNA, 25 bp, Mus musculus
aagtcagcactgtggtcaggacgga

SEQ ID NO: 66143 - DNA, 25 bp, Mus musculus
aagtcagcaggtcttcagcaatccg

SEQ ID NO: 66144 - DNA, 25 bp, Mus musculus
aagtcagcaggtgttcagcaatccg

SEQ ID NO: 66145 - DNA, 25 bp, Mus musculus
aagtcagcagtcatgttgtgcttat

SEQ ID NO: 66146 - DNA, 25 bp, Mus musculus
aagtcagcagtcttgttgtgcttat

SEQ ID NO: 66147 - DNA, 25 bp, Mus musculus
aagtcagcagttcccagcaacgata

SEQ ID NO: 66148 - DNA, 25 bp, Mus musculus
aagtcagcagttgccagcaacgata

SEQ ID NO: 66149 - DNA, 25 bp, Mus musculus
aagtcagcatgcctctctgagagag

SEQ ID NO: 66150 - DNA, 25 bp, Mus musculus
aagtcagcatgcgtctctgagagag

SEQ ID NO: 66151 - DNA, 25 bp, Mus musculus
aagtcagcatggactttcacttcca

SEQ ID NO: 66152 - DNA, 25 bp, Mus musculus
aagtcagcatggtctttcacttcca

SEQ ID NO: 66153 - DNA, 25 bp, Mus musculus
aagtcagcattcctgctgcagaact

SEQ ID NO: 66154 - DNA, 25 bp, Mus musculus
aagtcagcattcgtgctgcagaact

SEQ ID NO: 66155 - DNA, 25 bp, Mus musculus
aagtcagcatttccagtggctctag

SEQ ID NO: 66156 - DNA, 25 bp, Mus musculus
aagtcagcatttgcagtggctctag

SEQ ID NO: 66157 - DNA, 25 bp, Mus musculus
aagtcagccaccattgcttctgtaa

SEQ ID NO: 66158 - DNA, 25 bp, Mus musculus
aagtcagccacctttgcttctgtaa

SEQ ID NO: 66159 - DNA, 25 bp, Mus musculus
aagtcagccagcacagcaagtcagt

SEQ ID NO: 66160 - DNA, 25 bp, Mus musculus
aagtcagccagctcagcaagtcagt

SEQ ID NO: 66161 - DNA, 25 bp, Mus musculus
aagtcagccctgatgatccaaacac

SEQ ID NO: 66162 - DNA, 25 bp, Mus musculus
aagtcagccctgctgacatatccca

SEQ ID NO: 66163 - DNA, 25 bp, Mus musculus
aagtcagccctggtgacatatccca

SEQ ID NO: 66164 - DNA, 25 bp, Mus musculus
aagtcagccctgttgatccaaacac

SEQ ID NO: 66165 - DNA, 25 bp, Mus musculus
aagtcagcctggctccttgaggtga

SEQ ID NO: 66166 - DNA, 25 bp, Mus musculus
aagtcagcctgggtccttgaggtga

SEQ ID NO: 66167 - DNA, 25 bp, Mus musculus
aagtcagcctgtctgtatccgatgt

SEQ ID NO: 66168 - DNA, 25 bp, Mus musculus
aagtcagcctgtgtgtatccgatgt

SEQ ID NO: 66169 - DNA, 25 bp, Mus musculus
aagtcagcgagaatcaccatcacag

SEQ ID NO: 66170 - DNA, 25 bp, Mus musculus
aagtcagcgagattcaccatcacag

SEQ ID NO: 66171 - DNA, 25 bp, Mus musculus
aagtcagctcagagtcggctacagt

SEQ ID NO: 66172 - DNA, 25 bp, Mus musculus
aagtcagctcagtgtcggctacagt

SEQ ID NO: 66173 - DNA, 25 bp, Mus musculus
aagtcagctcttactgcacccaact

SEQ ID NO: 66174 - DNA, 25 bp, Mus musculus
aagtcagctctttctgcacccaact

SEQ ID NO: 66175 - DNA, 25 bp, Mus musculus
aagtcagctgagaatttgtagggca

SEQ ID NO: 66176 - DNA, 25 bp, Mus musculus
aagtcagctgagtatttgtagggca

SEQ ID NO: 66177 - DNA, 25 bp, Mus musculus
aagtcagctggccatttagggtcta

SEQ ID NO: 66178 - DNA, 25 bp, Mus musculus
aagtcagctggcgatttagggtcta

SEQ ID NO: 66179 - DNA, 25 bp, Mus musculus
aagtcagcttaaatggccttttact

SEQ ID NO: 66180 - DNA, 25 bp, Mus musculus
aagtcagcttaattggccttttact

SEQ ID NO: 66181 - DNA, 25 bp, Mus musculus
aagtcagcttggaaatgcggccttg

SEQ ID NO: 66182 - DNA, 25 bp, Mus musculus
aagtcagcttggtaatgcggccttg

SEQ ID NO: 66183 - DNA, 25 bp, Mus musculus
aagtcagctttcatcaaggatacaa

SEQ ID NO: 66184 - DNA, 25 bp, Mus musculus
aagtcagctttcttcaaggatacaa

SEQ ID NO: 66185 - DNA, 25 bp, Mus musculus
aagtcagctttgactcagtttctct

SEQ ID NO: 66186 - DNA, 25 bp, Mus musculus
aagtcagctttgtctcagtttctct

SEQ ID NO: 66187 - DNA, 25 bp, Mus musculus
aagtcaggaaatcaggctgagccct

SEQ ID NO: 66188 - DNA, 25 bp, Mus musculus
aagtcaggaaatgaggctgagccct

SEQ ID NO: 66189 - DNA, 25 bp, Mus musculus
aagtcaggaacgaagctccatctcc

SEQ ID NO: 66190 - DNA, 25 bp, Mus musculus
aagtcaggaacgtagctccatctcc

SEQ ID NO: 66191 - DNA, 25 bp, Mus musculus
aagtcaggaactccagcaaccagct

SEQ ID NO: 66192 - DNA, 25 bp, Mus musculus
aagtcaggaactgcagcaaccagct

SEQ ID NO: 66193 - DNA, 25 bp, Mus musculus
aagtcaggaattccccaggacccta

SEQ ID NO: 66194 - DNA, 25 bp, Mus musculus
aagtcaggaattgcccaggacccta

SEQ ID NO: 66195 - DNA, 25 bp, Mus musculus
aagtcaggactgagactccaagtga

SEQ ID NO: 66196 - DNA, 25 bp, Mus musculus
aagtcaggactgtgactccaagtga

SEQ ID NO: 66197 - DNA, 25 bp, Mus musculus
aagtcaggagaacagcagtaccact

SEQ ID NO: 66198 - DNA, 25 bp, Mus musculus
aagtcaggagaagagcagtaccact

SEQ ID NO: 66199 - DNA, 25 bp, Mus musculus
aagtcaggagggaccttctgtaaag

SEQ ID NO: 66200 - DNA, 25 bp, Mus musculus
aagtcaggagggtccttctgtaaag

SEQ ID NO: 66201 - DNA, 25 bp, Mus musculus
aagtcaggagtgcacgccttgatcc

SEQ ID NO: 66202 - DNA, 25 bp, Mus musculus
aagtcaggagtggacgccttgatcc

SEQ ID NO: 66203 - DNA, 25 bp, Mus musculus
aagtcaggattcaccattctcagtg

SEQ ID NO: 66204 - DNA, 25 bp, Mus musculus
aagtcaggattctccattctcagtg

SEQ ID NO: 66205 - DNA, 25 bp, Mus musculus
aagtcaggcacaatttcagggcaag

SEQ ID NO: 66206 - DNA, 25 bp, Mus musculus
aagtcaggcacattttcagggcaag

SEQ ID NO: 66207 - DNA, 25 bp, Mus musculus
aagtcaggcactcagtctgtggctc

SEQ ID NO: 66208 - DNA, 25 bp, Mus musculus
aagtcaggcactgagtctgtggctc

SEQ ID NO: 66209 - DNA, 25 bp, Mus musculus
aagtcaggcagacctacccgcttct

SEQ ID NO: 66210 - DNA, 25 bp, Mus musculus
aagtcaggcagagctacccgcttct

SEQ ID NO: 66211 - DNA, 25 bp, Mus musculus
aagtcaggccttcagaactgtctct

SEQ ID NO: 66212 - DNA, 25 bp, Mus musculus
aagtcaggccttgagaactgtctct

SEQ ID NO: 66213 - DNA, 25 bp, Mus musculus
aagtcaggcttccaagaggagttga

SEQ ID NO: 66214 - DNA, 25 bp, Mus musculus
aagtcaggcttcgaagaggagttga

SEQ ID NO: 66215 - DNA, 25 bp, Mus musculus
aagtcaggctttcctattggagatc

SEQ ID NO: 66216 - DNA, 25 bp, Mus musculus
aagtcaggctttgctattggagatc

SEQ ID NO: 66217 - DNA, 25 bp, Mus musculus
aagtcagggaagctcgcagcctcta

SEQ ID NO: 66218 - DNA, 25 bp, Mus musculus
aagtcagggaaggtcgcagcctcta

SEQ ID NO: 66219 - DNA, 25 bp, Mus musculus
aagtcagggattcatcgacatgtct

SEQ ID NO: 66220 - DNA, 25 bp, Mus musculus
aagtcagggattgatcgacatgtct

SEQ ID NO: 66221 - DNA, 25 bp, Mus musculus
aagtcagggcatatcttgcctagtg

SEQ ID NO: 66222 - DNA, 25 bp, Mus musculus
aagtcagggcatttcttgcctagtg

SEQ ID NO: 66223 - DNA, 25 bp, Mus musculus
aagtcagggccaacacaacgagtag

SEQ ID NO: 66224 - DNA, 25 bp, Mus musculus
aagtcagggccatcacaacgagtag

SEQ ID NO: 66225 - DNA, 25 bp, Mus musculus
aagtcagggcccctctcaaggagta

SEQ ID NO: 66226 - DNA, 25 bp, Mus musculus
aagtcagggcccgtctcaaggagta

SEQ ID NO: 66227 - DNA, 25 bp, Mus musculus
aagtcagggtcgctgtccagcccta

SEQ ID NO: 66228 - DNA, 25 bp, Mus musculus
aagtcagggtcggtgtccagcccta

SEQ ID NO: 66229 - DNA, 25 bp, Mus musculus
aagtcagggtgaccatccccctatc

SEQ ID NO: 66230 - DNA, 25 bp, Mus musculus
aagtcagggtgactaatcgaagtca

SEQ ID NO: 66231 - DNA, 25 bp, Mus musculus
aagtcagggtgagcatccccctatc

SEQ ID NO: 66232 - DNA, 25 bp, Mus musculus
aagtcagggtgagtaatcgaagtca

SEQ ID NO: 66233 - DNA, 25 bp, Mus musculus
aagtcagggtgtcgccaagtattta

SEQ ID NO: 66234 - DNA, 25 bp, Mus musculus
aagtcagggtgtggccaagtattta

SEQ ID NO: 66235 - DNA, 25 bp, Mus musculus
aagtcaggtatgctccagcatgcac

SEQ ID NO: 66236 - DNA, 25 bp, Mus musculus
aagtcaggtatggtccagcatgcac

SEQ ID NO: 66237 - DNA, 25 bp, Mus musculus
aagtcaggtccacattgcttccagg

SEQ ID NO: 66238 - DNA, 25 bp, Mus musculus
aagtcaggtccagattgcttccagg

SEQ ID NO: 66239 - DNA, 25 bp, Mus musculus
aagtcaggtccccacattctgttca

SEQ ID NO: 66240 - DNA, 25 bp, Mus musculus
aagtcaggtcccgacattctgttca

SEQ ID NO: 66241 - DNA, 25 bp, Mus musculus
aagtcaggtctcctgcgtcctggtt

SEQ ID NO: 66242 - DNA, 25 bp, Mus musculus
aagtcaggtctcgtgcgtcctggtt

SEQ ID NO: 66243 - DNA, 25 bp, Mus musculus
aagtcaggttcacagctttgcctcg

SEQ ID NO: 66244 - DNA, 25 bp, Mus musculus
aagtcaggttcagagctttgcctcg

SEQ ID NO: 66245 - DNA, 25 bp, Mus musculus
aagtcaggtttcactgcttgcgttt

SEQ ID NO: 66246 - DNA, 25 bp, Mus musculus
aagtcaggtttctctgcttgcgttt

SEQ ID NO: 66247 - DNA, 25 bp, Mus musculus
aagtcagtaagtaggcccctctcca

SEQ ID NO: 66248 - DNA, 25 bp, Mus musculus
aagtcagtaagttggcccctctcca

SEQ ID NO: 66249 - DNA, 25 bp, Mus musculus
aagtcagtacccacattcagctgga

SEQ ID NO: 66250 - DNA, 25 bp, Mus musculus
aagtcagtaccctcattcagctgga

SEQ ID NO: 66251 - DNA, 25 bp, Mus musculus
aagtcagtactaataacattcctat

SEQ ID NO: 66252 - DNA, 25 bp, Mus musculus
aagtcagtactattaacattcctat

SEQ ID NO: 66253 - DNA, 25 bp, Mus musculus
aagtcagtagcaaacccactgccat

SEQ ID NO: 66254 - DNA, 25 bp, Mus musculus
aagtcagtagcatacccactgccat

SEQ ID NO: 66255 - DNA, 25 bp, Mus musculus
aagtcagtagttaatgctgtattac

SEQ ID NO: 66256 - DNA, 25 bp, Mus musculus
aagtcagtagtttatgctgtattac

SEQ ID NO: 66257 - DNA, 25 bp, Mus musculus
aagtcagtatctatgccacctcctc

SEQ ID NO: 66258 - DNA, 25 bp, Mus musculus
aagtcagtatctttgccacctcctc

SEQ ID NO: 66259 - DNA, 25 bp, Mus musculus
aagtcagtatgccatttgttttaga

SEQ ID NO: 66260 - DNA, 25 bp, Mus musculus
aagtcagtatgcgatttgttttaga

SEQ ID NO: 66261 - DNA, 25 bp, Mus musculus
aagtcagtcaataacacctctagag

SEQ ID NO: 66262 - DNA, 25 bp, Mus musculus
aagtcagtcaattacacctctagag

SEQ ID NO: 66263 - DNA, 25 bp, Mus musculus
aagtcagtcagacggctggtcacat

SEQ ID NO: 66264 - DNA, 25 bp, Mus musculus
aagtcagtcagagggctggtcacat

SEQ ID NO: 66265 - DNA, 25 bp, Mus musculus
aagtcagtccatattcaggtgaaag

SEQ ID NO: 66266 - DNA, 25 bp, Mus musculus
aagtcagtccattttcaggtgaaag

SEQ ID NO: 66267 - DNA, 25 bp, Mus musculus
aagtcagtcctcaaagacatgctca

SEQ ID NO: 66268 - DNA, 25 bp, Mus musculus
aagtcagtcctctaagacatgctca

SEQ ID NO: 66269 - DNA, 25 bp, Mus musculus
aagtcagtgaatactggaggagcct

SEQ ID NO: 66270 - DNA, 25 bp, Mus musculus
aagtcagtgaattctggaggagcct

SEQ ID NO: 66271 - DNA, 25 bp, Mus musculus
aagtcagtgacccaattgcatttaa

SEQ ID NO: 66272 - DNA, 25 bp, Mus musculus
aagtcagtgaccgaattgcatttaa

SEQ ID NO: 66273 - DNA, 25 bp, Mus musculus
aagtcagtgagtaccttgtgctaga

SEQ ID NO: 66274 - DNA, 25 bp, Mus musculus
aagtcagtgagttccttgtgctaga

SEQ ID NO: 66275 - DNA, 25 bp, Mus musculus
aagtcagtgcggaggaccctggctc

SEQ ID NO: 66276 - DNA, 25 bp, Mus musculus
aagtcagtgcggtggaccctggctc

SEQ ID NO: 66277 - DNA, 25 bp, Mus musculus
aagtcagtgcttattagttcatccg

SEQ ID NO: 66278 - DNA, 25 bp, Mus musculus
aagtcagtgctttttagttcatccg

SEQ ID NO: 66279 - DNA, 25 bp, Mus musculus
aagtcagtgggaaccctggttgcat

SEQ ID NO: 66280 - DNA, 25 bp, Mus musculus
aagtcagtgggatccctggttgcat

SEQ ID NO: 66281 - DNA, 25 bp, Mus musculus
aagtcagtggtgaaggcctggcttc

SEQ ID NO: 66282 - DNA, 25 bp, Mus musculus
aagtcagtggtgtaggcctggcttc

SEQ ID NO: 66283 - DNA, 25 bp, Mus musculus
aagtcagtgtttagatctaggctct

SEQ ID NO: 66284 - DNA, 25 bp, Mus musculus
aagtcagtgttttgatctaggctct

SEQ ID NO: 66285 - DNA, 25 bp, Mus musculus
aagtcagttaggacctgccctgtgt

SEQ ID NO: 66286 - DNA, 25 bp, Mus musculus
aagtcagttaggtcctgccctgtgt

SEQ ID NO: 66287 - DNA, 25 bp, Mus musculus
aagtcagttatgatgcaacctaatt

SEQ ID NO: 66288 - DNA, 25 bp, Mus musculus
aagtcagttatgttgcaacctaatt

SEQ ID NO: 66289 - DNA, 25 bp, Mus musculus
aagtcagttattaagctgaggctgg

SEQ ID NO: 66290 - DNA, 25 bp, Mus musculus
aagtcagttatttagctgaggctgg

SEQ ID NO: 66291 - DNA, 25 bp, Mus musculus
aagtcagttcctccattactagcta

SEQ ID NO: 66292 - DNA, 25 bp, Mus musculus
aagtcagttcctgcattactagcta

SEQ ID NO: 66293 - DNA, 25 bp, Mus musculus
aagtcagttcttagagcttcagtgc

SEQ ID NO: 66294 - DNA, 25 bp, Mus musculus
aagtcagttctttgagcttcagtgc

SEQ ID NO: 66295 - DNA, 25 bp, Mus musculus
aagtcagttgagaacctgcctggct

SEQ ID NO: 66296 - DNA, 25 bp, Mus musculus
aagtcagttgagtacctgcctggct

SEQ ID NO: 66297 - DNA, 25 bp, Mus musculus
aagtcagttgggatcggagccccgc

SEQ ID NO: 66298 - DNA, 25 bp, Mus musculus
aagtcagttgggttcggagccccgc

SEQ ID NO: 66299 - DNA, 25 bp, Mus musculus
aagtcagtttttcgacgatgctggt

SEQ ID NO: 66300 - DNA, 25 bp, Mus musculus
aagtcagtttttggacgatgctggt

SEQ ID NO: 66301 - DNA, 25 bp, Mus musculus
aagtcataagccacttctctttacc

SEQ ID NO: 66302 - DNA, 25 bp, Mus musculus
aagtcataagcctcttctctttacc

SEQ ID NO: 66303 - DNA, 25 bp, Mus musculus
aagtcatacagcctcttggtgcact

SEQ ID NO: 66304 - DNA, 25 bp, Mus musculus
aagtcatacagcgtcttggtgcact

SEQ ID NO: 66305 - DNA, 25 bp, Mus musculus
aagtcataccttctgctaggcgcaa

SEQ ID NO: 66306 - DNA, 25 bp, Mus musculus
aagtcataccttgtgctaggcgcaa

SEQ ID NO: 66307 - DNA, 25 bp, Mus musculus
aagtcatagattcccagcttgctga

SEQ ID NO: 66308 - DNA, 25 bp, Mus musculus
aagtcatagattgccagcttgctga

SEQ ID NO: 66309 - DNA, 25 bp, Mus musculus
aagtcatagccactgggcaggacct

SEQ ID NO: 66310 - DNA, 25 bp, Mus musculus
aagtcatagccagtgggcaggacct

SEQ ID NO: 66311 - DNA, 25 bp, Mus musculus
aagtcatagctgatgtaagctgctc

SEQ ID NO: 66312 - DNA, 25 bp, Mus musculus
aagtcatagctgttgtaagctgctc

SEQ ID NO: 66313 - DNA, 25 bp, Mus musculus
aagtcatagcttcgtaatagccaca

SEQ ID NO: 66314 - DNA, 25 bp, Mus musculus
aagtcatagcttggtaatagccaca

SEQ ID NO: 66315 - DNA, 25 bp, Mus musculus
aagtcatagtgaacatgccagtgca

SEQ ID NO: 66316 - DNA, 25 bp, Mus musculus
aagtcatagtgatcatgccagtgca

SEQ ID NO: 66317 - DNA, 25 bp, Mus musculus
aagtcatatgcaagttctcctgcca

SEQ ID NO: 66318 - DNA, 25 bp, Mus musculus
aagtcatatgcatgttctcctgcca

SEQ ID NO: 66319 - DNA, 25 bp, Mus musculus
aagtcatattctagcctgaagccta

SEQ ID NO: 66320 - DNA, 25 bp, Mus musculus
aagtcatattcttgcctgaagccta

SEQ ID NO: 66321 - DNA, 25 bp, Mus musculus
aagtcatcacaaaacctactccaat

SEQ ID NO: 66322 - DNA, 25 bp, Mus musculus
aagtcatcacaatacctactccaat

SEQ ID NO: 66323 - DNA, 25 bp, Mus musculus
aagtcatcaccgctctgacgggtgg

SEQ ID NO: 66324 - DNA, 25 bp, Mus musculus
aagtcatcaccggtctgacgggtgg

SEQ ID NO: 66325 - DNA, 25 bp, Mus musculus
aagtcatcagggaacccagcttcca

SEQ ID NO: 66326 - DNA, 25 bp, Mus musculus
aagtcatcagggtacccagcttcca

SEQ ID NO: 66327 - DNA, 25 bp, Mus musculus
aagtcatcatgtaactactttccct

SEQ ID NO: 66328 - DNA, 25 bp, Mus musculus
aagtcatcatgttactactttccct

SEQ ID NO: 66329 - DNA, 25 bp, Mus musculus
aagtcatccaaaaatcccaatcacg

SEQ ID NO: 66330 - DNA, 25 bp, Mus musculus
aagtcatccaaatatcccaatcacg

SEQ ID NO: 66331 - DNA, 25 bp, Mus musculus
aagtcatccatgacattccttaggc

SEQ ID NO: 66332 - DNA, 25 bp, Mus musculus
aagtcatccatgattttcctctatg

SEQ ID NO: 66333 - DNA, 25 bp, Mus musculus
aagtcatccatgtcattccttaggc

SEQ ID NO: 66334 - DNA, 25 bp, Mus musculus
aagtcatccatgtttttcctctatg

SEQ ID NO: 66335 - DNA, 25 bp, Mus musculus
aagtcatccccaagctgaattgtgt

SEQ ID NO: 66336 - DNA, 25 bp, Mus musculus
aagtcatccccatgctgaattgtgt

SEQ ID NO: 66337 - DNA, 25 bp, Mus musculus
aagtcatccgaccagcacaaagctg

SEQ ID NO: 66338 - DNA, 25 bp, Mus musculus
aagtcatccgacgagcacaaagctg

SEQ ID NO: 66339 - DNA, 25 bp, Mus musculus
aagtcatccgttacctttcagaggt

SEQ ID NO: 66340 - DNA, 25 bp, Mus musculus
aagtcatccgtttcctttcagaggt

SEQ ID NO: 66341 - DNA, 25 bp, Mus musculus
aagtcatcctgaatccgttgggcat

SEQ ID NO: 66342 - DNA, 25 bp, Mus musculus
aagtcatcctgattccgttgggcat

SEQ ID NO: 66343 - DNA, 25 bp, Mus musculus
aagtcatcggtccattttatgagtt

SEQ ID NO: 66344 - DNA, 25 bp, Mus musculus
aagtcatcggtcgattttatgagtt

SEQ ID NO: 66345 - DNA, 25 bp, Mus musculus
aagtcatctaaaacatctgggcctg

SEQ ID NO: 66346 - DNA, 25 bp, Mus musculus
aagtcatctaaatcatctgggcctg

SEQ ID NO: 66347 - DNA, 25 bp, Mus musculus
aagtcatctcagcaccaatccacgt

SEQ ID NO: 66348 - DNA, 25 bp, Mus musculus
aagtcatctcaggaccaatccacgt

SEQ ID NO: 66349 - DNA, 25 bp, Mus musculus
aagtcatctctgcacattttgtttg

SEQ ID NO: 66350 - DNA, 25 bp, Mus musculus
aagtcatctctgcttgcaaagcaaa

SEQ ID NO: 66351 - DNA, 25 bp, Mus musculus
aagtcatctctggacattttgtttg

SEQ ID NO: 66352 - DNA, 25 bp, Mus musculus
aagtcatctctggttgcaaagcaaa

SEQ ID NO: 66353 - DNA, 25 bp, Mus musculus
aagtcatctgacatctcttcagacg

SEQ ID NO: 66354 - DNA, 25 bp, Mus musculus
aagtcatctgacttctcttcagacg

SEQ ID NO: 66355 - DNA, 25 bp, Mus musculus
aagtcatgaactcgatctggtctgt

SEQ ID NO: 66356 - DNA, 25 bp, Mus musculus
aagtcatgaactggatctggtctgt

SEQ ID NO: 66357 - DNA, 25 bp, Mus musculus
aagtcatgagccatactctacccaa

SEQ ID NO: 66358 - DNA, 25 bp, Mus musculus
aagtcatgagccttactctacccaa

SEQ ID NO: 66359 - DNA, 25 bp, Mus musculus
aagtcatgcaagctgcaacttccct

SEQ ID NO: 66360 - DNA, 25 bp, Mus musculus
aagtcatgcaaggtgcaacttccct

SEQ ID NO: 66361 - DNA, 25 bp, Mus musculus
aagtcatgcatgaggtccatacacc

SEQ ID NO: 66362 - DNA, 25 bp, Mus musculus
aagtcatgcatgtggtccatacacc

SEQ ID NO: 66363 - DNA, 25 bp, Mus musculus
aagtcatgcggacctttttaagcat

SEQ ID NO: 66364 - DNA, 25 bp, Mus musculus
aagtcatgcggagctttttaagcat

SEQ ID NO: 66365 - DNA, 25 bp, Mus musculus
aagtcatgctggcttcgggccagac

SEQ ID NO: 66366 - DNA, 25 bp, Mus musculus
aagtcatgctgggttcgggccagac

SEQ ID NO: 66367 - DNA, 25 bp, Mus musculus
aagtcatggaccatcagtgtcagca

SEQ ID NO: 66368 - DNA, 25 bp, Mus musculus
aagtcatggaccttcagtgtcagca

SEQ ID NO: 66369 - DNA, 25 bp, Mus musculus
aagtcatggcccatcccgggacgtg

SEQ ID NO: 66370 - DNA, 25 bp, Mus musculus
aagtcatggcccttcccgggacgtg

SEQ ID NO: 66371 - DNA, 25 bp, Mus musculus
aagtcatggctgacatgcccagcat

SEQ ID NO: 66372 - DNA, 25 bp, Mus musculus
aagtcatggctgtcatgcccagcat

SEQ ID NO: 66373 - DNA, 25 bp, Mus musculus
aagtcatgggtgattttgctaaagc

SEQ ID NO: 66374 - DNA, 25 bp, Mus musculus
aagtcatgggtgtttttgctaaagc

SEQ ID NO: 66375 - DNA, 25 bp, Mus musculus
aagtcatggtatagccagtgctggc

SEQ ID NO: 66376 - DNA, 25 bp, Mus musculus
aagtcatggtattgccagtgctggc

SEQ ID NO: 66377 - DNA, 25 bp, Mus musculus
aagtcatgtaccacgattggcgttt

SEQ ID NO: 66378 - DNA, 25 bp, Mus musculus
aagtcatgtacctcgattggcgttt

SEQ ID NO: 66379 - DNA, 25 bp, Mus musculus
aagtcatgtccaccccgctagcatt

SEQ ID NO: 66380 - DNA, 25 bp, Mus musculus
aagtcatgtccagcccgctagcatt

SEQ ID NO: 66381 - DNA, 25 bp, Mus musculus
aagtcatgtctcaactatcctgtgt

SEQ ID NO: 66382 - DNA, 25 bp, Mus musculus
aagtcatgtctctactatcctgtgt

SEQ ID NO: 66383 - DNA, 25 bp, Mus musculus
aagtcatgtggtactcctgttcact

SEQ ID NO: 66384 - DNA, 25 bp, Mus musculus
aagtcatgtggttctcctgttcact

SEQ ID NO: 66385 - DNA, 25 bp, Mus musculus
aagtcattaagaaatccccatttgt

SEQ ID NO: 66386 - DNA, 25 bp, Mus musculus
aagtcattaagatatccccatttgt

SEQ ID NO: 66387 - DNA, 25 bp, Mus musculus
aagtcattaccacaatctccgcaag

SEQ ID NO: 66388 - DNA, 25 bp, Mus musculus
aagtcattaccagaatctccgcaag

SEQ ID NO: 66389 - DNA, 25 bp, Mus musculus
aagtcattcaatctctgtggatgta

SEQ ID NO: 66390 - DNA, 25 bp, Mus musculus
aagtcattcaatgtctgtggatgta

SEQ ID NO: 66391 - DNA, 25 bp, Mus musculus
aagtcattccagcaatctcttcggg

SEQ ID NO: 66392 - DNA, 25 bp, Mus musculus
aagtcattccaggaatctcttcggg

SEQ ID NO: 66393 - DNA, 25 bp, Mus musculus
aagtcattccatcgctgggattgca

SEQ ID NO: 66394 - DNA, 25 bp, Mus musculus
aagtcattccatggctgggattgca

SEQ ID NO: 66395 - DNA, 25 bp, Mus musculus
aagtcattcctcactggctattcac

SEQ ID NO: 66396 - DNA, 25 bp, Mus musculus
aagtcattcctcagggaagtcagga

SEQ ID NO: 66397 - DNA, 25 bp, Mus musculus
aagtcattcctctctggctattcac

SEQ ID NO: 66398 - DNA, 25 bp, Mus musculus
aagtcattcctctgggaagtcagga

SEQ ID NO: 66399 - DNA, 25 bp, Mus musculus
aagtcattctcacctttgtaggcaa

SEQ ID NO: 66400 - DNA, 25 bp, Mus musculus
aagtcattctcagctttgtaggcaa

SEQ ID NO: 66401 - DNA, 25 bp, Mus musculus
aagtcattgatgaggcttccagaca

SEQ ID NO: 66402 - DNA, 25 bp, Mus musculus
aagtcattgatgtggcttccagaca

SEQ ID NO: 66403 - DNA, 25 bp, Mus musculus
aagtcattgcagactgggtcccata

SEQ ID NO: 66404 - DNA, 25 bp, Mus musculus
aagtcattgcagtctgggtcccata

SEQ ID NO: 66405 - DNA, 25 bp, Mus musculus
aagtcattgccactgcctataatat

SEQ ID NO: 66406 - DNA, 25 bp, Mus musculus
aagtcattgccagtgcctataatat

SEQ ID NO: 66407 - DNA, 25 bp, Mus musculus
aagtcattgggcactgagagatgtt

SEQ ID NO: 66408 - DNA, 25 bp, Mus musculus
aagtcattgggctctgagagatgtt

SEQ ID NO: 66409 - DNA, 25 bp, Mus musculus
aagtcattggtgcttctcagtgtgc

SEQ ID NO: 66410 - DNA, 25 bp, Mus musculus
aagtcattggtggttctcagtgtgc

SEQ ID NO: 66411 - DNA, 25 bp, Mus musculus
aagtcattgtagaggcagatgctga

SEQ ID NO: 66412 - DNA, 25 bp, Mus musculus
aagtcattgtagaggcttcttctcc

SEQ ID NO: 66413 - DNA, 25 bp, Mus musculus
aagtcattgtagtggcagatgctga

SEQ ID NO: 66414 - DNA, 25 bp, Mus musculus
aagtcattgtagtggcttcttctcc

SEQ ID NO: 66415 - DNA, 25 bp, Mus musculus
aagtcattgtccaagagcccattat

SEQ ID NO: 66416 - DNA, 25 bp, Mus musculus
aagtcattgtcctagagcccattat

SEQ ID NO: 66417 - DNA, 25 bp, Mus musculus
aagtcattgtggactggctttgcta

SEQ ID NO: 66418 - DNA, 25 bp, Mus musculus
aagtcattgtggtctggctttgcta

SEQ ID NO: 66419 - DNA, 25 bp, Mus musculus
aagtcatttacactgaccctgtggc

SEQ ID NO: 66420 - DNA, 25 bp, Mus musculus
aagtcatttacagtgaccctgtggc

SEQ ID NO: 66421 - DNA, 25 bp, Mus musculus
aagtcatttgagactctgagcctcc

SEQ ID NO: 66422 - DNA, 25 bp, Mus musculus
aagtcatttgagtctctgagcctcc

SEQ ID NO: 66423 - DNA, 25 bp, Mus musculus
aagtcatttgcgctgcactctgcac

SEQ ID NO: 66424 - DNA, 25 bp, Mus musculus
aagtcatttgcggtgcactctgcac

SEQ ID NO: 66425 - DNA, 25 bp, Mus musculus
aagtcatttgttcgcaaggccttca

SEQ ID NO: 66426 - DNA, 25 bp, Mus musculus
aagtcatttgttggcaaggccttca

SEQ ID NO: 66427 - DNA, 25 bp, Mus musculus
aagtcatttttcctgcatgagtttc

SEQ ID NO: 66428 - DNA, 25 bp, Mus musculus
aagtcatttttcgtgcatgagtttc

SEQ ID NO: 66429 - DNA, 25 bp, Mus musculus
aagtccaaatgtcagttagcaccct

SEQ ID NO: 66430 - DNA, 25 bp, Mus musculus
aagtccaaatgtgagttagcaccct

SEQ ID NO: 66431 - DNA, 25 bp, Mus musculus
aagtccaacacactggtccatgtgc

SEQ ID NO: 66432 - DNA, 25 bp, Mus musculus
aagtccaacacagtggtccatgtgc

SEQ ID NO: 66433 - DNA, 25 bp, Mus musculus
aagtccaacaccaacctggctgtac

SEQ ID NO: 66434 - DNA, 25 bp, Mus musculus
aagtccaacacctacctggctgtac

SEQ ID NO: 66435 - DNA, 25 bp, Mus musculus
aagtccaagcgtatgttgctgcttc

SEQ ID NO: 66436 - DNA, 25 bp, Mus musculus
aagtccaagcgtttgttgctgcttc

SEQ ID NO: 66437 - DNA, 25 bp, Mus musculus
aagtccaagctgaatgcgtatatgt

SEQ ID NO: 66438 - DNA, 25 bp, Mus musculus
aagtccaagctgtatgcgtatatgt

SEQ ID NO: 66439 - DNA, 25 bp, Mus musculus
aagtccaaggagacatgtccctgtg

SEQ ID NO: 66440 - DNA, 25 bp, Mus musculus
aagtccaaggagtcatgtccctgtg

SEQ ID NO: 66441 - DNA, 25 bp, Mus musculus
aagtccaaggccagtagcctagact

SEQ ID NO: 66442 - DNA, 25 bp, Mus musculus
aagtccaaggcctgtagcctagact

SEQ ID NO: 66443 - DNA, 25 bp, Mus musculus
aagtccaagtctcgccagtgtgtca

SEQ ID NO: 66444 - DNA, 25 bp, Mus musculus
aagtccaagtctggccagtgtgtca

SEQ ID NO: 66445 - DNA, 25 bp, Mus musculus
aagtccaagtggacctccacataaa

SEQ ID NO: 66446 - DNA, 25 bp, Mus musculus
aagtccaagtggtcctccacataaa

SEQ ID NO: 66447 - DNA, 25 bp, Mus musculus
aagtccaattccaagcactgttaga

SEQ ID NO: 66448 - DNA, 25 bp, Mus musculus
aagtccaattccagtctatccacat

SEQ ID NO: 66449 - DNA, 25 bp, Mus musculus
aagtccaattcctagcactgttaga

SEQ ID NO: 66450 - DNA, 25 bp, Mus musculus
aagtccaattcctgtctatccacat

SEQ ID NO: 66451 - DNA, 25 bp, Mus musculus
aagtccaattttctgttggatttct

SEQ ID NO: 66452 - DNA, 25 bp, Mus musculus
aagtccaattttgtgttggatttct

SEQ ID NO: 66453 - DNA, 25 bp, Mus musculus
aagtccacaaatcaacttctcctag

SEQ ID NO: 66454 - DNA, 25 bp, Mus musculus
aagtccacaaatgaacttctcctag

SEQ ID NO: 66455 - DNA, 25 bp, Mus musculus
aagtccacaactccaattttctatc

SEQ ID NO: 66456 - DNA, 25 bp, Mus musculus
aagtccacaactgcaattttctatc

SEQ ID NO: 66457 - DNA, 25 bp, Mus musculus
aagtccacaataatttctcaagtgt

SEQ ID NO: 66458 - DNA, 25 bp, Mus musculus
aagtccacaatattttctcaagtgt

SEQ ID NO: 66459 - DNA, 25 bp, Mus musculus
aagtccacaattagtcaaggttgac

SEQ ID NO: 66460 - DNA, 25 bp, Mus musculus
aagtccacaatttgtcaaggttgac

SEQ ID NO: 66461 - DNA, 25 bp, Mus musculus
aagtccacaccaagtcaagctgcat

SEQ ID NO: 66462 - DNA, 25 bp, Mus musculus
aagtccacaccatgtcaagctgcat

SEQ ID NO: 66463 - DNA, 25 bp, Mus musculus
aagtccacagggacacagctgaagt

SEQ ID NO: 66464 - DNA, 25 bp, Mus musculus
aagtccacagggaggtctgcggcca

SEQ ID NO: 66465 - DNA, 25 bp, Mus musculus
aagtccacagggtcacagctgaagt

SEQ ID NO: 66466 - DNA, 25 bp, Mus musculus
aagtccacagggtggtctgcggcca

SEQ ID NO: 66467 - DNA, 25 bp, Mus musculus
aagtccaccagaatagctgcctgct

SEQ ID NO: 66468 - DNA, 25 bp, Mus musculus
aagtccaccagattagctgcctgct

SEQ ID NO: 66469 - DNA, 25 bp, Mus musculus
aagtccaccaggctctcgagagcat

SEQ ID NO: 66470 - DNA, 25 bp, Mus musculus
aagtccaccagggtctcgagagcat

SEQ ID NO: 66471 - DNA, 25 bp, Mus musculus
aagtccacccaaaagagctagtcct

SEQ ID NO: 66472 - DNA, 25 bp, Mus musculus
aagtccacccaatagagctagtcct

SEQ ID NO: 66473 - DNA, 25 bp, Mus musculus
aagtccacccctcgtgaaggccatg

SEQ ID NO: 66474 - DNA, 25 bp, Mus musculus
aagtccacccctggtgaaggccatg

SEQ ID NO: 66475 - DNA, 25 bp, Mus musculus
aagtccacccttcacaagtgtcaga

SEQ ID NO: 66476 - DNA, 25 bp, Mus musculus
aagtccacccttgacaagtgtcaga

SEQ ID NO: 66477 - DNA, 25 bp, Mus musculus
aagtccacctggacagattctccaa

SEQ ID NO: 66478 - DNA, 25 bp, Mus musculus
aagtccacctggtcagattctccaa

SEQ ID NO: 66479 - DNA, 25 bp, Mus musculus
aagtccacgaatacctgggctggca

SEQ ID NO: 66480 - DNA, 25 bp, Mus musculus
aagtccacgaattcctgggctggca

SEQ ID NO: 66481 - DNA, 25 bp, Mus musculus
aagtccacgctgagagtgctataca

SEQ ID NO: 66482 - DNA, 25 bp, Mus musculus
aagtccacgctgtgagtgctataca

SEQ ID NO: 66483 - DNA, 25 bp, Mus musculus
aagtccacggccatgatgcctatga

SEQ ID NO: 66484 - DNA, 25 bp, Mus musculus
aagtccacggccttgatgcctatga

SEQ ID NO: 66485 - DNA, 25 bp, Mus musculus
aagtccacgggaacctggctacaag

SEQ ID NO: 66486 - DNA, 25 bp, Mus musculus
aagtccacgggatcctggctacaag

SEQ ID NO: 66487 - DNA, 25 bp, Mus musculus
aagtccactaagcaccattctgaaa

SEQ ID NO: 66488 - DNA, 25 bp, Mus musculus
aagtccactaaggaccattctgaaa

SEQ ID NO: 66489 - DNA, 25 bp, Mus musculus
aagtccactaataagctgtcccgtt

SEQ ID NO: 66490 - DNA, 25 bp, Mus musculus
aagtccactaattagctgtcccgtt

SEQ ID NO: 66491 - DNA, 25 bp, Mus musculus
aagtccactcagcaagcagtttgaa

SEQ ID NO: 66492 - DNA, 25 bp, Mus musculus
aagtccactcaggaagcagtttgaa

SEQ ID NO: 66493 - DNA, 25 bp, Mus musculus
aagtccagaatcatagccatcgcct

SEQ ID NO: 66494 - DNA, 25 bp, Mus musculus
aagtccagaatcttagccatcgcct

SEQ ID NO: 66495 - DNA, 25 bp, Mus musculus
aagtccagacctaaagtccaactag

SEQ ID NO: 66496 - DNA, 25 bp, Mus musculus
aagtccagaccttaagtccaactag

SEQ ID NO: 66497 - DNA, 25 bp, Mus musculus
aagtccagactgaacaccagaagat

SEQ ID NO: 66498 - DNA, 25 bp, Mus musculus
aagtccagactgtacaccagaagat

SEQ ID NO: 66499 - DNA, 25 bp, Mus musculus
aagtccagagagacccttgtgtgtc

SEQ ID NO: 66500 - DNA, 25 bp, Mus musculus
aagtccagagagtcccttgtgtgtc

SEQ ID NO: 66501 - DNA, 25 bp, Mus musculus
aagtccagagttcttggccttccaa

SEQ ID NO: 66502 - DNA, 25 bp, Mus musculus
aagtccagagttgttggccttccaa

SEQ ID NO: 66503 - DNA, 25 bp, Mus musculus
aagtccagatctccccgaagatcca

SEQ ID NO: 66504 - DNA, 25 bp, Mus musculus
aagtccagatctgcccgaagatcca

SEQ ID NO: 66505 - DNA, 25 bp, Mus musculus
aagtccagctcaaaggtaaagtcca

SEQ ID NO: 66506 - DNA, 25 bp, Mus musculus
aagtccagctcataggtaaagtcca

SEQ ID NO: 66507 - DNA, 25 bp, Mus musculus
aagtccagctggagcacctagaatt

SEQ ID NO: 66508 - DNA, 25 bp, Mus musculus
aagtccagctggagtactgtggcgt

SEQ ID NO: 66509 - DNA, 25 bp, Mus musculus
aagtccagctggtgcacctagaatt

SEQ ID NO: 66510 - DNA, 25 bp, Mus musculus
aagtccagctggtgtactgtggcgt

SEQ ID NO: 66511 - DNA, 25 bp, Mus musculus
aagtccaggaacatgacctttgtat

SEQ ID NO: 66512 - DNA, 25 bp, Mus musculus
aagtccaggaacttgacctttgtat

SEQ ID NO: 66513 - DNA, 25 bp, Mus musculus
aagtccaggaatagacagatcaggg

SEQ ID NO: 66514 - DNA, 25 bp, Mus musculus
aagtccaggaattgacagatcaggg

SEQ ID NO: 66515 - DNA, 25 bp, Mus musculus
aagtccaggctgatctccttcctgc

SEQ ID NO: 66516 - DNA, 25 bp, Mus musculus
aagtccaggctgttctccttcctgc

SEQ ID NO: 66517 - DNA, 25 bp, Mus musculus
aagtccagggatcccatcagatgca

SEQ ID NO: 66518 - DNA, 25 bp, Mus musculus
aagtccagggatgccatcagatgca

SEQ ID NO: 66519 - DNA, 25 bp, Mus musculus
aagtccaggtacagcgggaatctcc

SEQ ID NO: 66520 - DNA, 25 bp, Mus musculus
aagtccaggtactgcgggaatctcc

SEQ ID NO: 66521 - DNA, 25 bp, Mus musculus
aagtccaggtctaccctgagcgtaa

SEQ ID NO: 66522 - DNA, 25 bp, Mus musculus
aagtccaggtctctacttgggtagt

SEQ ID NO: 66523 - DNA, 25 bp, Mus musculus
aagtccaggtctgtacttgggtagt

SEQ ID NO: 66524 - DNA, 25 bp, Mus musculus
aagtccaggtcttccctgagcgtaa

SEQ ID NO: 66525 - DNA, 25 bp, Mus musculus
aagtccaggtggagctgactgttct

SEQ ID NO: 66526 - DNA, 25 bp, Mus musculus
aagtccaggtggtgctgactgttct

SEQ ID NO: 66527 - DNA, 25 bp, Mus musculus
aagtccagtaagaaccacacacatg

SEQ ID NO: 66528 - DNA, 25 bp, Mus musculus
aagtccagtaagtaccacacacatg

SEQ ID NO: 66529 - DNA, 25 bp, Mus musculus
aagtccagtcccagcatctagcaaa

SEQ ID NO: 66530 - DNA, 25 bp, Mus musculus
aagtccagtccctgcatctagcaaa

SEQ ID NO: 66531 - DNA, 25 bp, Mus musculus
aagtccagttccagaaagaggcagg

SEQ ID NO: 66532 - DNA, 25 bp, Mus musculus
aagtccagttcctgaaagaggcagg

SEQ ID NO: 66533 - DNA, 25 bp, Mus musculus
aagtccagttggctttctagcatcc

SEQ ID NO: 66534 - DNA, 25 bp, Mus musculus
aagtccagttgggtttctagcatcc

SEQ ID NO: 66535 - DNA, 25 bp, Mus musculus
aagtccataattcttatcttcagaa

SEQ ID NO: 66536 - DNA, 25 bp, Mus musculus
aagtccataattgttatcttcagaa

SEQ ID NO: 66537 - DNA, 25 bp, Mus musculus
aagtccatagctaaaataatgacat

SEQ ID NO: 66538 - DNA, 25 bp, Mus musculus
aagtccatagcttaaataatgacat

SEQ ID NO: 66539 - DNA, 25 bp, Mus musculus
aagtccatatgtatttacatccaga

SEQ ID NO: 66540 - DNA, 25 bp, Mus musculus
aagtccatatgtttttacatccaga

SEQ ID NO: 66541 - DNA, 25 bp, Mus musculus
aagtccatattacataccttgtcaa

SEQ ID NO: 66542 - DNA, 25 bp, Mus musculus
aagtccatattagataccttgtcaa

SEQ ID NO: 66543 - DNA, 25 bp, Mus musculus
aagtccatcgacaggtaagtagata

SEQ ID NO: 66544 - DNA, 25 bp, Mus musculus
aagtccatcgactggtaagtagata

SEQ ID NO: 66545 - DNA, 25 bp, Mus musculus
aagtccatcggaaataccagacatt

SEQ ID NO: 66546 - DNA, 25 bp, Mus musculus
aagtccatcggatataccagacatt

SEQ ID NO: 66547 - DNA, 25 bp, Mus musculus
aagtccatcgtacttttctgagccc

SEQ ID NO: 66548 - DNA, 25 bp, Mus musculus
aagtccatcgtagttttctgagccc

SEQ ID NO: 66549 - DNA, 25 bp, Mus musculus
aagtccatctatacctataacattc

SEQ ID NO: 66550 - DNA, 25 bp, Mus musculus
aagtccatctattcctataacattc

SEQ ID NO: 66551 - DNA, 25 bp, Mus musculus
aagtccatgcccagaaggctgcaaa

SEQ ID NO: 66552 - DNA, 25 bp, Mus musculus
aagtccatgccctgaaggctgcaaa

SEQ ID NO: 66553 - DNA, 25 bp, Mus musculus
aagtccatggccactgttgttgaca

SEQ ID NO: 66554 - DNA, 25 bp, Mus musculus
aagtccatggcctctgttgttgaca

SEQ ID NO: 66555 - DNA, 25 bp, Mus musculus
aagtccatgggaagagctgccactt

SEQ ID NO: 66556 - DNA, 25 bp, Mus musculus
aagtccatgggatgagctgccactt

SEQ ID NO: 66557 - DNA, 25 bp, Mus musculus
aagtccatgggtacaactcagttac

SEQ ID NO: 66558 - DNA, 25 bp, Mus musculus
aagtccatgggttcaactcagttac

SEQ ID NO: 66559 - DNA, 25 bp, Mus musculus
aagtccatggtgaagcacagcgcgt

SEQ ID NO: 66560 - DNA, 25 bp, Mus musculus
aagtccatggtgtagcacagcgcgt

SEQ ID NO: 66561 - DNA, 25 bp, Mus musculus
aagtccatgtacctcacagtgaaaa

SEQ ID NO: 66562 - DNA, 25 bp, Mus musculus
aagtccatgtacgtcacagtgaaaa

SEQ ID NO: 66563 - DNA, 25 bp, Mus musculus
aagtccatgttgctgctaaaattag

SEQ ID NO: 66564 - DNA, 25 bp, Mus musculus
aagtccatgttggtgctaaaattag

SEQ ID NO: 66565 - DNA, 25 bp, Mus musculus
aagtccattatcatccctactatta

SEQ ID NO: 66566 - DNA, 25 bp, Mus musculus
aagtccattatcttccctactatta

SEQ ID NO: 66567 - DNA, 25 bp, Mus musculus
aagtccattgagctgctacggcggc

SEQ ID NO: 66568 - DNA, 25 bp, Mus musculus
aagtccattgaggtgctacggcggc

SEQ ID NO: 66569 - DNA, 25 bp, Mus musculus
aagtccattggaagcactcgaaata

SEQ ID NO: 66570 - DNA, 25 bp, Mus musculus
aagtccattggatgcactcgaaata

SEQ ID NO: 66571 - DNA, 25 bp, Mus musculus
aagtccatttggatatgctgccttg

SEQ ID NO: 66572 - DNA, 25 bp, Mus musculus
aagtccatttggttatgctgccttg

SEQ ID NO: 66573 - DNA, 25 bp, Mus musculus
aagtccattttgctgagccggcgtc

SEQ ID NO: 66574 - DNA, 25 bp, Mus musculus
aagtccattttggtgagccggcgtc

SEQ ID NO: 66575 - DNA, 25 bp, Mus musculus
aagtcccaaagcacgaagcagcgta

SEQ ID NO: 66576 - DNA, 25 bp, Mus musculus
aagtcccaaagctcgaagcagcgta

SEQ ID NO: 66577 - DNA, 25 bp, Mus musculus
aagtcccaaagtcttagatgtgtta

SEQ ID NO: 66578 - DNA, 25 bp, Mus musculus
aagtcccaaagtgttagatgtgtta

SEQ ID NO: 66579 - DNA, 25 bp, Mus musculus
aagtcccaacatatccaagaacata

SEQ ID NO: 66580 - DNA, 25 bp, Mus musculus
aagtcccaacatccaattcgaagcc

SEQ ID NO: 66581 - DNA, 25 bp, Mus musculus
aagtcccaacatgcaattcgaagcc

SEQ ID NO: 66582 - DNA, 25 bp, Mus musculus
aagtcccaacatttccaagaacata

SEQ ID NO: 66583 - DNA, 25 bp, Mus musculus
aagtcccaaccactgtaggcttaat

SEQ ID NO: 66584 - DNA, 25 bp, Mus musculus
aagtcccaaccagtgtaggcttaat

SEQ ID NO: 66585 - DNA, 25 bp, Mus musculus
aagtcccaagaaacatgatgcatag

SEQ ID NO: 66586 - DNA, 25 bp, Mus musculus
aagtcccaagaatcatgatgcatag

SEQ ID NO: 66587 - DNA, 25 bp, Mus musculus
aagtcccaagctcctgggtcaagac

SEQ ID NO: 66588 - DNA, 25 bp, Mus musculus
aagtcccaagctgctgggtcaagac

SEQ ID NO: 66589 - DNA, 25 bp, Mus musculus
aagtcccaattaaatacacagttgt

SEQ ID NO: 66590 - DNA, 25 bp, Mus musculus
aagtcccaattatatacacagttgt

SEQ ID NO: 66591 - DNA, 25 bp, Mus musculus
aagtcccacacactcaattcacgtt

SEQ ID NO: 66592 - DNA, 25 bp, Mus musculus
aagtcccacacagtcaattcacgtt

SEQ ID NO: 66593 - DNA, 25 bp, Mus musculus
aagtcccacgagactgtgtgtaacc

SEQ ID NO: 66594 - DNA, 25 bp, Mus musculus
aagtcccacgagtctgtgtgtaacc

SEQ ID NO: 66595 - DNA, 25 bp, Mus musculus
aagtcccagaaacgcttgcatctct

SEQ ID NO: 66596 - DNA, 25 bp, Mus musculus
aagtcccagaaaggcttgcatctct

SEQ ID NO: 66597 - DNA, 25 bp, Mus musculus
aagtcccagagcacttgggtccgga

SEQ ID NO: 66598 - DNA, 25 bp, Mus musculus
aagtcccagagctcttgggtccgga

SEQ ID NO: 66599 - DNA, 25 bp, Mus musculus
aagtcccagaggacaggttatcaga

SEQ ID NO: 66600 - DNA, 25 bp, Mus musculus
aagtcccagaggctcacattctgga

SEQ ID NO: 66601 - DNA, 25 bp, Mus musculus
aagtcccagagggtcacattctgga

SEQ ID NO: 66602 - DNA, 25 bp, Mus musculus
aagtcccagaggtcaggttatcaga

SEQ ID NO: 66603 - DNA, 25 bp, Mus musculus
aagtcccagctgaagacacagttgg

SEQ ID NO: 66604 - DNA, 25 bp, Mus musculus
aagtcccagctgatatcttggcggg

SEQ ID NO: 66605 - DNA, 25 bp, Mus musculus
aagtcccagctgtagacacagttgg

SEQ ID NO: 66606 - DNA, 25 bp, Mus musculus
aagtcccagctgttatcttggcggg

SEQ ID NO: 66607 - DNA, 25 bp, Mus musculus
aagtcccaggagcagtcttcagaac

SEQ ID NO: 66608 - DNA, 25 bp, Mus musculus
aagtcccaggaggagtcttcagaac

SEQ ID NO: 66609 - DNA, 25 bp, Mus musculus
aagtcccagggaaccctcagggtgt

SEQ ID NO: 66610 - DNA, 25 bp, Mus musculus
aagtcccagggatccctcagggtgt

SEQ ID NO: 66611 - DNA, 25 bp, Mus musculus
aagtcccagtgcacagacacggagc

SEQ ID NO: 66612 - DNA, 25 bp, Mus musculus
aagtcccagtgctcagacacggagc

SEQ ID NO: 66613 - DNA, 25 bp, Mus musculus
aagtcccatcagaggtagccagcaa

SEQ ID NO: 66614 - DNA, 25 bp, Mus musculus
aagtcccatcagtggtagccagcaa

SEQ ID NO: 66615 - DNA, 25 bp, Mus musculus
aagtcccatcgaaccacttctatac

SEQ ID NO: 66616 - DNA, 25 bp, Mus musculus
aagtcccatcgatccacttctatac

SEQ ID NO: 66617 - DNA, 25 bp, Mus musculus
aagtcccatttacacagtgtcctga

SEQ ID NO: 66618 - DNA, 25 bp, Mus musculus
aagtcccatttagacagtgtcctga

SEQ ID NO: 66619 - DNA, 25 bp, Mus musculus
aagtccccaaagaagcattcccaga

SEQ ID NO: 66620 - DNA, 25 bp, Mus musculus
aagtccccaaagtagcattcccaga

SEQ ID NO: 66621 - DNA, 25 bp, Mus musculus
aagtccccaactctataatcagacc

SEQ ID NO: 66622 - DNA, 25 bp, Mus musculus
aagtccccaactgtataatcagacc

SEQ ID NO: 66623 - DNA, 25 bp, Mus musculus
aagtccccaataaagccttcatgtc

SEQ ID NO: 66624 - DNA, 25 bp, Mus musculus
aagtccccaatatagccttcatgtc

SEQ ID NO: 66625 - DNA, 25 bp, Mus musculus
aagtccccactacttggtgtacctg

SEQ ID NO: 66626 - DNA, 25 bp, Mus musculus
aagtccccactagttggtgtacctg

SEQ ID NO: 66627 - DNA, 25 bp, Mus musculus
aagtccccagaacataccatccagt

SEQ ID NO: 66628 - DNA, 25 bp, Mus musculus
aagtccccagaagataccatccagt

SEQ ID NO: 66629 - DNA, 25 bp, Mus musculus
aagtccccagcactgacgatgtgga

SEQ ID NO: 66630 - DNA, 25 bp, Mus musculus
aagtccccagcactgtgagaaaatg

SEQ ID NO: 66631 - DNA, 25 bp, Mus musculus
aagtccccagcagtgacgatgtgga

SEQ ID NO: 66632 - DNA, 25 bp, Mus musculus
aagtccccagcagtgtgagaaaatg

SEQ ID NO: 66633 - DNA, 25 bp, Mus musculus
aagtccccagccaatactcaggaga

SEQ ID NO: 66634 - DNA, 25 bp, Mus musculus
aagtccccagcctatactcaggaga

SEQ ID NO: 66635 - DNA, 25 bp, Mus musculus
aagtccccatcaatgccgggagtgt

SEQ ID NO: 66636 - DNA, 25 bp, Mus musculus
aagtccccatcattgccgggagtgt

SEQ ID NO: 66637 - DNA, 25 bp, Mus musculus
aagtcccctgtgaacttagtgcaga

SEQ ID NO: 66638 - DNA, 25 bp, Mus musculus
aagtcccctgtgtacttagtgcaga

SEQ ID NO: 66639 - DNA, 25 bp, Mus musculus
aagtcccgagggacatgttgaaatg

SEQ ID NO: 66640 - DNA, 25 bp, Mus musculus
aagtcccgagggtcatgttgaaatg

SEQ ID NO: 66641 - DNA, 25 bp, Mus musculus
aagtcccgatacacaggagactgaa

SEQ ID NO: 66642 - DNA, 25 bp, Mus musculus
aagtcccgatactcaggagactgaa

SEQ ID NO: 66643 - DNA, 25 bp, Mus musculus
aagtcccgatgaactcccaggatgg

SEQ ID NO: 66644 - DNA, 25 bp, Mus musculus
aagtcccgatgatctcccaggatgg

SEQ ID NO: 66645 - DNA, 25 bp, Mus musculus
aagtcccgatgtcgttctgttgttt

SEQ ID NO: 66646 - DNA, 25 bp, Mus musculus
aagtcccgatgtggttctgttgttt

SEQ ID NO: 66647 - DNA, 25 bp, Mus musculus
aagtcccgtcatccggaggtcctgg

SEQ ID NO: 66648 - DNA, 25 bp, Mus musculus
aagtcccgtcatgcggaggtcctgg

SEQ ID NO: 66649 - DNA, 25 bp, Mus musculus
aagtccctcagcatcatgaccagat

SEQ ID NO: 66650 - DNA, 25 bp, Mus musculus
aagtccctcagcttcatgaccagat

SEQ ID NO: 66651 - DNA, 25 bp, Mus musculus
aagtccctcataagtttcagtctag

SEQ ID NO: 66652 - DNA, 25 bp, Mus musculus
aagtccctcatatgtttcagtctag

SEQ ID NO: 66653 - DNA, 25 bp, Mus musculus
aagtccctcctcattgcagatttga

SEQ ID NO: 66654 - DNA, 25 bp, Mus musculus
aagtccctcctctttgcagatttga

SEQ ID NO: 66655 - DNA, 25 bp, Mus musculus
aagtccctcctgacacatgagtatt

SEQ ID NO: 66656 - DNA, 25 bp, Mus musculus
aagtccctcctgctgaactgatgag

SEQ ID NO: 66657 - DNA, 25 bp, Mus musculus
aagtccctcctggtgaactgatgag

SEQ ID NO: 66658 - DNA, 25 bp, Mus musculus
aagtccctcctgtcacatgagtatt

SEQ ID NO: 66659 - DNA, 25 bp, Mus musculus
aagtccctcgccattgttatctatg

SEQ ID NO: 66660 - DNA, 25 bp, Mus musculus
aagtccctcgcctttgttatctatg

SEQ ID NO: 66661 - DNA, 25 bp, Mus musculus
aagtccctctatcgccacctgagag

SEQ ID NO: 66662 - DNA, 25 bp, Mus musculus
aagtccctctatggccacctgagag

SEQ ID NO: 66663 - DNA, 25 bp, Mus musculus
aagtccctctgaaccatctagtgaa

SEQ ID NO: 66664 - DNA, 25 bp, Mus musculus
aagtccctctgatccatctagtgaa

SEQ ID NO: 66665 - DNA, 25 bp, Mus musculus
aagtccctgacgaccatcatggaac

SEQ ID NO: 66666 - DNA, 25 bp, Mus musculus
aagtccctgacgtccatcatggaac

SEQ ID NO: 66667 - DNA, 25 bp, Mus musculus
aagtccctgctgcatgcttgtgagg

SEQ ID NO: 66668 - DNA, 25 bp, Mus musculus
aagtccctgctggatgcttgtgagg

SEQ ID NO: 66669 - DNA, 25 bp, Mus musculus
aagtccctggagaatgctgtctagc

SEQ ID NO: 66670 - DNA, 25 bp, Mus musculus
aagtccctggagtatgctgtctagc

SEQ ID NO: 66671 - DNA, 25 bp, Mus musculus
aagtccctggttcgcgcaggcagcc

SEQ ID NO: 66672 - DNA, 25 bp, Mus musculus
aagtccctggttggcgcaggcagcc

SEQ ID NO: 66673 - DNA, 25 bp, Mus musculus
aagtccctgtagagcctggaggcaa

SEQ ID NO: 66674 - DNA, 25 bp, Mus musculus
aagtccctgtagtgcctggaggcaa

SEQ ID NO: 66675 - DNA, 25 bp, Mus musculus
aagtccctgtatcgtttcttctgga

SEQ ID NO: 66676 - DNA, 25 bp, Mus musculus
aagtccctgtatggtttcttctgga

SEQ ID NO: 66677 - DNA, 25 bp, Mus musculus
aagtccctgtggctaactgaggttc

SEQ ID NO: 66678 - DNA, 25 bp, Mus musculus
aagtccctgtgggtaactgaggttc

SEQ ID NO: 66679 - DNA, 25 bp, Mus musculus
aagtcccttagtagctgggcaggta

SEQ ID NO: 66680 - DNA, 25 bp, Mus musculus
aagtcccttagttgctgggcaggta

SEQ ID NO: 66681 - DNA, 25 bp, Mus musculus
aagtcccttatgcatagctgtgatc

SEQ ID NO: 66682 - DNA, 25 bp, Mus musculus
aagtcccttatggatagctgtgatc

SEQ ID NO: 66683 - DNA, 25 bp, Mus musculus
aagtcccttcgtcaaatatgtacat

SEQ ID NO: 66684 - DNA, 25 bp, Mus musculus
aagtcccttcgtgaaatatgtacat

SEQ ID NO: 66685 - DNA, 25 bp, Mus musculus
aagtcccttgggagcaatctccagc

SEQ ID NO: 66686 - DNA, 25 bp, Mus musculus
aagtcccttgggtgcaatctccagc

SEQ ID NO: 66687 - DNA, 25 bp, Mus musculus
aagtcccttgtccatgctgcactgg

SEQ ID NO: 66688 - DNA, 25 bp, Mus musculus
aagtcccttgtcgatgctgcactgg

SEQ ID NO: 66689 - DNA, 25 bp, Mus musculus
aagtcccttttaagattctggctct

SEQ ID NO: 66690 - DNA, 25 bp, Mus musculus
aagtcccttttatgattctggctct

SEQ ID NO: 66691 - DNA, 25 bp, Mus musculus
aagtccgaatgcagatcctcatgat

SEQ ID NO: 66692 - DNA, 25 bp, Mus musculus
aagtccgaatgctgatcctcatgat

SEQ ID NO: 66693 - DNA, 25 bp, Mus musculus
aagtccgagcacctgatgcccgaac

SEQ ID NO: 66694 - DNA, 25 bp, Mus musculus
aagtccgagcacgtgatgcccgaac

SEQ ID NO: 66695 - DNA, 25 bp, Mus musculus
aagtccgagggcagtcagatgagta

SEQ ID NO: 66696 - DNA, 25 bp, Mus musculus
aagtccgagggctgtcagatgagta

SEQ ID NO: 66697 - DNA, 25 bp, Mus musculus
aagtccgagtaacttgcagctttcg

SEQ ID NO: 66698 - DNA, 25 bp, Mus musculus
aagtccgagtaagttgcagctttcg

SEQ ID NO: 66699 - DNA, 25 bp, Mus musculus
aagtccgatagcaaaaccttggcaa

SEQ ID NO: 66700 - DNA, 25 bp, Mus musculus
aagtccgatagctaaaccttggcaa

SEQ ID NO: 66701 - DNA, 25 bp, Mus musculus
aagtccgccagaaccggaagaagat

SEQ ID NO: 66702 - DNA, 25 bp, Mus musculus
aagtccgccagatccggaagaagat

SEQ ID NO: 66703 - DNA, 25 bp, Mus musculus
aagtccgcctgcattagctgtgttt

SEQ ID NO: 66704 - DNA, 25 bp, Mus musculus
aagtccgcctgctttagctgtgttt

SEQ ID NO: 66705 - DNA, 25 bp, Mus musculus
aagtccgctcagatacaaaccatgg

SEQ ID NO: 66706 - DNA, 25 bp, Mus musculus
aagtccgctcagttacaaaccatgg

SEQ ID NO: 66707 - DNA, 25 bp, Mus musculus
aagtccggacagaactctactggtt

SEQ ID NO: 66708 - DNA, 25 bp, Mus musculus
aagtccggacagtactctactggtt

SEQ ID NO: 66709 - DNA, 25 bp, Mus musculus
aagtccggagacacaggctggcgtt

SEQ ID NO: 66710 - DNA, 25 bp, Mus musculus
aagtccggagactcaggctggcgtt

SEQ ID NO: 66711 - DNA, 25 bp, Mus musculus
aagtccggcaggatctcaaggcagg

SEQ ID NO: 66712 - DNA, 25 bp, Mus musculus
aagtccggcaggttctcaaggcagg

SEQ ID NO: 66713 - DNA, 25 bp, Mus musculus
aagtccggttacaggcgaatggcac

SEQ ID NO: 66714 - DNA, 25 bp, Mus musculus
aagtccggttactggcgaatggcac

SEQ ID NO: 66715 - DNA, 25 bp, Mus musculus
aagtccgtacgtaatgagtggtgtc

SEQ ID NO: 66716 - DNA, 25 bp, Mus musculus
aagtccgtacgttatgagtggtgtc

SEQ ID NO: 66717 - DNA, 25 bp, Mus musculus
aagtccgtccctctgggatctctgt

SEQ ID NO: 66718 - DNA, 25 bp, Mus musculus
aagtccgtccctgtgggatctctgt

SEQ ID NO: 66719 - DNA, 25 bp, Mus musculus
aagtccgtccgaatctgacatggaa

SEQ ID NO: 66720 - DNA, 25 bp, Mus musculus
aagtccgtccgattctgacatggaa

SEQ ID NO: 66721 - DNA, 25 bp, Mus musculus
aagtccgtgacaacgcgagcgctcg

SEQ ID NO: 66722 - DNA, 25 bp, Mus musculus
aagtccgtgacacggcaccatttgc

SEQ ID NO: 66723 - DNA, 25 bp, Mus musculus
aagtccgtgacagggcaccatttgc

SEQ ID NO: 66724 - DNA, 25 bp, Mus musculus
aagtccgtgacatcgcgagcgctcg

SEQ ID NO: 66725 - DNA, 25 bp, Mus musculus
aagtccgtgaggctgattctgtccc

SEQ ID NO: 66726 - DNA, 25 bp, Mus musculus
aagtccgtgagggtgattctgtccc

SEQ ID NO: 66727 - DNA, 25 bp, Mus musculus
aagtccgtggctccagacttcatcc

SEQ ID NO: 66728 - DNA, 25 bp, Mus musculus
aagtccgtggctgcagacttcatcc

SEQ ID NO: 66729 - DNA, 25 bp, Mus musculus
aagtccgttgagcatcacgccagtg

SEQ ID NO: 66730 - DNA, 25 bp, Mus musculus
aagtccgttgaggatcacgccagtg

SEQ ID NO: 66731 - DNA, 25 bp, Mus musculus
aagtccgttgctccgttgtgcagtc

SEQ ID NO: 66732 - DNA, 25 bp, Mus musculus
aagtccgttgctgcgttgtgcagtc

SEQ ID NO: 66733 - DNA, 25 bp, Mus musculus
aagtccgtttaacctgtgaatggta

SEQ ID NO: 66734 - DNA, 25 bp, Mus musculus
aagtccgtttaagctgtgaatggta

SEQ ID NO: 66735 - DNA, 25 bp, Mus musculus
aagtcctaacctagtacacaccact

SEQ ID NO: 66736 - DNA, 25 bp, Mus musculus
aagtcctaaccttgtacacaccact

SEQ ID NO: 66737 - DNA, 25 bp, Mus musculus
aagtcctacctgagtgtccgtggct

SEQ ID NO: 66738 - DNA, 25 bp, Mus musculus
aagtcctacctgtgtgtccgtggct

SEQ ID NO: 66739 - DNA, 25 bp, Mus musculus
aagtcctactataccgtacgtcaga

SEQ ID NO: 66740 - DNA, 25 bp, Mus musculus
aagtcctactattccgtacgtcaga

SEQ ID NO: 66741 - DNA, 25 bp, Mus musculus
aagtcctagaagagagtagctgtgt

SEQ ID NO: 66742 - DNA, 25 bp, Mus musculus
aagtcctagaagtgagtagctgtgt

SEQ ID NO: 66743 - DNA, 25 bp, Mus musculus
aagtcctagagcctttcaagtccta

SEQ ID NO: 66744 - DNA, 25 bp, Mus musculus
aagtcctagagcgtttcaagtccta

SEQ ID NO: 66745 - DNA, 25 bp, Mus musculus
aagtcctagccaatgtcagcctggg

SEQ ID NO: 66746 - DNA, 25 bp, Mus musculus
aagtcctagccattgtcagcctggg

SEQ ID NO: 66747 - DNA, 25 bp, Mus musculus
aagtcctagtagcaaagcctgtaag

SEQ ID NO: 66748 - DNA, 25 bp, Mus musculus
aagtcctagtaggaaagcctgtaag

SEQ ID NO: 66749 - DNA, 25 bp, Mus musculus
aagtcctatcaccaagctctgtttg

SEQ ID NO: 66750 - DNA, 25 bp, Mus musculus
aagtcctatcacgaagctctgtttg

SEQ ID NO: 66751 - DNA, 25 bp, Mus musculus
aagtcctatccaagacctgggtcaa

SEQ ID NO: 66752 - DNA, 25 bp, Mus musculus
aagtcctatccatgacctgggtcaa

SEQ ID NO: 66753 - DNA, 25 bp, Mus musculus
aagtcctatgatccactgtggccct

SEQ ID NO: 66754 - DNA, 25 bp, Mus musculus
aagtcctatgatgcactgtggccct

SEQ ID NO: 66755 - DNA, 25 bp, Mus musculus
aagtcctcaaagagtcaccgcactg

SEQ ID NO: 66756 - DNA, 25 bp, Mus musculus
aagtcctcaaagtgtcaccgcactg

SEQ ID NO: 66757 - DNA, 25 bp, Mus musculus
aagtcctcacccagtcagaggtctg

SEQ ID NO: 66758 - DNA, 25 bp, Mus musculus
aagtcctcaccctgtcagaggtctg

SEQ ID NO: 66759 - DNA, 25 bp, Mus musculus
aagtcctcacttacgatcatagctg

SEQ ID NO: 66760 - DNA, 25 bp, Mus musculus
aagtcctcacttccaccgtgtatgg

SEQ ID NO: 66761 - DNA, 25 bp, Mus musculus
aagtcctcacttgcaccgtgtatgg

SEQ ID NO: 66762 - DNA, 25 bp, Mus musculus
aagtcctcactttcgatcatagctg

SEQ ID NO: 66763 - DNA, 25 bp, Mus musculus
aagtcctcagcaattcaggcatgtg

SEQ ID NO: 66764 - DNA, 25 bp, Mus musculus
aagtcctcagcatttcaggcatgtg

SEQ ID NO: 66765 - DNA, 25 bp, Mus musculus
aagtcctcagccattgacattcggg

SEQ ID NO: 66766 - DNA, 25 bp, Mus musculus
aagtcctcagcctttgacattcggg

SEQ ID NO: 66767 - DNA, 25 bp, Mus musculus
aagtcctcagctaccagagattggt

SEQ ID NO: 66768 - DNA, 25 bp, Mus musculus
aagtcctcagcttccagagattggt

SEQ ID NO: 66769 - DNA, 25 bp, Mus musculus
aagtcctccaatacacattaaggaa

SEQ ID NO: 66770 - DNA, 25 bp, Mus musculus
aagtcctccaattcacattaaggaa

SEQ ID NO: 66771 - DNA, 25 bp, Mus musculus
aagtcctccattattatgattccta

SEQ ID NO: 66772 - DNA, 25 bp, Mus musculus
aagtcctccatttttatgattccta

SEQ ID NO: 66773 - DNA, 25 bp, Mus musculus
aagtcctcccaacttgagttccact

SEQ ID NO: 66774 - DNA, 25 bp, Mus musculus
aagtcctcccaagttgagttccact

SEQ ID NO: 66775 - DNA, 25 bp, Mus musculus
aagtcctccctccactcaaaaagag

SEQ ID NO: 66776 - DNA, 25 bp, Mus musculus
aagtcctccctcgactcaaaaagag

SEQ ID NO: 66777 - DNA, 25 bp, Mus musculus
aagtcctccctgagagtctttatgg

SEQ ID NO: 66778 - DNA, 25 bp, Mus musculus
aagtcctccctgtgagtctttatgg

SEQ ID NO: 66779 - DNA, 25 bp, Mus musculus
aagtcctccgtgaaatatttcctca

SEQ ID NO: 66780 - DNA, 25 bp, Mus musculus
aagtcctccgtgcatttcagtacag

SEQ ID NO: 66781 - DNA, 25 bp, Mus musculus
aagtcctccgtggatttcagtacag

SEQ ID NO: 66782 - DNA, 25 bp, Mus musculus
aagtcctccgtgtaatatttcctca

SEQ ID NO: 66783 - DNA, 25 bp, Mus musculus
aagtcctcctttaggattattctgt

SEQ ID NO: 66784 - DNA, 25 bp, Mus musculus
aagtcctccttttggattattctgt

SEQ ID NO: 66785 - DNA, 25 bp, Mus musculus
aagtcctcgactatgcatacaaaca

SEQ ID NO: 66786 - DNA, 25 bp, Mus musculus
aagtcctcgactttgcatacaaaca

SEQ ID NO: 66787 - DNA, 25 bp, Mus musculus
aagtcctcgaggcttttcagaatgt

SEQ ID NO: 66788 - DNA, 25 bp, Mus musculus
aagtcctcgagggttttcagaatgt

SEQ ID NO: 66789 - DNA, 25 bp, Mus musculus
aagtcctcggatctctggatcatca

SEQ ID NO: 66790 - DNA, 25 bp, Mus musculus
aagtcctcggatgtctggatcatca

SEQ ID NO: 66791 - DNA, 25 bp, Mus musculus
aagtcctctagacacactggtccag

SEQ ID NO: 66792 - DNA, 25 bp, Mus musculus
aagtcctctagagacactggtccag

SEQ ID NO: 66793 - DNA, 25 bp, Mus musculus
aagtcctctccacgcatggcaagtt

SEQ ID NO: 66794 - DNA, 25 bp, Mus musculus
aagtcctctccaggcatggcaagtt

SEQ ID NO: 66795 - DNA, 25 bp, Mus musculus
aagtcctctcctacctcaaatcgag

SEQ ID NO: 66796 - DNA, 25 bp, Mus musculus
aagtcctctccttcctcaaatcgag

SEQ ID NO: 66797 - DNA, 25 bp, Mus musculus
aagtcctctcgcaactcaaggttca

SEQ ID NO: 66798 - DNA, 25 bp, Mus musculus
aagtcctctcgctactcaaggttca

SEQ ID NO: 66799 - DNA, 25 bp, Mus musculus
aagtcctctcttatgaaagcctact

SEQ ID NO: 66800 - DNA, 25 bp, Mus musculus
aagtcctctcttttgaaagcctact

SEQ ID NO: 66801 - DNA, 25 bp, Mus musculus
aagtcctctgacattgtcctcaaca

SEQ ID NO: 66802 - DNA, 25 bp, Mus musculus
aagtcctctgactttgtcctcaaca

SEQ ID NO: 66803 - DNA, 25 bp, Mus musculus
aagtcctctgagaagctacgaaagt

SEQ ID NO: 66804 - DNA, 25 bp, Mus musculus
aagtcctctgagctgaggctcgaag

SEQ ID NO: 66805 - DNA, 25 bp, Mus musculus
aagtcctctgaggtgaggctcgaag

SEQ ID NO: 66806 - DNA, 25 bp, Mus musculus
aagtcctctgagtagctacgaaagt

SEQ ID NO: 66807 - DNA, 25 bp, Mus musculus
aagtcctctgcaagtttccaaaatt

SEQ ID NO: 66808 - DNA, 25 bp, Mus musculus
aagtcctctgcatgtttccaaaatt

SEQ ID NO: 66809 - DNA, 25 bp, Mus musculus
aagtcctctggcaaatctagtagtg

SEQ ID NO: 66810 - DNA, 25 bp, Mus musculus
aagtcctctggctaatctagtagtg

SEQ ID NO: 66811 - DNA, 25 bp, Mus musculus
aagtcctctgtccagttttacagca

SEQ ID NO: 66812 - DNA, 25 bp, Mus musculus
aagtcctctgtcgagttttacagca

SEQ ID NO: 66813 - DNA, 25 bp, Mus musculus
aagtcctcttgtaaagctctttagc

SEQ ID NO: 66814 - DNA, 25 bp, Mus musculus
aagtcctcttgttaagctctttagc

SEQ ID NO: 66815 - DNA, 25 bp, Mus musculus
aagtcctgaaagacgtttgcacgtt

SEQ ID NO: 66816 - DNA, 25 bp, Mus musculus
aagtcctgaaagtcgtttgcacgtt

SEQ ID NO: 66817 - DNA, 25 bp, Mus musculus
aagtcctgagacctgaagattgtaa

SEQ ID NO: 66818 - DNA, 25 bp, Mus musculus
aagtcctgagacgtgaagattgtaa

SEQ ID NO: 66819 - DNA, 25 bp, Mus musculus
aagtcctgagtcatgtcagtcacta

SEQ ID NO: 66820 - DNA, 25 bp, Mus musculus
aagtcctgagtcttgtcagtcacta

SEQ ID NO: 66821 - DNA, 25 bp, Mus musculus
aagtcctgatcgactcaccatcagc

SEQ ID NO: 66822 - DNA, 25 bp, Mus musculus
aagtcctgatcgtctcaccatcagc

SEQ ID NO: 66823 - DNA, 25 bp, Mus musculus
aagtcctgcgccagcaagtgtgagc

SEQ ID NO: 66824 - DNA, 25 bp, Mus musculus
aagtcctgcgcctgcaagtgtgagc

SEQ ID NO: 66825 - DNA, 25 bp, Mus musculus
aagtcctgctgcagagctctgaaga

SEQ ID NO: 66826 - DNA, 25 bp, Mus musculus
aagtcctgctgctgagctctgaaga

SEQ ID NO: 66827 - DNA, 25 bp, Mus musculus
aagtcctgctttacttttcagtgcc

SEQ ID NO: 66828 - DNA, 25 bp, Mus musculus
aagtcctgcttttcttttcagtgcc

SEQ ID NO: 66829 - DNA, 25 bp, Mus musculus
aagtcctggaagctcgtcacggtca

SEQ ID NO: 66830 - DNA, 25 bp, Mus musculus
aagtcctggaaggtcgtcacggtca

SEQ ID NO: 66831 - DNA, 25 bp, Mus musculus
aagtcctggagtcattcttgagaat

SEQ ID NO: 66832 - DNA, 25 bp, Mus musculus
aagtcctggagtgattcttgagaat

SEQ ID NO: 66833 - DNA, 25 bp, Mus musculus
aagtcctggcatatgatctgaccgt

SEQ ID NO: 66834 - DNA, 25 bp, Mus musculus
aagtcctggcatttgatctgaccgt

SEQ ID NO: 66835 - DNA, 25 bp, Mus musculus
aagtcctggctcatattggctcaaa

SEQ ID NO: 66836 - DNA, 25 bp, Mus musculus
aagtcctggctcttattggctcaaa

SEQ ID NO: 66837 - DNA, 25 bp, Mus musculus
aagtcctggcttctgggctgcacag

SEQ ID NO: 66838 - DNA, 25 bp, Mus musculus
aagtcctggcttgtgggctgcacag

SEQ ID NO: 66839 - DNA, 25 bp, Mus musculus
aagtcctgggaactactgcagtcaa

SEQ ID NO: 66840 - DNA, 25 bp, Mus musculus
aagtcctgggaagtactgcagtcaa

SEQ ID NO: 66841 - DNA, 25 bp, Mus musculus
aagtcctgggcaccgggtcatctgt

SEQ ID NO: 66842 - DNA, 25 bp, Mus musculus
aagtcctgggcagcgggtcatctgt

SEQ ID NO: 66843 - DNA, 25 bp, Mus musculus
aagtcctgggttagtagtgcccact

SEQ ID NO: 66844 - DNA, 25 bp, Mus musculus
aagtcctgggtttgtagtgcccact

SEQ ID NO: 66845 - DNA, 25 bp, Mus musculus
aagtcctggtcccttggagagaaag

SEQ ID NO: 66846 - DNA, 25 bp, Mus musculus
aagtcctggtccgttggagagaaag

SEQ ID NO: 66847 - DNA, 25 bp, Mus musculus
aagtcctggtgacgtttctgctccc

SEQ ID NO: 66848 - DNA, 25 bp, Mus musculus
aagtcctggtgactgtttctcatct

SEQ ID NO: 66849 - DNA, 25 bp, Mus musculus
aagtcctggtgaggtttctgctccc

SEQ ID NO: 66850 - DNA, 25 bp, Mus musculus
aagtcctggtgagtgtttctcatct

SEQ ID NO: 66851 - DNA, 25 bp, Mus musculus
aagtcctggttgaagctgaccactt

SEQ ID NO: 66852 - DNA, 25 bp, Mus musculus
aagtcctggttgtagctgaccactt

SEQ ID NO: 66853 - DNA, 25 bp, Mus musculus
aagtcctgtactaaaactgcccaga

SEQ ID NO: 66854 - DNA, 25 bp, Mus musculus
aagtcctgtacttaaactgcccaga

SEQ ID NO: 66855 - DNA, 25 bp, Mus musculus
aagtcctgtcacaaatgagctgagc

SEQ ID NO: 66856 - DNA, 25 bp, Mus musculus
aagtcctgtcactaatgagctgagc

SEQ ID NO: 66857 - DNA, 25 bp, Mus musculus
aagtcctgtgtcatgacccttaagc

SEQ ID NO: 66858 - DNA, 25 bp, Mus musculus
aagtcctgtgtcttgacccttaagc

SEQ ID NO: 66859 - DNA, 25 bp, Mus musculus
aagtccttacgcctgatgagccaga

SEQ ID NO: 66860 - DNA, 25 bp, Mus musculus
aagtccttacgcgtgatgagccaga

SEQ ID NO: 66861 - DNA, 25 bp, Mus musculus
aagtccttatgcacagtagtcaata

SEQ ID NO: 66862 - DNA, 25 bp, Mus musculus
aagtccttatgctcagtagtcaata

SEQ ID NO: 66863 - DNA, 25 bp, Mus musculus
aagtccttatggagttctggcccag

SEQ ID NO: 66864 - DNA, 25 bp, Mus musculus
aagtccttatggtgttctggcccag

SEQ ID NO: 66865 - DNA, 25 bp, Mus musculus
aagtccttcaatagagcatgctcat

SEQ ID NO: 66866 - DNA, 25 bp, Mus musculus
aagtccttcaattgagcatgctcat

SEQ ID NO: 66867 - DNA, 25 bp, Mus musculus
aagtccttcagaaacagcaggtgca

SEQ ID NO: 66868 - DNA, 25 bp, Mus musculus
aagtccttcagatacagcaggtgca

SEQ ID NO: 66869 - DNA, 25 bp, Mus musculus
aagtccttccatattatttgatttg

SEQ ID NO: 66870 - DNA, 25 bp, Mus musculus
aagtccttccattttatttgatttg

SEQ ID NO: 66871 - DNA, 25 bp, Mus musculus
aagtccttcccgagtacaaagcatt

SEQ ID NO: 66872 - DNA, 25 bp, Mus musculus
aagtccttcccgtgtacaaagcatt

SEQ ID NO: 66873 - DNA, 25 bp, Mus musculus
aagtccttccttacgcaagcacgca

SEQ ID NO: 66874 - DNA, 25 bp, Mus musculus
aagtccttccttctaaaaagtgcat

SEQ ID NO: 66875 - DNA, 25 bp, Mus musculus
aagtccttccttgtaaaaagtgcat

SEQ ID NO: 66876 - DNA, 25 bp, Mus musculus
aagtccttcctttcgcaagcacgca

SEQ ID NO: 66877 - DNA, 25 bp, Mus musculus
aagtccttcttcacggatgacgaca

SEQ ID NO: 66878 - DNA, 25 bp, Mus musculus
aagtccttcttctcggatgacgaca

SEQ ID NO: 66879 - DNA, 25 bp, Mus musculus
aagtccttctttccgtactaatctg

SEQ ID NO: 66880 - DNA, 25 bp, Mus musculus
aagtccttctttgcgtactaatctg

SEQ ID NO: 66881 - DNA, 25 bp, Mus musculus
aagtccttgagcacccttggatcaa

SEQ ID NO: 66882 - DNA, 25 bp, Mus musculus
aagtccttgagccaagaggtctgga

SEQ ID NO: 66883 - DNA, 25 bp, Mus musculus
aagtccttgagccagaagctgcaga

SEQ ID NO: 66884 - DNA, 25 bp, Mus musculus
aagtccttgagcgaagaggtctgga

SEQ ID NO: 66885 - DNA, 25 bp, Mus musculus
aagtccttgagcgagaagctgcaga

SEQ ID NO: 66886 - DNA, 25 bp, Mus musculus
aagtccttgagctcccttggatcaa

SEQ ID NO: 66887 - DNA, 25 bp, Mus musculus
aagtccttgagtatttggccaagct

SEQ ID NO: 66888 - DNA, 25 bp, Mus musculus
aagtccttgagtttttggccaagct

SEQ ID NO: 66889 - DNA, 25 bp, Mus musculus
aagtccttgctgacagtacttgtta

SEQ ID NO: 66890 - DNA, 25 bp, Mus musculus
aagtccttgctgactgtttacaaag

SEQ ID NO: 66891 - DNA, 25 bp, Mus musculus
aagtccttgctgtcagtacttgtta

SEQ ID NO: 66892 - DNA, 25 bp, Mus musculus
aagtccttgctgtctgtttacaaag

SEQ ID NO: 66893 - DNA, 25 bp, Mus musculus
aagtccttggtgcagatccatgaaa

SEQ ID NO: 66894 - DNA, 25 bp, Mus musculus
aagtccttggtggagatccatgaaa

SEQ ID NO: 66895 - DNA, 25 bp, Mus musculus
aagtcctttatacttgtcagtgtat

SEQ ID NO: 66896 - DNA, 25 bp, Mus musculus
aagtcctttatagttgtcagtgtat

SEQ ID NO: 66897 - DNA, 25 bp, Mus musculus
aagtcctttcgcagactcttgagtg

SEQ ID NO: 66898 - DNA, 25 bp, Mus musculus
aagtcctttcgctgactcttgagtg

SEQ ID NO: 66899 - DNA, 25 bp, Mus musculus
aagtcctttctaatctgtgccagta

SEQ ID NO: 66900 - DNA, 25 bp, Mus musculus
aagtcctttctattctgtgccagta

SEQ ID NO: 66901 - DNA, 25 bp, Mus musculus
aagtcctttcttagaactgtcgcag

SEQ ID NO: 66902 - DNA, 25 bp, Mus musculus
aagtcctttctttgaactgtcgcag

SEQ ID NO: 66903 - DNA, 25 bp, Mus musculus
aagtcctttgacagtgtatctaggc

SEQ ID NO: 66904 - DNA, 25 bp, Mus musculus
aagtcctttgactgtgtatctaggc

SEQ ID NO: 66905 - DNA, 25 bp, Mus musculus
aagtcctttgttagattctctgggt

SEQ ID NO: 66906 - DNA, 25 bp, Mus musculus
aagtcctttgtttgattctctgggt

SEQ ID NO: 66907 - DNA, 25 bp, Mus musculus
aagtccttttcacagcatgatttgt

SEQ ID NO: 66908 - DNA, 25 bp, Mus musculus
aagtccttttcagagcatgatttgt

SEQ ID NO: 66909 - DNA, 25 bp, Mus musculus
aagtcctttttccatccctctactg

SEQ ID NO: 66910 - DNA, 25 bp, Mus musculus
aagtcctttttcgatccctctactg

SEQ ID NO: 66911 - DNA, 25 bp, Mus musculus
aagtcgaagcttaccctgccttcta

SEQ ID NO: 66912 - DNA, 25 bp, Mus musculus
aagtcgaagctttccctgccttcta

SEQ ID NO: 66913 - DNA, 25 bp, Mus musculus
aagtcgaattcaaaccgggagatca

SEQ ID NO: 66914 - DNA, 25 bp, Mus musculus
aagtcgaattcataccgggagatca

SEQ ID NO: 66915 - DNA, 25 bp, Mus musculus
aagtcgacaaccacagtacctctgt

SEQ ID NO: 66916 - DNA, 25 bp, Mus musculus
aagtcgacaacctcagtacctctgt

SEQ ID NO: 66917 - DNA, 25 bp, Mus musculus
aagtcgaccaacatgaagtgcctga

SEQ ID NO: 66918 - DNA, 25 bp, Mus musculus
aagtcgaccaacttgaagtgcctga

SEQ ID NO: 66919 - DNA, 25 bp, Mus musculus
aagtcgacggttccttaaaccatgc

SEQ ID NO: 66920 - DNA, 25 bp, Mus musculus
aagtcgacggttgcttaaaccatgc

SEQ ID NO: 66921 - DNA, 25 bp, Mus musculus
aagtcgacgtggactgctgcgagaa

SEQ ID NO: 66922 - DNA, 25 bp, Mus musculus
aagtcgacgtggtctgctgcgagaa

SEQ ID NO: 66923 - DNA, 25 bp, Mus musculus
aagtcgactaagcttggtgtttcta

SEQ ID NO: 66924 - DNA, 25 bp, Mus musculus
aagtcgactaaggttggtgtttcta

SEQ ID NO: 66925 - DNA, 25 bp, Mus musculus
aagtcgactgcacagagcgcatcag

SEQ ID NO: 66926 - DNA, 25 bp, Mus musculus
aagtcgactgcagagagcgcatcag

SEQ ID NO: 66927 - DNA, 25 bp, Mus musculus
aagtcgactttcacggatactcagt

SEQ ID NO: 66928 - DNA, 25 bp, Mus musculus
aagtcgactttctcggatactcagt

SEQ ID NO: 66929 - DNA, 25 bp, Mus musculus
aagtcgagagccatcacctcagatt

SEQ ID NO: 66930 - DNA, 25 bp, Mus musculus
aagtcgagagccttcacctcagatt

SEQ ID NO: 66931 - DNA, 25 bp, Mus musculus
aagtcgagagcgcaaacgaagtaga

SEQ ID NO: 66932 - DNA, 25 bp, Mus musculus
aagtcgagagcggaaacgaagtaga

SEQ ID NO: 66933 - DNA, 25 bp, Mus musculus
aagtcgagttagatggtttcacaac

SEQ ID NO: 66934 - DNA, 25 bp, Mus musculus
aagtcgagttagttggtttcacaac

SEQ ID NO: 66935 - DNA, 25 bp, Mus musculus
aagtcgatatgtacgggctgcccac

SEQ ID NO: 66936 - DNA, 25 bp, Mus musculus
aagtcgatatgttcgggctgcccac

SEQ ID NO: 66937 - DNA, 25 bp, Mus musculus
aagtcgatgactcaataatttggat

SEQ ID NO: 66938 - DNA, 25 bp, Mus musculus
aagtcgatgactgaataatttggat

SEQ ID NO: 66939 - DNA, 25 bp, Mus musculus
aagtcgatgggcagtttccatagga

SEQ ID NO: 66940 - DNA, 25 bp, Mus musculus
aagtcgatgggctgtttccatagga

SEQ ID NO: 66941 - DNA, 25 bp, Mus musculus
aagtcgatgtcgctggtgtacacaa

SEQ ID NO: 66942 - DNA, 25 bp, Mus musculus
aagtcgatgtcggtggtgtacacaa

SEQ ID NO: 66943 - DNA, 25 bp, Mus musculus
aagtcgatgtgaacaagcttgtgac

SEQ ID NO: 66944 - DNA, 25 bp, Mus musculus
aagtcgatgtgatcaagcttgtgac

SEQ ID NO: 66945 - DNA, 25 bp, Mus musculus
aagtcgatttgtaccaaagccctgg

SEQ ID NO: 66946 - DNA, 25 bp, Mus musculus
aagtcgatttgttccaaagccctgg

SEQ ID NO: 66947 - DNA, 25 bp, Mus musculus
aagtcgcaatgtctcttcagagcag

SEQ ID NO: 66948 - DNA, 25 bp, Mus musculus
aagtcgcaatgtgtcttcagagcag

SEQ ID NO: 66949 - DNA, 25 bp, Mus musculus
aagtcgcaccaccttgcagaaagtg

SEQ ID NO: 66950 - DNA, 25 bp, Mus musculus
aagtcgcaccacgttgcagaaagtg

SEQ ID NO: 66951 - DNA, 25 bp, Mus musculus
aagtcgcagaccaacagcaacggct

SEQ ID NO: 66952 - DNA, 25 bp, Mus musculus
aagtcgcagacctacagcaacggct

SEQ ID NO: 66953 - DNA, 25 bp, Mus musculus
aagtcgcagtgccactgtgagccca

SEQ ID NO: 66954 - DNA, 25 bp, Mus musculus
aagtcgcagtgcgactgtgagccca

SEQ ID NO: 66955 - DNA, 25 bp, Mus musculus
aagtcgcatctacctcaagagtgtc

SEQ ID NO: 66956 - DNA, 25 bp, Mus musculus
aagtcgcatctagctcaagagtgtc

SEQ ID NO: 66957 - DNA, 25 bp, Mus musculus
aagtcgcatttcatcatcggtgtaa

SEQ ID NO: 66958 - DNA, 25 bp, Mus musculus
aagtcgcatttcttcatcggtgtaa

SEQ ID NO: 66959 - DNA, 25 bp, Mus musculus
aagtcgcctaaaaacgcgcaaggag

SEQ ID NO: 66960 - DNA, 25 bp, Mus musculus
aagtcgcctaaatacgcgcaaggag

SEQ ID NO: 66961 - DNA, 25 bp, Mus musculus
aagtcgcctagcaactttgggttct

SEQ ID NO: 66962 - DNA, 25 bp, Mus musculus
aagtcgcctagctactttgggttct

SEQ ID NO: 66963 - DNA, 25 bp, Mus musculus
aagtcgcgtctccaccaggagctaa

SEQ ID NO: 66964 - DNA, 25 bp, Mus musculus
aagtcgcgtctcgaccaggagctaa

SEQ ID NO: 66965 - DNA, 25 bp, Mus musculus
aagtcgctctccagggaggcaatga

SEQ ID NO: 66966 - DNA, 25 bp, Mus musculus
aagtcgctctcctgggaggcaatga

SEQ ID NO: 66967 - DNA, 25 bp, Mus musculus
aagtcgctctcgctatcctgttgga

SEQ ID NO: 66968 - DNA, 25 bp, Mus musculus
aagtcgctctcggtatcctgttgga

SEQ ID NO: 66969 - DNA, 25 bp, Mus musculus
aagtcggacgccatggcatatgccc

SEQ ID NO: 66970 - DNA, 25 bp, Mus musculus
aagtcggacgccttggcatatgccc

SEQ ID NO: 66971 - DNA, 25 bp, Mus musculus
aagtcggagaaacccagcacggcgt

SEQ ID NO: 66972 - DNA, 25 bp, Mus musculus
aagtcggagaaagccagcacggcgt

SEQ ID NO: 66973 - DNA, 25 bp, Mus musculus
aagtcggagctgaccaatttggcgg

SEQ ID NO: 66974 - DNA, 25 bp, Mus musculus
aagtcggagctgtccaatttggcgg

SEQ ID NO: 66975 - DNA, 25 bp, Mus musculus
aagtcggaggcgctgaagccttccc

SEQ ID NO: 66976 - DNA, 25 bp, Mus musculus
aagtcggaggcggtgaagccttccc

SEQ ID NO: 66977 - DNA, 25 bp, Mus musculus
aagtcggaggctcagatcaagccaa

SEQ ID NO: 66978 - DNA, 25 bp, Mus musculus
aagtcggaggctgagatcaagccaa

SEQ ID NO: 66979 - DNA, 25 bp, Mus musculus
aagtcggaggtcacgggccagctta

SEQ ID NO: 66980 - DNA, 25 bp, Mus musculus
aagtcggaggtctcgggccagctta

SEQ ID NO: 66981 - DNA, 25 bp, Mus musculus
aagtcggatatcctggagcgcaaca

SEQ ID NO: 66982 - DNA, 25 bp, Mus musculus
aagtcggatatcgtggagcgcaaca

SEQ ID NO: 66983 - DNA, 25 bp, Mus musculus
aagtcggatccaatttgtgtcctat

SEQ ID NO: 66984 - DNA, 25 bp, Mus musculus
aagtcggatccattttgtgtcctat

SEQ ID NO: 66985 - DNA, 25 bp, Mus musculus
aagtcggatccccagaaatcatgct

SEQ ID NO: 66986 - DNA, 25 bp, Mus musculus
aagtcggatcccgagaaatcatgct

SEQ ID NO: 66987 - DNA, 25 bp, Mus musculus
aagtcggatctcaattaagtctgga

SEQ ID NO: 66988 - DNA, 25 bp, Mus musculus
aagtcggatctctattaagtctgga

SEQ ID NO: 66989 - DNA, 25 bp, Mus musculus
aagtcggccatcagtggcaagagag

SEQ ID NO: 66990 - DNA, 25 bp, Mus musculus
aagtcggccatctgtggcaagagag

SEQ ID NO: 66991 - DNA, 25 bp, Mus musculus
aagtcggcctgacaagaccacttca

SEQ ID NO: 66992 - DNA, 25 bp, Mus musculus
aagtcggcctgagaagaccacttca

SEQ ID NO: 66993 - DNA, 25 bp, Mus musculus
aagtcgggaagtactctgccagcac

SEQ ID NO: 66994 - DNA, 25 bp, Mus musculus
aagtcgggaagttctctgccagcac

SEQ ID NO: 66995 - DNA, 25 bp, Mus musculus
aagtcgggaatgctccctctatcac

SEQ ID NO: 66996 - DNA, 25 bp, Mus musculus
aagtcgggaatggtccctctatcac

SEQ ID NO: 66997 - DNA, 25 bp, Mus musculus
aagtcgggcatgctcatgcacctgt

SEQ ID NO: 66998 - DNA, 25 bp, Mus musculus
aagtcgggcatggtcatgcacctgt

SEQ ID NO: 66999 - DNA, 25 bp, Mus musculus
aagtcgggcccacagctgaaacaac

SEQ ID NO: 67000 - DNA, 25 bp, Mus musculus
aagtcgggcccagagctgaaacaac

SEQ ID NO: 67001 - DNA, 25 bp, Mus musculus
aagtcggtaactcctttttcaggag

SEQ ID NO: 67002 - DNA, 25 bp, Mus musculus
aagtcggtaactgctttttcaggag

SEQ ID NO: 67003 - DNA, 25 bp, Mus musculus
aagtcggtcaggaagtcggcaagat

SEQ ID NO: 67004 - DNA, 25 bp, Mus musculus
aagtcggtcaggtagtcggcaagat

SEQ ID NO: 67005 - DNA, 25 bp, Mus musculus
aagtcggtctaaactggagagccaa

SEQ ID NO: 67006 - DNA, 25 bp, Mus musculus
aagtcggtctaatctggagagccaa

SEQ ID NO: 67007 - DNA, 25 bp, Mus musculus
aagtcggtggctattccccagcttc

SEQ ID NO: 67008 - DNA, 25 bp, Mus musculus
aagtcggtggcttttccccagcttc

SEQ ID NO: 67009 - DNA, 25 bp, Mus musculus
aagtcgtaatctagcatcctaatgc

SEQ ID NO: 67010 - DNA, 25 bp, Mus musculus
aagtcgtaatcttgcatcctaatgc

SEQ ID NO: 67011 - DNA, 25 bp, Mus musculus
aagtcgtcacttattccagctattg

SEQ ID NO: 67012 - DNA, 25 bp, Mus musculus
aagtcgtcactttttccagctattg

SEQ ID NO: 67013 - DNA, 25 bp, Mus musculus
aagtcgtcccttatctgtcatcgta

SEQ ID NO: 67014 - DNA, 25 bp, Mus musculus
aagtcgtcccttttctgtcatcgta

SEQ ID NO: 67015 - DNA, 25 bp, Mus musculus
aagtcgtcggccagtggtgtctcca

SEQ ID NO: 67016 - DNA, 25 bp, Mus musculus
aagtcgtcggcctgtggtgtctcca

SEQ ID NO: 67017 - DNA, 25 bp, Mus musculus
aagtcgtctccaaatgctgtatgaa

SEQ ID NO: 67018 - DNA, 25 bp, Mus musculus
aagtcgtctccatatgctgtatgaa

SEQ ID NO: 67019 - DNA, 25 bp, Mus musculus
aagtcgtcttgtcccctgtttggtc

SEQ ID NO: 67020 - DNA, 25 bp, Mus musculus
aagtcgtcttgtgccctgtttggtc

SEQ ID NO: 67021 - DNA, 25 bp, Mus musculus
aagtcgtctttcatattgtatggtc

SEQ ID NO: 67022 - DNA, 25 bp, Mus musculus
aagtcgtctttcttattgtatggtc

SEQ ID NO: 67023 - DNA, 25 bp, Mus musculus
aagtcgtgaacgcagccctgcacct

SEQ ID NO: 67024 - DNA, 25 bp, Mus musculus
aagtcgtgaacggagccctgcacct

SEQ ID NO: 67025 - DNA, 25 bp, Mus musculus
aagtcgtgatccacagcaaggcgtt

SEQ ID NO: 67026 - DNA, 25 bp, Mus musculus
aagtcgtgatcctcagcaaggcgtt

SEQ ID NO: 67027 - DNA, 25 bp, Mus musculus
aagtcgtggatgaacacgatggcaa

SEQ ID NO: 67028 - DNA, 25 bp, Mus musculus
aagtcgtggatgtacacgatggcaa

SEQ ID NO: 67029 - DNA, 25 bp, Mus musculus
aagtcgttataaatcatctggatga

SEQ ID NO: 67030 - DNA, 25 bp, Mus musculus
aagtcgttataattcatctggatga

SEQ ID NO: 67031 - DNA, 25 bp, Mus musculus
aagtctaaaacaaccgtacagcacg

SEQ ID NO: 67032 - DNA, 25 bp, Mus musculus
aagtctaaaacatccgtacagcacg

SEQ ID NO: 67033 - DNA, 25 bp, Mus musculus
aagtctaaagtacctgtattatcaa

SEQ ID NO: 67034 - DNA, 25 bp, Mus musculus
aagtctaaagtagctgtattatcaa

SEQ ID NO: 67035 - DNA, 25 bp, Mus musculus
aagtctaaatagctggcccatttgt

SEQ ID NO: 67036 - DNA, 25 bp, Mus musculus
aagtctaaataggtggcccatttgt

SEQ ID NO: 67037 - DNA, 25 bp, Mus musculus
aagtctaacacgagtttctctgttt

SEQ ID NO: 67038 - DNA, 25 bp, Mus musculus
aagtctaacacgtgtttctctgttt

SEQ ID NO: 67039 - DNA, 25 bp, Mus musculus
aagtctaactgcatggttgcctcca

SEQ ID NO: 67040 - DNA, 25 bp, Mus musculus
aagtctaactgcttggttgcctcca

SEQ ID NO: 67041 - DNA, 25 bp, Mus musculus
aagtctaagcaacatgttttgtata

SEQ ID NO: 67042 - DNA, 25 bp, Mus musculus
aagtctaagcaagatgttttgtata

SEQ ID NO: 67043 - DNA, 25 bp, Mus musculus
aagtctaagtttcttcagctcagga

SEQ ID NO: 67044 - DNA, 25 bp, Mus musculus
aagtctaagtttgttcagctcagga

SEQ ID NO: 67045 - DNA, 25 bp, Mus musculus
aagtctaatgtcactgcttcatatc

SEQ ID NO: 67046 - DNA, 25 bp, Mus musculus
aagtctaatgtctctgcttcatatc

SEQ ID NO: 67047 - DNA, 25 bp, Mus musculus
aagtctacaactactcctgtgaacc

SEQ ID NO: 67048 - DNA, 25 bp, Mus musculus
aagtctacaacttctcctgtgaacc

SEQ ID NO: 67049 - DNA, 25 bp, Mus musculus
aagtctacaagtcattagctgtgag

SEQ ID NO: 67050 - DNA, 25 bp, Mus musculus
aagtctacaagtgattagctgtgag

SEQ ID NO: 67051 - DNA, 25 bp, Mus musculus
aagtctacacaaaggcttgccggtc

SEQ ID NO: 67052 - DNA, 25 bp, Mus musculus
aagtctacacaactcatcaggcatc

SEQ ID NO: 67053 - DNA, 25 bp, Mus musculus
aagtctacacaagtcatcaggcatc

SEQ ID NO: 67054 - DNA, 25 bp, Mus musculus
aagtctacacaatggcttgccggtc

SEQ ID NO: 67055 - DNA, 25 bp, Mus musculus
aagtctacacgtatctttgaaagta

SEQ ID NO: 67056 - DNA, 25 bp, Mus musculus
aagtctacacgtttctttgaaagta

SEQ ID NO: 67057 - DNA, 25 bp, Mus musculus
aagtctacagctcttttcacgtgaa

SEQ ID NO: 67058 - DNA, 25 bp, Mus musculus
aagtctacagctgttttcacgtgaa

SEQ ID NO: 67059 - DNA, 25 bp, Mus musculus
aagtctacaggcatttattgtgcaa

SEQ ID NO: 67060 - DNA, 25 bp, Mus musculus
aagtctacaggcttttattgtgcaa

SEQ ID NO: 67061 - DNA, 25 bp, Mus musculus
aagtctaccctgacctctacagaga

SEQ ID NO: 67062 - DNA, 25 bp, Mus musculus
aagtctaccctgtcctctacagaga

SEQ ID NO: 67063 - DNA, 25 bp, Mus musculus
aagtctacccttcaggacaattcaa

SEQ ID NO: 67064 - DNA, 25 bp, Mus musculus
aagtctacccttgaggacaattcaa

SEQ ID NO: 67065 - DNA, 25 bp, Mus musculus
aagtctacctggactctagagctac

SEQ ID NO: 67066 - DNA, 25 bp, Mus musculus
aagtctacctggtctctagagctac

SEQ ID NO: 67067 - DNA, 25 bp, Mus musculus
aagtctacgttgctgagagccccag

SEQ ID NO: 67068 - DNA, 25 bp, Mus musculus
aagtctacgttggtgagagccccag

SEQ ID NO: 67069 - DNA, 25 bp, Mus musculus
aagtctagactgactccacatctgt

SEQ ID NO: 67070 - DNA, 25 bp, Mus musculus
aagtctagactgtctccacatctgt

SEQ ID NO: 67071 - DNA, 25 bp, Mus musculus
aagtctagccagcttcatggcaccc

SEQ ID NO: 67072 - DNA, 25 bp, Mus musculus
aagtctagccaggttcatggcaccc

SEQ ID NO: 67073 - DNA, 25 bp, Mus musculus
aagtctagcccactcgatttgatgc

SEQ ID NO: 67074 - DNA, 25 bp, Mus musculus
aagtctagcccagtcgatttgatgc

SEQ ID NO: 67075 - DNA, 25 bp, Mus musculus
aagtctagcctgcataacccagtga

SEQ ID NO: 67076 - DNA, 25 bp, Mus musculus
aagtctagcctggataacccagtga

SEQ ID NO: 67077 - DNA, 25 bp, Mus musculus
aagtctagccttctatggaaagtca

SEQ ID NO: 67078 - DNA, 25 bp, Mus musculus
aagtctagccttgtatggaaagtca

SEQ ID NO: 67079 - DNA, 25 bp, Mus musculus
aagtctagggataggcacctatgct

SEQ ID NO: 67080 - DNA, 25 bp, Mus musculus
aagtctagggattggcacctatgct

SEQ ID NO: 67081 - DNA, 25 bp, Mus musculus
aagtctaggttaactttactgaggt

SEQ ID NO: 67082 - DNA, 25 bp, Mus musculus
aagtctaggttatctttactgaggt

SEQ ID NO: 67083 - DNA, 25 bp, Mus musculus
aagtctagtattaatcgcatcaatt

SEQ ID NO: 67084 - DNA, 25 bp, Mus musculus
aagtctagtatttatcgcatcaatt

SEQ ID NO: 67085 - DNA, 25 bp, Mus musculus
aagtctagttctctacatgcagtta

SEQ ID NO: 67086 - DNA, 25 bp, Mus musculus
aagtctagttctgtacatgcagtta

SEQ ID NO: 67087 - DNA, 25 bp, Mus musculus
aagtctagtttaatcctggctaaag

SEQ ID NO: 67088 - DNA, 25 bp, Mus musculus
aagtctagtttattcctggctaaag

SEQ ID NO: 67089 - DNA, 25 bp, Mus musculus
aagtctataaacacattgtctcagt

SEQ ID NO: 67090 - DNA, 25 bp, Mus musculus
aagtctataaaccagtgccatgtcc

SEQ ID NO: 67091 - DNA, 25 bp, Mus musculus
aagtctataaacgagtgccatgtcc

SEQ ID NO: 67092 - DNA, 25 bp, Mus musculus
aagtctataaactcattgtctcagt

SEQ ID NO: 67093 - DNA, 25 bp, Mus musculus
aagtctatatatcgagccatcccag

SEQ ID NO: 67094 - DNA, 25 bp, Mus musculus
aagtctatatatggagccatcccag

SEQ ID NO: 67095 - DNA, 25 bp, Mus musculus
aagtctatcagaaaggccatcagtt

SEQ ID NO: 67096 - DNA, 25 bp, Mus musculus
aagtctatcagataggccatcagtt

SEQ ID NO: 67097 - DNA, 25 bp, Mus musculus
aagtctatcagtacagcgcatccac

SEQ ID NO: 67098 - DNA, 25 bp, Mus musculus
aagtctatcagttcagcgcatccac

SEQ ID NO: 67099 - DNA, 25 bp, Mus musculus
aagtctatcataacttgtcctataa

SEQ ID NO: 67100 - DNA, 25 bp, Mus musculus
aagtctatcatatcttgtcctataa

SEQ ID NO: 67101 - DNA, 25 bp, Mus musculus
aagtctatcgagactagcctaatat

SEQ ID NO: 67102 - DNA, 25 bp, Mus musculus
aagtctatcgagtctagcctaatat

SEQ ID NO: 67103 - DNA, 25 bp, Mus musculus
aagtctatctgaaccagggcactca

SEQ ID NO: 67104 - DNA, 25 bp, Mus musculus
aagtctatctgatccagggcactca

SEQ ID NO: 67105 - DNA, 25 bp, Mus musculus
aagtctatcttacttccactttctt

SEQ ID NO: 67106 - DNA, 25 bp, Mus musculus
aagtctatcttagttccactttctt

SEQ ID NO: 67107 - DNA, 25 bp, Mus musculus
aagtctatcttcaccagccacagct

SEQ ID NO: 67108 - DNA, 25 bp, Mus musculus
aagtctatcttctccagccacagct

SEQ ID NO: 67109 - DNA, 25 bp, Mus musculus
aagtctatcttgattgtcattccag

SEQ ID NO: 67110 - DNA, 25 bp, Mus musculus
aagtctatcttgtttgtcattccag

SEQ ID NO: 67111 - DNA, 25 bp, Mus musculus
aagtctatgactcagtatccctaca

SEQ ID NO: 67112 - DNA, 25 bp, Mus musculus
aagtctatgactgagtatccctaca

SEQ ID NO: 67113 - DNA, 25 bp, Mus musculus
aagtctatgctcaacaagggtcgga

SEQ ID NO: 67114 - DNA, 25 bp, Mus musculus
aagtctatgctctacaagggtcgga

SEQ ID NO: 67115 - DNA, 25 bp, Mus musculus
aagtctatgtgcactgtttttgtga

SEQ ID NO: 67116 - DNA, 25 bp, Mus musculus
aagtctatgtgctctgtttttgtga

SEQ ID NO: 67117 - DNA, 25 bp, Mus musculus
aagtctattatcagggacatgccct

SEQ ID NO: 67118 - DNA, 25 bp, Mus musculus
aagtctattatctgggacatgccct

SEQ ID NO: 67119 - DNA, 25 bp, Mus musculus
aagtctattggtcggtgcatgctac

SEQ ID NO: 67120 - DNA, 25 bp, Mus musculus
aagtctattggtgggtgcatgctac

SEQ ID NO: 67121 - DNA, 25 bp, Mus musculus
aagtctattttactgctgctgctcc

SEQ ID NO: 67122 - DNA, 25 bp, Mus musculus
aagtctattttagtgctgctgctcc

SEQ ID NO: 67123 - DNA, 25 bp, Mus musculus
aagtctcaaataaaccgcctgtgcc

SEQ ID NO: 67124 - DNA, 25 bp, Mus musculus
aagtctcaaatataccgcctgtgcc

SEQ ID NO: 67125 - DNA, 25 bp, Mus musculus
aagtctcaacagctgtgtggacccc

SEQ ID NO: 67126 - DNA, 25 bp, Mus musculus
aagtctcaacaggtgtgtggacccc

SEQ ID NO: 67127 - DNA, 25 bp, Mus musculus
aagtctcaacccacatcggaaatgg

SEQ ID NO: 67128 - DNA, 25 bp, Mus musculus
aagtctcaaccctcatcggaaatgg

SEQ ID NO: 67129 - DNA, 25 bp, Mus musculus
aagtctcaacttccttgtgtgctgt

SEQ ID NO: 67130 - DNA, 25 bp, Mus musculus
aagtctcaacttgcttgtgtgctgt

SEQ ID NO: 67131 - DNA, 25 bp, Mus musculus
aagtctcaagagaatggcctttctg

SEQ ID NO: 67132 - DNA, 25 bp, Mus musculus
aagtctcaagagtatggcctttctg

SEQ ID NO: 67133 - DNA, 25 bp, Mus musculus
aagtctcacaagcatcttgaaatga

SEQ ID NO: 67134 - DNA, 25 bp, Mus musculus
aagtctcacaaggatcttgaaatga

SEQ ID NO: 67135 - DNA, 25 bp, Mus musculus
aagtctcaccaaaccccggactgag

SEQ ID NO: 67136 - DNA, 25 bp, Mus musculus
aagtctcaccaatccccggactgag

SEQ ID NO: 67137 - DNA, 25 bp, Mus musculus
aagtctcactatctcctgtatgggc

SEQ ID NO: 67138 - DNA, 25 bp, Mus musculus
aagtctcactatgtcctgtatgggc

SEQ ID NO: 67139 - DNA, 25 bp, Mus musculus
aagtctcactgcatgtccattgtaa

SEQ ID NO: 67140 - DNA, 25 bp, Mus musculus
aagtctcactgcttgtccattgtaa

SEQ ID NO: 67141 - DNA, 25 bp, Mus musculus
aagtctcactgtacactgttaactg

SEQ ID NO: 67142 - DNA, 25 bp, Mus musculus
aagtctcactgttcactgttaactg

SEQ ID NO: 67143 - DNA, 25 bp, Mus musculus
aagtctcacttgatttctacagcgt

SEQ ID NO: 67144 - DNA, 25 bp, Mus musculus
aagtctcacttgttttctacagcgt

SEQ ID NO: 67145 - DNA, 25 bp, Mus musculus
aagtctcactttactcatctgcaaa

SEQ ID NO: 67146 - DNA, 25 bp, Mus musculus
aagtctcacttttctcatctgcaaa

SEQ ID NO: 67147 - DNA, 25 bp, Mus musculus
aagtctcagacacaggaataggatc

SEQ ID NO: 67148 - DNA, 25 bp, Mus musculus
aagtctcagacagaggaataggatc

SEQ ID NO: 67149 - DNA, 25 bp, Mus musculus
aagtctcagcaaccttctaggttct

SEQ ID NO: 67150 - DNA, 25 bp, Mus musculus
aagtctcagcaagcttctaggttct

SEQ ID NO: 67151 - DNA, 25 bp, Mus musculus
aagtctcagcggctggaagccatca

SEQ ID NO: 67152 - DNA, 25 bp, Mus musculus
aagtctcagcgggtggaagccatca

SEQ ID NO: 67153 - DNA, 25 bp, Mus musculus
aagtctcagctgcagcggactggaa

SEQ ID NO: 67154 - DNA, 25 bp, Mus musculus
aagtctcagctggagcggactggaa

SEQ ID NO: 67155 - DNA, 25 bp, Mus musculus
aagtctcaggctatggctgccagga

SEQ ID NO: 67156 - DNA, 25 bp, Mus musculus
aagtctcaggctttggctgccagga

SEQ ID NO: 67157 - DNA, 25 bp, Mus musculus
aagtctcagtttattcgcttgagta

SEQ ID NO: 67158 - DNA, 25 bp, Mus musculus
aagtctcagttttttcgcttgagta

SEQ ID NO: 67159 - DNA, 25 bp, Mus musculus
aagtctcatactctaagtgccttaa

SEQ ID NO: 67160 - DNA, 25 bp, Mus musculus
aagtctcatactgtaagtgccttaa

SEQ ID NO: 67161 - DNA, 25 bp, Mus musculus
aagtctcatcccacacagtttcttg

SEQ ID NO: 67162 - DNA, 25 bp, Mus musculus
aagtctcatccctcacagtttcttg

SEQ ID NO: 67163 - DNA, 25 bp, Mus musculus
aagtctcatgagacagcagtgcttg

SEQ ID NO: 67164 - DNA, 25 bp, Mus musculus
aagtctcatgagtcagcagtgcttg

SEQ ID NO: 67165 - DNA, 25 bp, Mus musculus
aagtctcatgcaatagccagctcta

SEQ ID NO: 67166 - DNA, 25 bp, Mus musculus
aagtctcatgcattagccagctcta

SEQ ID NO: 67167 - DNA, 25 bp, Mus musculus
aagtctcatgggaatcagggatgcc

SEQ ID NO: 67168 - DNA, 25 bp, Mus musculus
aagtctcatgggtatcagggatgcc

SEQ ID NO: 67169 - DNA, 25 bp, Mus musculus
aagtctcattacattccggaagaag

SEQ ID NO: 67170 - DNA, 25 bp, Mus musculus
aagtctcattactttccggaagaag

SEQ ID NO: 67171 - DNA, 25 bp, Mus musculus
aagtctcattagatagcctaggcta

SEQ ID NO: 67172 - DNA, 25 bp, Mus musculus
aagtctcattagttagcctaggcta

SEQ ID NO: 67173 - DNA, 25 bp, Mus musculus
aagtctccaaacaatgctgtcagta

SEQ ID NO: 67174 - DNA, 25 bp, Mus musculus
aagtctccaaactatgctgtcagta

SEQ ID NO: 67175 - DNA, 25 bp, Mus musculus
aagtctccaaggcatcggtcagctt

SEQ ID NO: 67176 - DNA, 25 bp, Mus musculus
aagtctccaagggatcggtcagctt

SEQ ID NO: 67177 - DNA, 25 bp, Mus musculus
aagtctccacatatctctgcaaaat

SEQ ID NO: 67178 - DNA, 25 bp, Mus musculus
aagtctccacatttctctgcaaaat

SEQ ID NO: 67179 - DNA, 25 bp, Mus musculus
aagtctccagatcctaattttgtta

SEQ ID NO: 67180 - DNA, 25 bp, Mus musculus
aagtctccagatgctaattttgtta

SEQ ID NO: 67181 - DNA, 25 bp, Mus musculus
aagtctccagctctgttgctaagca

SEQ ID NO: 67182 - DNA, 25 bp, Mus musculus
aagtctccagctgtgttgctaagca

SEQ ID NO: 67183 - DNA, 25 bp, Mus musculus
aagtctccaggacgaccaaaaagag

SEQ ID NO: 67184 - DNA, 25 bp, Mus musculus
aagtctccaggaggaccaaaaagag

SEQ ID NO: 67185 - DNA, 25 bp, Mus musculus
aagtctccaggcagtaattccagaa

SEQ ID NO: 67186 - DNA, 25 bp, Mus musculus
aagtctccaggcatgtaagtgttca

SEQ ID NO: 67187 - DNA, 25 bp, Mus musculus
aagtctccaggctgtaattccagaa

SEQ ID NO: 67188 - DNA, 25 bp, Mus musculus
aagtctccaggcttgtaagtgttca

SEQ ID NO: 67189 - DNA, 25 bp, Mus musculus
aagtctccagtaagcagtggtcctc

SEQ ID NO: 67190 - DNA, 25 bp, Mus musculus
aagtctccagtatgcagtggtcctc

SEQ ID NO: 67191 - DNA, 25 bp, Mus musculus
aagtctccagttacttgtagagaga

SEQ ID NO: 67192 - DNA, 25 bp, Mus musculus
aagtctccagtttcttgtagagaga

SEQ ID NO: 67193 - DNA, 25 bp, Mus musculus
aagtctccatagattttcagtctca

SEQ ID NO: 67194 - DNA, 25 bp, Mus musculus
aagtctccatagtttttcagtctca

SEQ ID NO: 67195 - DNA, 25 bp, Mus musculus
aagtctccatggctgtgatggccac

SEQ ID NO: 67196 - DNA, 25 bp, Mus musculus
aagtctccatgggtgtgatggccac

SEQ ID NO: 67197 - DNA, 25 bp, Mus musculus
aagtctccattgaggagcctggctt

SEQ ID NO: 67198 - DNA, 25 bp, Mus musculus
aagtctccattgtggagcctggctt

SEQ ID NO: 67199 - DNA, 25 bp, Mus musculus
aagtctcccagcctacggtgcaagg

SEQ ID NO: 67200 - DNA, 25 bp, Mus musculus
aagtctcccagcgtacggtgcaagg

SEQ ID NO: 67201 - DNA, 25 bp, Mus musculus
aagtctcccattatatatctgtgaa

SEQ ID NO: 67202 - DNA, 25 bp, Mus musculus
aagtctcccattttatatctgtgaa

SEQ ID NO: 67203 - DNA, 25 bp, Mus musculus
aagtctcccctcagtcattcaatgt

SEQ ID NO: 67204 - DNA, 25 bp, Mus musculus
aagtctcccctctgtcattcaatgt

SEQ ID NO: 67205 - DNA, 25 bp, Mus musculus
aagtctcccgctattacaaatgtgc

SEQ ID NO: 67206 - DNA, 25 bp, Mus musculus
aagtctcccgcttttacaaatgtgc

SEQ ID NO: 67207 - DNA, 25 bp, Mus musculus
aagtctcccggtctatgtcacttat

SEQ ID NO: 67208 - DNA, 25 bp, Mus musculus
aagtctcccggtgtatgtcacttat

SEQ ID NO: 67209 - DNA, 25 bp, Mus musculus
aagtctccctggactccatgaagaa

SEQ ID NO: 67210 - DNA, 25 bp, Mus musculus
aagtctccctggtctccatgaagaa

SEQ ID NO: 67211 - DNA, 25 bp, Mus musculus
aagtctcccttcatatcccaatagg

SEQ ID NO: 67212 - DNA, 25 bp, Mus musculus
aagtctcccttcttatcccaatagg

SEQ ID NO: 67213 - DNA, 25 bp, Mus musculus
aagtctccgaaactttctccactat

SEQ ID NO: 67214 - DNA, 25 bp, Mus musculus
aagtctccgaaagtttctccactat

SEQ ID NO: 67215 - DNA, 25 bp, Mus musculus
aagtctccgaagagccatttggaca

SEQ ID NO: 67216 - DNA, 25 bp, Mus musculus
aagtctccgaagtgccatttggaca

SEQ ID NO: 67217 - DNA, 25 bp, Mus musculus
aagtctcctcaactcttaccggcaa

SEQ ID NO: 67218 - DNA, 25 bp, Mus musculus
aagtctcctcaagtcttaccggcaa

SEQ ID NO: 67219 - DNA, 25 bp, Mus musculus
aagtctcctcacatcatctacaggg

SEQ ID NO: 67220 - DNA, 25 bp, Mus musculus
aagtctcctcacttcatctacaggg

SEQ ID NO: 67221 - DNA, 25 bp, Mus musculus
aagtctcctgacatctgcgagcgag

SEQ ID NO: 67222 - DNA, 25 bp, Mus musculus
aagtctcctgacttctgcgagcgag

SEQ ID NO: 67223 - DNA, 25 bp, Mus musculus
aagtctccttctacaatgcactgtt

SEQ ID NO: 67224 - DNA, 25 bp, Mus musculus
aagtctccttcttcaatgcactgtt

SEQ ID NO: 67225 - DNA, 25 bp, Mus musculus
aagtctccttgtcaactgctactgg

SEQ ID NO: 67226 - DNA, 25 bp, Mus musculus
aagtctccttgtgaactgctactgg

SEQ ID NO: 67227 - DNA, 25 bp, Mus musculus
aagtctcgattcaatcttgacctga

SEQ ID NO: 67228 - DNA, 25 bp, Mus musculus
aagtctcgattctatcttgacctga

SEQ ID NO: 67229 - DNA, 25 bp, Mus musculus
aagtctcgcagcatgtgctcgtgga

SEQ ID NO: 67230 - DNA, 25 bp, Mus musculus
aagtctcgcagcttgtgctcgtgga

SEQ ID NO: 67231 - DNA, 25 bp, Mus musculus
aagtctcgtgtaaatttgttatctc

SEQ ID NO: 67232 - DNA, 25 bp, Mus musculus
aagtctcgtgtatatttgttatctc

SEQ ID NO: 67233 - DNA, 25 bp, Mus musculus
aagtctctaagtcactaggctcctt

SEQ ID NO: 67234 - DNA, 25 bp, Mus musculus
aagtctctaagtgactaggctcctt

SEQ ID NO: 67235 - DNA, 25 bp, Mus musculus
aagtctctacaaaagctcttgccac

SEQ ID NO: 67236 - DNA, 25 bp, Mus musculus
aagtctctacaatagctcttgccac

SEQ ID NO: 67237 - DNA, 25 bp, Mus musculus
aagtctctatgtctcaacgtttcca

SEQ ID NO: 67238 - DNA, 25 bp, Mus musculus
aagtctctatgtgtcaacgtttcca

SEQ ID NO: 67239 - DNA, 25 bp, Mus musculus
aagtctctcactagaaaattttctt

SEQ ID NO: 67240 - DNA, 25 bp, Mus musculus
aagtctctcacttgaaaattttctt

SEQ ID NO: 67241 - DNA, 25 bp, Mus musculus
aagtctctcagaacttccccagttt

SEQ ID NO: 67242 - DNA, 25 bp, Mus musculus
aagtctctcagacggctctacttaa

SEQ ID NO: 67243 - DNA, 25 bp, Mus musculus
aagtctctcagagggctctacttaa

SEQ ID NO: 67244 - DNA, 25 bp, Mus musculus
aagtctctcagatcttccccagttt

SEQ ID NO: 67245 - DNA, 25 bp, Mus musculus
aagtctctcagccacccatggttac

SEQ ID NO: 67246 - DNA, 25 bp, Mus musculus
aagtctctcagcgacccatggttac

SEQ ID NO: 67247 - DNA, 25 bp, Mus musculus
aagtctctcttaaacaatctggctg

SEQ ID NO: 67248 - DNA, 25 bp, Mus musculus
aagtctctcttatacaatctggctg

SEQ ID NO: 67249 - DNA, 25 bp, Mus musculus
aagtctctcttcaggtgttggatca

SEQ ID NO: 67250 - DNA, 25 bp, Mus musculus
aagtctctcttctggtgttggatca

SEQ ID NO: 67251 - DNA, 25 bp, Mus musculus
aagtctctcttgaataagtttcatc

SEQ ID NO: 67252 - DNA, 25 bp, Mus musculus
aagtctctcttgtataagtttcatc

SEQ ID NO: 67253 - DNA, 25 bp, Mus musculus
aagtctctgaccatggacagtgtga

SEQ ID NO: 67254 - DNA, 25 bp, Mus musculus
aagtctctgaccttggacagtgtga

SEQ ID NO: 67255 - DNA, 25 bp, Mus musculus
aagtctctgatcaagcttcttccca

SEQ ID NO: 67256 - DNA, 25 bp, Mus musculus
aagtctctgatctagcttcttccca

SEQ ID NO: 67257 - DNA, 25 bp, Mus musculus
aagtctctgcaacgctaggcacaca

SEQ ID NO: 67258 - DNA, 25 bp, Mus musculus
aagtctctgcaaggctaggcacaca

SEQ ID NO: 67259 - DNA, 25 bp, Mus musculus
aagtctctgccaagcgcaaggtggt

SEQ ID NO: 67260 - DNA, 25 bp, Mus musculus
aagtctctgccatgcgcaaggtggt

SEQ ID NO: 67261 - DNA, 25 bp, Mus musculus
aagtctctgcccctgtcggtgccag

SEQ ID NO: 67262 - DNA, 25 bp, Mus musculus
aagtctctgcccgtgtcggtgccag

SEQ ID NO: 67263 - DNA, 25 bp, Mus musculus
aagtctctgcttcctttatggtttc

SEQ ID NO: 67264 - DNA, 25 bp, Mus musculus
aagtctctgcttgctttatggtttc

SEQ ID NO: 67265 - DNA, 25 bp, Mus musculus
aagtctctggagacgatcaactcta

SEQ ID NO: 67266 - DNA, 25 bp, Mus musculus
aagtctctggagtcgatcaactcta

SEQ ID NO: 67267 - DNA, 25 bp, Mus musculus
aagtctctgggcatctaaatcctcc

SEQ ID NO: 67268 - DNA, 25 bp, Mus musculus
aagtctctgggcctcaaggacgaca

SEQ ID NO: 67269 - DNA, 25 bp, Mus musculus
aagtctctgggcgtcaaggacgaca

SEQ ID NO: 67270 - DNA, 25 bp, Mus musculus
aagtctctgggcttctaaatcctcc

SEQ ID NO: 67271 - DNA, 25 bp, Mus musculus
aagtctctggtccttctcactgagt

SEQ ID NO: 67272 - DNA, 25 bp, Mus musculus
aagtctctggtcgttctcactgagt

SEQ ID NO: 67273 - DNA, 25 bp, Mus musculus
aagtctctgtccctagacaccggag

SEQ ID NO: 67274 - DNA, 25 bp, Mus musculus
aagtctctgtccgtagacaccggag

SEQ ID NO: 67275 - DNA, 25 bp, Mus musculus
aagtctctgtgcagtttgtcacaca

SEQ ID NO: 67276 - DNA, 25 bp, Mus musculus
aagtctctgtgctgtttgtcacaca

SEQ ID NO: 67277 - DNA, 25 bp, Mus musculus
aagtctcttactctcagcatactga

SEQ ID NO: 67278 - DNA, 25 bp, Mus musculus
aagtctcttactgtcagcatactga

SEQ ID NO: 67279 - DNA, 25 bp, Mus musculus
aagtctcttagacgagtcaccctgc

SEQ ID NO: 67280 - DNA, 25 bp, Mus musculus
aagtctcttagaggagtcaccctgc

SEQ ID NO: 67281 - DNA, 25 bp, Mus musculus
aagtctcttattcaacttggagctc

SEQ ID NO: 67282 - DNA, 25 bp, Mus musculus
aagtctcttattgaacttggagctc

SEQ ID NO: 67283 - DNA, 25 bp, Mus musculus
aagtctcttcaaagcctgcctgcaa

SEQ ID NO: 67284 - DNA, 25 bp, Mus musculus
aagtctcttcaatgcctgcctgcaa

SEQ ID NO: 67285 - DNA, 25 bp, Mus musculus
aagtctcttctgatagtccctctat

SEQ ID NO: 67286 - DNA, 25 bp, Mus musculus
aagtctcttctgttagtccctctat

SEQ ID NO: 67287 - DNA, 25 bp, Mus musculus
aagtctcttcttcatgctctaacca

SEQ ID NO: 67288 - DNA, 25 bp, Mus musculus
aagtctcttcttgatgctctaacca

SEQ ID NO: 67289 - DNA, 25 bp, Mus musculus
aagtctcttgccaatctgatgtgta

SEQ ID NO: 67290 - DNA, 25 bp, Mus musculus
aagtctcttgcctatctgatgtgta

SEQ ID NO: 67291 - DNA, 25 bp, Mus musculus
aagtctcttttgatggatgctccag

SEQ ID NO: 67292 - DNA, 25 bp, Mus musculus
aagtctcttttgttggatgctccag

SEQ ID NO: 67293 - DNA, 25 bp, Mus musculus
aagtctgaacacacgtttgtgtccc

SEQ ID NO: 67294 - DNA, 25 bp, Mus musculus
aagtctgaacactcgtttgtgtccc

SEQ ID NO: 67295 - DNA, 25 bp, Mus musculus
aagtctgaaccacgaccaggccagt

SEQ ID NO: 67296 - DNA, 25 bp, Mus musculus
aagtctgaaccaggaccaggccagt

SEQ ID NO: 67297 - DNA, 25 bp, Mus musculus
aagtctgaatccaatgagcctgaag

SEQ ID NO: 67298 - DNA, 25 bp, Mus musculus
aagtctgaatcctatgagcctgaag

SEQ ID NO: 67299 - DNA, 25 bp, Mus musculus
aagtctgaatgcaacatcccattaa

SEQ ID NO: 67300 - DNA, 25 bp, Mus musculus
aagtctgaatgctacatcccattaa

SEQ ID NO: 67301 - DNA, 25 bp, Mus musculus
aagtctgacaatatcttgctgggaa

SEQ ID NO: 67302 - DNA, 25 bp, Mus musculus
aagtctgacaatttcttgctgggaa

SEQ ID NO: 67303 - DNA, 25 bp, Mus musculus
aagtctgacactagtactgaacaca

SEQ ID NO: 67304 - DNA, 25 bp, Mus musculus
aagtctgacacttgtactgaacaca

SEQ ID NO: 67305 - DNA, 25 bp, Mus musculus
aagtctgacatgcaaacggccaaga

SEQ ID NO: 67306 - DNA, 25 bp, Mus musculus
aagtctgacatggaaacggccaaga

SEQ ID NO: 67307 - DNA, 25 bp, Mus musculus
aagtctgaccatccttcagggacgt

SEQ ID NO: 67308 - DNA, 25 bp, Mus musculus
aagtctgaccatgcttcagggacgt

SEQ ID NO: 67309 - DNA, 25 bp, Mus musculus
aagtctgacctgattcagcaccgaa

SEQ ID NO: 67310 - DNA, 25 bp, Mus musculus
aagtctgacctgtttcagcaccgaa

SEQ ID NO: 67311 - DNA, 25 bp, Mus musculus
aagtctgacgatcacacctccaatt

SEQ ID NO: 67312 - DNA, 25 bp, Mus musculus
aagtctgacgatgacacctccaatt

SEQ ID NO: 67313 - DNA, 25 bp, Mus musculus
aagtctgacgggaaacgtgtggcac

SEQ ID NO: 67314 - DNA, 25 bp, Mus musculus
aagtctgacgggtaacgtgtggcac

SEQ ID NO: 67315 - DNA, 25 bp, Mus musculus
aagtctgacttaaccacggtctgac

SEQ ID NO: 67316 - DNA, 25 bp, Mus musculus
aagtctgacttacctgtaccttgtt

SEQ ID NO: 67317 - DNA, 25 bp, Mus musculus
aagtctgacttagctgtaccttgtt

SEQ ID NO: 67318 - DNA, 25 bp, Mus musculus
aagtctgacttatccacggtctgac

SEQ ID NO: 67319 - DNA, 25 bp, Mus musculus
aagtctgacttgcaatgctcggtga

SEQ ID NO: 67320 - DNA, 25 bp, Mus musculus
aagtctgacttggaatgctcggtga

SEQ ID NO: 67321 - DNA, 25 bp, Mus musculus
aagtctgagcgactgtctccagtca

SEQ ID NO: 67322 - DNA, 25 bp, Mus musculus
aagtctgagcgagtgtctccagtca

SEQ ID NO: 67323 - DNA, 25 bp, Mus musculus
aagtctgagctcatttctttgacac

SEQ ID NO: 67324 - DNA, 25 bp, Mus musculus
aagtctgagctcctgcggaatgcag

SEQ ID NO: 67325 - DNA, 25 bp, Mus musculus
aagtctgagctcgtgcggaatgcag

SEQ ID NO: 67326 - DNA, 25 bp, Mus musculus
aagtctgagctcttttctttgacac

SEQ ID NO: 67327 - DNA, 25 bp, Mus musculus
aagtctgaggacatcctgggataca

SEQ ID NO: 67328 - DNA, 25 bp, Mus musculus
aagtctgaggacttcctgggataca

SEQ ID NO: 67329 - DNA, 25 bp, Mus musculus
aagtctgaggcaccctaagctacat

SEQ ID NO: 67330 - DNA, 25 bp, Mus musculus
aagtctgaggcagcctaagctacat

SEQ ID NO: 67331 - DNA, 25 bp, Mus musculus
aagtctgaggtcatcaagggacgct

SEQ ID NO: 67332 - DNA, 25 bp, Mus musculus
aagtctgaggtcttcaagggacgct

SEQ ID NO: 67333 - DNA, 25 bp, Mus musculus
aagtctgagtctagtcagagatcaa

SEQ ID NO: 67334 - DNA, 25 bp, Mus musculus
aagtctgagtcttgtcagagatcaa

SEQ ID NO: 67335 - DNA, 25 bp, Mus musculus
aagtctgagtgccttgaccggacca

SEQ ID NO: 67336 - DNA, 25 bp, Mus musculus
aagtctgagtgcgttgaccggacca

SEQ ID NO: 67337 - DNA, 25 bp, Mus musculus
aagtctgagttgagtgtccattcta

SEQ ID NO: 67338 - DNA, 25 bp, Mus musculus
aagtctgagttgtgtgtccattcta

SEQ ID NO: 67339 - DNA, 25 bp, Mus musculus
aagtctgatccgacacttgcaggac

SEQ ID NO: 67340 - DNA, 25 bp, Mus musculus
aagtctgatccgtcacttgcaggac

SEQ ID NO: 67341 - DNA, 25 bp, Mus musculus
aagtctgatctactgctagtctgta

SEQ ID NO: 67342 - DNA, 25 bp, Mus musculus
aagtctgatctagtgctagtctgta

SEQ ID NO: 67343 - DNA, 25 bp, Mus musculus
aagtctgatggcctggattctgtcc

SEQ ID NO: 67344 - DNA, 25 bp, Mus musculus
aagtctgatggcgtggattctgtcc

SEQ ID NO: 67345 - DNA, 25 bp, Mus musculus
aagtctgatgttcggctaccagccc

SEQ ID NO: 67346 - DNA, 25 bp, Mus musculus
aagtctgatgttgggctaccagccc

SEQ ID NO: 67347 - DNA, 25 bp, Mus musculus
aagtctgcaaccacttactgagcaa

SEQ ID NO: 67348 - DNA, 25 bp, Mus musculus
aagtctgcaacctcttactgagcaa

SEQ ID NO: 67349 - DNA, 25 bp, Mus musculus
aagtctgcaactacctaagctggat

SEQ ID NO: 67350 - DNA, 25 bp, Mus musculus
aagtctgcaacttcctaagctggat

SEQ ID NO: 67351 - DNA, 25 bp, Mus musculus
aagtctgcacttctcaagcagaagg

SEQ ID NO: 67352 - DNA, 25 bp, Mus musculus
aagtctgcacttgtcaagcagaagg

SEQ ID NO: 67353 - DNA, 25 bp, Mus musculus
aagtctgcagagacgggcaaacaag

SEQ ID NO: 67354 - DNA, 25 bp, Mus musculus
aagtctgcagagctatgaatcttaa

SEQ ID NO: 67355 - DNA, 25 bp, Mus musculus
aagtctgcagaggtatgaatcttaa

SEQ ID NO: 67356 - DNA, 25 bp, Mus musculus
aagtctgcagagtcgggcaaacaag

SEQ ID NO: 67357 - DNA, 25 bp, Mus musculus
aagtctgcagatccttttcagctat

SEQ ID NO: 67358 - DNA, 25 bp, Mus musculus
aagtctgcagatgcttttcagctat

SEQ ID NO: 67359 - DNA, 25 bp, Mus musculus
aagtctgcaggtccccaccgcatta

SEQ ID NO: 67360 - DNA, 25 bp, Mus musculus
aagtctgcaggtgcccaccgcatta

SEQ ID NO: 67361 - DNA, 25 bp, Mus musculus
aagtctgcataccttgtgctctgtt

SEQ ID NO: 67362 - DNA, 25 bp, Mus musculus
aagtctgcatacgttgtgctctgtt

SEQ ID NO: 67363 - DNA, 25 bp, Mus musculus
aagtctgcatgcctgtgcaaccggg

SEQ ID NO: 67364 - DNA, 25 bp, Mus musculus
aagtctgcatgcgtgtgcaaccggg

SEQ ID NO: 67365 - DNA, 25 bp, Mus musculus
aagtctgccaaactgtggaaacggt

SEQ ID NO: 67366 - DNA, 25 bp, Mus musculus
aagtctgccaaagtgtggaaacggt

SEQ ID NO: 67367 - DNA, 25 bp, Mus musculus
aagtctgccaagaactggtcgcaga

SEQ ID NO: 67368 - DNA, 25 bp, Mus musculus
aagtctgccaagtactggtcgcaga

SEQ ID NO: 67369 - DNA, 25 bp, Mus musculus
aagtctgccaccaagttggagccta

SEQ ID NO: 67370 - DNA, 25 bp, Mus musculus
aagtctgccacctagttggagccta

SEQ ID NO: 67371 - DNA, 25 bp, Mus musculus
aagtctgccacgcttagctgctctt

SEQ ID NO: 67372 - DNA, 25 bp, Mus musculus
aagtctgccacggttagctgctctt

SEQ ID NO: 67373 - DNA, 25 bp, Mus musculus
aagtctgccataacaaatgccatca

SEQ ID NO: 67374 - DNA, 25 bp, Mus musculus
aagtctgccatacgaagggtttcta

SEQ ID NO: 67375 - DNA, 25 bp, Mus musculus
aagtctgccataggaagggtttcta

SEQ ID NO: 67376 - DNA, 25 bp, Mus musculus
aagtctgccatatcaaatgccatca

SEQ ID NO: 67377 - DNA, 25 bp, Mus musculus
aagtctgcccagaaatctgctgaag

SEQ ID NO: 67378 - DNA, 25 bp, Mus musculus
aagtctgcccagtaatctgctgaag

SEQ ID NO: 67379 - DNA, 25 bp, Mus musculus
aagtctgcccatattgtggccagaa

SEQ ID NO: 67380 - DNA, 25 bp, Mus musculus
aagtctgcccattttgtggccagaa

SEQ ID NO: 67381 - DNA, 25 bp, Mus musculus
aagtctgcctatatcttacacagtg

SEQ ID NO: 67382 - DNA, 25 bp, Mus musculus
aagtctgcctatttcttacacagtg

SEQ ID NO: 67383 - DNA, 25 bp, Mus musculus
aagtctgcctcaccagcagtgagct

SEQ ID NO: 67384 - DNA, 25 bp, Mus musculus
aagtctgcctcagcagcagtgagct

SEQ ID NO: 67385 - DNA, 25 bp, Mus musculus
aagtctgcctctctttaccctaagc

SEQ ID NO: 67386 - DNA, 25 bp, Mus musculus
aagtctgcctctgtttaccctaagc

SEQ ID NO: 67387 - DNA, 25 bp, Mus musculus
aagtctgcctggaagacatgtctta

SEQ ID NO: 67388 - DNA, 25 bp, Mus musculus
aagtctgcctggtagacatgtctta

SEQ ID NO: 67389 - DNA, 25 bp, Mus musculus
aagtctgccttaaaatctgccatgg

SEQ ID NO: 67390 - DNA, 25 bp, Mus musculus
aagtctgccttacctctagagcgta

SEQ ID NO: 67391 - DNA, 25 bp, Mus musculus
aagtctgccttagctctagagcgta

SEQ ID NO: 67392 - DNA, 25 bp, Mus musculus
aagtctgccttataatctgccatgg

SEQ ID NO: 67393 - DNA, 25 bp, Mus musculus
aagtctgcgcatctgcacaatttat

SEQ ID NO: 67394 - DNA, 25 bp, Mus musculus
aagtctgcgcatgtgcacaatttat

SEQ ID NO: 67395 - DNA, 25 bp, Mus musculus
aagtctgcgctaattcatgctgcct

SEQ ID NO: 67396 - DNA, 25 bp, Mus musculus
aagtctgcgctatttcatgctgcct

SEQ ID NO: 67397 - DNA, 25 bp, Mus musculus
aagtctgcgctgagtttcacaaggg

SEQ ID NO: 67398 - DNA, 25 bp, Mus musculus
aagtctgcgctgtgtttcacaaggg

SEQ ID NO: 67399 - DNA, 25 bp, Mus musculus
aagtctgcgtcacaatcacgtgcta

SEQ ID NO: 67400 - DNA, 25 bp, Mus musculus
aagtctgcgtcagaatcacgtgcta

SEQ ID NO: 67401 - DNA, 25 bp, Mus musculus
aagtctgctaagagctttgttcatt

SEQ ID NO: 67402 - DNA, 25 bp, Mus musculus
aagtctgctaagtgctttgttcatt

SEQ ID NO: 67403 - DNA, 25 bp, Mus musculus
aagtctgctacccaagatgatgaat

SEQ ID NO: 67404 - DNA, 25 bp, Mus musculus
aagtctgctaccgaagatgatgaat

SEQ ID NO: 67405 - DNA, 25 bp, Mus musculus
aagtctgctatgacctgcactgaaa

SEQ ID NO: 67406 - DNA, 25 bp, Mus musculus
aagtctgctatgtcctgcactgaaa

SEQ ID NO: 67407 - DNA, 25 bp, Mus musculus
aagtctgctcacaagaacccaaggg

SEQ ID NO: 67408 - DNA, 25 bp, Mus musculus
aagtctgctcactagaacccaaggg

SEQ ID NO: 67409 - DNA, 25 bp, Mus musculus
aagtctgctcgcctgaagtgttgat

SEQ ID NO: 67410 - DNA, 25 bp, Mus musculus
aagtctgctcgcgtgaagtgttgat

SEQ ID NO: 67411 - DNA, 25 bp, Mus musculus
aagtctgctgacctgcgttggcttc

SEQ ID NO: 67412 - DNA, 25 bp, Mus musculus
aagtctgctgacgtgcgttggcttc

SEQ ID NO: 67413 - DNA, 25 bp, Mus musculus
aagtctgctgctagaaggagccaat

SEQ ID NO: 67414 - DNA, 25 bp, Mus musculus
aagtctgctgcttgaaggagccaat

SEQ ID NO: 67415 - DNA, 25 bp, Mus musculus
aagtctgctgtgaaatggatctcat

SEQ ID NO: 67416 - DNA, 25 bp, Mus musculus
aagtctgctgtgtaatggatctcat

SEQ ID NO: 67417 - DNA, 25 bp, Mus musculus
aagtctgcttccctctggatgaatg

SEQ ID NO: 67418 - DNA, 25 bp, Mus musculus
aagtctgcttccgtctggatgaatg

SEQ ID NO: 67419 - DNA, 25 bp, Mus musculus
aagtctgcttctagcctgcctttaa

SEQ ID NO: 67420 - DNA, 25 bp, Mus musculus
aagtctgcttcttgcctgcctttaa

SEQ ID NO: 67421 - DNA, 25 bp, Mus musculus
aagtctgcttggcaggatgcccttc

SEQ ID NO: 67422 - DNA, 25 bp, Mus musculus
aagtctgcttgggaggatgcccttc

SEQ ID NO: 67423 - DNA, 25 bp, Mus musculus
aagtctggaccaagctgatggctgc

SEQ ID NO: 67424 - DNA, 25 bp, Mus musculus
aagtctggaccatgctgatggctgc

SEQ ID NO: 67425 - DNA, 25 bp, Mus musculus
aagtctggagtacgcagtgctccca

SEQ ID NO: 67426 - DNA, 25 bp, Mus musculus
aagtctggagtaggcagtgctccca

SEQ ID NO: 67427 - DNA, 25 bp, Mus musculus
aagtctggagtcaggtgtgcagttt

SEQ ID NO: 67428 - DNA, 25 bp, Mus musculus
aagtctggagtctggtgtgcagttt

SEQ ID NO: 67429 - DNA, 25 bp, Mus musculus
aagtctggatccagttctcacattc

SEQ ID NO: 67430 - DNA, 25 bp, Mus musculus
aagtctggatcctgttctcacattc

SEQ ID NO: 67431 - DNA, 25 bp, Mus musculus
aagtctggatcgaattgtaaattgc

SEQ ID NO: 67432 - DNA, 25 bp, Mus musculus
aagtctggatcgtattgtaaattgc

SEQ ID NO: 67433 - DNA, 25 bp, Mus musculus
aagtctggatgtcgaatctcattca

SEQ ID NO: 67434 - DNA, 25 bp, Mus musculus
aagtctggatgtggaatctcattca

SEQ ID NO: 67435 - DNA, 25 bp, Mus musculus
aagtctggcaagagccttgaacaca

SEQ ID NO: 67436 - DNA, 25 bp, Mus musculus
aagtctggcaagtgccttgaacaca

SEQ ID NO: 67437 - DNA, 25 bp, Mus musculus
aagtctggcaccacattttggtagc

SEQ ID NO: 67438 - DNA, 25 bp, Mus musculus
aagtctggcacctcattttggtagc

SEQ ID NO: 67439 - DNA, 25 bp, Mus musculus
aagtctggcactatcgttggaggag

SEQ ID NO: 67440 - DNA, 25 bp, Mus musculus
aagtctggcactttcgttggaggag

SEQ ID NO: 67441 - DNA, 25 bp, Mus musculus
aagtctggcccaatgctggtgaagc

SEQ ID NO: 67442 - DNA, 25 bp, Mus musculus
aagtctggcccattgctggtgaagc

SEQ ID NO: 67443 - DNA, 25 bp, Mus musculus
aagtctggcgcgaagttttcagagt

SEQ ID NO: 67444 - DNA, 25 bp, Mus musculus
aagtctggcgcgtagttttcagagt

SEQ ID NO: 67445 - DNA, 25 bp, Mus musculus
aagtctggctccaccagtctggaga

SEQ ID NO: 67446 - DNA, 25 bp, Mus musculus
aagtctggctcctccagtctggaga

SEQ ID NO: 67447 - DNA, 25 bp, Mus musculus
aagtctggctttccccagcacagga

SEQ ID NO: 67448 - DNA, 25 bp, Mus musculus
aagtctggctttcggtaactagaag

SEQ ID NO: 67449 - DNA, 25 bp, Mus musculus
aagtctggctttgcccagcacagga

SEQ ID NO: 67450 - DNA, 25 bp, Mus musculus
aagtctggctttgggtaactagaag

SEQ ID NO: 67451 - DNA, 25 bp, Mus musculus
aagtctgggaagacggctaggaatc

SEQ ID NO: 67452 - DNA, 25 bp, Mus musculus
aagtctgggaagtcggctaggaatc

SEQ ID NO: 67453 - DNA, 25 bp, Mus musculus
aagtctgggactacaacgagggtga

SEQ ID NO: 67454 - DNA, 25 bp, Mus musculus
aagtctgggacttcaacgagggtga

SEQ ID NO: 67455 - DNA, 25 bp, Mus musculus
aagtctgggcgcaggagctaaacca

SEQ ID NO: 67456 - DNA, 25 bp, Mus musculus
aagtctgggcgctggagctaaacca

SEQ ID NO: 67457 - DNA, 25 bp, Mus musculus
aagtctgggctcactttaaatctaa

SEQ ID NO: 67458 - DNA, 25 bp, Mus musculus
aagtctgggctctctttaaatctaa

SEQ ID NO: 67459 - DNA, 25 bp, Mus musculus
aagtctgggcttatcaaagctccat

SEQ ID NO: 67460 - DNA, 25 bp, Mus musculus
aagtctgggcttcatatttgctgag

SEQ ID NO: 67461 - DNA, 25 bp, Mus musculus
aagtctgggcttgatatttgctgag

SEQ ID NO: 67462 - DNA, 25 bp, Mus musculus
aagtctgggcttttcaaagctccat

SEQ ID NO: 67463 - DNA, 25 bp, Mus musculus
aagtctgggtcactcgtgccttgtg

SEQ ID NO: 67464 - DNA, 25 bp, Mus musculus
aagtctgggtcagtcgtgccttgtg

SEQ ID NO: 67465 - DNA, 25 bp, Mus musculus
aagtctgggtgacactagactgtgt

SEQ ID NO: 67466 - DNA, 25 bp, Mus musculus
aagtctgggtgagactagactgtgt

SEQ ID NO: 67467 - DNA, 25 bp, Mus musculus
aagtctggttccatggcaggatgat

SEQ ID NO: 67468 - DNA, 25 bp, Mus musculus
aagtctggttccttggcaggatgat

SEQ ID NO: 67469 - DNA, 25 bp, Mus musculus
aagtctgtaataaccatagcttgtt

SEQ ID NO: 67470 - DNA, 25 bp, Mus musculus
aagtctgtaatatccatagcttgtt

SEQ ID NO: 67471 - DNA, 25 bp, Mus musculus
aagtctgtacagatgcctcattaat

SEQ ID NO: 67472 - DNA, 25 bp, Mus musculus
aagtctgtacagttgcctcattaat

SEQ ID NO: 67473 - DNA, 25 bp, Mus musculus
aagtctgtagaccatagaactggca

SEQ ID NO: 67474 - DNA, 25 bp, Mus musculus
aagtctgtagacgatagaactggca

SEQ ID NO: 67475 - DNA, 25 bp, Mus musculus
aagtctgtagccagactggtttcgt

SEQ ID NO: 67476 - DNA, 25 bp, Mus musculus
aagtctgtagcctgactggtttcgt

SEQ ID NO: 67477 - DNA, 25 bp, Mus musculus
aagtctgtaggcagtttggttgttt

SEQ ID NO: 67478 - DNA, 25 bp, Mus musculus
aagtctgtaggctgtttggttgttt

SEQ ID NO: 67479 - DNA, 25 bp, Mus musculus
aagtctgtatgtagtactgtaatgg

SEQ ID NO: 67480 - DNA, 25 bp, Mus musculus
aagtctgtatgttgtactgtaatgg

SEQ ID NO: 67481 - DNA, 25 bp, Mus musculus
aagtctgtattacaaatatctgtat

SEQ ID NO: 67482 - DNA, 25 bp, Mus musculus
aagtctgtattagaaatatctgtat

SEQ ID NO: 67483 - DNA, 25 bp, Mus musculus
aagtctgtcactagtttttgtacag

SEQ ID NO: 67484 - DNA, 25 bp, Mus musculus
aagtctgtcacttgtttttgtacag

SEQ ID NO: 67485 - DNA, 25 bp, Mus musculus
aagtctgtcgacaggtggtcttttg

SEQ ID NO: 67486 - DNA, 25 bp, Mus musculus
aagtctgtcgactggtggtcttttg

SEQ ID NO: 67487 - DNA, 25 bp, Mus musculus
aagtctgtcgtaaattccgtttgat

SEQ ID NO: 67488 - DNA, 25 bp, Mus musculus
aagtctgtcgtatattccgtttgat

SEQ ID NO: 67489 - DNA, 25 bp, Mus musculus
aagtctgtctgacaagatagtgccg

SEQ ID NO: 67490 - DNA, 25 bp, Mus musculus
aagtctgtctgagaagatagtgccg

SEQ ID NO: 67491 - DNA, 25 bp, Mus musculus
aagtctgtctgcaccagggaacgag

SEQ ID NO: 67492 - DNA, 25 bp, Mus musculus
aagtctgtctgctccagggaacgag

SEQ ID NO: 67493 - DNA, 25 bp, Mus musculus
aagtctgtctggcatgcacagtcct

SEQ ID NO: 67494 - DNA, 25 bp, Mus musculus
aagtctgtctggcattttctggatt

SEQ ID NO: 67495 - DNA, 25 bp, Mus musculus
aagtctgtctgggatgcacagtcct

SEQ ID NO: 67496 - DNA, 25 bp, Mus musculus
aagtctgtctgggattttctggatt

SEQ ID NO: 67497 - DNA, 25 bp, Mus musculus
aagtctgtgaccaaacatccaaatt

SEQ ID NO: 67498 - DNA, 25 bp, Mus musculus
aagtctgtgacctaacatccaaatt

SEQ ID NO: 67499 - DNA, 25 bp, Mus musculus
aagtctgtgagactgccaccgggca

SEQ ID NO: 67500 - DNA, 25 bp, Mus musculus
aagtctgtgagagtgccaccgggca

SEQ ID NO: 67501 - DNA, 25 bp, Mus musculus
aagtctgtgcatcgcatgcatgcag

SEQ ID NO: 67502 - DNA, 25 bp, Mus musculus
aagtctgtgcatggcatgcatgcag

SEQ ID NO: 67503 - DNA, 25 bp, Mus musculus
aagtctgtgcctcctgcacagaaag

SEQ ID NO: 67504 - DNA, 25 bp, Mus musculus
aagtctgtgcctgctgcacagaaag

SEQ ID NO: 67505 - DNA, 25 bp, Mus musculus
aagtctgtgcttaaggttgaggaat

SEQ ID NO: 67506 - DNA, 25 bp, Mus musculus
aagtctgtgctttaggttgaggaat

SEQ ID NO: 67507 - DNA, 25 bp, Mus musculus
aagtctgtggatcgctcgtacacca

SEQ ID NO: 67508 - DNA, 25 bp, Mus musculus
aagtctgtggatctgctgatgtaca

SEQ ID NO: 67509 - DNA, 25 bp, Mus musculus
aagtctgtggatggctcgtacacca

SEQ ID NO: 67510 - DNA, 25 bp, Mus musculus
aagtctgtggatgtgctgatgtaca

SEQ ID NO: 67511 - DNA, 25 bp, Mus musculus
aagtctgtgggaatccatctgccat

SEQ ID NO: 67512 - DNA, 25 bp, Mus musculus
aagtctgtgggattccatctgccat

SEQ ID NO: 67513 - DNA, 25 bp, Mus musculus
aagtctgtgggcagggtatttagtc

SEQ ID NO: 67514 - DNA, 25 bp, Mus musculus
aagtctgtgggctgggtatttagtc

SEQ ID NO: 67515 - DNA, 25 bp, Mus musculus
aagtctgtggttagtcccatctgtg

SEQ ID NO: 67516 - DNA, 25 bp, Mus musculus
aagtctgtggtttgtcccatctgtg

SEQ ID NO: 67517 - DNA, 25 bp, Mus musculus
aagtctgtgtatctaacattggcag

SEQ ID NO: 67518 - DNA, 25 bp, Mus musculus
aagtctgtgtatgtaacattggcag

SEQ ID NO: 67519 - DNA, 25 bp, Mus musculus
aagtctgtgtgcctgggttaaccac

SEQ ID NO: 67520 - DNA, 25 bp, Mus musculus
aagtctgtgtgcgtgggttaaccac

SEQ ID NO: 67521 - DNA, 25 bp, Mus musculus
aagtctgtgtggactggcttaaaca

SEQ ID NO: 67522 - DNA, 25 bp, Mus musculus
aagtctgtgtggtctggcttaaaca

SEQ ID NO: 67523 - DNA, 25 bp, Mus musculus
aagtctgtgtgtcaagtttgcagca

SEQ ID NO: 67524 - DNA, 25 bp, Mus musculus
aagtctgtgtgtgaagtttgcagca

SEQ ID NO: 67525 - DNA, 25 bp, Mus musculus
aagtctgtgttgacatggaagctgg

SEQ ID NO: 67526 - DNA, 25 bp, Mus musculus
aagtctgtgttgtcatggaagctgg

SEQ ID NO: 67527 - DNA, 25 bp, Mus musculus
aagtctgttactccagcactgtgcc

SEQ ID NO: 67528 - DNA, 25 bp, Mus musculus
aagtctgttactgcagcactgtgcc

SEQ ID NO: 67529 - DNA, 25 bp, Mus musculus
aagtctgttcggaggccctgataga

SEQ ID NO: 67530 - DNA, 25 bp, Mus musculus
aagtctgttcggtggccctgataga

SEQ ID NO: 67531 - DNA, 25 bp, Mus musculus
aagtctgttctcataccacctgggt

SEQ ID NO: 67532 - DNA, 25 bp, Mus musculus
aagtctgttctcatgtacggcgtgg

SEQ ID NO: 67533 - DNA, 25 bp, Mus musculus
aagtctgttctcttaccacctgggt

SEQ ID NO: 67534 - DNA, 25 bp, Mus musculus
aagtctgttctcttgtacggcgtgg

SEQ ID NO: 67535 - DNA, 25 bp, Mus musculus
aagtctgttctgccggcattgtggg

SEQ ID NO: 67536 - DNA, 25 bp, Mus musculus
aagtctgttctggcggcattgtggg

SEQ ID NO: 67537 - DNA, 25 bp, Mus musculus
aagtctgttttaaccccagtgtagc

SEQ ID NO: 67538 - DNA, 25 bp, Mus musculus
aagtctgttttatccccagtgtagc

SEQ ID NO: 67539 - DNA, 25 bp, Mus musculus
aagtcttaaccaaaggacatgttta

SEQ ID NO: 67540 - DNA, 25 bp, Mus musculus
aagtcttaaccataggacatgttta

SEQ ID NO: 67541 - DNA, 25 bp, Mus musculus
aagtcttacgccatctggacaggtt

SEQ ID NO: 67542 - DNA, 25 bp, Mus musculus
aagtcttacgccttctggacaggtt

SEQ ID NO: 67543 - DNA, 25 bp, Mus musculus
aagtcttactcactttctactcaga

SEQ ID NO: 67544 - DNA, 25 bp, Mus musculus
aagtcttactcagtttctactcaga

SEQ ID NO: 67545 - DNA, 25 bp, Mus musculus
aagtcttacttcagttctcgccaag

SEQ ID NO: 67546 - DNA, 25 bp, Mus musculus
aagtcttacttctgttctcgccaag

SEQ ID NO: 67547 - DNA, 25 bp, Mus musculus
aagtcttagcacatcttgtcttggc

SEQ ID NO: 67548 - DNA, 25 bp, Mus musculus
aagtcttagcacttcttgtcttggc

SEQ ID NO: 67549 - DNA, 25 bp, Mus musculus
aagtcttagcatcattttggctggg

SEQ ID NO: 67550 - DNA, 25 bp, Mus musculus
aagtcttagcatgattttggctggg

SEQ ID NO: 67551 - DNA, 25 bp, Mus musculus
aagtcttagcccataatggctgagt

SEQ ID NO: 67552 - DNA, 25 bp, Mus musculus
aagtcttagcccttaatggctgagt

SEQ ID NO: 67553 - DNA, 25 bp, Mus musculus
aagtcttagggcacatttgcttgat

SEQ ID NO: 67554 - DNA, 25 bp, Mus musculus
aagtcttagggcattccatgatggc

SEQ ID NO: 67555 - DNA, 25 bp, Mus musculus
aagtcttagggctcatttgcttgat

SEQ ID NO: 67556 - DNA, 25 bp, Mus musculus
aagtcttagggctttccatgatggc

SEQ ID NO: 67557 - DNA, 25 bp, Mus musculus
aagtcttatatcagaatctcatggt

SEQ ID NO: 67558 - DNA, 25 bp, Mus musculus
aagtcttatatctgaatctcatggt

SEQ ID NO: 67559 - DNA, 25 bp, Mus musculus
aagtcttatgatactgggatcgcta

SEQ ID NO: 67560 - DNA, 25 bp, Mus musculus
aagtcttatgattctgggatcgcta

SEQ ID NO: 67561 - DNA, 25 bp, Mus musculus
aagtcttatgcgctgggagttcttt

SEQ ID NO: 67562 - DNA, 25 bp, Mus musculus
aagtcttatgcggtgggagttcttt

SEQ ID NO: 67563 - DNA, 25 bp, Mus musculus
aagtcttatgtgcatagaggcctaa

SEQ ID NO: 67564 - DNA, 25 bp, Mus musculus
aagtcttatgtggatagaggcctaa

SEQ ID NO: 67565 - DNA, 25 bp, Mus musculus
aagtcttattaccttgctcaggctg

SEQ ID NO: 67566 - DNA, 25 bp, Mus musculus
aagtcttattacgttgctcaggctg

SEQ ID NO: 67567 - DNA, 25 bp, Mus musculus
aagtcttattatactctgcgagcct

SEQ ID NO: 67568 - DNA, 25 bp, Mus musculus
aagtcttattattctctgcgagcct

SEQ ID NO: 67569 - DNA, 25 bp, Mus musculus
aagtcttatttgcaccttgtttggt

SEQ ID NO: 67570 - DNA, 25 bp, Mus musculus
aagtcttatttggaccttgtttggt

SEQ ID NO: 67571 - DNA, 25 bp, Mus musculus
aagtcttcaaaaaacagtccatttc

SEQ ID NO: 67572 - DNA, 25 bp, Mus musculus
aagtcttcaaaatacagtccatttc

SEQ ID NO: 67573 - DNA, 25 bp, Mus musculus
aagtcttcaaacaacctcagagcct

SEQ ID NO: 67574 - DNA, 25 bp, Mus musculus
aagtcttcaaactacctcagagcct

SEQ ID NO: 67575 - DNA, 25 bp, Mus musculus
aagtcttcaactcctcggccagagc

SEQ ID NO: 67576 - DNA, 25 bp, Mus musculus
aagtcttcaactgctcggccagagc

SEQ ID NO: 67577 - DNA, 25 bp, Mus musculus
aagtcttcacacaggctatccagtg

SEQ ID NO: 67578 - DNA, 25 bp, Mus musculus
aagtcttcacactggctatccagtg

SEQ ID NO: 67579 - DNA, 25 bp, Mus musculus
aagtcttcaccaaggtcccacagaa

SEQ ID NO: 67580 - DNA, 25 bp, Mus musculus
aagtcttcaccatggtcccacagaa

SEQ ID NO: 67581 - DNA, 25 bp, Mus musculus
aagtcttcagaaatgctccagcaga

SEQ ID NO: 67582 - DNA, 25 bp, Mus musculus
aagtcttcagaattgctccagcaga

SEQ ID NO: 67583 - DNA, 25 bp, Mus musculus
aagtcttcagatcacacacctctgc

SEQ ID NO: 67584 - DNA, 25 bp, Mus musculus
aagtcttcagatgacacacctctgc

SEQ ID NO: 67585 - DNA, 25 bp, Mus musculus
aagtcttcagccctctacacggatt

SEQ ID NO: 67586 - DNA, 25 bp, Mus musculus
aagtcttcagccgtctacacggatt

SEQ ID NO: 67587 - DNA, 25 bp, Mus musculus
aagtcttcagctccttgatggataa

SEQ ID NO: 67588 - DNA, 25 bp, Mus musculus
aagtcttcagctgcttgatggataa

SEQ ID NO: 67589 - DNA, 25 bp, Mus musculus
aagtcttcaggccagactccaggca

SEQ ID NO: 67590 - DNA, 25 bp, Mus musculus
aagtcttcaggcgagactccaggca

SEQ ID NO: 67591 - DNA, 25 bp, Mus musculus
aagtcttcatcgaggcatgagcggg

SEQ ID NO: 67592 - DNA, 25 bp, Mus musculus
aagtcttcatcgtggcatgagcggg

SEQ ID NO: 67593 - DNA, 25 bp, Mus musculus
aagtcttcatttcagctgagtggct

SEQ ID NO: 67594 - DNA, 25 bp, Mus musculus
aagtcttcatttcccagctactaag

SEQ ID NO: 67595 - DNA, 25 bp, Mus musculus
aagtcttcatttgagctgagtggct

SEQ ID NO: 67596 - DNA, 25 bp, Mus musculus
aagtcttcatttgccagctactaag

SEQ ID NO: 67597 - DNA, 25 bp, Mus musculus
aagtcttccaacctggagcgacatt

SEQ ID NO: 67598 - DNA, 25 bp, Mus musculus
aagtcttccaacgtggagcgacatt

SEQ ID NO: 67599 - DNA, 25 bp, Mus musculus
aagtcttccactcagcagttcagga

SEQ ID NO: 67600 - DNA, 25 bp, Mus musculus
aagtcttccactgagcagttcagga

SEQ ID NO: 67601 - DNA, 25 bp, Mus musculus
aagtcttccataatctgtgtttgta

SEQ ID NO: 67602 - DNA, 25 bp, Mus musculus
aagtcttccatattctgtgtttgta

SEQ ID NO: 67603 - DNA, 25 bp, Mus musculus
aagtcttccattacagtcagctgtt

SEQ ID NO: 67604 - DNA, 25 bp, Mus musculus
aagtcttccatttcagtcagctgtt

SEQ ID NO: 67605 - DNA, 25 bp, Mus musculus
aagtcttccggtcgcggcgaccaat

SEQ ID NO: 67606 - DNA, 25 bp, Mus musculus
aagtcttccggtggcggcgaccaat

SEQ ID NO: 67607 - DNA, 25 bp, Mus musculus
aagtcttcctcgctcctgaatttga

SEQ ID NO: 67608 - DNA, 25 bp, Mus musculus
aagtcttcctcggtcctgaatttga

SEQ ID NO: 67609 - DNA, 25 bp, Mus musculus
aagtcttcgagtaacaagtctaaag

SEQ ID NO: 67610 - DNA, 25 bp, Mus musculus
aagtcttcgagttacaagtctaaag

SEQ ID NO: 67611 - DNA, 25 bp, Mus musculus
aagtcttctaaaagtaatgagctta

SEQ ID NO: 67612 - DNA, 25 bp, Mus musculus
aagtcttctaaatgtaatgagctta

SEQ ID NO: 67613 - DNA, 25 bp, Mus musculus
aagtcttctactcagtgggtcctgg

SEQ ID NO: 67614 - DNA, 25 bp, Mus musculus
aagtcttctactccggcccaggagg

SEQ ID NO: 67615 - DNA, 25 bp, Mus musculus
aagtcttctactgagtgggtcctgg

SEQ ID NO: 67616 - DNA, 25 bp, Mus musculus
aagtcttctactgcggcccaggagg

SEQ ID NO: 67617 - DNA, 25 bp, Mus musculus
aagtcttctgagctgtgacggctaa

SEQ ID NO: 67618 - DNA, 25 bp, Mus musculus
aagtcttctgaggtgtgacggctaa

SEQ ID NO: 67619 - DNA, 25 bp, Mus musculus
aagtcttctgatacagccttctaaa

SEQ ID NO: 67620 - DNA, 25 bp, Mus musculus
aagtcttctgattcagccttctaaa

SEQ ID NO: 67621 - DNA, 25 bp, Mus musculus
aagtcttctgtcataactacccaag

SEQ ID NO: 67622 - DNA, 25 bp, Mus musculus
aagtcttctgtcttaactacccaag

SEQ ID NO: 67623 - DNA, 25 bp, Mus musculus
aagtcttctgtgacttccatcaggg

SEQ ID NO: 67624 - DNA, 25 bp, Mus musculus
aagtcttctgtgcacctcagtcaag

SEQ ID NO: 67625 - DNA, 25 bp, Mus musculus
aagtcttctgtggacctcagtcaag

SEQ ID NO: 67626 - DNA, 25 bp, Mus musculus
aagtcttctgtgtcttccatcaggg

SEQ ID NO: 67627 - DNA, 25 bp, Mus musculus
aagtcttctgttatagttggctatt

SEQ ID NO: 67628 - DNA, 25 bp, Mus musculus
aagtcttctgttttagttggctatt

SEQ ID NO: 67629 - DNA, 25 bp, Mus musculus
aagtcttcttcaaggttcagtttaa

SEQ ID NO: 67630 - DNA, 25 bp, Mus musculus
aagtcttcttcatggttcagtttaa

SEQ ID NO: 67631 - DNA, 25 bp, Mus musculus
aagtcttcttccacatttctgggta

SEQ ID NO: 67632 - DNA, 25 bp, Mus musculus
aagtcttcttcctcatttctgggta

SEQ ID NO: 67633 - DNA, 25 bp, Mus musculus
aagtcttgagatctccaacatgcaa

SEQ ID NO: 67634 - DNA, 25 bp, Mus musculus
aagtcttgagatgtccaacatgcaa

SEQ ID NO: 67635 - DNA, 25 bp, Mus musculus
aagtcttgagctcaggtcttcatgc

SEQ ID NO: 67636 - DNA, 25 bp, Mus musculus
aagtcttgagctgaggtcttcatgc

SEQ ID NO: 67637 - DNA, 25 bp, Mus musculus
aagtcttgagtgactgtttgcagtc

SEQ ID NO: 67638 - DNA, 25 bp, Mus musculus
aagtcttgagtgtctgtttgcagtc

SEQ ID NO: 67639 - DNA, 25 bp, Mus musculus
aagtcttgatttacttcatcagtaa

SEQ ID NO: 67640 - DNA, 25 bp, Mus musculus
aagtcttgattttcttcatcagtaa

SEQ ID NO: 67641 - DNA, 25 bp, Mus musculus
aagtcttgccctcgaactgctgtag

SEQ ID NO: 67642 - DNA, 25 bp, Mus musculus
aagtcttgccctggaactgctgtag

SEQ ID NO: 67643 - DNA, 25 bp, Mus musculus
aagtcttgctagcagcgaaccacac

SEQ ID NO: 67644 - DNA, 25 bp, Mus musculus
aagtcttgctaggagcgaaccacac

SEQ ID NO: 67645 - DNA, 25 bp, Mus musculus
aagtcttgctttctcttggccttca

SEQ ID NO: 67646 - DNA, 25 bp, Mus musculus
aagtcttgctttgtcttggccttca

SEQ ID NO: 67647 - DNA, 25 bp, Mus musculus
aagtcttggaagaatttgctcaaac

SEQ ID NO: 67648 - DNA, 25 bp, Mus musculus
aagtcttggaagtatttgctcaaac

SEQ ID NO: 67649 - DNA, 25 bp, Mus musculus
aagtcttggagaattttgccagcat

SEQ ID NO: 67650 - DNA, 25 bp, Mus musculus
aagtcttggagatttttgccagcat

SEQ ID NO: 67651 - DNA, 25 bp, Mus musculus
aagtcttggagcacggaactctacc

SEQ ID NO: 67652 - DNA, 25 bp, Mus musculus
aagtcttggagctcggaactctacc

SEQ ID NO: 67653 - DNA, 25 bp, Mus musculus
aagtcttggcccaacccagagaaat

SEQ ID NO: 67654 - DNA, 25 bp, Mus musculus
aagtcttggccctacccagagaaat

SEQ ID NO: 67655 - DNA, 25 bp, Mus musculus
aagtcttggcggacacagggctgct

SEQ ID NO: 67656 - DNA, 25 bp, Mus musculus
aagtcttggcggtcacagggctgct

SEQ ID NO: 67657 - DNA, 25 bp, Mus musculus
aagtcttggctgacagtgcccagga

SEQ ID NO: 67658 - DNA, 25 bp, Mus musculus
aagtcttggctgtcagtgcccagga

SEQ ID NO: 67659 - DNA, 25 bp, Mus musculus
aagtcttggcttcagttttcagcat

SEQ ID NO: 67660 - DNA, 25 bp, Mus musculus
aagtcttggcttgagttttcagcat

SEQ ID NO: 67661 - DNA, 25 bp, Mus musculus
aagtcttgggcacgtgtgtgtcttt

SEQ ID NO: 67662 - DNA, 25 bp, Mus musculus
aagtcttgggcaggtgtgtgtcttt

SEQ ID NO: 67663 - DNA, 25 bp, Mus musculus
aagtcttgggccaaactgttgagct

SEQ ID NO: 67664 - DNA, 25 bp, Mus musculus
aagtcttgggcctaactgttgagct

SEQ ID NO: 67665 - DNA, 25 bp, Mus musculus
aagtcttgtcagacctttatcagct

SEQ ID NO: 67666 - DNA, 25 bp, Mus musculus
aagtcttgtcagtcctttatcagct

SEQ ID NO: 67667 - DNA, 25 bp, Mus musculus
aagtcttgtctacatacagaaccca

SEQ ID NO: 67668 - DNA, 25 bp, Mus musculus
aagtcttgtctaccaccgtgagaat

SEQ ID NO: 67669 - DNA, 25 bp, Mus musculus
aagtcttgtctagatacagaaccca

SEQ ID NO: 67670 - DNA, 25 bp, Mus musculus
aagtcttgtctagcaccgtgagaat

SEQ ID NO: 67671 - DNA, 25 bp, Mus musculus
aagtcttgtttgcagaccttccttg

SEQ ID NO: 67672 - DNA, 25 bp, Mus musculus
aagtcttgtttggagaccttccttg

SEQ ID NO: 67673 - DNA, 25 bp, Mus musculus
aagtctttaagcactgtgccaatgt

SEQ ID NO: 67674 - DNA, 25 bp, Mus musculus
aagtctttaagctctgtgccaatgt

SEQ ID NO: 67675 - DNA, 25 bp, Mus musculus
aagtctttactaacagtcactggga

SEQ ID NO: 67676 - DNA, 25 bp, Mus musculus
aagtctttactatcagtcactggga

SEQ ID NO: 67677 - DNA, 25 bp, Mus musculus
aagtctttactcagccctggcaagg

SEQ ID NO: 67678 - DNA, 25 bp, Mus musculus
aagtctttactctgccctggcaagg

SEQ ID NO: 67679 - DNA, 25 bp, Mus musculus
aagtctttagtcattccagacggat

SEQ ID NO: 67680 - DNA, 25 bp, Mus musculus
aagtctttagtctttccagacggat

SEQ ID NO: 67681 - DNA, 25 bp, Mus musculus
aagtctttcactcctggagggtgca

SEQ ID NO: 67682 - DNA, 25 bp, Mus musculus
aagtctttcactgctggagggtgca

SEQ ID NO: 67683 - DNA, 25 bp, Mus musculus
aagtctttcataccactgtctagct

SEQ ID NO: 67684 - DNA, 25 bp, Mus musculus
aagtctttcatagcactgtctagct

SEQ ID NO: 67685 - DNA, 25 bp, Mus musculus
aagtctttcatccttcagaagtaca

SEQ ID NO: 67686 - DNA, 25 bp, Mus musculus
aagtctttcatcgttcagaagtaca

SEQ ID NO: 67687 - DNA, 25 bp, Mus musculus
aagtctttcattcaccccaggtgaa

SEQ ID NO: 67688 - DNA, 25 bp, Mus musculus
aagtctttcattccacttcactggg

SEQ ID NO: 67689 - DNA, 25 bp, Mus musculus
aagtctttcattgaccccaggtgaa

SEQ ID NO: 67690 - DNA, 25 bp, Mus musculus
aagtctttcattgcacttcactggg

SEQ ID NO: 67691 - DNA, 25 bp, Mus musculus
aagtctttcccacctaaccaagtgg

SEQ ID NO: 67692 - DNA, 25 bp, Mus musculus
aagtctttcccagctaaccaagtgg

SEQ ID NO: 67693 - DNA, 25 bp, Mus musculus
aagtctttcctgctgggtgcatgtg

SEQ ID NO: 67694 - DNA, 25 bp, Mus musculus
aagtctttcctggtgggtgcatgtg

SEQ ID NO: 67695 - DNA, 25 bp, Mus musculus
aagtctttgagcaagccagtccagg

SEQ ID NO: 67696 - DNA, 25 bp, Mus musculus
aagtctttgagctagccagtccagg

SEQ ID NO: 67697 - DNA, 25 bp, Mus musculus
aagtctttgcaacctcagttatagg

SEQ ID NO: 67698 - DNA, 25 bp, Mus musculus
aagtctttgcaagctcagttatagg

SEQ ID NO: 67699 - DNA, 25 bp, Mus musculus
aagtctttgcggaatcgctacctga

SEQ ID NO: 67700 - DNA, 25 bp, Mus musculus
aagtctttgcggtatcgctacctga

SEQ ID NO: 67701 - DNA, 25 bp, Mus musculus
aagtctttggagcaatcctctacac

SEQ ID NO: 67702 - DNA, 25 bp, Mus musculus
aagtctttggaggaatcctctacac

SEQ ID NO: 67703 - DNA, 25 bp, Mus musculus
aagtctttggctagatctgtacagc

SEQ ID NO: 67704 - DNA, 25 bp, Mus musculus
aagtctttggcttgatctgtacagc

SEQ ID NO: 67705 - DNA, 25 bp, Mus musculus
aagtctttgtgcacccagcgtttta

SEQ ID NO: 67706 - DNA, 25 bp, Mus musculus
aagtctttgtgctcccagcgtttta

SEQ ID NO: 67707 - DNA, 25 bp, Mus musculus
aagtctttgtgtatcatccttaagc

SEQ ID NO: 67708 - DNA, 25 bp, Mus musculus
aagtctttgtgtttcatccttaagc

SEQ ID NO: 67709 - DNA, 25 bp, Mus musculus
aagtcttttaccatgtctctgacat

SEQ ID NO: 67710 - DNA, 25 bp, Mus musculus
aagtcttttaccttgtctctgacat

SEQ ID NO: 67711 - DNA, 25 bp, Mus musculus
aagtcttttcctccagagtgatcct

SEQ ID NO: 67712 - DNA, 25 bp, Mus musculus
aagtcttttcctgcagagtgatcct

SEQ ID NO: 67713 - DNA, 25 bp, Mus musculus
aagtcttttcgcctgctcagtggtc

SEQ ID NO: 67714 - DNA, 25 bp, Mus musculus
aagtcttttcgcgtgctcagtggtc

SEQ ID NO: 67715 - DNA, 25 bp, Mus musculus
aagtcttttctcataagttgagcaa

SEQ ID NO: 67716 - DNA, 25 bp, Mus musculus
aagtcttttctcttaagttgagcaa

SEQ ID NO: 67717 - DNA, 25 bp, Mus musculus
aagtcttttgttcctgtttcagaag

SEQ ID NO: 67718 - DNA, 25 bp, Mus musculus
aagtcttttgttgctgtttcagaag

SEQ ID NO: 67719 - DNA, 25 bp, Mus musculus
aagtgaaaacatctccaggtctcta

SEQ ID NO: 67720 - DNA, 25 bp, Mus musculus
aagtgaaaacatgtccaggtctcta

SEQ ID NO: 67721 - DNA, 25 bp, Mus musculus
aagtgaaaagcacggccctcaagcc

SEQ ID NO: 67722 - DNA, 25 bp, Mus musculus
aagtgaaaagcagggccctcaagcc

SEQ ID NO: 67723 - DNA, 25 bp, Mus musculus
aagtgaaaccctacactaaatggca

SEQ ID NO: 67724 - DNA, 25 bp, Mus musculus
aagtgaaacccttcactaaatggca

SEQ ID NO: 67725 - DNA, 25 bp, Mus musculus
aagtgaaacctcactcacggccaca

SEQ ID NO: 67726 - DNA, 25 bp, Mus musculus
aagtgaaacctctctcacggccaca

SEQ ID NO: 67727 - DNA, 25 bp, Mus musculus
aagtgaaagaccagtccgctcgtag

SEQ ID NO: 67728 - DNA, 25 bp, Mus musculus
aagtgaaagacctgtccgctcgtag

SEQ ID NO: 67729 - DNA, 25 bp, Mus musculus
aagtgaaaggataaccttcagtgtt

SEQ ID NO: 67730 - DNA, 25 bp, Mus musculus
aagtgaaaggattaccttcagtgtt

SEQ ID NO: 67731 - DNA, 25 bp, Mus musculus
aagtgaaagttgcttcgccctgtca

SEQ ID NO: 67732 - DNA, 25 bp, Mus musculus
aagtgaaagttggttcgccctgtca

SEQ ID NO: 67733 - DNA, 25 bp, Mus musculus
aagtgaaatccccttcagactacag

SEQ ID NO: 67734 - DNA, 25 bp, Mus musculus
aagtgaaatcccgttcagactacag

SEQ ID NO: 67735 - DNA, 25 bp, Mus musculus
aagtgaaattatccctatgtgtcta

SEQ ID NO: 67736 - DNA, 25 bp, Mus musculus
aagtgaaattatgcctatgtgtcta

SEQ ID NO: 67737 - DNA, 25 bp, Mus musculus
aagtgaacacatagggcattttgga

SEQ ID NO: 67738 - DNA, 25 bp, Mus musculus
aagtgaacacattgggcattttgga

SEQ ID NO: 67739 - DNA, 25 bp, Mus musculus
aagtgaacatccaggagtggctgca

SEQ ID NO: 67740 - DNA, 25 bp, Mus musculus
aagtgaacatcccacactggcagat

SEQ ID NO: 67741 - DNA, 25 bp, Mus musculus
aagtgaacatccgacactggcagat

SEQ ID NO: 67742 - DNA, 25 bp, Mus musculus
aagtgaacatcctggagtggctgca

SEQ ID NO: 67743 - DNA, 25 bp, Mus musculus
aagtgaaccaatcccctgtgtcctg

SEQ ID NO: 67744 - DNA, 25 bp, Mus musculus
aagtgaaccaatgccctgtgtcctg

SEQ ID NO: 67745 - DNA, 25 bp, Mus musculus
aagtgaacccagctgagactcagat

SEQ ID NO: 67746 - DNA, 25 bp, Mus musculus
aagtgaacccaggtgagactcagat

SEQ ID NO: 67747 - DNA, 25 bp, Mus musculus
aagtgaaccccaagactgcatttcc

SEQ ID NO: 67748 - DNA, 25 bp, Mus musculus
aagtgaaccccatgactgcatttcc

SEQ ID NO: 67749 - DNA, 25 bp, Mus musculus
aagtgaaccgctaggacatgtatgg

SEQ ID NO: 67750 - DNA, 25 bp, Mus musculus
aagtgaaccgcttggacatgtatgg

SEQ ID NO: 67751 - DNA, 25 bp, Mus musculus
aagtgaacggtcagtgtcctgcttt

SEQ ID NO: 67752 - DNA, 25 bp, Mus musculus
aagtgaacggtctgtgtcctgcttt

SEQ ID NO: 67753 - DNA, 25 bp, Mus musculus
aagtgaactcacagtcatgactggg

SEQ ID NO: 67754 - DNA, 25 bp, Mus musculus
aagtgaactcactgtcatgactggg

SEQ ID NO: 67755 - DNA, 25 bp, Mus musculus
aagtgaactcttacgggcacccaca

SEQ ID NO: 67756 - DNA, 25 bp, Mus musculus
aagtgaactctttcgggcacccaca

SEQ ID NO: 67757 - DNA, 25 bp, Mus musculus
aagtgaacttatactgttactagag

SEQ ID NO: 67758 - DNA, 25 bp, Mus musculus
aagtgaacttattctgttactagag

SEQ ID NO: 67759 - DNA, 25 bp, Mus musculus
aagtgaagaacccacgtgatctgat

SEQ ID NO: 67760 - DNA, 25 bp, Mus musculus
aagtgaagaaccgacgtgatctgat

SEQ ID NO: 67761 - DNA, 25 bp, Mus musculus
aagtgaagagctatcagccgcgttt

SEQ ID NO: 67762 - DNA, 25 bp, Mus musculus
aagtgaagagctttcagccgcgttt

SEQ ID NO: 67763 - DNA, 25 bp, Mus musculus
aagtgaagccacagcgaaggcctct

SEQ ID NO: 67764 - DNA, 25 bp, Mus musculus
aagtgaagccactgcgaaggcctct

SEQ ID NO: 67765 - DNA, 25 bp, Mus musculus
aagtgaagccctagtgaacacagga

SEQ ID NO: 67766 - DNA, 25 bp, Mus musculus
aagtgaagcccttgtgaacacagga

SEQ ID NO: 67767 - DNA, 25 bp, Mus musculus
aagtgaagctttcccagatgccttt

SEQ ID NO: 67768 - DNA, 25 bp, Mus musculus
aagtgaagctttgccagatgccttt

SEQ ID NO: 67769 - DNA, 25 bp, Mus musculus
aagtgaaggccaactgtgtgctcgc

SEQ ID NO: 67770 - DNA, 25 bp, Mus musculus
aagtgaaggccatctgtgtgctcgc

SEQ ID NO: 67771 - DNA, 25 bp, Mus musculus
aagtgaaggtcacctgcctagccgt

SEQ ID NO: 67772 - DNA, 25 bp, Mus musculus
aagtgaaggtcagctgcctagccgt

SEQ ID NO: 67773 - DNA, 25 bp, Mus musculus
aagtgaagtatgagtctcatctccc

SEQ ID NO: 67774 - DNA, 25 bp, Mus musculus
aagtgaagtatgtgtctcatctccc

SEQ ID NO: 67775 - DNA, 25 bp, Mus musculus
aagtgaagtcccagccttctaggaa

SEQ ID NO: 67776 - DNA, 25 bp, Mus musculus
aagtgaagtcccattggtacccctg

SEQ ID NO: 67777 - DNA, 25 bp, Mus musculus
aagtgaagtccctgccttctaggaa

SEQ ID NO: 67778 - DNA, 25 bp, Mus musculus
aagtgaagtccctttggtacccctg

SEQ ID NO: 67779 - DNA, 25 bp, Mus musculus
aagtgaataactccagtgccagctc

SEQ ID NO: 67780 - DNA, 25 bp, Mus musculus
aagtgaataactgcagtgccagctc

SEQ ID NO: 67781 - DNA, 25 bp, Mus musculus
aagtgaatactgctcacgacagttt

SEQ ID NO: 67782 - DNA, 25 bp, Mus musculus
aagtgaatactggtcacgacagttt

SEQ ID NO: 67783 - DNA, 25 bp, Mus musculus
aagtgaatagtcattggtcctgttc

SEQ ID NO: 67784 - DNA, 25 bp, Mus musculus
aagtgaatagtctttggtcctgttc

SEQ ID NO: 67785 - DNA, 25 bp, Mus musculus
aagtgaatcgggaacaattagcaaa

SEQ ID NO: 67786 - DNA, 25 bp, Mus musculus
aagtgaatcgggtacaattagcaaa

SEQ ID NO: 67787 - DNA, 25 bp, Mus musculus
aagtgaatctgtcggcattttagcc

SEQ ID NO: 67788 - DNA, 25 bp, Mus musculus
aagtgaatctgtgggcattttagcc

SEQ ID NO: 67789 - DNA, 25 bp, Mus musculus
aagtgaatcttacttccccaaacag

SEQ ID NO: 67790 - DNA, 25 bp, Mus musculus
aagtgaatcttagttccccaaacag

SEQ ID NO: 67791 - DNA, 25 bp, Mus musculus
aagtgaatgacacccacgcgtggtc

SEQ ID NO: 67792 - DNA, 25 bp, Mus musculus
aagtgaatgacagccacgcgtggtc

SEQ ID NO: 67793 - DNA, 25 bp, Mus musculus
aagtgaatgatgaatatttcccatt

SEQ ID NO: 67794 - DNA, 25 bp, Mus musculus
aagtgaatgatgtatatttcccatt

SEQ ID NO: 67795 - DNA, 25 bp, Mus musculus
aagtgaatgcacaccgcagaggcat

SEQ ID NO: 67796 - DNA, 25 bp, Mus musculus
aagtgaatgcactccgcagaggcat

SEQ ID NO: 67797 - DNA, 25 bp, Mus musculus
aagtgaatgcttcatgccagccctc

SEQ ID NO: 67798 - DNA, 25 bp, Mus musculus
aagtgaatgcttgatgccagccctc

SEQ ID NO: 67799 - DNA, 25 bp, Mus musculus
aagtgaatggcgacctatgtccttt

SEQ ID NO: 67800 - DNA, 25 bp, Mus musculus
aagtgaatggcgtcctatgtccttt

SEQ ID NO: 67801 - DNA, 25 bp, Mus musculus
aagtgaatgtcccttgctggaagga

SEQ ID NO: 67802 - DNA, 25 bp, Mus musculus
aagtgaatgtccgttgctggaagga

SEQ ID NO: 67803 - DNA, 25 bp, Mus musculus
aagtgaatttatctctatcaggaat

SEQ ID NO: 67804 - DNA, 25 bp, Mus musculus
aagtgaatttatgtctatcaggaat

SEQ ID NO: 67805 - DNA, 25 bp, Mus musculus
aagtgaatttccagtaatgctgctg

SEQ ID NO: 67806 - DNA, 25 bp, Mus musculus
aagtgaatttcctgtaatgctgctg

SEQ ID NO: 67807 - DNA, 25 bp, Mus musculus
aagtgaattttgatccccttgattg

SEQ ID NO: 67808 - DNA, 25 bp, Mus musculus
aagtgaattttgttccccttgattg

SEQ ID NO: 67809 - DNA, 25 bp, Mus musculus
aagtgacaaaccaccttttcagaag

SEQ ID NO: 67810 - DNA, 25 bp, Mus musculus
aagtgacaaacctccttttcagaag

SEQ ID NO: 67811 - DNA, 25 bp, Mus musculus
aagtgacaagctcctttccagactc

SEQ ID NO: 67812 - DNA, 25 bp, Mus musculus
aagtgacaagctgctttccagactc

SEQ ID NO: 67813 - DNA, 25 bp, Mus musculus
aagtgacaatatcacactgctctct

SEQ ID NO: 67814 - DNA, 25 bp, Mus musculus
aagtgacaatatgacactgctctct

SEQ ID NO: 67815 - DNA, 25 bp, Mus musculus
aagtgacacactactgtttttctgt

SEQ ID NO: 67816 - DNA, 25 bp, Mus musculus
aagtgacacacttctgtttttctgt

SEQ ID NO: 67817 - DNA, 25 bp, Mus musculus
aagtgacaccaacgctatcctctga

SEQ ID NO: 67818 - DNA, 25 bp, Mus musculus
aagtgacaccaaggctatcctctga

SEQ ID NO: 67819 - DNA, 25 bp, Mus musculus
aagtgacacctaattcaatactata

SEQ ID NO: 67820 - DNA, 25 bp, Mus musculus
aagtgacacctatttcaatactata

SEQ ID NO: 67821 - DNA, 25 bp, Mus musculus
aagtgacacctcaactttctacggc

SEQ ID NO: 67822 - DNA, 25 bp, Mus musculus
aagtgacacctctactttctacggc

SEQ ID NO: 67823 - DNA, 25 bp, Mus musculus
aagtgacacctgacacctggtgatg

SEQ ID NO: 67824 - DNA, 25 bp, Mus musculus
aagtgacacctgtcacctggtgatg

SEQ ID NO: 67825 - DNA, 25 bp, Mus musculus
aagtgacactggagagaatgatggt

SEQ ID NO: 67826 - DNA, 25 bp, Mus musculus
aagtgacactggtgagaatgatggt

SEQ ID NO: 67827 - DNA, 25 bp, Mus musculus
aagtgacactgtaacactgtctgcc

SEQ ID NO: 67828 - DNA, 25 bp, Mus musculus
aagtgacactgtcgacctcggtcac

SEQ ID NO: 67829 - DNA, 25 bp, Mus musculus
aagtgacactgtggacctcggtcac

SEQ ID NO: 67830 - DNA, 25 bp, Mus musculus
aagtgacactgttacactgtctgcc

SEQ ID NO: 67831 - DNA, 25 bp, Mus musculus
aagtgacacttcaagtcttcggcat

SEQ ID NO: 67832 - DNA, 25 bp, Mus musculus
aagtgacacttctagtcttcggcat

SEQ ID NO: 67833 - DNA, 25 bp, Mus musculus
aagtgacagaccacatccttacctg

SEQ ID NO: 67834 - DNA, 25 bp, Mus musculus
aagtgacagacctcatccttacctg

SEQ ID NO: 67835 - DNA, 25 bp, Mus musculus
aagtgacagagaataatcccagcac

SEQ ID NO: 67836 - DNA, 25 bp, Mus musculus
aagtgacagagattaatcccagcac

SEQ ID NO: 67837 - DNA, 25 bp, Mus musculus
aagtgacaggtcagctgggcctgct

SEQ ID NO: 67838 - DNA, 25 bp, Mus musculus
aagtgacaggtctgctgggcctgct

SEQ ID NO: 67839 - DNA, 25 bp, Mus musculus
aagtgacagtaaactcagccccttg

SEQ ID NO: 67840 - DNA, 25 bp, Mus musculus
aagtgacagtaatctcagccccttg

SEQ ID NO: 67841 - DNA, 25 bp, Mus musculus
aagtgacagtagcatcctctcaggc

SEQ ID NO: 67842 - DNA, 25 bp, Mus musculus
aagtgacagtaggatcctctcaggc

SEQ ID NO: 67843 - DNA, 25 bp, Mus musculus
aagtgacagtctcaaggcctgcagc

SEQ ID NO: 67844 - DNA, 25 bp, Mus musculus
aagtgacagtctgaaggcctgcagc

SEQ ID NO: 67845 - DNA, 25 bp, Mus musculus
aagtgacatgatctggccaaaaatc

SEQ ID NO: 67846 - DNA, 25 bp, Mus musculus
aagtgacatgatgtggccaaaaatc

SEQ ID NO: 67847 - DNA, 25 bp, Mus musculus
aagtgacatgttaccacgccattag

SEQ ID NO: 67848 - DNA, 25 bp, Mus musculus
aagtgacatgtttccacgccattag

SEQ ID NO: 67849 - DNA, 25 bp, Mus musculus
aagtgacattgaagggtgtcccctc

SEQ ID NO: 67850 - DNA, 25 bp, Mus musculus
aagtgacattgatgggtgtcccctc

SEQ ID NO: 67851 - DNA, 25 bp, Mus musculus
aagtgaccaaacatctcattttgat

SEQ ID NO: 67852 - DNA, 25 bp, Mus musculus
aagtgaccaaacttctcattttgat

SEQ ID NO: 67853 - DNA, 25 bp, Mus musculus
aagtgaccagcacggctatcgtgga

SEQ ID NO: 67854 - DNA, 25 bp, Mus musculus
aagtgaccagcagggctatcgtgga

SEQ ID NO: 67855 - DNA, 25 bp, Mus musculus
aagtgaccagctacaggatgtcttc

SEQ ID NO: 67856 - DNA, 25 bp, Mus musculus
aagtgaccagcttcaggatgtcttc

SEQ ID NO: 67857 - DNA, 25 bp, Mus musculus
aagtgaccagtcatccaaggacatg

SEQ ID NO: 67858 - DNA, 25 bp, Mus musculus
aagtgaccagtcttccaaggacatg

SEQ ID NO: 67859 - DNA, 25 bp, Mus musculus
aagtgacccaacagtttgtcgccca

SEQ ID NO: 67860 - DNA, 25 bp, Mus musculus
aagtgacccaactgtttgtcgccca

SEQ ID NO: 67861 - DNA, 25 bp, Mus musculus
aagtgacccaagaaatcagtgttta

SEQ ID NO: 67862 - DNA, 25 bp, Mus musculus
aagtgacccaagtaatcagtgttta

SEQ ID NO: 67863 - DNA, 25 bp, Mus musculus
aagtgacccctcctgttaatcctag

SEQ ID NO: 67864 - DNA, 25 bp, Mus musculus
aagtgacccctcgtgttaatcctag

SEQ ID NO: 67865 - DNA, 25 bp, Mus musculus
aagtgaccctgtacagtatctgctt

SEQ ID NO: 67866 - DNA, 25 bp, Mus musculus
aagtgaccctgtcaaatcctccttt

SEQ ID NO: 67867 - DNA, 25 bp, Mus musculus
aagtgaccctgtctggcacgagcaa

SEQ ID NO: 67868 - DNA, 25 bp, Mus musculus
aagtgaccctgtgaaatcctccttt

SEQ ID NO: 67869 - DNA, 25 bp, Mus musculus
aagtgaccctgtgtggcacgagcaa

SEQ ID NO: 67870 - DNA, 25 bp, Mus musculus
aagtgaccctgttcagtatctgctt

SEQ ID NO: 67871 - DNA, 25 bp, Mus musculus
aagtgaccgacacacgtgcgtgaga

SEQ ID NO: 67872 - DNA, 25 bp, Mus musculus
aagtgaccgacaccacgtgccgtga

SEQ ID NO: 67873 - DNA, 25 bp, Mus musculus
aagtgaccgacagacgtgcgtgaga

SEQ ID NO: 67874 - DNA, 25 bp, Mus musculus
aagtgaccgacagcacgtgccgtga

SEQ ID NO: 67875 - DNA, 25 bp, Mus musculus
aagtgaccgatccaaagctcttaga

SEQ ID NO: 67876 - DNA, 25 bp, Mus musculus
aagtgaccgatcgaaagctcttaga

SEQ ID NO: 67877 - DNA, 25 bp, Mus musculus
aagtgaccggtcatggacagctgtg

SEQ ID NO: 67878 - DNA, 25 bp, Mus musculus
aagtgaccggtcttggacagctgtg

SEQ ID NO: 67879 - DNA, 25 bp, Mus musculus
aagtgacctcacctacggcaaatga

SEQ ID NO: 67880 - DNA, 25 bp, Mus musculus
aagtgacctcacgtacggcaaatga

SEQ ID NO: 67881 - DNA, 25 bp, Mus musculus
aagtgacctccgctgagccatttcc

SEQ ID NO: 67882 - DNA, 25 bp, Mus musculus
aagtgacctccggtgagccatttcc

SEQ ID NO: 67883 - DNA, 25 bp, Mus musculus
aagtgacctgccagctcatctgggt

SEQ ID NO: 67884 - DNA, 25 bp, Mus musculus
aagtgacctgcctgctcatctgggt

SEQ ID NO: 67885 - DNA, 25 bp, Mus musculus
aagtgacctgtgattagcctaccca

SEQ ID NO: 67886 - DNA, 25 bp, Mus musculus
aagtgacctgtgtttagcctaccca

SEQ ID NO: 67887 - DNA, 25 bp, Mus musculus
aagtgaccttctaggacaccacgtg

SEQ ID NO: 67888 - DNA, 25 bp, Mus musculus
aagtgaccttctcacatccatgaca

SEQ ID NO: 67889 - DNA, 25 bp, Mus musculus
aagtgaccttctgacatccatgaca

SEQ ID NO: 67890 - DNA, 25 bp, Mus musculus
aagtgaccttcttggacaccacgtg

SEQ ID NO: 67891 - DNA, 25 bp, Mus musculus
aagtgaccttgtatttatcttgtgt

SEQ ID NO: 67892 - DNA, 25 bp, Mus musculus
aagtgaccttgtttttatcttgtgt

SEQ ID NO: 67893 - DNA, 25 bp, Mus musculus
aagtgacctttgagagctaccggcc

SEQ ID NO: 67894 - DNA, 25 bp, Mus musculus
aagtgacctttgtgagctaccggcc

SEQ ID NO: 67895 - DNA, 25 bp, Mus musculus
aagtgaccttttcatgcgcggcagg

SEQ ID NO: 67896 - DNA, 25 bp, Mus musculus
aagtgaccttttcattgcaagttaa

SEQ ID NO: 67897 - DNA, 25 bp, Mus musculus
aagtgaccttttgatgcgcggcagg

SEQ ID NO: 67898 - DNA, 25 bp, Mus musculus
aagtgaccttttgattgcaagttaa

SEQ ID NO: 67899 - DNA, 25 bp, Mus musculus
aagtgacgaagtcattgctgtggcc

SEQ ID NO: 67900 - DNA, 25 bp, Mus musculus
aagtgacgaagtgattgctgtggcc

SEQ ID NO: 67901 - DNA, 25 bp, Mus musculus
aagtgacgacgaattggtgccctca

SEQ ID NO: 67902 - DNA, 25 bp, Mus musculus
aagtgacgacgatttggtgccctca

SEQ ID NO: 67903 - DNA, 25 bp, Mus musculus
aagtgacgcaagagtttctggtcgg

SEQ ID NO: 67904 - DNA, 25 bp, Mus musculus
aagtgacgcaagtgtttctggtcgg

SEQ ID NO: 67905 - DNA, 25 bp, Mus musculus
aagtgacgctcaagcttttgatgat

SEQ ID NO: 67906 - DNA, 25 bp, Mus musculus
aagtgacgctcatgcttttgatgat

SEQ ID NO: 67907 - DNA, 25 bp, Mus musculus
aagtgacgtcttaccctaatatgag

SEQ ID NO: 67908 - DNA, 25 bp, Mus musculus
aagtgacgtctttccctaatatgag

SEQ ID NO: 67909 - DNA, 25 bp, Mus musculus
aagtgacgtggcagttctgatcctc

SEQ ID NO: 67910 - DNA, 25 bp, Mus musculus
aagtgacgtggctgttctgatcctc

SEQ ID NO: 67911 - DNA, 25 bp, Mus musculus
aagtgacgtgttattaatgcgttca

SEQ ID NO: 67912 - DNA, 25 bp, Mus musculus
aagtgacgtgtttttaatgcgttca

SEQ ID NO: 67913 - DNA, 25 bp, Mus musculus
aagtgactaagccactgggtttctt

SEQ ID NO: 67914 - DNA, 25 bp, Mus musculus
aagtgactaagcgactgggtttctt

SEQ ID NO: 67915 - DNA, 25 bp, Mus musculus
aagtgactaatgacctcaagaggtt

SEQ ID NO: 67916 - DNA, 25 bp, Mus musculus
aagtgactaatgtcctcaagaggtt

SEQ ID NO: 67917 - DNA, 25 bp, Mus musculus
aagtgactaccacttatttctaaat

SEQ ID NO: 67918 - DNA, 25 bp, Mus musculus
aagtgactaccagttatttctaaat

SEQ ID NO: 67919 - DNA, 25 bp, Mus musculus
aagtgactattcaagaacaggctgt

SEQ ID NO: 67920 - DNA, 25 bp, Mus musculus
aagtgactattctagaacaggctgt

SEQ ID NO: 67921 - DNA, 25 bp, Mus musculus
aagtgactcaataactactctttct

SEQ ID NO: 67922 - DNA, 25 bp, Mus musculus
aagtgactcaattactactctttct

SEQ ID NO: 67923 - DNA, 25 bp, Mus musculus
aagtgactcactctggtggccgtga

SEQ ID NO: 67924 - DNA, 25 bp, Mus musculus
aagtgactcactgtggtggccgtga

SEQ ID NO: 67925 - DNA, 25 bp, Mus musculus
aagtgactcagtactaccagaagat

SEQ ID NO: 67926 - DNA, 25 bp, Mus musculus
aagtgactcagttctaccagaagat

SEQ ID NO: 67927 - DNA, 25 bp, Mus musculus
aagtgactcccaccaaggcagtgtg

SEQ ID NO: 67928 - DNA, 25 bp, Mus musculus
aagtgactcccagcaaggcagtgtg

SEQ ID NO: 67929 - DNA, 25 bp, Mus musculus
aagtgactctagacctgatcacagg

SEQ ID NO: 67930 - DNA, 25 bp, Mus musculus
aagtgactctagtcctgatcacagg

SEQ ID NO: 67931 - DNA, 25 bp, Mus musculus
aagtgactctgaatctcttgtgatc

SEQ ID NO: 67932 - DNA, 25 bp, Mus musculus
aagtgactctgattctcttgtgatc

SEQ ID NO: 67933 - DNA, 25 bp, Mus musculus
aagtgactctggaggagttcccgca

SEQ ID NO: 67934 - DNA, 25 bp, Mus musculus
aagtgactctggtggagttcccgca

SEQ ID NO: 67935 - DNA, 25 bp, Mus musculus
aagtgactctgtagacgtgctctgt

SEQ ID NO: 67936 - DNA, 25 bp, Mus musculus
aagtgactctgtctactctcacgtt

SEQ ID NO: 67937 - DNA, 25 bp, Mus musculus
aagtgactctgtgtactctcacgtt

SEQ ID NO: 67938 - DNA, 25 bp, Mus musculus
aagtgactctgttgacgtgctctgt

SEQ ID NO: 67939 - DNA, 25 bp, Mus musculus
aagtgactcttaaacgtatagccag

SEQ ID NO: 67940 - DNA, 25 bp, Mus musculus
aagtgactcttatacgtatagccag

SEQ ID NO: 67941 - DNA, 25 bp, Mus musculus
aagtgactgaggcatatctgttaga

SEQ ID NO: 67942 - DNA, 25 bp, Mus musculus
aagtgactgagggatatctgttaga

SEQ ID NO: 67943 - DNA, 25 bp, Mus musculus
aagtgactgcgtaggctgtggttct

SEQ ID NO: 67944 - DNA, 25 bp, Mus musculus
aagtgactgcgttggctgtggttct

SEQ ID NO: 67945 - DNA, 25 bp, Mus musculus
aagtgactgctactgatctgagtgc

SEQ ID NO: 67946 - DNA, 25 bp, Mus musculus
aagtgactgctagtgatctgagtgc

SEQ ID NO: 67947 - DNA, 25 bp, Mus musculus
aagtgactgcttccggttccaggac

SEQ ID NO: 67948 - DNA, 25 bp, Mus musculus
aagtgactgcttgcggttccaggac

SEQ ID NO: 67949 - DNA, 25 bp, Mus musculus
aagtgactggacaccttacaggttc

SEQ ID NO: 67950 - DNA, 25 bp, Mus musculus
aagtgactggactccttacaggttc

SEQ ID NO: 67951 - DNA, 25 bp, Mus musculus
aagtgactgggcctgcagctactgc

SEQ ID NO: 67952 - DNA, 25 bp, Mus musculus
aagtgactgggcgtgcagctactgc

SEQ ID NO: 67953 - DNA, 25 bp, Mus musculus
aagtgactggttcaatctcattaca

SEQ ID NO: 67954 - DNA, 25 bp, Mus musculus
aagtgactggttgaatctcattaca

SEQ ID NO: 67955 - DNA, 25 bp, Mus musculus
aagtgactgtatctacacctcgtac

SEQ ID NO: 67956 - DNA, 25 bp, Mus musculus
aagtgactgtatgtacacctcgtac

SEQ ID NO: 67957 - DNA, 25 bp, Mus musculus
aagtgactgtccagggctagtgaga

SEQ ID NO: 67958 - DNA, 25 bp, Mus musculus
aagtgactgtcctgggctagtgaga

SEQ ID NO: 67959 - DNA, 25 bp, Mus musculus
aagtgacttcagacggctccattct

SEQ ID NO: 67960 - DNA, 25 bp, Mus musculus
aagtgacttcagtcggctccattct

SEQ ID NO: 67961 - DNA, 25 bp, Mus musculus
aagtgacttcatagagcttcagagt

SEQ ID NO: 67962 - DNA, 25 bp, Mus musculus
aagtgacttcattgagcttcagagt

SEQ ID NO: 67963 - DNA, 25 bp, Mus musculus
aagtgacttccacagtagtgttact

SEQ ID NO: 67964 - DNA, 25 bp, Mus musculus
aagtgacttccaccaaagtgtgtat

SEQ ID NO: 67965 - DNA, 25 bp, Mus musculus
aagtgacttccagagtagtgttact

SEQ ID NO: 67966 - DNA, 25 bp, Mus musculus
aagtgacttccagcaaagtgtgtat

SEQ ID NO: 67967 - DNA, 25 bp, Mus musculus
aagtgacttcggcagtggatcccaa

SEQ ID NO: 67968 - DNA, 25 bp, Mus musculus
aagtgacttcgggagtggatcccaa

SEQ ID NO: 67969 - DNA, 25 bp, Mus musculus
aagtgacttctgactgcttctaatg

SEQ ID NO: 67970 - DNA, 25 bp, Mus musculus
aagtgacttctgtctgcttctaatg

SEQ ID NO: 67971 - DNA, 25 bp, Mus musculus
aagtgacttgatagccgggcttaga

SEQ ID NO: 67972 - DNA, 25 bp, Mus musculus
aagtgacttgattgccgggcttaga

SEQ ID NO: 67973 - DNA, 25 bp, Mus musculus
aagtgacttggaattttatggcaga

SEQ ID NO: 67974 - DNA, 25 bp, Mus musculus
aagtgacttggatttttatggcaga

SEQ ID NO: 67975 - DNA, 25 bp, Mus musculus
aagtgacttgggacattcctctggc

SEQ ID NO: 67976 - DNA, 25 bp, Mus musculus
aagtgacttgggtcattcctctggc

SEQ ID NO: 67977 - DNA, 25 bp, Mus musculus
aagtgacttgtcacaccgaaaggac

SEQ ID NO: 67978 - DNA, 25 bp, Mus musculus
aagtgacttgtctcaccgaaaggac

SEQ ID NO: 67979 - DNA, 25 bp, Mus musculus
aagtgacttgtgaccagttcctgag

SEQ ID NO: 67980 - DNA, 25 bp, Mus musculus
aagtgacttgtgtccagttcctgag

SEQ ID NO: 67981 - DNA, 25 bp, Mus musculus
aagtgacttgttagtgtgggttctc

SEQ ID NO: 67982 - DNA, 25 bp, Mus musculus
aagtgacttgtttgtgtgggttctc

SEQ ID NO: 67983 - DNA, 25 bp, Mus musculus
aagtgactttccaggcaagctgcgc

SEQ ID NO: 67984 - DNA, 25 bp, Mus musculus
aagtgactttcctggcaagctgcgc

SEQ ID NO: 67985 - DNA, 25 bp, Mus musculus
aagtgactttctagtcccaggctct

SEQ ID NO: 67986 - DNA, 25 bp, Mus musculus
aagtgactttcttgtcccaggctct

SEQ ID NO: 67987 - DNA, 25 bp, Mus musculus
aagtgagaaactccagacctcctgc

SEQ ID NO: 67988 - DNA, 25 bp, Mus musculus
aagtgagaaactgcagacctcctgc

SEQ ID NO: 67989 - DNA, 25 bp, Mus musculus
aagtgagaacttaccctactgtgtt

SEQ ID NO: 67990 - DNA, 25 bp, Mus musculus
aagtgagaactttccctactgtgtt

SEQ ID NO: 67991 - DNA, 25 bp, Mus musculus
aagtgagaatacacctctgggatga

SEQ ID NO: 67992 - DNA, 25 bp, Mus musculus
aagtgagaatactcctctgggatga

SEQ ID NO: 67993 - DNA, 25 bp, Mus musculus
aagtgagaatgcataccatgtgtat

SEQ ID NO: 67994 - DNA, 25 bp, Mus musculus
aagtgagaatgcttaccatgtgtat

SEQ ID NO: 67995 - DNA, 25 bp, Mus musculus
aagtgagaatttagccccacggact

SEQ ID NO: 67996 - DNA, 25 bp, Mus musculus
aagtgagaattttgccccacggact

SEQ ID NO: 67997 - DNA, 25 bp, Mus musculus
aagtgagacccgagattcctaagtg

SEQ ID NO: 67998 - DNA, 25 bp, Mus musculus
aagtgagacccgtgattcctaagtg

SEQ ID NO: 67999 - DNA, 25 bp, Mus musculus
aagtgagacctgaccacttttggtt

SEQ ID NO: 68000 - DNA, 25 bp, Mus musculus
aagtgagacctgatctctacagaca

SEQ ID NO: 68001 - DNA, 25 bp, Mus musculus
aagtgagacctgtccacttttggtt

SEQ ID NO: 68002 - DNA, 25 bp, Mus musculus
aagtgagacctgttctctacagaca

SEQ ID NO: 68003 - DNA, 25 bp, Mus musculus
aagtgagagaccacagtgccgcaca

SEQ ID NO: 68004 - DNA, 25 bp, Mus musculus
aagtgagagacctcagtgccgcaca

SEQ ID NO: 68005 - DNA, 25 bp, Mus musculus
aagtgagaggagctctaactgggaa

SEQ ID NO: 68006 - DNA, 25 bp, Mus musculus
aagtgagaggaggtctaactgggaa

SEQ ID NO: 68007 - DNA, 25 bp, Mus musculus
aagtgagagggcataagtttgcaaa

SEQ ID NO: 68008 - DNA, 25 bp, Mus musculus
aagtgagagggcttaagtttgcaaa

SEQ ID NO: 68009 - DNA, 25 bp, Mus musculus
aagtgagagtgcaatgagtaccaga

SEQ ID NO: 68010 - DNA, 25 bp, Mus musculus
aagtgagagtgctatgagtaccaga

SEQ ID NO: 68011 - DNA, 25 bp, Mus musculus
aagtgagagtggcacttcctgcaat

SEQ ID NO: 68012 - DNA, 25 bp, Mus musculus
aagtgagagtgggacttcctgcaat

SEQ ID NO: 68013 - DNA, 25 bp, Mus musculus
aagtgagatcccaattgcttgtgct

SEQ ID NO: 68014 - DNA, 25 bp, Mus musculus
aagtgagatccctattgcttgtgct

SEQ ID NO: 68015 - DNA, 25 bp, Mus musculus
aagtgagatcttaactatgactatt

SEQ ID NO: 68016 - DNA, 25 bp, Mus musculus
aagtgagatctttactatgactatt

SEQ ID NO: 68017 - DNA, 25 bp, Mus musculus
aagtgagattcacatgtatgcctaa

SEQ ID NO: 68018 - DNA, 25 bp, Mus musculus
aagtgagattcagatgtatgcctaa

SEQ ID NO: 68019 - DNA, 25 bp, Mus musculus
aagtgagatttacccaatagctgga

SEQ ID NO: 68020 - DNA, 25 bp, Mus musculus
aagtgagatttagccaatagctgga

SEQ ID NO: 68021 - DNA, 25 bp, Mus musculus
aagtgagcacctatctcccctgcat

SEQ ID NO: 68022 - DNA, 25 bp, Mus musculus
aagtgagcacctttctcccctgcat

SEQ ID NO: 68023 - DNA, 25 bp, Mus musculus
aagtgagcactgaccagccgagcga

SEQ ID NO: 68024 - DNA, 25 bp, Mus musculus
aagtgagcactgtccagccgagcga

SEQ ID NO: 68025 - DNA, 25 bp, Mus musculus
aagtgagcagatacctgtagcatct

SEQ ID NO: 68026 - DNA, 25 bp, Mus musculus
aagtgagcagattcctgtagcatct

SEQ ID NO: 68027 - DNA, 25 bp, Mus musculus
aagtgagcagttaggagttgattct

SEQ ID NO: 68028 - DNA, 25 bp, Mus musculus
aagtgagcagtttggagttgattct

SEQ ID NO: 68029 - DNA, 25 bp, Mus musculus
aagtgagcataaactgtccgtctgt

SEQ ID NO: 68030 - DNA, 25 bp, Mus musculus
aagtgagcataatctgtccgtctgt

SEQ ID NO: 68031 - DNA, 25 bp, Mus musculus
aagtgagcccagagtacttctccat

SEQ ID NO: 68032 - DNA, 25 bp, Mus musculus
aagtgagcccagtgtacttctccat

SEQ ID NO: 68033 - DNA, 25 bp, Mus musculus
aagtgagccgggatcctagaaaaca

SEQ ID NO: 68034 - DNA, 25 bp, Mus musculus
aagtgagccgggttcctagaaaaca

SEQ ID NO: 68035 - DNA, 25 bp, Mus musculus
aagtgagcctgcctgtttcccaagc

SEQ ID NO: 68036 - DNA, 25 bp, Mus musculus
aagtgagcctgcgtgtttcccaagc

SEQ ID NO: 68037 - DNA, 25 bp, Mus musculus
aagtgagccttcagcttaatgtcta

SEQ ID NO: 68038 - DNA, 25 bp, Mus musculus
aagtgagccttctgcttaatgtcta

SEQ ID NO: 68039 - DNA, 25 bp, Mus musculus
aagtgagcgagcatcgggccttcgt

SEQ ID NO: 68040 - DNA, 25 bp, Mus musculus
aagtgagcgagcttcgggccttcgt

SEQ ID NO: 68041 - DNA, 25 bp, Mus musculus
aagtgagcgcgcactcttcccagtg

SEQ ID NO: 68042 - DNA, 25 bp, Mus musculus
aagtgagcgcgctctcttcccagtg

SEQ ID NO: 68043 - DNA, 25 bp, Mus musculus
aagtgagcggtcagccaagaagttc

SEQ ID NO: 68044 - DNA, 25 bp, Mus musculus
aagtgagcggtctgccaagaagttc

SEQ ID NO: 68045 - DNA, 25 bp, Mus musculus
aagtgagcgtggattccagcacagc

SEQ ID NO: 68046 - DNA, 25 bp, Mus musculus
aagtgagcgtggtttccagcacagc

SEQ ID NO: 68047 - DNA, 25 bp, Mus musculus
aagtgagctagcatttccatccagg

SEQ ID NO: 68048 - DNA, 25 bp, Mus musculus
aagtgagctagcttttccatccagg

SEQ ID NO: 68049 - DNA, 25 bp, Mus musculus
aagtgagctaggctctcccaaatca

SEQ ID NO: 68050 - DNA, 25 bp, Mus musculus
aagtgagctagggtctcccaaatca

SEQ ID NO: 68051 - DNA, 25 bp, Mus musculus
aagtgagctcatctgtgggaaccaa

SEQ ID NO: 68052 - DNA, 25 bp, Mus musculus
aagtgagctcatgtgtgggaaccaa

SEQ ID NO: 68053 - DNA, 25 bp, Mus musculus
aagtgagctcctcgaagcaccaaga

SEQ ID NO: 68054 - DNA, 25 bp, Mus musculus
aagtgagctcctggaagcaccaaga

SEQ ID NO: 68055 - DNA, 25 bp, Mus musculus
aagtgagctctgactccaaatgacc

SEQ ID NO: 68056 - DNA, 25 bp, Mus musculus
aagtgagctctgtctccaaatgacc

SEQ ID NO: 68057 - DNA, 25 bp, Mus musculus
aagtgagctcttatcgcatgcgatg

SEQ ID NO: 68058 - DNA, 25 bp, Mus musculus
aagtgagctcttttcgcatgcgatg

SEQ ID NO: 68059 - DNA, 25 bp, Mus musculus
aagtgagctgtaaaggctgagctct

SEQ ID NO: 68060 - DNA, 25 bp, Mus musculus
aagtgagctgtataggctgagctct

SEQ ID NO: 68061 - DNA, 25 bp, Mus musculus
aagtgagctgttccatccctcttag

SEQ ID NO: 68062 - DNA, 25 bp, Mus musculus
aagtgagctgttgcatccctcttag

SEQ ID NO: 68063 - DNA, 25 bp, Mus musculus
aagtgagcttatcacccacaacctg

SEQ ID NO: 68064 - DNA, 25 bp, Mus musculus
aagtgagcttatgacccacaacctg

SEQ ID NO: 68065 - DNA, 25 bp, Mus musculus
aagtgagcttccacagctccggacc

SEQ ID NO: 68066 - DNA, 25 bp, Mus musculus
aagtgagcttcctcagctccggacc

SEQ ID NO: 68067 - DNA, 25 bp, Mus musculus
aagtgagcttcgctcttcaggagtc

SEQ ID NO: 68068 - DNA, 25 bp, Mus musculus
aagtgagcttcggtcttcaggagtc

SEQ ID NO: 68069 - DNA, 25 bp, Mus musculus
aagtgagctttgctgtatatataca

SEQ ID NO: 68070 - DNA, 25 bp, Mus musculus
aagtgagctttggtgtatatataca

SEQ ID NO: 68071 - DNA, 25 bp, Mus musculus
aagtgaggaccaagcctgaccacca

SEQ ID NO: 68072 - DNA, 25 bp, Mus musculus
aagtgaggaccatgcctgaccacca

SEQ ID NO: 68073 - DNA, 25 bp, Mus musculus
aagtgaggatgacctctcctttgcc

SEQ ID NO: 68074 - DNA, 25 bp, Mus musculus
aagtgaggatgagctctcctttgcc

SEQ ID NO: 68075 - DNA, 25 bp, Mus musculus
aagtgaggatgccttggtcctactt

SEQ ID NO: 68076 - DNA, 25 bp, Mus musculus
aagtgaggatgcgttggtcctactt

SEQ ID NO: 68077 - DNA, 25 bp, Mus musculus
aagtgaggattacccaacctgcacc

SEQ ID NO: 68078 - DNA, 25 bp, Mus musculus
aagtgaggattagccaacctgcacc

SEQ ID NO: 68079 - DNA, 25 bp, Mus musculus
aagtgaggcagactcccatgctgtt

SEQ ID NO: 68080 - DNA, 25 bp, Mus musculus
aagtgaggcagagtcccatgctgtt

SEQ ID NO: 68081 - DNA, 25 bp, Mus musculus
aagtgaggccatcggaaactgttgc

SEQ ID NO: 68082 - DNA, 25 bp, Mus musculus
aagtgaggccatgggaaactgttgc

SEQ ID NO: 68083 - DNA, 25 bp, Mus musculus
aagtgaggccgaatgaagcttgttc

SEQ ID NO: 68084 - DNA, 25 bp, Mus musculus
aagtgaggccgattgaagcttgttc

SEQ ID NO: 68085 - DNA, 25 bp, Mus musculus
aagtgaggcgtcagcgagcttgctt

SEQ ID NO: 68086 - DNA, 25 bp, Mus musculus
aagtgaggcgtctgcgagcttgctt

SEQ ID NO: 68087 - DNA, 25 bp, Mus musculus
aagtgagggctgagacccttccgat

SEQ ID NO: 68088 - DNA, 25 bp, Mus musculus
aagtgagggctgtgacccttccgat

SEQ ID NO: 68089 - DNA, 25 bp, Mus musculus
aagtgagggtaacactgtctcctcc

SEQ ID NO: 68090 - DNA, 25 bp, Mus musculus
aagtgagggtaagactgtctcctcc

SEQ ID NO: 68091 - DNA, 25 bp, Mus musculus
aagtgaggtccacagcctgggactc

SEQ ID NO: 68092 - DNA, 25 bp, Mus musculus
aagtgaggtccagagcctgggactc

SEQ ID NO: 68093 - DNA, 25 bp, Mus musculus
aagtgaggtctcacatttgcagctc

SEQ ID NO: 68094 - DNA, 25 bp, Mus musculus
aagtgaggtctctcatttgcagctc

SEQ ID NO: 68095 - DNA, 25 bp, Mus musculus
aagtgaggtcttacagccttgctgc

SEQ ID NO: 68096 - DNA, 25 bp, Mus musculus
aagtgaggtcttcctgatctgacag

SEQ ID NO: 68097 - DNA, 25 bp, Mus musculus
aagtgaggtcttgctgatctgacag

SEQ ID NO: 68098 - DNA, 25 bp, Mus musculus
aagtgaggtctttcagccttgctgc

SEQ ID NO: 68099 - DNA, 25 bp, Mus musculus
aagtgaggtgtccataccaggagct

SEQ ID NO: 68100 - DNA, 25 bp, Mus musculus
aagtgaggtgtcgataccaggagct

SEQ ID NO: 68101 - DNA, 25 bp, Mus musculus
aagtgaggttttctggctcatgccc

SEQ ID NO: 68102 - DNA, 25 bp, Mus musculus
aagtgaggttttgtggctcatgccc

SEQ ID NO: 68103 - DNA, 25 bp, Mus musculus
aagtgagtactgaggcatgccacgc

SEQ ID NO: 68104 - DNA, 25 bp, Mus musculus
aagtgagtactgtggcatgccacgc

SEQ ID NO: 68105 - DNA, 25 bp, Mus musculus
aagtgagtcacaatcctgctggaac

SEQ ID NO: 68106 - DNA, 25 bp, Mus musculus
aagtgagtcacattcctgctggaac

SEQ ID NO: 68107 - DNA, 25 bp, Mus musculus
aagtgagtcaccagctggtagtaga

SEQ ID NO: 68108 - DNA, 25 bp, Mus musculus
aagtgagtcacctgctggtagtaga

SEQ ID NO: 68109 - DNA, 25 bp, Mus musculus
aagtgagtccagaaagccctcgctc

SEQ ID NO: 68110 - DNA, 25 bp, Mus musculus
aagtgagtccagtaagccctcgctc

SEQ ID NO: 68111 - DNA, 25 bp, Mus musculus
aagtgagtctaccaaatgccagtta

SEQ ID NO: 68112 - DNA, 25 bp, Mus musculus
aagtgagtctacgaaatgccagtta

SEQ ID NO: 68113 - DNA, 25 bp, Mus musculus
aagtgagtctataaggcattctgat

SEQ ID NO: 68114 - DNA, 25 bp, Mus musculus
aagtgagtctattaggcattctgat

SEQ ID NO: 68115 - DNA, 25 bp, Mus musculus
aagtgagtctgtctctgataatgac

SEQ ID NO: 68116 - DNA, 25 bp, Mus musculus
aagtgagtctgtgtctgataatgac

SEQ ID NO: 68117 - DNA, 25 bp, Mus musculus
aagtgagtgcttcccgtgatacatg

SEQ ID NO: 68118 - DNA, 25 bp, Mus musculus
aagtgagtgcttgccgtgatacatg

SEQ ID NO: 68119 - DNA, 25 bp, Mus musculus
aagtgagtggccagagctcattccc

SEQ ID NO: 68120 - DNA, 25 bp, Mus musculus
aagtgagtggcctgagctcattccc

SEQ ID NO: 68121 - DNA, 25 bp, Mus musculus
aagtgagtggtgatatttcctacag

SEQ ID NO: 68122 - DNA, 25 bp, Mus musculus
aagtgagtggtgttatttcctacag

SEQ ID NO: 68123 - DNA, 25 bp, Mus musculus
aagtgagtgtgtcgatctccagcgc

SEQ ID NO: 68124 - DNA, 25 bp, Mus musculus
aagtgagtgtgtggatctccagcgc

SEQ ID NO: 68125 - DNA, 25 bp, Mus musculus
aagtgagttggcaaccaccacccaa

SEQ ID NO: 68126 - DNA, 25 bp, Mus musculus
aagtgagttggctaccaccacccaa

SEQ ID NO: 68127 - DNA, 25 bp, Mus musculus
aagtgagttgtgatatctgcaccat

SEQ ID NO: 68128 - DNA, 25 bp, Mus musculus
aagtgagttgtgttatctgcaccat

SEQ ID NO: 68129 - DNA, 25 bp, Mus musculus
aagtgagttgttcttcatagctaaa

SEQ ID NO: 68130 - DNA, 25 bp, Mus musculus
aagtgagttgttgttcatagctaaa

SEQ ID NO: 68131 - DNA, 25 bp, Mus musculus
aagtgagtttgacgcgccatccctc

SEQ ID NO: 68132 - DNA, 25 bp, Mus musculus
aagtgagtttgaggcgccatccctc

SEQ ID NO: 68133 - DNA, 25 bp, Mus musculus
aagtgagtttttcggctgagctcag

SEQ ID NO: 68134 - DNA, 25 bp, Mus musculus
aagtgagtttttgggctgagctcag

SEQ ID NO: 68135 - DNA, 25 bp, Mus musculus
aagtgataccccaggcgtgagagtg

SEQ ID NO: 68136 - DNA, 25 bp, Mus musculus
aagtgatacccctggcgtgagagtg

SEQ ID NO: 68137 - DNA, 25 bp, Mus musculus
aagtgatacctgcagttcctagctc

SEQ ID NO: 68138 - DNA, 25 bp, Mus musculus
aagtgatacctggagttcctagctc

SEQ ID NO: 68139 - DNA, 25 bp, Mus musculus
aagtgataggctatactcatatagt

SEQ ID NO: 68140 - DNA, 25 bp, Mus musculus
aagtgataggctttactcatatagt

SEQ ID NO: 68141 - DNA, 25 bp, Mus musculus
aagtgatcacctaatttttggccaa

SEQ ID NO: 68142 - DNA, 25 bp, Mus musculus
aagtgatcaccttatttttggccaa

SEQ ID NO: 68143 - DNA, 25 bp, Mus musculus
aagtgatcagagatttagtgggcaa

SEQ ID NO: 68144 - DNA, 25 bp, Mus musculus
aagtgatcagagttttagtgggcaa

SEQ ID NO: 68145 - DNA, 25 bp, Mus musculus
aagtgatcagctctttcaaaaacaa

SEQ ID NO: 68146 - DNA, 25 bp, Mus musculus
aagtgatcagctgtttcaaaaacaa

SEQ ID NO: 68147 - DNA, 25 bp, Mus musculus
aagtgatcagtacactttgaccttt

SEQ ID NO: 68148 - DNA, 25 bp, Mus musculus
aagtgatcagtagactttgaccttt

SEQ ID NO: 68149 - DNA, 25 bp, Mus musculus
aagtgatccccgagacagagcaggc

SEQ ID NO: 68150 - DNA, 25 bp, Mus musculus
aagtgatccccgtgacagagcaggc

SEQ ID NO: 68151 - DNA, 25 bp, Mus musculus
aagtgatccgcaaggcctgtgagga

SEQ ID NO: 68152 - DNA, 25 bp, Mus musculus
aagtgatccgcatggcctgtgagga

SEQ ID NO: 68153 - DNA, 25 bp, Mus musculus
aagtgatcgggaaacgcggttctga

SEQ ID NO: 68154 - DNA, 25 bp, Mus musculus
aagtgatcgggatacgcggttctga

SEQ ID NO: 68155 - DNA, 25 bp, Mus musculus
aagtgatctctgagtcctttagacg

SEQ ID NO: 68156 - DNA, 25 bp, Mus musculus
aagtgatctctgtgtcctttagacg

SEQ ID NO: 68157 - DNA, 25 bp, Mus musculus
aagtgatctgctactgactcacacc

SEQ ID NO: 68158 - DNA, 25 bp, Mus musculus
aagtgatctgcttctgactcacacc

SEQ ID NO: 68159 - DNA, 25 bp, Mus musculus
aagtgatctgttcgttttttataag

SEQ ID NO: 68160 - DNA, 25 bp, Mus musculus
aagtgatctgttggttttttataag

SEQ ID NO: 68161 - DNA, 25 bp, Mus musculus
aagtgatgaatacgagttctcccgg

SEQ ID NO: 68162 - DNA, 25 bp, Mus musculus
aagtgatgaataggagttctcccgg

SEQ ID NO: 68163 - DNA, 25 bp, Mus musculus
aagtgatgactacccttgcatctcc

SEQ ID NO: 68164 - DNA, 25 bp, Mus musculus
aagtgatgactagccttgcatctcc

SEQ ID NO: 68165 - DNA, 25 bp, Mus musculus
aagtgatgatgacccgtctgcctac

SEQ ID NO: 68166 - DNA, 25 bp, Mus musculus
aagtgatgatgagccgtctgcctac

SEQ ID NO: 68167 - DNA, 25 bp, Mus musculus
aagtgatgcagaatttttacagtta

SEQ ID NO: 68168 - DNA, 25 bp, Mus musculus
aagtgatgcagattttttacagtta

SEQ ID NO: 68169 - DNA, 25 bp, Mus musculus
aagtgatgcctcaaacctgggactg

SEQ ID NO: 68170 - DNA, 25 bp, Mus musculus
aagtgatgcctctaacctgggactg

SEQ ID NO: 68171 - DNA, 25 bp, Mus musculus
aagtgatgcgacagccagaccaagg

SEQ ID NO: 68172 - DNA, 25 bp, Mus musculus
aagtgatgcgactgccagaccaagg

SEQ ID NO: 68173 - DNA, 25 bp, Mus musculus
aagtgatggcacagcacagctgcac

SEQ ID NO: 68174 - DNA, 25 bp, Mus musculus
aagtgatggcactgcacagctgcac

SEQ ID NO: 68175 - DNA, 25 bp, Mus musculus
aagtgatggcttatttcttatataa

SEQ ID NO: 68176 - DNA, 25 bp, Mus musculus
aagtgatggcttctgctaggtctca

SEQ ID NO: 68177 - DNA, 25 bp, Mus musculus
aagtgatggcttgtgctaggtctca

SEQ ID NO: 68178 - DNA, 25 bp, Mus musculus
aagtgatggcttttttcttatataa

SEQ ID NO: 68179 - DNA, 25 bp, Mus musculus
aagtgatggttcatgcgcgtggtac

SEQ ID NO: 68180 - DNA, 25 bp, Mus musculus
aagtgatggttcttgcgcgtggtac

SEQ ID NO: 68181 - DNA, 25 bp, Mus musculus
aagtgatgtcagctcaactccgaag

SEQ ID NO: 68182 - DNA, 25 bp, Mus musculus
aagtgatgtcaggtcaactccgaag

SEQ ID NO: 68183 - DNA, 25 bp, Mus musculus
aagtgattaaacctgcagactatgc

SEQ ID NO: 68184 - DNA, 25 bp, Mus musculus
aagtgattaaacgtgcagactatgc

SEQ ID NO: 68185 - DNA, 25 bp, Mus musculus
aagtgattatatattgggattccaa

SEQ ID NO: 68186 - DNA, 25 bp, Mus musculus
aagtgattatattttgggattccaa

SEQ ID NO: 68187 - DNA, 25 bp, Mus musculus
aagtgattatcaacgtcctctgggt

SEQ ID NO: 68188 - DNA, 25 bp, Mus musculus
aagtgattatcatcgtcctctgggt

SEQ ID NO: 68189 - DNA, 25 bp, Mus musculus
aagtgattccaaacctaattgagta

SEQ ID NO: 68190 - DNA, 25 bp, Mus musculus
aagtgattccaatcctaattgagta

SEQ ID NO: 68191 - DNA, 25 bp, Mus musculus
aagtgattcgcaaaatttctctctg

SEQ ID NO: 68192 - DNA, 25 bp, Mus musculus
aagtgattcgcataatttctctctg

SEQ ID NO: 68193 - DNA, 25 bp, Mus musculus
aagtgattcgttactctgttgcatt

SEQ ID NO: 68194 - DNA, 25 bp, Mus musculus
aagtgattcgtttctctgttgcatt

SEQ ID NO: 68195 - DNA, 25 bp, Mus musculus
aagtgattcttcactgcatgtgtgg

SEQ ID NO: 68196 - DNA, 25 bp, Mus musculus
aagtgattcttctctgcatgtgtgg

SEQ ID NO: 68197 - DNA, 25 bp, Mus musculus
aagtgattgattagggatagtgaat

SEQ ID NO: 68198 - DNA, 25 bp, Mus musculus
aagtgattgatttgggatagtgaat

SEQ ID NO: 68199 - DNA, 25 bp, Mus musculus
aagtgattgcacagcctgtggagca

SEQ ID NO: 68200 - DNA, 25 bp, Mus musculus
aagtgattgcactgcctgtggagca

SEQ ID NO: 68201 - DNA, 25 bp, Mus musculus
aagtgattgcatctggtctgcacct

SEQ ID NO: 68202 - DNA, 25 bp, Mus musculus
aagtgattgcatgtggtctgcacct

SEQ ID NO: 68203 - DNA, 25 bp, Mus musculus
aagtgattgtgtctcgctgcaacgt

SEQ ID NO: 68204 - DNA, 25 bp, Mus musculus
aagtgattgtgtgtcgctgcaacgt

SEQ ID NO: 68205 - DNA, 25 bp, Mus musculus
aagtgatttacccttggaatctcaa

SEQ ID NO: 68206 - DNA, 25 bp, Mus musculus
aagtgatttaccgttggaatctcaa

SEQ ID NO: 68207 - DNA, 25 bp, Mus musculus
aagtgatttcggctgggcatccaaa

SEQ ID NO: 68208 - DNA, 25 bp, Mus musculus
aagtgatttcgggtgggcatccaaa

SEQ ID NO: 68209 - DNA, 25 bp, Mus musculus
aagtgatttgatattcagtgctgta

SEQ ID NO: 68210 - DNA, 25 bp, Mus musculus
aagtgatttgattttcagtgctgta

SEQ ID NO: 68211 - DNA, 25 bp, Mus musculus
aagtgatttgctatttagtcagcat

SEQ ID NO: 68212 - DNA, 25 bp, Mus musculus
aagtgatttgctcgcatcaggttta

SEQ ID NO: 68213 - DNA, 25 bp, Mus musculus
aagtgatttgctcgccagagcgctt

SEQ ID NO: 68214 - DNA, 25 bp, Mus musculus
aagtgatttgctggcatcaggttta

SEQ ID NO: 68215 - DNA, 25 bp, Mus musculus
aagtgatttgctggccagagcgctt

SEQ ID NO: 68216 - DNA, 25 bp, Mus musculus
aagtgatttgctttttagtcagcat

SEQ ID NO: 68217 - DNA, 25 bp, Mus musculus
aagtgatttggcactgttaggctgt

SEQ ID NO: 68218 - DNA, 25 bp, Mus musculus
aagtgatttggctctgttaggctgt

SEQ ID NO: 68219 - DNA, 25 bp, Mus musculus
aagtgatttgtgatgtgatggtatg

SEQ ID NO: 68220 - DNA, 25 bp, Mus musculus
aagtgatttgtgttgtgatggtatg

SEQ ID NO: 68221 - DNA, 25 bp, Mus musculus
aagtgatttttcaagagatagagac

SEQ ID NO: 68222 - DNA, 25 bp, Mus musculus
aagtgatttttctagagatagagac

SEQ ID NO: 68223 - DNA, 25 bp, Mus musculus
aagtgcaaaggaaccacctggctca

SEQ ID NO: 68224 - DNA, 25 bp, Mus musculus
aagtgcaaaggatccacctggctca

SEQ ID NO: 68225 - DNA, 25 bp, Mus musculus
aagtgcaaagttcagcctgtcccat

SEQ ID NO: 68226 - DNA, 25 bp, Mus musculus
aagtgcaaagttgagcctgtcccat

SEQ ID NO: 68227 - DNA, 25 bp, Mus musculus
aagtgcaacccacataggtctttat

SEQ ID NO: 68228 - DNA, 25 bp, Mus musculus
aagtgcaacccagataggtctttat

SEQ ID NO: 68229 - DNA, 25 bp, Mus musculus
aagtgcaacctaatgaccctgcagt

SEQ ID NO: 68230 - DNA, 25 bp, Mus musculus
aagtgcaacctattgaccctgcagt

SEQ ID NO: 68231 - DNA, 25 bp, Mus musculus
aagtgcaactgacagaggaggccaa

SEQ ID NO: 68232 - DNA, 25 bp, Mus musculus
aagtgcaactgagagaggaggccaa

SEQ ID NO: 68233 - DNA, 25 bp, Mus musculus
aagtgcaagacgagcgactacgcgg

SEQ ID NO: 68234 - DNA, 25 bp, Mus musculus
aagtgcaagacgtgcgactacgcgg

SEQ ID NO: 68235 - DNA, 25 bp, Mus musculus
aagtgcaagattacccatacaagtg

SEQ ID NO: 68236 - DNA, 25 bp, Mus musculus
aagtgcaagatttcccatacaagtg

SEQ ID NO: 68237 - DNA, 25 bp, Mus musculus
aagtgcaagctcctgtgatgtctca

SEQ ID NO: 68238 - DNA, 25 bp, Mus musculus
aagtgcaagctcgtgtgatgtctca

SEQ ID NO: 68239 - DNA, 25 bp, Mus musculus
aagtgcaagggcattggccactcgc

SEQ ID NO: 68240 - DNA, 25 bp, Mus musculus
aagtgcaagggctttggccactcgc

SEQ ID NO: 68241 - DNA, 25 bp, Mus musculus
aagtgcaagttgatctatgattcgc

SEQ ID NO: 68242 - DNA, 25 bp, Mus musculus
aagtgcaagttgttctatgattcgc

SEQ ID NO: 68243 - DNA, 25 bp, Mus musculus
aagtgcaatacacggccaagccggc

SEQ ID NO: 68244 - DNA, 25 bp, Mus musculus
aagtgcaatacagggccaagccggc

SEQ ID NO: 68245 - DNA, 25 bp, Mus musculus
aagtgcaatggcaccctagtcaaag

SEQ ID NO: 68246 - DNA, 25 bp, Mus musculus
aagtgcaatggctccctagtcaaag

SEQ ID NO: 68247 - DNA, 25 bp, Mus musculus
aagtgcacacccataaatgcctaaa

SEQ ID NO: 68248 - DNA, 25 bp, Mus musculus
aagtgcacacccatagatgctgcag

SEQ ID NO: 68249 - DNA, 25 bp, Mus musculus
aagtgcacacccttaaatgcctaaa

SEQ ID NO: 68250 - DNA, 25 bp, Mus musculus
aagtgcacacccttagatgctgcag

SEQ ID NO: 68251 - DNA, 25 bp, Mus musculus
aagtgcacactacagatttgttagc

SEQ ID NO: 68252 - DNA, 25 bp, Mus musculus
aagtgcacactagagatttgttagc

SEQ ID NO: 68253 - DNA, 25 bp, Mus musculus
aagtgcacactcaatggtacgaggt

SEQ ID NO: 68254 - DNA, 25 bp, Mus musculus
aagtgcacactccagggatgagcat

SEQ ID NO: 68255 - DNA, 25 bp, Mus musculus
aagtgcacactcgagggatgagcat

SEQ ID NO: 68256 - DNA, 25 bp, Mus musculus
aagtgcacactctatggtacgaggt

SEQ ID NO: 68257 - DNA, 25 bp, Mus musculus
aagtgcacactgaagcagcgcatgc

SEQ ID NO: 68258 - DNA, 25 bp, Mus musculus
aagtgcacactgtagcagcgcatgc

SEQ ID NO: 68259 - DNA, 25 bp, Mus musculus
aagtgcacagcccagtaatttattt

SEQ ID NO: 68260 - DNA, 25 bp, Mus musculus
aagtgcacagccgagtaatttattt

SEQ ID NO: 68261 - DNA, 25 bp, Mus musculus
aagtgcacatgcctataattctagc

SEQ ID NO: 68262 - DNA, 25 bp, Mus musculus
aagtgcacatgcgtataattctagc

SEQ ID NO: 68263 - DNA, 25 bp, Mus musculus
aagtgcacatttactggctcctgag

SEQ ID NO: 68264 - DNA, 25 bp, Mus musculus
aagtgcacattttctggctcctgag

SEQ ID NO: 68265 - DNA, 25 bp, Mus musculus
aagtgcaccagcatcttcatgttac

SEQ ID NO: 68266 - DNA, 25 bp, Mus musculus
aagtgcaccagcttcttcatgttac

SEQ ID NO: 68267 - DNA, 25 bp, Mus musculus
aagtgcaccatcctatgagcctgac

SEQ ID NO: 68268 - DNA, 25 bp, Mus musculus
aagtgcaccatcgtatgagcctgac

SEQ ID NO: 68269 - DNA, 25 bp, Mus musculus
aagtgcacccaaactacctttggat

SEQ ID NO: 68270 - DNA, 25 bp, Mus musculus
aagtgcacccaatctacctttggat

SEQ ID NO: 68271 - DNA, 25 bp, Mus musculus
aagtgcacccctcacgctgtcctat

SEQ ID NO: 68272 - DNA, 25 bp, Mus musculus
aagtgcacccctgacgctgtcctat

SEQ ID NO: 68273 - DNA, 25 bp, Mus musculus
aagtgcacctcgctggttttaagta

SEQ ID NO: 68274 - DNA, 25 bp, Mus musculus
aagtgcacctcggtggttttaagta

SEQ ID NO: 68275 - DNA, 25 bp, Mus musculus
aagtgcacctgtacctaatgtataa

SEQ ID NO: 68276 - DNA, 25 bp, Mus musculus
aagtgcacctgttcctaatgtataa

SEQ ID NO: 68277 - DNA, 25 bp, Mus musculus
aagtgcacgttaatctctgaggaca

SEQ ID NO: 68278 - DNA, 25 bp, Mus musculus
aagtgcacgttattctctgaggaca

SEQ ID NO: 68279 - DNA, 25 bp, Mus musculus
aagtgcactacgcttgtgggtccac

SEQ ID NO: 68280 - DNA, 25 bp, Mus musculus
aagtgcactacggttgtgggtccac

SEQ ID NO: 68281 - DNA, 25 bp, Mus musculus
aagtgcactactccctcatgggaag

SEQ ID NO: 68282 - DNA, 25 bp, Mus musculus
aagtgcactactgcctcatgggaag

SEQ ID NO: 68283 - DNA, 25 bp, Mus musculus
aagtgcactggcagatttgaccaaa

SEQ ID NO: 68284 - DNA, 25 bp, Mus musculus
aagtgcactggctgatttgaccaaa

SEQ ID NO: 68285 - DNA, 25 bp, Mus musculus
aagtgcactgtgcaaaattttgcag

SEQ ID NO: 68286 - DNA, 25 bp, Mus musculus
aagtgcactgtggaaaattttgcag

SEQ ID NO: 68287 - DNA, 25 bp, Mus musculus
aagtgcactgttattgccatgtgag

SEQ ID NO: 68288 - DNA, 25 bp, Mus musculus
aagtgcactgtttttgccatgtgag

SEQ ID NO: 68289 - DNA, 25 bp, Mus musculus
aagtgcacttcactgtgcttggcac

SEQ ID NO: 68290 - DNA, 25 bp, Mus musculus
aagtgcacttcagtgtgcttggcac

SEQ ID NO: 68291 - DNA, 25 bp, Mus musculus
aagtgcacttctctcaggagtggac

SEQ ID NO: 68292 - DNA, 25 bp, Mus musculus
aagtgcacttctgtcaggagtggac

SEQ ID NO: 68293 - DNA, 25 bp, Mus musculus
aagtgcactttgcagaagtctcacc

SEQ ID NO: 68294 - DNA, 25 bp, Mus musculus
aagtgcactttggagaagtctcacc

SEQ ID NO: 68295 - DNA, 25 bp, Mus musculus
aagtgcagataaccgatgcctaccc

SEQ ID NO: 68296 - DNA, 25 bp, Mus musculus
aagtgcagataagcgatgcctaccc

SEQ ID NO: 68297 - DNA, 25 bp, Mus musculus
aagtgcagatgccttggtcagcctt

SEQ ID NO: 68298 - DNA, 25 bp, Mus musculus
aagtgcagatgcgttggtcagcctt

SEQ ID NO: 68299 - DNA, 25 bp, Mus musculus
aagtgcagatggactccccttccac

SEQ ID NO: 68300 - DNA, 25 bp, Mus musculus
aagtgcagatggtctccccttccac

SEQ ID NO: 68301 - DNA, 25 bp, Mus musculus
aagtgcagatgtcccagctggaacc

SEQ ID NO: 68302 - DNA, 25 bp, Mus musculus
aagtgcagatgtgccagctggaacc

SEQ ID NO: 68303 - DNA, 25 bp, Mus musculus
aagtgcagcaccacagaagaagtaa

SEQ ID NO: 68304 - DNA, 25 bp, Mus musculus
aagtgcagcacctcagaagaagtaa

SEQ ID NO: 68305 - DNA, 25 bp, Mus musculus
aagtgcagcagcatacacctagaat

SEQ ID NO: 68306 - DNA, 25 bp, Mus musculus
aagtgcagcagcttacacctagaat

SEQ ID NO: 68307 - DNA, 25 bp, Mus musculus
aagtgcagccaacctcaagcgcaaa

SEQ ID NO: 68308 - DNA, 25 bp, Mus musculus
aagtgcagccaagctcaagcgcaaa

SEQ ID NO: 68309 - DNA, 25 bp, Mus musculus
aagtgcagccacatgctatactgaa

SEQ ID NO: 68310 - DNA, 25 bp, Mus musculus
aagtgcagccacttgctatactgaa

SEQ ID NO: 68311 - DNA, 25 bp, Mus musculus
aagtgcagcctaatccagtgctggt

SEQ ID NO: 68312 - DNA, 25 bp, Mus musculus
aagtgcagcctattccagtgctggt

SEQ ID NO: 68313 - DNA, 25 bp, Mus musculus
aagtgcaggactcactcaaacctct

SEQ ID NO: 68314 - DNA, 25 bp, Mus musculus
aagtgcaggactcccaagatctgga

SEQ ID NO: 68315 - DNA, 25 bp, Mus musculus
aagtgcaggactgactcaaacctct

SEQ ID NO: 68316 - DNA, 25 bp, Mus musculus
aagtgcaggactgccaagatctgga

SEQ ID NO: 68317 - DNA, 25 bp, Mus musculus
aagtgcagggcaaactcagtcgctg

SEQ ID NO: 68318 - DNA, 25 bp, Mus musculus
aagtgcagggcatactcagtcgctg

SEQ ID NO: 68319 - DNA, 25 bp, Mus musculus
aagtgcagtcacatgccaaggctgt

SEQ ID NO: 68320 - DNA, 25 bp, Mus musculus
aagtgcagtcacttgccaaggctgt

SEQ ID NO: 68321 - DNA, 25 bp, Mus musculus
aagtgcagtgatattccatgttagc

SEQ ID NO: 68322 - DNA, 25 bp, Mus musculus
aagtgcagtgattttccatgttagc

SEQ ID NO: 68323 - DNA, 25 bp, Mus musculus
aagtgcagtgccagcaggtgttgcc

SEQ ID NO: 68324 - DNA, 25 bp, Mus musculus
aagtgcagtgcctgcaggtgttgcc

SEQ ID NO: 68325 - DNA, 25 bp, Mus musculus
aagtgcagtgctaccctgagaggtt

SEQ ID NO: 68326 - DNA, 25 bp, Mus musculus
aagtgcagtgcttccctgagaggtt

SEQ ID NO: 68327 - DNA, 25 bp, Mus musculus
aagtgcagtggcctttctaatggag

SEQ ID NO: 68328 - DNA, 25 bp, Mus musculus
aagtgcagtggcgtttctaatggag

SEQ ID NO: 68329 - DNA, 25 bp, Mus musculus
aagtgcagttgcaggtctgtcatgc

SEQ ID NO: 68330 - DNA, 25 bp, Mus musculus
aagtgcagttgctggtctgtcatgc

SEQ ID NO: 68331 - DNA, 25 bp, Mus musculus
aagtgcatacagatcttacagagga

SEQ ID NO: 68332 - DNA, 25 bp, Mus musculus
aagtgcatacagttcttacagagga

SEQ ID NO: 68333 - DNA, 25 bp, Mus musculus
aagtgcatcaagaaggctgtgaagc

SEQ ID NO: 68334 - DNA, 25 bp, Mus musculus
aagtgcatcaagtaggctgtgaagc

SEQ ID NO: 68335 - DNA, 25 bp, Mus musculus
aagtgcatcatgaacctacctcagg

SEQ ID NO: 68336 - DNA, 25 bp, Mus musculus
aagtgcatcatgtacctacctcagg

SEQ ID NO: 68337 - DNA, 25 bp, Mus musculus
aagtgcatccctctacagttgatgg

SEQ ID NO: 68338 - DNA, 25 bp, Mus musculus
aagtgcatccctgtacagttgatgg

SEQ ID NO: 68339 - DNA, 25 bp, Mus musculus
aagtgcatctggagaccaggttctc

SEQ ID NO: 68340 - DNA, 25 bp, Mus musculus
aagtgcatctggtgaccaggttctc

SEQ ID NO: 68341 - DNA, 25 bp, Mus musculus
aagtgcatctgtcgctttggtacga

SEQ ID NO: 68342 - DNA, 25 bp, Mus musculus
aagtgcatctgtggctttggtacga

SEQ ID NO: 68343 - DNA, 25 bp, Mus musculus
aagtgcatcttgaagtttattctgt

SEQ ID NO: 68344 - DNA, 25 bp, Mus musculus
aagtgcatcttgtagtttattctgt

SEQ ID NO: 68345 - DNA, 25 bp, Mus musculus
aagtgcatgaccaagctctctgcaa

SEQ ID NO: 68346 - DNA, 25 bp, Mus musculus
aagtgcatgacctagctctctgcaa

SEQ ID NO: 68347 - DNA, 25 bp, Mus musculus
aagtgcatgcagagttgtttttcta

SEQ ID NO: 68348 - DNA, 25 bp, Mus musculus
aagtgcatgcagtgttgtttttcta

SEQ ID NO: 68349 - DNA, 25 bp, Mus musculus
aagtgcatgcggagtaaaccttcat

SEQ ID NO: 68350 - DNA, 25 bp, Mus musculus
aagtgcatgcggtgtaaaccttcat

SEQ ID NO: 68351 - DNA, 25 bp, Mus musculus
aagtgcatgcttctgtgactgcatc

SEQ ID NO: 68352 - DNA, 25 bp, Mus musculus
aagtgcatgcttgtgtgactgcatc

SEQ ID NO: 68353 - DNA, 25 bp, Mus musculus
aagtgcatggacctgtacacaccca

SEQ ID NO: 68354 - DNA, 25 bp, Mus musculus
aagtgcatggacgtgtacacaccca

SEQ ID NO: 68355 - DNA, 25 bp, Mus musculus
aagtgcatgtgcagcatcttctcaa

SEQ ID NO: 68356 - DNA, 25 bp, Mus musculus
aagtgcatgtgctgcatcttctcaa

SEQ ID NO: 68357 - DNA, 25 bp, Mus musculus
aagtgcattcacaggcagagttctg

SEQ ID NO: 68358 - DNA, 25 bp, Mus musculus
aagtgcattcactggcagagttctg

SEQ ID NO: 68359 - DNA, 25 bp, Mus musculus
aagtgcattctgaaggtgatctctc

SEQ ID NO: 68360 - DNA, 25 bp, Mus musculus
aagtgcattctgtaggtgatctctc

SEQ ID NO: 68361 - DNA, 25 bp, Mus musculus
aagtgcattgataaccttgccaggt

SEQ ID NO: 68362 - DNA, 25 bp, Mus musculus
aagtgcattgattaccttgccaggt

SEQ ID NO: 68363 - DNA, 25 bp, Mus musculus
aagtgcatttctattcgctcatcaa

SEQ ID NO: 68364 - DNA, 25 bp, Mus musculus
aagtgcatttcttttcgctcatcaa

SEQ ID NO: 68365 - DNA, 25 bp, Mus musculus
aagtgcatttgcagggcccaggttc

SEQ ID NO: 68366 - DNA, 25 bp, Mus musculus
aagtgcatttgctgggcccaggttc

SEQ ID NO: 68367 - DNA, 25 bp, Mus musculus
aagtgcattttacatagtacttctc

SEQ ID NO: 68368 - DNA, 25 bp, Mus musculus
aagtgcattttagatagtacttctc

SEQ ID NO: 68369 - DNA, 25 bp, Mus musculus
aagtgcattttgctaatcagtcagt

SEQ ID NO: 68370 - DNA, 25 bp, Mus musculus
aagtgcattttggtaatcagtcagt

SEQ ID NO: 68371 - DNA, 25 bp, Mus musculus
aagtgccaaccaaggctctgactgt

SEQ ID NO: 68372 - DNA, 25 bp, Mus musculus
aagtgccaaccaattccattaacaa

SEQ ID NO: 68373 - DNA, 25 bp, Mus musculus
aagtgccaaccacgtctttctgggt

SEQ ID NO: 68374 - DNA, 25 bp, Mus musculus
aagtgccaaccaggtctttctgggt

SEQ ID NO: 68375 - DNA, 25 bp, Mus musculus
aagtgccaaccatggctctgactgt

SEQ ID NO: 68376 - DNA, 25 bp, Mus musculus
aagtgccaaccatttccattaacaa

SEQ ID NO: 68377 - DNA, 25 bp, Mus musculus
aagtgccaacctcgtgtgatggtct

SEQ ID NO: 68378 - DNA, 25 bp, Mus musculus
aagtgccaacctggtgtgatggtct

SEQ ID NO: 68379 - DNA, 25 bp, Mus musculus
aagtgccaagccacgatcaggtgca

SEQ ID NO: 68380 - DNA, 25 bp, Mus musculus
aagtgccaagcctcgatcaggtgca

SEQ ID NO: 68381 - DNA, 25 bp, Mus musculus
aagtgccaagctattcccacggcga

SEQ ID NO: 68382 - DNA, 25 bp, Mus musculus
aagtgccaagcttttcccacggcga

SEQ ID NO: 68383 - DNA, 25 bp, Mus musculus
aagtgccaaggcacatggtgttcct

SEQ ID NO: 68384 - DNA, 25 bp, Mus musculus
aagtgccaaggctcatggtgttcct

SEQ ID NO: 68385 - DNA, 25 bp, Mus musculus
aagtgccaattccttgaaccctaat

SEQ ID NO: 68386 - DNA, 25 bp, Mus musculus
aagtgccaattcgttgaaccctaat

SEQ ID NO: 68387 - DNA, 25 bp, Mus musculus
aagtgccacagaagaactcgtaaag

SEQ ID NO: 68388 - DNA, 25 bp, Mus musculus
aagtgccacagaagcgaaatgaaac

SEQ ID NO: 68389 - DNA, 25 bp, Mus musculus
aagtgccacagatgaactcgtaaag

SEQ ID NO: 68390 - DNA, 25 bp, Mus musculus
aagtgccacagatgcgaaatgaaac

SEQ ID NO: 68391 - DNA, 25 bp, Mus musculus
aagtgccacattccagctagcagtt

SEQ ID NO: 68392 - DNA, 25 bp, Mus musculus
aagtgccacattgcagctagcagtt

SEQ ID NO: 68393 - DNA, 25 bp, Mus musculus
aagtgccacccaatacatgactagc

SEQ ID NO: 68394 - DNA, 25 bp, Mus musculus
aagtgccacccattacatgactagc

SEQ ID NO: 68395 - DNA, 25 bp, Mus musculus
aagtgccacgagagcagagtcatga

SEQ ID NO: 68396 - DNA, 25 bp, Mus musculus
aagtgccacgagtgcagagtcatga

SEQ ID NO: 68397 - DNA, 25 bp, Mus musculus
aagtgccaggagaaggatttcatga

SEQ ID NO: 68398 - DNA, 25 bp, Mus musculus
aagtgccaggagtaggatttcatga

SEQ ID NO: 68399 - DNA, 25 bp, Mus musculus
aagtgccaggcactgcggaagtcat

SEQ ID NO: 68400 - DNA, 25 bp, Mus musculus
aagtgccaggcagtgcggaagtcat

SEQ ID NO: 68401 - DNA, 25 bp, Mus musculus
aagtgccagtcaaaaacccacccag

SEQ ID NO: 68402 - DNA, 25 bp, Mus musculus
aagtgccagtcataaacccacccag

SEQ ID NO: 68403 - DNA, 25 bp, Mus musculus
aagtgccatactcgtctgggtcaga

SEQ ID NO: 68404 - DNA, 25 bp, Mus musculus
aagtgccatactggtctgggtcaga

SEQ ID NO: 68405 - DNA, 25 bp, Mus musculus
aagtgccatagactggcgggcattt

SEQ ID NO: 68406 - DNA, 25 bp, Mus musculus
aagtgccatagagtggcgggcattt

SEQ ID NO: 68407 - DNA, 25 bp, Mus musculus
aagtgccatatcaggagtcttctcc

SEQ ID NO: 68408 - DNA, 25 bp, Mus musculus
aagtgccatatctggagtcttctcc

SEQ ID NO: 68409 - DNA, 25 bp, Mus musculus
aagtgccatgcaaactctctgtatg

SEQ ID NO: 68410 - DNA, 25 bp, Mus musculus
aagtgccatgcatactctctgtatg

SEQ ID NO: 68411 - DNA, 25 bp, Mus musculus
aagtgccatgctatgactagggttt

SEQ ID NO: 68412 - DNA, 25 bp, Mus musculus
aagtgccatgctttgactagggttt

SEQ ID NO: 68413 - DNA, 25 bp, Mus musculus
aagtgccatggaagcgatttccctg

SEQ ID NO: 68414 - DNA, 25 bp, Mus musculus
aagtgccatggatgcgatttccctg

SEQ ID NO: 68415 - DNA, 25 bp, Mus musculus
aagtgccatggcaacaggtgtttgc

SEQ ID NO: 68416 - DNA, 25 bp, Mus musculus
aagtgccatggctacaggtgtttgc

SEQ ID NO: 68417 - DNA, 25 bp, Mus musculus
aagtgccatgttaaggacctgatca

SEQ ID NO: 68418 - DNA, 25 bp, Mus musculus
aagtgccatgtttaggacctgatca

SEQ ID NO: 68419 - DNA, 25 bp, Mus musculus
aagtgccattacaactgtacacggg

SEQ ID NO: 68420 - DNA, 25 bp, Mus musculus
aagtgccattacatgatggtggcta

SEQ ID NO: 68421 - DNA, 25 bp, Mus musculus
aagtgccattactactgtacacggg

SEQ ID NO: 68422 - DNA, 25 bp, Mus musculus
aagtgccattacttgatggtggcta

SEQ ID NO: 68423 - DNA, 25 bp, Mus musculus
aagtgccattctaaaattgtcaaga

SEQ ID NO: 68424 - DNA, 25 bp, Mus musculus
aagtgccattcttaaattgtcaaga

SEQ ID NO: 68425 - DNA, 25 bp, Mus musculus
aagtgccatttaagtcactccctag

SEQ ID NO: 68426 - DNA, 25 bp, Mus musculus
aagtgccatttatgtcactccctag

SEQ ID NO: 68427 - DNA, 25 bp, Mus musculus
aagtgcccaagtctaacttagctat

SEQ ID NO: 68428 - DNA, 25 bp, Mus musculus
aagtgcccaagtgtaacttagctat

SEQ ID NO: 68429 - DNA, 25 bp, Mus musculus
aagtgcccacccctagtagcatgat

SEQ ID NO: 68430 - DNA, 25 bp, Mus musculus
aagtgcccacccgtagtagcatgat

SEQ ID NO: 68431 - DNA, 25 bp, Mus musculus
aagtgcccacgtctgagaagaaccc

SEQ ID NO: 68432 - DNA, 25 bp, Mus musculus
aagtgcccacgtgtgagaagaaccc

SEQ ID NO: 68433 - DNA, 25 bp, Mus musculus
aagtgcccagcaatatacagagaca

SEQ ID NO: 68434 - DNA, 25 bp, Mus musculus
aagtgcccagcattatacagagaca

SEQ ID NO: 68435 - DNA, 25 bp, Mus musculus
aagtgcccatttcctaaaggtgaag

SEQ ID NO: 68436 - DNA, 25 bp, Mus musculus
aagtgcccatttgctaaaggtgaag

SEQ ID NO: 68437 - DNA, 25 bp, Mus musculus
aagtgccccaggcaaagtaggccac

SEQ ID NO: 68438 - DNA, 25 bp, Mus musculus
aagtgccccaggcaattctcatcat

SEQ ID NO: 68439 - DNA, 25 bp, Mus musculus
aagtgccccagggaaagtaggccac

SEQ ID NO: 68440 - DNA, 25 bp, Mus musculus
aagtgccccagggaattctcatcat

SEQ ID NO: 68441 - DNA, 25 bp, Mus musculus
aagtgcccctagacacgtggaactg

SEQ ID NO: 68442 - DNA, 25 bp, Mus musculus
aagtgcccctagtcacgtggaactg

SEQ ID NO: 68443 - DNA, 25 bp, Mus musculus
aagtgcccctcaaaagcatttgtgt

SEQ ID NO: 68444 - DNA, 25 bp, Mus musculus
aagtgcccctcaactctttgtggga

SEQ ID NO: 68445 - DNA, 25 bp, Mus musculus
aagtgcccctcataagcatttgtgt

SEQ ID NO: 68446 - DNA, 25 bp, Mus musculus
aagtgcccctcatctctttgtggga

SEQ ID NO: 68447 - DNA, 25 bp, Mus musculus
aagtgcccctccaatgtgggagtta

SEQ ID NO: 68448 - DNA, 25 bp, Mus musculus
aagtgcccctcctatgtgggagtta

SEQ ID NO: 68449 - DNA, 25 bp, Mus musculus
aagtgccccttcacttgtgaatatg

SEQ ID NO: 68450 - DNA, 25 bp, Mus musculus
aagtgccccttctcttgtgaatatg

SEQ ID NO: 68451 - DNA, 25 bp, Mus musculus
aagtgccccttgaggagaccgtcag

SEQ ID NO: 68452 - DNA, 25 bp, Mus musculus
aagtgccccttgtggagaccgtcag

SEQ ID NO: 68453 - DNA, 25 bp, Mus musculus
aagtgcccgagcagatcagaaccat

SEQ ID NO: 68454 - DNA, 25 bp, Mus musculus
aagtgcccgagctgatcagaaccat

SEQ ID NO: 68455 - DNA, 25 bp, Mus musculus
aagtgcccgcaaactacattctcct

SEQ ID NO: 68456 - DNA, 25 bp, Mus musculus
aagtgcccgcaatctacattctcct

SEQ ID NO: 68457 - DNA, 25 bp, Mus musculus
aagtgcccgcccactatgactgaag

SEQ ID NO: 68458 - DNA, 25 bp, Mus musculus
aagtgcccgccctctatgactgaag

SEQ ID NO: 68459 - DNA, 25 bp, Mus musculus
aagtgcccggagagcaacttccaga

SEQ ID NO: 68460 - DNA, 25 bp, Mus musculus
aagtgcccggagtgcaacttccaga

SEQ ID NO: 68461 - DNA, 25 bp, Mus musculus
aagtgcccgtacagctccagcaagt

SEQ ID NO: 68462 - DNA, 25 bp, Mus musculus
aagtgcccgtactgctccagcaagt

SEQ ID NO: 68463 - DNA, 25 bp, Mus musculus
aagtgccctgccagagtttgcatca

SEQ ID NO: 68464 - DNA, 25 bp, Mus musculus
aagtgccctgcctgagtttgcatca

SEQ ID NO: 68465 - DNA, 25 bp, Mus musculus
aagtgccctgtaactgcagcaggag

SEQ ID NO: 68466 - DNA, 25 bp, Mus musculus
aagtgccctgtatctgcagcaggag

SEQ ID NO: 68467 - DNA, 25 bp, Mus musculus
aagtgcccttctacacttgtaggac

SEQ ID NO: 68468 - DNA, 25 bp, Mus musculus
aagtgcccttcttcacttgtaggac

SEQ ID NO: 68469 - DNA, 25 bp, Mus musculus
aagtgcccttttcacctcacacgtg

SEQ ID NO: 68470 - DNA, 25 bp, Mus musculus
aagtgcccttttgacctcacacgtg

SEQ ID NO: 68471 - DNA, 25 bp, Mus musculus
aagtgccgagaacattcccattcct

SEQ ID NO: 68472 - DNA, 25 bp, Mus musculus
aagtgccgagaagattcccattcct

SEQ ID NO: 68473 - DNA, 25 bp, Mus musculus
aagtgccgagctaacttatctcttg

SEQ ID NO: 68474 - DNA, 25 bp, Mus musculus
aagtgccgagcttacttatctcttg

SEQ ID NO: 68475 - DNA, 25 bp, Mus musculus
aagtgccgattgaggtgtcgcccaa

SEQ ID NO: 68476 - DNA, 25 bp, Mus musculus
aagtgccgattgtggtgtcgcccaa

SEQ ID NO: 68477 - DNA, 25 bp, Mus musculus
aagtgccgggataaggcttgcgcca

SEQ ID NO: 68478 - DNA, 25 bp, Mus musculus
aagtgccgggattaggcttgcgcca

SEQ ID NO: 68479 - DNA, 25 bp, Mus musculus
aagtgccggtgaccgatgctcctaa

SEQ ID NO: 68480 - DNA, 25 bp, Mus musculus
aagtgccggtgagcgatgctcctaa

SEQ ID NO: 68481 - DNA, 25 bp, Mus musculus
aagtgccgtcttctaggcatgccag

SEQ ID NO: 68482 - DNA, 25 bp, Mus musculus
aagtgccgtcttgtaggcatgccag

SEQ ID NO: 68483 - DNA, 25 bp, Mus musculus
aagtgcctaagtcctcccaaataat

SEQ ID NO: 68484 - DNA, 25 bp, Mus musculus
aagtgcctaagtgctcccaaataat

SEQ ID NO: 68485 - DNA, 25 bp, Mus musculus
aagtgcctacctctctagctaattt

SEQ ID NO: 68486 - DNA, 25 bp, Mus musculus
aagtgcctacctgtctagctaattt

SEQ ID NO: 68487 - DNA, 25 bp, Mus musculus
aagtgcctagcgatctgaggactct

SEQ ID NO: 68488 - DNA, 25 bp, Mus musculus
aagtgcctagcgttctgaggactct

SEQ ID NO: 68489 - DNA, 25 bp, Mus musculus
aagtgcctaggcagcttcatcttcc

SEQ ID NO: 68490 - DNA, 25 bp, Mus musculus
aagtgcctaggccagaggataccct

SEQ ID NO: 68491 - DNA, 25 bp, Mus musculus
aagtgcctaggcgagaggataccct

SEQ ID NO: 68492 - DNA, 25 bp, Mus musculus
aagtgcctaggctgcttcatcttcc

SEQ ID NO: 68493 - DNA, 25 bp, Mus musculus
aagtgcctcagtctgcctatggaaa

SEQ ID NO: 68494 - DNA, 25 bp, Mus musculus
aagtgcctcagtgtgcctatggaaa

SEQ ID NO: 68495 - DNA, 25 bp, Mus musculus
aagtgcctcctcctgtcatgtgcat

SEQ ID NO: 68496 - DNA, 25 bp, Mus musculus
aagtgcctcctcgtgtcatgtgcat

SEQ ID NO: 68497 - DNA, 25 bp, Mus musculus
aagtgcctcgatcctgatccttaga

SEQ ID NO: 68498 - DNA, 25 bp, Mus musculus
aagtgcctcgatgctgatccttaga

SEQ ID NO: 68499 - DNA, 25 bp, Mus musculus
aagtgcctcggacccagacatctag

SEQ ID NO: 68500 - DNA, 25 bp, Mus musculus
aagtgcctcggagccagacatctag

SEQ ID NO: 68501 - DNA, 25 bp, Mus musculus
aagtgcctcggcattgatccagagt

SEQ ID NO: 68502 - DNA, 25 bp, Mus musculus
aagtgcctcggctttgatccagagt

SEQ ID NO: 68503 - DNA, 25 bp, Mus musculus
aagtgcctctcacattttgttgtgc

SEQ ID NO: 68504 - DNA, 25 bp, Mus musculus
aagtgcctctcagattttgttgtgc

SEQ ID NO: 68505 - DNA, 25 bp, Mus musculus
aagtgcctcttaagcagactgcttc

SEQ ID NO: 68506 - DNA, 25 bp, Mus musculus
aagtgcctcttatgcagactgcttc

SEQ ID NO: 68507 - DNA, 25 bp, Mus musculus
aagtgcctcttcagtctctagatct

SEQ ID NO: 68508 - DNA, 25 bp, Mus musculus
aagtgcctcttctgtctctagatct

SEQ ID NO: 68509 - DNA, 25 bp, Mus musculus
aagtgcctctttctagtattaaatg

SEQ ID NO: 68510 - DNA, 25 bp, Mus musculus
aagtgcctctttgtagtattaaatg

SEQ ID NO: 68511 - DNA, 25 bp, Mus musculus
aagtgcctgaccagacgttacacag

SEQ ID NO: 68512 - DNA, 25 bp, Mus musculus
aagtgcctgacctgacgttacacag

SEQ ID NO: 68513 - DNA, 25 bp, Mus musculus
aagtgcctgactagcttgcaagcat

SEQ ID NO: 68514 - DNA, 25 bp, Mus musculus
aagtgcctgactctactgctttcaa

SEQ ID NO: 68515 - DNA, 25 bp, Mus musculus
aagtgcctgactgtactgctttcaa

SEQ ID NO: 68516 - DNA, 25 bp, Mus musculus
aagtgcctgacttgcttgcaagcat

SEQ ID NO: 68517 - DNA, 25 bp, Mus musculus
aagtgcctgatccatccaccttcaa

SEQ ID NO: 68518 - DNA, 25 bp, Mus musculus
aagtgcctgatcgatccaccttcaa

SEQ ID NO: 68519 - DNA, 25 bp, Mus musculus
aagtgcctgattattcggaaagaat

SEQ ID NO: 68520 - DNA, 25 bp, Mus musculus
aagtgcctgatttttcggaaagaat

SEQ ID NO: 68521 - DNA, 25 bp, Mus musculus
aagtgcctgcagatcgttttgagtc

SEQ ID NO: 68522 - DNA, 25 bp, Mus musculus
aagtgcctgcagttcgttttgagtc

SEQ ID NO: 68523 - DNA, 25 bp, Mus musculus
aagtgcctgcttcatgcccatccag

SEQ ID NO: 68524 - DNA, 25 bp, Mus musculus
aagtgcctgcttgatgcccatccag

SEQ ID NO: 68525 - DNA, 25 bp, Mus musculus
aagtgcctggagacctttgacgatc

SEQ ID NO: 68526 - DNA, 25 bp, Mus musculus
aagtgcctggagattacggtgagat

SEQ ID NO: 68527 - DNA, 25 bp, Mus musculus
aagtgcctggagtcctttgacgatc

SEQ ID NO: 68528 - DNA, 25 bp, Mus musculus
aagtgcctggagtttacggtgagat

SEQ ID NO: 68529 - DNA, 25 bp, Mus musculus
aagtgcctgtatacctttcatttgc

SEQ ID NO: 68530 - DNA, 25 bp, Mus musculus
aagtgcctgtattcctttcatttgc

SEQ ID NO: 68531 - DNA, 25 bp, Mus musculus
aagtgcctgtctattcagtgtttgg

SEQ ID NO: 68532 - DNA, 25 bp, Mus musculus
aagtgcctgtcttttcagtgtttgg

SEQ ID NO: 68533 - DNA, 25 bp, Mus musculus
aagtgccttagaacctgagccacag

SEQ ID NO: 68534 - DNA, 25 bp, Mus musculus
aagtgccttagatcctgagccacag

SEQ ID NO: 68535 - DNA, 25 bp, Mus musculus
aagtgccttatgcacctgtggtcta

SEQ ID NO: 68536 - DNA, 25 bp, Mus musculus
aagtgccttatggacctgtggtcta

SEQ ID NO: 68537 - DNA, 25 bp, Mus musculus
aagtgccttcagaggatgggtgata

SEQ ID NO: 68538 - DNA, 25 bp, Mus musculus
aagtgccttcagtggatgggtgata

SEQ ID NO: 68539 - DNA, 25 bp, Mus musculus
aagtgccttgcaaatctttatgatt

SEQ ID NO: 68540 - DNA, 25 bp, Mus musculus
aagtgccttgcacttggtaggtgct

SEQ ID NO: 68541 - DNA, 25 bp, Mus musculus
aagtgccttgcagttggtaggtgct

SEQ ID NO: 68542 - DNA, 25 bp, Mus musculus
aagtgccttgcatatctttatgatt

SEQ ID NO: 68543 - DNA, 25 bp, Mus musculus
aagtgccttgtgaccatgatctgct

SEQ ID NO: 68544 - DNA, 25 bp, Mus musculus
aagtgccttgtgtccatgatctgct

SEQ ID NO: 68545 - DNA, 25 bp, Mus musculus
aagtgcctttagactatgatgatga

SEQ ID NO: 68546 - DNA, 25 bp, Mus musculus
aagtgcctttagtctatgatgatga

SEQ ID NO: 68547 - DNA, 25 bp, Mus musculus
aagtgcgacaagagcttccgattga

SEQ ID NO: 68548 - DNA, 25 bp, Mus musculus
aagtgcgacaagtgcttccgattga

SEQ ID NO: 68549 - DNA, 25 bp, Mus musculus
aagtgcgacggcaagacagcttgat

SEQ ID NO: 68550 - DNA, 25 bp, Mus musculus
aagtgcgacggctagacagcttgat

SEQ ID NO: 68551 - DNA, 25 bp, Mus musculus
aagtgcgagcacagcctttctaacc

SEQ ID NO: 68552 - DNA, 25 bp, Mus musculus
aagtgcgagcactgcctttctaacc

SEQ ID NO: 68553 - DNA, 25 bp, Mus musculus
aagtgcgatgatagactctcctcct

SEQ ID NO: 68554 - DNA, 25 bp, Mus musculus
aagtgcgatgattgactctcctcct

SEQ ID NO: 68555 - DNA, 25 bp, Mus musculus
aagtgcgcagaaaggtctacagttc

SEQ ID NO: 68556 - DNA, 25 bp, Mus musculus
aagtgcgcagaatggtctacagttc

SEQ ID NO: 68557 - DNA, 25 bp, Mus musculus
aagtgcgccagaactaccaccagga

SEQ ID NO: 68558 - DNA, 25 bp, Mus musculus
aagtgcgccagatctaccaccagga

SEQ ID NO: 68559 - DNA, 25 bp, Mus musculus
aagtgcgccagccagccttatttta

SEQ ID NO: 68560 - DNA, 25 bp, Mus musculus
aagtgcgccagcgagccttatttta

SEQ ID NO: 68561 - DNA, 25 bp, Mus musculus
aagtgcgctggtacaggaatggcca

SEQ ID NO: 68562 - DNA, 25 bp, Mus musculus
aagtgcgctggttcaggaatggcca

SEQ ID NO: 68563 - DNA, 25 bp, Mus musculus
aagtgcgcttggctcgtcagcacaa

SEQ ID NO: 68564 - DNA, 25 bp, Mus musculus
aagtgcgcttgggtcgtcagcacaa

SEQ ID NO: 68565 - DNA, 25 bp, Mus musculus
aagtgcgctttcagttgagttgata

SEQ ID NO: 68566 - DNA, 25 bp, Mus musculus
aagtgcgctttctgttgagttgata

SEQ ID NO: 68567 - DNA, 25 bp, Mus musculus
aagtgcggagctcatgcttgctcag

SEQ ID NO: 68568 - DNA, 25 bp, Mus musculus
aagtgcggagctgatgcttgctcag

SEQ ID NO: 68569 - DNA, 25 bp, Mus musculus
aagtgcggctaacaaacagctcagt

SEQ ID NO: 68570 - DNA, 25 bp, Mus musculus
aagtgcggctaagaaacagctcagt

SEQ ID NO: 68571 - DNA, 25 bp, Mus musculus
aagtgcgggacgacacagaagacac

SEQ ID NO: 68572 - DNA, 25 bp, Mus musculus
aagtgcgggacgtcacagaagacac

SEQ ID NO: 68573 - DNA, 25 bp, Mus musculus
aagtgcggtcatacctggtttaact

SEQ ID NO: 68574 - DNA, 25 bp, Mus musculus
aagtgcggtcattcctggtttaact

SEQ ID NO: 68575 - DNA, 25 bp, Mus musculus
aagtgcggttccagtacccatctgg

SEQ ID NO: 68576 - DNA, 25 bp, Mus musculus
aagtgcggttcctgtacccatctgg

SEQ ID NO: 68577 - DNA, 25 bp, Mus musculus
aagtgcgtgcagagtttcatcccag

SEQ ID NO: 68578 - DNA, 25 bp, Mus musculus
aagtgcgtgcagtgtttcatcccag

SEQ ID NO: 68579 - DNA, 25 bp, Mus musculus
aagtgcgtggccattgagtgaagcc

SEQ ID NO: 68580 - DNA, 25 bp, Mus musculus
aagtgcgtggcctttgagtgaagcc

SEQ ID NO: 68581 - DNA, 25 bp, Mus musculus
aagtgcgttcaaagtctgtgtctag

SEQ ID NO: 68582 - DNA, 25 bp, Mus musculus
aagtgcgttcaatgtctgtgtctag

SEQ ID NO: 68583 - DNA, 25 bp, Mus musculus
aagtgcgttccacatcactggagga

SEQ ID NO: 68584 - DNA, 25 bp, Mus musculus
aagtgcgttccagatcactggagga

SEQ ID NO: 68585 - DNA, 25 bp, Mus musculus
aagtgctaaagtcctcttcccagag

SEQ ID NO: 68586 - DNA, 25 bp, Mus musculus
aagtgctaaagtgctcttcccagag

SEQ ID NO: 68587 - DNA, 25 bp, Mus musculus
aagtgctaacacagtctcatttttt

SEQ ID NO: 68588 - DNA, 25 bp, Mus musculus
aagtgctaacactgtctcatttttt

SEQ ID NO: 68589 - DNA, 25 bp, Mus musculus
aagtgctaacagcatggcgacaaag

SEQ ID NO: 68590 - DNA, 25 bp, Mus musculus
aagtgctaacaggatggcgacaaag

SEQ ID NO: 68591 - DNA, 25 bp, Mus musculus
aagtgctaagtgattcagtctgtac

SEQ ID NO: 68592 - DNA, 25 bp, Mus musculus
aagtgctaagtgtttcagtctgtac

SEQ ID NO: 68593 - DNA, 25 bp, Mus musculus
aagtgctacaaccattggagccttt

SEQ ID NO: 68594 - DNA, 25 bp, Mus musculus
aagtgctacaacgattggagccttt

SEQ ID NO: 68595 - DNA, 25 bp, Mus musculus
aagtgctaccagaaccgatctgttg

SEQ ID NO: 68596 - DNA, 25 bp, Mus musculus
aagtgctaccagtaccgatctgttg

SEQ ID NO: 68597 - DNA, 25 bp, Mus musculus
aagtgctaccctcacttaaggagga

SEQ ID NO: 68598 - DNA, 25 bp, Mus musculus
aagtgctaccctgacttaaggagga

SEQ ID NO: 68599 - DNA, 25 bp, Mus musculus
aagtgctacctaacagcagacccgg

SEQ ID NO: 68600 - DNA, 25 bp, Mus musculus
aagtgctacctactagagccggaga

SEQ ID NO: 68601 - DNA, 25 bp, Mus musculus
aagtgctacctagtagagccggaga

SEQ ID NO: 68602 - DNA, 25 bp, Mus musculus
aagtgctacctatcagcagacccgg

SEQ ID NO: 68603 - DNA, 25 bp, Mus musculus
aagtgctacgtgattcctctgaaca

SEQ ID NO: 68604 - DNA, 25 bp, Mus musculus
aagtgctacgtgtttcctctgaaca

SEQ ID NO: 68605 - DNA, 25 bp, Mus musculus
aagtgctagcacacagatttgaagg

SEQ ID NO: 68606 - DNA, 25 bp, Mus musculus
aagtgctagcactcagatttgaagg

SEQ ID NO: 68607 - DNA, 25 bp, Mus musculus
aagtgctagcagaggtatatacagt

SEQ ID NO: 68608 - DNA, 25 bp, Mus musculus
aagtgctagcagtggtatatacagt

SEQ ID NO: 68609 - DNA, 25 bp, Mus musculus
aagtgctagcatctgcgttctcagc

SEQ ID NO: 68610 - DNA, 25 bp, Mus musculus
aagtgctagcatgtgcgttctcagc

SEQ ID NO: 68611 - DNA, 25 bp, Mus musculus
aagtgctagctgatgtacgtacgat

SEQ ID NO: 68612 - DNA, 25 bp, Mus musculus
aagtgctagctgttgtacgtacgat

SEQ ID NO: 68613 - DNA, 25 bp, Mus musculus
aagtgctagtgacgcagaccttctc

SEQ ID NO: 68614 - DNA, 25 bp, Mus musculus
aagtgctagtgaggcagaccttctc

SEQ ID NO: 68615 - DNA, 25 bp, Mus musculus
aagtgctagttcactttggttgcta

SEQ ID NO: 68616 - DNA, 25 bp, Mus musculus
aagtgctagttctctttggttgcta

SEQ ID NO: 68617 - DNA, 25 bp, Mus musculus
aagtgctataacctgcagttcccag

SEQ ID NO: 68618 - DNA, 25 bp, Mus musculus
aagtgctataacgtgcagttcccag

SEQ ID NO: 68619 - DNA, 25 bp, Mus musculus
aagtgctatcacatgcgtaccccaa

SEQ ID NO: 68620 - DNA, 25 bp, Mus musculus
aagtgctatcacttgcgtaccccaa

SEQ ID NO: 68621 - DNA, 25 bp, Mus musculus
aagtgctatgacagaggtggcctcc

SEQ ID NO: 68622 - DNA, 25 bp, Mus musculus
aagtgctatgactgaggtggcctcc

SEQ ID NO: 68623 - DNA, 25 bp, Mus musculus
aagtgctatgccctgaagatatttc

SEQ ID NO: 68624 - DNA, 25 bp, Mus musculus
aagtgctatgccgtgaagatatttc

SEQ ID NO: 68625 - DNA, 25 bp, Mus musculus
aagtgctatgtaacagtggctccca

SEQ ID NO: 68626 - DNA, 25 bp, Mus musculus
aagtgctatgtatcagtggctccca

SEQ ID NO: 68627 - DNA, 25 bp, Mus musculus
aagtgctatgtgcatccgtataaaa

SEQ ID NO: 68628 - DNA, 25 bp, Mus musculus
aagtgctatgtggatccgtataaaa

SEQ ID NO: 68629 - DNA, 25 bp, Mus musculus
aagtgctattatcgccactgtgagc

SEQ ID NO: 68630 - DNA, 25 bp, Mus musculus
aagtgctattatggccactgtgagc

SEQ ID NO: 68631 - DNA, 25 bp, Mus musculus
aagtgctatttgatcccaactcaga

SEQ ID NO: 68632 - DNA, 25 bp, Mus musculus
aagtgctatttgttcccaactcaga

SEQ ID NO: 68633 - DNA, 25 bp, Mus musculus
aagtgctcaacaaagagtggtgaca

SEQ ID NO: 68634 - DNA, 25 bp, Mus musculus
aagtgctcaacatagagtggtgaca

SEQ ID NO: 68635 - DNA, 25 bp, Mus musculus
aagtgctcaataaagaaatcctgga

SEQ ID NO: 68636 - DNA, 25 bp, Mus musculus
aagtgctcaatatagaaatcctgga

SEQ ID NO: 68637 - DNA, 25 bp, Mus musculus
aagtgctcacacaccagcaagaaag

SEQ ID NO: 68638 - DNA, 25 bp, Mus musculus
aagtgctcacactccagcaagaaag

SEQ ID NO: 68639 - DNA, 25 bp, Mus musculus
aagtgctcagaaatgttttcccatt

SEQ ID NO: 68640 - DNA, 25 bp, Mus musculus
aagtgctcagaattgttttcccatt

SEQ ID NO: 68641 - DNA, 25 bp, Mus musculus
aagtgctcagagaatcctctttatg

SEQ ID NO: 68642 - DNA, 25 bp, Mus musculus
aagtgctcagagctctatgctgcct

SEQ ID NO: 68643 - DNA, 25 bp, Mus musculus
aagtgctcagagcttttgcggcttt

SEQ ID NO: 68644 - DNA, 25 bp, Mus musculus
aagtgctcagaggtctatgctgcct

SEQ ID NO: 68645 - DNA, 25 bp, Mus musculus
aagtgctcagaggttttgcggcttt

SEQ ID NO: 68646 - DNA, 25 bp, Mus musculus
aagtgctcagagtatcctctttatg

SEQ ID NO: 68647 - DNA, 25 bp, Mus musculus
aagtgctccaaacctaacggtcaga

SEQ ID NO: 68648 - DNA, 25 bp, Mus musculus
aagtgctccaaagctaacggtcaga

SEQ ID NO: 68649 - DNA, 25 bp, Mus musculus
aagtgctccatcagtctgtgccata

SEQ ID NO: 68650 - DNA, 25 bp, Mus musculus
aagtgctccatctgtctgtgccata

SEQ ID NO: 68651 - DNA, 25 bp, Mus musculus
aagtgctccgagatcacattccaga

SEQ ID NO: 68652 - DNA, 25 bp, Mus musculus
aagtgctccgagttcacattccaga

SEQ ID NO: 68653 - DNA, 25 bp, Mus musculus
aagtgctcctggattcccagtggaa

SEQ ID NO: 68654 - DNA, 25 bp, Mus musculus
aagtgctcctggtttcccagtggaa

SEQ ID NO: 68655 - DNA, 25 bp, Mus musculus
aagtgctctactccctaagcctttg

SEQ ID NO: 68656 - DNA, 25 bp, Mus musculus
aagtgctctactgcctaagcctttg

SEQ ID NO: 68657 - DNA, 25 bp, Mus musculus
aagtgctctagcaagctgaacccca

SEQ ID NO: 68658 - DNA, 25 bp, Mus musculus
aagtgctctagctagctgaacccca

SEQ ID NO: 68659 - DNA, 25 bp, Mus musculus
aagtgctctatacatagtggctgcc

SEQ ID NO: 68660 - DNA, 25 bp, Mus musculus
aagtgctctatagatagtggctgcc

SEQ ID NO: 68661 - DNA, 25 bp, Mus musculus
aagtgctctgaacgtgagtccaaga

SEQ ID NO: 68662 - DNA, 25 bp, Mus musculus
aagtgctctgaaggtgagtccaaga

SEQ ID NO: 68663 - DNA, 25 bp, Mus musculus
aagtgctctgcaccgccgggtatcg

SEQ ID NO: 68664 - DNA, 25 bp, Mus musculus
aagtgctctgcagcgccgggtatcg

SEQ ID NO: 68665 - DNA, 25 bp, Mus musculus
aagtgctctgccattcagctgtatc

SEQ ID NO: 68666 - DNA, 25 bp, Mus musculus
aagtgctctgccctaggagttgatc

SEQ ID NO: 68667 - DNA, 25 bp, Mus musculus
aagtgctctgccgtaggagttgatc

SEQ ID NO: 68668 - DNA, 25 bp, Mus musculus
aagtgctctgcctttcagctgtatc

SEQ ID NO: 68669 - DNA, 25 bp, Mus musculus
aagtgctctgggacttcgtatttga

SEQ ID NO: 68670 - DNA, 25 bp, Mus musculus
aagtgctctgggtcttcgtatttga

SEQ ID NO: 68671 - DNA, 25 bp, Mus musculus
aagtgctctgtaatgtcacccttag

SEQ ID NO: 68672 - DNA, 25 bp, Mus musculus
aagtgctctgtattgtcacccttag

SEQ ID NO: 68673 - DNA, 25 bp, Mus musculus
aagtgctcttaaactcccagccatc

SEQ ID NO: 68674 - DNA, 25 bp, Mus musculus
aagtgctcttaatctcccagccatc

SEQ ID NO: 68675 - DNA, 25 bp, Mus musculus
aagtgctcttgcagtccagggcctg

SEQ ID NO: 68676 - DNA, 25 bp, Mus musculus
aagtgctcttgctgtccagggcctg

SEQ ID NO: 68677 - DNA, 25 bp, Mus musculus
aagtgctgacataccacgtgtgtgt

SEQ ID NO: 68678 - DNA, 25 bp, Mus musculus
aagtgctgacatccctataacctca

SEQ ID NO: 68679 - DNA, 25 bp, Mus musculus
aagtgctgacatgcctataacctca

SEQ ID NO: 68680 - DNA, 25 bp, Mus musculus
aagtgctgacattccacgtgtgtgt

SEQ ID NO: 68681 - DNA, 25 bp, Mus musculus
aagtgctgaccgagcttcatatcat

SEQ ID NO: 68682 - DNA, 25 bp, Mus musculus
aagtgctgaccgtgcttcatatcat

SEQ ID NO: 68683 - DNA, 25 bp, Mus musculus
aagtgctgactccaaatgctatttt

SEQ ID NO: 68684 - DNA, 25 bp, Mus musculus
aagtgctgactcgaaatgctatttt

SEQ ID NO: 68685 - DNA, 25 bp, Mus musculus
aagtgctgactgacctctgctcggc

SEQ ID NO: 68686 - DNA, 25 bp, Mus musculus
aagtgctgactgacgtttgtgtgtg

SEQ ID NO: 68687 - DNA, 25 bp, Mus musculus
aagtgctgactgagcagtctgaccc

SEQ ID NO: 68688 - DNA, 25 bp, Mus musculus
aagtgctgactgtcctctgctcggc

SEQ ID NO: 68689 - DNA, 25 bp, Mus musculus
aagtgctgactgtcgtttgtgtgtg

SEQ ID NO: 68690 - DNA, 25 bp, Mus musculus
aagtgctgactgtgcagtctgaccc

SEQ ID NO: 68691 - DNA, 25 bp, Mus musculus
aagtgctgagacactgaggctccat

SEQ ID NO: 68692 - DNA, 25 bp, Mus musculus
aagtgctgagactctgaggctccat

SEQ ID NO: 68693 - DNA, 25 bp, Mus musculus
aagtgctgagccatcaattggtcca

SEQ ID NO: 68694 - DNA, 25 bp, Mus musculus
aagtgctgagccttcaattggtcca

SEQ ID NO: 68695 - DNA, 25 bp, Mus musculus
aagtgctgataactgaccttggagt

SEQ ID NO: 68696 - DNA, 25 bp, Mus musculus
aagtgctgataagtgaccttggagt

SEQ ID NO: 68697 - DNA, 25 bp, Mus musculus
aagtgctgatgacgtcatcccggcg

SEQ ID NO: 68698 - DNA, 25 bp, Mus musculus
aagtgctgatgaggtcatcccggcg

SEQ ID NO: 68699 - DNA, 25 bp, Mus musculus
aagtgctgatggacactgcctgggc

SEQ ID NO: 68700 - DNA, 25 bp, Mus musculus
aagtgctgatggtcactgcctgggc

SEQ ID NO: 68701 - DNA, 25 bp, Mus musculus
aagtgctgcaaaccccaggaccagg

SEQ ID NO: 68702 - DNA, 25 bp, Mus musculus
aagtgctgcaaagcccaggaccagg

SEQ ID NO: 68703 - DNA, 25 bp, Mus musculus
aagtgctgcagtaacaaagttttga

SEQ ID NO: 68704 - DNA, 25 bp, Mus musculus
aagtgctgcagttacaaagttttga

SEQ ID NO: 68705 - DNA, 25 bp, Mus musculus
aagtgctgcctcagtggccgctgca

SEQ ID NO: 68706 - DNA, 25 bp, Mus musculus
aagtgctgcctctgtggccgctgca

SEQ ID NO: 68707 - DNA, 25 bp, Mus musculus
aagtgctgctctataaactcacctc

SEQ ID NO: 68708 - DNA, 25 bp, Mus musculus
aagtgctgctctttaaactcacctc

SEQ ID NO: 68709 - DNA, 25 bp, Mus musculus
aagtgctgctgcagtgctcggaccc

SEQ ID NO: 68710 - DNA, 25 bp, Mus musculus
aagtgctgctgctgtgctcggaccc

SEQ ID NO: 68711 - DNA, 25 bp, Mus musculus
aagtgctgctggacattcggtctcg

SEQ ID NO: 68712 - DNA, 25 bp, Mus musculus
aagtgctgctggtcattcggtctcg

SEQ ID NO: 68713 - DNA, 25 bp, Mus musculus
aagtgctggaacatccgcttcagga

SEQ ID NO: 68714 - DNA, 25 bp, Mus musculus
aagtgctggaacttccgcttcagga

SEQ ID NO: 68715 - DNA, 25 bp, Mus musculus
aagtgctggaatcagagaggacccc

SEQ ID NO: 68716 - DNA, 25 bp, Mus musculus
aagtgctggaatgagagaggacccc

SEQ ID NO: 68717 - DNA, 25 bp, Mus musculus
aagtgctggacactctctccttcgc

SEQ ID NO: 68718 - DNA, 25 bp, Mus musculus
aagtgctggacagtctctccttcgc

SEQ ID NO: 68719 - DNA, 25 bp, Mus musculus
aagtgctggaccatgcagctctgaa

SEQ ID NO: 68720 - DNA, 25 bp, Mus musculus
aagtgctggaccttgcagctctgaa

SEQ ID NO: 68721 - DNA, 25 bp, Mus musculus
aagtgctggcacactatgggcgctc

SEQ ID NO: 68722 - DNA, 25 bp, Mus musculus
aagtgctggcactctatgggcgctc

SEQ ID NO: 68723 - DNA, 25 bp, Mus musculus
aagtgctggccccagagcatgaagt

SEQ ID NO: 68724 - DNA, 25 bp, Mus musculus
aagtgctggcccgagagcatgaagt

SEQ ID NO: 68725 - DNA, 25 bp, Mus musculus
aagtgctgggaaagccacccttgtg

SEQ ID NO: 68726 - DNA, 25 bp, Mus musculus
aagtgctgggaaatcaagggagcca

SEQ ID NO: 68727 - DNA, 25 bp, Mus musculus
aagtgctgggaatgccacccttgtg

SEQ ID NO: 68728 - DNA, 25 bp, Mus musculus
aagtgctgggaattcaagggagcca

SEQ ID NO: 68729 - DNA, 25 bp, Mus musculus
aagtgctgggctacgtccttgcttt

SEQ ID NO: 68730 - DNA, 25 bp, Mus musculus
aagtgctgggcttcgtccttgcttt

SEQ ID NO: 68731 - DNA, 25 bp, Mus musculus
aagtgctgggtcaatccaggtccag

SEQ ID NO: 68732 - DNA, 25 bp, Mus musculus
aagtgctgggtctatccaggtccag

SEQ ID NO: 68733 - DNA, 25 bp, Mus musculus
aagtgctgggttaaatattcaaact

SEQ ID NO: 68734 - DNA, 25 bp, Mus musculus
aagtgctgggtttaatattcaaact

SEQ ID NO: 68735 - DNA, 25 bp, Mus musculus
aagtgctggtgaaaagtcgtctgtt

SEQ ID NO: 68736 - DNA, 25 bp, Mus musculus
aagtgctggtgataagtcgtctgtt

SEQ ID NO: 68737 - DNA, 25 bp, Mus musculus
aagtgctggtgtacgctcagggtat

SEQ ID NO: 68738 - DNA, 25 bp, Mus musculus
aagtgctggtgttcgctcagggtat

SEQ ID NO: 68739 - DNA, 25 bp, Mus musculus
aagtgctgtaccactgagctcactt

SEQ ID NO: 68740 - DNA, 25 bp, Mus musculus
aagtgctgtacctctgagctcactt

SEQ ID NO: 68741 - DNA, 25 bp, Mus musculus
aagtgctgtagactggccaaacctc

SEQ ID NO: 68742 - DNA, 25 bp, Mus musculus
aagtgctgtagagtggccaaacctc

SEQ ID NO: 68743 - DNA, 25 bp, Mus musculus
aagtgctgtgtcatcaactgtggaa

SEQ ID NO: 68744 - DNA, 25 bp, Mus musculus
aagtgctgtgtccaagttcttgggt

SEQ ID NO: 68745 - DNA, 25 bp, Mus musculus
aagtgctgtgtcgaagttcttgggt

SEQ ID NO: 68746 - DNA, 25 bp, Mus musculus
aagtgctgtgtcttcaactgtggaa

SEQ ID NO: 68747 - DNA, 25 bp, Mus musculus
aagtgctgtgtgctataaacccaac

SEQ ID NO: 68748 - DNA, 25 bp, Mus musculus
aagtgctgtgtggtataaacccaac

SEQ ID NO: 68749 - DNA, 25 bp, Mus musculus
aagtgctgttaacccttatctccat

SEQ ID NO: 68750 - DNA, 25 bp, Mus musculus
aagtgctgttaagccttatctccat

SEQ ID NO: 68751 - DNA, 25 bp, Mus musculus
aagtgctgttgacatagccgcgatc

SEQ ID NO: 68752 - DNA, 25 bp, Mus musculus
aagtgctgttgagatagccgcgatc

SEQ ID NO: 68753 - DNA, 25 bp, Mus musculus
aagtgctgttgcagtgtaagtagac

SEQ ID NO: 68754 - DNA, 25 bp, Mus musculus
aagtgctgttgctgtgtaagtagac

SEQ ID NO: 68755 - DNA, 25 bp, Mus musculus
aagtgctgtttgaacgcaaccttgc

SEQ ID NO: 68756 - DNA, 25 bp, Mus musculus
aagtgctgtttgcaaatcctcctag

SEQ ID NO: 68757 - DNA, 25 bp, Mus musculus
aagtgctgtttggaaatcctcctag

SEQ ID NO: 68758 - DNA, 25 bp, Mus musculus
aagtgctgtttgtacgcaaccttgc

SEQ ID NO: 68759 - DNA, 25 bp, Mus musculus
aagtgcttaatgaaaatctgatcca

SEQ ID NO: 68760 - DNA, 25 bp, Mus musculus
aagtgcttaatgacagccgtctctc

SEQ ID NO: 68761 - DNA, 25 bp, Mus musculus
aagtgcttaatgtaaatctgatcca

SEQ ID NO: 68762 - DNA, 25 bp, Mus musculus
aagtgcttaatgtcagccgtctctc

SEQ ID NO: 68763 - DNA, 25 bp, Mus musculus
aagtgcttatgtatttctgactaac

SEQ ID NO: 68764 - DNA, 25 bp, Mus musculus
aagtgcttatgtttttctgactaac

SEQ ID NO: 68765 - DNA, 25 bp, Mus musculus
aagtgcttccacaaaagagatacca

SEQ ID NO: 68766 - DNA, 25 bp, Mus musculus
aagtgcttccacacacaagtggtca

SEQ ID NO: 68767 - DNA, 25 bp, Mus musculus
aagtgcttccactaaagagatacca

SEQ ID NO: 68768 - DNA, 25 bp, Mus musculus
aagtgcttccactcacaagtggtca

SEQ ID NO: 68769 - DNA, 25 bp, Mus musculus
aagtgcttccggcatgcaggccaaa

SEQ ID NO: 68770 - DNA, 25 bp, Mus musculus
aagtgcttccgggatgcaggccaaa

SEQ ID NO: 68771 - DNA, 25 bp, Mus musculus
aagtgcttcgtactgatgtgtgtgt

SEQ ID NO: 68772 - DNA, 25 bp, Mus musculus
aagtgcttcgtagtgatgtgtgtgt

SEQ ID NO: 68773 - DNA, 25 bp, Mus musculus
aagtgcttgccgctaagcctgaaga

SEQ ID NO: 68774 - DNA, 25 bp, Mus musculus
aagtgcttgccggtaagcctgaaga

SEQ ID NO: 68775 - DNA, 25 bp, Mus musculus
aagtgcttgcttatgcgtaatctac

SEQ ID NO: 68776 - DNA, 25 bp, Mus musculus
aagtgcttgcttttgcgtaatctac

SEQ ID NO: 68777 - DNA, 25 bp, Mus musculus
aagtgcttggcaatcgcgatctcct

SEQ ID NO: 68778 - DNA, 25 bp, Mus musculus
aagtgcttggcaccatttcatccta

SEQ ID NO: 68779 - DNA, 25 bp, Mus musculus
aagtgcttggcagcatttcatccta

SEQ ID NO: 68780 - DNA, 25 bp, Mus musculus
aagtgcttggcattcgcgatctcct

SEQ ID NO: 68781 - DNA, 25 bp, Mus musculus
aagtgcttggctagctatacttcac

SEQ ID NO: 68782 - DNA, 25 bp, Mus musculus
aagtgcttggcttgctatacttcac

SEQ ID NO: 68783 - DNA, 25 bp, Mus musculus
aagtgcttgggtcgcacgtgtcatc

SEQ ID NO: 68784 - DNA, 25 bp, Mus musculus
aagtgcttgggtggcacgtgtcatc

SEQ ID NO: 68785 - DNA, 25 bp, Mus musculus
aagtgcttggtcaactctgcctgtc

SEQ ID NO: 68786 - DNA, 25 bp, Mus musculus
aagtgcttggtctactctgcctgtc

SEQ ID NO: 68787 - DNA, 25 bp, Mus musculus
aagtgcttggtgcaccaggccacag

SEQ ID NO: 68788 - DNA, 25 bp, Mus musculus
aagtgcttggtggaccaggccacag

SEQ ID NO: 68789 - DNA, 25 bp, Mus musculus
aagtgctttcaaatgcagagccatc

SEQ ID NO: 68790 - DNA, 25 bp, Mus musculus
aagtgctttcaaattactcaaatag

SEQ ID NO: 68791 - DNA, 25 bp, Mus musculus
aagtgctttcaattgcagagccatc

SEQ ID NO: 68792 - DNA, 25 bp, Mus musculus
aagtgctttcaatttactcaaatag

SEQ ID NO: 68793 - DNA, 25 bp, Mus musculus
aagtgctttcctcgcattcgtgagg

SEQ ID NO: 68794 - DNA, 25 bp, Mus musculus
aagtgctttcctggcattcgtgagg

SEQ ID NO: 68795 - DNA, 25 bp, Mus musculus
aagtgctttctgacagacgctggga

SEQ ID NO: 68796 - DNA, 25 bp, Mus musculus
aagtgctttctgtcagacgctggga

SEQ ID NO: 68797 - DNA, 25 bp, Mus musculus
aagtgctttgcaagatttcaggtta

SEQ ID NO: 68798 - DNA, 25 bp, Mus musculus
aagtgctttgcatgatttcaggtta

SEQ ID NO: 68799 - DNA, 25 bp, Mus musculus
aagtgctttggcacaccaagccatc

SEQ ID NO: 68800 - DNA, 25 bp, Mus musculus
aagtgctttggctcaccaagccatc

SEQ ID NO: 68801 - DNA, 25 bp, Mus musculus
aagtgctttggtaacacctgtagcc

SEQ ID NO: 68802 - DNA, 25 bp, Mus musculus
aagtgctttggttacacctgtagcc

SEQ ID NO: 68803 - DNA, 25 bp, Mus musculus
aagtgctttgtccttctaatcagtt

SEQ ID NO: 68804 - DNA, 25 bp, Mus musculus
aagtgctttgtcgttctaatcagtt

SEQ ID NO: 68805 - DNA, 25 bp, Mus musculus
aagtgcttttccaatcttcaactca

SEQ ID NO: 68806 - DNA, 25 bp, Mus musculus
aagtgcttttcctatcttcaactca

SEQ ID NO: 68807 - DNA, 25 bp, Mus musculus
aagtgcttttctcctgaactctatg

SEQ ID NO: 68808 - DNA, 25 bp, Mus musculus
aagtgcttttctctgcacgtgggca

SEQ ID NO: 68809 - DNA, 25 bp, Mus musculus
aagtgcttttctgctgaactctatg

SEQ ID NO: 68810 - DNA, 25 bp, Mus musculus
aagtgcttttctgtgcacgtgggca

SEQ ID NO: 68811 - DNA, 25 bp, Mus musculus
aagtgcttttttcaaagtgatcagc

SEQ ID NO: 68812 - DNA, 25 bp, Mus musculus
aagtgcttttttgaaagtgatcagc

SEQ ID NO: 68813 - DNA, 25 bp, Mus musculus
aagtggaaacaaatactctgaatgt

SEQ ID NO: 68814 - DNA, 25 bp, Mus musculus
aagtggaaacaattactctgaatgt

SEQ ID NO: 68815 - DNA, 25 bp, Mus musculus
aagtggaaacgcataccccagtctt

SEQ ID NO: 68816 - DNA, 25 bp, Mus musculus
aagtggaaacgcttaccccagtctt

SEQ ID NO: 68817 - DNA, 25 bp, Mus musculus
aagtggaaatgcatcgcctcatcag

SEQ ID NO: 68818 - DNA, 25 bp, Mus musculus
aagtggaaatgcttcgcctcatcag

SEQ ID NO: 68819 - DNA, 25 bp, Mus musculus
aagtggaacactcctcagagcttca

SEQ ID NO: 68820 - DNA, 25 bp, Mus musculus
aagtggaacactgctcagagcttca

SEQ ID NO: 68821 - DNA, 25 bp, Mus musculus
aagtggaaccagatgcaggccttct

SEQ ID NO: 68822 - DNA, 25 bp, Mus musculus
aagtggaaccagttgcaggccttct

SEQ ID NO: 68823 - DNA, 25 bp, Mus musculus
aagtggaagagcaagccgctccttt

SEQ ID NO: 68824 - DNA, 25 bp, Mus musculus
aagtggaagagctagccgctccttt

SEQ ID NO: 68825 - DNA, 25 bp, Mus musculus
aagtggaagcctatgattgaaaaca

SEQ ID NO: 68826 - DNA, 25 bp, Mus musculus
aagtggaagcctttgattgaaaaca

SEQ ID NO: 68827 - DNA, 25 bp, Mus musculus
aagtggaaggtcagctcctgggtca

SEQ ID NO: 68828 - DNA, 25 bp, Mus musculus
aagtggaaggtctgctcctgggtca

SEQ ID NO: 68829 - DNA, 25 bp, Mus musculus
aagtggaatcccatcttcaggacga

SEQ ID NO: 68830 - DNA, 25 bp, Mus musculus
aagtggaatcccttcttcaggacga

SEQ ID NO: 68831 - DNA, 25 bp, Mus musculus
aagtggacagatacttcatcgctgt

SEQ ID NO: 68832 - DNA, 25 bp, Mus musculus
aagtggacagattcttcatcgctgt

SEQ ID NO: 68833 - DNA, 25 bp, Mus musculus
aagtggacagcgctttgacaaaaag

SEQ ID NO: 68834 - DNA, 25 bp, Mus musculus
aagtggacagcggtttgacaaaaag

SEQ ID NO: 68835 - DNA, 25 bp, Mus musculus
aagtggacagctagttaatggtaac

SEQ ID NO: 68836 - DNA, 25 bp, Mus musculus
aagtggacagcttgttaatggtaac

SEQ ID NO: 68837 - DNA, 25 bp, Mus musculus
aagtggacatctatgctttgggcct

SEQ ID NO: 68838 - DNA, 25 bp, Mus musculus
aagtggacatctttgctttgggcct

SEQ ID NO: 68839 - DNA, 25 bp, Mus musculus
aagtggacccggctggcttcaatga

SEQ ID NO: 68840 - DNA, 25 bp, Mus musculus
aagtggacccgggtggcttcaatga

SEQ ID NO: 68841 - DNA, 25 bp, Mus musculus
aagtggaccgtgaaaacctggcatc

SEQ ID NO: 68842 - DNA, 25 bp, Mus musculus
aagtggaccgtgtaaacctggcatc

SEQ ID NO: 68843 - DNA, 25 bp, Mus musculus
aagtggacctttccacacttgtggg

SEQ ID NO: 68844 - DNA, 25 bp, Mus musculus
aagtggacctttgcacacttgtggg

SEQ ID NO: 68845 - DNA, 25 bp, Mus musculus
aagtggacgcctcaccgaacgggat

SEQ ID NO: 68846 - DNA, 25 bp, Mus musculus
aagtggacgcctgaccgaacgggat

SEQ ID NO: 68847 - DNA, 25 bp, Mus musculus
aagtggacgtctatatcctgtgcac

SEQ ID NO: 68848 - DNA, 25 bp, Mus musculus
aagtggacgtctccattttgtttct

SEQ ID NO: 68849 - DNA, 25 bp, Mus musculus
aagtggacgtctgcattttgtttct

SEQ ID NO: 68850 - DNA, 25 bp, Mus musculus
aagtggacgtctttatcctgtgcac

SEQ ID NO: 68851 - DNA, 25 bp, Mus musculus
aagtggactaacagtagagatacaa

SEQ ID NO: 68852 - DNA, 25 bp, Mus musculus
aagtggactaactgtagagatacaa

SEQ ID NO: 68853 - DNA, 25 bp, Mus musculus
aagtggactgtgccagtatagtaca

SEQ ID NO: 68854 - DNA, 25 bp, Mus musculus
aagtggactgtggcagtatagtaca

SEQ ID NO: 68855 - DNA, 25 bp, Mus musculus
aagtggacttccacgagttcatcgt

SEQ ID NO: 68856 - DNA, 25 bp, Mus musculus
aagtggacttcctcgagttcatcgt

SEQ ID NO: 68857 - DNA, 25 bp, Mus musculus
aagtggacttcgctctctctccgat

SEQ ID NO: 68858 - DNA, 25 bp, Mus musculus
aagtggacttcggtctctctccgat

SEQ ID NO: 68859 - DNA, 25 bp, Mus musculus
aagtggagaattccatggcttttat

SEQ ID NO: 68860 - DNA, 25 bp, Mus musculus
aagtggagaattgcatggcttttat

SEQ ID NO: 68861 - DNA, 25 bp, Mus musculus
aagtggagaccaatctgcttaaaat

SEQ ID NO: 68862 - DNA, 25 bp, Mus musculus
aagtggagaccattctgcttaaaat

SEQ ID NO: 68863 - DNA, 25 bp, Mus musculus
aagtggagacctcgcccttcagtta

SEQ ID NO: 68864 - DNA, 25 bp, Mus musculus
aagtggagacctggcccttcagtta

SEQ ID NO: 68865 - DNA, 25 bp, Mus musculus
aagtggagcagcactgaccctctga

SEQ ID NO: 68866 - DNA, 25 bp, Mus musculus
aagtggagcagctctgaccctctga

SEQ ID NO: 68867 - DNA, 25 bp, Mus musculus
aagtggagccatagctgcgactcta

SEQ ID NO: 68868 - DNA, 25 bp, Mus musculus
aagtggagccattgctgcgactcta

SEQ ID NO: 68869 - DNA, 25 bp, Mus musculus
aagtggagccttaaccagatggtaa

SEQ ID NO: 68870 - DNA, 25 bp, Mus musculus
aagtggagcctttaccagatggtaa

SEQ ID NO: 68871 - DNA, 25 bp, Mus musculus
aagtggagctacctatgcgctgctc

SEQ ID NO: 68872 - DNA, 25 bp, Mus musculus
aagtggagctacgtatgcgctgctc

SEQ ID NO: 68873 - DNA, 25 bp, Mus musculus
aagtggagctgtacagtaagtggaa

SEQ ID NO: 68874 - DNA, 25 bp, Mus musculus
aagtggagctgttcagtaagtggaa

SEQ ID NO: 68875 - DNA, 25 bp, Mus musculus
aagtggaggagccatcgagaccctc

SEQ ID NO: 68876 - DNA, 25 bp, Mus musculus
aagtggaggagcgatcgagaccctc

SEQ ID NO: 68877 - DNA, 25 bp, Mus musculus
aagtggaggcccagtgtgcttccag

SEQ ID NO: 68878 - DNA, 25 bp, Mus musculus
aagtggaggccctgtgtgcttccag

SEQ ID NO: 68879 - DNA, 25 bp, Mus musculus
aagtggaggcctctaggctacgcct

SEQ ID NO: 68880 - DNA, 25 bp, Mus musculus
aagtggaggcctgtaggctacgcct

SEQ ID NO: 68881 - DNA, 25 bp, Mus musculus
aagtggagtaccagcagtcacccct

SEQ ID NO: 68882 - DNA, 25 bp, Mus musculus
aagtggagtacctgcagtcacccct

SEQ ID NO: 68883 - DNA, 25 bp, Mus musculus
aagtggagtttaccggcagcatcaa

SEQ ID NO: 68884 - DNA, 25 bp, Mus musculus
aagtggagtttagcggcagcatcaa

SEQ ID NO: 68885 - DNA, 25 bp, Mus musculus
aagtggataagtcgcagccccatgc

SEQ ID NO: 68886 - DNA, 25 bp, Mus musculus
aagtggataagtggcagccccatgc

SEQ ID NO: 68887 - DNA, 25 bp, Mus musculus
aagtggatacatatctatttgtgat

SEQ ID NO: 68888 - DNA, 25 bp, Mus musculus
aagtggatacatttctatttgtgat

SEQ ID NO: 68889 - DNA, 25 bp, Mus musculus
aagtggatcaatcctactgaccctt

SEQ ID NO: 68890 - DNA, 25 bp, Mus musculus
aagtggatcaatgctactgaccctt

SEQ ID NO: 68891 - DNA, 25 bp, Mus musculus
aagtggatctgtcctacttgctgtc

SEQ ID NO: 68892 - DNA, 25 bp, Mus musculus
aagtggatctgtgctacttgctgtc

SEQ ID NO: 68893 - DNA, 25 bp, Mus musculus
aagtggatgagacccgcaagtgcta

SEQ ID NO: 68894 - DNA, 25 bp, Mus musculus
aagtggatgagagccgcaagtgcta

SEQ ID NO: 68895 - DNA, 25 bp, Mus musculus
aagtggatgatcagggcaccctgct

SEQ ID NO: 68896 - DNA, 25 bp, Mus musculus
aagtggatgatctgggcaccctgct

SEQ ID NO: 68897 - DNA, 25 bp, Mus musculus
aagtggatgctccatccgattctag

SEQ ID NO: 68898 - DNA, 25 bp, Mus musculus
aagtggatgctcgatccgattctag

SEQ ID NO: 68899 - DNA, 25 bp, Mus musculus
aagtggattaagctctggtcctaga

SEQ ID NO: 68900 - DNA, 25 bp, Mus musculus
aagtggattaaggtctggtcctaga

SEQ ID NO: 68901 - DNA, 25 bp, Mus musculus
aagtggattcctagtcgcctaagga

SEQ ID NO: 68902 - DNA, 25 bp, Mus musculus
aagtggattccttgtcgcctaagga

SEQ ID NO: 68903 - DNA, 25 bp, Mus musculus
aagtggattcgaatgggcctggcta

SEQ ID NO: 68904 - DNA, 25 bp, Mus musculus
aagtggattcgattgggcctggcta

SEQ ID NO: 68905 - DNA, 25 bp, Mus musculus
aagtggattcttcacagcgctgtgc

SEQ ID NO: 68906 - DNA, 25 bp, Mus musculus
aagtggattcttgacagcgctgtgc

SEQ ID NO: 68907 - DNA, 25 bp, Mus musculus
aagtggcaaaacagtacccctcaca

SEQ ID NO: 68908 - DNA, 25 bp, Mus musculus
aagtggcaaaactgtacccctcaca

SEQ ID NO: 68909 - DNA, 25 bp, Mus musculus
aagtggcaaagcatcctcagttctc

SEQ ID NO: 68910 - DNA, 25 bp, Mus musculus
aagtggcaaagcttcctcagttctc

SEQ ID NO: 68911 - DNA, 25 bp, Mus musculus
aagtggcaagccagctgagctactg

SEQ ID NO: 68912 - DNA, 25 bp, Mus musculus
aagtggcaagcctgctgagctactg

SEQ ID NO: 68913 - DNA, 25 bp, Mus musculus
aagtggcaaggaagcatcatgtcaa

SEQ ID NO: 68914 - DNA, 25 bp, Mus musculus
aagtggcaaggatgcatcatgtcaa

SEQ ID NO: 68915 - DNA, 25 bp, Mus musculus
aagtggcaaggtaacaaagtggcta

SEQ ID NO: 68916 - DNA, 25 bp, Mus musculus
aagtggcaaggtcgtgactggtgaa

SEQ ID NO: 68917 - DNA, 25 bp, Mus musculus
aagtggcaaggtggtgactggtgaa

SEQ ID NO: 68918 - DNA, 25 bp, Mus musculus
aagtggcaaggttacaaagtggcta

SEQ ID NO: 68919 - DNA, 25 bp, Mus musculus
aagtggcaatgcacaggtgcttctg

SEQ ID NO: 68920 - DNA, 25 bp, Mus musculus
aagtggcaatgctcaggtgcttctg

SEQ ID NO: 68921 - DNA, 25 bp, Mus musculus
aagtggcacagacttagcactccat

SEQ ID NO: 68922 - DNA, 25 bp, Mus musculus
aagtggcacagactttgctggctgc

SEQ ID NO: 68923 - DNA, 25 bp, Mus musculus
aagtggcacagagttagcactccat

SEQ ID NO: 68924 - DNA, 25 bp, Mus musculus
aagtggcacagagtttgctggctgc

SEQ ID NO: 68925 - DNA, 25 bp, Mus musculus
aagtggcacattaccagcgttccca

SEQ ID NO: 68926 - DNA, 25 bp, Mus musculus
aagtggcacattcagctctattggt

SEQ ID NO: 68927 - DNA, 25 bp, Mus musculus
aagtggcacattgagctctattggt

SEQ ID NO: 68928 - DNA, 25 bp, Mus musculus
aagtggcacatttccagcgttccca

SEQ ID NO: 68929 - DNA, 25 bp, Mus musculus
aagtggcacccaccccagcagaatg

SEQ ID NO: 68930 - DNA, 25 bp, Mus musculus
aagtggcacccagcccagcagaatg

SEQ ID NO: 68931 - DNA, 25 bp, Mus musculus
aagtggcacctgctggacgacctgt

SEQ ID NO: 68932 - DNA, 25 bp, Mus musculus
aagtggcacctggtggacgacctgt

SEQ ID NO: 68933 - DNA, 25 bp, Mus musculus
aagtggcactctcacctctggagaa

SEQ ID NO: 68934 - DNA, 25 bp, Mus musculus
aagtggcactctgacctctggagaa

SEQ ID NO: 68935 - DNA, 25 bp, Mus musculus
aagtggcactgaatagctcgagtca

SEQ ID NO: 68936 - DNA, 25 bp, Mus musculus
aagtggcactgattagctcgagtca

SEQ ID NO: 68937 - DNA, 25 bp, Mus musculus
aagtggcagacaccaacatgcagat

SEQ ID NO: 68938 - DNA, 25 bp, Mus musculus
aagtggcagacagcaacatgcagat

SEQ ID NO: 68939 - DNA, 25 bp, Mus musculus
aagtggcagattaagggcatgagtt

SEQ ID NO: 68940 - DNA, 25 bp, Mus musculus
aagtggcagattcccggttggctca

SEQ ID NO: 68941 - DNA, 25 bp, Mus musculus
aagtggcagattgccggttggctca

SEQ ID NO: 68942 - DNA, 25 bp, Mus musculus
aagtggcagatttagggcatgagtt

SEQ ID NO: 68943 - DNA, 25 bp, Mus musculus
aagtggcagcatcaccgattcgttg

SEQ ID NO: 68944 - DNA, 25 bp, Mus musculus
aagtggcagcatgaccgattcgttg

SEQ ID NO: 68945 - DNA, 25 bp, Mus musculus
aagtggcagcccatagacactgtga

SEQ ID NO: 68946 - DNA, 25 bp, Mus musculus
aagtggcagcccttagacactgtga

SEQ ID NO: 68947 - DNA, 25 bp, Mus musculus
aagtggcagcgcacactgtgtgacc

SEQ ID NO: 68948 - DNA, 25 bp, Mus musculus
aagtggcagcgctcactgtgtgacc

SEQ ID NO: 68949 - DNA, 25 bp, Mus musculus
aagtggcataccatggctctatgtg

SEQ ID NO: 68950 - DNA, 25 bp, Mus musculus
aagtggcataccttggctctatgtg

SEQ ID NO: 68951 - DNA, 25 bp, Mus musculus
aagtggcatagtcctcctggaagtc

SEQ ID NO: 68952 - DNA, 25 bp, Mus musculus
aagtggcatagtgctcctggaagtc

SEQ ID NO: 68953 - DNA, 25 bp, Mus musculus
aagtggcatcctatggccggcccta

SEQ ID NO: 68954 - DNA, 25 bp, Mus musculus
aagtggcatcctttggccggcccta

SEQ ID NO: 68955 - DNA, 25 bp, Mus musculus
aagtggcatgatacgagacgctggc

SEQ ID NO: 68956 - DNA, 25 bp, Mus musculus
aagtggcatgattcgagacgctggc

SEQ ID NO: 68957 - DNA, 25 bp, Mus musculus
aagtggcatggtagtttcttgctgc

SEQ ID NO: 68958 - DNA, 25 bp, Mus musculus
aagtggcatggttgtttcttgctgc

SEQ ID NO: 68959 - DNA, 25 bp, Mus musculus
aagtggcatgtaagtttccatccag

SEQ ID NO: 68960 - DNA, 25 bp, Mus musculus
aagtggcatgtatgtttccatccag

SEQ ID NO: 68961 - DNA, 25 bp, Mus musculus
aagtggcattaactgtcccctactg

SEQ ID NO: 68962 - DNA, 25 bp, Mus musculus
aagtggcattaagtgtcccctactg

SEQ ID NO: 68963 - DNA, 25 bp, Mus musculus
aagtggcattcccaggtctctgagc

SEQ ID NO: 68964 - DNA, 25 bp, Mus musculus
aagtggcattccgaggtctctgagc

SEQ ID NO: 68965 - DNA, 25 bp, Mus musculus
aagtggccaaacatcgcctactctt

SEQ ID NO: 68966 - DNA, 25 bp, Mus musculus
aagtggccaaacttcgcctactctt

SEQ ID NO: 68967 - DNA, 25 bp, Mus musculus
aagtggccaagacagtcttctgcct

SEQ ID NO: 68968 - DNA, 25 bp, Mus musculus
aagtggccaagagagtcttctgcct

SEQ ID NO: 68969 - DNA, 25 bp, Mus musculus
aagtggccaatcatgagactgagca

SEQ ID NO: 68970 - DNA, 25 bp, Mus musculus
aagtggccaatcttgagactgagca

SEQ ID NO: 68971 - DNA, 25 bp, Mus musculus
aagtggccaccacggactacaacca

SEQ ID NO: 68972 - DNA, 25 bp, Mus musculus
aagtggccaccagggactacaacca

SEQ ID NO: 68973 - DNA, 25 bp, Mus musculus
aagtggccactgcagtcatctctac

SEQ ID NO: 68974 - DNA, 25 bp, Mus musculus
aagtggccactggagtcatctctac

SEQ ID NO: 68975 - DNA, 25 bp, Mus musculus
aagtggccacttaccacagagctat

SEQ ID NO: 68976 - DNA, 25 bp, Mus musculus
aagtggccactttccacagagctat

SEQ ID NO: 68977 - DNA, 25 bp, Mus musculus
aagtggccaggtcacatttctgtgt

SEQ ID NO: 68978 - DNA, 25 bp, Mus musculus
aagtggccaggtgacatttctgtgt

SEQ ID NO: 68979 - DNA, 25 bp, Mus musculus
aagtggccagtgaaccagaagaggc

SEQ ID NO: 68980 - DNA, 25 bp, Mus musculus
aagtggccagtgtaccagaagaggc

SEQ ID NO: 68981 - DNA, 25 bp, Mus musculus
aagtggccattacctttgttatcta

SEQ ID NO: 68982 - DNA, 25 bp, Mus musculus
aagtggccattagctttgttatcta

SEQ ID NO: 68983 - DNA, 25 bp, Mus musculus
aagtggccatttaaggcattacttt

SEQ ID NO: 68984 - DNA, 25 bp, Mus musculus
aagtggccatttatatacatgtatg

SEQ ID NO: 68985 - DNA, 25 bp, Mus musculus
aagtggccattttaggcattacttt

SEQ ID NO: 68986 - DNA, 25 bp, Mus musculus
aagtggccatttttatacatgtatg

SEQ ID NO: 68987 - DNA, 25 bp, Mus musculus
aagtggcccagcacttatgccagat

SEQ ID NO: 68988 - DNA, 25 bp, Mus musculus
aagtggcccagctcttatgccagat

SEQ ID NO: 68989 - DNA, 25 bp, Mus musculus
aagtggcccaggagtttttgtcaga

SEQ ID NO: 68990 - DNA, 25 bp, Mus musculus
aagtggcccaggtgtttttgtcaga

SEQ ID NO: 68991 - DNA, 25 bp, Mus musculus
aagtggcccagtatcacatcattct

SEQ ID NO: 68992 - DNA, 25 bp, Mus musculus
aagtggcccagtttcacatcattct

SEQ ID NO: 68993 - DNA, 25 bp, Mus musculus
aagtggccccagagagtgtcagtga

SEQ ID NO: 68994 - DNA, 25 bp, Mus musculus
aagtggccccagcttgagaaacaaa

SEQ ID NO: 68995 - DNA, 25 bp, Mus musculus
aagtggccccaggttgagaaacaaa

SEQ ID NO: 68996 - DNA, 25 bp, Mus musculus
aagtggccccagtgagtgtcagtga

SEQ ID NO: 68997 - DNA, 25 bp, Mus musculus
aagtggccctgaagcgagtgaactg

SEQ ID NO: 68998 - DNA, 25 bp, Mus musculus
aagtggccctgatgcgagtgaactg

SEQ ID NO: 68999 - DNA, 25 bp, Mus musculus
aagtggccggtaaaggtacctctgt

SEQ ID NO: 69000 - DNA, 25 bp, Mus musculus
aagtggccggtataggtacctctgt

SEQ ID NO: 69001 - DNA, 25 bp, Mus musculus
aagtggcctagcagcactgctgctg

SEQ ID NO: 69002 - DNA, 25 bp, Mus musculus
aagtggcctagctgcactgctgctg

SEQ ID NO: 69003 - DNA, 25 bp, Mus musculus
aagtggcctcatactgcaaccaata

SEQ ID NO: 69004 - DNA, 25 bp, Mus musculus
aagtggcctcattctgcaaccaata

SEQ ID NO: 69005 - DNA, 25 bp, Mus musculus
aagtggcctccacagaaggtagtca

SEQ ID NO: 69006 - DNA, 25 bp, Mus musculus
aagtggcctccagagaaggtagtca

SEQ ID NO: 69007 - DNA, 25 bp, Mus musculus
aagtggcctcctctggtcacgaact

SEQ ID NO: 69008 - DNA, 25 bp, Mus musculus
aagtggcctcctgtggtcacgaact

SEQ ID NO: 69009 - DNA, 25 bp, Mus musculus
aagtggcctcgaaagtaaagctcat

SEQ ID NO: 69010 - DNA, 25 bp, Mus musculus
aagtggcctcgatagtaaagctcat

SEQ ID NO: 69011 - DNA, 25 bp, Mus musculus
aagtggccttagcaactgggcagct

SEQ ID NO: 69012 - DNA, 25 bp, Mus musculus
aagtggccttaggaactgggcagct

SEQ ID NO: 69013 - DNA, 25 bp, Mus musculus
aagtggccttatacgcagggatcgc

SEQ ID NO: 69014 - DNA, 25 bp, Mus musculus
aagtggccttattcgcagggatcgc

SEQ ID NO: 69015 - DNA, 25 bp, Mus musculus
aagtggccttggaggtaccagaaga

SEQ ID NO: 69016 - DNA, 25 bp, Mus musculus
aagtggccttggtggtaccagaaga

SEQ ID NO: 69017 - DNA, 25 bp, Mus musculus
aagtggccttgtaggttgccttact

SEQ ID NO: 69018 - DNA, 25 bp, Mus musculus
aagtggccttgttggttgccttact

SEQ ID NO: 69019 - DNA, 25 bp, Mus musculus
aagtggcgcaaccttactcaggaaa

SEQ ID NO: 69020 - DNA, 25 bp, Mus musculus
aagtggcgcaacgttactcaggaaa

SEQ ID NO: 69021 - DNA, 25 bp, Mus musculus
aagtggcgtctactccagtaaatcc

SEQ ID NO: 69022 - DNA, 25 bp, Mus musculus
aagtggcgtctagtccagtaaatcc

SEQ ID NO: 69023 - DNA, 25 bp, Mus musculus
aagtggctaataagcagcaggcaca

SEQ ID NO: 69024 - DNA, 25 bp, Mus musculus
aagtggctaatatgcagcaggcaca

SEQ ID NO: 69025 - DNA, 25 bp, Mus musculus
aagtggctacagcattgtggctaac

SEQ ID NO: 69026 - DNA, 25 bp, Mus musculus
aagtggctacaggattgtggctaac

SEQ ID NO: 69027 - DNA, 25 bp, Mus musculus
aagtggctaccacaagtgtttctac

SEQ ID NO: 69028 - DNA, 25 bp, Mus musculus
aagtggctaccagaagtgtttctac

SEQ ID NO: 69029 - DNA, 25 bp, Mus musculus
aagtggctaccgaggtgccgttccg

SEQ ID NO: 69030 - DNA, 25 bp, Mus musculus
aagtggctaccgtggtgccgttccg

SEQ ID NO: 69031 - DNA, 25 bp, Mus musculus
aagtggctactacaagctcccttca

SEQ ID NO: 69032 - DNA, 25 bp, Mus musculus
aagtggctactagaagctcccttca

SEQ ID NO: 69033 - DNA, 25 bp, Mus musculus
aagtggctatgacaacctgaccttc

SEQ ID NO: 69034 - DNA, 25 bp, Mus musculus
aagtggctatgagaacctgaccttc

SEQ ID NO: 69035 - DNA, 25 bp, Mus musculus
aagtggctatgccttggaactggca

SEQ ID NO: 69036 - DNA, 25 bp, Mus musculus
aagtggctatgcgttggaactggca

SEQ ID NO: 69037 - DNA, 25 bp, Mus musculus
aagtggctatgtacttccctgggta

SEQ ID NO: 69038 - DNA, 25 bp, Mus musculus
aagtggctatgttcttccctgggta

SEQ ID NO: 69039 - DNA, 25 bp, Mus musculus
aagtggctattgaggatgacccaag

SEQ ID NO: 69040 - DNA, 25 bp, Mus musculus
aagtggctattgtggatgacccaag

SEQ ID NO: 69041 - DNA, 25 bp, Mus musculus
aagtggctccacatagaaaaacctg

SEQ ID NO: 69042 - DNA, 25 bp, Mus musculus
aagtggctccacttagaaaaacctg

SEQ ID NO: 69043 - DNA, 25 bp, Mus musculus
aagtggctcgcactgaggctcctga

SEQ ID NO: 69044 - DNA, 25 bp, Mus musculus
aagtggctcgcagtgaggctcctga

SEQ ID NO: 69045 - DNA, 25 bp, Mus musculus
aagtggctctcactattgtgacagt

SEQ ID NO: 69046 - DNA, 25 bp, Mus musculus
aagtggctctcagtattgtgacagt

SEQ ID NO: 69047 - DNA, 25 bp, Mus musculus
aagtggctctgcaggtttgaaatgt

SEQ ID NO: 69048 - DNA, 25 bp, Mus musculus
aagtggctctgctggtttgaaatgt

SEQ ID NO: 69049 - DNA, 25 bp, Mus musculus
aagtggctgaagaacatcgtctaca

SEQ ID NO: 69050 - DNA, 25 bp, Mus musculus
aagtggctgaagtacatcgtctaca

SEQ ID NO: 69051 - DNA, 25 bp, Mus musculus
aagtggctgaggacttggagaccct

SEQ ID NO: 69052 - DNA, 25 bp, Mus musculus
aagtggctgaggtcttggagaccct

SEQ ID NO: 69053 - DNA, 25 bp, Mus musculus
aagtggctgcacagctagagcgctg

SEQ ID NO: 69054 - DNA, 25 bp, Mus musculus
aagtggctgcactgctagagcgctg

SEQ ID NO: 69055 - DNA, 25 bp, Mus musculus
aagtggctgcccaggatgttgccaa

SEQ ID NO: 69056 - DNA, 25 bp, Mus musculus
aagtggctgccctggatgttgccaa

SEQ ID NO: 69057 - DNA, 25 bp, Mus musculus
aagtggctgctgaagttaccatgca

SEQ ID NO: 69058 - DNA, 25 bp, Mus musculus
aagtggctgctgtagttaccatgca

SEQ ID NO: 69059 - DNA, 25 bp, Mus musculus
aagtggctggccaagattgcctgag

SEQ ID NO: 69060 - DNA, 25 bp, Mus musculus
aagtggctggcccaggacttagtcc

SEQ ID NO: 69061 - DNA, 25 bp, Mus musculus
aagtggctggccgaggacttagtcc

SEQ ID NO: 69062 - DNA, 25 bp, Mus musculus
aagtggctggcctagattgcctgag

SEQ ID NO: 69063 - DNA, 25 bp, Mus musculus
aagtggctggtaaccctaggaaaag

SEQ ID NO: 69064 - DNA, 25 bp, Mus musculus
aagtggctggtatccctaggaaaag

SEQ ID NO: 69065 - DNA, 25 bp, Mus musculus
aagtggctggtgagacaccgtgcaa

SEQ ID NO: 69066 - DNA, 25 bp, Mus musculus
aagtggctggtgtgacaccgtgcaa

SEQ ID NO: 69067 - DNA, 25 bp, Mus musculus
aagtggctgtgtcggattttgaaca

SEQ ID NO: 69068 - DNA, 25 bp, Mus musculus
aagtggctgtgtgggattttgaaca

SEQ ID NO: 69069 - DNA, 25 bp, Mus musculus
aagtggctgttgcttctgaccaaaa

SEQ ID NO: 69070 - DNA, 25 bp, Mus musculus
aagtggctgttggttctgaccaaaa

SEQ ID NO: 69071 - DNA, 25 bp, Mus musculus
aagtggcttagacctagatcccaat

SEQ ID NO: 69072 - DNA, 25 bp, Mus musculus
aagtggcttagagctagatcccaat

SEQ ID NO: 69073 - DNA, 25 bp, Mus musculus
aagtggcttcagcatctcacaagac

SEQ ID NO: 69074 - DNA, 25 bp, Mus musculus
aagtggcttcaggatctcacaagac

SEQ ID NO: 69075 - DNA, 25 bp, Mus musculus
aagtggcttcataagtcactgcctt

SEQ ID NO: 69076 - DNA, 25 bp, Mus musculus
aagtggcttcattagtcactgcctt

SEQ ID NO: 69077 - DNA, 25 bp, Mus musculus
aagtggcttccgcaaggcagtcgca

SEQ ID NO: 69078 - DNA, 25 bp, Mus musculus
aagtggcttccggaaggcagtcgca

SEQ ID NO: 69079 - DNA, 25 bp, Mus musculus
aagtggcttcggcagcgtcctatga

SEQ ID NO: 69080 - DNA, 25 bp, Mus musculus
aagtggcttcgggagcgtcctatga

SEQ ID NO: 69081 - DNA, 25 bp, Mus musculus
aagtggcttctgaaagatcccacgt

SEQ ID NO: 69082 - DNA, 25 bp, Mus musculus
aagtggcttctgtaagatcccacgt

SEQ ID NO: 69083 - DNA, 25 bp, Mus musculus
aagtggctttcgctttcagtgaatt

SEQ ID NO: 69084 - DNA, 25 bp, Mus musculus
aagtggctttcggtttcagtgaatt

SEQ ID NO: 69085 - DNA, 25 bp, Mus musculus
aagtggctttctctactttgcacgt

SEQ ID NO: 69086 - DNA, 25 bp, Mus musculus
aagtggctttctgtactttgcacgt

SEQ ID NO: 69087 - DNA, 25 bp, Mus musculus
aagtgggaaatacccctgaactctt

SEQ ID NO: 69088 - DNA, 25 bp, Mus musculus
aagtgggaaatagccctgaactctt

SEQ ID NO: 69089 - DNA, 25 bp, Mus musculus
aagtgggaagaacgcacacctagct

SEQ ID NO: 69090 - DNA, 25 bp, Mus musculus
aagtgggaagaaggcacacctagct

SEQ ID NO: 69091 - DNA, 25 bp, Mus musculus
aagtgggaatggctgctacctgttt

SEQ ID NO: 69092 - DNA, 25 bp, Mus musculus
aagtgggaatgggtgctacctgttt

SEQ ID NO: 69093 - DNA, 25 bp, Mus musculus
aagtgggaatttcagctctgatact

SEQ ID NO: 69094 - DNA, 25 bp, Mus musculus
aagtgggaatttgagctctgatact

SEQ ID NO: 69095 - DNA, 25 bp, Mus musculus
aagtgggacaggaacaccatccggt

SEQ ID NO: 69096 - DNA, 25 bp, Mus musculus
aagtgggacaggtacaccatccggt

SEQ ID NO: 69097 - DNA, 25 bp, Mus musculus
aagtgggacagtatggttccataca

SEQ ID NO: 69098 - DNA, 25 bp, Mus musculus
aagtgggacagtttggttccataca

SEQ ID NO: 69099 - DNA, 25 bp, Mus musculus
aagtgggacatccatattagcctaa

SEQ ID NO: 69100 - DNA, 25 bp, Mus musculus
aagtgggacatcgatattagcctaa

SEQ ID NO: 69101 - DNA, 25 bp, Mus musculus
aagtgggacggcatctggcattctt

SEQ ID NO: 69102 - DNA, 25 bp, Mus musculus
aagtgggacggcttctggcattctt

SEQ ID NO: 69103 - DNA, 25 bp, Mus musculus
aagtgggacgtaatgtgcacagaaa

SEQ ID NO: 69104 - DNA, 25 bp, Mus musculus
aagtgggacgtattgtgcacagaaa

SEQ ID NO: 69105 - DNA, 25 bp, Mus musculus
aagtgggactatatgacaggtgaga

SEQ ID NO: 69106 - DNA, 25 bp, Mus musculus
aagtgggactatcccagagctgctg

SEQ ID NO: 69107 - DNA, 25 bp, Mus musculus
aagtgggactatgccagagctgctg

SEQ ID NO: 69108 - DNA, 25 bp, Mus musculus
aagtgggactatttgacaggtgaga

SEQ ID NO: 69109 - DNA, 25 bp, Mus musculus
aagtgggagatgctcctttttgtcc

SEQ ID NO: 69110 - DNA, 25 bp, Mus musculus
aagtgggagatggtcctttttgtcc

SEQ ID NO: 69111 - DNA, 25 bp, Mus musculus
aagtgggagcctaggactgattgta

SEQ ID NO: 69112 - DNA, 25 bp, Mus musculus
aagtgggagccttggactgattgta

SEQ ID NO: 69113 - DNA, 25 bp, Mus musculus
aagtgggagctcaccatctgtactg

SEQ ID NO: 69114 - DNA, 25 bp, Mus musculus
aagtgggagctcatccagctggctg

SEQ ID NO: 69115 - DNA, 25 bp, Mus musculus
aagtgggagctctccatctgtactg

SEQ ID NO: 69116 - DNA, 25 bp, Mus musculus
aagtgggagctcttccagctggctg

SEQ ID NO: 69117 - DNA, 25 bp, Mus musculus
aagtgggaggccagcccatctgtgt

SEQ ID NO: 69118 - DNA, 25 bp, Mus musculus
aagtgggaggcctgcccatctgtgt

SEQ ID NO: 69119 - DNA, 25 bp, Mus musculus
aagtgggagtcaacttgccctggaa

SEQ ID NO: 69120 - DNA, 25 bp, Mus musculus
aagtgggagtcatcttgccctggaa

SEQ ID NO: 69121 - DNA, 25 bp, Mus musculus
aagtgggatacccagacagacagac

SEQ ID NO: 69122 - DNA, 25 bp, Mus musculus
aagtgggataccgagacagacagac

SEQ ID NO: 69123 - DNA, 25 bp, Mus musculus
aagtgggatgccatgcctaacctcg

SEQ ID NO: 69124 - DNA, 25 bp, Mus musculus
aagtgggatgccttgcctaacctcg

SEQ ID NO: 69125 - DNA, 25 bp, Mus musculus
aagtgggatggaactgctagtgaac

SEQ ID NO: 69126 - DNA, 25 bp, Mus musculus
aagtgggatggatctgctagtgaac

SEQ ID NO: 69127 - DNA, 25 bp, Mus musculus
aagtgggatgttctgtctgatgctt

SEQ ID NO: 69128 - DNA, 25 bp, Mus musculus
aagtgggatgttgtgtctgatgctt

SEQ ID NO: 69129 - DNA, 25 bp, Mus musculus
aagtgggattcccagactccagcac

SEQ ID NO: 69130 - DNA, 25 bp, Mus musculus
aagtgggattccgagactccagcac

SEQ ID NO: 69131 - DNA, 25 bp, Mus musculus
aagtgggcactgactacagcaggtg

SEQ ID NO: 69132 - DNA, 25 bp, Mus musculus
aagtgggcactgtctacagcaggtg

SEQ ID NO: 69133 - DNA, 25 bp, Mus musculus
aagtgggcagcaaatgcctggccat

SEQ ID NO: 69134 - DNA, 25 bp, Mus musculus
aagtgggcagcatatgcctggccat

SEQ ID NO: 69135 - DNA, 25 bp, Mus musculus
aagtgggcagggattattcattaca

SEQ ID NO: 69136 - DNA, 25 bp, Mus musculus
aagtgggcagggtttattcattaca

SEQ ID NO: 69137 - DNA, 25 bp, Mus musculus
aagtgggcagtgctgctctttgcac

SEQ ID NO: 69138 - DNA, 25 bp, Mus musculus
aagtgggcagtggtgctctttgcac

SEQ ID NO: 69139 - DNA, 25 bp, Mus musculus
aagtgggcatctagttcttctccta

SEQ ID NO: 69140 - DNA, 25 bp, Mus musculus
aagtgggcatcttgttcttctccta

SEQ ID NO: 69141 - DNA, 25 bp, Mus musculus
aagtgggccaagaatcttgccctga

SEQ ID NO: 69142 - DNA, 25 bp, Mus musculus
aagtgggccaagtatcttgccctga

SEQ ID NO: 69143 - DNA, 25 bp, Mus musculus
aagtgggccagcctacacagcagac

SEQ ID NO: 69144 - DNA, 25 bp, Mus musculus
aagtgggccagcgtacacagcagac

SEQ ID NO: 69145 - DNA, 25 bp, Mus musculus
aagtgggcccagaactcatagagat

SEQ ID NO: 69146 - DNA, 25 bp, Mus musculus
aagtgggcccagtactcatagagat

SEQ ID NO: 69147 - DNA, 25 bp, Mus musculus
aagtgggccccaatatctgcctaaa

SEQ ID NO: 69148 - DNA, 25 bp, Mus musculus
aagtgggccccattatctgcctaaa

SEQ ID NO: 69149 - DNA, 25 bp, Mus musculus
aagtgggcgttacgccagactccaa

SEQ ID NO: 69150 - DNA, 25 bp, Mus musculus
aagtgggcgttaggccagactccaa

SEQ ID NO: 69151 - DNA, 25 bp, Mus musculus
aagtgggctagcaatcagctgtgct

SEQ ID NO: 69152 - DNA, 25 bp, Mus musculus
aagtgggctagctatcagctgtgct

SEQ ID NO: 69153 - DNA, 25 bp, Mus musculus
aagtgggctcctactggaagcagtt

SEQ ID NO: 69154 - DNA, 25 bp, Mus musculus
aagtgggctccttctggaagcagtt

SEQ ID NO: 69155 - DNA, 25 bp, Mus musculus
aagtgggctcgaacaatggaggcat

SEQ ID NO: 69156 - DNA, 25 bp, Mus musculus
aagtgggctcgatcaatggaggcat

SEQ ID NO: 69157 - DNA, 25 bp, Mus musculus
aagtgggctcggacttcattggcag

SEQ ID NO: 69158 - DNA, 25 bp, Mus musculus
aagtgggctcggtcttcattggcag

SEQ ID NO: 69159 - DNA, 25 bp, Mus musculus
aagtgggcttatatctctcatttta

SEQ ID NO: 69160 - DNA, 25 bp, Mus musculus
aagtgggcttatttctctcatttta

SEQ ID NO: 69161 - DNA, 25 bp, Mus musculus
aagtgggcttctcaatccagcatcc

SEQ ID NO: 69162 - DNA, 25 bp, Mus musculus
aagtgggcttctgaatccagcatcc

SEQ ID NO: 69163 - DNA, 25 bp, Mus musculus
aagtgggtagccacacagatccaat

SEQ ID NO: 69164 - DNA, 25 bp, Mus musculus
aagtgggtagcctcacagatccaat

SEQ ID NO: 69165 - DNA, 25 bp, Mus musculus
aagtgggtatacagccagatacagg

SEQ ID NO: 69166 - DNA, 25 bp, Mus musculus
aagtgggtatactgccagatacagg

SEQ ID NO: 69167 - DNA, 25 bp, Mus musculus
aagtgggtatgtcacgttttgctaa

SEQ ID NO: 69168 - DNA, 25 bp, Mus musculus
aagtgggtatgtgacgttttgctaa

SEQ ID NO: 69169 - DNA, 25 bp, Mus musculus
aagtgggtcatgcatcacgcacagc

SEQ ID NO: 69170 - DNA, 25 bp, Mus musculus
aagtgggtcatggatcacgcacagc

SEQ ID NO: 69171 - DNA, 25 bp, Mus musculus
aagtgggtcattcggccaggtcctt

SEQ ID NO: 69172 - DNA, 25 bp, Mus musculus
aagtgggtcattgggccaggtcctt

SEQ ID NO: 69173 - DNA, 25 bp, Mus musculus
aagtgggtccctcggatacttctgg

SEQ ID NO: 69174 - DNA, 25 bp, Mus musculus
aagtgggtccctgggatacttctgg

SEQ ID NO: 69175 - DNA, 25 bp, Mus musculus
aagtgggtctgcctttacatcgagc

SEQ ID NO: 69176 - DNA, 25 bp, Mus musculus
aagtgggtctgcgtttacatcgagc

SEQ ID NO: 69177 - DNA, 25 bp, Mus musculus
aagtgggtgaggatcccttctgtca

SEQ ID NO: 69178 - DNA, 25 bp, Mus musculus
aagtgggtgaggttcccttctgtca

SEQ ID NO: 69179 - DNA, 25 bp, Mus musculus
aagtgggtgatcatcggcctgcttc

SEQ ID NO: 69180 - DNA, 25 bp, Mus musculus
aagtgggtgatcttcggcctgcttc

SEQ ID NO: 69181 - DNA, 25 bp, Mus musculus
aagtgggtgcaaacacttgcagcaa

SEQ ID NO: 69182 - DNA, 25 bp, Mus musculus
aagtgggtgcaatcacttgcagcaa

SEQ ID NO: 69183 - DNA, 25 bp, Mus musculus
aagtgggtgcctaaccttatcacat

SEQ ID NO: 69184 - DNA, 25 bp, Mus musculus
aagtgggtgccttaccttatcacat

SEQ ID NO: 69185 - DNA, 25 bp, Mus musculus
aagtgggtgcttaattgtggaaatc

SEQ ID NO: 69186 - DNA, 25 bp, Mus musculus
aagtgggtgctttattgtggaaatc

SEQ ID NO: 69187 - DNA, 25 bp, Mus musculus
aagtgggtgtctctgagttcatcgt

SEQ ID NO: 69188 - DNA, 25 bp, Mus musculus
aagtgggtgtctgtgagttcatcgt

SEQ ID NO: 69189 - DNA, 25 bp, Mus musculus
aagtggtaaaccaggctgaggatgt

SEQ ID NO: 69190 - DNA, 25 bp, Mus musculus
aagtggtaaacctggctgaggatgt

SEQ ID NO: 69191 - DNA, 25 bp, Mus musculus
aagtggtaaagactcccagctccct

SEQ ID NO: 69192 - DNA, 25 bp, Mus musculus
aagtggtaaagagtcccagctccct

SEQ ID NO: 69193 - DNA, 25 bp, Mus musculus
aagtggtacaaacccgtgtctgctc

SEQ ID NO: 69194 - DNA, 25 bp, Mus musculus
aagtggtacaaagccgtgtctgctc

SEQ ID NO: 69195 - DNA, 25 bp, Mus musculus
aagtggtagacgaggcattcataaa

SEQ ID NO: 69196 - DNA, 25 bp, Mus musculus
aagtggtagacgtggcattcataaa

SEQ ID NO: 69197 - DNA, 25 bp, Mus musculus
aagtggtagtgaaaaatctgaaaca

SEQ ID NO: 69198 - DNA, 25 bp, Mus musculus
aagtggtagtgataaatctgaaaca

SEQ ID NO: 69199 - DNA, 25 bp, Mus musculus
aagtggtatactaggctgtctgggt

SEQ ID NO: 69200 - DNA, 25 bp, Mus musculus
aagtggtatacttggctgtctgggt

SEQ ID NO: 69201 - DNA, 25 bp, Mus musculus
aagtggtatccaaagacaactgccc

SEQ ID NO: 69202 - DNA, 25 bp, Mus musculus
aagtggtatccatagacaactgccc

SEQ ID NO: 69203 - DNA, 25 bp, Mus musculus
aagtggtcacttactcttgccattc

SEQ ID NO: 69204 - DNA, 25 bp, Mus musculus
aagtggtcacttcgttccagaaccg

SEQ ID NO: 69205 - DNA, 25 bp, Mus musculus
aagtggtcacttggttccagaaccg

SEQ ID NO: 69206 - DNA, 25 bp, Mus musculus
aagtggtcactttctcttgccattc

SEQ ID NO: 69207 - DNA, 25 bp, Mus musculus
aagtggtcaggaacgcctagtcaat

SEQ ID NO: 69208 - DNA, 25 bp, Mus musculus
aagtggtcaggaccccggaacgcca

SEQ ID NO: 69209 - DNA, 25 bp, Mus musculus
aagtggtcaggagcccggaacgcca

SEQ ID NO: 69210 - DNA, 25 bp, Mus musculus
aagtggtcaggatcgcctagtcaat

SEQ ID NO: 69211 - DNA, 25 bp, Mus musculus
aagtggtccagccactgcgaagcaa

SEQ ID NO: 69212 - DNA, 25 bp, Mus musculus
aagtggtccagcgactgcgaagcaa

SEQ ID NO: 69213 - DNA, 25 bp, Mus musculus
aagtggtccgcaatgagttcaccct

SEQ ID NO: 69214 - DNA, 25 bp, Mus musculus
aagtggtccgcattgagttcaccct

SEQ ID NO: 69215 - DNA, 25 bp, Mus musculus
aagtggtcctagattctgccttgca

SEQ ID NO: 69216 - DNA, 25 bp, Mus musculus
aagtggtcctagtttctgccttgca

SEQ ID NO: 69217 - DNA, 25 bp, Mus musculus
aagtggtcctttaggctctaggata

SEQ ID NO: 69218 - DNA, 25 bp, Mus musculus
aagtggtccttttggctctaggata

SEQ ID NO: 69219 - DNA, 25 bp, Mus musculus
aagtggtcgacccagaattgcctca

SEQ ID NO: 69220 - DNA, 25 bp, Mus musculus
aagtggtcgaccgagaattgcctca

SEQ ID NO: 69221 - DNA, 25 bp, Mus musculus
aagtggtctacacggccatccaata

SEQ ID NO: 69222 - DNA, 25 bp, Mus musculus
aagtggtctacagggccatccaata

SEQ ID NO: 69223 - DNA, 25 bp, Mus musculus
aagtggtctccaataagtacttgag

SEQ ID NO: 69224 - DNA, 25 bp, Mus musculus
aagtggtctccattaagtacttgag

SEQ ID NO: 69225 - DNA, 25 bp, Mus musculus
aagtggtctctgacctctgctcaag

SEQ ID NO: 69226 - DNA, 25 bp, Mus musculus
aagtggtctctgtcctctgctcaag

SEQ ID NO: 69227 - DNA, 25 bp, Mus musculus
aagtggtctgggatcagtgctgtta

SEQ ID NO: 69228 - DNA, 25 bp, Mus musculus
aagtggtctgggttcagtgctgtta

SEQ ID NO: 69229 - DNA, 25 bp, Mus musculus
aagtggtctgtgacaggtacttcca

SEQ ID NO: 69230 - DNA, 25 bp, Mus musculus
aagtggtctgtgtcaggtacttcca

SEQ ID NO: 69231 - DNA, 25 bp, Mus musculus
aagtggtcttatacacgtgggtgat

SEQ ID NO: 69232 - DNA, 25 bp, Mus musculus
aagtggtcttattcacgtgggtgat

SEQ ID NO: 69233 - DNA, 25 bp, Mus musculus
aagtggtgaaatactgctgctcctt

SEQ ID NO: 69234 - DNA, 25 bp, Mus musculus
aagtggtgaaattctgctgctcctt

SEQ ID NO: 69235 - DNA, 25 bp, Mus musculus
aagtggtgaacgactggctgtgctc

SEQ ID NO: 69236 - DNA, 25 bp, Mus musculus
aagtggtgaacgtctggctgtgctc

SEQ ID NO: 69237 - DNA, 25 bp, Mus musculus
aagtggtgaactacgcgcagggatt

SEQ ID NO: 69238 - DNA, 25 bp, Mus musculus
aagtggtgaacttcgcgcagggatt

SEQ ID NO: 69239 - DNA, 25 bp, Mus musculus
aagtggtgaatccagcgctcccttg

SEQ ID NO: 69240 - DNA, 25 bp, Mus musculus
aagtggtgaatcgagcgctcccttg

SEQ ID NO: 69241 - DNA, 25 bp, Mus musculus
aagtggtgacaacaattctggctga

SEQ ID NO: 69242 - DNA, 25 bp, Mus musculus
aagtggtgacaagaattctggctga

SEQ ID NO: 69243 - DNA, 25 bp, Mus musculus
aagtggtgacacacactacccattg

SEQ ID NO: 69244 - DNA, 25 bp, Mus musculus
aagtggtgacacctgaaggctgaca

SEQ ID NO: 69245 - DNA, 25 bp, Mus musculus
aagtggtgacacgtgaaggctgaca

SEQ ID NO: 69246 - DNA, 25 bp, Mus musculus
aagtggtgacactcactacccattg

SEQ ID NO: 69247 - DNA, 25 bp, Mus musculus
aagtggtgacctattcctgtcatag

SEQ ID NO: 69248 - DNA, 25 bp, Mus musculus
aagtggtgaccttttcctgtcatag

SEQ ID NO: 69249 - DNA, 25 bp, Mus musculus
aagtggtgactgagtgtgccccttc

SEQ ID NO: 69250 - DNA, 25 bp, Mus musculus
aagtggtgactgtgtgtgccccttc

SEQ ID NO: 69251 - DNA, 25 bp, Mus musculus
aagtggtgagccctgaatccctgaa

SEQ ID NO: 69252 - DNA, 25 bp, Mus musculus
aagtggtgagccgtgaatccctgaa

SEQ ID NO: 69253 - DNA, 25 bp, Mus musculus
aagtggtgcaatactctttcaatga

SEQ ID NO: 69254 - DNA, 25 bp, Mus musculus
aagtggtgcaattctctttcaatga

SEQ ID NO: 69255 - DNA, 25 bp, Mus musculus
aagtggtgccccagtcagtcactca

SEQ ID NO: 69256 - DNA, 25 bp, Mus musculus
aagtggtgcccctgtcagtcactca

SEQ ID NO: 69257 - DNA, 25 bp, Mus musculus
aagtggtgcccgcatatcacaagga

SEQ ID NO: 69258 - DNA, 25 bp, Mus musculus
aagtggtgcccggatatcacaagga

SEQ ID NO: 69259 - DNA, 25 bp, Mus musculus
aagtggtgcctcaaccgtcagtgtg

SEQ ID NO: 69260 - DNA, 25 bp, Mus musculus
aagtggtgcctctaccgtcagtgtg

SEQ ID NO: 69261 - DNA, 25 bp, Mus musculus
aagtggtgctgacatgatcaaagga

SEQ ID NO: 69262 - DNA, 25 bp, Mus musculus
aagtggtgctgagatgatcaaagga

SEQ ID NO: 69263 - DNA, 25 bp, Mus musculus
aagtggtggacaacccctgagcgac

SEQ ID NO: 69264 - DNA, 25 bp, Mus musculus
aagtggtggacatcccctgagcgac

SEQ ID NO: 69265 - DNA, 25 bp, Mus musculus
aagtggtggcctcagagcttcctgc

SEQ ID NO: 69266 - DNA, 25 bp, Mus musculus
aagtggtggcctgagagcttcctgc

SEQ ID NO: 69267 - DNA, 25 bp, Mus musculus
aagtggtgggacatggcactccaat

SEQ ID NO: 69268 - DNA, 25 bp, Mus musculus
aagtggtgggacttggcactccaat

SEQ ID NO: 69269 - DNA, 25 bp, Mus musculus
aagtggtgggagacattcacattta

SEQ ID NO: 69270 - DNA, 25 bp, Mus musculus
aagtggtgggagtcattcacattta

SEQ ID NO: 69271 - DNA, 25 bp, Mus musculus
aagtggtggttgcagttatttctgt

SEQ ID NO: 69272 - DNA, 25 bp, Mus musculus
aagtggtggttggagttatttctgt

SEQ ID NO: 69273 - DNA, 25 bp, Mus musculus
aagtggtgtcccacggcttttctat

SEQ ID NO: 69274 - DNA, 25 bp, Mus musculus
aagtggtgtccctcggcttttctat

SEQ ID NO: 69275 - DNA, 25 bp, Mus musculus
aagtggtgtgttcttagcccatgca

SEQ ID NO: 69276 - DNA, 25 bp, Mus musculus
aagtggtgtgttgttagcccatgca

SEQ ID NO: 69277 - DNA, 25 bp, Mus musculus
aagtggtgttaaacattgggcctgt

SEQ ID NO: 69278 - DNA, 25 bp, Mus musculus
aagtggtgttaatcattgggcctgt

SEQ ID NO: 69279 - DNA, 25 bp, Mus musculus
aagtggttaaggcagggcggattct

SEQ ID NO: 69280 - DNA, 25 bp, Mus musculus
aagtggttaagggagggcggattct

SEQ ID NO: 69281 - DNA, 25 bp, Mus musculus
aagtggttaatcctcactccttcac

SEQ ID NO: 69282 - DNA, 25 bp, Mus musculus
aagtggttaatcgtcactccttcac

SEQ ID NO: 69283 - DNA, 25 bp, Mus musculus
aagtggttaccgcagaatctgtgga

SEQ ID NO: 69284 - DNA, 25 bp, Mus musculus
aagtggttaccggagaatctgtgga

SEQ ID NO: 69285 - DNA, 25 bp, Mus musculus
aagtggttactcacagaatcctaaa

SEQ ID NO: 69286 - DNA, 25 bp, Mus musculus
aagtggttactctcagaatcctaaa

SEQ ID NO: 69287 - DNA, 25 bp, Mus musculus
aagtggttagctatcccagaccatt

SEQ ID NO: 69288 - DNA, 25 bp, Mus musculus
aagtggttagctttcccagaccatt

SEQ ID NO: 69289 - DNA, 25 bp, Mus musculus
aagtggttattaatgtgacagtttt

SEQ ID NO: 69290 - DNA, 25 bp, Mus musculus
aagtggttattattgtgacagtttt

SEQ ID NO: 69291 - DNA, 25 bp, Mus musculus
aagtggttcacaaacccaaccctgt

SEQ ID NO: 69292 - DNA, 25 bp, Mus musculus
aagtggttcacaagtgattccacca

SEQ ID NO: 69293 - DNA, 25 bp, Mus musculus
aagtggttcacatacccaaccctgt

SEQ ID NO: 69294 - DNA, 25 bp, Mus musculus
aagtggttcacatgtgattccacca

SEQ ID NO: 69295 - DNA, 25 bp, Mus musculus
aagtggttcatgaccgttgctcagg

SEQ ID NO: 69296 - DNA, 25 bp, Mus musculus
aagtggttcatgtccgttgctcagg

SEQ ID NO: 69297 - DNA, 25 bp, Mus musculus
aagtggttccttctggcatttctca

SEQ ID NO: 69298 - DNA, 25 bp, Mus musculus
aagtggttccttgtggcatttctca

SEQ ID NO: 69299 - DNA, 25 bp, Mus musculus
aagtggttgctcactctatgcatgt

SEQ ID NO: 69300 - DNA, 25 bp, Mus musculus
aagtggttgctctctctatgcatgt

SEQ ID NO: 69301 - DNA, 25 bp, Mus musculus
aagtggttggacagctcgaatcatc

SEQ ID NO: 69302 - DNA, 25 bp, Mus musculus
aagtggttggactgctcgaatcatc

SEQ ID NO: 69303 - DNA, 25 bp, Mus musculus
aagtggttgtctacctgcacttctg

SEQ ID NO: 69304 - DNA, 25 bp, Mus musculus
aagtggttgtcttcctgcacttctg

SEQ ID NO: 69305 - DNA, 25 bp, Mus musculus
aagtggtttattctggccaccggag

SEQ ID NO: 69306 - DNA, 25 bp, Mus musculus
aagtggtttattgtggccaccggag

SEQ ID NO: 69307 - DNA, 25 bp, Mus musculus
aagtggtttcagacgtctctaaggg

SEQ ID NO: 69308 - DNA, 25 bp, Mus musculus
aagtggtttcagtcgtctctaaggg

SEQ ID NO: 69309 - DNA, 25 bp, Mus musculus
aagtggtttgacatcggctgcctgg

SEQ ID NO: 69310 - DNA, 25 bp, Mus musculus
aagtggtttgacttcggctgcctgg

SEQ ID NO: 69311 - DNA, 25 bp, Mus musculus
aagtggttttgcagggtcatcacac

SEQ ID NO: 69312 - DNA, 25 bp, Mus musculus
aagtggttttgctgggtcatcacac

SEQ ID NO: 69313 - DNA, 25 bp, Mus musculus
aagtgtaaatccactcctttctgta

SEQ ID NO: 69314 - DNA, 25 bp, Mus musculus
aagtgtaaatcctctcctttctgta

SEQ ID NO: 69315 - DNA, 25 bp, Mus musculus
aagtgtaaattaactatggctttgc

SEQ ID NO: 69316 - DNA, 25 bp, Mus musculus
aagtgtaaattatctatggctttgc

SEQ ID NO: 69317 - DNA, 25 bp, Mus musculus
aagtgtaaattgcatgtgtgggcat

SEQ ID NO: 69318 - DNA, 25 bp, Mus musculus
aagtgtaaattggatgtgtgggcat

SEQ ID NO: 69319 - DNA, 25 bp, Mus musculus
aagtgtaacagcatcacctgggaag

SEQ ID NO: 69320 - DNA, 25 bp, Mus musculus
aagtgtaacagcatgccggcaataa

SEQ ID NO: 69321 - DNA, 25 bp, Mus musculus
aagtgtaacagcttcacctgggaag

SEQ ID NO: 69322 - DNA, 25 bp, Mus musculus
aagtgtaacagcttgccggcaataa

SEQ ID NO: 69323 - DNA, 25 bp, Mus musculus
aagtgtaactctctcaagctcccct

SEQ ID NO: 69324 - DNA, 25 bp, Mus musculus
aagtgtaactctgtcaagctcccct

SEQ ID NO: 69325 - DNA, 25 bp, Mus musculus
aagtgtaacttactcagccatccac

SEQ ID NO: 69326 - DNA, 25 bp, Mus musculus
aagtgtaacttagtcagccatccac

SEQ ID NO: 69327 - DNA, 25 bp, Mus musculus
aagtgtaacttccttgcataccctg

SEQ ID NO: 69328 - DNA, 25 bp, Mus musculus
aagtgtaacttcgttgcataccctg

SEQ ID NO: 69329 - DNA, 25 bp, Mus musculus
aagtgtaaggacatgcttggctata

SEQ ID NO: 69330 - DNA, 25 bp, Mus musculus
aagtgtaaggacttgcttggctata

SEQ ID NO: 69331 - DNA, 25 bp, Mus musculus
aagtgtaatataaaatcccaataaa

SEQ ID NO: 69332 - DNA, 25 bp, Mus musculus
aagtgtaatatataatcccaataaa

SEQ ID NO: 69333 - DNA, 25 bp, Mus musculus
aagtgtaatcagactctaggttggg

SEQ ID NO: 69334 - DNA, 25 bp, Mus musculus
aagtgtaatcagtctctaggttggg

SEQ ID NO: 69335 - DNA, 25 bp, Mus musculus
aagtgtaatcctatcttaatgtgtt

SEQ ID NO: 69336 - DNA, 25 bp, Mus musculus
aagtgtaatcctttcttaatgtgtt

SEQ ID NO: 69337 - DNA, 25 bp, Mus musculus
aagtgtaatcttatatgttagcatt

SEQ ID NO: 69338 - DNA, 25 bp, Mus musculus
aagtgtaatcttttatgttagcatt

SEQ ID NO: 69339 - DNA, 25 bp, Mus musculus
aagtgtaattttccccaccatcttg

SEQ ID NO: 69340 - DNA, 25 bp, Mus musculus
aagtgtaattttgcccaccatcttg

SEQ ID NO: 69341 - DNA, 25 bp, Mus musculus
aagtgtacacacagcaaggcccatg

SEQ ID NO: 69342 - DNA, 25 bp, Mus musculus
aagtgtacacactgcaaggcccatg

SEQ ID NO: 69343 - DNA, 25 bp, Mus musculus
aagtgtacagtacgtatgctataag

SEQ ID NO: 69344 - DNA, 25 bp, Mus musculus
aagtgtacagtaggtatgctataag

SEQ ID NO: 69345 - DNA, 25 bp, Mus musculus
aagtgtacagtcaccacaatgttga

SEQ ID NO: 69346 - DNA, 25 bp, Mus musculus
aagtgtacagtccagttctcaggat

SEQ ID NO: 69347 - DNA, 25 bp, Mus musculus
aagtgtacagtcgagttctcaggat

SEQ ID NO: 69348 - DNA, 25 bp, Mus musculus
aagtgtacagtctccacaatgttga

SEQ ID NO: 69349 - DNA, 25 bp, Mus musculus
aagtgtacatccacctgggactgaa

SEQ ID NO: 69350 - DNA, 25 bp, Mus musculus
aagtgtacatccacggtcgggagtc

SEQ ID NO: 69351 - DNA, 25 bp, Mus musculus
aagtgtacatcctcctgggactgaa

SEQ ID NO: 69352 - DNA, 25 bp, Mus musculus
aagtgtacatcctcggtcgggagtc

SEQ ID NO: 69353 - DNA, 25 bp, Mus musculus
aagtgtaccagcacgagtctacctt

SEQ ID NO: 69354 - DNA, 25 bp, Mus musculus
aagtgtaccagctcgagtctacctt

SEQ ID NO: 69355 - DNA, 25 bp, Mus musculus
aagtgtaccgaaacaagttgctgga

SEQ ID NO: 69356 - DNA, 25 bp, Mus musculus
aagtgtaccgaatcaagttgctgga

SEQ ID NO: 69357 - DNA, 25 bp, Mus musculus
aagtgtacctctcaggatatcccca

SEQ ID NO: 69358 - DNA, 25 bp, Mus musculus
aagtgtacctctgaggatatcccca

SEQ ID NO: 69359 - DNA, 25 bp, Mus musculus
aagtgtacctgccaacttcacttca

SEQ ID NO: 69360 - DNA, 25 bp, Mus musculus
aagtgtacctgcgaacttcacttca

SEQ ID NO: 69361 - DNA, 25 bp, Mus musculus
aagtgtacttatatcgccttgctaa

SEQ ID NO: 69362 - DNA, 25 bp, Mus musculus
aagtgtacttatttcgccttgctaa

SEQ ID NO: 69363 - DNA, 25 bp, Mus musculus
aagtgtagactcagtcccaaacctg

SEQ ID NO: 69364 - DNA, 25 bp, Mus musculus
aagtgtagactctgtcccaaacctg

SEQ ID NO: 69365 - DNA, 25 bp, Mus musculus
aagtgtagcaggacctgcgggcatc

SEQ ID NO: 69366 - DNA, 25 bp, Mus musculus
aagtgtagcaggtcctgcgggcatc

SEQ ID NO: 69367 - DNA, 25 bp, Mus musculus
aagtgtagcgtcacctatctggata

SEQ ID NO: 69368 - DNA, 25 bp, Mus musculus
aagtgtagcgtctcctatctggata

SEQ ID NO: 69369 - DNA, 25 bp, Mus musculus
aagtgtagctgtacacggcaagagc

SEQ ID NO: 69370 - DNA, 25 bp, Mus musculus
aagtgtagctgttcacggcaagagc

SEQ ID NO: 69371 - DNA, 25 bp, Mus musculus
aagtgtaggatcacagcgttcctca

SEQ ID NO: 69372 - DNA, 25 bp, Mus musculus
aagtgtaggatctcagcgttcctca

SEQ ID NO: 69373 - DNA, 25 bp, Mus musculus
aagtgtaggcagagctcctggagca

SEQ ID NO: 69374 - DNA, 25 bp, Mus musculus
aagtgtaggcagtgctcctggagca

SEQ ID NO: 69375 - DNA, 25 bp, Mus musculus
aagtgtaggccccacacattggaaa

SEQ ID NO: 69376 - DNA, 25 bp, Mus musculus
aagtgtaggcccgacacattggaaa

SEQ ID NO: 69377 - DNA, 25 bp, Mus musculus
aagtgtaggttcatctccacttttg

SEQ ID NO: 69378 - DNA, 25 bp, Mus musculus
aagtgtaggttcttctccacttttg

SEQ ID NO: 69379 - DNA, 25 bp, Mus musculus
aagtgtagtactagtccctgctgct

SEQ ID NO: 69380 - DNA, 25 bp, Mus musculus
aagtgtagtacttgtccctgctgct

SEQ ID NO: 69381 - DNA, 25 bp, Mus musculus
aagtgtagtctaagagggtctgtgc

SEQ ID NO: 69382 - DNA, 25 bp, Mus musculus
aagtgtagtctatgagggtctgtgc

SEQ ID NO: 69383 - DNA, 25 bp, Mus musculus
aagtgtagtgtgcttgcagatctcc

SEQ ID NO: 69384 - DNA, 25 bp, Mus musculus
aagtgtagtgtggttgcagatctcc

SEQ ID NO: 69385 - DNA, 25 bp, Mus musculus
aagtgtagttgtcaccaccctggac

SEQ ID NO: 69386 - DNA, 25 bp, Mus musculus
aagtgtagttgtgaccaccctggac

SEQ ID NO: 69387 - DNA, 25 bp, Mus musculus
aagtgtataaacagagtctcacaaa

SEQ ID NO: 69388 - DNA, 25 bp, Mus musculus
aagtgtataaactgagtctcacaaa

SEQ ID NO: 69389 - DNA, 25 bp, Mus musculus
aagtgtataaagagaccctcccaag

SEQ ID NO: 69390 - DNA, 25 bp, Mus musculus
aagtgtataaagtgaccctcccaag

SEQ ID NO: 69391 - DNA, 25 bp, Mus musculus
aagtgtataatcaagtgtgttctta

SEQ ID NO: 69392 - DNA, 25 bp, Mus musculus
aagtgtataatctagtgtgttctta

SEQ ID NO: 69393 - DNA, 25 bp, Mus musculus
aagtgtataggaaatgtgtttctat

SEQ ID NO: 69394 - DNA, 25 bp, Mus musculus
aagtgtataggatatgtgtttctat

SEQ ID NO: 69395 - DNA, 25 bp, Mus musculus
aagtgtatccaaccgtgcacccacc

SEQ ID NO: 69396 - DNA, 25 bp, Mus musculus
aagtgtatccaagcgtgcacccacc

SEQ ID NO: 69397 - DNA, 25 bp, Mus musculus
aagtgtatcccaaggctacttcatt

SEQ ID NO: 69398 - DNA, 25 bp, Mus musculus
aagtgtatcccatggctacttcatt

SEQ ID NO: 69399 - DNA, 25 bp, Mus musculus
aagtgtatctgacgctgcactaacc

SEQ ID NO: 69400 - DNA, 25 bp, Mus musculus
aagtgtatctgaggctgcactaacc

SEQ ID NO: 69401 - DNA, 25 bp, Mus musculus
aagtgtatgaagactccggcatccc

SEQ ID NO: 69402 - DNA, 25 bp, Mus musculus
aagtgtatgaagtctccggcatccc

SEQ ID NO: 69403 - DNA, 25 bp, Mus musculus
aagtgtatgcaacggcctgggttcc

SEQ ID NO: 69404 - DNA, 25 bp, Mus musculus
aagtgtatgcaagggcctgggttcc

SEQ ID NO: 69405 - DNA, 25 bp, Mus musculus
aagtgtatggacacccgacgcaagc

SEQ ID NO: 69406 - DNA, 25 bp, Mus musculus
aagtgtatggactcccgacgcaagc

SEQ ID NO: 69407 - DNA, 25 bp, Mus musculus
aagtgtattcagcttcttagagaaa

SEQ ID NO: 69408 - DNA, 25 bp, Mus musculus
aagtgtattcaggttcttagagaaa

SEQ ID NO: 69409 - DNA, 25 bp, Mus musculus
aagtgtattcatagccttgtctctg

SEQ ID NO: 69410 - DNA, 25 bp, Mus musculus
aagtgtattcattgccttgtctctg

SEQ ID NO: 69411 - DNA, 25 bp, Mus musculus
aagtgtattctcaggcctgtgacat

SEQ ID NO: 69412 - DNA, 25 bp, Mus musculus
aagtgtattctctggcctgtgacat

SEQ ID NO: 69413 - DNA, 25 bp, Mus musculus
aagtgtattgtaaccagttccttgg

SEQ ID NO: 69414 - DNA, 25 bp, Mus musculus
aagtgtattgtatccagttccttgg

SEQ ID NO: 69415 - DNA, 25 bp, Mus musculus
aagtgtattttcctgagctatcatt

SEQ ID NO: 69416 - DNA, 25 bp, Mus musculus
aagtgtattttcgtgagctatcatt

SEQ ID NO: 69417 - DNA, 25 bp, Mus musculus
aagtgtcaaccacaaagtgttgccg

SEQ ID NO: 69418 - DNA, 25 bp, Mus musculus
aagtgtcaaccagaaagtgttgccg

SEQ ID NO: 69419 - DNA, 25 bp, Mus musculus
aagtgtcacaacagggcctcattaa

SEQ ID NO: 69420 - DNA, 25 bp, Mus musculus
aagtgtcacaactgggcctcattaa

SEQ ID NO: 69421 - DNA, 25 bp, Mus musculus
aagtgtcacaggaatagggttccat

SEQ ID NO: 69422 - DNA, 25 bp, Mus musculus
aagtgtcacaggtatagggttccat

SEQ ID NO: 69423 - DNA, 25 bp, Mus musculus
aagtgtcacatcagatcacacaatg

SEQ ID NO: 69424 - DNA, 25 bp, Mus musculus
aagtgtcacatctgatcacacaatg

SEQ ID NO: 69425 - DNA, 25 bp, Mus musculus
aagtgtcaccagactgtaacttatg

SEQ ID NO: 69426 - DNA, 25 bp, Mus musculus
aagtgtcaccagtctgtaacttatg

SEQ ID NO: 69427 - DNA, 25 bp, Mus musculus
aagtgtcacctgaggccacgtgggc

SEQ ID NO: 69428 - DNA, 25 bp, Mus musculus
aagtgtcacctgtggccacgtgggc

SEQ ID NO: 69429 - DNA, 25 bp, Mus musculus
aagtgtcacgagaccgggcttctga

SEQ ID NO: 69430 - DNA, 25 bp, Mus musculus
aagtgtcacgagtccgggcttctga

SEQ ID NO: 69431 - DNA, 25 bp, Mus musculus
aagtgtcacgtgcatcgccatctaa

SEQ ID NO: 69432 - DNA, 25 bp, Mus musculus
aagtgtcacgtggatcgccatctaa

SEQ ID NO: 69433 - DNA, 25 bp, Mus musculus
aagtgtcactgacccaaacttgaat

SEQ ID NO: 69434 - DNA, 25 bp, Mus musculus
aagtgtcactgagccaaacttgaat

SEQ ID NO: 69435 - DNA, 25 bp, Mus musculus
aagtgtcactttccacagtggagtg

SEQ ID NO: 69436 - DNA, 25 bp, Mus musculus
aagtgtcactttgcacagtggagtg

SEQ ID NO: 69437 - DNA, 25 bp, Mus musculus
aagtgtcagaacctagcatattgct

SEQ ID NO: 69438 - DNA, 25 bp, Mus musculus
aagtgtcagaacgtagcatattgct

SEQ ID NO: 69439 - DNA, 25 bp, Mus musculus
aagtgtcagatccaagcaggcttga

SEQ ID NO: 69440 - DNA, 25 bp, Mus musculus
aagtgtcagatcgaagcaggcttga

SEQ ID NO: 69441 - DNA, 25 bp, Mus musculus
aagtgtcagcggaccacaatcttaa

SEQ ID NO: 69442 - DNA, 25 bp, Mus musculus
aagtgtcagcggtccacaatcttaa

SEQ ID NO: 69443 - DNA, 25 bp, Mus musculus
aagtgtcagctgagctactttgctt

SEQ ID NO: 69444 - DNA, 25 bp, Mus musculus
aagtgtcagctgtgctactttgctt

SEQ ID NO: 69445 - DNA, 25 bp, Mus musculus
aagtgtcaggctccatcagtcgtca

SEQ ID NO: 69446 - DNA, 25 bp, Mus musculus
aagtgtcaggctgcatcagtcgtca

SEQ ID NO: 69447 - DNA, 25 bp, Mus musculus
aagtgtcagggaactcattcagtga

SEQ ID NO: 69448 - DNA, 25 bp, Mus musculus
aagtgtcagggatctcattcagtga

SEQ ID NO: 69449 - DNA, 25 bp, Mus musculus
aagtgtcagtcaactacctgcgggt

SEQ ID NO: 69450 - DNA, 25 bp, Mus musculus
aagtgtcagtcatctacctgcgggt

SEQ ID NO: 69451 - DNA, 25 bp, Mus musculus
aagtgtcagtgacccttggctgcat

SEQ ID NO: 69452 - DNA, 25 bp, Mus musculus
aagtgtcagtgagccttggctgcat

SEQ ID NO: 69453 - DNA, 25 bp, Mus musculus
aagtgtcatgaccttcgacctttga

SEQ ID NO: 69454 - DNA, 25 bp, Mus musculus
aagtgtcatgacgttcgacctttga

SEQ ID NO: 69455 - DNA, 25 bp, Mus musculus
aagtgtcatgatctgatcacacctg

SEQ ID NO: 69456 - DNA, 25 bp, Mus musculus
aagtgtcatgatgtgatcacacctg

SEQ ID NO: 69457 - DNA, 25 bp, Mus musculus
aagtgtcatgttatccaagcagtgg

SEQ ID NO: 69458 - DNA, 25 bp, Mus musculus
aagtgtcatgttttccaagcagtgg

SEQ ID NO: 69459 - DNA, 25 bp, Mus musculus
aagtgtccacatatgttgtatcaac

SEQ ID NO: 69460 - DNA, 25 bp, Mus musculus
aagtgtccacatttgttgtatcaac

SEQ ID NO: 69461 - DNA, 25 bp, Mus musculus
aagtgtccagatactcagatgtttg

SEQ ID NO: 69462 - DNA, 25 bp, Mus musculus
aagtgtccagatcctgccaaacatc

SEQ ID NO: 69463 - DNA, 25 bp, Mus musculus
aagtgtccagatgctgccaaacatc

SEQ ID NO: 69464 - DNA, 25 bp, Mus musculus
aagtgtccagattctcagatgtttg

SEQ ID NO: 69465 - DNA, 25 bp, Mus musculus
aagtgtccagcgcagtgacttccag

SEQ ID NO: 69466 - DNA, 25 bp, Mus musculus
aagtgtccagcggagtgacttccag

SEQ ID NO: 69467 - DNA, 25 bp, Mus musculus
aagtgtccagtcagagggtcctttt

SEQ ID NO: 69468 - DNA, 25 bp, Mus musculus
aagtgtccagtctgagggtcctttt

SEQ ID NO: 69469 - DNA, 25 bp, Mus musculus
aagtgtccatcaagctgtatcccgg

SEQ ID NO: 69470 - DNA, 25 bp, Mus musculus
aagtgtccatcatgctgtatcccgg

SEQ ID NO: 69471 - DNA, 25 bp, Mus musculus
aagtgtcccactacttaggcagcta

SEQ ID NO: 69472 - DNA, 25 bp, Mus musculus
aagtgtcccacttcttaggcagcta

SEQ ID NO: 69473 - DNA, 25 bp, Mus musculus
aagtgtcccagactttgaaacttct

SEQ ID NO: 69474 - DNA, 25 bp, Mus musculus
aagtgtcccagagtttgaaacttct

SEQ ID NO: 69475 - DNA, 25 bp, Mus musculus
aagtgtcccaggagagtctgacctc

SEQ ID NO: 69476 - DNA, 25 bp, Mus musculus
aagtgtcccaggtgagtctgacctc

SEQ ID NO: 69477 - DNA, 25 bp, Mus musculus
aagtgtcccggaacaatgggctgca

SEQ ID NO: 69478 - DNA, 25 bp, Mus musculus
aagtgtcccggatcaatgggctgca

SEQ ID NO: 69479 - DNA, 25 bp, Mus musculus
aagtgtccctaaaggatgtcacatg

SEQ ID NO: 69480 - DNA, 25 bp, Mus musculus
aagtgtccctaatggatgtcacatg

SEQ ID NO: 69481 - DNA, 25 bp, Mus musculus
aagtgtccgaggcttgtaacagata

SEQ ID NO: 69482 - DNA, 25 bp, Mus musculus
aagtgtccgagggttgtaacagata

SEQ ID NO: 69483 - DNA, 25 bp, Mus musculus
aagtgtccggacagcgagaagcgct

SEQ ID NO: 69484 - DNA, 25 bp, Mus musculus
aagtgtccggactgcgagaagcgct

SEQ ID NO: 69485 - DNA, 25 bp, Mus musculus
aagtgtcctaatcctacatgtgaga

SEQ ID NO: 69486 - DNA, 25 bp, Mus musculus
aagtgtcctaatgctacatgtgaga

SEQ ID NO: 69487 - DNA, 25 bp, Mus musculus
aagtgtcctacaccgtttgtgcttt

SEQ ID NO: 69488 - DNA, 25 bp, Mus musculus
aagtgtcctacagcgtttgtgcttt

SEQ ID NO: 69489 - DNA, 25 bp, Mus musculus
aagtgtcctctgcatacagtgctca

SEQ ID NO: 69490 - DNA, 25 bp, Mus musculus
aagtgtcctctggatacagtgctca

SEQ ID NO: 69491 - DNA, 25 bp, Mus musculus
aagtgtcctgatagactgctcacag

SEQ ID NO: 69492 - DNA, 25 bp, Mus musculus
aagtgtcctgattgactgctcacag

SEQ ID NO: 69493 - DNA, 25 bp, Mus musculus
aagtgtcctgcactggaatgaccac

SEQ ID NO: 69494 - DNA, 25 bp, Mus musculus
aagtgtcctgcagtggaatgaccac

SEQ ID NO: 69495 - DNA, 25 bp, Mus musculus
aagtgtcctgtgagttaagttcaaa

SEQ ID NO: 69496 - DNA, 25 bp, Mus musculus
aagtgtcctgtgtgttaagttcaaa

SEQ ID NO: 69497 - DNA, 25 bp, Mus musculus
aagtgtccttaactggtgagctctc

SEQ ID NO: 69498 - DNA, 25 bp, Mus musculus
aagtgtccttaagtggtgagctctc

SEQ ID NO: 69499 - DNA, 25 bp, Mus musculus
aagtgtccttacctcttcacagaac

SEQ ID NO: 69500 - DNA, 25 bp, Mus musculus
aagtgtccttacgtcttcacagaac

SEQ ID NO: 69501 - DNA, 25 bp, Mus musculus
aagtgtcgaacactgttttctacac

SEQ ID NO: 69502 - DNA, 25 bp, Mus musculus
aagtgtcgaacagtgttttctacac

SEQ ID NO: 69503 - DNA, 25 bp, Mus musculus
aagtgtcgggatctgctttgcaaat

SEQ ID NO: 69504 - DNA, 25 bp, Mus musculus
aagtgtcgggatgtgctttgcaaat

SEQ ID NO: 69505 - DNA, 25 bp, Mus musculus
aagtgtcgtctcatgtgtgaacctt

SEQ ID NO: 69506 - DNA, 25 bp, Mus musculus
aagtgtcgtctcttgtgtgaacctt

SEQ ID NO: 69507 - DNA, 25 bp, Mus musculus
aagtgtcgtcttctgtttgtttcct

SEQ ID NO: 69508 - DNA, 25 bp, Mus musculus
aagtgtcgtcttgtgtttgtttcct

SEQ ID NO: 69509 - DNA, 25 bp, Mus musculus
aagtgtcgtgatctaccactttcca

SEQ ID NO: 69510 - DNA, 25 bp, Mus musculus
aagtgtcgtgatgtaccactttcca

SEQ ID NO: 69511 - DNA, 25 bp, Mus musculus
aagtgtctagttatttgaaatgcaa

SEQ ID NO: 69512 - DNA, 25 bp, Mus musculus
aagtgtctagttttttgaaatgcaa

SEQ ID NO: 69513 - DNA, 25 bp, Mus musculus
aagtgtctatagaccgtgcctcatc

SEQ ID NO: 69514 - DNA, 25 bp, Mus musculus
aagtgtctatagtccgtgcctcatc

SEQ ID NO: 69515 - DNA, 25 bp, Mus musculus
aagtgtctatgcatcctatgctcat

SEQ ID NO: 69516 - DNA, 25 bp, Mus musculus
aagtgtctatgcatgtcctgtgtac

SEQ ID NO: 69517 - DNA, 25 bp, Mus musculus
aagtgtctatgcttcctatgctcat

SEQ ID NO: 69518 - DNA, 25 bp, Mus musculus
aagtgtctatgcttgtcctgtgtac

SEQ ID NO: 69519 - DNA, 25 bp, Mus musculus
aagtgtctattgagtatgccacgca

SEQ ID NO: 69520 - DNA, 25 bp, Mus musculus
aagtgtctattgtgtatgccacgca

SEQ ID NO: 69521 - DNA, 25 bp, Mus musculus
aagtgtctcaacagacctggctaga

SEQ ID NO: 69522 - DNA, 25 bp, Mus musculus
aagtgtctcaacagtctctgcatta

SEQ ID NO: 69523 - DNA, 25 bp, Mus musculus
aagtgtctcaactgacctggctaga

SEQ ID NO: 69524 - DNA, 25 bp, Mus musculus
aagtgtctcaactgtctctgcatta

SEQ ID NO: 69525 - DNA, 25 bp, Mus musculus
aagtgtctcactacctagtaaacat

SEQ ID NO: 69526 - DNA, 25 bp, Mus musculus
aagtgtctcacttcctagtaaacat

SEQ ID NO: 69527 - DNA, 25 bp, Mus musculus
aagtgtctcaggaaatccatcaagg

SEQ ID NO: 69528 - DNA, 25 bp, Mus musculus
aagtgtctcaggtaatccatcaagg

SEQ ID NO: 69529 - DNA, 25 bp, Mus musculus
aagtgtctcggacacctgtggtgac

SEQ ID NO: 69530 - DNA, 25 bp, Mus musculus
aagtgtctcggagacctgtggtgac

SEQ ID NO: 69531 - DNA, 25 bp, Mus musculus
aagtgtctcgtacgcgcggagcccc

SEQ ID NO: 69532 - DNA, 25 bp, Mus musculus
aagtgtctcgtaggcgcggagcccc

SEQ ID NO: 69533 - DNA, 25 bp, Mus musculus
aagtgtctcgttattgttcatctct

SEQ ID NO: 69534 - DNA, 25 bp, Mus musculus
aagtgtctcgtttttgttcatctct

SEQ ID NO: 69535 - DNA, 25 bp, Mus musculus
aagtgtctgacaccatgatagctgt

SEQ ID NO: 69536 - DNA, 25 bp, Mus musculus
aagtgtctgacagcatgatagctgt

SEQ ID NO: 69537 - DNA, 25 bp, Mus musculus
aagtgtctgaccatcgtcacgggtc

SEQ ID NO: 69538 - DNA, 25 bp, Mus musculus
aagtgtctgaccttcgtcacgggtc

SEQ ID NO: 69539 - DNA, 25 bp, Mus musculus
aagtgtctgcacaagtgggtccatg

SEQ ID NO: 69540 - DNA, 25 bp, Mus musculus
aagtgtctgcacacatttgctgcaa

SEQ ID NO: 69541 - DNA, 25 bp, Mus musculus
aagtgtctgcactagtgggtccatg

SEQ ID NO: 69542 - DNA, 25 bp, Mus musculus
aagtgtctgcactcatttgctgcaa

SEQ ID NO: 69543 - DNA, 25 bp, Mus musculus
aagtgtctgcatagcatctcggttt

SEQ ID NO: 69544 - DNA, 25 bp, Mus musculus
aagtgtctgcattgcatctcggttt

SEQ ID NO: 69545 - DNA, 25 bp, Mus musculus
aagtgtctggaaccctcattagcct

SEQ ID NO: 69546 - DNA, 25 bp, Mus musculus
aagtgtctggaagcctcattagcct

SEQ ID NO: 69547 - DNA, 25 bp, Mus musculus
aagtgtctggagatgtcaggttcca

SEQ ID NO: 69548 - DNA, 25 bp, Mus musculus
aagtgtctggagttgtcaggttcca

SEQ ID NO: 69549 - DNA, 25 bp, Mus musculus
aagtgtctggcaaacacggtggcat

SEQ ID NO: 69550 - DNA, 25 bp, Mus musculus
aagtgtctggcatacacggtggcat

SEQ ID NO: 69551 - DNA, 25 bp, Mus musculus
aagtgtctgggcataacacacccca

SEQ ID NO: 69552 - DNA, 25 bp, Mus musculus
aagtgtctgggcttaacacacccca

SEQ ID NO: 69553 - DNA, 25 bp, Mus musculus
aagtgtctgtcccttttcattcagg

SEQ ID NO: 69554 - DNA, 25 bp, Mus musculus
aagtgtctgtccgttttcattcagg

SEQ ID NO: 69555 - DNA, 25 bp, Mus musculus
aagtgtctgtctaccgtgtgcaaag

SEQ ID NO: 69556 - DNA, 25 bp, Mus musculus
aagtgtctgtcttccgtgtgcaaag

SEQ ID NO: 69557 - DNA, 25 bp, Mus musculus
aagtgtcttcaacatgcagaacgag

SEQ ID NO: 69558 - DNA, 25 bp, Mus musculus
aagtgtcttcaagatgcagaacgag

SEQ ID NO: 69559 - DNA, 25 bp, Mus musculus
aagtgtcttcccaaaagccaggatc

SEQ ID NO: 69560 - DNA, 25 bp, Mus musculus
aagtgtcttcccagtattggttctc

SEQ ID NO: 69561 - DNA, 25 bp, Mus musculus
aagtgtcttccctaaagccaggatc

SEQ ID NO: 69562 - DNA, 25 bp, Mus musculus
aagtgtcttccctgtattggttctc

SEQ ID NO: 69563 - DNA, 25 bp, Mus musculus
aagtgtcttccgagtgtgtgaccgt

SEQ ID NO: 69564 - DNA, 25 bp, Mus musculus
aagtgtcttccgctggacaagctga

SEQ ID NO: 69565 - DNA, 25 bp, Mus musculus
aagtgtcttccgctgtgtctcagta

SEQ ID NO: 69566 - DNA, 25 bp, Mus musculus
aagtgtcttccggtggacaagctga

SEQ ID NO: 69567 - DNA, 25 bp, Mus musculus
aagtgtcttccggtgtgtctcagta

SEQ ID NO: 69568 - DNA, 25 bp, Mus musculus
aagtgtcttccgtgtgtgtgaccgt

SEQ ID NO: 69569 - DNA, 25 bp, Mus musculus
aagtgtcttcgcatgaatgaggcag

SEQ ID NO: 69570 - DNA, 25 bp, Mus musculus
aagtgtcttcgcttgaatgaggcag

SEQ ID NO: 69571 - DNA, 25 bp, Mus musculus
aagtgtcttctcatgacagtcgtga

SEQ ID NO: 69572 - DNA, 25 bp, Mus musculus
aagtgtcttctcttgacagtcgtga

SEQ ID NO: 69573 - DNA, 25 bp, Mus musculus
aagtgtcttgagaccatgatccaaa

SEQ ID NO: 69574 - DNA, 25 bp, Mus musculus
aagtgtcttgagtccatgatccaaa

SEQ ID NO: 69575 - DNA, 25 bp, Mus musculus
aagtgtcttgcaattgtctggaagt

SEQ ID NO: 69576 - DNA, 25 bp, Mus musculus
aagtgtcttgcatttgtctggaagt

SEQ ID NO: 69577 - DNA, 25 bp, Mus musculus
aagtgtctttgtcgactgagctcag

SEQ ID NO: 69578 - DNA, 25 bp, Mus musculus
aagtgtctttgtggactgagctcag

SEQ ID NO: 69579 - DNA, 25 bp, Mus musculus
aagtgtgaaactcttgtgtctctga

SEQ ID NO: 69580 - DNA, 25 bp, Mus musculus
aagtgtgaaactgttgtgtctctga

SEQ ID NO: 69581 - DNA, 25 bp, Mus musculus
aagtgtgaagcaatggagtcatcct

SEQ ID NO: 69582 - DNA, 25 bp, Mus musculus
aagtgtgaagcattggagtcatcct

SEQ ID NO: 69583 - DNA, 25 bp, Mus musculus
aagtgtgaagttctcctagccttgt

SEQ ID NO: 69584 - DNA, 25 bp, Mus musculus
aagtgtgaagttgtcctagccttgt

SEQ ID NO: 69585 - DNA, 25 bp, Mus musculus
aagtgtgaatcgcttccctgctgaa

SEQ ID NO: 69586 - DNA, 25 bp, Mus musculus
aagtgtgaatcggttccctgctgaa

SEQ ID NO: 69587 - DNA, 25 bp, Mus musculus
aagtgtgaattaccttctactgcac

SEQ ID NO: 69588 - DNA, 25 bp, Mus musculus
aagtgtgaattagcttctactgcac

SEQ ID NO: 69589 - DNA, 25 bp, Mus musculus
aagtgtgaattcctccatcagccag

SEQ ID NO: 69590 - DNA, 25 bp, Mus musculus
aagtgtgaattcgtccatcagccag

SEQ ID NO: 69591 - DNA, 25 bp, Mus musculus
aagtgtgacaacaccctccaggaca

SEQ ID NO: 69592 - DNA, 25 bp, Mus musculus
aagtgtgacaactccctccaggaca

SEQ ID NO: 69593 - DNA, 25 bp, Mus musculus
aagtgtgacactatctagttaaaca

SEQ ID NO: 69594 - DNA, 25 bp, Mus musculus
aagtgtgacactttctagttaaaca

SEQ ID NO: 69595 - DNA, 25 bp, Mus musculus
aagtgtgacataagtgaccaggcat

SEQ ID NO: 69596 - DNA, 25 bp, Mus musculus
aagtgtgacatatgtgaccaggcat

SEQ ID NO: 69597 - DNA, 25 bp, Mus musculus
aagtgtgacatcatcttaagaaaca

SEQ ID NO: 69598 - DNA, 25 bp, Mus musculus
aagtgtgacatcttcttaagaaaca

SEQ ID NO: 69599 - DNA, 25 bp, Mus musculus
aagtgtgaccaaatgctttctccaa

SEQ ID NO: 69600 - DNA, 25 bp, Mus musculus
aagtgtgaccaattgctttctccaa

SEQ ID NO: 69601 - DNA, 25 bp, Mus musculus
aagtgtgacccgagcagcaggagca

SEQ ID NO: 69602 - DNA, 25 bp, Mus musculus
aagtgtgacccgtgcagcaggagca

SEQ ID NO: 69603 - DNA, 25 bp, Mus musculus
aagtgtgaccctcgccacggcaaat

SEQ ID NO: 69604 - DNA, 25 bp, Mus musculus
aagtgtgaccctggccacggcaaat

SEQ ID NO: 69605 - DNA, 25 bp, Mus musculus
aagtgtgaccgcctctctgtagcta

SEQ ID NO: 69606 - DNA, 25 bp, Mus musculus
aagtgtgaccgcgtctctgtagcta

SEQ ID NO: 69607 - DNA, 25 bp, Mus musculus
aagtgtgaccttagtcccagttctc

SEQ ID NO: 69608 - DNA, 25 bp, Mus musculus
aagtgtgacctttgtcccagttctc

SEQ ID NO: 69609 - DNA, 25 bp, Mus musculus
aagtgtgacggaacctaatttcaag

SEQ ID NO: 69610 - DNA, 25 bp, Mus musculus
aagtgtgacggatcctaatttcaag

SEQ ID NO: 69611 - DNA, 25 bp, Mus musculus
aagtgtgactacctggaacttacag

SEQ ID NO: 69612 - DNA, 25 bp, Mus musculus
aagtgtgactacgtggaacttacag

SEQ ID NO: 69613 - DNA, 25 bp, Mus musculus
aagtgtgactcaccctgtgtttgct

SEQ ID NO: 69614 - DNA, 25 bp, Mus musculus
aagtgtgactcagcctgtgtttgct

SEQ ID NO: 69615 - DNA, 25 bp, Mus musculus
aagtgtgagagccataatgtatgaa

SEQ ID NO: 69616 - DNA, 25 bp, Mus musculus
aagtgtgagagcgataatgtatgaa

SEQ ID NO: 69617 - DNA, 25 bp, Mus musculus
aagtgtgagcagactgtcctggtgc

SEQ ID NO: 69618 - DNA, 25 bp, Mus musculus
aagtgtgagcagtctgtcctggtgc

SEQ ID NO: 69619 - DNA, 25 bp, Mus musculus
aagtgtgagcgcaaactgcaggact

SEQ ID NO: 69620 - DNA, 25 bp, Mus musculus
aagtgtgagcgctaactgcaggact

SEQ ID NO: 69621 - DNA, 25 bp, Mus musculus
aagtgtgaggcgataaacccggtca

SEQ ID NO: 69622 - DNA, 25 bp, Mus musculus
aagtgtgaggcgttaaacccggtca

SEQ ID NO: 69623 - DNA, 25 bp, Mus musculus
aagtgtgaggctacagaactgtgac

SEQ ID NO: 69624 - DNA, 25 bp, Mus musculus
aagtgtgaggctcacgcctccagac

SEQ ID NO: 69625 - DNA, 25 bp, Mus musculus
aagtgtgaggctgacgcctccagac

SEQ ID NO: 69626 - DNA, 25 bp, Mus musculus
aagtgtgaggcttcagaactgtgac

SEQ ID NO: 69627 - DNA, 25 bp, Mus musculus
aagtgtgatgtcagtgccgtgtgcc

SEQ ID NO: 69628 - DNA, 25 bp, Mus musculus
aagtgtgatgtctgtgccgtgtgcc

SEQ ID NO: 69629 - DNA, 25 bp, Mus musculus
aagtgtgatgtgacccagagccagc

SEQ ID NO: 69630 - DNA, 25 bp, Mus musculus
aagtgtgatgtgtcccagagccagc

SEQ ID NO: 69631 - DNA, 25 bp, Mus musculus
aagtgtgatttcagcttttgtttcc

SEQ ID NO: 69632 - DNA, 25 bp, Mus musculus
aagtgtgatttctgcttttgtttcc

SEQ ID NO: 69633 - DNA, 25 bp, Mus musculus
aagtgtgcaaccaggcctggtccaa

SEQ ID NO: 69634 - DNA, 25 bp, Mus musculus
aagtgtgcaacctggcctggtccaa

SEQ ID NO: 69635 - DNA, 25 bp, Mus musculus
aagtgtgcaagtcctgtgactccca

SEQ ID NO: 69636 - DNA, 25 bp, Mus musculus
aagtgtgcaagtgctgtgactccca

SEQ ID NO: 69637 - DNA, 25 bp, Mus musculus
aagtgtgcacttactgtatatcttt

SEQ ID NO: 69638 - DNA, 25 bp, Mus musculus
aagtgtgcactttctgtatatcttt

SEQ ID NO: 69639 - DNA, 25 bp, Mus musculus
aagtgtgcagagcaggcgctcacca

SEQ ID NO: 69640 - DNA, 25 bp, Mus musculus
aagtgtgcagaggaggcgctcacca

SEQ ID NO: 69641 - DNA, 25 bp, Mus musculus
aagtgtgccaagaggaccttcacca

SEQ ID NO: 69642 - DNA, 25 bp, Mus musculus
aagtgtgccaagtggaccttcacca

SEQ ID NO: 69643 - DNA, 25 bp, Mus musculus
aagtgtgccaccaatatctctatct

SEQ ID NO: 69644 - DNA, 25 bp, Mus musculus
aagtgtgccacctatatctctatct

SEQ ID NO: 69645 - DNA, 25 bp, Mus musculus
aagtgtgccagcagcagagacctga

SEQ ID NO: 69646 - DNA, 25 bp, Mus musculus
aagtgtgccagctgcagagacctga

SEQ ID NO: 69647 - DNA, 25 bp, Mus musculus
aagtgtgccagtactcgagggatgc

SEQ ID NO: 69648 - DNA, 25 bp, Mus musculus
aagtgtgccagttctcgagggatgc

SEQ ID NO: 69649 - DNA, 25 bp, Mus musculus
aagtgtgccctcacctaaagctaag

SEQ ID NO: 69650 - DNA, 25 bp, Mus musculus
aagtgtgccctctcctaaagctaag

SEQ ID NO: 69651 - DNA, 25 bp, Mus musculus
aagtgtgcctagctagccagcagag

SEQ ID NO: 69652 - DNA, 25 bp, Mus musculus
aagtgtgcctaggtagccagcagag

SEQ ID NO: 69653 - DNA, 25 bp, Mus musculus
aagtgtgcctataccttttagccct

SEQ ID NO: 69654 - DNA, 25 bp, Mus musculus
aagtgtgcctattccttttagccct

SEQ ID NO: 69655 - DNA, 25 bp, Mus musculus
aagtgtgcctgaaccaatcttggta

SEQ ID NO: 69656 - DNA, 25 bp, Mus musculus
aagtgtgcctgatccaatcttggta

SEQ ID NO: 69657 - DNA, 25 bp, Mus musculus
aagtgtgcctgcagacgtgtttcag

SEQ ID NO: 69658 - DNA, 25 bp, Mus musculus
aagtgtgcctgctgacgtgtttcag

SEQ ID NO: 69659 - DNA, 25 bp, Mus musculus
aagtgtgcctttcgcaaacctcact

SEQ ID NO: 69660 - DNA, 25 bp, Mus musculus
aagtgtgcctttggcaaacctcact

SEQ ID NO: 69661 - DNA, 25 bp, Mus musculus
aagtgtgcgaagagttcctccgacc

SEQ ID NO: 69662 - DNA, 25 bp, Mus musculus
aagtgtgcgaagtgttcctccgacc

SEQ ID NO: 69663 - DNA, 25 bp, Mus musculus
aagtgtgcgccactatacgcggttc

SEQ ID NO: 69664 - DNA, 25 bp, Mus musculus
aagtgtgcgccagtatacgcggttc

SEQ ID NO: 69665 - DNA, 25 bp, Mus musculus
aagtgtgctcctaggtgctattcat

SEQ ID NO: 69666 - DNA, 25 bp, Mus musculus
aagtgtgctccttggtgctattcat

SEQ ID NO: 69667 - DNA, 25 bp, Mus musculus
aagtgtgctctacactgtgtgcgcc

SEQ ID NO: 69668 - DNA, 25 bp, Mus musculus
aagtgtgctctagactgtgtgcgcc

SEQ ID NO: 69669 - DNA, 25 bp, Mus musculus
aagtgtgctctcctgcctttgtgaa

SEQ ID NO: 69670 - DNA, 25 bp, Mus musculus
aagtgtgctctcgtgcctttgtgaa

SEQ ID NO: 69671 - DNA, 25 bp, Mus musculus
aagtgtgctcttacagttaacaaca

SEQ ID NO: 69672 - DNA, 25 bp, Mus musculus
aagtgtgctctttcagttaacaaca

SEQ ID NO: 69673 - DNA, 25 bp, Mus musculus
aagtgtgctggcatgactgtgaccc

SEQ ID NO: 69674 - DNA, 25 bp, Mus musculus
aagtgtgctggcttgactgtgaccc

SEQ ID NO: 69675 - DNA, 25 bp, Mus musculus
aagtgtgctgggattgacgttcgtc

SEQ ID NO: 69676 - DNA, 25 bp, Mus musculus
aagtgtgctgggtttgacgttcgtc

SEQ ID NO: 69677 - DNA, 25 bp, Mus musculus
aagtgtgctgtgattcctttaccct

SEQ ID NO: 69678 - DNA, 25 bp, Mus musculus
aagtgtgctgtgtttcctttaccct

SEQ ID NO: 69679 - DNA, 25 bp, Mus musculus
aagtgtgcttgtatgtgctcatgta

SEQ ID NO: 69680 - DNA, 25 bp, Mus musculus
aagtgtgcttgtttgtgctcatgta

SEQ ID NO: 69681 - DNA, 25 bp, Mus musculus
aagtgtgctttccaatacaatgata

SEQ ID NO: 69682 - DNA, 25 bp, Mus musculus
aagtgtgctttcgaatacaatgata

SEQ ID NO: 69683 - DNA, 25 bp, Mus musculus
aagtgtggacacacttccagtaaaa

SEQ ID NO: 69684 - DNA, 25 bp, Mus musculus
aagtgtggacactcttccagtaaaa

SEQ ID NO: 69685 - DNA, 25 bp, Mus musculus
aagtgtggacatacaccaactctcc

SEQ ID NO: 69686 - DNA, 25 bp, Mus musculus
aagtgtggacattcaccaactctcc

SEQ ID NO: 69687 - DNA, 25 bp, Mus musculus
aagtgtggactaccatgatgttata

SEQ ID NO: 69688 - DNA, 25 bp, Mus musculus
aagtgtggactagcatgatgttata

SEQ ID NO: 69689 - DNA, 25 bp, Mus musculus
aagtgtggacttcccaggatatgct

SEQ ID NO: 69690 - DNA, 25 bp, Mus musculus
aagtgtggacttgccaggatatgct

SEQ ID NO: 69691 - DNA, 25 bp, Mus musculus
aagtgtggcagcagagcacagcctt

SEQ ID NO: 69692 - DNA, 25 bp, Mus musculus
aagtgtggcagctgagcacagcctt

SEQ ID NO: 69693 - DNA, 25 bp, Mus musculus
aagtgtggccacattgaagaaactg

SEQ ID NO: 69694 - DNA, 25 bp, Mus musculus
aagtgtggccactttgaagaaactg

SEQ ID NO: 69695 - DNA, 25 bp, Mus musculus
aagtgtggccagaagtcgagtccct

SEQ ID NO: 69696 - DNA, 25 bp, Mus musculus
aagtgtggccagtagtcgagtccct

SEQ ID NO: 69697 - DNA, 25 bp, Mus musculus
aagtgtggccataacggaggtctcc

SEQ ID NO: 69698 - DNA, 25 bp, Mus musculus
aagtgtggccattacggaggtctcc

SEQ ID NO: 69699 - DNA, 25 bp, Mus musculus
aagtgtggcccaagctcataattgt

SEQ ID NO: 69700 - DNA, 25 bp, Mus musculus
aagtgtggcccatgctcataattgt

SEQ ID NO: 69701 - DNA, 25 bp, Mus musculus
aagtgtggcgctcacattttccatc

SEQ ID NO: 69702 - DNA, 25 bp, Mus musculus
aagtgtggcgctgacattttccatc

SEQ ID NO: 69703 - DNA, 25 bp, Mus musculus
aagtgtggctgcagctcttcttaaa

SEQ ID NO: 69704 - DNA, 25 bp, Mus musculus
aagtgtggctgctgctcttcttaaa

SEQ ID NO: 69705 - DNA, 25 bp, Mus musculus
aagtgtggctttcgtgaaatcgtag

SEQ ID NO: 69706 - DNA, 25 bp, Mus musculus
aagtgtggctttggtgaaatcgtag

SEQ ID NO: 69707 - DNA, 25 bp, Mus musculus
aagtgtgggcacagactgacaacca

SEQ ID NO: 69708 - DNA, 25 bp, Mus musculus
aagtgtgggcactgactgacaacca

SEQ ID NO: 69709 - DNA, 25 bp, Mus musculus
aagtgtgggcctatctggctctggt

SEQ ID NO: 69710 - DNA, 25 bp, Mus musculus
aagtgtgggcctttctggctctggt

SEQ ID NO: 69711 - DNA, 25 bp, Mus musculus
aagtgtgggctgaatggcccgccat

SEQ ID NO: 69712 - DNA, 25 bp, Mus musculus
aagtgtgggctgtatggcccgccat

SEQ ID NO: 69713 - DNA, 25 bp, Mus musculus
aagtgtgggtgtactgataagctac

SEQ ID NO: 69714 - DNA, 25 bp, Mus musculus
aagtgtgggtgttctgataagctac

SEQ ID NO: 69715 - DNA, 25 bp, Mus musculus
aagtgtgggttcagtccttagagaa

SEQ ID NO: 69716 - DNA, 25 bp, Mus musculus
aagtgtgggttctgtccttagagaa

SEQ ID NO: 69717 - DNA, 25 bp, Mus musculus
aagtgtggtactagaaggcatgatt

SEQ ID NO: 69718 - DNA, 25 bp, Mus musculus
aagtgtggtacttgaaggcatgatt

SEQ ID NO: 69719 - DNA, 25 bp, Mus musculus
aagtgtggtatgacctggtgttttc

SEQ ID NO: 69720 - DNA, 25 bp, Mus musculus
aagtgtggtatgtcctggtgttttc

SEQ ID NO: 69721 - DNA, 25 bp, Mus musculus
aagtgtggtctaacttattccgaga

SEQ ID NO: 69722 - DNA, 25 bp, Mus musculus
aagtgtggtctatcttattccgaga

SEQ ID NO: 69723 - DNA, 25 bp, Mus musculus
aagtgtggttcacggcctgtgcaca

SEQ ID NO: 69724 - DNA, 25 bp, Mus musculus
aagtgtggttcagggcctgtgcaca

SEQ ID NO: 69725 - DNA, 25 bp, Mus musculus
aagtgtgtacagctatcatcttaga

SEQ ID NO: 69726 - DNA, 25 bp, Mus musculus
aagtgtgtacaggtatcatcttaga

SEQ ID NO: 69727 - DNA, 25 bp, Mus musculus
aagtgtgtacatatctcaccgtgaa

SEQ ID NO: 69728 - DNA, 25 bp, Mus musculus
aagtgtgtacatttctcaccgtgaa

SEQ ID NO: 69729 - DNA, 25 bp, Mus musculus
aagtgtgtaccaacatgccagattt

SEQ ID NO: 69730 - DNA, 25 bp, Mus musculus
aagtgtgtaccatcatgccagattt

SEQ ID NO: 69731 - DNA, 25 bp, Mus musculus
aagtgtgtagtgatgttctcgtgcc

SEQ ID NO: 69732 - DNA, 25 bp, Mus musculus
aagtgtgtagtgttgttctcgtgcc

SEQ ID NO: 69733 - DNA, 25 bp, Mus musculus
aagtgtgtatgaactccccggagaa

SEQ ID NO: 69734 - DNA, 25 bp, Mus musculus
aagtgtgtatgatctccccggagaa

SEQ ID NO: 69735 - DNA, 25 bp, Mus musculus
aagtgtgtattgattctgtattccc

SEQ ID NO: 69736 - DNA, 25 bp, Mus musculus
aagtgtgtattgtttctgtattccc

SEQ ID NO: 69737 - DNA, 25 bp, Mus musculus
aagtgtgtcacccagctgggccctg

SEQ ID NO: 69738 - DNA, 25 bp, Mus musculus
aagtgtgtcaccgagctgggccctg

SEQ ID NO: 69739 - DNA, 25 bp, Mus musculus
aagtgtgtcagcatcactgagcagg

SEQ ID NO: 69740 - DNA, 25 bp, Mus musculus
aagtgtgtcagcttcactgagcagg

SEQ ID NO: 69741 - DNA, 25 bp, Mus musculus
aagtgtgtctacaatcacatcctaa

SEQ ID NO: 69742 - DNA, 25 bp, Mus musculus
aagtgtgtctactatcacatcctaa

SEQ ID NO: 69743 - DNA, 25 bp, Mus musculus
aagtgtgtctagctccaacccaagt

SEQ ID NO: 69744 - DNA, 25 bp, Mus musculus
aagtgtgtctaggtccaacccaagt

SEQ ID NO: 69745 - DNA, 25 bp, Mus musculus
aagtgtgtctcactgtcaccttcac

SEQ ID NO: 69746 - DNA, 25 bp, Mus musculus
aagtgtgtctcagtgtcaccttcac

SEQ ID NO: 69747 - DNA, 25 bp, Mus musculus
aagtgtgtctccagtcttggaaagc

SEQ ID NO: 69748 - DNA, 25 bp, Mus musculus
aagtgtgtctcctgtcttggaaagc

SEQ ID NO: 69749 - DNA, 25 bp, Mus musculus
aagtgtgtctctagcctgggtggct

SEQ ID NO: 69750 - DNA, 25 bp, Mus musculus
aagtgtgtctcttgcctgggtggct

SEQ ID NO: 69751 - DNA, 25 bp, Mus musculus
aagtgtgtctggagttccctgtcgg

SEQ ID NO: 69752 - DNA, 25 bp, Mus musculus
aagtgtgtctggtgttccctgtcgg

SEQ ID NO: 69753 - DNA, 25 bp, Mus musculus
aagtgtgtcttgatacagcaatcac

SEQ ID NO: 69754 - DNA, 25 bp, Mus musculus
aagtgtgtcttgttacagcaatcac

SEQ ID NO: 69755 - DNA, 25 bp, Mus musculus
aagtgtgtgaccatcagagcttttc

SEQ ID NO: 69756 - DNA, 25 bp, Mus musculus
aagtgtgtgaccttcagagcttttc

SEQ ID NO: 69757 - DNA, 25 bp, Mus musculus
aagtgtgtgagtattgcctgcttgt

SEQ ID NO: 69758 - DNA, 25 bp, Mus musculus
aagtgtgtgagttttgcctgcttgt

SEQ ID NO: 69759 - DNA, 25 bp, Mus musculus
aagtgtgtgcatatctaagttgaac

SEQ ID NO: 69760 - DNA, 25 bp, Mus musculus
aagtgtgtgcatttctaagttgaac

SEQ ID NO: 69761 - DNA, 25 bp, Mus musculus
aagtgtgtgcctatgatgctgtctc

SEQ ID NO: 69762 - DNA, 25 bp, Mus musculus
aagtgtgtgcctatgtagttttcac

SEQ ID NO: 69763 - DNA, 25 bp, Mus musculus
aagtgtgtgcctttgatgctgtctc

SEQ ID NO: 69764 - DNA, 25 bp, Mus musculus
aagtgtgtgcctttgtagttttcac

SEQ ID NO: 69765 - DNA, 25 bp, Mus musculus
aagtgtgtgctgctttcgcctcctg

SEQ ID NO: 69766 - DNA, 25 bp, Mus musculus
aagtgtgtgctggtttcgcctcctg

SEQ ID NO: 69767 - DNA, 25 bp, Mus musculus
aagtgtgtgcttacctggaggtcac

SEQ ID NO: 69768 - DNA, 25 bp, Mus musculus
aagtgtgtgcttctacactgagaag

SEQ ID NO: 69769 - DNA, 25 bp, Mus musculus
aagtgtgtgcttgtacactgagaag

SEQ ID NO: 69770 - DNA, 25 bp, Mus musculus
aagtgtgtgctttcctggaggtcac

SEQ ID NO: 69771 - DNA, 25 bp, Mus musculus
aagtgtgtgtacaatccctgctatg

SEQ ID NO: 69772 - DNA, 25 bp, Mus musculus
aagtgtgtgtactatccctgctatg

SEQ ID NO: 69773 - DNA, 25 bp, Mus musculus
aagtgtgtgtatcaattcctactaa

SEQ ID NO: 69774 - DNA, 25 bp, Mus musculus
aagtgtgtgtatgaattcctactaa

SEQ ID NO: 69775 - DNA, 25 bp, Mus musculus
aagtgtgtgtcccatggacagcccc

SEQ ID NO: 69776 - DNA, 25 bp, Mus musculus
aagtgtgtgtccgatggacagcccc

SEQ ID NO: 69777 - DNA, 25 bp, Mus musculus
aagtgtgtgtgtcgaccatccgcac

SEQ ID NO: 69778 - DNA, 25 bp, Mus musculus
aagtgtgtgtgtggaccatccgcac

SEQ ID NO: 69779 - DNA, 25 bp, Mus musculus
aagtgtgtgttaacacaccccttgt

SEQ ID NO: 69780 - DNA, 25 bp, Mus musculus
aagtgtgtgttatcacaccccttgt

SEQ ID NO: 69781 - DNA, 25 bp, Mus musculus
aagtgtgtgttcatacgtgtgtacg

SEQ ID NO: 69782 - DNA, 25 bp, Mus musculus
aagtgtgtgttcttacgtgtgtacg

SEQ ID NO: 69783 - DNA, 25 bp, Mus musculus
aagtgtgttcacataaccttctcta

SEQ ID NO: 69784 - DNA, 25 bp, Mus musculus
aagtgtgttcacttaaccttctcta

SEQ ID NO: 69785 - DNA, 25 bp, Mus musculus
aagtgtgttcccatgtgacaatttt

SEQ ID NO: 69786 - DNA, 25 bp, Mus musculus
aagtgtgttcccttgtgacaatttt

SEQ ID NO: 69787 - DNA, 25 bp, Mus musculus
aagtgtgttcgcaatgtttgtaaaa

SEQ ID NO: 69788 - DNA, 25 bp, Mus musculus
aagtgtgttcgctatgtttgtaaaa

SEQ ID NO: 69789 - DNA, 25 bp, Mus musculus
aagtgtgttctcacctgcagtgtaa

SEQ ID NO: 69790 - DNA, 25 bp, Mus musculus
aagtgtgttctctcctgcagtgtaa

SEQ ID NO: 69791 - DNA, 25 bp, Mus musculus
aagtgtgttgtgcatttaggcttca

SEQ ID NO: 69792 - DNA, 25 bp, Mus musculus
aagtgtgttgtggatttaggcttca

SEQ ID NO: 69793 - DNA, 25 bp, Mus musculus
aagtgtgtttttccaggtagtccta

SEQ ID NO: 69794 - DNA, 25 bp, Mus musculus
aagtgtgtttttgcaggtagtccta

SEQ ID NO: 69795 - DNA, 25 bp, Mus musculus
aagtgttaacttcggcagcagcctc

SEQ ID NO: 69796 - DNA, 25 bp, Mus musculus
aagtgttaacttgggcagcagcctc

SEQ ID NO: 69797 - DNA, 25 bp, Mus musculus
aagtgttaagtccagtccttcgttg

SEQ ID NO: 69798 - DNA, 25 bp, Mus musculus
aagtgttaagtcgagtccttcgttg

SEQ ID NO: 69799 - DNA, 25 bp, Mus musculus
aagtgttacaatcatcacatttgga

SEQ ID NO: 69800 - DNA, 25 bp, Mus musculus
aagtgttacaatgatcacatttgga

SEQ ID NO: 69801 - DNA, 25 bp, Mus musculus
aagtgttactcacacatgggcacct

SEQ ID NO: 69802 - DNA, 25 bp, Mus musculus
aagtgttactcagacatgggcacct

SEQ ID NO: 69803 - DNA, 25 bp, Mus musculus
aagtgttacttcattggtaccaaca

SEQ ID NO: 69804 - DNA, 25 bp, Mus musculus
aagtgttacttctttggtaccaaca

SEQ ID NO: 69805 - DNA, 25 bp, Mus musculus
aagtgttagactagactggactaca

SEQ ID NO: 69806 - DNA, 25 bp, Mus musculus
aagtgttagacttgactggactaca

SEQ ID NO: 69807 - DNA, 25 bp, Mus musculus
aagtgttagcctcctgatttgtctc

SEQ ID NO: 69808 - DNA, 25 bp, Mus musculus
aagtgttagcctgctgatttgtctc

SEQ ID NO: 69809 - DNA, 25 bp, Mus musculus
aagtgttaggaactggctctccctg

SEQ ID NO: 69810 - DNA, 25 bp, Mus musculus
aagtgttaggaagtggctctccctg

SEQ ID NO: 69811 - DNA, 25 bp, Mus musculus
aagtgttaggagacacaggcctgtg

SEQ ID NO: 69812 - DNA, 25 bp, Mus musculus
aagtgttaggagtcacaggcctgtg

SEQ ID NO: 69813 - DNA, 25 bp, Mus musculus
aagtgttagggtcccatttctgtac

SEQ ID NO: 69814 - DNA, 25 bp, Mus musculus
aagtgttagggtgccatttctgtac

SEQ ID NO: 69815 - DNA, 25 bp, Mus musculus
aagtgttatacacatccctcccctt

SEQ ID NO: 69816 - DNA, 25 bp, Mus musculus
aagtgttatacagatccctcccctt

SEQ ID NO: 69817 - DNA, 25 bp, Mus musculus
aagtgttatttcacttctcagtgaa

SEQ ID NO: 69818 - DNA, 25 bp, Mus musculus
aagtgttatttctcttctcagtgaa

SEQ ID NO: 69819 - DNA, 25 bp, Mus musculus
aagtgttcaacaagccctacttcat

SEQ ID NO: 69820 - DNA, 25 bp, Mus musculus
aagtgttcaacatgccctacttcat

SEQ ID NO: 69821 - DNA, 25 bp, Mus musculus
aagtgttcaagtcgcacaccaagcc

SEQ ID NO: 69822 - DNA, 25 bp, Mus musculus
aagtgttcaagtggcacaccaagcc

SEQ ID NO: 69823 - DNA, 25 bp, Mus musculus
aagtgttcacccagagcaataacgt

SEQ ID NO: 69824 - DNA, 25 bp, Mus musculus
aagtgttcaccctgagcaataacgt

SEQ ID NO: 69825 - DNA, 25 bp, Mus musculus
aagtgttcactgcaacatttcccat

SEQ ID NO: 69826 - DNA, 25 bp, Mus musculus
aagtgttcactggaacatttcccat

SEQ ID NO: 69827 - DNA, 25 bp, Mus musculus
aagtgttcacttaccttgagacggg

SEQ ID NO: 69828 - DNA, 25 bp, Mus musculus
aagtgttcacttcagcgcttcaacc

SEQ ID NO: 69829 - DNA, 25 bp, Mus musculus
aagtgttcacttgagcgcttcaacc

SEQ ID NO: 69830 - DNA, 25 bp, Mus musculus
aagtgttcactttccttgagacggg

SEQ ID NO: 69831 - DNA, 25 bp, Mus musculus
aagtgttcagccacattttcatgtc

SEQ ID NO: 69832 - DNA, 25 bp, Mus musculus
aagtgttcagcctcattttcatgtc

SEQ ID NO: 69833 - DNA, 25 bp, Mus musculus
aagtgttcatgaattgatcagggct

SEQ ID NO: 69834 - DNA, 25 bp, Mus musculus
aagtgttcatgatttgatcagggct

SEQ ID NO: 69835 - DNA, 25 bp, Mus musculus
aagtgttcatgcctgtccttcacca

SEQ ID NO: 69836 - DNA, 25 bp, Mus musculus
aagtgttcatgcgtgtccttcacca

SEQ ID NO: 69837 - DNA, 25 bp, Mus musculus
aagtgttcatggacttcacctaaag

SEQ ID NO: 69838 - DNA, 25 bp, Mus musculus
aagtgttcatggtcttcacctaaag

SEQ ID NO: 69839 - DNA, 25 bp, Mus musculus
aagtgttccagacagggcaacgcgt

SEQ ID NO: 69840 - DNA, 25 bp, Mus musculus
aagtgttccagagagggcaacgcgt

SEQ ID NO: 69841 - DNA, 25 bp, Mus musculus
aagtgttcccaaatcacccagataa

SEQ ID NO: 69842 - DNA, 25 bp, Mus musculus
aagtgttcccaattcacccagataa

SEQ ID NO: 69843 - DNA, 25 bp, Mus musculus
aagtgttcccacaacacagactgtt

SEQ ID NO: 69844 - DNA, 25 bp, Mus musculus
aagtgttcccacattcaagtgacaa

SEQ ID NO: 69845 - DNA, 25 bp, Mus musculus
aagtgttcccactacacagactgtt

SEQ ID NO: 69846 - DNA, 25 bp, Mus musculus
aagtgttcccactttcaagtgacaa

SEQ ID NO: 69847 - DNA, 25 bp, Mus musculus
aagtgttcccatctccgtgtgatta

SEQ ID NO: 69848 - DNA, 25 bp, Mus musculus
aagtgttcccatgtccgtgtgatta

SEQ ID NO: 69849 - DNA, 25 bp, Mus musculus
aagtgttccctaccaacactgatgt

SEQ ID NO: 69850 - DNA, 25 bp, Mus musculus
aagtgttccctagcaacactgatgt

SEQ ID NO: 69851 - DNA, 25 bp, Mus musculus
aagtgttcctttctttcaaatgttg

SEQ ID NO: 69852 - DNA, 25 bp, Mus musculus
aagtgttcctttgtttcaaatgttg

SEQ ID NO: 69853 - DNA, 25 bp, Mus musculus
aagtgttcgtgcagccccaaaaagt

SEQ ID NO: 69854 - DNA, 25 bp, Mus musculus
aagtgttcgtgctgccccaaaaagt

SEQ ID NO: 69855 - DNA, 25 bp, Mus musculus
aagtgttcgttcatctaaggcattc

SEQ ID NO: 69856 - DNA, 25 bp, Mus musculus
aagtgttcgttcttctaaggcattc

SEQ ID NO: 69857 - DNA, 25 bp, Mus musculus
aagtgttctaacacacctccagcat

SEQ ID NO: 69858 - DNA, 25 bp, Mus musculus
aagtgttctaactcacctccagcat

SEQ ID NO: 69859 - DNA, 25 bp, Mus musculus
aagtgttctcatatccaaagtttat

SEQ ID NO: 69860 - DNA, 25 bp, Mus musculus
aagtgttctcatatgctgatcaagg

SEQ ID NO: 69861 - DNA, 25 bp, Mus musculus
aagtgttctcatttccaaagtttat

SEQ ID NO: 69862 - DNA, 25 bp, Mus musculus
aagtgttctcatttgctgatcaagg

SEQ ID NO: 69863 - DNA, 25 bp, Mus musculus
aagtgttctgaccacaatttttgag

SEQ ID NO: 69864 - DNA, 25 bp, Mus musculus
aagtgttctgacgacaatttttgag

SEQ ID NO: 69865 - DNA, 25 bp, Mus musculus
aagtgttctgcgcatgaatcccctt

SEQ ID NO: 69866 - DNA, 25 bp, Mus musculus
aagtgttctgcggatgaatcccctt

SEQ ID NO: 69867 - DNA, 25 bp, Mus musculus
aagtgttcttcaatcacccatggac

SEQ ID NO: 69868 - DNA, 25 bp, Mus musculus
aagtgttcttcattcacccatggac

SEQ ID NO: 69869 - DNA, 25 bp, Mus musculus
aagtgttcttctcggacctggtaga

SEQ ID NO: 69870 - DNA, 25 bp, Mus musculus
aagtgttcttctcggcttgtttctc

SEQ ID NO: 69871 - DNA, 25 bp, Mus musculus
aagtgttcttctgggacctggtaga

SEQ ID NO: 69872 - DNA, 25 bp, Mus musculus
aagtgttcttctgggcttgtttctc

SEQ ID NO: 69873 - DNA, 25 bp, Mus musculus
aagtgttctttcacgtgtgccagga

SEQ ID NO: 69874 - DNA, 25 bp, Mus musculus
aagtgttctttctcgtgtgccagga

SEQ ID NO: 69875 - DNA, 25 bp, Mus musculus
aagtgttctttgctcctgaattgca

SEQ ID NO: 69876 - DNA, 25 bp, Mus musculus
aagtgttctttggtcctgaattgca

SEQ ID NO: 69877 - DNA, 25 bp, Mus musculus
aagtgttgaacaacgtgaagcccaa

SEQ ID NO: 69878 - DNA, 25 bp, Mus musculus
aagtgttgaacatcgtgaagcccaa

SEQ ID NO: 69879 - DNA, 25 bp, Mus musculus
aagtgttgaacgctccatctgtaga

SEQ ID NO: 69880 - DNA, 25 bp, Mus musculus
aagtgttgaacggtccatctgtaga

SEQ ID NO: 69881 - DNA, 25 bp, Mus musculus
aagtgttgactacatgaccaagcag

SEQ ID NO: 69882 - DNA, 25 bp, Mus musculus
aagtgttgactagatgaccaagcag

SEQ ID NO: 69883 - DNA, 25 bp, Mus musculus
aagtgttgatctctgctgatggcca

SEQ ID NO: 69884 - DNA, 25 bp, Mus musculus
aagtgttgatctgtgctgatggcca

SEQ ID NO: 69885 - DNA, 25 bp, Mus musculus
aagtgttgatttacttccatagtaa

SEQ ID NO: 69886 - DNA, 25 bp, Mus musculus
aagtgttgattttcttccatagtaa

SEQ ID NO: 69887 - DNA, 25 bp, Mus musculus
aagtgttgctgcaacaactagccaa

SEQ ID NO: 69888 - DNA, 25 bp, Mus musculus
aagtgttgctgctacaactagccaa

SEQ ID NO: 69889 - DNA, 25 bp, Mus musculus
aagtgttggcaacagattaggtctc

SEQ ID NO: 69890 - DNA, 25 bp, Mus musculus
aagtgttggcaagagattaggtctc

SEQ ID NO: 69891 - DNA, 25 bp, Mus musculus
aagtgttggcacattgctgtaatcc

SEQ ID NO: 69892 - DNA, 25 bp, Mus musculus
aagtgttggcactttgctgtaatcc

SEQ ID NO: 69893 - DNA, 25 bp, Mus musculus
aagtgttggcatcttgtttctttaa

SEQ ID NO: 69894 - DNA, 25 bp, Mus musculus
aagtgttggcatgttgtttctttaa

SEQ ID NO: 69895 - DNA, 25 bp, Mus musculus
aagtgttggctgatgtcctgaaaca

SEQ ID NO: 69896 - DNA, 25 bp, Mus musculus
aagtgttggctgttgtcctgaaaca

SEQ ID NO: 69897 - DNA, 25 bp, Mus musculus
aagtgttgggacaatattgcaaatg

SEQ ID NO: 69898 - DNA, 25 bp, Mus musculus
aagtgttgggacacttacagactat

SEQ ID NO: 69899 - DNA, 25 bp, Mus musculus
aagtgttgggactatattgcaaatg

SEQ ID NO: 69900 - DNA, 25 bp, Mus musculus
aagtgttgggactcttacagactat

SEQ ID NO: 69901 - DNA, 25 bp, Mus musculus
aagtgttggtagactgggaaccaca

SEQ ID NO: 69902 - DNA, 25 bp, Mus musculus
aagtgttggtagcagactgtgcctc

SEQ ID NO: 69903 - DNA, 25 bp, Mus musculus
aagtgttggtaggagactgtgcctc

SEQ ID NO: 69904 - DNA, 25 bp, Mus musculus
aagtgttggtagtctgggaaccaca

SEQ ID NO: 69905 - DNA, 25 bp, Mus musculus
aagtgttggtctcccaagcttagac

SEQ ID NO: 69906 - DNA, 25 bp, Mus musculus
aagtgttggtctgccaagcttagac

SEQ ID NO: 69907 - DNA, 25 bp, Mus musculus
aagtgttgtgctcgatatcccaaag

SEQ ID NO: 69908 - DNA, 25 bp, Mus musculus
aagtgttgtgctggatatcccaaag

SEQ ID NO: 69909 - DNA, 25 bp, Mus musculus
aagtgtttaacaagcactcggtatg

SEQ ID NO: 69910 - DNA, 25 bp, Mus musculus
aagtgtttaacatgcactcggtatg

SEQ ID NO: 69911 - DNA, 25 bp, Mus musculus
aagtgtttacatctgggcgactcgg

SEQ ID NO: 69912 - DNA, 25 bp, Mus musculus
aagtgtttacatgtgggcgactcgg

SEQ ID NO: 69913 - DNA, 25 bp, Mus musculus
aagtgtttactgacctgtctccagc

SEQ ID NO: 69914 - DNA, 25 bp, Mus musculus
aagtgtttactgtcctgtctccagc

SEQ ID NO: 69915 - DNA, 25 bp, Mus musculus
aagtgtttccaactagcagtgaatg

SEQ ID NO: 69916 - DNA, 25 bp, Mus musculus
aagtgtttccaagtagcagtgaatg

SEQ ID NO: 69917 - DNA, 25 bp, Mus musculus
aagtgtttccacatcataacaaagt

SEQ ID NO: 69918 - DNA, 25 bp, Mus musculus
aagtgtttccacttcataacaaagt

SEQ ID NO: 69919 - DNA, 25 bp, Mus musculus
aagtgtttccagagtgtgcgtctcg

SEQ ID NO: 69920 - DNA, 25 bp, Mus musculus
aagtgtttccagtgtgtgcgtctcg

SEQ ID NO: 69921 - DNA, 25 bp, Mus musculus
aagtgtttcccaacaggtctggctc

SEQ ID NO: 69922 - DNA, 25 bp, Mus musculus
aagtgtttcccatcaggtctggctc

SEQ ID NO: 69923 - DNA, 25 bp, Mus musculus
aagtgtttccggaagtgcatcggga

SEQ ID NO: 69924 - DNA, 25 bp, Mus musculus
aagtgtttccggtagtgcatcggga

SEQ ID NO: 69925 - DNA, 25 bp, Mus musculus
aagtgtttcctaaactgggttctct

SEQ ID NO: 69926 - DNA, 25 bp, Mus musculus
aagtgtttcctatactgggttctct

SEQ ID NO: 69927 - DNA, 25 bp, Mus musculus
aagtgtttctaaagcctgcattcta

SEQ ID NO: 69928 - DNA, 25 bp, Mus musculus
aagtgtttctaacagccacgtgaaa

SEQ ID NO: 69929 - DNA, 25 bp, Mus musculus
aagtgtttctaagagccacgtgaaa

SEQ ID NO: 69930 - DNA, 25 bp, Mus musculus
aagtgtttctaatgcctgcattcta

SEQ ID NO: 69931 - DNA, 25 bp, Mus musculus
aagtgtttctggcacagtgtgaact

SEQ ID NO: 69932 - DNA, 25 bp, Mus musculus
aagtgtttctgggacagtgtgaact

SEQ ID NO: 69933 - DNA, 25 bp, Mus musculus
aagtgtttgaaacccttcagttcag

SEQ ID NO: 69934 - DNA, 25 bp, Mus musculus
aagtgtttgaaagccttcagttcag

SEQ ID NO: 69935 - DNA, 25 bp, Mus musculus
aagtgtttgattatctacctttcaa

SEQ ID NO: 69936 - DNA, 25 bp, Mus musculus
aagtgtttgattttctacctttcaa

SEQ ID NO: 69937 - DNA, 25 bp, Mus musculus
aagtgtttgcacagatggctgcctc

SEQ ID NO: 69938 - DNA, 25 bp, Mus musculus
aagtgtttgcactgatggctgcctc

SEQ ID NO: 69939 - DNA, 25 bp, Mus musculus
aagtgtttgcagacatacccagttc

SEQ ID NO: 69940 - DNA, 25 bp, Mus musculus
aagtgtttgcagtcatacccagttc

SEQ ID NO: 69941 - DNA, 25 bp, Mus musculus
aagtgtttgctcaccagaatgcaac

SEQ ID NO: 69942 - DNA, 25 bp, Mus musculus
aagtgtttgctctccagaatgcaac

SEQ ID NO: 69943 - DNA, 25 bp, Mus musculus
aagtgtttggatagttggtctccag

SEQ ID NO: 69944 - DNA, 25 bp, Mus musculus
aagtgtttggattgttggtctccag

SEQ ID NO: 69945 - DNA, 25 bp, Mus musculus
aagtgtttggtgaggtgtgtacatc

SEQ ID NO: 69946 - DNA, 25 bp, Mus musculus
aagtgtttggtgtggtgtgtacatc

SEQ ID NO: 69947 - DNA, 25 bp, Mus musculus
aagtgtttggttaggtgcctgacat

SEQ ID NO: 69948 - DNA, 25 bp, Mus musculus
aagtgtttggtttggtgcctgacat

SEQ ID NO: 69949 - DNA, 25 bp, Mus musculus
aagtgtttgtgaccttagctaacga

SEQ ID NO: 69950 - DNA, 25 bp, Mus musculus
aagtgtttgtgagcttagctaacga

SEQ ID NO: 69951 - DNA, 25 bp, Mus musculus
aagtgttttaccattggacatagac

SEQ ID NO: 69952 - DNA, 25 bp, Mus musculus
aagtgttttacctttggacatagac

SEQ ID NO: 69953 - DNA, 25 bp, Mus musculus
aagtgttttactcaggctactcttt

SEQ ID NO: 69954 - DNA, 25 bp, Mus musculus
aagtgttttactgaggctactcttt

SEQ ID NO: 69955 - DNA, 25 bp, Mus musculus
aagtgttttagaatgccagcccatt

SEQ ID NO: 69956 - DNA, 25 bp, Mus musculus
aagtgttttagattgccagcccatt

SEQ ID NO: 69957 - DNA, 25 bp, Mus musculus
aagtgttttatgcttcatatggcta

SEQ ID NO: 69958 - DNA, 25 bp, Mus musculus
aagtgttttatggttcatatggcta

SEQ ID NO: 69959 - DNA, 25 bp, Mus musculus
aagtgttttattacgtcatgttcag

SEQ ID NO: 69960 - DNA, 25 bp, Mus musculus
aagtgttttatttcgtcatgttcag

SEQ ID NO: 69961 - DNA, 25 bp, Mus musculus
aagtgttttcacctccgtgaagtga

SEQ ID NO: 69962 - DNA, 25 bp, Mus musculus
aagtgttttcacgtccgtgaagtga

SEQ ID NO: 69963 - DNA, 25 bp, Mus musculus
aagtgttttcatctctacagtccca

SEQ ID NO: 69964 - DNA, 25 bp, Mus musculus
aagtgttttcatgtctacagtccca

SEQ ID NO: 69965 - DNA, 25 bp, Mus musculus
aagtgttttctaaattaggcgtgat

SEQ ID NO: 69966 - DNA, 25 bp, Mus musculus
aagtgttttctatattaggcgtgat

SEQ ID NO: 69967 - DNA, 25 bp, Mus musculus
aagttaaaactgacccatctggtat

SEQ ID NO: 69968 - DNA, 25 bp, Mus musculus
aagttaaaactgtcccatctggtat

SEQ ID NO: 69969 - DNA, 25 bp, Mus musculus
aagttaaacggtcgcaggcatgtcc

SEQ ID NO: 69970 - DNA, 25 bp, Mus musculus
aagttaaacggtggcaggcatgtcc

SEQ ID NO: 69971 - DNA, 25 bp, Mus musculus
aagttaaatcatcatcaggtacatc

SEQ ID NO: 69972 - DNA, 25 bp, Mus musculus
aagttaaatcatgatcaggtacatc

SEQ ID NO: 69973 - DNA, 25 bp, Mus musculus
aagttaacaagacagccagtggccg

SEQ ID NO: 69974 - DNA, 25 bp, Mus musculus
aagttaacaagagagccagtggccg

SEQ ID NO: 69975 - DNA, 25 bp, Mus musculus
aagttaacagctcagtttgggatgg

SEQ ID NO: 69976 - DNA, 25 bp, Mus musculus
aagttaacagctgagtttgggatgg

SEQ ID NO: 69977 - DNA, 25 bp, Mus musculus
aagttaacaggcacctcagccagtt

SEQ ID NO: 69978 - DNA, 25 bp, Mus musculus
aagttaacaggctcctcagccagtt

SEQ ID NO: 69979 - DNA, 25 bp, Mus musculus
aagttaacagttcacctgccggctt

SEQ ID NO: 69980 - DNA, 25 bp, Mus musculus
aagttaacagttgacctgccggctt

SEQ ID NO: 69981 - DNA, 25 bp, Mus musculus
aagttaacatgcagccaaccgatgg

SEQ ID NO: 69982 - DNA, 25 bp, Mus musculus
aagttaacatgctgccaaccgatgg

SEQ ID NO: 69983 - DNA, 25 bp, Mus musculus
aagttaaccaggatggctgccgtta

SEQ ID NO: 69984 - DNA, 25 bp, Mus musculus
aagttaaccaggttggctgccgtta

SEQ ID NO: 69985 - DNA, 25 bp, Mus musculus
aagttaacccgcacccaaatctatg

SEQ ID NO: 69986 - DNA, 25 bp, Mus musculus
aagttaacccgctcccaaatctatg

SEQ ID NO: 69987 - DNA, 25 bp, Mus musculus
aagttaactgctcccttggtatatg

SEQ ID NO: 69988 - DNA, 25 bp, Mus musculus
aagttaactgctgccttggtatatg

SEQ ID NO: 69989 - DNA, 25 bp, Mus musculus
aagttaactgtgatgtatattcata

SEQ ID NO: 69990 - DNA, 25 bp, Mus musculus
aagttaactgtgttgtatattcata

SEQ ID NO: 69991 - DNA, 25 bp, Mus musculus
aagttaacttctaccaagcttggct

SEQ ID NO: 69992 - DNA, 25 bp, Mus musculus
aagttaacttcttccaagcttggct

SEQ ID NO: 69993 - DNA, 25 bp, Mus musculus
aagttaagaaatcctccccacagct

SEQ ID NO: 69994 - DNA, 25 bp, Mus musculus
aagttaagaaatgctccccacagct

SEQ ID NO: 69995 - DNA, 25 bp, Mus musculus
aagttaagaattatctgcatctgct

SEQ ID NO: 69996 - DNA, 25 bp, Mus musculus
aagttaagaattttctgcatctgct

SEQ ID NO: 69997 - DNA, 25 bp, Mus musculus
aagttaagtctgagagtgtccatct

SEQ ID NO: 69998 - DNA, 25 bp, Mus musculus
aagttaagtctgtgagtgtccatct

SEQ ID NO: 69999 - DNA, 25 bp, Mus musculus
aagttaagttcaaccctgctggcat

SEQ ID NO: 70000 - DNA, 25 bp, Mus musculus
aagttaagttcatccctgctggcat

SEQ ID NO: 70001 - DNA, 25 bp, Mus musculus
aagttaatcaccatccatagcttag

SEQ ID NO: 70002 - DNA, 25 bp, Mus musculus
aagttaatcaccttccatagcttag

SEQ ID NO: 70003 - DNA, 25 bp, Mus musculus
aagttaatccaaatgctgacagctg

SEQ ID NO: 70004 - DNA, 25 bp, Mus musculus
aagttaatccaattgctgacagctg

SEQ ID NO: 70005 - DNA, 25 bp, Mus musculus
aagttaatctggatgctgagcagac

SEQ ID NO: 70006 - DNA, 25 bp, Mus musculus
aagttaatctggttgctgagcagac

SEQ ID NO: 70007 - DNA, 25 bp, Mus musculus
aagttaatctttaagccgctcgctg

SEQ ID NO: 70008 - DNA, 25 bp, Mus musculus
aagttaatcttttagccgctcgctg

SEQ ID NO: 70009 - DNA, 25 bp, Mus musculus
aagttaatggcactgtaccttgtgc

SEQ ID NO: 70010 - DNA, 25 bp, Mus musculus
aagttaatggcagtgtaccttgtgc

SEQ ID NO: 70011 - DNA, 25 bp, Mus musculus
aagttaattctgatcctctggcatc

SEQ ID NO: 70012 - DNA, 25 bp, Mus musculus
aagttaattctgttcctctggcatc

SEQ ID NO: 70013 - DNA, 25 bp, Mus musculus
aagttaattgttcatgcacattcat

SEQ ID NO: 70014 - DNA, 25 bp, Mus musculus
aagttaattgttgatgcacattcat

SEQ ID NO: 70015 - DNA, 25 bp, Mus musculus
aagttacaactacattgcctttata

SEQ ID NO: 70016 - DNA, 25 bp, Mus musculus
aagttacaactacctcactgcagac

SEQ ID NO: 70017 - DNA, 25 bp, Mus musculus
aagttacaactagattgcctttata

SEQ ID NO: 70018 - DNA, 25 bp, Mus musculus
aagttacaactagctcactgcagac

SEQ ID NO: 70019 - DNA, 25 bp, Mus musculus
aagttacaagccaacagcgtctggg

SEQ ID NO: 70020 - DNA, 25 bp, Mus musculus
aagttacaagcctacagcgtctggg

SEQ ID NO: 70021 - DNA, 25 bp, Mus musculus
aagttacaatgtctagatgctgcag

SEQ ID NO: 70022 - DNA, 25 bp, Mus musculus
aagttacaatgtgtagatgctgcag

SEQ ID NO: 70023 - DNA, 25 bp, Mus musculus
aagttacacaacacatccgcagatg

SEQ ID NO: 70024 - DNA, 25 bp, Mus musculus
aagttacacaactcatccgcagatg

SEQ ID NO: 70025 - DNA, 25 bp, Mus musculus
aagttacagctaatgcctcacacag

SEQ ID NO: 70026 - DNA, 25 bp, Mus musculus
aagttacagctattgcctcacacag

SEQ ID NO: 70027 - DNA, 25 bp, Mus musculus
aagttacagttgagatcctacccca

SEQ ID NO: 70028 - DNA, 25 bp, Mus musculus
aagttacagttgtgatcctacccca

SEQ ID NO: 70029 - DNA, 25 bp, Mus musculus
aagttacatattccatgtccccaca

SEQ ID NO: 70030 - DNA, 25 bp, Mus musculus
aagttacatattgcatgtccccaca

SEQ ID NO: 70031 - DNA, 25 bp, Mus musculus
aagttacatctaccctgactccaag

SEQ ID NO: 70032 - DNA, 25 bp, Mus musculus
aagttacatctactgcagactctct

SEQ ID NO: 70033 - DNA, 25 bp, Mus musculus
aagttacatctagcctgactccaag

SEQ ID NO: 70034 - DNA, 25 bp, Mus musculus
aagttacatctagtgcagactctct

SEQ ID NO: 70035 - DNA, 25 bp, Mus musculus
aagttacatgagctgatgcgctaca

SEQ ID NO: 70036 - DNA, 25 bp, Mus musculus
aagttacatgaggtgatgcgctaca

SEQ ID NO: 70037 - DNA, 25 bp, Mus musculus
aagttacatttactgcagactttct

SEQ ID NO: 70038 - DNA, 25 bp, Mus musculus
aagttacatttagtgcagactttct

SEQ ID NO: 70039 - DNA, 25 bp, Mus musculus
aagttaccaatgattgccaattttg

SEQ ID NO: 70040 - DNA, 25 bp, Mus musculus
aagttaccaatgtttgccaattttg

SEQ ID NO: 70041 - DNA, 25 bp, Mus musculus
aagttaccacctatgcggatttcat

SEQ ID NO: 70042 - DNA, 25 bp, Mus musculus
aagttaccacctttgcggatttcat

SEQ ID NO: 70043 - DNA, 25 bp, Mus musculus
aagttaccactgatatttgagttca

SEQ ID NO: 70044 - DNA, 25 bp, Mus musculus
aagttaccactgttatttgagttca

SEQ ID NO: 70045 - DNA, 25 bp, Mus musculus
aagttaccatctacttactccacat

SEQ ID NO: 70046 - DNA, 25 bp, Mus musculus
aagttaccatcttcttactccacat

SEQ ID NO: 70047 - DNA, 25 bp, Mus musculus
aagttaccatgcaacagcctgctgt

SEQ ID NO: 70048 - DNA, 25 bp, Mus musculus
aagttaccatgcatttgcatccgtc

SEQ ID NO: 70049 - DNA, 25 bp, Mus musculus
aagttaccatgctacagcctgctgt

SEQ ID NO: 70050 - DNA, 25 bp, Mus musculus
aagttaccatgcttttgcatccgtc

SEQ ID NO: 70051 - DNA, 25 bp, Mus musculus
aagttacccggaatctctcagagtt

SEQ ID NO: 70052 - DNA, 25 bp, Mus musculus
aagttacccggattctctcagagtt

SEQ ID NO: 70053 - DNA, 25 bp, Mus musculus
aagttacctccaaagtctctggact

SEQ ID NO: 70054 - DNA, 25 bp, Mus musculus
aagttacctccatagtctctggact

SEQ ID NO: 70055 - DNA, 25 bp, Mus musculus
aagttacctgagactaagctataaa

SEQ ID NO: 70056 - DNA, 25 bp, Mus musculus
aagttacctgagtctaagctataaa

SEQ ID NO: 70057 - DNA, 25 bp, Mus musculus
aagttacctgatatgtgcgaagcca

SEQ ID NO: 70058 - DNA, 25 bp, Mus musculus
aagttacctgatttgtgcgaagcca

SEQ ID NO: 70059 - DNA, 25 bp, Mus musculus
aagttacgcgctcccactttcagaa

SEQ ID NO: 70060 - DNA, 25 bp, Mus musculus
aagttacgcgctgccactttcagaa

SEQ ID NO: 70061 - DNA, 25 bp, Mus musculus
aagttacggcccagattcaaggtct

SEQ ID NO: 70062 - DNA, 25 bp, Mus musculus
aagttacggccctgattcaaggtct

SEQ ID NO: 70063 - DNA, 25 bp, Mus musculus
aagttacgtcttacagtttgtgaat

SEQ ID NO: 70064 - DNA, 25 bp, Mus musculus
aagttacgtctttcagtttgtgaat

SEQ ID NO: 70065 - DNA, 25 bp, Mus musculus
aagttactacacattcgcctgtcca

SEQ ID NO: 70066 - DNA, 25 bp, Mus musculus
aagttactacactttcgcctgtcca

SEQ ID NO: 70067 - DNA, 25 bp, Mus musculus
aagttactagtgattcatcagaaaa

SEQ ID NO: 70068 - DNA, 25 bp, Mus musculus
aagttactagtgtttcatcagaaaa

SEQ ID NO: 70069 - DNA, 25 bp, Mus musculus
aagttactatcccatattacccact

SEQ ID NO: 70070 - DNA, 25 bp, Mus musculus
aagttactatccgatattacccact

SEQ ID NO: 70071 - DNA, 25 bp, Mus musculus
aagttactcatacagaagtgtacgc

SEQ ID NO: 70072 - DNA, 25 bp, Mus musculus
aagttactcatagagaagtgtacgc

SEQ ID NO: 70073 - DNA, 25 bp, Mus musculus
aagttactcattcagaactgtgctt

SEQ ID NO: 70074 - DNA, 25 bp, Mus musculus
aagttactcattgagaactgtgctt

SEQ ID NO: 70075 - DNA, 25 bp, Mus musculus
aagttactctaaaactgcctgccct

SEQ ID NO: 70076 - DNA, 25 bp, Mus musculus
aagttactctaatactgcctgccct

SEQ ID NO: 70077 - DNA, 25 bp, Mus musculus
aagttactcttacacacatacggaa

SEQ ID NO: 70078 - DNA, 25 bp, Mus musculus
aagttactcttagacacatacggaa

SEQ ID NO: 70079 - DNA, 25 bp, Mus musculus
aagttactcttgctttgtgtgtggt

SEQ ID NO: 70080 - DNA, 25 bp, Mus musculus
aagttactcttggtttgtgtgtggt

SEQ ID NO: 70081 - DNA, 25 bp, Mus musculus
aagttactgagcacctttcctagga

SEQ ID NO: 70082 - DNA, 25 bp, Mus musculus
aagttactgagctcctttcctagga

SEQ ID NO: 70083 - DNA, 25 bp, Mus musculus
aagttactgataccccgtgttgcct

SEQ ID NO: 70084 - DNA, 25 bp, Mus musculus
aagttactgatagcccgtgttgcct

SEQ ID NO: 70085 - DNA, 25 bp, Mus musculus
aagttactgcagaggaattgattct

SEQ ID NO: 70086 - DNA, 25 bp, Mus musculus
aagttactgcagtggaattgattct

SEQ ID NO: 70087 - DNA, 25 bp, Mus musculus
aagttactgctcaatagaatttagt

SEQ ID NO: 70088 - DNA, 25 bp, Mus musculus
aagttactgctctatagaatttagt

SEQ ID NO: 70089 - DNA, 25 bp, Mus musculus
aagttactgctgaagacccactcga

SEQ ID NO: 70090 - DNA, 25 bp, Mus musculus
aagttactgctgtagacccactcga

SEQ ID NO: 70091 - DNA, 25 bp, Mus musculus
aagttactggacctctgccaaggag

SEQ ID NO: 70092 - DNA, 25 bp, Mus musculus
aagttactggacgtctgccaaggag

SEQ ID NO: 70093 - DNA, 25 bp, Mus musculus
aagttactggcaattcttgcttccg

SEQ ID NO: 70094 - DNA, 25 bp, Mus musculus
aagttactggcatttcttgcttccg

SEQ ID NO: 70095 - DNA, 25 bp, Mus musculus
aagttactgtagcaggaaggcttga

SEQ ID NO: 70096 - DNA, 25 bp, Mus musculus
aagttactgtaggaggaaggcttga

SEQ ID NO: 70097 - DNA, 25 bp, Mus musculus
aagttacttagtccggcatcatgtc

SEQ ID NO: 70098 - DNA, 25 bp, Mus musculus
aagttacttagtgcggcatcatgtc

SEQ ID NO: 70099 - DNA, 25 bp, Mus musculus
aagttacttctgatctctcattcca

SEQ ID NO: 70100 - DNA, 25 bp, Mus musculus
aagttacttctgttctctcattcca

SEQ ID NO: 70101 - DNA, 25 bp, Mus musculus
aagttacttgtcaatggcatggttt

SEQ ID NO: 70102 - DNA, 25 bp, Mus musculus
aagttacttgtctatggcatggttt

SEQ ID NO: 70103 - DNA, 25 bp, Mus musculus
aagttacttgtgcacagttctttgt

SEQ ID NO: 70104 - DNA, 25 bp, Mus musculus
aagttacttgtggacagttctttgt

SEQ ID NO: 70105 - DNA, 25 bp, Mus musculus
aagttactttgcagctctgtgtcgt

SEQ ID NO: 70106 - DNA, 25 bp, Mus musculus
aagttactttgctgctctgtgtcgt

SEQ ID NO: 70107 - DNA, 25 bp, Mus musculus
aagttacttttacactcatccactc

SEQ ID NO: 70108 - DNA, 25 bp, Mus musculus
aagttacttttagactcatccactc

SEQ ID NO: 70109 - DNA, 25 bp, Mus musculus
aagttagacttgagcactgaattaa

SEQ ID NO: 70110 - DNA, 25 bp, Mus musculus
aagttagacttgtgcactgaattaa

SEQ ID NO: 70111 - DNA, 25 bp, Mus musculus
aagttagagcagacggaagcccaac

SEQ ID NO: 70112 - DNA, 25 bp, Mus musculus
aagttagagcagtcggaagcccaac

SEQ ID NO: 70113 - DNA, 25 bp, Mus musculus
aagttagagcccatttcacattcca

SEQ ID NO: 70114 - DNA, 25 bp, Mus musculus
aagttagagcccttttcacattcca

SEQ ID NO: 70115 - DNA, 25 bp, Mus musculus
aagttagagctaagcccctggtaat

SEQ ID NO: 70116 - DNA, 25 bp, Mus musculus
aagttagagctatgcccctggtaat

SEQ ID NO: 70117 - DNA, 25 bp, Mus musculus
aagttagataatcaagttctccagc

SEQ ID NO: 70118 - DNA, 25 bp, Mus musculus
aagttagataatgaagttctccagc

SEQ ID NO: 70119 - DNA, 25 bp, Mus musculus
aagttagcaagtcttttctgtggaa

SEQ ID NO: 70120 - DNA, 25 bp, Mus musculus
aagttagcaagtgttttctgtggaa

SEQ ID NO: 70121 - DNA, 25 bp, Mus musculus
aagttagcaggtcgctgcagcccag

SEQ ID NO: 70122 - DNA, 25 bp, Mus musculus
aagttagcaggtggctgcagcccag

SEQ ID NO: 70123 - DNA, 25 bp, Mus musculus
aagttagccagcacagtttccagaa

SEQ ID NO: 70124 - DNA, 25 bp, Mus musculus
aagttagccagctcagtttccagaa

SEQ ID NO: 70125 - DNA, 25 bp, Mus musculus
aagttagcggccagagagatgttct

SEQ ID NO: 70126 - DNA, 25 bp, Mus musculus
aagttagcggcctgagagatgttct

SEQ ID NO: 70127 - DNA, 25 bp, Mus musculus
aagttagctctccaagttgcgactc

SEQ ID NO: 70128 - DNA, 25 bp, Mus musculus
aagttagctctcgaagttgcgactc

SEQ ID NO: 70129 - DNA, 25 bp, Mus musculus
aagttagctttacttccacagggag

SEQ ID NO: 70130 - DNA, 25 bp, Mus musculus
aagttagctttagttccacagggag

SEQ ID NO: 70131 - DNA, 25 bp, Mus musculus
aagttaggcatgattgatggcacat

SEQ ID NO: 70132 - DNA, 25 bp, Mus musculus
aagttaggcatgtttgatggcacat

SEQ ID NO: 70133 - DNA, 25 bp, Mus musculus
aagttaggcccaccaaggcctcagg

SEQ ID NO: 70134 - DNA, 25 bp, Mus musculus
aagttaggcccagcaaggcctcagg

SEQ ID NO: 70135 - DNA, 25 bp, Mus musculus
aagttaggccccaagggattgtgat

SEQ ID NO: 70136 - DNA, 25 bp, Mus musculus
aagttaggcccctagggattgtgat

SEQ ID NO: 70137 - DNA, 25 bp, Mus musculus
aagttaggccctctaccaatgcatt

SEQ ID NO: 70138 - DNA, 25 bp, Mus musculus
aagttaggccctgtaccaatgcatt

SEQ ID NO: 70139 - DNA, 25 bp, Mus musculus
aagttagggaccattctgccttggc

SEQ ID NO: 70140 - DNA, 25 bp, Mus musculus
aagttagggacctttctgccttggc

SEQ ID NO: 70141 - DNA, 25 bp, Mus musculus
aagttagggctcaacagacagtaca

SEQ ID NO: 70142 - DNA, 25 bp, Mus musculus
aagttagggctctacagacagtaca

SEQ ID NO: 70143 - DNA, 25 bp, Mus musculus
aagttaggtcgtcgtcagccttggc

SEQ ID NO: 70144 - DNA, 25 bp, Mus musculus
aagttaggtcgtggtcagccttggc

SEQ ID NO: 70145 - DNA, 25 bp, Mus musculus
aagttaggtgatctgtggatcctca

SEQ ID NO: 70146 - DNA, 25 bp, Mus musculus
aagttaggtgatcttttatcagaaa

SEQ ID NO: 70147 - DNA, 25 bp, Mus musculus
aagttaggtgatgtgtggatcctca

SEQ ID NO: 70148 - DNA, 25 bp, Mus musculus
aagttaggtgatgttttatcagaaa

SEQ ID NO: 70149 - DNA, 25 bp, Mus musculus
aagttaggttagcactgcccatcag

SEQ ID NO: 70150 - DNA, 25 bp, Mus musculus
aagttaggttaggactgcccatcag

SEQ ID NO: 70151 - DNA, 25 bp, Mus musculus
aagttagtcaagagcctgagttttt

SEQ ID NO: 70152 - DNA, 25 bp, Mus musculus
aagttagtcaagtgcctgagttttt

SEQ ID NO: 70153 - DNA, 25 bp, Mus musculus
aagttagtcagcagtggtggtcaaa

SEQ ID NO: 70154 - DNA, 25 bp, Mus musculus
aagttagtcagctgtggtggtcaaa

SEQ ID NO: 70155 - DNA, 25 bp, Mus musculus
aagttagtcattaatgtatctcaga

SEQ ID NO: 70156 - DNA, 25 bp, Mus musculus
aagttagtcatttatgtatctcaga

SEQ ID NO: 70157 - DNA, 25 bp, Mus musculus
aagttagtgcttactgaccattggg

SEQ ID NO: 70158 - DNA, 25 bp, Mus musculus
aagttagtgctttctgaccattggg

SEQ ID NO: 70159 - DNA, 25 bp, Mus musculus
aagttagttccactctactatcagc

SEQ ID NO: 70160 - DNA, 25 bp, Mus musculus
aagttagttccagtctactatcagc

SEQ ID NO: 70161 - DNA, 25 bp, Mus musculus
aagttagttcctctgtcagcagccc

SEQ ID NO: 70162 - DNA, 25 bp, Mus musculus
aagttagttcctgtgtcagcagccc

SEQ ID NO: 70163 - DNA, 25 bp, Mus musculus
aagttagttttgagaattgagacac

SEQ ID NO: 70164 - DNA, 25 bp, Mus musculus
aagttagttttgtgaattgagacac

SEQ ID NO: 70165 - DNA, 25 bp, Mus musculus
aagttatagctaaccaaattgttat

SEQ ID NO: 70166 - DNA, 25 bp, Mus musculus
aagttatagctatccaaattgttat

SEQ ID NO: 70167 - DNA, 25 bp, Mus musculus
aagttatagtaacaagcatttggtt

SEQ ID NO: 70168 - DNA, 25 bp, Mus musculus
aagttatagtaagaagcatttggtt

SEQ ID NO: 70169 - DNA, 25 bp, Mus musculus
aagttatatagtccctgttttgaga

SEQ ID NO: 70170 - DNA, 25 bp, Mus musculus
aagttatatagtgcctgttttgaga

SEQ ID NO: 70171 - DNA, 25 bp, Mus musculus
aagttatcacttatttagcatgcat

SEQ ID NO: 70172 - DNA, 25 bp, Mus musculus
aagttatcacttttttagcatgcat

SEQ ID NO: 70173 - DNA, 25 bp, Mus musculus
aagttatcatcaacatcgccattgc

SEQ ID NO: 70174 - DNA, 25 bp, Mus musculus
aagttatcatcatcatcgccattgc

SEQ ID NO: 70175 - DNA, 25 bp, Mus musculus
aagttatcatttaggcctgtttggg

SEQ ID NO: 70176 - DNA, 25 bp, Mus musculus
aagttatcattttggcctgtttggg

SEQ ID NO: 70177 - DNA, 25 bp, Mus musculus
aagttatcctttagtgatgtcccta

SEQ ID NO: 70178 - DNA, 25 bp, Mus musculus
aagttatccttttgtgatgtcccta

SEQ ID NO: 70179 - DNA, 25 bp, Mus musculus
aagttatctgggatgtgcttcatat

SEQ ID NO: 70180 - DNA, 25 bp, Mus musculus
aagttatctgggttgtgcttcatat

SEQ ID NO: 70181 - DNA, 25 bp, Mus musculus
aagttatgaggtcctgtgccctgaa

SEQ ID NO: 70182 - DNA, 25 bp, Mus musculus
aagttatgaggtgctgtgccctgaa

SEQ ID NO: 70183 - DNA, 25 bp, Mus musculus
aagttatgctggcagattccccaag

SEQ ID NO: 70184 - DNA, 25 bp, Mus musculus
aagttatgctgggagattccccaag

SEQ ID NO: 70185 - DNA, 25 bp, Mus musculus
aagttatggacactcaggcctccgt

SEQ ID NO: 70186 - DNA, 25 bp, Mus musculus
aagttatggacagtcaggcctccgt

SEQ ID NO: 70187 - DNA, 25 bp, Mus musculus
aagttatgtcgtctctgtttgtgga

SEQ ID NO: 70188 - DNA, 25 bp, Mus musculus
aagttatgtcgtgtctgtttgtgga

SEQ ID NO: 70189 - DNA, 25 bp, Mus musculus
aagttatgtctcactgaaggtggga

SEQ ID NO: 70190 - DNA, 25 bp, Mus musculus
aagttatgtctctctgaaggtggga

SEQ ID NO: 70191 - DNA, 25 bp, Mus musculus
aagttatgtgccaccacttccttgg

SEQ ID NO: 70192 - DNA, 25 bp, Mus musculus
aagttatgtgcctccacttccttgg

SEQ ID NO: 70193 - DNA, 25 bp, Mus musculus
aagttatgtgtgaaggtaccatgta

SEQ ID NO: 70194 - DNA, 25 bp, Mus musculus
aagttatgtgtgagtgcccaatgta

SEQ ID NO: 70195 - DNA, 25 bp, Mus musculus
aagttatgtgtgtaggtaccatgta

SEQ ID NO: 70196 - DNA, 25 bp, Mus musculus
aagttatgtgtgtgtgcccaatgta

SEQ ID NO: 70197 - DNA, 25 bp, Mus musculus
aagttatgtttcagattttcaaatt

SEQ ID NO: 70198 - DNA, 25 bp, Mus musculus
aagttatgtttctgattttcaaatt

SEQ ID NO: 70199 - DNA, 25 bp, Mus musculus
aagttattaacaagtcagcaggcag

SEQ ID NO: 70200 - DNA, 25 bp, Mus musculus
aagttattaacatgtcagcaggcag

SEQ ID NO: 70201 - DNA, 25 bp, Mus musculus
aagttattaagactgcccaacctgg

SEQ ID NO: 70202 - DNA, 25 bp, Mus musculus
aagttattaagagtgcccaacctgg

SEQ ID NO: 70203 - DNA, 25 bp, Mus musculus
aagttattacagagcccctatgata

SEQ ID NO: 70204 - DNA, 25 bp, Mus musculus
aagttattacagtgcccctatgata

SEQ ID NO: 70205 - DNA, 25 bp, Mus musculus
aagttattcaccagggtatgcaata

SEQ ID NO: 70206 - DNA, 25 bp, Mus musculus
aagttattcacctgggtatgcaata

SEQ ID NO: 70207 - DNA, 25 bp, Mus musculus
aagttattccaaacacagccccagc

SEQ ID NO: 70208 - DNA, 25 bp, Mus musculus
aagttattccaatcacagccccagc

SEQ ID NO: 70209 - DNA, 25 bp, Mus musculus
aagttattctctcatctccatacat

SEQ ID NO: 70210 - DNA, 25 bp, Mus musculus
aagttattctctgatctccatacat

SEQ ID NO: 70211 - DNA, 25 bp, Mus musculus
aagttattcttaaagacccgagcta

SEQ ID NO: 70212 - DNA, 25 bp, Mus musculus
aagttattcttatagacccgagcta

SEQ ID NO: 70213 - DNA, 25 bp, Mus musculus
aagttattgacccagtccacctatt

SEQ ID NO: 70214 - DNA, 25 bp, Mus musculus
aagttattgaccgagtccacctatt

SEQ ID NO: 70215 - DNA, 25 bp, Mus musculus
aagttattggccctgtgtcatcctc

SEQ ID NO: 70216 - DNA, 25 bp, Mus musculus
aagttattggccgtgtgtcatcctc

SEQ ID NO: 70217 - DNA, 25 bp, Mus musculus
aagttattggtgcaagatgttgcta

SEQ ID NO: 70218 - DNA, 25 bp, Mus musculus
aagttattggtggaagatgttgcta

SEQ ID NO: 70219 - DNA, 25 bp, Mus musculus
aagttatttaccatctgctgttgag

SEQ ID NO: 70220 - DNA, 25 bp, Mus musculus
aagttatttaccttctgctgttgag

SEQ ID NO: 70221 - DNA, 25 bp, Mus musculus
aagttatttccaaccaaagtgtagg

SEQ ID NO: 70222 - DNA, 25 bp, Mus musculus
aagttatttccatccaaagtgtagg

SEQ ID NO: 70223 - DNA, 25 bp, Mus musculus
aagttatttgcaagcctatgactgc

SEQ ID NO: 70224 - DNA, 25 bp, Mus musculus
aagttatttgcatgcctatgactgc

SEQ ID NO: 70225 - DNA, 25 bp, Mus musculus
aagttcaaaactctcttcctctctc

SEQ ID NO: 70226 - DNA, 25 bp, Mus musculus
aagttcaaaactgtcttcctctctc

SEQ ID NO: 70227 - DNA, 25 bp, Mus musculus
aagttcaaacctccagcttgtgaaa

SEQ ID NO: 70228 - DNA, 25 bp, Mus musculus
aagttcaaacctgcagcttgtgaaa

SEQ ID NO: 70229 - DNA, 25 bp, Mus musculus
aagttcaaagctctgcacatgtgga

SEQ ID NO: 70230 - DNA, 25 bp, Mus musculus
aagttcaaagctgtgcacatgtgga

SEQ ID NO: 70231 - DNA, 25 bp, Mus musculus
aagttcaaatctcctgagtgactca

SEQ ID NO: 70232 - DNA, 25 bp, Mus musculus
aagttcaaatctgctgagtgactca

SEQ ID NO: 70233 - DNA, 25 bp, Mus musculus
aagttcaacactcgctactcatcta

SEQ ID NO: 70234 - DNA, 25 bp, Mus musculus
aagttcaacactggctactcatcta

SEQ ID NO: 70235 - DNA, 25 bp, Mus musculus
aagttcaagactcgcctgtctcaaa

SEQ ID NO: 70236 - DNA, 25 bp, Mus musculus
aagttcaagactggcctgtctcaaa

SEQ ID NO: 70237 - DNA, 25 bp, Mus musculus
aagttcaagcagaggcagactcgac

SEQ ID NO: 70238 - DNA, 25 bp, Mus musculus
aagttcaagcagtggcagactcgac

SEQ ID NO: 70239 - DNA, 25 bp, Mus musculus
aagttcaagctcaccatgaaatttg

SEQ ID NO: 70240 - DNA, 25 bp, Mus musculus
aagttcaagctctccatgaaatttg

SEQ ID NO: 70241 - DNA, 25 bp, Mus musculus
aagttcaaggccctgtgctgcggca

SEQ ID NO: 70242 - DNA, 25 bp, Mus musculus
aagttcaaggccgtgtgctgcggca

SEQ ID NO: 70243 - DNA, 25 bp, Mus musculus
aagttcaaggttcgctgcagcaggt

SEQ ID NO: 70244 - DNA, 25 bp, Mus musculus
aagttcaaggttggctgcagcaggt

SEQ ID NO: 70245 - DNA, 25 bp, Mus musculus
aagttcaagttgactatcttgctac

SEQ ID NO: 70246 - DNA, 25 bp, Mus musculus
aagttcaagttgtctatcttgctac

SEQ ID NO: 70247 - DNA, 25 bp, Mus musculus
aagttcaatagaacagcagccaatg

SEQ ID NO: 70248 - DNA, 25 bp, Mus musculus
aagttcaatagatcagcagccaatg

SEQ ID NO: 70249 - DNA, 25 bp, Mus musculus
aagttcaatcaacgaccacccgtgg

SEQ ID NO: 70250 - DNA, 25 bp, Mus musculus
aagttcaatcaaggaccacccgtgg

SEQ ID NO: 70251 - DNA, 25 bp, Mus musculus
aagttcaattgtactgtgattatga

SEQ ID NO: 70252 - DNA, 25 bp, Mus musculus
aagttcaattgttctgtgattatga

SEQ ID NO: 70253 - DNA, 25 bp, Mus musculus
aagttcacaaacatccagggaccag

SEQ ID NO: 70254 - DNA, 25 bp, Mus musculus
aagttcacaaacttccagggaccag

SEQ ID NO: 70255 - DNA, 25 bp, Mus musculus
aagttcacagagctcctcaagacca

SEQ ID NO: 70256 - DNA, 25 bp, Mus musculus
aagttcacagaggtcctcaagacca

SEQ ID NO: 70257 - DNA, 25 bp, Mus musculus
aagttcacaggcacagtgcagccca

SEQ ID NO: 70258 - DNA, 25 bp, Mus musculus
aagttcacaggctcagtgcagccca

SEQ ID NO: 70259 - DNA, 25 bp, Mus musculus
aagttcaccactagagtcctctctc

SEQ ID NO: 70260 - DNA, 25 bp, Mus musculus
aagttcaccacttgagtcctctctc

SEQ ID NO: 70261 - DNA, 25 bp, Mus musculus
aagttcacccagacagcctggtgct

SEQ ID NO: 70262 - DNA, 25 bp, Mus musculus
aagttcacccagtcagcctggtgct

SEQ ID NO: 70263 - DNA, 25 bp, Mus musculus
aagttcaccgtacgtcatttagcag

SEQ ID NO: 70264 - DNA, 25 bp, Mus musculus
aagttcaccgtaggtcatttagcag

SEQ ID NO: 70265 - DNA, 25 bp, Mus musculus
aagttcacctacatggagcaggcgt

SEQ ID NO: 70266 - DNA, 25 bp, Mus musculus
aagttcacctacttggagcaggcgt

SEQ ID NO: 70267 - DNA, 25 bp, Mus musculus
aagttcacctgcacacattgttgga

SEQ ID NO: 70268 - DNA, 25 bp, Mus musculus
aagttcacctgctcacattgttgga

SEQ ID NO: 70269 - DNA, 25 bp, Mus musculus
aagttcacgagtagtcttccagcct

SEQ ID NO: 70270 - DNA, 25 bp, Mus musculus
aagttcacgagttgtcttccagcct

SEQ ID NO: 70271 - DNA, 25 bp, Mus musculus
aagttcacgatgcactgcgcagcgc

SEQ ID NO: 70272 - DNA, 25 bp, Mus musculus
aagttcacgatggactgcgcagcgc

SEQ ID NO: 70273 - DNA, 25 bp, Mus musculus
aagttcacgcacactaacatcacat

SEQ ID NO: 70274 - DNA, 25 bp, Mus musculus
aagttcacgcactctaacatcacat

SEQ ID NO: 70275 - DNA, 25 bp, Mus musculus
aagttcacggcgcccagcagcagca

SEQ ID NO: 70276 - DNA, 25 bp, Mus musculus
aagttcacggcggccagcagcagca

SEQ ID NO: 70277 - DNA, 25 bp, Mus musculus
aagttcacgtctccctgcatagatg

SEQ ID NO: 70278 - DNA, 25 bp, Mus musculus
aagttcacgtctgcctgcatagatg

SEQ ID NO: 70279 - DNA, 25 bp, Mus musculus
aagttcacgtgcactgacacagcac

SEQ ID NO: 70280 - DNA, 25 bp, Mus musculus
aagttcacgtgctctgacacagcac

SEQ ID NO: 70281 - DNA, 25 bp, Mus musculus
aagttcactacccaatccatacaag

SEQ ID NO: 70282 - DNA, 25 bp, Mus musculus
aagttcactaccgaatccatacaag

SEQ ID NO: 70283 - DNA, 25 bp, Mus musculus
aagttcactacgaagccaggctggc

SEQ ID NO: 70284 - DNA, 25 bp, Mus musculus
aagttcactacgtagccaggctggc

SEQ ID NO: 70285 - DNA, 25 bp, Mus musculus
aagttcactgctatttctgatacgc

SEQ ID NO: 70286 - DNA, 25 bp, Mus musculus
aagttcactgctttttctgatacgc

SEQ ID NO: 70287 - DNA, 25 bp, Mus musculus
aagttcactttgctatatttgttgt

SEQ ID NO: 70288 - DNA, 25 bp, Mus musculus
aagttcactttggtatatttgttgt

SEQ ID NO: 70289 - DNA, 25 bp, Mus musculus
aagttcagaaatcgcctcacacttt

SEQ ID NO: 70290 - DNA, 25 bp, Mus musculus
aagttcagaaatggcctcacacttt

SEQ ID NO: 70291 - DNA, 25 bp, Mus musculus
aagttcagaagccttgagccgaaac

SEQ ID NO: 70292 - DNA, 25 bp, Mus musculus
aagttcagaagcgttgagccgaaac

SEQ ID NO: 70293 - DNA, 25 bp, Mus musculus
aagttcagacaaaatcagccccagt

SEQ ID NO: 70294 - DNA, 25 bp, Mus musculus
aagttcagacaatatcagccccagt

SEQ ID NO: 70295 - DNA, 25 bp, Mus musculus
aagttcagacctaccaagaagccat

SEQ ID NO: 70296 - DNA, 25 bp, Mus musculus
aagttcagaccttccaagaagccat

SEQ ID NO: 70297 - DNA, 25 bp, Mus musculus
aagttcagagaccaacgcccagcgc

SEQ ID NO: 70298 - DNA, 25 bp, Mus musculus
aagttcagagacgaacgcccagcgc

SEQ ID NO: 70299 - DNA, 25 bp, Mus musculus
aagttcagagctcagctgtacccag

SEQ ID NO: 70300 - DNA, 25 bp, Mus musculus
aagttcagagctgagctgtacccag

SEQ ID NO: 70301 - DNA, 25 bp, Mus musculus
aagttcagaggtatagtaggttgct

SEQ ID NO: 70302 - DNA, 25 bp, Mus musculus
aagttcagaggtttagtaggttgct

SEQ ID NO: 70303 - DNA, 25 bp, Mus musculus
aagttcagcacacacctgctttctc

SEQ ID NO: 70304 - DNA, 25 bp, Mus musculus
aagttcagcacagacctgctttctc

SEQ ID NO: 70305 - DNA, 25 bp, Mus musculus
aagttcagcactcctatatcatgta

SEQ ID NO: 70306 - DNA, 25 bp, Mus musculus
aagttcagcactgctatatcatgta

SEQ ID NO: 70307 - DNA, 25 bp, Mus musculus
aagttcagccccaggattggaggct

SEQ ID NO: 70308 - DNA, 25 bp, Mus musculus
aagttcagcccctggattggaggct

SEQ ID NO: 70309 - DNA, 25 bp, Mus musculus
aagttcagctaaaccagggctttga

SEQ ID NO: 70310 - DNA, 25 bp, Mus musculus
aagttcagctaatccagggctttga

SEQ ID NO: 70311 - DNA, 25 bp, Mus musculus
aagttcagctcactttgggtctgaa

SEQ ID NO: 70312 - DNA, 25 bp, Mus musculus
aagttcagctcagtttgggtctgaa

SEQ ID NO: 70313 - DNA, 25 bp, Mus musculus
aagttcagctccaggtggacctaac

SEQ ID NO: 70314 - DNA, 25 bp, Mus musculus
aagttcagctcccatcatggtcttc

SEQ ID NO: 70315 - DNA, 25 bp, Mus musculus
aagttcagctccgatcatggtcttc

SEQ ID NO: 70316 - DNA, 25 bp, Mus musculus
aagttcagctcctggtggacctaac

SEQ ID NO: 70317 - DNA, 25 bp, Mus musculus
aagttcagctctcccactaatctgc

SEQ ID NO: 70318 - DNA, 25 bp, Mus musculus
aagttcagctctgccactaatctgc

SEQ ID NO: 70319 - DNA, 25 bp, Mus musculus
aagttcagcttcagttggctcttca

SEQ ID NO: 70320 - DNA, 25 bp, Mus musculus
aagttcagcttctgttggctcttca

SEQ ID NO: 70321 - DNA, 25 bp, Mus musculus
aagttcaggaagatgttctacgtga

SEQ ID NO: 70322 - DNA, 25 bp, Mus musculus
aagttcaggaagttgttctacgtga

SEQ ID NO: 70323 - DNA, 25 bp, Mus musculus
aagttcaggccaacatcttcaaaga

SEQ ID NO: 70324 - DNA, 25 bp, Mus musculus
aagttcaggccatcatcttcaaaga

SEQ ID NO: 70325 - DNA, 25 bp, Mus musculus
aagttcaggcgcacaaggtcgttca

SEQ ID NO: 70326 - DNA, 25 bp, Mus musculus
aagttcaggcgctcaaggtcgttca

SEQ ID NO: 70327 - DNA, 25 bp, Mus musculus
aagttcaggctcaagggctttcagg

SEQ ID NO: 70328 - DNA, 25 bp, Mus musculus
aagttcaggctctagggctttcagg

SEQ ID NO: 70329 - DNA, 25 bp, Mus musculus
aagttcaggttgatcgcggacacta

SEQ ID NO: 70330 - DNA, 25 bp, Mus musculus
aagttcaggttgttcgcggacacta

SEQ ID NO: 70331 - DNA, 25 bp, Mus musculus
aagttcagtgagctttccagcagcc

SEQ ID NO: 70332 - DNA, 25 bp, Mus musculus
aagttcagtgaggtttccagcagcc

SEQ ID NO: 70333 - DNA, 25 bp, Mus musculus
aagttcagtgcgatgaagtacgagc

SEQ ID NO: 70334 - DNA, 25 bp, Mus musculus
aagttcagtgcgttgaagtacgagc

SEQ ID NO: 70335 - DNA, 25 bp, Mus musculus
aagttcagtggcacgctgcggctga

SEQ ID NO: 70336 - DNA, 25 bp, Mus musculus
aagttcagtggctcgctgcggctga

SEQ ID NO: 70337 - DNA, 25 bp, Mus musculus
aagttcagttcaagtccgattggag

SEQ ID NO: 70338 - DNA, 25 bp, Mus musculus
aagttcagttcatgtccgattggag

SEQ ID NO: 70339 - DNA, 25 bp, Mus musculus
aagttcataatcagctagctttgca

SEQ ID NO: 70340 - DNA, 25 bp, Mus musculus
aagttcataatctgctagctttgca

SEQ ID NO: 70341 - DNA, 25 bp, Mus musculus
aagttcataggaaagccatgttggc

SEQ ID NO: 70342 - DNA, 25 bp, Mus musculus
aagttcataggatagccatgttggc

SEQ ID NO: 70343 - DNA, 25 bp, Mus musculus
aagttcatcatcctggatccttcat

SEQ ID NO: 70344 - DNA, 25 bp, Mus musculus
aagttcatcatcgtggatccttcat

SEQ ID NO: 70345 - DNA, 25 bp, Mus musculus
aagttcatccctacagttcttgata

SEQ ID NO: 70346 - DNA, 25 bp, Mus musculus
aagttcatcccttcagttcttgata

SEQ ID NO: 70347 - DNA, 25 bp, Mus musculus
aagttcatccgtcctggagctgagg

SEQ ID NO: 70348 - DNA, 25 bp, Mus musculus
aagttcatccgtgctggagctgagg

SEQ ID NO: 70349 - DNA, 25 bp, Mus musculus
aagttcatcctaccagacggtgcca

SEQ ID NO: 70350 - DNA, 25 bp, Mus musculus
aagttcatcctagcagacggtgcca

SEQ ID NO: 70351 - DNA, 25 bp, Mus musculus
aagttcatcctcctggacaacactg

SEQ ID NO: 70352 - DNA, 25 bp, Mus musculus
aagttcatcctcgtggacaacactg

SEQ ID NO: 70353 - DNA, 25 bp, Mus musculus
aagttcatcctgagactcttgaagt

SEQ ID NO: 70354 - DNA, 25 bp, Mus musculus
aagttcatcctgtgactcttgaagt

SEQ ID NO: 70355 - DNA, 25 bp, Mus musculus
aagttcatctagactgctgctgtgg

SEQ ID NO: 70356 - DNA, 25 bp, Mus musculus
aagttcatctagtctgctgctgtgg

SEQ ID NO: 70357 - DNA, 25 bp, Mus musculus
aagttcatctgcacccatcagagtt

SEQ ID NO: 70358 - DNA, 25 bp, Mus musculus
aagttcatctgctcccatcagagtt

SEQ ID NO: 70359 - DNA, 25 bp, Mus musculus
aagttcatgcttatagttcccagga

SEQ ID NO: 70360 - DNA, 25 bp, Mus musculus
aagttcatgcttttagttcccagga

SEQ ID NO: 70361 - DNA, 25 bp, Mus musculus
aagttcatggccagcctagagtagt

SEQ ID NO: 70362 - DNA, 25 bp, Mus musculus
aagttcatggcctgcctagagtagt

SEQ ID NO: 70363 - DNA, 25 bp, Mus musculus
aagttcatggctcttcactgtcatt

SEQ ID NO: 70364 - DNA, 25 bp, Mus musculus
aagttcatggctgttcactgtcatt

SEQ ID NO: 70365 - DNA, 25 bp, Mus musculus
aagttcatgggtctttgccagcttc

SEQ ID NO: 70366 - DNA, 25 bp, Mus musculus
aagttcatgggtgtttgccagcttc

SEQ ID NO: 70367 - DNA, 25 bp, Mus musculus
aagttcatggtcaacatagtcccaa

SEQ ID NO: 70368 - DNA, 25 bp, Mus musculus
aagttcatggtctacatagtcccaa

SEQ ID NO: 70369 - DNA, 25 bp, Mus musculus
aagttcatgtgtcctggagtggcca

SEQ ID NO: 70370 - DNA, 25 bp, Mus musculus
aagttcatgtgtgctggagtggcca

SEQ ID NO: 70371 - DNA, 25 bp, Mus musculus
aagttcattaacaaatcagcctagg

SEQ ID NO: 70372 - DNA, 25 bp, Mus musculus
aagttcattaacaacctaaaatcag

SEQ ID NO: 70373 - DNA, 25 bp, Mus musculus
aagttcattaactaatcagcctagg

SEQ ID NO: 70374 - DNA, 25 bp, Mus musculus
aagttcattaactacctaaaatcag

SEQ ID NO: 70375 - DNA, 25 bp, Mus musculus
aagttcattactagtaggcaaagat

SEQ ID NO: 70376 - DNA, 25 bp, Mus musculus
aagttcattacttgtaggcaaagat

SEQ ID NO: 70377 - DNA, 25 bp, Mus musculus
aagttcattgagctcttcaggtccg

SEQ ID NO: 70378 - DNA, 25 bp, Mus musculus
aagttcattgaggtcttcaggtccg

SEQ ID NO: 70379 - DNA, 25 bp, Mus musculus
aagttcattgatactcctttcgctc

SEQ ID NO: 70380 - DNA, 25 bp, Mus musculus
aagttcattgattctcctttcgctc

SEQ ID NO: 70381 - DNA, 25 bp, Mus musculus
aagttcattggtcctggggccgcca

SEQ ID NO: 70382 - DNA, 25 bp, Mus musculus
aagttcattggtgctggggccgcca

SEQ ID NO: 70383 - DNA, 25 bp, Mus musculus
aagttcattgtgactacaaattgtt

SEQ ID NO: 70384 - DNA, 25 bp, Mus musculus
aagttcattgtgtctacaaattgtt

SEQ ID NO: 70385 - DNA, 25 bp, Mus musculus
aagttcatttatccttttatccaag

SEQ ID NO: 70386 - DNA, 25 bp, Mus musculus
aagttcatttatgcttttatccaag

SEQ ID NO: 70387 - DNA, 25 bp, Mus musculus
aagttcatttgcagatcagcgatta

SEQ ID NO: 70388 - DNA, 25 bp, Mus musculus
aagttcatttgctgatcagcgatta

SEQ ID NO: 70389 - DNA, 25 bp, Mus musculus
aagttcatttgtatatagcccacag

SEQ ID NO: 70390 - DNA, 25 bp, Mus musculus
aagttcatttgtttatagcccacag

SEQ ID NO: 70391 - DNA, 25 bp, Mus musculus
aagttcattttgctgtcctcttgac

SEQ ID NO: 70392 - DNA, 25 bp, Mus musculus
aagttcattttggtgtcctcttgac

SEQ ID NO: 70393 - DNA, 25 bp, Mus musculus
aagttccaaaggctgtgatctcaga

SEQ ID NO: 70394 - DNA, 25 bp, Mus musculus
aagttccaaagggtgtgatctcaga

SEQ ID NO: 70395 - DNA, 25 bp, Mus musculus
aagttccaagctatatagtcctggc

SEQ ID NO: 70396 - DNA, 25 bp, Mus musculus
aagttccaagctttatagtcctggc

SEQ ID NO: 70397 - DNA, 25 bp, Mus musculus
aagttccaagggatcatggctctgc

SEQ ID NO: 70398 - DNA, 25 bp, Mus musculus
aagttccaagggttcatggctctgc

SEQ ID NO: 70399 - DNA, 25 bp, Mus musculus
aagttccaagttaccatctttgact

SEQ ID NO: 70400 - DNA, 25 bp, Mus musculus
aagttccaagtttccatctttgact

SEQ ID NO: 70401 - DNA, 25 bp, Mus musculus
aagttccaatacagtcaagcctttg

SEQ ID NO: 70402 - DNA, 25 bp, Mus musculus
aagttccaatactgtcaagcctttg

SEQ ID NO: 70403 - DNA, 25 bp, Mus musculus
aagttccacagactgaagcgatcga

SEQ ID NO: 70404 - DNA, 25 bp, Mus musculus
aagttccacagagtgaagcgatcga

SEQ ID NO: 70405 - DNA, 25 bp, Mus musculus
aagttccaccagaccattggcaagc

SEQ ID NO: 70406 - DNA, 25 bp, Mus musculus
aagttccaccagtccattggcaagc

SEQ ID NO: 70407 - DNA, 25 bp, Mus musculus
aagttccaccatccattgacagtga

SEQ ID NO: 70408 - DNA, 25 bp, Mus musculus
aagttccaccatgcattgacagtga

SEQ ID NO: 70409 - DNA, 25 bp, Mus musculus
aagttccacctacctctggactagg

SEQ ID NO: 70410 - DNA, 25 bp, Mus musculus
aagttccacctagctctggactagg

SEQ ID NO: 70411 - DNA, 25 bp, Mus musculus
aagttccacgatccctgcttagata

SEQ ID NO: 70412 - DNA, 25 bp, Mus musculus
aagttccacgatgcctgcttagata

SEQ ID NO: 70413 - DNA, 25 bp, Mus musculus
aagttccactgtccactctggtcag

SEQ ID NO: 70414 - DNA, 25 bp, Mus musculus
aagttccactgtgcactctggtcag

SEQ ID NO: 70415 - DNA, 25 bp, Mus musculus
aagttccactttagccacagtttat

SEQ ID NO: 70416 - DNA, 25 bp, Mus musculus
aagttccacttttgccacagtttat

SEQ ID NO: 70417 - DNA, 25 bp, Mus musculus
aagttccagaggctttcggcaatga

SEQ ID NO: 70418 - DNA, 25 bp, Mus musculus
aagttccagagggtttcggcaatga

SEQ ID NO: 70419 - DNA, 25 bp, Mus musculus
aagttccagcaaatgccacagaagg

SEQ ID NO: 70420 - DNA, 25 bp, Mus musculus
aagttccagcaattgccacagaagg

SEQ ID NO: 70421 - DNA, 25 bp, Mus musculus
aagttccagcagaacgcccagagcc

SEQ ID NO: 70422 - DNA, 25 bp, Mus musculus
aagttccagcagtacgcccagagcc

SEQ ID NO: 70423 - DNA, 25 bp, Mus musculus
aagttccagggtagcaagtgcttgg

SEQ ID NO: 70424 - DNA, 25 bp, Mus musculus
aagttccagggttgcaagtgcttgg

SEQ ID NO: 70425 - DNA, 25 bp, Mus musculus
aagttccaggtcactgaaaagccct

SEQ ID NO: 70426 - DNA, 25 bp, Mus musculus
aagttccaggtcattgccattgaag

SEQ ID NO: 70427 - DNA, 25 bp, Mus musculus
aagttccaggtctctgaaaagccct

SEQ ID NO: 70428 - DNA, 25 bp, Mus musculus
aagttccaggtctttgccattgaag

SEQ ID NO: 70429 - DNA, 25 bp, Mus musculus
aagttccaggtgaccactgaagtcc

SEQ ID NO: 70430 - DNA, 25 bp, Mus musculus
aagttccaggtgtccactgaagtcc

SEQ ID NO: 70431 - DNA, 25 bp, Mus musculus
aagttccagtggcttcagaaatcat

SEQ ID NO: 70432 - DNA, 25 bp, Mus musculus
aagttccagtgggttcagaaatcat

SEQ ID NO: 70433 - DNA, 25 bp, Mus musculus
aagttccagttgctcatgtccagga

SEQ ID NO: 70434 - DNA, 25 bp, Mus musculus
aagttccagttggtcatgtccagga

SEQ ID NO: 70435 - DNA, 25 bp, Mus musculus
aagttccatcaaatgcctagcaaag

SEQ ID NO: 70436 - DNA, 25 bp, Mus musculus
aagttccatcaattgcctagcaaag

SEQ ID NO: 70437 - DNA, 25 bp, Mus musculus
aagttccatcccaagtagcacatat

SEQ ID NO: 70438 - DNA, 25 bp, Mus musculus
aagttccatccctagtagcacatat

SEQ ID NO: 70439 - DNA, 25 bp, Mus musculus
aagttccatcttcgcgtggcctctg

SEQ ID NO: 70440 - DNA, 25 bp, Mus musculus
aagttccatcttggcgtggcctctg

SEQ ID NO: 70441 - DNA, 25 bp, Mus musculus
aagttccattttatcctgtatcagt

SEQ ID NO: 70442 - DNA, 25 bp, Mus musculus
aagttccattttttcctgtatcagt

SEQ ID NO: 70443 - DNA, 25 bp, Mus musculus
aagttcccaaatcagtcttagctcc

SEQ ID NO: 70444 - DNA, 25 bp, Mus musculus
aagttcccaaatgagtcttagctcc

SEQ ID NO: 70445 - DNA, 25 bp, Mus musculus
aagttcccaggcaacaaaagagatg

SEQ ID NO: 70446 - DNA, 25 bp, Mus musculus
aagttcccaggctacaaaagagatg

SEQ ID NO: 70447 - DNA, 25 bp, Mus musculus
aagttcccagtcactagaggctctg

SEQ ID NO: 70448 - DNA, 25 bp, Mus musculus
aagttcccagtctctagaggctctg

SEQ ID NO: 70449 - DNA, 25 bp, Mus musculus
aagttcccatttacttgtttgcctg

SEQ ID NO: 70450 - DNA, 25 bp, Mus musculus
aagttcccattttcttgtttgcctg

SEQ ID NO: 70451 - DNA, 25 bp, Mus musculus
aagttccccagaccataagctaaat

SEQ ID NO: 70452 - DNA, 25 bp, Mus musculus
aagttccccagagcataagctaaat

SEQ ID NO: 70453 - DNA, 25 bp, Mus musculus
aagttccccggcatgtggatgactc

SEQ ID NO: 70454 - DNA, 25 bp, Mus musculus
aagttccccggcttgtggatgactc

SEQ ID NO: 70455 - DNA, 25 bp, Mus musculus
aagttcccctatagcttccttatat

SEQ ID NO: 70456 - DNA, 25 bp, Mus musculus
aagttcccctattgcttccttatat

SEQ ID NO: 70457 - DNA, 25 bp, Mus musculus
aagttcccctggcactgaatatgta

SEQ ID NO: 70458 - DNA, 25 bp, Mus musculus
aagttcccctgggactgaatatgta

SEQ ID NO: 70459 - DNA, 25 bp, Mus musculus
aagttccccttgatcactgcggtgt

SEQ ID NO: 70460 - DNA, 25 bp, Mus musculus
aagttccccttgttcactgcggtgt

SEQ ID NO: 70461 - DNA, 25 bp, Mus musculus
aagttccctacaattgcctgcaaat

SEQ ID NO: 70462 - DNA, 25 bp, Mus musculus
aagttccctacatttgcctgcaaat

SEQ ID NO: 70463 - DNA, 25 bp, Mus musculus
aagttccctcctatgacacaggtgt

SEQ ID NO: 70464 - DNA, 25 bp, Mus musculus
aagttccctcctttgacacaggtgt

SEQ ID NO: 70465 - DNA, 25 bp, Mus musculus
aagttccctggaatgtaccggacag

SEQ ID NO: 70466 - DNA, 25 bp, Mus musculus
aagttccctggattgtaccggacag

SEQ ID NO: 70467 - DNA, 25 bp, Mus musculus
aagttcccttaaaggtggcgatgtc

SEQ ID NO: 70468 - DNA, 25 bp, Mus musculus
aagttcccttaatggtggcgatgtc

SEQ ID NO: 70469 - DNA, 25 bp, Mus musculus
aagttcccttgcacctgaatcagta

SEQ ID NO: 70470 - DNA, 25 bp, Mus musculus
aagttcccttgctcctgaatcagta

SEQ ID NO: 70471 - DNA, 25 bp, Mus musculus
aagttccgaaggaatctctccatat

SEQ ID NO: 70472 - DNA, 25 bp, Mus musculus
aagttccgaaggtatctctccatat

SEQ ID NO: 70473 - DNA, 25 bp, Mus musculus
aagttccgcaggctgctgagctctc

SEQ ID NO: 70474 - DNA, 25 bp, Mus musculus
aagttccgcagggtgctgagctctc

SEQ ID NO: 70475 - DNA, 25 bp, Mus musculus
aagttccggatcaacctgaccttgt

SEQ ID NO: 70476 - DNA, 25 bp, Mus musculus
aagttccggatctacctgaccttgt

SEQ ID NO: 70477 - DNA, 25 bp, Mus musculus
aagttccgtgtaactggcactcatg

SEQ ID NO: 70478 - DNA, 25 bp, Mus musculus
aagttccgtgtatctggcactcatg

SEQ ID NO: 70479 - DNA, 25 bp, Mus musculus
aagttcctaattctcctgttcttgc

SEQ ID NO: 70480 - DNA, 25 bp, Mus musculus
aagttcctaattgtcctgttcttgc

SEQ ID NO: 70481 - DNA, 25 bp, Mus musculus
aagttcctaccacacatcagacctt

SEQ ID NO: 70482 - DNA, 25 bp, Mus musculus
aagttcctaccagacatcagacctt

SEQ ID NO: 70483 - DNA, 25 bp, Mus musculus
aagttcctaccccagatacaggcac

SEQ ID NO: 70484 - DNA, 25 bp, Mus musculus
aagttcctacccgagatacaggcac

SEQ ID NO: 70485 - DNA, 25 bp, Mus musculus
aagttcctaggccaatatacattca

SEQ ID NO: 70486 - DNA, 25 bp, Mus musculus
aagttcctaggcgaatatacattca

SEQ ID NO: 70487 - DNA, 25 bp, Mus musculus
aagttcctagggaatgcaccctgtg

SEQ ID NO: 70488 - DNA, 25 bp, Mus musculus
aagttcctagggtatgcaccctgtg

SEQ ID NO: 70489 - DNA, 25 bp, Mus musculus
aagttcctatctatgctcccaatct

SEQ ID NO: 70490 - DNA, 25 bp, Mus musculus
aagttcctatctttgctcccaatct

SEQ ID NO: 70491 - DNA, 25 bp, Mus musculus
aagttcctccttcctcatgggtcct

SEQ ID NO: 70492 - DNA, 25 bp, Mus musculus
aagttcctccttgctcatgggtcct

SEQ ID NO: 70493 - DNA, 25 bp, Mus musculus
aagttcctgaacctcattcaccatg

SEQ ID NO: 70494 - DNA, 25 bp, Mus musculus
aagttcctgaacgtcattcaccatg

SEQ ID NO: 70495 - DNA, 25 bp, Mus musculus
aagttcctgaagactggcgatgctg

SEQ ID NO: 70496 - DNA, 25 bp, Mus musculus
aagttcctgaagtctggcgatgctg

SEQ ID NO: 70497 - DNA, 25 bp, Mus musculus
aagttcctgacaccagtgagacgct

SEQ ID NO: 70498 - DNA, 25 bp, Mus musculus
aagttcctgacagcagtgagacgct

SEQ ID NO: 70499 - DNA, 25 bp, Mus musculus
aagttcctgcccagcttaattaagt

SEQ ID NO: 70500 - DNA, 25 bp, Mus musculus
aagttcctgccctgcttaattaagt

SEQ ID NO: 70501 - DNA, 25 bp, Mus musculus
aagttcctggacagcggaggtcacc

SEQ ID NO: 70502 - DNA, 25 bp, Mus musculus
aagttcctggactgcggaggtcacc

SEQ ID NO: 70503 - DNA, 25 bp, Mus musculus
aagttcctggccaggtgcacacggt

SEQ ID NO: 70504 - DNA, 25 bp, Mus musculus
aagttcctggcctggtgcacacggt

SEQ ID NO: 70505 - DNA, 25 bp, Mus musculus
aagttcctggttagtagatttctag

SEQ ID NO: 70506 - DNA, 25 bp, Mus musculus
aagttcctggtttgtagatttctag

SEQ ID NO: 70507 - DNA, 25 bp, Mus musculus
aagttcctgtctcagactcttacag

SEQ ID NO: 70508 - DNA, 25 bp, Mus musculus
aagttcctgtctgagactcttacag

SEQ ID NO: 70509 - DNA, 25 bp, Mus musculus
aagttcctgttgctccttcaaatgg

SEQ ID NO: 70510 - DNA, 25 bp, Mus musculus
aagttcctgttggtccttcaaatgg

SEQ ID NO: 70511 - DNA, 25 bp, Mus musculus
aagttccttcagatgaacagttctt

SEQ ID NO: 70512 - DNA, 25 bp, Mus musculus
aagttccttcagttgaacagttctt

SEQ ID NO: 70513 - DNA, 25 bp, Mus musculus
aagttccttggacttatgctccatg

SEQ ID NO: 70514 - DNA, 25 bp, Mus musculus
aagttccttggagttatgctccatg

SEQ ID NO: 70515 - DNA, 25 bp, Mus musculus
aagttcgaccatccattggttccag

SEQ ID NO: 70516 - DNA, 25 bp, Mus musculus
aagttcgaccatgcattggttccag

SEQ ID NO: 70517 - DNA, 25 bp, Mus musculus
aagttcgatcttctatgtgtcgcca

SEQ ID NO: 70518 - DNA, 25 bp, Mus musculus
aagttcgatcttgtatgtgtcgcca

SEQ ID NO: 70519 - DNA, 25 bp, Mus musculus
aagttcgatgctctggattctggct

SEQ ID NO: 70520 - DNA, 25 bp, Mus musculus
aagttcgatgctgtggattctggct

SEQ ID NO: 70521 - DNA, 25 bp, Mus musculus
aagttcgatgtcaggcggttcactc

SEQ ID NO: 70522 - DNA, 25 bp, Mus musculus
aagttcgatgtctggcggttcactc

SEQ ID NO: 70523 - DNA, 25 bp, Mus musculus
aagttcgcagggacgtcacgtccgc

SEQ ID NO: 70524 - DNA, 25 bp, Mus musculus
aagttcgcagggtcgtcacgtccgc

SEQ ID NO: 70525 - DNA, 25 bp, Mus musculus
aagttcgccaagctcatcgtggaga

SEQ ID NO: 70526 - DNA, 25 bp, Mus musculus
aagttcgccaaggtcatcgtggaga

SEQ ID NO: 70527 - DNA, 25 bp, Mus musculus
aagttcgcccgcctctctcagatgg

SEQ ID NO: 70528 - DNA, 25 bp, Mus musculus
aagttcgcccgcgtctctcagatgg

SEQ ID NO: 70529 - DNA, 25 bp, Mus musculus
aagttcgcgcgcactgacgagctta

SEQ ID NO: 70530 - DNA, 25 bp, Mus musculus
aagttcgcgcgctctgacgagctta

SEQ ID NO: 70531 - DNA, 25 bp, Mus musculus
aagttcgctgctctcatgtgtctga

SEQ ID NO: 70532 - DNA, 25 bp, Mus musculus
aagttcgctgctgtcatgtgtctga

SEQ ID NO: 70533 - DNA, 25 bp, Mus musculus
aagttcggatgcctgtagtttctga

SEQ ID NO: 70534 - DNA, 25 bp, Mus musculus
aagttcggatgcgtgtagtttctga

SEQ ID NO: 70535 - DNA, 25 bp, Mus musculus
aagttcggccggaactccgctctga

SEQ ID NO: 70536 - DNA, 25 bp, Mus musculus
aagttcggccggtactccgctctga

SEQ ID NO: 70537 - DNA, 25 bp, Mus musculus
aagttcgggaacacccaccatgaat

SEQ ID NO: 70538 - DNA, 25 bp, Mus musculus
aagttcgggaactcccaccatgaat

SEQ ID NO: 70539 - DNA, 25 bp, Mus musculus
aagttcgggagtctggtgcaccctc

SEQ ID NO: 70540 - DNA, 25 bp, Mus musculus
aagttcgggagtgtggtgcaccctc

SEQ ID NO: 70541 - DNA, 25 bp, Mus musculus
aagttcgggattcgctggcctccac

SEQ ID NO: 70542 - DNA, 25 bp, Mus musculus
aagttcgggattggctggcctccac

SEQ ID NO: 70543 - DNA, 25 bp, Mus musculus
aagttcggtgtccttgaccgatcct

SEQ ID NO: 70544 - DNA, 25 bp, Mus musculus
aagttcggtgtcgttgaccgatcct

SEQ ID NO: 70545 - DNA, 25 bp, Mus musculus
aagttcggtttcaagtgtagggcag

SEQ ID NO: 70546 - DNA, 25 bp, Mus musculus
aagttcggtttctagtgtagggcag

SEQ ID NO: 70547 - DNA, 25 bp, Mus musculus
aagttcgtgcagaactgtccaggca

SEQ ID NO: 70548 - DNA, 25 bp, Mus musculus
aagttcgtgcagtactgtccaggca

SEQ ID NO: 70549 - DNA, 25 bp, Mus musculus
aagttcgtgcggctgcgcaacaagt

SEQ ID NO: 70550 - DNA, 25 bp, Mus musculus
aagttcgtgcgggtgcgcaacaagt

SEQ ID NO: 70551 - DNA, 25 bp, Mus musculus
aagttctaaactcacgtgtccagcg

SEQ ID NO: 70552 - DNA, 25 bp, Mus musculus
aagttctaaactgacgtgtccagcg

SEQ ID NO: 70553 - DNA, 25 bp, Mus musculus
aagttctaaataacagacgtctctg

SEQ ID NO: 70554 - DNA, 25 bp, Mus musculus
aagttctaaatatcagacgtctctg

SEQ ID NO: 70555 - DNA, 25 bp, Mus musculus
aagttctaacataaatcggtctcaa

SEQ ID NO: 70556 - DNA, 25 bp, Mus musculus
aagttctaacattaatcggtctcaa

SEQ ID NO: 70557 - DNA, 25 bp, Mus musculus
aagttctaagacacgggctgggcat

SEQ ID NO: 70558 - DNA, 25 bp, Mus musculus
aagttctaagactcgggctgggcat

SEQ ID NO: 70559 - DNA, 25 bp, Mus musculus
aagttctaagtcatggcttaagaga

SEQ ID NO: 70560 - DNA, 25 bp, Mus musculus
aagttctaagtcttggcttaagaga

SEQ ID NO: 70561 - DNA, 25 bp, Mus musculus
aagttctaatctacctatcttgacc

SEQ ID NO: 70562 - DNA, 25 bp, Mus musculus
aagttctaatcttcctatcttgacc

SEQ ID NO: 70563 - DNA, 25 bp, Mus musculus
aagttctaccacaaccatggcctgt

SEQ ID NO: 70564 - DNA, 25 bp, Mus musculus
aagttctaccactaccatggcctgt

SEQ ID NO: 70565 - DNA, 25 bp, Mus musculus
aagttctaccataagccaccggcag

SEQ ID NO: 70566 - DNA, 25 bp, Mus musculus
aagttctaccattagccaccggcag

SEQ ID NO: 70567 - DNA, 25 bp, Mus musculus
aagttctacgacagcaactcagaat

SEQ ID NO: 70568 - DNA, 25 bp, Mus musculus
aagttctacgactgcaactcagaat

SEQ ID NO: 70569 - DNA, 25 bp, Mus musculus
aagttctactccactcaacgatttg

SEQ ID NO: 70570 - DNA, 25 bp, Mus musculus
aagttctactcctctcaacgatttg

SEQ ID NO: 70571 - DNA, 25 bp, Mus musculus
aagttctactgcaacattccgggac

SEQ ID NO: 70572 - DNA, 25 bp, Mus musculus
aagttctactgcacctatcttggga

SEQ ID NO: 70573 - DNA, 25 bp, Mus musculus
aagttctactgctacattccgggac

SEQ ID NO: 70574 - DNA, 25 bp, Mus musculus
aagttctactgctcctatcttggga

SEQ ID NO: 70575 - DNA, 25 bp, Mus musculus
aagttctacttcagtggcgccaaca

SEQ ID NO: 70576 - DNA, 25 bp, Mus musculus
aagttctacttctgtggcgccaaca

SEQ ID NO: 70577 - DNA, 25 bp, Mus musculus
aagttctagagtctctgggacccca

SEQ ID NO: 70578 - DNA, 25 bp, Mus musculus
aagttctagagtgtctgggacccca

SEQ ID NO: 70579 - DNA, 25 bp, Mus musculus
aagttctagcttaagtgttggcact

SEQ ID NO: 70580 - DNA, 25 bp, Mus musculus
aagttctagctttagtgttggcact

SEQ ID NO: 70581 - DNA, 25 bp, Mus musculus
aagttctaggagacccctgctataa

SEQ ID NO: 70582 - DNA, 25 bp, Mus musculus
aagttctaggagtcccctgctataa

SEQ ID NO: 70583 - DNA, 25 bp, Mus musculus
aagttctaggcacccagtgagctac

SEQ ID NO: 70584 - DNA, 25 bp, Mus musculus
aagttctaggcagccagtgagctac

SEQ ID NO: 70585 - DNA, 25 bp, Mus musculus
aagttctagtccagctatgtccacc

SEQ ID NO: 70586 - DNA, 25 bp, Mus musculus
aagttctagtcctgctatgtccacc

SEQ ID NO: 70587 - DNA, 25 bp, Mus musculus
aagttctatcaacctggagcagtca

SEQ ID NO: 70588 - DNA, 25 bp, Mus musculus
aagttctatcaagctggagcagtca

SEQ ID NO: 70589 - DNA, 25 bp, Mus musculus
aagttctatcagctctttctagagg

SEQ ID NO: 70590 - DNA, 25 bp, Mus musculus
aagttctatcaggtctttctagagg

SEQ ID NO: 70591 - DNA, 25 bp, Mus musculus
aagttctatcttaataatgctatct

SEQ ID NO: 70592 - DNA, 25 bp, Mus musculus
aagttctatctttataatgctatct

SEQ ID NO: 70593 - DNA, 25 bp, Mus musculus
aagttctcaaccatgcttgtgcatt

SEQ ID NO: 70594 - DNA, 25 bp, Mus musculus
aagttctcaaccttgcttgtgcatt

SEQ ID NO: 70595 - DNA, 25 bp, Mus musculus
aagttctcacaacggataagcgtct

SEQ ID NO: 70596 - DNA, 25 bp, Mus musculus
aagttctcacaagggataagcgtct

SEQ ID NO: 70597 - DNA, 25 bp, Mus musculus
aagttctcacttctggctttcctag

SEQ ID NO: 70598 - DNA, 25 bp, Mus musculus
aagttctcacttgtggctttcctag

SEQ ID NO: 70599 - DNA, 25 bp, Mus musculus
aagttctcagaacggacgcaggact

SEQ ID NO: 70600 - DNA, 25 bp, Mus musculus
aagttctcagaagggacgcaggact

SEQ ID NO: 70601 - DNA, 25 bp, Mus musculus
aagttctcagctactcgctttcagt

SEQ ID NO: 70602 - DNA, 25 bp, Mus musculus
aagttctcagcttctcgctttcagt

SEQ ID NO: 70603 - DNA, 25 bp, Mus musculus
aagttctcatgtccttaccaccttt

SEQ ID NO: 70604 - DNA, 25 bp, Mus musculus
aagttctcatgtgcttaccaccttt

SEQ ID NO: 70605 - DNA, 25 bp, Mus musculus
aagttctcatttcgttctacacatg

SEQ ID NO: 70606 - DNA, 25 bp, Mus musculus
aagttctcatttggttctacacatg

SEQ ID NO: 70607 - DNA, 25 bp, Mus musculus
aagttctccaacagtccacttttgg

SEQ ID NO: 70608 - DNA, 25 bp, Mus musculus
aagttctccaactgtccacttttgg

SEQ ID NO: 70609 - DNA, 25 bp, Mus musculus
aagttctccagcatctaggaccgac

SEQ ID NO: 70610 - DNA, 25 bp, Mus musculus
aagttctccagcttctaggaccgac

SEQ ID NO: 70611 - DNA, 25 bp, Mus musculus
aagttctccatgctgccagaatcat

SEQ ID NO: 70612 - DNA, 25 bp, Mus musculus
aagttctccatggtgccagaatcat

SEQ ID NO: 70613 - DNA, 25 bp, Mus musculus
aagttctcccatagaggactcttgc

SEQ ID NO: 70614 - DNA, 25 bp, Mus musculus
aagttctcccatcgccacaaaggat

SEQ ID NO: 70615 - DNA, 25 bp, Mus musculus
aagttctcccatggccacaaaggat

SEQ ID NO: 70616 - DNA, 25 bp, Mus musculus
aagttctcccattgaggactcttgc

SEQ ID NO: 70617 - DNA, 25 bp, Mus musculus
aagttctccccaaatggcaagtggt

SEQ ID NO: 70618 - DNA, 25 bp, Mus musculus
aagttctccccatatggcaagtggt

SEQ ID NO: 70619 - DNA, 25 bp, Mus musculus
aagttctccggcctggatcaatgcg

SEQ ID NO: 70620 - DNA, 25 bp, Mus musculus
aagttctccggcgtggatcaatgcg

SEQ ID NO: 70621 - DNA, 25 bp, Mus musculus
aagttctcctcaagttctgggtcta

SEQ ID NO: 70622 - DNA, 25 bp, Mus musculus
aagttctcctcatgttctgggtcta

SEQ ID NO: 70623 - DNA, 25 bp, Mus musculus
aagttctccttacacagcgaccaac

SEQ ID NO: 70624 - DNA, 25 bp, Mus musculus
aagttctccttagacagcgaccaac

SEQ ID NO: 70625 - DNA, 25 bp, Mus musculus
aagttctcgctcaacttcttagctt

SEQ ID NO: 70626 - DNA, 25 bp, Mus musculus
aagttctcgctctacttcttagctt

SEQ ID NO: 70627 - DNA, 25 bp, Mus musculus
aagttctcggagctgctcaagcggc

SEQ ID NO: 70628 - DNA, 25 bp, Mus musculus
aagttctcggaggtgctcaagcggc

SEQ ID NO: 70629 - DNA, 25 bp, Mus musculus
aagttctctgccctctttgtgattt

SEQ ID NO: 70630 - DNA, 25 bp, Mus musculus
aagttctctgccgtctttgtgattt

SEQ ID NO: 70631 - DNA, 25 bp, Mus musculus
aagttctctggacattggtgagtga

SEQ ID NO: 70632 - DNA, 25 bp, Mus musculus
aagttctctggagattggtgagtga

SEQ ID NO: 70633 - DNA, 25 bp, Mus musculus
aagttctctgtcatggtcttaagga

SEQ ID NO: 70634 - DNA, 25 bp, Mus musculus
aagttctctgtccttcctgaagtgt

SEQ ID NO: 70635 - DNA, 25 bp, Mus musculus
aagttctctgtcgttcctgaagtgt

SEQ ID NO: 70636 - DNA, 25 bp, Mus musculus
aagttctctgtcttggtcttaagga

SEQ ID NO: 70637 - DNA, 25 bp, Mus musculus
aagttctcttagagaccctggactc

SEQ ID NO: 70638 - DNA, 25 bp, Mus musculus
aagttctcttagtgaccctggactc

SEQ ID NO: 70639 - DNA, 25 bp, Mus musculus
aagttctctttgatcctaatcaccc

SEQ ID NO: 70640 - DNA, 25 bp, Mus musculus
aagttctctttgttcctaatcaccc

SEQ ID NO: 70641 - DNA, 25 bp, Mus musculus
aagttctgaataccctgtgatctat

SEQ ID NO: 70642 - DNA, 25 bp, Mus musculus
aagttctgaatagcctgtgatctat

SEQ ID NO: 70643 - DNA, 25 bp, Mus musculus
aagttctgaattatctcttcccaca

SEQ ID NO: 70644 - DNA, 25 bp, Mus musculus
aagttctgaattttctcttcccaca

SEQ ID NO: 70645 - DNA, 25 bp, Mus musculus
aagttctgacataccagtgttttaa

SEQ ID NO: 70646 - DNA, 25 bp, Mus musculus
aagttctgacatcgctctgtatctg

SEQ ID NO: 70647 - DNA, 25 bp, Mus musculus
aagttctgacatggctctgtatctg

SEQ ID NO: 70648 - DNA, 25 bp, Mus musculus
aagttctgacattccagtgttttaa

SEQ ID NO: 70649 - DNA, 25 bp, Mus musculus
aagttctgatgacattgtggctgta

SEQ ID NO: 70650 - DNA, 25 bp, Mus musculus
aagttctgatgagattgtggctgta

SEQ ID NO: 70651 - DNA, 25 bp, Mus musculus
aagttctgatttcctcactctatcc

SEQ ID NO: 70652 - DNA, 25 bp, Mus musculus
aagttctgatttgctcactctatcc

SEQ ID NO: 70653 - DNA, 25 bp, Mus musculus
aagttctgcaaaaaggtctctcatt

SEQ ID NO: 70654 - DNA, 25 bp, Mus musculus
aagttctgcaaataggtctctcatt

SEQ ID NO: 70655 - DNA, 25 bp, Mus musculus
aagttctgcattacccaggttggct

SEQ ID NO: 70656 - DNA, 25 bp, Mus musculus
aagttctgcatttcccaggttggct

SEQ ID NO: 70657 - DNA, 25 bp, Mus musculus
aagttctgccaacccatagatgcca

SEQ ID NO: 70658 - DNA, 25 bp, Mus musculus
aagttctgccaagccatagatgcca

SEQ ID NO: 70659 - DNA, 25 bp, Mus musculus
aagttctgcccaatatggttcgatc

SEQ ID NO: 70660 - DNA, 25 bp, Mus musculus
aagttctgcccattatggttcgatc

SEQ ID NO: 70661 - DNA, 25 bp, Mus musculus
aagttctgccgtccccgctgaaagg

SEQ ID NO: 70662 - DNA, 25 bp, Mus musculus
aagttctgccgtgcccgctgaaagg

SEQ ID NO: 70663 - DNA, 25 bp, Mus musculus
aagttctgctaaatcaggcatgcat

SEQ ID NO: 70664 - DNA, 25 bp, Mus musculus
aagttctgctaacactcaccttcca

SEQ ID NO: 70665 - DNA, 25 bp, Mus musculus
aagttctgctaagactcaccttcca

SEQ ID NO: 70666 - DNA, 25 bp, Mus musculus
aagttctgctaattcaggcatgcat

SEQ ID NO: 70667 - DNA, 25 bp, Mus musculus
aagttctgctgcacgaagattcctc

SEQ ID NO: 70668 - DNA, 25 bp, Mus musculus
aagttctgctgctcgaagattcctc

SEQ ID NO: 70669 - DNA, 25 bp, Mus musculus
aagttctgctggaaacagttctggc

SEQ ID NO: 70670 - DNA, 25 bp, Mus musculus
aagttctgctggtaacagttctggc

SEQ ID NO: 70671 - DNA, 25 bp, Mus musculus
aagttctgctgtcctattacatact

SEQ ID NO: 70672 - DNA, 25 bp, Mus musculus
aagttctgctgtgctattacatact

SEQ ID NO: 70673 - DNA, 25 bp, Mus musculus
aagttctggagaagtgttcacctca

SEQ ID NO: 70674 - DNA, 25 bp, Mus musculus
aagttctggagatgtgttcacctca

SEQ ID NO: 70675 - DNA, 25 bp, Mus musculus
aagttctggagcatacggcggctac

SEQ ID NO: 70676 - DNA, 25 bp, Mus musculus
aagttctggagcttacggcggctac

SEQ ID NO: 70677 - DNA, 25 bp, Mus musculus
aagttctggatcagtcagcccgggc

SEQ ID NO: 70678 - DNA, 25 bp, Mus musculus
aagttctggatctgtcagcccgggc

SEQ ID NO: 70679 - DNA, 25 bp, Mus musculus
aagttctgggaccagagcctcccaa

SEQ ID NO: 70680 - DNA, 25 bp, Mus musculus
aagttctgggacgagagcctcccaa

SEQ ID NO: 70681 - DNA, 25 bp, Mus musculus
aagttctgggagaagcctgctggcc

SEQ ID NO: 70682 - DNA, 25 bp, Mus musculus
aagttctgggagtagcctgctggcc

SEQ ID NO: 70683 - DNA, 25 bp, Mus musculus
aagttctgtacaccagccaggttct

SEQ ID NO: 70684 - DNA, 25 bp, Mus musculus
aagttctgtacagcagccaggttct

SEQ ID NO: 70685 - DNA, 25 bp, Mus musculus
aagttctgtcccaagcatcacagaa

SEQ ID NO: 70686 - DNA, 25 bp, Mus musculus
aagttctgtccctagcatcacagaa

SEQ ID NO: 70687 - DNA, 25 bp, Mus musculus
aagttctgtctaaagtcttcactgc

SEQ ID NO: 70688 - DNA, 25 bp, Mus musculus
aagttctgtctatagtcttcactgc

SEQ ID NO: 70689 - DNA, 25 bp, Mus musculus
aagttctgtggcctggtgtgtccca

SEQ ID NO: 70690 - DNA, 25 bp, Mus musculus
aagttctgtggcgtggtgtgtccca

SEQ ID NO: 70691 - DNA, 25 bp, Mus musculus
aagttctgttcccatgggctgcatt

SEQ ID NO: 70692 - DNA, 25 bp, Mus musculus
aagttctgttccgatgggctgcatt

SEQ ID NO: 70693 - DNA, 25 bp, Mus musculus
aagttctgttgtatgatctatggca

SEQ ID NO: 70694 - DNA, 25 bp, Mus musculus
aagttctgttgtttgatctatggca

SEQ ID NO: 70695 - DNA, 25 bp, Mus musculus
aagttctgtttaatccgtagctcca

SEQ ID NO: 70696 - DNA, 25 bp, Mus musculus
aagttctgtttattccgtagctcca

SEQ ID NO: 70697 - DNA, 25 bp, Mus musculus
aagttctgttttctagcctaggcta

SEQ ID NO: 70698 - DNA, 25 bp, Mus musculus
aagttctgttttgtagcctaggcta

SEQ ID NO: 70699 - DNA, 25 bp, Mus musculus
aagttcttaactacccaagctgcag

SEQ ID NO: 70700 - DNA, 25 bp, Mus musculus
aagttcttaacttcccaagctgcag

SEQ ID NO: 70701 - DNA, 25 bp, Mus musculus
aagttcttacatactggaatccaga

SEQ ID NO: 70702 - DNA, 25 bp, Mus musculus
aagttcttacattctggaatccaga

SEQ ID NO: 70703 - DNA, 25 bp, Mus musculus
aagttcttacgcaatgaccgttctc

SEQ ID NO: 70704 - DNA, 25 bp, Mus musculus
aagttcttacgctatgaccgttctc

SEQ ID NO: 70705 - DNA, 25 bp, Mus musculus
aagttcttagcacaagtgttttaca

SEQ ID NO: 70706 - DNA, 25 bp, Mus musculus
aagttcttagcagaagtgttttaca

SEQ ID NO: 70707 - DNA, 25 bp, Mus musculus
aagttcttagccactgtagctctta

SEQ ID NO: 70708 - DNA, 25 bp, Mus musculus
aagttcttagcctctgtagctctta

SEQ ID NO: 70709 - DNA, 25 bp, Mus musculus
aagttcttagtaatgaatgccttca

SEQ ID NO: 70710 - DNA, 25 bp, Mus musculus
aagttcttagtattgaatgccttca

SEQ ID NO: 70711 - DNA, 25 bp, Mus musculus
aagttcttagttatcagctctccaa

SEQ ID NO: 70712 - DNA, 25 bp, Mus musculus
aagttcttagttttcagctctccaa

SEQ ID NO: 70713 - DNA, 25 bp, Mus musculus
aagttcttccagatggtgggcctga

SEQ ID NO: 70714 - DNA, 25 bp, Mus musculus
aagttcttccagttggtgggcctga

SEQ ID NO: 70715 - DNA, 25 bp, Mus musculus
aagttcttcctcaatttggagctga

SEQ ID NO: 70716 - DNA, 25 bp, Mus musculus
aagttcttcctctatttggagctga

SEQ ID NO: 70717 - DNA, 25 bp, Mus musculus
aagttcttcgagcaagccttccagc

SEQ ID NO: 70718 - DNA, 25 bp, Mus musculus
aagttcttcgaggaagccttccagc

SEQ ID NO: 70719 - DNA, 25 bp, Mus musculus
aagttcttcgccagcatcaagagaa

SEQ ID NO: 70720 - DNA, 25 bp, Mus musculus
aagttcttcgcctgcatcaagagaa

SEQ ID NO: 70721 - DNA, 25 bp, Mus musculus
aagttcttctacatcaagctcaaag

SEQ ID NO: 70722 - DNA, 25 bp, Mus musculus
aagttcttctacttcaagctcaaag

SEQ ID NO: 70723 - DNA, 25 bp, Mus musculus
aagttcttgaaaacgatttaccctg

SEQ ID NO: 70724 - DNA, 25 bp, Mus musculus
aagttcttgaaatcgatttaccctg

SEQ ID NO: 70725 - DNA, 25 bp, Mus musculus
aagttcttgaaccttgcttgtctcg

SEQ ID NO: 70726 - DNA, 25 bp, Mus musculus
aagttcttgaacgttgcttgtctcg

SEQ ID NO: 70727 - DNA, 25 bp, Mus musculus
aagttcttgagaaccgcttgtgtct

SEQ ID NO: 70728 - DNA, 25 bp, Mus musculus
aagttcttgagatccgcttgtgtct

SEQ ID NO: 70729 - DNA, 25 bp, Mus musculus
aagttcttggtgcaggtcagcttcc

SEQ ID NO: 70730 - DNA, 25 bp, Mus musculus
aagttcttggtggaggtcagcttcc

SEQ ID NO: 70731 - DNA, 25 bp, Mus musculus
aagttctttatactcaggcatagta

SEQ ID NO: 70732 - DNA, 25 bp, Mus musculus
aagttctttatagtcaggcatagta

SEQ ID NO: 70733 - DNA, 25 bp, Mus musculus
aagttctttgcaaatgaaacgagtg

SEQ ID NO: 70734 - DNA, 25 bp, Mus musculus
aagttctttgcatatgaaacgagtg

SEQ ID NO: 70735 - DNA, 25 bp, Mus musculus
aagttctttgtactatgtcagttcc

SEQ ID NO: 70736 - DNA, 25 bp, Mus musculus
aagttctttgtagtatgtcagttcc

SEQ ID NO: 70737 - DNA, 25 bp, Mus musculus
aagttcttttgcagtagcattcatt

SEQ ID NO: 70738 - DNA, 25 bp, Mus musculus
aagttcttttgctgtagcattcatt

SEQ ID NO: 70739 - DNA, 25 bp, Mus musculus
aagttgaacagtcgactatccgtag

SEQ ID NO: 70740 - DNA, 25 bp, Mus musculus
aagttgaacagtggactatccgtag

SEQ ID NO: 70741 - DNA, 25 bp, Mus musculus
aagttgaacctaacagcctggcgag

SEQ ID NO: 70742 - DNA, 25 bp, Mus musculus
aagttgaacctatcagcctggcgag

SEQ ID NO: 70743 - DNA, 25 bp, Mus musculus
aagttgaactcaccatgcctattaa

SEQ ID NO: 70744 - DNA, 25 bp, Mus musculus
aagttgaactcagcatgcctattaa

SEQ ID NO: 70745 - DNA, 25 bp, Mus musculus
aagttgaagctgacccaccatggat

SEQ ID NO: 70746 - DNA, 25 bp, Mus musculus
aagttgaagctgtcccaccatggat

SEQ ID NO: 70747 - DNA, 25 bp, Mus musculus
aagttgaagggcatcctcagctgtc

SEQ ID NO: 70748 - DNA, 25 bp, Mus musculus
aagttgaagggcttcctcagctgtc

SEQ ID NO: 70749 - DNA, 25 bp, Mus musculus
aagttgacaattacctcaaggtcct

SEQ ID NO: 70750 - DNA, 25 bp, Mus musculus
aagttgacaatttcctcaaggtcct

SEQ ID NO: 70751 - DNA, 25 bp, Mus musculus
aagttgacagctaagtgccttgcct

SEQ ID NO: 70752 - DNA, 25 bp, Mus musculus
aagttgacagcttagtgccttgcct

SEQ ID NO: 70753 - DNA, 25 bp, Mus musculus
aagttgaccatgcactatttatagt

SEQ ID NO: 70754 - DNA, 25 bp, Mus musculus
aagttgaccatggactatttatagt

SEQ ID NO: 70755 - DNA, 25 bp, Mus musculus
aagttgacccagcttcctaatgaac

SEQ ID NO: 70756 - DNA, 25 bp, Mus musculus
aagttgacccaggttcctaatgaac

SEQ ID NO: 70757 - DNA, 25 bp, Mus musculus
aagttgacctccacggtgatgctat

SEQ ID NO: 70758 - DNA, 25 bp, Mus musculus
aagttgacctcctcggtgatgctat

SEQ ID NO: 70759 - DNA, 25 bp, Mus musculus
aagttgacttgactcatccctgcct

SEQ ID NO: 70760 - DNA, 25 bp, Mus musculus
aagttgacttgagtcatccctgcct

SEQ ID NO: 70761 - DNA, 25 bp, Mus musculus
aagttgagacatcgccacactgatt

SEQ ID NO: 70762 - DNA, 25 bp, Mus musculus
aagttgagacatggccacactgatt

SEQ ID NO: 70763 - DNA, 25 bp, Mus musculus
aagttgagaccaccgtaggtagcta

SEQ ID NO: 70764 - DNA, 25 bp, Mus musculus
aagttgagaccagcgtaggtagcta

SEQ ID NO: 70765 - DNA, 25 bp, Mus musculus
aagttgagcagaaggtggcccattt

SEQ ID NO: 70766 - DNA, 25 bp, Mus musculus
aagttgagcagatggtggcccattt

SEQ ID NO: 70767 - DNA, 25 bp, Mus musculus
aagttgagctgtatggcttcctgta

SEQ ID NO: 70768 - DNA, 25 bp, Mus musculus
aagttgagctgtttggcttcctgta

SEQ ID NO: 70769 - DNA, 25 bp, Mus musculus
aagttgaggcttattccagctttct

SEQ ID NO: 70770 - DNA, 25 bp, Mus musculus
aagttgaggctttttccagctttct

SEQ ID NO: 70771 - DNA, 25 bp, Mus musculus
aagttgagtggcatttgcaccttca

SEQ ID NO: 70772 - DNA, 25 bp, Mus musculus
aagttgagtggcttttgcaccttca

SEQ ID NO: 70773 - DNA, 25 bp, Mus musculus
aagttgagtgtgactaccttgcata

SEQ ID NO: 70774 - DNA, 25 bp, Mus musculus
aagttgagtgtgtctaccttgcata

SEQ ID NO: 70775 - DNA, 25 bp, Mus musculus
aagttgatcaacacaagcctcctca

SEQ ID NO: 70776 - DNA, 25 bp, Mus musculus
aagttgatcaactcaagcctcctca

SEQ ID NO: 70777 - DNA, 25 bp, Mus musculus
aagttgatcatgagtgctgaagact

SEQ ID NO: 70778 - DNA, 25 bp, Mus musculus
aagttgatcatgtgtgctgaagact

SEQ ID NO: 70779 - DNA, 25 bp, Mus musculus
aagttgatctttccctgtcatgaga

SEQ ID NO: 70780 - DNA, 25 bp, Mus musculus
aagttgatctttgcctgtcatgaga

SEQ ID NO: 70781 - DNA, 25 bp, Mus musculus
aagttgatgaaacatctctcccatc

SEQ ID NO: 70782 - DNA, 25 bp, Mus musculus
aagttgatgaaagatctctcccatc

SEQ ID NO: 70783 - DNA, 25 bp, Mus musculus
aagttgatgactctgtgacgttgaa

SEQ ID NO: 70784 - DNA, 25 bp, Mus musculus
aagttgatgactgtgtgacgttgaa

SEQ ID NO: 70785 - DNA, 25 bp, Mus musculus
aagttgatggtcaagctgggccacc

SEQ ID NO: 70786 - DNA, 25 bp, Mus musculus
aagttgatggtctagctgggccacc

SEQ ID NO: 70787 - DNA, 25 bp, Mus musculus
aagttgatgtctcagaccggctcac

SEQ ID NO: 70788 - DNA, 25 bp, Mus musculus
aagttgatgtctgagaccggctcac

SEQ ID NO: 70789 - DNA, 25 bp, Mus musculus
aagttgattactccttctatgccca

SEQ ID NO: 70790 - DNA, 25 bp, Mus musculus
aagttgattactgcttctatgccca

SEQ ID NO: 70791 - DNA, 25 bp, Mus musculus
aagttgattgacctccttttctctc

SEQ ID NO: 70792 - DNA, 25 bp, Mus musculus
aagttgattgacgtccttttctctc

SEQ ID NO: 70793 - DNA, 25 bp, Mus musculus
aagttgatttcaaaggctgtagaac

SEQ ID NO: 70794 - DNA, 25 bp, Mus musculus
aagttgatttcataggctgtagaac

SEQ ID NO: 70795 - DNA, 25 bp, Mus musculus
aagttgattttcatgttcatgcaag

SEQ ID NO: 70796 - DNA, 25 bp, Mus musculus
aagttgattttcttgttcatgcaag

SEQ ID NO: 70797 - DNA, 25 bp, Mus musculus
aagttgcaaactaggcctctggaaa

SEQ ID NO: 70798 - DNA, 25 bp, Mus musculus
aagttgcaaacttggcctctggaaa

SEQ ID NO: 70799 - DNA, 25 bp, Mus musculus
aagttgcaagaactggtgccgcccg

SEQ ID NO: 70800 - DNA, 25 bp, Mus musculus
aagttgcaagaagtggtgccgcccg

SEQ ID NO: 70801 - DNA, 25 bp, Mus musculus
aagttgcaagccatgagcaccacca

SEQ ID NO: 70802 - DNA, 25 bp, Mus musculus
aagttgcaagccttgagcaccacca

SEQ ID NO: 70803 - DNA, 25 bp, Mus musculus
aagttgcacctaatgttaagtggaa

SEQ ID NO: 70804 - DNA, 25 bp, Mus musculus
aagttgcacctattgttaagtggaa

SEQ ID NO: 70805 - DNA, 25 bp, Mus musculus
aagttgcaggctacacaaagctccc

SEQ ID NO: 70806 - DNA, 25 bp, Mus musculus
aagttgcaggcttcacaaagctccc

SEQ ID NO: 70807 - DNA, 25 bp, Mus musculus
aagttgcaggttcctaacgggccat

SEQ ID NO: 70808 - DNA, 25 bp, Mus musculus
aagttgcaggttgctaacgggccat

SEQ ID NO: 70809 - DNA, 25 bp, Mus musculus
aagttgcagtctaccaatgtgaata

SEQ ID NO: 70810 - DNA, 25 bp, Mus musculus
aagttgcagtctagttgcactcggt

SEQ ID NO: 70811 - DNA, 25 bp, Mus musculus
aagttgcagtcttccaatgtgaata

SEQ ID NO: 70812 - DNA, 25 bp, Mus musculus
aagttgcagtcttgttgcactcggt

SEQ ID NO: 70813 - DNA, 25 bp, Mus musculus
aagttgcatagcatggcctcagtgt

SEQ ID NO: 70814 - DNA, 25 bp, Mus musculus
aagttgcatagcttggcctcagtgt

SEQ ID NO: 70815 - DNA, 25 bp, Mus musculus
aagttgcatcataaagttagctgga

SEQ ID NO: 70816 - DNA, 25 bp, Mus musculus
aagttgcatcattaagttagctgga

SEQ ID NO: 70817 - DNA, 25 bp, Mus musculus
aagttgcatccaataagcacgcgca

SEQ ID NO: 70818 - DNA, 25 bp, Mus musculus
aagttgcatccattaagcacgcgca

SEQ ID NO: 70819 - DNA, 25 bp, Mus musculus
aagttgcatgcactgcgggacttgc

SEQ ID NO: 70820 - DNA, 25 bp, Mus musculus
aagttgcatgcagtgcgggacttgc

SEQ ID NO: 70821 - DNA, 25 bp, Mus musculus
aagttgcattgccttctgtaagtaa

SEQ ID NO: 70822 - DNA, 25 bp, Mus musculus
aagttgcattgcgttctgtaagtaa

SEQ ID NO: 70823 - DNA, 25 bp, Mus musculus
aagttgcattttcactcccagctat

SEQ ID NO: 70824 - DNA, 25 bp, Mus musculus
aagttgcattttgactcccagctat

SEQ ID NO: 70825 - DNA, 25 bp, Mus musculus
aagttgccatctaccttgggataaa

SEQ ID NO: 70826 - DNA, 25 bp, Mus musculus
aagttgccatcttccttgggataaa

SEQ ID NO: 70827 - DNA, 25 bp, Mus musculus
aagttgccatgtcacatttctttta

SEQ ID NO: 70828 - DNA, 25 bp, Mus musculus
aagttgccatgtgacatttctttta

SEQ ID NO: 70829 - DNA, 25 bp, Mus musculus
aagttgcccaacaccaagatccgct

SEQ ID NO: 70830 - DNA, 25 bp, Mus musculus
aagttgcccaactccaagatccgct

SEQ ID NO: 70831 - DNA, 25 bp, Mus musculus
aagttgcccaggattagctcacttc

SEQ ID NO: 70832 - DNA, 25 bp, Mus musculus
aagttgcccaggtttagctcacttc

SEQ ID NO: 70833 - DNA, 25 bp, Mus musculus
aagttgcccttcatcatggtaactg

SEQ ID NO: 70834 - DNA, 25 bp, Mus musculus
aagttgcccttcttcatggtaactg

SEQ ID NO: 70835 - DNA, 25 bp, Mus musculus
aagttgcctattccatatggctcag

SEQ ID NO: 70836 - DNA, 25 bp, Mus musculus
aagttgcctattgcatatggctcag

SEQ ID NO: 70837 - DNA, 25 bp, Mus musculus
aagttgcctgagacctgagatccta

SEQ ID NO: 70838 - DNA, 25 bp, Mus musculus
aagttgcctgagtcctgagatccta

SEQ ID NO: 70839 - DNA, 25 bp, Mus musculus
aagttgcgcagaacacgttacggga

SEQ ID NO: 70840 - DNA, 25 bp, Mus musculus
aagttgcgcagatcacgttacggga

SEQ ID NO: 70841 - DNA, 25 bp, Mus musculus
aagttgcgcaggcacgccccagttg

SEQ ID NO: 70842 - DNA, 25 bp, Mus musculus
aagttgcgcagggacgccccagttg

SEQ ID NO: 70843 - DNA, 25 bp, Mus musculus
aagttgcggcataccaccggtaaga

SEQ ID NO: 70844 - DNA, 25 bp, Mus musculus
aagttgcggcattccaccggtaaga

SEQ ID NO: 70845 - DNA, 25 bp, Mus musculus
aagttgcgggcacgctgcactttga

SEQ ID NO: 70846 - DNA, 25 bp, Mus musculus
aagttgcgggcaggctgcactttga

SEQ ID NO: 70847 - DNA, 25 bp, Mus musculus
aagttgcgttggatgtactggcaca

SEQ ID NO: 70848 - DNA, 25 bp, Mus musculus
aagttgcgttggttgtactggcaca

SEQ ID NO: 70849 - DNA, 25 bp, Mus musculus
aagttgctaaataacaagccactag

SEQ ID NO: 70850 - DNA, 25 bp, Mus musculus
aagttgctaaattacaagccactag

SEQ ID NO: 70851 - DNA, 25 bp, Mus musculus
aagttgctaacacctagtatgtaca

SEQ ID NO: 70852 - DNA, 25 bp, Mus musculus
aagttgctaacagctagtatgtaca

SEQ ID NO: 70853 - DNA, 25 bp, Mus musculus
aagttgctaagaccttttgtccttg

SEQ ID NO: 70854 - DNA, 25 bp, Mus musculus
aagttgctaagagcttttgtccttg

SEQ ID NO: 70855 - DNA, 25 bp, Mus musculus
aagttgctaagcatcttcatctccc

SEQ ID NO: 70856 - DNA, 25 bp, Mus musculus
aagttgctaagcttcttcatctccc

SEQ ID NO: 70857 - DNA, 25 bp, Mus musculus
aagttgctacaactatctgtacaga

SEQ ID NO: 70858 - DNA, 25 bp, Mus musculus
aagttgctacaagtatctgtacaga

SEQ ID NO: 70859 - DNA, 25 bp, Mus musculus
aagttgctacttctctgttagtttc

SEQ ID NO: 70860 - DNA, 25 bp, Mus musculus
aagttgctacttgtctgttagtttc

SEQ ID NO: 70861 - DNA, 25 bp, Mus musculus
aagttgctaggcaactgtttctgaa

SEQ ID NO: 70862 - DNA, 25 bp, Mus musculus
aagttgctaggctactgtttctgaa

SEQ ID NO: 70863 - DNA, 25 bp, Mus musculus
aagttgctcaatattcaagtagtca

SEQ ID NO: 70864 - DNA, 25 bp, Mus musculus
aagttgctcaattttcaagtagtca

SEQ ID NO: 70865 - DNA, 25 bp, Mus musculus
aagttgctcacacgcacaaggtcct

SEQ ID NO: 70866 - DNA, 25 bp, Mus musculus
aagttgctcacaggcacaaggtcct

SEQ ID NO: 70867 - DNA, 25 bp, Mus musculus
aagttgctcagactctgtctggcaa

SEQ ID NO: 70868 - DNA, 25 bp, Mus musculus
aagttgctcagagtctgtctggcaa

SEQ ID NO: 70869 - DNA, 25 bp, Mus musculus
aagttgctcagtactaatggtgttt

SEQ ID NO: 70870 - DNA, 25 bp, Mus musculus
aagttgctcagttctaatggtgttt

SEQ ID NO: 70871 - DNA, 25 bp, Mus musculus
aagttgctccgtaggcgctcggaag

SEQ ID NO: 70872 - DNA, 25 bp, Mus musculus
aagttgctccgttggcgctcggaag

SEQ ID NO: 70873 - DNA, 25 bp, Mus musculus
aagttgctctctcagtcgtgtttgt

SEQ ID NO: 70874 - DNA, 25 bp, Mus musculus
aagttgctctctcatatctgcatgt

SEQ ID NO: 70875 - DNA, 25 bp, Mus musculus
aagttgctctctgagtcgtgtttgt

SEQ ID NO: 70876 - DNA, 25 bp, Mus musculus
aagttgctctctgatatctgcatgt

SEQ ID NO: 70877 - DNA, 25 bp, Mus musculus
aagttgctcttgacagagtcctgca

SEQ ID NO: 70878 - DNA, 25 bp, Mus musculus
aagttgctcttgtcagagtcctgca

SEQ ID NO: 70879 - DNA, 25 bp, Mus musculus
aagttgctctttctcactgcagtta

SEQ ID NO: 70880 - DNA, 25 bp, Mus musculus
aagttgctctttgtcactgcagtta

SEQ ID NO: 70881 - DNA, 25 bp, Mus musculus
aagttgctgactcttacgcgcagaa

SEQ ID NO: 70882 - DNA, 25 bp, Mus musculus
aagttgctgactgttacgcgcagaa

SEQ ID NO: 70883 - DNA, 25 bp, Mus musculus
aagttgctggcacaccttaagaagt

SEQ ID NO: 70884 - DNA, 25 bp, Mus musculus
aagttgctggcagaccttaagaagt

SEQ ID NO: 70885 - DNA, 25 bp, Mus musculus
aagttgctggctcgaccaggttcta

SEQ ID NO: 70886 - DNA, 25 bp, Mus musculus
aagttgctggctggaccaggttcta

SEQ ID NO: 70887 - DNA, 25 bp, Mus musculus
aagttgctgtatcattggaggcata

SEQ ID NO: 70888 - DNA, 25 bp, Mus musculus
aagttgctgtatgattggaggcata

SEQ ID NO: 70889 - DNA, 25 bp, Mus musculus
aagttgctgtcactgttgcccacta

SEQ ID NO: 70890 - DNA, 25 bp, Mus musculus
aagttgctgtcagtgttgcccacta

SEQ ID NO: 70891 - DNA, 25 bp, Mus musculus
aagttgctgtcccttactccaggta

SEQ ID NO: 70892 - DNA, 25 bp, Mus musculus
aagttgctgtccgttactccaggta

SEQ ID NO: 70893 - DNA, 25 bp, Mus musculus
aagttgctgtgactaccaagcctac

SEQ ID NO: 70894 - DNA, 25 bp, Mus musculus
aagttgctgtgagtaccaagcctac

SEQ ID NO: 70895 - DNA, 25 bp, Mus musculus
aagttgctgtggcatctttgttcct

SEQ ID NO: 70896 - DNA, 25 bp, Mus musculus
aagttgctgtgggatctttgttcct

SEQ ID NO: 70897 - DNA, 25 bp, Mus musculus
aagttgcttacacggattctttgaa

SEQ ID NO: 70898 - DNA, 25 bp, Mus musculus
aagttgcttacagggattctttgaa

SEQ ID NO: 70899 - DNA, 25 bp, Mus musculus
aagttgcttattcgctgttctctgc

SEQ ID NO: 70900 - DNA, 25 bp, Mus musculus
aagttgcttattggctgttctctgc

SEQ ID NO: 70901 - DNA, 25 bp, Mus musculus
aagttgcttcagattttcataggat

SEQ ID NO: 70902 - DNA, 25 bp, Mus musculus
aagttgcttcagtttttcataggat

SEQ ID NO: 70903 - DNA, 25 bp, Mus musculus
aagttgcttcccacttctaggatct

SEQ ID NO: 70904 - DNA, 25 bp, Mus musculus
aagttgcttccctcttctaggatct

SEQ ID NO: 70905 - DNA, 25 bp, Mus musculus
aagttgcttctcaaccacaggttgt

SEQ ID NO: 70906 - DNA, 25 bp, Mus musculus
aagttgcttctctaccacaggttgt

SEQ ID NO: 70907 - DNA, 25 bp, Mus musculus
aagttgcttggcacagggtatggtc

SEQ ID NO: 70908 - DNA, 25 bp, Mus musculus
aagttgcttggctcagggtatggtc

SEQ ID NO: 70909 - DNA, 25 bp, Mus musculus
aagttgctttagctggagggtccca

SEQ ID NO: 70910 - DNA, 25 bp, Mus musculus
aagttgctttaggtggagggtccca

SEQ ID NO: 70911 - DNA, 25 bp, Mus musculus
aagttgctttggctcatgtcttctt

SEQ ID NO: 70912 - DNA, 25 bp, Mus musculus
aagttgctttgggtcatgtcttctt

SEQ ID NO: 70913 - DNA, 25 bp, Mus musculus
aagttggaactcagattcctcggat

SEQ ID NO: 70914 - DNA, 25 bp, Mus musculus
aagttggaactctgattcctcggat

SEQ ID NO: 70915 - DNA, 25 bp, Mus musculus
aagttggaataccagagctatctgg

SEQ ID NO: 70916 - DNA, 25 bp, Mus musculus
aagttggaatacgagagctatctgg

SEQ ID NO: 70917 - DNA, 25 bp, Mus musculus
aagttggaatgtagctggcgccaca

SEQ ID NO: 70918 - DNA, 25 bp, Mus musculus
aagttggaatgttgctggcgccaca

SEQ ID NO: 70919 - DNA, 25 bp, Mus musculus
aagttggaccatcggctgtattcca

SEQ ID NO: 70920 - DNA, 25 bp, Mus musculus
aagttggaccatgggctgtattcca

SEQ ID NO: 70921 - DNA, 25 bp, Mus musculus
aagttggacccacagtgtgagacca

SEQ ID NO: 70922 - DNA, 25 bp, Mus musculus
aagttggacccagagtgtgagacca

SEQ ID NO: 70923 - DNA, 25 bp, Mus musculus
aagttggactaaccgaccttgaatg

SEQ ID NO: 70924 - DNA, 25 bp, Mus musculus
aagttggactaagcgaccttgaatg

SEQ ID NO: 70925 - DNA, 25 bp, Mus musculus
aagttggactacacctatctcatca

SEQ ID NO: 70926 - DNA, 25 bp, Mus musculus
aagttggactactcctatctcatca

SEQ ID NO: 70927 - DNA, 25 bp, Mus musculus
aagttggagacaccagccatggcta

SEQ ID NO: 70928 - DNA, 25 bp, Mus musculus
aagttggagacagcagccatggcta

SEQ ID NO: 70929 - DNA, 25 bp, Mus musculus
aagttggaggacctcaccccagtgg

SEQ ID NO: 70930 - DNA, 25 bp, Mus musculus
aagttggaggacgtcaccccagtgg

SEQ ID NO: 70931 - DNA, 25 bp, Mus musculus
aagttggaggctctgaactctcagc

SEQ ID NO: 70932 - DNA, 25 bp, Mus musculus
aagttggaggctgtgaactctcagc

SEQ ID NO: 70933 - DNA, 25 bp, Mus musculus
aagttggagtccagctggtccatca

SEQ ID NO: 70934 - DNA, 25 bp, Mus musculus
aagttggagtcctgctggtccatca

SEQ ID NO: 70935 - DNA, 25 bp, Mus musculus
aagttggatactcgaccaggctcca

SEQ ID NO: 70936 - DNA, 25 bp, Mus musculus
aagttggatactggaccaggctcca

SEQ ID NO: 70937 - DNA, 25 bp, Mus musculus
aagttggatagcctgacccgctgag

SEQ ID NO: 70938 - DNA, 25 bp, Mus musculus
aagttggatagcgtgacccgctgag

SEQ ID NO: 70939 - DNA, 25 bp, Mus musculus
aagttggatggcattgtttccatga

SEQ ID NO: 70940 - DNA, 25 bp, Mus musculus
aagttggatggctttgtttccatga

SEQ ID NO: 70941 - DNA, 25 bp, Mus musculus
aagttggatgtgcatttttgccctg

SEQ ID NO: 70942 - DNA, 25 bp, Mus musculus
aagttggatgtggatttttgccctg

SEQ ID NO: 70943 - DNA, 25 bp, Mus musculus
aagttggatttcctgctgctgtaaa

SEQ ID NO: 70944 - DNA, 25 bp, Mus musculus
aagttggatttcgtgctgctgtaaa

SEQ ID NO: 70945 - DNA, 25 bp, Mus musculus
aagttggcatctcatggtgtgtctc

SEQ ID NO: 70946 - DNA, 25 bp, Mus musculus
aagttggcatctgatggtgtgtctc

SEQ ID NO: 70947 - DNA, 25 bp, Mus musculus
aagttggcatgacgctacttcaaga

SEQ ID NO: 70948 - DNA, 25 bp, Mus musculus
aagttggcatgaggctacttcaaga

SEQ ID NO: 70949 - DNA, 25 bp, Mus musculus
aagttggccaagagtacttcactat

SEQ ID NO: 70950 - DNA, 25 bp, Mus musculus
aagttggccaagtgtacttcactat

SEQ ID NO: 70951 - DNA, 25 bp, Mus musculus
aagttggccatcaaggtctgaggag

SEQ ID NO: 70952 - DNA, 25 bp, Mus musculus
aagttggccatctaggtctgaggag

SEQ ID NO: 70953 - DNA, 25 bp, Mus musculus
aagttggcgagacgctcctgaccct

SEQ ID NO: 70954 - DNA, 25 bp, Mus musculus
aagttggcgagaggctcctgaccct

SEQ ID NO: 70955 - DNA, 25 bp, Mus musculus
aagttggcggcccttatgcagaaca

SEQ ID NO: 70956 - DNA, 25 bp, Mus musculus
aagttggcggccgttatgcagaaca

SEQ ID NO: 70957 - DNA, 25 bp, Mus musculus
aagttggcgtgtaccttgattgtga

SEQ ID NO: 70958 - DNA, 25 bp, Mus musculus
aagttggcgtgttccttgattgtga

SEQ ID NO: 70959 - DNA, 25 bp, Mus musculus
aagttggctaccatgaacagctgaa

SEQ ID NO: 70960 - DNA, 25 bp, Mus musculus
aagttggctaccttgaacagctgaa

SEQ ID NO: 70961 - DNA, 25 bp, Mus musculus
aagttggctatacagagtgccctga

SEQ ID NO: 70962 - DNA, 25 bp, Mus musculus
aagttggctatagagagtgccctga

SEQ ID NO: 70963 - DNA, 25 bp, Mus musculus
aagttggctcaaaatggacccctct

SEQ ID NO: 70964 - DNA, 25 bp, Mus musculus
aagttggctcaatatggacccctct

SEQ ID NO: 70965 - DNA, 25 bp, Mus musculus
aagttggctccaagggtcaccttga

SEQ ID NO: 70966 - DNA, 25 bp, Mus musculus
aagttggctccatgggtcaccttga

SEQ ID NO: 70967 - DNA, 25 bp, Mus musculus
aagttggctctaactagcacaggta

SEQ ID NO: 70968 - DNA, 25 bp, Mus musculus
aagttggctctatctagcacaggta

SEQ ID NO: 70969 - DNA, 25 bp, Mus musculus
aagttggctctgacaaacatctcct

SEQ ID NO: 70970 - DNA, 25 bp, Mus musculus
aagttggctctgtcaaacatctcct

SEQ ID NO: 70971 - DNA, 25 bp, Mus musculus
aagttggctgctagggtggccccat

SEQ ID NO: 70972 - DNA, 25 bp, Mus musculus
aagttggctgcttgggtggccccat

SEQ ID NO: 70973 - DNA, 25 bp, Mus musculus
aagttggctgtcatttagatcctcc

SEQ ID NO: 70974 - DNA, 25 bp, Mus musculus
aagttggctgtcttttagatcctcc

SEQ ID NO: 70975 - DNA, 25 bp, Mus musculus
aagttggctttcatttttcctagat

SEQ ID NO: 70976 - DNA, 25 bp, Mus musculus
aagttggctttcttttttcctagat

SEQ ID NO: 70977 - DNA, 25 bp, Mus musculus
aagttgggacttcgacctggcctga

SEQ ID NO: 70978 - DNA, 25 bp, Mus musculus
aagttgggacttggacctggcctga

SEQ ID NO: 70979 - DNA, 25 bp, Mus musculus
aagttgggcagcatcagcgacgacc

SEQ ID NO: 70980 - DNA, 25 bp, Mus musculus
aagttgggcagcttcagcgacgacc

SEQ ID NO: 70981 - DNA, 25 bp, Mus musculus
aagttgggcatcacatttccatctt

SEQ ID NO: 70982 - DNA, 25 bp, Mus musculus
aagttgggcatctcatttccatctt

SEQ ID NO: 70983 - DNA, 25 bp, Mus musculus
aagttgggccaaatcggcttccatc

SEQ ID NO: 70984 - DNA, 25 bp, Mus musculus
aagttgggccaattcggcttccatc

SEQ ID NO: 70985 - DNA, 25 bp, Mus musculus
aagttgggccttcagctcagcaatt

SEQ ID NO: 70986 - DNA, 25 bp, Mus musculus
aagttgggccttgagctcagcaatt

SEQ ID NO: 70987 - DNA, 25 bp, Mus musculus
aagttgggtattcagacctccagct

SEQ ID NO: 70988 - DNA, 25 bp, Mus musculus
aagttgggtattgagacctccagct

SEQ ID NO: 70989 - DNA, 25 bp, Mus musculus
aagttgggtcctatggtcctcagct

SEQ ID NO: 70990 - DNA, 25 bp, Mus musculus
aagttgggtcctttggtcctcagct

SEQ ID NO: 70991 - DNA, 25 bp, Mus musculus
aagttggtatgcaccttacctttga

SEQ ID NO: 70992 - DNA, 25 bp, Mus musculus
aagttggtatgctccttacctttga

SEQ ID NO: 70993 - DNA, 25 bp, Mus musculus
aagttggtcagtcaacctcctactt

SEQ ID NO: 70994 - DNA, 25 bp, Mus musculus
aagttggtcagtgaacctcctactt

SEQ ID NO: 70995 - DNA, 25 bp, Mus musculus
aagttggtcataagcacatctccct

SEQ ID NO: 70996 - DNA, 25 bp, Mus musculus
aagttggtcatatgcacatctccct

SEQ ID NO: 70997 - DNA, 25 bp, Mus musculus
aagttggtccctaggatacttcttg

SEQ ID NO: 70998 - DNA, 25 bp, Mus musculus
aagttggtcccttggatacttcttg

SEQ ID NO: 70999 - DNA, 25 bp, Mus musculus
aagttggtctcccttctgctttggc

SEQ ID NO: 71000 - DNA, 25 bp, Mus musculus
aagttggtctccgttctgctttggc

SEQ ID NO: 71001 - DNA, 25 bp, Mus musculus
aagttggtcttgatcctagcaacaa

SEQ ID NO: 71002 - DNA, 25 bp, Mus musculus
aagttggtcttgatctatccgctaa

SEQ ID NO: 71003 - DNA, 25 bp, Mus musculus
aagttggtcttgttcctagcaacaa

SEQ ID NO: 71004 - DNA, 25 bp, Mus musculus
aagttggtcttgttctatccgctaa

SEQ ID NO: 71005 - DNA, 25 bp, Mus musculus
aagttggtgatccactagagggata

SEQ ID NO: 71006 - DNA, 25 bp, Mus musculus
aagttggtgatcgactagagggata

SEQ ID NO: 71007 - DNA, 25 bp, Mus musculus
aagttggtgccaactagggttgaag

SEQ ID NO: 71008 - DNA, 25 bp, Mus musculus
aagttggtgccatctagggttgaag

SEQ ID NO: 71009 - DNA, 25 bp, Mus musculus
aagttggttatgacgccatgcttgg

SEQ ID NO: 71010 - DNA, 25 bp, Mus musculus
aagttggttatgtcgccatgcttgg

SEQ ID NO: 71011 - DNA, 25 bp, Mus musculus
aagttggttcttaggttgtgagatc

SEQ ID NO: 71012 - DNA, 25 bp, Mus musculus
aagttggttctttggttgtgagatc

SEQ ID NO: 71013 - DNA, 25 bp, Mus musculus
aagttggtttatatacgcatcagaa

SEQ ID NO: 71014 - DNA, 25 bp, Mus musculus
aagttggtttatttacgcatcagaa

SEQ ID NO: 71015 - DNA, 25 bp, Mus musculus
aagttgtaagagctgatcccaccct

SEQ ID NO: 71016 - DNA, 25 bp, Mus musculus
aagttgtaagaggtgatcccaccct

SEQ ID NO: 71017 - DNA, 25 bp, Mus musculus
aagttgtaagctatctattgaccct

SEQ ID NO: 71018 - DNA, 25 bp, Mus musculus
aagttgtaagctttctattgaccct

SEQ ID NO: 71019 - DNA, 25 bp, Mus musculus
aagttgtacaacaagaagtgtttca

SEQ ID NO: 71020 - DNA, 25 bp, Mus musculus
aagttgtacaactagaagtgtttca

SEQ ID NO: 71021 - DNA, 25 bp, Mus musculus
aagttgtacagtcagggccccaggc

SEQ ID NO: 71022 - DNA, 25 bp, Mus musculus
aagttgtacagtgagggccccaggc

SEQ ID NO: 71023 - DNA, 25 bp, Mus musculus
aagttgtactatctcagcctttgct

SEQ ID NO: 71024 - DNA, 25 bp, Mus musculus
aagttgtactatgtcagcctttgct

SEQ ID NO: 71025 - DNA, 25 bp, Mus musculus
aagttgtagagaatcacgtgtccat

SEQ ID NO: 71026 - DNA, 25 bp, Mus musculus
aagttgtagagattcacgtgtccat

SEQ ID NO: 71027 - DNA, 25 bp, Mus musculus
aagttgtagagtacccatacttgga

SEQ ID NO: 71028 - DNA, 25 bp, Mus musculus
aagttgtagagttcccatacttgga

SEQ ID NO: 71029 - DNA, 25 bp, Mus musculus
aagttgtagtttagagccttcccag

SEQ ID NO: 71030 - DNA, 25 bp, Mus musculus
aagttgtagttttgagccttcccag

SEQ ID NO: 71031 - DNA, 25 bp, Mus musculus
aagttgtatcctcaccttcttttgc

SEQ ID NO: 71032 - DNA, 25 bp, Mus musculus
aagttgtatcctgaccttcttttgc

SEQ ID NO: 71033 - DNA, 25 bp, Mus musculus
aagttgtattcaaccacaggttcag

SEQ ID NO: 71034 - DNA, 25 bp, Mus musculus
aagttgtattcatccacaggttcag

SEQ ID NO: 71035 - DNA, 25 bp, Mus musculus
aagttgtcacagactttgggctcta

SEQ ID NO: 71036 - DNA, 25 bp, Mus musculus
aagttgtcacagtctttgggctcta

SEQ ID NO: 71037 - DNA, 25 bp, Mus musculus
aagttgtccagcaacatgaatacag

SEQ ID NO: 71038 - DNA, 25 bp, Mus musculus
aagttgtccagctacatgaatacag

SEQ ID NO: 71039 - DNA, 25 bp, Mus musculus
aagttgtcccttctttgtatctgca

SEQ ID NO: 71040 - DNA, 25 bp, Mus musculus
aagttgtcccttgtttgtatctgca

SEQ ID NO: 71041 - DNA, 25 bp, Mus musculus
aagttgtctccaacttcatcaacag

SEQ ID NO: 71042 - DNA, 25 bp, Mus musculus
aagttgtctccatcttcatcaacag

SEQ ID NO: 71043 - DNA, 25 bp, Mus musculus
aagttgtctgagctaccagtgtttt

SEQ ID NO: 71044 - DNA, 25 bp, Mus musculus
aagttgtctgaggtaccagtgtttt

SEQ ID NO: 71045 - DNA, 25 bp, Mus musculus
aagttgtctgatatccctgaaggga

SEQ ID NO: 71046 - DNA, 25 bp, Mus musculus
aagttgtctgatttccctgaaggga

SEQ ID NO: 71047 - DNA, 25 bp, Mus musculus
aagttgtctggcagctttatgtaca

SEQ ID NO: 71048 - DNA, 25 bp, Mus musculus
aagttgtctggctgctttatgtaca

SEQ ID NO: 71049 - DNA, 25 bp, Mus musculus
aagttgtcttctcaactccacgtat

SEQ ID NO: 71050 - DNA, 25 bp, Mus musculus
aagttgtcttctgaactccacgtat

SEQ ID NO: 71051 - DNA, 25 bp, Mus musculus
aagttgtgaaggctccagagccagt

SEQ ID NO: 71052 - DNA, 25 bp, Mus musculus
aagttgtgaagggtccagagccagt

SEQ ID NO: 71053 - DNA, 25 bp, Mus musculus
aagttgtgaccacttaaccaccgat

SEQ ID NO: 71054 - DNA, 25 bp, Mus musculus
aagttgtgaccagttaaccaccgat

SEQ ID NO: 71055 - DNA, 25 bp, Mus musculus
aagttgtgacttagcaggccttctt

SEQ ID NO: 71056 - DNA, 25 bp, Mus musculus
aagttgtgactttgcaggccttctt

SEQ ID NO: 71057 - DNA, 25 bp, Mus musculus
aagttgtgagcaacctctcaccaga

SEQ ID NO: 71058 - DNA, 25 bp, Mus musculus
aagttgtgagcatcctctcaccaga

SEQ ID NO: 71059 - DNA, 25 bp, Mus musculus
aagttgtgatgtagtgctatgtgac

SEQ ID NO: 71060 - DNA, 25 bp, Mus musculus
aagttgtgatgttgtgctatgtgac

SEQ ID NO: 71061 - DNA, 25 bp, Mus musculus
aagttgtgcactaccaacagctaga

SEQ ID NO: 71062 - DNA, 25 bp, Mus musculus
aagttgtgcacttccaacagctaga

SEQ ID NO: 71063 - DNA, 25 bp, Mus musculus
aagttgtgcatgaccttgtactgat

SEQ ID NO: 71064 - DNA, 25 bp, Mus musculus
aagttgtgcatgtccttgtactgat

SEQ ID NO: 71065 - DNA, 25 bp, Mus musculus
aagttgtgccatcccacagccaagg

SEQ ID NO: 71066 - DNA, 25 bp, Mus musculus
aagttgtgccatgccacagccaagg

SEQ ID NO: 71067 - DNA, 25 bp, Mus musculus
aagttgtgcctcaccaccaggtaga

SEQ ID NO: 71068 - DNA, 25 bp, Mus musculus
aagttgtgcctctccaccaggtaga

SEQ ID NO: 71069 - DNA, 25 bp, Mus musculus
aagttgtggagcatttctagtaatc

SEQ ID NO: 71070 - DNA, 25 bp, Mus musculus
aagttgtggagcttttctagtaatc

SEQ ID NO: 71071 - DNA, 25 bp, Mus musculus
aagttgtggcttaacacctctgtaa

SEQ ID NO: 71072 - DNA, 25 bp, Mus musculus
aagttgtggcttagggagtcccgct

SEQ ID NO: 71073 - DNA, 25 bp, Mus musculus
aagttgtggctttacacctctgtaa

SEQ ID NO: 71074 - DNA, 25 bp, Mus musculus
aagttgtggctttgggagtcccgct

SEQ ID NO: 71075 - DNA, 25 bp, Mus musculus
aagttgtgggatcaccaagctgcct

SEQ ID NO: 71076 - DNA, 25 bp, Mus musculus
aagttgtgggatgaccaagctgcct

SEQ ID NO: 71077 - DNA, 25 bp, Mus musculus
aagttgtgtagtagcctggttttca

SEQ ID NO: 71078 - DNA, 25 bp, Mus musculus
aagttgtgtagttgcctggttttca

SEQ ID NO: 71079 - DNA, 25 bp, Mus musculus
aagttgtgtcccagatctcccaggt

SEQ ID NO: 71080 - DNA, 25 bp, Mus musculus
aagttgtgtccctgatctcccaggt

SEQ ID NO: 71081 - DNA, 25 bp, Mus musculus
aagttgtgtctaaaaaatgctggtt

SEQ ID NO: 71082 - DNA, 25 bp, Mus musculus
aagttgtgtctataaaatgctggtt

SEQ ID NO: 71083 - DNA, 25 bp, Mus musculus
aagttgtgtgctaactaccactgcc

SEQ ID NO: 71084 - DNA, 25 bp, Mus musculus
aagttgtgtgcttactaccactgcc

SEQ ID NO: 71085 - DNA, 25 bp, Mus musculus
aagttgtgtttgaagtgatgtctcc

SEQ ID NO: 71086 - DNA, 25 bp, Mus musculus
aagttgtgtttgatcattgggacca

SEQ ID NO: 71087 - DNA, 25 bp, Mus musculus
aagttgtgtttgtagtgatgtctcc

SEQ ID NO: 71088 - DNA, 25 bp, Mus musculus
aagttgtgtttgttcattgggacca

SEQ ID NO: 71089 - DNA, 25 bp, Mus musculus
aagttgttacatcgtgttgtggaac

SEQ ID NO: 71090 - DNA, 25 bp, Mus musculus
aagttgttacatggtgttgtggaac

SEQ ID NO: 71091 - DNA, 25 bp, Mus musculus
aagttgttagctacagtgtctagta

SEQ ID NO: 71092 - DNA, 25 bp, Mus musculus
aagttgttagcttcagtgtctagta

SEQ ID NO: 71093 - DNA, 25 bp, Mus musculus
aagttgttaggcatctgcttgggaa

SEQ ID NO: 71094 - DNA, 25 bp, Mus musculus
aagttgttaggcttctgcttgggaa

SEQ ID NO: 71095 - DNA, 25 bp, Mus musculus
aagttgttatacagtcccacacggc

SEQ ID NO: 71096 - DNA, 25 bp, Mus musculus
aagttgttatactgtcccacacggc

SEQ ID NO: 71097 - DNA, 25 bp, Mus musculus
aagttgttccatacatatttaccta

SEQ ID NO: 71098 - DNA, 25 bp, Mus musculus
aagttgttccattcatatttaccta

SEQ ID NO: 71099 - DNA, 25 bp, Mus musculus
aagttgttcctgagtcaagtttgca

SEQ ID NO: 71100 - DNA, 25 bp, Mus musculus
aagttgttcctgtgtcaagtttgca

SEQ ID NO: 71101 - DNA, 25 bp, Mus musculus
aagttgttctagacttttccatggg

SEQ ID NO: 71102 - DNA, 25 bp, Mus musculus
aagttgttctagtcttttccatggg

SEQ ID NO: 71103 - DNA, 25 bp, Mus musculus
aagttgttctgtcacctcttcaata

SEQ ID NO: 71104 - DNA, 25 bp, Mus musculus
aagttgttctgtgacctcttcaata

SEQ ID NO: 71105 - DNA, 25 bp, Mus musculus
aagttgttgctcataggagccctgg

SEQ ID NO: 71106 - DNA, 25 bp, Mus musculus
aagttgttgctcttaggagccctgg

SEQ ID NO: 71107 - DNA, 25 bp, Mus musculus
aagttgttgtcaatcgctaggctgg

SEQ ID NO: 71108 - DNA, 25 bp, Mus musculus
aagttgttgtcattcgctaggctgg

SEQ ID NO: 71109 - DNA, 25 bp, Mus musculus
aagttgttgttcaagctgcctcagg

SEQ ID NO: 71110 - DNA, 25 bp, Mus musculus
aagttgttgttcctgtatttcatga

SEQ ID NO: 71111 - DNA, 25 bp, Mus musculus
aagttgttgttcgtgtatttcatga

SEQ ID NO: 71112 - DNA, 25 bp, Mus musculus
aagttgttgttctagctgcctcagg

SEQ ID NO: 71113 - DNA, 25 bp, Mus musculus
aagttgtttacaatgatttgctaga

SEQ ID NO: 71114 - DNA, 25 bp, Mus musculus
aagttgtttacattgatttgctaga

SEQ ID NO: 71115 - DNA, 25 bp, Mus musculus
aagttgtttcaactccagagccaaa

SEQ ID NO: 71116 - DNA, 25 bp, Mus musculus
aagttgtttcaagtccagagccaaa

SEQ ID NO: 71117 - DNA, 25 bp, Mus musculus
aagttgtttccccaactgcttgaga

SEQ ID NO: 71118 - DNA, 25 bp, Mus musculus
aagttgtttcccgaactgcttgaga

SEQ ID NO: 71119 - DNA, 25 bp, Mus musculus
aagttgtttgggagatatatagtgc

SEQ ID NO: 71120 - DNA, 25 bp, Mus musculus
aagttgtttgggtgatatatagtgc

SEQ ID NO: 71121 - DNA, 25 bp, Mus musculus
aagttgttttgcagggcaggttcta

SEQ ID NO: 71122 - DNA, 25 bp, Mus musculus
aagttgttttgctgggcaggttcta

SEQ ID NO: 71123 - DNA, 25 bp, Mus musculus
aagttgtttttgcatgtgattctat

SEQ ID NO: 71124 - DNA, 25 bp, Mus musculus
aagttgtttttggatgtgattctat

SEQ ID NO: 71125 - DNA, 25 bp, Mus musculus
aagtttaagaccaatctgagtgcat

SEQ ID NO: 71126 - DNA, 25 bp, Mus musculus
aagtttaagacctatctgagtgcat

SEQ ID NO: 71127 - DNA, 25 bp, Mus musculus
aagtttaagactagcaggccactaa

SEQ ID NO: 71128 - DNA, 25 bp, Mus musculus
aagtttaagacttgcaggccactaa

SEQ ID NO: 71129 - DNA, 25 bp, Mus musculus
aagtttaagtctcctagcgtagctg

SEQ ID NO: 71130 - DNA, 25 bp, Mus musculus
aagtttaagtctgctagcgtagctg

SEQ ID NO: 71131 - DNA, 25 bp, Mus musculus
aagtttacactcacgtcagagctgg

SEQ ID NO: 71132 - DNA, 25 bp, Mus musculus
aagtttacactctcgtcagagctgg

SEQ ID NO: 71133 - DNA, 25 bp, Mus musculus
aagtttactccgattcaggcagagg

SEQ ID NO: 71134 - DNA, 25 bp, Mus musculus
aagtttactccgtttcaggcagagg

SEQ ID NO: 71135 - DNA, 25 bp, Mus musculus
aagtttactgccagtctcttaggtg

SEQ ID NO: 71136 - DNA, 25 bp, Mus musculus
aagtttactgcctgtctcttaggtg

SEQ ID NO: 71137 - DNA, 25 bp, Mus musculus
aagtttagactgaacattttgccca

SEQ ID NO: 71138 - DNA, 25 bp, Mus musculus
aagtttagactgtacattttgccca

SEQ ID NO: 71139 - DNA, 25 bp, Mus musculus
aagtttagcgtcagggaaggcacct

SEQ ID NO: 71140 - DNA, 25 bp, Mus musculus
aagtttagcgtctgggaaggcacct

SEQ ID NO: 71141 - DNA, 25 bp, Mus musculus
aagtttaggcttacactgactgatg

SEQ ID NO: 71142 - DNA, 25 bp, Mus musculus
aagtttaggctttcactgactgatg

SEQ ID NO: 71143 - DNA, 25 bp, Mus musculus
aagtttagttctcttcatggtcact

SEQ ID NO: 71144 - DNA, 25 bp, Mus musculus
aagtttagttctgttcatggtcact

SEQ ID NO: 71145 - DNA, 25 bp, Mus musculus
aagtttataggtaactgtcacccag

SEQ ID NO: 71146 - DNA, 25 bp, Mus musculus
aagtttataggttactgtcacccag

SEQ ID NO: 71147 - DNA, 25 bp, Mus musculus
aagtttatccctagtcaccttcctg

SEQ ID NO: 71148 - DNA, 25 bp, Mus musculus
aagtttatcccttgtcaccttcctg

SEQ ID NO: 71149 - DNA, 25 bp, Mus musculus
aagtttatctacataaccccagagg

SEQ ID NO: 71150 - DNA, 25 bp, Mus musculus
aagtttatctacttaaccccagagg

SEQ ID NO: 71151 - DNA, 25 bp, Mus musculus
aagtttatcttcagtgtcttgccac

SEQ ID NO: 71152 - DNA, 25 bp, Mus musculus
aagtttatcttctgtgtcttgccac

SEQ ID NO: 71153 - DNA, 25 bp, Mus musculus
aagtttatggtcatcctccaatgcc

SEQ ID NO: 71154 - DNA, 25 bp, Mus musculus
aagtttatggtcttcctccaatgcc

SEQ ID NO: 71155 - DNA, 25 bp, Mus musculus
aagtttattactatggctacatatt

SEQ ID NO: 71156 - DNA, 25 bp, Mus musculus
aagtttattactttggctacatatt

SEQ ID NO: 71157 - DNA, 25 bp, Mus musculus
aagtttattagacatggtgttccta

SEQ ID NO: 71158 - DNA, 25 bp, Mus musculus
aagtttattagagatggtgttccta

SEQ ID NO: 71159 - DNA, 25 bp, Mus musculus
aagtttattattcccatgttttcat

SEQ ID NO: 71160 - DNA, 25 bp, Mus musculus
aagtttattattgccatgttttcat

SEQ ID NO: 71161 - DNA, 25 bp, Mus musculus
aagtttattcgcaagacccgtgaga

SEQ ID NO: 71162 - DNA, 25 bp, Mus musculus
aagtttattcgctagacccgtgaga

SEQ ID NO: 71163 - DNA, 25 bp, Mus musculus
aagtttattgagattgacttcataa

SEQ ID NO: 71164 - DNA, 25 bp, Mus musculus
aagtttattgagtttgacttcataa

SEQ ID NO: 71165 - DNA, 25 bp, Mus musculus
aagtttatttgccagcactcgagcc

SEQ ID NO: 71166 - DNA, 25 bp, Mus musculus
aagtttatttgcgagcactcgagcc

SEQ ID NO: 71167 - DNA, 25 bp, Mus musculus
aagtttattttccttctgcattggg

SEQ ID NO: 71168 - DNA, 25 bp, Mus musculus
aagtttattttcgttctgcattggg

SEQ ID NO: 71169 - DNA, 25 bp, Mus musculus
aagtttcaacccagaatgctgcacc

SEQ ID NO: 71170 - DNA, 25 bp, Mus musculus
aagtttcaaccctgaatgctgcacc

SEQ ID NO: 71171 - DNA, 25 bp, Mus musculus
aagtttcacacaaggccagatatac

SEQ ID NO: 71172 - DNA, 25 bp, Mus musculus
aagtttcacacatggccagatatac

SEQ ID NO: 71173 - DNA, 25 bp, Mus musculus
aagtttcacaggagtgtttgcacat

SEQ ID NO: 71174 - DNA, 25 bp, Mus musculus
aagtttcacaggtgtgtttgcacat

SEQ ID NO: 71175 - DNA, 25 bp, Mus musculus
aagtttcacatcatgggcttgtttt

SEQ ID NO: 71176 - DNA, 25 bp, Mus musculus
aagtttcacatccaccatcagtggg

SEQ ID NO: 71177 - DNA, 25 bp, Mus musculus
aagtttcacatcgaccatcagtggg

SEQ ID NO: 71178 - DNA, 25 bp, Mus musculus
aagtttcacatcttgggcttgtttt

SEQ ID NO: 71179 - DNA, 25 bp, Mus musculus
aagtttcaccacacagactgccttt

SEQ ID NO: 71180 - DNA, 25 bp, Mus musculus
aagtttcaccactcagactgccttt

SEQ ID NO: 71181 - DNA, 25 bp, Mus musculus
aagtttcacgtcatggtgccttttg

SEQ ID NO: 71182 - DNA, 25 bp, Mus musculus
aagtttcacgtcttggtgccttttg

SEQ ID NO: 71183 - DNA, 25 bp, Mus musculus
aagtttcagaccagcctaggccact

SEQ ID NO: 71184 - DNA, 25 bp, Mus musculus
aagtttcagacctgcctaggccact

SEQ ID NO: 71185 - DNA, 25 bp, Mus musculus
aagtttcagatactctttcttcaaa

SEQ ID NO: 71186 - DNA, 25 bp, Mus musculus
aagtttcagatagtctttcttcaaa

SEQ ID NO: 71187 - DNA, 25 bp, Mus musculus
aagtttcagatcacacccaggatgt

SEQ ID NO: 71188 - DNA, 25 bp, Mus musculus
aagtttcagatctcacccaggatgt

SEQ ID NO: 71189 - DNA, 25 bp, Mus musculus
aagtttcagctgatattcacgtagg

SEQ ID NO: 71190 - DNA, 25 bp, Mus musculus
aagtttcagctgcattctgatcccc

SEQ ID NO: 71191 - DNA, 25 bp, Mus musculus
aagtttcagctggattctgatcccc

SEQ ID NO: 71192 - DNA, 25 bp, Mus musculus
aagtttcagctgttattcacgtagg

SEQ ID NO: 71193 - DNA, 25 bp, Mus musculus
aagtttcagcttctgtgcacaggct

SEQ ID NO: 71194 - DNA, 25 bp, Mus musculus
aagtttcagcttgtgtgcacaggct

SEQ ID NO: 71195 - DNA, 25 bp, Mus musculus
aagtttcagggtcgctgactgcttc

SEQ ID NO: 71196 - DNA, 25 bp, Mus musculus
aagtttcagggtggctgactgcttc

SEQ ID NO: 71197 - DNA, 25 bp, Mus musculus
aagtttcagtgtctcttctacaaaa

SEQ ID NO: 71198 - DNA, 25 bp, Mus musculus
aagtttcagtgtgtcttctacaaaa

SEQ ID NO: 71199 - DNA, 25 bp, Mus musculus
aagtttcataatacagtgctgtgga

SEQ ID NO: 71200 - DNA, 25 bp, Mus musculus
aagtttcataattcagtgctgtgga

SEQ ID NO: 71201 - DNA, 25 bp, Mus musculus
aagtttcatattacagcatctagtt

SEQ ID NO: 71202 - DNA, 25 bp, Mus musculus
aagtttcatatttcagcatctagtt

SEQ ID NO: 71203 - DNA, 25 bp, Mus musculus
aagtttcatcctattgtcaagttta

SEQ ID NO: 71204 - DNA, 25 bp, Mus musculus
aagtttcatccttttgtcaagttta

SEQ ID NO: 71205 - DNA, 25 bp, Mus musculus
aagtttcatgacaggcgagaggtat

SEQ ID NO: 71206 - DNA, 25 bp, Mus musculus
aagtttcatgactggcgagaggtat

SEQ ID NO: 71207 - DNA, 25 bp, Mus musculus
aagtttcatgagatcgctcctttgc

SEQ ID NO: 71208 - DNA, 25 bp, Mus musculus
aagtttcatgagttcgctcctttgc

SEQ ID NO: 71209 - DNA, 25 bp, Mus musculus
aagtttcatggcatggcgcacggct

SEQ ID NO: 71210 - DNA, 25 bp, Mus musculus
aagtttcatggcttggcgcacggct

SEQ ID NO: 71211 - DNA, 25 bp, Mus musculus
aagtttcatgtgatcatgttctgtt

SEQ ID NO: 71212 - DNA, 25 bp, Mus musculus
aagtttcatgtgttcatgttctgtt

SEQ ID NO: 71213 - DNA, 25 bp, Mus musculus
aagtttcatgttctttagttggtca

SEQ ID NO: 71214 - DNA, 25 bp, Mus musculus
aagtttcatgttgtttagttggtca

SEQ ID NO: 71215 - DNA, 25 bp, Mus musculus
aagtttcattagctacatggataca

SEQ ID NO: 71216 - DNA, 25 bp, Mus musculus
aagtttcattaggtacatggataca

SEQ ID NO: 71217 - DNA, 25 bp, Mus musculus
aagtttcattctatgtaatgcttag

SEQ ID NO: 71218 - DNA, 25 bp, Mus musculus
aagtttcattctttgtaatgcttag

SEQ ID NO: 71219 - DNA, 25 bp, Mus musculus
aagtttccaagacagtccgtgggat

SEQ ID NO: 71220 - DNA, 25 bp, Mus musculus
aagtttccaagagagtccgtgggat

SEQ ID NO: 71221 - DNA, 25 bp, Mus musculus
aagtttccacagagctggtcacagt

SEQ ID NO: 71222 - DNA, 25 bp, Mus musculus
aagtttccacagtgctggtcacagt

SEQ ID NO: 71223 - DNA, 25 bp, Mus musculus
aagtttccactcactagatccagta

SEQ ID NO: 71224 - DNA, 25 bp, Mus musculus
aagtttccactctctagatccagta

SEQ ID NO: 71225 - DNA, 25 bp, Mus musculus
aagtttccagaacaggccttttgct

SEQ ID NO: 71226 - DNA, 25 bp, Mus musculus
aagtttccagaagaggccttttgct

SEQ ID NO: 71227 - DNA, 25 bp, Mus musculus
aagtttccagcccacaggctaaaga

SEQ ID NO: 71228 - DNA, 25 bp, Mus musculus
aagtttccagccgacaggctaaaga

SEQ ID NO: 71229 - DNA, 25 bp, Mus musculus
aagtttccagcgcagttgaatctta

SEQ ID NO: 71230 - DNA, 25 bp, Mus musculus
aagtttccagcggagttgaatctta

SEQ ID NO: 71231 - DNA, 25 bp, Mus musculus
aagtttccagttatcggcttgcttg

SEQ ID NO: 71232 - DNA, 25 bp, Mus musculus
aagtttccagttttcggcttgcttg

SEQ ID NO: 71233 - DNA, 25 bp, Mus musculus
aagtttcccactagcagatgttcag

SEQ ID NO: 71234 - DNA, 25 bp, Mus musculus
aagtttcccacttgcagatgttcag

SEQ ID NO: 71235 - DNA, 25 bp, Mus musculus
aagtttcccagaccgacgcataaag

SEQ ID NO: 71236 - DNA, 25 bp, Mus musculus
aagtttcccagagcgacgcataaag

SEQ ID NO: 71237 - DNA, 25 bp, Mus musculus
aagtttccctggagctggcacgtca

SEQ ID NO: 71238 - DNA, 25 bp, Mus musculus
aagtttccctggtgctggcacgtca

SEQ ID NO: 71239 - DNA, 25 bp, Mus musculus
aagtttcctgaacgtgtggctctta

SEQ ID NO: 71240 - DNA, 25 bp, Mus musculus
aagtttcctgaaggtgtggctctta

SEQ ID NO: 71241 - DNA, 25 bp, Mus musculus
aagtttcgctttctgatcctctgaa

SEQ ID NO: 71242 - DNA, 25 bp, Mus musculus
aagtttcgctttgtgatcctctgaa

SEQ ID NO: 71243 - DNA, 25 bp, Mus musculus
aagtttctaaagacgatcccaccag

SEQ ID NO: 71244 - DNA, 25 bp, Mus musculus
aagtttctaaagtcgatcccaccag

SEQ ID NO: 71245 - DNA, 25 bp, Mus musculus
aagtttctaagaagctctgttggga

SEQ ID NO: 71246 - DNA, 25 bp, Mus musculus
aagtttctaagatgctctgttggga

SEQ ID NO: 71247 - DNA, 25 bp, Mus musculus
aagtttctagatcacactgactgaa

SEQ ID NO: 71248 - DNA, 25 bp, Mus musculus
aagtttctagatgacactgactgaa

SEQ ID NO: 71249 - DNA, 25 bp, Mus musculus
aagtttctagctcaggccacaggaa

SEQ ID NO: 71250 - DNA, 25 bp, Mus musculus
aagtttctagctgaggccacaggaa

SEQ ID NO: 71251 - DNA, 25 bp, Mus musculus
aagtttctaggcagcctgcccattt

SEQ ID NO: 71252 - DNA, 25 bp, Mus musculus
aagtttctaggctgcctgcccattt

SEQ ID NO: 71253 - DNA, 25 bp, Mus musculus
aagtttctagttctgttgctcctgt

SEQ ID NO: 71254 - DNA, 25 bp, Mus musculus
aagtttctagttgtgttgctcctgt

SEQ ID NO: 71255 - DNA, 25 bp, Mus musculus
aagtttctcagaaccttgtttcaaa

SEQ ID NO: 71256 - DNA, 25 bp, Mus musculus
aagtttctcagatccttgtttcaaa

SEQ ID NO: 71257 - DNA, 25 bp, Mus musculus
aagtttctcatcaggctttctgata

SEQ ID NO: 71258 - DNA, 25 bp, Mus musculus
aagtttctcatctggctttctgata

SEQ ID NO: 71259 - DNA, 25 bp, Mus musculus
aagtttctccatagacatgttgcat

SEQ ID NO: 71260 - DNA, 25 bp, Mus musculus
aagtttctccattgacatgttgcat

SEQ ID NO: 71261 - DNA, 25 bp, Mus musculus
aagtttctctctatgtactctggtc

SEQ ID NO: 71262 - DNA, 25 bp, Mus musculus
aagtttctctctttgtactctggtc

SEQ ID NO: 71263 - DNA, 25 bp, Mus musculus
aagtttctgacccaaccaagctaag

SEQ ID NO: 71264 - DNA, 25 bp, Mus musculus
aagtttctgaccgaaccaagctaag

SEQ ID NO: 71265 - DNA, 25 bp, Mus musculus
aagtttctgagtatctcccatactg

SEQ ID NO: 71266 - DNA, 25 bp, Mus musculus
aagtttctgagtttctcccatactg

SEQ ID NO: 71267 - DNA, 25 bp, Mus musculus
aagtttctgatcaaaatcccgtgaa

SEQ ID NO: 71268 - DNA, 25 bp, Mus musculus
aagtttctgatctaaatcccgtgaa

SEQ ID NO: 71269 - DNA, 25 bp, Mus musculus
aagtttctgcaacaggaggcgttca

SEQ ID NO: 71270 - DNA, 25 bp, Mus musculus
aagtttctgcaagaggaggcgttca

SEQ ID NO: 71271 - DNA, 25 bp, Mus musculus
aagtttctggccctggctcagggca

SEQ ID NO: 71272 - DNA, 25 bp, Mus musculus
aagtttctggccgtggctcagggca

SEQ ID NO: 71273 - DNA, 25 bp, Mus musculus
aagtttctggtacggactccactag

SEQ ID NO: 71274 - DNA, 25 bp, Mus musculus
aagtttctggtagggactccactag

SEQ ID NO: 71275 - DNA, 25 bp, Mus musculus
aagtttctgttccatggattccgct

SEQ ID NO: 71276 - DNA, 25 bp, Mus musculus
aagtttctgttcgatggattccgct

SEQ ID NO: 71277 - DNA, 25 bp, Mus musculus
aagtttctgttgacggcatgtggtg

SEQ ID NO: 71278 - DNA, 25 bp, Mus musculus
aagtttctgttgtcggcatgtggtg

SEQ ID NO: 71279 - DNA, 25 bp, Mus musculus
aagtttcttcgaactcaaggcttcc

SEQ ID NO: 71280 - DNA, 25 bp, Mus musculus
aagtttcttcgatctcaaggcttcc

SEQ ID NO: 71281 - DNA, 25 bp, Mus musculus
aagtttcttctgcatataagttcat

SEQ ID NO: 71282 - DNA, 25 bp, Mus musculus
aagtttcttctggatataagttcat

SEQ ID NO: 71283 - DNA, 25 bp, Mus musculus
aagtttcttgacactgagagccata

SEQ ID NO: 71284 - DNA, 25 bp, Mus musculus
aagtttcttgactctgagagccata

SEQ ID NO: 71285 - DNA, 25 bp, Mus musculus
aagtttctttcacggcttgaccgtg

SEQ ID NO: 71286 - DNA, 25 bp, Mus musculus
aagtttctttcagggcttgaccgtg

SEQ ID NO: 71287 - DNA, 25 bp, Mus musculus
aagtttcttttgctctactctaaag

SEQ ID NO: 71288 - DNA, 25 bp, Mus musculus
aagtttcttttggtctactctaaag

SEQ ID NO: 71289 - DNA, 25 bp, Mus musculus
aagtttgaactcacggtgaccctca

SEQ ID NO: 71290 - DNA, 25 bp, Mus musculus
aagtttgaactctcggtgaccctca

SEQ ID NO: 71291 - DNA, 25 bp, Mus musculus
aagtttgacaccatccggattctgg

SEQ ID NO: 71292 - DNA, 25 bp, Mus musculus
aagtttgacaccttccggattctgg

SEQ ID NO: 71293 - DNA, 25 bp, Mus musculus
aagtttgaccaaatcgagcagttca

SEQ ID NO: 71294 - DNA, 25 bp, Mus musculus
aagtttgaccaattcgagcagttca

SEQ ID NO: 71295 - DNA, 25 bp, Mus musculus
aagtttgacccaaaggtggatgata

SEQ ID NO: 71296 - DNA, 25 bp, Mus musculus
aagtttgacccataggtggatgata

SEQ ID NO: 71297 - DNA, 25 bp, Mus musculus
aagtttgacgagctgcaccagctga

SEQ ID NO: 71298 - DNA, 25 bp, Mus musculus
aagtttgacgaggtgcaccagctga

SEQ ID NO: 71299 - DNA, 25 bp, Mus musculus
aagtttgactacctgtttgctgaga

SEQ ID NO: 71300 - DNA, 25 bp, Mus musculus
aagtttgactacgtgtttgctgaga

SEQ ID NO: 71301 - DNA, 25 bp, Mus musculus
aagtttgactcaccgcatgtgcata

SEQ ID NO: 71302 - DNA, 25 bp, Mus musculus
aagtttgactcagcgcatgtgcata

SEQ ID NO: 71303 - DNA, 25 bp, Mus musculus
aagtttgagattatcctaggctaca

SEQ ID NO: 71304 - DNA, 25 bp, Mus musculus
aagtttgagattttcctaggctaca

SEQ ID NO: 71305 - DNA, 25 bp, Mus musculus
aagtttgagcaaatcctggacattt

SEQ ID NO: 71306 - DNA, 25 bp, Mus musculus
aagtttgagcaattcctggacattt

SEQ ID NO: 71307 - DNA, 25 bp, Mus musculus
aagtttgagccaaccagcttcaggt

SEQ ID NO: 71308 - DNA, 25 bp, Mus musculus
aagtttgagccatccagcttcaggt

SEQ ID NO: 71309 - DNA, 25 bp, Mus musculus
aagtttgagcgccccagaggccgaa

SEQ ID NO: 71310 - DNA, 25 bp, Mus musculus
aagtttgagcgcgccagaggccgaa

SEQ ID NO: 71311 - DNA, 25 bp, Mus musculus
aagtttgaggctcacaggccagcct

SEQ ID NO: 71312 - DNA, 25 bp, Mus musculus
aagtttgaggctgacaggccagcct

SEQ ID NO: 71313 - DNA, 25 bp, Mus musculus
aagtttgaggtgactggctggctac

SEQ ID NO: 71314 - DNA, 25 bp, Mus musculus
aagtttgaggtgtctggctggctac

SEQ ID NO: 71315 - DNA, 25 bp, Mus musculus
aagtttgagtcactccatccagaga

SEQ ID NO: 71316 - DNA, 25 bp, Mus musculus
aagtttgagtcagtccatccagaga

SEQ ID NO: 71317 - DNA, 25 bp, Mus musculus
aagtttgatcgactctcagtgtttc

SEQ ID NO: 71318 - DNA, 25 bp, Mus musculus
aagtttgatcgagtctcagtgtttc

SEQ ID NO: 71319 - DNA, 25 bp, Mus musculus
aagtttgatgtcctcaagctgccag

SEQ ID NO: 71320 - DNA, 25 bp, Mus musculus
aagtttgatgtcgtcaagctgccag

SEQ ID NO: 71321 - DNA, 25 bp, Mus musculus
aagtttgattttcagcagctcctct

SEQ ID NO: 71322 - DNA, 25 bp, Mus musculus
aagtttgattttgagcagctcctct

SEQ ID NO: 71323 - DNA, 25 bp, Mus musculus
aagtttgcaactccctttttcaggc

SEQ ID NO: 71324 - DNA, 25 bp, Mus musculus
aagtttgcaactgcctttttcaggc

SEQ ID NO: 71325 - DNA, 25 bp, Mus musculus
aagtttgcaagcagacctggctgac

SEQ ID NO: 71326 - DNA, 25 bp, Mus musculus
aagtttgcaagctgacctggctgac

SEQ ID NO: 71327 - DNA, 25 bp, Mus musculus
aagtttgcacgaagccattctgggc

SEQ ID NO: 71328 - DNA, 25 bp, Mus musculus
aagtttgcacgatgccattctgggc

SEQ ID NO: 71329 - DNA, 25 bp, Mus musculus
aagtttgcactcactggtagagtac

SEQ ID NO: 71330 - DNA, 25 bp, Mus musculus
aagtttgcactctctggtagagtac

SEQ ID NO: 71331 - DNA, 25 bp, Mus musculus
aagtttgcagccagacttccagact

SEQ ID NO: 71332 - DNA, 25 bp, Mus musculus
aagtttgcagcctgacttccagact

SEQ ID NO: 71333 - DNA, 25 bp, Mus musculus
aagtttgcagtgcacaggagacttt

SEQ ID NO: 71334 - DNA, 25 bp, Mus musculus
aagtttgcagtgctcttcaacccca

SEQ ID NO: 71335 - DNA, 25 bp, Mus musculus
aagtttgcagtggacaggagacttt

SEQ ID NO: 71336 - DNA, 25 bp, Mus musculus
aagtttgcagtggtcttcaacccca

SEQ ID NO: 71337 - DNA, 25 bp, Mus musculus
aagtttgccaacacagtttcaatcc

SEQ ID NO: 71338 - DNA, 25 bp, Mus musculus
aagtttgccaactcagtttcaatcc

SEQ ID NO: 71339 - DNA, 25 bp, Mus musculus
aagtttgcccaacatatttgctata

SEQ ID NO: 71340 - DNA, 25 bp, Mus musculus
aagtttgcccaagatatttgctata

SEQ ID NO: 71341 - DNA, 25 bp, Mus musculus
aagtttgccccactctgagatgtgc

SEQ ID NO: 71342 - DNA, 25 bp, Mus musculus
aagtttgccccagtctgagatgtgc

SEQ ID NO: 71343 - DNA, 25 bp, Mus musculus
aagtttgccctcaccacaaaagaag

SEQ ID NO: 71344 - DNA, 25 bp, Mus musculus
aagtttgccctctccacaaaagaag

SEQ ID NO: 71345 - DNA, 25 bp, Mus musculus
aagtttgccctgagcatgtgtgtcc

SEQ ID NO: 71346 - DNA, 25 bp, Mus musculus
aagtttgccctgtgcatgtgtgtcc

SEQ ID NO: 71347 - DNA, 25 bp, Mus musculus
aagtttgccttaatatacatgtgaa

SEQ ID NO: 71348 - DNA, 25 bp, Mus musculus
aagtttgccttattatacatgtgaa

SEQ ID NO: 71349 - DNA, 25 bp, Mus musculus
aagtttgcgcgcagcgacgagcgca

SEQ ID NO: 71350 - DNA, 25 bp, Mus musculus
aagtttgcgcgctgcgacgagcgca

SEQ ID NO: 71351 - DNA, 25 bp, Mus musculus
aagtttgctacaagatcctgcctgt

SEQ ID NO: 71352 - DNA, 25 bp, Mus musculus
aagtttgctacatgatcctgcctgt

SEQ ID NO: 71353 - DNA, 25 bp, Mus musculus
aagtttgctcagatgtttcagtgct

SEQ ID NO: 71354 - DNA, 25 bp, Mus musculus
aagtttgctcagttgtttcagtgct

SEQ ID NO: 71355 - DNA, 25 bp, Mus musculus
aagtttgctctcagcttggactagt

SEQ ID NO: 71356 - DNA, 25 bp, Mus musculus
aagtttgctctctgcttggactagt

SEQ ID NO: 71357 - DNA, 25 bp, Mus musculus
aagtttgctctgcttttttgatgct

SEQ ID NO: 71358 - DNA, 25 bp, Mus musculus
aagtttgctctggttttttgatgct

SEQ ID NO: 71359 - DNA, 25 bp, Mus musculus
aagtttgctgcacgatacatagaat

SEQ ID NO: 71360 - DNA, 25 bp, Mus musculus
aagtttgctgcaggatacatagaat

SEQ ID NO: 71361 - DNA, 25 bp, Mus musculus
aagtttgctgttccattccagtgga

SEQ ID NO: 71362 - DNA, 25 bp, Mus musculus
aagtttgctgttgcattccagtgga

SEQ ID NO: 71363 - DNA, 25 bp, Mus musculus
aagtttgcttagagcatgatgtcat

SEQ ID NO: 71364 - DNA, 25 bp, Mus musculus
aagtttgcttagtgcatgatgtcat

SEQ ID NO: 71365 - DNA, 25 bp, Mus musculus
aagtttgctttcacccaaacagcca

SEQ ID NO: 71366 - DNA, 25 bp, Mus musculus
aagtttgctttctcccaaacagcca

SEQ ID NO: 71367 - DNA, 25 bp, Mus musculus
aagtttggactacctcatctcatgg

SEQ ID NO: 71368 - DNA, 25 bp, Mus musculus
aagtttggactagctcatctcatgg

SEQ ID NO: 71369 - DNA, 25 bp, Mus musculus
aagtttggagctccagtacttccca

SEQ ID NO: 71370 - DNA, 25 bp, Mus musculus
aagtttggagctgcagtacttccca

SEQ ID NO: 71371 - DNA, 25 bp, Mus musculus
aagtttggagtaagcaccggcatta

SEQ ID NO: 71372 - DNA, 25 bp, Mus musculus
aagtttggagtatgcaccggcatta

SEQ ID NO: 71373 - DNA, 25 bp, Mus musculus
aagtttggatttccctgagttgaca

SEQ ID NO: 71374 - DNA, 25 bp, Mus musculus
aagtttggatttgcctgagttgaca

SEQ ID NO: 71375 - DNA, 25 bp, Mus musculus
aagtttggcaaaccacctttatcca

SEQ ID NO: 71376 - DNA, 25 bp, Mus musculus
aagtttggcaaagcacctttatcca

SEQ ID NO: 71377 - DNA, 25 bp, Mus musculus
aagtttggcaacagctctaagcaca

SEQ ID NO: 71378 - DNA, 25 bp, Mus musculus
aagtttggcaactgctctaagcaca

SEQ ID NO: 71379 - DNA, 25 bp, Mus musculus
aagtttggccaacccattagcctgc

SEQ ID NO: 71380 - DNA, 25 bp, Mus musculus
aagtttggccaagccattagcctgc

SEQ ID NO: 71381 - DNA, 25 bp, Mus musculus
aagtttggccataggtagcagctaa

SEQ ID NO: 71382 - DNA, 25 bp, Mus musculus
aagtttggccattggtagcagctaa

SEQ ID NO: 71383 - DNA, 25 bp, Mus musculus
aagtttggcccaagaatcatctcta

SEQ ID NO: 71384 - DNA, 25 bp, Mus musculus
aagtttggcccactcatttttgtat

SEQ ID NO: 71385 - DNA, 25 bp, Mus musculus
aagtttggcccagtcatttttgtat

SEQ ID NO: 71386 - DNA, 25 bp, Mus musculus
aagtttggcccatgaatcatctcta

SEQ ID NO: 71387 - DNA, 25 bp, Mus musculus
aagtttggcctcctgcctggaatca

SEQ ID NO: 71388 - DNA, 25 bp, Mus musculus
aagtttggcctcgtgcctggaatca

SEQ ID NO: 71389 - DNA, 25 bp, Mus musculus
aagtttgggaagaatgctcgtggat

SEQ ID NO: 71390 - DNA, 25 bp, Mus musculus
aagtttgggaagtatgctcgtggat

SEQ ID NO: 71391 - DNA, 25 bp, Mus musculus
aagtttgggcagatctggtgactaa

SEQ ID NO: 71392 - DNA, 25 bp, Mus musculus
aagtttgggcagttctggtgactaa

SEQ ID NO: 71393 - DNA, 25 bp, Mus musculus
aagtttgggcttctaacctggatga

SEQ ID NO: 71394 - DNA, 25 bp, Mus musculus
aagtttgggcttgtaacctggatga

SEQ ID NO: 71395 - DNA, 25 bp, Mus musculus
aagtttgggttcacctggtgtcagg

SEQ ID NO: 71396 - DNA, 25 bp, Mus musculus
aagtttgggttctcctggtgtcagg

SEQ ID NO: 71397 - DNA, 25 bp, Mus musculus
aagtttggtcttaccaccttcagtg

SEQ ID NO: 71398 - DNA, 25 bp, Mus musculus
aagtttggtctttccaccttcagtg

SEQ ID NO: 71399 - DNA, 25 bp, Mus musculus
aagtttggtgctaatcttctaataa

SEQ ID NO: 71400 - DNA, 25 bp, Mus musculus
aagtttggtgcttatcttctaataa

SEQ ID NO: 71401 - DNA, 25 bp, Mus musculus
aagtttggtggcaggtgtcctcaac

SEQ ID NO: 71402 - DNA, 25 bp, Mus musculus
aagtttggtggctggtgtcctcaac

SEQ ID NO: 71403 - DNA, 25 bp, Mus musculus
aagtttgtacacagacctaagtctc

SEQ ID NO: 71404 - DNA, 25 bp, Mus musculus
aagtttgtacactgacctaagtctc

SEQ ID NO: 71405 - DNA, 25 bp, Mus musculus
aagtttgtagctcggcacatccaca

SEQ ID NO: 71406 - DNA, 25 bp, Mus musculus
aagtttgtagctgggcacatccaca

SEQ ID NO: 71407 - DNA, 25 bp, Mus musculus
aagtttgtatgcatctatgtgtata

SEQ ID NO: 71408 - DNA, 25 bp, Mus musculus
aagtttgtatgcttctatgtgtata

SEQ ID NO: 71409 - DNA, 25 bp, Mus musculus
aagtttgtcagtcaccatcccgagc

SEQ ID NO: 71410 - DNA, 25 bp, Mus musculus
aagtttgtcagtcatgaacgctaca

SEQ ID NO: 71411 - DNA, 25 bp, Mus musculus
aagtttgtcagtgaccatcccgagc

SEQ ID NO: 71412 - DNA, 25 bp, Mus musculus
aagtttgtcagtgatgaacgctaca

SEQ ID NO: 71413 - DNA, 25 bp, Mus musculus
aagtttgtcgatctcttgccaaagg

SEQ ID NO: 71414 - DNA, 25 bp, Mus musculus
aagtttgtcgatgtcttgccaaagg

SEQ ID NO: 71415 - DNA, 25 bp, Mus musculus
aagtttgtgaccagtctgaactaca

SEQ ID NO: 71416 - DNA, 25 bp, Mus musculus
aagtttgtgacctgtctgaactaca

SEQ ID NO: 71417 - DNA, 25 bp, Mus musculus
aagtttgtgactagcctgagataca

SEQ ID NO: 71418 - DNA, 25 bp, Mus musculus
aagtttgtgacttgcctgagataca

SEQ ID NO: 71419 - DNA, 25 bp, Mus musculus
aagtttgtgccacaggatgtcccac

SEQ ID NO: 71420 - DNA, 25 bp, Mus musculus
aagtttgtgccagaggatgtcccac

SEQ ID NO: 71421 - DNA, 25 bp, Mus musculus
aagtttgtggctccctttctgtgaa

SEQ ID NO: 71422 - DNA, 25 bp, Mus musculus
aagtttgtggctgcctttctgtgaa

SEQ ID NO: 71423 - DNA, 25 bp, Mus musculus
aagtttgtggtcctggcagacccta

SEQ ID NO: 71424 - DNA, 25 bp, Mus musculus
aagtttgtggtcgtggcagacccta

SEQ ID NO: 71425 - DNA, 25 bp, Mus musculus
aagtttgtgttgaaccagcgcatgc

SEQ ID NO: 71426 - DNA, 25 bp, Mus musculus
aagtttgtgttgtaccagcgcatgc

SEQ ID NO: 71427 - DNA, 25 bp, Mus musculus
aagtttgttgctccttcctatgata

SEQ ID NO: 71428 - DNA, 25 bp, Mus musculus
aagtttgttgctgcttcctatgata

SEQ ID NO: 71429 - DNA, 25 bp, Mus musculus
aagtttgttggcctttgtgtccttg

SEQ ID NO: 71430 - DNA, 25 bp, Mus musculus
aagtttgttggcgtttgtgtccttg

SEQ ID NO: 71431 - DNA, 25 bp, Mus musculus
aagttttacaaaatcaaggtgatat

SEQ ID NO: 71432 - DNA, 25 bp, Mus musculus
aagttttacaaattcaaggtgatat

SEQ ID NO: 71433 - DNA, 25 bp, Mus musculus
aagttttacaacagcttgccaagct

SEQ ID NO: 71434 - DNA, 25 bp, Mus musculus
aagttttacaactgcttgccaagct

SEQ ID NO: 71435 - DNA, 25 bp, Mus musculus
aagttttacaagcattaccctcctg

SEQ ID NO: 71436 - DNA, 25 bp, Mus musculus
aagttttacaaggattaccctcctg

SEQ ID NO: 71437 - DNA, 25 bp, Mus musculus
aagttttacattactcaagtggaca

SEQ ID NO: 71438 - DNA, 25 bp, Mus musculus
aagttttacatttctcaagtggaca

SEQ ID NO: 71439 - DNA, 25 bp, Mus musculus
aagttttagatccaatctgcctcaa

SEQ ID NO: 71440 - DNA, 25 bp, Mus musculus
aagttttagatcgaatctgcctcaa

SEQ ID NO: 71441 - DNA, 25 bp, Mus musculus
aagttttagtgccatgtcgctgtag

SEQ ID NO: 71442 - DNA, 25 bp, Mus musculus
aagttttagtgcgatgtcgctgtag

SEQ ID NO: 71443 - DNA, 25 bp, Mus musculus
aagttttatactctaggctggcctt

SEQ ID NO: 71444 - DNA, 25 bp, Mus musculus
aagttttatactgtaggctggcctt

SEQ ID NO: 71445 - DNA, 25 bp, Mus musculus
aagttttcaaatccacctactcctg

SEQ ID NO: 71446 - DNA, 25 bp, Mus musculus
aagttttcaaatgcacctactcctg

SEQ ID NO: 71447 - DNA, 25 bp, Mus musculus
aagttttcacacaacctggcataaa

SEQ ID NO: 71448 - DNA, 25 bp, Mus musculus
aagttttcacactacctggcataaa

SEQ ID NO: 71449 - DNA, 25 bp, Mus musculus
aagttttcacagctattgcagacca

SEQ ID NO: 71450 - DNA, 25 bp, Mus musculus
aagttttcacaggtattgcagacca

SEQ ID NO: 71451 - DNA, 25 bp, Mus musculus
aagttttcacgtatctggaggcaat

SEQ ID NO: 71452 - DNA, 25 bp, Mus musculus
aagttttcacgtttctggaggcaat

SEQ ID NO: 71453 - DNA, 25 bp, Mus musculus
aagttttccaccactgttactagat

SEQ ID NO: 71454 - DNA, 25 bp, Mus musculus
aagttttccacctctgttactagat

SEQ ID NO: 71455 - DNA, 25 bp, Mus musculus
aagttttcccagaaaagagatgcac

SEQ ID NO: 71456 - DNA, 25 bp, Mus musculus
aagttttcccagtaaagagatgcac

SEQ ID NO: 71457 - DNA, 25 bp, Mus musculus
aagttttcgtccatcagagcagcat

SEQ ID NO: 71458 - DNA, 25 bp, Mus musculus
aagttttcgtccttcagagcagcat

SEQ ID NO: 71459 - DNA, 25 bp, Mus musculus
aagttttcgttcatagagtctgtca

SEQ ID NO: 71460 - DNA, 25 bp, Mus musculus
aagttttcgttcttagagtctgtca

SEQ ID NO: 71461 - DNA, 25 bp, Mus musculus
aagttttctcagagcagctttccct

SEQ ID NO: 71462 - DNA, 25 bp, Mus musculus
aagttttctcagtgcagctttccct

SEQ ID NO: 71463 - DNA, 25 bp, Mus musculus
aagttttctccactgaactatcact

SEQ ID NO: 71464 - DNA, 25 bp, Mus musculus
aagttttctccagtgaactatcact

SEQ ID NO: 71465 - DNA, 25 bp, Mus musculus
aagttttctcttcagcagtgctctc

SEQ ID NO: 71466 - DNA, 25 bp, Mus musculus
aagttttctcttgagcagtgctctc

SEQ ID NO: 71467 - DNA, 25 bp, Mus musculus
aagttttctgccagaagttcatgag

SEQ ID NO: 71468 - DNA, 25 bp, Mus musculus
aagttttctgcctgaagttcatgag

SEQ ID NO: 71469 - DNA, 25 bp, Mus musculus
aagttttctgctaccagtttcagag

SEQ ID NO: 71470 - DNA, 25 bp, Mus musculus
aagttttctgcttccagtttcagag

SEQ ID NO: 71471 - DNA, 25 bp, Mus musculus
aagttttctggcagggtattgcacc

SEQ ID NO: 71472 - DNA, 25 bp, Mus musculus
aagttttctggctgggtattgcacc

SEQ ID NO: 71473 - DNA, 25 bp, Mus musculus
aagttttctggtcatgtcttcctta

SEQ ID NO: 71474 - DNA, 25 bp, Mus musculus
aagttttctggtgatgtcttcctta

SEQ ID NO: 71475 - DNA, 25 bp, Mus musculus
aagttttctttacagtcaatcacga

SEQ ID NO: 71476 - DNA, 25 bp, Mus musculus
aagttttctttagagtcaatcacga

SEQ ID NO: 71477 - DNA, 25 bp, Mus musculus
aagttttgatcgatctccatccttg

SEQ ID NO: 71478 - DNA, 25 bp, Mus musculus
aagttttgatcgttctccatccttg

SEQ ID NO: 71479 - DNA, 25 bp, Mus musculus
aagttttgcatgatcatcacacaga

SEQ ID NO: 71480 - DNA, 25 bp, Mus musculus
aagttttgcatgttcatcacacaga

SEQ ID NO: 71481 - DNA, 25 bp, Mus musculus
aagttttggacccactgcgtactag

SEQ ID NO: 71482 - DNA, 25 bp, Mus musculus
aagttttggaccgactgcgtactag

SEQ ID NO: 71483 - DNA, 25 bp, Mus musculus
aagttttggtgtccttccatgtact

SEQ ID NO: 71484 - DNA, 25 bp, Mus musculus
aagttttggtgtgcttccatgtact

SEQ ID NO: 71485 - DNA, 25 bp, Mus musculus
aagttttgtgtaaattccagtctgt

SEQ ID NO: 71486 - DNA, 25 bp, Mus musculus
aagttttgtgtatattccagtctgt

SEQ ID NO: 71487 - DNA, 25 bp, Mus musculus
aagttttgtttcctgctgaatccgg

SEQ ID NO: 71488 - DNA, 25 bp, Mus musculus
aagttttgtttcgtgctgaatccgg

SEQ ID NO: 71489 - DNA, 25 bp, Mus musculus
aagttttgtttgcaatcagagcgca

SEQ ID NO: 71490 - DNA, 25 bp, Mus musculus
aagttttgtttggaatcagagcgca

SEQ ID NO: 71491 - DNA, 25 bp, Mus musculus
aagtttttacaaccacagcatggag

SEQ ID NO: 71492 - DNA, 25 bp, Mus musculus
aagtttttacaagcacagcatggag

SEQ ID NO: 71493 - DNA, 25 bp, Mus musculus
aagtttttagagctcccagctgaga

SEQ ID NO: 71494 - DNA, 25 bp, Mus musculus
aagtttttagaggtcccagctgaga

SEQ ID NO: 71495 - DNA, 25 bp, Mus musculus
aagtttttcattctgccttctccaa

SEQ ID NO: 71496 - DNA, 25 bp, Mus musculus
aagtttttcattgtgccttctccaa

SEQ ID NO: 71497 - DNA, 25 bp, Mus musculus
aagtttttccacagcttgctaaatc

SEQ ID NO: 71498 - DNA, 25 bp, Mus musculus
aagtttttccactgcttgctaaatc

SEQ ID NO: 71499 - DNA, 25 bp, Mus musculus
aagtttttctgcaactttgctgcta

SEQ ID NO: 71500 - DNA, 25 bp, Mus musculus
aagtttttctgctactttgctgcta

SEQ ID NO: 71501 - DNA, 25 bp, Mus musculus
aagtttttctggacattgtgtggca

SEQ ID NO: 71502 - DNA, 25 bp, Mus musculus
aagtttttctggtcattgtgtggca

SEQ ID NO: 71503 - DNA, 25 bp, Mus musculus
aagtttttgcaacatgtctcctaga

SEQ ID NO: 71504 - DNA, 25 bp, Mus musculus
aagtttttgcaagatgtctcctaga

SEQ ID NO: 71505 - DNA, 25 bp, Mus musculus
aagtttttggagatatttctcactg

SEQ ID NO: 71506 - DNA, 25 bp, Mus musculus
aagtttttggagttatttctcactg

SEQ ID NO: 71507 - DNA, 25 bp, Mus musculus
aagttttttgcaagtgtgtacacat

SEQ ID NO: 71508 - DNA, 25 bp, Mus musculus
aagttttttgcatgtgtgtacacat

SEQ ID NO: 71509 - DNA, 25 bp, Mus musculus
aataaaaacgctactctcctcaagt

SEQ ID NO: 71510 - DNA, 25 bp, Mus musculus
aataaaaacgcttctctcctcaagt

SEQ ID NO: 71511 - DNA, 25 bp, Mus musculus
aataaaaacgttctcaggccatcaa

SEQ ID NO: 71512 - DNA, 25 bp, Mus musculus
aataaaaacgttgtcaggccatcaa

SEQ ID NO: 71513 - DNA, 25 bp, Mus musculus
aataaaaagctcatgaccccacaca

SEQ ID NO: 71514 - DNA, 25 bp, Mus musculus
aataaaaagctcttgaccccacaca

SEQ ID NO: 71515 - DNA, 25 bp, Mus musculus
aataaaaataagatctgatgctctc

SEQ ID NO: 71516 - DNA, 25 bp, Mus musculus
aataaaaataagttctgatgctctc

SEQ ID NO: 71517 - DNA, 25 bp, Mus musculus
aataaaaatggtccggctggcttca

SEQ ID NO: 71518 - DNA, 25 bp, Mus musculus
aataaaaatggtgcggctggcttca

SEQ ID NO: 71519 - DNA, 25 bp, Mus musculus
aataaaaccttgaatggtgtgcggt

SEQ ID NO: 71520 - DNA, 25 bp, Mus musculus
aataaaaccttgtatggtgtgcggt

SEQ ID NO: 71521 - DNA, 25 bp, Mus musculus
aataaaagactcctgcaacctacct

SEQ ID NO: 71522 - DNA, 25 bp, Mus musculus
aataaaagactcgtgcaacctacct

SEQ ID NO: 71523 - DNA, 25 bp, Mus musculus
aataaaaggtacatcctctccacat

SEQ ID NO: 71524 - DNA, 25 bp, Mus musculus
aataaaaggtacttcctctccacat

SEQ ID NO: 71525 - DNA, 25 bp, Mus musculus
aataaaagtaccacaggctgggcgt

SEQ ID NO: 71526 - DNA, 25 bp, Mus musculus
aataaaagtacctcaggctgggcgt

SEQ ID NO: 71527 - DNA, 25 bp, Mus musculus
aataaaataattcccgtgtgtcaat

SEQ ID NO: 71528 - DNA, 25 bp, Mus musculus
aataaaataattgccgtgtgtcaat

SEQ ID NO: 71529 - DNA, 25 bp, Mus musculus
aataaaatacgtctccatttcttca

SEQ ID NO: 71530 - DNA, 25 bp, Mus musculus
aataaaatacgtgtccatttcttca

SEQ ID NO: 71531 - DNA, 25 bp, Mus musculus
aataaaatactgaggccctcctact

SEQ ID NO: 71532 - DNA, 25 bp, Mus musculus
aataaaatactgtggccctcctact

SEQ ID NO: 71533 - DNA, 25 bp, Mus musculus
aataaaatgctgctcacaaaagtca

SEQ ID NO: 71534 - DNA, 25 bp, Mus musculus
aataaaatgctggtcacaaaagtca

SEQ ID NO: 71535 - DNA, 25 bp, Mus musculus
aataaaatgtcacttgcctaccggg

SEQ ID NO: 71536 - DNA, 25 bp, Mus musculus
aataaaatgtcagttgcctaccggg

SEQ ID NO: 71537 - DNA, 25 bp, Mus musculus
aataaaattctcaccttcaagcatg

SEQ ID NO: 71538 - DNA, 25 bp, Mus musculus
aataaaattctccacattccatgag

SEQ ID NO: 71539 - DNA, 25 bp, Mus musculus
aataaaattctcgacattccatgag

SEQ ID NO: 71540 - DNA, 25 bp, Mus musculus
aataaaattctctccttcaagcatg

SEQ ID NO: 71541 - DNA, 25 bp, Mus musculus
aataaaattggcactttgcacacac

SEQ ID NO: 71542 - DNA, 25 bp, Mus musculus
aataaaattggctctttgcacacac

SEQ ID NO: 71543 - DNA, 25 bp, Mus musculus
aataaaattgttccctgcttctgag

SEQ ID NO: 71544 - DNA, 25 bp, Mus musculus
aataaaattgttgcctgcttctgag

SEQ ID NO: 71545 - DNA, 25 bp, Mus musculus
aataaacaagccagccaagcctgag

SEQ ID NO: 71546 - DNA, 25 bp, Mus musculus
aataaacaagcctgccaagcctgag

SEQ ID NO: 71547 - DNA, 25 bp, Mus musculus
aataaacacacccagggccacttcg

SEQ ID NO: 71548 - DNA, 25 bp, Mus musculus
aataaacacaccgagggccacttcg

SEQ ID NO: 71549 - DNA, 25 bp, Mus musculus
aataaacaccaacagctgatgagag

SEQ ID NO: 71550 - DNA, 25 bp, Mus musculus
aataaacaccaagagctgatgagag

SEQ ID NO: 71551 - DNA, 25 bp, Mus musculus
aataaacagcagaactccatggcct

SEQ ID NO: 71552 - DNA, 25 bp, Mus musculus
aataaacagcagtactccatggcct

SEQ ID NO: 71553 - DNA, 25 bp, Mus musculus
aataaacaggttactcgcacctcag

SEQ ID NO: 71554 - DNA, 25 bp, Mus musculus
aataaacaggtttctcgcacctcag

SEQ ID NO: 71555 - DNA, 25 bp, Mus musculus
aataaaccaacactctttcttgtgt

SEQ ID NO: 71556 - DNA, 25 bp, Mus musculus
aataaaccaacagtctttcttgtgt

SEQ ID NO: 71557 - DNA, 25 bp, Mus musculus
aataaaccaagtagtggtggtggca

SEQ ID NO: 71558 - DNA, 25 bp, Mus musculus
aataaaccaagttgtggtggtggca

SEQ ID NO: 71559 - DNA, 25 bp, Mus musculus
aataaaccatgtccgagcgaacgac

SEQ ID NO: 71560 - DNA, 25 bp, Mus musculus
aataaaccatgtgcgagcgaacgac

SEQ ID NO: 71561 - DNA, 25 bp, Mus musculus
aataaacccactagtccaaagccag

SEQ ID NO: 71562 - DNA, 25 bp, Mus musculus
aataaacccacttgtccaaagccag

SEQ ID NO: 71563 - DNA, 25 bp, Mus musculus
aataaaccccacacataatagcctc

SEQ ID NO: 71564 - DNA, 25 bp, Mus musculus
aataaaccccactcataatagcctc

SEQ ID NO: 71565 - DNA, 25 bp, Mus musculus
aataaacctgctagtcgttcagcgc

SEQ ID NO: 71566 - DNA, 25 bp, Mus musculus
aataaacctgcttgtcgttcagcgc

SEQ ID NO: 71567 - DNA, 25 bp, Mus musculus
aataaacctggtccctcctaagctg

SEQ ID NO: 71568 - DNA, 25 bp, Mus musculus
aataaacctggtgcctcctaagctg

SEQ ID NO: 71569 - DNA, 25 bp, Mus musculus
aataaacctgtgatgctgtcaccgt

SEQ ID NO: 71570 - DNA, 25 bp, Mus musculus
aataaacctgtgttgctgtcaccgt

SEQ ID NO: 71571 - DNA, 25 bp, Mus musculus
aataaaccttccatccaactgtagt

SEQ ID NO: 71572 - DNA, 25 bp, Mus musculus
aataaaccttccttccaactgtagt

SEQ ID NO: 71573 - DNA, 25 bp, Mus musculus
aataaacgaaaccattcctgcctcg

SEQ ID NO: 71574 - DNA, 25 bp, Mus musculus
aataaacgaaacgattcctgcctcg

SEQ ID NO: 71575 - DNA, 25 bp, Mus musculus
aataaacgccttcgtcaggtcagca

SEQ ID NO: 71576 - DNA, 25 bp, Mus musculus
aataaacgccttggtcaggtcagca

SEQ ID NO: 71577 - DNA, 25 bp, Mus musculus
aataaacgctcactccattagcggg

SEQ ID NO: 71578 - DNA, 25 bp, Mus musculus
aataaacgctcagtccattagcggg

SEQ ID NO: 71579 - DNA, 25 bp, Mus musculus
aataaactatgcacctatatgaaaa

SEQ ID NO: 71580 - DNA, 25 bp, Mus musculus
aataaactatgctcctatatgaaaa

SEQ ID NO: 71581 - DNA, 25 bp, Mus musculus
aataaactcactctcagccttctgt

SEQ ID NO: 71582 - DNA, 25 bp, Mus musculus
aataaactcactgtcagccttctgt

SEQ ID NO: 71583 - DNA, 25 bp, Mus musculus
aataaactgggcacgctccatggag

SEQ ID NO: 71584 - DNA, 25 bp, Mus musculus
aataaactgggctcgctccatggag

SEQ ID NO: 71585 - DNA, 25 bp, Mus musculus
aataaactgtacaccaccatgcacg

SEQ ID NO: 71586 - DNA, 25 bp, Mus musculus
aataaactgtactccaccatgcacg

SEQ ID NO: 71587 - DNA, 25 bp, Mus musculus
aataaactgtcaacctgggctctca

SEQ ID NO: 71588 - DNA, 25 bp, Mus musculus
aataaactgtcatcctgggctctca

SEQ ID NO: 71589 - DNA, 25 bp, Mus musculus
aataaactgttcacctggtcaccat

SEQ ID NO: 71590 - DNA, 25 bp, Mus musculus
aataaactgttctcctggtcaccat

SEQ ID NO: 71591 - DNA, 25 bp, Mus musculus
aataaagacgcacggttgctgatgt

SEQ ID NO: 71592 - DNA, 25 bp, Mus musculus
aataaagacgcagggttgctgatgt

SEQ ID NO: 71593 - DNA, 25 bp, Mus musculus
aataaagagaagacagccctgctgc

SEQ ID NO: 71594 - DNA, 25 bp, Mus musculus
aataaagagaagtcagccctgctgc

SEQ ID NO: 71595 - DNA, 25 bp, Mus musculus
aataaagcaccaccgtgggcatctg

SEQ ID NO: 71596 - DNA, 25 bp, Mus musculus
aataaagcaccagcgtgggcatctg

SEQ ID NO: 71597 - DNA, 25 bp, Mus musculus
aataaagcactcagctgtggagaag

SEQ ID NO: 71598 - DNA, 25 bp, Mus musculus
aataaagcactctgctgtggagaag

SEQ ID NO: 71599 - DNA, 25 bp, Mus musculus
aataaagcagacatgtaagagagga

SEQ ID NO: 71600 - DNA, 25 bp, Mus musculus
aataaagcagacttgtaagagagga

SEQ ID NO: 71601 - DNA, 25 bp, Mus musculus
aataaagcatcgagcacacaccctt

SEQ ID NO: 71602 - DNA, 25 bp, Mus musculus
aataaagcatcgtgcacacaccctt

SEQ ID NO: 71603 - DNA, 25 bp, Mus musculus
aataaagctgctagtgtcacccgtg

SEQ ID NO: 71604 - DNA, 25 bp, Mus musculus
aataaagctgcttgtgtcacccgtg

SEQ ID NO: 71605 - DNA, 25 bp, Mus musculus
aataaaggtgttccctgtgcccatc

SEQ ID NO: 71606 - DNA, 25 bp, Mus musculus
aataaaggtgttgcctgtgcccatc

SEQ ID NO: 71607 - DNA, 25 bp, Mus musculus
aataaagtaacacacccatcatcta

SEQ ID NO: 71608 - DNA, 25 bp, Mus musculus
aataaagtaacagacccatcatcta

SEQ ID NO: 71609 - DNA, 25 bp, Mus musculus
aataaagtacgtagctctgtctccc

SEQ ID NO: 71610 - DNA, 25 bp, Mus musculus
aataaagtacgttgctctgtctccc

SEQ ID NO: 71611 - DNA, 25 bp, Mus musculus
aataaagtcagtcctgagagccagg

SEQ ID NO: 71612 - DNA, 25 bp, Mus musculus
aataaagtcagtgctgagagccagg

SEQ ID NO: 71613 - DNA, 25 bp, Mus musculus
aataaagtcctcacctgggcttcat

SEQ ID NO: 71614 - DNA, 25 bp, Mus musculus
aataaagtcctctcctgggcttcat

SEQ ID NO: 71615 - DNA, 25 bp, Mus musculus
aataaagtccttagtgattattgta

SEQ ID NO: 71616 - DNA, 25 bp, Mus musculus
aataaagtcctttgtgattattgta

SEQ ID NO: 71617 - DNA, 25 bp, Mus musculus
aataaagtcgatctttggtcagtgg

SEQ ID NO: 71618 - DNA, 25 bp, Mus musculus
aataaagtcgatgtttggtcagtgg

SEQ ID NO: 71619 - DNA, 25 bp, Mus musculus
aataaagtcgctccccaaggggagg

SEQ ID NO: 71620 - DNA, 25 bp, Mus musculus
aataaagtcgctgcccaaggggagg

SEQ ID NO: 71621 - DNA, 25 bp, Mus musculus
aataaagtctccattcatccgttgc

SEQ ID NO: 71622 - DNA, 25 bp, Mus musculus
aataaagtctcctttcatccgttgc

SEQ ID NO: 71623 - DNA, 25 bp, Mus musculus
aataaagtggccactgagttcctgc

SEQ ID NO: 71624 - DNA, 25 bp, Mus musculus
aataaagtggcctctgagttcctgc

SEQ ID NO: 71625 - DNA, 25 bp, Mus musculus
aataaagttgccagcctagaccatg

SEQ ID NO: 71626 - DNA, 25 bp, Mus musculus
aataaagttgcctgcctagaccatg

SEQ ID NO: 71627 - DNA, 25 bp, Mus musculus
aataaagtttgccttcccctcagag

SEQ ID NO: 71628 - DNA, 25 bp, Mus musculus
aataaagtttgcgttcccctcagag

SEQ ID NO: 71629 - DNA, 25 bp, Mus musculus
aataaataacggagatggttctgac

SEQ ID NO: 71630 - DNA, 25 bp, Mus musculus
aataaataacggtgatggttctgac

SEQ ID NO: 71631 - DNA, 25 bp, Mus musculus
aataaatacagccctcctcctcagt

SEQ ID NO: 71632 - DNA, 25 bp, Mus musculus
aataaatacagcgctcctcctcagt

SEQ ID NO: 71633 - DNA, 25 bp, Mus musculus
aataaatacctcacctcagtcttgg

SEQ ID NO: 71634 - DNA, 25 bp, Mus musculus
aataaatacctcatatctgaagttt

SEQ ID NO: 71635 - DNA, 25 bp, Mus musculus
aataaatacctctcctcagtcttgg

SEQ ID NO: 71636 - DNA, 25 bp, Mus musculus
aataaatacctcttatctgaagttt

SEQ ID NO: 71637 - DNA, 25 bp, Mus musculus
aataaatcaaggctgcattgcagct

SEQ ID NO: 71638 - DNA, 25 bp, Mus musculus
aataaatcaagggtgcattgcagct

SEQ ID NO: 71639 - DNA, 25 bp, Mus musculus
aataaatcccgaattccttctcatc

SEQ ID NO: 71640 - DNA, 25 bp, Mus musculus
aataaatcccgatttccttctcatc

SEQ ID NO: 71641 - DNA, 25 bp, Mus musculus
aataaatcccggatctgtgctgtgt

SEQ ID NO: 71642 - DNA, 25 bp, Mus musculus
aataaatcccggttctgtgctgtgt

SEQ ID NO: 71643 - DNA, 25 bp, Mus musculus
aataaatccctccaatggagtctgt

SEQ ID NO: 71644 - DNA, 25 bp, Mus musculus
aataaatccctcgaatggagtctgt

SEQ ID NO: 71645 - DNA, 25 bp, Mus musculus
aataaatcgatcatatttttggcga

SEQ ID NO: 71646 - DNA, 25 bp, Mus musculus
aataaatcgatcttatttttggcga

SEQ ID NO: 71647 - DNA, 25 bp, Mus musculus
aataaatctgcccaagtctctcaag

SEQ ID NO: 71648 - DNA, 25 bp, Mus musculus
aataaatctgccgaagtctctcaag

SEQ ID NO: 71649 - DNA, 25 bp, Mus musculus
aataaatctgctatcctggacatgc

SEQ ID NO: 71650 - DNA, 25 bp, Mus musculus
aataaatctgctttcctggacatgc

SEQ ID NO: 71651 - DNA, 25 bp, Mus musculus
aataaatcttcacgtacttcccatg

SEQ ID NO: 71652 - DNA, 25 bp, Mus musculus
aataaatcttcaggtacttcccatg

SEQ ID NO: 71653 - DNA, 25 bp, Mus musculus
aataaatctttcacccttcagttgc

SEQ ID NO: 71654 - DNA, 25 bp, Mus musculus
aataaatctttctcccttcagttgc

SEQ ID NO: 71655 - DNA, 25 bp, Mus musculus
aataaatgaccgcagcagtacttat

SEQ ID NO: 71656 - DNA, 25 bp, Mus musculus
aataaatgaccggagcagtacttat

SEQ ID NO: 71657 - DNA, 25 bp, Mus musculus
aataaatgacctctggaccatcggg

SEQ ID NO: 71658 - DNA, 25 bp, Mus musculus
aataaatgacctgtggaccatcggg

SEQ ID NO: 71659 - DNA, 25 bp, Mus musculus
aataaatgacttctattcccagcat

SEQ ID NO: 71660 - DNA, 25 bp, Mus musculus
aataaatgacttgtattcccagcat

SEQ ID NO: 71661 - DNA, 25 bp, Mus musculus
aataaatgaggccagtctgccctgc

SEQ ID NO: 71662 - DNA, 25 bp, Mus musculus
aataaatgaggcgagtctgccctgc

SEQ ID NO: 71663 - DNA, 25 bp, Mus musculus
aataaatgagtaaagctgctgtgac

SEQ ID NO: 71664 - DNA, 25 bp, Mus musculus
aataaatgagtatagctgctgtgac

SEQ ID NO: 71665 - DNA, 25 bp, Mus musculus
aataaatgccaacacacactccttt

SEQ ID NO: 71666 - DNA, 25 bp, Mus musculus
aataaatgccaagacacactccttt

SEQ ID NO: 71667 - DNA, 25 bp, Mus musculus
aataaatgcgcaagtctttataaag

SEQ ID NO: 71668 - DNA, 25 bp, Mus musculus
aataaatgcgcatgtctttataaag

SEQ ID NO: 71669 - DNA, 25 bp, Mus musculus
aataaatgctctcaacttctatgcc

SEQ ID NO: 71670 - DNA, 25 bp, Mus musculus
aataaatgctctgaacttctatgcc

SEQ ID NO: 71671 - DNA, 25 bp, Mus musculus
aataaatgtaaaagctcccttatgc

SEQ ID NO: 71672 - DNA, 25 bp, Mus musculus
aataaatgtaaatgctcccttatgc

SEQ ID NO: 71673 - DNA, 25 bp, Mus musculus
aataaatgttccaccacatccctat

SEQ ID NO: 71674 - DNA, 25 bp, Mus musculus
aataaatgttcctccacatccctat

SEQ ID NO: 71675 - DNA, 25 bp, Mus musculus
aataaattcagtcaggcagcctata

SEQ ID NO: 71676 - DNA, 25 bp, Mus musculus
aataaattcagtcggatgcgcacac

SEQ ID NO: 71677 - DNA, 25 bp, Mus musculus
aataaattcagtgaggcagcctata

SEQ ID NO: 71678 - DNA, 25 bp, Mus musculus
aataaattcagtgggatgcgcacac

SEQ ID NO: 71679 - DNA, 25 bp, Mus musculus
aataaattcatcactaattctatag

SEQ ID NO: 71680 - DNA, 25 bp, Mus musculus
aataaattcatctctaattctatag

SEQ ID NO: 71681 - DNA, 25 bp, Mus musculus
aataaattccacaaagaaggccagg

SEQ ID NO: 71682 - DNA, 25 bp, Mus musculus
aataaattccactaagaaggccagg

SEQ ID NO: 71683 - DNA, 25 bp, Mus musculus
aataaattgcacagatgccagtcta

SEQ ID NO: 71684 - DNA, 25 bp, Mus musculus
aataaattgcactgatgccagtcta

SEQ ID NO: 71685 - DNA, 25 bp, Mus musculus
aataaattgtgcactttgtcatggc

SEQ ID NO: 71686 - DNA, 25 bp, Mus musculus
aataaattgtgctctttgtcatggc

SEQ ID NO: 71687 - DNA, 25 bp, Mus musculus
aataaatttctacacttgccatttg

SEQ ID NO: 71688 - DNA, 25 bp, Mus musculus
aataaatttctagacttgccatttg

SEQ ID NO: 71689 - DNA, 25 bp, Mus musculus
aataaatttgctacaggcccagctc

SEQ ID NO: 71690 - DNA, 25 bp, Mus musculus
aataaatttgcttcaggcccagctc

SEQ ID NO: 71691 - DNA, 25 bp, Mus musculus
aataaattttctcatttctccaaga

SEQ ID NO: 71692 - DNA, 25 bp, Mus musculus
aataaattttctgatttctccaaga

SEQ ID NO: 71693 - DNA, 25 bp, Mus musculus
aataacaagccacctcaggtctgtg

SEQ ID NO: 71694 - DNA, 25 bp, Mus musculus
aataacaagccagctcaggtctgtg

SEQ ID NO: 71695 - DNA, 25 bp, Mus musculus
aataacaagctaatcacaccagcat

SEQ ID NO: 71696 - DNA, 25 bp, Mus musculus
aataacaagctattcacaccagcat

SEQ ID NO: 71697 - DNA, 25 bp, Mus musculus
aataacaagtatcgctggttttggg

SEQ ID NO: 71698 - DNA, 25 bp, Mus musculus
aataacaagtatggctggttttggg

SEQ ID NO: 71699 - DNA, 25 bp, Mus musculus
aataacaatgtaatcgtttcctgat

SEQ ID NO: 71700 - DNA, 25 bp, Mus musculus
aataacaatgtattcgtttcctgat

SEQ ID NO: 71701 - DNA, 25 bp, Mus musculus
aataacacatgtatcctgggagcaa

SEQ ID NO: 71702 - DNA, 25 bp, Mus musculus
aataacacatgtttcctgggagcaa

SEQ ID NO: 71703 - DNA, 25 bp, Mus musculus
aataacaccttcagctatttgcctg

SEQ ID NO: 71704 - DNA, 25 bp, Mus musculus
aataacaccttctgctatttgcctg

SEQ ID NO: 71705 - DNA, 25 bp, Mus musculus
aataacacggccctgccaatagtcg

SEQ ID NO: 71706 - DNA, 25 bp, Mus musculus
aataacacggccgtgccaatagtcg

SEQ ID NO: 71707 - DNA, 25 bp, Mus musculus
aataacacgtttagcttgtagtcag

SEQ ID NO: 71708 - DNA, 25 bp, Mus musculus
aataacacgttttgcttgtagtcag

SEQ ID NO: 71709 - DNA, 25 bp, Mus musculus
aataacagaagcagctctcagagcc

SEQ ID NO: 71710 - DNA, 25 bp, Mus musculus
aataacagaagctgctctcagagcc

SEQ ID NO: 71711 - DNA, 25 bp, Mus musculus
aataacagcaaaccctcctatagaa

SEQ ID NO: 71712 - DNA, 25 bp, Mus musculus
aataacagcaaagcctcctatagaa

SEQ ID NO: 71713 - DNA, 25 bp, Mus musculus
aataacagctccaacattttacaga

SEQ ID NO: 71714 - DNA, 25 bp, Mus musculus
aataacagctcctacattttacaga

SEQ ID NO: 71715 - DNA, 25 bp, Mus musculus
aataacaggacaacgcccatctggt

SEQ ID NO: 71716 - DNA, 25 bp, Mus musculus
aataacaggacatcgcccatctggt

SEQ ID NO: 71717 - DNA, 25 bp, Mus musculus
aataacaggcttaatctaccaagaa

SEQ ID NO: 71718 - DNA, 25 bp, Mus musculus
aataacaggcttacacagtgagtgg

SEQ ID NO: 71719 - DNA, 25 bp, Mus musculus
aataacaggctttatctaccaagaa

SEQ ID NO: 71720 - DNA, 25 bp, Mus musculus
aataacaggctttcacagtgagtgg

SEQ ID NO: 71721 - DNA, 25 bp, Mus musculus
aataacagggcaagacattccaaag

SEQ ID NO: 71722 - DNA, 25 bp, Mus musculus
aataacagggcatgacattccaaag

SEQ ID NO: 71723 - DNA, 25 bp, Mus musculus
aataacatattactcgcccaacttt

SEQ ID NO: 71724 - DNA, 25 bp, Mus musculus
aataacatattagtcgcccaacttt

SEQ ID NO: 71725 - DNA, 25 bp, Mus musculus
aataacatcgtgcttccccagtctc

SEQ ID NO: 71726 - DNA, 25 bp, Mus musculus
aataacatcgtggttccccagtctc

SEQ ID NO: 71727 - DNA, 25 bp, Mus musculus
aataacatctttattctcgggctat

SEQ ID NO: 71728 - DNA, 25 bp, Mus musculus
aataacatcttttttctcgggctat

SEQ ID NO: 71729 - DNA, 25 bp, Mus musculus
aataacatggcaaagctgcagcaaa

SEQ ID NO: 71730 - DNA, 25 bp, Mus musculus
aataacatggcatagctgcagcaaa

SEQ ID NO: 71731 - DNA, 25 bp, Mus musculus
aataacatgtccatcatttttatga

SEQ ID NO: 71732 - DNA, 25 bp, Mus musculus
aataacatgtccttcatttttatga

SEQ ID NO: 71733 - DNA, 25 bp, Mus musculus
aataacattaccatactgtggagga

SEQ ID NO: 71734 - DNA, 25 bp, Mus musculus
aataacattaccttactgtggagga

SEQ ID NO: 71735 - DNA, 25 bp, Mus musculus
aataacattcgacgctcccagtggg

SEQ ID NO: 71736 - DNA, 25 bp, Mus musculus
aataacattcgaggctcccagtggg

SEQ ID NO: 71737 - DNA, 25 bp, Mus musculus
aataacattgccctggccttggagg

SEQ ID NO: 71738 - DNA, 25 bp, Mus musculus
aataacattgccgtggccttggagg

SEQ ID NO: 71739 - DNA, 25 bp, Mus musculus
aataacattgctatcatcttggata

SEQ ID NO: 71740 - DNA, 25 bp, Mus musculus
aataacattgctttcatcttggata

SEQ ID NO: 71741 - DNA, 25 bp, Mus musculus
aataaccaaataacctctgctaggg

SEQ ID NO: 71742 - DNA, 25 bp, Mus musculus
aataaccaaatatcctctgctaggg

SEQ ID NO: 71743 - DNA, 25 bp, Mus musculus
aataaccaacttcttgaggctccaa

SEQ ID NO: 71744 - DNA, 25 bp, Mus musculus
aataaccaacttgttgaggctccaa

SEQ ID NO: 71745 - DNA, 25 bp, Mus musculus
aataaccacacacgcacttgctgtc

SEQ ID NO: 71746 - DNA, 25 bp, Mus musculus
aataaccacacaggcacttgctgtc

SEQ ID NO: 71747 - DNA, 25 bp, Mus musculus
aataaccacactaaagacttgaata

SEQ ID NO: 71748 - DNA, 25 bp, Mus musculus
aataaccacacttaagacttgaata

SEQ ID NO: 71749 - DNA, 25 bp, Mus musculus
aataaccagcatctttaactcagga

SEQ ID NO: 71750 - DNA, 25 bp, Mus musculus
aataaccagcatgtttaactcagga

SEQ ID NO: 71751 - DNA, 25 bp, Mus musculus
aataaccaggtgaagtccttgtaag

SEQ ID NO: 71752 - DNA, 25 bp, Mus musculus
aataaccaggtgtagtccttgtaag

SEQ ID NO: 71753 - DNA, 25 bp, Mus musculus
aataaccaggttatccgcagtgggc

SEQ ID NO: 71754 - DNA, 25 bp, Mus musculus
aataaccaggttttccgcagtgggc

SEQ ID NO: 71755 - DNA, 25 bp, Mus musculus
aataaccagtgtagcctcattcagc

SEQ ID NO: 71756 - DNA, 25 bp, Mus musculus
aataaccagtgttgcctcattcagc

SEQ ID NO: 71757 - DNA, 25 bp, Mus musculus
aataaccatgccattgtagcaaaaa

SEQ ID NO: 71758 - DNA, 25 bp, Mus musculus
aataaccatgcctttgtagcaaaaa

SEQ ID NO: 71759 - DNA, 25 bp, Mus musculus
aataacccataaagagtgatttcat

SEQ ID NO: 71760 - DNA, 25 bp, Mus musculus
aataacccataatgagtgatttcat

SEQ ID NO: 71761 - DNA, 25 bp, Mus musculus
aataaccccaccatttctgattact

SEQ ID NO: 71762 - DNA, 25 bp, Mus musculus
aataaccccaccttttctgattact

SEQ ID NO: 71763 - DNA, 25 bp, Mus musculus
aataacccgagtctcctgaggtaag

SEQ ID NO: 71764 - DNA, 25 bp, Mus musculus
aataacccgagtgtcctgaggtaag

SEQ ID NO: 71765 - DNA, 25 bp, Mus musculus
aataacccgcaccagaagcagcaaa

SEQ ID NO: 71766 - DNA, 25 bp, Mus musculus
aataacccgcacgagaagcagcaaa

SEQ ID NO: 71767 - DNA, 25 bp, Mus musculus
aataaccctcttagctgtgttgtga

SEQ ID NO: 71768 - DNA, 25 bp, Mus musculus
aataaccctctttgctgtgttgtga

SEQ ID NO: 71769 - DNA, 25 bp, Mus musculus
aataacccttacagtgtttgctaca

SEQ ID NO: 71770 - DNA, 25 bp, Mus musculus
aataacccttactgtgtttgctaca

SEQ ID NO: 71771 - DNA, 25 bp, Mus musculus
aataaccgcactaagcaagcttctg

SEQ ID NO: 71772 - DNA, 25 bp, Mus musculus
aataaccgcacttagcaagcttctg

SEQ ID NO: 71773 - DNA, 25 bp, Mus musculus
aataaccgcagtccctacactactt

SEQ ID NO: 71774 - DNA, 25 bp, Mus musculus
aataaccgcagtgcctacactactt

SEQ ID NO: 71775 - DNA, 25 bp, Mus musculus
aataaccgtctgatgagtagccatg

SEQ ID NO: 71776 - DNA, 25 bp, Mus musculus
aataaccgtctgttgagtagccatg

SEQ ID NO: 71777 - DNA, 25 bp, Mus musculus
aataaccgttaacctcacttgtctc

SEQ ID NO: 71778 - DNA, 25 bp, Mus musculus
aataaccgttaagctcacttgtctc

SEQ ID NO: 71779 - DNA, 25 bp, Mus musculus
aataacctggagctctcacgggagt

SEQ ID NO: 71780 - DNA, 25 bp, Mus musculus
aataacctggaggtctcacgggagt

SEQ ID NO: 71781 - DNA, 25 bp, Mus musculus
aataaccttacacctgtttccagag

SEQ ID NO: 71782 - DNA, 25 bp, Mus musculus
aataaccttacagctgtttccagag

SEQ ID NO: 71783 - DNA, 25 bp, Mus musculus
aataacctttatcagcccaaccttg

SEQ ID NO: 71784 - DNA, 25 bp, Mus musculus
aataacctttatgagcccaaccttg

SEQ ID NO: 71785 - DNA, 25 bp, Mus musculus
aataacctttgcatggcatttcaaa

SEQ ID NO: 71786 - DNA, 25 bp, Mus musculus
aataacctttgcttggcatttcaaa

SEQ ID NO: 71787 - DNA, 25 bp, Mus musculus
aataacgaagagaccatcattgcgg

SEQ ID NO: 71788 - DNA, 25 bp, Mus musculus
aataacgaagagtccatcattgcgg

SEQ ID NO: 71789 - DNA, 25 bp, Mus musculus
aataacgagctcaaagctgggtgtg

SEQ ID NO: 71790 - DNA, 25 bp, Mus musculus
aataacgagctctaagctgggtgtg

SEQ ID NO: 71791 - DNA, 25 bp, Mus musculus
aataacgcttttatactgtattttg

SEQ ID NO: 71792 - DNA, 25 bp, Mus musculus
aataacgcttttttactgtattttg

SEQ ID NO: 71793 - DNA, 25 bp, Mus musculus
aataacggtgctagaagttcccaat

SEQ ID NO: 71794 - DNA, 25 bp, Mus musculus
aataacggtgcttgaagttcccaat

SEQ ID NO: 71795 - DNA, 25 bp, Mus musculus
aataacgtcttgatttctacattcc

SEQ ID NO: 71796 - DNA, 25 bp, Mus musculus
aataacgtcttgttttctacattcc

SEQ ID NO: 71797 - DNA, 25 bp, Mus musculus
aataacgtgcttcggtgtgtgactt

SEQ ID NO: 71798 - DNA, 25 bp, Mus musculus
aataacgtgcttgggtgtgtgactt

SEQ ID NO: 71799 - DNA, 25 bp, Mus musculus
aataacgttttgaagcaggccatga

SEQ ID NO: 71800 - DNA, 25 bp, Mus musculus
aataacgttttgtagcaggccatga

SEQ ID NO: 71801 - DNA, 25 bp, Mus musculus
aataactaatctacagcaccctgag

SEQ ID NO: 71802 - DNA, 25 bp, Mus musculus
aataactaatcttcagcaccctgag

SEQ ID NO: 71803 - DNA, 25 bp, Mus musculus
aataactactccaaatcgattccca

SEQ ID NO: 71804 - DNA, 25 bp, Mus musculus
aataactactcctaatcgattccca

SEQ ID NO: 71805 - DNA, 25 bp, Mus musculus
aataactatggcagcaggttcttct

SEQ ID NO: 71806 - DNA, 25 bp, Mus musculus
aataactatggctgcaggttcttct

SEQ ID NO: 71807 - DNA, 25 bp, Mus musculus
aataactcagctcgttctcatgtcc

SEQ ID NO: 71808 - DNA, 25 bp, Mus musculus
aataactcagctggttctcatgtcc

SEQ ID NO: 71809 - DNA, 25 bp, Mus musculus
aataactcatcccttcaaactggag

SEQ ID NO: 71810 - DNA, 25 bp, Mus musculus
aataactcatccgttcaaactggag

SEQ ID NO: 71811 - DNA, 25 bp, Mus musculus
aataactcctatatatgtaagccag

SEQ ID NO: 71812 - DNA, 25 bp, Mus musculus
aataactcctatttatgtaagccag

SEQ ID NO: 71813 - DNA, 25 bp, Mus musculus
aataactcctccatgaatccttttg

SEQ ID NO: 71814 - DNA, 25 bp, Mus musculus
aataactcctccttgaatccttttg

SEQ ID NO: 71815 - DNA, 25 bp, Mus musculus
aataactcctttacaatgacatgtg

SEQ ID NO: 71816 - DNA, 25 bp, Mus musculus
aataactccttttcaatgacatgtg

SEQ ID NO: 71817 - DNA, 25 bp, Mus musculus
aataactctgcaaccacgacttggg

SEQ ID NO: 71818 - DNA, 25 bp, Mus musculus
aataactctgcatccacgacttggg

SEQ ID NO: 71819 - DNA, 25 bp, Mus musculus
aataactctgttacgtaggaagcta

SEQ ID NO: 71820 - DNA, 25 bp, Mus musculus
aataactctgtttcgtaggaagcta

SEQ ID NO: 71821 - DNA, 25 bp, Mus musculus
aataactcttagacttgggttcaga

SEQ ID NO: 71822 - DNA, 25 bp, Mus musculus
aataactcttagtcttgggttcaga

SEQ ID NO: 71823 - DNA, 25 bp, Mus musculus
aataactcttcaatcatgctttaac

SEQ ID NO: 71824 - DNA, 25 bp, Mus musculus
aataactcttcattcatgctttaac

SEQ ID NO: 71825 - DNA, 25 bp, Mus musculus
aataactgacagctgacaccatatg

SEQ ID NO: 71826 - DNA, 25 bp, Mus musculus
aataactgacaggtgacaccatatg

SEQ ID NO: 71827 - DNA, 25 bp, Mus musculus
aataactgacctcaactatctctcc

SEQ ID NO: 71828 - DNA, 25 bp, Mus musculus
aataactgacctgaactatctctcc

SEQ ID NO: 71829 - DNA, 25 bp, Mus musculus
aataactgaggtagcctcctttctg

SEQ ID NO: 71830 - DNA, 25 bp, Mus musculus
aataactgaggttgcctcctttctg

SEQ ID NO: 71831 - DNA, 25 bp, Mus musculus
aataactgcatcacttcttttctgc

SEQ ID NO: 71832 - DNA, 25 bp, Mus musculus
aataactgcatctcttcttttctgc

SEQ ID NO: 71833 - DNA, 25 bp, Mus musculus
aataactgctcaaaattgctcccac

SEQ ID NO: 71834 - DNA, 25 bp, Mus musculus
aataactgctcataattgctcccac

SEQ ID NO: 71835 - DNA, 25 bp, Mus musculus
aataactggatcattctgctgacaa

SEQ ID NO: 71836 - DNA, 25 bp, Mus musculus
aataactggatctttctgctgacaa

SEQ ID NO: 71837 - DNA, 25 bp, Mus musculus
aataactgtcatccagggaaccaga

SEQ ID NO: 71838 - DNA, 25 bp, Mus musculus
aataactgtcatgcagggaaccaga

SEQ ID NO: 71839 - DNA, 25 bp, Mus musculus
aataactgtgaacgtcacggaccat

SEQ ID NO: 71840 - DNA, 25 bp, Mus musculus
aataactgtgaaggtcacggaccat

SEQ ID NO: 71841 - DNA, 25 bp, Mus musculus
aataacttacagagccttaggctca

SEQ ID NO: 71842 - DNA, 25 bp, Mus musculus
aataacttacagtgccttaggctca

SEQ ID NO: 71843 - DNA, 25 bp, Mus musculus
aataacttagagcacatggattaac

SEQ ID NO: 71844 - DNA, 25 bp, Mus musculus
aataacttagaggacatggattaac

SEQ ID NO: 71845 - DNA, 25 bp, Mus musculus
aataacttcaaacaccagctgcatg

SEQ ID NO: 71846 - DNA, 25 bp, Mus musculus
aataacttcaaagaccagctgcatg

SEQ ID NO: 71847 - DNA, 25 bp, Mus musculus
aataacttcagtaggctcaggctct

SEQ ID NO: 71848 - DNA, 25 bp, Mus musculus
aataacttcagttggctcaggctct

SEQ ID NO: 71849 - DNA, 25 bp, Mus musculus
aataacttccgacataattctgaca

SEQ ID NO: 71850 - DNA, 25 bp, Mus musculus
aataacttccgagataattctgaca

SEQ ID NO: 71851 - DNA, 25 bp, Mus musculus
aataacttgagcacattgtccttag

SEQ ID NO: 71852 - DNA, 25 bp, Mus musculus
aataacttgagctcattgtccttag

SEQ ID NO: 71853 - DNA, 25 bp, Mus musculus
aataacttgccaatgctaccctgaa

SEQ ID NO: 71854 - DNA, 25 bp, Mus musculus
aataacttgccattgctaccctgaa

SEQ ID NO: 71855 - DNA, 25 bp, Mus musculus
aataacttgggtaccattgtcctgt

SEQ ID NO: 71856 - DNA, 25 bp, Mus musculus
aataacttgggttccattgtcctgt

SEQ ID NO: 71857 - DNA, 25 bp, Mus musculus
aataacttggtcagcctcacaggaa

SEQ ID NO: 71858 - DNA, 25 bp, Mus musculus
aataacttggtctgcctcacaggaa

SEQ ID NO: 71859 - DNA, 25 bp, Mus musculus
aataactttaatccctactccaaat

SEQ ID NO: 71860 - DNA, 25 bp, Mus musculus
aataactttaatgcctactccaaat

SEQ ID NO: 71861 - DNA, 25 bp, Mus musculus
aataactttgttcgcaattgttgct

SEQ ID NO: 71862 - DNA, 25 bp, Mus musculus
aataactttgttggcaattgttgct

SEQ ID NO: 71863 - DNA, 25 bp, Mus musculus
aataacttttatcttccaccaatgt

SEQ ID NO: 71864 - DNA, 25 bp, Mus musculus
aataacttttatgttccaccaatgt

SEQ ID NO: 71865 - DNA, 25 bp, Mus musculus
aataactttttcagcccactatact

SEQ ID NO: 71866 - DNA, 25 bp, Mus musculus
aataactttttctgcccactatact

SEQ ID NO: 71867 - DNA, 25 bp, Mus musculus
aataagaaaatcactcgggccaggt

SEQ ID NO: 71868 - DNA, 25 bp, Mus musculus
aataagaaaatctctcgggccaggt

SEQ ID NO: 71869 - DNA, 25 bp, Mus musculus
aataagaactaccaatcacccacaa

SEQ ID NO: 71870 - DNA, 25 bp, Mus musculus
aataagaactacgaatcacccacaa

SEQ ID NO: 71871 - DNA, 25 bp, Mus musculus
aataagaatgctctcattccccagc

SEQ ID NO: 71872 - DNA, 25 bp, Mus musculus
aataagaatgctgtcattccccagc

SEQ ID NO: 71873 - DNA, 25 bp, Mus musculus
aataagacatctcctacctgctgct

SEQ ID NO: 71874 - DNA, 25 bp, Mus musculus
aataagacatctgctacctgctgct

SEQ ID NO: 71875 - DNA, 25 bp, Mus musculus
aataagaccagtaacagtgagtatg

SEQ ID NO: 71876 - DNA, 25 bp, Mus musculus
aataagaccagttacagtgagtatg

SEQ ID NO: 71877 - DNA, 25 bp, Mus musculus
aataagagagtcagtggcctcatga

SEQ ID NO: 71878 - DNA, 25 bp, Mus musculus
aataagagagtctgtggcctcatga

SEQ ID NO: 71879 - DNA, 25 bp, Mus musculus
aataagagccaacgccatcaggacc

SEQ ID NO: 71880 - DNA, 25 bp, Mus musculus
aataagagccaaggccatcaggacc

SEQ ID NO: 71881 - DNA, 25 bp, Mus musculus
aataagaggtctactggtgggaccg

SEQ ID NO: 71882 - DNA, 25 bp, Mus musculus
aataagaggtcttctggtgggaccg

SEQ ID NO: 71883 - DNA, 25 bp, Mus musculus
aataagagtggcatggcacataggc

SEQ ID NO: 71884 - DNA, 25 bp, Mus musculus
aataagagtggcttggcacataggc

SEQ ID NO: 71885 - DNA, 25 bp, Mus musculus
aataagagttctatccctgcaactt

SEQ ID NO: 71886 - DNA, 25 bp, Mus musculus
aataagagttctttccctgcaactt

SEQ ID NO: 71887 - DNA, 25 bp, Mus musculus
aataagatcaacacctgttctcacc

SEQ ID NO: 71888 - DNA, 25 bp, Mus musculus
aataagatcaactcctgttctcacc

SEQ ID NO: 71889 - DNA, 25 bp, Mus musculus
aataagatccttcggccatcactgg

SEQ ID NO: 71890 - DNA, 25 bp, Mus musculus
aataagatccttgggccatcactgg

SEQ ID NO: 71891 - DNA, 25 bp, Mus musculus
aataagatctcacttgcacgtgcaa

SEQ ID NO: 71892 - DNA, 25 bp, Mus musculus
aataagatctcagttgcacgtgcaa

SEQ ID NO: 71893 - DNA, 25 bp, Mus musculus
aataagatctgcactaggttcctcc

SEQ ID NO: 71894 - DNA, 25 bp, Mus musculus
aataagatctgctctaggttcctcc

SEQ ID NO: 71895 - DNA, 25 bp, Mus musculus
aataagatgttacgccaggcatggt

SEQ ID NO: 71896 - DNA, 25 bp, Mus musculus
aataagatgttaggccaggcatggt

SEQ ID NO: 71897 - DNA, 25 bp, Mus musculus
aataagattagcagttcccagagaa

SEQ ID NO: 71898 - DNA, 25 bp, Mus musculus
aataagattagctgttcccagagaa

SEQ ID NO: 71899 - DNA, 25 bp, Mus musculus
aataagattgccctaccttagccgc

SEQ ID NO: 71900 - DNA, 25 bp, Mus musculus
aataagattgccgtaccttagccgc

SEQ ID NO: 71901 - DNA, 25 bp, Mus musculus
aataagattgttccctgcatttcgg

SEQ ID NO: 71902 - DNA, 25 bp, Mus musculus
aataagattgttgcctgcatttcgg

SEQ ID NO: 71903 - DNA, 25 bp, Mus musculus
aataagattttcaaagccagatgtg

SEQ ID NO: 71904 - DNA, 25 bp, Mus musculus
aataagattttctaagccagatgtg

SEQ ID NO: 71905 - DNA, 25 bp, Mus musculus
aataagatttttcctccctaaatag

SEQ ID NO: 71906 - DNA, 25 bp, Mus musculus
aataagatttttgctccctaaatag

SEQ ID NO: 71907 - DNA, 25 bp, Mus musculus
aataagcacaggcagtttcccctat

SEQ ID NO: 71908 - DNA, 25 bp, Mus musculus
aataagcacagggagtttcccctat

SEQ ID NO: 71909 - DNA, 25 bp, Mus musculus
aataagcacttcaccgtatccatag

SEQ ID NO: 71910 - DNA, 25 bp, Mus musculus
aataagcacttctccgtatccatag

SEQ ID NO: 71911 - DNA, 25 bp, Mus musculus
aataagcagatcctggcacacacct

SEQ ID NO: 71912 - DNA, 25 bp, Mus musculus
aataagcagatcgtggcacacacct

SEQ ID NO: 71913 - DNA, 25 bp, Mus musculus
aataagcagctgattctaactcaaa

SEQ ID NO: 71914 - DNA, 25 bp, Mus musculus
aataagcagctgtttctaactcaaa

SEQ ID NO: 71915 - DNA, 25 bp, Mus musculus
aataagcatcccaaaggtttgtgtc

SEQ ID NO: 71916 - DNA, 25 bp, Mus musculus
aataagcatccctaaggtttgtgtc

SEQ ID NO: 71917 - DNA, 25 bp, Mus musculus
aataagcattcccttgacagcacag

SEQ ID NO: 71918 - DNA, 25 bp, Mus musculus
aataagcattccgttgacagcacag

SEQ ID NO: 71919 - DNA, 25 bp, Mus musculus
aataagccagacagggtcttggtgt

SEQ ID NO: 71920 - DNA, 25 bp, Mus musculus
aataagccagactgggtcttggtgt

SEQ ID NO: 71921 - DNA, 25 bp, Mus musculus
aataagccagtgctgtcggcccttc

SEQ ID NO: 71922 - DNA, 25 bp, Mus musculus
aataagccagtggtgtcggcccttc

SEQ ID NO: 71923 - DNA, 25 bp, Mus musculus
aataagcccgtgaactttcgtgtat

SEQ ID NO: 71924 - DNA, 25 bp, Mus musculus
aataagcccgtgtactttcgtgtat

SEQ ID NO: 71925 - DNA, 25 bp, Mus musculus
aataagccctctattctcagccttg

SEQ ID NO: 71926 - DNA, 25 bp, Mus musculus
aataagccctcttttctcagccttg

SEQ ID NO: 71927 - DNA, 25 bp, Mus musculus
aataagcctaaaaatcctgtcagat

SEQ ID NO: 71928 - DNA, 25 bp, Mus musculus
aataagcctaaatatcctgtcagat

SEQ ID NO: 71929 - DNA, 25 bp, Mus musculus
aataagcctacgcttaacatcaagc

SEQ ID NO: 71930 - DNA, 25 bp, Mus musculus
aataagcctacggttaacatcaagc

SEQ ID NO: 71931 - DNA, 25 bp, Mus musculus
aataagcctcgcacggttttgaagc

SEQ ID NO: 71932 - DNA, 25 bp, Mus musculus
aataagcctcgctcggttttgaagc

SEQ ID NO: 71933 - DNA, 25 bp, Mus musculus
aataagcctcttactaacccaacag

SEQ ID NO: 71934 - DNA, 25 bp, Mus musculus
aataagcctctttctaacccaacag

SEQ ID NO: 71935 - DNA, 25 bp, Mus musculus
aataagcctggtctctacgttcgtg

SEQ ID NO: 71936 - DNA, 25 bp, Mus musculus
aataagcctggtgtctacgttcgtg

SEQ ID NO: 71937 - DNA, 25 bp, Mus musculus
aataagccttatccaaatccccatc

SEQ ID NO: 71938 - DNA, 25 bp, Mus musculus
aataagccttatgcaaatccccatc

SEQ ID NO: 71939 - DNA, 25 bp, Mus musculus
aataagcgtggacgctgcatctccc

SEQ ID NO: 71940 - DNA, 25 bp, Mus musculus
aataagcgtggaggctgcatctccc

SEQ ID NO: 71941 - DNA, 25 bp, Mus musculus
aataagctcactacttggctattgt

SEQ ID NO: 71942 - DNA, 25 bp, Mus musculus
aataagctcacttcttggctattgt

SEQ ID NO: 71943 - DNA, 25 bp, Mus musculus
aataagctcatcacaacaagaggta

SEQ ID NO: 71944 - DNA, 25 bp, Mus musculus
aataagctcatctcaacaagaggta

SEQ ID NO: 71945 - DNA, 25 bp, Mus musculus
aataagctgtttacctttggcagag

SEQ ID NO: 71946 - DNA, 25 bp, Mus musculus
aataagctgttttcctttggcagag

SEQ ID NO: 71947 - DNA, 25 bp, Mus musculus
aataagcttatactgaccccacttc

SEQ ID NO: 71948 - DNA, 25 bp, Mus musculus
aataagcttatagtgaccccacttc

SEQ ID NO: 71949 - DNA, 25 bp, Mus musculus
aataagcttatcaatctggtccctg

SEQ ID NO: 71950 - DNA, 25 bp, Mus musculus
aataagcttatctatctggtccctg

SEQ ID NO: 71951 - DNA, 25 bp, Mus musculus
aataagcttcccacattttcagtac

SEQ ID NO: 71952 - DNA, 25 bp, Mus musculus
aataagcttccctcattttcagtac

SEQ ID NO: 71953 - DNA, 25 bp, Mus musculus
aataagcttgttccagtgtttctct

SEQ ID NO: 71954 - DNA, 25 bp, Mus musculus
aataagcttgttgcagtgtttctct

SEQ ID NO: 71955 - DNA, 25 bp, Mus musculus
aataagctttatcccagaaactcag

SEQ ID NO: 71956 - DNA, 25 bp, Mus musculus
aataagctttatgccagaaactcag

SEQ ID NO: 71957 - DNA, 25 bp, Mus musculus
aataagctttcccatcataatatat

SEQ ID NO: 71958 - DNA, 25 bp, Mus musculus
aataagctttccgatcataatatat

SEQ ID NO: 71959 - DNA, 25 bp, Mus musculus
aataagctttctctctcatagcctt

SEQ ID NO: 71960 - DNA, 25 bp, Mus musculus
aataagctttctgtctcatagcctt

SEQ ID NO: 71961 - DNA, 25 bp, Mus musculus
aataagctttttccactagaacata

SEQ ID NO: 71962 - DNA, 25 bp, Mus musculus
aataagctttttgcactagaacata

SEQ ID NO: 71963 - DNA, 25 bp, Mus musculus
aataaggacatactattgccctgct

SEQ ID NO: 71964 - DNA, 25 bp, Mus musculus
aataaggacatagtattgccctgct

SEQ ID NO: 71965 - DNA, 25 bp, Mus musculus
aataaggagaagctatattccctcg

SEQ ID NO: 71966 - DNA, 25 bp, Mus musculus
aataaggagaaggtatattccctcg

SEQ ID NO: 71967 - DNA, 25 bp, Mus musculus
aataaggagacaacccacatcccag

SEQ ID NO: 71968 - DNA, 25 bp, Mus musculus
aataaggagacatcccacatcccag

SEQ ID NO: 71969 - DNA, 25 bp, Mus musculus
aataaggaggccaatgccacgctga

SEQ ID NO: 71970 - DNA, 25 bp, Mus musculus
aataaggaggcctatgccacgctga

SEQ ID NO: 71971 - DNA, 25 bp, Mus musculus
aataaggagggcaaggccagcaatg

SEQ ID NO: 71972 - DNA, 25 bp, Mus musculus
aataaggagggcacgctctggccct

SEQ ID NO: 71973 - DNA, 25 bp, Mus musculus
aataaggagggctaggccagcaatg

SEQ ID NO: 71974 - DNA, 25 bp, Mus musculus
aataaggagggctcgctctggccct

SEQ ID NO: 71975 - DNA, 25 bp, Mus musculus
aataaggagtcactcccagcaagaa

SEQ ID NO: 71976 - DNA, 25 bp, Mus musculus
aataaggagtcagtcccagcaagaa

SEQ ID NO: 71977 - DNA, 25 bp, Mus musculus
aataaggatgagctttgatggtgtt

SEQ ID NO: 71978 - DNA, 25 bp, Mus musculus
aataaggatgaggtttgatggtgtt

SEQ ID NO: 71979 - DNA, 25 bp, Mus musculus
aataaggcaacgcttaactgaggtg

SEQ ID NO: 71980 - DNA, 25 bp, Mus musculus
aataaggcaacggttaactgaggtg

SEQ ID NO: 71981 - DNA, 25 bp, Mus musculus
aataaggcccgcaactgtgcggagg

SEQ ID NO: 71982 - DNA, 25 bp, Mus musculus
aataaggcccgctactgtgcggagg

SEQ ID NO: 71983 - DNA, 25 bp, Mus musculus
aataaggcctctctagccatggcta

SEQ ID NO: 71984 - DNA, 25 bp, Mus musculus
aataaggcctctgtagccatggcta

SEQ ID NO: 71985 - DNA, 25 bp, Mus musculus
aataaggcctgtaccatgctcttta

SEQ ID NO: 71986 - DNA, 25 bp, Mus musculus
aataaggcctgttccatgctcttta

SEQ ID NO: 71987 - DNA, 25 bp, Mus musculus
aataaggccttgctatcactcatcc

SEQ ID NO: 71988 - DNA, 25 bp, Mus musculus
aataaggccttggtatcactcatcc

SEQ ID NO: 71989 - DNA, 25 bp, Mus musculus
aataagggctatactgccccatatg

SEQ ID NO: 71990 - DNA, 25 bp, Mus musculus
aataagggctattctgccccatatg

SEQ ID NO: 71991 - DNA, 25 bp, Mus musculus
aataagggctctaggattcccttgc

SEQ ID NO: 71992 - DNA, 25 bp, Mus musculus
aataagggctctcgcaggtattccc

SEQ ID NO: 71993 - DNA, 25 bp, Mus musculus
aataagggctctggcaggtattccc

SEQ ID NO: 71994 - DNA, 25 bp, Mus musculus
aataagggctcttggattcccttgc

SEQ ID NO: 71995 - DNA, 25 bp, Mus musculus
aataagggctggaatttcgcctctg

SEQ ID NO: 71996 - DNA, 25 bp, Mus musculus
aataagggctggtatttcgcctctg

SEQ ID NO: 71997 - DNA, 25 bp, Mus musculus
aataagggtcttcccttgagtccag

SEQ ID NO: 71998 - DNA, 25 bp, Mus musculus
aataagggtcttgccttgagtccag

SEQ ID NO: 71999 - DNA, 25 bp, Mus musculus
aataaggtatcactgcccatggaac

SEQ ID NO: 72000 - DNA, 25 bp, Mus musculus
aataaggtatcagtgcccatggaac

SEQ ID NO: 72001 - DNA, 25 bp, Mus musculus
aataaggtccataaaaggctgcagt

SEQ ID NO: 72002 - DNA, 25 bp, Mus musculus
aataaggtccattaaaggctgcagt

SEQ ID NO: 72003 - DNA, 25 bp, Mus musculus
aataaggtgtggagctcactgctgt

SEQ ID NO: 72004 - DNA, 25 bp, Mus musculus
aataaggtgtggtgctcactgctgt

SEQ ID NO: 72005 - DNA, 25 bp, Mus musculus
aataagtaacctaccacattcatgc

SEQ ID NO: 72006 - DNA, 25 bp, Mus musculus
aataagtaaccttccacattcatgc

SEQ ID NO: 72007 - DNA, 25 bp, Mus musculus
aataagtaatgcacagggctctgaa

SEQ ID NO: 72008 - DNA, 25 bp, Mus musculus
aataagtaatgctcagggctctgaa

SEQ ID NO: 72009 - DNA, 25 bp, Mus musculus
aataagtacatcctgacaggctcag

SEQ ID NO: 72010 - DNA, 25 bp, Mus musculus
aataagtacatcgtgacaggctcag

SEQ ID NO: 72011 - DNA, 25 bp, Mus musculus
aataagtactttactgacacaggag

SEQ ID NO: 72012 - DNA, 25 bp, Mus musculus
aataagtacttttctgacacaggag

SEQ ID NO: 72013 - DNA, 25 bp, Mus musculus
aataagtaggttaccaattggctat

SEQ ID NO: 72014 - DNA, 25 bp, Mus musculus
aataagtaggtttccaattggctat

SEQ ID NO: 72015 - DNA, 25 bp, Mus musculus
aataagtcaactactcagagcctgg

SEQ ID NO: 72016 - DNA, 25 bp, Mus musculus
aataagtcaacttctcagagcctgg

SEQ ID NO: 72017 - DNA, 25 bp, Mus musculus
aataagtcaataagtgttgcacctc

SEQ ID NO: 72018 - DNA, 25 bp, Mus musculus
aataagtcaatatgtgttgcacctc

SEQ ID NO: 72019 - DNA, 25 bp, Mus musculus
aataagtcaatgatctgctgtcctc

SEQ ID NO: 72020 - DNA, 25 bp, Mus musculus
aataagtcaatgttctgctgtcctc

SEQ ID NO: 72021 - DNA, 25 bp, Mus musculus
aataagtcacatattgttatgggtg

SEQ ID NO: 72022 - DNA, 25 bp, Mus musculus
aataagtcacatccccttcagataa

SEQ ID NO: 72023 - DNA, 25 bp, Mus musculus
aataagtcacatgcccttcagataa

SEQ ID NO: 72024 - DNA, 25 bp, Mus musculus
aataagtcacattttgttatgggtg

SEQ ID NO: 72025 - DNA, 25 bp, Mus musculus
aataagtcacttcacaccacagaaa

SEQ ID NO: 72026 - DNA, 25 bp, Mus musculus
aataagtcacttgacaccacagaaa

SEQ ID NO: 72027 - DNA, 25 bp, Mus musculus
aataagtcatctcagttcctggccc

SEQ ID NO: 72028 - DNA, 25 bp, Mus musculus
aataagtcatctgagttcctggccc

SEQ ID NO: 72029 - DNA, 25 bp, Mus musculus
aataagtcattcacagttttagaac

SEQ ID NO: 72030 - DNA, 25 bp, Mus musculus
aataagtcattctcagttttagaac

SEQ ID NO: 72031 - DNA, 25 bp, Mus musculus
aataagtcctggaggtgttctctcc

SEQ ID NO: 72032 - DNA, 25 bp, Mus musculus
aataagtcctggtggtgttctctcc

SEQ ID NO: 72033 - DNA, 25 bp, Mus musculus
aataagtcgggcaatctgagataca

SEQ ID NO: 72034 - DNA, 25 bp, Mus musculus
aataagtcgggctatctgagataca

SEQ ID NO: 72035 - DNA, 25 bp, Mus musculus
aataagtctcacaccagactctgac

SEQ ID NO: 72036 - DNA, 25 bp, Mus musculus
aataagtctcactccagactctgac

SEQ ID NO: 72037 - DNA, 25 bp, Mus musculus
aataagtgccgtcaacgtcttcccg

SEQ ID NO: 72038 - DNA, 25 bp, Mus musculus
aataagtgccgtgaacgtcttcccg

SEQ ID NO: 72039 - DNA, 25 bp, Mus musculus
aataagtgctgtcacccagactcag

SEQ ID NO: 72040 - DNA, 25 bp, Mus musculus
aataagtgctgtgacccagactcag

SEQ ID NO: 72041 - DNA, 25 bp, Mus musculus
aataagtgctttctatttgcagtaa

SEQ ID NO: 72042 - DNA, 25 bp, Mus musculus
aataagtgctttgtatttgcagtaa

SEQ ID NO: 72043 - DNA, 25 bp, Mus musculus
aataagtggcagcatcttcggcctc

SEQ ID NO: 72044 - DNA, 25 bp, Mus musculus
aataagtggcaggatcttcggcctc

SEQ ID NO: 72045 - DNA, 25 bp, Mus musculus
aataagtggtcacggctagagacat

SEQ ID NO: 72046 - DNA, 25 bp, Mus musculus
aataagtggtcagggctagagacat

SEQ ID NO: 72047 - DNA, 25 bp, Mus musculus
aataagttcagaattctcaaggaag

SEQ ID NO: 72048 - DNA, 25 bp, Mus musculus
aataagttcagatttctcaaggaag

SEQ ID NO: 72049 - DNA, 25 bp, Mus musculus
aataagttccctaatgtctccggct

SEQ ID NO: 72050 - DNA, 25 bp, Mus musculus
aataagttcccttatgtctccggct

SEQ ID NO: 72051 - DNA, 25 bp, Mus musculus
aataagttcctgagtggcttcggcc

SEQ ID NO: 72052 - DNA, 25 bp, Mus musculus
aataagttcctgtgtggcttcggcc

SEQ ID NO: 72053 - DNA, 25 bp, Mus musculus
aataagttccttacagtctgtttct

SEQ ID NO: 72054 - DNA, 25 bp, Mus musculus
aataagttcctttcagtctgtttct

SEQ ID NO: 72055 - DNA, 25 bp, Mus musculus
aataagttctgtccactggtttgtt

SEQ ID NO: 72056 - DNA, 25 bp, Mus musculus
aataagttctgtgcactggtttgtt

SEQ ID NO: 72057 - DNA, 25 bp, Mus musculus
aataagtttctgatgacggcatgtg

SEQ ID NO: 72058 - DNA, 25 bp, Mus musculus
aataagtttctgttgacggcatgtg

SEQ ID NO: 72059 - DNA, 25 bp, Mus musculus
aataataaatccattcgctgcttgt

SEQ ID NO: 72060 - DNA, 25 bp, Mus musculus
aataataaatcctttcgctgcttgt

SEQ ID NO: 72061 - DNA, 25 bp, Mus musculus
aataataacctcatgccctaattca

SEQ ID NO: 72062 - DNA, 25 bp, Mus musculus
aataataacctcttgccctaattca

SEQ ID NO: 72063 - DNA, 25 bp, Mus musculus
aataataacctgatcaccctctttg

SEQ ID NO: 72064 - DNA, 25 bp, Mus musculus
aataataacctgttcaccctctttg

SEQ ID NO: 72065 - DNA, 25 bp, Mus musculus
aataataagggcatgtacttgctca

SEQ ID NO: 72066 - DNA, 25 bp, Mus musculus
aataataagggcttgtacttgctca

SEQ ID NO: 72067 - DNA, 25 bp, Mus musculus
aataataatgctcgccatgatttcc

SEQ ID NO: 72068 - DNA, 25 bp, Mus musculus
aataataatgctggccatgatttcc

SEQ ID NO: 72069 - DNA, 25 bp, Mus musculus
aataataatggtcggcgcctccttt

SEQ ID NO: 72070 - DNA, 25 bp, Mus musculus
aataataatggtgggcgcctccttt

SEQ ID NO: 72071 - DNA, 25 bp, Mus musculus
aataataatttcactgcatggagac

SEQ ID NO: 72072 - DNA, 25 bp, Mus musculus
aataataatttctctgcatggagac

SEQ ID NO: 72073 - DNA, 25 bp, Mus musculus
aataatacactaaatttgctgactg

SEQ ID NO: 72074 - DNA, 25 bp, Mus musculus
aataatacactatatttgctgactg

SEQ ID NO: 72075 - DNA, 25 bp, Mus musculus
aataataccctacagatgagcgaaa

SEQ ID NO: 72076 - DNA, 25 bp, Mus musculus
aataataccctagagatgagcgaaa

SEQ ID NO: 72077 - DNA, 25 bp, Mus musculus
aataatacctaccttgtcaagcggc

SEQ ID NO: 72078 - DNA, 25 bp, Mus musculus
aataatacctacgttgtcaagcggc

SEQ ID NO: 72079 - DNA, 25 bp, Mus musculus
aataatacctataggaaggcagata

SEQ ID NO: 72080 - DNA, 25 bp, Mus musculus
aataatacctattggaaggcagata

SEQ ID NO: 72081 - DNA, 25 bp, Mus musculus
aataatactaatatcctggtttgat

SEQ ID NO: 72082 - DNA, 25 bp, Mus musculus
aataatactaatttcctggtttgat

SEQ ID NO: 72083 - DNA, 25 bp, Mus musculus
aataatagattcacactgctgacgt

SEQ ID NO: 72084 - DNA, 25 bp, Mus musculus
aataatagattctcactgctgacgt

SEQ ID NO: 72085 - DNA, 25 bp, Mus musculus
aataatatcaccaaaaatatggcgt

SEQ ID NO: 72086 - DNA, 25 bp, Mus musculus
aataatatcacctaaaatatggcgt

SEQ ID NO: 72087 - DNA, 25 bp, Mus musculus
aataatatcctcacgtgttcttcac

SEQ ID NO: 72088 - DNA, 25 bp, Mus musculus
aataatatcctctcgtgttcttcac

SEQ ID NO: 72089 - DNA, 25 bp, Mus musculus
aataatattagcagttctcaaagaa

SEQ ID NO: 72090 - DNA, 25 bp, Mus musculus
aataatattagctgttctcaaagaa

SEQ ID NO: 72091 - DNA, 25 bp, Mus musculus
aataatattcccagcctgcaagaag

SEQ ID NO: 72092 - DNA, 25 bp, Mus musculus
aataatattccctgcctgcaagaag

SEQ ID NO: 72093 - DNA, 25 bp, Mus musculus
aataatattgggaccctcgatttat

SEQ ID NO: 72094 - DNA, 25 bp, Mus musculus
aataatattgggtccctcgatttat

SEQ ID NO: 72095 - DNA, 25 bp, Mus musculus
aataatatttctattggtgtcccat

SEQ ID NO: 72096 - DNA, 25 bp, Mus musculus
aataatatttcttttggtgtcccat

SEQ ID NO: 72097 - DNA, 25 bp, Mus musculus
aataatcaaacaagttagcaacagg

SEQ ID NO: 72098 - DNA, 25 bp, Mus musculus
aataatcaaacatgttagcaacagg

SEQ ID NO: 72099 - DNA, 25 bp, Mus musculus
aataatcaccatatcgttccaaaga

SEQ ID NO: 72100 - DNA, 25 bp, Mus musculus
aataatcaccatttcgttccaaaga

SEQ ID NO: 72101 - DNA, 25 bp, Mus musculus
aataatcatgctcacgtctttcttc

SEQ ID NO: 72102 - DNA, 25 bp, Mus musculus
aataatcatgctgacgtctttcttc

SEQ ID NO: 72103 - DNA, 25 bp, Mus musculus
aataatcattgaatgcgcgcagtcg

SEQ ID NO: 72104 - DNA, 25 bp, Mus musculus
aataatcattgattgcgcgcagtcg

SEQ ID NO: 72105 - DNA, 25 bp, Mus musculus
aataatccacagacagcctggttgc

SEQ ID NO: 72106 - DNA, 25 bp, Mus musculus
aataatccacagtcagcctggttgc

SEQ ID NO: 72107 - DNA, 25 bp, Mus musculus
aataatccactcatacatttccatg

SEQ ID NO: 72108 - DNA, 25 bp, Mus musculus
aataatccactcttacatttccatg

SEQ ID NO: 72109 - DNA, 25 bp, Mus musculus
aataatccagcaacttgctccctaa

SEQ ID NO: 72110 - DNA, 25 bp, Mus musculus
aataatccagcatcttgctccctaa

SEQ ID NO: 72111 - DNA, 25 bp, Mus musculus
aataatccagctattgcctgtgtcc

SEQ ID NO: 72112 - DNA, 25 bp, Mus musculus
aataatccagcttttgcctgtgtcc

SEQ ID NO: 72113 - DNA, 25 bp, Mus musculus
aataatcccaatatgggcatgcgtg

SEQ ID NO: 72114 - DNA, 25 bp, Mus musculus
aataatcccaatttgggcatgcgtg

SEQ ID NO: 72115 - DNA, 25 bp, Mus musculus
aataatcccatcaatctgtacagtt

SEQ ID NO: 72116 - DNA, 25 bp, Mus musculus
aataatcccatctatctgtacagtt

SEQ ID NO: 72117 - DNA, 25 bp, Mus musculus
aataatcccatgacatcgttgtgtg

SEQ ID NO: 72118 - DNA, 25 bp, Mus musculus
aataatcccatgtcatcgttgtgtg

SEQ ID NO: 72119 - DNA, 25 bp, Mus musculus
aataatccccttccaacaagatgtc

SEQ ID NO: 72120 - DNA, 25 bp, Mus musculus
aataatccccttgcaacaagatgtc

SEQ ID NO: 72121 - DNA, 25 bp, Mus musculus
aataatcctcagacagggcacatag

SEQ ID NO: 72122 - DNA, 25 bp, Mus musculus
aataatcctcagtcagggcacatag

SEQ ID NO: 72123 - DNA, 25 bp, Mus musculus
aataatcctttcattcttgctccaa

SEQ ID NO: 72124 - DNA, 25 bp, Mus musculus
aataatcctttctttcttgctccaa

SEQ ID NO: 72125 - DNA, 25 bp, Mus musculus
aataatctatctacgagctactccc

SEQ ID NO: 72126 - DNA, 25 bp, Mus musculus
aataatctatcttcgagctactccc

SEQ ID NO: 72127 - DNA, 25 bp, Mus musculus
aataatctcaacataattccatata

SEQ ID NO: 72128 - DNA, 25 bp, Mus musculus
aataatctcaacttaattccatata

SEQ ID NO: 72129 - DNA, 25 bp, Mus musculus
aataatctgccaacagtctgaaagg

SEQ ID NO: 72130 - DNA, 25 bp, Mus musculus
aataatctgccatcagtctgaaagg

SEQ ID NO: 72131 - DNA, 25 bp, Mus musculus
aataatctgcttagccagccatgat

SEQ ID NO: 72132 - DNA, 25 bp, Mus musculus
aataatctgctttgccagccatgat

SEQ ID NO: 72133 - DNA, 25 bp, Mus musculus
aataatctgttgacgtggagaccag

SEQ ID NO: 72134 - DNA, 25 bp, Mus musculus
aataatctgttgtcgtggagaccag

SEQ ID NO: 72135 - DNA, 25 bp, Mus musculus
aataatctttcactgtggactcagg

SEQ ID NO: 72136 - DNA, 25 bp, Mus musculus
aataatctttcagtgtggactcagg

SEQ ID NO: 72137 - DNA, 25 bp, Mus musculus
aataatcttttaaatgcacagatat

SEQ ID NO: 72138 - DNA, 25 bp, Mus musculus
aataatcttttatatgcacagatat

SEQ ID NO: 72139 - DNA, 25 bp, Mus musculus
aataatgaagatagaggctactgct

SEQ ID NO: 72140 - DNA, 25 bp, Mus musculus
aataatgaagattgaggctactgct

SEQ ID NO: 72141 - DNA, 25 bp, Mus musculus
aataatgaagctaccacgtctcctc

SEQ ID NO: 72142 - DNA, 25 bp, Mus musculus
aataatgaagcttccacgtctcctc

SEQ ID NO: 72143 - DNA, 25 bp, Mus musculus
aataatgactgacgcccagctttcc

SEQ ID NO: 72144 - DNA, 25 bp, Mus musculus
aataatgactgaggcccagctttcc

SEQ ID NO: 72145 - DNA, 25 bp, Mus musculus
aataatgagagaccggccagtgcct

SEQ ID NO: 72146 - DNA, 25 bp, Mus musculus
aataatgagagagcggccagtgcct

SEQ ID NO: 72147 - DNA, 25 bp, Mus musculus
aataatgatcaccactctgctgggc

SEQ ID NO: 72148 - DNA, 25 bp, Mus musculus
aataatgatcacgactctgctgggc

SEQ ID NO: 72149 - DNA, 25 bp, Mus musculus
aataatgatctaaacactgtggaag

SEQ ID NO: 72150 - DNA, 25 bp, Mus musculus
aataatgatctatacactgtggaag

SEQ ID NO: 72151 - DNA, 25 bp, Mus musculus
aataatgatgcgactgtcttctgtc

SEQ ID NO: 72152 - DNA, 25 bp, Mus musculus
aataatgatgcgtctgtcttctgtc

SEQ ID NO: 72153 - DNA, 25 bp, Mus musculus
aataatgatttcctgccacctgaac

SEQ ID NO: 72154 - DNA, 25 bp, Mus musculus
aataatgatttcgtgccacctgaac

SEQ ID NO: 72155 - DNA, 25 bp, Mus musculus
aataatgcaggacaccaaggtacag

SEQ ID NO: 72156 - DNA, 25 bp, Mus musculus
aataatgcaggagaccaaggtacag

SEQ ID NO: 72157 - DNA, 25 bp, Mus musculus
aataatgcagtcactgtagctcact

SEQ ID NO: 72158 - DNA, 25 bp, Mus musculus
aataatgcagtctctgtagctcact

SEQ ID NO: 72159 - DNA, 25 bp, Mus musculus
aataatgccccactatgtaagagta

SEQ ID NO: 72160 - DNA, 25 bp, Mus musculus
aataatgccccagtatgtaagagta

SEQ ID NO: 72161 - DNA, 25 bp, Mus musculus
aataatgccttcctgccttgtttca

SEQ ID NO: 72162 - DNA, 25 bp, Mus musculus
aataatgccttcgtgccttgtttca

SEQ ID NO: 72163 - DNA, 25 bp, Mus musculus
aataatgcgacaacttgccttaagt

SEQ ID NO: 72164 - DNA, 25 bp, Mus musculus
aataatgcgacatcttgccttaagt

SEQ ID NO: 72165 - DNA, 25 bp, Mus musculus
aataatgctaatcgccaccttggct

SEQ ID NO: 72166 - DNA, 25 bp, Mus musculus
aataatgctaatggccaccttggct

SEQ ID NO: 72167 - DNA, 25 bp, Mus musculus
aataatgctattacctgtgaaccta

SEQ ID NO: 72168 - DNA, 25 bp, Mus musculus
aataatgctatttcctgtgaaccta

SEQ ID NO: 72169 - DNA, 25 bp, Mus musculus
aataatggagttattctgtgctgct

SEQ ID NO: 72170 - DNA, 25 bp, Mus musculus
aataatggagtttttctgtgctgct

SEQ ID NO: 72171 - DNA, 25 bp, Mus musculus
aataatggatctcgccagttatgcc

SEQ ID NO: 72172 - DNA, 25 bp, Mus musculus
aataatggatctggccagttatgcc

SEQ ID NO: 72173 - DNA, 25 bp, Mus musculus
aataatggcccgcagccgtgaagaa

SEQ ID NO: 72174 - DNA, 25 bp, Mus musculus
aataatggcccggagccgtgaagaa

SEQ ID NO: 72175 - DNA, 25 bp, Mus musculus
aataatggctctcactggtaccctg

SEQ ID NO: 72176 - DNA, 25 bp, Mus musculus
aataatggctctgactggtaccctg

SEQ ID NO: 72177 - DNA, 25 bp, Mus musculus
aataatggctgtcatgaatttcatg

SEQ ID NO: 72178 - DNA, 25 bp, Mus musculus
aataatggctgtgatgaatttcatg

SEQ ID NO: 72179 - DNA, 25 bp, Mus musculus
aataatgggaaacagcagggcttag

SEQ ID NO: 72180 - DNA, 25 bp, Mus musculus
aataatgggaaagagcagggcttag

SEQ ID NO: 72181 - DNA, 25 bp, Mus musculus
aataatggtattcggcctggcctag

SEQ ID NO: 72182 - DNA, 25 bp, Mus musculus
aataatggtattgggcctggcctag

SEQ ID NO: 72183 - DNA, 25 bp, Mus musculus
aataatggtcccatttcttcacaca

SEQ ID NO: 72184 - DNA, 25 bp, Mus musculus
aataatggtcccttttcttcacaca

SEQ ID NO: 72185 - DNA, 25 bp, Mus musculus
aataatggtcgtcagttactttctt

SEQ ID NO: 72186 - DNA, 25 bp, Mus musculus
aataatggtcgtgagttactttctt

SEQ ID NO: 72187 - DNA, 25 bp, Mus musculus
aataatggtgaacagtggtcaataa

SEQ ID NO: 72188 - DNA, 25 bp, Mus musculus
aataatggtgaagagtggtcaataa

SEQ ID NO: 72189 - DNA, 25 bp, Mus musculus
aataatggtgtccttagctacccct

SEQ ID NO: 72190 - DNA, 25 bp, Mus musculus
aataatggtgtcgttagctacccct

SEQ ID NO: 72191 - DNA, 25 bp, Mus musculus
aataatgtagtgacagtgtccgttt

SEQ ID NO: 72192 - DNA, 25 bp, Mus musculus
aataatgtagtgtcagtgtccgttt

SEQ ID NO: 72193 - DNA, 25 bp, Mus musculus
aataatgtatgtattgagacatgaa

SEQ ID NO: 72194 - DNA, 25 bp, Mus musculus
aataatgtatgttttgagacatgaa

SEQ ID NO: 72195 - DNA, 25 bp, Mus musculus
aataatgtccaacctgtctgaccag

SEQ ID NO: 72196 - DNA, 25 bp, Mus musculus
aataatgtccaagctgtctgaccag

SEQ ID NO: 72197 - DNA, 25 bp, Mus musculus
aataatgtcccacatgtacatcctt

SEQ ID NO: 72198 - DNA, 25 bp, Mus musculus
aataatgtcccagatgtacatcctt

SEQ ID NO: 72199 - DNA, 25 bp, Mus musculus
aataatgtcgcgaaggtgtaggttc

SEQ ID NO: 72200 - DNA, 25 bp, Mus musculus
aataatgtcgcgtaggtgtaggttc

SEQ ID NO: 72201 - DNA, 25 bp, Mus musculus
aataatgtctgccacctatgccacg

SEQ ID NO: 72202 - DNA, 25 bp, Mus musculus
aataatgtctgcgacctatgccacg

SEQ ID NO: 72203 - DNA, 25 bp, Mus musculus
aataatgtctttacggttggcatgc

SEQ ID NO: 72204 - DNA, 25 bp, Mus musculus
aataatgtcttttcggttggcatgc

SEQ ID NO: 72205 - DNA, 25 bp, Mus musculus
aataatgtgatgaaaggccttccgc

SEQ ID NO: 72206 - DNA, 25 bp, Mus musculus
aataatgtgatgtaaggccttccgc

SEQ ID NO: 72207 - DNA, 25 bp, Mus musculus
aataatgtgattaccaaaattggca

SEQ ID NO: 72208 - DNA, 25 bp, Mus musculus
aataatgtgatttccaaaattggca

SEQ ID NO: 72209 - DNA, 25 bp, Mus musculus
aataatgtgccacctctgatcagca

SEQ ID NO: 72210 - DNA, 25 bp, Mus musculus
aataatgtgccagctctgatcagca

SEQ ID NO: 72211 - DNA, 25 bp, Mus musculus
aataatgtgcctctgttgtcctttt

SEQ ID NO: 72212 - DNA, 25 bp, Mus musculus
aataatgtgcctgtgttgtcctttt

SEQ ID NO: 72213 - DNA, 25 bp, Mus musculus
aataatgtgcttacagtgccttagt

SEQ ID NO: 72214 - DNA, 25 bp, Mus musculus
aataatgtgctttcagtgccttagt

SEQ ID NO: 72215 - DNA, 25 bp, Mus musculus
aataatgtgtgacgtggttcatccc

SEQ ID NO: 72216 - DNA, 25 bp, Mus musculus
aataatgtgtgaggtggttcatccc

SEQ ID NO: 72217 - DNA, 25 bp, Mus musculus
aataatgttgaaaccttactcagag

SEQ ID NO: 72218 - DNA, 25 bp, Mus musculus
aataatgttgaatccttactcagag

SEQ ID NO: 72219 - DNA, 25 bp, Mus musculus
aataattagtttaggcattggtttg

SEQ ID NO: 72220 - DNA, 25 bp, Mus musculus
aataattagttttggcattggtttg

SEQ ID NO: 72221 - DNA, 25 bp, Mus musculus
aataattcacaaaggcctgggtcaa

SEQ ID NO: 72222 - DNA, 25 bp, Mus musculus
aataattcacaatggcctgggtcaa

SEQ ID NO: 72223 - DNA, 25 bp, Mus musculus
aataattcacatctgccttgtcgag

SEQ ID NO: 72224 - DNA, 25 bp, Mus musculus
aataattcacatgtgccttgtcgag

SEQ ID NO: 72225 - DNA, 25 bp, Mus musculus
aataattcccaaagtgccagaggca

SEQ ID NO: 72226 - DNA, 25 bp, Mus musculus
aataattcccaatgtgccagaggca

SEQ ID NO: 72227 - DNA, 25 bp, Mus musculus
aataattccttcaggtcccgacaat

SEQ ID NO: 72228 - DNA, 25 bp, Mus musculus
aataattccttctggtcccgacaat

SEQ ID NO: 72229 - DNA, 25 bp, Mus musculus
aataattcctttagtgcctatgaac

SEQ ID NO: 72230 - DNA, 25 bp, Mus musculus
aataattccttttgtgcctatgaac

SEQ ID NO: 72231 - DNA, 25 bp, Mus musculus
aataattctattaacctgagctgag

SEQ ID NO: 72232 - DNA, 25 bp, Mus musculus
aataattctatttacctgagctgag

SEQ ID NO: 72233 - DNA, 25 bp, Mus musculus
aataattctcacatgtccatgtagc

SEQ ID NO: 72234 - DNA, 25 bp, Mus musculus
aataattctcacttgtccatgtagc

SEQ ID NO: 72235 - DNA, 25 bp, Mus musculus
aataattctggaagcctggtatgat

SEQ ID NO: 72236 - DNA, 25 bp, Mus musculus
aataattctggatgcctggtatgat

SEQ ID NO: 72237 - DNA, 25 bp, Mus musculus
aataattcttataggccgctgtgtt

SEQ ID NO: 72238 - DNA, 25 bp, Mus musculus
aataattcttattggccgctgtgtt

SEQ ID NO: 72239 - DNA, 25 bp, Mus musculus
aataattcttttaccactcatgcac

SEQ ID NO: 72240 - DNA, 25 bp, Mus musculus
aataattcttttccaacgtggtgct

SEQ ID NO: 72241 - DNA, 25 bp, Mus musculus
aataattcttttgcaacgtggtgct

SEQ ID NO: 72242 - DNA, 25 bp, Mus musculus
aataattctttttccactcatgcac

SEQ ID NO: 72243 - DNA, 25 bp, Mus musculus
aataattgaccaaatagggctcgaa

SEQ ID NO: 72244 - DNA, 25 bp, Mus musculus
aataattgaccatatagggctcgaa

SEQ ID NO: 72245 - DNA, 25 bp, Mus musculus
aataattgactcaaacgttcccctg

SEQ ID NO: 72246 - DNA, 25 bp, Mus musculus
aataattgactctaacgttcccctg

SEQ ID NO: 72247 - DNA, 25 bp, Mus musculus
aataattgcaccaactcctcagcgc

SEQ ID NO: 72248 - DNA, 25 bp, Mus musculus
aataattgcacctactcctcagcgc

SEQ ID NO: 72249 - DNA, 25 bp, Mus musculus
aataattgcttgaaccctaggtaat

SEQ ID NO: 72250 - DNA, 25 bp, Mus musculus
aataattgcttgtaccctaggtaat

SEQ ID NO: 72251 - DNA, 25 bp, Mus musculus
aataattgtactcctcttctgagga

SEQ ID NO: 72252 - DNA, 25 bp, Mus musculus
aataattgtactgctcttctgagga

SEQ ID NO: 72253 - DNA, 25 bp, Mus musculus
aataattgtgttacgaagctttggg

SEQ ID NO: 72254 - DNA, 25 bp, Mus musculus
aataattgtgtttcgaagctttggg

SEQ ID NO: 72255 - DNA, 25 bp, Mus musculus
aataattgttgtctgtgatacctgt

SEQ ID NO: 72256 - DNA, 25 bp, Mus musculus
aataattgttgtgtgtgatacctgt

SEQ ID NO: 72257 - DNA, 25 bp, Mus musculus
aataatttaaatactgttgctgctt

SEQ ID NO: 72258 - DNA, 25 bp, Mus musculus
aataatttaaattctgttgctgctt

SEQ ID NO: 72259 - DNA, 25 bp, Mus musculus
aataatttacagaggcagagctgga

SEQ ID NO: 72260 - DNA, 25 bp, Mus musculus
aataatttacagtggcagagctgga

SEQ ID NO: 72261 - DNA, 25 bp, Mus musculus
aataatttcaaaactttgtcatgac

SEQ ID NO: 72262 - DNA, 25 bp, Mus musculus
aataatttcaaatctttgtcatgac

SEQ ID NO: 72263 - DNA, 25 bp, Mus musculus
aataatttccccagttgctgagcgt

SEQ ID NO: 72264 - DNA, 25 bp, Mus musculus
aataatttcccctgttgctgagcgt

SEQ ID NO: 72265 - DNA, 25 bp, Mus musculus
aataatttctcgagggacgtcctct

SEQ ID NO: 72266 - DNA, 25 bp, Mus musculus
aataatttctcgtgggacgtcctct

SEQ ID NO: 72267 - DNA, 25 bp, Mus musculus
aataatttctctccacgaagctgtc

SEQ ID NO: 72268 - DNA, 25 bp, Mus musculus
aataatttctctgcacgaagctgtc

SEQ ID NO: 72269 - DNA, 25 bp, Mus musculus
aataatttgggcctagagttccctg

SEQ ID NO: 72270 - DNA, 25 bp, Mus musculus
aataatttgggcgtagagttccctg

SEQ ID NO: 72271 - DNA, 25 bp, Mus musculus
aataatttgtctagaagcccagtgt

SEQ ID NO: 72272 - DNA, 25 bp, Mus musculus
aataatttgtcttgaagcccagtgt

SEQ ID NO: 72273 - DNA, 25 bp, Mus musculus
aataatttgtttctgaacattgctg

SEQ ID NO: 72274 - DNA, 25 bp, Mus musculus
aataatttgtttgtgaacattgctg

SEQ ID NO: 72275 - DNA, 25 bp, Mus musculus
aataattttcagcaagtcgatgtat

SEQ ID NO: 72276 - DNA, 25 bp, Mus musculus
aataattttcaggaagtcgatgtat

SEQ ID NO: 72277 - DNA, 25 bp, Mus musculus
aataattttgtgactccctgtcctt

SEQ ID NO: 72278 - DNA, 25 bp, Mus musculus
aataattttgtgtctccctgtcctt

SEQ ID NO: 72279 - DNA, 25 bp, Mus musculus
aataatttttatactcattgagaca

SEQ ID NO: 72280 - DNA, 25 bp, Mus musculus
aataatttttatcccgtaggagatg

SEQ ID NO: 72281 - DNA, 25 bp, Mus musculus
aataatttttatgccgtaggagatg

SEQ ID NO: 72282 - DNA, 25 bp, Mus musculus
aataatttttattctcattgagaca

SEQ ID NO: 72283 - DNA, 25 bp, Mus musculus
aataatttttctatgcaggggccag

SEQ ID NO: 72284 - DNA, 25 bp, Mus musculus
aataatttttctttgcaggggccag

SEQ ID NO: 72285 - DNA, 25 bp, Mus musculus
aatacaaaccccacacagcttaaag

SEQ ID NO: 72286 - DNA, 25 bp, Mus musculus
aatacaaacccctcacagcttaaag

SEQ ID NO: 72287 - DNA, 25 bp, Mus musculus
aatacaaaccttatgccaggtggtg

SEQ ID NO: 72288 - DNA, 25 bp, Mus musculus
aatacaaaccttttgccaggtggtg

SEQ ID NO: 72289 - DNA, 25 bp, Mus musculus
aatacaaactaaagcttcacacaga

SEQ ID NO: 72290 - DNA, 25 bp, Mus musculus
aatacaaactaatgcttcacacaga

SEQ ID NO: 72291 - DNA, 25 bp, Mus musculus
aatacaaactctcagcttgtctgat

SEQ ID NO: 72292 - DNA, 25 bp, Mus musculus
aatacaaactctgagcttgtctgat

SEQ ID NO: 72293 - DNA, 25 bp, Mus musculus
aatacaaactgaacctgaagagctg

SEQ ID NO: 72294 - DNA, 25 bp, Mus musculus
aatacaaactgatcctgaagagctg

SEQ ID NO: 72295 - DNA, 25 bp, Mus musculus
aatacaaagcccattcgtttccttg

SEQ ID NO: 72296 - DNA, 25 bp, Mus musculus
aatacaaagccctttcgtttccttg

SEQ ID NO: 72297 - DNA, 25 bp, Mus musculus
aatacaaagggacggctggcaacgc

SEQ ID NO: 72298 - DNA, 25 bp, Mus musculus
aatacaaagggagggctggcaacgc

SEQ ID NO: 72299 - DNA, 25 bp, Mus musculus
aatacaaatatcctggtcatatgat

SEQ ID NO: 72300 - DNA, 25 bp, Mus musculus
aatacaaatatcgtggtcatatgat

SEQ ID NO: 72301 - DNA, 25 bp, Mus musculus
aatacaaatcccaggagttggtgag

SEQ ID NO: 72302 - DNA, 25 bp, Mus musculus
aatacaaatccctggagttggtgag

SEQ ID NO: 72303 - DNA, 25 bp, Mus musculus
aatacaacactgcttcctttgtgga

SEQ ID NO: 72304 - DNA, 25 bp, Mus musculus
aatacaacactggttcctttgtgga

SEQ ID NO: 72305 - DNA, 25 bp, Mus musculus
aatacaacatacactcatttggact

SEQ ID NO: 72306 - DNA, 25 bp, Mus musculus
aatacaacatactctcatttggact

SEQ ID NO: 72307 - DNA, 25 bp, Mus musculus
aatacaaccgtactggaccatgtcc

SEQ ID NO: 72308 - DNA, 25 bp, Mus musculus
aatacaaccgtagtggaccatgtcc

SEQ ID NO: 72309 - DNA, 25 bp, Mus musculus
aatacaacctttaggattagttatg

SEQ ID NO: 72310 - DNA, 25 bp, Mus musculus
aatacaaccttttggattagttatg

SEQ ID NO: 72311 - DNA, 25 bp, Mus musculus
aatacaacgccccaggtgtgttgct

SEQ ID NO: 72312 - DNA, 25 bp, Mus musculus
aatacaacgcccgaggtgtgttgct

SEQ ID NO: 72313 - DNA, 25 bp, Mus musculus
aatacaacgcgaaactagagttcaa

SEQ ID NO: 72314 - DNA, 25 bp, Mus musculus
aatacaacgcgatactagagttcaa

SEQ ID NO: 72315 - DNA, 25 bp, Mus musculus
aatacaactgctcccgttttgtttg

SEQ ID NO: 72316 - DNA, 25 bp, Mus musculus
aatacaactgctgccgttttgtttg

SEQ ID NO: 72317 - DNA, 25 bp, Mus musculus
aatacaacttgaactttcaggagtg

SEQ ID NO: 72318 - DNA, 25 bp, Mus musculus
aatacaacttgatctttcaggagtg

SEQ ID NO: 72319 - DNA, 25 bp, Mus musculus
aatacaactttgcatcttgcaccat

SEQ ID NO: 72320 - DNA, 25 bp, Mus musculus
aatacaactttggatcttgcaccat

SEQ ID NO: 72321 - DNA, 25 bp, Mus musculus
aatacaagagggaccccaacagcag

SEQ ID NO: 72322 - DNA, 25 bp, Mus musculus
aatacaagagggtccccaacagcag

SEQ ID NO: 72323 - DNA, 25 bp, Mus musculus
aatacaaggcggagcaccccaaaat

SEQ ID NO: 72324 - DNA, 25 bp, Mus musculus
aatacaaggcggtgcaccccaaaat

SEQ ID NO: 72325 - DNA, 25 bp, Mus musculus
aatacaaggctgctatttttgcaag

SEQ ID NO: 72326 - DNA, 25 bp, Mus musculus
aatacaaggctggtatttttgcaag

SEQ ID NO: 72327 - DNA, 25 bp, Mus musculus
aatacaagtgttatagccgggtggt

SEQ ID NO: 72328 - DNA, 25 bp, Mus musculus
aatacaagtgttttagccgggtggt

SEQ ID NO: 72329 - DNA, 25 bp, Mus musculus
aatacaatcacgctctgagctccct

SEQ ID NO: 72330 - DNA, 25 bp, Mus musculus
aatacaatcacggtctgagctccct

SEQ ID NO: 72331 - DNA, 25 bp, Mus musculus
aatacaatcctcaaaatatctaata

SEQ ID NO: 72332 - DNA, 25 bp, Mus musculus
aatacaatcctctaaatatctaata

SEQ ID NO: 72333 - DNA, 25 bp, Mus musculus
aatacaatgagcactgttggttccg

SEQ ID NO: 72334 - DNA, 25 bp, Mus musculus
aatacaatgagctctgttggttccg

SEQ ID NO: 72335 - DNA, 25 bp, Mus musculus
aatacaatgcaactgctatggattt

SEQ ID NO: 72336 - DNA, 25 bp, Mus musculus
aatacaatgcaagtgctatggattt

SEQ ID NO: 72337 - DNA, 25 bp, Mus musculus
aatacaatgtatatccttttgggtc

SEQ ID NO: 72338 - DNA, 25 bp, Mus musculus
aatacaatgtatttccttttgggtc

SEQ ID NO: 72339 - DNA, 25 bp, Mus musculus
aatacaattggcacgtgctgcgtct

SEQ ID NO: 72340 - DNA, 25 bp, Mus musculus
aatacaattggctcgtgctgcgtct

SEQ ID NO: 72341 - DNA, 25 bp, Mus musculus
aatacaatttgccactcagatgagt

SEQ ID NO: 72342 - DNA, 25 bp, Mus musculus
aatacaatttgcgactcagatgagt

SEQ ID NO: 72343 - DNA, 25 bp, Mus musculus
aatacacaccgaaattctgactgag

SEQ ID NO: 72344 - DNA, 25 bp, Mus musculus
aatacacaccgatattctgactgag

SEQ ID NO: 72345 - DNA, 25 bp, Mus musculus
aatacacagaatcctttggacagag

SEQ ID NO: 72346 - DNA, 25 bp, Mus musculus
aatacacagaatgctttggacagag

SEQ ID NO: 72347 - DNA, 25 bp, Mus musculus
aatacacaggatagctgggcccacg

SEQ ID NO: 72348 - DNA, 25 bp, Mus musculus
aatacacaggattgctgggcccacg

SEQ ID NO: 72349 - DNA, 25 bp, Mus musculus
aatacacagggcacagatagtttta

SEQ ID NO: 72350 - DNA, 25 bp, Mus musculus
aatacacagggctcagatagtttta

SEQ ID NO: 72351 - DNA, 25 bp, Mus musculus
aatacacagtaacatgtgtggactg

SEQ ID NO: 72352 - DNA, 25 bp, Mus musculus
aatacacagtaagatgtgtggactg

SEQ ID NO: 72353 - DNA, 25 bp, Mus musculus
aatacacatatacacctataggtgg

SEQ ID NO: 72354 - DNA, 25 bp, Mus musculus
aatacacatatagacctataggtgg

SEQ ID NO: 72355 - DNA, 25 bp, Mus musculus
aatacacatcacaagccaggcagtg

SEQ ID NO: 72356 - DNA, 25 bp, Mus musculus
aatacacatcactagccaggcagtg

SEQ ID NO: 72357 - DNA, 25 bp, Mus musculus
aatacacatttcaaccactgtttgg

SEQ ID NO: 72358 - DNA, 25 bp, Mus musculus
aatacacatttctaccactgtttgg

SEQ ID NO: 72359 - DNA, 25 bp, Mus musculus
aatacaccaagtcccaaagcagcat

SEQ ID NO: 72360 - DNA, 25 bp, Mus musculus
aatacaccaagtgccaaagcagcat

SEQ ID NO: 72361 - DNA, 25 bp, Mus musculus
aatacacccgcccatatgccaaggt

SEQ ID NO: 72362 - DNA, 25 bp, Mus musculus
aatacacccgccgatatgccaaggt

SEQ ID NO: 72363 - DNA, 25 bp, Mus musculus
aatacaccggatagaaagccctgct

SEQ ID NO: 72364 - DNA, 25 bp, Mus musculus
aatacaccggattgaaagccctgct

SEQ ID NO: 72365 - DNA, 25 bp, Mus musculus
aatacacctctaacttgcatgggaa

SEQ ID NO: 72366 - DNA, 25 bp, Mus musculus
aatacacctctacgttcagaacctg

SEQ ID NO: 72367 - DNA, 25 bp, Mus musculus
aatacacctctaggttcagaacctg

SEQ ID NO: 72368 - DNA, 25 bp, Mus musculus
aatacacctctatcttgcatgggaa

SEQ ID NO: 72369 - DNA, 25 bp, Mus musculus
aatacacctgtgacagggctcaggg

SEQ ID NO: 72370 - DNA, 25 bp, Mus musculus
aatacacctgtgtcagggctcaggg

SEQ ID NO: 72371 - DNA, 25 bp, Mus musculus
aatacacgctccctccaggtgtgga

SEQ ID NO: 72372 - DNA, 25 bp, Mus musculus
aatacacgctccgtccaggtgtgga

SEQ ID NO: 72373 - DNA, 25 bp, Mus musculus
aatacactagtaaaggatccatgat

SEQ ID NO: 72374 - DNA, 25 bp, Mus musculus
aatacactagtataggatccatgat

SEQ ID NO: 72375 - DNA, 25 bp, Mus musculus
aatacactcacaccagtatctagag

SEQ ID NO: 72376 - DNA, 25 bp, Mus musculus
aatacactcacagcagtatctagag

SEQ ID NO: 72377 - DNA, 25 bp, Mus musculus
aatacactcaccctgcttaatgttt

SEQ ID NO: 72378 - DNA, 25 bp, Mus musculus
aatacactcaccgtgcttaatgttt

SEQ ID NO: 72379 - DNA, 25 bp, Mus musculus
aatacactccagctgctgcgttata

SEQ ID NO: 72380 - DNA, 25 bp, Mus musculus
aatacactccaggtgctgcgttata

SEQ ID NO: 72381 - DNA, 25 bp, Mus musculus
aatacactcccaactgtttcagagg

SEQ ID NO: 72382 - DNA, 25 bp, Mus musculus
aatacactcccatctgtttcagagg

SEQ ID NO: 72383 - DNA, 25 bp, Mus musculus
aatacactctcacgtatcctttctg

SEQ ID NO: 72384 - DNA, 25 bp, Mus musculus
aatacactctcaggtatcctttctg

SEQ ID NO: 72385 - DNA, 25 bp, Mus musculus
aatacactctctacctggcatgtgt

SEQ ID NO: 72386 - DNA, 25 bp, Mus musculus
aatacactctctcccagaatacttg

SEQ ID NO: 72387 - DNA, 25 bp, Mus musculus
aatacactctctgccagaatacttg

SEQ ID NO: 72388 - DNA, 25 bp, Mus musculus
aatacactctcttcctggcatgtgt

SEQ ID NO: 72389 - DNA, 25 bp, Mus musculus
aatacactgagcatgtttgtagaga

SEQ ID NO: 72390 - DNA, 25 bp, Mus musculus
aatacactgagcttgtttgtagaga

SEQ ID NO: 72391 - DNA, 25 bp, Mus musculus
aatacactgcccatgttgaagattt

SEQ ID NO: 72392 - DNA, 25 bp, Mus musculus
aatacactgcccttgttgaagattt

SEQ ID NO: 72393 - DNA, 25 bp, Mus musculus
aatacactgcttctgcgtggtgaga

SEQ ID NO: 72394 - DNA, 25 bp, Mus musculus
aatacactgcttgtgcgtggtgaga

SEQ ID NO: 72395 - DNA, 25 bp, Mus musculus
aatacactggaaaagttcgctgcaa

SEQ ID NO: 72396 - DNA, 25 bp, Mus musculus
aatacactggaatagttcgctgcaa

SEQ ID NO: 72397 - DNA, 25 bp, Mus musculus
aatacactgttactagcctacttgc

SEQ ID NO: 72398 - DNA, 25 bp, Mus musculus
aatacactgttagtagcctacttgc

SEQ ID NO: 72399 - DNA, 25 bp, Mus musculus
aatacactgttcaaggtccccttct

SEQ ID NO: 72400 - DNA, 25 bp, Mus musculus
aatacactgttctaggtccccttct

SEQ ID NO: 72401 - DNA, 25 bp, Mus musculus
aatacactgtttccccttctgaaca

SEQ ID NO: 72402 - DNA, 25 bp, Mus musculus
aatacactgtttgcccttctgaaca

SEQ ID NO: 72403 - DNA, 25 bp, Mus musculus
aatacacttaagctttgtctgcaaa

SEQ ID NO: 72404 - DNA, 25 bp, Mus musculus
aatacacttaaggtttgtctgcaaa

SEQ ID NO: 72405 - DNA, 25 bp, Mus musculus
aatacacttgagatgtttctacact

SEQ ID NO: 72406 - DNA, 25 bp, Mus musculus
aatacacttgagttgtttctacact

SEQ ID NO: 72407 - DNA, 25 bp, Mus musculus
aatacacttgtgattcaggaaacct

SEQ ID NO: 72408 - DNA, 25 bp, Mus musculus
aatacacttgtgtttcaggaaacct

SEQ ID NO: 72409 - DNA, 25 bp, Mus musculus
aatacactttcaatgcttcagtttg

SEQ ID NO: 72410 - DNA, 25 bp, Mus musculus
aatacactttcattgcttcagtttg

SEQ ID NO: 72411 - DNA, 25 bp, Mus musculus
aatacagacagcacttgcaggttat

SEQ ID NO: 72412 - DNA, 25 bp, Mus musculus
aatacagacagctcttgcaggttat

SEQ ID NO: 72413 - DNA, 25 bp, Mus musculus
aatacagacctgctggccacaggct

SEQ ID NO: 72414 - DNA, 25 bp, Mus musculus
aatacagacctggtggccacaggct

SEQ ID NO: 72415 - DNA, 25 bp, Mus musculus
aatacagacgggagtgcctgcaacc

SEQ ID NO: 72416 - DNA, 25 bp, Mus musculus
aatacagacgggtgtgcctgcaacc

SEQ ID NO: 72417 - DNA, 25 bp, Mus musculus
aatacagacttcactcccacattaa

SEQ ID NO: 72418 - DNA, 25 bp, Mus musculus
aatacagacttctctcccacattaa

SEQ ID NO: 72419 - DNA, 25 bp, Mus musculus
aatacagagcaaacttcctgccaca

SEQ ID NO: 72420 - DNA, 25 bp, Mus musculus
aatacagagcaatcttcctgccaca

SEQ ID NO: 72421 - DNA, 25 bp, Mus musculus
aatacagaggctcctcggcttacag

SEQ ID NO: 72422 - DNA, 25 bp, Mus musculus
aatacagaggctgctcggcttacag

SEQ ID NO: 72423 - DNA, 25 bp, Mus musculus
aatacagagttcacctgttccccag

SEQ ID NO: 72424 - DNA, 25 bp, Mus musculus
aatacagagttctcctgttccccag

SEQ ID NO: 72425 - DNA, 25 bp, Mus musculus
aatacagatacactcccaagggagg

SEQ ID NO: 72426 - DNA, 25 bp, Mus musculus
aatacagatacagtcccaagggagg

SEQ ID NO: 72427 - DNA, 25 bp, Mus musculus
aatacagatcatagacagccgtcca

SEQ ID NO: 72428 - DNA, 25 bp, Mus musculus
aatacagatcattgacagccgtcca

SEQ ID NO: 72429 - DNA, 25 bp, Mus musculus
aatacagattcaattcccagaagtc

SEQ ID NO: 72430 - DNA, 25 bp, Mus musculus
aatacagattcatttcccagaagtc

SEQ ID NO: 72431 - DNA, 25 bp, Mus musculus
aatacagattctctatcccattccc

SEQ ID NO: 72432 - DNA, 25 bp, Mus musculus
aatacagattctgtatcccattccc

SEQ ID NO: 72433 - DNA, 25 bp, Mus musculus
aatacagattgtaccctttgaaaat

SEQ ID NO: 72434 - DNA, 25 bp, Mus musculus
aatacagattgttccctttgaaaat

SEQ ID NO: 72435 - DNA, 25 bp, Mus musculus
aatacagcaacaccaggcgcgaccg

SEQ ID NO: 72436 - DNA, 25 bp, Mus musculus
aatacagcaacagcaggcgcgaccg

SEQ ID NO: 72437 - DNA, 25 bp, Mus musculus
aatacagcacttccttagccttctg

SEQ ID NO: 72438 - DNA, 25 bp, Mus musculus
aatacagcacttgcttagccttctg

SEQ ID NO: 72439 - DNA, 25 bp, Mus musculus
aatacagcagttatcctaggcccaa

SEQ ID NO: 72440 - DNA, 25 bp, Mus musculus
aatacagcagttttcctaggcccaa

SEQ ID NO: 72441 - DNA, 25 bp, Mus musculus
aatacagcatttcagttcactccac

SEQ ID NO: 72442 - DNA, 25 bp, Mus musculus
aatacagcatttgagttcactccac

SEQ ID NO: 72443 - DNA, 25 bp, Mus musculus
aatacagccagaacgtgattctaat

SEQ ID NO: 72444 - DNA, 25 bp, Mus musculus
aatacagccagatcgtgattctaat

SEQ ID NO: 72445 - DNA, 25 bp, Mus musculus
aatacagccatgatgtgcctctgcc

SEQ ID NO: 72446 - DNA, 25 bp, Mus musculus
aatacagccatgttgtgcctctgcc

SEQ ID NO: 72447 - DNA, 25 bp, Mus musculus
aatacagcccaaaagctgctgcctg

SEQ ID NO: 72448 - DNA, 25 bp, Mus musculus
aatacagcccaatagctgctgcctg

SEQ ID NO: 72449 - DNA, 25 bp, Mus musculus
aatacagccttacctgagcagcgtt

SEQ ID NO: 72450 - DNA, 25 bp, Mus musculus
aatacagccttagctgagcagcgtt

SEQ ID NO: 72451 - DNA, 25 bp, Mus musculus
aatacagcggtcctgttgagttctc

SEQ ID NO: 72452 - DNA, 25 bp, Mus musculus
aatacagcggtcgtgttgagttctc

SEQ ID NO: 72453 - DNA, 25 bp, Mus musculus
aatacagcgtgcaggtttggcgtat

SEQ ID NO: 72454 - DNA, 25 bp, Mus musculus
aatacagcgtgctggtttggcgtat

SEQ ID NO: 72455 - DNA, 25 bp, Mus musculus
aatacagcgttacggtcggtgacat

SEQ ID NO: 72456 - DNA, 25 bp, Mus musculus
aatacagcgttagggtcggtgacat

SEQ ID NO: 72457 - DNA, 25 bp, Mus musculus
aatacagctataactgaccttgaga

SEQ ID NO: 72458 - DNA, 25 bp, Mus musculus
aatacagctatatctgaccttgaga

SEQ ID NO: 72459 - DNA, 25 bp, Mus musculus
aatacagctcctcttattatggcta

SEQ ID NO: 72460 - DNA, 25 bp, Mus musculus
aatacagctcctgttattatggcta

SEQ ID NO: 72461 - DNA, 25 bp, Mus musculus
aatacagctcttaaggatccagaag

SEQ ID NO: 72462 - DNA, 25 bp, Mus musculus
aatacagctctttaggatccagaag

SEQ ID NO: 72463 - DNA, 25 bp, Mus musculus
aatacagctgggaccctaccttcaa

SEQ ID NO: 72464 - DNA, 25 bp, Mus musculus
aatacagctgggtccctaccttcaa

SEQ ID NO: 72465 - DNA, 25 bp, Mus musculus
aatacaggagagattgggacaagac

SEQ ID NO: 72466 - DNA, 25 bp, Mus musculus
aatacaggagagtttgggacaagac

SEQ ID NO: 72467 - DNA, 25 bp, Mus musculus
aatacaggcaagcaaggccaatggc

SEQ ID NO: 72468 - DNA, 25 bp, Mus musculus
aatacaggcaaggaaggccaatggc

SEQ ID NO: 72469 - DNA, 25 bp, Mus musculus
aatacaggcatcatctaagggaccc

SEQ ID NO: 72470 - DNA, 25 bp, Mus musculus
aatacaggcatcttctaagggaccc

SEQ ID NO: 72471 - DNA, 25 bp, Mus musculus
aatacaggcccaattatacacaagg

SEQ ID NO: 72472 - DNA, 25 bp, Mus musculus
aatacaggcccatttatacacaagg

SEQ ID NO: 72473 - DNA, 25 bp, Mus musculus
aatacaggccctaagatctctgctg

SEQ ID NO: 72474 - DNA, 25 bp, Mus musculus
aatacaggcccttagatctctgctg

SEQ ID NO: 72475 - DNA, 25 bp, Mus musculus
aatacaggcgacaccaagcttgttt

SEQ ID NO: 72476 - DNA, 25 bp, Mus musculus
aatacaggcgacagacggtccccat

SEQ ID NO: 72477 - DNA, 25 bp, Mus musculus
aatacaggcgactccaagcttgttt

SEQ ID NO: 72478 - DNA, 25 bp, Mus musculus
aatacaggcgactgacggtccccat

SEQ ID NO: 72479 - DNA, 25 bp, Mus musculus
aatacagggcttacgattcagcgct

SEQ ID NO: 72480 - DNA, 25 bp, Mus musculus
aatacagggctttcgattcagcgct

SEQ ID NO: 72481 - DNA, 25 bp, Mus musculus
aatacaggtacacgatgctgaagaa

SEQ ID NO: 72482 - DNA, 25 bp, Mus musculus
aatacaggtacaggatgctgaagaa

SEQ ID NO: 72483 - DNA, 25 bp, Mus musculus
aatacaggttgtccaggcagctggt

SEQ ID NO: 72484 - DNA, 25 bp, Mus musculus
aatacaggttgtgcaggcagctggt

SEQ ID NO: 72485 - DNA, 25 bp, Mus musculus
aatacagtaaaaccactactctgct

SEQ ID NO: 72486 - DNA, 25 bp, Mus musculus
aatacagtaaaagcactactctgct

SEQ ID NO: 72487 - DNA, 25 bp, Mus musculus
aatacagtactgattcccacataat

SEQ ID NO: 72488 - DNA, 25 bp, Mus musculus
aatacagtactgtttcccacataat

SEQ ID NO: 72489 - DNA, 25 bp, Mus musculus
aatacagtctctaagtcactaggct

SEQ ID NO: 72490 - DNA, 25 bp, Mus musculus
aatacagtctcttagtcactaggct

SEQ ID NO: 72491 - DNA, 25 bp, Mus musculus
aatacagtgaaaaagcccaggatat

SEQ ID NO: 72492 - DNA, 25 bp, Mus musculus
aatacagtgaaatagcccaggatat

SEQ ID NO: 72493 - DNA, 25 bp, Mus musculus
aatacagtgacccactgtgcttctt

SEQ ID NO: 72494 - DNA, 25 bp, Mus musculus
aatacagtgaccgactgtgcttctt

SEQ ID NO: 72495 - DNA, 25 bp, Mus musculus
aatacagtgagcagcttagaactat

SEQ ID NO: 72496 - DNA, 25 bp, Mus musculus
aatacagtgagctgcttagaactat

SEQ ID NO: 72497 - DNA, 25 bp, Mus musculus
aatacagtgatgaagctgctagcga

SEQ ID NO: 72498 - DNA, 25 bp, Mus musculus
aatacagtgatgtagctgctagcga

SEQ ID NO: 72499 - DNA, 25 bp, Mus musculus
aatacagtgcccctttcagtgatgg

SEQ ID NO: 72500 - DNA, 25 bp, Mus musculus
aatacagtgcccgtttcagtgatgg

SEQ ID NO: 72501 - DNA, 25 bp, Mus musculus
aatacagtgctcaggtggtggcctt

SEQ ID NO: 72502 - DNA, 25 bp, Mus musculus
aatacagtgctctggtggtggcctt

SEQ ID NO: 72503 - DNA, 25 bp, Mus musculus
aatacagttctacattggctagcct

SEQ ID NO: 72504 - DNA, 25 bp, Mus musculus
aatacagttctagattggctagcct

SEQ ID NO: 72505 - DNA, 25 bp, Mus musculus
aatacagttggtaccttatgttatt

SEQ ID NO: 72506 - DNA, 25 bp, Mus musculus
aatacagttggttccttatgttatt

SEQ ID NO: 72507 - DNA, 25 bp, Mus musculus
aatacataaattacccctcagacct

SEQ ID NO: 72508 - DNA, 25 bp, Mus musculus
aatacataaatttcccctcagacct

SEQ ID NO: 72509 - DNA, 25 bp, Mus musculus
aatacataacttaggctggtcccaa

SEQ ID NO: 72510 - DNA, 25 bp, Mus musculus
aatacataactttggctggtcccaa

SEQ ID NO: 72511 - DNA, 25 bp, Mus musculus
aatacataatagaggctgaggctca

SEQ ID NO: 72512 - DNA, 25 bp, Mus musculus
aatacataatagtggctgaggctca

SEQ ID NO: 72513 - DNA, 25 bp, Mus musculus
aatacataatgtcactaggcttctg

SEQ ID NO: 72514 - DNA, 25 bp, Mus musculus
aatacataatgtgactaggcttctg

SEQ ID NO: 72515 - DNA, 25 bp, Mus musculus
aatacatacaacatccagctcttag

SEQ ID NO: 72516 - DNA, 25 bp, Mus musculus
aatacatacaacttccagctcttag

SEQ ID NO: 72517 - DNA, 25 bp, Mus musculus
aatacatacacactacctgggatgc

SEQ ID NO: 72518 - DNA, 25 bp, Mus musculus
aatacatacacagtacctgggatgc

SEQ ID NO: 72519 - DNA, 25 bp, Mus musculus
aatacatactctaacgctccaagtt

SEQ ID NO: 72520 - DNA, 25 bp, Mus musculus
aatacatactcttacgctccaagtt

SEQ ID NO: 72521 - DNA, 25 bp, Mus musculus
aatacatacttgctttctgccatga

SEQ ID NO: 72522 - DNA, 25 bp, Mus musculus
aatacatacttggtttctgccatga

SEQ ID NO: 72523 - DNA, 25 bp, Mus musculus
aatacatagctacaggagtccaggg

SEQ ID NO: 72524 - DNA, 25 bp, Mus musculus
aatacatagctagaggagtccaggg

SEQ ID NO: 72525 - DNA, 25 bp, Mus musculus
aatacatagtacagccagtcacgag

SEQ ID NO: 72526 - DNA, 25 bp, Mus musculus
aatacatagtactgccagtcacgag

SEQ ID NO: 72527 - DNA, 25 bp, Mus musculus
aatacatagtatcgtggcccagagt

SEQ ID NO: 72528 - DNA, 25 bp, Mus musculus
aatacatagtatggtggcccagagt

SEQ ID NO: 72529 - DNA, 25 bp, Mus musculus
aatacatattccacaggccagttcc

SEQ ID NO: 72530 - DNA, 25 bp, Mus musculus
aatacatattcctcaggccagttcc

SEQ ID NO: 72531 - DNA, 25 bp, Mus musculus
aatacatcaactactgcaacccaga

SEQ ID NO: 72532 - DNA, 25 bp, Mus musculus
aatacatcaacttctgcaacccaga

SEQ ID NO: 72533 - DNA, 25 bp, Mus musculus
aatacatcaaggacagagaggcggt

SEQ ID NO: 72534 - DNA, 25 bp, Mus musculus
aatacatcaaggtcagagaggcggt

SEQ ID NO: 72535 - DNA, 25 bp, Mus musculus
aatacatcaatccattttcctctgc

SEQ ID NO: 72536 - DNA, 25 bp, Mus musculus
aatacatcaatcgattttcctctgc

SEQ ID NO: 72537 - DNA, 25 bp, Mus musculus
aatacatcacacctagtgcatctgc

SEQ ID NO: 72538 - DNA, 25 bp, Mus musculus
aatacatcacacgtagtgcatctgc

SEQ ID NO: 72539 - DNA, 25 bp, Mus musculus
aatacatcctctcttttcccgttct

SEQ ID NO: 72540 - DNA, 25 bp, Mus musculus
aatacatcctctgttttcccgttct

SEQ ID NO: 72541 - DNA, 25 bp, Mus musculus
aatacatcttatcgcttgggttgag

SEQ ID NO: 72542 - DNA, 25 bp, Mus musculus
aatacatcttatggcttgggttgag

SEQ ID NO: 72543 - DNA, 25 bp, Mus musculus
aatacatgaacacaggccaatttga

SEQ ID NO: 72544 - DNA, 25 bp, Mus musculus
aatacatgaacagaggccaatttga

SEQ ID NO: 72545 - DNA, 25 bp, Mus musculus
aatacatgaggcaaatcccagcact

SEQ ID NO: 72546 - DNA, 25 bp, Mus musculus
aatacatgaggctaatcccagcact

SEQ ID NO: 72547 - DNA, 25 bp, Mus musculus
aatacatgattcacgttgaactgtg

SEQ ID NO: 72548 - DNA, 25 bp, Mus musculus
aatacatgattctcgttgaactgtg

SEQ ID NO: 72549 - DNA, 25 bp, Mus musculus
aatacatgcatacgtgtcacgtaca

SEQ ID NO: 72550 - DNA, 25 bp, Mus musculus
aatacatgcataggtgtcacgtaca

SEQ ID NO: 72551 - DNA, 25 bp, Mus musculus
aatacatgcgacagagcctcatctt

SEQ ID NO: 72552 - DNA, 25 bp, Mus musculus
aatacatgcgactgagcctcatctt

SEQ ID NO: 72553 - DNA, 25 bp, Mus musculus
aatacatgcgtgatggtagcaatgg

SEQ ID NO: 72554 - DNA, 25 bp, Mus musculus
aatacatgcgtgttggtagcaatgg

SEQ ID NO: 72555 - DNA, 25 bp, Mus musculus
aatacatgcttaatagtgttctaaa

SEQ ID NO: 72556 - DNA, 25 bp, Mus musculus
aatacatgcttattagtgttctaaa

SEQ ID NO: 72557 - DNA, 25 bp, Mus musculus
aatacatgcttgagtaacgtgcccc

SEQ ID NO: 72558 - DNA, 25 bp, Mus musculus
aatacatgcttgtgtaacgtgcccc

SEQ ID NO: 72559 - DNA, 25 bp, Mus musculus
aatacatggctgacgttttcctacc

SEQ ID NO: 72560 - DNA, 25 bp, Mus musculus
aatacatggctgtcgttttcctacc

SEQ ID NO: 72561 - DNA, 25 bp, Mus musculus
aatacatgtgtaccttacttgagac

SEQ ID NO: 72562 - DNA, 25 bp, Mus musculus
aatacatgtgtagcttacttgagac

SEQ ID NO: 72563 - DNA, 25 bp, Mus musculus
aatacatgttgtcccagagttagaa

SEQ ID NO: 72564 - DNA, 25 bp, Mus musculus
aatacatgttgtgccagagttagaa

SEQ ID NO: 72565 - DNA, 25 bp, Mus musculus
aatacattaaacctgtctccactgt

SEQ ID NO: 72566 - DNA, 25 bp, Mus musculus
aatacattaaacgtgtctccactgt

SEQ ID NO: 72567 - DNA, 25 bp, Mus musculus
aatacattcattcacagggctcaga

SEQ ID NO: 72568 - DNA, 25 bp, Mus musculus
aatacattcattgacagggctcaga

SEQ ID NO: 72569 - DNA, 25 bp, Mus musculus
aatacattccctcttacagtatgga

SEQ ID NO: 72570 - DNA, 25 bp, Mus musculus
aatacattccctgttacagtatgga

SEQ ID NO: 72571 - DNA, 25 bp, Mus musculus
aatacattccggagaaaagccttat

SEQ ID NO: 72572 - DNA, 25 bp, Mus musculus
aatacattccggtgaaaagccttat

SEQ ID NO: 72573 - DNA, 25 bp, Mus musculus
aatacattgctgaacccaggatcac

SEQ ID NO: 72574 - DNA, 25 bp, Mus musculus
aatacattgctgtacccaggatcac

SEQ ID NO: 72575 - DNA, 25 bp, Mus musculus
aatacatttcctatagagctaccat

SEQ ID NO: 72576 - DNA, 25 bp, Mus musculus
aatacatttcctttagagctaccat

SEQ ID NO: 72577 - DNA, 25 bp, Mus musculus
aatacatttctactactggctgcta

SEQ ID NO: 72578 - DNA, 25 bp, Mus musculus
aatacatttctagtactggctgcta

SEQ ID NO: 72579 - DNA, 25 bp, Mus musculus
aatacatttgtaacgtctgcagaat

SEQ ID NO: 72580 - DNA, 25 bp, Mus musculus
aatacatttgtatcgtctgcagaat

SEQ ID NO: 72581 - DNA, 25 bp, Mus musculus
aatacattttaacctagttggtcct

SEQ ID NO: 72582 - DNA, 25 bp, Mus musculus
aatacattttaagctagttggtcct

SEQ ID NO: 72583 - DNA, 25 bp, Mus musculus
aatacattttatccctgctccttag

SEQ ID NO: 72584 - DNA, 25 bp, Mus musculus
aatacattttatgcctgctccttag

SEQ ID NO: 72585 - DNA, 25 bp, Mus musculus
aatacattttccaaccatagcaggt

SEQ ID NO: 72586 - DNA, 25 bp, Mus musculus
aatacattttcctaccatagcaggt

SEQ ID NO: 72587 - DNA, 25 bp, Mus musculus
aatacatttttgacagaggcttaat

SEQ ID NO: 72588 - DNA, 25 bp, Mus musculus
aatacatttttgtcagaggcttaat

SEQ ID NO: 72589 - DNA, 25 bp, Mus musculus
aataccaaaactaagcaacagctta

SEQ ID NO: 72590 - DNA, 25 bp, Mus musculus
aataccaaaacttagcaacagctta

SEQ ID NO: 72591 - DNA, 25 bp, Mus musculus
aataccaaagcgctgttcctaatga

SEQ ID NO: 72592 - DNA, 25 bp, Mus musculus
aataccaaagcggtgttcctaatga

SEQ ID NO: 72593 - DNA, 25 bp, Mus musculus
aataccaaagctagtttctccctca

SEQ ID NO: 72594 - DNA, 25 bp, Mus musculus
aataccaaagcttgtttctccctca

SEQ ID NO: 72595 - DNA, 25 bp, Mus musculus
aataccaacagtacacgtcctctga

SEQ ID NO: 72596 - DNA, 25 bp, Mus musculus
aataccaacagttcacgtcctctga

SEQ ID NO: 72597 - DNA, 25 bp, Mus musculus
aataccaagtggagccttactgtgg

SEQ ID NO: 72598 - DNA, 25 bp, Mus musculus
aataccaagtggtgccttactgtgg

SEQ ID NO: 72599 - DNA, 25 bp, Mus musculus
aataccaatctgctcttggcaagcc

SEQ ID NO: 72600 - DNA, 25 bp, Mus musculus
aataccaatctggtcttggcaagcc

SEQ ID NO: 72601 - DNA, 25 bp, Mus musculus
aataccaattacagctgcctccttc

SEQ ID NO: 72602 - DNA, 25 bp, Mus musculus
aataccaattactgctgcctccttc

SEQ ID NO: 72603 - DNA, 25 bp, Mus musculus
aataccacaatcaatgcggagctag

SEQ ID NO: 72604 - DNA, 25 bp, Mus musculus
aataccacaatctatgcggagctag

SEQ ID NO: 72605 - DNA, 25 bp, Mus musculus
aataccacactcagttgttgtaaca

SEQ ID NO: 72606 - DNA, 25 bp, Mus musculus
aataccacactctgttgttgtaaca

SEQ ID NO: 72607 - DNA, 25 bp, Mus musculus
aataccacattgatgcagtcagtgt

SEQ ID NO: 72608 - DNA, 25 bp, Mus musculus
aataccacattgttgcagtcagtgt

SEQ ID NO: 72609 - DNA, 25 bp, Mus musculus
aataccaccatcctactgggcgtta

SEQ ID NO: 72610 - DNA, 25 bp, Mus musculus
aataccaccatcgtactgggcgtta

SEQ ID NO: 72611 - DNA, 25 bp, Mus musculus
aataccacccacaggcacatatact

SEQ ID NO: 72612 - DNA, 25 bp, Mus musculus
aataccacccactggcacatatact

SEQ ID NO: 72613 - DNA, 25 bp, Mus musculus
aataccacccagagttcctgaggag

SEQ ID NO: 72614 - DNA, 25 bp, Mus musculus
aataccacccagtgttcctgaggag

SEQ ID NO: 72615 - DNA, 25 bp, Mus musculus
aataccacctgtcggaccatgtttg

SEQ ID NO: 72616 - DNA, 25 bp, Mus musculus
aataccacctgtgggaccatgtttg

SEQ ID NO: 72617 - DNA, 25 bp, Mus musculus
aataccaccttcctcatcatgggct

SEQ ID NO: 72618 - DNA, 25 bp, Mus musculus
aataccaccttcgtcatcatgggct

SEQ ID NO: 72619 - DNA, 25 bp, Mus musculus
aataccacgttgacatgcccatgtc

SEQ ID NO: 72620 - DNA, 25 bp, Mus musculus
aataccacgttgtcatgcccatgtc

SEQ ID NO: 72621 - DNA, 25 bp, Mus musculus
aataccactcagaacagattccgcg

SEQ ID NO: 72622 - DNA, 25 bp, Mus musculus
aataccactcagtacagattccgcg

SEQ ID NO: 72623 - DNA, 25 bp, Mus musculus
aataccacttctctggccttagcgg

SEQ ID NO: 72624 - DNA, 25 bp, Mus musculus
aataccacttctgtggccttagcgg

SEQ ID NO: 72625 - DNA, 25 bp, Mus musculus
aataccactttgctagtagtatgta

SEQ ID NO: 72626 - DNA, 25 bp, Mus musculus
aataccactttggtagtagtatgta

SEQ ID NO: 72627 - DNA, 25 bp, Mus musculus
aataccagaaaaccatgaccccgtg

SEQ ID NO: 72628 - DNA, 25 bp, Mus musculus
aataccagaaaagcatgaccccgtg

SEQ ID NO: 72629 - DNA, 25 bp, Mus musculus
aataccagaagcactttcccgacat

SEQ ID NO: 72630 - DNA, 25 bp, Mus musculus
aataccagaagctctttcccgacat

SEQ ID NO: 72631 - DNA, 25 bp, Mus musculus
aataccagagcaacattggctgtca

SEQ ID NO: 72632 - DNA, 25 bp, Mus musculus
aataccagagcatcattggctgtca

SEQ ID NO: 72633 - DNA, 25 bp, Mus musculus
aataccagcagtacattgttgtcta

SEQ ID NO: 72634 - DNA, 25 bp, Mus musculus
aataccagcagttcattgttgtcta

SEQ ID NO: 72635 - DNA, 25 bp, Mus musculus
aataccagccaacgtgatgtgacca

SEQ ID NO: 72636 - DNA, 25 bp, Mus musculus
aataccagccaaggtgatgtgacca

SEQ ID NO: 72637 - DNA, 25 bp, Mus musculus
aataccagcgtcatgcatctagatg

SEQ ID NO: 72638 - DNA, 25 bp, Mus musculus
aataccagcgtcttgcatctagatg

SEQ ID NO: 72639 - DNA, 25 bp, Mus musculus
aataccagcgttctttttggcacac

SEQ ID NO: 72640 - DNA, 25 bp, Mus musculus
aataccagcgttgtttttggcacac

SEQ ID NO: 72641 - DNA, 25 bp, Mus musculus
aataccagtcttataaagaccagct

SEQ ID NO: 72642 - DNA, 25 bp, Mus musculus
aataccagtcttttaaagaccagct

SEQ ID NO: 72643 - DNA, 25 bp, Mus musculus
aataccagtgatcctgtcagcaatg

SEQ ID NO: 72644 - DNA, 25 bp, Mus musculus
aataccagtgatgctgtcagcaatg

SEQ ID NO: 72645 - DNA, 25 bp, Mus musculus
aataccagtgctatttctgtgcagt

SEQ ID NO: 72646 - DNA, 25 bp, Mus musculus
aataccagtgctttttctgtgcagt

SEQ ID NO: 72647 - DNA, 25 bp, Mus musculus
aataccataaaactgtttgctacaa

SEQ ID NO: 72648 - DNA, 25 bp, Mus musculus
aataccataaaagtgtttgctacaa

SEQ ID NO: 72649 - DNA, 25 bp, Mus musculus
aataccatacctaggctttctggtc

SEQ ID NO: 72650 - DNA, 25 bp, Mus musculus
aataccataccttggctttctggtc

SEQ ID NO: 72651 - DNA, 25 bp, Mus musculus
aataccatatatactgattacagtt

SEQ ID NO: 72652 - DNA, 25 bp, Mus musculus
aataccatatattctgattacagtt

SEQ ID NO: 72653 - DNA, 25 bp, Mus musculus
aataccatcaatacttgggatctga

SEQ ID NO: 72654 - DNA, 25 bp, Mus musculus
aataccatcaattcttgggatctga

SEQ ID NO: 72655 - DNA, 25 bp, Mus musculus
aataccatcagcacatcatgacaat

SEQ ID NO: 72656 - DNA, 25 bp, Mus musculus
aataccatcagctcatcatgacaat

SEQ ID NO: 72657 - DNA, 25 bp, Mus musculus
aataccatccagctacttggcagtt

SEQ ID NO: 72658 - DNA, 25 bp, Mus musculus
aataccatccaggtacttggcagtt

SEQ ID NO: 72659 - DNA, 25 bp, Mus musculus
aataccatccttataacagctacat

SEQ ID NO: 72660 - DNA, 25 bp, Mus musculus
aataccatccttttaacagctacat

SEQ ID NO: 72661 - DNA, 25 bp, Mus musculus
aataccatcgatctagctcttgata

SEQ ID NO: 72662 - DNA, 25 bp, Mus musculus
aataccatcgatgtagctcttgata

SEQ ID NO: 72663 - DNA, 25 bp, Mus musculus
aataccatctataacttgaacactg

SEQ ID NO: 72664 - DNA, 25 bp, Mus musculus
aataccatctattacttgaacactg

SEQ ID NO: 72665 - DNA, 25 bp, Mus musculus
aataccatgcagctaaacactcaca

SEQ ID NO: 72666 - DNA, 25 bp, Mus musculus
aataccatgcaggtaaacactcaca

SEQ ID NO: 72667 - DNA, 25 bp, Mus musculus
aataccatggctcactgaacacctt

SEQ ID NO: 72668 - DNA, 25 bp, Mus musculus
aataccatggctgactgaacacctt

SEQ ID NO: 72669 - DNA, 25 bp, Mus musculus
aataccatgggccattcttttctgg

SEQ ID NO: 72670 - DNA, 25 bp, Mus musculus
aataccatgggcgattcttttctgg

SEQ ID NO: 72671 - DNA, 25 bp, Mus musculus
aataccatgggtaaacacagcacac

SEQ ID NO: 72672 - DNA, 25 bp, Mus musculus
aataccatgggttaacacagcacac

SEQ ID NO: 72673 - DNA, 25 bp, Mus musculus
aataccatgttgcataccacccttc

SEQ ID NO: 72674 - DNA, 25 bp, Mus musculus
aataccatgttggataccacccttc

SEQ ID NO: 72675 - DNA, 25 bp, Mus musculus
aataccattattagtcaatttgtgg

SEQ ID NO: 72676 - DNA, 25 bp, Mus musculus
aataccattatttgtcaatttgtgg

SEQ ID NO: 72677 - DNA, 25 bp, Mus musculus
aataccattcttcgccaggccagaa

SEQ ID NO: 72678 - DNA, 25 bp, Mus musculus
aataccattcttggccaggccagaa

SEQ ID NO: 72679 - DNA, 25 bp, Mus musculus
aataccatttcacttcccacttctt

SEQ ID NO: 72680 - DNA, 25 bp, Mus musculus
aataccatttcagttcccacttctt

SEQ ID NO: 72681 - DNA, 25 bp, Mus musculus
aatacccaacaaagccacttctagg

SEQ ID NO: 72682 - DNA, 25 bp, Mus musculus
aatacccaacaatgccacttctagg

SEQ ID NO: 72683 - DNA, 25 bp, Mus musculus
aatacccaagttattgccgccaatt

SEQ ID NO: 72684 - DNA, 25 bp, Mus musculus
aatacccaagtttttgccgccaatt

SEQ ID NO: 72685 - DNA, 25 bp, Mus musculus
aatacccacatcaagccattggagg

SEQ ID NO: 72686 - DNA, 25 bp, Mus musculus
aatacccacatctagccattggagg

SEQ ID NO: 72687 - DNA, 25 bp, Mus musculus
aatacccactttcctgatgtcatgt

SEQ ID NO: 72688 - DNA, 25 bp, Mus musculus
aatacccactttgctgatgtcatgt

SEQ ID NO: 72689 - DNA, 25 bp, Mus musculus
aatacccagatgacttaagcagcaa

SEQ ID NO: 72690 - DNA, 25 bp, Mus musculus
aatacccagatgtcttaagcagcaa

SEQ ID NO: 72691 - DNA, 25 bp, Mus musculus
aatacccagcataggcttacagcta

SEQ ID NO: 72692 - DNA, 25 bp, Mus musculus
aatacccagcattggcttacagcta

SEQ ID NO: 72693 - DNA, 25 bp, Mus musculus
aatacccagctcaaggttattgtat

SEQ ID NO: 72694 - DNA, 25 bp, Mus musculus
aatacccagctctaggttattgtat

SEQ ID NO: 72695 - DNA, 25 bp, Mus musculus
aatacccagctgatattcctctgaa

SEQ ID NO: 72696 - DNA, 25 bp, Mus musculus
aatacccagctgttattcctctgaa

SEQ ID NO: 72697 - DNA, 25 bp, Mus musculus
aatacccaggagcatggtgtgccag

SEQ ID NO: 72698 - DNA, 25 bp, Mus musculus
aatacccaggaggatggtgtgccag

SEQ ID NO: 72699 - DNA, 25 bp, Mus musculus
aatacccaggtcatgcagctcagga

SEQ ID NO: 72700 - DNA, 25 bp, Mus musculus
aatacccaggtcttgcagctcagga

SEQ ID NO: 72701 - DNA, 25 bp, Mus musculus
aatacccagtacaggttgaggctga

SEQ ID NO: 72702 - DNA, 25 bp, Mus musculus
aatacccagtactggttgaggctga

SEQ ID NO: 72703 - DNA, 25 bp, Mus musculus
aatacccagtgtataccaccattat

SEQ ID NO: 72704 - DNA, 25 bp, Mus musculus
aatacccagtgtattgaacaccaag

SEQ ID NO: 72705 - DNA, 25 bp, Mus musculus
aatacccagtgtttaccaccattat

SEQ ID NO: 72706 - DNA, 25 bp, Mus musculus
aatacccagtgttttgaacaccaag

SEQ ID NO: 72707 - DNA, 25 bp, Mus musculus
aatacccagttcacatgtccttggt

SEQ ID NO: 72708 - DNA, 25 bp, Mus musculus
aatacccagttctcatgtccttggt

SEQ ID NO: 72709 - DNA, 25 bp, Mus musculus
aatacccatctgaacactgcagtgt

SEQ ID NO: 72710 - DNA, 25 bp, Mus musculus
aatacccatctgtacactgcagtgt

SEQ ID NO: 72711 - DNA, 25 bp, Mus musculus
aataccccgtatcaataatgcctga

SEQ ID NO: 72712 - DNA, 25 bp, Mus musculus
aataccccgtatgaataatgcctga

SEQ ID NO: 72713 - DNA, 25 bp, Mus musculus
aatacccgtgtaagactccttaagg

SEQ ID NO: 72714 - DNA, 25 bp, Mus musculus
aatacccgtgtatgactccttaagg

SEQ ID NO: 72715 - DNA, 25 bp, Mus musculus
aataccctcttaaccaactattagg

SEQ ID NO: 72716 - DNA, 25 bp, Mus musculus
aataccctcttatccaactattagg

SEQ ID NO: 72717 - DNA, 25 bp, Mus musculus
aataccctgagtacctctagcttgc

SEQ ID NO: 72718 - DNA, 25 bp, Mus musculus
aataccctgagttcctctagcttgc

SEQ ID NO: 72719 - DNA, 25 bp, Mus musculus
aataccctgataaggcccgacggag

SEQ ID NO: 72720 - DNA, 25 bp, Mus musculus
aataccctgatatggcccgacggag

SEQ ID NO: 72721 - DNA, 25 bp, Mus musculus
aataccctgggactaaatgctgtac

SEQ ID NO: 72722 - DNA, 25 bp, Mus musculus
aataccctgggagtaaatgctgtac

SEQ ID NO: 72723 - DNA, 25 bp, Mus musculus
aatacccttacccttagtgctgatg

SEQ ID NO: 72724 - DNA, 25 bp, Mus musculus
aatacccttaccgttagtgctgatg

SEQ ID NO: 72725 - DNA, 25 bp, Mus musculus
aatacccttaggcaatactttgatc

SEQ ID NO: 72726 - DNA, 25 bp, Mus musculus
aatacccttagggaatactttgatc

SEQ ID NO: 72727 - DNA, 25 bp, Mus musculus
aatacccttggtcctgtgtcagtgt

SEQ ID NO: 72728 - DNA, 25 bp, Mus musculus
aatacccttggtgctgtgtcagtgt

SEQ ID NO: 72729 - DNA, 25 bp, Mus musculus
aatacccttgtcactggctggcatc

SEQ ID NO: 72730 - DNA, 25 bp, Mus musculus
aatacccttgtctctggctggcatc

SEQ ID NO: 72731 - DNA, 25 bp, Mus musculus
aataccctttgccaggtgcttattt

SEQ ID NO: 72732 - DNA, 25 bp, Mus musculus
aataccctttgcgaggtgcttattt

SEQ ID NO: 72733 - DNA, 25 bp, Mus musculus
aataccgaggtaagggttctcttga

SEQ ID NO: 72734 - DNA, 25 bp, Mus musculus
aataccgaggtatgggttctcttga

SEQ ID NO: 72735 - DNA, 25 bp, Mus musculus
aataccgatcatattcaccagagat

SEQ ID NO: 72736 - DNA, 25 bp, Mus musculus
aataccgatcattttcaccagagat

SEQ ID NO: 72737 - DNA, 25 bp, Mus musculus
aataccgattgcagtacttggcctc

SEQ ID NO: 72738 - DNA, 25 bp, Mus musculus
aataccgattgctgtacttggcctc

SEQ ID NO: 72739 - DNA, 25 bp, Mus musculus
aataccgcatgcatatcgcaatggt

SEQ ID NO: 72740 - DNA, 25 bp, Mus musculus
aataccgcatgcttatcgcaatggt

SEQ ID NO: 72741 - DNA, 25 bp, Mus musculus
aataccgcctagagggccctggaag

SEQ ID NO: 72742 - DNA, 25 bp, Mus musculus
aataccgcctagtgggccctggaag

SEQ ID NO: 72743 - DNA, 25 bp, Mus musculus
aataccgtagagcagcccctggatc

SEQ ID NO: 72744 - DNA, 25 bp, Mus musculus
aataccgtagaggagcccctggatc

SEQ ID NO: 72745 - DNA, 25 bp, Mus musculus
aataccgtatgcaggttctctgttg

SEQ ID NO: 72746 - DNA, 25 bp, Mus musculus
aataccgtatgctggttctctgttg

SEQ ID NO: 72747 - DNA, 25 bp, Mus musculus
aataccgtgtgtcttgcaattggca

SEQ ID NO: 72748 - DNA, 25 bp, Mus musculus
aataccgtgtgtgttgcaattggca

SEQ ID NO: 72749 - DNA, 25 bp, Mus musculus
aatacctaaatcacctgggcttctg

SEQ ID NO: 72750 - DNA, 25 bp, Mus musculus
aatacctaaatctcctgggcttctg

SEQ ID NO: 72751 - DNA, 25 bp, Mus musculus
aatacctaattactacattcaacaa

SEQ ID NO: 72752 - DNA, 25 bp, Mus musculus
aatacctaattagtacattcaacaa

SEQ ID NO: 72753 - DNA, 25 bp, Mus musculus
aatacctacaatcccagcgtttgcg

SEQ ID NO: 72754 - DNA, 25 bp, Mus musculus
aatacctacaatgccagcgtttgcg

SEQ ID NO: 72755 - DNA, 25 bp, Mus musculus
aatacctaccatcgtttgccacaga

SEQ ID NO: 72756 - DNA, 25 bp, Mus musculus
aatacctaccatggtttgccacaga

SEQ ID NO: 72757 - DNA, 25 bp, Mus musculus
aatacctacccgcagtaaagcagga

SEQ ID NO: 72758 - DNA, 25 bp, Mus musculus
aatacctacccggagtaaagcagga

SEQ ID NO: 72759 - DNA, 25 bp, Mus musculus
aatacctaccttctattatacatga

SEQ ID NO: 72760 - DNA, 25 bp, Mus musculus
aatacctaccttgtattatacatga

SEQ ID NO: 72761 - DNA, 25 bp, Mus musculus
aatacctacgccagaagccttttag

SEQ ID NO: 72762 - DNA, 25 bp, Mus musculus
aatacctacgcctgaagccttttag

SEQ ID NO: 72763 - DNA, 25 bp, Mus musculus
aatacctactagctgttgcttttga

SEQ ID NO: 72764 - DNA, 25 bp, Mus musculus
aatacctactaggtgttgcttttga

SEQ ID NO: 72765 - DNA, 25 bp, Mus musculus
aatacctcccatcctcactgattgg

SEQ ID NO: 72766 - DNA, 25 bp, Mus musculus
aatacctcccatgctcactgattgg

SEQ ID NO: 72767 - DNA, 25 bp, Mus musculus
aatacctcccggcaagggtcagaga

SEQ ID NO: 72768 - DNA, 25 bp, Mus musculus
aatacctcccgggaagggtcagaga

SEQ ID NO: 72769 - DNA, 25 bp, Mus musculus
aatacctcctgaacaattagtctgt

SEQ ID NO: 72770 - DNA, 25 bp, Mus musculus
aatacctcctgatcaattagtctgt

SEQ ID NO: 72771 - DNA, 25 bp, Mus musculus
aatacctctcaaagtcttacctaag

SEQ ID NO: 72772 - DNA, 25 bp, Mus musculus
aatacctctcaatgtcttacctaag

SEQ ID NO: 72773 - DNA, 25 bp, Mus musculus
aatacctctcatagcaggctgttgg

SEQ ID NO: 72774 - DNA, 25 bp, Mus musculus
aatacctctcattgcaggctgttgg

SEQ ID NO: 72775 - DNA, 25 bp, Mus musculus
aatacctctcccactttacagaaga

SEQ ID NO: 72776 - DNA, 25 bp, Mus musculus
aatacctctccctctttacagaaga

SEQ ID NO: 72777 - DNA, 25 bp, Mus musculus
aatacctctgcaacttatagtcgtc

SEQ ID NO: 72778 - DNA, 25 bp, Mus musculus
aatacctctgcatcttatagtcgtc

SEQ ID NO: 72779 - DNA, 25 bp, Mus musculus
aatacctctgccactttgaaaattg

SEQ ID NO: 72780 - DNA, 25 bp, Mus musculus
aatacctctgcctctttgaaaattg

SEQ ID NO: 72781 - DNA, 25 bp, Mus musculus
aatacctctggtcaagtcgctactt

SEQ ID NO: 72782 - DNA, 25 bp, Mus musculus
aatacctctggtgaagtcgctactt

SEQ ID NO: 72783 - DNA, 25 bp, Mus musculus
aatacctcttcaatgcagcgctgtt

SEQ ID NO: 72784 - DNA, 25 bp, Mus musculus
aatacctcttcattgcagcgctgtt

SEQ ID NO: 72785 - DNA, 25 bp, Mus musculus
aatacctcttgtcggaaggactgcc

SEQ ID NO: 72786 - DNA, 25 bp, Mus musculus
aatacctcttgtgggaaggactgcc

SEQ ID NO: 72787 - DNA, 25 bp, Mus musculus
aatacctgaagcacagcgactcaag

SEQ ID NO: 72788 - DNA, 25 bp, Mus musculus
aatacctgaagcagtgttacctaaa

SEQ ID NO: 72789 - DNA, 25 bp, Mus musculus
aatacctgaagctcagcgactcaag

SEQ ID NO: 72790 - DNA, 25 bp, Mus musculus
aatacctgaagctgtgttacctaaa

SEQ ID NO: 72791 - DNA, 25 bp, Mus musculus
aatacctgagttatgctccaaagaa

SEQ ID NO: 72792 - DNA, 25 bp, Mus musculus
aatacctgagttttgctccaaagaa

SEQ ID NO: 72793 - DNA, 25 bp, Mus musculus
aatacctgcccaaaaggaccactaa

SEQ ID NO: 72794 - DNA, 25 bp, Mus musculus
aatacctgcccataaggaccactaa

SEQ ID NO: 72795 - DNA, 25 bp, Mus musculus
aatacctggagcctttgtgatgacc

SEQ ID NO: 72796 - DNA, 25 bp, Mus musculus
aatacctggagcgtttgtgatgacc

SEQ ID NO: 72797 - DNA, 25 bp, Mus musculus
aatacctggattcggcctatcggag

SEQ ID NO: 72798 - DNA, 25 bp, Mus musculus
aatacctggattgggcctatcggag

SEQ ID NO: 72799 - DNA, 25 bp, Mus musculus
aatacctggcctcgtgcatggtagg

SEQ ID NO: 72800 - DNA, 25 bp, Mus musculus
aatacctggcctggtgcatggtagg

SEQ ID NO: 72801 - DNA, 25 bp, Mus musculus
aatacctggctcacttgcctagaaa

SEQ ID NO: 72802 - DNA, 25 bp, Mus musculus
aatacctggctctcttgcctagaaa

SEQ ID NO: 72803 - DNA, 25 bp, Mus musculus
aatacctgggatacatatacatcta

SEQ ID NO: 72804 - DNA, 25 bp, Mus musculus
aatacctgggattcatatacatcta

SEQ ID NO: 72805 - DNA, 25 bp, Mus musculus
aatacctgttgtcgtgcggttacaa

SEQ ID NO: 72806 - DNA, 25 bp, Mus musculus
aatacctgttgtggtgcggttacaa

SEQ ID NO: 72807 - DNA, 25 bp, Mus musculus
aatacctgtttaacaaatgccctgt

SEQ ID NO: 72808 - DNA, 25 bp, Mus musculus
aatacctgtttatcaaatgccctgt

SEQ ID NO: 72809 - DNA, 25 bp, Mus musculus
aatacctgttttctcaaatttgact

SEQ ID NO: 72810 - DNA, 25 bp, Mus musculus
aatacctgttttgtcaaatttgact

SEQ ID NO: 72811 - DNA, 25 bp, Mus musculus
aataccttaaacagcctgtaactgg

SEQ ID NO: 72812 - DNA, 25 bp, Mus musculus
aataccttaaactgcctgtaactgg

SEQ ID NO: 72813 - DNA, 25 bp, Mus musculus
aataccttagctatgctgagccgta

SEQ ID NO: 72814 - DNA, 25 bp, Mus musculus
aataccttagctttgctgagccgta

SEQ ID NO: 72815 - DNA, 25 bp, Mus musculus
aataccttatagactgtgaactcag

SEQ ID NO: 72816 - DNA, 25 bp, Mus musculus
aataccttatagtctgtgaactcag

SEQ ID NO: 72817 - DNA, 25 bp, Mus musculus
aataccttcactccagtcagtgtag

SEQ ID NO: 72818 - DNA, 25 bp, Mus musculus
aataccttcactctagcccagagtg

SEQ ID NO: 72819 - DNA, 25 bp, Mus musculus
aataccttcactgcagtcagtgtag

SEQ ID NO: 72820 - DNA, 25 bp, Mus musculus
aataccttcactgtagcccagagtg

SEQ ID NO: 72821 - DNA, 25 bp, Mus musculus
aataccttcggcaatgctggctttt

SEQ ID NO: 72822 - DNA, 25 bp, Mus musculus
aataccttcggctatgctggctttt

SEQ ID NO: 72823 - DNA, 25 bp, Mus musculus
aataccttctggacccaaagagact

SEQ ID NO: 72824 - DNA, 25 bp, Mus musculus
aataccttctggtcccaaagagact

SEQ ID NO: 72825 - DNA, 25 bp, Mus musculus
aataccttcttcagtctgaaaatga

SEQ ID NO: 72826 - DNA, 25 bp, Mus musculus
aataccttcttctgtctgaaaatga

SEQ ID NO: 72827 - DNA, 25 bp, Mus musculus
aataccttgaagctctggaaggcaa

SEQ ID NO: 72828 - DNA, 25 bp, Mus musculus
aataccttgaaggtctggaaggcaa

SEQ ID NO: 72829 - DNA, 25 bp, Mus musculus
aataccttgatgagctggcgcctta

SEQ ID NO: 72830 - DNA, 25 bp, Mus musculus
aataccttgatgtgctggcgcctta

SEQ ID NO: 72831 - DNA, 25 bp, Mus musculus
aataccttggatatgcacattggca

SEQ ID NO: 72832 - DNA, 25 bp, Mus musculus
aataccttggatttgcacattggca

SEQ ID NO: 72833 - DNA, 25 bp, Mus musculus
aataccttgtgtagtcctttgtctt

SEQ ID NO: 72834 - DNA, 25 bp, Mus musculus
aataccttgtgttgtcctttgtctt

SEQ ID NO: 72835 - DNA, 25 bp, Mus musculus
aatacctttaatagcagcgacttga

SEQ ID NO: 72836 - DNA, 25 bp, Mus musculus
aatacctttaattgcagcgacttga

SEQ ID NO: 72837 - DNA, 25 bp, Mus musculus
aatacctttactatcggcatccctg

SEQ ID NO: 72838 - DNA, 25 bp, Mus musculus
aatacctttactttcggcatccctg

SEQ ID NO: 72839 - DNA, 25 bp, Mus musculus
aatacctttgatatagctctacttc

SEQ ID NO: 72840 - DNA, 25 bp, Mus musculus
aatacctttgatttagctctacttc

SEQ ID NO: 72841 - DNA, 25 bp, Mus musculus
aatacctttgtacttactcaagcag

SEQ ID NO: 72842 - DNA, 25 bp, Mus musculus
aatacctttgtagttactcaagcag

SEQ ID NO: 72843 - DNA, 25 bp, Mus musculus
aataccttttgtctctatgattgtt

SEQ ID NO: 72844 - DNA, 25 bp, Mus musculus
aataccttttgtgtctatgattgtt

SEQ ID NO: 72845 - DNA, 25 bp, Mus musculus
aatacgaactgcacgcgggaaccga

SEQ ID NO: 72846 - DNA, 25 bp, Mus musculus
aatacgaactgctcgcgggaaccga

SEQ ID NO: 72847 - DNA, 25 bp, Mus musculus
aatacgacagctctccttgataatg

SEQ ID NO: 72848 - DNA, 25 bp, Mus musculus
aatacgacagctgtccttgataatg

SEQ ID NO: 72849 - DNA, 25 bp, Mus musculus
aatacgaccggtaccttgatgaaag

SEQ ID NO: 72850 - DNA, 25 bp, Mus musculus
aatacgaccggttccttgatgaaag

SEQ ID NO: 72851 - DNA, 25 bp, Mus musculus
aatacgacgactaccaccacgagcg

SEQ ID NO: 72852 - DNA, 25 bp, Mus musculus
aatacgacgacttccaccacgagcg

SEQ ID NO: 72853 - DNA, 25 bp, Mus musculus
aatacgactgatcagcgccagccag

SEQ ID NO: 72854 - DNA, 25 bp, Mus musculus
aatacgactgatgagcgccagccag

SEQ ID NO: 72855 - DNA, 25 bp, Mus musculus
aatacgaggaacacatcgtctgctc

SEQ ID NO: 72856 - DNA, 25 bp, Mus musculus
aatacgaggaactcatcgtctgctc

SEQ ID NO: 72857 - DNA, 25 bp, Mus musculus
aatacgatcggaccctgcttgtagc

SEQ ID NO: 72858 - DNA, 25 bp, Mus musculus
aatacgatcggagcctgcttgtagc

SEQ ID NO: 72859 - DNA, 25 bp, Mus musculus
aatacgatgcaaacccagctcatct

SEQ ID NO: 72860 - DNA, 25 bp, Mus musculus
aatacgatgcaatcccagctcatct

SEQ ID NO: 72861 - DNA, 25 bp, Mus musculus
aatacgatgctgctcatcacagctt

SEQ ID NO: 72862 - DNA, 25 bp, Mus musculus
aatacgatgctggtcatcacagctt

SEQ ID NO: 72863 - DNA, 25 bp, Mus musculus
aatacgattgaaatcctagccctct

SEQ ID NO: 72864 - DNA, 25 bp, Mus musculus
aatacgattgaattcctagccctct

SEQ ID NO: 72865 - DNA, 25 bp, Mus musculus
aatacgatttgtcgttggtctagaa

SEQ ID NO: 72866 - DNA, 25 bp, Mus musculus
aatacgatttgtggttggtctagaa

SEQ ID NO: 72867 - DNA, 25 bp, Mus musculus
aatacgatttttctactgctgcccc

SEQ ID NO: 72868 - DNA, 25 bp, Mus musculus
aatacgatttttgtactgctgcccc

SEQ ID NO: 72869 - DNA, 25 bp, Mus musculus
aatacgcacatgcaccttttctttc

SEQ ID NO: 72870 - DNA, 25 bp, Mus musculus
aatacgcacatggaccttttctttc

SEQ ID NO: 72871 - DNA, 25 bp, Mus musculus
aatacgcagagtatttcccactggg

SEQ ID NO: 72872 - DNA, 25 bp, Mus musculus
aatacgcagagtttttcccactggg

SEQ ID NO: 72873 - DNA, 25 bp, Mus musculus
aatacgcgactcaagcgatgtctgc

SEQ ID NO: 72874 - DNA, 25 bp, Mus musculus
aatacgcgactctagcgatgtctgc

SEQ ID NO: 72875 - DNA, 25 bp, Mus musculus
aatacgctaaacatttggccaagag

SEQ ID NO: 72876 - DNA, 25 bp, Mus musculus
aatacgctaaacttttggccaagag

SEQ ID NO: 72877 - DNA, 25 bp, Mus musculus
aatacgctctgcattgtgactgtca

SEQ ID NO: 72878 - DNA, 25 bp, Mus musculus
aatacgctctgctttgtgactgtca

SEQ ID NO: 72879 - DNA, 25 bp, Mus musculus
aatacgctgggcactgtgtagtaaa

SEQ ID NO: 72880 - DNA, 25 bp, Mus musculus
aatacgctgggctctgtgtagtaaa

SEQ ID NO: 72881 - DNA, 25 bp, Mus musculus
aatacggaaccgacgtgtgcttcag

SEQ ID NO: 72882 - DNA, 25 bp, Mus musculus
aatacggaaccgtcgtgtgcttcag

SEQ ID NO: 72883 - DNA, 25 bp, Mus musculus
aatacggaccttcaaactgggccag

SEQ ID NO: 72884 - DNA, 25 bp, Mus musculus
aatacggaccttgaaactgggccag

SEQ ID NO: 72885 - DNA, 25 bp, Mus musculus
aatacggcagagcacaccttgtcca

SEQ ID NO: 72886 - DNA, 25 bp, Mus musculus
aatacggcagaggacaccttgtcca

SEQ ID NO: 72887 - DNA, 25 bp, Mus musculus
aatacggtagctaggccttgcaaaa

SEQ ID NO: 72888 - DNA, 25 bp, Mus musculus
aatacggtagctcgtaaccgcatcc

SEQ ID NO: 72889 - DNA, 25 bp, Mus musculus
aatacggtagctggtaaccgcatcc

SEQ ID NO: 72890 - DNA, 25 bp, Mus musculus
aatacggtagcttggccttgcaaaa

SEQ ID NO: 72891 - DNA, 25 bp, Mus musculus
aatacggtatctactgctcagcagt

SEQ ID NO: 72892 - DNA, 25 bp, Mus musculus
aatacggtatcttctgctcagcagt

SEQ ID NO: 72893 - DNA, 25 bp, Mus musculus
aatacggtctcgctgtccatgtcta

SEQ ID NO: 72894 - DNA, 25 bp, Mus musculus
aatacggtctcggtgtccatgtcta

SEQ ID NO: 72895 - DNA, 25 bp, Mus musculus
aatacggtcttcacgttggtctcgg

SEQ ID NO: 72896 - DNA, 25 bp, Mus musculus
aatacggtcttctcgttggtctcgg

SEQ ID NO: 72897 - DNA, 25 bp, Mus musculus
aatacggttaaaagtgaggcctttg

SEQ ID NO: 72898 - DNA, 25 bp, Mus musculus
aatacggttaaatgtgaggcctttg

SEQ ID NO: 72899 - DNA, 25 bp, Mus musculus
aatacggttgatcttggcagggaaa

SEQ ID NO: 72900 - DNA, 25 bp, Mus musculus
aatacggttgatgttggcagggaaa

SEQ ID NO: 72901 - DNA, 25 bp, Mus musculus
aatacgtaaactcctttcagaacag

SEQ ID NO: 72902 - DNA, 25 bp, Mus musculus
aatacgtaaactgctttcagaacag

SEQ ID NO: 72903 - DNA, 25 bp, Mus musculus
aatacgtaccagaagccacgttctg

SEQ ID NO: 72904 - DNA, 25 bp, Mus musculus
aatacgtaccagtagccacgttctg

SEQ ID NO: 72905 - DNA, 25 bp, Mus musculus
aatacgtacccacgtgtccccaatg

SEQ ID NO: 72906 - DNA, 25 bp, Mus musculus
aatacgtacccaggtgtccccaatg

SEQ ID NO: 72907 - DNA, 25 bp, Mus musculus
aatacgtagaatctgctgtctgtgc

SEQ ID NO: 72908 - DNA, 25 bp, Mus musculus
aatacgtagaatgtgctgtctgtgc

SEQ ID NO: 72909 - DNA, 25 bp, Mus musculus
aatacgtattccacagtgttggctg

SEQ ID NO: 72910 - DNA, 25 bp, Mus musculus
aatacgtattcctcagtgttggctg

SEQ ID NO: 72911 - DNA, 25 bp, Mus musculus
aatacgtctcatacttcatttcagc

SEQ ID NO: 72912 - DNA, 25 bp, Mus musculus
aatacgtctcattcttcatttcagc

SEQ ID NO: 72913 - DNA, 25 bp, Mus musculus
aatacgtgagctagggctaccagcc

SEQ ID NO: 72914 - DNA, 25 bp, Mus musculus
aatacgtgagcttgggctaccagcc

SEQ ID NO: 72915 - DNA, 25 bp, Mus musculus
aatacgtgatttaccctatccctat

SEQ ID NO: 72916 - DNA, 25 bp, Mus musculus
aatacgtgattttccctatccctat

SEQ ID NO: 72917 - DNA, 25 bp, Mus musculus
aatacgtgcttcacttttgttgttg

SEQ ID NO: 72918 - DNA, 25 bp, Mus musculus
aatacgtgcttctcttttgttgttg

SEQ ID NO: 72919 - DNA, 25 bp, Mus musculus
aatacgtgtgtcacccacttggtgg

SEQ ID NO: 72920 - DNA, 25 bp, Mus musculus
aatacgtgtgtctcccacttggtgg

SEQ ID NO: 72921 - DNA, 25 bp, Mus musculus
aatacgttcttcataccaggaccag

SEQ ID NO: 72922 - DNA, 25 bp, Mus musculus
aatacgttcttcttaccaggaccag

SEQ ID NO: 72923 - DNA, 25 bp, Mus musculus
aatacgttgccaaggtgatcgaccg

SEQ ID NO: 72924 - DNA, 25 bp, Mus musculus
aatacgttgccatggtgatcgaccg

SEQ ID NO: 72925 - DNA, 25 bp, Mus musculus
aatacgtttgtgcagaatctctatg

SEQ ID NO: 72926 - DNA, 25 bp, Mus musculus
aatacgtttgtggagaatctctatg

SEQ ID NO: 72927 - DNA, 25 bp, Mus musculus
aatactaagggcatcctcctgggag

SEQ ID NO: 72928 - DNA, 25 bp, Mus musculus
aatactaagggcttcctcctgggag

SEQ ID NO: 72929 - DNA, 25 bp, Mus musculus
aatactaattaaatactcacctgct

SEQ ID NO: 72930 - DNA, 25 bp, Mus musculus
aatactaattaattactcacctgct

SEQ ID NO: 72931 - DNA, 25 bp, Mus musculus
aatactaatttgctttgctgaccaa

SEQ ID NO: 72932 - DNA, 25 bp, Mus musculus
aatactaatttggtttgctgaccaa

SEQ ID NO: 72933 - DNA, 25 bp, Mus musculus
aatactacccacaattcccaagaat

SEQ ID NO: 72934 - DNA, 25 bp, Mus musculus
aatactacccactattcccaagaat

SEQ ID NO: 72935 - DNA, 25 bp, Mus musculus
aatactacgctcatctgcttgtaat

SEQ ID NO: 72936 - DNA, 25 bp, Mus musculus
aatactacgctcttctgcttgtaat

SEQ ID NO: 72937 - DNA, 25 bp, Mus musculus
aatactacttaaagacaggttgtct

SEQ ID NO: 72938 - DNA, 25 bp, Mus musculus
aatactacttaatgacaggttgtct

SEQ ID NO: 72939 - DNA, 25 bp, Mus musculus
aatactacttccacatggcttcatg

SEQ ID NO: 72940 - DNA, 25 bp, Mus musculus
aatactacttcctcatggcttcatg

SEQ ID NO: 72941 - DNA, 25 bp, Mus musculus
aatactagatgcaagtgtttccaaa

SEQ ID NO: 72942 - DNA, 25 bp, Mus musculus
aatactagatgctagtgtttccaaa

SEQ ID NO: 72943 - DNA, 25 bp, Mus musculus
aatactagcattccatgtacagagt

SEQ ID NO: 72944 - DNA, 25 bp, Mus musculus
aatactagcattgcatgtacagagt

SEQ ID NO: 72945 - DNA, 25 bp, Mus musculus
aatactagcccaacagaagacaaag

SEQ ID NO: 72946 - DNA, 25 bp, Mus musculus
aatactagcccatcagaagacaaag

SEQ ID NO: 72947 - DNA, 25 bp, Mus musculus
aatactaggaggaagccagctgcct

SEQ ID NO: 72948 - DNA, 25 bp, Mus musculus
aatactaggaggtagccagctgcct

SEQ ID NO: 72949 - DNA, 25 bp, Mus musculus
aatactagttacatgcctctcacat

SEQ ID NO: 72950 - DNA, 25 bp, Mus musculus
aatactagttacttgcctctcacat

SEQ ID NO: 72951 - DNA, 25 bp, Mus musculus
aatactatacaaccaaacatccgcc

SEQ ID NO: 72952 - DNA, 25 bp, Mus musculus
aatactatacaagcaaacatccgcc

SEQ ID NO: 72953 - DNA, 25 bp, Mus musculus
aatactatactcagcatcggtactt

SEQ ID NO: 72954 - DNA, 25 bp, Mus musculus
aatactatactctgcatcggtactt

SEQ ID NO: 72955 - DNA, 25 bp, Mus musculus
aatactatatctcagctcttgcaaa

SEQ ID NO: 72956 - DNA, 25 bp, Mus musculus
aatactatatctgagctcttgcaaa

SEQ ID NO: 72957 - DNA, 25 bp, Mus musculus
aatactatcatactgtatatcctat

SEQ ID NO: 72958 - DNA, 25 bp, Mus musculus
aatactatcatagtgtatatcctat

SEQ ID NO: 72959 - DNA, 25 bp, Mus musculus
aatactatccacagagtgccgtcca

SEQ ID NO: 72960 - DNA, 25 bp, Mus musculus
aatactatccactgagtgccgtcca

SEQ ID NO: 72961 - DNA, 25 bp, Mus musculus
aatactatctatacaaccaactgtg

SEQ ID NO: 72962 - DNA, 25 bp, Mus musculus
aatactatctattcaaccaactgtg

SEQ ID NO: 72963 - DNA, 25 bp, Mus musculus
aatactatctccatgatgacatcaa

SEQ ID NO: 72964 - DNA, 25 bp, Mus musculus
aatactatctccttgatgacatcaa

SEQ ID NO: 72965 - DNA, 25 bp, Mus musculus
aatactatcttactgacggccctcc

SEQ ID NO: 72966 - DNA, 25 bp, Mus musculus
aatactatcttagtgacggccctcc

SEQ ID NO: 72967 - DNA, 25 bp, Mus musculus
aatactatgatgactgccccttttt

SEQ ID NO: 72968 - DNA, 25 bp, Mus musculus
aatactatgatgctgcctggtgcca

SEQ ID NO: 72969 - DNA, 25 bp, Mus musculus
aatactatgatggtgcctggtgcca

SEQ ID NO: 72970 - DNA, 25 bp, Mus musculus
aatactatgatgtctgccccttttt

SEQ ID NO: 72971 - DNA, 25 bp, Mus musculus
aatactatgtggaacagttggctgt

SEQ ID NO: 72972 - DNA, 25 bp, Mus musculus
aatactatgtggtacagttggctgt

SEQ ID NO: 72973 - DNA, 25 bp, Mus musculus
aatactattactactctgagcctcc

SEQ ID NO: 72974 - DNA, 25 bp, Mus musculus
aatactattacttctctgagcctcc

SEQ ID NO: 72975 - DNA, 25 bp, Mus musculus
aatactattagcatcctgtacagtg

SEQ ID NO: 72976 - DNA, 25 bp, Mus musculus
aatactattagcttcctgtacagtg

SEQ ID NO: 72977 - DNA, 25 bp, Mus musculus
aatactattcagaatgccctctgcc

SEQ ID NO: 72978 - DNA, 25 bp, Mus musculus
aatactattcagtatgccctctgcc

SEQ ID NO: 72979 - DNA, 25 bp, Mus musculus
aatactattctgatgtctgggtggg

SEQ ID NO: 72980 - DNA, 25 bp, Mus musculus
aatactattctgttgtctgggtggg

SEQ ID NO: 72981 - DNA, 25 bp, Mus musculus
aatactcacattcctgcatgtagct

SEQ ID NO: 72982 - DNA, 25 bp, Mus musculus
aatactcacattgctgcatgtagct

SEQ ID NO: 72983 - DNA, 25 bp, Mus musculus
aatactcacttcatgaacggtgcca

SEQ ID NO: 72984 - DNA, 25 bp, Mus musculus
aatactcacttcttgaacggtgcca

SEQ ID NO: 72985 - DNA, 25 bp, Mus musculus
aatactcagagaacagcattatcaa

SEQ ID NO: 72986 - DNA, 25 bp, Mus musculus
aatactcagagatcagcattatcaa

SEQ ID NO: 72987 - DNA, 25 bp, Mus musculus
aatactcagagtctgggcgcagatt

SEQ ID NO: 72988 - DNA, 25 bp, Mus musculus
aatactcagagtgtgggcgcagatt

SEQ ID NO: 72989 - DNA, 25 bp, Mus musculus
aatactcagcccactcgtgttgagt

SEQ ID NO: 72990 - DNA, 25 bp, Mus musculus
aatactcagccctctcgtgttgagt

SEQ ID NO: 72991 - DNA, 25 bp, Mus musculus
aatactcagctcaagacactttcag

SEQ ID NO: 72992 - DNA, 25 bp, Mus musculus
aatactcagctctagacactttcag

SEQ ID NO: 72993 - DNA, 25 bp, Mus musculus
aatactcagggtcttcatttgggaa

SEQ ID NO: 72994 - DNA, 25 bp, Mus musculus
aatactcagggtgttcatttgggaa

SEQ ID NO: 72995 - DNA, 25 bp, Mus musculus
aatactcagtctagctttacccaga

SEQ ID NO: 72996 - DNA, 25 bp, Mus musculus
aatactcagtcttgctttacccaga

SEQ ID NO: 72997 - DNA, 25 bp, Mus musculus
aatactcatcttattgtcctttccc

SEQ ID NO: 72998 - DNA, 25 bp, Mus musculus
aatactcatctttttgtcctttccc

SEQ ID NO: 72999 - DNA, 25 bp, Mus musculus
aatactcatgctcaaatggccttaa

SEQ ID NO: 73000 - DNA, 25 bp, Mus musculus
aatactcatgctgaaatggccttaa

SEQ ID NO: 73001 - DNA, 25 bp, Mus musculus
aatactcatgggatatcaggttctt

SEQ ID NO: 73002 - DNA, 25 bp, Mus musculus
aatactcatgggttatcaggttctt

SEQ ID NO: 73003 - DNA, 25 bp, Mus musculus
aatactcatttgacatttgctttag

SEQ ID NO: 73004 - DNA, 25 bp, Mus musculus
aatactcatttgtcatttgctttag

SEQ ID NO: 73005 - DNA, 25 bp, Mus musculus
aatactccagttcgtatgtggcact

SEQ ID NO: 73006 - DNA, 25 bp, Mus musculus
aatactccagttggtatgtggcact

SEQ ID NO: 73007 - DNA, 25 bp, Mus musculus
aatactccatcaactgaatcgtgta

SEQ ID NO: 73008 - DNA, 25 bp, Mus musculus
aatactccatcatctgaatcgtgta

SEQ ID NO: 73009 - DNA, 25 bp, Mus musculus
aatactccccgtcccactggaggtg

SEQ ID NO: 73010 - DNA, 25 bp, Mus musculus
aatactccccgtgccactggaggtg

SEQ ID NO: 73011 - DNA, 25 bp, Mus musculus
aatactccctggaggcattggttgt

SEQ ID NO: 73012 - DNA, 25 bp, Mus musculus
aatactccctggtggcattggttgt

SEQ ID NO: 73013 - DNA, 25 bp, Mus musculus
aatactcctgtgagggcactgtcca

SEQ ID NO: 73014 - DNA, 25 bp, Mus musculus
aatactcctgtgtgggcactgtcca

SEQ ID NO: 73015 - DNA, 25 bp, Mus musculus
aatactcctttcagacctcatttag

SEQ ID NO: 73016 - DNA, 25 bp, Mus musculus
aatactcctttctgacctcatttag

SEQ ID NO: 73017 - DNA, 25 bp, Mus musculus
aatactcgaacgagattttgtttca

SEQ ID NO: 73018 - DNA, 25 bp, Mus musculus
aatactcgaacgtgattttgtttca

SEQ ID NO: 73019 - DNA, 25 bp, Mus musculus
aatactcgagatctacaataaagcc

SEQ ID NO: 73020 - DNA, 25 bp, Mus musculus
aatactcgagatgtacaataaagcc

SEQ ID NO: 73021 - DNA, 25 bp, Mus musculus
aatactcgatgaatcccaaggatgg

SEQ ID NO: 73022 - DNA, 25 bp, Mus musculus
aatactcgatgattcccaaggatgg

SEQ ID NO: 73023 - DNA, 25 bp, Mus musculus
aatactcgctctaatgtagctgata

SEQ ID NO: 73024 - DNA, 25 bp, Mus musculus
aatactcgctcttatgtagctgata

SEQ ID NO: 73025 - DNA, 25 bp, Mus musculus
aatactcgctgaatatgctcagagc

SEQ ID NO: 73026 - DNA, 25 bp, Mus musculus
aatactcgctgattatgctcagagc

SEQ ID NO: 73027 - DNA, 25 bp, Mus musculus
aatactcggttcatttaggccacgg

SEQ ID NO: 73028 - DNA, 25 bp, Mus musculus
aatactcggttcttttaggccacgg

SEQ ID NO: 73029 - DNA, 25 bp, Mus musculus
aatactctatcgctcaaccttaatt

SEQ ID NO: 73030 - DNA, 25 bp, Mus musculus
aatactctatcggtcaaccttaatt

SEQ ID NO: 73031 - DNA, 25 bp, Mus musculus
aatactctattcactttcacactga

SEQ ID NO: 73032 - DNA, 25 bp, Mus musculus
aatactctattctctttcacactga

SEQ ID NO: 73033 - DNA, 25 bp, Mus musculus
aatactctatttcccatttggctgc

SEQ ID NO: 73034 - DNA, 25 bp, Mus musculus
aatactctatttgccatttggctgc

SEQ ID NO: 73035 - DNA, 25 bp, Mus musculus
aatactctcagcagaaagcccggaa

SEQ ID NO: 73036 - DNA, 25 bp, Mus musculus
aatactctcagctgaaagcccggaa

SEQ ID NO: 73037 - DNA, 25 bp, Mus musculus
aatactctgcacatgttaggaacac

SEQ ID NO: 73038 - DNA, 25 bp, Mus musculus
aatactctgcacttgttaggaacac

SEQ ID NO: 73039 - DNA, 25 bp, Mus musculus
aatactctgcagactttccgggaat

SEQ ID NO: 73040 - DNA, 25 bp, Mus musculus
aatactctgcagtctttccgggaat

SEQ ID NO: 73041 - DNA, 25 bp, Mus musculus
aatactctgggtctctgcaagtaca

SEQ ID NO: 73042 - DNA, 25 bp, Mus musculus
aatactctgggtgtctgcaagtaca

SEQ ID NO: 73043 - DNA, 25 bp, Mus musculus
aatactctgtatctccgagttcgtg

SEQ ID NO: 73044 - DNA, 25 bp, Mus musculus
aatactctgtatgtccgagttcgtg

SEQ ID NO: 73045 - DNA, 25 bp, Mus musculus
aatactctgtcacttggcctcattc

SEQ ID NO: 73046 - DNA, 25 bp, Mus musculus
aatactctgtcagttggcctcattc

SEQ ID NO: 73047 - DNA, 25 bp, Mus musculus
aatactctgtggagcaaggatcccc

SEQ ID NO: 73048 - DNA, 25 bp, Mus musculus
aatactctgtggtgcaaggatcccc

SEQ ID NO: 73049 - DNA, 25 bp, Mus musculus
aatactcttacacccatattccgtg

SEQ ID NO: 73050 - DNA, 25 bp, Mus musculus
aatactcttacagccatattccgtg

SEQ ID NO: 73051 - DNA, 25 bp, Mus musculus
aatactcttatgaaacagtccctaa

SEQ ID NO: 73052 - DNA, 25 bp, Mus musculus
aatactcttatgtaacagtccctaa

SEQ ID NO: 73053 - DNA, 25 bp, Mus musculus
aatactcttccaatgcatctacagg

SEQ ID NO: 73054 - DNA, 25 bp, Mus musculus
aatactcttccattgcatctacagg

SEQ ID NO: 73055 - DNA, 25 bp, Mus musculus
aatactcttctcatatgctactctc

SEQ ID NO: 73056 - DNA, 25 bp, Mus musculus
aatactcttctcttatgctactctc

SEQ ID NO: 73057 - DNA, 25 bp, Mus musculus
aatactcttgagacttttgtagaag

SEQ ID NO: 73058 - DNA, 25 bp, Mus musculus
aatactcttgagtcttttgtagaag

SEQ ID NO: 73059 - DNA, 25 bp, Mus musculus
aatactcttgcacactaacttttgt

SEQ ID NO: 73060 - DNA, 25 bp, Mus musculus
aatactcttgcagactaacttttgt

SEQ ID NO: 73061 - DNA, 25 bp, Mus musculus
aatactcttgttcggtttcactgga

SEQ ID NO: 73062 - DNA, 25 bp, Mus musculus
aatactcttgttgggtttcactgga

SEQ ID NO: 73063 - DNA, 25 bp, Mus musculus
aatactgaaaccattggtctgactc

SEQ ID NO: 73064 - DNA, 25 bp, Mus musculus
aatactgaaacctttggtctgactc

SEQ ID NO: 73065 - DNA, 25 bp, Mus musculus
aatactgaaccacctaacagcttgg

SEQ ID NO: 73066 - DNA, 25 bp, Mus musculus
aatactgaaccagctaacagcttgg

SEQ ID NO: 73067 - DNA, 25 bp, Mus musculus
aatactgaagctagggacgtttgtt

SEQ ID NO: 73068 - DNA, 25 bp, Mus musculus
aatactgaagctcgagttcaaagca

SEQ ID NO: 73069 - DNA, 25 bp, Mus musculus
aatactgaagctggagttcaaagca

SEQ ID NO: 73070 - DNA, 25 bp, Mus musculus
aatactgaagcttgggacgtttgtt

SEQ ID NO: 73071 - DNA, 25 bp, Mus musculus
aatactgaatggatccctagttctt

SEQ ID NO: 73072 - DNA, 25 bp, Mus musculus
aatactgaatggttccctagttctt

SEQ ID NO: 73073 - DNA, 25 bp, Mus musculus
aatactgacattcgctgggacatct

SEQ ID NO: 73074 - DNA, 25 bp, Mus musculus
aatactgacattggctgggacatct

SEQ ID NO: 73075 - DNA, 25 bp, Mus musculus
aatactgactccctggccagaaact

SEQ ID NO: 73076 - DNA, 25 bp, Mus musculus
aatactgactccgtggccagaaact

SEQ ID NO: 73077 - DNA, 25 bp, Mus musculus
aatactgactgcatgtacttaggtt

SEQ ID NO: 73078 - DNA, 25 bp, Mus musculus
aatactgactgcctggtaccggact

SEQ ID NO: 73079 - DNA, 25 bp, Mus musculus
aatactgactgcgtggtaccggact

SEQ ID NO: 73080 - DNA, 25 bp, Mus musculus
aatactgactgcttgtacttaggtt

SEQ ID NO: 73081 - DNA, 25 bp, Mus musculus
aatactgagaatccctcttctacca

SEQ ID NO: 73082 - DNA, 25 bp, Mus musculus
aatactgagaatgcctcttctacca

SEQ ID NO: 73083 - DNA, 25 bp, Mus musculus
aatactgagcccatagtcatgaact

SEQ ID NO: 73084 - DNA, 25 bp, Mus musculus
aatactgagcccttagtcatgaact

SEQ ID NO: 73085 - DNA, 25 bp, Mus musculus
aatactgagctgctcctgtaatcat

SEQ ID NO: 73086 - DNA, 25 bp, Mus musculus
aatactgagctggtcctgtaatcat

SEQ ID NO: 73087 - DNA, 25 bp, Mus musculus
aatactgagtgacctgtcatcttga

SEQ ID NO: 73088 - DNA, 25 bp, Mus musculus
aatactgagtgagctgtcatcttga

SEQ ID NO: 73089 - DNA, 25 bp, Mus musculus
aatactgagtttagcttcttcctct

SEQ ID NO: 73090 - DNA, 25 bp, Mus musculus
aatactgagttttgcttcttcctct

SEQ ID NO: 73091 - DNA, 25 bp, Mus musculus
aatactgatagcacggtggcaaaga

SEQ ID NO: 73092 - DNA, 25 bp, Mus musculus
aatactgatagctcggtggcaaaga

SEQ ID NO: 73093 - DNA, 25 bp, Mus musculus
aatactgatctgataaagcaacatt

SEQ ID NO: 73094 - DNA, 25 bp, Mus musculus
aatactgatctgttaaagcaacatt

SEQ ID NO: 73095 - DNA, 25 bp, Mus musculus
aatactgatgagctgtgatagtcac

SEQ ID NO: 73096 - DNA, 25 bp, Mus musculus
aatactgatgaggtgtgatagtcac

SEQ ID NO: 73097 - DNA, 25 bp, Mus musculus
aatactgatttgatgcctaggtaca

SEQ ID NO: 73098 - DNA, 25 bp, Mus musculus
aatactgatttgttgcctaggtaca

SEQ ID NO: 73099 - DNA, 25 bp, Mus musculus
aatactgattttactgtacctcgaa

SEQ ID NO: 73100 - DNA, 25 bp, Mus musculus
aatactgatttttctgtacctcgaa

SEQ ID NO: 73101 - DNA, 25 bp, Mus musculus
aatactgcaatactgttagccttcg

SEQ ID NO: 73102 - DNA, 25 bp, Mus musculus
aatactgcaatagtgttagccttcg

SEQ ID NO: 73103 - DNA, 25 bp, Mus musculus
aatactgcaccacagggtggaggtc

SEQ ID NO: 73104 - DNA, 25 bp, Mus musculus
aatactgcaccagagggtggaggtc

SEQ ID NO: 73105 - DNA, 25 bp, Mus musculus
aatactgcagacagggtataccctc

SEQ ID NO: 73106 - DNA, 25 bp, Mus musculus
aatactgcagactgggtataccctc

SEQ ID NO: 73107 - DNA, 25 bp, Mus musculus
aatactgcattaactttgagcccat

SEQ ID NO: 73108 - DNA, 25 bp, Mus musculus
aatactgcattatctttgagcccat

SEQ ID NO: 73109 - DNA, 25 bp, Mus musculus
aatactgcatttccagtgggtgaac

SEQ ID NO: 73110 - DNA, 25 bp, Mus musculus
aatactgcatttgcagtgggtgaac

SEQ ID NO: 73111 - DNA, 25 bp, Mus musculus
aatactgccagaagctgatgttcag

SEQ ID NO: 73112 - DNA, 25 bp, Mus musculus
aatactgccagatgctgatgttcag

SEQ ID NO: 73113 - DNA, 25 bp, Mus musculus
aatactgccaggcttggtttctgat

SEQ ID NO: 73114 - DNA, 25 bp, Mus musculus
aatactgccagggttggtttctgat

SEQ ID NO: 73115 - DNA, 25 bp, Mus musculus
aatactgcccagaggataacacttg

SEQ ID NO: 73116 - DNA, 25 bp, Mus musculus
aatactgcccagtggataacacttg

SEQ ID NO: 73117 - DNA, 25 bp, Mus musculus
aatactgcccttagaaacttcccag

SEQ ID NO: 73118 - DNA, 25 bp, Mus musculus
aatactgcccttcccacaactttgt

SEQ ID NO: 73119 - DNA, 25 bp, Mus musculus
aatactgcccttgccacaactttgt

SEQ ID NO: 73120 - DNA, 25 bp, Mus musculus
aatactgccctttgaaacttcccag

SEQ ID NO: 73121 - DNA, 25 bp, Mus musculus
aatactgccgctaaaatgatcacaa

SEQ ID NO: 73122 - DNA, 25 bp, Mus musculus
aatactgccgcttaaatgatcacaa

SEQ ID NO: 73123 - DNA, 25 bp, Mus musculus
aatactgcctccactagactgagct

SEQ ID NO: 73124 - DNA, 25 bp, Mus musculus
aatactgcctcctctagactgagct

SEQ ID NO: 73125 - DNA, 25 bp, Mus musculus
aatactgcgaggctttggcagatga

SEQ ID NO: 73126 - DNA, 25 bp, Mus musculus
aatactgcgagggtttggcagatga

SEQ ID NO: 73127 - DNA, 25 bp, Mus musculus
aatactgcgatgctcttggaggaga

SEQ ID NO: 73128 - DNA, 25 bp, Mus musculus
aatactgcgatggtcttggaggaga

SEQ ID NO: 73129 - DNA, 25 bp, Mus musculus
aatactgcgtcaaaatcctggtaga

SEQ ID NO: 73130 - DNA, 25 bp, Mus musculus
aatactgcgtcataatcctggtaga

SEQ ID NO: 73131 - DNA, 25 bp, Mus musculus
aatactgctagcacaactggcggtt

SEQ ID NO: 73132 - DNA, 25 bp, Mus musculus
aatactgctagctcaactggcggtt

SEQ ID NO: 73133 - DNA, 25 bp, Mus musculus
aatactgctcacagtgtgtgactgt

SEQ ID NO: 73134 - DNA, 25 bp, Mus musculus
aatactgctcactgtgtgtgactgt

SEQ ID NO: 73135 - DNA, 25 bp, Mus musculus
aatactgctctaccatgagtctgta

SEQ ID NO: 73136 - DNA, 25 bp, Mus musculus
aatactgctctagcatgagtctgta

SEQ ID NO: 73137 - DNA, 25 bp, Mus musculus
aatactgctgagcttggtggcacag

SEQ ID NO: 73138 - DNA, 25 bp, Mus musculus
aatactgctgaggttggtggcacag

SEQ ID NO: 73139 - DNA, 25 bp, Mus musculus
aatactgctggcagagcttgcttta

SEQ ID NO: 73140 - DNA, 25 bp, Mus musculus
aatactgctggctgagcttgcttta

SEQ ID NO: 73141 - DNA, 25 bp, Mus musculus
aatactgctgtgagctcttgaggct

SEQ ID NO: 73142 - DNA, 25 bp, Mus musculus
aatactgctgtgtgctcttgaggct

SEQ ID NO: 73143 - DNA, 25 bp, Mus musculus
aatactgctgttactgttccatttc

SEQ ID NO: 73144 - DNA, 25 bp, Mus musculus
aatactgctgtttctgttccatttc

SEQ ID NO: 73145 - DNA, 25 bp, Mus musculus
aatactgcttctcatcgctgttctt

SEQ ID NO: 73146 - DNA, 25 bp, Mus musculus
aatactgcttctgatcgctgttctt

SEQ ID NO: 73147 - DNA, 25 bp, Mus musculus
aatactgctttgctactagccagtg

SEQ ID NO: 73148 - DNA, 25 bp, Mus musculus
aatactgctttggtactagccagtg

SEQ ID NO: 73149 - DNA, 25 bp, Mus musculus
aatactggaaatcggaccttctgtc

SEQ ID NO: 73150 - DNA, 25 bp, Mus musculus
aatactggaaatgggaccttctgtc

SEQ ID NO: 73151 - DNA, 25 bp, Mus musculus
aatactggagataaagtcaggtcct

SEQ ID NO: 73152 - DNA, 25 bp, Mus musculus
aatactggagattaagtcaggtcct

SEQ ID NO: 73153 - DNA, 25 bp, Mus musculus
aatactggcgcccaaatattttagt

SEQ ID NO: 73154 - DNA, 25 bp, Mus musculus
aatactggcgccgaaatattttagt

SEQ ID NO: 73155 - DNA, 25 bp, Mus musculus
aatactggctcgaatactacggaat

SEQ ID NO: 73156 - DNA, 25 bp, Mus musculus
aatactggctcgtatactacggaat

SEQ ID NO: 73157 - DNA, 25 bp, Mus musculus
aatactggctgacgtgggtatgcct

SEQ ID NO: 73158 - DNA, 25 bp, Mus musculus
aatactggctgaggtgggtatgcct

SEQ ID NO: 73159 - DNA, 25 bp, Mus musculus
aatactggcttgataaatctctgca

SEQ ID NO: 73160 - DNA, 25 bp, Mus musculus
aatactggcttgttaaatctctgca

SEQ ID NO: 73161 - DNA, 25 bp, Mus musculus
aatactggctttagcttctcatcca

SEQ ID NO: 73162 - DNA, 25 bp, Mus musculus
aatactggcttttgcttctcatcca

SEQ ID NO: 73163 - DNA, 25 bp, Mus musculus
aatactgggaagacggcagccggcc

SEQ ID NO: 73164 - DNA, 25 bp, Mus musculus
aatactgggaagtcggcagccggcc

SEQ ID NO: 73165 - DNA, 25 bp, Mus musculus
aatactgggatcacaattttttggt

SEQ ID NO: 73166 - DNA, 25 bp, Mus musculus
aatactgggatctcaattttttggt

SEQ ID NO: 73167 - DNA, 25 bp, Mus musculus
aatactgggctaactttgccaggag

SEQ ID NO: 73168 - DNA, 25 bp, Mus musculus
aatactgggctatctttgccaggag

SEQ ID NO: 73169 - DNA, 25 bp, Mus musculus
aatactgggtacatcttctagagga

SEQ ID NO: 73170 - DNA, 25 bp, Mus musculus
aatactgggtacttcttctagagga

SEQ ID NO: 73171 - DNA, 25 bp, Mus musculus
aatactgggtgacaagacctccggg

SEQ ID NO: 73172 - DNA, 25 bp, Mus musculus
aatactgggtgagaagacctccggg

SEQ ID NO: 73173 - DNA, 25 bp, Mus musculus
aatactggtatcaacagccatgggc

SEQ ID NO: 73174 - DNA, 25 bp, Mus musculus
aatactggtatctacagccatgggc

SEQ ID NO: 73175 - DNA, 25 bp, Mus musculus
aatactggtttgaacggtgtctagt

SEQ ID NO: 73176 - DNA, 25 bp, Mus musculus
aatactggtttgtacggtgtctagt

SEQ ID NO: 73177 - DNA, 25 bp, Mus musculus
aatactgtaaccatgctgccgttct

SEQ ID NO: 73178 - DNA, 25 bp, Mus musculus
aatactgtaaccttgctgccgttct

SEQ ID NO: 73179 - DNA, 25 bp, Mus musculus
aatactgtactccatgttttccacc

SEQ ID NO: 73180 - DNA, 25 bp, Mus musculus
aatactgtactcgatgttttccacc

SEQ ID NO: 73181 - DNA, 25 bp, Mus musculus
aatactgtacttagaagcttcttca

SEQ ID NO: 73182 - DNA, 25 bp, Mus musculus
aatactgtactttgaagcttcttca

SEQ ID NO: 73183 - DNA, 25 bp, Mus musculus
aatactgtagagacgcttccacgaa

SEQ ID NO: 73184 - DNA, 25 bp, Mus musculus
aatactgtagagtcgcttccacgaa

SEQ ID NO: 73185 - DNA, 25 bp, Mus musculus
aatactgtagatactgctgtccgca

SEQ ID NO: 73186 - DNA, 25 bp, Mus musculus
aatactgtagattctgctgtccgca

SEQ ID NO: 73187 - DNA, 25 bp, Mus musculus
aatactgtatcaagtggctatttta

SEQ ID NO: 73188 - DNA, 25 bp, Mus musculus
aatactgtatcatgtggctatttta

SEQ ID NO: 73189 - DNA, 25 bp, Mus musculus
aatactgtatgaactataacctaat

SEQ ID NO: 73190 - DNA, 25 bp, Mus musculus
aatactgtatgatctataacctaat

SEQ ID NO: 73191 - DNA, 25 bp, Mus musculus
aatactgtatttacgtatgtacacg

SEQ ID NO: 73192 - DNA, 25 bp, Mus musculus
aatactgtatttcctcccttctgac

SEQ ID NO: 73193 - DNA, 25 bp, Mus musculus
aatactgtatttgctcccttctgac

SEQ ID NO: 73194 - DNA, 25 bp, Mus musculus
aatactgtattttcgtatgtacacg

SEQ ID NO: 73195 - DNA, 25 bp, Mus musculus
aatactgtcacaaggttccaccgtg

SEQ ID NO: 73196 - DNA, 25 bp, Mus musculus
aatactgtcacatggttccaccgtg

SEQ ID NO: 73197 - DNA, 25 bp, Mus musculus
aatactgtcaccagtttttcctgaa

SEQ ID NO: 73198 - DNA, 25 bp, Mus musculus
aatactgtcacctgtttttcctgaa

SEQ ID NO: 73199 - DNA, 25 bp, Mus musculus
aatactgtcactaaatcacctctgc

SEQ ID NO: 73200 - DNA, 25 bp, Mus musculus
aatactgtcactaagcttatgcagc

SEQ ID NO: 73201 - DNA, 25 bp, Mus musculus
aatactgtcacttaatcacctctgc

SEQ ID NO: 73202 - DNA, 25 bp, Mus musculus
aatactgtcacttagcttatgcagc

SEQ ID NO: 73203 - DNA, 25 bp, Mus musculus
aatactgtcattccagatactcaaa

SEQ ID NO: 73204 - DNA, 25 bp, Mus musculus
aatactgtcattgcagatactcaaa

SEQ ID NO: 73205 - DNA, 25 bp, Mus musculus
aatactgtccatatgcctgagtgcc

SEQ ID NO: 73206 - DNA, 25 bp, Mus musculus
aatactgtccatttgcctgagtgcc

SEQ ID NO: 73207 - DNA, 25 bp, Mus musculus
aatactgtccttataggttgtgctc

SEQ ID NO: 73208 - DNA, 25 bp, Mus musculus
aatactgtccttttaggttgtgctc

SEQ ID NO: 73209 - DNA, 25 bp, Mus musculus
aatactgtctaaaactctggccctg

SEQ ID NO: 73210 - DNA, 25 bp, Mus musculus
aatactgtctaatactctggccctg

SEQ ID NO: 73211 - DNA, 25 bp, Mus musculus
aatactgtgaacacttggtaatcta

SEQ ID NO: 73212 - DNA, 25 bp, Mus musculus
aatactgtgaactcttggtaatcta

SEQ ID NO: 73213 - DNA, 25 bp, Mus musculus
aatactgtgaggatatttcctgttt

SEQ ID NO: 73214 - DNA, 25 bp, Mus musculus
aatactgtgaggttatttcctgttt

SEQ ID NO: 73215 - DNA, 25 bp, Mus musculus
aatactgtgctaatctttctggaac

SEQ ID NO: 73216 - DNA, 25 bp, Mus musculus
aatactgtgctattctttctggaac

SEQ ID NO: 73217 - DNA, 25 bp, Mus musculus
aatactgtgcttatgtgtttcaact

SEQ ID NO: 73218 - DNA, 25 bp, Mus musculus
aatactgtgcttttgtgtttcaact

SEQ ID NO: 73219 - DNA, 25 bp, Mus musculus
aatactgtggaaaactatctgtgca

SEQ ID NO: 73220 - DNA, 25 bp, Mus musculus
aatactgtggaatactatctgtgca

SEQ ID NO: 73221 - DNA, 25 bp, Mus musculus
aatactgtggccactgtaaagccat

SEQ ID NO: 73222 - DNA, 25 bp, Mus musculus
aatactgtggcctctgtaaagccat

SEQ ID NO: 73223 - DNA, 25 bp, Mus musculus
aatactgtggtaagagatatcccga

SEQ ID NO: 73224 - DNA, 25 bp, Mus musculus
aatactgtggtatgagatatcccga

SEQ ID NO: 73225 - DNA, 25 bp, Mus musculus
aatactgtgtctcctgtcagtggga

SEQ ID NO: 73226 - DNA, 25 bp, Mus musculus
aatactgtgtctgctgtcagtggga

SEQ ID NO: 73227 - DNA, 25 bp, Mus musculus
aatactgttaacagcctttgctttt

SEQ ID NO: 73228 - DNA, 25 bp, Mus musculus
aatactgttaactgcctttgctttt

SEQ ID NO: 73229 - DNA, 25 bp, Mus musculus
aatactgttacacgattcatgaact

SEQ ID NO: 73230 - DNA, 25 bp, Mus musculus
aatactgttacaggattcatgaact

SEQ ID NO: 73231 - DNA, 25 bp, Mus musculus
aatactgttctcagcatttcatctg

SEQ ID NO: 73232 - DNA, 25 bp, Mus musculus
aatactgttctctgcatttcatctg

SEQ ID NO: 73233 - DNA, 25 bp, Mus musculus
aatactgttgttctattattaggca

SEQ ID NO: 73234 - DNA, 25 bp, Mus musculus
aatactgttgttgtattattaggca

SEQ ID NO: 73235 - DNA, 25 bp, Mus musculus
aatactgtttcaaaggttgttatac

SEQ ID NO: 73236 - DNA, 25 bp, Mus musculus
aatactgtttcataggttgttatac

SEQ ID NO: 73237 - DNA, 25 bp, Mus musculus
aatactgtttttcgtctgggtgtag

SEQ ID NO: 73238 - DNA, 25 bp, Mus musculus
aatactgtttttggtctgggtgtag

SEQ ID NO: 73239 - DNA, 25 bp, Mus musculus
aatacttaagtcatatctgagcctt

SEQ ID NO: 73240 - DNA, 25 bp, Mus musculus
aatacttaagtcttatctgagcctt

SEQ ID NO: 73241 - DNA, 25 bp, Mus musculus
aatacttaatttcagcctggctgtt

SEQ ID NO: 73242 - DNA, 25 bp, Mus musculus
aatacttaatttgagcctggctgtt

SEQ ID NO: 73243 - DNA, 25 bp, Mus musculus
aatacttatcatagaaacctcagaa

SEQ ID NO: 73244 - DNA, 25 bp, Mus musculus
aatacttatcattgaaacctcagaa

SEQ ID NO: 73245 - DNA, 25 bp, Mus musculus
aatacttattgtctctgtaggcacc

SEQ ID NO: 73246 - DNA, 25 bp, Mus musculus
aatacttattgtgtctgtaggcacc

SEQ ID NO: 73247 - DNA, 25 bp, Mus musculus
aatacttcaatgaactcagagctgg

SEQ ID NO: 73248 - DNA, 25 bp, Mus musculus
aatacttcaatgtactcagagctgg

SEQ ID NO: 73249 - DNA, 25 bp, Mus musculus
aatacttcactgagtgggtctgacc

SEQ ID NO: 73250 - DNA, 25 bp, Mus musculus
aatacttcactgtgtgggtctgacc

SEQ ID NO: 73251 - DNA, 25 bp, Mus musculus
aatacttcaggcattaggtcctcct

SEQ ID NO: 73252 - DNA, 25 bp, Mus musculus
aatacttcaggctttaggtcctcct

SEQ ID NO: 73253 - DNA, 25 bp, Mus musculus
aatacttcattccttaattctccct

SEQ ID NO: 73254 - DNA, 25 bp, Mus musculus
aatacttcattcgttaattctccct

SEQ ID NO: 73255 - DNA, 25 bp, Mus musculus
aatacttccaaactgtcacttctac

SEQ ID NO: 73256 - DNA, 25 bp, Mus musculus
aatacttccaaagtgtcacttctac

SEQ ID NO: 73257 - DNA, 25 bp, Mus musculus
aatacttcccaaccactgagtcact

SEQ ID NO: 73258 - DNA, 25 bp, Mus musculus
aatacttcccaagcactgagtcact

SEQ ID NO: 73259 - DNA, 25 bp, Mus musculus
aatacttcctcaaatgtgctattta

SEQ ID NO: 73260 - DNA, 25 bp, Mus musculus
aatacttcctcatatgtgctattta

SEQ ID NO: 73261 - DNA, 25 bp, Mus musculus
aatacttcgctcaactctgtttaaa

SEQ ID NO: 73262 - DNA, 25 bp, Mus musculus
aatacttcgctctactctgtttaaa

SEQ ID NO: 73263 - DNA, 25 bp, Mus musculus
aatacttctaagagtccattttatg

SEQ ID NO: 73264 - DNA, 25 bp, Mus musculus
aatacttctaagtgtccattttatg

SEQ ID NO: 73265 - DNA, 25 bp, Mus musculus
aatacttctcgtcttcagagcacat

SEQ ID NO: 73266 - DNA, 25 bp, Mus musculus
aatacttctcgtgttcagagcacat

SEQ ID NO: 73267 - DNA, 25 bp, Mus musculus
aatacttcttgtcatatgggactaa

SEQ ID NO: 73268 - DNA, 25 bp, Mus musculus
aatacttcttgtgatatgggactaa

SEQ ID NO: 73269 - DNA, 25 bp, Mus musculus
aatacttgaactctgtgtctgctgc

SEQ ID NO: 73270 - DNA, 25 bp, Mus musculus
aatacttgaactgtgtgtctgctgc

SEQ ID NO: 73271 - DNA, 25 bp, Mus musculus
aatacttgacttatctcccctggat

SEQ ID NO: 73272 - DNA, 25 bp, Mus musculus
aatacttgacttttctcccctggat

SEQ ID NO: 73273 - DNA, 25 bp, Mus musculus
aatacttgagctcctctttagcggc

SEQ ID NO: 73274 - DNA, 25 bp, Mus musculus
aatacttgagctgctctttagcggc

SEQ ID NO: 73275 - DNA, 25 bp, Mus musculus
aatacttgcaaaaccggatctgatg

SEQ ID NO: 73276 - DNA, 25 bp, Mus musculus
aatacttgcaaatccggatctgatg

SEQ ID NO: 73277 - DNA, 25 bp, Mus musculus
aatacttgcaacctgctacacatca

SEQ ID NO: 73278 - DNA, 25 bp, Mus musculus
aatacttgcaacgtgctacacatca

SEQ ID NO: 73279 - DNA, 25 bp, Mus musculus
aatacttgcagccagatgtgatatc

SEQ ID NO: 73280 - DNA, 25 bp, Mus musculus
aatacttgcagcgagatgtgatatc

SEQ ID NO: 73281 - DNA, 25 bp, Mus musculus
aatacttgctgaccgccctggagct

SEQ ID NO: 73282 - DNA, 25 bp, Mus musculus
aatacttgctgagcgccctggagct

SEQ ID NO: 73283 - DNA, 25 bp, Mus musculus
aatacttgcttacttcttgaacttt

SEQ ID NO: 73284 - DNA, 25 bp, Mus musculus
aatacttgcttagttcttgaacttt

SEQ ID NO: 73285 - DNA, 25 bp, Mus musculus
aatacttggatcactacactttgtt

SEQ ID NO: 73286 - DNA, 25 bp, Mus musculus
aatacttggatctctacactttgtt

SEQ ID NO: 73287 - DNA, 25 bp, Mus musculus
aatacttggattccagccctatgcc

SEQ ID NO: 73288 - DNA, 25 bp, Mus musculus
aatacttggattgcagccctatgcc

SEQ ID NO: 73289 - DNA, 25 bp, Mus musculus
aatacttgggacacaaagcgaagat

SEQ ID NO: 73290 - DNA, 25 bp, Mus musculus
aatacttgggactcaaagcgaagat

SEQ ID NO: 73291 - DNA, 25 bp, Mus musculus
aatacttggtgtccaggttcttact

SEQ ID NO: 73292 - DNA, 25 bp, Mus musculus
aatacttggtgtgcaggttcttact

SEQ ID NO: 73293 - DNA, 25 bp, Mus musculus
aatacttgtatgaggactgtgacgt

SEQ ID NO: 73294 - DNA, 25 bp, Mus musculus
aatacttgtatgtggactgtgacgt

SEQ ID NO: 73295 - DNA, 25 bp, Mus musculus
aatacttgtcatatctttcacttaa

SEQ ID NO: 73296 - DNA, 25 bp, Mus musculus
aatacttgtcatttctttcacttaa

SEQ ID NO: 73297 - DNA, 25 bp, Mus musculus
aatacttgtcgtcctgtttttcgct

SEQ ID NO: 73298 - DNA, 25 bp, Mus musculus
aatacttgtcgtgctgtttttcgct

SEQ ID NO: 73299 - DNA, 25 bp, Mus musculus
aatacttgtgtgctagcttctgtta

SEQ ID NO: 73300 - DNA, 25 bp, Mus musculus
aatacttgtgtggtagcttctgtta

SEQ ID NO: 73301 - DNA, 25 bp, Mus musculus
aatacttgttgtctgtgggctgcca

SEQ ID NO: 73302 - DNA, 25 bp, Mus musculus
aatacttgttgtgtgtgggctgcca

SEQ ID NO: 73303 - DNA, 25 bp, Mus musculus
aatactttaaaaactcgcatccgag

SEQ ID NO: 73304 - DNA, 25 bp, Mus musculus
aatactttaaaatctcgcatccgag

SEQ ID NO: 73305 - DNA, 25 bp, Mus musculus
aatactttacaaactggcttagagt

SEQ ID NO: 73306 - DNA, 25 bp, Mus musculus
aatactttacaatctggcttagagt

SEQ ID NO: 73307 - DNA, 25 bp, Mus musculus
aatactttaccccatctctaaatca

SEQ ID NO: 73308 - DNA, 25 bp, Mus musculus
aatactttaccccttgtgatcaaag

SEQ ID NO: 73309 - DNA, 25 bp, Mus musculus
aatactttacccgatctctaaatca

SEQ ID NO: 73310 - DNA, 25 bp, Mus musculus
aatactttacccgttgtgatcaaag

SEQ ID NO: 73311 - DNA, 25 bp, Mus musculus
aatactttactacagaccgaggcct

SEQ ID NO: 73312 - DNA, 25 bp, Mus musculus
aatactttactagagaccgaggcct

SEQ ID NO: 73313 - DNA, 25 bp, Mus musculus
aatactttagagatgccttttgaga

SEQ ID NO: 73314 - DNA, 25 bp, Mus musculus
aatactttagagttgccttttgaga

SEQ ID NO: 73315 - DNA, 25 bp, Mus musculus
aatactttatacctgtatggacgtg

SEQ ID NO: 73316 - DNA, 25 bp, Mus musculus
aatactttatacgtgtatggacgtg

SEQ ID NO: 73317 - DNA, 25 bp, Mus musculus
aatactttatttcgctgttccatcc

SEQ ID NO: 73318 - DNA, 25 bp, Mus musculus
aatactttatttggctgttccatcc

SEQ ID NO: 73319 - DNA, 25 bp, Mus musculus
aatactttccatacattatatttta

SEQ ID NO: 73320 - DNA, 25 bp, Mus musculus
aatactttccattcattatatttta

SEQ ID NO: 73321 - DNA, 25 bp, Mus musculus
aatactttcccaaatttctatgata

SEQ ID NO: 73322 - DNA, 25 bp, Mus musculus
aatactttcccaatgcagtcaactc

SEQ ID NO: 73323 - DNA, 25 bp, Mus musculus
aatactttcccaatgtctcttttga

SEQ ID NO: 73324 - DNA, 25 bp, Mus musculus
aatactttcccatatttctatgata

SEQ ID NO: 73325 - DNA, 25 bp, Mus musculus
aatactttcccattgcagtcaactc

SEQ ID NO: 73326 - DNA, 25 bp, Mus musculus
aatactttcccattgtctcttttga

SEQ ID NO: 73327 - DNA, 25 bp, Mus musculus
aatactttctaaatgccagagggat

SEQ ID NO: 73328 - DNA, 25 bp, Mus musculus
aatactttctaattgccagagggat

SEQ ID NO: 73329 - DNA, 25 bp, Mus musculus
aatactttctggagatcatgggttc

SEQ ID NO: 73330 - DNA, 25 bp, Mus musculus
aatactttctggtgatcatgggttc

SEQ ID NO: 73331 - DNA, 25 bp, Mus musculus
aatactttctgtatggtccgcagca

SEQ ID NO: 73332 - DNA, 25 bp, Mus musculus
aatactttctgtttggtccgcagca

SEQ ID NO: 73333 - DNA, 25 bp, Mus musculus
aatactttctttaccctattgcagg

SEQ ID NO: 73334 - DNA, 25 bp, Mus musculus
aatactttcttttccctattgcagg

SEQ ID NO: 73335 - DNA, 25 bp, Mus musculus
aatactttgaccctgagggcagaca

SEQ ID NO: 73336 - DNA, 25 bp, Mus musculus
aatactttgaccgtgagggcagaca

SEQ ID NO: 73337 - DNA, 25 bp, Mus musculus
aatactttgatcacctgtcaggaca

SEQ ID NO: 73338 - DNA, 25 bp, Mus musculus
aatactttgatctcctgtcaggaca

SEQ ID NO: 73339 - DNA, 25 bp, Mus musculus
aatactttgctcagatacatcttga

SEQ ID NO: 73340 - DNA, 25 bp, Mus musculus
aatactttgctctgatacatcttga

SEQ ID NO: 73341 - DNA, 25 bp, Mus musculus
aatactttggccctgatccagctga

SEQ ID NO: 73342 - DNA, 25 bp, Mus musculus
aatactttggccgtgatccagctga

SEQ ID NO: 73343 - DNA, 25 bp, Mus musculus
aatactttgttacttgctgttcagt

SEQ ID NO: 73344 - DNA, 25 bp, Mus musculus
aatactttgttagttgctgttcagt

SEQ ID NO: 73345 - DNA, 25 bp, Mus musculus
aatacttttggacattggatggcct

SEQ ID NO: 73346 - DNA, 25 bp, Mus musculus
aatacttttggagattggatggcct

SEQ ID NO: 73347 - DNA, 25 bp, Mus musculus
aatactttttgcataaactgctctg

SEQ ID NO: 73348 - DNA, 25 bp, Mus musculus
aatactttttgcttaaactgctctg

SEQ ID NO: 73349 - DNA, 25 bp, Mus musculus
aatactttttggcttctcccagctc

SEQ ID NO: 73350 - DNA, 25 bp, Mus musculus
aatactttttgggttctcccagctc

SEQ ID NO: 73351 - DNA, 25 bp, Mus musculus
aatagaaaactccatgctctgccca

SEQ ID NO: 73352 - DNA, 25 bp, Mus musculus
aatagaaaactcgatgctctgccca

SEQ ID NO: 73353 - DNA, 25 bp, Mus musculus
aatagaaaggttcatttgtctccgg

SEQ ID NO: 73354 - DNA, 25 bp, Mus musculus
aatagaaaggttgatttgtctccgg

SEQ ID NO: 73355 - DNA, 25 bp, Mus musculus
aatagaaattctacagctggtggat

SEQ ID NO: 73356 - DNA, 25 bp, Mus musculus
aatagaaattcttcagctggtggat

SEQ ID NO: 73357 - DNA, 25 bp, Mus musculus
aatagaacatacagctttcagaggg

SEQ ID NO: 73358 - DNA, 25 bp, Mus musculus
aatagaacatactgctttcagaggg

SEQ ID NO: 73359 - DNA, 25 bp, Mus musculus
aatagaaccactaagccgggcaggg

SEQ ID NO: 73360 - DNA, 25 bp, Mus musculus
aatagaaccacttagccgggcaggg

SEQ ID NO: 73361 - DNA, 25 bp, Mus musculus
aatagaaccagcactggcggacata

SEQ ID NO: 73362 - DNA, 25 bp, Mus musculus
aatagaaccagctctggcggacata

SEQ ID NO: 73363 - DNA, 25 bp, Mus musculus
aatagaaccgtcaaccagtgacctc

SEQ ID NO: 73364 - DNA, 25 bp, Mus musculus
aatagaaccgtctaccagtgacctc

SEQ ID NO: 73365 - DNA, 25 bp, Mus musculus
aatagaacctgccatgtcataacat

SEQ ID NO: 73366 - DNA, 25 bp, Mus musculus
aatagaacctgcgatgtcataacat

SEQ ID NO: 73367 - DNA, 25 bp, Mus musculus
aatagaacctggcaccagtgagcct

SEQ ID NO: 73368 - DNA, 25 bp, Mus musculus
aatagaacctgggaccagtgagcct

SEQ ID NO: 73369 - DNA, 25 bp, Mus musculus
aatagaaccttgatcattataaaca

SEQ ID NO: 73370 - DNA, 25 bp, Mus musculus
aatagaaccttgttcattataaaca

SEQ ID NO: 73371 - DNA, 25 bp, Mus musculus
aatagaactccaccagttgcagtgg

SEQ ID NO: 73372 - DNA, 25 bp, Mus musculus
aatagaactccagcagttgcagtgg

SEQ ID NO: 73373 - DNA, 25 bp, Mus musculus
aatagaacttgcaaccatctaccca

SEQ ID NO: 73374 - DNA, 25 bp, Mus musculus
aatagaacttgctaccatctaccca

SEQ ID NO: 73375 - DNA, 25 bp, Mus musculus
aatagaagactgactcaggtgtgcg

SEQ ID NO: 73376 - DNA, 25 bp, Mus musculus
aatagaagactgtctcaggtgtgcg

SEQ ID NO: 73377 - DNA, 25 bp, Mus musculus
aatagaagcctactgggttgcccac

SEQ ID NO: 73378 - DNA, 25 bp, Mus musculus
aatagaagcctagtgggttgcccac

SEQ ID NO: 73379 - DNA, 25 bp, Mus musculus
aatagaagcctccagctgctgtcta

SEQ ID NO: 73380 - DNA, 25 bp, Mus musculus
aatagaagcctcgagctgctgtcta

SEQ ID NO: 73381 - DNA, 25 bp, Mus musculus
aatagaagccttagtcagtccctcc

SEQ ID NO: 73382 - DNA, 25 bp, Mus musculus
aatagaagcctttgtcagtccctcc

SEQ ID NO: 73383 - DNA, 25 bp, Mus musculus
aatagaaggcctctagtcacggtgt

SEQ ID NO: 73384 - DNA, 25 bp, Mus musculus
aatagaaggcctgtagtcacggtgt

SEQ ID NO: 73385 - DNA, 25 bp, Mus musculus
aatagaagtccaccgtcactaggct

SEQ ID NO: 73386 - DNA, 25 bp, Mus musculus
aatagaagtccagcgtcactaggct

SEQ ID NO: 73387 - DNA, 25 bp, Mus musculus
aatagaagtgaccttggccaagcca

SEQ ID NO: 73388 - DNA, 25 bp, Mus musculus
aatagaagtgacgttggccaagcca

SEQ ID NO: 73389 - DNA, 25 bp, Mus musculus
aatagaatacatcggctgaagagat

SEQ ID NO: 73390 - DNA, 25 bp, Mus musculus
aatagaatacatgggctgaagagat

SEQ ID NO: 73391 - DNA, 25 bp, Mus musculus
aatagaatccagaccgttatgttga

SEQ ID NO: 73392 - DNA, 25 bp, Mus musculus
aatagaatccagtccgttatgttga

SEQ ID NO: 73393 - DNA, 25 bp, Mus musculus
aatagaattataaccccagcccaaa

SEQ ID NO: 73394 - DNA, 25 bp, Mus musculus
aatagaattatatccccagcccaaa

SEQ ID NO: 73395 - DNA, 25 bp, Mus musculus
aatagaattctcagtgggctcctgg

SEQ ID NO: 73396 - DNA, 25 bp, Mus musculus
aatagaattctctgtgggctcctgg

SEQ ID NO: 73397 - DNA, 25 bp, Mus musculus
aatagaattgttagcgttgtcattt

SEQ ID NO: 73398 - DNA, 25 bp, Mus musculus
aatagaattgtttgcgttgtcattt

SEQ ID NO: 73399 - DNA, 25 bp, Mus musculus
aatagaatttgtcaagtactttgga

SEQ ID NO: 73400 - DNA, 25 bp, Mus musculus
aatagaatttgtgaagtactttgga

SEQ ID NO: 73401 - DNA, 25 bp, Mus musculus
aatagacaacccagactcgcagtgg

SEQ ID NO: 73402 - DNA, 25 bp, Mus musculus
aatagacaaccctgactcgcagtgg

SEQ ID NO: 73403 - DNA, 25 bp, Mus musculus
aatagacaagtccacataaccccag

SEQ ID NO: 73404 - DNA, 25 bp, Mus musculus
aatagacaagtcgacataaccccag

SEQ ID NO: 73405 - DNA, 25 bp, Mus musculus
aatagacaatacagcccatcttcct

SEQ ID NO: 73406 - DNA, 25 bp, Mus musculus
aatagacaatactgcccatcttcct

SEQ ID NO: 73407 - DNA, 25 bp, Mus musculus
aatagacaccgcagtgcccaaatgg

SEQ ID NO: 73408 - DNA, 25 bp, Mus musculus
aatagacaccgctgtgcccaaatgg

SEQ ID NO: 73409 - DNA, 25 bp, Mus musculus
aatagacactcgatgattccctttg

SEQ ID NO: 73410 - DNA, 25 bp, Mus musculus
aatagacactcgttgattccctttg

SEQ ID NO: 73411 - DNA, 25 bp, Mus musculus
aatagacagttcctcttttatatgg

SEQ ID NO: 73412 - DNA, 25 bp, Mus musculus
aatagacagttcgtcttttatatgg

SEQ ID NO: 73413 - DNA, 25 bp, Mus musculus
aatagaccaagacagcctcattttt

SEQ ID NO: 73414 - DNA, 25 bp, Mus musculus
aatagaccaagagagcctcattttt

SEQ ID NO: 73415 - DNA, 25 bp, Mus musculus
aatagaccatataccggatctgcca

SEQ ID NO: 73416 - DNA, 25 bp, Mus musculus
aatagaccatattccggatctgcca

SEQ ID NO: 73417 - DNA, 25 bp, Mus musculus
aatagaccccaaccaagtgtcctct

SEQ ID NO: 73418 - DNA, 25 bp, Mus musculus
aatagaccccaagcaagtgtcctct

SEQ ID NO: 73419 - DNA, 25 bp, Mus musculus
aatagaccccacaggcatcttgaag

SEQ ID NO: 73420 - DNA, 25 bp, Mus musculus
aatagaccccactggcatcttgaag

SEQ ID NO: 73421 - DNA, 25 bp, Mus musculus
aatagaccgtgacaggccacagcct

SEQ ID NO: 73422 - DNA, 25 bp, Mus musculus
aatagaccgtgagaggccacagcct

SEQ ID NO: 73423 - DNA, 25 bp, Mus musculus
aatagacctgccagttactttttgt

SEQ ID NO: 73424 - DNA, 25 bp, Mus musculus
aatagacctgcctgttactttttgt

SEQ ID NO: 73425 - DNA, 25 bp, Mus musculus
aatagacctgctctgtgtattgcca

SEQ ID NO: 73426 - DNA, 25 bp, Mus musculus
aatagacctgctgtgtgtattgcca

SEQ ID NO: 73427 - DNA, 25 bp, Mus musculus
aatagacctggcaaacaggagacaa

SEQ ID NO: 73428 - DNA, 25 bp, Mus musculus
aatagacctggctaacaggagacaa

SEQ ID NO: 73429 - DNA, 25 bp, Mus musculus
aatagaccttagagtgtgttctgtc

SEQ ID NO: 73430 - DNA, 25 bp, Mus musculus
aatagaccttagtgtgtgttctgtc

SEQ ID NO: 73431 - DNA, 25 bp, Mus musculus
aatagacgcaggaggccatcagaga

SEQ ID NO: 73432 - DNA, 25 bp, Mus musculus
aatagacgcaggtggccatcagaga

SEQ ID NO: 73433 - DNA, 25 bp, Mus musculus
aatagacgccatcgccaagctcacg

SEQ ID NO: 73434 - DNA, 25 bp, Mus musculus
aatagacgccatggccaagctcacg

SEQ ID NO: 73435 - DNA, 25 bp, Mus musculus
aatagacggccactggcttttctcc

SEQ ID NO: 73436 - DNA, 25 bp, Mus musculus
aatagacggccagtggcttttctcc

SEQ ID NO: 73437 - DNA, 25 bp, Mus musculus
aatagacggctccagcagcagtaca

SEQ ID NO: 73438 - DNA, 25 bp, Mus musculus
aatagacggctcgagcagcagtaca

SEQ ID NO: 73439 - DNA, 25 bp, Mus musculus
aatagactagaacccattgaataac

SEQ ID NO: 73440 - DNA, 25 bp, Mus musculus
aatagactagaagccattgaataac

SEQ ID NO: 73441 - DNA, 25 bp, Mus musculus
aatagactaggcaagcacgctgcta

SEQ ID NO: 73442 - DNA, 25 bp, Mus musculus
aatagactaggctagcacgctgcta

SEQ ID NO: 73443 - DNA, 25 bp, Mus musculus
aatagactagtccacattttgtttg

SEQ ID NO: 73444 - DNA, 25 bp, Mus musculus
aatagactagtcgacattttgtttg

SEQ ID NO: 73445 - DNA, 25 bp, Mus musculus
aatagactcaaacagcacactcata

SEQ ID NO: 73446 - DNA, 25 bp, Mus musculus
aatagactcaaagagcacactcata

SEQ ID NO: 73447 - DNA, 25 bp, Mus musculus
aatagactcaagctcccaattaggt

SEQ ID NO: 73448 - DNA, 25 bp, Mus musculus
aatagactcaaggtcccaattaggt

SEQ ID NO: 73449 - DNA, 25 bp, Mus musculus
aatagactccatacagggtgtgtga

SEQ ID NO: 73450 - DNA, 25 bp, Mus musculus
aatagactccattcagggtgtgtga

SEQ ID NO: 73451 - DNA, 25 bp, Mus musculus
aatagactctggaggtcagtttcca

SEQ ID NO: 73452 - DNA, 25 bp, Mus musculus
aatagactctggtggtcagtttcca

SEQ ID NO: 73453 - DNA, 25 bp, Mus musculus
aatagactctttctcttatttttgg

SEQ ID NO: 73454 - DNA, 25 bp, Mus musculus
aatagactctttgtcttatttttgg

SEQ ID NO: 73455 - DNA, 25 bp, Mus musculus
aatagactgtgactcctactgggac

SEQ ID NO: 73456 - DNA, 25 bp, Mus musculus
aatagactgtgagtcctactgggac

SEQ ID NO: 73457 - DNA, 25 bp, Mus musculus
aatagacttcttactccttgtgtac

SEQ ID NO: 73458 - DNA, 25 bp, Mus musculus
aatagacttctttctccttgtgtac

SEQ ID NO: 73459 - DNA, 25 bp, Mus musculus
aatagacttgagagccctggctctg

SEQ ID NO: 73460 - DNA, 25 bp, Mus musculus
aatagacttgagtgccctggctctg

SEQ ID NO: 73461 - DNA, 25 bp, Mus musculus
aatagacttgccagagatctcccag

SEQ ID NO: 73462 - DNA, 25 bp, Mus musculus
aatagacttgcctgagatctcccag

SEQ ID NO: 73463 - DNA, 25 bp, Mus musculus
aatagacttgttcttagggctcagt

SEQ ID NO: 73464 - DNA, 25 bp, Mus musculus
aatagacttgttgttagggctcagt

SEQ ID NO: 73465 - DNA, 25 bp, Mus musculus
aatagacttttgatggtttcagaat

SEQ ID NO: 73466 - DNA, 25 bp, Mus musculus
aatagacttttgttggtttcagaat

SEQ ID NO: 73467 - DNA, 25 bp, Mus musculus
aatagagacctcatcctggatgctg

SEQ ID NO: 73468 - DNA, 25 bp, Mus musculus
aatagagacctcttcctggatgctg

SEQ ID NO: 73469 - DNA, 25 bp, Mus musculus
aatagagagcgtatttacagatggc

SEQ ID NO: 73470 - DNA, 25 bp, Mus musculus
aatagagagcgtttttacagatggc

SEQ ID NO: 73471 - DNA, 25 bp, Mus musculus
aatagagatagcaactaaatgacag

SEQ ID NO: 73472 - DNA, 25 bp, Mus musculus
aatagagatagctactaaatgacag

SEQ ID NO: 73473 - DNA, 25 bp, Mus musculus
aatagagcaccaaatccttcatgcc

SEQ ID NO: 73474 - DNA, 25 bp, Mus musculus
aatagagcaccatatccttcatgcc

SEQ ID NO: 73475 - DNA, 25 bp, Mus musculus
aatagagcagcactgccttttgact

SEQ ID NO: 73476 - DNA, 25 bp, Mus musculus
aatagagcagcagtgccttttgact

SEQ ID NO: 73477 - DNA, 25 bp, Mus musculus
aatagagcagtaattgcgcacccct

SEQ ID NO: 73478 - DNA, 25 bp, Mus musculus
aatagagcagtatttgcgcacccct

SEQ ID NO: 73479 - DNA, 25 bp, Mus musculus
aatagagcagttcctgctaccagtc

SEQ ID NO: 73480 - DNA, 25 bp, Mus musculus
aatagagcagttgctgctaccagtc

SEQ ID NO: 73481 - DNA, 25 bp, Mus musculus
aatagagccaagcttctgtcgtgac

SEQ ID NO: 73482 - DNA, 25 bp, Mus musculus
aatagagccaaggttctgtcgtgac

SEQ ID NO: 73483 - DNA, 25 bp, Mus musculus
aatagagctgctaccgactttagat

SEQ ID NO: 73484 - DNA, 25 bp, Mus musculus
aatagagctgctacgcctagaattg

SEQ ID NO: 73485 - DNA, 25 bp, Mus musculus
aatagagctgcttccgactttagat

SEQ ID NO: 73486 - DNA, 25 bp, Mus musculus
aatagagctgcttcgcctagaattg

SEQ ID NO: 73487 - DNA, 25 bp, Mus musculus
aatagaggacacaagcaaacaagac

SEQ ID NO: 73488 - DNA, 25 bp, Mus musculus
aatagaggacactagcaaacaagac

SEQ ID NO: 73489 - DNA, 25 bp, Mus musculus
aatagaggcaggctccttcaggtcc

SEQ ID NO: 73490 - DNA, 25 bp, Mus musculus
aatagaggcagggtccttcaggtcc

SEQ ID NO: 73491 - DNA, 25 bp, Mus musculus
aatagaggccatacctcaactgtga

SEQ ID NO: 73492 - DNA, 25 bp, Mus musculus
aatagaggccattcctcaactgtga

SEQ ID NO: 73493 - DNA, 25 bp, Mus musculus
aatagaggcgaccagcatttcatcc

SEQ ID NO: 73494 - DNA, 25 bp, Mus musculus
aatagaggcgacgagcatttcatcc

SEQ ID NO: 73495 - DNA, 25 bp, Mus musculus
aatagaggctcaacttcgcaaacag

SEQ ID NO: 73496 - DNA, 25 bp, Mus musculus
aatagaggctcatcttcgcaaacag

SEQ ID NO: 73497 - DNA, 25 bp, Mus musculus
aatagaggctctattatgctgctgc

SEQ ID NO: 73498 - DNA, 25 bp, Mus musculus
aatagaggctcttttatgctgctgc

SEQ ID NO: 73499 - DNA, 25 bp, Mus musculus
aatagagggaagctagtggctccaa

SEQ ID NO: 73500 - DNA, 25 bp, Mus musculus
aatagagggaaggtagtggctccaa

SEQ ID NO: 73501 - DNA, 25 bp, Mus musculus
aatagagtactaagccatgttggct

SEQ ID NO: 73502 - DNA, 25 bp, Mus musculus
aatagagtactatgccatgttggct

SEQ ID NO: 73503 - DNA, 25 bp, Mus musculus
aatagagtgcctacttagccttcaa

SEQ ID NO: 73504 - DNA, 25 bp, Mus musculus
aatagagtgccttcttagccttcaa

SEQ ID NO: 73505 - DNA, 25 bp, Mus musculus
aatagagtggcacgcctctgtcggt

SEQ ID NO: 73506 - DNA, 25 bp, Mus musculus
aatagagtggcaggcctctgtcggt

SEQ ID NO: 73507 - DNA, 25 bp, Mus musculus
aatagagtggccacattggttccca

SEQ ID NO: 73508 - DNA, 25 bp, Mus musculus
aatagagtggcctcattggttccca

SEQ ID NO: 73509 - DNA, 25 bp, Mus musculus
aatagagtggttctgtgaaaaactg

SEQ ID NO: 73510 - DNA, 25 bp, Mus musculus
aatagagtggttgtgtgaaaaactg

SEQ ID NO: 73511 - DNA, 25 bp, Mus musculus
aatagagttctcataggctaaggct

SEQ ID NO: 73512 - DNA, 25 bp, Mus musculus
aatagagttctcttaggctaaggct

SEQ ID NO: 73513 - DNA, 25 bp, Mus musculus
aatagagttgctcacagactgtgct

SEQ ID NO: 73514 - DNA, 25 bp, Mus musculus
aatagagttgctgacagactgtgct

SEQ ID NO: 73515 - DNA, 25 bp, Mus musculus
aatagatacattcctggcctttgtt

SEQ ID NO: 73516 - DNA, 25 bp, Mus musculus
aatagatacattgctggcctttgtt

SEQ ID NO: 73517 - DNA, 25 bp, Mus musculus
aatagatagctgaaacactgcctgg

SEQ ID NO: 73518 - DNA, 25 bp, Mus musculus
aatagatagctgtaacactgcctgg

SEQ ID NO: 73519 - DNA, 25 bp, Mus musculus
aatagatatattcgacacagacggc

SEQ ID NO: 73520 - DNA, 25 bp, Mus musculus
aatagatatattggacacagacggc

SEQ ID NO: 73521 - DNA, 25 bp, Mus musculus
aatagatcagctctgtccaactcta

SEQ ID NO: 73522 - DNA, 25 bp, Mus musculus
aatagatcagctgtgtccaactcta

SEQ ID NO: 73523 - DNA, 25 bp, Mus musculus
aatagatccatccacaatttccttg

SEQ ID NO: 73524 - DNA, 25 bp, Mus musculus
aatagatccatcgacaatttccttg

SEQ ID NO: 73525 - DNA, 25 bp, Mus musculus
aatagatctcttccatcaaaattga

SEQ ID NO: 73526 - DNA, 25 bp, Mus musculus
aatagatctcttgcatcaaaattga

SEQ ID NO: 73527 - DNA, 25 bp, Mus musculus
aatagatctgtaccctcaatgcccc

SEQ ID NO: 73528 - DNA, 25 bp, Mus musculus
aatagatctgtagcctcaatgcccc

SEQ ID NO: 73529 - DNA, 25 bp, Mus musculus
aatagatcttccctcatgggacgct

SEQ ID NO: 73530 - DNA, 25 bp, Mus musculus
aatagatcttccgtcatgggacgct

SEQ ID NO: 73531 - DNA, 25 bp, Mus musculus
aatagatgacctatcacagactgaa

SEQ ID NO: 73532 - DNA, 25 bp, Mus musculus
aatagatgacctttcacagactgaa

SEQ ID NO: 73533 - DNA, 25 bp, Mus musculus
aatagatgctcgcattctcctctaa

SEQ ID NO: 73534 - DNA, 25 bp, Mus musculus
aatagatgctcggattctcctctaa

SEQ ID NO: 73535 - DNA, 25 bp, Mus musculus
aatagatggtatacagcagttctgt

SEQ ID NO: 73536 - DNA, 25 bp, Mus musculus
aatagatggtattcagcagttctgt

SEQ ID NO: 73537 - DNA, 25 bp, Mus musculus
aatagatgtagtcccatttggccct

SEQ ID NO: 73538 - DNA, 25 bp, Mus musculus
aatagatgtagtgccatttggccct

SEQ ID NO: 73539 - DNA, 25 bp, Mus musculus
aatagatgtcaccacagtcgagaga

SEQ ID NO: 73540 - DNA, 25 bp, Mus musculus
aatagatgtcacgacagtcgagaga

SEQ ID NO: 73541 - DNA, 25 bp, Mus musculus
aatagattcatcagtttcctgccat

SEQ ID NO: 73542 - DNA, 25 bp, Mus musculus
aatagattcatctgtttcctgccat

SEQ ID NO: 73543 - DNA, 25 bp, Mus musculus
aatagattggttatgatgcctggtt

SEQ ID NO: 73544 - DNA, 25 bp, Mus musculus
aatagattggttttgatgcctggtt

SEQ ID NO: 73545 - DNA, 25 bp, Mus musculus
aatagatttcatagttaacagaact

SEQ ID NO: 73546 - DNA, 25 bp, Mus musculus
aatagatttcattgttaacagaact

SEQ ID NO: 73547 - DNA, 25 bp, Mus musculus
aatagatttcctaagggctcggcaa

SEQ ID NO: 73548 - DNA, 25 bp, Mus musculus
aatagatttccttagggctcggcaa

SEQ ID NO: 73549 - DNA, 25 bp, Mus musculus
aatagattttggatagcctgggcta

SEQ ID NO: 73550 - DNA, 25 bp, Mus musculus
aatagattttggttagcctgggcta

SEQ ID NO: 73551 - DNA, 25 bp, Mus musculus
aatagcaaatttctcagcacttgga

SEQ ID NO: 73552 - DNA, 25 bp, Mus musculus
aatagcaaatttgtcagcacttgga

SEQ ID NO: 73553 - DNA, 25 bp, Mus musculus
aatagcaacaggaggcgacatcaac

SEQ ID NO: 73554 - DNA, 25 bp, Mus musculus
aatagcaacaggtggcgacatcaac

SEQ ID NO: 73555 - DNA, 25 bp, Mus musculus
aatagcaacccacgctgaactgcag

SEQ ID NO: 73556 - DNA, 25 bp, Mus musculus
aatagcaacccaggctgaactgcag

SEQ ID NO: 73557 - DNA, 25 bp, Mus musculus
aatagcaactaacctggcagcctcc

SEQ ID NO: 73558 - DNA, 25 bp, Mus musculus
aatagcaactaagctggcagcctcc

SEQ ID NO: 73559 - DNA, 25 bp, Mus musculus
aatagcaagccactaccatcttagc

SEQ ID NO: 73560 - DNA, 25 bp, Mus musculus
aatagcaagccagtaccatcttagc

SEQ ID NO: 73561 - DNA, 25 bp, Mus musculus
aatagcaaggccatcagtcaagata

SEQ ID NO: 73562 - DNA, 25 bp, Mus musculus
aatagcaaggccttcagtcaagata

SEQ ID NO: 73563 - DNA, 25 bp, Mus musculus
aatagcaaggctctaaccacacagc

SEQ ID NO: 73564 - DNA, 25 bp, Mus musculus
aatagcaaggctgtaaccacacagc

SEQ ID NO: 73565 - DNA, 25 bp, Mus musculus
aatagcaatctccaggatgcctagg

SEQ ID NO: 73566 - DNA, 25 bp, Mus musculus
aatagcaatctcgaggatgcctagg

SEQ ID NO: 73567 - DNA, 25 bp, Mus musculus
aatagcaatctgcttgggccagact

SEQ ID NO: 73568 - DNA, 25 bp, Mus musculus
aatagcaatctggttgggccagact

SEQ ID NO: 73569 - DNA, 25 bp, Mus musculus
aatagcaccattctgatgtgtattt

SEQ ID NO: 73570 - DNA, 25 bp, Mus musculus
aatagcaccattgtgatgtgtattt

SEQ ID NO: 73571 - DNA, 25 bp, Mus musculus
aatagcacccttcaagcactttaac

SEQ ID NO: 73572 - DNA, 25 bp, Mus musculus
aatagcacccttgaagcactttaac

SEQ ID NO: 73573 - DNA, 25 bp, Mus musculus
aatagcacctacaccttagcttttc

SEQ ID NO: 73574 - DNA, 25 bp, Mus musculus
aatagcacctactccttagcttttc

SEQ ID NO: 73575 - DNA, 25 bp, Mus musculus
aatagcacgggaattgtctcacagg

SEQ ID NO: 73576 - DNA, 25 bp, Mus musculus
aatagcacgggatttgtctcacagg

SEQ ID NO: 73577 - DNA, 25 bp, Mus musculus
aatagcacgtgccaagtcttcatct

SEQ ID NO: 73578 - DNA, 25 bp, Mus musculus
aatagcacgtgcgaagtcttcatct

SEQ ID NO: 73579 - DNA, 25 bp, Mus musculus
aatagcactcgaaattttgcttcat

SEQ ID NO: 73580 - DNA, 25 bp, Mus musculus
aatagcactcgatattttgcttcat

SEQ ID NO: 73581 - DNA, 25 bp, Mus musculus
aatagcactgaactgtcactcctgg

SEQ ID NO: 73582 - DNA, 25 bp, Mus musculus
aatagcactgaagtgtcactcctgg

SEQ ID NO: 73583 - DNA, 25 bp, Mus musculus
aatagcactgtcctggacctcaggc

SEQ ID NO: 73584 - DNA, 25 bp, Mus musculus
aatagcactgtcgtggacctcaggc

SEQ ID NO: 73585 - DNA, 25 bp, Mus musculus
aatagcacttccagtacctctgtat

SEQ ID NO: 73586 - DNA, 25 bp, Mus musculus
aatagcacttccatgttatcttcgg

SEQ ID NO: 73587 - DNA, 25 bp, Mus musculus
aatagcacttcctgtacctctgtat

SEQ ID NO: 73588 - DNA, 25 bp, Mus musculus
aatagcacttccttgttatcttcgg

SEQ ID NO: 73589 - DNA, 25 bp, Mus musculus
aatagcacttgccacagagcctgat

SEQ ID NO: 73590 - DNA, 25 bp, Mus musculus
aatagcacttgcgacagagcctgat

SEQ ID NO: 73591 - DNA, 25 bp, Mus musculus
aatagcagaatgcagcttgtaaaga

SEQ ID NO: 73592 - DNA, 25 bp, Mus musculus
aatagcagaatggagcttgtaaaga

SEQ ID NO: 73593 - DNA, 25 bp, Mus musculus
aatagcagacttcaacagacaggca

SEQ ID NO: 73594 - DNA, 25 bp, Mus musculus
aatagcagacttgaacagacaggca

SEQ ID NO: 73595 - DNA, 25 bp, Mus musculus
aatagcagcaagatttgtcctctct

SEQ ID NO: 73596 - DNA, 25 bp, Mus musculus
aatagcagcaagttttgtcctctct

SEQ ID NO: 73597 - DNA, 25 bp, Mus musculus
aatagcagcaatcttggctttttgt

SEQ ID NO: 73598 - DNA, 25 bp, Mus musculus
aatagcagcaatgttggctttttgt

SEQ ID NO: 73599 - DNA, 25 bp, Mus musculus
aatagcagcatcaaatctcccaggg

SEQ ID NO: 73600 - DNA, 25 bp, Mus musculus
aatagcagcatctaatctcccaggg

SEQ ID NO: 73601 - DNA, 25 bp, Mus musculus
aatagcagcgcgagtagcagcccga

SEQ ID NO: 73602 - DNA, 25 bp, Mus musculus
aatagcagcgcgtgtagcagcccga

SEQ ID NO: 73603 - DNA, 25 bp, Mus musculus
aatagcagctgcacagtagcagctt

SEQ ID NO: 73604 - DNA, 25 bp, Mus musculus
aatagcagctgctcagtagcagctt

SEQ ID NO: 73605 - DNA, 25 bp, Mus musculus
aatagcaggtttatatatcctgctt

SEQ ID NO: 73606 - DNA, 25 bp, Mus musculus
aatagcaggtttttatatcctgctt

SEQ ID NO: 73607 - DNA, 25 bp, Mus musculus
aatagcagtatcatttcactttcag

SEQ ID NO: 73608 - DNA, 25 bp, Mus musculus
aatagcagtatcttttcactttcag

SEQ ID NO: 73609 - DNA, 25 bp, Mus musculus
aatagcagtatgcagatttgtcact

SEQ ID NO: 73610 - DNA, 25 bp, Mus musculus
aatagcagtatggagatttgtcact

SEQ ID NO: 73611 - DNA, 25 bp, Mus musculus
aatagcagtcctattaagcacaact

SEQ ID NO: 73612 - DNA, 25 bp, Mus musculus
aatagcagtccttttaagcacaact

SEQ ID NO: 73613 - DNA, 25 bp, Mus musculus
aatagcagtgaacatcagggtgttc

SEQ ID NO: 73614 - DNA, 25 bp, Mus musculus
aatagcagtgaagatcagggtgttc

SEQ ID NO: 73615 - DNA, 25 bp, Mus musculus
aatagcagtgaccttcttgaccaca

SEQ ID NO: 73616 - DNA, 25 bp, Mus musculus
aatagcagtgacgttcttgaccaca

SEQ ID NO: 73617 - DNA, 25 bp, Mus musculus
aatagcagtgtgaccgttgacaact

SEQ ID NO: 73618 - DNA, 25 bp, Mus musculus
aatagcagtgtgtccgttgacaact

SEQ ID NO: 73619 - DNA, 25 bp, Mus musculus
aatagcagtttgatgtccctgtgtc

SEQ ID NO: 73620 - DNA, 25 bp, Mus musculus
aatagcagtttgttgtccctgtgtc

SEQ ID NO: 73621 - DNA, 25 bp, Mus musculus
aatagcataactacagaaggtatgt

SEQ ID NO: 73622 - DNA, 25 bp, Mus musculus
aatagcataacttcagaaggtatgt

SEQ ID NO: 73623 - DNA, 25 bp, Mus musculus
aatagcatcagtaaccgacatccca

SEQ ID NO: 73624 - DNA, 25 bp, Mus musculus
aatagcatcagttaccgacatccca

SEQ ID NO: 73625 - DNA, 25 bp, Mus musculus
aatagcatcattaccagttagcagg

SEQ ID NO: 73626 - DNA, 25 bp, Mus musculus
aatagcatcattctgctgttggagt

SEQ ID NO: 73627 - DNA, 25 bp, Mus musculus
aatagcatcattgtgctgttggagt

SEQ ID NO: 73628 - DNA, 25 bp, Mus musculus
aatagcatcatttccagttagcagg

SEQ ID NO: 73629 - DNA, 25 bp, Mus musculus
aatagcatcccacaggaccaaggaa

SEQ ID NO: 73630 - DNA, 25 bp, Mus musculus
aatagcatcccagaggaccaaggaa

SEQ ID NO: 73631 - DNA, 25 bp, Mus musculus
aatagcatcctcctcgaactcaaag

SEQ ID NO: 73632 - DNA, 25 bp, Mus musculus
aatagcatcctcgtcgaactcaaag

SEQ ID NO: 73633 - DNA, 25 bp, Mus musculus
aatagcatcctgagatgcccgtgga

SEQ ID NO: 73634 - DNA, 25 bp, Mus musculus
aatagcatcctgtgatgcccgtgga

SEQ ID NO: 73635 - DNA, 25 bp, Mus musculus
aatagcatctcaaaccagcttctct

SEQ ID NO: 73636 - DNA, 25 bp, Mus musculus
aatagcatctcaagttctttagaac

SEQ ID NO: 73637 - DNA, 25 bp, Mus musculus
aatagcatctcataccagcttctct

SEQ ID NO: 73638 - DNA, 25 bp, Mus musculus
aatagcatctcatgttctttagaac

SEQ ID NO: 73639 - DNA, 25 bp, Mus musculus
aatagcatgattcacacctcggaat

SEQ ID NO: 73640 - DNA, 25 bp, Mus musculus
aatagcatgattgacacctcggaat

SEQ ID NO: 73641 - DNA, 25 bp, Mus musculus
aatagcatgggcacctttctgcttc

SEQ ID NO: 73642 - DNA, 25 bp, Mus musculus
aatagcatgggctcctttctgcttc

SEQ ID NO: 73643 - DNA, 25 bp, Mus musculus
aatagcatgtatcggttatgttcaa

SEQ ID NO: 73644 - DNA, 25 bp, Mus musculus
aatagcatgtatgggttatgttcaa

SEQ ID NO: 73645 - DNA, 25 bp, Mus musculus
aatagcatgttcactaacacccttc

SEQ ID NO: 73646 - DNA, 25 bp, Mus musculus
aatagcatgttctctaacacccttc

SEQ ID NO: 73647 - DNA, 25 bp, Mus musculus
aatagcattcagaagatccttaaga

SEQ ID NO: 73648 - DNA, 25 bp, Mus musculus
aatagcattcagtagatccttaaga

SEQ ID NO: 73649 - DNA, 25 bp, Mus musculus
aatagccaacatatgtacaggacta

SEQ ID NO: 73650 - DNA, 25 bp, Mus musculus
aatagccaacatttgtacaggacta

SEQ ID NO: 73651 - DNA, 25 bp, Mus musculus
aatagccaaggcctgagtgaagtct

SEQ ID NO: 73652 - DNA, 25 bp, Mus musculus
aatagccaaggcgtgagtgaagtct

SEQ ID NO: 73653 - DNA, 25 bp, Mus musculus
aatagccacaaacttgcaactctcc

SEQ ID NO: 73654 - DNA, 25 bp, Mus musculus
aatagccacaaagttgcaactctcc

SEQ ID NO: 73655 - DNA, 25 bp, Mus musculus
aatagccacaagcatcgccattaat

SEQ ID NO: 73656 - DNA, 25 bp, Mus musculus
aatagccacaaggatcgccattaat

SEQ ID NO: 73657 - DNA, 25 bp, Mus musculus
aatagccacagaccgagatcttgtt

SEQ ID NO: 73658 - DNA, 25 bp, Mus musculus
aatagccacagagcgagatcttgtt

SEQ ID NO: 73659 - DNA, 25 bp, Mus musculus
aatagccacattaaatcaccaattt

SEQ ID NO: 73660 - DNA, 25 bp, Mus musculus
aatagccacatttaatcaccaattt

SEQ ID NO: 73661 - DNA, 25 bp, Mus musculus
aatagccacgccaatattcaaccag

SEQ ID NO: 73662 - DNA, 25 bp, Mus musculus
aatagccacgcctatattcaaccag

SEQ ID NO: 73663 - DNA, 25 bp, Mus musculus
aatagccacttacacactttacctc

SEQ ID NO: 73664 - DNA, 25 bp, Mus musculus
aatagccacttagacactttacctc

SEQ ID NO: 73665 - DNA, 25 bp, Mus musculus
aatagccagagtcttcagctcacag

SEQ ID NO: 73666 - DNA, 25 bp, Mus musculus
aatagccagagtgttcagctcacag

SEQ ID NO: 73667 - DNA, 25 bp, Mus musculus
aatagccagctcaccataatacact

SEQ ID NO: 73668 - DNA, 25 bp, Mus musculus
aatagccagctctccataatacact

SEQ ID NO: 73669 - DNA, 25 bp, Mus musculus
aatagccaggcgaagatcttgaccc

SEQ ID NO: 73670 - DNA, 25 bp, Mus musculus
aatagccaggcgtagatcttgaccc

SEQ ID NO: 73671 - DNA, 25 bp, Mus musculus
aatagccatcatatacatcatccct

SEQ ID NO: 73672 - DNA, 25 bp, Mus musculus
aatagccatcatttacatcatccct

SEQ ID NO: 73673 - DNA, 25 bp, Mus musculus
aatagccatgagcaaccaaagacag

SEQ ID NO: 73674 - DNA, 25 bp, Mus musculus
aatagccatgaggaaccaaagacag

SEQ ID NO: 73675 - DNA, 25 bp, Mus musculus
aatagccatggcacagaccttcgtc

SEQ ID NO: 73676 - DNA, 25 bp, Mus musculus
aatagccatggctcagaccttcgtc

SEQ ID NO: 73677 - DNA, 25 bp, Mus musculus
aatagcccaaacactttgttactag

SEQ ID NO: 73678 - DNA, 25 bp, Mus musculus
aatagcccaaactctttgttactag

SEQ ID NO: 73679 - DNA, 25 bp, Mus musculus
aatagcccacgtatgtggtctcagt

SEQ ID NO: 73680 - DNA, 25 bp, Mus musculus
aatagcccacgtttgtggtctcagt

SEQ ID NO: 73681 - DNA, 25 bp, Mus musculus
aatagcccaggaaatgcattaactc

SEQ ID NO: 73682 - DNA, 25 bp, Mus musculus
aatagcccaggatatgcattaactc

SEQ ID NO: 73683 - DNA, 25 bp, Mus musculus
aatagcccaggcctacagactgtag

SEQ ID NO: 73684 - DNA, 25 bp, Mus musculus
aatagcccaggcgtacagactgtag

SEQ ID NO: 73685 - DNA, 25 bp, Mus musculus
aatagcccagggaggaacctataat

SEQ ID NO: 73686 - DNA, 25 bp, Mus musculus
aatagcccagggtggaacctataat

SEQ ID NO: 73687 - DNA, 25 bp, Mus musculus
aatagcccatgtcttacctgtctgt

SEQ ID NO: 73688 - DNA, 25 bp, Mus musculus
aatagcccatgtgttacctgtctgt

SEQ ID NO: 73689 - DNA, 25 bp, Mus musculus
aatagcccattcacaatgccttagc

SEQ ID NO: 73690 - DNA, 25 bp, Mus musculus
aatagcccattcacagggtggccca

SEQ ID NO: 73691 - DNA, 25 bp, Mus musculus
aatagcccattctcaatgccttagc

SEQ ID NO: 73692 - DNA, 25 bp, Mus musculus
aatagcccattctcagggtggccca

SEQ ID NO: 73693 - DNA, 25 bp, Mus musculus
aatagcccctggctcttccagacag

SEQ ID NO: 73694 - DNA, 25 bp, Mus musculus
aatagcccctgggtcttccagacag

SEQ ID NO: 73695 - DNA, 25 bp, Mus musculus
aatagccctatgcagttacttagta

SEQ ID NO: 73696 - DNA, 25 bp, Mus musculus
aatagccctatggagttacttagta

SEQ ID NO: 73697 - DNA, 25 bp, Mus musculus
aatagccctgcaccccatgtggaga

SEQ ID NO: 73698 - DNA, 25 bp, Mus musculus
aatagccctgcagcccatgtggaga

SEQ ID NO: 73699 - DNA, 25 bp, Mus musculus
aatagccctggaacaacacatgagt

SEQ ID NO: 73700 - DNA, 25 bp, Mus musculus
aatagccctggatcaacacatgagt

SEQ ID NO: 73701 - DNA, 25 bp, Mus musculus
aatagccctgtgatggaattctgcc

SEQ ID NO: 73702 - DNA, 25 bp, Mus musculus
aatagccctgtgttggaattctgcc

SEQ ID NO: 73703 - DNA, 25 bp, Mus musculus
aatagccctttccatgagcgatttc

SEQ ID NO: 73704 - DNA, 25 bp, Mus musculus
aatagccctttcgatgagcgatttc

SEQ ID NO: 73705 - DNA, 25 bp, Mus musculus
aatagccgtcttctgtactgccttc

SEQ ID NO: 73706 - DNA, 25 bp, Mus musculus
aatagccgtcttgtgtactgccttc

SEQ ID NO: 73707 - DNA, 25 bp, Mus musculus
aatagcctacttcgcctggcagtgg

SEQ ID NO: 73708 - DNA, 25 bp, Mus musculus
aatagcctacttggcctggcagtgg

SEQ ID NO: 73709 - DNA, 25 bp, Mus musculus
aatagcctagccactgagctgtaga

SEQ ID NO: 73710 - DNA, 25 bp, Mus musculus
aatagcctagcccagcatgttcgga

SEQ ID NO: 73711 - DNA, 25 bp, Mus musculus
aatagcctagccgagcatgttcgga

SEQ ID NO: 73712 - DNA, 25 bp, Mus musculus
aatagcctagcctctgagctgtaga

SEQ ID NO: 73713 - DNA, 25 bp, Mus musculus
aatagcctcaacctgcatgtggtag

SEQ ID NO: 73714 - DNA, 25 bp, Mus musculus
aatagcctcaacgtgcatgtggtag

SEQ ID NO: 73715 - DNA, 25 bp, Mus musculus
aatagcctcaagagaccagcacaag

SEQ ID NO: 73716 - DNA, 25 bp, Mus musculus
aatagcctcaagtgaccagcacaag

SEQ ID NO: 73717 - DNA, 25 bp, Mus musculus
aatagcctcctgcattggttttact

SEQ ID NO: 73718 - DNA, 25 bp, Mus musculus
aatagcctcctggattggttttact

SEQ ID NO: 73719 - DNA, 25 bp, Mus musculus
aatagcctcgatatgggtgggaaga

SEQ ID NO: 73720 - DNA, 25 bp, Mus musculus
aatagcctcgatttgggtgggaaga

SEQ ID NO: 73721 - DNA, 25 bp, Mus musculus
aatagcctctgaatgccaccaaaga

SEQ ID NO: 73722 - DNA, 25 bp, Mus musculus
aatagcctctgattgccaccaaaga

SEQ ID NO: 73723 - DNA, 25 bp, Mus musculus
aatagcctctggacctgattgtgtg

SEQ ID NO: 73724 - DNA, 25 bp, Mus musculus
aatagcctctggtcctgattgtgtg

SEQ ID NO: 73725 - DNA, 25 bp, Mus musculus
aatagcctgatgacaggagcctgat

SEQ ID NO: 73726 - DNA, 25 bp, Mus musculus
aatagcctgatgtcaggagcctgat

SEQ ID NO: 73727 - DNA, 25 bp, Mus musculus
aatagcctgggcaatccttatagta

SEQ ID NO: 73728 - DNA, 25 bp, Mus musculus
aatagcctgggctatccttatagta

SEQ ID NO: 73729 - DNA, 25 bp, Mus musculus
aatagccttagcaatcatttcctag

SEQ ID NO: 73730 - DNA, 25 bp, Mus musculus
aatagccttagctatcatttcctag

SEQ ID NO: 73731 - DNA, 25 bp, Mus musculus
aatagccttaggacgggcttctgtt

SEQ ID NO: 73732 - DNA, 25 bp, Mus musculus
aatagccttaggtcgggcttctgtt

SEQ ID NO: 73733 - DNA, 25 bp, Mus musculus
aatagccttcttatctgcattacaa

SEQ ID NO: 73734 - DNA, 25 bp, Mus musculus
aatagccttcttttctgcattacaa

SEQ ID NO: 73735 - DNA, 25 bp, Mus musculus
aatagccttggacgtatcggttcag

SEQ ID NO: 73736 - DNA, 25 bp, Mus musculus
aatagccttggaggtatcggttcag

SEQ ID NO: 73737 - DNA, 25 bp, Mus musculus
aatagcgcagctagctcgacagtat

SEQ ID NO: 73738 - DNA, 25 bp, Mus musculus
aatagcgcagcttgctcgacagtat

SEQ ID NO: 73739 - DNA, 25 bp, Mus musculus
aatagcgggcagcaggccaccaaga

SEQ ID NO: 73740 - DNA, 25 bp, Mus musculus
aatagcgggcaggaggccaccaaga

SEQ ID NO: 73741 - DNA, 25 bp, Mus musculus
aatagcgtatacagtacccagcgcc

SEQ ID NO: 73742 - DNA, 25 bp, Mus musculus
aatagcgtatactgtacccagcgcc

SEQ ID NO: 73743 - DNA, 25 bp, Mus musculus
aatagcgtcaccattctttgctgtg

SEQ ID NO: 73744 - DNA, 25 bp, Mus musculus
aatagcgtcacctttctttgctgtg

SEQ ID NO: 73745 - DNA, 25 bp, Mus musculus
aatagcgtgcgaccatctgatagat

SEQ ID NO: 73746 - DNA, 25 bp, Mus musculus
aatagcgtgcgagcatctgatagat

SEQ ID NO: 73747 - DNA, 25 bp, Mus musculus
aatagcgtgtgaaatcttgaggaag

SEQ ID NO: 73748 - DNA, 25 bp, Mus musculus
aatagcgtgtgatatcttgaggaag

SEQ ID NO: 73749 - DNA, 25 bp, Mus musculus
aatagctaaattctccttcctgagg

SEQ ID NO: 73750 - DNA, 25 bp, Mus musculus
aatagctaaattgtccttcctgagg

SEQ ID NO: 73751 - DNA, 25 bp, Mus musculus
aatagctaacatacactggtccctt

SEQ ID NO: 73752 - DNA, 25 bp, Mus musculus
aatagctaacattcactggtccctt

SEQ ID NO: 73753 - DNA, 25 bp, Mus musculus
aatagctaacccaattcccagaaag

SEQ ID NO: 73754 - DNA, 25 bp, Mus musculus
aatagctaaccctattcccagaaag

SEQ ID NO: 73755 - DNA, 25 bp, Mus musculus
aatagctacaaaattatgtgagtcc

SEQ ID NO: 73756 - DNA, 25 bp, Mus musculus
aatagctacaaatttatgtgagtcc

SEQ ID NO: 73757 - DNA, 25 bp, Mus musculus
aatagctacagaccctgttgacatt

SEQ ID NO: 73758 - DNA, 25 bp, Mus musculus
aatagctacagagcctgttgacatt

SEQ ID NO: 73759 - DNA, 25 bp, Mus musculus
aatagctacaggacccttcctctgt

SEQ ID NO: 73760 - DNA, 25 bp, Mus musculus
aatagctacaggtcccttcctctgt

SEQ ID NO: 73761 - DNA, 25 bp, Mus musculus
aatagctaccatattctttctgtcc

SEQ ID NO: 73762 - DNA, 25 bp, Mus musculus
aatagctaccattttctttctgtcc

SEQ ID NO: 73763 - DNA, 25 bp, Mus musculus
aatagctacgttatttatgtatgta

SEQ ID NO: 73764 - DNA, 25 bp, Mus musculus
aatagctacgttttttatgtatgta

SEQ ID NO: 73765 - DNA, 25 bp, Mus musculus
aatagctagttcatgtacacacaca

SEQ ID NO: 73766 - DNA, 25 bp, Mus musculus
aatagctagttcttgtacacacaca

SEQ ID NO: 73767 - DNA, 25 bp, Mus musculus
aatagctagtttcagatttcatctc

SEQ ID NO: 73768 - DNA, 25 bp, Mus musculus
aatagctagtttgagatttcatctc

SEQ ID NO: 73769 - DNA, 25 bp, Mus musculus
aatagctatgacacggtgtgcacct

SEQ ID NO: 73770 - DNA, 25 bp, Mus musculus
aatagctatgactcggtgtgcacct

SEQ ID NO: 73771 - DNA, 25 bp, Mus musculus
aatagctcaaacacattttgctgat

SEQ ID NO: 73772 - DNA, 25 bp, Mus musculus
aatagctcaaactcattttgctgat

SEQ ID NO: 73773 - DNA, 25 bp, Mus musculus
aatagctccactagttgtccaacag

SEQ ID NO: 73774 - DNA, 25 bp, Mus musculus
aatagctccacttgttgtccaacag

SEQ ID NO: 73775 - DNA, 25 bp, Mus musculus
aatagctccattcaggaagcttcag

SEQ ID NO: 73776 - DNA, 25 bp, Mus musculus
aatagctccattgaggaagcttcag

SEQ ID NO: 73777 - DNA, 25 bp, Mus musculus
aatagctccggtacagatacagctt

SEQ ID NO: 73778 - DNA, 25 bp, Mus musculus
aatagctccggttcagatacagctt

SEQ ID NO: 73779 - DNA, 25 bp, Mus musculus
aatagctcggaacccaacaggcggt

SEQ ID NO: 73780 - DNA, 25 bp, Mus musculus
aatagctcggaagccaacaggcggt

SEQ ID NO: 73781 - DNA, 25 bp, Mus musculus
aatagctcggagagtaaccctctgt

SEQ ID NO: 73782 - DNA, 25 bp, Mus musculus
aatagctcggagtgtaaccctctgt

SEQ ID NO: 73783 - DNA, 25 bp, Mus musculus
aatagctctaatactttaaccttgg

SEQ ID NO: 73784 - DNA, 25 bp, Mus musculus
aatagctctaattctttaaccttgg

SEQ ID NO: 73785 - DNA, 25 bp, Mus musculus
aatagctctgatatttgctgctgct

SEQ ID NO: 73786 - DNA, 25 bp, Mus musculus
aatagctctgatttttgctgctgct

SEQ ID NO: 73787 - DNA, 25 bp, Mus musculus
aatagctctgcacaagtctcggtaa

SEQ ID NO: 73788 - DNA, 25 bp, Mus musculus
aatagctctgcagaagtctcggtaa

SEQ ID NO: 73789 - DNA, 25 bp, Mus musculus
aatagctgacccagttggtctgcgc

SEQ ID NO: 73790 - DNA, 25 bp, Mus musculus
aatagctgaccctgttggtctgcgc

SEQ ID NO: 73791 - DNA, 25 bp, Mus musculus
aatagctgactgactagcctcaaca

SEQ ID NO: 73792 - DNA, 25 bp, Mus musculus
aatagctgactgtctagcctcaaca

SEQ ID NO: 73793 - DNA, 25 bp, Mus musculus
aatagctgaggcatggtttcaacat

SEQ ID NO: 73794 - DNA, 25 bp, Mus musculus
aatagctgaggcttggtttcaacat

SEQ ID NO: 73795 - DNA, 25 bp, Mus musculus
aatagctgatcaatcttccatgttt

SEQ ID NO: 73796 - DNA, 25 bp, Mus musculus
aatagctgatcattcttccatgttt

SEQ ID NO: 73797 - DNA, 25 bp, Mus musculus
aatagctgcaagatacccggtgctt

SEQ ID NO: 73798 - DNA, 25 bp, Mus musculus
aatagctgcaagttacccggtgctt

SEQ ID NO: 73799 - DNA, 25 bp, Mus musculus
aatagctgcacacaagccttgtggc

SEQ ID NO: 73800 - DNA, 25 bp, Mus musculus
aatagctgcacagaagccttgtggc

SEQ ID NO: 73801 - DNA, 25 bp, Mus musculus
aatagctgcatacgcagagccctgt

SEQ ID NO: 73802 - DNA, 25 bp, Mus musculus
aatagctgcataggcagagccctgt

SEQ ID NO: 73803 - DNA, 25 bp, Mus musculus
aatagctgccataatgtctcataga

SEQ ID NO: 73804 - DNA, 25 bp, Mus musculus
aatagctgccattatgtctcataga

SEQ ID NO: 73805 - DNA, 25 bp, Mus musculus
aatagctgcccgatggtgaaattca

SEQ ID NO: 73806 - DNA, 25 bp, Mus musculus
aatagctgcccgttggtgaaattca

SEQ ID NO: 73807 - DNA, 25 bp, Mus musculus
aatagctgcctaagtgcttatgagg

SEQ ID NO: 73808 - DNA, 25 bp, Mus musculus
aatagctgcctatgtgcttatgagg

SEQ ID NO: 73809 - DNA, 25 bp, Mus musculus
aatagctgcctccattctactgact

SEQ ID NO: 73810 - DNA, 25 bp, Mus musculus
aatagctgcctcgattctactgact

SEQ ID NO: 73811 - DNA, 25 bp, Mus musculus
aatagctgcctgctcattttcattc

SEQ ID NO: 73812 - DNA, 25 bp, Mus musculus
aatagctgcctggtcattttcattc

SEQ ID NO: 73813 - DNA, 25 bp, Mus musculus
aatagctgccttaagataggtctga

SEQ ID NO: 73814 - DNA, 25 bp, Mus musculus
aatagctgccttctagtgctgtagc

SEQ ID NO: 73815 - DNA, 25 bp, Mus musculus
aatagctgccttgtagtgctgtagc

SEQ ID NO: 73816 - DNA, 25 bp, Mus musculus
aatagctgcctttagataggtctga

SEQ ID NO: 73817 - DNA, 25 bp, Mus musculus
aatagctgctatagtgcctttttca

SEQ ID NO: 73818 - DNA, 25 bp, Mus musculus
aatagctgctattgtgcctttttca

SEQ ID NO: 73819 - DNA, 25 bp, Mus musculus
aatagctgctccagtgccaacaatc

SEQ ID NO: 73820 - DNA, 25 bp, Mus musculus
aatagctgctcctgtgccaacaatc

SEQ ID NO: 73821 - DNA, 25 bp, Mus musculus
aatagctgcttactcagtagattga

SEQ ID NO: 73822 - DNA, 25 bp, Mus musculus
aatagctgcttagtcagtagattga

SEQ ID NO: 73823 - DNA, 25 bp, Mus musculus
aatagctgcttcctgaattcatcta

SEQ ID NO: 73824 - DNA, 25 bp, Mus musculus
aatagctgcttcgtgaattcatcta

SEQ ID NO: 73825 - DNA, 25 bp, Mus musculus
aatagctggctcattcttgtgaatt

SEQ ID NO: 73826 - DNA, 25 bp, Mus musculus
aatagctggctctttcttgtgaatt

SEQ ID NO: 73827 - DNA, 25 bp, Mus musculus
aatagctggtaaacaccatctcgcc

SEQ ID NO: 73828 - DNA, 25 bp, Mus musculus
aatagctggtaatcaccatctcgcc

SEQ ID NO: 73829 - DNA, 25 bp, Mus musculus
aatagctggtcactgtgttagatat

SEQ ID NO: 73830 - DNA, 25 bp, Mus musculus
aatagctggtcagtgtgttagatat

SEQ ID NO: 73831 - DNA, 25 bp, Mus musculus
aatagctgtatgctttccactatac

SEQ ID NO: 73832 - DNA, 25 bp, Mus musculus
aatagctgtatggtttccactatac

SEQ ID NO: 73833 - DNA, 25 bp, Mus musculus
aatagcttagtcctgggaacctgac

SEQ ID NO: 73834 - DNA, 25 bp, Mus musculus
aatagcttagtcgtgggaacctgac

SEQ ID NO: 73835 - DNA, 25 bp, Mus musculus
aatagcttagtgagttcaaatcccc

SEQ ID NO: 73836 - DNA, 25 bp, Mus musculus
aatagcttagtgatagtgttcctgt

SEQ ID NO: 73837 - DNA, 25 bp, Mus musculus
aatagcttagtgtgttcaaatcccc

SEQ ID NO: 73838 - DNA, 25 bp, Mus musculus
aatagcttagtgttagtgttcctgt

SEQ ID NO: 73839 - DNA, 25 bp, Mus musculus
aatagcttccagctcttcgtgggca

SEQ ID NO: 73840 - DNA, 25 bp, Mus musculus
aatagcttccaggtcttcgtgggca

SEQ ID NO: 73841 - DNA, 25 bp, Mus musculus
aatagcttcctgataatctaccctc

SEQ ID NO: 73842 - DNA, 25 bp, Mus musculus
aatagcttcctgatttagatggctg

SEQ ID NO: 73843 - DNA, 25 bp, Mus musculus
aatagcttcctgttaatctaccctc

SEQ ID NO: 73844 - DNA, 25 bp, Mus musculus
aatagcttcctgttttagatggctg

SEQ ID NO: 73845 - DNA, 25 bp, Mus musculus
aatagcttcgggagtctatggcccc

SEQ ID NO: 73846 - DNA, 25 bp, Mus musculus
aatagcttcgggtgtctatggcccc

SEQ ID NO: 73847 - DNA, 25 bp, Mus musculus
aatagcttctatagatgagttttat

SEQ ID NO: 73848 - DNA, 25 bp, Mus musculus
aatagcttctattgatgagttttat

SEQ ID NO: 73849 - DNA, 25 bp, Mus musculus
aatagcttggctcaaaactttggta

SEQ ID NO: 73850 - DNA, 25 bp, Mus musculus
aatagcttggctgaaaactttggta

SEQ ID NO: 73851 - DNA, 25 bp, Mus musculus
aatagcttggtccttggttggttgc

SEQ ID NO: 73852 - DNA, 25 bp, Mus musculus
aatagcttggtcgttggttggttgc

SEQ ID NO: 73853 - DNA, 25 bp, Mus musculus
aatagctttatgctcttcacagagt

SEQ ID NO: 73854 - DNA, 25 bp, Mus musculus
aatagctttatggtcttcacagagt

SEQ ID NO: 73855 - DNA, 25 bp, Mus musculus
aatagctttcatactggcattttca

SEQ ID NO: 73856 - DNA, 25 bp, Mus musculus
aatagctttcattctggcattttca

SEQ ID NO: 73857 - DNA, 25 bp, Mus musculus
aatagctttcgtctggtctgatgaa

SEQ ID NO: 73858 - DNA, 25 bp, Mus musculus
aatagctttcgtgtggtctgatgaa

SEQ ID NO: 73859 - DNA, 25 bp, Mus musculus
aatagctttgatagcacaactaaag

SEQ ID NO: 73860 - DNA, 25 bp, Mus musculus
aatagctttgatcggacattctttt

SEQ ID NO: 73861 - DNA, 25 bp, Mus musculus
aatagctttgatgggacattctttt

SEQ ID NO: 73862 - DNA, 25 bp, Mus musculus
aatagctttgattgcacaactaaag

SEQ ID NO: 73863 - DNA, 25 bp, Mus musculus
aatagcttttctaatgtgattcatc

SEQ ID NO: 73864 - DNA, 25 bp, Mus musculus
aatagcttttctcaggctaggctgt

SEQ ID NO: 73865 - DNA, 25 bp, Mus musculus
aatagcttttctgaggctaggctgt

SEQ ID NO: 73866 - DNA, 25 bp, Mus musculus
aatagcttttcttatgtgattcatc

SEQ ID NO: 73867 - DNA, 25 bp, Mus musculus
aataggaagtgaagccacgggcgcc

SEQ ID NO: 73868 - DNA, 25 bp, Mus musculus
aataggaagtgatgccacgggcgcc

SEQ ID NO: 73869 - DNA, 25 bp, Mus musculus
aataggaattggcttcggcctccgc

SEQ ID NO: 73870 - DNA, 25 bp, Mus musculus
aataggaattgggttcggcctccgc

SEQ ID NO: 73871 - DNA, 25 bp, Mus musculus
aataggaattttcacccctgtgctt

SEQ ID NO: 73872 - DNA, 25 bp, Mus musculus
aataggaattttgacccctgtgctt

SEQ ID NO: 73873 - DNA, 25 bp, Mus musculus
aataggacaataaagctgcggtttc

SEQ ID NO: 73874 - DNA, 25 bp, Mus musculus
aataggacaatatagctgcggtttc

SEQ ID NO: 73875 - DNA, 25 bp, Mus musculus
aataggaccagcacttcgaacacag

SEQ ID NO: 73876 - DNA, 25 bp, Mus musculus
aataggaccagctcttcgaacacag

SEQ ID NO: 73877 - DNA, 25 bp, Mus musculus
aataggacccgcctgctagacgtgc

SEQ ID NO: 73878 - DNA, 25 bp, Mus musculus
aataggacccgcgtgctagacgtgc

SEQ ID NO: 73879 - DNA, 25 bp, Mus musculus
aataggacctacaacgctgtgtgaa

SEQ ID NO: 73880 - DNA, 25 bp, Mus musculus
aataggacctactacgctgtgtgaa

SEQ ID NO: 73881 - DNA, 25 bp, Mus musculus
aataggacctttcatgcctcctttt

SEQ ID NO: 73882 - DNA, 25 bp, Mus musculus
aataggacctttgatgcctcctttt

SEQ ID NO: 73883 - DNA, 25 bp, Mus musculus
aataggacgcctcccataatctttg

SEQ ID NO: 73884 - DNA, 25 bp, Mus musculus
aataggacgcctgccataatctttg

SEQ ID NO: 73885 - DNA, 25 bp, Mus musculus
aataggactctgatgggagatgtac

SEQ ID NO: 73886 - DNA, 25 bp, Mus musculus
aataggactctgttgggagatgtac

SEQ ID NO: 73887 - DNA, 25 bp, Mus musculus
aataggactgcacttaattggacgt

SEQ ID NO: 73888 - DNA, 25 bp, Mus musculus
aataggactgcagttaattggacgt

SEQ ID NO: 73889 - DNA, 25 bp, Mus musculus
aataggagacttaccccgtcttcat

SEQ ID NO: 73890 - DNA, 25 bp, Mus musculus
aataggagactttccccgtcttcat

SEQ ID NO: 73891 - DNA, 25 bp, Mus musculus
aataggagcaacacatggacaatgg

SEQ ID NO: 73892 - DNA, 25 bp, Mus musculus
aataggagcaactcatggacaatgg

SEQ ID NO: 73893 - DNA, 25 bp, Mus musculus
aataggagccgcctttcactgtgtt

SEQ ID NO: 73894 - DNA, 25 bp, Mus musculus
aataggagccgcgtttcactgtgtt

SEQ ID NO: 73895 - DNA, 25 bp, Mus musculus
aataggagccttcatctcaggagga

SEQ ID NO: 73896 - DNA, 25 bp, Mus musculus
aataggagccttgatctcaggagga

SEQ ID NO: 73897 - DNA, 25 bp, Mus musculus
aataggaggactagtcttctgagac

SEQ ID NO: 73898 - DNA, 25 bp, Mus musculus
aataggaggacttgtcttctgagac

SEQ ID NO: 73899 - DNA, 25 bp, Mus musculus
aataggaggagaccccgccgcagcc

SEQ ID NO: 73900 - DNA, 25 bp, Mus musculus
aataggaggagagcccgccgcagcc

SEQ ID NO: 73901 - DNA, 25 bp, Mus musculus
aataggaggcgtcacttctcaccat

SEQ ID NO: 73902 - DNA, 25 bp, Mus musculus
aataggaggcgtgacttctcaccat

SEQ ID NO: 73903 - DNA, 25 bp, Mus musculus
aataggaggtcaccggccgtgaact

SEQ ID NO: 73904 - DNA, 25 bp, Mus musculus
aataggaggtcagcggccgtgaact

SEQ ID NO: 73905 - DNA, 25 bp, Mus musculus
aataggaggtgcctctgatgcctct

SEQ ID NO: 73906 - DNA, 25 bp, Mus musculus
aataggaggtgcgtctgatgcctct

SEQ ID NO: 73907 - DNA, 25 bp, Mus musculus
aataggatacttcagtaccggcggt

SEQ ID NO: 73908 - DNA, 25 bp, Mus musculus
aataggatacttgagtaccggcggt

SEQ ID NO: 73909 - DNA, 25 bp, Mus musculus
aataggatccagcagggtcctcagc

SEQ ID NO: 73910 - DNA, 25 bp, Mus musculus
aataggatccaggagggtcctcagc

SEQ ID NO: 73911 - DNA, 25 bp, Mus musculus
aataggatgccaatgctctcctcat

SEQ ID NO: 73912 - DNA, 25 bp, Mus musculus
aataggatgccattgctctcctcat

SEQ ID NO: 73913 - DNA, 25 bp, Mus musculus
aataggatgggcaacacttgctcca

SEQ ID NO: 73914 - DNA, 25 bp, Mus musculus
aataggatgggctacacttgctcca

SEQ ID NO: 73915 - DNA, 25 bp, Mus musculus
aataggatggtgagcgtggccttct

SEQ ID NO: 73916 - DNA, 25 bp, Mus musculus
aataggatggtgtgcgtggccttct

SEQ ID NO: 73917 - DNA, 25 bp, Mus musculus
aataggatgtgcaccaagcctgtgc

SEQ ID NO: 73918 - DNA, 25 bp, Mus musculus
aataggatgtgctccaagcctgtgc

SEQ ID NO: 73919 - DNA, 25 bp, Mus musculus
aataggattaatactcagctcagag

SEQ ID NO: 73920 - DNA, 25 bp, Mus musculus
aataggattaattctcagctcagag

SEQ ID NO: 73921 - DNA, 25 bp, Mus musculus
aataggattagtctgtgcgaccaac

SEQ ID NO: 73922 - DNA, 25 bp, Mus musculus
aataggattagtgtgtgcgaccaac

SEQ ID NO: 73923 - DNA, 25 bp, Mus musculus
aataggatttctatgtattacattt

SEQ ID NO: 73924 - DNA, 25 bp, Mus musculus
aataggatttctttgtattacattt

SEQ ID NO: 73925 - DNA, 25 bp, Mus musculus
aataggattttactgaggtatacca

SEQ ID NO: 73926 - DNA, 25 bp, Mus musculus
aataggattttagtgaggtatacca

SEQ ID NO: 73927 - DNA, 25 bp, Mus musculus
aataggcacctaagtatgagatata

SEQ ID NO: 73928 - DNA, 25 bp, Mus musculus
aataggcacctatgtatgagatata

SEQ ID NO: 73929 - DNA, 25 bp, Mus musculus
aataggcacctcacaaccatctcag

SEQ ID NO: 73930 - DNA, 25 bp, Mus musculus
aataggcacctctcaaccatctcag

SEQ ID NO: 73931 - DNA, 25 bp, Mus musculus
aataggcagcagcattacgacccaa

SEQ ID NO: 73932 - DNA, 25 bp, Mus musculus
aataggcagcaggattacgacccaa

SEQ ID NO: 73933 - DNA, 25 bp, Mus musculus
aataggcaggagctctcaaattagc

SEQ ID NO: 73934 - DNA, 25 bp, Mus musculus
aataggcaggaggtctcaaattagc

SEQ ID NO: 73935 - DNA, 25 bp, Mus musculus
aataggcatcttcaagtaggctcgt

SEQ ID NO: 73936 - DNA, 25 bp, Mus musculus
aataggcatcttgaagtaggctcgt

SEQ ID NO: 73937 - DNA, 25 bp, Mus musculus
aataggcctagaacaccagccttgg

SEQ ID NO: 73938 - DNA, 25 bp, Mus musculus
aataggcctagatcaccagccttgg

SEQ ID NO: 73939 - DNA, 25 bp, Mus musculus
aataggccttctatagatttatagc

SEQ ID NO: 73940 - DNA, 25 bp, Mus musculus
aataggccttctttagatttatagc

SEQ ID NO: 73941 - DNA, 25 bp, Mus musculus
aataggccttttactaggaaggcag

SEQ ID NO: 73942 - DNA, 25 bp, Mus musculus
aataggcctttttctaggaaggcag

SEQ ID NO: 73943 - DNA, 25 bp, Mus musculus
aataggcgagctatgatgtgaagat

SEQ ID NO: 73944 - DNA, 25 bp, Mus musculus
aataggcgagctttgatgtgaagat

SEQ ID NO: 73945 - DNA, 25 bp, Mus musculus
aataggctagcgatgactcagagtc

SEQ ID NO: 73946 - DNA, 25 bp, Mus musculus
aataggctagcgttgactcagagtc

SEQ ID NO: 73947 - DNA, 25 bp, Mus musculus
aataggctatctcgtctcagcaatg

SEQ ID NO: 73948 - DNA, 25 bp, Mus musculus
aataggctatctggtctcagcaatg

SEQ ID NO: 73949 - DNA, 25 bp, Mus musculus
aataggctctccaagacgtgtttcc

SEQ ID NO: 73950 - DNA, 25 bp, Mus musculus
aataggctctcctagacgtgtttcc

SEQ ID NO: 73951 - DNA, 25 bp, Mus musculus
aataggctcttgctgtttcccatat

SEQ ID NO: 73952 - DNA, 25 bp, Mus musculus
aataggctcttggtgtttcccatat

SEQ ID NO: 73953 - DNA, 25 bp, Mus musculus
aataggctgcagcatgtttggcata

SEQ ID NO: 73954 - DNA, 25 bp, Mus musculus
aataggctgcaggatgtttggcata

SEQ ID NO: 73955 - DNA, 25 bp, Mus musculus
aataggcttatgcagctcaaacctc

SEQ ID NO: 73956 - DNA, 25 bp, Mus musculus
aataggcttatggagctcaaacctc

SEQ ID NO: 73957 - DNA, 25 bp, Mus musculus
aataggcttcttctactattgaagt

SEQ ID NO: 73958 - DNA, 25 bp, Mus musculus
aataggcttcttgtactattgaagt

SEQ ID NO: 73959 - DNA, 25 bp, Mus musculus
aataggcttttccattgacaaacac

SEQ ID NO: 73960 - DNA, 25 bp, Mus musculus
aataggcttttcgattgacaaacac

SEQ ID NO: 73961 - DNA, 25 bp, Mus musculus
aataggctttttctgggctcgattc

SEQ ID NO: 73962 - DNA, 25 bp, Mus musculus
aataggctttttgtgggctcgattc

SEQ ID NO: 73963 - DNA, 25 bp, Mus musculus
aatagggaccgcacagggccccgtg

SEQ ID NO: 73964 - DNA, 25 bp, Mus musculus
aatagggaccgctcagggccccgtg

SEQ ID NO: 73965 - DNA, 25 bp, Mus musculus
aatagggagaagctgcttgcccagc

SEQ ID NO: 73966 - DNA, 25 bp, Mus musculus
aatagggagaaggtgcttgcccagc

SEQ ID NO: 73967 - DNA, 25 bp, Mus musculus
aatagggaggacacagactggtttc

SEQ ID NO: 73968 - DNA, 25 bp, Mus musculus
aatagggaggactcagactggtttc

SEQ ID NO: 73969 - DNA, 25 bp, Mus musculus
aatagggatcttagctcttcttcag

SEQ ID NO: 73970 - DNA, 25 bp, Mus musculus
aatagggatcttatggttcaccaga

SEQ ID NO: 73971 - DNA, 25 bp, Mus musculus
aatagggatctttgctcttcttcag

SEQ ID NO: 73972 - DNA, 25 bp, Mus musculus
aatagggatcttttggttcaccaga

SEQ ID NO: 73973 - DNA, 25 bp, Mus musculus
aatagggattgtatgtgtttggagt

SEQ ID NO: 73974 - DNA, 25 bp, Mus musculus
aatagggattgtttgtgtttggagt

SEQ ID NO: 73975 - DNA, 25 bp, Mus musculus
aatagggcacttcagctggcagaga

SEQ ID NO: 73976 - DNA, 25 bp, Mus musculus
aatagggcacttgagctggcagaga

SEQ ID NO: 73977 - DNA, 25 bp, Mus musculus
aatagggccaaaagttcactgtctc

SEQ ID NO: 73978 - DNA, 25 bp, Mus musculus
aatagggccaaatgttcactgtctc

SEQ ID NO: 73979 - DNA, 25 bp, Mus musculus
aatagggctgccactctgaaaagag

SEQ ID NO: 73980 - DNA, 25 bp, Mus musculus
aatagggctgcctctctgaaaagag

SEQ ID NO: 73981 - DNA, 25 bp, Mus musculus
aatagggcttttatgctctcaaaga

SEQ ID NO: 73982 - DNA, 25 bp, Mus musculus
aatagggcttttttgctctcaaaga

SEQ ID NO: 73983 - DNA, 25 bp, Mus musculus
aatagggtattcaggtgctttgtgc

SEQ ID NO: 73984 - DNA, 25 bp, Mus musculus
aatagggtattctggtgctttgtgc

SEQ ID NO: 73985 - DNA, 25 bp, Mus musculus
aatagggtcgtacagatgggcacca

SEQ ID NO: 73986 - DNA, 25 bp, Mus musculus
aatagggtcgtagagatgggcacca

SEQ ID NO: 73987 - DNA, 25 bp, Mus musculus
aatagggttgccctgtgtaacccag

SEQ ID NO: 73988 - DNA, 25 bp, Mus musculus
aatagggttgccgtgtgtaacccag

SEQ ID NO: 73989 - DNA, 25 bp, Mus musculus
aataggtaggccaggtttctagcgt

SEQ ID NO: 73990 - DNA, 25 bp, Mus musculus
aataggtaggcctggtttctagcgt

SEQ ID NO: 73991 - DNA, 25 bp, Mus musculus
aataggtcacatcaaggccagccac

SEQ ID NO: 73992 - DNA, 25 bp, Mus musculus
aataggtcacatgaaggccagccac

SEQ ID NO: 73993 - DNA, 25 bp, Mus musculus
aataggtcatctccctgcataagtg

SEQ ID NO: 73994 - DNA, 25 bp, Mus musculus
aataggtcatctgcctgcataagtg

SEQ ID NO: 73995 - DNA, 25 bp, Mus musculus
aataggtccattacatccagttggg

SEQ ID NO: 73996 - DNA, 25 bp, Mus musculus
aataggtccatttcatccagttggg

SEQ ID NO: 73997 - DNA, 25 bp, Mus musculus
aataggtctcatacatacagtgtat

SEQ ID NO: 73998 - DNA, 25 bp, Mus musculus
aataggtctcattcatacagtgtat

SEQ ID NO: 73999 - DNA, 25 bp, Mus musculus
aataggtctgcccatacatatgctc

SEQ ID NO: 74000 - DNA, 25 bp, Mus musculus
aataggtctgccgatacatatgctc

SEQ ID NO: 74001 - DNA, 25 bp, Mus musculus
aataggtctgctctctagtgtcctt

SEQ ID NO: 74002 - DNA, 25 bp, Mus musculus
aataggtctgctgtctagtgtcctt

SEQ ID NO: 74003 - DNA, 25 bp, Mus musculus
aataggtctgtgctcatttctcgtc

SEQ ID NO: 74004 - DNA, 25 bp, Mus musculus
aataggtctgtggtcatttctcgtc

SEQ ID NO: 74005 - DNA, 25 bp, Mus musculus
aataggtgaccactgtgtctataac

SEQ ID NO: 74006 - DNA, 25 bp, Mus musculus
aataggtgaccagtgtgtctataac

SEQ ID NO: 74007 - DNA, 25 bp, Mus musculus
aataggtgagatatctctccttccc

SEQ ID NO: 74008 - DNA, 25 bp, Mus musculus
aataggtgagatttctctccttccc

SEQ ID NO: 74009 - DNA, 25 bp, Mus musculus
aataggtgctatcaacaggaaatta

SEQ ID NO: 74010 - DNA, 25 bp, Mus musculus
aataggtgctatgaacaggaaatta

SEQ ID NO: 74011 - DNA, 25 bp, Mus musculus
aataggtggaatatgactgctcaga

SEQ ID NO: 74012 - DNA, 25 bp, Mus musculus
aataggtggaatttgactgctcaga

SEQ ID NO: 74013 - DNA, 25 bp, Mus musculus
aataggtggctgacataattacaac

SEQ ID NO: 74014 - DNA, 25 bp, Mus musculus
aataggtggctgtcataattacaac

SEQ ID NO: 74015 - DNA, 25 bp, Mus musculus
aataggtgggccaggacatcagctg

SEQ ID NO: 74016 - DNA, 25 bp, Mus musculus
aataggtgggcctggacatcagctg

SEQ ID NO: 74017 - DNA, 25 bp, Mus musculus
aataggtggttacccagcgcttccc

SEQ ID NO: 74018 - DNA, 25 bp, Mus musculus
aataggtggttagccagcgcttccc

SEQ ID NO: 74019 - DNA, 25 bp, Mus musculus
aataggtgtctaagacctgtgaagt

SEQ ID NO: 74020 - DNA, 25 bp, Mus musculus
aataggtgtctatgacctgtgaagt

SEQ ID NO: 74021 - DNA, 25 bp, Mus musculus
aataggttacggaggatacaagcct

SEQ ID NO: 74022 - DNA, 25 bp, Mus musculus
aataggttacggtggatacaagcct

SEQ ID NO: 74023 - DNA, 25 bp, Mus musculus
aataggttccgtataaatgagaggg

SEQ ID NO: 74024 - DNA, 25 bp, Mus musculus
aataggttccgtttaaatgagaggg

SEQ ID NO: 74025 - DNA, 25 bp, Mus musculus
aataggttctaaacacactcgctca

SEQ ID NO: 74026 - DNA, 25 bp, Mus musculus
aataggttctaatcacactcgctca

SEQ ID NO: 74027 - DNA, 25 bp, Mus musculus
aataggttgcgcagatcttagactc

SEQ ID NO: 74028 - DNA, 25 bp, Mus musculus
aataggttgcgctgatcttagactc

SEQ ID NO: 74029 - DNA, 25 bp, Mus musculus
aataggtttaacaatctctccaaga

SEQ ID NO: 74030 - DNA, 25 bp, Mus musculus
aataggtttaactatctctccaaga

SEQ ID NO: 74031 - DNA, 25 bp, Mus musculus
aataggtttcatattctgtagtctg

SEQ ID NO: 74032 - DNA, 25 bp, Mus musculus
aataggtttcattttctgtagtctg

SEQ ID NO: 74033 - DNA, 25 bp, Mus musculus
aataggtttttgatgctgtgctaca

SEQ ID NO: 74034 - DNA, 25 bp, Mus musculus
aataggtttttgttgctgtgctaca

SEQ ID NO: 74035 - DNA, 25 bp, Mus musculus
aatagtaaacacatgctgaggcagg

SEQ ID NO: 74036 - DNA, 25 bp, Mus musculus
aatagtaaacacttgctgaggcagg

SEQ ID NO: 74037 - DNA, 25 bp, Mus musculus
aatagtaaccgtcaaaggagagagt

SEQ ID NO: 74038 - DNA, 25 bp, Mus musculus
aatagtaaccgtgaaaggagagagt

SEQ ID NO: 74039 - DNA, 25 bp, Mus musculus
aatagtaatagcacctttctccttc

SEQ ID NO: 74040 - DNA, 25 bp, Mus musculus
aatagtaatagctcctttctccttc

SEQ ID NO: 74041 - DNA, 25 bp, Mus musculus
aatagtaatcctcggagtctccttc

SEQ ID NO: 74042 - DNA, 25 bp, Mus musculus
aatagtaatcctgggagtctccttc

SEQ ID NO: 74043 - DNA, 25 bp, Mus musculus
aatagtaattctatggagtcctatg

SEQ ID NO: 74044 - DNA, 25 bp, Mus musculus
aatagtaattctttggagtcctatg

SEQ ID NO: 74045 - DNA, 25 bp, Mus musculus
aatagtaattgtcgtcactgtggcc

SEQ ID NO: 74046 - DNA, 25 bp, Mus musculus
aatagtaattgtggtcactgtggcc

SEQ ID NO: 74047 - DNA, 25 bp, Mus musculus
aatagtacactgacctgagtcccga

SEQ ID NO: 74048 - DNA, 25 bp, Mus musculus
aatagtacactgtcctgagtcccga

SEQ ID NO: 74049 - DNA, 25 bp, Mus musculus
aatagtacaggcctgtagttccagc

SEQ ID NO: 74050 - DNA, 25 bp, Mus musculus
aatagtacaggcgtgtagttccagc

SEQ ID NO: 74051 - DNA, 25 bp, Mus musculus
aatagtacaggtccccagaatccat

SEQ ID NO: 74052 - DNA, 25 bp, Mus musculus
aatagtacaggtgcccagaatccat

SEQ ID NO: 74053 - DNA, 25 bp, Mus musculus
aatagtaccattcatatcagcaaga

SEQ ID NO: 74054 - DNA, 25 bp, Mus musculus
aatagtaccattgatatcagcaaga

SEQ ID NO: 74055 - DNA, 25 bp, Mus musculus
aatagtagccagcagttgccttacc

SEQ ID NO: 74056 - DNA, 25 bp, Mus musculus
aatagtagccaggagttgccttacc

SEQ ID NO: 74057 - DNA, 25 bp, Mus musculus
aatagtagctctccatttgaaaatg

SEQ ID NO: 74058 - DNA, 25 bp, Mus musculus
aatagtagctctgcatttgaaaatg

SEQ ID NO: 74059 - DNA, 25 bp, Mus musculus
aatagtaggctcatgcatgtgcatt

SEQ ID NO: 74060 - DNA, 25 bp, Mus musculus
aatagtaggctcttgcatgtgcatt

SEQ ID NO: 74061 - DNA, 25 bp, Mus musculus
aatagtagtgcacgcctgcaatcct

SEQ ID NO: 74062 - DNA, 25 bp, Mus musculus
aatagtagtgcaggcctgcaatcct

SEQ ID NO: 74063 - DNA, 25 bp, Mus musculus
aatagtagttggatgcttggcacat

SEQ ID NO: 74064 - DNA, 25 bp, Mus musculus
aatagtagttggttgcttggcacat

SEQ ID NO: 74065 - DNA, 25 bp, Mus musculus
aatagtatcaggatggcccattctt

SEQ ID NO: 74066 - DNA, 25 bp, Mus musculus
aatagtatcaggttggcccattctt

SEQ ID NO: 74067 - DNA, 25 bp, Mus musculus
aatagtatccacaaaccacctagtc

SEQ ID NO: 74068 - DNA, 25 bp, Mus musculus
aatagtatccactaaccacctagtc

SEQ ID NO: 74069 - DNA, 25 bp, Mus musculus
aatagtatgtccatgtggcttgatt

SEQ ID NO: 74070 - DNA, 25 bp, Mus musculus
aatagtatgtccttgtggcttgatt

SEQ ID NO: 74071 - DNA, 25 bp, Mus musculus
aatagtatttccactactgcctggc

SEQ ID NO: 74072 - DNA, 25 bp, Mus musculus
aatagtatttcctctactgcctggc

SEQ ID NO: 74073 - DNA, 25 bp, Mus musculus
aatagtcacaacatgatttcagaac

SEQ ID NO: 74074 - DNA, 25 bp, Mus musculus
aatagtcacaacttgatttcagaac

SEQ ID NO: 74075 - DNA, 25 bp, Mus musculus
aatagtcacagtatttctgatgtta

SEQ ID NO: 74076 - DNA, 25 bp, Mus musculus
aatagtcacagtttttctgatgtta

SEQ ID NO: 74077 - DNA, 25 bp, Mus musculus
aatagtcacgtgcatgcttgctctc

SEQ ID NO: 74078 - DNA, 25 bp, Mus musculus
aatagtcacgtggatgcttgctctc

SEQ ID NO: 74079 - DNA, 25 bp, Mus musculus
aatagtcactgcacaatttggatct

SEQ ID NO: 74080 - DNA, 25 bp, Mus musculus
aatagtcactgctcaatttggatct

SEQ ID NO: 74081 - DNA, 25 bp, Mus musculus
aatagtcagatgcatcagtggccaa

SEQ ID NO: 74082 - DNA, 25 bp, Mus musculus
aatagtcagatggatcagtggccaa

SEQ ID NO: 74083 - DNA, 25 bp, Mus musculus
aatagtcagctgctatgtcaaacaa

SEQ ID NO: 74084 - DNA, 25 bp, Mus musculus
aatagtcagctggtatgtcaaacaa

SEQ ID NO: 74085 - DNA, 25 bp, Mus musculus
aatagtcaggacagctataccccag

SEQ ID NO: 74086 - DNA, 25 bp, Mus musculus
aatagtcaggactgctataccccag

SEQ ID NO: 74087 - DNA, 25 bp, Mus musculus
aatagtcagtggctgtggcactccg

SEQ ID NO: 74088 - DNA, 25 bp, Mus musculus
aatagtcagtgggtgtggcactccg

SEQ ID NO: 74089 - DNA, 25 bp, Mus musculus
aatagtcagttgattatgccctaac

SEQ ID NO: 74090 - DNA, 25 bp, Mus musculus
aatagtcagttgtttatgccctaac

SEQ ID NO: 74091 - DNA, 25 bp, Mus musculus
aatagtcataggactttaaaaatat

SEQ ID NO: 74092 - DNA, 25 bp, Mus musculus
aatagtcataggtctttaaaaatat

SEQ ID NO: 74093 - DNA, 25 bp, Mus musculus
aatagtcattccaagtatccatgaa

SEQ ID NO: 74094 - DNA, 25 bp, Mus musculus
aatagtcattcctagtatccatgaa

SEQ ID NO: 74095 - DNA, 25 bp, Mus musculus
aatagtcattggaagccccagaggc

SEQ ID NO: 74096 - DNA, 25 bp, Mus musculus
aatagtcattggtagccccagaggc

SEQ ID NO: 74097 - DNA, 25 bp, Mus musculus
aatagtccagacacaggcaaatgag

SEQ ID NO: 74098 - DNA, 25 bp, Mus musculus
aatagtccagactcaggcaaatgag

SEQ ID NO: 74099 - DNA, 25 bp, Mus musculus
aatagtcccaagacccttacgatct

SEQ ID NO: 74100 - DNA, 25 bp, Mus musculus
aatagtcccaagcagttgcctcaga

SEQ ID NO: 74101 - DNA, 25 bp, Mus musculus
aatagtcccaaggagttgcctcaga

SEQ ID NO: 74102 - DNA, 25 bp, Mus musculus
aatagtcccaagtcccttacgatct

SEQ ID NO: 74103 - DNA, 25 bp, Mus musculus
aatagtccccatattacacatttgg

SEQ ID NO: 74104 - DNA, 25 bp, Mus musculus
aatagtccccattttacacatttgg

SEQ ID NO: 74105 - DNA, 25 bp, Mus musculus
aatagtccctgaaacatgccatctg

SEQ ID NO: 74106 - DNA, 25 bp, Mus musculus
aatagtccctgatacatgccatctg

SEQ ID NO: 74107 - DNA, 25 bp, Mus musculus
aatagtccgtgccttgccttggagg

SEQ ID NO: 74108 - DNA, 25 bp, Mus musculus
aatagtccgtgcgttgccttggagg

SEQ ID NO: 74109 - DNA, 25 bp, Mus musculus
aatagtcctacccattcaacagagt

SEQ ID NO: 74110 - DNA, 25 bp, Mus musculus
aatagtcctaccgattcaacagagt

SEQ ID NO: 74111 - DNA, 25 bp, Mus musculus
aatagtcctcataagtttttctcag

SEQ ID NO: 74112 - DNA, 25 bp, Mus musculus
aatagtcctcattagtttttctcag

SEQ ID NO: 74113 - DNA, 25 bp, Mus musculus
aatagtcctctcactgtctgaattc

SEQ ID NO: 74114 - DNA, 25 bp, Mus musculus
aatagtcctctctctgtctgaattc

SEQ ID NO: 74115 - DNA, 25 bp, Mus musculus
aatagtcgctggcatctttttcctc

SEQ ID NO: 74116 - DNA, 25 bp, Mus musculus
aatagtcgctgggatctttttcctc

SEQ ID NO: 74117 - DNA, 25 bp, Mus musculus
aatagtcgtgcacagcgtgggcact

SEQ ID NO: 74118 - DNA, 25 bp, Mus musculus
aatagtcgtgcagagcgtgggcact

SEQ ID NO: 74119 - DNA, 25 bp, Mus musculus
aatagtctacctacttgagtgcatc

SEQ ID NO: 74120 - DNA, 25 bp, Mus musculus
aatagtctaccttcttgagtgcatc

SEQ ID NO: 74121 - DNA, 25 bp, Mus musculus
aatagtctagccatttctcctgatg

SEQ ID NO: 74122 - DNA, 25 bp, Mus musculus
aatagtctagccttttctcctgatg

SEQ ID NO: 74123 - DNA, 25 bp, Mus musculus
aatagtctccagacccctttctttg

SEQ ID NO: 74124 - DNA, 25 bp, Mus musculus
aatagtctccagtcccctttctttg

SEQ ID NO: 74125 - DNA, 25 bp, Mus musculus
aatagtctcgggaactccagtgcta

SEQ ID NO: 74126 - DNA, 25 bp, Mus musculus
aatagtctcgggtactccagtgcta

SEQ ID NO: 74127 - DNA, 25 bp, Mus musculus
aatagtctctcaacacttccagttc

SEQ ID NO: 74128 - DNA, 25 bp, Mus musculus
aatagtctctcatcacttccagttc

SEQ ID NO: 74129 - DNA, 25 bp, Mus musculus
aatagtctgactccgctatgttact

SEQ ID NO: 74130 - DNA, 25 bp, Mus musculus
aatagtctgactgcgctatgttact

SEQ ID NO: 74131 - DNA, 25 bp, Mus musculus
aatagtcttaggatcttttcttcat

SEQ ID NO: 74132 - DNA, 25 bp, Mus musculus
aatagtcttaggttcttttcttcat

SEQ ID NO: 74133 - DNA, 25 bp, Mus musculus
aatagtctttttcgaatgcaggaca

SEQ ID NO: 74134 - DNA, 25 bp, Mus musculus
aatagtctttttggaatgcaggaca

SEQ ID NO: 74135 - DNA, 25 bp, Mus musculus
aatagtgaatgtactgttcccaaca

SEQ ID NO: 74136 - DNA, 25 bp, Mus musculus
aatagtgaatgttctgttcccaaca

SEQ ID NO: 74137 - DNA, 25 bp, Mus musculus
aatagtgaccatatactgttgttca

SEQ ID NO: 74138 - DNA, 25 bp, Mus musculus
aatagtgaccatttactgttgttca

SEQ ID NO: 74139 - DNA, 25 bp, Mus musculus
aatagtgaccttcagcggtgtctat

SEQ ID NO: 74140 - DNA, 25 bp, Mus musculus
aatagtgaccttgagcggtgtctat

SEQ ID NO: 74141 - DNA, 25 bp, Mus musculus
aatagtgactatagccttaaggaca

SEQ ID NO: 74142 - DNA, 25 bp, Mus musculus
aatagtgactattgccttaaggaca

SEQ ID NO: 74143 - DNA, 25 bp, Mus musculus
aatagtgagtggcttatgctgataa

SEQ ID NO: 74144 - DNA, 25 bp, Mus musculus
aatagtgagtgggttatgctgataa

SEQ ID NO: 74145 - DNA, 25 bp, Mus musculus
aatagtgatccccaaatctgtcacc

SEQ ID NO: 74146 - DNA, 25 bp, Mus musculus
aatagtgatcccgaaatctgtcacc

SEQ ID NO: 74147 - DNA, 25 bp, Mus musculus
aatagtgatttcaataccacacttg

SEQ ID NO: 74148 - DNA, 25 bp, Mus musculus
aatagtgatttctataccacacttg

SEQ ID NO: 74149 - DNA, 25 bp, Mus musculus
aatagtgcattcactcaaggcccag

SEQ ID NO: 74150 - DNA, 25 bp, Mus musculus
aatagtgcattctctcaaggcccag

SEQ ID NO: 74151 - DNA, 25 bp, Mus musculus
aatagtgctgatacaagggctggga

SEQ ID NO: 74152 - DNA, 25 bp, Mus musculus
aatagtgctgattcaagggctggga

SEQ ID NO: 74153 - DNA, 25 bp, Mus musculus
aatagtgctgtcctctggtgacatt

SEQ ID NO: 74154 - DNA, 25 bp, Mus musculus
aatagtgctgtcgtctggtgacatt

SEQ ID NO: 74155 - DNA, 25 bp, Mus musculus
aatagtggatctcgtagctgccttt

SEQ ID NO: 74156 - DNA, 25 bp, Mus musculus
aatagtggatctggtagctgccttt

SEQ ID NO: 74157 - DNA, 25 bp, Mus musculus
aatagtggcagcacagcttccagag

SEQ ID NO: 74158 - DNA, 25 bp, Mus musculus
aatagtggcagctcagcttccagag

SEQ ID NO: 74159 - DNA, 25 bp, Mus musculus
aatagtgggaccctctctgttcacg

SEQ ID NO: 74160 - DNA, 25 bp, Mus musculus
aatagtgggaccgtctctgttcacg

SEQ ID NO: 74161 - DNA, 25 bp, Mus musculus
aatagtgggccgacttgaggcacct

SEQ ID NO: 74162 - DNA, 25 bp, Mus musculus
aatagtgggccgtcttgaggcacct

SEQ ID NO: 74163 - DNA, 25 bp, Mus musculus
aatagtggtcataggccggctctag

SEQ ID NO: 74164 - DNA, 25 bp, Mus musculus
aatagtggtcattggccggctctag

SEQ ID NO: 74165 - DNA, 25 bp, Mus musculus
aatagtgtacttcccatttgagcct

SEQ ID NO: 74166 - DNA, 25 bp, Mus musculus
aatagtgtacttgccatttgagcct

SEQ ID NO: 74167 - DNA, 25 bp, Mus musculus
aatagtgtatatacttgctttaagt

SEQ ID NO: 74168 - DNA, 25 bp, Mus musculus
aatagtgtatattcttgctttaagt

SEQ ID NO: 74169 - DNA, 25 bp, Mus musculus
aatagtgtattcaccttctcctaca

SEQ ID NO: 74170 - DNA, 25 bp, Mus musculus
aatagtgtattctccttctcctaca

SEQ ID NO: 74171 - DNA, 25 bp, Mus musculus
aatagtgtcaatattttctctgtaa

SEQ ID NO: 74172 - DNA, 25 bp, Mus musculus
aatagtgtcaattttttctctgtaa

SEQ ID NO: 74173 - DNA, 25 bp, Mus musculus
aatagtgtcacacagtctgcagctg

SEQ ID NO: 74174 - DNA, 25 bp, Mus musculus
aatagtgtcacagagtctgcagctg

SEQ ID NO: 74175 - DNA, 25 bp, Mus musculus
aatagtgtctttcaaattgacccca

SEQ ID NO: 74176 - DNA, 25 bp, Mus musculus
aatagtgtctttgaaattgacccca

SEQ ID NO: 74177 - DNA, 25 bp, Mus musculus
aatagtgtggcactgtgctgcttac

SEQ ID NO: 74178 - DNA, 25 bp, Mus musculus
aatagtgtggcagtgtgctgcttac

SEQ ID NO: 74179 - DNA, 25 bp, Mus musculus
aatagtgttcagaatcttagtcatc

SEQ ID NO: 74180 - DNA, 25 bp, Mus musculus
aatagtgttcagtatcttagtcatc

SEQ ID NO: 74181 - DNA, 25 bp, Mus musculus
aatagtgttgccaccagtacccttt

SEQ ID NO: 74182 - DNA, 25 bp, Mus musculus
aatagtgttgcctccagtacccttt

SEQ ID NO: 74183 - DNA, 25 bp, Mus musculus
aatagttacataagctttgcttgaa

SEQ ID NO: 74184 - DNA, 25 bp, Mus musculus
aatagttacatatgctttgcttgaa

SEQ ID NO: 74185 - DNA, 25 bp, Mus musculus
aatagttacattaccgtccatttca

SEQ ID NO: 74186 - DNA, 25 bp, Mus musculus
aatagttacatttccgtccatttca

SEQ ID NO: 74187 - DNA, 25 bp, Mus musculus
aatagttacgtgcttgtccctctaa

SEQ ID NO: 74188 - DNA, 25 bp, Mus musculus
aatagttacgtggttgtccctctaa

SEQ ID NO: 74189 - DNA, 25 bp, Mus musculus
aatagttactcaagttctgccttcc

SEQ ID NO: 74190 - DNA, 25 bp, Mus musculus
aatagttactcatgttctgccttcc

SEQ ID NO: 74191 - DNA, 25 bp, Mus musculus
aatagttacttcattttccacctgg

SEQ ID NO: 74192 - DNA, 25 bp, Mus musculus
aatagttacttctttttccacctgg

SEQ ID NO: 74193 - DNA, 25 bp, Mus musculus
aatagttagcacacaactacaggtt

SEQ ID NO: 74194 - DNA, 25 bp, Mus musculus
aatagttagcactcaactacaggtt

SEQ ID NO: 74195 - DNA, 25 bp, Mus musculus
aatagttagcttagctctttctagt

SEQ ID NO: 74196 - DNA, 25 bp, Mus musculus
aatagttagctttgctctttctagt

SEQ ID NO: 74197 - DNA, 25 bp, Mus musculus
aatagttatcctaaaatctgtgtta

SEQ ID NO: 74198 - DNA, 25 bp, Mus musculus
aatagttatccttaaatctgtgtta

SEQ ID NO: 74199 - DNA, 25 bp, Mus musculus
aatagttatctgcaaaccaccagtg

SEQ ID NO: 74200 - DNA, 25 bp, Mus musculus
aatagttatctggaaaccaccagtg

SEQ ID NO: 74201 - DNA, 25 bp, Mus musculus
aatagttcattcatgccgggcagtg

SEQ ID NO: 74202 - DNA, 25 bp, Mus musculus
aatagttcattcttgccgggcagtg

SEQ ID NO: 74203 - DNA, 25 bp, Mus musculus
aatagttctgtcagggcttgtgcca

SEQ ID NO: 74204 - DNA, 25 bp, Mus musculus
aatagttctgtctgggcttgtgcca

SEQ ID NO: 74205 - DNA, 25 bp, Mus musculus
aatagttctttcagcaggtctgggt

SEQ ID NO: 74206 - DNA, 25 bp, Mus musculus
aatagttctttctgcaggtctgggt

SEQ ID NO: 74207 - DNA, 25 bp, Mus musculus
aatagttgaaatactccagtgcaga

SEQ ID NO: 74208 - DNA, 25 bp, Mus musculus
aatagttgaaattctccagtgcaga

SEQ ID NO: 74209 - DNA, 25 bp, Mus musculus
aatagttgactgcattcccagttaa

SEQ ID NO: 74210 - DNA, 25 bp, Mus musculus
aatagttgactggattcccagttaa

SEQ ID NO: 74211 - DNA, 25 bp, Mus musculus
aatagttgcttcaaccctttcctgt

SEQ ID NO: 74212 - DNA, 25 bp, Mus musculus
aatagttgcttctaccctttcctgt

SEQ ID NO: 74213 - DNA, 25 bp, Mus musculus
aatagtttaatcagacgtgtcccag

SEQ ID NO: 74214 - DNA, 25 bp, Mus musculus
aatagtttaatctgacgtgtcccag

SEQ ID NO: 74215 - DNA, 25 bp, Mus musculus
aatagtttactcatacatcatgaat

SEQ ID NO: 74216 - DNA, 25 bp, Mus musculus
aatagtttactcttacatcatgaat

SEQ ID NO: 74217 - DNA, 25 bp, Mus musculus
aatagtttcattaggctgttcggcc

SEQ ID NO: 74218 - DNA, 25 bp, Mus musculus
aatagtttcatttggctgttcggcc

SEQ ID NO: 74219 - DNA, 25 bp, Mus musculus
aatagtttccacacagttcactgtt

SEQ ID NO: 74220 - DNA, 25 bp, Mus musculus
aatagtttccactcagttcactgtt

SEQ ID NO: 74221 - DNA, 25 bp, Mus musculus
aatagtttcctgcttgtgactaccc

SEQ ID NO: 74222 - DNA, 25 bp, Mus musculus
aatagtttcctggttgtgactaccc

SEQ ID NO: 74223 - DNA, 25 bp, Mus musculus
aatagtttcttcatactctgcatat

SEQ ID NO: 74224 - DNA, 25 bp, Mus musculus
aatagtttcttcttactctgcatat

SEQ ID NO: 74225 - DNA, 25 bp, Mus musculus
aatagtttcttgacttgagttatga

SEQ ID NO: 74226 - DNA, 25 bp, Mus musculus
aatagtttcttgtcttgagttatga

SEQ ID NO: 74227 - DNA, 25 bp, Mus musculus
aatagtttgctcacattaacgatcc

SEQ ID NO: 74228 - DNA, 25 bp, Mus musculus
aatagtttgctctcattaacgatcc

SEQ ID NO: 74229 - DNA, 25 bp, Mus musculus
aatagtttgggcaatcccatcccat

SEQ ID NO: 74230 - DNA, 25 bp, Mus musculus
aatagtttgggctatcccatcccat

SEQ ID NO: 74231 - DNA, 25 bp, Mus musculus
aatagttttaagcagccacatctac

SEQ ID NO: 74232 - DNA, 25 bp, Mus musculus
aatagttttaaggagccacatctac

SEQ ID NO: 74233 - DNA, 25 bp, Mus musculus
aatagttttcatcgcccaatgtact

SEQ ID NO: 74234 - DNA, 25 bp, Mus musculus
aatagttttcatggcccaatgtact

SEQ ID NO: 74235 - DNA, 25 bp, Mus musculus
aatagttttgtaaggctccaagatg

SEQ ID NO: 74236 - DNA, 25 bp, Mus musculus
aatagttttgtatggctccaagatg

SEQ ID NO: 74237 - DNA, 25 bp, Mus musculus
aatagttttgttcaggagtgggcat

SEQ ID NO: 74238 - DNA, 25 bp, Mus musculus
aatagttttgttgaggagtgggcat

SEQ ID NO: 74239 - DNA, 25 bp, Mus musculus
aatagtttttctcagtggtggcata

SEQ ID NO: 74240 - DNA, 25 bp, Mus musculus
aatagtttttctgagtggtggcata

SEQ ID NO: 74241 - DNA, 25 bp, Mus musculus
aatataaaacaacgctccttccagg

SEQ ID NO: 74242 - DNA, 25 bp, Mus musculus
aatataaaacaaggctccttccagg

SEQ ID NO: 74243 - DNA, 25 bp, Mus musculus
aatataaaatccagtctaccctcac

SEQ ID NO: 74244 - DNA, 25 bp, Mus musculus
aatataaaatcctgtctaccctcac

SEQ ID NO: 74245 - DNA, 25 bp, Mus musculus
aatataaacaacaccagcctaccga

SEQ ID NO: 74246 - DNA, 25 bp, Mus musculus
aatataaacaactccagcctaccga

SEQ ID NO: 74247 - DNA, 25 bp, Mus musculus
aatataaacgttcctcatgccgaca

SEQ ID NO: 74248 - DNA, 25 bp, Mus musculus
aatataaacgttgctcatgccgaca

SEQ ID NO: 74249 - DNA, 25 bp, Mus musculus
aatataaataaacctactgctttgg

SEQ ID NO: 74250 - DNA, 25 bp, Mus musculus
aatataaataaagctactgctttgg

SEQ ID NO: 74251 - DNA, 25 bp, Mus musculus
aatataaatgcaactacccctttcc

SEQ ID NO: 74252 - DNA, 25 bp, Mus musculus
aatataaatgcatctacccctttcc

SEQ ID NO: 74253 - DNA, 25 bp, Mus musculus
aatataaatggtacactccagggag

SEQ ID NO: 74254 - DNA, 25 bp, Mus musculus
aatataaatggttcactccagggag

SEQ ID NO: 74255 - DNA, 25 bp, Mus musculus
aatataacctctactgggacagtgc

SEQ ID NO: 74256 - DNA, 25 bp, Mus musculus
aatataacctcttctgggacagtgc

SEQ ID NO: 74257 - DNA, 25 bp, Mus musculus
aatataaccttgcttgggaactgag

SEQ ID NO: 74258 - DNA, 25 bp, Mus musculus
aatataaccttggttgggaactgag

SEQ ID NO: 74259 - DNA, 25 bp, Mus musculus
aatataactccacacatgtccgttg

SEQ ID NO: 74260 - DNA, 25 bp, Mus musculus
aatataactccagacatgtccgttg

SEQ ID NO: 74261 - DNA, 25 bp, Mus musculus
aatataagcactcattcaggcccag

SEQ ID NO: 74262 - DNA, 25 bp, Mus musculus
aatataagcactgattcaggcccag

SEQ ID NO: 74263 - DNA, 25 bp, Mus musculus
aatataagggtgatcgggtgcgtgc

SEQ ID NO: 74264 - DNA, 25 bp, Mus musculus
aatataagggtgttcgggtgcgtgc

SEQ ID NO: 74265 - DNA, 25 bp, Mus musculus
aatataataaataggcctcgaggcc

SEQ ID NO: 74266 - DNA, 25 bp, Mus musculus
aatataataaattggcctcgaggcc

SEQ ID NO: 74267 - DNA, 25 bp, Mus musculus
aatataatctagaaacagcccaaca

SEQ ID NO: 74268 - DNA, 25 bp, Mus musculus
aatataatctagtaacagcccaaca

SEQ ID NO: 74269 - DNA, 25 bp, Mus musculus
aatataatggaactctcctgacact

SEQ ID NO: 74270 - DNA, 25 bp, Mus musculus
aatataatggaagtctcctgacact

SEQ ID NO: 74271 - DNA, 25 bp, Mus musculus
aatatacaagtgagaaagcagttaa

SEQ ID NO: 74272 - DNA, 25 bp, Mus musculus
aatatacaagtgtgaaagcagttaa

SEQ ID NO: 74273 - DNA, 25 bp, Mus musculus
aatatacaccctactatagctcgtc

SEQ ID NO: 74274 - DNA, 25 bp, Mus musculus
aatatacacccttctatagctcgtc

SEQ ID NO: 74275 - DNA, 25 bp, Mus musculus
aatatacagacccatccatacacaa

SEQ ID NO: 74276 - DNA, 25 bp, Mus musculus
aatatacagaccgatccatacacaa

SEQ ID NO: 74277 - DNA, 25 bp, Mus musculus
aatatacagatgattgttttcttct

SEQ ID NO: 74278 - DNA, 25 bp, Mus musculus
aatatacagatgtttgttttcttct

SEQ ID NO: 74279 - DNA, 25 bp, Mus musculus
aatatacatacgatgctctaattca

SEQ ID NO: 74280 - DNA, 25 bp, Mus musculus
aatatacatacgttgctctaattca

SEQ ID NO: 74281 - DNA, 25 bp, Mus musculus
aatatacatggactctcagcactga

SEQ ID NO: 74282 - DNA, 25 bp, Mus musculus
aatatacatggagtctcagcactga

SEQ ID NO: 74283 - DNA, 25 bp, Mus musculus
aatataccaagtcccaccatcttac

SEQ ID NO: 74284 - DNA, 25 bp, Mus musculus
aatataccaagtgccaccatcttac

SEQ ID NO: 74285 - DNA, 25 bp, Mus musculus
aatataccacatcctgagacactaa

SEQ ID NO: 74286 - DNA, 25 bp, Mus musculus
aatataccacatgctgagacactaa

SEQ ID NO: 74287 - DNA, 25 bp, Mus musculus
aatataccactaacctgcagagaca

SEQ ID NO: 74288 - DNA, 25 bp, Mus musculus
aatataccactatcctgcagagaca

SEQ ID NO: 74289 - DNA, 25 bp, Mus musculus
aatatacccatccattttcttactg

SEQ ID NO: 74290 - DNA, 25 bp, Mus musculus
aatatacccatcgattttcttactg

SEQ ID NO: 74291 - DNA, 25 bp, Mus musculus
aatataccctctaccttgtggagtg

SEQ ID NO: 74292 - DNA, 25 bp, Mus musculus
aatataccctcttccttgtggagtg

SEQ ID NO: 74293 - DNA, 25 bp, Mus musculus
aatataccgacaccgtggactgctg

SEQ ID NO: 74294 - DNA, 25 bp, Mus musculus
aatataccgacagcgtggactgctg

SEQ ID NO: 74295 - DNA, 25 bp, Mus musculus
aatatacctcttatttcaccatgtg

SEQ ID NO: 74296 - DNA, 25 bp, Mus musculus
aatatacctcttttttcaccatgtg

SEQ ID NO: 74297 - DNA, 25 bp, Mus musculus
aatatacctgacatagattccgcaa

SEQ ID NO: 74298 - DNA, 25 bp, Mus musculus
aatatacctgacttagattccgcaa

SEQ ID NO: 74299 - DNA, 25 bp, Mus musculus
aatatacctggtaatttcttcccat

SEQ ID NO: 74300 - DNA, 25 bp, Mus musculus
aatatacctggttatttcttcccat

SEQ ID NO: 74301 - DNA, 25 bp, Mus musculus
aatatacgtaggattcagagagtta

SEQ ID NO: 74302 - DNA, 25 bp, Mus musculus
aatatacgtaggtttcagagagtta

SEQ ID NO: 74303 - DNA, 25 bp, Mus musculus
aatatactaggactgcaccctttta

SEQ ID NO: 74304 - DNA, 25 bp, Mus musculus
aatatactaggagtgcaccctttta

SEQ ID NO: 74305 - DNA, 25 bp, Mus musculus
aatatactaggtctttaatctgatg

SEQ ID NO: 74306 - DNA, 25 bp, Mus musculus
aatatactaggtgtttaatctgatg

SEQ ID NO: 74307 - DNA, 25 bp, Mus musculus
aatatactatgtactgtcgacgctc

SEQ ID NO: 74308 - DNA, 25 bp, Mus musculus
aatatactatgttctgtcgacgctc

SEQ ID NO: 74309 - DNA, 25 bp, Mus musculus
aatatactctaaacttcgtgctccc

SEQ ID NO: 74310 - DNA, 25 bp, Mus musculus
aatatactctaatcttcgtgctccc

SEQ ID NO: 74311 - DNA, 25 bp, Mus musculus
aatatactgaatccatacacttttt

SEQ ID NO: 74312 - DNA, 25 bp, Mus musculus
aatatactgaatgcatacacttttt

SEQ ID NO: 74313 - DNA, 25 bp, Mus musculus
aatatacttatgactttttgcagat

SEQ ID NO: 74314 - DNA, 25 bp, Mus musculus
aatatacttatgtctttttgcagat

SEQ ID NO: 74315 - DNA, 25 bp, Mus musculus
aatatacttccgactgtgttggcag

SEQ ID NO: 74316 - DNA, 25 bp, Mus musculus
aatatacttccgtctgtgttggcag

SEQ ID NO: 74317 - DNA, 25 bp, Mus musculus
aatatacttctaaacttgccctcgt

SEQ ID NO: 74318 - DNA, 25 bp, Mus musculus
aatatacttctatacttgccctcgt

SEQ ID NO: 74319 - DNA, 25 bp, Mus musculus
aatatacttgccctatctccaaaac

SEQ ID NO: 74320 - DNA, 25 bp, Mus musculus
aatatacttgccgtatctccaaaac

SEQ ID NO: 74321 - DNA, 25 bp, Mus musculus
aatatacttgttcttctaccacagg

SEQ ID NO: 74322 - DNA, 25 bp, Mus musculus
aatatacttgttgttctaccacagg

SEQ ID NO: 74323 - DNA, 25 bp, Mus musculus
aatatactttgcagtcacctctacc

SEQ ID NO: 74324 - DNA, 25 bp, Mus musculus
aatatactttgctgtcacctctacc

SEQ ID NO: 74325 - DNA, 25 bp, Mus musculus
aatatagaaagcctcaccctgtgtg

SEQ ID NO: 74326 - DNA, 25 bp, Mus musculus
aatatagaaagcgtcaccctgtgtg

SEQ ID NO: 74327 - DNA, 25 bp, Mus musculus
aatatagaacccattcttgcttccc

SEQ ID NO: 74328 - DNA, 25 bp, Mus musculus
aatatagaaccctttcttgcttccc

SEQ ID NO: 74329 - DNA, 25 bp, Mus musculus
aatatagacagccactcttccttct

SEQ ID NO: 74330 - DNA, 25 bp, Mus musculus
aatatagacagcgactcttccttct

SEQ ID NO: 74331 - DNA, 25 bp, Mus musculus
aatatagatcttaatttgcccataa

SEQ ID NO: 74332 - DNA, 25 bp, Mus musculus
aatatagatctttatttgcccataa

SEQ ID NO: 74333 - DNA, 25 bp, Mus musculus
aatatagcatgaactctcggtcctc

SEQ ID NO: 74334 - DNA, 25 bp, Mus musculus
aatatagcatgatctctcggtcctc

SEQ ID NO: 74335 - DNA, 25 bp, Mus musculus
aatatagccattctctgtgtcctac

SEQ ID NO: 74336 - DNA, 25 bp, Mus musculus
aatatagccattgtctgtgtcctac

SEQ ID NO: 74337 - DNA, 25 bp, Mus musculus
aatatagccctcaacttgttaggaa

SEQ ID NO: 74338 - DNA, 25 bp, Mus musculus
aatatagccctctacttgttaggaa

SEQ ID NO: 74339 - DNA, 25 bp, Mus musculus
aatatagcctctaccacagagctac

SEQ ID NO: 74340 - DNA, 25 bp, Mus musculus
aatatagcctcttccacagagctac

SEQ ID NO: 74341 - DNA, 25 bp, Mus musculus
aatatagctgaccattaataaaaca

SEQ ID NO: 74342 - DNA, 25 bp, Mus musculus
aatatagctgacgattaataaaaca

SEQ ID NO: 74343 - DNA, 25 bp, Mus musculus
aatatagctgcaacctaaacccaaa

SEQ ID NO: 74344 - DNA, 25 bp, Mus musculus
aatatagctgcatcctaaacccaaa

SEQ ID NO: 74345 - DNA, 25 bp, Mus musculus
aatataggccataagttgactctgt

SEQ ID NO: 74346 - DNA, 25 bp, Mus musculus
aatataggccattagttgactctgt

SEQ ID NO: 74347 - DNA, 25 bp, Mus musculus
aatataggcccaccctaatacagct

SEQ ID NO: 74348 - DNA, 25 bp, Mus musculus
aatataggcccagcctaatacagct

SEQ ID NO: 74349 - DNA, 25 bp, Mus musculus
aatataggccgtaggcctctctcga

SEQ ID NO: 74350 - DNA, 25 bp, Mus musculus
aatataggccgttggcctctctcga

SEQ ID NO: 74351 - DNA, 25 bp, Mus musculus
aatataggcgtaagacccagagatc

SEQ ID NO: 74352 - DNA, 25 bp, Mus musculus
aatataggcgtatgacccagagatc

SEQ ID NO: 74353 - DNA, 25 bp, Mus musculus
aatatagggcttcgccacagtttcc

SEQ ID NO: 74354 - DNA, 25 bp, Mus musculus
aatatagggcttggccacagtttcc

SEQ ID NO: 74355 - DNA, 25 bp, Mus musculus
aatatagggtctcagtgccacctgc

SEQ ID NO: 74356 - DNA, 25 bp, Mus musculus
aatatagggtctgagtgccacctgc

SEQ ID NO: 74357 - DNA, 25 bp, Mus musculus
aatatagtagttaccctcagtactt

SEQ ID NO: 74358 - DNA, 25 bp, Mus musculus
aatatagtagtttccctcagtactt

SEQ ID NO: 74359 - DNA, 25 bp, Mus musculus
aatatagtatcgactgcattccagc

SEQ ID NO: 74360 - DNA, 25 bp, Mus musculus
aatatagtatcgtctgcattccagc

SEQ ID NO: 74361 - DNA, 25 bp, Mus musculus
aatatagtatgcaacagggcatttg

SEQ ID NO: 74362 - DNA, 25 bp, Mus musculus
aatatagtatgctacagggcatttg

SEQ ID NO: 74363 - DNA, 25 bp, Mus musculus
aatatagtccaaccttctcgtcaga

SEQ ID NO: 74364 - DNA, 25 bp, Mus musculus
aatatagtccaagcttctcgtcaga

SEQ ID NO: 74365 - DNA, 25 bp, Mus musculus
aatatagtctctactcctgggtaac

SEQ ID NO: 74366 - DNA, 25 bp, Mus musculus
aatatagtctcttctcctgggtaac

SEQ ID NO: 74367 - DNA, 25 bp, Mus musculus
aatatagtggttaggcctctgatta

SEQ ID NO: 74368 - DNA, 25 bp, Mus musculus
aatatagtggtttggcctctgatta

SEQ ID NO: 74369 - DNA, 25 bp, Mus musculus
aatatataagccctaatttctgtgt

SEQ ID NO: 74370 - DNA, 25 bp, Mus musculus
aatatataagccgtaatttctgtgt

SEQ ID NO: 74371 - DNA, 25 bp, Mus musculus
aatatataatatccagccagcttaa

SEQ ID NO: 74372 - DNA, 25 bp, Mus musculus
aatatataatatgcagccagcttaa

SEQ ID NO: 74373 - DNA, 25 bp, Mus musculus
aatatatagtgcatgcaaggtccta

SEQ ID NO: 74374 - DNA, 25 bp, Mus musculus
aatatatagtgcttgcaaggtccta

SEQ ID NO: 74375 - DNA, 25 bp, Mus musculus
aatatatcaccaattgtctatgaat

SEQ ID NO: 74376 - DNA, 25 bp, Mus musculus
aatatatcaccatttgtctatgaat

SEQ ID NO: 74377 - DNA, 25 bp, Mus musculus
aatatatcagttcacccattcctcc

SEQ ID NO: 74378 - DNA, 25 bp, Mus musculus
aatatatcagttgacccattcctcc

SEQ ID NO: 74379 - DNA, 25 bp, Mus musculus
aatatatccaacacaggtcgccttt

SEQ ID NO: 74380 - DNA, 25 bp, Mus musculus
aatatatccaactcaggtcgccttt

SEQ ID NO: 74381 - DNA, 25 bp, Mus musculus
aatatatccagtacgcttgcagaga

SEQ ID NO: 74382 - DNA, 25 bp, Mus musculus
aatatatccagttcgcttgcagaga

SEQ ID NO: 74383 - DNA, 25 bp, Mus musculus
aatatatccctgctccttacaggag

SEQ ID NO: 74384 - DNA, 25 bp, Mus musculus
aatatatccctggtccttacaggag

SEQ ID NO: 74385 - DNA, 25 bp, Mus musculus
aatatatctactcccaccacaggaa

SEQ ID NO: 74386 - DNA, 25 bp, Mus musculus
aatatatctactgccaccacaggaa

SEQ ID NO: 74387 - DNA, 25 bp, Mus musculus
aatatatctcatcacttctccaagt

SEQ ID NO: 74388 - DNA, 25 bp, Mus musculus
aatatatctcatgacttctccaagt

SEQ ID NO: 74389 - DNA, 25 bp, Mus musculus
aatatatctctgacgtgctccatag

SEQ ID NO: 74390 - DNA, 25 bp, Mus musculus
aatatatctctgtcgtgctccatag

SEQ ID NO: 74391 - DNA, 25 bp, Mus musculus
aatatatgcagaatcacaggtacct

SEQ ID NO: 74392 - DNA, 25 bp, Mus musculus
aatatatgcagattcacaggtacct

SEQ ID NO: 74393 - DNA, 25 bp, Mus musculus
aatatatggaccaagcttaaggcga

SEQ ID NO: 74394 - DNA, 25 bp, Mus musculus
aatatatggacctagcttaaggcga

SEQ ID NO: 74395 - DNA, 25 bp, Mus musculus
aatatatgtcagcagttgcagggct

SEQ ID NO: 74396 - DNA, 25 bp, Mus musculus
aatatatgtcaggagttgcagggct

SEQ ID NO: 74397 - DNA, 25 bp, Mus musculus
aatatatgtccccaagtgcatgtcc

SEQ ID NO: 74398 - DNA, 25 bp, Mus musculus
aatatatgtcccgaagtgcatgtcc

SEQ ID NO: 74399 - DNA, 25 bp, Mus musculus
aatatattcacaactgcattcagac

SEQ ID NO: 74400 - DNA, 25 bp, Mus musculus
aatatattcacatctgcattcagac

SEQ ID NO: 74401 - DNA, 25 bp, Mus musculus
aatatattccagacccagtttgtat

SEQ ID NO: 74402 - DNA, 25 bp, Mus musculus
aatatattccagtcccagtttgtat

SEQ ID NO: 74403 - DNA, 25 bp, Mus musculus
aatatattccccaaattactgaaga

SEQ ID NO: 74404 - DNA, 25 bp, Mus musculus
aatatattcccctaattactgaaga

SEQ ID NO: 74405 - DNA, 25 bp, Mus musculus
aatatattctcacctgtgagatgga

SEQ ID NO: 74406 - DNA, 25 bp, Mus musculus
aatatattctcagctgtgagatgga

SEQ ID NO: 74407 - DNA, 25 bp, Mus musculus
aatatattctttagttaccactggg

SEQ ID NO: 74408 - DNA, 25 bp, Mus musculus
aatatattcttttgttaccactggg

SEQ ID NO: 74409 - DNA, 25 bp, Mus musculus
aatatattgcccaatcgggacccaa

SEQ ID NO: 74410 - DNA, 25 bp, Mus musculus
aatatattgccctatcgggacccaa

SEQ ID NO: 74411 - DNA, 25 bp, Mus musculus
aatatattgcctaaaggacctacta

SEQ ID NO: 74412 - DNA, 25 bp, Mus musculus
aatatattgccttaaggacctacta

SEQ ID NO: 74413 - DNA, 25 bp, Mus musculus
aatatattgcttacagatggtagga

SEQ ID NO: 74414 - DNA, 25 bp, Mus musculus
aatatattgctttcagatggtagga

SEQ ID NO: 74415 - DNA, 25 bp, Mus musculus
aatatatttgatcaccacgctgact

SEQ ID NO: 74416 - DNA, 25 bp, Mus musculus
aatatatttgatgaccacgctgact

SEQ ID NO: 74417 - DNA, 25 bp, Mus musculus
aatatattttacatgcactgtgttt

SEQ ID NO: 74418 - DNA, 25 bp, Mus musculus
aatatattttacttgcactgtgttt

SEQ ID NO: 74419 - DNA, 25 bp, Mus musculus
aatatcaaccttcggtctccacatg

SEQ ID NO: 74420 - DNA, 25 bp, Mus musculus
aatatcaaccttgggtctccacatg

SEQ ID NO: 74421 - DNA, 25 bp, Mus musculus
aatatcaactatctcctcaagtatg

SEQ ID NO: 74422 - DNA, 25 bp, Mus musculus
aatatcaactatgtcctcaagtatg

SEQ ID NO: 74423 - DNA, 25 bp, Mus musculus
aatatcaactccagtttcttcttcc

SEQ ID NO: 74424 - DNA, 25 bp, Mus musculus
aatatcaactcctgtttcttcttcc

SEQ ID NO: 74425 - DNA, 25 bp, Mus musculus
aatatcaagattccttatgctcatt

SEQ ID NO: 74426 - DNA, 25 bp, Mus musculus
aatatcaagattctttctgtaccag

SEQ ID NO: 74427 - DNA, 25 bp, Mus musculus
aatatcaagattgcttatgctcatt

SEQ ID NO: 74428 - DNA, 25 bp, Mus musculus
aatatcaagattgtttctgtaccag

SEQ ID NO: 74429 - DNA, 25 bp, Mus musculus
aatatcaatggaatccctcttaccc

SEQ ID NO: 74430 - DNA, 25 bp, Mus musculus
aatatcaatggattccctcttaccc

SEQ ID NO: 74431 - DNA, 25 bp, Mus musculus
aatatcaattgtagactctaaccct

SEQ ID NO: 74432 - DNA, 25 bp, Mus musculus
aatatcaattgttgactctaaccct

SEQ ID NO: 74433 - DNA, 25 bp, Mus musculus
aatatcacaactacttcctgaggca

SEQ ID NO: 74434 - DNA, 25 bp, Mus musculus
aatatcacaacttcttcctgaggca

SEQ ID NO: 74435 - DNA, 25 bp, Mus musculus
aatatcacactgatggtacgaggtg

SEQ ID NO: 74436 - DNA, 25 bp, Mus musculus
aatatcacactgttggtacgaggtg

SEQ ID NO: 74437 - DNA, 25 bp, Mus musculus
aatatcacaggaaacctcaggttag

SEQ ID NO: 74438 - DNA, 25 bp, Mus musculus
aatatcacaggacaccatttgcagt

SEQ ID NO: 74439 - DNA, 25 bp, Mus musculus
aatatcacaggagaccatttgcagt

SEQ ID NO: 74440 - DNA, 25 bp, Mus musculus
aatatcacaggatacctcaggttag

SEQ ID NO: 74441 - DNA, 25 bp, Mus musculus
aatatcaccaagatgtaccctctcc

SEQ ID NO: 74442 - DNA, 25 bp, Mus musculus
aatatcaccaagttgtaccctctcc

SEQ ID NO: 74443 - DNA, 25 bp, Mus musculus
aatatcaccagaagcttggctacca

SEQ ID NO: 74444 - DNA, 25 bp, Mus musculus
aatatcaccagatgcttggctacca

SEQ ID NO: 74445 - DNA, 25 bp, Mus musculus
aatatcaccatgatcctgcgaggaa

SEQ ID NO: 74446 - DNA, 25 bp, Mus musculus
aatatcaccatgttcctgcgaggaa

SEQ ID NO: 74447 - DNA, 25 bp, Mus musculus
aatatcactaataccatgctattta

SEQ ID NO: 74448 - DNA, 25 bp, Mus musculus
aatatcactaattccatgctattta

SEQ ID NO: 74449 - DNA, 25 bp, Mus musculus
aatatcactgacatggtgggactat

SEQ ID NO: 74450 - DNA, 25 bp, Mus musculus
aatatcactgacttggtgggactat

SEQ ID NO: 74451 - DNA, 25 bp, Mus musculus
aatatcactgtgaccttcagctgac

SEQ ID NO: 74452 - DNA, 25 bp, Mus musculus
aatatcactgtgtccttcagctgac

SEQ ID NO: 74453 - DNA, 25 bp, Mus musculus
aatatcacttacacgttaggcctgg

SEQ ID NO: 74454 - DNA, 25 bp, Mus musculus
aatatcacttactcgttaggcctgg

SEQ ID NO: 74455 - DNA, 25 bp, Mus musculus
aatatcagcaccagtcgcccaagga

SEQ ID NO: 74456 - DNA, 25 bp, Mus musculus
aatatcagcacctgtcgcccaagga

SEQ ID NO: 74457 - DNA, 25 bp, Mus musculus
aatatcagccttacatagcccagga

SEQ ID NO: 74458 - DNA, 25 bp, Mus musculus
aatatcagcctttcatagcccagga

SEQ ID NO: 74459 - DNA, 25 bp, Mus musculus
aatatcagctggaggctggcatcaa

SEQ ID NO: 74460 - DNA, 25 bp, Mus musculus
aatatcagctggtggctggcatcaa

SEQ ID NO: 74461 - DNA, 25 bp, Mus musculus
aatatcaggaggcactttctacgcc

SEQ ID NO: 74462 - DNA, 25 bp, Mus musculus
aatatcaggagggactttctacgcc

SEQ ID NO: 74463 - DNA, 25 bp, Mus musculus
aatatcaggcaactgctatgctcct

SEQ ID NO: 74464 - DNA, 25 bp, Mus musculus
aatatcaggcaagtgctatgctcct

SEQ ID NO: 74465 - DNA, 25 bp, Mus musculus
aatatcagtactacacactgctttg

SEQ ID NO: 74466 - DNA, 25 bp, Mus musculus
aatatcagtacttcacactgctttg

SEQ ID NO: 74467 - DNA, 25 bp, Mus musculus
aatatcagtctcaccttatcagagg

SEQ ID NO: 74468 - DNA, 25 bp, Mus musculus
aatatcagtctctccttatcagagg

SEQ ID NO: 74469 - DNA, 25 bp, Mus musculus
aatatcagtcttctttgtctagtac

SEQ ID NO: 74470 - DNA, 25 bp, Mus musculus
aatatcagtcttgtttgtctagtac

SEQ ID NO: 74471 - DNA, 25 bp, Mus musculus
aatatcagtgtgcaactggcttgca

SEQ ID NO: 74472 - DNA, 25 bp, Mus musculus
aatatcagtgtggaactggcttgca

SEQ ID NO: 74473 - DNA, 25 bp, Mus musculus
aatatcagttctacctgtattaatg

SEQ ID NO: 74474 - DNA, 25 bp, Mus musculus
aatatcagttcttcctgtattaatg

SEQ ID NO: 74475 - DNA, 25 bp, Mus musculus
aatatcataccaatccttgcctggt

SEQ ID NO: 74476 - DNA, 25 bp, Mus musculus
aatatcataccattccttgcctggt

SEQ ID NO: 74477 - DNA, 25 bp, Mus musculus
aatatcatcaccagccaggcgtgcc

SEQ ID NO: 74478 - DNA, 25 bp, Mus musculus
aatatcatcacctgccaggcgtgcc

SEQ ID NO: 74479 - DNA, 25 bp, Mus musculus
aatatcatcttcagtgttccagctc

SEQ ID NO: 74480 - DNA, 25 bp, Mus musculus
aatatcatcttctgtgttccagctc

SEQ ID NO: 74481 - DNA, 25 bp, Mus musculus
aatatccaaggcactgaagtcccct

SEQ ID NO: 74482 - DNA, 25 bp, Mus musculus
aatatccaaggcagggcccaggcat

SEQ ID NO: 74483 - DNA, 25 bp, Mus musculus
aatatccaaggctctgaagtcccct

SEQ ID NO: 74484 - DNA, 25 bp, Mus musculus
aatatccaaggctgggcccaggcat

SEQ ID NO: 74485 - DNA, 25 bp, Mus musculus
aatatccaatatactgcccttcaga

SEQ ID NO: 74486 - DNA, 25 bp, Mus musculus
aatatccaatattctgcccttcaga

SEQ ID NO: 74487 - DNA, 25 bp, Mus musculus
aatatccaatccaaagagcagtttt

SEQ ID NO: 74488 - DNA, 25 bp, Mus musculus
aatatccaatcctaagagcagtttt

SEQ ID NO: 74489 - DNA, 25 bp, Mus musculus
aatatccacgatcgatcgcttccta

SEQ ID NO: 74490 - DNA, 25 bp, Mus musculus
aatatccacgatggatcgcttccta

SEQ ID NO: 74491 - DNA, 25 bp, Mus musculus
aatatccagtgaccacttcctgttc

SEQ ID NO: 74492 - DNA, 25 bp, Mus musculus
aatatccagtgagcacttcctgttc

SEQ ID NO: 74493 - DNA, 25 bp, Mus musculus
aatatccatagcactgttggcctcg

SEQ ID NO: 74494 - DNA, 25 bp, Mus musculus
aatatccatagctctgttggcctcg

SEQ ID NO: 74495 - DNA, 25 bp, Mus musculus
aatatccatggcatagggttttatt

SEQ ID NO: 74496 - DNA, 25 bp, Mus musculus
aatatccatggcttagggttttatt

SEQ ID NO: 74497 - DNA, 25 bp, Mus musculus
aatatccatgtaacaatgcatcagt

SEQ ID NO: 74498 - DNA, 25 bp, Mus musculus
aatatccatgtatcaatgcatcagt

SEQ ID NO: 74499 - DNA, 25 bp, Mus musculus
aatatccattccatatctactacat

SEQ ID NO: 74500 - DNA, 25 bp, Mus musculus
aatatccattccttatctactacat

SEQ ID NO: 74501 - DNA, 25 bp, Mus musculus
aatatcccaacaattgcttccctga

SEQ ID NO: 74502 - DNA, 25 bp, Mus musculus
aatatcccaacacggcagctaaagg

SEQ ID NO: 74503 - DNA, 25 bp, Mus musculus
aatatcccaacagggcagctaaagg

SEQ ID NO: 74504 - DNA, 25 bp, Mus musculus
aatatcccaacatttgcttccctga

SEQ ID NO: 74505 - DNA, 25 bp, Mus musculus
aatatcccacaacccctacagattt

SEQ ID NO: 74506 - DNA, 25 bp, Mus musculus
aatatcccacaagccctacagattt

SEQ ID NO: 74507 - DNA, 25 bp, Mus musculus
aatatcccagaacagcgacagacag

SEQ ID NO: 74508 - DNA, 25 bp, Mus musculus
aatatcccagaagagcgacagacag

SEQ ID NO: 74509 - DNA, 25 bp, Mus musculus
aatatcccagggacaagaggtcaag

SEQ ID NO: 74510 - DNA, 25 bp, Mus musculus
aatatcccagggtcaagaggtcaag

SEQ ID NO: 74511 - DNA, 25 bp, Mus musculus
aatatcccagtaagtcagtttcaga

SEQ ID NO: 74512 - DNA, 25 bp, Mus musculus
aatatcccagtatgtcagtttcaga

SEQ ID NO: 74513 - DNA, 25 bp, Mus musculus
aatatcccagtgacaaacctatctt

SEQ ID NO: 74514 - DNA, 25 bp, Mus musculus
aatatcccagtgtcaaacctatctt

SEQ ID NO: 74515 - DNA, 25 bp, Mus musculus
aatatcccatgtcaggttacaggca

SEQ ID NO: 74516 - DNA, 25 bp, Mus musculus
aatatcccatgtgaggttacaggca

SEQ ID NO: 74517 - DNA, 25 bp, Mus musculus
aatatcccattgcttgtgtggcgcc

SEQ ID NO: 74518 - DNA, 25 bp, Mus musculus
aatatcccattggttgtgtggcgcc

SEQ ID NO: 74519 - DNA, 25 bp, Mus musculus
aatatccccatgctttgcaactcag

SEQ ID NO: 74520 - DNA, 25 bp, Mus musculus
aatatccccatggtttgcaactcag

SEQ ID NO: 74521 - DNA, 25 bp, Mus musculus
aatatccccttgactcttaggaggc

SEQ ID NO: 74522 - DNA, 25 bp, Mus musculus
aatatccccttgtctcttaggaggc

SEQ ID NO: 74523 - DNA, 25 bp, Mus musculus
aatatcccgagaaaatgaaatttgg

SEQ ID NO: 74524 - DNA, 25 bp, Mus musculus
aatatcccgagataatgaaatttgg

SEQ ID NO: 74525 - DNA, 25 bp, Mus musculus
aatatccctgcccaaatttgtgacc

SEQ ID NO: 74526 - DNA, 25 bp, Mus musculus
aatatccctgccgaaatttgtgacc

SEQ ID NO: 74527 - DNA, 25 bp, Mus musculus
aatatccgaatcagcactcaagtga

SEQ ID NO: 74528 - DNA, 25 bp, Mus musculus
aatatccgaatctgcactcaagtga

SEQ ID NO: 74529 - DNA, 25 bp, Mus musculus
aatatcctaaaaaccgtgcatggag

SEQ ID NO: 74530 - DNA, 25 bp, Mus musculus
aatatcctaaaatccgtgcatggag

SEQ ID NO: 74531 - DNA, 25 bp, Mus musculus
aatatcctaagcatcttcgcaacac

SEQ ID NO: 74532 - DNA, 25 bp, Mus musculus
aatatcctaagcttcttcgcaacac

SEQ ID NO: 74533 - DNA, 25 bp, Mus musculus
aatatcctaggaagattaccagctt

SEQ ID NO: 74534 - DNA, 25 bp, Mus musculus
aatatcctaggatgattaccagctt

SEQ ID NO: 74535 - DNA, 25 bp, Mus musculus
aatatcctcggaagagtgcgcccag

SEQ ID NO: 74536 - DNA, 25 bp, Mus musculus
aatatcctcggatgagtgcgcccag

SEQ ID NO: 74537 - DNA, 25 bp, Mus musculus
aatatcctcgtcatctgtgtgccaa

SEQ ID NO: 74538 - DNA, 25 bp, Mus musculus
aatatcctcgtcttctgtgtgccaa

SEQ ID NO: 74539 - DNA, 25 bp, Mus musculus
aatatcctctcaaccatcaagtggt

SEQ ID NO: 74540 - DNA, 25 bp, Mus musculus
aatatcctctcatccatcaagtggt

SEQ ID NO: 74541 - DNA, 25 bp, Mus musculus
aatatcctgaccatgctatagcttg

SEQ ID NO: 74542 - DNA, 25 bp, Mus musculus
aatatcctgaccttgctatagcttg

SEQ ID NO: 74543 - DNA, 25 bp, Mus musculus
aatatcctgactatccaggtccagg

SEQ ID NO: 74544 - DNA, 25 bp, Mus musculus
aatatcctgactttccaggtccagg

SEQ ID NO: 74545 - DNA, 25 bp, Mus musculus
aatatcctgatgcttcccatggcca

SEQ ID NO: 74546 - DNA, 25 bp, Mus musculus
aatatcctgatggttcccatggcca

SEQ ID NO: 74547 - DNA, 25 bp, Mus musculus
aatatcctgcaacacatagccaagt

SEQ ID NO: 74548 - DNA, 25 bp, Mus musculus
aatatcctgcaagacatagccaagt

SEQ ID NO: 74549 - DNA, 25 bp, Mus musculus
aatatcctgcccagggatgagctga

SEQ ID NO: 74550 - DNA, 25 bp, Mus musculus
aatatcctgccctgggatgagctga

SEQ ID NO: 74551 - DNA, 25 bp, Mus musculus
aatatcctggataactatacctagt

SEQ ID NO: 74552 - DNA, 25 bp, Mus musculus
aatatcctggattactatacctagt

SEQ ID NO: 74553 - DNA, 25 bp, Mus musculus
aatatcctggcaacatatcatcccg

SEQ ID NO: 74554 - DNA, 25 bp, Mus musculus
aatatcctggcatcatatcatcccg

SEQ ID NO: 74555 - DNA, 25 bp, Mus musculus
aatatcctggcgaactttgtgctat

SEQ ID NO: 74556 - DNA, 25 bp, Mus musculus
aatatcctggcgtactttgtgctat

SEQ ID NO: 74557 - DNA, 25 bp, Mus musculus
aatatcctggttcgctacaaagctg

SEQ ID NO: 74558 - DNA, 25 bp, Mus musculus
aatatcctggttggctacaaagctg

SEQ ID NO: 74559 - DNA, 25 bp, Mus musculus
aatatcctgtctaattttccagaat

SEQ ID NO: 74560 - DNA, 25 bp, Mus musculus
aatatcctgtcttattttccagaat

SEQ ID NO: 74561 - DNA, 25 bp, Mus musculus
aatatccttattaaacagtagtgtt

SEQ ID NO: 74562 - DNA, 25 bp, Mus musculus
aatatccttattctaccacctacgg

SEQ ID NO: 74563 - DNA, 25 bp, Mus musculus
aatatccttattgtaccacctacgg

SEQ ID NO: 74564 - DNA, 25 bp, Mus musculus
aatatccttatttaacagtagtgtt

SEQ ID NO: 74565 - DNA, 25 bp, Mus musculus
aatatccttctccttgctggtgggt

SEQ ID NO: 74566 - DNA, 25 bp, Mus musculus
aatatccttctcgttgctggtgggt

SEQ ID NO: 74567 - DNA, 25 bp, Mus musculus
aatatccttgcgctttcctttgcac

SEQ ID NO: 74568 - DNA, 25 bp, Mus musculus
aatatccttgcggtttcctttgcac

SEQ ID NO: 74569 - DNA, 25 bp, Mus musculus
aatatccttggtcacgttgtcgcca

SEQ ID NO: 74570 - DNA, 25 bp, Mus musculus
aatatccttggtgacgttgtcgcca

SEQ ID NO: 74571 - DNA, 25 bp, Mus musculus
aatatccttttaacttgccacatca

SEQ ID NO: 74572 - DNA, 25 bp, Mus musculus
aatatccttttatcttgccacatca

SEQ ID NO: 74573 - DNA, 25 bp, Mus musculus
aatatcgaaattaagagcagtctca

SEQ ID NO: 74574 - DNA, 25 bp, Mus musculus
aatatcgaaatttagagcagtctca

SEQ ID NO: 74575 - DNA, 25 bp, Mus musculus
aatatcgagattccacttgtagatg

SEQ ID NO: 74576 - DNA, 25 bp, Mus musculus
aatatcgagattgcacttgtagatg

SEQ ID NO: 74577 - DNA, 25 bp, Mus musculus
aatatctaaaatacctccgtgactg

SEQ ID NO: 74578 - DNA, 25 bp, Mus musculus
aatatctaaaattcctccgtgactg

SEQ ID NO: 74579 - DNA, 25 bp, Mus musculus
aatatctaagccaaatgctcaaagg

SEQ ID NO: 74580 - DNA, 25 bp, Mus musculus
aatatctaagcctaatgctcaaagg

SEQ ID NO: 74581 - DNA, 25 bp, Mus musculus
aatatctactttagccaggcctcaa

SEQ ID NO: 74582 - DNA, 25 bp, Mus musculus
aatatctacttttgccaggcctcaa

SEQ ID NO: 74583 - DNA, 25 bp, Mus musculus
aatatctagcccaaaggtaagttgc

SEQ ID NO: 74584 - DNA, 25 bp, Mus musculus
aatatctagccctaaggtaagttgc

SEQ ID NO: 74585 - DNA, 25 bp, Mus musculus
aatatctaggcaactgacactttca

SEQ ID NO: 74586 - DNA, 25 bp, Mus musculus
aatatctaggcatctgacactttca

SEQ ID NO: 74587 - DNA, 25 bp, Mus musculus
aatatctatattcctgacagacata

SEQ ID NO: 74588 - DNA, 25 bp, Mus musculus
aatatctatattgctgacagacata

SEQ ID NO: 74589 - DNA, 25 bp, Mus musculus
aatatctatgtacgagggactgcag

SEQ ID NO: 74590 - DNA, 25 bp, Mus musculus
aatatctatgtaggagggactgcag

SEQ ID NO: 74591 - DNA, 25 bp, Mus musculus
aatatctattgcattttctgagtca

SEQ ID NO: 74592 - DNA, 25 bp, Mus musculus
aatatctattgctttttctgagtca

SEQ ID NO: 74593 - DNA, 25 bp, Mus musculus
aatatctattttacaccctatgtag

SEQ ID NO: 74594 - DNA, 25 bp, Mus musculus
aatatctatttttcaccctatgtag

SEQ ID NO: 74595 - DNA, 25 bp, Mus musculus
aatatctcaatccagagtctcctct

SEQ ID NO: 74596 - DNA, 25 bp, Mus musculus
aatatctcaatcgagagtctcctct

SEQ ID NO: 74597 - DNA, 25 bp, Mus musculus
aatatctcacagactaacagcagct

SEQ ID NO: 74598 - DNA, 25 bp, Mus musculus
aatatctcacagtctaacagcagct

SEQ ID NO: 74599 - DNA, 25 bp, Mus musculus
aatatctcatatctctcatcatcaa

SEQ ID NO: 74600 - DNA, 25 bp, Mus musculus
aatatctcatatgtctcatcatcaa

SEQ ID NO: 74601 - DNA, 25 bp, Mus musculus
aatatctcattcacaatgccaccca

SEQ ID NO: 74602 - DNA, 25 bp, Mus musculus
aatatctcattctcaatgccaccca

SEQ ID NO: 74603 - DNA, 25 bp, Mus musculus
aatatctcatttacacaggcactgt

SEQ ID NO: 74604 - DNA, 25 bp, Mus musculus
aatatctcattttcacaggcactgt

SEQ ID NO: 74605 - DNA, 25 bp, Mus musculus
aatatctccaatcttcgttgttcga

SEQ ID NO: 74606 - DNA, 25 bp, Mus musculus
aatatctccaatgttcgttgttcga

SEQ ID NO: 74607 - DNA, 25 bp, Mus musculus
aatatctccaggaccgaatcactct

SEQ ID NO: 74608 - DNA, 25 bp, Mus musculus
aatatctccaggtccgaatcactct

SEQ ID NO: 74609 - DNA, 25 bp, Mus musculus
aatatctcctctcacagacatatgc

SEQ ID NO: 74610 - DNA, 25 bp, Mus musculus
aatatctcctctgacagacatatgc

SEQ ID NO: 74611 - DNA, 25 bp, Mus musculus
aatatctctttcactcagagggctc

SEQ ID NO: 74612 - DNA, 25 bp, Mus musculus
aatatctctttctctcagagggctc

SEQ ID NO: 74613 - DNA, 25 bp, Mus musculus
aatatctctttgacaagcacaccct

SEQ ID NO: 74614 - DNA, 25 bp, Mus musculus
aatatctctttgtcaagcacaccct

SEQ ID NO: 74615 - DNA, 25 bp, Mus musculus
aatatctgcgcgatatttgtagaat

SEQ ID NO: 74616 - DNA, 25 bp, Mus musculus
aatatctgcgcgttatttgtagaat

SEQ ID NO: 74617 - DNA, 25 bp, Mus musculus
aatatctgctttccaaatcggctaa

SEQ ID NO: 74618 - DNA, 25 bp, Mus musculus
aatatctgctttgcaaatcggctaa

SEQ ID NO: 74619 - DNA, 25 bp, Mus musculus
aatatctggtatcgcttctcggtgc

SEQ ID NO: 74620 - DNA, 25 bp, Mus musculus
aatatctggtatctttgctgtctaa

SEQ ID NO: 74621 - DNA, 25 bp, Mus musculus
aatatctggtatggcttctcggtgc

SEQ ID NO: 74622 - DNA, 25 bp, Mus musculus
aatatctggtatgtttgctgtctaa

SEQ ID NO: 74623 - DNA, 25 bp, Mus musculus
aatatctgtaatcttatttcatgct

SEQ ID NO: 74624 - DNA, 25 bp, Mus musculus
aatatctgtaatgttatttcatgct

SEQ ID NO: 74625 - DNA, 25 bp, Mus musculus
aatatctgtcatactactctgttac

SEQ ID NO: 74626 - DNA, 25 bp, Mus musculus
aatatctgtcattctactctgttac

SEQ ID NO: 74627 - DNA, 25 bp, Mus musculus
aatatctgtggcctgcaaggcccat

SEQ ID NO: 74628 - DNA, 25 bp, Mus musculus
aatatctgtggcgtgcaaggcccat

SEQ ID NO: 74629 - DNA, 25 bp, Mus musculus
aatatctgtgtaactgccaaatgtg

SEQ ID NO: 74630 - DNA, 25 bp, Mus musculus
aatatctgtgtatctgccaaatgtg

SEQ ID NO: 74631 - DNA, 25 bp, Mus musculus
aatatctgttctcagatgtccccag

SEQ ID NO: 74632 - DNA, 25 bp, Mus musculus
aatatctgttctgagatgtccccag

SEQ ID NO: 74633 - DNA, 25 bp, Mus musculus
aatatcttaatgagtctcgctggtt

SEQ ID NO: 74634 - DNA, 25 bp, Mus musculus
aatatcttaatgtgtctcgctggtt

SEQ ID NO: 74635 - DNA, 25 bp, Mus musculus
aatatcttaccacacttaatagttt

SEQ ID NO: 74636 - DNA, 25 bp, Mus musculus
aatatcttaccagacttaatagttt

SEQ ID NO: 74637 - DNA, 25 bp, Mus musculus
aatatcttccttacgtcatctggac

SEQ ID NO: 74638 - DNA, 25 bp, Mus musculus
aatatcttcctttcgtcatctggac

SEQ ID NO: 74639 - DNA, 25 bp, Mus musculus
aatatcttctccaggctccgacagg

SEQ ID NO: 74640 - DNA, 25 bp, Mus musculus
aatatcttctcctggctccgacagg

SEQ ID NO: 74641 - DNA, 25 bp, Mus musculus
aatatcttctgtattctgccttctg

SEQ ID NO: 74642 - DNA, 25 bp, Mus musculus
aatatcttctgtcaaccatacccct

SEQ ID NO: 74643 - DNA, 25 bp, Mus musculus
aatatcttctgtgaaccatacccct

SEQ ID NO: 74644 - DNA, 25 bp, Mus musculus
aatatcttctgttttctgccttctg

SEQ ID NO: 74645 - DNA, 25 bp, Mus musculus
aatatcttgactacagtgctactgt

SEQ ID NO: 74646 - DNA, 25 bp, Mus musculus
aatatcttgacttcagtgctactgt

SEQ ID NO: 74647 - DNA, 25 bp, Mus musculus
aatatcttgatgatgggttgtccca

SEQ ID NO: 74648 - DNA, 25 bp, Mus musculus
aatatcttgatgttgggttgtccca

SEQ ID NO: 74649 - DNA, 25 bp, Mus musculus
aatatcttttctcttttaacattga

SEQ ID NO: 74650 - DNA, 25 bp, Mus musculus
aatatcttttctgttttaacattga

SEQ ID NO: 74651 - DNA, 25 bp, Mus musculus
aatatgaacctgcaggccacgttga

SEQ ID NO: 74652 - DNA, 25 bp, Mus musculus
aatatgaacctggaggccacgttga

SEQ ID NO: 74653 - DNA, 25 bp, Mus musculus
aatatgaaggccatccctgcaccaa

SEQ ID NO: 74654 - DNA, 25 bp, Mus musculus
aatatgaaggccttccctgcaccaa

SEQ ID NO: 74655 - DNA, 25 bp, Mus musculus
aatatgaaggctctgtaatgactac

SEQ ID NO: 74656 - DNA, 25 bp, Mus musculus
aatatgaaggctgtgtaatgactac

SEQ ID NO: 74657 - DNA, 25 bp, Mus musculus
aatatgaatacccagatgagctcca

SEQ ID NO: 74658 - DNA, 25 bp, Mus musculus
aatatgaataccgagatgagctcca

SEQ ID NO: 74659 - DNA, 25 bp, Mus musculus
aatatgaatcttattgtgcactaac

SEQ ID NO: 74660 - DNA, 25 bp, Mus musculus
aatatgaatctttttgtgcactaac

SEQ ID NO: 74661 - DNA, 25 bp, Mus musculus
aatatgacaggcatcagtcgctctt

SEQ ID NO: 74662 - DNA, 25 bp, Mus musculus
aatatgacaggcttcagtcgctctt

SEQ ID NO: 74663 - DNA, 25 bp, Mus musculus
aatatgacatggagatgggcgagaa

SEQ ID NO: 74664 - DNA, 25 bp, Mus musculus
aatatgacatggtgatgggcgagaa

SEQ ID NO: 74665 - DNA, 25 bp, Mus musculus
aatatgaccaagacattctgcccct

SEQ ID NO: 74666 - DNA, 25 bp, Mus musculus
aatatgaccaagtcattctgcccct

SEQ ID NO: 74667 - DNA, 25 bp, Mus musculus
aatatgacggatcgccggagttgct

SEQ ID NO: 74668 - DNA, 25 bp, Mus musculus
aatatgacggatggccggagttgct

SEQ ID NO: 74669 - DNA, 25 bp, Mus musculus
aatatgacggctaggccaaccagca

SEQ ID NO: 74670 - DNA, 25 bp, Mus musculus
aatatgacggcttggccaaccagca

SEQ ID NO: 74671 - DNA, 25 bp, Mus musculus
aatatgactaacagtttactggaca

SEQ ID NO: 74672 - DNA, 25 bp, Mus musculus
aatatgactaactgtttactggaca

SEQ ID NO: 74673 - DNA, 25 bp, Mus musculus
aatatgacttgaacttggcgtacta

SEQ ID NO: 74674 - DNA, 25 bp, Mus musculus
aatatgacttgatcttggcgtacta

SEQ ID NO: 74675 - DNA, 25 bp, Mus musculus
aatatgagatagacggccgcgatta

SEQ ID NO: 74676 - DNA, 25 bp, Mus musculus
aatatgagatagtcggccgcgatta

SEQ ID NO: 74677 - DNA, 25 bp, Mus musculus
aatatgagccagaagcatttgtttg

SEQ ID NO: 74678 - DNA, 25 bp, Mus musculus
aatatgagccagtagcatttgtttg

SEQ ID NO: 74679 - DNA, 25 bp, Mus musculus
aatatgagctgcagccctagcaacc

SEQ ID NO: 74680 - DNA, 25 bp, Mus musculus
aatatgagctgctgccctagcaacc

SEQ ID NO: 74681 - DNA, 25 bp, Mus musculus
aatatgatatttcaccatctccaga

SEQ ID NO: 74682 - DNA, 25 bp, Mus musculus
aatatgatatttgaccatctccaga

SEQ ID NO: 74683 - DNA, 25 bp, Mus musculus
aatatgatcaagagcaccatccccg

SEQ ID NO: 74684 - DNA, 25 bp, Mus musculus
aatatgatcaagtgcaccatccccg

SEQ ID NO: 74685 - DNA, 25 bp, Mus musculus
aatatgatcgctatctatgagtaca

SEQ ID NO: 74686 - DNA, 25 bp, Mus musculus
aatatgatcgctttctatgagtaca

SEQ ID NO: 74687 - DNA, 25 bp, Mus musculus
aatatgatcgttactagttccatcc

SEQ ID NO: 74688 - DNA, 25 bp, Mus musculus
aatatgatcgtttctagttccatcc

SEQ ID NO: 74689 - DNA, 25 bp, Mus musculus
aatatgatctcacctatacctagca

SEQ ID NO: 74690 - DNA, 25 bp, Mus musculus
aatatgatctcagctatacctagca

SEQ ID NO: 74691 - DNA, 25 bp, Mus musculus
aatatgatcttcagctgtactgtaa

SEQ ID NO: 74692 - DNA, 25 bp, Mus musculus
aatatgatcttctgctgtactgtaa

SEQ ID NO: 74693 - DNA, 25 bp, Mus musculus
aatatgatgagcaggcagagcccca

SEQ ID NO: 74694 - DNA, 25 bp, Mus musculus
aatatgatgagctggcagagcccca

SEQ ID NO: 74695 - DNA, 25 bp, Mus musculus
aatatgattatcataagcccaaagg

SEQ ID NO: 74696 - DNA, 25 bp, Mus musculus
aatatgattatcttaagcccaaagg

SEQ ID NO: 74697 - DNA, 25 bp, Mus musculus
aatatgattcctaccccccacatga

SEQ ID NO: 74698 - DNA, 25 bp, Mus musculus
aatatgattcctctgcatagacaat

SEQ ID NO: 74699 - DNA, 25 bp, Mus musculus
aatatgattcctgtgcatagacaat

SEQ ID NO: 74700 - DNA, 25 bp, Mus musculus
aatatgattccttccccccacatga

SEQ ID NO: 74701 - DNA, 25 bp, Mus musculus
aatatgatttcaattgctgttcaaa

SEQ ID NO: 74702 - DNA, 25 bp, Mus musculus
aatatgatttcatttgctgttcaaa

SEQ ID NO: 74703 - DNA, 25 bp, Mus musculus
aatatgatttttcccctgttgtttt

SEQ ID NO: 74704 - DNA, 25 bp, Mus musculus
aatatgatttttgccctgttgtttt

SEQ ID NO: 74705 - DNA, 25 bp, Mus musculus
aatatgcaatagaccctgtgggtgt

SEQ ID NO: 74706 - DNA, 25 bp, Mus musculus
aatatgcaatagtccctgtgggtgt

SEQ ID NO: 74707 - DNA, 25 bp, Mus musculus
aatatgcagagtcaccgcggagatg

SEQ ID NO: 74708 - DNA, 25 bp, Mus musculus
aatatgcagagtgaccgcggagatg

SEQ ID NO: 74709 - DNA, 25 bp, Mus musculus
aatatgcagcctattctttccacga

SEQ ID NO: 74710 - DNA, 25 bp, Mus musculus
aatatgcagccttttctttccacga

SEQ ID NO: 74711 - DNA, 25 bp, Mus musculus
aatatgcagctaaccctgggacttt

SEQ ID NO: 74712 - DNA, 25 bp, Mus musculus
aatatgcagctatccctgggacttt

SEQ ID NO: 74713 - DNA, 25 bp, Mus musculus
aatatgcagctcatattccaaaggg

SEQ ID NO: 74714 - DNA, 25 bp, Mus musculus
aatatgcagctcttattccaaaggg

SEQ ID NO: 74715 - DNA, 25 bp, Mus musculus
aatatgcatgcacctcttagatttc

SEQ ID NO: 74716 - DNA, 25 bp, Mus musculus
aatatgcatgcagctcttagatttc

SEQ ID NO: 74717 - DNA, 25 bp, Mus musculus
aatatgccagccatgctcagtgatg

SEQ ID NO: 74718 - DNA, 25 bp, Mus musculus
aatatgccagccttgctcagtgatg

SEQ ID NO: 74719 - DNA, 25 bp, Mus musculus
aatatgccatggatatttgccagag

SEQ ID NO: 74720 - DNA, 25 bp, Mus musculus
aatatgccatggttatttgccagag

SEQ ID NO: 74721 - DNA, 25 bp, Mus musculus
aatatgcccaccatcagggagcagc

SEQ ID NO: 74722 - DNA, 25 bp, Mus musculus
aatatgcccaccttcagggagcagc

SEQ ID NO: 74723 - DNA, 25 bp, Mus musculus
aatatgcccaggatcagtaaataaa

SEQ ID NO: 74724 - DNA, 25 bp, Mus musculus
aatatgcccaggttcagtaaataaa

SEQ ID NO: 74725 - DNA, 25 bp, Mus musculus
aatatgccccgcagggtatttgtaa

SEQ ID NO: 74726 - DNA, 25 bp, Mus musculus
aatatgccccgctgggtatttgtaa

SEQ ID NO: 74727 - DNA, 25 bp, Mus musculus
aatatgcctccaacagatagtcagt

SEQ ID NO: 74728 - DNA, 25 bp, Mus musculus
aatatgcctccatcagatagtcagt

SEQ ID NO: 74729 - DNA, 25 bp, Mus musculus
aatatgcgagacatcacaatgaggg

SEQ ID NO: 74730 - DNA, 25 bp, Mus musculus
aatatgcgagacttcacaatgaggg

SEQ ID NO: 74731 - DNA, 25 bp, Mus musculus
aatatgcgagctctcttcttctttg

SEQ ID NO: 74732 - DNA, 25 bp, Mus musculus
aatatgcgagctgtcttcttctttg

SEQ ID NO: 74733 - DNA, 25 bp, Mus musculus
aatatgcgcattcactttgcagtgt

SEQ ID NO: 74734 - DNA, 25 bp, Mus musculus
aatatgcgcattgactttgcagtgt

SEQ ID NO: 74735 - DNA, 25 bp, Mus musculus
aatatgcgtgtacatatattttcct

SEQ ID NO: 74736 - DNA, 25 bp, Mus musculus
aatatgcgtgtagatatattttcct

SEQ ID NO: 74737 - DNA, 25 bp, Mus musculus
aatatgctacagaacatctaggctg

SEQ ID NO: 74738 - DNA, 25 bp, Mus musculus
aatatgctacagtacatctaggctg

SEQ ID NO: 74739 - DNA, 25 bp, Mus musculus
aatatgctagttcggccgctaatca

SEQ ID NO: 74740 - DNA, 25 bp, Mus musculus
aatatgctagttgggccgctaatca

SEQ ID NO: 74741 - DNA, 25 bp, Mus musculus
aatatgctcactagtgtatttcttg

SEQ ID NO: 74742 - DNA, 25 bp, Mus musculus
aatatgctcacttgtgtatttcttg

SEQ ID NO: 74743 - DNA, 25 bp, Mus musculus
aatatgctcattataatttacctgg

SEQ ID NO: 74744 - DNA, 25 bp, Mus musculus
aatatgctcattttaatttacctgg

SEQ ID NO: 74745 - DNA, 25 bp, Mus musculus
aatatgctcttcagacttcctcaaa

SEQ ID NO: 74746 - DNA, 25 bp, Mus musculus
aatatgctcttctgacttcctcaaa

SEQ ID NO: 74747 - DNA, 25 bp, Mus musculus
aatatgctgaacctggatggtccca

SEQ ID NO: 74748 - DNA, 25 bp, Mus musculus
aatatgctgaacgtggatggtccca

SEQ ID NO: 74749 - DNA, 25 bp, Mus musculus
aatatgctgtacaactccaggtcca

SEQ ID NO: 74750 - DNA, 25 bp, Mus musculus
aatatgctgtactactccaggtcca

SEQ ID NO: 74751 - DNA, 25 bp, Mus musculus
aatatgcttcttacattcctctctg

SEQ ID NO: 74752 - DNA, 25 bp, Mus musculus
aatatgcttctttcattcctctctg

SEQ ID NO: 74753 - DNA, 25 bp, Mus musculus
aatatgcttgtacaacttcctgcct

SEQ ID NO: 74754 - DNA, 25 bp, Mus musculus
aatatgcttgtagaacttcctgcct

SEQ ID NO: 74755 - DNA, 25 bp, Mus musculus
aatatgctttagagcattgccaagg

SEQ ID NO: 74756 - DNA, 25 bp, Mus musculus
aatatgctttagtgcattgccaagg

SEQ ID NO: 74757 - DNA, 25 bp, Mus musculus
aatatgcttttgcactgcccttcta

SEQ ID NO: 74758 - DNA, 25 bp, Mus musculus
aatatgcttttggactgcccttcta

SEQ ID NO: 74759 - DNA, 25 bp, Mus musculus
aatatggaaattcgcttatactata

SEQ ID NO: 74760 - DNA, 25 bp, Mus musculus
aatatggaaattggcttatactata

SEQ ID NO: 74761 - DNA, 25 bp, Mus musculus
aatatggaattgacacccatcatca

SEQ ID NO: 74762 - DNA, 25 bp, Mus musculus
aatatggaattgtcacccatcatca

SEQ ID NO: 74763 - DNA, 25 bp, Mus musculus
aatatggaccagaggtttctctgct

SEQ ID NO: 74764 - DNA, 25 bp, Mus musculus
aatatggaccagctgactcctgtat

SEQ ID NO: 74765 - DNA, 25 bp, Mus musculus
aatatggaccaggtgactcctgtat

SEQ ID NO: 74766 - DNA, 25 bp, Mus musculus
aatatggaccagtggtttctctgct

SEQ ID NO: 74767 - DNA, 25 bp, Mus musculus
aatatggacctaatcgtcaaatcag

SEQ ID NO: 74768 - DNA, 25 bp, Mus musculus
aatatggacctattcgtcaaatcag

SEQ ID NO: 74769 - DNA, 25 bp, Mus musculus
aatatggcacatatggtccgcactg

SEQ ID NO: 74770 - DNA, 25 bp, Mus musculus
aatatggcacatttggtccgcactg

SEQ ID NO: 74771 - DNA, 25 bp, Mus musculus
aatatggcacccatgggttgctgag

SEQ ID NO: 74772 - DNA, 25 bp, Mus musculus
aatatggcacccttgggttgctgag

SEQ ID NO: 74773 - DNA, 25 bp, Mus musculus
aatatggcagcaattggccgccact

SEQ ID NO: 74774 - DNA, 25 bp, Mus musculus
aatatggcagcatttggccgccact

SEQ ID NO: 74775 - DNA, 25 bp, Mus musculus
aatatggcatcactagcaccctcag

SEQ ID NO: 74776 - DNA, 25 bp, Mus musculus
aatatggcatcagtagcaccctcag

SEQ ID NO: 74777 - DNA, 25 bp, Mus musculus
aatatggcatctatcgatttctgta

SEQ ID NO: 74778 - DNA, 25 bp, Mus musculus
aatatggcatctttcgatttctgta

SEQ ID NO: 74779 - DNA, 25 bp, Mus musculus
aatatggcttggcatgggctcgaat

SEQ ID NO: 74780 - DNA, 25 bp, Mus musculus
aatatggcttgggatgggctcgaat

SEQ ID NO: 74781 - DNA, 25 bp, Mus musculus
aatatgggaactctttgtttagtgc

SEQ ID NO: 74782 - DNA, 25 bp, Mus musculus
aatatgggaactgtttgtttagtgc

SEQ ID NO: 74783 - DNA, 25 bp, Mus musculus
aatatgggatggctccaagctggtc

SEQ ID NO: 74784 - DNA, 25 bp, Mus musculus
aatatgggatgggtccaagctggtc

SEQ ID NO: 74785 - DNA, 25 bp, Mus musculus
aatatgggcatcattgtgtcacact

SEQ ID NO: 74786 - DNA, 25 bp, Mus musculus
aatatgggcatctttgtgtcacact

SEQ ID NO: 74787 - DNA, 25 bp, Mus musculus
aatatgggcatgacttttctataga

SEQ ID NO: 74788 - DNA, 25 bp, Mus musculus
aatatgggcatgtcttttctataga

SEQ ID NO: 74789 - DNA, 25 bp, Mus musculus
aatatgggtcctatcagtttccagc

SEQ ID NO: 74790 - DNA, 25 bp, Mus musculus
aatatgggtcctttcagtttccagc

SEQ ID NO: 74791 - DNA, 25 bp, Mus musculus
aatatggtaacccagcagctttgag

SEQ ID NO: 74792 - DNA, 25 bp, Mus musculus
aatatggtaaccgagcagctttgag

SEQ ID NO: 74793 - DNA, 25 bp, Mus musculus
aatatggtcaccaactggctattaa

SEQ ID NO: 74794 - DNA, 25 bp, Mus musculus
aatatggtcacctactggctattaa

SEQ ID NO: 74795 - DNA, 25 bp, Mus musculus
aatatggtgccacacagctgggccc

SEQ ID NO: 74796 - DNA, 25 bp, Mus musculus
aatatggtgccagacagctgggccc

SEQ ID NO: 74797 - DNA, 25 bp, Mus musculus
aatatggtgcctcgaatctgctgct

SEQ ID NO: 74798 - DNA, 25 bp, Mus musculus
aatatggtgcctggaatctgctgct

SEQ ID NO: 74799 - DNA, 25 bp, Mus musculus
aatatggtgctaccattcagactca

SEQ ID NO: 74800 - DNA, 25 bp, Mus musculus
aatatggtgctagcattcagactca

SEQ ID NO: 74801 - DNA, 25 bp, Mus musculus
aatatggtggccagagaggctcact

SEQ ID NO: 74802 - DNA, 25 bp, Mus musculus
aatatggtggcctgagaggctcact

SEQ ID NO: 74803 - DNA, 25 bp, Mus musculus
aatatggtggctcactgttctgcca

SEQ ID NO: 74804 - DNA, 25 bp, Mus musculus
aatatggtggctgactgttctgcca

SEQ ID NO: 74805 - DNA, 25 bp, Mus musculus
aatatggttctgatctgtcatctca

SEQ ID NO: 74806 - DNA, 25 bp, Mus musculus
aatatggttctgttctgtcatctca

SEQ ID NO: 74807 - DNA, 25 bp, Mus musculus
aatatggttgtcatcatgttaaaac

SEQ ID NO: 74808 - DNA, 25 bp, Mus musculus
aatatggttgtcttcatgttaaaac

SEQ ID NO: 74809 - DNA, 25 bp, Mus musculus
aatatggtttggatggcaacataaa

SEQ ID NO: 74810 - DNA, 25 bp, Mus musculus
aatatggtttggttggcaacataaa

SEQ ID NO: 74811 - DNA, 25 bp, Mus musculus
aatatgtacattactgcttgttgtt

SEQ ID NO: 74812 - DNA, 25 bp, Mus musculus
aatatgtacatttctgcttgttgtt

SEQ ID NO: 74813 - DNA, 25 bp, Mus musculus
aatatgtaccagaattatttgcaga

SEQ ID NO: 74814 - DNA, 25 bp, Mus musculus
aatatgtaccagtattatttgcaga

SEQ ID NO: 74815 - DNA, 25 bp, Mus musculus
aatatgtactcgctcatagtaggag

SEQ ID NO: 74816 - DNA, 25 bp, Mus musculus
aatatgtactcggtcatagtaggag

SEQ ID NO: 74817 - DNA, 25 bp, Mus musculus
aatatgtagcttagtgggttatgac

SEQ ID NO: 74818 - DNA, 25 bp, Mus musculus
aatatgtagctttgtgggttatgac

SEQ ID NO: 74819 - DNA, 25 bp, Mus musculus
aatatgtatcgaccttctaccccaa

SEQ ID NO: 74820 - DNA, 25 bp, Mus musculus
aatatgtatcgagcttctaccccaa

SEQ ID NO: 74821 - DNA, 25 bp, Mus musculus
aatatgtcaaggactcacgagccag

SEQ ID NO: 74822 - DNA, 25 bp, Mus musculus
aatatgtcaaggtctcacgagccag

SEQ ID NO: 74823 - DNA, 25 bp, Mus musculus
aatatgtcagctagaggtaaagtac

SEQ ID NO: 74824 - DNA, 25 bp, Mus musculus
aatatgtcagcttgaggtaaagtac

SEQ ID NO: 74825 - DNA, 25 bp, Mus musculus
aatatgtccaggctttcaaaacatt

SEQ ID NO: 74826 - DNA, 25 bp, Mus musculus
aatatgtccagggtttcaaaacatt

SEQ ID NO: 74827 - DNA, 25 bp, Mus musculus
aatatgtcctccagcagtccccaag

SEQ ID NO: 74828 - DNA, 25 bp, Mus musculus
aatatgtcctcctgcagtccccaag

SEQ ID NO: 74829 - DNA, 25 bp, Mus musculus
aatatgtcctgcagagaggtgtcca

SEQ ID NO: 74830 - DNA, 25 bp, Mus musculus
aatatgtcctgctgagaggtgtcca

SEQ ID NO: 74831 - DNA, 25 bp, Mus musculus
aatatgtctgacctgaaacaaggga

SEQ ID NO: 74832 - DNA, 25 bp, Mus musculus
aatatgtctgacgtgaaacaaggga

SEQ ID NO: 74833 - DNA, 25 bp, Mus musculus
aatatgtcttccagtgcacggacgg

SEQ ID NO: 74834 - DNA, 25 bp, Mus musculus
aatatgtcttcctgtgcacggacgg

SEQ ID NO: 74835 - DNA, 25 bp, Mus musculus
aatatgtcttggattcttctgtgtc

SEQ ID NO: 74836 - DNA, 25 bp, Mus musculus
aatatgtcttggtttcttctgtgtc

SEQ ID NO: 74837 - DNA, 25 bp, Mus musculus
aatatgtgacccaaactaagttcgt

SEQ ID NO: 74838 - DNA, 25 bp, Mus musculus
aatatgtgaccctaactaagttcgt

SEQ ID NO: 74839 - DNA, 25 bp, Mus musculus
aatatgtgagccagtggcggccatt

SEQ ID NO: 74840 - DNA, 25 bp, Mus musculus
aatatgtgagcctgtggcggccatt

SEQ ID NO: 74841 - DNA, 25 bp, Mus musculus
aatatgtgcactatgctcttagaga

SEQ ID NO: 74842 - DNA, 25 bp, Mus musculus
aatatgtgcactttgctcttagaga

SEQ ID NO: 74843 - DNA, 25 bp, Mus musculus
aatatgtgcagtatacctgtcatct

SEQ ID NO: 74844 - DNA, 25 bp, Mus musculus
aatatgtgcagtttacctgtcatct

SEQ ID NO: 74845 - DNA, 25 bp, Mus musculus
aatatgtgctttctaccacacccag

SEQ ID NO: 74846 - DNA, 25 bp, Mus musculus
aatatgtgctttgtaccacacccag

SEQ ID NO: 74847 - DNA, 25 bp, Mus musculus
aatatgtggatgaagcctccaagaa

SEQ ID NO: 74848 - DNA, 25 bp, Mus musculus
aatatgtggatgtagcctccaagaa

SEQ ID NO: 74849 - DNA, 25 bp, Mus musculus
aatatgtgtaatacccaagctcaca

SEQ ID NO: 74850 - DNA, 25 bp, Mus musculus
aatatgtgtaattcccaagctcaca

SEQ ID NO: 74851 - DNA, 25 bp, Mus musculus
aatatgtgtggcaatccttcagata

SEQ ID NO: 74852 - DNA, 25 bp, Mus musculus
aatatgtgtggctatccttcagata

SEQ ID NO: 74853 - DNA, 25 bp, Mus musculus
aatatgtgttcactgtcatgactgt

SEQ ID NO: 74854 - DNA, 25 bp, Mus musculus
aatatgtgttcagtgtcatgactgt

SEQ ID NO: 74855 - DNA, 25 bp, Mus musculus
aatatgttcaatacttttcactcaa

SEQ ID NO: 74856 - DNA, 25 bp, Mus musculus
aatatgttcaattcttttcactcaa

SEQ ID NO: 74857 - DNA, 25 bp, Mus musculus
aatatgttcagcatattcatacctg

SEQ ID NO: 74858 - DNA, 25 bp, Mus musculus
aatatgttcagcttattcatacctg

SEQ ID NO: 74859 - DNA, 25 bp, Mus musculus
aatatgttcagtactttcatggtca

SEQ ID NO: 74860 - DNA, 25 bp, Mus musculus
aatatgttcagttctttcatggtca

SEQ ID NO: 74861 - DNA, 25 bp, Mus musculus
aatatgttcattagttccctggcca

SEQ ID NO: 74862 - DNA, 25 bp, Mus musculus
aatatgttcatttgttccctggcca

SEQ ID NO: 74863 - DNA, 25 bp, Mus musculus
aatatgttcccaagtccccactttc

SEQ ID NO: 74864 - DNA, 25 bp, Mus musculus
aatatgttcccatgtccccactttc

SEQ ID NO: 74865 - DNA, 25 bp, Mus musculus
aatatgttcgttcttagtaccacca

SEQ ID NO: 74866 - DNA, 25 bp, Mus musculus
aatatgttcgttgttagtaccacca

SEQ ID NO: 74867 - DNA, 25 bp, Mus musculus
aatatgttcttacatcctcatcacc

SEQ ID NO: 74868 - DNA, 25 bp, Mus musculus
aatatgttcttagatcctcatcacc

SEQ ID NO: 74869 - DNA, 25 bp, Mus musculus
aatatgttgcttcccctgatttttt

SEQ ID NO: 74870 - DNA, 25 bp, Mus musculus
aatatgttgcttgccctgatttttt

SEQ ID NO: 74871 - DNA, 25 bp, Mus musculus
aatatgtttcccattggcttatagt

SEQ ID NO: 74872 - DNA, 25 bp, Mus musculus
aatatgtttccctttggcttatagt

SEQ ID NO: 74873 - DNA, 25 bp, Mus musculus
aatatgtttctcacacaggctctga

SEQ ID NO: 74874 - DNA, 25 bp, Mus musculus
aatatgtttctctcacaggctctga

SEQ ID NO: 74875 - DNA, 25 bp, Mus musculus
aatatgtttgttacacttccctaat

SEQ ID NO: 74876 - DNA, 25 bp, Mus musculus
aatatgtttgtttcacttccctaat

SEQ ID NO: 74877 - DNA, 25 bp, Mus musculus
aatattaaactcctatgtaatctag

SEQ ID NO: 74878 - DNA, 25 bp, Mus musculus
aatattaaactcgtatgtaatctag

SEQ ID NO: 74879 - DNA, 25 bp, Mus musculus
aatattaaagtcacgcagacctagt

SEQ ID NO: 74880 - DNA, 25 bp, Mus musculus
aatattaaagtctcgcagacctagt

SEQ ID NO: 74881 - DNA, 25 bp, Mus musculus
aatattaacagtcttgatacctcaa

SEQ ID NO: 74882 - DNA, 25 bp, Mus musculus
aatattaacagtgttgatacctcaa

SEQ ID NO: 74883 - DNA, 25 bp, Mus musculus
aatattaacgtcaagttgttctata

SEQ ID NO: 74884 - DNA, 25 bp, Mus musculus
aatattaacgtctagttgttctata

SEQ ID NO: 74885 - DNA, 25 bp, Mus musculus
aatattaactttccatgtgctgcca

SEQ ID NO: 74886 - DNA, 25 bp, Mus musculus
aatattaactttgcatgtgctgcca

SEQ ID NO: 74887 - DNA, 25 bp, Mus musculus
aatattaatcaactagtgttcacag

SEQ ID NO: 74888 - DNA, 25 bp, Mus musculus
aatattaatcaagtagtgttcacag

SEQ ID NO: 74889 - DNA, 25 bp, Mus musculus
aatattaatcagctccttttacagg

SEQ ID NO: 74890 - DNA, 25 bp, Mus musculus
aatattaatcaggtccttttacagg

SEQ ID NO: 74891 - DNA, 25 bp, Mus musculus
aatattaatccacccgcagaagcac

SEQ ID NO: 74892 - DNA, 25 bp, Mus musculus
aatattaatccagccgcagaagcac

SEQ ID NO: 74893 - DNA, 25 bp, Mus musculus
aatattacagcgactgtgcccggga

SEQ ID NO: 74894 - DNA, 25 bp, Mus musculus
aatattacagcgtctgtgcccggga

SEQ ID NO: 74895 - DNA, 25 bp, Mus musculus
aatattactaaacactgtattggtg

SEQ ID NO: 74896 - DNA, 25 bp, Mus musculus
aatattactaaagactgtattggtg

SEQ ID NO: 74897 - DNA, 25 bp, Mus musculus
aatattactgtcctcatgactccac

SEQ ID NO: 74898 - DNA, 25 bp, Mus musculus
aatattactgtcgtcatgactccac

SEQ ID NO: 74899 - DNA, 25 bp, Mus musculus
aatattagccatccatttattatgt

SEQ ID NO: 74900 - DNA, 25 bp, Mus musculus
aatattagccatgcatttattatgt

SEQ ID NO: 74901 - DNA, 25 bp, Mus musculus
aatattataaacaccctggtccagg

SEQ ID NO: 74902 - DNA, 25 bp, Mus musculus
aatattataaactccctggtccagg

SEQ ID NO: 74903 - DNA, 25 bp, Mus musculus
aatattatcaaccattctgttctgg

SEQ ID NO: 74904 - DNA, 25 bp, Mus musculus
aatattatcaacgattctgttctgg

SEQ ID NO: 74905 - DNA, 25 bp, Mus musculus
aatattatccacaggtcggtcatat

SEQ ID NO: 74906 - DNA, 25 bp, Mus musculus
aatattatccactggtcggtcatat

SEQ ID NO: 74907 - DNA, 25 bp, Mus musculus
aatattatcctgcaatatgttggat

SEQ ID NO: 74908 - DNA, 25 bp, Mus musculus
aatattatcctggaatatgttggat

SEQ ID NO: 74909 - DNA, 25 bp, Mus musculus
aatattatctgtcggccaaggcagt

SEQ ID NO: 74910 - DNA, 25 bp, Mus musculus
aatattatctgtgggccaaggcagt

SEQ ID NO: 74911 - DNA, 25 bp, Mus musculus
aatattatgcttacactctgttttt

SEQ ID NO: 74912 - DNA, 25 bp, Mus musculus
aatattatgcttacatgctgtatgt

SEQ ID NO: 74913 - DNA, 25 bp, Mus musculus
aatattatgctttcactctgttttt

SEQ ID NO: 74914 - DNA, 25 bp, Mus musculus
aatattatgctttcatgctgtatgt

SEQ ID NO: 74915 - DNA, 25 bp, Mus musculus
aatattatggcccacatcctgtgaa

SEQ ID NO: 74916 - DNA, 25 bp, Mus musculus
aatattatggccgacatcctgtgaa

SEQ ID NO: 74917 - DNA, 25 bp, Mus musculus
aatattatttcaactgcagtcttgt

SEQ ID NO: 74918 - DNA, 25 bp, Mus musculus
aatattatttcatctgcagtcttgt

SEQ ID NO: 74919 - DNA, 25 bp, Mus musculus
aatattattttactgccaggcagtg

SEQ ID NO: 74920 - DNA, 25 bp, Mus musculus
aatattattttagtgccaggcagtg

SEQ ID NO: 74921 - DNA, 25 bp, Mus musculus
aatattcaaactcggtctcgtctgc

SEQ ID NO: 74922 - DNA, 25 bp, Mus musculus
aatattcaaactgggtctcgtctgc

SEQ ID NO: 74923 - DNA, 25 bp, Mus musculus
aatattcaagctacaccatgctaga

SEQ ID NO: 74924 - DNA, 25 bp, Mus musculus
aatattcaagcttcaccatgctaga

SEQ ID NO: 74925 - DNA, 25 bp, Mus musculus
aatattcaagttaagaccctggcag

SEQ ID NO: 74926 - DNA, 25 bp, Mus musculus
aatattcaagtttagaccctggcag

SEQ ID NO: 74927 - DNA, 25 bp, Mus musculus
aatattcaatgtagtccgcctggct

SEQ ID NO: 74928 - DNA, 25 bp, Mus musculus
aatattcaatgtcaccctcaagggc

SEQ ID NO: 74929 - DNA, 25 bp, Mus musculus
aatattcaatgtgaccctcaagggc

SEQ ID NO: 74930 - DNA, 25 bp, Mus musculus
aatattcaatgttgtccgcctggct

SEQ ID NO: 74931 - DNA, 25 bp, Mus musculus
aatattcaccatatgttttgcataa

SEQ ID NO: 74932 - DNA, 25 bp, Mus musculus
aatattcaccatttgttttgcataa

SEQ ID NO: 74933 - DNA, 25 bp, Mus musculus
aatattcagattcgaaggactttaa

SEQ ID NO: 74934 - DNA, 25 bp, Mus musculus
aatattcagattggaaggactttaa

SEQ ID NO: 74935 - DNA, 25 bp, Mus musculus
aatattcagggtaggacggcagagc

SEQ ID NO: 74936 - DNA, 25 bp, Mus musculus
aatattcagggttggacggcagagc

SEQ ID NO: 74937 - DNA, 25 bp, Mus musculus
aatattcagtggaggctccgagtat

SEQ ID NO: 74938 - DNA, 25 bp, Mus musculus
aatattcagtggtggctccgagtat

SEQ ID NO: 74939 - DNA, 25 bp, Mus musculus
aatattccaaccacataagtaactg

SEQ ID NO: 74940 - DNA, 25 bp, Mus musculus
aatattccaacctcataagtaactg

SEQ ID NO: 74941 - DNA, 25 bp, Mus musculus
aatattccattccttctcagtgtca

SEQ ID NO: 74942 - DNA, 25 bp, Mus musculus
aatattccattcgttctcagtgtca

SEQ ID NO: 74943 - DNA, 25 bp, Mus musculus
aatattccattgataggctgtacta

SEQ ID NO: 74944 - DNA, 25 bp, Mus musculus
aatattccattgttaggctgtacta

SEQ ID NO: 74945 - DNA, 25 bp, Mus musculus
aatattccccaaaactgtccttcct

SEQ ID NO: 74946 - DNA, 25 bp, Mus musculus
aatattccccaatactgtccttcct

SEQ ID NO: 74947 - DNA, 25 bp, Mus musculus
aatattccccgaagccgagtgctgg

SEQ ID NO: 74948 - DNA, 25 bp, Mus musculus
aatattccccgatgccgagtgctgg

SEQ ID NO: 74949 - DNA, 25 bp, Mus musculus
aatattcccgggatagaccaggcat

SEQ ID NO: 74950 - DNA, 25 bp, Mus musculus
aatattcccgggttagaccaggcat

SEQ ID NO: 74951 - DNA, 25 bp, Mus musculus
aatattccggccaaactcagggctt

SEQ ID NO: 74952 - DNA, 25 bp, Mus musculus
aatattccggcctaactcagggctt

SEQ ID NO: 74953 - DNA, 25 bp, Mus musculus
aatattcctcctaatgttgcagaca

SEQ ID NO: 74954 - DNA, 25 bp, Mus musculus
aatattcctccttatgttgcagaca

SEQ ID NO: 74955 - DNA, 25 bp, Mus musculus
aatattcgacaaaagtctcttatct

SEQ ID NO: 74956 - DNA, 25 bp, Mus musculus
aatattcgacaatagtctcttatct

SEQ ID NO: 74957 - DNA, 25 bp, Mus musculus
aatattcgccatattcttcgggcta

SEQ ID NO: 74958 - DNA, 25 bp, Mus musculus
aatattcgccattttcttcgggcta

SEQ ID NO: 74959 - DNA, 25 bp, Mus musculus
aatattcgtacaccacccagataga

SEQ ID NO: 74960 - DNA, 25 bp, Mus musculus
aatattcgtacagcacccagataga

SEQ ID NO: 74961 - DNA, 25 bp, Mus musculus
aatattcgtttcagtctttgtaatc

SEQ ID NO: 74962 - DNA, 25 bp, Mus musculus
aatattcgtttctgtctttgtaatc

SEQ ID NO: 74963 - DNA, 25 bp, Mus musculus
aatattctcaagatggttggtgatg

SEQ ID NO: 74964 - DNA, 25 bp, Mus musculus
aatattctcaagttggttggtgatg

SEQ ID NO: 74965 - DNA, 25 bp, Mus musculus
aatattctcatcatagccttgtgac

SEQ ID NO: 74966 - DNA, 25 bp, Mus musculus
aatattctcatcttagccttgtgac

SEQ ID NO: 74967 - DNA, 25 bp, Mus musculus
aatattctcctactagcactttttt

SEQ ID NO: 74968 - DNA, 25 bp, Mus musculus
aatattctcctagtagcactttttt

SEQ ID NO: 74969 - DNA, 25 bp, Mus musculus
aatattctccttaggtcaggctagc

SEQ ID NO: 74970 - DNA, 25 bp, Mus musculus
aatattctcctttggtcaggctagc

SEQ ID NO: 74971 - DNA, 25 bp, Mus musculus
aatattctcgctcttctgattctgt

SEQ ID NO: 74972 - DNA, 25 bp, Mus musculus
aatattctcgctgttctgattctgt

SEQ ID NO: 74973 - DNA, 25 bp, Mus musculus
aatattctctaaacttctcctgctg

SEQ ID NO: 74974 - DNA, 25 bp, Mus musculus
aatattctctaatcttctcctgctg

SEQ ID NO: 74975 - DNA, 25 bp, Mus musculus
aatattctctgccaaaacctctctg

SEQ ID NO: 74976 - DNA, 25 bp, Mus musculus
aatattctctgcgaaaacctctctg

SEQ ID NO: 74977 - DNA, 25 bp, Mus musculus
aatattctctgtcatggcatcccag

SEQ ID NO: 74978 - DNA, 25 bp, Mus musculus
aatattctctgtgatggcatcccag

SEQ ID NO: 74979 - DNA, 25 bp, Mus musculus
aatattctgataactccctgcactg

SEQ ID NO: 74980 - DNA, 25 bp, Mus musculus
aatattctgatatctccctgcactg

SEQ ID NO: 74981 - DNA, 25 bp, Mus musculus
aatattctgggtattcaagtctctt

SEQ ID NO: 74982 - DNA, 25 bp, Mus musculus
aatattctgggttttcaagtctctt

SEQ ID NO: 74983 - DNA, 25 bp, Mus musculus
aatattctggtcacatttcctcatt

SEQ ID NO: 74984 - DNA, 25 bp, Mus musculus
aatattctggtctcatttcctcatt

SEQ ID NO: 74985 - DNA, 25 bp, Mus musculus
aatattctggtgatgttctggtggc

SEQ ID NO: 74986 - DNA, 25 bp, Mus musculus
aatattctggtgttgttctggtggc

SEQ ID NO: 74987 - DNA, 25 bp, Mus musculus
aatattctgtccattccttaactgc

SEQ ID NO: 74988 - DNA, 25 bp, Mus musculus
aatattctgtcctttccttaactgc

SEQ ID NO: 74989 - DNA, 25 bp, Mus musculus
aatattctgtctatgggagggctcg

SEQ ID NO: 74990 - DNA, 25 bp, Mus musculus
aatattctgtctttgggagggctcg

SEQ ID NO: 74991 - DNA, 25 bp, Mus musculus
aatattctgtttactattgagacaa

SEQ ID NO: 74992 - DNA, 25 bp, Mus musculus
aatattctgttttctattgagacaa

SEQ ID NO: 74993 - DNA, 25 bp, Mus musculus
aatattcttatgaacaggtagtagg

SEQ ID NO: 74994 - DNA, 25 bp, Mus musculus
aatattcttatgtacaggtagtagg

SEQ ID NO: 74995 - DNA, 25 bp, Mus musculus
aatattcttcggaggcaatcttctt

SEQ ID NO: 74996 - DNA, 25 bp, Mus musculus
aatattcttcggtggcaatcttctt

SEQ ID NO: 74997 - DNA, 25 bp, Mus musculus
aatattcttctaatgatgctccatc

SEQ ID NO: 74998 - DNA, 25 bp, Mus musculus
aatattcttctattgatgctccatc

SEQ ID NO: 74999 - DNA, 25 bp, Mus musculus
aatattcttgtaaacttgtcagcat

SEQ ID NO: 75000 - DNA, 25 bp, Mus musculus
aatattcttgtatacttgtcagcat

SEQ ID NO: 75001 - DNA, 25 bp, Mus musculus
aatattcttgtcactgggaatgcag

SEQ ID NO: 75002 - DNA, 25 bp, Mus musculus
aatattcttgtctctgggaatgcag

SEQ ID NO: 75003 - DNA, 25 bp, Mus musculus
aatattgaaactcctgtgtcttatc

SEQ ID NO: 75004 - DNA, 25 bp, Mus musculus
aatattgaaactgctgtgtcttatc

SEQ ID NO: 75005 - DNA, 25 bp, Mus musculus
aatattgaaatcagagcctctggag

SEQ ID NO: 75006 - DNA, 25 bp, Mus musculus
aatattgaaatctgagcctctggag

SEQ ID NO: 75007 - DNA, 25 bp, Mus musculus
aatattgaagtcactcctctctttt

SEQ ID NO: 75008 - DNA, 25 bp, Mus musculus
aatattgaagtctctcctctctttt

SEQ ID NO: 75009 - DNA, 25 bp, Mus musculus
aatattgaagtgcagctggcttcag

SEQ ID NO: 75010 - DNA, 25 bp, Mus musculus
aatattgaagtggagctggcttcag

SEQ ID NO: 75011 - DNA, 25 bp, Mus musculus
aatattgacactacttttcctgctt

SEQ ID NO: 75012 - DNA, 25 bp, Mus musculus
aatattgacacttcttttcctgctt

SEQ ID NO: 75013 - DNA, 25 bp, Mus musculus
aatattgacgctcaggactttatca

SEQ ID NO: 75014 - DNA, 25 bp, Mus musculus
aatattgacgctgaggactttatca

SEQ ID NO: 75015 - DNA, 25 bp, Mus musculus
aatattgactataaccgcttggatg

SEQ ID NO: 75016 - DNA, 25 bp, Mus musculus
aatattgactattaccgcttggatg

SEQ ID NO: 75017 - DNA, 25 bp, Mus musculus
aatattgagtttatctatcctggac

SEQ ID NO: 75018 - DNA, 25 bp, Mus musculus
aatattgagtttttctatcctggac

SEQ ID NO: 75019 - DNA, 25 bp, Mus musculus
aatattgcacttatttgctctcatt

SEQ ID NO: 75020 - DNA, 25 bp, Mus musculus
aatattgcacttttttgctctcatt

SEQ ID NO: 75021 - DNA, 25 bp, Mus musculus
aatattgccagcagctagcagcgtg

SEQ ID NO: 75022 - DNA, 25 bp, Mus musculus
aatattgccagctgctagcagcgtg

SEQ ID NO: 75023 - DNA, 25 bp, Mus musculus
aatattgccataatctgtagtattt

SEQ ID NO: 75024 - DNA, 25 bp, Mus musculus
aatattgccatattctgtagtattt

SEQ ID NO: 75025 - DNA, 25 bp, Mus musculus
aatattgccatgataggccctgcca

SEQ ID NO: 75026 - DNA, 25 bp, Mus musculus
aatattgccatgttaggccctgcca

SEQ ID NO: 75027 - DNA, 25 bp, Mus musculus
aatattgccggactgtctgcagaga

SEQ ID NO: 75028 - DNA, 25 bp, Mus musculus
aatattgccggagtgtctgcagaga

SEQ ID NO: 75029 - DNA, 25 bp, Mus musculus
aatattgcgcacattttccacatgg

SEQ ID NO: 75030 - DNA, 25 bp, Mus musculus
aatattgcgcactttttccacatgg

SEQ ID NO: 75031 - DNA, 25 bp, Mus musculus
aatattgctaatcgaactttcttct

SEQ ID NO: 75032 - DNA, 25 bp, Mus musculus
aatattgctaatggaactttcttct

SEQ ID NO: 75033 - DNA, 25 bp, Mus musculus
aatattgctccaagggtgcagctta

SEQ ID NO: 75034 - DNA, 25 bp, Mus musculus
aatattgctccatgggtgcagctta

SEQ ID NO: 75035 - DNA, 25 bp, Mus musculus
aatattgctcctacacaaattaata

SEQ ID NO: 75036 - DNA, 25 bp, Mus musculus
aatattgctccttcacaaattaata

SEQ ID NO: 75037 - DNA, 25 bp, Mus musculus
aatattgctggaaatgctattgtat

SEQ ID NO: 75038 - DNA, 25 bp, Mus musculus
aatattgctggatatgctattgtat

SEQ ID NO: 75039 - DNA, 25 bp, Mus musculus
aatattgcttgtaatcctggagata

SEQ ID NO: 75040 - DNA, 25 bp, Mus musculus
aatattgcttgttatcctggagata

SEQ ID NO: 75041 - DNA, 25 bp, Mus musculus
aatattggaatactgatgtctagca

SEQ ID NO: 75042 - DNA, 25 bp, Mus musculus
aatattggaatagtgatgtctagca

SEQ ID NO: 75043 - DNA, 25 bp, Mus musculus
aatattggcttcaagtgctgtcaga

SEQ ID NO: 75044 - DNA, 25 bp, Mus musculus
aatattggcttctagtgctgtcaga

SEQ ID NO: 75045 - DNA, 25 bp, Mus musculus
aatattgtaaatactggactcagga

SEQ ID NO: 75046 - DNA, 25 bp, Mus musculus
aatattgtaaattctggactcagga

SEQ ID NO: 75047 - DNA, 25 bp, Mus musculus
aatattgtaacgaactgaggctgaa

SEQ ID NO: 75048 - DNA, 25 bp, Mus musculus
aatattgtaacgtactgaggctgaa

SEQ ID NO: 75049 - DNA, 25 bp, Mus musculus
aatattgtacccagtcagttctaat

SEQ ID NO: 75050 - DNA, 25 bp, Mus musculus
aatattgtaccctgtcagttctaat

SEQ ID NO: 75051 - DNA, 25 bp, Mus musculus
aatattgtagctcttctctcaaaac

SEQ ID NO: 75052 - DNA, 25 bp, Mus musculus
aatattgtagctgttctctcaaaac

SEQ ID NO: 75053 - DNA, 25 bp, Mus musculus
aatattgtccagagtttggccgcaa

SEQ ID NO: 75054 - DNA, 25 bp, Mus musculus
aatattgtccagtgtttggccgcaa

SEQ ID NO: 75055 - DNA, 25 bp, Mus musculus
aatattgtcttacaacgcatcagag

SEQ ID NO: 75056 - DNA, 25 bp, Mus musculus
aatattgtcttagaacgcatcagag

SEQ ID NO: 75057 - DNA, 25 bp, Mus musculus
aatattgtgaaacaccctctgaccc

SEQ ID NO: 75058 - DNA, 25 bp, Mus musculus
aatattgtgaaagaccctctgaccc

SEQ ID NO: 75059 - DNA, 25 bp, Mus musculus
aatattgtgctaccttcaagcctgg

SEQ ID NO: 75060 - DNA, 25 bp, Mus musculus
aatattgtgctagcttcaagcctgg

SEQ ID NO: 75061 - DNA, 25 bp, Mus musculus
aatattgtgtgcactcagtcaggct

SEQ ID NO: 75062 - DNA, 25 bp, Mus musculus
aatattgtgtgctctcagtcaggct

SEQ ID NO: 75063 - DNA, 25 bp, Mus musculus
aatattgtgttgctgatttctaggc

SEQ ID NO: 75064 - DNA, 25 bp, Mus musculus
aatattgtgttggtgatttctaggc

SEQ ID NO: 75065 - DNA, 25 bp, Mus musculus
aatattgttaagattttactgtgga

SEQ ID NO: 75066 - DNA, 25 bp, Mus musculus
aatattgttaagtttttactgtgga

SEQ ID NO: 75067 - DNA, 25 bp, Mus musculus
aatattgttatgcatcctggtctac

SEQ ID NO: 75068 - DNA, 25 bp, Mus musculus
aatattgttatggatcctggtctac

SEQ ID NO: 75069 - DNA, 25 bp, Mus musculus
aatattgttctcatcttgaccacct

SEQ ID NO: 75070 - DNA, 25 bp, Mus musculus
aatattgttctcttcttgaccacct

SEQ ID NO: 75071 - DNA, 25 bp, Mus musculus
aatatttaagagacttccgccacaa

SEQ ID NO: 75072 - DNA, 25 bp, Mus musculus
aatatttaagagtcttccgccacaa

SEQ ID NO: 75073 - DNA, 25 bp, Mus musculus
aatatttaccaccagaccaacacag

SEQ ID NO: 75074 - DNA, 25 bp, Mus musculus
aatatttaccacgagaccaacacag

SEQ ID NO: 75075 - DNA, 25 bp, Mus musculus
aatatttacgtcaggcacaccgcaa

SEQ ID NO: 75076 - DNA, 25 bp, Mus musculus
aatatttacgtctggcacaccgcaa

SEQ ID NO: 75077 - DNA, 25 bp, Mus musculus
aatatttatcctaatttcaggccca

SEQ ID NO: 75078 - DNA, 25 bp, Mus musculus
aatatttatccttatttcaggccca

SEQ ID NO: 75079 - DNA, 25 bp, Mus musculus
aatatttatggaatgctgcatgatt

SEQ ID NO: 75080 - DNA, 25 bp, Mus musculus
aatatttatggattgctgcatgatt

SEQ ID NO: 75081 - DNA, 25 bp, Mus musculus
aatatttcagacctagcctccttct

SEQ ID NO: 75082 - DNA, 25 bp, Mus musculus
aatatttcagacgtagcctccttct

SEQ ID NO: 75083 - DNA, 25 bp, Mus musculus
aatatttcagagattgtacacaagg

SEQ ID NO: 75084 - DNA, 25 bp, Mus musculus
aatatttcagagtttgtacacaagg

SEQ ID NO: 75085 - DNA, 25 bp, Mus musculus
aatatttcattacagttgtgccaac

SEQ ID NO: 75086 - DNA, 25 bp, Mus musculus
aatatttcattagagttgtgccaac

SEQ ID NO: 75087 - DNA, 25 bp, Mus musculus
aatatttccactcctccttttcagg

SEQ ID NO: 75088 - DNA, 25 bp, Mus musculus
aatatttccactgctccttttcagg

SEQ ID NO: 75089 - DNA, 25 bp, Mus musculus
aatatttccgtcatgagcagttgca

SEQ ID NO: 75090 - DNA, 25 bp, Mus musculus
aatatttccgtcttgagcagttgca

SEQ ID NO: 75091 - DNA, 25 bp, Mus musculus
aatatttcctgtagcttcaaagccc

SEQ ID NO: 75092 - DNA, 25 bp, Mus musculus
aatatttcctgttgcttcaaagccc

SEQ ID NO: 75093 - DNA, 25 bp, Mus musculus
aatatttctaacatctgtggtccaa

SEQ ID NO: 75094 - DNA, 25 bp, Mus musculus
aatatttctaacttctgtggtccaa

SEQ ID NO: 75095 - DNA, 25 bp, Mus musculus
aatatttctccaccacccatatgtc

SEQ ID NO: 75096 - DNA, 25 bp, Mus musculus
aatatttctccagcacccatatgtc

SEQ ID NO: 75097 - DNA, 25 bp, Mus musculus
aatatttctcttctactgtagtgaa

SEQ ID NO: 75098 - DNA, 25 bp, Mus musculus
aatatttctcttcttgttggtgttc

SEQ ID NO: 75099 - DNA, 25 bp, Mus musculus
aatatttctcttgtactgtagtgaa

SEQ ID NO: 75100 - DNA, 25 bp, Mus musculus
aatatttctcttgttgttggtgttc

SEQ ID NO: 75101 - DNA, 25 bp, Mus musculus
aatatttctgccaccagctctttga

SEQ ID NO: 75102 - DNA, 25 bp, Mus musculus
aatatttctgcctccagctctttga

SEQ ID NO: 75103 - DNA, 25 bp, Mus musculus
aatatttctgttaagagtctgctga

SEQ ID NO: 75104 - DNA, 25 bp, Mus musculus
aatatttctgtttagagtctgctga

SEQ ID NO: 75105 - DNA, 25 bp, Mus musculus
aatatttctttaaggttgtaactca

SEQ ID NO: 75106 - DNA, 25 bp, Mus musculus
aatatttctttatggttgtaactca

SEQ ID NO: 75107 - DNA, 25 bp, Mus musculus
aatatttctttgatgtgccttttgg

SEQ ID NO: 75108 - DNA, 25 bp, Mus musculus
aatatttctttgttgtgccttttgg

SEQ ID NO: 75109 - DNA, 25 bp, Mus musculus
aatatttgagggagagactccctgt

SEQ ID NO: 75110 - DNA, 25 bp, Mus musculus
aatatttgagggtgagactccctgt

SEQ ID NO: 75111 - DNA, 25 bp, Mus musculus
aatatttgatccatcttcccttgca

SEQ ID NO: 75112 - DNA, 25 bp, Mus musculus
aatatttgatccttcttcccttgca

SEQ ID NO: 75113 - DNA, 25 bp, Mus musculus
aatatttgcaacaaccagctggtct

SEQ ID NO: 75114 - DNA, 25 bp, Mus musculus
aatatttgcaactaccagctggtct

SEQ ID NO: 75115 - DNA, 25 bp, Mus musculus
aatatttgccacagtaataactttg

SEQ ID NO: 75116 - DNA, 25 bp, Mus musculus
aatatttgccactgtaataactttg

SEQ ID NO: 75117 - DNA, 25 bp, Mus musculus
aatatttgcctcattatcctgtaaa

SEQ ID NO: 75118 - DNA, 25 bp, Mus musculus
aatatttgcctctttatcctgtaaa

SEQ ID NO: 75119 - DNA, 25 bp, Mus musculus
aatatttgcttcctgccttgttatc

SEQ ID NO: 75120 - DNA, 25 bp, Mus musculus
aatatttgcttcgtgccttgttatc

SEQ ID NO: 75121 - DNA, 25 bp, Mus musculus
aatatttggcttacagtgtctcaag

SEQ ID NO: 75122 - DNA, 25 bp, Mus musculus
aatatttggctttcagtgtctcaag

SEQ ID NO: 75123 - DNA, 25 bp, Mus musculus
aatatttgtattccctatctagtag

SEQ ID NO: 75124 - DNA, 25 bp, Mus musculus
aatatttgtattgcctatctagtag

SEQ ID NO: 75125 - DNA, 25 bp, Mus musculus
aatatttgtcagcatccaccaggtt

SEQ ID NO: 75126 - DNA, 25 bp, Mus musculus
aatatttgtcaggatccaccaggtt

SEQ ID NO: 75127 - DNA, 25 bp, Mus musculus
aatatttgtctcaactccaatccac

SEQ ID NO: 75128 - DNA, 25 bp, Mus musculus
aatatttgtctctactccaatccac

SEQ ID NO: 75129 - DNA, 25 bp, Mus musculus
aatatttgtgcgcagttctgccggg

SEQ ID NO: 75130 - DNA, 25 bp, Mus musculus
aatatttgtgcggagttctgccggg

SEQ ID NO: 75131 - DNA, 25 bp, Mus musculus
aatatttgttggctccactgctcct

SEQ ID NO: 75132 - DNA, 25 bp, Mus musculus
aatatttgttgggtccactgctcct

SEQ ID NO: 75133 - DNA, 25 bp, Mus musculus
aatattttacctcactacttgctat

SEQ ID NO: 75134 - DNA, 25 bp, Mus musculus
aatattttacctgactacttgctat

SEQ ID NO: 75135 - DNA, 25 bp, Mus musculus
aatattttagctctctctctttttt

SEQ ID NO: 75136 - DNA, 25 bp, Mus musculus
aatattttagctgtctctctttttt

SEQ ID NO: 75137 - DNA, 25 bp, Mus musculus
aatattttaggtaggctggaagcag

SEQ ID NO: 75138 - DNA, 25 bp, Mus musculus
aatattttaggttggctggaagcag

SEQ ID NO: 75139 - DNA, 25 bp, Mus musculus
aatattttattccttagaagcctat

SEQ ID NO: 75140 - DNA, 25 bp, Mus musculus
aatattttattcgttagaagcctat

SEQ ID NO: 75141 - DNA, 25 bp, Mus musculus
aatattttcataagtcacactactg

SEQ ID NO: 75142 - DNA, 25 bp, Mus musculus
aatattttcatatgtcacactactg

SEQ ID NO: 75143 - DNA, 25 bp, Mus musculus
aatattttgagccatctaccttctc

SEQ ID NO: 75144 - DNA, 25 bp, Mus musculus
aatattttgagcgatctaccttctc

SEQ ID NO: 75145 - DNA, 25 bp, Mus musculus
aatattttgataaggctatacactg

SEQ ID NO: 75146 - DNA, 25 bp, Mus musculus
aatattttgatatggctatacactg

SEQ ID NO: 75147 - DNA, 25 bp, Mus musculus
aatattttgccacctctactttcct

SEQ ID NO: 75148 - DNA, 25 bp, Mus musculus
aatattttgccagctctactttcct

SEQ ID NO: 75149 - DNA, 25 bp, Mus musculus
aatattttgcctaacatggatttgc

SEQ ID NO: 75150 - DNA, 25 bp, Mus musculus
aatattttgccttacatggatttgc

SEQ ID NO: 75151 - DNA, 25 bp, Mus musculus
aatattttggctcgcgggatggctc

SEQ ID NO: 75152 - DNA, 25 bp, Mus musculus
aatattttggctggcgggatggctc

SEQ ID NO: 75153 - DNA, 25 bp, Mus musculus
aatattttggtgacgattcctcctg

SEQ ID NO: 75154 - DNA, 25 bp, Mus musculus
aatattttggtgtcgattcctcctg

SEQ ID NO: 75155 - DNA, 25 bp, Mus musculus
aatatttttaatctggccccaaatg

SEQ ID NO: 75156 - DNA, 25 bp, Mus musculus
aatatttttaatgtggccccaaatg

SEQ ID NO: 75157 - DNA, 25 bp, Mus musculus
aatatttttaccactgaattgctta

SEQ ID NO: 75158 - DNA, 25 bp, Mus musculus
aatatttttacctctgaattgctta

SEQ ID NO: 75159 - DNA, 25 bp, Mus musculus
aatatttttatgcttccctgtacct

SEQ ID NO: 75160 - DNA, 25 bp, Mus musculus
aatatttttatggttccctgtacct

SEQ ID NO: 75161 - DNA, 25 bp, Mus musculus
aatatttttcaaatgggcatctttt

SEQ ID NO: 75162 - DNA, 25 bp, Mus musculus
aatatttttcaattgggcatctttt

SEQ ID NO: 75163 - DNA, 25 bp, Mus musculus
aatatttttgtgagctgcagttcaa

SEQ ID NO: 75164 - DNA, 25 bp, Mus musculus
aatatttttgtgtgctgcagttcaa

SEQ ID NO: 75165 - DNA, 25 bp, Mus musculus
aatatttttgttactatcttgaaat

SEQ ID NO: 75166 - DNA, 25 bp, Mus musculus
aatatttttgtttctatcttgaaat

SEQ ID NO: 75167 - DNA, 25 bp, Mus musculus
aatattttttatcaagtgctacttg

SEQ ID NO: 75168 - DNA, 25 bp, Mus musculus
aatattttttatgaagtgctacttg

SEQ ID NO: 75169 - DNA, 25 bp, Mus musculus
aatattttttgtaaagatggcaata

SEQ ID NO: 75170 - DNA, 25 bp, Mus musculus
aatattttttgttaagatggcaata

SEQ ID NO: 75171 - DNA, 25 bp, Mus musculus
aatcaaaactttacatgacttgtca

SEQ ID NO: 75172 - DNA, 25 bp, Mus musculus
aatcaaaacttttcatgacttgtca

SEQ ID NO: 75173 - DNA, 25 bp, Mus musculus
aatcaaaagtggatgccttcataag

SEQ ID NO: 75174 - DNA, 25 bp, Mus musculus
aatcaaaagtggttgccttcataag

SEQ ID NO: 75175 - DNA, 25 bp, Mus musculus
aatcaaaataccacctttcctgtgg

SEQ ID NO: 75176 - DNA, 25 bp, Mus musculus
aatcaaaatacctcctttcctgtgg

SEQ ID NO: 75177 - DNA, 25 bp, Mus musculus
aatcaaaatagtctcgttctcctcg

SEQ ID NO: 75178 - DNA, 25 bp, Mus musculus
aatcaaaatagtgtcgttctcctcg

SEQ ID NO: 75179 - DNA, 25 bp, Mus musculus
aatcaaaatcgtccgtaggccacag

SEQ ID NO: 75180 - DNA, 25 bp, Mus musculus
aatcaaaatcgtgcgtaggccacag

SEQ ID NO: 75181 - DNA, 25 bp, Mus musculus
aatcaaaattctctgactgcactgt

SEQ ID NO: 75182 - DNA, 25 bp, Mus musculus
aatcaaaattctgtgactgcactgt

SEQ ID NO: 75183 - DNA, 25 bp, Mus musculus
aatcaaaatttacagctgcccagta

SEQ ID NO: 75184 - DNA, 25 bp, Mus musculus
aatcaaaatttagagctgcccagta

SEQ ID NO: 75185 - DNA, 25 bp, Mus musculus
aatcaaacaatccatactgcaaaga

SEQ ID NO: 75186 - DNA, 25 bp, Mus musculus
aatcaaacaatcgatactgcaaaga

SEQ ID NO: 75187 - DNA, 25 bp, Mus musculus
aatcaaacagtgcagccctgaccct

SEQ ID NO: 75188 - DNA, 25 bp, Mus musculus
aatcaaacagtggagccctgaccct

SEQ ID NO: 75189 - DNA, 25 bp, Mus musculus
aatcaaaccaggaagccatccccag

SEQ ID NO: 75190 - DNA, 25 bp, Mus musculus
aatcaaaccaggtagccatccccag

SEQ ID NO: 75191 - DNA, 25 bp, Mus musculus
aatcaaacccatagttggatgctcc

SEQ ID NO: 75192 - DNA, 25 bp, Mus musculus
aatcaaacccattgttggatgctcc

SEQ ID NO: 75193 - DNA, 25 bp, Mus musculus
aatcaaaccccaagcgtacagctga

SEQ ID NO: 75194 - DNA, 25 bp, Mus musculus
aatcaaaccccatgcgtacagctga

SEQ ID NO: 75195 - DNA, 25 bp, Mus musculus
aatcaaacctacagggcaggcccta

SEQ ID NO: 75196 - DNA, 25 bp, Mus musculus
aatcaaacctactgggcaggcccta

SEQ ID NO: 75197 - DNA, 25 bp, Mus musculus
aatcaaacctgcagtgcttttctga

SEQ ID NO: 75198 - DNA, 25 bp, Mus musculus
aatcaaacctgctgtgcttttctga

SEQ ID NO: 75199 - DNA, 25 bp, Mus musculus
aatcaaaccttgactctagtcacgt

SEQ ID NO: 75200 - DNA, 25 bp, Mus musculus
aatcaaaccttgtctctagtcacgt

SEQ ID NO: 75201 - DNA, 25 bp, Mus musculus
aatcaaactcagagtctgcagatga

SEQ ID NO: 75202 - DNA, 25 bp, Mus musculus
aatcaaactcagtgtctgcagatga

SEQ ID NO: 75203 - DNA, 25 bp, Mus musculus
aatcaaactgagcatcgtcgggcta

SEQ ID NO: 75204 - DNA, 25 bp, Mus musculus
aatcaaactgaggatcgtcgggcta

SEQ ID NO: 75205 - DNA, 25 bp, Mus musculus
aatcaaactgatccatttaacgtgt

SEQ ID NO: 75206 - DNA, 25 bp, Mus musculus
aatcaaactgatgcatttaacgtgt

SEQ ID NO: 75207 - DNA, 25 bp, Mus musculus
aatcaaacttctcactgcctgaagc

SEQ ID NO: 75208 - DNA, 25 bp, Mus musculus
aatcaaacttctgactgcctgaagc

SEQ ID NO: 75209 - DNA, 25 bp, Mus musculus
aatcaaagaatacccatgaggaacc

SEQ ID NO: 75210 - DNA, 25 bp, Mus musculus
aatcaaagaatagccatgaggaacc

SEQ ID NO: 75211 - DNA, 25 bp, Mus musculus
aatcaaagacatccaacgacacgtt

SEQ ID NO: 75212 - DNA, 25 bp, Mus musculus
aatcaaagacatgcaacgacacgtt

SEQ ID NO: 75213 - DNA, 25 bp, Mus musculus
aatcaaagagtgaccattcctgcag

SEQ ID NO: 75214 - DNA, 25 bp, Mus musculus
aatcaaagagtgtccattcctgcag

SEQ ID NO: 75215 - DNA, 25 bp, Mus musculus
aatcaaagccagaaatggagttagc

SEQ ID NO: 75216 - DNA, 25 bp, Mus musculus
aatcaaagccagtaatggagttagc

SEQ ID NO: 75217 - DNA, 25 bp, Mus musculus
aatcaaagcctcaagtcaccagacg

SEQ ID NO: 75218 - DNA, 25 bp, Mus musculus
aatcaaagcctctagtcaccagacg

SEQ ID NO: 75219 - DNA, 25 bp, Mus musculus
aatcaaagttatatccaagtacata

SEQ ID NO: 75220 - DNA, 25 bp, Mus musculus
aatcaaagttatttccaagtacata

SEQ ID NO: 75221 - DNA, 25 bp, Mus musculus
aatcaaatattcctgccgcatcgaa

SEQ ID NO: 75222 - DNA, 25 bp, Mus musculus
aatcaaatattcgtgccgcatcgaa

SEQ ID NO: 75223 - DNA, 25 bp, Mus musculus
aatcaaatcccactcctgtggtgag

SEQ ID NO: 75224 - DNA, 25 bp, Mus musculus
aatcaaatcccagtcctgtggtgag

SEQ ID NO: 75225 - DNA, 25 bp, Mus musculus
aatcaaatccctaagtatccagacg

SEQ ID NO: 75226 - DNA, 25 bp, Mus musculus
aatcaaatcccttagtatccagacg

SEQ ID NO: 75227 - DNA, 25 bp, Mus musculus
aatcaaatcctacgttgccatcgaa

SEQ ID NO: 75228 - DNA, 25 bp, Mus musculus
aatcaaatcctaggttgccatcgaa

SEQ ID NO: 75229 - DNA, 25 bp, Mus musculus
aatcaaatcgggaatccttggcaac

SEQ ID NO: 75230 - DNA, 25 bp, Mus musculus
aatcaaatcgggtatccttggcaac

SEQ ID NO: 75231 - DNA, 25 bp, Mus musculus
aatcaaatctgacaaaacgtttggt

SEQ ID NO: 75232 - DNA, 25 bp, Mus musculus
aatcaaatctgagaaaacgtttggt

SEQ ID NO: 75233 - DNA, 25 bp, Mus musculus
aatcaaatgcatcccgaccttcaat

SEQ ID NO: 75234 - DNA, 25 bp, Mus musculus
aatcaaatgcatgccgaccttcaat

SEQ ID NO: 75235 - DNA, 25 bp, Mus musculus
aatcaaatggcccaaagagaaccat

SEQ ID NO: 75236 - DNA, 25 bp, Mus musculus
aatcaaatggccgaaagagaaccat

SEQ ID NO: 75237 - DNA, 25 bp, Mus musculus
aatcaaattacaacattttcttccc

SEQ ID NO: 75238 - DNA, 25 bp, Mus musculus
aatcaaattacatcattttcttccc

SEQ ID NO: 75239 - DNA, 25 bp, Mus musculus
aatcaaattctgaagtctccgactt

SEQ ID NO: 75240 - DNA, 25 bp, Mus musculus
aatcaaattctgtagtctccgactt

SEQ ID NO: 75241 - DNA, 25 bp, Mus musculus
aatcaaattgatcagcttcaggttc

SEQ ID NO: 75242 - DNA, 25 bp, Mus musculus
aatcaaattgatgagcttcaggttc

SEQ ID NO: 75243 - DNA, 25 bp, Mus musculus
aatcaaattgctcggaagagtattc

SEQ ID NO: 75244 - DNA, 25 bp, Mus musculus
aatcaaattgctgggaagagtattc

SEQ ID NO: 75245 - DNA, 25 bp, Mus musculus
aatcaacacaacagtggattccagg

SEQ ID NO: 75246 - DNA, 25 bp, Mus musculus
aatcaacacaactgtggattccagg

SEQ ID NO: 75247 - DNA, 25 bp, Mus musculus
aatcaacagagcctcctgtctcctg

SEQ ID NO: 75248 - DNA, 25 bp, Mus musculus
aatcaacagagcgtcctgtctcctg

SEQ ID NO: 75249 - DNA, 25 bp, Mus musculus
aatcaacatcttatccttctgtccc

SEQ ID NO: 75250 - DNA, 25 bp, Mus musculus
aatcaacatcttttccttctgtccc

SEQ ID NO: 75251 - DNA, 25 bp, Mus musculus
aatcaacatgagattgcctcttacc

SEQ ID NO: 75252 - DNA, 25 bp, Mus musculus
aatcaacatgagtttgcctcttacc

SEQ ID NO: 75253 - DNA, 25 bp, Mus musculus
aatcaacatgttacctattattact

SEQ ID NO: 75254 - DNA, 25 bp, Mus musculus
aatcaacatgtttcctattattact

SEQ ID NO: 75255 - DNA, 25 bp, Mus musculus
aatcaaccagttctgcccaatgaag

SEQ ID NO: 75256 - DNA, 25 bp, Mus musculus
aatcaaccagttgtgcccaatgaag

SEQ ID NO: 75257 - DNA, 25 bp, Mus musculus
aatcaaccccagacactggaaatga

SEQ ID NO: 75258 - DNA, 25 bp, Mus musculus
aatcaaccccagtcactggaaatga

SEQ ID NO: 75259 - DNA, 25 bp, Mus musculus
aatcaacctggaagtaggctaccat

SEQ ID NO: 75260 - DNA, 25 bp, Mus musculus
aatcaacctggatgtaggctaccat

SEQ ID NO: 75261 - DNA, 25 bp, Mus musculus
aatcaacctgtgattatcagcagtg

SEQ ID NO: 75262 - DNA, 25 bp, Mus musculus
aatcaacctgtgtttatcagcagtg

SEQ ID NO: 75263 - DNA, 25 bp, Mus musculus
aatcaacctttgagtatgtcccagc

SEQ ID NO: 75264 - DNA, 25 bp, Mus musculus
aatcaacctttgtgtatgtcccagc

SEQ ID NO: 75265 - DNA, 25 bp, Mus musculus
aatcaacgaaatctgtgaagtccct

SEQ ID NO: 75266 - DNA, 25 bp, Mus musculus
aatcaacgaaatgtgtgaagtccct

SEQ ID NO: 75267 - DNA, 25 bp, Mus musculus
aatcaacgctttcgcggtgacgggc

SEQ ID NO: 75268 - DNA, 25 bp, Mus musculus
aatcaacgctttggcggtgacgggc

SEQ ID NO: 75269 - DNA, 25 bp, Mus musculus
aatcaacggagcctgggatgacctt

SEQ ID NO: 75270 - DNA, 25 bp, Mus musculus
aatcaacggagcgtgggatgacctt

SEQ ID NO: 75271 - DNA, 25 bp, Mus musculus
aatcaactaaacatgggcaaaggag

SEQ ID NO: 75272 - DNA, 25 bp, Mus musculus
aatcaactaaacttgggcaaaggag

SEQ ID NO: 75273 - DNA, 25 bp, Mus musculus
aatcaactcactacatctatacctc

SEQ ID NO: 75274 - DNA, 25 bp, Mus musculus
aatcaactcacttcatctatacctc

SEQ ID NO: 75275 - DNA, 25 bp, Mus musculus
aatcaactcctaatttcacactgtg

SEQ ID NO: 75276 - DNA, 25 bp, Mus musculus
aatcaactcctattttcacactgtg

SEQ ID NO: 75277 - DNA, 25 bp, Mus musculus
aatcaactctgcacatccagttaca

SEQ ID NO: 75278 - DNA, 25 bp, Mus musculus
aatcaactctgctcatccagttaca

SEQ ID NO: 75279 - DNA, 25 bp, Mus musculus
aatcaactgtctatcttgacatgtg

SEQ ID NO: 75280 - DNA, 25 bp, Mus musculus
aatcaactgtctttcttgacatgtg

SEQ ID NO: 75281 - DNA, 25 bp, Mus musculus
aatcaacttctcatacctgtatagc

SEQ ID NO: 75282 - DNA, 25 bp, Mus musculus
aatcaacttctcttacctgtatagc

SEQ ID NO: 75283 - DNA, 25 bp, Mus musculus
aatcaacttctgatttcctacctga

SEQ ID NO: 75284 - DNA, 25 bp, Mus musculus
aatcaacttctgttttcctacctga

SEQ ID NO: 75285 - DNA, 25 bp, Mus musculus
aatcaacttgcacctactctcatgg

SEQ ID NO: 75286 - DNA, 25 bp, Mus musculus
aatcaacttgcagctactctcatgg

SEQ ID NO: 75287 - DNA, 25 bp, Mus musculus
aatcaacttttcatgtactctatgt

SEQ ID NO: 75288 - DNA, 25 bp, Mus musculus
aatcaacttttcttgtactctatgt

SEQ ID NO: 75289 - DNA, 25 bp, Mus musculus
aatcaagaaactcttcccttccctg

SEQ ID NO: 75290 - DNA, 25 bp, Mus musculus
aatcaagaaactgttcccttccctg

SEQ ID NO: 75291 - DNA, 25 bp, Mus musculus
aatcaagaattgctcccagaaaatg

SEQ ID NO: 75292 - DNA, 25 bp, Mus musculus
aatcaagaattggtcccagaaaatg

SEQ ID NO: 75293 - DNA, 25 bp, Mus musculus
aatcaagacagccacctcaggagga

SEQ ID NO: 75294 - DNA, 25 bp, Mus musculus
aatcaagacagcgacctcaggagga

SEQ ID NO: 75295 - DNA, 25 bp, Mus musculus
aatcaagacctccaccagtctgtta

SEQ ID NO: 75296 - DNA, 25 bp, Mus musculus
aatcaagacctcgaccagtctgtta

SEQ ID NO: 75297 - DNA, 25 bp, Mus musculus
aatcaagacgacaacatggtccaaa

SEQ ID NO: 75298 - DNA, 25 bp, Mus musculus
aatcaagacgactacatggtccaaa

SEQ ID NO: 75299 - DNA, 25 bp, Mus musculus
aatcaagactgtatccacattttac

SEQ ID NO: 75300 - DNA, 25 bp, Mus musculus
aatcaagactgtttccacattttac

SEQ ID NO: 75301 - DNA, 25 bp, Mus musculus
aatcaagagtctctggtgtggtgct

SEQ ID NO: 75302 - DNA, 25 bp, Mus musculus
aatcaagagtctgtggtgtggtgct

SEQ ID NO: 75303 - DNA, 25 bp, Mus musculus
aatcaagatcttatcagcccatgac

SEQ ID NO: 75304 - DNA, 25 bp, Mus musculus
aatcaagatcttttcagcccatgac

SEQ ID NO: 75305 - DNA, 25 bp, Mus musculus
aatcaagatggcagcccattatggg

SEQ ID NO: 75306 - DNA, 25 bp, Mus musculus
aatcaagatggctgcccattatggg

SEQ ID NO: 75307 - DNA, 25 bp, Mus musculus
aatcaagcactaactcctgagtcag

SEQ ID NO: 75308 - DNA, 25 bp, Mus musculus
aatcaagcactatctcctgagtcag

SEQ ID NO: 75309 - DNA, 25 bp, Mus musculus
aatcaagcacttcatgactgagcaa

SEQ ID NO: 75310 - DNA, 25 bp, Mus musculus
aatcaagcacttgatgactgagcaa

SEQ ID NO: 75311 - DNA, 25 bp, Mus musculus
aatcaagcagaaccagaccctggct

SEQ ID NO: 75312 - DNA, 25 bp, Mus musculus
aatcaagcagaagcagaccctggct

SEQ ID NO: 75313 - DNA, 25 bp, Mus musculus
aatcaagcaggtaccccaccaggag

SEQ ID NO: 75314 - DNA, 25 bp, Mus musculus
aatcaagcaggtactttcttctcag

SEQ ID NO: 75315 - DNA, 25 bp, Mus musculus
aatcaagcaggttccccaccaggag

SEQ ID NO: 75316 - DNA, 25 bp, Mus musculus
aatcaagcaggttctttcttctcag

SEQ ID NO: 75317 - DNA, 25 bp, Mus musculus
aatcaagccagacgatccggcgctg

SEQ ID NO: 75318 - DNA, 25 bp, Mus musculus
aatcaagccagaggatccggcgctg

SEQ ID NO: 75319 - DNA, 25 bp, Mus musculus
aatcaagccatcagccttgagggca

SEQ ID NO: 75320 - DNA, 25 bp, Mus musculus
aatcaagccatctgccttgagggca

SEQ ID NO: 75321 - DNA, 25 bp, Mus musculus
aatcaagccattacctgtcgtgtag

SEQ ID NO: 75322 - DNA, 25 bp, Mus musculus
aatcaagccatttcctgtcgtgtag

SEQ ID NO: 75323 - DNA, 25 bp, Mus musculus
aatcaagccctaaattcccaaggag

SEQ ID NO: 75324 - DNA, 25 bp, Mus musculus
aatcaagccctatattcccaaggag

SEQ ID NO: 75325 - DNA, 25 bp, Mus musculus
aatcaagccgagcttcccagacgtg

SEQ ID NO: 75326 - DNA, 25 bp, Mus musculus
aatcaagccgaggttcccagacgtg

SEQ ID NO: 75327 - DNA, 25 bp, Mus musculus
aatcaagcttaccatggcacaattg

SEQ ID NO: 75328 - DNA, 25 bp, Mus musculus
aatcaagcttacgatggcacaattg

SEQ ID NO: 75329 - DNA, 25 bp, Mus musculus
aatcaaggagtgcttttgtggacag

SEQ ID NO: 75330 - DNA, 25 bp, Mus musculus
aatcaaggagtggttttgtggacag

SEQ ID NO: 75331 - DNA, 25 bp, Mus musculus
aatcaaggattgaaggttctctctt

SEQ ID NO: 75332 - DNA, 25 bp, Mus musculus
aatcaaggattgtaggttctctctt

SEQ ID NO: 75333 - DNA, 25 bp, Mus musculus
aatcaaggcatgagaggagcggccc

SEQ ID NO: 75334 - DNA, 25 bp, Mus musculus
aatcaaggcatgagcagtgatccat

SEQ ID NO: 75335 - DNA, 25 bp, Mus musculus
aatcaaggcatgtgaggagcggccc

SEQ ID NO: 75336 - DNA, 25 bp, Mus musculus
aatcaaggcatgtgcagtgatccat

SEQ ID NO: 75337 - DNA, 25 bp, Mus musculus
aatcaaggccatcctgcccattgat

SEQ ID NO: 75338 - DNA, 25 bp, Mus musculus
aatcaaggccatgctgcccattgat

SEQ ID NO: 75339 - DNA, 25 bp, Mus musculus
aatcaagggataaggctctattact

SEQ ID NO: 75340 - DNA, 25 bp, Mus musculus
aatcaagggatatggctctattact

SEQ ID NO: 75341 - DNA, 25 bp, Mus musculus
aatcaaggtcccctatccaatggga

SEQ ID NO: 75342 - DNA, 25 bp, Mus musculus
aatcaaggtcccgtatccaatggga

SEQ ID NO: 75343 - DNA, 25 bp, Mus musculus
aatcaaggtgagactctctgtcttc

SEQ ID NO: 75344 - DNA, 25 bp, Mus musculus
aatcaaggtgagtctctctgtcttc

SEQ ID NO: 75345 - DNA, 25 bp, Mus musculus
aatcaagtaacaataagctcctaac

SEQ ID NO: 75346 - DNA, 25 bp, Mus musculus
aatcaagtaacattaagctcctaac

SEQ ID NO: 75347 - DNA, 25 bp, Mus musculus
aatcaagtagcacttcgcagaacag

SEQ ID NO: 75348 - DNA, 25 bp, Mus musculus
aatcaagtagcagttcgcagaacag

SEQ ID NO: 75349 - DNA, 25 bp, Mus musculus
aatcaagtcaccaaagccttgccag

SEQ ID NO: 75350 - DNA, 25 bp, Mus musculus
aatcaagtcacctaagccttgccag

SEQ ID NO: 75351 - DNA, 25 bp, Mus musculus
aatcaagtcccgaacccactctgtg

SEQ ID NO: 75352 - DNA, 25 bp, Mus musculus
aatcaagtcccgtacccactctgtg

SEQ ID NO: 75353 - DNA, 25 bp, Mus musculus
aatcaagtctttcttctaagtgtta

SEQ ID NO: 75354 - DNA, 25 bp, Mus musculus
aatcaagtctttgttctaagtgtta

SEQ ID NO: 75355 - DNA, 25 bp, Mus musculus
aatcaagtgtttcctgcctgttgtt

SEQ ID NO: 75356 - DNA, 25 bp, Mus musculus
aatcaagtgtttgctgcctgttgtt

SEQ ID NO: 75357 - DNA, 25 bp, Mus musculus
aatcaagttctccttttcccagatg

SEQ ID NO: 75358 - DNA, 25 bp, Mus musculus
aatcaagttctcgttttcccagatg

SEQ ID NO: 75359 - DNA, 25 bp, Mus musculus
aatcaagttctgattctgtcccatc

SEQ ID NO: 75360 - DNA, 25 bp, Mus musculus
aatcaagttctgtttctgtcccatc

SEQ ID NO: 75361 - DNA, 25 bp, Mus musculus
aatcaagttggcaagttgtgtgttt

SEQ ID NO: 75362 - DNA, 25 bp, Mus musculus
aatcaagttggctagttgtgtgttt

SEQ ID NO: 75363 - DNA, 25 bp, Mus musculus
aatcaagttggtcacgcggtacagt

SEQ ID NO: 75364 - DNA, 25 bp, Mus musculus
aatcaagttggtgacgcggtacagt

SEQ ID NO: 75365 - DNA, 25 bp, Mus musculus
aatcaagtttttccagcctgtctgg

SEQ ID NO: 75366 - DNA, 25 bp, Mus musculus
aatcaagtttttgcagcctgtctgg

SEQ ID NO: 75367 - DNA, 25 bp, Mus musculus
aatcaatacagcagtgtgggtggaa

SEQ ID NO: 75368 - DNA, 25 bp, Mus musculus
aatcaatacagctgtgtgggtggaa

SEQ ID NO: 75369 - DNA, 25 bp, Mus musculus
aatcaatattgactcctctgcacag

SEQ ID NO: 75370 - DNA, 25 bp, Mus musculus
aatcaatattgagtcctctgcacag

SEQ ID NO: 75371 - DNA, 25 bp, Mus musculus
aatcaatcaaagaagcccgtgtcgg

SEQ ID NO: 75372 - DNA, 25 bp, Mus musculus
aatcaatcaaagtagcccgtgtcgg

SEQ ID NO: 75373 - DNA, 25 bp, Mus musculus
aatcaatcagagaagcagccgcttt

SEQ ID NO: 75374 - DNA, 25 bp, Mus musculus
aatcaatcagagtagcagccgcttt

SEQ ID NO: 75375 - DNA, 25 bp, Mus musculus
aatcaatcccttcaaatgtcctagc

SEQ ID NO: 75376 - DNA, 25 bp, Mus musculus
aatcaatcccttgaaatgtcctagc

SEQ ID NO: 75377 - DNA, 25 bp, Mus musculus
aatcaatccttgacctagagctcct

SEQ ID NO: 75378 - DNA, 25 bp, Mus musculus
aatcaatccttgtcctagagctcct

SEQ ID NO: 75379 - DNA, 25 bp, Mus musculus
aatcaatcttggactccactgagga

SEQ ID NO: 75380 - DNA, 25 bp, Mus musculus
aatcaatcttggtctccactgagga

SEQ ID NO: 75381 - DNA, 25 bp, Mus musculus
aatcaatgagaacacaggcagtgtc

SEQ ID NO: 75382 - DNA, 25 bp, Mus musculus
aatcaatgagaagacaggcagtgtc

SEQ ID NO: 75383 - DNA, 25 bp, Mus musculus
aatcaatgatttcccatgtcttgcc

SEQ ID NO: 75384 - DNA, 25 bp, Mus musculus
aatcaatgatttgccatgtcttgcc

SEQ ID NO: 75385 - DNA, 25 bp, Mus musculus
aatcaatgcctgcacattgcaattc

SEQ ID NO: 75386 - DNA, 25 bp, Mus musculus
aatcaatgcctggacattgcaattc

SEQ ID NO: 75387 - DNA, 25 bp, Mus musculus
aatcaatgcttgatgtagtcacagc

SEQ ID NO: 75388 - DNA, 25 bp, Mus musculus
aatcaatgcttgttgtagtcacagc

SEQ ID NO: 75389 - DNA, 25 bp, Mus musculus
aatcaatgtcctagtgtggtattta

SEQ ID NO: 75390 - DNA, 25 bp, Mus musculus
aatcaatgtccttgtgtggtattta

SEQ ID NO: 75391 - DNA, 25 bp, Mus musculus
aatcaatgtctcaggctggttttct

SEQ ID NO: 75392 - DNA, 25 bp, Mus musculus
aatcaatgtctctggctggttttct

SEQ ID NO: 75393 - DNA, 25 bp, Mus musculus
aatcaatgtgaccatccctgcaggg

SEQ ID NO: 75394 - DNA, 25 bp, Mus musculus
aatcaatgtgacgatccctgcaggg

SEQ ID NO: 75395 - DNA, 25 bp, Mus musculus
aatcaatgtggcaaaatcttttcac

SEQ ID NO: 75396 - DNA, 25 bp, Mus musculus
aatcaatgtggctaaatcttttcac

SEQ ID NO: 75397 - DNA, 25 bp, Mus musculus
aatcaatgtgttctccttggtgata

SEQ ID NO: 75398 - DNA, 25 bp, Mus musculus
aatcaatgtgttgtccttggtgata

SEQ ID NO: 75399 - DNA, 25 bp, Mus musculus
aatcaattatgtattctccttccag

SEQ ID NO: 75400 - DNA, 25 bp, Mus musculus
aatcaattatgttttctccttccag

SEQ ID NO: 75401 - DNA, 25 bp, Mus musculus
aatcaattatttcccacacagtgcg

SEQ ID NO: 75402 - DNA, 25 bp, Mus musculus
aatcaattatttgccacacagtgcg

SEQ ID NO: 75403 - DNA, 25 bp, Mus musculus
aatcaattcgcacattccgcagctc

SEQ ID NO: 75404 - DNA, 25 bp, Mus musculus
aatcaattcgcagattccgcagctc

SEQ ID NO: 75405 - DNA, 25 bp, Mus musculus
aatcaattgccacacttgagtcaat

SEQ ID NO: 75406 - DNA, 25 bp, Mus musculus
aatcaattgccagacttgagtcaat

SEQ ID NO: 75407 - DNA, 25 bp, Mus musculus
aatcaatttggcagctttaatcttg

SEQ ID NO: 75408 - DNA, 25 bp, Mus musculus
aatcaatttggccacattagttatg

SEQ ID NO: 75409 - DNA, 25 bp, Mus musculus
aatcaatttggcgacattagttatg

SEQ ID NO: 75410 - DNA, 25 bp, Mus musculus
aatcaatttggctgctttaatcttg

SEQ ID NO: 75411 - DNA, 25 bp, Mus musculus
aatcacaaagacctcatccaagctg

SEQ ID NO: 75412 - DNA, 25 bp, Mus musculus
aatcacaaagacgtcatccaagctg

SEQ ID NO: 75413 - DNA, 25 bp, Mus musculus
aatcacaaaggtactgtcggacaca

SEQ ID NO: 75414 - DNA, 25 bp, Mus musculus
aatcacaaaggttctgtcggacaca

SEQ ID NO: 75415 - DNA, 25 bp, Mus musculus
aatcacaaagtcagtcatgccacct

SEQ ID NO: 75416 - DNA, 25 bp, Mus musculus
aatcacaaagtctgtcatgccacct

SEQ ID NO: 75417 - DNA, 25 bp, Mus musculus
aatcacaacaacagtcacagacctt

SEQ ID NO: 75418 - DNA, 25 bp, Mus musculus
aatcacaacaactgtcacagacctt

SEQ ID NO: 75419 - DNA, 25 bp, Mus musculus
aatcacaaccttctcatttgtttgt

SEQ ID NO: 75420 - DNA, 25 bp, Mus musculus
aatcacaaccttgtcatttgtttgt

SEQ ID NO: 75421 - DNA, 25 bp, Mus musculus
aatcacaactggatctctgcaggct

SEQ ID NO: 75422 - DNA, 25 bp, Mus musculus
aatcacaactggttctctgcaggct

SEQ ID NO: 75423 - DNA, 25 bp, Mus musculus
aatcacaacttgatattcatcagag

SEQ ID NO: 75424 - DNA, 25 bp, Mus musculus
aatcacaacttgttattcatcagag

SEQ ID NO: 75425 - DNA, 25 bp, Mus musculus
aatcacaagacccaaagcactgctg

SEQ ID NO: 75426 - DNA, 25 bp, Mus musculus
aatcacaagaccgaaagcactgctg

SEQ ID NO: 75427 - DNA, 25 bp, Mus musculus
aatcacaagggcctgggtcagcctc

SEQ ID NO: 75428 - DNA, 25 bp, Mus musculus
aatcacaagggcgtgggtcagcctc

SEQ ID NO: 75429 - DNA, 25 bp, Mus musculus
aatcacaagtgccttactctgacca

SEQ ID NO: 75430 - DNA, 25 bp, Mus musculus
aatcacaagtgcgttactctgacca

SEQ ID NO: 75431 - DNA, 25 bp, Mus musculus
aatcacaagttgcatgaggacctgt

SEQ ID NO: 75432 - DNA, 25 bp, Mus musculus
aatcacaagttggatgaggacctgt

SEQ ID NO: 75433 - DNA, 25 bp, Mus musculus
aatcacaatgaaatctgaggcacac

SEQ ID NO: 75434 - DNA, 25 bp, Mus musculus
aatcacaatgaattctgaggcacac

SEQ ID NO: 75435 - DNA, 25 bp, Mus musculus
aatcacacacagaagggacgcccgt

SEQ ID NO: 75436 - DNA, 25 bp, Mus musculus
aatcacacacagtagggacgcccgt

SEQ ID NO: 75437 - DNA, 25 bp, Mus musculus
aatcacactaagaccatcattttgg

SEQ ID NO: 75438 - DNA, 25 bp, Mus musculus
aatcacactaagtccatcattttgg

SEQ ID NO: 75439 - DNA, 25 bp, Mus musculus
aatcacacttggatactgagatgac

SEQ ID NO: 75440 - DNA, 25 bp, Mus musculus
aatcacacttggttactgagatgac

SEQ ID NO: 75441 - DNA, 25 bp, Mus musculus
aatcacagacctacccctaagggat

SEQ ID NO: 75442 - DNA, 25 bp, Mus musculus
aatcacagaccttcccctaagggat

SEQ ID NO: 75443 - DNA, 25 bp, Mus musculus
aatcacagatatcactgccctgctg

SEQ ID NO: 75444 - DNA, 25 bp, Mus musculus
aatcacagatatgactgccctgctg

SEQ ID NO: 75445 - DNA, 25 bp, Mus musculus
aatcacagatttccgtagctcctct

SEQ ID NO: 75446 - DNA, 25 bp, Mus musculus
aatcacagatttgcgtagctcctct

SEQ ID NO: 75447 - DNA, 25 bp, Mus musculus
aatcacagcaggagccttgggcaaa

SEQ ID NO: 75448 - DNA, 25 bp, Mus musculus
aatcacagcaggtgccttgggcaaa

SEQ ID NO: 75449 - DNA, 25 bp, Mus musculus
aatcacagccgtatattgtcccatt

SEQ ID NO: 75450 - DNA, 25 bp, Mus musculus
aatcacagccgtttattgtcccatt

SEQ ID NO: 75451 - DNA, 25 bp, Mus musculus
aatcacagctgaattcactgggaag

SEQ ID NO: 75452 - DNA, 25 bp, Mus musculus
aatcacagctgatttcactgggaag

SEQ ID NO: 75453 - DNA, 25 bp, Mus musculus
aatcacagctggcagtgcggatccg

SEQ ID NO: 75454 - DNA, 25 bp, Mus musculus
aatcacagctgggagtgcggatccg

SEQ ID NO: 75455 - DNA, 25 bp, Mus musculus
aatcacaggactcccagggaccttc

SEQ ID NO: 75456 - DNA, 25 bp, Mus musculus
aatcacaggactgccagggaccttc

SEQ ID NO: 75457 - DNA, 25 bp, Mus musculus
aatcacagtactctgcatgctgagg

SEQ ID NO: 75458 - DNA, 25 bp, Mus musculus
aatcacagtactgtgcatgctgagg

SEQ ID NO: 75459 - DNA, 25 bp, Mus musculus
aatcacagtgaaagtggctggcgct

SEQ ID NO: 75460 - DNA, 25 bp, Mus musculus
aatcacagtgaatgtggctggcgct

SEQ ID NO: 75461 - DNA, 25 bp, Mus musculus
aatcacagtgatagttctccttgct

SEQ ID NO: 75462 - DNA, 25 bp, Mus musculus
aatcacagtgattgttctccttgct

SEQ ID NO: 75463 - DNA, 25 bp, Mus musculus
aatcacagtgcaacgcggtaaagac

SEQ ID NO: 75464 - DNA, 25 bp, Mus musculus
aatcacagtgcatcgcggtaaagac

SEQ ID NO: 75465 - DNA, 25 bp, Mus musculus
aatcacagtgcccagtatccgaaat

SEQ ID NO: 75466 - DNA, 25 bp, Mus musculus
aatcacagtgccgagtatccgaaat

SEQ ID NO: 75467 - DNA, 25 bp, Mus musculus
aatcacagtgtaattcattatccca

SEQ ID NO: 75468 - DNA, 25 bp, Mus musculus
aatcacagtgtatttcattatccca

SEQ ID NO: 75469 - DNA, 25 bp, Mus musculus
aatcacataaaacggcccagaccac

SEQ ID NO: 75470 - DNA, 25 bp, Mus musculus
aatcacataaaagggcccagaccac

SEQ ID NO: 75471 - DNA, 25 bp, Mus musculus
aatcacatacacacttatcccaaat

SEQ ID NO: 75472 - DNA, 25 bp, Mus musculus
aatcacatacactcttatcccaaat

SEQ ID NO: 75473 - DNA, 25 bp, Mus musculus
aatcacatagggatgactccccaaa

SEQ ID NO: 75474 - DNA, 25 bp, Mus musculus
aatcacatagggttgactccccaaa

SEQ ID NO: 75475 - DNA, 25 bp, Mus musculus
aatcacatcagcagtgtcatcaagg

SEQ ID NO: 75476 - DNA, 25 bp, Mus musculus
aatcacatcagctgtgtcatcaagg

SEQ ID NO: 75477 - DNA, 25 bp, Mus musculus
aatcacatcccacctgggcaatgag

SEQ ID NO: 75478 - DNA, 25 bp, Mus musculus
aatcacatcccagctgggcaatgag

SEQ ID NO: 75479 - DNA, 25 bp, Mus musculus
aatcacatctctaactactgctagt

SEQ ID NO: 75480 - DNA, 25 bp, Mus musculus
aatcacatctctagtcacatcttgt

SEQ ID NO: 75481 - DNA, 25 bp, Mus musculus
aatcacatctcttactactgctagt

SEQ ID NO: 75482 - DNA, 25 bp, Mus musculus
aatcacatctcttgtcacatcttgt

SEQ ID NO: 75483 - DNA, 25 bp, Mus musculus
aatcacatctgcacagtggcgttga

SEQ ID NO: 75484 - DNA, 25 bp, Mus musculus
aatcacatctgcagacggtctaatg

SEQ ID NO: 75485 - DNA, 25 bp, Mus musculus
aatcacatctgctcagtggcgttga

SEQ ID NO: 75486 - DNA, 25 bp, Mus musculus
aatcacatctgctgacggtctaatg

SEQ ID NO: 75487 - DNA, 25 bp, Mus musculus
aatcacatctgtaaatctttttatc

SEQ ID NO: 75488 - DNA, 25 bp, Mus musculus
aatcacatctgttaatctttttatc

SEQ ID NO: 75489 - DNA, 25 bp, Mus musculus
aatcacatctttaactagggttact

SEQ ID NO: 75490 - DNA, 25 bp, Mus musculus
aatcacatcttttactagggttact

SEQ ID NO: 75491 - DNA, 25 bp, Mus musculus
aatcacatgaagcttcccaaccatc

SEQ ID NO: 75492 - DNA, 25 bp, Mus musculus
aatcacatgaaggttcccaaccatc

SEQ ID NO: 75493 - DNA, 25 bp, Mus musculus
aatcacatgtgtagtgtcttggaca

SEQ ID NO: 75494 - DNA, 25 bp, Mus musculus
aatcacatgtgttgtgtcttggaca

SEQ ID NO: 75495 - DNA, 25 bp, Mus musculus
aatcacatgttgagtgccactgtag

SEQ ID NO: 75496 - DNA, 25 bp, Mus musculus
aatcacatgttgtgtgccactgtag

SEQ ID NO: 75497 - DNA, 25 bp, Mus musculus
aatcacattgacacatggaatggcc

SEQ ID NO: 75498 - DNA, 25 bp, Mus musculus
aatcacattgactcatggaatggcc

SEQ ID NO: 75499 - DNA, 25 bp, Mus musculus
aatcaccaaaaaatgtcccgccagc

SEQ ID NO: 75500 - DNA, 25 bp, Mus musculus
aatcaccaaaaattgtcccgccagc

SEQ ID NO: 75501 - DNA, 25 bp, Mus musculus
aatcaccaacagcagagtcagggac

SEQ ID NO: 75502 - DNA, 25 bp, Mus musculus
aatcaccaacaggagagtcagggac

SEQ ID NO: 75503 - DNA, 25 bp, Mus musculus
aatcaccaacgtctgcatgctttcg

SEQ ID NO: 75504 - DNA, 25 bp, Mus musculus
aatcaccaacgtgtgcatgctttcg

SEQ ID NO: 75505 - DNA, 25 bp, Mus musculus
aatcaccaactgaattttgtatcta

SEQ ID NO: 75506 - DNA, 25 bp, Mus musculus
aatcaccaactgtattttgtatcta

SEQ ID NO: 75507 - DNA, 25 bp, Mus musculus
aatcaccaacttctcatcaggcagt

SEQ ID NO: 75508 - DNA, 25 bp, Mus musculus
aatcaccaacttgtcatcaggcagt

SEQ ID NO: 75509 - DNA, 25 bp, Mus musculus
aatcaccaagaaatccttcttagag

SEQ ID NO: 75510 - DNA, 25 bp, Mus musculus
aatcaccaagaattccttcttagag

SEQ ID NO: 75511 - DNA, 25 bp, Mus musculus
aatcaccaagatactctggcacagt

SEQ ID NO: 75512 - DNA, 25 bp, Mus musculus
aatcaccaagattctctggcacagt

SEQ ID NO: 75513 - DNA, 25 bp, Mus musculus
aatcaccaagctagaagaccctgcg

SEQ ID NO: 75514 - DNA, 25 bp, Mus musculus
aatcaccaagcttgaagaccctgcg

SEQ ID NO: 75515 - DNA, 25 bp, Mus musculus
aatcaccaaggtccaaggcgatcca

SEQ ID NO: 75516 - DNA, 25 bp, Mus musculus
aatcaccaaggtgcaaggcgatcca

SEQ ID NO: 75517 - DNA, 25 bp, Mus musculus
aatcaccaagtcatccaggagaccc

SEQ ID NO: 75518 - DNA, 25 bp, Mus musculus
aatcaccaagtcttccaggagaccc

SEQ ID NO: 75519 - DNA, 25 bp, Mus musculus
aatcaccacattataatcataacta

SEQ ID NO: 75520 - DNA, 25 bp, Mus musculus
aatcaccacattcccagtaccagga

SEQ ID NO: 75521 - DNA, 25 bp, Mus musculus
aatcaccacattgccagtaccagga

SEQ ID NO: 75522 - DNA, 25 bp, Mus musculus
aatcaccacattttaatcataacta

SEQ ID NO: 75523 - DNA, 25 bp, Mus musculus
aatcaccactagaccatgctgtggg

SEQ ID NO: 75524 - DNA, 25 bp, Mus musculus
aatcaccactagtccatgctgtggg

SEQ ID NO: 75525 - DNA, 25 bp, Mus musculus
aatcaccactttagcaagctgtttt

SEQ ID NO: 75526 - DNA, 25 bp, Mus musculus
aatcaccacttttgcaagctgtttt

SEQ ID NO: 75527 - DNA, 25 bp, Mus musculus
aatcaccagattaggtggccagcca

SEQ ID NO: 75528 - DNA, 25 bp, Mus musculus
aatcaccagatttggtggccagcca

SEQ ID NO: 75529 - DNA, 25 bp, Mus musculus
aatcaccaggggctgctgttgatgg

SEQ ID NO: 75530 - DNA, 25 bp, Mus musculus
aatcaccagggggtgctgttgatgg

SEQ ID NO: 75531 - DNA, 25 bp, Mus musculus
aatcaccatcaccacctaaaggagt

SEQ ID NO: 75532 - DNA, 25 bp, Mus musculus
aatcaccatcacgacctaaaggagt

SEQ ID NO: 75533 - DNA, 25 bp, Mus musculus
aatcaccatggaattacctggatgt

SEQ ID NO: 75534 - DNA, 25 bp, Mus musculus
aatcaccatggatttacctggatgt

SEQ ID NO: 75535 - DNA, 25 bp, Mus musculus
aatcacccatctaagcttgccttga

SEQ ID NO: 75536 - DNA, 25 bp, Mus musculus
aatcacccatcttagcttgccttga

SEQ ID NO: 75537 - DNA, 25 bp, Mus musculus
aatcacccggataattcaggacaaa

SEQ ID NO: 75538 - DNA, 25 bp, Mus musculus
aatcacccggattattcaggacaaa

SEQ ID NO: 75539 - DNA, 25 bp, Mus musculus
aatcaccctgtgacctgtaatcaac

SEQ ID NO: 75540 - DNA, 25 bp, Mus musculus
aatcaccctgtgtcctgtaatcaac

SEQ ID NO: 75541 - DNA, 25 bp, Mus musculus
aatcaccgaggaagcaagaagatca

SEQ ID NO: 75542 - DNA, 25 bp, Mus musculus
aatcaccgaggatgcaagaagatca

SEQ ID NO: 75543 - DNA, 25 bp, Mus musculus
aatcaccgatgcaactttgcaggca

SEQ ID NO: 75544 - DNA, 25 bp, Mus musculus
aatcaccgatgctactttgcaggca

SEQ ID NO: 75545 - DNA, 25 bp, Mus musculus
aatcaccgatttcaatttgggccga

SEQ ID NO: 75546 - DNA, 25 bp, Mus musculus
aatcaccgatttgaatttgggccga

SEQ ID NO: 75547 - DNA, 25 bp, Mus musculus
aatcaccgtgtaagttatggtctaa

SEQ ID NO: 75548 - DNA, 25 bp, Mus musculus
aatcaccgtgtatgttatggtctaa

SEQ ID NO: 75549 - DNA, 25 bp, Mus musculus
aatcaccgttaactaacatcctctc

SEQ ID NO: 75550 - DNA, 25 bp, Mus musculus
aatcaccgttaagtaacatcctctc

SEQ ID NO: 75551 - DNA, 25 bp, Mus musculus
aatcacctatgtctccagtgacata

SEQ ID NO: 75552 - DNA, 25 bp, Mus musculus
aatcacctatgtgtccagtgacata

SEQ ID NO: 75553 - DNA, 25 bp, Mus musculus
aatcacctcagtagctgctgtaata

SEQ ID NO: 75554 - DNA, 25 bp, Mus musculus
aatcacctcagttgctgctgtaata

SEQ ID NO: 75555 - DNA, 25 bp, Mus musculus
aatcacctgcatctagggctgaagg

SEQ ID NO: 75556 - DNA, 25 bp, Mus musculus
aatcacctgcatgtagggctgaagg

SEQ ID NO: 75557 - DNA, 25 bp, Mus musculus
aatcacctggataggcagcctctga

SEQ ID NO: 75558 - DNA, 25 bp, Mus musculus
aatcacctggattggcagcctctga

SEQ ID NO: 75559 - DNA, 25 bp, Mus musculus
aatcacctgggaatcggtccgttga

SEQ ID NO: 75560 - DNA, 25 bp, Mus musculus
aatcacctgggattcggtccgttga

SEQ ID NO: 75561 - DNA, 25 bp, Mus musculus
aatcacctggtacatggacgtctga

SEQ ID NO: 75562 - DNA, 25 bp, Mus musculus
aatcacctggtagatggacgtctga

SEQ ID NO: 75563 - DNA, 25 bp, Mus musculus
aatcacctgtgacccatatcaccat

SEQ ID NO: 75564 - DNA, 25 bp, Mus musculus
aatcacctgtgagccatatcaccat

SEQ ID NO: 75565 - DNA, 25 bp, Mus musculus
aatcaccttcggctacacaaggagt

SEQ ID NO: 75566 - DNA, 25 bp, Mus musculus
aatcaccttcgggtacacaaggagt

SEQ ID NO: 75567 - DNA, 25 bp, Mus musculus
aatcaccttctcattaaactttgct

SEQ ID NO: 75568 - DNA, 25 bp, Mus musculus
aatcaccttctctttaaactttgct

SEQ ID NO: 75569 - DNA, 25 bp, Mus musculus
aatcaccttgataatcctccgaact

SEQ ID NO: 75570 - DNA, 25 bp, Mus musculus
aatcaccttgattatcctccgaact

SEQ ID NO: 75571 - DNA, 25 bp, Mus musculus
aatcaccttgctattcacctatatt

SEQ ID NO: 75572 - DNA, 25 bp, Mus musculus
aatcaccttgcttttcacctatatt

SEQ ID NO: 75573 - DNA, 25 bp, Mus musculus
aatcaccttgggaataactctctgt

SEQ ID NO: 75574 - DNA, 25 bp, Mus musculus
aatcaccttgggtataactctctgt

SEQ ID NO: 75575 - DNA, 25 bp, Mus musculus
aatcacgaagtgagggtgtccaagg

SEQ ID NO: 75576 - DNA, 25 bp, Mus musculus
aatcacgaagtgtgggtgtccaagg

SEQ ID NO: 75577 - DNA, 25 bp, Mus musculus
aatcacgagaagacaacggcagctg

SEQ ID NO: 75578 - DNA, 25 bp, Mus musculus
aatcacgagaagtcaacggcagctg

SEQ ID NO: 75579 - DNA, 25 bp, Mus musculus
aatcacgagggtcacccactgagtg

SEQ ID NO: 75580 - DNA, 25 bp, Mus musculus
aatcacgagggtgacccactgagtg

SEQ ID NO: 75581 - DNA, 25 bp, Mus musculus
aatcacgatccaacgaaaggctggt

SEQ ID NO: 75582 - DNA, 25 bp, Mus musculus
aatcacgatccatcgaaaggctggt

SEQ ID NO: 75583 - DNA, 25 bp, Mus musculus
aatcacgcccatcctaaaatctatg

SEQ ID NO: 75584 - DNA, 25 bp, Mus musculus
aatcacgcccatgctaaaatctatg

SEQ ID NO: 75585 - DNA, 25 bp, Mus musculus
aatcacgccctgcagctacaggatg

SEQ ID NO: 75586 - DNA, 25 bp, Mus musculus
aatcacgccctggagctacaggatg

SEQ ID NO: 75587 - DNA, 25 bp, Mus musculus
aatcacgctcggacctgctcaaggc

SEQ ID NO: 75588 - DNA, 25 bp, Mus musculus
aatcacgctcggtcctgctcaaggc

SEQ ID NO: 75589 - DNA, 25 bp, Mus musculus
aatcacgctgtaatttctgttatta

SEQ ID NO: 75590 - DNA, 25 bp, Mus musculus
aatcacgctgtattttctgttatta

SEQ ID NO: 75591 - DNA, 25 bp, Mus musculus
aatcacgtaaatacacccggacaga

SEQ ID NO: 75592 - DNA, 25 bp, Mus musculus
aatcacgtaaattcacccggacaga

SEQ ID NO: 75593 - DNA, 25 bp, Mus musculus
aatcacgtcaaacttggtgctcaaa

SEQ ID NO: 75594 - DNA, 25 bp, Mus musculus
aatcacgtcaaagttggtgctcaaa

SEQ ID NO: 75595 - DNA, 25 bp, Mus musculus
aatcacgtcttaccccttatcaaat

SEQ ID NO: 75596 - DNA, 25 bp, Mus musculus
aatcacgtcttagcccttatcaaat

SEQ ID NO: 75597 - DNA, 25 bp, Mus musculus
aatcacgtgagacgatttggtacac

SEQ ID NO: 75598 - DNA, 25 bp, Mus musculus
aatcacgtgagaggatttggtacac

SEQ ID NO: 75599 - DNA, 25 bp, Mus musculus
aatcacgtgctacagggaaccagag

SEQ ID NO: 75600 - DNA, 25 bp, Mus musculus
aatcacgtgctagagggaaccagag

SEQ ID NO: 75601 - DNA, 25 bp, Mus musculus
aatcacgtgttacctgctcctcgga

SEQ ID NO: 75602 - DNA, 25 bp, Mus musculus
aatcacgtgttagctgctcctcgga

SEQ ID NO: 75603 - DNA, 25 bp, Mus musculus
aatcacgtgttcagggctatctcag

SEQ ID NO: 75604 - DNA, 25 bp, Mus musculus
aatcacgtgttctgggctatctcag

SEQ ID NO: 75605 - DNA, 25 bp, Mus musculus
aatcacgtttgtatccttggcatct

SEQ ID NO: 75606 - DNA, 25 bp, Mus musculus
aatcacgtttgtttccttggcatct

SEQ ID NO: 75607 - DNA, 25 bp, Mus musculus
aatcactaaccaagtatcccaggtg

SEQ ID NO: 75608 - DNA, 25 bp, Mus musculus
aatcactaaccatgtatcccaggtg

SEQ ID NO: 75609 - DNA, 25 bp, Mus musculus
aatcactaactcacccttttgggat

SEQ ID NO: 75610 - DNA, 25 bp, Mus musculus
aatcactaactctcccttttgggat

SEQ ID NO: 75611 - DNA, 25 bp, Mus musculus
aatcactacagaacccattctccag

SEQ ID NO: 75612 - DNA, 25 bp, Mus musculus
aatcactacagatcccattctccag

SEQ ID NO: 75613 - DNA, 25 bp, Mus musculus
aatcactaccagatacgagtcccga

SEQ ID NO: 75614 - DNA, 25 bp, Mus musculus
aatcactaccagttacgagtcccga

SEQ ID NO: 75615 - DNA, 25 bp, Mus musculus
aatcactagtgtattgctgttgcga

SEQ ID NO: 75616 - DNA, 25 bp, Mus musculus
aatcactagtgttttgctgttgcga

SEQ ID NO: 75617 - DNA, 25 bp, Mus musculus
aatcactatgtgattctacttctaa

SEQ ID NO: 75618 - DNA, 25 bp, Mus musculus
aatcactatgtgtttctacttctaa

SEQ ID NO: 75619 - DNA, 25 bp, Mus musculus
aatcactcaaagctgcagttctgca

SEQ ID NO: 75620 - DNA, 25 bp, Mus musculus
aatcactcaaaggtgcagttctgca

SEQ ID NO: 75621 - DNA, 25 bp, Mus musculus
aatcactcacccaaagagagcctaa

SEQ ID NO: 75622 - DNA, 25 bp, Mus musculus
aatcactcaccctaagagagcctaa

SEQ ID NO: 75623 - DNA, 25 bp, Mus musculus
aatcactcaggcaggtgcttgtacc

SEQ ID NO: 75624 - DNA, 25 bp, Mus musculus
aatcactcaggctggtgcttgtacc

SEQ ID NO: 75625 - DNA, 25 bp, Mus musculus
aatcactcagtcctaacttttcaga

SEQ ID NO: 75626 - DNA, 25 bp, Mus musculus
aatcactcagtcgtaacttttcaga

SEQ ID NO: 75627 - DNA, 25 bp, Mus musculus
aatcactccttgcagtccagtttgt

SEQ ID NO: 75628 - DNA, 25 bp, Mus musculus
aatcactccttggagtccagtttgt

SEQ ID NO: 75629 - DNA, 25 bp, Mus musculus
aatcactcgattctcctgagagcag

SEQ ID NO: 75630 - DNA, 25 bp, Mus musculus
aatcactcgattgtcctgagagcag

SEQ ID NO: 75631 - DNA, 25 bp, Mus musculus
aatcactctatcatggtatctccac

SEQ ID NO: 75632 - DNA, 25 bp, Mus musculus
aatcactctatcttggtatctccac

SEQ ID NO: 75633 - DNA, 25 bp, Mus musculus
aatcactctgcacttggagccttgc

SEQ ID NO: 75634 - DNA, 25 bp, Mus musculus
aatcactctgcagttggagccttgc

SEQ ID NO: 75635 - DNA, 25 bp, Mus musculus
aatcactgacatcttacattccaca

SEQ ID NO: 75636 - DNA, 25 bp, Mus musculus
aatcactgacatgttacattccaca

SEQ ID NO: 75637 - DNA, 25 bp, Mus musculus
aatcactgaccgaacagtagcctca

SEQ ID NO: 75638 - DNA, 25 bp, Mus musculus
aatcactgaccgtacagtagcctca

SEQ ID NO: 75639 - DNA, 25 bp, Mus musculus
aatcactgagctctccaggtctatg

SEQ ID NO: 75640 - DNA, 25 bp, Mus musculus
aatcactgagctgtccaggtctatg

SEQ ID NO: 75641 - DNA, 25 bp, Mus musculus
aatcactgattacttctttggcttg

SEQ ID NO: 75642 - DNA, 25 bp, Mus musculus
aatcactgattagttctttggcttg

SEQ ID NO: 75643 - DNA, 25 bp, Mus musculus
aatcactgcactcttactgtaaagc

SEQ ID NO: 75644 - DNA, 25 bp, Mus musculus
aatcactgcactgttactgtaaagc

SEQ ID NO: 75645 - DNA, 25 bp, Mus musculus
aatcactggtccaacttgaggccca

SEQ ID NO: 75646 - DNA, 25 bp, Mus musculus
aatcactggtcctacttgaggccca

SEQ ID NO: 75647 - DNA, 25 bp, Mus musculus
aatcactgtactattttgacccaga

SEQ ID NO: 75648 - DNA, 25 bp, Mus musculus
aatcactgtacttttttgacccaga

SEQ ID NO: 75649 - DNA, 25 bp, Mus musculus
aatcactgtcagagctagccttgcc

SEQ ID NO: 75650 - DNA, 25 bp, Mus musculus
aatcactgtcagtgctagccttgcc

SEQ ID NO: 75651 - DNA, 25 bp, Mus musculus
aatcactgtcttcattcggcacttc

SEQ ID NO: 75652 - DNA, 25 bp, Mus musculus
aatcactgtcttcgaagatttccta

SEQ ID NO: 75653 - DNA, 25 bp, Mus musculus
aatcactgtcttgattcggcacttc

SEQ ID NO: 75654 - DNA, 25 bp, Mus musculus
aatcactgtcttggaagatttccta

SEQ ID NO: 75655 - DNA, 25 bp, Mus musculus
aatcactgtgacattgtaaagctac

SEQ ID NO: 75656 - DNA, 25 bp, Mus musculus
aatcactgtgactttgtaaagctac

SEQ ID NO: 75657 - DNA, 25 bp, Mus musculus
aatcactgtggactctttgagtaca

SEQ ID NO: 75658 - DNA, 25 bp, Mus musculus
aatcactgtggagtctttgagtaca

SEQ ID NO: 75659 - DNA, 25 bp, Mus musculus
aatcactgtggtaccctgtcaagag

SEQ ID NO: 75660 - DNA, 25 bp, Mus musculus
aatcactgtggttccctgtcaagag

SEQ ID NO: 75661 - DNA, 25 bp, Mus musculus
aatcactgtgtgacagcgactggcc

SEQ ID NO: 75662 - DNA, 25 bp, Mus musculus
aatcactgtgtgtcagcgactggcc

SEQ ID NO: 75663 - DNA, 25 bp, Mus musculus
aatcactgttcaactcactttttga

SEQ ID NO: 75664 - DNA, 25 bp, Mus musculus
aatcactgttcatctcactttttga

SEQ ID NO: 75665 - DNA, 25 bp, Mus musculus
aatcactgttccatgttttgggcct

SEQ ID NO: 75666 - DNA, 25 bp, Mus musculus
aatcactgttccttgttttgggcct

SEQ ID NO: 75667 - DNA, 25 bp, Mus musculus
aatcactgtttaagtctgggcccac

SEQ ID NO: 75668 - DNA, 25 bp, Mus musculus
aatcactgtttatgtctgggcccac

SEQ ID NO: 75669 - DNA, 25 bp, Mus musculus
aatcacttaaacactctggtaaaag

SEQ ID NO: 75670 - DNA, 25 bp, Mus musculus
aatcacttaaactctctggtaaaag

SEQ ID NO: 75671 - DNA, 25 bp, Mus musculus
aatcacttaacaatccgttgcccaa

SEQ ID NO: 75672 - DNA, 25 bp, Mus musculus
aatcacttaacattccgttgcccaa

SEQ ID NO: 75673 - DNA, 25 bp, Mus musculus
aatcacttactaagttcctccagtc

SEQ ID NO: 75674 - DNA, 25 bp, Mus musculus
aatcacttactatgttcctccagtc

SEQ ID NO: 75675 - DNA, 25 bp, Mus musculus
aatcacttagaacccaactttcttc

SEQ ID NO: 75676 - DNA, 25 bp, Mus musculus
aatcacttagaagccaactttcttc

SEQ ID NO: 75677 - DNA, 25 bp, Mus musculus
aatcacttcaataaagagcgcctgg

SEQ ID NO: 75678 - DNA, 25 bp, Mus musculus
aatcacttcaattaagagcgcctgg

SEQ ID NO: 75679 - DNA, 25 bp, Mus musculus
aatcacttcataatcccctttagga

SEQ ID NO: 75680 - DNA, 25 bp, Mus musculus
aatcacttcatattcccctttagga

SEQ ID NO: 75681 - DNA, 25 bp, Mus musculus
aatcacttcctgctctgactagagg

SEQ ID NO: 75682 - DNA, 25 bp, Mus musculus
aatcacttcctggtctgactagagg

SEQ ID NO: 75683 - DNA, 25 bp, Mus musculus
aatcacttcgtgaaaaactctcttg

SEQ ID NO: 75684 - DNA, 25 bp, Mus musculus
aatcacttcgtgtaaaactctcttg

SEQ ID NO: 75685 - DNA, 25 bp, Mus musculus
aatcacttctggagtatacactgtc

SEQ ID NO: 75686 - DNA, 25 bp, Mus musculus
aatcacttctggtgtatacactgtc

SEQ ID NO: 75687 - DNA, 25 bp, Mus musculus
aatcacttgctaaggatcatggctg

SEQ ID NO: 75688 - DNA, 25 bp, Mus musculus
aatcacttgctatggatcatggctg

SEQ ID NO: 75689 - DNA, 25 bp, Mus musculus
aatcactttgctatagggcaactca

SEQ ID NO: 75690 - DNA, 25 bp, Mus musculus
aatcactttgctatcttccaggtac

SEQ ID NO: 75691 - DNA, 25 bp, Mus musculus
aatcactttgctttagggcaactca

SEQ ID NO: 75692 - DNA, 25 bp, Mus musculus
aatcactttgctttcttccaggtac

SEQ ID NO: 75693 - DNA, 25 bp, Mus musculus
aatcacttttccatatctgcttctg

SEQ ID NO: 75694 - DNA, 25 bp, Mus musculus
aatcacttttccttatctgcttctg

SEQ ID NO: 75695 - DNA, 25 bp, Mus musculus
aatcactttttaaagaccttgtaag

SEQ ID NO: 75696 - DNA, 25 bp, Mus musculus
aatcactttttatagaccttgtaag

SEQ ID NO: 75697 - DNA, 25 bp, Mus musculus
aatcagaaacagctccctaaccctt

SEQ ID NO: 75698 - DNA, 25 bp, Mus musculus
aatcagaaacaggtccctaaccctt

SEQ ID NO: 75699 - DNA, 25 bp, Mus musculus
aatcagaaactgcagataggtacag

SEQ ID NO: 75700 - DNA, 25 bp, Mus musculus
aatcagaaactggagataggtacag

SEQ ID NO: 75701 - DNA, 25 bp, Mus musculus
aatcagaaccccagagacctaaaag

SEQ ID NO: 75702 - DNA, 25 bp, Mus musculus
aatcagaacccctgagacctaaaag

SEQ ID NO: 75703 - DNA, 25 bp, Mus musculus
aatcagaagcttcagtgcccgtgac

SEQ ID NO: 75704 - DNA, 25 bp, Mus musculus
aatcagaagcttgagtgcccgtgac

SEQ ID NO: 75705 - DNA, 25 bp, Mus musculus
aatcagaaggccacaaagcacccat

SEQ ID NO: 75706 - DNA, 25 bp, Mus musculus
aatcagaaggcctcaaagcacccat

SEQ ID NO: 75707 - DNA, 25 bp, Mus musculus
aatcagaatgatcccatgtccacgc

SEQ ID NO: 75708 - DNA, 25 bp, Mus musculus
aatcagaatgatgccatgtccacgc

SEQ ID NO: 75709 - DNA, 25 bp, Mus musculus
aatcagacagttagagttcctattt

SEQ ID NO: 75710 - DNA, 25 bp, Mus musculus
aatcagacagtttgagttcctattt

SEQ ID NO: 75711 - DNA, 25 bp, Mus musculus
aatcagacatttacgtggcccatgc

SEQ ID NO: 75712 - DNA, 25 bp, Mus musculus
aatcagacattttcgtggcccatgc

SEQ ID NO: 75713 - DNA, 25 bp, Mus musculus
aatcagaccacaaagccttggctgt

SEQ ID NO: 75714 - DNA, 25 bp, Mus musculus
aatcagaccacatagccttggctgt

SEQ ID NO: 75715 - DNA, 25 bp, Mus musculus
aatcagaccagcctgtatggcttaa

SEQ ID NO: 75716 - DNA, 25 bp, Mus musculus
aatcagaccagcgtgtatggcttaa

SEQ ID NO: 75717 - DNA, 25 bp, Mus musculus
aatcagacctcaatgtaaagacact

SEQ ID NO: 75718 - DNA, 25 bp, Mus musculus
aatcagacctcattgtaaagacact

SEQ ID NO: 75719 - DNA, 25 bp, Mus musculus
aatcagacgtgccttccacaggatg

SEQ ID NO: 75720 - DNA, 25 bp, Mus musculus
aatcagacgtgcgttccacaggatg

SEQ ID NO: 75721 - DNA, 25 bp, Mus musculus
aatcagactatgagtttagagcccc

SEQ ID NO: 75722 - DNA, 25 bp, Mus musculus
aatcagactatgtgtttagagcccc

SEQ ID NO: 75723 - DNA, 25 bp, Mus musculus
aatcagactgagcacttagggccac

SEQ ID NO: 75724 - DNA, 25 bp, Mus musculus
aatcagactgaggacttagggccac

SEQ ID NO: 75725 - DNA, 25 bp, Mus musculus
aatcagactgctattaattgctact

SEQ ID NO: 75726 - DNA, 25 bp, Mus musculus
aatcagactgcttttaattgctact

SEQ ID NO: 75727 - DNA, 25 bp, Mus musculus
aatcagactgttcaaggtggctcaa

SEQ ID NO: 75728 - DNA, 25 bp, Mus musculus
aatcagactgttgaaggtggctcaa

SEQ ID NO: 75729 - DNA, 25 bp, Mus musculus
aatcagacttgacagcagtggctgc

SEQ ID NO: 75730 - DNA, 25 bp, Mus musculus
aatcagacttgagagcagtggctgc

SEQ ID NO: 75731 - DNA, 25 bp, Mus musculus
aatcagagacacacatccacacagg

SEQ ID NO: 75732 - DNA, 25 bp, Mus musculus
aatcagagacacctggtttcaccct

SEQ ID NO: 75733 - DNA, 25 bp, Mus musculus
aatcagagacacgtggtttcaccct

SEQ ID NO: 75734 - DNA, 25 bp, Mus musculus
aatcagagacactcatccacacagg

SEQ ID NO: 75735 - DNA, 25 bp, Mus musculus
aatcagagccctagcaaaattggtt

SEQ ID NO: 75736 - DNA, 25 bp, Mus musculus
aatcagagcccttgcaaaattggtt

SEQ ID NO: 75737 - DNA, 25 bp, Mus musculus
aatcagaggaaactggcgcgctgcc

SEQ ID NO: 75738 - DNA, 25 bp, Mus musculus
aatcagaggaaagtggcgcgctgcc

SEQ ID NO: 75739 - DNA, 25 bp, Mus musculus
aatcagaggagccactgcctgaggt

SEQ ID NO: 75740 - DNA, 25 bp, Mus musculus
aatcagaggagcgactgcctgaggt

SEQ ID NO: 75741 - DNA, 25 bp, Mus musculus
aatcagaggataacttttgggagct

SEQ ID NO: 75742 - DNA, 25 bp, Mus musculus
aatcagaggatatcttttgggagct

SEQ ID NO: 75743 - DNA, 25 bp, Mus musculus
aatcagaggcacatttgtcatcgtc

SEQ ID NO: 75744 - DNA, 25 bp, Mus musculus
aatcagaggcacttttgtcatcgtc

SEQ ID NO: 75745 - DNA, 25 bp, Mus musculus
aatcagaggctacccctgcctgtgt

SEQ ID NO: 75746 - DNA, 25 bp, Mus musculus
aatcagaggctagccctgcctgtgt

SEQ ID NO: 75747 - DNA, 25 bp, Mus musculus
aatcagaggttcaccggtcaggtca

SEQ ID NO: 75748 - DNA, 25 bp, Mus musculus
aatcagaggttctccggtcaggtca

SEQ ID NO: 75749 - DNA, 25 bp, Mus musculus
aatcagagtggaacccttctctact

SEQ ID NO: 75750 - DNA, 25 bp, Mus musculus
aatcagagtggatcccttctctact

SEQ ID NO: 75751 - DNA, 25 bp, Mus musculus
aatcagagtgttatccacgttccag

SEQ ID NO: 75752 - DNA, 25 bp, Mus musculus
aatcagagtgttttccacgttccag

SEQ ID NO: 75753 - DNA, 25 bp, Mus musculus
aatcagagttaaccatatccctttc

SEQ ID NO: 75754 - DNA, 25 bp, Mus musculus
aatcagagttaagcatatccctttc

SEQ ID NO: 75755 - DNA, 25 bp, Mus musculus
aatcagagttgccacctttcctaaa

SEQ ID NO: 75756 - DNA, 25 bp, Mus musculus
aatcagagttgcgacctttcctaaa

SEQ ID NO: 75757 - DNA, 25 bp, Mus musculus
aatcagatacctcgacttgtcctat

SEQ ID NO: 75758 - DNA, 25 bp, Mus musculus
aatcagatacctggacttgtcctat

SEQ ID NO: 75759 - DNA, 25 bp, Mus musculus
aatcagatcctgaaagtctgaacca

SEQ ID NO: 75760 - DNA, 25 bp, Mus musculus
aatcagatcctgtaagtctgaacca

SEQ ID NO: 75761 - DNA, 25 bp, Mus musculus
aatcagatggcacaccctacagctc

SEQ ID NO: 75762 - DNA, 25 bp, Mus musculus
aatcagatggcagaccctacagctc

SEQ ID NO: 75763 - DNA, 25 bp, Mus musculus
aatcagattctgcttgtgaacgtca

SEQ ID NO: 75764 - DNA, 25 bp, Mus musculus
aatcagattctggttgtgaacgtca

SEQ ID NO: 75765 - DNA, 25 bp, Mus musculus
aatcagattgccaccctggatttca

SEQ ID NO: 75766 - DNA, 25 bp, Mus musculus
aatcagattgcctccctggatttca

SEQ ID NO: 75767 - DNA, 25 bp, Mus musculus
aatcagattggaagccctggaccca

SEQ ID NO: 75768 - DNA, 25 bp, Mus musculus
aatcagattggatgccctggaccca

SEQ ID NO: 75769 - DNA, 25 bp, Mus musculus
aatcagatttgaccttgctttaact

SEQ ID NO: 75770 - DNA, 25 bp, Mus musculus
aatcagatttgagcttgctttaact

SEQ ID NO: 75771 - DNA, 25 bp, Mus musculus
aatcagatttgtagggtttctaact

SEQ ID NO: 75772 - DNA, 25 bp, Mus musculus
aatcagatttgttgggtttctaact

SEQ ID NO: 75773 - DNA, 25 bp, Mus musculus
aatcagattttcattcgaggcgaga

SEQ ID NO: 75774 - DNA, 25 bp, Mus musculus
aatcagattttctttcgaggcgaga

SEQ ID NO: 75775 - DNA, 25 bp, Mus musculus
aatcagcaacagacttcagtaccag

SEQ ID NO: 75776 - DNA, 25 bp, Mus musculus
aatcagcaacagtcttcagtaccag

SEQ ID NO: 75777 - DNA, 25 bp, Mus musculus
aatcagcacatacaatggtgagcct

SEQ ID NO: 75778 - DNA, 25 bp, Mus musculus
aatcagcacatagaatggtgagcct

SEQ ID NO: 75779 - DNA, 25 bp, Mus musculus
aatcagcacattcggcagctcaact

SEQ ID NO: 75780 - DNA, 25 bp, Mus musculus
aatcagcacattgggcagctcaact

SEQ ID NO: 75781 - DNA, 25 bp, Mus musculus
aatcagcagcagctacgcaaggtcc

SEQ ID NO: 75782 - DNA, 25 bp, Mus musculus
aatcagcagcaggtacgcaaggtcc

SEQ ID NO: 75783 - DNA, 25 bp, Mus musculus
aatcagcaggatctttctttcccca

SEQ ID NO: 75784 - DNA, 25 bp, Mus musculus
aatcagcaggatgtttctttcccca

SEQ ID NO: 75785 - DNA, 25 bp, Mus musculus
aatcagcagtgtatacgccccaagg

SEQ ID NO: 75786 - DNA, 25 bp, Mus musculus
aatcagcagtgtttacgccccaagg

SEQ ID NO: 75787 - DNA, 25 bp, Mus musculus
aatcagcagttgaaagcatcattct

SEQ ID NO: 75788 - DNA, 25 bp, Mus musculus
aatcagcagttgtaagcatcattct

SEQ ID NO: 75789 - DNA, 25 bp, Mus musculus
aatcagcataaaaacccatcctggt

SEQ ID NO: 75790 - DNA, 25 bp, Mus musculus
aatcagcataaatacccatcctggt

SEQ ID NO: 75791 - DNA, 25 bp, Mus musculus
aatcagcatcggctgggctgccatg

SEQ ID NO: 75792 - DNA, 25 bp, Mus musculus
aatcagcatcgggtgggctgccatg

SEQ ID NO: 75793 - DNA, 25 bp, Mus musculus
aatcagcatgcccagaattttacta

SEQ ID NO: 75794 - DNA, 25 bp, Mus musculus
aatcagcatgccgagaattttacta

SEQ ID NO: 75795 - DNA, 25 bp, Mus musculus
aatcagccaccaagcgcagacacta

SEQ ID NO: 75796 - DNA, 25 bp, Mus musculus
aatcagccaccatgcgcagacacta

SEQ ID NO: 75797 - DNA, 25 bp, Mus musculus
aatcagccagaccatcagacagcag

SEQ ID NO: 75798 - DNA, 25 bp, Mus musculus
aatcagccagacgatcagacagcag

SEQ ID NO: 75799 - DNA, 25 bp, Mus musculus
aatcagccagcacgccaagtacact

SEQ ID NO: 75800 - DNA, 25 bp, Mus musculus
aatcagccagcaggccaagtacact

SEQ ID NO: 75801 - DNA, 25 bp, Mus musculus
aatcagcccggaagctttgctcact

SEQ ID NO: 75802 - DNA, 25 bp, Mus musculus
aatcagcccggatgctttgctcact

SEQ ID NO: 75803 - DNA, 25 bp, Mus musculus
aatcagccttcaaaagtacgagtgt

SEQ ID NO: 75804 - DNA, 25 bp, Mus musculus
aatcagccttcataagtacgagtgt

SEQ ID NO: 75805 - DNA, 25 bp, Mus musculus
aatcagccttctctgtagacttgtc

SEQ ID NO: 75806 - DNA, 25 bp, Mus musculus
aatcagccttctgtgtagacttgtc

SEQ ID NO: 75807 - DNA, 25 bp, Mus musculus
aatcagcgactaagcatcctctatt

SEQ ID NO: 75808 - DNA, 25 bp, Mus musculus
aatcagcgactatgcatcctctatt

SEQ ID NO: 75809 - DNA, 25 bp, Mus musculus
aatcagcgtggtagactgccagcct

SEQ ID NO: 75810 - DNA, 25 bp, Mus musculus
aatcagcgtggttgactgccagcct

SEQ ID NO: 75811 - DNA, 25 bp, Mus musculus
aatcagctaccgagatcagttatct

SEQ ID NO: 75812 - DNA, 25 bp, Mus musculus
aatcagctaccgtgatcagttatct

SEQ ID NO: 75813 - DNA, 25 bp, Mus musculus
aatcagctacggcaggttttggttg

SEQ ID NO: 75814 - DNA, 25 bp, Mus musculus
aatcagctacgggaggttttggttg

SEQ ID NO: 75815 - DNA, 25 bp, Mus musculus
aatcagctcattcctattcatctgg

SEQ ID NO: 75816 - DNA, 25 bp, Mus musculus
aatcagctcattgctattcatctgg

SEQ ID NO: 75817 - DNA, 25 bp, Mus musculus
aatcagctcgtacttacctggagag

SEQ ID NO: 75818 - DNA, 25 bp, Mus musculus
aatcagctcgtagttacctggagag

SEQ ID NO: 75819 - DNA, 25 bp, Mus musculus
aatcagctctgaagtgtcacagccc

SEQ ID NO: 75820 - DNA, 25 bp, Mus musculus
aatcagctctgatgtgtcacagccc

SEQ ID NO: 75821 - DNA, 25 bp, Mus musculus
aatcagctgactcccatttgttggc

SEQ ID NO: 75822 - DNA, 25 bp, Mus musculus
aatcagctgactgccatttgttggc

SEQ ID NO: 75823 - DNA, 25 bp, Mus musculus
aatcagctgcttaccaaaggcgtgc

SEQ ID NO: 75824 - DNA, 25 bp, Mus musculus
aatcagctgctttccaaaggcgtgc

SEQ ID NO: 75825 - DNA, 25 bp, Mus musculus
aatcagctggccagggtgacacaca

SEQ ID NO: 75826 - DNA, 25 bp, Mus musculus
aatcagctggcctgggtgacacaca

SEQ ID NO: 75827 - DNA, 25 bp, Mus musculus
aatcagcttgagctcattcttggct

SEQ ID NO: 75828 - DNA, 25 bp, Mus musculus
aatcagcttgaggtcattcttggct

SEQ ID NO: 75829 - DNA, 25 bp, Mus musculus
aatcagcttttgcaagccagttttt

SEQ ID NO: 75830 - DNA, 25 bp, Mus musculus
aatcagcttttggaagccagttttt

SEQ ID NO: 75831 - DNA, 25 bp, Mus musculus
aatcagctttttcaagttacaccat

SEQ ID NO: 75832 - DNA, 25 bp, Mus musculus
aatcagctttttgaagttacaccat

SEQ ID NO: 75833 - DNA, 25 bp, Mus musculus
aatcaggaaacgattgctcgggcaa

SEQ ID NO: 75834 - DNA, 25 bp, Mus musculus
aatcaggaaacgtttgctcgggcaa

SEQ ID NO: 75835 - DNA, 25 bp, Mus musculus
aatcaggaactcattttcctcctag

SEQ ID NO: 75836 - DNA, 25 bp, Mus musculus
aatcaggaactctttttcctcctag

SEQ ID NO: 75837 - DNA, 25 bp, Mus musculus
aatcaggaattgactgacagctccc

SEQ ID NO: 75838 - DNA, 25 bp, Mus musculus
aatcaggaattgtctgacagctccc

SEQ ID NO: 75839 - DNA, 25 bp, Mus musculus
aatcaggacacgcatgttcattccc

SEQ ID NO: 75840 - DNA, 25 bp, Mus musculus
aatcaggacacggatgttcattccc

SEQ ID NO: 75841 - DNA, 25 bp, Mus musculus
aatcaggaccgtcgcagttggaatt

SEQ ID NO: 75842 - DNA, 25 bp, Mus musculus
aatcaggaccgtggcagttggaatt

SEQ ID NO: 75843 - DNA, 25 bp, Mus musculus
aatcaggactttcatttctttagcc

SEQ ID NO: 75844 - DNA, 25 bp, Mus musculus
aatcaggactttgatttctttagcc

SEQ ID NO: 75845 - DNA, 25 bp, Mus musculus
aatcaggagcccctatactgtgctt

SEQ ID NO: 75846 - DNA, 25 bp, Mus musculus
aatcaggagcccgtatactgtgctt

SEQ ID NO: 75847 - DNA, 25 bp, Mus musculus
aatcaggagggccctgtctgtactg

SEQ ID NO: 75848 - DNA, 25 bp, Mus musculus
aatcaggagggcgctgtctgtactg

SEQ ID NO: 75849 - DNA, 25 bp, Mus musculus
aatcaggatatgcagttttcaggag

SEQ ID NO: 75850 - DNA, 25 bp, Mus musculus
aatcaggatatgctcaggctgggca

SEQ ID NO: 75851 - DNA, 25 bp, Mus musculus
aatcaggatatggagttttcaggag

SEQ ID NO: 75852 - DNA, 25 bp, Mus musculus
aatcaggatatggtcaggctgggca

SEQ ID NO: 75853 - DNA, 25 bp, Mus musculus
aatcaggatcctacatggtgctgcc

SEQ ID NO: 75854 - DNA, 25 bp, Mus musculus
aatcaggatccttcatggtgctgcc

SEQ ID NO: 75855 - DNA, 25 bp, Mus musculus
aatcaggatgtcatcaccctaggga

SEQ ID NO: 75856 - DNA, 25 bp, Mus musculus
aatcaggatgtcttcaccctaggga

SEQ ID NO: 75857 - DNA, 25 bp, Mus musculus
aatcaggatgttcttttcttcttca

SEQ ID NO: 75858 - DNA, 25 bp, Mus musculus
aatcaggatgttgttttcttcttca

SEQ ID NO: 75859 - DNA, 25 bp, Mus musculus
aatcaggattcgatgtttgtaacag

SEQ ID NO: 75860 - DNA, 25 bp, Mus musculus
aatcaggattcgttgtttgtaacag

SEQ ID NO: 75861 - DNA, 25 bp, Mus musculus
aatcaggcagctaacctacctgtaa

SEQ ID NO: 75862 - DNA, 25 bp, Mus musculus
aatcaggcagcttacctacctgtaa

SEQ ID NO: 75863 - DNA, 25 bp, Mus musculus
aatcaggcagtcacattccgaatag

SEQ ID NO: 75864 - DNA, 25 bp, Mus musculus
aatcaggcagtctcattccgaatag

SEQ ID NO: 75865 - DNA, 25 bp, Mus musculus
aatcaggccattcttttgccccatt

SEQ ID NO: 75866 - DNA, 25 bp, Mus musculus
aatcaggccattgttttgccccatt

SEQ ID NO: 75867 - DNA, 25 bp, Mus musculus
aatcaggccctactgttgacatgac

SEQ ID NO: 75868 - DNA, 25 bp, Mus musculus
aatcaggccctagtgttgacatgac

SEQ ID NO: 75869 - DNA, 25 bp, Mus musculus
aatcaggcctttcgccagagacgcc

SEQ ID NO: 75870 - DNA, 25 bp, Mus musculus
aatcaggcctttggccagagacgcc

SEQ ID NO: 75871 - DNA, 25 bp, Mus musculus
aatcaggctacgaggctttatttca

SEQ ID NO: 75872 - DNA, 25 bp, Mus musculus
aatcaggctacgtggctttatttca

SEQ ID NO: 75873 - DNA, 25 bp, Mus musculus
aatcaggctgtaagatctggatttg

SEQ ID NO: 75874 - DNA, 25 bp, Mus musculus
aatcaggctgtatgatctggatttg

SEQ ID NO: 75875 - DNA, 25 bp, Mus musculus
aatcaggcttagaacccacaggtgg

SEQ ID NO: 75876 - DNA, 25 bp, Mus musculus
aatcaggcttagtacccacaggtgg

SEQ ID NO: 75877 - DNA, 25 bp, Mus musculus
aatcaggctttacgcaaacctgtag

SEQ ID NO: 75878 - DNA, 25 bp, Mus musculus
aatcaggctttaggcaaacctgtag

SEQ ID NO: 75879 - DNA, 25 bp, Mus musculus
aatcaggctttgatcttagcacaga

SEQ ID NO: 75880 - DNA, 25 bp, Mus musculus
aatcaggctttgttcttagcacaga

SEQ ID NO: 75881 - DNA, 25 bp, Mus musculus
aatcagggaagaccgctcagcttga

SEQ ID NO: 75882 - DNA, 25 bp, Mus musculus
aatcagggaagagcgctcagcttga

SEQ ID NO: 75883 - DNA, 25 bp, Mus musculus
aatcagggaataaagtttgcataac

SEQ ID NO: 75884 - DNA, 25 bp, Mus musculus
aatcagggaatatagtttgcataac

SEQ ID NO: 75885 - DNA, 25 bp, Mus musculus
aatcagggacacagggccatttctt

SEQ ID NO: 75886 - DNA, 25 bp, Mus musculus
aatcagggacactgggccatttctt

SEQ ID NO: 75887 - DNA, 25 bp, Mus musculus
aatcagggaccacctttactacagt

SEQ ID NO: 75888 - DNA, 25 bp, Mus musculus
aatcagggaccagctttactacagt

SEQ ID NO: 75889 - DNA, 25 bp, Mus musculus
aatcagggaggacggtagccatatt

SEQ ID NO: 75890 - DNA, 25 bp, Mus musculus
aatcagggaggagggtagccatatt

SEQ ID NO: 75891 - DNA, 25 bp, Mus musculus
aatcagggccctcagatgctagtta

SEQ ID NO: 75892 - DNA, 25 bp, Mus musculus
aatcagggccctgagatgctagtta

SEQ ID NO: 75893 - DNA, 25 bp, Mus musculus
aatcaggtagcactccaaaatggac

SEQ ID NO: 75894 - DNA, 25 bp, Mus musculus
aatcaggtagcagtccaaaatggac

SEQ ID NO: 75895 - DNA, 25 bp, Mus musculus
aatcaggtcactatatctatctccc

SEQ ID NO: 75896 - DNA, 25 bp, Mus musculus
aatcaggtcactttatctatctccc

SEQ ID NO: 75897 - DNA, 25 bp, Mus musculus
aatcaggtcagcatacaaggaaact

SEQ ID NO: 75898 - DNA, 25 bp, Mus musculus
aatcaggtcagcttacaaggaaact

SEQ ID NO: 75899 - DNA, 25 bp, Mus musculus
aatcaggtccttaagtaactcattt

SEQ ID NO: 75900 - DNA, 25 bp, Mus musculus
aatcaggtcctttagtaactcattt

SEQ ID NO: 75901 - DNA, 25 bp, Mus musculus
aatcaggtctctcatgggcttccat

SEQ ID NO: 75902 - DNA, 25 bp, Mus musculus
aatcaggtctctgatgggcttccat

SEQ ID NO: 75903 - DNA, 25 bp, Mus musculus
aatcaggtgaccatacactggcagg

SEQ ID NO: 75904 - DNA, 25 bp, Mus musculus
aatcaggtgaccttacactggcagg

SEQ ID NO: 75905 - DNA, 25 bp, Mus musculus
aatcaggtggcaagtagccttacct

SEQ ID NO: 75906 - DNA, 25 bp, Mus musculus
aatcaggtggcatgtagccttacct

SEQ ID NO: 75907 - DNA, 25 bp, Mus musculus
aatcaggtgtttcctgcgctactac

SEQ ID NO: 75908 - DNA, 25 bp, Mus musculus
aatcaggtgtttgctgcgctactac

SEQ ID NO: 75909 - DNA, 25 bp, Mus musculus
aatcaggttactagggctgcgtgca

SEQ ID NO: 75910 - DNA, 25 bp, Mus musculus
aatcaggttacttgggctgcgtgca

SEQ ID NO: 75911 - DNA, 25 bp, Mus musculus
aatcaggttctgctcacttggacat

SEQ ID NO: 75912 - DNA, 25 bp, Mus musculus
aatcaggttctggtcacttggacat

SEQ ID NO: 75913 - DNA, 25 bp, Mus musculus
aatcaggtttggagtggagtagcaa

SEQ ID NO: 75914 - DNA, 25 bp, Mus musculus
aatcaggtttggtgtggagtagcaa

SEQ ID NO: 75915 - DNA, 25 bp, Mus musculus
aatcaggttttactaactgcaacat

SEQ ID NO: 75916 - DNA, 25 bp, Mus musculus
aatcaggttttagtaactgcaacat

SEQ ID NO: 75917 - DNA, 25 bp, Mus musculus
aatcagtaaatgatggccgggcaga

SEQ ID NO: 75918 - DNA, 25 bp, Mus musculus
aatcagtaaatgttggccgggcaga

SEQ ID NO: 75919 - DNA, 25 bp, Mus musculus
aatcagtaactcattaattgtcagt

SEQ ID NO: 75920 - DNA, 25 bp, Mus musculus
aatcagtaactctttaattgtcagt

SEQ ID NO: 75921 - DNA, 25 bp, Mus musculus
aatcagtactccaattgcatgtctc

SEQ ID NO: 75922 - DNA, 25 bp, Mus musculus
aatcagtactcctattgcatgtctc

SEQ ID NO: 75923 - DNA, 25 bp, Mus musculus
aatcagtactgcaaagacacccggc

SEQ ID NO: 75924 - DNA, 25 bp, Mus musculus
aatcagtactgctaagacacccggc

SEQ ID NO: 75925 - DNA, 25 bp, Mus musculus
aatcagtaggctctccacaccttgt

SEQ ID NO: 75926 - DNA, 25 bp, Mus musculus
aatcagtaggctgtccacaccttgt

SEQ ID NO: 75927 - DNA, 25 bp, Mus musculus
aatcagtatctgatgctgagggcag

SEQ ID NO: 75928 - DNA, 25 bp, Mus musculus
aatcagtatctgttgctgagggcag

SEQ ID NO: 75929 - DNA, 25 bp, Mus musculus
aatcagtattctctgctgcttagaa

SEQ ID NO: 75930 - DNA, 25 bp, Mus musculus
aatcagtattctgtgctgcttagaa

SEQ ID NO: 75931 - DNA, 25 bp, Mus musculus
aatcagtcacttacacgggttttgc

SEQ ID NO: 75932 - DNA, 25 bp, Mus musculus
aatcagtcactttcacgggttttgc

SEQ ID NO: 75933 - DNA, 25 bp, Mus musculus
aatcagtcccgtagcctcttctttt

SEQ ID NO: 75934 - DNA, 25 bp, Mus musculus
aatcagtcccgttgcctcttctttt

SEQ ID NO: 75935 - DNA, 25 bp, Mus musculus
aatcagtccgtcctgttttcgagta

SEQ ID NO: 75936 - DNA, 25 bp, Mus musculus
aatcagtccgtcgtgttttcgagta

SEQ ID NO: 75937 - DNA, 25 bp, Mus musculus
aatcagtctaagcaagcaatggtct

SEQ ID NO: 75938 - DNA, 25 bp, Mus musculus
aatcagtctaaggaagcaatggtct

SEQ ID NO: 75939 - DNA, 25 bp, Mus musculus
aatcagtctgacaatggcctggaca

SEQ ID NO: 75940 - DNA, 25 bp, Mus musculus
aatcagtctgactatggcctggaca

SEQ ID NO: 75941 - DNA, 25 bp, Mus musculus
aatcagtcttccaattttgggccga

SEQ ID NO: 75942 - DNA, 25 bp, Mus musculus
aatcagtcttcctattttgggccga

SEQ ID NO: 75943 - DNA, 25 bp, Mus musculus
aatcagtcttttccccaaagtgctg

SEQ ID NO: 75944 - DNA, 25 bp, Mus musculus
aatcagtcttttgcccaaagtgctg

SEQ ID NO: 75945 - DNA, 25 bp, Mus musculus
aatcagtgagtcagtggcctgtgcc

SEQ ID NO: 75946 - DNA, 25 bp, Mus musculus
aatcagtgagtctgtggcctgtgcc

SEQ ID NO: 75947 - DNA, 25 bp, Mus musculus
aatcagtgataaagacagaccctgt

SEQ ID NO: 75948 - DNA, 25 bp, Mus musculus
aatcagtgataatgacagaccctgt

SEQ ID NO: 75949 - DNA, 25 bp, Mus musculus
aatcagtgatttctccaaaatccaa

SEQ ID NO: 75950 - DNA, 25 bp, Mus musculus
aatcagtgatttgtccaaaatccaa

SEQ ID NO: 75951 - DNA, 25 bp, Mus musculus
aatcagtgctatctgttgagtacaa

SEQ ID NO: 75952 - DNA, 25 bp, Mus musculus
aatcagtgctatgtgttgagtacaa

SEQ ID NO: 75953 - DNA, 25 bp, Mus musculus
aatcagtgctctatgtatgcgtcca

SEQ ID NO: 75954 - DNA, 25 bp, Mus musculus
aatcagtgctctttgtatgcgtcca

SEQ ID NO: 75955 - DNA, 25 bp, Mus musculus
aatcagtgctgcatcttcatgggct

SEQ ID NO: 75956 - DNA, 25 bp, Mus musculus
aatcagtgctgcttcttcatgggct

SEQ ID NO: 75957 - DNA, 25 bp, Mus musculus
aatcagtgctgtcaacgggctgcca

SEQ ID NO: 75958 - DNA, 25 bp, Mus musculus
aatcagtgctgtgaacgggctgcca

SEQ ID NO: 75959 - DNA, 25 bp, Mus musculus
aatcagtgcttactaggcagaggca

SEQ ID NO: 75960 - DNA, 25 bp, Mus musculus
aatcagtgcttagtaggcagaggca

SEQ ID NO: 75961 - DNA, 25 bp, Mus musculus
aatcagtggctgaagtttcctaaca

SEQ ID NO: 75962 - DNA, 25 bp, Mus musculus
aatcagtggctgtagtttcctaaca

SEQ ID NO: 75963 - DNA, 25 bp, Mus musculus
aatcagtgttctaacttcctgtaca

SEQ ID NO: 75964 - DNA, 25 bp, Mus musculus
aatcagtgttctaatatgcttttta

SEQ ID NO: 75965 - DNA, 25 bp, Mus musculus
aatcagtgttcttacttcctgtaca

SEQ ID NO: 75966 - DNA, 25 bp, Mus musculus
aatcagtgttcttatatgcttttta

SEQ ID NO: 75967 - DNA, 25 bp, Mus musculus
aatcagtgttggctctccattcagt

SEQ ID NO: 75968 - DNA, 25 bp, Mus musculus
aatcagtgttgggtctccattcagt

SEQ ID NO: 75969 - DNA, 25 bp, Mus musculus
aatcagtgtttaacctgttatacaa

SEQ ID NO: 75970 - DNA, 25 bp, Mus musculus
aatcagtgtttatcctgttatacaa

SEQ ID NO: 75971 - DNA, 25 bp, Mus musculus
aatcagtgtttcctactttcacatc

SEQ ID NO: 75972 - DNA, 25 bp, Mus musculus
aatcagtgtttcgtactttcacatc

SEQ ID NO: 75973 - DNA, 25 bp, Mus musculus
aatcagttactgcttcctacagtgc

SEQ ID NO: 75974 - DNA, 25 bp, Mus musculus
aatcagttactggttcctacagtgc

SEQ ID NO: 75975 - DNA, 25 bp, Mus musculus
aatcagttcttcctcgaatgggagt

SEQ ID NO: 75976 - DNA, 25 bp, Mus musculus
aatcagttcttcgtcgaatgggagt

SEQ ID NO: 75977 - DNA, 25 bp, Mus musculus
aatcagttgaaacgcaccgtgtccc

SEQ ID NO: 75978 - DNA, 25 bp, Mus musculus
aatcagttgaaaggcaccgtgtccc

SEQ ID NO: 75979 - DNA, 25 bp, Mus musculus
aatcagttgagtatcttcccatggc

SEQ ID NO: 75980 - DNA, 25 bp, Mus musculus
aatcagttgagtttcttcccatggc

SEQ ID NO: 75981 - DNA, 25 bp, Mus musculus
aatcagttgcctactgttggaggtt

SEQ ID NO: 75982 - DNA, 25 bp, Mus musculus
aatcagttgccttctgttggaggtt

SEQ ID NO: 75983 - DNA, 25 bp, Mus musculus
aatcagttgctgatccaagttctaa

SEQ ID NO: 75984 - DNA, 25 bp, Mus musculus
aatcagttgctgttccaagttctaa

SEQ ID NO: 75985 - DNA, 25 bp, Mus musculus
aatcagttgtaaacgcctgttccaa

SEQ ID NO: 75986 - DNA, 25 bp, Mus musculus
aatcagttgtaatcgcctgttccaa

SEQ ID NO: 75987 - DNA, 25 bp, Mus musculus
aatcagttgtaccatctgtggtcat

SEQ ID NO: 75988 - DNA, 25 bp, Mus musculus
aatcagttgtacgatctgtggtcat

SEQ ID NO: 75989 - DNA, 25 bp, Mus musculus
aatcagtttactatgcttccttcca

SEQ ID NO: 75990 - DNA, 25 bp, Mus musculus
aatcagtttactttgcttccttcca

SEQ ID NO: 75991 - DNA, 25 bp, Mus musculus
aatcagtttcatacaccgacaatgt

SEQ ID NO: 75992 - DNA, 25 bp, Mus musculus
aatcagtttcatcgagtttcttaga

SEQ ID NO: 75993 - DNA, 25 bp, Mus musculus
aatcagtttcatggagtttcttaga

SEQ ID NO: 75994 - DNA, 25 bp, Mus musculus
aatcagtttcattcaccgacaatgt

SEQ ID NO: 75995 - DNA, 25 bp, Mus musculus
aatcataacatcaaggaagcccttt

SEQ ID NO: 75996 - DNA, 25 bp, Mus musculus
aatcataacatctaggaagcccttt

SEQ ID NO: 75997 - DNA, 25 bp, Mus musculus
aatcataactggagctgtggccggg

SEQ ID NO: 75998 - DNA, 25 bp, Mus musculus
aatcataactggtgctgtggccggg

SEQ ID NO: 75999 - DNA, 25 bp, Mus musculus
aatcataaggtgatagcttctcaaa

SEQ ID NO: 76000 - DNA, 25 bp, Mus musculus
aatcataaggtgttagcttctcaaa

SEQ ID NO: 76001 - DNA, 25 bp, Mus musculus
aatcataccttgacttcatacctag

SEQ ID NO: 76002 - DNA, 25 bp, Mus musculus
aatcataccttgtcttcatacctag

SEQ ID NO: 76003 - DNA, 25 bp, Mus musculus
aatcatactcttagcagttgtatca

SEQ ID NO: 76004 - DNA, 25 bp, Mus musculus
aatcatactctttgcagttgtatca

SEQ ID NO: 76005 - DNA, 25 bp, Mus musculus
aatcatacttgccttctcatactaa

SEQ ID NO: 76006 - DNA, 25 bp, Mus musculus
aatcatacttgcgttctcatactaa

SEQ ID NO: 76007 - DNA, 25 bp, Mus musculus
aatcatagccagcagctcttgactg

SEQ ID NO: 76008 - DNA, 25 bp, Mus musculus
aatcatagccaggagctcttgactg

SEQ ID NO: 76009 - DNA, 25 bp, Mus musculus
aatcatagccttccacttctaggaa

SEQ ID NO: 76010 - DNA, 25 bp, Mus musculus
aatcatagccttgcacttctaggaa

SEQ ID NO: 76011 - DNA, 25 bp, Mus musculus
aatcatagctgcaaagtcttttctg

SEQ ID NO: 76012 - DNA, 25 bp, Mus musculus
aatcatagctgctaagtcttttctg

SEQ ID NO: 76013 - DNA, 25 bp, Mus musculus
aatcatagtgagcatgccggtcctt

SEQ ID NO: 76014 - DNA, 25 bp, Mus musculus
aatcatagtgaggatgccggtcctt

SEQ ID NO: 76015 - DNA, 25 bp, Mus musculus
aatcatatccaaaaaacacacttaa

SEQ ID NO: 76016 - DNA, 25 bp, Mus musculus
aatcatatccaataaacacacttaa

SEQ ID NO: 76017 - DNA, 25 bp, Mus musculus
aatcatatccatatcacctgtacat

SEQ ID NO: 76018 - DNA, 25 bp, Mus musculus
aatcatatccatttcacctgtacat

SEQ ID NO: 76019 - DNA, 25 bp, Mus musculus
aatcatatggaacctgtaaaacagt

SEQ ID NO: 76020 - DNA, 25 bp, Mus musculus
aatcatatggaagctgtaaaacagt

SEQ ID NO: 76021 - DNA, 25 bp, Mus musculus
aatcatattcacctaacactcttct

SEQ ID NO: 76022 - DNA, 25 bp, Mus musculus
aatcatattcacgtaacactcttct

SEQ ID NO: 76023 - DNA, 25 bp, Mus musculus
aatcatattgtacttctgcatttag

SEQ ID NO: 76024 - DNA, 25 bp, Mus musculus
aatcatattgtagttctgcatttag

SEQ ID NO: 76025 - DNA, 25 bp, Mus musculus
aatcatatttttccatttcagtcaa

SEQ ID NO: 76026 - DNA, 25 bp, Mus musculus
aatcatatttttgcatttcagtcaa

SEQ ID NO: 76027 - DNA, 25 bp, Mus musculus
aatcatcaactcaatcagcatctga

SEQ ID NO: 76028 - DNA, 25 bp, Mus musculus
aatcatcaactctatcagcatctga

SEQ ID NO: 76029 - DNA, 25 bp, Mus musculus
aatcatcaccagaagagctcctgtg

SEQ ID NO: 76030 - DNA, 25 bp, Mus musculus
aatcatcaccagtagagctcctgtg

SEQ ID NO: 76031 - DNA, 25 bp, Mus musculus
aatcatcaccatattttgtttgtac

SEQ ID NO: 76032 - DNA, 25 bp, Mus musculus
aatcatcaccattttttgtttgtac

SEQ ID NO: 76033 - DNA, 25 bp, Mus musculus
aatcatcaccctcgatttctgagcc

SEQ ID NO: 76034 - DNA, 25 bp, Mus musculus
aatcatcaccctggatttctgagcc

SEQ ID NO: 76035 - DNA, 25 bp, Mus musculus
aatcatcactaaatttagcctcggt

SEQ ID NO: 76036 - DNA, 25 bp, Mus musculus
aatcatcactaattttagcctcggt

SEQ ID NO: 76037 - DNA, 25 bp, Mus musculus
aatcatcactgaaggttccccagaa

SEQ ID NO: 76038 - DNA, 25 bp, Mus musculus
aatcatcactgatggttccccagaa

SEQ ID NO: 76039 - DNA, 25 bp, Mus musculus
aatcatcagcagagtatcttgaaag

SEQ ID NO: 76040 - DNA, 25 bp, Mus musculus
aatcatcagcagtgtatcttgaaag

SEQ ID NO: 76041 - DNA, 25 bp, Mus musculus
aatcatcaggatatattcttctcag

SEQ ID NO: 76042 - DNA, 25 bp, Mus musculus
aatcatcaggatttattcttctcag

SEQ ID NO: 76043 - DNA, 25 bp, Mus musculus
aatcatcagggcagtgtttgttgtg

SEQ ID NO: 76044 - DNA, 25 bp, Mus musculus
aatcatcagggctgtgtttgttgtg

SEQ ID NO: 76045 - DNA, 25 bp, Mus musculus
aatcatcatacacgaggaggactct

SEQ ID NO: 76046 - DNA, 25 bp, Mus musculus
aatcatcatacaggaggaggactct

SEQ ID NO: 76047 - DNA, 25 bp, Mus musculus
aatcatcatcgcactcaacaacatc

SEQ ID NO: 76048 - DNA, 25 bp, Mus musculus
aatcatcatcgctctcaacaacatc

SEQ ID NO: 76049 - DNA, 25 bp, Mus musculus
aatcatcatcttatcgtaacacctt

SEQ ID NO: 76050 - DNA, 25 bp, Mus musculus
aatcatcatcttttcgtaacacctt

SEQ ID NO: 76051 - DNA, 25 bp, Mus musculus
aatcatcattacaagaccctgtcct

SEQ ID NO: 76052 - DNA, 25 bp, Mus musculus
aatcatcattactagaccctgtcct

SEQ ID NO: 76053 - DNA, 25 bp, Mus musculus
aatcatcattgcaggctgggaccct

SEQ ID NO: 76054 - DNA, 25 bp, Mus musculus
aatcatcattgctggctgggaccct

SEQ ID NO: 76055 - DNA, 25 bp, Mus musculus
aatcatccaaggcacgagcgtggtt

SEQ ID NO: 76056 - DNA, 25 bp, Mus musculus
aatcatccaagggacgagcgtggtt

SEQ ID NO: 76057 - DNA, 25 bp, Mus musculus
aatcatccactgcttgaatggcggt

SEQ ID NO: 76058 - DNA, 25 bp, Mus musculus
aatcatccactggttgaatggcggt

SEQ ID NO: 76059 - DNA, 25 bp, Mus musculus
aatcatccagacacggagaccggag

SEQ ID NO: 76060 - DNA, 25 bp, Mus musculus
aatcatccagactcggagaccggag

SEQ ID NO: 76061 - DNA, 25 bp, Mus musculus
aatcatcccacaatgcttagaaggt

SEQ ID NO: 76062 - DNA, 25 bp, Mus musculus
aatcatcccacattgcttagaaggt

SEQ ID NO: 76063 - DNA, 25 bp, Mus musculus
aatcatcccagactgctctatggag

SEQ ID NO: 76064 - DNA, 25 bp, Mus musculus
aatcatcccagagtgctctatggag

SEQ ID NO: 76065 - DNA, 25 bp, Mus musculus
aatcatcccctcagtttgaatgcac

SEQ ID NO: 76066 - DNA, 25 bp, Mus musculus
aatcatcccctctgtttgaatgcac

SEQ ID NO: 76067 - DNA, 25 bp, Mus musculus
aatcatcctagcagacatgtgctgt

SEQ ID NO: 76068 - DNA, 25 bp, Mus musculus
aatcatcctagctgacatgtgctgt

SEQ ID NO: 76069 - DNA, 25 bp, Mus musculus
aatcatcctgatctcgcaaacaaat

SEQ ID NO: 76070 - DNA, 25 bp, Mus musculus
aatcatcctgatgtcgcaaacaaat

SEQ ID NO: 76071 - DNA, 25 bp, Mus musculus
aatcatcctggtattgtactctgtg

SEQ ID NO: 76072 - DNA, 25 bp, Mus musculus
aatcatcctggtcccattataacac

SEQ ID NO: 76073 - DNA, 25 bp, Mus musculus
aatcatcctggtgccattataacac

SEQ ID NO: 76074 - DNA, 25 bp, Mus musculus
aatcatcctggttttgtactctgtg

SEQ ID NO: 76075 - DNA, 25 bp, Mus musculus
aatcatcctgtgagctttgccatta

SEQ ID NO: 76076 - DNA, 25 bp, Mus musculus
aatcatcctgtgtgctttgccatta

SEQ ID NO: 76077 - DNA, 25 bp, Mus musculus
aatcatctaatgctacttcttcctt

SEQ ID NO: 76078 - DNA, 25 bp, Mus musculus
aatcatctaatggtacttcttcctt

SEQ ID NO: 76079 - DNA, 25 bp, Mus musculus
aatcatctaattatcccacctggga

SEQ ID NO: 76080 - DNA, 25 bp, Mus musculus
aatcatctaattttcccacctggga

SEQ ID NO: 76081 - DNA, 25 bp, Mus musculus
aatcatctacatcgctttgctgcac

SEQ ID NO: 76082 - DNA, 25 bp, Mus musculus
aatcatctacatggctttgctgcac

SEQ ID NO: 76083 - DNA, 25 bp, Mus musculus
aatcatctacctatgttcttgacaa

SEQ ID NO: 76084 - DNA, 25 bp, Mus musculus
aatcatctacctttgttcttgacaa

SEQ ID NO: 76085 - DNA, 25 bp, Mus musculus
aatcatctatctctccctggtgtat

SEQ ID NO: 76086 - DNA, 25 bp, Mus musculus
aatcatctatctgtccctggtgtat

SEQ ID NO: 76087 - DNA, 25 bp, Mus musculus
aatcatctattgacacctgtcccag

SEQ ID NO: 76088 - DNA, 25 bp, Mus musculus
aatcatctattgtcacctgtcccag

SEQ ID NO: 76089 - DNA, 25 bp, Mus musculus
aatcatctcaacatgctaacatgtt

SEQ ID NO: 76090 - DNA, 25 bp, Mus musculus
aatcatctcaacttgctaacatgtt

SEQ ID NO: 76091 - DNA, 25 bp, Mus musculus
aatcatctcactcaggatgcagaag

SEQ ID NO: 76092 - DNA, 25 bp, Mus musculus
aatcatctcactgaggatgcagaag

SEQ ID NO: 76093 - DNA, 25 bp, Mus musculus
aatcatctcgtcatccatttctgtt

SEQ ID NO: 76094 - DNA, 25 bp, Mus musculus
aatcatctcgtcttccatttctgtt

SEQ ID NO: 76095 - DNA, 25 bp, Mus musculus
aatcatctctctatatactctttaa

SEQ ID NO: 76096 - DNA, 25 bp, Mus musculus
aatcatctctctttatactctttaa

SEQ ID NO: 76097 - DNA, 25 bp, Mus musculus
aatcatctctgtatctcgggttctg

SEQ ID NO: 76098 - DNA, 25 bp, Mus musculus
aatcatctctgtttctcgggttctg

SEQ ID NO: 76099 - DNA, 25 bp, Mus musculus
aatcatctcttcacagcctagaaag

SEQ ID NO: 76100 - DNA, 25 bp, Mus musculus
aatcatctcttctcagcctagaaag

SEQ ID NO: 76101 - DNA, 25 bp, Mus musculus
aatcatctgaatagcgtgacccaaa

SEQ ID NO: 76102 - DNA, 25 bp, Mus musculus
aatcatctgaattgcgtgacccaaa

SEQ ID NO: 76103 - DNA, 25 bp, Mus musculus
aatcatctgagaccttccaaaggag

SEQ ID NO: 76104 - DNA, 25 bp, Mus musculus
aatcatctgagagcttccaaaggag

SEQ ID NO: 76105 - DNA, 25 bp, Mus musculus
aatcatcttcacaaacaagcttttc

SEQ ID NO: 76106 - DNA, 25 bp, Mus musculus
aatcatcttcactaacaagcttttc

SEQ ID NO: 76107 - DNA, 25 bp, Mus musculus
aatcatcttcgcagacatgtgtcta

SEQ ID NO: 76108 - DNA, 25 bp, Mus musculus
aatcatcttcgctgacatgtgtcta

SEQ ID NO: 76109 - DNA, 25 bp, Mus musculus
aatcatctttcactccagcctaaag

SEQ ID NO: 76110 - DNA, 25 bp, Mus musculus
aatcatctttcagtccagcctaaag

SEQ ID NO: 76111 - DNA, 25 bp, Mus musculus
aatcatgaaattcgttccgggaagc

SEQ ID NO: 76112 - DNA, 25 bp, Mus musculus
aatcatgaaattggttccgggaagc

SEQ ID NO: 76113 - DNA, 25 bp, Mus musculus
aatcatgaactacatttctctaggt

SEQ ID NO: 76114 - DNA, 25 bp, Mus musculus
aatcatgaactagatttctctaggt

SEQ ID NO: 76115 - DNA, 25 bp, Mus musculus
aatcatgaagaactaacccgggact

SEQ ID NO: 76116 - DNA, 25 bp, Mus musculus
aatcatgaagaagtaacccgggact

SEQ ID NO: 76117 - DNA, 25 bp, Mus musculus
aatcatgaaggaaggccaatgctga

SEQ ID NO: 76118 - DNA, 25 bp, Mus musculus
aatcatgaaggatggccaatgctga

SEQ ID NO: 76119 - DNA, 25 bp, Mus musculus
aatcatgaatcacagccaggctata

SEQ ID NO: 76120 - DNA, 25 bp, Mus musculus
aatcatgaatcagagccaggctata

SEQ ID NO: 76121 - DNA, 25 bp, Mus musculus
aatcatgaattgcttcctgagaatc

SEQ ID NO: 76122 - DNA, 25 bp, Mus musculus
aatcatgaattggttcctgagaatc

SEQ ID NO: 76123 - DNA, 25 bp, Mus musculus
aatcatgaccatcgctttcttggct

SEQ ID NO: 76124 - DNA, 25 bp, Mus musculus
aatcatgaccatggctttcttggct

SEQ ID NO: 76125 - DNA, 25 bp, Mus musculus
aatcatgacctgaacctaagctcga

SEQ ID NO: 76126 - DNA, 25 bp, Mus musculus
aatcatgacctgtacctaagctcga

SEQ ID NO: 76127 - DNA, 25 bp, Mus musculus
aatcatgaccttaatttttcaggaa

SEQ ID NO: 76128 - DNA, 25 bp, Mus musculus
aatcatgacctttatttttcaggaa

SEQ ID NO: 76129 - DNA, 25 bp, Mus musculus
aatcatgacttcactcctcttgaga

SEQ ID NO: 76130 - DNA, 25 bp, Mus musculus
aatcatgacttctctcctcttgaga

SEQ ID NO: 76131 - DNA, 25 bp, Mus musculus
aatcatgagatccatcaatttttag

SEQ ID NO: 76132 - DNA, 25 bp, Mus musculus
aatcatgagatcgatcaatttttag

SEQ ID NO: 76133 - DNA, 25 bp, Mus musculus
aatcatgagccgaagatcctgtgcc

SEQ ID NO: 76134 - DNA, 25 bp, Mus musculus
aatcatgagccgaggaagcccacat

SEQ ID NO: 76135 - DNA, 25 bp, Mus musculus
aatcatgagccgtagatcctgtgcc

SEQ ID NO: 76136 - DNA, 25 bp, Mus musculus
aatcatgagccgtggaagcccacat

SEQ ID NO: 76137 - DNA, 25 bp, Mus musculus
aatcatgagtttctgcagaggtgac

SEQ ID NO: 76138 - DNA, 25 bp, Mus musculus
aatcatgagtttgtgcagaggtgac

SEQ ID NO: 76139 - DNA, 25 bp, Mus musculus
aatcatgatacaaaccttttagcca

SEQ ID NO: 76140 - DNA, 25 bp, Mus musculus
aatcatgatacataccttttagcca

SEQ ID NO: 76141 - DNA, 25 bp, Mus musculus
aatcatgatatgattcctcctgtgc

SEQ ID NO: 76142 - DNA, 25 bp, Mus musculus
aatcatgatatgtttcctcctgtgc

SEQ ID NO: 76143 - DNA, 25 bp, Mus musculus
aatcatgatctcaagttgggaagtt

SEQ ID NO: 76144 - DNA, 25 bp, Mus musculus
aatcatgatctctagttgggaagtt

SEQ ID NO: 76145 - DNA, 25 bp, Mus musculus
aatcatgatcttaccagtttagttt

SEQ ID NO: 76146 - DNA, 25 bp, Mus musculus
aatcatgatctttccagtttagttt

SEQ ID NO: 76147 - DNA, 25 bp, Mus musculus
aatcatgcaaagacgaggatgtaga

SEQ ID NO: 76148 - DNA, 25 bp, Mus musculus
aatcatgcaaagtcgaggatgtaga

SEQ ID NO: 76149 - DNA, 25 bp, Mus musculus
aatcatgcactcagctgctgtgcag

SEQ ID NO: 76150 - DNA, 25 bp, Mus musculus
aatcatgcactctgctgctgtgcag

SEQ ID NO: 76151 - DNA, 25 bp, Mus musculus
aatcatgcatatccactgtttctcc

SEQ ID NO: 76152 - DNA, 25 bp, Mus musculus
aatcatgcatatgcactgtttctcc

SEQ ID NO: 76153 - DNA, 25 bp, Mus musculus
aatcatgccataattagtctggagt

SEQ ID NO: 76154 - DNA, 25 bp, Mus musculus
aatcatgccatatttagtctggagt

SEQ ID NO: 76155 - DNA, 25 bp, Mus musculus
aatcatgcccatcagtcacgtggat

SEQ ID NO: 76156 - DNA, 25 bp, Mus musculus
aatcatgcccatgagtcacgtggat

SEQ ID NO: 76157 - DNA, 25 bp, Mus musculus
aatcatgcctagaaagtccgtttgg

SEQ ID NO: 76158 - DNA, 25 bp, Mus musculus
aatcatgcctagtaagtccgtttgg

SEQ ID NO: 76159 - DNA, 25 bp, Mus musculus
aatcatgccttcaaagtccagtgtg

SEQ ID NO: 76160 - DNA, 25 bp, Mus musculus
aatcatgccttctaagtccagtgtg

SEQ ID NO: 76161 - DNA, 25 bp, Mus musculus
aatcatgcggacaggtttttaagtg

SEQ ID NO: 76162 - DNA, 25 bp, Mus musculus
aatcatgcggactggtttttaagtg

SEQ ID NO: 76163 - DNA, 25 bp, Mus musculus
aatcatgctcatattaatccagcca

SEQ ID NO: 76164 - DNA, 25 bp, Mus musculus
aatcatgctcattttaatccagcca

SEQ ID NO: 76165 - DNA, 25 bp, Mus musculus
aatcatgctctgatcaggatcggag

SEQ ID NO: 76166 - DNA, 25 bp, Mus musculus
aatcatgctctgttcaggatcggag

SEQ ID NO: 76167 - DNA, 25 bp, Mus musculus
aatcatgctgaactacaccctttgc

SEQ ID NO: 76168 - DNA, 25 bp, Mus musculus
aatcatgctgaagtacaccctttgc

SEQ ID NO: 76169 - DNA, 25 bp, Mus musculus
aatcatgctggaacatttgtaaccc

SEQ ID NO: 76170 - DNA, 25 bp, Mus musculus
aatcatgctggatcatttgtaaccc

SEQ ID NO: 76171 - DNA, 25 bp, Mus musculus
aatcatgctgtaatcgtggctgtaa

SEQ ID NO: 76172 - DNA, 25 bp, Mus musculus
aatcatgctgtattcgtggctgtaa

SEQ ID NO: 76173 - DNA, 25 bp, Mus musculus
aatcatggactcaattgcccccaga

SEQ ID NO: 76174 - DNA, 25 bp, Mus musculus
aatcatggactctattgcccccaga

SEQ ID NO: 76175 - DNA, 25 bp, Mus musculus
aatcatggatgcagccttcgtgagc

SEQ ID NO: 76176 - DNA, 25 bp, Mus musculus
aatcatggatgctgccttcgtgagc

SEQ ID NO: 76177 - DNA, 25 bp, Mus musculus
aatcatggattaatgccctatgggc

SEQ ID NO: 76178 - DNA, 25 bp, Mus musculus
aatcatggattattgccctatgggc

SEQ ID NO: 76179 - DNA, 25 bp, Mus musculus
aatcatggcaaaagacctggtgcgt

SEQ ID NO: 76180 - DNA, 25 bp, Mus musculus
aatcatggcaaatgacctggtgcgt

SEQ ID NO: 76181 - DNA, 25 bp, Mus musculus
aatcatggcacacgacttcatattg

SEQ ID NO: 76182 - DNA, 25 bp, Mus musculus
aatcatggcacaggacttcatattg

SEQ ID NO: 76183 - DNA, 25 bp, Mus musculus
aatcatggcctaatgggttctgttt

SEQ ID NO: 76184 - DNA, 25 bp, Mus musculus
aatcatggcctattgggttctgttt

SEQ ID NO: 76185 - DNA, 25 bp, Mus musculus
aatcatgggattccacatcccggag

SEQ ID NO: 76186 - DNA, 25 bp, Mus musculus
aatcatgggattgcacatcccggag

SEQ ID NO: 76187 - DNA, 25 bp, Mus musculus
aatcatgggcatactgcggagccta

SEQ ID NO: 76188 - DNA, 25 bp, Mus musculus
aatcatgggcattctgcggagccta

SEQ ID NO: 76189 - DNA, 25 bp, Mus musculus
aatcatgggccgacgtctattacgt

SEQ ID NO: 76190 - DNA, 25 bp, Mus musculus
aatcatgggccgtcgtctattacgt

SEQ ID NO: 76191 - DNA, 25 bp, Mus musculus
aatcatggtattatcatcagcttga

SEQ ID NO: 76192 - DNA, 25 bp, Mus musculus
aatcatggtattttcatcagcttga

SEQ ID NO: 76193 - DNA, 25 bp, Mus musculus
aatcatggtcataccatggagacct

SEQ ID NO: 76194 - DNA, 25 bp, Mus musculus
aatcatggtcattccatggagacct

SEQ ID NO: 76195 - DNA, 25 bp, Mus musculus
aatcatggtgaactttcccttcatt

SEQ ID NO: 76196 - DNA, 25 bp, Mus musculus
aatcatggtgaagtttcccttcatt

SEQ ID NO: 76197 - DNA, 25 bp, Mus musculus
aatcatggtttccactgtgtttgat

SEQ ID NO: 76198 - DNA, 25 bp, Mus musculus
aatcatggtttcgactgtgtttgat

SEQ ID NO: 76199 - DNA, 25 bp, Mus musculus
aatcatgtaaccacaacttctcgta

SEQ ID NO: 76200 - DNA, 25 bp, Mus musculus
aatcatgtaacctcaacttctcgta

SEQ ID NO: 76201 - DNA, 25 bp, Mus musculus
aatcatgtaactaactttcacacat

SEQ ID NO: 76202 - DNA, 25 bp, Mus musculus
aatcatgtaacttactttcacacat

SEQ ID NO: 76203 - DNA, 25 bp, Mus musculus
aatcatgtaagacatttcctgcaat

SEQ ID NO: 76204 - DNA, 25 bp, Mus musculus
aatcatgtaagagatttcctgcaat

SEQ ID NO: 76205 - DNA, 25 bp, Mus musculus
aatcatgtatcgcagcaagctgtta

SEQ ID NO: 76206 - DNA, 25 bp, Mus musculus
aatcatgtatcggagcaagctgtta

SEQ ID NO: 76207 - DNA, 25 bp, Mus musculus
aatcatgtatgcagcccgagacggt

SEQ ID NO: 76208 - DNA, 25 bp, Mus musculus
aatcatgtatgctgcccgagacggt

SEQ ID NO: 76209 - DNA, 25 bp, Mus musculus
aatcatgtcatcagcattctgtgac

SEQ ID NO: 76210 - DNA, 25 bp, Mus musculus
aatcatgtcatctgcattctgtgac

SEQ ID NO: 76211 - DNA, 25 bp, Mus musculus
aatcatgtctagacatactgaactg

SEQ ID NO: 76212 - DNA, 25 bp, Mus musculus
aatcatgtctagtcatactgaactg

SEQ ID NO: 76213 - DNA, 25 bp, Mus musculus
aatcatgtctgtcagttcattttga

SEQ ID NO: 76214 - DNA, 25 bp, Mus musculus
aatcatgtctgtgagttcattttga

SEQ ID NO: 76215 - DNA, 25 bp, Mus musculus
aatcatgtgactatacctcttcctg

SEQ ID NO: 76216 - DNA, 25 bp, Mus musculus
aatcatgtgactcaagtgactagca

SEQ ID NO: 76217 - DNA, 25 bp, Mus musculus
aatcatgtgactgaagtgactagca

SEQ ID NO: 76218 - DNA, 25 bp, Mus musculus
aatcatgtgactttacctcttcctg

SEQ ID NO: 76219 - DNA, 25 bp, Mus musculus
aatcatgtgctgactcctgcaattc

SEQ ID NO: 76220 - DNA, 25 bp, Mus musculus
aatcatgtgctgtctcctgcaattc

SEQ ID NO: 76221 - DNA, 25 bp, Mus musculus
aatcatgtgcttccaacacactaaa

SEQ ID NO: 76222 - DNA, 25 bp, Mus musculus
aatcatgtgcttgcaacacactaaa

SEQ ID NO: 76223 - DNA, 25 bp, Mus musculus
aatcatgtggttatattagaggtct

SEQ ID NO: 76224 - DNA, 25 bp, Mus musculus
aatcatgtggttttattagaggtct

SEQ ID NO: 76225 - DNA, 25 bp, Mus musculus
aatcatgtgtgtcactgggctgctt

SEQ ID NO: 76226 - DNA, 25 bp, Mus musculus
aatcatgtgtgtgactgggctgctt

SEQ ID NO: 76227 - DNA, 25 bp, Mus musculus
aatcatgtgttgaggccgagggtat

SEQ ID NO: 76228 - DNA, 25 bp, Mus musculus
aatcatgtgttgtggccgagggtat

SEQ ID NO: 76229 - DNA, 25 bp, Mus musculus
aatcatgttagcacatctctttgcc

SEQ ID NO: 76230 - DNA, 25 bp, Mus musculus
aatcatgttagctcatctctttgcc

SEQ ID NO: 76231 - DNA, 25 bp, Mus musculus
aatcatgttcacacctacaaggaga

SEQ ID NO: 76232 - DNA, 25 bp, Mus musculus
aatcatgttcactcctacaaggaga

SEQ ID NO: 76233 - DNA, 25 bp, Mus musculus
aatcatgttggtctttttgcttttc

SEQ ID NO: 76234 - DNA, 25 bp, Mus musculus
aatcatgttggtgtttttgcttttc

SEQ ID NO: 76235 - DNA, 25 bp, Mus musculus
aatcatgtttgaagcactctggagg

SEQ ID NO: 76236 - DNA, 25 bp, Mus musculus
aatcatgtttgatgcactctggagg

SEQ ID NO: 76237 - DNA, 25 bp, Mus musculus
aatcatgttttaataggttgtcttt

SEQ ID NO: 76238 - DNA, 25 bp, Mus musculus
aatcatgttttattaggttgtcttt

SEQ ID NO: 76239 - DNA, 25 bp, Mus musculus
aatcatgttttcacctcaacttctc

SEQ ID NO: 76240 - DNA, 25 bp, Mus musculus
aatcatgttttctcctcaacttctc

SEQ ID NO: 76241 - DNA, 25 bp, Mus musculus
aatcatgtttttcactttagggcat

SEQ ID NO: 76242 - DNA, 25 bp, Mus musculus
aatcatgtttttgactttagggcat

SEQ ID NO: 76243 - DNA, 25 bp, Mus musculus
aatcattaaaatcggcggcgcaggg

SEQ ID NO: 76244 - DNA, 25 bp, Mus musculus
aatcattaaaatgggcggcgcaggg

SEQ ID NO: 76245 - DNA, 25 bp, Mus musculus
aatcattaaggcatcagttttgaga

SEQ ID NO: 76246 - DNA, 25 bp, Mus musculus
aatcattaaggcttcagttttgaga

SEQ ID NO: 76247 - DNA, 25 bp, Mus musculus
aatcattagtagactgttgccttgt

SEQ ID NO: 76248 - DNA, 25 bp, Mus musculus
aatcattagtagtctgttgccttgt

SEQ ID NO: 76249 - DNA, 25 bp, Mus musculus
aatcattagttgcaaagctcagaac

SEQ ID NO: 76250 - DNA, 25 bp, Mus musculus
aatcattagttggaaagctcagaac

SEQ ID NO: 76251 - DNA, 25 bp, Mus musculus
aatcattattgcatactctgtactt

SEQ ID NO: 76252 - DNA, 25 bp, Mus musculus
aatcattattgcttactctgtactt

SEQ ID NO: 76253 - DNA, 25 bp, Mus musculus
aatcattcatgcctttgacaacaaa

SEQ ID NO: 76254 - DNA, 25 bp, Mus musculus
aatcattcatgcgtttgacaacaaa

SEQ ID NO: 76255 - DNA, 25 bp, Mus musculus
aatcattccattaatgtcccataag

SEQ ID NO: 76256 - DNA, 25 bp, Mus musculus
aatcattccattctagactctaaag

SEQ ID NO: 76257 - DNA, 25 bp, Mus musculus
aatcattccattgtagactctaaag

SEQ ID NO: 76258 - DNA, 25 bp, Mus musculus
aatcattccatttatgtcccataag

SEQ ID NO: 76259 - DNA, 25 bp, Mus musculus
aatcattcctatctggagtctctga

SEQ ID NO: 76260 - DNA, 25 bp, Mus musculus
aatcattcctatgtggagtctctga

SEQ ID NO: 76261 - DNA, 25 bp, Mus musculus
aatcattcctgcatagagggtacgt

SEQ ID NO: 76262 - DNA, 25 bp, Mus musculus
aatcattcctgcttagagggtacgt

SEQ ID NO: 76263 - DNA, 25 bp, Mus musculus
aatcattcctgtatctgtgtcttac

SEQ ID NO: 76264 - DNA, 25 bp, Mus musculus
aatcattcctgtttctgtgtcttac

SEQ ID NO: 76265 - DNA, 25 bp, Mus musculus
aatcattccttgcacttttacaaag

SEQ ID NO: 76266 - DNA, 25 bp, Mus musculus
aatcattccttggacttttacaaag

SEQ ID NO: 76267 - DNA, 25 bp, Mus musculus
aatcattcctttcgtgatttacctg

SEQ ID NO: 76268 - DNA, 25 bp, Mus musculus
aatcattcctttggtgatttacctg

SEQ ID NO: 76269 - DNA, 25 bp, Mus musculus
aatcattctactagactcagactca

SEQ ID NO: 76270 - DNA, 25 bp, Mus musculus
aatcattctacttgactcagactca

SEQ ID NO: 76271 - DNA, 25 bp, Mus musculus
aatcattcttgtaggacagtttttg

SEQ ID NO: 76272 - DNA, 25 bp, Mus musculus
aatcattcttgttggacagtttttg

SEQ ID NO: 76273 - DNA, 25 bp, Mus musculus
aatcattgacagaggcgtcctacaa

SEQ ID NO: 76274 - DNA, 25 bp, Mus musculus
aatcattgacagtggcgtcctacaa

SEQ ID NO: 76275 - DNA, 25 bp, Mus musculus
aatcattgactgaattcccaaaaaa

SEQ ID NO: 76276 - DNA, 25 bp, Mus musculus
aatcattgactgtattcccaaaaaa

SEQ ID NO: 76277 - DNA, 25 bp, Mus musculus
aatcattgctctaggcctctttgat

SEQ ID NO: 76278 - DNA, 25 bp, Mus musculus
aatcattgctctatatagcatgcta

SEQ ID NO: 76279 - DNA, 25 bp, Mus musculus
aatcattgctcttggcctctttgat

SEQ ID NO: 76280 - DNA, 25 bp, Mus musculus
aatcattgctctttatagcatgcta

SEQ ID NO: 76281 - DNA, 25 bp, Mus musculus
aatcattggcaaagtacagcccctg

SEQ ID NO: 76282 - DNA, 25 bp, Mus musculus
aatcattggcaatgtacagcccctg

SEQ ID NO: 76283 - DNA, 25 bp, Mus musculus
aatcattggccactggtcttggtga

SEQ ID NO: 76284 - DNA, 25 bp, Mus musculus
aatcattggccagtggtcttggtga

SEQ ID NO: 76285 - DNA, 25 bp, Mus musculus
aatcattgggccagtgtcataaaat

SEQ ID NO: 76286 - DNA, 25 bp, Mus musculus
aatcattgggccattgagatggctc

SEQ ID NO: 76287 - DNA, 25 bp, Mus musculus
aatcattgggcctgtgtcataaaat

SEQ ID NO: 76288 - DNA, 25 bp, Mus musculus
aatcattgggcctttgagatggctc

SEQ ID NO: 76289 - DNA, 25 bp, Mus musculus
aatcattgggctctgtcctctgggt

SEQ ID NO: 76290 - DNA, 25 bp, Mus musculus
aatcattgggctgtgtcctctgggt

SEQ ID NO: 76291 - DNA, 25 bp, Mus musculus
aatcattgtcatatcctgttctctc

SEQ ID NO: 76292 - DNA, 25 bp, Mus musculus
aatcattgtcatttcctgttctctc

SEQ ID NO: 76293 - DNA, 25 bp, Mus musculus
aatcattgtccacggaaatggccaa

SEQ ID NO: 76294 - DNA, 25 bp, Mus musculus
aatcattgtccagggaaatggccaa

SEQ ID NO: 76295 - DNA, 25 bp, Mus musculus
aatcattgtcgtccaggctgtcgaa

SEQ ID NO: 76296 - DNA, 25 bp, Mus musculus
aatcattgtcgtgcaggctgtcgaa

SEQ ID NO: 76297 - DNA, 25 bp, Mus musculus
aatcattgtctcaggtaaacccctg

SEQ ID NO: 76298 - DNA, 25 bp, Mus musculus
aatcattgtctctggtaaacccctg

SEQ ID NO: 76299 - DNA, 25 bp, Mus musculus
aatcattgttctcacagggctggca

SEQ ID NO: 76300 - DNA, 25 bp, Mus musculus
aatcattgttctgacagggctggca

SEQ ID NO: 76301 - DNA, 25 bp, Mus musculus
aatcattgtttcagttcaaaaggtg

SEQ ID NO: 76302 - DNA, 25 bp, Mus musculus
aatcattgtttctgttcaaaaggtg

SEQ ID NO: 76303 - DNA, 25 bp, Mus musculus
aatcatttaatgatctggcctcaag

SEQ ID NO: 76304 - DNA, 25 bp, Mus musculus
aatcatttaatgttctggcctcaag

SEQ ID NO: 76305 - DNA, 25 bp, Mus musculus
aatcatttagataccactgttccct

SEQ ID NO: 76306 - DNA, 25 bp, Mus musculus
aatcatttagattccactgttccct

SEQ ID NO: 76307 - DNA, 25 bp, Mus musculus
aatcatttagttacttacctgagga

SEQ ID NO: 76308 - DNA, 25 bp, Mus musculus
aatcatttagtttcttacctgagga

SEQ ID NO: 76309 - DNA, 25 bp, Mus musculus
aatcatttatccatctcagtgcttt

SEQ ID NO: 76310 - DNA, 25 bp, Mus musculus
aatcatttatccttctcagtgcttt

SEQ ID NO: 76311 - DNA, 25 bp, Mus musculus
aatcatttctctactaggctgtgag

SEQ ID NO: 76312 - DNA, 25 bp, Mus musculus
aatcatttctcttctaggctgtgag

SEQ ID NO: 76313 - DNA, 25 bp, Mus musculus
aatcatttcttaaccattggtgtta

SEQ ID NO: 76314 - DNA, 25 bp, Mus musculus
aatcatttcttatccattggtgtta

SEQ ID NO: 76315 - DNA, 25 bp, Mus musculus
aatcatttgacaaacattgctttaa

SEQ ID NO: 76316 - DNA, 25 bp, Mus musculus
aatcatttgacatacattgctttaa

SEQ ID NO: 76317 - DNA, 25 bp, Mus musculus
aatcatttgtaaagaaccctccaga

SEQ ID NO: 76318 - DNA, 25 bp, Mus musculus
aatcatttgtaatgaaccctccaga

SEQ ID NO: 76319 - DNA, 25 bp, Mus musculus
aatcattttcccaagtcaagcacat

SEQ ID NO: 76320 - DNA, 25 bp, Mus musculus
aatcattttccctagtcaagcacat

SEQ ID NO: 76321 - DNA, 25 bp, Mus musculus
aatcattttgtacggcatggcagca

SEQ ID NO: 76322 - DNA, 25 bp, Mus musculus
aatcattttgtagggcatggcagca

SEQ ID NO: 76323 - DNA, 25 bp, Mus musculus
aatcatttttaccttgctcactttt

SEQ ID NO: 76324 - DNA, 25 bp, Mus musculus
aatcatttttacgttgctcactttt

SEQ ID NO: 76325 - DNA, 25 bp, Mus musculus
aatccaaaaatcactcctgggcacc

SEQ ID NO: 76326 - DNA, 25 bp, Mus musculus
aatccaaaaatctctcctgggcacc

SEQ ID NO: 76327 - DNA, 25 bp, Mus musculus
aatccaaaagcaattctactctaag

SEQ ID NO: 76328 - DNA, 25 bp, Mus musculus
aatccaaaagcatttctactctaag

SEQ ID NO: 76329 - DNA, 25 bp, Mus musculus
aatccaaaaggccactgcactttca

SEQ ID NO: 76330 - DNA, 25 bp, Mus musculus
aatccaaaaggcgactgcactttca

SEQ ID NO: 76331 - DNA, 25 bp, Mus musculus
aatccaaacaaacagctggctgcct

SEQ ID NO: 76332 - DNA, 25 bp, Mus musculus
aatccaaacaaagagctggctgcct

SEQ ID NO: 76333 - DNA, 25 bp, Mus musculus
aatccaaacaaccatgcttggctaa

SEQ ID NO: 76334 - DNA, 25 bp, Mus musculus
aatccaaacaacgatgcttggctaa

SEQ ID NO: 76335 - DNA, 25 bp, Mus musculus
aatccaaacagcattatcctcttct

SEQ ID NO: 76336 - DNA, 25 bp, Mus musculus
aatccaaacagctttatcctcttct

SEQ ID NO: 76337 - DNA, 25 bp, Mus musculus
aatccaaactcgagtgtgaggtcca

SEQ ID NO: 76338 - DNA, 25 bp, Mus musculus
aatccaaactcgtgtgtgaggtcca

SEQ ID NO: 76339 - DNA, 25 bp, Mus musculus
aatccaaactggcttctgagctcga

SEQ ID NO: 76340 - DNA, 25 bp, Mus musculus
aatccaaactgggttctgagctcga

SEQ ID NO: 76341 - DNA, 25 bp, Mus musculus
aatccaaacttgagaccctgtcagt

SEQ ID NO: 76342 - DNA, 25 bp, Mus musculus
aatccaaacttgtgaccctgtcagt

SEQ ID NO: 76343 - DNA, 25 bp, Mus musculus
aatccaaagccaaatgcctcgagcc

SEQ ID NO: 76344 - DNA, 25 bp, Mus musculus
aatccaaagccatatgcctcgagcc

SEQ ID NO: 76345 - DNA, 25 bp, Mus musculus
aatccaaagggcaatcacaggtata

SEQ ID NO: 76346 - DNA, 25 bp, Mus musculus
aatccaaagggctatcacaggtata

SEQ ID NO: 76347 - DNA, 25 bp, Mus musculus
aatccaaagtcacaagctgccctgg

SEQ ID NO: 76348 - DNA, 25 bp, Mus musculus
aatccaaagtcagaagctgccctgg

SEQ ID NO: 76349 - DNA, 25 bp, Mus musculus
aatccaaataacacatcgggatggg

SEQ ID NO: 76350 - DNA, 25 bp, Mus musculus
aatccaaataactcatcgggatggg

SEQ ID NO: 76351 - DNA, 25 bp, Mus musculus
aatccaaatgctcaagaacgggaaa

SEQ ID NO: 76352 - DNA, 25 bp, Mus musculus
aatccaaatgctgaagaacgggaaa

SEQ ID NO: 76353 - DNA, 25 bp, Mus musculus
aatccaacagttagagcctcatcct

SEQ ID NO: 76354 - DNA, 25 bp, Mus musculus
aatccaacagtttgagcctcatcct

SEQ ID NO: 76355 - DNA, 25 bp, Mus musculus
aatccaacatttcgcctttgaggcc

SEQ ID NO: 76356 - DNA, 25 bp, Mus musculus
aatccaacatttggcctttgaggcc

SEQ ID NO: 76357 - DNA, 25 bp, Mus musculus
aatccaaccatactgcaggaggaag

SEQ ID NO: 76358 - DNA, 25 bp, Mus musculus
aatccaaccatagtgcaggaggaag

SEQ ID NO: 76359 - DNA, 25 bp, Mus musculus
aatccaaccttgacatctgcctgag

SEQ ID NO: 76360 - DNA, 25 bp, Mus musculus
aatccaaccttgtcatctgcctgag

SEQ ID NO: 76361 - DNA, 25 bp, Mus musculus
aatccaacctttacttgtttgtatg

SEQ ID NO: 76362 - DNA, 25 bp, Mus musculus
aatccaaccttttcttgtttgtatg

SEQ ID NO: 76363 - DNA, 25 bp, Mus musculus
aatccaacggagatgaatggctttt

SEQ ID NO: 76364 - DNA, 25 bp, Mus musculus
aatccaacggagttgaatggctttt

SEQ ID NO: 76365 - DNA, 25 bp, Mus musculus
aatccaactgagcttgtcacttggt

SEQ ID NO: 76366 - DNA, 25 bp, Mus musculus
aatccaactgaggttgtcacttggt

SEQ ID NO: 76367 - DNA, 25 bp, Mus musculus
aatccaactgttagagggtgaccgg

SEQ ID NO: 76368 - DNA, 25 bp, Mus musculus
aatccaactgtttgagggtgaccgg

SEQ ID NO: 76369 - DNA, 25 bp, Mus musculus
aatccaagatctcgtgcattctatg

SEQ ID NO: 76370 - DNA, 25 bp, Mus musculus
aatccaagatctggtgcattctatg

SEQ ID NO: 76371 - DNA, 25 bp, Mus musculus
aatccaagatggatgccgtgtagta

SEQ ID NO: 76372 - DNA, 25 bp, Mus musculus
aatccaagatggttgccgtgtagta

SEQ ID NO: 76373 - DNA, 25 bp, Mus musculus
aatccaagctgcacatttccctatt

SEQ ID NO: 76374 - DNA, 25 bp, Mus musculus
aatccaagctgctcatttccctatt

SEQ ID NO: 76375 - DNA, 25 bp, Mus musculus
aatccaagctggcatatgacgtctt

SEQ ID NO: 76376 - DNA, 25 bp, Mus musculus
aatccaagctgggatatgacgtctt

SEQ ID NO: 76377 - DNA, 25 bp, Mus musculus
aatccaaggataaagtgtcagccac

SEQ ID NO: 76378 - DNA, 25 bp, Mus musculus
aatccaaggatatagtgtcagccac

SEQ ID NO: 76379 - DNA, 25 bp, Mus musculus
aatccaaggcctatgagccctggga

SEQ ID NO: 76380 - DNA, 25 bp, Mus musculus
aatccaaggcctttgagccctggga

SEQ ID NO: 76381 - DNA, 25 bp, Mus musculus
aatccaagggcaacgctgttacagc

SEQ ID NO: 76382 - DNA, 25 bp, Mus musculus
aatccaagggcatcgctgttacagc

SEQ ID NO: 76383 - DNA, 25 bp, Mus musculus
aatccaagggctcggacaaccctgt

SEQ ID NO: 76384 - DNA, 25 bp, Mus musculus
aatccaagggctgggacaaccctgt

SEQ ID NO: 76385 - DNA, 25 bp, Mus musculus
aatccaagtcttcgcctacataggt

SEQ ID NO: 76386 - DNA, 25 bp, Mus musculus
aatccaagtcttggcctacataggt

SEQ ID NO: 76387 - DNA, 25 bp, Mus musculus
aatccaagtgaacaagcctgtgaca

SEQ ID NO: 76388 - DNA, 25 bp, Mus musculus
aatccaagtgaagaagcctgtgaca

SEQ ID NO: 76389 - DNA, 25 bp, Mus musculus
aatccaagtggcatgtgcagtgaca

SEQ ID NO: 76390 - DNA, 25 bp, Mus musculus
aatccaagtggcttgtgcagtgaca

SEQ ID NO: 76391 - DNA, 25 bp, Mus musculus
aatccaagtgtccaacctctgtggt

SEQ ID NO: 76392 - DNA, 25 bp, Mus musculus
aatccaagtgtcgaacctctgtggt

SEQ ID NO: 76393 - DNA, 25 bp, Mus musculus
aatccaagtgtgactgaagaatctt

SEQ ID NO: 76394 - DNA, 25 bp, Mus musculus
aatccaagtgtgtctgaagaatctt

SEQ ID NO: 76395 - DNA, 25 bp, Mus musculus
aatccaatacagaggcctcgtgtgg

SEQ ID NO: 76396 - DNA, 25 bp, Mus musculus
aatccaatacagtggcctcgtgtgg

SEQ ID NO: 76397 - DNA, 25 bp, Mus musculus
aatccaatcttcagcaattcccagt

SEQ ID NO: 76398 - DNA, 25 bp, Mus musculus
aatccaatcttctgcaattcccagt

SEQ ID NO: 76399 - DNA, 25 bp, Mus musculus
aatccaattgaactcaccctcaatg

SEQ ID NO: 76400 - DNA, 25 bp, Mus musculus
aatccaattgaagtcaccctcaatg

SEQ ID NO: 76401 - DNA, 25 bp, Mus musculus
aatccacaaagcatcttgaagcccc

SEQ ID NO: 76402 - DNA, 25 bp, Mus musculus
aatccacaaagcttcttgaagcccc

SEQ ID NO: 76403 - DNA, 25 bp, Mus musculus
aatccacaacggagcaagtgccttg

SEQ ID NO: 76404 - DNA, 25 bp, Mus musculus
aatccacaacggtgcaagtgccttg

SEQ ID NO: 76405 - DNA, 25 bp, Mus musculus
aatccacaagtacgccaggactgca

SEQ ID NO: 76406 - DNA, 25 bp, Mus musculus
aatccacaagtaggccaggactgca

SEQ ID NO: 76407 - DNA, 25 bp, Mus musculus
aatccacacatactttttctccttt

SEQ ID NO: 76408 - DNA, 25 bp, Mus musculus
aatccacacatagtttttctccttt

SEQ ID NO: 76409 - DNA, 25 bp, Mus musculus
aatccacacattattgtccattgct

SEQ ID NO: 76410 - DNA, 25 bp, Mus musculus
aatccacacatttttgtccattgct

SEQ ID NO: 76411 - DNA, 25 bp, Mus musculus
aatccacaccaaagggagacttcca

SEQ ID NO: 76412 - DNA, 25 bp, Mus musculus
aatccacaccaatgggagacttcca

SEQ ID NO: 76413 - DNA, 25 bp, Mus musculus
aatccacactgacgcctagaccttg

SEQ ID NO: 76414 - DNA, 25 bp, Mus musculus
aatccacactgaggcctagaccttg

SEQ ID NO: 76415 - DNA, 25 bp, Mus musculus
aatccacagaggacgcgccgggcgc

SEQ ID NO: 76416 - DNA, 25 bp, Mus musculus
aatccacagaggtcgcgccgggcgc

SEQ ID NO: 76417 - DNA, 25 bp, Mus musculus
aatccacagtatagcttggtttatt

SEQ ID NO: 76418 - DNA, 25 bp, Mus musculus
aatccacagtattgcttggtttatt

SEQ ID NO: 76419 - DNA, 25 bp, Mus musculus
aatccacataagctgtgttttctat

SEQ ID NO: 76420 - DNA, 25 bp, Mus musculus
aatccacataaggtgtgttttctat

SEQ ID NO: 76421 - DNA, 25 bp, Mus musculus
aatccacatatcaagctggccaaaa

SEQ ID NO: 76422 - DNA, 25 bp, Mus musculus
aatccacatatctagctggccaaaa

SEQ ID NO: 76423 - DNA, 25 bp, Mus musculus
aatccacatccaaacttggtgtctc

SEQ ID NO: 76424 - DNA, 25 bp, Mus musculus
aatccacatccatacttggtgtctc

SEQ ID NO: 76425 - DNA, 25 bp, Mus musculus
aatccacatgttcagaacgactaat

SEQ ID NO: 76426 - DNA, 25 bp, Mus musculus
aatccacatgttgagaacgactaat

SEQ ID NO: 76427 - DNA, 25 bp, Mus musculus
aatccacattgtagattccttttgt

SEQ ID NO: 76428 - DNA, 25 bp, Mus musculus
aatccacattgttgattccttttgt

SEQ ID NO: 76429 - DNA, 25 bp, Mus musculus
aatccaccaaataactcaagtcctg

SEQ ID NO: 76430 - DNA, 25 bp, Mus musculus
aatccaccaaatccaatggctcaga

SEQ ID NO: 76431 - DNA, 25 bp, Mus musculus
aatccaccaaatgcaatggctcaga

SEQ ID NO: 76432 - DNA, 25 bp, Mus musculus
aatccaccaaattactcaagtcctg

SEQ ID NO: 76433 - DNA, 25 bp, Mus musculus
aatccaccattgactgtaacaccag

SEQ ID NO: 76434 - DNA, 25 bp, Mus musculus
aatccaccattgtctgtaacaccag

SEQ ID NO: 76435 - DNA, 25 bp, Mus musculus
aatccacccaccctccaggagaagc

SEQ ID NO: 76436 - DNA, 25 bp, Mus musculus
aatccacccaccgtccaggagaagc

SEQ ID NO: 76437 - DNA, 25 bp, Mus musculus
aatccacccagtagtgttctaaaat

SEQ ID NO: 76438 - DNA, 25 bp, Mus musculus
aatccacccagttgtgttctaaaat

SEQ ID NO: 76439 - DNA, 25 bp, Mus musculus
aatccacccatcacattctaagaag

SEQ ID NO: 76440 - DNA, 25 bp, Mus musculus
aatccacccatctcattctaagaag

SEQ ID NO: 76441 - DNA, 25 bp, Mus musculus
aatccacctctgattatagtgtaat

SEQ ID NO: 76442 - DNA, 25 bp, Mus musculus
aatccacctctgtttatagtgtaat

SEQ ID NO: 76443 - DNA, 25 bp, Mus musculus
aatccacctcttcatggtttcttgg

SEQ ID NO: 76444 - DNA, 25 bp, Mus musculus
aatccacctcttgatggtttcttgg

SEQ ID NO: 76445 - DNA, 25 bp, Mus musculus
aatccacctgagatttgacattgat

SEQ ID NO: 76446 - DNA, 25 bp, Mus musculus
aatccacctgagttttgacattgat

SEQ ID NO: 76447 - DNA, 25 bp, Mus musculus
aatccaccttttcagctataagtag

SEQ ID NO: 76448 - DNA, 25 bp, Mus musculus
aatccaccttttgagctataagtag

SEQ ID NO: 76449 - DNA, 25 bp, Mus musculus
aatccacggctgcaattggacttca

SEQ ID NO: 76450 - DNA, 25 bp, Mus musculus
aatccacggctggaattggacttca

SEQ ID NO: 76451 - DNA, 25 bp, Mus musculus
aatccacggttgactgcttgtaaag

SEQ ID NO: 76452 - DNA, 25 bp, Mus musculus
aatccacggttgtctgcttgtaaag

SEQ ID NO: 76453 - DNA, 25 bp, Mus musculus
aatccacgtgataaatgttttcatt

SEQ ID NO: 76454 - DNA, 25 bp, Mus musculus
aatccacgtgattaatgttttcatt

SEQ ID NO: 76455 - DNA, 25 bp, Mus musculus
aatccactagtgaaacccaggacat

SEQ ID NO: 76456 - DNA, 25 bp, Mus musculus
aatccactagtgtaacccaggacat

SEQ ID NO: 76457 - DNA, 25 bp, Mus musculus
aatccactcataaatttgcttcttt

SEQ ID NO: 76458 - DNA, 25 bp, Mus musculus
aatccactcatatatttgcttcttt

SEQ ID NO: 76459 - DNA, 25 bp, Mus musculus
aatccactcgtgatttggaggccat

SEQ ID NO: 76460 - DNA, 25 bp, Mus musculus
aatccactcgtgttttggaggccat

SEQ ID NO: 76461 - DNA, 25 bp, Mus musculus
aatccactctggcttgtcaactgta

SEQ ID NO: 76462 - DNA, 25 bp, Mus musculus
aatccactctgggttgtcaactgta

SEQ ID NO: 76463 - DNA, 25 bp, Mus musculus
aatccactcttacatttccatgaca

SEQ ID NO: 76464 - DNA, 25 bp, Mus musculus
aatccactcttagatttccatgaca

SEQ ID NO: 76465 - DNA, 25 bp, Mus musculus
aatccactctttcctatgctggcta

SEQ ID NO: 76466 - DNA, 25 bp, Mus musculus
aatccactctttgctatgctggcta

SEQ ID NO: 76467 - DNA, 25 bp, Mus musculus
aatccactgggacatgacgacgcct

SEQ ID NO: 76468 - DNA, 25 bp, Mus musculus
aatccactgggagatgacgacgcct

SEQ ID NO: 76469 - DNA, 25 bp, Mus musculus
aatccactggtcattacctagggta

SEQ ID NO: 76470 - DNA, 25 bp, Mus musculus
aatccactggtctttacctagggta

SEQ ID NO: 76471 - DNA, 25 bp, Mus musculus
aatccactgttaagctatacacccc

SEQ ID NO: 76472 - DNA, 25 bp, Mus musculus
aatccactgttatgctatacacccc

SEQ ID NO: 76473 - DNA, 25 bp, Mus musculus
aatccacttattatatgcttgtaat

SEQ ID NO: 76474 - DNA, 25 bp, Mus musculus
aatccacttattttatgcttgtaat

SEQ ID NO: 76475 - DNA, 25 bp, Mus musculus
aatccacttcaaaacgctgcggctc

SEQ ID NO: 76476 - DNA, 25 bp, Mus musculus
aatccacttcaatacgctgcggctc

SEQ ID NO: 76477 - DNA, 25 bp, Mus musculus
aatccacttgacatcacgacattct

SEQ ID NO: 76478 - DNA, 25 bp, Mus musculus
aatccacttgacttcacgacattct

SEQ ID NO: 76479 - DNA, 25 bp, Mus musculus
aatccacttgccaccaaagctttat

SEQ ID NO: 76480 - DNA, 25 bp, Mus musculus
aatccacttgcctccaaagctttat

SEQ ID NO: 76481 - DNA, 25 bp, Mus musculus
aatccactttggcttcgtgaaagat

SEQ ID NO: 76482 - DNA, 25 bp, Mus musculus
aatccactttgggttcgtgaaagat

SEQ ID NO: 76483 - DNA, 25 bp, Mus musculus
aatccactttgtccctatctttcaa

SEQ ID NO: 76484 - DNA, 25 bp, Mus musculus
aatccactttgtgcctatctttcaa

SEQ ID NO: 76485 - DNA, 25 bp, Mus musculus
aatccagaaatcaaagcccgggctc

SEQ ID NO: 76486 - DNA, 25 bp, Mus musculus
aatccagaaatctaagcccgggctc

SEQ ID NO: 76487 - DNA, 25 bp, Mus musculus
aatccagaacttaacttgcctcata

SEQ ID NO: 76488 - DNA, 25 bp, Mus musculus
aatccagaactttacttgcctcata

SEQ ID NO: 76489 - DNA, 25 bp, Mus musculus
aatccagacacgcaaagacctcatg

SEQ ID NO: 76490 - DNA, 25 bp, Mus musculus
aatccagacacggaaagacctcatg

SEQ ID NO: 76491 - DNA, 25 bp, Mus musculus
aatccagacccacgaagctgtgcgg

SEQ ID NO: 76492 - DNA, 25 bp, Mus musculus
aatccagacccaggaagctgtgcgg

SEQ ID NO: 76493 - DNA, 25 bp, Mus musculus
aatccagaccccagttgaagtgcag

SEQ ID NO: 76494 - DNA, 25 bp, Mus musculus
aatccagacccctgttgaagtgcag

SEQ ID NO: 76495 - DNA, 25 bp, Mus musculus
aatccagacctcatggtgtttttct

SEQ ID NO: 76496 - DNA, 25 bp, Mus musculus
aatccagacctcttggtgtttttct

SEQ ID NO: 76497 - DNA, 25 bp, Mus musculus
aatccagacttaacctgtttcctca

SEQ ID NO: 76498 - DNA, 25 bp, Mus musculus
aatccagacttatcctgtttcctca

SEQ ID NO: 76499 - DNA, 25 bp, Mus musculus
aatccagagacaatccagggctagg

SEQ ID NO: 76500 - DNA, 25 bp, Mus musculus
aatccagagacattccagggctagg

SEQ ID NO: 76501 - DNA, 25 bp, Mus musculus
aatccagagactcactgcctttagc

SEQ ID NO: 76502 - DNA, 25 bp, Mus musculus
aatccagagactgactgcctttagc

SEQ ID NO: 76503 - DNA, 25 bp, Mus musculus
aatccagagagccaaaatgccattt

SEQ ID NO: 76504 - DNA, 25 bp, Mus musculus
aatccagagagcgaaaatgccattt

SEQ ID NO: 76505 - DNA, 25 bp, Mus musculus
aatccagagcaacaagagaccagtg

SEQ ID NO: 76506 - DNA, 25 bp, Mus musculus
aatccagagcaaccgcagcgaggtg

SEQ ID NO: 76507 - DNA, 25 bp, Mus musculus
aatccagagcaagaagagaccagtg

SEQ ID NO: 76508 - DNA, 25 bp, Mus musculus
aatccagagcaagcgcagcgaggtg

SEQ ID NO: 76509 - DNA, 25 bp, Mus musculus
aatccagagcctcaaacatgctaga

SEQ ID NO: 76510 - DNA, 25 bp, Mus musculus
aatccagagcctgaaacatgctaga

SEQ ID NO: 76511 - DNA, 25 bp, Mus musculus
aatccagaggccaggattcaggctc

SEQ ID NO: 76512 - DNA, 25 bp, Mus musculus
aatccagaggcctggattcaggctc

SEQ ID NO: 76513 - DNA, 25 bp, Mus musculus
aatccagagtgtcctgagtctagtt

SEQ ID NO: 76514 - DNA, 25 bp, Mus musculus
aatccagagtgtgctgagtctagtt

SEQ ID NO: 76515 - DNA, 25 bp, Mus musculus
aatccagatagacccagagcaagag

SEQ ID NO: 76516 - DNA, 25 bp, Mus musculus
aatccagatagagccagagcaagag

SEQ ID NO: 76517 - DNA, 25 bp, Mus musculus
aatccagatcacctgacagccaagt

SEQ ID NO: 76518 - DNA, 25 bp, Mus musculus
aatccagatcacgtgacagccaagt

SEQ ID NO: 76519 - DNA, 25 bp, Mus musculus
aatccagatgatacagtcccagctc

SEQ ID NO: 76520 - DNA, 25 bp, Mus musculus
aatccagatgattcagtcccagctc

SEQ ID NO: 76521 - DNA, 25 bp, Mus musculus
aatccagatggaatgcagaccactc

SEQ ID NO: 76522 - DNA, 25 bp, Mus musculus
aatccagatggattgcagaccactc

SEQ ID NO: 76523 - DNA, 25 bp, Mus musculus
aatccagatgtcaagaacttgccta

SEQ ID NO: 76524 - DNA, 25 bp, Mus musculus
aatccagatgtctagaacttgccta

SEQ ID NO: 76525 - DNA, 25 bp, Mus musculus
aatccagcacggaaaacggcggcgt

SEQ ID NO: 76526 - DNA, 25 bp, Mus musculus
aatccagcacggtaaacggcggcgt

SEQ ID NO: 76527 - DNA, 25 bp, Mus musculus
aatccagcaggaacatctactcaag

SEQ ID NO: 76528 - DNA, 25 bp, Mus musculus
aatccagcaggatcatctactcaag

SEQ ID NO: 76529 - DNA, 25 bp, Mus musculus
aatccagcatcgcaggcacaagtcc

SEQ ID NO: 76530 - DNA, 25 bp, Mus musculus
aatccagcatcggaggcacaagtcc

SEQ ID NO: 76531 - DNA, 25 bp, Mus musculus
aatccagccagacgctgcaacacag

SEQ ID NO: 76532 - DNA, 25 bp, Mus musculus
aatccagccagaggctgcaacacag

SEQ ID NO: 76533 - DNA, 25 bp, Mus musculus
aatccagccatcacacaaaagtttg

SEQ ID NO: 76534 - DNA, 25 bp, Mus musculus
aatccagccatctcacaaaagtttg

SEQ ID NO: 76535 - DNA, 25 bp, Mus musculus
aatccagccattacagcagacatgt

SEQ ID NO: 76536 - DNA, 25 bp, Mus musculus
aatccagccatttcagcagacatgt

SEQ ID NO: 76537 - DNA, 25 bp, Mus musculus
aatccagcccctatgaaatgttgtt

SEQ ID NO: 76538 - DNA, 25 bp, Mus musculus
aatccagcccctttgaaatgttgtt

SEQ ID NO: 76539 - DNA, 25 bp, Mus musculus
aatccagccctcatgaattgaaatg

SEQ ID NO: 76540 - DNA, 25 bp, Mus musculus
aatccagccctcttgaattgaaatg

SEQ ID NO: 76541 - DNA, 25 bp, Mus musculus
aatccagcgactacagtgacatcat

SEQ ID NO: 76542 - DNA, 25 bp, Mus musculus
aatccagcgacttcagtgacatcat

SEQ ID NO: 76543 - DNA, 25 bp, Mus musculus
aatccagcgcttcgaggagattctc

SEQ ID NO: 76544 - DNA, 25 bp, Mus musculus
aatccagcgcttggaggagattctc

SEQ ID NO: 76545 - DNA, 25 bp, Mus musculus
aatccagctggacgcgtgttaccca

SEQ ID NO: 76546 - DNA, 25 bp, Mus musculus
aatccagctggaggcgtgttaccca

SEQ ID NO: 76547 - DNA, 25 bp, Mus musculus
aatccagctggtacacggactcaag

SEQ ID NO: 76548 - DNA, 25 bp, Mus musculus
aatccagctggttcacggactcaag

SEQ ID NO: 76549 - DNA, 25 bp, Mus musculus
aatccagctgttatggttaccaatc

SEQ ID NO: 76550 - DNA, 25 bp, Mus musculus
aatccagctgttttggttaccaatc

SEQ ID NO: 76551 - DNA, 25 bp, Mus musculus
aatccagcttccatctttgtataca

SEQ ID NO: 76552 - DNA, 25 bp, Mus musculus
aatccagcttccttctttgtataca

SEQ ID NO: 76553 - DNA, 25 bp, Mus musculus
aatccaggagccaggagtgtctgac

SEQ ID NO: 76554 - DNA, 25 bp, Mus musculus
aatccaggagcctggagtgtctgac

SEQ ID NO: 76555 - DNA, 25 bp, Mus musculus
aatccaggagctatagtcagacatc

SEQ ID NO: 76556 - DNA, 25 bp, Mus musculus
aatccaggagctttagtcagacatc

SEQ ID NO: 76557 - DNA, 25 bp, Mus musculus
aatccaggagttctttggtctgcga

SEQ ID NO: 76558 - DNA, 25 bp, Mus musculus
aatccaggagttgtttggtctgcga

SEQ ID NO: 76559 - DNA, 25 bp, Mus musculus
aatccaggccaactgtacattgctt

SEQ ID NO: 76560 - DNA, 25 bp, Mus musculus
aatccaggccaagtgtacattgctt

SEQ ID NO: 76561 - DNA, 25 bp, Mus musculus
aatccaggcctgactttggaggaaa

SEQ ID NO: 76562 - DNA, 25 bp, Mus musculus
aatccaggcctgtctttggaggaaa

SEQ ID NO: 76563 - DNA, 25 bp, Mus musculus
aatccaggctggagttgaagctcaa

SEQ ID NO: 76564 - DNA, 25 bp, Mus musculus
aatccaggctggtgttgaagctcaa

SEQ ID NO: 76565 - DNA, 25 bp, Mus musculus
aatccaggctgtagctacggcagca

SEQ ID NO: 76566 - DNA, 25 bp, Mus musculus
aatccaggctgttgctacggcagca

SEQ ID NO: 76567 - DNA, 25 bp, Mus musculus
aatccaggcttccagagatctgact

SEQ ID NO: 76568 - DNA, 25 bp, Mus musculus
aatccaggcttcgagagatctgact

SEQ ID NO: 76569 - DNA, 25 bp, Mus musculus
aatccagggaaacttcagtcatgac

SEQ ID NO: 76570 - DNA, 25 bp, Mus musculus
aatccagggaaagttcagtcatgac

SEQ ID NO: 76571 - DNA, 25 bp, Mus musculus
aatccagggaacacctgagccggga

SEQ ID NO: 76572 - DNA, 25 bp, Mus musculus
aatccagggaactcctgagccggga

SEQ ID NO: 76573 - DNA, 25 bp, Mus musculus
aatccagggaggacgcgactgttcc

SEQ ID NO: 76574 - DNA, 25 bp, Mus musculus
aatccagggaggtcgcgactgttcc

SEQ ID NO: 76575 - DNA, 25 bp, Mus musculus
aatccaggtagcatcctagttaaag

SEQ ID NO: 76576 - DNA, 25 bp, Mus musculus
aatccaggtagcttcctagttaaag

SEQ ID NO: 76577 - DNA, 25 bp, Mus musculus
aatccaggtgctaatgttgttactt

SEQ ID NO: 76578 - DNA, 25 bp, Mus musculus
aatccaggtgcttatgttgttactt

SEQ ID NO: 76579 - DNA, 25 bp, Mus musculus
aatccagtaaccacacacccaaaat

SEQ ID NO: 76580 - DNA, 25 bp, Mus musculus
aatccagtaacctcacacccaaaat

SEQ ID NO: 76581 - DNA, 25 bp, Mus musculus
aatccagtacctccttgaagttgtc

SEQ ID NO: 76582 - DNA, 25 bp, Mus musculus
aatccagtacctgcttgaagttgtc

SEQ ID NO: 76583 - DNA, 25 bp, Mus musculus
aatccagtcactaaaccacacattg

SEQ ID NO: 76584 - DNA, 25 bp, Mus musculus
aatccagtcacttaaccacacattg

SEQ ID NO: 76585 - DNA, 25 bp, Mus musculus
aatccagtcatcatccatctttgtt

SEQ ID NO: 76586 - DNA, 25 bp, Mus musculus
aatccagtcatcttccatctttgtt

SEQ ID NO: 76587 - DNA, 25 bp, Mus musculus
aatccagtcccaattcttctatcat

SEQ ID NO: 76588 - DNA, 25 bp, Mus musculus
aatccagtcccatttcttctatcat

SEQ ID NO: 76589 - DNA, 25 bp, Mus musculus
aatccagtccgtccattttaacata

SEQ ID NO: 76590 - DNA, 25 bp, Mus musculus
aatccagtccgtgcattttaacata

SEQ ID NO: 76591 - DNA, 25 bp, Mus musculus
aatccagtcttacctgaggtgctgt

SEQ ID NO: 76592 - DNA, 25 bp, Mus musculus
aatccagtcttagctgaggtgctgt

SEQ ID NO: 76593 - DNA, 25 bp, Mus musculus
aatccagtggccatgcaaacggtcc

SEQ ID NO: 76594 - DNA, 25 bp, Mus musculus
aatccagtggccttgcaaacggtcc

SEQ ID NO: 76595 - DNA, 25 bp, Mus musculus
aatccagtgggtatttgcagttcat

SEQ ID NO: 76596 - DNA, 25 bp, Mus musculus
aatccagtgggtttttgcagttcat

SEQ ID NO: 76597 - DNA, 25 bp, Mus musculus
aatccagtggtcatcttcgatgtca

SEQ ID NO: 76598 - DNA, 25 bp, Mus musculus
aatccagtggtcttcttcgatgtca

SEQ ID NO: 76599 - DNA, 25 bp, Mus musculus
aatccagtgtggatcagtaaatgtg

SEQ ID NO: 76600 - DNA, 25 bp, Mus musculus
aatccagtgtggttcagtaaatgtg

SEQ ID NO: 76601 - DNA, 25 bp, Mus musculus
aatccagttattccagccagccatg

SEQ ID NO: 76602 - DNA, 25 bp, Mus musculus
aatccagttattgcagccagccatg

SEQ ID NO: 76603 - DNA, 25 bp, Mus musculus
aatccagttctcaggctgtgtttga

SEQ ID NO: 76604 - DNA, 25 bp, Mus musculus
aatccagttctctggctgtgtttga

SEQ ID NO: 76605 - DNA, 25 bp, Mus musculus
aatccagttcttatcttgtaccagt

SEQ ID NO: 76606 - DNA, 25 bp, Mus musculus
aatccagttcttttcttgtaccagt

SEQ ID NO: 76607 - DNA, 25 bp, Mus musculus
aatccagttgcaattctcagacaat

SEQ ID NO: 76608 - DNA, 25 bp, Mus musculus
aatccagttgcatttctcagacaat

SEQ ID NO: 76609 - DNA, 25 bp, Mus musculus
aatccagttgccatttctcgacaag

SEQ ID NO: 76610 - DNA, 25 bp, Mus musculus
aatccagttgccttttctcgacaag

SEQ ID NO: 76611 - DNA, 25 bp, Mus musculus
aatccagtttgccattcattgaaga

SEQ ID NO: 76612 - DNA, 25 bp, Mus musculus
aatccagtttgcgattcattgaaga

SEQ ID NO: 76613 - DNA, 25 bp, Mus musculus
aatccataaactcgaggtgtgcaga

SEQ ID NO: 76614 - DNA, 25 bp, Mus musculus
aatccataaactggaggtgtgcaga

SEQ ID NO: 76615 - DNA, 25 bp, Mus musculus
aatccatacaagagtgaaaccctaa

SEQ ID NO: 76616 - DNA, 25 bp, Mus musculus
aatccatacaagtgtgaaaccctaa

SEQ ID NO: 76617 - DNA, 25 bp, Mus musculus
aatccatacacgctttctagtcagg

SEQ ID NO: 76618 - DNA, 25 bp, Mus musculus
aatccatacacggtttctagtcagg

SEQ ID NO: 76619 - DNA, 25 bp, Mus musculus
aatccataccatctgcaaatcgttg

SEQ ID NO: 76620 - DNA, 25 bp, Mus musculus
aatccataccatgtgcaaatcgttg

SEQ ID NO: 76621 - DNA, 25 bp, Mus musculus
aatccatactgtagactatcactct

SEQ ID NO: 76622 - DNA, 25 bp, Mus musculus
aatccatactgttgactatcactct

SEQ ID NO: 76623 - DNA, 25 bp, Mus musculus
aatccataggaccacggtggaggct

SEQ ID NO: 76624 - DNA, 25 bp, Mus musculus
aatccataggacgacggtggaggct

SEQ ID NO: 76625 - DNA, 25 bp, Mus musculus
aatccataggagcactaattcaaat

SEQ ID NO: 76626 - DNA, 25 bp, Mus musculus
aatccataggaggactaattcaaat

SEQ ID NO: 76627 - DNA, 25 bp, Mus musculus
aatccatagggcattgcattcttct

SEQ ID NO: 76628 - DNA, 25 bp, Mus musculus
aatccatagggctttgcattcttct

SEQ ID NO: 76629 - DNA, 25 bp, Mus musculus
aatccatagttgaagctgtggcatg

SEQ ID NO: 76630 - DNA, 25 bp, Mus musculus
aatccatagttgtagctgtggcatg

SEQ ID NO: 76631 - DNA, 25 bp, Mus musculus
aatccatatcagatgcacgggctcg

SEQ ID NO: 76632 - DNA, 25 bp, Mus musculus
aatccatatcagttgcacgggctcg

SEQ ID NO: 76633 - DNA, 25 bp, Mus musculus
aatccatattgtacgctattttgct

SEQ ID NO: 76634 - DNA, 25 bp, Mus musculus
aatccatattgttcgctattttgct

SEQ ID NO: 76635 - DNA, 25 bp, Mus musculus
aatccatcaaaccatcatgtcggag

SEQ ID NO: 76636 - DNA, 25 bp, Mus musculus
aatccatcaaacgatcatgtcggag

SEQ ID NO: 76637 - DNA, 25 bp, Mus musculus
aatccatcagaaatgttcatcccag

SEQ ID NO: 76638 - DNA, 25 bp, Mus musculus
aatccatcagaattgttcatcccag

SEQ ID NO: 76639 - DNA, 25 bp, Mus musculus
aatccatcaggcacatgtagtcttg

SEQ ID NO: 76640 - DNA, 25 bp, Mus musculus
aatccatcaggctcatgtagtcttg

SEQ ID NO: 76641 - DNA, 25 bp, Mus musculus
aatccatcatagctcatcttttggg

SEQ ID NO: 76642 - DNA, 25 bp, Mus musculus
aatccatcataggtcatcttttggg

SEQ ID NO: 76643 - DNA, 25 bp, Mus musculus
aatccatcccaaaccatttctaaaa

SEQ ID NO: 76644 - DNA, 25 bp, Mus musculus
aatccatcccaatccatttctaaaa

SEQ ID NO: 76645 - DNA, 25 bp, Mus musculus
aatccatcctatcggcagaaaaaca

SEQ ID NO: 76646 - DNA, 25 bp, Mus musculus
aatccatcctatgggcagaaaaaca

SEQ ID NO: 76647 - DNA, 25 bp, Mus musculus
aatccatccttactaactttcagac

SEQ ID NO: 76648 - DNA, 25 bp, Mus musculus
aatccatccttagtaactttcagac

SEQ ID NO: 76649 - DNA, 25 bp, Mus musculus
aatccatctcaaattagtgttttaa

SEQ ID NO: 76650 - DNA, 25 bp, Mus musculus
aatccatctcaatttagtgttttaa

SEQ ID NO: 76651 - DNA, 25 bp, Mus musculus
aatccatctccaatgcggaaaagac

SEQ ID NO: 76652 - DNA, 25 bp, Mus musculus
aatccatctccattgcggaaaagac

SEQ ID NO: 76653 - DNA, 25 bp, Mus musculus
aatccatctctgattgttatcctgt

SEQ ID NO: 76654 - DNA, 25 bp, Mus musculus
aatccatctctgtttgttatcctgt

SEQ ID NO: 76655 - DNA, 25 bp, Mus musculus
aatccatcttccactgctcagcatg

SEQ ID NO: 76656 - DNA, 25 bp, Mus musculus
aatccatcttcctctgctcagcatg

SEQ ID NO: 76657 - DNA, 25 bp, Mus musculus
aatccatcttttacttacccatcca

SEQ ID NO: 76658 - DNA, 25 bp, Mus musculus
aatccatctttttcttacccatcca

SEQ ID NO: 76659 - DNA, 25 bp, Mus musculus
aatccatgattgcacttgacgaggg

SEQ ID NO: 76660 - DNA, 25 bp, Mus musculus
aatccatgattggacttgacgaggg

SEQ ID NO: 76661 - DNA, 25 bp, Mus musculus
aatccatgccatccttttatcctga

SEQ ID NO: 76662 - DNA, 25 bp, Mus musculus
aatccatgccatgcttttatcctga

SEQ ID NO: 76663 - DNA, 25 bp, Mus musculus
aatccatgccgcagcgtgagggtag

SEQ ID NO: 76664 - DNA, 25 bp, Mus musculus
aatccatgccgctgcgtgagggtag

SEQ ID NO: 76665 - DNA, 25 bp, Mus musculus
aatccatgctatacaaaaactcaat

SEQ ID NO: 76666 - DNA, 25 bp, Mus musculus
aatccatgctattcaaaaactcaat

SEQ ID NO: 76667 - DNA, 25 bp, Mus musculus
aatccatgctgacttctggtctctg

SEQ ID NO: 76668 - DNA, 25 bp, Mus musculus
aatccatgctgagttctggtctctg

SEQ ID NO: 76669 - DNA, 25 bp, Mus musculus
aatccatgctgtatggttgtcctct

SEQ ID NO: 76670 - DNA, 25 bp, Mus musculus
aatccatgctgtttggttgtcctct

SEQ ID NO: 76671 - DNA, 25 bp, Mus musculus
aatccatggcgcatctgttgaagca

SEQ ID NO: 76672 - DNA, 25 bp, Mus musculus
aatccatggcgcttctgttgaagca

SEQ ID NO: 76673 - DNA, 25 bp, Mus musculus
aatccatgggacagatgactccctc

SEQ ID NO: 76674 - DNA, 25 bp, Mus musculus
aatccatgggactgatgactccctc

SEQ ID NO: 76675 - DNA, 25 bp, Mus musculus
aatccatggttgcaactcacgctgc

SEQ ID NO: 76676 - DNA, 25 bp, Mus musculus
aatccatggttggaactcacgctgc

SEQ ID NO: 76677 - DNA, 25 bp, Mus musculus
aatccatgtattcaggctttacaaa

SEQ ID NO: 76678 - DNA, 25 bp, Mus musculus
aatccatgtattgaggctttacaaa

SEQ ID NO: 76679 - DNA, 25 bp, Mus musculus
aatccatgtgacaattccgtgatca

SEQ ID NO: 76680 - DNA, 25 bp, Mus musculus
aatccatgtgactattccgtgatca

SEQ ID NO: 76681 - DNA, 25 bp, Mus musculus
aatccatgttctcctgagcctggat

SEQ ID NO: 76682 - DNA, 25 bp, Mus musculus
aatccatgttctgctgagcctggat

SEQ ID NO: 76683 - DNA, 25 bp, Mus musculus
aatccattaccacagcattcagtga

SEQ ID NO: 76684 - DNA, 25 bp, Mus musculus
aatccattaccagagcattcagtga

SEQ ID NO: 76685 - DNA, 25 bp, Mus musculus
aatccattatccaaaatcccacaag

SEQ ID NO: 76686 - DNA, 25 bp, Mus musculus
aatccattatcctaaatcccacaag

SEQ ID NO: 76687 - DNA, 25 bp, Mus musculus
aatccattatctagactttaggaat

SEQ ID NO: 76688 - DNA, 25 bp, Mus musculus
aatccattatcttgactttaggaat

SEQ ID NO: 76689 - DNA, 25 bp, Mus musculus
aatccattcactacagttcccagta

SEQ ID NO: 76690 - DNA, 25 bp, Mus musculus
aatccattcacttcagttcccagta

SEQ ID NO: 76691 - DNA, 25 bp, Mus musculus
aatccattccatacccacataatgt

SEQ ID NO: 76692 - DNA, 25 bp, Mus musculus
aatccattccattcccacataatgt

SEQ ID NO: 76693 - DNA, 25 bp, Mus musculus
aatccattcctgatagcttcatgac

SEQ ID NO: 76694 - DNA, 25 bp, Mus musculus
aatccattcctgttagcttcatgac

SEQ ID NO: 76695 - DNA, 25 bp, Mus musculus
aatccattcttcactagggcaacgt

SEQ ID NO: 76696 - DNA, 25 bp, Mus musculus
aatccattcttctctagggcaacgt

SEQ ID NO: 76697 - DNA, 25 bp, Mus musculus
aatccattctttaccacttgtgtgg

SEQ ID NO: 76698 - DNA, 25 bp, Mus musculus
aatccattcttttccacttgtgtgg

SEQ ID NO: 76699 - DNA, 25 bp, Mus musculus
aatccattggataacttttaagctt

SEQ ID NO: 76700 - DNA, 25 bp, Mus musculus
aatccattggattacttttaagctt

SEQ ID NO: 76701 - DNA, 25 bp, Mus musculus
aatccattgggcaccattggcgaca

SEQ ID NO: 76702 - DNA, 25 bp, Mus musculus
aatccattgggctccattggcgaca

SEQ ID NO: 76703 - DNA, 25 bp, Mus musculus
aatccattgttgatgctttcgtttt

SEQ ID NO: 76704 - DNA, 25 bp, Mus musculus
aatccattgttgttgctttcgtttt

SEQ ID NO: 76705 - DNA, 25 bp, Mus musculus
aatccatttcctctgatgcctactg

SEQ ID NO: 76706 - DNA, 25 bp, Mus musculus
aatccatttcctgtgatgcctactg

SEQ ID NO: 76707 - DNA, 25 bp, Mus musculus
aatccatttgtgactacttactgtt

SEQ ID NO: 76708 - DNA, 25 bp, Mus musculus
aatccatttgtgtctacttactgtt

SEQ ID NO: 76709 - DNA, 25 bp, Mus musculus
aatccatttttcacctctggaatct

SEQ ID NO: 76710 - DNA, 25 bp, Mus musculus
aatccatttttctcctctggaatct

SEQ ID NO: 76711 - DNA, 25 bp, Mus musculus
aatcccaaatacaggtgaacactat

SEQ ID NO: 76712 - DNA, 25 bp, Mus musculus
aatcccaaatactggtgaacactat

SEQ ID NO: 76713 - DNA, 25 bp, Mus musculus
aatcccaaattgaagtcccaggcca

SEQ ID NO: 76714 - DNA, 25 bp, Mus musculus
aatcccaaattgtagtcccaggcca

SEQ ID NO: 76715 - DNA, 25 bp, Mus musculus
aatcccaacattatgcaaatttgag

SEQ ID NO: 76716 - DNA, 25 bp, Mus musculus
aatcccaacattttgcaaatttgag

SEQ ID NO: 76717 - DNA, 25 bp, Mus musculus
aatcccaagatcagtgctgtacttc

SEQ ID NO: 76718 - DNA, 25 bp, Mus musculus
aatcccaagatctgtgctgtacttc

SEQ ID NO: 76719 - DNA, 25 bp, Mus musculus
aatcccaaggatcagctcagtccct

SEQ ID NO: 76720 - DNA, 25 bp, Mus musculus
aatcccaaggatgagctcagtccct

SEQ ID NO: 76721 - DNA, 25 bp, Mus musculus
aatcccaaggtcatcatcaatgctg

SEQ ID NO: 76722 - DNA, 25 bp, Mus musculus
aatcccaaggtcttcatcaatgctg

SEQ ID NO: 76723 - DNA, 25 bp, Mus musculus
aatcccaagtcaatgcgtgtatccc

SEQ ID NO: 76724 - DNA, 25 bp, Mus musculus
aatcccaagtcattgcgtgtatccc

SEQ ID NO: 76725 - DNA, 25 bp, Mus musculus
aatcccaagtgcagtaaacataacc

SEQ ID NO: 76726 - DNA, 25 bp, Mus musculus
aatcccaagtgctgtaaacataacc

SEQ ID NO: 76727 - DNA, 25 bp, Mus musculus
aatcccaatttactggttgaggcca

SEQ ID NO: 76728 - DNA, 25 bp, Mus musculus
aatcccaatttagtggttgaggcca

SEQ ID NO: 76729 - DNA, 25 bp, Mus musculus
aatcccacagtcctagtagatacgt

SEQ ID NO: 76730 - DNA, 25 bp, Mus musculus
aatcccacagtcgtagtagatacgt

SEQ ID NO: 76731 - DNA, 25 bp, Mus musculus
aatcccacatttcctagacacaatt

SEQ ID NO: 76732 - DNA, 25 bp, Mus musculus
aatcccacatttgctagacacaatt

SEQ ID NO: 76733 - DNA, 25 bp, Mus musculus
aatcccaccagccttattagagaaa

SEQ ID NO: 76734 - DNA, 25 bp, Mus musculus
aatcccaccagcgttattagagaaa

SEQ ID NO: 76735 - DNA, 25 bp, Mus musculus
aatcccacctgtctctaactgagag

SEQ ID NO: 76736 - DNA, 25 bp, Mus musculus
aatcccacctgtgtctaactgagag

SEQ ID NO: 76737 - DNA, 25 bp, Mus musculus
aatcccactactccggaggccaagg

SEQ ID NO: 76738 - DNA, 25 bp, Mus musculus
aatcccactactgcggaggccaagg

SEQ ID NO: 76739 - DNA, 25 bp, Mus musculus
aatcccactcctattggacagatta

SEQ ID NO: 76740 - DNA, 25 bp, Mus musculus
aatcccactccttttggacagatta

SEQ ID NO: 76741 - DNA, 25 bp, Mus musculus
aatcccactgctatggatagcacag

SEQ ID NO: 76742 - DNA, 25 bp, Mus musculus
aatcccactgctttggatagcacag

SEQ ID NO: 76743 - DNA, 25 bp, Mus musculus
aatcccactgtgctcaagcatttgt

SEQ ID NO: 76744 - DNA, 25 bp, Mus musculus
aatcccactgtggtcaagcatttgt

SEQ ID NO: 76745 - DNA, 25 bp, Mus musculus
aatcccagaactacaggcaccaagg

SEQ ID NO: 76746 - DNA, 25 bp, Mus musculus
aatcccagaacttcaggcaccaagg

SEQ ID NO: 76747 - DNA, 25 bp, Mus musculus
aatcccagaccaatggtggcaccag

SEQ ID NO: 76748 - DNA, 25 bp, Mus musculus
aatcccagaccattggtggcaccag

SEQ ID NO: 76749 - DNA, 25 bp, Mus musculus
aatcccagagatattcagtgtgcca

SEQ ID NO: 76750 - DNA, 25 bp, Mus musculus
aatcccagagattttcagtgtgcca

SEQ ID NO: 76751 - DNA, 25 bp, Mus musculus
aatcccagagccaggtcatgatgcc

SEQ ID NO: 76752 - DNA, 25 bp, Mus musculus
aatcccagagcctggtcatgatgcc

SEQ ID NO: 76753 - DNA, 25 bp, Mus musculus
aatcccagaggcaggcttggatcca

SEQ ID NO: 76754 - DNA, 25 bp, Mus musculus
aatcccagaggctggcttggatcca

SEQ ID NO: 76755 - DNA, 25 bp, Mus musculus
aatcccagatctcctccactgagat

SEQ ID NO: 76756 - DNA, 25 bp, Mus musculus
aatcccagatctgctccactgagat

SEQ ID NO: 76757 - DNA, 25 bp, Mus musculus
aatcccagcaagagaccgtggctca

SEQ ID NO: 76758 - DNA, 25 bp, Mus musculus
aatcccagcaagtgaccgtggctca

SEQ ID NO: 76759 - DNA, 25 bp, Mus musculus
aatcccagcaccacctaagaaggtg

SEQ ID NO: 76760 - DNA, 25 bp, Mus musculus
aatcccagcacctcctaagaaggtg

SEQ ID NO: 76761 - DNA, 25 bp, Mus musculus
aatcccagcagtcctgttttgacag

SEQ ID NO: 76762 - DNA, 25 bp, Mus musculus
aatcccagcagtgctgttttgacag

SEQ ID NO: 76763 - DNA, 25 bp, Mus musculus
aatcccagcatgatggagggtccat

SEQ ID NO: 76764 - DNA, 25 bp, Mus musculus
aatcccagcatgttggagggtccat

SEQ ID NO: 76765 - DNA, 25 bp, Mus musculus
aatcccagcattaggtatacatggt

SEQ ID NO: 76766 - DNA, 25 bp, Mus musculus
aatcccagcattctgtaatagaaga

SEQ ID NO: 76767 - DNA, 25 bp, Mus musculus
aatcccagcattgtgtaatagaaga

SEQ ID NO: 76768 - DNA, 25 bp, Mus musculus
aatcccagcatttggtatacatggt

SEQ ID NO: 76769 - DNA, 25 bp, Mus musculus
aatcccagcgacctcacgagtatgg

SEQ ID NO: 76770 - DNA, 25 bp, Mus musculus
aatcccagcgacgtcacgagtatgg

SEQ ID NO: 76771 - DNA, 25 bp, Mus musculus
aatcccagcgttcaggagattaaag

SEQ ID NO: 76772 - DNA, 25 bp, Mus musculus
aatcccagcgttgaggagattaaag

SEQ ID NO: 76773 - DNA, 25 bp, Mus musculus
aatcccagctaaacattttcttcat

SEQ ID NO: 76774 - DNA, 25 bp, Mus musculus
aatcccagctaatcattttcttcat

SEQ ID NO: 76775 - DNA, 25 bp, Mus musculus
aatcccaggagaagcaatgccctct

SEQ ID NO: 76776 - DNA, 25 bp, Mus musculus
aatcccaggagatgcaatgccctct

SEQ ID NO: 76777 - DNA, 25 bp, Mus musculus
aatcccaggcatatttatatactca

SEQ ID NO: 76778 - DNA, 25 bp, Mus musculus
aatcccaggcatttttatatactca

SEQ ID NO: 76779 - DNA, 25 bp, Mus musculus
aatcccaggcccacctgcaattata

SEQ ID NO: 76780 - DNA, 25 bp, Mus musculus
aatcccaggccctcctgcaattata

SEQ ID NO: 76781 - DNA, 25 bp, Mus musculus
aatcccaggcctcagaaggcaacat

SEQ ID NO: 76782 - DNA, 25 bp, Mus musculus
aatcccaggcctgagaaggcaacat

SEQ ID NO: 76783 - DNA, 25 bp, Mus musculus
aatcccagggagagggcctgaccaa

SEQ ID NO: 76784 - DNA, 25 bp, Mus musculus
aatcccagggagtgggcctgaccaa

SEQ ID NO: 76785 - DNA, 25 bp, Mus musculus
aatcccagggatcttagactgcttt

SEQ ID NO: 76786 - DNA, 25 bp, Mus musculus
aatcccagggatgttagactgcttt

SEQ ID NO: 76787 - DNA, 25 bp, Mus musculus
aatcccagggcaatcagcagttcaa

SEQ ID NO: 76788 - DNA, 25 bp, Mus musculus
aatcccagggcattcagcagttcaa

SEQ ID NO: 76789 - DNA, 25 bp, Mus musculus
aatcccaggtggaccctgagtggaa

SEQ ID NO: 76790 - DNA, 25 bp, Mus musculus
aatcccaggtggtccctgagtggaa

SEQ ID NO: 76791 - DNA, 25 bp, Mus musculus
aatcccaggtgtcagcgagcttctg

SEQ ID NO: 76792 - DNA, 25 bp, Mus musculus
aatcccaggtgtgagcgagcttctg

SEQ ID NO: 76793 - DNA, 25 bp, Mus musculus
aatcccagtcagaattcagaggcag

SEQ ID NO: 76794 - DNA, 25 bp, Mus musculus
aatcccagtcagtattcagaggcag

SEQ ID NO: 76795 - DNA, 25 bp, Mus musculus
aatcccagtcctaagaagctaccat

SEQ ID NO: 76796 - DNA, 25 bp, Mus musculus
aatcccagtccttagaagctaccat

SEQ ID NO: 76797 - DNA, 25 bp, Mus musculus
aatcccagtgcaccgcggagtcaag

SEQ ID NO: 76798 - DNA, 25 bp, Mus musculus
aatcccagtgcagcgcggagtcaag

SEQ ID NO: 76799 - DNA, 25 bp, Mus musculus
aatcccagtgcgaagaaggcaaagg

SEQ ID NO: 76800 - DNA, 25 bp, Mus musculus
aatcccagtgcgtagaaggcaaagg

SEQ ID NO: 76801 - DNA, 25 bp, Mus musculus
aatcccagtggaagataagaggcct

SEQ ID NO: 76802 - DNA, 25 bp, Mus musculus
aatcccagtggatgataagaggcct

SEQ ID NO: 76803 - DNA, 25 bp, Mus musculus
aatcccagtggcctgcacttgtaca

SEQ ID NO: 76804 - DNA, 25 bp, Mus musculus
aatcccagtggcctgtaccatatta

SEQ ID NO: 76805 - DNA, 25 bp, Mus musculus
aatcccagtggcgtgcacttgtaca

SEQ ID NO: 76806 - DNA, 25 bp, Mus musculus
aatcccagtggcgtgtaccatatta

SEQ ID NO: 76807 - DNA, 25 bp, Mus musculus
aatcccagtgtgaggaaggtaaagt

SEQ ID NO: 76808 - DNA, 25 bp, Mus musculus
aatcccagtgtgtggaaggtaaagt

SEQ ID NO: 76809 - DNA, 25 bp, Mus musculus
aatcccagtgttctaggtagccttt

SEQ ID NO: 76810 - DNA, 25 bp, Mus musculus
aatcccagtgttgtaggtagccttt

SEQ ID NO: 76811 - DNA, 25 bp, Mus musculus
aatcccagtttaaagctctcaattg

SEQ ID NO: 76812 - DNA, 25 bp, Mus musculus
aatcccagtttaatctgagttcaag

SEQ ID NO: 76813 - DNA, 25 bp, Mus musculus
aatcccagtttatagctctcaattg

SEQ ID NO: 76814 - DNA, 25 bp, Mus musculus
aatcccagtttattctgagttcaag

SEQ ID NO: 76815 - DNA, 25 bp, Mus musculus
aatcccagtttgattgtgtactaat

SEQ ID NO: 76816 - DNA, 25 bp, Mus musculus
aatcccagtttgtttgtgtactaat

SEQ ID NO: 76817 - DNA, 25 bp, Mus musculus
aatcccataacccatcaatgctgtt

SEQ ID NO: 76818 - DNA, 25 bp, Mus musculus
aatcccataaccgatcaatgctgtt

SEQ ID NO: 76819 - DNA, 25 bp, Mus musculus
aatcccataatcacctaagctcaaa

SEQ ID NO: 76820 - DNA, 25 bp, Mus musculus
aatcccataatctcctaagctcaaa

SEQ ID NO: 76821 - DNA, 25 bp, Mus musculus
aatcccataatgaatagcaattacg

SEQ ID NO: 76822 - DNA, 25 bp, Mus musculus
aatcccataatgtatagcaattacg

SEQ ID NO: 76823 - DNA, 25 bp, Mus musculus
aatcccatacatcactggtggtcgg

SEQ ID NO: 76824 - DNA, 25 bp, Mus musculus
aatcccatacatgactggtggtcgg

SEQ ID NO: 76825 - DNA, 25 bp, Mus musculus
aatcccatagccagatcactgttgt

SEQ ID NO: 76826 - DNA, 25 bp, Mus musculus
aatcccatagcctgatcactgttgt

SEQ ID NO: 76827 - DNA, 25 bp, Mus musculus
aatcccatcaagctttctgtagact

SEQ ID NO: 76828 - DNA, 25 bp, Mus musculus
aatcccatcaaggtttctgtagact

SEQ ID NO: 76829 - DNA, 25 bp, Mus musculus
aatcccatcaatagcttcatcaggt

SEQ ID NO: 76830 - DNA, 25 bp, Mus musculus
aatcccatcaattgcttcatcaggt

SEQ ID NO: 76831 - DNA, 25 bp, Mus musculus
aatcccatcatcaacggtgctaaga

SEQ ID NO: 76832 - DNA, 25 bp, Mus musculus
aatcccatcatctacggtgctaaga

SEQ ID NO: 76833 - DNA, 25 bp, Mus musculus
aatcccatccagagaacacttgtcc

SEQ ID NO: 76834 - DNA, 25 bp, Mus musculus
aatcccatccagtgaacacttgtcc

SEQ ID NO: 76835 - DNA, 25 bp, Mus musculus
aatcccatccatacttcagggtaat

SEQ ID NO: 76836 - DNA, 25 bp, Mus musculus
aatcccatccattcttcagggtaat

SEQ ID NO: 76837 - DNA, 25 bp, Mus musculus
aatcccatcgttacatggctaaccc

SEQ ID NO: 76838 - DNA, 25 bp, Mus musculus
aatcccatcgtttcatggctaaccc

SEQ ID NO: 76839 - DNA, 25 bp, Mus musculus
aatcccatcttcatgcgcaaggaca

SEQ ID NO: 76840 - DNA, 25 bp, Mus musculus
aatcccatcttcttgcgcaaggaca

SEQ ID NO: 76841 - DNA, 25 bp, Mus musculus
aatcccatgccaactatcaagtcat

SEQ ID NO: 76842 - DNA, 25 bp, Mus musculus
aatcccatgccatctatcaagtcat

SEQ ID NO: 76843 - DNA, 25 bp, Mus musculus
aatcccatggatctcggaacgatca

SEQ ID NO: 76844 - DNA, 25 bp, Mus musculus
aatcccatggatgtcggaacgatca

SEQ ID NO: 76845 - DNA, 25 bp, Mus musculus
aatcccatggcaccagtggactgtg

SEQ ID NO: 76846 - DNA, 25 bp, Mus musculus
aatcccatggcagcagtggactgtg

SEQ ID NO: 76847 - DNA, 25 bp, Mus musculus
aatcccatggctactgcagtgtgtg

SEQ ID NO: 76848 - DNA, 25 bp, Mus musculus
aatcccatggcttctgcagtgtgtg

SEQ ID NO: 76849 - DNA, 25 bp, Mus musculus
aatcccatgtccagtttaacttcaa

SEQ ID NO: 76850 - DNA, 25 bp, Mus musculus
aatcccatgtcctgtttaacttcaa

SEQ ID NO: 76851 - DNA, 25 bp, Mus musculus
aatcccattagtccgtttgataaag

SEQ ID NO: 76852 - DNA, 25 bp, Mus musculus
aatcccattagtgcgtttgataaag

SEQ ID NO: 76853 - DNA, 25 bp, Mus musculus
aatcccattctcaatatgctctgta

SEQ ID NO: 76854 - DNA, 25 bp, Mus musculus
aatcccattctctatatgctctgta

SEQ ID NO: 76855 - DNA, 25 bp, Mus musculus
aatcccattgtgcttagcctcaatt

SEQ ID NO: 76856 - DNA, 25 bp, Mus musculus
aatcccattgtggttagcctcaatt

SEQ ID NO: 76857 - DNA, 25 bp, Mus musculus
aatcccatttctataagatgtctgg

SEQ ID NO: 76858 - DNA, 25 bp, Mus musculus
aatcccatttctttaagatgtctgg

SEQ ID NO: 76859 - DNA, 25 bp, Mus musculus
aatcccattttaagtgacttctcag

SEQ ID NO: 76860 - DNA, 25 bp, Mus musculus
aatcccattttatgtgacttctcag

SEQ ID NO: 76861 - DNA, 25 bp, Mus musculus
aatcccattttgagctgagagccca

SEQ ID NO: 76862 - DNA, 25 bp, Mus musculus
aatcccattttgtgctgagagccca

SEQ ID NO: 76863 - DNA, 25 bp, Mus musculus
aatccccaaagcactctcctggtgt

SEQ ID NO: 76864 - DNA, 25 bp, Mus musculus
aatccccaaagctctctcctggtgt

SEQ ID NO: 76865 - DNA, 25 bp, Mus musculus
aatccccaaggtatctcttgcaggt

SEQ ID NO: 76866 - DNA, 25 bp, Mus musculus
aatccccaaggtttctcttgcaggt

SEQ ID NO: 76867 - DNA, 25 bp, Mus musculus
aatccccacaaacaccatggcttga

SEQ ID NO: 76868 - DNA, 25 bp, Mus musculus
aatccccacaaagaccatggcttga

SEQ ID NO: 76869 - DNA, 25 bp, Mus musculus
aatccccacctgactcctgtgtgtc

SEQ ID NO: 76870 - DNA, 25 bp, Mus musculus
aatccccacctgtctcctgtgtgtc

SEQ ID NO: 76871 - DNA, 25 bp, Mus musculus
aatccccagaagaatcagggccgcc

SEQ ID NO: 76872 - DNA, 25 bp, Mus musculus
aatccccagaagtatcagggccgcc

SEQ ID NO: 76873 - DNA, 25 bp, Mus musculus
aatccccataccaagaattgtgttg

SEQ ID NO: 76874 - DNA, 25 bp, Mus musculus
aatccccatacctagaattgtgttg

SEQ ID NO: 76875 - DNA, 25 bp, Mus musculus
aatccccatatactcatcctaaaat

SEQ ID NO: 76876 - DNA, 25 bp, Mus musculus
aatccccatatagtcatcctaaaat

SEQ ID NO: 76877 - DNA, 25 bp, Mus musculus
aatccccattctaccatctttgatg

SEQ ID NO: 76878 - DNA, 25 bp, Mus musculus
aatccccattcttccatctttgatg

SEQ ID NO: 76879 - DNA, 25 bp, Mus musculus
aatcccctatatagctatttatcca

SEQ ID NO: 76880 - DNA, 25 bp, Mus musculus
aatcccctatattgctatttatcca

SEQ ID NO: 76881 - DNA, 25 bp, Mus musculus
aatcccctcattatgtgcatttact

SEQ ID NO: 76882 - DNA, 25 bp, Mus musculus
aatcccctcattttgtgcatttact

SEQ ID NO: 76883 - DNA, 25 bp, Mus musculus
aatcccctcggtaactcctgaagag

SEQ ID NO: 76884 - DNA, 25 bp, Mus musculus
aatcccctcggttactcctgaagag

SEQ ID NO: 76885 - DNA, 25 bp, Mus musculus
aatcccctctagactgcatatggaa

SEQ ID NO: 76886 - DNA, 25 bp, Mus musculus
aatcccctctagtctgcatatggaa

SEQ ID NO: 76887 - DNA, 25 bp, Mus musculus
aatcccctctgtatgttcaaataag

SEQ ID NO: 76888 - DNA, 25 bp, Mus musculus
aatcccctctgtttgttcaaataag

SEQ ID NO: 76889 - DNA, 25 bp, Mus musculus
aatcccctgacccagctggaagagg

SEQ ID NO: 76890 - DNA, 25 bp, Mus musculus
aatcccctgaccgagctggaagagg

SEQ ID NO: 76891 - DNA, 25 bp, Mus musculus
aatcccctgagccacacaaaaagtg

SEQ ID NO: 76892 - DNA, 25 bp, Mus musculus
aatcccctgagcgacacaaaaagtg

SEQ ID NO: 76893 - DNA, 25 bp, Mus musculus
aatcccctggatctgcacaatctga

SEQ ID NO: 76894 - DNA, 25 bp, Mus musculus
aatcccctggatgtgcacaatctga

SEQ ID NO: 76895 - DNA, 25 bp, Mus musculus
aatcccctgtccactcagagtatgt

SEQ ID NO: 76896 - DNA, 25 bp, Mus musculus
aatcccctgtcctctcagagtatgt

SEQ ID NO: 76897 - DNA, 25 bp, Mus musculus
aatccccttcgtcgatctctgagaa

SEQ ID NO: 76898 - DNA, 25 bp, Mus musculus
aatccccttcgtggatctctgagaa

SEQ ID NO: 76899 - DNA, 25 bp, Mus musculus
aatccccttctgaaaaccagtcctg

SEQ ID NO: 76900 - DNA, 25 bp, Mus musculus
aatccccttctgtaaaccagtcctg

SEQ ID NO: 76901 - DNA, 25 bp, Mus musculus
aatccccttgtcagtctgagtacag

SEQ ID NO: 76902 - DNA, 25 bp, Mus musculus
aatccccttgtctgtctgagtacag

SEQ ID NO: 76903 - DNA, 25 bp, Mus musculus
aatcccgacgtcagttgctgtttgt

SEQ ID NO: 76904 - DNA, 25 bp, Mus musculus
aatcccgacgtctgttgctgtttgt

SEQ ID NO: 76905 - DNA, 25 bp, Mus musculus
aatcccgaggccctgtgagccgtgc

SEQ ID NO: 76906 - DNA, 25 bp, Mus musculus
aatcccgaggccgtgtgagccgtgc

SEQ ID NO: 76907 - DNA, 25 bp, Mus musculus
aatcccgagggaagtctcaatccaa

SEQ ID NO: 76908 - DNA, 25 bp, Mus musculus
aatcccgagggatgtctcaatccaa

SEQ ID NO: 76909 - DNA, 25 bp, Mus musculus
aatcccgagggccacaaccactggg

SEQ ID NO: 76910 - DNA, 25 bp, Mus musculus
aatcccgagggcgacaaccactggg

SEQ ID NO: 76911 - DNA, 25 bp, Mus musculus
aatcccgatgttacgacttcttgaa

SEQ ID NO: 76912 - DNA, 25 bp, Mus musculus
aatcccgatgtttcgacttcttgaa

SEQ ID NO: 76913 - DNA, 25 bp, Mus musculus
aatcccggagggaaactgtgaatgc

SEQ ID NO: 76914 - DNA, 25 bp, Mus musculus
aatcccggagggtaactgtgaatgc

SEQ ID NO: 76915 - DNA, 25 bp, Mus musculus
aatcccggtggaagcttcaatcagt

SEQ ID NO: 76916 - DNA, 25 bp, Mus musculus
aatcccggtggatgcttcaatcagt

SEQ ID NO: 76917 - DNA, 25 bp, Mus musculus
aatcccgtagatccacttattgaat

SEQ ID NO: 76918 - DNA, 25 bp, Mus musculus
aatcccgtagatgcacttattgaat

SEQ ID NO: 76919 - DNA, 25 bp, Mus musculus
aatcccgtgtctctttgcagccagg

SEQ ID NO: 76920 - DNA, 25 bp, Mus musculus
aatcccgtgtctgtttgcagccagg

SEQ ID NO: 76921 - DNA, 25 bp, Mus musculus
aatcccgtgttcatgtccagtaatc

SEQ ID NO: 76922 - DNA, 25 bp, Mus musculus
aatcccgtgttcttgtccagtaatc

SEQ ID NO: 76923 - DNA, 25 bp, Mus musculus
aatcccgtttcaagtcttcatgttg

SEQ ID NO: 76924 - DNA, 25 bp, Mus musculus
aatcccgtttcatgtcttcatgttg

SEQ ID NO: 76925 - DNA, 25 bp, Mus musculus
aatccctaactgcagtactatagta

SEQ ID NO: 76926 - DNA, 25 bp, Mus musculus
aatccctaactggagtactatagta

SEQ ID NO: 76927 - DNA, 25 bp, Mus musculus
aatccctaagataaactgtgtgttt

SEQ ID NO: 76928 - DNA, 25 bp, Mus musculus
aatccctaagattaactgtgtgttt

SEQ ID NO: 76929 - DNA, 25 bp, Mus musculus
aatccctaagtgcctcaactgccct

SEQ ID NO: 76930 - DNA, 25 bp, Mus musculus
aatccctaagtggctcaactgccct

SEQ ID NO: 76931 - DNA, 25 bp, Mus musculus
aatccctaattaccagtgacagcag

SEQ ID NO: 76932 - DNA, 25 bp, Mus musculus
aatccctaattagcagtgacagcag

SEQ ID NO: 76933 - DNA, 25 bp, Mus musculus
aatccctaatttactgccggtgtat

SEQ ID NO: 76934 - DNA, 25 bp, Mus musculus
aatccctaattttctgccggtgtat

SEQ ID NO: 76935 - DNA, 25 bp, Mus musculus
aatccctacactatcataaccttga

SEQ ID NO: 76936 - DNA, 25 bp, Mus musculus
aatccctacactttcataaccttga

SEQ ID NO: 76937 - DNA, 25 bp, Mus musculus
aatccctagaatccagtccttatgt

SEQ ID NO: 76938 - DNA, 25 bp, Mus musculus
aatccctagaatgcagtccttatgt

SEQ ID NO: 76939 - DNA, 25 bp, Mus musculus
aatccctagattatagaactgtatg

SEQ ID NO: 76940 - DNA, 25 bp, Mus musculus
aatccctagattttagaactgtatg

SEQ ID NO: 76941 - DNA, 25 bp, Mus musculus
aatccctagctcacactgacaatgt

SEQ ID NO: 76942 - DNA, 25 bp, Mus musculus
aatccctagctctcactgacaatgt

SEQ ID NO: 76943 - DNA, 25 bp, Mus musculus
aatccctaggtgattcctgcagtga

SEQ ID NO: 76944 - DNA, 25 bp, Mus musculus
aatccctaggtgtttcctgcagtga

SEQ ID NO: 76945 - DNA, 25 bp, Mus musculus
aatccctagtcaagatcttgcaacc

SEQ ID NO: 76946 - DNA, 25 bp, Mus musculus
aatccctagtcatgatcttgcaacc

SEQ ID NO: 76947 - DNA, 25 bp, Mus musculus
aatccctataccagcaattaaaatg

SEQ ID NO: 76948 - DNA, 25 bp, Mus musculus
aatccctatacctgcaattaaaatg

SEQ ID NO: 76949 - DNA, 25 bp, Mus musculus
aatccctcagacacccagagtttgc

SEQ ID NO: 76950 - DNA, 25 bp, Mus musculus
aatccctcagactcccagagtttgc

SEQ ID NO: 76951 - DNA, 25 bp, Mus musculus
aatccctcattgaccgggactacat

SEQ ID NO: 76952 - DNA, 25 bp, Mus musculus
aatccctcattgtccgggactacat

SEQ ID NO: 76953 - DNA, 25 bp, Mus musculus
aatccctccgagaaatggtggaact

SEQ ID NO: 76954 - DNA, 25 bp, Mus musculus
aatccctccgagtaatggtggaact

SEQ ID NO: 76955 - DNA, 25 bp, Mus musculus
aatccctctatcacactgtctagtc

SEQ ID NO: 76956 - DNA, 25 bp, Mus musculus
aatccctctatctcactgtctagtc

SEQ ID NO: 76957 - DNA, 25 bp, Mus musculus
aatccctctgagacctccaagtctt

SEQ ID NO: 76958 - DNA, 25 bp, Mus musculus
aatccctctgagtcctccaagtctt

SEQ ID NO: 76959 - DNA, 25 bp, Mus musculus
aatccctctgatactgatactggct

SEQ ID NO: 76960 - DNA, 25 bp, Mus musculus
aatccctctgattctgatactggct

SEQ ID NO: 76961 - DNA, 25 bp, Mus musculus
aatccctctgccactagaaatagca

SEQ ID NO: 76962 - DNA, 25 bp, Mus musculus
aatccctctgcctctagaaatagca

SEQ ID NO: 76963 - DNA, 25 bp, Mus musculus
aatccctgagtaattagttccttat

SEQ ID NO: 76964 - DNA, 25 bp, Mus musculus
aatccctgagtatttagttccttat

SEQ ID NO: 76965 - DNA, 25 bp, Mus musculus
aatccctgattcagcttctgtaaag

SEQ ID NO: 76966 - DNA, 25 bp, Mus musculus
aatccctgattctgcttctgtaaag

SEQ ID NO: 76967 - DNA, 25 bp, Mus musculus
aatccctgcagacactgtatttttc

SEQ ID NO: 76968 - DNA, 25 bp, Mus musculus
aatccctgcagagactgtatttttc

SEQ ID NO: 76969 - DNA, 25 bp, Mus musculus
aatccctgccatcacaaaatcaaca

SEQ ID NO: 76970 - DNA, 25 bp, Mus musculus
aatccctgccatgacaaaatcaaca

SEQ ID NO: 76971 - DNA, 25 bp, Mus musculus
aatccctgcccacctacaaaaatat

SEQ ID NO: 76972 - DNA, 25 bp, Mus musculus
aatccctgcccagctacaaaaatat

SEQ ID NO: 76973 - DNA, 25 bp, Mus musculus
aatccctgccccattcaataaataa

SEQ ID NO: 76974 - DNA, 25 bp, Mus musculus
aatccctgcccctttcaataaataa

SEQ ID NO: 76975 - DNA, 25 bp, Mus musculus
aatccctgcgatcccaacttgagga

SEQ ID NO: 76976 - DNA, 25 bp, Mus musculus
aatccctgcgatgccaacttgagga

SEQ ID NO: 76977 - DNA, 25 bp, Mus musculus
aatccctgcttcagcttgaggtgga

SEQ ID NO: 76978 - DNA, 25 bp, Mus musculus
aatccctgcttctgcttgaggtgga

SEQ ID NO: 76979 - DNA, 25 bp, Mus musculus
aatccctggaccagtctacctgagg

SEQ ID NO: 76980 - DNA, 25 bp, Mus musculus
aatccctggacctgtctacctgagg

SEQ ID NO: 76981 - DNA, 25 bp, Mus musculus
aatccctggatcctgtaggccctgg

SEQ ID NO: 76982 - DNA, 25 bp, Mus musculus
aatccctggatcgtgtaggccctgg

SEQ ID NO: 76983 - DNA, 25 bp, Mus musculus
aatccctgggacatcaagtctctca

SEQ ID NO: 76984 - DNA, 25 bp, Mus musculus
aatccctgggacttcaagtctctca

SEQ ID NO: 76985 - DNA, 25 bp, Mus musculus
aatccctgggcaatcttgtgctcta

SEQ ID NO: 76986 - DNA, 25 bp, Mus musculus
aatccctgggcattcttgtgctcta

SEQ ID NO: 76987 - DNA, 25 bp, Mus musculus
aatccctggtggaggagcaatcacc

SEQ ID NO: 76988 - DNA, 25 bp, Mus musculus
aatccctggtggtggagcaatcacc

SEQ ID NO: 76989 - DNA, 25 bp, Mus musculus
aatccctgtaagatccaaactccat

SEQ ID NO: 76990 - DNA, 25 bp, Mus musculus
aatccctgtaagttccaaactccat

SEQ ID NO: 76991 - DNA, 25 bp, Mus musculus
aatccctgtcaaagtgagccccagt

SEQ ID NO: 76992 - DNA, 25 bp, Mus musculus
aatccctgtcaatgtgagccccagt

SEQ ID NO: 76993 - DNA, 25 bp, Mus musculus
aatccctgtgcccaataaaactttg

SEQ ID NO: 76994 - DNA, 25 bp, Mus musculus
aatccctgtgccgaataaaactttg

SEQ ID NO: 76995 - DNA, 25 bp, Mus musculus
aatccctgtgtgatctgcgagttca

SEQ ID NO: 76996 - DNA, 25 bp, Mus musculus
aatccctgtgtgttctgcgagttca

SEQ ID NO: 76997 - DNA, 25 bp, Mus musculus
aatccctgtttgagtaggcgctggc

SEQ ID NO: 76998 - DNA, 25 bp, Mus musculus
aatccctgtttgtgtaggcgctggc

SEQ ID NO: 76999 - DNA, 25 bp, Mus musculus
aatcccttaattatctctaaacaat

SEQ ID NO: 77000 - DNA, 25 bp, Mus musculus
aatcccttaattttctctaaacaat

SEQ ID NO: 77001 - DNA, 25 bp, Mus musculus
aatcccttagagactggagcctgta

SEQ ID NO: 77002 - DNA, 25 bp, Mus musculus
aatcccttagagtctggagcctgta

SEQ ID NO: 77003 - DNA, 25 bp, Mus musculus
aatcccttcctcagagggtctgtgg

SEQ ID NO: 77004 - DNA, 25 bp, Mus musculus
aatcccttcctctgagggtctgtgg

SEQ ID NO: 77005 - DNA, 25 bp, Mus musculus
aatcccttcctgacaggtctgggtg

SEQ ID NO: 77006 - DNA, 25 bp, Mus musculus
aatcccttcctgtcaggtctgggtg

SEQ ID NO: 77007 - DNA, 25 bp, Mus musculus
aatcccttcgagaacgactatgaaa

SEQ ID NO: 77008 - DNA, 25 bp, Mus musculus
aatcccttcgagtacgactatgaaa

SEQ ID NO: 77009 - DNA, 25 bp, Mus musculus
aatcccttgacaactactacctctt

SEQ ID NO: 77010 - DNA, 25 bp, Mus musculus
aatcccttgacatctactacctctt

SEQ ID NO: 77011 - DNA, 25 bp, Mus musculus
aatcccttgctaacagaatgctcca

SEQ ID NO: 77012 - DNA, 25 bp, Mus musculus
aatcccttgctatcagaatgctcca

SEQ ID NO: 77013 - DNA, 25 bp, Mus musculus
aatcccttgctgatcctacagagta

SEQ ID NO: 77014 - DNA, 25 bp, Mus musculus
aatcccttgctgttcctacagagta

SEQ ID NO: 77015 - DNA, 25 bp, Mus musculus
aatccctttactcaagtctcagctt

SEQ ID NO: 77016 - DNA, 25 bp, Mus musculus
aatccctttactgaagtctcagctt

SEQ ID NO: 77017 - DNA, 25 bp, Mus musculus
aatccctttctgatagaggcggagt

SEQ ID NO: 77018 - DNA, 25 bp, Mus musculus
aatccctttctgttagaggcggagt

SEQ ID NO: 77019 - DNA, 25 bp, Mus musculus
aatccctttgctcgaatctcggatg

SEQ ID NO: 77020 - DNA, 25 bp, Mus musculus
aatccctttgctggaatctcggatg

SEQ ID NO: 77021 - DNA, 25 bp, Mus musculus
aatccgaagtcgcagccgtagccgg

SEQ ID NO: 77022 - DNA, 25 bp, Mus musculus
aatccgaagtcggagccgtagccgg

SEQ ID NO: 77023 - DNA, 25 bp, Mus musculus
aatccgacctgcagtaggaatcaat

SEQ ID NO: 77024 - DNA, 25 bp, Mus musculus
aatccgacctgctgtaggaatcaat

SEQ ID NO: 77025 - DNA, 25 bp, Mus musculus
aatccgacgtgcacccagttgggca

SEQ ID NO: 77026 - DNA, 25 bp, Mus musculus
aatccgacgtgctcccagttgggca

SEQ ID NO: 77027 - DNA, 25 bp, Mus musculus
aatccgagccatcttgttggcagat

SEQ ID NO: 77028 - DNA, 25 bp, Mus musculus
aatccgagccatgttgttggcagat

SEQ ID NO: 77029 - DNA, 25 bp, Mus musculus
aatccgaggatcctacaatctgcag

SEQ ID NO: 77030 - DNA, 25 bp, Mus musculus
aatccgaggatcgtacaatctgcag

SEQ ID NO: 77031 - DNA, 25 bp, Mus musculus
aatccgagggctactgactccagaa

SEQ ID NO: 77032 - DNA, 25 bp, Mus musculus
aatccgagggcttctgactccagaa

SEQ ID NO: 77033 - DNA, 25 bp, Mus musculus
aatccgagtgagactgttcgccgat

SEQ ID NO: 77034 - DNA, 25 bp, Mus musculus
aatccgagtgagtctgttcgccgat

SEQ ID NO: 77035 - DNA, 25 bp, Mus musculus
aatccgataaccaggctgatagctt

SEQ ID NO: 77036 - DNA, 25 bp, Mus musculus
aatccgataacctggctgatagctt

SEQ ID NO: 77037 - DNA, 25 bp, Mus musculus
aatccgatctccactccggagcaga

SEQ ID NO: 77038 - DNA, 25 bp, Mus musculus
aatccgatctcctctccggagcaga

SEQ ID NO: 77039 - DNA, 25 bp, Mus musculus
aatccgatgatgcatctcttggagc

SEQ ID NO: 77040 - DNA, 25 bp, Mus musculus
aatccgatgatggatctcttggagc

SEQ ID NO: 77041 - DNA, 25 bp, Mus musculus
aatccgattgaaaaggcagtaccac

SEQ ID NO: 77042 - DNA, 25 bp, Mus musculus
aatccgattgaataggcagtaccac

SEQ ID NO: 77043 - DNA, 25 bp, Mus musculus
aatccgcaacctcaggaagtccttc

SEQ ID NO: 77044 - DNA, 25 bp, Mus musculus
aatccgcaacctgaggaagtccttc

SEQ ID NO: 77045 - DNA, 25 bp, Mus musculus
aatccgcatattatgaagtctttga

SEQ ID NO: 77046 - DNA, 25 bp, Mus musculus
aatccgcatattttgaagtctttga

SEQ ID NO: 77047 - DNA, 25 bp, Mus musculus
aatccgcgtcgactgtaaggcgtat

SEQ ID NO: 77048 - DNA, 25 bp, Mus musculus
aatccgcgtcgagtgtaaggcgtat

SEQ ID NO: 77049 - DNA, 25 bp, Mus musculus
aatccgcgtttgacagtgcgggtat

SEQ ID NO: 77050 - DNA, 25 bp, Mus musculus
aatccgcgtttgtcagtgcgggtat

SEQ ID NO: 77051 - DNA, 25 bp, Mus musculus
aatccgctcaggacctagtactgga

SEQ ID NO: 77052 - DNA, 25 bp, Mus musculus
aatccgctcaggtcctagtactgga

SEQ ID NO: 77053 - DNA, 25 bp, Mus musculus
aatccgctcctgatgcagagcaatt

SEQ ID NO: 77054 - DNA, 25 bp, Mus musculus
aatccgctcctgttgcagagcaatt

SEQ ID NO: 77055 - DNA, 25 bp, Mus musculus
aatccgctgcctcgtataagaaaca

SEQ ID NO: 77056 - DNA, 25 bp, Mus musculus
aatccgctgcctggtataagaaaca

SEQ ID NO: 77057 - DNA, 25 bp, Mus musculus
aatccggactctctgtactgagtac

SEQ ID NO: 77058 - DNA, 25 bp, Mus musculus
aatccggactctgtgtactgagtac

SEQ ID NO: 77059 - DNA, 25 bp, Mus musculus
aatccggacttcatactacactgga

SEQ ID NO: 77060 - DNA, 25 bp, Mus musculus
aatccggacttcttactacactgga

SEQ ID NO: 77061 - DNA, 25 bp, Mus musculus
aatccggagacacttcattgagttc

SEQ ID NO: 77062 - DNA, 25 bp, Mus musculus
aatccggagacagttcattgagttc

SEQ ID NO: 77063 - DNA, 25 bp, Mus musculus
aatccggaggctcaatctcatgtgt

SEQ ID NO: 77064 - DNA, 25 bp, Mus musculus
aatccggaggctgaatctcatgtgt

SEQ ID NO: 77065 - DNA, 25 bp, Mus musculus
aatccggattataacagcactttgc

SEQ ID NO: 77066 - DNA, 25 bp, Mus musculus
aatccggattattacagcactttgc

SEQ ID NO: 77067 - DNA, 25 bp, Mus musculus
aatccggattggcaaaacagctcag

SEQ ID NO: 77068 - DNA, 25 bp, Mus musculus
aatccggattgggaaaacagctcag

SEQ ID NO: 77069 - DNA, 25 bp, Mus musculus
aatccggccctacaaagtataatag

SEQ ID NO: 77070 - DNA, 25 bp, Mus musculus
aatccggccctagaaagtataatag

SEQ ID NO: 77071 - DNA, 25 bp, Mus musculus
aatccggcctttcatgtcttctggt

SEQ ID NO: 77072 - DNA, 25 bp, Mus musculus
aatccggcctttgatgtcttctggt

SEQ ID NO: 77073 - DNA, 25 bp, Mus musculus
aatccggcgatcactgtgccttggg

SEQ ID NO: 77074 - DNA, 25 bp, Mus musculus
aatccggcgatctctgtgccttggg

SEQ ID NO: 77075 - DNA, 25 bp, Mus musculus
aatccgggctgtcgaaaccagaact

SEQ ID NO: 77076 - DNA, 25 bp, Mus musculus
aatccgggctgtggaaaccagaact

SEQ ID NO: 77077 - DNA, 25 bp, Mus musculus
aatccgggcttgctagctcatatct

SEQ ID NO: 77078 - DNA, 25 bp, Mus musculus
aatccgggcttggtagctcatatct

SEQ ID NO: 77079 - DNA, 25 bp, Mus musculus
aatccgggtctcatgttatttgcac

SEQ ID NO: 77080 - DNA, 25 bp, Mus musculus
aatccgggtctcttgttatttgcac

SEQ ID NO: 77081 - DNA, 25 bp, Mus musculus
aatccggtgaatctggactcgggtc

SEQ ID NO: 77082 - DNA, 25 bp, Mus musculus
aatccggtgaatgtggactcgggtc

SEQ ID NO: 77083 - DNA, 25 bp, Mus musculus
aatccggtgcttaatgcctttttgg

SEQ ID NO: 77084 - DNA, 25 bp, Mus musculus
aatccggtgctttatgcctttttgg

SEQ ID NO: 77085 - DNA, 25 bp, Mus musculus
aatccgtcaagtaatccgaaaatat

SEQ ID NO: 77086 - DNA, 25 bp, Mus musculus
aatccgtcaagttatccgaaaatat

SEQ ID NO: 77087 - DNA, 25 bp, Mus musculus
aatccgtcctgcaaatggtttcctt

SEQ ID NO: 77088 - DNA, 25 bp, Mus musculus
aatccgtcctgctaatggtttcctt

SEQ ID NO: 77089 - DNA, 25 bp, Mus musculus
aatccgtgatgacatgtggcgcccc

SEQ ID NO: 77090 - DNA, 25 bp, Mus musculus
aatccgtgatgagatgtggcgcccc

SEQ ID NO: 77091 - DNA, 25 bp, Mus musculus
aatccgtgggtcaggctagaaggcc

SEQ ID NO: 77092 - DNA, 25 bp, Mus musculus
aatccgtgggtctggctagaaggcc

SEQ ID NO: 77093 - DNA, 25 bp, Mus musculus
aatccgtgtaccaacttattctcaa

SEQ ID NO: 77094 - DNA, 25 bp, Mus musculus
aatccgtgtacctacttattctcaa

SEQ ID NO: 77095 - DNA, 25 bp, Mus musculus
aatccgtgtattatgttctgtgtct

SEQ ID NO: 77096 - DNA, 25 bp, Mus musculus
aatccgtgtattttgttctgtgtct

SEQ ID NO: 77097 - DNA, 25 bp, Mus musculus
aatccgtgtgacagacacccaggac

SEQ ID NO: 77098 - DNA, 25 bp, Mus musculus
aatccgtgtgactgacacccaggac

SEQ ID NO: 77099 - DNA, 25 bp, Mus musculus
aatccgtgtgtaaatttaagaccct

SEQ ID NO: 77100 - DNA, 25 bp, Mus musculus
aatccgtgtgtatatttaagaccct

SEQ ID NO: 77101 - DNA, 25 bp, Mus musculus
aatccgtgttggcacagcaggatga

SEQ ID NO: 77102 - DNA, 25 bp, Mus musculus
aatccgtgttgggacagcaggatga

SEQ ID NO: 77103 - DNA, 25 bp, Mus musculus
aatccgttaccaaggaagcctggct

SEQ ID NO: 77104 - DNA, 25 bp, Mus musculus
aatccgttaccatggaagcctggct

SEQ ID NO: 77105 - DNA, 25 bp, Mus musculus
aatccgttccctctcttgaaaggtg

SEQ ID NO: 77106 - DNA, 25 bp, Mus musculus
aatccgttccctgtcttgaaaggtg

SEQ ID NO: 77107 - DNA, 25 bp, Mus musculus
aatccgttgctgacaccacggtgct

SEQ ID NO: 77108 - DNA, 25 bp, Mus musculus
aatccgttgctgtcaccacggtgct

SEQ ID NO: 77109 - DNA, 25 bp, Mus musculus
aatccgttgggcctgagactcgatc

SEQ ID NO: 77110 - DNA, 25 bp, Mus musculus
aatccgttgggcgtgagactcgatc

SEQ ID NO: 77111 - DNA, 25 bp, Mus musculus
aatccgtttgttcatactttcctct

SEQ ID NO: 77112 - DNA, 25 bp, Mus musculus
aatccgtttgttgatactttcctct

SEQ ID NO: 77113 - DNA, 25 bp, Mus musculus
aatccgttttgacatcagggaactg

SEQ ID NO: 77114 - DNA, 25 bp, Mus musculus
aatccgttttgagatcagggaactg

SEQ ID NO: 77115 - DNA, 25 bp, Mus musculus
aatcctaaccgtccgatggcagagt

SEQ ID NO: 77116 - DNA, 25 bp, Mus musculus
aatcctaaccgtgcgatggcagagt

SEQ ID NO: 77117 - DNA, 25 bp, Mus musculus
aatcctaagaaacgtgacttctcca

SEQ ID NO: 77118 - DNA, 25 bp, Mus musculus
aatcctaagaaaggtgacttctcca

SEQ ID NO: 77119 - DNA, 25 bp, Mus musculus
aatcctaagctgcagtctaggactt

SEQ ID NO: 77120 - DNA, 25 bp, Mus musculus
aatcctaagctggagtctaggactt

SEQ ID NO: 77121 - DNA, 25 bp, Mus musculus
aatcctaaggcacctttaaaccctg

SEQ ID NO: 77122 - DNA, 25 bp, Mus musculus
aatcctaaggcagctttaaaccctg

SEQ ID NO: 77123 - DNA, 25 bp, Mus musculus
aatcctaaggttatgttgtctctgg

SEQ ID NO: 77124 - DNA, 25 bp, Mus musculus
aatcctaaggttttgttgtctctgg

SEQ ID NO: 77125 - DNA, 25 bp, Mus musculus
aatcctaatttcatccatatttcat

SEQ ID NO: 77126 - DNA, 25 bp, Mus musculus
aatcctaatttcttccatatttcat

SEQ ID NO: 77127 - DNA, 25 bp, Mus musculus
aatcctacacatcctctttggtggc

SEQ ID NO: 77128 - DNA, 25 bp, Mus musculus
aatcctacacatgctctttggtggc

SEQ ID NO: 77129 - DNA, 25 bp, Mus musculus
aatcctacaggaatgatgacaatgc

SEQ ID NO: 77130 - DNA, 25 bp, Mus musculus
aatcctacaggattgatgacaatgc

SEQ ID NO: 77131 - DNA, 25 bp, Mus musculus
aatcctaccaatcctgactctggaa

SEQ ID NO: 77132 - DNA, 25 bp, Mus musculus
aatcctaccaatgctgactctggaa

SEQ ID NO: 77133 - DNA, 25 bp, Mus musculus
aatcctaccgagcacaggaccttat

SEQ ID NO: 77134 - DNA, 25 bp, Mus musculus
aatcctaccgaggacaggaccttat

SEQ ID NO: 77135 - DNA, 25 bp, Mus musculus
aatcctacctggagcggagcgtcaa

SEQ ID NO: 77136 - DNA, 25 bp, Mus musculus
aatcctacctggtgcggagcgtcaa

SEQ ID NO: 77137 - DNA, 25 bp, Mus musculus
aatcctacctttcttcagagcagtc

SEQ ID NO: 77138 - DNA, 25 bp, Mus musculus
aatcctacctttgttcagagcagtc

SEQ ID NO: 77139 - DNA, 25 bp, Mus musculus
aatcctagaaaaatcctatcatggg

SEQ ID NO: 77140 - DNA, 25 bp, Mus musculus
aatcctagaaaattcctatcatggg

SEQ ID NO: 77141 - DNA, 25 bp, Mus musculus
aatcctagataaagtgcagtgccca

SEQ ID NO: 77142 - DNA, 25 bp, Mus musculus
aatcctagataatgtgcagtgccca

SEQ ID NO: 77143 - DNA, 25 bp, Mus musculus
aatcctagcacactgggacaccgag

SEQ ID NO: 77144 - DNA, 25 bp, Mus musculus
aatcctagcacagtgggacaccgag

SEQ ID NO: 77145 - DNA, 25 bp, Mus musculus
aatcctagcactagacgttagggta

SEQ ID NO: 77146 - DNA, 25 bp, Mus musculus
aatcctagcacttgacgttagggta

SEQ ID NO: 77147 - DNA, 25 bp, Mus musculus
aatcctagcaggcacagacctcttt

SEQ ID NO: 77148 - DNA, 25 bp, Mus musculus
aatcctagcagggacagacctcttt

SEQ ID NO: 77149 - DNA, 25 bp, Mus musculus
aatcctagccaacaagctttggtgg

SEQ ID NO: 77150 - DNA, 25 bp, Mus musculus
aatcctagccaagaagctttggtgg

SEQ ID NO: 77151 - DNA, 25 bp, Mus musculus
aatcctagccatcaagctttgatag

SEQ ID NO: 77152 - DNA, 25 bp, Mus musculus
aatcctagccatgaagctttgatag

SEQ ID NO: 77153 - DNA, 25 bp, Mus musculus
aatcctaggagtctgcacgtgcata

SEQ ID NO: 77154 - DNA, 25 bp, Mus musculus
aatcctaggagtgtgcacgtgcata

SEQ ID NO: 77155 - DNA, 25 bp, Mus musculus
aatcctaggcatcacaggtgttgat

SEQ ID NO: 77156 - DNA, 25 bp, Mus musculus
aatcctaggcatgacaggtgttgat

SEQ ID NO: 77157 - DNA, 25 bp, Mus musculus
aatcctagtaatcagggcttttaca

SEQ ID NO: 77158 - DNA, 25 bp, Mus musculus
aatcctagtaatgagggcttttaca

SEQ ID NO: 77159 - DNA, 25 bp, Mus musculus
aatcctagtagtctgtgcttccatg

SEQ ID NO: 77160 - DNA, 25 bp, Mus musculus
aatcctagtagtgtgtgcttccatg

SEQ ID NO: 77161 - DNA, 25 bp, Mus musculus
aatcctagtcagagtcagaggtcaa

SEQ ID NO: 77162 - DNA, 25 bp, Mus musculus
aatcctagtcagatgcgtatgtaca

SEQ ID NO: 77163 - DNA, 25 bp, Mus musculus
aatcctagtcagtgtcagaggtcaa

SEQ ID NO: 77164 - DNA, 25 bp, Mus musculus
aatcctagtcagttgcgtatgtaca

SEQ ID NO: 77165 - DNA, 25 bp, Mus musculus
aatcctagttccatttgtaccatcc

SEQ ID NO: 77166 - DNA, 25 bp, Mus musculus
aatcctagttccttttgtaccatcc

SEQ ID NO: 77167 - DNA, 25 bp, Mus musculus
aatcctatagatatatcttggacca

SEQ ID NO: 77168 - DNA, 25 bp, Mus musculus
aatcctatagatttatcttggacca

SEQ ID NO: 77169 - DNA, 25 bp, Mus musculus
aatcctataggtcgttttcacctgt

SEQ ID NO: 77170 - DNA, 25 bp, Mus musculus
aatcctataggtggttttcacctgt

SEQ ID NO: 77171 - DNA, 25 bp, Mus musculus
aatcctatatacatttgccatgaga

SEQ ID NO: 77172 - DNA, 25 bp, Mus musculus
aatcctatatacttttgccatgaga

SEQ ID NO: 77173 - DNA, 25 bp, Mus musculus
aatcctatatcacatgatcccttgg

SEQ ID NO: 77174 - DNA, 25 bp, Mus musculus
aatcctatatcagatgatcccttgg

SEQ ID NO: 77175 - DNA, 25 bp, Mus musculus
aatcctatccagatatctgtcgggc

SEQ ID NO: 77176 - DNA, 25 bp, Mus musculus
aatcctatccagttatctgtcgggc

SEQ ID NO: 77177 - DNA, 25 bp, Mus musculus
aatcctatctgacagggactgctcc

SEQ ID NO: 77178 - DNA, 25 bp, Mus musculus
aatcctatctgagagggactgctcc

SEQ ID NO: 77179 - DNA, 25 bp, Mus musculus
aatcctatgaagctggtgatccaga

SEQ ID NO: 77180 - DNA, 25 bp, Mus musculus
aatcctatgaaggtggtgatccaga

SEQ ID NO: 77181 - DNA, 25 bp, Mus musculus
aatcctatgggacacacactggcct

SEQ ID NO: 77182 - DNA, 25 bp, Mus musculus
aatcctatgggagacacactggcct

SEQ ID NO: 77183 - DNA, 25 bp, Mus musculus
aatcctatggtacccaagttggtca

SEQ ID NO: 77184 - DNA, 25 bp, Mus musculus
aatcctatggtagccaagttggtca

SEQ ID NO: 77185 - DNA, 25 bp, Mus musculus
aatcctatgtttcgccatgctgctg

SEQ ID NO: 77186 - DNA, 25 bp, Mus musculus
aatcctatgtttggccatgctgctg

SEQ ID NO: 77187 - DNA, 25 bp, Mus musculus
aatcctattctcatgacattgccta

SEQ ID NO: 77188 - DNA, 25 bp, Mus musculus
aatcctattctcttgacattgccta

SEQ ID NO: 77189 - DNA, 25 bp, Mus musculus
aatcctattggcagcctgtgaacgg

SEQ ID NO: 77190 - DNA, 25 bp, Mus musculus
aatcctattggctgcctgtgaacgg

SEQ ID NO: 77191 - DNA, 25 bp, Mus musculus
aatcctatttacaagagcgccgtga

SEQ ID NO: 77192 - DNA, 25 bp, Mus musculus
aatcctatttactagagcgccgtga

SEQ ID NO: 77193 - DNA, 25 bp, Mus musculus
aatcctatttgaccaacatcttcaa

SEQ ID NO: 77194 - DNA, 25 bp, Mus musculus
aatcctatttgagcaacatcttcaa

SEQ ID NO: 77195 - DNA, 25 bp, Mus musculus
aatcctatttgcaatgcagctgaag

SEQ ID NO: 77196 - DNA, 25 bp, Mus musculus
aatcctatttgctatgcagctgaag

SEQ ID NO: 77197 - DNA, 25 bp, Mus musculus
aatcctcaacacatggtgcaataga

SEQ ID NO: 77198 - DNA, 25 bp, Mus musculus
aatcctcaacacttggtgcaataga

SEQ ID NO: 77199 - DNA, 25 bp, Mus musculus
aatcctcaactacatcaaagggaat

SEQ ID NO: 77200 - DNA, 25 bp, Mus musculus
aatcctcaactagatcaaagggaat

SEQ ID NO: 77201 - DNA, 25 bp, Mus musculus
aatcctcaaggcacagatgtttgca

SEQ ID NO: 77202 - DNA, 25 bp, Mus musculus
aatcctcaaggctcagatgtttgca

SEQ ID NO: 77203 - DNA, 25 bp, Mus musculus
aatcctcacaggcactatgaagttg

SEQ ID NO: 77204 - DNA, 25 bp, Mus musculus
aatcctcacagggactatgaagttg

SEQ ID NO: 77205 - DNA, 25 bp, Mus musculus
aatcctcaccatctaaagttgtctg

SEQ ID NO: 77206 - DNA, 25 bp, Mus musculus
aatcctcaccatgtaaagttgtctg

SEQ ID NO: 77207 - DNA, 25 bp, Mus musculus
aatcctcagaggaaagccttatcca

SEQ ID NO: 77208 - DNA, 25 bp, Mus musculus
aatcctcagaggtaagccttatcca

SEQ ID NO: 77209 - DNA, 25 bp, Mus musculus
aatcctcagcagatccacaaggtgg

SEQ ID NO: 77210 - DNA, 25 bp, Mus musculus
aatcctcagcagttccacaaggtgg

SEQ ID NO: 77211 - DNA, 25 bp, Mus musculus
aatcctcagtgtaaaatgtcttgtg

SEQ ID NO: 77212 - DNA, 25 bp, Mus musculus
aatcctcagtgttaaatgtcttgtg

SEQ ID NO: 77213 - DNA, 25 bp, Mus musculus
aatcctcatcgccttaatagacaaa

SEQ ID NO: 77214 - DNA, 25 bp, Mus musculus
aatcctcatcgcgttaatagacaaa

SEQ ID NO: 77215 - DNA, 25 bp, Mus musculus
aatcctcattggctaaagagctggt

SEQ ID NO: 77216 - DNA, 25 bp, Mus musculus
aatcctcattgggtaaagagctggt

SEQ ID NO: 77217 - DNA, 25 bp, Mus musculus
aatcctccacgcagtttggttgctg

SEQ ID NO: 77218 - DNA, 25 bp, Mus musculus
aatcctccacgctgtttggttgctg

SEQ ID NO: 77219 - DNA, 25 bp, Mus musculus
aatcctccactaatacccattagag

SEQ ID NO: 77220 - DNA, 25 bp, Mus musculus
aatcctccactattacccattagag

SEQ ID NO: 77221 - DNA, 25 bp, Mus musculus
aatcctccatataattcaagcagca

SEQ ID NO: 77222 - DNA, 25 bp, Mus musculus
aatcctccatattattcaagcagca

SEQ ID NO: 77223 - DNA, 25 bp, Mus musculus
aatcctcccatgagaatgagaccag

SEQ ID NO: 77224 - DNA, 25 bp, Mus musculus
aatcctcccatgtgaatgagaccag

SEQ ID NO: 77225 - DNA, 25 bp, Mus musculus
aatcctccccagactcaagtattga

SEQ ID NO: 77226 - DNA, 25 bp, Mus musculus
aatcctccccagtctcaagtattga

SEQ ID NO: 77227 - DNA, 25 bp, Mus musculus
aatcctccccttaacagacctgtgt

SEQ ID NO: 77228 - DNA, 25 bp, Mus musculus
aatcctcccctttacagacctgtgt

SEQ ID NO: 77229 - DNA, 25 bp, Mus musculus
aatcctccctaccagtttgagctcg

SEQ ID NO: 77230 - DNA, 25 bp, Mus musculus
aatcctccctacgagtttgagctcg

SEQ ID NO: 77231 - DNA, 25 bp, Mus musculus
aatcctccctagaagttatgaacac

SEQ ID NO: 77232 - DNA, 25 bp, Mus musculus
aatcctccctagtagttatgaacac

SEQ ID NO: 77233 - DNA, 25 bp, Mus musculus
aatcctccctcacacagggacaaag

SEQ ID NO: 77234 - DNA, 25 bp, Mus musculus
aatcctccctcagacagggacaaag

SEQ ID NO: 77235 - DNA, 25 bp, Mus musculus
aatcctcctccgaccaacatttaat

SEQ ID NO: 77236 - DNA, 25 bp, Mus musculus
aatcctcctccgtccaacatttaat

SEQ ID NO: 77237 - DNA, 25 bp, Mus musculus
aatcctcctggtaaggtaggcacat

SEQ ID NO: 77238 - DNA, 25 bp, Mus musculus
aatcctcctggttaggtaggcacat

SEQ ID NO: 77239 - DNA, 25 bp, Mus musculus
aatcctcctttaatcattcatccat

SEQ ID NO: 77240 - DNA, 25 bp, Mus musculus
aatcctcctttattcattcatccat

SEQ ID NO: 77241 - DNA, 25 bp, Mus musculus
aatcctcctttgaccaacattttat

SEQ ID NO: 77242 - DNA, 25 bp, Mus musculus
aatcctcctttgtccaacattttat

SEQ ID NO: 77243 - DNA, 25 bp, Mus musculus
aatcctcgcatgaaactttggtact

SEQ ID NO: 77244 - DNA, 25 bp, Mus musculus
aatcctcgcatgtaactttggtact

SEQ ID NO: 77245 - DNA, 25 bp, Mus musculus
aatcctcggaccatcataaagttgt

SEQ ID NO: 77246 - DNA, 25 bp, Mus musculus
aatcctcggaccttcataaagttgt

SEQ ID NO: 77247 - DNA, 25 bp, Mus musculus
aatcctcggcatccagctgagaata

SEQ ID NO: 77248 - DNA, 25 bp, Mus musculus
aatcctcggcatgcagctgagaata

SEQ ID NO: 77249 - DNA, 25 bp, Mus musculus
aatcctcgtactcaagctactgcgg

SEQ ID NO: 77250 - DNA, 25 bp, Mus musculus
aatcctcgtactgaagctactgcgg

SEQ ID NO: 77251 - DNA, 25 bp, Mus musculus
aatcctctagtgagggactgggagt

SEQ ID NO: 77252 - DNA, 25 bp, Mus musculus
aatcctctagtgtgggactgggagt

SEQ ID NO: 77253 - DNA, 25 bp, Mus musculus
aatcctctatgtcttcaaattccag

SEQ ID NO: 77254 - DNA, 25 bp, Mus musculus
aatcctctatgtgttcaaattccag

SEQ ID NO: 77255 - DNA, 25 bp, Mus musculus
aatcctctattgaaacttggatcag

SEQ ID NO: 77256 - DNA, 25 bp, Mus musculus
aatcctctattgtaacttggatcag

SEQ ID NO: 77257 - DNA, 25 bp, Mus musculus
aatcctctcacccatagctatggga

SEQ ID NO: 77258 - DNA, 25 bp, Mus musculus
aatcctctcaccgatagctatggga

SEQ ID NO: 77259 - DNA, 25 bp, Mus musculus
aatcctctcctgccggatgaaaagc

SEQ ID NO: 77260 - DNA, 25 bp, Mus musculus
aatcctctcctggcggatgaaaagc

SEQ ID NO: 77261 - DNA, 25 bp, Mus musculus
aatcctctctgactgtttaatgcca

SEQ ID NO: 77262 - DNA, 25 bp, Mus musculus
aatcctctctgagtgtttaatgcca

SEQ ID NO: 77263 - DNA, 25 bp, Mus musculus
aatcctctgaagatgggtctgctta

SEQ ID NO: 77264 - DNA, 25 bp, Mus musculus
aatcctctgaagttgggtctgctta

SEQ ID NO: 77265 - DNA, 25 bp, Mus musculus
aatcctctgtaaccccattttcagg

SEQ ID NO: 77266 - DNA, 25 bp, Mus musculus
aatcctctgtaagcccattttcagg

SEQ ID NO: 77267 - DNA, 25 bp, Mus musculus
aatcctctgtgaactgtcggctgaa

SEQ ID NO: 77268 - DNA, 25 bp, Mus musculus
aatcctctgtgatctgtcggctgaa

SEQ ID NO: 77269 - DNA, 25 bp, Mus musculus
aatcctctgtgcagttgaattcctg

SEQ ID NO: 77270 - DNA, 25 bp, Mus musculus
aatcctctgtgctgttgaattcctg

SEQ ID NO: 77271 - DNA, 25 bp, Mus musculus
aatcctctgtttcctgggcggtaag

SEQ ID NO: 77272 - DNA, 25 bp, Mus musculus
aatcctctgtttctggagccttgga

SEQ ID NO: 77273 - DNA, 25 bp, Mus musculus
aatcctctgtttgctgggcggtaag

SEQ ID NO: 77274 - DNA, 25 bp, Mus musculus
aatcctctgtttgtggagccttgga

SEQ ID NO: 77275 - DNA, 25 bp, Mus musculus
aatcctcttcagacatctaaccaag

SEQ ID NO: 77276 - DNA, 25 bp, Mus musculus
aatcctcttcagtcatctaaccaag

SEQ ID NO: 77277 - DNA, 25 bp, Mus musculus
aatcctcttgagagtggaccggaca

SEQ ID NO: 77278 - DNA, 25 bp, Mus musculus
aatcctcttgagtgtggaccggaca

SEQ ID NO: 77279 - DNA, 25 bp, Mus musculus
aatcctcttgatctccactcaattt

SEQ ID NO: 77280 - DNA, 25 bp, Mus musculus
aatcctcttgatgtccactcaattt

SEQ ID NO: 77281 - DNA, 25 bp, Mus musculus
aatcctcttgctaattttatctgtc

SEQ ID NO: 77282 - DNA, 25 bp, Mus musculus
aatcctcttgcttattttatctgtc

SEQ ID NO: 77283 - DNA, 25 bp, Mus musculus
aatcctcttttgctctgagaagtca

SEQ ID NO: 77284 - DNA, 25 bp, Mus musculus
aatcctcttttggtctgagaagtca

SEQ ID NO: 77285 - DNA, 25 bp, Mus musculus
aatcctgaaaacacggcagcaacag

SEQ ID NO: 77286 - DNA, 25 bp, Mus musculus
aatcctgaaaactcggcagcaacag

SEQ ID NO: 77287 - DNA, 25 bp, Mus musculus
aatcctgaaccgagtgtgtctgctg

SEQ ID NO: 77288 - DNA, 25 bp, Mus musculus
aatcctgaaccgtgtgtgtctgctg

SEQ ID NO: 77289 - DNA, 25 bp, Mus musculus
aatcctgaagttacatagtatccac

SEQ ID NO: 77290 - DNA, 25 bp, Mus musculus
aatcctgaagtttcatagtatccac

SEQ ID NO: 77291 - DNA, 25 bp, Mus musculus
aatcctgacatgatggtaggctgag

SEQ ID NO: 77292 - DNA, 25 bp, Mus musculus
aatcctgacatgttggtaggctgag

SEQ ID NO: 77293 - DNA, 25 bp, Mus musculus
aatcctgaccaccttgaatccagaa

SEQ ID NO: 77294 - DNA, 25 bp, Mus musculus
aatcctgaccacgttgaatccagaa

SEQ ID NO: 77295 - DNA, 25 bp, Mus musculus
aatcctgaccccaatggtcattccg

SEQ ID NO: 77296 - DNA, 25 bp, Mus musculus
aatcctgacccctatggtcattccg

SEQ ID NO: 77297 - DNA, 25 bp, Mus musculus
aatcctgaccttaccaaagaacatg

SEQ ID NO: 77298 - DNA, 25 bp, Mus musculus
aatcctgacctttccaaagaacatg

SEQ ID NO: 77299 - DNA, 25 bp, Mus musculus
aatcctgactctactgagacatgag

SEQ ID NO: 77300 - DNA, 25 bp, Mus musculus
aatcctgactctcgctattcgcttc

SEQ ID NO: 77301 - DNA, 25 bp, Mus musculus
aatcctgactctggctattcgcttc

SEQ ID NO: 77302 - DNA, 25 bp, Mus musculus
aatcctgactcttctgagacatgag

SEQ ID NO: 77303 - DNA, 25 bp, Mus musculus
aatcctgactgaatgaggccaagca

SEQ ID NO: 77304 - DNA, 25 bp, Mus musculus
aatcctgactgattgaggccaagca

SEQ ID NO: 77305 - DNA, 25 bp, Mus musculus
aatcctgactttagtttgacggtga

SEQ ID NO: 77306 - DNA, 25 bp, Mus musculus
aatcctgacttttgtttgacggtga

SEQ ID NO: 77307 - DNA, 25 bp, Mus musculus
aatcctgagcgtacgtactgttgac

SEQ ID NO: 77308 - DNA, 25 bp, Mus musculus
aatcctgagcgttcgtactgttgac

SEQ ID NO: 77309 - DNA, 25 bp, Mus musculus
aatcctgaggtacgcattgtgtaca

SEQ ID NO: 77310 - DNA, 25 bp, Mus musculus
aatcctgaggtaggcattgtgtaca

SEQ ID NO: 77311 - DNA, 25 bp, Mus musculus
aatcctgagtatatctgcttggcat

SEQ ID NO: 77312 - DNA, 25 bp, Mus musculus
aatcctgagtatctgccctgctgtt

SEQ ID NO: 77313 - DNA, 25 bp, Mus musculus
aatcctgagtatgtgccctgctgtt

SEQ ID NO: 77314 - DNA, 25 bp, Mus musculus
aatcctgagtatttctgcttggcat

SEQ ID NO: 77315 - DNA, 25 bp, Mus musculus
aatcctgagttcaagggaccttaga

SEQ ID NO: 77316 - DNA, 25 bp, Mus musculus
aatcctgagttctagggaccttaga

SEQ ID NO: 77317 - DNA, 25 bp, Mus musculus
aatcctgattttaaggcgggtgtca

SEQ ID NO: 77318 - DNA, 25 bp, Mus musculus
aatcctgatttttaggcgggtgtca

SEQ ID NO: 77319 - DNA, 25 bp, Mus musculus
aatcctgcactgatttgatagtgct

SEQ ID NO: 77320 - DNA, 25 bp, Mus musculus
aatcctgcactgcacatactggcga

SEQ ID NO: 77321 - DNA, 25 bp, Mus musculus
aatcctgcactggacatactggcga

SEQ ID NO: 77322 - DNA, 25 bp, Mus musculus
aatcctgcactgttttgatagtgct

SEQ ID NO: 77323 - DNA, 25 bp, Mus musculus
aatcctgcagagaacatagaaatag

SEQ ID NO: 77324 - DNA, 25 bp, Mus musculus
aatcctgcagagtacatagaaatag

SEQ ID NO: 77325 - DNA, 25 bp, Mus musculus
aatcctgcagcaaccgtggcgtttt

SEQ ID NO: 77326 - DNA, 25 bp, Mus musculus
aatcctgcagcacggatgcatgcag

SEQ ID NO: 77327 - DNA, 25 bp, Mus musculus
aatcctgcagcagggatgcatgcag

SEQ ID NO: 77328 - DNA, 25 bp, Mus musculus
aatcctgcagcatccgtggcgtttt

SEQ ID NO: 77329 - DNA, 25 bp, Mus musculus
aatcctgcagtcagaaccgaccgca

SEQ ID NO: 77330 - DNA, 25 bp, Mus musculus
aatcctgcagtctgaaccgaccgca

SEQ ID NO: 77331 - DNA, 25 bp, Mus musculus
aatcctgcagtgagcctcggaaaat

SEQ ID NO: 77332 - DNA, 25 bp, Mus musculus
aatcctgcagtgatttgaggtgcca

SEQ ID NO: 77333 - DNA, 25 bp, Mus musculus
aatcctgcagtgtgcctcggaaaat

SEQ ID NO: 77334 - DNA, 25 bp, Mus musculus
aatcctgcagtgttttgaggtgcca

SEQ ID NO: 77335 - DNA, 25 bp, Mus musculus
aatcctgcagttaggctttagggcc

SEQ ID NO: 77336 - DNA, 25 bp, Mus musculus
aatcctgcagtttggctttagggcc

SEQ ID NO: 77337 - DNA, 25 bp, Mus musculus
aatcctgccactatcatgtttttaa

SEQ ID NO: 77338 - DNA, 25 bp, Mus musculus
aatcctgccactttcatgtttttaa

SEQ ID NO: 77339 - DNA, 25 bp, Mus musculus
aatcctgccaggagctgagatatta

SEQ ID NO: 77340 - DNA, 25 bp, Mus musculus
aatcctgccaggtgctgagatatta

SEQ ID NO: 77341 - DNA, 25 bp, Mus musculus
aatcctgccagtccattaacatgag

SEQ ID NO: 77342 - DNA, 25 bp, Mus musculus
aatcctgccagtgcattaacatgag

SEQ ID NO: 77343 - DNA, 25 bp, Mus musculus
aatcctgccttgaaagagcttctgt

SEQ ID NO: 77344 - DNA, 25 bp, Mus musculus
aatcctgccttgtaagagcttctgt

SEQ ID NO: 77345 - DNA, 25 bp, Mus musculus
aatcctgctaagattcgatggctgt

SEQ ID NO: 77346 - DNA, 25 bp, Mus musculus
aatcctgctaagtttcgatggctgt

SEQ ID NO: 77347 - DNA, 25 bp, Mus musculus
aatcctgctcttacataaacctttt

SEQ ID NO: 77348 - DNA, 25 bp, Mus musculus
aatcctgctctttcataaacctttt

SEQ ID NO: 77349 - DNA, 25 bp, Mus musculus
aatcctgctgagagcttgactttca

SEQ ID NO: 77350 - DNA, 25 bp, Mus musculus
aatcctgctgagtgcttgactttca

SEQ ID NO: 77351 - DNA, 25 bp, Mus musculus
aatcctgctgtcacaagggtatccg

SEQ ID NO: 77352 - DNA, 25 bp, Mus musculus
aatcctgctgtctcaagggtatccg

SEQ ID NO: 77353 - DNA, 25 bp, Mus musculus
aatcctgctttgagagtatttgtaa

SEQ ID NO: 77354 - DNA, 25 bp, Mus musculus
aatcctgctttgcatggcctcacat

SEQ ID NO: 77355 - DNA, 25 bp, Mus musculus
aatcctgctttggatggcctcacat

SEQ ID NO: 77356 - DNA, 25 bp, Mus musculus
aatcctgctttgtgagtatttgtaa

SEQ ID NO: 77357 - DNA, 25 bp, Mus musculus
aatcctggaacgagtggatggacga

SEQ ID NO: 77358 - DNA, 25 bp, Mus musculus
aatcctggaacgtgtggatggacga

SEQ ID NO: 77359 - DNA, 25 bp, Mus musculus
aatcctggaatactttgtgggtata

SEQ ID NO: 77360 - DNA, 25 bp, Mus musculus
aatcctggaatagtttgtgggtata

SEQ ID NO: 77361 - DNA, 25 bp, Mus musculus
aatcctggaatgagggtctccttgc

SEQ ID NO: 77362 - DNA, 25 bp, Mus musculus
aatcctggaatgtgggtctccttgc

SEQ ID NO: 77363 - DNA, 25 bp, Mus musculus
aatcctggacctcgatacggcctcg

SEQ ID NO: 77364 - DNA, 25 bp, Mus musculus
aatcctggacctggatacggcctcg

SEQ ID NO: 77365 - DNA, 25 bp, Mus musculus
aatcctggagtcaccctacttatga

SEQ ID NO: 77366 - DNA, 25 bp, Mus musculus
aatcctggagtctccctacttatga

SEQ ID NO: 77367 - DNA, 25 bp, Mus musculus
aatcctggatctacaagtcttgctt

SEQ ID NO: 77368 - DNA, 25 bp, Mus musculus
aatcctggatcttcaagtcttgctt

SEQ ID NO: 77369 - DNA, 25 bp, Mus musculus
aatcctggattaactgaatcctcag

SEQ ID NO: 77370 - DNA, 25 bp, Mus musculus
aatcctggattatctgaatcctcag

SEQ ID NO: 77371 - DNA, 25 bp, Mus musculus
aatcctggcaagctattttgtggaa

SEQ ID NO: 77372 - DNA, 25 bp, Mus musculus
aatcctggcaaggtattttgtggaa

SEQ ID NO: 77373 - DNA, 25 bp, Mus musculus
aatcctggcaataacttagactgtg

SEQ ID NO: 77374 - DNA, 25 bp, Mus musculus
aatcctggcaattacttagactgtg

SEQ ID NO: 77375 - DNA, 25 bp, Mus musculus
aatcctggcactaggaagtctgaag

SEQ ID NO: 77376 - DNA, 25 bp, Mus musculus
aatcctggcacttggaagtctgaag

SEQ ID NO: 77377 - DNA, 25 bp, Mus musculus
aatcctggcagactacagaggcagg

SEQ ID NO: 77378 - DNA, 25 bp, Mus musculus
aatcctggcagagtacagaggcagg

SEQ ID NO: 77379 - DNA, 25 bp, Mus musculus
aatcctggccctataaacatggtca

SEQ ID NO: 77380 - DNA, 25 bp, Mus musculus
aatcctggccctttaaacatggtca

SEQ ID NO: 77381 - DNA, 25 bp, Mus musculus
aatcctggctggctcagaatatcca

SEQ ID NO: 77382 - DNA, 25 bp, Mus musculus
aatcctggctgggtcagaatatcca

SEQ ID NO: 77383 - DNA, 25 bp, Mus musculus
aatcctgggaaacctgactgatatc

SEQ ID NO: 77384 - DNA, 25 bp, Mus musculus
aatcctgggaaagctgactgatatc

SEQ ID NO: 77385 - DNA, 25 bp, Mus musculus
aatcctgggatgctccccagccatg

SEQ ID NO: 77386 - DNA, 25 bp, Mus musculus
aatcctgggatggtccccagccatg

SEQ ID NO: 77387 - DNA, 25 bp, Mus musculus
aatcctgggcggctcaccgaaagga

SEQ ID NO: 77388 - DNA, 25 bp, Mus musculus
aatcctgggcgggtcaccgaaagga

SEQ ID NO: 77389 - DNA, 25 bp, Mus musculus
aatcctgggctcaaagggttcctag

SEQ ID NO: 77390 - DNA, 25 bp, Mus musculus
aatcctgggctctaagggttcctag

SEQ ID NO: 77391 - DNA, 25 bp, Mus musculus
aatcctgggcttaactggttctcct

SEQ ID NO: 77392 - DNA, 25 bp, Mus musculus
aatcctgggctttactggttctcct

SEQ ID NO: 77393 - DNA, 25 bp, Mus musculus
aatcctgggttaatcatattccttg

SEQ ID NO: 77394 - DNA, 25 bp, Mus musculus
aatcctgggttattcatattccttg

SEQ ID NO: 77395 - DNA, 25 bp, Mus musculus
aatcctggtcttaatggacgtctcc

SEQ ID NO: 77396 - DNA, 25 bp, Mus musculus
aatcctggtctttatggacgtctcc

SEQ ID NO: 77397 - DNA, 25 bp, Mus musculus
aatcctggtggacactacttcctgc

SEQ ID NO: 77398 - DNA, 25 bp, Mus musculus
aatcctggtggagactacttcctgc

SEQ ID NO: 77399 - DNA, 25 bp, Mus musculus
aatcctggtggcaatcaggctcagt

SEQ ID NO: 77400 - DNA, 25 bp, Mus musculus
aatcctggtggctatcaggctcagt

SEQ ID NO: 77401 - DNA, 25 bp, Mus musculus
aatcctggttcacaagctacggcca

SEQ ID NO: 77402 - DNA, 25 bp, Mus musculus
aatcctggttcagaagctacggcca

SEQ ID NO: 77403 - DNA, 25 bp, Mus musculus
aatcctggtttcataggagcgccct

SEQ ID NO: 77404 - DNA, 25 bp, Mus musculus
aatcctggtttcttaggagcgccct

SEQ ID NO: 77405 - DNA, 25 bp, Mus musculus
aatcctggtttgctgcaagtctgtc

SEQ ID NO: 77406 - DNA, 25 bp, Mus musculus
aatcctggtttggtgcaagtctgtc

SEQ ID NO: 77407 - DNA, 25 bp, Mus musculus
aatcctgtaaatatacctctgaaat

SEQ ID NO: 77408 - DNA, 25 bp, Mus musculus
aatcctgtaaatttacctctgaaat

SEQ ID NO: 77409 - DNA, 25 bp, Mus musculus
aatcctgtaacgctccggtggttag

SEQ ID NO: 77410 - DNA, 25 bp, Mus musculus
aatcctgtaacggtccggtggttag

SEQ ID NO: 77411 - DNA, 25 bp, Mus musculus
aatcctgtaagcagcaagaacgaca

SEQ ID NO: 77412 - DNA, 25 bp, Mus musculus
aatcctgtaagctgcaagaacgaca

SEQ ID NO: 77413 - DNA, 25 bp, Mus musculus
aatcctgtaagtcggaactgccctc

SEQ ID NO: 77414 - DNA, 25 bp, Mus musculus
aatcctgtaagtgggaactgccctc

SEQ ID NO: 77415 - DNA, 25 bp, Mus musculus
aatcctgtaatccatgttgcctttg

SEQ ID NO: 77416 - DNA, 25 bp, Mus musculus
aatcctgtaatcgatgttgcctttg

SEQ ID NO: 77417 - DNA, 25 bp, Mus musculus
aatcctgtacagaagcgtctgtcct

SEQ ID NO: 77418 - DNA, 25 bp, Mus musculus
aatcctgtacagtagcgtctgtcct

SEQ ID NO: 77419 - DNA, 25 bp, Mus musculus
aatcctgtacatcgctcctttacct

SEQ ID NO: 77420 - DNA, 25 bp, Mus musculus
aatcctgtacatggctcctttacct

SEQ ID NO: 77421 - DNA, 25 bp, Mus musculus
aatcctgtacttagaaacatcagct

SEQ ID NO: 77422 - DNA, 25 bp, Mus musculus
aatcctgtactttgaaacatcagct

SEQ ID NO: 77423 - DNA, 25 bp, Mus musculus
aatcctgtagttactttgggcgtct

SEQ ID NO: 77424 - DNA, 25 bp, Mus musculus
aatcctgtagtttctttgggcgtct

SEQ ID NO: 77425 - DNA, 25 bp, Mus musculus
aatcctgtcaagagagattgtgtaa

SEQ ID NO: 77426 - DNA, 25 bp, Mus musculus
aatcctgtcaagtgagattgtgtaa

SEQ ID NO: 77427 - DNA, 25 bp, Mus musculus
aatcctgtcagaaggccattggaat

SEQ ID NO: 77428 - DNA, 25 bp, Mus musculus
aatcctgtcagatggccattggaat

SEQ ID NO: 77429 - DNA, 25 bp, Mus musculus
aatcctgtcagccttctatcagtag

SEQ ID NO: 77430 - DNA, 25 bp, Mus musculus
aatcctgtcagcgttctatcagtag

SEQ ID NO: 77431 - DNA, 25 bp, Mus musculus
aatcctgtcaggcaacccagctggg

SEQ ID NO: 77432 - DNA, 25 bp, Mus musculus
aatcctgtcagggaacccagctggg

SEQ ID NO: 77433 - DNA, 25 bp, Mus musculus
aatcctgtcctcctgaacgaccagg

SEQ ID NO: 77434 - DNA, 25 bp, Mus musculus
aatcctgtcctcgtgaacgaccagg

SEQ ID NO: 77435 - DNA, 25 bp, Mus musculus
aatcctgtcgccatgctgctgacca

SEQ ID NO: 77436 - DNA, 25 bp, Mus musculus
aatcctgtcgcccacggaatcagct

SEQ ID NO: 77437 - DNA, 25 bp, Mus musculus
aatcctgtcgccgacggaatcagct

SEQ ID NO: 77438 - DNA, 25 bp, Mus musculus
aatcctgtcgccttgctgctgacca

SEQ ID NO: 77439 - DNA, 25 bp, Mus musculus
aatcctgtcgtcacttcaaactgaa

SEQ ID NO: 77440 - DNA, 25 bp, Mus musculus
aatcctgtcgtctcttcaaactgaa

SEQ ID NO: 77441 - DNA, 25 bp, Mus musculus
aatcctgtgcagaccctaaatgtaa

SEQ ID NO: 77442 - DNA, 25 bp, Mus musculus
aatcctgtgcagtccctaaatgtaa

SEQ ID NO: 77443 - DNA, 25 bp, Mus musculus
aatcctgtggagaatctgtaggctt

SEQ ID NO: 77444 - DNA, 25 bp, Mus musculus
aatcctgtggagaattagacgggcc

SEQ ID NO: 77445 - DNA, 25 bp, Mus musculus
aatcctgtggagtatctgtaggctt

SEQ ID NO: 77446 - DNA, 25 bp, Mus musculus
aatcctgtggagtattagacgggcc

SEQ ID NO: 77447 - DNA, 25 bp, Mus musculus
aatcctgtggccaatatcatcgagc

SEQ ID NO: 77448 - DNA, 25 bp, Mus musculus
aatcctgtggccaatcacatggcaa

SEQ ID NO: 77449 - DNA, 25 bp, Mus musculus
aatcctgtggcctatatcatcgagc

SEQ ID NO: 77450 - DNA, 25 bp, Mus musculus
aatcctgtggcctatcacatggcaa

SEQ ID NO: 77451 - DNA, 25 bp, Mus musculus
aatcctgtgggcaccatgtgagata

SEQ ID NO: 77452 - DNA, 25 bp, Mus musculus
aatcctgtgggcacttctggcctct

SEQ ID NO: 77453 - DNA, 25 bp, Mus musculus
aatcctgtgggctccatgtgagata

SEQ ID NO: 77454 - DNA, 25 bp, Mus musculus
aatcctgtgggctcttctggcctct

SEQ ID NO: 77455 - DNA, 25 bp, Mus musculus
aatcctgtgtgtcagaccacactag

SEQ ID NO: 77456 - DNA, 25 bp, Mus musculus
aatcctgtgtgtgagaccacactag

SEQ ID NO: 77457 - DNA, 25 bp, Mus musculus
aatcctgttatacggacctaggtca

SEQ ID NO: 77458 - DNA, 25 bp, Mus musculus
aatcctgttatagggacctaggtca

SEQ ID NO: 77459 - DNA, 25 bp, Mus musculus
aatcctgttcaaagtcaagtcacct

SEQ ID NO: 77460 - DNA, 25 bp, Mus musculus
aatcctgttcaatgtcaagtcacct

SEQ ID NO: 77461 - DNA, 25 bp, Mus musculus
aatcctgttctcatcggtggcagga

SEQ ID NO: 77462 - DNA, 25 bp, Mus musculus
aatcctgttctcttcggtggcagga

SEQ ID NO: 77463 - DNA, 25 bp, Mus musculus
aatcctgttcttcgttagacgtctc

SEQ ID NO: 77464 - DNA, 25 bp, Mus musculus
aatcctgttcttggttagacgtctc

SEQ ID NO: 77465 - DNA, 25 bp, Mus musculus
aatcctgttgaaaagccatgtttaa

SEQ ID NO: 77466 - DNA, 25 bp, Mus musculus
aatcctgttgaatagccatgtttaa

SEQ ID NO: 77467 - DNA, 25 bp, Mus musculus
aatcctgttggtcgagtatgtctac

SEQ ID NO: 77468 - DNA, 25 bp, Mus musculus
aatcctgttggtggagtatgtctac

SEQ ID NO: 77469 - DNA, 25 bp, Mus musculus
aatccttaagcgctttcaaaagttg

SEQ ID NO: 77470 - DNA, 25 bp, Mus musculus
aatccttaagcggtttcaaaagttg

SEQ ID NO: 77471 - DNA, 25 bp, Mus musculus
aatccttacatcattcttctgggtg

SEQ ID NO: 77472 - DNA, 25 bp, Mus musculus
aatccttacatctttcttctgggtg

SEQ ID NO: 77473 - DNA, 25 bp, Mus musculus
aatccttacatgaacctgccctttg

SEQ ID NO: 77474 - DNA, 25 bp, Mus musculus
aatccttacatgtacctgccctttg

SEQ ID NO: 77475 - DNA, 25 bp, Mus musculus
aatccttaccgtcatctggttctag

SEQ ID NO: 77476 - DNA, 25 bp, Mus musculus
aatccttaccgtgatctggttctag

SEQ ID NO: 77477 - DNA, 25 bp, Mus musculus
aatccttagacgcttgagaataaaa

SEQ ID NO: 77478 - DNA, 25 bp, Mus musculus
aatccttagacggttgagaataaaa

SEQ ID NO: 77479 - DNA, 25 bp, Mus musculus
aatccttatagtcaatcctgtgcct

SEQ ID NO: 77480 - DNA, 25 bp, Mus musculus
aatccttatagtgaatcctgtgcct

SEQ ID NO: 77481 - DNA, 25 bp, Mus musculus
aatccttattccagtgtctttcatg

SEQ ID NO: 77482 - DNA, 25 bp, Mus musculus
aatccttattcctgtgtctttcatg

SEQ ID NO: 77483 - DNA, 25 bp, Mus musculus
aatccttcaaggctgtgttccagta

SEQ ID NO: 77484 - DNA, 25 bp, Mus musculus
aatccttcaagggtgtgttccagta

SEQ ID NO: 77485 - DNA, 25 bp, Mus musculus
aatccttcaattacctagcctttga

SEQ ID NO: 77486 - DNA, 25 bp, Mus musculus
aatccttcaatttcctagcctttga

SEQ ID NO: 77487 - DNA, 25 bp, Mus musculus
aatccttcagacctattgaacttaa

SEQ ID NO: 77488 - DNA, 25 bp, Mus musculus
aatccttcagacgtattgaacttaa

SEQ ID NO: 77489 - DNA, 25 bp, Mus musculus
aatccttcagggacctatgtgacac

SEQ ID NO: 77490 - DNA, 25 bp, Mus musculus
aatccttcagggtcctatgtgacac

SEQ ID NO: 77491 - DNA, 25 bp, Mus musculus
aatccttcaggtaatgttcccatgt

SEQ ID NO: 77492 - DNA, 25 bp, Mus musculus
aatccttcaggttatgttcccatgt

SEQ ID NO: 77493 - DNA, 25 bp, Mus musculus
aatccttcagtgatggttcaccact

SEQ ID NO: 77494 - DNA, 25 bp, Mus musculus
aatccttcagtgttggttcaccact

SEQ ID NO: 77495 - DNA, 25 bp, Mus musculus
aatccttcagttccagccagaagct

SEQ ID NO: 77496 - DNA, 25 bp, Mus musculus
aatccttcagttgcagccagaagct

SEQ ID NO: 77497 - DNA, 25 bp, Mus musculus
aatccttccgccatagacgcagaga

SEQ ID NO: 77498 - DNA, 25 bp, Mus musculus
aatccttccgccttagacgcagaga

SEQ ID NO: 77499 - DNA, 25 bp, Mus musculus
aatccttcgactcgcgcatgtacgt

SEQ ID NO: 77500 - DNA, 25 bp, Mus musculus
aatccttcgactggcgcatgtacgt

SEQ ID NO: 77501 - DNA, 25 bp, Mus musculus
aatccttcgatgatcaggaacgcag

SEQ ID NO: 77502 - DNA, 25 bp, Mus musculus
aatccttcgatgttcaggaacgcag

SEQ ID NO: 77503 - DNA, 25 bp, Mus musculus
aatccttcggatcctgtatttattt

SEQ ID NO: 77504 - DNA, 25 bp, Mus musculus
aatccttcggatgctgtatttattt

SEQ ID NO: 77505 - DNA, 25 bp, Mus musculus
aatccttctccactcagagatcagg

SEQ ID NO: 77506 - DNA, 25 bp, Mus musculus
aatccttctccagtcagagatcagg

SEQ ID NO: 77507 - DNA, 25 bp, Mus musculus
aatccttctctgaacatgctgagtg

SEQ ID NO: 77508 - DNA, 25 bp, Mus musculus
aatccttctctgtacatgctgagtg

SEQ ID NO: 77509 - DNA, 25 bp, Mus musculus
aatccttctcttaatggcagtgcac

SEQ ID NO: 77510 - DNA, 25 bp, Mus musculus
aatccttctctttatggcagtgcac

SEQ ID NO: 77511 - DNA, 25 bp, Mus musculus
aatccttctggccaatttccctagt

SEQ ID NO: 77512 - DNA, 25 bp, Mus musculus
aatccttctggcgaatttccctagt

SEQ ID NO: 77513 - DNA, 25 bp, Mus musculus
aatccttctgtgagtcagcgggtgc

SEQ ID NO: 77514 - DNA, 25 bp, Mus musculus
aatccttctgtgtgtcagcgggtgc

SEQ ID NO: 77515 - DNA, 25 bp, Mus musculus
aatccttctgttcttacaagcttgt

SEQ ID NO: 77516 - DNA, 25 bp, Mus musculus
aatccttctgttgttacaagcttgt

SEQ ID NO: 77517 - DNA, 25 bp, Mus musculus
aatccttcttgaaagtttgcgggca

SEQ ID NO: 77518 - DNA, 25 bp, Mus musculus
aatccttcttgatagtttgcgggca

SEQ ID NO: 77519 - DNA, 25 bp, Mus musculus
aatccttcttgtatatgctgtgttc

SEQ ID NO: 77520 - DNA, 25 bp, Mus musculus
aatccttcttgtttatgctgtgttc

SEQ ID NO: 77521 - DNA, 25 bp, Mus musculus
aatccttgccaacggatgatcctgg

SEQ ID NO: 77522 - DNA, 25 bp, Mus musculus
aatccttgccaagggatgatcctgg

SEQ ID NO: 77523 - DNA, 25 bp, Mus musculus
aatccttgcctccatttgtgaaaat

SEQ ID NO: 77524 - DNA, 25 bp, Mus musculus
aatccttgcctcgatttgtgaaaat

SEQ ID NO: 77525 - DNA, 25 bp, Mus musculus
aatccttggcgtcggacattcggtg

SEQ ID NO: 77526 - DNA, 25 bp, Mus musculus
aatccttggcgtgggacattcggtg

SEQ ID NO: 77527 - DNA, 25 bp, Mus musculus
aatccttggcttattcatcgtatca

SEQ ID NO: 77528 - DNA, 25 bp, Mus musculus
aatccttggctttttcatcgtatca

SEQ ID NO: 77529 - DNA, 25 bp, Mus musculus
aatccttgggaaacttatcctgtgg

SEQ ID NO: 77530 - DNA, 25 bp, Mus musculus
aatccttgggaatcttatcctgtgg

SEQ ID NO: 77531 - DNA, 25 bp, Mus musculus
aatccttgggacaggtgacagacca

SEQ ID NO: 77532 - DNA, 25 bp, Mus musculus
aatccttgggactggtgacagacca

SEQ ID NO: 77533 - DNA, 25 bp, Mus musculus
aatccttgggcaacgcctgcccaga

SEQ ID NO: 77534 - DNA, 25 bp, Mus musculus
aatccttgggcatcgcctgcccaga

SEQ ID NO: 77535 - DNA, 25 bp, Mus musculus
aatccttgggtcaggaaaagcactc

SEQ ID NO: 77536 - DNA, 25 bp, Mus musculus
aatccttgggtctggaaaagcactc

SEQ ID NO: 77537 - DNA, 25 bp, Mus musculus
aatccttggtagaggtggctggtcc

SEQ ID NO: 77538 - DNA, 25 bp, Mus musculus
aatccttggtagtggtggctggtcc

SEQ ID NO: 77539 - DNA, 25 bp, Mus musculus
aatccttggtttagcctaacatctc

SEQ ID NO: 77540 - DNA, 25 bp, Mus musculus
aatccttggttttgcctaacatctc

SEQ ID NO: 77541 - DNA, 25 bp, Mus musculus
aatccttgtgaaatggaccccaggc

SEQ ID NO: 77542 - DNA, 25 bp, Mus musculus
aatccttgtgaattggaccccaggc

SEQ ID NO: 77543 - DNA, 25 bp, Mus musculus
aatccttgtgagctgggacgccgta

SEQ ID NO: 77544 - DNA, 25 bp, Mus musculus
aatccttgtgaggtgggacgccgta

SEQ ID NO: 77545 - DNA, 25 bp, Mus musculus
aatccttgtggacttcttcctggtt

SEQ ID NO: 77546 - DNA, 25 bp, Mus musculus
aatccttgtggagttcttcctggtt

SEQ ID NO: 77547 - DNA, 25 bp, Mus musculus
aatccttgtgtaaattagtttcaga

SEQ ID NO: 77548 - DNA, 25 bp, Mus musculus
aatccttgtgtatattagtttcaga

SEQ ID NO: 77549 - DNA, 25 bp, Mus musculus
aatccttgtgtccagaatcccagat

SEQ ID NO: 77550 - DNA, 25 bp, Mus musculus
aatccttgtgtcgagaatcccagat

SEQ ID NO: 77551 - DNA, 25 bp, Mus musculus
aatccttgttagactactgacttaa

SEQ ID NO: 77552 - DNA, 25 bp, Mus musculus
aatccttgttagtctactgacttaa

SEQ ID NO: 77553 - DNA, 25 bp, Mus musculus
aatccttgttggcacttcacctgat

SEQ ID NO: 77554 - DNA, 25 bp, Mus musculus
aatccttgttgggacttcacctgat

SEQ ID NO: 77555 - DNA, 25 bp, Mus musculus
aatcctttaaacctgcagacctttg

SEQ ID NO: 77556 - DNA, 25 bp, Mus musculus
aatcctttaaacgtgcagacctttg

SEQ ID NO: 77557 - DNA, 25 bp, Mus musculus
aatcctttacctacagaaagcttag

SEQ ID NO: 77558 - DNA, 25 bp, Mus musculus
aatcctttaccttcagaaagcttag

SEQ ID NO: 77559 - DNA, 25 bp, Mus musculus
aatcctttaggacctctgtcatgtt

SEQ ID NO: 77560 - DNA, 25 bp, Mus musculus
aatcctttaggagctctgtcatgtt

SEQ ID NO: 77561 - DNA, 25 bp, Mus musculus
aatcctttagtcaatgttcaaacct

SEQ ID NO: 77562 - DNA, 25 bp, Mus musculus
aatcctttagtctatgttcaaacct

SEQ ID NO: 77563 - DNA, 25 bp, Mus musculus
aatcctttattcaggaagtgagtgc

SEQ ID NO: 77564 - DNA, 25 bp, Mus musculus
aatcctttattctggaagtgagtgc

SEQ ID NO: 77565 - DNA, 25 bp, Mus musculus
aatcctttccagataggactgatta

SEQ ID NO: 77566 - DNA, 25 bp, Mus musculus
aatcctttccagttaggactgatta

SEQ ID NO: 77567 - DNA, 25 bp, Mus musculus
aatcctttcctaatagttcatcagc

SEQ ID NO: 77568 - DNA, 25 bp, Mus musculus
aatcctttcctattagttcatcagc

SEQ ID NO: 77569 - DNA, 25 bp, Mus musculus
aatcctttctgcatttgtttgctgt

SEQ ID NO: 77570 - DNA, 25 bp, Mus musculus
aatcctttctgcttttgtttgctgt

SEQ ID NO: 77571 - DNA, 25 bp, Mus musculus
aatcctttgaacactttcgcatggg

SEQ ID NO: 77572 - DNA, 25 bp, Mus musculus
aatcctttgaactctttcgcatggg

SEQ ID NO: 77573 - DNA, 25 bp, Mus musculus
aatcctttgcagacaagaacactca

SEQ ID NO: 77574 - DNA, 25 bp, Mus musculus
aatcctttgcagtcaagaacactca

SEQ ID NO: 77575 - DNA, 25 bp, Mus musculus
aatcctttgcatacaaccctttgtt

SEQ ID NO: 77576 - DNA, 25 bp, Mus musculus
aatcctttgcatccagctgactggg

SEQ ID NO: 77577 - DNA, 25 bp, Mus musculus
aatcctttgcatgcagctgactggg

SEQ ID NO: 77578 - DNA, 25 bp, Mus musculus
aatcctttgcattcaaccctttgtt

SEQ ID NO: 77579 - DNA, 25 bp, Mus musculus
aatcctttgctaactgacctgtgta

SEQ ID NO: 77580 - DNA, 25 bp, Mus musculus
aatcctttgctatctgacctgtgta

SEQ ID NO: 77581 - DNA, 25 bp, Mus musculus
aatcctttgggtattgcaagagcaa

SEQ ID NO: 77582 - DNA, 25 bp, Mus musculus
aatcctttgggttttgcaagagcaa

SEQ ID NO: 77583 - DNA, 25 bp, Mus musculus
aatccttttaggattagattcatgg

SEQ ID NO: 77584 - DNA, 25 bp, Mus musculus
aatccttttaggtttagattcatgg

SEQ ID NO: 77585 - DNA, 25 bp, Mus musculus
aatccttttattaatactggctcag

SEQ ID NO: 77586 - DNA, 25 bp, Mus musculus
aatccttttatttatactggctcag

SEQ ID NO: 77587 - DNA, 25 bp, Mus musculus
aatccttttgttatgatcaatgggc

SEQ ID NO: 77588 - DNA, 25 bp, Mus musculus
aatccttttgttttgatcaatgggc

SEQ ID NO: 77589 - DNA, 25 bp, Mus musculus
aatcctttttgaccaattttcccat

SEQ ID NO: 77590 - DNA, 25 bp, Mus musculus
aatcctttttgagcaattttcccat

SEQ ID NO: 77591 - DNA, 25 bp, Mus musculus
aatcgaaagacactggcttcccctg

SEQ ID NO: 77592 - DNA, 25 bp, Mus musculus
aatcgaaagacagtggcttcccctg

SEQ ID NO: 77593 - DNA, 25 bp, Mus musculus
aatcgaaaggttcctgggctcccag

SEQ ID NO: 77594 - DNA, 25 bp, Mus musculus
aatcgaaaggttgctgggctcccag

SEQ ID NO: 77595 - DNA, 25 bp, Mus musculus
aatcgaaagtggatccccgaggctt

SEQ ID NO: 77596 - DNA, 25 bp, Mus musculus
aatcgaaagtggttccccgaggctt

SEQ ID NO: 77597 - DNA, 25 bp, Mus musculus
aatcgaacacggcttctctgagaga

SEQ ID NO: 77598 - DNA, 25 bp, Mus musculus
aatcgaacacgggttctctgagaga

SEQ ID NO: 77599 - DNA, 25 bp, Mus musculus
aatcgaaccgttattgacagtgact

SEQ ID NO: 77600 - DNA, 25 bp, Mus musculus
aatcgaaccgtttttgacagtgact

SEQ ID NO: 77601 - DNA, 25 bp, Mus musculus
aatcgaactatcaatcctgctgtgg

SEQ ID NO: 77602 - DNA, 25 bp, Mus musculus
aatcgaactatctatcctgctgtgg

SEQ ID NO: 77603 - DNA, 25 bp, Mus musculus
aatcgaactcgtcggacctctgaaa

SEQ ID NO: 77604 - DNA, 25 bp, Mus musculus
aatcgaactcgtgggacctctgaaa

SEQ ID NO: 77605 - DNA, 25 bp, Mus musculus
aatcgaagcctcaaagtctccactg

SEQ ID NO: 77606 - DNA, 25 bp, Mus musculus
aatcgaagcctctaagtctccactg

SEQ ID NO: 77607 - DNA, 25 bp, Mus musculus
aatcgaagggctcatcaggaagaca

SEQ ID NO: 77608 - DNA, 25 bp, Mus musculus
aatcgaagggctgatcaggaagaca

SEQ ID NO: 77609 - DNA, 25 bp, Mus musculus
aatcgaatccaccacaagtctatac

SEQ ID NO: 77610 - DNA, 25 bp, Mus musculus
aatcgaatccacgacaagtctatac

SEQ ID NO: 77611 - DNA, 25 bp, Mus musculus
aatcgaattgttactaggccttcaa

SEQ ID NO: 77612 - DNA, 25 bp, Mus musculus
aatcgaattgtttctaggccttcaa

SEQ ID NO: 77613 - DNA, 25 bp, Mus musculus
aatcgacacactatgactcccaaat

SEQ ID NO: 77614 - DNA, 25 bp, Mus musculus
aatcgacacactttgactcccaaat

SEQ ID NO: 77615 - DNA, 25 bp, Mus musculus
aatcgacacaggagggaccaagacc

SEQ ID NO: 77616 - DNA, 25 bp, Mus musculus
aatcgacacaggtgggaccaagacc

SEQ ID NO: 77617 - DNA, 25 bp, Mus musculus
aatcgacagcatatgtctccttatg

SEQ ID NO: 77618 - DNA, 25 bp, Mus musculus
aatcgacagcatttgtctccttatg

SEQ ID NO: 77619 - DNA, 25 bp, Mus musculus
aatcgacatagtacagctgtttggg

SEQ ID NO: 77620 - DNA, 25 bp, Mus musculus
aatcgacatagttcagctgtttggg

SEQ ID NO: 77621 - DNA, 25 bp, Mus musculus
aatcgaccaggtaagtccacttgcc

SEQ ID NO: 77622 - DNA, 25 bp, Mus musculus
aatcgaccaggtagctgcagctttg

SEQ ID NO: 77623 - DNA, 25 bp, Mus musculus
aatcgaccaggttagtccacttgcc

SEQ ID NO: 77624 - DNA, 25 bp, Mus musculus
aatcgaccaggttgctgcagctttg

SEQ ID NO: 77625 - DNA, 25 bp, Mus musculus
aatcgacccaagactgtcacagcaa

SEQ ID NO: 77626 - DNA, 25 bp, Mus musculus
aatcgacccaagtctgtcacagcaa

SEQ ID NO: 77627 - DNA, 25 bp, Mus musculus
aatcgaccgcccactggaggaagat

SEQ ID NO: 77628 - DNA, 25 bp, Mus musculus
aatcgaccgccctctggaggaagat

SEQ ID NO: 77629 - DNA, 25 bp, Mus musculus
aatcgactcagtacgtgacatcacg

SEQ ID NO: 77630 - DNA, 25 bp, Mus musculus
aatcgactcagttcgtgacatcacg

SEQ ID NO: 77631 - DNA, 25 bp, Mus musculus
aatcgactctacactatggcatctg

SEQ ID NO: 77632 - DNA, 25 bp, Mus musculus
aatcgactctactctatggcatctg

SEQ ID NO: 77633 - DNA, 25 bp, Mus musculus
aatcgactgagcagctcatccggaa

SEQ ID NO: 77634 - DNA, 25 bp, Mus musculus
aatcgactgagctgctcatccggaa

SEQ ID NO: 77635 - DNA, 25 bp, Mus musculus
aatcgactttttagactggtgctgg

SEQ ID NO: 77636 - DNA, 25 bp, Mus musculus
aatcgacttttttgactggtgctgg

SEQ ID NO: 77637 - DNA, 25 bp, Mus musculus
aatcgagaacctctggaccctggac

SEQ ID NO: 77638 - DNA, 25 bp, Mus musculus
aatcgagaacctgtggaccctggac

SEQ ID NO: 77639 - DNA, 25 bp, Mus musculus
aatcgagaacgaagtacccagcaag

SEQ ID NO: 77640 - DNA, 25 bp, Mus musculus
aatcgagaacgatgtacccagcaag

SEQ ID NO: 77641 - DNA, 25 bp, Mus musculus
aatcgagcccccagtgcacaactga

SEQ ID NO: 77642 - DNA, 25 bp, Mus musculus
aatcgagccccctgtgcacaactga

SEQ ID NO: 77643 - DNA, 25 bp, Mus musculus
aatcgagcctcaactttttcatgga

SEQ ID NO: 77644 - DNA, 25 bp, Mus musculus
aatcgagcctcatctttttcatgga

SEQ ID NO: 77645 - DNA, 25 bp, Mus musculus
aatcgaggctagactagtctacaaa

SEQ ID NO: 77646 - DNA, 25 bp, Mus musculus
aatcgaggctagtctagtctacaaa

SEQ ID NO: 77647 - DNA, 25 bp, Mus musculus
aatcgaggtcctctgcaaaggctac

SEQ ID NO: 77648 - DNA, 25 bp, Mus musculus
aatcgaggtcctgtgcaaaggctac

SEQ ID NO: 77649 - DNA, 25 bp, Mus musculus
aatcgagtgcatactgcagccagtc

SEQ ID NO: 77650 - DNA, 25 bp, Mus musculus
aatcgagtgcattctgcagccagtc

SEQ ID NO: 77651 - DNA, 25 bp, Mus musculus
aatcgagtgcttcagggcaacttcc

SEQ ID NO: 77652 - DNA, 25 bp, Mus musculus
aatcgagtgcttgagggcaacttcc

SEQ ID NO: 77653 - DNA, 25 bp, Mus musculus
aatcgagttctgctacaaatcccgt

SEQ ID NO: 77654 - DNA, 25 bp, Mus musculus
aatcgagttctggtacaaatcccgt

SEQ ID NO: 77655 - DNA, 25 bp, Mus musculus
aatcgagtttgaacagtttctgccc

SEQ ID NO: 77656 - DNA, 25 bp, Mus musculus
aatcgagtttgatcagtttctgccc

SEQ ID NO: 77657 - DNA, 25 bp, Mus musculus
aatcgatacgttacatagccttgaa

SEQ ID NO: 77658 - DNA, 25 bp, Mus musculus
aatcgatacgtttcatagccttgaa

SEQ ID NO: 77659 - DNA, 25 bp, Mus musculus
aatcgatagccactcccaaatgaaa

SEQ ID NO: 77660 - DNA, 25 bp, Mus musculus
aatcgatagccagtcccaaatgaaa

SEQ ID NO: 77661 - DNA, 25 bp, Mus musculus
aatcgatcttggaccacttcagtca

SEQ ID NO: 77662 - DNA, 25 bp, Mus musculus
aatcgatcttggtccacttcagtca

SEQ ID NO: 77663 - DNA, 25 bp, Mus musculus
aatcgatgccctatgatgtgtgcca

SEQ ID NO: 77664 - DNA, 25 bp, Mus musculus
aatcgatgccctttgatgtgtgcca

SEQ ID NO: 77665 - DNA, 25 bp, Mus musculus
aatcgatgtcataggtccctatgga

SEQ ID NO: 77666 - DNA, 25 bp, Mus musculus
aatcgatgtcattggtccctatgga

SEQ ID NO: 77667 - DNA, 25 bp, Mus musculus
aatcgatgtgcgcttggaccgcaat

SEQ ID NO: 77668 - DNA, 25 bp, Mus musculus
aatcgatgtgcggttggaccgcaat

SEQ ID NO: 77669 - DNA, 25 bp, Mus musculus
aatcgattcccaaggcaggtctatc

SEQ ID NO: 77670 - DNA, 25 bp, Mus musculus
aatcgattcccatggcaggtctatc

SEQ ID NO: 77671 - DNA, 25 bp, Mus musculus
aatcgattcttacccatatttaatg

SEQ ID NO: 77672 - DNA, 25 bp, Mus musculus
aatcgattcttagccatatttaatg

SEQ ID NO: 77673 - DNA, 25 bp, Mus musculus
aatcgatttaccctgaagttcatgc

SEQ ID NO: 77674 - DNA, 25 bp, Mus musculus
aatcgatttaccgtgaagttcatgc

SEQ ID NO: 77675 - DNA, 25 bp, Mus musculus
aatcgcaatcgacggaaccgaggca

SEQ ID NO: 77676 - DNA, 25 bp, Mus musculus
aatcgcaatcgagggaaccgaggca

SEQ ID NO: 77677 - DNA, 25 bp, Mus musculus
aatcgcacagctctaaccttcagtc

SEQ ID NO: 77678 - DNA, 25 bp, Mus musculus
aatcgcacagctgtaaccttcagtc

SEQ ID NO: 77679 - DNA, 25 bp, Mus musculus
aatcgcagaaacaacgtaaggacta

SEQ ID NO: 77680 - DNA, 25 bp, Mus musculus
aatcgcagaaactacgtaaggacta

SEQ ID NO: 77681 - DNA, 25 bp, Mus musculus
aatcgcagagcactttccaagttga

SEQ ID NO: 77682 - DNA, 25 bp, Mus musculus
aatcgcagagcagtttccaagttga

SEQ ID NO: 77683 - DNA, 25 bp, Mus musculus
aatcgcagcggtctccttttgattt

SEQ ID NO: 77684 - DNA, 25 bp, Mus musculus
aatcgcagcggtgtccttttgattt

SEQ ID NO: 77685 - DNA, 25 bp, Mus musculus
aatcgcagggcgcacctataatgac

SEQ ID NO: 77686 - DNA, 25 bp, Mus musculus
aatcgcagggcggacctataatgac

SEQ ID NO: 77687 - DNA, 25 bp, Mus musculus
aatcgcataatcacactttcacaga

SEQ ID NO: 77688 - DNA, 25 bp, Mus musculus
aatcgcataatctcactttcacaga

SEQ ID NO: 77689 - DNA, 25 bp, Mus musculus
aatcgcatactgaagcgcaaccaat

SEQ ID NO: 77690 - DNA, 25 bp, Mus musculus
aatcgcatactgtagcgcaaccaat

SEQ ID NO: 77691 - DNA, 25 bp, Mus musculus
aatcgcatagcccatttagtccagc

SEQ ID NO: 77692 - DNA, 25 bp, Mus musculus
aatcgcatagccgatttagtccagc

SEQ ID NO: 77693 - DNA, 25 bp, Mus musculus
aatcgcatcagtagccgacgccgaa

SEQ ID NO: 77694 - DNA, 25 bp, Mus musculus
aatcgcatcagttgccgacgccgaa

SEQ ID NO: 77695 - DNA, 25 bp, Mus musculus
aatcgcatcgttctcagtcggtata

SEQ ID NO: 77696 - DNA, 25 bp, Mus musculus
aatcgcatcgttgtcagtcggtata

SEQ ID NO: 77697 - DNA, 25 bp, Mus musculus
aatcgcatgaatacagcttctaagg

SEQ ID NO: 77698 - DNA, 25 bp, Mus musculus
aatcgcatgaattcagcttctaagg

SEQ ID NO: 77699 - DNA, 25 bp, Mus musculus
aatcgcatgcgccaaagccgcagtg

SEQ ID NO: 77700 - DNA, 25 bp, Mus musculus
aatcgcatgcgcgaaagccgcagtg

SEQ ID NO: 77701 - DNA, 25 bp, Mus musculus
aatcgcatgggtatttctgcagctt

SEQ ID NO: 77702 - DNA, 25 bp, Mus musculus
aatcgcatgggtttttctgcagctt

SEQ ID NO: 77703 - DNA, 25 bp, Mus musculus
aatcgcatgtgtcccgccagtaatc

SEQ ID NO: 77704 - DNA, 25 bp, Mus musculus
aatcgcatgtgtgccgccagtaatc

SEQ ID NO: 77705 - DNA, 25 bp, Mus musculus
aatcgcattgcaagaggaaccaggc

SEQ ID NO: 77706 - DNA, 25 bp, Mus musculus
aatcgcattgcatgaggaaccaggc

SEQ ID NO: 77707 - DNA, 25 bp, Mus musculus
aatcgcattgggaagccaggacaat

SEQ ID NO: 77708 - DNA, 25 bp, Mus musculus
aatcgcattgggtagccaggacaat

SEQ ID NO: 77709 - DNA, 25 bp, Mus musculus
aatcgccaaattcttgctccaaacc

SEQ ID NO: 77710 - DNA, 25 bp, Mus musculus
aatcgccaaattgttgctccaaacc

SEQ ID NO: 77711 - DNA, 25 bp, Mus musculus
aatcgccacaggagagtgcgggcca

SEQ ID NO: 77712 - DNA, 25 bp, Mus musculus
aatcgccacaggtgagtgcgggcca

SEQ ID NO: 77713 - DNA, 25 bp, Mus musculus
aatcgccagcttatatctgatatac

SEQ ID NO: 77714 - DNA, 25 bp, Mus musculus
aatcgccagcttttatctgatatac

SEQ ID NO: 77715 - DNA, 25 bp, Mus musculus
aatcgccaggttctacaagctgcac

SEQ ID NO: 77716 - DNA, 25 bp, Mus musculus
aatcgccaggttgtacaagctgcac

SEQ ID NO: 77717 - DNA, 25 bp, Mus musculus
aatcgccatagtatgggctacagga

SEQ ID NO: 77718 - DNA, 25 bp, Mus musculus
aatcgccatagtttgggctacagga

SEQ ID NO: 77719 - DNA, 25 bp, Mus musculus
aatcgccatggcagtccttggatat

SEQ ID NO: 77720 - DNA, 25 bp, Mus musculus
aatcgccatggctgtccttggatat

SEQ ID NO: 77721 - DNA, 25 bp, Mus musculus
aatcgcccgtacagagcgccggcgg

SEQ ID NO: 77722 - DNA, 25 bp, Mus musculus
aatcgcccgtactgagcgccggcgg

SEQ ID NO: 77723 - DNA, 25 bp, Mus musculus
aatcgcccgtcaatctgtcattaaa

SEQ ID NO: 77724 - DNA, 25 bp, Mus musculus
aatcgcccgtcattctgtcattaaa

SEQ ID NO: 77725 - DNA, 25 bp, Mus musculus
aatcgccctcacagacacactagag

SEQ ID NO: 77726 - DNA, 25 bp, Mus musculus
aatcgccctcactgacacactagag

SEQ ID NO: 77727 - DNA, 25 bp, Mus musculus
aatcgccgcgccaagtggaagaagc

SEQ ID NO: 77728 - DNA, 25 bp, Mus musculus
aatcgccgcgcctagtggaagaagc

SEQ ID NO: 77729 - DNA, 25 bp, Mus musculus
aatcgcctggttaataatgctaaca

SEQ ID NO: 77730 - DNA, 25 bp, Mus musculus
aatcgcctggtttataatgctaaca

SEQ ID NO: 77731 - DNA, 25 bp, Mus musculus
aatcgccttatgacactgtgggttc

SEQ ID NO: 77732 - DNA, 25 bp, Mus musculus
aatcgccttatgtcactgtgggttc

SEQ ID NO: 77733 - DNA, 25 bp, Mus musculus
aatcgccttccacctagaccgaaga

SEQ ID NO: 77734 - DNA, 25 bp, Mus musculus
aatcgccttccagctagaccgaaga

SEQ ID NO: 77735 - DNA, 25 bp, Mus musculus
aatcgcgaacagacacatttagtgc

SEQ ID NO: 77736 - DNA, 25 bp, Mus musculus
aatcgcgaacagtcacatttagtgc

SEQ ID NO: 77737 - DNA, 25 bp, Mus musculus
aatcgcgcttctagaagacctatgt

SEQ ID NO: 77738 - DNA, 25 bp, Mus musculus
aatcgcgcttcttgaagacctatgt

SEQ ID NO: 77739 - DNA, 25 bp, Mus musculus
aatcgcgtctcgcttttgggaatat

SEQ ID NO: 77740 - DNA, 25 bp, Mus musculus
aatcgcgtctcggttttgggaatat

SEQ ID NO: 77741 - DNA, 25 bp, Mus musculus
aatcgcgtggctaatgtttgtcccg

SEQ ID NO: 77742 - DNA, 25 bp, Mus musculus
aatcgcgtggcttatgtttgtcccg

SEQ ID NO: 77743 - DNA, 25 bp, Mus musculus
aatcgcgttcataaagcagagctat

SEQ ID NO: 77744 - DNA, 25 bp, Mus musculus
aatcgcgttcattaagcagagctat

SEQ ID NO: 77745 - DNA, 25 bp, Mus musculus
aatcgctactatctgtccaagggcc

SEQ ID NO: 77746 - DNA, 25 bp, Mus musculus
aatcgctactatgtgtccaagggcc

SEQ ID NO: 77747 - DNA, 25 bp, Mus musculus
aatcgctactctactctctgaattg

SEQ ID NO: 77748 - DNA, 25 bp, Mus musculus
aatcgctactcttctctctgaattg

SEQ ID NO: 77749 - DNA, 25 bp, Mus musculus
aatcgctagtttctttgggacctgc

SEQ ID NO: 77750 - DNA, 25 bp, Mus musculus
aatcgctagtttgtttgggacctgc

SEQ ID NO: 77751 - DNA, 25 bp, Mus musculus
aatcgctatactacatctctatgag

SEQ ID NO: 77752 - DNA, 25 bp, Mus musculus
aatcgctatacttcatctctatgag

SEQ ID NO: 77753 - DNA, 25 bp, Mus musculus
aatcgctgcactcgatgccgagaat

SEQ ID NO: 77754 - DNA, 25 bp, Mus musculus
aatcgctgcactggatgccgagaat

SEQ ID NO: 77755 - DNA, 25 bp, Mus musculus
aatcgctgtgtgagggcatcacggc

SEQ ID NO: 77756 - DNA, 25 bp, Mus musculus
aatcgctgtgtgtgggcatcacggc

SEQ ID NO: 77757 - DNA, 25 bp, Mus musculus
aatcgctgtgttatgacatctcgcc

SEQ ID NO: 77758 - DNA, 25 bp, Mus musculus
aatcgctgtgttttgacatctcgcc

SEQ ID NO: 77759 - DNA, 25 bp, Mus musculus
aatcgcttagttctggacgtgtata

SEQ ID NO: 77760 - DNA, 25 bp, Mus musculus
aatcgcttagttgtggacgtgtata

SEQ ID NO: 77761 - DNA, 25 bp, Mus musculus
aatcgcttattcactgttatgagac

SEQ ID NO: 77762 - DNA, 25 bp, Mus musculus
aatcgcttattctctgttatgagac

SEQ ID NO: 77763 - DNA, 25 bp, Mus musculus
aatcgcttccccagcttgcgagtaa

SEQ ID NO: 77764 - DNA, 25 bp, Mus musculus
aatcgcttcccctgcttgcgagtaa

SEQ ID NO: 77765 - DNA, 25 bp, Mus musculus
aatcgcttggtcattgagctcactg

SEQ ID NO: 77766 - DNA, 25 bp, Mus musculus
aatcgcttggtctttgagctcactg

SEQ ID NO: 77767 - DNA, 25 bp, Mus musculus
aatcgctttgatcttgaactttaca

SEQ ID NO: 77768 - DNA, 25 bp, Mus musculus
aatcgctttgatgttgaactttaca

SEQ ID NO: 77769 - DNA, 25 bp, Mus musculus
aatcgctttgttctgaagacatcgt

SEQ ID NO: 77770 - DNA, 25 bp, Mus musculus
aatcgctttgttgtgaagacatcgt

SEQ ID NO: 77771 - DNA, 25 bp, Mus musculus
aatcggaacacaatcagctgctggg

SEQ ID NO: 77772 - DNA, 25 bp, Mus musculus
aatcggaacacattcagctgctggg

SEQ ID NO: 77773 - DNA, 25 bp, Mus musculus
aatcggaatcctatctactcactac

SEQ ID NO: 77774 - DNA, 25 bp, Mus musculus
aatcggaatcctttctactcactac

SEQ ID NO: 77775 - DNA, 25 bp, Mus musculus
aatcggacatctccagcgctggtgg

SEQ ID NO: 77776 - DNA, 25 bp, Mus musculus
aatcggacatctgcagcgctggtgg

SEQ ID NO: 77777 - DNA, 25 bp, Mus musculus
aatcggacctagagggacctcctat

SEQ ID NO: 77778 - DNA, 25 bp, Mus musculus
aatcggacctagtgggacctcctat

SEQ ID NO: 77779 - DNA, 25 bp, Mus musculus
aatcggactgccaaatttcaccggt

SEQ ID NO: 77780 - DNA, 25 bp, Mus musculus
aatcggactgcctaatttcaccggt

SEQ ID NO: 77781 - DNA, 25 bp, Mus musculus
aatcggagaacaaattgctgtcagc

SEQ ID NO: 77782 - DNA, 25 bp, Mus musculus
aatcggagaacatattgctgtcagc

SEQ ID NO: 77783 - DNA, 25 bp, Mus musculus
aatcggagccctccctagagacgga

SEQ ID NO: 77784 - DNA, 25 bp, Mus musculus
aatcggagccctgcctagagacgga

SEQ ID NO: 77785 - DNA, 25 bp, Mus musculus
aatcggagtgagctcttgcgtcgta

SEQ ID NO: 77786 - DNA, 25 bp, Mus musculus
aatcggagtgaggtcttgcgtcgta

SEQ ID NO: 77787 - DNA, 25 bp, Mus musculus
aatcggagtggccttacctccagct

SEQ ID NO: 77788 - DNA, 25 bp, Mus musculus
aatcggagtggcgttacctccagct

SEQ ID NO: 77789 - DNA, 25 bp, Mus musculus
aatcggcaaaggaacacagcgggaa

SEQ ID NO: 77790 - DNA, 25 bp, Mus musculus
aatcggcaaaggtacacagcgggaa

SEQ ID NO: 77791 - DNA, 25 bp, Mus musculus
aatcggcaactaagaccaactccat

SEQ ID NO: 77792 - DNA, 25 bp, Mus musculus
aatcggcaactatgaccaactccat

SEQ ID NO: 77793 - DNA, 25 bp, Mus musculus
aatcggcaagtaaacattccctgag

SEQ ID NO: 77794 - DNA, 25 bp, Mus musculus
aatcggcaagtatacattccctgag

SEQ ID NO: 77795 - DNA, 25 bp, Mus musculus
aatcggcatgatcgacaagctgctg

SEQ ID NO: 77796 - DNA, 25 bp, Mus musculus
aatcggcatgatggacaagctgctg

SEQ ID NO: 77797 - DNA, 25 bp, Mus musculus
aatcggcccctgaaaagcagtcaaa

SEQ ID NO: 77798 - DNA, 25 bp, Mus musculus
aatcggcccctgtaaagcagtcaaa

SEQ ID NO: 77799 - DNA, 25 bp, Mus musculus
aatcggcccttaccagaaactatcg

SEQ ID NO: 77800 - DNA, 25 bp, Mus musculus
aatcggcccttagcagaaactatcg

SEQ ID NO: 77801 - DNA, 25 bp, Mus musculus
aatcggcccttgcaggtacacatgc

SEQ ID NO: 77802 - DNA, 25 bp, Mus musculus
aatcggcccttggaggtacacatgc

SEQ ID NO: 77803 - DNA, 25 bp, Mus musculus
aatcggcctagtcggcttgtgttca

SEQ ID NO: 77804 - DNA, 25 bp, Mus musculus
aatcggcctagtgggcttgtgttca

SEQ ID NO: 77805 - DNA, 25 bp, Mus musculus
aatcggcctgtgagaatacaataca

SEQ ID NO: 77806 - DNA, 25 bp, Mus musculus
aatcggcctgtgtgaatacaataca

SEQ ID NO: 77807 - DNA, 25 bp, Mus musculus
aatcggcgattgactcaattcccac

SEQ ID NO: 77808 - DNA, 25 bp, Mus musculus
aatcggcgattgtctcaattcccac

SEQ ID NO: 77809 - DNA, 25 bp, Mus musculus
aatcggctactacaatctgctgtgg

SEQ ID NO: 77810 - DNA, 25 bp, Mus musculus
aatcggctactagaatctgctgtgg

SEQ ID NO: 77811 - DNA, 25 bp, Mus musculus
aatcggctgcacatgtggcttccag

SEQ ID NO: 77812 - DNA, 25 bp, Mus musculus
aatcggctgcacttgtggcttccag

SEQ ID NO: 77813 - DNA, 25 bp, Mus musculus
aatcggctgtcacaggtgcaggcct

SEQ ID NO: 77814 - DNA, 25 bp, Mus musculus
aatcggctgtcagaggtgcaggcct

SEQ ID NO: 77815 - DNA, 25 bp, Mus musculus
aatcgggacttaccttagatctcac

SEQ ID NO: 77816 - DNA, 25 bp, Mus musculus
aatcgggacttagcttagatctcac

SEQ ID NO: 77817 - DNA, 25 bp, Mus musculus
aatcgggaggtcagctatgtcctat

SEQ ID NO: 77818 - DNA, 25 bp, Mus musculus
aatcgggaggtctgctatgtcctat

SEQ ID NO: 77819 - DNA, 25 bp, Mus musculus
aatcgggcactcagtattcattaag

SEQ ID NO: 77820 - DNA, 25 bp, Mus musculus
aatcgggcactctgtattcattaag

SEQ ID NO: 77821 - DNA, 25 bp, Mus musculus
aatcgggcagatctagttttctaat

SEQ ID NO: 77822 - DNA, 25 bp, Mus musculus
aatcgggcagatgtagttttctaat

SEQ ID NO: 77823 - DNA, 25 bp, Mus musculus
aatcgggccactattgaagcgacgc

SEQ ID NO: 77824 - DNA, 25 bp, Mus musculus
aatcgggccacttttgaagcgacgc

SEQ ID NO: 77825 - DNA, 25 bp, Mus musculus
aatcggggcatccacgcggaagaca

SEQ ID NO: 77826 - DNA, 25 bp, Mus musculus
aatcggggcatcgacgcggaagaca

SEQ ID NO: 77827 - DNA, 25 bp, Mus musculus
aatcgggtcacacgagacccctgat

SEQ ID NO: 77828 - DNA, 25 bp, Mus musculus
aatcgggtcacaggagacccctgat

SEQ ID NO: 77829 - DNA, 25 bp, Mus musculus
aatcgggtcttcaatggaaactcag

SEQ ID NO: 77830 - DNA, 25 bp, Mus musculus
aatcgggtcttctatggaaactcag

SEQ ID NO: 77831 - DNA, 25 bp, Mus musculus
aatcgggttgtccaaatcctcttga

SEQ ID NO: 77832 - DNA, 25 bp, Mus musculus
aatcgggttgtcgaaatcctcttga

SEQ ID NO: 77833 - DNA, 25 bp, Mus musculus
aatcggtacaaccatagtcctagta

SEQ ID NO: 77834 - DNA, 25 bp, Mus musculus
aatcggtacaacgatagtcctagta

SEQ ID NO: 77835 - DNA, 25 bp, Mus musculus
aatcggtacgatattctgttcctgt

SEQ ID NO: 77836 - DNA, 25 bp, Mus musculus
aatcggtacgattttctgttcctgt

SEQ ID NO: 77837 - DNA, 25 bp, Mus musculus
aatcggtacttgaagacagttttga

SEQ ID NO: 77838 - DNA, 25 bp, Mus musculus
aatcggtacttgtagacagttttga

SEQ ID NO: 77839 - DNA, 25 bp, Mus musculus
aatcggtattctatatggtgtgact

SEQ ID NO: 77840 - DNA, 25 bp, Mus musculus
aatcggtattctttatggtgtgact

SEQ ID NO: 77841 - DNA, 25 bp, Mus musculus
aatcggtggctccatcagggagact

SEQ ID NO: 77842 - DNA, 25 bp, Mus musculus
aatcggtggctcgatcagggagact

SEQ ID NO: 77843 - DNA, 25 bp, Mus musculus
aatcggtgtggaatgcccactttga

SEQ ID NO: 77844 - DNA, 25 bp, Mus musculus
aatcggtgtggattgcccactttga

SEQ ID NO: 77845 - DNA, 25 bp, Mus musculus
aatcggttcactctatgcttaataa

SEQ ID NO: 77846 - DNA, 25 bp, Mus musculus
aatcggttcactgtatgcttaataa

SEQ ID NO: 77847 - DNA, 25 bp, Mus musculus
aatcggttgctgctgagtgcagatc

SEQ ID NO: 77848 - DNA, 25 bp, Mus musculus
aatcggttgctggtgagtgcagatc

SEQ ID NO: 77849 - DNA, 25 bp, Mus musculus
aatcggttggaaactttgtagatca

SEQ ID NO: 77850 - DNA, 25 bp, Mus musculus
aatcggttggaatctttgtagatca

SEQ ID NO: 77851 - DNA, 25 bp, Mus musculus
aatcggtttgatagagtgggctctg

SEQ ID NO: 77852 - DNA, 25 bp, Mus musculus
aatcggtttgattgagtgggctctg

SEQ ID NO: 77853 - DNA, 25 bp, Mus musculus
aatcgtaaagtactggctgccgcca

SEQ ID NO: 77854 - DNA, 25 bp, Mus musculus
aatcgtaaagtagtggctgccgcca

SEQ ID NO: 77855 - DNA, 25 bp, Mus musculus
aatcgtagactcagcatctcatgac

SEQ ID NO: 77856 - DNA, 25 bp, Mus musculus
aatcgtagactctgcatctcatgac

SEQ ID NO: 77857 - DNA, 25 bp, Mus musculus
aatcgtagagctacctatggtcgaa

SEQ ID NO: 77858 - DNA, 25 bp, Mus musculus
aatcgtagagcttcctatggtcgaa

SEQ ID NO: 77859 - DNA, 25 bp, Mus musculus
aatcgtagcctgctgacactaagga

SEQ ID NO: 77860 - DNA, 25 bp, Mus musculus
aatcgtagcctggtgacactaagga

SEQ ID NO: 77861 - DNA, 25 bp, Mus musculus
aatcgtaggaggctttcacacactg

SEQ ID NO: 77862 - DNA, 25 bp, Mus musculus
aatcgtaggagggtttcacacactg

SEQ ID NO: 77863 - DNA, 25 bp, Mus musculus
aatcgtagttttctctgctttgagt

SEQ ID NO: 77864 - DNA, 25 bp, Mus musculus
aatcgtagttttgtctgctttgagt

SEQ ID NO: 77865 - DNA, 25 bp, Mus musculus
aatcgtatagcgacggccggtgtgt

SEQ ID NO: 77866 - DNA, 25 bp, Mus musculus
aatcgtatagcgtcggccggtgtgt

SEQ ID NO: 77867 - DNA, 25 bp, Mus musculus
aatcgtatgattcacctcatcttta

SEQ ID NO: 77868 - DNA, 25 bp, Mus musculus
aatcgtatgattgacctcatcttta

SEQ ID NO: 77869 - DNA, 25 bp, Mus musculus
aatcgtatggtgcttttactctgta

SEQ ID NO: 77870 - DNA, 25 bp, Mus musculus
aatcgtatggtggttttactctgta

SEQ ID NO: 77871 - DNA, 25 bp, Mus musculus
aatcgtatgtctctgcaggtttaac

SEQ ID NO: 77872 - DNA, 25 bp, Mus musculus
aatcgtatgtctgtgcaggtttaac

SEQ ID NO: 77873 - DNA, 25 bp, Mus musculus
aatcgtatttttcatcagcttccca

SEQ ID NO: 77874 - DNA, 25 bp, Mus musculus
aatcgtatttttgatcagcttccca

SEQ ID NO: 77875 - DNA, 25 bp, Mus musculus
aatcgtcatgaacacatttgtagag

SEQ ID NO: 77876 - DNA, 25 bp, Mus musculus
aatcgtcatgaagacatttgtagag

SEQ ID NO: 77877 - DNA, 25 bp, Mus musculus
aatcgtcctcccattttatattata

SEQ ID NO: 77878 - DNA, 25 bp, Mus musculus
aatcgtcctccctttttatattata

SEQ ID NO: 77879 - DNA, 25 bp, Mus musculus
aatcgtcctgccaaattatgaaatg

SEQ ID NO: 77880 - DNA, 25 bp, Mus musculus
aatcgtcctgcctaattatgaaatg

SEQ ID NO: 77881 - DNA, 25 bp, Mus musculus
aatcgtcgcagtctttcctgctttg

SEQ ID NO: 77882 - DNA, 25 bp, Mus musculus
aatcgtcgcagtgtttcctgctttg

SEQ ID NO: 77883 - DNA, 25 bp, Mus musculus
aatcgtcgttgcatctcacaacatc

SEQ ID NO: 77884 - DNA, 25 bp, Mus musculus
aatcgtcgttgcttctcacaacatc

SEQ ID NO: 77885 - DNA, 25 bp, Mus musculus
aatcgtctacatccattgacctatg

SEQ ID NO: 77886 - DNA, 25 bp, Mus musculus
aatcgtctacatgcattgacctatg

SEQ ID NO: 77887 - DNA, 25 bp, Mus musculus
aatcgtctatgccacctaggagcta

SEQ ID NO: 77888 - DNA, 25 bp, Mus musculus
aatcgtctatgcgacctaggagcta

SEQ ID NO: 77889 - DNA, 25 bp, Mus musculus
aatcgtctcatgcatctacagctct

SEQ ID NO: 77890 - DNA, 25 bp, Mus musculus
aatcgtctcatggatctacagctct

SEQ ID NO: 77891 - DNA, 25 bp, Mus musculus
aatcgtctctatagcctccgaggag

SEQ ID NO: 77892 - DNA, 25 bp, Mus musculus
aatcgtctctattgcctccgaggag

SEQ ID NO: 77893 - DNA, 25 bp, Mus musculus
aatcgtctgacaccagtgggacaca

SEQ ID NO: 77894 - DNA, 25 bp, Mus musculus
aatcgtctgacagcagtgggacaca

SEQ ID NO: 77895 - DNA, 25 bp, Mus musculus
aatcgtctgatgctctgtatggaag

SEQ ID NO: 77896 - DNA, 25 bp, Mus musculus
aatcgtctgatggtctgtatggaag

SEQ ID NO: 77897 - DNA, 25 bp, Mus musculus
aatcgtctgcataagttcgggtcct

SEQ ID NO: 77898 - DNA, 25 bp, Mus musculus
aatcgtctgcattagttcgggtcct

SEQ ID NO: 77899 - DNA, 25 bp, Mus musculus
aatcgtgaaatgatggcaccctaga

SEQ ID NO: 77900 - DNA, 25 bp, Mus musculus
aatcgtgaaatgttggcaccctaga

SEQ ID NO: 77901 - DNA, 25 bp, Mus musculus
aatcgtgaaggccaagcatctgcag

SEQ ID NO: 77902 - DNA, 25 bp, Mus musculus
aatcgtgaaggcgaagcatctgcag

SEQ ID NO: 77903 - DNA, 25 bp, Mus musculus
aatcgtgagaggacgtgctgcccag

SEQ ID NO: 77904 - DNA, 25 bp, Mus musculus
aatcgtgagaggtcgtgctgcccag

SEQ ID NO: 77905 - DNA, 25 bp, Mus musculus
aatcgtgatcgcaccatatactgtt

SEQ ID NO: 77906 - DNA, 25 bp, Mus musculus
aatcgtgatcgctccatatactgtt

SEQ ID NO: 77907 - DNA, 25 bp, Mus musculus
aatcgtgatcggaggacttacatcc

SEQ ID NO: 77908 - DNA, 25 bp, Mus musculus
aatcgtgatcggtggacttacatcc

SEQ ID NO: 77909 - DNA, 25 bp, Mus musculus
aatcgtgattctcttctccgaaacc

SEQ ID NO: 77910 - DNA, 25 bp, Mus musculus
aatcgtgattctgttctccgaaacc

SEQ ID NO: 77911 - DNA, 25 bp, Mus musculus
aatcgtgcatttatacttctgtgta

SEQ ID NO: 77912 - DNA, 25 bp, Mus musculus
aatcgtgcatttttacttctgtgta

SEQ ID NO: 77913 - DNA, 25 bp, Mus musculus
aatcgtgcgtggctacaaatgggct

SEQ ID NO: 77914 - DNA, 25 bp, Mus musculus
aatcgtgcgtgggtacaaatgggct

SEQ ID NO: 77915 - DNA, 25 bp, Mus musculus
aatcgtgctaataatggttttcatt

SEQ ID NO: 77916 - DNA, 25 bp, Mus musculus
aatcgtgctaattatggttttcatt

SEQ ID NO: 77917 - DNA, 25 bp, Mus musculus
aatcgtggaacactgcgtcctcgag

SEQ ID NO: 77918 - DNA, 25 bp, Mus musculus
aatcgtggaacagtgcgtcctcgag

SEQ ID NO: 77919 - DNA, 25 bp, Mus musculus
aatcgtggaggcagcatacttcatt

SEQ ID NO: 77920 - DNA, 25 bp, Mus musculus
aatcgtggaggctgcatacttcatt

SEQ ID NO: 77921 - DNA, 25 bp, Mus musculus
aatcgtggccagaaactgatcctaa

SEQ ID NO: 77922 - DNA, 25 bp, Mus musculus
aatcgtggccagtaactgatcctaa

SEQ ID NO: 77923 - DNA, 25 bp, Mus musculus
aatcgtgggatgatggacttcattt

SEQ ID NO: 77924 - DNA, 25 bp, Mus musculus
aatcgtgggatgttggacttcattt

SEQ ID NO: 77925 - DNA, 25 bp, Mus musculus
aatcgtgggctccatgagcagcaca

SEQ ID NO: 77926 - DNA, 25 bp, Mus musculus
aatcgtgggctcgatgagcagcaca

SEQ ID NO: 77927 - DNA, 25 bp, Mus musculus
aatcgtgggtgaaatgacgttgccg

SEQ ID NO: 77928 - DNA, 25 bp, Mus musculus
aatcgtgggtgatatgacgttgccg

SEQ ID NO: 77929 - DNA, 25 bp, Mus musculus
aatcgtggtcctctggacaagtgga

SEQ ID NO: 77930 - DNA, 25 bp, Mus musculus
aatcgtggtcctgtggacaagtgga

SEQ ID NO: 77931 - DNA, 25 bp, Mus musculus
aatcgtggtctgaaaagaaagtgat

SEQ ID NO: 77932 - DNA, 25 bp, Mus musculus
aatcgtggtctgtaaagaaagtgat

SEQ ID NO: 77933 - DNA, 25 bp, Mus musculus
aatcgtggtcttcttataccagcat

SEQ ID NO: 77934 - DNA, 25 bp, Mus musculus
aatcgtggtcttgttataccagcat

SEQ ID NO: 77935 - DNA, 25 bp, Mus musculus
aatcgtggtttcatacttggtatta

SEQ ID NO: 77936 - DNA, 25 bp, Mus musculus
aatcgtggtttcttacttggtatta

SEQ ID NO: 77937 - DNA, 25 bp, Mus musculus
aatcgtgtcattataggtctctgga

SEQ ID NO: 77938 - DNA, 25 bp, Mus musculus
aatcgtgtcattttaggtctctgga

SEQ ID NO: 77939 - DNA, 25 bp, Mus musculus
aatcgtgtccagagaaagatgcaga

SEQ ID NO: 77940 - DNA, 25 bp, Mus musculus
aatcgtgtccagtgaaagatgcaga

SEQ ID NO: 77941 - DNA, 25 bp, Mus musculus
aatcgtgtcttacgcatttgcgctc

SEQ ID NO: 77942 - DNA, 25 bp, Mus musculus
aatcgtgtcttaggcatttgcgctc

SEQ ID NO: 77943 - DNA, 25 bp, Mus musculus
aatcgtgtgtgtctttttactccta

SEQ ID NO: 77944 - DNA, 25 bp, Mus musculus
aatcgtgtgtgtgtttttactccta

SEQ ID NO: 77945 - DNA, 25 bp, Mus musculus
aatcgtgttccaagagcactttgta

SEQ ID NO: 77946 - DNA, 25 bp, Mus musculus
aatcgtgttccatgagcactttgta

SEQ ID NO: 77947 - DNA, 25 bp, Mus musculus
aatcgttaactgagagacgctgtaa

SEQ ID NO: 77948 - DNA, 25 bp, Mus musculus
aatcgttaactgtgagacgctgtaa

SEQ ID NO: 77949 - DNA, 25 bp, Mus musculus
aatcgttaagcaagggtggtgactc

SEQ ID NO: 77950 - DNA, 25 bp, Mus musculus
aatcgttaagcatgggtggtgactc

SEQ ID NO: 77951 - DNA, 25 bp, Mus musculus
aatcgttatcatccgagcaccaaac

SEQ ID NO: 77952 - DNA, 25 bp, Mus musculus
aatcgttatcatgcgagcaccaaac

SEQ ID NO: 77953 - DNA, 25 bp, Mus musculus
aatcgttgaactaggctgttgttac

SEQ ID NO: 77954 - DNA, 25 bp, Mus musculus
aatcgttgaacttggctgttgttac

SEQ ID NO: 77955 - DNA, 25 bp, Mus musculus
aatcgttgtagtcacgggttcagaa

SEQ ID NO: 77956 - DNA, 25 bp, Mus musculus
aatcgttgtagtgacgggttcagaa

SEQ ID NO: 77957 - DNA, 25 bp, Mus musculus
aatcgtttcatcattcggcgtgcga

SEQ ID NO: 77958 - DNA, 25 bp, Mus musculus
aatcgtttcatctttcggcgtgcga

SEQ ID NO: 77959 - DNA, 25 bp, Mus musculus
aatcgtttctcaaatgaatctgatc

SEQ ID NO: 77960 - DNA, 25 bp, Mus musculus
aatcgtttctcatatgaatctgatc

SEQ ID NO: 77961 - DNA, 25 bp, Mus musculus
aatcgtttctgcctctcatttcttc

SEQ ID NO: 77962 - DNA, 25 bp, Mus musculus
aatcgtttctgcgtctcatttcttc

SEQ ID NO: 77963 - DNA, 25 bp, Mus musculus
aatcgtttgctcaaaggtggtttca

SEQ ID NO: 77964 - DNA, 25 bp, Mus musculus
aatcgtttgctctaaggtggtttca

SEQ ID NO: 77965 - DNA, 25 bp, Mus musculus
aatcgtttgtatcgtctcatgtcaa

SEQ ID NO: 77966 - DNA, 25 bp, Mus musculus
aatcgtttgtatggtctcatgtcaa

SEQ ID NO: 77967 - DNA, 25 bp, Mus musculus
aatctaaaagctctattcaatgcaa

SEQ ID NO: 77968 - DNA, 25 bp, Mus musculus
aatctaaaagctgtattcaatgcaa

SEQ ID NO: 77969 - DNA, 25 bp, Mus musculus
aatctaaaggtcatacccggcaagc

SEQ ID NO: 77970 - DNA, 25 bp, Mus musculus
aatctaaaggtcttacccggcaagc

SEQ ID NO: 77971 - DNA, 25 bp, Mus musculus
aatctaaataatacaccctgttggt

SEQ ID NO: 77972 - DNA, 25 bp, Mus musculus
aatctaaataattcaccctgttggt

SEQ ID NO: 77973 - DNA, 25 bp, Mus musculus
aatctaaatcctcccatatttgcca

SEQ ID NO: 77974 - DNA, 25 bp, Mus musculus
aatctaaatcctgccatatttgcca

SEQ ID NO: 77975 - DNA, 25 bp, Mus musculus
aatctaaattccattttcgccatcg

SEQ ID NO: 77976 - DNA, 25 bp, Mus musculus
aatctaaattcctttttcgccatcg

SEQ ID NO: 77977 - DNA, 25 bp, Mus musculus
aatctaaccattaaatcatttgtaa

SEQ ID NO: 77978 - DNA, 25 bp, Mus musculus
aatctaaccatttaatcatttgtaa

SEQ ID NO: 77979 - DNA, 25 bp, Mus musculus
aatctaagaatgcatccctgaaagg

SEQ ID NO: 77980 - DNA, 25 bp, Mus musculus
aatctaagaatggatccctgaaagg

SEQ ID NO: 77981 - DNA, 25 bp, Mus musculus
aatctaagacataccatcttgagta

SEQ ID NO: 77982 - DNA, 25 bp, Mus musculus
aatctaagacattccatcttgagta

SEQ ID NO: 77983 - DNA, 25 bp, Mus musculus
aatctaagccaaaactcccaacaag

SEQ ID NO: 77984 - DNA, 25 bp, Mus musculus
aatctaagccaatactcccaacaag

SEQ ID NO: 77985 - DNA, 25 bp, Mus musculus
aatctaagttatactcaccagccag

SEQ ID NO: 77986 - DNA, 25 bp, Mus musculus
aatctaagttatccagcaccctgta

SEQ ID NO: 77987 - DNA, 25 bp, Mus musculus
aatctaagttatgcagcaccctgta

SEQ ID NO: 77988 - DNA, 25 bp, Mus musculus
aatctaagttattctcaccagccag

SEQ ID NO: 77989 - DNA, 25 bp, Mus musculus
aatctaagttcacattcacccttgg

SEQ ID NO: 77990 - DNA, 25 bp, Mus musculus
aatctaagttcagattcacccttgg

SEQ ID NO: 77991 - DNA, 25 bp, Mus musculus
aatctaagtttacaatacacccctg

SEQ ID NO: 77992 - DNA, 25 bp, Mus musculus
aatctaagtttagaatacacccctg

SEQ ID NO: 77993 - DNA, 25 bp, Mus musculus
aatctaatggtcacttcgggcatca

SEQ ID NO: 77994 - DNA, 25 bp, Mus musculus
aatctaatggtctcttcgggcatca

SEQ ID NO: 77995 - DNA, 25 bp, Mus musculus
aatctaattcacaactctggacaag

SEQ ID NO: 77996 - DNA, 25 bp, Mus musculus
aatctaattcactactctggacaag

SEQ ID NO: 77997 - DNA, 25 bp, Mus musculus
aatctacacctgcacacttttactt

SEQ ID NO: 77998 - DNA, 25 bp, Mus musculus
aatctacacctggacacttttactt

SEQ ID NO: 77999 - DNA, 25 bp, Mus musculus
aatctacacttcatagggtcagtac

SEQ ID NO: 78000 - DNA, 25 bp, Mus musculus
aatctacacttcttagggtcagtac

SEQ ID NO: 78001 - DNA, 25 bp, Mus musculus
aatctacagggcctgagcgctggct

SEQ ID NO: 78002 - DNA, 25 bp, Mus musculus
aatctacagggcgtgagcgctggct

SEQ ID NO: 78003 - DNA, 25 bp, Mus musculus
aatctacagttgctggtcctaggcc

SEQ ID NO: 78004 - DNA, 25 bp, Mus musculus
aatctacagttggtggtcctaggcc

SEQ ID NO: 78005 - DNA, 25 bp, Mus musculus
aatctaccaactctccccttatttg

SEQ ID NO: 78006 - DNA, 25 bp, Mus musculus
aatctaccaactgtccccttatttg

SEQ ID NO: 78007 - DNA, 25 bp, Mus musculus
aatctaccagtaacccattttgtgt

SEQ ID NO: 78008 - DNA, 25 bp, Mus musculus
aatctaccagtatcccattttgtgt

SEQ ID NO: 78009 - DNA, 25 bp, Mus musculus
aatctaccgtctaacctggatgttt

SEQ ID NO: 78010 - DNA, 25 bp, Mus musculus
aatctaccgtcttacctggatgttt

SEQ ID NO: 78011 - DNA, 25 bp, Mus musculus
aatctacctggaagctcagtggaac

SEQ ID NO: 78012 - DNA, 25 bp, Mus musculus
aatctacctggatgctcagtggaac

SEQ ID NO: 78013 - DNA, 25 bp, Mus musculus
aatctacgatttctaattacctgga

SEQ ID NO: 78014 - DNA, 25 bp, Mus musculus
aatctacgatttgtaattacctgga

SEQ ID NO: 78015 - DNA, 25 bp, Mus musculus
aatctactcaaaacagtctgcgctg

SEQ ID NO: 78016 - DNA, 25 bp, Mus musculus
aatctactcaaatcagtctgcgctg

SEQ ID NO: 78017 - DNA, 25 bp, Mus musculus
aatctactcataatttcctgaccta

SEQ ID NO: 78018 - DNA, 25 bp, Mus musculus
aatctactcatattttcctgaccta

SEQ ID NO: 78019 - DNA, 25 bp, Mus musculus
aatctactctatactcattttaggc

SEQ ID NO: 78020 - DNA, 25 bp, Mus musculus
aatctactctattctcattttaggc

SEQ ID NO: 78021 - DNA, 25 bp, Mus musculus
aatctactgcttcggtctttttctc

SEQ ID NO: 78022 - DNA, 25 bp, Mus musculus
aatctactgcttgggtctttttctc

SEQ ID NO: 78023 - DNA, 25 bp, Mus musculus
aatctactgttaaaacctggtgtca

SEQ ID NO: 78024 - DNA, 25 bp, Mus musculus
aatctactgttataacctggtgtca

SEQ ID NO: 78025 - DNA, 25 bp, Mus musculus
aatctacttattaacctcagcacat

SEQ ID NO: 78026 - DNA, 25 bp, Mus musculus
aatctacttatttacctcagcacat

SEQ ID NO: 78027 - DNA, 25 bp, Mus musculus
aatctacttggtcagcagtttctct

SEQ ID NO: 78028 - DNA, 25 bp, Mus musculus
aatctacttggtgagcagtttctct

SEQ ID NO: 78029 - DNA, 25 bp, Mus musculus
aatctagaactacagtcacactttg

SEQ ID NO: 78030 - DNA, 25 bp, Mus musculus
aatctagaactagagtcacactttg

SEQ ID NO: 78031 - DNA, 25 bp, Mus musculus
aatctagacacacgacacacctgat

SEQ ID NO: 78032 - DNA, 25 bp, Mus musculus
aatctagacacaggacacacctgat

SEQ ID NO: 78033 - DNA, 25 bp, Mus musculus
aatctagactatacctttgaccaaa

SEQ ID NO: 78034 - DNA, 25 bp, Mus musculus
aatctagactattcctttgaccaaa

SEQ ID NO: 78035 - DNA, 25 bp, Mus musculus
aatctagagtcaactttgggcccgc

SEQ ID NO: 78036 - DNA, 25 bp, Mus musculus
aatctagagtcatctttgggcccgc

SEQ ID NO: 78037 - DNA, 25 bp, Mus musculus
aatctagcacagaatcttcctcgaa

SEQ ID NO: 78038 - DNA, 25 bp, Mus musculus
aatctagcacagtatcttcctcgaa

SEQ ID NO: 78039 - DNA, 25 bp, Mus musculus
aatctagcagagatgttttcaggta

SEQ ID NO: 78040 - DNA, 25 bp, Mus musculus
aatctagcagagttgttttcaggta

SEQ ID NO: 78041 - DNA, 25 bp, Mus musculus
aatctagcagcgattctcccgtact

SEQ ID NO: 78042 - DNA, 25 bp, Mus musculus
aatctagcagcgtttctcccgtact

SEQ ID NO: 78043 - DNA, 25 bp, Mus musculus
aatctagcagctcggacacttcatg

SEQ ID NO: 78044 - DNA, 25 bp, Mus musculus
aatctagcagctgggacacttcatg

SEQ ID NO: 78045 - DNA, 25 bp, Mus musculus
aatctagcattactgatactacaag

SEQ ID NO: 78046 - DNA, 25 bp, Mus musculus
aatctagcattagtgatactacaag

SEQ ID NO: 78047 - DNA, 25 bp, Mus musculus
aatctagccccacacatacagtgtt

SEQ ID NO: 78048 - DNA, 25 bp, Mus musculus
aatctagccccagacatacagtgtt

SEQ ID NO: 78049 - DNA, 25 bp, Mus musculus
aatctagctacaaactccatcggtg

SEQ ID NO: 78050 - DNA, 25 bp, Mus musculus
aatctagctacatactccatcggtg

SEQ ID NO: 78051 - DNA, 25 bp, Mus musculus
aatctagctgaccagtgtttacaat

SEQ ID NO: 78052 - DNA, 25 bp, Mus musculus
aatctagctgacgagtgtttacaat

SEQ ID NO: 78053 - DNA, 25 bp, Mus musculus
aatctagctgataaagtgtggacca

SEQ ID NO: 78054 - DNA, 25 bp, Mus musculus
aatctagctgattaagtgtggacca

SEQ ID NO: 78055 - DNA, 25 bp, Mus musculus
aatctagcttccactagaccttgag

SEQ ID NO: 78056 - DNA, 25 bp, Mus musculus
aatctagcttcctctagaccttgag

SEQ ID NO: 78057 - DNA, 25 bp, Mus musculus
aatctagctttaaagtattatttca

SEQ ID NO: 78058 - DNA, 25 bp, Mus musculus
aatctagctttatagtattatttca

SEQ ID NO: 78059 - DNA, 25 bp, Mus musculus
aatctaggaactcccacattctctg

SEQ ID NO: 78060 - DNA, 25 bp, Mus musculus
aatctaggaactgccacattctctg

SEQ ID NO: 78061 - DNA, 25 bp, Mus musculus
aatctaggacaccatctattctgcc

SEQ ID NO: 78062 - DNA, 25 bp, Mus musculus
aatctaggacacgatctattctgcc

SEQ ID NO: 78063 - DNA, 25 bp, Mus musculus
aatctaggacctcatacacacacac

SEQ ID NO: 78064 - DNA, 25 bp, Mus musculus
aatctaggacctgatacacacacac

SEQ ID NO: 78065 - DNA, 25 bp, Mus musculus
aatctaggcataaccaaccttttga

SEQ ID NO: 78066 - DNA, 25 bp, Mus musculus
aatctaggcatatccaaccttttga

SEQ ID NO: 78067 - DNA, 25 bp, Mus musculus
aatctagggactatcccttgcctgt

SEQ ID NO: 78068 - DNA, 25 bp, Mus musculus
aatctagggactttcccttgcctgt

SEQ ID NO: 78069 - DNA, 25 bp, Mus musculus
aatctagggtacaaccatccctgac

SEQ ID NO: 78070 - DNA, 25 bp, Mus musculus
aatctagggtactaccatccctgac

SEQ ID NO: 78071 - DNA, 25 bp, Mus musculus
aatctaggtgtgatgctgttgcctg

SEQ ID NO: 78072 - DNA, 25 bp, Mus musculus
aatctaggtgtgttgctgttgcctg

SEQ ID NO: 78073 - DNA, 25 bp, Mus musculus
aatctaggttggagggcaggaacta

SEQ ID NO: 78074 - DNA, 25 bp, Mus musculus
aatctaggttggtgggcaggaacta

SEQ ID NO: 78075 - DNA, 25 bp, Mus musculus
aatctagtacttacatttttgttat

SEQ ID NO: 78076 - DNA, 25 bp, Mus musculus
aatctagtactttcatttttgttat

SEQ ID NO: 78077 - DNA, 25 bp, Mus musculus
aatctagtattaacaacagtatgag

SEQ ID NO: 78078 - DNA, 25 bp, Mus musculus
aatctagtattatcaacagtatgag

SEQ ID NO: 78079 - DNA, 25 bp, Mus musculus
aatctagtcaacagactcctgccaa

SEQ ID NO: 78080 - DNA, 25 bp, Mus musculus
aatctagtcaactgactcctgccaa

SEQ ID NO: 78081 - DNA, 25 bp, Mus musculus
aatctagttcagagccaagccttaa

SEQ ID NO: 78082 - DNA, 25 bp, Mus musculus
aatctagttcagtgccaagccttaa

SEQ ID NO: 78083 - DNA, 25 bp, Mus musculus
aatctagttcccaaattggttcttg

SEQ ID NO: 78084 - DNA, 25 bp, Mus musculus
aatctagttccctaattggttcttg

SEQ ID NO: 78085 - DNA, 25 bp, Mus musculus
aatctagttctcctgcatatttgag

SEQ ID NO: 78086 - DNA, 25 bp, Mus musculus
aatctagttctcgtgcatatttgag

SEQ ID NO: 78087 - DNA, 25 bp, Mus musculus
aatctagttgtcactgggccaggac

SEQ ID NO: 78088 - DNA, 25 bp, Mus musculus
aatctagttgtctctgggccaggac

SEQ ID NO: 78089 - DNA, 25 bp, Mus musculus
aatctagtttatatgttccaatgac

SEQ ID NO: 78090 - DNA, 25 bp, Mus musculus
aatctagtttatttgttccaatgac

SEQ ID NO: 78091 - DNA, 25 bp, Mus musculus
aatctagttttacatgcctccagtc

SEQ ID NO: 78092 - DNA, 25 bp, Mus musculus
aatctagttttagatgcctccagtc

SEQ ID NO: 78093 - DNA, 25 bp, Mus musculus
aatctagttttgacttccgatctac

SEQ ID NO: 78094 - DNA, 25 bp, Mus musculus
aatctagttttgtcttccgatctac

SEQ ID NO: 78095 - DNA, 25 bp, Mus musculus
aatctatagccaaatcccttttcac

SEQ ID NO: 78096 - DNA, 25 bp, Mus musculus
aatctatagccatatcccttttcac

SEQ ID NO: 78097 - DNA, 25 bp, Mus musculus
aatctataggatcttgtgcccaaag

SEQ ID NO: 78098 - DNA, 25 bp, Mus musculus
aatctataggatgttgtgcccaaag

SEQ ID NO: 78099 - DNA, 25 bp, Mus musculus
aatctatatagccagccctctggac

SEQ ID NO: 78100 - DNA, 25 bp, Mus musculus
aatctatatagcgagccctctggac

SEQ ID NO: 78101 - DNA, 25 bp, Mus musculus
aatctatatgcacctgagccttgag

SEQ ID NO: 78102 - DNA, 25 bp, Mus musculus
aatctatatgcagctgagccttgag

SEQ ID NO: 78103 - DNA, 25 bp, Mus musculus
aatctatcaagcagaagagtgaatt

SEQ ID NO: 78104 - DNA, 25 bp, Mus musculus
aatctatcaagctgaagagtgaatt

SEQ ID NO: 78105 - DNA, 25 bp, Mus musculus
aatctatcaatccacccatcacatt

SEQ ID NO: 78106 - DNA, 25 bp, Mus musculus
aatctatcaatcgacccatcacatt

SEQ ID NO: 78107 - DNA, 25 bp, Mus musculus
aatctatcacagcagtgaccccact

SEQ ID NO: 78108 - DNA, 25 bp, Mus musculus
aatctatcacaggagtgaccccact

SEQ ID NO: 78109 - DNA, 25 bp, Mus musculus
aatctatcatttaactcccacattg

SEQ ID NO: 78110 - DNA, 25 bp, Mus musculus
aatctatcattttactcccacattg

SEQ ID NO: 78111 - DNA, 25 bp, Mus musculus
aatctatccatcagttgagcacctg

SEQ ID NO: 78112 - DNA, 25 bp, Mus musculus
aatctatccatcatctatcagtcat

SEQ ID NO: 78113 - DNA, 25 bp, Mus musculus
aatctatccatctgttgagcacctg

SEQ ID NO: 78114 - DNA, 25 bp, Mus musculus
aatctatccatcttctatcagtcat

SEQ ID NO: 78115 - DNA, 25 bp, Mus musculus
aatctatctcacagctgacaacctt

SEQ ID NO: 78116 - DNA, 25 bp, Mus musculus
aatctatctcactgctgacaacctt

SEQ ID NO: 78117 - DNA, 25 bp, Mus musculus
aatctatgacctagaatcggccctg

SEQ ID NO: 78118 - DNA, 25 bp, Mus musculus
aatctatgaccttgaatcggccctg

SEQ ID NO: 78119 - DNA, 25 bp, Mus musculus
aatctatgagcgctacttgccagct

SEQ ID NO: 78120 - DNA, 25 bp, Mus musculus
aatctatgagcggtacttgccagct

SEQ ID NO: 78121 - DNA, 25 bp, Mus musculus
aatctatgccttacgaactccagag

SEQ ID NO: 78122 - DNA, 25 bp, Mus musculus
aatctatgcctttcgaactccagag

SEQ ID NO: 78123 - DNA, 25 bp, Mus musculus
aatctatgctgaaccaccgaaataa

SEQ ID NO: 78124 - DNA, 25 bp, Mus musculus
aatctatgctgatccaccgaaataa

SEQ ID NO: 78125 - DNA, 25 bp, Mus musculus
aatctatgggtcaagatgttctccc

SEQ ID NO: 78126 - DNA, 25 bp, Mus musculus
aatctatgggtctagatgttctccc

SEQ ID NO: 78127 - DNA, 25 bp, Mus musculus
aatctatgtagtcttccagttgaat

SEQ ID NO: 78128 - DNA, 25 bp, Mus musculus
aatctatgtagtgttccagttgaat

SEQ ID NO: 78129 - DNA, 25 bp, Mus musculus
aatctatgtattcaccctgggtcgg

SEQ ID NO: 78130 - DNA, 25 bp, Mus musculus
aatctatgtattgaccctgggtcgg

SEQ ID NO: 78131 - DNA, 25 bp, Mus musculus
aatctattagaaagtcctcccgaag

SEQ ID NO: 78132 - DNA, 25 bp, Mus musculus
aatctattagaatgtcctcccgaag

SEQ ID NO: 78133 - DNA, 25 bp, Mus musculus
aatctattcaagacctggcctgtat

SEQ ID NO: 78134 - DNA, 25 bp, Mus musculus
aatctattcaagtcctggcctgtat

SEQ ID NO: 78135 - DNA, 25 bp, Mus musculus
aatctattcactctttcgcttattc

SEQ ID NO: 78136 - DNA, 25 bp, Mus musculus
aatctattcactgtttcgcttattc

SEQ ID NO: 78137 - DNA, 25 bp, Mus musculus
aatctattgaccaggtaccttcact

SEQ ID NO: 78138 - DNA, 25 bp, Mus musculus
aatctattgacctggtaccttcact

SEQ ID NO: 78139 - DNA, 25 bp, Mus musculus
aatctattgactattaaggtgacta

SEQ ID NO: 78140 - DNA, 25 bp, Mus musculus
aatctattgacttttaaggtgacta

SEQ ID NO: 78141 - DNA, 25 bp, Mus musculus
aatctattgtatccccgatttcctg

SEQ ID NO: 78142 - DNA, 25 bp, Mus musculus
aatctattgtatgcccgatttcctg

SEQ ID NO: 78143 - DNA, 25 bp, Mus musculus
aatctattgtggcttcttgtgtaaa

SEQ ID NO: 78144 - DNA, 25 bp, Mus musculus
aatctattgtgggttcttgtgtaaa

SEQ ID NO: 78145 - DNA, 25 bp, Mus musculus
aatctatttagcatgtgtactatgg

SEQ ID NO: 78146 - DNA, 25 bp, Mus musculus
aatctatttagcttgtgtactatgg

SEQ ID NO: 78147 - DNA, 25 bp, Mus musculus
aatctatttatgaagctctgggctg

SEQ ID NO: 78148 - DNA, 25 bp, Mus musculus
aatctatttatgtagctctgggctg

SEQ ID NO: 78149 - DNA, 25 bp, Mus musculus
aatctatttcacacctgggctatag

SEQ ID NO: 78150 - DNA, 25 bp, Mus musculus
aatctatttcactcctgggctatag

SEQ ID NO: 78151 - DNA, 25 bp, Mus musculus
aatctattttgacccactttaggga

SEQ ID NO: 78152 - DNA, 25 bp, Mus musculus
aatctattttgagccactttaggga

SEQ ID NO: 78153 - DNA, 25 bp, Mus musculus
aatctcaaaaccatgaccatcctgt

SEQ ID NO: 78154 - DNA, 25 bp, Mus musculus
aatctcaaaaccttgaccatcctgt

SEQ ID NO: 78155 - DNA, 25 bp, Mus musculus
aatctcaaagagacgaaggctagtc

SEQ ID NO: 78156 - DNA, 25 bp, Mus musculus
aatctcaaagagtcgaaggctagtc

SEQ ID NO: 78157 - DNA, 25 bp, Mus musculus
aatctcaacaagacattctacagga

SEQ ID NO: 78158 - DNA, 25 bp, Mus musculus
aatctcaacaagtcattctacagga

SEQ ID NO: 78159 - DNA, 25 bp, Mus musculus
aatctcaacagcaccttcaggactt

SEQ ID NO: 78160 - DNA, 25 bp, Mus musculus
aatctcaacagctccttcaggactt

SEQ ID NO: 78161 - DNA, 25 bp, Mus musculus
aatctcaaccttcactttgcacttc

SEQ ID NO: 78162 - DNA, 25 bp, Mus musculus
aatctcaaccttgactttgcacttc

SEQ ID NO: 78163 - DNA, 25 bp, Mus musculus
aatctcaacttaccgatttcccaca

SEQ ID NO: 78164 - DNA, 25 bp, Mus musculus
aatctcaacttagcgatttcccaca

SEQ ID NO: 78165 - DNA, 25 bp, Mus musculus
aatctcaaggcaccgctaaacgtca

SEQ ID NO: 78166 - DNA, 25 bp, Mus musculus
aatctcaaggcagcgctaaacgtca

SEQ ID NO: 78167 - DNA, 25 bp, Mus musculus
aatctcaagttaactggccgcatct

SEQ ID NO: 78168 - DNA, 25 bp, Mus musculus
aatctcaagttatctggccgcatct

SEQ ID NO: 78169 - DNA, 25 bp, Mus musculus
aatctcaatcttaaggttaccttgt

SEQ ID NO: 78170 - DNA, 25 bp, Mus musculus
aatctcaatctttaggttaccttgt

SEQ ID NO: 78171 - DNA, 25 bp, Mus musculus
aatctcaatggactggtgttgacca

SEQ ID NO: 78172 - DNA, 25 bp, Mus musculus
aatctcaatggagtggtgttgacca

SEQ ID NO: 78173 - DNA, 25 bp, Mus musculus
aatctcacaatcaaatccttcctga

SEQ ID NO: 78174 - DNA, 25 bp, Mus musculus
aatctcacaatctaatccttcctga

SEQ ID NO: 78175 - DNA, 25 bp, Mus musculus
aatctcacagatagctatgttgaaa

SEQ ID NO: 78176 - DNA, 25 bp, Mus musculus
aatctcacagattgctatgttgaaa

SEQ ID NO: 78177 - DNA, 25 bp, Mus musculus
aatctcaccctccagcagggatatg

SEQ ID NO: 78178 - DNA, 25 bp, Mus musculus
aatctcaccctcgagcagggatatg

SEQ ID NO: 78179 - DNA, 25 bp, Mus musculus
aatctcaccctgaggacgtcagaaa

SEQ ID NO: 78180 - DNA, 25 bp, Mus musculus
aatctcaccctgtggacgtcagaaa

SEQ ID NO: 78181 - DNA, 25 bp, Mus musculus
aatctcactatgaaatccctcacag

SEQ ID NO: 78182 - DNA, 25 bp, Mus musculus
aatctcactatgtaatccctcacag

SEQ ID NO: 78183 - DNA, 25 bp, Mus musculus
aatctcacttttcggtagcctattc

SEQ ID NO: 78184 - DNA, 25 bp, Mus musculus
aatctcacttttgggtagcctattc

SEQ ID NO: 78185 - DNA, 25 bp, Mus musculus
aatctcagaagactgcacaccagaa

SEQ ID NO: 78186 - DNA, 25 bp, Mus musculus
aatctcagaagagtgcacaccagaa

SEQ ID NO: 78187 - DNA, 25 bp, Mus musculus
aatctcagacctattactttcgttg

SEQ ID NO: 78188 - DNA, 25 bp, Mus musculus
aatctcagaccttttactttcgttg

SEQ ID NO: 78189 - DNA, 25 bp, Mus musculus
aatctcagagctagcaaaactgcag

SEQ ID NO: 78190 - DNA, 25 bp, Mus musculus
aatctcagagcttgcaaaactgcag

SEQ ID NO: 78191 - DNA, 25 bp, Mus musculus
aatctcagatctccatctattccga

SEQ ID NO: 78192 - DNA, 25 bp, Mus musculus
aatctcagatctgcatctattccga

SEQ ID NO: 78193 - DNA, 25 bp, Mus musculus
aatctcagcaccactccttgttgaa

SEQ ID NO: 78194 - DNA, 25 bp, Mus musculus
aatctcagcacctctccttgttgaa

SEQ ID NO: 78195 - DNA, 25 bp, Mus musculus
aatctcagcattcttcagaggccaa

SEQ ID NO: 78196 - DNA, 25 bp, Mus musculus
aatctcagcattgttcagaggccaa

SEQ ID NO: 78197 - DNA, 25 bp, Mus musculus
aatctcaggcagaatttggctccat

SEQ ID NO: 78198 - DNA, 25 bp, Mus musculus
aatctcaggcagtatttggctccat

SEQ ID NO: 78199 - DNA, 25 bp, Mus musculus
aatctcagggacacatggagtcgaa

SEQ ID NO: 78200 - DNA, 25 bp, Mus musculus
aatctcagggactcatggagtcgaa

SEQ ID NO: 78201 - DNA, 25 bp, Mus musculus
aatctcagggtcacgcgcctctggg

SEQ ID NO: 78202 - DNA, 25 bp, Mus musculus
aatctcagggtctcgcgcctctggg

SEQ ID NO: 78203 - DNA, 25 bp, Mus musculus
aatctcagtcaaattctaggttcat

SEQ ID NO: 78204 - DNA, 25 bp, Mus musculus
aatctcagtcaatttctaggttcat

SEQ ID NO: 78205 - DNA, 25 bp, Mus musculus
aatctcagtgatatatgtgtcagaa

SEQ ID NO: 78206 - DNA, 25 bp, Mus musculus
aatctcagtgatttatgtgtcagaa

SEQ ID NO: 78207 - DNA, 25 bp, Mus musculus
aatctcagtgtaactttatccctag

SEQ ID NO: 78208 - DNA, 25 bp, Mus musculus
aatctcagtgtatctttatccctag

SEQ ID NO: 78209 - DNA, 25 bp, Mus musculus
aatctcagtgttctcaacttggtca

SEQ ID NO: 78210 - DNA, 25 bp, Mus musculus
aatctcagtgttgtcaacttggtca

SEQ ID NO: 78211 - DNA, 25 bp, Mus musculus
aatctcagttttctcctgtttcagc

SEQ ID NO: 78212 - DNA, 25 bp, Mus musculus
aatctcagttttgtcctgtttcagc

SEQ ID NO: 78213 - DNA, 25 bp, Mus musculus
aatctcataagaaaggttgttttcc

SEQ ID NO: 78214 - DNA, 25 bp, Mus musculus
aatctcataagataggttgttttcc

SEQ ID NO: 78215 - DNA, 25 bp, Mus musculus
aatctcataatcattttgtctttgg

SEQ ID NO: 78216 - DNA, 25 bp, Mus musculus
aatctcataatctttttgtctttgg

SEQ ID NO: 78217 - DNA, 25 bp, Mus musculus
aatctcatcacccagtggaaggcgt

SEQ ID NO: 78218 - DNA, 25 bp, Mus musculus
aatctcatcaccgagtggaaggcgt

SEQ ID NO: 78219 - DNA, 25 bp, Mus musculus
aatctcatctaacgtcattaagctg

SEQ ID NO: 78220 - DNA, 25 bp, Mus musculus
aatctcatctaaggtcattaagctg

SEQ ID NO: 78221 - DNA, 25 bp, Mus musculus
aatctcatgtgtcgactctaagctt

SEQ ID NO: 78222 - DNA, 25 bp, Mus musculus
aatctcatgtgtctctggctgggaa

SEQ ID NO: 78223 - DNA, 25 bp, Mus musculus
aatctcatgtgtggactctaagctt

SEQ ID NO: 78224 - DNA, 25 bp, Mus musculus
aatctcatgtgtgtctggctgggaa

SEQ ID NO: 78225 - DNA, 25 bp, Mus musculus
aatctcatgttaaagcttaacagaa

SEQ ID NO: 78226 - DNA, 25 bp, Mus musculus
aatctcatgttatagcttaacagaa

SEQ ID NO: 78227 - DNA, 25 bp, Mus musculus
aatctcattcgtactgtggctagga

SEQ ID NO: 78228 - DNA, 25 bp, Mus musculus
aatctcattcgttctgtggctagga

SEQ ID NO: 78229 - DNA, 25 bp, Mus musculus
aatctcattcttaacatcatcaaaa

SEQ ID NO: 78230 - DNA, 25 bp, Mus musculus
aatctcattctttacatcatcaaaa

SEQ ID NO: 78231 - DNA, 25 bp, Mus musculus
aatctcattgagctggccgaactgg

SEQ ID NO: 78232 - DNA, 25 bp, Mus musculus
aatctcattgaggtggccgaactgg

SEQ ID NO: 78233 - DNA, 25 bp, Mus musculus
aatctcattgttcgcaactcctatg

SEQ ID NO: 78234 - DNA, 25 bp, Mus musculus
aatctcattgttctgtttcttgaat

SEQ ID NO: 78235 - DNA, 25 bp, Mus musculus
aatctcattgttggcaactcctatg

SEQ ID NO: 78236 - DNA, 25 bp, Mus musculus
aatctcattgttgtgtttcttgaat

SEQ ID NO: 78237 - DNA, 25 bp, Mus musculus
aatctcatttcacattaacgctcga

SEQ ID NO: 78238 - DNA, 25 bp, Mus musculus
aatctcatttcagattaacgctcga

SEQ ID NO: 78239 - DNA, 25 bp, Mus musculus
aatctccaagtcattattttcacta

SEQ ID NO: 78240 - DNA, 25 bp, Mus musculus
aatctccaagtctttattttcacta

SEQ ID NO: 78241 - DNA, 25 bp, Mus musculus
aatctccaatttacagaccagtgct

SEQ ID NO: 78242 - DNA, 25 bp, Mus musculus
aatctccaattttcagaccagtgct

SEQ ID NO: 78243 - DNA, 25 bp, Mus musculus
aatctccacaggctttttgtgctgg

SEQ ID NO: 78244 - DNA, 25 bp, Mus musculus
aatctccacagggtttttgtgctgg

SEQ ID NO: 78245 - DNA, 25 bp, Mus musculus
aatctccacgttaggtcagttctca

SEQ ID NO: 78246 - DNA, 25 bp, Mus musculus
aatctccacgtttggtcagttctca

SEQ ID NO: 78247 - DNA, 25 bp, Mus musculus
aatctccagacaagctcagatgagt

SEQ ID NO: 78248 - DNA, 25 bp, Mus musculus
aatctccagacatgctcagatgagt

SEQ ID NO: 78249 - DNA, 25 bp, Mus musculus
aatctccaggctactttatgtttcc

SEQ ID NO: 78250 - DNA, 25 bp, Mus musculus
aatctccaggcttctttatgtttcc

SEQ ID NO: 78251 - DNA, 25 bp, Mus musculus
aatctccagggcaccaaggcatgtt

SEQ ID NO: 78252 - DNA, 25 bp, Mus musculus
aatctccagggctccaaggcatgtt

SEQ ID NO: 78253 - DNA, 25 bp, Mus musculus
aatctccagggtaacccaggagtag

SEQ ID NO: 78254 - DNA, 25 bp, Mus musculus
aatctccagggttacccaggagtag

SEQ ID NO: 78255 - DNA, 25 bp, Mus musculus
aatctccagtgtcccacgtgtagag

SEQ ID NO: 78256 - DNA, 25 bp, Mus musculus
aatctccagtgtgccacgtgtagag

SEQ ID NO: 78257 - DNA, 25 bp, Mus musculus
aatctccatcttctgagtcatgctt

SEQ ID NO: 78258 - DNA, 25 bp, Mus musculus
aatctccatcttgtgagtcatgctt

SEQ ID NO: 78259 - DNA, 25 bp, Mus musculus
aatctccatggtaagaattcttttt

SEQ ID NO: 78260 - DNA, 25 bp, Mus musculus
aatctccatggttagaattcttttt

SEQ ID NO: 78261 - DNA, 25 bp, Mus musculus
aatctccattggaggactcttttct

SEQ ID NO: 78262 - DNA, 25 bp, Mus musculus
aatctccattggtggactcttttct

SEQ ID NO: 78263 - DNA, 25 bp, Mus musculus
aatctcccaacaattgcagctaagc

SEQ ID NO: 78264 - DNA, 25 bp, Mus musculus
aatctcccaacatttgcagctaagc

SEQ ID NO: 78265 - DNA, 25 bp, Mus musculus
aatctcccacaacagtgcctgatat

SEQ ID NO: 78266 - DNA, 25 bp, Mus musculus
aatctcccacaagagtgcctgatat

SEQ ID NO: 78267 - DNA, 25 bp, Mus musculus
aatctcccagatagcacagttaaac

SEQ ID NO: 78268 - DNA, 25 bp, Mus musculus
aatctcccagattgcacagttaaac

SEQ ID NO: 78269 - DNA, 25 bp, Mus musculus
aatctcccgcaaaggaatccaggca

SEQ ID NO: 78270 - DNA, 25 bp, Mus musculus
aatctcccgcaatggaatccaggca

SEQ ID NO: 78271 - DNA, 25 bp, Mus musculus
aatctccctaaaaacctgataacgg

SEQ ID NO: 78272 - DNA, 25 bp, Mus musculus
aatctccctaaatacctgataacgg

SEQ ID NO: 78273 - DNA, 25 bp, Mus musculus
aatctccctcatctcttagtggtca

SEQ ID NO: 78274 - DNA, 25 bp, Mus musculus
aatctccctcatgtcttagtggtca

SEQ ID NO: 78275 - DNA, 25 bp, Mus musculus
aatctccctgccagtttggactttg

SEQ ID NO: 78276 - DNA, 25 bp, Mus musculus
aatctccctgcctgtttggactttg

SEQ ID NO: 78277 - DNA, 25 bp, Mus musculus
aatctccctgtgatgcaagtcgaaa

SEQ ID NO: 78278 - DNA, 25 bp, Mus musculus
aatctccctgtgttgcaagtcgaaa

SEQ ID NO: 78279 - DNA, 25 bp, Mus musculus
aatctccgaggacagaccacagtag

SEQ ID NO: 78280 - DNA, 25 bp, Mus musculus
aatctccgaggagagaccacagtag

SEQ ID NO: 78281 - DNA, 25 bp, Mus musculus
aatctccgggagcagtgaacaatga

SEQ ID NO: 78282 - DNA, 25 bp, Mus musculus
aatctccgggaggagtgaacaatga

SEQ ID NO: 78283 - DNA, 25 bp, Mus musculus
aatctcctaagaactgccggctgct

SEQ ID NO: 78284 - DNA, 25 bp, Mus musculus
aatctcctaagatctgccggctgct

SEQ ID NO: 78285 - DNA, 25 bp, Mus musculus
aatctcctactaactcgacttccag

SEQ ID NO: 78286 - DNA, 25 bp, Mus musculus
aatctcctactatctcgacttccag

SEQ ID NO: 78287 - DNA, 25 bp, Mus musculus
aatctcctagctcctgcatgtatga

SEQ ID NO: 78288 - DNA, 25 bp, Mus musculus
aatctcctagctgctgcatgtatga

SEQ ID NO: 78289 - DNA, 25 bp, Mus musculus
aatctcctgaccaaggctgtttcta

SEQ ID NO: 78290 - DNA, 25 bp, Mus musculus
aatctcctgacctaggctgtttcta

SEQ ID NO: 78291 - DNA, 25 bp, Mus musculus
aatctcctgatcagcattttctcag

SEQ ID NO: 78292 - DNA, 25 bp, Mus musculus
aatctcctgatctgcattttctcag

SEQ ID NO: 78293 - DNA, 25 bp, Mus musculus
aatctcctgcatctactttatcaag

SEQ ID NO: 78294 - DNA, 25 bp, Mus musculus
aatctcctgcatgtactttatcaag

SEQ ID NO: 78295 - DNA, 25 bp, Mus musculus
aatctcctggtgagcttacagcagc

SEQ ID NO: 78296 - DNA, 25 bp, Mus musculus
aatctcctggtgtgcttacagcagc

SEQ ID NO: 78297 - DNA, 25 bp, Mus musculus
aatctcctgtttaattcctatctcc

SEQ ID NO: 78298 - DNA, 25 bp, Mus musculus
aatctcctgttttattcctatctcc

SEQ ID NO: 78299 - DNA, 25 bp, Mus musculus
aatctccttcccatggataaccagt

SEQ ID NO: 78300 - DNA, 25 bp, Mus musculus
aatctccttcccttggataaccagt

SEQ ID NO: 78301 - DNA, 25 bp, Mus musculus
aatctccttgatagctctagttagg

SEQ ID NO: 78302 - DNA, 25 bp, Mus musculus
aatctccttgattgctctagttagg

SEQ ID NO: 78303 - DNA, 25 bp, Mus musculus
aatctccttgcaaaactggttgact

SEQ ID NO: 78304 - DNA, 25 bp, Mus musculus
aatctccttgcataactggttgact

SEQ ID NO: 78305 - DNA, 25 bp, Mus musculus
aatctcctttacatctttacagtgt

SEQ ID NO: 78306 - DNA, 25 bp, Mus musculus
aatctcctttacttctttacagtgt

SEQ ID NO: 78307 - DNA, 25 bp, Mus musculus
aatctcctttatatatcacctcgtc

SEQ ID NO: 78308 - DNA, 25 bp, Mus musculus
aatctcctttatttatcacctcgtc

SEQ ID NO: 78309 - DNA, 25 bp, Mus musculus
aatctcctttgtcagaatcactgca

SEQ ID NO: 78310 - DNA, 25 bp, Mus musculus
aatctcctttgtgagaatcactgca

SEQ ID NO: 78311 - DNA, 25 bp, Mus musculus
aatctcgaaactacacattccaaag

SEQ ID NO: 78312 - DNA, 25 bp, Mus musculus
aatctcgaaacttcacattccaaag

SEQ ID NO: 78313 - DNA, 25 bp, Mus musculus
aatctcgacatcacagggcttgacc

SEQ ID NO: 78314 - DNA, 25 bp, Mus musculus
aatctcgacatctcagggcttgacc

SEQ ID NO: 78315 - DNA, 25 bp, Mus musculus
aatctcgagagcaggcagacccata

SEQ ID NO: 78316 - DNA, 25 bp, Mus musculus
aatctcgagagctggcagacccata

SEQ ID NO: 78317 - DNA, 25 bp, Mus musculus
aatctcgagtatatagttgccaaag

SEQ ID NO: 78318 - DNA, 25 bp, Mus musculus
aatctcgagtatttagttgccaaag

SEQ ID NO: 78319 - DNA, 25 bp, Mus musculus
aatctcgcggatcgactttgagtac

SEQ ID NO: 78320 - DNA, 25 bp, Mus musculus
aatctcgcggatggactttgagtac

SEQ ID NO: 78321 - DNA, 25 bp, Mus musculus
aatctcgctgttcttctgttggtcc

SEQ ID NO: 78322 - DNA, 25 bp, Mus musculus
aatctcgctgttgttctgttggtcc

SEQ ID NO: 78323 - DNA, 25 bp, Mus musculus
aatctcggcccacaatgtacacaac

SEQ ID NO: 78324 - DNA, 25 bp, Mus musculus
aatctcggcccagaatgtacacaac

SEQ ID NO: 78325 - DNA, 25 bp, Mus musculus
aatctcgggaggcacctttttgagc

SEQ ID NO: 78326 - DNA, 25 bp, Mus musculus
aatctcgggaggcttttgtgcatga

SEQ ID NO: 78327 - DNA, 25 bp, Mus musculus
aatctcgggagggacctttttgagc

SEQ ID NO: 78328 - DNA, 25 bp, Mus musculus
aatctcgggagggttttgtgcatga

SEQ ID NO: 78329 - DNA, 25 bp, Mus musculus
aatctcgggatgaagccacagctgc

SEQ ID NO: 78330 - DNA, 25 bp, Mus musculus
aatctcgggatgtagccacagctgc

SEQ ID NO: 78331 - DNA, 25 bp, Mus musculus
aatctcgtacacattgtgtttccag

SEQ ID NO: 78332 - DNA, 25 bp, Mus musculus
aatctcgtacactttgtgtttccag

SEQ ID NO: 78333 - DNA, 25 bp, Mus musculus
aatctcgtcacacactatcttgagt

SEQ ID NO: 78334 - DNA, 25 bp, Mus musculus
aatctcgtcacagactatcttgagt

SEQ ID NO: 78335 - DNA, 25 bp, Mus musculus
aatctcgtgcttcacttagcgggtt

SEQ ID NO: 78336 - DNA, 25 bp, Mus musculus
aatctcgtgcttgacttagcgggtt

SEQ ID NO: 78337 - DNA, 25 bp, Mus musculus
aatctcgtggtgcttagctaggcag

SEQ ID NO: 78338 - DNA, 25 bp, Mus musculus
aatctcgtggtggttagctaggcag

SEQ ID NO: 78339 - DNA, 25 bp, Mus musculus
aatctcgttggcatcagcttctggt

SEQ ID NO: 78340 - DNA, 25 bp, Mus musculus
aatctcgttggcttcagcttctggt

SEQ ID NO: 78341 - DNA, 25 bp, Mus musculus
aatctctacatactttactggcctc

SEQ ID NO: 78342 - DNA, 25 bp, Mus musculus
aatctctacatagtttactggcctc

SEQ ID NO: 78343 - DNA, 25 bp, Mus musculus
aatctctactacctggcgctaattg

SEQ ID NO: 78344 - DNA, 25 bp, Mus musculus
aatctctactacgtggcgctaattg

SEQ ID NO: 78345 - DNA, 25 bp, Mus musculus
aatctctagagtactttctcccatc

SEQ ID NO: 78346 - DNA, 25 bp, Mus musculus
aatctctagagttctttctcccatc

SEQ ID NO: 78347 - DNA, 25 bp, Mus musculus
aatctctaggatctagggagcctga

SEQ ID NO: 78348 - DNA, 25 bp, Mus musculus
aatctctaggatgtagggagcctga

SEQ ID NO: 78349 - DNA, 25 bp, Mus musculus
aatctctagggtactaagggctcac

SEQ ID NO: 78350 - DNA, 25 bp, Mus musculus
aatctctagggttctaagggctcac

SEQ ID NO: 78351 - DNA, 25 bp, Mus musculus
aatctctaggtactgcctcgaaccg

SEQ ID NO: 78352 - DNA, 25 bp, Mus musculus
aatctctaggtagtgcctcgaaccg

SEQ ID NO: 78353 - DNA, 25 bp, Mus musculus
aatctctaggttagttctgctgtcg

SEQ ID NO: 78354 - DNA, 25 bp, Mus musculus
aatctctaggtttgttctgctgtcg

SEQ ID NO: 78355 - DNA, 25 bp, Mus musculus
aatctctagttcatactgctgccag

SEQ ID NO: 78356 - DNA, 25 bp, Mus musculus
aatctctagttcttactgctgccag

SEQ ID NO: 78357 - DNA, 25 bp, Mus musculus
aatctctataacaccagatgttgag

SEQ ID NO: 78358 - DNA, 25 bp, Mus musculus
aatctctataactccagatgttgag

SEQ ID NO: 78359 - DNA, 25 bp, Mus musculus
aatctctataatatttccgtatcag

SEQ ID NO: 78360 - DNA, 25 bp, Mus musculus
aatctctataatttttccgtatcag

SEQ ID NO: 78361 - DNA, 25 bp, Mus musculus
aatctctatacactgggtggctcca

SEQ ID NO: 78362 - DNA, 25 bp, Mus musculus
aatctctatacagtgggtggctcca

SEQ ID NO: 78363 - DNA, 25 bp, Mus musculus
aatctctatcatcgatcaactccag

SEQ ID NO: 78364 - DNA, 25 bp, Mus musculus
aatctctatcatggatcaactccag

SEQ ID NO: 78365 - DNA, 25 bp, Mus musculus
aatctctatggaccaattgccttta

SEQ ID NO: 78366 - DNA, 25 bp, Mus musculus
aatctctatggaccctatgtgccca

SEQ ID NO: 78367 - DNA, 25 bp, Mus musculus
aatctctatggagcaattgccttta

SEQ ID NO: 78368 - DNA, 25 bp, Mus musculus
aatctctatggagcctatgtgccca

SEQ ID NO: 78369 - DNA, 25 bp, Mus musculus
aatctctcaaagcatgacatttgca

SEQ ID NO: 78370 - DNA, 25 bp, Mus musculus
aatctctcaaaggatgacatttgca

SEQ ID NO: 78371 - DNA, 25 bp, Mus musculus
aatctctcaacccatgccagggagg

SEQ ID NO: 78372 - DNA, 25 bp, Mus musculus
aatctctcaaccgatgccagggagg

SEQ ID NO: 78373 - DNA, 25 bp, Mus musculus
aatctctcaagaagcaacttatttg

SEQ ID NO: 78374 - DNA, 25 bp, Mus musculus
aatctctcaagatgcaacttatttg

SEQ ID NO: 78375 - DNA, 25 bp, Mus musculus
aatctctcagggagggcggagactc

SEQ ID NO: 78376 - DNA, 25 bp, Mus musculus
aatctctcagggtgggcggagactc

SEQ ID NO: 78377 - DNA, 25 bp, Mus musculus
aatctctcagttccctgtgtggtga

SEQ ID NO: 78378 - DNA, 25 bp, Mus musculus
aatctctcagttgcctgtgtggtga

SEQ ID NO: 78379 - DNA, 25 bp, Mus musculus
aatctctccacacaatagctggcca

SEQ ID NO: 78380 - DNA, 25 bp, Mus musculus
aatctctccacagaatagctggcca

SEQ ID NO: 78381 - DNA, 25 bp, Mus musculus
aatctctccctacgtggtgatttca

SEQ ID NO: 78382 - DNA, 25 bp, Mus musculus
aatctctccctaggtggtgatttca

SEQ ID NO: 78383 - DNA, 25 bp, Mus musculus
aatctctcgcatcgatttttatcaa

SEQ ID NO: 78384 - DNA, 25 bp, Mus musculus
aatctctcgcatggatttttatcaa

SEQ ID NO: 78385 - DNA, 25 bp, Mus musculus
aatctctcggaaccatgtggacaca

SEQ ID NO: 78386 - DNA, 25 bp, Mus musculus
aatctctcggaagcatgtggacaca

SEQ ID NO: 78387 - DNA, 25 bp, Mus musculus
aatctctctcaaatctcagtctgtg

SEQ ID NO: 78388 - DNA, 25 bp, Mus musculus
aatctctctcaattctcagtctgtg

SEQ ID NO: 78389 - DNA, 25 bp, Mus musculus
aatctctctcagaccttgctagctt

SEQ ID NO: 78390 - DNA, 25 bp, Mus musculus
aatctctctcagtccttgctagctt

SEQ ID NO: 78391 - DNA, 25 bp, Mus musculus
aatctctctcttcaccaaggatcaa

SEQ ID NO: 78392 - DNA, 25 bp, Mus musculus
aatctctctcttgaccaaggatcaa

SEQ ID NO: 78393 - DNA, 25 bp, Mus musculus
aatctctctgagcactgcgtacgtg

SEQ ID NO: 78394 - DNA, 25 bp, Mus musculus
aatctctctgaggactgcgtacgtg

SEQ ID NO: 78395 - DNA, 25 bp, Mus musculus
aatctctctgcacgctggactggca

SEQ ID NO: 78396 - DNA, 25 bp, Mus musculus
aatctctctgcaggctggactggca

SEQ ID NO: 78397 - DNA, 25 bp, Mus musculus
aatctctcttacacagcaagcatgg

SEQ ID NO: 78398 - DNA, 25 bp, Mus musculus
aatctctcttactcagcaagcatgg

SEQ ID NO: 78399 - DNA, 25 bp, Mus musculus
aatctctcttgcactgctatgttta

SEQ ID NO: 78400 - DNA, 25 bp, Mus musculus
aatctctcttgctctgctatgttta

SEQ ID NO: 78401 - DNA, 25 bp, Mus musculus
aatctctcttttacaacaccagctt

SEQ ID NO: 78402 - DNA, 25 bp, Mus musculus
aatctctctttttcaacaccagctt

SEQ ID NO: 78403 - DNA, 25 bp, Mus musculus
aatctctgagggagagtttccttgt

SEQ ID NO: 78404 - DNA, 25 bp, Mus musculus
aatctctgagggtgagtttccttgt

SEQ ID NO: 78405 - DNA, 25 bp, Mus musculus
aatctctgagtcacgcaagcttttg

SEQ ID NO: 78406 - DNA, 25 bp, Mus musculus
aatctctgagtctcgcaagcttttg

SEQ ID NO: 78407 - DNA, 25 bp, Mus musculus
aatctctgatacctcctacttaggg

SEQ ID NO: 78408 - DNA, 25 bp, Mus musculus
aatctctgatacgtcctacttaggg

SEQ ID NO: 78409 - DNA, 25 bp, Mus musculus
aatctctgattactgtttgccctct

SEQ ID NO: 78410 - DNA, 25 bp, Mus musculus
aatctctgattagtgtttgccctct

SEQ ID NO: 78411 - DNA, 25 bp, Mus musculus
aatctctgcgccaagtgtatggacg

SEQ ID NO: 78412 - DNA, 25 bp, Mus musculus
aatctctgcgcctagtgtatggacg

SEQ ID NO: 78413 - DNA, 25 bp, Mus musculus
aatctctggaccctagacctgggag

SEQ ID NO: 78414 - DNA, 25 bp, Mus musculus
aatctctggaccgtagacctgggag

SEQ ID NO: 78415 - DNA, 25 bp, Mus musculus
aatctctggctcaggaaaacctgga

SEQ ID NO: 78416 - DNA, 25 bp, Mus musculus
aatctctggctctggaaaacctgga

SEQ ID NO: 78417 - DNA, 25 bp, Mus musculus
aatctctggctgactacatcaccgc

SEQ ID NO: 78418 - DNA, 25 bp, Mus musculus
aatctctggctgtctacatcaccgc

SEQ ID NO: 78419 - DNA, 25 bp, Mus musculus
aatctctggcttatagactccaggt

SEQ ID NO: 78420 - DNA, 25 bp, Mus musculus
aatctctggcttttagactccaggt

SEQ ID NO: 78421 - DNA, 25 bp, Mus musculus
aatctctgggcaagactgtgagctc

SEQ ID NO: 78422 - DNA, 25 bp, Mus musculus
aatctctgggcaccgcagcgctacg

SEQ ID NO: 78423 - DNA, 25 bp, Mus musculus
aatctctgggcactgcatcacgata

SEQ ID NO: 78424 - DNA, 25 bp, Mus musculus
aatctctgggcagcgcagcgctacg

SEQ ID NO: 78425 - DNA, 25 bp, Mus musculus
aatctctgggcagtgcatcacgata

SEQ ID NO: 78426 - DNA, 25 bp, Mus musculus
aatctctgggcatgactgtgagctc

SEQ ID NO: 78427 - DNA, 25 bp, Mus musculus
aatctctggtctccataagagccca

SEQ ID NO: 78428 - DNA, 25 bp, Mus musculus
aatctctggtctgcataagagccca

SEQ ID NO: 78429 - DNA, 25 bp, Mus musculus
aatctctgtccacttttgtagctga

SEQ ID NO: 78430 - DNA, 25 bp, Mus musculus
aatctctgtccagttttgtagctga

SEQ ID NO: 78431 - DNA, 25 bp, Mus musculus
aatctctgtgtccacaacaggaggg

SEQ ID NO: 78432 - DNA, 25 bp, Mus musculus
aatctctgtgtcgacaacaggaggg

SEQ ID NO: 78433 - DNA, 25 bp, Mus musculus
aatctctgtgtgctccactttaaaa

SEQ ID NO: 78434 - DNA, 25 bp, Mus musculus
aatctctgtgtggtccactttaaaa

SEQ ID NO: 78435 - DNA, 25 bp, Mus musculus
aatctctgttctccgggttgggttc

SEQ ID NO: 78436 - DNA, 25 bp, Mus musculus
aatctctgttctgcgggttgggttc

SEQ ID NO: 78437 - DNA, 25 bp, Mus musculus
aatctctgttggctcttgtggaaac

SEQ ID NO: 78438 - DNA, 25 bp, Mus musculus
aatctctgttgggtcttgtggaaac

SEQ ID NO: 78439 - DNA, 25 bp, Mus musculus
aatctcttacccagactaaactgga

SEQ ID NO: 78440 - DNA, 25 bp, Mus musculus
aatctcttaccctgactaaactgga

SEQ ID NO: 78441 - DNA, 25 bp, Mus musculus
aatctcttcaagcttagccctacgg

SEQ ID NO: 78442 - DNA, 25 bp, Mus musculus
aatctcttcaaggttagccctacgg

SEQ ID NO: 78443 - DNA, 25 bp, Mus musculus
aatctcttcacaattcctatcagct

SEQ ID NO: 78444 - DNA, 25 bp, Mus musculus
aatctcttcacatttcctatcagct

SEQ ID NO: 78445 - DNA, 25 bp, Mus musculus
aatctcttcagaatccgtcaacttt

SEQ ID NO: 78446 - DNA, 25 bp, Mus musculus
aatctcttcagattccgtcaacttt

SEQ ID NO: 78447 - DNA, 25 bp, Mus musculus
aatctcttcagcagatcttcataag

SEQ ID NO: 78448 - DNA, 25 bp, Mus musculus
aatctcttcagctgatcttcataag

SEQ ID NO: 78449 - DNA, 25 bp, Mus musculus
aatctcttcatacttgtgagggcaa

SEQ ID NO: 78450 - DNA, 25 bp, Mus musculus
aatctcttcatagttgtgagggcaa

SEQ ID NO: 78451 - DNA, 25 bp, Mus musculus
aatctcttcatcctaattgagagcc

SEQ ID NO: 78452 - DNA, 25 bp, Mus musculus
aatctcttcatcgtaattgagagcc

SEQ ID NO: 78453 - DNA, 25 bp, Mus musculus
aatctcttcccactcaaactggagg

SEQ ID NO: 78454 - DNA, 25 bp, Mus musculus
aatctcttcccagtcaaactggagg

SEQ ID NO: 78455 - DNA, 25 bp, Mus musculus
aatctcttccgaccagatgcttcag

SEQ ID NO: 78456 - DNA, 25 bp, Mus musculus
aatctcttccgagcagatgcttcag

SEQ ID NO: 78457 - DNA, 25 bp, Mus musculus
aatctcttcctgaggcactgagtac

SEQ ID NO: 78458 - DNA, 25 bp, Mus musculus
aatctcttcctgtggcactgagtac

SEQ ID NO: 78459 - DNA, 25 bp, Mus musculus
aatctcttcgtgcctagtctgtgac

SEQ ID NO: 78460 - DNA, 25 bp, Mus musculus
aatctcttcgtggctagtctgtgac

SEQ ID NO: 78461 - DNA, 25 bp, Mus musculus
aatctcttctaactacttgtctggg

SEQ ID NO: 78462 - DNA, 25 bp, Mus musculus
aatctcttctaagtacttgtctggg

SEQ ID NO: 78463 - DNA, 25 bp, Mus musculus
aatctcttctcaaaggacaggacat

SEQ ID NO: 78464 - DNA, 25 bp, Mus musculus
aatctcttctcataggacaggacat

SEQ ID NO: 78465 - DNA, 25 bp, Mus musculus
aatctcttctgcaagtttggtgatc

SEQ ID NO: 78466 - DNA, 25 bp, Mus musculus
aatctcttctgctagtttggtgatc

SEQ ID NO: 78467 - DNA, 25 bp, Mus musculus
aatctcttgtaactggagttcttgt

SEQ ID NO: 78468 - DNA, 25 bp, Mus musculus
aatctcttgtaagtggagttcttgt

SEQ ID NO: 78469 - DNA, 25 bp, Mus musculus
aatctcttgtgacatggcatttcta

SEQ ID NO: 78470 - DNA, 25 bp, Mus musculus
aatctcttgtgagatggcatttcta

SEQ ID NO: 78471 - DNA, 25 bp, Mus musculus
aatctctttaaacatgaccaacatg

SEQ ID NO: 78472 - DNA, 25 bp, Mus musculus
aatctctttaaagatgaccaacatg

SEQ ID NO: 78473 - DNA, 25 bp, Mus musculus
aatctctttataatctagctgctga

SEQ ID NO: 78474 - DNA, 25 bp, Mus musculus
aatctctttatattctagctgctga

SEQ ID NO: 78475 - DNA, 25 bp, Mus musculus
aatctctttgccatctacttgagca

SEQ ID NO: 78476 - DNA, 25 bp, Mus musculus
aatctctttgccttctacttgagca

SEQ ID NO: 78477 - DNA, 25 bp, Mus musculus
aatctgaaaaggctgagttacggtt

SEQ ID NO: 78478 - DNA, 25 bp, Mus musculus
aatctgaaaagggtgagttacggtt

SEQ ID NO: 78479 - DNA, 25 bp, Mus musculus
aatctgaaaatcagtgccctaccta

SEQ ID NO: 78480 - DNA, 25 bp, Mus musculus
aatctgaaaatctgtgccctaccta

SEQ ID NO: 78481 - DNA, 25 bp, Mus musculus
aatctgaaagtgattcctgcccctg

SEQ ID NO: 78482 - DNA, 25 bp, Mus musculus
aatctgaaagtgtttcctgcccctg

SEQ ID NO: 78483 - DNA, 25 bp, Mus musculus
aatctgaaatgcagaccctgtcaca

SEQ ID NO: 78484 - DNA, 25 bp, Mus musculus
aatctgaaatgctgaccctgtcaca

SEQ ID NO: 78485 - DNA, 25 bp, Mus musculus
aatctgaacagcaaacagtgccatt

SEQ ID NO: 78486 - DNA, 25 bp, Mus musculus
aatctgaacagctaacagtgccatt

SEQ ID NO: 78487 - DNA, 25 bp, Mus musculus
aatctgaacccgaaagctgcctgtc

SEQ ID NO: 78488 - DNA, 25 bp, Mus musculus
aatctgaacccgtaagctgcctgtc

SEQ ID NO: 78489 - DNA, 25 bp, Mus musculus
aatctgaacgtgaggcactgctagt

SEQ ID NO: 78490 - DNA, 25 bp, Mus musculus
aatctgaacgtgtggcactgctagt

SEQ ID NO: 78491 - DNA, 25 bp, Mus musculus
aatctgaagcttagcatttgtttta

SEQ ID NO: 78492 - DNA, 25 bp, Mus musculus
aatctgaagctttgcatttgtttta

SEQ ID NO: 78493 - DNA, 25 bp, Mus musculus
aatctgaaggtgcatgtcaggcagt

SEQ ID NO: 78494 - DNA, 25 bp, Mus musculus
aatctgaaggtggatgtcaggcagt

SEQ ID NO: 78495 - DNA, 25 bp, Mus musculus
aatctgaagtgaattctagcttact

SEQ ID NO: 78496 - DNA, 25 bp, Mus musculus
aatctgaagtgatttctagcttact

SEQ ID NO: 78497 - DNA, 25 bp, Mus musculus
aatctgaatcctacatctctaggct

SEQ ID NO: 78498 - DNA, 25 bp, Mus musculus
aatctgaatccttcatctctaggct

SEQ ID NO: 78499 - DNA, 25 bp, Mus musculus
aatctgaatttcagtcactccctac

SEQ ID NO: 78500 - DNA, 25 bp, Mus musculus
aatctgaatttctgtcactccctac

SEQ ID NO: 78501 - DNA, 25 bp, Mus musculus
aatctgacaacaatctttaccaata

SEQ ID NO: 78502 - DNA, 25 bp, Mus musculus
aatctgacaacattctttaccaata

SEQ ID NO: 78503 - DNA, 25 bp, Mus musculus
aatctgacagacaagaacagtgtaa

SEQ ID NO: 78504 - DNA, 25 bp, Mus musculus
aatctgacagactagaacagtgtaa

SEQ ID NO: 78505 - DNA, 25 bp, Mus musculus
aatctgacagcaactgtaattctgt

SEQ ID NO: 78506 - DNA, 25 bp, Mus musculus
aatctgacagcatctgtaattctgt

SEQ ID NO: 78507 - DNA, 25 bp, Mus musculus
aatctgacccctcctgttaacttat

SEQ ID NO: 78508 - DNA, 25 bp, Mus musculus
aatctgacccctgctgttaacttat

SEQ ID NO: 78509 - DNA, 25 bp, Mus musculus
aatctgacctaacctcttttctgtt

SEQ ID NO: 78510 - DNA, 25 bp, Mus musculus
aatctgacctaagctcttttctgtt

SEQ ID NO: 78511 - DNA, 25 bp, Mus musculus
aatctgacgtggatcagctctacct

SEQ ID NO: 78512 - DNA, 25 bp, Mus musculus
aatctgacgtggttcagctctacct

SEQ ID NO: 78513 - DNA, 25 bp, Mus musculus
aatctgactcctacatccatgaaat

SEQ ID NO: 78514 - DNA, 25 bp, Mus musculus
aatctgactccttcatccatgaaat

SEQ ID NO: 78515 - DNA, 25 bp, Mus musculus
aatctgactggactatgtgttccat

SEQ ID NO: 78516 - DNA, 25 bp, Mus musculus
aatctgactggagtatgtgttccat

SEQ ID NO: 78517 - DNA, 25 bp, Mus musculus
aatctgacttttagtaaccttactg

SEQ ID NO: 78518 - DNA, 25 bp, Mus musculus
aatctgactttttgtaaccttactg

SEQ ID NO: 78519 - DNA, 25 bp, Mus musculus
aatctgagacacattcctgatcctg

SEQ ID NO: 78520 - DNA, 25 bp, Mus musculus
aatctgagacactttcctgatcctg

SEQ ID NO: 78521 - DNA, 25 bp, Mus musculus
aatctgagagtgaacattgttgctt

SEQ ID NO: 78522 - DNA, 25 bp, Mus musculus
aatctgagagtgtacattgttgctt

SEQ ID NO: 78523 - DNA, 25 bp, Mus musculus
aatctgagccagagttcctcttgac

SEQ ID NO: 78524 - DNA, 25 bp, Mus musculus
aatctgagccagagtttgggacccg

SEQ ID NO: 78525 - DNA, 25 bp, Mus musculus
aatctgagccagtgttcctcttgac

SEQ ID NO: 78526 - DNA, 25 bp, Mus musculus
aatctgagccagtgtttgggacccg

SEQ ID NO: 78527 - DNA, 25 bp, Mus musculus
aatctgagccatctcctacaggcat

SEQ ID NO: 78528 - DNA, 25 bp, Mus musculus
aatctgagccatgtcctacaggcat

SEQ ID NO: 78529 - DNA, 25 bp, Mus musculus
aatctgagcctaccctggtgtacac

SEQ ID NO: 78530 - DNA, 25 bp, Mus musculus
aatctgagcctagcctggtgtacac

SEQ ID NO: 78531 - DNA, 25 bp, Mus musculus
aatctgagcctgaagagctttctta

SEQ ID NO: 78532 - DNA, 25 bp, Mus musculus
aatctgagcctgtagagctttctta

SEQ ID NO: 78533 - DNA, 25 bp, Mus musculus
aatctgagctgacaacctccatcca

SEQ ID NO: 78534 - DNA, 25 bp, Mus musculus
aatctgagctgagaacctccatcca

SEQ ID NO: 78535 - DNA, 25 bp, Mus musculus
aatctgaggtctctcatgcctagtt

SEQ ID NO: 78536 - DNA, 25 bp, Mus musculus
aatctgaggtctgtcatgcctagtt

SEQ ID NO: 78537 - DNA, 25 bp, Mus musculus
aatctgaggtgacccctgtgacttt

SEQ ID NO: 78538 - DNA, 25 bp, Mus musculus
aatctgaggtgagccctgtgacttt

SEQ ID NO: 78539 - DNA, 25 bp, Mus musculus
aatctgagtgtgatccatttgcatg

SEQ ID NO: 78540 - DNA, 25 bp, Mus musculus
aatctgagtgtgttccatttgcatg

SEQ ID NO: 78541 - DNA, 25 bp, Mus musculus
aatctgagttgtatcaatttaggcc

SEQ ID NO: 78542 - DNA, 25 bp, Mus musculus
aatctgagttgtttcaatttaggcc

SEQ ID NO: 78543 - DNA, 25 bp, Mus musculus
aatctgatacctatctactaatagt

SEQ ID NO: 78544 - DNA, 25 bp, Mus musculus
aatctgatacctttctactaatagt

SEQ ID NO: 78545 - DNA, 25 bp, Mus musculus
aatctgatcagaaaacccaggataa

SEQ ID NO: 78546 - DNA, 25 bp, Mus musculus
aatctgatcagataacccaggataa

SEQ ID NO: 78547 - DNA, 25 bp, Mus musculus
aatctgatcagcacaccttaaggac

SEQ ID NO: 78548 - DNA, 25 bp, Mus musculus
aatctgatcagctcaccttaaggac

SEQ ID NO: 78549 - DNA, 25 bp, Mus musculus
aatctgatccagaactatgaggcaa

SEQ ID NO: 78550 - DNA, 25 bp, Mus musculus
aatctgatccagtactatgaggcaa

SEQ ID NO: 78551 - DNA, 25 bp, Mus musculus
aatctgatcctgaaaatcctcattg

SEQ ID NO: 78552 - DNA, 25 bp, Mus musculus
aatctgatcctgtaaatcctcattg

SEQ ID NO: 78553 - DNA, 25 bp, Mus musculus
aatctgatgcccaggtctggagtgt

SEQ ID NO: 78554 - DNA, 25 bp, Mus musculus
aatctgatgccctggtctggagtgt

SEQ ID NO: 78555 - DNA, 25 bp, Mus musculus
aatctgatggatacctgcctgggag

SEQ ID NO: 78556 - DNA, 25 bp, Mus musculus
aatctgatggattcctgcctgggag

SEQ ID NO: 78557 - DNA, 25 bp, Mus musculus
aatctgatgttgactacatatgcaa

SEQ ID NO: 78558 - DNA, 25 bp, Mus musculus
aatctgatgttgtctacatatgcaa

SEQ ID NO: 78559 - DNA, 25 bp, Mus musculus
aatctgattcagatgcttgcacagt

SEQ ID NO: 78560 - DNA, 25 bp, Mus musculus
aatctgattcagttgcttgcacagt

SEQ ID NO: 78561 - DNA, 25 bp, Mus musculus
aatctgattgcaacctttctttgta

SEQ ID NO: 78562 - DNA, 25 bp, Mus musculus
aatctgattgcatcctttctttgta

SEQ ID NO: 78563 - DNA, 25 bp, Mus musculus
aatctgattgctcacctggatgaaa

SEQ ID NO: 78564 - DNA, 25 bp, Mus musculus
aatctgattgctgacctggatgaaa

SEQ ID NO: 78565 - DNA, 25 bp, Mus musculus
aatctgatttcaccaaccgagttga

SEQ ID NO: 78566 - DNA, 25 bp, Mus musculus
aatctgatttcaccctgagttccca

SEQ ID NO: 78567 - DNA, 25 bp, Mus musculus
aatctgatttcagcaaccgagttga

SEQ ID NO: 78568 - DNA, 25 bp, Mus musculus
aatctgatttcagcctgagttccca

SEQ ID NO: 78569 - DNA, 25 bp, Mus musculus
aatctgatttgtactttgggctact

SEQ ID NO: 78570 - DNA, 25 bp, Mus musculus
aatctgatttgttctttgggctact

SEQ ID NO: 78571 - DNA, 25 bp, Mus musculus
aatctgcactggagtgttcaggcca

SEQ ID NO: 78572 - DNA, 25 bp, Mus musculus
aatctgcactggtgtgttcaggcca

SEQ ID NO: 78573 - DNA, 25 bp, Mus musculus
aatctgcagatccatcatgtgggtc

SEQ ID NO: 78574 - DNA, 25 bp, Mus musculus
aatctgcagatcgatcatgtgggtc

SEQ ID NO: 78575 - DNA, 25 bp, Mus musculus
aatctgcagcacatcagcgaccggg

SEQ ID NO: 78576 - DNA, 25 bp, Mus musculus
aatctgcagcacttcagcgaccggg

SEQ ID NO: 78577 - DNA, 25 bp, Mus musculus
aatctgcagcagaattttgctatca

SEQ ID NO: 78578 - DNA, 25 bp, Mus musculus
aatctgcagcagtattttgctatca

SEQ ID NO: 78579 - DNA, 25 bp, Mus musculus
aatctgcagcccaatgtattctcaa

SEQ ID NO: 78580 - DNA, 25 bp, Mus musculus
aatctgcagccctatgtattctcaa

SEQ ID NO: 78581 - DNA, 25 bp, Mus musculus
aatctgcaggtgagtggtctgatcc

SEQ ID NO: 78582 - DNA, 25 bp, Mus musculus
aatctgcaggtgtgtggtctgatcc

SEQ ID NO: 78583 - DNA, 25 bp, Mus musculus
aatctgcagtctctaaaaaagtggc

SEQ ID NO: 78584 - DNA, 25 bp, Mus musculus
aatctgcagtctgtaaaaaagtggc

SEQ ID NO: 78585 - DNA, 25 bp, Mus musculus
aatctgcagttgaaaccaccactac

SEQ ID NO: 78586 - DNA, 25 bp, Mus musculus
aatctgcagttgtaaccaccactac

SEQ ID NO: 78587 - DNA, 25 bp, Mus musculus
aatctgcatactacagcatgtggcc

SEQ ID NO: 78588 - DNA, 25 bp, Mus musculus
aatctgcatacttcagcatgtggcc

SEQ ID NO: 78589 - DNA, 25 bp, Mus musculus
aatctgcatatgaagggtttcctga

SEQ ID NO: 78590 - DNA, 25 bp, Mus musculus
aatctgcatatgtagggtttcctga

SEQ ID NO: 78591 - DNA, 25 bp, Mus musculus
aatctgccatatctttacatatttg

SEQ ID NO: 78592 - DNA, 25 bp, Mus musculus
aatctgccatatgtttacatatttg

SEQ ID NO: 78593 - DNA, 25 bp, Mus musculus
aatctgcccaatccaaatcttttgc

SEQ ID NO: 78594 - DNA, 25 bp, Mus musculus
aatctgcccaatgcaaatcttttgc

SEQ ID NO: 78595 - DNA, 25 bp, Mus musculus
aatctgccccagactcagaaaagtt

SEQ ID NO: 78596 - DNA, 25 bp, Mus musculus
aatctgccccagtctcagaaaagtt

SEQ ID NO: 78597 - DNA, 25 bp, Mus musculus
aatctgccgcctagcctcataaata

SEQ ID NO: 78598 - DNA, 25 bp, Mus musculus
aatctgccgccttgcctcataaata

SEQ ID NO: 78599 - DNA, 25 bp, Mus musculus
aatctgccgggcaagcagggctgtt

SEQ ID NO: 78600 - DNA, 25 bp, Mus musculus
aatctgccgggctagcagggctgtt

SEQ ID NO: 78601 - DNA, 25 bp, Mus musculus
aatctgcctcaaaggaaatactagt

SEQ ID NO: 78602 - DNA, 25 bp, Mus musculus
aatctgcctcaatggaaatactagt

SEQ ID NO: 78603 - DNA, 25 bp, Mus musculus
aatctgcctgttatgacacatgccg

SEQ ID NO: 78604 - DNA, 25 bp, Mus musculus
aatctgcctgttttgacacatgccg

SEQ ID NO: 78605 - DNA, 25 bp, Mus musculus
aatctgccttccctggagagatgtt

SEQ ID NO: 78606 - DNA, 25 bp, Mus musculus
aatctgccttccgtggagagatgtt

SEQ ID NO: 78607 - DNA, 25 bp, Mus musculus
aatctgccttgacaaatcccacaca

SEQ ID NO: 78608 - DNA, 25 bp, Mus musculus
aatctgccttgagaaatcccacaca

SEQ ID NO: 78609 - DNA, 25 bp, Mus musculus
aatctgcgatggagccctggagtgc

SEQ ID NO: 78610 - DNA, 25 bp, Mus musculus
aatctgcgatggtgccctggagtgc

SEQ ID NO: 78611 - DNA, 25 bp, Mus musculus
aatctgctacaccaccacttaaaaa

SEQ ID NO: 78612 - DNA, 25 bp, Mus musculus
aatctgctacacgaccacttaaaaa

SEQ ID NO: 78613 - DNA, 25 bp, Mus musculus
aatctgctacgaaagccacaggcct

SEQ ID NO: 78614 - DNA, 25 bp, Mus musculus
aatctgctacgatagccacaggcct

SEQ ID NO: 78615 - DNA, 25 bp, Mus musculus
aatctgctagcacttaggagcggaa

SEQ ID NO: 78616 - DNA, 25 bp, Mus musculus
aatctgctagcagttaggagcggaa

SEQ ID NO: 78617 - DNA, 25 bp, Mus musculus
aatctgctccagaaaaggatccagg

SEQ ID NO: 78618 - DNA, 25 bp, Mus musculus
aatctgctccagagacgctcacact

SEQ ID NO: 78619 - DNA, 25 bp, Mus musculus
aatctgctccagtaaaggatccagg

SEQ ID NO: 78620 - DNA, 25 bp, Mus musculus
aatctgctccagtgacgctcacact

SEQ ID NO: 78621 - DNA, 25 bp, Mus musculus
aatctgctctggcagcctaagtctg

SEQ ID NO: 78622 - DNA, 25 bp, Mus musculus
aatctgctctgggagcctaagtctg

SEQ ID NO: 78623 - DNA, 25 bp, Mus musculus
aatctgctgatgctggctcatttct

SEQ ID NO: 78624 - DNA, 25 bp, Mus musculus
aatctgctgatggtggctcatttct

SEQ ID NO: 78625 - DNA, 25 bp, Mus musculus
aatctgctgcagacgctatacaaca

SEQ ID NO: 78626 - DNA, 25 bp, Mus musculus
aatctgctgcagtcgctatacaaca

SEQ ID NO: 78627 - DNA, 25 bp, Mus musculus
aatctgctggcccttcgtcagattg

SEQ ID NO: 78628 - DNA, 25 bp, Mus musculus
aatctgctggccgttcgtcagattg

SEQ ID NO: 78629 - DNA, 25 bp, Mus musculus
aatctgctgtaacctttcctgtttt

SEQ ID NO: 78630 - DNA, 25 bp, Mus musculus
aatctgctgtaagctttcctgtttt

SEQ ID NO: 78631 - DNA, 25 bp, Mus musculus
aatctgctgttgaagtatgggagct

SEQ ID NO: 78632 - DNA, 25 bp, Mus musculus
aatctgctgttgtagtatgggagct

SEQ ID NO: 78633 - DNA, 25 bp, Mus musculus
aatctgcttcagcttatgcctcgag

SEQ ID NO: 78634 - DNA, 25 bp, Mus musculus
aatctgcttcaggttatgcctcgag

SEQ ID NO: 78635 - DNA, 25 bp, Mus musculus
aatctgcttgagcaccttctccaga

SEQ ID NO: 78636 - DNA, 25 bp, Mus musculus
aatctgcttgaggaccttctccaga

SEQ ID NO: 78637 - DNA, 25 bp, Mus musculus
aatctgcttggacgccattaaccgg

SEQ ID NO: 78638 - DNA, 25 bp, Mus musculus
aatctgcttggaggccattaaccgg

SEQ ID NO: 78639 - DNA, 25 bp, Mus musculus
aatctgctttgcaatcgtatgaaga

SEQ ID NO: 78640 - DNA, 25 bp, Mus musculus
aatctgctttgctatcgtatgaaga

SEQ ID NO: 78641 - DNA, 25 bp, Mus musculus
aatctgcttttgctgggagtgcttt

SEQ ID NO: 78642 - DNA, 25 bp, Mus musculus
aatctgcttttggtgggagtgcttt

SEQ ID NO: 78643 - DNA, 25 bp, Mus musculus
aatctggaaccactggactccggct

SEQ ID NO: 78644 - DNA, 25 bp, Mus musculus
aatctggaaccagtggactccggct

SEQ ID NO: 78645 - DNA, 25 bp, Mus musculus
aatctggaagttcttgactgtcggc

SEQ ID NO: 78646 - DNA, 25 bp, Mus musculus
aatctggaagttgttgactgtcggc

SEQ ID NO: 78647 - DNA, 25 bp, Mus musculus
aatctggaatctcagggtctcgcgc

SEQ ID NO: 78648 - DNA, 25 bp, Mus musculus
aatctggaatctgagggtctcgcgc

SEQ ID NO: 78649 - DNA, 25 bp, Mus musculus
aatctggaatgcatggtcccttcaa

SEQ ID NO: 78650 - DNA, 25 bp, Mus musculus
aatctggaatgcttggtcccttcaa

SEQ ID NO: 78651 - DNA, 25 bp, Mus musculus
aatctggaattaactgtggtctgca

SEQ ID NO: 78652 - DNA, 25 bp, Mus musculus
aatctggaattatctgtggtctgca

SEQ ID NO: 78653 - DNA, 25 bp, Mus musculus
aatctggacctgaaggagctcccag

SEQ ID NO: 78654 - DNA, 25 bp, Mus musculus
aatctggacctgtaggagctcccag

SEQ ID NO: 78655 - DNA, 25 bp, Mus musculus
aatctggactggagggttggttcct

SEQ ID NO: 78656 - DNA, 25 bp, Mus musculus
aatctggactggtgggttggttcct

SEQ ID NO: 78657 - DNA, 25 bp, Mus musculus
aatctggagaatctggtctttggta

SEQ ID NO: 78658 - DNA, 25 bp, Mus musculus
aatctggagaatgtggtctttggta

SEQ ID NO: 78659 - DNA, 25 bp, Mus musculus
aatctggagcagctacaccggcgca

SEQ ID NO: 78660 - DNA, 25 bp, Mus musculus
aatctggagcaggtacaccggcgca

SEQ ID NO: 78661 - DNA, 25 bp, Mus musculus
aatctggagcatatgtgttactgga

SEQ ID NO: 78662 - DNA, 25 bp, Mus musculus
aatctggagcatttgtgttactgga

SEQ ID NO: 78663 - DNA, 25 bp, Mus musculus
aatctggagcctattggcgctctgt

SEQ ID NO: 78664 - DNA, 25 bp, Mus musculus
aatctggagccttttggcgctctgt

SEQ ID NO: 78665 - DNA, 25 bp, Mus musculus
aatctggagtccaaggtaatcctct

SEQ ID NO: 78666 - DNA, 25 bp, Mus musculus
aatctggagtcctaggtaatcctct

SEQ ID NO: 78667 - DNA, 25 bp, Mus musculus
aatctggatgctctaccttgtacct

SEQ ID NO: 78668 - DNA, 25 bp, Mus musculus
aatctggatgctgtaccttgtacct

SEQ ID NO: 78669 - DNA, 25 bp, Mus musculus
aatctggatgtcaccttcatacatt

SEQ ID NO: 78670 - DNA, 25 bp, Mus musculus
aatctggatgtctccttcatacatt

SEQ ID NO: 78671 - DNA, 25 bp, Mus musculus
aatctggcaggcatatatttgacat

SEQ ID NO: 78672 - DNA, 25 bp, Mus musculus
aatctggcaggcttatatttgacat

SEQ ID NO: 78673 - DNA, 25 bp, Mus musculus
aatctggcagttcatttgtgttagc

SEQ ID NO: 78674 - DNA, 25 bp, Mus musculus
aatctggcagttgatttgtgttagc

SEQ ID NO: 78675 - DNA, 25 bp, Mus musculus
aatctggcatgtcttcacaccataa

SEQ ID NO: 78676 - DNA, 25 bp, Mus musculus
aatctggcatgtgttcacaccataa

SEQ ID NO: 78677 - DNA, 25 bp, Mus musculus
aatctggccagcctgcatcgtggtg

SEQ ID NO: 78678 - DNA, 25 bp, Mus musculus
aatctggccagcgtgcatcgtggtg

SEQ ID NO: 78679 - DNA, 25 bp, Mus musculus
aatctggcccttaaggagctttgct

SEQ ID NO: 78680 - DNA, 25 bp, Mus musculus
aatctggcccttcatgcttctatct

SEQ ID NO: 78681 - DNA, 25 bp, Mus musculus
aatctggcccttgatgcttctatct

SEQ ID NO: 78682 - DNA, 25 bp, Mus musculus
aatctggccctttaggagctttgct

SEQ ID NO: 78683 - DNA, 25 bp, Mus musculus
aatctggcctctagcacaattcttc

SEQ ID NO: 78684 - DNA, 25 bp, Mus musculus
aatctggcctcttgcacaattcttc

SEQ ID NO: 78685 - DNA, 25 bp, Mus musculus
aatctggctaatcgactagaacggc

SEQ ID NO: 78686 - DNA, 25 bp, Mus musculus
aatctggctaatggactagaacggc

SEQ ID NO: 78687 - DNA, 25 bp, Mus musculus
aatctggctctgaggctagcttctg

SEQ ID NO: 78688 - DNA, 25 bp, Mus musculus
aatctggctctgtggctagcttctg

SEQ ID NO: 78689 - DNA, 25 bp, Mus musculus
aatctggctgcaaggaatgtgagga

SEQ ID NO: 78690 - DNA, 25 bp, Mus musculus
aatctggctgcatggaatgtgagga

SEQ ID NO: 78691 - DNA, 25 bp, Mus musculus
aatctggcttatctgcattttgggc

SEQ ID NO: 78692 - DNA, 25 bp, Mus musculus
aatctggcttatgtgcattttgggc

SEQ ID NO: 78693 - DNA, 25 bp, Mus musculus
aatctggcttctccattcctattaa

SEQ ID NO: 78694 - DNA, 25 bp, Mus musculus
aatctggcttctgcattcctattaa

SEQ ID NO: 78695 - DNA, 25 bp, Mus musculus
aatctgggaactctggtctatctct

SEQ ID NO: 78696 - DNA, 25 bp, Mus musculus
aatctgggaactgtggtctatctct

SEQ ID NO: 78697 - DNA, 25 bp, Mus musculus
aatctgggacatatgcttgtgggct

SEQ ID NO: 78698 - DNA, 25 bp, Mus musculus
aatctgggacatttgcttgtgggct

SEQ ID NO: 78699 - DNA, 25 bp, Mus musculus
aatctgggactgaaggtgcctcctc

SEQ ID NO: 78700 - DNA, 25 bp, Mus musculus
aatctgggactgtaggtgcctcctc

SEQ ID NO: 78701 - DNA, 25 bp, Mus musculus
aatctgggatgtatgctcctaccct

SEQ ID NO: 78702 - DNA, 25 bp, Mus musculus
aatctgggatgtttgctcctaccct

SEQ ID NO: 78703 - DNA, 25 bp, Mus musculus
aatctgggcatcagggttgggaatt

SEQ ID NO: 78704 - DNA, 25 bp, Mus musculus
aatctgggcatctgggttgggaatt

SEQ ID NO: 78705 - DNA, 25 bp, Mus musculus
aatctgggccacactatgagacctt

SEQ ID NO: 78706 - DNA, 25 bp, Mus musculus
aatctgggccactctatgagacctt

SEQ ID NO: 78707 - DNA, 25 bp, Mus musculus
aatctgggcgatccaatcatttttt

SEQ ID NO: 78708 - DNA, 25 bp, Mus musculus
aatctgggcgatgcaatcatttttt

SEQ ID NO: 78709 - DNA, 25 bp, Mus musculus
aatctgggctggattaaaggccact

SEQ ID NO: 78710 - DNA, 25 bp, Mus musculus
aatctgggctggtttaaaggccact

SEQ ID NO: 78711 - DNA, 25 bp, Mus musculus
aatctgggctttacactccgcgagt

SEQ ID NO: 78712 - DNA, 25 bp, Mus musculus
aatctgggcttttcactccgcgagt

SEQ ID NO: 78713 - DNA, 25 bp, Mus musculus
aatctggggcctacgagcctctgca

SEQ ID NO: 78714 - DNA, 25 bp, Mus musculus
aatctggggccttcgagcctctgca

SEQ ID NO: 78715 - DNA, 25 bp, Mus musculus
aatctgggtcctccatctttaaaaa

SEQ ID NO: 78716 - DNA, 25 bp, Mus musculus
aatctgggtcctgcatctttaaaaa

SEQ ID NO: 78717 - DNA, 25 bp, Mus musculus
aatctgggtctgcatctcttattaa

SEQ ID NO: 78718 - DNA, 25 bp, Mus musculus
aatctgggtctggatctcttattaa

SEQ ID NO: 78719 - DNA, 25 bp, Mus musculus
aatctgggtttgactttctcaccac

SEQ ID NO: 78720 - DNA, 25 bp, Mus musculus
aatctgggtttgtctttctcaccac

SEQ ID NO: 78721 - DNA, 25 bp, Mus musculus
aatctggtacgacagctccttctgg

SEQ ID NO: 78722 - DNA, 25 bp, Mus musculus
aatctggtacgagagctccttctgg

SEQ ID NO: 78723 - DNA, 25 bp, Mus musculus
aatctggtagctactgctgacattc

SEQ ID NO: 78724 - DNA, 25 bp, Mus musculus
aatctggtagcttctgctgacattc

SEQ ID NO: 78725 - DNA, 25 bp, Mus musculus
aatctggtagggatacttacagtat

SEQ ID NO: 78726 - DNA, 25 bp, Mus musculus
aatctggtagggttacttacagtat

SEQ ID NO: 78727 - DNA, 25 bp, Mus musculus
aatctggtatctccctataactcac

SEQ ID NO: 78728 - DNA, 25 bp, Mus musculus
aatctggtatctgcctataactcac

SEQ ID NO: 78729 - DNA, 25 bp, Mus musculus
aatctggtcctcatatgagagtctc

SEQ ID NO: 78730 - DNA, 25 bp, Mus musculus
aatctggtcctcttatgagagtctc

SEQ ID NO: 78731 - DNA, 25 bp, Mus musculus
aatctggtctacagactttaactca

SEQ ID NO: 78732 - DNA, 25 bp, Mus musculus
aatctggtctactgactttaactca

SEQ ID NO: 78733 - DNA, 25 bp, Mus musculus
aatctggtctgtcctggagagtgtt

SEQ ID NO: 78734 - DNA, 25 bp, Mus musculus
aatctggtctgtgctggagagtgtt

SEQ ID NO: 78735 - DNA, 25 bp, Mus musculus
aatctggtcttcaaatcgagtccag

SEQ ID NO: 78736 - DNA, 25 bp, Mus musculus
aatctggtcttctaatcgagtccag

SEQ ID NO: 78737 - DNA, 25 bp, Mus musculus
aatctggtgaggaccacaaagtcta

SEQ ID NO: 78738 - DNA, 25 bp, Mus musculus
aatctggtgaggtccacaaagtcta

SEQ ID NO: 78739 - DNA, 25 bp, Mus musculus
aatctggtgcagcttgtcccggtgt

SEQ ID NO: 78740 - DNA, 25 bp, Mus musculus
aatctggtgcaggttgtcccggtgt

SEQ ID NO: 78741 - DNA, 25 bp, Mus musculus
aatctggtgttgaacaactaagtca

SEQ ID NO: 78742 - DNA, 25 bp, Mus musculus
aatctggtgttgtacaactaagtca

SEQ ID NO: 78743 - DNA, 25 bp, Mus musculus
aatctggtgtttagtccactgctca

SEQ ID NO: 78744 - DNA, 25 bp, Mus musculus
aatctggtgttttgtccactgctca

SEQ ID NO: 78745 - DNA, 25 bp, Mus musculus
aatctggttcataggaatttcctgc

SEQ ID NO: 78746 - DNA, 25 bp, Mus musculus
aatctggttcattggaatttcctgc

SEQ ID NO: 78747 - DNA, 25 bp, Mus musculus
aatctggttgatattgcgatatcag

SEQ ID NO: 78748 - DNA, 25 bp, Mus musculus
aatctggttgattttgcgatatcag

SEQ ID NO: 78749 - DNA, 25 bp, Mus musculus
aatctggtttagctcacgttgtaca

SEQ ID NO: 78750 - DNA, 25 bp, Mus musculus
aatctggtttaggtcacgttgtaca

SEQ ID NO: 78751 - DNA, 25 bp, Mus musculus
aatctggtttcaatagaacccacag

SEQ ID NO: 78752 - DNA, 25 bp, Mus musculus
aatctggtttcattagaacccacag

SEQ ID NO: 78753 - DNA, 25 bp, Mus musculus
aatctggtttgaacttgtgcatcct

SEQ ID NO: 78754 - DNA, 25 bp, Mus musculus
aatctggtttgatcttgtgcatcct

SEQ ID NO: 78755 - DNA, 25 bp, Mus musculus
aatctggtttgtaatcatttattta

SEQ ID NO: 78756 - DNA, 25 bp, Mus musculus
aatctggtttgttatcatttattta

SEQ ID NO: 78757 - DNA, 25 bp, Mus musculus
aatctgtaacacatttgtggagacg

SEQ ID NO: 78758 - DNA, 25 bp, Mus musculus
aatctgtaacacttttgtggagacg

SEQ ID NO: 78759 - DNA, 25 bp, Mus musculus
aatctgtacaacaaaggctcttgtg

SEQ ID NO: 78760 - DNA, 25 bp, Mus musculus
aatctgtacaactaaggctcttgtg

SEQ ID NO: 78761 - DNA, 25 bp, Mus musculus
aatctgtacagaaacagctgaccgg

SEQ ID NO: 78762 - DNA, 25 bp, Mus musculus
aatctgtacagatacagctgaccgg

SEQ ID NO: 78763 - DNA, 25 bp, Mus musculus
aatctgtacagtatcacgtgtttac

SEQ ID NO: 78764 - DNA, 25 bp, Mus musculus
aatctgtacagtttcacgtgtttac

SEQ ID NO: 78765 - DNA, 25 bp, Mus musculus
aatctgtacgcacgtgtagggcact

SEQ ID NO: 78766 - DNA, 25 bp, Mus musculus
aatctgtacgcaggtgtagggcact

SEQ ID NO: 78767 - DNA, 25 bp, Mus musculus
aatctgtacgtaattcgaatcttta

SEQ ID NO: 78768 - DNA, 25 bp, Mus musculus
aatctgtacgtatttcgaatcttta

SEQ ID NO: 78769 - DNA, 25 bp, Mus musculus
aatctgtaggaaactgcctctgtcc

SEQ ID NO: 78770 - DNA, 25 bp, Mus musculus
aatctgtaggaatctgcctctgtcc

SEQ ID NO: 78771 - DNA, 25 bp, Mus musculus
aatctgtaggctcaatgcttctgga

SEQ ID NO: 78772 - DNA, 25 bp, Mus musculus
aatctgtaggctgaatgcttctgga

SEQ ID NO: 78773 - DNA, 25 bp, Mus musculus
aatctgtagtctccctatcgtttta

SEQ ID NO: 78774 - DNA, 25 bp, Mus musculus
aatctgtagtctgcctatcgtttta

SEQ ID NO: 78775 - DNA, 25 bp, Mus musculus
aatctgtatgggaaatggacctata

SEQ ID NO: 78776 - DNA, 25 bp, Mus musculus
aatctgtatgggtaatggacctata

SEQ ID NO: 78777 - DNA, 25 bp, Mus musculus
aatctgtattctatcattccctctg

SEQ ID NO: 78778 - DNA, 25 bp, Mus musculus
aatctgtattctttcattccctctg

SEQ ID NO: 78779 - DNA, 25 bp, Mus musculus
aatctgtattgaactgatttcagta

SEQ ID NO: 78780 - DNA, 25 bp, Mus musculus
aatctgtattgatctgatttcagta

SEQ ID NO: 78781 - DNA, 25 bp, Mus musculus
aatctgtcactgaggactcaggctc

SEQ ID NO: 78782 - DNA, 25 bp, Mus musculus
aatctgtcactgtggactcaggctc

SEQ ID NO: 78783 - DNA, 25 bp, Mus musculus
aatctgtcagatatcctagcttagc

SEQ ID NO: 78784 - DNA, 25 bp, Mus musculus
aatctgtcagatttcctagcttagc

SEQ ID NO: 78785 - DNA, 25 bp, Mus musculus
aatctgtccatgctggactcaataa

SEQ ID NO: 78786 - DNA, 25 bp, Mus musculus
aatctgtccatggtggactcaataa

SEQ ID NO: 78787 - DNA, 25 bp, Mus musculus
aatctgtcctctaatggagtctctc

SEQ ID NO: 78788 - DNA, 25 bp, Mus musculus
aatctgtcctcttatggagtctctc

SEQ ID NO: 78789 - DNA, 25 bp, Mus musculus
aatctgtctccaatttaactcttga

SEQ ID NO: 78790 - DNA, 25 bp, Mus musculus
aatctgtctccattttaactcttga

SEQ ID NO: 78791 - DNA, 25 bp, Mus musculus
aatctgtctcttcactgtgtcccca

SEQ ID NO: 78792 - DNA, 25 bp, Mus musculus
aatctgtctcttgactgtgtcccca

SEQ ID NO: 78793 - DNA, 25 bp, Mus musculus
aatctgtctgacaggacctttgaat

SEQ ID NO: 78794 - DNA, 25 bp, Mus musculus
aatctgtctgactggacctttgaat

SEQ ID NO: 78795 - DNA, 25 bp, Mus musculus
aatctgtctgggagtcggtcttctt

SEQ ID NO: 78796 - DNA, 25 bp, Mus musculus
aatctgtctgggtgtcggtcttctt

SEQ ID NO: 78797 - DNA, 25 bp, Mus musculus
aatctgtctgtgaggcccaagagct

SEQ ID NO: 78798 - DNA, 25 bp, Mus musculus
aatctgtctgtgtggcccaagagct

SEQ ID NO: 78799 - DNA, 25 bp, Mus musculus
aatctgtctttaacatgatttagaa

SEQ ID NO: 78800 - DNA, 25 bp, Mus musculus
aatctgtctttatcatgatttagaa

SEQ ID NO: 78801 - DNA, 25 bp, Mus musculus
aatctgtctttcactgggctgaagc

SEQ ID NO: 78802 - DNA, 25 bp, Mus musculus
aatctgtctttctctgggctgaagc

SEQ ID NO: 78803 - DNA, 25 bp, Mus musculus
aatctgtgacacattcatgaagtca

SEQ ID NO: 78804 - DNA, 25 bp, Mus musculus
aatctgtgacacattttcggagtca

SEQ ID NO: 78805 - DNA, 25 bp, Mus musculus
aatctgtgacactttcatgaagtca

SEQ ID NO: 78806 - DNA, 25 bp, Mus musculus
aatctgtgacactttttcggagtca

SEQ ID NO: 78807 - DNA, 25 bp, Mus musculus
aatctgtgcatcagtcaccctggac

SEQ ID NO: 78808 - DNA, 25 bp, Mus musculus
aatctgtgcatctgtcaccctggac

SEQ ID NO: 78809 - DNA, 25 bp, Mus musculus
aatctgtgcccgagaattcttcata

SEQ ID NO: 78810 - DNA, 25 bp, Mus musculus
aatctgtgcccgtgaattcttcata

SEQ ID NO: 78811 - DNA, 25 bp, Mus musculus
aatctgtgccctaaattgccattag

SEQ ID NO: 78812 - DNA, 25 bp, Mus musculus
aatctgtgcccttaattgccattag

SEQ ID NO: 78813 - DNA, 25 bp, Mus musculus
aatctgtgcttaaagtggttctctc

SEQ ID NO: 78814 - DNA, 25 bp, Mus musculus
aatctgtgcttatagtggttctctc

SEQ ID NO: 78815 - DNA, 25 bp, Mus musculus
aatctgtgcttcagagtttgatcag

SEQ ID NO: 78816 - DNA, 25 bp, Mus musculus
aatctgtgcttctgagtttgatcag

SEQ ID NO: 78817 - DNA, 25 bp, Mus musculus
aatctgtggaggctctagcccctgt

SEQ ID NO: 78818 - DNA, 25 bp, Mus musculus
aatctgtggagggtctagcccctgt

SEQ ID NO: 78819 - DNA, 25 bp, Mus musculus
aatctgtggcttcctgaaatttgag

SEQ ID NO: 78820 - DNA, 25 bp, Mus musculus
aatctgtggcttgctgaaatttgag

SEQ ID NO: 78821 - DNA, 25 bp, Mus musculus
aatctgtggtaactgccaggagacc

SEQ ID NO: 78822 - DNA, 25 bp, Mus musculus
aatctgtggtaagtgccaggagacc

SEQ ID NO: 78823 - DNA, 25 bp, Mus musculus
aatctgtggtacatgtcatccttgg

SEQ ID NO: 78824 - DNA, 25 bp, Mus musculus
aatctgtggtacttgtcatccttgg

SEQ ID NO: 78825 - DNA, 25 bp, Mus musculus
aatctgtggtgaagtcgttttctaa

SEQ ID NO: 78826 - DNA, 25 bp, Mus musculus
aatctgtggtgatgtcgttttctaa

SEQ ID NO: 78827 - DNA, 25 bp, Mus musculus
aatctgtgtgctccttggctcttaa

SEQ ID NO: 78828 - DNA, 25 bp, Mus musculus
aatctgtgtgctgcttggctcttaa

SEQ ID NO: 78829 - DNA, 25 bp, Mus musculus
aatctgtgtgtccttgttactgcaa

SEQ ID NO: 78830 - DNA, 25 bp, Mus musculus
aatctgtgtgtcgttgttactgcaa

SEQ ID NO: 78831 - DNA, 25 bp, Mus musculus
aatctgtgtgtgctactttcaaaat

SEQ ID NO: 78832 - DNA, 25 bp, Mus musculus
aatctgtgtgtggtactttcaaaat

SEQ ID NO: 78833 - DNA, 25 bp, Mus musculus
aatctgttacacattgctgcatcaa

SEQ ID NO: 78834 - DNA, 25 bp, Mus musculus
aatctgttacactttgctgcatcaa

SEQ ID NO: 78835 - DNA, 25 bp, Mus musculus
aatctgttactactttggaatgttt

SEQ ID NO: 78836 - DNA, 25 bp, Mus musculus
aatctgttactagtttggaatgttt

SEQ ID NO: 78837 - DNA, 25 bp, Mus musculus
aatctgttagacatctctgcacctg

SEQ ID NO: 78838 - DNA, 25 bp, Mus musculus
aatctgttagacttctctgcacctg

SEQ ID NO: 78839 - DNA, 25 bp, Mus musculus
aatctgttagccacgtgctgtgacg

SEQ ID NO: 78840 - DNA, 25 bp, Mus musculus
aatctgttagcctcgtgctgtgacg

SEQ ID NO: 78841 - DNA, 25 bp, Mus musculus
aatctgttaggaacctccaggctaa

SEQ ID NO: 78842 - DNA, 25 bp, Mus musculus
aatctgttaggatcctccaggctaa

SEQ ID NO: 78843 - DNA, 25 bp, Mus musculus
aatctgttataccttgctccagcac

SEQ ID NO: 78844 - DNA, 25 bp, Mus musculus
aatctgttatacgttgctccagcac

SEQ ID NO: 78845 - DNA, 25 bp, Mus musculus
aatctgttcagacttccttgtggct

SEQ ID NO: 78846 - DNA, 25 bp, Mus musculus
aatctgttcagagttccttgtggct

SEQ ID NO: 78847 - DNA, 25 bp, Mus musculus
aatctgttccagctatctatttcat

SEQ ID NO: 78848 - DNA, 25 bp, Mus musculus
aatctgttccaggtatctatttcat

SEQ ID NO: 78849 - DNA, 25 bp, Mus musculus
aatctgttccctcgtcatgctgcca

SEQ ID NO: 78850 - DNA, 25 bp, Mus musculus
aatctgttccctggtcatgctgcca

SEQ ID NO: 78851 - DNA, 25 bp, Mus musculus
aatctgttcctgatacccagtgata

SEQ ID NO: 78852 - DNA, 25 bp, Mus musculus
aatctgttcctgttacccagtgata

SEQ ID NO: 78853 - DNA, 25 bp, Mus musculus
aatctgttcgacacaggaacctcct

SEQ ID NO: 78854 - DNA, 25 bp, Mus musculus
aatctgttcgactcaggaacctcct

SEQ ID NO: 78855 - DNA, 25 bp, Mus musculus
aatctgttctgactggaagggcgca

SEQ ID NO: 78856 - DNA, 25 bp, Mus musculus
aatctgttctgagtggaagggcgca

SEQ ID NO: 78857 - DNA, 25 bp, Mus musculus
aatctgttgactccgtgttttgtaa

SEQ ID NO: 78858 - DNA, 25 bp, Mus musculus
aatctgttgactgcgtgttttgtaa

SEQ ID NO: 78859 - DNA, 25 bp, Mus musculus
aatctgttgtggctgatgcctgtca

SEQ ID NO: 78860 - DNA, 25 bp, Mus musculus
aatctgttgtgggtgatgcctgtca

SEQ ID NO: 78861 - DNA, 25 bp, Mus musculus
aatctgttgtgtagagtgactctcc

SEQ ID NO: 78862 - DNA, 25 bp, Mus musculus
aatctgttgtgttgagtgactctcc

SEQ ID NO: 78863 - DNA, 25 bp, Mus musculus
aatctgttgttcagccatagaccaa

SEQ ID NO: 78864 - DNA, 25 bp, Mus musculus
aatctgttgttctgccatagaccaa

SEQ ID NO: 78865 - DNA, 25 bp, Mus musculus
aatctgtttattctagctctaccat

SEQ ID NO: 78866 - DNA, 25 bp, Mus musculus
aatctgtttattgtagctctaccat

SEQ ID NO: 78867 - DNA, 25 bp, Mus musculus
aatctgtttcccaattctggtatgc

SEQ ID NO: 78868 - DNA, 25 bp, Mus musculus
aatctgtttccctattctggtatgc

SEQ ID NO: 78869 - DNA, 25 bp, Mus musculus
aatctgtttctgaaagtgcctgtgt

SEQ ID NO: 78870 - DNA, 25 bp, Mus musculus
aatctgtttctgtaagtgcctgtgt

SEQ ID NO: 78871 - DNA, 25 bp, Mus musculus
aatctgtttgtcatacacgtctctc

SEQ ID NO: 78872 - DNA, 25 bp, Mus musculus
aatctgtttgtcttacacgtctctc

SEQ ID NO: 78873 - DNA, 25 bp, Mus musculus
aatctgtttgtgcttcctccaatca

SEQ ID NO: 78874 - DNA, 25 bp, Mus musculus
aatctgtttgtggttcctccaatca

SEQ ID NO: 78875 - DNA, 25 bp, Mus musculus
aatcttaaaagtagtgttccctatg

SEQ ID NO: 78876 - DNA, 25 bp, Mus musculus
aatcttaaaagttgtgttccctatg

SEQ ID NO: 78877 - DNA, 25 bp, Mus musculus
aatcttaacccacaacatcgttgtt

SEQ ID NO: 78878 - DNA, 25 bp, Mus musculus
aatcttaacccacgtagatgtctga

SEQ ID NO: 78879 - DNA, 25 bp, Mus musculus
aatcttaacccagaacatcgttgtt

SEQ ID NO: 78880 - DNA, 25 bp, Mus musculus
aatcttaacccaggtagatgtctga

SEQ ID NO: 78881 - DNA, 25 bp, Mus musculus
aatcttaactcactgtcctatgccc

SEQ ID NO: 78882 - DNA, 25 bp, Mus musculus
aatcttaactcagtgtcctatgccc

SEQ ID NO: 78883 - DNA, 25 bp, Mus musculus
aatcttaaggtcatgcctcacaaag

SEQ ID NO: 78884 - DNA, 25 bp, Mus musculus
aatcttaaggtcttgcctcacaaag

SEQ ID NO: 78885 - DNA, 25 bp, Mus musculus
aatcttaattgtatgtagttcagga

SEQ ID NO: 78886 - DNA, 25 bp, Mus musculus
aatcttaattgtttgtagttcagga

SEQ ID NO: 78887 - DNA, 25 bp, Mus musculus
aatcttacaaatattaacgtctagt

SEQ ID NO: 78888 - DNA, 25 bp, Mus musculus
aatcttacaaattttaacgtctagt

SEQ ID NO: 78889 - DNA, 25 bp, Mus musculus
aatcttacactgaaacttctggaga

SEQ ID NO: 78890 - DNA, 25 bp, Mus musculus
aatcttacactgtaacttctggaga

SEQ ID NO: 78891 - DNA, 25 bp, Mus musculus
aatcttaccaccagctatagcctga

SEQ ID NO: 78892 - DNA, 25 bp, Mus musculus
aatcttaccacctgctatagcctga

SEQ ID NO: 78893 - DNA, 25 bp, Mus musculus
aatcttactcatctcctctatgtta

SEQ ID NO: 78894 - DNA, 25 bp, Mus musculus
aatcttactcatgtcctctatgtta

SEQ ID NO: 78895 - DNA, 25 bp, Mus musculus
aatcttactctgctttgtcagtcct

SEQ ID NO: 78896 - DNA, 25 bp, Mus musculus
aatcttactctggtttgtcagtcct

SEQ ID NO: 78897 - DNA, 25 bp, Mus musculus
aatcttactcttaagtccctagtgc

SEQ ID NO: 78898 - DNA, 25 bp, Mus musculus
aatcttactctttagtccctagtgc

SEQ ID NO: 78899 - DNA, 25 bp, Mus musculus
aatcttagagtcacctgacctttcc

SEQ ID NO: 78900 - DNA, 25 bp, Mus musculus
aatcttagagtctcctgacctttcc

SEQ ID NO: 78901 - DNA, 25 bp, Mus musculus
aatcttagccaccatgagctcgcaa

SEQ ID NO: 78902 - DNA, 25 bp, Mus musculus
aatcttagccacgatgagctcgcaa

SEQ ID NO: 78903 - DNA, 25 bp, Mus musculus
aatcttaggagtactgtcgtcggtt

SEQ ID NO: 78904 - DNA, 25 bp, Mus musculus
aatcttaggagttctgtcgtcggtt

SEQ ID NO: 78905 - DNA, 25 bp, Mus musculus
aatcttagtcttcagctctgctttg

SEQ ID NO: 78906 - DNA, 25 bp, Mus musculus
aatcttagtcttgagctctgctttg

SEQ ID NO: 78907 - DNA, 25 bp, Mus musculus
aatcttatagacaacccgtccatga

SEQ ID NO: 78908 - DNA, 25 bp, Mus musculus
aatcttatagactacccgtccatga

SEQ ID NO: 78909 - DNA, 25 bp, Mus musculus
aatcttatagagatagctactctgt

SEQ ID NO: 78910 - DNA, 25 bp, Mus musculus
aatcttatagagttagctactctgt

SEQ ID NO: 78911 - DNA, 25 bp, Mus musculus
aatcttatatatagagcttcgtgtt

SEQ ID NO: 78912 - DNA, 25 bp, Mus musculus
aatcttatatattgagcttcgtgtt

SEQ ID NO: 78913 - DNA, 25 bp, Mus musculus
aatcttatgctacacttgagcctca

SEQ ID NO: 78914 - DNA, 25 bp, Mus musculus
aatcttatgctagacttgagcctca

SEQ ID NO: 78915 - DNA, 25 bp, Mus musculus
aatcttatgctcatggtttctggga

SEQ ID NO: 78916 - DNA, 25 bp, Mus musculus
aatcttatgctcttggtttctggga

SEQ ID NO: 78917 - DNA, 25 bp, Mus musculus
aatcttattctgcatctaaagtcaa

SEQ ID NO: 78918 - DNA, 25 bp, Mus musculus
aatcttattctggatctaaagtcaa

SEQ ID NO: 78919 - DNA, 25 bp, Mus musculus
aatcttatttatagtacatacctgg

SEQ ID NO: 78920 - DNA, 25 bp, Mus musculus
aatcttatttattgtacatacctgg

SEQ ID NO: 78921 - DNA, 25 bp, Mus musculus
aatcttcaagagatccatcacctct

SEQ ID NO: 78922 - DNA, 25 bp, Mus musculus
aatcttcaagagttccatcacctct

SEQ ID NO: 78923 - DNA, 25 bp, Mus musculus
aatcttcaagttaagtgattcactg

SEQ ID NO: 78924 - DNA, 25 bp, Mus musculus
aatcttcaagtttagtgattcactg

SEQ ID NO: 78925 - DNA, 25 bp, Mus musculus
aatcttcaccgaatctccaaatctg

SEQ ID NO: 78926 - DNA, 25 bp, Mus musculus
aatcttcaccgattctccaaatctg

SEQ ID NO: 78927 - DNA, 25 bp, Mus musculus
aatcttcaggcgagaccaagggaac

SEQ ID NO: 78928 - DNA, 25 bp, Mus musculus
aatcttcaggcgtgaccaagggaac

SEQ ID NO: 78929 - DNA, 25 bp, Mus musculus
aatcttcagtaaatgccccaaagcc

SEQ ID NO: 78930 - DNA, 25 bp, Mus musculus
aatcttcagtaattgccccaaagcc

SEQ ID NO: 78931 - DNA, 25 bp, Mus musculus
aatcttcagtataagtaacacagga

SEQ ID NO: 78932 - DNA, 25 bp, Mus musculus
aatcttcagtattagtaacacagga

SEQ ID NO: 78933 - DNA, 25 bp, Mus musculus
aatcttcatagtctcacaggacccc

SEQ ID NO: 78934 - DNA, 25 bp, Mus musculus
aatcttcatagtgtcacaggacccc

SEQ ID NO: 78935 - DNA, 25 bp, Mus musculus
aatcttcatcaaccctggagcagat

SEQ ID NO: 78936 - DNA, 25 bp, Mus musculus
aatcttcatcaagcctggagcagat

SEQ ID NO: 78937 - DNA, 25 bp, Mus musculus
aatcttcatctcagaaaagtggcaa

SEQ ID NO: 78938 - DNA, 25 bp, Mus musculus
aatcttcatctctgaaaagtggcaa

SEQ ID NO: 78939 - DNA, 25 bp, Mus musculus
aatcttcatgtccttggtggtgggc

SEQ ID NO: 78940 - DNA, 25 bp, Mus musculus
aatcttcatgtcgttggtggtgggc

SEQ ID NO: 78941 - DNA, 25 bp, Mus musculus
aatcttcatttcaatcactttgtgg

SEQ ID NO: 78942 - DNA, 25 bp, Mus musculus
aatcttcatttctatcactttgtgg

SEQ ID NO: 78943 - DNA, 25 bp, Mus musculus
aatcttcatttgcagttcatgtaac

SEQ ID NO: 78944 - DNA, 25 bp, Mus musculus
aatcttcatttgcttaactgactag

SEQ ID NO: 78945 - DNA, 25 bp, Mus musculus
aatcttcatttggagttcatgtaac

SEQ ID NO: 78946 - DNA, 25 bp, Mus musculus
aatcttcatttggttaactgactag

SEQ ID NO: 78947 - DNA, 25 bp, Mus musculus
aatcttcattttcaatcagacgggt

SEQ ID NO: 78948 - DNA, 25 bp, Mus musculus
aatcttcattttgaatcagacgggt

SEQ ID NO: 78949 - DNA, 25 bp, Mus musculus
aatcttccaagaacatgcccgtatg

SEQ ID NO: 78950 - DNA, 25 bp, Mus musculus
aatcttccaagatcatgcccgtatg

SEQ ID NO: 78951 - DNA, 25 bp, Mus musculus
aatcttccacttatcctctaatgtc

SEQ ID NO: 78952 - DNA, 25 bp, Mus musculus
aatcttccacttcacattgatgtct

SEQ ID NO: 78953 - DNA, 25 bp, Mus musculus
aatcttccacttgacattgatgtct

SEQ ID NO: 78954 - DNA, 25 bp, Mus musculus
aatcttccacttttcctctaatgtc

SEQ ID NO: 78955 - DNA, 25 bp, Mus musculus
aatcttccagcaaacaggagcgcta

SEQ ID NO: 78956 - DNA, 25 bp, Mus musculus
aatcttccagcatacaggagcgcta

SEQ ID NO: 78957 - DNA, 25 bp, Mus musculus
aatcttccagggacacctaatgttt

SEQ ID NO: 78958 - DNA, 25 bp, Mus musculus
aatcttccagggtcacctaatgttt

SEQ ID NO: 78959 - DNA, 25 bp, Mus musculus
aatcttccatatcttgcaatgccaa

SEQ ID NO: 78960 - DNA, 25 bp, Mus musculus
aatcttccatatgttgcaatgccaa

SEQ ID NO: 78961 - DNA, 25 bp, Mus musculus
aatcttcccactcctttgtgattgg

SEQ ID NO: 78962 - DNA, 25 bp, Mus musculus
aatcttcccactgctttgtgattgg

SEQ ID NO: 78963 - DNA, 25 bp, Mus musculus
aatcttcccagaagagtctatatac

SEQ ID NO: 78964 - DNA, 25 bp, Mus musculus
aatcttcccagacatcagtgggtca

SEQ ID NO: 78965 - DNA, 25 bp, Mus musculus
aatcttcccagagatcagtgggtca

SEQ ID NO: 78966 - DNA, 25 bp, Mus musculus
aatcttcccagatgagtctatatac

SEQ ID NO: 78967 - DNA, 25 bp, Mus musculus
aatcttccccaaactagctcattaa

SEQ ID NO: 78968 - DNA, 25 bp, Mus musculus
aatcttccccaatctagctcattaa

SEQ ID NO: 78969 - DNA, 25 bp, Mus musculus
aatcttcgctgtatctgacttttct

SEQ ID NO: 78970 - DNA, 25 bp, Mus musculus
aatcttcgctgtttctgacttttct

SEQ ID NO: 78971 - DNA, 25 bp, Mus musculus
aatcttcgcttgattttggctgtaa

SEQ ID NO: 78972 - DNA, 25 bp, Mus musculus
aatcttcgcttgtttttggctgtaa

SEQ ID NO: 78973 - DNA, 25 bp, Mus musculus
aatcttcggtcaagaggtaacccac

SEQ ID NO: 78974 - DNA, 25 bp, Mus musculus
aatcttcggtcatgaggtaacccac

SEQ ID NO: 78975 - DNA, 25 bp, Mus musculus
aatcttcgttgccatactgtctaga

SEQ ID NO: 78976 - DNA, 25 bp, Mus musculus
aatcttcgttgcgatactgtctaga

SEQ ID NO: 78977 - DNA, 25 bp, Mus musculus
aatcttcgttgtatcttggcctgac

SEQ ID NO: 78978 - DNA, 25 bp, Mus musculus
aatcttcgttgtttcttggcctgac

SEQ ID NO: 78979 - DNA, 25 bp, Mus musculus
aatcttctaggactcctggcaggtg

SEQ ID NO: 78980 - DNA, 25 bp, Mus musculus
aatcttctaggagtcctggcaggtg

SEQ ID NO: 78981 - DNA, 25 bp, Mus musculus
aatcttctatacatggagctgtctt

SEQ ID NO: 78982 - DNA, 25 bp, Mus musculus
aatcttctatacttggagctgtctt

SEQ ID NO: 78983 - DNA, 25 bp, Mus musculus
aatcttctattacgtttttctccag

SEQ ID NO: 78984 - DNA, 25 bp, Mus musculus
aatcttctattaggtttttctccag

SEQ ID NO: 78985 - DNA, 25 bp, Mus musculus
aatcttctcagtcaccaggcatgac

SEQ ID NO: 78986 - DNA, 25 bp, Mus musculus
aatcttctcagtgaccaggcatgac

SEQ ID NO: 78987 - DNA, 25 bp, Mus musculus
aatcttctccagatttttcggaggc

SEQ ID NO: 78988 - DNA, 25 bp, Mus musculus
aatcttctccagttttttcggaggc

SEQ ID NO: 78989 - DNA, 25 bp, Mus musculus
aatcttctcctcctatggtattatg

SEQ ID NO: 78990 - DNA, 25 bp, Mus musculus
aatcttctcctcgtatggtattatg

SEQ ID NO: 78991 - DNA, 25 bp, Mus musculus
aatcttctcgacattggcacatact

SEQ ID NO: 78992 - DNA, 25 bp, Mus musculus
aatcttctcgactttggcacatact

SEQ ID NO: 78993 - DNA, 25 bp, Mus musculus
aatcttctctagacttcgttgtaaa

SEQ ID NO: 78994 - DNA, 25 bp, Mus musculus
aatcttctctagtcttcgttgtaaa

SEQ ID NO: 78995 - DNA, 25 bp, Mus musculus
aatcttctctcaagaatgtgtggtg

SEQ ID NO: 78996 - DNA, 25 bp, Mus musculus
aatcttctctcatgaatgtgtggtg

SEQ ID NO: 78997 - DNA, 25 bp, Mus musculus
aatcttctctctccgtgtaggtagg

SEQ ID NO: 78998 - DNA, 25 bp, Mus musculus
aatcttctctctgcgtgtaggtagg

SEQ ID NO: 78999 - DNA, 25 bp, Mus musculus
aatcttctgaatagccttgttgtcc

SEQ ID NO: 79000 - DNA, 25 bp, Mus musculus
aatcttctgaattgccttgttgtcc

SEQ ID NO: 79001 - DNA, 25 bp, Mus musculus
aatcttctgcctaccaggctttaaa

SEQ ID NO: 79002 - DNA, 25 bp, Mus musculus
aatcttctgccttccaggctttaaa

SEQ ID NO: 79003 - DNA, 25 bp, Mus musculus
aatcttctggccactcgaattggaa

SEQ ID NO: 79004 - DNA, 25 bp, Mus musculus
aatcttctggcctctcgaattggaa

SEQ ID NO: 79005 - DNA, 25 bp, Mus musculus
aatcttctggtaattggagctcaat

SEQ ID NO: 79006 - DNA, 25 bp, Mus musculus
aatcttctggtatttggagctcaat

SEQ ID NO: 79007 - DNA, 25 bp, Mus musculus
aatcttcttacactcagtacattta

SEQ ID NO: 79008 - DNA, 25 bp, Mus musculus
aatcttcttacagtcagtacattta

SEQ ID NO: 79009 - DNA, 25 bp, Mus musculus
aatcttcttataacacttgtcctga

SEQ ID NO: 79010 - DNA, 25 bp, Mus musculus
aatcttcttatatcacttgtcctga

SEQ ID NO: 79011 - DNA, 25 bp, Mus musculus
aatcttcttccaaagagttcatttc

SEQ ID NO: 79012 - DNA, 25 bp, Mus musculus
aatcttcttccatagagttcatttc

SEQ ID NO: 79013 - DNA, 25 bp, Mus musculus
aatcttcttgaacggctgacacggg

SEQ ID NO: 79014 - DNA, 25 bp, Mus musculus
aatcttcttgaagggctgacacggg

SEQ ID NO: 79015 - DNA, 25 bp, Mus musculus
aatcttcttggcaattccttatctt

SEQ ID NO: 79016 - DNA, 25 bp, Mus musculus
aatcttcttggctattccttatctt

SEQ ID NO: 79017 - DNA, 25 bp, Mus musculus
aatcttctttgaccatatgtgctac

SEQ ID NO: 79018 - DNA, 25 bp, Mus musculus
aatcttctttgagcatatgtgctac

SEQ ID NO: 79019 - DNA, 25 bp, Mus musculus
aatcttctttttacaccatcaggca

SEQ ID NO: 79020 - DNA, 25 bp, Mus musculus
aatcttcttttttcaccatcaggca

SEQ ID NO: 79021 - DNA, 25 bp, Mus musculus
aatcttgaaatgatccgcagcagaa

SEQ ID NO: 79022 - DNA, 25 bp, Mus musculus
aatcttgaaatgttccgcagcagaa

SEQ ID NO: 79023 - DNA, 25 bp, Mus musculus
aatcttgaactgattgttgactagg

SEQ ID NO: 79024 - DNA, 25 bp, Mus musculus
aatcttgaactgtttgttgactagg

SEQ ID NO: 79025 - DNA, 25 bp, Mus musculus
aatcttgacaacctctgcattttaa

SEQ ID NO: 79026 - DNA, 25 bp, Mus musculus
aatcttgacaacgtctgcattttaa

SEQ ID NO: 79027 - DNA, 25 bp, Mus musculus
aatcttgacactcaatccctagctc

SEQ ID NO: 79028 - DNA, 25 bp, Mus musculus
aatcttgacactcctggcacaaatg

SEQ ID NO: 79029 - DNA, 25 bp, Mus musculus
aatcttgacactgaatccctagctc

SEQ ID NO: 79030 - DNA, 25 bp, Mus musculus
aatcttgacactgctggcacaaatg

SEQ ID NO: 79031 - DNA, 25 bp, Mus musculus
aatcttgactatcacttcgctagga

SEQ ID NO: 79032 - DNA, 25 bp, Mus musculus
aatcttgactatgacttcgctagga

SEQ ID NO: 79033 - DNA, 25 bp, Mus musculus
aatcttgactgtaattatgccctag

SEQ ID NO: 79034 - DNA, 25 bp, Mus musculus
aatcttgactgttattatgccctag

SEQ ID NO: 79035 - DNA, 25 bp, Mus musculus
aatcttgacttactgtcatcctccg

SEQ ID NO: 79036 - DNA, 25 bp, Mus musculus
aatcttgacttagtgtcatcctccg

SEQ ID NO: 79037 - DNA, 25 bp, Mus musculus
aatcttgacttgagcaaccgctatc

SEQ ID NO: 79038 - DNA, 25 bp, Mus musculus
aatcttgacttgcttaattctagta

SEQ ID NO: 79039 - DNA, 25 bp, Mus musculus
aatcttgacttggttaattctagta

SEQ ID NO: 79040 - DNA, 25 bp, Mus musculus
aatcttgacttgtgcaaccgctatc

SEQ ID NO: 79041 - DNA, 25 bp, Mus musculus
aatcttgagaaacgcccatcccgga

SEQ ID NO: 79042 - DNA, 25 bp, Mus musculus
aatcttgagaaaggcccatcccgga

SEQ ID NO: 79043 - DNA, 25 bp, Mus musculus
aatcttgagactaaggtgcggctgc

SEQ ID NO: 79044 - DNA, 25 bp, Mus musculus
aatcttgagactctgtgtggaccct

SEQ ID NO: 79045 - DNA, 25 bp, Mus musculus
aatcttgagactgtgtgtggaccct

SEQ ID NO: 79046 - DNA, 25 bp, Mus musculus
aatcttgagacttaggtgcggctgc

SEQ ID NO: 79047 - DNA, 25 bp, Mus musculus
aatcttgagcctacagcttacctag

SEQ ID NO: 79048 - DNA, 25 bp, Mus musculus
aatcttgagccttcagcttacctag

SEQ ID NO: 79049 - DNA, 25 bp, Mus musculus
aatcttgataggatctcatcctaac

SEQ ID NO: 79050 - DNA, 25 bp, Mus musculus
aatcttgataggttctcatcctaac

SEQ ID NO: 79051 - DNA, 25 bp, Mus musculus
aatcttgatatccttcagaagcaca

SEQ ID NO: 79052 - DNA, 25 bp, Mus musculus
aatcttgatatcgttcagaagcaca

SEQ ID NO: 79053 - DNA, 25 bp, Mus musculus
aatcttgatcttctgactgtggtag

SEQ ID NO: 79054 - DNA, 25 bp, Mus musculus
aatcttgatcttgtgactgtggtag

SEQ ID NO: 79055 - DNA, 25 bp, Mus musculus
aatcttgattttagtaaccttgcaa

SEQ ID NO: 79056 - DNA, 25 bp, Mus musculus
aatcttgatttttgtaaccttgcaa

SEQ ID NO: 79057 - DNA, 25 bp, Mus musculus
aatcttgcaggtagttctgcttcta

SEQ ID NO: 79058 - DNA, 25 bp, Mus musculus
aatcttgcaggtatcaaaggcttcc

SEQ ID NO: 79059 - DNA, 25 bp, Mus musculus
aatcttgcaggttgttctgcttcta

SEQ ID NO: 79060 - DNA, 25 bp, Mus musculus
aatcttgcaggtttcaaaggcttcc

SEQ ID NO: 79061 - DNA, 25 bp, Mus musculus
aatcttgcagttacaatgtgcacac

SEQ ID NO: 79062 - DNA, 25 bp, Mus musculus
aatcttgcagtttcaatgtgcacac

SEQ ID NO: 79063 - DNA, 25 bp, Mus musculus
aatcttgccaagcacagtacaactg

SEQ ID NO: 79064 - DNA, 25 bp, Mus musculus
aatcttgccaaggacagtacaactg

SEQ ID NO: 79065 - DNA, 25 bp, Mus musculus
aatcttgccgataacacttgtggtt

SEQ ID NO: 79066 - DNA, 25 bp, Mus musculus
aatcttgccgattacacttgtggtt

SEQ ID NO: 79067 - DNA, 25 bp, Mus musculus
aatcttgcctcacgaacagaaccac

SEQ ID NO: 79068 - DNA, 25 bp, Mus musculus
aatcttgcctcaggaacagaaccac

SEQ ID NO: 79069 - DNA, 25 bp, Mus musculus
aatcttgctgctattatgaatcaca

SEQ ID NO: 79070 - DNA, 25 bp, Mus musculus
aatcttgctgctcagaaaacgtaca

SEQ ID NO: 79071 - DNA, 25 bp, Mus musculus
aatcttgctgctgagaaaacgtaca

SEQ ID NO: 79072 - DNA, 25 bp, Mus musculus
aatcttgctgcttttatgaatcaca

SEQ ID NO: 79073 - DNA, 25 bp, Mus musculus
aatcttgctggccattgtcatcgtt

SEQ ID NO: 79074 - DNA, 25 bp, Mus musculus
aatcttgctggcgattgtcatcgtt

SEQ ID NO: 79075 - DNA, 25 bp, Mus musculus
aatcttgctgtaaggtgttttgact

SEQ ID NO: 79076 - DNA, 25 bp, Mus musculus
aatcttgctgtatggtgttttgact

SEQ ID NO: 79077 - DNA, 25 bp, Mus musculus
aatcttggactgcagaggttctgca

SEQ ID NO: 79078 - DNA, 25 bp, Mus musculus
aatcttggactggagaggttctgca

SEQ ID NO: 79079 - DNA, 25 bp, Mus musculus
aatcttggagaaccctacttcgtct

SEQ ID NO: 79080 - DNA, 25 bp, Mus musculus
aatcttggagaagcctacttcgtct

SEQ ID NO: 79081 - DNA, 25 bp, Mus musculus
aatcttggatgcaagttctgtgaca

SEQ ID NO: 79082 - DNA, 25 bp, Mus musculus
aatcttggatgctagttctgtgaca

SEQ ID NO: 79083 - DNA, 25 bp, Mus musculus
aatcttggatgtcattgaaccgtca

SEQ ID NO: 79084 - DNA, 25 bp, Mus musculus
aatcttggatgtgattgaaccgtca

SEQ ID NO: 79085 - DNA, 25 bp, Mus musculus
aatcttggcagactgtgaccatcca

SEQ ID NO: 79086 - DNA, 25 bp, Mus musculus
aatcttggcagagtgtgaccatcca

SEQ ID NO: 79087 - DNA, 25 bp, Mus musculus
aatcttggcatccagactttttatg

SEQ ID NO: 79088 - DNA, 25 bp, Mus musculus
aatcttggcatcgagactttttatg

SEQ ID NO: 79089 - DNA, 25 bp, Mus musculus
aatcttggcatgagcacattcctca

SEQ ID NO: 79090 - DNA, 25 bp, Mus musculus
aatcttggcatgtgcacattcctca

SEQ ID NO: 79091 - DNA, 25 bp, Mus musculus
aatcttggccagcttaggatgcgat

SEQ ID NO: 79092 - DNA, 25 bp, Mus musculus
aatcttggccaggttaggatgcgat

SEQ ID NO: 79093 - DNA, 25 bp, Mus musculus
aatcttgggaacctgaacactaagt

SEQ ID NO: 79094 - DNA, 25 bp, Mus musculus
aatcttgggaacgtgaacactaagt

SEQ ID NO: 79095 - DNA, 25 bp, Mus musculus
aatcttgggttaatgcacattgtac

SEQ ID NO: 79096 - DNA, 25 bp, Mus musculus
aatcttgggttattgcacattgtac

SEQ ID NO: 79097 - DNA, 25 bp, Mus musculus
aatcttggtagcaatagatcgcata

SEQ ID NO: 79098 - DNA, 25 bp, Mus musculus
aatcttggtagctatagatcgcata

SEQ ID NO: 79099 - DNA, 25 bp, Mus musculus
aatcttggtcatatttgtagcacta

SEQ ID NO: 79100 - DNA, 25 bp, Mus musculus
aatcttggtcatttttgtagcacta

SEQ ID NO: 79101 - DNA, 25 bp, Mus musculus
aatcttgtacaaacatttccatcac

SEQ ID NO: 79102 - DNA, 25 bp, Mus musculus
aatcttgtacaatcatttccatcac

SEQ ID NO: 79103 - DNA, 25 bp, Mus musculus
aatcttgtatctctgctggggctgg

SEQ ID NO: 79104 - DNA, 25 bp, Mus musculus
aatcttgtatctgtgctggggctgg

SEQ ID NO: 79105 - DNA, 25 bp, Mus musculus
aatcttgtatgaatgctgacgtgga

SEQ ID NO: 79106 - DNA, 25 bp, Mus musculus
aatcttgtatgattgctgacgtgga

SEQ ID NO: 79107 - DNA, 25 bp, Mus musculus
aatcttgtcaggagtgatgaatgca

SEQ ID NO: 79108 - DNA, 25 bp, Mus musculus
aatcttgtcaggtgtgatgaatgca

SEQ ID NO: 79109 - DNA, 25 bp, Mus musculus
aatcttgtcattcatttattgcctt

SEQ ID NO: 79110 - DNA, 25 bp, Mus musculus
aatcttgtcattctcacctgatgcc

SEQ ID NO: 79111 - DNA, 25 bp, Mus musculus
aatcttgtcattgatttattgcctt

SEQ ID NO: 79112 - DNA, 25 bp, Mus musculus
aatcttgtcattgtcacctgatgcc

SEQ ID NO: 79113 - DNA, 25 bp, Mus musculus
aatcttgtccgcaatgttcgccagg

SEQ ID NO: 79114 - DNA, 25 bp, Mus musculus
aatcttgtccgctatgttcgccagg

SEQ ID NO: 79115 - DNA, 25 bp, Mus musculus
aatcttgtcctgatcgacaaagcga

SEQ ID NO: 79116 - DNA, 25 bp, Mus musculus
aatcttgtcctgttcgacaaagcga

SEQ ID NO: 79117 - DNA, 25 bp, Mus musculus
aatcttgtctccaggttacccagaa

SEQ ID NO: 79118 - DNA, 25 bp, Mus musculus
aatcttgtctcctggttacccagaa

SEQ ID NO: 79119 - DNA, 25 bp, Mus musculus
aatcttgtctttcctatctgtgctc

SEQ ID NO: 79120 - DNA, 25 bp, Mus musculus
aatcttgtctttcttccactcggtc

SEQ ID NO: 79121 - DNA, 25 bp, Mus musculus
aatcttgtctttgctatctgtgctc

SEQ ID NO: 79122 - DNA, 25 bp, Mus musculus
aatcttgtctttgttccactcggtc

SEQ ID NO: 79123 - DNA, 25 bp, Mus musculus
aatcttgtgtacatcctttgatttt

SEQ ID NO: 79124 - DNA, 25 bp, Mus musculus
aatcttgtgtacttcctttgatttt

SEQ ID NO: 79125 - DNA, 25 bp, Mus musculus
aatcttgttagtcctgtggccatct

SEQ ID NO: 79126 - DNA, 25 bp, Mus musculus
aatcttgttagtgctgtggccatct

SEQ ID NO: 79127 - DNA, 25 bp, Mus musculus
aatcttgttatccaagtagccaggc

SEQ ID NO: 79128 - DNA, 25 bp, Mus musculus
aatcttgttatcgaagtagccaggc

SEQ ID NO: 79129 - DNA, 25 bp, Mus musculus
aatcttgttctaagaatcacacttc

SEQ ID NO: 79130 - DNA, 25 bp, Mus musculus
aatcttgttctatgaatcacacttc

SEQ ID NO: 79131 - DNA, 25 bp, Mus musculus
aatcttgttggcaccagcaactgca

SEQ ID NO: 79132 - DNA, 25 bp, Mus musculus
aatcttgttggctccagcaactgca

SEQ ID NO: 79133 - DNA, 25 bp, Mus musculus
aatcttgttgtaattttggcttctt

SEQ ID NO: 79134 - DNA, 25 bp, Mus musculus
aatcttgttgtatttttggcttctt

SEQ ID NO: 79135 - DNA, 25 bp, Mus musculus
aatcttgtttccagtttctcactct

SEQ ID NO: 79136 - DNA, 25 bp, Mus musculus
aatcttgtttcctgtttctcactct

SEQ ID NO: 79137 - DNA, 25 bp, Mus musculus
aatcttgtttctcggaagacgttca

SEQ ID NO: 79138 - DNA, 25 bp, Mus musculus
aatcttgtttctgggaagacgttca

SEQ ID NO: 79139 - DNA, 25 bp, Mus musculus
aatcttgttttgacattagcagttg

SEQ ID NO: 79140 - DNA, 25 bp, Mus musculus
aatcttgttttgtcattagcagttg

SEQ ID NO: 79141 - DNA, 25 bp, Mus musculus
aatctttaaaatccacaggttacac

SEQ ID NO: 79142 - DNA, 25 bp, Mus musculus
aatctttaaaatctgggaagatcga

SEQ ID NO: 79143 - DNA, 25 bp, Mus musculus
aatctttaaaatgcacaggttacac

SEQ ID NO: 79144 - DNA, 25 bp, Mus musculus
aatctttaaaatgtgggaagatcga

SEQ ID NO: 79145 - DNA, 25 bp, Mus musculus
aatctttaagccagcagcagccttc

SEQ ID NO: 79146 - DNA, 25 bp, Mus musculus
aatctttaagcctgcagcagccttc

SEQ ID NO: 79147 - DNA, 25 bp, Mus musculus
aatctttacaacagccctttgacaa

SEQ ID NO: 79148 - DNA, 25 bp, Mus musculus
aatctttacaactgccctttgacaa

SEQ ID NO: 79149 - DNA, 25 bp, Mus musculus
aatctttagaaccagccaagcaagc

SEQ ID NO: 79150 - DNA, 25 bp, Mus musculus
aatctttagaacgagccaagcaagc

SEQ ID NO: 79151 - DNA, 25 bp, Mus musculus
aatctttagaatccccaaatgtttg

SEQ ID NO: 79152 - DNA, 25 bp, Mus musculus
aatctttagaatgcccaaatgtttg

SEQ ID NO: 79153 - DNA, 25 bp, Mus musculus
aatctttagattacctgagagaaaa

SEQ ID NO: 79154 - DNA, 25 bp, Mus musculus
aatctttagatttcctgagagaaaa

SEQ ID NO: 79155 - DNA, 25 bp, Mus musculus
aatctttagcaaacggtcctagacg

SEQ ID NO: 79156 - DNA, 25 bp, Mus musculus
aatctttagcaatcggtcctagacg

SEQ ID NO: 79157 - DNA, 25 bp, Mus musculus
aatctttaggccagctcttttgttt

SEQ ID NO: 79158 - DNA, 25 bp, Mus musculus
aatctttaggcctgctcttttgttt

SEQ ID NO: 79159 - DNA, 25 bp, Mus musculus
aatctttagtgtagacacccaccct

SEQ ID NO: 79160 - DNA, 25 bp, Mus musculus
aatctttagtgttgacacccaccct

SEQ ID NO: 79161 - DNA, 25 bp, Mus musculus
aatctttattcaccacacatccttg

SEQ ID NO: 79162 - DNA, 25 bp, Mus musculus
aatctttattcagcacacatccttg

SEQ ID NO: 79163 - DNA, 25 bp, Mus musculus
aatctttcaaacaccgggatgcaaa

SEQ ID NO: 79164 - DNA, 25 bp, Mus musculus
aatctttcaaactccgggatgcaaa

SEQ ID NO: 79165 - DNA, 25 bp, Mus musculus
aatctttcacttcgcaccatggtta

SEQ ID NO: 79166 - DNA, 25 bp, Mus musculus
aatctttcacttggcaccatggtta

SEQ ID NO: 79167 - DNA, 25 bp, Mus musculus
aatctttccatacactattcctggt

SEQ ID NO: 79168 - DNA, 25 bp, Mus musculus
aatctttccatagactattcctggt

SEQ ID NO: 79169 - DNA, 25 bp, Mus musculus
aatctttcccacaagccatttaata

SEQ ID NO: 79170 - DNA, 25 bp, Mus musculus
aatctttcccactagccatttaata

SEQ ID NO: 79171 - DNA, 25 bp, Mus musculus
aatctttccgagatccagcatgtca

SEQ ID NO: 79172 - DNA, 25 bp, Mus musculus
aatctttccgagttccagcatgtca

SEQ ID NO: 79173 - DNA, 25 bp, Mus musculus
aatctttccttacagttgacttttg

SEQ ID NO: 79174 - DNA, 25 bp, Mus musculus
aatctttccttagagttgacttttg

SEQ ID NO: 79175 - DNA, 25 bp, Mus musculus
aatctttctaagcttgagtgagtaa

SEQ ID NO: 79176 - DNA, 25 bp, Mus musculus
aatctttctaaggttgagtgagtaa

SEQ ID NO: 79177 - DNA, 25 bp, Mus musculus
aatctttctacccaggtcctgggat

SEQ ID NO: 79178 - DNA, 25 bp, Mus musculus
aatctttctaccgaggtcctgggat

SEQ ID NO: 79179 - DNA, 25 bp, Mus musculus
aatctttctaggaatgtgcatggca

SEQ ID NO: 79180 - DNA, 25 bp, Mus musculus
aatctttctaggtatgtgcatggca

SEQ ID NO: 79181 - DNA, 25 bp, Mus musculus
aatctttctgacagttgctataggc

SEQ ID NO: 79182 - DNA, 25 bp, Mus musculus
aatctttctgacattttgccatagt

SEQ ID NO: 79183 - DNA, 25 bp, Mus musculus
aatctttctgactgttgctataggc

SEQ ID NO: 79184 - DNA, 25 bp, Mus musculus
aatctttctgactttttgccatagt

SEQ ID NO: 79185 - DNA, 25 bp, Mus musculus
aatctttctgcgcaggtcctaggat

SEQ ID NO: 79186 - DNA, 25 bp, Mus musculus
aatctttctgcggaggtcctaggat

SEQ ID NO: 79187 - DNA, 25 bp, Mus musculus
aatctttctgctaggcatctcttaa

SEQ ID NO: 79188 - DNA, 25 bp, Mus musculus
aatctttctgcttggcatctcttaa

SEQ ID NO: 79189 - DNA, 25 bp, Mus musculus
aatctttcttaaacctgtgactgct

SEQ ID NO: 79190 - DNA, 25 bp, Mus musculus
aatctttcttaatcctgtgactgct

SEQ ID NO: 79191 - DNA, 25 bp, Mus musculus
aatctttctttgctgtgtatttctg

SEQ ID NO: 79192 - DNA, 25 bp, Mus musculus
aatctttctttggtgtgtatttctg

SEQ ID NO: 79193 - DNA, 25 bp, Mus musculus
aatctttgaaatctcttcttcttcc

SEQ ID NO: 79194 - DNA, 25 bp, Mus musculus
aatctttgaaatgtcttcttcttcc

SEQ ID NO: 79195 - DNA, 25 bp, Mus musculus
aatctttgagttcacattcacccca

SEQ ID NO: 79196 - DNA, 25 bp, Mus musculus
aatctttgagttgacattcacccca

SEQ ID NO: 79197 - DNA, 25 bp, Mus musculus
aatctttgcagaagttgttcccact

SEQ ID NO: 79198 - DNA, 25 bp, Mus musculus
aatctttgcagatgttgttcccact

SEQ ID NO: 79199 - DNA, 25 bp, Mus musculus
aatctttgcattatctgaagccagt

SEQ ID NO: 79200 - DNA, 25 bp, Mus musculus
aatctttgcattttctgaagccagt

SEQ ID NO: 79201 - DNA, 25 bp, Mus musculus
aatctttgccatagagtattcaaga

SEQ ID NO: 79202 - DNA, 25 bp, Mus musculus
aatctttgccattgagtattcaaga

SEQ ID NO: 79203 - DNA, 25 bp, Mus musculus
aatctttgccgaacttgaccagaaa

SEQ ID NO: 79204 - DNA, 25 bp, Mus musculus
aatctttgccgatcttgaccagaaa

SEQ ID NO: 79205 - DNA, 25 bp, Mus musculus
aatctttgctgtctaattttcctag

SEQ ID NO: 79206 - DNA, 25 bp, Mus musculus
aatctttgctgtgtaattttcctag

SEQ ID NO: 79207 - DNA, 25 bp, Mus musculus
aatctttgctttctttgcacaatgt

SEQ ID NO: 79208 - DNA, 25 bp, Mus musculus
aatctttgctttgtttgcacaatgt

SEQ ID NO: 79209 - DNA, 25 bp, Mus musculus
aatctttggaatccagactcctgcc

SEQ ID NO: 79210 - DNA, 25 bp, Mus musculus
aatctttggaatgcagactcctgcc

SEQ ID NO: 79211 - DNA, 25 bp, Mus musculus
aatctttggtataccatgcacgcct

SEQ ID NO: 79212 - DNA, 25 bp, Mus musculus
aatctttggtattccatgcacgcct

SEQ ID NO: 79213 - DNA, 25 bp, Mus musculus
aatctttggtctaaaagctttgcca

SEQ ID NO: 79214 - DNA, 25 bp, Mus musculus
aatctttggtcttaaagctttgcca

SEQ ID NO: 79215 - DNA, 25 bp, Mus musculus
aatctttgtaaactgcgcaagtgca

SEQ ID NO: 79216 - DNA, 25 bp, Mus musculus
aatctttgtaaagtgcgcaagtgca

SEQ ID NO: 79217 - DNA, 25 bp, Mus musculus
aatcttttacagaggtctgcaatca

SEQ ID NO: 79218 - DNA, 25 bp, Mus musculus
aatcttttacagtggtctgcaatca

SEQ ID NO: 79219 - DNA, 25 bp, Mus musculus
aatcttttactaaacatctcccagc

SEQ ID NO: 79220 - DNA, 25 bp, Mus musculus
aatcttttactatacatctcccagc

SEQ ID NO: 79221 - DNA, 25 bp, Mus musculus
aatcttttatcccagttctatgtca

SEQ ID NO: 79222 - DNA, 25 bp, Mus musculus
aatcttttatccgagttctatgtca

SEQ ID NO: 79223 - DNA, 25 bp, Mus musculus
aatcttttccagagccatatgcgtc

SEQ ID NO: 79224 - DNA, 25 bp, Mus musculus
aatcttttccagtgccatatgcgtc

SEQ ID NO: 79225 - DNA, 25 bp, Mus musculus
aatcttttccggagatgggtcctct

SEQ ID NO: 79226 - DNA, 25 bp, Mus musculus
aatcttttccggtgatgggtcctct

SEQ ID NO: 79227 - DNA, 25 bp, Mus musculus
aatcttttcgagatattgccctagt

SEQ ID NO: 79228 - DNA, 25 bp, Mus musculus
aatcttttcgagttattgccctagt

SEQ ID NO: 79229 - DNA, 25 bp, Mus musculus
aatcttttgaagctcacctttccta

SEQ ID NO: 79230 - DNA, 25 bp, Mus musculus
aatcttttgaaggtcacctttccta

SEQ ID NO: 79231 - DNA, 25 bp, Mus musculus
aatcttttgcctcctactgactagg

SEQ ID NO: 79232 - DNA, 25 bp, Mus musculus
aatcttttgcctgctactgactagg

SEQ ID NO: 79233 - DNA, 25 bp, Mus musculus
aatcttttgctcatcttaccttgaa

SEQ ID NO: 79234 - DNA, 25 bp, Mus musculus
aatcttttgctcttcttaccttgaa

SEQ ID NO: 79235 - DNA, 25 bp, Mus musculus
aatcttttgtacatgtgagcctttt

SEQ ID NO: 79236 - DNA, 25 bp, Mus musculus
aatcttttgtacttgtgagcctttt

SEQ ID NO: 79237 - DNA, 25 bp, Mus musculus
aatcttttgtagagccaccctactg

SEQ ID NO: 79238 - DNA, 25 bp, Mus musculus
aatcttttgtagtgccaccctactg

SEQ ID NO: 79239 - DNA, 25 bp, Mus musculus
aatcttttgtgcctcaattcctcca

SEQ ID NO: 79240 - DNA, 25 bp, Mus musculus
aatcttttgtgcgtcaattcctcca

SEQ ID NO: 79241 - DNA, 25 bp, Mus musculus
aatcttttgttgcatgtggtgccac

SEQ ID NO: 79242 - DNA, 25 bp, Mus musculus
aatcttttgttggatgtggtgccac

SEQ ID NO: 79243 - DNA, 25 bp, Mus musculus
aatctttttacgattcctgtgcatc

SEQ ID NO: 79244 - DNA, 25 bp, Mus musculus
aatctttttacgtttcctgtgcatc

SEQ ID NO: 79245 - DNA, 25 bp, Mus musculus
aatctttttctccagtaatggtcca

SEQ ID NO: 79246 - DNA, 25 bp, Mus musculus
aatctttttctcgagtaatggtcca

SEQ ID NO: 79247 - DNA, 25 bp, Mus musculus
aatctttttcttacagccttagctc

SEQ ID NO: 79248 - DNA, 25 bp, Mus musculus
aatctttttctttcagccttagctc

SEQ ID NO: 79249 - DNA, 25 bp, Mus musculus
aatgaaaacagtcgctgctactgaa

SEQ ID NO: 79250 - DNA, 25 bp, Mus musculus
aatgaaaacagtggctgctactgaa

SEQ ID NO: 79251 - DNA, 25 bp, Mus musculus
aatgaaaacgtgacacttggtcagg

SEQ ID NO: 79252 - DNA, 25 bp, Mus musculus
aatgaaaacgtgtcacttggtcagg

SEQ ID NO: 79253 - DNA, 25 bp, Mus musculus
aatgaaaacttcagtcaaagactga

SEQ ID NO: 79254 - DNA, 25 bp, Mus musculus
aatgaaaacttctgtcaaagactga

SEQ ID NO: 79255 - DNA, 25 bp, Mus musculus
aatgaaaagccgaccagcctcttgt

SEQ ID NO: 79256 - DNA, 25 bp, Mus musculus
aatgaaaagccgtccagcctcttgt

SEQ ID NO: 79257 - DNA, 25 bp, Mus musculus
aatgaaaagctcacatccttcctat

SEQ ID NO: 79258 - DNA, 25 bp, Mus musculus
aatgaaaagctctcatccttcctat

SEQ ID NO: 79259 - DNA, 25 bp, Mus musculus
aatgaaaagggcactcctgcatccc

SEQ ID NO: 79260 - DNA, 25 bp, Mus musculus
aatgaaaagggctctcctgcatccc

SEQ ID NO: 79261 - DNA, 25 bp, Mus musculus
aatgaaaataagacagctgccctgt

SEQ ID NO: 79262 - DNA, 25 bp, Mus musculus
aatgaaaataagtcagctgccctgt

SEQ ID NO: 79263 - DNA, 25 bp, Mus musculus
aatgaaacagtgagctgcttctcct

SEQ ID NO: 79264 - DNA, 25 bp, Mus musculus
aatgaaacagtgtgctgcttctcct

SEQ ID NO: 79265 - DNA, 25 bp, Mus musculus
aatgaaacattcaactcctgctgtg

SEQ ID NO: 79266 - DNA, 25 bp, Mus musculus
aatgaaacattccaagccagcagag

SEQ ID NO: 79267 - DNA, 25 bp, Mus musculus
aatgaaacattcgaagccagcagag

SEQ ID NO: 79268 - DNA, 25 bp, Mus musculus
aatgaaacattctactcctgctgtg

SEQ ID NO: 79269 - DNA, 25 bp, Mus musculus
aatgaaaccagcagtgttccctcac

SEQ ID NO: 79270 - DNA, 25 bp, Mus musculus
aatgaaaccagctgtgttccctcac

SEQ ID NO: 79271 - DNA, 25 bp, Mus musculus
aatgaaacccaacaactccacagac

SEQ ID NO: 79272 - DNA, 25 bp, Mus musculus
aatgaaacccaagaactccacagac

SEQ ID NO: 79273 - DNA, 25 bp, Mus musculus
aatgaaaccgcccatatactgctgt

SEQ ID NO: 79274 - DNA, 25 bp, Mus musculus
aatgaaaccgccgatatactgctgt

SEQ ID NO: 79275 - DNA, 25 bp, Mus musculus
aatgaaacctatctccttcgcgtac

SEQ ID NO: 79276 - DNA, 25 bp, Mus musculus
aatgaaacctatgtccttcgcgtac

SEQ ID NO: 79277 - DNA, 25 bp, Mus musculus
aatgaaacctttcagtaacctgctt

SEQ ID NO: 79278 - DNA, 25 bp, Mus musculus
aatgaaacctttgagtaacctgctt

SEQ ID NO: 79279 - DNA, 25 bp, Mus musculus
aatgaaactcgccagagacgctaca

SEQ ID NO: 79280 - DNA, 25 bp, Mus musculus
aatgaaactcgcgagagacgctaca

SEQ ID NO: 79281 - DNA, 25 bp, Mus musculus
aatgaaactgacagccttctgtgta

SEQ ID NO: 79282 - DNA, 25 bp, Mus musculus
aatgaaactgacatagacactttaa

SEQ ID NO: 79283 - DNA, 25 bp, Mus musculus
aatgaaactgactgccttctgtgta

SEQ ID NO: 79284 - DNA, 25 bp, Mus musculus
aatgaaactgacttagacactttaa

SEQ ID NO: 79285 - DNA, 25 bp, Mus musculus
aatgaaactggccaagagggctaaa

SEQ ID NO: 79286 - DNA, 25 bp, Mus musculus
aatgaaactggccatcctttctaac

SEQ ID NO: 79287 - DNA, 25 bp, Mus musculus
aatgaaactggcgaagagggctaaa

SEQ ID NO: 79288 - DNA, 25 bp, Mus musculus
aatgaaactggcgatcctttctaac

SEQ ID NO: 79289 - DNA, 25 bp, Mus musculus
aatgaaacttctagactcccaatcc

SEQ ID NO: 79290 - DNA, 25 bp, Mus musculus
aatgaaacttcttgactcccaatcc

SEQ ID NO: 79291 - DNA, 25 bp, Mus musculus
aatgaaacttggaggcacagtatgt

SEQ ID NO: 79292 - DNA, 25 bp, Mus musculus
aatgaaacttggtggcacagtatgt

SEQ ID NO: 79293 - DNA, 25 bp, Mus musculus
aatgaaagactcatcctggctgctc

SEQ ID NO: 79294 - DNA, 25 bp, Mus musculus
aatgaaagactcttcctggctgctc

SEQ ID NO: 79295 - DNA, 25 bp, Mus musculus
aatgaaagcatccatgccttgccac

SEQ ID NO: 79296 - DNA, 25 bp, Mus musculus
aatgaaagcatcgatgccttgccac

SEQ ID NO: 79297 - DNA, 25 bp, Mus musculus
aatgaaagctcacaggccccttctc

SEQ ID NO: 79298 - DNA, 25 bp, Mus musculus
aatgaaagctcagaggccccttctc

SEQ ID NO: 79299 - DNA, 25 bp, Mus musculus
aatgaaagctggcatccgcagtcct

SEQ ID NO: 79300 - DNA, 25 bp, Mus musculus
aatgaaagctgggatccgcagtcct

SEQ ID NO: 79301 - DNA, 25 bp, Mus musculus
aatgaaaggagccactgccctgaac

SEQ ID NO: 79302 - DNA, 25 bp, Mus musculus
aatgaaaggagcgactgccctgaac

SEQ ID NO: 79303 - DNA, 25 bp, Mus musculus
aatgaaaggcctccgcaattctgtc

SEQ ID NO: 79304 - DNA, 25 bp, Mus musculus
aatgaaaggcctgcgcaattctgtc

SEQ ID NO: 79305 - DNA, 25 bp, Mus musculus
aatgaaagggtcactgccttcgtta

SEQ ID NO: 79306 - DNA, 25 bp, Mus musculus
aatgaaagggtctctgccttcgtta

SEQ ID NO: 79307 - DNA, 25 bp, Mus musculus
aatgaaagtctaccgcttacctgct

SEQ ID NO: 79308 - DNA, 25 bp, Mus musculus
aatgaaagtctagcgcttacctgct

SEQ ID NO: 79309 - DNA, 25 bp, Mus musculus
aatgaaagtctgagtcagtctcaac

SEQ ID NO: 79310 - DNA, 25 bp, Mus musculus
aatgaaagtctgtgtcagtctcaac

SEQ ID NO: 79311 - DNA, 25 bp, Mus musculus
aatgaaagttcccagtcgggagatg

SEQ ID NO: 79312 - DNA, 25 bp, Mus musculus
aatgaaagttccgagtcgggagatg

SEQ ID NO: 79313 - DNA, 25 bp, Mus musculus
aatgaaatatttctggactccccag

SEQ ID NO: 79314 - DNA, 25 bp, Mus musculus
aatgaaatatttgtggactccccag

SEQ ID NO: 79315 - DNA, 25 bp, Mus musculus
aatgaaatcatcacaaatggaacta

SEQ ID NO: 79316 - DNA, 25 bp, Mus musculus
aatgaaatcatctcaaatggaacta

SEQ ID NO: 79317 - DNA, 25 bp, Mus musculus
aatgaaatccatattgtacgctatt

SEQ ID NO: 79318 - DNA, 25 bp, Mus musculus
aatgaaatccattttgtacgctatt

SEQ ID NO: 79319 - DNA, 25 bp, Mus musculus
aatgaaatcccactaaggccgctat

SEQ ID NO: 79320 - DNA, 25 bp, Mus musculus
aatgaaatcccagtaaggccgctat

SEQ ID NO: 79321 - DNA, 25 bp, Mus musculus
aatgaaatccttctatctcagcctc

SEQ ID NO: 79322 - DNA, 25 bp, Mus musculus
aatgaaatccttgtatctcagcctc

SEQ ID NO: 79323 - DNA, 25 bp, Mus musculus
aatgaaatgcatccctatgaccacc

SEQ ID NO: 79324 - DNA, 25 bp, Mus musculus
aatgaaatgcatgcctatgaccacc

SEQ ID NO: 79325 - DNA, 25 bp, Mus musculus
aatgaaatgtccaccagggcgctct

SEQ ID NO: 79326 - DNA, 25 bp, Mus musculus
aatgaaatgtcctccagggcgctct

SEQ ID NO: 79327 - DNA, 25 bp, Mus musculus
aatgaaattcatatggtgtcccacc

SEQ ID NO: 79328 - DNA, 25 bp, Mus musculus
aatgaaattcatttggtgtcccacc

SEQ ID NO: 79329 - DNA, 25 bp, Mus musculus
aatgaaattgtacctcctcacacag

SEQ ID NO: 79330 - DNA, 25 bp, Mus musculus
aatgaaattgtagctcctcacacag

SEQ ID NO: 79331 - DNA, 25 bp, Mus musculus
aatgaacaaatgaacagatcatcat

SEQ ID NO: 79332 - DNA, 25 bp, Mus musculus
aatgaacaaatgtacagatcatcat

SEQ ID NO: 79333 - DNA, 25 bp, Mus musculus
aatgaacaaggaagccatgccctcc

SEQ ID NO: 79334 - DNA, 25 bp, Mus musculus
aatgaacaaggatgccatgccctcc

SEQ ID NO: 79335 - DNA, 25 bp, Mus musculus
aatgaacacaaaccctcgaagccag

SEQ ID NO: 79336 - DNA, 25 bp, Mus musculus
aatgaacacaaagcctcgaagccag

SEQ ID NO: 79337 - DNA, 25 bp, Mus musculus
aatgaacacatcaaggccctgagcc

SEQ ID NO: 79338 - DNA, 25 bp, Mus musculus
aatgaacacatctaggccctgagcc

SEQ ID NO: 79339 - DNA, 25 bp, Mus musculus
aatgaacaccttaacgcttgctgag

SEQ ID NO: 79340 - DNA, 25 bp, Mus musculus
aatgaacacctttacgcttgctgag

SEQ ID NO: 79341 - DNA, 25 bp, Mus musculus
aatgaacagcccctgcatttggtcc

SEQ ID NO: 79342 - DNA, 25 bp, Mus musculus
aatgaacagcccgtgcatttggtcc

SEQ ID NO: 79343 - DNA, 25 bp, Mus musculus
aatgaacagggactccattctctgg

SEQ ID NO: 79344 - DNA, 25 bp, Mus musculus
aatgaacagggagtccattctctgg

SEQ ID NO: 79345 - DNA, 25 bp, Mus musculus
aatgaacagggcactgattgatcag

SEQ ID NO: 79346 - DNA, 25 bp, Mus musculus
aatgaacagggctctgattgatcag

SEQ ID NO: 79347 - DNA, 25 bp, Mus musculus
aatgaacatggtctaacaaggaact

SEQ ID NO: 79348 - DNA, 25 bp, Mus musculus
aatgaacatggtgtaacaaggaact

SEQ ID NO: 79349 - DNA, 25 bp, Mus musculus
aatgaacattcacaggtccatgata

SEQ ID NO: 79350 - DNA, 25 bp, Mus musculus
aatgaacattcagaggtccatgata

SEQ ID NO: 79351 - DNA, 25 bp, Mus musculus
aatgaacatttcactatccccatga

SEQ ID NO: 79352 - DNA, 25 bp, Mus musculus
aatgaacatttctctatccccatga

SEQ ID NO: 79353 - DNA, 25 bp, Mus musculus
aatgaaccacaaatatccggctata

SEQ ID NO: 79354 - DNA, 25 bp, Mus musculus
aatgaaccacaattatccggctata

SEQ ID NO: 79355 - DNA, 25 bp, Mus musculus
aatgaaccagacaacctcacaggga

SEQ ID NO: 79356 - DNA, 25 bp, Mus musculus
aatgaaccagactacctcacaggga

SEQ ID NO: 79357 - DNA, 25 bp, Mus musculus
aatgaaccagataggagcatttttt

SEQ ID NO: 79358 - DNA, 25 bp, Mus musculus
aatgaaccagattggagcatttttt

SEQ ID NO: 79359 - DNA, 25 bp, Mus musculus
aatgaaccatgtagcttttgctaaa

SEQ ID NO: 79360 - DNA, 25 bp, Mus musculus
aatgaaccatgttgcttttgctaaa

SEQ ID NO: 79361 - DNA, 25 bp, Mus musculus
aatgaaccccgtaactacacactca

SEQ ID NO: 79362 - DNA, 25 bp, Mus musculus
aatgaaccccgttactacacactca

SEQ ID NO: 79363 - DNA, 25 bp, Mus musculus
aatgaaccctgcagtaggcatttaa

SEQ ID NO: 79364 - DNA, 25 bp, Mus musculus
aatgaaccctgctgtaggcatttaa

SEQ ID NO: 79365 - DNA, 25 bp, Mus musculus
aatgaacctctcaccatgggaaggc

SEQ ID NO: 79366 - DNA, 25 bp, Mus musculus
aatgaacctctctccatgggaaggc

SEQ ID NO: 79367 - DNA, 25 bp, Mus musculus
aatgaacgccttcaagcagagaaag

SEQ ID NO: 79368 - DNA, 25 bp, Mus musculus
aatgaacgccttgaagcagagaaag

SEQ ID NO: 79369 - DNA, 25 bp, Mus musculus
aatgaacgctttcctaatgacgatt

SEQ ID NO: 79370 - DNA, 25 bp, Mus musculus
aatgaacgctttgctaatgacgatt

SEQ ID NO: 79371 - DNA, 25 bp, Mus musculus
aatgaacgttacctttgtcgccctg

SEQ ID NO: 79372 - DNA, 25 bp, Mus musculus
aatgaacgttacgtttgtcgccctg

SEQ ID NO: 79373 - DNA, 25 bp, Mus musculus
aatgaactccgcacagaacaccggc

SEQ ID NO: 79374 - DNA, 25 bp, Mus musculus
aatgaactccgctcagaacaccggc

SEQ ID NO: 79375 - DNA, 25 bp, Mus musculus
aatgaactcctccaagtagagcctc

SEQ ID NO: 79376 - DNA, 25 bp, Mus musculus
aatgaactcctcgaagtagagcctc

SEQ ID NO: 79377 - DNA, 25 bp, Mus musculus
aatgaactctacactcttgcttctg

SEQ ID NO: 79378 - DNA, 25 bp, Mus musculus
aatgaactctactctcttgcttctg

SEQ ID NO: 79379 - DNA, 25 bp, Mus musculus
aatgaactcttgaagaggaagcagc

SEQ ID NO: 79380 - DNA, 25 bp, Mus musculus
aatgaactcttgtagaggaagcagc

SEQ ID NO: 79381 - DNA, 25 bp, Mus musculus
aatgaactggttcttttctcttaat

SEQ ID NO: 79382 - DNA, 25 bp, Mus musculus
aatgaactggttgttttctcttaat

SEQ ID NO: 79383 - DNA, 25 bp, Mus musculus
aatgaactgtgtccctcagaggagc

SEQ ID NO: 79384 - DNA, 25 bp, Mus musculus
aatgaactgtgtgcctcagaggagc

SEQ ID NO: 79385 - DNA, 25 bp, Mus musculus
aatgaactgtttactatggtcagaa

SEQ ID NO: 79386 - DNA, 25 bp, Mus musculus
aatgaactgttttctatggtcagaa

SEQ ID NO: 79387 - DNA, 25 bp, Mus musculus
aatgaacttcccagcccttttgtgt

SEQ ID NO: 79388 - DNA, 25 bp, Mus musculus
aatgaacttccctgcccttttgtgt

SEQ ID NO: 79389 - DNA, 25 bp, Mus musculus
aatgaagaactccttgctctctgcc

SEQ ID NO: 79390 - DNA, 25 bp, Mus musculus
aatgaagaactcgttgctctctgcc

SEQ ID NO: 79391 - DNA, 25 bp, Mus musculus
aatgaagaatacaggtgctctccca

SEQ ID NO: 79392 - DNA, 25 bp, Mus musculus
aatgaagaatactggtgctctccca

SEQ ID NO: 79393 - DNA, 25 bp, Mus musculus
aatgaagaatctatggcctgtgaac

SEQ ID NO: 79394 - DNA, 25 bp, Mus musculus
aatgaagaatctttggcctgtgaac

SEQ ID NO: 79395 - DNA, 25 bp, Mus musculus
aatgaagaccctcacctgaactcca

SEQ ID NO: 79396 - DNA, 25 bp, Mus musculus
aatgaagaccctccaaagcgaccca

SEQ ID NO: 79397 - DNA, 25 bp, Mus musculus
aatgaagaccctgacctgaactcca

SEQ ID NO: 79398 - DNA, 25 bp, Mus musculus
aatgaagaccctgcaaagcgaccca

SEQ ID NO: 79399 - DNA, 25 bp, Mus musculus
aatgaagacgcccttgagccagaac

SEQ ID NO: 79400 - DNA, 25 bp, Mus musculus
aatgaagacgccgttgagccagaac

SEQ ID NO: 79401 - DNA, 25 bp, Mus musculus
aatgaagagacccaagcccaaaatc

SEQ ID NO: 79402 - DNA, 25 bp, Mus musculus
aatgaagagaccgaagcccaaaatc

SEQ ID NO: 79403 - DNA, 25 bp, Mus musculus
aatgaagagatgactggcctccctg

SEQ ID NO: 79404 - DNA, 25 bp, Mus musculus
aatgaagagatgtctggcctccctg

SEQ ID NO: 79405 - DNA, 25 bp, Mus musculus
aatgaagagttcacagtggctgcta

SEQ ID NO: 79406 - DNA, 25 bp, Mus musculus
aatgaagagttctcagtggctgcta

SEQ ID NO: 79407 - DNA, 25 bp, Mus musculus
aatgaagatttcctccaaacctctc

SEQ ID NO: 79408 - DNA, 25 bp, Mus musculus
aatgaagatttcgtccaaacctctc

SEQ ID NO: 79409 - DNA, 25 bp, Mus musculus
aatgaagcacaccactgaccttgat

SEQ ID NO: 79410 - DNA, 25 bp, Mus musculus
aatgaagcacacgactgaccttgat

SEQ ID NO: 79411 - DNA, 25 bp, Mus musculus
aatgaagcactcagccacacaagga

SEQ ID NO: 79412 - DNA, 25 bp, Mus musculus
aatgaagcactctgccacacaagga

SEQ ID NO: 79413 - DNA, 25 bp, Mus musculus
aatgaagcatcactccagaacctgt

SEQ ID NO: 79414 - DNA, 25 bp, Mus musculus
aatgaagcatcagtccagaacctgt

SEQ ID NO: 79415 - DNA, 25 bp, Mus musculus
aatgaagccacaacataccctggcg

SEQ ID NO: 79416 - DNA, 25 bp, Mus musculus
aatgaagccacatcataccctggcg

SEQ ID NO: 79417 - DNA, 25 bp, Mus musculus
aatgaagccagcacctcatctagaa

SEQ ID NO: 79418 - DNA, 25 bp, Mus musculus
aatgaagccagctcctcatctagaa

SEQ ID NO: 79419 - DNA, 25 bp, Mus musculus
aatgaagccatacggacatcgaccc

SEQ ID NO: 79420 - DNA, 25 bp, Mus musculus
aatgaagccatagggacatcgaccc

SEQ ID NO: 79421 - DNA, 25 bp, Mus musculus
aatgaagccgtcaggctgggtccta

SEQ ID NO: 79422 - DNA, 25 bp, Mus musculus
aatgaagccgtctggctgggtccta

SEQ ID NO: 79423 - DNA, 25 bp, Mus musculus
aatgaagcctaactcccaaagtggg

SEQ ID NO: 79424 - DNA, 25 bp, Mus musculus
aatgaagcctaagtcccaaagtggg

SEQ ID NO: 79425 - DNA, 25 bp, Mus musculus
aatgaagccttcagaagcctgcctt

SEQ ID NO: 79426 - DNA, 25 bp, Mus musculus
aatgaagccttcatgcgtgtgctga

SEQ ID NO: 79427 - DNA, 25 bp, Mus musculus
aatgaagccttctgaagcctgcctt

SEQ ID NO: 79428 - DNA, 25 bp, Mus musculus
aatgaagccttcttgcgtgtgctga

SEQ ID NO: 79429 - DNA, 25 bp, Mus musculus
aatgaagctcttcaggacctatcct

SEQ ID NO: 79430 - DNA, 25 bp, Mus musculus
aatgaagctcttgaggacctatcct

SEQ ID NO: 79431 - DNA, 25 bp, Mus musculus
aatgaagctgctcagatcctgcggt

SEQ ID NO: 79432 - DNA, 25 bp, Mus musculus
aatgaagctgctgagatcctgcggt

SEQ ID NO: 79433 - DNA, 25 bp, Mus musculus
aatgaagctggaagtggtggtacac

SEQ ID NO: 79434 - DNA, 25 bp, Mus musculus
aatgaagctggatgtggtggtacac

SEQ ID NO: 79435 - DNA, 25 bp, Mus musculus
aatgaagctgtaactataggtcttt

SEQ ID NO: 79436 - DNA, 25 bp, Mus musculus
aatgaagctgtatctataggtcttt

SEQ ID NO: 79437 - DNA, 25 bp, Mus musculus
aatgaaggaccgaaggactcggcgt

SEQ ID NO: 79438 - DNA, 25 bp, Mus musculus
aatgaaggaccgtaggactcggcgt

SEQ ID NO: 79439 - DNA, 25 bp, Mus musculus
aatgaaggactcatctccctagtgg

SEQ ID NO: 79440 - DNA, 25 bp, Mus musculus
aatgaaggactcttctccctagtgg

SEQ ID NO: 79441 - DNA, 25 bp, Mus musculus
aatgaaggcaccaccgtgagcataa

SEQ ID NO: 79442 - DNA, 25 bp, Mus musculus
aatgaaggcacctccgtgagcataa

SEQ ID NO: 79443 - DNA, 25 bp, Mus musculus
aatgaaggcataccccttttcccaa

SEQ ID NO: 79444 - DNA, 25 bp, Mus musculus
aatgaaggcatagcccttttcccaa

SEQ ID NO: 79445 - DNA, 25 bp, Mus musculus
aatgaaggccacacgcataagcatg

SEQ ID NO: 79446 - DNA, 25 bp, Mus musculus
aatgaaggccactcgcataagcatg

SEQ ID NO: 79447 - DNA, 25 bp, Mus musculus
aatgaaggccgacctcctggaggct

SEQ ID NO: 79448 - DNA, 25 bp, Mus musculus
aatgaaggccgagctcctggaggct

SEQ ID NO: 79449 - DNA, 25 bp, Mus musculus
aatgaaggcctgaatctcagcactt

SEQ ID NO: 79450 - DNA, 25 bp, Mus musculus
aatgaaggcctgtatctcagcactt

SEQ ID NO: 79451 - DNA, 25 bp, Mus musculus
aatgaaggctatatgcgccgtggtg

SEQ ID NO: 79452 - DNA, 25 bp, Mus musculus
aatgaaggctatttgcgccgtggtg

SEQ ID NO: 79453 - DNA, 25 bp, Mus musculus
aatgaaggcttgaaatttgcacgca

SEQ ID NO: 79454 - DNA, 25 bp, Mus musculus
aatgaaggcttgtaatttgcacgca

SEQ ID NO: 79455 - DNA, 25 bp, Mus musculus
aatgaagggaacctgcccttgcact

SEQ ID NO: 79456 - DNA, 25 bp, Mus musculus
aatgaagggaacgtgcccttgcact

SEQ ID NO: 79457 - DNA, 25 bp, Mus musculus
aatgaagggactcctttcttcaggg

SEQ ID NO: 79458 - DNA, 25 bp, Mus musculus
aatgaagggactgctttcttcaggg

SEQ ID NO: 79459 - DNA, 25 bp, Mus musculus
aatgaagtacaaacctgtcctaggg

SEQ ID NO: 79460 - DNA, 25 bp, Mus musculus
aatgaagtacaatcctgtcctaggg

SEQ ID NO: 79461 - DNA, 25 bp, Mus musculus
aatgaagtcagtcttcccatacctg

SEQ ID NO: 79462 - DNA, 25 bp, Mus musculus
aatgaagtcagtgttcccatacctg

SEQ ID NO: 79463 - DNA, 25 bp, Mus musculus
aatgaagtcatccacttcccatgtt

SEQ ID NO: 79464 - DNA, 25 bp, Mus musculus
aatgaagtcatcgacttcccatgtt

SEQ ID NO: 79465 - DNA, 25 bp, Mus musculus
aatgaagtctcactgctatagcaac

SEQ ID NO: 79466 - DNA, 25 bp, Mus musculus
aatgaagtctcagtgctatagcaac

SEQ ID NO: 79467 - DNA, 25 bp, Mus musculus
aatgaagtctgaccttgtgcagcag

SEQ ID NO: 79468 - DNA, 25 bp, Mus musculus
aatgaagtctgagcttgtgcagcag

SEQ ID NO: 79469 - DNA, 25 bp, Mus musculus
aatgaagtgctgctattgtgaaaac

SEQ ID NO: 79470 - DNA, 25 bp, Mus musculus
aatgaagtgctggtattgtgaaaac

SEQ ID NO: 79471 - DNA, 25 bp, Mus musculus
aatgaagtggctactgagcctctta

SEQ ID NO: 79472 - DNA, 25 bp, Mus musculus
aatgaagtggcttctgagcctctta

SEQ ID NO: 79473 - DNA, 25 bp, Mus musculus
aatgaagtgtggacatgtcagagca

SEQ ID NO: 79474 - DNA, 25 bp, Mus musculus
aatgaagtgtggtcatgtcagagca

SEQ ID NO: 79475 - DNA, 25 bp, Mus musculus
aatgaagttctgattaagtgcaata

SEQ ID NO: 79476 - DNA, 25 bp, Mus musculus
aatgaagttctgtttaagtgcaata

SEQ ID NO: 79477 - DNA, 25 bp, Mus musculus
aatgaagtttctattggattgcaga

SEQ ID NO: 79478 - DNA, 25 bp, Mus musculus
aatgaagtttcttttggattgcaga

SEQ ID NO: 79479 - DNA, 25 bp, Mus musculus
aatgaataaggtactccccatgctg

SEQ ID NO: 79480 - DNA, 25 bp, Mus musculus
aatgaataaggttctccccatgctg

SEQ ID NO: 79481 - DNA, 25 bp, Mus musculus
aatgaatacatgactgcaggtttct

SEQ ID NO: 79482 - DNA, 25 bp, Mus musculus
aatgaatacatgtctgcaggtttct

SEQ ID NO: 79483 - DNA, 25 bp, Mus musculus
aatgaatatccaagtctgctgagat

SEQ ID NO: 79484 - DNA, 25 bp, Mus musculus
aatgaatatccatgtctgctgagat

SEQ ID NO: 79485 - DNA, 25 bp, Mus musculus
aatgaatatcctcgttttccttcca

SEQ ID NO: 79486 - DNA, 25 bp, Mus musculus
aatgaatatcctggttttccttcca

SEQ ID NO: 79487 - DNA, 25 bp, Mus musculus
aatgaatatctcctgcactgtttgc

SEQ ID NO: 79488 - DNA, 25 bp, Mus musculus
aatgaatatctcgtgcactgtttgc

SEQ ID NO: 79489 - DNA, 25 bp, Mus musculus
aatgaatcacctctgttcagcgcag

SEQ ID NO: 79490 - DNA, 25 bp, Mus musculus
aatgaatcacctgtgttcagcgcag

SEQ ID NO: 79491 - DNA, 25 bp, Mus musculus
aatgaatcagttcggcgcagccacg

SEQ ID NO: 79492 - DNA, 25 bp, Mus musculus
aatgaatcagttgggcgcagccacg

SEQ ID NO: 79493 - DNA, 25 bp, Mus musculus
aatgaatcattcacccatgttgggt

SEQ ID NO: 79494 - DNA, 25 bp, Mus musculus
aatgaatcattctcccatgttgggt

SEQ ID NO: 79495 - DNA, 25 bp, Mus musculus
aatgaatccactagggcttctgttc

SEQ ID NO: 79496 - DNA, 25 bp, Mus musculus
aatgaatccacttgggcttctgttc

SEQ ID NO: 79497 - DNA, 25 bp, Mus musculus
aatgaatccggcaccaccaacaggg

SEQ ID NO: 79498 - DNA, 25 bp, Mus musculus
aatgaatccggctccaccaacaggg

SEQ ID NO: 79499 - DNA, 25 bp, Mus musculus
aatgaatcctctatgcccgagtagc

SEQ ID NO: 79500 - DNA, 25 bp, Mus musculus
aatgaatcctctttgcccgagtagc

SEQ ID NO: 79501 - DNA, 25 bp, Mus musculus
aatgaatccttgaataagcaactgc

SEQ ID NO: 79502 - DNA, 25 bp, Mus musculus
aatgaatccttgtataagcaactgc

SEQ ID NO: 79503 - DNA, 25 bp, Mus musculus
aatgaatcgcgccttctatcccgga

SEQ ID NO: 79504 - DNA, 25 bp, Mus musculus
aatgaatcgcgcgttctatcccgga

SEQ ID NO: 79505 - DNA, 25 bp, Mus musculus
aatgaatctgtccattttgtcctgg

SEQ ID NO: 79506 - DNA, 25 bp, Mus musculus
aatgaatctgtcgattttgtcctgg

SEQ ID NO: 79507 - DNA, 25 bp, Mus musculus
aatgaatctgttcaggcctagtgcc

SEQ ID NO: 79508 - DNA, 25 bp, Mus musculus
aatgaatctgttgaggcctagtgcc

SEQ ID NO: 79509 - DNA, 25 bp, Mus musculus
aatgaatcttgtctcttttctccag

SEQ ID NO: 79510 - DNA, 25 bp, Mus musculus
aatgaatcttgtgtcttttctccag

SEQ ID NO: 79511 - DNA, 25 bp, Mus musculus
aatgaatgaaaaaagggcctgtctc

SEQ ID NO: 79512 - DNA, 25 bp, Mus musculus
aatgaatgaaaatagggcctgtctc

SEQ ID NO: 79513 - DNA, 25 bp, Mus musculus
aatgaatgaaatcccgggtggctcc

SEQ ID NO: 79514 - DNA, 25 bp, Mus musculus
aatgaatgaaatgccgggtggctcc

SEQ ID NO: 79515 - DNA, 25 bp, Mus musculus
aatgaatgaagtctgcccattgaaa

SEQ ID NO: 79516 - DNA, 25 bp, Mus musculus
aatgaatgaagtgtgcccattgaaa

SEQ ID NO: 79517 - DNA, 25 bp, Mus musculus
aatgaatgactgcaccggcaagagt

SEQ ID NO: 79518 - DNA, 25 bp, Mus musculus
aatgaatgactggaccggcaagagt

SEQ ID NO: 79519 - DNA, 25 bp, Mus musculus
aatgaatgacttcagaggccactct

SEQ ID NO: 79520 - DNA, 25 bp, Mus musculus
aatgaatgacttgagaggccactct

SEQ ID NO: 79521 - DNA, 25 bp, Mus musculus
aatgaatgatcccaagaaactactt

SEQ ID NO: 79522 - DNA, 25 bp, Mus musculus
aatgaatgatccgaagaaactactt

SEQ ID NO: 79523 - DNA, 25 bp, Mus musculus
aatgaatgattcagcctcttctccg

SEQ ID NO: 79524 - DNA, 25 bp, Mus musculus
aatgaatgattctgcctcttctccg

SEQ ID NO: 79525 - DNA, 25 bp, Mus musculus
aatgaatgcaataggccctggtaac

SEQ ID NO: 79526 - DNA, 25 bp, Mus musculus
aatgaatgcaattggccctggtaac

SEQ ID NO: 79527 - DNA, 25 bp, Mus musculus
aatgaatgcagcacgtctgacctct

SEQ ID NO: 79528 - DNA, 25 bp, Mus musculus
aatgaatgcagctcgtctgacctct

SEQ ID NO: 79529 - DNA, 25 bp, Mus musculus
aatgaatgcgggatacagctgtaca

SEQ ID NO: 79530 - DNA, 25 bp, Mus musculus
aatgaatgcgggttacagctgtaca

SEQ ID NO: 79531 - DNA, 25 bp, Mus musculus
aatgaatgctgactcctgatactcc

SEQ ID NO: 79532 - DNA, 25 bp, Mus musculus
aatgaatgctgagtcctgatactcc

SEQ ID NO: 79533 - DNA, 25 bp, Mus musculus
aatgaatggatgactctgagccctt

SEQ ID NO: 79534 - DNA, 25 bp, Mus musculus
aatgaatggatgtctctgagccctt

SEQ ID NO: 79535 - DNA, 25 bp, Mus musculus
aatgaatggcctatttgttaatgag

SEQ ID NO: 79536 - DNA, 25 bp, Mus musculus
aatgaatggcctttttgttaatgag

SEQ ID NO: 79537 - DNA, 25 bp, Mus musculus
aatgaatgttctccccagcatccaa

SEQ ID NO: 79538 - DNA, 25 bp, Mus musculus
aatgaatgttctgcccagcatccaa

SEQ ID NO: 79539 - DNA, 25 bp, Mus musculus
aatgaattaatcagctcagctcttg

SEQ ID NO: 79540 - DNA, 25 bp, Mus musculus
aatgaattaatctgctcagctcttg

SEQ ID NO: 79541 - DNA, 25 bp, Mus musculus
aatgaattataactcactttgtact

SEQ ID NO: 79542 - DNA, 25 bp, Mus musculus
aatgaattataagtcactttgtact

SEQ ID NO: 79543 - DNA, 25 bp, Mus musculus
aatgaattcactctacctcaggagc

SEQ ID NO: 79544 - DNA, 25 bp, Mus musculus
aatgaattcactgtacctcaggagc

SEQ ID NO: 79545 - DNA, 25 bp, Mus musculus
aatgaattccataagcccagtttga

SEQ ID NO: 79546 - DNA, 25 bp, Mus musculus
aatgaattccattagcccagtttga

SEQ ID NO: 79547 - DNA, 25 bp, Mus musculus
aatgaattccgccacgaggcgtgca

SEQ ID NO: 79548 - DNA, 25 bp, Mus musculus
aatgaattccgcgacgaggcgtgca

SEQ ID NO: 79549 - DNA, 25 bp, Mus musculus
aatgaattcttgactggtctcaaca

SEQ ID NO: 79550 - DNA, 25 bp, Mus musculus
aatgaattcttgatcatcttttgta

SEQ ID NO: 79551 - DNA, 25 bp, Mus musculus
aatgaattcttgtctggtctcaaca

SEQ ID NO: 79552 - DNA, 25 bp, Mus musculus
aatgaattcttgttcatcttttgta

SEQ ID NO: 79553 - DNA, 25 bp, Mus musculus
aatgaattctttcagggctgcccag

SEQ ID NO: 79554 - DNA, 25 bp, Mus musculus
aatgaattctttgagggctgcccag

SEQ ID NO: 79555 - DNA, 25 bp, Mus musculus
aatgaattgatgattagtttgcttt

SEQ ID NO: 79556 - DNA, 25 bp, Mus musculus
aatgaattgatgtttagtttgcttt

SEQ ID NO: 79557 - DNA, 25 bp, Mus musculus
aatgaatttgttctgcttgccctgg

SEQ ID NO: 79558 - DNA, 25 bp, Mus musculus
aatgaatttgttgtgcttgccctgg

SEQ ID NO: 79559 - DNA, 25 bp, Mus musculus
aatgaattttccagcgtggctcatc

SEQ ID NO: 79560 - DNA, 25 bp, Mus musculus
aatgaattttccagggagtcagttc

SEQ ID NO: 79561 - DNA, 25 bp, Mus musculus
aatgaattttcctgcgtggctcatc

SEQ ID NO: 79562 - DNA, 25 bp, Mus musculus
aatgaattttcctgggagtcagttc

SEQ ID NO: 79563 - DNA, 25 bp, Mus musculus
aatgacaaattcaggagctcctccg

SEQ ID NO: 79564 - DNA, 25 bp, Mus musculus
aatgacaaattctggagctcctccg

SEQ ID NO: 79565 - DNA, 25 bp, Mus musculus
aatgacaactccaacatgtatattc

SEQ ID NO: 79566 - DNA, 25 bp, Mus musculus
aatgacaactcctacatgtatattc

SEQ ID NO: 79567 - DNA, 25 bp, Mus musculus
aatgacaagcatatttcagacaggc

SEQ ID NO: 79568 - DNA, 25 bp, Mus musculus
aatgacaagcatttttcagacaggc

SEQ ID NO: 79569 - DNA, 25 bp, Mus musculus
aatgacaaggccctgtcctcgcact

SEQ ID NO: 79570 - DNA, 25 bp, Mus musculus
aatgacaaggccgtgtcctcgcact

SEQ ID NO: 79571 - DNA, 25 bp, Mus musculus
aatgacaagtccaggtcccctacct

SEQ ID NO: 79572 - DNA, 25 bp, Mus musculus
aatgacaagtcctggtcccctacct

SEQ ID NO: 79573 - DNA, 25 bp, Mus musculus
aatgacaagtgaactttcctaatgc

SEQ ID NO: 79574 - DNA, 25 bp, Mus musculus
aatgacaagtgatctttcctaatgc

SEQ ID NO: 79575 - DNA, 25 bp, Mus musculus
aatgacaagtggcaggcccgctctg

SEQ ID NO: 79576 - DNA, 25 bp, Mus musculus
aatgacaagtgggaggcccgctctg

SEQ ID NO: 79577 - DNA, 25 bp, Mus musculus
aatgacacaagtcagctagcagtga

SEQ ID NO: 79578 - DNA, 25 bp, Mus musculus
aatgacacaagtgagctagcagtga

SEQ ID NO: 79579 - DNA, 25 bp, Mus musculus
aatgacacagcaacagatccagtat

SEQ ID NO: 79580 - DNA, 25 bp, Mus musculus
aatgacacagcatcagatccagtat

SEQ ID NO: 79581 - DNA, 25 bp, Mus musculus
aatgacacatatcagcactggcaat

SEQ ID NO: 79582 - DNA, 25 bp, Mus musculus
aatgacacatatgagcactggcaat

SEQ ID NO: 79583 - DNA, 25 bp, Mus musculus
aatgacacatctactgtcatccctg

SEQ ID NO: 79584 - DNA, 25 bp, Mus musculus
aatgacacatctcacactgctcagc

SEQ ID NO: 79585 - DNA, 25 bp, Mus musculus
aatgacacatctgacactgctcagc

SEQ ID NO: 79586 - DNA, 25 bp, Mus musculus
aatgacacatcttctgtcatccctg

SEQ ID NO: 79587 - DNA, 25 bp, Mus musculus
aatgacacattaagagtctcctgga

SEQ ID NO: 79588 - DNA, 25 bp, Mus musculus
aatgacacattatgagtctcctgga

SEQ ID NO: 79589 - DNA, 25 bp, Mus musculus
aatgacaccattcttatcaccacaa

SEQ ID NO: 79590 - DNA, 25 bp, Mus musculus
aatgacaccattgttatcaccacaa

SEQ ID NO: 79591 - DNA, 25 bp, Mus musculus
aatgacacctgtccagctagctgtg

SEQ ID NO: 79592 - DNA, 25 bp, Mus musculus
aatgacacctgtgcagctagctgtg

SEQ ID NO: 79593 - DNA, 25 bp, Mus musculus
aatgacaccttcaactcactgggtc

SEQ ID NO: 79594 - DNA, 25 bp, Mus musculus
aatgacaccttctactcactgggtc

SEQ ID NO: 79595 - DNA, 25 bp, Mus musculus
aatgacacgaaccttcctgaccagt

SEQ ID NO: 79596 - DNA, 25 bp, Mus musculus
aatgacacgaacgttcctgaccagt

SEQ ID NO: 79597 - DNA, 25 bp, Mus musculus
aatgacacggaaactgctctggcag

SEQ ID NO: 79598 - DNA, 25 bp, Mus musculus
aatgacacggaatctgctctggcag

SEQ ID NO: 79599 - DNA, 25 bp, Mus musculus
aatgacactagtcaggtccctgagg

SEQ ID NO: 79600 - DNA, 25 bp, Mus musculus
aatgacactagtgaggtccctgagg

SEQ ID NO: 79601 - DNA, 25 bp, Mus musculus
aatgacactatcaactctgagttta

SEQ ID NO: 79602 - DNA, 25 bp, Mus musculus
aatgacactatctactctgagttta

SEQ ID NO: 79603 - DNA, 25 bp, Mus musculus
aatgacactattaggtcaccaagca

SEQ ID NO: 79604 - DNA, 25 bp, Mus musculus
aatgacactatttggtcaccaagca

SEQ ID NO: 79605 - DNA, 25 bp, Mus musculus
aatgacactgccagtattctaacag

SEQ ID NO: 79606 - DNA, 25 bp, Mus musculus
aatgacactgcctgtattctaacag

SEQ ID NO: 79607 - DNA, 25 bp, Mus musculus
aatgacactgctcggcttgggaact

SEQ ID NO: 79608 - DNA, 25 bp, Mus musculus
aatgacactgctgggcttgggaact

SEQ ID NO: 79609 - DNA, 25 bp, Mus musculus
aatgacactgtcctgatgactgata

SEQ ID NO: 79610 - DNA, 25 bp, Mus musculus
aatgacactgtcgtgatgactgata

SEQ ID NO: 79611 - DNA, 25 bp, Mus musculus
aatgacactgtgattccacttgagc

SEQ ID NO: 79612 - DNA, 25 bp, Mus musculus
aatgacactgtgcattgcttgttgt

SEQ ID NO: 79613 - DNA, 25 bp, Mus musculus
aatgacactgtggattgcttgttgt

SEQ ID NO: 79614 - DNA, 25 bp, Mus musculus
aatgacactgtgtttccacttgagc

SEQ ID NO: 79615 - DNA, 25 bp, Mus musculus
aatgacactttgaagtccccatgat

SEQ ID NO: 79616 - DNA, 25 bp, Mus musculus
aatgacactttgtagtccccatgat

SEQ ID NO: 79617 - DNA, 25 bp, Mus musculus
aatgacagagatagccagtcaccat

SEQ ID NO: 79618 - DNA, 25 bp, Mus musculus
aatgacagagattgccagtcaccat

SEQ ID NO: 79619 - DNA, 25 bp, Mus musculus
aatgacagatacctttaccctaagt

SEQ ID NO: 79620 - DNA, 25 bp, Mus musculus
aatgacagatacgtttaccctaagt

SEQ ID NO: 79621 - DNA, 25 bp, Mus musculus
aatgacagatctcgagagtctcctg

SEQ ID NO: 79622 - DNA, 25 bp, Mus musculus
aatgacagatctcgcctgagctcgg

SEQ ID NO: 79623 - DNA, 25 bp, Mus musculus
aatgacagatctggagagtctcctg

SEQ ID NO: 79624 - DNA, 25 bp, Mus musculus
aatgacagatctggcctgagctcgg

SEQ ID NO: 79625 - DNA, 25 bp, Mus musculus
aatgacagcaccaaaccagagttcc

SEQ ID NO: 79626 - DNA, 25 bp, Mus musculus
aatgacagcacctaaccagagttcc

SEQ ID NO: 79627 - DNA, 25 bp, Mus musculus
aatgacagcagacgactagcgccac

SEQ ID NO: 79628 - DNA, 25 bp, Mus musculus
aatgacagcagaggactagcgccac

SEQ ID NO: 79629 - DNA, 25 bp, Mus musculus
aatgacagcagtagctctcctgatc

SEQ ID NO: 79630 - DNA, 25 bp, Mus musculus
aatgacagcagttgctctcctgatc

SEQ ID NO: 79631 - DNA, 25 bp, Mus musculus
aatgacagccttcgcacagatgtct

SEQ ID NO: 79632 - DNA, 25 bp, Mus musculus
aatgacagccttggcacagatgtct

SEQ ID NO: 79633 - DNA, 25 bp, Mus musculus
aatgacagcgagacccaaagccggg

SEQ ID NO: 79634 - DNA, 25 bp, Mus musculus
aatgacagcgagtcccaaagccggg

SEQ ID NO: 79635 - DNA, 25 bp, Mus musculus
aatgacagcgcgcatcccaaggcga

SEQ ID NO: 79636 - DNA, 25 bp, Mus musculus
aatgacagcgcggatcccaaggcga

SEQ ID NO: 79637 - DNA, 25 bp, Mus musculus
aatgacagcgtcctttggattcctg

SEQ ID NO: 79638 - DNA, 25 bp, Mus musculus
aatgacagcgtcgtttggattcctg

SEQ ID NO: 79639 - DNA, 25 bp, Mus musculus
aatgacagctaactgctctgccata

SEQ ID NO: 79640 - DNA, 25 bp, Mus musculus
aatgacagctaagtgctctgccata

SEQ ID NO: 79641 - DNA, 25 bp, Mus musculus
aatgacaggccccaggaagtcactt

SEQ ID NO: 79642 - DNA, 25 bp, Mus musculus
aatgacaggcccgaggaagtcactt

SEQ ID NO: 79643 - DNA, 25 bp, Mus musculus
aatgacaggcggaccaatacatgcg

SEQ ID NO: 79644 - DNA, 25 bp, Mus musculus
aatgacaggcggtccaatacatgcg

SEQ ID NO: 79645 - DNA, 25 bp, Mus musculus
aatgacaggctactgttgggtaaaa

SEQ ID NO: 79646 - DNA, 25 bp, Mus musculus
aatgacaggctagtgttgggtaaaa

SEQ ID NO: 79647 - DNA, 25 bp, Mus musculus
aatgacagggccacttaaaatcaca

SEQ ID NO: 79648 - DNA, 25 bp, Mus musculus
aatgacagggcccagtgacagtaat

SEQ ID NO: 79649 - DNA, 25 bp, Mus musculus
aatgacagggccgagtgacagtaat

SEQ ID NO: 79650 - DNA, 25 bp, Mus musculus
aatgacagggcctcttaaaatcaca

SEQ ID NO: 79651 - DNA, 25 bp, Mus musculus
aatgacaggtttcctgctgttccgg

SEQ ID NO: 79652 - DNA, 25 bp, Mus musculus
aatgacaggtttgctgctgttccgg

SEQ ID NO: 79653 - DNA, 25 bp, Mus musculus
aatgacagtatgctttccttctccg

SEQ ID NO: 79654 - DNA, 25 bp, Mus musculus
aatgacagtatggtttccttctccg

SEQ ID NO: 79655 - DNA, 25 bp, Mus musculus
aatgacagtgatcccttccaggtca

SEQ ID NO: 79656 - DNA, 25 bp, Mus musculus
aatgacagtgatgccttccaggtca

SEQ ID NO: 79657 - DNA, 25 bp, Mus musculus
aatgacataatcacacaacctcctc

SEQ ID NO: 79658 - DNA, 25 bp, Mus musculus
aatgacataatctcacaacctcctc

SEQ ID NO: 79659 - DNA, 25 bp, Mus musculus
aatgacatacaccaggcggtcagag

SEQ ID NO: 79660 - DNA, 25 bp, Mus musculus
aatgacatacacgaggcggtcagag

SEQ ID NO: 79661 - DNA, 25 bp, Mus musculus
aatgacatacccagactgtgcagta

SEQ ID NO: 79662 - DNA, 25 bp, Mus musculus
aatgacataccctgactgtgcagta
